United States Patent 8,461,315 (MICRORNAS AND USES THEREOF) - sequence listing, part 2

SEQ ID NO: 28478 - RNA, 64 nt, Homo Sapiens
gcuggauaauauucucuguaagccauauucuuuaaaaaaaaaaacucaaaaucaauuuauuaag

SEQ ID NO: 28479 - RNA, 64 nt, Homo Sapiens
agcuggauaauauucucugugagccauauucuuuaaaaaaaaaaacucaaaaucaauuuauuaa

SEQ ID NO: 28480 - RNA, 64 nt, Homo Sapiens
gauguagaguguuuuuuuuacauguauuuaaagaaaaaaaaauaaagcagcuauacguggcaua

SEQ ID NO: 28481 - RNA, 64 nt, Homo Sapiens
agauguagaguguuuuuuuuacauguauuuaaagaaaaaaaaaugaagcagcuauacguggcau

SEQ ID NO: 28482 - RNA, 64 nt, Homo Sapiens
caccuucaguuuccugguguuuuuuuuaagguaaaaaaaaaauaguuuguuugguuuuuuuuuu

SEQ ID NO: 28483 - RNA, 64 nt, Homo Sapiens
acaccuucaguuuccugguguuuuuuuuaagguaaaaaaaaaaugguuuguuugguuuuuuuuu

SEQ ID NO: 28484 - RNA, 64 nt, Homo Sapiens
uacaccuucaguuuccugguuuuuuuuuuaagguaaaaaaaaaaugguuuguuugguuuuuuuu

SEQ ID NO: 28485 - RNA, 64 nt, Homo Sapiens
cacaauauuccaaguacaacggagauuagacaaaaaaaaaaauccuguuggcaaaacaauaggg

SEQ ID NO: 28486 - RNA, 64 nt, Homo Sapiens
ccacaauauuccaaguacaagggagauuagacaaaaaaaaaaauacuguuggcaaaacaauagg

SEQ ID NO: 28487 - RNA, 64 nt, Homo Sapiens
uccacaauauuccaaguacaggggagauuagacaaaaaaaaaaauacuguuggcaaaacaauag

SEQ ID NO: 28488 - RNA, 64 nt, Homo Sapiens
auccacaauauuccaaguacgggggagauuagacaaaaaaaaaauuacuguuggcaaaacaaua

SEQ ID NO: 28489 - RNA, 64 nt, Homo Sapiens
caacuccauagccuugcaaaaaugguauaaauggaaaaaaaauaaagucuuacuuuuaacaaga

SEQ ID NO: 28490 - RNA, 64 nt, Homo Sapiens
cuuacuuuuaacaagaaaugaugcauaugcaaccaaaaaaaaguccuacauuuagagucuguag

SEQ ID NO: 28491 - RNA, 51 nt, Homo Sapiens
cuuauuuucuagaaaacguuaaaaaaaaagauuuuaguacacuuaguuuaa

SEQ ID NO: 28492 - RNA, 50 nt, Homo Sapiens
acuuauuuucuagaaaacguaaaaaaaaaguuuuaguacacuuaguuuaa

SEQ ID NO: 28493 - RNA, 64 nt, Homo Sapiens
auauauacauaucuuuugaagugauguuacuuguaaaaaaaaguaugugaagaugugaucauuu

SEQ ID NO: 28494 - RNA, 64 nt, Homo Sapiens
caauaaaguaaaaaccgcaguuucugaaggcuuuaaaaaaaauaagaaacucuuagguggaaug

SEQ ID NO: 28495 - RNA, 64 nt, Homo Sapiens
ccaugcacucucucucuguuuuucuccugugggaaaaaaaaauucccauuuuagaaaaucagau

SEQ ID NO: 28496 - RNA, 64 nt, Homo Sapiens
uccaugcacucucucucuguuuuucuccugugggaaaaaaaaauucccauuuuagaaaaucaga

SEQ ID NO: 28497 - RNA, 64 nt, Homo Sapiens
uuuaaugguuaauaggaugaaaugagacacauacaaaaaaaaucagguauaaggaucuuuugua

SEQ ID NO: 28498 - RNA, 64 nt, Homo Sapiens
caaggacaucuaacuuuuucuagcaaccacuaaaaaaaaaaauuaaaugaaacaugaaaugcag

SEQ ID NO: 28499 - RNA, 64 nt, Homo Sapiens
ucaaggacaucuaacuuuuuguagcaaccacuaaaaaaaaaaauaaaaugaaacaugaaaugca

SEQ ID NO: 28500 - RNA, 64 nt, Homo Sapiens
uucaaggacaucuaacuuuuaguagcaaccacuaaaaaaaaaaaaaaaaugaaacaugaaaugc

SEQ ID NO: 28501 - RNA, 64 nt, Homo Sapiens
auucaaggacaucuaacuuucaguagcaaccacuaaaaaaaaaacaaaaaugaaacaugaaaug

SEQ ID NO: 28502 - RNA, 64 nt, Homo Sapiens
cuuuacuuggauauucauguuguguugaauuuaaaaaaaaaauacaauguauauuauguuccug

SEQ ID NO: 28503 - RNA, 64 nt, Homo Sapiens
acuuuacuuggauauucaugguguguugaauuuaaaaaaaaaauacaauguauauuauguuccu

SEQ ID NO: 28504 - RNA, 64 nt, Homo Sapiens
uacuuuacuuggauauucauuguguguugaauuuaaaaaaaaaaaacaauguauauuauguucc

SEQ ID NO: 28505 - RNA, 64 nt, Homo Sapiens
auguauauuauguuccuguguaaccuuuuuuuuaaaaaaaaacaagaugaaaucauuccuaaau

SEQ ID NO: 28506 - RNA, 64 nt, Homo Sapiens
aauguauauuauguuccuguuuaaccuuuuuuuuaaaaaaaaacaagaugaaaucauuccuaaa

SEQ ID NO: 28507 - RNA, 64 nt, Homo Sapiens
ggauauuugaagaaaagcaucgucucccccuccaaaaaaaaaguccuuugaggcaucugcuccc

SEQ ID NO: 28508 - RNA, 64 nt, Homo Sapiens
uggauauuugaagaaaagcaccgucucccccuccaaaaaaaaagcccuuugaggcaucugcucc

SEQ ID NO: 28509 - RNA, 64 nt, Homo Sapiens
gcuucuuaucuuuguuaacaaagaguagguuuaaaaaaaaaaguggugcaauuucuaaauuugu

SEQ ID NO: 28510 - RNA, 64 nt, Homo Sapiens
ugcuucuuaucuuuguuaacuaagaguagguuuaaaaaaaaaagaggugcaauuucuaaauuug

SEQ ID NO: 28511 - RNA, 64 nt, Homo Sapiens
gugcuucuuaucuuuguuaaguaagaguagguuuaaaaaaaaaaaaggugcaauuucuaaauuu

SEQ ID NO: 28512 - RNA, 64 nt, Homo Sapiens
uugcacuaauugagguacauaaaaaauagaaagaaaaaaaaaguccccauccuccacccccccc

SEQ ID NO: 28513 - RNA, 64 nt, Homo Sapiens
uuugcacuaauugagguacacaaaaaauagaaagaaaaaaaaagaccccauccuccaccccccc

SEQ ID NO: 28514 - RNA, 64 nt, Homo Sapiens
aaaagaaucuuaaaauaggagagacuccaucucaaaaaaaaauaccagccucggugacaagagc

SEQ ID NO: 28515 - RNA, 64 nt, Homo Sapiens
aaaaagaaucuuaaaauaggcgagacuccaucucaaaaaaaaauuccagccucggugacaagag

SEQ ID NO: 28516 - RNA, 64 nt, Homo Sapiens
gucuccaggaggcuguccaggaggcaaaaaaaaaaaaaaaaaguuuaaaaauggucaaauauuu

SEQ ID NO: 28517 - RNA, 64 nt, Homo Sapiens
ugucuccaggaggcuguccaugaggcaaaaaaaaaaaaaaaaaguuuaaaaauggucaaauauu

SEQ ID NO: 28518 - RNA, 64 nt, Homo Sapiens
gugucuccaggaggcuguccuugaggcaaaaaaaaaaaaaaaaaauuuaaaaauggucaaauau

SEQ ID NO: 28519 - RNA, 64 nt, Homo Sapiens
agugucuccaggaggcugucuuugaggcaaaaaaaaaaaaaaaauauuuaaaaauggucaaaua

SEQ ID NO: 28520 - RNA, 64 nt, Homo Sapiens
aagugucuccaggaggcuguauuugaggcaaaaaaaaaaaaaaaauauuuaaaaauggucaaau

SEQ ID NO: 28521 - RNA, 64 nt, Homo Sapiens
aaagugucuccaggaggcuguauuugaggcaaaaaaaaaaaaaagauauuuaaaaauggucaaa

SEQ ID NO: 28522 - RNA, 64 nt, Homo Sapiens
aaaagugucuccaggaggcuauauuugaggcaaaaaaaaaaaaaugauauuuaaaaauggucaa

SEQ ID NO: 28523 - RNA, 64 nt, Homo Sapiens
aaaaagugucuccaggaggcaauauuugaggcaaaaaaaaaaaaaugauauuuaaaaaugguca

SEQ ID NO: 28524 - RNA, 64 nt, Homo Sapiens
aaaaaagugucuccaggaggaaauauuugaggcaaaaaaaaaaacaugauauuuaaaaaugguc

SEQ ID NO: 28525 - RNA, 64 nt, Homo Sapiens
aaaaaaagugucuccaggagcaaauauuugaggcaaaaaaaaaaucaugauauuuaaaaauggu

SEQ ID NO: 28526 - RNA, 64 nt, Homo Sapiens
caucagcccaggucccagugccauuggcuucaagaaaaaaaaaaaaucucuccccaaugcucuc

SEQ ID NO: 28527 - RNA, 64 nt, Homo Sapiens
aucagcccaggucccagugccauuggcuucaagaaaaaaaaaaaaucucuccccaaugcucucc

SEQ ID NO: 28528 - RNA, 64 nt, Homo Sapiens
ucagcccaggucccagugccauuggcuucaagaaaaaaaaaaaaucucuccccaaugcucuccu

SEQ ID NO: 28529 - RNA, 64 nt, Homo Sapiens
cagcccaggucccagugccauuggcuucaagaaaaaaaaaaaaucucuccccaaugcucuccuu

SEQ ID NO: 28530 - RNA, 64 nt, Homo Sapiens
agcccaggucccagugccauuggcuucaagaaaaaaaaaaaaucucuccccaaugcucuccuua

SEQ ID NO: 28531 - RNA, 64 nt, Homo Sapiens
caccuguaguucuguuuauuggucaguggaaaugaaaaaaaaaaaaaaaaaaagucugcguuca

SEQ ID NO: 28532 - RNA, 64 nt, Homo Sapiens
accuguaguucuguuuauuggucaguggaaaugaaaaaaaaaaaaaaaaaaagucugcguucau

SEQ ID NO: 28533 - RNA, 64 nt, Homo Sapiens
ccuguaguucuguuuauuggucaguggaaaugaaaaaaaaaaaaaaaaaaagucugcguucauu

SEQ ID NO: 28534 - RNA, 64 nt, Homo Sapiens
cuguaguucuguuuauuggucaguggaaaugaaaaaaaaaaaaaaaaaaagucugcguucauug

SEQ ID NO: 28535 - RNA, 64 nt, Homo Sapiens
uguaguucuguuuauuggucaguggaaaugaaaaaaaaaaaaaaaaaaagucugcguucauugc

SEQ ID NO: 28536 - RNA, 64 nt, Homo Sapiens
guaguucuguuuauuggucaguggaaaugaaaaaaaaaaaaaaaaaaagucugcguucauugca

SEQ ID NO: 28537 - RNA, 64 nt, Homo Sapiens
uaguucuguuuauuggucaguggaaaugaaaaaaaaaaaaaaaaaaagucugcguucauugcag

SEQ ID NO: 28538 - RNA, 64 nt, Homo Sapiens
aguucuguuuauuggucaguggaaaugaaaaaaaaaaaaaaaaaaagucugcguucauugcagu

SEQ ID NO: 28539 - RNA, 64 nt, Homo Sapiens
guucuguuuauuggucaguggaaaugaaaaaaaaaaaaaaaaaaagucugcguucauugcaguu

SEQ ID NO: 28540 - RNA, 64 nt, Homo Sapiens
uucuguuuauuggucaguggaaaugaaaaaaaaaaaaaaaaaaagucugcguucauugcaguuc

SEQ ID NO: 28541 - RNA, 64 nt, Homo Sapiens
ucuguuuauuggucaguggaaaugaaaaaaaaaaaaaaaaaaagucugcguucauugcaguucc

SEQ ID NO: 28542 - RNA, 64 nt, Homo Sapiens
cuguuuauuggucaguggaaaugaaaaaaaaaaaaaaaaaaagucugcguucauugcaguucca

SEQ ID NO: 28543 - RNA, 64 nt, Homo Sapiens
cacagacaccaacacaccacucauuggaaaauggaaaaaaaaaacaaaaaaaaaacaaaaaaau

SEQ ID NO: 28544 - RNA, 64 nt, Homo Sapiens
acagacaccaacacaccacucauuggaaaauggaaaaaaaaaacaaaaaaaaaacaaaaaaaug

SEQ ID NO: 28545 - RNA, 64 nt, Homo Sapiens
cagacaccaacacaccacucauuggaaaauggaaaaaaaaaacaaaaaaaaaacaaaaaaaugu

SEQ ID NO: 28546 - RNA, 64 nt, Homo Sapiens
acacaccacucauuggaaaauggaaaaaaaaaacaaaaaaaaaacaaaaaaauguacaauggau

SEQ ID NO: 28547 - RNA, 64 nt, Homo Sapiens
cacaccacucauuggaaaauggaaaaaaaaaacaaaaaaaaaacaaaaaaauguacaauggaug

SEQ ID NO: 28548 - RNA, 64 nt, Homo Sapiens
acaccacucauuggaaaauggaaaaaaaaaacaaaaaaaaaacaaaaaaauguacaauggaugc

SEQ ID NO: 28549 - RNA, 64 nt, Homo Sapiens
uaaaaauaacuuagauucaaauuuauaguagaagaaaaaaaaucuuucagauaagagguguucu

SEQ ID NO: 28550 - RNA, 64 nt, Homo Sapiens
ucauugaaauaaaugacaagucauacugccacuuaaaaaaaaaaagaccuuugucaaggagagu

SEQ ID NO: 28551 - RNA, 64 nt, Homo Sapiens
cauugaaauaaaugacaagucauacugccacuuaaaaaaaaaaagaccuuugucaaggagagug

SEQ ID NO: 28552 - RNA, 64 nt, Homo Sapiens
auugaaauaaaugacaagucauacugccacuuaaaaaaaaaaagaccuuugucaaggagagugc

SEQ ID NO: 28553 - RNA, 64 nt, Homo Sapiens
uugaaauaaaugacaagucauacugccacuuaaaaaaaaaaagaccuuugucaaggagagugca

SEQ ID NO: 28554 - RNA, 64 nt, Homo Sapiens
gaaaagcaagucaaaaauauuuccuuuuugauguaaaaaaaaaaagcccuauuucgcacuaaca

SEQ ID NO: 28555 - RNA, 64 nt, Homo Sapiens
aaaagcaagucaaaaauauuuccuuuuugauguaaaaaaaaaaagcccuauuucgcacuaacau

SEQ ID NO: 28556 - RNA, 64 nt, Homo Sapiens
aaagcaagucaaaaauauuuccuuuuugauguaaaaaaaaaaagcccuauuucgcacuaacauu

SEQ ID NO: 28557 - RNA, 64 nt, Homo Sapiens
aagcaagucaaaaauauuuccuuuuugauguaaaaaaaaaaagcccuauuucgcacuaacauuu

SEQ ID NO: 28558 - RNA, 64 nt, Homo Sapiens
uaagauaacuagaauuggauuaugguguaaaaauaaaaaaaaaauuuauucacauaaguuucaa

SEQ ID NO: 28559 - RNA, 64 nt, Homo Sapiens
aagauaacuagaauuggauuaugguguaaaaauaaaaaaaaaauuuauucacauaaguuucaag

SEQ ID NO: 28560 - RNA, 64 nt, Homo Sapiens
agauaacuagaauuggauuaugguguaaaaauaaaaaaaaaauuuauucacauaaguuucaaga

SEQ ID NO: 28561 - RNA, 64 nt, Homo Sapiens
cuccagccugggcgacagagcgagacuccgucucaaaaaaaaaaaaaaaaaaaaaaagaaagua

SEQ ID NO: 28562 - RNA, 64 nt, Homo Sapiens
uccagccugggcgacagagcgagacuccgucucaaaaaaaaaaaaaaaaaaaaaaagaaaguaa

SEQ ID NO: 28563 - RNA, 64 nt, Homo Sapiens
ccagccugggcgacagagcgagacuccgucucaaaaaaaaaaaaaaaaaaaaaaagaaaguaau

SEQ ID NO: 28564 - RNA, 64 nt, Homo Sapiens
cagccugggcgacagagcgagacuccgucucaaaaaaaaaaaaaaaaaaaaaaagaaaguaauu

SEQ ID NO: 28565 - RNA, 64 nt, Homo Sapiens
agccugggcgacagagcgagacuccgucucaaaaaaaaaaaaaaaaaaaaaaagaaaguaauuu

SEQ ID NO: 28566 - RNA, 64 nt, Homo Sapiens
gccugggcgacagagcgagacuccgucucaaaaaaaaaaaaaaaaaaaaaaagaaaguaauuuu

SEQ ID NO: 28567 - RNA, 64 nt, Homo Sapiens
ccugggcgacagagcgagacuccgucucaaaaaaaaaaaaaaaaaaaaaaagaaaguaauuuua

SEQ ID NO: 28568 - RNA, 64 nt, Homo Sapiens
cugggcgacagagcgagacuccgucucaaaaaaaaaaaaaaaaaaaaaaagaaaguaauuuuaa

SEQ ID NO: 28569 - RNA, 64 nt, Homo Sapiens
ugggcgacagagcgagacuccgucucaaaaaaaaaaaaaaaaaaaaaaagaaaguaauuuuaaa

SEQ ID NO: 28570 - RNA, 64 nt, Homo Sapiens
gggcgacagagcgagacuccgucucaaaaaaaaaaaaaaaaaaaaaaagaaaguaauuuuaaac

SEQ ID NO: 28571 - RNA, 64 nt, Homo Sapiens
ggcgacagagcgagacuccgucucaaaaaaaaaaaaaaaaaaaaaaagaaaguaauuuuaaacu

SEQ ID NO: 28572 - RNA, 64 nt, Homo Sapiens
gcgacagagcgagacuccgucucaaaaaaaaaaaaaaaaaaaaaaagaaaguaauuuuaaacuc

SEQ ID NO: 28573 - RNA, 64 nt, Homo Sapiens
cgacagagcgagacuccgucucaaaaaaaaaaaaaaaaaaaaaaagaaaguaauuuuaaacuca

SEQ ID NO: 28574 - RNA, 64 nt, Homo Sapiens
gacagagcgagacuccgucucaaaaaaaaaaaaaaaaaaaaaaagaaaguaauuuuaaacucac

SEQ ID NO: 28575 - RNA, 64 nt, Homo Sapiens
acagagcgagacuccgucucaaaaaaaaaaaaaaaaaaaaaaagaaaguaauuuuaaacucacu

SEQ ID NO: 28576 - RNA, 64 nt, Homo Sapiens
cagagcgagacuccgucucaaaaaaaaaaaaaaaaaaaaaaagaaaguaauuuuaaacucacug

SEQ ID NO: 28577 - RNA, 64 nt, Homo Sapiens
caagguuuaaggugacccaaugauucagcuauuuaaaaaaaaaagaggaaagaaugaaagagua

SEQ ID NO: 28578 - RNA, 64 nt, Homo Sapiens
aagguuuaaggugacccaaugauucagcuauuuaaaaaaaaaagaggaaagaaugaaagaguaa

SEQ ID NO: 28579 - RNA, 64 nt, Homo Sapiens
agguuuaaggugacccaaugauucagcuauuuaaaaaaaaaagaggaaagaaugaaagaguaaa

SEQ ID NO: 28580 - RNA, 64 nt, Homo Sapiens
aaggcagaaaaacuugaaauaccaacauucuggcaaaaaaaaaucaguuuuaugaagaguaagu

SEQ ID NO: 28581 - RNA, 64 nt, Homo Sapiens
aggcagaaaaacuugaaauaccaacauucuggcaaaaaaaaaucaguuuuaugaagaguaagug

SEQ ID NO: 28582 - RNA, 64 nt, Homo Sapiens
uauuauaguuuaacaaaaauuguuuauaucuuggaaaaaaaacuuucuguuuaaaaaaaauaaa

SEQ ID NO: 28583 - RNA, 64 nt, Homo Sapiens
auuguuuauaucuuggaaaaaaaacuuucuguuuaaaaaaaauaaacaagugaauguuggaaau

SEQ ID NO: 28584 - RNA, 64 nt, Homo Sapiens
gcagaaucuccuggauauauaauuuauucuguugaaaaaaaaaaaagcaugcaguaucuaugac

SEQ ID NO: 28585 - RNA, 64 nt, Homo Sapiens
cagaaucuccuggauauauaauuuauucuguugaaaaaaaaaaaagcaugcaguaucuaugacc

SEQ ID NO: 28586 - RNA, 64 nt, Homo Sapiens
agaaucuccuggauauauaauuuauucuguugaaaaaaaaaaaagcaugcaguaucuaugaccu

SEQ ID NO: 28587 - RNA, 64 nt, Homo Sapiens
gaaucuccuggauauauaauuuauucuguugaaaaaaaaaaaagcaugcaguaucuaugaccua

SEQ ID NO: 28588 - RNA, 64 nt, Homo Sapiens
aaucuccuggauauauaauuuauucuguugaaaaaaaaaaaagcaugcaguaucuaugaccuau

SEQ ID NO: 28589 - RNA, 64 nt, Homo Sapiens
gaaaaccuuucuucaccaaaucuugguugaugccaaaaaaaaauacaugcuaagagaaguagaa

SEQ ID NO: 28590 - RNA, 64 nt, Homo Sapiens
aaaaccuuucuucaccaaaucuugguugaugccaaaaaaaaauacaugcuaagagaaguagaaa

SEQ ID NO: 28591 - RNA, 64 nt, Homo Sapiens
caguauaugcuauucaaugaucuuagaaguacugaaaaaaaaagacguuuuuaaaacguagagg

SEQ ID NO: 28592 - RNA, 64 nt, Homo Sapiens
aguauaugcuauucaaugaucuuagaaguacugaaaaaaaaagacguuuuuaaaacguagagga

SEQ ID NO: 28593 - RNA, 64 nt, Homo Sapiens
augacuguuuucucucucuauggaaauaaaaaggaaaaaaaaaaaggaaacuuuuuuuguuugc

SEQ ID NO: 28594 - RNA, 64 nt, Homo Sapiens
ugacuguuuucucucucuauggaaauaaaaaggaaaaaaaaaaaggaaacuuuuuuuguuugcu

SEQ ID NO: 28595 - RNA, 64 nt, Homo Sapiens
gacuguuuucucucucuauggaaauaaaaaggaaaaaaaaaaaggaaacuuuuuuuguuugcuc

SEQ ID NO: 28596 - RNA, 64 nt, Homo Sapiens
acuguuuucucucucuauggaaauaaaaaggaaaaaaaaaaaggaaacuuuuuuuguuugcucu

SEQ ID NO: 28597 - RNA, 64 nt, Homo Sapiens
ucaugucauuugacauuuuuuguuugcugaagugaaaaaaaaagauaaagguuguacggugguc

SEQ ID NO: 28598 - RNA, 64 nt, Homo Sapiens
caugucauuugacauuuuuuguuugcugaagugaaaaaaaaagauaaagguuguacgguggucu

SEQ ID NO: 28599 - RNA, 64 nt, Homo Sapiens
uagcuccuguccuuguauucucacuccuacacuuaaaaaaaaaauccuuacugacuaguuaugu

SEQ ID NO: 28600 - RNA, 64 nt, Homo Sapiens
agcuccuguccuuguauucucacuccuacacuuaaaaaaaaaauccuuacugacuaguuaugug

SEQ ID NO: 28601 - RNA, 64 nt, Homo Sapiens
gcuccuguccuuguauucucacuccuacacuuaaaaaaaaaauccuuacugacuaguuauguga

SEQ ID NO: 28602 - RNA, 64 nt, Homo Sapiens
gucagcaagaaggccugccucaucuuaacaaagcaaaaaaaaaugcuuuaauucaaauuaaaaa

SEQ ID NO: 28603 - RNA, 64 nt, Homo Sapiens
ucagcaagaaggccugccucaucuuaacaaagcaaaaaaaaaugcuuuaauucaaauuaaaaau

SEQ ID NO: 28604 - RNA, 64 nt, Homo Sapiens
ucgaacaugcaguacauaaaaaggggaaaaggagaaaaaaaaagccuuacuuuguuuuacuugc

SEQ ID NO: 28605 - RNA, 64 nt, Homo Sapiens
cgaacaugcaguacauaaaaaggggaaaaggagaaaaaaaaagccuuacuuuguuuuacuugcc

SEQ ID NO: 28606 - RNA, 64 nt, Homo Sapiens
auaaaauucacuuauuguauguguguuguaaucuaaaaaaaaaaagaaugacaaacagcuucuu

SEQ ID NO: 28607 - RNA, 64 nt, Homo Sapiens
uaaaauucacuuauuguauguguguuguaaucuaaaaaaaaaaagaaugacaaacagcuucuuu

SEQ ID NO: 28608 - RNA, 64 nt, Homo Sapiens
aaaauucacuuauuguauguguguuguaaucuaaaaaaaaaaagaaugacaaacagcuucuuua

SEQ ID NO: 28609 - RNA, 64 nt, Homo Sapiens
aaauucacuuauuguauguguguuguaaucuaaaaaaaaaaagaaugacaaacagcuucuuuaa

SEQ ID NO: 28610 - RNA, 64 nt, Homo Sapiens
uccuuuuuuaaaaguaaauguacaggaugccaguaaaaaaaaaaaauggcuucagaauuaaaac

SEQ ID NO: 28611 - RNA, 64 nt, Homo Sapiens
ccuuuuuuaaaaguaaauguacaggaugccaguaaaaaaaaaaaauggcuucagaauuaaaacu

SEQ ID NO: 28612 - RNA, 64 nt, Homo Sapiens
cuuuuuuaaaaguaaauguacaggaugccaguaaaaaaaaaaaauggcuucagaauuaaaacua

SEQ ID NO: 28613 - RNA, 64 nt, Homo Sapiens
uuuuuuaaaaguaaauguacaggaugccaguaaaaaaaaaaaauggcuucagaauuaaaacuau

SEQ ID NO: 28614 - RNA, 64 nt, Homo Sapiens
uuuuuaaaaguaaauguacaggaugccaguaaaaaaaaaaaauggcuucagaauuaaaacuaug

SEQ ID NO: 28615 - RNA, 64 nt, Homo Sapiens
gugccugauaagcuucaaagcugcuuuauucaauaaaaaaaagaaaugaaaaagauauaugaau

SEQ ID NO: 28616 - RNA, 64 nt, Homo Sapiens
cuauccaucaugaccagcaaauacucauuuuaggaaaaaaaaaagcaugaucugaaaaauacuu

SEQ ID NO: 28617 - RNA, 64 nt, Homo Sapiens
uauccaucaugaccagcaaauacucauuuuaggaaaaaaaaaagcaugaucugaaaaauacuuu

SEQ ID NO: 28618 - RNA, 64 nt, Homo Sapiens
auccaucaugaccagcaaauacucauuuuaggaaaaaaaaaagcaugaucugaaaaauacuuuu

SEQ ID NO: 28619 - RNA, 64 nt, Homo Sapiens
gcacauauauauauguauuuaaaaaaaucaaaacaaaaaaaaacucauuuauaccuguguauuu

SEQ ID NO: 28620 - RNA, 64 nt, Homo Sapiens
cacauauauauauguauuuaaaaaaaucaaaacaaaaaaaaacucauuuauaccuguguauuuu

SEQ ID NO: 28621 - RNA, 64 nt, Homo Sapiens; identical to SEQ ID NO: 28549

SEQ ID NO: 28622 - RNA, 64 nt, Homo Sapiens
ucauugaaauaaaugacaagucauacugucacuuaaaaaaaaaaaaaagaccuuugucaaggag

SEQ ID NO: 28623 - RNA, 64 nt, Homo Sapiens
cauugaaauaaaugacaagucauacugucacuuaaaaaaaaaaaaaagaccuuugucaaggaga

SEQ ID NO: 28624 - RNA, 64 nt, Homo Sapiens
auugaaauaaaugacaagucauacugucacuuaaaaaaaaaaaaaagaccuuugucaaggagag

SEQ ID NO: 28625 - RNA, 64 nt, Homo Sapiens
uugaaauaaaugacaagucauacugucacuuaaaaaaaaaaaaaagaccuuugucaaggagagu

SEQ ID NO: 28626 - RNA, 64 nt, Homo Sapiens
ugaaauaaaugacaagucauacugucacuuaaaaaaaaaaaaaagaccuuugucaaggagagug

SEQ ID NO: 28627 - RNA, 64 nt, Homo Sapiens
gaaauaaaugacaagucauacugucacuuaaaaaaaaaaaaaagaccuuugucaaggagagugc

SEQ ID NO: 28628 - RNA, 64 nt, Homo Sapiens
aaauaaaugacaagucauacugucacuuaaaaaaaaaaaaaagaccuuugucaaggagagugca

SEQ ID NO: 28629 - RNA, 64 nt, Homo Sapiens
auaauaagggauagcaagguguuuuccuccauuuaaaaaaaaaaagguauaauuuacauacaau

SEQ ID NO: 28630 - RNA, 64 nt, Homo Sapiens
uaauaagggauagcaagguguuuuccuccauuuaaaaaaaaaaagguauaauuuacauacaaua

SEQ ID NO: 28631 - RNA, 64 nt, Homo Sapiens
aauaagggauagcaagguguuuuccuccauuuaaaaaaaaaaagguauaauuuacauacaauaa

SEQ ID NO: 28632 - RNA, 64 nt, Homo Sapiens
auaagggauagcaagguguuuuccuccauuuaaaaaaaaaaagguauaauuuacauacaauaaa

SEQ ID NO: 28633 - RNA, 64 nt, Homo Sapiens
caacauggugagacccugucucuacuaaaacgauaaaaaaaaaaaaaaaauuagccaggcuugg

SEQ ID NO: 28634 - RNA, 64 nt, Homo Sapiens
aacauggugagacccugucucuacuaaaacgauaaaaaaaaaaaaaaaauuagccaggcuuggu

SEQ ID NO: 28635 - RNA, 64 nt, Homo Sapiens
acauggugagacccugucucuacuaaaacgauaaaaaaaaaaaaaaaauuagccaggcuuggug

SEQ ID NO: 28636 - RNA, 64 nt, Homo Sapiens
cauggugagacccugucucuacuaaaacgauaaaaaaaaaaaaaaaauuagccaggcuuggugg

SEQ ID NO: 28637 - RNA, 64 nt, Homo Sapiens
auggugagacccugucucuacuaaaacgauaaaaaaaaaaaaaaaauuagccaggcuugguggc

SEQ ID NO: 28638 - RNA, 64 nt, Homo Sapiens
uggugagacccugucucuacuaaaacgauaaaaaaaaaaaaaaaauuagccaggcuugguggca

SEQ ID NO: 28639 - RNA, 64 nt, Homo Sapiens
ggugagacccugucucuacuaaaacgauaaaaaaaaaaaaaaaauuagccaggcuugguggcac

SEQ ID NO: 28640 - RNA, 64 nt, Homo Sapiens
gugagacccugucucuacuaaaacgauaaaaaaaaaaaaaaaauuagccaggcuugguggcaca

SEQ ID NO: 28641 - RNA, 64 nt, Homo Sapiens
ugagacccugucucuacuaaaacgauaaaaaaaaaaaaaaaauuagccaggcuugguggcacac

SEQ ID NO: 28642 - RNA, 64 nt, Homo Sapiens
ucauaaggagcuuaucugaacagauuuaucuaagaaaaaaaaaaaacgacauaaaauaagugaa

SEQ ID NO: 28643 - RNA, 64 nt, Homo Sapiens
cauaaggagcuuaucugaacagauuuaucuaagaaaaaaaaaaaacgacauaaaauaagugaaa

SEQ ID NO: 28644 - RNA, 64 nt, Homo Sapiens
auaaggagcuuaucugaacagauuuaucuaagaaaaaaaaaaaacgacauaaaauaagugaaac

SEQ ID NO: 28645 - RNA, 64 nt, Homo Sapiens
uaaggagcuuaucugaacagauuuaucuaagaaaaaaaaaaaacgacauaaaauaagugaaaca

SEQ ID NO: 28646 - RNA, 64 nt, Homo Sapiens
aaggagcuuaucugaacagauuuaucuaagaaaaaaaaaaaacgacauaaaauaagugaaacaa

SEQ ID NO: 28647 - RNA, 64 nt, Homo Sapiens
agacagacugaauauaucuaaaauuuccagcaauaaaaaaaaaagcauuuaacuugcaccaagc

SEQ ID NO: 28648 - RNA, 64 nt, Homo Sapiens
gacagacugaauauaucuaaaauuuccagcaauaaaaaaaaaagcauuuaacuugcaccaagca

SEQ ID NO: 28649 - RNA, 64 nt, Homo Sapiens
acagacugaauauaucuaaaauuuccagcaauaaaaaaaaaagcauuuaacuugcaccaagcaa

SEQ ID NO: 28650 - RNA, 64 nt, Homo Sapiens
agccugggugacagagccagacacugucucggggaaaaaaaaaaaaaaaaaaagacacaucacu

SEQ ID NO: 28651 - RNA, 64 nt, Homo Sapiens
gccugggugacagagccagacacugucucggggaaaaaaaaaaaaaaaaaaagacacaucacua

SEQ ID NO: 28652 - RNA, 64 nt, Homo Sapiens
ccugggugacagagccagacacugucucggggaaaaaaaaaaaaaaaaaaagacacaucacuau

SEQ ID NO: 28653 - RNA, 64 nt, Homo Sapiens
cugggugacagagccagacacugucucggggaaaaaaaaaaaaaaaaaaagacacaucacuaua

SEQ ID NO: 28654 - RNA, 64 nt, Homo Sapiens
ugggugacagagccagacacugucucggggaaaaaaaaaaaaaaaaaaagacacaucacuauaa

SEQ ID NO: 28655 - RNA, 64 nt, Homo Sapiens
gggugacagagccagacacugucucggggaaaaaaaaaaaaaaaaaaagacacaucacuauaaa

SEQ ID NO: 28656 - RNA, 64 nt, Homo Sapiens
ggugacagagccagacacugucucggggaaaaaaaaaaaaaaaaaaagacacaucacuauaaau

SEQ ID NO: 28657 - RNA, 64 nt, Homo Sapiens
gugacagagccagacacugucucggggaaaaaaaaaaaaaaaaaaagacacaucacuauaaaua

SEQ ID NO: 28658 - RNA, 64 nt, Homo Sapiens
ugacagagccagacacugucucggggaaaaaaaaaaaaaaaaaaagacacaucacuauaaauag

SEQ ID NO: 28659 - RNA, 64 nt, Homo Sapiens
gacagagccagacacugucucggggaaaaaaaaaaaaaaaaaaagacacaucacuauaaauagc

SEQ ID NO: 28660 - RNA, 64 nt, Homo Sapiens
acagagccagacacugucucggggaaaaaaaaaaaaaaaaaaagacacaucacuauaaauagca

SEQ ID NO: 28661 - RNA, 64 nt, Homo Sapiens
cagagccagacacugucucggggaaaaaaaaaaaaaaaaaaagacacaucacuauaaauagcaa

SEQ ID NO: 28662 - RNA, 64 nt, Homo Sapiens
uuuagaccccucucaguuaagaaaugcuuagauuaaaaaaaaaaaauuacguaggauuaauaca

SEQ ID NO: 28663 - RNA, 64 nt, Homo Sapiens
uuagaccccucucaguuaagaaaugcuuagauuaaaaaaaaaaaauuacguaggauuaauacag

SEQ ID NO: 28664 - RNA, 64 nt, Homo Sapiens
uagaccccucucaguuaagaaaugcuuagauuaaaaaaaaaaaauuacguaggauuaauacaga

SEQ ID NO: 28665 - RNA, 64 nt, Homo Sapiens
agaccccucucaguuaagaaaugcuuagauuaaaaaaaaaaaauuacguaggauuaauacagaa

SEQ ID NO: 28666 - RNA, 64 nt, Homo Sapiens
gaccccucucaguuaagaaaugcuuagauuaaaaaaaaaaaauuacguaggauuaauacagaaa

SEQ ID NO: 28667 - RNA, 64 nt, Homo Sapiens
aguucucaauugaugacaguguuugaaucaucauaaaaaaaauaccugcuuuucaucuggacaa

SEQ ID NO: 28668 - RNA, 64 nt, Homo Sapiens
uuccagccugggugacugagcgagacucugucucaaaaaaaaaaaaaaaaaaaaaaagaaaaag

SEQ ID NO: 28669 - RNA, 64 nt, Homo Sapiens
uccagccugggugacugagcgagacucugucucaaaaaaaaaaaaaaaaaaaaaaagaaaaaga

SEQ ID NO: 28670 - RNA, 64 nt, Homo Sapiens
ccagccugggugacugagcgagacucugucucaaaaaaaaaaaaaaaaaaaaaaagaaaaagaa

SEQ ID NO: 28671 - RNA, 64 nt, Homo Sapiens
cagccugggugacugagcgagacucugucucaaaaaaaaaaaaaaaaaaaaaaagaaaaagaaa

SEQ ID NO: 28672 - RNA, 64 nt, Homo Sapiens
agccugggugacugagcgagacucugucucaaaaaaaaaaaaaaaaaaaaaaagaaaaagaaaa

SEQ ID NO: 28673 - RNA, 64 nt, Homo Sapiens
gccugggugacugagcgagacucugucucaaaaaaaaaaaaaaaaaaaaaaagaaaaagaaaaa

SEQ ID NO: 28674 - RNA, 64 nt, Homo Sapiens
ccugggugacugagcgagacucugucucaaaaaaaaaaaaaaaaaaaaaaagaaaaagaaaaag

SEQ ID NO: 28675 - RNA, 64 nt, Homo Sapiens
cugggugacugagcgagacucugucucaaaaaaaaaaaaaaaaaaaaaaagaaaaagaaaaaga

SEQ ID NO: 28676 - RNA, 64 nt, Homo Sapiens
ugggugacugagcgagacucugucucaaaaaaaaaaaaaaaaaaaaaaagaaaaagaaaaagaa

SEQ ID NO: 28677 - RNA, 64 nt, Homo Sapiens
gggugacugagcgagacucugucucaaaaaaaaaaaaaaaaaaaaaaagaaaaagaaaaagaaa

SEQ ID NO: 28678 - RNA, 64 nt, Homo Sapiens
ggugacugagcgagacucugucucaaaaaaaaaaaaaaaaaaaaaaagaaaaagaaaaagaaaa

SEQ ID NO: 28679 - RNA, 64 nt, Homo Sapiens
gugacugagcgagacucugucucaaaaaaaaaaaaaaaaaaaaaaagaaaaagaaaaagaaaag

SEQ ID NO: 28680 - RNA, 64 nt, Homo Sapiens
ugacugagcgagacucugucucaaaaaaaaaaaaaaaaaaaaaaagaaaaagaaaaagaaaaga

SEQ ID NO: 28681 - RNA, 64 nt, Homo Sapiens
gacugagcgagacucugucucaaaaaaaaaaaaaaaaaaaaaaagaaaaagaaaaagaaaagaa

SEQ ID NO: 28682 - RNA, 64 nt, Homo Sapiens
acugagcgagacucugucucaaaaaaaaaaaaaaaaaaaaaaagaaaaagaaaaagaaaagaaa

SEQ ID NO: 28683 - RNA, 64 nt, Homo Sapiens
cugagcgagacucugucucaaaaaaaaaaaaaaaaaaaaaaagaaaaagaaaaagaaaagaaaa

SEQ ID NO: 28684 - RNA, 64 nt, Homo Sapiens
gguuuuuucuuuuuucuuuuaccaguacaguaagaaaaaaaaaaaaaaaaaaaaagccaugcua

SEQ ID NO: 28685 - RNA, 64 nt, Homo Sapiens
guuuuuucuuuuuucuuuuaccaguacaguaagaaaaaaaaaaaaaaaaaaaaagccaugcuau

SEQ ID NO: 28686 - RNA, 64 nt, Homo Sapiens
uuuuuucuuuuuucuuuuaccaguacaguaagaaaaaaaaaaaaaaaaaaaaagccaugcuauc

SEQ ID NO: 28687 - RNA, 64 nt, Homo Sapiens
uuuuucuuuuuucuuuuaccaguacaguaagaaaaaaaaaaaaaaaaaaaaagccaugcuauca

SEQ ID NO: 28688 - RNA, 64 nt, Homo Sapiens
uuuucuuuuuucuuuuaccaguacaguaagaaaaaaaaaaaaaaaaaaaaagccaugcuaucaa

SEQ ID NO: 28689 - RNA, 64 nt, Homo Sapiens
uuucuuuuuucuuuuaccaguacaguaagaaaaaaaaaaaaaaaaaaaaagccaugcuaucaau

SEQ ID NO: 28690 - RNA, 64 nt, Homo Sapiens
uucuuuuuucuuuuaccaguacaguaagaaaaaaaaaaaaaaaaaaaaagccaugcuaucaauc

SEQ ID NO: 28691 - RNA, 64 nt, Homo Sapiens
ucuuuuuucuuuuaccaguacaguaagaaaaaaaaaaaaaaaaaaaaagccaugcuaucaauca

SEQ ID NO: 28692 - RNA, 64 nt, Homo Sapiens
cuuuuuucuuuuaccaguacaguaagaaaaaaaaaaaaaaaaaaaaagccaugcuaucaaucaa

SEQ ID NO: 28693 - RNA, 64 nt, Homo Sapiens
uuuuuucuuuuaccaguacaguaagaaaaaaaaaaaaaaaaaaaaagccaugcuaucaaucaag

SEQ ID NO: 28694 - RNA, 64 nt, Homo Sapiens
uuuuucuuuuaccaguacaguaagaaaaaaaaaaaaaaaaaaaaagccaugcuaucaaucaaga

SEQ ID NO: 28695 - RNA, 64 nt, Homo Sapiens
uuuucuuuuaccaguacaguaagaaaaaaaaaaaaaaaaaaaaagccaugcuaucaaucaagau

SEQ ID NO: 28696 - RNA, 64 nt, Homo Sapiens
uuucuuuuaccaguacaguaagaaaaaaaaaaaaaaaaaaaaagccaugcuaucaaucaagauu

SEQ ID NO: 28697 - RNA, 64 nt, Homo Sapiens
uucuuuuaccaguacaguaagaaaaaaaaaaaaaaaaaaaaagccaugcuaucaaucaagauuc

SEQ ID NO: 28698 - RNA, 64 nt, Homo Sapiens
gagaugcuuauagaugauaguuguacauaugugcaaaaaaaaauccacuugcaaugguaagaaa

SEQ ID NO: 28699 - RNA, 64 nt, Homo Sapiens
agaugcuuauagaugauaguuguacauaugugcaaaaaaaaauccacuugcaaugguaagaaau

SEQ ID NO: 28700 - RNA, 64 nt, Homo Sapiens
uaaacuuacaucagggaaaaauugguauuuaugcaaaaaaaaauguuuuuguccuugugagucc

SEQ ID NO: 28701 - RNA, 64 nt, Homo Sapiens
aaacuuacaucagggaaaaauugguauuuaugcaaaaaaaaauguuuuuguccuugugagucca

SEQ ID NO: 28702 - RNA, 64 nt, Homo Sapiens
aauaguucacaauguucuaaauuuggaaggacuuaaaaaaaaaacuuguuuaaauuuccaucug

SEQ ID NO: 28703 - RNA, 64 nt, Homo Sapiens
auaguucacaauguucuaaauuuggaaggacuuaaaaaaaaaacuuguuuaaauuuccaucugu

SEQ ID NO: 28704 - RNA, 64 nt, Homo Sapiens
uaguucacaauguucuaaauuuggaaggacuuaaaaaaaaaacuuguuuaaauuuccaucuguu

SEQ ID NO: 28705 - RNA, 64 nt, Homo Sapiens
ucaggauuuaagucugagguagucaacccucaggaaaaaaaaaauggcuuaucugaaaucagua

SEQ ID NO: 28706 - RNA, 64 nt, Homo Sapiens
caggauuuaagucugagguagucaacccucaggaaaaaaaaaauggcuuaucugaaaucaguac

SEQ ID NO: 28707 - RNA, 64 nt, Homo Sapiens
aggauuuaagucugagguagucaacccucaggaaaaaaaaaauggcuuaucugaaaucaguacu

SEQ ID NO: 28708 - RNA, 64 nt, Homo Sapiens
ugauuagugccucuuucugcaaacuuuuccaucuaaaaaaaaaaauguuuuuuuuaagacagga

SEQ ID NO: 28709 - RNA, 64 nt, Homo Sapiens
gauuagugccucuuucugcaaacuuuuccaucuaaaaaaaaaaauguuuuuuuuaagacaggau

SEQ ID NO: 28710 - RNA, 64 nt, Homo Sapiens
auuagugccucuuucugcaaacuuuuccaucuaaaaaaaaaaauguuuuuuuuaagacaggauc

SEQ ID NO: 28711 - RNA, 64 nt, Homo Sapiens
uuagugccucuuucugcaaacuuuuccaucuaaaaaaaaaaauguuuuuuuuaagacaggaucu

SEQ ID NO: 28712 - RNA, 64 nt, Homo Sapiens
aaguuguugguguuuguuuaggggccauuuuguuaaaaaaaaaaagcacauaacuuuuaacacu

SEQ ID NO: 28713 - RNA, 64 nt, Homo Sapiens
aguuguugguguuuguuuaggggccauuuuguuaaaaaaaaaaagcacauaacuuuuaacacua

SEQ ID NO: 28714 - RNA, 64 nt, Homo Sapiens
guuguugguguuuguuuaggggccauuuuguuaaaaaaaaaaagcacauaacuuuuaacacuag

SEQ ID NO: 28715 - RNA, 64 nt, Homo Sapiens
uuguugguguuuguuuaggggccauuuuguuaaaaaaaaaaagcacauaacuuuuaacacuaga

SEQ ID NO: 28716 - RNA, 64 nt, Homo Sapiens
cagaauauuaagaaaaugaaguaacugauuuucuaaaaaaaaaaaaaaaaaaaauuucuacauu

SEQ ID NO: 28717 - RNA, 64 nt, Homo Sapiens
agaauauuaagaaaaugaaguaacugauuuucuaaaaaaaaaaaaaaaaaaaauuucuacauua

SEQ ID NO: 28718 - RNA, 64 nt, Homo Sapiens
gaauauuaagaaaaugaaguaacugauuuucuaaaaaaaaaaaaaaaaaaaauuucuacauuau

SEQ ID NO: 28719 - RNA, 64 nt, Homo Sapiens
aauauuaagaaaaugaaguaacugauuuucuaaaaaaaaaaaaaaaaaaaauuucuacauuaua

SEQ ID NO: 28720 - RNA, 64 nt, Homo Sapiens
auauuaagaaaaugaaguaacugauuuucuaaaaaaaaaaaaaaaaaaaauuucuacauuauaa

SEQ ID NO: 28721 - RNA, 64 nt, Homo Sapiens
uauuaagaaaaugaaguaacugauuuucuaaaaaaaaaaaaaaaaaaaauuucuacauuauaac

SEQ ID NO: 28722 - RNA, 64 nt, Homo Sapiens
auuaagaaaaugaaguaacugauuuucuaaaaaaaaaaaaaaaaaaaauuucuacauuauaacu

SEQ ID NO: 28723 - RNA, 64 nt, Homo Sapiens
uuaagaaaaugaaguaacugauuuucuaaaaaaaaaaaaaaaaaaaauuucuacauuauaacuc

SEQ ID NO: 28724 - RNA, 64 nt, Homo Sapiens
uaagaaaaugaaguaacugauuuucuaaaaaaaaaaaaaaaaaaaauuucuacauuauaacuca

SEQ ID NO: 28725 - RNA, 64 nt, Homo Sapiens
aagaaaaugaaguaacugauuuucuaaaaaaaaaaaaaaaaaaaauuucuacauuauaacucac

SEQ ID NO: 28726 - RNA, 64 nt, Homo Sapiens
agaaaaugaaguaacugauuuucuaaaaaaaaaaaaaaaaaaaauuucuacauuauaacucaca

SEQ ID NO: 28727 - RNA, 64 nt, Homo Sapiens
gaaaaugaaguaacugauuuucuaaaaaaaaaaaaaaaaaaaauuucuacauuauaacucacag

SEQ ID NO: 28728 - RNA, 64 nt, Homo Sapiens
aaaaugaaguaacugauuuucuaaaaaaaaaaaaaaaaaaaauuucuacauuauaacucacagc

SEQ ID NO: 28729 - RNA, 64 nt, Homo Sapiens
cugucugugaaauaauguaagaagcuuuucacuuaaaaaaaaugcauuacuuucacuuaacacu

SEQ ID NO: 28730 - RNA, 64 nt, Homo Sapiens
cacuccagucuggguaacagggagacugcaucucaaaaaaaaaaaaaaaaaaaaaaaagggcug

SEQ ID NO: 28731 - RNA, 64 nt, Homo Sapiens
acuccagucuggguaacagggagacugcaucucaaaaaaaaaaaaaaaaaaaaaaaagggcugu

SEQ ID NO: 28732 - RNA, 64 nt, Homo Sapiens
cuccagucuggguaacagggagacugcaucucaaaaaaaaaaaaaaaaaaaaaaaagggcuguc

SEQ ID NO: 28733 - RNA, 64 nt, Homo Sapiens
uccagucuggguaacagggagacugcaucucaaaaaaaaaaaaaaaaaaaaaaaagggcugucc

SEQ ID NO: 28734 - RNA, 64 nt, Homo Sapiens
ccagucuggguaacagggagacugcaucucaaaaaaaaaaaaaaaaaaaaaaaagggcugucca

SEQ ID NO: 28735 - RNA, 64 nt, Homo Sapiens
cagucuggguaacagggagacugcaucucaaaaaaaaaaaaaaaaaaaaaaaagggcuguccau

SEQ ID NO: 28736 - RNA, 64 nt, Homo Sapiens
agucuggguaacagggagacugcaucucaaaaaaaaaaaaaaaaaaaaaaaagggcuguccaug

SEQ ID NO: 28737 - RNA, 64 nt, Homo Sapiens
gucuggguaacagggagacugcaucucaaaaaaaaaaaaaaaaaaaaaaaagggcuguccaugu

SEQ ID NO: 28738 - RNA, 64 nt, Homo Sapiens
ucuggguaacagggagacugcaucucaaaaaaaaaaaaaaaaaaaaaaaagggcuguccaugua

SEQ ID NO: 28739 - RNA, 64 nt, Homo Sapiens
cuggguaacagggagacugcaucucaaaaaaaaaaaaaaaaaaaaaaaagggcuguccauguau

SEQ ID NO: 28740 - RNA, 64 nt, Homo Sapiens
uggguaacagggagacugcaucucaaaaaaaaaaaaaaaaaaaaaaaagggcuguccauguauu

SEQ ID NO: 28741 - RNA, 64 nt, Homo Sapiens
ggguaacagggagacugcaucucaaaaaaaaaaaaaaaaaaaaaaaagggcuguccauguauuc

SEQ ID NO: 28742 - RNA, 64 nt, Homo Sapiens
gguaacagggagacugcaucucaaaaaaaaaaaaaaaaaaaaaaaagggcuguccauguauuca

SEQ ID NO: 28743 - RNA, 64 nt, Homo Sapiens
guaacagggagacugcaucucaaaaaaaaaaaaaaaaaaaaaaaagggcuguccauguauucac

SEQ ID NO: 28744 - RNA, 64 nt, Homo Sapiens
uaacagggagacugcaucucaaaaaaaaaaaaaaaaaaaaaaaagggcuguccauguauucaca

SEQ ID NO: 28745 - RNA, 64 nt, Homo Sapiens
aacagggagacugcaucucaaaaaaaaaaaaaaaaaaaaaaaagggcuguccauguauucacac

SEQ ID NO: 28746 - RNA, 64 nt, Homo Sapiens
acagggagacugcaucucaaaaaaaaaaaaaaaaaaaaaaaagggcuguccauguauucacaca

SEQ ID NO: 28747 - RNA, 64 nt, Homo Sapiens
augaagccuguagaacugagaaggagaagcuuacaaaaaaaaaaaaauccucuucuauauugca

SEQ ID NO: 28748 - RNA, 64 nt, Homo Sapiens
ugaagccuguagaacugagaaggagaagcuuacaaaaaaaaaaaaauccucuucuauauugcag

SEQ ID NO: 28749 - RNA, 64 nt, Homo Sapiens
gaagccuguagaacugagaaggagaagcuuacaaaaaaaaaaaaauccucuucuauauugcagu

SEQ ID NO: 28750 - RNA, 64 nt, Homo Sapiens
aagccuguagaacugagaaggagaagcuuacaaaaaaaaaaaaauccucuucuauauugcagug

SEQ ID NO: 28751 - RNA, 64 nt, Homo Sapiens
agccuguagaacugagaaggagaagcuuacaaaaaaaaaaaaauccucuucuauauugcagugu

SEQ ID NO: 28752 - RNA, 64 nt, Homo Sapiens
gccuguagaacugagaaggagaagcuuacaaaaaaaaaaaaauccucuucuauauugcaguguc

SEQ ID NO: 28753 - RNA, 64 nt, Homo Sapiens
cccacagauuaaaccaaccacagaucaaaaauagaaaaaaaaaaaaaaagaaaaaaagaaugua

SEQ ID NO: 28754 - RNA, 64 nt, Homo Sapiens
ccacagauuaaaccaaccacagaucaaaaauagaaaaaaaaaaaaaaagaaaaaaagaauguaa

SEQ ID NO: 28755 - RNA, 64 nt, Homo Sapiens
cacagauuaaaccaaccacagaucaaaaauagaaaaaaaaaaaaaaagaaaaaaagaauguaaa

SEQ ID NO: 28756 - RNA, 64 nt, Homo Sapiens
acagauuaaaccaaccacagaucaaaaauagaaaaaaaaaaaaaaagaaaaaaagaauguaaaa

SEQ ID NO: 28757 - RNA, 64 nt, Homo Sapiens
cagauuaaaccaaccacagaucaaaaauagaaaaaaaaaaaaaaagaaaaaaagaauguaaaau

SEQ ID NO: 28758 - RNA, 64 nt, Homo Sapiens
agauuaaaccaaccacagaucaaaaauagaaaaaaaaaaaaaaagaaaaaaagaauguaaaauu

SEQ ID NO: 28759 - RNA, 64 nt, Homo Sapiens
gauuaaaccaaccacagaucaaaaauagaaaaaaaaaaaaaaagaaaaaaagaauguaaaauuu

SEQ ID NO: 28760 - RNA, 64 nt, Homo Sapiens
auuaaaccaaccacagaucaaaaauagaaaaaaaaaaaaaaagaaaaaaagaauguaaaauuuu

SEQ ID NO: 28761 - RNA, 64 nt, Homo Sapiens
aaccaacccaguuacuuauauuaauaauauucagaaaaaaaaaaaaagaaaaggaaaaagaaaa

SEQ ID NO: 28762 - RNA, 64 nt, Homo Sapiens
accaacccaguuacuuauauuaauaauauucagaaaaaaaaaaaaagaaaaggaaaaagaaaaa

SEQ ID NO: 28763 - RNA, 64 nt, Homo Sapiens
ccaacccaguuacuuauauuaauaauauucagaaaaaaaaaaaaagaaaaggaaaaagaaaaau

SEQ ID NO: 28764 - RNA, 64 nt, Homo Sapiens
caacccaguuacuuauauuaauaauauucagaaaaaaaaaaaaagaaaaggaaaaagaaaaaua

SEQ ID NO: 28765 - RNA, 64 nt, Homo Sapiens
aacccaguuacuuauauuaauaauauucagaaaaaaaaaaaaagaaaaggaaaaagaaaaauau

SEQ ID NO: 28766 - RNA, 64 nt, Homo Sapiens
acccaguuacuuauauuaauaauauucagaaaaaaaaaaaaagaaaaggaaaaagaaaaauaua

SEQ ID NO: 28767 - RNA, 64 nt, Homo Sapiens
uguacuuuuaccaguuucuuugucccaccaacuuaaaaaaaaaaaguacaauucauuguuuugc

SEQ ID NO: 28768 - RNA, 64 nt, Homo Sapiens
guacuuuuaccaguuucuuugucccaccaacuuaaaaaaaaaaaguacaauucauuguuuugca

SEQ ID NO: 28769 - RNA, 64 nt, Homo Sapiens
uacuuuuaccaguuucuuugucccaccaacuuaaaaaaaaaaaguacaauucauuguuuugcaa

SEQ ID NO: 28770 - RNA, 64 nt, Homo Sapiens
acuuuuaccaguuucuuugucccaccaacuuaaaaaaaaaaaguacaauucauuguuuugcaaa

SEQ ID NO: 28771 - RNA, 64 nt, Homo Sapiens
uaauuaugacaugagaaugaagaaauuauuuuggaaaaaaaaaaugaccuaauuuaccuaucag

SEQ ID NO: 28772 - RNA, 64 nt, Homo Sapiens
aauuaugacaugagaaugaagaaauuauuuuggaaaaaaaaaaugaccuaauuuaccuaucagu

SEQ ID NO: 28773 - RNA, 64 nt, Homo Sapiens
auuaugacaugagaaugaagaaauuauuuuggaaaaaaaaaaugaccuaauuuaccuaucagug

SEQ ID NO: 28774 - RNA, 64 nt, Homo Sapiens
gacuuuccacuuuguccuuucugcucuugugaagaaaaaaaaaagcauuuucgaggaaagaauu

SEQ ID NO: 28775 - RNA, 64 nt, Homo Sapiens
acuuuccacuuuguccuuucugcucuugugaagaaaaaaaaaagcauuuucgaggaaagaauua

SEQ ID NO: 28776 - RNA, 64 nt, Homo Sapiens
cuuuccacuuuguccuuucugcucuugugaagaaaaaaaaaagcauuuucgaggaaagaauuau

SEQ ID NO: 28777 - RNA, 64 nt, Homo Sapiens
auaaauaauuuuucacauuguauuguugcuauauaaaaaaaauaauagaauugguuggguuucu

SEQ ID NO: 28778 - RNA, 64 nt, Homo Sapiens
uuguauuauuuggaguuagguccucacuugggggaaaaaaaaaaaagaaaagccaagcaaacca

SEQ ID NO: 28779 - RNA, 64 nt, Homo Sapiens
uguauuauuuggaguuagguccucacuugggggaaaaaaaaaaaagaaaagccaagcaaaccaa

SEQ ID NO: 28780 - RNA, 64 nt, Homo Sapiens
guauuauuuggaguuagguccucacuugggggaaaaaaaaaaaagaaaagccaagcaaaccaau

SEQ ID NO: 28781 - RNA, 64 nt, Homo Sapiens
uauuauuuggaguuagguccucacuugggggaaaaaaaaaaaagaaaagccaagcaaaccaaug

SEQ ID NO: 28782 - RNA, 64 nt, Homo Sapiens
auuauuuggaguuagguccucacuugggggaaaaaaaaaaaagaaaagccaagcaaaccaaugg

SEQ ID NO: 28783 - RNA, 64 nt, Homo Sapiens
agacugggaucccccaccccaacagugauuuuggaaaaaaaaaugaaaguucuguucguuuauc

SEQ ID NO: 28784 - RNA, 64 nt, Homo Sapiens
gacugggaucccccaccccaacagugauuuuggaaaaaaaaaugaaaguucuguucguuuaucc

SEQ ID NO: 28785 - RNA, 64 nt, Homo Sapiens
guuugagaccaauguagugagacucaucucugccaaaaaaaaaaaauuagccgggcaugguggc

SEQ ID NO: 28786 - RNA, 64 nt, Homo Sapiens
uuugagaccaauguagugagacucaucucugccaaaaaaaaaaaauuagccgggcaugguggca

SEQ ID NO: 28787 - RNA, 64 nt, Homo Sapiens
uugagaccaauguagugagacucaucucugccaaaaaaaaaaaauuagccgggcaugguggcac

SEQ ID NO: 28788 - RNA, 64 nt, Homo Sapiens
ugagaccaauguagugagacucaucucugccaaaaaaaaaaaauuagccgggcaugguggcaca

SEQ ID NO: 28789 - RNA, 64 nt, Homo Sapiens
gagaccaauguagugagacucaucucugccaaaaaaaaaaaauuagccgggcaugguggcacac

SEQ ID NO: 28790 - RNA, 64 nt, Homo Sapiens
uaggagucuguuauuuaaaaaaagcauuaaauuuaaaaaaaaacugucuugucuacuuuuagcu

SEQ ID NO: 28791 - RNA, 64 nt, Homo Sapiens
aggagucuguuauuuaaaaaaagcauuaaauuuaaaaaaaaacugucuugucuacuuuuagcuu

SEQ ID NO: 28792 - RNA, 64 nt, Homo Sapiens
auaaaacuguuaaaucauggccugauaucaucuuaaaaaaaaaucucagaaucugaaauaagcc

SEQ ID NO: 28793 - RNA, 64 nt, Homo Sapiens
uaaaacuguuaaaucauggccugauaucaucuuaaaaaaaaaucucagaaucugaaauaagccc

SEQ ID NO: 28794 - RNA, 64 nt, Homo Sapiens
uuuugaaauuaaauuaucuauucuucccccccccaaaaaaaaguauuguaaauccuuaaguaaa

SEQ ID NO: 28795 - RNA, 64 nt, Homo Sapiens
ugagccucauguaagaacaugauggucuuuuuuuaaaaaaaaagucgugccaauuauaagugcu

SEQ ID NO: 28796 - RNA, 64 nt, Homo Sapiens
gagccucauguaagaacaugauggucuuuuuuuaaaaaaaaagucgugccaauuauaagugcuu

SEQ ID NO: 28797 - RNA, 64 nt, Homo Sapiens
uuuuuuugagauggagucucguaaaguuaccuuuaaaaaaaaaguucuauuuucccuguauugg

SEQ ID NO: 28798 - RNA, 64 nt, Homo Sapiens
uuuuuugagauggagucucguaaaguuaccuuuaaaaaaaaaguucuauuuucccuguauuggu

SEQ ID NO: 28799 - RNA, 64 nt, Homo Sapiens
uuuaauggcuaacaacucaaucucauuaaguuggaaaaaaaacuuaucaaagagacauuuacau

SEQ ID NO: 28800 - RNA, 64 nt, Homo Sapiens
uaagcguguguaaaugggcuuuagucuggaaaccaaaaaaaaaaaaaaaauuuagucauucuau

SEQ ID NO: 28801 - RNA, 64 nt, Homo Sapiens
aagcguguguaaaugggcuuuagucuggaaaccaaaaaaaaaaaaaaaauuuagucauucuaua

SEQ ID NO: 28802 - RNA, 64 nt, Homo Sapiens
agcguguguaaaugggcuuuagucuggaaaccaaaaaaaaaaaaaaaauuuagucauucuauag

SEQ ID NO: 28803 - RNA, 64 nt, Homo Sapiens
gcguguguaaaugggcuuuagucuggaaaccaaaaaaaaaaaaaaaauuuagucauucuauagg

SEQ ID NO: 28804 - RNA, 64 nt, Homo Sapiens
cguguguaaaugggcuuuagucuggaaaccaaaaaaaaaaaaaaaauuuagucauucuauagga

SEQ ID NO: 28805 - RNA, 64 nt, Homo Sapiens
guguguaaaugggcuuuagucuggaaaccaaaaaaaaaaaaaaaauuuagucauucuauaggau

SEQ ID NO: 28806 - RNA, 64 nt, Homo Sapiens
uguguaaaugggcuuuagucuggaaaccaaaaaaaaaaaaaaaauuuagucauucuauaggauc

SEQ ID NO: 28807 - RNA, 64 nt, Homo Sapiens
guguaaaugggcuuuagucuggaaaccaaaaaaaaaaaaaaaauuuagucauucuauaggauca

SEQ ID NO: 28808 - RNA, 64 nt, Homo Sapiens
uguaaaugggcuuuagucuggaaaccaaaaaaaaaaaaaaaauuuagucauucuauaggaucau

SEQ ID NO: 28809 - RNA, 64 nt, Homo Sapiens
aucaucuauaagggagggcugggggcgggaaaagaaaaaaaaaagucauuuugaaauuaaccuc

SEQ ID NO: 28810 - RNA, 64 nt, Homo Sapiens
ucaucuauaagggagggcugggggcgggaaaagaaaaaaaaaagucauuuugaaauuaaccucc

SEQ ID NO: 28811 - RNA, 64 nt, Homo Sapiens
caucuauaagggagggcugggggcgggaaaagaaaaaaaaaagucauuuugaaauuaaccuccu

SEQ ID NO: 28812 - RNA, 64 nt, Homo Sapiens
ggaauagggaacuaauuuaugaaacagccaucuuaaaaaaaaaaaaaguaaacugcaaaaguac

SEQ ID NO: 28813 - RNA, 64 nt, Homo Sapiens
gaauagggaacuaauuuaugaaacagccaucuuaaaaaaaaaaaaaguaaacugcaaaaguaca

SEQ ID NO: 28814 - RNA, 64 nt, Homo Sapiens
aauagggaacuaauuuaugaaacagccaucuuaaaaaaaaaaaaaguaaacugcaaaaguacaa

SEQ ID NO: 28815 - RNA, 64 nt, Homo Sapiens
auagggaacuaauuuaugaaacagccaucuuaaaaaaaaaaaaaguaaacugcaaaaguacaaa

SEQ ID NO: 28816 - RNA, 64 nt, Homo Sapiens
uagggaacuaauuuaugaaacagccaucuuaaaaaaaaaaaaaguaaacugcaaaaguacaaaa

SEQ ID NO: 28817 - RNA, 64 nt, Homo Sapiens
agggaacuaauuuaugaaacagccaucuuaaaaaaaaaaaaaguaaacugcaaaaguacaaaau

SEQ ID NO: 28818 - RNA, 64 nt, Homo Sapiens
ugagaaugugacuuuuucugguguuguaaaaaagaaaaaaaaaagaaugcucauuguaaaaaua

SEQ ID NO: 28819 - RNA, 64 nt, Homo Sapiens
gagaaugugacuuuuucugguguuguaaaaaagaaaaaaaaaagaaugcucauuguaaaaauaa

SEQ ID NO: 28820 - RNA, 64 nt, Homo Sapiens
agaaugugacuuuuucugguguuguaaaaaagaaaaaaaaaagaaugcucauuguaaaaauaaa

SEQ ID NO: 28821 - RNA, 64 nt, Homo Sapiens
acuccagccuggugacagagugagacucugucucaaaaaaaaaguuucaauguuuacuccuaga

SEQ ID NO: 28822 - RNA, 64 nt, Homo Sapiens
cuccagccuggugacagagugagacucugucucaaaaaaaaaguuucaauguuuacuccuagag

SEQ ID NO: 28823 - RNA, 64 nt, Homo Sapiens
ugauauuuuaggaauaacggacuuuuaaagaagcaaaaaaaaagacugaauuuccuugcuuacu

SEQ ID NO: 28824 - RNA, 64 nt, Homo Sapiens
gauauuuuaggaauaacggacuuuuaaagaagcaaaaaaaaagacugaauuuccuugcuuacuu

SEQ ID NO: 28825 - RNA, 64 nt, Homo Sapiens
uauuuaucuuugauuucagucuuggcaauuguuuaaaaaaaaaaucuagauuuguuuuauuagg

SEQ ID NO: 28826 - RNA, 64 nt, Homo Sapiens
auuuaucuuugauuucagucuuggcaauuguuuaaaaaaaaaaucuagauuuguuuuauuaggu

SEQ ID NO: 28827 - RNA, 64 nt, Homo Sapiens
uuuaucuuugauuucagucuuggcaauuguuuaaaaaaaaaaucuagauuuguuuuauuagguu

SEQ ID NO: 28828 - RNA, 64 nt, Homo Sapiens
agaagaaaaaagacaaaaucgaccauaaaagaccaaaaaaaaaaaaaaaaucagaaaaccccca

SEQ ID NO: 28829 - RNA, 64 nt, Homo Sapiens
gaagaaaaaagacaaaaucgaccauaaaagaccaaaaaaaaaaaaaaaaucagaaaacccccac

SEQ ID NO: 28830 - RNA, 64 nt, Homo Sapiens
aagaaaaaagacaaaaucgaccauaaaagaccaaaaaaaaaaaaaaaaucagaaaacccccacc

SEQ ID NO: 28831 - RNA, 64 nt, Homo Sapiens
agaaaaaagacaaaaucgaccauaaaagaccaaaaaaaaaaaaaaaaucagaaaacccccaccu

SEQ ID NO: 28832 - RNA, 64 nt, Homo Sapiens
gaaaaaagacaaaaucgaccauaaaagaccaaaaaaaaaaaaaaaaucagaaaacccccaccua

SEQ ID NO: 28833 - RNA, 64 nt, Homo Sapiens
aaaaaagacaaaaucgaccauaaaagaccaaaaaaaaaaaaaaaaucagaaaacccccaccuaa

SEQ ID NO: 28834 - RNA, 64 nt, Homo Sapiens
aaaaagacaaaaucgaccauaaaagaccaaaaaaaaaaaaaaaaucagaaaacccccaccuaau

SEQ ID NO: 28835 - RNA, 64 nt, Homo Sapiens
aaaagacaaaaucgaccauaaaagaccaaaaaaaaaaaaaaaaucagaaaacccccaccuaauc

SEQ ID NO: 28836 - RNA, 64 nt, Homo Sapiens
aaagacaaaaucgaccauaaaagaccaaaaaaaaaaaaaaaaucagaaaacccccaccuaaucc

SEQ ID NO: 28837 - RNA, 64 nt, Homo Sapiens
uugaaacuaguacuuuucccuuuaaaaacaaaccaaaaaaaaaaacaaaaaaaaacuuuuuaau

SEQ ID NO: 28838 - RNA, 64 nt, Homo Sapiens
ugaaacuaguacuuuucccuuuaaaaacaaaccaaaaaaaaaaacaaaaaaaaacuuuuuaauu

SEQ ID NO: 28839 - RNA, 64 nt, Homo Sapiens
gaaacuaguacuuuucccuuuaaaaacaaaccaaaaaaaaaaacaaaaaaaaacuuuuuaauua

SEQ ID NO: 28840 - RNA, 64 nt, Homo Sapiens
aaacuaguacuuuucccuuuaaaaacaaaccaaaaaaaaaaacaaaaaaaaacuuuuuaauuaa

SEQ ID NO: 28841 - RNA, 64 nt, Homo Sapiens
cuuuucccuuuaaaaacaaaccaaaaaaaaaaacaaaaaaaaacuuuuuaauuaaagaaccuag

SEQ ID NO: 28842 - RNA, 64 nt, Homo Sapiens
uuuucccuuuaaaaacaaaccaaaaaaaaaaacaaaaaaaaacuuuuuaauuaaagaaccuagu

SEQ ID NO: 28843 - RNA, 64 nt, Homo Sapiens
ggggaagaugguucaaagauacaagaaaaaguagaaaaaaaaauaacacuuaacuaaaaccccu

SEQ ID NO: 28844 - RNA, 64 nt, Homo Sapiens
gggaagaugguucaaagauacaagaaaaaguagaaaaaaaaauaacacuuaacuaaaaccccua

SEQ ID NO: 28845 - RNA, 64 nt, Homo Sapiens
uuccaaagcugaagauccccauucuuucucuuugaaaaaaaaaaaggccuaaugcauuauuuug

SEQ ID NO: 28846 - RNA, 64 nt, Homo Sapiens
uccaaagcugaagauccccauucuuucucuuugaaaaaaaaaaaggccuaaugcauuauuuugu

SEQ ID NO: 28847 - RNA, 64 nt, Homo Sapiens
ccaaagcugaagauccccauucuuucucuuugaaaaaaaaaaaggccuaaugcauuauuuuguc

SEQ ID NO: 28848 - RNA, 64 nt, Homo Sapiens
caaagcugaagauccccauucuuucucuuugaaaaaaaaaaaggccuaaugcauuauuuuguca

SEQ ID NO: 28849 - RNA, 64 nt, Homo Sapiens
cgaaaaaguauugaagauuagcuuuuaaaaacugaaaaaaaaaaaugaaugacucacauagagg

SEQ ID NO: 28850 - RNA, 64 nt, Homo Sapiens
gaaaaaguauugaagauuagcuuuuaaaaacugaaaaaaaaaaaugaaugacucacauagaggu

SEQ ID NO: 28851 - RNA, 64 nt, Homo Sapiens
aaaaaguauugaagauuagcuuuuaaaaacugaaaaaaaaaaaugaaugacucacauagagguu

SEQ ID NO: 28852 - RNA, 64 nt, Homo Sapiens
aaaaguauugaagauuagcuuuuaaaaacugaaaaaaaaaaaugaaugacucacauagagguug

SEQ ID NO: 28853 - RNA, 64 nt, Homo Sapiens
aaccaaaguccuuuuucccaaagguucugaaaggaaaaaaaaaaaaaacaaaaaaaaagaaaaa

SEQ ID NO: 28854 - RNA, 64 nt, Homo Sapiens
accaaaguccuuuuucccaaagguucugaaaggaaaaaaaaaaaaaacaaaaaaaaagaaaaac

SEQ ID NO: 28855 - RNA, 64 nt, Homo Sapiens
ccaaaguccuuuuucccaaagguucugaaaggaaaaaaaaaaaaaacaaaaaaaaagaaaaaca

SEQ ID NO: 28856 - RNA, 64 nt, Homo Sapiens
caaaguccuuuuucccaaagguucugaaaggaaaaaaaaaaaaaacaaaaaaaaagaaaaacaa

SEQ ID NO: 28857 - RNA, 64 nt, Homo Sapiens
aaaguccuuuuucccaaagguucugaaaggaaaaaaaaaaaaaacaaaaaaaaagaaaaacaaa

SEQ ID NO: 28858 - RNA, 63 nt, Homo Sapiens
aaguccuuuuucccaaagguucugaaaggaaaaaaaaaaaaaacaaaaaaaaagaaaaacaaa

SEQ ID NO: 28859 - RNA, 62 nt, Homo Sapiens
aguccuuuuucccaaagguucugaaaggaaaaaaaaaaaaaacaaaaaaaaagaaaaacaaa

SEQ ID NO: 28860 - RNA, 64 nt, Homo Sapiens
uaacauggugaaacccugccucuacuaaaaauacaaaaaaaaacaaaauuagccgggcgugguu

SEQ ID NO: 28861 - RNA, 64 nt, Homo Sapiens
aacauggugaaacccugccucuacuaaaaauacaaaaaaaaacaaaauuagccgggcgugguug

SEQ ID NO: 28862 - RNA, 64 nt, Homo Sapiens
ucccucaaaaaguuaccaccacaucagaaaaaauaaaaaaaaaauaguaaaguaggcagagcua

SEQ ID NO: 28863 - RNA, 64 nt, Homo Sapiens
cccucaaaaaguuaccaccacaucagaaaaaauaaaaaaaaaauaguaaaguaggcagagcuag

SEQ ID NO: 28864 - RNA, 64 nt, Homo Sapiens
ccucaaaaaguuaccaccacaucagaaaaaauaaaaaaaaaauaguaaaguaggcagagcuagg

SEQ ID NO: 28865 - RNA, 64 nt, Homo Sapiens
ucgcaugaaaaugacagauaacacuguaguuccuaaaaaaaaaauuaaaugcauaagcauaagg

SEQ ID NO: 28866 - RNA, 64 nt, Homo Sapiens
cgcaugaaaaugacagauaacacuguaguuccuaaaaaaaaaauuaaaugcauaagcauaaggu

SEQ ID NO: 28867 - RNA, 64 nt, Homo Sapiens
gcaugaaaaugacagauaacacuguaguuccuaaaaaaaaaauuaaaugcauaagcauaaggua

SEQ ID NO: 28868 - RNA, 64 nt, Homo Sapiens
cagagaugucugcucuuuuaaauuauauauaaggaaaaaaaauagccugccuugggacaggugu

SEQ ID NO: 28869 - RNA, 64 nt, Homo Sapiens
uaaauauucuugaacaauuaguagauccagaaagaaaaaaaaauaugcuuucucugugugugua

SEQ ID NO: 28870 - RNA, 64 nt, Homo Sapiens
aaauauucuugaacaauuaguagauccagaaagaaaaaaaaauaugcuuucucuguguguguac

SEQ ID NO: 28871 - RNA, 64 nt, Homo Sapiens
gaaauggggaaaaaagaaaacaacagcaagucagaaaaaaaaaacaagagagagaaauucauau

SEQ ID NO: 28872 - RNA, 64 nt, Homo Sapiens
aaauggggaaaaaagaaaacaacagcaagucagaaaaaaaaaacaagagagagaaauucauauu

SEQ ID NO: 28873 - RNA, 64 nt, Homo Sapiens
aauggggaaaaaagaaaacaacagcaagucagaaaaaaaaaacaagagagagaaauucauauua

SEQ ID NO: 28874 - RNA, 64 nt, Homo Sapiens
uggggaggggaaaucuuuucuuucuuucccccuuaaaaaaaaacacaucugccccgaacacuuu

SEQ ID NO: 28875 - RNA, 64 nt, Homo Sapiens
ggggaggggaaaucuuuucuuucuuucccccuuaaaaaaaaacacaucugccccgaacacuuuc

SEQ ID NO: 28876 - RNA, 64 nt, Homo Sapiens
ucugauaaacagacuuugaaugugcauuuucagaaaaaaaaaucuuuuuugaaugaaaugccac

SEQ ID NO: 28877 - RNA, 64 nt, Homo Sapiens
cucugauaaacagacuuugacugugcauuuucagaaaaaaaaauguuuuuugaaugaaaugcca

SEQ ID NO: 28878 - RNA, 64 nt, Homo Sapiens
uauauauauaugugugugugaccuagggaaggaaaaaaaaaauaacaaguucuaucacuccuuu

SEQ ID NO: 28879 - RNA, 64 nt, Homo Sapiens
auauauauauauguguguguuaccuagggaaggaaaaaaaaaaucacaaguucuaucacuccuu

SEQ ID NO: 28880 - RNA, 64 nt, Homo Sapiens
uauauauauauauguguguguuaccuagggaaggaaaaaaaaaagcacaaguucuaucacuccu

SEQ ID NO: 28881 - RNA, 64 nt, Homo Sapiens
aggaaaaaaggaauauuuagguuuuaacaaaaaaaaaaaaaagcucuuuacuuucucccaguau

SEQ ID NO: 28882 - RNA, 64 nt, Homo Sapiens
caggaaaaaaggaauauuuauguuuuaacaaaaaaaaaaaaaaguucuuuacuuucucccagua

SEQ ID NO: 28883 - RNA, 64 nt, Homo Sapiens
gcaggaaaaaaggaauauuuauguuuuaacaaaaaaaaaaaaaauuucuuuacuuucucccagu

SEQ ID NO: 28884 - RNA, 64 nt, Homo Sapiens
agcaggaaaaaaggaauauuuauguuuuaacaaaaaaaaaaaaauuuucuuuacuuucucccag

SEQ ID NO: 28885 - RNA, 64 nt, Homo Sapiens
aagcaggaaaaaaggaauauguauguuuuaacaaaaaaaaaaaauuuuucuuuacuuucuccca

SEQ ID NO: 28886 - RNA, 64 nt, Homo Sapiens
aaagcaggaaaaaaggaauaaguauguuuuaacaaaaaaaaaaaguuuuucuuuacuuucuccc

SEQ ID NO: 28887 - RNA, 64 nt, Homo Sapiens
aaaagcaggaaaaaaggaaucaguauguuuuaacaaaaaaaaaaaguuuuucuuuacuuucucc

SEQ ID NO: 28888 - RNA, 64 nt, Homo Sapiens
ucaauguaucagcuuuuuuuaucugagaagauuaaaaaaaaaucugcagugguuucagaggcag

SEQ ID NO: 28889 - RNA, 64 nt, Homo Sapiens
cucaauguaucagcuuuuuugaucugagaagauuaaaaaaaaauuugcagugguuucagaggca

SEQ ID NO: 28890 - RNA, 64 nt, Homo Sapiens
uuuuaaagauauaaauauauugaaagaaccuaaaaaaaaaaauauuuagucagaauuccuagac

SEQ ID NO: 28891 - RNA, 64 nt, Homo Sapiens
auuuuaaagauauaaauauacugaaagaaccuaaaaaaaaaaauauuuagucagaauuccuaga

SEQ ID NO: 28892 - RNA, 64 nt, Homo Sapiens
uauuuuaaagauauaaauauacugaaagaaccuaaaaaaaaaaagauuuagucagaauuccuag

SEQ ID NO: 28893 - RNA, 64 nt, Homo Sapiens
auauuuuaaagauauaaauagacugaaagaaccuaaaaaaaaaaugauuuagucagaauuccua

SEQ ID NO: 28894 - RNA, 64 nt, Homo Sapiens
ugcuccgacuagggggaaaagaaagacacccaaaaaaaaaaauguguuagguauuauuugaaug

SEQ ID NO: 28895 - RNA, 64 nt, Homo Sapiens
gugcuccgacuagggggaaaggaaagacacccaaaaaaaaaaauguguuagguauuauuugaau

SEQ ID NO: 28896 - RNA, 64 nt, Homo Sapiens
ugugcuccgacuagggggaauggaaagacacccaaaaaaaaaaaaguguuagguauuauuugaa

SEQ ID NO: 28897 - RNA, 64 nt, Homo Sapiens
augugcuccgacuagggggaauggaaagacacccaaaaaaaaaacaguguuagguauuauuuga

SEQ ID NO: 28898 - RNA, 64 nt, Homo Sapiens
cccuaaagacuaacuugaaaucuuuccuuaguuaaaaaaaaauuuaauuuauuauacaccuuag

SEQ ID NO: 28899 - RNA, 64 nt, Homo Sapiens
ucccuaaagacuaacuugaagucuuuccuuaguuaaaaaaaaauauaauuuauuauacaccuua

SEQ ID NO: 28900 - RNA, 64 nt, Homo Sapiens
aaauuaaauuaaaaacagaagccaaucucuucuaaaaaaaaacaugcuuuaucccacggaaaau

SEQ ID NO: 28901 - RNA, 64 nt, Homo Sapiens
aaaauuaaauuaaaaacagaugccaaucucuucuaaaaaaaaaccugcuuuaucccacggaaaa

SEQ ID NO: 28902 - RNA, 64 nt, Homo Sapiens
cuugaacuaaugacucaaauccaccucaaaaaaaaaaaaaaaucccugguggcacagugagacu

SEQ ID NO: 28903 - RNA, 64 nt, Homo Sapiens
ccuugaacuaaugacucaaauccaccucaaaaaaaaaaaaaaaugccugguggcacagugagac

SEQ ID NO: 28904 - RNA, 64 nt, Homo Sapiens
uccuugaacuaaugacucaacuccaccucaaaaaaaaaaaaaaaagccugguggcacagugaga

SEQ ID NO: 28905 - RNA, 64 nt, Homo Sapiens
auccuugaacuaaugacucaacuccaccucaaaaaaaaaaaaaacagccugguggcacagugag

SEQ ID NO: 28906 - RNA, 64 nt, Homo Sapiens
aauccuugaacuaaugacucgacuccaccucaaaaaaaaaaaaaccagccugguggcacaguga

SEQ ID NO: 28907 - RNA, 64 nt, Homo Sapiens
aaauccuugaacuaaugacuagacuccaccucaaaaaaaaaaaauccagccugguggcacagug

SEQ ID NO: 28908 - RNA, 64 nt, Homo Sapiens
aaaauccuugaacuaaugacgagacuccaccucaaaaaaaaaaacuccagccugguggcacagu

SEQ ID NO: 28909 - RNA, 64 nt, Homo Sapiens
aaaaauccuugaacuaaugaugagacuccaccucaaaaaaaaaagcuccagccugguggcacag

SEQ ID NO: 28910 - RNA, 64 nt, Homo Sapiens
uagagcacaauaauccuugcucuaaaaaauaaaaaaaaaaaacuucauugugauauuugacaac

SEQ ID NO: 28911 - RNA, 64 nt, Homo Sapiens
uuagagcacaauaauccuugcucuaaaaaauaaaaaaaaaaaacgucauugugauauuugacaa

SEQ ID NO: 28912 - RNA, 64 nt, Homo Sapiens
cuuagagcacaauaauccuuacucuaaaaaauaaaaaaaaaaaaugucauugugauauuugaca

SEQ ID NO: 28913 - RNA, 64 nt, Homo Sapiens
acuuagagcacaauaauccuaacucuaaaaaauaaaaaaaaaaagugucauugugauauuugac

SEQ ID NO: 28914 - RNA, 64 nt, Homo Sapiens
aacuuagagcacaauaaucccaacucuaaaaaauaaaaaaaaaacgugucauugugauauuuga

SEQ ID NO: 28915 - RNA, 64 nt, Homo Sapiens
ccaguaacuuuguuuuucaaaguguuaggaauaaaaaaaaaagagaugagcaaaaucuacuucu

SEQ ID NO: 28916 - RNA, 64 nt, Homo Sapiens
accaguaacuuuguuuuucauaguguuaggaauaaaaaaaaaagugaugagcaaaaucuacuuc

SEQ ID NO: 28917 - RNA, 64 nt, Homo Sapiens
gaccaguaacuuuguuuuuccuaguguuaggaauaaaaaaaaaauugaugagcaaaaucuacuu

SEQ ID NO: 28918 - RNA, 64 nt, Homo Sapiens
auacuuacuauuaguaucuaaaaguuauuuuuuaaaaaaaaaucgccuuugccauuugucuuag

SEQ ID NO: 28919 - RNA, 64 nt, Homo Sapiens
cauacuuacuauuaguaucugaaaguuauuuuuuaaaaaaaaauagccuuugccauuugucuua

SEQ ID NO: 28920 - RNA, 64 nt, Homo Sapiens
cuaucaguauuaugggcaauaaaacaaagcauuaaaaaaaaagcaaaaacaauacaaguuuuag

SEQ ID NO: 28921 - RNA, 64 nt, Homo Sapiens
ccuaucaguauuaugggcaagaaaacaaagcauuaaaaaaaaaguaaaaacaauacaaguuuua

SEQ ID NO: 28922 - RNA, 64 nt, Homo Sapiens
caaaaaguuuacauuaauuaaaaugucuaaagaaaaaaaaaauugaaaaguuacucuagaggaa

SEQ ID NO: 28923 - RNA, 64 nt, Homo Sapiens
ucaaaaaguuuacauuaauuaaaaugucuaaagaaaaaaaaaauugaaaaguuacucuagagga

SEQ ID NO: 28924 - RNA, 64 nt, Homo Sapiens
uucaaaaaguuuacauuaauaaaaaugucuaaagaaaaaaaaaauugaaaaguuacucuagagg

SEQ ID NO: 28925 - RNA, 64 nt, Homo Sapiens
gaauaucacuccuccaggagcacaaaaaaaaaaaaaaaaaaauuuaggcucugcaucaagauug

SEQ ID NO: 28926 - RNA, 64 nt, Homo Sapiens
ugaauaucacuccuccaggagcacaaaaaaaaaaaaaaaaaaauuuaggcucugcaucaagauu

SEQ ID NO: 28927 - RNA, 64 nt, Homo Sapiens
uugaauaucacuccuccaggugcacaaaaaaaaaaaaaaaaaaauuuaggcucugcaucaagau

SEQ ID NO: 28928 - RNA, 64 nt, Homo Sapiens
auugaauaucacuccuccaguugcacaaaaaaaaaaaaaaaaaaguuuaggcucugcaucaaga

SEQ ID NO: 28929 - RNA, 64 nt, Homo Sapiens
aauugaauaucacuccuccaauugcacaaaaaaaaaaaaaaaaauguuuaggcucugcaucaag

SEQ ID NO: 28930 - RNA, 64 nt, Homo Sapiens
aaauugaauaucacuccuccgauugcacaaaaaaaaaaaaaaaacuguuuaggcucugcaucaa

SEQ ID NO: 28931 - RNA, 64 nt, Homo Sapiens
aaaauugaauaucacuccucagauugcacaaaaaaaaaaaaaaaacuguuuaggcucugcauca

SEQ ID NO: 28932 - RNA, 64 nt, Homo Sapiens
aaaaauugaauaucacuccuaagauugcacaaaaaaaaaaaaaagacuguuuaggcucugcauc

SEQ ID NO: 28933 - RNA, 64 nt, Homo Sapiens
aaaaaauugaauaucacucccaagauugcacaaaaaaaaaaaaaggacuguuuaggcucugcau

SEQ ID NO: 28934 - RNA, 64 nt, Homo Sapiens
aaaaaaauugaauaucacucucaagauugcacaaaaaaaaaaaaaggacuguuuaggcucugca

SEQ ID NO: 28935 - RNA, 64 nt, Homo Sapiens
aaaaaaaauugaauaucacuaucaagauugcacaaaaaaaaaaauaggacuguuuaggcucugc

SEQ ID NO: 28936 - RNA, 64 nt, Homo Sapiens
aaaaaaaaauugaauaucaccaucaagauugcacaaaaaaaaaaauaggacuguuuaggcucug

SEQ ID NO: 28937 - RNA, 64 nt, Homo Sapiens
cuaaaaccaaaaacuccuuuuuaccagaaaagaaaaaaaaaaccaucuaaagaucuauuuugcc

SEQ ID NO: 28938 - RNA, 64 nt, Homo Sapiens
ccuaaaaccaaaaacuccuucuuaccagaaaagaaaaaaaaaacuaucuaaagaucuauuuugc

SEQ ID NO: 28939 - RNA, 64 nt, Homo Sapiens
cccuaaaaccaaaaacuccuccuuaccagaaaagaaaaaaaaaaauaucuaaagaucuauuuug

SEQ ID NO: 28940 - RNA, 64 nt, Homo Sapiens
caucauggauaaaaacuaagaaaaagaaccaaaaaaaaaaaauuucaaauuauucuugucuuuc

SEQ ID NO: 28941 - RNA, 64 nt, Homo Sapiens
ucaucauggauaaaaacuaacaaaaagaaccaaaaaaaaaaaauaucaaauuauucuugucuuu

SEQ ID NO: 28942 - RNA, 64 nt, Homo Sapiens
uucaucauggauaaaaacuaucaaaaagaaccaaaaaaaaaaaauaucaaauuauucuugucuu

SEQ ID NO: 28943 - RNA, 64 nt, Homo Sapiens
auucaucauggauaaaaacuuucaaaaagaaccaaaaaaaaaaaauaucaaauuauucuugucu

SEQ ID NO: 28944 - RNA, 64 nt, Homo Sapiens
aauucaucauggauaaaaacuuucaaaaagaaccaaaaaaaaaauauaucaaauuauucuuguc

SEQ ID NO: 28945 - RNA, 64 nt, Homo Sapiens
aaagaaagaaggccacguaucaaauuugucauuaaaaaaaaaucuuaacaaucuccauguaguc

SEQ ID NO: 28946 - RNA, 64 nt, Homo Sapiens
caaagaaagaaggccacguaccaaauuugucauuaaaaaaaaauuuuaacaaucuccauguagu

SEQ ID NO: 28947 - RNA, 64 nt, Homo Sapiens
auaauuuggaaaaacccaugcacuugaaaaacuaaaaaaaaacauauguauuaauauaugcauu

SEQ ID NO: 28948 - RNA, 64 nt, Homo Sapiens
aauaauuuggaaaaacccauucacuugaaaaacuaaaaaaaaacuuauguauuaauauaugcau

SEQ ID NO: 28949 - RNA, 64 nt, Homo Sapiens
aggggaaaggguugguuaggguaaaaaaaaaaaaaaaaaaaacaucauugaagauaaagcaaaa

SEQ ID NO: 28950 - RNA, 64 nt, Homo Sapiens
aaggggaaaggguugguuagaguaaaaaaaaaaaaaaaaaaaacuucauugaagauaaagcaaa

SEQ ID NO: 28951 - RNA, 64 nt, Homo Sapiens
caaggggaaaggguugguuaaaguaaaaaaaaaaaaaaaaaaaaguucauugaagauaaagcaa

SEQ ID NO: 28952 - RNA, 64 nt, Homo Sapiens
acaaggggaaaggguugguuaaaguaaaaaaaaaaaaaaaaaaaaguucauugaagauaaagca

SEQ ID NO: 28953 - RNA, 64 nt, Homo Sapiens
aacaaggggaaaggguugguaaaaguaaaaaaaaaaaaaaaaaaaaguucauugaagauaaagc

SEQ ID NO: 28954 - RNA, 64 nt, Homo Sapiens
aaacaaggggaaaggguuggcaaaaguaaaaaaaaaaaaaaaaagaaguucauugaagauaaag

SEQ ID NO: 28955 - RNA, 64 nt, Homo Sapiens
aaaacaaggggaaaggguuggcaaaaguaaaaaaaaaaaaaaaaagaaguucauugaagauaaa

SEQ ID NO: 28956 - RNA, 64 nt, Homo Sapiens
aaaaacaaggggaaaggguuagcaaaaguaaaaaaaaaaaaaaaaagaaguucauugaagauaa

SEQ ID NO: 28957 - RNA, 64 nt, Homo Sapiens
aaaaaacaaggggaaaggguaagcaaaaguaaaaaaaaaaaaaaaaagaaguucauugaagaua

SEQ ID NO: 28958 - RNA, 64 nt, Homo Sapiens
aaaaaaacaaggggaaagggaaagcaaaaguaaaaaaaaaaaaagaaagaaguucauugaagau

SEQ ID NO: 28959 - RNA, 64 nt, Homo Sapiens
aaaaaaaacaaggggaaagguaaagcaaaaguaaaaaaaaaaaaggaaagaaguucauugaaga

SEQ ID NO: 28960 - RNA, 64 nt, Homo Sapiens
aaaaaaaaacaaggggaaagauaaagcaaaaguaaaaaaaaaaauggaaagaaguucauugaag

SEQ ID NO: 28961 - RNA, 64 nt, Homo Sapiens
aaaaaaaaaacaaggggaaagauaaagcaaaaguaaaaaaaaaauuggaaagaaguucauugaa

SEQ ID NO: 28962 - RNA, 64 nt, Homo Sapiens
acucuugucuaauauucgucccuuuuuuuaauuuaaaaaaaaugauaaagaaccucucuauguc

SEQ ID NO: 28963 - RNA, 64 nt, Homo Sapiens
uggaguuggagggcuaacaugaccauaccuauuaaaaaaaaaugaucagagaccauuaaaagag

SEQ ID NO: 28964 - RNA, 64 nt, Homo Sapiens
guggaguuggagggcuaacaggaccauaccuauuaaaaaaaaaugaucagagaccauuaaaaga

SEQ ID NO: 28965 - RNA, 64 nt, Homo Sapiens
cagguacucuguuuuguaaagccguguguggaaaaaaaaaaaguggucgauaugcauuauaugu

SEQ ID NO: 28966 - RNA, 64 nt, Homo Sapiens
ucagguacucuguuuuguaaugccguguguggaaaaaaaaaaaggggucgauaugcauuauaug

SEQ ID NO: 28967 - RNA, 64 nt, Homo Sapiens
gucagguacucuguuuuguagugccguguguggaaaaaaaaaaaggggucgauaugcauuauau

SEQ ID NO: 28968 - RNA, 64 nt, Homo Sapiens
agucagguacucuguuuuguugugccguguguggaaaaaaaaaagggggucgauaugcauuaua

SEQ ID NO: 28969 - RNA, 64 nt, Homo Sapiens
uacacuugggacuuggcaaacacuuucccagaaaaaaaaaaacuuugggagaaaugauauauac

SEQ ID NO: 28970 - RNA, 64 nt, Homo Sapiens
uuacacuugggacuuggcaaccacuuucccagaaaaaaaaaaacguugggagaaaugauauaua

SEQ ID NO: 28971 - RNA, 64 nt, Homo Sapiens
cuuacacuugggacuuggcaaccacuuucccagaaaaaaaaaaauguugggagaaaugauauau

SEQ ID NO: 28972 - RNA, 64 nt, Homo Sapiens
acuuacacuugggacuuggcuaccacuuucccagaaaaaaaaaaauguugggagaaaugauaua

SEQ ID NO: 28973 - RNA, 64 nt, Homo Sapiens
uuugguaccaaagauuacacaaaauaggccgggaaaaaaaaaucuccaugucaucagagauggu

SEQ ID NO: 28974 - RNA, 64 nt, Homo Sapiens
cuuugguaccaaagauuacauaaaauaggccgggaaaaaaaaauuuccaugucaucagagaugg

SEQ ID NO: 28975 - RNA, 64 nt, Homo Sapiens
aacccauccauagaaauaguuaauuuagaggaagaaaaaaaaucuauauuagucuagggccacu

SEQ ID NO: 28976 - RNA, 64 nt, Homo Sapiens
uuguuucuauccccauuacaaaaaauuuacauuuaaaaaaaauggaaaaaaggcccacaauuag

SEQ ID NO: 28977 - RNA, 64 nt, Homo Sapiens
auuuuuaauauagagucaaacuucuuucucuuuaaaaaaaaauuuuaguuuuuaacuucaaagg

SEQ ID NO: 28978 - RNA, 64 nt, Homo Sapiens
uauuuuuaauauagagucaagcuucuuucucuuuaaaaaaaaauuuuaguuuuuaacuucaaag

SEQ ID NO: 28979 - RNA, 64 nt, Homo Sapiens
uuucaacaaacugacuuuacuuucuuguagaauaaaaaaaaaucaacaggauugcaccuaucaa

SEQ ID NO: 28980 - RNA, 64 nt, Homo Sapiens
cuuucaacaaacugacuuuaauuucuuguagaauaaaaaaaaauuaacaggauugcaccuauca

SEQ ID NO: 28981 - RNA, 64 nt, Homo Sapiens
cauucuaguaaaucgaaugucaucucaaaaaagaaaaaaaaaggugagcaacagagugagaccc

SEQ ID NO: 28982 - RNA, 64 nt, Homo Sapiens
gcauucuaguaaaucgaaugccaucucaaaaaagaaaaaaaaagcugagcaacagagugagacc

SEQ ID NO: 28983 - RNA, 64 nt, Homo Sapiens
auuaggcugcagaggcaagaaaaaauaaaaauuaaaaaaaaauucaagauccccaacucuacaa

SEQ ID NO: 28984 - RNA, 64 nt, Homo Sapiens
uauuaggcugcagaggcaagaaaaaauaaaaauuaaaaaaaaaugcaagauccccaacucuaca

SEQ ID NO: 28985 - RNA, 64 nt, Homo Sapiens
auucauugauaauucuaacuauuuaaaaagacaaaaaaaaaagacauuuuuuaaaaucaagaaa

SEQ ID NO: 28986 - RNA, 64 nt, Homo Sapiens
aauucauugauaauucuaacaauuuaaaaagacaaaaaaaaaagacauuuuuuaaaaucaagaa

SEQ ID NO: 28987 - RNA, 64 nt, Homo Sapiens
gaauucauugauaauucuaaaaauuuaaaaagacaaaaaaaaaauacauuuuuuaaaaucaaga

SEQ ID NO: 28988 - RNA, 64 nt, Homo Sapiens
uggugagaagcucgcuccuuuaucauuaaggagaaaaaaaaauacagugagcuguuuauuuaaa

SEQ ID NO: 28989 - RNA, 64 nt, Homo Sapiens
auggugagaagcucgcuccuauaucauuaaggagaaaaaaaaauacagugagcuguuuauuuaa

SEQ ID NO: 28990 - RNA, 64 nt, Homo Sapiens
guguccuguuuugcacauaguuucaaaauagaaaaaaaaaaacuguauauuuagguaacuagaa

SEQ ID NO: 28991 - RNA, 64 nt, Homo Sapiens
uguguccuguuuugcacauaauuucaaaauagaaaaaaaaaaacuguauauuuagguaacuaga

SEQ ID NO: 28992 - RNA, 64 nt, Homo Sapiens
cuguguccuguuuugcacauaauuucaaaauagaaaaaaaaaaacuguauauuuagguaacuag

SEQ ID NO: 28993 - RNA, 64 nt, Homo Sapiens
acuguguccuguuuugcacagaauuucaaaauagaaaaaaaaaaacuguauauuuagguaacua

SEQ ID NO: 28994 - RNA, 64 nt, Homo Sapiens
uacuucuccaaaguguucucaaaaaaaaaaaaaaaaaaaaaagaagacuccgucucaaaaaaaa

SEQ ID NO: 28995 - RNA, 64 nt, Homo Sapiens
auacuucuccaaaguguucuaaaaaaaaaaaaaaaaaaaaaaagaagacuccgucucaaaaaaa

SEQ ID NO: 28996 - RNA, 64 nt, Homo Sapiens
gauacuucuccaaaguguucaaaaaaaaaaaaaaaaaaaaaaaacaagacuccgucucaaaaaa

SEQ ID NO: 28997 - RNA, 64 nt, Homo Sapiens
agauacuucuccaaaguguuaaaaaaaaaaaaaaaaaaaaaaaagcaagacuccgucucaaaaa

SEQ ID NO: 28998 - RNA, 64 nt, Homo Sapiens
aagauacuucuccaaaguguaaaaaaaaaaaaaaaaaaaaaaaaagcaagacuccgucucaaaa

SEQ ID NO: 28999 - RNA, 64 nt, Homo Sapiens
aaagauacuucuccaaagugaaaaaaaaaaaaaaaaaaaaaaaagagcaagacuccgucucaaa

SEQ ID NO: 29000 - RNA, 64 nt, Homo Sapiens
aaaagauacuucuccaaaguaaaaaaaaaaaaaaaaaaaaaaaaagagcaagacuccgucucaa

SEQ ID NO: 29001 - RNA, 64 nt, Homo Sapiens
aaaaagauacuucuccaaagaaaaaaaaaaaaaaaaaaaaaaaacagagcaagacuccgucuca

SEQ ID NO: 29002 - RNA, 64 nt, Homo Sapiens
aaaaaagauacuucuccaaaaaaaaaaaaaaaaaaaaaaaaaaaacagagcaagacuccgucuc

SEQ ID NO: 29003 - RNA, 64 nt, Homo Sapiens
aaaaaaagauacuucuccaacaaaaaaaaaaaaaaaaaaaaaaagacagagcaagacuccgucu

SEQ ID NO: 29004 - RNA, 64 nt, Homo Sapiens
aaaaaaaagauacuucuccaucaaaaaaaaaaaaaaaaaaaaaacgacagagcaagacuccguc

SEQ ID NO: 29005 - RNA, 64 nt, Homo Sapiens
aaaaaaaaagauacuucucccucaaaaaaaaaaaaaaaaaaaaagcgacagagcaagacuccgu

SEQ ID NO: 29006 - RNA, 64 nt, Homo Sapiens
aaaaaaaaaagauacuucucucucaaaaaaaaaaaaaaaaaaaaggcgacagagcaagacuccg

SEQ ID NO: 29007 - RNA, 64 nt, Homo Sapiens
aaaaaaaaaaagauacuucugucucaaaaaaaaaaaaaaaaaaagggcgacagagcaagacucc

SEQ ID NO: 29008 - RNA, 64 nt, Homo Sapiens
aaaaaaaaaaaagauacuuccgucucaaaaaaaaaaaaaaaaaaugggcgacagagcaagacuc

SEQ ID NO: 29009 - RNA, 64 nt, Homo Sapiens
aaaaaaaaaaaaagauacuuccgucucaaaaaaaaaaaaaaaaacugggcgacagagcaagacu

SEQ ID NO: 29010 - RNA, 64 nt, Homo Sapiens
aaaaaaaaaaaaaagauacuuccgucucaaaaaaaaaaaaaaaaccugggcgacagagcaagac

SEQ ID NO: 29011 - RNA, 64 nt, Homo Sapiens
aaaaaaaaaaaaaaagauaccuccgucucaaaaaaaaaaaaaaagccugggcgacagagcaaga

SEQ ID NO: 29012 - RNA, 64 nt, Homo Sapiens
aaaaaaaaaaaaaaaagauaacuccgucucaaaaaaaaaaaaaaagccugggcgacagagcaag

SEQ ID NO: 29013 - RNA, 64 nt, Homo Sapiens
aaaaaaaaaaaaaaaaagaugacuccgucucaaaaaaaaaaaaacagccugggcgacagagcaa

SEQ ID NO: 29014 - RNA, 64 nt, Homo Sapiens
aaaaaaaaaaaaaaaaaagaagacuccgucucaaaaaaaaaaaaccagccugggcgacagagca

SEQ ID NO: 29015 - RNA, 64 nt, Homo Sapiens
aaaaaaaaaaaaaaaaaaagaagacuccgucucaaaaaaaaaaauccagccugggcgacagagc

SEQ ID NO: 29016 - RNA, 64 nt, Homo Sapiens
aaaaaaaaaaaaaaaaaaaacaagacuccgucucaaaaaaaaaacuccagccugggcgacagag

SEQ ID NO: 29017 - RNA, 64 nt, Homo Sapiens
uuauaaucucaaaugcuagugaaauuuuugauuaaaaaaaaauuaaaucacucacuuuauuuug

SEQ ID NO: 29018 - RNA, 64 nt, Homo Sapiens
uuuauaaucucaaaugcuagggaaauuuuugauuaaaaaaaaaugaaaucacucacuuuauuuu

SEQ ID NO: 29019 - RNA, 64 nt, Homo Sapiens
aaaaagacgucggagaaaagaaaaaaaaaaaaaaaaaaaaaagcucugcccuccaaaaagacaa

SEQ ID NO: 29020 - RNA, 64 nt, Homo Sapiens
caaaaagacgucggagaaaaaaaaaaaaaaaaaaaaaaaaaaagcucugcccuccaaaaagaca

SEQ ID NO: 29021 - RNA, 64 nt, Homo Sapiens
gcaaaaagacgucggagaaaaaaaaaaaaaaaaaaaaaaaaaaaacucugcccuccaaaaagac

SEQ ID NO: 29022 - RNA, 64 nt, Homo Sapiens
agcaaaaagacgucggagaacaaaaaaaaaaaaaaaaaaaaaaacacucugcccuccaaaaaga

SEQ ID NO: 29023 - RNA, 64 nt, Homo Sapiens
aagcaaaaagacgucggagaacaaaaaaaaaaaaaaaaaaaaaaccacucugcccuccaaaaag

SEQ ID NO: 29024 - RNA, 64 nt, Homo Sapiens
aaagcaaaaagacgucggaggacaaaaaaaaaaaaaaaaaaaaacccacucugcccuccaaaaa

SEQ ID NO: 29025 - RNA, 64 nt, Homo Sapiens
aaaagcaaaaagacgucggaagacaaaaaaaaaaaaaaaaaaaaccccacucugcccuccaaaa

SEQ ID NO: 29026 - RNA, 64 nt, Homo Sapiens
aaaaagcaaaaagacgucggaagacaaaaaaaaaaaaaaaaaaaaccccacucugcccuccaaa

SEQ ID NO: 29027 - RNA, 64 nt, Homo Sapiens
aaaaaagcaaaaagacgucgaaagacaaaaaaaaaaaaaaaaaagaccccacucugcccuccaa

SEQ ID NO: 29028 - RNA, 64 nt, Homo Sapiens
aaaaaaagcaaaaagacgucaaaagacaaaaaaaaaaaaaaaaaggaccccacucugcccucca

SEQ ID NO: 29029 - RNA, 64 nt, Homo Sapiens
aaaaaaaagcaaaaagacguaaaaagacaaaaaaaaaaaaaaaacggaccccacucugcccucc

SEQ ID NO: 29030 - RNA, 64 nt, Homo Sapiens
aaaaaaaaagcaaaaagacgcaaaaagacaaaaaaaaaaaaaaaccggaccccacucugcccuc

SEQ ID NO: 29031 - RNA, 64 nt, Homo Sapiens
aaaaaaaaaagcaaaaagacccaaaaagacaaaaaaaaaaaaaauccggaccccacucugcccu

SEQ ID NO: 29032 - RNA, 64 nt, Homo Sapiens
aaaaaaaaaaagcaaaaagauccaaaaagacaaaaaaaaaaaaauuccggaccccacucugccc

SEQ ID NO: 29033 - RNA, 64 nt, Homo Sapiens
aaaaaaaaaaaagcaaaaagcuccaaaaagacaaaaaaaaaaaauuuccggaccccacucugcc

SEQ ID NO: 29034 - RNA, 64 nt, Homo Sapiens
aaaaaaaaaaaaagcaaaaaccuccaaaaagacaaaaaaaaaaauuuuccggaccccacucugc

SEQ ID NO: 29035 - RNA, 64 nt, Homo Sapiens
aaaaaaaaaaaaaagcaaaacccuccaaaaagacaaaaaaaaaacuuuuccggaccccacucug

SEQ ID NO: 29036 - RNA, 64 nt, Homo Sapiens
cccuucacuccuacugggagucaguuuaaaagaaaaaaaaaauccugcaccauguaccccaccu

SEQ ID NO: 29037 - RNA, 64 nt, Homo Sapiens
ccccuucacuccuacugggauucaguuuaaaagaaaaaaaaaaugcugcaccauguaccccacc

SEQ ID NO: 29038 - RNA, 64 nt, Homo Sapiens
uccccuucacuccuacugggcuucaguuuaaaagaaaaaaaaaaagcugcaccauguaccccac

SEQ ID NO: 29039 - RNA, 64 nt, Homo Sapiens
cuuucuuucucacaggcauaaaaaaaaaaaaaaaaaaaaaaagcaaaaaaaaaaaaaaaaaaaa

SEQ ID NO: 29040 - RNA, 64 nt, Homo Sapiens
ccuuucuuucucacaggcauaaaaaaaaaaaaaaaaaaaaaaagaaaaaaaaaaaaaaaaaaaa

SEQ ID NO: 29041 - RNA, 64 nt, Homo Sapiens
gccuuucuuucucacaggcaaaaaaaaaaaaaaaaaaaaaaaaauaaaaaaaaaaaaaaaaaaa

SEQ ID NO: 29042 - RNA, 64 nt, Homo Sapiens
agccuuucuuucucacaggcaaaaaaaaaaaaaaaaaaaaaaaauuaaaaaaaaaaaaaaaaaa

SEQ ID NO: 29043 - RNA, 64 nt, Homo Sapiens
aagccuuucuuucucacaggaaaaaaaaaaaaaaaaaaaaaaaaauuaaaaaaaaaaaaaaaaa

SEQ ID NO: 29044 - RNA, 64 nt, Homo Sapiens
aaagccuuucuuucucacagaaaaaaaaaaaaaaaaaaaaaaaagauuaaaaaaaaaaaaaaaa

SEQ ID NO: 29045 - RNA, 64 nt, Homo Sapiens
aaaagccuuucuuucucacaaaaaaaaaaaaaaaaaaaaaaaaaagauuaaaaaaaaaaaaaaa

SEQ ID NO: 29046 - RNA, 64 nt, Homo Sapiens
aaaaagccuuucuuucucacaaaaaaaaaaaaaaaaaaaaaaaacagauuaaaaaaaaaaaaaa

SEQ ID NO: 29047 - RNA, 64 nt, Homo Sapiens
aaaaaagccuuucuuucucaaaaaaaaaaaaaaaaaaaaaaaaagcagauuaaaaaaaaaaaaa

SEQ ID NO: 29048 - RNA, 64 nt, Homo Sapiens
aaaaaaagccuuucuuucucaaaaaaaaaaaaaaaaaaaaaaaaugcagauuaaaaaaaaaaaa

SEQ ID NO: 29049 - RNA, 64 nt, Homo Sapiens
aaaaaaaagccuuucuuucuaaaaaaaaaaaaaaaaaaaaaaaauugcagauuaaaaaaaaaaa

SEQ ID NO: 29050 - RNA, 64 nt, Homo Sapiens
aaaaaaaaagccuuucuuucaaaaaaaaaaaaaaaaaaaaaaaauuugcagauuaaaaaaaaaa

SEQ ID NO: 29051 - RNA, 64 nt, Homo Sapiens
aaaaaaaaaagccuuucuuuaaaaaaaaaaaaaaaaaaaaaaaacuuugcagauuaaaaaaaaa

SEQ ID NO: 29052 - RNA, 64 nt, Homo Sapiens
aaaaaaaaaaagccuuucuuaaaaaaaaaaaaaaaaaaaaaaaaacuuugcagauuaaaaaaaa

SEQ ID NO: 29053 - RNA, 64 nt, Homo Sapiens
aaaaaaaaaaaagccuuucuaaaaaaaaaaaaaaaaaaaaaaaagacuuugcagauuaaaaaaa

SEQ ID NO: 29054 - RNA, 64 nt, Homo Sapiens
aaaaaaaaaaaaagccuuucaaaaaaaaaaaaaaaaaaaaaaaaggacuuugcagauuaaaaaa

SEQ ID NO: 29055 - RNA, 64 nt, Homo Sapiens
aaaaaaaaaaaaaagccuuuaaaaaaaaaaaaaaaaaaaaaaaaaggacuuugcagauuaaaaa

SEQ ID NO: 29056 - RNA, 64 nt, Homo Sapiens
aaaaaaaaaaaaaaagccuuaaaaaaaaaaaaaaaaaaaaaaaaaaggacuuugcagauuaaaa

SEQ ID NO: 29057 - RNA, 64 nt, Homo Sapiens
aaaaaaaaaaaaaaaagccuaaaaaaaaaaaaaaaaaaaaaaaaaaaggacuuugcagauuaaa

SEQ ID NO: 29058 - RNA, 64 nt, Homo Sapiens
aaaaaaaaaaaaaaaaagccaaaaaaaaaaaaaaaaaaaaaaaacaaaggacuuugcagauuaa

SEQ ID NO: 29059 - RNA, 64 nt, Homo Sapiens
aaaaaaaaaaaaaaaaaagcaaaaaaaaaaaaaaaaaaaaaaaagcaaaggacuuugcagauua

SEQ ID NO: 29060 - RNA, 64 nt, Homo Sapiens
aaaaaaaaaaaaaaaaaaagaaaaaaaaaaaaaaaaaaaaaaaaugcaaaggacuuugcagauu

SEQ ID NO: 29061 - RNA, 64 nt, Homo Sapiens
aaaaaaaaaaaaaaaaaaaauaaaaaaaaaaaaaaaaaaaaaaagugcaaaggacuuugcagau

SEQ ID NO: 29062 - RNA, 64 nt, Homo Sapiens
aaaaaaaaaaaaaaaaaaaauuaaaaaaaaaaaaaaaaaaaaaaugugcaaaggacuuugcaga

SEQ ID NO: 29063 - RNA, 64 nt, Homo Sapiens
aaaaaaaaaaaaaaaaaaaaauuaaaaaaaaaaaaaaaaaaaaauugugcaaaggacuuugcag

SEQ ID NO: 29064 - RNA, 64 nt, Homo Sapiens
aaaaaaaaaaaaaaaaaaaagauuaaaaaaaaaaaaaaaaaaaacuugugcaaaggacuuugca

SEQ ID NO: 29065 - RNA, 64 nt, Homo Sapiens
aaaaaaaaaaaaaaaaaaaaagauuaaaaaaaaaaaaaaaaaaaacuugugcaaaggacuuugc

SEQ ID NO: 29066 - RNA, 64 nt, Homo Sapiens
aaaaaaaaaaaaaaaaaaaacagauuaaaaaaaaaaaaaaaaaagacuugugcaaaggacuuug

SEQ ID NO: 29067 - RNA, 64 nt, Homo Sapiens
aaaaaaaaaaaaaaaaaaaagcagauuaaaaaaaaaaaaaaaaaagacuugugcaaaggacuuu

SEQ ID NO: 29068 - RNA, 64 nt, Homo Sapiens
aaaaaaaaaaaaaaaaaaaaugcagauuaaaaaaaaaaaaaaaagagacuugugcaaaggacuu

SEQ ID NO: 29069 - RNA, 64 nt, Homo Sapiens
aaaaaaaaaaaaaaaaaaaauugcagauuaaaaaaaaaaaaaaaggagacuugugcaaaggacu

SEQ ID NO: 29070 - RNA, 64 nt, Homo Sapiens
aaaaaaaaaaaaaaaaaaaauuugcagauuaaaaaaaaaaaaaagggagacuugugcaaaggac

SEQ ID NO: 29071 - RNA, 64 nt, Homo Sapiens
aaaaaaaaaaaaaaaaaaaacuuugcagauuaaaaaaaaaaaaaugggagacuugugcaaagga

SEQ ID NO: 29072 - RNA, 64 nt, Homo Sapiens
aaaaaaaaaaaaaaaaaaaaacuuugcagauuaaaaaaaaaaaauugggagacuugugcaaagg

SEQ ID NO: 29073 - RNA, 64 nt, Homo Sapiens
aaaaaaaaaaaaaaaaaaaagacuuugcagauuaaaaaaaaaaaguugggagacuugugcaaag

SEQ ID NO: 29074 - RNA, 64 nt, Homo Sapiens
aaaaaaaaaaaaaaaaaaaaggacuuugcagauuaaaaaaaaaaaguugggagacuugugcaaa

SEQ ID NO: 29075 - RNA, 64 nt, Homo Sapiens
agccuuuggcuuguucuguguacaauaaacugaaaaaaaaaacuaccagugaaaugugugugua

SEQ ID NO: 29076 - RNA, 64 nt, Homo Sapiens
uagccuuuggcuuguucuguauacaauaaacugaaaaaaaaaaccaccagugaaaugugugugu

SEQ ID NO: 29077 - RNA, 64 nt, Homo Sapiens
cuagccuuuggcuuguucuguauacaauaaacugaaaaaaaaaaccaccagugaaaugugugug

SEQ ID NO: 29078 - RNA, 64 nt, Homo Sapiens
accaccagugaaauguguguuguacagacuuuuuaaaaaaaacaguuuguauugucuugucaau

SEQ ID NO: 29079 - RNA, 64 nt, Homo Sapiens
ggugggggggaaugggccaauuuugcaucaguuaaaaaaaaaggccuuucucugggauucaaau

SEQ ID NO: 29080 - RNA, 64 nt, Homo Sapiens
gggugggggggaaugggccauuuuugcaucaguuaaaaaaaaagaccuuucucugggauucaaa

SEQ ID NO: 29081 - RNA, 64 nt, Homo Sapiens
agaagaagaaggagagcaagaucuuugacugaaaaaaaaaaagauaaauuccauaugcuccagg

SEQ ID NO: 29082 - RNA, 64 nt, Homo Sapiens
aagaagaagaaggagagcaagaucuuugacugaaaaaaaaaaaguuaaauuccauaugcuccag

SEQ ID NO: 29083 - RNA, 64 nt, Homo Sapiens
gaagaagaagaaggagagcaggaucuuugacugaaaaaaaaaaaguuaaauuccauaugcucca

SEQ ID NO: 29084 - RNA, 64 nt, Homo Sapiens
agaagaagaagaaggagagcaggaucuuugacugaaaaaaaaaagguuaaauuccauaugcucc

SEQ ID NO: 29085 - RNA, 64 nt, Homo Sapiens
gagagagagagaggugugagagaugcauuuaauaaaaaaaaagauuuuuaaucuacuuuugcua

SEQ ID NO: 29086 - RNA, 64 nt, Homo Sapiens
agagagagagagaggugugaaagaugcauuuaauaaaaaaaaaguuuuuuaaucuacuuuugcu

SEQ ID NO: 29087 - RNA, 64 nt, Homo Sapiens
uuuuuaaagaaaacuguuccuauuuuuguaugaaaaaaaaaauuaauuguuuugcaaauggauc

SEQ ID NO: 29088 - RNA, 64 nt, Homo Sapiens
uuuuuuaaagaaaacuguuccuauuuuuguaugaaaaaaaaaauaaauuguuuugcaaauggau

SEQ ID NO: 29089 - RNA, 64 nt, Homo Sapiens
uuuuuuuaaagaaaacuguuucuauuuuuguaugaaaaaaaaaagaaauuguuuugcaaaugga

SEQ ID NO: 29090 - RNA, 64 nt, Homo Sapiens
ucauauuuuguauauaucugugucaaaaaaaaaaaaaaaaaagcacucaaaucuccaguauucu

SEQ ID NO: 29091 - RNA, 64 nt, Homo Sapiens
cucauauuuuguauauaucuuugucaaaaaaaaaaaaaaaaaaggacucaaaucuccaguauuc

SEQ ID NO: 29092 - RNA, 64 nt, Homo Sapiens
gcucauauuuuguauauauccuugucaaaaaaaaaaaaaaaaaaugacucaaaucuccaguauu

SEQ ID NO: 29093 - RNA, 64 nt, Homo Sapiens
agcucauauuuuguauauauucuugucaaaaaaaaaaaaaaaaauugacucaaaucuccaguau

SEQ ID NO: 29094 - RNA, 64 nt, Homo Sapiens
aagcucauauuuuguauauauucuugucaaaaaaaaaaaaaaaaauugacucaaaucuccagua

SEQ ID NO: 29095 - RNA, 64 nt, Homo Sapiens
aaagcucauauuuuguauauauucuugucaaaaaaaaaaaaaaaaauugacucaaaucuccagu

SEQ ID NO: 29096 - RNA, 64 nt, Homo Sapiens
aaaagcucauauuuuguauauauucuugucaaaaaaaaaaaaaaaaauugacucaaaucuccag

SEQ ID NO: 29097 - RNA, 64 nt, Homo Sapiens
aaaaagcucauauuuuguauguauucuugucaaaaaaaaaaaaaaaaauugacucaaaucucca

SEQ ID NO: 29098 - RNA, 64 nt, Homo Sapiens
aaaaaagcucauauuuuguaaguauucuugucaaaaaaaaaaaaaaaaauugacucaaaucucc

SEQ ID NO: 29099 - RNA, 64 nt, Homo Sapiens
aaaaaaagcucauauuuugucaguauucuugucaaaaaaaaaaacaaaaauugacucaaaucuc

SEQ ID NO: 29100 - RNA, 64 nt, Homo Sapiens
aaaaaaaagcucauauuuugccaguauucuugucaaaaaaaaaaacaaaaauugacucaaaucu

SEQ ID NO: 29101 - RNA, 64 nt, Homo Sapiens
aaaugaagagugggaaggcaugguccucuggaaaaaaaaaaaugguaauauguaaacugugauu

SEQ ID NO: 29102 - RNA, 64 nt, Homo Sapiens
gaaaugaagagugggaaggcuugguccucuggaaaaaaaaaaauuguaauauguaaacugugau

SEQ ID NO: 29103 - RNA, 64 nt, Homo Sapiens
ugaaaugaagagugggaagguuugguccucuggaaaaaaaaaaaauguaauauguaaacuguga

SEQ ID NO: 29104 - RNA, 64 nt, Homo Sapiens
augaaaugaagagugggaagauuugguccucuggaaaaaaaaaaaauguaauauguaaacugug

SEQ ID NO: 29105 - RNA, 62 nt, Homo Sapiens
gccucucuguccuaugaagaaaaaagaaaaagaaaaaaaaaagaccaaaccauccaaaugcc

SEQ ID NO: 29106 - RNA, 63 nt, Homo Sapiens
gccucucuguccuaugaagacaaaaagaaaaagaaaaaaaaaaugaccaaaccauccaaaugc

SEQ ID NO: 29107 - RNA, 64 nt, Homo Sapiens
gccucucuguccuaugaagaccaaaaagaaaaagaaaaaaaaaauugaccaaaccauccaaaug

SEQ ID NO: 29108 - RNA, 64 nt, Homo Sapiens
auauuugucacagaaauuuauguucuugguauuaaaaaaaaagcacucugcauuaacucuauaa

SEQ ID NO: 29109 - RNA, 64 nt, Homo Sapiens
cauauuugucacagaaauuuauguucuugguauuaaaaaaaaaggacucugcauuaacucuaua

SEQ ID NO: 29110 - RNA, 64 nt, Homo Sapiens
aauaagacauggauacaacccccaucucuaaaaaaaaaaaaauucuggccaacacagcgagacc

SEQ ID NO: 29111 - RNA, 64 nt, Homo Sapiens
uaauaagacauggauacaacccccaucucuaaaaaaaaaaaaauacuggccaacacagcgagac

SEQ ID NO: 29112 - RNA, 64 nt, Homo Sapiens
uuaauaagacauggauacaacccccaucucuaaaaaaaaaaaaagacuggccaacacagcgaga

SEQ ID NO: 29113 - RNA, 64 nt, Homo Sapiens
auuaauaagacauggauacaacccccaucucuaaaaaaaaaaaaagacuggccaacacagcgag

SEQ ID NO: 29114 - RNA, 64 nt, Homo Sapiens
aauuaauaagacauggauacgacccccaucucuaaaaaaaaaaacagacuggccaacacagcga

SEQ ID NO: 29115 - RNA, 64 nt, Homo Sapiens
aaauuaauaagacauggauaagacccccaucucuaaaaaaaaaaccagacuggccaacacagcg

SEQ ID NO: 29116 - RNA, 64 nt, Homo Sapiens
gagguuguauucucagugucuguuuuggacuaaaaaaaaaaauacucaacaaaaccaaucuaca

SEQ ID NO: 29117 - RNA, 64 nt, Homo Sapiens
agagguuguauucucaguguauguuuuggacuaaaaaaaaaaauacucaacaaaaccaaucuac

SEQ ID NO: 29118 - RNA, 64 nt, Homo Sapiens
uagagguuguauucucagugcauguuuuggacuaaaaaaaaaaacacucaacaaaaccaaucua

SEQ ID NO: 29119 - RNA, 64 nt, Homo Sapiens
auagagguuguauucucaguacauguuuuggacuaaaaaaaaaaacacucaacaaaaccaaucu

SEQ ID NO: 29120 - RNA, 64 nt, Homo Sapiens
cuagaauucuuuguugaaagaguugguaugagaaaaaaaaaagccuuaaaauauauucuggguc

SEQ ID NO: 29121 - RNA, 64 nt, Homo Sapiens
ccuagaauucuuuguugaaacaguugguaugagaaaaaaaaaagucuuaaaauauauucugggu

SEQ ID NO: 29122 - RNA, 64 nt, Homo Sapiens
gccuagaauucuuuguugaaucaguugguaugagaaaaaaaaaauucuuaaaauauauucuggg

SEQ ID NO: 29123 - RNA, 64 nt, Homo Sapiens
auacauaugugauuauggcuuuuuuguccaagaaaaaaaaaagcguuuuuuauaaaaauauaua

SEQ ID NO: 29124 - RNA, 64 nt, Homo Sapiens
cauacauaugugauuauggcauuuuuguccaagaaaaaaaaaagaguuuuuuauaaaaauauau

SEQ ID NO: 29125 - RNA, 64 nt, Homo Sapiens
gcauacauaugugauuaugguauuuuuguccaagaaaaaaaaaacaguuuuuuauaaaaauaua

SEQ ID NO: 29126 - RNA, 64 nt, Homo Sapiens
ggaaugccaguuagauuuuuaaaaaaggaaaaaaaaaaaaaauaaguaaaaaaaaaaaaaaaga

SEQ ID NO: 29127 - RNA, 64 nt, Homo Sapiens
aggaaugccaguuagauuuuaaaaaaaggaaaaaaaaaaaaaauaaguaaaaaaaaaaaaaaag

SEQ ID NO: 29128 - RNA, 64 nt, Homo Sapiens
uaggaaugccaguuagauuugaaaaaaaggaaaaaaaaaaaaaaaaaguaaaaaaaaaaaaaaa

SEQ ID NO: 29129 - RNA, 64 nt, Homo Sapiens
auaggaaugccaguuagauuagaaaaaaaggaaaaaaaaaaaaaaaaaguaaaaaaaaaaaaaa

SEQ ID NO: 29130 - RNA, 64 nt, Homo Sapiens
gcuuguaugggacagaauagaagaaaaaaaggaaaaaaaaaaaaaaaaaguaaaaaaaaaaaaa

SEQ ID NO: 29131 - RNA, 64 nt, Homo Sapiens
agcuuguaugggacagaauaaaagaaaaaaaggaaaaaaaaaaaaaaaaaguaaaaaaaaaaaa

SEQ ID NO: 29132 - RNA, 64 nt, Homo Sapiens
aagcuuguaugggacagaauaaaagaaaaaaaggaaaaaaaaaacaaaaaaguaaaaaaaaaaa

SEQ ID NO: 29133 - RNA, 64 nt, Homo Sapiens
aaaaaaggaaaaaaaaaaaaaaaaaguaaaaaaaaaaaaaaagaaugaaguggugauauuuaca

SEQ ID NO: 29134 - RNA, 64 nt, Homo Sapiens
aaaaaaaggaaaaaaaaaaaaaaaaaguaaaaaaaaaaaaaaagaaugaaguggugauauuuac

SEQ ID NO: 29135 - RNA, 64 nt, Homo Sapiens
gaaaaaaaggaaaaaaaaaacaaaaaaguaaaaaaaaaaaaaaagaaugaaguggugauauuua

SEQ ID NO: 29136 - RNA, 64 nt, Homo Sapiens
agaaaaaaaggaaaaaaaaaacaaaaaaguaaaaaaaaaaaaaaagaaugaaguggugauauuu

SEQ ID NO: 29137 - RNA, 64 nt, Homo Sapiens
aagaaaaaaaggaaaaaaaauacaaaaaaguaaaaaaaaaaaaaaagaaugaaguggugauauu

SEQ ID NO: 29138 - RNA, 64 nt, Homo Sapiens
aaagaaaaaaaggaaaaaaauuacaaaaaaguaaaaaaaaaaaagaagaaugaaguggugauau

SEQ ID NO: 29139 - RNA, 64 nt, Homo Sapiens
aaaagaaaaaaaggaaaaaauuuacaaaaaaguaaaaaaaaaaaggaagaaugaaguggugaua

SEQ ID NO: 29140 - RNA, 64 nt, Homo Sapiens
aaaaagaaaaaaaggaaaaaauuuacaaaaaaguaaaaaaaaaaaggaagaaugaaguggugau

SEQ ID NO: 29141 - RNA, 64 nt, Homo Sapiens
auugaaauuaaaauucagcugacccugucucaaaaaaaaaaaugcagccuaggugacagaauga

SEQ ID NO: 29142 - RNA, 64 nt, Homo Sapiens
gauugaaauuaaaauucagcagacccugucucaaaaaaaaaaauccagccuaggugacagaaug

SEQ ID NO: 29143 - RNA, 64 nt, Homo Sapiens
ugauugaaauuaaaauucaggagacccugucucaaaaaaaaaaaaccagccuaggugacagaau

SEQ ID NO: 29144 - RNA, 64 nt, Homo Sapiens
augauugaaauuaaaauucaugagacccugucucaaaaaaaaaauaccagccuaggugacagaa

SEQ ID NO: 29145 - RNA, 64 nt, Homo Sapiens
uaaaauuagccaggcguggugaccccgucucuacaaaaaaaauucagccugggaaacauaacaa

SEQ ID NO: 29146 - RNA, 64 nt, Homo Sapiens
agcccauccuuugaggcugaaaggggguuuaaaaaaaaaaaaccgggucauuaaaaccagcuca

SEQ ID NO: 29147 - RNA, 64 nt, Homo Sapiens
cagcccauccuuugaggcugaaaggggguuuaaaaaaaaaaaacugggucauuaaaaccagcuc

SEQ ID NO: 29148 - RNA, 64 nt, Homo Sapiens
ccagcccauccuuugaggcucaaaggggguuuaaaaaaaaaaaacugggucauuaaaaccagcu

SEQ ID NO: 29149 - RNA, 64 nt, Homo Sapiens
accagcccauccuuugaggcucaaaggggguuuaaaaaaaaaaaacugggucauuaaaaccagc

SEQ ID NO: 29150 - RNA, 64 nt, Homo Sapiens
aaccagcccauccuuugaggcucaaaggggguuuaaaaaaaaaaaacugggucauuaaaaccag

SEQ ID NO: 29151 - RNA, 64 nt, Homo Sapiens
cuccaaccugggcaacagaguaagaccuugucuuaaaaaaaaauaaaaacauaaaaaaaaauaa

SEQ ID NO: 29152 - RNA, 64 nt, Homo Sapiens
uccaaccugggcaacagaguaagaccuugucuuaaaaaaaaauaaaaacauaaaaaaaaauaaa

SEQ ID NO: 29153 - RNA, 64 nt, Homo Sapiens
uauauuaaaaaaccacuuuuagaugguuuuuuuuaaaaaaaaaaaaaaaacugguaaaauuacu

SEQ ID NO: 29154 - RNA, 64 nt, Homo Sapiens
auauuaaaaaaccacuuuuagaugguuuuuuuuaaaaaaaaaaaaaaaacugguaaaauuacuu

SEQ ID NO: 29155 - RNA, 64 nt, Homo Sapiens
uauuaaaaaaccacuuuuagaugguuuuuuuuaaaaaaaaaaaaaaaacugguaaaauuacuuu

SEQ ID NO: 29156 - RNA, 64 nt, Homo Sapiens
auuaaaaaaccacuuuuagaugguuuuuuuuaaaaaaaaaaaaaaaacugguaaaauuacuuuu

SEQ ID NO: 29157 - RNA, 64 nt, Homo Sapiens
uuaaaaaaccacuuuuagaugguuuuuuuuaaaaaaaaaaaaaaaacugguaaaauuacuuuug

SEQ ID NO: 29158 - RNA, 64 nt, Homo Sapiens
uaaaaaaccacuuuuagaugguuuuuuuuaaaaaaaaaaaaaaaacugguaaaauuacuuuugg

SEQ ID NO: 29159 - RNA, 64 nt, Homo Sapiens
aaaaaaccacuuuuagaugguuuuuuuuaaaaaaaaaaaaaaaacugguaaaauuacuuuuggc

SEQ ID NO: 29160 - RNA, 64 nt, Homo Sapiens
aaaaaccacuuuuagaugguuuuuuuuaaaaaaaaaaaaaaaacugguaaaauuacuuuuggca

SEQ ID NO: 29161 - RNA, 64 nt, Homo Sapiens
aaaaccacuuuuagaugguuuuuuuuaaaaaaaaaaaaaaaacugguaaaauuacuuuuggcag

SEQ ID NO: 29162 - RNA, 64 nt, Homo Sapiens
uaagugcagcauuuuugcaucugacauuuuaccuaaaaaaaaagacaccaaacuuggcagagag

SEQ ID NO: 29163 - RNA, 64 nt, Homo Sapiens
aagugcagcauuuuugcaucugacauuuuaccuaaaaaaaaagacaccaaacuuggcagagagg

SEQ ID NO: 29164 - RNA, 64 nt, Homo Sapiens
aaaaguuuucuaaccccugcucuagguuacggagaaaaaaaaaauggaauaauguucucugcua

SEQ ID NO: 29165 - RNA, 64 nt, Homo Sapiens
aaaguuuucuaaccccugcucuagguuacggagaaaaaaaaaauggaauaauguucucugcuac

SEQ ID NO: 29166 - RNA, 64 nt, Homo Sapiens
aaguuuucuaaccccugcucuagguuacggagaaaaaaaaaauggaauaauguucucugcuacu

SEQ ID NO: 29167 - RNA, 64 nt, Homo Sapiens
aucaaaaaacccuucaauagcauccuuaagauuuaaaaaaaaaaaaaaaaaaaaggaaaaaaaa

SEQ ID NO: 29168 - RNA, 64 nt, Homo Sapiens
ucaaaaaacccuucaauagcauccuuaagauuuaaaaaaaaaaaaaaaaaaaaggaaaaaaaag

SEQ ID NO: 29169 - RNA, 64 nt, Homo Sapiens
caaaaaacccuucaauagcauccuuaagauuuaaaaaaaaaaaaaaaaaaaaggaaaaaaaagu

SEQ ID NO: 29170 - RNA, 64 nt, Homo Sapiens
aaaaaacccuucaauagcauccuuaagauuuaaaaaaaaaaaaaaaaaaaaggaaaaaaaagug

SEQ ID NO: 29171 - RNA, 64 nt, Homo Sapiens
aaaaacccuucaauagcauccuuaagauuuaaaaaaaaaaaaaaaaaaaaggaaaaaaaaguga

SEQ ID NO: 29172 - RNA, 64 nt, Homo Sapiens
aaaacccuucaauagcauccuuaagauuuaaaaaaaaaaaaaaaaaaaaggaaaaaaaagugau

SEQ ID NO: 29173 - RNA, 64 nt, Homo Sapiens
aaacccuucaauagcauccuuaagauuuaaaaaaaaaaaaaaaaaaaaggaaaaaaaagugaug

SEQ ID NO: 29174 - RNA, 64 nt, Homo Sapiens
aacccuucaauagcauccuuaagauuuaaaaaaaaaaaaaaaaaaaaggaaaaaaaagugaugg

SEQ ID NO: 29175 - RNA, 64 nt, Homo Sapiens
acccuucaauagcauccuuaagauuuaaaaaaaaaaaaaaaaaaaaggaaaaaaaagugaugga

SEQ ID NO: 29176 - RNA, 64 nt, Homo Sapiens
cccuucaauagcauccuuaagauuuaaaaaaaaaaaaaaaaaaaaggaaaaaaaagugauggaa

SEQ ID NO: 29177 - RNA, 64 nt, Homo Sapiens
ccuucaauagcauccuuaagauuuaaaaaaaaaaaaaaaaaaaaggaaaaaaaagugauggaag

SEQ ID NO: 29178 - RNA, 64 nt, Homo Sapiens
cuucaauagcauccuuaagauuuaaaaaaaaaaaaaaaaaaaaggaaaaaaaagugauggaagc

SEQ ID NO: 29179 - RNA, 64 nt, Homo Sapiens
uucaauagcauccuuaagauuuaaaaaaaaaaaaaaaaaaaaggaaaaaaaagugauggaagcc

SEQ ID NO: 29180 - RNA, 64 nt, Homo Sapiens
uccuuaagauuuaaaaaaaaaaaaaaaaaaaaggaaaaaaaagugauggaagccguaagugcuu

SEQ ID NO: 29181 - RNA, 64 nt, Homo Sapiens
uuuucucuucauguuguaacaaaaaggaaaaaagaaaaaaaaaucccaucccuuuuguacauau

SEQ ID NO: 29182 - RNA, 64 nt, Homo Sapiens
uuucucuucauguuguaacaaaaaggaaaaaagaaaaaaaaaucccaucccuuuuguacauaug

SEQ ID NO: 29183 - RNA, 64 nt, Homo Sapiens
uaauuauuccaacacccaucugccaugcgauguuaaaaaaaaaaaaaaggaagaaaaauaacac

SEQ ID NO: 29184 - RNA, 64 nt, Homo Sapiens
aauuauuccaacacccaucugccaugcgauguuaaaaaaaaaaaaaaggaagaaaaauaacaca

SEQ ID NO: 29185 - RNA, 64 nt, Homo Sapiens
auuauuccaacacccaucugccaugcgauguuaaaaaaaaaaaaaaggaagaaaaauaacacag

SEQ ID NO: 29186 - RNA, 64 nt, Homo Sapiens
uuauuccaacacccaucugccaugcgauguuaaaaaaaaaaaaaaggaagaaaaauaacacagc

SEQ ID NO: 29187 - RNA, 64 nt, Homo Sapiens
uauuccaacacccaucugccaugcgauguuaaaaaaaaaaaaaaggaagaaaaauaacacagcu

SEQ ID NO: 29188 - RNA, 64 nt, Homo Sapiens
auuccaacacccaucugccaugcgauguuaaaaaaaaaaaaaaggaagaaaaauaacacagcua

SEQ ID NO: 29189 - RNA, 64 nt, Homo Sapiens
uuccaacacccaucugccaugcgauguuaaaaaaaaaaaaaaggaagaaaaauaacacagcuac

SEQ ID NO: 29190 - RNA, 64 nt, Homo Sapiens
acaugaugacuugugaacauuagggauuuaaaggaaaaaaaaaaagaauucuguuccccucaua

SEQ ID NO: 29191 - RNA, 64 nt, Homo Sapiens
caugaugacuugugaacauuagggauuuaaaggaaaaaaaaaaagaauucuguuccccucauau

SEQ ID NO: 29192 - RNA, 64 nt, Homo Sapiens
augaugacuugugaacauuagggauuuaaaggaaaaaaaaaaagaauucuguuccccucauauc

SEQ ID NO: 29193 - RNA, 64 nt, Homo Sapiens
ugaugacuugugaacauuagggauuuaaaggaaaaaaaaaaagaauucuguuccccucauauca

SEQ ID NO: 29194 - RNA, 64 nt, Homo Sapiens
aggaguuuacgaaaucugcuguuuuaucaaagugaaaaaaaauugcuuauuacucuucauuuua

SEQ ID NO: 29195 - RNA, 64 nt, Homo Sapiens
cuuccuccaaagaauuaauaggcaacagugggagaaaaaaaaggcauaauggcaaauccuucaa

SEQ ID NO: 29196 - RNA, 64 nt, Homo Sapiens
cauauguuuaauugaauugaaaauaucccuuaggaaaaaaaaaaaacacacaaaaaaccacaag

SEQ ID NO: 29197 - RNA, 64 nt, Homo Sapiens
auauguuuaauugaauugaaaauaucccuuaggaaaaaaaaaaaacacacaaaaaaccacaaga

SEQ ID NO: 29198 - RNA, 64 nt, Homo Sapiens
uauguuuaauugaauugaaaauaucccuuaggaaaaaaaaaaaacacacaaaaaaccacaagag

SEQ ID NO: 29199 - RNA, 64 nt, Homo Sapiens
auguuuaauugaauugaaaauaucccuuaggaaaaaaaaaaaacacacaaaaaaccacaagagc

SEQ ID NO: 29200 - RNA, 64 nt, Homo Sapiens
uguuuaauugaauugaaaauaucccuuaggaaaaaaaaaaaacacacaaaaaaccacaagagcc

SEQ ID NO: 29201 - RNA, 64 nt, Homo Sapiens
gcuaguuuaaaaaagaaaauauguaauauaauguaaaaaaaaacaaaaaaaagcuuuuaugaug

SEQ ID NO: 29202 - RNA, 64 nt, Homo Sapiens
cuaguuuaaaaaagaaaauauguaauauaauguaaaaaaaaacaaaaaaaagcuuuuaugaugg

SEQ ID NO: 29203 - RNA, 64 nt, Homo Sapiens
aaaagaaaauauguaauauaauguaaaaaaaaacaaaaaaaagcuuuuaugauggauuuuguaa

SEQ ID NO: 29204 - RNA, 64 nt, Homo Sapiens
gcagggagaagggccgggggggguaggagaggagaaaaaaaaagugaaaaaaagaaacgaaaag

SEQ ID NO: 29205 - RNA, 64 nt, Homo Sapiens
cagggagaagggccgggggggguaggagaggagaaaaaaaaagugaaaaaaagaaacgaaaagg

SEQ ID NO: 29206 - RNA, 64 nt, Homo Sapiens
ugugauuguuguuauugauguuguuguugauggcaaaaaaaaaaaagcgacuucgaguuugcuc

SEQ ID NO: 29207 - RNA, 64 nt, Homo Sapiens
gugauuguuguuauugauguuguuguugauggcaaaaaaaaaaaagcgacuucgaguuugcucc

SEQ ID NO: 29208 - RNA, 64 nt, Homo Sapiens
ugauuguuguuauugauguuguuguugauggcaaaaaaaaaaaagcgacuucgaguuugcuccc

SEQ ID NO: 29209 - RNA, 64 nt, Homo Sapiens
gauuguuguuauugauguuguuguugauggcaaaaaaaaaaaagcgacuucgaguuugcucccc

SEQ ID NO: 29210 - RNA, 64 nt, Homo Sapiens
auuguuguuauugauguuguuguugauggcaaaaaaaaaaaagcgacuucgaguuugcuccccu

SEQ ID NO: 29211 - RNA, 64 nt, Homo Sapiens
acaggggcagucaguggagggcgagugguuucggaaaaaaaaaaagaaaaaaagaaaaaaaaag

SEQ ID NO: 29212 - RNA, 64 nt, Homo Sapiens
caggggcagucaguggagggcgagugguuucggaaaaaaaaaaagaaaaaaagaaaaaaaaaga

SEQ ID NO: 29213 - RNA, 64 nt, Homo Sapiens
aggggcagucaguggagggcgagugguuucggaaaaaaaaaaagaaaaaaagaaaaaaaaagaa

SEQ ID NO: 29214 - RNA, 64 nt, Homo Sapiens
ggggcagucaguggagggcgagugguuucggaaaaaaaaaaagaaaaaaagaaaaaaaaagaaa

SEQ ID NO: 29215 - RNA, 64 nt, Homo Sapiens
gcgagugguuucggaaaaaaaaaaagaaaaaaagaaaaaaaaagaaaaaaaaaagauuuuuuuc

SEQ ID NO: 29216 - RNA, 64 nt, Homo Sapiens
cgagugguuucggaaaaaaaaaaagaaaaaaagaaaaaaaaagaaaaaaaaaagauuuuuuucu

SEQ ID NO: 29217 - RNA, 64 nt, Homo Sapiens
ucggaaaaaaaaaaagaaaaaaagaaaaaaaaagaaaaaaaaaagauuuuuuucuucucuuaau

SEQ ID NO: 29218 - RNA, 64 nt, Homo Sapiens
cggaaaaaaaaaaagaaaaaaagaaaaaaaaagaaaaaaaaaagauuuuuuucuucucuuaauc

SEQ ID NO: 29219 - RNA, 64 nt, Homo Sapiens
ggaaaaaaaaaaagaaaaaaagaaaaaaaaagaaaaaaaaaagauuuuuuucuucucuuaaucg

SEQ ID NO: 29220 - RNA, 64 nt, Homo Sapiens
uaaaauucaaggccacaaaaacaauguuugggggaaaaaaaagaaaaaaucaugccagcuaauc

SEQ ID NO: 29221 - RNA, 64 nt, Homo Sapiens
cugcaguaagccaagaucaugcugugccucaaggaaaaaaaaaauuaauguuuacugauauuug

SEQ ID NO: 29222 - RNA, 64 nt, Homo Sapiens
ugcaguaagccaagaucaugcugugccucaaggaaaaaaaaaauuaauguuuacugauauuugu

SEQ ID NO: 29223 - RNA, 64 nt, Homo Sapiens
gcaguaagccaagaucaugcugugccucaaggaaaaaaaaaauuaauguuuacugauauuuguu

SEQ ID NO: 29224 - RNA, 64 nt, Homo Sapiens
gaaaagucugaaugagaagauggcaggacgucugaaaaaaaaaguuauaauuaauaaaaucugc

SEQ ID NO: 29225 - RNA, 64 nt, Homo Sapiens
aaaagucugaaugagaagauggcaggacgucugaaaaaaaaaguuauaauuaauaaaaucugcg

SEQ ID NO: 29226 - RNA, 64 nt, Homo Sapiens
cacuccagccugggugacagcuagacccugucucaaaaaaaaaaaaaaagacugggaagagagc

SEQ ID NO: 29227 - RNA, 64 nt, Homo Sapiens
acuccagccugggugacagcuagacccugucucaaaaaaaaaaaaaaagacugggaagagagcu

SEQ ID NO: 29228 - RNA, 64 nt, Homo Sapiens
cuccagccugggugacagcuagacccugucucaaaaaaaaaaaaaaagacugggaagagagcua

SEQ ID NO: 29229 - RNA, 64 nt, Homo Sapiens
uccagccugggugacagcuagacccugucucaaaaaaaaaaaaaaagacugggaagagagcuag

SEQ ID NO: 29230 - RNA, 64 nt, Homo Sapiens
ccagccugggugacagcuagacccugucucaaaaaaaaaaaaaaagacugggaagagagcuaga

SEQ ID NO: 29231 - RNA, 64 nt, Homo Sapiens
cagccugggugacagcuagacccugucucaaaaaaaaaaaaaaagacugggaagagagcuagag

SEQ ID NO: 29232 - RNA, 64 nt, Homo Sapiens
agccugggugacagcuagacccugucucaaaaaaaaaaaaaaagacugggaagagagcuagagg

SEQ ID NO: 29233 - RNA, 64 nt, Homo Sapiens
gccugggugacagcuagacccugucucaaaaaaaaaaaaaaagacugggaagagagcuagaggg

SEQ ID NO: 29234 - RNA, 64 nt, Homo Sapiens
caggacccuugcccccacccccauuuuuuuaaugaaaaaaaaaaacaaaaaaaacggauccaag

SEQ ID NO: 29235 - RNA, 64 nt, Homo Sapiens
aggacccuugcccccacccccauuuuuuuaaugaaaaaaaaaaacaaaaaaaacggauccaaga

SEQ ID NO: 29236 - RNA, 64 nt, Homo Sapiens
ggacccuugcccccacccccauuuuuuuaaugaaaaaaaaaaacaaaaaaaacggauccaagaa

SEQ ID NO: 29237 - RNA, 64 nt, Homo Sapiens
gacccuugcccccacccccauuuuuuuaaugaaaaaaaaaaacaaaaaaaacggauccaagaag

SEQ ID NO: 29238 - RNA, 64 nt, Homo Sapiens
ccccacccccauuuuuuuaaugaaaaaaaaaaacaaaaaaaacggauccaagaagaaaagagaa

SEQ ID NO: 29239 - RNA, 64 nt, Homo Sapiens
uuauuuccuucuccacucucuccaugcccuggagaaaaaaaaguccagaagaaaucauaaauau

SEQ ID NO: 29240 - RNA, 64 nt, Homo Sapiens
aggggauagccagaaucucugaggaaaauggaccaaaaaaaaaaaggccugaaccccaaggaag

SEQ ID NO: 29241 - RNA, 64 nt, Homo Sapiens
ggggauagccagaaucucugaggaaaauggaccaaaaaaaaaaaggccugaaccccaaggaaga

SEQ ID NO: 29242 - RNA, 64 nt, Homo Sapiens
gggauagccagaaucucugaggaaaauggaccaaaaaaaaaaaggccugaaccccaaggaagac

SEQ ID NO: 29243 - RNA, 64 nt, Homo Sapiens
ggauagccagaaucucugaggaaaauggaccaaaaaaaaaaaggccugaaccccaaggaagacu

SEQ ID NO: 29244 - RNA, 64 nt, Homo Sapiens
ugcccuuggcucagaaugguuauagcagaaauacaaaaaaaaaaaaaaagucuguacuaauuuc

SEQ ID NO: 29245 - RNA, 64 nt, Homo Sapiens
gcccuuggcucagaaugguuauagcagaaauacaaaaaaaaaaaaaaagucuguacuaauuuca

SEQ ID NO: 29246 - RNA, 64 nt, Homo Sapiens
cccuuggcucagaaugguuauagcagaaauacaaaaaaaaaaaaaaagucuguacuaauuucaa

SEQ ID NO: 29247 - RNA, 64 nt, Homo Sapiens
ccuuggcucagaaugguuauagcagaaauacaaaaaaaaaaaaaaagucuguacuaauuucaau

SEQ ID NO: 29248 - RNA, 64 nt, Homo Sapiens
cuuggcucagaaugguuauagcagaaauacaaaaaaaaaaaaaaagucuguacuaauuucaaua

SEQ ID NO: 29249 - RNA, 64 nt, Homo Sapiens
uuggcucagaaugguuauagcagaaauacaaaaaaaaaaaaaaagucuguacuaauuucaauau

SEQ ID NO: 29250 - RNA, 64 nt, Homo Sapiens
uggcucagaaugguuauagcagaaauacaaaaaaaaaaaaaaagucuguacuaauuucaauaug

SEQ ID NO: 29251 - RNA, 64 nt, Homo Sapiens
ggcucagaaugguuauagcagaaauacaaaaaaaaaaaaaaagucuguacuaauuucaauaugg

SEQ ID NO: 29252 - RNA, 64 nt, Homo Sapiens
cagacaaggaacucucuccucucuuuuuggagggaaaaaaaaaauaucacuacacaaaccaggc

SEQ ID NO: 29253 - RNA, 64 nt, Homo Sapiens
agacaaggaacucucuccucucuuuuuggagggaaaaaaaaaauaucacuacacaaaccaggca

SEQ ID NO: 29254 - RNA, 64 nt, Homo Sapiens
gacaaggaacucucuccucucuuuuuggagggaaaaaaaaaauaucacuacacaaaccaggcac

SEQ ID NO: 29255 - RNA, 64 nt, Homo Sapiens
cugcaggacagaaacaagguuuuaaagcauugccaaaaaaaagaaaacagaaagaaaaaaugua

SEQ ID NO: 29256 - RNA, 64 nt, Homo Sapiens
cccuccccaccuucaccuucucaaaaauggaaggaaaaaaaaacugugaauggggaaugcugac

SEQ ID NO: 29257 - RNA, 64 nt, Homo Sapiens
ccuccccaccuucaccuucucaaaaauggaaggaaaaaaaaacugugaauggggaaugcugacu

SEQ ID NO: 29258 - RNA, 64 nt, Homo Sapiens
gaaucuuguaacuuuauucuuuuuucuccugcugaaaaaaaaaauuaaaccaaucguaugaaag

SEQ ID NO: 29259 - RNA, 64 nt, Homo Sapiens
aaucuuguaacuuuauucuuuuuucuccugcugaaaaaaaaaauuaaaccaaucguaugaaagu

SEQ ID NO: 29260 - RNA, 64 nt, Homo Sapiens
aucuuguaacuuuauucuuuuuucuccugcugaaaaaaaaaauuaaaccaaucguaugaaaguu

SEQ ID NO: 29261 - RNA, 64 nt, Homo Sapiens
uacauuuuguaaaaauauuuauaaaauguuuuguaaaaaaaaaaaaacuauaacaaauugcagu

SEQ ID NO: 29262 - RNA, 64 nt, Homo Sapiens
acauuuuguaaaaauauuuauaaaauguuuuguaaaaaaaaaaaaacuauaacaaauugcaguu

SEQ ID NO: 29263 - RNA, 64 nt, Homo Sapiens
cauuuuguaaaaauauuuauaaaauguuuuguaaaaaaaaaaaaacuauaacaaauugcaguuu

SEQ ID NO: 29264 - RNA, 64 nt, Homo Sapiens
auuuuguaaaaauauuuauaaaauguuuuguaaaaaaaaaaaaacuauaacaaauugcaguuua

SEQ ID NO: 29265 - RNA, 64 nt, Homo Sapiens
uuuuguaaaaauauuuauaaaauguuuuguaaaaaaaaaaaaacuauaacaaauugcaguuuau

SEQ ID NO: 29266 - RNA, 64 nt, Homo Sapiens
uuuguaaaaauauuuauaaaauguuuuguaaaaaaaaaaaaacuauaacaaauugcaguuuauu

SEQ ID NO: 29267 - RNA, 64 nt, Homo Sapiens
ucacaguccuauguacagagcuuucuuuuguauuaaaaaaaaauacucuuucaauaaauguauc

SEQ ID NO: 29268 - RNA, 64 nt, Homo Sapiens
cacaguccuauguacagagcuuucuuuuguauuaaaaaaaaauacucuuucaauaaauguauca

SEQ ID NO: 29269 - RNA, 64 nt, Homo Sapiens
gcaaaugaagaaauauuuuaaggaaaccuauuugaaaaaaaaagcaaagaccauuugauaaaag

SEQ ID NO: 29270 - RNA, 64 nt, Homo Sapiens
caaaugaagaaauauuuuaaggaaaccuauuugaaaaaaaaagcaaagaccauuugauaaaagc

SEQ ID NO: 29271 - RNA, 64 nt, Homo Sapiens
auauuagguagaauacacauacaaucaaaauuuuaaaaaaaaaagcuaaauaacuuaaaaaaaa

SEQ ID NO: 29272 - RNA, 64 nt, Homo Sapiens
uauuagguagaauacacauacaaucaaaauuuuaaaaaaaaaagcuaaauaacuuaaaaaaaaa

SEQ ID NO: 29273 - RNA, 64 nt, Homo Sapiens
auuagguagaauacacauacaaucaaaauuuuaaaaaaaaaagcuaaauaacuuaaaaaaaaac

SEQ ID NO: 29274 - RNA, 64 nt, Homo Sapiens
aaucaaaauuuuaaaaaaaaaagcuaaauaacuuaaaaaaaaacugaggcguacaacggagcaa

SEQ ID NO: 29275 - RNA, 64 nt, Homo Sapiens
aucaaaauuuuaaaaaaaaaagcuaaauaacuuaaaaaaaaacugaggcguacaacggagcaac

SEQ ID NO: 29276 - RNA, 64 nt, Homo Sapiens
ggcaacauaacaagaccccaucccuuauuaaaagaaaaaaaaauaauuccucauuucaucauug

SEQ ID NO: 29277 - RNA, 64 nt, Homo Sapiens
gcaacauaacaagaccccaucccuuauuaaaagaaaaaaaaauaauuccucauuucaucauugg

SEQ ID NO: 29278 - RNA, 64 nt, Homo Sapiens
cagccugggcaacauggcaaaacaccgucucuacaaaaaaaaaaaaaaaaaaaauuagccaagu

SEQ ID NO: 29279 - RNA, 64 nt, Homo Sapiens
agccugggcaacauggcaaaacaccgucucuacaaaaaaaaaaaaaaaaaaaauuagccaagua

SEQ ID NO: 29280 - RNA, 64 nt, Homo Sapiens
gccugggcaacauggcaaaacaccgucucuacaaaaaaaaaaaaaaaaaaaauuagccaaguac

SEQ ID NO: 29281 - RNA, 64 nt, Homo Sapiens
ccugggcaacauggcaaaacaccgucucuacaaaaaaaaaaaaaaaaaaaauuagccaaguaca

SEQ ID NO: 29282 - RNA, 64 nt, Homo Sapiens
cugggcaacauggcaaaacaccgucucuacaaaaaaaaaaaaaaaaaaaauuagccaaguacag

SEQ ID NO: 29283 - RNA, 64 nt, Homo Sapiens
ugggcaacauggcaaaacaccgucucuacaaaaaaaaaaaaaaaaaaaauuagccaaguacagu

SEQ ID NO: 29284 - RNA, 64 nt, Homo Sapiens
gggcaacauggcaaaacaccgucucuacaaaaaaaaaaaaaaaaaaaauuagccaaguacagug

SEQ ID NO: 29285 - RNA, 64 nt, Homo Sapiens
ggcaacauggcaaaacaccgucucuacaaaaaaaaaaaaaaaaaaaauuagccaaguacagugg

SEQ ID NO: 29286 - RNA, 64 nt, Homo Sapiens
gcaacauggcaaaacaccgucucuacaaaaaaaaaaaaaaaaaaaauuagccaaguacaguggg

SEQ ID NO: 29287 - RNA, 64 nt, Homo Sapiens
caacauggcaaaacaccgucucuacaaaaaaaaaaaaaaaaaaaauuagccaaguacagugggg

SEQ ID NO: 29288 - RNA, 64 nt, Homo Sapiens
aacauggcaaaacaccgucucuacaaaaaaaaaaaaaaaaaaaauuagccaaguacaguggggc

SEQ ID NO: 29289 - RNA, 64 nt, Homo Sapiens
acauggcaaaacaccgucucuacaaaaaaaaaaaaaaaaaaaauuagccaaguacaguggggca

SEQ ID NO: 29290 - RNA, 64 nt, Homo Sapiens
cauggcaaaacaccgucucuacaaaaaaaaaaaaaaaaaaaauuagccaaguacaguggggcac

SEQ ID NO: 29291 - RNA, 64 nt, Homo Sapiens
acaacauagcaagaccucaucucuucuaaaaauuaaaaaaaaaaaaaauaggcauggugguaca

SEQ ID NO: 29292 - RNA, 64 nt, Homo Sapiens
caacauagcaagaccucaucucuucuaaaaauuaaaaaaaaaaaaaauaggcauggugguacac

SEQ ID NO: 29293 - RNA, 64 nt, Homo Sapiens
aacauagcaagaccucaucucuucuaaaaauuaaaaaaaaaaaaaauaggcauggugguacaca

SEQ ID NO: 29294 - RNA, 64 nt, Homo Sapiens
acauagcaagaccucaucucuucuaaaaauuaaaaaaaaaaaaaauaggcauggugguacacac

SEQ ID NO: 29295 - RNA, 64 nt, Homo Sapiens
cauagcaagaccucaucucuucuaaaaauuaaaaaaaaaaaaaauaggcauggugguacacacc

SEQ ID NO: 29296 - RNA, 64 nt, Homo Sapiens
auagcaagaccucaucucuucuaaaaauuaaaaaaaaaaaaaauaggcauggugguacacaccu

SEQ ID NO: 29297 - RNA, 64 nt, Homo Sapiens
uagcaagaccucaucucuucuaaaaauuaaaaaaaaaaaaaauaggcauggugguacacaccug

SEQ ID NO: 29298 - RNA, 64 nt, Homo Sapiens
cuuuuuuuuuuuuaaucuauugcucuuuggaaauaaaaaaaaagucaguuuaaaaugauuucuc

SEQ ID NO: 29299 - RNA, 64 nt, Homo Sapiens
uuuuuuuuuuuuaaucuauugcucuuuggaaauaaaaaaaaagucaguuuaaaaugauuucuca

SEQ ID NO: 29300 - RNA, 64 nt, Homo Sapiens
ggcaauaagaacuucauuuuacaauuuaguuuucaaaaaaaaaaugcaggaaacuguuuuauca

SEQ ID NO: 29301 - RNA, 64 nt, Homo Sapiens
gcaauaagaacuucauuuuacaauuuaguuuucaaaaaaaaaaugcaggaaacuguuuuaucag

SEQ ID NO: 29302 - RNA, 64 nt, Homo Sapiens
caauaagaacuucauuuuacaauuuaguuuucaaaaaaaaaaugcaggaaacuguuuuaucagg

SEQ ID NO: 29303 - RNA, 64 nt, Homo Sapiens
cuugaagacuuacagcaaauccuuugugaaaaauaaaaaaaaaaaagagacuuuaaaauccugg

SEQ ID NO: 29304 - RNA, 64 nt, Homo Sapiens
uugaagacuuacagcaaauccuuugugaaaaauaaaaaaaaaaaagagacuuuaaaauccuggu

SEQ ID NO: 29305 - RNA, 64 nt, Homo Sapiens
ugaagacuuacagcaaauccuuugugaaaaauaaaaaaaaaaaagagacuuuaaaauccuggug

SEQ ID NO: 29306 - RNA, 64 nt, Homo Sapiens
gaagacuuacagcaaauccuuugugaaaaauaaaaaaaaaaaagagacuuuaaaauccuggugu

SEQ ID NO: 29307 - RNA, 64 nt, Homo Sapiens
aagacuuacagcaaauccuuugugaaaaauaaaaaaaaaaaagagacuuuaaaauccuggugua

SEQ ID NO: 29308 - RNA, 64 nt, Homo Sapiens
aagagcaauucaaaaaaaguaaccuuauacuacuaaaaaaaaaauucuugcauauauuaucauc

SEQ ID NO: 29309 - RNA, 64 nt, Homo Sapiens
agagcaauucaaaaaaaguaaccuuauacuacuaaaaaaaaaauucuugcauauauuaucauca

SEQ ID NO: 29310 - RNA, 64 nt, Homo Sapiens
gagcaauucaaaaaaaguaaccuuauacuacuaaaaaaaaaauucuugcauauauuaucaucaa

SEQ ID NO: 29311 - RNA, 64 nt, Homo Sapiens
uuuuaauuauuauuuccccgucccuuaaaaagacaaaaaaaauaaggcaaaaggaaagcaacua

SEQ ID NO: 29312 - RNA, 64 nt, Homo Sapiens
auaccuggcaaaacuaaauaaauuaccaaaaaggaaaaaaaauccaccaaaccaugauaaacac

SEQ ID NO: 29313 - RNA, 64 nt, Homo Sapiens
gcccccucuuucacuaaggaaggcaaaugaagugaaaaaaaaaaaugccauuuucaauccuucc

SEQ ID NO: 29314 - RNA, 64 nt, Homo Sapiens
cccccucuuucacuaaggaaggcaaaugaagugaaaaaaaaaaaugccauuuucaauccuuccu

SEQ ID NO: 29315 - RNA, 64 nt, Homo Sapiens
ccccucuuucacuaaggaaggcaaaugaagugaaaaaaaaaaaugccauuuucaauccuuccuu

SEQ ID NO: 29316 - RNA, 64 nt, Homo Sapiens
cccucuuucacuaaggaaggcaaaugaagugaaaaaaaaaaaugccauuuucaauccuuccuuu

SEQ ID NO: 29317 - RNA, 64 nt, Homo Sapiens
caagccauguaaaagaucuacuuuuucuaagggcaaaaaaaaaaaaaaaaaaaaaagaacacuc

SEQ ID NO: 29318 - RNA, 64 nt, Homo Sapiens
aagccauguaaaagaucuacuuuuucuaagggcaaaaaaaaaaaaaaaaaaaaaagaacacucc

SEQ ID NO: 29319 - RNA, 64 nt, Homo Sapiens
agccauguaaaagaucuacuuuuucuaagggcaaaaaaaaaaaaaaaaaaaaaagaacacuccu

SEQ ID NO: 29320 - RNA, 64 nt, Homo Sapiens
gccauguaaaagaucuacuuuuucuaagggcaaaaaaaaaaaaaaaaaaaaaagaacacuccuu

SEQ ID NO: 29321 - RNA, 64 nt, Homo Sapiens
ccauguaaaagaucuacuuuuucuaagggcaaaaaaaaaaaaaaaaaaaaaagaacacuccuuu

SEQ ID NO: 29322 - RNA, 64 nt, Homo Sapiens
cauguaaaagaucuacuuuuucuaagggcaaaaaaaaaaaaaaaaaaaaaagaacacuccuuuc

SEQ ID NO: 29323 - RNA, 64 nt, Homo Sapiens
auguaaaagaucuacuuuuucuaagggcaaaaaaaaaaaaaaaaaaaaaagaacacuccuuucu

SEQ ID NO: 29324 - RNA, 64 nt, Homo Sapiens
uguaaaagaucuacuuuuucuaagggcaaaaaaaaaaaaaaaaaaaaaagaacacuccuuucug

SEQ ID NO: 29325 - RNA, 64 nt, Homo Sapiens
guaaaagaucuacuuuuucuaagggcaaaaaaaaaaaaaaaaaaaaaagaacacuccuuucuga

SEQ ID NO: 29326 - RNA, 64 nt, Homo Sapiens
uaaaagaucuacuuuuucuaagggcaaaaaaaaaaaaaaaaaaaaaagaacacuccuuucugag

SEQ ID NO: 29327 - RNA, 64 nt, Homo Sapiens
aaaagaucuacuuuuucuaagggcaaaaaaaaaaaaaaaaaaaaaagaacacuccuuucugaga

SEQ ID NO: 29328 - RNA, 64 nt, Homo Sapiens
aaagaucuacuuuuucuaagggcaaaaaaaaaaaaaaaaaaaaaagaacacuccuuucugagac

SEQ ID NO: 29329 - RNA, 64 nt, Homo Sapiens
aagaucuacuuuuucuaagggcaaaaaaaaaaaaaaaaaaaaaagaacacuccuuucugagacu

SEQ ID NO: 29330 - RNA, 64 nt, Homo Sapiens
agaucuacuuuuucuaagggcaaaaaaaaaaaaaaaaaaaaaagaacacuccuuucugagacuu

SEQ ID NO: 29331 - RNA, 64 nt, Homo Sapiens
gaucuacuuuuucuaagggcaaaaaaaaaaaaaaaaaaaaaagaacacuccuuucugagacuuu

SEQ ID NO: 29332 - RNA, 64 nt, Homo Sapiens
ccagaggaacuuagggauuucaccccuggcuuuuaaaaaaaacgaaauaccgacaagccacaag

SEQ ID NO: 29333 - RNA, 64 nt, Homo Sapiens
acaguuguggaguaucccauucugaugaguacagaaaaaaaaagaaaaagaaaagaagagaaaa

SEQ ID NO: 29334 - RNA, 64 nt, Homo Sapiens
caguuguggaguaucccauucugaugaguacagaaaaaaaaagaaaaagaaaagaagagaaaaa

SEQ ID NO: 29335 - RNA, 64 nt, Homo Sapiens
aaauuaagaaaaaaaucaaaaaaggaagaaaacuaaaaaaaaaaaaaaucaaaucaccuuguga

SEQ ID NO: 29336 - RNA, 64 nt, Homo Sapiens
aauuaagaaaaaaaucaaaaaaggaagaaaacuaaaaaaaaaaaaaaucaaaucaccuugugau

SEQ ID NO: 29337 - RNA, 64 nt, Homo Sapiens
auuaagaaaaaaaucaaaaaaggaagaaaacuaaaaaaaaaaaaaaucaaaucaccuugugauu

SEQ ID NO: 29338 - RNA, 64 nt, Homo Sapiens
uuaagaaaaaaaucaaaaaaggaagaaaacuaaaaaaaaaaaaaaucaaaucaccuugugauuc

SEQ ID NO: 29339 - RNA, 64 nt, Homo Sapiens
uaagaaaaaaaucaaaaaaggaagaaaacuaaaaaaaaaaaaaaucaaaucaccuugugauuca

SEQ ID NO: 29340 - RNA, 64 nt, Homo Sapiens
aagaaaaaaaucaaaaaaggaagaaaacuaaaaaaaaaaaaaaucaaaucaccuugugauucag

SEQ ID NO: 29341 - RNA, 64 nt, Homo Sapiens
agaaaaaaaucaaaaaaggaagaaaacuaaaaaaaaaaaaaaucaaaucaccuugugauucagu

SEQ ID NO: 29342 - RNA, 64 nt, Homo Sapiens
gucagauucaucaaacaaaaaauaaaucucgaagaaaaaaaaugcacuuacaugugcuuauuug

SEQ ID NO: 29343 - RNA, 64 nt, Homo Sapiens
uuaagauuaaaaaauuuuuaaaccucuaugucugaaaaaaaaaaugacacuccuggaagauggc

SEQ ID NO: 29344 - RNA, 64 nt, Homo Sapiens
uaagauuaaaaaauuuuuaaaccucuaugucugaaaaaaaaaaugacacuccuggaagauggcu

SEQ ID NO: 29345 - RNA, 64 nt, Homo Sapiens
aagauuaaaaaauuuuuaaaccucuaugucugaaaaaaaaaaugacacuccuggaagauggcua

SEQ ID NO: 29346 - RNA, 64 nt, Homo Sapiens
gaggaaaaaagaaaaaacaccaauacccagauuuaaaaaaaaaaaaacgaucauagucuuagga

SEQ ID NO: 29347 - RNA, 64 nt, Homo Sapiens
aggaaaaaagaaaaaacaccaauacccagauuuaaaaaaaaaaaaacgaucauagucuuaggag

SEQ ID NO: 29348 - RNA, 64 nt, Homo Sapiens
ggaaaaaagaaaaaacaccaauacccagauuuaaaaaaaaaaaaacgaucauagucuuaggagu

SEQ ID NO: 29349 - RNA, 64 nt, Homo Sapiens
gaaaaaagaaaaaacaccaauacccagauuuaaaaaaaaaaaaacgaucauagucuuaggaguu

SEQ ID NO: 29350 - RNA, 64 nt, Homo Sapiens
aaaaaagaaaaaacaccaauacccagauuuaaaaaaaaaaaaacgaucauagucuuaggaguuc

SEQ ID NO: 29351 - RNA, 64 nt, Homo Sapiens
aaaaagaaaaaacaccaauacccagauuuaaaaaaaaaaaaacgaucauagucuuaggaguuca

SEQ ID NO: 29352 - RNA, 64 nt, Homo Sapiens
ugcuuucuuuuccagucgucuuugagaauaaaggaaaaaaaaaucuucagaugcaaugguuuug

SEQ ID NO: 29353 - RNA, 64 nt, Homo Sapiens
gcuuucuuuuccagucgucuuugagaauaaaggaaaaaaaaaucuucagaugcaaugguuuugu

SEQ ID NO: 29354 - RNA, 64 nt, Homo Sapiens
cugaaaaaugaagugaagacccauauaugcaguuaaaaaaaaguuaauuuucaaaaaauacugu

SEQ ID NO: 29355 - RNA, 64 nt, Homo Sapiens
cagaauuuggcauaucgaugcaugcaauggaaagaaaaaaaauuuguuaaaauuuguaaauguu

SEQ ID NO: 29356 - RNA, 64 nt, Homo Sapiens
ugaguaucucaggguaaguaacaaaaaaacaaacaaaaaaaaucacugaaauuuuucccucaca

SEQ ID NO: 29357 - RNA, 64 nt, Homo Sapiens
uaccuggucauuuugugaucacaagagucuaugcaaaaaaaaaaauuucuuuaccccagauuau

SEQ ID NO: 29358 - RNA, 64 nt, Homo Sapiens
accuggucauuuugugaucacaagagucuaugcaaaaaaaaaaauuucuuuaccccagauuauc

SEQ ID NO: 29359 - RNA, 64 nt, Homo Sapiens
ccuggucauuuugugaucacaagagucuaugcaaaaaaaaaaauuucuuuaccccagauuauca

SEQ ID NO: 29360 - RNA, 64 nt, Homo Sapiens
cuggucauuuugugaucacaagagucuaugcaaaaaaaaaaauuucuuuaccccagauuaucag

SEQ ID NO: 29361 - RNA, 64 nt, Homo Sapiens
acuuaaagggaauauaugagguuuuuuuuuuuuuaaaaaaaaacuuuuauuuauuauuuguagu

SEQ ID NO: 29362 - RNA, 64 nt, Homo Sapiens
cuuaaagggaauauaugagguuuuuuuuuuuuuaaaaaaaaacuuuuauuuauuauuuguagua

SEQ ID NO: 29363 - RNA, 64 nt, Homo Sapiens
ugugaaccuagacuuagaacaaauccugcuuuugaaaaaaaauguuuugcuucuuacaaaauca

SEQ ID NO: 29364 - RNA, 64 nt, Homo Sapiens
uuaacuuggaguuucauuucuuuucauuguaaucaaaaaaaaaauuaacagaagccaaaauacu

SEQ ID NO: 29365 - RNA, 64 nt, Homo Sapiens
uaacuuggaguuucauuucuuuucauuguaaucaaaaaaaaaauuaacagaagccaaaauacuu

SEQ ID NO: 29366 - RNA, 64 nt, Homo Sapiens
aacuuggaguuucauuucuuuucauuguaaucaaaaaaaaaauuaacagaagccaaaauacuuc

SEQ ID NO: 29367 - RNA, 64 nt, Homo Sapiens
aacugugucauuuuguauacacaugugagguuugaaaaaaaaaaaaaaaaaaaaaagaacuacc

SEQ ID NO: 29368 - RNA, 64 nt, Homo Sapiens
acugugucauuuuguauacacaugugagguuugaaaaaaaaaaaaaaaaaaaaaagaacuaccu

SEQ ID NO: 29369 - RNA, 64 nt, Homo Sapiens
cugugucauuuuguauacacaugugagguuugaaaaaaaaaaaaaaaaaaaaaagaacuaccuu

SEQ ID NO: 29370 - RNA, 64 nt, Homo Sapiens
ugugucauuuuguauacacaugugagguuugaaaaaaaaaaaaaaaaaaaaaagaacuaccuug

SEQ ID NO: 29371 - RNA, 64 nt, Homo Sapiens
gugucauuuuguauacacaugugagguuugaaaaaaaaaaaaaaaaaaaaaagaacuaccuugu

SEQ ID NO: 29372 - RNA, 64 nt, Homo Sapiens
ugucauuuuguauacacaugugagguuugaaaaaaaaaaaaaaaaaaaaaagaacuaccuugug

SEQ ID NO: 29373 - RNA, 64 nt, Homo Sapiens
gucauuuuguauacacaugugagguuugaaaaaaaaaaaaaaaaaaaaaagaacuaccuuguga

SEQ ID NO: 29374 - RNA, 64 nt, Homo Sapiens
ucauuuuguauacacaugugagguuugaaaaaaaaaaaaaaaaaaaaaagaacuaccuugugag

SEQ ID NO: 29375 - RNA, 64 nt, Homo Sapiens
cauuuuguauacacaugugagguuugaaaaaaaaaaaaaaaaaaaaaagaacuaccuugugagu

SEQ ID NO: 29376 - RNA, 64 nt, Homo Sapiens
auuuuguauacacaugugagguuugaaaaaaaaaaaaaaaaaaaaaagaacuaccuugugaguu

SEQ ID NO: 29377 - RNA, 64 nt, Homo Sapiens
uuuuguauacacaugugagguuugaaaaaaaaaaaaaaaaaaaaaagaacuaccuugugaguuu

SEQ ID NO: 29378 - RNA, 64 nt, Homo Sapiens
uuuguauacacaugugagguuugaaaaaaaaaaaaaaaaaaaaaagaacuaccuugugaguuuu

SEQ ID NO: 29379 - RNA, 64 nt, Homo Sapiens
uuguauacacaugugagguuugaaaaaaaaaaaaaaaaaaaaaagaacuaccuugugaguuuug

SEQ ID NO: 29380 - RNA, 64 nt, Homo Sapiens
uguauacacaugugagguuugaaaaaaaaaaaaaaaaaaaaaagaacuaccuugugaguuuugc

SEQ ID NO: 29381 - RNA, 64 nt, Homo Sapiens
guauacacaugugagguuugaaaaaaaaaaaaaaaaaaaaaagaacuaccuugugaguuuugcu

SEQ ID NO: 29382 - RNA, 64 nt, Homo Sapiens
ugcuuugugguugcugucauauuugcucuagaagaaaaaaaaaaaaggaggggaaaugcauuuu

SEQ ID NO: 29383 - RNA, 64 nt, Homo Sapiens
gcuuugugguugcugucauauuugcucuagaagaaaaaaaaaaaaggaggggaaaugcauuuuc

SEQ ID NO: 29384 - RNA, 64 nt, Homo Sapiens
cuuugugguugcugucauauuugcucuagaagaaaaaaaaaaaaggaggggaaaugcauuuucc

SEQ ID NO: 29385 - RNA, 64 nt, Homo Sapiens
uuugugguugcugucauauuugcucuagaagaaaaaaaaaaaaggaggggaaaugcauuuuccc

SEQ ID NO: 29386 - RNA, 64 nt, Homo Sapiens
uugugguugcugucauauuugcucuagaagaaaaaaaaaaaaggaggggaaaugcauuuucccc

SEQ ID NO: 29387 - RNA, 64 nt, Homo Sapiens
gcugcauuuuuuuaaaguuggauugcugcuauuuaaaaaaaaaaaaaggacacagaucaaaaaa

SEQ ID NO: 29388 - RNA, 64 nt, Homo Sapiens
cugcauuuuuuuaaaguuggauugcugcuauuuaaaaaaaaaaaaaggacacagaucaaaaaaa

SEQ ID NO: 29389 - RNA, 64 nt, Homo Sapiens
ugcauuuuuuuaaaguuggauugcugcuauuuaaaaaaaaaaaaaggacacagaucaaaaaaac

SEQ ID NO: 29390 - RNA, 64 nt, Homo Sapiens
gcauuuuuuuaaaguuggauugcugcuauuuaaaaaaaaaaaaaggacacagaucaaaaaaaca

SEQ ID NO: 29391 - RNA, 64 nt, Homo Sapiens
cauuuuuuuaaaguuggauugcugcuauuuaaaaaaaaaaaaaggacacagaucaaaaaaacac

SEQ ID NO: 29392 - RNA, 64 nt, Homo Sapiens
auuuuuuuaaaguuggauugcugcuauuuaaaaaaaaaaaaaggacacagaucaaaaaaacacc

SEQ ID NO: 29393 - RNA, 64 nt, Homo Sapiens
uagaaauagaacaauccaucagcaugagacuuugaaaaaaaaacacaugaucagcuucucaugu

SEQ ID NO: 29394 - RNA, 64 nt, Homo Sapiens
agaaauagaacaauccaucagcaugagacuuugaaaaaaaaacacaugaucagcuucucauguu

SEQ ID NO: 29395 - RNA, 64 nt, Homo Sapiens
aauguaccuuugcauucuuuaauuaaaauugcuuaaaaaaaaacuuucauuauuucaguaaaau

SEQ ID NO: 29396 - RNA, 64 nt, Homo Sapiens
auguaccuuugcauucuuuaauuaaaauugcuuaaaaaaaaacuuucauuauuucaguaaaaug

SEQ ID NO: 29397 - RNA, 64 nt, Homo Sapiens
uuguucaaaaguuagaacaucuggcugcaccaggaaaaaaaaaaaaaaaaaguccuguucuucu

SEQ ID NO: 29398 - RNA, 64 nt, Homo Sapiens
uguucaaaaguuagaacaucuggcugcaccaggaaaaaaaaaaaaaaaaaguccuguucuucuu

SEQ ID NO: 29399 - RNA, 64 nt, Homo Sapiens
guucaaaaguuagaacaucuggcugcaccaggaaaaaaaaaaaaaaaaaguccuguucuucuuu

SEQ ID NO: 29400 - RNA, 64 nt, Homo Sapiens
uucaaaaguuagaacaucuggcugcaccaggaaaaaaaaaaaaaaaaaguccuguucuucuuua

SEQ ID NO: 29401 - RNA, 64 nt, Homo Sapiens
ucaaaaguuagaacaucuggcugcaccaggaaaaaaaaaaaaaaaaaguccuguucuucuuuag

SEQ ID NO: 29402 - RNA, 64 nt, Homo Sapiens
caaaaguuagaacaucuggcugcaccaggaaaaaaaaaaaaaaaaaguccuguucuucuuuaga

SEQ ID NO: 29403 - RNA, 64 nt, Homo Sapiens
aaaaguuagaacaucuggcugcaccaggaaaaaaaaaaaaaaaaaguccuguucuucuuuagau

SEQ ID NO: 29404 - RNA, 64 nt, Homo Sapiens
aaaguuagaacaucuggcugcaccaggaaaaaaaaaaaaaaaaaguccuguucuucuuuagaua

SEQ ID NO: 29405 - RNA, 64 nt, Homo Sapiens
aaguuagaacaucuggcugcaccaggaaaaaaaaaaaaaaaaaguccuguucuucuuuagauaa

SEQ ID NO: 29406 - RNA, 64 nt, Homo Sapiens
aguuagaacaucuggcugcaccaggaaaaaaaaaaaaaaaaaguccuguucuucuuuagauaaa

SEQ ID NO: 29407 - RNA, 64 nt, Homo Sapiens
cuagccauauuuaggacaacugaagaaaagcuggaaaaaaaaacaagcaaacuugaacacugaa

SEQ ID NO: 29408 - RNA, 64 nt, Homo Sapiens
uagccauauuuaggacaacugaagaaaagcuggaaaaaaaaacaagcaaacuugaacacugaag

SEQ ID NO: 29409 - RNA, 64 nt, Homo Sapiens
ccagccugggcgacagagugaaacuacaucucagaaaaaaaaaaaaaaaaaaaaaaaaaaaguu

SEQ ID NO: 29410 - RNA, 64 nt, Homo Sapiens
cagccugggcgacagagugaaacuacaucucagaaaaaaaaaaaaaaaaaaaaaaaaaaaguua

SEQ ID NO: 29411 - RNA, 64 nt, Homo Sapiens
agccugggcgacagagugaaacuacaucucagaaaaaaaaaaaaaaaaaaaaaaaaaaaguuaa

SEQ ID NO: 29412 - RNA, 64 nt, Homo Sapiens
gccugggcgacagagugaaacuacaucucagaaaaaaaaaaaaaaaaaaaaaaaaaaaguuaau

SEQ ID NO: 29413 - RNA, 64 nt, Homo Sapiens
ccugggcgacagagugaaacuacaucucagaaaaaaaaaaaaaaaaaaaaaaaaaaaguuaaug

SEQ ID NO: 29414 - RNA, 64 nt, Homo Sapiens
cugggcgacagagugaaacuacaucucagaaaaaaaaaaaaaaaaaaaaaaaaaaaguuaaugu

SEQ ID NO: 29415 - RNA, 64 nt, Homo Sapiens
ugggcgacagagugaaacuacaucucagaaaaaaaaaaaaaaaaaaaaaaaaaaaguuaauguc

SEQ ID NO: 29416 - RNA, 64 nt, Homo Sapiens
gggcgacagagugaaacuacaucucagaaaaaaaaaaaaaaaaaaaaaaaaaaaguuaaugucc

SEQ ID NO: 29417 - RNA, 64 nt, Homo Sapiens
ggcgacagagugaaacuacaucucagaaaaaaaaaaaaaaaaaaaaaaaaaaaguuaaugucca

SEQ ID NO: 29418 - RNA, 64 nt, Homo Sapiens
gcgacagagugaaacuacaucucagaaaaaaaaaaaaaaaaaaaaaaaaaaaguuaauguccaa

SEQ ID NO: 29419 - RNA, 64 nt, Homo Sapiens
cgacagagugaaacuacaucucagaaaaaaaaaaaaaaaaaaaaaaaaaaaguuaauguccaaa

SEQ ID NO: 29420 - RNA, 64 nt, Homo Sapiens
gacagagugaaacuacaucucagaaaaaaaaaaaaaaaaaaaaaaaaaaaguuaauguccaaaa

SEQ ID NO: 29421 - RNA, 64 nt, Homo Sapiens
acagagugaaacuacaucucagaaaaaaaaaaaaaaaaaaaaaaaaaaaguuaauguccaaaaa

SEQ ID NO: 29422 - RNA, 64 nt, Homo Sapiens
cagagugaaacuacaucucagaaaaaaaaaaaaaaaaaaaaaaaaaaaguuaauguccaaaaau

SEQ ID NO: 29423 - RNA, 64 nt, Homo Sapiens
agagugaaacuacaucucagaaaaaaaaaaaaaaaaaaaaaaaaaaaguuaauguccaaaaaug

SEQ ID NO: 29424 - RNA, 64 nt, Homo Sapiens
gagugaaacuacaucucagaaaaaaaaaaaaaaaaaaaaaaaaaaaguuaauguccaaaaauga

SEQ ID NO: 29425 - RNA, 64 nt, Homo Sapiens
agugaaacuacaucucagaaaaaaaaaaaaaaaaaaaaaaaaaaaguuaauguccaaaaaugac

SEQ ID NO: 29426 - RNA, 64 nt, Homo Sapiens
gugaaacuacaucucagaaaaaaaaaaaaaaaaaaaaaaaaaaaguuaauguccaaaaaugaca

SEQ ID NO: 29427 - RNA, 64 nt, Homo Sapiens
ugaaacuacaucucagaaaaaaaaaaaaaaaaaaaaaaaaaaaguuaauguccaaaaaugacag

SEQ ID NO: 29428 - RNA, 64 nt, Homo Sapiens
gaaacuacaucucagaaaaaaaaaaaaaaaaaaaaaaaaaaaguuaauguccaaaaaugacaga

SEQ ID NO: 29429 - RNA, 64 nt, Homo Sapiens
gaaaacuaccaauaaauguagaauggaugauuccaaaaaaaaaaaaaaaaagaagaaagagaga

SEQ ID NO: 29430 - RNA, 64 nt, Homo Sapiens
aaaacuaccaauaaauguagaauggaugauuccaaaaaaaaaaaaaaaaagaagaaagagagaa

SEQ ID NO: 29431 - RNA, 64 nt, Homo Sapiens
aaacuaccaauaaauguagaauggaugauuccaaaaaaaaaaaaaaaaagaagaaagagagaaa

SEQ ID NO: 29432 - RNA, 64 nt, Homo Sapiens
aacuaccaauaaauguagaauggaugauuccaaaaaaaaaaaaaaaaagaagaaagagagaaag

SEQ ID NO: 29433 - RNA, 64 nt, Homo Sapiens
acuaccaauaaauguagaauggaugauuccaaaaaaaaaaaaaaaaagaagaaagagagaaaga

SEQ ID NO: 29434 - RNA, 64 nt, Homo Sapiens
cuaccaauaaauguagaauggaugauuccaaaaaaaaaaaaaaaaagaagaaagagagaaagaa

SEQ ID NO: 29435 - RNA, 64 nt, Homo Sapiens
uaccaauaaauguagaauggaugauuccaaaaaaaaaaaaaaaaagaagaaagagagaaagaaa

SEQ ID NO: 29436 - RNA, 64 nt, Homo Sapiens
accaauaaauguagaauggaugauuccaaaaaaaaaaaaaaaaagaagaaagagagaaagaaag

SEQ ID NO: 29437 - RNA, 64 nt, Homo Sapiens
ccaauaaauguagaauggaugauuccaaaaaaaaaaaaaaaaagaagaaagagagaaagaaaga

SEQ ID NO: 29438 - RNA, 64 nt, Homo Sapiens
caauaaauguagaauggaugauuccaaaaaaaaaaaaaaaaagaagaaagagagaaagaaagaa

SEQ ID NO: 29439 - RNA, 64 nt, Homo Sapiens
agugaucaccaaaggacugagaaucugggagggcaaaaaaaaaaaaaaaguuuuuaugugcacu

SEQ ID NO: 29440 - RNA, 64 nt, Homo Sapiens
gugaucaccaaaggacugagaaucugggagggcaaaaaaaaaaaaaaaguuuuuaugugcacuu

SEQ ID NO: 29441 - RNA, 64 nt, Homo Sapiens
ugaucaccaaaggacugagaaucugggagggcaaaaaaaaaaaaaaaguuuuuaugugcacuua

SEQ ID NO: 29442 - RNA, 64 nt, Homo Sapiens
gaucaccaaaggacugagaaucugggagggcaaaaaaaaaaaaaaaguuuuuaugugcacuuaa

SEQ ID NO: 29443 - RNA, 64 nt, Homo Sapiens
aucaccaaaggacugagaaucugggagggcaaaaaaaaaaaaaaaguuuuuaugugcacuuaaa

SEQ ID NO: 29444 - RNA, 64 nt, Homo Sapiens
ucaccaaaggacugagaaucugggagggcaaaaaaaaaaaaaaaguuuuuaugugcacuuaaau

SEQ ID NO: 29445 - RNA, 64 nt, Homo Sapiens
caccaaaggacugagaaucugggagggcaaaaaaaaaaaaaaaguuuuuaugugcacuuaaauu

SEQ ID NO: 29446 - RNA, 64 nt, Homo Sapiens
accaaaggacugagaaucugggagggcaaaaaaaaaaaaaaaguuuuuaugugcacuuaaauuu

SEQ ID NO: 29447 - RNA, 64 nt, Homo Sapiens
cuuagauuuucuuuuaaaaaaauuaaaauaaaacaaaaaaaaauuucuaggacuagacgaugua

SEQ ID NO: 29448 - RNA, 64 nt, Homo Sapiens
uuagauuuucuuuuaaaaaaauuaaaauaaaacaaaaaaaaauuucuaggacuagacgauguaa

SEQ ID NO: 29449 - RNA, 64 nt, Homo Sapiens
gcugauguugguauuggguguaggaacaugauuuaaaaaaaaacucuugccucugcuuuccccc

SEQ ID NO: 29450 - RNA, 64 nt, Homo Sapiens
cugauguugguauuggguguaggaacaugauuuaaaaaaaaacucuugccucugcuuuccccca

SEQ ID NO: 29451 - RNA, 64 nt, Homo Sapiens
ggaacuuuugggugccaaaugggacuuuuagauuaaaaaaaaaucagaauuaugcuuaacuuuc

SEQ ID NO: 29452 - RNA, 64 nt, Homo Sapiens
gaacuuuugggugccaaaugggacuuuuagauuaaaaaaaaaucagaauuaugcuuaacuuucc

SEQ ID NO: 29453 - RNA, 64 nt, Homo Sapiens
aaaaaaagaaagaaaaaauacaaaaaacaaaaacaaaaaaaaaagaggguaauguacaaguuuc

SEQ ID NO: 29454 - RNA, 64 nt, Homo Sapiens
aaaaaagaaagaaaaaauacaaaaaacaaaaacaaaaaaaaaagaggguaauguacaaguuucu

SEQ ID NO: 29455 - RNA, 64 nt, Homo Sapiens
aaaaagaaagaaaaaauacaaaaaacaaaaacaaaaaaaaaagaggguaauguacaaguuucug

SEQ ID NO: 29456 - RNA, 64 nt, Homo Sapiens
gaauccacauuuguauuucaagauaauguaguuuaaaaaaaaaaaaaagaaaaaaacuugaugu

SEQ ID NO: 29457 - RNA, 64 nt, Homo Sapiens
aauccacauuuguauuucaagauaauguaguuuaaaaaaaaaaaaaagaaaaaaacuugaugua

SEQ ID NO: 29458 - RNA, 64 nt, Homo Sapiens
auccacauuuguauuucaagauaauguaguuuaaaaaaaaaaaaaagaaaaaaacuugauguaa

SEQ ID NO: 29459 - RNA, 64 nt, Homo Sapiens
uccacauuuguauuucaagauaauguaguuuaaaaaaaaaaaaaagaaaaaaacuugauguaaa

SEQ ID NO: 29460 - RNA, 64 nt, Homo Sapiens
ccacauuuguauuucaagauaauguaguuuaaaaaaaaaaaaaagaaaaaaacuugauguaaau

SEQ ID NO: 29461 - RNA, 64 nt, Homo Sapiens
cacauuuguauuucaagauaauguaguuuaaaaaaaaaaaaaagaaaaaaacuugauguaaauu

SEQ ID NO: 29462 - RNA, 64 nt, Homo Sapiens
acauuuguauuucaagauaauguaguuuaaaaaaaaaaaaaagaaaaaaacuugauguaaauuc

SEQ ID NO: 29463 - RNA, 64 nt, Homo Sapiens
auuugaaacagaccugccauuccauuuguuaauuaaaaaaaaaaaaaauccuaaagggaaaaaa

SEQ ID NO: 29464 - RNA, 64 nt, Homo Sapiens
uuugaaacagaccugccauuccauuuguuaauuaaaaaaaaaaaaaauccuaaagggaaaaaac

SEQ ID NO: 29465 - RNA, 64 nt, Homo Sapiens
uugaaacagaccugccauuccauuuguuaauuaaaaaaaaaaaaaauccuaaagggaaaaaacc

SEQ ID NO: 29466 - RNA, 64 nt, Homo Sapiens
ugaaacagaccugccauuccauuuguuaauuaaaaaaaaaaaaaauccuaaagggaaaaaaccg

SEQ ID NO: 29467 - RNA, 64 nt, Homo Sapiens
gaaacagaccugccauuccauuuguuaauuaaaaaaaaaaaaaauccuaaagggaaaaaaccga

SEQ ID NO: 29468 - RNA, 64 nt, Homo Sapiens
aaacagaccugccauuccauuuguuaauuaaaaaaaaaaaaaauccuaaagggaaaaaaccgac

SEQ ID NO: 29469 - RNA, 64 nt, Homo Sapiens
aacagaccugccauuccauuuguuaauuaaaaaaaaaaaaaauccuaaagggaaaaaaccgacc

SEQ ID NO: 29470 - RNA, 64 nt, Homo Sapiens
cuuuucaucugaaaacuaauaccuggaaaaggauaaaaaaaaaaaggaauccgugacccacaga

SEQ ID NO: 29471 - RNA, 64 nt, Homo Sapiens
uuuucaucugaaaacuaauaccuggaaaaggauaaaaaaaaaaaggaauccgugacccacagag

SEQ ID NO: 29472 - RNA, 64 nt, Homo Sapiens
uuucaucugaaaacuaauaccuggaaaaggauaaaaaaaaaaaggaauccgugacccacagagc

SEQ ID NO: 29473 - RNA, 64 nt, Homo Sapiens
uucaucugaaaacuaauaccuggaaaaggauaaaaaaaaaaaggaauccgugacccacagagcu

SEQ ID NO: 29474 - RNA, 64 nt, Homo Sapiens
agguaguugguugaucacaguuuguuaauuguauaaaaaaaaauuaccuagaauaucucuuccc

SEQ ID NO: 29475 - RNA, 64 nt, Homo Sapiens
gguaguugguugaucacaguuuguuaauuguauaaaaaaaaauuaccuagaauaucucuuccca

SEQ ID NO: 29476 - RNA, 64 nt, Homo Sapiens
ugacuuugacaauuacucagguuugagaaaaaggaaaaaaaaacagccaccguuucuuccugcc

SEQ ID NO: 29477 - RNA, 64 nt, Homo Sapiens
gacuuugacaauuacucagguuugagaaaaaggaaaaaaaaacagccaccguuucuuccugcca

SEQ ID NO: 29478 - RNA, 64 nt, Homo Sapiens
aggcaugugugaaacauacucauagauguuaugcaaaaaaaagucuauggccagguaugcaugg

SEQ ID NO: 29479 - RNA, 64 nt, Homo Sapiens
aaaaugauggcagugguuugaaaaacuaaaacagaaaaaaaaauggaagccaacacaucacuca

SEQ ID NO: 29480 - RNA, 64 nt, Homo Sapiens
aaaugauggcagugguuugaaaaacuaaaacagaaaaaaaaauggaagccaacacaucacucau

SEQ ID NO: 29481 - RNA, 64 nt, Homo Sapiens
cuccagccugggugacaaagcgagacuccaucucaaaaaaaaaaaaaaaaaaaaaggaaagaac

SEQ ID NO: 29482 - RNA, 64 nt, Homo Sapiens
uccagccugggugacaaagcgagacuccaucucaaaaaaaaaaaaaaaaaaaaaggaaagaacu

SEQ ID NO: 29483 - RNA, 64 nt, Homo Sapiens
ccagccugggugacaaagcgagacuccaucucaaaaaaaaaaaaaaaaaaaaaggaaagaacug

SEQ ID NO: 29484 - RNA, 64 nt, Homo Sapiens
cagccugggugacaaagcgagacuccaucucaaaaaaaaaaaaaaaaaaaaaggaaagaacugu

SEQ ID NO: 29485 - RNA, 64 nt, Homo Sapiens
agccugggugacaaagcgagacuccaucucaaaaaaaaaaaaaaaaaaaaaggaaagaacuguc

SEQ ID NO: 29486 - RNA, 64 nt, Homo Sapiens
gccugggugacaaagcgagacuccaucucaaaaaaaaaaaaaaaaaaaaaggaaagaacuguca

SEQ ID NO: 29487 - RNA, 64 nt, Homo Sapiens
ccugggugacaaagcgagacuccaucucaaaaaaaaaaaaaaaaaaaaaggaaagaacugucau

SEQ ID NO: 29488 - RNA, 64 nt, Homo Sapiens
cugggugacaaagcgagacuccaucucaaaaaaaaaaaaaaaaaaaaaggaaagaacugucaug

SEQ ID NO: 29489 - RNA, 64 nt, Homo Sapiens
ugggugacaaagcgagacuccaucucaaaaaaaaaaaaaaaaaaaaaggaaagaacugucaugu

SEQ ID NO: 29490 - RNA, 64 nt, Homo Sapiens
gggugacaaagcgagacuccaucucaaaaaaaaaaaaaaaaaaaaaggaaagaacugucaugua

SEQ ID NO: 29491 - RNA, 64 nt, Homo Sapiens
ggugacaaagcgagacuccaucucaaaaaaaaaaaaaaaaaaaaaggaaagaacugucauguaa

SEQ ID NO: 29492 - RNA, 64 nt, Homo Sapiens
gugacaaagcgagacuccaucucaaaaaaaaaaaaaaaaaaaaaggaaagaacugucauguaaa

SEQ ID NO: 29493 - RNA, 64 nt, Homo Sapiens
ugacaaagcgagacuccaucucaaaaaaaaaaaaaaaaaaaaaggaaagaacugucauguaaac

SEQ ID NO: 29494 - RNA, 64 nt, Homo Sapiens
gacaaagcgagacuccaucucaaaaaaaaaaaaaaaaaaaaaggaaagaacugucauguaaaca

SEQ ID NO: 29495 - RNA, 64 nt, Homo Sapiens
aguuauggccaucuuaguggcuuuuccuuuuuuuaaaaaaaauacaccaacacuuauuauuuuc

SEQ ID NO: 29496 - RNA, 64 nt, Homo Sapiens
uucuccucuaaaaggaaaccuuauuuaaaguuccaaaaaaaaugauguugcauaaccaccaccu

SEQ ID NO: 29497 - RNA, 64 nt, Homo Sapiens
gagagagauguaauuuaaaaagccuugauuuuaaaaaaaaaagaaaaagauuuugacauaaaag

SEQ ID NO: 29498 - RNA, 64 nt, Homo Sapiens
agagagagauguaauuuaaagagccuugauuuuaaaaaaaaaagaaaaagauuuugacauaaaa

SEQ ID NO: 29499 - RNA, 64 nt, Homo Sapiens
gagagagagauguaauuuaaagagccuugauuuuaaaaaaaaaaaaaaaagauuuugacauaaa

SEQ ID NO: 29500 - RNA, 64 nt, Homo Sapiens
uaacugaagaacuaaguugacuccaucucaacaaaaaaaaaaucgcuugggugacagagugaga

SEQ ID NO: 29501 - RNA, 64 nt, Homo Sapiens
cuaacugaagaacuaaguugacuccaucucaacaaaaaaaaaauagcuugggugacagagugag

SEQ ID NO: 29502 - RNA, 64 nt, Homo Sapiens
ucuaacugaagaacuaaguugacuccaucucaacaaaaaaaaaacagcuugggugacagaguga

SEQ ID NO: 29503 - RNA, 64 nt, Homo Sapiens
cagcuguccuuggagcagagaguaauguagacaaaaaaaaaagcguauaaaguguuacugcaug

SEQ ID NO: 29504 - RNA, 64 nt, Homo Sapiens
ccagcuguccuuggagcagagaguaauguagacaaaaaaaaaaguguauaaaguguuacugcau

SEQ ID NO: 29505 - RNA, 64 nt, Homo Sapiens
gccagcuguccuuggagcagugaguaauguagacaaaaaaaaaaauguauaaaguguuacugca

SEQ ID NO: 29506 - RNA, 64 nt, Homo Sapiens
uggcuaacuaguguguuuucucugaauaggcauuaaaaaaaauauuacugggacacuuuuaaac

SEQ ID NO: 29507 - RNA, 64 nt, Homo Sapiens
acuuccagaaaauguuuagaaauaagaacccuuaaaaaaaaacaauuuaauaaauaguaaaucc

SEQ ID NO: 29508 - RNA, 64 nt, Homo Sapiens
aacuuccagaaaauguuuagcaauaagaacccuuaaaaaaaaacaauuuaauaaauaguaaauc

SEQ ID NO: 29509 - RNA, 64 nt, Homo Sapiens
aguggaaauaaaugaucauaucucagagugauuaaaaaaaaaucuaaaaaacaagaaugcauga

SEQ ID NO: 29510 - RNA, 64 nt, Homo Sapiens
caguggaaauaaaugaucauaucucagagugauuaaaaaaaaauuuaaaaaacaagaaugcaug

SEQ ID NO: 29511 - RNA, 64 nt, Homo Sapiens
augaauuacgaagcaccuuaaugcauuucauuaaaaaaaaaaccuguuuguagauguuugucug

SEQ ID NO: 29512 - RNA, 64 nt, Homo Sapiens
caugaauuacgaagcaccuugaugcauuucauuaaaaaaaaaacuuguuuguagauguuugucu

SEQ ID NO: 29513 - RNA, 64 nt, Homo Sapiens
ccaugaauuacgaagcaccuugaugcauuucauuaaaaaaaaaauuuguuuguagauguuuguc

SEQ ID NO: 29514 - RNA, 54 nt, Homo Sapiens
ggaaggggacugcguuaacggaagaaaaaaaagauggagauggcaacguucuga

SEQ ID NO: 29515 - RNA, 64 nt, Homo Sapiens
aaucuagauuaucaagguuacaaaggguaaaaaaaaaaaaaagaguggugucucugaauuacug

SEQ ID NO: 29516 - RNA, 64 nt, Homo Sapiens
aaaucuagauuaucaagguugcaaaggguaaaaaaaaaaaaaagaguggugucucugaauuacu

SEQ ID NO: 29517 - RNA, 64 nt, Homo Sapiens
gaaaucuagauuaucaagguugcaaaggguaaaaaaaaaaaaaacaguggugucucugaauuac

SEQ ID NO: 29518 - RNA, 64 nt, Homo Sapiens
agaaaucuagauuaucaaggcugcaaaggguaaaaaaaaaaaaagcaguggugucucugaauua

SEQ ID NO: 29519 - RNA, 64 nt, Homo Sapiens
aagaaaucuagauuaucaagacugcaaaggguaaaaaaaaaaaaagcaguggugucucugaauu

SEQ ID NO: 29520 - RNA, 64 nt, Homo Sapiens
aaagaaaucuagauuaucaauacugcaaaggguaaaaaaaaaaacagcaguggugucucugaau

SEQ ID NO: 29521 - RNA, 64 nt, Homo Sapiens
aaaagaaaucuagauuaucauuacugcaaaggguaaaaaaaaaaucagcaguggugucucugaa

SEQ ID NO: 29522 - RNA, 64 nt, Homo Sapiens
ugguaucaacccacauuuugguuucacaaauuaaaaaaaaaaucuugaaaauaguacuuucuuc

SEQ ID NO: 29523 - RNA, 64 nt, Homo Sapiens
cugguaucaacccacauuuucguuucacaaauuaaaaaaaaaauauugaaaauaguacuuucuu

SEQ ID NO: 29524 - RNA, 64 nt, Homo Sapiens
ucugguaucaacccacauuuucguuucacaaauuaaaaaaaaaacauugaaaauaguacuuucu

SEQ ID NO: 29525 - RNA, 64 nt, Homo Sapiens
uuuauaaguagggagaaauucuuuaaagugcuuuaaaaaaaaguuuuguggguuuugaaugcau

SEQ ID NO: 29526 - RNA, 64 nt, Homo Sapiens
aaguugcuuucuuuuuuucagaaaaaacaaaaacaaaaaaaacucucacuuuaaacucuuuggg

SEQ ID NO: 29527 - RNA, 64 nt, Homo Sapiens
ggggauucuuaaaguugaauuuggaaaucuuuaaaaaaaaaauuucaaaguugccuaaauccau

SEQ ID NO: 29528 - RNA, 64 nt, Homo Sapiens
uggggauucuuaaaguugaauuuggaaaucuuuaaaaaaaaaauuucaaaguugccuaaaucca

SEQ ID NO: 29529 - RNA, 64 nt, Homo Sapiens
uuggggauucuuaaaguugaauuuggaaaucuuuaaaaaaaaaaauucaaaguugccuaaaucc

SEQ ID NO: 29530 - RNA, 64 nt, Homo Sapiens
caaucugaggaaagacugcagguuugcacccaaaaaaaaaaaccucguuggagagccuuacuug

SEQ ID NO: 29531 - RNA, 64 nt, Homo Sapiens
ccaaucugaggaaagacugcggguuugcacccaaaaaaaaaaacuucguuggagagccuuacuu

SEQ ID NO: 29532 - RNA, 64 nt, Homo Sapiens
cccaaucugaggaaagacuguggguuugcacccaaaaaaaaaaaauucguuggagagccuuacu

SEQ ID NO: 29533 - RNA, 64 nt, Homo Sapiens
acccaaucugaggaaagacuuuggguuugcacccaaaaaaaaaacauucguuggagagccuuac

SEQ ID NO: 29534 - RNA, 64 nt, Homo Sapiens
ugcucuauaucugaaagagcgaaaauauagagaaaaaaaaaaccgugguggccacuggugacuu

SEQ ID NO: 29535 - RNA, 64 nt, Homo Sapiens
cugcucuauaucugaaagagugaaaauauagagaaaaaaaaaacugugguggccacuggugacu

SEQ ID NO: 29536 - RNA, 64 nt, Homo Sapiens
ccugcucuauaucugaaagauugaaaauauagagaaaaaaaaaagugugguggccacuggugac

SEQ ID NO: 29537 - RNA, 64 nt, Homo Sapiens
augaugguggugaauaaagauuaaaagcaaaaaaaaaaaaaaguuuuuuuuccaccuccacuuu

SEQ ID NO: 29538 - RNA, 64 nt, Homo Sapiens
uaugaugguggugaauaaaguuuaaaagcaaaaaaaaaaaaaaguuuuuuuuccaccuccacuu

SEQ ID NO: 29539 - RNA, 64 nt, Homo Sapiens
guaugaugguggugaauaaauuuuaaaagcaaaaaaaaaaaaaauuuuuuuuuccaccuccacu

SEQ ID NO: 29540 - RNA, 64 nt, Homo Sapiens
aguaugaugguggugaauaauuuuuaaaagcaaaaaaaaaaaaauuuuuuuuuuccaccuccac

SEQ ID NO: 29541 - RNA, 64 nt, Homo Sapiens
aaguaugaugguggugaauacuuuuuaaaagcaaaaaaaaaaaauuuuuuuuuuuccaccucca

SEQ ID NO: 29542 - RNA, 64 nt, Homo Sapiens
aaaguaugaugguggugaauacuuuuuaaaagcaaaaaaaaaaauuuuuuuuuuuuccaccucc

SEQ ID NO: 29543 - RNA, 64 nt, Homo Sapiens
aaaaguaugaugguggugaacacuuuuuaaaagcaaaaaaaaaauuuuuuuuuuuuuccaccuc

SEQ ID NO: 29544 - RNA, 64 nt, Homo Sapiens
aaaguuauuuguuugugggucaaaaaaaaaaaaaaaaaaaaauuucaaaggcccagcuccugcu

SEQ ID NO: 29545 - RNA, 64 nt, Homo Sapiens
uaaaguuauuuguuugugggucaaaaaaaaaaaaaaaaaaaaaucucaaaggcccagcuccugc

SEQ ID NO: 29546 - RNA, 64 nt, Homo Sapiens
uuaaaguuauuuguuuguggcucaaaaaaaaaaaaaaaaaaaaaccucaaaggcccagcuccug

SEQ ID NO: 29547 - RNA, 64 nt, Homo Sapiens
auuaaaguuauuuguuuguggcucaaaaaaaaaaaaaaaaaaaacccucaaaggcccagcuccu

SEQ ID NO: 29548 - RNA, 64 nt, Homo Sapiens
aauuaaaguuauuuguuuguugcucaaaaaaaaaaaaaaaaaaagcccucaaaggcccagcucc

SEQ ID NO: 29549 - RNA, 64 nt, Homo Sapiens
aaauuaaaguuauuuguuugcugcucaaaaaaaaaaaaaaaaaaggcccucaaaggcccagcuc

SEQ ID NO: 29550 - RNA, 64 nt, Homo Sapiens
aaaauuaaaguuauuuguuuccugcucaaaaaaaaaaaaaaaaagggcccucaaaggcccagcu

SEQ ID NO: 29551 - RNA, 64 nt, Homo Sapiens
aaaaauuaaaguuauuuguuuccugcucaaaaaaaaaaaaaaaaggggcccucaaaggcccagc

SEQ ID NO: 29552 - RNA, 64 nt, Homo Sapiens
aaaaaauuaaaguuauuugucuccugcucaaaaaaaaaaaaaaaaggggcccucaaaggcccag

SEQ ID NO: 29553 - RNA, 64 nt, Homo Sapiens
aaaaaaauuaaaguuauuuggcuccugcucaaaaaaaaaaaaaacaggggcccucaaaggccca

SEQ ID NO: 29554 - RNA, 64 nt, Homo Sapiens
aaaaaaaauuaaaguuauuuagcuccugcucaaaaaaaaaaaaagcaggggcccucaaaggccc

SEQ ID NO: 29555 - RNA, 64 nt, Homo Sapiens
aaaaaaaaauuaaaguuauucagcuccugcucaaaaaaaaaaaaagcaggggcccucaaaggcc

SEQ ID NO: 29556 - RNA, 64 nt, Homo Sapiens
aaaaaaaaaauuaaaguuauccagcuccugcucaaaaaaaaaaagagcaggggcccucaaaggc

SEQ ID NO: 29557 - RNA, 64 nt, Homo Sapiens
aaaaaaaaaaauuaaaguuacccagcuccugcucaaaaaaaaaaggagcaggggcccucaaagg

SEQ ID NO: 29558 - RNA, 64 nt, Homo Sapiens
ugacuucccauuguuuuuggcuuuaaauaaauccaaaaaaaauggaugcacuuuuuuguguguu

SEQ ID NO: 29559 - RNA, 64 nt, Homo Sapiens
auuuagaugcacuuuuuugucauuguuuuuaaaaaaaaaaaaucagcauaugaggaauuaaaga

SEQ ID NO: 29560 - RNA, 64 nt, Homo Sapiens
cauuuagaugcacuuuuuugacauuguuuuuaaaaaaaaaaaaucagcauaugaggaauuaaag

SEQ ID NO: 29561 - RNA, 64 nt, Homo Sapiens
ucauuuagaugcacuuuuuugacauuguuuuuaaaaaaaaaaaaucagcauaugaggaauuaaa

SEQ ID NO: 29562 - RNA, 64 nt, Homo Sapiens
aucauuuagaugcacuuuuuagacauuguuuuuaaaaaaaaaaagucagcauaugaggaauuaa

SEQ ID NO: 29563 - RNA, 64 nt, Homo Sapiens
aaucauuuagaugcacuuuuaagacauuguuuuuaaaaaaaaaaagucagcauaugaggaauua

SEQ ID NO: 29564 - RNA, 64 nt, Homo Sapiens
cuucaugaauuucuccuuucgcagaaaccuuuaaaaaaaaaaugcuuugaacuuucauagcacu

SEQ ID NO: 29565 - RNA, 64 nt, Homo Sapiens
gcuucaugaauuucuccuuuugcagaaaccuuuaaaaaaaaaauccuuugaacuuucauagcac

SEQ ID NO: 29566 - RNA, 64 nt, Homo Sapiens
ugcuucaugaauuucuccuucugcagaaaccuuuaaaaaaaaaaaccuuugaacuuucauagca

SEQ ID NO: 29567 - RNA, 64 nt, Homo Sapiens
aacauguuuuuguuguaguuaaucaucauuuuuaaaaaaaaauuucccuucaaaucugccuuug

SEQ ID NO: 29568 - RNA, 64 nt, Homo Sapiens
uaacauguuuuuguuguagugaaucaucauuuuuaaaaaaaaauuucccuucaaaucugccuuu

SEQ ID NO: 29569 - RNA, 64 nt, Homo Sapiens
aaauugugcaaagcauaggucgccgucucaaaaaaaaaaaaagaagccuggcgacagagcgaga

SEQ ID NO: 29570 - RNA, 64 nt, Homo Sapiens
aaaauugugcaaagcauaggacgccgucucaaaaaaaaaaaaagcagccuggcgacagagcgag

SEQ ID NO: 29571 - RNA, 64 nt, Homo Sapiens
gaaaauugugcaaagcauaggacgccgucucaaaaaaaaaaaaaccagccuggcgacagagcga

SEQ ID NO: 29572 - RNA, 64 nt, Homo Sapiens
agaaaauugugcaaagcauaagacgccgucucaaaaaaaaaaaauccagccuggcgacagagcg

SEQ ID NO: 29573 - RNA, 64 nt, Homo Sapiens
aagaaaauugugcaaagcaugagacgccgucucaaaaaaaaaaacuccagccuggcgacagagc

SEQ ID NO: 29574 - RNA, 64 nt, Homo Sapiens
aaagaaaauugugcaaagcacgagacgccgucucaaaaaaaaaaacuccagccuggcgacagag

SEQ ID NO: 29575 - RNA, 64 nt, Homo Sapiens
cuauuucuuuuccuuuuauuuauucagguuuagaaaaaaaaaucuguuuuaaaaguggucauuu

SEQ ID NO: 29576 - RNA, 64 nt, Homo Sapiens
ccuauuucuuuuccuuuuauuuauucagguuuagaaaaaaaaaucuguuuuaaaaguggucauu

SEQ ID NO: 29577 - RNA, 64 nt, Homo Sapiens
aggaccacaugugagauguuguguggagccuggaaaaaaaaauucucgauccuugaaaagaacu

SEQ ID NO: 29578 - RNA, 64 nt, Homo Sapiens
uaggaccacaugugagauguuguguggagccuggaaaaaaaaauacucgauccuugaaaagaac

SEQ ID NO: 29579 - RNA, 64 nt, Homo Sapiens
ccuaaaaacucucuauacuccacuucaaaaauaaaaaaaaaaucuaaguauguacauacaguuu

SEQ ID NO: 29580 - RNA, 64 nt, Homo Sapiens
cccuaaaaacucucuauacuucacuucaaaaauaaaaaaaaaauauaaguauguacauacaguu

SEQ ID NO: 29581 - RNA, 64 nt, Homo Sapiens
ucccuaaaaacucucuauacuucacuucaaaaauaaaaaaaaaauauaaguauguacauacagu

SEQ ID NO: 29582 - RNA, 64 nt, Homo Sapiens
agagaauuagggaaacaccauucuccuaaaaaaaaaaaaaaaugcauaguuaagcuacuccucu

SEQ ID NO: 29583 - RNA, 64 nt, Homo Sapiens
gagagaauuagggaaacaccuuucuccuaaaaaaaaaaaaaaauccauaguuaagcuacuccuc

SEQ ID NO: 29584 - RNA, 64 nt, Homo Sapiens
ugagagaauuagggaaacaccuuucuccuaaaaaaaaaaaaaaacccauaguuaagcuacuccu

SEQ ID NO: 29585 - RNA, 64 nt, Homo Sapiens
augagagaauuagggaaacaucuuucuccuaaaaaaaaaaaaaaacccauaguuaagcuacucc

SEQ ID NO: 29586 - RNA, 64 nt, Homo Sapiens
aaugagagaauuagggaaaccucuuucuccuaaaaaaaaaaaaaaacccauaguuaagcuacuc

SEQ ID NO: 29587 - RNA, 64 nt, Homo Sapiens
aaaugagagaauuagggaaaccucuuucuccuaaaaaaaaaaaacaacccauaguuaagcuacu

SEQ ID NO: 29588 - RNA, 64 nt, Homo Sapiens
aaaaugagagaauuagggaauccucuuucuccuaaaaaaaaaaaucaacccauaguuaagcuac

SEQ ID NO: 29589 - RNA, 64 nt, Homo Sapiens
aaaaaugagagaauuagggacuccucuuucuccuaaaaaaaaaacucaacccauaguuaagcua

SEQ ID NO: 29590 - RNA, 64 nt, Homo Sapiens
cgaaugacuuaggcagaacaaaaaacgaaaaacaaaaaaaaacugcuugggcaccaacagaauu

SEQ ID NO: 29591 - RNA, 64 nt, Homo Sapiens
ucgaaugacuuaggcagaacuaaaaacgaaaaacaaaaaaaaacugcuugggcaccaacagaau

SEQ ID NO: 29592 - RNA, 64 nt, Homo Sapiens
cugagaccaugaguggggcuaaaaaaaaaaaacaaaaaaaaaccggguuuauuuuauguaaaaa

SEQ ID NO: 29593 - RNA, 64 nt, Homo Sapiens
ccugagaccaugaguggggcaaaaaaaaaaaaacaaaaaaaaacaggguuuauuuuauguaaaa

SEQ ID NO: 29594 - RNA, 64 nt, Homo Sapiens
aaaaaaaacccugagaccauuauguaaaaaaaaaaaaaaaaacaggugugcuaaggguuuauuu

SEQ ID NO: 29595 - RNA, 64 nt, Homo Sapiens
aaaaaaaaacccugagaccauuauguaaaaaaaaaaaaaaaaacgggugugcuaaggguuuauu

SEQ ID NO: 29596 - RNA, 64 nt, Homo Sapiens
caaaaaaaaacccugagaccuuuauguaaaaaaaaaaaaaaaaacgggugugcuaaggguuuau

SEQ ID NO: 29597 - RNA, 64 nt, Homo Sapiens
acaaaaaaaaacccugagacuuuuauguaaaaaaaaaaaaaaaaacgggugugcuaaggguuua

SEQ ID NO: 29598 - RNA, 64 nt, Homo Sapiens
aacaaaaaaaaacccugagaauuuuauguaaaaaaaaaaaaaaagacgggugugcuaaggguuu

SEQ ID NO: 29599 - RNA, 64 nt, Homo Sapiens
aaacaaaaaaaaacccugaguauuuuauguaaaaaaaaaaaaaaggacgggugugcuaaggguu

SEQ ID NO: 29600 - RNA, 64 nt, Homo Sapiens
aaaacaaaaaaaaacccugauuauuuuauguaaaaaaaaaaaaauggacgggugugcuaagggu

SEQ ID NO: 29601 - RNA, 64 nt, Homo Sapiens
aaaaacaaaaaaaaacccuguuuauuuuauguaaaaaaaaaaaaguggacgggugugcuaaggg

SEQ ID NO: 29602 - RNA, 64 nt, Homo Sapiens
aaaaaacaaaaaaaaacccuguuuauuuuauguaaaaaaaaaaaaguggacgggugugcuaagg

SEQ ID NO: 29603 - RNA, 64 nt, Homo Sapiens
aaaaaaacaaaaaaaaacccgguuuauuuuauguaaaaaaaaaacaguggacgggugugcuaag

SEQ ID NO: 29604 - RNA, 64 nt, Homo Sapiens
cacauaaaguuccauguguauuuguuaaaaaagaaaaaaaaacaguucaguguuuuaaccugua

SEQ ID NO: 29605 - RNA, 64 nt, Homo Sapiens
acacauaaaguuccauguguauuuguuaaaaaagaaaaaaaaacuguucaguguuuuaaccugu

SEQ ID NO: 29606 - RNA, 64 nt, Homo Sapiens
aaaccaaacaccucccuugaucaucaguuaaaaaaaaaaaaagauuggagggaagacagcagag

SEQ ID NO: 29607 - RNA, 64 nt, Homo Sapiens
aaaaccaaacaccucccuuggucaucaguuaaaaaaaaaaaaagcuuggagggaagacagcaga

SEQ ID NO: 29608 - RNA, 64 nt, Homo Sapiens
gaaaaccaaacaccucccuuagucaucaguuaaaaaaaaaaaaaccuuggagggaagacagcag

SEQ ID NO: 29609 - RNA, 64 nt, Homo Sapiens
agaaaaccaaacaccucccugagucaucaguuaaaaaaaaaaaacccuuggagggaagacagca

SEQ ID NO: 29610 - RNA, 64 nt, Homo Sapiens
aagaaaaccaaacaccucccagagucaucaguuaaaaaaaaaaaucccuuggagggaagacagc

SEQ ID NO: 29611 - RNA, 64 nt, Homo Sapiens
aaagaaaaccaaacaccucccagagucaucaguuaaaaaaaaaauucccuuggagggaagacag

SEQ ID NO: 29612 - RNA, 64 nt, Homo Sapiens
auaaagaaagaaaagugcgacuccaacucaaaaaaaaaaaaagagccugggcgauggagcgaga

SEQ ID NO: 29613 - RNA, 64 nt, Homo Sapiens
aauaaagaaagaaaagugcgacuccaacucaaaaaaaaaaaaagagccugggcgauggagcgag

SEQ ID NO: 29614 - RNA, 64 nt, Homo Sapiens
gaauaaagaaagaaaagugcgacuccaacucaaaaaaaaaaaaacagccugggcgauggagcga

SEQ ID NO: 29615 - RNA, 64 nt, Homo Sapiens
agaauaaagaaagaaaagugagacuccaacucaaaaaaaaaaaaccagccugggcgauggagcg

SEQ ID NO: 29616 - RNA, 64 nt, Homo Sapiens
aagaauaaagaaagaaaagugagacuccaacucaaaaaaaaaaauccagccugggcgauggagc

SEQ ID NO: 29617 - RNA, 64 nt, Homo Sapiens
aaagaauaaagaaagaaaagcgagacuccaacucaaaaaaaaaacuccagccugggcgauggag

SEQ ID NO: 29618 - RNA, 64 nt, Homo Sapiens
ccuaugcaacuucaaauaguacaaaauggauuaaaaaaaaaaugaagguuccauaguaucuuuu

SEQ ID NO: 29619 - RNA, 64 nt, Homo Sapiens
gccuaugcaacuucaaauaguacaaaauggauuaaaaaaaaaaucaagguuccauaguaucuuu

SEQ ID NO: 29620 - RNA, 64 nt, Homo Sapiens
ugccuaugcaacuucaaauauuacaaaauggauuaaaaaaaaaaucaagguuccauaguaucuu

SEQ ID NO: 29621 - RNA, 64 nt, Homo Sapiens
ccaggacccacccauguuuuuaaggauaugguuaaaaaaaaauccuguauaaugaaaaaguauu

SEQ ID NO: 29622 - RNA, 64 nt, Homo Sapiens
cccaggacccacccauguuuuuaaggauaugguuaaaaaaaaauacuguauaaugaaaaaguau

SEQ ID NO: 29623 - RNA, 64 nt, Homo Sapiens
cguaaucuguuucaccuguaaauagcaugcuugaaaaaaaaauaugagauaucaagguaauuaa

SEQ ID NO: 29624 - RNA, 64 nt, Homo Sapiens
acguaaucuguuucaccuguaaauagcaugcuugaaaaaaaaauaugagauaucaagguaauua

SEQ ID NO: 29625 - RNA, 64 nt, Homo Sapiens
ccugcaacccucuugaucuuauuuguuguuaaaaaaaaaaaauugauugggacacauaccauug

SEQ ID NO: 29626 - RNA, 64 nt, Homo Sapiens
uccugcaacccucuugaucugauuuguuguuaaaaaaaaaaaauagauugggacacauaccauu

SEQ ID NO: 29627 - RNA, 64 nt, Homo Sapiens
uuccugcaacccucuugaucugauuuguuguuaaaaaaaaaaaagagauugggacacauaccau

SEQ ID NO: 29628 - RNA, 64 nt, Homo Sapiens
auuccugcaacccucuugauuugauuuguuguuaaaaaaaaaaaggagauugggacacauacca

SEQ ID NO: 29629 - RNA, 64 nt, Homo Sapiens
aauuccugcaacccucuugaauugauuuguuguuaaaaaaaaaaaggagauugggacacauacc

SEQ ID NO: 29630 - RNA, 64 nt, Homo Sapiens
gacaaaguuacgaggccaucaaaaacuuuaaaaaaaaaaaaaccuucuggaacaaaacaguuag

SEQ ID NO: 29631 - RNA, 64 nt, Homo Sapiens
cgacaaaguuacgaggccaugaaaaacuuuaaaaaaaaaaaaacauucuggaacaaaacaguua

SEQ ID NO: 29632 - RNA, 64 nt, Homo Sapiens
ccgacaaaguuacgaggccaagaaaaacuuuaaaaaaaaaaaaagauucuggaacaaaacaguu

SEQ ID NO: 29633 - RNA, 64 nt, Homo Sapiens
accgacaaaguuacgaggccuagaaaaacuuuaaaaaaaaaaaaugauucuggaacaaaacagu

SEQ ID NO: 29634 - RNA, 64 nt, Homo Sapiens
aaccgacaaaguuacgaggcuuagaaaaacuuuaaaaaaaaaaacugauucuggaacaaaacag

SEQ ID NO: 29635 - RNA, 64 nt, Homo Sapiens
aaaccgacaaaguuacgaggguuagaaaaacuuuaaaaaaaaaaacugauucuggaacaaaaca

SEQ ID NO: 29636 - RNA, 64 nt, Homo Sapiens
cuuuucuuuuuaaacaguucaaaaaaaaaaaaaaaaaaaaaaggguucaugcaguaggauaaaa

SEQ ID NO: 29637 - RNA, 64 nt, Homo Sapiens
gcuuuucuuuuuaaacaguuaaaaaaaaaaaaaaaaaaaaaaagaguucaugcaguaggauaaa

SEQ ID NO: 29638 - RNA, 64 nt, Homo Sapiens
ggcuuuucuuuuuaaacaguaaaaaaaaaaaaaaaaaaaaaaaacaguucaugcaguaggauaa

SEQ ID NO: 29639 - RNA, 64 nt, Homo Sapiens
aggcuuuucuuuuuaaacagaaaaaaaaaaaaaaaaaaaaaaaaucaguucaugcaguaggaua

SEQ ID NO: 29640 - RNA, 64 nt, Homo Sapiens
aaggcuuuucuuuuuaaacaaaaaaaaaaaaaaaaaaaaaaaaagucaguucaugcaguaggau

SEQ ID NO: 29641 - RNA, 64 nt, Homo Sapiens
aaaggcuuuucuuuuuaaacuaaaaaaaaaaaaaaaaaaaaaaaugucaguucaugcaguagga

SEQ ID NO: 29642 - RNA, 64 nt, Homo Sapiens
aaaaggcuuuucuuuuuaaaauaaaaaaaaaaaaaaaaaaaaaauugucaguucaugcaguagg

SEQ ID NO: 29643 - RNA, 64 nt, Homo Sapiens
aaaaaggcuuuucuuuuuaagauaaaaaaaaaaaaaaaaaaaaauuugucaguucaugcaguag

SEQ ID NO: 29644 - RNA, 64 nt, Homo Sapiens
aaaaaaggcuuuucuuuuuaggauaaaaaaaaaaaaaaaaaaaaauuugucaguucaugcagua

SEQ ID NO: 29645 - RNA, 64 nt, Homo Sapiens
aaaaaaaggcuuuucuuuuuaggauaaaaaaaaaaaaaaaaaaaaauuugucaguucaugcagu

SEQ ID NO: 29646 - RNA, 64 nt, Homo Sapiens
aaaaaaaaggcuuuucuuuuuaggauaaaaaaaaaaaaaaaaaaaaauuugucaguucaugcag

SEQ ID NO: 29647 - RNA, 64 nt, Homo Sapiens
aaaaaaaaaggcuuuucuuuguaggauaaaaaaaaaaaaaaaaagaaauuugucaguucaugca

SEQ ID NO: 29648 - RNA, 64 nt, Homo Sapiens
aaaaaaaaaaggcuuuucuuaguaggauaaaaaaaaaaaaaaaaagaaauuugucaguucaugc

SEQ ID NO: 29649 - RNA, 64 nt, Homo Sapiens
aaaaaaaaaaaggcuuuucucaguaggauaaaaaaaaaaaaaaacagaaauuugucaguucaug

SEQ ID NO: 29650 - RNA, 64 nt, Homo Sapiens
aaaaaaaaaaaaggcuuuucgcaguaggauaaaaaaaaaaaaaaccagaaauuugucaguucau

SEQ ID NO: 29651 - RNA, 64 nt, Homo Sapiens
aaaaaaaaaaaaaggcuuuuugcaguaggauaaaaaaaaaaaaagccagaaauuugucaguuca

SEQ ID NO: 29652 - RNA, 64 nt, Homo Sapiens
aaaaaaaaaaaaaaggcuuuaugcaguaggauaaaaaaaaaaaaugccagaaauuugucaguuc

SEQ ID NO: 29653 - RNA, 64 nt, Homo Sapiens
aaaaaaaaaaaaaaaggcuucaugcaguaggauaaaaaaaaaaaaugccagaaauuugucaguu

SEQ ID NO: 29654 - RNA, 64 nt, Homo Sapiens
aaaaaaaaaaaaaaaaggcuucaugcaguaggauaaaaaaaaaaaaugccagaaauuugucagu

SEQ ID NO: 29655 - RNA, 64 nt, Homo Sapiens
uaauuuuuuacaccuucauguggcauuuaugcaaaaaaaaaagucacugagcaauaaaguaucg

SEQ ID NO: 29656 - RNA, 64 nt, Homo Sapiens
uuaauuuuuuacaccuucauguggcauuuaugcaaaaaaaaaagacacugagcaauaaaguauc

SEQ ID NO: 29657 - RNA, 64 nt, Homo Sapiens
guuaauuuuuuacaccuucacguggcauuuaugcaaaaaaaaaaaacacugagcaauaaaguau

SEQ ID NO: 29658 - RNA, 64 nt, Homo Sapiens
gauuaaacaagauaauuaugagucaagugugaaaaaaaaaaagagauucaaaaguugaccugaa

SEQ ID NO: 29659 - RNA, 64 nt, Homo Sapiens
agauuaaacaagauaauuauaagucaagugugaaaaaaaaaaagagauucaaaaguugaccuga

SEQ ID NO: 29660 - RNA, 64 nt, Homo Sapiens
gagauuaaacaagauaauuaaaagucaagugugaaaaaaaaaaagagauucaaaaguugaccug

SEQ ID NO: 29661 - RNA, 64 nt, Homo Sapiens
agagauuaaacaagauaauugaaagucaagugugaaaaaaaaaaugagauucaaaaguugaccu

SEQ ID NO: 29662 - RNA, 64 nt, Homo Sapiens
aaaaagaaaguacugucugucucaaaaaaaaaaaaaaaaaaagagcgacagagccagaccuugu

SEQ ID NO: 29663 - RNA, 64 nt, Homo Sapiens
aaaaaagaaaguacugucugucucaaaaaaaaaaaaaaaaaaagggcgacagagccagaccuug

SEQ ID NO: 29664 - RNA, 64 nt, Homo Sapiens
gaaaaaagaaaguacugucugucucaaaaaaaaaaaaaaaaaaagggcgacagagccagaccuu

SEQ ID NO: 29665 - RNA, 64 nt, Homo Sapiens
agaaaaaagaaaguacugucugucucaaaaaaaaaaaaaaaaaaugggcgacagagccagaccu

SEQ ID NO: 29666 - RNA, 64 nt, Homo Sapiens
aagaaaaaagaaaguacuguuugucucaaaaaaaaaaaaaaaaacugggcgacagagccagacc

SEQ ID NO: 29667 - RNA, 64 nt, Homo Sapiens
aaagaaaaaagaaaguacugcuugucucaaaaaaaaaaaaaaaaccugggcgacagagccagac

SEQ ID NO: 29668 - RNA, 64 nt, Homo Sapiens
aaaagaaaaaagaaaguacuccuugucucaaaaaaaaaaaaaaaaccugggcgacagagccaga

SEQ ID NO: 29669 - RNA, 64 nt, Homo Sapiens
aaaaagaaaaaagaaaguacaccuugucucaaaaaaaaaaaaaaaaccugggcgacagagccag

SEQ ID NO: 29670 - RNA, 64 nt, Homo Sapiens
aaaaaagaaaaaagaaaguagaccuugucucaaaaaaaaaaaaacaaccugggcgacagagcca

SEQ ID NO: 29671 - RNA, 64 nt, Homo Sapiens
aaaaaaagaaaaaagaaaguagaccuugucucaaaaaaaaaaaaccaaccugggcgacagagcc

SEQ ID NO: 29672 - RNA, 64 nt, Homo Sapiens
aaaaaaaagaaaaaagaaagcagaccuugucucaaaaaaaaaaauccaaccugggcgacagagc

SEQ ID NO: 29673 - RNA, 64 nt, Homo Sapiens
aaaaaaaaagaaaaaagaaaccagaccuugucucaaaaaaaaaauuccaaccugggcgacagag

SEQ ID NO: 29674 - RNA, 64 nt, Homo Sapiens
uaaaugacuugaguacccaaagacuccgucucaaaaaaaaaaguucaagccuggcgacagagcg

SEQ ID NO: 29675 - RNA, 64 nt, Homo Sapiens
uuaaaugacuugaguacccagagacuccgucucaaaaaaaaaagcucaagccuggcgacagagc

SEQ ID NO: 29676 - RNA, 64 nt, Homo Sapiens
guuaaaugacuugaguaccccgagacuccgucucaaaaaaaaaaacucaagccuggcgacagag

SEQ ID NO: 29677 - RNA, 64 nt, Homo Sapiens
auuauuuuccaaaaguggccugauucaacuaaaaaaaaaaaaguauuuuaacucugucuucacc

SEQ ID NO: 29678 - RNA, 64 nt, Homo Sapiens
uauuauuuuccaaaaguggccugauucaacuaaaaaaaaaaaaggauuuuaacucugucuucac

SEQ ID NO: 29679 - RNA, 64 nt, Homo Sapiens
guauuauuuuccaaaaguggccugauucaacuaaaaaaaaaaaaugauuuuaacucugucuuca

SEQ ID NO: 29680 - RNA, 64 nt, Homo Sapiens
aguauuauuuuccaaaagugaccugauucaacuaaaaaaaaaaagugauuuuaacucugucuuc

SEQ ID NO: 29681 - RNA, 64 nt, Homo Sapiens
aaguauuauuuuccaaaagucaccugauucaacuaaaaaaaaaaugugauuuuaacucugucuu

SEQ ID NO: 29682 - RNA, 64 nt, Homo Sapiens
gaaauagagcucuaaguuauaaaaaaaaauuaaaaaaaaaaacaacaacaaaaaacaaacaaca

SEQ ID NO: 29683 - RNA, 64 nt, Homo Sapiens
agaaauagagcucuaaguuaaaaaaaaaaauuaaaaaaaaaaacaacaacaaaaaacaaacaac

SEQ ID NO: 29684 - RNA, 64 nt, Homo Sapiens
cagaaauagagcucuaaguucaaaaaaaaaauuaaaaaaaaaaaaaacaacaaaaaacaaacaa

SEQ ID NO: 29685 - RNA, 64 nt, Homo Sapiens
acagaaauagagcucuaaguacaaaaaaaaaauuaaaaaaaaaacaaacaacaaaaaacaaaca

SEQ ID NO: 29686 - RNA, 64 nt, Homo Sapiens
aaaaaaaaaaacagaaauagaaaacaaacaacaaaaaaaaaauuauguuaaaaacaaacaacaa

SEQ ID NO: 29687 - RNA, 64 nt, Homo Sapiens
uaaaaaaaaaaacagaaauaaaaaacaaacaacaaaaaaaaaauuauguuaaaaacaaacaaca

SEQ ID NO: 29688 - RNA, 64 nt, Homo Sapiens
uuaaaaaaaaaaacagaaauaaaaaacaaacaacaaaaaaaaaacuauguuaaaaacaaacaac

SEQ ID NO: 29689 - RNA, 64 nt, Homo Sapiens
gcaucuaguccaacuccuugguuagagcugagaaaaaaaaaauauuauguugacuaaaauuaua

SEQ ID NO: 29690 - RNA, 64 nt, Homo Sapiens
agcaucuaguccaacuccuuaguuagagcugagaaaaaaaaaaucuuauguugacuaaaauuau

SEQ ID NO: 29691 - RNA, 64 nt, Homo Sapiens
uagcaucuaguccaacuccuuaguuagagcugagaaaaaaaaaaucuuauguugacuaaaauua

SEQ ID NO: 29692 - RNA, 64 nt, Homo Sapiens
uacuggcugguuuaauacuugauaucagguuaaaaaaaaaaaguugaucucuuuuucugagcag

SEQ ID NO: 29693 - RNA, 64 nt, Homo Sapiens
uuacuggcugguuuaauacuggauaucagguuaaaaaaaaaaaggugaucucuuuuucugagca

SEQ ID NO: 29694 - RNA, 64 nt, Homo Sapiens
guuacuggcugguuuaauacaggauaucagguuaaaaaaaaaaaagugaucucuuuuucugagc

SEQ ID NO: 29695 - RNA, 64 nt, Homo Sapiens
aguuacuggcugguuuaauacaggauaucagguuaaaaaaaaaaaagugaucucuuuuucugag

SEQ ID NO: 29696 - RNA, 64 nt, Homo Sapiens
cugcaaaaccaaaaauaaaugaccuugucuuuaaaaaaaaaaugcagccugggggauacaguga

SEQ ID NO: 29697 - RNA, 64 nt, Homo Sapiens
gcugcaaaaccaaaaauaaaagaccuugucuuuaaaaaaaaaauucagccugggggauacagug

SEQ ID NO: 29698 - RNA, 64 nt, Homo Sapiens
ugcugcaaaaccaaaaauaagagaccuugucuuuaaaaaaaaaauucagccugggggauacagu

SEQ ID NO: 29699 - RNA, 64 nt, Homo Sapiens
uuugccaauagcuaaaaaguaagaaggaauuaaaaaaaaaaagcuaacacuugagcaaaugcuu

SEQ ID NO: 29700 - RNA, 64 nt, Homo Sapiens
cuuugccaauagcuaaaaaguaagaaggaauuaaaaaaaaaaaguuaacacuugagcaaaugcu

SEQ ID NO: 29701 - RNA, 64 nt, Homo Sapiens
gcuuugccaauagcuaaaaauuaagaaggaauuaaaaaaaaaaauuuaacacuugagcaaaugc

SEQ ID NO: 29702 - RNA, 64 nt, Homo Sapiens
agcuuugccaauagcuaaaacuuaagaaggaauuaaaaaaaaaaguuuaacacuugagcaaaug

SEQ ID NO: 29703 - RNA, 64 nt, Homo Sapiens
gacaaaacacacugaaauuucucauguuaaaaaaaaaaaaaacauuaaauccaguauuuguuua

SEQ ID NO: 29704 - RNA, 64 nt, Homo Sapiens
agacaaaacacacugaaauuacucauguuaaaaaaaaaaaaaacuuuaaauccaguauuuguuu

SEQ ID NO: 29705 - RNA, 64 nt, Homo Sapiens
cagacaaaacacacugaaauuacucauguuaaaaaaaaaaaaaacuuuaaauccaguauuuguu

SEQ ID NO: 29706 - RNA, 64 nt, Homo Sapiens
acagacaaaacacacugaaauuacucauguuaaaaaaaaaaaaaacuuuaaauccaguauuugu

SEQ ID NO: 29707 - RNA, 64 nt, Homo Sapiens
aacagacaaaacacacugaauuuacucauguuaaaaaaaaaaaacacuuuaaauccaguauuug

SEQ ID NO: 29708 - RNA, 64 nt, Homo Sapiens
aaacagacaaaacacacugaguuuacucauguuaaaaaaaaaaagcacuuuaaauccaguauuu

SEQ ID NO: 29709 - RNA, 64 nt, Homo Sapiens
aaaacagacaaaacacacuguguuuacucauguuaaaaaaaaaaugcacuuuaaauccaguauu

SEQ ID NO: 29710 - RNA, 64 nt, Homo Sapiens
uacuuugaucucuguuuuuggacgcagagacugaaaaaaaaauuaaaacauugauuugagcaua

SEQ ID NO: 29711 - RNA, 64 nt, Homo Sapiens
uuacuuugaucucuguuuuuagacgcagagacugaaaaaaaaaugaaaacauugauuugagcau

SEQ ID NO: 29712 - RNA, 64 nt, Homo Sapiens
uuauuuucaagccuucgaaccuaaaagaaaugcaaaaaaaaaguguuguuaaugaccaaacauu

SEQ ID NO: 29713 - RNA, 64 nt, Homo Sapiens
uuuauuuucaagccuucgaaucuaaaagaaaugcaaaaaaaaagaguuguuaaugaccaaacau

SEQ ID NO: 29714 - RNA, 64 nt, Homo Sapiens
acuguguaaccagguuaaguucugacagaaaaaaaaaaaaaaucuaaacugguugucaguuaca

SEQ ID NO: 29715 - RNA, 64 nt, Homo Sapiens
cacuguguaaccagguuaagaucugacagaaaaaaaaaaaaaaucuaaacugguugucaguuac

SEQ ID NO: 29716 - RNA, 64 nt, Homo Sapiens
ucacuguguaaccagguuaacaucugacagaaaaaaaaaaaaaaacuaaacugguugucaguua

SEQ ID NO: 29717 - RNA, 64 nt, Homo Sapiens
aucacuguguaaccagguuaacaucugacagaaaaaaaaaaaaagacuaaacugguugucaguu

SEQ ID NO: 29718 - RNA, 64 nt, Homo Sapiens
aaucacuguguaaccagguuuacaucugacagaaaaaaaaaaaaagacuaaacugguugucagu

SEQ ID NO: 29719 - RNA, 64 nt, Homo Sapiens
aaaucacuguguaaccagguuuacaucugacagaaaaaaaaaaaaagacuaaacugguugucag

SEQ ID NO: 29720 - RNA, 64 nt, Homo Sapiens
aaaaucacuguguaaccaggguuacaucugacagaaaaaaaaaaaaagacuaaacugguuguca

SEQ ID NO: 29721 - RNA, 64 nt, Homo Sapiens
aaccgggcgugguggcaggccacuaaaaaugcaaaaaaaaaauuacauggcgaaaccccgucuc

SEQ ID NO: 29722 - RNA, 64 nt, Homo Sapiens
uaaccgggcgugguggcaggccacuaaaaaugcaaaaaaaaaauaacauggcgaaaccccgucu

SEQ ID NO: 29723 - RNA, 64 nt, Homo Sapiens
uuaaccgggcgugguggcaguccacuaaaaaugcaaaaaaaaaacaacauggcgaaaccccguc

SEQ ID NO: 29724 - RNA, 64 nt, Homo Sapiens
uauuuauguauguacaguuuaauguuauaguaaaaaaaaaaagagcuuuaugugaaaaaaguug

SEQ ID NO: 29725 - RNA, 64 nt, Homo Sapiens
auauuuauguauguacaguugaauguuauaguaaaaaaaaaaagggcuuuaugugaaaaaaguu

SEQ ID NO: 29726 - RNA, 64 nt, Homo Sapiens
gauauuuauguauguacaguugaauguuauaguaaaaaaaaaaaaggcuuuaugugaaaaaagu

SEQ ID NO: 29727 - RNA, 64 nt, Homo Sapiens
agauauuuauguauguacaguugaauguuauaguaaaaaaaaaaaaggcuuuaugugaaaaaag

SEQ ID NO: 29728 - RNA, 64 nt, Homo Sapiens
gauucaauuuuaugguaaagugauacugaggguaaaaaaaaauuaaaaaaggaaaaguagauag

SEQ ID NO: 29729 - RNA, 64 nt, Homo Sapiens
ugauucaauuuuaugguaaagugauacugaggguaaaaaaaaaugaaaaaaggaaaaguagaua

SEQ ID NO: 29730 - RNA, 64 nt, Homo Sapiens
guauugugauuuucaauuuuuuagguuuuaacuuaaaaaaaauuugaauguuaguuagaaaaug

SEQ ID NO: 29731 - RNA, 64 nt, Homo Sapiens
aaagugcuuuucugggucauuuaugccuccaagaaaaaaaaauucuuuaggugagaugacuaaa

SEQ ID NO: 29732 - RNA, 64 nt, Homo Sapiens
uaaagugcuuuucugggucaauuaugccuccaagaaaaaaaaaugcuuuaggugagaugacuaa

SEQ ID NO: 29733 - RNA, 64 nt, Homo Sapiens
aagaaaaaaugugcugcguuuacccaacuaaaaaaaaaaaaauaccccuccaucucgauucucg

SEQ ID NO: 29734 - RNA, 64 nt, Homo Sapiens
aaagaaaaaaugugcugcguguacccaacuaaaaaaaaaaaaaucccccuccaucucgauucuc

SEQ ID NO: 29735 - RNA, 64 nt, Homo Sapiens
uaaagaaaaaaugugcugcgcguacccaacuaaaaaaaaaaaaaucccccuccaucucgauucu

SEQ ID NO: 29736 - RNA, 64 nt, Homo Sapiens
auaaagaaaaaaugugcugcucguacccaacuaaaaaaaaaaaauucccccuccaucucgauuc

SEQ ID NO: 29737 - RNA, 64 nt, Homo Sapiens
aauaaagaaaaaaugugcugcucguacccaacuaaaaaaaaaaaguucccccuccaucucgauu

SEQ ID NO: 29738 - RNA, 64 nt, Homo Sapiens
aaauaaagaaaaaaugugcuucucguacccaacuaaaaaaaaaauguucccccuccaucucgau

SEQ ID NO: 29739 - RNA, 64 nt, Homo Sapiens
cugagucgggggagaggauggcagagacuuuauuaaaaaaaaaaaaagauuguagugguagucu

SEQ ID NO: 29740 - RNA, 64 nt, Homo Sapiens
ugagucgggggagaggauggcagagacuuuauuaaaaaaaaaaaaagauuguagugguagucua

SEQ ID NO: 29741 - RNA, 64 nt, Homo Sapiens
gagucgggggagaggauggcagagacuuuauuaaaaaaaaaaaaagauuguagugguagucuaa

SEQ ID NO: 29742 - RNA, 64 nt, Homo Sapiens
agucgggggagaggauggcagagacuuuauuaaaaaaaaaaaaagauuguagugguagucuaac

SEQ ID NO: 29743 - RNA, 64 nt, Homo Sapiens
gucgggggagaggauggcagagacuuuauuaaaaaaaaaaaaagauuguagugguagucuaacu

SEQ ID NO: 29744 - RNA, 64 nt, Homo Sapiens
ucgggggagaggauggcagagacuuuauuaaaaaaaaaaaaagauuguagugguagucuaacuc

SEQ ID NO: 29745 - RNA, 64 nt, Homo Sapiens
guccugucccuuggaaccuuuguacgcuuugcucaaaaaaaaacaaaaaaaaaaaacaaaaaaa

SEQ ID NO: 29746 - RNA, 64 nt, Homo Sapiens
uccugucccuuggaaccuuuguacgcuuugcucaaaaaaaaacaaaaaaaaaaaacaaaaaaaa

SEQ ID NO: 29747 - RNA, 64 nt, Homo Sapiens
uuggaaccuuuguacgcuuugcucaaaaaaaaacaaaaaaaaaaaacaaaaaaaaaaaacaacg

SEQ ID NO: 29748 - RNA, 64 nt, Homo Sapiens
uggaaccuuuguacgcuuugcucaaaaaaaaacaaaaaaaaaaaacaaaaaaaaaaaacaacgg

SEQ ID NO: 29749 - RNA, 64 nt, Homo Sapiens
ggaaccuuuguacgcuuugcucaaaaaaaaacaaaaaaaaaaaacaaaaaaaaaaaacaacggu

SEQ ID NO: 29750 - RNA, 64 nt, Homo Sapiens
gaaccuuuguacgcuuugcucaaaaaaaaacaaaaaaaaaaaacaaaaaaaaaaaacaacggug

SEQ ID NO: 29751 - RNA, 64 nt, Homo Sapiens
aaccuuuguacgcuuugcucaaaaaaaaacaaaaaaaaaaaacaaaaaaaaaaaacaacggugg

SEQ ID NO: 29752 - RNA, 64 nt, Homo Sapiens
acgcuuugcucaaaaaaaaacaaaaaaaaaaaacaaaaaaaaaaaacaacgguggagccuucgc

SEQ ID NO: 29753 - RNA, 64 nt, Homo Sapiens
cgcuuugcucaaaaaaaaacaaaaaaaaaaaacaaaaaaaaaaaacaacgguggagccuucgca

SEQ ID NO: 29754 - RNA, 64 nt, Homo Sapiens
gcuuugcucaaaaaaaaacaaaaaaaaaaaacaaaaaaaaaaaacaacgguggagccuucgcac

SEQ ID NO: 29755 - RNA, 64 nt, Homo Sapiens
cuuugcucaaaaaaaaacaaaaaaaaaaaacaaaaaaaaaaaacaacgguggagccuucgcacu

SEQ ID NO: 29756 - RNA, 64 nt, Homo Sapiens
uuugcucaaaaaaaaacaaaaaaaaaaaacaaaaaaaaaaaacaacgguggagccuucgcacuc

SEQ ID NO: 29757 - RNA, 64 nt, Homo Sapiens
uguuuguuucuaacuucuguaauacauacaaugcaaaaaaaaaaaaaaaaaaauggccacaaca

SEQ ID NO: 29758 - RNA, 64 nt, Homo Sapiens
guuuguuucuaacuucuguaauacauacaaugcaaaaaaaaaaaaaaaaaaauggccacaacag

SEQ ID NO: 29759 - RNA, 64 nt, Homo Sapiens
uuuguuucuaacuucuguaauacauacaaugcaaaaaaaaaaaaaaaaaaauggccacaacagu

SEQ ID NO: 29760 - RNA, 64 nt, Homo Sapiens
uuguuucuaacuucuguaauacauacaaugcaaaaaaaaaaaaaaaaaaauggccacaacaguu

SEQ ID NO: 29761 - RNA, 64 nt, Homo Sapiens
uguuucuaacuucuguaauacauacaaugcaaaaaaaaaaaaaaaaaaauggccacaacaguug

SEQ ID NO: 29762 - RNA, 64 nt, Homo Sapiens
guuucuaacuucuguaauacauacaaugcaaaaaaaaaaaaaaaaaaauggccacaacaguugc

SEQ ID NO: 29763 - RNA, 64 nt, Homo Sapiens
uuucuaacuucuguaauacauacaaugcaaaaaaaaaaaaaaaaaaauggccacaacaguugca

SEQ ID NO: 29764 - RNA, 64 nt, Homo Sapiens
uucuaacuucuguaauacauacaaugcaaaaaaaaaaaaaaaaaaauggccacaacaguugcac

SEQ ID NO: 29765 - RNA, 64 nt, Homo Sapiens
ucuaacuucuguaauacauacaaugcaaaaaaaaaaaaaaaaaaauggccacaacaguugcaca

SEQ ID NO: 29766 - RNA, 64 nt, Homo Sapiens
cuaacuucuguaauacauacaaugcaaaaaaaaaaaaaaaaaaauggccacaacaguugcacag

SEQ ID NO: 29767 - RNA, 64 nt, Homo Sapiens
uaacuucuguaauacauacaaugcaaaaaaaaaaaaaaaaaaauggccacaacaguugcacagu

SEQ ID NO: 29768 - RNA, 64 nt, Homo Sapiens
aacuucuguaauacauacaaugcaaaaaaaaaaaaaaaaaaauggccacaacaguugcacagug

SEQ ID NO: 29769 - RNA, 64 nt, Homo Sapiens
cacacuccagccugggcaacagagacucugucucaaaaaaaaaaaaaaaaaaaauuaaccucaa

SEQ ID NO: 29770 - RNA, 64 nt, Homo Sapiens
acacuccagccugggcaacagagacucugucucaaaaaaaaaaaaaaaaaaaauuaaccucaac

SEQ ID NO: 29771 - RNA, 64 nt, Homo Sapiens
cacuccagccugggcaacagagacucugucucaaaaaaaaaaaaaaaaaaaauuaaccucaacc

SEQ ID NO: 29772 - RNA, 64 nt, Homo Sapiens
acuccagccugggcaacagagacucugucucaaaaaaaaaaaaaaaaaaaauuaaccucaacca

SEQ ID NO: 29773 - RNA, 64 nt, Homo Sapiens
cuccagccugggcaacagagacucugucucaaaaaaaaaaaaaaaaaaaauuaaccucaaccaa

SEQ ID NO: 29774 - RNA, 64 nt, Homo Sapiens
uccagccugggcaacagagacucugucucaaaaaaaaaaaaaaaaaaaauuaaccucaaccaaa

SEQ ID NO: 29775 - RNA, 64 nt, Homo Sapiens
ccagccugggcaacagagacucugucucaaaaaaaaaaaaaaaaaaaauuaaccucaaccaaac

SEQ ID NO: 29776 - RNA, 64 nt, Homo Sapiens
cagccugggcaacagagacucugucucaaaaaaaaaaaaaaaaaaaauuaaccucaaccaaacg

SEQ ID NO: 29777 - RNA, 64 nt, Homo Sapiens
agccugggcaacagagacucugucucaaaaaaaaaaaaaaaaaaaauuaaccucaaccaaacgc

SEQ ID NO: 29778 - RNA, 64 nt, Homo Sapiens
gccugggcaacagagacucugucucaaaaaaaaaaaaaaaaaaaauuaaccucaaccaaacgcc

SEQ ID NO: 29779 - RNA, 64 nt, Homo Sapiens
ccugggcaacagagacucugucucaaaaaaaaaaaaaaaaaaaauuaaccucaaccaaacgccu

SEQ ID NO: 29780 - RNA, 64 nt, Homo Sapiens
cugggcaacagagacucugucucaaaaaaaaaaaaaaaaaaaauuaaccucaaccaaacgccua

SEQ ID NO: 29781 - RNA, 64 nt, Homo Sapiens
ugggcaacagagacucugucucaaaaaaaaaaaaaaaaaaaauuaaccucaaccaaacgccuau

SEQ ID NO: 29782 - RNA, 64 nt, Homo Sapiens
gaguagauccaugauggauuaauaaagcuugcugaaaaaaaaaaucuguguaucaauuagauuu

SEQ ID NO: 29783 - RNA, 64 nt, Homo Sapiens
aguagauccaugauggauuaauaaagcuugcugaaaaaaaaaaucuguguaucaauuagauuua

SEQ ID NO: 29784 - RNA, 64 nt, Homo Sapiens
guagauccaugauggauuaauaaagcuugcugaaaaaaaaaaucuguguaucaauuagauuuac

SEQ ID NO: 29785 - RNA, 64 nt, Homo Sapiens
gagaagagaaacuuggcuucuguuuucgcaaaggaaaaaaaaaauaggauaggcuucccuugug

SEQ ID NO: 29786 - RNA, 64 nt, Homo Sapiens
agaagagaaacuuggcuucuguuuucgcaaaggaaaaaaaaaauaggauaggcuucccuugugc

SEQ ID NO: 29787 - RNA, 64 nt, Homo Sapiens
gaagagaaacuuggcuucuguuuucgcaaaggaaaaaaaaaauaggauaggcuucccuugugca

SEQ ID NO: 29788 - RNA, 64 nt, Homo Sapiens
cuccagccuggcaauagaccgagacuccgucuccaaaaaaaaaaaaaauacaauuuuuauuucu

SEQ ID NO: 29789 - RNA, 64 nt, Homo Sapiens
uccagccuggcaauagaccgagacuccgucuccaaaaaaaaaaaaaauacaauuuuuauuucuu

SEQ ID NO: 29790 - RNA, 64 nt, Homo Sapiens
ccagccuggcaauagaccgagacuccgucuccaaaaaaaaaaaaaauacaauuuuuauuucuuu

SEQ ID NO: 29791 - RNA, 64 nt, Homo Sapiens
cagccuggcaauagaccgagacuccgucuccaaaaaaaaaaaaaauacaauuuuuauuucuuuu

SEQ ID NO: 29792 - RNA, 64 nt, Homo Sapiens
agccuggcaauagaccgagacuccgucuccaaaaaaaaaaaaaauacaauuuuuauuucuuuua

SEQ ID NO: 29793 - RNA, 64 nt, Homo Sapiens
gccuggcaauagaccgagacuccgucuccaaaaaaaaaaaaaauacaauuuuuauuucuuuuac

SEQ ID NO: 29794 - RNA, 64 nt, Homo Sapiens
ccuggcaauagaccgagacuccgucuccaaaaaaaaaaaaaauacaauuuuuauuucuuuuacu

SEQ ID NO: 29795 - RNA, 64 nt, Homo Sapiens
aaguccaagugauucauguacugaggaauguaggaaaaaaaaucugaggauagugcuuuacucu

SEQ ID NO: 29796 - RNA, 64 nt, Homo Sapiens
uauaauauuacuucaaagauauguaaucacaaacaaaaaaaacuauuuuuuauaaugucauuug

SEQ ID NO: 29797 - RNA, 64 nt, Homo Sapiens
cucccuccugggcaacagaacaagacuccaucucaaaaaaaaaaaaguacaucauaaaaguaca

SEQ ID NO: 29798 - RNA, 64 nt, Homo Sapiens
ucccuccugggcaacagaacaagacuccaucucaaaaaaaaaaaaguacaucauaaaaguacau

SEQ ID NO: 29799 - RNA, 64 nt, Homo Sapiens
cccuccugggcaacagaacaagacuccaucucaaaaaaaaaaaaguacaucauaaaaguacauc

SEQ ID NO: 29800 - RNA, 64 nt, Homo Sapiens
ccuccugggcaacagaacaagacuccaucucaaaaaaaaaaaaguacaucauaaaaguacauca

SEQ ID NO: 29801 - RNA, 64 nt, Homo Sapiens
cuccugggcaacagaacaagacuccaucucaaaaaaaaaaaaguacaucauaaaaguacaucau

SEQ ID NO: 29802 - RNA, 64 nt, Homo Sapiens
agucuuuacaaugcuuguuucaaagaaccaacagaaaaaaaagcuaagaaaacugagaacuaac

SEQ ID NO: 29803 - RNA, 64 nt, Homo Sapiens
uaaaugucacgagaucauuuuuacauuaaacgugaaaaaaaaucaacuuugccggaucacuuau

SEQ ID NO: 29804 - RNA, 64 nt, Homo Sapiens
uacuuuuuauuaugaguuaauauaguuuagcaguaaaaaaaaaaaaaaaaaccacaccuaaaau

SEQ ID NO: 29805 - RNA, 64 nt, Homo Sapiens
acuuuuuauuaugaguuaauauaguuuagcaguaaaaaaaaaaaaaaaaaccacaccuaaaaua

SEQ ID NO: 29806 - RNA, 64 nt, Homo Sapiens
cuuuuuauuaugaguuaauauaguuuagcaguaaaaaaaaaaaaaaaaaccacaccuaaaauag

SEQ ID NO: 29807 - RNA, 64 nt, Homo Sapiens
uuuuuauuaugaguuaauauaguuuagcaguaaaaaaaaaaaaaaaaaccacaccuaaaauaga

SEQ ID NO: 29808 - RNA, 64 nt, Homo Sapiens
uuuuauuaugaguuaauauaguuuagcaguaaaaaaaaaaaaaaaaaccacaccuaaaauagac

SEQ ID NO: 29809 - RNA, 64 nt, Homo Sapiens
uuuauuaugaguuaauauaguuuagcaguaaaaaaaaaaaaaaaaaccacaccuaaaauagacc

SEQ ID NO: 29810 - RNA, 64 nt, Homo Sapiens
uuauuaugaguuaauauaguuuagcaguaaaaaaaaaaaaaaaaaccacaccuaaaauagacca

SEQ ID NO: 29811 - RNA, 64 nt, Homo Sapiens
uauuaugaguuaauauaguuuagcaguaaaaaaaaaaaaaaaaaccacaccuaaaauagaccac

SEQ ID NO: 29812 - RNA, 64 nt, Homo Sapiens
auuaugaguuaauauaguuuagcaguaaaaaaaaaaaaaaaaaccacaccuaaaauagaccacu

SEQ ID NO: 29813 - RNA, 64 nt, Homo Sapiens
uuaugaguuaauauaguuuagcaguaaaaaaaaaaaaaaaaaccacaccuaaaauagaccacug

SEQ ID NO: 29814 - RNA, 64 nt, Homo Sapiens
auaaauuuuaaucucuguuaaucuuaccugcuuuaaaaaaaaguucuuguguguucguaucuuu

SEQ ID NO: 29815 - RNA, 64 nt, Homo Sapiens
gcauugcaugugaauaagaaaauaauguuuaaagaaaaaaaaaaaaaagcaaaccuccaaaacg

SEQ ID NO: 29816 - RNA, 64 nt, Homo Sapiens
cauugcaugugaauaagaaaauaauguuuaaagaaaaaaaaaaaaaagcaaaccuccaaaacgu

SEQ ID NO: 29817 - RNA, 64 nt, Homo Sapiens
auugcaugugaauaagaaaauaauguuuaaagaaaaaaaaaaaaaagcaaaccuccaaaacgug

SEQ ID NO: 29818 - RNA, 64 nt, Homo Sapiens
uugcaugugaauaagaaaauaauguuuaaagaaaaaaaaaaaaaagcaaaccuccaaaacgugg

SEQ ID NO: 29819 - RNA, 64 nt, Homo Sapiens
ugcaugugaauaagaaaauaauguuuaaagaaaaaaaaaaaaaagcaaaccuccaaaacgugga

SEQ ID NO: 29820 - RNA, 64 nt, Homo Sapiens
gcaugugaauaagaaaauaauguuuaaagaaaaaaaaaaaaaagcaaaccuccaaaacguggac

SEQ ID NO: 29821 - RNA, 64 nt, Homo Sapiens
caugugaauaagaaaauaauguuuaaagaaaaaaaaaaaaaagcaaaccuccaaaacguggacc

SEQ ID NO: 29822 - RNA, 64 nt, Homo Sapiens
cuuggauauaugguugaagaaucaaaacaaaagcaaaaaaaaaaagcaaaaaaagaaaagagaa

SEQ ID NO: 29823 - RNA, 64 nt, Homo Sapiens
uuggauauaugguugaagaaucaaaacaaaagcaaaaaaaaaaagcaaaaaaagaaaagagaaa

SEQ ID NO: 29824 - RNA, 64 nt, Homo Sapiens
uggauauaugguugaagaaucaaaacaaaagcaaaaaaaaaaagcaaaaaaagaaaagagaaaa

SEQ ID NO: 29825 - RNA, 64 nt, Homo Sapiens
ggauauaugguugaagaaucaaaacaaaagcaaaaaaaaaaagcaaaaaaagaaaagagaaaaa

SEQ ID NO: 29826 - RNA, 64 nt, Homo Sapiens
acaauuuugacaacuuuugaccacuugcgcuaauaaaaaaaaaaaaaaacuacucuuaugucca

SEQ ID NO: 29827 - RNA, 64 nt, Homo Sapiens
caauuuugacaacuuuugaccacuugcgcuaauaaaaaaaaaaaaaaacuacucuuauguccac

SEQ ID NO: 29828 - RNA, 64 nt, Homo Sapiens
aauuuugacaacuuuugaccacuugcgcuaauaaaaaaaaaaaaaaacuacucuuauguccacu

SEQ ID NO: 29829 - RNA, 64 nt, Homo Sapiens
auuuugacaacuuuugaccacuugcgcuaauaaaaaaaaaaaaaaacuacucuuauguccacuu

SEQ ID NO: 29830 - RNA, 64 nt, Homo Sapiens
uuuugacaacuuuugaccacuugcgcuaauaaaaaaaaaaaaaaacuacucuuauguccacuuu

SEQ ID NO: 29831 - RNA, 64 nt, Homo Sapiens
uuugacaacuuuugaccacuugcgcuaauaaaaaaaaaaaaaaacuacucuuauguccacuuua

SEQ ID NO: 29832 - RNA, 64 nt, Homo Sapiens
uugacaacuuuugaccacuugcgcuaauaaaaaaaaaaaaaaacuacucuuauguccacuuuac

SEQ ID NO: 29833 - RNA, 64 nt, Homo Sapiens
ugacaacuuuugaccacuugcgcuaauaaaaaaaaaaaaaaacuacucuuauguccacuuuaca

SEQ ID NO: 29834 - RNA, 64 nt, Homo Sapiens
uuuugacacuuccauuguuuaaaaauacacauggaaaaaaaaaaaacccuauaugcuuacugug

SEQ ID NO: 29835 - RNA, 64 nt, Homo Sapiens
uuugacacuuccauuguuuaaaaauacacauggaaaaaaaaaaaacccuauaugcuuacugugc

SEQ ID NO: 29836 - RNA, 64 nt, Homo Sapiens
uugacacuuccauuguuuaaaaauacacauggaaaaaaaaaaaacccuauaugcuuacugugca

SEQ ID NO: 29837 - RNA, 64 nt, Homo Sapiens
ugacacuuccauuguuuaaaaauacacauggaaaaaaaaaaaacccuauaugcuuacugugcac

SEQ ID NO: 29838 - RNA, 64 nt, Homo Sapiens
gacacuuccauuguuuaaaaauacacauggaaaaaaaaaaaacccuauaugcuuacugugcacc

SEQ ID NO: 29839 - RNA, 64 nt, Homo Sapiens
uuuuguuuagucuagccacaguucuucacaaaggaaaaaaaaauguguagaugauaccaugacu

SEQ ID NO: 29840 - RNA, 64 nt, Homo Sapiens
uuuguuuagucuagccacaguucuucacaaaggaaaaaaaaauguguagaugauaccaugacuu

SEQ ID NO: 29841 - RNA, 64 nt, Homo Sapiens
ucacagggacagaucugauuuauuuauuuugguuaaaaaaaaaaaaaaggaacagaaacaacuu

SEQ ID NO: 29842 - RNA, 64 nt, Homo Sapiens
cacagggacagaucugauuuauuuauuuugguuaaaaaaaaaaaaaaggaacagaaacaacuuu

SEQ ID NO: 29843 - RNA, 64 nt, Homo Sapiens
acagggacagaucugauuuauuuauuuugguuaaaaaaaaaaaaaaggaacagaaacaacuuug

SEQ ID NO: 29844 - RNA, 64 nt, Homo Sapiens
cagggacagaucugauuuauuuauuuugguuaaaaaaaaaaaaaaggaacagaaacaacuuugc

SEQ ID NO: 29845 - RNA, 64 nt, Homo Sapiens
agggacagaucugauuuauuuauuuugguuaaaaaaaaaaaaaaggaacagaaacaacuuugca

SEQ ID NO: 29846 - RNA, 64 nt, Homo Sapiens
gggacagaucugauuuauuuauuuugguuaaaaaaaaaaaaaaggaacagaaacaacuuugcau

SEQ ID NO: 29847 - RNA, 64 nt, Homo Sapiens
ggacagaucugauuuauuuauuuugguuaaaaaaaaaaaaaaggaacagaaacaacuuugcauu

SEQ ID NO: 29848 - RNA, 64 nt, Homo Sapiens
gagcagaaauuuaucuuucaaagagguauauuugaaaaaaaaaaaaaguauaugugaggauuuu

SEQ ID NO: 29849 - RNA, 64 nt, Homo Sapiens
agcagaaauuuaucuuucaaagagguauauuugaaaaaaaaaaaaaguauaugugaggauuuuu

SEQ ID NO: 29850 - RNA, 64 nt, Homo Sapiens
gcagaaauuuaucuuucaaagagguauauuugaaaaaaaaaaaaaguauaugugaggauuuuua

SEQ ID NO: 29851 - RNA, 64 nt, Homo Sapiens
cagaaauuuaucuuucaaagagguauauuugaaaaaaaaaaaaaguauaugugaggauuuuuau

SEQ ID NO: 29852 - RNA, 64 nt, Homo Sapiens
agaaauuuaucuuucaaagagguauauuugaaaaaaaaaaaaaguauaugugaggauuuuuauu

SEQ ID NO: 29853 - RNA, 64 nt, Homo Sapiens
gaaauuuaucuuucaaagagguauauuugaaaaaaaaaaaaaguauaugugaggauuuuuauug

SEQ ID NO: 29854 - RNA, 64 nt, Homo Sapiens
uucugaaucaucuugaaaauaagauuccaaccacaaaaaaaauuuagccauuucuuuacuaaaa

SEQ ID NO: 29855 - RNA, 64 nt, Homo Sapiens
ccaaccacaaaaaaaauuuagccauuucuuuacuaaaaaaaaccaaaaaacaaaucuguuuuau

SEQ ID NO: 29856 - RNA, 64 nt, Homo Sapiens
aaaguucuaaaguuauaaaaauguuuucugcaguaaaaaaaaaguucucugggccgggcguggu

SEQ ID NO: 29857 - RNA, 64 nt, Homo Sapiens
aaguucuaaaguuauaaaaauguuuucugcaguaaaaaaaaaguucucugggccgggcguggug

SEQ ID NO: 29858 - RNA, 64 nt, Homo Sapiens
ugggcaacauaaugaaacuuccuuuccagggaggaaaaaaaaaaaaaaaaaaagcucugagagc

SEQ ID NO: 29859 - RNA, 64 nt, Homo Sapiens
gggcaacauaaugaaacuuccuuuccagggaggaaaaaaaaaaaaaaaaaaagcucugagagca

SEQ ID NO: 29860 - RNA, 64 nt, Homo Sapiens
ggcaacauaaugaaacuuccuuuccagggaggaaaaaaaaaaaaaaaaaaagcucugagagcau

SEQ ID NO: 29861 - RNA, 64 nt, Homo Sapiens
gcaacauaaugaaacuuccuuuccagggaggaaaaaaaaaaaaaaaaaaagcucugagagcauc

SEQ ID NO: 29862 - RNA, 64 nt, Homo Sapiens
caacauaaugaaacuuccuuuccagggaggaaaaaaaaaaaaaaaaaaagcucugagagcaucu

SEQ ID NO: 29863 - RNA, 64 nt, Homo Sapiens
aacauaaugaaacuuccuuuccagggaggaaaaaaaaaaaaaaaaaaagcucugagagcaucuu

SEQ ID NO: 29864 - RNA, 64 nt, Homo Sapiens
acauaaugaaacuuccuuuccagggaggaaaaaaaaaaaaaaaaaaagcucugagagcaucuua

SEQ ID NO: 29865 - RNA, 64 nt, Homo Sapiens
cauaaugaaacuuccuuuccagggaggaaaaaaaaaaaaaaaaaaagcucugagagcaucuuau

SEQ ID NO: 29866 - RNA, 64 nt, Homo Sapiens
auaaugaaacuuccuuuccagggaggaaaaaaaaaaaaaaaaaaagcucugagagcaucuuauu

SEQ ID NO: 29867 - RNA, 64 nt, Homo Sapiens
uaaugaaacuuccuuuccagggaggaaaaaaaaaaaaaaaaaaagcucugagagcaucuuauuu

SEQ ID NO: 29868 - RNA, 64 nt, Homo Sapiens
aaugaaacuuccuuuccagggaggaaaaaaaaaaaaaaaaaaagcucugagagcaucuuauuuu

SEQ ID NO: 29869 - RNA, 64 nt, Homo Sapiens
augaaacuuccuuuccagggaggaaaaaaaaaaaaaaaaaaagcucugagagcaucuuauuuug

SEQ ID NO: 29870 - RNA, 64 nt, Homo Sapiens
cuccagccugggugauagagcaagaccccaacucaaaaaaaaaaaaaaggaucccacgguucac

SEQ ID NO: 29871 - RNA, 64 nt, Homo Sapiens
uccagccugggugauagagcaagaccccaacucaaaaaaaaaaaaaaggaucccacgguucacc

SEQ ID NO: 29872 - RNA, 64 nt, Homo Sapiens
ccagccugggugauagagcaagaccccaacucaaaaaaaaaaaaaaggaucccacgguucaccu

SEQ ID NO: 29873 - RNA, 64 nt, Homo Sapiens
cagccugggugauagagcaagaccccaacucaaaaaaaaaaaaaaggaucccacgguucaccuu

SEQ ID NO: 29874 - RNA, 64 nt, Homo Sapiens
agccugggugauagagcaagaccccaacucaaaaaaaaaaaaaaggaucccacgguucaccuug

SEQ ID NO: 29875 - RNA, 64 nt, Homo Sapiens
gccugggugauagagcaagaccccaacucaaaaaaaaaaaaaaggaucccacgguucaccuugu

SEQ ID NO: 29876 - RNA, 64 nt, Homo Sapiens
ccugggugauagagcaagaccccaacucaaaaaaaaaaaaaaggaucccacgguucaccuugug

SEQ ID NO: 29877 - RNA, 64 nt, Homo Sapiens
cuccagccugggcgacagagcaagacuccaucucaaaaaaaaaguuaauuaauuaauuagauua

SEQ ID NO: 29878 - RNA, 64 nt, Homo Sapiens
uccagccugggcgacagagcaagacuccaucucaaaaaaaaaguuaauuaauuaauuagauuaa

SEQ ID NO: 29879 - RNA, 64 nt, Homo Sapiens
cugugauaguucaguucuuuaguuuuucuauuugaaaaaaaaaaaucauuuaaaugauccuuug

SEQ ID NO: 29880 - RNA, 64 nt, Homo Sapiens
ugugauaguucaguucuuuaguuuuucuauuugaaaaaaaaaaaucauuuaaaugauccuuugu

SEQ ID NO: 29881 - RNA, 64 nt, Homo Sapiens
gugauaguucaguucuuuaguuuuucuauuugaaaaaaaaaaaucauuuaaaugauccuuuguu

SEQ ID NO: 29882 - RNA, 64 nt, Homo Sapiens
ugauaguucaguucuuuaguuuuucuauuugaaaaaaaaaaaucauuuaaaugauccuuuguuc

SEQ ID NO: 29883 - RNA, 64 nt, Homo Sapiens
uaaacauugcagguuuaaacauaaaggagucuuuaaaaaaaaaucauuuacguuggaauuuuag

SEQ ID NO: 29884 - RNA, 64 nt, Homo Sapiens
aaacauugcagguuuaaacauaaaggagucuuuaaaaaaaaaucauuuacguuggaauuuuagg

SEQ ID NO: 29885 - RNA, 64 nt, Homo Sapiens
aguuuggagggauccuaagagcauuuuuguggguaaaaaaaaaaccuguggacauaaugaauuu

SEQ ID NO: 29886 - RNA, 64 nt, Homo Sapiens
guuuggagggauccuaagagcauuuuuguggguaaaaaaaaaaccuguggacauaaugaauuuu

SEQ ID NO: 29887 - RNA, 64 nt, Homo Sapiens
uuuggagggauccuaagagcauuuuuguggguaaaaaaaaaaccuguggacauaaugaauuuug

SEQ ID NO: 29888 - RNA, 64 nt, Homo Sapiens
gacagggucugacauggucagucuacuaaaaaacaaaaaaaaaaaacaaaaaaaaaaaaacaaa

SEQ ID NO: 29889 - RNA, 64 nt, Homo Sapiens
acagggucugacauggucagucuacuaaaaaacaaaaaaaaaaaacaaaaaaaaaaaaacaaaa

SEQ ID NO: 29890 - RNA, 64 nt, Homo Sapiens
cagggucugacauggucagucuacuaaaaaacaaaaaaaaaaaacaaaaaaaaaaaaacaaaag

SEQ ID NO: 29891 - RNA, 64 nt, Homo Sapiens
agggucugacauggucagucuacuaaaaaacaaaaaaaaaaaacaaaaaaaaaaaaacaaaaga

SEQ ID NO: 29892 - RNA, 64 nt, Homo Sapiens
gggucugacauggucagucuacuaaaaaacaaaaaaaaaaaacaaaaaaaaaaaaacaaaagaa

SEQ ID NO: 29893 - RNA, 64 nt, Homo Sapiens
auggucagucuacuaaaaaacaaaaaaaaaaaacaaaaaaaaaaaaacaaaagaaaaaaauaaa

SEQ ID NO: 29894 - RNA, 64 nt, Homo Sapiens
uggucagucuacuaaaaaacaaaaaaaaaaaacaaaaaaaaaaaaacaaaagaaaaaaauaaaa

SEQ ID NO: 29895 - RNA, 64 nt, Homo Sapiens
ggucagucuacuaaaaaacaaaaaaaaaaaacaaaaaaaaaaaaacaaaagaaaaaaauaaaaa

SEQ ID NO: 29896 - RNA, 64 nt, Homo Sapiens
gucagucuacuaaaaaacaaaaaaaaaaaacaaaaaaaaaaaaacaaaagaaaaaaauaaaaau

SEQ ID NO: 29897 - RNA, 64 nt, Homo Sapiens
ucagucuacuaaaaaacaaaaaaaaaaaacaaaaaaaaaaaaacaaaagaaaaaaauaaaaaua

SEQ ID NO: 29898 - RNA, 64 nt, Homo Sapiens
cagucuacuaaaaaacaaaaaaaaaaaacaaaaaaaaaaaaacaaaagaaaaaaauaaaaauac

SEQ ID NO: 29899 - RNA, 64 nt, Homo Sapiens
uuuuaaugaauaugaccccuauagaaaagucaagaaaaaaaaacccuuguauaaauuauuuuau

SEQ ID NO: 29900 - RNA, 64 nt, Homo Sapiens
uuuaaugaauaugaccccuauagaaaagucaagaaaaaaaaacccuuguauaaauuauuuuauu

SEQ ID NO: 29901 - RNA, 64 nt, Homo Sapiens
ugucauugagaaaguucaaaauggaauaggcuuuaaaaaaaaaaaaacuuucaaagauccgcca

SEQ ID NO: 29902 - RNA, 64 nt, Homo Sapiens
gucauugagaaaguucaaaauggaauaggcuuuaaaaaaaaaaaaacuuucaaagauccgccaa

SEQ ID NO: 29903 - RNA, 64 nt, Homo Sapiens
ucauugagaaaguucaaaauggaauaggcuuuaaaaaaaaaaaaacuuucaaagauccgccaaa

SEQ ID NO: 29904 - RNA, 64 nt, Homo Sapiens
cauugagaaaguucaaaauggaauaggcuuuaaaaaaaaaaaaacuuucaaagauccgccaaau

SEQ ID NO: 29905 - RNA, 64 nt, Homo Sapiens
auugagaaaguucaaaauggaauaggcuuuaaaaaaaaaaaaacuuucaaagauccgccaaauc

SEQ ID NO: 29906 - RNA, 64 nt, Homo Sapiens
uugagaaaguucaaaauggaauaggcuuuaaaaaaaaaaaaacuuucaaagauccgccaaauca

SEQ ID NO: 29907 - RNA, 64 nt, Homo Sapiens
uuccagacugggugacagagugagacuccaucucaaaaaaaaaaaaguugacucuacccccuaa

SEQ ID NO: 29908 - RNA, 64 nt, Homo Sapiens
uccagacugggugacagagugagacuccaucucaaaaaaaaaaaaguugacucuacccccuaau

SEQ ID NO: 29909 - RNA, 64 nt, Homo Sapiens
ccagacugggugacagagugagacuccaucucaaaaaaaaaaaaguugacucuacccccuaauu

SEQ ID NO: 29910 - RNA, 64 nt, Homo Sapiens
cagacugggugacagagugagacuccaucucaaaaaaaaaaaaguugacucuacccccuaauuu

SEQ ID NO: 29911 - RNA, 64 nt, Homo Sapiens
agacugggugacagagugagacuccaucucaaaaaaaaaaaaguugacucuacccccuaauuug

SEQ ID NO: 29912 - RNA, 64 nt, Homo Sapiens
aauguagaaaagauacucagucuuaauccuaugcaaaaaaaaaaaucaaguaauuguuuuccua

SEQ ID NO: 29913 - RNA, 64 nt, Homo Sapiens
auguagaaaagauacucagucuuaauccuaugcaaaaaaaaaaaucaaguaauuguuuuccuau

SEQ ID NO: 29914 - RNA, 64 nt, Homo Sapiens
uguagaaaagauacucagucuuaauccuaugcaaaaaaaaaaaucaaguaauuguuuuccuaug

SEQ ID NO: 29915 - RNA, 64 nt, Homo Sapiens
guagaaaagauacucagucuuaauccuaugcaaaaaaaaaaaucaaguaauuguuuuccuauga

SEQ ID NO: 29916 - RNA, 64 nt, Homo Sapiens
ccuuccaggauuaaguugucaucauucugggaagaaaaaaaaaacauuaaugaagaggccaaua

SEQ ID NO: 29917 - RNA, 64 nt, Homo Sapiens
cuuccaggauuaaguugucaucauucugggaagaaaaaaaaaacauuaaugaagaggccaauaa

SEQ ID NO: 29918 - RNA, 64 nt, Homo Sapiens
uuccaggauuaaguugucaucauucugggaagaaaaaaaaaacauuaaugaagaggccaauaau

SEQ ID NO: 29919 - RNA, 64 nt, Homo Sapiens
uucaaaguuugcuuaguuacaacaaagcaccuuuaaaaaaaauacauuuuaaaaaaacauucca

SEQ ID NO: 29920 - RNA, 64 nt, Homo Sapiens
uguugacuuaaaaauaugagauacauaggaugugaaaaaaaauguuugcaguacucagcaaaaa

SEQ ID NO: 29921 - RNA, 64 nt, Homo Sapiens
uacgugccuuuuucuuaaaugcuuucauuuauugaaaaaaaaaaaaaaugcccccaaagcacua

SEQ ID NO: 29922 - RNA, 64 nt, Homo Sapiens
acgugccuuuuucuuaaaugcuuucauuuauugaaaaaaaaaaaaaaugcccccaaagcacuau

SEQ ID NO: 29923 - RNA, 64 nt, Homo Sapiens
cgugccuuuuucuuaaaugcuuucauuuauugaaaaaaaaaaaaaaugcccccaaagcacuaug

SEQ ID NO: 29924 - RNA, 64 nt, Homo Sapiens
gugccuuuuucuuaaaugcuuucauuuauugaaaaaaaaaaaaaaugcccccaaagcacuaugc

SEQ ID NO: 29925 - RNA, 64 nt, Homo Sapiens
ugccuuuuucuuaaaugcuuucauuuauugaaaaaaaaaaaaaaugcccccaaagcacuaugcu

SEQ ID NO: 29926 - RNA, 64 nt, Homo Sapiens
gccuuuuucuuaaaugcuuucauuuauugaaaaaaaaaaaaaaugcccccaaagcacuaugcug

SEQ ID NO: 29927 - RNA, 64 nt, Homo Sapiens
ccuuuuucuuaaaugcuuucauuuauugaaaaaaaaaaaaaaugcccccaaagcacuaugcugg

SEQ ID NO: 29928 - RNA, 64 nt, Homo Sapiens
acuccagccugggugacuagcaaaacuccaucucaaaaaaaaaaaaaagaaagaaagaaacuga

SEQ ID NO: 29929 - RNA, 64 nt, Homo Sapiens
cuccagccugggugacuagcaaaacuccaucucaaaaaaaaaaaaaagaaagaaagaaacugaa

SEQ ID NO: 29930 - RNA, 64 nt, Homo Sapiens
uccagccugggugacuagcaaaacuccaucucaaaaaaaaaaaaaagaaagaaagaaacugaaa

SEQ ID NO: 29931 - RNA, 64 nt, Homo Sapiens
ccagccugggugacuagcaaaacuccaucucaaaaaaaaaaaaaagaaagaaagaaacugaaaa

SEQ ID NO: 29932 - RNA, 64 nt, Homo Sapiens
cagccugggugacuagcaaaacuccaucucaaaaaaaaaaaaaagaaagaaagaaacugaaaag

SEQ ID NO: 29933 - RNA, 64 nt, Homo Sapiens
agccugggugacuagcaaaacuccaucucaaaaaaaaaaaaaagaaagaaagaaacugaaaagu

SEQ ID NO: 29934 - RNA, 64 nt, Homo Sapiens
gccugggugacuagcaaaacuccaucucaaaaaaaaaaaaaagaaagaaagaaacugaaaagug

SEQ ID NO: 29935 - RNA, 64 nt, Homo Sapiens
ucgcuucucagccuuuuggcuaagauuaaguauuaaaaaaaaaccaggcucugccaggcgcagu

SEQ ID NO: 29936 - RNA, 64 nt, Homo Sapiens
cgcuucucagccuuuuggcuaagauuaaguauuaaaaaaaaaccaggcucugccaggcgcagug

SEQ ID NO: 29937 - RNA, 64 nt, Homo Sapiens
ucauuugaccaagacacagaagaugaugaaugggaaaaaaaacauagagaucacaccgcaaaga

SEQ ID NO: 29938 - RNA, 64 nt, Homo Sapiens
guauaaauguuuuuacugcuuuuagaaaauaaagaaaaaaaacuugguucauguuuacaugccu

SEQ ID NO: 29939 - RNA, 64 nt, Homo Sapiens
uccagccugggcaacaagagcaaaacucugucucaaaaaaaaaaaaaaaugauggagcuccgaa

SEQ ID NO: 29940 - RNA, 64 nt, Homo Sapiens
ccagccugggcaacaagagcaaaacucugucucaaaaaaaaaaaaaaaugauggagcuccgaau

SEQ ID NO: 29941 - RNA, 64 nt, Homo Sapiens
cagccugggcaacaagagcaaaacucugucucaaaaaaaaaaaaaaaugauggagcuccgaaug

SEQ ID NO: 29942 - RNA, 64 nt, Homo Sapiens
agccugggcaacaagagcaaaacucugucucaaaaaaaaaaaaaaaugauggagcuccgaaugu

SEQ ID NO: 29943 - RNA, 64 nt, Homo Sapiens
gccugggcaacaagagcaaaacucugucucaaaaaaaaaaaaaaaugauggagcuccgaaugug

SEQ ID NO: 29944 - RNA, 64 nt, Homo Sapiens
ccugggcaacaagagcaaaacucugucucaaaaaaaaaaaaaaaugauggagcuccgaaugugc

SEQ ID NO: 29945 - RNA, 64 nt, Homo Sapiens
cugggcaacaagagcaaaacucugucucaaaaaaaaaaaaaaaugauggagcuccgaaugugcu

SEQ ID NO: 29946 - RNA, 64 nt, Homo Sapiens
ugggcaacaagagcaaaacucugucucaaaaaaaaaaaaaaaugauggagcuccgaaugugcuu

SEQ ID NO: 29947 - RNA, 64 nt, Homo Sapiens
ucagccugggcaacacagugagacuccaucucuuaaaaaaaaaauuagcuggguauagugguau

SEQ ID NO: 29948 - RNA, 64 nt, Homo Sapiens
cagccugggcaacacagugagacuccaucucuuaaaaaaaaaauuagcuggguauagugguaug

SEQ ID NO: 29949 - RNA, 64 nt, Homo Sapiens
agccugggcaacacagugagacuccaucucuuaaaaaaaaaauuagcuggguauagugguaugu

SEQ ID NO: 29950 - RNA, 64 nt, Homo Sapiens
aaguaaguaaucuuuaacugaacucugaccacuuaaaaaaaaaucuaaaaauugaacuaccuau

SEQ ID NO: 29951 - RNA, 64 nt, Homo Sapiens
aguaaguaaucuuuaacugaacucugaccacuuaaaaaaaaaucuaaaaauugaacuaccuaua

SEQ ID NO: 29952 - RNA, 64 nt, Homo Sapiens
cuccagccugggcgacagagcaagacuccgucucaaaaaaaaaaaaaaaaaaaaaaaaagagug

SEQ ID NO: 29953 - RNA, 64 nt, Homo Sapiens
uccagccugggcgacagagcaagacuccgucucaaaaaaaaaaaaaaaaaaaaaaaaagaguga

SEQ ID NO: 29954 - RNA, 64 nt, Homo Sapiens
ccagccugggcgacagagcaagacuccgucucaaaaaaaaaaaaaaaaaaaaaaaaagagugaa

SEQ ID NO: 29955 - RNA, 64 nt, Homo Sapiens
cagccugggcgacagagcaagacuccgucucaaaaaaaaaaaaaaaaaaaaaaaaagagugaau

SEQ ID NO: 29956 - RNA, 64 nt, Homo Sapiens
agccugggcgacagagcaagacuccgucucaaaaaaaaaaaaaaaaaaaaaaaaagagugaaug

SEQ ID NO: 29957 - RNA, 64 nt, Homo Sapiens
gccugggcgacagagcaagacuccgucucaaaaaaaaaaaaaaaaaaaaaaaaagagugaaugu

SEQ ID NO: 29958 - RNA, 64 nt, Homo Sapiens
ccugggcgacagagcaagacuccgucucaaaaaaaaaaaaaaaaaaaaaaaaagagugaaugua

SEQ ID NO: 29959 - RNA, 64 nt, Homo Sapiens
cugggcgacagagcaagacuccgucucaaaaaaaaaaaaaaaaaaaaaaaaagagugaauguaa

SEQ ID NO: 29960 - RNA, 64 nt, Homo Sapiens
ugggcgacagagcaagacuccgucucaaaaaaaaaaaaaaaaaaaaaaaaagagugaauguaau

SEQ ID NO: 29961 - RNA, 64 nt, Homo Sapiens
gggcgacagagcaagacuccgucucaaaaaaaaaaaaaaaaaaaaaaaaagagugaauguaaua

SEQ ID NO: 29962 - RNA, 64 nt, Homo Sapiens
ggcgacagagcaagacuccgucucaaaaaaaaaaaaaaaaaaaaaaaaagagugaauguaauag

SEQ ID NO: 29963 - RNA, 64 nt, Homo Sapiens
gcgacagagcaagacuccgucucaaaaaaaaaaaaaaaaaaaaaaaaagagugaauguaauagu

SEQ ID NO: 29964 - RNA, 64 nt, Homo Sapiens
cgacagagcaagacuccgucucaaaaaaaaaaaaaaaaaaaaaaaaagagugaauguaauaguc

SEQ ID NO: 29965 - RNA, 64 nt, Homo Sapiens
gacagagcaagacuccgucucaaaaaaaaaaaaaaaaaaaaaaaaagagugaauguaauagucu

SEQ ID NO: 29966 - RNA, 64 nt, Homo Sapiens
acagagcaagacuccgucucaaaaaaaaaaaaaaaaaaaaaaaaagagugaauguaauagucuu

SEQ ID NO: 29967 - RNA, 64 nt, Homo Sapiens
cagagcaagacuccgucucaaaaaaaaaaaaaaaaaaaaaaaaagagugaauguaauagucuug

SEQ ID NO: 29968 - RNA, 64 nt, Homo Sapiens
agagcaagacuccgucucaaaaaaaaaaaaaaaaaaaaaaaaagagugaauguaauagucuugc

SEQ ID NO: 29969 - RNA, 64 nt, Homo Sapiens
gagcaagacuccgucucaaaaaaaaaaaaaaaaaaaaaaaaagagugaauguaauagucuugca

SEQ ID NO: 29970 - RNA, 64 nt, Homo Sapiens
aaaaccaccaaggaaaccuacuccaaaaaugaacaaaaaaaaaaaaagcgaaagacugcaguug

SEQ ID NO: 29971 - RNA, 64 nt, Homo Sapiens
aaaccaccaaggaaaccuacuccaaaaaugaacaaaaaaaaaaaaagcgaaagacugcaguugu

SEQ ID NO: 29972 - RNA, 64 nt, Homo Sapiens
aaccaccaaggaaaccuacuccaaaaaugaacaaaaaaaaaaaaagcgaaagacugcaguugug

SEQ ID NO: 29973 - RNA, 64 nt, Homo Sapiens
accaccaaggaaaccuacuccaaaaaugaacaaaaaaaaaaaaagcgaaagacugcaguugugc

SEQ ID NO: 29974 - RNA, 64 nt, Homo Sapiens
ccaccaaggaaaccuacuccaaaaaugaacaaaaaaaaaaaaagcgaaagacugcaguugugcu

SEQ ID NO: 29975 - RNA, 64 nt, Homo Sapiens
caccaaggaaaccuacuccaaaaaugaacaaaaaaaaaaaaagcgaaagacugcaguugugcua

SEQ ID NO: 29976 - RNA, 64 nt, Homo Sapiens
acucccgccuggcaacagagcaagagucugucucaaaaaaaaaaagaaaaaaagaaaaaaagaa

SEQ ID NO: 29977 - RNA, 64 nt, Homo Sapiens
cucccgccuggcaacagagcaagagucugucucaaaaaaaaaaagaaaaaaagaaaaaaagaaa

SEQ ID NO: 29978 - RNA, 64 nt, Homo Sapiens
ucccgccuggcaacagagcaagagucugucucaaaaaaaaaaagaaaaaaagaaaaaaagaaaa

SEQ ID NO: 29979 - RNA, 64 nt, Homo Sapiens
cccgccuggcaacagagcaagagucugucucaaaaaaaaaaagaaaaaaagaaaaaaagaaaaa

SEQ ID NO: 29980 - RNA, 64 nt, Homo Sapiens
gguaauuugagagaaauaugaagaacugaggaggaaaaaaaaaaaaaagaaaagaaccaacaac

SEQ ID NO: 29981 - RNA, 64 nt, Homo Sapiens
guaauuugagagaaauaugaagaacugaggaggaaaaaaaaaaaaaagaaaagaaccaacaacc

SEQ ID NO: 29982 - RNA, 64 nt, Homo Sapiens
uaauuugagagaaauaugaagaacugaggaggaaaaaaaaaaaaaagaaaagaaccaacaaccu

SEQ ID NO: 29983 - RNA, 64 nt, Homo Sapiens
aauuugagagaaauaugaagaacugaggaggaaaaaaaaaaaaaagaaaagaaccaacaaccuc

SEQ ID NO: 29984 - RNA, 64 nt, Homo Sapiens
auuugagagaaauaugaagaacugaggaggaaaaaaaaaaaaaagaaaagaaccaacaaccuca

SEQ ID NO: 29985 - RNA, 64 nt, Homo Sapiens
uuugagagaaauaugaagaacugaggaggaaaaaaaaaaaaaagaaaagaaccaacaaccucaa

SEQ ID NO: 29986 - RNA, 64 nt, Homo Sapiens
uugagagaaauaugaagaacugaggaggaaaaaaaaaaaaaagaaaagaaccaacaaccucaac

SEQ ID NO: 29987 - RNA, 64 nt, Homo Sapiens
aauauguaaauuaaaauauuucuacauuuuauugaaaaaaaaaccuuuuuuuuugccuaaauau

SEQ ID NO: 29988 - RNA, 64 nt, Homo Sapiens
auauguaaauuaaaauauuucuacauuuuauugaaaaaaaaaccuuuuuuuuugccuaaauaua

SEQ ID NO: 29989 - RNA, 64 nt, Homo Sapiens
ucguugaacauaauguuccaguugaaugcaaaacaaaaaaaauauggaaaacauuuugauaaaa

SEQ ID NO: 29990 - RNA, 64 nt, Homo Sapiens
ugaacauuggcuaugaugaagauuauuacauaugaaaaaaaaacucacacaacauauuuguauu

SEQ ID NO: 29991 - RNA, 64 nt, Homo Sapiens
gaacauuggcuaugaugaagauuauuacauaugaaaaaaaaacucacacaacauauuuguauug

SEQ ID NO: 29992 - RNA, 64 nt, Homo Sapiens
guaguucaagugacuuuccuacuuuuguauuuccaaaaaaaauuaucuuguaaguagcuuguca

SEQ ID NO: 29993 - RNA, 64 nt, Homo Sapiens
caaaauuauuaauuuuauuaggcuuuuggaaaagaaaaaaaacuuuuugauguuuuaggugauu

SEQ ID NO: 29994 - RNA, 64 nt, Homo Sapiens
gagcuguuauguaacacuguauauaaaugguugcaaaaaaaaaaaaaagucagugcuucuaaaa

SEQ ID NO: 29995 - RNA, 64 nt, Homo Sapiens
agcuguuauguaacacuguauauaaaugguugcaaaaaaaaaaaaaagucagugcuucuaaaaa

SEQ ID NO: 29996 - RNA, 64 nt, Homo Sapiens
gcuguuauguaacacuguauauaaaugguugcaaaaaaaaaaaaaagucagugcuucuaaaaag

SEQ ID NO: 29997 - RNA, 64 nt, Homo Sapiens
cuguuauguaacacuguauauaaaugguugcaaaaaaaaaaaaaagucagugcuucuaaaaaga

SEQ ID NO: 29998 - RNA, 64 nt, Homo Sapiens
uguuauguaacacuguauauaaaugguugcaaaaaaaaaaaaaagucagugcuucuaaaaagaa

SEQ ID NO: 29999 - RNA, 64 nt, Homo Sapiens
guuauguaacacuguauauaaaugguugcaaaaaaaaaaaaaagucagugcuucuaaaaagaau

SEQ ID NO: 30000 - RNA, 64 nt, Homo Sapiens
uuauguaacacuguauauaaaugguugcaaaaaaaaaaaaaagucagugcuucuaaaaagaauu

SEQ ID NO: 30001 - RNA, 64 nt, Homo Sapiens
guugguuuuauuuggagguuugugggcuuuuuuuaaaaaaaaaaaguccucaaaucaggaagaa

SEQ ID NO: 30002 - RNA, 64 nt, Homo Sapiens
uugguuuuauuuggagguuugugggcuuuuuuuaaaaaaaaaaaguccucaaaucaggaagaaa

SEQ ID NO: 30003 - RNA, 64 nt, Homo Sapiens
ugguuuuauuuggagguuugugggcuuuuuuuaaaaaaaaaaaguccucaaaucaggaagaaac

SEQ ID NO: 30004 - RNA, 64 nt, Homo Sapiens
gguuuuauuuggagguuugugggcuuuuuuuaaaaaaaaaaaguccucaaaucaggaagaaaca

SEQ ID NO: 30005 - RNA, 64 nt, Homo Sapiens
ccuaaguauaaaugguugucuguuuuuguaacuuaaaaaaaaaaaaaaaaguuuggccgggugc

SEQ ID NO: 30006 - RNA, 64 nt, Homo Sapiens
cuaaguauaaaugguugucuguuuuuguaacuuaaaaaaaaaaaaaaaaguuuggccgggugcg

SEQ ID NO: 30007 - RNA, 64 nt, Homo Sapiens
uaaguauaaaugguugucuguuuuuguaacuuaaaaaaaaaaaaaaaaguuuggccgggugcgg

SEQ ID NO: 30008 - RNA, 64 nt, Homo Sapiens
aaguauaaaugguugucuguuuuuguaacuuaaaaaaaaaaaaaaaaguuuggccgggugcggu

SEQ ID NO: 30009 - RNA, 64 nt, Homo Sapiens
aguauaaaugguugucuguuuuuguaacuuaaaaaaaaaaaaaaaaguuuggccgggugcggug

SEQ ID NO: 30010 - RNA, 64 nt, Homo Sapiens
guauaaaugguugucuguuuuuguaacuuaaaaaaaaaaaaaaaaguuuggccgggugcggugg

SEQ ID NO: 30011 - RNA, 64 nt, Homo Sapiens
uauaaaugguugucuguuuuuguaacuuaaaaaaaaaaaaaaaaguuuggccgggugcgguggc

SEQ ID NO: 30012 - RNA, 64 nt, Homo Sapiens
auaaaugguugucuguuuuuguaacuuaaaaaaaaaaaaaaaaguuuggccgggugcgguggcu

SEQ ID NO: 30013 - RNA, 64 nt, Homo Sapiens
uaaaugguugucuguuuuuguaacuuaaaaaaaaaaaaaaaaguuuggccgggugcgguggcuc

SEQ ID NO: 30014 - RNA, 64 nt, Homo Sapiens
acuccggccugaugacagagcgagauuccgucuuaaaaaaaaaaaaaaaaaaguuuguuuuuaa

SEQ ID NO: 30015 - RNA, 64 nt, Homo Sapiens
cuccggccugaugacagagcgagauuccgucuuaaaaaaaaaaaaaaaaaaguuuguuuuuaaa

SEQ ID NO: 30016 - RNA, 64 nt, Homo Sapiens
uccggccugaugacagagcgagauuccgucuuaaaaaaaaaaaaaaaaaaguuuguuuuuaaaa

SEQ ID NO: 30017 - RNA, 64 nt, Homo Sapiens
ccggccugaugacagagcgagauuccgucuuaaaaaaaaaaaaaaaaaaguuuguuuuuaaaaa

SEQ ID NO: 30018 - RNA, 64 nt, Homo Sapiens
cggccugaugacagagcgagauuccgucuuaaaaaaaaaaaaaaaaaaguuuguuuuuaaaaaa

SEQ ID NO: 30019 - RNA, 64 nt, Homo Sapiens
ggccugaugacagagcgagauuccgucuuaaaaaaaaaaaaaaaaaaguuuguuuuuaaaaaaa

SEQ ID NO: 30020 - RNA, 64 nt, Homo Sapiens
gccugaugacagagcgagauuccgucuuaaaaaaaaaaaaaaaaaaguuuguuuuuaaaaaaau

SEQ ID NO: 30021 - RNA, 64 nt, Homo Sapiens
ccugaugacagagcgagauuccgucuuaaaaaaaaaaaaaaaaaaguuuguuuuuaaaaaaauc

SEQ ID NO: 30022 - RNA, 64 nt, Homo Sapiens
cugaugacagagcgagauuccgucuuaaaaaaaaaaaaaaaaaaguuuguuuuuaaaaaaaucu

SEQ ID NO: 30023 - RNA, 64 nt, Homo Sapiens
ugaugacagagcgagauuccgucuuaaaaaaaaaaaaaaaaaaguuuguuuuuaaaaaaaucua

SEQ ID NO: 30024 - RNA, 64 nt, Homo Sapiens
gaugacagagcgagauuccgucuuaaaaaaaaaaaaaaaaaaguuuguuuuuaaaaaaaucuaa

SEQ ID NO: 30025 - RNA, 64 nt, Homo Sapiens
acccagccugggccacagugcaagacuccaucucaaaaaaaaaagaaaagaaaaagccuguuua

SEQ ID NO: 30026 - RNA, 64 nt, Homo Sapiens
cccagccugggccacagugcaagacuccaucucaaaaaaaaaagaaaagaaaaagccuguuuaa

SEQ ID NO: 30027 - RNA, 64 nt, Homo Sapiens
ccagccugggccacagugcaagacuccaucucaaaaaaaaaagaaaagaaaaagccuguuuaau

SEQ ID NO: 30028 - RNA, 64 nt, Homo Sapiens
acgaugcaagcccguuguguuuccgagcuuuuuuaaaaaaaaauuuguagcaccgggcauggug

SEQ ID NO: 30029 - RNA, 64 nt, Homo Sapiens
cgaugcaagcccguuguguuuccgagcuuuuuuaaaaaaaaauuuguagcaccgggcauggugc

SEQ ID NO: 30030 - RNA, 64 nt, Homo Sapiens
gagaucaauaagaaauguucaggagagaggaaagaaaaaaaauauaugcuccacaauuuauauu

SEQ ID NO: 30031 - RNA, 64 nt, Homo Sapiens
ccccauuuccuccucuuucccucuccccgcugccaaaaaaaaaaaaaaaggaaacguuuaucau

SEQ ID NO: 30032 - RNA, 64 nt, Homo Sapiens
cccauuuccuccucuuucccucuccccgcugccaaaaaaaaaaaaaaaggaaacguuuaucaug

SEQ ID NO: 30033 - RNA, 64 nt, Homo Sapiens
ccauuuccuccucuuucccucuccccgcugccaaaaaaaaaaaaaaaggaaacguuuaucauga

SEQ ID NO: 30034 - RNA, 64 nt, Homo Sapiens
cauuuccuccucuuucccucuccccgcugccaaaaaaaaaaaaaaaggaaacguuuaucaugaa

SEQ ID NO: 30035 - RNA, 64 nt, Homo Sapiens
auuuccuccucuuucccucuccccgcugccaaaaaaaaaaaaaaaggaaacguuuaucaugaau

SEQ ID NO: 30036 - RNA, 64 nt, Homo Sapiens
uuuccuccucuuucccucuccccgcugccaaaaaaaaaaaaaaaggaaacguuuaucaugaauc

SEQ ID NO: 30037 - RNA, 64 nt, Homo Sapiens
uuccuccucuuucccucuccccgcugccaaaaaaaaaaaaaaaggaaacguuuaucaugaauca

SEQ ID NO: 30038 - RNA, 64 nt, Homo Sapiens
uccuccucuuucccucuccccgcugccaaaaaaaaaaaaaaaggaaacguuuaucaugaaucaa

SEQ ID NO: 30039 - RNA, 64 nt, Homo Sapiens
caauguauauucuaaauaaagucaucuaacuauuaaaaaaaaaacacccuuccuaacccuucuu

SEQ ID NO: 30040 - RNA, 64 nt, Homo Sapiens
aauguauauucuaaauaaagucaucuaacuauuaaaaaaaaaacacccuuccuaacccuucuuu

SEQ ID NO: 30041 - RNA, 64 nt, Homo Sapiens
auguauauucuaaauaaagucaucuaacuauuaaaaaaaaaacacccuuccuaacccuucuuuu

SEQ ID NO: 30042 - RNA, 64 nt, Homo Sapiens
ucagauuugaaauacugcaauaaugguugucuuuaaaaaaaaaaaagaaauguacuguuaaggu

SEQ ID NO: 30043 - RNA, 64 nt, Homo Sapiens
cagauuugaaauacugcaauaaugguugucuuuaaaaaaaaaaaagaaauguacuguuaaggua

SEQ ID NO: 30044 - RNA, 64 nt, Homo Sapiens
agauuugaaauacugcaauaaugguugucuuuaaaaaaaaaaaagaaauguacuguuaagguau

SEQ ID NO: 30045 - RNA, 64 nt, Homo Sapiens
gauuugaaauacugcaauaaugguugucuuuaaaaaaaaaaaagaaauguacuguuaagguauu

SEQ ID NO: 30046 - RNA, 64 nt, Homo Sapiens
auuugaaauacugcaauaaugguugucuuuaaaaaaaaaaaagaaauguacuguuaagguauua

SEQ ID NO: 30047 - RNA, 64 nt, Homo Sapiens
ccugggugaaagagcgagacuccgucucaaaaacaaaaaaaaaagaaaagaaauauauuuuauu

SEQ ID NO: 30048 - RNA, 64 nt, Homo Sapiens
cugggugaaagagcgagacuccgucucaaaaacaaaaaaaaaagaaaagaaauauauuuuauuc

SEQ ID NO: 30049 - RNA, 64 nt, Homo Sapiens
ugggugaaagagcgagacuccgucucaaaaacaaaaaaaaaagaaaagaaauauauuuuauuca

SEQ ID NO: 30050 - RNA, 64 nt, Homo Sapiens
cgugagccacugcgcccgggcaagaccuuuuuuuaaaaaaaaaaaaaaaaaaacuuccauucuu

SEQ ID NO: 30051 - RNA, 64 nt, Homo Sapiens
gugagccacugcgcccgggcaagaccuuuuuuuaaaaaaaaaaaaaaaaaaacuuccauucuuu

SEQ ID NO: 30052 - RNA, 64 nt, Homo Sapiens
ugagccacugcgcccgggcaagaccuuuuuuuaaaaaaaaaaaaaaaaaaacuuccauucuuuc

SEQ ID NO: 30053 - RNA, 64 nt, Homo Sapiens
gagccacugcgcccgggcaagaccuuuuuuuaaaaaaaaaaaaaaaaaaacuuccauucuuucu

SEQ ID NO: 30054 - RNA, 64 nt, Homo Sapiens
agccacugcgcccgggcaagaccuuuuuuuaaaaaaaaaaaaaaaaaaacuuccauucuuucuu

SEQ ID NO: 30055 - RNA, 64 nt, Homo Sapiens
gccacugcgcccgggcaagaccuuuuuuuaaaaaaaaaaaaaaaaaaacuuccauucuuucuuc

SEQ ID NO: 30056 - RNA, 64 nt, Homo Sapiens
ccacugcgcccgggcaagaccuuuuuuuaaaaaaaaaaaaaaaaaaacuuccauucuuucuucc

SEQ ID NO: 30057 - RNA, 64 nt, Homo Sapiens
cacugcgcccgggcaagaccuuuuuuuaaaaaaaaaaaaaaaaaaacuuccauucuuucuuccu

SEQ ID NO: 30058 - RNA, 64 nt, Homo Sapiens
acugcgcccgggcaagaccuuuuuuuaaaaaaaaaaaaaaaaaaacuuccauucuuucuuccuc

SEQ ID NO: 30059 - RNA, 64 nt, Homo Sapiens
cugcgcccgggcaagaccuuuuuuuaaaaaaaaaaaaaaaaaaacuuccauucuuucuuccucc

SEQ ID NO: 30060 - RNA, 64 nt, Homo Sapiens
ugcgcccgggcaagaccuuuuuuuaaaaaaaaaaaaaaaaaaacuuccauucuuucuuccucca

SEQ ID NO: 30061 - RNA, 64 nt, Homo Sapiens
gcgcccgggcaagaccuuuuuuuaaaaaaaaaaaaaaaaaaacuuccauucuuucuuccuccag

SEQ ID NO: 30062 - RNA, 64 nt, Homo Sapiens
cccaugcugccaaguuguagcuauagcuacaaauaaaaaaaaaccuuguuuuccagaauucuca

SEQ ID NO: 30063 - RNA, 64 nt, Homo Sapiens
ccaugcugccaaguuguagcuauagcuacaaauaaaaaaaaaccuuguuuuccagaauucucag

SEQ ID NO: 30064 - RNA, 64 nt, Homo Sapiens
uggaauauaauggaauauucuugagacugaucacaaaaaaaaaaaccuuuuuaauauuucuuua

SEQ ID NO: 30065 - RNA, 64 nt, Homo Sapiens
ggaauauaauggaauauucuugagacugaucacaaaaaaaaaaaccuuuuuaauauuucuuuau

SEQ ID NO: 30066 - RNA, 64 nt, Homo Sapiens
gaauauaauggaauauucuugagacugaucacaaaaaaaaaaaccuuuuuaauauuucuuuaua

SEQ ID NO: 30067 - RNA, 64 nt, Homo Sapiens
aauauaauggaauauucuugagacugaucacaaaaaaaaaaaccuuuuuaauauuucuuuauag

SEQ ID NO: 30068 - RNA, 64 nt, Homo Sapiens
uuccuuucuuagacuucauaggagauagugcuuuaaaaaaaaaaaaaacuucuauuauuuguuu

SEQ ID NO: 30069 - RNA, 64 nt, Homo Sapiens
uccuuucuuagacuucauaggagauagugcuuuaaaaaaaaaaaaaacuucuauuauuuguuua

SEQ ID NO: 30070 - RNA, 64 nt, Homo Sapiens
ccuuucuuagacuucauaggagauagugcuuuaaaaaaaaaaaaaacuucuauuauuuguuuag

SEQ ID NO: 30071 - RNA, 64 nt, Homo Sapiens
cuuucuuagacuucauaggagauagugcuuuaaaaaaaaaaaaaacuucuauuauuuguuuagu

SEQ ID NO: 30072 - RNA, 64 nt, Homo Sapiens
uuucuuagacuucauaggagauagugcuuuaaaaaaaaaaaaaacuucuauuauuuguuuagua

SEQ ID NO: 30073 - RNA, 64 nt, Homo Sapiens
uucuuagacuucauaggagauagugcuuuaaaaaaaaaaaaaacuucuauuauuuguuuaguau

SEQ ID NO: 30074 - RNA, 64 nt, Homo Sapiens
ucuuagacuucauaggagauagugcuuuaaaaaaaaaaaaaacuucuauuauuuguuuaguaug

SEQ ID NO: 30075 - RNA, 64 nt, Homo Sapiens
uauccaaaagauuuuuaaaaauagggcuguguuuaaaaaaaaaaaacaaaacaagaaaagcagc

SEQ ID NO: 30076 - RNA, 64 nt, Homo Sapiens
auccaaaagauuuuuaaaaauagggcuguguuuaaaaaaaaaaaacaaaacaagaaaagcagca

SEQ ID NO: 30077 - RNA, 64 nt, Homo Sapiens
uccaaaagauuuuuaaaaauagggcuguguuuaaaaaaaaaaaacaaaacaagaaaagcagcag

SEQ ID NO: 30078 - RNA, 64 nt, Homo Sapiens
ccaaaagauuuuuaaaaauagggcuguguuuaaaaaaaaaaaacaaaacaagaaaagcagcagu

SEQ ID NO: 30079 - RNA, 64 nt, Homo Sapiens
caaaagauuuuuaaaaauagggcuguguuuaaaaaaaaaaaacaaaacaagaaaagcagcagug

SEQ ID NO: 30080 - RNA, 64 nt, Homo Sapiens
gcuggacagugagacuuuugacagugagacugucaaaaaaaaaaaaaaaauuaauagauaaaac

SEQ ID NO: 30081 - RNA, 64 nt, Homo Sapiens
cuggacagugagacuuuugacagugagacugucaaaaaaaaaaaaaaaauuaauagauaaaaca

SEQ ID NO: 30082 - RNA, 64 nt, Homo Sapiens
uggacagugagacuuuugacagugagacugucaaaaaaaaaaaaaaaauuaauagauaaaacag

SEQ ID NO: 30083 - RNA, 64 nt, Homo Sapiens
ggacagugagacuuuugacagugagacugucaaaaaaaaaaaaaaaauuaauagauaaaacagg

SEQ ID NO: 30084 - RNA, 64 nt, Homo Sapiens
gacagugagacuuuugacagugagacugucaaaaaaaaaaaaaaaauuaauagauaaaacaggc

SEQ ID NO: 30085 - RNA, 64 nt, Homo Sapiens
acagugagacuuuugacagugagacugucaaaaaaaaaaaaaaaauuaauagauaaaacaggcc

SEQ ID NO: 30086 - RNA, 64 nt, Homo Sapiens
cagugagacuuuugacagugagacugucaaaaaaaaaaaaaaaauuaauagauaaaacaggcca

SEQ ID NO: 30087 - RNA, 64 nt, Homo Sapiens
agugagacuuuugacagugagacugucaaaaaaaaaaaaaaaauuaauagauaaaacaggccac

SEQ ID NO: 30088 - RNA, 64 nt, Homo Sapiens
gugagacuuuugacagugagacugucaaaaaaaaaaaaaaaauuaauagauaaaacaggccacu

SEQ ID NO: 30089 - RNA, 64 nt, Homo Sapiens
cuugaaagaagauuauuaguacuccaagauugaaaaaaaaaacuaaaaauaagucagauuguua

SEQ ID NO: 30090 - RNA, 64 nt, Homo Sapiens
ucuugaaagaagauuauuagaacuccaagauugaaaaaaaaaacgaaaaauaagucagauuguu

SEQ ID NO: 30091 - RNA, 64 nt, Homo Sapiens
cucuugaaagaagauuauuauaacuccaagauugaaaaaaaaaaagaaaaauaagucagauugu

SEQ ID NO: 30092 - RNA, 64 nt, Homo Sapiens
aagauacccauucuuucugcuuuaaaaaaaaaaaaaaaaaaacuaacaaaagcaaaacucuauc

SEQ ID NO: 30093 - RNA, 64 nt, Homo Sapiens
uaagauacccauucuuucugcuuuaaaaaaaaaaaaaaaaaaaccaacaaaagcaaaacucuau

SEQ ID NO: 30094 - RNA, 64 nt, Homo Sapiens
cuaagauacccauucuuucuucuuuaaaaaaaaaaaaaaaaaaagcaacaaaagcaaaacucua

SEQ ID NO: 30095 - RNA, 64 nt, Homo Sapiens
acuaagauacccauucuuucaucuuuaaaaaaaaaaaaaaaaaaagcaacaaaagcaaaacucu

SEQ ID NO: 30096 - RNA, 64 nt, Homo Sapiens
aacuaagauacccauucuuuuaucuuuaaaaaaaaaaaaaaaaagagcaacaaaagcaaaacuc

SEQ ID NO: 30097 - RNA, 64 nt, Homo Sapiens
aaacuaagauacccauucuucuaucuuuaaaaaaaaaaaaaaaaugagcaacaaaagcaaaacu

SEQ ID NO: 30098 - RNA, 64 nt, Homo Sapiens
aaaacuaagauacccauucuucuaucuuuaaaaaaaaaaaaaaacugagcaacaaaagcaaaac

SEQ ID NO: 30099 - RNA, 64 nt, Homo Sapiens
aaaaacuaagauacccauuccucuaucuuuaaaaaaaaaaaaaaccugagcaacaaaagcaaaa

SEQ ID NO: 30100 - RNA, 64 nt, Homo Sapiens
aaaaaacuaagauacccauuacucuaucuuuaaaaaaaaaaaaagccugagcaacaaaagcaaa

SEQ ID NO: 30101 - RNA, 64 nt, Homo Sapiens
aaaaaaacuaagauacccauaacucuaucuuuaaaaaaaaaaaaagccugagcaacaaaagcaa

SEQ ID NO: 30102 - RNA, 64 nt, Homo Sapiens
aaaaaaaacuaagauacccaaaacucuaucuuuaaaaaaaaaaacagccugagcaacaaaagca

SEQ ID NO: 30103 - RNA, 64 nt, Homo Sapiens
aaaaaaaaacuaagauacccaaaacucuaucuuuaaaaaaaaaaccagccugagcaacaaaagc

SEQ ID NO: 30104 - RNA, 64 nt, Homo Sapiens
aauagaagauuccugcugugagcaaacuugaaaaaaaaaaaagaagauauguuucugauacaau

SEQ ID NO: 30105 - RNA, 64 nt, Homo Sapiens
aaauagaagauuccugcuguuagcaaacuugaaaaaaaaaaaagaagauauguuucugauacaa

SEQ ID NO: 30106 - RNA, 64 nt, Homo Sapiens
gaaauagaagauuccugcugauagcaaacuugaaaaaaaaaaaaaaagauauguuucugauaca

SEQ ID NO: 30107 - RNA, 64 nt, Homo Sapiens
agaaauagaagauuccugcuaauagcaaacuugaaaaaaaaaaaaaaagauauguuucugauac

SEQ ID NO: 30108 - RNA, 64 nt, Homo Sapiens
aagaaauagaagauuccugccaauagcaaacuugaaaaaaaaaauaaaagauauguuucugaua

SEQ ID NO: 30109 - RNA, 64 nt, Homo Sapiens
uugacaaauugaagauggauaagugcgccuugcaaaaaaaaacuauuuucauagguacaaacac

SEQ ID NO: 30110 - RNA, 64 nt, Homo Sapiens
uuugacaaauugaagauggacaagugcgccuugcaaaaaaaaacuauuuucauagguacaaaca

SEQ ID NO: 30111 - RNA, 64 nt, Homo Sapiens
aauguuuuggggguguucugcaugauuuucuaaaaaaaaaaauauguauacuaccauagugagc

SEQ ID NO: 30112 - RNA, 64 nt, Homo Sapiens
aaauguuuuggggguguucuccaugauuuucuaaaaaaaaaaauuuguauacuaccauagugag

SEQ ID NO: 30113 - RNA, 64 nt, Homo Sapiens
uaaauguuuuggggguguucgccaugauuuucuaaaaaaaaaaaauuguauacuaccauaguga

SEQ ID NO: 30114 - RNA, 64 nt, Homo Sapiens
auaaauguuuuggggguguuagccaugauuuucuaaaaaaaaaauauuguauacuaccauagug

SEQ ID NO: 30115 - RNA, 52 nt, Homo Sapiens
uccaagcccuucugucugucagaaaaaaaaucugcugaagacugaauuguaa

SEQ ID NO: 30116 - RNA, 64 nt, Homo Sapiens
uaaaauacaaaaaacaacauugaggggaaaaacaaaaaaaaacuucuuuuuuucauccuuccuc

SEQ ID NO: 30117 - RNA, 64 nt, Homo Sapiens
uuaaaauacaaaaaacaacacugaggggaaaaacaaaaaaaaacuucuuuuuuucauccuuccu

SEQ ID NO: 30118 - RNA, 64 nt, Homo Sapiens
acugccucauucuuauuucaauauaacccuuuaaaaaaaaaauccacugaucuaaaggacauau

SEQ ID NO: 30119 - RNA, 64 nt, Homo Sapiens
cacugccucauucuuauuucuauauaacccuuuaaaaaaaaaauacacugaucuaaaggacaua

SEQ ID NO: 30120 - RNA, 64 nt, Homo Sapiens
ucacugccucauucuuauuuauauauaacccuuuaaaaaaaaaauacacugaucuaaaggacau

SEQ ID NO: 30121 - RNA, 64 nt, Homo Sapiens
caaaagauagagaauacaagcaaucaguucuuugaaaaaaaagucaggauuucuguauacugug

SEQ ID NO: 30122 - RNA, 64 nt, Homo Sapiens
agacuccaccuuaaguaguacugauaaauuaaaaaaaaaaaauuauuuugaagauuuuuaagca

SEQ ID NO: 30123 - RNA, 64 nt, Homo Sapiens
uagacuccaccuuaaguaguacugauaaauuaaaaaaaaaaaauuauuuugaagauuuuuaagc

SEQ ID NO: 30124 - RNA, 64 nt, Homo Sapiens
uuagacuccaccuuaaguagcacugauaaauuaaaaaaaaaaaacuauuuugaagauuuuuaag

SEQ ID NO: 30125 - RNA, 64 nt, Homo Sapiens
auuagacuccaccuuaaguagcacugauaaauuaaaaaaaaaaagcuauuuugaagauuuuuaa

SEQ ID NO: 30126 - RNA, 64 nt, Homo Sapiens
aauuagacuccaccuuaaguagcacugauaaauuaaaaaaaaaaagcuauuuugaagauuuuua

SEQ ID NO: 30127 - RNA, 64 nt, Homo Sapiens
uagaauucuuggaaguacauugucuccaaaaaaaaaaaaaaaucgccugggugacgagugaaac

SEQ ID NO: 30128 - RNA, 64 nt, Homo Sapiens
cuagaauucuuggaaguacacugucuccaaaaaaaaaaaaaaauagccugggugacgagugaaa

SEQ ID NO: 30129 - RNA, 64 nt, Homo Sapiens
ucuagaauucuuggaaguacacugucuccaaaaaaaaaaaaaaaaagccugggugacgagugaa

SEQ ID NO: 30130 - RNA, 64 nt, Homo Sapiens
aucuagaauucuuggaaguaaacugucuccaaaaaaaaaaaaaacaagccugggugacgaguga

SEQ ID NO: 30131 - RNA, 64 nt, Homo Sapiens
aaucuagaauucuuggaaguaaacugucuccaaaaaaaaaaaaaucaagccugggugacgagug

SEQ ID NO: 30132 - RNA, 64 nt, Homo Sapiens
aaaucuagaauucuuggaaggaaacugucuccaaaaaaaaaaaacucaagccugggugacgagu

SEQ ID NO: 30133 - RNA, 64 nt, Homo Sapiens
aaaaucuagaauucuuggaaugaaacugucuccaaaaaaaaaaaacucaagccugggugacgag

SEQ ID NO: 30134 - RNA, 64 nt, Homo Sapiens
aaaaaucuagaauucuuggagugaaacugucuccaaaaaaaaaacacucaagccugggugacga

SEQ ID NO: 30135 - RNA, 64 nt, Homo Sapiens
aaacagaagagcacccugaacaguuacacuuaauaaaaaaaauucuauauaaaaaucauuggca

SEQ ID NO: 30136 - RNA, 64 nt, Homo Sapiens
auugcaaaugcuuuagaaauuuuuugucugaauaaaaaaaaagcguuacguaaaguuaaaauga

SEQ ID NO: 30137 - RNA, 64 nt, Homo Sapiens
cauugcaaaugcuuuagaaaauuuuugucugaauaaaaaaaaaguguuacguaaaguuaaaaug

SEQ ID NO: 30138 - RNA, 64 nt, Homo Sapiens
ccuuugagacaguuucuuaggaggaaggauuguaaaaaaaaaugaauaacauuaccuuacugug

SEQ ID NO: 30139 - RNA, 64 nt, Homo Sapiens
gccuuugagacaguuucuuaggaggaaggauuguaaaaaaaaauuaauaacauuaccuuacugu

SEQ ID NO: 30140 - RNA, 64 nt, Homo Sapiens
aauuugauuuuagggauuguucucaaaugugaaaaaaaaaaagaucaauaucaugaucauccaa

SEQ ID NO: 30141 - RNA, 64 nt, Homo Sapiens
aaauuugauuuuagggauugaucucaaaugugaaaaaaaaaaagcucaauaucaugaucaucca

SEQ ID NO: 30142 - RNA, 64 nt, Homo Sapiens
gaaauuugauuuuagggauuaaucucaaaugugaaaaaaaaaaaccucaauaucaugaucaucc

SEQ ID NO: 30143 - RNA, 64 nt, Homo Sapiens
agaaauuugauuuuagggaucaaucucaaaugugaaaaaaaaaacccucaauaucaugaucauc

SEQ ID NO: 30144 - RNA, 64 nt, Homo Sapiens
gaaucucaguguauucucaacagaaaaaaaaaaaaaaaaaaacagacagagugagacuccaucu

SEQ ID NO: 30145 - RNA, 64 nt, Homo Sapiens
agaaucucaguguauucucaucagaaaaaaaaaaaaaaaaaaaccgacagagugagacuccauc

SEQ ID NO: 30146 - RNA, 64 nt, Homo Sapiens
cagaaucucaguguauucuccucagaaaaaaaaaaaaaaaaaaagcgacagagugagacuccau

SEQ ID NO: 30147 - RNA, 64 nt, Homo Sapiens
acagaaucucaguguauucuucucagaaaaaaaaaaaaaaaaaaggcgacagagugagacucca

SEQ ID NO: 30148 - RNA, 64 nt, Homo Sapiens
aacagaaucucaguguauucaucucagaaaaaaaaaaaaaaaaagggcgacagagugagacucc

SEQ ID NO: 30149 - RNA, 64 nt, Homo Sapiens
aaacagaaucucaguguauucaucucagaaaaaaaaaaaaaaaaugggcgacagagugagacuc

SEQ ID NO: 30150 - RNA, 64 nt, Homo Sapiens
aaaacagaaucucaguguauccaucucagaaaaaaaaaaaaaaacugggcgacagagugagacu

SEQ ID NO: 30151 - RNA, 64 nt, Homo Sapiens
aaaaacagaaucucaguguauccaucucagaaaaaaaaaaaaaaccugggcgacagagugagac

SEQ ID NO: 30152 - RNA, 64 nt, Homo Sapiens
aaaaaacagaaucucagugucuccaucucagaaaaaaaaaaaaagccugggcgacagagugaga

SEQ ID NO: 30153 - RNA, 64 nt, Homo Sapiens
aaaaaaacagaaucucagugacuccaucucagaaaaaaaaaaaaagccugggcgacagagugag

SEQ ID NO: 30154 - RNA, 64 nt, Homo Sapiens
aaaaaaaacagaaucucagugacuccaucucagaaaaaaaaaaacagccugggcgacagaguga

SEQ ID NO: 30155 - RNA, 64 nt, Homo Sapiens
aaaaaaaaacagaaucucagagacuccaucucagaaaaaaaaaaccagccugggcgacagagug

SEQ ID NO: 30156 - RNA, 64 nt, Homo Sapiens
uguaaacgcgaaaaauacuaccggcaaaacugaaaaaaaaaaucgugauuuagguuuguaacau

SEQ ID NO: 30157 - RNA, 64 nt, Homo Sapiens
cuguaaacgcgaaaaauacuuccggcaaaacugaaaaaaaaaauagugauuuagguuuguaaca

SEQ ID NO: 30158 - RNA, 64 nt, Homo Sapiens
ucuguaaacgcgaaaaauacauccggcaaaacugaaaaaaaaaacagugauuuagguuuguaac

SEQ ID NO: 30159 - RNA, 64 nt, Homo Sapiens
aaaggcgcuuugaaacaggguuguaaagagugagaaaaaaaaucuuuuuuuuuaauugcacuuc

SEQ ID NO: 30160 - RNA, 64 nt, Homo Sapiens
cacaaaaagucccccuucaaaaaaagaaaagagaaaaaaaaacaacuugaaguaacuauaacaa

SEQ ID NO: 30161 - RNA, 64 nt, Homo Sapiens
acacaaaaagucccccuucaaaaaaagaaaagagaaaaaaaaacuacuugaaguaacuauaaca

SEQ ID NO: 30162 - RNA, 64 nt, Homo Sapiens
gauguuuuaacuuauuuauaauggcuuugucuugaaaaaaaauauguucaucucuuuguccuga

SEQ ID NO: 30163 - RNA, 64 nt, Homo Sapiens
uuaaguguucucggggaugcuucccagugaaauaaaaaaaaauuuguaaaguagcuguaagaau

SEQ ID NO: 30164 - RNA, 64 nt, Homo Sapiens
uuuaaguguucucggggauguuucccagugaaauaaaaaaaaauuuguaaaguagcuguaagaa

SEQ ID NO: 30165 - RNA, 64 nt, Homo Sapiens
auuaccaagagaaggggacucagcuuuaaaaagaaaaaaaaagaccuuccucuguaagauaucc

SEQ ID NO: 30166 - RNA, 64 nt, Homo Sapiens
aauuaccaagagaaggggacccagcuuuaaaaagaaaaaaaaaguccuuccucuguaagauauc

SEQ ID NO: 30167 - RNA, 64 nt, Homo Sapiens
cuuagaccuguagauagugauacuaaaaaugaaaaaaaaaaaccaccugcuuuuuaaauauuuc

SEQ ID NO: 30168 - RNA, 64 nt, Homo Sapiens
ccuuagaccuguagauagugcuacuaaaaaugaaaaaaaaaaaccaccugcuuuuuaaauauuu

SEQ ID NO: 30169 - RNA, 64 nt, Homo Sapiens
cccuuagaccuguagauaguucuacuaaaaaugaaaaaaaaaaagcaccugcuuuuuaaauauu

SEQ ID NO: 30170 - RNA, 64 nt, Homo Sapiens
acccuuagaccuguagauaguucuacuaaaaaugaaaaaaaaaaugcaccugcuuuuuaaauau

SEQ ID NO: 30171 - RNA, 64 nt, Homo Sapiens
gaaauuaacauccaguggagaucaagcauacaauaaaaaaaacuuuggaauugucucuaaaugc

SEQ ID NO: 30172 - RNA, 64 nt, Homo Sapiens
aaaucauucuguuuccugcagggaauaauaauaaaaaaaaaagagauggaaaaugcuauuggca

SEQ ID NO: 30173 - RNA, 64 nt, Homo Sapiens
aaaaucauucuguuuccugcagggaauaauaauaaaaaaaaaagagauggaaaaugcuauuggc

SEQ ID NO: 30174 - RNA, 64 nt, Homo Sapiens
gaaaaucauucuguuuccugcagggaauaauaauaaaaaaaaaauagauggaaaaugcuauugg

SEQ ID NO: 30175 - RNA, 64 nt, Homo Sapiens
uaaaauuagaaaaauaacucacccauuuaaaaaaaaaaaaaagcacuccucaccguaucuuuua

SEQ ID NO: 30176 - RNA, 64 nt, Homo Sapiens
cuaaaauuagaaaaauaacuaacccauuuaaaaaaaaaaaaaagcacuccucaccguaucuuuu

SEQ ID NO: 30177 - RNA, 64 nt, Homo Sapiens
gcuaaaauuagaaaaauaacuaacccauuuaaaaaaaaaaaaaaacacuccucaccguaucuuu

SEQ ID NO: 30178 - RNA, 64 nt, Homo Sapiens
agcuaaaauuagaaaaauaauuaacccauuuaaaaaaaaaaaaacacacuccucaccguaucuu

SEQ ID NO: 30179 - RNA, 64 nt, Homo Sapiens
aagcuaaaauuagaaaaauauuuaacccauuuaaaaaaaaaaaaacacacuccucaccguaucu

SEQ ID NO: 30180 - RNA, 64 nt, Homo Sapiens
aaagcuaaaauuagaaaaauuuuuaacccauuuaaaaaaaaaaaaacacacuccucaccguauc

SEQ ID NO: 30181 - RNA, 64 nt, Homo Sapiens
aaaagcuaaaauuagaaaaacuuuuaacccauuuaaaaaaaaaacaacacacuccucaccguau

SEQ ID NO: 30182 - RNA, 64 nt, Homo Sapiens
aaaguaaauuaaaaacaaaacaaaaaaaaaaacaaaaaaaaacaaauagaaauuaaaaacaaaa

SEQ ID NO: 30183 - RNA, 64 nt, Homo Sapiens
aaaaguaaauuaaaaacaaaacaaaaaaaaaaacaaaaaaaaacaaauagaaauuaaaaacaaa

SEQ ID NO: 30184 - RNA, 64 nt, Homo Sapiens
aaaaaaaacaaaaguaaauuaaaaacaaaacaaaaaaaaaaacauaaccagaaaaauagaaauu

SEQ ID NO: 30185 - RNA, 64 nt, Homo Sapiens
aaaaaaaaacaaaaguaaauuaaaaacaaaacaaaaaaaaaaacuuaaccagaaaaauagaaau

SEQ ID NO: 30186 - RNA, 64 nt, Homo Sapiens
caaaaaaaaacaaaaguaaauuaaaaacaaaacaaaaaaaaaaaguuaaccagaaaaauagaaa

SEQ ID NO: 30187 - RNA, 64 nt, Homo Sapiens
acaaaaaaaaacaaaaguaaauuaaaaacaaaacaaaaaaaaaaaguuaaccagaaaaauagaa

SEQ ID NO: 30188 - RNA, 64 nt, Homo Sapiens
gacaucagaugaaaugaaaaacgacgacaaccacaaaaaaaauuaaaaaaaaaaaaacaagaug

SEQ ID NO: 30189 - RNA, 64 nt, Homo Sapiens
agaugacgacgacaaccacaacaaaaaaaaaaaaaaaaaaaacaaugugauuuguuaaaaaaaa

SEQ ID NO: 30190 - RNA, 64 nt, Homo Sapiens
aagaugacgacgacaaccacaacaaaaaaaaaaaaaaaaaaaacgaugugauuuguuaaaaaaa

SEQ ID NO: 30191 - RNA, 64 nt, Homo Sapiens
caagaugacgacgacaaccaaaacaaaaaaaaaaaaaaaaaaaaagaugugauuuguuaaaaaa

SEQ ID NO: 30192 - RNA, 64 nt, Homo Sapiens
acaagaugacgacgacaaccaaaacaaaaaaaaaaaaaaaaaaacagaugugauuuguuaaaaa

SEQ ID NO: 30193 - RNA, 64 nt, Homo Sapiens
aacaagaugacgacgacaacaaaaacaaaaaaaaaaaaaaaaaaccagaugugauuuguuaaaa

SEQ ID NO: 30194 - RNA, 64 nt, Homo Sapiens
aaacaagaugacgacgacaaaaaaaacaaaaaaaaaaaaaaaaaaccagaugugauuuguuaaa

SEQ ID NO: 30195 - RNA, 64 nt, Homo Sapiens
aaaacaagaugacgacgacaaaaaaaacaaaaaaaaaaaaaaaagaccagaugugauuuguuaa

SEQ ID NO: 30196 - RNA, 64 nt, Homo Sapiens
aaaaacaagaugacgacgacaaaaaaaacaaaaaaaaaaaaaaaagaccagaugugauuuguua

SEQ ID NO: 30197 - RNA, 64 nt, Homo Sapiens
aaaaaacaagaugacgacgaaaaaaaaaacaaaaaaaaaaaaaaaagaccagaugugauuuguu

SEQ ID NO: 30198 - RNA, 64 nt, Homo Sapiens
aaaaaaacaagaugacgacguaaaaaaaaacaaaaaaaaaaaaacaagaccagaugugauuugu

SEQ ID NO: 30199 - RNA, 64 nt, Homo Sapiens
aaaaaaaacaagaugacgacuuaaaaaaaaacaaaaaaaaaaaaacaagaccagaugugauuug

SEQ ID NO: 30200 - RNA, 64 nt, Homo Sapiens
aaaaaaaaacaagaugacgaguuaaaaaaaaacaaaaaaaaaaaaacaagaccagaugugauuu

SEQ ID NO: 30201 - RNA, 64 nt, Homo Sapiens
aaaaaaaaaacaagaugacguguuaaaaaaaaacaaaaaaaaaaaaacaagaccagaugugauu

SEQ ID NO: 30202 - RNA, 64 nt, Homo Sapiens
aaaaaaaaaaaaaaaaaaacgaugugauuuguuaaaaaaaaacaucugcagaaaaacaagacca

SEQ ID NO: 30203 - RNA, 64 nt, Homo Sapiens
aaaaaaaaaaaaaaaaaaaaagaugugauuuguuaaaaaaaaacgucugcagaaaaacaagacc

SEQ ID NO: 30204 - RNA, 64 nt, Homo Sapiens
gggaggcuuuucaaaggugguuuugguaguaagaaaaaaaaauuaugcuccaugaugcugugug

SEQ ID NO: 30205 - RNA, 64 nt, Homo Sapiens
ugggaggcuuuucaaaggugguuuugguaguaagaaaaaaaaauuaugcuccaugaugcugugu

SEQ ID NO: 30206 - RNA, 64 nt, Homo Sapiens
gggauauuaccauggcaaccgacugaucugacaaaaaaaaaagaaaugugcuugggucccacgu

SEQ ID NO: 30207 - RNA, 64 nt, Homo Sapiens
agggauauuaccauggcaacugacugaucugacaaaaaaaaaaggaaugugcuugggucccacg

SEQ ID NO: 30208 - RNA, 64 nt, Homo Sapiens
gagggauauuaccauggcaagugacugaucugacaaaaaaaaaaagaaugugcuugggucccac

SEQ ID NO: 30209 - RNA, 64 nt, Homo Sapiens
gagagagagagaaagaaauaacuccaucucaaaaaaaaaaaagaagccugggucacagagugag

SEQ ID NO: 30210 - RNA, 64 nt, Homo Sapiens
agagagagagagaaagaaaugacuccaucucaaaaaaaaaaaagcagccugggucacagaguga

SEQ ID NO: 30211 - RNA, 64 nt, Homo Sapiens
gagagagagagagaaagaaaagacuccaucucaaaaaaaaaaaaccagccugggucacagagug

SEQ ID NO: 30212 - RNA, 64 nt, Homo Sapiens
agagagagagagagaaagaagagacuccaucucaaaaaaaaaaauccagccugggucacagagu

SEQ ID NO: 30213 - RNA, 64 nt, Homo Sapiens
aagagagagagagagaaagaugagacuccaucucaaaaaaaaaacuccagccugggucacagag

SEQ ID NO: 30214 - RNA, 64 nt, Homo Sapiens
uucugugucagagcccagccgacccugucucaaaaaaaaaaagacggccugggugacagaguga

SEQ ID NO: 30215 - RNA, 64 nt, Homo Sapiens
auucugugucagagcccagcagacccugucucaaaaaaaaaaagccggccugggugacagagug

SEQ ID NO: 30216 - RNA, 64 nt, Homo Sapiens
gauucugugucagagcccaggagacccugucucaaaaaaaaaaauccggccugggugacagagu

SEQ ID NO: 30217 - RNA, 64 nt, Homo Sapiens
agauucugugucagagcccaugagacccugucucaaaaaaaaaacuccggccugggugacagag

SEQ ID NO: 30218 - RNA, 64 nt, Homo Sapiens
acaaauggggcaaacagucuccgucucaaaaaaaaaaaaaaauuugggcaacaagagcaaaacu

SEQ ID NO: 30219 - RNA, 64 nt, Homo Sapiens
uacaaauggggcaaacagucuccgucucaaaaaaaaaaaaaaaucugggcaacaagagcaaaac

SEQ ID NO: 30220 - RNA, 64 nt, Homo Sapiens
uuacaaauggggcaaacagucuccgucucaaaaaaaaaaaaaaaccugggcaacaagagcaaaa

SEQ ID NO: 30221 - RNA, 64 nt, Homo Sapiens
auuacaaauggggcaaacagacuccgucucaaaaaaaaaaaaaagccugggcaacaagagcaaa

SEQ ID NO: 30222 - RNA, 64 nt, Homo Sapiens
aauuacaaauggggcaaacaaacuccgucucaaaaaaaaaaaaaagccugggcaacaagagcaa

SEQ ID NO: 30223 - RNA, 64 nt, Homo Sapiens
aaauuacaaauggggcaaacaaacuccgucucaaaaaaaaaaaacagccugggcaacaagagca

SEQ ID NO: 30224 - RNA, 64 nt, Homo Sapiens
aaaauuacaaauggggcaaaaaaacuccgucucaaaaaaaaaaaccagccugggcaacaagagc

SEQ ID NO: 30225 - RNA, 64 nt, Homo Sapiens
aaaaauuacaaauggggcaacaaaacuccgucucaaaaaaaaaauccagccugggcaacaagag

SEQ ID NO: 30226 - RNA, 64 nt, Homo Sapiens
gagauuacacuggcauaaacguauuacaaaaggaaaaaaaaauuccucugacuuuauuuuccau

SEQ ID NO: 30227 - RNA, 64 nt, Homo Sapiens
ugagauuacacuggcauaaauguauuacaaaaggaaaaaaaaauuccucugacuuuauuuucca

SEQ ID NO: 30228 - RNA, 64 nt, Homo Sapiens
uuuuaaaaauuguauccuagauuuucagugguagaaaaaaaaggaucaaaucauauuucuguac

SEQ ID NO: 30229 - RNA, 64 nt, Homo Sapiens
uuccuccccacugcaugaaggcuuuaguuuaagaaaaaaaaauacagagagacagugcagugua

SEQ ID NO: 30230 - RNA, 64 nt, Homo Sapiens
auuccuccccacugcaugaaagcuuuaguuuaagaaaaaaaaauacagagagacagugcagugu

SEQ ID NO: 30231 - RNA, 64 nt, Homo Sapiens
uauuugaaguguuuuuauagaaacaaaccaaaaaaaaaaaaagaauugggaauggauaauuuag

SEQ ID NO: 30232 - RNA, 64 nt, Homo Sapiens
auauuugaaguguuuuuauagaaacaaaccaaaaaaaaaaaaaguauugggaauggauaauuua

SEQ ID NO: 30233 - RNA, 64 nt, Homo Sapiens
gauauuugaaguguuuuuauagaaacaaaccaaaaaaaaaaaaauuauugggaauggauaauuu

SEQ ID NO: 30234 - RNA, 64 nt, Homo Sapiens
agauauuugaaguguuuuuauagaaacaaaccaaaaaaaaaaaacuuauugggaauggauaauu

SEQ ID NO: 30235 - RNA, 64 nt, Homo Sapiens
aagauauuugaaguguuuuuuuagaaacaaaccaaaaaaaaaaaccuuauugggaauggauaau

SEQ ID NO: 30236 - RNA, 64 nt, Homo Sapiens
aaagauauuugaaguguuuuuuuagaaacaaaccaaaaaaaaaaaccuuauugggaauggauaa

SEQ ID NO: 30237 - RNA, 64 nt, Homo Sapiens
uccaaauauuuguggguccgaacauuuuuaauuuaaaaaaaauugcucaaagcaauuaaguggg

SEQ ID NO: 30238 - RNA, 64 nt, Homo Sapiens
uagauuauaacaaacugcuaguaauucaucuguuaaaaaaaaucguauaaguagcugccaauuu

SEQ ID NO: 30239 - RNA, 64 nt, Homo Sapiens
acuuucaacaaggcauauagccaucucaaaaaaaaaaaaaaauucugggugacacagcaagacu

SEQ ID NO: 30240 - RNA, 64 nt, Homo Sapiens
uacuuucaacaaggcauauauccaucucaaaaaaaaaaaaaaauccugggugacacagcaagac

SEQ ID NO: 30241 - RNA, 64 nt, Homo Sapiens
uuacuuucaacaaggcauaucuccaucucaaaaaaaaaaaaaaagccugggugacacagcaaga

SEQ ID NO: 30242 - RNA, 64 nt, Homo Sapiens
auuacuuucaacaaggcauaacuccaucucaaaaaaaaaaaaaaagccugggugacacagcaag

SEQ ID NO: 30243 - RNA, 64 nt, Homo Sapiens
aauuacuuucaacaaggcaugacuccaucucaaaaaaaaaaaaauagccugggugacacagcaa

SEQ ID NO: 30244 - RNA, 64 nt, Homo Sapiens
aaauuacuuucaacaaggcaagacuccaucucaaaaaaaaaaaacuagccugggugacacagca

SEQ ID NO: 30245 - RNA, 64 nt, Homo Sapiens
aaaauuacuuucaacaaggcaagacuccaucucaaaaaaaaaaagcuagccugggugacacagc

SEQ ID NO: 30246 - RNA, 64 nt, Homo Sapiens
aaaaauuacuuucaacaaggcaagacuccaucucaaaaaaaaaacgcuagccugggugacacag

SEQ ID NO: 30247 - RNA, 64 nt, Homo Sapiens
ugauuuguuucugucuucaauagaaaacaaaaacaaaaaaaaugauuuucucuuguaaaacauu

SEQ ID NO: 30248 - RNA, 64 nt, Homo Sapiens
uacagacacucaaauuccacaaacaaacaauuaaaaaaaaaacauagcuuaucaacuccccucc

SEQ ID NO: 30249 - RNA, 64 nt, Homo Sapiens
auacagacacucaaauuccacaaacaaacaauuaaaaaaaaaacuuagcuuaucaacuccccuc

SEQ ID NO: 30250 - RNA, 64 nt, Homo Sapiens
cauacagacacucaaauuccccaaacaaacaauuaaaaaaaaaaauuagcuuaucaacuccccu

SEQ ID NO: 30251 - RNA, 64 nt, Homo Sapiens
guauuuguacuuuuaaagggacuucaucucaaaaaaaaaaaauuagccugggcaacagcgugag

SEQ ID NO: 30252 - RNA, 64 nt, Homo Sapiens
uguauuuguacuuuuaaagggacuucaucucaaaaaaaaaaaaucagccugggcaacagcguga

SEQ ID NO: 30253 - RNA, 64 nt, Homo Sapiens
uuguauuuguacuuuuaaagagacuucaucucaaaaaaaaaaaaccagccugggcaacagcgug

SEQ ID NO: 30254 - RNA, 64 nt, Homo Sapiens
auuguauuuguacuuuuaaagagacuucaucucaaaaaaaaaaauccagccugggcaacagcgu

SEQ ID NO: 30255 - RNA, 64 nt, Homo Sapiens
aauuguauuuguacuuuuaaugagacuucaucucaaaaaaaaaauuccagccugggcaacagcg

SEQ ID NO: 30256 - RNA, 63 nt, Homo Sapiens
aaaaaaacaaaaaaacgaagcccaaaagggagaaaaaaaaaacaaugcagagaaagagcaaag

SEQ ID NO: 30257 - RNA, 64 nt, Homo Sapiens
aaaaaaacaaaaaaacgaaggcccaaaagggagaaaaaaaaaacuaaugcagagaaagagcaaa

SEQ ID NO: 30258 - RNA, 64 nt, Homo Sapiens
caaaaaaacaaaaaaacgaaagcccaaaagggagaaaaaaaaaauuaaugcagagaaagagcaa

SEQ ID NO: 30259 - RNA, 64 nt, Homo Sapiens
guucuagcccaggagcggugagacuccaucucaaaaaaaaaagaccagcuugggcaacagagca

SEQ ID NO: 30260 - RNA, 64 nt, Homo Sapiens
aguucuagcccaggagcgguaagacuccaucucaaaaaaaaaaguccagcuugggcaacagagc

SEQ ID NO: 30261 - RNA, 64 nt, Homo Sapiens
gaguucuagcccaggagcggcaagacuccaucucaaaaaaaaaacuccagcuugggcaacagag

SEQ ID NO: 30262 - RNA, 64 nt, Homo Sapiens
aaaauaaaggagacuugaaauaaaaaaaaaaaaaaaaaaaaaggcaaaaccuagucccuaaaau

SEQ ID NO: 30263 - RNA, 64 nt, Homo Sapiens
gaaaauaaaggagacuugaauuaaaaaaaaaaaaaaaaaaaaaggcaaaaccuagucccuaaaa

SEQ ID NO: 30264 - RNA, 64 nt, Homo Sapiens
ggaaaauaaaggagacuugaauuaaaaaaaaaaaaaaaaaaaaaagcaaaaccuagucccuaaa

SEQ ID NO: 30265 - RNA, 64 nt, Homo Sapiens
aggaaaauaaaggagacuugaauuaaaaaaaaaaaaaaaaaaaauagcaaaaccuagucccuaa

SEQ ID NO: 30266 - RNA, 64 nt, Homo Sapiens
aaggaaaauaaaggagacuuaaauuaaaaaaaaaaaaaaaaaaaauagcaaaaccuagucccua

SEQ ID NO: 30267 - RNA, 64 nt, Homo Sapiens
aaaggaaaauaaaggagacuaaaauuaaaaaaaaaaaaaaaaaacauagcaaaaccuagucccu

SEQ ID NO: 30268 - RNA, 64 nt, Homo Sapiens
aaaaggaaaauaaaggagacuaaaauuaaaaaaaaaaaaaaaaaacauagcaaaaccuaguccc

SEQ ID NO: 30269 - RNA, 64 nt, Homo Sapiens
aaaaaggaaaauaaaggagacuaaaauuaaaaaaaaaaaaaaaaaacauagcaaaaccuagucc

SEQ ID NO: 30270 - RNA, 64 nt, Homo Sapiens
aaaaaaggaaaauaaaggagccuaaaauuaaaaaaaaaaaaaaacaacauagcaaaaccuaguc

SEQ ID NO: 30271 - RNA, 64 nt, Homo Sapiens
aaaaaaaggaaaauaaaggacccuaaaauuaaaaaaaaaaaaaagcaacauagcaaaaccuagu

SEQ ID NO: 30272 - RNA, 64 nt, Homo Sapiens
aaaaaaaaggaaaauaaaggucccuaaaauuaaaaaaaaaaaaaggcaacauagcaaaaccuag

SEQ ID NO: 30273 - RNA, 64 nt, Homo Sapiens
aaaaaaaaaggaaaauaaaggucccuaaaauuaaaaaaaaaaaagggcaacauagcaaaaccua

SEQ ID NO: 30274 - RNA, 64 nt, Homo Sapiens
aaaaaaaaaaggaaaauaaaagucccuaaaauuaaaaaaaaaaaugggcaacauagcaaaaccu

SEQ ID NO: 30275 - RNA, 64 nt, Homo Sapiens
aaaaaaaaaaaggaaaauaauagucccuaaaauuaaaaaaaaaacugggcaacauagcaaaacc

SEQ ID NO: 30276 - RNA, 64 nt, Homo Sapiens
aaaaagaaaaagccgggugagucucucucggaaaaaaaaaaagagggcaacauggugaccuccc

SEQ ID NO: 30277 - RNA, 64 nt, Homo Sapiens
aaaaaagaaaaagccgggugcgucucucucggaaaaaaaaaaagugggcaacauggugaccucc

SEQ ID NO: 30278 - RNA, 64 nt, Homo Sapiens
gaaaaaagaaaaagccggguccgucucucucggaaaaaaaaaaacugggcaacauggugaccuc

SEQ ID NO: 30279 - RNA, 64 nt, Homo Sapiens
agaaaaaagaaaaagccgggcccgucucucucggaaaaaaaaaaccugggcaacauggugaccu

SEQ ID NO: 30280 - RNA, 64 nt, Homo Sapiens
aaacuugauugggauccaaaccgucuccaaaaaaaaaaaaaacacugggcgacaaaucaagacc

SEQ ID NO: 30281 - RNA, 64 nt, Homo Sapiens
aaaacuugauugggauccaacccgucuccaaaaaaaaaaaaaacccugggcgacaaaucaagac

SEQ ID NO: 30282 - RNA, 64 nt, Homo Sapiens
caaaacuugauugggauccaccccgucuccaaaaaaaaaaaaaagccugggcgacaaaucaaga

SEQ ID NO: 30283 - RNA, 64 nt, Homo Sapiens
acaaaacuugauugggauccaccccgucuccaaaaaaaaaaaaaagccugggcgacaaaucaag

SEQ ID NO: 30284 - RNA, 64 nt, Homo Sapiens
aacaaaacuugauugggaucgaccccgucuccaaaaaaaaaaaacagccugggcgacaaaucaa

SEQ ID NO: 30285 - RNA, 64 nt, Homo Sapiens
aaacaaaacuugauugggauagaccccgucuccaaaaaaaaaaaccagccugggcgacaaauca

SEQ ID NO: 30286 - RNA, 64 nt, Homo Sapiens
aaaacaaaacuugauugggaaagaccccgucuccaaaaaaaaaauccagccugggcgacaaauc

SEQ ID NO: 30287 - RNA, 64 nt, Homo Sapiens
cccaaaaugauuccaauagaccacuauuaaaaaaaaaaaaaaucgagugggagccugacagaca

SEQ ID NO: 30288 - RNA, 64 nt, Homo Sapiens
ccccaaaaugauuccaauagaccacuauuaaaaaaaaaaaaaauggagugggagccugacagac

SEQ ID NO: 30289 - RNA, 64 nt, Homo Sapiens
uccccaaaaugauuccaauacaccacuauuaaaaaaaaaaaaaaaggagugggagccugacaga

SEQ ID NO: 30290 - RNA, 64 nt, Homo Sapiens
auccccaaaaugauuccaauacaccacuauuaaaaaaaaaaaaauaggagugggagccugacag

SEQ ID NO: 30291 - RNA, 64 nt, Homo Sapiens
aauccccaaaaugauuccaagacaccacuauuaaaaaaaaaaaacuaggagugggagccugaca

SEQ ID NO: 30292 - RNA, 64 nt, Homo Sapiens
aaauccccaaaaugauuccaagacaccacuauuaaaaaaaaaaaucuaggagugggagccugac

SEQ ID NO: 30293 - RNA, 64 nt, Homo Sapiens
aaaauccccaaaaugauucccagacaccacuauuaaaaaaaaaagucuaggagugggagccuga

SEQ ID NO: 30294 - RNA, 64 nt, Homo Sapiens
acugguauuuauuugguuaaaugaagagaacaguaaaaaaaauucucuaucucuguacuccuau

SEQ ID NO: 30295 - RNA, 64 nt, Homo Sapiens
acaucaguauaggccaucaaacaauuaucuuuaaaaaaaaaaucaguaaguguggguagcaaaa

SEQ ID NO: 30296 - RNA, 64 nt, Homo Sapiens
cacaucaguauaggccaucaaacaauuaucuuuaaaaaaaaaauaaguaaguguggguagcaaa

SEQ ID NO: 30297 - RNA, 64 nt, Homo Sapiens
ucacaucaguauaggccaucaaacaauuaucuuuaaaaaaaaaacaaguaaguguggguagcaa

SEQ ID NO: 30298 - RNA, 64 nt, Homo Sapiens
uaguauagcacuacauucuuccuaaauuuucuuaaaaaaaaauccauacccuacuuuuucugua

SEQ ID NO: 30299 - RNA, 64 nt, Homo Sapiens
cuaguauagcacuacauucuaccuaaauuuucuuaaaaaaaaauucauacccuacuuuuucugu

SEQ ID NO: 30300 - RNA, 64 nt, Homo Sapiens
accaugaauuuguacugugcuaaaaaaaaauacaaaaaaaaagcucuuugcagaauuaucuuau

SEQ ID NO: 30301 - RNA, 64 nt, Homo Sapiens
caccaugaauuuguacuguguuaaaaaaaaauacaaaaaaaaaggucuuugcagaauuaucuua

SEQ ID NO: 30302 - RNA, 64 nt, Homo Sapiens
caaaaaaaaagcaccaugaagaauuaucuuauuaaaaaaaaauaagccgagagcugucuuugca

SEQ ID NO: 30303 - RNA, 64 nt, Homo Sapiens
acaaaaaaaaagcaccaugaagaauuaucuuauuaaaaaaaaauaagccgagagcugucuuugc

SEQ ID NO: 30304 - RNA, 64 nt, Homo Sapiens
gauuauauuaaaauuuaaagucuaugggcugguuaaaaaaaacaguauaugcuuauauauuaag

SEQ ID NO: 30305 - RNA, 64 nt, Homo Sapiens
caccacaguauuucuagcauaaaaaaaaaaaaaaaaaaaaaauguauuuucucgccaccaaaaa

SEQ ID NO: 30306 - RNA, 64 nt, Homo Sapiens
gcaccacaguauuucuagcaaaaaaaaaaaaaaaaaaaaaaaaucuauuuucucgccaccaaaa

SEQ ID NO: 30307 - RNA, 64 nt, Homo Sapiens
ugcaccacaguauuucuagcaaaaaaaaaaaaaaaaaaaaaaaaacuauuuucucgccaccaaa

SEQ ID NO: 30308 - RNA, 64 nt, Homo Sapiens
augcaccacaguauuucuagaaaaaaaaaaaaaaaaaaaaaaaauacuauuuucucgccaccaa

SEQ ID NO: 30309 - RNA, 64 nt, Homo Sapiens
aaugcaccacaguauuucuaaaaaaaaaaaaaaaaaaaaaaaaaguacuauuuucucgccacca

SEQ ID NO: 30310 - RNA, 64 nt, Homo Sapiens
aaaugcaccacaguauuucuaaaaaaaaaaaaaaaaaaaaaaaaaguacuauuuucucgccacc

SEQ ID NO: 30311 - RNA, 64 nt, Homo Sapiens
aaaaugcaccacaguauuuccaaaaaaaaaaaaaaaaaaaaaaacaguacuauuuucucgccac

SEQ ID NO: 30312 - RNA, 64 nt, Homo Sapiens
aaaaaugcaccacaguauuuccaaaaaaaaaaaaaaaaaaaaaaacaguacuauuuucucgcca

SEQ ID NO: 30313 - RNA, 64 nt, Homo Sapiens
aaaaaaugcaccacaguauuaccaaaaaaaaaaaaaaaaaaaaaaacaguacuauuuucucgcc

SEQ ID NO: 30314 - RNA, 64 nt, Homo Sapiens
aaaaaaaugcaccacaguaucaccaaaaaaaaaaaaaaaaaaaauaacaguacuauuuucucgc

SEQ ID NO: 30315 - RNA, 64 nt, Homo Sapiens
aaaaaaaaugcaccacaguaccaccaaaaaaaaaaaaaaaaaaauuaacaguacuauuuucucg

SEQ ID NO: 30316 - RNA, 64 nt, Homo Sapiens
aaaaaaaaaugcaccacagugccaccaaaaaaaaaaaaaaaaaacuuaacaguacuauuuucuc

SEQ ID NO: 30317 - RNA, 64 nt, Homo Sapiens
aaaaaaaaaaugcaccacagcgccaccaaaaaaaaaaaaaaaaaccuuaacaguacuauuuucu

SEQ ID NO: 30318 - RNA, 64 nt, Homo Sapiens
aaaaaaaaaaaugcaccacaucgccaccaaaaaaaaaaaaaaaagccuuaacaguacuauuuuc

SEQ ID NO: 30319 - RNA, 64 nt, Homo Sapiens
aaaaaaaaaaaaugcaccaccucgccaccaaaaaaaaaaaaaaaugccuuaacaguacuauuuu

SEQ ID NO: 30320 - RNA, 64 nt, Homo Sapiens
aaaaaaaaaaaaaugcaccaucucgccaccaaaaaaaaaaaaaauugccuuaacaguacuauuu

SEQ ID NO: 30321 - RNA, 64 nt, Homo Sapiens
aaaaaaaaaaaaaaugcaccuucucgccaccaaaaaaaaaaaaauuugccuuaacaguacuauu

SEQ ID NO: 30322 - RNA, 64 nt, Homo Sapiens
aaaaaaaaaaaaaaaugcacuuucucgccaccaaaaaaaaaaaaauuugccuuaacaguacuau

SEQ ID NO: 30323 - RNA, 64 nt, Homo Sapiens
aaaaaaaaaaaaaaaaugcauuuucucgccaccaaaaaaaaaaagauuugccuuaacaguacua

SEQ ID NO: 30324 - RNA, 64 nt, Homo Sapiens
aaaaaaaaaaaaaaaaaugcauuuucucgccaccaaaaaaaaaaagauuugccuuaacaguacu

SEQ ID NO: 30325 - RNA, 64 nt, Homo Sapiens
cguuccccuugguuaacugaaaacuacucuuuaaaaaaaaaauaacaccaguuaauacuuuuua

SEQ ID NO: 30326 - RNA, 64 nt, Homo Sapiens
acguuccccuugguuaacugaaaacuacucuuuaaaaaaaaaaugacaccaguuaauacuuuuu

SEQ ID NO: 30327 - RNA, 64 nt, Homo Sapiens
uacguuccccuugguuaacuuaaaacuacucuuuaaaaaaaaaaggacaccaguuaauacuuuu

SEQ ID NO: 30328 - RNA, 64 nt, Homo Sapiens
aagguuguuauggacuggacucucaaaaaaaaaaaaaaaaaagaggugacagagugagacucua

SEQ ID NO: 30329 - RNA, 64 nt, Homo Sapiens
aaagguuguuauggacuggaaucucaaaaaaaaaaaaaaaaaaggggugacagagugagacucu

SEQ ID NO: 30330 - RNA, 64 nt, Homo Sapiens
gaaagguuguuauggacugguaucucaaaaaaaaaaaaaaaaaaugggugacagagugagacuc

SEQ ID NO: 30331 - RNA, 64 nt, Homo Sapiens
agaaagguuguuauggacugcuaucucaaaaaaaaaaaaaaaaacugggugacagagugagacu

SEQ ID NO: 30332 - RNA, 64 nt, Homo Sapiens
aagaaagguuguuauggacuucuaucucaaaaaaaaaaaaaaaaccugggugacagagugagac

SEQ ID NO: 30333 - RNA, 64 nt, Homo Sapiens
aaagaaagguuguuauggaccucuaucucaaaaaaaaaaaaaaagccugggugacagagugaga

SEQ ID NO: 30334 - RNA, 64 nt, Homo Sapiens
aaaagaaagguuguuauggaacucuaucucaaaaaaaaaaaaaacgccugggugacagagugag

SEQ ID NO: 30335 - RNA, 64 nt, Homo Sapiens
aaaaagaaagguuguuaugggacucuaucucaaaaaaaaaaaaaccgccugggugacagaguga

SEQ ID NO: 30336 - RNA, 64 nt, Homo Sapiens
aaaaaagaaagguuguuaugagacucuaucucaaaaaaaaaaaacccgccugggugacagagug

SEQ ID NO: 30337 - RNA, 64 nt, Homo Sapiens
aaaaaaagaaagguuguuaugagacucuaucucaaaaaaaaaaaucccgccugggugacagagu

SEQ ID NO: 30338 - RNA, 64 nt, Homo Sapiens
aaaaaaaagaaagguuguuaugagacucuaucucaaaaaaaaaacucccgccugggugacagag

SEQ ID NO: 30339 - RNA, 64 nt, Homo Sapiens
aaagggcagucucaauacuuuuuuuaaggagagaaaaaaaaaucugaauguuucuaaaaaugcc

SEQ ID NO: 30340 - RNA, 64 nt, Homo Sapiens
caaagggcagucucaauacucuuuuuaaggagagaaaaaaaaauuugaauguuucuaaaaaugc

SEQ ID NO: 30341 - RNA, 64 nt, Homo Sapiens
agacaaagaaaaccuaaaguuaaaaauuaaauuaaaaaaaaagaacagaaaaagaaaaagaaaa

SEQ ID NO: 30342 - RNA, 64 nt, Homo Sapiens
aagacaaagaaaaccuaaagauaaaaauuaaauuaaaaaaaaagcacagaaaaagaaaaagaaa

SEQ ID NO: 30343 - RNA, 64 nt, Homo Sapiens
guuuuggaggaggggcaaaauccgacuaccagaaaaaaaaaauuagagagaaauucauaacaaa

SEQ ID NO: 30344 - RNA, 64 nt, Homo Sapiens
uguuuuggaggaggggcaaaauccgacuaccagaaaaaaaaaaugagagagaaauucauaacaa

SEQ ID NO: 30345 - RNA, 64 nt, Homo Sapiens
uuguuuuggaggaggggcaaaauccgacuaccagaaaaaaaaaaggagagagaaauucauaaca

SEQ ID NO: 30346 - RNA, 64 nt, Homo Sapiens
gcaaaagcaaaaguagcaacuaauugacuuggaaaaaaaaaacaaaugauaauagaaagcaccc

SEQ ID NO: 30347 - RNA, 64 nt, Homo Sapiens
agcaaaagcaaaaguagcaacuaauugacuuggaaaaaaaaaacgaaugauaauagaaagcacc

SEQ ID NO: 30348 - RNA, 64 nt, Homo Sapiens
cagcaaaagcaaaaguagcaccuaauugacuuggaaaaaaaaaaugaaugauaauagaaagcac

SEQ ID NO: 30349 - RNA, 64 nt, Homo Sapiens
guuuuuuuagaguagaguuaaaaaaaaaaaaaaaaaaaaaaauaagcuccaccgguaaaaaaaa

SEQ ID NO: 30350 - RNA, 64 nt, Homo Sapiens
aguuuuuuuagaguagaguuaaaaaaaaaaaaaaaaaaaaaaaucagcuccaccgguaaaaaaa

SEQ ID NO: 30351 - RNA, 64 nt, Homo Sapiens
uaguuuuuuuagaguagaguaaaaaaaaaaaaaaaaaaaaaaaaacagcuccaccgguaaaaaa

SEQ ID NO: 30352 - RNA, 64 nt, Homo Sapiens
auaguuuuuuuagaguagagaaaaaaaaaaaaaaaaaaaaaaaaaacagcuccaccgguaaaaa

SEQ ID NO: 30353 - RNA, 64 nt, Homo Sapiens
aauaguuuuuuuagaguagaaaaaaaaaaaaaaaaaaaaaaaaaaaacagcuccaccgguaaaa

SEQ ID NO: 30354 - RNA, 64 nt, Homo Sapiens
aaauaguuuuuuuagaguagaaaaaaaaaaaaaaaaaaaaaaaauaaacagcuccaccgguaaa

SEQ ID NO: 30355 - RNA, 64 nt, Homo Sapiens
aaaauaguuuuuuuagaguaaaaaaaaaaaaaaaaaaaaaaaaauuaaacagcuccaccgguaa

SEQ ID NO: 30356 - RNA, 64 nt, Homo Sapiens
aaaaauaguuuuuuuagaguaaaaaaaaaaaaaaaaaaaaaaaacuuaaacagcuccaccggua

SEQ ID NO: 30357 - RNA, 64 nt, Homo Sapiens
aaaaaauaguuuuuuuagagaaaaaaaaaaaaaaaaaaaaaaaagcuuaaacagcuccaccggu

SEQ ID NO: 30358 - RNA, 64 nt, Homo Sapiens
aaaaaaauaguuuuuuuagauaaaaaaaaaaaaaaaaaaaaaaaggcuuaaacagcuccaccgg

SEQ ID NO: 30359 - RNA, 64 nt, Homo Sapiens
aaaaaaaauaguuuuuuuagguaaaaaaaaaaaaaaaaaaaaaauggcuuaaacagcuccaccg

SEQ ID NO: 30360 - RNA, 64 nt, Homo Sapiens
aaaaaaaaauaguuuuuuuagguaaaaaaaaaaaaaaaaaaaaauuggcuuaaacagcuccacc

SEQ ID NO: 30361 - RNA, 64 nt, Homo Sapiens
aaaaaaaaaauaguuuuuuucgguaaaaaaaaaaaaaaaaaaaacuuggcuuaaacagcuccac

SEQ ID NO: 30362 - RNA, 64 nt, Homo Sapiens
aaaaaaaaaaauaguuuuuuccgguaaaaaaaaaaaaaaaaaaaccuuggcuuaaacagcucca

SEQ ID NO: 30363 - RNA, 64 nt, Homo Sapiens
aaaaaaaaaaaauaguuuuuaccgguaaaaaaaaaaaaaaaaaauccuuggcuuaaacagcucc

SEQ ID NO: 30364 - RNA, 64 nt, Homo Sapiens
aaaaaaaaaaaaauaguuuucaccgguaaaaaaaaaaaaaaaaacuccuuggcuuaaacagcuc

SEQ ID NO: 30365 - RNA, 64 nt, Homo Sapiens
aaaaaaaaaaaaaauaguuuccaccgguaaaaaaaaaaaaaaaaacuccuuggcuuaaacagcu

SEQ ID NO: 30366 - RNA, 64 nt, Homo Sapiens
aaaaaaaaaaaaaaauaguuuccaccgguaaaaaaaaaaaaaaaaacuccuuggcuuaaacagc

SEQ ID NO: 30367 - RNA, 64 nt, Homo Sapiens
aaaaaaaaaaaaaaaauagucuccaccgguaaaaaaaaaaaaaacaacuccuuggcuuaaacag

SEQ ID NO: 30368 - RNA, 64 nt, Homo Sapiens
aaaaaaaaaaaaaaaaauaggcuccaccgguaaaaaaaaaaaaaacaacuccuuggcuuaaaca

SEQ ID NO: 30369 - RNA, 64 nt, Homo Sapiens
aaaaaaaaaaaaaaaaaauaagcuccaccgguaaaaaaaaaaaacacaacuccuuggcuuaaac

SEQ ID NO: 30370 - RNA, 64 nt, Homo Sapiens
aaaaaaaaaaaaaaaaaaaucagcuccaccgguaaaaaaaaaaaccacaacuccuuggcuuaaa

SEQ ID NO: 30371 - RNA, 64 nt, Homo Sapiens
aaaaaaaaaaaaaaaaaaaaacagcuccaccgguaaaaaaaaaauccacaacuccuuggcuuaa

SEQ ID NO: 30372 - RNA, 64 nt, Homo Sapiens
aaaauugaagugcuauugcaggacaugcuaggggaaaaaaaagugcuggggagaaaaugcuuaa

SEQ ID NO: 30373 - RNA, 64 nt, Homo Sapiens
caaugaaaauuuagcaagccggcaugcuuuaaaaaaaaaaaagggaucuuuauuagauagcagu

SEQ ID NO: 30374 - RNA, 64 nt, Homo Sapiens
gcaaugaaaauuuagcaagcuggcaugcuuuaaaaaaaaaaaagugaucuuuauuagauagcag

SEQ ID NO: 30375 - RNA, 64 nt, Homo Sapiens
ggcaaugaaaauuuagcaagguggcaugcuuuaaaaaaaaaaaagugaucuuuauuagauagca

SEQ ID NO: 30376 - RNA, 64 nt, Homo Sapiens
aggcaaugaaaauuuagcaaaguggcaugcuuuaaaaaaaaaaaugugaucuuuauuagauagc

SEQ ID NO: 30377 - RNA, 64 nt, Homo Sapiens
aaggcaaugaaaauuuagcacaguggcaugcuuuaaaaaaaaaaaugugaucuuuauuagauag

SEQ ID NO: 30378 - RNA, 64 nt, Homo Sapiens
aaaaacaaaaaacaacucuacaaaaaaaaauuaaaaaaaaaacagacccaaguucuucccaucu

SEQ ID NO: 30379 - RNA, 64 nt, Homo Sapiens
aaaaaacaaaaaacaacucuucaaaaaaaaauuaaaaaaaaaacggacccaaguucuucccauc

SEQ ID NO: 30380 - RNA, 64 nt, Homo Sapiens
caaaaaacaaaaaacaacuccucaaaaaaaaauuaaaaaaaaaaaggacccaaguucuucccau

SEQ ID NO: 30381 - RNA, 64 nt, Homo Sapiens
aaaaaaaaaacaaaaaacaauucuucccaucucaaaaaaaaauuuggagcaaggaggacccaag

SEQ ID NO: 30382 - RNA, 64 nt, Homo Sapiens
uaaaaaaaaaacaaaaaacaguucuucccaucucaaaaaaaaauguggagcaaggaggacccaa

SEQ ID NO: 30383 - RNA, 64 nt, Homo Sapiens
auugcucuaucagcugacuuuucaggguauccuuaaaaaaaaacacacacgaaaaacaaaaguu

SEQ ID NO: 30384 - RNA, 64 nt, Homo Sapiens
uugcucuaucagcugacuuuucaggguauccuuaaaaaaaaacacacacgaaaaacaaaaguuu

SEQ ID NO: 30385 - RNA, 64 nt, Homo Sapiens
aggucacauauugugauuuccagcuguagcauucaaaaaaaaaauugguguucaugacucugug

SEQ ID NO: 30386 - RNA, 64 nt, Homo Sapiens
ggucacauauugugauuuccagcuguagcauucaaaaaaaaaauugguguucaugacucugugg

SEQ ID NO: 30387 - RNA, 64 nt, Homo Sapiens
gucacauauugugauuuccagcuguagcauucaaaaaaaaaauugguguucaugacucuguggu

SEQ ID NO: 30388 - RNA, 64 nt, Homo Sapiens
aaaaucaguacgaauguaucuccuugaaaaaugcaaaaaaaaaaaaaucccugaaauauucuuc

SEQ ID NO: 30389 - RNA, 64 nt, Homo Sapiens
aaaucaguacgaauguaucuccuugaaaaaugcaaaaaaaaaaaaaucccugaaauauucuucu

SEQ ID NO: 30390 - RNA, 64 nt, Homo Sapiens
aaucaguacgaauguaucuccuugaaaaaugcaaaaaaaaaaaaaucccugaaauauucuucua

SEQ ID NO: 30391 - RNA, 64 nt, Homo Sapiens
aucaguacgaauguaucuccuugaaaaaugcaaaaaaaaaaaaaucccugaaauauucuucuau

SEQ ID NO: 30392 - RNA, 64 nt, Homo Sapiens
ucaguacgaauguaucuccuugaaaaaugcaaaaaaaaaaaaaucccugaaauauucuucuaua

SEQ ID NO: 30393 - RNA, 64 nt, Homo Sapiens
caguacgaauguaucuccuugaaaaaugcaaaaaaaaaaaaaucccugaaauauucuucuauaa

SEQ ID NO: 30394 - RNA, 64 nt, Homo Sapiens
uauaauuaccuguaagguuaucugguuuuaaaagaaaaaaaaaaagccuacaaacucagugacc

SEQ ID NO: 30395 - RNA, 64 nt, Homo Sapiens
auaauuaccuguaagguuaucugguuuuaaaagaaaaaaaaaaagccuacaaacucagugaccu

SEQ ID NO: 30396 - RNA, 64 nt, Homo Sapiens
uaauuaccuguaagguuaucugguuuuaaaagaaaaaaaaaaagccuacaaacucagugaccua

SEQ ID NO: 30397 - RNA, 64 nt, Homo Sapiens
aauuaccuguaagguuaucugguuuuaaaagaaaaaaaaaaagccuacaaacucagugaccuac

SEQ ID NO: 30398 - RNA, 64 nt, Homo Sapiens
cuccagccugggugacagagcaagacucucucucaaaaaaaaaaaaaaaaaaaaauucuagacc

SEQ ID NO: 30399 - RNA, 64 nt, Homo Sapiens
uccagccugggugacagagcaagacucucucucaaaaaaaaaaaaaaaaaaaaauucuagaccg

SEQ ID NO: 30400 - RNA, 64 nt, Homo Sapiens
ccagccugggugacagagcaagacucucucucaaaaaaaaaaaaaaaaaaaaauucuagaccga

SEQ ID NO: 30401 - RNA, 64 nt, Homo Sapiens
cagccugggugacagagcaagacucucucucaaaaaaaaaaaaaaaaaaaaauucuagaccgaa

SEQ ID NO: 30402 - RNA, 64 nt, Homo Sapiens
agccugggugacagagcaagacucucucucaaaaaaaaaaaaaaaaaaaaauucuagaccgaag

SEQ ID NO: 30403 - RNA, 64 nt, Homo Sapiens
gccugggugacagagcaagacucucucucaaaaaaaaaaaaaaaaaaaaauucuagaccgaagu

SEQ ID NO: 30404 - RNA, 64 nt, Homo Sapiens
ccugggugacagagcaagacucucucucaaaaaaaaaaaaaaaaaaaaauucuagaccgaagug

SEQ ID NO: 30405 - RNA, 64 nt, Homo Sapiens
cugggugacagagcaagacucucucucaaaaaaaaaaaaaaaaaaaaauucuagaccgaagugu

SEQ ID NO: 30406 - RNA, 64 nt, Homo Sapiens
ugggugacagagcaagacucucucucaaaaaaaaaaaaaaaaaaaaauucuagaccgaagugua

SEQ ID NO: 30407 - RNA, 64 nt, Homo Sapiens
gggugacagagcaagacucucucucaaaaaaaaaaaaaaaaaaaaauucuagaccgaaguguac

SEQ ID NO: 30408 - RNA, 64 nt, Homo Sapiens
ggugacagagcaagacucucucucaaaaaaaaaaaaaaaaaaaaauucuagaccgaaguguacg

SEQ ID NO: 30409 - RNA, 64 nt, Homo Sapiens
gugacagagcaagacucucucucaaaaaaaaaaaaaaaaaaaaauucuagaccgaaguguacgg

SEQ ID NO: 30410 - RNA, 64 nt, Homo Sapiens
ugacagagcaagacucucucucaaaaaaaaaaaaaaaaaaaaauucuagaccgaaguguacggc

SEQ ID NO: 30411 - RNA, 64 nt, Homo Sapiens
gacagagcaagacucucucucaaaaaaaaaaaaaaaaaaaaauucuagaccgaaguguacggca

SEQ ID NO: 30412 - RNA, 64 nt, Homo Sapiens
uguuuuucagaaaaggguguguuuggaugaaaguaaaaaaaaaaauaaaaucuuucacugucuc

SEQ ID NO: 30413 - RNA, 64 nt, Homo Sapiens
guuuuucagaaaaggguguguuuggaugaaaguaaaaaaaaaaauaaaaucuuucacugucucu

SEQ ID NO: 30414 - RNA, 64 nt, Homo Sapiens
uuuuucagaaaaggguguguuuggaugaaaguaaaaaaaaaaauaaaaucuuucacugucucua

SEQ ID NO: 30415 - RNA, 64 nt, Homo Sapiens
uuuucagaaaaggguguguuuggaugaaaguaaaaaaaaaaauaaaaucuuucacugucucuaa

SEQ ID NO: 30416 - RNA, 64 nt, Homo Sapiens
cugcguugugugaaauguccaucuuaguuuuguuaaaaaaaaaaaaaaaaaaaggaaacagccu

SEQ ID NO: 30417 - RNA, 64 nt, Homo Sapiens
ugcguugugugaaauguccaucuuaguuuuguuaaaaaaaaaaaaaaaaaaaggaaacagccuc

SEQ ID NO: 30418 - RNA, 64 nt, Homo Sapiens
gcguugugugaaauguccaucuuaguuuuguuaaaaaaaaaaaaaaaaaaaggaaacagccuca

SEQ ID NO: 30419 - RNA, 64 nt, Homo Sapiens
cguugugugaaauguccaucuuaguuuuguuaaaaaaaaaaaaaaaaaaaggaaacagccucac

SEQ ID NO: 30420 - RNA, 64 nt, Homo Sapiens
guugugugaaauguccaucuuaguuuuguuaaaaaaaaaaaaaaaaaaaggaaacagccucacu

SEQ ID NO: 30421 - RNA, 64 nt, Homo Sapiens
uugugugaaauguccaucuuaguuuuguuaaaaaaaaaaaaaaaaaaaggaaacagccucacuu

SEQ ID NO: 30422 - RNA, 64 nt, Homo Sapiens
ugugugaaauguccaucuuaguuuuguuaaaaaaaaaaaaaaaaaaaggaaacagccucacuuu

SEQ ID NO: 30423 - RNA, 64 nt, Homo Sapiens
gugugaaauguccaucuuaguuuuguuaaaaaaaaaaaaaaaaaaaggaaacagccucacuuuu

SEQ ID NO: 30424 - RNA, 64 nt, Homo Sapiens
ugugaaauguccaucuuaguuuuguuaaaaaaaaaaaaaaaaaaaggaaacagccucacuuuuu

SEQ ID NO: 30425 - RNA, 64 nt, Homo Sapiens
gugaaauguccaucuuaguuuuguuaaaaaaaaaaaaaaaaaaaggaaacagccucacuuuuuu

SEQ ID NO: 30426 - RNA, 64 nt, Homo Sapiens
ugaaauguccaucuuaguuuuguuaaaaaaaaaaaaaaaaaaaggaaacagccucacuuuuuug

SEQ ID NO: 30427 - RNA, 64 nt, Homo Sapiens
gaaauguccaucuuaguuuuguuaaaaaaaaaaaaaaaaaaaggaaacagccucacuuuuuugu

SEQ ID NO: 30428 - RNA, 64 nt, Homo Sapiens
uuucuuguaauggcaccucaaauuuuauacucuuaaaaaaaaacaauaauuugugaauuaccac

SEQ ID NO: 30429 - RNA, 64 nt, Homo Sapiens
uucuuguaauggcaccucaaauuuuauacucuuaaaaaaaaacaauaauuugugaauuaccacc

SEQ ID NO: 30430 - RNA, 64 nt, Homo Sapiens
cggccugaguagcauagcaagacccugucucuacaaaaaaaacaaaaauuagcugggcauggug

SEQ ID NO: 30431 - RNA, 64 nt, Homo Sapiens
cacucuagccugggcaacggugagacccugccucaaaaaaaauaaaaauaaaaauaaaacacuu

SEQ ID NO: 30432 - RNA, 64 nt, Homo Sapiens
aauccucagcugacacauaauuugaauggugcagaaaaaaaaaaagaaaccguaauuuuauuau

SEQ ID NO: 30433 - RNA, 64 nt, Homo Sapiens
auccucagcugacacauaauuugaauggugcagaaaaaaaaaaagaaaccguaauuuuauuauu

SEQ ID NO: 30434 - RNA, 64 nt, Homo Sapiens
uccucagcugacacauaauuugaauggugcagaaaaaaaaaaagaaaccguaauuuuauuauua

SEQ ID NO: 30435 - RNA, 64 nt, Homo Sapiens
ccucagcugacacauaauuugaauggugcagaaaaaaaaaaagaaaccguaauuuuauuauuag

SEQ ID NO: 30436 - RNA, 64 nt, Homo Sapiens
cugaauagaaacaaaacuuuugaaugcuggauucaaaaaaaaaaaaaaguuaucuggacagcuu

SEQ ID NO: 30437 - RNA, 64 nt, Homo Sapiens
ugaauagaaacaaaacuuuugaaugcuggauucaaaaaaaaaaaaaaguuaucuggacagcuuc

SEQ ID NO: 30438 - RNA, 64 nt, Homo Sapiens
gaauagaaacaaaacuuuugaaugcuggauucaaaaaaaaaaaaaaguuaucuggacagcuucu

SEQ ID NO: 30439 - RNA, 64 nt, Homo Sapiens
aauagaaacaaaacuuuugaaugcuggauucaaaaaaaaaaaaaaguuaucuggacagcuucuu

SEQ ID NO: 30440 - RNA, 64 nt, Homo Sapiens
auagaaacaaaacuuuugaaugcuggauucaaaaaaaaaaaaaaguuaucuggacagcuucuuu

SEQ ID NO: 30441 - RNA, 64 nt, Homo Sapiens
uagaaacaaaacuuuugaaugcuggauucaaaaaaaaaaaaaaguuaucuggacagcuucuuug

SEQ ID NO: 30442 - RNA, 64 nt, Homo Sapiens
agaaacaaaacuuuugaaugcuggauucaaaaaaaaaaaaaaguuaucuggacagcuucuuuga

SEQ ID NO: 30443 - RNA, 64 nt, Homo Sapiens
uuugaguugauaguuauuaaaaagaaaacaaaacaaaaaaaaaaggcaaggcacaacaaaaaaa

SEQ ID NO: 30444 - RNA, 64 nt, Homo Sapiens
uugaguugauaguuauuaaaaagaaaacaaaacaaaaaaaaaaggcaaggcacaacaaaaaaau

SEQ ID NO: 30445 - RNA, 64 nt, Homo Sapiens
ugaguugauaguuauuaaaaagaaaacaaaacaaaaaaaaaaggcaaggcacaacaaaaaaaua

SEQ ID NO: 30446 - RNA, 64 nt, Homo Sapiens
aggcaaggcacaacaaaaaaauauccugggcaauaaaaaaaauauuuuaaaccagcuuuggagc

SEQ ID NO: 30447 - RNA, 64 nt, Homo Sapiens
gugagcuaugauugcaccacuguacuccugccuuaaaaaaaaaaaaaaaaucccaauaguccau

SEQ ID NO: 30448 - RNA, 64 nt, Homo Sapiens
ugagcuaugauugcaccacuguacuccugccuuaaaaaaaaaaaaaaaaucccaauaguccaug

SEQ ID NO: 30449 - RNA, 64 nt, Homo Sapiens
gagcuaugauugcaccacuguacuccugccuuaaaaaaaaaaaaaaaaucccaauaguccauga

SEQ ID NO: 30450 - RNA, 64 nt, Homo Sapiens
agcuaugauugcaccacuguacuccugccuuaaaaaaaaaaaaaaaaucccaauaguccaugaa

SEQ ID NO: 30451 - RNA, 64 nt, Homo Sapiens
gcuaugauugcaccacuguacuccugccuuaaaaaaaaaaaaaaaaucccaauaguccaugaag

SEQ ID NO: 30452 - RNA, 64 nt, Homo Sapiens
cuaugauugcaccacuguacuccugccuuaaaaaaaaaaaaaaaaucccaauaguccaugaagg

SEQ ID NO: 30453 - RNA, 64 nt, Homo Sapiens
uaugauugcaccacuguacuccugccuuaaaaaaaaaaaaaaaaucccaauaguccaugaaggc

SEQ ID NO: 30454 - RNA, 64 nt, Homo Sapiens
augauugcaccacuguacuccugccuuaaaaaaaaaaaaaaaaucccaauaguccaugaaggcu

SEQ ID NO: 30455 - RNA, 64 nt, Homo Sapiens
ugauugcaccacuguacuccugccuuaaaaaaaaaaaaaaaaucccaauaguccaugaaggcuu

SEQ ID NO: 30456 - RNA, 64 nt, Homo Sapiens
accccccaacuuuuuuagagacagccugucucuuaaaaaaaaaauuaauuugguagugagagcu

SEQ ID NO: 30457 - RNA, 64 nt, Homo Sapiens
ccccccaacuuuuuuagagacagccugucucuuaaaaaaaaaauuaauuugguagugagagcuu

SEQ ID NO: 30458 - RNA, 64 nt, Homo Sapiens
cccccaacuuuuuuagagacagccugucucuuaaaaaaaaaauuaauuugguagugagagcuug

SEQ ID NO: 30459 - RNA, 64 nt, Homo Sapiens
guuauuuaugcuugcugcacagacauauuagaagaaaaaaaaaagcuuuguauuauucuuccac

SEQ ID NO: 30460 - RNA, 64 nt, Homo Sapiens
uuauuuaugcuugcugcacagacauauuagaagaaaaaaaaaagcuuuguauuauucuuccaca

SEQ ID NO: 30461 - RNA, 64 nt, Homo Sapiens
uauuuaugcuugcugcacagacauauuagaagaaaaaaaaaagcuuuguauuauucuuccacau

SEQ ID NO: 30462 - RNA, 64 nt, Homo Sapiens
ugccuuauccaggaauaauugccccuuugcagagaaaaaaaaaaacuuaaaaaaagcacaugcc

SEQ ID NO: 30463 - RNA, 64 nt, Homo Sapiens
gccuuauccaggaauaauugccccuuugcagagaaaaaaaaaaacuuaaaaaaagcacaugccu

SEQ ID NO: 30464 - RNA, 64 nt, Homo Sapiens
ccuuauccaggaauaauugccccuuugcagagaaaaaaaaaaacuuaaaaaaagcacaugccua

SEQ ID NO: 30465 - RNA, 64 nt, Homo Sapiens
cuuauccaggaauaauugccccuuugcagagaaaaaaaaaaacuuaaaaaaagcacaugccuac

SEQ ID NO: 30466 - RNA, 64 nt, Homo Sapiens
cacuccauccugggugacagcaagaucuugucucaaaaaaaaaaaaaaaaaccaggagugaaaa

SEQ ID NO: 30467 - RNA, 64 nt, Homo Sapiens
acuccauccugggugacagcaagaucuugucucaaaaaaaaaaaaaaaaaccaggagugaaaaa

SEQ ID NO: 30468 - RNA, 64 nt, Homo Sapiens
cuccauccugggugacagcaagaucuugucucaaaaaaaaaaaaaaaaaccaggagugaaaaag

SEQ ID NO: 30469 - RNA, 64 nt, Homo Sapiens
uccauccugggugacagcaagaucuugucucaaaaaaaaaaaaaaaaaccaggagugaaaaagg

SEQ ID NO: 30470 - RNA, 64 nt, Homo Sapiens
ccauccugggugacagcaagaucuugucucaaaaaaaaaaaaaaaaaccaggagugaaaaagga

SEQ ID NO: 30471 - RNA, 64 nt, Homo Sapiens
cauccugggugacagcaagaucuugucucaaaaaaaaaaaaaaaaaccaggagugaaaaaggaa

SEQ ID NO: 30472 - RNA, 64 nt, Homo Sapiens
auccugggugacagcaagaucuugucucaaaaaaaaaaaaaaaaaccaggagugaaaaaggaaa

SEQ ID NO: 30473 - RNA, 64 nt, Homo Sapiens
uccugggugacagcaagaucuugucucaaaaaaaaaaaaaaaaaccaggagugaaaaaggaaag

SEQ ID NO: 30474 - RNA, 64 nt, Homo Sapiens
ccugggugacagcaagaucuugucucaaaaaaaaaaaaaaaaaccaggagugaaaaaggaaagu

SEQ ID NO: 30475 - RNA, 64 nt, Homo Sapiens
cugggugacagcaagaucuugucucaaaaaaaaaaaaaaaaaccaggagugaaaaaggaaagua

SEQ ID NO: 30476 - RNA, 64 nt, Homo Sapiens
ucuacuauucaguuccucaaacugaagcuuauugaaaaaaaaauguauaauguuauuuguuuua

SEQ ID NO: 30477 - RNA, 64 nt, Homo Sapiens
cuacuauucaguuccucaaacugaagcuuauugaaaaaaaaauguauaauguuauuuguuuuau

SEQ ID NO: 30478 - RNA, 64 nt, Homo Sapiens
ugcacauuuuuucauuucuuacuugucuaaaaguaaaaaaaaauaucagccugucuccuagguc

SEQ ID NO: 30479 - RNA, 64 nt, Homo Sapiens
gcacauuuuuucauuucuuacuugucuaaaaguaaaaaaaaauaucagccugucuccuagguca

SEQ ID NO: 30480 - RNA, 64 nt, Homo Sapiens
cugacuacuaaacagaagcagauagaaguggccgaaaaaaaaaugaauuuugagguauuuucuu

SEQ ID NO: 30481 - RNA, 64 nt, Homo Sapiens
ugacuacuaaacagaagcagauagaaguggccgaaaaaaaaaugaauuuugagguauuuucuuu

SEQ ID NO: 30482 - RNA, 64 nt, Homo Sapiens
cacuccagccucagcaauagagugagacugucucaaaaaaaaaaaaaaaaaaaaaaccugccaa

SEQ ID NO: 30483 - RNA, 64 nt, Homo Sapiens
acuccagccucagcaauagagugagacugucucaaaaaaaaaaaaaaaaaaaaaaccugccaau

SEQ ID NO: 30484 - RNA, 64 nt, Homo Sapiens
cuccagccucagcaauagagugagacugucucaaaaaaaaaaaaaaaaaaaaaaccugccaauu

SEQ ID NO: 30485 - RNA, 64 nt, Homo Sapiens
uccagccucagcaauagagugagacugucucaaaaaaaaaaaaaaaaaaaaaaccugccaauuu

SEQ ID NO: 30486 - RNA, 64 nt, Homo Sapiens
ccagccucagcaauagagugagacugucucaaaaaaaaaaaaaaaaaaaaaaccugccaauuuu

SEQ ID NO: 30487 - RNA, 64 nt, Homo Sapiens
cagccucagcaauagagugagacugucucaaaaaaaaaaaaaaaaaaaaaaccugccaauuuuc

SEQ ID NO: 30488 - RNA, 64 nt, Homo Sapiens
agccucagcaauagagugagacugucucaaaaaaaaaaaaaaaaaaaaaaccugccaauuuuca

SEQ ID NO: 30489 - RNA, 64 nt, Homo Sapiens
gccucagcaauagagugagacugucucaaaaaaaaaaaaaaaaaaaaaaccugccaauuuucaa

SEQ ID NO: 30490 - RNA, 64 nt, Homo Sapiens
ccucagcaauagagugagacugucucaaaaaaaaaaaaaaaaaaaaaaccugccaauuuucaaa

SEQ ID NO: 30491 - RNA, 64 nt, Homo Sapiens
cucagcaauagagugagacugucucaaaaaaaaaaaaaaaaaaaaaaccugccaauuuucaaac

SEQ ID NO: 30492 - RNA, 64 nt, Homo Sapiens
ucagcaauagagugagacugucucaaaaaaaaaaaaaaaaaaaaaaccugccaauuuucaaaca

SEQ ID NO: 30493 - RNA, 64 nt, Homo Sapiens
cagcaauagagugagacugucucaaaaaaaaaaaaaaaaaaaaaaccugccaauuuucaaacau

SEQ ID NO: 30494 - RNA, 64 nt, Homo Sapiens
agcaauagagugagacugucucaaaaaaaaaaaaaaaaaaaaaaccugccaauuuucaaacaua

SEQ ID NO: 30495 - RNA, 64 nt, Homo Sapiens
gcaauagagugagacugucucaaaaaaaaaaaaaaaaaaaaaaccugccaauuuucaaacauac

SEQ ID NO: 30496 - RNA, 64 nt, Homo Sapiens
caauagagugagacugucucaaaaaaaaaaaaaaaaaaaaaaccugccaauuuucaaacauacc

SEQ ID NO: 30497 - RNA, 64 nt, Homo Sapiens
auguaaacugcagccaccuuuagugauacuuuugaaaaaaaaaaauaaagggauauggcuguug

SEQ ID NO: 30498 - RNA, 64 nt, Homo Sapiens
uguaaacugcagccaccuuuagugauacuuuugaaaaaaaaaaauaaagggauauggcuguugu

SEQ ID NO: 30499 - RNA, 64 nt, Homo Sapiens
guaaacugcagccaccuuuagugauacuuuugaaaaaaaaaaauaaagggauauggcuguugua

SEQ ID NO: 30500 - RNA, 64 nt, Homo Sapiens
uaaacugcagccaccuuuagugauacuuuugaaaaaaaaaaauaaagggauauggcuguuguag

SEQ ID NO: 30501 - RNA, 64 nt, Homo Sapiens
uaguuuuauaagcuguucuguaacauaguguagcaaaaaaaaaaguucaagucauguuauacag

SEQ ID NO: 30502 - RNA, 64 nt, Homo Sapiens
aguuuuauaagcuguucuguaacauaguguagcaaaaaaaaaaguucaagucauguuauacagg

SEQ ID NO: 30503 - RNA, 64 nt, Homo Sapiens
guuuuauaagcuguucuguaacauaguguagcaaaaaaaaaaguucaagucauguuauacaggu

SEQ ID NO: 30504 - RNA, 64 nt, Homo Sapiens
aaucuuaagugaaaugggugcagcauuccuuuggaaaaaaaaaucuuuuuauuuucaagugaua

SEQ ID NO: 30505 - RNA, 64 nt, Homo Sapiens
aucuuaagugaaaugggugcagcauuccuuuggaaaaaaaaaucuuuuuauuuucaagugauaa

SEQ ID NO: 30506 - RNA, 64 nt, Homo Sapiens
uggggguuaagcugauguuaaaacaguuugcaauaaaaaaaaaugaaucagcuuaagucauuua

SEQ ID NO: 30507 - RNA, 64 nt, Homo Sapiens
ggggguuaagcugauguuaaaacaguuugcaauaaaaaaaaaugaaucagcuuaagucauuuaa

SEQ ID NO: 30508 - RNA, 64 nt, Homo Sapiens
ccugccugggcaacaagagugaaacuccaucuccaaaaaaaaaaagaaaaaguaacaaaaggaa

SEQ ID NO: 30509 - RNA, 64 nt, Homo Sapiens
cugccugggcaacaagagugaaacuccaucuccaaaaaaaaaaagaaaaaguaacaaaaggaaa

SEQ ID NO: 30510 - RNA, 64 nt, Homo Sapiens
ugccugggcaacaagagugaaacuccaucuccaaaaaaaaaaagaaaaaguaacaaaaggaaau

SEQ ID NO: 30511 - RNA, 64 nt, Homo Sapiens
gccugggcaacaagagugaaacuccaucuccaaaaaaaaaaagaaaaaguaacaaaaggaaauu

SEQ ID NO: 30512 - RNA, 64 nt, Homo Sapiens
agccugggugccacagcgagacccuaguuaagagaaaaaaaaaguaaaaacaaauuguggguca

SEQ ID NO: 30513 - RNA, 64 nt, Homo Sapiens
gccugggugccacagcgagacccuaguuaagagaaaaaaaaaguaaaaacaaauugugggucaa

SEQ ID NO: 30514 - RNA, 64 nt, Homo Sapiens
ggcaauguagugacaccucauuucuauuuauuuuaaaaaaaagagagaguaacuacagaagaac

SEQ ID NO: 30515 - RNA, 64 nt, Homo Sapiens
uccuguuccaaugaaaaaauuaaaaccugauacgaaaaaaaaaaaauuccaguuaaccuauuuu

SEQ ID NO: 30516 - RNA, 64 nt, Homo Sapiens
ccuguuccaaugaaaaaauuaaaaccugauacgaaaaaaaaaaaauuccaguuaaccuauuuug

SEQ ID NO: 30517 - RNA, 64 nt, Homo Sapiens
cuguuccaaugaaaaaauuaaaaccugauacgaaaaaaaaaaaauuccaguuaaccuauuuugu

SEQ ID NO: 30518 - RNA, 64 nt, Homo Sapiens
uguuccaaugaaaaaauuaaaaccugauacgaaaaaaaaaaaauuccaguuaaccuauuuugug

SEQ ID NO: 30519 - RNA, 64 nt, Homo Sapiens
guuccaaugaaaaaauuaaaaccugauacgaaaaaaaaaaaauuccaguuaaccuauuuugugu

SEQ ID NO: 30520 - RNA, 64 nt, Homo Sapiens
aguauuaagguuuucauguggaaaggugucauucaaaaaaaaaguaauuggcauacauauucca

SEQ ID NO: 30521 - RNA, 64 nt, Homo Sapiens
guauuaagguuuucauguggaaaggugucauucaaaaaaaaaguaauuggcauacauauuccac

SEQ ID NO: 30522 - RNA, 64 nt, Homo Sapiens
guuuacuuuuggggggguucccuuagaagacauuaaaaaaaaauacugccuuggucugugcagg

SEQ ID NO: 30523 - RNA, 64 nt, Homo Sapiens
uuuacuuuuggggggguucccuuagaagacauuaaaaaaaaauacugccuuggucugugcaggc

SEQ ID NO: 30524 - RNA, 63 nt, Homo Sapiens
uuuguuucacuaaacuuucuaaauaaaaacugagaaaaaaaaaaucacugaaaccaggugcuu

SEQ ID NO: 30525 - RNA, 62 nt, Homo Sapiens
uuguuucacuaaacuuucuaaauaaaaacugagaaaaaaaaaaucacugaaaccaggugcuu

SEQ ID NO: 30526 - RNA, 64 nt, Homo Sapiens
aucccgugcuuaaaaaaauaaaaaauaaaaaaauaaaaaaaaaauaagacuuuaacugcaguuc

SEQ ID NO: 30527 - RNA, 64 nt, Homo Sapiens
ucccgugcuuaaaaaaauaaaaaauaaaaaaauaaaaaaaaaauaagacuuuaacugcaguucc

SEQ ID NO: 30528 - RNA, 64 nt, Homo Sapiens
cccgugcuuaaaaaaauaaaaaauaaaaaaauaaaaaaaaaauaagacuuuaacugcaguucca

SEQ ID NO: 30529 - RNA, 64 nt, Homo Sapiens
ugcgcuuguacuauaugcuaaaauauggaaaaggaaaaaaaaaucucacaaguucuuuuggaac

SEQ ID NO: 30530 - RNA, 64 nt, Homo Sapiens
gcgcuuguacuauaugcuaaaauauggaaaaggaaaaaaaaaucucacaaguucuuuuggaacu

SEQ ID NO: 30531 - RNA, 64 nt, Homo Sapiens
cugggcaacagagggagacuccgucucaaaaacuaaaaaaaaaaaauacauuuaguauagcggg

SEQ ID NO: 30532 - RNA, 64 nt, Homo Sapiens
ugggcaacagagggagacuccgucucaaaaacuaaaaaaaaaaaauacauuuaguauagcgggg

SEQ ID NO: 30533 - RNA, 64 nt, Homo Sapiens
gggcaacagagggagacuccgucucaaaaacuaaaaaaaaaaaauacauuuaguauagcggggg

SEQ ID NO: 30534 - RNA, 64 nt, Homo Sapiens
ggcaacagagggagacuccgucucaaaaacuaaaaaaaaaaaauacauuuaguauagcgggggg

SEQ ID NO: 30535 - RNA, 64 nt, Homo Sapiens
gcaacagagggagacuccgucucaaaaacuaaaaaaaaaaaauacauuuaguauagcggggggu

SEQ ID NO: 30536 - RNA, 64 nt, Homo Sapiens
aagggcuuaggccaaaucuuacuuugaguauguuaaaaaaaaaaaaaugcugcuggcuuuucug

SEQ ID NO: 30537 - RNA, 64 nt, Homo Sapiens
agggcuuaggccaaaucuuacuuugaguauguuaaaaaaaaaaaaaugcugcuggcuuuucuga

SEQ ID NO: 30538 - RNA, 64 nt, Homo Sapiens
gggcuuaggccaaaucuuacuuugaguauguuaaaaaaaaaaaaaugcugcuggcuuuucugaa

SEQ ID NO: 30539 - RNA, 64 nt, Homo Sapiens
ggcuuaggccaaaucuuacuuugaguauguuaaaaaaaaaaaaaugcugcuggcuuuucugaag

SEQ ID NO: 30540 - RNA, 64 nt, Homo Sapiens
gcuuaggccaaaucuuacuuugaguauguuaaaaaaaaaaaaaugcugcuggcuuuucugaaga

SEQ ID NO: 30541 - RNA, 64 nt, Homo Sapiens
cuuaggccaaaucuuacuuugaguauguuaaaaaaaaaaaaaugcugcuggcuuuucugaagac

SEQ ID NO: 30542 - RNA, 64 nt, Homo Sapiens
ccguuuccuucuaacuaaugaaaaacugcuuacuaaaaaaaaauuuuauacuuuccuugcuaag

SEQ ID NO: 30543 - RNA, 64 nt, Homo Sapiens
cguuuccuucuaacuaaugaaaaacugcuuacuaaaaaaaaauuuuauacuuuccuugcuaagg

SEQ ID NO: 30544 - RNA, 64 nt, Homo Sapiens
ggaaccuauaguagaaaaggaaacuaguagggccaaaaaaaaaaagaaaaagaaaaagaaaaaa

SEQ ID NO: 30545 - RNA, 64 nt, Homo Sapiens
gaaccuauaguagaaaaggaaacuaguagggccaaaaaaaaaaagaaaaagaaaaagaaaaaag

SEQ ID NO: 30546 - RNA, 64 nt, Homo Sapiens
aaccuauaguagaaaaggaaacuaguagggccaaaaaaaaaaagaaaaagaaaaagaaaaaaga

SEQ ID NO: 30547 - RNA, 64 nt, Homo Sapiens
accuauaguagaaaaggaaacuaguagggccaaaaaaaaaaagaaaaagaaaaagaaaaaagaa

SEQ ID NO: 30548 - RNA, 64 nt, Homo Sapiens
gccaaaaaaaaaaagaaaaagaaaaagaaaaaagaaaaaaaaagaaaaaacugggaccuaagua

SEQ ID NO: 30549 - RNA, 64 nt, Homo Sapiens
ccaaaaaaaaaaagaaaaagaaaaagaaaaaagaaaaaaaaagaaaaaacugggaccuaaguau

SEQ ID NO: 30550 - RNA, 64 nt, Homo Sapiens
aaccccauuuuccuaaagaacaaaguaguaaaauaaaaaaaaauuuaaaaaauuaaaaaauaaa

SEQ ID NO: 30551 - RNA, 64 nt, Homo Sapiens
accccauuuuccuaaagaacaaaguaguaaaauaaaaaaaaauuuaaaaaauuaaaaaauaaaa

SEQ ID NO: 30552 - RNA, 64 nt, Homo Sapiens
guaaaauaaaaaaaaauuuaaaaaauuaaaaaauaaaaaaaagaggucacuaaaagaccaagau

SEQ ID NO: 30553 - RNA, 64 nt, Homo Sapiens
gcuugaaucugggaaacaagcucaaaaaacagugaaaaaaaaaguacugguuuaggaguucaaa

SEQ ID NO: 30554 - RNA, 64 nt, Homo Sapiens
cuugaaucugggaaacaagcucaaaaaacagugaaaaaaaaaguacugguuuaggaguucaaaa

SEQ ID NO: 30555 - RNA, 64 nt, Homo Sapiens
gcagacugguguuaaugaguauauguaacaguuuaaaaaaaaaguugguauuuuauaagcacag

SEQ ID NO: 30556 - RNA, 64 nt, Homo Sapiens
cagacugguguuaaugaguauauguaacaguuuaaaaaaaaaguugguauuuuauaagcacaga

SEQ ID NO: 30557 - RNA, 64 nt, Homo Sapiens
guaaaaaaauuguugucacagcaaccagcguuacaaaaaaaaaaaaaaaaaucacagguugcaa

SEQ ID NO: 30558 - RNA, 64 nt, Homo Sapiens
uaaaaaaauuguugucacagcaaccagcguuacaaaaaaaaaaaaaaaaaucacagguugcaaa

SEQ ID NO: 30559 - RNA, 64 nt, Homo Sapiens
aaaaaaauuguugucacagcaaccagcguuacaaaaaaaaaaaaaaaaaucacagguugcaaac

SEQ ID NO: 30560 - RNA, 64 nt, Homo Sapiens
aaaaaauuguugucacagcaaccagcguuacaaaaaaaaaaaaaaaaaucacagguugcaaacc

SEQ ID NO: 30561 - RNA, 64 nt, Homo Sapiens
aaaaauuguugucacagcaaccagcguuacaaaaaaaaaaaaaaaaaucacagguugcaaaccc

SEQ ID NO: 30562 - RNA, 64 nt, Homo Sapiens
aaaauuguugucacagcaaccagcguuacaaaaaaaaaaaaaaaaaucacagguugcaaacccu

SEQ ID NO: 30563 - RNA, 64 nt, Homo Sapiens
aaauuguugucacagcaaccagcguuacaaaaaaaaaaaaaaaaaucacagguugcaaacccug

SEQ ID NO: 30564 - RNA, 64 nt, Homo Sapiens
aauuguugucacagcaaccagcguuacaaaaaaaaaaaaaaaaaucacagguugcaaacccugg

SEQ ID NO: 30565 - RNA, 64 nt, Homo Sapiens
auuguugucacagcaaccagcguuacaaaaaaaaaaaaaaaaaucacagguugcaaacccuggu

SEQ ID NO: 30566 - RNA, 64 nt, Homo Sapiens
uuguugucacagcaaccagcguuacaaaaaaaaaaaaaaaaaucacagguugcaaacccuggua

SEQ ID NO: 30567 - RNA, 64 nt, Homo Sapiens
aucaguguuuaguauguuguucuaaccaguccagaaaaaaaaauaagcuguuugaauuacaucu

SEQ ID NO: 30568 - RNA, 64 nt, Homo Sapiens
ucaguguuuaguauguuguucuaaccaguccagaaaaaaaaauaagcuguuugaauuacaucug

SEQ ID NO: 30569 - RNA, 64 nt, Homo Sapiens
uuaaguuaauacagguuucaauuguggcauuaggaaaaaaaaaaaccuugugaugcuaugguug

SEQ ID NO: 30570 - RNA, 64 nt, Homo Sapiens
uaaguuaauacagguuucaauuguggcauuaggaaaaaaaaaaaccuugugaugcuaugguugg

SEQ ID NO: 30571 - RNA, 64 nt, Homo Sapiens
aaguuaauacagguuucaauuguggcauuaggaaaaaaaaaaaccuugugaugcuaugguuggg

SEQ ID NO: 30572 - RNA, 64 nt, Homo Sapiens
aguuaauacagguuucaauuguggcauuaggaaaaaaaaaaaccuugugaugcuaugguugggg

SEQ ID NO: 30573 - RNA, 64 nt, Homo Sapiens
caaagaucacuacagaccaaaacagaagaagaagaaaaaaaagaaaaagaaaucuaagcaacau

SEQ ID NO: 30574 - RNA, 64 nt, Homo Sapiens
uuugauccugaguaugcuugguguuugccuucagaaaaaaaaaaauacauuguaaauaaccuca

SEQ ID NO: 30575 - RNA, 64 nt, Homo Sapiens
uugauccugaguaugcuugguguuugccuucagaaaaaaaaaaauacauuguaaauaaccucag

SEQ ID NO: 30576 - RNA, 64 nt, Homo Sapiens
ugauccugaguaugcuugguguuugccuucagaaaaaaaaaaauacauuguaaauaaccucagc

SEQ ID NO: 30577 - RNA, 64 nt, Homo Sapiens
gauccugaguaugcuugguguuugccuucagaaaaaaaaaaauacauuguaaauaaccucagcu

SEQ ID NO: 30578 - RNA, 64 nt, Homo Sapiens
uaaaacuacuuuguugaaacaucaaccugggcagaaaaaaaaaaaaaaagacauguaaaauuuu

SEQ ID NO: 30579 - RNA, 64 nt, Homo Sapiens
aaaacuacuuuguugaaacaucaaccugggcagaaaaaaaaaaaaaaagacauguaaaauuuug

SEQ ID NO: 30580 - RNA, 64 nt, Homo Sapiens
aaacuacuuuguugaaacaucaaccugggcagaaaaaaaaaaaaaaagacauguaaaauuuugu

SEQ ID NO: 30581 - RNA, 64 nt, Homo Sapiens
aacuacuuuguugaaacaucaaccugggcagaaaaaaaaaaaaaaagacauguaaaauuuuguu

SEQ ID NO: 30582 - RNA, 64 nt, Homo Sapiens
acuacuuuguugaaacaucaaccugggcagaaaaaaaaaaaaaaagacauguaaaauuuuguua

SEQ ID NO: 30583 - RNA, 64 nt, Homo Sapiens
cuacuuuguugaaacaucaaccugggcagaaaaaaaaaaaaaaagacauguaaaauuuuguuau

SEQ ID NO: 30584 - RNA, 64 nt, Homo Sapiens
uacuuuguugaaacaucaaccugggcagaaaaaaaaaaaaaaagacauguaaaauuuuguuauu

SEQ ID NO: 30585 - RNA, 64 nt, Homo Sapiens
acuuuguugaaacaucaaccugggcagaaaaaaaaaaaaaaagacauguaaaauuuuguuauuu

SEQ ID NO: 30586 - RNA, 64 nt, Homo Sapiens
cagucuguauaugaaaaaauaggucaucaaaaggaaaaaaaauaacuuugauuaacuaguguua

SEQ ID NO: 30587 - RNA, 64 nt, Homo Sapiens
gacaacauggugaaacccgucucuacuaauuuacaaaaaaaauuagccagguguguuggcacau

SEQ ID NO: 30588 - RNA, 64 nt, Homo Sapiens
ugcagccugggcaacagaaugagacugugucuucaaaaaaaaaaagcacugucaugcagggcag

SEQ ID NO: 30589 - RNA, 64 nt, Homo Sapiens
gcagccugggcaacagaaugagacugugucuucaaaaaaaaaaagcacugucaugcagggcagg

SEQ ID NO: 30590 - RNA, 64 nt, Homo Sapiens
cagccugggcaacagaaugagacugugucuucaaaaaaaaaaagcacugucaugcagggcaggg

SEQ ID NO: 30591 - RNA, 64 nt, Homo Sapiens
agccugggcaacagaaugagacugugucuucaaaaaaaaaaagcacugucaugcagggcagggu

SEQ ID NO: 30592 - RNA, 64 nt, Homo Sapiens
uuaggaauagucuguuaccacagcauaagcugguaaaaaaaaaaaaaaaaaucauacagcucuu

SEQ ID NO: 30593 - RNA, 64 nt, Homo Sapiens
uaggaauagucuguuaccacagcauaagcugguaaaaaaaaaaaaaaaaaucauacagcucuuc

SEQ ID NO: 30594 - RNA, 64 nt, Homo Sapiens
aggaauagucuguuaccacagcauaagcugguaaaaaaaaaaaaaaaaaucauacagcucuucu

SEQ ID NO: 30595 - RNA, 64 nt, Homo Sapiens
ggaauagucuguuaccacagcauaagcugguaaaaaaaaaaaaaaaaaucauacagcucuucuu

SEQ ID NO: 30596 - RNA, 64 nt, Homo Sapiens
gaauagucuguuaccacagcauaagcugguaaaaaaaaaaaaaaaaaucauacagcucuucuuc

SEQ ID NO: 30597 - RNA, 64 nt, Homo Sapiens
aauagucuguuaccacagcauaagcugguaaaaaaaaaaaaaaaaaucauacagcucuucuucc

SEQ ID NO: 30598 - RNA, 64 nt, Homo Sapiens
auagucuguuaccacagcauaagcugguaaaaaaaaaaaaaaaaaucauacagcucuucuuccc

SEQ ID NO: 30599 - RNA, 64 nt, Homo Sapiens
uagucuguuaccacagcauaagcugguaaaaaaaaaaaaaaaaaucauacagcucuucuucccg

SEQ ID NO: 30600 - RNA, 64 nt, Homo Sapiens
agucuguuaccacagcauaagcugguaaaaaaaaaaaaaaaaaucauacagcucuucuucccgg

SEQ ID NO: 30601 - RNA, 64 nt, Homo Sapiens
gucuguuaccacagcauaagcugguaaaaaaaaaaaaaaaaaucauacagcucuucuucccgga

SEQ ID NO: 30602 - RNA, 64 nt, Homo Sapiens
auaagucuuaccucuuguauaagcauguuguacuaaaaaaaaauuuugaaacauuuuguauauu

SEQ ID NO: 30603 - RNA, 64 nt, Homo Sapiens
uaagucuuaccucuuguauaagcauguuguacuaaaaaaaaauuuugaaacauuuuguauauug

SEQ ID NO: 30604 - RNA, 64 nt, Homo Sapiens
uuguuaauagaacaaaaucacaagacucuaucuaaaaaaaaagccuccagccugggcgacagag

SEQ ID NO: 30605 - RNA, 64 nt, Homo Sapiens
cuuguuaauagaacaaaaucgcaagacucuaucuaaaaaaaaagacuccagccugggcgacaga

SEQ ID NO: 30606 - RNA, 64 nt, Homo Sapiens
gaauuuugaaucuccuuuccccgucucaaacagaaaaaaaaagacugggcagcagagcgagacu

SEQ ID NO: 30607 - RNA, 64 nt, Homo Sapiens
agaauuuugaaucuccuuucuccgucucaaacagaaaaaaaaagccugggcagcagagcgagac

SEQ ID NO: 30608 - RNA, 64 nt, Homo Sapiens
auaugcacagucugaauguauucaagaaaaaaaaaaaaaaaagacaacaagagugaaacuccau

SEQ ID NO: 30609 - RNA, 64 nt, Homo Sapiens
aauaugcacagucugaauguuuucaagaaaaaaaaaaaaaaaaggcaacaagagugaaacucca

SEQ ID NO: 30610 - RNA, 64 nt, Homo Sapiens
gaauaugcacagucugaaugauuucaagaaaaaaaaaaaaaaaaugcaacaagagugaaacucc

SEQ ID NO: 30611 - RNA, 64 nt, Homo Sapiens
agaauaugcacagucugaaucauuucaagaaaaaaaaaaaaaaagugcaacaagagugaaacuc

SEQ ID NO: 30612 - RNA, 64 nt, Homo Sapiens
aagaauaugcacagucugaaccauuucaagaaaaaaaaaaaaaaugugcaacaagagugaaacu

SEQ ID NO: 30613 - RNA, 64 nt, Homo Sapiens
aaagaauaugcacagucugauccauuucaagaaaaaaaaaaaaacugugcaacaagagugaaac

SEQ ID NO: 30614 - RNA, 64 nt, Homo Sapiens
aaaagaauaugcacagucugcuccauuucaagaaaaaaaaaaaaccugugcaacaagagugaaa

SEQ ID NO: 30615 - RNA, 64 nt, Homo Sapiens
aaaaagaauaugcacagucuacuccauuucaagaaaaaaaaaaagccugugcaacaagagugaa

SEQ ID NO: 30616 - RNA, 64 nt, Homo Sapiens
aaaaaagaauaugcacagucaacuccauuucaagaaaaaaaaaaagccugugcaacaagaguga

SEQ ID NO: 30617 - RNA, 64 nt, Homo Sapiens
acacaaagaggaaaacuagaugugcuuuuuuaaaaaaaaaaauaagaauucuucauuuuucauu

SEQ ID NO: 30618 - RNA, 64 nt, Homo Sapiens
aacacaaagaggaaaacuaguugugcuuuuuuaaaaaaaaaaauaagaauucuucauuuuucau

SEQ ID NO: 30619 - RNA, 64 nt, Homo Sapiens
uaacacaaagaggaaaacuauuugugcuuuuuuaaaaaaaaaaaaaagaauucuucauuuuuca

SEQ ID NO: 30620 - RNA, 64 nt, Homo Sapiens
auaacacaaagaggaaaacuauuugugcuuuuuuaaaaaaaaaagaaagaauucuucauuuuuc

SEQ ID NO: 30621 - RNA, 64 nt, Homo Sapiens
uuuuuaccuuacaccaagugcacuccaaaagaaaaaaaaaaaguggagaaggaggaguuaucuc

SEQ ID NO: 30622 - RNA, 64 nt, Homo Sapiens
uuuuuuaccuuacaccaaguccacuccaaaagaaaaaaaaaaaguggagaaggaggaguuaucu

SEQ ID NO: 30623 - RNA, 64 nt, Homo Sapiens
guuuuuuaccuuacaccaaguccacuccaaaagaaaaaaaaaaaguggagaaggaggaguuauc

SEQ ID NO: 30624 - RNA, 64 nt, Homo Sapiens
aguuuuuuaccuuacaccaacuccacuccaaaagaaaaaaaaaagguggagaaggaggaguuau

SEQ ID NO: 30625 - RNA, 64 nt, Homo Sapiens
auuaauaagucacaaccccucaccaccacuacaaaaaaaaaagacaccaacaccgccacaccaa

SEQ ID NO: 30626 - RNA, 64 nt, Homo Sapiens
aauuaauaagucacaaccccacaccaccacuacaaaaaaaaaagccaccaacaccgccacacca

SEQ ID NO: 30627 - RNA, 64 nt, Homo Sapiens
gaauuaauaagucacaacccaacaccaccacuacaaaaaaaaaaaccaccaacaccgccacacc

SEQ ID NO: 30628 - RNA, 64 nt, Homo Sapiens
cauaguauaaacccauuaagauguguuuguuuuaaaaaaaaaugguaauuuauaguuugacaug

SEQ ID NO: 30629 - RNA, 64 nt, Homo Sapiens
gcauaguauaaacccauuaagauguguuuguuuuaaaaaaaaauuguaauuuauaguuugacau

SEQ ID NO: 30630 - RNA, 64 nt, Homo Sapiens
uauguguauucuuauucaaacugugcaaaaaaaaaaaaaaaauucuugacuggaauauguaaga

SEQ ID NO: 30631 - RNA, 64 nt, Homo Sapiens
uuauguguauucuuauucaaacugugcaaaaaaaaaaaaaaaauccuugacuggaauauguaag

SEQ ID NO: 30632 - RNA, 64 nt, Homo Sapiens
uuuauguguauucuuauucagacugugcaaaaaaaaaaaaaaaaaccuugacuggaauauguaa

SEQ ID NO: 30633 - RNA, 64 nt, Homo Sapiens
auuuauguguauucuuauucagacugugcaaaaaaaaaaaaaaagaccuugacuggaauaugua

SEQ ID NO: 30634 - RNA, 64 nt, Homo Sapiens
aauuuauguguauucuuauuaagacugugcaaaaaaaaaaaaaaagaccuugacuggaauaugu

SEQ ID NO: 30635 - RNA, 64 nt, Homo Sapiens
aaauuuauguguauucuuauuaagacugugcaaaaaaaaaaaaauagaccuugacuggaauaug

SEQ ID NO: 30636 - RNA, 64 nt, Homo Sapiens
aaaauuuauguguauucuuaguaagacugugcaaaaaaaaaaaaauagaccuugacuggaauau

SEQ ID NO: 30637 - RNA, 64 nt, Homo Sapiens
aaaaauuuauguguauucuuuguaagacugugcaaaaaaaaaaacauagaccuugacuggaaua

SEQ ID NO: 30638 - RNA, 64 nt, Homo Sapiens
aaaaaauuuauguguauucuauguaagacugugcaaaaaaaaaaucauagaccuugacuggaau

SEQ ID NO: 30639 - RNA, 64 nt, Homo Sapiens
uugacuagaaauagaucaugugagaaaaaaaaccaaaaaaaauuacuggauuuggaaagaauau

SEQ ID NO: 30640 - RNA, 64 nt, Homo Sapiens
aaaaaaaauuuugacuagaagaaagaauauugagaaaaaaaacccuacugagagacuggauuug

SEQ ID NO: 30641 - RNA, 64 nt, Homo Sapiens
cauucagguuaaauuuggccuuaauaaaaagaaaaaaaaaaacggaccguuccuaucucagauc

SEQ ID NO: 30642 - RNA, 64 nt, Homo Sapiens
gcauucagguuaaauuuggccuuaauaaaaagaaaaaaaaaaacugaccguuccuaucucagau

SEQ ID NO: 30643 - RNA, 64 nt, Homo Sapiens
cgcauucagguuaaauuuggucuuaauaaaaagaaaaaaaaaaaaugaccguuccuaucucaga

SEQ ID NO: 30644 - RNA, 64 nt, Homo Sapiens
acgcauucagguuaaauuugaucuuaauaaaaagaaaaaaaaaauaugaccguuccuaucucag

SEQ ID NO: 30645 - RNA, 64 nt, Homo Sapiens
ucacuuuuaacucucugccugccacaccuguaaaaaaaaaaaccuucuuuguaauaaguauuuu

SEQ ID NO: 30646 - RNA, 64 nt, Homo Sapiens
cucacuuuuaacucucugccugccacaccuguaaaaaaaaaaacuuucuuuguaauaaguauuu

SEQ ID NO: 30647 - RNA, 64 nt, Homo Sapiens
ccucacuuuuaacucucugcuugccacaccuguaaaaaaaaaaacuuucuuuguaauaaguauu

SEQ ID NO: 30648 - RNA, 64 nt, Homo Sapiens
accucacuuuuaacucucuguuugccacaccuguaaaaaaaaaagcuuucuuuguaauaaguau

SEQ ID NO: 30649 - RNA, 64 nt, Homo Sapiens
cugugacaaaacggugcauuugaauauauuuaaaaaaaaaaaguaagaucuuucugguaauccg

SEQ ID NO: 30650 - RNA, 64 nt, Homo Sapiens
ucugugacaaaacggugcaugugaauauauuuaaaaaaaaaaagcaagaucuuucugguaaucc

SEQ ID NO: 30651 - RNA, 64 nt, Homo Sapiens
gucugugacaaaacggugcacgugaauauauuuaaaaaaaaaaaucaagaucuuucugguaauc

SEQ ID NO: 30652 - RNA, 64 nt, Homo Sapiens
agucugugacaaaacggugcccgugaauauauuuaaaaaaaaaauucaagaucuuucugguaau

SEQ ID NO: 30653 - RNA, 64 nt, Homo Sapiens
cucccucagaaaguacugaguagaugaugaagagaaaaaaaaguugagaagcuugaaugggcag

SEQ ID NO: 30654 - RNA, 64 nt, Homo Sapiens
guuuuucccaccuugucgcucacacaccuugcaaaaaaaaaauuuggaaacacacacagacaca

SEQ ID NO: 30655 - RNA, 64 nt, Homo Sapiens
uguuuuucccaccuugucgcacacacaccuugcaaaaaaaaaauauggaaacacacacagacac

SEQ ID NO: 30656 - RNA, 64 nt, Homo Sapiens
uuguuuuucccaccuugucgcacacacaccuugcaaaaaaaaaaaauggaaacacacacagaca

SEQ ID NO: 30657 - RNA, 64 nt, Homo Sapiens
aacaaaagaaaaugcacucuucugcauguuuaaaaaaaaaaagccuauccagauuuuuuauaug

SEQ ID NO: 30658 - RNA, 64 nt, Homo Sapiens
caacaaaagaaaaugcacucgucugcauguuuaaaaaaaaaaaggcuauccagauuuuuuauau

SEQ ID NO: 30659 - RNA, 64 nt, Homo Sapiens
gcaacaaaagaaaaugcacuugucugcauguuuaaaaaaaaaaaugcuauccagauuuuuuaua

SEQ ID NO: 30660 - RNA, 64 nt, Homo Sapiens
agcaacaaaagaaaaugcacaugucugcauguuuaaaaaaaaaagugcuauccagauuuuuuau

SEQ ID NO: 30661 - RNA, 62 nt, Homo Sapiens
ucauccagggcuuggugcuuucuuuuccaaauaaaaaaaaaaccucuggauacagaaccccu

SEQ ID NO: 30662 - RNA, 63 nt, Homo Sapiens
ucauccagggcuuggugcuuuucuuuuccaaauaaaaaaaaaacccucuggauacagaacccc

SEQ ID NO: 30663 - RNA, 64 nt, Homo Sapiens
ucauccagggcuuggugcuucuucuuuuccaaauaaaaaaaaaaccccucuggauacagaaccc

SEQ ID NO: 30664 - RNA, 64 nt, Homo Sapiens
gucuuuguuuaaaauuacuuguguugcaaaaaaaaaaaaaaaguauuucacugugauguauauu

SEQ ID NO: 30665 - RNA, 64 nt, Homo Sapiens
ugucuuuguuuaaaauuacuuguguugcaaaaaaaaaaaaaaagcauuucacugugauguauau

SEQ ID NO: 30666 - RNA, 64 nt, Homo Sapiens
gugucuuuguuuaaaauuacuuguguugcaaaaaaaaaaaaaaaacauuucacugugauguaua

SEQ ID NO: 30667 - RNA, 64 nt, Homo Sapiens
agugucuuuguuuaaaauuaauuguguugcaaaaaaaaaaaaaacacauuucacugugauguau

SEQ ID NO: 30668 - RNA, 64 nt, Homo Sapiens
aagugucuuuguuuaaaauuuauuguguugcaaaaaaaaaaaaaacacauuucacugugaugua

SEQ ID NO: 30669 - RNA, 64 nt, Homo Sapiens
aaagugucuuuguuuaaaauauauuguguugcaaaaaaaaaaaauacacauuucacugugaugu

SEQ ID NO: 30670 - RNA, 64 nt, Homo Sapiens
aaaagugucuuuguuuaaaauauauuguguugcaaaaaaaaaaauuacacauuucacugugaug

SEQ ID NO: 30671 - RNA, 64 nt, Homo Sapiens
aaaaagugucuuuguuuaaaguauauuguguugcaaaaaaaaaaauuacacauuucacugugau

SEQ ID NO: 30672 - RNA, 64 nt, Homo Sapiens
aagaaagagggaaaaagagcauagaaaaaaagaaaaaaaaaagacucuguaggaucguaaaaaa

SEQ ID NO: 30673 - RNA, 64 nt, Homo Sapiens
aaagaaagagggaaaaagagaauagaaaaaaagaaaaaaaaaagucucuguaggaucguaaaaa

SEQ ID NO: 30674 - RNA, 64 nt, Homo Sapiens
gaaagaaagagggaaaaagaaaauagaaaaaaagaaaaaaaaaaaucucuguaggaucguaaaa

SEQ ID NO: 30675 - RNA, 64 nt, Homo Sapiens
uuuagaggauuaugcuuguuguaaggaaauuuaaaaaaaaaacaugucuagaagaaauaacacu

SEQ ID NO: 30676 - RNA, 64 nt, Homo Sapiens
auuuagaggauuaugcuuguuguaaggaaauuuaaaaaaaaaacuugucuagaagaaauaacac

SEQ ID NO: 30677 - RNA, 64 nt, Homo Sapiens
cauuuagaggauuaugcuugcuguaaggaaauuuaaaaaaaaaaguugucuagaagaaauaaca

SEQ ID NO: 30678 - RNA, 64 nt, Homo Sapiens
ccuuuuguaauguuugaaaaaauuggcagucaaaaaaaaaaauagcccauaccauagaagaaag

SEQ ID NO: 30679 - RNA, 64 nt, Homo Sapiens
accuuuuguaauguuugaaagaauuggcagucaaaaaaaaaaauggcccauaccauagaagaaa

SEQ ID NO: 30680 - RNA, 64 nt, Homo Sapiens
uaccuuuuguaauguuugaaagaauuggcagucaaaaaaaaaaauggcccauaccauagaagaa

SEQ ID NO: 30681 - RNA, 64 nt, Homo Sapiens
auaccuuuuguaauguuugaaagaauuggcagucaaaaaaaaaauuggcccauaccauagaaga

SEQ ID NO: 30682 - RNA, 64 nt, Homo Sapiens
ugagcuaaaacucauuuuucggcuaggccucuuaaaaaaaaauuuuaacaggauaacuugagca

SEQ ID NO: 30683 - RNA, 64 nt, Homo Sapiens
uugagcuaaaacucauuuuuaggcuaggccucuuaaaaaaaaauuuuaacaggauaacuugagc

SEQ ID NO: 30684 - RNA, 64 nt, Homo Sapiens
aagagggagauaaaucccauaccaggggcaaaaaaaaaaaaagccaucccagguucugacuuuu

SEQ ID NO: 30685 - RNA, 64 nt, Homo Sapiens
caagagggagauaaaucccauaccaggggcaaaaaaaaaaaaagucaucccagguucugacuuu

SEQ ID NO: 30686 - RNA, 64 nt, Homo Sapiens
gcaagagggagauaaaucccuuaccaggggcaaaaaaaaaaaaagucaucccagguucugacuu

SEQ ID NO: 30687 - RNA, 64 nt, Homo Sapiens
agcaagagggagauaaauccuuuaccaggggcaaaaaaaaaaaaggucaucccagguucugacu

SEQ ID NO: 30688 - RNA, 64 nt, Homo Sapiens
aagcaagagggagauaaaucuuuuaccaggggcaaaaaaaaaaauggucaucccagguucugac

SEQ ID NO: 30689 - RNA, 64 nt, Homo Sapiens
aaagcaagagggagauaaaucuuuuaccaggggcaaaaaaaaaacuggucaucccagguucuga

SEQ ID NO: 30690 - RNA, 64 nt, Homo Sapiens
uauguggaauucugucucuuuaacuuaguaaaaaaaaaaaaaugugaugggguuuuuuuuuuua

SEQ ID NO: 30691 - RNA, 64 nt, Homo Sapiens
guauguggaauucugucucuauaacuuaguaaaaaaaaaaaaaugugaugggguuuuuuuuuuu

SEQ ID NO: 30692 - RNA, 64 nt, Homo Sapiens
uguauguggaauucugucucuauaacuuaguaaaaaaaaaaaaaggugaugggguuuuuuuuuu

SEQ ID NO: 30693 - RNA, 64 nt, Homo Sapiens
auguauguggaauucugucuuuauaacuuaguaaaaaaaaaaaauggugaugggguuuuuuuuu

SEQ ID NO: 30694 - RNA, 64 nt, Homo Sapiens
aauguauguggaauucugucuuuauaacuuaguaaaaaaaaaaauuggugaugggguuuuuuuu

SEQ ID NO: 30695 - RNA, 64 nt, Homo Sapiens
aaauguauguggaauucuguuuuuauaacuuaguaaaaaaaaaauuuggugaugggguuuuuuu

SEQ ID NO: 30696 - RNA, 64 nt, Homo Sapiens
guuucuggcugaugggugacaaaaaaaaaaaaaaaaaaaaaagagaauuuacuuuucuuaaaaa

SEQ ID NO: 30697 - RNA, 64 nt, Homo Sapiens
aguuucuggcugaugggugaaaaaaaaaaaaaaaaaaaaaaaagugaauuuacuuuucuuaaaa

SEQ ID NO: 30698 - RNA, 64 nt, Homo Sapiens
gaguuucuggcugaugggugaaaaaaaaaaaaaaaaaaaaaaaaaugaauuuacuuuucuuaaa

SEQ ID NO: 30699 - RNA, 64 nt, Homo Sapiens
agaguuucuggcugauggguaaaaaaaaaaaaaaaaaaaaaaaagaugaauuuacuuuucuuaa

SEQ ID NO: 30700 - RNA, 64 nt, Homo Sapiens
aagaguuucuggcugaugggaaaaaaaaaaaaaaaaaaaaaaaaagaugaauuuacuuuucuua

SEQ ID NO: 30701 - RNA, 64 nt, Homo Sapiens
aaagaguuucuggcugauggaaaaaaaaaaaaaaaaaaaaaaaaaagaugaauuuacuuuucuu

SEQ ID NO: 30702 - RNA, 64 nt, Homo Sapiens
aaaagaguuucuggcugauguaaaaaaaaaaaaaaaaaaaaaaacaagaugaauuuacuuuucu

SEQ ID NO: 30703 - RNA, 64 nt, Homo Sapiens
aaaaagaguuucuggcugauuuaaaaaaaaaaaaaaaaaaaaaagcaagaugaauuuacuuuuc

SEQ ID NO: 30704 - RNA, 64 nt, Homo Sapiens
aaaaaagaguuucuggcugacuuaaaaaaaaaaaaaaaaaaaaaagcaagaugaauuuacuuuu

SEQ ID NO: 30705 - RNA, 64 nt, Homo Sapiens
aaaaaaagaguuucuggcugucuuaaaaaaaaaaaaaaaaaaaagagcaagaugaauuuacuuu

SEQ ID NO: 30706 - RNA, 64 nt, Homo Sapiens
aaaaaaaagaguuucuggcuuucuuaaaaaaaaaaaaaaaaaaaugagcaagaugaauuuacuu

SEQ ID NO: 30707 - RNA, 64 nt, Homo Sapiens
aaaaaaaaagaguuucuggcuuucuuaaaaaaaaaaaaaaaaaagugagcaagaugaauuuacu

SEQ ID NO: 30708 - RNA, 64 nt, Homo Sapiens
aaaaaaaaaagaguuucugguuuucuuaaaaaaaaaaaaaaaaaugugagcaagaugaauuuac

SEQ ID NO: 30709 - RNA, 64 nt, Homo Sapiens
aaaaaaaaaaagaguuucugcuuuucuuaaaaaaaaaaaaaaaacugugagcaagaugaauuua

SEQ ID NO: 30710 - RNA, 64 nt, Homo Sapiens
aaaaaaaaaaaagaguuucuacuuuucuuaaaaaaaaaaaaaaaacugugagcaagaugaauuu

SEQ ID NO: 30711 - RNA, 64 nt, Homo Sapiens
aaaaaaaaaaaaagaguuucuacuuuucuuaaaaaaaaaaaaaagacugugagcaagaugaauu

SEQ ID NO: 30712 - RNA, 64 nt, Homo Sapiens
aaaaaaaaaaaaaagaguuuuuacuuuucuuaaaaaaaaaaaaaggacugugagcaagaugaau

SEQ ID NO: 30713 - RNA, 64 nt, Homo Sapiens
aaaaaaaaaaaaaaagaguuuuuacuuuucuuaaaaaaaaaaaaaggacugugagcaagaugaa

SEQ ID NO: 30714 - RNA, 64 nt, Homo Sapiens
aaaaaaaaaaaaaaaagaguauuuacuuuucuuaaaaaaaaaaaaaggacugugagcaagauga

SEQ ID NO: 30715 - RNA, 64 nt, Homo Sapiens
aaaaaaaaaaaaaaaaagagaauuuacuuuucuuaaaaaaaaaaaaaggacugugagcaagaug

SEQ ID NO: 30716 - RNA, 64 nt, Homo Sapiens
aacaaaaauauuuuucccccacauuuuauuuuuuaaaaaaaagaaauuuucucccauugugcga

SEQ ID NO: 30717 - RNA, 64 nt, Homo Sapiens
aaagaaaaagacagcaucucgaauugcuuuuuaaaaaaaaaagagaaagggaagaauuagguuu

SEQ ID NO: 30718 - RNA, 64 nt, Homo Sapiens
aaaagaaaaagacagcaucuugaauugcuuuuuaaaaaaaaaagagaaagggaagaauuagguu

SEQ ID NO: 30719 - RNA, 64 nt, Homo Sapiens
gaaaagaaaaagacagcaucuugaauugcuuuuuaaaaaaaaaaaagaaagggaagaauuaggu

SEQ ID NO: 30720 - RNA, 64 nt, Homo Sapiens
aagaaagaaaagguacaugucgagacucugucucaaaaaaaagaacuccagccugggcaacggg

SEQ ID NO: 30721 - RNA, 64 nt, Homo Sapiens
aaaaagaaaaaaagaagcccuaagacucugucuuaaaaaaaacuaagagccugggcaauuuuuu

SEQ ID NO: 30722 - RNA, 58 nt, Homo Sapiens
ccgagacguuucugugacuuaucagcagaaaaaaaacaaaaaagcaggaaagauguaa

SEQ ID NO: 30723 - RNA, 64 nt, Homo Sapiens
uaugcuaguagauuacaacucucaaaaaaaaaaaaaaaaaaaucgcgacagagugagacuccau

SEQ ID NO: 30724 - RNA, 64 nt, Homo Sapiens
cuaugcuaguagauuacaacucucaaaaaaaaaaaaaaaaaaauggcgacagagugagacucca

SEQ ID NO: 30725 - RNA, 64 nt, Homo Sapiens
ucuaugcuaguagauuacaaaucucaaaaaaaaaaaaaaaaaaagggcgacagagugagacucc

SEQ ID NO: 30726 - RNA, 64 nt, Homo Sapiens
aucuaugcuaguagauuacacaucucaaaaaaaaaaaaaaaaaaugggcgacagagugagacuc

SEQ ID NO: 30727 - RNA, 64 nt, Homo Sapiens
aaucuaugcuaguagauuacccaucucaaaaaaaaaaaaaaaaagugggcgacagagugagacu

SEQ ID NO: 30728 - RNA, 64 nt, Homo Sapiens
aaaucuaugcuaguagauuauccaucucaaaaaaaaaaaaaaaacgugggcgacagagugagac

SEQ ID NO: 30729 - RNA, 64 nt, Homo Sapiens
aaaaucuaugcuaguagauucuccaucucaaaaaaaaaaaaaaagcgugggcgacagagugaga

SEQ ID NO: 30730 - RNA, 64 nt, Homo Sapiens
aaaaaucuaugcuaguagauacuccaucucaaaaaaaaaaaaaaagcgugggcgacagagugag

SEQ ID NO: 30731 - RNA, 64 nt, Homo Sapiens
aaaaaaucuaugcuaguagagacuccaucucaaaaaaaaaaaaacagcgugggcgacagaguga

SEQ ID NO: 30732 - RNA, 64 nt, Homo Sapiens
aaaaaaaucuaugcuaguagagacuccaucucaaaaaaaaaaaaccagcgugggcgacagagug

SEQ ID NO: 30733 - RNA, 64 nt, Homo Sapiens
aaaaaaaaucuaugcuaguagagacuccaucucaaaaaaaaaaauccagcgugggcgacagagu

SEQ ID NO: 30734 - RNA, 64 nt, Homo Sapiens
aaaaaaaaaucuaugcuaguugagacuccaucucaaaaaaaaaacuccagcgugggcgacagag

SEQ ID NO: 30735 - RNA, 64 nt, Homo Sapiens
aaacuaggcaugaaaucagucuggaaagaaaaaaaaaaaaaagacagaaauccaugugggcuuc

SEQ ID NO: 30736 - RNA, 64 nt, Homo Sapiens
aaaacuaggcaugaaaucagccuggaaagaaaaaaaaaaaaaagucagaaauccaugugggcuu

SEQ ID NO: 30737 - RNA, 64 nt, Homo Sapiens
gaaaacuaggcaugaaaucauccuggaaagaaaaaaaaaaaaaagucagaaauccaugugggcu

SEQ ID NO: 30738 - RNA, 64 nt, Homo Sapiens
agaaaacuaggcaugaaaucuuccuggaaagaaaaaaaaaaaaaugucagaaauccaugugggc

SEQ ID NO: 30739 - RNA, 64 nt, Homo Sapiens
aagaaaacuaggcaugaaaucuuccuggaaagaaaaaaaaaaaacugucagaaauccauguggg

SEQ ID NO: 30740 - RNA, 64 nt, Homo Sapiens
aaagaaaacuaggcaugaaagcuuccuggaaagaaaaaaaaaaaucugucagaaauccaugugg

SEQ ID NO: 30741 - RNA, 64 nt, Homo Sapiens
aaaagaaaacuaggcaugaaggcuuccuggaaagaaaaaaaaaaaucugucagaaauccaugug

SEQ ID NO: 30742 - RNA, 64 nt, Homo Sapiens
aacuguaauuugauugacuguuugauguuucaaaaaaaaaaagguucaguuuuuuuaaaugccc

SEQ ID NO: 30743 - RNA, 64 nt, Homo Sapiens
gaacuguaauuugauugacucuuugauguuucaaaaaaaaaaaguuucaguuuuuuuaaaugcc

SEQ ID NO: 30744 - RNA, 64 nt, Homo Sapiens
ggaacuguaauuugauugacccuuugauguuucaaaaaaaaaaaguuucaguuuuuuuaaaugc

SEQ ID NO: 30745 - RNA, 64 nt, Homo Sapiens
aggaacuguaauuugauugacccuuugauguuucaaaaaaaaaauguuucaguuuuuuuaaaug

SEQ ID NO: 30746 - RNA, 64 nt, Homo Sapiens
uuguuuuuucuuuauuguccuucucucaagaaaaaaaaaaaaguuauuucuauuuaauacucuu

SEQ ID NO: 30747 - RNA, 64 nt, Homo Sapiens
uuuguuuuuucuuuauugucuuucucucaagaaaaaaaaaaaaguuauuucuauuuaauacucu

SEQ ID NO: 30748 - RNA, 64 nt, Homo Sapiens
guuuguuuuuucuuuauuguuuuucucucaagaaaaaaaaaaaaauuauuucuauuuaauacuc

SEQ ID NO: 30749 - RNA, 64 nt, Homo Sapiens
aguuuguuuuuucuuuauugcuuuucucucaagaaaaaaaaaaauauuauuucuauuuaauacu

SEQ ID NO: 30750 - RNA, 64 nt, Homo Sapiens
aaguuuguuuuuucuuuauuucuuuucucucaagaaaaaaaaaaauauuauuucuauuuaauac

SEQ ID NO: 30751 - RNA, 64 nt, Homo Sapiens
gauuaacauuaaauaaaaguaaaaaaaaaaaaaaaaaaaaaagggugccuuagcuugguuaaaa

SEQ ID NO: 30752 - RNA, 64 nt, Homo Sapiens
ggauuaacauuaaauaaaagaaaaaaaaaaaaaaaaaaaaaaagagugccuuagcuugguuaaa

SEQ ID NO: 30753 - RNA, 64 nt, Homo Sapiens
gggauuaacauuaaauaaaaaaaaaaaaaaaaaaaaaaaaaaaauagugccuuagcuugguuaa

SEQ ID NO: 30754 - RNA, 64 nt, Homo Sapiens
agggauuaacauuaaauaaaaaaaaaaaaaaaaaaaaaaaaaaaguagugccuuagcuugguua

SEQ ID NO: 30755 - RNA, 64 nt, Homo Sapiens
aagggauuaacauuaaauaaaaaaaaaaaaaaaaaaaaaaaaaagguagugccuuagcuugguu

SEQ ID NO: 30756 - RNA, 64 nt, Homo Sapiens
aaagggauuaacauuaaauauaaaaaaaaaaaaaaaaaaaaaaaugguagugccuuagcuuggu

SEQ ID NO: 30757 - RNA, 64 nt, Homo Sapiens
aaaagggauuaacauuaaauuuaaaaaaaaaaaaaaaaaaaaaacugguagugccuuagcuugg

SEQ ID NO: 30758 - RNA, 64 nt, Homo Sapiens
aaaaagggauuaacauuaaaguuaaaaaaaaaaaaaaaaaaaaaucugguagugccuuagcuug

SEQ ID NO: 30759 - RNA, 64 nt, Homo Sapiens
aaaaaagggauuaacauuaagguuaaaaaaaaaaaaaaaaaaaauucugguagugccuuagcuu

SEQ ID NO: 30760 - RNA, 64 nt, Homo Sapiens
aaaaaaagggauuaacauuaugguuaaaaaaaaaaaaaaaaaaauuucugguagugccuuagcu

SEQ ID NO: 30761 - RNA, 64 nt, Homo Sapiens
aaaaaaaagggauuaacauuuugguuaaaaaaaaaaaaaaaaaaauuucugguagugccuuagc

SEQ ID NO: 30762 - RNA, 64 nt, Homo Sapiens
aaaaaaaaagggauuaacaucuugguuaaaaaaaaaaaaaaaaaaauuucugguagugccuuag

SEQ ID NO: 30763 - RNA, 64 nt, Homo Sapiens
aaaaaaaaaagggauuaacagcuugguuaaaaaaaaaaaaaaaaaaauuucugguagugccuua

SEQ ID NO: 30764 - RNA, 64 nt, Homo Sapiens
aaaaaaaaaaagggauuaacagcuugguuaaaaaaaaaaaaaaagaaauuucugguagugccuu

SEQ ID NO: 30765 - RNA, 64 nt, Homo Sapiens
aaaaaaaaaaaagggauuaauagcuugguuaaaaaaaaaaaaaaugaaauuucugguagugccu

SEQ ID NO: 30766 - RNA, 64 nt, Homo Sapiens
aaaaaaaaaaaaagggauuauuagcuugguuaaaaaaaaaaaaauugaaauuucugguagugcc

SEQ ID NO: 30767 - RNA, 64 nt, Homo Sapiens
aaaaaaaaaaaaaagggauucuuagcuugguuaaaaaaaaaaaacuugaaauuucugguagugc

SEQ ID NO: 30768 - RNA, 64 nt, Homo Sapiens
aaaaaaaaaaaaaaagggauccuuagcuugguuaaaaaaaaaaaccuugaaauuucugguagug

SEQ ID NO: 30769 - RNA, 64 nt, Homo Sapiens
aaaaaaaaaaaaaaaagggagccuuagcuugguuaaaaaaaaaauccuugaaauuucugguagu

SEQ ID NO: 30770 - RNA, 64 nt, Homo Sapiens
gaaagaaaaauauuucugaguauauaucucuuuaaaaaaaaacagugggagguuuuuagaagag

SEQ ID NO: 30771 - RNA, 64 nt, Homo Sapiens
agaaagaaaaauauuucugaguauauaucucuuuaaaaaaaaacggugggagguuuuuagaaga

SEQ ID NO: 30772 - RNA, 64 nt, Homo Sapiens
uguuuuaugauaauauuauaagaaaaccuuaaaaaaaaaaaacuucuguauuuccuuuccauuc

SEQ ID NO: 30773 - RNA, 64 nt, Homo Sapiens
uuguuuuaugauaauauuaucagaaaaccuuaaaaaaaaaaaacaucuguauuuccuuuccauu

SEQ ID NO: 30774 - RNA, 64 nt, Homo Sapiens
cuuguuuuaugauaauauuaucagaaaaccuuaaaaaaaaaaaagaucuguauuuccuuuccau

SEQ ID NO: 30775 - RNA, 64 nt, Homo Sapiens
acuuguuuuaugauaauauuuucagaaaaccuuaaaaaaaaaaaugaucuguauuuccuuucca

SEQ ID NO: 30776 - RNA, 64 nt, Homo Sapiens
aacuuguuuuaugauaauauauucagaaaaccuuaaaaaaaaaacugaucuguauuuccuuucc

SEQ ID NO: 30777 - RNA, 64 nt, Homo Sapiens
cacgcuuggugugaauacuuaacuuuugcuggcaaaaaaaaauuagagguuucuuugauguuuu

SEQ ID NO: 30778 - RNA, 64 nt, Homo Sapiens
ucacgcuuggugugaauacuuaacuuuugcuggcaaaaaaaaauaagagguuucuuugauguuu

SEQ ID NO: 30779 - RNA, 64 nt, Homo Sapiens
cauuuacuggcaaggagaagauugaauuucagaaaaaaaaaaugccacuuaccaauugcuaagu

SEQ ID NO: 30780 - RNA, 64 nt, Homo Sapiens
gcauuuacuggcaaggagaauauugaauuucagaaaaaaaaaaugccacuuaccaauugcuaag

SEQ ID NO: 30781 - RNA, 64 nt, Homo Sapiens
ugcauuuacuggcaaggagaguauugaauuucagaaaaaaaaaaagccacuuaccaauugcuaa

SEQ ID NO: 30782 - RNA, 64 nt, Homo Sapiens
aaaaccguggccagccaccaagaaauaacuugaaaaaaaaaauuuucaaaaauaugucugcuau

SEQ ID NO: 30783 - RNA, 64 nt, Homo Sapiens
uaaaaccguggccagccaccuagaaauaacuugaaaaaaaaaaucuucaaaaauaugucugcua

SEQ ID NO: 30784 - RNA, 64 nt, Homo Sapiens
uuaaaaccguggccagccacauagaaauaacuugaaaaaaaaaaacuucaaaaauaugucugcu

SEQ ID NO: 30785 - RNA, 64 nt, Homo Sapiens
guugaaagguccaguucucaaacuuucuauagaaaaaaaaaauucuuugcuuacagcuagauga

SEQ ID NO: 30786 - RNA, 64 nt, Homo Sapiens
uguugaaagguccaguucucaaacuuucuauagaaaaaaaaaauacuuugcuuacagcuagaug

SEQ ID NO: 30787 - RNA, 64 nt, Homo Sapiens
uuguugaaagguccaguucugaaacuuucuauagaaaaaaaaaagacuuugcuuacagcuagau

SEQ ID NO: 30788 - RNA, 64 nt, Homo Sapiens
uuuuuuuaaccauccuuaaagucuaugcuuaaaaaaaaaaaauuguuguaccgaaucaacugga

SEQ ID NO: 30789 - RNA, 64 nt, Homo Sapiens
uuuuuuuuaaccauccuuaaagucuaugcuuaaaaaaaaaaaauuguuguaccgaaucaacugg

SEQ ID NO: 30790 - RNA, 64 nt, Homo Sapiens
uuuuuuuuuaaccauccuuagagucuaugcuuaaaaaaaaaaaauuguuguaccgaaucaacug

SEQ ID NO: 30791 - RNA, 64 nt, Homo Sapiens
auuuuuuuuuaaccauccuuggagucuaugcuuaaaaaaaaaaacuuguuguaccgaaucaacu

SEQ ID NO: 30792 - RNA, 64 nt, Homo Sapiens
aauuuuuuuuuaaccauccuuggagucuaugcuuaaaaaaaaaagcuuguuguaccgaaucaac

SEQ ID NO: 30793 - RNA, 64 nt, Homo Sapiens
ccgcacuuggcaacuucuucuccaaacaugauugaaaaaaaaccucuguaaguuggaacuuauu

SEQ ID NO: 30794 - RNA, 64 nt, Homo Sapiens
ccuauucuuggaaaauacacuacuuugauuaaguaaaaaaaaucagucaaucagauaagaagua

SEQ ID NO: 30795 - RNA, 64 nt, Homo Sapiens
gagguauauugccaaaacauaaaguaauguuaaaaaaaaaaauagaaauaucuuguuaugccag

SEQ ID NO: 30796 - RNA, 64 nt, Homo Sapiens
agagguauauugccaaaacagaaaguaauguuaaaaaaaaaaauugaaauaucuuguuaugcca

SEQ ID NO: 30797 - RNA, 64 nt, Homo Sapiens
uagagguauauugccaaaacagaaaguaauguuaaaaaaaaaaauugaaauaucuuguuaugcc

SEQ ID NO: 30798 - RNA, 64 nt, Homo Sapiens
auagagguauauugccaaaacagaaaguaauguuaaaaaaaaaacuugaaauaucuuguuaugc

SEQ ID NO: 30799 - RNA, 64 nt, Homo Sapiens
aaaucagaaaacccacgguuuuucuggggggagaaaaaaaaagcccuucugaagucugagccca

SEQ ID NO: 30800 - RNA, 64 nt, Homo Sapiens
caaaucagaaaacccacgguauuucuggggggagaaaaaaaaaguccuucugaagucugagccc

SEQ ID NO: 30801 - RNA, 64 nt, Homo Sapiens
aaaaaaagacucuuuuuggucuaguaguuaaaaaaaaaaaaagguauguauuagugauauuucu

SEQ ID NO: 30802 - RNA, 64 nt, Homo Sapiens
gaaaaaaagacucuuuuuggucuaguaguuaaaaaaaaaaaaagguauguauuagugauauuuc

SEQ ID NO: 30803 - RNA, 64 nt, Homo Sapiens
ggaaaaaaagacucuuuuugcucuaguaguuaaaaaaaaaaaaauguauguauuagugauauuu

SEQ ID NO: 30804 - RNA, 64 nt, Homo Sapiens
aggaaaaaaagacucuuuuuucucuaguaguuaaaaaaaaaaaacuguauguauuagugauauu

SEQ ID NO: 30805 - RNA, 64 nt, Homo Sapiens
aaggaaaaaaagacucuuuuuucucuaguaguuaaaaaaaaaaaucuguauguauuagugauau

SEQ ID NO: 30806 - RNA, 64 nt, Homo Sapiens
aaaggaaaaaaagacucuuuuuucucuaguaguuaaaaaaaaaaaucuguauguauuagugaua

SEQ ID NO: 30807 - RNA, 64 nt, Homo Sapiens
ccauaauacaaaaggcuccaauacagcagcaagaaaaaaaaaugauuugcaaugggauguauga

SEQ ID NO: 30808 - RNA, 64 nt, Homo Sapiens
gccauaauacaaaaggcuccaauacagcagcaagaaaaaaaaaugauuugcaaugggauguaug

SEQ ID NO: 30809 - RNA, 64 nt, Homo Sapiens
ggaaaacccucaagggcaugacaauaauggaaaaaaaaaaaagaagucacaauguucuuuauau

SEQ ID NO: 30810 - RNA, 64 nt, Homo Sapiens
aggaaaacccucaagggcauuacaauaauggaaaaaaaaaaaagaagucacaauguucuuuaua

SEQ ID NO: 30811 - RNA, 64 nt, Homo Sapiens
gaggaaaacccucaagggcaauacaauaauggaaaaaaaaaaaaaaagucacaauguucuuuau

SEQ ID NO: 30812 - RNA, 64 nt, Homo Sapiens
agaggaaaacccucaagggcuauacaauaauggaaaaaaaaaaaaaaagucacaauguucuuua

SEQ ID NO: 30813 - RNA, 64 nt, Homo Sapiens
aagaggaaaacccucaagggauauacaauaauggaaaaaaaaaauaaaagucacaauguucuuu

SEQ ID NO: 30814 - RNA, 64 nt, Homo Sapiens
cagccucauaaaguagauuaauuagcuuuucuaaaaaaaaaaucgcuauuucuaaauauuuuaa

SEQ ID NO: 30815 - RNA, 64 nt, Homo Sapiens
ccagccucauaaaguagauuaauuagcuuuucuaaaaaaaaaauagcuauuucuaaauauuuua

SEQ ID NO: 30816 - RNA, 64 nt, Homo Sapiens
uccagccucauaaaguagauaaauuagcuuuucuaaaaaaaaaauagcuauuucuaaauauuuu

SEQ ID NO: 30817 - RNA, 64 nt, Homo Sapiens
uuaaaaccauuaaaaagaaaccuuggggacugaaaaaaaaaagauuuguacugagugguacaag

SEQ ID NO: 30818 - RNA, 64 nt, Homo Sapiens
auuaaaaccauuaaaaagaagccuuggggacugaaaaaaaaaagauuuguacugagugguacaa

SEQ ID NO: 30819 - RNA, 64 nt, Homo Sapiens
gauuaaaaccauuaaaaagaagccuuggggacugaaaaaaaaaacauuuguacugagugguaca

SEQ ID NO: 30820 - RNA, 64 nt, Homo Sapiens
guacaguguauauuccuuugcaucagaaugaaagaaaaaaaauuacugauaauaucuguaauga

SEQ ID NO: 30821 - RNA, 64 nt, Homo Sapiens
uuaaguauauccuuuaaaggauuuuccucugcuuaaaaaaaauuucauugguaaauaguagucu

SEQ ID NO: 30822 - RNA, 64 nt, Homo Sapiens
cuugugacuuacaauuugcacaaaaguuuuaauuaaaaaaaaucaaacuuggacccuuggaaaa

SEQ ID NO: 30823 - RNA, 64 nt, Homo Sapiens
gaagaugaaauauauauuguugcacuuuguuuagaaaaaaaacucuguagacucuaagauacac

SEQ ID NO: 30824 - RNA, 64 nt, Homo Sapiens
cuuauacucaccugcguuuuuuguuaauguacaaaaaaaaaaccuaauauacuagauguuaagg

SEQ ID NO: 30825 - RNA, 64 nt, Homo Sapiens
ccuuauacucaccugcguuuguuguuaauguacaaaaaaaaaacuuaauauacuagauguuaag

SEQ ID NO: 30826 - RNA, 64 nt, Homo Sapiens
cccuuauacucaccugcguugguuguuaauguacaaaaaaaaaacuuaauauacuagauguuaa

SEQ ID NO: 30827 - RNA, 64 nt, Homo Sapiens
aucaaagaaagaugaaauaaaaagaaaagaugaaaaaaaaaacuggcuucuacugaagaaccau

SEQ ID NO: 30828 - RNA, 64 nt, Homo Sapiens
uaucaaagaaagaugaaauauaaagaaaagaugaaaaaaaaaacuggcuucuacugaagaacca

SEQ ID NO: 30829 - RNA, 64 nt, Homo Sapiens
cuaucaaagaaagaugaaauauaaagaaaagaugaaaaaaaaaacuggcuucuacugaagaacc

SEQ ID NO: 30830 - RNA, 64 nt, Homo Sapiens
gugaagauaguacuagcaagauuggcuucugaaaaaaaaaaagaaagcugcagauuuagagaac

SEQ ID NO: 30831 - RNA, 64 nt, Homo Sapiens
agugaagauaguacuagcaacauuggcuucugaaaaaaaaaaaggaagcugcagauuuagagaa

SEQ ID NO: 30832 - RNA, 64 nt, Homo Sapiens
gagugaagauaguacuagcaacauuggcuucugaaaaaaaaaaaugaagcugcagauuuagaga

SEQ ID NO: 30833 - RNA, 64 nt, Homo Sapiens
agagugaagauaguacuagcaacauuggcuucugaaaaaaaaaaaugaagcugcagauuuagag

SEQ ID NO: 30834 - RNA, 64 nt, Homo Sapiens
uauaggguagaaauaagagcagggacuggguuuaaaaaaaaagaugcuuuauaaacuauauuag

SEQ ID NO: 30835 - RNA, 64 nt, Homo Sapiens
auauaggguagaaauaagaggagggacuggguuuaaaaaaaaaggugcuuuauaaacuauauua

SEQ ID NO: 30836 - RNA, 64 nt, Homo Sapiens
uauuuuucuaguaaauauuaagaacaaauaggaaaaaaaaaacuauuucauuaaagaaguuggg

SEQ ID NO: 30837 - RNA, 64 nt, Homo Sapiens
uuauuuuucuaguaaauauugagaacaaauaggaaaaaaaaaacuauuucauuaaagaaguugg

SEQ ID NO: 30838 - RNA, 64 nt, Homo Sapiens
cuuauuuuucuaguaaauauggagaacaaauaggaaaaaaaaaauuauuucauuaaagaaguug

SEQ ID NO: 30839 - RNA, 64 nt, Homo Sapiens
acuuuugaaacucagacuucaaacuuuugugggaaaaaaaaaucaaguucuagcuuaaguguug

SEQ ID NO: 30840 - RNA, 64 nt, Homo Sapiens
cacuuuugaaacucagacuugaaacuuuugugggaaaaaaaaauaaaguucuagcuuaaguguu

SEQ ID NO: 30841 - RNA, 64 nt, Homo Sapiens
aacaaacacuucuuuccaucagucuuugacaagaaaaaaaaacauaauuuaaaacuauggugua

SEQ ID NO: 30842 - RNA, 64 nt, Homo Sapiens
aaacaaacacuucuuuccauaagucuuugacaagaaaaaaaaacuuaauuuaaaacuauggugu

SEQ ID NO: 30843 - RNA, 64 nt, Homo Sapiens
ccaaugagaacucaacuccuagcagaaugacaaaaaaaaaaaggacuauccaaaaacuuagaug

SEQ ID NO: 30844 - RNA, 64 nt, Homo Sapiens
gccaaugagaacucaacuccgagcagaaugacaaaaaaaaaaagaacuauccaaaaacuuagau

SEQ ID NO: 30845 - RNA, 64 nt, Homo Sapiens
ggccaaugagaacucaacucugagcagaaugacaaaaaaaaaaacaacuauccaaaaacuuaga

SEQ ID NO: 30846 - RNA, 64 nt, Homo Sapiens
aggccaaugagaacucaacuaugagcagaaugacaaaaaaaaaaccaacuauccaaaaacuuag

SEQ ID NO: 30847 - RNA, 64 nt, Homo Sapiens
agacuccauugugccuuacuacuggaaauuaaaaaaaaaaaacuuuacugcuugcaguaauuca

SEQ ID NO: 30848 - RNA, 64 nt, Homo Sapiens
uagacuccauugugccuuacaacuggaaauuaaaaaaaaaaaacauuacugcuugcaguaauuc

SEQ ID NO: 30849 - RNA, 64 nt, Homo Sapiens
cuagacuccauugugccuuacaacuggaaauuaaaaaaaaaaaauauuacugcuugcaguaauu

SEQ ID NO: 30850 - RNA, 64 nt, Homo Sapiens
acuagacuccauugugccuuucaacuggaaauuaaaaaaaaaaauuauuacugcuugcaguaau

SEQ ID NO: 30851 - RNA, 64 nt, Homo Sapiens
aacuagacuccauugugccuuucaacuggaaauuaaaaaaaaaacuuauuacugcuugcaguaa

SEQ ID NO: 30852 - RNA, 64 nt, Homo Sapiens
cuuauuuuguauaaaggacucuuuacaaauggaaaaaaaaaaucaaaacaugacaguggauucu

SEQ ID NO: 30853 - RNA, 64 nt, Homo Sapiens
ccuuauuuuguauaaaggacucuuuacaaauggaaaaaaaaaaucaaaacaugacaguggauuc

SEQ ID NO: 30854 - RNA, 64 nt, Homo Sapiens
uccuuauuuuguauaaaggacucuuuacaaauggaaaaaaaaaagcaaaacaugacaguggauu

SEQ ID NO: 30855 - RNA, 64 nt, Homo Sapiens
cugauuuauuacuaugucuuaaaaaaaaaaaaaaaaaaaaaaccaaaaauuguuagaaaugggu

SEQ ID NO: 30856 - RNA, 64 nt, Homo Sapiens
ccugauuuauuacuaugucuuaaaaaaaaaaaaaaaaaaaaaacuaaaaauuguuagaaauggg

SEQ ID NO: 30857 - RNA, 64 nt, Homo Sapiens
cccugauuuauuacuaugucguaaaaaaaaaaaaaaaaaaaaaaguaaaaauuguuagaaaugg

SEQ ID NO: 30858 - RNA, 64 nt, Homo Sapiens
acccugauuuauuacuaugugguaaaaaaaaaaaaaaaaaaaaaaguaaaaauuguuagaaaug

SEQ ID NO: 30859 - RNA, 64 nt, Homo Sapiens
aacccugauuuauuacuaugggguaaaaaaaaaaaaaaaaaaaacaguaaaaauuguuagaaau

SEQ ID NO: 30860 - RNA, 64 nt, Homo Sapiens
aaacccugauuuauuacuauuggguaaaaaaaaaaaaaaaaaaaacaguaaaaauuguuagaaa

SEQ ID NO: 30861 - RNA, 64 nt, Homo Sapiens
aaaacccugauuuauuacuaauggguaaaaaaaaaaaaaaaaaauacaguaaaaauuguuagaa

SEQ ID NO: 30862 - RNA, 64 nt, Homo Sapiens
aaaaacccugauuuauuacuaauggguaaaaaaaaaaaaaaaaauuacaguaaaaauuguuaga

SEQ ID NO: 30863 - RNA, 64 nt, Homo Sapiens
aaaaaacccugauuuauuacaaauggguaaaaaaaaaaaaaaaauuuacaguaaaaauuguuag

SEQ ID NO: 30864 - RNA, 64 nt, Homo Sapiens
aaaaaaacccugauuuauuagaaauggguaaaaaaaaaaaaaaauuuuacaguaaaaauuguua

SEQ ID NO: 30865 - RNA, 64 nt, Homo Sapiens
aaaaaaaacccugauuuauuagaaauggguaaaaaaaaaaaaaaauuuuacaguaaaaauuguu

SEQ ID NO: 30866 - RNA, 64 nt, Homo Sapiens
aaaaaaaaacccugauuuauuagaaauggguaaaaaaaaaaaaaaauuuuacaguaaaaauugu

SEQ ID NO: 30867 - RNA, 64 nt, Homo Sapiens
aaaaaaaaaacccugauuuauuagaaauggguaaaaaaaaaaaaaaauuuuacaguaaaaauug

SEQ ID NO: 30868 - RNA, 64 nt, Homo Sapiens
aaaaaaaaaaacccugauuuguuagaaauggguaaaaaaaaaaaaaaauuuuacaguaaaaauu

SEQ ID NO: 30869 - RNA, 64 nt, Homo Sapiens
aaaaaaaaaaaacccugauuuguuagaaauggguaaaaaaaaaaaaaaauuuuacaguaaaaau

SEQ ID NO: 30870 - RNA, 64 nt, Homo Sapiens
gcaaauuaguucuuuuucccauggaaccuuaugaaaaaaaaauauuauauaguauuuugaagau

SEQ ID NO: 30871 - RNA, 64 nt, Homo Sapiens
agcaaauuaguucuuuuuccuauggaaccuuaugaaaaaaaaauauuauauaguauuuugaaga

SEQ ID NO: 30872 - RNA, 64 nt, Homo Sapiens
caaaagcugcaugucuaaaaaaaaacaaaaacaaaaaaaaaacaguuuuuuucaaaaaaaaaaa

SEQ ID NO: 30873 - RNA, 64 nt, Homo Sapiens
acaaaagcugcaugucuaaaaaaaaacaaaaacaaaaaaaaaacgguuuuuuucaaaaaaaaaa

SEQ ID NO: 30874 - RNA, 64 nt, Homo Sapiens
cacaaaagcugcaugucuaaaaaaaaacaaaaacaaaaaaaaaaugguuuuuuucaaaaaaaaa

SEQ ID NO: 30875 - RNA, 64 nt, Homo Sapiens
aaaacaaaaaaaaaacacaauuuuucaaaaaaaaaaaaaaaacagaucucaaaauaaacugguu

SEQ ID NO: 30876 - RNA, 64 nt, Homo Sapiens
aaaaacaaaaaaaaaacacauuuuuucaaaaaaaaaaaaaaaacugaucucaaaauaaacuggu

SEQ ID NO: 30877 - RNA, 64 nt, Homo Sapiens
caaaaacaaaaaaaaaacacuuuuuuucaaaaaaaaaaaaaaaacugaucucaaaauaaacugg

SEQ ID NO: 30878 - RNA, 64 nt, Homo Sapiens
acaaaaacaaaaaaaaaacaguuuuuuucaaaaaaaaaaaaaaaacugaucucaaaauaaacug

SEQ ID NO: 30879 - RNA, 64 nt, Homo Sapiens
aacaaaaacaaaaaaaaaacgguuuuuuucaaaaaaaaaaaaaacacugaucucaaaauaaacu

SEQ ID NO: 30880 - RNA, 64 nt, Homo Sapiens
aaacaaaaacaaaaaaaaaaugguuuuuuucaaaaaaaaaaaaaucacugaucucaaaauaaac

SEQ ID NO: 30881 - RNA, 64 nt, Homo Sapiens
aaaacaaaaacaaaaaaaaacugguuuuuuucaaaaaaaaaaaauucacugaucucaaaauaaa

SEQ ID NO: 30882 - RNA, 64 nt, Homo Sapiens
aaaaacaaaaacaaaaaaaaacugguuuuuuucaaaaaaaaaaauuucacugaucucaaaauaa

SEQ ID NO: 30883 - RNA, 64 nt, Homo Sapiens
aaaaaacaaaaacaaaaaaaaacugguuuuuuucaaaaaaaaaauuuucacugaucucaaaaua

SEQ ID NO: 30884 - RNA, 64 nt, Homo Sapiens
ugcguaaguccuaacccccaggcaagccaaaaaaaaaaaaaagaaaguccucuguaagguguca

SEQ ID NO: 30885 - RNA, 64 nt, Homo Sapiens
augcguaaguccuaacccccaggcaagccaaaaaaaaaaaaaaguaaguccucuguaagguguc

SEQ ID NO: 30886 - RNA, 64 nt, Homo Sapiens
gaugcguaaguccuaacccccaggcaagccaaaaaaaaaaaaaauuaaguccucuguaaggugu

SEQ ID NO: 30887 - RNA, 64 nt, Homo Sapiens
agaugcguaaguccuaacccucaggcaagccaaaaaaaaaaaaaauuaaguccucuguaaggug

SEQ ID NO: 30888 - RNA, 64 nt, Homo Sapiens
aagaugcguaaguccuaaccgucaggcaagccaaaaaaaaaaaacauuaaguccucuguaaggu

SEQ ID NO: 30889 - RNA, 64 nt, Homo Sapiens
aaagaugcguaaguccuaacugucaggcaagccaaaaaaaaaaagcauuaaguccucuguaagg

SEQ ID NO: 30890 - RNA, 64 nt, Homo Sapiens
aaaagaugcguaaguccuaagugucaggcaagccaaaaaaaaaaugcauuaaguccucuguaag

SEQ ID NO: 30891 - RNA, 64 nt, Homo Sapiens
uaacugaaauauaaucagaaacauuaaagccuguaaaaaaaaauugcugcguuuuugguaaagg

SEQ ID NO: 30892 - RNA, 64 nt, Homo Sapiens
aacugaaauauaaucagaaacauuaaagccuguaaaaaaaaauugcugcguuuuugguaaaggg

SEQ ID NO: 30893 - RNA, 64 nt, Homo Sapiens
aacaugugggaaaaaauauuacauuuuaagggggaaaaaaaaacccaccauucucuucuccccc

SEQ ID NO: 30894 - RNA, 64 nt, Homo Sapiens
acaugugggaaaaaauauuacauuuuaagggggaaaaaaaaacccaccauucucuucucccccu

SEQ ID NO: 30895 - RNA, 64 nt, Homo Sapiens
cuccagccugggcaacagaguaagacucagucucaaaaaaaaaaaaaagagugaaaugcuuuuu

SEQ ID NO: 30896 - RNA, 64 nt, Homo Sapiens
uccagccugggcaacagaguaagacucagucucaaaaaaaaaaaaaagagugaaaugcuuuuug

SEQ ID NO: 30897 - RNA, 64 nt, Homo Sapiens
ccagccugggcaacagaguaagacucagucucaaaaaaaaaaaaaagagugaaaugcuuuuugu

SEQ ID NO: 30898 - RNA, 64 nt, Homo Sapiens
cagccugggcaacagaguaagacucagucucaaaaaaaaaaaaaagagugaaaugcuuuuuguu

SEQ ID NO: 30899 - RNA, 64 nt, Homo Sapiens
agccugggcaacagaguaagacucagucucaaaaaaaaaaaaaagagugaaaugcuuuuuguuu

SEQ ID NO: 30900 - RNA, 64 nt, Homo Sapiens
gccugggcaacagaguaagacucagucucaaaaaaaaaaaaaagagugaaaugcuuuuuguuug

SEQ ID NO: 30901 - RNA, 64 nt, Homo Sapiens
ccugggcaacagaguaagacucagucucaaaaaaaaaaaaaagagugaaaugcuuuuuguuugc

SEQ ID NO: 30902 - RNA, 64 nt, Homo Sapiens
aagaaaauggaaaaaaacccacaaaacaaacuuuaaaaaaaaaaaaaaacaaauuugccaaggu

SEQ ID NO: 30903 - RNA, 64 nt, Homo Sapiens
agaaaauggaaaaaaacccacaaaacaaacuuuaaaaaaaaaaaaaaacaaauuugccaagguu

SEQ ID NO: 30904 - RNA, 64 nt, Homo Sapiens
gaaaauggaaaaaaacccacaaaacaaacuuuaaaaaaaaaaaaaaacaaauuugccaagguuu

SEQ ID NO: 30905 - RNA, 64 nt, Homo Sapiens
aaaauggaaaaaaacccacaaaacaaacuuuaaaaaaaaaaaaaaacaaauuugccaagguuua

SEQ ID NO: 30906 - RNA, 64 nt, Homo Sapiens
aaauggaaaaaaacccacaaaacaaacuuuaaaaaaaaaaaaaaacaaauuugccaagguuuag

SEQ ID NO: 30907 - RNA, 64 nt, Homo Sapiens
aauggaaaaaaacccacaaaacaaacuuuaaaaaaaaaaaaaaacaaauuugccaagguuuagc

SEQ ID NO: 30908 - RNA, 64 nt, Homo Sapiens
auggaaaaaaacccacaaaacaaacuuuaaaaaaaaaaaaaaacaaauuugccaagguuuagcu

SEQ ID NO: 30909 - RNA, 64 nt, Homo Sapiens
uggaaaaaaacccacaaaacaaacuuuaaaaaaaaaaaaaaacaaauuugccaagguuuagcug

SEQ ID NO: 30910 - RNA, 64 nt, Homo Sapiens
ggacaacauagggagaccccaucucuaccggaggaaaaaaaaaagagucaggccugguggugug

SEQ ID NO: 30911 - RNA, 64 nt, Homo Sapiens
gacaacauagggagaccccaucucuaccggaggaaaaaaaaaagagucaggccugguggugugc

SEQ ID NO: 30912 - RNA, 64 nt, Homo Sapiens
acaacauagggagaccccaucucuaccggaggaaaaaaaaaagagucaggccugguggugugcg

SEQ ID NO: 30913 - RNA, 64 nt, Homo Sapiens
cuccagccugggugacagagcaagacuccaucucaaaaaaaaaauaaauaaaaaaaaaugcagc

SEQ ID NO: 30914 - RNA, 64 nt, Homo Sapiens
uccagccugggugacagagcaagacuccaucucaaaaaaaaaauaaauaaaaaaaaaugcagcu

SEQ ID NO: 30915 - RNA, 64 nt, Homo Sapiens
ccagccugggugacagagcaagacuccaucucaaaaaaaaaauaaauaaaaaaaaaugcagcug

SEQ ID NO: 30916 - RNA, 64 nt, Homo Sapiens
cagagcaagacuccaucucaaaaaaaaaauaaauaaaaaaaaaugcagcugcaggagugaggcg

SEQ ID NO: 30917 - RNA, 64 nt, Homo Sapiens
agagcaagacuccaucucaaaaaaaaaauaaauaaaaaaaaaugcagcugcaggagugaggcgc

SEQ ID NO: 30918 - RNA, 64 nt, Homo Sapiens
caacaugacgaaaccccaucucuacugaaaauagaaaaaaaaaauuagccaggcuugcaccugu

SEQ ID NO: 30919 - RNA, 64 nt, Homo Sapiens
aacaugacgaaaccccaucucuacugaaaauagaaaaaaaaaauuagccaggcuugcaccugua

SEQ ID NO: 30920 - RNA, 64 nt, Homo Sapiens
acaugacgaaaccccaucucuacugaaaauagaaaaaaaaaauuagccaggcuugcaccuguaa

SEQ ID NO: 30921 - RNA, 64 nt, Homo Sapiens
ggacuguccauugacguuccuaaugugguagcagaaaaaaaaaaauggugucuuaagugcuuag

SEQ ID NO: 30922 - RNA, 64 nt, Homo Sapiens
gacuguccauugacguuccuaaugugguagcagaaaaaaaaaaauggugucuuaagugcuuagu

SEQ ID NO: 30923 - RNA, 64 nt, Homo Sapiens
acuguccauugacguuccuaaugugguagcagaaaaaaaaaaauggugucuuaagugcuuagug

SEQ ID NO: 30924 - RNA, 64 nt, Homo Sapiens
cuguccauugacguuccuaaugugguagcagaaaaaaaaaaauggugucuuaagugcuuagugu

SEQ ID NO: 30925 - RNA, 64 nt, Homo Sapiens
uugcuucuguuuauuaaaauugaccugcaaaguuaaaaaaaaauuaaaguugagaacagguaua

SEQ ID NO: 30926 - RNA, 64 nt, Homo Sapiens
ugcuucuguuuauuaaaauugaccugcaaaguuaaaaaaaaauuaaaguugagaacagguauaa

SEQ ID NO: 30927 - RNA, 64 nt, Homo Sapiens
aaacaaaugaaaaacguuuaaaaagaagaagaagaaaaaaaacaagaacaagcagcaacagcug

SEQ ID NO: 30928 - RNA, 64 nt, Homo Sapiens
auuuuaaaguguuccagacccaaaaaggaaaaauaaaaaaaaaggaauauuuguacccaacagc

SEQ ID NO: 30929 - RNA, 64 nt, Homo Sapiens
uuuuaaaguguuccagacccaaaaaggaaaaauaaaaaaaaaggaauauuuguacccaacagcu

SEQ ID NO: 30930 - RNA, 64 nt, Homo Sapiens
aauuucaucacuguugaugugguucuuuuguguuaaaaaaaaaaagugcaacuaucaaaacuaa

SEQ ID NO: 30931 - RNA, 64 nt, Homo Sapiens
auuucaucacuguugaugugguucuuuuguguuaaaaaaaaaaagugcaacuaucaaaacuaaa

SEQ ID NO: 30932 - RNA, 64 nt, Homo Sapiens
uuucaucacuguugaugugguucuuuuguguuaaaaaaaaaaagugcaacuaucaaaacuaaaa

SEQ ID NO: 30933 - RNA, 64 nt, Homo Sapiens
uucaucacuguugaugugguucuuuuguguuaaaaaaaaaaagugcaacuaucaaaacuaaaaa

SEQ ID NO: 30934 - RNA, 64 nt, Homo Sapiens
uaugccuucauauuagcaaauaugaaauucugugaaaaaaaacccuuugaucuuaaaaaaaaaa

SEQ ID NO: 30935 - RNA, 64 nt, Homo Sapiens
uaugaaauucugugaaaaaaaacccuuugaucuuaaaaaaaaaaaaaccaccccccccuucugu

SEQ ID NO: 30936 - RNA, 64 nt, Homo Sapiens
augaaauucugugaaaaaaaacccuuugaucuuaaaaaaaaaaaaaccaccccccccuucugua

SEQ ID NO: 30937 - RNA, 64 nt, Homo Sapiens
ugaaauucugugaaaaaaaacccuuugaucuuaaaaaaaaaaaaaccaccccccccuucuguag

SEQ ID NO: 30938 - RNA, 64 nt, Homo Sapiens
gaaauucugugaaaaaaaacccuuugaucuuaaaaaaaaaaaaaccaccccccccuucuguagc

SEQ ID NO: 30939 - RNA, 64 nt, Homo Sapiens
aaauucugugaaaaaaaacccuuugaucuuaaaaaaaaaaaaaccaccccccccuucuguagca

SEQ ID NO: 30940 - RNA, 64 nt, Homo Sapiens
aauucugugaaaaaaaacccuuugaucuuaaaaaaaaaaaaaccaccccccccuucuguagcag

SEQ ID NO: 30941 - RNA, 64 nt, Homo Sapiens
gagcuggccacaggcuggcagccuccaggggcuuaaaaaaaaaggcaaagaacacagaaagagg

SEQ ID NO: 30942 - RNA, 64 nt, Homo Sapiens
agcuggccacaggcuggcagccuccaggggcuuaaaaaaaaaggcaaagaacacagaaagagga

SEQ ID NO: 30943 - RNA, 64 nt, Homo Sapiens
uugguuggacugcucauggauuuuguagcuguuuaaaaaaaaaaaaaagguagcugugauacaa

SEQ ID NO: 30944 - RNA, 64 nt, Homo Sapiens
ugguuggacugcucauggauuuuguagcuguuuaaaaaaaaaaaaaagguagcugugauacaaa

SEQ ID NO: 30945 - RNA, 64 nt, Homo Sapiens
gguuggacugcucauggauuuuguagcuguuuaaaaaaaaaaaaaagguagcugugauacaaac

SEQ ID NO: 30946 - RNA, 64 nt, Homo Sapiens
guuggacugcucauggauuuuguagcuguuuaaaaaaaaaaaaaagguagcugugauacaaacc

SEQ ID NO: 30947 - RNA, 64 nt, Homo Sapiens
uuggacugcucauggauuuuguagcuguuuaaaaaaaaaaaaaagguagcugugauacaaaccc

SEQ ID NO: 30948 - RNA, 64 nt, Homo Sapiens
uggacugcucauggauuuuguagcuguuuaaaaaaaaaaaaaagguagcugugauacaaacccc

SEQ ID NO: 30949 - RNA, 64 nt, Homo Sapiens
ggacugcucauggauuuuguagcuguuuaaaaaaaaaaaaaagguagcugugauacaaacccca

SEQ ID NO: 30950 - RNA, 64 nt, Homo Sapiens
uuucaaguaaauauagcauuccuuuggcaaaaagaaaaaaaaaguaaaagaaaagaaaaaaaau

SEQ ID NO: 30951 - RNA, 64 nt, Homo Sapiens
uucaaguaaauauagcauuccuuuggcaaaaagaaaaaaaaaguaaaagaaaagaaaaaaaaug

SEQ ID NO: 30952 - RNA, 64 nt, Homo Sapiens
cuuuggcaaaaagaaaaaaaaaguaaaagaaaagaaaaaaaauguauuaccacccgaugagccu

SEQ ID NO: 30953 - RNA, 64 nt, Homo Sapiens
uuguucugcuuguuguaauggugaaugcuuuaagaaaaaaaaguguaauuugcuaagaauaauu

SEQ ID NO: 30954 - RNA, 64 nt, Homo Sapiens
uuuaaacuuauugcacuaaauacaggcucuguacaaaaaaaaaaaaaaaaaaaaagccucagca

SEQ ID NO: 30955 - RNA, 64 nt, Homo Sapiens
uuaaacuuauugcacuaaauacaggcucuguacaaaaaaaaaaaaaaaaaaaaagccucagcau

SEQ ID NO: 30956 - RNA, 64 nt, Homo Sapiens
uaaacuuauugcacuaaauacaggcucuguacaaaaaaaaaaaaaaaaaaaaagccucagcauu

SEQ ID NO: 30957 - RNA, 64 nt, Homo Sapiens
aaacuuauugcacuaaauacaggcucuguacaaaaaaaaaaaaaaaaaaaaagccucagcauuu

SEQ ID NO: 30958 - RNA, 64 nt, Homo Sapiens
aacuuauugcacuaaauacaggcucuguacaaaaaaaaaaaaaaaaaaaaagccucagcauuuu

SEQ ID NO: 30959 - RNA, 64 nt, Homo Sapiens
acuuauugcacuaaauacaggcucuguacaaaaaaaaaaaaaaaaaaaaagccucagcauuuua

SEQ ID NO: 30960 - RNA, 64 nt, Homo Sapiens
cuuauugcacuaaauacaggcucuguacaaaaaaaaaaaaaaaaaaaaagccucagcauuuuau

SEQ ID NO: 30961 - RNA, 64 nt, Homo Sapiens
uuauugcacuaaauacaggcucuguacaaaaaaaaaaaaaaaaaaaaagccucagcauuuuauc

SEQ ID NO: 30962 - RNA, 64 nt, Homo Sapiens
uauugcacuaaauacaggcucuguacaaaaaaaaaaaaaaaaaaaaagccucagcauuuuauca

SEQ ID NO: 30963 - RNA, 64 nt, Homo Sapiens
auugcacuaaauacaggcucuguacaaaaaaaaaaaaaaaaaaaaagccucagcauuuuaucau

SEQ ID NO: 30964 - RNA, 64 nt, Homo Sapiens
uugcacuaaauacaggcucuguacaaaaaaaaaaaaaaaaaaaaagccucagcauuuuaucauu

SEQ ID NO: 30965 - RNA, 64 nt, Homo Sapiens
ugcacuaaauacaggcucuguacaaaaaaaaaaaaaaaaaaaaagccucagcauuuuaucauuc

SEQ ID NO: 30966 - RNA, 64 nt, Homo Sapiens
gcacuaaauacaggcucuguacaaaaaaaaaaaaaaaaaaaaagccucagcauuuuaucauucc

SEQ ID NO: 30967 - RNA, 64 nt, Homo Sapiens
cacuaaauacaggcucuguacaaaaaaaaaaaaaaaaaaaaagccucagcauuuuaucauucca

SEQ ID NO: 30968 - RNA, 64 nt, Homo Sapiens
agcuuuuucaagaccuaacugcagccgcuuugggaaaaaaaaacaaaaaacaaaaaacagaaaa

SEQ ID NO: 30969 - RNA, 64 nt, Homo Sapiens
gcuuuuucaagaccuaacugcagccgcuuugggaaaaaaaaacaaaaaacaaaaaacagaaaac

SEQ ID NO: 30970 - RNA, 64 nt, Homo Sapiens
ucugucuacucagaucauagugaaaacuggaaacaaaaaaaaaaaacagccucuucuuggaaag

SEQ ID NO: 30971 - RNA, 64 nt, Homo Sapiens
cugucuacucagaucauagugaaaacuggaaacaaaaaaaaaaaacagccucuucuuggaaagu

SEQ ID NO: 30972 - RNA, 64 nt, Homo Sapiens
ugucuacucagaucauagugaaaacuggaaacaaaaaaaaaaaacagccucuucuuggaaagug

SEQ ID NO: 30973 - RNA, 64 nt, Homo Sapiens
gucuacucagaucauagugaaaacuggaaacaaaaaaaaaaaacagccucuucuuggaaaguga

SEQ ID NO: 30974 - RNA, 64 nt, Homo Sapiens
ucuacucagaucauagugaaaacuggaaacaaaaaaaaaaaacagccucuucuuggaaagugac

SEQ ID NO: 30975 - RNA, 64 nt, Homo Sapiens
gauggugggggcauuuuuagagcggcaauaauugaaaaaaaaggcgaacucugccuuggagagg

SEQ ID NO: 30976 - RNA, 64 nt, Homo Sapiens
gaugagaaaauuuucaauucuggccaugagaaagaaaaaaaaauaaacagccuucuuuuuuuuu

SEQ ID NO: 30977 - RNA, 64 nt, Homo Sapiens
augagaaaauuuucaauucuggccaugagaaagaaaaaaaaauaaacagccuucuuuuuuuuuc

SEQ ID NO: 30978 - RNA, 64 nt, Homo Sapiens
aacuaaagaauggauuuaauuaaacuauguauugaaaaaaaaguagccuaaguguuagagaugg

SEQ ID NO: 30979 - RNA, 64 nt, Homo Sapiens
cuccagccuggaugacagagcaaaaaacugucucaaaaaaaaaaaaaucuuacaaccucacaaa

SEQ ID NO: 30980 - RNA, 64 nt, Homo Sapiens
uccagccuggaugacagagcaaaaaacugucucaaaaaaaaaaaaaucuuacaaccucacaaau

SEQ ID NO: 30981 - RNA, 64 nt, Homo Sapiens
ccagccuggaugacagagcaaaaaacugucucaaaaaaaaaaaaaucuuacaaccucacaaaua

SEQ ID NO: 30982 - RNA, 64 nt, Homo Sapiens
cagccuggaugacagagcaaaaaacugucucaaaaaaaaaaaaaucuuacaaccucacaaauaa

SEQ ID NO: 30983 - RNA, 64 nt, Homo Sapiens
agccuggaugacagagcaaaaaacugucucaaaaaaaaaaaaaucuuacaaccucacaaauaac

SEQ ID NO: 30984 - RNA, 64 nt, Homo Sapiens
gccuggaugacagagcaaaaaacugucucaaaaaaaaaaaaaucuuacaaccucacaaauaacc

SEQ ID NO: 30985 - RNA, 60 nt, Homo Sapiens
agaugaaugccagacugugaaggaaaauauaaaaaaaaagucgacugcuaugcucaaaaa

SEQ ID NO: 30986 - RNA, 61 nt, Homo Sapiens
agaugaaugccagacugugaaggaaaauauaaaaaaaaagucgacugcuaugcucaaaaag

SEQ ID NO: 30987 - RNA, 64 nt, Homo Sapiens
uccagccugggugacaagagugaaacuccaucucaaaaaaaaagaaaagaagguccagcuuuug

SEQ ID NO: 30988 - RNA, 64 nt, Homo Sapiens
ccagccugggugacaagagugaaacuccaucucaaaaaaaaagaaaagaagguccagcuuuugg

SEQ ID NO: 30989 - RNA, 64 nt, Homo Sapiens
uccagccugggcgacaagagcaaaacuccgucucaaaaaaaaaaaaaagauacaaagucugcau

SEQ ID NO: 30990 - RNA, 64 nt, Homo Sapiens
ccagccugggcgacaagagcaaaacuccgucucaaaaaaaaaaaaaagauacaaagucugcauu

SEQ ID NO: 30991 - RNA, 64 nt, Homo Sapiens
cagccugggcgacaagagcaaaacuccgucucaaaaaaaaaaaaaagauacaaagucugcauuu

SEQ ID NO: 30992 - RNA, 64 nt, Homo Sapiens
agccugggcgacaagagcaaaacuccgucucaaaaaaaaaaaaaagauacaaagucugcauuug

SEQ ID NO: 30993 - RNA, 64 nt, Homo Sapiens
gccugggcgacaagagcaaaacuccgucucaaaaaaaaaaaaaagauacaaagucugcauuuga

SEQ ID NO: 30994 - RNA, 64 nt, Homo Sapiens
ccugggcgacaagagcaaaacuccgucucaaaaaaaaaaaaaagauacaaagucugcauuugau

SEQ ID NO: 30995 - RNA, 64 nt, Homo Sapiens
cugggcgacaagagcaaaacuccgucucaaaaaaaaaaaaaagauacaaagucugcauuugaua

SEQ ID NO: 30996 - RNA, 64 nt, Homo Sapiens
cucuagccugugugacagagcaagacccugucucaaaaaaaaaaaaaauuuguucgaaugccuu

SEQ ID NO: 30997 - RNA, 64 nt, Homo Sapiens
ucuagccugugugacagagcaagacccugucucaaaaaaaaaaaaaauuuguucgaaugccuua

SEQ ID NO: 30998 - RNA, 64 nt, Homo Sapiens
cuagccugugugacagagcaagacccugucucaaaaaaaaaaaaaauuuguucgaaugccuuau

SEQ ID NO: 30999 - RNA, 64 nt, Homo Sapiens
uagccugugugacagagcaagacccugucucaaaaaaaaaaaaaauuuguucgaaugccuuaua

SEQ ID NO: 31000 - RNA, 64 nt, Homo Sapiens
agccugugugacagagcaagacccugucucaaaaaaaaaaaaaauuuguucgaaugccuuauag

SEQ ID NO: 31001 - RNA, 64 nt, Homo Sapiens
gccugugugacagagcaagacccugucucaaaaaaaaaaaaaauuuguucgaaugccuuauagc

SEQ ID NO: 31002 - RNA, 64 nt, Homo Sapiens
ccugugugacagagcaagacccugucucaaaaaaaaaaaaaauuuguucgaaugccuuauagcc

SEQ ID NO: 31003 - RNA, 64 nt, Homo Sapiens
ccacauaaaauacacuaacgauagcugaugagcuaaaaaaaaaaaaaaagucuguguauaauuu

SEQ ID NO: 31004 - RNA, 64 nt, Homo Sapiens
cacauaaaauacacuaacgauagcugaugagcuaaaaaaaaaaaaaaagucuguguauaauuuu

SEQ ID NO: 31005 - RNA, 64 nt, Homo Sapiens
acauaaaauacacuaacgauagcugaugagcuaaaaaaaaaaaaaaagucuguguauaauuuuu

SEQ ID NO: 31006 - RNA, 64 nt, Homo Sapiens
cauaaaauacacuaacgauagcugaugagcuaaaaaaaaaaaaaaagucuguguauaauuuuug

SEQ ID NO: 31007 - RNA, 64 nt, Homo Sapiens
auaaaauacacuaacgauagcugaugagcuaaaaaaaaaaaaaaagucuguguauaauuuuugu

SEQ ID NO: 31008 - RNA, 64 nt, Homo Sapiens
uaaaauacacuaacgauagcugaugagcuaaaaaaaaaaaaaaagucuguguauaauuuuugug

SEQ ID NO: 31009 - RNA, 64 nt, Homo Sapiens
aaaauacacuaacgauagcugaugagcuaaaaaaaaaaaaaaagucuguguauaauuuuuguga

SEQ ID NO: 31010 - RNA, 64 nt, Homo Sapiens
aaauacacuaacgauagcugaugagcuaaaaaaaaaaaaaaagucuguguauaauuuuugugau

SEQ ID NO: 31011 - RNA, 64 nt, Homo Sapiens
ucaguguugacuuuuucuuucuuagaucuaguuuaaaaaaaaaaaaaaccacauaacaauucuu

SEQ ID NO: 31012 - RNA, 64 nt, Homo Sapiens
caguguugacuuuuucuuucuuagaucuaguuuaaaaaaaaaaaaaaccacauaacaauucuuu

SEQ ID NO: 31013 - RNA, 64 nt, Homo Sapiens
aguguugacuuuuucuuucuuagaucuaguuuaaaaaaaaaaaaaaccacauaacaauucuuug

SEQ ID NO: 31014 - RNA, 64 nt, Homo Sapiens
guguugacuuuuucuuucuuagaucuaguuuaaaaaaaaaaaaaaccacauaacaauucuuuga

SEQ ID NO: 31015 - RNA, 64 nt, Homo Sapiens
uguugacuuuuucuuucuuagaucuaguuuaaaaaaaaaaaaaaccacauaacaauucuuugaa

SEQ ID NO: 31016 - RNA, 64 nt, Homo Sapiens
guugacuuuuucuuucuuagaucuaguuuaaaaaaaaaaaaaaccacauaacaauucuuugaag

SEQ ID NO: 31017 - RNA, 64 nt, Homo Sapiens
uugacuuuuucuuucuuagaucuaguuuaaaaaaaaaaaaaaccacauaacaauucuuugaaga

SEQ ID NO: 31018 - RNA, 64 nt, Homo Sapiens
uguacuuuuugugcaugaccuggaccugcuaaggaaaaaaaaaucuuguggauugauugcuuug

SEQ ID NO: 31019 - RNA, 64 nt, Homo Sapiens
guacuuuuugugcaugaccuggaccugcuaaggaaaaaaaaaucuuguggauugauugcuuugc

SEQ ID NO: 31020 - RNA, 64 nt, Homo Sapiens
ccaaggcagguguuguuaaucuaucauagcacuuaaaaaaaaaaaaaaaaagagaccaaaaaua

SEQ ID NO: 31021 - RNA, 64 nt, Homo Sapiens
caaggcagguguuguuaaucuaucauagcacuuaaaaaaaaaaaaaaaaagagaccaaaaauaa

SEQ ID NO: 31022 - RNA, 64 nt, Homo Sapiens
aaggcagguguuguuaaucuaucauagcacuuaaaaaaaaaaaaaaaaagagaccaaaaauaac

SEQ ID NO: 31023 - RNA, 64 nt, Homo Sapiens
aggcagguguuguuaaucuaucauagcacuuaaaaaaaaaaaaaaaaagagaccaaaaauaacu

SEQ ID NO: 31024 - RNA, 64 nt, Homo Sapiens
ggcagguguuguuaaucuaucauagcacuuaaaaaaaaaaaaaaaaagagaccaaaaauaacuu

SEQ ID NO: 31025 - RNA, 64 nt, Homo Sapiens
gcagguguuguuaaucuaucauagcacuuaaaaaaaaaaaaaaaaagagaccaaaaauaacuuu

SEQ ID NO: 31026 - RNA, 64 nt, Homo Sapiens
cagguguuguuaaucuaucauagcacuuaaaaaaaaaaaaaaaaagagaccaaaaauaacuuua

SEQ ID NO: 31027 - RNA, 64 nt, Homo Sapiens
agguguuguuaaucuaucauagcacuuaaaaaaaaaaaaaaaaagagaccaaaaauaacuuuag

SEQ ID NO: 31028 - RNA, 64 nt, Homo Sapiens
gguguuguuaaucuaucauagcacuuaaaaaaaaaaaaaaaaagagaccaaaaauaacuuuagg

SEQ ID NO: 31029 - RNA, 64 nt, Homo Sapiens
guguuguuaaucuaucauagcacuuaaaaaaaaaaaaaaaaagagaccaaaaauaacuuuagga

SEQ ID NO: 31030 - RNA, 64 nt, Homo Sapiens
uguuuuuuucuggaacuacuucaagugagaaaauaaaaaaaaauggugacaaagcuguacagau

SEQ ID NO: 31031 - RNA, 64 nt, Homo Sapiens
guuuuuuucuggaacuacuucaagugagaaaauaaaaaaaaauggugacaaagcuguacagaua

SEQ ID NO: 31032 - RNA, 64 nt, Homo Sapiens
gagccuuuuuuuuuuuaaucuucguaacauguuuaaaaaaaaacagugauuuuaacugcauauu

SEQ ID NO: 31033 - RNA, 64 nt, Homo Sapiens
agccuuuuuuuuuuuaaucuucguaacauguuuaaaaaaaaacagugauuuuaacugcauauuu

SEQ ID NO: 31034 - RNA, 64 nt, Homo Sapiens
accacauuuuaggaucucgccuggaaacagagguaaaaaaaagaagugugcgcccggcuaaugc

SEQ ID NO: 31035 - RNA, 64 nt, Homo Sapiens
guauauuuaugaccagagcaaaaauguaaaaaacaaaaaaaacaacaaaaaaaguuuguuacuu

SEQ ID NO: 31036 - RNA, 64 nt, Homo Sapiens
ugaugcgugcuacuugcuauuaugagagaagcuuaaaaaaaaaaaggaagauauuucugaaaga

SEQ ID NO: 31037 - RNA, 64 nt, Homo Sapiens
gaugcgugcuacuugcuauuaugagagaagcuuaaaaaaaaaaaggaagauauuucugaaagac

SEQ ID NO: 31038 - RNA, 64 nt, Homo Sapiens
augcgugcuacuugcuauuaugagagaagcuuaaaaaaaaaaaggaagauauuucugaaagacc

SEQ ID NO: 31039 - RNA, 64 nt, Homo Sapiens
ugcgugcuacuugcuauuaugagagaagcuuaaaaaaaaaaaggaagauauuucugaaagacca

SEQ ID NO: 31040 - RNA, 64 nt, Homo Sapiens
caucaaaucuuguugaguuuaaaaaauaaacagcaaaaaaaaacaaaacaaaacaaaaaaaaac

SEQ ID NO: 31041 - RNA, 64 nt, Homo Sapiens
aucaaaucuuguugaguuuaaaaaauaaacagcaaaaaaaaacaaaacaaaacaaaaaaaaaca

SEQ ID NO: 31042 - RNA, 64 nt, Homo Sapiens
auguaucugucuacuuucucuuguuuaaaaaaagaaaaaaaaacuuaaaaaaaugggguuauag

SEQ ID NO: 31043 - RNA, 64 nt, Homo Sapiens
uguaucugucuacuuucucuuguuuaaaaaaagaaaaaaaaacuuaaaaaaaugggguuauaga

SEQ ID NO: 31044 - RNA, 64 nt, Homo Sapiens
guuuuuuuuuuuuuaaucaaaaaacaauuuuuuuaaaaaaaaagcuuugaaaauggaugguuug

SEQ ID NO: 31045 - RNA, 64 nt, Homo Sapiens
uuuuuuuuuuuuuaaucaaaaaacaauuuuuuuaaaaaaaaagcuuugaaaauggaugguuugg

SEQ ID NO: 31046 - RNA, 64 nt, Homo Sapiens
agcuuugaaaauggaugguuuggguauuaaaaagaaaaaaaaaacuuaaaaaaaaaaagacacu

SEQ ID NO: 31047 - RNA, 64 nt, Homo Sapiens
gcuuugaaaauggaugguuuggguauuaaaaagaaaaaaaaaacuuaaaaaaaaaaagacacua

SEQ ID NO: 31048 - RNA, 64 nt, Homo Sapiens
cuuugaaaauggaugguuuggguauuaaaaagaaaaaaaaaacuuaaaaaaaaaaagacacuaa

SEQ ID NO: 31049 - RNA, 64 nt, Homo Sapiens
gaugguuuggguauuaaaaagaaaaaaaaaacuuaaaaaaaaaaagacacuaacggccagugag

SEQ ID NO: 31050 - RNA, 64 nt, Homo Sapiens
augguuuggguauuaaaaagaaaaaaaaaacuuaaaaaaaaaaagacacuaacggccagugagu

SEQ ID NO: 31051 - RNA, 64 nt, Homo Sapiens
ugguuuggguauuaaaaagaaaaaaaaaacuuaaaaaaaaaaagacacuaacggccagugaguu

SEQ ID NO: 31052 - RNA, 64 nt, Homo Sapiens
gguuuggguauuaaaaagaaaaaaaaaacuuaaaaaaaaaaagacacuaacggccagugaguug

SEQ ID NO: 31053 - RNA, 64 nt, Homo Sapiens
uuuuguuuuuuauuuugaacagacguuuuaaaagaaaaaaaaacaacuaccuucuguccuagaa

SEQ ID NO: 31054 - RNA, 64 nt, Homo Sapiens
uuuguuuuuuauuuugaacagacguuuuaaaagaaaaaaaaacaacuaccuucuguccuagaag

SEQ ID NO: 31055 - RNA, 64 nt, Homo Sapiens
ugggaggaugguggccugcagcggccaagaagccaaaaaaaauuuuuuuuuuuucagauacugu

SEQ ID NO: 31056 - RNA, 64 nt, Homo Sapiens
agccugggugacagagcgagacuguguuucaaagaaaaaaaaaaacaagcagccuuuugcuugg

SEQ ID NO: 31057 - RNA, 64 nt, Homo Sapiens
gccugggugacagagcgagacuguguuucaaagaaaaaaaaaaacaagcagccuuuugcuuggu

SEQ ID NO: 31058 - RNA, 64 nt, Homo Sapiens
ccugggugacagagcgagacuguguuucaaagaaaaaaaaaaacaagcagccuuuugcuugguu

SEQ ID NO: 31059 - RNA, 64 nt, Homo Sapiens
cugggugacagagcgagacuguguuucaaagaaaaaaaaaaacaagcagccuuuugcuugguug

SEQ ID NO: 31060 - RNA, 64 nt, Homo Sapiens
gauaagagaaaaugucuaaagcaucuggaaagguaaaaaaaaaaaaucuauuuuuguacaaaug

SEQ ID NO: 31061 - RNA, 64 nt, Homo Sapiens
auaagagaaaaugucuaaagcaucuggaaagguaaaaaaaaaaaaucuauuuuuguacaaaugu

SEQ ID NO: 31062 - RNA, 64 nt, Homo Sapiens
uaagagaaaaugucuaaagcaucuggaaagguaaaaaaaaaaaaucuauuuuuguacaaaugua

SEQ ID NO: 31063 - RNA, 64 nt, Homo Sapiens
aagagaaaaugucuaaagcaucuggaaagguaaaaaaaaaaaaucuauuuuuguacaaauguaa

SEQ ID NO: 31064 - RNA, 64 nt, Homo Sapiens
agagaaaaugucuaaagcaucuggaaagguaaaaaaaaaaaaucuauuuuuguacaaauguaau

SEQ ID NO: 31065 - RNA, 64 nt, Homo Sapiens
gauuaauaaguggaugguuuuuguuucuaaaaagaaaaaaaaaaucaguguucacccuuauaga

SEQ ID NO: 31066 - RNA, 64 nt, Homo Sapiens
auuaauaaguggaugguuuuuguuucuaaaaagaaaaaaaaaaucaguguucacccuuauagag

SEQ ID NO: 31067 - RNA, 64 nt, Homo Sapiens
uuaauaaguggaugguuuuuguuucuaaaaagaaaaaaaaaaucaguguucacccuuauagaga

SEQ ID NO: 31068 - RNA, 64 nt, Homo Sapiens
gaccauuucuuguucuguuuccaaugaaaucaauaaaaaaaaagaaguacuuuaaaugggguuu

SEQ ID NO: 31069 - RNA, 64 nt, Homo Sapiens
accauuucuuguucuguuuccaaugaaaucaauaaaaaaaaagaaguacuuuaaaugggguuuu

SEQ ID NO: 31070 - RNA, 64 nt, Homo Sapiens
aaaaaaagaaaaaaggaaaaaaaagaaaaaaugaaaaaaaaaggacccaguuugaaaucuuaaa

SEQ ID NO: 31071 - RNA, 64 nt, Homo Sapiens
gaaaaaaagaaaaaaggaaaaaaaagaaaaaaugaaaaaaaaagaacccaguuugaaaucuuaa

SEQ ID NO: 31072 - RNA, 64 nt, Homo Sapiens
uaugaaaucucuguagccuugauuucuaaaaguuaaaaaaaauaagccauuuuauaagcacucu

SEQ ID NO: 31073 - RNA, 64 nt, Homo Sapiens
aaaagaggaagacuggacaauuuuuuuuuaaauaaaaaaaaaggacaacaauaguuuaagaaau

SEQ ID NO: 31074 - RNA, 64 nt, Homo Sapiens
gaaaagaggaagacuggacauuuuuuuuuuaaauaaaaaaaaagcacaacaauaguuuaagaaa

SEQ ID NO: 31075 - RNA, 64 nt, Homo Sapiens
cacuuguauaaaaauggucuuaagugucuuuuuuaaaaaaaauuaaacuauugccauacuucag

SEQ ID NO: 31076 - RNA, 64 nt, Homo Sapiens
aaaaagaaacaaaaaggaaccaaaaauaaaagggaaaaaaaagaguacccaugacuguugccug

SEQ ID NO: 31077 - RNA, 64 nt, Homo Sapiens
guuguagaaauucuuaauuuuccuguuuucuaaaaaaaaaaacuuuaaaaaaaaagaauucugg

SEQ ID NO: 31078 - RNA, 64 nt, Homo Sapiens
uguuguagaaauucuuaauuguccuguuuucuaaaaaaaaaaacuuuaaaaaaaaagaauucug

SEQ ID NO: 31079 - RNA, 64 nt, Homo Sapiens
cuguuguagaaauucuuaaugguccuguuuucuaaaaaaaaaaaauuuaaaaaaaaagaauucu

SEQ ID NO: 31080 - RNA, 64 nt, Homo Sapiens
acuguuguagaaauucuuaaugguccuguuuucuaaaaaaaaaacauuuaaaaaaaaagaauuc

SEQ ID NO: 31081 - RNA, 64 nt, Homo Sapiens
auucugguccuguuuucuaaaggaucaucauuuaaaaaaaaagauggaaguaaaggcauuccac

SEQ ID NO: 31082 - RNA, 64 nt, Homo Sapiens
aauucugguccuguuuucuacaggaucaucauuuaaaaaaaaagauggaaguaaaggcauucca

SEQ ID NO: 31083 - RNA, 64 nt, Homo Sapiens
aaauuuccaagcaugguaucgagacuccaucucaaaaaaaaagauccagccugggcgaaagagu

SEQ ID NO: 31084 - RNA, 64 nt, Homo Sapiens
aaaauuuccaagcaugguauugagacuccaucucaaaaaaaaagcuccagccugggcgaaagag

SEQ ID NO: 31085 - RNA, 64 nt, Homo Sapiens
aucugaguuauucagccagucugaccaugaaaaaaaaaaaaauaagagacuuacuagagacugg

SEQ ID NO: 31086 - RNA, 64 nt, Homo Sapiens
aaucugaguuauucagccaggcugaccaugaaaaaaaaaaaaauuagagacuuacuagagacug

SEQ ID NO: 31087 - RNA, 64 nt, Homo Sapiens
uaaucugaguuauucagccaggcugaccaugaaaaaaaaaaaaacuagagacuuacuagagacu

SEQ ID NO: 31088 - RNA, 64 nt, Homo Sapiens
auaaucugaguuauucagccuggcugaccaugaaaaaaaaaaaaccuagagacuuacuagagac

SEQ ID NO: 31089 - RNA, 64 nt, Homo Sapiens
aauaaucugaguuauucagccuggcugaccaugaaaaaaaaaaacccuagagacuuacuagaga

SEQ ID NO: 31090 - RNA, 64 nt, Homo Sapiens
aaauaaucugaguuauucagacuggcugaccaugaaaaaaaaaaucccuagagacuuacuagag

SEQ ID NO: 31091 - RNA, 64 nt, Homo Sapiens
uucaguaggauguuuuguacacuuguauauuuaaaaaaaaaaucacuucuaucauuuuaaacug

SEQ ID NO: 31092 - RNA, 64 nt, Homo Sapiens
cuucaguaggauguuuuguagacuuguauauuuaaaaaaaaaauaacuucuaucauuuuaaacu

SEQ ID NO: 31093 - RNA, 64 nt, Homo Sapiens
ucuucaguaggauguuuuguugacuuguauauuuaaaaaaaaaagaacuucuaucauuuuaaac

SEQ ID NO: 31094 - RNA, 64 nt, Homo Sapiens
auauauauauucuccuuuuaagaagggaaauuggaaaaaaaauucccccucuucucugggugua

SEQ ID NO: 31095 - RNA, 64 nt, Homo Sapiens
auguuuaaaauggcaaaagcaaucuuuuuuaaugaaaaaaaaucauacaaaucacauauaguuu

SEQ ID NO: 31096 - RNA, 64 nt, Homo Sapiens
guaacaaauucucgcuccaugugggucacuuaagaaaaaaaagucucuuuauuggugguccuaa

SEQ ID NO: 31097 - RNA, 64 nt, Homo Sapiens
aaaacccucacagucuuccucuuggcccuuaaaaaaaaaaaagaugauaaauauuacauuuacc

SEQ ID NO: 31098 - RNA, 64 nt, Homo Sapiens
aaaaacccucacagucuuccccuuggcccuuaaaaaaaaaaaagaugauaaauauuacauuuac

SEQ ID NO: 31099 - RNA, 64 nt, Homo Sapiens
gaaaaacccucacagucuuccccuuggcccuuaaaaaaaaaaaaaaugauaaauauuacauuua

SEQ ID NO: 31100 - RNA, 64 nt, Homo Sapiens
agaaaaacccucacagucuuacccuuggcccuuaaaaaaaaaaauaaugauaaauauuacauuu

SEQ ID NO: 31101 - RNA, 64 nt, Homo Sapiens
aagaaaaacccucacagucuuacccuuggcccuuaaaaaaaaaacuaaugauaaauauuacauu

SEQ ID NO: 31102 - RNA, 64 nt, Homo Sapiens
ccauagcacagcugucuuuacuuuugagauuaaaaaaaaaaacgacucucuugaaucacguuaa

SEQ ID NO: 31103 - RNA, 64 nt, Homo Sapiens
gccauagcacagcugucuuuacuuuugagauuaaaaaaaaaaaccacucucuugaaucacguua

SEQ ID NO: 31104 - RNA, 64 nt, Homo Sapiens
cgccauagcacagcugucuuaacuuuugagauuaaaaaaaaaaaccacucucuugaaucacguu

SEQ ID NO: 31105 - RNA, 64 nt, Homo Sapiens
acgccauagcacagcugucuuaacuuuugagauuaaaaaaaaaaaccacucucuugaaucacgu

SEQ ID NO: 31106 - RNA, 64 nt, Homo Sapiens
aaaugcauuaaauagaaggucaucucuauaaauaaaaaaaaaggugggcaacauagcgagacuc

SEQ ID NO: 31107 - RNA, 64 nt, Homo Sapiens
gaaaugcauuaaauagaaggccaucucuauaaauaaaaaaaaagcugggcaacauagcgagacu

SEQ ID NO: 31108 - RNA, 64 nt, Homo Sapiens
ugaaaaaaguuccuguggauuguacaauucaaaaaaaaaaaagagauuauguaggaaauguuug

SEQ ID NO: 31109 - RNA, 64 nt, Homo Sapiens
augaaaaaaguuccuguggaguguacaauucaaaaaaaaaaaagggauuauguaggaaauguuu

SEQ ID NO: 31110 - RNA, 64 nt, Homo Sapiens
gaugaaaaaaguuccugugguguguacaauucaaaaaaaaaaaauggauuauguaggaaauguu

SEQ ID NO: 31111 - RNA, 64 nt, Homo Sapiens
agaugaaaaaaguuccuguguuguguacaauucaaaaaaaaaaauuggauuauguaggaaaugu

SEQ ID NO: 31112 - RNA, 64 nt, Homo Sapiens
aagaugaaaaaaguuccuguuuuguguacaauucaaaaaaaaaaguuggauuauguaggaaaug

SEQ ID NO: 31113 - RNA, 64 nt, Homo Sapiens
ugaguaucauugcaugaauuggauuuaccuuuaaaaaaaaaaccgcauugaaugaucaaauauu

SEQ ID NO: 31114 - RNA, 64 nt, Homo Sapiens
cugaguaucauugcaugaauuggauuuaccuuuaaaaaaaaaacagcauugaaugaucaaauau

SEQ ID NO: 31115 - RNA, 64 nt, Homo Sapiens
ccugaguaucauugcaugaauuggauuuaccuuuaaaaaaaaaauagcauugaaugaucaaaua

SEQ ID NO: 31116 - RNA, 64 nt, Homo Sapiens
uaaauuauugaaugaguaguuaauaggcacuugaaaaaaaaagacuuugcucugguuaaaacag

SEQ ID NO: 31117 - RNA, 64 nt, Homo Sapiens
auaaauuauugaaugaguagguaauaggcacuugaaaaaaaaagccuuugcucugguuaaaaca

SEQ ID NO: 31118 - RNA, 64 nt, Homo Sapiens
caaucugaggaaagacugcagguuugcacccaaaaaaaaaaaccucauuggagagccuuacuug

SEQ ID NO: 31119 - RNA, 64 nt, Homo Sapiens
ccaaucugaggaaagacugcggguuugcacccaaaaaaaaaaacuucauuggagagccuuacuu

SEQ ID NO: 31120 - RNA, 64 nt, Homo Sapiens
cccaaucugaggaaagacuguggguuugcacccaaaaaaaaaaaauucauuggagagccuuacu

SEQ ID NO: 31121 - RNA, 64 nt, Homo Sapiens
acccaaucugaggaaagacuuuggguuugcacccaaaaaaaaaacauucauuggagagccuuac

SEQ ID NO: 31122 - RNA, 64 nt, Homo Sapiens
aacaucuucauagaugaauguuuucaaaauucaaaaaaaaaagcaaggaaauuuagauuggucc

SEQ ID NO: 31123 - RNA, 64 nt, Homo Sapiens
caacaucuucauagaugaaucuuuucaaaauucaaaaaaaaaagaaaggaaauuuagauugguc

SEQ ID NO: 31124 - RNA, 64 nt, Homo Sapiens
gcaacaucuucauagaugaaccuuuucaaaauucaaaaaaaaaauaaaggaaauuuagauuggu

SEQ ID NO: 31125 - RNA, 64 nt, Homo Sapiens
uauauacugcuguaucaugcgucucaaaaaaaacaaaaaaaacaggggacagagcaagacucuu

SEQ ID NO: 31126 - RNA, 64 nt, Homo Sapiens
aaaaaaacauauauacugcuaagacucuugucucaaaaaaaacacuccagccuggggacagagc

SEQ ID NO: 31127 - RNA, 64 nt, Homo Sapiens
caagcgccucaccuuagcauuccaugaaauaacaaaaaaaaauaugaaaaggcuuccaggaguu

SEQ ID NO: 31128 - RNA, 64 nt, Homo Sapiens
acaagcgccucaccuuagcauuccaugaaauaacaaaaaaaaauaugaaaaggcuuccaggagu

SEQ ID NO: 31129 - RNA, 64 nt, Homo Sapiens
ccuguagaaauauuauuccauauacacacacacaaaaaaaaauaacaauuaauuguacauaaug

SEQ ID NO: 31130 - RNA, 64 nt, Homo Sapiens
accuguagaaauauuauuccguauacacacacacaaaaaaaaaugacaauuaauuguacauaau

SEQ ID NO: 31131 - RNA, 64 nt, Homo Sapiens
uuaacacaucacaggucaagguagcuuuuagggaaaaaaaaaugagagagguuauggagguacu

SEQ ID NO: 31132 - RNA, 64 nt, Homo Sapiens
guuaacacaucacaggucaauguagcuuuuagggaaaaaaaaauaagagagguuauggagguac

SEQ ID NO: 31133 - RNA, 64 nt, Homo Sapiens
aaaaaacuagacaaggagagaaaaaaaaaaaaaaaaaaaaaacaugggauaucaaacuugcaaa

SEQ ID NO: 31134 - RNA, 64 nt, Homo Sapiens
aaaaaaacuagacaaggagaaaaaaaaaaaaaaaaaaaaaaaaccugggauaucaaacuugcaa

SEQ ID NO: 31135 - RNA, 64 nt, Homo Sapiens
caaaaaaacuagacaaggagaaaaaaaaaaaaaaaaaaaaaaaagcugggauaucaaacuugca

SEQ ID NO: 31136 - RNA, 64 nt, Homo Sapiens
acaaaaaaacuagacaaggaaaaaaaaaaaaaaaaaaaaaaaaacgcugggauaucaaacuugc

SEQ ID NO: 31137 - RNA, 64 nt, Homo Sapiens
aacaaaaaaacuagacaaggcaaaaaaaaaaaaaaaaaaaaaaagcgcugggauaucaaacuug

SEQ ID NO: 31138 - RNA, 64 nt, Homo Sapiens
aaacaaaaaaacuagacaaggcaaaaaaaaaaaaaaaaaaaaaaggcgcugggauaucaaacuu

SEQ ID NO: 31139 - RNA, 64 nt, Homo Sapiens
aaaacaaaaaaacuagacaaugcaaaaaaaaaaaaaaaaaaaaaaggcgcugggauaucaaacu

SEQ ID NO: 31140 - RNA, 64 nt, Homo Sapiens
aaaaacaaaaaaacuagacauugcaaaaaaaaaaaaaaaaaaaagaggcgcugggauaucaaac

SEQ ID NO: 31141 - RNA, 64 nt, Homo Sapiens
aaaaaacaaaaaaacuagaccuugcaaaaaaaaaaaaaaaaaaaggaggcgcugggauaucaaa

SEQ ID NO: 31142 - RNA, 64 nt, Homo Sapiens
aaaaaaacaaaaaaacuagaacuugcaaaaaaaaaaaaaaaaaaaggaggcgcugggauaucaa

SEQ ID NO: 31143 - RNA, 64 nt, Homo Sapiens
aaaaaaaacaaaaaaacuagaacuugcaaaaaaaaaaaaaaaaaaaggaggcgcugggauauca

SEQ ID NO: 31144 - RNA, 64 nt, Homo Sapiens
aaaaaaaaacaaaaaaacuaaaacuugcaaaaaaaaaaaaaaaacaaggaggcgcugggauauc

SEQ ID NO: 31145 - RNA, 64 nt, Homo Sapiens
aaaaaaaaaacaaaaaaacucaaacuugcaaaaaaaaaaaaaaaacaaggaggcgcugggauau

SEQ ID NO: 31146 - RNA, 64 nt, Homo Sapiens
aaaaaaaaaaacaaaaaaacucaaacuugcaaaaaaaaaaaaaaaacaaggaggcgcugggaua

SEQ ID NO: 31147 - RNA, 64 nt, Homo Sapiens
aaaaaaaaaaaacaaaaaaaaucaaacuugcaaaaaaaaaaaaaaaacaaggaggcgcugggau

SEQ ID NO: 31148 - RNA, 64 nt, Homo Sapiens
aaaaaaaaaaaaacaaaaaauaucaaacuugcaaaaaaaaaaaacaaacaaggaggcgcuggga

SEQ ID NO: 31149 - RNA, 64 nt, Homo Sapiens
aaaaaaaaaaaaaacaaaaaauaucaaacuugcaaaaaaaaaaagcaaacaaggaggcgcuggg

SEQ ID NO: 31150 - RNA, 64 nt, Homo Sapiens
aaaaaaaaaaaaaaacaaaagauaucaaacuugcaaaaaaaaaaugcaaacaaggaggcgcugg

SEQ ID NO: 31151 - RNA, 64 nt, Homo Sapiens
ugcuaggauuuaaaaauaaaguagccucuuaaaaaaaaaaaaccaugcauugucauuuaauaua

SEQ ID NO: 31152 - RNA, 64 nt, Homo Sapiens
cugcuaggauuuaaaaauaaaguagccucuuaaaaaaaaaaaacaaugcauugucauuuaauau

SEQ ID NO: 31153 - RNA, 64 nt, Homo Sapiens
ccugcuaggauuuaaaaauauaguagccucuuaaaaaaaaaaaaaaaugcauugucauuuaaua

SEQ ID NO: 31154 - RNA, 64 nt, Homo Sapiens
accugcuaggauuuaaaaauauaguagccucuuaaaaaaaaaaaaaaaugcauugucauuuaau

SEQ ID NO: 31155 - RNA, 64 nt, Homo Sapiens
aaccugcuaggauuuaaaaauauaguagccucuuaaaaaaaaaacaaaaugcauugucauuuaa

SEQ ID NO: 31156 - RNA, 64 nt, Homo Sapiens
ccacaaauuuaaucacuuguaaaauagaaaaaaaaaaaaaaagugcuggcaacuggucuugacc

SEQ ID NO: 31157 - RNA, 64 nt, Homo Sapiens
uccacaaauuuaaucacuugcaaaauagaaaaaaaaaaaaaaagagcuggcaacuggucuugac

SEQ ID NO: 31158 - RNA, 64 nt, Homo Sapiens
guccacaaauuuaaucacuuccaaaauagaaaaaaaaaaaaaaaaagcuggcaacuggucuuga

SEQ ID NO: 31159 - RNA, 64 nt, Homo Sapiens
aguccacaaauuuaaucacuaccaaaauagaaaaaaaaaaaaaagaagcuggcaacuggucuug

SEQ ID NO: 31160 - RNA, 64 nt, Homo Sapiens
aaguccacaaauuuaaucacgaccaaaauagaaaaaaaaaaaaaagaagcuggcaacuggucuu

SEQ ID NO: 31161 - RNA, 64 nt, Homo Sapiens
aaaguccacaaauuuaaucaugaccaaaauagaaaaaaaaaaaaaagaagcuggcaacuggucu

SEQ ID NO: 31162 - RNA, 64 nt, Homo Sapiens
aaaaguccacaaauuuaaucuugaccaaaauagaaaaaaaaaaagaagaagcuggcaacugguc

SEQ ID NO: 31163 - RNA, 64 nt, Homo Sapiens
aaaaaguccacaaauuuaaucuugaccaaaauagaaaaaaaaaaggaagaagcuggcaacuggu

SEQ ID NO: 31164 - RNA, 64 nt, Homo Sapiens
gcuccuucuuuuggauuauugaaugucuguaaaaaaaaaaaacucuuauaaauagugcugcuau

SEQ ID NO: 31165 - RNA, 64 nt, Homo Sapiens
ugcuccuucuuuuggauuauugaaugucuguaaaaaaaaaaaacucuuauaaauagugcugcua

SEQ ID NO: 31166 - RNA, 64 nt, Homo Sapiens
cugcuccuucuuuuggauuaaugaaugucuguaaaaaaaaaaaacucuuauaaauagugcugcu

SEQ ID NO: 31167 - RNA, 64 nt, Homo Sapiens
acugcuccuucuuuuggauuuaugaaugucuguaaaaaaaaaaaacucuuauaaauagugcugc

SEQ ID NO: 31168 - RNA, 64 nt, Homo Sapiens
aacugcuccuucuuuuggaucuaugaaugucuguaaaaaaaaaacacucuuauaaauagugcug

SEQ ID NO: 31169 - RNA, 64 nt, Homo Sapiens
aaaaaccacauacaggaaaacuugucuugaaaaaaaaaaaaacaucugugugacagaaugagac

SEQ ID NO: 31170 - RNA, 64 nt, Homo Sapiens
aaaaaaccacauacaggaaaccuugucuugaaaaaaaaaaaaacgucugugugacagaaugaga

SEQ ID NO: 31171 - RNA, 64 nt, Homo Sapiens
caaaaaaccacauacaggaaaccuugucuugaaaaaaaaaaaaaagucugugugacagaaugag

SEQ ID NO: 31172 - RNA, 64 nt, Homo Sapiens
acaaaaaaccacauacaggagaccuugucuugaaaaaaaaaaaacagucugugugacagaauga

SEQ ID NO: 31173 - RNA, 64 nt, Homo Sapiens
aacaaaaaaccacauacaggagaccuugucuugaaaaaaaaaaaccagucugugugacagaaug

SEQ ID NO: 31174 - RNA, 64 nt, Homo Sapiens
aaacaaaaaaccacauacaggagaccuugucuugaaaaaaaaaauccagucugugugacagaau

SEQ ID NO: 31175 - RNA, 64 nt, Homo Sapiens
aaaaacucuguuguaaaaacacuggguuuaauuaaaaaaaaagacauugucuucuguacaucuu

SEQ ID NO: 31176 - RNA, 64 nt, Homo Sapiens
aaaaaacucuguuguaaaaauacuggguuuaauuaaaaaaaaagucauugucuucuguacaucu

SEQ ID NO: 31177 - RNA, 64 nt, Homo Sapiens
aaccaguucugugaaaacggcuaaaacuugaaaaaaaaaaaagaacaaaugcaaauuuaguucu

SEQ ID NO: 31178 - RNA, 64 nt, Homo Sapiens
aaaccaguucugugaaaacgucuaaaacuugaaaaaaaaaaaagaacaaaugcaaauuuaguuc

SEQ ID NO: 31179 - RNA, 64 nt, Homo Sapiens
gaaaccaguucugugaaaaccucuaaaacuugaaaaaaaaaaaauaacaaaugcaaauuuaguu

SEQ ID NO: 31180 - RNA, 64 nt, Homo Sapiens
agaaaccaguucugugaaaaucucuaaaacuugaaaaaaaaaaauuaacaaaugcaaauuuagu

SEQ ID NO: 31181 - RNA, 64 nt, Homo Sapiens
aagaaaccaguucugugaaauucucuaaaacuugaaaaaaaaaauuuaacaaaugcaaauuuag

SEQ ID NO: 31182 - RNA, 64 nt, Homo Sapiens
auccaauacugcccaaggauuccaccucaaaaaaaaaaaaaagaccuggcgacaagagugagac

SEQ ID NO: 31183 - RNA, 64 nt, Homo Sapiens
aauccaauacugcccaaggacuccaccucaaaaaaaaaaaaaaggccuggcgacaagagugaga

SEQ ID NO: 31184 - RNA, 64 nt, Homo Sapiens
gaauccaauacugcccaaggacuccaccucaaaaaaaaaaaaaaagccuggcgacaagagugag

SEQ ID NO: 31185 - RNA, 64 nt, Homo Sapiens
agaauccaauacugcccaaggacuccaccucaaaaaaaaaaaaacagccuggcgacaagaguga

SEQ ID NO: 31186 - RNA, 64 nt, Homo Sapiens
aagaauccaauacugcccaaagacuccaccucaaaaaaaaaaaaccagccuggcgacaagagug

SEQ ID NO: 31187 - RNA, 64 nt, Homo Sapiens
aaagaauccaauacugcccagagacuccaccucaaaaaaaaaaauccagccuggcgacaagagu

SEQ ID NO: 31188 - RNA, 64 nt, Homo Sapiens
aaaagaauccaauacugcccugagacuccaccucaaaaaaaaaacuccagccuggcgacaagag

SEQ ID NO: 31189 - RNA, 64 nt, Homo Sapiens
aauugaauugggggagucaucaaaaaaaaaaaaaaaaaaaaagagacagagcaagacuccgucu

SEQ ID NO: 31190 - RNA, 64 nt, Homo Sapiens
aaauugaauugggggagucaucaaaaaaaaaaaaaaaaaaaaagugacagagcaagacuccguc

SEQ ID NO: 31191 - RNA, 64 nt, Homo Sapiens
gaaauugaauugggggaguccucaaaaaaaaaaaaaaaaaaaaagugacagagcaagacuccgu

SEQ ID NO: 31192 - RNA, 64 nt, Homo Sapiens
agaaauugaauugggggaguucucaaaaaaaaaaaaaaaaaaaaggugacagagcaagacuccg

SEQ ID NO: 31193 - RNA, 64 nt, Homo Sapiens
aagaaauugaauugggggaggucucaaaaaaaaaaaaaaaaaaagggugacagagcaagacucc

SEQ ID NO: 31194 - RNA, 64 nt, Homo Sapiens
aaagaaauugaauugggggacgucucaaaaaaaaaaaaaaaaaaugggugacagagcaagacuc

SEQ ID NO: 31195 - RNA, 64 nt, Homo Sapiens
aaaagaaauugaauugggggccgucucaaaaaaaaaaaaaaaaacugggugacagagcaagacu

SEQ ID NO: 31196 - RNA, 64 nt, Homo Sapiens
aaaaagaaauugaauugggguccgucucaaaaaaaaaaaaaaaaccugggugacagagcaagac

SEQ ID NO: 31197 - RNA, 64 nt, Homo Sapiens
aaaaaagaaauugaauugggcuccgucucaaaaaaaaaaaaaaagccugggugacagagcaaga

SEQ ID NO: 31198 - RNA, 64 nt, Homo Sapiens
aaaaaaagaaauugaauuggacuccgucucaaaaaaaaaaaaaaagccugggugacagagcaag

SEQ ID NO: 31199 - RNA, 64 nt, Homo Sapiens
aaaaaaaagaaauugaauuggacuccgucucaaaaaaaaaaaaacagccugggugacagagcaa

SEQ ID NO: 31200 - RNA, 64 nt, Homo Sapiens
aaaaaaaaagaaauugaauuagacuccgucucaaaaaaaaaaaaccagccugggugacagagca

SEQ ID NO: 31201 - RNA, 64 nt, Homo Sapiens
aaaaaaaaaagaaauugaauaagacuccgucucaaaaaaaaaaauccagccugggugacagagc

SEQ ID NO: 31202 - RNA, 64 nt, Homo Sapiens
aaaaaaaaaaagaaauugaacaagacuccgucucaaaaaaaaaacuccagccugggugacagag

SEQ ID NO: 31203 - RNA, 64 nt, Homo Sapiens
augaaaaaaguuaugggauuucugucucaaaaaaaaaaaaaauuccugggcgacagagugagac

SEQ ID NO: 31204 - RNA, 64 nt, Homo Sapiens
uaugaaaaaaguuaugggaucucugucucaaaaaaaaaaaaaaugccugggcgacagagugaga

SEQ ID NO: 31205 - RNA, 64 nt, Homo Sapiens
uuaugaaaaaaguuaugggaacucugucucaaaaaaaaaaaaaaagccugggcgacagagugag

SEQ ID NO: 31206 - RNA, 64 nt, Homo Sapiens
auuaugaaaaaaguuauggggacucugucucaaaaaaaaaaaaacagccugggcgacagaguga

SEQ ID NO: 31207 - RNA, 64 nt, Homo Sapiens
aauuaugaaaaaaguuauggagacucugucucaaaaaaaaaaaaccagccugggcgacagagug

SEQ ID NO: 31208 - RNA, 64 nt, Homo Sapiens
aaauuaugaaaaaaguuauggagacucugucucaaaaaaaaaaauccagccugggcgacagagu

SEQ ID NO: 31209 - RNA, 64 nt, Homo Sapiens
aaaauuaugaaaaaaguuauugagacucugucucaaaaaaaaaacuccagccugggcgacagag

SEQ ID NO: 31210 - RNA, 64 nt, Homo Sapiens
aaaaguuaugggauuaaaaauggccacuaaauuaaaaaaaaauugaucacugucaucuaaaagc

SEQ ID NO: 31211 - RNA, 64 nt, Homo Sapiens
uaaaaguuaugggauuaaaacuggccacuaaauuaaaaaaaaauagaucacugucaucuaaaag

SEQ ID NO: 31212 - RNA, 64 nt, Homo Sapiens
cucaauaaacuaugugcccaugccaucucaaaaaaaaaaaaauuuggggaacauaugagacccc

SEQ ID NO: 31213 - RNA, 64 nt, Homo Sapiens
ucucaauaaacuaugugccccugccaucucaaaaaaaaaaaaaucuggggaacauaugagaccc

SEQ ID NO: 31214 - RNA, 64 nt, Homo Sapiens
uucucaauaaacuaugugccccugccaucucaaaaaaaaaaaaaucuggggaacauaugagacc

SEQ ID NO: 31215 - RNA, 64 nt, Homo Sapiens
auucucaauaaacuaugugccccugccaucucaaaaaaaaaaaagucuggggaacauaugagac

SEQ ID NO: 31216 - RNA, 64 nt, Homo Sapiens
aauucucaauaaacuaugugccccugccaucucaaaaaaaaaaaagucuggggaacauaugaga

SEQ ID NO: 31217 - RNA, 64 nt, Homo Sapiens
aaauucucaauaaacuauguaccccugccaucucaaaaaaaaaauagucuggggaacauaugag

SEQ ID NO: 31218 - RNA, 64 nt, Homo Sapiens
auaaacuauguuucuuauuaguuuguuuucauuaaaaaaaaagcugacuuuuacaaaauuacuu

SEQ ID NO: 31219 - RNA, 64 nt, Homo Sapiens
cauaaacuauguuucuuauuuguuuguuuucauuaaaaaaaaagcugacuuuuacaaaauuacu

SEQ ID NO: 31220 - RNA, 64 nt, Homo Sapiens
gcuuccaggacagagcaugcucugucucaaaaaaaaaaaaaaugcugggcaacgagcaaaaaac

SEQ ID NO: 31221 - RNA, 64 nt, Homo Sapiens
ggcuuccaggacagagcaugcucugucucaaaaaaaaaaaaaauccugggcaacgagcaaaaaa

SEQ ID NO: 31222 - RNA, 64 nt, Homo Sapiens
uggcuuccaggacagagcauacucugucucaaaaaaaaaaaaaagccugggcaacgagcaaaaa

SEQ ID NO: 31223 - RNA, 64 nt, Homo Sapiens
auggcuuccaggacagagcaaacucugucucaaaaaaaaaaaaaagccugggcaacgagcaaaa

SEQ ID NO: 31224 - RNA, 64 nt, Homo Sapiens
aauggcuuccaggacagagcaaacucugucucaaaaaaaaaaaacagccugggcaacgagcaaa

SEQ ID NO: 31225 - RNA, 64 nt, Homo Sapiens
aaaaaaaaaaaaagaaaaagaaaacucugucucaaaaaaaaaaaccagccugggcaacgagcaa

SEQ ID NO: 31226 - RNA, 64 nt, Homo Sapiens
aaaaaaaaaaaaaagaaaaaaaaaacucugucucaaaaaaaaaauccagccugggcaacgagca

SEQ ID NO: 31227 - RNA, 64 nt, Homo Sapiens
uuuguuuacugauuggggagaaaagcaaaaagaaaaaaaaaaugggugauugaauauuuguaua

SEQ ID NO: 31228 - RNA, 64 nt, Homo Sapiens
guuuguuuacugauuggggaaaaaagcaaaaagaaaaaaaaaaugggugauugaauauuuguau

SEQ ID NO: 31229 - RNA, 64 nt, Homo Sapiens
uguuuguuuacugauugggguaaaaagcaaaaagaaaaaaaaaaggggugauugaauauuugua

SEQ ID NO: 31230 - RNA, 64 nt, Homo Sapiens
cagggcaaaggaccuggcguugccaaaaaaaaaaaaaaaaaagcgaaacuccguccccaccccc

SEQ ID NO: 31231 - RNA, 64 nt, Homo Sapiens
ccagggcaaaggaccuggcgcugccaaaaaaaaaaaaaaaaaagugaaacuccguccccacccc

SEQ ID NO: 31232 - RNA, 64 nt, Homo Sapiens
gccagggcaaaggaccuggcccugccaaaaaaaaaaaaaaaaaagugaaacuccguccccaccc

SEQ ID NO: 31233 - RNA, 64 nt, Homo Sapiens
agccagggcaaaggaccuggcccugccaaaaaaaaaaaaaaaaaagugaaacuccguccccacc

SEQ ID NO: 31234 - RNA, 64 nt, Homo Sapiens
aagccagggcaaaggaccugccccugccaaaaaaaaaaaaaaaagagugaaacuccguccccac

SEQ ID NO: 31235 - RNA, 64 nt, Homo Sapiens
aaagccagggcaaaggaccucccccugccaaaaaaaaaaaaaaaagagugaaacuccgucccca

SEQ ID NO: 31236 - RNA, 64 nt, Homo Sapiens
aaaagccagggcaaaggaccacccccugccaaaaaaaaaaaaaagagagugaaacuccgucccc

SEQ ID NO: 31237 - RNA, 64 nt, Homo Sapiens
aaaaagccagggcaaaggaccacccccugccaaaaaaaaaaaaacgagagugaaacuccguccc

SEQ ID NO: 31238 - RNA, 64 nt, Homo Sapiens
aaaaaagccagggcaaaggaccacccccugccaaaaaaaaaaaaacgagagugaaacuccgucc

SEQ ID NO: 31239 - RNA, 64 nt, Homo Sapiens
aaaaaaagccagggcaaaggcccacccccugccaaaaaaaaaaaaacgagagugaaacuccguc

SEQ ID NO: 31240 - RNA, 64 nt, Homo Sapiens
aaaaaaaagccagggcaaagccccacccccugccaaaaaaaaaacaacgagagugaaacuccgu

SEQ ID NO: 31241 - RNA, 62 nt, Homo Sapiens
ggagacuuuuuuuguaagguaagauuuaaaaaaaaaaaaaaauaaaaaaaaaaaaagaagaa

SEQ ID NO: 31242 - RNA, 63 nt, Homo Sapiens
ggagacuuuuuuuguaagguaaagauuuaaaaaaaaaaaaaaauuaaaaaaaaaaaaagaaga

SEQ ID NO: 31243 - RNA, 64 nt, Homo Sapiens
ggagacuuuuuuuguaagguaaaagauuuaaaaaaaaaaaaaaauuuaaaaaaaaaaaaagaag

SEQ ID NO: 31244 - RNA, 64 nt, Homo Sapiens
aggagacuuuuuuuguaagggaaaagauuuaaaaaaaaaaaaaacuuuaaaaaaaaaaaaagaa

SEQ ID NO: 31245 - RNA, 64 nt, Homo Sapiens
aaggagacuuuuuuuguaagagaaaagauuuaaaaaaaaaaaaaacuuuaaaaaaaaaaaaaga

SEQ ID NO: 31246 - RNA, 64 nt, Homo Sapiens
aaaggagacuuuuuuuguaaaagaaaagauuuaaaaaaaaaaaaaacuuuaaaaaaaaaaaaag

SEQ ID NO: 31247 - RNA, 64 nt, Homo Sapiens
aaaaggagacuuuuuuuguagaagaaaagauuuaaaaaaaaaaacaacuuuaaaaaaaaaaaaa

SEQ ID NO: 31248 - RNA, 64 nt, Homo Sapiens
aaaaaggagacuuuuuuuguagaagaaaagauuuaaaaaaaaaaucaacuuuaaaaaaaaaaaa

SEQ ID NO: 31249 - RNA, 64 nt, Homo Sapiens
agaaaagauuuaaaaaaaaacucaacuuuaaaaaaaaaaaaagaccauacacugaagcuuuuac

SEQ ID NO: 31250 - RNA, 64 nt, Homo Sapiens
aagaaaagauuuaaaaaaaaccucaacuuuaaaaaaaaaaaaaguccauacacugaagcuuuua

SEQ ID NO: 31251 - RNA, 64 nt, Homo Sapiens
gaagaaaagauuuaaaaaaaaccucaacuuuaaaaaaaaaaaaauuccauacacugaagcuuuu

SEQ ID NO: 31252 - RNA, 64 nt, Homo Sapiens
agaagaaaagauuuaaaaaauaccucaacuuuaaaaaaaaaaaauuuccauacacugaagcuuu

SEQ ID NO: 31253 - RNA, 64 nt, Homo Sapiens
aagaagaaaagauuuaaaaauuaccucaacuuuaaaaaaaaaaaguuuccauacacugaagcuu

SEQ ID NO: 31254 - RNA, 64 nt, Homo Sapiens
aaagaagaaaagauuuaaaauuuaccucaacuuuaaaaaaaaaagguuuccauacacugaagcu

SEQ ID NO: 31255 - RNA, 64 nt, Homo Sapiens
aucuggucagggaagugggggauguucuuuugauaaaaaaaaaaaaaaaaauuuauguauuuaa

SEQ ID NO: 31256 - RNA, 64 nt, Homo Sapiens
ucuggucagggaagugggggauguucuuuugauaaaaaaaaaaaaaaaaauuuauguauuuaaa

SEQ ID NO: 31257 - RNA, 64 nt, Homo Sapiens
cuggucagggaagugggggauguucuuuugauaaaaaaaaaaaaaaaaauuuauguauuuaaac

SEQ ID NO: 31258 - RNA, 64 nt, Homo Sapiens
uggucagggaagugggggauguucuuuugauaaaaaaaaaaaaaaaaauuuauguauuuaaacu

SEQ ID NO: 31259 - RNA, 64 nt, Homo Sapiens
ggucagggaagugggggauguucuuuugauaaaaaaaaaaaaaaaaauuuauguauuuaaacuu

SEQ ID NO: 31260 - RNA, 64 nt, Homo Sapiens
gucagggaagugggggauguucuuuugauaaaaaaaaaaaaaaaaauuuauguauuuaaacuuu

SEQ ID NO: 31261 - RNA, 64 nt, Homo Sapiens
ucagggaagugggggauguucuuuugauaaaaaaaaaaaaaaaaauuuauguauuuaaacuuuu

SEQ ID NO: 31262 - RNA, 64 nt, Homo Sapiens
cagggaagugggggauguucuuuugauaaaaaaaaaaaaaaaaauuuauguauuuaaacuuuua

SEQ ID NO: 31263 - RNA, 64 nt, Homo Sapiens
agggaagugggggauguucuuuugauaaaaaaaaaaaaaaaaauuuauguauuuaaacuuuuau

SEQ ID NO: 31264 - RNA, 64 nt, Homo Sapiens
gggaagugggggauguucuuuugauaaaaaaaaaaaaaaaaauuuauguauuuaaacuuuuauu

SEQ ID NO: 31265 - RNA, 64 nt, Homo Sapiens
ucaagugcuucaaugaugcagcauuucuugcacuaaaaaaaaaaaaaaaaaaaaaacuagaaag

SEQ ID NO: 31266 - RNA, 64 nt, Homo Sapiens
caagugcuucaaugaugcagcauuucuugcacuaaaaaaaaaaaaaaaaaaaaaacuagaaagu

SEQ ID NO: 31267 - RNA, 64 nt, Homo Sapiens
aagugcuucaaugaugcagcauuucuugcacuaaaaaaaaaaaaaaaaaaaaaacuagaaaguu

SEQ ID NO: 31268 - RNA, 64 nt, Homo Sapiens
agugcuucaaugaugcagcauuucuugcacuaaaaaaaaaaaaaaaaaaaaaacuagaaaguuu

SEQ ID NO: 31269 - RNA, 64 nt, Homo Sapiens
gugcuucaaugaugcagcauuucuugcacuaaaaaaaaaaaaaaaaaaaaaacuagaaaguuuu

SEQ ID NO: 31270 - RNA, 64 nt, Homo Sapiens
ugcuucaaugaugcagcauuucuugcacuaaaaaaaaaaaaaaaaaaaaaacuagaaaguuuug

SEQ ID NO: 31271 - RNA, 64 nt, Homo Sapiens
gcuucaaugaugcagcauuucuugcacuaaaaaaaaaaaaaaaaaaaaaacuagaaaguuuugg

SEQ ID NO: 31272 - RNA, 64 nt, Homo Sapiens
cuucaaugaugcagcauuucuugcacuaaaaaaaaaaaaaaaaaaaaaacuagaaaguuuuggg

SEQ ID NO: 31273 - RNA, 64 nt, Homo Sapiens
uucaaugaugcagcauuucuugcacuaaaaaaaaaaaaaaaaaaaaaacuagaaaguuuuggga

SEQ ID NO: 31274 - RNA, 64 nt, Homo Sapiens
ucaaugaugcagcauuucuugcacuaaaaaaaaaaaaaaaaaaaaaacuagaaaguuuugggac

SEQ ID NO: 31275 - RNA, 64 nt, Homo Sapiens
caaugaugcagcauuucuugcacuaaaaaaaaaaaaaaaaaaaaaacuagaaaguuuugggaca

SEQ ID NO: 31276 - RNA, 64 nt, Homo Sapiens
aaugaugcagcauuucuugcacuaaaaaaaaaaaaaaaaaaaaaacuagaaaguuuugggacau

SEQ ID NO: 31277 - RNA, 64 nt, Homo Sapiens
augaugcagcauuucuugcacuaaaaaaaaaaaaaaaaaaaaaacuagaaaguuuugggacaug

SEQ ID NO: 31278 - RNA, 64 nt, Homo Sapiens
ugaugcagcauuucuugcacuaaaaaaaaaaaaaaaaaaaaaacuagaaaguuuugggacaugg

SEQ ID NO: 31279 - RNA, 64 nt, Homo Sapiens
gaugcagcauuucuugcacuaaaaaaaaaaaaaaaaaaaaaacuagaaaguuuugggacauggg

SEQ ID NO: 31280 - RNA, 64 nt, Homo Sapiens
auauccccuauuuaacagggucucuagugcugugaaaaaaaaaaugcugaacauugcauauaac

SEQ ID NO: 31281 - RNA, 64 nt, Homo Sapiens
uauccccuauuuaacagggucucuagugcugugaaaaaaaaaaugcugaacauugcauauaacu

SEQ ID NO: 31282 - RNA, 64 nt, Homo Sapiens
auccccuauuuaacagggucucuagugcugugaaaaaaaaaaugcugaacauugcauauaacuu

SEQ ID NO: 31283 - RNA, 64 nt, Homo Sapiens
cuggccacaguuguuugaugcauuaaaagaaaauaaaaaaaagaaaaaagagaaaagaaaaaaa

SEQ ID NO: 31284 - RNA, 64 nt, Homo Sapiens
uaaaagaaaauaaaaaaaagaaaaaagagaaaagaaaaaaaaagaaaaaaguuguaggcgaauc

SEQ ID NO: 31285 - RNA, 64 nt, Homo Sapiens
aaaagaaaauaaaaaaaagaaaaaagagaaaagaaaaaaaaagaaaaaaguuguaggcgaauca

SEQ ID NO: 31286 - RNA, 64 nt, Homo Sapiens
ucaucguuugccuagcaugucccuguggcgucucaaaaaaaaguuucaucgucccgucauuguu

SEQ ID NO: 31287 - RNA, 64 nt, Homo Sapiens
gauaagacaaguuuagaauugguuuacuuaauacaaaaaaaaaaaaaagaauuucaaaaaaaaa

SEQ ID NO: 31288 - RNA, 64 nt, Homo Sapiens
auaagacaaguuuagaauugguuuacuuaauacaaaaaaaaaaaaaagaauuucaaaaaaaaaa

SEQ ID NO: 31289 - RNA, 64 nt, Homo Sapiens
uaagacaaguuuagaauugguuuacuuaauacaaaaaaaaaaaaaagaauuucaaaaaaaaaag

SEQ ID NO: 31290 - RNA, 64 nt, Homo Sapiens
aagacaaguuuagaauugguuuacuuaauacaaaaaaaaaaaaaagaauuucaaaaaaaaaagu

SEQ ID NO: 31291 - RNA, 64 nt, Homo Sapiens
agacaaguuuagaauugguuuacuuaauacaaaaaaaaaaaaaagaauuucaaaaaaaaaaguu

SEQ ID NO: 31292 - RNA, 64 nt, Homo Sapiens
gacaaguuuagaauugguuuacuuaauacaaaaaaaaaaaaaagaauuucaaaaaaaaaaguug

SEQ ID NO: 31293 - RNA, 64 nt, Homo Sapiens
acaaguuuagaauugguuuacuuaauacaaaaaaaaaaaaaagaauuucaaaaaaaaaaguugu

SEQ ID NO: 31294 - RNA, 64 nt, Homo Sapiens
guuuacuuaauacaaaaaaaaaaaaaagaauuucaaaaaaaaaaguuguuugcuuaaaaaaaau

SEQ ID NO: 31295 - RNA, 64 nt, Homo Sapiens
uuuacuuaauacaaaaaaaaaaaaaagaauuucaaaaaaaaaaguuguuugcuuaaaaaaaauu

SEQ ID NO: 31296 - RNA, 64 nt, Homo Sapiens
uuacuuaauacaaaaaaaaaaaaaagaauuucaaaaaaaaaaguuguuugcuuaaaaaaaauuu

SEQ ID NO: 31297 - RNA, 64 nt, Homo Sapiens
aaaaaagaauuucaaaaaaaaaaguuguuugcuuaaaaaaaauuucaugugagggaaaaaaaaa

SEQ ID NO: 31298 - RNA, 64 nt, Homo Sapiens
aaguuguuugcuuaaaaaaaauuucaugugagggaaaaaaaaaaaaccuauuccagaauaaguu

SEQ ID NO: 31299 - RNA, 64 nt, Homo Sapiens
aguuguuugcuuaaaaaaaauuucaugugagggaaaaaaaaaaaaccuauuccagaauaaguuu

SEQ ID NO: 31300 - RNA, 64 nt, Homo Sapiens
guuguuugcuuaaaaaaaauuucaugugagggaaaaaaaaaaaaccuauuccagaauaaguuuu

SEQ ID NO: 31301 - RNA, 64 nt, Homo Sapiens
uuguuugcuuaaaaaaaauuucaugugagggaaaaaaaaaaaaccuauuccagaauaaguuuug

SEQ ID NO: 31302 - RNA, 64 nt, Homo Sapiens
uguuugcuuaaaaaaaauuucaugugagggaaaaaaaaaaaaccuauuccagaauaaguuuugu

SEQ ID NO: 31303 - RNA, 64 nt, Homo Sapiens
uuuauuauguguuuuguauaaaucccuaauauuuaaaaaaaaaaacaaaacaaaaaaagguuac

SEQ ID NO: 31304 - RNA, 64 nt, Homo Sapiens
uuauuauguguuuuguauaaaucccuaauauuuaaaaaaaaaaacaaaacaaaaaaagguuaca

SEQ ID NO: 31305 - RNA, 64 nt, Homo Sapiens
uauuauguguuuuguauaaaucccuaauauuuaaaaaaaaaaacaaaacaaaaaaagguuacaa

SEQ ID NO: 31306 - RNA, 64 nt, Homo Sapiens
auuauguguuuuguauaaaucccuaauauuuaaaaaaaaaaacaaaacaaaaaaagguuacaaa

SEQ ID NO: 31307 - RNA, 64 nt, Homo Sapiens
uuacuguuuguuuuuauuaucuuaagugcuaauuaaaaaaaaaauaaaauuuuaaaaaaaccug

SEQ ID NO: 31308 - RNA, 64 nt, Homo Sapiens
uacuguuuguuuuuauuaucuuaagugcuaauuaaaaaaaaaauaaaauuuuaaaaaaaccugu

SEQ ID NO: 31309 - RNA, 64 nt, Homo Sapiens
acuguuuguuuuuauuaucuuaagugcuaauuaaaaaaaaaauaaaauuuuaaaaaaaccugua

SEQ ID NO: 31310 - RNA, 64 nt, Homo Sapiens
cauuuggauuuuguuguuugauggaauuugagccaaaaaaaaaauacgcaggcuuuccuauuuc

SEQ ID NO: 31311 - RNA, 64 nt, Homo Sapiens
auuuggauuuuguuguuugauggaauuugagccaaaaaaaaaauacgcaggcuuuccuauuucu

SEQ ID NO: 31312 - RNA, 64 nt, Homo Sapiens
uuuggauuuuguuguuugauggaauuugagccaaaaaaaaaauacgcaggcuuuccuauuucua

SEQ ID NO: 31313 - RNA, 64 nt, Homo Sapiens
uuuuguaccaguggaacuuuuuauacuggagauuaaaaaaaaaauggaaauuuuuguggcuugc

SEQ ID NO: 31314 - RNA, 64 nt, Homo Sapiens
uuuguaccaguggaacuuuuuauacuggagauuaaaaaaaaaauggaaauuuuuguggcuugcu

SEQ ID NO: 31315 - RNA, 64 nt, Homo Sapiens
uuguaccaguggaacuuuuuauacuggagauuaaaaaaaaaauggaaauuuuuguggcuugcuc

SEQ ID NO: 31316 - RNA, 64 nt, Homo Sapiens
guccagccugggugacagagcaagacugcguuucaaaaaaaaaaaaaaaaaaacccauuaaaag

SEQ ID NO: 31317 - RNA, 64 nt, Homo Sapiens
uccagccugggugacagagcaagacugcguuucaaaaaaaaaaaaaaaaaaacccauuaaaaga

SEQ ID NO: 31318 - RNA, 64 nt, Homo Sapiens
ccagccugggugacagagcaagacugcguuucaaaaaaaaaaaaaaaaaaacccauuaaaagag

SEQ ID NO: 31319 - RNA, 64 nt, Homo Sapiens
cagccugggugacagagcaagacugcguuucaaaaaaaaaaaaaaaaaaacccauuaaaagagg

SEQ ID NO: 31320 - RNA, 64 nt, Homo Sapiens
agccugggugacagagcaagacugcguuucaaaaaaaaaaaaaaaaaaacccauuaaaagaggc

SEQ ID NO: 31321 - RNA, 64 nt, Homo Sapiens
gccugggugacagagcaagacugcguuucaaaaaaaaaaaaaaaaaaacccauuaaaagaggcc

SEQ ID NO: 31322 - RNA, 64 nt, Homo Sapiens
ccugggugacagagcaagacugcguuucaaaaaaaaaaaaaaaaaaacccauuaaaagaggccu

SEQ ID NO: 31323 - RNA, 64 nt, Homo Sapiens
cugggugacagagcaagacugcguuucaaaaaaaaaaaaaaaaaaacccauuaaaagaggccuc

SEQ ID NO: 31324 - RNA, 64 nt, Homo Sapiens
ugggugacagagcaagacugcguuucaaaaaaaaaaaaaaaaaaacccauuaaaagaggccucc

SEQ ID NO: 31325 - RNA, 64 nt, Homo Sapiens
gggugacagagcaagacugcguuucaaaaaaaaaaaaaaaaaaacccauuaaaagaggccuccu

SEQ ID NO: 31326 - RNA, 64 nt, Homo Sapiens
ggugacagagcaagacugcguuucaaaaaaaaaaaaaaaaaaacccauuaaaagaggccuccuu

SEQ ID NO: 31327 - RNA, 64 nt, Homo Sapiens
gugacagagcaagacugcguuucaaaaaaaaaaaaaaaaaaacccauuaaaagaggccuccuuc

SEQ ID NO: 31328 - RNA, 64 nt, Homo Sapiens
ucaaaaaauaaauaaauagaaagagagagagaggaaaaaaaaagaaaagaacacuucuuuauuu

SEQ ID NO: 31329 - RNA, 64 nt, Homo Sapiens
caaaaaauaaauaaauagaaagagagagagaggaaaaaaaaagaaaagaacacuucuuuauuug

SEQ ID NO: 31330 - RNA, 64 nt, Homo Sapiens
aaacgauuuaccaauguuguuuuuuuuuaacaagaaaaaaaauaaaagcacauugucauuuuuu

SEQ ID NO: 31331 - RNA, 64 nt, Homo Sapiens
guaaccgucuaugguguguuuuuucauuaaugacaaaaaaaaaaagguuucaacuggauuauuu

SEQ ID NO: 31332 - RNA, 64 nt, Homo Sapiens
uaaccgucuaugguguguuuuuucauuaaugacaaaaaaaaaaagguuucaacuggauuauuua

SEQ ID NO: 31333 - RNA, 64 nt, Homo Sapiens
aaccgucuaugguguguuuuuucauuaaugacaaaaaaaaaaagguuucaacuggauuauuuaa

SEQ ID NO: 31334 - RNA, 64 nt, Homo Sapiens
accgucuaugguguguuuuuucauuaaugacaaaaaaaaaaagguuucaacuggauuauuuaaa

SEQ ID NO: 31335 - RNA, 64 nt, Homo Sapiens
ccugagcacuagcaauccacccaccucuguuuccaaaaaaaaaaaaaaaaugaaaggucaaccc

SEQ ID NO: 31336 - RNA, 64 nt, Homo Sapiens
cugagcacuagcaauccacccaccucuguuuccaaaaaaaaaaaaaaaaugaaaggucaacccc

SEQ ID NO: 31337 - RNA, 64 nt, Homo Sapiens
ugagcacuagcaauccacccaccucuguuuccaaaaaaaaaaaaaaaaugaaaggucaaccccu

SEQ ID NO: 31338 - RNA, 64 nt, Homo Sapiens
gagcacuagcaauccacccaccucuguuuccaaaaaaaaaaaaaaaaugaaaggucaaccccua

SEQ ID NO: 31339 - RNA, 64 nt, Homo Sapiens
agcacuagcaauccacccaccucuguuuccaaaaaaaaaaaaaaaaugaaaggucaaccccuau

SEQ ID NO: 31340 - RNA, 64 nt, Homo Sapiens
gcacuagcaauccacccaccucuguuuccaaaaaaaaaaaaaaaaugaaaggucaaccccuaug

SEQ ID NO: 31341 - RNA, 64 nt, Homo Sapiens
cacuagcaauccacccaccucuguuuccaaaaaaaaaaaaaaaaugaaaggucaaccccuaugc

SEQ ID NO: 31342 - RNA, 64 nt, Homo Sapiens
acuagcaauccacccaccucuguuuccaaaaaaaaaaaaaaaaugaaaggucaaccccuaugca

SEQ ID NO: 31343 - RNA, 64 nt, Homo Sapiens
cuagcaauccacccaccucuguuuccaaaaaaaaaaaaaaaaugaaaggucaaccccuaugcaa

SEQ ID NO: 31344 - RNA, 64 nt, Homo Sapiens
cuccagccugggugacagauccagacucugucucaaaaaaaaaaaaaaaaaaaauacuucuggc

SEQ ID NO: 31345 - RNA, 64 nt, Homo Sapiens
uccagccugggugacagauccagacucugucucaaaaaaaaaaaaaaaaaaaauacuucuggca

SEQ ID NO: 31346 - RNA, 64 nt, Homo Sapiens
ccagccugggugacagauccagacucugucucaaaaaaaaaaaaaaaaaaaauacuucuggcag

SEQ ID NO: 31347 - RNA, 64 nt, Homo Sapiens
cagccugggugacagauccagacucugucucaaaaaaaaaaaaaaaaaaaauacuucuggcaga

SEQ ID NO: 31348 - RNA, 64 nt, Homo Sapiens
agccugggugacagauccagacucugucucaaaaaaaaaaaaaaaaaaaauacuucuggcagag

SEQ ID NO: 31349 - RNA, 64 nt, Homo Sapiens
gccugggugacagauccagacucugucucaaaaaaaaaaaaaaaaaaaauacuucuggcagagu

SEQ ID NO: 31350 - RNA, 64 nt, Homo Sapiens
ccugggugacagauccagacucugucucaaaaaaaaaaaaaaaaaaaauacuucuggcagaguc

SEQ ID NO: 31351 - RNA, 64 nt, Homo Sapiens
cugggugacagauccagacucugucucaaaaaaaaaaaaaaaaaaaauacuucuggcagagucu

SEQ ID NO: 31352 - RNA, 64 nt, Homo Sapiens
ugggugacagauccagacucugucucaaaaaaaaaaaaaaaaaaaauacuucuggcagagucuu

SEQ ID NO: 31353 - RNA, 64 nt, Homo Sapiens
gggugacagauccagacucugucucaaaaaaaaaaaaaaaaaaaauacuucuggcagagucuuu

SEQ ID NO: 31354 - RNA, 64 nt, Homo Sapiens
ggugacagauccagacucugucucaaaaaaaaaaaaaaaaaaaauacuucuggcagagucuuuu

SEQ ID NO: 31355 - RNA, 64 nt, Homo Sapiens
gugacagauccagacucugucucaaaaaaaaaaaaaaaaaaaauacuucuggcagagucuuuua

SEQ ID NO: 31356 - RNA, 64 nt, Homo Sapiens
ugacagauccagacucugucucaaaaaaaaaaaaaaaaaaaauacuucuggcagagucuuuuau

SEQ ID NO: 31357 - RNA, 64 nt, Homo Sapiens
ggccacaauuuaauuaauugguaagauauaaugcaaaaaaaaaaagagaaauguuugccuuaug

SEQ ID NO: 31358 - RNA, 64 nt, Homo Sapiens
gccacaauuuaauuaauugguaagauauaaugcaaaaaaaaaaagagaaauguuugccuuaugu

SEQ ID NO: 31359 - RNA, 64 nt, Homo Sapiens
ccacaauuuaauuaauugguaagauauaaugcaaaaaaaaaaagagaaauguuugccuuaugua

SEQ ID NO: 31360 - RNA, 64 nt, Homo Sapiens
cacaauuuaauuaauugguaagauauaaugcaaaaaaaaaaagagaaauguuugccuuauguau

SEQ ID NO: 31361 - RNA, 64 nt, Homo Sapiens
agccaggagaacaaacuaauuccuuuaaauaaauaaaaaaaaaaaaugcaaauguccuucacca

SEQ ID NO: 31362 - RNA, 64 nt, Homo Sapiens
gccaggagaacaaacuaauuccuuuaaauaaauaaaaaaaaaaaaugcaaauguccuucaccag

SEQ ID NO: 31363 - RNA, 64 nt, Homo Sapiens
ccaggagaacaaacuaauuccuuuaaauaaauaaaaaaaaaaaaugcaaauguccuucaccagu

SEQ ID NO: 31364 - RNA, 64 nt, Homo Sapiens
caggagaacaaacuaauuccuuuaaauaaauaaaaaaaaaaaaugcaaauguccuucaccagua

SEQ ID NO: 31365 - RNA, 64 nt, Homo Sapiens
aggagaacaaacuaauuccuuuaaauaaauaaaaaaaaaaaaugcaaauguccuucaccaguaa

SEQ ID NO: 31366 - RNA, 64 nt, Homo Sapiens
uguacugucagcuucacuccaccugagaaaaaagaaaaaaaaauugauagcucaaaugcaugua

SEQ ID NO: 31367 - RNA, 64 nt, Homo Sapiens
guacugucagcuucacuccaccugagaaaaaagaaaaaaaaauugauagcucaaaugcauguaa

SEQ ID NO: 31368 - RNA, 64 nt, Homo Sapiens
uuuuggcuuaggugcaggguugcaaagggaucagaaaaaaaaaaucauaauaaagcuuuaguuc

SEQ ID NO: 31369 - RNA, 64 nt, Homo Sapiens
uuuggcuuaggugcaggguugcaaagggaucagaaaaaaaaaaucauaauaaagcuuuaguuca

SEQ ID NO: 31370 - RNA, 64 nt, Homo Sapiens
uuggcuuaggugcaggguugcaaagggaucagaaaaaaaaaaucauaauaaagcuuuaguucau

SEQ ID NO: 31371 - RNA, 64 nt, Homo Sapiens
auagcacaucaccugggacuuggcaaucuuuguuaaaaaaaaauuuccuuucuaaugggauuug

SEQ ID NO: 31372 - RNA, 64 nt, Homo Sapiens
uagcacaucaccugggacuuggcaaucuuuguuaaaaaaaaauuuccuuucuaaugggauuugg

SEQ ID NO: 31373 - RNA, 64 nt, Homo Sapiens
aaagaaguaccugaucaggaucugggagaauuugaaaaaaaaagaaaaacuagaaaaauaaaca

SEQ ID NO: 31374 - RNA, 64 nt, Homo Sapiens
aagaaguaccugaucaggaucugggagaauuugaaaaaaaaagaaaaacuagaaaaauaaacaa

SEQ ID NO: 31375 - RNA, 64 nt, Homo Sapiens
aagaaaaacuagaaaaauaaacaaaauuaaaaagaaaaaaaaauaccugagacugaguaacuua

SEQ ID NO: 31376 - RNA, 64 nt, Homo Sapiens
agaaaaacuagaaaaauaaacaaaauuaaaaagaaaaaaaaauaccugagacugaguaacuuau

SEQ ID NO: 31377 - RNA, 64 nt, Homo Sapiens
uacauguaaaccugucugcaaaauuagcuuuuuuaaaaaaaaaaaaaaaaaaauuggggggguu

SEQ ID NO: 31378 - RNA, 64 nt, Homo Sapiens
acauguaaaccugucugcaaaauuagcuuuuuuaaaaaaaaaaaaaaaaaaauuggggggguua

SEQ ID NO: 31379 - RNA, 64 nt, Homo Sapiens
cauguaaaccugucugcaaaauuagcuuuuuuaaaaaaaaaaaaaaaaaaauuggggggguuaa

SEQ ID NO: 31380 - RNA, 64 nt, Homo Sapiens
auguaaaccugucugcaaaauuagcuuuuuuaaaaaaaaaaaaaaaaaaauuggggggguuaau

SEQ ID NO: 31381 - RNA, 64 nt, Homo Sapiens
uguaaaccugucugcaaaauuagcuuuuuuaaaaaaaaaaaaaaaaaaauuggggggguuaauu

SEQ ID NO: 31382 - RNA, 64 nt, Homo Sapiens
guaaaccugucugcaaaauuagcuuuuuuaaaaaaaaaaaaaaaaaaauuggggggguuaauuu

SEQ ID NO: 31383 - RNA, 64 nt, Homo Sapiens
uaaaccugucugcaaaauuagcuuuuuuaaaaaaaaaaaaaaaaaaauuggggggguuaauuua

SEQ ID NO: 31384 - RNA, 64 nt, Homo Sapiens
aaaccugucugcaaaauuagcuuuuuuaaaaaaaaaaaaaaaaaaauuggggggguuaauuuau

SEQ ID NO: 31385 - RNA, 64 nt, Homo Sapiens
aaccugucugcaaaauuagcuuuuuuaaaaaaaaaaaaaaaaaaauuggggggguuaauuuauc

SEQ ID NO: 31386 - RNA, 64 nt, Homo Sapiens
accugucugcaaaauuagcuuuuuuaaaaaaaaaaaaaaaaaaauuggggggguuaauuuauca

SEQ ID NO: 31387 - RNA, 64 nt, Homo Sapiens
ccugucugcaaaauuagcuuuuuuaaaaaaaaaaaaaaaaaaauuggggggguuaauuuaucau

SEQ ID NO: 31388 - RNA, 64 nt, Homo Sapiens
cugucugcaaaauuagcuuuuuuaaaaaaaaaaaaaaaaaaauuggggggguuaauuuaucauu

SEQ ID NO: 31389 - RNA, 64 nt, Homo Sapiens
ggcauuugcagauuuuuauauuaguugcuuuguuaaaaaaaaaaagauuguauugcuguccuug

SEQ ID NO: 31390 - RNA, 64 nt, Homo Sapiens
gcauuugcagauuuuuauauuaguugcuuuguuaaaaaaaaaaagauuguauugcuguccuuga

SEQ ID NO: 31391 - RNA, 64 nt, Homo Sapiens
cauuugcagauuuuuauauuaguugcuuuguuaaaaaaaaaaagauuguauugcuguccuugaa

SEQ ID NO: 31392 - RNA, 64 nt, Homo Sapiens
auuugcagauuuuuauauuaguugcuuuguuaaaaaaaaaaagauuguauugcuguccuugaau

SEQ ID NO: 31393 - RNA, 64 nt, Homo Sapiens
uccagccugagugacagagagagauucaaaaaacaaaaaaaaagcaaaaauauacuuugcuauu

SEQ ID NO: 31394 - RNA, 64 nt, Homo Sapiens
ccagccugagugacagagagagauucaaaaaacaaaaaaaaagcaaaaauauacuuugcuauug

SEQ ID NO: 31395 - RNA, 64 nt, Homo Sapiens
uuuugaggccaguacaaccuugauaacaaaaccuaaaaaaaaaacaacaaaaaaacccauaaag

SEQ ID NO: 31396 - RNA, 64 nt, Homo Sapiens
uuugaggccaguacaaccuugauaacaaaaccuaaaaaaaaaacaacaaaaaaacccauaaagc

SEQ ID NO: 31397 - RNA, 64 nt, Homo Sapiens
uugaggccaguacaaccuugauaacaaaaccuaaaaaaaaaacaacaaaaaaacccauaaagcu

SEQ ID NO: 31398 - RNA, 64 nt, Homo Sapiens
gaagacagagugagaccccaucucaggaaaaaagaaaaaaaaaaagaugucauucagcagguua

SEQ ID NO: 31399 - RNA, 64 nt, Homo Sapiens
aagacagagugagaccccaucucaggaaaaaagaaaaaaaaaaagaugucauucagcagguuaa

SEQ ID NO: 31400 - RNA, 64 nt, Homo Sapiens
agacagagugagaccccaucucaggaaaaaagaaaaaaaaaaagaugucauucagcagguuaau

SEQ ID NO: 31401 - RNA, 64 nt, Homo Sapiens
gacagagugagaccccaucucaggaaaaaagaaaaaaaaaaagaugucauucagcagguuaaug

SEQ ID NO: 31402 - RNA, 64 nt, Homo Sapiens
aggguuuuguuucuugaauaucuucacuuuaaacaaaaaaaaaaaacaacuuucauuugugugg

SEQ ID NO: 31403 - RNA, 64 nt, Homo Sapiens
ggguuuuguuucuugaauaucuucacuuuaaacaaaaaaaaaaaacaacuuucauuuguguggc

SEQ ID NO: 31404 - RNA, 64 nt, Homo Sapiens
gguuuuguuucuugaauaucuucacuuuaaacaaaaaaaaaaaacaacuuucauuuguguggca

SEQ ID NO: 31405 - RNA, 64 nt, Homo Sapiens
guuuuguuucuugaauaucuucacuuuaaacaaaaaaaaaaaacaacuuucauuuguguggcau

SEQ ID NO: 31406 - RNA, 64 nt, Homo Sapiens
uuuuguuucuugaauaucuucacuuuaaacaaaaaaaaaaaacaacuuucauuuguguggcauu

SEQ ID NO: 31407 - RNA, 64 nt, Homo Sapiens
cuucaauuacauaggcagguuuuucuuaaaaaugaaaaaaaaaucaaagauuuuuuuaacaguu

SEQ ID NO: 31408 - RNA, 64 nt, Homo Sapiens
uucaauuacauaggcagguuuuucuuaaaaaugaaaaaaaaaucaaagauuuuuuuaacaguuc

SEQ ID NO: 31409 - RNA, 64 nt, Homo Sapiens
cuuguacaaacucaacacuaacuuuuuuuuuuuuaaaaaaaaaaagguacuaaguaucuucaau

SEQ ID NO: 31410 - RNA, 64 nt, Homo Sapiens
uuguacaaacucaacacuaacuuuuuuuuuuuuaaaaaaaaaaagguacuaaguaucuucaauc

SEQ ID NO: 31411 - RNA, 64 nt, Homo Sapiens
uguacaaacucaacacuaacuuuuuuuuuuuuaaaaaaaaaaagguacuaaguaucuucaauca

SEQ ID NO: 31412 - RNA, 64 nt, Homo Sapiens
guacaaacucaacacuaacuuuuuuuuuuuuaaaaaaaaaaagguacuaaguaucuucaaucag

SEQ ID NO: 31413 - RNA, 64 nt, Homo Sapiens
cagauauuuguacugaagucugauacagaauuagaaaaaaaaaauucuuguugaaauauuuuga

SEQ ID NO: 31414 - RNA, 64 nt, Homo Sapiens
agauauuuguacugaagucugauacagaauuagaaaaaaaaaauucuuguugaaauauuuugaa

SEQ ID NO: 31415 - RNA, 64 nt, Homo Sapiens
gauauuuguacugaagucugauacagaauuagaaaaaaaaaauucuuguugaaauauuuugaaa

SEQ ID NO: 31416 - RNA, 64 nt, Homo Sapiens
agggggcgcagauuagcauugcucaagaguauguaaaaaaaaaaaaaaaaaaaaagaaccaaac

SEQ ID NO: 31417 - RNA, 64 nt, Homo Sapiens
gggggcgcagauuagcauugcucaagaguauguaaaaaaaaaaaaaaaaaaaaagaaccaaacc

SEQ ID NO: 31418 - RNA, 64 nt, Homo Sapiens
ggggcgcagauuagcauugcucaagaguauguaaaaaaaaaaaaaaaaaaaaagaaccaaacca

SEQ ID NO: 31419 - RNA, 64 nt, Homo Sapiens
gggcgcagauuagcauugcucaagaguauguaaaaaaaaaaaaaaaaaaaaagaaccaaaccac

SEQ ID NO: 31420 - RNA, 64 nt, Homo Sapiens
ggcgcagauuagcauugcucaagaguauguaaaaaaaaaaaaaaaaaaaaagaaccaaaccacu

SEQ ID NO: 31421 - RNA, 64 nt, Homo Sapiens
gcgcagauuagcauugcucaagaguauguaaaaaaaaaaaaaaaaaaaaagaaccaaaccacug

SEQ ID NO: 31422 - RNA, 64 nt, Homo Sapiens
cgcagauuagcauugcucaagaguauguaaaaaaaaaaaaaaaaaaaaagaaccaaaccacugg

SEQ ID NO: 31423 - RNA, 64 nt, Homo Sapiens
gcagauuagcauugcucaagaguauguaaaaaaaaaaaaaaaaaaaaagaaccaaaccacugga

SEQ ID NO: 31424 - RNA, 64 nt, Homo Sapiens
cagauuagcauugcucaagaguauguaaaaaaaaaaaaaaaaaaaaagaaccaaaccacuggaa

SEQ ID NO: 31425 - RNA, 64 nt, Homo Sapiens
agauuagcauugcucaagaguauguaaaaaaaaaaaaaaaaaaaaagaaccaaaccacuggaaa

SEQ ID NO: 31426 - RNA, 64 nt, Homo Sapiens
gauuagcauugcucaagaguauguaaaaaaaaaaaaaaaaaaaaagaaccaaaccacuggaaau

SEQ ID NO: 31427 - RNA, 64 nt, Homo Sapiens
auuagcauugcucaagaguauguaaaaaaaaaaaaaaaaaaaaagaaccaaaccacuggaaaua

SEQ ID NO: 31428 - RNA, 64 nt, Homo Sapiens
uuagcauugcucaagaguauguaaaaaaaaaaaaaaaaaaaaagaaccaaaccacuggaaauaa

SEQ ID NO: 31429 - RNA, 64 nt, Homo Sapiens
uagcauugcucaagaguauguaaaaaaaaaaaaaaaaaaaaagaaccaaaccacuggaaauaau

SEQ ID NO: 31430 - RNA, 64 nt, Homo Sapiens
aauuauaaugauaugccccuuuucuuauaaaaacaaaaaaaaaaauaaugaaacacagugaauu

SEQ ID NO: 31431 - RNA, 64 nt, Homo Sapiens
auuauaaugauaugccccuuuucuuauaaaaacaaaaaaaaaaauaaugaaacacagugaauuu

SEQ ID NO: 31432 - RNA, 64 nt, Homo Sapiens
uuauaaugauaugccccuuuucuuauaaaaacaaaaaaaaaaauaaugaaacacagugaauuug

SEQ ID NO: 31433 - RNA, 64 nt, Homo Sapiens
uauaaugauaugccccuuuucuuauaaaaacaaaaaaaaaaauaaugaaacacagugaauuugu

SEQ ID NO: 31434 - RNA, 64 nt, Homo Sapiens
ccugucuuugguuaggcucguguacuucugcaggaaaaaaaaaaaaggaugugucauuggucau

SEQ ID NO: 31435 - RNA, 64 nt, Homo Sapiens
cugucuuugguuaggcucguguacuucugcaggaaaaaaaaaaaaggaugugucauuggucaug

SEQ ID NO: 31436 - RNA, 64 nt, Homo Sapiens
ugucuuugguuaggcucguguacuucugcaggaaaaaaaaaaaaggaugugucauuggucauga

SEQ ID NO: 31437 - RNA, 64 nt, Homo Sapiens
gucuuugguuaggcucguguacuucugcaggaaaaaaaaaaaaggaugugucauuggucaugau

SEQ ID NO: 31438 - RNA, 64 nt, Homo Sapiens
ucuuugguuaggcucguguacuucugcaggaaaaaaaaaaaaggaugugucauuggucaugaua

SEQ ID NO: 31439 - RNA, 64 nt, Homo Sapiens
auuauccagauuauuuggauaaguccuuuuuaagaaaaaaaaagaaaaugaaaaacaacacaaa

SEQ ID NO: 31440 - RNA, 64 nt, Homo Sapiens
uuauccagauuauuuggauaaguccuuuuuaagaaaaaaaaagaaaaugaaaaacaacacaaaa

SEQ ID NO: 31441 - RNA, 64 nt, Homo Sapiens
cucuagucugggugacagagcgagacucugucucaaaaaaaaaaaaauaaagccgggcguggug

SEQ ID NO: 31442 - RNA, 64 nt, Homo Sapiens
ucuagucugggugacagagcgagacucugucucaaaaaaaaaaaaauaaagccgggcguggugg

SEQ ID NO: 31443 - RNA, 64 nt, Homo Sapiens
cuagucugggugacagagcgagacucugucucaaaaaaaaaaaaauaaagccgggcgugguggc

SEQ ID NO: 31444 - RNA, 64 nt, Homo Sapiens
uagucugggugacagagcgagacucugucucaaaaaaaaaaaaauaaagccgggcgugguggcu

SEQ ID NO: 31445 - RNA, 64 nt, Homo Sapiens
agucugggugacagagcgagacucugucucaaaaaaaaaaaaauaaagccgggcgugguggcuc

SEQ ID NO: 31446 - RNA, 64 nt, Homo Sapiens
gucugggugacagagcgagacucugucucaaaaaaaaaaaaauaaagccgggcgugguggcuca

SEQ ID NO: 31447 - RNA, 64 nt, Homo Sapiens
caacauggugaaaccuugucucuacuaaaacuacaaaaaaaauuagccaggcgugguggcgggc

SEQ ID NO: 31448 - RNA, 64 nt, Homo Sapiens
gcuccagccugagcaacaagagcgaaacugucucaaaaaaaagaagaaaauaaauaaauaaaaa

SEQ ID NO: 31449 - RNA, 64 nt, Homo Sapiens
caauaucagugcucgagacacagugaagcaaauuaaaaaaaaaaaaaaaaaaaaucccugaaug

SEQ ID NO: 31450 - RNA, 64 nt, Homo Sapiens
aauaucagugcucgagacacagugaagcaaauuaaaaaaaaaaaaaaaaaaaaucccugaauga

SEQ ID NO: 31451 - RNA, 64 nt, Homo Sapiens
auaucagugcucgagacacagugaagcaaauuaaaaaaaaaaaaaaaaaaaaucccugaaugau

SEQ ID NO: 31452 - RNA, 64 nt, Homo Sapiens
uaucagugcucgagacacagugaagcaaauuaaaaaaaaaaaaaaaaaaaaucccugaaugaug

SEQ ID NO: 31453 - RNA, 64 nt, Homo Sapiens
aucagugcucgagacacagugaagcaaauuaaaaaaaaaaaaaaaaaaaaucccugaaugauga

SEQ ID NO: 31454 - RNA, 64 nt, Homo Sapiens
ucagugcucgagacacagugaagcaaauuaaaaaaaaaaaaaaaaaaaaucccugaaugaugau

SEQ ID NO: 31455 - RNA, 64 nt, Homo Sapiens
cagugcucgagacacagugaagcaaauuaaaaaaaaaaaaaaaaaaaaucccugaaugaugauu

SEQ ID NO: 31456 - RNA, 64 nt, Homo Sapiens
agugcucgagacacagugaagcaaauuaaaaaaaaaaaaaaaaaaaaucccugaaugaugauua

SEQ ID NO: 31457 - RNA, 64 nt, Homo Sapiens
gugcucgagacacagugaagcaaauuaaaaaaaaaaaaaaaaaaaaucccugaaugaugauuag

SEQ ID NO: 31458 - RNA, 64 nt, Homo Sapiens
ugcucgagacacagugaagcaaauuaaaaaaaaaaaaaaaaaaaaucccugaaugaugauuaga

SEQ ID NO: 31459 - RNA, 64 nt, Homo Sapiens
gcucgagacacagugaagcaaauuaaaaaaaaaaaaaaaaaaaaucccugaaugaugauuagag

SEQ ID NO: 31460 - RNA, 64 nt, Homo Sapiens
cucgagacacagugaagcaaauuaaaaaaaaaaaaaaaaaaaaucccugaaugaugauuagaga

SEQ ID NO: 31461 - RNA, 64 nt, Homo Sapiens
ucgagacacagugaagcaaauuaaaaaaaaaaaaaaaaaaaaucccugaaugaugauuagagac

SEQ ID NO: 31462 - RNA, 64 nt, Homo Sapiens
uguauuguuuuuauuuugcgaaacaaaacaaaacaaaaaaaaaagcuuggaacuccaucacgug

SEQ ID NO: 31463 - RNA, 64 nt, Homo Sapiens
guauuguuuuuauuuugcgaaacaaaacaaaacaaaaaaaaaagcuuggaacuccaucacgugg

SEQ ID NO: 31464 - RNA, 64 nt, Homo Sapiens
uauuguuuuuauuuugcgaaacaaaacaaaacaaaaaaaaaagcuuggaacuccaucacgugga

SEQ ID NO: 31465 - RNA, 64 nt, Homo Sapiens
cuuuuauaaugaaguaaaaguugugucuauaauuaaaaaaaaauauauauauauacacacacac

SEQ ID NO: 31466 - RNA, 64 nt, Homo Sapiens
uuuuauaaugaaguaaaaguugugucuauaauuaaaaaaaaauauauauauauacacacacaca

SEQ ID NO: 31467 - RNA, 64 nt, Homo Sapiens
auuauaaaaauaaugaauucucacuguaaauuucaaaaaaaaauuacaaaaguaugugaauuua

SEQ ID NO: 31468 - RNA, 64 nt, Homo Sapiens
uuauaaaaauaaugaauucucacuguaaauuucaaaaaaaaauuacaaaaguaugugaauuuaa

SEQ ID NO: 31469 - RNA, 64 nt, Homo Sapiens
gcagcaguggccucuacguuuuacuccuuugcugaaaaaaaaucaucuugcccacaggccugug

SEQ ID NO: 31470 - RNA, 64 nt, Homo Sapiens
ccaaucuauucuaauuaccuuaaaucuaaaggggaaaaaaaaaaucacaaacaggacuggguag

SEQ ID NO: 31471 - RNA, 64 nt, Homo Sapiens
caaucuauucuaauuaccuuaaaucuaaaggggaaaaaaaaaaucacaaacaggacuggguagu

SEQ ID NO: 31472 - RNA, 64 nt, Homo Sapiens
aaucuauucuaauuaccuuaaaucuaaaggggaaaaaaaaaaucacaaacaggacuggguaguu

SEQ ID NO: 31473 - RNA, 64 nt, Homo Sapiens
cuaggcaacagagcgagacucugucuccccccgcaaaaaaaaaaaagaaagaaagaaagagaaa

SEQ ID NO: 31474 - RNA, 64 nt, Homo Sapiens
uaggcaacagagcgagacucugucuccccccgcaaaaaaaaaaaagaaagaaagaaagagaaaa

SEQ ID NO: 31475 - RNA, 64 nt, Homo Sapiens
aggcaacagagcgagacucugucuccccccgcaaaaaaaaaaaagaaagaaagaaagagaaaag

SEQ ID NO: 31476 - RNA, 64 nt, Homo Sapiens
ggcaacagagcgagacucugucuccccccgcaaaaaaaaaaaagaaagaaagaaagagaaaaga

SEQ ID NO: 31477 - RNA, 64 nt, Homo Sapiens
gcaacagagcgagacucugucuccccccgcaaaaaaaaaaaagaaagaaagaaagagaaaagaa

SEQ ID NO: 31478 - RNA, 64 nt, Homo Sapiens
cagaccuacaaagaguuaaaacaaacagacaaacaaaaaaaaacacuacuauuuuaaauagugg

SEQ ID NO: 31479 - RNA, 64 nt, Homo Sapiens
agaccuacaaagaguuaaaacaaacagacaaacaaaaaaaaacacuacuauuuuaaauagugga

SEQ ID NO: 31480 - RNA, 64 nt, Homo Sapiens
uauacccccaccccacaaagauuuucuucagguuaaaaaaaaaguuuaaaaaaaagauuuuaaa

SEQ ID NO: 31481 - RNA, 64 nt, Homo Sapiens
auacccccaccccacaaagauuuucuucagguuaaaaaaaaaguuuaaaaaaaagauuuuaaaa

SEQ ID NO: 31482 - RNA, 64 nt, Homo Sapiens
cacaaagauuuucuucagguuaaaaaaaaaguuuaaaaaaaagauuuuaaaauaaagcauuuau

SEQ ID NO: 31483 - RNA, 64 nt, Homo Sapiens
acguccugggggaggggggcauuuuuuauguuacaaaaaaaaauuacgaaagaaaagaaaucuc

SEQ ID NO: 31484 - RNA, 64 nt, Homo Sapiens
cguccugggggaggggggcauuuuuuauguuacaaaaaaaaauuacgaaagaaaagaaaucucu

SEQ ID NO: 31485 - RNA, 64 nt, Homo Sapiens
uuauuuuucuucuguacagucuaaagcuacagagaaaaaaaaaugcacucuucccuugccggcu

SEQ ID NO: 31486 - RNA, 64 nt, Homo Sapiens
uauuuuucuucuguacagucuaaagcuacagagaaaaaaaaaugcacucuucccuugccggcuc

SEQ ID NO: 31487 - RNA, 64 nt, Homo Sapiens
acacauaacauggguuauuuaguuuaacucuggcaaaaaaaaaaaaaaaaauuuuguauguuga

SEQ ID NO: 31488 - RNA, 64 nt, Homo Sapiens
cacauaacauggguuauuuaguuuaacucuggcaaaaaaaaaaaaaaaaauuuuguauguugau

SEQ ID NO: 31489 - RNA, 64 nt, Homo Sapiens
acauaacauggguuauuuaguuuaacucuggcaaaaaaaaaaaaaaaaauuuuguauguugaug

SEQ ID NO: 31490 - RNA, 64 nt, Homo Sapiens
cauaacauggguuauuuaguuuaacucuggcaaaaaaaaaaaaaaaaauuuuguauguugaugu

SEQ ID NO: 31491 - RNA, 64 nt, Homo Sapiens
auaacauggguuauuuaguuuaacucuggcaaaaaaaaaaaaaaaaauuuuguauguugauguu

SEQ ID NO: 31492 - RNA, 64 nt, Homo Sapiens
uaacauggguuauuuaguuuaacucuggcaaaaaaaaaaaaaaaaauuuuguauguugauguuu

SEQ ID NO: 31493 - RNA, 64 nt, Homo Sapiens
aacauggguuauuuaguuuaacucuggcaaaaaaaaaaaaaaaaauuuuguauguugauguuug

SEQ ID NO: 31494 - RNA, 64 nt, Homo Sapiens
acauggguuauuuaguuuaacucuggcaaaaaaaaaaaaaaaaauuuuguauguugauguuugu

SEQ ID NO: 31495 - RNA, 64 nt, Homo Sapiens
cauggguuauuuaguuuaacucuggcaaaaaaaaaaaaaaaaauuuuguauguugauguuugua

SEQ ID NO: 31496 - RNA, 64 nt, Homo Sapiens
auggguuauuuaguuuaacucuggcaaaaaaaaaaaaaaaaauuuuguauguugauguuuguau

SEQ ID NO: 31497 - RNA, 64 nt, Homo Sapiens
aaaccaaaaugacaucuuuuuaaagcuuauccauaaaaaaaaauagaugucuuuuauaguggaa

SEQ ID NO: 31498 - RNA, 64 nt, Homo Sapiens
aaccaaaaugacaucuuuuuaaagcuuauccauaaaaaaaaauagaugucuuuuauaguggaaa

SEQ ID NO: 31499 - RNA, 64 nt, Homo Sapiens
auacuuuaaauaauuuaacuacccuuaauuacuuaaaaaaaaaaaaaagcuuuaugauuuucau

SEQ ID NO: 31500 - RNA, 64 nt, Homo Sapiens
uacuuuaaauaauuuaacuacccuuaauuacuuaaaaaaaaaaaaaagcuuuaugauuuucaua

SEQ ID NO: 31501 - RNA, 64 nt, Homo Sapiens
acuuuaaauaauuuaacuacccuuaauuacuuaaaaaaaaaaaaaagcuuuaugauuuucauaa

SEQ ID NO: 31502 - RNA, 64 nt, Homo Sapiens
cuuuaaauaauuuaacuacccuuaauuacuuaaaaaaaaaaaaaagcuuuaugauuuucauaac

SEQ ID NO: 31503 - RNA, 64 nt, Homo Sapiens
uuuaaauaauuuaacuacccuuaauuacuuaaaaaaaaaaaaaagcuuuaugauuuucauaacu

SEQ ID NO: 31504 - RNA, 64 nt, Homo Sapiens
uuaaauaauuuaacuacccuuaauuacuuaaaaaaaaaaaaaagcuuuaugauuuucauaacuu

SEQ ID NO: 31505 - RNA, 64 nt, Homo Sapiens
uaaauaauuuaacuacccuuaauuacuuaaaaaaaaaaaaaagcuuuaugauuuucauaacuua

SEQ ID NO: 31506 - RNA, 64 nt, Homo Sapiens
cucguuugggcaacaagagugaaacucuugucucaaaaaaaaaaaaaaaugagguuuaagacag

SEQ ID NO: 31507 - RNA, 64 nt, Homo Sapiens
ucguuugggcaacaagagugaaacucuugucucaaaaaaaaaaaaaaaugagguuuaagacagu

SEQ ID NO: 31508 - RNA, 64 nt, Homo Sapiens
cguuugggcaacaagagugaaacucuugucucaaaaaaaaaaaaaaaugagguuuaagacaguu

SEQ ID NO: 31509 - RNA, 64 nt, Homo Sapiens
guuugggcaacaagagugaaacucuugucucaaaaaaaaaaaaaaaugagguuuaagacaguuu

SEQ ID NO: 31510 - RNA, 64 nt, Homo Sapiens
uuugggcaacaagagugaaacucuugucucaaaaaaaaaaaaaaaugagguuuaagacaguuuu

SEQ ID NO: 31511 - RNA, 64 nt, Homo Sapiens
uugggcaacaagagugaaacucuugucucaaaaaaaaaaaaaaaugagguuuaagacaguuuug

SEQ ID NO: 31512 - RNA, 64 nt, Homo Sapiens
ugggcaacaagagugaaacucuugucucaaaaaaaaaaaaaaaugagguuuaagacaguuuugu

SEQ ID NO: 31513 - RNA, 64 nt, Homo Sapiens
gggcaacaagagugaaacucuugucucaaaaaaaaaaaaaaaugagguuuaagacaguuuuguc

SEQ ID NO: 31514 - RNA, 64 nt, Homo Sapiens
acugguguaaacagugaaagguauuugcuuguugaaaaaaaaaacuggcaaagugaaaagauac

SEQ ID NO: 31515 - RNA, 64 nt, Homo Sapiens
cugguguaaacagugaaagguauuugcuuguugaaaaaaaaaacuggcaaagugaaaagauaca

SEQ ID NO: 31516 - RNA, 64 nt, Homo Sapiens
ugguguaaacagugaaagguauuugcuuguugaaaaaaaaaacuggcaaagugaaaagauacag

SEQ ID NO: 31517 - RNA, 64 nt, Homo Sapiens
acugcacuccagccugggugacagauuuugucuuaaaaaaaaaaaaaaaaaaguugauaugagu

SEQ ID NO: 31518 - RNA, 64 nt, Homo Sapiens
cugcacuccagccugggugacagauuuugucuuaaaaaaaaaaaaaaaaaaguugauaugaguu

SEQ ID NO: 31519 - RNA, 64 nt, Homo Sapiens
ugcacuccagccugggugacagauuuugucuuaaaaaaaaaaaaaaaaaaguugauaugaguuu

SEQ ID NO: 31520 - RNA, 64 nt, Homo Sapiens
gcacuccagccugggugacagauuuugucuuaaaaaaaaaaaaaaaaaaguugauaugaguuuu

SEQ ID NO: 31521 - RNA, 64 nt, Homo Sapiens
cacuccagccugggugacagauuuugucuuaaaaaaaaaaaaaaaaaaguugauaugaguuuua

SEQ ID NO: 31522 - RNA, 64 nt, Homo Sapiens
acuccagccugggugacagauuuugucuuaaaaaaaaaaaaaaaaaaguugauaugaguuuuau

SEQ ID NO: 31523 - RNA, 64 nt, Homo Sapiens
cuccagccugggugacagauuuugucuuaaaaaaaaaaaaaaaaaaguugauaugaguuuuauu

SEQ ID NO: 31524 - RNA, 64 nt, Homo Sapiens
uccagccugggugacagauuuugucuuaaaaaaaaaaaaaaaaaaguugauaugaguuuuauuu

SEQ ID NO: 31525 - RNA, 64 nt, Homo Sapiens
ccagccugggugacagauuuugucuuaaaaaaaaaaaaaaaaaaguugauaugaguuuuauuuu

SEQ ID NO: 31526 - RNA, 64 nt, Homo Sapiens
cagccugggugacagauuuugucuuaaaaaaaaaaaaaaaaaaguugauaugaguuuuauuuuc

SEQ ID NO: 31527 - RNA, 64 nt, Homo Sapiens
agccugggugacagauuuugucuuaaaaaaaaaaaaaaaaaaguugauaugaguuuuauuuucu

SEQ ID NO: 31528 - RNA, 64 nt, Homo Sapiens
aguauaagucaaucuauggucagugucuuugguuaaaaaaaaaaaaaaacacaggcaguucuuu

SEQ ID NO: 31529 - RNA, 64 nt, Homo Sapiens
guauaagucaaucuauggucagugucuuugguuaaaaaaaaaaaaaaacacaggcaguucuuua

SEQ ID NO: 31530 - RNA, 64 nt, Homo Sapiens
uauaagucaaucuauggucagugucuuugguuaaaaaaaaaaaaaaacacaggcaguucuuuac

SEQ ID NO: 31531 - RNA, 64 nt, Homo Sapiens
auaagucaaucuauggucagugucuuugguuaaaaaaaaaaaaaaacacaggcaguucuuuaca

SEQ ID NO: 31532 - RNA, 64 nt, Homo Sapiens
uaagucaaucuauggucagugucuuugguuaaaaaaaaaaaaaaacacaggcaguucuuuacau

SEQ ID NO: 31533 - RNA, 64 nt, Homo Sapiens
aagucaaucuauggucagugucuuugguuaaaaaaaaaaaaaaacacaggcaguucuuuacaua

SEQ ID NO: 31534 - RNA, 64 nt, Homo Sapiens
agucaaucuauggucagugucuuugguuaaaaaaaaaaaaaaacacaggcaguucuuuacauaa

SEQ ID NO: 31535 - RNA, 64 nt, Homo Sapiens
gucaaucuauggucagugucuuugguuaaaaaaaaaaaaaaacacaggcaguucuuuacauaaa

SEQ ID NO: 31536 - RNA, 64 nt, Homo Sapiens
agagacccugcaguugcacuuucucguaaaaguuaaaaaaaaaaaaaaaaaaaaaagguuuuuc

SEQ ID NO: 31537 - RNA, 64 nt, Homo Sapiens
gagacccugcaguugcacuuucucguaaaaguuaaaaaaaaaaaaaaaaaaaaaagguuuuucc

SEQ ID NO: 31538 - RNA, 64 nt, Homo Sapiens
agacccugcaguugcacuuucucguaaaaguuaaaaaaaaaaaaaaaaaaaaaagguuuuuccc

SEQ ID NO: 31539 - RNA, 64 nt, Homo Sapiens
gacccugcaguugcacuuucucguaaaaguuaaaaaaaaaaaaaaaaaaaaaagguuuuucccg

SEQ ID NO: 31540 - RNA, 64 nt, Homo Sapiens
acccugcaguugcacuuucucguaaaaguuaaaaaaaaaaaaaaaaaaaaaagguuuuucccgg

SEQ ID NO: 31541 - RNA, 64 nt, Homo Sapiens
cccugcaguugcacuuucucguaaaaguuaaaaaaaaaaaaaaaaaaaaaagguuuuucccggc

SEQ ID NO: 31542 - RNA, 64 nt, Homo Sapiens
ccugcaguugcacuuucucguaaaaguuaaaaaaaaaaaaaaaaaaaaaagguuuuucccggcc

SEQ ID NO: 31543 - RNA, 64 nt, Homo Sapiens
cugcaguugcacuuucucguaaaaguuaaaaaaaaaaaaaaaaaaaaaagguuuuucccggccu

SEQ ID NO: 31544 - RNA, 64 nt, Homo Sapiens
ugcaguugcacuuucucguaaaaguuaaaaaaaaaaaaaaaaaaaaaagguuuuucccggccuu

SEQ ID NO: 31545 - RNA, 64 nt, Homo Sapiens
gcaguugcacuuucucguaaaaguuaaaaaaaaaaaaaaaaaaaaaagguuuuucccggccuuu

SEQ ID NO: 31546 - RNA, 64 nt, Homo Sapiens
caguugcacuuucucguaaaaguuaaaaaaaaaaaaaaaaaaaaaagguuuuucccggccuuug

SEQ ID NO: 31547 - RNA, 64 nt, Homo Sapiens
aguugcacuuucucguaaaaguuaaaaaaaaaaaaaaaaaaaaaagguuuuucccggccuuuga

SEQ ID NO: 31548 - RNA, 64 nt, Homo Sapiens
guugcacuuucucguaaaaguuaaaaaaaaaaaaaaaaaaaaaagguuuuucccggccuuugaa

SEQ ID NO: 31549 - RNA, 64 nt, Homo Sapiens
uugcacuuucucguaaaaguuaaaaaaaaaaaaaaaaaaaaaagguuuuucccggccuuugaac

SEQ ID NO: 31550 - RNA, 64 nt, Homo Sapiens
ugcacuuucucguaaaaguuaaaaaaaaaaaaaaaaaaaaaagguuuuucccggccuuugaaca

SEQ ID NO: 31551 - RNA, 64 nt, Homo Sapiens
uguuccaaggcauuuuagcggggaggggguuaucaaaaaaaaaaaaaugugacucaagacuucc

SEQ ID NO: 31552 - RNA, 64 nt, Homo Sapiens
guuccaaggcauuuuagcggggaggggguuaucaaaaaaaaaaaaaugugacucaagacuucca

SEQ ID NO: 31553 - RNA, 64 nt, Homo Sapiens
uuccaaggcauuuuagcggggaggggguuaucaaaaaaaaaaaaaugugacucaagacuuccag

SEQ ID NO: 31554 - RNA, 64 nt, Homo Sapiens
uccaaggcauuuuagcggggaggggguuaucaaaaaaaaaaaaaugugacucaagacuuccaga

SEQ ID NO: 31555 - RNA, 64 nt, Homo Sapiens
ccaaggcauuuuagcggggaggggguuaucaaaaaaaaaaaaaugugacucaagacuuccagag

SEQ ID NO: 31556 - RNA, 64 nt, Homo Sapiens
caaggcauuuuagcggggaggggguuaucaaaaaaaaaaaaaugugacucaagacuuccagagc

SEQ ID NO: 31557 - RNA, 50 nt, Homo Sapiens
aggaugaugaagaugaaugaaaaaaaaaaucaaacagcagaagaccaagg

SEQ ID NO: 31558 - RNA, 51 nt, Homo Sapiens
aggaugaugaagaugaaugaaaaaaaaaaucaaacagcagaagaccaaggc

SEQ ID NO: 31559 - RNA, 64 nt, Homo Sapiens
ugaucccauuaccagauaagauugacugacggggaaaaaaaaaaaaaaagaauggggugugaau

SEQ ID NO: 31560 - RNA, 64 nt, Homo Sapiens
gaucccauuaccagauaagauugacugacggggaaaaaaaaaaaaaaagaauggggugugaaug

SEQ ID NO: 31561 - RNA, 64 nt, Homo Sapiens
aucccauuaccagauaagauugacugacggggaaaaaaaaaaaaaaagaauggggugugaaugu

SEQ ID NO: 31562 - RNA, 64 nt, Homo Sapiens
ucccauuaccagauaagauugacugacggggaaaaaaaaaaaaaaagaauggggugugaaugua

SEQ ID NO: 31563 - RNA, 64 nt, Homo Sapiens
cccauuaccagauaagauugacugacggggaaaaaaaaaaaaaaagaauggggugugaauguac

SEQ ID NO: 31564 - RNA, 64 nt, Homo Sapiens
ccauuaccagauaagauugacugacggggaaaaaaaaaaaaaaagaauggggugugaauguacc

SEQ ID NO: 31565 - RNA, 64 nt, Homo Sapiens
cauuaccagauaagauugacugacggggaaaaaaaaaaaaaaagaauggggugugaauguacca

SEQ ID NO: 31566 - RNA, 64 nt, Homo Sapiens
auuaccagauaagauugacugacggggaaaaaaaaaaaaaaagaauggggugugaauguaccaa

SEQ ID NO: 31567 - RNA, 64 nt, Homo Sapiens
cuccagccugggcgacagagcgagacuccgucucaaaaaaaaaaaaaaaagauucaauguucau

SEQ ID NO: 31568 - RNA, 64 nt, Homo Sapiens
uccagccugggcgacagagcgagacuccgucucaaaaaaaaaaaaaaaagauucaauguucauu

SEQ ID NO: 31569 - RNA, 64 nt, Homo Sapiens
ccagccugggcgacagagcgagacuccgucucaaaaaaaaaaaaaaaagauucaauguucauug

SEQ ID NO: 31570 - RNA, 64 nt, Homo Sapiens
cagccugggcgacagagcgagacuccgucucaaaaaaaaaaaaaaaagauucaauguucauugu

SEQ ID NO: 31571 - RNA, 64 nt, Homo Sapiens
agccugggcgacagagcgagacuccgucucaaaaaaaaaaaaaaaagauucaauguucauuguu

SEQ ID NO: 31572 - RNA, 64 nt, Homo Sapiens
gccugggcgacagagcgagacuccgucucaaaaaaaaaaaaaaaagauucaauguucauuguua

SEQ ID NO: 31573 - RNA, 64 nt, Homo Sapiens
ccugggcgacagagcgagacuccgucucaaaaaaaaaaaaaaaagauucaauguucauuguuau

SEQ ID NO: 31574 - RNA, 64 nt, Homo Sapiens
cugggcgacagagcgagacuccgucucaaaaaaaaaaaaaaaagauucaauguucauuguuauu

SEQ ID NO: 31575 - RNA, 64 nt, Homo Sapiens
ugggcgacagagcgagacuccgucucaaaaaaaaaaaaaaaagauucaauguucauuguuauuu

SEQ ID NO: 31576 - RNA, 64 nt, Homo Sapiens
cauuucaucuaagccacuuaucugauaaccaaaaaaaaaaaagaaauauuuucacaaaggguua

SEQ ID NO: 31577 - RNA, 64 nt, Homo Sapiens
acauuucaucuaagccacuuaucugauaaccaaaaaaaaaaaagaaauauuuucacaaaggguu

SEQ ID NO: 31578 - RNA, 64 nt, Homo Sapiens
gacauuucaucuaagccacuuaucugauaaccaaaaaaaaaaaaaaaauauuuucacaaagggu

SEQ ID NO: 31579 - RNA, 64 nt, Homo Sapiens
agacauuucaucuaagccacuuaucugauaaccaaaaaaaaaaagaaaauauuuucacaaaggg

SEQ ID NO: 31580 - RNA, 64 nt, Homo Sapiens
aagacauuucaucuaagccaguuaucugauaaccaaaaaaaaaaggaaaauauuuucacaaagg

SEQ ID NO: 31581 - RNA, 64 nt, Homo Sapiens
auuccuggggccugcccagugacuccgucuccaaaaaaaaaagacagccugggcaacagagcaa

SEQ ID NO: 31582 - RNA, 64 nt, Homo Sapiens
aauuccuggggccugcccagagacuccgucuccaaaaaaaaaagccagccugggcaacagagca

SEQ ID NO: 31583 - RNA, 64 nt, Homo Sapiens
aaaaaaaaaaagaauuccugaagacuccgucuccaaaaaaaaaauccagccugggcaacagagc

SEQ ID NO: 31584 - RNA, 64 nt, Homo Sapiens
guccucuuaaucguuuacuuaaauggaauaaaaaaaaaaaaagagcaaacagguggauguguaa

SEQ ID NO: 31585 - RNA, 64 nt, Homo Sapiens
aguccucuuaaucguuuacuaaaauggaauaaaaaaaaaaaaagggcaaacagguggaugugua

SEQ ID NO: 31586 - RNA, 64 nt, Homo Sapiens
gaguccucuuaaucguuuacaaaaauggaauaaaaaaaaaaaaauggcaaacagguggaugugu

SEQ ID NO: 31587 - RNA, 64 nt, Homo Sapiens
agaguccucuuaaucguuuauaaaaauggaauaaaaaaaaaaaaauggcaaacagguggaugug

SEQ ID NO: 31588 - RNA, 64 nt, Homo Sapiens
aagaguccucuuaaucguuuguaaaaauggaauaaaaaaaaaaacauggcaaacagguggaugu

SEQ ID NO: 31589 - RNA, 64 nt, Homo Sapiens
aaagaguccucuuaaucguuuguaaaaauggaauaaaaaaaaaaucauggcaaacagguggaug

SEQ ID NO: 31590 - RNA, 64 nt, Homo Sapiens
caugggagagaugguguuuuaaacaaaacaaaacaaaaaaaagaagccaaacuccgucaaaaaa

SEQ ID NO: 31591 - RNA, 64 nt, Homo Sapiens
aaacaaaacaaaaaaaagacgccaaacuccgucaaaaaaaaacaacuccagcuggagugacaga

SEQ ID NO: 31592 - RNA, 64 nt, Homo Sapiens
aaaacaaaacaaaaaaaagaagccaaacuccgucaaaaaaaaaccacuccagcuggagugacag

SEQ ID NO: 31593 - RNA, 64 nt, Homo Sapiens
uaguauuuucuguuguccaguuugcauuugauaaaaaaaaaauaccaagcuuauaguuaggacc

SEQ ID NO: 31594 - RNA, 64 nt, Homo Sapiens
auaguauuuucuguuguccacuuugcauuugauaaaaaaaaaauaccaagcuuauaguuaggac

SEQ ID NO: 31595 - RNA, 64 nt, Homo Sapiens
uauaguauuuucuguuguccccuuugcauuugauaaaaaaaaaauaccaagcuuauaguuagga

SEQ ID NO: 31596 - RNA, 64 nt, Homo Sapiens
guaaaagugaaauauuacuguugcuuuaauggaaaaaaaaaacaaguuuugcagcacaauggug

SEQ ID NO: 31597 - RNA, 64 nt, Homo Sapiens
aguaaaagugaaauauuacuguugcuuuaauggaaaaaaaaaacuaguuuugcagcacaauggu

SEQ ID NO: 31598 - RNA, 64 nt, Homo Sapiens
caguaaaagugaaauauuacuguugcuuuaauggaaaaaaaaaauuaguuuugcagcacaaugg

SEQ ID NO: 31599 - RNA, 64 nt, Homo Sapiens
caggcaugguggugggcuacaaaaaaaaaaaaaaaaaaaaaagcugaaaugugucucuacuuac

SEQ ID NO: 31600 - RNA, 64 nt, Homo Sapiens
ccaggcaugguggugggcuacaaaaaaaaaaaaaaaaaaaaaaggugaaaugugucucuacuua

SEQ ID NO: 31601 - RNA, 64 nt, Homo Sapiens
gccaggcaugguggugggcuacaaaaaaaaaaaaaaaaaaaaaaagugaaaugugucucuacuu

SEQ ID NO: 31602 - RNA, 64 nt, Homo Sapiens
agccaggcaugguggugggcuacaaaaaaaaaaaaaaaaaaaaacagugaaaugugucucuacu

SEQ ID NO: 31603 - RNA, 64 nt, Homo Sapiens
aagccaggcauggugguggguuacaaaaaaaaaaaaaaaaaaaaacagugaaaugugucucuac

SEQ ID NO: 31604 - RNA, 64 nt, Homo Sapiens
aaagccaggcauggugguggcuuacaaaaaaaaaaaaaaaaaaacacagugaaaugugucucua

SEQ ID NO: 31605 - RNA, 64 nt, Homo Sapiens
aaaagccaggcaugguggugacuuacaaaaaaaaaaaaaaaaaaacacagugaaaugugucucu

SEQ ID NO: 31606 - RNA, 64 nt, Homo Sapiens
aaaaagccaggcauggugguuacuuacaaaaaaaaaaaaaaaaaaacacagugaaaugugucuc

SEQ ID NO: 31607 - RNA, 64 nt, Homo Sapiens
aaaaaagccaggcaugguggcuacuuacaaaaaaaaaaaaaaaacaacacagugaaaugugucu

SEQ ID NO: 31608 - RNA, 64 nt, Homo Sapiens
aaaaaaagccaggcauggugucuacuuacaaaaaaaaaaaaaaaccaacacagugaaauguguc

SEQ ID NO: 31609 - RNA, 64 nt, Homo Sapiens
aaaaaaaagccaggcauggucucuacuuacaaaaaaaaaaaaaagccaacacagugaaaugugu

SEQ ID NO: 31610 - RNA, 64 nt, Homo Sapiens
aaaaaaaaagccaggcauggucucuacuuacaaaaaaaaaaaaaggccaacacagugaaaugug

SEQ ID NO: 31611 - RNA, 64 nt, Homo Sapiens
aaaaaaaaaagccaggcauggucucuacuuacaaaaaaaaaaaauggccaacacagugaaaugu

SEQ ID NO: 31612 - RNA, 64 nt, Homo Sapiens
aaaaaaaaaaagccaggcauugucucuacuuacaaaaaaaaaaacuggccaacacagugaaaug

SEQ ID NO: 31613 - RNA, 64 nt, Homo Sapiens
aaaaaaaaaaaagccaggcagugucucuacuuacaaaaaaaaaaccuggccaacacagugaaau

SEQ ID NO: 31614 - RNA, 64 nt, Homo Sapiens
aagagccuguacccgcgacuccgucucaaaaaaaaaaaaaaagagggugacagagcgugagacu

SEQ ID NO: 31615 - RNA, 64 nt, Homo Sapiens
aaagagccuguacccgcgacuccgucucaaaaaaaaaaaaaaagugggugacagagcgugagac

SEQ ID NO: 31616 - RNA, 64 nt, Homo Sapiens
gaaagagccuguacccgcgacuccgucucaaaaaaaaaaaaaaacugggugacagagcgugaga

SEQ ID NO: 31617 - RNA, 64 nt, Homo Sapiens
agaaagagccuguacccgcgacuccgucucaaaaaaaaaaaaaaccugggugacagagcgugag

SEQ ID NO: 31618 - RNA, 64 nt, Homo Sapiens
aagaaagagccuguacccgcgacuccgucucaaaaaaaaaaaaagccugggugacagagcguga

SEQ ID NO: 31619 - RNA, 64 nt, Homo Sapiens
aaagaaagagccuguacccgagacuccgucucaaaaaaaaaaaaagccugggugacagagcgug

SEQ ID NO: 31620 - RNA, 64 nt, Homo Sapiens
aaaagaaagagccuguacccgagacuccgucucaaaaaaaaaaacagccugggugacagagcgu

SEQ ID NO: 31621 - RNA, 64 nt, Homo Sapiens
aaaaagaaagagccuguaccugagacuccgucucaaaaaaaaaaccagccugggugacagagcg

SEQ ID NO: 31622 - RNA, 55 nt, Homo Sapiens
agaccaaagaccucaaacaccaagaaaaaaaaagaacaagaccccugaggcauga

SEQ ID NO: 31623 - RNA, 54 nt, Homo Sapiens
aagaccaaagaccucaaacacaagaaaaaaaaagacaagaccccugaggcauga

SEQ ID NO: 31624 - RNA, 64 nt, Homo Sapiens
guucaacaauaagggcaaaguuccguucccaagaaaaaaaaauugccugggcgacagagcaaga

SEQ ID NO: 31625 - RNA, 64 nt, Homo Sapiens
uguucaacaauaagggcaaaauuccguucccaagaaaaaaaaauagccugggcgacagagcaag

SEQ ID NO: 31626 - RNA, 64 nt, Homo Sapiens
guaugugaagaugcaccguccagaaggccgacacaaaaaaaaugacugaaagggcugucaaccc

SEQ ID NO: 31627 - RNA, 64 nt, Homo Sapiens
acaugccugaacaacuuuucaaaagcaucauuuaaaaaaaaaugaaaaccaaagugcuauuuuu

SEQ ID NO: 31628 - RNA, 64 nt, Homo Sapiens
gacaugccugaacaacuuuuuaaaagcaucauuuaaaaaaaaauuaaaaccaaagugcuauuuu

SEQ ID NO: 31629 - RNA, 64 nt, Homo Sapiens
aauugcccaucaauaaguuuaaacuuuugcaauaaaaaaaaauaauuuaaaaaguuuucugaaa

SEQ ID NO: 31630 - RNA, 64 nt, Homo Sapiens
aaauugcccaucaauaaguuaaaacuuuugcaauaaaaaaaaaucauuuaaaaaguuuucugaa

SEQ ID NO: 31631 - RNA, 64 nt, Homo Sapiens
aaagauaaugauuuauugcacacugauuugcuuuaaaaaaaauaaagguuuuuguccuuuccuu

SEQ ID NO: 31632 - RNA, 64 nt, Homo Sapiens
cuguuuguuuaaagcaugcaagauucucucauuuaaaaaaaauacuggucagacuuuuuuuguu

SEQ ID NO: 31633 - RNA, 64 nt, Homo Sapiens
aaauaaauuauuauaaccuugagacucugucucaaaaaaaaauuuccagccugggugacagagu

SEQ ID NO: 31634 - RNA, 64 nt, Homo Sapiens
uaaauaaauuauuauaaccuugagacucugucucaaaaaaaaaucuccagccugggugacagag

SEQ ID NO: 31635 - RNA, 64 nt, Homo Sapiens
gccagguguggggugcaugcuaaauuuaaauacaaaaaaaaauagccucaaaaaaaaauuaaaa

SEQ ID NO: 31636 - RNA, 64 nt, Homo Sapiens
agccagguguggggugcaugauaaauuuaaauacaaaaaaaaauugccucaaaaaaaaauuaaa

SEQ ID NO: 31637 - RNA, 64 nt, Homo Sapiens
aaaauaaauuuaaauacaaaaagacucugccucaaaaaaaaauuuccagccugggcaacagagc

SEQ ID NO: 31638 - RNA, 64 nt, Homo Sapiens
uaaaauaaauuuaaauacaacaagacucugccucaaaaaaaaaucuccagccugggcaacagag

SEQ ID NO: 31639 - RNA, 64 nt, Homo Sapiens
guaaaauauguauauauccauuguuaaauuguaaaaaaaaaaguggauguauuuauauaauuau

SEQ ID NO: 31640 - RNA, 64 nt, Homo Sapiens
uguaaaauauguauauauccuuuguuaaauuguaaaaaaaaaagaggauguauuuauauaauua

SEQ ID NO: 31641 - RNA, 64 nt, Homo Sapiens
guguaaaauauguauauaucauuuguuaaauuguaaaaaaaaaagaggauguauuuauauaauu

SEQ ID NO: 31642 - RNA, 64 nt, Homo Sapiens
uuggcuacccaacauucauuuacgcugcaaaaaaaaaaaaaaugauuauuuguauuuugugaau

SEQ ID NO: 31643 - RNA, 64 nt, Homo Sapiens
guuggcuacccaacauucauuuacgcugcaaaaaaaaaaaaaaucauuauuuguauuuugugaa

SEQ ID NO: 31644 - RNA, 64 nt, Homo Sapiens
uguuggcuacccaacauucaauuacgcugcaaaaaaaaaaaaaaucauuauuuguauuuuguga

SEQ ID NO: 31645 - RNA, 64 nt, Homo Sapiens
auguuggcuacccaacauucaauuacgcugcaaaaaaaaaaaaaaucauuauuuguauuuugug

SEQ ID NO: 31646 - RNA, 64 nt, Homo Sapiens
aauguuggcuacccaacauugaauuacgcugcaaaaaaaaaaaacaucauuauuuguauuuugu

SEQ ID NO: 31647 - RNA, 64 nt, Homo Sapiens
aaauguuggcuacccaacauugaauuacgcugcaaaaaaaaaaaucaucauuauuuguauuuug

SEQ ID NO: 31648 - RNA, 64 nt, Homo Sapiens
aaaauguuggcuacccaacagugaauuacgcugcaaaaaaaaaaaucaucauuauuuguauuuu

SEQ ID NO: 31649 - RNA, 64 nt, Homo Sapiens
aaauaaaaugcacauaaauuaugcagugauaccaaaaaaaaagguguacuggaagugcuaucua

SEQ ID NO: 31650 - RNA, 64 nt, Homo Sapiens
gaaauaaaaugcacauaaauaaugcagugauaccaaaaaaaaaguuguacuggaagugcuaucu

SEQ ID NO: 31651 - RNA, 64 nt, Homo Sapiens
uauccuguacgugugaagauuaacagauuaucugaaaaaaaaucuuaaaaguuauaaaucaaaa

SEQ ID NO: 31652 - RNA, 64 nt, Homo Sapiens
uucuguuauaaagugauuuuuuucaaaaagugcaaaaaaaaagauaaaaucagcaaaggcagug

SEQ ID NO: 31653 - RNA, 64 nt, Homo Sapiens
auucuguuauaaagugauuuguuucaaaaagugcaaaaaaaaagguaaaaucagcaaaggcagu

SEQ ID NO: 31654 - RNA, 64 nt, Homo Sapiens
aauaaaccucuaacucggucaaacucuauuaaaaaaaaaaaagaauuuaagaauaagacacaca

SEQ ID NO: 31655 - RNA, 64 nt, Homo Sapiens
aaauaaaccucuaacucgguaaaacucuauuaaaaaaaaaaaagaauuuaagaauaagacacac

SEQ ID NO: 31656 - RNA, 64 nt, Homo Sapiens
gaaauaaaccucuaacucggcaaaacucuauuaaaaaaaaaaaaaaauuuaagaauaagacaca

SEQ ID NO: 31657 - RNA, 64 nt, Homo Sapiens
agaaauaaaccucuaacucgacaaaacucuauuaaaaaaaaaaauaaauuuaagaauaagacac

SEQ ID NO: 31658 - RNA, 64 nt, Homo Sapiens
aagaaauaaaccucuaacuccacaaaacucuauuaaaaaaaaaauuaaauuuaagaauaagaca

SEQ ID NO: 31659 - RNA, 64 nt, Homo Sapiens
aaacuacuuguuguguugaaagugacauaaaaaaaaaaaaaacucaagguuaguaaauaaaaua

SEQ ID NO: 31660 - RNA, 64 nt, Homo Sapiens
uaaacuacuuguuguguugaaagugacauaaaaaaaaaaaaaacucaagguuaguaaauaaaau

SEQ ID NO: 31661 - RNA, 64 nt, Homo Sapiens
cuaaacuacuuguuguguuguaagugacauaaaaaaaaaaaaaagucaagguuaguaaauaaaa

SEQ ID NO: 31662 - RNA, 64 nt, Homo Sapiens
acuaaacuacuuguuguguuauaagugacauaaaaaaaaaaaaaugucaagguuaguaaauaaa

SEQ ID NO: 31663 - RNA, 64 nt, Homo Sapiens
aacuaaacuacuuguuguguaauaagugacauaaaaaaaaaaaacugucaagguuaguaaauaa

SEQ ID NO: 31664 - RNA, 64 nt, Homo Sapiens
aaacuaaacuacuuguugugaaauaagugacauaaaaaaaaaaaccugucaagguuaguaaaua

SEQ ID NO: 31665 - RNA, 64 nt, Homo Sapiens
aaaacuaaacuacuuguuguaaaauaagugacauaaaaaaaaaacccugucaagguuaguaaau

SEQ ID NO: 31666 - RNA, 64 nt, Homo Sapiens
cuuguuggauaauaguguuuguuaacagaaugaaaaaaaaaagucuucgaaugcauauuuaaga

SEQ ID NO: 31667 - RNA, 64 nt, Homo Sapiens
ucuuguuggauaauaguguuaguuaacagaaugaaaaaaaaaagccuucgaaugcauauuuaag

SEQ ID NO: 31668 - RNA, 64 nt, Homo Sapiens
gucuuguuggauaauagugugaguuaacagaaugaaaaaaaaaagccuucgaaugcauauuuaa

SEQ ID NO: 31669 - RNA, 64 nt, Homo Sapiens
accuauacgguaguugcuuuaccuaaaaacaacaaaaaaaaauagccaauuuuucaaugaaaug

SEQ ID NO: 31670 - RNA, 64 nt, Homo Sapiens
aaccuauacgguaguugcuugaccuaaaaacaacaaaaaaaaauugccaauuuuucaaugaaau

SEQ ID NO: 31671 - RNA, 64 nt, Homo Sapiens
aaucuuuaaaaucugcugcacuagcuugauuuuaaaaaaaaacauguuuguauaugcaaaacug

SEQ ID NO: 31672 - RNA, 64 nt, Homo Sapiens
aaaucuuuaaaaucugcugcgcuagcuugauuuuaaaaaaaaacauguuuguauaugcaaaacu

SEQ ID NO: 31673 - RNA, 64 nt, Homo Sapiens
cagcuuucauguuucugauucuuuuuauacaaagaaaaaaaauuuuuagucuguuauuuuguuu

SEQ ID NO: 31674 - RNA, 60 nt, Homo Sapiens
aaaaacagaaaccaaucgguagaggaagagaaaaaaaacacaucuccagcaguggccuga

SEQ ID NO: 31675 - RNA, 64 nt, Homo Sapiens
ugcauuugcuuaguuuauuucuuuuauaauaggaaaaaaaaauacuacucucuuauacuggcug

SEQ ID NO: 31676 - RNA, 64 nt, Homo Sapiens
augcauuugcuuaguuuauugcuuuuauaauaggaaaaaaaaauccuacucucuuauacuggcu

SEQ ID NO: 31677 - RNA, 64 nt, Homo Sapiens
uaaaaauaguuaagcacuguccuuuacaguuuaaaaaaaaaauccugucucuccuuccucccuu

SEQ ID NO: 31678 - RNA, 64 nt, Homo Sapiens
cuaaaaauaguuaagcacuguccuuuacaguuuaaaaaaaaaauucugucucuccuuccucccu

SEQ ID NO: 31679 - RNA, 64 nt, Homo Sapiens
ucuaaaaauaguuaagcacuuuccuuuacaguuuaaaaaaaaaauucugucucuccuuccuccc

SEQ ID NO: 31680 - RNA, 64 nt, Homo Sapiens
aacacuauagauuuguuuuuuaucuuugcucuuaaaaaaaaagugcagaaauaaaaauacugaa

SEQ ID NO: 31681 - RNA, 64 nt, Homo Sapiens
uaacacuauagauuuguuuuauaucuuugcucuuaaaaaaaaagggcagaaauaaaaauacuga

SEQ ID NO: 31682 - RNA, 64 nt, Homo Sapiens
caaccuuuacaucuagaauaaacuguguacuuuaaaaaaaaauuuagaguggauaguguguuaa

SEQ ID NO: 31683 - RNA, 64 nt, Homo Sapiens
ucaaccuuuacaucuagaauaaacuguguacuuuaaaaaaaaauauagaguggauaguguguua

SEQ ID NO: 31684 - RNA, 64 nt, Homo Sapiens
ucuauucauagcuuauccuuuuuuuuuuuuaaugaaaaaaaauuugggccaguaggagggauuu

SEQ ID NO: 31685 - RNA, 64 nt, Homo Sapiens
aauccauaccaugaugcguuaaaagauuguuuaaaaaaaaaagguaagaaaaaaaaaaaagaaa

SEQ ID NO: 31686 - RNA, 64 nt, Homo Sapiens
gaauccauaccaugaugcguaaaaagauuguuuaaaaaaaaaaguuaagaaaaaaaaaaaagaa

SEQ ID NO: 31687 - RNA, 64 nt, Homo Sapiens
ggaauccauaccaugaugcgaaaaaagauuguuuaaaaaaaaaauuuaagaaaaaaaaaaaaga

SEQ ID NO: 31688 - RNA, 64 nt, Homo Sapiens
aaaaaagauuguuuaaaaaauacauuuaagaaaaaaaaaaaagaugcuguaccgagguguuuuu

SEQ ID NO: 31689 - RNA, 64 nt, Homo Sapiens
aaaaaaagauuguuuaaaaauuacauuuaagaaaaaaaaaaaagcugcuguaccgagguguuuu

SEQ ID NO: 31690 - RNA, 64 nt, Homo Sapiens
gaaaaaaagauuguuuaaaauuuacauuuaagaaaaaaaaaaaaucugcuguaccgagguguuu

SEQ ID NO: 31691 - RNA, 64 nt, Homo Sapiens
agaaaaaaagauuguuuaaauuuuacauuuaagaaaaaaaaaaacucugcuguaccgagguguu

SEQ ID NO: 31692 - RNA, 64 nt, Homo Sapiens
aagaaaaaaagauuguuuaauuuuuacauuuaagaaaaaaaaaaucucugcuguaccgaggugu

SEQ ID NO: 31693 - RNA, 64 nt, Homo Sapiens
aaaaaauaauugagaaagugugacuuuuuauagaaaaaaaaaggaaaguugaaaaaauaucauu

SEQ ID NO: 31694 - RNA, 64 nt, Homo Sapiens
gaaaaaauaauugagaaaguuugacuuuuuauagaaaaaaaaagaaaaguugaaaaaauaucau

SEQ ID NO: 31695 - RNA, 64 nt, Homo Sapiens
gccagaaagucauuccuuccuuuuagaaaaaacaaaaaaaaagguuacugccaaacucacuccu

SEQ ID NO: 31696 - RNA, 64 nt, Homo Sapiens
ggccagaaagucauuccuucuuuuuagaaaaaacaaaaaaaaagguuacugccaaacucacucc

SEQ ID NO: 31697 - RNA, 64 nt, Homo Sapiens
ucccaacucagauuucugugaguucucuaggaaaaaaaaaaacuaaaugauugauauucaagca

SEQ ID NO: 31698 - RNA, 64 nt, Homo Sapiens
uucccaacucagauuucuguaaguucucuaggaaaaaaaaaaacgaaaugauugauauucaagc

SEQ ID NO: 31699 - RNA, 64 nt, Homo Sapiens
cuucccaacucagauuucugcaaguucucuaggaaaaaaaaaaaggaaaugauugauauucaag

SEQ ID NO: 31700 - RNA, 64 nt, Homo Sapiens
acuucccaacucagauuucugcaaguucucuaggaaaaaaaaaagggaaaugauugauauucaa

SEQ ID NO: 31701 - RNA, 64 nt, Homo Sapiens
aaagaaaaaaggcauaaaucuauaaaaaauagaaaaaaaaaagaaauacuguuuguacuguuug

SEQ ID NO: 31702 - RNA, 64 nt, Homo Sapiens
aaaagaaaaaaggcauaaauguauaaaaaauagaaaaaaaaaagcaauacuguuuguacuguuu

SEQ ID NO: 31703 - RNA, 64 nt, Homo Sapiens
gaaaagaaaaaaggcauaaauguauaaaaaauagaaaaaaaaaagcaauacuguuuguacuguu

SEQ ID NO: 31704 - RNA, 64 nt, Homo Sapiens
augugcuuaagaagugggacgaucaguaaaagaaaaaaaaaauaaucuuuugcagucucucugg

SEQ ID NO: 31705 - RNA, 64 nt, Homo Sapiens
aaugugcuuaagaagugggaggaucaguaaaagaaaaaaaaaauuaucuuuugcagucucucug

SEQ ID NO: 31706 - RNA, 64 nt, Homo Sapiens
uaaugugcuuaagaaguggggggaucaguaaaagaaaaaaaaaauuaucuuuugcagucucucu

SEQ ID NO: 31707 - RNA, 64 nt, Homo Sapiens
uaaugucuucuaauauccugggucuucagcaaaaaaaaaaaagccauacccaaaguagccagcu

SEQ ID NO: 31708 - RNA, 64 nt, Homo Sapiens
cuaaugucuucuaauauccuuggucuucagcaaaaaaaaaaaagacauacccaaaguagccagc

SEQ ID NO: 31709 - RNA, 64 nt, Homo Sapiens
gcuaaugucuucuaauaucccuggucuucagcaaaaaaaaaaaagacauacccaaaguagccag

SEQ ID NO: 31710 - RNA, 64 nt, Homo Sapiens
agcuaaugucuucuaauaucgcuggucuucagcaaaaaaaaaaaugacauacccaaaguagcca

SEQ ID NO: 31711 - RNA, 64 nt, Homo Sapiens
aagcuaaugucuucuaauauagcuggucuucagcaaaaaaaaaauugacauacccaaaguagcc

SEQ ID NO: 31712 - RNA, 64 nt, Homo Sapiens
aaaagaaaaauaaagcacguugucucuaaagaaaaaaaaaaaguugggcaacauagcaagaccc

SEQ ID NO: 31713 - RNA, 64 nt, Homo Sapiens
uaaaagaaaaauaaagcacgcugucucuaaagaaaaaaaaaaagcugggcaacauagcaagacc

SEQ ID NO: 31714 - RNA, 64 nt, Homo Sapiens
guaaaagaaaaauaaagcacccugucucuaaagaaaaaaaaaaaccugggcaacauagcaagac

SEQ ID NO: 31715 - RNA, 64 nt, Homo Sapiens
aguaaaagaaaaauaaagcacccugucucuaaagaaaaaaaaaagccugggcaacauagcaaga

SEQ ID NO: 31716 - RNA, 64 nt, Homo Sapiens
cuuucuugcagacaagucacuuggacagaaaaaaaaaaaaaaguacguauguaauccucacucu

SEQ ID NO: 31717 - RNA, 64 nt, Homo Sapiens
ucuuucuugcagacaagucauuuggacagaaaaaaaaaaaaaaguacguauguaauccucacuc

SEQ ID NO: 31718 - RNA, 64 nt, Homo Sapiens
gucuuucuugcagacaaguccuuuggacagaaaaaaaaaaaaaacuacguauguaauccucacu

SEQ ID NO: 31719 - RNA, 64 nt, Homo Sapiens
agucuuucuugcagacaaguucuuuggacagaaaaaaaaaaaaaacuacguauguaauccucac

SEQ ID NO: 31720 - RNA, 64 nt, Homo Sapiens
aagucuuucuugcagacaagcucuuuggacagaaaaaaaaaaaagacuacguauguaauccuca

SEQ ID NO: 31721 - RNA, 64 nt, Homo Sapiens
aaagucuuucuugcagacaaacucuuuggacagaaaaaaaaaaaagacuacguauguaauccuc

SEQ ID NO: 31722 - RNA, 64 nt, Homo Sapiens
aaaagucuuucuugcagacacacucuuuggacagaaaaaaaaaagagacuacguauguaauccu

SEQ ID NO: 31723 - RNA, 64 nt, Homo Sapiens
aaaagaaaaagaggaagaaguuuccucucaaaaaaaaaaaaagaacaauuccagugggcuuuuu

SEQ ID NO: 31724 - RNA, 64 nt, Homo Sapiens
aaaaagaaaaagaggaagaauuuuccucucaaaaaaaaaaaaaggacaauuccagugggcuuuu

SEQ ID NO: 31725 - RNA, 64 nt, Homo Sapiens
gaaaaagaaaaagaggaagauuuuuccucucaaaaaaaaaaaaaagacaauuccagugggcuuu

SEQ ID NO: 31726 - RNA, 64 nt, Homo Sapiens
agaaaaagaaaaagaggaaguuuuuuccucucaaaaaaaaaaaauagacaauuccagugggcuu

SEQ ID NO: 31727 - RNA, 64 nt, Homo Sapiens
aagaaaaagaaaaagaggaauuuuuuuccucucaaaaaaaaaaauuagacaauuccagugggcu

SEQ ID NO: 31728 - RNA, 64 nt, Homo Sapiens
aaagaaaaagaaaaagaggauuuuuuuuccucucaaaaaaaaaauuuagacaauuccagugggc

SEQ ID NO: 31729 - RNA, 64 nt, Homo Sapiens
uuucuuauaguauuggaacuaagccaauuaaaaaaaaaaaaaguugccgacuuauuuuuauagg

SEQ ID NO: 31730 - RNA, 64 nt, Homo Sapiens
uuuucuuauaguauuggaacgaagccaauuaaaaaaaaaaaaaguugccgacuuauuuuuauag

SEQ ID NO: 31731 - RNA, 64 nt, Homo Sapiens
guuuucuuauaguauuggaaggaagccaauuaaaaaaaaaaaaauuugccgacuuauuuuuaua

SEQ ID NO: 31732 - RNA, 64 nt, Homo Sapiens
aguuuucuuauaguauuggaaggaagccaauuaaaaaaaaaaaaauuugccgacuuauuuuuau

SEQ ID NO: 31733 - RNA, 64 nt, Homo Sapiens
aaguuuucuuauaguauugguaggaagccaauuaaaaaaaaaaacauuugccgacuuauuuuua

SEQ ID NO: 31734 - RNA, 64 nt, Homo Sapiens
aaaguuuucuuauaguauugauaggaagccaauuaaaaaaaaaaucauuugccgacuuauuuuu

SEQ ID NO: 31735 - RNA, 64 nt, Homo Sapiens
auauuaaacaacaugaaacuuggucaaguuaaaaaaaaaaaacaccuucuucaggggaagacug

SEQ ID NO: 31736 - RNA, 64 nt, Homo Sapiens
aauauuaaacaacaugaaacguggucaaguuaaaaaaaaaaaaccccuucuucaggggaagacu

SEQ ID NO: 31737 - RNA, 64 nt, Homo Sapiens
caauauuaaacaacaugaaauguggucaaguuaaaaaaaaaaaagcccuucuucaggggaagac

SEQ ID NO: 31738 - RNA, 64 nt, Homo Sapiens
acaauauuaaacaacaugaacuguggucaaguuaaaaaaaaaaaugcccuucuucaggggaaga

SEQ ID NO: 31739 - RNA, 64 nt, Homo Sapiens
aacaauauuaaacaacaugaacuguggucaaguuaaaaaaaaaaaugcccuucuucaggggaag

SEQ ID NO: 31740 - RNA, 64 nt, Homo Sapiens
aaaaacuguugucuaauauaaaagagaaucuaaaaaaaaaaacaaagggugcuuauucuuuaac

SEQ ID NO: 31741 - RNA, 64 nt, Homo Sapiens
aaaaaacuguugucuaauaucaaagagaaucuaaaaaaaaaaacgaagggugcuuauucuuuaa

SEQ ID NO: 31742 - RNA, 64 nt, Homo Sapiens
caaaaaacuguugucuaauaacaaagagaaucuaaaaaaaaaaaggaagggugcuuauucuuua

SEQ ID NO: 31743 - RNA, 64 nt, Homo Sapiens
acaaaaaacuguugucuaauaacaaagagaaucuaaaaaaaaaacggaagggugcuuauucuuu

SEQ ID NO: 31744 - RNA, 64 nt, Homo Sapiens
guaauucaugauaggcuucggagccgggacucuaaaaaaaaauuggcaaguuaccaaacacagu

SEQ ID NO: 31745 - RNA, 64 nt, Homo Sapiens
uguaauucaugauaggcuucugagccgggacucuaaaaaaaaauuggcaaguuaccaaacacag

SEQ ID NO: 31746 - RNA, 64 nt, Homo Sapiens
aagcaaaugguaagacccuuugggaaaaaugaaaaaaaaaaauaauguugcugccucauugacc

SEQ ID NO: 31747 - RNA, 64 nt, Homo Sapiens
aaagcaaaugguaagacccucugggaaaaaugaaaaaaaaaaauaauguugcugccucauugac

SEQ ID NO: 31748 - RNA, 64 nt, Homo Sapiens
uaaagcaaaugguaagacccccugggaaaaaugaaaaaaaaaaauaauguugcugccucauuga

SEQ ID NO: 31749 - RNA, 64 nt, Homo Sapiens
auaaagcaaaugguaagaccaccugggaaaaaugaaaaaaaaaauuaauguugcugccucauug

SEQ ID NO: 31750 - RNA, 64 nt, Homo Sapiens
auuaaguuucacaagcuguuugaugcaaaaaaaaaaaaaaaaguaguucaguaaaacccucuga

SEQ ID NO: 31751 - RNA, 64 nt, Homo Sapiens
uauuaaguuucacaagcuguaugaugcaaaaaaaaaaaaaaaagaaguucaguaaaacccucug

SEQ ID NO: 31752 - RNA, 64 nt, Homo Sapiens
guauuaaguuucacaagcuggaugaugcaaaaaaaaaaaaaaaauaaguucaguaaaacccucu

SEQ ID NO: 31753 - RNA, 64 nt, Homo Sapiens
aguauuaaguuucacaagcuugaugaugcaaaaaaaaaaaaaaaguaaguucaguaaaacccuc

SEQ ID NO: 31754 - RNA, 64 nt, Homo Sapiens
aaguauuaaguuucacaagccugaugaugcaaaaaaaaaaaaaauguaaguucaguaaaacccu

SEQ ID NO: 31755 - RNA, 64 nt, Homo Sapiens
aaaguauuaaguuucacaagucugaugaugcaaaaaaaaaaaaauuguaaguucaguaaaaccc

SEQ ID NO: 31756 - RNA, 64 nt, Homo Sapiens
aaaaguauuaaguuucacaacucugaugaugcaaaaaaaaaaaaguuguaaguucaguaaaacc

SEQ ID NO: 31757 - RNA, 64 nt, Homo Sapiens
aaaaaguauuaaguuucacaccucugaugaugcaaaaaaaaaaagguuguaaguucaguaaaac

SEQ ID NO: 31758 - RNA, 64 nt, Homo Sapiens
aaaaaaguauuaaguuucaccccucugaugaugcaaaaaaaaaacgguuguaaguucaguaaaa

SEQ ID NO: 31759 - RNA, 64 nt, Homo Sapiens
aaucuuugccaaauccuucaaaacuggaaauggaaaaaaaaauaaaaucugugucuacuuuaaa

SEQ ID NO: 31760 - RNA, 64 nt, Homo Sapiens
aaaucuuugccaaauccuucaaaacuggaaauggaaaaaaaaaucaaaucugugucuacuuuaa

SEQ ID NO: 31761 - RNA, 64 nt, Homo Sapiens
gcugagcuggcagagagcuccaccauuuggugcuaaaaaaaaaaacguccugagguucaugacc

SEQ ID NO: 31762 - RNA, 64 nt, Homo Sapiens
cugagcuggcagagagcuccaccauuuggugcuaaaaaaaaaaacguccugagguucaugacca

SEQ ID NO: 31763 - RNA, 64 nt, Homo Sapiens
ugagcuggcagagagcuccaccauuuggugcuaaaaaaaaaaacguccugagguucaugaccac

SEQ ID NO: 31764 - RNA, 64 nt, Homo Sapiens
gagcuggcagagagcuccaccauuuggugcuaaaaaaaaaaacguccugagguucaugaccacc

SEQ ID NO: 31765 - RNA, 64 nt, Homo Sapiens
ggauuuucaccaaaauaaugcuuuugaaaaaaagaaaaaaaaaacggauauauugagaaucaaa

SEQ ID NO: 31766 - RNA, 64 nt, Homo Sapiens
gauuuucaccaaaauaaugcuuuugaaaaaaagaaaaaaaaaacggauauauugagaaucaaag

SEQ ID NO: 31767 - RNA, 64 nt, Homo Sapiens
auuuucaccaaaauaaugcuuuugaaaaaaagaaaaaaaaaacggauauauugagaaucaaagu

SEQ ID NO: 31768 - RNA, 64 nt, Homo Sapiens
uccucucuacauuuaagaguagcaauagaacaauaaaaaaaaauacgucuuucaaauuaauugc

SEQ ID NO: 31769 - RNA, 64 nt, Homo Sapiens
ccucucuacauuuaagaguagcaauagaacaauaaaaaaaaauacgucuuucaaauuaauugca

SEQ ID NO: 31770 - RNA, 64 nt, Homo Sapiens
uggagucuuaugauggauuuuuaacuucccguggaaaaaaaaauaaaggcuguaucuaaaauau

SEQ ID NO: 31771 - RNA, 64 nt, Homo Sapiens
ggagucuuaugauggauuuuuaacuucccguggaaaaaaaaauaaaggcuguaucuaaaauauc

SEQ ID NO: 31772 - RNA, 64 nt, Homo Sapiens
caaccuggugaaacccugucucuacuaaaaauacaaaaaaaauuagcugagcgugguggcgggc

SEQ ID NO: 31773 - RNA, 64 nt, Homo Sapiens
uuuaucuuccugcaaacaaggguuaccugaaaagaaaaaaaaagucaacauugucaagcuguuu

SEQ ID NO: 31774 - RNA, 64 nt, Homo Sapiens
uuaucuuccugcaaacaaggguuaccugaaaagaaaaaaaaagucaacauugucaagcuguuug

SEQ ID NO: 31775 - RNA, 64 nt, Homo Sapiens
guacuguaaagugaaaagggaugugcaaaaaaauaaaaaaaaacaacaaaaaaagcuaaccuuc

SEQ ID NO: 31776 - RNA, 64 nt, Homo Sapiens
uacuguaaagugaaaagggaugugcaaaaaaauaaaaaaaaacaacaaaaaaagcuaaccuucu

SEQ ID NO: 31777 - RNA, 64 nt, Homo Sapiens
uggauuacagaaaugaguuaauugucucugugauaaaaaaaaaaaaugaaauauuuucuuauug

SEQ ID NO: 31778 - RNA, 64 nt, Homo Sapiens
ggauuacagaaaugaguuaauugucucugugauaaaaaaaaaaaaugaaauauuuucuuauuga

SEQ ID NO: 31779 - RNA, 64 nt, Homo Sapiens
gauuacagaaaugaguuaauugucucugugauaaaaaaaaaaaaugaaauauuuucuuauugaa

SEQ ID NO: 31780 - RNA, 64 nt, Homo Sapiens
auuacagaaaugaguuaauugucucugugauaaaaaaaaaaaaugaaauauuuucuuauugaau

SEQ ID NO: 31781 - RNA, 64 nt, Homo Sapiens
uuacagaaaugaguuaauugucucugugauaaaaaaaaaaaaugaaauauuuucuuauugaauu

SEQ ID NO: 31782 - RNA, 64 nt, Homo Sapiens
uaaucauugcauagugacugaaaagccuaagugcaaaaaaaaaaaaaaaagauguucuuguuuc

SEQ ID NO: 31783 - RNA, 64 nt, Homo Sapiens
aaucauugcauagugacugaaaagccuaagugcaaaaaaaaaaaaaaaagauguucuuguuucu

SEQ ID NO: 31784 - RNA, 64 nt, Homo Sapiens
aucauugcauagugacugaaaagccuaagugcaaaaaaaaaaaaaaaagauguucuuguuucug

SEQ ID NO: 31785 - RNA, 64 nt, Homo Sapiens
ucauugcauagugacugaaaagccuaagugcaaaaaaaaaaaaaaaagauguucuuguuucuga

SEQ ID NO: 31786 - RNA, 64 nt, Homo Sapiens
cauugcauagugacugaaaagccuaagugcaaaaaaaaaaaaaaaagauguucuuguuucugaa

SEQ ID NO: 31787 - RNA, 64 nt, Homo Sapiens
auugcauagugacugaaaagccuaagugcaaaaaaaaaaaaaaaagauguucuuguuucugaac

SEQ ID NO: 31788 - RNA, 64 nt, Homo Sapiens
uugcauagugacugaaaagccuaagugcaaaaaaaaaaaaaaaagauguucuuguuucugaacu

SEQ ID NO: 31789 - RNA, 64 nt, Homo Sapiens
ugcauagugacugaaaagccuaagugcaaaaaaaaaaaaaaaagauguucuuguuucugaacuu

SEQ ID NO: 31790 - RNA, 64 nt, Homo Sapiens
gcauagugacugaaaagccuaagugcaaaaaaaaaaaaaaaagauguucuuguuucugaacuuc

SEQ ID NO: 31791 - RNA, 64 nt, Homo Sapiens
gauggacuuuucugauaaaucuuggcagacaucuaaaaaaaaaaccauauuuuucacaagaaaa

SEQ ID NO: 31792 - RNA, 64 nt, Homo Sapiens
auggacuuuucugauaaaucuuggcagacaucuaaaaaaaaaaccauauuuuucacaagaaaau

SEQ ID NO: 31793 - RNA, 64 nt, Homo Sapiens
uggacuuuucugauaaaucuuggcagacaucuaaaaaaaaaaccauauuuuucacaagaaaaug

SEQ ID NO: 31794 - RNA, 64 nt, Homo Sapiens
ucaucgccguugaaaugaaaagagagacagagagaaaaaaaaaaagagaacccacaugaagcuc

SEQ ID NO: 31795 - RNA, 64 nt, Homo Sapiens
caucgccguugaaaugaaaagagagacagagagaaaaaaaaaaagagaacccacaugaagcucu

SEQ ID NO: 31796 - RNA, 64 nt, Homo Sapiens
aucgccguugaaaugaaaagagagacagagagaaaaaaaaaaagagaacccacaugaagcucug

SEQ ID NO: 31797 - RNA, 64 nt, Homo Sapiens
ucgccguugaaaugaaaagagagacagagagaaaaaaaaaaagagaacccacaugaagcucuga

SEQ ID NO: 31798 - RNA, 64 nt, Homo Sapiens
cucauuuguguggaugcgugaccaugggaaaaagaaaaaaaaaaagauccauuuuuuagguucu

SEQ ID NO: 31799 - RNA, 64 nt, Homo Sapiens
ucauuuguguggaugcgugaccaugggaaaaagaaaaaaaaaaagauccauuuuuuagguucuu

SEQ ID NO: 31800 - RNA, 64 nt, Homo Sapiens
cauuuguguggaugcgugaccaugggaaaaagaaaaaaaaaaagauccauuuuuuagguucuuu

SEQ ID NO: 31801 - RNA, 64 nt, Homo Sapiens
auuuguguggaugcgugaccaugggaaaaagaaaaaaaaaaagauccauuuuuuagguucuuuu

SEQ ID NO: 31802 - RNA, 64 nt, Homo Sapiens
auuacaacuuuguacugguuguaacuugcauuagaaaaaaaagagauauauacaccacaaagaa

SEQ ID NO: 31803 - RNA, 64 nt, Homo Sapiens
guuuaaaaaaaugcaaaucauucuuuaccuuaagaaaaaaaaaauacccuuugcuuugugccuc

SEQ ID NO: 31804 - RNA, 64 nt, Homo Sapiens
uuuaaaaaaaugcaaaucauucuuuaccuuaagaaaaaaaaaauacccuuugcuuugugccuca

SEQ ID NO: 31805 - RNA, 64 nt, Homo Sapiens
uuaaaaaaaugcaaaucauucuuuaccuuaagaaaaaaaaaauacccuuugcuuugugccucaa

SEQ ID NO: 31806 - RNA, 64 nt, Homo Sapiens
cuccagugugagcaacagaacgagacucugucucaaaaaaaaaaaaaaaaaggaagaaagagaa

SEQ ID NO: 31807 - RNA, 64 nt, Homo Sapiens
uccagugugagcaacagaacgagacucugucucaaaaaaaaaaaaaaaaaggaagaaagagaag

SEQ ID NO: 31808 - RNA, 64 nt, Homo Sapiens
ccagugugagcaacagaacgagacucugucucaaaaaaaaaaaaaaaaaggaagaaagagaaga

SEQ ID NO: 31809 - RNA, 64 nt, Homo Sapiens
cagugugagcaacagaacgagacucugucucaaaaaaaaaaaaaaaaaggaagaaagagaagau

SEQ ID NO: 31810 - RNA, 64 nt, Homo Sapiens
agugugagcaacagaacgagacucugucucaaaaaaaaaaaaaaaaaggaagaaagagaagaua

SEQ ID NO: 31811 - RNA, 64 nt, Homo Sapiens
gugugagcaacagaacgagacucugucucaaaaaaaaaaaaaaaaaggaagaaagagaagauag

SEQ ID NO: 31812 - RNA, 64 nt, Homo Sapiens
ugugagcaacagaacgagacucugucucaaaaaaaaaaaaaaaaaggaagaaagagaagauaga

SEQ ID NO: 31813 - RNA, 64 nt, Homo Sapiens
gugagcaacagaacgagacucugucucaaaaaaaaaaaaaaaaaggaagaaagagaagauagag

SEQ ID NO: 31814 - RNA, 64 nt, Homo Sapiens
ugagcaacagaacgagacucugucucaaaaaaaaaaaaaaaaaggaagaaagagaagauagaga

SEQ ID NO: 31815 - RNA, 64 nt, Homo Sapiens
gagcaacagaacgagacucugucucaaaaaaaaaaaaaaaaaggaagaaagagaagauagagac

SEQ ID NO: 31816 - RNA, 64 nt, Homo Sapiens
ggggaaaaugaagguuaggauuuaacagucauuuaaaaaaaaaauuuguuuugacggaugauug

SEQ ID NO: 31817 - RNA, 64 nt, Homo Sapiens
gggaaaaugaagguuaggauuuaacagucauuuaaaaaaaaaauuuguuuugacggaugauugg

SEQ ID NO: 31818 - RNA, 64 nt, Homo Sapiens
ggaaaaugaagguuaggauuuaacagucauuuaaaaaaaaaauuuguuuugacggaugauugga

SEQ ID NO: 31819 - RNA, 64 nt, Homo Sapiens
caaaauuuugacaacgaugauguucaccagaaggaaaaaaaaaaaucaguuuuaugcacuuuau

SEQ ID NO: 31820 - RNA, 64 nt, Homo Sapiens
aaaauuuugacaacgaugauguucaccagaaggaaaaaaaaaaaucaguuuuaugcacuuuauu

SEQ ID NO: 31821 - RNA, 64 nt, Homo Sapiens
aaauuuugacaacgaugauguucaccagaaggaaaaaaaaaaaucaguuuuaugcacuuuauuu

SEQ ID NO: 31822 - RNA, 64 nt, Homo Sapiens
aauuuugacaacgaugauguucaccagaaggaaaaaaaaaaaucaguuuuaugcacuuuauuuu

SEQ ID NO: 31823 - RNA, 64 nt, Homo Sapiens
ugaguuuucagcaccaguagauuuguauuaaaagaaaaaaaaauggggccuuagcuucuggcuu

SEQ ID NO: 31824 - RNA, 64 nt, Homo Sapiens
gaguuuucagcaccaguagauuuguauuaaaagaaaaaaaaauggggccuuagcuucuggcuuu

SEQ ID NO: 31825 - RNA, 64 nt, Homo Sapiens
aucagcucagcacaugcuuuaagaaagcaaaaccaaaaaaaaaaaaaaaaagaugcagcaucaa

SEQ ID NO: 31826 - RNA, 64 nt, Homo Sapiens
ucagcucagcacaugcuuuaagaaagcaaaaccaaaaaaaaaaaaaaaaagaugcagcaucaac

SEQ ID NO: 31827 - RNA, 64 nt, Homo Sapiens
cagcucagcacaugcuuuaagaaagcaaaaccaaaaaaaaaaaaaaaaagaugcagcaucaacu

SEQ ID NO: 31828 - RNA, 64 nt, Homo Sapiens
agcucagcacaugcuuuaagaaagcaaaaccaaaaaaaaaaaaaaaaagaugcagcaucaacuc

SEQ ID NO: 31829 - RNA, 64 nt, Homo Sapiens
gcucagcacaugcuuuaagaaagcaaaaccaaaaaaaaaaaaaaaaagaugcagcaucaacucc

SEQ ID NO: 31830 - RNA, 64 nt, Homo Sapiens
cucagcacaugcuuuaagaaagcaaaaccaaaaaaaaaaaaaaaaagaugcagcaucaacuccu

SEQ ID NO: 31831 - RNA, 64 nt, Homo Sapiens
ucagcacaugcuuuaagaaagcaaaaccaaaaaaaaaaaaaaaaagaugcagcaucaacuccug

SEQ ID NO: 31832 - RNA, 64 nt, Homo Sapiens
cagcacaugcuuuaagaaagcaaaaccaaaaaaaaaaaaaaaaagaugcagcaucaacuccuga

SEQ ID NO: 31833 - RNA, 64 nt, Homo Sapiens
agcacaugcuuuaagaaagcaaaaccaaaaaaaaaaaaaaaaagaugcagcaucaacuccugac

SEQ ID NO: 31834 - RNA, 64 nt, Homo Sapiens
gcacaugcuuuaagaaagcaaaaccaaaaaaaaaaaaaaaaagaugcagcaucaacuccugacu

SEQ ID NO: 31835 - RNA, 64 nt, Homo Sapiens
auagcccaagauagccaugugaccuggaacuuuuaaaaaaaaauuuuuuuuuaagagccagagu

SEQ ID NO: 31836 - RNA, 64 nt, Homo Sapiens
uagcccaagauagccaugugaccuggaacuuuuaaaaaaaaauuuuuuuuuaagagccagaguc

SEQ ID NO: 31837 - RNA, 64 nt, Homo Sapiens
agcucagacuuuguauuuaaaaguuaaaaaggacaaaaaaaaaaucuaaagcauuuaaaaucua

SEQ ID NO: 31838 - RNA, 64 nt, Homo Sapiens
gcucagacuuuguauuuaaaaguuaaaaaggacaaaaaaaaaaucuaaagcauuuaaaaucuag

SEQ ID NO: 31839 - RNA, 64 nt, Homo Sapiens
cucagacuuuguauuuaaaaguuaaaaaggacaaaaaaaaaaucuaaagcauuuaaaaucuagu

SEQ ID NO: 31840 - RNA, 64 nt, Homo Sapiens
augauggcucuuggaaagaaugacguuuugcuggaaaaaaaaaaaagaacaguuuguguuucac

SEQ ID NO: 31841 - RNA, 64 nt, Homo Sapiens
ugauggcucuuggaaagaaugacguuuugcuggaaaaaaaaaaaagaacaguuuguguuucaca

SEQ ID NO: 31842 - RNA, 64 nt, Homo Sapiens
gauggcucuuggaaagaaugacguuuugcuggaaaaaaaaaaaagaacaguuuguguuucacaa

SEQ ID NO: 31843 - RNA, 64 nt, Homo Sapiens
auggcucuuggaaagaaugacguuuugcuggaaaaaaaaaaaagaacaguuuguguuucacaaa

SEQ ID NO: 31844 - RNA, 64 nt, Homo Sapiens
uggcucuuggaaagaaugacguuuugcuggaaaaaaaaaaaagaacaguuuguguuucacaaac

SEQ ID NO: 31845 - RNA, 64 nt, Homo Sapiens
aguaggaaauaaaaauggaagcuauuaugaccucaaaaaaaaaaagccaacuuugagcuaggau

SEQ ID NO: 31846 - RNA, 64 nt, Homo Sapiens
guaggaaauaaaaauggaagcuauuaugaccucaaaaaaaaaaagccaacuuugagcuaggaua

SEQ ID NO: 31847 - RNA, 64 nt, Homo Sapiens
uaggaaauaaaaauggaagcuauuaugaccucaaaaaaaaaaagccaacuuugagcuaggauaa

SEQ ID NO: 31848 - RNA, 64 nt, Homo Sapiens
aggaaauaaaaauggaagcuauuaugaccucaaaaaaaaaaagccaacuuugagcuaggauaaa

SEQ ID NO: 31849 - RNA, 64 nt, Homo Sapiens
caacauagugaaaccccgucucuacuaaaaauacaaaaaaaaaauuagcugggugugguggcag

SEQ ID NO: 31850 - RNA, 64 nt, Homo Sapiens
aacauagugaaaccccgucucuacuaaaaauacaaaaaaaaaauuagcugggugugguggcagu

SEQ ID NO: 31851 - RNA, 64 nt, Homo Sapiens
acauagugaaaccccgucucuacuaaaaauacaaaaaaaaaauuagcugggugugguggcaguc

SEQ ID NO: 31852 - RNA, 64 nt, Homo Sapiens
cuccagccuuggugacaaugggagacuccaucucaaaaaaaaaaaaaaaaaaaaaaaagauaaa

SEQ ID NO: 31853 - RNA, 64 nt, Homo Sapiens
uccagccuuggugacaaugggagacuccaucucaaaaaaaaaaaaaaaaaaaaaaaagauaaaa

SEQ ID NO: 31854 - RNA, 64 nt, Homo Sapiens
ccagccuuggugacaaugggagacuccaucucaaaaaaaaaaaaaaaaaaaaaaaagauaaaaa

SEQ ID NO: 31855 - RNA, 64 nt, Homo Sapiens
cagccuuggugacaaugggagacuccaucucaaaaaaaaaaaaaaaaaaaaaaaagauaaaaag

SEQ ID NO: 31856 - RNA, 64 nt, Homo Sapiens
agccuuggugacaaugggagacuccaucucaaaaaaaaaaaaaaaaaaaaaaaagauaaaaagu

SEQ ID NO: 31857 - RNA, 64 nt, Homo Sapiens
gccuuggugacaaugggagacuccaucucaaaaaaaaaaaaaaaaaaaaaaaagauaaaaaguc

SEQ ID NO: 31858 - RNA, 64 nt, Homo Sapiens
ccuuggugacaaugggagacuccaucucaaaaaaaaaaaaaaaaaaaaaaaagauaaaaaguca

SEQ ID NO: 31859 - RNA, 64 nt, Homo Sapiens
cuuggugacaaugggagacuccaucucaaaaaaaaaaaaaaaaaaaaaaaagauaaaaagucag

SEQ ID NO: 31860 - RNA, 64 nt, Homo Sapiens
uuggugacaaugggagacuccaucucaaaaaaaaaaaaaaaaaaaaaaaagauaaaaagucaga

SEQ ID NO: 31861 - RNA, 64 nt, Homo Sapiens
uggugacaaugggagacuccaucucaaaaaaaaaaaaaaaaaaaaaaaagauaaaaagucagaa

SEQ ID NO: 31862 - RNA, 64 nt, Homo Sapiens
ggugacaaugggagacuccaucucaaaaaaaaaaaaaaaaaaaaaaaagauaaaaagucagaaa

SEQ ID NO: 31863 - RNA, 64 nt, Homo Sapiens
gugacaaugggagacuccaucucaaaaaaaaaaaaaaaaaaaaaaaagauaaaaagucagaaau

SEQ ID NO: 31864 - RNA, 64 nt, Homo Sapiens
ugacaaugggagacuccaucucaaaaaaaaaaaaaaaaaaaaaaaagauaaaaagucagaaauc

SEQ ID NO: 31865 - RNA, 64 nt, Homo Sapiens
gacaaugggagacuccaucucaaaaaaaaaaaaaaaaaaaaaaaagauaaaaagucagaaaucu

SEQ ID NO: 31866 - RNA, 64 nt, Homo Sapiens
acaaugggagacuccaucucaaaaaaaaaaaaaaaaaaaaaaaagauaaaaagucagaaaucug

SEQ ID NO: 31867 - RNA, 64 nt, Homo Sapiens
caaugggagacuccaucucaaaaaaaaaaaaaaaaaaaaaaaagauaaaaagucagaaaucuga

SEQ ID NO: 31868 - RNA, 64 nt, Homo Sapiens
aaugggagacuccaucucaaaaaaaaaaaaaaaaaaaaaaaagauaaaaagucagaaaucugaa

SEQ ID NO: 31869 - RNA, 64 nt, Homo Sapiens
aaucucugccauuuuagauacugugaaacaaacuaaaaaaaaaaaagcuuuuguuuuguauuug

SEQ ID NO: 31870 - RNA, 64 nt, Homo Sapiens
aucucugccauuuuagauacugugaaacaaacuaaaaaaaaaaaagcuuuuguuuuguauuugu

SEQ ID NO: 31871 - RNA, 64 nt, Homo Sapiens
ucucugccauuuuagauacugugaaacaaacuaaaaaaaaaaaagcuuuuguuuuguauuuguu

SEQ ID NO: 31872 - RNA, 64 nt, Homo Sapiens
cucugccauuuuagauacugugaaacaaacuaaaaaaaaaaaagcuuuuguuuuguauuuguuu

SEQ ID NO: 31873 - RNA, 64 nt, Homo Sapiens
ucugccauuuuagauacugugaaacaaacuaaaaaaaaaaaagcuuuuguuuuguauuuguuua

SEQ ID NO: 31874 - RNA, 64 nt, Homo Sapiens
ggagucccuuuugcaucauuguuuuaaggaugauaaaaaaaaauaacaacuagggacaauacag

SEQ ID NO: 31875 - RNA, 64 nt, Homo Sapiens
gagucccuuuugcaucauuguuuuaaggaugauaaaaaaaaauaacaacuagggacaauacaga

SEQ ID NO: 31876 - RNA, 64 nt, Homo Sapiens
uuccuguaaaauuucaaauugaugugguauuaauaaaaaaaaaaaaaacacaaacaaugacugu

SEQ ID NO: 31877 - RNA, 64 nt, Homo Sapiens
uccuguaaaauuucaaauugaugugguauuaauaaaaaaaaaaaaaacacaaacaaugacugug

SEQ ID NO: 31878 - RNA, 64 nt, Homo Sapiens
ccuguaaaauuucaaauugaugugguauuaauaaaaaaaaaaaaaacacaaacaaugacugugg

SEQ ID NO: 31879 - RNA, 64 nt, Homo Sapiens
cuguaaaauuucaaauugaugugguauuaauaaaaaaaaaaaaaacacaaacaaugacuguggc

SEQ ID NO: 31880 - RNA, 64 nt, Homo Sapiens
uguaaaauuucaaauugaugugguauuaauaaaaaaaaaaaaaacacaaacaaugacuguggca

SEQ ID NO: 31881 - RNA, 64 nt, Homo Sapiens
guaaaauuucaaauugaugugguauuaauaaaaaaaaaaaaaacacaaacaaugacuguggcau

SEQ ID NO: 31882 - RNA, 64 nt, Homo Sapiens
uaaaauuucaaauugaugugguauuaauaaaaaaaaaaaaaacacaaacaaugacuguggcauc

SEQ ID NO: 31883 - RNA, 64 nt, Homo Sapiens
ucacugcauucuuugaacaaucauguagucgauuaaaaaaaaaaaacaaacuuuuuuuuccuag

SEQ ID NO: 31884 - RNA, 64 nt, Homo Sapiens
cacugcauucuuugaacaaucauguagucgauuaaaaaaaaaaaacaaacuuuuuuuuccuagg

SEQ ID NO: 31885 - RNA, 64 nt, Homo Sapiens
acugcauucuuugaacaaucauguagucgauuaaaaaaaaaaaacaaacuuuuuuuuccuaggc

SEQ ID NO: 31886 - RNA, 64 nt, Homo Sapiens
cugcauucuuugaacaaucauguagucgauuaaaaaaaaaaaacaaacuuuuuuuuccuaggcu

SEQ ID NO: 31887 - RNA, 64 nt, Homo Sapiens
ugcauucuuugaacaaucauguagucgauuaaaaaaaaaaaacaaacuuuuuuuuccuaggcug

SEQ ID NO: 31888 - RNA, 64 nt, Homo Sapiens
ggggagaggcccccaucagggaccagacuguuccaaaaaaaaaacaaaaaacaaaaacaaacaa

SEQ ID NO: 31889 - RNA, 64 nt, Homo Sapiens
gggagaggcccccaucagggaccagacuguuccaaaaaaaaaacaaaaaacaaaaacaaacaaa

SEQ ID NO: 31890 - RNA, 64 nt, Homo Sapiens
ggagaggcccccaucagggaccagacuguuccaaaaaaaaaacaaaaaacaaaaacaaacaaaa

SEQ ID NO: 31891 - RNA, 64 nt, Homo Sapiens
gaggagagaagguagagcuguucuuaaauuuauuaaaaaaaaaaauaaaagggaaucucagugu

SEQ ID NO: 31892 - RNA, 64 nt, Homo Sapiens
aggagagaagguagagcuguucuuaaauuuauuaaaaaaaaaaauaaaagggaaucucaguguc

SEQ ID NO: 31893 - RNA, 64 nt, Homo Sapiens
ggagagaagguagagcuguucuuaaauuuauuaaaaaaaaaaauaaaagggaaucucagugucu

SEQ ID NO: 31894 - RNA, 64 nt, Homo Sapiens
gagagaagguagagcuguucuuaaauuuauuaaaaaaaaaaauaaaagggaaucucagugucug

SEQ ID NO: 31895 - RNA, 64 nt, Homo Sapiens
cacugcagccuaggugacagucagacccugucucaaaaaaaauaaaaaaaauuuaaaauaaucu

SEQ ID NO: 31896 - RNA, 64 nt, Homo Sapiens
cuaggugacagucagacccugucucaaaaaaaauaaaaaaaauuuaaaauaaucuuggggugag

SEQ ID NO: 31897 - RNA, 64 nt, Homo Sapiens
ucucucuagggcagcagagagcuuuuugcacuuuaaaaaaaaaaagaaagaaagaaaggucgga

SEQ ID NO: 31898 - RNA, 64 nt, Homo Sapiens
cucucuagggcagcagagagcuuuuugcacuuuaaaaaaaaaaagaaagaaagaaaggucggaa

SEQ ID NO: 31899 - RNA, 64 nt, Homo Sapiens
ucucuagggcagcagagagcuuuuugcacuuuaaaaaaaaaaagaaagaaagaaaggucggaau

SEQ ID NO: 31900 - RNA, 64 nt, Homo Sapiens
cucuagggcagcagagagcuuuuugcacuuuaaaaaaaaaaagaaagaaagaaaggucggaauu

SEQ ID NO: 31901 - RNA, 64 nt, Homo Sapiens
cuccggccugggugacagaaggaggcucugccuuaaaaaaaaaaaaaaaaaaaaccuccuggga

SEQ ID NO: 31902 - RNA, 64 nt, Homo Sapiens
uccggccugggugacagaaggaggcucugccuuaaaaaaaaaaaaaaaaaaaaccuccugggac

SEQ ID NO: 31903 - RNA, 64 nt, Homo Sapiens
ccggccugggugacagaaggaggcucugccuuaaaaaaaaaaaaaaaaaaaaccuccugggacu

SEQ ID NO: 31904 - RNA, 64 nt, Homo Sapiens
cggccugggugacagaaggaggcucugccuuaaaaaaaaaaaaaaaaaaaaccuccugggacug

SEQ ID NO: 31905 - RNA, 64 nt, Homo Sapiens
ggccugggugacagaaggaggcucugccuuaaaaaaaaaaaaaaaaaaaaccuccugggacugu

SEQ ID NO: 31906 - RNA, 64 nt, Homo Sapiens
gccugggugacagaaggaggcucugccuuaaaaaaaaaaaaaaaaaaaaccuccugggacuguu

SEQ ID NO: 31907 - RNA, 64 nt, Homo Sapiens
ccugggugacagaaggaggcucugccuuaaaaaaaaaaaaaaaaaaaaccuccugggacuguug

SEQ ID NO: 31908 - RNA, 64 nt, Homo Sapiens
cugggugacagaaggaggcucugccuuaaaaaaaaaaaaaaaaaaaaccuccugggacuguugc

SEQ ID NO: 31909 - RNA, 64 nt, Homo Sapiens
ugggugacagaaggaggcucugccuuaaaaaaaaaaaaaaaaaaaaccuccugggacuguugca

SEQ ID NO: 31910 - RNA, 64 nt, Homo Sapiens
gggugacagaaggaggcucugccuuaaaaaaaaaaaaaaaaaaaaccuccugggacuguugcaa

SEQ ID NO: 31911 - RNA, 64 nt, Homo Sapiens
ggugacagaaggaggcucugccuuaaaaaaaaaaaaaaaaaaaaccuccugggacuguugcaag

SEQ ID NO: 31912 - RNA, 64 nt, Homo Sapiens
gugacagaaggaggcucugccuuaaaaaaaaaaaaaaaaaaaaccuccugggacuguugcaagg

SEQ ID NO: 31913 - RNA, 64 nt, Homo Sapiens
ugacagaaggaggcucugccuuaaaaaaaaaaaaaaaaaaaaccuccugggacuguugcaagga

SEQ ID NO: 31914 - RNA, 64 nt, Homo Sapiens
uuacccaaaaacugucuuuaaaagagagagagagaaaaaaaaaauaguauuugcauaacccuga

SEQ ID NO: 31915 - RNA, 64 nt, Homo Sapiens
uacccaaaaacugucuuuaaaagagagagagagaaaaaaaaaauaguauuugcauaacccugag

SEQ ID NO: 31916 - RNA, 64 nt, Homo Sapiens
acccaaaaacugucuuuaaaagagagagagagaaaaaaaaaauaguauuugcauaacccugagc

SEQ ID NO: 31917 - RNA, 64 nt, Homo Sapiens
cgggagaggauuagguuccauccuuuacguguuuaaaaaaaagcauaaaaacauuuuaaaaaca

SEQ ID NO: 31918 - RNA, 64 nt, Homo Sapiens
acaagauaaaacucacaggggaauguacuuuuuuaaaaaaaaaugaaaaagaaaaaaaaagcug

SEQ ID NO: 31919 - RNA, 64 nt, Homo Sapiens
caagauaaaacucacaggggaauguacuuuuuuaaaaaaaaaugaaaaagaaaaaaaaagcugc

SEQ ID NO: 31920 - RNA, 64 nt, Homo Sapiens
ggggaauguacuuuuuuaaaaaaaaaugaaaaagaaaaaaaaagcugcacauuuacagugacuu

SEQ ID NO: 31921 - RNA, 64 nt, Homo Sapiens
gggaauguacuuuuuuaaaaaaaaaugaaaaagaaaaaaaaagcugcacauuuacagugacuua

SEQ ID NO: 31922 - RNA, 64 nt, Homo Sapiens
ggccgggcaugguggcagagcgagacuccgucucaaaaaaaaaaaaaaaaaaaaaaaagaaaag

SEQ ID NO: 31923 - RNA, 64 nt, Homo Sapiens
gccgggcaugguggcagagcgagacuccgucucaaaaaaaaaaaaaaaaaaaaaaaagaaaaga

SEQ ID NO: 31924 - RNA, 64 nt, Homo Sapiens
ccgggcaugguggcagagcgagacuccgucucaaaaaaaaaaaaaaaaaaaaaaaagaaaagaa

SEQ ID NO: 31925 - RNA, 64 nt, Homo Sapiens
cgggcaugguggcagagcgagacuccgucucaaaaaaaaaaaaaaaaaaaaaaaagaaaagaaa

SEQ ID NO: 31926 - RNA, 64 nt, Homo Sapiens
gggcaugguggcagagcgagacuccgucucaaaaaaaaaaaaaaaaaaaaaaaagaaaagaaaa

SEQ ID NO: 31927 - RNA, 64 nt, Homo Sapiens
ggcaugguggcagagcgagacuccgucucaaaaaaaaaaaaaaaaaaaaaaaagaaaagaaaag

SEQ ID NO: 31928 - RNA, 64 nt, Homo Sapiens
gcaugguggcagagcgagacuccgucucaaaaaaaaaaaaaaaaaaaaaaaagaaaagaaaaga

SEQ ID NO: 31929 - RNA, 64 nt, Homo Sapiens
caugguggcagagcgagacuccgucucaaaaaaaaaaaaaaaaaaaaaaaagaaaagaaaagaa

SEQ ID NO: 31930 - RNA, 64 nt, Homo Sapiens
augguggcagagcgagacuccgucucaaaaaaaaaaaaaaaaaaaaaaaagaaaagaaaagaaa

SEQ ID NO: 31931 - RNA, 64 nt, Homo Sapiens
ugguggcagagcgagacuccgucucaaaaaaaaaaaaaaaaaaaaaaaagaaaagaaaagaaaa

SEQ ID NO: 31932 - RNA, 64 nt, Homo Sapiens
gguggcagagcgagacuccgucucaaaaaaaaaaaaaaaaaaaaaaaagaaaagaaaagaaaau

SEQ ID NO: 31933 - RNA, 64 nt, Homo Sapiens
guggcagagcgagacuccgucucaaaaaaaaaaaaaaaaaaaaaaaauauaaggauguaaaaga

SEQ ID NO: 31934 - RNA, 64 nt, Homo Sapiens
uggcagagcgagacuccgucucaaaaaaaaaaaaaaaaaaaaaaaauauaaggauguaaaagaa

SEQ ID NO: 31935 - RNA, 64 nt, Homo Sapiens
ggcagagcgagacuccgucucaaaaaaaaaaaaaaaaaaaaaaaauauaaggauguaaaagaag

SEQ ID NO: 31936 - RNA, 64 nt, Homo Sapiens
gcagagcgagacuccgucucaaaaaaaaaaaaaaaaaaaaaaaauauaaggauguaaaagaagc

SEQ ID NO: 31937 - RNA, 64 nt, Homo Sapiens
cagagcgagacuccgucucaaaaaaaaaaaaaaaaaaaaaaaauauaaggauguaaaagaagca

SEQ ID NO: 31938 - RNA, 64 nt, Homo Sapiens
agagcgagacuccgucucaaaaaaaaaaaaaaaaaaaaaaaauauaaggauguaaaagaagcaa

SEQ ID NO: 31939 - RNA, 64 nt, Homo Sapiens
gaagcugccuuauaguuuucaucacugggacuuuaaaaaaaaauuacugugaaaaugagguauu

SEQ ID NO: 31940 - RNA, 64 nt, Homo Sapiens
aagcugccuuauaguuuucaucacugggacuuuaaaaaaaaauuacugugaaaaugagguauuc

SEQ ID NO: 31941 - RNA, 64 nt, Homo Sapiens
auugaggcuaaaaccacaaaguggcucaggcuuuaaaaaaaaaacacuguggauaaugacaaaa

SEQ ID NO: 31942 - RNA, 64 nt, Homo Sapiens
uugaggcuaaaaccacaaaguggcucaggcuuuaaaaaaaaaacacuguggauaaugacaaaaa

SEQ ID NO: 31943 - RNA, 64 nt, Homo Sapiens
ugaggcuaaaaccacaaaguggcucaggcuuuaaaaaaaaaacacuguggauaaugacaaaaag

SEQ ID NO: 31944 - RNA, 64 nt, Homo Sapiens
caccagccugggugacagugugagacccagccucaaaaaaaaaaaaaaaaaagugaugaaucaa

SEQ ID NO: 31945 - RNA, 64 nt, Homo Sapiens
accagccugggugacagugugagacccagccucaaaaaaaaaaaaaaaaaagugaugaaucaaa

SEQ ID NO: 31946 - RNA, 64 nt, Homo Sapiens
ccagccugggugacagugugagacccagccucaaaaaaaaaaaaaaaaaagugaugaaucaaaa

SEQ ID NO: 31947 - RNA, 64 nt, Homo Sapiens
cagccugggugacagugugagacccagccucaaaaaaaaaaaaaaaaaagugaugaaucaaaau

SEQ ID NO: 31948 - RNA, 64 nt, Homo Sapiens
agccugggugacagugugagacccagccucaaaaaaaaaaaaaaaaaagugaugaaucaaaauu

SEQ ID NO: 31949 - RNA, 64 nt, Homo Sapiens
gccugggugacagugugagacccagccucaaaaaaaaaaaaaaaaaagugaugaaucaaaauua

SEQ ID NO: 31950 - RNA, 64 nt, Homo Sapiens
ccugggugacagugugagacccagccucaaaaaaaaaaaaaaaaaagugaugaaucaaaauuag

SEQ ID NO: 31951 - RNA, 64 nt, Homo Sapiens
cugggugacagugugagacccagccucaaaaaaaaaaaaaaaaaagugaugaaucaaaauuaga

SEQ ID NO: 31952 - RNA, 64 nt, Homo Sapiens
ugggugacagugugagacccagccucaaaaaaaaaaaaaaaaaagugaugaaucaaaauuagaa

SEQ ID NO: 31953 - RNA, 64 nt, Homo Sapiens
gggugacagugugagacccagccucaaaaaaaaaaaaaaaaaagugaugaaucaaaauuagaaa

SEQ ID NO: 31954 - RNA, 64 nt, Homo Sapiens
ggugacagugugagacccagccucaaaaaaaaaaaaaaaaaagugaugaaucaaaauuagaaau

SEQ ID NO: 31955 - RNA, 64 nt, Homo Sapiens
uuccaagcaccucagaugaaaacucacuuuuauuaaaaaaaaaaaagacaaggguuuauauuca

SEQ ID NO: 31956 - RNA, 64 nt, Homo Sapiens
uccaagcaccucagaugaaaacucacuuuuauuaaaaaaaaaaaagacaaggguuuauauucau

SEQ ID NO: 31957 - RNA, 64 nt, Homo Sapiens
ccaagcaccucagaugaaaacucacuuuuauuaaaaaaaaaaaagacaaggguuuauauucaua

SEQ ID NO: 31958 - RNA, 64 nt, Homo Sapiens
caagcaccucagaugaaaacucacuuuuauuaaaaaaaaaaaagacaaggguuuauauucauau

SEQ ID NO: 31959 - RNA, 64 nt, Homo Sapiens
aagcaccucagaugaaaacucacuuuuauuaaaaaaaaaaaagacaaggguuuauauucauaua

SEQ ID NO: 31960 - RNA, 64 nt, Homo Sapiens
ugaaaauaguuaagauccaaagucagaauaggccaaaaaaaaaaaaaaaaaaagccuaaauagu

SEQ ID NO: 31961 - RNA, 64 nt, Homo Sapiens
gaaaauaguuaagauccaaagucagaauaggccaaaaaaaaaaaaaaaaaaagccuaaauagua

SEQ ID NO: 31962 - RNA, 64 nt, Homo Sapiens
aaaauaguuaagauccaaagucagaauaggccaaaaaaaaaaaaaaaaaaagccuaaauaguaa

SEQ ID NO: 31963 - RNA, 64 nt, Homo Sapiens
aaauaguuaagauccaaagucagaauaggccaaaaaaaaaaaaaaaaaaagccuaaauaguaag

SEQ ID NO: 31964 - RNA, 64 nt, Homo Sapiens
aauaguuaagauccaaagucagaauaggccaaaaaaaaaaaaaaaaaaagccuaaauaguaagc

SEQ ID NO: 31965 - RNA, 64 nt, Homo Sapiens
auaguuaagauccaaagucagaauaggccaaaaaaaaaaaaaaaaaaagccuaaauaguaagcu

SEQ ID NO: 31966 - RNA, 64 nt, Homo Sapiens
uaguuaagauccaaagucagaauaggccaaaaaaaaaaaaaaaaaaagccuaaauaguaagcug

SEQ ID NO: 31967 - RNA, 64 nt, Homo Sapiens
aguuaagauccaaagucagaauaggccaaaaaaaaaaaaaaaaaaagccuaaauaguaagcugg

SEQ ID NO: 31968 - RNA, 64 nt, Homo Sapiens
guuaagauccaaagucagaauaggccaaaaaaaaaaaaaaaaaaagccuaaauaguaagcuggu

SEQ ID NO: 31969 - RNA, 64 nt, Homo Sapiens
uuaagauccaaagucagaauaggccaaaaaaaaaaaaaaaaaaagccuaaauaguaagcuggug

SEQ ID NO: 31970 - RNA, 64 nt, Homo Sapiens
uaagauccaaagucagaauaggccaaaaaaaaaaaaaaaaaaagccuaaauaguaagcugguga

SEQ ID NO: 31971 - RNA, 64 nt, Homo Sapiens
aagauccaaagucagaauaggccaaaaaaaaaaaaaaaaaaagccuaaauaguaagcuggugaa

SEQ ID NO: 31972 - RNA, 64 nt, Homo Sapiens
accugagugacagagcaacacucugucuuaaaagaaaaaaaaaaaagagagagauaguaaucuc

SEQ ID NO: 31973 - RNA, 64 nt, Homo Sapiens
ccugagugacagagcaacacucugucuuaaaagaaaaaaaaaaaagagagagauaguaaucucu

SEQ ID NO: 31974 - RNA, 64 nt, Homo Sapiens
cugagugacagagcaacacucugucuuaaaagaaaaaaaaaaaagagagagauaguaaucucuu

SEQ ID NO: 31975 - RNA, 64 nt, Homo Sapiens
ugagugacagagcaacacucugucuuaaaagaaaaaaaaaaaagagagagauaguaaucucuug

SEQ ID NO: 31976 - RNA, 64 nt, Homo Sapiens
gagugacagagcaacacucugucuuaaaagaaaaaaaaaaaagagagagauaguaaucucuugg

SEQ ID NO: 31977 - RNA, 64 nt, Homo Sapiens
aaaguuuuuuuaaagaacagaaacuuuuccaauuaaaaaaaaaaagcagacuucugguucaaga

SEQ ID NO: 31978 - RNA, 64 nt, Homo Sapiens
aaguuuuuuuaaagaacagaaacuuuuccaauuaaaaaaaaaaagcagacuucugguucaagau

SEQ ID NO: 31979 - RNA, 64 nt, Homo Sapiens
aguuuuuuuaaagaacagaaacuuuuccaauuaaaaaaaaaaagcagacuucugguucaagaua

SEQ ID NO: 31980 - RNA, 64 nt, Homo Sapiens
guuuuuuuaaagaacagaaacuuuuccaauuaaaaaaaaaaagcagacuucugguucaagauag

SEQ ID NO: 31981 - RNA, 64 nt, Homo Sapiens
ucuuuaaguaauuuaacaacagauuugcuaauuuaaaaaaaaaugaaaaaaaaaaucuuaccag

SEQ ID NO: 31982 - RNA, 64 nt, Homo Sapiens
cuuuaaguaauuuaacaacagauuugcuaauuuaaaaaaaaaugaaaaaaaaaaucuuaccagc

SEQ ID NO: 31983 - RNA, 64 nt, Homo Sapiens
uuuaacaacagauuugcuaauuuaaaaaaaaaugaaaaaaaaaaucuuaccagcaguuuguaaa

SEQ ID NO: 31984 - RNA, 64 nt, Homo Sapiens
uuaacaacagauuugcuaauuuaaaaaaaaaugaaaaaaaaaaucuuaccagcaguuuguaaag

SEQ ID NO: 31985 - RNA, 64 nt, Homo Sapiens
uaacaacagauuugcuaauuuaaaaaaaaaugaaaaaaaaaaucuuaccagcaguuuguaaagg

SEQ ID NO: 31986 - RNA, 64 nt, Homo Sapiens
aucuuguccuggaauauuuuugggguuggaacucaaaaaaaaaaaaaaaaaaucaaucuuuucu

SEQ ID NO: 31987 - RNA, 64 nt, Homo Sapiens
ucuuguccuggaauauuuuugggguuggaacucaaaaaaaaaaaaaaaaaaucaaucuuuucuc

SEQ ID NO: 31988 - RNA, 64 nt, Homo Sapiens
cuuguccuggaauauuuuugggguuggaacucaaaaaaaaaaaaaaaaaaucaaucuuuucuca

SEQ ID NO: 31989 - RNA, 64 nt, Homo Sapiens
uuguccuggaauauuuuugggguuggaacucaaaaaaaaaaaaaaaaaaucaaucuuuucucag

SEQ ID NO: 31990 - RNA, 64 nt, Homo Sapiens
uguccuggaauauuuuugggguuggaacucaaaaaaaaaaaaaaaaaaucaaucuuuucucagg

SEQ ID NO: 31991 - RNA, 64 nt, Homo Sapiens
guccuggaauauuuuugggguuggaacucaaaaaaaaaaaaaaaaaaucaaucuuuucucaggc

SEQ ID NO: 31992 - RNA, 64 nt, Homo Sapiens
uccuggaauauuuuugggguuggaacucaaaaaaaaaaaaaaaaaaucaaucuuuucucaggcc

SEQ ID NO: 31993 - RNA, 64 nt, Homo Sapiens
ccuggaauauuuuugggguuggaacucaaaaaaaaaaaaaaaaaaucaaucuuuucucaggccu

SEQ ID NO: 31994 - RNA, 64 nt, Homo Sapiens
cuggaauauuuuugggguuggaacucaaaaaaaaaaaaaaaaaaucaaucuuuucucaggccug

SEQ ID NO: 31995 - RNA, 64 nt, Homo Sapiens
uggaauauuuuugggguuggaacucaaaaaaaaaaaaaaaaaaucaaucuuuucucaggccugg

SEQ ID NO: 31996 - RNA, 64 nt, Homo Sapiens
ggaauauuuuugggguuggaacucaaaaaaaaaaaaaaaaaaucaaucuuuucucaggccuggc

SEQ ID NO: 31997 - RNA, 64 nt, Homo Sapiens
uuuguaaauccuuguauuccuauuuuuuuuaaagaaaaaaaaaaaaccuuaagcugcauuuguu

SEQ ID NO: 31998 - RNA, 64 nt, Homo Sapiens
uuguaaauccuuguauuccuauuuuuuuuaaagaaaaaaaaaaaaccuuaagcugcauuuguua

SEQ ID NO: 31999 - RNA, 64 nt, Homo Sapiens
uguaaauccuuguauuccuauuuuuuuuaaagaaaaaaaaaaaaccuuaagcugcauuuguuac

SEQ ID NO: 32000 - RNA, 64 nt, Homo Sapiens
guaaauccuuguauuccuauuuuuuuuaaagaaaaaaaaaaaaccuuaagcugcauuuguuacu

SEQ ID NO: 32001 - RNA, 64 nt, Homo Sapiens
uaaauccuuguauuccuauuuuuuuuaaagaaaaaaaaaaaaccuuaagcugcauuuguuacug

SEQ ID NO: 32002 - RNA, 64 nt, Homo Sapiens
uguuuaaauauugaaggccuagacaaagaacuagaaaaaaaaaagcaguuuccaggcccaucca

SEQ ID NO: 32003 - RNA, 64 nt, Homo Sapiens
guuuaaauauugaaggccuagacaaagaacuagaaaaaaaaaagcaguuuccaggcccauccau

SEQ ID NO: 32004 - RNA, 64 nt, Homo Sapiens
uuuaaauauugaaggccuagacaaagaacuagaaaaaaaaaagcaguuuccaggcccauccaua

SEQ ID NO: 32005 - RNA, 64 nt, Homo Sapiens
uuugaaaaugucucuguaauauuuuaucuucuuuaaaaaaaagggggggaaauaccaaagugug

SEQ ID NO: 32006 - RNA, 64 nt, Homo Sapiens
auguaacaugaagccauuccagaaaugguaacuuaaaaaaaaaaagacuacaugucuaggaaac

SEQ ID NO: 32007 - RNA, 64 nt, Homo Sapiens
uguaacaugaagccauuccagaaaugguaacuuaaaaaaaaaaagacuacaugucuaggaaacu

SEQ ID NO: 32008 - RNA, 64 nt, Homo Sapiens
guaacaugaagccauuccagaaaugguaacuuaaaaaaaaaaagacuacaugucuaggaaacug

SEQ ID NO: 32009 - RNA, 64 nt, Homo Sapiens
uaacaugaagccauuccagaaaugguaacuuaaaaaaaaaaagacuacaugucuaggaaacugu

SEQ ID NO: 32010 - RNA, 64 nt, Homo Sapiens
cuccagccugggcaacagagggagacucugucucaaaaaaaaagaaguuacuuccaagacagac

SEQ ID NO: 32011 - RNA, 64 nt, Homo Sapiens
uccagccugggcaacagagggagacucugucucaaaaaaaaagaaguuacuuccaagacagacu

SEQ ID NO: 32012 - RNA, 64 nt, Homo Sapiens
ucagguuagguuuuggucucucuugcuccacugcaaaaaaaaaaaaaaaaaaaaaaaaaaaaaa

SEQ ID NO: 32013 - RNA, 64 nt, Homo Sapiens
cagguuagguuuuggucucucuugcuccacugcaaaaaaaaaaaaaaaaaaaaaaaaaaaaaaa

SEQ ID NO: 32014 - RNA, 64 nt, Homo Sapiens
agguuagguuuuggucucucuugcuccacugcaaaaaaaaaaaaaaaaaaaaaaaaaaaaaaaa

SEQ ID NO: 32015 - RNA, 64 nt, Homo Sapiens
gguuagguuuuggucucucuugcuccacugcaaaaaaaaaaaaaaaaaaaaaaaaaaaaaaaaa

SEQ ID NO: 32016 - RNA, 64 nt, Homo Sapiens
guuagguuuuggucucucuugcuccacugcaaaaaaaaaaaaaaaaaaaaaaaaaaaaaaaaag

SEQ ID NO: 32017 - RNA, 64 nt, Homo Sapiens
uuagguuuuggucucucuugcuccacugcaaaaaaaaaaaaaaaaaaaaaaaaaaaaaaaaagc

SEQ ID NO: 32018 - RNA, 64 nt, Homo Sapiens
uagguuuuggucucucuugcuccacugcaaaaaaaaaaaaaaaaaaaaaaaaaaaaaaaaagcc

SEQ ID NO: 32019 - RNA, 64 nt, Homo Sapiens
agguuuuggucucucuugcuccacugcaaaaaaaaaaaaaaaaaaaaaaaaaaaaaaaaagccu

SEQ ID NO: 32020 - RNA, 64 nt, Homo Sapiens
gguuuuggucucucuugcuccacugcaaaaaaaaaaaaaaaaaaaaaaaaaaaaaaaaagccug

SEQ ID NO: 32021 - RNA, 64 nt, Homo Sapiens
guuuuggucucucuugcuccacugcaaaaaaaaaaaaaaaaaaaaaaaaaaaaaaaaagccuga

SEQ ID NO: 32022 - RNA, 64 nt, Homo Sapiens
uuuuggucucucuugcuccacugcaaaaaaaaaaaaaaaaaaaaaaaaaaaaaaaaagccugaa

SEQ ID NO: 32023 - RNA, 64 nt, Homo Sapiens
uuuggucucucuugcuccacugcaaaaaaaaaaaaaaaaaaaaaaaaaaaaaaaaagccugaag

SEQ ID NO: 32024 - RNA, 64 nt, Homo Sapiens
uuggucucucuugcuccacugcaaaaaaaaaaaaaaaaaaaaaaaaaaaaaaaaagccugaaga

SEQ ID NO: 32025 - RNA, 64 nt, Homo Sapiens
uggucucucuugcuccacugcaaaaaaaaaaaaaaaaaaaaaaaaaaaaaaaaagccugaagag

SEQ ID NO: 32026 - RNA, 64 nt, Homo Sapiens
ggucucucuugcuccacugcaaaaaaaaaaaaaaaaaaaaaaaaaaaaaaaaagccugaagaga

SEQ ID NO: 32027 - RNA, 64 nt, Homo Sapiens
gucucucuugcuccacugcaaaaaaaaaaaaaaaaaaaaaaaaaaaaaaaaagccugaagagau

SEQ ID NO: 32028 - RNA, 64 nt, Homo Sapiens
ucucucuugcuccacugcaaaaaaaaaaaaaaaaaaaaaaaaaaaaaaaaagccugaagagaug

SEQ ID NO: 32029 - RNA, 64 nt, Homo Sapiens
cucucuugcuccacugcaaaaaaaaaaaaaaaaaaaaaaaaaaaaaaaaagccugaagagauga

SEQ ID NO: 32030 - RNA, 64 nt, Homo Sapiens
ucucuugcuccacugcaaaaaaaaaaaaaaaaaaaaaaaaaaaaaaaaagccugaagagaugag

SEQ ID NO: 32031 - RNA, 64 nt, Homo Sapiens
cucuugcuccacugcaaaaaaaaaaaaaaaaaaaaaaaaaaaaaaaaagccugaagagaugaga

SEQ ID NO: 32032 - RNA, 64 nt, Homo Sapiens
ucuugcuccacugcaaaaaaaaaaaaaaaaaaaaaaaaaaaaaaaaagccugaagagaugagau

SEQ ID NO: 32033 - RNA, 64 nt, Homo Sapiens
cuugcuccacugcaaaaaaaaaaaaaaaaaaaaaaaaaaaaaaaaagccugaagagaugagaua

SEQ ID NO: 32034 - RNA, 64 nt, Homo Sapiens
uugcuccacugcaaaaaaaaaaaaaaaaaaaaaaaaaaaaaaaaagccugaagagaugagauag

SEQ ID NO: 32035 - RNA, 64 nt, Homo Sapiens
ugcuccacugcaaaaaaaaaaaaaaaaaaaaaaaaaaaaaaaaagccugaagagaugagauagg

SEQ ID NO: 32036 - RNA, 64 nt, Homo Sapiens
gcuccacugcaaaaaaaaaaaaaaaaaaaaaaaaaaaaaaaaagccugaagagaugagauagga

SEQ ID NO: 32037 - RNA, 64 nt, Homo Sapiens
cuccacugcaaaaaaaaaaaaaaaaaaaaaaaaaaaaaaaaagccugaagagaugagauaggag

SEQ ID NO: 32038 - RNA, 64 nt, Homo Sapiens
cuccagccugggcgacagagcgagacuccaucucaaaaaaaaaaaaaacaucagcaucugcccc

SEQ ID NO: 32039 - RNA, 64 nt, Homo Sapiens
uccagccugggcgacagagcgagacuccaucucaaaaaaaaaaaaaacaucagcaucugcccca

SEQ ID NO: 32040 - RNA, 64 nt, Homo Sapiens
ccagccugggcgacagagcgagacuccaucucaaaaaaaaaaaaaacaucagcaucugccccag

SEQ ID NO: 32041 - RNA, 64 nt, Homo Sapiens
cagccugggcgacagagcgagacuccaucucaaaaaaaaaaaaaacaucagcaucugccccagu

SEQ ID NO: 32042 - RNA, 64 nt, Homo Sapiens
agccugggcgacagagcgagacuccaucucaaaaaaaaaaaaaacaucagcaucugccccaguu

SEQ ID NO: 32043 - RNA, 64 nt, Homo Sapiens
gccugggcgacagagcgagacuccaucucaaaaaaaaaaaaaacaucagcaucugccccaguug

SEQ ID NO: 32044 - RNA, 63 nt, Homo Sapiens
ccugggcgacagagcgagacuccaucucaaaaaaaaaaaaaacaucagcaucugccccaguug

SEQ ID NO: 32045 - RNA, 64 nt, Homo Sapiens
acaugucagagacauuuauaaaaagugaaaggauaaaaaaaaaaaaaaacaacuaauaccgggc

SEQ ID NO: 32046 - RNA, 64 nt, Homo Sapiens
caugucagagacauuuauaaaaagugaaaggauaaaaaaaaaaaaaaacaacuaauaccgggcg

SEQ ID NO: 32047 - RNA, 64 nt, Homo Sapiens
augucagagacauuuauaaaaagugaaaggauaaaaaaaaaaaaaaacaacuaauaccgggcgc

SEQ ID NO: 32048 - RNA, 64 nt, Homo Sapiens
ugucagagacauuuauaaaaagugaaaggauaaaaaaaaaaaaaaacaacuaauaccgggcgca

SEQ ID NO: 32049 - RNA, 64 nt, Homo Sapiens
gucagagacauuuauaaaaagugaaaggauaaaaaaaaaaaaaaacaacuaauaccgggcgcag

SEQ ID NO: 32050 - RNA, 64 nt, Homo Sapiens
ucagagacauuuauaaaaagugaaaggauaaaaaaaaaaaaaaacaacuaauaccgggcgcagc

SEQ ID NO: 32051 - RNA, 64 nt, Homo Sapiens
cagagacauuuauaaaaagugaaaggauaaaaaaaaaaaaaaacaacuaauaccgggcgcagca

SEQ ID NO: 32052 - RNA, 64 nt, Homo Sapiens
agagacauuuauaaaaagugaaaggauaaaaaaaaaaaaaaacaacuaauaccgggcgcagcau

SEQ ID NO: 32053 - RNA, 64 nt, Homo Sapiens
acaaaauaaugaaugaauuuucuccaucuguuuaaaaaaaaauaggucucuuuccuuccuguug

SEQ ID NO: 32054 - RNA, 64 nt, Homo Sapiens
aacaaaauaaugaaugaauugucuccaucuguuuaaaaaaaaauaggucucuuuccuuccuguu

SEQ ID NO: 32055 - RNA, 64 nt, Homo Sapiens
agaaagaauuagaaauaaaugcagugcucgugaaaaaaaaaagccccaggaacuugaguucuaa

SEQ ID NO: 32056 - RNA, 64 nt, Homo Sapiens
cagaaagaauuagaaauaaaagcagugcucgugaaaaaaaaaagucccaggaacuugaguucua

SEQ ID NO: 32057 - RNA, 64 nt, Homo Sapiens
gcagaaagaauuagaaauaaaagcagugcucgugaaaaaaaaaaaucccaggaacuugaguucu

SEQ ID NO: 32058 - RNA, 64 nt, Homo Sapiens
caagaaaauagagugaggcuagacuccuaaucaaaaaaaaaacaccagccugggagacagaacg

SEQ ID NO: 32059 - RNA, 64 nt, Homo Sapiens
acaagaaaauagagugaggcgagacuccuaaucaaaaaaaaaacuccagccugggagacagaac

SEQ ID NO: 32060 - RNA, 64 nt, Homo Sapiens
cacaagaaaauagagugaggcgagacuccuaaucaaaaaaaaaacuccagccugggagacagaa

SEQ ID NO: 32061 - RNA, 64 nt, Homo Sapiens
augugggaacucaaauuuucagacuccaugucaaaaaaaaaagaccaggcugggugacagagcg

SEQ ID NO: 32062 - RNA, 64 nt, Homo Sapiens
aaugugggaacucaaauuuugagacuccaugucaaaaaaaaaaguccaggcugggugacagagc

SEQ ID NO: 32063 - RNA, 64 nt, Homo Sapiens
gaaugugggaacucaaauuucgagacuccaugucaaaaaaaaaacuccaggcugggugacagag

SEQ ID NO: 32064 - RNA, 64 nt, Homo Sapiens
uuaagucuuuuaaauuuuggggcucauuuaaaagaaaaaaaagguuauaaaagagcacuucugu

SEQ ID NO: 32065 - RNA, 64 nt, Homo Sapiens
uugucucuugauuucuguaagcuacuuugaaaggaaaaaaaaggcaaucuuuuauuguuccuuu

SEQ ID NO: 32066 - RNA, 64 nt, Homo Sapiens
cauggugaggcuuaacaaugucauggcuaagcuuaaaaaaaacuggagugaacauuuggguaaa

SEQ ID NO: 32067 - RNA, 64 nt, Homo Sapiens
cacacacacacaacaaaaaucuuucagaaaacagaaaaaaaacaaauugauaauaaacuguccu

SEQ ID NO: 32068 - RNA, 64 nt, Homo Sapiens
auaaauugcaugcugcuuuaaaacauaaaaaguuaaaaaaaauauugccguugccaagaacuga

SEQ ID NO: 32069 - RNA, 64 nt, Homo Sapiens
gcucugcaggcuuaauaaaauugucguguguagaaaaaaaaacaccuagauuauaucaaaguau

SEQ ID NO: 32070 - RNA, 64 nt, Homo Sapiens
agcucugcaggcuuaauaaauuugucguguguagaaaaaaaaacuccuagauuauaucaaagua

SEQ ID NO: 32071 - RNA, 64 nt, Homo Sapiens
caguuuauuaaaaaugacacaaaacaaacaaucaaaaaaaaagaaaacauuuacagaguuacaa

SEQ ID NO: 32072 - RNA, 64 nt, Homo Sapiens
acaguuuauuaaaaaugacaaaaaacaaacaaucaaaaaaaaagaaaacauuuacagaguuaca

SEQ ID NO: 32073 - RNA, 64 nt, Homo Sapiens
auuaaaucaugucccccccuacaaaaaaaaaaaaaaaaaaaacuacccccucacucugcccccc

SEQ ID NO: 32074 - RNA, 64 nt, Homo Sapiens
uauuaaaucauguccccccccacaaaaaaaaaaaaaaaaaaaacgacccccucacucugccccc

SEQ ID NO: 32075 - RNA, 64 nt, Homo Sapiens
aaaaaaaaauuaaggccaaaccacaaaaaaaaaaaaaaaaaaaaagacccccucacucugcccc

SEQ ID NO: 32076 - RNA, 64 nt, Homo Sapiens
aaaaaaaaaauuaaggccaacccacaaaaaaaaaaaaaaaaaaaaagacccccucacucugccc

SEQ ID NO: 32077 - RNA, 64 nt, Homo Sapiens
aaaaaaaaaaauuaaggccaccccacaaaaaaaaaaaaaaaaaacaagacccccucacucugcc

SEQ ID NO: 32078 - RNA, 64 nt, Homo Sapiens
aaaaaaaaaaaauuaaggcccccccacaaaaaaaaaaaaaaaaagcaagacccccucacucugc

SEQ ID NO: 32079 - RNA, 64 nt, Homo Sapiens
aaaaaaaaaaaaauuaaggcccccccacaaaaaaaaaaaaaaaaggcaagacccccucacucug

SEQ ID NO: 32080 - RNA, 64 nt, Homo Sapiens
aaaaaaaaaaaaaauuaaggaccccccacaaaaaaaaaaaaaaaacugccucccgcugcugccc

SEQ ID NO: 32081 - RNA, 64 nt, Homo Sapiens
aaaaaaaaaaaaaaauuaagcaccccccacaaaaaaaaaaaaaacacugccucccgcugcugcc

SEQ ID NO: 32082 - RNA, 64 nt, Homo Sapiens
aaaaaaaaaaaaaaaauuaaccaccccccacaaaaaaaaaaaaaccacugccucccgcugcugc

SEQ ID NO: 32083 - RNA, 64 nt, Homo Sapiens
aaaaaaaaaaaaaaaaauuacccaccccccacaaaaaaaaaaaaaccacugccucccgcugcug

SEQ ID NO: 32084 - RNA, 64 nt, Homo Sapiens
aaaaaaaaaaaaaaaaaauugcccaccccccacaaaaaaaaaaacaccacugccucccgcugcu

SEQ ID NO: 32085 - RNA, 64 nt, Homo Sapiens
aaaaaaaaaaaaaaaaaaauugcccaccccccacaaaaaaaaaaccaccacugccucccgcugc

SEQ ID NO: 32086 - RNA, 64 nt, Homo Sapiens
guggaucaguuugcuaaauguugugccaaaaagaaaaaaaaagagguccaucugugauauuucu

SEQ ID NO: 32087 - RNA, 64 nt, Homo Sapiens
aguggaucaguuugcuaaauuuugugccaaaaagaaaaaaaaagggguccaucugugauauuuc

SEQ ID NO: 32088 - RNA, 64 nt, Homo Sapiens
acaaaagugcuauuuguuucuaagaaacauuguaaaaaaaaauuuacuuaaauuaagaucaagg

SEQ ID NO: 32089 - RNA, 64 nt, Homo Sapiens
uacaaaagugcuauuuguuuguaagaaacauuguaaaaaaaaauuuacuuaaauuaagaucaag

SEQ ID NO: 32090 - RNA, 64 nt, Homo Sapiens
uuuuuuuaaauuaaaaaggacuuuguaucuggggaaaaaaaacuuuuuaugcaagggcaaaaau

SEQ ID NO: 32091 - RNA, 64 nt, Homo Sapiens
acauuuaucaaacuggcugaguuuucuuuaaaaaaaaaaaaauuugauuuaggacuuguucugu

SEQ ID NO: 32092 - RNA, 64 nt, Homo Sapiens
uacauuuaucaaacuggcuguguuuucuuuaaaaaaaaaaaaaucugauuuaggacuuguucug

SEQ ID NO: 32093 - RNA, 64 nt, Homo Sapiens
uuacauuuaucaaacuggcuguguuuucuuuaaaaaaaaaaaaaucugauuuaggacuuguucu

SEQ ID NO: 32094 - RNA, 64 nt, Homo Sapiens
auuacauuuaucaaacuggcuguguuuucuuuaaaaaaaaaaaagucugauuuaggacuuguuc

SEQ ID NO: 32095 - RNA, 64 nt, Homo Sapiens
aauuacauuuaucaaacuggcuguguuuucuuuaaaaaaaaaaaugucugauuuaggacuuguu

SEQ ID NO: 32096 - RNA, 64 nt, Homo Sapiens
aaauuacauuuaucaaacugucuguguuuucuuuaaaaaaaaaauugucugauuuaggacuugu

SEQ ID NO: 32097 - RNA, 64 nt, Homo Sapiens
acuaaauuaaauaauuuuuuauuuuuuuccaaaaaaaaaaaacuucaguuuuuuugccuuauug

SEQ ID NO: 32098 - RNA, 64 nt, Homo Sapiens
uacuaaauuaaauaauuuuugauuuuuuuccaaaaaaaaaaaacuucaguuuuuuugccuuauu

SEQ ID NO: 32099 - RNA, 64 nt, Homo Sapiens
cuacuaaauuaaauaauuuuugauuuuuuuccaaaaaaaaaaaauuucaguuuuuuugccuuau

SEQ ID NO: 32100 - RNA, 64 nt, Homo Sapiens
acuacuaaauuaaauaauuuuugauuuuuuuccaaaaaaaaaaauuuucaguuuuuuugccuua

SEQ ID NO: 32101 - RNA, 64 nt, Homo Sapiens
aacuacuaaauuaaauaauuauugauuuuuuuccaaaaaaaaaaauuuucaguuuuuuugccuu

SEQ ID NO: 32102 - RNA, 64 nt, Homo Sapiens
ggaaaaaaagaaccauacaaaaaacugaagaaaaaaaaaaaacagcagcgaagagaaaugaaga

SEQ ID NO: 32103 - RNA, 64 nt, Homo Sapiens
aggaaaaaaagaaccauacaaaaaacugaagaaaaaaaaaaaacugcagcgaagagaaaugaag

SEQ ID NO: 32104 - RNA, 64 nt, Homo Sapiens
caggaaaaaaagaaccauacgaaaaacugaagaaaaaaaaaaaauugcagcgaagagaaaugaa

SEQ ID NO: 32105 - RNA, 64 nt, Homo Sapiens
acaggaaaaaaagaaccauaagaaaaacugaagaaaaaaaaaaauuugcagcgaagagaaauga

SEQ ID NO: 32106 - RNA, 64 nt, Homo Sapiens
aacaggaaaaaaagaaccauaagaaaaacugaagaaaaaaaaaauuuugcagcgaagagaaaug

SEQ ID NO: 32107 - RNA, 64 nt, Homo Sapiens
uugcagcgaagagaaaugaacccaccaucacaaaaaaaaaaauuuauaaaaaauaaaacaaaaa

SEQ ID NO: 32108 - RNA, 64 nt, Homo Sapiens
uuugcagcgaagagaaaugaacccaccaucacaaaaaaaaaaauuuauaaaaaauaaaacaaaa

SEQ ID NO: 32109 - RNA, 64 nt, Homo Sapiens
uuuugcagcgaagagaaaugaacccaccaucacaaaaaaaaaaauuuauaaaaaauaaaacaaa

SEQ ID NO: 32110 - RNA, 64 nt, Homo Sapiens
auuuugcagcgaagagaaauaaacccaccaucacaaaaaaaaaauuuuauaaaaaauaaaacaa

SEQ ID NO: 32111 - RNA, 64 nt, Homo Sapiens
acaaaaacuuagaauugaggccugucucaaaaaaaaaaaaaacacuggggugauagaacaagac

SEQ ID NO: 32112 - RNA, 64 nt, Homo Sapiens
aacaaaaacuuagaauugagcccugucucaaaaaaaaaaaaaacccuggggugauagaacaaga

SEQ ID NO: 32113 - RNA, 64 nt, Homo Sapiens
caacaaaaacuuagaauugaacccugucucaaaaaaaaaaaaaagccuggggugauagaacaag

SEQ ID NO: 32114 - RNA, 64 nt, Homo Sapiens
acaacaaaaacuuagaauuggacccugucucaaaaaaaaaaaaaagccuggggugauagaacaa

SEQ ID NO: 32115 - RNA, 64 nt, Homo Sapiens
aacaacaaaaacuuagaauuagacccugucucaaaaaaaaaaaacagccuggggugauagaaca

SEQ ID NO: 32116 - RNA, 64 nt, Homo Sapiens
aaacaacaaaaacuuagaauaagacccugucucaaaaaaaaaaaccagccuggggugauagaac

SEQ ID NO: 32117 - RNA, 64 nt, Homo Sapiens
aaaacaacaaaaacuuagaacaagacccugucucaaaaaaaaaauccagccuggggugauagaa

SEQ ID NO: 32118 - RNA, 64 nt, Homo Sapiens
cacucauauaaaaggugagccauuucaaaaaaaaaaaaaaaaucugggcgacagagcaagacuc

SEQ ID NO: 32119 - RNA, 64 nt, Homo Sapiens
ccacucauauaaaaggugagccauuucaaaaaaaaaaaaaaaaucugggcgacagagcaagacu

SEQ ID NO: 32120 - RNA, 64 nt, Homo Sapiens
uccacucauauaaaaggugauccauuucaaaaaaaaaaaaaaaaccugggcgacagagcaagac

SEQ ID NO: 32121 - RNA, 64 nt, Homo Sapiens
auccacucauauaaaaggugcuccauuucaaaaaaaaaaaaaaagccugggcgacagagcaaga

SEQ ID NO: 32122 - RNA, 64 nt, Homo Sapiens
aauccacucauauaaaagguacuccauuucaaaaaaaaaaaaaaagccugggcgacagagcaag

SEQ ID NO: 32123 - RNA, 64 nt, Homo Sapiens
aaauccacucauauaaaagggacuccauuucaaaaaaaaaaaaacagccugggcgacagagcaa

SEQ ID NO: 32124 - RNA, 64 nt, Homo Sapiens
aaaauccacucauauaaaagagacuccauuucaaaaaaaaaaaaccagccugggcgacagagca

SEQ ID NO: 32125 - RNA, 64 nt, Homo Sapiens
aaaaauccacucauauaaaaaagacuccauuucaaaaaaaaaaauccagccugggcgacagagc

SEQ ID NO: 32126 - RNA, 64 nt, Homo Sapiens
aaaaaauccacucauauaaacaagacuccauuucaaaaaaaaaacuccagccugggcgacagag

SEQ ID NO: 32127 - RNA, 64 nt, Homo Sapiens
caauaauaaaaaggcucauuaccuucgauuaaaaaaaaaaaagaggaagcaggaccaguaaggg

SEQ ID NO: 32128 - RNA, 64 nt, Homo Sapiens
acaauaauaaaaaggcucaugaccuucgauuaaaaaaaaaaaaguggaagcaggaccaguaagg

SEQ ID NO: 32129 - RNA, 64 nt, Homo Sapiens
gacaauaauaaaaaggcucaggaccuucgauuaaaaaaaaaaaaauggaagcaggaccaguaag

SEQ ID NO: 32130 - RNA, 64 nt, Homo Sapiens
agacaauaauaaaaaggcucgggaccuucgauuaaaaaaaaaaacauggaagcaggaccaguaa

SEQ ID NO: 32131 - RNA, 64 nt, Homo Sapiens
aagacaauaauaaaaaggcuagggaccuucgauuaaaaaaaaaaucauggaagcaggaccagua

SEQ ID NO: 32132 - RNA, 64 nt, Homo Sapiens
acauacgugacagcucacuuuuucuuaaaaaaaaaaaaaaaauguugguugggagucagauugg

SEQ ID NO: 32133 - RNA, 64 nt, Homo Sapiens
gacauacgugacagcucacuguuucuuaaaaaaaaaaaaaaaauauugguugggagucagauug

SEQ ID NO: 32134 - RNA, 64 nt, Homo Sapiens
ugacauacgugacagcucacgguuucuuaaaaaaaaaaaaaaaacauugguugggagucagauu

SEQ ID NO: 32135 - RNA, 64 nt, Homo Sapiens
augacauacgugacagcucaugguuucuuaaaaaaaaaaaaaaaccauugguugggagucagau

SEQ ID NO: 32136 - RNA, 64 nt, Homo Sapiens
aaugacauacgugacagcucuugguuucuuaaaaaaaaaaaaaaaccauugguugggagucaga

SEQ ID NO: 32137 - RNA, 64 nt, Homo Sapiens
aaaugacauacgugacagcuauugguuucuuaaaaaaaaaaaaaaaccauugguugggagucag

SEQ ID NO: 32138 - RNA, 64 nt, Homo Sapiens
aaaaugacauacgugacagcgauugguuucuuaaaaaaaaaaaaaaaccauugguugggaguca

SEQ ID NO: 32139 - RNA, 64 nt, Homo Sapiens
aaaaaugacauacgugacagagauugguuucuuaaaaaaaaaaacaaaccauugguugggaguc

SEQ ID NO: 32140 - RNA, 64 nt, Homo Sapiens
aaaaaaugacauacgugacacagauugguuucuuaaaaaaaaaagcaaaccauugguugggagu

SEQ ID NO: 32141 - RNA, 64 nt, Homo Sapiens
uccuguaauuugcacuuucugacuuuauaaaaaaaaaaaaaagcuugugcuuuuauucuuuuua

SEQ ID NO: 32142 - RNA, 64 nt, Homo Sapiens
cuccuguaauuugcacuuucagacuuuauaaaaaaaaaaaaaaguuugugcuuuuauucuuuuu

SEQ ID NO: 32143 - RNA, 64 nt, Homo Sapiens
gcuccuguaauuugcacuuuuagacuuuauaaaaaaaaaaaaaauuuugugcuuuuauucuuuu

SEQ ID NO: 32144 - RNA, 64 nt, Homo Sapiens
agcuccuguaauuugcacuuuuagacuuuauaaaaaaaaaaaaacuuuugugcuuuuauucuuu

SEQ ID NO: 32145 - RNA, 64 nt, Homo Sapiens
aagcuccuguaauuugcacuuuuagacuuuauaaaaaaaaaaaaacuuuugugcuuuuauucuu

SEQ ID NO: 32146 - RNA, 64 nt, Homo Sapiens
aaagcuccuguaauuugcacuuuuagacuuuauaaaaaaaaaaauacuuuugugcuuuuauucu

SEQ ID NO: 32147 - RNA, 64 nt, Homo Sapiens
aaaagcuccuguaauuugcauuuuuagacuuuauaaaaaaaaaauuacuuuugugcuuuuauuc

SEQ ID NO: 32148 - RNA, 64 nt, Homo Sapiens
uuugugauuuaauaauacuauagaaaguuaaagaaaaaaaaacuccuuugugccacuucagugc

SEQ ID NO: 32149 - RNA, 64 nt, Homo Sapiens
uuuugugauuuaauaauacucuagaaaguuaaagaaaaaaaaacgccuuugugccacuucagug

SEQ ID NO: 32150 - RNA, 64 nt, Homo Sapiens
ggcuggucuacuaggcagcccacaauauuuuaagaaaaaaaaguuuguacagauaguuuauaag

SEQ ID NO: 32151 - RNA, 64 nt, Homo Sapiens
gagagagagagaaaaagaaaaucucaaaaaaaaaaaaaaaaagaggaugacagagugagaccuu

SEQ ID NO: 32152 - RNA, 64 nt, Homo Sapiens
agagagagagagaaaaagaauaucucaaaaaaaaaaaaaaaaaguggaugacagagugagaccu

SEQ ID NO: 32153 - RNA, 64 nt, Homo Sapiens
gagagagagagagaaaaagauuaucucaaaaaaaaaaaaaaaaacuggaugacagagugagacc

SEQ ID NO: 32154 - RNA, 64 nt, Homo Sapiens
agagagagagagagaaaaagcuuaucucaaaaaaaaaaaaaaaaccuggaugacagagugagac

SEQ ID NO: 32155 - RNA, 64 nt, Homo Sapiens
aagagagagagagagaaaaaccuuaucucaaaaaaaaaaaaaaagccuggaugacagagugaga

SEQ ID NO: 32156 - RNA, 64 nt, Homo Sapiens
aaagagagagagagagaaaaaccuuaucucaaaaaaaaaaaaaaagccuggaugacagagugag

SEQ ID NO: 32157 - RNA, 64 nt, Homo Sapiens
aaaagagagagagagagaaagaccuuaucucaaaaaaaaaaaaaaagccuggaugacagaguga

SEQ ID NO: 32158 - RNA, 64 nt, Homo Sapiens
aaaaagagagagagagagaaagaccuuaucucaaaaaaaaaaaagaagccuggaugacagagug

SEQ ID NO: 32159 - RNA, 64 nt, Homo Sapiens
aaaaaagagagagagagagagagaccuuaucucaaaaaaaaaaaugaagccuggaugacagagu

SEQ ID NO: 32160 - RNA, 64 nt, Homo Sapiens
aaaaaaagagagagagagagugagaccuuaucucaaaaaaaaaacugaagccuggaugacagag

SEQ ID NO: 32161 - RNA, 64 nt, Homo Sapiens
cacuuuuggcuaaucaugcacuccaucucaaaaaaaaaaaaagugccugggcaacagagggaga

SEQ ID NO: 32162 - RNA, 64 nt, Homo Sapiens
ucacuuuuggcuaaucaugcacuccaucucaaaaaaaaaaaaagagccugggcaacagagggag

SEQ ID NO: 32163 - RNA, 64 nt, Homo Sapiens
gucacuuuuggcuaaucauggacuccaucucaaaaaaaaaaaaacagccugggcaacagaggga

SEQ ID NO: 32164 - RNA, 64 nt, Homo Sapiens
agucacuuuuggcuaaucauagacuccaucucaaaaaaaaaaaaccagccugggcaacagaggg

SEQ ID NO: 32165 - RNA, 64 nt, Homo Sapiens
aagucacuuuuggcuaaucagagacuccaucucaaaaaaaaaaauccagccugggcaacagagg

SEQ ID NO: 32166 - RNA, 64 nt, Homo Sapiens
aaagucacuuuuggcuaaucggagacuccaucucaaaaaaaaaacuccagccugggcaacagag

SEQ ID NO: 32167 - RNA, 64 nt, Homo Sapiens
cagguaaauguuauauaauucaugguaaaagaaaaaaaaaaagauaucucguaauuguguauag

SEQ ID NO: 32168 - RNA, 64 nt, Homo Sapiens
acagguaaauguuauauaaugcaugguaaaagaaaaaaaaaaagguaucucguaauuguguaua

SEQ ID NO: 32169 - RNA, 64 nt, Homo Sapiens
gacagguaaauguuauauaaagcaugguaaaagaaaaaaaaaaauguaucucguaauuguguau

SEQ ID NO: 32170 - RNA, 64 nt, Homo Sapiens
agacagguaaauguuauauauagcaugguaaaagaaaaaaaaaacuguaucucguaauugugua

SEQ ID NO: 32171 - RNA, 64 nt, Homo Sapiens
aaaacaaaaacaaaaaagacaaggcucugucucaaaaaaaaacauccagccugggugacagagc

SEQ ID NO: 32172 - RNA, 64 nt, Homo Sapiens
aaaaacaaaaacaaaaaagacaaggcucugucucaaaaaaaaaccuccagccugggugacagag

SEQ ID NO: 32173 - RNA, 64 nt, Homo Sapiens
ccagugcuugugagggaacuggaguuguugugaaaaaaaaaaccguguuguaggaauuagucag

SEQ ID NO: 32174 - RNA, 64 nt, Homo Sapiens
cccagugcuugugagggaacgggaguuguugugaaaaaaaaaacuguguuguaggaauuaguca

SEQ ID NO: 32175 - RNA, 64 nt, Homo Sapiens
ccccagugcuugugagggaaagggaguuguugugaaaaaaaaaauuguguuguaggaauuaguc

SEQ ID NO: 32176 - RNA, 64 nt, Homo Sapiens
aaaucaucugaaaagcauuugaguuucuuguuuaaaaaaaaauaccuaaauuuuuguuauagca

SEQ ID NO: 32177 - RNA, 64 nt, Homo Sapiens
aaaaucaucugaaaagcauuagaguuucuuguuuaaaaaaaaauaccuaaauuuuuguuauagc

SEQ ID NO: 32178 - RNA, 64 nt, Homo Sapiens
acuugucccaaaaguuuuugggagaccccgucaaaaaaaaaaguacuccagccugggugacaaa

SEQ ID NO: 32179 - RNA, 64 nt, Homo Sapiens
uacuugucccaaaaguuuuuaggagaccccgucaaaaaaaaaagcacuccagccugggugacaa

SEQ ID NO: 32180 - RNA, 64 nt, Homo Sapiens
guacuugucccaaaaguuuuaaggagaccccgucaaaaaaaaaaacacuccagccugggugaca

SEQ ID NO: 32181 - RNA, 64 nt, Homo Sapiens
gaccuuaagaaacuauuuacucagugaugauaaaaaaaaaaauggcagggaauggagacagaca

SEQ ID NO: 32182 - RNA, 64 nt, Homo Sapiens
ggaccuuaagaaacuauuuaaucagugaugauaaaaaaaaaaauagcagggaauggagacagac

SEQ ID NO: 32183 - RNA, 64 nt, Homo Sapiens
uggaccuuaagaaacuauuucaucagugaugauaaaaaaaaaaagagcagggaauggagacaga

SEQ ID NO: 32184 - RNA, 64 nt, Homo Sapiens
auggaccuuaagaaacuauuacaucagugaugauaaaaaaaaaaggagcagggaauggagacag

SEQ ID NO: 32185 - RNA, 64 nt, Homo Sapiens
ucaguuauguuuuuauuagcuguacaguguaaaaaaaaaaaaucgaaugccaaaguaaacuuua

SEQ ID NO: 32186 - RNA, 64 nt, Homo Sapiens
cucaguuauguuuuuauuagauguacaguguaaaaaaaaaaaauugaaugccaaaguaaacuuu

SEQ ID NO: 32187 - RNA, 64 nt, Homo Sapiens
ucucaguuauguuuuuauuauauguacaguguaaaaaaaaaaaagugaaugccaaaguaaacuu

SEQ ID NO: 32188 - RNA, 64 nt, Homo Sapiens
aucucaguuauguuuuuauuuuauguacaguguaaaaaaaaaaaugugaaugccaaaguaaacu

SEQ ID NO: 32189 - RNA, 64 nt, Homo Sapiens
aaucucaguuauguuuuuauuuuauguacaguguaaaaaaaaaacugugaaugccaaaguaaac

SEQ ID NO: 32190 - RNA, 64 nt, Homo Sapiens
gcucuuggcugugaaaagaguuuuuccuuaaaaaaaaaaaaauuaggaaaaaaggaauaaaguu

SEQ ID NO: 32191 - RNA, 64 nt, Homo Sapiens
ugcucuuggcugugaaaagauuuuuuccuuaaaaaaaaaaaaauuaggaaaaaaggaauaaagu

SEQ ID NO: 32192 - RNA, 64 nt, Homo Sapiens
uugcucuuggcugugaaaaguuuuuuuccuuaaaaaaaaaaaaacuaggaaaaaaggaauaaag

SEQ ID NO: 32193 - RNA, 64 nt, Homo Sapiens
auugcucuuggcugugaaaaguuuuuuuccuuaaaaaaaaaaaaccuaggaaaaaaggaauaaa

SEQ ID NO: 32194 - RNA, 64 nt, Homo Sapiens
aauugcucuuggcugugaaaaguuuuuuuccuuaaaaaaaaaaauccuaggaaaaaaggaauaa

SEQ ID NO: 32195 - RNA, 64 nt, Homo Sapiens
aaauugcucuuggcugugaaaaguuuuuuuccuuaaaaaaaaaauuccuaggaaaaaaggaaua

SEQ ID NO: 32196 - RNA, 64 nt, Homo Sapiens
uaaacucuucuuuucuuuuuuuuguauuuucacaaaaaaaaagucaguauauuauagugauaau

SEQ ID NO: 32197 - RNA, 64 nt, Homo Sapiens
uuaaacucuucuuuucuuuuuuuuguauuuucacaaaaaaaaaggcaguauauuauagugauaa

SEQ ID NO: 32198 - RNA, 64 nt, Homo Sapiens
cucaguuuugcuugcauuccuauuucuuaagcauaaaaaaaaugaaauauuuugcuuuggacca

SEQ ID NO: 32199 - RNA, 64 nt, Homo Sapiens
acuauuuuucacauaaucaagagaguccaucucaaaaaaaaacaucuagccugggccauagagc

SEQ ID NO: 32200 - RNA, 64 nt, Homo Sapiens
aacuauuuuucacauaaucacgagaguccaucucaaaaaaaaaccucuagccugggccauagag

SEQ ID NO: 32201 - RNA, 64 nt, Homo Sapiens
agcauacauaugcaaaacuaaaaaaaaaaaaaaaaaaaaaaaccgggauguggguuuguacaaa

SEQ ID NO: 32202 - RNA, 64 nt, Homo Sapiens
cagcauacauaugcaaaacuaaaaaaaaaaaaaaaaaaaaaaacagggauguggguuuguacaa

SEQ ID NO: 32203 - RNA, 64 nt, Homo Sapiens
ccagcauacauaugcaaaacaaaaaaaaaaaaaaaaaaaaaaaaaagggauguggguuuguaca

SEQ ID NO: 32204 - RNA, 64 nt, Homo Sapiens
accagcauacauaugcaaaaaaaaaaaaaaaaaaaaaaaaaaaauaagggauguggguuuguac

SEQ ID NO: 32205 - RNA, 64 nt, Homo Sapiens
aaccagcauacauaugcaaacaaaaaaaaaaaaaaaaaaaaaaaguaagggauguggguuugua

SEQ ID NO: 32206 - RNA, 64 nt, Homo Sapiens
aaaccagcauacauaugcaaacaaaaaaaaaaaaaaaaaaaaaaaguaagggauguggguuugu

SEQ ID NO: 32207 - RNA, 64 nt, Homo Sapiens
aaaaccagcauacauaugcauacaaaaaaaaaaaaaaaaaaaaaaaguaagggauguggguuug

SEQ ID NO: 32208 - RNA, 64 nt, Homo Sapiens
aaaaaccagcauacauaugcguacaaaaaaaaaaaaaaaaaaaaaaaguaagggauguggguuu

SEQ ID NO: 32209 - RNA, 64 nt, Homo Sapiens
aaaaaaccagcauacauauguguacaaaaaaaaaaaaaaaaaaaaaaaguaagggauguggguu

SEQ ID NO: 32210 - RNA, 64 nt, Homo Sapiens
aaaaaaaccagcauacauauuuguacaaaaaaaaaaaaaaaaaauaaaaguaagggaugugggu

SEQ ID NO: 32211 - RNA, 64 nt, Homo Sapiens
aaaaaaaaccagcauacauauuuguacaaaaaaaaaaaaaaaaauuaaaaguaagggauguggg

SEQ ID NO: 32212 - RNA, 64 nt, Homo Sapiens
aaaaaaaaaccagcauacauguuuguacaaaaaaaaaaaaaaaacuuaaaaguaagggaugugg

SEQ ID NO: 32213 - RNA, 64 nt, Homo Sapiens
aaaaaaaaaaccagcauacagguuuguacaaaaaaaaaaaaaaaccuuaaaaguaagggaugug

SEQ ID NO: 32214 - RNA, 64 nt, Homo Sapiens
aaaaaaaaaaaccagcauacggguuuguacaaaaaaaaaaaaaacccuuaaaaguaagggaugu

SEQ ID NO: 32215 - RNA, 64 nt, Homo Sapiens
aaaaaaaaaaaaccagcauauggguuuguacaaaaaaaaaaaaagcccuuaaaaguaagggaug

SEQ ID NO: 32216 - RNA, 64 nt, Homo Sapiens
aaaaaaaaaaaaaccagcauguggguuuguacaaaaaaaaaaaaugcccuuaaaaguaagggau

SEQ ID NO: 32217 - RNA, 64 nt, Homo Sapiens
aaaaaaaaaaaaaaccagcauguggguuuguacaaaaaaaaaaauugcccuuaaaaguaaggga

SEQ ID NO: 32218 - RNA, 64 nt, Homo Sapiens
aaaaaaaaaaaaaaaccagcauguggguuuguacaaaaaaaaaauuugcccuuaaaaguaaggg

SEQ ID NO: 32219 - RNA, 64 nt, Homo Sapiens
uucuuuggaaaguacacucuugcuguguaaaaaaaaaaaaaauggacugggaaggcuugggauu

SEQ ID NO: 32220 - RNA, 64 nt, Homo Sapiens
guucuuuggaaaguacacucuugcuguguaaaaaaaaaaaaaauagacugggaaggcuugggau

SEQ ID NO: 32221 - RNA, 64 nt, Homo Sapiens
uguucuuuggaaaguacacuuuugcuguguaaaaaaaaaaaaaagagacugggaaggcuuggga

SEQ ID NO: 32222 - RNA, 64 nt, Homo Sapiens
auguucuuuggaaaguacacauuugcuguguaaaaaaaaaaaaaugagacugggaaggcuuggg

SEQ ID NO: 32223 - RNA, 64 nt, Homo Sapiens
aauguucuuuggaaaguacagauuugcuguguaaaaaaaaaaaagugagacugggaaggcuugg

SEQ ID NO: 32224 - RNA, 64 nt, Homo Sapiens
aaauguucuuuggaaaguacggauuugcuguguaaaaaaaaaaaugugagacugggaaggcuug

SEQ ID NO: 32225 - RNA, 64 nt, Homo Sapiens
aaaauguucuuuggaaaguagggauuugcuguguaaaaaaaaaagugugagacugggaaggcuu

SEQ ID NO: 32226 - RNA, 64 nt, Homo Sapiens
uccagacucaaguugcuaagcuaaaaaggauuaaaaaaaaaauccuuucucauuuuauguugaa

SEQ ID NO: 32227 - RNA, 64 nt, Homo Sapiens
cuccagacucaaguugcuaaacuaaaaaggauuaaaaaaaaaauucuuucucauuuuauguuga

SEQ ID NO: 32228 - RNA, 64 nt, Homo Sapiens
ucuccagacucaaguugcuaaacuaaaaaggauuaaaaaaaaaauucuuucucauuuuauguug

SEQ ID NO: 32229 - RNA, 64 nt, Homo Sapiens
cauugcuuuguauuguaguagcaaacuacacuuuaaaaaaaacuccuacuaaccgugccaucuu

SEQ ID NO: 32230 - RNA, 64 nt, Homo Sapiens
agcuauugguaauauaauaaggucccagaauggaaaaaaaaaucuaguaccuguaagcauuuua

SEQ ID NO: 32231 - RNA, 64 nt, Homo Sapiens
cagcuauugguaauauaauaaggucccagaauggaaaaaaaaaucuaguaccuguaagcauuuu

SEQ ID NO: 32232 - RNA, 64 nt, Homo Sapiens
cuuaacaacagcuucuugcuuaaacucuaaguguaaaaaaaaguuccuuccugccccaaaauua

SEQ ID NO: 32233 - RNA, 64 nt, Homo Sapiens
agauugacuauuuauacaaaccucuugaauuaaaaaaaaaaacuuaacauuggugcaaagauug

SEQ ID NO: 32234 - RNA, 64 nt, Homo Sapiens
uagauugacuauuuauacaagccucuugaauuaaaaaaaaaaaccuaacauuggugcaaagauu

SEQ ID NO: 32235 - RNA, 64 nt, Homo Sapiens
cuagauugacuauuuauacaugccucuugaauuaaaaaaaaaaaccuaacauuggugcaaagau

SEQ ID NO: 32236 - RNA, 64 nt, Homo Sapiens
acuagauugacuauuuauacuugccucuugaauuaaaaaaaaaagccuaacauuggugcaaaga

SEQ ID NO: 32237 - RNA, 64 nt, Homo Sapiens
caauugugcggagccaaccaaaaaaaaaaaaaaaaaaaaaaagguagagagacuccaucucaaa

SEQ ID NO: 32238 - RNA, 64 nt, Homo Sapiens
gcaauugugcggagccaaccaaaaaaaaaaaaaaaaaaaaaaagauagagagacuccaucucaa

SEQ ID NO: 32239 - RNA, 64 nt, Homo Sapiens
ggcaauugugcggagccaacaaaaaaaaaaaaaaaaaaaaaaaacauagagagacuccaucuca

SEQ ID NO: 32240 - RNA, 64 nt, Homo Sapiens
aggcaauugugcggagccaaaaaaaaaaaaaaaaaaaaaaaaaaacauagagagacuccaucuc

SEQ ID NO: 32241 - RNA, 64 nt, Homo Sapiens
aaggcaauugugcggagccacaaaaaaaaaaaaaaaaaaaaaaagacauagagagacuccaucu

SEQ ID NO: 32242 - RNA, 64 nt, Homo Sapiens
aaaggcaauugugcggagccucaaaaaaaaaaaaaaaaaaaaaaugacauagagagacuccauc

SEQ ID NO: 32243 - RNA, 64 nt, Homo Sapiens
aaaaggcaauugugcggagccucaaaaaaaaaaaaaaaaaaaaagugacauagagagacuccau

SEQ ID NO: 32244 - RNA, 64 nt, Homo Sapiens
aaaaaggcaauugugcggagucucaaaaaaaaaaaaaaaaaaaaggugacauagagagacucca

SEQ ID NO: 32245 - RNA, 64 nt, Homo Sapiens
aaaaaaggcaauugugcggaaucucaaaaaaaaaaaaaaaaaaagggugacauagagagacucc

SEQ ID NO: 32246 - RNA, 64 nt, Homo Sapiens
aaaaaaaggcaauugugcggcaucucaaaaaaaaaaaaaaaaaaugggugacauagagagacuc

SEQ ID NO: 32247 - RNA, 64 nt, Homo Sapiens
aaaaaaaaggcaauugugcgccaucucaaaaaaaaaaaaaaaaacugggugacauagagagacu

SEQ ID NO: 32248 - RNA, 64 nt, Homo Sapiens
aaaaaaaaaggcaauugugcuccaucucaaaaaaaaaaaaaaaaccugggugacauagagagac

SEQ ID NO: 32249 - RNA, 64 nt, Homo Sapiens
aaaaaaaaaaggcaauugugcuccaucucaaaaaaaaaaaaaaagccugggugacauagagaga

SEQ ID NO: 32250 - RNA, 64 nt, Homo Sapiens
aaaaaaaaaaaggcaauuguacuccaucucaaaaaaaaaaaaaaagccugggugacauagagag

SEQ ID NO: 32251 - RNA, 64 nt, Homo Sapiens
aaaaaaaaaaaaggcaauuggacuccaucucaaaaaaaaaaaaacagccugggugacauagaga

SEQ ID NO: 32252 - RNA, 64 nt, Homo Sapiens
aaaaaaaaaaaaaggcaauuagacuccaucucaaaaaaaaaaaaucagccugggugacauagag

SEQ ID NO: 32253 - RNA, 64 nt, Homo Sapiens
aaaaaaaaaaaaaaggcaaugagacuccaucucaaaaaaaaaaauucagccugggugacauaga

SEQ ID NO: 32254 - RNA, 64 nt, Homo Sapiens
aaaaaaaaaaaaaaaggcaaagagacuccaucucaaaaaaaaaaauucagccugggugacauag

SEQ ID NO: 32255 - RNA, 64 nt, Homo Sapiens
auaaaagaaacccuucccccuagaagucacacaaaaaaaaaagggcuguauuucuguguuuuga

SEQ ID NO: 32256 - RNA, 64 nt, Homo Sapiens
gauaaaagaaacccuuccccauagaagucacacaaaaaaaaaagugcuguauuucuguguuuug

SEQ ID NO: 32257 - RNA, 64 nt, Homo Sapiens
ggauaaaagaaacccuucccgauagaagucacacaaaaaaaaaagugcuguauuucuguguuuu

SEQ ID NO: 32258 - RNA, 64 nt, Homo Sapiens
aaagauacgugccugcggugcuccgucucgaggaaaaaaaaagagccugggcaacacagcgaga

SEQ ID NO: 32259 - RNA, 64 nt, Homo Sapiens
aaaagauacgugccugcgguacuccgucucgaggaaaaaaaaagagccugggcaacacagcgag

SEQ ID NO: 32260 - RNA, 64 nt, Homo Sapiens
agcuaggcguagugguuggccuacuaaaaauacaaaaaaaaauuaacacggugaaacccugucu

SEQ ID NO: 32261 - RNA, 64 nt, Homo Sapiens
uagcuaggcguagugguuggucuacuaaaaauacaaaaaaaaauuaacacggugaaacccuguc

SEQ ID NO: 32262 - RNA, 64 nt, Homo Sapiens
aaaagggcagcccuccuuaccucagccacaaccaaaaaaaaauaaacugagcaucuccagcauu

SEQ ID NO: 32263 - RNA, 64 nt, Homo Sapiens
aaaaagggcagcccuccuuaucucagccacaaccaaaaaaaaaugaacugagcaucuccagcau

SEQ ID NO: 32264 - RNA, 64 nt, Homo Sapiens
cagaugauacaaauaugaaaaugacaagcauauaaaaaaaaauggaggcugaaaguaaagccac

SEQ ID NO: 32265 - RNA, 64 nt, Homo Sapiens
gcagaugauacaaauaugaacaugacaagcauauaaaaaaaaauugaggcugaaaguaaagcca

SEQ ID NO: 32266 - RNA, 64 nt, Homo Sapiens
aaaaagacuaaagcccuauuagcucuuaaaagaaaaaaaaaagcuacuaggaauucagaugauc

SEQ ID NO: 32267 - RNA, 64 nt, Homo Sapiens
caaaaagacuaaagcccuaucagcucuuaaaagaaaaaaaaaagguacuaggaauucagaugau

SEQ ID NO: 32268 - RNA, 64 nt, Homo Sapiens
gcaaaaagacuaaagcccuaucagcucuuaaaagaaaaaaaaaaaguacuaggaauucagauga

SEQ ID NO: 32269 - RNA, 64 nt, Homo Sapiens
uacuugcaaguacuaggaaucagaaaaggaaaaaaaaaaaaauuaccaccuaaugguaggugga

SEQ ID NO: 32270 - RNA, 64 nt, Homo Sapiens
uuacuugcaaguacuaggaaacagaaaaggaaaaaaaaaaaaauaaccaccuaaugguaggugg

SEQ ID NO: 32271 - RNA, 64 nt, Homo Sapiens
uuuacuugcaaguacuaggagacagaaaaggaaaaaaaaaaaaagaaccaccuaaugguaggug

SEQ ID NO: 32272 - RNA, 64 nt, Homo Sapiens
auuuacuugcaaguacuaggggacagaaaaggaaaaaaaaaaaaggaaccaccuaaugguaggu

SEQ ID NO: 32273 - RNA, 64 nt, Homo Sapiens
aauuuacuugcaaguacuaguggacagaaaaggaaaaaaaaaaaaggaaccaccuaaugguagg

SEQ ID NO: 32274 - RNA, 64 nt, Homo Sapiens
aaauuuacuugcaaguacuaguggacagaaaaggaaaaaaaaaauaggaaccaccuaaugguag

SEQ ID NO: 32275 - RNA, 64 nt, Homo Sapiens
caaaaaaauucuuauggcggucgauguuuuuuuaaaaaaaaauggagauguagcgauguaagug

SEQ ID NO: 32276 - RNA, 64 nt, Homo Sapiens
gcaaaaaaauucuuauggcggucgauguuuuuuuaaaaaaaaauagagauguagcgauguaagu

SEQ ID NO: 32277 - RNA, 64 nt, Homo Sapiens
agcacaucccuuuacuuacuugucaucuacaauuaaaaaaaauuaggggaauuaugugugugaa

SEQ ID NO: 32278 - RNA, 64 nt, Homo Sapiens
uuuaaacuggccuuuauuacuaaacuuuuuuuaaaaaaaaaaucuaaucuuuuuaaaaaagguu

SEQ ID NO: 32279 - RNA, 64 nt, Homo Sapiens
cuuuaaacuggccuuuauuauuaaacuuuuuuuaaaaaaaaaauuuaaucuuuuuaaaaaaggu

SEQ ID NO: 32280 - RNA, 64 nt, Homo Sapiens
ucuuuaaacuggccuuuauuuuuaaacuuuuuuuaaaaaaaaaauuuaaucuuuuuaaaaaagg

SEQ ID NO: 32281 - RNA, 64 nt, Homo Sapiens
agugugaaguuuacaguuagaauacuaacugggaaaaaaaaacuuuaaaaauuuucuaaauauu

SEQ ID NO: 32282 - RNA, 64 nt, Homo Sapiens
uagugugaaguuuacaguuauaauacuaacugggaaaaaaaaacauuaaaaauuuucuaaauau

SEQ ID NO: 32283 - RNA, 64 nt, Homo Sapiens
agagagauggcaguauugaccauuuaguuuaguuaaaaaaaaaaaaaaaaagguggcaggagag

SEQ ID NO: 32284 - RNA, 64 nt, Homo Sapiens
gagagauggcaguauugaccauuuaguuuaguuaaaaaaaaaaaaaaaaagguggcaggagagg

SEQ ID NO: 32285 - RNA, 64 nt, Homo Sapiens
agagauggcaguauugaccauuuaguuuaguuaaaaaaaaaaaaaaaaagguggcaggagaggc

SEQ ID NO: 32286 - RNA, 64 nt, Homo Sapiens
gagauggcaguauugaccauuuaguuuaguuaaaaaaaaaaaaaaaaagguggcaggagaggcu

SEQ ID NO: 32287 - RNA, 64 nt, Homo Sapiens
agauggcaguauugaccauuuaguuuaguuaaaaaaaaaaaaaaaaagguggcaggagaggcuu

SEQ ID NO: 32288 - RNA, 64 nt, Homo Sapiens
gauggcaguauugaccauuuaguuuaguuaaaaaaaaaaaaaaaaagguggcaggagaggcuuu

SEQ ID NO: 32289 - RNA, 64 nt, Homo Sapiens
auggcaguauugaccauuuaguuuaguuaaaaaaaaaaaaaaaaagguggcaggagaggcuuug

SEQ ID NO: 32290 - RNA, 64 nt, Homo Sapiens
uggcaguauugaccauuuaguuuaguuaaaaaaaaaaaaaaaaagguggcaggagaggcuuugg

SEQ ID NO: 32291 - RNA, 64 nt, Homo Sapiens
ggcaguauugaccauuuaguuuaguuaaaaaaaaaaaaaaaaagguggcaggagaggcuuuggg

SEQ ID NO: 32292 - RNA, 64 nt, Homo Sapiens
gcaguauugaccauuuaguuuaguuaaaaaaaaaaaaaaaaagguggcaggagaggcuuugggg

SEQ ID NO: 32293 - RNA, 64 nt, Homo Sapiens
uuguuuuuguucuuuguguuuuagggugaaacuuaaaaaaaaaauucugcccccaccuagauca

SEQ ID NO: 32294 - RNA, 64 nt, Homo Sapiens
uguuuuuguucuuuguguuuuagggugaaacuuaaaaaaaaaauucugcccccaccuagaucau

SEQ ID NO: 32295 - RNA, 64 nt, Homo Sapiens
guuuuuguucuuuguguuuuagggugaaacuuaaaaaaaaaauucugcccccaccuagaucaua

SEQ ID NO: 32296 - RNA, 64 nt, Homo Sapiens
ucccuuguaaaauauuugucugucucuuuuuuuuaaaaaaaaaaaaggccgggcacuguggcuc

SEQ ID NO: 32297 - RNA, 64 nt, Homo Sapiens
cccuuguaaaauauuugucugucucuuuuuuuuaaaaaaaaaaaaggccgggcacuguggcuca

SEQ ID NO: 32298 - RNA, 64 nt, Homo Sapiens
ccuuguaaaauauuugucugucucuuuuuuuuaaaaaaaaaaaaggccgggcacuguggcucac

SEQ ID NO: 32299 - RNA, 64 nt, Homo Sapiens
cuuguaaaauauuugucugucucuuuuuuuuaaaaaaaaaaaaggccgggcacuguggcucacg

SEQ ID NO: 32300 - RNA, 64 nt, Homo Sapiens
uuguaaaauauuugucugucucuuuuuuuuaaaaaaaaaaaaggccgggcacuguggcucacgc

SEQ ID NO: 32301 - RNA, 64 nt, Homo Sapiens
uugguggggaagggaaggguauauagauuguauuaaaaaaaaaaagguauauaugcauauaucu

SEQ ID NO: 32302 - RNA, 64 nt, Homo Sapiens
ugguggggaagggaaggguauauagauuguauuaaaaaaaaaaagguauauaugcauauaucua

SEQ ID NO: 32303 - RNA, 64 nt, Homo Sapiens
gguggggaagggaaggguauauagauuguauuaaaaaaaaaaagguauauaugcauauaucuau

SEQ ID NO: 32304 - RNA, 64 nt, Homo Sapiens
guggggaagggaaggguauauagauuguauuaaaaaaaaaaagguauauaugcauauaucuaua

SEQ ID NO: 32305 - RNA, 64 nt, Homo Sapiens
uuguugucauuguuuuuuugcaugcuuucuuaauaaaaaaaaaaaaagaauguuuacaguuuua

SEQ ID NO: 32306 - RNA, 64 nt, Homo Sapiens
uguugucauuguuuuuuugcaugcuuucuuaauaaaaaaaaaaaaagaauguuuacaguuuuau

SEQ ID NO: 32307 - RNA, 64 nt, Homo Sapiens
guugucauuguuuuuuugcaugcuuucuuaauaaaaaaaaaaaaagaauguuuacaguuuuauc

SEQ ID NO: 32308 - RNA, 64 nt, Homo Sapiens
uugucauuguuuuuuugcaugcuuucuuaauaaaaaaaaaaaaagaauguuuacaguuuuaucu

SEQ ID NO: 32309 - RNA, 64 nt, Homo Sapiens
ugucauuguuuuuuugcaugcuuucuuaauaaaaaaaaaaaaagaauguuuacaguuuuaucuu

SEQ ID NO: 32310 - RNA, 64 nt, Homo Sapiens
gucauuguuuuuuugcaugcuuucuuaauaaaaaaaaaaaaagaauguuuacaguuuuaucuua

SEQ ID NO: 32311 - RNA, 64 nt, Homo Sapiens
uccagccugggagauagagcaagacuccaucucuaaaaaaaaaaaaaaaugcuaaugugagaau

SEQ ID NO: 32312 - RNA, 64 nt, Homo Sapiens
ccagccugggagauagagcaagacuccaucucuaaaaaaaaaaaaaaaugcuaaugugagaaua

SEQ ID NO: 32313 - RNA, 64 nt, Homo Sapiens
cagccugggagauagagcaagacuccaucucuaaaaaaaaaaaaaaaugcuaaugugagaauau

SEQ ID NO: 32314 - RNA, 64 nt, Homo Sapiens
agccugggagauagagcaagacuccaucucuaaaaaaaaaaaaaaaugcuaaugugagaauaua

SEQ ID NO: 32315 - RNA, 64 nt, Homo Sapiens
gccugggagauagagcaagacuccaucucuaaaaaaaaaaaaaaaugcuaaugugagaauauaa

SEQ ID NO: 32316 - RNA, 64 nt, Homo Sapiens
ccugggagauagagcaagacuccaucucuaaaaaaaaaaaaaaaugcuaaugugagaauauaaa

SEQ ID NO: 32317 - RNA, 64 nt, Homo Sapiens
cugggagauagagcaagacuccaucucuaaaaaaaaaaaaaaaugcuaaugugagaauauaaau

SEQ ID NO: 32318 - RNA, 64 nt, Homo Sapiens
ugggagauagagcaagacuccaucucuaaaaaaaaaaaaaaaugcuaaugugagaauauaaauu

SEQ ID NO: 32319 - RNA, 64 nt, Homo Sapiens
aauugaugacuuuauaaugcaaccaggaguauugaaaaaaaaguaagcaaugagcucaaauaau

SEQ ID NO: 32320 - RNA, 64 nt, Homo Sapiens
augcugaaaagaagagaaauaccccaaguucuugaaaaaaaauuuuuugauaugacuacucuaa

SEQ ID NO: 32321 - RNA, 64 nt, Homo Sapiens
cauuauuuguuuuggauaaugaagucagcagaggaaaaaaaaauaugaccaucucaaaagaugc

SEQ ID NO: 32322 - RNA, 64 nt, Homo Sapiens
auuauuuguuuuggauaaugaagucagcagaggaaaaaaaaauaugaccaucucaaaagaugcc

SEQ ID NO: 32323 - RNA, 64 nt, Homo Sapiens
caggucuguuccuguuacuguugggucuuggcugaaaaaaaaaaaugcuuuuaaaaaagauaaa

SEQ ID NO: 32324 - RNA, 64 nt, Homo Sapiens
aggucuguuccuguuacuguugggucuuggcugaaaaaaaaaaaugcuuuuaaaaaagauaaaa

SEQ ID NO: 32325 - RNA, 64 nt, Homo Sapiens
ggucuguuccuguuacuguugggucuuggcugaaaaaaaaaaaugcuuuuaaaaaagauaaaau

SEQ ID NO: 32326 - RNA, 64 nt, Homo Sapiens
gucuguuccuguuacuguugggucuuggcugaaaaaaaaaaaugcuuuuaaaaaagauaaaaug

SEQ ID NO: 32327 - RNA, 64 nt, Homo Sapiens
acacacacacacauacacaaauauuccaggauacaaaaaaaaacauuuaaaaauccgagaccca

SEQ ID NO: 32328 - RNA, 64 nt, Homo Sapiens
cacacacacacauacacaaauauuccaggauacaaaaaaaaacauuuaaaaauccgagacccag

SEQ ID NO: 32329 - RNA, 64 nt, Homo Sapiens
gcuuaaacacaaauguuacugcuuaucuuuucuuaaaaaaaaaaaaaacaaaguguagguauuu

SEQ ID NO: 32330 - RNA, 64 nt, Homo Sapiens
cuuaaacacaaauguuacugcuuaucuuuucuuaaaaaaaaaaaaaacaaaguguagguauuuu

SEQ ID NO: 32331 - RNA, 64 nt, Homo Sapiens
uuaaacacaaauguuacugcuuaucuuuucuuaaaaaaaaaaaaaacaaaguguagguauuuug

SEQ ID NO: 32332 - RNA, 64 nt, Homo Sapiens
uaaacacaaauguuacugcuuaucuuuucuuaaaaaaaaaaaaaacaaaguguagguauuuuga

SEQ ID NO: 32333 - RNA, 64 nt, Homo Sapiens
aaacacaaauguuacugcuuaucuuuucuuaaaaaaaaaaaaaacaaaguguagguauuuugaa

SEQ ID NO: 32334 - RNA, 64 nt, Homo Sapiens
aacacaaauguuacugcuuaucuuuucuuaaaaaaaaaaaaaacaaaguguagguauuuugaag

SEQ ID NO: 32335 - RNA, 64 nt, Homo Sapiens
acacaaauguuacugcuuaucuuuucuuaaaaaaaaaaaaaacaaaguguagguauuuugaagu

SEQ ID NO: 32336 - RNA, 64 nt, Homo Sapiens
uaaacugacugugguuucuuaagaacaugacacuaaaaaaaaaguguuuuuuuuccaccguugc

SEQ ID NO: 32337 - RNA, 64 nt, Homo Sapiens
aaacugacugugguuucuuaagaacaugacacuaaaaaaaaaguguuuuuuuuccaccguugcu

SEQ ID NO: 32338 - RNA, 64 nt, Homo Sapiens
cuccagccuggguaacagagugagacuccaucucaaaaaaaaaaaaaauagauauuuuuccaaa

SEQ ID NO: 32339 - RNA, 64 nt, Homo Sapiens
uccagccuggguaacagagugagacuccaucucaaaaaaaaaaaaaauagauauuuuuccaaag

SEQ ID NO: 32340 - RNA, 64 nt, Homo Sapiens
ccagccuggguaacagagugagacuccaucucaaaaaaaaaaaaaauagauauuuuuccaaaga

SEQ ID NO: 32341 - RNA, 64 nt, Homo Sapiens
cagccuggguaacagagugagacuccaucucaaaaaaaaaaaaaauagauauuuuuccaaagaa

SEQ ID NO: 32342 - RNA, 64 nt, Homo Sapiens
agccuggguaacagagugagacuccaucucaaaaaaaaaaaaaauagauauuuuuccaaagaag

SEQ ID NO: 32343 - RNA, 64 nt, Homo Sapiens
gccuggguaacagagugagacuccaucucaaaaaaaaaaaaaauagauauuuuuccaaagaaga

SEQ ID NO: 32344 - RNA, 64 nt, Homo Sapiens
ccuggguaacagagugagacuccaucucaaaaaaaaaaaaaauagauauuuuuccaaagaagac

SEQ ID NO: 32345 - RNA, 64 nt, Homo Sapiens
aaguagcacauggaguagcugagguuaaacaaacaaaaaaaaauuuuaaacaaagaaaggaaaa

SEQ ID NO: 32346 - RNA, 64 nt, Homo Sapiens
aguagcacauggaguagcugagguuaaacaaacaaaaaaaaauuuuaaacaaagaaaggaaaaa

SEQ ID NO: 32347 - RNA, 64 nt, Homo Sapiens
agauucuuucuucugaaagccaagcaccacaaggaaaaaaaaaauuauuaauagcucagguuaa

SEQ ID NO: 32348 - RNA, 64 nt, Homo Sapiens
gauucuuucuucugaaagccaagcaccacaaggaaaaaaaaaauuauuaauagcucagguuaaa

SEQ ID NO: 32349 - RNA, 64 nt, Homo Sapiens
auucuuucuucugaaagccaagcaccacaaggaaaaaaaaaauuauuaauagcucagguuaaaa

SEQ ID NO: 32350 - RNA, 64 nt, Homo Sapiens
ccuuuuuuuuuuccuuuaaguauucuugagauacaaaaaaaaaaaguaaauacaauuucaaaaa

SEQ ID NO: 32351 - RNA, 64 nt, Homo Sapiens
cuuuuuuuuuuccuuuaaguauucuugagauacaaaaaaaaaaaguaaauacaauuucaaaaaa

SEQ ID NO: 32352 - RNA, 64 nt, Homo Sapiens
uuuuuuuuuuccuuuaaguauucuugagauacaaaaaaaaaaaguaaauacaauuucaaaaaaa

SEQ ID NO: 32353 - RNA, 64 nt, Homo Sapiens
uuuuuuuuuccuuuaaguauucuugagauacaaaaaaaaaaaguaaauacaauuucaaaaaaaa

SEQ ID NO: 32354 - RNA, 64 nt, Homo Sapiens
uugagauacaaaaaaaaaaaguaaauacaauuucaaaaaaaaaguuccggaucuguuuuuaagc

SEQ ID NO: 32355 - RNA, 64 nt, Homo Sapiens
ugagauacaaaaaaaaaaaguaaauacaauuucaaaaaaaaaguuccggaucuguuuuuaagcu

SEQ ID NO: 32356 - RNA, 64 nt, Homo Sapiens
gcaugugccucacuuuaagaaaguccuguaggggaaaaaaaaaacugucagagcgaauucaugc

SEQ ID NO: 32357 - RNA, 64 nt, Homo Sapiens
caugugccucacuuuaagaaaguccuguaggggaaaaaaaaaacugucagagcgaauucaugca

SEQ ID NO: 32358 - RNA, 64 nt, Homo Sapiens
augugccucacuuuaagaaaguccuguaggggaaaaaaaaaacugucagagcgaauucaugcau

SEQ ID NO: 32359 - RNA, 64 nt, Homo Sapiens
uccagccugggcgacagugcaagacucugucuccaaaaaaaaaaaaagaaaaaagaaaaucccc

SEQ ID NO: 32360 - RNA, 64 nt, Homo Sapiens
ccagccugggcgacagugcaagacucugucuccaaaaaaaaaaaaagaaaaaagaaaauccccc

SEQ ID NO: 32361 - RNA, 64 nt, Homo Sapiens
cagccugggcgacagugcaagacucugucuccaaaaaaaaaaaaagaaaaaagaaaaucccccu

SEQ ID NO: 32362 - RNA, 64 nt, Homo Sapiens
agccugggcgacagugcaagacucugucuccaaaaaaaaaaaaagaaaaaagaaaaucccccuu

SEQ ID NO: 32363 - RNA, 64 nt, Homo Sapiens
gccugggcgacagugcaagacucugucuccaaaaaaaaaaaaagaaaaaagaaaaucccccuuc

SEQ ID NO: 32364 - RNA, 64 nt, Homo Sapiens
ccugggcgacagugcaagacucugucuccaaaaaaaaaaaaagaaaaaagaaaaucccccuuca

SEQ ID NO: 32365 - RNA, 64 nt, Homo Sapiens
gaugagaccuaccuuccaguugucagcaagcaggaaaaaaaaauugggaccucaguugcaacca

SEQ ID NO: 32366 - RNA, 64 nt, Homo Sapiens
augagaccuaccuuccaguugucagcaagcaggaaaaaaaaauugggaccucaguugcaaccac

SEQ ID NO: 32367 - RNA, 64 nt, Homo Sapiens
guucucuguuuaaaaaaaucuaaaaagaaaaaggaaaaaaaaaaaagaacugcugugggauugu

SEQ ID NO: 32368 - RNA, 64 nt, Homo Sapiens
uucucuguuuaaaaaaaucuaaaaagaaaaaggaaaaaaaaaaaagaacugcugugggauuguc

SEQ ID NO: 32369 - RNA, 64 nt, Homo Sapiens
ucucuguuuaaaaaaaucuaaaaagaaaaaggaaaaaaaaaaaagaacugcugugggauuguca

SEQ ID NO: 32370 - RNA, 64 nt, Homo Sapiens
cucuguuuaaaaaaaucuaaaaagaaaaaggaaaaaaaaaaaagaacugcugugggauugucaa

SEQ ID NO: 32371 - RNA, 64 nt, Homo Sapiens
ucuguuuaaaaaaaucuaaaaagaaaaaggaaaaaaaaaaaagaacugcugugggauugucaac

SEQ ID NO: 32372 - RNA, 64 nt, Homo Sapiens
aagucuaugagaaaguagcauuuaauuaaaguuuaaaaaaaaaaagguugggcguuguggcuca

SEQ ID NO: 32373 - RNA, 64 nt, Homo Sapiens
agucuaugagaaaguagcauuuaauuaaaguuuaaaaaaaaaaagguugggcguuguggcucau

SEQ ID NO: 32374 - RNA, 64 nt, Homo Sapiens
gucuaugagaaaguagcauuuaauuaaaguuuaaaaaaaaaaagguugggcguuguggcucaug

SEQ ID NO: 32375 - RNA, 64 nt, Homo Sapiens
ucuaugagaaaguagcauuuaauuaaaguuuaaaaaaaaaaagguugggcguuguggcucaugc

SEQ ID NO: 32376 - RNA, 64 nt, Homo Sapiens
ccccugccucuaccuguccccaaauuuuuauauuaaaaaaaaaaaauaaaauaaacuacuuugg

SEQ ID NO: 32377 - RNA, 64 nt, Homo Sapiens
cccugccucuaccuguccccaaauuuuuauauuaaaaaaaaaaaauaaaauaaacuacuuugga

SEQ ID NO: 32378 - RNA, 64 nt, Homo Sapiens
ccugccucuaccuguccccaaauuuuuauauuaaaaaaaaaaaauaaaauaaacuacuuuggaa

SEQ ID NO: 32379 - RNA, 64 nt, Homo Sapiens
cugccucuaccuguccccaaauuuuuauauuaaaaaaaaaaaauaaaauaaacuacuuuggaac

SEQ ID NO: 32380 - RNA, 64 nt, Homo Sapiens
ugccucuaccuguccccaaauuuuuauauuaaaaaaaaaaaauaaaauaaacuacuuuggaacc

SEQ ID NO: 32381 - RNA, 64 nt, Homo Sapiens
accucucaaucuauuuguuuuuaaagaaaucccuaaaaaaaaaaauuauccaauugaacgcaca

SEQ ID NO: 32382 - RNA, 64 nt, Homo Sapiens
ccucucaaucuauuuguuuuuaaagaaaucccuaaaaaaaaaaauuauccaauugaacgcacau

SEQ ID NO: 32383 - RNA, 64 nt, Homo Sapiens
cucucaaucuauuuguuuuuaaagaaaucccuaaaaaaaaaaauuauccaauugaacgcacaua

SEQ ID NO: 32384 - RNA, 64 nt, Homo Sapiens
ucucaaucuauuuguuuuuaaagaaaucccuaaaaaaaaaaauuauccaauugaacgcacauag

SEQ ID NO: 32385 - RNA, 64 nt, Homo Sapiens
guuguaucuuuugcauguagcuuccuuaauggagaaaaaaaaaccuaauaaauuuccagaauca

SEQ ID NO: 32386 - RNA, 64 nt, Homo Sapiens
uuguaucuuuugcauguagcuuccuuaauggagaaaaaaaaaccuaauaaauuuccagaaucau

SEQ ID NO: 32387 - RNA, 64 nt, Homo Sapiens
cgggccuggggcgcucugcgugcagauuuuguacaaaaaaaaaaaagacacacacacauacaug

SEQ ID NO: 32388 - RNA, 64 nt, Homo Sapiens
gggccuggggcgcucugcgugcagauuuuguacaaaaaaaaaaaagacacacacacauacauga

SEQ ID NO: 32389 - RNA, 64 nt, Homo Sapiens
ggccuggggcgcucugcgugcagauuuuguacaaaaaaaaaaaagacacacacacauacaugau

SEQ ID NO: 32390 - RNA, 64 nt, Homo Sapiens
gccuggggcgcucugcgugcagauuuuguacaaaaaaaaaaaagacacacacacauacaugaua

SEQ ID NO: 32391 - RNA, 64 nt, Homo Sapiens
ccuggggcgcucugcgugcagauuuuguacaaaaaaaaaaaagacacacacacauacaugauaa

SEQ ID NO: 32392 - RNA, 64 nt, Homo Sapiens
cuauaggagaaaaaaagagaaaaaaauaaaaaucaaaaaaaaaaaaaagaaagaaagaaaccuc

SEQ ID NO: 32393 - RNA, 64 nt, Homo Sapiens
uauaggagaaaaaaagagaaaaaaauaaaaaucaaaaaaaaaaaaaagaaagaaagaaaccucc

SEQ ID NO: 32394 - RNA, 64 nt, Homo Sapiens
auaggagaaaaaaagagaaaaaaauaaaaaucaaaaaaaaaaaaaagaaagaaagaaaccucca

SEQ ID NO: 32395 - RNA, 64 nt, Homo Sapiens
uaggagaaaaaaagagaaaaaaauaaaaaucaaaaaaaaaaaaaagaaagaaagaaaccuccag

SEQ ID NO: 32396 - RNA, 64 nt, Homo Sapiens
aggagaaaaaaagagaaaaaaauaaaaaucaaaaaaaaaaaaaagaaagaaagaaaccuccagc

SEQ ID NO: 32397 - RNA, 64 nt, Homo Sapiens
ggagaaaaaaagagaaaaaaauaaaaaucaaaaaaaaaaaaaagaaagaaagaaaccuccagcg

SEQ ID NO: 32398 - RNA, 64 nt, Homo Sapiens
gagaaaaaaagagaaaaaaauaaaaaucaaaaaaaaaaaaaagaaagaaagaaaccuccagcgu

SEQ ID NO: 32399 - RNA, 64 nt, Homo Sapiens
aaauagucauguacauacaaauaugaacaaacuuaaaaaaaaaauacaaacccuuggaucacau

SEQ ID NO: 32400 - RNA, 64 nt, Homo Sapiens
aauagucauguacauacaaauaugaacaaacuuaaaaaaaaaauacaaacccuuggaucacaug

SEQ ID NO: 32401 - RNA, 64 nt, Homo Sapiens
auagucauguacauacaaauaugaacaaacuuaaaaaaaaaauacaaacccuuggaucacaugg

SEQ ID NO: 32402 - RNA, 64 nt, Homo Sapiens
caugugcaccuugggguuuuguaaugacagugcuaaaaaaaaaaagcauuuuuuuuuuaugauu

SEQ ID NO: 32403 - RNA, 64 nt, Homo Sapiens
augugcaccuugggguuuuguaaugacagugcuaaaaaaaaaaagcauuuuuuuuuuaugauuu

SEQ ID NO: 32404 - RNA, 64 nt, Homo Sapiens
ugugcaccuugggguuuuguaaugacagugcuaaaaaaaaaaagcauuuuuuuuuuaugauuug

SEQ ID NO: 32405 - RNA, 64 nt, Homo Sapiens
gugcaccuugggguuuuguaaugacagugcuaaaaaaaaaaagcauuuuuuuuuuaugauuugu

SEQ ID NO: 32406 - RNA, 64 nt, Homo Sapiens
auucaaaccaaaggcuguuuuucuauguuuaaagaaaaaaaaaaguaaaaaccaaacacaacac

SEQ ID NO: 32407 - RNA, 64 nt, Homo Sapiens
uucaaaccaaaggcuguuuuucuauguuuaaagaaaaaaaaaaguaaaaaccaaacacaacacc

SEQ ID NO: 32408 - RNA, 64 nt, Homo Sapiens
ucaaaccaaaggcuguuuuucuauguuuaaagaaaaaaaaaaguaaaaaccaaacacaacaccu

SEQ ID NO: 32409 - RNA, 64 nt, Homo Sapiens
agcuuagccaacauaguaagacccccaucucuuuaaaaaaaaaaaaaaaaaaaaaaaaaaaacu

SEQ ID NO: 32410 - RNA, 64 nt, Homo Sapiens
gcuuagccaacauaguaagacccccaucucuuuaaaaaaaaaaaaaaaaaaaaaaaaaaaacuu

SEQ ID NO: 32411 - RNA, 64 nt, Homo Sapiens
cuuagccaacauaguaagacccccaucucuuuaaaaaaaaaaaaaaaaaaaaaaaaaaaacuuu

SEQ ID NO: 32412 - RNA, 64 nt, Homo Sapiens
uuagccaacauaguaagacccccaucucuuuaaaaaaaaaaaaaaaaaaaaaaaaaaaacuuua

SEQ ID NO: 32413 - RNA, 64 nt, Homo Sapiens
uagccaacauaguaagacccccaucucuuuaaaaaaaaaaaaaaaaaaaaaaaaaaaacuuuag

SEQ ID NO: 32414 - RNA, 64 nt, Homo Sapiens
agccaacauaguaagacccccaucucuuuaaaaaaaaaaaaaaaaaaaaaaaaaaaacuuuaga

SEQ ID NO: 32415 - RNA, 64 nt, Homo Sapiens
gccaacauaguaagacccccaucucuuuaaaaaaaaaaaaaaaaaaaaaaaaaaaacuuuagaa

SEQ ID NO: 32416 - RNA, 64 nt, Homo Sapiens
ccaacauaguaagacccccaucucuuuaaaaaaaaaaaaaaaaaaaaaaaaaaaacuuuagaac

SEQ ID NO: 32417 - RNA, 64 nt, Homo Sapiens
caacauaguaagacccccaucucuuuaaaaaaaaaaaaaaaaaaaaaaaaaaaacuuuagaacu

SEQ ID NO: 32418 - RNA, 64 nt, Homo Sapiens
aacauaguaagacccccaucucuuuaaaaaaaaaaaaaaaaaaaaaaaaaaaacuuuagaacug

SEQ ID NO: 32419 - RNA, 64 nt, Homo Sapiens
acauaguaagacccccaucucuuuaaaaaaaaaaaaaaaaaaaaaaaaaaaacuuuagaacugg

SEQ ID NO: 32420 - RNA, 64 nt, Homo Sapiens
cauaguaagacccccaucucuuuaaaaaaaaaaaaaaaaaaaaaaaaaaaacuuuagaacuggg

SEQ ID NO: 32421 - RNA, 64 nt, Homo Sapiens
auaguaagacccccaucucuuuaaaaaaaaaaaaaaaaaaaaaaaaaaaacuuuagaacugggu

SEQ ID NO: 32422 - RNA, 64 nt, Homo Sapiens
uaguaagacccccaucucuuuaaaaaaaaaaaaaaaaaaaaaaaaaaaacuuuagaacugggug

SEQ ID NO: 32423 - RNA, 64 nt, Homo Sapiens
aguaagacccccaucucuuuaaaaaaaaaaaaaaaaaaaaaaaaaaaacuuuagaacugggugc

SEQ ID NO: 32424 - RNA, 64 nt, Homo Sapiens
guaagacccccaucucuuuaaaaaaaaaaaaaaaaaaaaaaaaaaaacuuuagaacugggugca

SEQ ID NO: 32425 - RNA, 64 nt, Homo Sapiens
uaagacccccaucucuuuaaaaaaaaaaaaaaaaaaaaaaaaaaaacuuuagaacugggugcag

SEQ ID NO: 32426 - RNA, 64 nt, Homo Sapiens
aagacccccaucucuuuaaaaaaaaaaaaaaaaaaaaaaaaaaaacuuuagaacugggugcagu

SEQ ID NO: 32427 - RNA, 64 nt, Homo Sapiens
agacccccaucucuuuaaaaaaaaaaaaaaaaaaaaaaaaaaaacuuuagaacugggugcagug

SEQ ID NO: 32428 - RNA, 64 nt, Homo Sapiens
gacccccaucucuuuaaaaaaaaaaaaaaaaaaaaaaaaaaaacuuuagaacugggugcagugg

SEQ ID NO: 32429 - RNA, 64 nt, Homo Sapiens
acccccaucucuuuaaaaaaaaaaaaaaaaaaaaaaaaaaaacuuuagaacugggugcaguggc

SEQ ID NO: 32430 - RNA, 64 nt, Homo Sapiens
auggaaacauagcaagacacugucucuacaggggaaaaaaaaaaaagaaacugagccuuaaaga

SEQ ID NO: 32431 - RNA, 64 nt, Homo Sapiens
uggaaacauagcaagacacugucucuacaggggaaaaaaaaaaaagaaacugagccuuaaagag

SEQ ID NO: 32432 - RNA, 64 nt, Homo Sapiens
ggaaacauagcaagacacugucucuacaggggaaaaaaaaaaaagaaacugagccuuaaagaga

SEQ ID NO: 32433 - RNA, 64 nt, Homo Sapiens
gaaacauagcaagacacugucucuacaggggaaaaaaaaaaaagaaacugagccuuaaagagau

SEQ ID NO: 32434 - RNA, 64 nt, Homo Sapiens
aaacauagcaagacacugucucuacaggggaaaaaaaaaaaagaaacugagccuuaaagagaug

SEQ ID NO: 32435 - RNA, 64 nt, Homo Sapiens
cacaauggcaaagccaaacagaggaagaaacauuaaaaaaaaaaaaaagaccauuauuucuuug

SEQ ID NO: 32436 - RNA, 64 nt, Homo Sapiens
acaauggcaaagccaaacagaggaagaaacauuaaaaaaaaaaaaaagaccauuauuucuuugu

SEQ ID NO: 32437 - RNA, 64 nt, Homo Sapiens
caauggcaaagccaaacagaggaagaaacauuaaaaaaaaaaaaaagaccauuauuucuuuguu

SEQ ID NO: 32438 - RNA, 64 nt, Homo Sapiens
aauggcaaagccaaacagaggaagaaacauuaaaaaaaaaaaaaagaccauuauuucuuuguuu

SEQ ID NO: 32439 - RNA, 64 nt, Homo Sapiens
auggcaaagccaaacagaggaagaaacauuaaaaaaaaaaaaaagaccauuauuucuuuguuuu

SEQ ID NO: 32440 - RNA, 64 nt, Homo Sapiens
uggcaaagccaaacagaggaagaaacauuaaaaaaaaaaaaaagaccauuauuucuuuguuuug

SEQ ID NO: 32441 - RNA, 64 nt, Homo Sapiens
ggcaaagccaaacagaggaagaaacauuaaaaaaaaaaaaaagaccauuauuucuuuguuuugu

SEQ ID NO: 32442 - RNA, 64 nt, Homo Sapiens
auuuuuauauuacagagcuuccaucaucaugaagaaaaaaaaauuugguucucaagugaacaaa

SEQ ID NO: 32443 - RNA, 64 nt, Homo Sapiens
uuuuuauauuacagagcuuccaucaucaugaagaaaaaaaaauuugguucucaagugaacaaac

SEQ ID NO: 32444 - RNA, 64 nt, Homo Sapiens
uacacagaguaucuggagaauaaaacccaaauucaaaaaaaaaaaugauaauuuauuuuuaagg

SEQ ID NO: 32445 - RNA, 64 nt, Homo Sapiens
acacagaguaucuggagaauaaaacccaaauucaaaaaaaaaaaugauaauuuauuuuuaaggu

SEQ ID NO: 32446 - RNA, 64 nt, Homo Sapiens
cacagaguaucuggagaauaaaacccaaauucaaaaaaaaaaaugauaauuuauuuuuaaggua

SEQ ID NO: 32447 - RNA, 64 nt, Homo Sapiens
acagaguaucuggagaauaaaacccaaauucaaaaaaaaaaaugauaauuuauuuuuaagguaa

SEQ ID NO: 32448 - RNA, 64 nt, Homo Sapiens
ucuuuugcuauaguuauacaucaauuuaaaaagcaaaaaaaaaaaaggggggggcaaucucucu

SEQ ID NO: 32449 - RNA, 64 nt, Homo Sapiens
cuuuugcuauaguuauacaucaauuuaaaaagcaaaaaaaaaaaaggggggggcaaucucucuc

SEQ ID NO: 32450 - RNA, 64 nt, Homo Sapiens
uuuugcuauaguuauacaucaauuuaaaaagcaaaaaaaaaaaaggggggggcaaucucucucu

SEQ ID NO: 32451 - RNA, 64 nt, Homo Sapiens
uuugcuauaguuauacaucaauuuaaaaagcaaaaaaaaaaaaggggggggcaaucucucucug

SEQ ID NO: 32452 - RNA, 64 nt, Homo Sapiens
uugcuauaguuauacaucaauuuaaaaagcaaaaaaaaaaaaggggggggcaaucucucucugu

SEQ ID NO: 32453 - RNA, 64 nt, Homo Sapiens
ucuuaagucccaguauaccucauuuuucauacugaaaaaaaaagcuuguggccaauggaacagu

SEQ ID NO: 32454 - RNA, 64 nt, Homo Sapiens
cuuaagucccaguauaccucauuuuucauacugaaaaaaaaagcuuguggccaauggaacagua

SEQ ID NO: 32455 - RNA, 64 nt, Homo Sapiens
aagauaaaaaauauuguuaagugugcaaguuauuaaaaaaaaaaaauugggccaggcacggugg

SEQ ID NO: 32456 - RNA, 64 nt, Homo Sapiens
agauaaaaaauauuguuaagugugcaaguuauuaaaaaaaaaaaauugggccaggcacgguggc

SEQ ID NO: 32457 - RNA, 64 nt, Homo Sapiens
gauaaaaaauauuguuaagugugcaaguuauuaaaaaaaaaaaauugggccaggcacgguggcu

SEQ ID NO: 32458 - RNA, 64 nt, Homo Sapiens
auaaaaaauauuguuaagugugcaaguuauuaaaaaaaaaaaauugggccaggcacgguggcuc

SEQ ID NO: 32459 - RNA, 64 nt, Homo Sapiens
uaaaaaauauuguuaagugugcaaguuauuaaaaaaaaaaaauugggccaggcacgguggcuca

SEQ ID NO: 32460 - RNA, 64 nt, Homo Sapiens
uccagccugggcaacaagagcgaaacuccauuucaaaaaaaaaaaauuggugacagacucaaug

SEQ ID NO: 32461 - RNA, 64 nt, Homo Sapiens
ccagccugggcaacaagagcgaaacuccauuucaaaaaaaaaaaauuggugacagacucaauga

SEQ ID NO: 32462 - RNA, 64 nt, Homo Sapiens
cagccugggcaacaagagcgaaacuccauuucaaaaaaaaaaaauuggugacagacucaaugau

SEQ ID NO: 32463 - RNA, 64 nt, Homo Sapiens
agccugggcaacaagagcgaaacuccauuucaaaaaaaaaaaauuggugacagacucaaugaug

SEQ ID NO: 32464 - RNA, 64 nt, Homo Sapiens
gccugggcaacaagagcgaaacuccauuucaaaaaaaaaaaauuggugacagacucaaugaugg

SEQ ID NO: 32465 - RNA, 64 nt, Homo Sapiens
ccagguguacuagugaauguaauuuauaguugccaaaaaaaaaaaaaaccugaaauaaauaaau

SEQ ID NO: 32466 - RNA, 64 nt, Homo Sapiens
cagguguacuagugaauguaauuuauaguugccaaaaaaaaaaaaaaccugaaauaaauaaaug

SEQ ID NO: 32467 - RNA, 64 nt, Homo Sapiens
agguguacuagugaauguaauuuauaguugccaaaaaaaaaaaaaaccugaaauaaauaaaugu

SEQ ID NO: 32468 - RNA, 64 nt, Homo Sapiens
gguguacuagugaauguaauuuauaguugccaaaaaaaaaaaaaaccugaaauaaauaaauguu

SEQ ID NO: 32469 - RNA, 64 nt, Homo Sapiens
guguacuagugaauguaauuuauaguugccaaaaaaaaaaaaaaccugaaauaaauaaauguua

SEQ ID NO: 32470 - RNA, 64 nt, Homo Sapiens
uguacuagugaauguaauuuauaguugccaaaaaaaaaaaaaaccugaaauaaauaaauguuag

SEQ ID NO: 32471 - RNA, 64 nt, Homo Sapiens
guacuagugaauguaauuuauaguugccaaaaaaaaaaaaaaccugaaauaaauaaauguuaga

SEQ ID NO: 32472 - RNA, 64 nt, Homo Sapiens
uauuuccuuuuuuaugcuuagaacaccaggguuuaaaaaaaaaaaaaaggugaggacaucuggg

SEQ ID NO: 32473 - RNA, 64 nt, Homo Sapiens
auuuccuuuuuuaugcuuagaacaccaggguuuaaaaaaaaaaaaaaggugaggacaucugggu

SEQ ID NO: 32474 - RNA, 64 nt, Homo Sapiens
uuuccuuuuuuaugcuuagaacaccaggguuuaaaaaaaaaaaaaaggugaggacaucuggguc

SEQ ID NO: 32475 - RNA, 64 nt, Homo Sapiens
uuccuuuuuuaugcuuagaacaccaggguuuaaaaaaaaaaaaaaggugaggacaucugggucu

SEQ ID NO: 32476 - RNA, 64 nt, Homo Sapiens
uccuuuuuuaugcuuagaacaccaggguuuaaaaaaaaaaaaaaggugaggacaucugggucuc

SEQ ID NO: 32477 - RNA, 64 nt, Homo Sapiens
ccuuuuuuaugcuuagaacaccaggguuuaaaaaaaaaaaaaaggugaggacaucugggucuca

SEQ ID NO: 32478 - RNA, 64 nt, Homo Sapiens
cuuuuuuaugcuuagaacaccaggguuuaaaaaaaaaaaaaaggugaggacaucugggucucau

SEQ ID NO: 32479 - RNA, 64 nt, Homo Sapiens
gaacuauaaccuuaggauuccugaaaagaauuucaaaaaaaaaauaaagacacuguugccaaug

SEQ ID NO: 32480 - RNA, 64 nt, Homo Sapiens
aacuauaaccuuaggauuccugaaaagaauuucaaaaaaaaaauaaagacacuguugccaaugu

SEQ ID NO: 32481 - RNA, 64 nt, Homo Sapiens
acuauaaccuuaggauuccugaaaagaauuucaaaaaaaaaauaaagacacuguugccaaugug

SEQ ID NO: 32482 - RNA, 64 nt, Homo Sapiens
aucaaauaaaaauggaaaaaaugaucauggcuuuaaaaaaaaaacaaaaacacacacacaugaa

SEQ ID NO: 32483 - RNA, 64 nt, Homo Sapiens
ucaaauaaaaauggaaaaaaugaucauggcuuuaaaaaaaaaacaaaaacacacacacaugaac

SEQ ID NO: 32484 - RNA, 64 nt, Homo Sapiens
caaauaaaaauggaaaaaaugaucauggcuuuaaaaaaaaaacaaaaacacacacacaugaacu

SEQ ID NO: 32485 - RNA, 64 nt, Homo Sapiens
uguggucuuuuucuuuccuccuaauguugaagagaaaaaaaaaaaaaaaaguuugcccagauug

SEQ ID NO: 32486 - RNA, 64 nt, Homo Sapiens
guggucuuuuucuuuccuccuaauguugaagagaaaaaaaaaaaaaaaaguuugcccagauugc

SEQ ID NO: 32487 - RNA, 64 nt, Homo Sapiens
uggucuuuuucuuuccuccuaauguugaagagaaaaaaaaaaaaaaaaguuugcccagauugcu

SEQ ID NO: 32488 - RNA, 64 nt, Homo Sapiens
ggucuuuuucuuuccuccuaauguugaagagaaaaaaaaaaaaaaaaguuugcccagauugcuu

SEQ ID NO: 32489 - RNA, 64 nt, Homo Sapiens
gucuuuuucuuuccuccuaauguugaagagaaaaaaaaaaaaaaaaguuugcccagauugcuua

SEQ ID NO: 32490 - RNA, 64 nt, Homo Sapiens
ucuuuuucuuuccuccuaauguugaagagaaaaaaaaaaaaaaaaguuugcccagauugcuuaa

SEQ ID NO: 32491 - RNA, 64 nt, Homo Sapiens
cuuuuucuuuccuccuaauguugaagagaaaaaaaaaaaaaaaaguuugcccagauugcuuaau

SEQ ID NO: 32492 - RNA, 64 nt, Homo Sapiens
uuuuucuuuccuccuaauguugaagagaaaaaaaaaaaaaaaaguuugcccagauugcuuaauu

SEQ ID NO: 32493 - RNA, 64 nt, Homo Sapiens
uuuucuuuccuccuaauguugaagagaaaaaaaaaaaaaaaaguuugcccagauugcuuaauua

SEQ ID NO: 32494 - RNA, 64 nt, Homo Sapiens
gucaguggcguugggagggggagaaaaggaaaagaaaaaaaaaagaagaagaagaagaaaagag

SEQ ID NO: 32495 - RNA, 64 nt, Homo Sapiens
ucaguggcguugggagggggagaaaaggaaaagaaaaaaaaaagaagaagaagaagaaaagaga

SEQ ID NO: 32496 - RNA, 64 nt, Homo Sapiens
caguggcguugggagggggagaaaaggaaaagaaaaaaaaaagaagaagaagaagaaaagagaa

SEQ ID NO: 32497 - RNA, 64 nt, Homo Sapiens
uuaaaaguuuuucugguagcuuuagcuuuaugcuaaaaaaaauaaugacauuggguaucuauuu

SEQ ID NO: 32498 - RNA, 64 nt, Homo Sapiens
cuaaguuccauguauuuuuguuacaaaucuucugaaaaaaaacaaaacaaugugaaacauuaaa

SEQ ID NO: 32499 - RNA, 64 nt, Homo Sapiens
gaauucccuugcguauucucucucuaaaacaaccaaaaaaaaauggagaggcuuuuuauauacu

SEQ ID NO: 32500 - RNA, 64 nt, Homo Sapiens
aauucccuugcguauucucucucuaaaacaaccaaaaaaaaauggagaggcuuuuuauauacuc

SEQ ID NO: 32501 - RNA, 64 nt, Homo Sapiens
ugcaguuagacgggguuacgggggcuaaaagcagaaaaaaaauuccauuucaucgggauggaac

SEQ ID NO: 32502 - RNA, 64 nt, Homo Sapiens
uaugugaucaguuuaauaguaacuuuauuuauuuaaaaaaaagaaacacaauuaguuacuguua

SEQ ID NO: 32503 - RNA, 64 nt, Homo Sapiens
uuuuaggggugggaacuuuuuuaaauguucauuuaaaaaaaaacaaaaacagggcagucuugua

SEQ ID NO: 32504 - RNA, 64 nt, Homo Sapiens
uuuaggggugggaacuuuuuuaaauguucauuuaaaaaaaaacaaaaacagggcagucuuguag

SEQ ID NO: 32505 - RNA, 64 nt, Homo Sapiens
aaauccucagugacaaaggcuguccugagguaggaaaaaaaaaaagaaacagcauuucuagaaa

SEQ ID NO: 32506 - RNA, 64 nt, Homo Sapiens
aauccucagugacaaaggcuguccugagguaggaaaaaaaaaaagaaacagcauuucuagaaac

SEQ ID NO: 32507 - RNA, 64 nt, Homo Sapiens
auccucagugacaaaggcuguccugagguaggaaaaaaaaaaagaaacagcauuucuagaaacc

SEQ ID NO: 32508 - RNA, 64 nt, Homo Sapiens
uccucagugacaaaggcuguccugagguaggaaaaaaaaaaagaaacagcauuucuagaaaccu

SEQ ID NO: 32509 - RNA, 64 nt, Homo Sapiens
cuccagccuggguggcaaagugagacucuggcucaaaaaaaaaaacaaaaaacaaaaccaucug

SEQ ID NO: 32510 - RNA, 64 nt, Homo Sapiens
uccagccuggguggcaaagugagacucuggcucaaaaaaaaaaacaaaaaacaaaaccaucugc

SEQ ID NO: 32511 - RNA, 64 nt, Homo Sapiens
ccagccuggguggcaaagugagacucuggcucaaaaaaaaaaacaaaaaacaaaaccaucugcc

SEQ ID NO: 32512 - RNA, 64 nt, Homo Sapiens
cagccuggguggcaaagugagacucuggcucaaaaaaaaaaacaaaaaacaaaaccaucugccc

SEQ ID NO: 32513 - RNA, 64 nt, Homo Sapiens
cugggaugauggagaaagcucgaggugaaguuuuaaaaaaaaaguuguggaaaggaaaguucca

SEQ ID NO: 32514 - RNA, 64 nt, Homo Sapiens
ugggaugauggagaaagcucgaggugaaguuuuaaaaaaaaaguuguggaaaggaaaguuccaa

SEQ ID NO: 32515 - RNA, 64 nt, Homo Sapiens
aaagaauuaucuggcacauuagguauuggaguuuaaaaaaaaagccaaauuucacagucuuaau

SEQ ID NO: 32516 - RNA, 64 nt, Homo Sapiens
aagaauuaucuggcacauuagguauuggaguuuaaaaaaaaagccaaauuucacagucuuaaua

SEQ ID NO: 32517 - RNA, 64 nt, Homo Sapiens
aaagccaaauuucacagucuuaauaacuuuuuuuaaaaaaaacuaaaaggcgcuucauguccag

SEQ ID NO: 32518 - RNA, 64 nt, Homo Sapiens
guguaagucacuguacccagcccaaaagcaguuuaaaaaaaaaaaagacaaaauauacaacucu

SEQ ID NO: 32519 - RNA, 64 nt, Homo Sapiens
uguaagucacuguacccagcccaaaagcaguuuaaaaaaaaaaaagacaaaauauacaacucuu

SEQ ID NO: 32520 - RNA, 64 nt, Homo Sapiens
guaagucacuguacccagcccaaaagcaguuuaaaaaaaaaaaagacaaaauauacaacucuug

SEQ ID NO: 32521 - RNA, 64 nt, Homo Sapiens
uaagucacuguacccagcccaaaagcaguuuaaaaaaaaaaaagacaaaauauacaacucuuga

SEQ ID NO: 32522 - RNA, 64 nt, Homo Sapiens
aagucacuguacccagcccaaaagcaguuuaaaaaaaaaaaagacaaaauauacaacucuugau

SEQ ID NO: 32523 - RNA, 64 nt, Homo Sapiens
gagcaaagcaucaaagaaucuuuaagggagguuuaaaaaaaaaaaaaaaaaaaaagauugguug

SEQ ID NO: 32524 - RNA, 64 nt, Homo Sapiens
agcaaagcaucaaagaaucuuuaagggagguuuaaaaaaaaaaaaaaaaaaaaagauugguugc

SEQ ID NO: 32525 - RNA, 64 nt, Homo Sapiens
gcaaagcaucaaagaaucuuuaagggagguuuaaaaaaaaaaaaaaaaaaaaagauugguugcc

SEQ ID NO: 32526 - RNA, 64 nt, Homo Sapiens
caaagcaucaaagaaucuuuaagggagguuuaaaaaaaaaaaaaaaaaaaaagauugguugccu

SEQ ID NO: 32527 - RNA, 64 nt, Homo Sapiens
aaagcaucaaagaaucuuuaagggagguuuaaaaaaaaaaaaaaaaaaaaagauugguugccuc

SEQ ID NO: 32528 - RNA, 64 nt, Homo Sapiens
aagcaucaaagaaucuuuaagggagguuuaaaaaaaaaaaaaaaaaaaaagauugguugccucu

SEQ ID NO: 32529 - RNA, 64 nt, Homo Sapiens
agcaucaaagaaucuuuaagggagguuuaaaaaaaaaaaaaaaaaaaaagauugguugccucug

SEQ ID NO: 32530 - RNA, 64 nt, Homo Sapiens
gcaucaaagaaucuuuaagggagguuuaaaaaaaaaaaaaaaaaaaaagauugguugccucugc

SEQ ID NO: 32531 - RNA, 64 nt, Homo Sapiens
caucaaagaaucuuuaagggagguuuaaaaaaaaaaaaaaaaaaaaagauugguugccucugcc

SEQ ID NO: 32532 - RNA, 64 nt, Homo Sapiens
aucaaagaaucuuuaagggagguuuaaaaaaaaaaaaaaaaaaaaagauugguugccucugccu

SEQ ID NO: 32533 - RNA, 64 nt, Homo Sapiens
ucaaagaaucuuuaagggagguuuaaaaaaaaaaaaaaaaaaaaagauugguugccucugccuu

SEQ ID NO: 32534 - RNA, 64 nt, Homo Sapiens
caaagaaucuuuaagggagguuuaaaaaaaaaaaaaaaaaaaaagauugguugccucugccuuu

SEQ ID NO: 32535 - RNA, 64 nt, Homo Sapiens
aaagaaucuuuaagggagguuuaaaaaaaaaaaaaaaaaaaaagauugguugccucugccuuug

SEQ ID NO: 32536 - RNA, 64 nt, Homo Sapiens
aagaaucuuuaagggagguuuaaaaaaaaaaaaaaaaaaaaagauugguugccucugccuuugu

SEQ ID NO: 32537 - RNA, 64 nt, Homo Sapiens
caggggaaagcacaaagcuauuucugaaauuaggaaaaaaaaaaaaaagguggaaggagcagcc

SEQ ID NO: 32538 - RNA, 64 nt, Homo Sapiens
aggggaaagcacaaagcuauuucugaaauuaggaaaaaaaaaaaaaagguggaaggagcagcca

SEQ ID NO: 32539 - RNA, 64 nt, Homo Sapiens
ggggaaagcacaaagcuauuucugaaauuaggaaaaaaaaaaaaaagguggaaggagcagccag

SEQ ID NO: 32540 - RNA, 64 nt, Homo Sapiens
gggaaagcacaaagcuauuucugaaauuaggaaaaaaaaaaaaaagguggaaggagcagccaga

SEQ ID NO: 32541 - RNA, 64 nt, Homo Sapiens
ggaaagcacaaagcuauuucugaaauuaggaaaaaaaaaaaaaagguggaaggagcagccagau

SEQ ID NO: 32542 - RNA, 64 nt, Homo Sapiens
gaaagcacaaagcuauuucugaaauuaggaaaaaaaaaaaaaagguggaaggagcagccagaug

SEQ ID NO: 32543 - RNA, 64 nt, Homo Sapiens
aaagcacaaagcuauuucugaaauuaggaaaaaaaaaaaaaagguggaaggagcagccagaugu

SEQ ID NO: 32544 - RNA, 64 nt, Homo Sapiens
gugugaagggguagaauuugugcgguaaagacuuaaaaaaaaaaguagggagauuaaaaaaaaa

SEQ ID NO: 32545 - RNA, 64 nt, Homo Sapiens
ugugaagggguagaauuugugcgguaaagacuuaaaaaaaaaaguagggagauuaaaaaaaaag

SEQ ID NO: 32546 - RNA, 64 nt, Homo Sapiens
gugaagggguagaauuugugcgguaaagacuuaaaaaaaaaaguagggagauuaaaaaaaaaga

SEQ ID NO: 32547 - RNA, 64 nt, Homo Sapiens
gcgguaaagacuuaaaaaaaaaaguagggagauuaaaaaaaaagaaagaaaaugcuuccuuauc

SEQ ID NO: 32548 - RNA, 64 nt, Homo Sapiens
cgguaaagacuuaaaaaaaaaaguagggagauuaaaaaaaaagaaagaaaaugcuuccuuaucu

SEQ ID NO: 32549 - RNA, 64 nt, Homo Sapiens
ucuccagccugggaggcacagcaaacugucccccaaaaaaaaaaaagaguccuuaccaauagca

SEQ ID NO: 32550 - RNA, 64 nt, Homo Sapiens
cuccagccugggaggcacagcaaacugucccccaaaaaaaaaaaagaguccuuaccaauagcag

SEQ ID NO: 32551 - RNA, 64 nt, Homo Sapiens
uccagccugggaggcacagcaaacugucccccaaaaaaaaaaaagaguccuuaccaauagcagg

SEQ ID NO: 32552 - RNA, 64 nt, Homo Sapiens
ccagccugggaggcacagcaaacugucccccaaaaaaaaaaaagaguccuuaccaauagcaggg

SEQ ID NO: 32553 - RNA, 64 nt, Homo Sapiens
cagccugggaggcacagcaaacugucccccaaaaaaaaaaaagaguccuuaccaauagcagggg

SEQ ID NO: 32554 - RNA, 64 nt, Homo Sapiens
cuccaggcugggugacagagcgagacuccaucucaaaaaaaaaaaaaagaaaaaaaaaaugucu

SEQ ID NO: 32555 - RNA, 64 nt, Homo Sapiens
uccaggcugggugacagagcgagacuccaucucaaaaaaaaaaaaaagaaaaaaaaaaugucug

SEQ ID NO: 32556 - RNA, 64 nt, Homo Sapiens
ccaggcugggugacagagcgagacuccaucucaaaaaaaaaaaaaagaaaaaaaaaaugucugc

SEQ ID NO: 32557 - RNA, 64 nt, Homo Sapiens
caggcugggugacagagcgagacuccaucucaaaaaaaaaaaaaagaaaaaaaaaaugucugcc

SEQ ID NO: 32558 - RNA, 64 nt, Homo Sapiens
aggcugggugacagagcgagacuccaucucaaaaaaaaaaaaaagaaaaaaaaaaugucugccu

SEQ ID NO: 32559 - RNA, 64 nt, Homo Sapiens
ggcugggugacagagcgagacuccaucucaaaaaaaaaaaaaagaaaaaaaaaaugucugccua

SEQ ID NO: 32560 - RNA, 63 nt, Homo Sapiens
gcugggugacagagcgagacuccaucucaaaaaaaaaaaaaagaaaaaaaaaaugucugccua

SEQ ID NO: 32561 - RNA, 64 nt, Homo Sapiens
aauaccucaugcaaaaugucuccugaaauaagggaaaaaaaaaaaaccacaacuuugaaaaucu

SEQ ID NO: 32562 - RNA, 64 nt, Homo Sapiens
auaccucaugcaaaaugucuccugaaauaagggaaaaaaaaaaaaccacaacuuugaaaaucuu

SEQ ID NO: 32563 - RNA, 64 nt, Homo Sapiens
uaccucaugcaaaaugucuccugaaauaagggaaaaaaaaaaaaccacaacuuugaaaaucuua

SEQ ID NO: 32564 - RNA, 64 nt, Homo Sapiens
accucaugcaaaaugucuccugaaauaagggaaaaaaaaaaaaccacaacuuugaaaaucuuaa

SEQ ID NO: 32565 - RNA, 64 nt, Homo Sapiens
ccucaugcaaaaugucuccugaaauaagggaaaaaaaaaaaaccacaacuuugaaaaucuuaau

SEQ ID NO: 32566 - RNA, 64 nt, Homo Sapiens
guugaaguuagcaaugccgaaagguuucugucuuaaaaaaaaaaauccuuguacuuaucaauuu

SEQ ID NO: 32567 - RNA, 64 nt, Homo Sapiens
uugaaguuagcaaugccgaaagguuucugucuuaaaaaaaaaaauccuuguacuuaucaauuuu

SEQ ID NO: 32568 - RNA, 64 nt, Homo Sapiens
ugaaguuagcaaugccgaaagguuucugucuuaaaaaaaaaaauccuuguacuuaucaauuuug

SEQ ID NO: 32569 - RNA, 64 nt, Homo Sapiens
gaaguuagcaaugccgaaagguuucugucuuaaaaaaaaaaauccuuguacuuaucaauuuugc

SEQ ID NO: 32570 - RNA, 64 nt, Homo Sapiens
cuacacuguccuggcagaaaacaaaagugacgagaaaaaaaaaucaggagucagcucugacaau

SEQ ID NO: 32571 - RNA, 64 nt, Homo Sapiens
uacacuguccuggcagaaaacaaaagugacgagaaaaaaaaaucaggagucagcucugacaaug

SEQ ID NO: 32572 - RNA, 64 nt, Homo Sapiens
uaauauggcccacacuuuauucaccacccuggagaaaaaaaaacccaggaauauguggaaaagc

SEQ ID NO: 32573 - RNA, 64 nt, Homo Sapiens
aauauggcccacacuuuauucaccacccuggagaaaaaaaaacccaggaauauguggaaaagcc

SEQ ID NO: 32574 - RNA, 64 nt, Homo Sapiens
gaagaagaugacgaugaugaaggcuucugccaaaaaaaaaaagaaagagcagguacauggaucc

SEQ ID NO: 32575 - RNA, 64 nt, Homo Sapiens
agaagaagaugacgaugaugcaggcuucugccaaaaaaaaaaaggaagagcagguacauggauc

SEQ ID NO: 32576 - RNA, 64 nt, Homo Sapiens
gagaagaagaugacgaugauccaggcuucugccaaaaaaaaaaaggaagagcagguacauggau

SEQ ID NO: 32577 - RNA, 64 nt, Homo Sapiens
agagaagaagaugacgaugauccaggcuucugccaaaaaaaaaagggaagagcagguacaugga

SEQ ID NO: 32578 - RNA, 64 nt, Homo Sapiens
auguguaauaugaaguaaaauucugccuuuuuuaaaaaaaaaguaguguuguuuccuucaaugu

SEQ ID NO: 32579 - RNA, 64 nt, Homo Sapiens
uauguguaauaugaaguaaauuucugccuuuuuuaaaaaaaaaggaguguuguuuccuucaaug

SEQ ID NO: 32580 - RNA, 64 nt, Homo Sapiens
aguggguuccugagcucaagaaaaaaaaaaaaaaaaaaaaaagcuuuuaagcauaaaaaaaaaa

SEQ ID NO: 32581 - RNA, 64 nt, Homo Sapiens
caguggguuccugagcucaaaaaaaaaaaaaaaaaaaaaaaaagcuuuuaagcauaaaaaaaaa

SEQ ID NO: 32582 - RNA, 64 nt, Homo Sapiens
gcaguggguuccugagcucaaaaaaaaaaaaaaaaaaaaaaaaaacuuuuaagcauaaaaaaaa

SEQ ID NO: 32583 - RNA, 64 nt, Homo Sapiens
agcaguggguuccugagcucaaaaaaaaaaaaaaaaaaaaaaaacacuuuuaagcauaaaaaaa

SEQ ID NO: 32584 - RNA, 64 nt, Homo Sapiens
aagcaguggguuccugagcuaaaaaaaaaaaaaaaaaaaaaaaaucacuuuuaagcauaaaaaa

SEQ ID NO: 32585 - RNA, 64 nt, Homo Sapiens
aaagcaguggguuccugagcaaaaaaaaaaaaaaaaaaaaaaaaaucacuuuuaagcauaaaaa

SEQ ID NO: 32586 - RNA, 64 nt, Homo Sapiens
aaaagcaguggguuccugagaaaaaaaaaaaaaaaaaaaaaaaauaucacuuuuaagcauaaaa

SEQ ID NO: 32587 - RNA, 64 nt, Homo Sapiens
aaaaagcaguggguuccugaaaaaaaaaaaaaaaaaaaaaaaaauuaucacuuuuaagcauaaa

SEQ ID NO: 32588 - RNA, 64 nt, Homo Sapiens
aaaaaagcaguggguuccugaaaaaaaaaaaaaaaaaaaaaaaauuuaucacuuuuaagcauaa

SEQ ID NO: 32589 - RNA, 64 nt, Homo Sapiens
aaaaaaagcaguggguuccuaaaaaaaaaaaaaaaaaaaaaaaacuuuaucacuuuuaagcaua

SEQ ID NO: 32590 - RNA, 64 nt, Homo Sapiens
aaaaaaaagcaguggguuccaaaaaaaaaaaaaaaaaaaaaaaaucuuuaucacuuuuaagcau

SEQ ID NO: 32591 - RNA, 64 nt, Homo Sapiens
aaaaaaaaagcaguggguucuaaaaaaaaaaaaaaaaaaaaaaacucuuuaucacuuuuaagca

SEQ ID NO: 32592 - RNA, 64 nt, Homo Sapiens
aaaaaaaaaagcaguggguuauaaaaaaaaaaaaaaaaaaaaaaccucuuuaucacuuuuaagc

SEQ ID NO: 32593 - RNA, 64 nt, Homo Sapiens
aaaaaaaaaaagcagugggucauaaaaaaaaaaaaaaaaaaaaauccucuuuaucacuuuuaag

SEQ ID NO: 32594 - RNA, 64 nt, Homo Sapiens
aaaaaaaaaaaagcaguggggcauaaaaaaaaaaaaaaaaaaaacuccucuuuaucacuuuuaa

SEQ ID NO: 32595 - RNA, 64 nt, Homo Sapiens
aaaaaaaaaaaaagcaguggagcauaaaaaaaaaaaaaaaaaaaucuccucuuuaucacuuuua

SEQ ID NO: 32596 - RNA, 64 nt, Homo Sapiens
aaaaaaaaaaaaaagcagugaagcauaaaaaaaaaaaaaaaaaacucuccucuuuaucacuuuu

SEQ ID NO: 32597 - RNA, 64 nt, Homo Sapiens
aaaaaaaaaaaaaaagcaguuaagcauaaaaaaaaaaaaaaaaaccucuccucuuuaucacuuu

SEQ ID NO: 32598 - RNA, 64 nt, Homo Sapiens
aaaaaaaaaaaaaaaagcaguuaagcauaaaaaaaaaaaaaaaagccucuccucuuuaucacuu

SEQ ID NO: 32599 - RNA, 64 nt, Homo Sapiens
aaaaaaaaaaaaaaaaagcauuuaagcauaaaaaaaaaaaaaaaugccucuccucuuuaucacu

SEQ ID NO: 32600 - RNA, 64 nt, Homo Sapiens
aaaaaaaaaaaaaaaaaagcuuuuaagcauaaaaaaaaaaaaaagugccucuccucuuuaucac

SEQ ID NO: 32601 - RNA, 64 nt, Homo Sapiens
aaaaaaaaaaaaaaaaaaagcuuuuaagcauaaaaaaaaaaaaaugugccucuccucuuuauca

SEQ ID NO: 32602 - RNA, 64 nt, Homo Sapiens
aaaaaaaaaaaaaaaaaaaaacuuuuaagcauaaaaaaaaaaaauugugccucuccucuuuauc

SEQ ID NO: 32603 - RNA, 64 nt, Homo Sapiens
aaaaaaaaaaaaaaaaaaaacacuuuuaagcauaaaaaaaaaaacuugugccucuccucuuuau

SEQ ID NO: 32604 - RNA, 64 nt, Homo Sapiens
aaaaaaaaaaaaaaaaaaaaucacuuuuaagcauaaaaaaaaaaccuugugccucuccucuuua

SEQ ID NO: 32605 - RNA, 64 nt, Homo Sapiens
aaaaaaccaaaagcauaaaaauaaaguggaaaaaaaaaaaaaggccacugagcggcuaaaugaa

SEQ ID NO: 32606 - RNA, 64 nt, Homo Sapiens
gaaaaaaccaaaagcauaaaaauaaaguggaaaaaaaaaaaaaggccacugagcggcuaaauga

SEQ ID NO: 32607 - RNA, 64 nt, Homo Sapiens
ggaaaaaaccaaaagcauaaaaauaaaguggaaaaaaaaaaaaaagccacugagcggcuaaaug

SEQ ID NO: 32608 - RNA, 64 nt, Homo Sapiens
aggaaaaaaccaaaagcauagaaauaaaguggaaaaaaaaaaaauagccacugagcggcuaaau

SEQ ID NO: 32609 - RNA, 64 nt, Homo Sapiens
aaggaaaaaaccaaaagcauugaaauaaaguggaaaaaaaaaaacuagccacugagcggcuaaa

SEQ ID NO: 32610 - RNA, 64 nt, Homo Sapiens
aaaggaaaaaaccaaaagcaaugaaauaaaguggaaaaaaaaaaucuagccacugagcggcuaa

SEQ ID NO: 32611 - RNA, 64 nt, Homo Sapiens
aaaaacaacugaccaguugugagcaguguggaaaaaaaaaaacaucacuagguucgaauccaga

SEQ ID NO: 32612 - RNA, 64 nt, Homo Sapiens
aaaaaacaacugaccaguugagagcaguguggaaaaaaaaaaacuucacuagguucgaauccag

SEQ ID NO: 32613 - RNA, 64 nt, Homo Sapiens
caaaaaacaacugaccaguugagagcaguguggaaaaaaaaaaaauucacuagguucgaaucca

SEQ ID NO: 32614 - RNA, 64 nt, Homo Sapiens
acaaaaaacaacugaccaguagagagcaguguggaaaaaaaaaaaauucacuagguucgaaucc

SEQ ID NO: 32615 - RNA, 64 nt, Homo Sapiens
uuggaggugauuuacagugauucaucccccccaaaaaaaaaagagccugcggacagaccaagac

SEQ ID NO: 32616 - RNA, 64 nt, Homo Sapiens
auuggaggugauuuacagugcuucaucccccccaaaaaaaaaagagccugcggacagaccaaga

SEQ ID NO: 32617 - RNA, 64 nt, Homo Sapiens
gauuggaggugauuuacaguacuucaucccccccaaaaaaaaaacagccugcggacagaccaag

SEQ ID NO: 32618 - RNA, 64 nt, Homo Sapiens
cacauagcuaucaagugugccuccgucucaaaaaaaaaaaaauggccugggccacagggcgaga

SEQ ID NO: 32619 - RNA, 64 nt, Homo Sapiens
gcacauagcuaucaagugugacuccgucucaaaaaaaaaaaaauagccugggccacagggcgag

SEQ ID NO: 32620 - RNA, 64 nt, Homo Sapiens
ugcacauagcuaucaagugugacuccgucucaaaaaaaaaaaaauagccugggccacagggcga

SEQ ID NO: 32621 - RNA, 64 nt, Homo Sapiens
augcacauagcuaucaagugagacuccgucucaaaaaaaaaaaacuagccugggccacagggcg

SEQ ID NO: 32622 - RNA, 64 nt, Homo Sapiens
aaugcacauagcuaucaagugagacuccgucucaaaaaaaaaaaucuagccugggccacagggc

SEQ ID NO: 32623 - RNA, 64 nt, Homo Sapiens
aaaugcacauagcuaucaagcgagacuccgucucaaaaaaaaaacucuagccugggccacaggg

SEQ ID NO: 32624 - RNA, 64 nt, Homo Sapiens
gagagagagagaaagagaacucucagaaaaaaaaaaaaaaaagagcgacaagagcaagacucug

SEQ ID NO: 32625 - RNA, 64 nt, Homo Sapiens
agagagagagagaaagagaagucucagaaaaaaaaaaaaaaaagggcgacaagagcaagacucu

SEQ ID NO: 32626 - RNA, 64 nt, Homo Sapiens
gagagagagagagaaagagaugucucagaaaaaaaaaaaaaaaagggcgacaagagcaagacuc

SEQ ID NO: 32627 - RNA, 64 nt, Homo Sapiens
agagagagagagagaaagagcugucucagaaaaaaaaaaaaaaaugggcgacaagagcaagacu

SEQ ID NO: 32628 - RNA, 64 nt, Homo Sapiens
aagagagagagagagaaagaucugucucagaaaaaaaaaaaaaacugggcgacaagagcaagac

SEQ ID NO: 32629 - RNA, 64 nt, Homo Sapiens
aaagagagagagagagaaagcucugucucagaaaaaaaaaaaaaccugggcgacaagagcaaga

SEQ ID NO: 32630 - RNA, 64 nt, Homo Sapiens
aaaagagagagagagagaaaacucugucucagaaaaaaaaaaaagccugggcgacaagagcaag

SEQ ID NO: 32631 - RNA, 64 nt, Homo Sapiens
aaaaagagagagagagagaagacucugucucagaaaaaaaaaaaagccugggcgacaagagcaa

SEQ ID NO: 32632 - RNA, 64 nt, Homo Sapiens
aaaaaagagagagagagagaagacucugucucagaaaaaaaaaacagccugggcgacaagagca

SEQ ID NO: 32633 - RNA, 64 nt, Homo Sapiens
aagagagagggccgggcgugucaaaaaaaaaaaaaaaaaaaagaacauaacaagauccugucuc

SEQ ID NO: 32634 - RNA, 64 nt, Homo Sapiens
aaagagagagggccgggcgucucaaaaaaaaaaaaaaaaaaaagaacauaacaagauccugucu

SEQ ID NO: 32635 - RNA, 64 nt, Homo Sapiens
gaaagagagagggccgggcgucucaaaaaaaaaaaaaaaaaaaacaacauaacaagauccuguc

SEQ ID NO: 32636 - RNA, 64 nt, Homo Sapiens
agaaagagagagggccgggccucucaaaaaaaaaaaaaaaaaaagcaacauaacaagauccugu

SEQ ID NO: 32637 - RNA, 64 nt, Homo Sapiens
aagaaagagagagggccgggucucucaaaaaaaaaaaaaaaaaaggcaacauaacaagauccug

SEQ ID NO: 32638 - RNA, 64 nt, Homo Sapiens
aaagaaagagagagggccgggucucucaaaaaaaaaaaaaaaaagggcaacauaacaagauccu

SEQ ID NO: 32639 - RNA, 64 nt, Homo Sapiens
aaaagaaagagagagggccgugucucucaaaaaaaaaaaaaaaaugggcaacauaacaagaucc

SEQ ID NO: 32640 - RNA, 64 nt, Homo Sapiens
aaaaagaaagagagagggcccugucucucaaaaaaaaaaaaaaacugggcaacauaacaagauc

SEQ ID NO: 32641 - RNA, 64 nt, Homo Sapiens
aaaaaagaaagagagagggcccugucucucaaaaaaaaaaaaaaccugggcaacauaacaagau

SEQ ID NO: 32642 - RNA, 64 nt, Homo Sapiens
aaaaaaagaaagagagaggguccugucucucaaaaaaaaaaaaagccugggcaacauaacaaga

SEQ ID NO: 32643 - RNA, 64 nt, Homo Sapiens
aaaaaaaagaaagagagaggauccugucucucaaaaaaaaaaaaagccugggcaacauaacaag

SEQ ID NO: 32644 - RNA, 64 nt, Homo Sapiens
aaaaaaaaagaaagagagaggauccugucucucaaaaaaaaaaacagccugggcaacauaacaa

SEQ ID NO: 32645 - RNA, 64 nt, Homo Sapiens
aaaaaaaaaagaaagagagaagauccugucucucaaaaaaaaaaccagccugggcaacauaaca

SEQ ID NO: 32646 - RNA, 64 nt, Homo Sapiens
aucaccuuuuguacaaaaacguuuuaaaaugaagaaaaaaaaccucccucccccacacccuggu

SEQ ID NO: 32647 - RNA, 64 nt, Homo Sapiens
ccaagaaacauuauuuauacauuucuuuaauuaaaaaaaaaaugacaaguuuuugagacacugg

SEQ ID NO: 32648 - RNA, 64 nt, Homo Sapiens
gccaagaaacauuauuuauagauuucuuuaauuaaaaaaaaaaucacaaguuuuugagacacug

SEQ ID NO: 32649 - RNA, 64 nt, Homo Sapiens
ugccaagaaacauuauuuauggauuucuuuaauuaaaaaaaaaaucacaaguuuuugagacacu

SEQ ID NO: 32650 - RNA, 64 nt, Homo Sapiens
cuuaucaaaaaacccauggcauuucauuucaauaaaaaaaaacugaugauuuuauguuaugugg

SEQ ID NO: 32651 - RNA, 64 nt, Homo Sapiens
ucuuaucaaaaaacccaugggauuucauuucaauaaaaaaaaacggaugauuuuauguuaugug

SEQ ID NO: 32652 - RNA, 64 nt, Homo Sapiens
uauguccuucuuauuuauuucaugauuuaaaaaaaaaaaaaauuggugcuaaaccuccaagugu

SEQ ID NO: 32653 - RNA, 64 nt, Homo Sapiens
uuauguccuucuuauuuauuucaugauuuaaaaaaaaaaaaaauuggugcuaaaccuccaagug

SEQ ID NO: 32654 - RNA, 64 nt, Homo Sapiens
uuuauguccuucuuauuuaugucaugauuuaaaaaaaaaaaaaacuggugcuaaaccuccaagu

SEQ ID NO: 32655 - RNA, 64 nt, Homo Sapiens
auuuauguccuucuuauuuaugucaugauuuaaaaaaaaaaaaagcuggugcuaaaccuccaag

SEQ ID NO: 32656 - RNA, 64 nt, Homo Sapiens
aauuuauguccuucuuauuugugucaugauuuaaaaaaaaaaaaugcuggugcuaaaccuccaa

SEQ ID NO: 32657 - RNA, 64 nt, Homo Sapiens
aaauuuauguccuucuuauuagugucaugauuuaaaaaaaaaaaaugcuggugcuaaaccucca

SEQ ID NO: 32658 - RNA, 64 nt, Homo Sapiens
aaaauuuauguccuucuuauaagugucaugauuuaaaaaaaaaagaugcuggugcuaaaccucc

SEQ ID NO: 32659 - RNA, 64 nt, Homo Sapiens
guuuauuucaucuugccuuugagauuucuggagaaaaaaaaacagugcugugggcacuggagua

SEQ ID NO: 32660 - RNA, 64 nt, Homo Sapiens
aguuuauuucaucuugccuuagagauuucuggagaaaaaaaaacugugcugugggcacuggagu

SEQ ID NO: 32661 - RNA, 64 nt, Homo Sapiens
aaaacauuugaaugaacuguaugccaacaguuuaaaaaaaaauuagauuuauuuaaaguucuua

SEQ ID NO: 32662 - RNA, 64 nt, Homo Sapiens
uaaaacauuugaaugaacugaaugccaacaguuuaaaaaaaaauuagauuuauuuaaaguucuu

SEQ ID NO: 32663 - RNA, 64 nt, Homo Sapiens
caugcaaaccugagugagcaaauuuaucaccauaaaaaaaaaccagauucauuuuucuugaugu

SEQ ID NO: 32664 - RNA, 64 nt, Homo Sapiens
ccaugcaaaccugagugagcuaauuuaucaccauaaaaaaaaaccagauucauuuuucuugaug

SEQ ID NO: 32665 - RNA, 64 nt, Homo Sapiens
aacagaggcagaggcaggcaagacaaaaaaaaaaaaaaaaaacauugcuguaagaaaaaaugua

SEQ ID NO: 32666 - RNA, 64 nt, Homo Sapiens
aaacagaggcagaggcaggcaagacaaaaaaaaaaaaaaaaaacauugcuguaagaaaaaaugu

SEQ ID NO: 32667 - RNA, 64 nt, Homo Sapiens
caaacagaggcagaggcagguaagacaaaaaaaaaaaaaaaaaagauugcuguaagaaaaaaug

SEQ ID NO: 32668 - RNA, 64 nt, Homo Sapiens
acaaacagaggcagaggcagguaagacaaaaaaaaaaaaaaaaaagauugcuguaagaaaaaau

SEQ ID NO: 32669 - RNA, 64 nt, Homo Sapiens
aacaaacagaggcagaggcauguaagacaaaaaaaaaaaaaaaaaagauugcuguaagaaaaaa

SEQ ID NO: 32670 - RNA, 64 nt, Homo Sapiens
aaacaaacagaggcagaggcauguaagacaaaaaaaaaaaaaaaaaagauugcuguaagaaaaa

SEQ ID NO: 32671 - RNA, 64 nt, Homo Sapiens
aaaacaaacagaggcagaggaauguaagacaaaaaaaaaaaaaaaaaagauugcuguaagaaaa

SEQ ID NO: 32672 - RNA, 64 nt, Homo Sapiens
aaaaacaaacagaggcagagaaauguaagacaaaaaaaaaaaaacaaaagauugcuguaagaaa

SEQ ID NO: 32673 - RNA, 64 nt, Homo Sapiens
aaaaaacaaacagaggcagaaaaauguaagacaaaaaaaaaaaaucaaaagauugcuguaagaa

SEQ ID NO: 32674 - RNA, 64 nt, Homo Sapiens
aaaaaaacaaacagaggcagaaaaauguaagacaaaaaaaaaaacucaaaagauugcuguaaga

SEQ ID NO: 32675 - RNA, 64 nt, Homo Sapiens
aaaaaaaacaaacagaggcaaaaaaauguaagacaaaaaaaaaaucucaaaagauugcuguaag

SEQ ID NO: 32676 - RNA, 64 nt, Homo Sapiens
caagaaauguauugaauacuuccugcaguuaggaaaaaaaaaucagcguuuuuauguaugcugu

SEQ ID NO: 32677 - RNA, 64 nt, Homo Sapiens
ccaagaaauguauugaauacuuccugcaguuaggaaaaaaaaaugagcguuuuuauguaugcug

SEQ ID NO: 32678 - RNA, 64 nt, Homo Sapiens
ggcuagucccuauguuauagcauuguuaauaaaaaaaaaaaacgaaagaauugugaucagguca

SEQ ID NO: 32679 - RNA, 64 nt, Homo Sapiens
gggcuagucccuauguuauaacauuguuaauaaaaaaaaaaaacuaaagaauugugaucagguc

SEQ ID NO: 32680 - RNA, 64 nt, Homo Sapiens
cgggcuagucccuauguuaucacauuguuaauaaaaaaaaaaaauuaaagaauugugaucaggu

SEQ ID NO: 32681 - RNA, 64 nt, Homo Sapiens
acgggcuagucccuauguuaucacauuguuaauaaaaaaaaaaauuuaaagaauugugaucagg

SEQ ID NO: 32682 - RNA, 64 nt, Homo Sapiens
aacgggcuagucccuauguugucacauuguuaauaaaaaaaaaacuuuaaagaauugugaucag

SEQ ID NO: 32683 - RNA, 64 nt, Homo Sapiens
uugagaagugcaaauguucgacaucuaugggaaaaaaaaaaacaugaaggaaauaagugaaacu

SEQ ID NO: 32684 - RNA, 64 nt, Homo Sapiens
auugagaagugcaaauguucuacaucuaugggaaaaaaaaaaaccugaaggaaauaagugaaac

SEQ ID NO: 32685 - RNA, 64 nt, Homo Sapiens
cauugagaagugcaaauguucuacaucuaugggaaaaaaaaaaaccugaaggaaauaagugaaa

SEQ ID NO: 32686 - RNA, 64 nt, Homo Sapiens
acauugagaagugcaaauguacuacaucuaugggaaaaaaaaaagccugaaggaaauaagugaa

SEQ ID NO: 32687 - RNA, 64 nt, Homo Sapiens
auaaaaaaacccaaacugaauuauuuuaaaaaagaaaaaaaaggcaaauaagcagaaaacauac

SEQ ID NO: 32688 - RNA, 64 nt, Homo Sapiens
ucugaauuuugaaaaaccacagaaggggaacaaaaaaaaaaauaggugacugagguuuuuaugu

SEQ ID NO: 32689 - RNA, 64 nt, Homo Sapiens
aucugaauuuugaaaaaccauagaaggggaacaaaaaaaaaaauuggugacugagguuuuuaug

SEQ ID NO: 32690 - RNA, 64 nt, Homo Sapiens
uaucugaauuuugaaaaaccguagaaggggaacaaaaaaaaaaaguggugacugagguuuuuau

SEQ ID NO: 32691 - RNA, 64 nt, Homo Sapiens
auaucugaauuuugaaaaacuguagaaggggaacaaaaaaaaaaaguggugacugagguuuuua

SEQ ID NO: 32692 - RNA, 64 nt, Homo Sapiens
gacaaaaauuagcgggggggcgucucuacuaaaaaaaaaaaauauggccaacauggugaaaccc

SEQ ID NO: 32693 - RNA, 64 nt, Homo Sapiens
agacaaaaauuagcggggggccgucucuacuaaaaaaaaaaaaucuggccaacauggugaaacc

SEQ ID NO: 32694 - RNA, 64 nt, Homo Sapiens
uagacaaaaauuagcgggggcccgucucuacuaaaaaaaaaaaaacuggccaacauggugaaac

SEQ ID NO: 32695 - RNA, 64 nt, Homo Sapiens
auagacaaaaauuagcggggccccgucucuacuaaaaaaaaaaagacuggccaacauggugaaa

SEQ ID NO: 32696 - RNA, 64 nt, Homo Sapiens
aauagacaaaaauuagcgggaccccgucucuacuaaaaaaaaaaagacuggccaacauggugaa

SEQ ID NO: 32697 - RNA, 64 nt, Homo Sapiens
uacauagauuugucucugugagaauuuaccagaaaaaaaaaagaacacuuuucucauuuuccug

SEQ ID NO: 32698 - RNA, 64 nt, Homo Sapiens
auacauagauuugucucugugagaauuuaccagaaaaaaaaaagcacacuuuucucauuuuccu

SEQ ID NO: 32699 - RNA, 64 nt, Homo Sapiens
gauacauagauuugucucugugagaauuuaccagaaaaaaaaaagcacacuuuucucauuuucc

SEQ ID NO: 32700 - RNA, 64 nt, Homo Sapiens
aaaauaaaaauaaauaaauaagugcuaaaguguaaaaaaaaauacuccuaacuucagggaauaa

SEQ ID NO: 32701 - RNA, 64 nt, Homo Sapiens
aaaaauaaaaauaaauaaauaagugcuaaaguguaaaaaaaaauccuccuaacuucagggaaua

SEQ ID NO: 32702 - RNA, 64 nt, Homo Sapiens
uguuuaaauuguauuugcaauguguacaaacacuaaaaaaaacuauauugaaaaauugacaaau

SEQ ID NO: 32703 - RNA, 64 nt, Homo Sapiens
cuuuucucuacagcaaauuaccaggaaggaauggaaaaaaaauugggagaagauacuguggcaa

SEQ ID NO: 32704 - RNA, 64 nt, Homo Sapiens
gccgggcaugguggcgcaagacaaaaaaaaaaaaaaaaaaaauaacccugucucuauuaaaaau

SEQ ID NO: 32705 - RNA, 64 nt, Homo Sapiens
agccgggcaugguggcgcaauacaaaaaaaaaaaaaaaaaaaauaacccugucucuauuaaaaa

SEQ ID NO: 32706 - RNA, 64 nt, Homo Sapiens
uagccgggcaugguggcgcaauacaaaaaaaaaaaaaaaaaaaaaaacccugucucuauuaaaa

SEQ ID NO: 32707 - RNA, 64 nt, Homo Sapiens
auagccgggcaugguggcgcaauacaaaaaaaaaaaaaaaaaaagaaacccugucucuauuaaa

SEQ ID NO: 32708 - RNA, 64 nt, Homo Sapiens
aauagccgggcaugguggcgaaauacaaaaaaaaaaaaaaaaaaagaaacccugucucuauuaa

SEQ ID NO: 32709 - RNA, 64 nt, Homo Sapiens
aaauagccgggcaugguggcaaaauacaaaaaaaaaaaaaaaaagagaaacccugucucuauua

SEQ ID NO: 32710 - RNA, 64 nt, Homo Sapiens
aaaauagccgggcaugguggaaaaauacaaaaaaaaaaaaaaaaggagaaacccugucucuauu

SEQ ID NO: 32711 - RNA, 64 nt, Homo Sapiens
aaaaauagccgggcaugguguaaaaauacaaaaaaaaaaaaaaauggagaaacccugucucuau

SEQ ID NO: 32712 - RNA, 64 nt, Homo Sapiens
aaaaaauagccgggcaugguuuaaaaauacaaaaaaaaaaaaaaauggagaaacccugucucua

SEQ ID NO: 32713 - RNA, 64 nt, Homo Sapiens
aaaaaaauagccgggcauggauuaaaaauacaaaaaaaaaaaaacauggagaaacccugucucu

SEQ ID NO: 32714 - RNA, 64 nt, Homo Sapiens
aaaaaaaauagccgggcauguauuaaaaauacaaaaaaaaaaaaacauggagaaacccugucuc

SEQ ID NO: 32715 - RNA, 64 nt, Homo Sapiens
aaaaaaaaauagccgggcaucuauuaaaaauacaaaaaaaaaaaaacauggagaaacccugucu

SEQ ID NO: 32716 - RNA, 64 nt, Homo Sapiens
aaaaaaaaaauagccgggcaucuauuaaaaauacaaaaaaaaaacaacauggagaaacccuguc

SEQ ID NO: 32717 - RNA, 64 nt, Homo Sapiens
uauuucugcauuuuauggccugaugaccaggaaaaaaaaaaaggcuuuguuuagggguaggcuu

SEQ ID NO: 32718 - RNA, 64 nt, Homo Sapiens
guauuucugcauuuuauggcuugaugaccaggaaaaaaaaaaagccuuuguuuagggguaggcu

SEQ ID NO: 32719 - RNA, 64 nt, Homo Sapiens
gguauuucugcauuuuaugguuugaugaccaggaaaaaaaaaaacccuuuguuuagggguaggc

SEQ ID NO: 32720 - RNA, 64 nt, Homo Sapiens
agguauuucugcauuuuaugcuuugaugaccaggaaaaaaaaaaccccuuuguuuagggguagg

SEQ ID NO: 32721 - RNA, 64 nt, Homo Sapiens
gguggaguuuggacugaucauauuuucagcuaaaaaaaaaaacggagguuacagagggagguga

SEQ ID NO: 32722 - RNA, 64 nt, Homo Sapiens
ggguggaguuuggacugaucauauuuucagcuaaaaaaaaaaacagagguuacagagggaggug

SEQ ID NO: 32723 - RNA, 64 nt, Homo Sapiens
cggguggaguuuggacugaugauauuuucagcuaaaaaaaaaaauagagguuacagagggaggu

SEQ ID NO: 32724 - RNA, 64 nt, Homo Sapiens
acggguggaguuuggacugaugauauuuucagcuaaaaaaaaaaguagagguuacagagggagg

SEQ ID NO: 32725 - RNA, 64 nt, Homo Sapiens
auaaauaguucuaaaagcaaaaaaacaucacuuaaaaaaaaagaccuauugaugcugguguuua

SEQ ID NO: 32726 - RNA, 64 nt, Homo Sapiens
aauaaauaguucuaaaagcaaaaaaacaucacuuaaaaaaaaaguccuauugaugcugguguuu

SEQ ID NO: 32727 - RNA, 64 nt, Homo Sapiens
auuuuaauugaucugugaaaaaaaaaaaaaaaaaaaaaaaaacccaagagcaaaacugucucaa

SEQ ID NO: 32728 - RNA, 64 nt, Homo Sapiens
cauuuuaauugaucugugaaaaaaaaaaaaaaaaaaaaaaaaacacaagagcaaaacugucuca

SEQ ID NO: 32729 - RNA, 64 nt, Homo Sapiens
ccauuuuaauugaucugugaaaaaaaaaaaaaaaaaaaaaaaaaaacaagagcaaaacugucuc

SEQ ID NO: 32730 - RNA, 64 nt, Homo Sapiens
accauuuuaauugaucugugcaaaaaaaaaaaaaaaaaaaaaaacaacaagagcaaaacugucu

SEQ ID NO: 32731 - RNA, 64 nt, Homo Sapiens
aaccauuuuaauugaucuguucaaaaaaaaaaaaaaaaaaaaaaacaacaagagcaaaacuguc

SEQ ID NO: 32732 - RNA, 64 nt, Homo Sapiens
aaaccauuuuaauugaucugcucaaaaaaaaaaaaaaaaaaaaagacaacaagagcaaaacugu

SEQ ID NO: 32733 - RNA, 64 nt, Homo Sapiens
aaaaccauuuuaauugaucuucucaaaaaaaaaaaaaaaaaaaaggacaacaagagcaaaacug

SEQ ID NO: 32734 - RNA, 64 nt, Homo Sapiens
aaaaaccauuuuaauugaucgucucaaaaaaaaaaaaaaaaaaauggacaacaagagcaaaacu

SEQ ID NO: 32735 - RNA, 64 nt, Homo Sapiens
aaaaaaccauuuuaauugauugucucaaaaaaaaaaaaaaaaaacuggacaacaagagcaaaac

SEQ ID NO: 32736 - RNA, 64 nt, Homo Sapiens
aaaaaaaccauuuuaauugacugucucaaaaaaaaaaaaaaaaaccuggacaacaagagcaaaa

SEQ ID NO: 32737 - RNA, 64 nt, Homo Sapiens
aaaaaaaaccauuuuaauugacugucucaaaaaaaaaaaaaaaagccuggacaacaagagcaaa

SEQ ID NO: 32738 - RNA, 64 nt, Homo Sapiens
aaaaaaaaaccauuuuaauuaacugucucaaaaaaaaaaaaaaaagccuggacaacaagagcaa

SEQ ID NO: 32739 - RNA, 64 nt, Homo Sapiens
aaaaaaaaaaccauuuuaauaaacugucucaaaaaaaaaaaaaacagccuggacaacaagagca

SEQ ID NO: 32740 - RNA, 64 nt, Homo Sapiens
aaaaaaaaaaaccauuuuaaaaaacugucucaaaaaaaaaaaaaccagccuggacaacaagagc

SEQ ID NO: 32741 - RNA, 64 nt, Homo Sapiens
aaaaaaaaaaaaccauuuuacaaaacugucucaaaaaaaaaaaauccagccuggacaacaagag

SEQ ID NO: 32742 - RNA, 64 nt, Homo Sapiens
aaaaaaaaaaaaaccauuuugcaaaacugucucaaaaaaaaaaacuccagccuggacaacaaga

SEQ ID NO: 32743 - RNA, 64 nt, Homo Sapiens
aaaaaaaaaaaaaaccauuuagcaaaacugucucaaaaaaaaaaacuccagccuggacaacaag

SEQ ID NO: 32744 - RNA, 64 nt, Homo Sapiens
ccucacuuuuguuuucuguuccaaacaacccaacaaaaaaaaucuagcaccuccccuucccaaa

SEQ ID NO: 32745 - RNA, 64 nt, Homo Sapiens
ucuuuuuccaauuugguuucuugguuucuaauuaaaaaaaaauuccauuuaaccguauguaaac

SEQ ID NO: 32746 - RNA, 64 nt, Homo Sapiens
uucuuuuuccaauuugguuucuugguuucuaauuaaaaaaaaauaccauuuaaccguauguaaa

SEQ ID NO: 32747 - RNA, 64 nt, Homo Sapiens
cuuuauaaagaugauauggucaaacugacgacaaaaaaaaaauucuggcugcaguaggaaaggc

SEQ ID NO: 32748 - RNA, 64 nt, Homo Sapiens
ucuuuauaaagaugauauggccaaacugacgacaaaaaaaaaauccuggcugcaguaggaaagg

SEQ ID NO: 32749 - RNA, 64 nt, Homo Sapiens
uucuuuauaaagaugauauggccaaacugacgacaaaaaaaaaaaccuggcugcaguaggaaag

SEQ ID NO: 32750 - RNA, 64 nt, Homo Sapiens
ggaaaaugcaauacauuuuucaggcuauauguuaaaaaaaaauuggauaugcaugauucuuaac

SEQ ID NO: 32751 - RNA, 64 nt, Homo Sapiens
uggaaaaugcaauacauuuuccaggcuauauguuaaaaaaaaauaggauaugcaugauucuuaa

SEQ ID NO: 32752 - RNA, 64 nt, Homo Sapiens
aaaaagaagaagaaaaguacaagacucugucucaaaaaaaaacacuccagccugggcaacaggu

SEQ ID NO: 32753 - RNA, 64 nt, Homo Sapiens
aaaaaagaagaagaaaaguauaagacucugucucaaaaaaaaacacuccagccugggcaacagg

SEQ ID NO: 32754 - RNA, 64 nt, Homo Sapiens
uggguaugguggcuuaugcccuccccccggcaaaaaaaaaaagcaucccaucucuacgcccacc

SEQ ID NO: 32755 - RNA, 64 nt, Homo Sapiens
cuggguaugguggcuuaugcccuccccccggcaaaaaaaaaaaggaucccaucucuacgcccac

SEQ ID NO: 32756 - RNA, 64 nt, Homo Sapiens
gcuggguaugguggcuuaugcccuccccccggcaaaaaaaaaaaggaucccaucucuacgccca

SEQ ID NO: 32757 - RNA, 64 nt, Homo Sapiens
agcuggguaugguggcuuauacccuccccccggcaaaaaaaaaaaggaucccaucucuacgccc

SEQ ID NO: 32758 - RNA, 64 nt, Homo Sapiens
uagacuucuuuauaucuuuuaaaaacaaacaaacaaaaaaaacauuuaaaacagacuccuuuaa

SEQ ID NO: 32759 - RNA, 64 nt, Homo Sapiens
aaaaagaacagccuuuuuagcgagacucuguuccaaaaaaaauacuccaggcugggcaacagua

SEQ ID NO: 32760 - RNA, 64 nt, Homo Sapiens
gaaaagagaacaauguguuuguugcuuguuaauaaaaaaaaauaguguuuuuguuuuugauuau

SEQ ID NO: 32761 - RNA, 64 nt, Homo Sapiens
agaaaagagaacaauguguuuguugcuuguuaauaaaaaaaaauuguguuuuuguuuuugauua

SEQ ID NO: 32762 - RNA, 64 nt, Homo Sapiens
aaacuugaaacuuuucuuuugaaaggaaaaaagaaaaaaaaauccuuccuuuuuuuuuuuuuaa

SEQ ID NO: 32763 - RNA, 64 nt, Homo Sapiens
caaacuugaaacuuuucuuuagaaaggaaaaaagaaaaaaaaauacuuccuuuuuuuuuuuuua

SEQ ID NO: 32764 - RNA, 64 nt, Homo Sapiens
guuuucauuaccucagcccuaaaaaauaaaaauaaaaaaaaauuacagagcgagaccaugucuc

SEQ ID NO: 32765 - RNA, 64 nt, Homo Sapiens
uguuuucauuaccucagccccaaaaaauaaaaauaaaaaaaaaugacagagcgagaccaugucu

SEQ ID NO: 32766 - RNA, 64 nt, Homo Sapiens
acauuugauagagauucaaagucaguuguugaauaaaaaaaaccgcagcuguagaaaagugcuu

SEQ ID NO: 32767 - RNA, 64 nt, Homo Sapiens
cuagcgaaaaaacuccuguuuaagguuaaaaagaaaaaaaaaguaggaccaaucucauuuuuaa

SEQ ID NO: 32768 - RNA, 64 nt, Homo Sapiens
ucuagcgaaaaaacuccuguauaagguuaaaaagaaaaaaaaaguaggaccaaucucauuuuua

SEQ ID NO: 32769 - RNA, 64 nt, Homo Sapiens
uucagaggucccugucuucuuucccuucaaaggaaaaaaaaauguuucucuucucccaaaucuu

SEQ ID NO: 32770 - RNA, 64 nt, Homo Sapiens
guucagaggucccugucuucuuucccuucaaaggaaaaaaaaauuuuucucuucucccaaaucu

SEQ ID NO: 32771 - RNA, 64 nt, Homo Sapiens
ugucacuggacaucagucacuuuuuaaauauaaaaaaaaaaaucuuggggggagguugguuuug

SEQ ID NO: 32772 - RNA, 64 nt, Homo Sapiens
cugucacuggacaucagucaguuuuuaaauauaaaaaaaaaaauuuuggggggagguugguuuu

SEQ ID NO: 32773 - RNA, 64 nt, Homo Sapiens
ucugucacuggacaucagucuguuuuuaaauauaaaaaaaaaaaauuuggggggagguugguuu

SEQ ID NO: 32774 - RNA, 64 nt, Homo Sapiens
aucugucacuggacaucaguuuguuuuuaaauauaaaaaaaaaauauuuggggggagguugguu

SEQ ID NO: 32775 - RNA, 64 nt, Homo Sapiens
uggaauuucaaauauacuaacaugcauauaauagaaaaaaaacauauuauauacaaguguaaua

SEQ ID NO: 32776 - RNA, 64 nt, Homo Sapiens
ugcccugggguuucugcaucuauaugaaauuauaaaaaaaaaguuuuucacaauggcucaagac

SEQ ID NO: 32777 - RNA, 64 nt, Homo Sapiens
uugcccugggguuucugcaucuauaugaaauuauaaaaaaaaagauuuucacaauggcucaaga

SEQ ID NO: 32778 - RNA, 64 nt, Homo Sapiens
acacugugguaguggcauuuuucaguauuaaaaaaaaaaaaauuccuuaccauuauuccagaga

SEQ ID NO: 32779 - RNA, 64 nt, Homo Sapiens
uacacugugguaguggcauuauucaguauuaaaaaaaaaaaaauaccuuaccauuauuccagag

SEQ ID NO: 32780 - RNA, 64 nt, Homo Sapiens
uuacacugugguaguggcaugauucaguauuaaaaaaaaaaaaagaccuuaccauuauuccaga

SEQ ID NO: 32781 - RNA, 64 nt, Homo Sapiens
auuacacugugguaguggcaagauucaguauuaaaaaaaaaaaaugaccuuaccauuauuccag

SEQ ID NO: 32782 - RNA, 64 nt, Homo Sapiens
aauuacacugugguaguggcgagauucaguauuaaaaaaaaaaauugaccuuaccauuauucca

SEQ ID NO: 32783 - RNA, 64 nt, Homo Sapiens
aaauuacacugugguaguggagagauucaguauuaaaaaaaaaauuugaccuuaccauuauucc

SEQ ID NO: 32784 - RNA, 64 nt, Homo Sapiens
aaaaagaaagaaagaaaaaacucugucucaaaaaaaaaaaaagagccggggugacagagcgaac

SEQ ID NO: 32785 - RNA, 64 nt, Homo Sapiens
aaaaaagaaagaaagaaaaaccucugucucaaaaaaaaaaaaagagccggggugacagagcgaa

SEQ ID NO: 32786 - RNA, 64 nt, Homo Sapiens
gaaaaaagaaagaaagaaaaaccucugucucaaaaaaaaaaaaacagccggggugacagagcga

SEQ ID NO: 32787 - RNA, 64 nt, Homo Sapiens
agaaaaaagaaagaaagaaaaaccucugucucaaaaaaaaaaaaccagccggggugacagagcg

SEQ ID NO: 32788 - RNA, 64 nt, Homo Sapiens
aagaaaaaagaaagaaagaagaaccucugucucaaaaaaaaaaauccagccggggugacagagc

SEQ ID NO: 32789 - RNA, 64 nt, Homo Sapiens
aaagaaaaaagaaagaaagacgaaccucugucucaaaaaaaaaacuccagccggggugacagag

SEQ ID NO: 32790 - RNA, 64 nt, Homo Sapiens
caaaaauuagccgggcguggccccaucucuacuaaaaaaaaauagccuggccaacacggugaaa

SEQ ID NO: 32791 - RNA, 64 nt, Homo Sapiens
acaaaaauuagccgggcgugaccccaucucuacuaaaaaaaaauagccuggccaacacggugaa

SEQ ID NO: 32792 - RNA, 64 nt, Homo Sapiens
cauaauaaucugaauaucuuaauagaugauaaccaaaaaaaacucugguaauuugugcagcagc

SEQ ID NO: 32793 - RNA, 64 nt, Homo Sapiens
gcaacucuggugagcagauuuaaacagaaaagaaaaaaaaaauaagaauuaagggguaaagcac

SEQ ID NO: 32794 - RNA, 64 nt, Homo Sapiens
agcaacucuggugagcagaucuaaacagaaaagaaaaaaaaaauaagaauuaagggguaaagca

SEQ ID NO: 32795 - RNA, 64 nt, Homo Sapiens
uagcaacucuggugagcagaacuaaacagaaaagaaaaaaaaaauaagaauuaagggguaaagc

SEQ ID NO: 32796 - RNA, 64 nt, Homo Sapiens
ggugcugauaaauauugauggacucugucuuaaaaaaaaaaauucagccugggugaagaaguga

SEQ ID NO: 32797 - RNA, 64 nt, Homo Sapiens
uggugcugauaaauauugauagacucugucuuaaaaaaaaaaauccagccugggugaagaagug

SEQ ID NO: 32798 - RNA, 64 nt, Homo Sapiens
uuggugcugauaaauauugagagacucugucuuaaaaaaaaaaauccagccugggugaagaagu

SEQ ID NO: 32799 - RNA, 64 nt, Homo Sapiens
auuggugcugauaaauauugugagacucugucuuaaaaaaaaaacuccagccugggugaagaag

SEQ ID NO: 32800 - RNA, 64 nt, Homo Sapiens
agucgggcgugguggugcauucuacuaaaaaaaaaaaaaaaauucaacauggugaaaccccauc

SEQ ID NO: 32801 - RNA, 64 nt, Homo Sapiens
uagucgggcgugguggugcacucuacuaaaaaaaaaaaaaaaauccaacauggugaaaccccau

SEQ ID NO: 32802 - RNA, 64 nt, Homo Sapiens
uuagucgggcgugguggugcucucuacuaaaaaaaaaaaaaaaagccaacauggugaaacccca

SEQ ID NO: 32803 - RNA, 64 nt, Homo Sapiens
auuagucgggcgugguggugaucucuacuaaaaaaaaaaaaaaaggccaacauggugaaacccc

SEQ ID NO: 32804 - RNA, 64 nt, Homo Sapiens
aauuagucgggcgugguggucaucucuacuaaaaaaaaaaaaaauggccaacauggugaaaccc

SEQ ID NO: 32805 - RNA, 64 nt, Homo Sapiens
aaauuagucgggcgugguggccaucucuacuaaaaaaaaaaaaacuggccaacauggugaaacc

SEQ ID NO: 32806 - RNA, 64 nt, Homo Sapiens
aaaauuagucgggcguggugcccaucucuacuaaaaaaaaaaaaccuggccaacauggugaaac

SEQ ID NO: 32807 - RNA, 64 nt, Homo Sapiens
aaaaauuagucgggcgugguccccaucucuacuaaaaaaaaaaagccuggccaacauggugaaa

SEQ ID NO: 32808 - RNA, 64 nt, Homo Sapiens
aaaaaauuagucgggcguggaccccaucucuacuaaaaaaaaaaagccuggccaacauggugaa

SEQ ID NO: 32809 - RNA, 64 nt, Homo Sapiens
ccucaccaugagugcuacauaaaaacaaacaaacaaaaaaaacaugucucaaaaaaaaaaaaac

SEQ ID NO: 32810 - RNA, 64 nt, Homo Sapiens
aaaacaaacaaacaaaaaaacucugucucaaaaaaaaaaaaacagcuugggcaacagaguaaga

SEQ ID NO: 32811 - RNA, 64 nt, Homo Sapiens
aaaaacaaacaaacaaaaaaacucugucucaaaaaaaaaaaaacagcuugggcaacagaguaag

SEQ ID NO: 32812 - RNA, 64 nt, Homo Sapiens
caaaaacaaacaaacaaaaagacucugucucaaaaaaaaaaaaacagcuugggcaacagaguaa

SEQ ID NO: 32813 - RNA, 64 nt, Homo Sapiens
acaaaaacaaacaaacaaaaagacucugucucaaaaaaaaaaaaccagcuugggcaacagagua

SEQ ID NO: 32814 - RNA, 64 nt, Homo Sapiens
aacaaaaacaaacaaacaaaaagacucugucucaaaaaaaaaaauccagcuugggcaacagagu

SEQ ID NO: 32815 - RNA, 64 nt, Homo Sapiens
aaacaaaaacaaacaaacaauaagacucugucucaaaaaaaaaacuccagcuugggcaacagag

SEQ ID NO: 32816 - RNA, 64 nt, Homo Sapiens
aaaaggguagacacaguugauagggggaagaaagaaaaaaaauucugucgguuaacuguaaagu

SEQ ID NO: 32817 - RNA, 64 nt, Homo Sapiens
cauaugugaaugagguugguauuguuauugguuaaaaaaaaagcuuaaaauagaaguacaccua

SEQ ID NO: 32818 - RNA, 64 nt, Homo Sapiens
ccauaugugaaugagguuggaauuguuauugguuaaaaaaaaaguuuaaaauagaaguacaccu

SEQ ID NO: 32819 - RNA, 64 nt, Homo Sapiens
cauuuucuuuggguuagagccuuuuaaaaaaaaaaaaaaaaauuuaagugauugaugcuguuuu

SEQ ID NO: 32820 - RNA, 64 nt, Homo Sapiens
ucauuuucuuuggguuagagucuuuuaaaaaaaaaaaaaaaaauuuaagugauugaugcuguuu

SEQ ID NO: 32821 - RNA, 64 nt, Homo Sapiens
uucauuuucuuuggguuagauucuuuuaaaaaaaaaaaaaaaaacuuaagugauugaugcuguu

SEQ ID NO: 32822 - RNA, 64 nt, Homo Sapiens
auucauuuucuuuggguuaguuucuuuuaaaaaaaaaaaaaaaaucuuaagugauugaugcugu

SEQ ID NO: 32823 - RNA, 64 nt, Homo Sapiens
aauucauuuucuuuggguuauuuucuuuuaaaaaaaaaaaaaaaaucuuaagugauugaugcug

SEQ ID NO: 32824 - RNA, 64 nt, Homo Sapiens
aaauucauuuucuuuggguuguuuucuuuuaaaaaaaaaaaaaaaaucuuaagugauugaugcu

SEQ ID NO: 32825 - RNA, 64 nt, Homo Sapiens
aaaauucauuuucuuuggguuguuuucuuuuaaaaaaaaaaaaaaaaucuuaagugauugaugc

SEQ ID NO: 32826 - RNA, 64 nt, Homo Sapiens
aaaaauucauuuucuuugggcuguuuucuuuuaaaaaaaaaaaaaaaaucuuaagugauugaug

SEQ ID NO: 32827 - RNA, 64 nt, Homo Sapiens
aaaaaauucauuuucuuugggcuguuuucuuuuaaaaaaaaaaagaaaaucuuaagugauugau

SEQ ID NO: 32828 - RNA, 64 nt, Homo Sapiens
aaaaaaauucauuuucuuugugcuguuuucuuuuaaaaaaaaaaagaaaaucuuaagugauuga

SEQ ID NO: 32829 - RNA, 64 nt, Homo Sapiens
ggaagaaaaucuuaagugauaaguguaaaaaaaaaaaaaaaagagagaugcuauacuaauaagc

SEQ ID NO: 32830 - RNA, 64 nt, Homo Sapiens
aggaagaaaaucuuaagugacaaguguaaaaaaaaaaaaaaaagcgagaugcuauacuaauaag

SEQ ID NO: 32831 - RNA, 64 nt, Homo Sapiens
gaggaagaaaaucuuaaguggcaaguguaaaaaaaaaaaaaaaaacgagaugcuauacuaauaa

SEQ ID NO: 32832 - RNA, 64 nt, Homo Sapiens
agaggaagaaaaucuuaaguagcaaguguaaaaaaaaaaaaaaaaacgagaugcuauacuaaua

SEQ ID NO: 32833 - RNA, 64 nt, Homo Sapiens
aagaggaagaaaaucuuaagaagcaaguguaaaaaaaaaaaaaagaacgagaugcuauacuaau

SEQ ID NO: 32834 - RNA, 64 nt, Homo Sapiens
aaagaggaagaaaaucuuaauaagcaaguguaaaaaaaaaaaaaggaacgagaugcuauacuaa

SEQ ID NO: 32835 - RNA, 64 nt, Homo Sapiens
aaaagaggaagaaaaucuuaauaagcaaguguaaaaaaaaaaaauggaacgagaugcuauacua

SEQ ID NO: 32836 - RNA, 64 nt, Homo Sapiens
aaaaagaggaagaaaaucuuaauaagcaaguguaaaaaaaaaaauuggaacgagaugcuauacu

SEQ ID NO: 32837 - RNA, 64 nt, Homo Sapiens
aaaaaagaggaagaaaaucuuaauaagcaaguguaaaaaaaaaauuuggaacgagaugcuauac

SEQ ID NO: 32838 - RNA, 64 nt, Homo Sapiens
ggcaagacaacuauaugguuaauuuauuguuuaaaaaaaaaauugcagugacuuauacuaagac

SEQ ID NO: 32839 - RNA, 64 nt, Homo Sapiens
uggcaagacaacuauauggucaauuuauuguuuaaaaaaaaaauugcagugacuuauacuaaga

SEQ ID NO: 32840 - RNA, 64 nt, Homo Sapiens
uuggcaagacaacuauauggacaauuuauuguuuaaaaaaaaaaaugcagugacuuauacuaag

SEQ ID NO: 32841 - RNA, 64 nt, Homo Sapiens
ccaugaaacauuugaacugauuuuucacuuaaagaaaaaaaaugacuguuuuacaguaucaaaa

SEQ ID NO: 32842 - RNA, 64 nt, Homo Sapiens
acaacaauaaauagggcaugacauguaaaaaaaaaaaaaaaacauaaaauguagcuggcccagg

SEQ ID NO: 32843 - RNA, 64 nt, Homo Sapiens
aacaacaauaaauagggcaugacauguaaaaaaaaaaaaaaaacguaaaauguagcuggcccag

SEQ ID NO: 32844 - RNA, 64 nt, Homo Sapiens
caacaacaauaaauagggcaggacauguaaaaaaaaaaaaaaaaaguaaaauguagcuggccca

SEQ ID NO: 32845 - RNA, 64 nt, Homo Sapiens
acaacaacaauaaauagggcaggacauguaaaaaaaaaaaaaaauaguaaaauguagcuggccc

SEQ ID NO: 32846 - RNA, 64 nt, Homo Sapiens
aacaacaacaauaaauagggcaggacauguaaaaaaaaaaaaaauuaguaaaauguagcuggcc

SEQ ID NO: 32847 - RNA, 64 nt, Homo Sapiens
aaacaacaacaauaaauaggccaggacauguaaaaaaaaaaaaauuuaguaaaauguagcuggc

SEQ ID NO: 32848 - RNA, 64 nt, Homo Sapiens
aaaacaacaacaauaaauagcccaggacauguaaaaaaaaaaaaauuuaguaaaauguagcugg

SEQ ID NO: 32849 - RNA, 64 nt, Homo Sapiens
aaaaacaacaacaauaaauagcccaggacauguaaaaaaaaaaacauuuaguaaaauguagcug

SEQ ID NO: 32850 - RNA, 64 nt, Homo Sapiens
aaaaaacaacaacaauaaauggcccaggacauguaaaaaaaaaaccauuuaguaaaauguagcu

SEQ ID NO: 32851 - RNA, 64 nt, Homo Sapiens
gcaaaaccaaguacauaguguuuuuuuuuuaaggaaaaaaaagcuauacauuucaguggccuuu

SEQ ID NO: 32852 - RNA, 53 nt, Homo Sapiens
agcaaguaauggaauugcacaaaaaaaaaaagcuaagcaaacuuuccaaauaa

SEQ ID NO: 32853 - RNA, 52 nt, Homo Sapiens
cagcaaguaauggaauugcaaaaaaaaaaaaguaagcaaacuuuccaaauaa

SEQ ID NO: 32854 - RNA, 51 nt, Homo Sapiens
gcagcaaguaauggaauugcaaaaaaaaaaauaagcaaacuuuccaaauaa

SEQ ID NO: 32855 - RNA, 50 nt, Homo Sapiens
agcagcaaguaauggaauugaaaaaaaaaauaagcaaacuuuccaaauaa

SEQ ID NO: 32856 - RNA, 64 nt, Homo Sapiens
ugauacuccauuugauuauugguaucaguuuggaaaaaaaaaucgauuucagcucuguauuugu

SEQ ID NO: 32857 - RNA, 64 nt, Homo Sapiens
cugauacuccauuugauuauugguaucaguuuggaaaaaaaaauagauuucagcucuguauuug

SEQ ID NO: 32858 - RNA, 64 nt, Homo Sapiens
uagucaccaggaggaucccucauuuuuagucauuaaaaaaaaucagguugacuaucuaaauagg

SEQ ID NO: 32859 - RNA, 64 nt, Homo Sapiens
auaauaaaauaagugagcugacucugucucaaaaaaaaaaaauaagccugggcgacagagcaag

SEQ ID NO: 32860 - RNA, 64 nt, Homo Sapiens
aauaauaaaauaagugagcugacucugucucaaaaaaaaaaaaucagccugggcgacagagcaa

SEQ ID NO: 32861 - RNA, 64 nt, Homo Sapiens
uaauaauaaaauaagugagcagacucugucucaaaaaaaaaaaaccagccugggcgacagagca

SEQ ID NO: 32862 - RNA, 64 nt, Homo Sapiens
auaauaauaaaauaagugagaagacucugucucaaaaaaaaaaauccagccugggcgacagagc

SEQ ID NO: 32863 - RNA, 64 nt, Homo Sapiens
aauaauaauaaaauaagugacaagacucugucucaaaaaaaaaacuccagccugggcgacagag

SEQ ID NO: 32864 - RNA, 64 nt, Homo Sapiens
gguguuucuauugaaacuguauuuucaggaaaaaaaaaaaaaggaguccuucaaauacugcugu

SEQ ID NO: 32865 - RNA, 64 nt, Homo Sapiens
ggguguuucuauugaaacuguauuuucaggaaaaaaaaaaaaaguaguccuucaaauacugcug

SEQ ID NO: 32866 - RNA, 64 nt, Homo Sapiens
gggguguuucuauugaaacuguauuuucaggaaaaaaaaaaaaauuaguccuucaaauacugcu

SEQ ID NO: 32867 - RNA, 64 nt, Homo Sapiens
agggguguuucuauugaaacuguauuuucaggaaaaaaaaaaaaauuaguccuucaaauacugc

SEQ ID NO: 32868 - RNA, 64 nt, Homo Sapiens
aagggguguuucuauugaaacuguauuuucaggaaaaaaaaaaaaauuaguccuucaaauacug

SEQ ID NO: 32869 - RNA, 64 nt, Homo Sapiens
aaagggguguuucuauugaagcuguauuuucaggaaaaaaaaaaaaauuaguccuucaaauacu

SEQ ID NO: 32870 - RNA, 64 nt, Homo Sapiens
aaagcuuucugccagacugauuauuuuuuuaaaaaaaaaaaagcacacuuguacgaauguagau

SEQ ID NO: 32871 - RNA, 64 nt, Homo Sapiens
caaagcuuucugccagacuguuuauuuuuuuaaaaaaaaaaaagcacacuuguacgaauguaga

SEQ ID NO: 32872 - RNA, 64 nt, Homo Sapiens
gcaaagcuuucugccagacuauuuauuuuuuuaaaaaaaaaaaaacacacuuguacgaauguag

SEQ ID NO: 32873 - RNA, 64 nt, Homo Sapiens
agcaaagcuuucugccagacgauuuauuuuuuuaaaaaaaaaaagacacacuuguacgaaugua

SEQ ID NO: 32874 - RNA, 64 nt, Homo Sapiens
aagcaaagcuuucugccagaagauuuauuuuuuuaaaaaaaaaaagacacacuuguacgaaugu

SEQ ID NO: 32875 - RNA, 64 nt, Homo Sapiens
uuaagugacagugccauaguagaaugguaaaaaaaaaaaaaauugugaagaucuggcacaagau

SEQ ID NO: 32876 - RNA, 64 nt, Homo Sapiens
uuuaagugacagugccauaguagaaugguaaaaaaaaaaaaaauugugaagaucuggcacaaga

SEQ ID NO: 32877 - RNA, 64 nt, Homo Sapiens
uuuuaagugacagugccauaauagaaugguaaaaaaaaaaaaaacugugaagaucuggcacaag

SEQ ID NO: 32878 - RNA, 64 nt, Homo Sapiens
auuuuaagugacagugccaugauagaaugguaaaaaaaaaaaaagcugugaagaucuggcacaa

SEQ ID NO: 32879 - RNA, 64 nt, Homo Sapiens
aauuuuaagugacagugccaagauagaaugguaaaaaaaaaaaaagcugugaagaucuggcaca

SEQ ID NO: 32880 - RNA, 64 nt, Homo Sapiens
aaauuuuaagugacagugccaagauagaaugguaaaaaaaaaaacagcugugaagaucuggcac

SEQ ID NO: 32881 - RNA, 64 nt, Homo Sapiens
aaaauuuuaagugacagugccaagauagaaugguaaaaaaaaaaacagcugugaagaucuggca

SEQ ID NO: 32882 - RNA, 64 nt, Homo Sapiens
uugcuuacuauuugauuaaaucuugagacaaacaaaaaaaaaguuuccaaaguaauaaaacuuu

SEQ ID NO: 32883 - RNA, 64 nt, Homo Sapiens
uuugcuuacuauuugauuaauucuugagacaaacaaaaaaaaagauuccaaaguaauaaaacuu

SEQ ID NO: 32884 - RNA, 64 nt, Homo Sapiens
agaaauuccaaaguaauaaaaaauaaauacaaaaaaaaaaaagaaaaauuucuuuuucuagaaa

SEQ ID NO: 32885 - RNA, 64 nt, Homo Sapiens
aagaaauuccaaaguaauaaaaaauaaauacaaaaaaaaaaaagaaaaauuucuuuuucuagaa

SEQ ID NO: 32886 - RNA, 64 nt, Homo Sapiens
gaagaaauuccaaaguaauaaaaaauaaauacaaaaaaaaaaaacaaaaauuucuuuuucuaga

SEQ ID NO: 32887 - RNA, 64 nt, Homo Sapiens
agaagaaauuccaaaguaauaaaaaauaaauacaaaaaaaaaaagcaaaaauuucuuuuucuag

SEQ ID NO: 32888 - RNA, 64 nt, Homo Sapiens
aagaagaaauuccaaaguaagaaaaaauaaauacaaaaaaaaaaugcaaaaauuucuuuuucua

SEQ ID NO: 32889 - RNA, 64 nt, Homo Sapiens
uagugcuccugcugucaagagaacauguuaaaaaaaaaaaaaucaaucuucacaguguuuuaaa

SEQ ID NO: 32890 - RNA, 64 nt, Homo Sapiens
cuagugcuccugcugucaagagaacauguuaaaaaaaaaaaaauuaaucuucacaguguuuuaa

SEQ ID NO: 32891 - RNA, 64 nt, Homo Sapiens
ucuagugcuccugcugucaaaagaacauguuaaaaaaaaaaaaauuaaucuucacaguguuuua

SEQ ID NO: 32892 - RNA, 64 nt, Homo Sapiens
aucuagugcuccugcugucaaaagaacauguuaaaaaaaaaaaauuuaaucuucacaguguuuu

SEQ ID NO: 32893 - RNA, 64 nt, Homo Sapiens
aaucuagugcuccugcugucuaaagaacauguuaaaaaaaaaaauuuuaaucuucacaguguuu

SEQ ID NO: 32894 - RNA, 64 nt, Homo Sapiens
aaaucuagugcuccugcuguuuaaagaacauguuaaaaaaaaaauuuuuaaucuucacaguguu

SEQ ID NO: 32895 - RNA, 64 nt, Homo Sapiens
aaaggggaucucuaauacugaaaaaaaaaaaaaaaaaaaaaaguaaauaauaccuuuucuuuaa

SEQ ID NO: 32896 - RNA, 64 nt, Homo Sapiens
uaaaggggaucucuaauacuaaaaaaaaaaaaaaaaaaaaaaagaaaauaauaccuuuucuuua

SEQ ID NO: 32897 - RNA, 64 nt, Homo Sapiens
guaaaggggaucucuaauacaaaaaaaaaaaaaaaaaaaaaaaagaaaauaauaccuuuucuuu

SEQ ID NO: 32898 - RNA, 64 nt, Homo Sapiens
aguaaaggggaucucuaauauaaaaaaaaaaaaaaaaaaaaaaaggaaaauaauaccuuuucuu

SEQ ID NO: 32899 - RNA, 64 nt, Homo Sapiens
aaguaaaggggaucucuaauuuaaaaaaaaaaaaaaaaaaaaaagggaaaauaauaccuuuucu

SEQ ID NO: 32900 - RNA, 64 nt, Homo Sapiens
aaaguaaaggggaucucuaauuuaaaaaaaaaaaaaaaaaaaaaggggaaaauaauaccuuuuc

SEQ ID NO: 32901 - RNA, 64 nt, Homo Sapiens
aaaaguaaaggggaucucuacuuuaaaaaaaaaaaaaaaaaaaauggggaaaauaauaccuuuu

SEQ ID NO: 32902 - RNA, 64 nt, Homo Sapiens
aaaaaguaaaggggaucucuucuuuaaaaaaaaaaaaaaaaaaauuggggaaaauaauaccuuu

SEQ ID NO: 32903 - RNA, 64 nt, Homo Sapiens
aaaaaaguaaaggggaucucuucuuuaaaaaaaaaaaaaaaaaauuuggggaaaauaauaccuu

SEQ ID NO: 32904 - RNA, 64 nt, Homo Sapiens
aaaaaaaguaaaggggaucuuuucuuuaaaaaaaaaaaaaaaaaauuuggggaaaauaauaccu

SEQ ID NO: 32905 - RNA, 64 nt, Homo Sapiens
aaaaaaaaguaaaggggaucuuuucuuuaaaaaaaaaaaaaaaacauuuggggaaaauaauacc

SEQ ID NO: 32906 - RNA, 64 nt, Homo Sapiens
aaaaaaaaaguaaaggggaucuuuucuuuaaaaaaaaaaaaaaaucauuuggggaaaauaauac

SEQ ID NO: 32907 - RNA, 64 nt, Homo Sapiens
aaaaaaaaaaguaaaggggaccuuuucuuuaaaaaaaaaaaaaauucauuuggggaaaauaaua

SEQ ID NO: 32908 - RNA, 64 nt, Homo Sapiens
aaaaaaaaaaaguaaaggggaccuuuucuuuaaaaaaaaaaaaacuucauuuggggaaaauaau

SEQ ID NO: 32909 - RNA, 64 nt, Homo Sapiens
aaaaaaaaaaaaguaaaggguaccuuuucuuuaaaaaaaaaaaagcuucauuuggggaaaauaa

SEQ ID NO: 32910 - RNA, 64 nt, Homo Sapiens
aaaaaaaaaaaaaguaaaggauaccuuuucuuuaaaaaaaaaaaugcuucauuuggggaaaaua

SEQ ID NO: 32911 - RNA, 64 nt, Homo Sapiens
aaaaaaaaaaaaaaguaaagaauaccuuuucuuuaaaaaaaaaauugcuucauuuggggaaaau

SEQ ID NO: 32912 - RNA, 64 nt, Homo Sapiens
uagcuaggcauguugccacauaaaaaauaaaaauaaaaaaaacuagaccucaucucuacaaaaa

SEQ ID NO: 32913 - RNA, 64 nt, Homo Sapiens
cugggcaugauggcucaugcagaaauuuaaaaaaaaaaaaaagcguugcuaacugacaauguua

SEQ ID NO: 32914 - RNA, 64 nt, Homo Sapiens
ccugggcaugauggcucaugaagaaauuuaaaaaaaaaaaaaaggguugcuaacugacaauguu

SEQ ID NO: 32915 - RNA, 64 nt, Homo Sapiens
gccugggcaugauggcucauuaagaaauuuaaaaaaaaaaaaaaagguugcuaacugacaaugu

SEQ ID NO: 32916 - RNA, 64 nt, Homo Sapiens
agccugggcaugauggcucauuaagaaauuuaaaaaaaaaaaaagagguugcuaacugacaaug

SEQ ID NO: 32917 - RNA, 64 nt, Homo Sapiens
aagccugggcaugauggcucguuaagaaauuuaaaaaaaaaaaaagagguugcuaacugacaau

SEQ ID NO: 32918 - RNA, 64 nt, Homo Sapiens
aaagccugggcaugauggcuuguuaagaaauuuaaaaaaaaaaauagagguugcuaacugacaa

SEQ ID NO: 32919 - RNA, 64 nt, Homo Sapiens
aaaagccugggcaugauggcauguuaagaaauuuaaaaaaaaaauuagagguugcuaacugaca

SEQ ID NO: 32920 - RNA, 64 nt, Homo Sapiens
ugagagugguagaauuacuuugucuugcauuaaaaaaaaaaauuucuggccuaugauuguguug

SEQ ID NO: 32921 - RNA, 64 nt, Homo Sapiens
uugagagugguagaauuacugugucuugcauuaaaaaaaaaaaucucuggccuaugauuguguu

SEQ ID NO: 32922 - RNA, 64 nt, Homo Sapiens
uuugagagugguagaauuacugugucuugcauuaaaaaaaaaaaacucuggccuaugauugugu

SEQ ID NO: 32923 - RNA, 64 nt, Homo Sapiens
auuugagagugguagaauuauugugucuugcauuaaaaaaaaaaaacucuggccuaugauugug

SEQ ID NO: 32924 - RNA, 64 nt, Homo Sapiens
uuacauauauugaucuaguuacuuuacaguugucaaaaaaaaucuguaagugucauuuuauagu

SEQ ID NO: 32925 - RNA, 64 nt, Homo Sapiens
aagcauagacauauuuuuuuaaaaagaaaaaaagaaaaaaaagaagaaaguacuugacuaaaaa

SEQ ID NO: 32926 - RNA, 64 nt, Homo Sapiens
aaaaaagaaaaaaaagaaagaaguacuugacuaaaaaaaaaagagugcuauuguuucuuuaaga

SEQ ID NO: 32927 - RNA, 64 nt, Homo Sapiens
aaaaaaagaaaaaaaagaaaaaaguacuugacuaaaaaaaaaagggugcuauuguuucuuuaag

SEQ ID NO: 32928 - RNA, 64 nt, Homo Sapiens
gaaaaaaagaaaaaaaagaagaaaguacuugacuaaaaaaaaaauggugcuauuguuucuuuaa

SEQ ID NO: 32929 - RNA, 64 nt, Homo Sapiens
cucccuggaucucugaauauaggccaggaaaaaaaaaaaaaagaugggucaccucaaggaucag

SEQ ID NO: 32930 - RNA, 64 nt, Homo Sapiens
acucccuggaucucugaauagaggccaggaaaaaaaaaaaaaagcugggucaccucaaggauca

SEQ ID NO: 32931 - RNA, 64 nt, Homo Sapiens
gacucccuggaucucugaauagaggccaggaaaaaaaaaaaaaaacugggucaccucaaggauc

SEQ ID NO: 32932 - RNA, 64 nt, Homo Sapiens
agacucccuggaucucugaacagaggccaggaaaaaaaaaaaaacacugggucaccucaaggau

SEQ ID NO: 32933 - RNA, 64 nt, Homo Sapiens
aagacucccuggaucucugaucagaggccaggaaaaaaaaaaaaccacugggucaccucaagga

SEQ ID NO: 32934 - RNA, 64 nt, Homo Sapiens
aaagacucccuggaucucugaucagaggccaggaaaaaaaaaaacccacugggucaccucaagg

SEQ ID NO: 32935 - RNA, 64 nt, Homo Sapiens
aaaagacucccuggaucucugaucagaggccaggaaaaaaaaaaucccacugggucaccucaag

SEQ ID NO: 32936 - RNA, 64 nt, Homo Sapiens
uauauauauauauaucuuagucuauagaaaagaaaaaaaaaauaugaucuuuuaucaauaaugu

SEQ ID NO: 32937 - RNA, 64 nt, Homo Sapiens
auauauauauauauaucuuauucuauagaaaagaaaaaaaaaauuugaucuuuuaucaauaaug

SEQ ID NO: 32938 - RNA, 64 nt, Homo Sapiens
uauauauauauauauaucuuguucuauagaaaagaaaaaaaaaaguugaucuuuuaucaauaau

SEQ ID NO: 32939 - RNA, 64 nt, Homo Sapiens
cacauugugacuuuuauuuagcacauuaaaaaaaaaaaaaaaucaaaaagagagaaacuugacu

SEQ ID NO: 32940 - RNA, 64 nt, Homo Sapiens
ccacauugugacuuuuauuuugcacauuaaaaaaaaaaaaaaauaaaaaagagagaaacuugac

SEQ ID NO: 32941 - RNA, 64 nt, Homo Sapiens
uccacauugugacuuuuauucugcacauuaaaaaaaaaaaaaaaaaaaaaagagagaaacuuga

SEQ ID NO: 32942 - RNA, 64 nt, Homo Sapiens
auccacauugugacuuuuauacugcacauuaaaaaaaaaaaaaagaaaaaaagagagaaacuug

SEQ ID NO: 32943 - RNA, 64 nt, Homo Sapiens
aauccacauugugacuuuuagacugcacauuaaaaaaaaaaaaaagaaaaaaagagagaaacuu

SEQ ID NO: 32944 - RNA, 64 nt, Homo Sapiens
aaauccacauugugacuuuuugacugcacauuaaaaaaaaaaaaaagaaaaaaagagagaaacu

SEQ ID NO: 32945 - RNA, 64 nt, Homo Sapiens
aaaauccacauugugacuuuuugacugcacauuaaaaaaaaaaagaagaaaaaaagagagaaac

SEQ ID NO: 32946 - RNA, 64 nt, Homo Sapiens
aaaaauccacauugugacuucuugacugcacauuaaaaaaaaaaagaagaaaaaaagagagaaa

SEQ ID NO: 32947 - RNA, 64 nt, Homo Sapiens
cuguagauagcaaauuguguagguuaaaagggaaaaaaaaaauuuccuuccugaacucuaauag

SEQ ID NO: 32948 - RNA, 64 nt, Homo Sapiens
ucuguagauagcaaauuguggagguuaaaagggaaaaaaaaaaucuccuuccugaacucuaaua

SEQ ID NO: 32949 - RNA, 64 nt, Homo Sapiens
uucuguagauagcaaauuguagagguuaaaagggaaaaaaaaaaccuccuuccugaacucuaau

SEQ ID NO: 32950 - RNA, 64 nt, Homo Sapiens
gaaaaaaaaaaaaaaaaaaaugucuugcccuuccaaaaaaaauucuguauuguucuuuaauggc

SEQ ID NO: 32951 - RNA, 64 nt, Homo Sapiens
uggguuggggggacccuuuuuuucaaguaaaaaaaaaaaaaaggaauccugucuggcuggcaga

SEQ ID NO: 32952 - RNA, 64 nt, Homo Sapiens
guggguuggggggacccuuuauuucaaguaaaaaaaaaaaaaagaaauccugucuggcuggcag

SEQ ID NO: 32953 - RNA, 64 nt, Homo Sapiens
gguggguuggggggacccuugauuucaaguaaaaaaaaaaaaaagaaauccugucuggcuggca

SEQ ID NO: 32954 - RNA, 64 nt, Homo Sapiens
agguggguuggggggacccuagauuucaaguaaaaaaaaaaaaaagaaauccugucuggcuggc

SEQ ID NO: 32955 - RNA, 64 nt, Homo Sapiens
aagguggguuggggggaccccagauuucaaguaaaaaaaaaaaacagaaauccugucuggcugg

SEQ ID NO: 32956 - RNA, 64 nt, Homo Sapiens
aaagguggguuggggggaccgcagauuucaaguaaaaaaaaaaaucagaaauccugucuggcug

SEQ ID NO: 32957 - RNA, 64 nt, Homo Sapiens
aaaagguggguuggggggacggcagauuucaaguaaaaaaaaaacucagaaauccugucuggcu

SEQ ID NO: 32958 - RNA, 64 nt, Homo Sapiens
acgugaccuuaugaggcucuaaaagaaaaaaaagaaaaaaaagcaaagcgaaacucugucucaa

SEQ ID NO: 32959 - RNA, 64 nt, Homo Sapiens
aaaaaaagcacgugaccuuacugucucaaaaaagaaaaaaaagaugggcaacaaaagcgaaacu

SEQ ID NO: 32960 - RNA, 64 nt, Homo Sapiens
gguggguggauuacuugaggucugucucaaaaaaaaaaaaaagacugggcaacaagagcgaaac

SEQ ID NO: 32961 - RNA, 64 nt, Homo Sapiens
agguggguggauuacuugagcucugucucaaaaaaaaaaaaaagccugggcaacaagagcgaaa

SEQ ID NO: 32962 - RNA, 64 nt, Homo Sapiens
gagguggguggauuacuugaacucugucucaaaaaaaaaaaaaagccugggcaacaagagcgaa

SEQ ID NO: 32963 - RNA, 64 nt, Homo Sapiens
agagguggguggauuacuugaacucugucucaaaaaaaaaaaaaagccugggcaacaagagcga

SEQ ID NO: 32964 - RNA, 64 nt, Homo Sapiens
aagagguggguggauuacuuaaacucugucucaaaaaaaaaaaacagccugggcaacaagagcg

SEQ ID NO: 32965 - RNA, 64 nt, Homo Sapiens
aaagagguggguggauuacugaaacucugucucaaaaaaaaaaaccagccugggcaacaagagc

SEQ ID NO: 32966 - RNA, 64 nt, Homo Sapiens
aaaagagguggguggauuaccgaaacucugucucaaaaaaaaaauccagccugggcaacaagag

SEQ ID NO: 32967 - RNA, 64 nt, Homo Sapiens
uaaaaaugaggaaccaagugcuguauuuaauuuaaaaaaaaacauucauuuauacuuugauaac

SEQ ID NO: 32968 - RNA, 64 nt, Homo Sapiens
auaaaaaugaggaaccaaguccuguauuuaauuuaaaaaaaaacuuucauuuauacuuugauaa

SEQ ID NO: 32969 - RNA, 64 nt, Homo Sapiens
uaaaaaauaaaaaaaguuuuuaaaauaaaaacuuaaaaaaaauucuuuuacuuuguagauaaua

SEQ ID NO: 32970 - RNA, 64 nt, Homo Sapiens
aagacuuggaacgcccuuuuuaaaaaaaaaaaaaaaaaaaaaucauucuugcugcuauuacugc

SEQ ID NO: 32971 - RNA, 64 nt, Homo Sapiens
caagacuuggaacgcccuuucuaaaaaaaaaaaaaaaaaaaaaugauucuugcugcuauuacug

SEQ ID NO: 32972 - RNA, 64 nt, Homo Sapiens
ucaagacuuggaacgcccuugcuaaaaaaaaaaaaaaaaaaaaaugauucuugcugcuauuacu

SEQ ID NO: 32973 - RNA, 64 nt, Homo Sapiens
aucaagacuuggaacgcccuugcuaaaaaaaaaaaaaaaaaaaagugauucuugcugcuauuac

SEQ ID NO: 32974 - RNA, 64 nt, Homo Sapiens
aaucaagacuuggaacgccccugcuaaaaaaaaaaaaaaaaaaaagugauucuugcugcuauua

SEQ ID NO: 32975 - RNA, 64 nt, Homo Sapiens
aaaucaagacuuggaacgccacugcuaaaaaaaaaaaaaaaaaagagugauucuugcugcuauu

SEQ ID NO: 32976 - RNA, 64 nt, Homo Sapiens
aaaaucaagacuuggaacgcuacugcuaaaaaaaaaaaaaaaaaagagugauucuugcugcuau

SEQ ID NO: 32977 - RNA, 64 nt, Homo Sapiens
aaaaaucaagacuuggaacguuacugcuaaaaaaaaaaaaaaaaaagagugauucuugcugcua

SEQ ID NO: 32978 - RNA, 64 nt, Homo Sapiens
aaaaaaucaagacuuggaacauuacugcuaaaaaaaaaaaaaaacaagagugauucuugcugcu

SEQ ID NO: 32979 - RNA, 64 nt, Homo Sapiens
aaaaaaaucaagacuuggaauauuacugcuaaaaaaaaaaaaaaacaagagugauucuugcugc

SEQ ID NO: 32980 - RNA, 64 nt, Homo Sapiens
aaaaaaaaucaagacuuggacuauuacugcuaaaaaaaaaaaaaaacaagagugauucuugcug

SEQ ID NO: 32981 - RNA, 64 nt, Homo Sapiens
aaaaaaaaaucaagacuugggcuauuacugcuaaaaaaaaaaaauaacaagagugauucuugcu

SEQ ID NO: 32982 - RNA, 64 nt, Homo Sapiens
aaaaaaaaaaucaagacuugugcuauuacugcuaaaaaaaaaaaguaacaagagugauucuugc

SEQ ID NO: 32983 - RNA, 64 nt, Homo Sapiens
aaaaaaaaaaaucaagacuucugcuauuacugcuaaaaaaaaaaaguaacaagagugauucuug

SEQ ID NO: 32984 - RNA, 64 nt, Homo Sapiens
caaaauuucaaguguagagacucuuuuccaaauaaaaaaaaaguaagaaaagggauucaacugu

SEQ ID NO: 32985 - RNA, 64 nt, Homo Sapiens
ucaaaauuucaaguguagagucucuuuuccaaauaaaaaaaaagaaagaaaagggauucaacug

SEQ ID NO: 32986 - RNA, 64 nt, Homo Sapiens
gggacaagugaacacauuaaacaaaaucuuucaaaaaaaaaaucugugucaaguggaaacaaaa

SEQ ID NO: 32987 - RNA, 64 nt, Homo Sapiens
cgggacaagugaacacauuaaacaaaaucuuucaaaaaaaaaaucugugucaaguggaaacaaa

SEQ ID NO: 32988 - RNA, 64 nt, Homo Sapiens
ucgggacaagugaacacauuaaacaaaaucuuucaaaaaaaaaaacugugucaaguggaaacaa

SEQ ID NO: 32989 - RNA, 64 nt, Homo Sapiens
gcagcaaaggguaguuuucauacaaaaaaacuuuaaaaaaaaugcacaaaaaauaaaaaacccc

SEQ ID NO: 32990 - RNA, 64 nt, Homo Sapiens
caaaaaauaaaaaaccccuacuaagcagaaaaagaaaaaaaacaucuucccuagaaacccaauu

SEQ ID NO: 32991 - RNA, 64 nt, Homo Sapiens
uguguggugggaaugugaaaaaaacauuauauuaaaaaaaaagucuugaaauaaucuaaaguuu

SEQ ID NO: 32992 - RNA, 64 nt, Homo Sapiens
uuguguggugggaaugugaauaaaacauuauauuaaaaaaaaagucuugaaauaaucuaaaguu

SEQ ID NO: 32993 - RNA, 64 nt, Homo Sapiens
uuuguuaauuaauguggccuucuccaauaaaaaaaaaaaaaagggugggacuucgcuguuuuua

SEQ ID NO: 32994 - RNA, 64 nt, Homo Sapiens
guuuguuaauuaauguggccaucuccaauaaaaaaaaaaaaaagugugggacuucgcuguuuuu

SEQ ID NO: 32995 - RNA, 64 nt, Homo Sapiens
gguuuguuaauuaauguggcuaucuccaauaaaaaaaaaaaaaaaugugggacuucgcuguuuu

SEQ ID NO: 32996 - RNA, 64 nt, Homo Sapiens
agguuuguuaauuaaugugguuaucuccaauaaaaaaaaaaaaauaugugggacuucgcuguuu

SEQ ID NO: 32997 - RNA, 64 nt, Homo Sapiens
aagguuuguuaauuaauguguuuaucuccaauaaaaaaaaaaaaguaugugggacuucgcuguu

SEQ ID NO: 32998 - RNA, 64 nt, Homo Sapiens
aaagguuuguuaauuaauguuuuuaucuccaauaaaaaaaaaaagguaugugggacuucgcugu

SEQ ID NO: 32999 - RNA, 64 nt, Homo Sapiens
aaaagguuuguuaauuaauguuuuuaucuccaauaaaaaaaaaaugguaugugggacuucgcug

SEQ ID NO: 33000 - RNA, 64 nt, Homo Sapiens
uuuugaagggaaaaaaaguggaaccuuaaaaaaaaaaaaaaaggcaggaaaaaaaaaaauuaau

SEQ ID NO: 33001 - RNA, 64 nt, Homo Sapiens
guuuugaagggaaaaaaaguugaaccuuaaaaaaaaaaaaaaagucaggaaaaaaaaaaauuaa

SEQ ID NO: 33002 - RNA, 64 nt, Homo Sapiens
gguuuugaagggaaaaaaagaugaaccuuaaaaaaaaaaaaaaaaucaggaaaaaaaaaaauua

SEQ ID NO: 33003 - RNA, 64 nt, Homo Sapiens
agguuuugaagggaaaaaaaaaugaaccuuaaaaaaaaaaaaaaaaucaggaaaaaaaaaaauu

SEQ ID NO: 33004 - RNA, 64 nt, Homo Sapiens
aagguuuugaagggaaaaaauaaugaaccuuaaaaaaaaaaaaauaaucaggaaaaaaaaaaau

SEQ ID NO: 33005 - RNA, 64 nt, Homo Sapiens
aaagguuuugaagggaaaaauuaaugaaccuuaaaaaaaaaaaaguaaucaggaaaaaaaaaaa

SEQ ID NO: 33006 - RNA, 64 nt, Homo Sapiens
aaaagguuuugaagggaaaaauuaaugaaccuuaaaaaaaaaaauguaaucaggaaaaaaaaaa

SEQ ID NO: 33007 - RNA, 64 nt, Homo Sapiens
aaaaagguuuugaagggaaaaauuaaugaaccuuaaaaaaaaaauuguaaucaggaaaaaaaaa

SEQ ID NO: 33008 - RNA, 64 nt, Homo Sapiens
aaugaaccuuaaaaaaaaaauuguaaucaggaaaaaaaaaaauucaaaaaaugagguuuugcuu

SEQ ID NO: 33009 - RNA, 64 nt, Homo Sapiens
uaaugaaccuuaaaaaaaaauuuguaaucaggaaaaaaaaaaauccaaaaaaugagguuuugcu

SEQ ID NO: 33010 - RNA, 64 nt, Homo Sapiens
uuaaugaaccuuaaaaaaaauuuuguaaucaggaaaaaaaaaaaaccaaaaaaugagguuuugc

SEQ ID NO: 33011 - RNA, 64 nt, Homo Sapiens
auuaaugaaccuuaaaaaaacuuuuguaaucaggaaaaaaaaaagaccaaaaaaugagguuuug

SEQ ID NO: 33012 - RNA, 64 nt, Homo Sapiens
ccccuuuuaaaacaagcagguuuuccauuaagaaaaaaaaaaguuuuggcucucuguuucauuu

SEQ ID NO: 33013 - RNA, 64 nt, Homo Sapiens
uccccuuuuaaaacaagcaguuuuuccauuaagaaaaaaaaaaguuuuggcucucuguuucauu

SEQ ID NO: 33014 - RNA, 64 nt, Homo Sapiens
guccccuuuuaaaacaagcauuuuuuccauuaagaaaaaaaaaacuuuuggcucucuguuucau

SEQ ID NO: 33015 - RNA, 64 nt, Homo Sapiens
cuuuacuucuuuugcaugcaaaaaaaugaugaaaaaaaaaaaggacuguguauuuucuuacaau

SEQ ID NO: 33016 - RNA, 64 nt, Homo Sapiens
gcuuuacuucuuuugcaugcuaaaaaaugaugaaaaaaaaaaagaacuguguauuuucuuacaa

SEQ ID NO: 33017 - RNA, 64 nt, Homo Sapiens
ggcuuuacuucuuuugcaugauaaaaaaugaugaaaaaaaaaaaaaacuguguauuuucuuaca

SEQ ID NO: 33018 - RNA, 64 nt, Homo Sapiens
aggcuuuacuucuuuugcauaauaaaaaaugaugaaaaaaaaaacaaacuguguauuuucuuac

SEQ ID NO: 33019 - RNA, 64 nt, Homo Sapiens
aaguuuuauuaaagauugaauauucaucaggaauaaaaaaaacauauuuuauuuuuuugguauu

SEQ ID NO: 33020 - RNA, 64 nt, Homo Sapiens
aaacagaaaaaaauucagacuuacaaaaaaaaaaaaaaaaaagagagauuaaauuuuuugccau

SEQ ID NO: 33021 - RNA, 64 nt, Homo Sapiens
aaaacagaaaaaaauucagauuuacaaaaaaaaaaaaaaaaaagugagauuaaauuuuuugcca

SEQ ID NO: 33022 - RNA, 64 nt, Homo Sapiens
gaaaacagaaaaaaauucagauuuacaaaaaaaaaaaaaaaaaaaugagauuaaauuuuuugcc

SEQ ID NO: 33023 - RNA, 64 nt, Homo Sapiens
agaaaacagaaaaaaauucacauuuacaaaaaaaaaaaaaaaaagaugagauuaaauuuuuugc

SEQ ID NO: 33024 - RNA, 64 nt, Homo Sapiens
aagaaaacagaaaaaaauucccauuuacaaaaaaaaaaaaaaaaagaugagauuaaauuuuuug

SEQ ID NO: 33025 - RNA, 64 nt, Homo Sapiens
aaagaaaacagaaaaaaauugccauuuacaaaaaaaaaaaaaaacagaugagauuaaauuuuuu

SEQ ID NO: 33026 - RNA, 64 nt, Homo Sapiens
aaaagaaaacagaaaaaaauugccauuuacaaaaaaaaaaaaaaacagaugagauuaaauuuuu

SEQ ID NO: 33027 - RNA, 64 nt, Homo Sapiens
aaaaagaaaacagaaaaaaauugccauuuacaaaaaaaaaaaaauacagaugagauuaaauuuu

SEQ ID NO: 33028 - RNA, 64 nt, Homo Sapiens
aaaaaagaaaacagaaaaaauuugccauuuacaaaaaaaaaaaacuacagaugagauuaaauuu

SEQ ID NO: 33029 - RNA, 64 nt, Homo Sapiens
aaaaaaagaaaacagaaaaauuuugccauuuacaaaaaaaaaaaacuacagaugagauuaaauu

SEQ ID NO: 33030 - RNA, 64 nt, Homo Sapiens
aaaaaaaagaaaacagaaaauuuuugccauuuacaaaaaaaaaagacuacagaugagauuaaau

SEQ ID NO: 33031 - RNA, 64 nt, Homo Sapiens
ggaaauugaauugguuucuauuuauauucguaaaaaaaaaaagauguacauauuuacaagaaac

SEQ ID NO: 33032 - RNA, 64 nt, Homo Sapiens
aggaaauugaauugguuucucuuuauauucguaaaaaaaaaaagcuguacauauuuacaagaaa

SEQ ID NO: 33033 - RNA, 64 nt, Homo Sapiens
gaggaaauugaauugguuucacuuuauauucguaaaaaaaaaaaacuguacauauuuacaagaa

SEQ ID NO: 33034 - RNA, 64 nt, Homo Sapiens
agaggaaauugaauugguuuaacuuuauauucguaaaaaaaaaagacuguacauauuuacaaga

SEQ ID NO: 33035 - RNA, 64 nt, Homo Sapiens
aaaaaagcaacacaauccugacuccuuuaagaaaaaaaaaaagguguauauuuuccaugcccuc

SEQ ID NO: 33036 - RNA, 64 nt, Homo Sapiens
gaaaaaagcaacacaauccucacuccuuuaagaaaaaaaaaaagcuguauauuuuccaugcccu

SEQ ID NO: 33037 - RNA, 64 nt, Homo Sapiens
ggaaaaaagcaacacaauccucacuccuuuaagaaaaaaaaaaagcuguauauuuuccaugccc

SEQ ID NO: 33038 - RNA, 64 nt, Homo Sapiens
aggaaaaaagcaacacaauccucacuccuuuaagaaaaaaaaaaugcuguauauuuuccaugcc

SEQ ID NO: 33039 - RNA, 64 nt, Homo Sapiens
acuugacuccaugacgucgaaaaggggacaaaaaaaaaaaaaggguuuuuuccuuuguuguuuu

SEQ ID NO: 33040 - RNA, 64 nt, Homo Sapiens
gacuugacuccaugacgucguaaaggggacaaaaaaaaaaaaaguguuuuuuccuuuguuguuu

SEQ ID NO: 33041 - RNA, 64 nt, Homo Sapiens
ggacuugacuccaugacgucuuaaaggggacaaaaaaaaaaaaauuguuuuuuccuuuguuguu

SEQ ID NO: 33042 - RNA, 64 nt, Homo Sapiens
aggacuugacuccaugacguuuuaaaggggacaaaaaaaaaaaauuuguuuuuuccuuuguugu

SEQ ID NO: 33043 - RNA, 64 nt, Homo Sapiens
aaggacuugacuccaugacguuuuaaaggggacaaaaaaaaaaaauuuguuuuuuccuuuguug

SEQ ID NO: 33044 - RNA, 64 nt, Homo Sapiens
aaaggacuugacuccaugacguuuuaaaggggacaaaaaaaaaauauuuguuuuuuccuuuguu

SEQ ID NO: 33045 - RNA, 64 nt, Homo Sapiens
aauaaacuguuacuuauauuauaucucacuguaaaaaaaaaauuaucaccugcuucccauagcc

SEQ ID NO: 33046 - RNA, 64 nt, Homo Sapiens
uaauaaacuguuacuuauaucauaucucacuguaaaaaaaaaauuaucaccugcuucccauagc

SEQ ID NO: 33047 - RNA, 64 nt, Homo Sapiens
uuaauaaacuguuacuuauaccauaucucacuguaaaaaaaaaaguaucaccugcuucccauag

SEQ ID NO: 33048 - RNA, 64 nt, Homo Sapiens
uacaaagaaauaugucucaaugugggguuaaaaaaaaaaaaagaugguagacuuaaggcuucau

SEQ ID NO: 33049 - RNA, 64 nt, Homo Sapiens
auacaaagaaauaugucucauugugggguuaaaaaaaaaaaaaggugguagacuuaaggcuuca

SEQ ID NO: 33050 - RNA, 64 nt, Homo Sapiens
gauacaaagaaauaugucucauugugggguuaaaaaaaaaaaaaugugguagacuuaaggcuuc

SEQ ID NO: 33051 - RNA, 64 nt, Homo Sapiens
agauacaaagaaauaugucucauugugggguuaaaaaaaaaaaagugugguagacuuaaggcuu

SEQ ID NO: 33052 - RNA, 64 nt, Homo Sapiens
aagauacaaagaaauaugucucauugugggguuaaaaaaaaaaaagugugguagacuuaaggcu

SEQ ID NO: 33053 - RNA, 64 nt, Homo Sapiens
aaagauacaaagaaauauguuucauugugggguuaaaaaaaaaacagugugguagacuuaaggc

SEQ ID NO: 33054 - RNA, 64 nt, Homo Sapiens
gccgggcgcgguggcaaaugaacuccgucucaaaaaaaaaaauuagccugggcaacaagagcaa

SEQ ID NO: 33055 - RNA, 64 nt, Homo Sapiens
ugccgggcgcgguggcaaauaaacuccgucucaaaaaaaaaaaucagccugggcaacaagagca

SEQ ID NO: 33056 - RNA, 64 nt, Homo Sapiens
uugccgggcgcgguggcaaaaaaacuccgucucaaaaaaaaaaaccagccugggcaacaagagc

SEQ ID NO: 33057 - RNA, 64 nt, Homo Sapiens
auugccgggcgcgguggcaacaaaacuccgucucaaaaaaaaaauccagccugggcaacaagag

SEQ ID NO: 33058 - RNA, 64 nt, Homo Sapiens
caguagccaauugaaaauguauaucccaaaauuuaaaaaaaaaaguaccagcagcaauaaaauu

SEQ ID NO: 33059 - RNA, 64 nt, Homo Sapiens
aguagccaauugaaaauguauaucccaaaauuuaaaaaaaaaaguaccagcagcaauaaaauug

SEQ ID NO: 33060 - RNA, 64 nt, Homo Sapiens
guagccaauugaaaauguauaucccaaaauuuaaaaaaaaaaguaccagcagcaauaaaauugc

SEQ ID NO: 33061 - RNA, 64 nt, Homo Sapiens
uggccaaggugauaaaacccgucucuacuaauacaaaaaaaauuagcuggguauguuggugcag

SEQ ID NO: 33062 - RNA, 64 nt, Homo Sapiens
aaaccccaucucuacuaaaaauauaaaaaucagcaaaaaaaauuuagccaggcuuggucaugca

SEQ ID NO: 33063 - RNA, 64 nt, Homo Sapiens
gugaacuuaaagcaaagaccucuuaguaaaaaauaaaaaaaaauaaaaaauaaaaauaaaaaaa

SEQ ID NO: 33064 - RNA, 64 nt, Homo Sapiens
ugaacuuaaagcaaagaccucuuaguaaaaaauaaaaaaaaauaaaaaauaaaaauaaaaaaag

SEQ ID NO: 33065 - RNA, 64 nt, Homo Sapiens
gaagaaaaauaucuaaacaucgagaaacuaugggaaaaaaaauugcaaaaucuaaaauaaaaaa

SEQ ID NO: 33066 - RNA, 64 nt, Homo Sapiens
augcuaguccuagauuacuuauugauuuaaaaacaaaaaaaagauuacuuaauuuugauuuaaa

SEQ ID NO: 33067 - RNA, 58 nt, Homo Sapiens
ccuaugaauucauggcauaauagguguuaaaaaaaaaaauaaaggaccucugggcuac

SEQ ID NO: 33068 - RNA, 59 nt, Homo Sapiens
ccuaugaauucauggcauaauagguguuaaaaaaaaaaauaaaggaccucugggcuaca

SEQ ID NO: 33069 - RNA, 60 nt, Homo Sapiens
ccuaugaauucauggcauaauagguguuaaaaaaaaaaauaaaggaccucugggcuacaa

SEQ ID NO: 33070 - RNA, 61 nt, Homo Sapiens
ccuaugaauucauggcauaauagguguuaaaaaaaaaaauaaaggaccucugggcuacaaa

SEQ ID NO: 33071 - RNA, 64 nt, Homo Sapiens
uaauugauauucuguucagaacuuucuuuagacuaaaaaaaaaaaaaaagacaaaauacacguu

SEQ ID NO: 33072 - RNA, 64 nt, Homo Sapiens
aauugauauucuguucagaacuuucuuuagacuaaaaaaaaaaaaaaagacaaaauacacguug

SEQ ID NO: 33073 - RNA, 64 nt, Homo Sapiens
auugauauucuguucagaacuuucuuuagacuaaaaaaaaaaaaaaagacaaaauacacguuga

SEQ ID NO: 33074 - RNA, 64 nt, Homo Sapiens
uugauauucuguucagaacuuucuuuagacuaaaaaaaaaaaaaaagacaaaauacacguugac

SEQ ID NO: 33075 - RNA, 64 nt, Homo Sapiens
ugauauucuguucagaacuuucuuuagacuaaaaaaaaaaaaaaagacaaaauacacguugacc

SEQ ID NO: 33076 - RNA, 64 nt, Homo Sapiens
gauauucuguucagaacuuucuuuagacuaaaaaaaaaaaaaaagacaaaauacacguugacca

SEQ ID NO: 33077 - RNA, 64 nt, Homo Sapiens
auauucuguucagaacuuucuuuagacuaaaaaaaaaaaaaaagacaaaauacacguugaccau

SEQ ID NO: 33078 - RNA, 64 nt, Homo Sapiens
uauucuguucagaacuuucuuuagacuaaaaaaaaaaaaaaagacaaaauacacguugaccaug

SEQ ID NO: 33079 - RNA, 64 nt, Homo Sapiens
ugggcaacauagggagacccccaucuuuacaaagaaaaaaaaaaggggaaaagaaaaucuuuua

SEQ ID NO: 33080 - RNA, 64 nt, Homo Sapiens
gggcaacauagggagacccccaucuuuacaaagaaaaaaaaaaggggaaaagaaaaucuuuuaa

SEQ ID NO: 33081 - RNA, 64 nt, Homo Sapiens
ggcaacauagggagacccccaucuuuacaaagaaaaaaaaaaggggaaaagaaaaucuuuuaaa

SEQ ID NO: 33082 - RNA, 64 nt, Homo Sapiens
cugcaucccauuuccagccucuuuucaagcugagaaaaaaaaaaaaaaacacguuugauacuuu

SEQ ID NO: 33083 - RNA, 64 nt, Homo Sapiens
ugcaucccauuuccagccucuuuucaagcugagaaaaaaaaaaaaaaacacguuugauacuuug

SEQ ID NO: 33084 - RNA, 64 nt, Homo Sapiens
gcaucccauuuccagccucuuuucaagcugagaaaaaaaaaaaaaaacacguuugauacuuugu

SEQ ID NO: 33085 - RNA, 64 nt, Homo Sapiens
caucccauuuccagccucuuuucaagcugagaaaaaaaaaaaaaaacacguuugauacuuugua

SEQ ID NO: 33086 - RNA, 64 nt, Homo Sapiens
aucccauuuccagccucuuuucaagcugagaaaaaaaaaaaaaaacacguuugauacuuuguac

SEQ ID NO: 33087 - RNA, 64 nt, Homo Sapiens
ucccauuuccagccucuuuucaagcugagaaaaaaaaaaaaaaacacguuugauacuuuguaca

SEQ ID NO: 33088 - RNA, 64 nt, Homo Sapiens
cccauuuccagccucuuuucaagcugagaaaaaaaaaaaaaaacacguuugauacuuuguacau

SEQ ID NO: 33089 - RNA, 64 nt, Homo Sapiens
ccauuuccagccucuuuucaagcugagaaaaaaaaaaaaaaacacguuugauacuuuguacauc

SEQ ID NO: 33090 - RNA, 64 nt, Homo Sapiens
aggaacagaguauuauugcacagaucugaagaucaaaaaaaagcucaaggaaauacagaucgga

SEQ ID NO: 33091 - RNA, 64 nt, Homo Sapiens
ucuucucuaucauaggcccuaaguucauugggggaaaaaaaauaagaagauucaacagaaucag

SEQ ID NO: 33092 - RNA, 64 nt, Homo Sapiens
aucccagugugccugauuugacauucuugucagcaaaaaaaaacuuaauuucuaguaaaucuau

SEQ ID NO: 33093 - RNA, 64 nt, Homo Sapiens
ucccagugugccugauuugacauucuugucagcaaaaaaaaacuuaauuucuaguaaaucuaua

SEQ ID NO: 33094 - RNA, 64 nt, Homo Sapiens
cuccagacugggugacacagcgagacuucaucucaaaaaaaaaaagaaaagaaaagcaauugua

SEQ ID NO: 33095 - RNA, 64 nt, Homo Sapiens
uccagacugggugacacagcgagacuucaucucaaaaaaaaaaagaaaagaaaagcaauuguac

SEQ ID NO: 33096 - RNA, 64 nt, Homo Sapiens
ccagacugggugacacagcgagacuucaucucaaaaaaaaaaagaaaagaaaagcaauuguacu

SEQ ID NO: 33097 - RNA, 64 nt, Homo Sapiens
cagacugggugacacagcgagacuucaucucaaaaaaaaaaagaaaagaaaagcaauuguacuu

SEQ ID NO: 33098 - RNA, 64 nt, Homo Sapiens
accaaacauugaugcuuaaggaccacacugaaggaaaaaaaaagaggggacuucgaaaaaaaaa

SEQ ID NO: 33099 - RNA, 64 nt, Homo Sapiens
ccaaacauugaugcuuaaggaccacacugaaggaaaaaaaaagaggggacuucgaaaaaaaaaa

SEQ ID NO: 33100 - RNA, 64 nt, Homo Sapiens
accacacugaaggaaaaaaaaagaggggacuucgaaaaaaaaaaaagcccugcaaaauauucua

SEQ ID NO: 33101 - RNA, 64 nt, Homo Sapiens
ccacacugaaggaaaaaaaaagaggggacuucgaaaaaaaaaaaagcccugcaaaauauucuaa

SEQ ID NO: 33102 - RNA, 64 nt, Homo Sapiens
cacacugaaggaaaaaaaaagaggggacuucgaaaaaaaaaaaagcccugcaaaauauucuaaa

SEQ ID NO: 33103 - RNA, 64 nt, Homo Sapiens
acacugaaggaaaaaaaaagaggggacuucgaaaaaaaaaaaagcccugcaaaauauucuaaaa

SEQ ID NO: 33104 - RNA, 64 nt, Homo Sapiens
cacugaaggaaaaaaaaagaggggacuucgaaaaaaaaaaaagcccugcaaaauauucuaaaac

SEQ ID NO: 33105 - RNA, 64 nt, Homo Sapiens
cugggugaaaaagacaggcugugucuccaaaaagaaaaaaaaaagucaaauucaaauaucaucu

SEQ ID NO: 33106 - RNA, 64 nt, Homo Sapiens
ugggugaaaaagacaggcugugucuccaaaaagaaaaaaaaaagucaaauucaaauaucaucug

SEQ ID NO: 33107 - RNA, 64 nt, Homo Sapiens
gggugaaaaagacaggcugugucuccaaaaagaaaaaaaaaagucaaauucaaauaucaucugg

SEQ ID NO: 33108 - RNA, 64 nt, Homo Sapiens
ucaauaaaauauuuuauuuauucauuaauuuaacaaaaaaaacagagcauuuaguuuguggcaa

SEQ ID NO: 33109 - RNA, 64 nt, Homo Sapiens
uaaguggcuaugcaagcaaaagcauagauagguuaaaaaaaaggaucagcuggcugggcagggu

SEQ ID NO: 33110 - RNA, 64 nt, Homo Sapiens
agcuucguaaacauagcaagacccagucucuaccaaaaaaaaaaaaaaaaaaaaaaaaaaaaaa

SEQ ID NO: 33111 - RNA, 64 nt, Homo Sapiens
gcuucguaaacauagcaagacccagucucuaccaaaaaaaaaaaaaaaaaaaaaaaaaaaaaaa

SEQ ID NO: 33112 - RNA, 64 nt, Homo Sapiens
cuucguaaacauagcaagacccagucucuaccaaaaaaaaaaaaaaaaaaaaaaaaaaaaaaaa

SEQ ID NO: 33113 - RNA, 64 nt, Homo Sapiens
uucguaaacauagcaagacccagucucuaccaaaaaaaaaaaaaaaaaaaaaaaaaaaaaaaau

SEQ ID NO: 33114 - RNA, 64 nt, Homo Sapiens
ucguaaacauagcaagacccagucucuaccaaaaaaaaaaaaaaaaaaaaaaaaaaaaaaaaua

SEQ ID NO: 33115 - RNA, 64 nt, Homo Sapiens
cguaaacauagcaagacccagucucuaccaaaaaaaaaaaaaaaaaaaaaaaaaaaaaaaauau

SEQ ID NO: 33116 - RNA, 64 nt, Homo Sapiens
guaaacauagcaagacccagucucuaccaaaaaaaaaaaaaaaaaaaaaaaaaaaaaaaauaua

SEQ ID NO: 33117 - RNA, 64 nt, Homo Sapiens
uaaacauagcaagacccagucucuaccaaaaaaaaaaaaaaaaaaaaaaaaaaaaaaaauauau

SEQ ID NO: 33118 - RNA, 64 nt, Homo Sapiens
aaacauagcaagacccagucucuaccaaaaaaaaaaaaaaaaaaaaaaaaaaaaaaaauauaua

SEQ ID NO: 33119 - RNA, 64 nt, Homo Sapiens
aacauagcaagacccagucucuaccaaaaaaaaaaaaaaaaaaaaaaaaaaaaaaaauauauau

SEQ ID NO: 33120 - RNA, 64 nt, Homo Sapiens
acauagcaagacccagucucuaccaaaaaaaaaaaaaaaaaaaaaaaaaaaaaaaauauauaua

SEQ ID NO: 33121 - RNA, 64 nt, Homo Sapiens
cauagcaagacccagucucuaccaaaaaaaaaaaaaaaaaaaaaaaaaaaaaaaauauauauau

SEQ ID NO: 33122 - RNA, 64 nt, Homo Sapiens
auagcaagacccagucucuaccaaaaaaaaaaaaaaaaaaaaaaaaaaaaaaaauauauauaua

SEQ ID NO: 33123 - RNA, 64 nt, Homo Sapiens
uagcaagacccagucucuaccaaaaaaaaaaaaaaaaaaaaaaaaaaaaaaaauauauauauau

SEQ ID NO: 33124 - RNA, 64 nt, Homo Sapiens
agcaagacccagucucuaccaaaaaaaaaaaaaaaaaaaaaaaaaaaaaaaauauauauauaua

SEQ ID NO: 33125 - RNA, 64 nt, Homo Sapiens
gcaagacccagucucuaccaaaaaaaaaaaaaaaaaaaaaaaaaaaaaaaauauauauauauau

SEQ ID NO: 33126 - RNA, 64 nt, Homo Sapiens
caagacccagucucuaccaaaaaaaaaaaaaaaaaaaaaaaaaaaaaaaauauauauauauaua

SEQ ID NO: 33127 - RNA, 64 nt, Homo Sapiens
aagacccagucucuaccaaaaaaaaaaaaaaaaaaaaaaaaaaaaaaaauauauauauauauau

SEQ ID NO: 33128 - RNA, 64 nt, Homo Sapiens
agacccagucucuaccaaaaaaaaaaaaaaaaaaaaaaaaaaaaaaaauauauauauauauaua

SEQ ID NO: 33129 - RNA, 64 nt, Homo Sapiens
gacccagucucuaccaaaaaaaaaaaaaaaaaaaaaaaaaaaaaaaauauauauauauauauac

SEQ ID NO: 33130 - RNA, 64 nt, Homo Sapiens
acccagucucuaccaaaaaaaaaaaaaaaaaaaaaaaaaaaaaaaauauauauauauauauaca

SEQ ID NO: 33131 - RNA, 64 nt, Homo Sapiens
cccagucucuaccaaaaaaaaaaaaaaaaaaaaaaaaaaaaaaaauauauauauauauauacac

SEQ ID NO: 33132 - RNA, 64 nt, Homo Sapiens
ccagucucuaccaaaaaaaaaaaaaaaaaaaaaaaaaaaaaaaauauauauauauauauacaca

SEQ ID NO: 33133 - RNA, 64 nt, Homo Sapiens
cagucucuaccaaaaaaaaaaaaaaaaaaaaaaaaaaaaaaaauauauauauauauauacacac

SEQ ID NO: 33134 - RNA, 64 nt, Homo Sapiens
agucucuaccaaaaaaaaaaaaaaaaaaaaaaaaaaaaaaaauauauauauauauauacacaca

SEQ ID NO: 33135 - RNA, 64 nt, Homo Sapiens
uggggagggagaaugcuuuuccccucccaguaauaaaaaaaaaaaaaaaaaaaauauauauaua

SEQ ID NO: 33136 - RNA, 64 nt, Homo Sapiens
ggggagggagaaugcuuuuccccucccaguaauaaaaaaaaaaaaaaaaaaaauauauauauau

SEQ ID NO: 33137 - RNA, 64 nt, Homo Sapiens
gggagggagaaugcuuuuccccucccaguaauaaaaaaaaaaaaaaaaaaaauauauauauaua

SEQ ID NO: 33138 - RNA, 64 nt, Homo Sapiens
ggagggagaaugcuuuuccccucccaguaauaaaaaaaaaaaaaaaaaaaauauauauauauau

SEQ ID NO: 33139 - RNA, 64 nt, Homo Sapiens
gagggagaaugcuuuuccccucccaguaauaaaaaaaaaaaaaaaaaaaauauauauauauaua

SEQ ID NO: 33140 - RNA, 64 nt, Homo Sapiens
agggagaaugcuuuuccccucccaguaauaaaaaaaaaaaaaaaaaaaauauauauauauauau

SEQ ID NO: 33141 - RNA, 64 nt, Homo Sapiens
gggagaaugcuuuuccccucccaguaauaaaaaaaaaaaaaaaaaaaauauauauauauauaua

SEQ ID NO: 33142 - RNA, 64 nt, Homo Sapiens
ggagaaugcuuuuccccucccaguaauaaaaaaaaaaaaaaaaaaaauauauauauauauauau

SEQ ID NO: 33143 - RNA, 64 nt, Homo Sapiens
gagaaugcuuuuccccucccaguaauaaaaaaaaaaaaaaaaaaaauauauauauauauauaua

SEQ ID NO: 33144 - RNA, 64 nt, Homo Sapiens
agaaugcuuuuccccucccaguaauaaaaaaaaaaaaaaaaaaaauauauauauauauauauau

SEQ ID NO: 33145 - RNA, 64 nt, Homo Sapiens
gaaugcuuuuccccucccaguaauaaaaaaaaaaaaaaaaaaaauauauauauauauauauaua

SEQ ID NO: 33146 - RNA, 64 nt, Homo Sapiens
aaugcuuuuccccucccaguaauaaaaaaaaaaaaaaaaaaaauauauauauauauauauauau

SEQ ID NO: 33147 - RNA, 64 nt, Homo Sapiens
augcuuuuccccucccaguaauaaaaaaaaaaaaaaaaaaaauauauauauauauauauauaua

SEQ ID NO: 33148 - RNA, 64 nt, Homo Sapiens
cacacuagcuugggugacagaggaagacugucucaaaaaaaaaaaaauugaucaaacugaugga

SEQ ID NO: 33149 - RNA, 64 nt, Homo Sapiens
acacuagcuugggugacagaggaagacugucucaaaaaaaaaaaaauugaucaaacugauggau

SEQ ID NO: 33150 - RNA, 64 nt, Homo Sapiens
cacuagcuugggugacagaggaagacugucucaaaaaaaaaaaaauugaucaaacugauggaua

SEQ ID NO: 33151 - RNA, 64 nt, Homo Sapiens
acuagcuugggugacagaggaagacugucucaaaaaaaaaaaaauugaucaaacugauggauac

SEQ ID NO: 33152 - RNA, 64 nt, Homo Sapiens
cuagcuugggugacagaggaagacugucucaaaaaaaaaaaaauugaucaaacugauggauacc

SEQ ID NO: 33153 - RNA, 64 nt, Homo Sapiens
uagcuugggugacagaggaagacugucucaaaaaaaaaaaaauugaucaaacugauggauaccc

SEQ ID NO: 33154 - RNA, 64 nt, Homo Sapiens
aaacgacccuguggcugugagaaagugaaaaaagaaaaaaaaaaaggcauuggcauuuucuugu

SEQ ID NO: 33155 - RNA, 64 nt, Homo Sapiens
aacgacccuguggcugugagaaagugaaaaaagaaaaaaaaaaaggcauuggcauuuucuuguc

SEQ ID NO: 33156 - RNA, 64 nt, Homo Sapiens
acgacccuguggcugugagaaagugaaaaaagaaaaaaaaaaaggcauuggcauuuucuugucu

SEQ ID NO: 33157 - RNA, 64 nt, Homo Sapiens
cgacccuguggcugugagaaagugaaaaaagaaaaaaaaaaaggcauuggcauuuucuugucuc

SEQ ID NO: 33158 - RNA, 64 nt, Homo Sapiens
ggaacauuccauaucauuagucgaaaacaaaaacaaaaaaaaaaccuuuggucauuuguaagac

SEQ ID NO: 33159 - RNA, 64 nt, Homo Sapiens
gaacauuccauaucauuagucgaaaacaaaaacaaaaaaaaaaccuuuggucauuuguaagaca

SEQ ID NO: 33160 - RNA, 64 nt, Homo Sapiens
aacauuccauaucauuagucgaaaacaaaaacaaaaaaaaaaccuuuggucauuuguaagacau

SEQ ID NO: 33161 - RNA, 64 nt, Homo Sapiens
ggauguguuuguaugcauucuggacauuugaauuaaaaaaaaaguauugugauccuguaaagga

SEQ ID NO: 33162 - RNA, 64 nt, Homo Sapiens
gauguguuuguaugcauucuggacauuugaauuaaaaaaaaaguauugugauccuguaaaggau

SEQ ID NO: 33163 - RNA, 64 nt, Homo Sapiens
cuccagccugggcgcaagaccaagacuuaaacgcaaaaaaaaaaaaaaaaaaaaaaaaaaaguu

SEQ ID NO: 33164 - RNA, 64 nt, Homo Sapiens
uccagccugggcgcaagaccaagacuuaaacgcaaaaaaaaaaaaaaaaaaaaaaaaaaaguuu

SEQ ID NO: 33165 - RNA, 64 nt, Homo Sapiens
ccagccugggcgcaagaccaagacuuaaacgcaaaaaaaaaaaaaaaaaaaaaaaaaaaguuuc

SEQ ID NO: 33166 - RNA, 64 nt, Homo Sapiens
cagccugggcgcaagaccaagacuuaaacgcaaaaaaaaaaaaaaaaaaaaaaaaaaaguuuca

SEQ ID NO: 33167 - RNA, 64 nt, Homo Sapiens
agccugggcgcaagaccaagacuuaaacgcaaaaaaaaaaaaaaaaaaaaaaaaaaaguuucau

SEQ ID NO: 33168 - RNA, 64 nt, Homo Sapiens
gccugggcgcaagaccaagacuuaaacgcaaaaaaaaaaaaaaaaaaaaaaaaaaaguuucaua

SEQ ID NO: 33169 - RNA, 64 nt, Homo Sapiens
ccugggcgcaagaccaagacuuaaacgcaaaaaaaaaaaaaaaaaaaaaaaaaaaguuucauaa

SEQ ID NO: 33170 - RNA, 64 nt, Homo Sapiens
cugggcgcaagaccaagacuuaaacgcaaaaaaaaaaaaaaaaaaaaaaaaaaaguuucauaau

SEQ ID NO: 33171 - RNA, 64 nt, Homo Sapiens
ugggcgcaagaccaagacuuaaacgcaaaaaaaaaaaaaaaaaaaaaaaaaaaguuucauaaua

SEQ ID NO: 33172 - RNA, 64 nt, Homo Sapiens
gggcgcaagaccaagacuuaaacgcaaaaaaaaaaaaaaaaaaaaaaaaaaaguuucauaauac

SEQ ID NO: 33173 - RNA, 64 nt, Homo Sapiens
ggcgcaagaccaagacuuaaacgcaaaaaaaaaaaaaaaaaaaaaaaaaaaguuucauaauaca

SEQ ID NO: 33174 - RNA, 64 nt, Homo Sapiens
gcgcaagaccaagacuuaaacgcaaaaaaaaaaaaaaaaaaaaaaaaaaaguuucauaauacag

SEQ ID NO: 33175 - RNA, 64 nt, Homo Sapiens
cgcaagaccaagacuuaaacgcaaaaaaaaaaaaaaaaaaaaaaaaaaaguuucauaauacagc

SEQ ID NO: 33176 - RNA, 64 nt, Homo Sapiens
gcaagaccaagacuuaaacgcaaaaaaaaaaaaaaaaaaaaaaaaaaaguuucauaauacagca

SEQ ID NO: 33177 - RNA, 64 nt, Homo Sapiens
caagaccaagacuuaaacgcaaaaaaaaaaaaaaaaaaaaaaaaaaaguuucauaauacagcau

SEQ ID NO: 33178 - RNA, 64 nt, Homo Sapiens
aagaccaagacuuaaacgcaaaaaaaaaaaaaaaaaaaaaaaaaaaguuucauaauacagcaug

SEQ ID NO: 33179 - RNA, 64 nt, Homo Sapiens
agaccaagacuuaaacgcaaaaaaaaaaaaaaaaaaaaaaaaaaaguuucauaauacagcaugg

SEQ ID NO: 33180 - RNA, 64 nt, Homo Sapiens
gaccaagacuuaaacgcaaaaaaaaaaaaaaaaaaaaaaaaaaaguuucauaauacagcauggu

SEQ ID NO: 33181 - RNA, 64 nt, Homo Sapiens
accaagacuuaaacgcaaaaaaaaaaaaaaaaaaaaaaaaaaaguuucauaauacagcaugguc

SEQ ID NO: 33182 - RNA, 64 nt, Homo Sapiens
ccaagacuuaaacgcaaaaaaaaaaaaaaaaaaaaaaaaaaaguuucauaauacagcauggucu

SEQ ID NO: 33183 - RNA, 64 nt, Homo Sapiens
aguguuuaauaacuggcauuaagcuuagagggugaaaaaaaaaaaaaagauugauaguauuuuu

SEQ ID NO: 33184 - RNA, 64 nt, Homo Sapiens
guguuuaauaacuggcauuaagcuuagagggugaaaaaaaaaaaaaagauugauaguauuuuuc

SEQ ID NO: 33185 - RNA, 64 nt, Homo Sapiens
uguuuaauaacuggcauuaagcuuagagggugaaaaaaaaaaaaaagauugauaguauuuuuca

SEQ ID NO: 33186 - RNA, 64 nt, Homo Sapiens
guuuaauaacuggcauuaagcuuagagggugaaaaaaaaaaaaaagauugauaguauuuuucau

SEQ ID NO: 33187 - RNA, 64 nt, Homo Sapiens
uuuaauaacuggcauuaagcuuagagggugaaaaaaaaaaaaaagauugauaguauuuuucaua

SEQ ID NO: 33188 - RNA, 64 nt, Homo Sapiens
uuaauaacuggcauuaagcuuagagggugaaaaaaaaaaaaaagauugauaguauuuuucauaa

SEQ ID NO: 33189 - RNA, 64 nt, Homo Sapiens
uaauaacuggcauuaagcuuagagggugaaaaaaaaaaaaaagauugauaguauuuuucauaau

SEQ ID NO: 33190 - RNA, 64 nt, Homo Sapiens
ccuaagaccaagauguaaaguaccaucugcccuuaaaaaaaauuggggcugucaauuucuaguu

SEQ ID NO: 33191 - RNA, 64 nt, Homo Sapiens
cuccagccugggcgacagggcaagacucugucucaaaaaaaaaaaaaaaaaaaaagacggaucc

SEQ ID NO: 33192 - RNA, 64 nt, Homo Sapiens
uccagccugggcgacagggcaagacucugucucaaaaaaaaaaaaaaaaaaaaagacggauccu

SEQ ID NO: 33193 - RNA, 64 nt, Homo Sapiens
ccagccugggcgacagggcaagacucugucucaaaaaaaaaaaaaaaaaaaaagacggauccuu

SEQ ID NO: 33194 - RNA, 64 nt, Homo Sapiens
cagccugggcgacagggcaagacucugucucaaaaaaaaaaaaaaaaaaaaagacggauccuuu

SEQ ID NO: 33195 - RNA, 64 nt, Homo Sapiens
agccugggcgacagggcaagacucugucucaaaaaaaaaaaaaaaaaaaaagacggauccuuuu

SEQ ID NO: 33196 - RNA, 64 nt, Homo Sapiens
gccugggcgacagggcaagacucugucucaaaaaaaaaaaaaaaaaaaaagacggauccuuuuu

SEQ ID NO: 33197 - RNA, 64 nt, Homo Sapiens
ccugggcgacagggcaagacucugucucaaaaaaaaaaaaaaaaaaaaagacggauccuuuuuu

SEQ ID NO: 33198 - RNA, 64 nt, Homo Sapiens
cugggcgacagggcaagacucugucucaaaaaaaaaaaaaaaaaaaaagacggauccuuuuuuu

SEQ ID NO: 33199 - RNA, 64 nt, Homo Sapiens
ugggcgacagggcaagacucugucucaaaaaaaaaaaaaaaaaaaaagacggauccuuuuuuuu

SEQ ID NO: 33200 - RNA, 64 nt, Homo Sapiens
gggcgacagggcaagacucugucucaaaaaaaaaaaaaaaaaaaaagacggauccuuuuuuuug

SEQ ID NO: 33201 - RNA, 64 nt, Homo Sapiens
ggcgacagggcaagacucugucucaaaaaaaaaaaaaaaaaaaaagacggauccuuuuuuuugg

SEQ ID NO: 33202 - RNA, 64 nt, Homo Sapiens
gcgacagggcaagacucugucucaaaaaaaaaaaaaaaaaaaaagacggauccuuuuuuuuggu

SEQ ID NO: 33203 - RNA, 64 nt, Homo Sapiens
cgacagggcaagacucugucucaaaaaaaaaaaaaaaaaaaaagacggauccuuuuuuuuggug

SEQ ID NO: 33204 - RNA, 64 nt, Homo Sapiens
gacagggcaagacucugucucaaaaaaaaaaaaaaaaaaaaagacggauccuuuuuuuuggugc

SEQ ID NO: 33205 - RNA, 64 nt, Homo Sapiens
auaccuuauauuuguaucauucuuuaaaguuuacaaaaaaaaaccuuauguuuuuauguaauca

SEQ ID NO: 33206 - RNA, 64 nt, Homo Sapiens
uaccuuauauuuguaucauucuuuaaaguuuacaaaaaaaaaccuuauguuuuuauguaaucag

SEQ ID NO: 33207 - RNA, 64 nt, Homo Sapiens
gugccaacccaaaaauugguuuuauuuuuuucuuaaaaaaaaaaaagucuaccaaaggaauuug

SEQ ID NO: 33208 - RNA, 64 nt, Homo Sapiens
ugccaacccaaaaauugguuuuauuuuuuucuuaaaaaaaaaaaagucuaccaaaggaauuugc

SEQ ID NO: 33209 - RNA, 64 nt, Homo Sapiens
gccaacccaaaaauugguuuuauuuuuuucuuaaaaaaaaaaaagucuaccaaaggaauuugca

SEQ ID NO: 33210 - RNA, 64 nt, Homo Sapiens
ccaacccaaaaauugguuuuauuuuuuucuuaaaaaaaaaaaagucuaccaaaggaauuugcau

SEQ ID NO: 33211 - RNA, 64 nt, Homo Sapiens
caacccaaaaauugguuuuauuuuuuucuuaaaaaaaaaaaagucuaccaaaggaauuugcauc

SEQ ID NO: 33212 - RNA, 64 nt, Homo Sapiens
agaauuacuagguugccauguggcucacuuauuuaaaaaaaaaaaaaaaaaacucacccguuuu

SEQ ID NO: 33213 - RNA, 64 nt, Homo Sapiens
gaauuacuagguugccauguggcucacuuauuuaaaaaaaaaaaaaaaaaacucacccguuuuc

SEQ ID NO: 33214 - RNA, 64 nt, Homo Sapiens
aauuacuagguugccauguggcucacuuauuuaaaaaaaaaaaaaaaaaacucacccguuuucc

SEQ ID NO: 33215 - RNA, 64 nt, Homo Sapiens
auuacuagguugccauguggcucacuuauuuaaaaaaaaaaaaaaaaaacucacccguuuuccu

SEQ ID NO: 33216 - RNA, 64 nt, Homo Sapiens
uuacuagguugccauguggcucacuuauuuaaaaaaaaaaaaaaaaaacucacccguuuuccug

SEQ ID NO: 33217 - RNA, 64 nt, Homo Sapiens
uacuagguugccauguggcucacuuauuuaaaaaaaaaaaaaaaaaacucacccguuuuccugg

SEQ ID NO: 33218 - RNA, 64 nt, Homo Sapiens
acuagguugccauguggcucacuuauuuaaaaaaaaaaaaaaaaaacucacccguuuuccuggg

SEQ ID NO: 33219 - RNA, 64 nt, Homo Sapiens
cuagguugccauguggcucacuuauuuaaaaaaaaaaaaaaaaaacucacccguuuuccuggga

SEQ ID NO: 33220 - RNA, 64 nt, Homo Sapiens
uagguugccauguggcucacuuauuuaaaaaaaaaaaaaaaaaacucacccguuuuccugggau

SEQ ID NO: 33221 - RNA, 64 nt, Homo Sapiens
agguugccauguggcucacuuauuuaaaaaaaaaaaaaaaaaacucacccguuuuccugggauu

SEQ ID NO: 33222 - RNA, 64 nt, Homo Sapiens
gguugccauguggcucacuuauuuaaaaaaaaaaaaaaaaaacucacccguuuuccugggauuu

SEQ ID NO: 33223 - RNA, 64 nt, Homo Sapiens
guugcauauggcaaugaaguguuuguuuuauauuaaaaaaaaccuguuauguacaguugaaaua

SEQ ID NO: 33224 - RNA, 64 nt, Homo Sapiens
uaaucacaacguuaagaugaaauuauauuuuuggaaaaaaaaaacacuugaagcccagauggaa

SEQ ID NO: 33225 - RNA, 64 nt, Homo Sapiens
aaucacaacguuaagaugaaauuauauuuuuggaaaaaaaaaacacuugaagcccagauggaaa

SEQ ID NO: 33226 - RNA, 64 nt, Homo Sapiens
aucacaacguuaagaugaaauuauauuuuuggaaaaaaaaaacacuugaagcccagauggaaau

SEQ ID NO: 33227 - RNA, 64 nt, Homo Sapiens
accuuuucuuucaauauggcggugcugcaguuaaaaaaaaaacagcaaucuuuuguugucuaaa

SEQ ID NO: 33228 - RNA, 64 nt, Homo Sapiens
aaccuuuucuuucaauauggaggugcugcaguuaaaaaaaaaacugcaaucuuuuguugucuaa

SEQ ID NO: 33229 - RNA, 64 nt, Homo Sapiens
caaccuuuucuuucaauaugaaggugcugcaguuaaaaaaaaaaaugcaaucuuuuguugucua

SEQ ID NO: 33230 - RNA, 62 nt, Homo Sapiens
uagaucuugaauguguuguaagauauuuaacgaaaaaaaagguuaugcaacaaaaaguguga

SEQ ID NO: 33231 - RNA, 64 nt, Homo Sapiens
aaaacaaaaacaaaacccuuuuccuuuccaguuaaaaaaaaacauuccuucccuucuuuccucu

SEQ ID NO: 33232 - RNA, 64 nt, Homo Sapiens
aaaaacaaaaacaaaacccuuuuccuuuccaguuaaaaaaaaaccuuccuucccuucuuuccuc

SEQ ID NO: 33233 - RNA, 64 nt, Homo Sapiens
uuauuguaugagagcuuaucaucuuuuucagaccaaaaaaaacuuauuaguuuugaauauaaac

SEQ ID NO: 33234 - RNA, 64 nt, Homo Sapiens
gauucuaguacaaaguuacuuuguuaaauauagaaaaaaaaagaguggagcauuauuuuucuuc

SEQ ID NO: 33235 - RNA, 64 nt, Homo Sapiens
agauucuaguacaaaguuaccuuguuaaauauagaaaaaaaaaguguggagcauuauuuuucuu

SEQ ID NO: 33236 - RNA, 64 nt, Homo Sapiens
auaguuucacaucucuuaguauacacacaagcaaaaaaaaaauguuucuuucccugaaauaaaa

SEQ ID NO: 33237 - RNA, 64 nt, Homo Sapiens
gauaguuucacaucucuuagaauacacacaagcaaaaaaaaaauauuucuuucccugaaauaaa

SEQ ID NO: 33238 - RNA, 64 nt, Homo Sapiens
ugauaguuucacaucucuuaaaauacacacaagcaaaaaaaaaacauuucuuucccugaaauaa

SEQ ID NO: 33239 - RNA, 64 nt, Homo Sapiens
auaaaaaguagcaguaaaauaguuguacaauaugaaaaaaaagacgcuuaauaccuaauaucau

SEQ ID NO: 33240 - RNA, 64 nt, Homo Sapiens
auagugcauuuuggugguaauguaaacuaaauaaaaaaaaaaugcuguacuuacagauucuucc

SEQ ID NO: 33241 - RNA, 64 nt, Homo Sapiens
gauagugcauuuuggugguacuguaaacuaaauaaaaaaaaaauccuguacuuacagauucuuc

SEQ ID NO: 33242 - RNA, 64 nt, Homo Sapiens
ugauagugcauuuuggugguccuguaaacuaaauaaaaaaaaaaaccuguacuuacagauucuu

SEQ ID NO: 33243 - RNA, 64 nt, Homo Sapiens
ccauaguacuaauuuuguuuaauucuuaaaauuaaaaaaaaacuuacuccuuagaguucagaug

SEQ ID NO: 33244 - RNA, 64 nt, Homo Sapiens
uccauaguacuaauuuuguugaauucuuaaaauuaaaaaaaaacuuacuccuuagaguucagau

SEQ ID NO: 33245 - RNA, 64 nt, Homo Sapiens
uaaaacugcgaagaauacuauuucgcuuaaaggaaaaaaaaaucauuuuuuucaguggaguggu

SEQ ID NO: 33246 - RNA, 64 nt, Homo Sapiens
cuaaaacugcgaagaauacuuuuucgcuuaaaggaaaaaaaaauaauuuuuuucaguggagugg

SEQ ID NO: 33247 - RNA, 64 nt, Homo Sapiens
ugcagcuguuuuguugacauuaauugcaaaaaaaaaaaaaaaguguuaacugaauaccacucug

SEQ ID NO: 33248 - RNA, 64 nt, Homo Sapiens
uugcagcuguuuuguugacaguaauugcaaaaaaaaaaaaaaaguguuaacugaauaccacucu

SEQ ID NO: 33249 - RNA, 64 nt, Homo Sapiens
guugcagcuguuuuguugacuguaauugcaaaaaaaaaaaaaaacuguuaacugaauaccacuc

SEQ ID NO: 33250 - RNA, 64 nt, Homo Sapiens
aguugcagcuguuuuguugacuguaauugcaaaaaaaaaaaaaaucuguuaacugaauaccacu

SEQ ID NO: 33251 - RNA, 64 nt, Homo Sapiens
aaguugcagcuguuuuguugucuguaauugcaaaaaaaaaaaaauucuguuaacugaauaccac

SEQ ID NO: 33252 - RNA, 64 nt, Homo Sapiens
aaaguugcagcuguuuuguucucuguaauugcaaaaaaaaaaaaguucuguuaacugaauacca

SEQ ID NO: 33253 - RNA, 64 nt, Homo Sapiens
aaaaguugcagcuguuuuguacucuguaauugcaaaaaaaaaaauguucuguuaacugaauacc

SEQ ID NO: 33254 - RNA, 64 nt, Homo Sapiens
aaaaaguugcagcuguuuugcacucuguaauugcaaaaaaaaaauuguucuguuaacugaauac

SEQ ID NO: 33255 - RNA, 64 nt, Homo Sapiens
ugaauaaacuacugaaaacaaaaauaagcagagaaaaaaaaaugacuuacacguggugcauauu

SEQ ID NO: 33256 - RNA, 64 nt, Homo Sapiens
gugaauaaacuacugaaaacuaaaauaagcagagaaaaaaaaauaacuuacacguggugcauau

SEQ ID NO: 33257 - RNA, 64 nt, Homo Sapiens
acaaacuuguacaaugaauugcuguuggcaagaaaaaaaaaacauaaaugaugucacuuuuagu

SEQ ID NO: 33258 - RNA, 64 nt, Homo Sapiens
aacaaacuuguacaaugaauugcuguuggcaagaaaaaaaaaacuuaaaugaugucacuuuuag

SEQ ID NO: 33259 - RNA, 64 nt, Homo Sapiens
caacaaacuuguacaaugaagugcuguuggcaagaaaaaaaaaauuuaaaugaugucacuuuua

SEQ ID NO: 33260 - RNA, 64 nt, Homo Sapiens
uauugugguuuaugcgaacaaauaaucauucauuaaaaaaaauguuuucugguuuuaguuuggg

SEQ ID NO: 33261 - RNA, 64 nt, Homo Sapiens
uuaaaugccagcuuuguacaguuaaacuuuuggaaaaaaaaagaucugcuaaauuaauggacuu

SEQ ID NO: 33262 - RNA, 64 nt, Homo Sapiens
auuaaaugccagcuuuguacuguuaaacuuuuggaaaaaaaaagaucugcuaaauuaauggacu

SEQ ID NO: 33263 - RNA, 64 nt, Homo Sapiens
cuccuuuuuuccuuucgucaaaaaaaaaaacaaaaaaaaaaaccccuuuuaguuuucuugguua

SEQ ID NO: 33264 - RNA, 64 nt, Homo Sapiens
ccuccuuuuuuccuuucgucaaaaaaaaaaacaaaaaaaaaaaccccuuuuaguuuucuugguu

SEQ ID NO: 33265 - RNA, 64 nt, Homo Sapiens
cccuccuuuuuuccuuucguuaaaaaaaaaaacaaaaaaaaaaaucccuuuuaguuuucuuggu

SEQ ID NO: 33266 - RNA, 64 nt, Homo Sapiens
acccuccuuuuuuccuuucguuaaaaaaaaaaacaaaaaaaaaacucccuuuuaguuuucuugg

SEQ ID NO: 33267 - RNA, 64 nt, Homo Sapiens
aaaaaaaaaacccuccuuuuuuuucuugguuaaaaaaaaaaacauuucaccaacucccuuuuag

SEQ ID NO: 33268 - RNA, 64 nt, Homo Sapiens
aaaaaaaaaaacccuccuuuguuuucuugguuaaaaaaaaaaaccuuucaccaacucccuuuua

SEQ ID NO: 33269 - RNA, 64 nt, Homo Sapiens
caaaaaaaaaaacccuccuuaguuuucuugguuaaaaaaaaaaaucuuucaccaacucccuuuu

SEQ ID NO: 33270 - RNA, 64 nt, Homo Sapiens
acaaaaaaaaaaacccuccuuaguuuucuugguuaaaaaaaaaagucuuucaccaacucccuuu

SEQ ID NO: 33271 - RNA, 64 nt, Homo Sapiens
auauguguauuagggugacugaaaaaaaaaaaagaaaaaaaaccaaaaaaaaaaaaaaaaaaag

SEQ ID NO: 33272 - RNA, 64 nt, Homo Sapiens
aaaaaaaccauauguguauuaaaaaaaaggaaaaaaaaaaaagacgucucaaaaaaaaaaaaaa

SEQ ID NO: 33273 - RNA, 64 nt, Homo Sapiens
aaaaaaaaccauauguguauaaaaaaaaaggaaaaaaaaaaaagccgucucaaaaaaaaaaaaa

SEQ ID NO: 33274 - RNA, 64 nt, Homo Sapiens
gaaaaaaaaccauauguguaaaaaaaaaaaggaaaaaaaaaaaauccgucucaaaaaaaaaaaa

SEQ ID NO: 33275 - RNA, 64 nt, Homo Sapiens
agaaaaaaaaccauauguguaaaaaaaaaaaggaaaaaaaaaaacuccgucucaaaaaaaaaaa

SEQ ID NO: 33276 - RNA, 64 nt, Homo Sapiens
aagaaaaaaaaccauaugugaaaaaaaaaaaaggaaaaaaaaaaacuccgucucaaaaaaaaaa

SEQ ID NO: 33277 - RNA, 64 nt, Homo Sapiens
aaaaaaaaaaaagaaaaaaaaaaaaaaaaaaaaaaaaaaaaaggacagagugagacuccgucuc

SEQ ID NO: 33278 - RNA, 64 nt, Homo Sapiens
gaaaaaaaaaaaagaaaaaacaaaaaaaaaaaaaaaaaaaaaaggacagagugagacuccgucu

SEQ ID NO: 33279 - RNA, 64 nt, Homo Sapiens
ggaaaaaaaaaaaagaaaaaucaaaaaaaaaaaaaaaaaaaaaaugacagagugagacuccguc

SEQ ID NO: 33280 - RNA, 64 nt, Homo Sapiens
aggaaaaaaaaaaaagaaaacucaaaaaaaaaaaaaaaaaaaaaaugacagagugagacuccgu

SEQ ID NO: 33281 - RNA, 64 nt, Homo Sapiens
aaggaaaaaaaaaaaagaaaucucaaaaaaaaaaaaaaaaaaaagaugacagagugagacuccg

SEQ ID NO: 33282 - RNA, 64 nt, Homo Sapiens
aaaggaaaaaaaaaaaagaagucucaaaaaaaaaaaaaaaaaaaggaugacagagugagacucc

SEQ ID NO: 33283 - RNA, 64 nt, Homo Sapiens
aaaaggaaaaaaaaaaaagacgucucaaaaaaaaaaaaaaaaaauggaugacagagugagacuc

SEQ ID NO: 33284 - RNA, 64 nt, Homo Sapiens
aaaaaggaaaaaaaaaaaagccgucucaaaaaaaaaaaaaaaaacuggaugacagagugagacu

SEQ ID NO: 33285 - RNA, 64 nt, Homo Sapiens
aaaaaaggaaaaaaaaaaaauccgucucaaaaaaaaaaaaaaaaccuggaugacagagugagac

SEQ ID NO: 33286 - RNA, 64 nt, Homo Sapiens
aaaaaaaggaaaaaaaaaaacuccgucucaaaaaaaaaaaaaaagccuggaugacagagugaga

SEQ ID NO: 33287 - RNA, 64 nt, Homo Sapiens
aaaaaaaaggaaaaaaaaaaacuccgucucaaaaaaaaaaaaaaagccuggaugacagagugag

SEQ ID NO: 33288 - RNA, 64 nt, Homo Sapiens
aaaaaaaaaggaaaaaaaaagacuccgucucaaaaaaaaaaaaacagccuggaugacagaguga

SEQ ID NO: 33289 - RNA, 64 nt, Homo Sapiens
aaaaaaaaaaggaaaaaaaaagacuccgucucaaaaaaaaaaaaccagccuggaugacagagug

SEQ ID NO: 33290 - RNA, 64 nt, Homo Sapiens
aaaaaaaaaaaggaaaaaaagagacuccgucucaaaaaaaaaaauccagccuggaugacagagu

SEQ ID NO: 33291 - RNA, 64 nt, Homo Sapiens
aaaaaaaaaaaaggaaaaaaugagacuccgucucaaaaaaaaaacuccagccuggaugacagag

SEQ ID NO: 33292 - RNA, 64 nt, Homo Sapiens
aauuaaccaauaaguucuaacccugucucaaaaaaaaaaaaacaaccuaggugacagagcaaga

SEQ ID NO: 33293 - RNA, 64 nt, Homo Sapiens
aaauuaaccaauaaguucuaacccugucucaaaaaaaaaaaaacaaccuaggugacagagcaag

SEQ ID NO: 33294 - RNA, 64 nt, Homo Sapiens
caaauuaaccaauaaguucugacccugucucaaaaaaaaaaaaacaaccuaggugacagagcaa

SEQ ID NO: 33295 - RNA, 64 nt, Homo Sapiens
acaaauuaaccaauaaguucagacccugucucaaaaaaaaaaaaccaaccuaggugacagagca

SEQ ID NO: 33296 - RNA, 64 nt, Homo Sapiens
aacaaauuaaccaauaaguuaagacccugucucaaaaaaaaaaauccaaccuaggugacagagc

SEQ ID NO: 33297 - RNA, 64 nt, Homo Sapiens
aaacaaauuaaccaauaagucaagacccugucucaaaaaaaaaacuccaaccuaggugacagag

SEQ ID NO: 33298 - RNA, 64 nt, Homo Sapiens
caaaacauuggauuuuauagugcugagcaaaaaaaaaaaaaauuguuguaaaaugcaacuguau

SEQ ID NO: 33299 - RNA, 64 nt, Homo Sapiens
ucaaaacauuggauuuuauauugcugagcaaaaaaaaaaaaaauaguuguaaaaugcaacugua

SEQ ID NO: 33300 - RNA, 64 nt, Homo Sapiens
uucaaaacauuggauuuuauauugcugagcaaaaaaaaaaaaaaaaguuguaaaaugcaacugu

SEQ ID NO: 33301 - RNA, 64 nt, Homo Sapiens
auucaaaacauuggauuuuauauugcugagcaaaaaaaaaaaaaaaaguuguaaaaugcaacug

SEQ ID NO: 33302 - RNA, 64 nt, Homo Sapiens
aauucaaaacauuggauuuuguauugcugagcaaaaaaaaaaaaaaaaguuguaaaaugcaacu

SEQ ID NO: 33303 - RNA, 64 nt, Homo Sapiens
aaauucaaaacauuggauuuuguauugcugagcaaaaaaaaaaauaaaaguuguaaaaugcaac

SEQ ID NO: 33304 - RNA, 64 nt, Homo Sapiens
aaaauucaaaacauuggauucuguauugcugagcaaaaaaaaaaauaaaaguuguaaaaugcaa

SEQ ID NO: 33305 - RNA, 64 nt, Homo Sapiens
aaaaaauuaucugauccuugcucccugucucuacaaaaaaaaucccuggguaacaaagugagac

SEQ ID NO: 33306 - RNA, 64 nt, Homo Sapiens
cacuaaggucaguguuauaaauuuugaaaggagaaaaaaaaagcuaaaacuuacuaugguauau

SEQ ID NO: 33307 - RNA, 64 nt, Homo Sapiens
ccacuaaggucaguguuauauauuuugaaaggagaaaaaaaaaguuaaaacuuacuaugguaua

SEQ ID NO: 33308 - RNA, 64 nt, Homo Sapiens
ugagauuggaaaaaauuagacaccuaucuggaaaaaaaaaaauaaggcacacugagcaaguuuu

SEQ ID NO: 33309 - RNA, 64 nt, Homo Sapiens
augagauuggaaaaaauuagucaccuaucuggaaaaaaaaaaauaaggcacacugagcaaguuu

SEQ ID NO: 33310 - RNA, 64 nt, Homo Sapiens
uaugagauuggaaaaaauuauucaccuaucuggaaaaaaaaaaagaaggcacacugagcaaguu

SEQ ID NO: 33311 - RNA, 64 nt, Homo Sapiens
auaugagauuggaaaaaauuuuucaccuaucuggaaaaaaaaaaggaaggcacacugagcaagu

SEQ ID NO: 33312 - RNA, 64 nt, Homo Sapiens
gcaaaagucuaaaauacccaacaaaaagcaaacaaaaaaaaacuuauaaaggaaaaacagcaaa

SEQ ID NO: 33313 - RNA, 64 nt, Homo Sapiens
ugcaaaagucuaaaauacccaacaaaaagcaaacaaaaaaaaacguauaaaggaaaaacagcaa

SEQ ID NO: 33314 - RNA, 64 nt, Homo Sapiens
acuucaucuaccaguaauuguaaguuuaaaaaaaaaaaaaaacuuugguuauugaauaaacaga

SEQ ID NO: 33315 - RNA, 64 nt, Homo Sapiens
uacuucaucuaccaguaauuauaaguuuaaaaaaaaaaaaaaaccuugguuauugaauaaacag

SEQ ID NO: 33316 - RNA, 64 nt, Homo Sapiens
cuacuucaucuaccaguaaugauaaguuuaaaaaaaaaaaaaaaacuugguuauugaauaaaca

SEQ ID NO: 33317 - RNA, 64 nt, Homo Sapiens
acuacuucaucuaccaguaaagauaaguuuaaaaaaaaaaaaaaaacuugguuauugaauaaac

SEQ ID NO: 33318 - RNA, 64 nt, Homo Sapiens
aacuacuucaucuaccaguacagauaaguuuaaaaaaaaaaaaaaaacuugguuauugaauaaa

SEQ ID NO: 33319 - RNA, 64 nt, Homo Sapiens
aaacuacuucaucuaccaguacagauaaguuuaaaaaaaaaaaagaaacuugguuauugaauaa

SEQ ID NO: 33320 - RNA, 64 nt, Homo Sapiens
aaaacuacuucaucuaccagaacagauaaguuuaaaaaaaaaaaagaaacuugguuauugaaua

SEQ ID NO: 33321 - RNA, 64 nt, Homo Sapiens
aaaaacuacuucaucuaccaaaacagauaaguuuaaaaaaaaaaaagaaacuugguuauugaau

SEQ ID NO: 33322 - RNA, 64 nt, Homo Sapiens
aguuacuuuguaauuuuugguugaacuuugccaaaaaaaaaagaaauugucaccucuguuaagg

SEQ ID NO: 33323 - RNA, 64 nt, Homo Sapiens
aaguuacuuuguaauuuuugguugaacuuugccaaaaaaaaaagaaauugucaccucuguuaag

SEQ ID NO: 33324 - RNA, 64 nt, Homo Sapiens
gaaguuacuuuguaauuuuugguugaacuuugccaaaaaaaaaaaaaauugucaccucuguuaa

SEQ ID NO: 33325 - RNA, 64 nt, Homo Sapiens
uuggacaugguuugcagcuuuguauuuaaaaaaaaaaaaaaagcguacuaacagcuauaggacu

SEQ ID NO: 33326 - RNA, 64 nt, Homo Sapiens
cuuggacaugguuugcagcuuuguauuuaaaaaaaaaaaaaaagaguacuaacagcuauaggac

SEQ ID NO: 33327 - RNA, 64 nt, Homo Sapiens
gcuuggacaugguuugcagccuuguauuuaaaaaaaaaaaaaaauaguacuaacagcuauagga

SEQ ID NO: 33328 - RNA, 64 nt, Homo Sapiens
agcuuggacaugguuugcagacuuguauuuaaaaaaaaaaaaaauuaguacuaacagcuauagg

SEQ ID NO: 33329 - RNA, 64 nt, Homo Sapiens
aagcuuggacaugguuugcagacuuguauuuaaaaaaaaaaaaaauuaguacuaacagcuauag

SEQ ID NO: 33330 - RNA, 64 nt, Homo Sapiens
aaagcuuggacaugguuugcggacuuguauuuaaaaaaaaaaaaaauuaguacuaacagcuaua

SEQ ID NO: 33331 - RNA, 64 nt, Homo Sapiens
aaaagcuuggacaugguuugaggacuuguauuuaaaaaaaaaaaaaauuaguacuaacagcuau

SEQ ID NO: 33332 - RNA, 64 nt, Homo Sapiens
aaaaagcuuggacaugguuuuaggacuuguauuuaaaaaaaaaaaaaauuaguacuaacagcua

SEQ ID NO: 33333 - RNA, 64 nt, Homo Sapiens
uuugcuaaucugauaguuaaaaaacaaaaaauuuaaaaaaaaggaaaguaaaaaaaacaaaaaa

SEQ ID NO: 33334 - RNA, 64 nt, Homo Sapiens
aaaaauuuaaaaaaaagguuaguaaaaaaaacaaaaaaaaaacacgguucaccaucaauuuaaa

SEQ ID NO: 33335 - RNA, 64 nt, Homo Sapiens
aaaaaauuuaaaaaaaagguaaguaaaaaaaacaaaaaaaaaacacgguucaccaucaauuuaa

SEQ ID NO: 33336 - RNA, 64 nt, Homo Sapiens
caaaaaauuuaaaaaaaaggaaaguaaaaaaaacaaaaaaaaaacacgguucaccaucaauuua

SEQ ID NO: 33337 - RNA, 64 nt, Homo Sapiens
aaaaaaaaacaaaaaauuuaaucaauuuaaaaguaaaaaaaacaucuuaaugccacgguucacc

SEQ ID NO: 33338 - RNA, 64 nt, Homo Sapiens
uauaaguguaacauguuuucuuuucuuaaaaauaaaaaaaaauaagcuuucacugaagguuuuu

SEQ ID NO: 33339 - RNA, 64 nt, Homo Sapiens
auauaaguguaacauguuuuuuuuucuuaaaaauaaaaaaaaauaagcuuucacugaagguuuu

SEQ ID NO: 33340 - RNA, 64 nt, Homo Sapiens
caagagugauuuucuguuacgaggauucuugaaaaaaaaaaaugaugaacuuguagggggcaua

SEQ ID NO: 33341 - RNA, 64 nt, Homo Sapiens
gcaagagugauuuucuguuaagaggauucuugaaaaaaaaaaauaaugaacuuguagggggcau

SEQ ID NO: 33342 - RNA, 64 nt, Homo Sapiens
ugcaagagugauuuucuguuuagaggauucuugaaaaaaaaaaagaaugaacuuguagggggca

SEQ ID NO: 33343 - RNA, 64 nt, Homo Sapiens
augcaagagugauuuucuguauagaggauucuugaaaaaaaaaacgaaugaacuuguagggggc

SEQ ID NO: 33344 - RNA, 64 nt, Homo Sapiens
uuucuccauugauuuucaccguauucuacaaaaaaaaaaaaaguaauguucuuuaaaaguuuaa

SEQ ID NO: 33345 - RNA, 64 nt, Homo Sapiens
uuuucuccauugauuuucacaguauucuacaaaaaaaaaaaaaguaauguucuuuaaaaguuua

SEQ ID NO: 33346 - RNA, 64 nt, Homo Sapiens
guuuucuccauugauuuucaaaguauucuacaaaaaaaaaaaaauuaauguucuuuaaaaguuu

SEQ ID NO: 33347 - RNA, 64 nt, Homo Sapiens
aguuuucuccauugauuuucuaaguauucuacaaaaaaaaaaaaauuaauguucuuuaaaaguu

SEQ ID NO: 33348 - RNA, 64 nt, Homo Sapiens
aaguuuucuccauugauuuuuuaaguauucuacaaaaaaaaaaauauuaauguucuuuaaaagu

SEQ ID NO: 33349 - RNA, 64 nt, Homo Sapiens
aaaguuuucuccauugauuuuuuaaguauucuacaaaaaaaaaaguauuaauguucuuuaaaag

SEQ ID NO: 33350 - RNA, 64 nt, Homo Sapiens
gaagaaaaacugccuacagggacugucucaaaaaaaaaaaaagacagccugggugacagaacaa

SEQ ID NO: 33351 - RNA, 64 nt, Homo Sapiens
agaagaaaaacugccuacagagacugucucaaaaaaaaaaaaagccagccugggugacagaaca

SEQ ID NO: 33352 - RNA, 64 nt, Homo Sapiens
gagaagaaaaacugccuacaaagacugucucaaaaaaaaaaaaauccagccugggugacagaac

SEQ ID NO: 33353 - RNA, 64 nt, Homo Sapiens
agagaagaaaaacugccuaccaagacugucucaaaaaaaaaaaacuccagccugggugacagaa

SEQ ID NO: 33354 - RNA, 64 nt, Homo Sapiens
aagagaagaaaaacugccuaacaagacugucucaaaaaaaaaaaacuccagccugggugacaga

SEQ ID NO: 33355 - RNA, 64 nt, Homo Sapiens
aaagagaagaaaaacugccuaacaagacugucucaaaaaaaaaacacuccagccugggugacag

SEQ ID NO: 33356 - RNA, 64 nt, Homo Sapiens
aaagaaaauuagccaggugucgcaaaaaaaaaaaaaaaaaaagaugaugagagugagacuccau

SEQ ID NO: 33357 - RNA, 64 nt, Homo Sapiens
aaaagaaaauuagccaggugucgcaaaaaaaaaaaaaaaaaaagaugaugagagugagacucca

SEQ ID NO: 33358 - RNA, 64 nt, Homo Sapiens
gaaaagaaaauuagccagguaucgcaaaaaaaaaaaaaaaaaaagaugaugagagugagacucc

SEQ ID NO: 33359 - RNA, 64 nt, Homo Sapiens
agaaaagaaaauuagccaggcaucgcaaaaaaaaaaaaaaaaaaggaugaugagagugagacuc

SEQ ID NO: 33360 - RNA, 64 nt, Homo Sapiens
aagaaaagaaaauuagccagccaucgcaaaaaaaaaaaaaaaaauggaugaugagagugagacu

SEQ ID NO: 33361 - RNA, 64 nt, Homo Sapiens
aaagaaaagaaaauuagccauccaucgcaaaaaaaaaaaaaaaacuggaugaugagagugagac

SEQ ID NO: 33362 - RNA, 64 nt, Homo Sapiens
aaaagaaaagaaaauuagcccuccaucgcaaaaaaaaaaaaaaaccuggaugaugagagugaga

SEQ ID NO: 33363 - RNA, 64 nt, Homo Sapiens
aaaaagaaaagaaaauuagcacuccaucgcaaaaaaaaaaaaaagccuggaugaugagagugag

SEQ ID NO: 33364 - RNA, 64 nt, Homo Sapiens
aaaaaagaaaagaaaauuaggacuccaucgcaaaaaaaaaaaaaagccuggaugaugagaguga

SEQ ID NO: 33365 - RNA, 64 nt, Homo Sapiens
aaaaaaagaaaagaaaauuaagacuccaucgcaaaaaaaaaaaacagccuggaugaugagagug

SEQ ID NO: 33366 - RNA, 64 nt, Homo Sapiens
aaaaaaaagaaaagaaaauugagacuccaucgcaaaaaaaaaaaucagccuggaugaugagagu

SEQ ID NO: 33367 - RNA, 64 nt, Homo Sapiens
aaaaaaaaagaaaagaaaauugagacuccaucgcaaaaaaaaaauucagccuggaugaugagag

SEQ ID NO: 33368 - RNA, 64 nt, Homo Sapiens
gguaccagguucuguguguugugguuaaaaaaaaaaaaaaaacauuaaaaagguguagacaaug

SEQ ID NO: 33369 - RNA, 64 nt, Homo Sapiens
agguaccagguucuguguguggugguuaaaaaaaaaaaaaaaacuuuaaaaagguguagacaau

SEQ ID NO: 33370 - RNA, 64 nt, Homo Sapiens
cagguaccagguucuguguguggugguuaaaaaaaaaaaaaaaauuuuaaaaagguguagacaa

SEQ ID NO: 33371 - RNA, 64 nt, Homo Sapiens
acagguaccagguucuguguauggugguuaaaaaaaaaaaaaaauuuuuaaaaagguguagaca

SEQ ID NO: 33372 - RNA, 64 nt, Homo Sapiens
aacagguaccagguucugugaauggugguuaaaaaaaaaaaaaaauuuuuaaaaagguguagac

SEQ ID NO: 33373 - RNA, 64 nt, Homo Sapiens
aaacagguaccagguucugucaauggugguuaaaaaaaaaaaaaaauuuuuaaaaagguguaga

SEQ ID NO: 33374 - RNA, 64 nt, Homo Sapiens
aaaacagguaccagguucugacaauggugguuaaaaaaaaaaaauaauuuuuaaaaagguguag

SEQ ID NO: 33375 - RNA, 64 nt, Homo Sapiens
aaaaacagguaccagguucugacaauggugguuaaaaaaaaaaauuaauuuuuaaaaaggugua

SEQ ID NO: 33376 - RNA, 64 nt, Homo Sapiens
aaaaaacagguaccagguucagacaauggugguuaaaaaaaaaacuuaauuuuuaaaaaggugu

SEQ ID NO: 33377 - RNA, 64 nt, Homo Sapiens
uaaacuugacauuuuaggguucucuaugcauuuaaaaaaaaauggguuuucugaaauguuauau

SEQ ID NO: 33378 - RNA, 64 nt, Homo Sapiens
guaaacuugacauuuuaggguucucuaugcauuuaaaaaaaaauagguuuucugaaauguuaua

SEQ ID NO: 33379 - RNA, 64 nt, Homo Sapiens
uuguguuaggacagcauauauguuauuuaaaaaaaaaaaaaacauucugguuuauuuccuagac

SEQ ID NO: 33380 - RNA, 64 nt, Homo Sapiens
auuguguuaggacagcauaucuguuauuuaaaaaaaaaaaaaacauucugguuuauuuccuaga

SEQ ID NO: 33381 - RNA, 64 nt, Homo Sapiens
cauuguguuaggacagcauaacuguuauuuaaaaaaaaaaaaaauauucugguuuauuuccuag

SEQ ID NO: 33382 - RNA, 64 nt, Homo Sapiens
acauuguguuaggacagcaugacuguuauuuaaaaaaaaaaaaaauauucugguuuauuuccua

SEQ ID NO: 33383 - RNA, 64 nt, Homo Sapiens
aacauuguguuaggacagcaagacuguuauuuaaaaaaaaaaaaaauauucugguuuauuuccu

SEQ ID NO: 33384 - RNA, 64 nt, Homo Sapiens
aaacauuguguuaggacagcuagacuguuauuuaaaaaaaaaaagaauauucugguuuauuucc

SEQ ID NO: 33385 - RNA, 64 nt, Homo Sapiens
aaaacauuguguuaggacagcuagacuguuauuuaaaaaaaaaaggaauauucugguuuauuuc

SEQ ID NO: 33386 - RNA, 64 nt, Homo Sapiens
aaagaaaagagaaaagcaauuggucucuuuaaaaaaaaaaaagggauguuauaauaaaguggaa

SEQ ID NO: 33387 - RNA, 64 nt, Homo Sapiens
gaaagaaaagagaaaagcaaauggucucuuuaaaaaaaaaaaagagauguuauaauaaagugga

SEQ ID NO: 33388 - RNA, 64 nt, Homo Sapiens
ggaaagaaaagagaaaagcaaauggucucuuuaaaaaaaaaaaacagauguuauaauaaagugg

SEQ ID NO: 33389 - RNA, 64 nt, Homo Sapiens
aggaaagaaaagagaaaagcgaauggucucuuuaaaaaaaaaaaccagauguuauaauaaagug

SEQ ID NO: 33390 - RNA, 64 nt, Homo Sapiens
aaggaaagaaaagagaaaagggaauggucucuuuaaaaaaaaaauccagauguuauaauaaagu

SEQ ID NO: 33391 - RNA, 64 nt, Homo Sapiens
agaagaaaaagaaacucaggguaaacuauggggaaaaaaaaagaaucagaaccuaagcacagca

SEQ ID NO: 33392 - RNA, 64 nt, Homo Sapiens
aagaagaaaaagaaacucagaguaaacuauggggaaaaaaaaagaaucagaaccuaagcacagc

SEQ ID NO: 33393 - RNA, 64 nt, Homo Sapiens
ugauuauauauuuuuaauccgcuguagaaaaauaaaaaaaaauuuaaaauaauguuuuuauuuu

SEQ ID NO: 33394 - RNA, 64 nt, Homo Sapiens
uugauuauauauuuuuaaucugcuguagaaaaauaaaaaaaaauuuaaaauaauguuuuuauuu

SEQ ID NO: 33395 - RNA, 64 nt, Homo Sapiens
gauacaugguuaaaggauaguacuccccaucaaaaaaaaaaaugaguagggaguguguaccccu

SEQ ID NO: 33396 - RNA, 64 nt, Homo Sapiens
ggauacaugguuaaaggauauuacuccccaucaaaaaaaaaaauuaguagggaguguguacccc

SEQ ID NO: 33397 - RNA, 64 nt, Homo Sapiens
uggauacaugguuaaaggaucuuacuccccaucaaaaaaaaaaaguaguagggaguguguaccc

SEQ ID NO: 33398 - RNA, 64 nt, Homo Sapiens
auggauacaugguuaaaggaccuuacuccccaucaaaaaaaaaauguaguagggaguguguacc

SEQ ID NO: 33399 - RNA, 64 nt, Homo Sapiens
aaagaaagaaacugauaaaaaaacaaaaagaaaaaaaaaaaagggaggcugcccugaacaaaaa

SEQ ID NO: 33400 - RNA, 64 nt, Homo Sapiens
gaaagaaagaaacugauaaaaaaacaaaaagaaaaaaaaaaaagugaggcugcccugaacaaaa

SEQ ID NO: 33401 - RNA, 64 nt, Homo Sapiens
ggaaagaaagaaacugauaaaaaaacaaaaagaaaaaaaaaaaagugaggcugcccugaacaaa

SEQ ID NO: 33402 - RNA, 64 nt, Homo Sapiens
aggaaagaaagaaacugauaaaaaaacaaaaagaaaaaaaaaaaagugaggcugcccugaacaa

SEQ ID NO: 33403 - RNA, 64 nt, Homo Sapiens
aaggaaagaaagaaacugauaaaaaaacaaaaagaaaaaaaaaacagugaggcugcccugaaca

SEQ ID NO: 33404 - RNA, 64 nt, Homo Sapiens
aaaagaaaaaaaaaaaaggaaggcugcccugaacaaaaaaaacauguuauuaugucaaccagug

SEQ ID NO: 33405 - RNA, 64 nt, Homo Sapiens
ccaagauuuuuuauuugaggguuuuuuguuuuuuaaaaaaaaauugaacaaagacuacuaauga

SEQ ID NO: 33406 - RNA, 64 nt, Homo Sapiens
caagauuuuuuauuugaggguuuuuuguuuuuuaaaaaaaaauugaacaaagacuacuaaugac

SEQ ID NO: 33407 - RNA, 64 nt, Homo Sapiens
cuccaaccugggcgacagggcgagacuccgucucaaaaaaaaaaaaaaauuuaccuccuuugca

SEQ ID NO: 33408 - RNA, 64 nt, Homo Sapiens
uccaaccugggcgacagggcgagacuccgucucaaaaaaaaaaaaaaauuuaccuccuuugcag

SEQ ID NO: 33409 - RNA, 64 nt, Homo Sapiens
ccaaccugggcgacagggcgagacuccgucucaaaaaaaaaaaaaaauuuaccuccuuugcagg

SEQ ID NO: 33410 - RNA, 64 nt, Homo Sapiens
caaccugggcgacagggcgagacuccgucucaaaaaaaaaaaaaaauuuaccuccuuugcaggc

SEQ ID NO: 33411 - RNA, 64 nt, Homo Sapiens
aaccugggcgacagggcgagacuccgucucaaaaaaaaaaaaaaauuuaccuccuuugcaggcc

SEQ ID NO: 33412 - RNA, 64 nt, Homo Sapiens
accugggcgacagggcgagacuccgucucaaaaaaaaaaaaaaauuuaccuccuuugcaggcca

SEQ ID NO: 33413 - RNA, 64 nt, Homo Sapiens
ccugggcgacagggcgagacuccgucucaaaaaaaaaaaaaaauuuaccuccuuugcaggccau

SEQ ID NO: 33414 - RNA, 64 nt, Homo Sapiens
cugggcgacagggcgagacuccgucucaaaaaaaaaaaaaaauuuaccuccuuugcaggccaua

SEQ ID NO: 33415 - RNA, 64 nt, Homo Sapiens
aggaggagagagaggaaaaaaagaggaaagaaggaaaaaaaaaagaauuaaaaaaaaaaaaaag

SEQ ID NO: 33416 - RNA, 64 nt, Homo Sapiens
ggaggagagagaggaaaaaaagaggaaagaaggaaaaaaaaaagaauuaaaaaaaaaaaaaaga

SEQ ID NO: 33417 - RNA, 64 nt, Homo Sapiens
gaggagagagaggaaaaaaagaggaaagaaggaaaaaaaaaagaauuaaaaaaaaaaaaaagaa

SEQ ID NO: 33418 - RNA, 64 nt, Homo Sapiens
aaaaaaagaggaaagaaggaaaaaaaaaagaauuaaaaaaaaaaaaaagaaaaacagaagauga

SEQ ID NO: 33419 - RNA, 64 nt, Homo Sapiens
aaaaaagaggaaagaaggaaaaaaaaaagaauuaaaaaaaaaaaaaagaaaaacagaagaugac

SEQ ID NO: 33420 - RNA, 64 nt, Homo Sapiens
aaaaagaggaaagaaggaaaaaaaaaagaauuaaaaaaaaaaaaaagaaaaacagaagaugacc

SEQ ID NO: 33421 - RNA, 64 nt, Homo Sapiens
aaaagaggaaagaaggaaaaaaaaaagaauuaaaaaaaaaaaaaagaaaaacagaagaugaccu

SEQ ID NO: 33422 - RNA, 64 nt, Homo Sapiens
aaagaggaaagaaggaaaaaaaaaagaauuaaaaaaaaaaaaaagaaaaacagaagaugaccuu

SEQ ID NO: 33423 - RNA, 64 nt, Homo Sapiens
aagaggaaagaaggaaaaaaaaaagaauuaaaaaaaaaaaaaagaaaaacagaagaugaccuug

SEQ ID NO: 33424 - RNA, 64 nt, Homo Sapiens
agaggaaagaaggaaaaaaaaaagaauuaaaaaaaaaaaaaagaaaaacagaagaugaccuuga

SEQ ID NO: 33425 - RNA, 64 nt, Homo Sapiens
aaaaaaaaagaaaaacagaagaugaccuugauggaaaaaaaauauuuuuuaaaaaaaagauaua

SEQ ID NO: 33426 - RNA, 64 nt, Homo Sapiens
agaagaugaccuugauggaaaaaaaauauuuuuuaaaaaaaagauauacuguggaaggggggag

SEQ ID NO: 33427 - RNA, 64 nt, Homo Sapiens
ucaagcuugggcaacgagagcaaaacucugucucaaaaaaaaaauuagccagauguggugacgc

SEQ ID NO: 33428 - RNA, 64 nt, Homo Sapiens
caagcuugggcaacgagagcaaaacucugucucaaaaaaaaaauuagccagauguggugacgca

SEQ ID NO: 33429 - RNA, 64 nt, Homo Sapiens
aagcuugggcaacgagagcaaaacucugucucaaaaaaaaaauuagccagauguggugacgcau

SEQ ID NO: 33430 - RNA, 64 nt, Homo Sapiens
uaaacuuaauuucuggccugugacuagaauguuuaaaaaaaaaaaagucggacuaaauguuaau

SEQ ID NO: 33431 - RNA, 64 nt, Homo Sapiens
aaacuuaauuucuggccugugacuagaauguuuaaaaaaaaaaaagucggacuaaauguuaauu

SEQ ID NO: 33432 - RNA, 64 nt, Homo Sapiens
aacuuaauuucuggccugugacuagaauguuuaaaaaaaaaaaagucggacuaaauguuaauua

SEQ ID NO: 33433 - RNA, 63 nt, Homo Sapiens
acuuaauuucuggccugugacuagaauguuuaaaaaaaaaaaagucggacuaaauguuaauua

SEQ ID NO: 33434 - RNA, 62 nt, Homo Sapiens
cuuaauuucuggccugugacuagaauguuuaaaaaaaaaaaagucggacuaaauguuaauua

SEQ ID NO: 33435 - RNA, 64 nt, Homo Sapiens
uuccucucuauucgcuuucuccuguuuuuuuuuuaaaaaaaaagcaugaaaaaggaagagaaaa

SEQ ID NO: 33436 - RNA, 64 nt, Homo Sapiens
uccucucuauucgcuuucuccuguuuuuuuuuuaaaaaaaaagcaugaaaaaggaagagaaaaa

SEQ ID NO: 33437 - RNA, 64 nt, Homo Sapiens
aauaugucacauuuucagucaaagaaccaugauuaaaaaaaaaaagacaacuuacaauuuaaau

SEQ ID NO: 33438 - RNA, 64 nt, Homo Sapiens
auaugucacauuuucagucaaagaaccaugauuaaaaaaaaaaagacaacuuacaauuuaaauc

SEQ ID NO: 33439 - RNA, 64 nt, Homo Sapiens
uaugucacauuuucagucaaagaaccaugauuaaaaaaaaaaagacaacuuacaauuuaaaucc

SEQ ID NO: 33440 - RNA, 64 nt, Homo Sapiens
augucacauuuucagucaaagaaccaugauuaaaaaaaaaaagacaacuuacaauuuaaauccu

SEQ ID NO: 33441 - RNA, 64 nt, Homo Sapiens
guugcuuaaauaucaaguauuguuuauaaccaccaaaaaaaaaaagcccugguaguuuuuuggc

SEQ ID NO: 33442 - RNA, 64 nt, Homo Sapiens
uugcuuaaauaucaaguauuguuuauaaccaccaaaaaaaaaaagcccugguaguuuuuuggca

SEQ ID NO: 33443 - RNA, 64 nt, Homo Sapiens
ugcuuaaauaucaaguauuguuuauaaccaccaaaaaaaaaaagcccugguaguuuuuuggcac

SEQ ID NO: 33444 - RNA, 64 nt, Homo Sapiens
gcuuaaauaucaaguauuguuuauaaccaccaaaaaaaaaaagcccugguaguuuuuuggcacc

SEQ ID NO: 33445 - RNA, 64 nt, Homo Sapiens
cauauaccaugauauaaucugaaaggggcagauuaaaaaaaaaaaaagaaucuaaaccuuacau

SEQ ID NO: 33446 - RNA, 64 nt, Homo Sapiens
auauaccaugauauaaucugaaaggggcagauuaaaaaaaaaaaaagaaucuaaaccuuacaug

SEQ ID NO: 33447 - RNA, 64 nt, Homo Sapiens
uauaccaugauauaaucugaaaggggcagauuaaaaaaaaaaaaagaaucuaaaccuuacaugu

SEQ ID NO: 33448 - RNA, 64 nt, Homo Sapiens
auaccaugauauaaucugaaaggggcagauuaaaaaaaaaaaaagaaucuaaaccuuacaugug

SEQ ID NO: 33449 - RNA, 64 nt, Homo Sapiens
uaccaugauauaaucugaaaggggcagauuaaaaaaaaaaaaagaaucuaaaccuuacaugugu

SEQ ID NO: 33450 - RNA, 64 nt, Homo Sapiens
accaugauauaaucugaaaggggcagauuaaaaaaaaaaaaagaaucuaaaccuuacaugugua

SEQ ID NO: 33451 - RNA, 64 nt, Homo Sapiens
ucuaauccuuguuagacuacugauuuaaagaaggaaaaaaaaaagccaacucuguagacaccuu

SEQ ID NO: 33452 - RNA, 64 nt, Homo Sapiens
cuaauccuuguuagacuacugauuuaaagaaggaaaaaaaaaagccaacucuguagacaccuuc

SEQ ID NO: 33453 - RNA, 64 nt, Homo Sapiens
uaauccuuguuagacuacugauuuaaagaaggaaaaaaaaaagccaacucuguagacaccuuca

SEQ ID NO: 33454 - RNA, 64 nt, Homo Sapiens
gaaauauuuuucaguuguuuaugucguuuacuacaaaaaaaaagauucagaguggauggaguac

SEQ ID NO: 33455 - RNA, 64 nt, Homo Sapiens
aaauauuuuucaguuguuuaugucguuuacuacaaaaaaaaagauucagaguggauggaguaca

SEQ ID NO: 33456 - RNA, 64 nt, Homo Sapiens
uaaaauaaucuaagcaucauugaagcaguaacacaaaaaaaagguucaguauuuucuuuuuagu

SEQ ID NO: 33457 - RNA, 64 nt, Homo Sapiens
uaauaccagaccaaagacauuuucuguuuccuggaaaaaaaaaaugaaucauguuaggcuuuag

SEQ ID NO: 33458 - RNA, 64 nt, Homo Sapiens
aauaccagaccaaagacauuuucuguuuccuggaaaaaaaaaaugaaucauguuaggcuuuagg

SEQ ID NO: 33459 - RNA, 64 nt, Homo Sapiens
auaccagaccaaagacauuuucuguuuccuggaaaaaaaaaaugaaucauguuaggcuuuaggu

SEQ ID NO: 33460 - RNA, 64 nt, Homo Sapiens
guuuuacugucuuagaucguucuuggaaaucacuaaaaaaaaaaaaaguuaauuugauguuugc

SEQ ID NO: 33461 - RNA, 64 nt, Homo Sapiens
uuuuacugucuuagaucguucuuggaaaucacuaaaaaaaaaaaaaguuaauuugauguuugcu

SEQ ID NO: 33462 - RNA, 64 nt, Homo Sapiens
uuuacugucuuagaucguucuuggaaaucacuaaaaaaaaaaaaaguuaauuugauguuugcuu

SEQ ID NO: 33463 - RNA, 64 nt, Homo Sapiens
uuacugucuuagaucguucuuggaaaucacuaaaaaaaaaaaaaguuaauuugauguuugcuua

SEQ ID NO: 33464 - RNA, 64 nt, Homo Sapiens
uacugucuuagaucguucuuggaaaucacuaaaaaaaaaaaaaguuaauuugauguuugcuuau

SEQ ID NO: 33465 - RNA, 64 nt, Homo Sapiens
acugucuuagaucguucuuggaaaucacuaaaaaaaaaaaaaguuaauuugauguuugcuuauu

SEQ ID NO: 33466 - RNA, 64 nt, Homo Sapiens
gguauaaagauauuuugagcagacuguaaacaagaaaaaaaaaaucaugcauucuuagcaaaau

SEQ ID NO: 33467 - RNA, 64 nt, Homo Sapiens
guauaaagauauuuugagcagacuguaaacaagaaaaaaaaaaucaugcauucuuagcaaaauu

SEQ ID NO: 33468 - RNA, 64 nt, Homo Sapiens
uauaaagauauuuugagcagacuguaaacaagaaaaaaaaaaucaugcauucuuagcaaaauug

SEQ ID NO: 33469 - RNA, 64 nt, Homo Sapiens
ugugucucugguacagaauaguugauauuaacagaaaaaaaaaaaucuguagcuucaugaauau

SEQ ID NO: 33470 - RNA, 64 nt, Homo Sapiens
gugucucugguacagaauaguugauauuaacagaaaaaaaaaaaucuguagcuucaugaauaug

SEQ ID NO: 33471 - RNA, 64 nt, Homo Sapiens
ugucucugguacagaauaguugauauuaacagaaaaaaaaaaaucuguagcuucaugaauaugc

SEQ ID NO: 33472 - RNA, 64 nt, Homo Sapiens
gucucugguacagaauaguugauauuaacagaaaaaaaaaaaucuguagcuucaugaauaugcc

SEQ ID NO: 33473 - RNA, 64 nt, Homo Sapiens
cuccagccugggcaacagagugagacuucgucucaaaaaaaaaaaaaaguuuggguugaagauc

SEQ ID NO: 33474 - RNA, 64 nt, Homo Sapiens
uccagccugggcaacagagugagacuucgucucaaaaaaaaaaaaaaguuuggguugaagauca

SEQ ID NO: 33475 - RNA, 64 nt, Homo Sapiens
ccagccugggcaacagagugagacuucgucucaaaaaaaaaaaaaaguuuggguugaagaucaa

SEQ ID NO: 33476 - RNA, 64 nt, Homo Sapiens
cagccugggcaacagagugagacuucgucucaaaaaaaaaaaaaaguuuggguugaagaucaaa

SEQ ID NO: 33477 - RNA, 64 nt, Homo Sapiens
agccugggcaacagagugagacuucgucucaaaaaaaaaaaaaaguuuggguugaagaucaaau

SEQ ID NO: 33478 - RNA, 64 nt, Homo Sapiens
gccugggcaacagagugagacuucgucucaaaaaaaaaaaaaaguuuggguugaagaucaaauu

SEQ ID NO: 33479 - RNA, 64 nt, Homo Sapiens
ccugggcaacagagugagacuucgucucaaaaaaaaaaaaaaguuuggguugaagaucaaauuc

SEQ ID NO: 33480 - RNA, 64 nt, Homo Sapiens
aucuugugccacagaaaaaugaaguacugaaauuaaaaaaaaaaaaucauagugauugggagua

SEQ ID NO: 33481 - RNA, 64 nt, Homo Sapiens
ucuugugccacagaaaaaugaaguacugaaauuaaaaaaaaaaaaucauagugauugggaguau

SEQ ID NO: 33482 - RNA, 64 nt, Homo Sapiens
cuugugccacagaaaaaugaaguacugaaauuaaaaaaaaaaaaucauagugauugggaguaug

SEQ ID NO: 33483 - RNA, 64 nt, Homo Sapiens
uugugccacagaaaaaugaaguacugaaauuaaaaaaaaaaaaucauagugauugggaguaugu

SEQ ID NO: 33484 - RNA, 64 nt, Homo Sapiens
ugugccacagaaaaaugaaguacugaaauuaaaaaaaaaaaaucauagugauugggaguauguc

SEQ ID NO: 33485 - RNA, 64 nt, Homo Sapiens
augugacauuugcccuagccuaagaguagcagguaaaaaaaaguuucuuucaucuuuugccuua

SEQ ID NO: 33486 - RNA, 64 nt, Homo Sapiens
uccuucuuggcaaaaguagcuuuugaacugauauaaaaaaaaaugcugaguaacagaaaaguau

SEQ ID NO: 33487 - RNA, 64 nt, Homo Sapiens
ccuucuuggcaaaaguagcuuuugaacugauauaaaaaaaaaugcugaguaacagaaaaguauu

SEQ ID NO: 33488 - RNA, 64 nt, Homo Sapiens
acuacccuccuuugaucuauuuuuggucauagguaaaaaaaaaaaucucucuugggagcauaua

SEQ ID NO: 33489 - RNA, 64 nt, Homo Sapiens
cuacccuccuuugaucuauuuuuggucauagguaaaaaaaaaaaucucucuugggagcauauaa

SEQ ID NO: 33490 - RNA, 64 nt, Homo Sapiens
uacccuccuuugaucuauuuuuggucauagguaaaaaaaaaaaucucucuugggagcauauaaa

SEQ ID NO: 33491 - RNA, 64 nt, Homo Sapiens
acccuccuuugaucuauuuuuggucauagguaaaaaaaaaaaucucucuugggagcauauaaac

SEQ ID NO: 33492 - RNA, 64 nt, Homo Sapiens
auguagcgggauuuuuaaggaaucagagagacugaaaaaaaaaaaaaaauuaaugauggucaaa

SEQ ID NO: 33493 - RNA, 64 nt, Homo Sapiens
uguagcgggauuuuuaaggaaucagagagacugaaaaaaaaaaaaaaauuaaugauggucaaag

SEQ ID NO: 33494 - RNA, 64 nt, Homo Sapiens
guagcgggauuuuuaaggaaucagagagacugaaaaaaaaaaaaaaauuaaugauggucaaagg

SEQ ID NO: 33495 - RNA, 64 nt, Homo Sapiens
uagcgggauuuuuaaggaaucagagagacugaaaaaaaaaaaaaaauuaaugauggucaaaggg

SEQ ID NO: 33496 - RNA, 64 nt, Homo Sapiens
agcgggauuuuuaaggaaucagagagacugaaaaaaaaaaaaaaauuaaugauggucaaagggu

SEQ ID NO: 33497 - RNA, 64 nt, Homo Sapiens
gcgggauuuuuaaggaaucagagagacugaaaaaaaaaaaaaaauuaaugauggucaaagggua

SEQ ID NO: 33498 - RNA, 64 nt, Homo Sapiens
cgggauuuuuaaggaaucagagagacugaaaaaaaaaaaaaaauuaaugauggucaaaggguau

SEQ ID NO: 33499 - RNA, 64 nt, Homo Sapiens
gggauuuuuaaggaaucagagagacugaaaaaaaaaaaaaaauuaaugauggucaaaggguaua

SEQ ID NO: 33500 - RNA, 64 nt, Homo Sapiens
uccuugcaaugugggagugcacaggaguccaccuaaaaaaaaaauccuugauacuguugccugc

SEQ ID NO: 33501 - RNA, 64 nt, Homo Sapiens
ccuugcaaugugggagugcacaggaguccaccuaaaaaaaaaauccuugauacuguugccugcc

SEQ ID NO: 33502 - RNA, 64 nt, Homo Sapiens
cuugcaaugugggagugcacaggaguccaccuaaaaaaaaaauccuugauacuguugccugccu

SEQ ID NO: 33503 - RNA, 64 nt, Homo Sapiens
uuuccuuuuuuuuuuuuuuuuuaauauuuuuuacaaaaaaaaagauuuuauacaagcaauauau

SEQ ID NO: 33504 - RNA, 64 nt, Homo Sapiens
uuccuuuuuuuuuuuuuuuuuaauauuuuuuacaaaaaaaaagauuuuauacaagcaauauaua

SEQ ID NO: 33505 - RNA, 64 nt, Homo Sapiens
aaaaagaaaaaaacaccaaaaaacaaaaacaaacaaaaaaaaaaacccacaacccuuaucuggu

SEQ ID NO: 33506 - RNA, 64 nt, Homo Sapiens
aaaagaaaaaaacaccaaaaaacaaaaacaaacaaaaaaaaaaacccacaacccuuaucugguu

SEQ ID NO: 33507 - RNA, 64 nt, Homo Sapiens
aaagaaaaaaacaccaaaaaacaaaaacaaacaaaaaaaaaaacccacaacccuuaucugguuc

SEQ ID NO: 33508 - RNA, 64 nt, Homo Sapiens
aagaaaaaaacaccaaaaaacaaaaacaaacaaaaaaaaaaacccacaacccuuaucugguucu

SEQ ID NO: 33509 - RNA, 64 nt, Homo Sapiens
aguuuugucacaguuaacugugucaaagagaauuaaaaaaaaaaacuucagauuuuguuuacau

SEQ ID NO: 33510 - RNA, 64 nt, Homo Sapiens
guuuugucacaguuaacugugucaaagagaauuaaaaaaaaaaacuucagauuuuguuuacaua

SEQ ID NO: 33511 - RNA, 64 nt, Homo Sapiens
uuuugucacaguuaacugugucaaagagaauuaaaaaaaaaaacuucagauuuuguuuacauau

SEQ ID NO: 33512 - RNA, 64 nt, Homo Sapiens
uuugucacaguuaacugugucaaagagaauuaaaaaaaaaaacuucagauuuuguuuacauauu

SEQ ID NO: 33513 - RNA, 64 nt, Homo Sapiens
aaacaguuuuguaacucuuugcuuuuuaaaucuuaaaaaaaaaaaaguugcugaaguacuguac

SEQ ID NO: 33514 - RNA, 64 nt, Homo Sapiens
aacaguuuuguaacucuuugcuuuuuaaaucuuaaaaaaaaaaaaguugcugaaguacuguaca

SEQ ID NO: 33515 - RNA, 64 nt, Homo Sapiens
acaguuuuguaacucuuugcuuuuuaaaucuuaaaaaaaaaaaaguugcugaaguacuguacag

SEQ ID NO: 33516 - RNA, 64 nt, Homo Sapiens
caguuuuguaacucuuugcuuuuuaaaucuuaaaaaaaaaaaaguugcugaaguacuguacagg

SEQ ID NO: 33517 - RNA, 64 nt, Homo Sapiens
aguuuuguaacucuuugcuuuuuaaaucuuaaaaaaaaaaaaguugcugaaguacuguacaggg

SEQ ID NO: 33518 - RNA, 64 nt, Homo Sapiens
gacugcaacauucucaggaccaaauuaaacugcuaaaaaaaaaaaaaaaguucauugacuugcu

SEQ ID NO: 33519 - RNA, 64 nt, Homo Sapiens
acugcaacauucucaggaccaaauuaaacugcuaaaaaaaaaaaaaaaguucauugacuugcuu

SEQ ID NO: 33520 - RNA, 64 nt, Homo Sapiens
cugcaacauucucaggaccaaauuaaacugcuaaaaaaaaaaaaaaaguucauugacuugcuua

SEQ ID NO: 33521 - RNA, 64 nt, Homo Sapiens
ugcaacauucucaggaccaaauuaaacugcuaaaaaaaaaaaaaaaguucauugacuugcuuag

SEQ ID NO: 33522 - RNA, 64 nt, Homo Sapiens
gcaacauucucaggaccaaauuaaacugcuaaaaaaaaaaaaaaaguucauugacuugcuuagu

SEQ ID NO: 33523 - RNA, 64 nt, Homo Sapiens
caacauucucaggaccaaauuaaacugcuaaaaaaaaaaaaaaaguucauugacuugcuuaguc

SEQ ID NO: 33524 - RNA, 64 nt, Homo Sapiens
aacauucucaggaccaaauuaaacugcuaaaaaaaaaaaaaaaguucauugacuugcuuagucg

SEQ ID NO: 33525 - RNA, 64 nt, Homo Sapiens
acauucucaggaccaaauuaaacugcuaaaaaaaaaaaaaaaguucauugacuugcuuagucgu

SEQ ID NO: 33526 - RNA, 64 nt, Homo Sapiens
aagaaucaaauugaaucuuuuacuuaccucuugcaaaaaaaaugaaaaaugaaaaaacaaauuc

SEQ ID NO: 33527 - RNA, 64 nt, Homo Sapiens
uuaaugaucuauucaggcaguagagcucuuaaggaaaaaaaaaaacccacuuucucucaagcau

SEQ ID NO: 33528 - RNA, 64 nt, Homo Sapiens
uaaugaucuauucaggcaguagagcucuuaaggaaaaaaaaaaacccacuuucucucaagcaug

SEQ ID NO: 33529 - RNA, 64 nt, Homo Sapiens
aaugaucuauucaggcaguagagcucuuaaggaaaaaaaaaaacccacuuucucucaagcaugu

SEQ ID NO: 33530 - RNA, 64 nt, Homo Sapiens
augaucuauucaggcaguagagcucuuaaggaaaaaaaaaaacccacuuucucucaagcaugua

SEQ ID NO: 33531 - RNA, 64 nt, Homo Sapiens
gauaagugagaauuauuuagaaaagacaugcuccaaaaaaaaaacaaaacugauaaaacaguuu

SEQ ID NO: 33532 - RNA, 64 nt, Homo Sapiens
auaagugagaauuauuuagaaaagacaugcuccaaaaaaaaaacaaaacugauaaaacaguuuu

SEQ ID NO: 33533 - RNA, 64 nt, Homo Sapiens
uaagugagaauuauuuagaaaagacaugcuccaaaaaaaaaacaaaacugauaaaacaguuuuu

SEQ ID NO: 33534 - RNA, 64 nt, Homo Sapiens
cauuuuucuuuaacuaacuucuauuuuuuuuaagaaaaaaaaauagacugguggguacucacag

SEQ ID NO: 33535 - RNA, 64 nt, Homo Sapiens
auuuuucuuuaacuaacuucuauuuuuuuuaagaaaaaaaaauagacugguggguacucacaga

SEQ ID NO: 33536 - RNA, 64 nt, Homo Sapiens
guuuuuucuuaaaauccacucuuggcaaugcaauaaaaaaaaccgucaccauaagccagugaca

SEQ ID NO: 33537 - RNA, 64 nt, Homo Sapiens
gauggauguauuuuccuaccccuaacuuaaggagaaaaaaaaaaagacuuccuuuuuuugccaa

SEQ ID NO: 33538 - RNA, 64 nt, Homo Sapiens
auggauguauuuuccuaccccuaacuuaaggagaaaaaaaaaaagacuuccuuuuuuugccaaa

SEQ ID NO: 33539 - RNA, 64 nt, Homo Sapiens
uggauguauuuuccuaccccuaacuuaaggagaaaaaaaaaaagacuuccuuuuuuugccaaag

SEQ ID NO: 33540 - RNA, 64 nt, Homo Sapiens
ggauguauuuuccuaccccuaacuuaaggagaaaaaaaaaaagacuuccuuuuuuugccaaagu

SEQ ID NO: 33541 - RNA, 64 nt, Homo Sapiens
cagcacaaagacauaauuuaauuccuucuaccuuaaaaaaaaaaaaaaaaaaaaaacagcucuc

SEQ ID NO: 33542 - RNA, 64 nt, Homo Sapiens
agcacaaagacauaauuuaauuccuucuaccuuaaaaaaaaaaaaaaaaaaaaaacagcucucc

SEQ ID NO: 33543 - RNA, 64 nt, Homo Sapiens
gcacaaagacauaauuuaauuccuucuaccuuaaaaaaaaaaaaaaaaaaaaaacagcucuccc

SEQ ID NO: 33544 - RNA, 64 nt, Homo Sapiens
cacaaagacauaauuuaauuccuucuaccuuaaaaaaaaaaaaaaaaaaaaaacagcucucccu

SEQ ID NO: 33545 - RNA, 64 nt, Homo Sapiens
acaaagacauaauuuaauuccuucuaccuuaaaaaaaaaaaaaaaaaaaaaacagcucucccuc

SEQ ID NO: 33546 - RNA, 64 nt, Homo Sapiens
caaagacauaauuuaauuccuucuaccuuaaaaaaaaaaaaaaaaaaaaaacagcucucccucu

SEQ ID NO: 33547 - RNA, 64 nt, Homo Sapiens
aaagacauaauuuaauuccuucuaccuuaaaaaaaaaaaaaaaaaaaaaacagcucucccucuc

SEQ ID NO: 33548 - RNA, 64 nt, Homo Sapiens
aagacauaauuuaauuccuucuaccuuaaaaaaaaaaaaaaaaaaaaaacagcucucccucucu

SEQ ID NO: 33549 - RNA, 64 nt, Homo Sapiens
agacauaauuuaauuccuucuaccuuaaaaaaaaaaaaaaaaaaaaaacagcucucccucucuu

SEQ ID NO: 33550 - RNA, 64 nt, Homo Sapiens
gacauaauuuaauuccuucuaccuuaaaaaaaaaaaaaaaaaaaaaacagcucucccucucuua

SEQ ID NO: 33551 - RNA, 64 nt, Homo Sapiens
acauaauuuaauuccuucuaccuuaaaaaaaaaaaaaaaaaaaaaacagcucucccucucuuag

SEQ ID NO: 33552 - RNA, 64 nt, Homo Sapiens
cauaauuuaauuccuucuaccuuaaaaaaaaaaaaaaaaaaaaaacagcucucccucucuuagg

SEQ ID NO: 33553 - RNA, 64 nt, Homo Sapiens
auaauuuaauuccuucuaccuuaaaaaaaaaaaaaaaaaaaaaacagcucucccucucuuaggg

SEQ ID NO: 33554 - RNA, 64 nt, Homo Sapiens
uaauuuaauuccuucuaccuuaaaaaaaaaaaaaaaaaaaaaacagcucucccucucuuagggu

SEQ ID NO: 33555 - RNA, 64 nt, Homo Sapiens
aauuuaauuccuucuaccuuaaaaaaaaaaaaaaaaaaaaaacagcucucccucucuuagggug

SEQ ID NO: 33556 - RNA, 64 nt, Homo Sapiens
ccaauccaacucugaauuuuaaagcaaaagcgucaaaaaaaagauucccuccuuacccccaacc

SEQ ID NO: 33557 - RNA, 64 nt, Homo Sapiens
gaaugaagucaaacugugccacacauggugaaugaaaaaaaaaaaaagaggcuguguuuuguca

SEQ ID NO: 33558 - RNA, 64 nt, Homo Sapiens
aaugaagucaaacugugccacacauggugaaugaaaaaaaaaaaaagaggcuguguuuugucac

SEQ ID NO: 33559 - RNA, 64 nt, Homo Sapiens
augaagucaaacugugccacacauggugaaugaaaaaaaaaaaaagaggcuguguuuugucaca

SEQ ID NO: 33560 - RNA, 64 nt, Homo Sapiens
ugaagucaaacugugccacacauggugaaugaaaaaaaaaaaaagaggcuguguuuugucacac

SEQ ID NO: 33561 - RNA, 64 nt, Homo Sapiens
gaagucaaacugugccacacauggugaaugaaaaaaaaaaaaagaggcuguguuuugucacaca

SEQ ID NO: 33562 - RNA, 64 nt, Homo Sapiens
aagucaaacugugccacacauggugaaugaaaaaaaaaaaaagaggcuguguuuugucacacag

SEQ ID NO: 33563 - RNA, 64 nt, Homo Sapiens
aguugcauuaacuauuucaaaaauuacugccuuuaaaaaaaacaaccucaagcuauauuuguau

SEQ ID NO: 33564 - RNA, 64 nt, Homo Sapiens
aacagaugauguauuucuccauugaaaacacaauaaaaaaaaaacagcacaaucucacaguugc

SEQ ID NO: 33565 - RNA, 64 nt, Homo Sapiens
acagaugauguauuucuccauugaaaacacaauaaaaaaaaaacagcacaaucucacaguugcc

SEQ ID NO: 33566 - RNA, 64 nt, Homo Sapiens
cagaugauguauuucuccauugaaaacacaauaaaaaaaaaacagcacaaucucacaguugccu

SEQ ID NO: 33567 - RNA, 64 nt, Homo Sapiens
cuaagggacauguuuugauaaaguaguaaaaauuaaaaaaaaaaaacuuuacuaagaugacauu

SEQ ID NO: 33568 - RNA, 64 nt, Homo Sapiens
uaagggacauguuuugauaaaguaguaaaaauuaaaaaaaaaaaacuuuacuaagaugacauug

SEQ ID NO: 33569 - RNA, 64 nt, Homo Sapiens
aagggacauguuuugauaaaguaguaaaaauuaaaaaaaaaaaacuuuacuaagaugacauugc

SEQ ID NO: 33570 - RNA, 64 nt, Homo Sapiens
agggacauguuuugauaaaguaguaaaaauuaaaaaaaaaaaacuuuacuaagaugacauugcu

SEQ ID NO: 33571 - RNA, 64 nt, Homo Sapiens
gggacauguuuugauaaaguaguaaaaauuaaaaaaaaaaaacuuuacuaagaugacauugcua

SEQ ID NO: 33572 - RNA, 64 nt, Homo Sapiens
caguuacaugcauacuucaaaaguauuuuccuguaaaaaaaaaaaaguuauauagguuuuguuu

SEQ ID NO: 33573 - RNA, 64 nt, Homo Sapiens
aguuacaugcauacuucaaaaguauuuuccuguaaaaaaaaaaaaguuauauagguuuuguuug

SEQ ID NO: 33574 - RNA, 64 nt, Homo Sapiens
guuacaugcauacuucaaaaguauuuuccuguaaaaaaaaaaaaguuauauagguuuuguuugc

SEQ ID NO: 33575 - RNA, 64 nt, Homo Sapiens
uuacaugcauacuucaaaaguauuuuccuguaaaaaaaaaaaaguuauauagguuuuguuugcu

SEQ ID NO: 33576 - RNA, 64 nt, Homo Sapiens
uacaugcauacuucaaaaguauuuuccuguaaaaaaaaaaaaguuauauagguuuuguuugcua

SEQ ID NO: 33577 - RNA, 64 nt, Homo Sapiens
aagauaauuuagcuaacuuuagacccuguuucuaaaaaaaaauaccagccugggcaacagagug

SEQ ID NO: 33578 - RNA, 64 nt, Homo Sapiens
aaagauaauuuagcuaacuugagacccuguuucuaaaaaaaaauuccagccugggcaacagagu

SEQ ID NO: 33579 - RNA, 64 nt, Homo Sapiens
aaaaucugacuuaguuuuaaauguggucuauggaaaaaaaaauaauuuuuuuuauuauuaaaug

SEQ ID NO: 33580 - RNA, 64 nt, Homo Sapiens
aaaaaucugacuuaguuuuagauguggucuauggaaaaaaaaauuauuuuuuuuauuauuaaau

SEQ ID NO: 33581 - RNA, 64 nt, Homo Sapiens
aagaaaacucccaucagacaaaaauacagaaaaaaaaaaaaaggaaagaaaaacguaaacuugg

SEQ ID NO: 33582 - RNA, 64 nt, Homo Sapiens
gaagaaaacucccaucagacgaaaauacagaaaaaaaaaaaaaguaaagaaaaacguaaacuug

SEQ ID NO: 33583 - RNA, 64 nt, Homo Sapiens
ggaagaaaacucccaucagaggaaaauacagaaaaaaaaaaaaacuaaagaaaaacguaaacuu

SEQ ID NO: 33584 - RNA, 64 nt, Homo Sapiens
aggaagaaaacucccaucaguggaaaauacagaaaaaaaaaaaaacuaaagaaaaacguaaacu

SEQ ID NO: 33585 - RNA, 64 nt, Homo Sapiens
aaggaagaaaacucccaucauuggaaaauacagaaaaaaaaaaaaacuaaagaaaaacguaaac

SEQ ID NO: 33586 - RNA, 64 nt, Homo Sapiens
aaaggaagaaaacucccauccuuggaaaauacagaaaaaaaaaagaacuaaagaaaaacguaaa

SEQ ID NO: 33587 - RNA, 64 nt, Homo Sapiens
gaaacacaaccaaaaaagcaaaaguucuuucaaaaaaaaaaacuugcccaccaacggcaaaucc

SEQ ID NO: 33588 - RNA, 64 nt, Homo Sapiens
ugaaacacaaccaaaaaagccaaaguucuuucaaaaaaaaaaaccugcccaccaacggcaaauc

SEQ ID NO: 33589 - RNA, 64 nt, Homo Sapiens
cugaaacacaaccaaaaaagccaaaguucuuucaaaaaaaaaaaacugcccaccaacggcaaau

SEQ ID NO: 33590 - RNA, 64 nt, Homo Sapiens
acugaaacacaaccaaaaaauccaaaguucuuucaaaaaaaaaacacugcccaccaacggcaaa

SEQ ID NO: 33591 - RNA, 64 nt, Homo Sapiens
aaaagaaaauuuaacuuaaauugcuuuaaaaaaaaaaaaaaagagauucccuuuuaaacuuauu

SEQ ID NO: 33592 - RNA, 64 nt, Homo Sapiens
aaaaagaaaauuuaacuuaauuugcuuuaaaaaaaaaaaaaaagagauucccuuuuaaacuuau

SEQ ID NO: 33593 - RNA, 64 nt, Homo Sapiens
gaaaaagaaaauuuaacuuauuuugcuuuaaaaaaaaaaaaaaacagauucccuuuuaaacuua

SEQ ID NO: 33594 - RNA, 64 nt, Homo Sapiens
agaaaaagaaaauuuaacuuauuuugcuuuaaaaaaaaaaaaaaacagauucccuuuuaaacuu

SEQ ID NO: 33595 - RNA, 64 nt, Homo Sapiens
aagaaaaagaaaauuuaacuuauuuugcuuuaaaaaaaaaaaaacacagauucccuuuuaaacu

SEQ ID NO: 33596 - RNA, 64 nt, Homo Sapiens
aaagaaaaagaaaauuuaacuuauuuugcuuuaaaaaaaaaaaaccacagauucccuuuuaaac

SEQ ID NO: 33597 - RNA, 64 nt, Homo Sapiens
aaaagaaaaagaaaauuuaacuuauuuugcuuuaaaaaaaaaaagccacagauucccuuuuaaa

SEQ ID NO: 33598 - RNA, 64 nt, Homo Sapiens
aaaaagaaaaagaaaauuuaacuuauuuugcuuuaaaaaaaaaaugccacagauucccuuuuaa

SEQ ID NO: 33599 - RNA, 64 nt, Homo Sapiens
uuuauuuuucuaaaaaaagauguauauuuguacaaaaaaaaagugggcugaaagaacauggacu

SEQ ID NO: 33600 - RNA, 64 nt, Homo Sapiens
uuuuauuuuucuaaaaaaaguuguauauuuguacaaaaaaaaagggggcugaaagaacauggac

SEQ ID NO: 33601 - RNA, 64 nt, Homo Sapiens
ugcaccuguuucacugugaaaaaaaaaaaaagaaaaaaaaaacacugaaaaaacaaaacaaaaa

SEQ ID NO: 33602 - RNA, 64 nt, Homo Sapiens
augcaccuguuucacugugaaaaaaaaaaaaagaaaaaaaaaacucugaaaaaacaaaacaaaa

SEQ ID NO: 33603 - RNA, 64 nt, Homo Sapiens
caugcaccuguuucacugugaaaaaaaaaaaaagaaaaaaaaaacucugaaaaaacaaaacaaa

SEQ ID NO: 33604 - RNA, 64 nt, Homo Sapiens
aaaaaaaaacaugcaccugucaaaacaaaaaaaaaaaaaaaagaaccucagaacucugaaaaaa

SEQ ID NO: 33605 - RNA, 64 nt, Homo Sapiens
aaaaaaaaaacaugcaccugacaaaacaaaaaaaaaaaaaaaagaaccucagaacucugaaaaa

SEQ ID NO: 33606 - RNA, 64 nt, Homo Sapiens
gaaaaaaaaaacaugcaccuaacaaaacaaaaaaaaaaaaaaaacaaccucagaacucugaaaa

SEQ ID NO: 33607 - RNA, 64 nt, Homo Sapiens
agaaaaaaaaaacaugcaccaaacaaaacaaaaaaaaaaaaaaagcaaccucagaacucugaaa

SEQ ID NO: 33608 - RNA, 64 nt, Homo Sapiens
aagaaaaaaaaaacaugcacaaaacaaaacaaaaaaaaaaaaaaagcaaccucagaacucugaa

SEQ ID NO: 33609 - RNA, 64 nt, Homo Sapiens
aaagaaaaaaaaaacaugcaaaaaacaaaacaaaaaaaaaaaaacagcaaccucagaacucuga

SEQ ID NO: 33610 - RNA, 64 nt, Homo Sapiens
aaaagaaaaaaaaaacaugcaaaaaacaaaacaaaaaaaaaaaaucagcaaccucagaacucug

SEQ ID NO: 33611 - RNA, 64 nt, Homo Sapiens
aaaaagaaaaaaaaaacauggaaaaaacaaaacaaaaaaaaaaagucagcaaccucagaacucu

SEQ ID NO: 33612 - RNA, 64 nt, Homo Sapiens
aaaaaagaaaaaaaaaacauugaaaaaacaaaacaaaaaaaaaaagucagcaaccucagaacuc

SEQ ID NO: 33613 - RNA, 64 nt, Homo Sapiens
cauuuacguaaacacgaauaugcuuaauccuuuuaaaaaaaaugauaguacuagguuagaacau

SEQ ID NO: 33614 - RNA, 64 nt, Homo Sapiens
gcuauagaaauccuugucaaaaugaaaaaaagaaaaaaaaaagaacucuggaaaaaaaaaaaaa

SEQ ID NO: 33615 - RNA, 64 nt, Homo Sapiens
agcuauagaaauccuugucaaaaugaaaaaaagaaaaaaaaaagaacucuggaaaaaaaaaaaa

SEQ ID NO: 33616 - RNA, 64 nt, Homo Sapiens
gagcuauagaaauccuugucaaaaugaaaaaaagaaaaaaaaaagaacucuggaaaaaaaaaaa

SEQ ID NO: 33617 - RNA, 64 nt, Homo Sapiens
aaaaaaagaaaaaaaaaagaacucuggaaaaaaaaaaaaaaauguuacagcgucaucugguuga

SEQ ID NO: 33618 - RNA, 64 nt, Homo Sapiens
gaaaaaaagaaaaaaaaaagaacucuggaaaaaaaaaaaaaaauauuacagcgucaucugguug

SEQ ID NO: 33619 - RNA, 64 nt, Homo Sapiens
ugaaaaaaagaaaaaaaaaagaacucuggaaaaaaaaaaaaaaagauuacagcgucaucugguu

SEQ ID NO: 33620 - RNA, 64 nt, Homo Sapiens
augaaaaaaagaaaaaaaaaugaacucuggaaaaaaaaaaaaaaagauuacagcgucaucuggu

SEQ ID NO: 33621 - RNA, 64 nt, Homo Sapiens
aaugaaaaaaagaaaaaaaauugaacucuggaaaaaaaaaaaaaaagauuacagcgucaucugg

SEQ ID NO: 33622 - RNA, 64 nt, Homo Sapiens
aaaugaaaaaaagaaaaaaaguugaacucuggaaaaaaaaaaaaaaagauuacagcgucaucug

SEQ ID NO: 33623 - RNA, 64 nt, Homo Sapiens
aaaaugaaaaaaagaaaaaagguugaacucuggaaaaaaaaaaaaaaagauuacagcgucaucu

SEQ ID NO: 33624 - RNA, 64 nt, Homo Sapiens
aaaaaugaaaaaaagaaaaaugguugaacucuggaaaaaaaaaaaaaaagauuacagcgucauc

SEQ ID NO: 33625 - RNA, 64 nt, Homo Sapiens
uuuaaaugaauugaauuccuguagguugaagaagaaaaaaaauauauguagguauucauuuuga

SEQ ID NO: 33626 - RNA, 64 nt, Homo Sapiens
auguuuguaacaagggugcccacagucuuuuuuuaaaaaaaacaaguccucuaguuccaggaaa

SEQ ID NO: 33627 - RNA, 64 nt, Homo Sapiens
uuuggucauuaaaucgaaugacaaccagggauucaaaaaaaauuggguuaagcuaccaaaaaug

SEQ ID NO: 33628 - RNA, 64 nt, Homo Sapiens
uuaccgcuguagugugaaaugcgguauuuuuuuaaaaaaaaaguuuaaaaaaaaaaaagaaucu

SEQ ID NO: 33629 - RNA, 64 nt, Homo Sapiens
uuuaccgcuguagugugaaaugcgguauuuuuuuaaaaaaaaaguuuaaaaaaaaaaaagaauc

SEQ ID NO: 33630 - RNA, 64 nt, Homo Sapiens
aucugcgguauuuuuuuaaauaccuucuuuaaaaaaaaaaaagauuaacuucuuacagcaguag

SEQ ID NO: 33631 - RNA, 64 nt, Homo Sapiens
aaucugcgguauuuuuuuaaguaccuucuuuaaaaaaaaaaaagguuaacuucuuacagcagua

SEQ ID NO: 33632 - RNA, 64 nt, Homo Sapiens
gaaucugcgguauuuuuuuaaguaccuucuuuaaaaaaaaaaaauguuaacuucuuacagcagu

SEQ ID NO: 33633 - RNA, 64 nt, Homo Sapiens
agaaucugcgguauuuuuuuuaguaccuucuuuaaaaaaaaaaauuguuaacuucuuacagcag

SEQ ID NO: 33634 - RNA, 64 nt, Homo Sapiens
aagaaucugcgguauuuuuuguaguaccuucuuuaaaaaaaaaacuuguuaacuucuuacagca

SEQ ID NO: 33635 - RNA, 64 nt, Homo Sapiens
gugaccagagggcaaaggacaauugacaguugaaaaaaaaaagacuaugauaccacgccuuaaa

SEQ ID NO: 33636 - RNA, 64 nt, Homo Sapiens
agugaccagagggcaaaggaaaauugacaguugaaaaaaaaaaggcuaugauaccacgccuuaa

SEQ ID NO: 33637 - RNA, 64 nt, Homo Sapiens
gagugaccagagggcaaaggaaaauugacaguugaaaaaaaaaaugcuaugauaccacgccuua

SEQ ID NO: 33638 - RNA, 64 nt, Homo Sapiens
cccacaauucuggaacuauaaugauuuucucagaaaaaaaaacuauacugaauaauuacuaaaa

SEQ ID NO: 33639 - RNA, 64 nt, Homo Sapiens
ucccacaauucuggaacuauaaugauuuucucagaaaaaaaaacaauacugaauaauuacuaaa

SEQ ID NO: 33640 - RNA, 64 nt, Homo Sapiens
agccuacuuaaaggcacaacucucaaaacaaaacaaaaaaaauuggcgacagagagagacucca

SEQ ID NO: 33641 - RNA, 64 nt, Homo Sapiens
aaaauuagccagacguggugacccugucucuacuaaaaaaaagaagccugaccaaaauggugaa

SEQ ID NO: 33642 - RNA, 64 nt, Homo Sapiens
aguuuucaguucugaagaagagcacuuuauuuaaaaaaaaaagaaacauauauuugaauuuaaa

SEQ ID NO: 33643 - RNA, 64 nt, Homo Sapiens
aaguuuucaguucugaagaaaagcacuuuauuuaaaaaaaaaagcaacauauauuugaauuuaa

SEQ ID NO: 33644 - RNA, 64 nt, Homo Sapiens
gaaguuuucaguucugaagaaaagcacuuuauuuaaaaaaaaaagcaacauauauuugaauuua

SEQ ID NO: 33645 - RNA, 64 nt, Homo Sapiens
aaaaaaucccuaaacauucaauuuaaaaaaaaaaaaaaaaaagguuccuuauagcuggacuuuu

SEQ ID NO: 33646 - RNA, 64 nt, Homo Sapiens
gaaaaaaucccuaaacauucuauuuaaaaaaaaaaaaaaaaaagcuuccuuauagcuggacuuu

SEQ ID NO: 33647 - RNA, 64 nt, Homo Sapiens
ggaaaaaaucccuaaacauuuuauuuaaaaaaaaaaaaaaaaaagcuuccuuauagcuggacuu

SEQ ID NO: 33648 - RNA, 64 nt, Homo Sapiens
aggaaaaaaucccuaaacauuuuauuuaaaaaaaaaaaaaaaaaugcuuccuuauagcuggacu

SEQ ID NO: 33649 - RNA, 64 nt, Homo Sapiens
aaggaaaaaaucccuaaacauuuuauuuaaaaaaaaaaaaaaaacugcuuccuuauagcuggac

SEQ ID NO: 33650 - RNA, 64 nt, Homo Sapiens
aaaggaaaaaaucccuaaaccuuuuauuuaaaaaaaaaaaaaaaacugcuuccuuauagcugga

SEQ ID NO: 33651 - RNA, 64 nt, Homo Sapiens
aaaaggaaaaaaucccuaaaacuuuuauuuaaaaaaaaaaaaaagacugcuuccuuauagcugg

SEQ ID NO: 33652 - RNA, 64 nt, Homo Sapiens
aaaaaggaaaaaaucccuaagacuuuuauuuaaaaaaaaaaaaaagacugcuuccuuauagcug

SEQ ID NO: 33653 - RNA, 64 nt, Homo Sapiens
aaaaaaggaaaaaaucccuaggacuuuuauuuaaaaaaaaaaaacagacugcuuccuuauagcu

SEQ ID NO: 33654 - RNA, 64 nt, Homo Sapiens
aaaaaaaggaaaaaaucccuuggacuuuuauuuaaaaaaaaaaaacagacugcuuccuuauagc

SEQ ID NO: 33655 - RNA, 64 nt, Homo Sapiens
aaaaaaaaggaaaaaauccccuggacuuuuauuuaaaaaaaaaacacagacugcuuccuuauag

SEQ ID NO: 33656 - RNA, 64 nt, Homo Sapiens
ugucaugugaggcaauaugcuucucugagggaaaaaaaaaaauguuauccuaaacagauggucu

SEQ ID NO: 33657 - RNA, 64 nt, Homo Sapiens
gugucaugugaggcaauauguuucucugagggaaaaaaaaaaauuuuauccuaaacagaugguc

SEQ ID NO: 33658 - RNA, 64 nt, Homo Sapiens
ugugucaugugaggcaauaucuuucucugagggaaaaaaaaaaaauuuauccuaaacagauggu

SEQ ID NO: 33659 - RNA, 64 nt, Homo Sapiens
augugucaugugaggcaauaucuuucucugagggaaaaaaaaaaaauuuauccuaaacagaugg

SEQ ID NO: 33660 - RNA, 64 nt, Homo Sapiens
ucaaauaaaacaugagauaaaaaaagaaaaaacgaaaaaaaaucuuguacagugucaauuugua

SEQ ID NO: 33661 - RNA, 64 nt, Homo Sapiens
gagguauagucuaaauggugauuauaagggaaguaaaaaaaaguuauuuauucauuauuuuaau

SEQ ID NO: 33662 - RNA, 64 nt, Homo Sapiens
aaaucuagggcuguauuuuauaagaaaaaaaaacaaaaaaaacaugcaucgugaccaaauuguu

SEQ ID NO: 33663 - RNA, 64 nt, Homo Sapiens
aaaaaaacaaaaucuagggccaaauuguuuaagaaaaaaaaacauaucaaaggugcaucgugac

SEQ ID NO: 33664 - RNA, 64 nt, Homo Sapiens
aaaaaaaacaaaaucuagggccaaauuguuuaagaaaaaaaaacauaucaaaggugcaucguga

SEQ ID NO: 33665 - RNA, 64 nt, Homo Sapiens
ggucuucaaagaucuguugacacccucuuuuaaaaaaaaaaaucgcaaacauaaucauuguucu

SEQ ID NO: 33666 - RNA, 64 nt, Homo Sapiens
cggucuucaaagaucuguugucacccucuuuuaaaaaaaaaaauugcaaacauaaucauuguuc

SEQ ID NO: 33667 - RNA, 64 nt, Homo Sapiens
ucggucuucaaagaucuguucucacccucuuuuaaaaaaaaaaauugcaaacauaaucauuguu

SEQ ID NO: 33668 - RNA, 64 nt, Homo Sapiens
aucggucuucaaagaucuguucucacccucuuuuaaaaaaaaaauuugcaaacauaaucauugu

SEQ ID NO: 33669 - RNA, 64 nt, Homo Sapiens
auucuucauucagaaaaauuaaaaacaaacaaacaaaaaaaacaaaaaaaaaaaaaaaaauccu

SEQ ID NO: 33670 - RNA, 64 nt, Homo Sapiens
cuaaaaacaaacaaacaaaaaaaaaaaaaaaaaaaaaaaaaaucaaaccaguguggcaaaaaaa

SEQ ID NO: 33671 - RNA, 64 nt, Homo Sapiens
ccuaaaaacaaacaaacaaaaaaaaaaaaaaaaaaaaaaaaaauaaaaccaguguggcaaaaaa

SEQ ID NO: 33672 - RNA, 64 nt, Homo Sapiens
uccuaaaaacaaacaaacaaaaaaaaaaaaaaaaaaaaaaaaaaaaaaaccaguguggcaaaaa

SEQ ID NO: 33673 - RNA, 64 nt, Homo Sapiens
auccuaaaaacaaacaaacaaaaaaaaaaaaaaaaaaaaaaaaacaaaaaccaguguggcaaaa

SEQ ID NO: 33674 - RNA, 64 nt, Homo Sapiens
aauccuaaaaacaaacaaacaaaaaaaaaaaaaaaaaaaaaaaaacaaaaaccaguguggcaaa

SEQ ID NO: 33675 - RNA, 64 nt, Homo Sapiens
aaauccuaaaaacaaacaaaaaaaaaaaaaaaaaaaaaaaaaaaaacaaaaaccaguguggcaa

SEQ ID NO: 33676 - RNA, 64 nt, Homo Sapiens
aaaauccuaaaaacaaacaaaaaaaaaaaaaaaaaaaaaaaaaauaacaaaaaccaguguggca

SEQ ID NO: 33677 - RNA, 64 nt, Homo Sapiens
aaaaauccuaaaaacaaacaaaaaaaaaaaaaaaaaaaaaaaaauuaacaaaaaccaguguggc

SEQ ID NO: 33678 - RNA, 64 nt, Homo Sapiens
aaaaaauccuaaaaacaaaccaaaaaaaaaaaaaaaaaaaaaaacuuaacaaaaaccagugugg

SEQ ID NO: 33679 - RNA, 64 nt, Homo Sapiens
aaaaaaauccuaaaaacaaagcaaaaaaaaaaaaaaaaaaaaaaucuuaacaaaaaccagugug

SEQ ID NO: 33680 - RNA, 64 nt, Homo Sapiens
aaaaaaaauccuaaaaacaaggcaaaaaaaaaaaaaaaaaaaaagucuuaacaaaaaccagugu

SEQ ID NO: 33681 - RNA, 64 nt, Homo Sapiens
aaaaaaaaauccuaaaaacauggcaaaaaaaaaaaaaaaaaaaaggucuuaacaaaaaccagug

SEQ ID NO: 33682 - RNA, 64 nt, Homo Sapiens
aaaaaaaaaauccuaaaaacguggcaaaaaaaaaaaaaaaaaaaaggucuuaacaaaaaccagu

SEQ ID NO: 33683 - RNA, 64 nt, Homo Sapiens
aaaaaaaaaaauccuaaaaauguggcaaaaaaaaaaaaaaaaaagaggucuuaacaaaaaccag

SEQ ID NO: 33684 - RNA, 64 nt, Homo Sapiens
aaaaaaaaaaaauccuaaaaguguggcaaaaaaaaaaaaaaaaaugaggucuuaacaaaaacca

SEQ ID NO: 33685 - RNA, 64 nt, Homo Sapiens
aaaaaaaaaaaaauccuaaaaguguggcaaaaaaaaaaaaaaaaaugaggucuuaacaaaaacc

SEQ ID NO: 33686 - RNA, 64 nt, Homo Sapiens
aaaaaaaaaaaaaauccuaacaguguggcaaaaaaaaaaaaaaagaugaggucuuaacaaaaac

SEQ ID NO: 33687 - RNA, 64 nt, Homo Sapiens
aaaaaaaaaaaaaaauccuaccaguguggcaaaaaaaaaaaaaaugaugaggucuuaacaaaaa

SEQ ID NO: 33688 - RNA, 64 nt, Homo Sapiens
aaaaaaaaaaaaaaaauccuaccaguguggcaaaaaaaaaaaaacugaugaggucuuaacaaaa

SEQ ID NO: 33689 - RNA, 64 nt, Homo Sapiens
aaaaaaaaaaaaaaaaauccaaccaguguggcaaaaaaaaaaaaacugaugaggucuuaacaaa

SEQ ID NO: 33690 - RNA, 64 nt, Homo Sapiens
aaaaaaaaaaaaaaaaaaucaaaccaguguggcaaaaaaaaaaagacugaugaggucuuaacaa

SEQ ID NO: 33691 - RNA, 64 nt, Homo Sapiens
aaaaaaaaaaaaaaaaaaauaaaaccaguguggcaaaaaaaaaaggacugaugaggucuuaaca

SEQ ID NO: 33692 - RNA, 64 nt, Homo Sapiens
uuuuguaacgacuauuugcaauuuauuuaaaagaaaaaaaaacuauuucucuuucuuuguguga

SEQ ID NO: 33693 - RNA, 64 nt, Homo Sapiens
uuuuuguaacgacuauuugcaauuuauuuaaaagaaaaaaaaacuauuucucuuucuuugugug

SEQ ID NO: 33694 - RNA, 64 nt, Homo Sapiens
gaaacccuuugacuuccacguaaaaggggaaaaaaaaaaaaagaaacuuuuuauguauagcuuc

SEQ ID NO: 33695 - RNA, 64 nt, Homo Sapiens
agaaacccuuugacuuccaccuaaaaggggaaaaaaaaaaaaagcaacuuuuuauguauagcuu

SEQ ID NO: 33696 - RNA, 64 nt, Homo Sapiens
gagaaacccuuugacuuccaucuaaaaggggaaaaaaaaaaaaaacaacuuuuuauguauagcu

SEQ ID NO: 33697 - RNA, 64 nt, Homo Sapiens
agagaaacccuuugacuuccuucuaaaaggggaaaaaaaaaaaaaacaacuuuuuauguauagc

SEQ ID NO: 33698 - RNA, 64 nt, Homo Sapiens
aagagaaacccuuugacuuccuucuaaaaggggaaaaaaaaaaaaaacaacuuuuuauguauag

SEQ ID NO: 33699 - RNA, 64 nt, Homo Sapiens
aaagagaaacccuuugacuugcuucuaaaaggggaaaaaaaaaaaaaacaacuuuuuauguaua

SEQ ID NO: 33700 - RNA, 64 nt, Homo Sapiens
aaggggugagcaguuaaugggagaaaagcuaaaaaaaaaaaaguuaacaacaaaaaaaaaauga

SEQ ID NO: 33701 - RNA, 64 nt, Homo Sapiens
uaaggggugagcaguuaaugagagaaaagcuaaaaaaaaaaaagauaacaacaaaaaaaaaaug

SEQ ID NO: 33702 - RNA, 64 nt, Homo Sapiens
guaaggggugagcaguuaaugagagaaaagcuaaaaaaaaaaaaaauaacaacaaaaaaaaaau

SEQ ID NO: 33703 - RNA, 64 nt, Homo Sapiens
aguaaggggugagcaguuaaugagagaaaagcuaaaaaaaaaaaaaauaacaacaaaaaaaaaa

SEQ ID NO: 33704 - RNA, 64 nt, Homo Sapiens
aaguaaggggugagcaguuaaugagagaaaagcuaaaaaaaaaaaaaauaacaacaaaaaaaaa

SEQ ID NO: 33705 - RNA, 64 nt, Homo Sapiens
agagaaaagcuaaaaaaaaaaaaaauaacaacaaaaaaaaaaugauaugugacaucuuuuuaaa

SEQ ID NO: 33706 - RNA, 64 nt, Homo Sapiens
gagagaaaagcuaaaaaaaaaaaaaauaacaacaaaaaaaaaaucauaugugacaucuuuuuaa

SEQ ID NO: 33707 - RNA, 64 nt, Homo Sapiens
ugagagaaaagcuaaaaaaaaaaaaaauaacaacaaaaaaaaaaucauaugugacaucuuuuua

SEQ ID NO: 33708 - RNA, 64 nt, Homo Sapiens
acaacaaaaaaaaaaugagaugugacaucuuuuuaaaaaaaauacuaaaguuccccaguucaua

SEQ ID NO: 33709 - RNA, 64 nt, Homo Sapiens
cgaucacucaguguguguuuaauccuuuauauacaaaaaaaauaguauuaaauuggaauuuuuu

SEQ ID NO: 33710 - RNA, 64 nt, Homo Sapiens
acccaagugacuccuuucuaguuaagaaaggggaaaaaaaaauauggccauuggcuugugcugu

SEQ ID NO: 33711 - RNA, 64 nt, Homo Sapiens
aacccaagugacuccuuucuuguuaagaaaggggaaaaaaaaaucuggccauuggcuugugcug

SEQ ID NO: 33712 - RNA, 64 nt, Homo Sapiens
guuuagugaauacagaggaauagccuuacaaaaaaaaaaaaauuaaaacaaaaagcuacaaaag

SEQ ID NO: 33713 - RNA, 64 nt, Homo Sapiens
uguuuagugaauacagaggaguagccuuacaaaaaaaaaaaaaugaaaacaaaaagcuacaaaa

SEQ ID NO: 33714 - RNA, 64 nt, Homo Sapiens
uuguuuagugaauacagaggaguagccuuacaaaaaaaaaaaaaggaaaacaaaaagcuacaaa

SEQ ID NO: 33715 - RNA, 64 nt, Homo Sapiens
auuguuuagugaauacagagaaguagccuuacaaaaaaaaaaaagggaaaacaaaaagcuacaa

SEQ ID NO: 33716 - RNA, 64 nt, Homo Sapiens
aauuguuuagugaauacagaaaaguagccuuacaaaaaaaaaaaagggaaaacaaaaagcuaca

SEQ ID NO: 33717 - RNA, 64 nt, Homo Sapiens
aaauuguuuagugaauacagaaaaguagccuuacaaaaaaaaaaaagggaaaacaaaaagcuac

SEQ ID NO: 33718 - RNA, 64 nt, Homo Sapiens
aaagcuauacuauaucucucuuggguugguucaaaaaaaaaauagacaguugccaguggaaaug

SEQ ID NO: 33719 - RNA, 64 nt, Homo Sapiens
aaaagcuauacuauaucucuguuggguugguucaaaaaaaaaauugacaguugccaguggaaau

SEQ ID NO: 33720 - RNA, 64 nt, Homo Sapiens
uaaaagcuauacuauaucucuguuggguugguucaaaaaaaaaauugacaguugccaguggaaa

SEQ ID NO: 33721 - RNA, 64 nt, Homo Sapiens
acagaaacacugccugauauuuagguacuagaaaaaaaaaaagguguaguugaagaagccuaaa

SEQ ID NO: 33722 - RNA, 64 nt, Homo Sapiens
gacagaaacacugccugauaauuagguacuagaaaaaaaaaaagauguaguugaagaagccuaa

SEQ ID NO: 33723 - RNA, 64 nt, Homo Sapiens
ggacagaaacacugccugauaauuagguacuagaaaaaaaaaaacauguaguugaagaagccua

SEQ ID NO: 33724 - RNA, 64 nt, Homo Sapiens
aggacagaaacacugccugaaaauuagguacuagaaaaaaaaaaacauguaguugaagaagccu

SEQ ID NO: 33725 - RNA, 64 nt, Homo Sapiens
cuauaaaauggugaaagcuuaaaaaaaaaaaaaaaaaaaaaaugcugccuaaaaaaaaaaaaaa

SEQ ID NO: 33726 - RNA, 64 nt, Homo Sapiens
gcuauaaaauggugaaagcuaaaaaaaaaaaaaaaaaaaaaaaugcugccuaaaaaaaaaaaaa

SEQ ID NO: 33727 - RNA, 64 nt, Homo Sapiens
ugcuauaaaauggugaaagcaaaaaaaaaaaaaaaaaaaaaaaaugcugccuaaaaaaaaaaaa

SEQ ID NO: 33728 - RNA, 64 nt, Homo Sapiens
augcuauaaaauggugaaagaaaaaaaaaaaaaaaaaaaaaaaauugcugccuaaaaaaaaaaa

SEQ ID NO: 33729 - RNA, 64 nt, Homo Sapiens
aaugcuauaaaauggugaaaaaaaaaaaaaaaaaaaaaaaaaaaguugcugccuaaaaaaaaaa

SEQ ID NO: 33730 - RNA, 64 nt, Homo Sapiens
aaaugcuauaaaauggugaaaaaaaaaaaaaaaaaaaaaaaaaauguugcugccuaaaaaaaaa

SEQ ID NO: 33731 - RNA, 64 nt, Homo Sapiens
aaaaugcuauaaaauggugaaaaaaaaaaaaaaaaaaaaaaaaaguguugcugccuaaaaaaaa

SEQ ID NO: 33732 - RNA, 64 nt, Homo Sapiens
aaaaaugcuauaaaauggugaaaaaaaaaaaaaaaaaaaaaaaaaguguugcugccuaaaaaaa

SEQ ID NO: 33733 - RNA, 64 nt, Homo Sapiens
aaaaaaugcuauaaaaugguaaaaaaaaaaaaaaaaaaaaaaaacaguguugcugccuaaaaaa

SEQ ID NO: 33734 - RNA, 64 nt, Homo Sapiens
aaaaaaaugcuauaaaauggaaaaaaaaaaaaaaaaaaaaaaaaccaguguugcugccuaaaaa

SEQ ID NO: 33735 - RNA, 64 nt, Homo Sapiens
aaaaaaaaugcuauaaaaugaaaaaaaaaaaaaaaaaaaaaaaagccaguguugcugccuaaaa

SEQ ID NO: 33736 - RNA, 64 nt, Homo Sapiens
aaaaaaaaaugcuauaaaauaaaaaaaaaaaaaaaaaaaaaaaaggccaguguugcugccuaaa

SEQ ID NO: 33737 - RNA, 64 nt, Homo Sapiens
aaaaaaaaaaugcuauaaaaaaaaaaaaaaaaaaaaaaaaaaaaaggccaguguugcugccuaa

SEQ ID NO: 33738 - RNA, 64 nt, Homo Sapiens
aaaaaaaaaaaugcuauaaaaaaaaaaaaaaaaaaaaaaaaaaaaaggccaguguugcugccua

SEQ ID NO: 33739 - RNA, 64 nt, Homo Sapiens
aaaaaaaaaaaaugcuauaaaaaaaaaaaaaaaaaaaaaaaaaacaaggccaguguugcugccu

SEQ ID NO: 33740 - RNA, 64 nt, Homo Sapiens
aaaaaaaaaaaaaugcuauauaaaaaaaaaaaaaaaaaaaaaaaccaaggccaguguugcugcc

SEQ ID NO: 33741 - RNA, 64 nt, Homo Sapiens
aaaaaaaaaaaaaaugcuaucuaaaaaaaaaaaaaaaaaaaaaagccaaggccaguguugcugc

SEQ ID NO: 33742 - RNA, 64 nt, Homo Sapiens
aaaaaaaaaaaaaaaugcuaccuaaaaaaaaaaaaaaaaaaaaaugccaaggccaguguugcug

SEQ ID NO: 33743 - RNA, 64 nt, Homo Sapiens
aaaaaaaaaaaaaaaaugcugccuaaaaaaaaaaaaaaaaaaaauugccaaggccaguguugcu

SEQ ID NO: 33744 - RNA, 64 nt, Homo Sapiens
aaaaaaaaaaaaaaaaaugcugccuaaaaaaaaaaaaaaaaaaauuugccaaggccaguguugc

SEQ ID NO: 33745 - RNA, 64 nt, Homo Sapiens
aaaaaaaaaaaaaaaaaaugcugccuaaaaaaaaaaaaaaaaaauuuugccaaggccaguguug

SEQ ID NO: 33746 - RNA, 64 nt, Homo Sapiens
aaaaaaaaaaaaaaaaaaaugcugccuaaaaaaaaaaaaaaaaauuuuugccaaggccaguguu

SEQ ID NO: 33747 - RNA, 64 nt, Homo Sapiens
aaaaaaaaaaaaaaaaaaaaugcugccuaaaaaaaaaaaaaaaauuuuuugccaaggccagugu

SEQ ID NO: 33748 - RNA, 64 nt, Homo Sapiens
aaaaaaaaaaaaaaaaaaaauugcugccuaaaaaaaaaaaaaaauuuuuuugccaaggccagug

SEQ ID NO: 33749 - RNA, 64 nt, Homo Sapiens
aaaaaaaaaaaaaaaaaaaaguugcugccuaaaaaaaaaaaaaauuuuuuuugccaaggccagu

SEQ ID NO: 33750 - RNA, 64 nt, Homo Sapiens
aaaaaaaaaaaaaaaaaaaauguugcugccuaaaaaaaaaaaaauuuuuuuuugccaaggccag

SEQ ID NO: 33751 - RNA, 64 nt, Homo Sapiens
aaaaaaaaaaaaaaaaaaaaguguugcugccuaaaaaaaaaaaauuuuuuuuuugccaaggcca

SEQ ID NO: 33752 - RNA, 64 nt, Homo Sapiens
aaaaaaaaaaaaaaaaaaaaaguguugcugccuaaaaaaaaaaauuuuuuuuuuugccaaggcc

SEQ ID NO: 33753 - RNA, 64 nt, Homo Sapiens
aaaaaaaaaaaaaaaaaaaacaguguugcugccuaaaaaaaaaauuuuuuuuuuuugccaaggc

SEQ ID NO: 33754 - RNA, 64 nt, Homo Sapiens
cuucuaaucagaagccacugcuauuugguuuaaaaaaaaaaagucuccagccagcuucuugagc

SEQ ID NO: 33755 - RNA, 64 nt, Homo Sapiens
ucuucuaaucagaagccacuccuauuugguuuaaaaaaaaaaagccuccagccagcuucuugag

SEQ ID NO: 33756 - RNA, 64 nt, Homo Sapiens
gucuucuaaucagaagccacgccuauuugguuuaaaaaaaaaaaaccuccagccagcuucuuga

SEQ ID NO: 33757 - RNA, 64 nt, Homo Sapiens
agucuucuaaucagaagccaagccuauuugguuuaaaaaaaaaaaaccuccagccagcuucuug

SEQ ID NO: 33758 - RNA, 64 nt, Homo Sapiens
uuuuuucaaauuucuucauucuccuuuggcuuuuaaaaaaaauuucauuaggggcuuaagcuag

SEQ ID NO: 33759 - RNA, 64 nt, Homo Sapiens
cauguuacacauuuaaguuuaaacugugucucaaaaaaaaaagucuagccugggugacagagca

SEQ ID NO: 33760 - RNA, 64 nt, Homo Sapiens
ucauguuacacauuuaaguuaaaacugugucucaaaaaaaaaagucuagccugggugacagagc

SEQ ID NO: 33761 - RNA, 64 nt, Homo Sapiens
gucauguuacacauuuaagucaaaacugugucucaaaaaaaaaacucuagccugggugacagag

SEQ ID NO: 33762 - RNA, 64 nt, Homo Sapiens
cuuaaauauuuguaauuguggggugauugaaagaaaaaaaaauaugcuccuagagaggagaaag

SEQ ID NO: 33763 - RNA, 64 nt, Homo Sapiens
acuuaaauauuuguaauuguggggugauugaaagaaaaaaaaauaugcuccuagagaggagaaa

SEQ ID NO: 33764 - RNA, 64 nt, Homo Sapiens
uaucuugaaaauguuuuggauuuuaaguuaaaaaaaaaaaaagcgucugaaaauagaacuugcc

SEQ ID NO: 33765 - RNA, 64 nt, Homo Sapiens
cuaucuugaaaauguuuuggcuuuuaaguuaaaaaaaaaaaaagagucugaaaauagaacuugc

SEQ ID NO: 33766 - RNA, 64 nt, Homo Sapiens
gcuaucuugaaaauguuuugccuuuuaaguuaaaaaaaaaaaaaaagucugaaaauagaacuug

SEQ ID NO: 33767 - RNA, 64 nt, Homo Sapiens
agcuaucuugaaaauguuuugccuuuuaaguuaaaaaaaaaaaaaaagucugaaaauagaacuu

SEQ ID NO: 33768 - RNA, 64 nt, Homo Sapiens
aagcuaucuugaaaauguuuugccuuuuaaguuaaaaaaaaaaagaaagucugaaaauagaacu

SEQ ID NO: 33769 - RNA, 64 nt, Homo Sapiens
aaagcuaucuugaaaauguuuugccuuuuaaguuaaaaaaaaaacgaaagucugaaaauagaac

SEQ ID NO: 33770 - RNA, 64 nt, Homo Sapiens
gcuugccuaacucauacuuugcguuuacagcuuaaaaaaaaagcuacggggccagucaugugaa

SEQ ID NO: 33771 - RNA, 64 nt, Homo Sapiens
cgcuugccuaacucauacuuagcguuuacagcuuaaaaaaaaaguuacggggccagucauguga

SEQ ID NO: 33772 - RNA, 64 nt, Homo Sapiens
aaaagagaaaaaaaucacaaggauuccuuugaagaaaaaaaagaauuucugauccacaaugcau

SEQ ID NO: 33773 - RNA, 64 nt, Homo Sapiens
aaaacauggcaaaaaauaaacacugauggacaaaaaaaaaaaguuauuuuuaagauuaaaggua

SEQ ID NO: 33774 - RNA, 64 nt, Homo Sapiens
uaaaacauggcaaaaaauaaacacugauggacaaaaaaaaaaagguauuuuuaagauuaaaggu

SEQ ID NO: 33775 - RNA, 64 nt, Homo Sapiens
guaaaacauggcaaaaaauauacacugauggacaaaaaaaaaaauguauuuuuaagauuaaagg

SEQ ID NO: 33776 - RNA, 64 nt, Homo Sapiens
aguaaaacauggcaaaaaauguacacugauggacaaaaaaaaaaguguauuuuuaagauuaaag

SEQ ID NO: 33777 - RNA, 64 nt, Homo Sapiens
agaaagcuacggaaccugccccaagugaaaaaaaaaaaaaaacugucuaucaaaacuauuugau

SEQ ID NO: 33778 - RNA, 64 nt, Homo Sapiens
uagaaagcuacggaaccugcuccaagugaaaaaaaaaaaaaaacugucuaucaaaacuauuuga

SEQ ID NO: 33779 - RNA, 64 nt, Homo Sapiens
cuagaaagcuacggaaccugauccaagugaaaaaaaaaaaaaaacugucuaucaaaacuauuug

SEQ ID NO: 33780 - RNA, 64 nt, Homo Sapiens
acuagaaagcuacggaaccugauccaagugaaaaaaaaaaaaaaucugucuaucaaaacuauuu

SEQ ID NO: 33781 - RNA, 64 nt, Homo Sapiens
aacuagaaagcuacggaaccugauccaagugaaaaaaaaaaaaauucugucuaucaaaacuauu

SEQ ID NO: 33782 - RNA, 64 nt, Homo Sapiens
aaacuagaaagcuacggaacuugauccaagugaaaaaaaaaaaauuucugucuaucaaaacuau

SEQ ID NO: 33783 - RNA, 64 nt, Homo Sapiens
aaaacuagaaagcuacggaauuugauccaagugaaaaaaaaaaauuuucugucuaucaaaacua

SEQ ID NO: 33784 - RNA, 64 nt, Homo Sapiens
aaaaacuagaaagcuacggaauuugauccaagugaaaaaaaaaauuuuucugucuaucaaaacu

SEQ ID NO: 33785 - RNA, 64 nt, Homo Sapiens
uauaagaacucaaggucccaaaaagugaaaaaaaaaaaaaaagacuauuauuaaacuuuuucua

SEQ ID NO: 33786 - RNA, 64 nt, Homo Sapiens
auauaagaacucaaggucccaaaaagugaaaaaaaaaaaaaaaggcuauuauuaaacuuuuucu

SEQ ID NO: 33787 - RNA, 64 nt, Homo Sapiens
gauauaagaacucaagguccuaaaaagugaaaaaaaaaaaaaaaugcuauuauuaaacuuuuuc

SEQ ID NO: 33788 - RNA, 64 nt, Homo Sapiens
agauauaagaacucaagguccuaaaaagugaaaaaaaaaaaaaacugcuauuauuaaacuuuuu

SEQ ID NO: 33789 - RNA, 64 nt, Homo Sapiens
aagauauaagaacucaagguucuaaaaagugaaaaaaaaaaaaaccugcuauuauuaaacuuuu

SEQ ID NO: 33790 - RNA, 64 nt, Homo Sapiens
aaagauauaagaacucaagguucuaaaaagugaaaaaaaaaaaaaccugcuauuauuaaacuuu

SEQ ID NO: 33791 - RNA, 64 nt, Homo Sapiens
aaaagauauaagaacucaaguuucuaaaaagugaaaaaaaaaaaaaccugcuauuauuaaacuu

SEQ ID NO: 33792 - RNA, 64 nt, Homo Sapiens
aaaaagauauaagaacucaauuuucuaaaaagugaaaaaaaaaauaaccugcuauuauuaaacu

SEQ ID NO: 33793 - RNA, 64 nt, Homo Sapiens
auauauauauauaaaauaaaugcucucagaaaaaaaaaaaaagcaugugaagucugaguaaggu

SEQ ID NO: 33794 - RNA, 64 nt, Homo Sapiens
cauauauauauauaaaauaauugcucucagaaaaaaaaaaaaagaaugugaagucugaguaagg

SEQ ID NO: 33795 - RNA, 64 nt, Homo Sapiens
gcauauauauauauaaaauaguugcucucagaaaaaaaaaaaaaaaaugugaagucugaguaag

SEQ ID NO: 33796 - RNA, 64 nt, Homo Sapiens
agcauauauauauauaaaaugguugcucucagaaaaaaaaaaaauaaaugugaagucugaguaa

SEQ ID NO: 33797 - RNA, 64 nt, Homo Sapiens
aagcauauauauauauaaaaagguugcucucagaaaaaaaaaaaauaaaugugaagucugagua

SEQ ID NO: 33798 - RNA, 64 nt, Homo Sapiens
aaagcauauauauauauaaaaagguugcucucagaaaaaaaaaagauaaaugugaagucugagu

SEQ ID NO: 33799 - RNA, 64 nt, Homo Sapiens
caguggaaauagagaaguaacugucucaaaaaaaaaaaaaaaggaccugggcaacagugagacc

SEQ ID NO: 33800 - RNA, 64 nt, Homo Sapiens
gcaguggaaauagagaaguaccugucucaaaaaaaaaaaaaaagcaccugggcaacagugagac

SEQ ID NO: 33801 - RNA, 64 nt, Homo Sapiens
ggcaguggaaauagagaagucccugucucaaaaaaaaaaaaaaaccaccugggcaacagugaga

SEQ ID NO: 33802 - RNA, 64 nt, Homo Sapiens
aggcaguggaaauagagaagacccugucucaaaaaaaaaaaaaacccaccugggcaacagugag

SEQ ID NO: 33803 - RNA, 64 nt, Homo Sapiens
aaggcaguggaaauagagaagacccugucucaaaaaaaaaaaaaucccaccugggcaacaguga

SEQ ID NO: 33804 - RNA, 64 nt, Homo Sapiens
aaaggcaguggaaauagagaagacccugucucaaaaaaaaaaaacucccaccugggcaacagug

SEQ ID NO: 33805 - RNA, 64 nt, Homo Sapiens
aaaaggcaguggaaauagaggagacccugucucaaaaaaaaaaagcucccaccugggcaacagu

SEQ ID NO: 33806 - RNA, 64 nt, Homo Sapiens
aaaaaggcaguggaaauagaugagacccugucucaaaaaaaaaaugcucccaccugggcaacag

SEQ ID NO: 33807 - RNA, 64 nt, Homo Sapiens
uagccaggcgugguggugcgaaaaaauacaaaaaaaaaaaaaucuggcgaaacuccauuucuau

SEQ ID NO: 33808 - RNA, 64 nt, Homo Sapiens
cuagccaggcgugguggugcuaaaaaauacaaaaaaaaaaaaauauggcgaaacuccauuucua

SEQ ID NO: 33809 - RNA, 64 nt, Homo Sapiens
ucuagccaggcgugguggugauaaaaaauacaaaaaaaaaaaaacauggcgaaacuccauuucu

SEQ ID NO: 33810 - RNA, 64 nt, Homo Sapiens
aucuagccaggcguggugguuauaaaaaauacaaaaaaaaaaaaacauggcgaaacuccauuuc

SEQ ID NO: 33811 - RNA, 64 nt, Homo Sapiens
aaucuagccaggcgugguggcuauaaaaaauacaaaaaaaaaaaaacauggcgaaacuccauuu

SEQ ID NO: 33812 - RNA, 64 nt, Homo Sapiens
aaaucuagccaggcguggugucuauaaaaaauacaaaaaaaaaacaacauggcgaaacuccauu

SEQ ID NO: 33813 - RNA, 64 nt, Homo Sapiens
acucuauguugccccacuuuugucaauuaaggaaaaaaaaaaucuuguugaaauguuuugcauc

SEQ ID NO: 33814 - RNA, 64 nt, Homo Sapiens
cacucuauguugccccacuucugucaauuaaggaaaaaaaaaaucuuguugaaauguuuugcau

SEQ ID NO: 33815 - RNA, 64 nt, Homo Sapiens
ucacucuauguugccccacuucugucaauuaaggaaaaaaaaaagcuuguugaaauguuuugca

SEQ ID NO: 33816 - RNA, 64 nt, Homo Sapiens
ucuuuaggcauuugccuaaguggaaaaggaaaaaaaaaaaaacuuagcucauuauuuccaucuu

SEQ ID NO: 33817 - RNA, 64 nt, Homo Sapiens
uucuuuaggcauuugccuaauuggaaaaggaaaaaaaaaaaaaccuagcucauuauuuccaucu

SEQ ID NO: 33818 - RNA, 64 nt, Homo Sapiens
cuucuuuaggcauuugccuauuuggaaaaggaaaaaaaaaaaaaacuagcucauuauuuccauc

SEQ ID NO: 33819 - RNA, 64 nt, Homo Sapiens
acuucuuuaggcauuugccucuuuggaaaaggaaaaaaaaaaaaaacuagcucauuauuuccau

SEQ ID NO: 33820 - RNA, 64 nt, Homo Sapiens
aacuucuuuaggcauuugccucuuuggaaaaggaaaaaaaaaaaaaacuagcucauuauuucca

SEQ ID NO: 33821 - RNA, 64 nt, Homo Sapiens
aaacuucuuuaggcauuugcaucuuuggaaaaggaaaaaaaaaauaaacuagcucauuauuucc

SEQ ID NO: 33822 - RNA, 64 nt, Homo Sapiens
aaggggaaaauuauuuaaauacaagaaacaaaacaaaaaaaauuaccgcuuuuuaaaauucaaa

SEQ ID NO: 33823 - RNA, 64 nt, Homo Sapiens
ggggagggaaugggagagaaaccuuugcaaaguuaaaaaaaaggcucuuuccuccuugccacuu

SEQ ID NO: 33824 - RNA, 64 nt, Homo Sapiens
cauuuguauguuaaguccuaggauaaaauauugcaaaaaaaacauauauuuuuuuaauuuggca

SEQ ID NO: 33825 - RNA, 64 nt, Homo Sapiens
aaaacaaacaggcugccauaggaaauaaaaagaaaaaaaaaacaaccuuuuuguuagugaauuu

SEQ ID NO: 33826 - RNA, 64 nt, Homo Sapiens
aaaaacaaacaggcugccauuggaaauaaaaagaaaaaaaaaacuaccuuuuuguuagugaauu

SEQ ID NO: 33827 - RNA, 64 nt, Homo Sapiens
caaaaacaaacaggcugccauuggaaauaaaaagaaaaaaaaaaguaccuuuuuguuagugaau

SEQ ID NO: 33828 - RNA, 64 nt, Homo Sapiens
acauuucugaccuguacuuaugcuuugcagaaaaaaaaaaaaucaaagugcuuaauauuguuau

SEQ ID NO: 33829 - RNA, 64 nt, Homo Sapiens
cacauuucugaccuguacuuuugcuuugcagaaaaaaaaaaaauaaaagugcuuaauauuguua

SEQ ID NO: 33830 - RNA, 64 nt, Homo Sapiens
ucacauuucugaccuguacuauugcuuugcagaaaaaaaaaaaaaaaaagugcuuaauauuguu

SEQ ID NO: 33831 - RNA, 64 nt, Homo Sapiens
aucacauuucugaccuguacuauugcuuugcagaaaaaaaaaaaaaaaaagugcuuaauauugu

SEQ ID NO: 33832 - RNA, 64 nt, Homo Sapiens
aaucacauuucugaccuguauuauugcuuugcagaaaaaaaaaaaaaaaaagugcuuaauauug

SEQ ID NO: 33833 - RNA, 64 nt, Homo Sapiens
uauagaaacuuguauuugggugaauuuuuauuucaaaaaaaauguuuuuuucugccuugggugu

SEQ ID NO: 33834 - RNA, 64 nt, Homo Sapiens
cccuuuucuuuuccuugaaauuuuacaaaacaagaaaaaaaauauaaucgagaaugccugggca

SEQ ID NO: 33835 - RNA, 64 nt, Homo Sapiens
guguguauguguguuggagcacauacaaggguaaaaaaaaaauuauacguuuacaguauugggu

SEQ ID NO: 33836 - RNA, 64 nt, Homo Sapiens
uguguguauguguguuggaguacauacaaggguaaaaaaaaaauaauacguuuacaguauuggg

SEQ ID NO: 33837 - RNA, 64 nt, Homo Sapiens
uuguguguauguguguuggaguacauacaaggguaaaaaaaaaaaaauacguuuacaguauugg

SEQ ID NO: 33838 - RNA, 64 nt, Homo Sapiens
cugguugaagauagaggauacuuuaaguaaaaaaaaaaaaaauuaacuaacaaagccacauuua

SEQ ID NO: 33839 - RNA, 64 nt, Homo Sapiens
ucugguugaagauagaggauacuuuaaguaaaaaaaaaaaaaauaaacuaacaaagccacauuu

SEQ ID NO: 33840 - RNA, 64 nt, Homo Sapiens
uucugguugaagauagaggauacuuuaaguaaaaaaaaaaaaaagaaacuaacaaagccacauu

SEQ ID NO: 33841 - RNA, 64 nt, Homo Sapiens
auucugguugaagauagagguuacuuuaaguaaaaaaaaaaaaaagaaacuaacaaagccacau

SEQ ID NO: 33842 - RNA, 64 nt, Homo Sapiens
aauucugguugaagauagaguuuacuuuaaguaaaaaaaaaaaauagaaacuaacaaagccaca

SEQ ID NO: 33843 - RNA, 64 nt, Homo Sapiens
aaauucugguugaagauagaauuuacuuuaaguaaaaaaaaaaauuagaaacuaacaaagccac

SEQ ID NO: 33844 - RNA, 64 nt, Homo Sapiens
aaaauucugguugaagauagcauuuacuuuaaguaaaaaaaaaauuuagaaacuaacaaagcca

SEQ ID NO: 33845 - RNA, 64 nt, Homo Sapiens
aaacacucauaccuguaguuugggccuuuaaaaaaaaaaaaagggaacauuuaaauuaaguuaa

SEQ ID NO: 33846 - RNA, 64 nt, Homo Sapiens
gaaacacucauaccuguaguaugggccuuuaaaaaaaaaaaaagggaacauuuaaauuaaguua

SEQ ID NO: 33847 - RNA, 64 nt, Homo Sapiens
ggaaacacucauaccuguagaaugggccuuuaaaaaaaaaaaaagggaacauuuaaauuaaguu

SEQ ID NO: 33848 - RNA, 64 nt, Homo Sapiens
aggaaacacucauaccuguauaaugggccuuuaaaaaaaaaaaaugggaacauuuaaauuaagu

SEQ ID NO: 33849 - RNA, 64 nt, Homo Sapiens
aaggaaacacucauaccuguuuaaugggccuuuaaaaaaaaaaaaugggaacauuuaaauuaag

SEQ ID NO: 33850 - RNA, 64 nt, Homo Sapiens
aaaggaaacacucauaccugguuaaugggccuuuaaaaaaaaaagaugggaacauuuaaauuaa

SEQ ID NO: 33851 - RNA, 64 nt, Homo Sapiens
aucugaaaugugacauuuucuaaaugccucccuuaaaaaaaaaacugcugaaaaucugugcuau

SEQ ID NO: 33852 - RNA, 64 nt, Homo Sapiens
ucugaaaugugacauuuucuaaaugccucccuuaaaaaaaaaacugcugaaaaucugugcuauu

SEQ ID NO: 33853 - RNA, 64 nt, Homo Sapiens
cugaaaugugacauuuucuaaaugccucccuuaaaaaaaaaacugcugaaaaucugugcuauuu

SEQ ID NO: 33854 - RNA, 64 nt, Homo Sapiens
uuauuagaagaaaaguacuguacugaaaauucagaaaaaaaaucucaaccuuaugccaaaaugg

SEQ ID NO: 33855 - RNA, 64 nt, Homo Sapiens
caacauggugaaacccugucucuacuaaaaauacaaaaaaaaauuagcugggcauagugguggg

SEQ ID NO: 33856 - RNA, 64 nt, Homo Sapiens
aacauggugaaacccugucucuacuaaaaauacaaaaaaaaauuagcugggcauaguggugggu

SEQ ID NO: 33857 - RNA, 64 nt, Homo Sapiens
cuccaaccuaggugacaaagcuacacgccaucucaaaaaaaaaaaagaaaaaggguuacaaaag

SEQ ID NO: 33858 - RNA, 64 nt, Homo Sapiens
uccaaccuaggugacaaagcuacacgccaucucaaaaaaaaaaaagaaaaaggguuacaaaagg

SEQ ID NO: 33859 - RNA, 64 nt, Homo Sapiens
ccaaccuaggugacaaagcuacacgccaucucaaaaaaaaaaaagaaaaaggguuacaaaaggu

SEQ ID NO: 33860 - RNA, 64 nt, Homo Sapiens
caaccuaggugacaaagcuacacgccaucucaaaaaaaaaaaagaaaaaggguuacaaaagguu

SEQ ID NO: 33861 - RNA, 64 nt, Homo Sapiens
aaccuaggugacaaagcuacacgccaucucaaaaaaaaaaaagaaaaaggguuacaaaagguuc

SEQ ID NO: 33862 - RNA, 64 nt, Homo Sapiens
uugguaccuacaacaugcuugauuuugagugauuaaaaaaaaauaauuuggcugggugcugugg

SEQ ID NO: 33863 - RNA, 64 nt, Homo Sapiens
ugguaccuacaacaugcuugauuuugagugauuaaaaaaaaauaauuuggcugggugcuguggc

SEQ ID NO: 33864 - RNA, 64 nt, Homo Sapiens
uccagccuuggugacagagcaagacuccgucuccaaaaaaaagaaaaaaaaauuucuugaagug

SEQ ID NO: 33865 - RNA, 64 nt, Homo Sapiens
ggugacagagcaagacuccgucuccaaaaaaaagaaaaaaaaauuucuugaaguggaaugaugu

SEQ ID NO: 33866 - RNA, 64 nt, Homo Sapiens
gugacagagcaagacuccgucuccaaaaaaaagaaaaaaaaauuucuugaaguggaaugaugua

SEQ ID NO: 33867 - RNA, 64 nt, Homo Sapiens
gcuaggcugcauagcauuauaaccugggaacguuaaaaaaaauacagacauucuugauucuuag

SEQ ID NO: 33868 - RNA, 64 nt, Homo Sapiens
uacuuucagaauuguauuucaguuuugaagauuuaaaaaaaaugugaaaauaaauauauauuag

SEQ ID NO: 33869 - RNA, 64 nt, Homo Sapiens
aagaacagaaaacaagaagucauaccuuuuucuuaaaaaaaaaaaaaaaguuuuugcuucaagu

SEQ ID NO: 33870 - RNA, 64 nt, Homo Sapiens
agaacagaaaacaagaagucauaccuuuuucuuaaaaaaaaaaaaaaaguuuuugcuucaagug

SEQ ID NO: 33871 - RNA, 64 nt, Homo Sapiens
gaacagaaaacaagaagucauaccuuuuucuuaaaaaaaaaaaaaaaguuuuugcuucaagugu

SEQ ID NO: 33872 - RNA, 64 nt, Homo Sapiens
aacagaaaacaagaagucauaccuuuuucuuaaaaaaaaaaaaaaaguuuuugcuucaaguguu

SEQ ID NO: 33873 - RNA, 64 nt, Homo Sapiens
acagaaaacaagaagucauaccuuuuucuuaaaaaaaaaaaaaaaguuuuugcuucaaguguuu

SEQ ID NO: 33874 - RNA, 64 nt, Homo Sapiens
cagaaaacaagaagucauaccuuuuucuuaaaaaaaaaaaaaaaguuuuugcuucaaguguuuu

SEQ ID NO: 33875 - RNA, 64 nt, Homo Sapiens
agaaaacaagaagucauaccuuuuucuuaaaaaaaaaaaaaaaguuuuugcuucaaguguuuug

SEQ ID NO: 33876 - RNA, 64 nt, Homo Sapiens
gaaaacaagaagucauaccuuuuucuuaaaaaaaaaaaaaaaguuuuugcuucaaguguuuugg

SEQ ID NO: 33877 - RNA, 64 nt, Homo Sapiens
uuuacuuuuuuuuaugaucaaggaaaagaucauuaaaaaaaaacacaaagaaguuuuucuuugu

SEQ ID NO: 33878 - RNA, 64 nt, Homo Sapiens
uuacuuuuuuuuaugaucaaggaaaagaucauuaaaaaaaaacacaaagaaguuuuucuuugug

SEQ ID NO: 33879 - RNA, 64 nt, Homo Sapiens
cuucuuaaaaucaaauguaaaucaauuacagauuaaaaaaaaaagccuguauuuaacucauaug

SEQ ID NO: 33880 - RNA, 64 nt, Homo Sapiens
uucuuaaaaucaaauguaaaucaauuacagauuaaaaaaaaaagccuguauuuaacucauauga

SEQ ID NO: 33881 - RNA, 64 nt, Homo Sapiens
ucuuaaaaucaaauguaaaucaauuacagauuaaaaaaaaaagccuguauuuaacucauaugau

SEQ ID NO: 33882 - RNA, 64 nt, Homo Sapiens
gugaaaaauuauaaucuacuuaaacucuaaucagaaaaaaaauucucaaaaaaacuauuaugaa

SEQ ID NO: 33883 - RNA, 64 nt, Homo Sapiens
uuauuguuuuguuauuuaaguuuauguuauuuauaaaaaaaaaaccuuaauaagcuguaucugu

SEQ ID NO: 33884 - RNA, 64 nt, Homo Sapiens
uauuguuuuguuauuuaaguuuauguuauuuauaaaaaaaaaaccuuaauaagcuguaucuguu

SEQ ID NO: 33885 - RNA, 64 nt, Homo Sapiens
auuguuuuguuauuuaaguuuauguuauuuauaaaaaaaaaaccuuaauaagcuguaucuguuu

SEQ ID NO: 33886 - RNA, 64 nt, Homo Sapiens
uuugggcuguauuugugcacuaaaucuuuauucuaaaaaaaaaaauggaaacuuuaauuuuuuu

SEQ ID NO: 33887 - RNA, 64 nt, Homo Sapiens
uugggcuguauuugugcacuaaaucuuuauucuaaaaaaaaaaauggaaacuuuaauuuuuuua

SEQ ID NO: 33888 - RNA, 64 nt, Homo Sapiens
ugggcuguauuugugcacuaaaucuuuauucuaaaaaaaaaaauggaaacuuuaauuuuuuuaa

SEQ ID NO: 33889 - RNA, 64 nt, Homo Sapiens
gggcuguauuugugcacuaaaucuuuauucuaaaaaaaaaaauggaaacuuuaauuuuuuuaaa

SEQ ID NO: 33890 - RNA, 64 nt, Homo Sapiens
aaaccuaaaacuguucuaaaauagaaagucugugaaaaaaaacaaaaguaaaguuauaaaagga

SEQ ID NO: 33891 - RNA, 64 nt, Homo Sapiens
uuuuauaaaaugaauuuuguaauuuuuuucugagaaaaaaaaguucuuaaauacaauaaaauug

SEQ ID NO: 33892 - RNA, 64 nt, Homo Sapiens
cuaaucucuuauucuaauaaauauacuaugaaauaaaaaaaaaaggaugaaagcuacuuuugcu

SEQ ID NO: 33893 - RNA, 64 nt, Homo Sapiens
uaaucucuuauucuaauaaauauacuaugaaauaaaaaaaaaaggaugaaagcuacuuuugcuu

SEQ ID NO: 33894 - RNA, 64 nt, Homo Sapiens
aaucucuuauucuaauaaauauacuaugaaauaaaaaaaaaaggaugaaagcuacuuuugcuuu

SEQ ID NO: 33895 - RNA, 64 nt, Homo Sapiens
uauggaagucgugucuuacuccaggugaagggggaaaaaaaaagccuauacuuuggcagguuau

SEQ ID NO: 33896 - RNA, 64 nt, Homo Sapiens
auggaagucgugucuuacuccaggugaagggggaaaaaaaaagccuauacuuuggcagguuaug

SEQ ID NO: 33897 - RNA, 64 nt, Homo Sapiens
cagccuggccaacauagugggacccugucucuacaaaaaaaaaauuugccaagagccugaguga

SEQ ID NO: 33898 - RNA, 64 nt, Homo Sapiens
agccuggccaacauagugggacccugucucuacaaaaaaaaaauuugccaagagccugagugac

SEQ ID NO: 33899 - RNA, 64 nt, Homo Sapiens
gccuggccaacauagugggacccugucucuacaaaaaaaaaauuugccaagagccugagugaca

SEQ ID NO: 33900 - RNA, 64 nt, Homo Sapiens
caagagccugagugacagagcaagaccccaucucaaaaaaaaaaacaaacaaacaaaaaaaaaa

SEQ ID NO: 33901 - RNA, 64 nt, Homo Sapiens
aagagccugagugacagagcaagaccccaucucaaaaaaaaaaacaaacaaacaaaaaaaaaac

SEQ ID NO: 33902 - RNA, 64 nt, Homo Sapiens
agagccugagugacagagcaagaccccaucucaaaaaaaaaaacaaacaaacaaaaaaaaaacc

SEQ ID NO: 33903 - RNA, 64 nt, Homo Sapiens
gagccugagugacagagcaagaccccaucucaaaaaaaaaaacaaacaaacaaaaaaaaaacca

SEQ ID NO: 33904 - RNA, 64 nt, Homo Sapiens
caagaccccaucucaaaaaaaaaaacaaacaaacaaaaaaaaaaccauauauauacauauauau

SEQ ID NO: 33905 - RNA, 64 nt, Homo Sapiens
aagaccccaucucaaaaaaaaaaacaaacaaacaaaaaaaaaaccauauauauacauauauaua

SEQ ID NO: 33906 - RNA, 64 nt, Homo Sapiens
agaccccaucucaaaaaaaaaaacaaacaaacaaaaaaaaaaccauauauauacauauauauau

SEQ ID NO: 33907 - RNA, 64 nt, Homo Sapiens
aucuuaauguagauuauaauuuuggucuuuuaggaaaaaaaaacaaaaaucugauauuuauuuc

SEQ ID NO: 33908 - RNA, 64 nt, Homo Sapiens
ucuuaauguagauuauaauuuuggucuuuuaggaaaaaaaaacaaaaaucugauauuuauuuca

SEQ ID NO: 33909 - RNA, 64 nt, Homo Sapiens
cuccagccugggcgacagagugagacuccgucucaaaaaaaaaaaaaaaaagaaauguuucauu

SEQ ID NO: 33910 - RNA, 64 nt, Homo Sapiens
uccagccugggcgacagagugagacuccgucucaaaaaaaaaaaaaaaaagaaauguuucauuu

SEQ ID NO: 33911 - RNA, 64 nt, Homo Sapiens
ccagccugggcgacagagugagacuccgucucaaaaaaaaaaaaaaaaagaaauguuucauuuu

SEQ ID NO: 33912 - RNA, 64 nt, Homo Sapiens
cagccugggcgacagagugagacuccgucucaaaaaaaaaaaaaaaaagaaauguuucauuuug

SEQ ID NO: 33913 - RNA, 64 nt, Homo Sapiens
agccugggcgacagagugagacuccgucucaaaaaaaaaaaaaaaaagaaauguuucauuuugg

SEQ ID NO: 33914 - RNA, 64 nt, Homo Sapiens
gccugggcgacagagugagacuccgucucaaaaaaaaaaaaaaaaagaaauguuucauuuuggu

SEQ ID NO: 33915 - RNA, 64 nt, Homo Sapiens
ccugggcgacagagugagacuccgucucaaaaaaaaaaaaaaaaagaaauguuucauuuugguu

SEQ ID NO: 33916 - RNA, 64 nt, Homo Sapiens
cugggcgacagagugagacuccgucucaaaaaaaaaaaaaaaaagaaauguuucauuuugguuu

SEQ ID NO: 33917 - RNA, 64 nt, Homo Sapiens
ugggcgacagagugagacuccgucucaaaaaaaaaaaaaaaaagaaauguuucauuuugguuuu

SEQ ID NO: 33918 - RNA, 64 nt, Homo Sapiens
gggcgacagagugagacuccgucucaaaaaaaaaaaaaaaaagaaauguuucauuuugguuuuu

SEQ ID NO: 33919 - RNA, 64 nt, Homo Sapiens
acaucaccaucaucuaagagcgggucaaggaauuaaaaaaaaacaacaaaacguuuaagggguu

SEQ ID NO: 33920 - RNA, 64 nt, Homo Sapiens
caucaccaucaucuaagagcgggucaaggaauuaaaaaaaaacaacaaaacguuuaagggguua

SEQ ID NO: 33921 - RNA, 64 nt, Homo Sapiens
uauuuuaugagccccaguuuucugggcuuaguuuaaaaaaaaaaucaagucuaaacauugcauu

SEQ ID NO: 33922 - RNA, 64 nt, Homo Sapiens
auuuuaugagccccaguuuucugggcuuaguuuaaaaaaaaaaucaagucuaaacauugcauuu

SEQ ID NO: 33923 - RNA, 64 nt, Homo Sapiens
uuuuaugagccccaguuuucugggcuuaguuuaaaaaaaaaaucaagucuaaacauugcauuua

SEQ ID NO: 33924 - RNA, 64 nt, Homo Sapiens
agcuuuuguucuuggauaaaaagucauacacuuuaaaaaaaaaaaaaacuuuuuccaggaaaau

SEQ ID NO: 33925 - RNA, 64 nt, Homo Sapiens
gcuuuuguucuuggauaaaaagucauacacuuuaaaaaaaaaaaaaacuuuuuccaggaaaaua

SEQ ID NO: 33926 - RNA, 64 nt, Homo Sapiens
cuuuuguucuuggauaaaaagucauacacuuuaaaaaaaaaaaaaacuuuuuccaggaaaauau

SEQ ID NO: 33927 - RNA, 64 nt, Homo Sapiens
uuuuguucuuggauaaaaagucauacacuuuaaaaaaaaaaaaaacuuuuuccaggaaaauaua

SEQ ID NO: 33928 - RNA, 64 nt, Homo Sapiens
uuuguucuuggauaaaaagucauacacuuuaaaaaaaaaaaaaacuuuuuccaggaaaauauau

SEQ ID NO: 33929 - RNA, 64 nt, Homo Sapiens
uuguucuuggauaaaaagucauacacuuuaaaaaaaaaaaaaacuuuuuccaggaaaauauauu

SEQ ID NO: 33930 - RNA, 64 nt, Homo Sapiens
uguucuuggauaaaaagucauacacuuuaaaaaaaaaaaaaacuuuuuccaggaaaauauauug

SEQ ID NO: 33931 - RNA, 64 nt, Homo Sapiens
caugccacugcacuccagccugggugacacagccaaaaaaaaaaccacuaaguuagaucucuac

SEQ ID NO: 33932 - RNA, 64 nt, Homo Sapiens
augccacugcacuccagccugggugacacagccaaaaaaaaaaccacuaaguuagaucucuacc

SEQ ID NO: 33933 - RNA, 64 nt, Homo Sapiens
ugccacugcacuccagccugggugacacagccaaaaaaaaaaccacuaaguuagaucucuaccu

SEQ ID NO: 33934 - RNA, 64 nt, Homo Sapiens
ucuuuuccccuuauugagauuaauauuuaagauuaaaaaaaaaauacccaaagccaaaugcagu

SEQ ID NO: 33935 - RNA, 64 nt, Homo Sapiens
cuuuuccccuuauugagauuaauauuuaagauuaaaaaaaaaauacccaaagccaaaugcaguu

SEQ ID NO: 33936 - RNA, 64 nt, Homo Sapiens
uuuuccccuuauugagauuaauauuuaagauuaaaaaaaaaauacccaaagccaaaugcaguuc

SEQ ID NO: 33937 - RNA, 64 nt, Homo Sapiens
agagaggggaagaauuuaauggacugugaauuucaaaaaaaaaaaaaaagacugucaaaugaac

SEQ ID NO: 33938 - RNA, 64 nt, Homo Sapiens
gagaggggaagaauuuaauggacugugaauuucaaaaaaaaaaaaaaagacugucaaaugaacu

SEQ ID NO: 33939 - RNA, 64 nt, Homo Sapiens
agaggggaagaauuuaauggacugugaauuucaaaaaaaaaaaaaaagacugucaaaugaacuu

SEQ ID NO: 33940 - RNA, 64 nt, Homo Sapiens
gaggggaagaauuuaauggacugugaauuucaaaaaaaaaaaaaaagacugucaaaugaacuuu

SEQ ID NO: 33941 - RNA, 64 nt, Homo Sapiens
aggggaagaauuuaauggacugugaauuucaaaaaaaaaaaaaaagacugucaaaugaacuuuu

SEQ ID NO: 33942 - RNA, 64 nt, Homo Sapiens
ggggaagaauuuaauggacugugaauuucaaaaaaaaaaaaaaagacugucaaaugaacuuuua

SEQ ID NO: 33943 - RNA, 64 nt, Homo Sapiens
gggaagaauuuaauggacugugaauuucaaaaaaaaaaaaaaagacugucaaaugaacuuuuac

SEQ ID NO: 33944 - RNA, 64 nt, Homo Sapiens
ggaagaauuuaauggacugugaauuucaaaaaaaaaaaaaaagacugucaaaugaacuuuuaca

SEQ ID NO: 33945 - RNA, 64 nt, Homo Sapiens
aaagacugucaaaugaacuuuuacagaaugcauuaaaaaaaaaaaaaaacuccugugucgguca

SEQ ID NO: 33946 - RNA, 64 nt, Homo Sapiens
aagacugucaaaugaacuuuuacagaaugcauuaaaaaaaaaaaaaaacuccugugucggucag

SEQ ID NO: 33947 - RNA, 64 nt, Homo Sapiens
agacugucaaaugaacuuuuacagaaugcauuaaaaaaaaaaaaaaacuccugugucggucaga

SEQ ID NO: 33948 - RNA, 64 nt, Homo Sapiens
gacugucaaaugaacuuuuacagaaugcauuaaaaaaaaaaaaaaacuccugugucggucagaa

SEQ ID NO: 33949 - RNA, 64 nt, Homo Sapiens
acugucaaaugaacuuuuacagaaugcauuaaaaaaaaaaaaaaacuccugugucggucagaac

SEQ ID NO: 33950 - RNA, 64 nt, Homo Sapiens
cugucaaaugaacuuuuacagaaugcauuaaaaaaaaaaaaaaacuccugugucggucagaaca

SEQ ID NO: 33951 - RNA, 64 nt, Homo Sapiens
ugucaaaugaacuuuuacagaaugcauuaaaaaaaaaaaaaaacuccugugucggucagaacaa

SEQ ID NO: 33952 - RNA, 64 nt, Homo Sapiens
gucaaaugaacuuuuacagaaugcauuaaaaaaaaaaaaaaacuccugugucggucagaacaac

SEQ ID NO: 33953 - RNA, 63 nt, Homo Sapiens
ggaaaacaaaaauaucuugcaagcagaaccuuggaaaaaaaaagccaugaacacuuauucuaa

SEQ ID NO: 33954 - RNA, 62 nt, Homo Sapiens
gaaaacaaaaauaucuugcaagcagaaccuuggaaaaaaaaagccaugaacacuuauucuaa

SEQ ID NO: 33955 - RNA, 64 nt, Homo Sapiens
ugcuuacuguauacuuguuucauacuauucuuugaaaaaaaagaacuugaaauauuuucauuau

SEQ ID NO: 33956 - RNA, 64 nt, Homo Sapiens
uguuuuuguaggcaaaaagaaguuccucaguaagaaaaaaaaugauugaauaguacccaauuaa

SEQ ID NO: 33957 - RNA, 64 nt, Homo Sapiens
aaaaauuuaaaaaauuuuaaaaaaaaaggaaggaaaaaaaaagaaaacaaaacaaaauaaaaca

SEQ ID NO: 33958 - RNA, 64 nt, Homo Sapiens
aaaaaauuuaaaaaauuuuaaaaaaaaaggaaggaaaaaaaaagaaaacaaaacaaaauaaaac

SEQ ID NO: 33959 - RNA, 64 nt, Homo Sapiens
aaggaaaaaaaaagaaaaaaaaacaaaauaaaacaaaaaaaagggcaugcuguaaaacaaaaca

SEQ ID NO: 33960 - RNA, 64 nt, Homo Sapiens
cagacuguuggucuuacuaacaucaaaaaaaaaaaaaaaaaagaacagcuugaugcuguuucua

SEQ ID NO: 33961 - RNA, 64 nt, Homo Sapiens
acagacuguuggucuuacuaacaucaaaaaaaaaaaaaaaaaagaacagcuugaugcuguuucu

SEQ ID NO: 33962 - RNA, 64 nt, Homo Sapiens
gacagacuguuggucuuacuuacaucaaaaaaaaaaaaaaaaaaaaacagcuugaugcuguuuc

SEQ ID NO: 33963 - RNA, 64 nt, Homo Sapiens
agacagacuguuggucuuaccuacaucaaaaaaaaaaaaaaaaagaaacagcuugaugcuguuu

SEQ ID NO: 33964 - RNA, 64 nt, Homo Sapiens
aagacagacuguuggucuuaucuacaucaaaaaaaaaaaaaaaaagaaacagcuugaugcuguu

SEQ ID NO: 33965 - RNA, 64 nt, Homo Sapiens
aaagacagacuguuggucuuuucuacaucaaaaaaaaaaaaaaagagaaacagcuugaugcugu

SEQ ID NO: 33966 - RNA, 64 nt, Homo Sapiens
aaaagacagacuguuggucuuuucuacaucaaaaaaaaaaaaaaagagaaacagcuugaugcug

SEQ ID NO: 33967 - RNA, 64 nt, Homo Sapiens
aaaaagacagacuguuggucguuucuacaucaaaaaaaaaaaaagagagaaacagcuugaugcu

SEQ ID NO: 33968 - RNA, 64 nt, Homo Sapiens
aaaaaagacagacuguugguuguuucuacaucaaaaaaaaaaaaagagagaaacagcuugaugc

SEQ ID NO: 33969 - RNA, 64 nt, Homo Sapiens
aaaaaaagacagacuguuggcuguuucuacaucaaaaaaaaaaauagagagaaacagcuugaug

SEQ ID NO: 33970 - RNA, 64 nt, Homo Sapiens
aaaaaaaagacagacuguuggcuguuucuacaucaaaaaaaaaaguagagagaaacagcuugau

SEQ ID NO: 33971 - RNA, 64 nt, Homo Sapiens
uguuaagucacaaaaagcgggacguuauguuaaaaaaaaaaaggaauacuuguaugaggacugu

SEQ ID NO: 33972 - RNA, 64 nt, Homo Sapiens
guguuaagucacaaaaagcgugacguuauguuaaaaaaaaaaagaaauacuuguaugaggacug

SEQ ID NO: 33973 - RNA, 64 nt, Homo Sapiens
gguguuaagucacaaaaagcgugacguuauguuaaaaaaaaaaaaaaauacuuguaugaggacu

SEQ ID NO: 33974 - RNA, 64 nt, Homo Sapiens
agguguuaagucacaaaaagugugacguuauguuaaaaaaaaaauaaaauacuuguaugaggac

SEQ ID NO: 33975 - RNA, 64 nt, Homo Sapiens
auguuuuugcuaguaucagauuaccucaauugaaaaaaaaaagaauguuagauauucuaugugu

SEQ ID NO: 33976 - RNA, 64 nt, Homo Sapiens
aauguuuuugcuaguaucaguuuaccucaauugaaaaaaaaaagcauguuagauauucuaugug

SEQ ID NO: 33977 - RNA, 64 nt, Homo Sapiens
gaauguuuuugcuaguaucaguuuaccucaauugaaaaaaaaaaucauguuagauauucuaugu

SEQ ID NO: 33978 - RNA, 64 nt, Homo Sapiens
uauuaauggucauugaaccagcuuuccucaacacaaaaaaaaguaaacaaucuuaaguugggca

SEQ ID NO: 33979 - RNA, 64 nt, Homo Sapiens
uauccuuguuuuccacacuaaguuuuagaagagaaaaaaaaauagccguuauguugccucaaau

SEQ ID NO: 33980 - RNA, 64 nt, Homo Sapiens
auauccuuguuuuccacacuuaguuuuagaagagaaaaaaaaaucgccguuauguugccucaaa

SEQ ID NO: 33981 - RNA, 64 nt, Homo Sapiens
cuuuggcuuaucaagccuagaaaucuggaaaaaaaaaaaaaagguggggcuagugggaucacag

SEQ ID NO: 33982 - RNA, 64 nt, Homo Sapiens
gcuuuggcuuaucaagccuagaaaucuggaaaaaaaaaaaaaagauggggcuagugggaucaca

SEQ ID NO: 33983 - RNA, 64 nt, Homo Sapiens
ggcuuuggcuuaucaagccuagaaaucuggaaaaaaaaaaaaaacauggggcuagugggaucac

SEQ ID NO: 33984 - RNA, 64 nt, Homo Sapiens
aggcuuuggcuuaucaagcccagaaaucuggaaaaaaaaaaaaaacauggggcuagugggauca

SEQ ID NO: 33985 - RNA, 64 nt, Homo Sapiens
aaggcuuuggcuuaucaagcacagaaaucuggaaaaaaaaaaaaaacauggggcuagugggauc

SEQ ID NO: 33986 - RNA, 64 nt, Homo Sapiens
aaaggcuuuggcuuaucaagcacagaaaucuggaaaaaaaaaaacaacauggggcuagugggau

SEQ ID NO: 33987 - RNA, 64 nt, Homo Sapiens
aaaaggcuuuggcuuaucaaucacagaaaucuggaaaaaaaaaagcaacauggggcuaguggga

SEQ ID NO: 33988 - RNA, 64 nt, Homo Sapiens
auaugaucauuuuccuuuuuaguucucuuaaaaaaaaaaaaaucucauuugucagccucuuuuu

SEQ ID NO: 33989 - RNA, 64 nt, Homo Sapiens
cauaugaucauuuuccuuuuuaguucucuuaaaaaaaaaaaaauuucauuugucagccucuuuu

SEQ ID NO: 33990 - RNA, 64 nt, Homo Sapiens
ucauaugaucauuuuccuuuuuaguucucuuaaaaaaaaaaaaaauucauuugucagccucuuu

SEQ ID NO: 33991 - RNA, 64 nt, Homo Sapiens
aucauaugaucauuuuccuuuuuaguucucuuaaaaaaaaaaaaaauucauuugucagccucuu

SEQ ID NO: 33992 - RNA, 64 nt, Homo Sapiens
aaucauaugaucauuuuccuuuuuaguucucuuaaaaaaaaaaaaaauucauuugucagccucu

SEQ ID NO: 33993 - RNA, 64 nt, Homo Sapiens
aaaucauaugaucauuuuccuuuuuaguucucuuaaaaaaaaaacaaauucauuugucagccuc

SEQ ID NO: 33994 - RNA, 64 nt, Homo Sapiens
cuaugaagagucuguuuaacaauugauggcuuaaaaaaaaaagucuacaguggauagaauuagg

SEQ ID NO: 33995 - RNA, 64 nt, Homo Sapiens
ucuaugaagagucuguuuaagaauugauggcuuaaaaaaaaaagucuacaguggauagaauuag

SEQ ID NO: 33996 - RNA, 64 nt, Homo Sapiens
gucuaugaagagucuguuuaggaauugauggcuuaaaaaaaaaauucuacaguggauagaauua

SEQ ID NO: 33997 - RNA, 64 nt, Homo Sapiens
guuaaucuaggagauaaugacaccucaaaaaaaaaaaaaaaagagggcgacaagagugaaacuc

SEQ ID NO: 33998 - RNA, 64 nt, Homo Sapiens
aguuaaucuaggagauaaugccaccucaaaaaaaaaaaaaaaagugggcgacaagagugaaacu

SEQ ID NO: 33999 - RNA, 64 nt, Homo Sapiens
gaguuaaucuaggagauaauuccaccucaaaaaaaaaaaaaaaacugggcgacaagagugaaac

SEQ ID NO: 34000 - RNA, 64 nt, Homo Sapiens
agaguuaaucuaggagauaacuccaccucaaaaaaaaaaaaaaaccugggcgacaagagugaaa

SEQ ID NO: 34001 - RNA, 64 nt, Homo Sapiens
aagaguuaaucuaggagauaacuccaccucaaaaaaaaaaaaaagccugggcgacaagagugaa

SEQ ID NO: 34002 - RNA, 64 nt, Homo Sapiens
aaagaguuaaucuaggagauaacuccaccucaaaaaaaaaaaaaagccugggcgacaagaguga

SEQ ID NO: 34003 - RNA, 64 nt, Homo Sapiens
aaaagaguuaaucuaggagaaaacuccaccucaaaaaaaaaaaacagccugggcgacaagagug

SEQ ID NO: 34004 - RNA, 64 nt, Homo Sapiens
aaaaagaguuaaucuaggaggaaacuccaccucaaaaaaaaaaaccagccugggcgacaagagu

SEQ ID NO: 34005 - RNA, 64 nt, Homo Sapiens
aaaaaagaguuaaucuaggaugaaacuccaccucaaaaaaaaaauccagccugggcgacaagag

SEQ ID NO: 34006 - RNA, 64 nt, Homo Sapiens
cagcuucuucagagagauaagucucaaaaaaaaaaaaaaaaacuuggugacagagugagacucc

SEQ ID NO: 34007 - RNA, 64 nt, Homo Sapiens
ucagcuucuucagagagauacgucucaaaaaaaaaaaaaaaaaccuggugacagagugagacuc

SEQ ID NO: 34008 - RNA, 64 nt, Homo Sapiens
cucagcuucuucagagagauccgucucaaaaaaaaaaaaaaaaaccuggugacagagugagacu

SEQ ID NO: 34009 - RNA, 64 nt, Homo Sapiens
acucagcuucuucagagagauccgucucaaaaaaaaaaaaaaaagccuggugacagagugagac

SEQ ID NO: 34010 - RNA, 64 nt, Homo Sapiens
aacucagcuucuucagagagcuccgucucaaaaaaaaaaaaaaaagccuggugacagagugaga

SEQ ID NO: 34011 - RNA, 64 nt, Homo Sapiens
aaacucagcuucuucagagaacuccgucucaaaaaaaaaaaaaacagccuggugacagagugag

SEQ ID NO: 34012 - RNA, 64 nt, Homo Sapiens
aaaacucagcuucuucagaggacuccgucucaaaaaaaaaaaaaccagccuggugacagaguga

SEQ ID NO: 34013 - RNA, 64 nt, Homo Sapiens
aaaaacucagcuucuucagaagacuccgucucaaaaaaaaaaaauccagccuggugacagagug

SEQ ID NO: 34014 - RNA, 64 nt, Homo Sapiens
aaaaaacucagcuucuucaggagacuccgucucaaaaaaaaaaacuccagccuggugacagagu

SEQ ID NO: 34015 - RNA, 64 nt, Homo Sapiens
aaaaaaacucagcuucuucaugagacuccgucucaaaaaaaaaaacuccagccuggugacagag

SEQ ID NO: 34016 - RNA, 64 nt, Homo Sapiens
uauugaaugaagcacuuggaaaaaugcagaaggaaaaaaaaacaucguauagauaugaucagac

SEQ ID NO: 34017 - RNA, 64 nt, Homo Sapiens
auauugaaugaagcacuuggcaaaaugcagaaggaaaaaaaaaccucguauagauaugaucaga

SEQ ID NO: 34018 - RNA, 64 nt, Homo Sapiens
ucaugagugcauggauuuaaaaaacaaaaaaaacaaaaaaaaccgcuaaaaagacaaaaaacaa

SEQ ID NO: 34019 - RNA, 64 nt, Homo Sapiens
aaaaaaaccucaugagugcaaaaaaacaaaaaacaaaaaaaacaccucuuccugcuaaaaagac

SEQ ID NO: 34020 - RNA, 64 nt, Homo Sapiens
uuuucuugcuacaaaaaauagaaccauuugccaaaaaaaaaagccuucauguucuaugacuaua

SEQ ID NO: 34021 - RNA, 64 nt, Homo Sapiens
cuuuucuugcuacaaaaaauagaaccauuugccaaaaaaaaaagucuucauguucuaugacuau

SEQ ID NO: 34022 - RNA, 64 nt, Homo Sapiens
gcuuuucuugcuacaaaaaauagaaccauuugccaaaaaaaaaaaucuucauguucuaugacua

SEQ ID NO: 34023 - RNA, 64 nt, Homo Sapiens
cacaugaugcacuucaaauugugucugcuguagaaaaaaaaauuuuaaguauuauuagggcccu

SEQ ID NO: 34024 - RNA, 64 nt, Homo Sapiens
ucacaugaugcacuucaaauugugucugcuguagaaaaaaaaauguuaaguauuauuagggccc

SEQ ID NO: 34025 - RNA, 64 nt, Homo Sapiens
auauucauauguauugcauuccgucucaaaaaaaaaaaaaaauucugggugacaaagcgagacu

SEQ ID NO: 34026 - RNA, 64 nt, Homo Sapiens
uauauucauauguauugcauuccgucucaaaaaaaaaaaaaaauccugggugacaaagcgagac

SEQ ID NO: 34027 - RNA, 64 nt, Homo Sapiens
uuauauucauauguauugcacuccgucucaaaaaaaaaaaaaaagccugggugacaaagcgaga

SEQ ID NO: 34028 - RNA, 64 nt, Homo Sapiens
auuauauucauauguauugcacuccgucucaaaaaaaaaaaaaaagccugggugacaaagcgag

SEQ ID NO: 34029 - RNA, 64 nt, Homo Sapiens
aauuauauucauauguauuggacuccgucucaaaaaaaaaaaaacagccugggugacaaagcga

SEQ ID NO: 34030 - RNA, 64 nt, Homo Sapiens
aaauuauauucauauguauuagacuccgucucaaaaaaaaaaaagcagccugggugacaaagcg

SEQ ID NO: 34031 - RNA, 64 nt, Homo Sapiens
aaaauuauauucauauguaugagacuccgucucaaaaaaaaaaaugcagccugggugacaaagc

SEQ ID NO: 34032 - RNA, 64 nt, Homo Sapiens
aaaaauuauauucauauguacgagacuccgucucaaaaaaaaaacugcagccugggugacaaag

SEQ ID NO: 34033 - RNA, 64 nt, Homo Sapiens
guuauuuauaguccaaagaaagaaauauuugaagaaaaaaaagcaagauagcagguuuauacuu

SEQ ID NO: 34034 - RNA, 64 nt, Homo Sapiens
uuuaaaagaccaggaccucaaaaagcuuuaaauuaaaaaaaauuacaaacuaaaaccucggugg

SEQ ID NO: 34035 - RNA, 64 nt, Homo Sapiens
aacauuuuuuccuauuacaaaguucaguuaguuaaaaaaaaacauucugaaaacauuccuucau

SEQ ID NO: 34036 - RNA, 64 nt, Homo Sapiens
aaacauuuuuuccuauuacauaguucaguuaguuaaaaaaaaacauucugaaaacauuccuuca

SEQ ID NO: 34037 - RNA, 64 nt, Homo Sapiens
aagcaaggauacuaagaaaagucugagaaaucugaaaaaaaagaaaaaaagaagagaaaagauc

SEQ ID NO: 34038 - RNA, 64 nt, Homo Sapiens
cgagugauagaaguagcaaggaaguucuggagauaaaaaaaauaugaugaaaagaguaguucaa

SEQ ID NO: 34039 - RNA, 64 nt, Homo Sapiens
uaugggaaaaaauuuaugggccaccaaauuuaaaaaaaaaaagucacugucaucuaaaagcagg

SEQ ID NO: 34040 - RNA, 64 nt, Homo Sapiens
uuaugggaaaaaauuuaugggccaccaaauuuaaaaaaaaaaagucacugucaucuaaaagcag

SEQ ID NO: 34041 - RNA, 64 nt, Homo Sapiens
guuaugggaaaaaauuuaugggccaccaaauuuaaaaaaaaaaaaucacugucaucuaaaagca

SEQ ID NO: 34042 - RNA, 64 nt, Homo Sapiens
aguuaugggaaaaaauuuauaggccaccaaauuuaaaaaaaaaagaucacugucaucuaaaagc

SEQ ID NO: 34043 - RNA, 64 nt, Homo Sapiens
auucuguaccaucacaacuucucaaaaaaaaaaaaaaaaaaauugugacagagcgagacuccau

SEQ ID NO: 34044 - RNA, 64 nt, Homo Sapiens
uauucuguaccaucacaacuucucaaaaaaaaaaaaaaaaaaauggugacagagcgagacucca

SEQ ID NO: 34045 - RNA, 64 nt, Homo Sapiens
uuauucuguaccaucacaacaucucaaaaaaaaaaaaaaaaaaagggugacagagcgagacucc

SEQ ID NO: 34046 - RNA, 64 nt, Homo Sapiens
auuauucuguaccaucacaacaucucaaaaaaaaaaaaaaaaaaugggugacagagcgagacuc

SEQ ID NO: 34047 - RNA, 64 nt, Homo Sapiens
aauuauucuguaccaucacaccaucucaaaaaaaaaaaaaaaaacugggugacagagcgagacu

SEQ ID NO: 34048 - RNA, 64 nt, Homo Sapiens
aaauuauucuguaccaucacuccaucucaaaaaaaaaaaaaaaaccugggugacagagcgagac

SEQ ID NO: 34049 - RNA, 64 nt, Homo Sapiens
aaaauuauucuguaccaucacuccaucucaaaaaaaaaaaaaaagccugggugacagagcgaga

SEQ ID NO: 34050 - RNA, 64 nt, Homo Sapiens
aaaaauuauucuguaccaucacuccaucucaaaaaaaaaaaaaaagccugggugacagagcgag

SEQ ID NO: 34051 - RNA, 64 nt, Homo Sapiens
aaaaaauuauucuguaccaugacuccaucucaaaaaaaaaaaaauagccugggugacagagcga

SEQ ID NO: 34052 - RNA, 64 nt, Homo Sapiens
aaaaaaauuauucuguaccaagacuccaucucaaaaaaaaaaaacuagccugggugacagagcg

SEQ ID NO: 34053 - RNA, 64 nt, Homo Sapiens
aaaaaaaauuauucuguaccgagacuccaucucaaaaaaaaaaaucuagccugggugacagagc

SEQ ID NO: 34054 - RNA, 64 nt, Homo Sapiens
aaaaaaaaauuauucuguaccgagacuccaucucaaaaaaaaaacucuagccugggugacagag

SEQ ID NO: 34055 - RNA, 64 nt, Homo Sapiens
ugccagagacgaguaugcccaccauauccaaaaaaaaaaaaaguagucugggugacagagagag

SEQ ID NO: 34056 - RNA, 64 nt, Homo Sapiens
uugccagagacgaguaugccgaccauauccaaaaaaaaaaaaagcagucugggugacagagaga

SEQ ID NO: 34057 - RNA, 64 nt, Homo Sapiens
guugccagagacgaguaugcagaccauauccaaaaaaaaaaaaaccagucugggugacagagag

SEQ ID NO: 34058 - RNA, 64 nt, Homo Sapiens
aguugccagagacgaguauggagaccauauccaaaaaaaaaaaauccagucugggugacagaga

SEQ ID NO: 34059 - RNA, 64 nt, Homo Sapiens
aaguugccagagacgaguauagagaccauauccaaaaaaaaaaacuccagucugggugacagag

SEQ ID NO: 34060 - RNA, 64 nt, Homo Sapiens
aaaguugccagagacgaguagagagaccauauccaaaaaaaaaaacuccagucugggugacaga

SEQ ID NO: 34061 - RNA, 64 nt, Homo Sapiens
uggguuuuuuuuuuuuuaauaacacugaccaauaaaaaaaaauguuuuguaacaaacuccuacc

SEQ ID NO: 34062 - RNA, 64 nt, Homo Sapiens
guggguuuuuuuuuuuuuaacaacacugaccaauaaaaaaaaaucuuuuguaacaaacuccuac

SEQ ID NO: 34063 - RNA, 64 nt, Homo Sapiens
gaaauuguuucccaugcugcggagaugcuuaacaaaaaaaaauuaaacagcucaucccagagaa

SEQ ID NO: 34064 - RNA, 64 nt, Homo Sapiens
ugaaauuguuucccaugcugaggagaugcuuaacaaaaaaaaaugaaacagcucaucccagaga

SEQ ID NO: 34065 - RNA, 64 nt, Homo Sapiens
aaaacaaaaacauggcagaucuuuuaguuuuuuuaaaaaaaacaagaaaacugacuuuguugca

SEQ ID NO: 34066 - RNA, 64 nt, Homo Sapiens
aaaauuuauuuuuuauauuccuccgucucaaaaaaaaaaaaagugccugggagacagagcaaga

SEQ ID NO: 34067 - RNA, 64 nt, Homo Sapiens
uaaaauuuauuuuuuauauuacuccgucucaaaaaaaaaaaaagagccugggagacagagcaag

SEQ ID NO: 34068 - RNA, 64 nt, Homo Sapiens
guaaaauuuauuuuuuauaugacuccgucucaaaaaaaaaaaaacagccugggagacagagcaa

SEQ ID NO: 34069 - RNA, 64 nt, Homo Sapiens
aguaaaauuuauuuuuuauaagacuccgucucaaaaaaaaaaaaccagccugggagacagagca

SEQ ID NO: 34070 - RNA, 64 nt, Homo Sapiens
aaguaaaauuuauuuuuuauaagacuccgucucaaaaaaaaaaauccagccugggagacagagc

SEQ ID NO: 34071 - RNA, 64 nt, Homo Sapiens
aaaguaaaauuuauuuuuuacaagacuccgucucaaaaaaaaaacuccagccugggagacagag

SEQ ID NO: 34072 - RNA, 64 nt, Homo Sapiens
ggagagagauagaggaagguaaaacuuaaaaaaaaaaaaaaagaaacauuuuucuuuaaaaagc

SEQ ID NO: 34073 - RNA, 64 nt, Homo Sapiens
aggagagagauagaggaaggcaaaacuuaaaaaaaaaaaaaaaguaacauuuuucuuuaaaaag

SEQ ID NO: 34074 - RNA, 64 nt, Homo Sapiens
gaggagagagauagaggaaggcaaaacuuaaaaaaaaaaaaaaacuaacauuuuucuuuaaaaa

SEQ ID NO: 34075 - RNA, 64 nt, Homo Sapiens
agaggagagagauagaggaaagcaaaacuuaaaaaaaaaaaaaaacuaacauuuuucuuuaaaa

SEQ ID NO: 34076 - RNA, 64 nt, Homo Sapiens
aagaggagagagauagaggaaagcaaaacuuaaaaaaaaaaaaaaacuaacauuuuucuuuaaa

SEQ ID NO: 34077 - RNA, 64 nt, Homo Sapiens
aaagaggagagagauagaggaaagcaaaacuuaaaaaaaaaaaagaacuaacauuuuucuuuaa

SEQ ID NO: 34078 - RNA, 64 nt, Homo Sapiens
aaaagaggagagagauagagaaaagcaaaacuuaaaaaaaaaaaugaacuaacauuuuucuuua

SEQ ID NO: 34079 - RNA, 64 nt, Homo Sapiens
aaaaagaggagagagauagaaaaaagcaaaacuuaaaaaaaaaacugaacuaacauuuuucuuu

SEQ ID NO: 34080 - RNA, 64 nt, Homo Sapiens
gcccugaauuaaauggcuguuuuuuuaaagaagaaaaaaaaacuuuuugcugguuugauuuuuu

SEQ ID NO: 34081 - RNA, 64 nt, Homo Sapiens
ugcccugaauuaaauggcuguuuuuuuaaagaagaaaaaaaaacauuuugcugguuugauuuuu

SEQ ID NO: 34082 - RNA, 64 nt, Homo Sapiens
gugaauggcguuaggguaaguuaccuguguuuaaaaaaaaaaguuuuucuauaauaaacaugga

SEQ ID NO: 34083 - RNA, 64 nt, Homo Sapiens
ugugaauggcguuaggguaaauuaccuguguuuaaaaaaaaaaguuuuucuauaauaaacaugg

SEQ ID NO: 34084 - RNA, 64 nt, Homo Sapiens
gugugaauggcguuaggguagauuaccuguguuuaaaaaaaaaaauuuuucuauaauaaacaug

SEQ ID NO: 34085 - RNA, 64 nt, Homo Sapiens
aagcucucuuuccuucucugccccucuauguacaaaaaaaaacagagggacagggaauuuuuuc

SEQ ID NO: 34086 - RNA, 64 nt, Homo Sapiens
aaagcucucuuuccuucucucccccucuauguacaaaaaaaaacggagggacagggaauuuuuu

SEQ ID NO: 34087 - RNA, 64 nt, Homo Sapiens
ggucaggguuuuaacgagcugacagagcggaaaaaaaaaaaagacagacacccuggucacccag

SEQ ID NO: 34088 - RNA, 64 nt, Homo Sapiens
aggucaggguuuuaacgagcggacagagcggaaaaaaaaaaaaggcagacacccuggucaccca

SEQ ID NO: 34089 - RNA, 64 nt, Homo Sapiens
gaggucaggguuuuaacgagaggacagagcggaaaaaaaaaaaaggcagacacccuggucaccc

SEQ ID NO: 34090 - RNA, 64 nt, Homo Sapiens
agaggucaggguuuuaacgacaggacagagcggaaaaaaaaaaauggcagacacccuggucacc

SEQ ID NO: 34091 - RNA, 64 nt, Homo Sapiens
aagaggucaggguuuuaacgccaggacagagcggaaaaaaaaaacuggcagacacccuggucac

SEQ ID NO: 34092 - RNA, 64 nt, Homo Sapiens
uuaaccaggaagggggccugggcccuuucagcaaaaaaaaaaccacaccacaaauauauccugu

SEQ ID NO: 34093 - RNA, 64 nt, Homo Sapiens
cuuaaccaggaagggggccuuggcccuuucagcaaaaaaaaaacuacaccacaaauauauccug

SEQ ID NO: 34094 - RNA, 64 nt, Homo Sapiens
ccuuaaccaggaagggggccguggcccuuucagcaaaaaaaaaauuacaccacaaauauauccu

SEQ ID NO: 34095 - RNA, 64 nt, Homo Sapiens
ucaagaguauuuauuaccgauggaaucaugcaaaaaaaaaaauguacuuauuuuccacuuaucu

SEQ ID NO: 34096 - RNA, 64 nt, Homo Sapiens
gucaagaguauuuauuaccguuggaaucaugcaaaaaaaaaaauuuacuuauuuuccacuuauc

SEQ ID NO: 34097 - RNA, 64 nt, Homo Sapiens
ugucaagaguauuuauuacccuuggaaucaugcaaaaaaaaaaauuuacuuauuuuccacuuau

SEQ ID NO: 34098 - RNA, 64 nt, Homo Sapiens
augucaagaguauuuauuacucuuggaaucaugcaaaaaaaaaaguuuacuuauuuuccacuua

SEQ ID NO: 34099 - RNA, 64 nt, Homo Sapiens
uauugacacggaugccuacaggaaaaaaaaaaaaaaaaaaaaggauuuugcagaugaaaagcgg

SEQ ID NO: 34100 - RNA, 64 nt, Homo Sapiens
guauugacacggaugccuacgggaaaaaaaaaaaaaaaaaaaagcauuuugcagaugaaaagcg

SEQ ID NO: 34101 - RNA, 64 nt, Homo Sapiens
gguauugacacggaugccuaggggaaaaaaaaaaaaaaaaaaaaucauuuugcagaugaaaagc

SEQ ID NO: 34102 - RNA, 64 nt, Homo Sapiens
aaacuacguguccagaaggucggggaaaaaaaaaaaaaaaaaaacucauuuugcagaugaaaag

SEQ ID NO: 34103 - RNA, 64 nt, Homo Sapiens
aaaacuacguguccagaagggcggggaaaaaaaaaaaaaaaaaaccucauuuugcagaugaaaa

SEQ ID NO: 34104 - RNA, 64 nt, Homo Sapiens
aaaaacuacguguccagaagagcggggaaaaaaaaaaaaaaaaauccucauuuugcagaugaaa

SEQ ID NO: 34105 - RNA, 64 nt, Homo Sapiens
aaaaaacuacguguccagaaaagcggggaaaaaaaaaaaaaaaauuccucauuuugcagaugaa

SEQ ID NO: 34106 - RNA, 64 nt, Homo Sapiens
aaaaaaacuacguguccagaaaagcggggaaaaaaaaaaaaaaaguuccucauuuugcagauga

SEQ ID NO: 34107 - RNA, 64 nt, Homo Sapiens
aaaaaaaacuacguguccagaaaagcggggaaaaaaaaaaaaaaaguuccucauuuugcagaug

SEQ ID NO: 34108 - RNA, 64 nt, Homo Sapiens
aaaaaaaaacuacguguccagaaaagcggggaaaaaaaaaaaaauaguuccucauuuugcagau

SEQ ID NO: 34109 - RNA, 64 nt, Homo Sapiens
aaaaaaaaaacuacguguccugaaaagcggggaaaaaaaaaaaauuaguuccucauuuugcaga

SEQ ID NO: 34110 - RNA, 64 nt, Homo Sapiens
aaaaaaaaaaacuacgugucaugaaaagcggggaaaaaaaaaaauuuaguuccucauuuugcag

SEQ ID NO: 34111 - RNA, 64 nt, Homo Sapiens
aaaaaaaaaaaacuacgugugaugaaaagcggggaaaaaaaaaauuuuaguuccucauuuugca

SEQ ID NO: 34112 - RNA, 64 nt, Homo Sapiens
uuugaagggacaaaugggaaaaaaccauuuaauaaaaaaaaaucgggagacuuuaggaucuuaa

SEQ ID NO: 34113 - RNA, 64 nt, Homo Sapiens
cuuugaagggacaaaugggaaaaaaccauuuaauaaaaaaaaauugggagacuuuaggaucuua

SEQ ID NO: 34114 - RNA, 64 nt, Homo Sapiens
cagccuagacaacauacuacgacccugucuauacaaaaaaaaacuucucuaaauuagccggaug

SEQ ID NO: 34115 - RNA, 64 nt, Homo Sapiens
agccuagacaacauacuacgacccugucuauacaaaaaaaaacuucucuaaauuagccggaugu

SEQ ID NO: 34116 - RNA, 64 nt, Homo Sapiens
acuguacuccugggcaacagcgagacuccgucucaaaaaaaaaaaaaaaaaaagaaaccauuua

SEQ ID NO: 34117 - RNA, 64 nt, Homo Sapiens
cuguacuccugggcaacagcgagacuccgucucaaaaaaaaaaaaaaaaaaagaaaccauuuau

SEQ ID NO: 34118 - RNA, 64 nt, Homo Sapiens
uguacuccugggcaacagcgagacuccgucucaaaaaaaaaaaaaaaaaaagaaaccauuuauu

SEQ ID NO: 34119 - RNA, 64 nt, Homo Sapiens
guacuccugggcaacagcgagacuccgucucaaaaaaaaaaaaaaaaaaagaaaccauuuauuu

SEQ ID NO: 34120 - RNA, 64 nt, Homo Sapiens
uacuccugggcaacagcgagacuccgucucaaaaaaaaaaaaaaaaaaagaaaccauuuauuuu

SEQ ID NO: 34121 - RNA, 64 nt, Homo Sapiens
acuccugggcaacagcgagacuccgucucaaaaaaaaaaaaaaaaaaagaaaccauuuauuuua

SEQ ID NO: 34122 - RNA, 64 nt, Homo Sapiens
cuccugggcaacagcgagacuccgucucaaaaaaaaaaaaaaaaaaagaaaccauuuauuuuaa

SEQ ID NO: 34123 - RNA, 64 nt, Homo Sapiens
uccugggcaacagcgagacuccgucucaaaaaaaaaaaaaaaaaaagaaaccauuuauuuuaaa

SEQ ID NO: 34124 - RNA, 64 nt, Homo Sapiens
ccugggcaacagcgagacuccgucucaaaaaaaaaaaaaaaaaaagaaaccauuuauuuuaaaa

SEQ ID NO: 34125 - RNA, 64 nt, Homo Sapiens
cugggcaacagcgagacuccgucucaaaaaaaaaaaaaaaaaaagaaaccauuuauuuuaaaaa

SEQ ID NO: 34126 - RNA, 64 nt, Homo Sapiens
ugggcaacagcgagacuccgucucaaaaaaaaaaaaaaaaaaagaaaccauuuauuuuaaaaau

SEQ ID NO: 34127 - RNA, 64 nt, Homo Sapiens
gggcaacagcgagacuccgucucaaaaaaaaaaaaaaaaaaagaaaccauuuauuuuaaaaaug

SEQ ID NO: 34128 - RNA, 64 nt, Homo Sapiens
aauacaugcaguaguacaucauuuuagcaacucuaaaaaaaaaaaaaauacaaauaaaaaggaa

SEQ ID NO: 34129 - RNA, 64 nt, Homo Sapiens
auacaugcaguaguacaucauuuuagcaacucuaaaaaaaaaaaaaauacaaauaaaaaggaaa

SEQ ID NO: 34130 - RNA, 64 nt, Homo Sapiens
uacaugcaguaguacaucauuuuagcaacucuaaaaaaaaaaaaaauacaaauaaaaaggaaaa

SEQ ID NO: 34131 - RNA, 64 nt, Homo Sapiens
acaugcaguaguacaucauuuuagcaacucuaaaaaaaaaaaaaauacaaauaaaaaggaaaaa

SEQ ID NO: 34132 - RNA, 64 nt, Homo Sapiens
caugcaguaguacaucauuuuagcaacucuaaaaaaaaaaaaaauacaaauaaaaaggaaaaaa

SEQ ID NO: 34133 - RNA, 64 nt, Homo Sapiens
augcaguaguacaucauuuuagcaacucuaaaaaaaaaaaaaauacaaauaaaaaggaaaaaaa

SEQ ID NO: 34134 - RNA, 64 nt, Homo Sapiens
ugcaguaguacaucauuuuagcaacucuaaaaaaaaaaaaaauacaaauaaaaaggaaaaaaaa

SEQ ID NO: 34135 - RNA, 64 nt, Homo Sapiens
aacucuaaaaaaaaaaaaaauacaaauaaaaaggaaaaaaaauuacauuuuuuaucuuauaccu

SEQ ID NO: 34136 - RNA, 64 nt, Homo Sapiens
gcuuaggggauuggaacugggguuuggcugaaagaaaaaaaaaaaaauguaacugaugaaucua

SEQ ID NO: 34137 - RNA, 64 nt, Homo Sapiens
cuuaggggauuggaacugggguuuggcugaaagaaaaaaaaaaaaauguaacugaugaaucuaa

SEQ ID NO: 34138 - RNA, 64 nt, Homo Sapiens
uuaggggauuggaacugggguuuggcugaaagaaaaaaaaaaaaauguaacugaugaaucuaaa

SEQ ID NO: 34139 - RNA, 64 nt, Homo Sapiens
uaggggauuggaacugggguuuggcugaaagaaaaaaaaaaaaauguaacugaugaaucuaaac

SEQ ID NO: 34140 - RNA, 64 nt, Homo Sapiens
aggggauuggaacugggguuuggcugaaagaaaaaaaaaaaaauguaacugaugaaucuaaacg

SEQ ID NO: 34141 - RNA, 64 nt, Homo Sapiens
ggggauuggaacugggguuuggcugaaagaaaaaaaaaaaaauguaacugaugaaucuaaacga

SEQ ID NO: 34142 - RNA, 64 nt, Homo Sapiens
caguauucagcuucuuaaccagucgcuauuuaggaaaaaaaacccacuaguuaggccaucaaca

SEQ ID NO: 34143 - RNA, 64 nt, Homo Sapiens
aaaguaauaaaaacuuaaauucuuuguaccaguuaaaaaaaauguauaaaauuuacaucugugc

SEQ ID NO: 34144 - RNA, 64 nt, Homo Sapiens
aacucugcuuuaaaacaaaaccaaacaaaacuuuaaaaaaaaaugugugauccagcuuucucuu

SEQ ID NO: 34145 - RNA, 64 nt, Homo Sapiens
acucugcuuuaaaacaaaaccaaacaaaacuuuaaaaaaaaaugugugauccagcuuucucuug

SEQ ID NO: 34146 - RNA, 64 nt, Homo Sapiens
cacaaguaaucuguugacagugccaauaaaugauaaaaaaaaaauuaacaugucacaauguaac

SEQ ID NO: 34147 - RNA, 64 nt, Homo Sapiens
acaaguaaucuguugacagugccaauaaaugauaaaaaaaaaauuaacaugucacaauguaacg

SEQ ID NO: 34148 - RNA, 64 nt, Homo Sapiens
caaguaaucuguugacagugccaauaaaugauaaaaaaaaaauuaacaugucacaauguaacgg

SEQ ID NO: 34149 - RNA, 64 nt, Homo Sapiens
cuccagccugggcaaaaagagcaaaacucucccuaaaaaaaaaauguagaauaucucuuaagau

SEQ ID NO: 34150 - RNA, 64 nt, Homo Sapiens
uccagccugggcaaaaagagcaaaacucucccuaaaaaaaaaauguagaauaucucuuaagauu

SEQ ID NO: 34151 - RNA, 64 nt, Homo Sapiens
ccagccugggcaaaaagagcaaaacucucccuaaaaaaaaaauguagaauaucucuuaagauuu

SEQ ID NO: 34152 - RNA, 64 nt, Homo Sapiens
ugagggcugcagggaaggcagcuuucauuuguuuaaaaaaaaaaaaaaaagacggaaaaaaaug

SEQ ID NO: 34153 - RNA, 64 nt, Homo Sapiens
gagggcugcagggaaggcagcuuucauuuguuuaaaaaaaaaaaaaaaagacggaaaaaaaugu

SEQ ID NO: 34154 - RNA, 64 nt, Homo Sapiens
agggcugcagggaaggcagcuuucauuuguuuaaaaaaaaaaaaaaaagacggaaaaaaaugug

SEQ ID NO: 34155 - RNA, 64 nt, Homo Sapiens
gggcugcagggaaggcagcuuucauuuguuuaaaaaaaaaaaaaaaagacggaaaaaaaugugu

SEQ ID NO: 34156 - RNA, 64 nt, Homo Sapiens
ggcugcagggaaggcagcuuucauuuguuuaaaaaaaaaaaaaaaagacggaaaaaaauguguc

SEQ ID NO: 34157 - RNA, 64 nt, Homo Sapiens
gcugcagggaaggcagcuuucauuuguuuaaaaaaaaaaaaaaaagacggaaaaaaauguguca

SEQ ID NO: 34158 - RNA, 64 nt, Homo Sapiens
cugcagggaaggcagcuuucauuuguuuaaaaaaaaaaaaaaaagacggaaaaaaaugugucac

SEQ ID NO: 34159 - RNA, 64 nt, Homo Sapiens
ugcagggaaggcagcuuucauuuguuuaaaaaaaaaaaaaaaagacggaaaaaaaugugucaca

SEQ ID NO: 34160 - RNA, 64 nt, Homo Sapiens
gcagggaaggcagcuuucauuuguuuaaaaaaaaaaaaaaaagacggaaaaaaaugugucacau

SEQ ID NO: 34161 - RNA, 64 nt, Homo Sapiens
cuccagucggguuaacagagcaagacacugucucaaaaaaaaaaaaaaaaaaaaguaucaacca

SEQ ID NO: 34162 - RNA, 64 nt, Homo Sapiens
uccagucggguuaacagagcaagacacugucucaaaaaaaaaaaaaaaaaaaaguaucaaccaa

SEQ ID NO: 34163 - RNA, 64 nt, Homo Sapiens
ccagucggguuaacagagcaagacacugucucaaaaaaaaaaaaaaaaaaaaguaucaaccaac

SEQ ID NO: 34164 - RNA, 64 nt, Homo Sapiens
cagucggguuaacagagcaagacacugucucaaaaaaaaaaaaaaaaaaaaguaucaaccaaca

SEQ ID NO: 34165 - RNA, 64 nt, Homo Sapiens
agucggguuaacagagcaagacacugucucaaaaaaaaaaaaaaaaaaaaguaucaaccaacaa

SEQ ID NO: 34166 - RNA, 64 nt, Homo Sapiens
gucggguuaacagagcaagacacugucucaaaaaaaaaaaaaaaaaaaaguaucaaccaacaaa

SEQ ID NO: 34167 - RNA, 64 nt, Homo Sapiens
ucggguuaacagagcaagacacugucucaaaaaaaaaaaaaaaaaaaaguaucaaccaacaaau

SEQ ID NO: 34168 - RNA, 64 nt, Homo Sapiens
cggguuaacagagcaagacacugucucaaaaaaaaaaaaaaaaaaaaguaucaaccaacaaaug

SEQ ID NO: 34169 - RNA, 64 nt, Homo Sapiens
ggguuaacagagcaagacacugucucaaaaaaaaaaaaaaaaaaaaguaucaaccaacaaaugu

SEQ ID NO: 34170 - RNA, 64 nt, Homo Sapiens
gguuaacagagcaagacacugucucaaaaaaaaaaaaaaaaaaaaguaucaaccaacaaauguu

SEQ ID NO: 34171 - RNA, 64 nt, Homo Sapiens
guuaacagagcaagacacugucucaaaaaaaaaaaaaaaaaaaaguaucaaccaacaaauguua

SEQ ID NO: 34172 - RNA, 64 nt, Homo Sapiens
uuaacagagcaagacacugucucaaaaaaaaaaaaaaaaaaaaguaucaaccaacaaauguuac

SEQ ID NO: 34173 - RNA, 64 nt, Homo Sapiens
uaacagagcaagacacugucucaaaaaaaaaaaaaaaaaaaaguaucaaccaacaaauguuacc

SEQ ID NO: 34174 - RNA, 64 nt, Homo Sapiens
gcuguuaauuuuuucacucaugugaaacaaaaugaaaaaaaaaauccaaaacagaacaagcccu

SEQ ID NO: 34175 - RNA, 64 nt, Homo Sapiens
cuguuaauuuuuucacucaugugaaacaaaaugaaaaaaaaaauccaaaacagaacaagcccuu

SEQ ID NO: 34176 - RNA, 64 nt, Homo Sapiens
uguuaauuuuuucacucaugugaaacaaaaugaaaaaaaaaauccaaaacagaacaagcccuuc

SEQ ID NO: 34177 - RNA, 64 nt, Homo Sapiens
cuuugggguuuuguuucuguuguuguucaaaugcaaaaaaaagaaaaaaaaagaaaaaaaaagg

SEQ ID NO: 34178 - RNA, 64 nt, Homo Sapiens
uuuguuucuguuguuguucaaaugcaaaaaaaagaaaaaaaaagaaaaaaaaaggugacucaca

SEQ ID NO: 34179 - RNA, 64 nt, Homo Sapiens
uuguuucuguuguuguucaaaugcaaaaaaaagaaaaaaaaagaaaaaaaaaggugacucacau

SEQ ID NO: 34180 - RNA, 64 nt, Homo Sapiens
uuguuguucaaaugcaaaaaaaagaaaaaaaaagaaaaaaaaaggugacucacauuguuacaca

SEQ ID NO: 34181 - RNA, 64 nt, Homo Sapiens
uguuguucaaaugcaaaaaaaagaaaaaaaaagaaaaaaaaaggugacucacauuguuacacau

SEQ ID NO: 34182 - RNA, 64 nt, Homo Sapiens
augugccauuuuucuucuagcaucgagauacaauaaaaaaaaaaaaaaagaaaagaagaagaaa

SEQ ID NO: 34183 - RNA, 64 nt, Homo Sapiens
ugugccauuuuucuucuagcaucgagauacaauaaaaaaaaaaaaaaagaaaagaagaagaaau

SEQ ID NO: 34184 - RNA, 64 nt, Homo Sapiens
gugccauuuuucuucuagcaucgagauacaauaaaaaaaaaaaaaaagaaaagaagaagaaaua

SEQ ID NO: 34185 - RNA, 64 nt, Homo Sapiens
ugccauuuuucuucuagcaucgagauacaauaaaaaaaaaaaaaaagaaaagaagaagaaauac

SEQ ID NO: 34186 - RNA, 64 nt, Homo Sapiens
gccauuuuucuucuagcaucgagauacaauaaaaaaaaaaaaaaagaaaagaagaagaaauacu

SEQ ID NO: 34187 - RNA, 64 nt, Homo Sapiens
ccauuuuucuucuagcaucgagauacaauaaaaaaaaaaaaaaagaaaagaagaagaaauacua

SEQ ID NO: 34188 - RNA, 64 nt, Homo Sapiens
cauuuuucuucuagcaucgagauacaauaaaaaaaaaaaaaaagaaaagaagaagaaauacuau

SEQ ID NO: 34189 - RNA, 63 nt, Homo Sapiens
auuuuucuucuagcaucgagauacaauaaaaaaaaaaaaaaagaaaagaagaagaaauacuau

SEQ ID NO: 34190 - RNA, 64 nt, Homo Sapiens
ucuuguuuacagauuuuuuuguuuguuuuuugagaaaaaaaaauguuuacucuuccaucauuua

SEQ ID NO: 34191 - RNA, 64 nt, Homo Sapiens
cuuguuuacagauuuuuuuguuuguuuuuugagaaaaaaaaauguuuacucuuccaucauuuaa

SEQ ID NO: 34192 - RNA, 64 nt, Homo Sapiens
uugagaaaaaaaaauguuuacucuuccaucauuuaaaaaaaauguaaaagacaaaaaaaaaaug

SEQ ID NO: 34193 - RNA, 64 nt, Homo Sapiens
uacucuuccaucauuuaaaaaaaauguaaaagacaaaaaaaaaauggaggaugauuuaaaagau

SEQ ID NO: 34194 - RNA, 64 nt, Homo Sapiens
acucuuccaucauuuaaaaaaaauguaaaagacaaaaaaaaaauggaggaugauuuaaaagaug

SEQ ID NO: 34195 - RNA, 64 nt, Homo Sapiens
cucuuccaucauuuaaaaaaaauguaaaagacaaaaaaaaaauggaggaugauuuaaaagaugc

SEQ ID NO: 34196 - RNA, 64 nt, Homo Sapiens
agcaugguucucaggaaaaccaguuccccaguuuaaaaaaaaaaaaaaaaauuccuuguaguuu

SEQ ID NO: 34197 - RNA, 64 nt, Homo Sapiens
gcaugguucucaggaaaaccaguuccccaguuuaaaaaaaaaaaaaaaaauuccuuguaguuuc

SEQ ID NO: 34198 - RNA, 64 nt, Homo Sapiens
caugguucucaggaaaaccaguuccccaguuuaaaaaaaaaaaaaaaaauuccuuguaguuucu

SEQ ID NO: 34199 - RNA, 64 nt, Homo Sapiens
augguucucaggaaaaccaguuccccaguuuaaaaaaaaaaaaaaaaauuccuuguaguuucuu

SEQ ID NO: 34200 - RNA, 64 nt, Homo Sapiens
ugguucucaggaaaaccaguuccccaguuuaaaaaaaaaaaaaaaaauuccuuguaguuucuua

SEQ ID NO: 34201 - RNA, 64 nt, Homo Sapiens
gguucucaggaaaaccaguuccccaguuuaaaaaaaaaaaaaaaaauuccuuguaguuucuuag

SEQ ID NO: 34202 - RNA, 64 nt, Homo Sapiens
guucucaggaaaaccaguuccccaguuuaaaaaaaaaaaaaaaaauuccuuguaguuucuuaga

SEQ ID NO: 34203 - RNA, 64 nt, Homo Sapiens
uucucaggaaaaccaguuccccaguuuaaaaaaaaaaaaaaaaauuccuuguaguuucuuagag

SEQ ID NO: 34204 - RNA, 64 nt, Homo Sapiens
ucucaggaaaaccaguuccccaguuuaaaaaaaaaaaaaaaaauuccuuguaguuucuuagagg

SEQ ID NO: 34205 - RNA, 64 nt, Homo Sapiens
cucaggaaaaccaguuccccaguuuaaaaaaaaaaaaaaaaauuccuuguaguuucuuagagga

SEQ ID NO: 34206 - RNA, 64 nt, Homo Sapiens
uagccugggcaacauagcgagaccucgucucuacaaaaaaaaauuaaaaagggggcuuugggag

SEQ ID NO: 34207 - RNA, 64 nt, Homo Sapiens
agccugggcaacauagcgagaccucgucucuacaaaaaaaaauuaaaaagggggcuuugggagg

SEQ ID NO: 34208 - RNA, 64 nt, Homo Sapiens
cacuccagccuggcgacagagcaaggcuccacucaaaaaaaagauuuaaaggggaaaaaauuga

SEQ ID NO: 34209 - RNA, 64 nt, Homo Sapiens
cacaucagccugagugacagagagacuuugucucaaaaaaaaaagaaaauuuuaauuuuaaugu

SEQ ID NO: 34210 - RNA, 64 nt, Homo Sapiens
acaucagccugagugacagagagacuuugucucaaaaaaaaaagaaaauuuuaauuuuaaugua

SEQ ID NO: 34211 - RNA, 64 nt, Homo Sapiens
caucagccugagugacagagagacuuugucucaaaaaaaaaagaaaauuuuaauuuuaauguag

SEQ ID NO: 34212 - RNA, 64 nt, Homo Sapiens
acuccagccuggcugacagagcgagacugucucuaaaaaaaaaagacucaaguggacccuacaa

SEQ ID NO: 34213 - RNA, 64 nt, Homo Sapiens
cuccagccuggcugacagagcgagacugucucuaaaaaaaaaagacucaaguggacccuacaau

SEQ ID NO: 34214 - RNA, 64 nt, Homo Sapiens
uccagccuggcugacagagcgagacugucucuaaaaaaaaaagacucaaguggacccuacaaug

SEQ ID NO: 34215 - RNA, 64 nt, Homo Sapiens
gauggaugacauaaaaauguaaacaucuccacacaaaaaaaaaaaugucuuaaccaaccgaaaa

SEQ ID NO: 34216 - RNA, 64 nt, Homo Sapiens
auggaugacauaaaaauguaaacaucuccacacaaaaaaaaaaaugucuuaaccaaccgaaaag

SEQ ID NO: 34217 - RNA, 64 nt, Homo Sapiens
uggaugacauaaaaauguaaacaucuccacacaaaaaaaaaaaugucuuaaccaaccgaaaaga

SEQ ID NO: 34218 - RNA, 64 nt, Homo Sapiens
ggaugacauaaaaauguaaacaucuccacacaaaaaaaaaaaugucuuaaccaaccgaaaagaa

SEQ ID NO: 34219 - RNA, 64 nt, Homo Sapiens
auguggggauguuugugcugcagacaaaaagaacaaaaaaaaauuuuuaaauaccacaagaugg

SEQ ID NO: 34220 - RNA, 64 nt, Homo Sapiens
uguggggauguuugugcugcagacaaaaagaacaaaaaaaaauuuuuaaauaccacaagaugga

SEQ ID NO: 34221 - RNA, 64 nt, Homo Sapiens
gaacaaaaaaaaauuuuuaaauaccacaagauggaaaaaaaaaacaaaaaaauuuaaaaagaug

SEQ ID NO: 34222 - RNA, 64 nt, Homo Sapiens
aacaaaaaaaaauuuuuaaauaccacaagauggaaaaaaaaaacaaaaaaauuuaaaaagaugg

SEQ ID NO: 34223 - RNA, 64 nt, Homo Sapiens
acaaaaaaaaauuuuuaaauaccacaagauggaaaaaaaaaacaaaaaaauuuaaaaagaugga

SEQ ID NO: 34224 - RNA, 64 nt, Homo Sapiens
uguuucuagaagucucuuuuaagcauuauuuuugaaaaaaaaaauauuuuuauagaugaauacu

SEQ ID NO: 34225 - RNA, 64 nt, Homo Sapiens
guuucuagaagucucuuuuaagcauuauuuuugaaaaaaaaaauauuuuuauagaugaauacuc

SEQ ID NO: 34226 - RNA, 64 nt, Homo Sapiens
uuucuagaagucucuuuuaagcauuauuuuugaaaaaaaaaauauuuuuauagaugaauacuca

SEQ ID NO: 34227 - RNA, 64 nt, Homo Sapiens
gaccagccagggcaacacagugagaccccuucucaaaaaaaaaaaaaaaaaagagagagugugu

SEQ ID NO: 34228 - RNA, 64 nt, Homo Sapiens
accagccagggcaacacagugagaccccuucucaaaaaaaaaaaaaaaaaagagagagugugug

SEQ ID NO: 34229 - RNA, 64 nt, Homo Sapiens
ccagccagggcaacacagugagaccccuucucaaaaaaaaaaaaaaaaaagagagaguguguga

SEQ ID NO: 34230 - RNA, 64 nt, Homo Sapiens
cagccagggcaacacagugagaccccuucucaaaaaaaaaaaaaaaaaagagagagugugugau

SEQ ID NO: 34231 - RNA, 64 nt, Homo Sapiens
agccagggcaacacagugagaccccuucucaaaaaaaaaaaaaaaaaagagagagugugugauu

SEQ ID NO: 34232 - RNA, 64 nt, Homo Sapiens
gccagggcaacacagugagaccccuucucaaaaaaaaaaaaaaaaaagagagagugugugauua

SEQ ID NO: 34233 - RNA, 64 nt, Homo Sapiens
ccagggcaacacagugagaccccuucucaaaaaaaaaaaaaaaaaagagagagugugugauuag

SEQ ID NO: 34234 - RNA, 64 nt, Homo Sapiens
cagggcaacacagugagaccccuucucaaaaaaaaaaaaaaaaaagagagagugugugauuaga

SEQ ID NO: 34235 - RNA, 64 nt, Homo Sapiens
agggcaacacagugagaccccuucucaaaaaaaaaaaaaaaaaagagagagugugugauuagaa

SEQ ID NO: 34236 - RNA, 64 nt, Homo Sapiens
gggcaacacagugagaccccuucucaaaaaaaaaaaaaaaaaagagagagugugugauuagaag

SEQ ID NO: 34237 - RNA, 64 nt, Homo Sapiens
ggcaacacagugagaccccuucucaaaaaaaaaaaaaaaaaagagagagugugugauuagaagc

SEQ ID NO: 34238 - RNA, 64 nt, Homo Sapiens
aaaauaggaacuuuugauaagaccuucuagaagcaaaaaaaaaaaaaaaaaaaaaaaaaagaaa

SEQ ID NO: 34239 - RNA, 64 nt, Homo Sapiens
aaauaggaacuuuugauaagaccuucuagaagcaaaaaaaaaaaaaaaaaaaaaaaaaagaaaa

SEQ ID NO: 34240 - RNA, 64 nt, Homo Sapiens
aauaggaacuuuugauaagaccuucuagaagcaaaaaaaaaaaaaaaaaaaaaaaaaagaaaaa

SEQ ID NO: 34241 - RNA, 64 nt, Homo Sapiens
auaggaacuuuugauaagaccuucuagaagcaaaaaaaaaaaaaaaaaaaaaaaaaagaaaaaa

SEQ ID NO: 34242 - RNA, 64 nt, Homo Sapiens
uaggaacuuuugauaagaccuucuagaagcaaaaaaaaaaaaaaaaaaaaaaaaaagaaaaaaa

SEQ ID NO: 34243 - RNA, 64 nt, Homo Sapiens
aggaacuuuugauaagaccuucuagaagcaaaaaaaaaaaaaaaaaaaaaaaaaagaaaaaaaa

SEQ ID NO: 34244 - RNA, 64 nt, Homo Sapiens
ggaacuuuugauaagaccuucuagaagcaaaaaaaaaaaaaaaaaaaaaaaaaagaaaaaaaaa

SEQ ID NO: 34245 - RNA, 64 nt, Homo Sapiens
gaacuuuugauaagaccuucuagaagcaaaaaaaaaaaaaaaaaaaaaaaaaagaaaaaaaaag

SEQ ID NO: 34246 - RNA, 64 nt, Homo Sapiens
aacuuuugauaagaccuucuagaagcaaaaaaaaaaaaaaaaaaaaaaaaaagaaaaaaaaaga

SEQ ID NO: 34247 - RNA, 64 nt, Homo Sapiens
acuuuugauaagaccuucuagaagcaaaaaaaaaaaaaaaaaaaaaaaaaagaaaaaaaaagaa

SEQ ID NO: 34248 - RNA, 64 nt, Homo Sapiens
cuuuugauaagaccuucuagaagcaaaaaaaaaaaaaaaaaaaaaaaaaagaaaaaaaaagaaa

SEQ ID NO: 34249 - RNA, 64 nt, Homo Sapiens
uuuugauaagaccuucuagaagcaaaaaaaaaaaaaaaaaaaaaaaaaagaaaaaaaaagaaaa

SEQ ID NO: 34250 - RNA, 64 nt, Homo Sapiens
uuugauaagaccuucuagaagcaaaaaaaaaaaaaaaaaaaaaaaaaagaaaaaaaaagaaaag

SEQ ID NO: 34251 - RNA, 64 nt, Homo Sapiens
uugauaagaccuucuagaagcaaaaaaaaaaaaaaaaaaaaaaaaaagaaaaaaaaagaaaaga

SEQ ID NO: 34252 - RNA, 64 nt, Homo Sapiens
ugauaagaccuucuagaagcaaaaaaaaaaaaaaaaaaaaaaaaaagaaaaaaaaagaaaagaa

SEQ ID NO: 34253 - RNA, 64 nt, Homo Sapiens
gauaagaccuucuagaagcaaaaaaaaaaaaaaaaaaaaaaaaaagaaaaaaaaagaaaagaaa

SEQ ID NO: 34254 - RNA, 64 nt, Homo Sapiens
auaagaccuucuagaagcaaaaaaaaaaaaaaaaaaaaaaaaaagaaaaaaaaagaaaagaaaa

SEQ ID NO: 34255 - RNA, 64 nt, Homo Sapiens
uaagaccuucuagaagcaaaaaaaaaaaaaaaaaaaaaaaaaagaaaaaaaaagaaaagaaaaa

SEQ ID NO: 34256 - RNA, 64 nt, Homo Sapiens
aagaccuucuagaagcaaaaaaaaaaaaaaaaaaaaaaaaaagaaaaaaaaagaaaagaaaaaa

SEQ ID NO: 34257 - RNA, 64 nt, Homo Sapiens
uagaagcaaaaaaaaaaaaaaaaaaaaaaaaaagaaaaaaaaagaaaagaaaaaaagaaaaaga

SEQ ID NO: 34258 - RNA, 63 nt, Homo Sapiens
agaagcaaaaaaaaaaaaaaaaaaaaaaaaaagaaaaaaaaagaaaagaaaaaaagaaaaaga

SEQ ID NO: 34259 - RNA, 64 nt, Homo Sapiens
uucagcucccuucccuugagaugaguuucuggggaaaaaaaagagacugguuagugaugcaguu

SEQ ID NO: 34260 - RNA, 64 nt, Homo Sapiens
cucuaguucuguuguuuuguguauauaauuuuuuaaaaaaaauuugugugcuucugcucauuac

SEQ ID NO: 34261 - RNA, 64 nt, Homo Sapiens
agccuggccaacauggugaaaccccaucucuacuaaaaaaaaaaaaaaaauuagguguggugac

SEQ ID NO: 34262 - RNA, 64 nt, Homo Sapiens
gccuggccaacauggugaaaccccaucucuacuaaaaaaaaaaaaaaaauuagguguggugaca

SEQ ID NO: 34263 - RNA, 64 nt, Homo Sapiens
ccuggccaacauggugaaaccccaucucuacuaaaaaaaaaaaaaaaauuagguguggugacac

SEQ ID NO: 34264 - RNA, 64 nt, Homo Sapiens
cuggccaacauggugaaaccccaucucuacuaaaaaaaaaaaaaaaauuagguguggugacaca

SEQ ID NO: 34265 - RNA, 64 nt, Homo Sapiens
uggccaacauggugaaaccccaucucuacuaaaaaaaaaaaaaaaauuagguguggugacacau

SEQ ID NO: 34266 - RNA, 64 nt, Homo Sapiens
ggccaacauggugaaaccccaucucuacuaaaaaaaaaaaaaaaauuagguguggugacacaug

SEQ ID NO: 34267 - RNA, 64 nt, Homo Sapiens
gccaacauggugaaaccccaucucuacuaaaaaaaaaaaaaaaauuagguguggugacacaugg

SEQ ID NO: 34268 - RNA, 64 nt, Homo Sapiens
ccaacauggugaaaccccaucucuacuaaaaaaaaaaaaaaaauuagguguggugacacauggc

SEQ ID NO: 34269 - RNA, 64 nt, Homo Sapiens
caacauggugaaaccccaucucuacuaaaaaaaaaaaaaaaauuagguguggugacacauggcu

SEQ ID NO: 34270 - RNA, 64 nt, Homo Sapiens
gccugggcaacauagcgagaccccuaucuguauuaaaaaaaaaucugauuuaauucuuuuauuu

SEQ ID NO: 34271 - RNA, 64 nt, Homo Sapiens
ccugggcaacauagcgagaccccuaucuguauuaaaaaaaaaucugauuuaauucuuuuauuua

SEQ ID NO: 34272 - RNA, 64 nt, Homo Sapiens
uucccucuaauaggaaacaguauaaauuuuaauuaaaaaaaaaaggcaaacuaaaauuucuuga

SEQ ID NO: 34273 - RNA, 64 nt, Homo Sapiens
ucccucuaauaggaaacaguauaaauuuuaauuaaaaaaaaaaggcaaacuaaaauuucuugaa

SEQ ID NO: 34274 - RNA, 64 nt, Homo Sapiens
cccucuaauaggaaacaguauaaauuuuaauuaaaaaaaaaaggcaaacuaaaauuucuugaaa

SEQ ID NO: 34275 - RNA, 64 nt, Homo Sapiens
aaaggcauugugggucugucuuuaaaguguuuacaaaaaaaaauuauauaaaaaaaaagucuag

SEQ ID NO: 34276 - RNA, 64 nt, Homo Sapiens
aaggcauugugggucugucuuuaaaguguuuacaaaaaaaaauuauauaaaaaaaaagucuagu

SEQ ID NO: 34277 - RNA, 64 nt, Homo Sapiens
cugucuuuaaaguguuuacaaaaaaaaauuauauaaaaaaaaagucuagugucgacugguguuu

SEQ ID NO: 34278 - RNA, 64 nt, Homo Sapiens
ugucuuuaaaguguuuacaaaaaaaaauuauauaaaaaaaaagucuagugucgacugguguuuu

SEQ ID NO: 34279 - RNA, 64 nt, Homo Sapiens
caagauagguuucuguauuuauauauuaaaauacaaaaaaaaacuuauaaaauguuuaaaaaaa

SEQ ID NO: 34280 - RNA, 64 nt, Homo Sapiens
aagauagguuucuguauuuauauauuaaaauacaaaaaaaaacuuauaaaauguuuaaaaaaau

SEQ ID NO: 34281 - RNA, 64 nt, Homo Sapiens
acauuugccuuuucacagcuagucuuuucauguuaaaaaaaaaaauguauuucauaucuauaaa

SEQ ID NO: 34282 - RNA, 64 nt, Homo Sapiens
cauuugccuuuucacagcuagucuuuucauguuaaaaaaaaaaauguauuucauaucuauaaaa

SEQ ID NO: 34283 - RNA, 64 nt, Homo Sapiens
auuugccuuuucacagcuagucuuuucauguuaaaaaaaaaaauguauuucauaucuauaaaac

SEQ ID NO: 34284 - RNA, 64 nt, Homo Sapiens
uuugccuuuucacagcuagucuuuucauguuaaaaaaaaaaauguauuucauaucuauaaaacc

SEQ ID NO: 34285 - RNA, 64 nt, Homo Sapiens
cuccaaccuggguaacagggcaagacccuaucucaaaaaaaaaaaaagucgccagcaacaagca

SEQ ID NO: 34286 - RNA, 64 nt, Homo Sapiens
uccaaccuggguaacagggcaagacccuaucucaaaaaaaaaaaaagucgccagcaacaagcac

SEQ ID NO: 34287 - RNA, 64 nt, Homo Sapiens
ccaaccuggguaacagggcaagacccuaucucaaaaaaaaaaaaagucgccagcaacaagcacg

SEQ ID NO: 34288 - RNA, 64 nt, Homo Sapiens
caaccuggguaacagggcaagacccuaucucaaaaaaaaaaaaagucgccagcaacaagcacgu

SEQ ID NO: 34289 - RNA, 64 nt, Homo Sapiens
aaccuggguaacagggcaagacccuaucucaaaaaaaaaaaaagucgccagcaacaagcacgua

SEQ ID NO: 34290 - RNA, 64 nt, Homo Sapiens
accuggguaacagggcaagacccuaucucaaaaaaaaaaaaagucgccagcaacaagcacguag

SEQ ID NO: 34291 - RNA, 64 nt, Homo Sapiens
uuuuuaaaggaaacaaacagacaacaaaaagaagaaaaaaaaaaagaaccuccuuggaaaaauu

SEQ ID NO: 34292 - RNA, 64 nt, Homo Sapiens
uuuuaaaggaaacaaacagacaacaaaaagaagaaaaaaaaaaagaaccuccuuggaaaaauua

SEQ ID NO: 34293 - RNA, 64 nt, Homo Sapiens
uuuaaaggaaacaaacagacaacaaaaagaagaaaaaaaaaaagaaccuccuuggaaaaauuaa

SEQ ID NO: 34294 - RNA, 64 nt, Homo Sapiens
uuaaaggaaacaaacagacaacaaaaagaagaaaaaaaaaaagaaccuccuuggaaaaauuaau

SEQ ID NO: 34295 - RNA, 64 nt, Homo Sapiens
cccccccacuaugcccucauuuuuuuaaaaaaggaaaaaaaaaagaaacuggguuccagucuua

SEQ ID NO: 34296 - RNA, 64 nt, Homo Sapiens
ccccccacuaugcccucauuuuuuuaaaaaaggaaaaaaaaaagaaacuggguuccagucuuaa

SEQ ID NO: 34297 - RNA, 64 nt, Homo Sapiens
cccccacuaugcccucauuuuuuuaaaaaaggaaaaaaaaaagaaacuggguuccagucuuaau

SEQ ID NO: 34298 - RNA, 64 nt, Homo Sapiens
uucacagcacucuggugcgggaagaagcagaagcaaaaaaaauaaaaauaaaaaaauaaauaaa

SEQ ID NO: 34299 - RNA, 64 nt, Homo Sapiens
caaaaaaaauaaaaauaaaaaaauaaauaaaaauaaaaaaaauaaaaaaggaaaaaaaaaaaag

SEQ ID NO: 34300 - RNA, 64 nt, Homo Sapiens
aaaaaauaaauaaaaauaaaaaaaauaaaaaaggaaaaaaaaaaaagaagaaacaagacaugcc

SEQ ID NO: 34301 - RNA, 64 nt, Homo Sapiens
aaaaauaaauaaaaauaaaaaaaauaaaaaaggaaaaaaaaaaaagaagaaacaagacaugcca

SEQ ID NO: 34302 - RNA, 64 nt, Homo Sapiens
aaaauaaauaaaaauaaaaaaaauaaaaaaggaaaaaaaaaaaagaagaaacaagacaugccac

SEQ ID NO: 34303 - RNA, 64 nt, Homo Sapiens
aaauaaauaaaaauaaaaaaaauaaaaaaggaaaaaaaaaaaagaagaaacaagacaugccacc

SEQ ID NO: 34304 - RNA, 64 nt, Homo Sapiens
aauaaauaaaaauaaaaaaaauaaaaaaggaaaaaaaaaaaagaagaaacaagacaugccaccu

SEQ ID NO: 34305 - RNA, 64 nt, Homo Sapiens
ugaagcuugacucccaaguuuccauagcaacaggaaaaaaaaaaaucuauccaaaucugaagau

SEQ ID NO: 34306 - RNA, 64 nt, Homo Sapiens
gaagcuugacucccaaguuuccauagcaacaggaaaaaaaaaaaucuauccaaaucugaagauu

SEQ ID NO: 34307 - RNA, 64 nt, Homo Sapiens
aagcuugacucccaaguuuccauagcaacaggaaaaaaaaaaaucuauccaaaucugaagauug

SEQ ID NO: 34308 - RNA, 64 nt, Homo Sapiens
agcuugacucccaaguuuccauagcaacaggaaaaaaaaaaaucuauccaaaucugaagauugc

SEQ ID NO: 34309 - RNA, 64 nt, Homo Sapiens
aaggugcuucagccuuguacuguguauauauauuaaaaaaaaaacaaaguuuuguauguuuuua

SEQ ID NO: 34310 - RNA, 64 nt, Homo Sapiens
aggugcuucagccuuguacuguguauauauauuaaaaaaaaaacaaaguuuuguauguuuuuau

SEQ ID NO: 34311 - RNA, 64 nt, Homo Sapiens
ggugcuucagccuuguacuguguauauauauuaaaaaaaaaacaaaguuuuguauguuuuuauu

SEQ ID NO: 34312 - RNA, 64 nt, Homo Sapiens
gggguuuuguuuguuguuuugguuuuuuuugggcaaaaaaaaaaaaaaaaccuugcuuuuagug

SEQ ID NO: 34313 - RNA, 64 nt, Homo Sapiens
ggguuuuguuuguuguuuugguuuuuuuugggcaaaaaaaaaaaaaaaaccuugcuuuuagugu

SEQ ID NO: 34314 - RNA, 64 nt, Homo Sapiens
gguuuuguuuguuguuuugguuuuuuuugggcaaaaaaaaaaaaaaaaccuugcuuuuaguguu

SEQ ID NO: 34315 - RNA, 64 nt, Homo Sapiens
guuuuguuuguuguuuugguuuuuuuugggcaaaaaaaaaaaaaaaaccuugcuuuuaguguuu

SEQ ID NO: 34316 - RNA, 64 nt, Homo Sapiens
uuuuguuuguuguuuugguuuuuuuugggcaaaaaaaaaaaaaaaaccuugcuuuuaguguuug

SEQ ID NO: 34317 - RNA, 64 nt, Homo Sapiens
uuuguuuguuguuuugguuuuuuuugggcaaaaaaaaaaaaaaaaccuugcuuuuaguguuugu

SEQ ID NO: 34318 - RNA, 64 nt, Homo Sapiens
uuguuuguuguuuugguuuuuuuugggcaaaaaaaaaaaaaaaaccuugcuuuuaguguuugua

SEQ ID NO: 34319 - RNA, 64 nt, Homo Sapiens
uguuuguuguuuugguuuuuuuugggcaaaaaaaaaaaaaaaaccuugcuuuuaguguuuguac

SEQ ID NO: 34320 - RNA, 64 nt, Homo Sapiens
guuuguuguuuugguuuuuuuugggcaaaaaaaaaaaaaaaaccuugcuuuuaguguuuguacu

SEQ ID NO: 34321 - RNA, 64 nt, Homo Sapiens
agcucuucuagaauuguuuaaacccuuaccaaggaaaaaaaagggauguuaccaacugagaucg

SEQ ID NO: 34322 - RNA, 64 nt, Homo Sapiens
aguaagauuccuguaagaaauacugcuuuuuaagaaaaaaaauaacaugcugaggggugaccua

SEQ ID NO: 34323 - RNA, 64 nt, Homo Sapiens
uugcuaugguguuuauaacaaaaaagaaaauuugaaaaaaaaaaucccaggggaguagcaggag

SEQ ID NO: 34324 - RNA, 64 nt, Homo Sapiens
ugcuaugguguuuauaacaaaaaagaaaauuugaaaaaaaaaaucccaggggaguagcaggagc

SEQ ID NO: 34325 - RNA, 64 nt, Homo Sapiens
gcuaugguguuuauaacaaaaaagaaaauuugaaaaaaaaaaucccaggggaguagcaggagcc

SEQ ID NO: 34326 - RNA, 64 nt, Homo Sapiens
cuccagccugggugacagagcgagacuccgucucaaaaaaaaaaauuucaagacuggagaggug

SEQ ID NO: 34327 - RNA, 64 nt, Homo Sapiens
uccagccugggugacagagcgagacuccgucucaaaaaaaaaaauuucaagacuggagagguga

SEQ ID NO: 34328 - RNA, 64 nt, Homo Sapiens
ccagccugggugacagagcgagacuccgucucaaaaaaaaaaauuucaagacuggagaggugau

SEQ ID NO: 34329 - RNA, 64 nt, Homo Sapiens
cagccugggugacagagcgagacuccgucucaaaaaaaaaaauuucaagacuggagaggugauc

SEQ ID NO: 34330 - RNA, 64 nt, Homo Sapiens
uccagccugggcgacagagcgagacucugucucgaaaaaaaaaaagguccgugccaagcugcuc

SEQ ID NO: 34331 - RNA, 64 nt, Homo Sapiens
ccagccugggcgacagagcgagacucugucucgaaaaaaaaaaagguccgugccaagcugcucc

SEQ ID NO: 34332 - RNA, 64 nt, Homo Sapiens
cagccugggcgacagagcgagacucugucucgaaaaaaaaaaagguccgugccaagcugcuccc

SEQ ID NO: 34333 - RNA, 64 nt, Homo Sapiens
agccugggcgacagagcgagacucugucucgaaaaaaaaaaagguccgugccaagcugcucccu

SEQ ID NO: 34334 - RNA, 64 nt, Homo Sapiens
uaaaaaaugccgaaaaccaguugacguuucuuaaaaaaaaaauuccacaguguugggcacaacu

SEQ ID NO: 34335 - RNA, 64 nt, Homo Sapiens
uuaaaaaaugccgaaaaccauuugacguuucuuaaaaaaaaaauuccacaguguugggcacaac

SEQ ID NO: 34336 - RNA, 64 nt, Homo Sapiens
uuuaaaaaaugccgaaaacccuuugacguuucuuaaaaaaaaaaauccacaguguugggcacaa

SEQ ID NO: 34337 - RNA, 64 nt, Homo Sapiens
uacccaagggaugucaguuuuuggaauguugcaaaaaaaaaagugauaggggaccggggggggc

SEQ ID NO: 34338 - RNA, 64 nt, Homo Sapiens
uuacccaagggaugucaguucuuggaauguugcaaaaaaaaaagggauaggggaccgggggggg

SEQ ID NO: 34339 - RNA, 64 nt, Homo Sapiens
guuacccaagggaugucagugcuuggaauguugcaaaaaaaaaauggauaggggaccggggggg

SEQ ID NO: 34340 - RNA, 64 nt, Homo Sapiens
caaaagagagaagaguuuuuaaaagaaaaaagaaaaaaaaaaucaaaaaaaaaaaaaaaaaaaa

SEQ ID NO: 34341 - RNA, 64 nt, Homo Sapiens
ccaaaagagagaagaguuuuaaaaagaaaaaagaaaaaaaaaauaaaaaaaaaaaaaaaaaaaa

SEQ ID NO: 34342 - RNA, 64 nt, Homo Sapiens
uccaaaagagagaagaguuuaaaaaagaaaaaagaaaaaaaaaaaaaaaaaaaaaaaaaaaaaa

SEQ ID NO: 34343 - RNA, 64 nt, Homo Sapiens
aaaaagaaaaaaaaaauccaaaaaaaaaaaaaaaaaaaaaaagauuccuuuaaaagccaaaaaa

SEQ ID NO: 34344 - RNA, 64 nt, Homo Sapiens
aaaaaagaaaaaaaaaauccaaaaaaaaaaaaaaaaaaaaaaaguuuccuuuaaaagccaaaaa

SEQ ID NO: 34345 - RNA, 64 nt, Homo Sapiens
gaaaaaagaaaaaaaaaaucaaaaaaaaaaaaaaaaaaaaaaaaguuuccuuuaaaagccaaaa

SEQ ID NO: 34346 - RNA, 64 nt, Homo Sapiens
agaaaaaagaaaaaaaaaauaaaaaaaaaaaaaaaaaaaaaaaauguuuccuuuaaaagccaaa

SEQ ID NO: 34347 - RNA, 64 nt, Homo Sapiens
aagaaaaaagaaaaaaaaaaaaaaaaaaaaaaaaaaaaaaaaaauuguuuccuuuaaaagccaa

SEQ ID NO: 34348 - RNA, 64 nt, Homo Sapiens
aaagaaaaaagaaaaaaaaaaaaaaaaaaaaaaaaaaaaaaaaaauuguuuccuuuaaaagcca

SEQ ID NO: 34349 - RNA, 64 nt, Homo Sapiens
aaaagaaaaaagaaaaaaaaaaaaaaaaaaaaaaaaaaaaaaaauauuguuuccuuuaaaagcc

SEQ ID NO: 34350 - RNA, 64 nt, Homo Sapiens
aaaaagaaaaaagaaaaaaacaaaaaaaaaaaaaaaaaaaaaaaguauuguuuccuuuaaaagc

SEQ ID NO: 34351 - RNA, 64 nt, Homo Sapiens
aaaaaagaaaaaagaaaaaaccaaaaaaaaaaaaaaaaaaaaaacguauuguuuccuuuaaaag

SEQ ID NO: 34352 - RNA, 64 nt, Homo Sapiens
aaaaaaagaaaaaagaaaaagccaaaaaaaaaaaaaaaaaaaaaacguauuguuuccuuuaaaa

SEQ ID NO: 34353 - RNA, 64 nt, Homo Sapiens
aaaaaaaagaaaaaagaaaaagccaaaaaaaaaaaaaaaaaaaaaacguauuguuuccuuuaaa

SEQ ID NO: 34354 - RNA, 64 nt, Homo Sapiens
aaaaaaaaagaaaaaagaaaaagccaaaaaaaaaaaaaaaaaaaaaacguauuguuuccuuuaa

SEQ ID NO: 34355 - RNA, 64 nt, Homo Sapiens
aaaaaaaaaagaaaaaagaaaaagccaaaaaaaaaaaaaaaaaacaaacguauuguuuccuuua

SEQ ID NO: 34356 - RNA, 64 nt, Homo Sapiens
aaaaaaaaaaagaaaaaagaaaaagccaaaaaaaaaaaaaaaaagcaaacguauuguuuccuuu

SEQ ID NO: 34357 - RNA, 64 nt, Homo Sapiens
aaaaaaaaaaaagaaaaaaguaaaagccaaaaaaaaaaaaaaaaagcaaacguauuguuuccuu

SEQ ID NO: 34358 - RNA, 64 nt, Homo Sapiens
aaaaaaaaaaaaagaaaaaauuaaaagccaaaaaaaaaaaaaaauagcaaacguauuguuuccu

SEQ ID NO: 34359 - RNA, 64 nt, Homo Sapiens
aaaaaaaaaaaaaagaaaaauuuaaaagccaaaaaaaaaaaaaacuagcaaacguauuguuucc

SEQ ID NO: 34360 - RNA, 64 nt, Homo Sapiens
aaaaaaaaaaaaaaagaaaacuuuaaaagccaaaaaaaaaaaaaucuagcaaacguauuguuuc

SEQ ID NO: 34361 - RNA, 64 nt, Homo Sapiens
aaaaaaaaaaaaaaaagaaaccuuuaaaagccaaaaaaaaaaaauucuagcaaacguauuguuu

SEQ ID NO: 34362 - RNA, 64 nt, Homo Sapiens
aaaaaaaaaaaaaaaaagaauccuuuaaaagccaaaaaaaaaaauuucuagcaaacguauuguu

SEQ ID NO: 34363 - RNA, 64 nt, Homo Sapiens
aaaaaaaaaaaaaaaaaagauuccuuuaaaagccaaaaaaaaaauuuucuagcaaacguauugu

SEQ ID NO: 34364 - RNA, 64 nt, Homo Sapiens
uaugcaacuccaaccccuggacuucuuuggauuaaaaaaaaaugaagcaauacuuaggaggcuu

SEQ ID NO: 34365 - RNA, 64 nt, Homo Sapiens
guaugcaacuccaaccccuguacuucuuuggauuaaaaaaaaauuaagcaauacuuaggaggcu

SEQ ID NO: 34366 - RNA, 64 nt, Homo Sapiens
gagauggggucuuacuauguauuucuuuuuuuuaaaaaaaaacacugaaauacuuuugaacaga

SEQ ID NO: 34367 - RNA, 64 nt, Homo Sapiens
agagauggggucuuacuaugaauuucuuuuuuuuaaaaaaaaacucugaaauacuuuugaacag

SEQ ID NO: 34368 - RNA, 64 nt, Homo Sapiens
guuugaguacauuuucccugaaugacuagauaaaaaaaaaaauuuagacucugugucaaaaaua

SEQ ID NO: 34369 - RNA, 64 nt, Homo Sapiens
uguuugaguacauuuucccuaaaugacuagauaaaaaaaaaaaucuagacucugugucaaaaau

SEQ ID NO: 34370 - RNA, 64 nt, Homo Sapiens
uuguuugaguacauuuucccuaaaugacuagauaaaaaaaaaaagcuagacucugugucaaaaa

SEQ ID NO: 34371 - RNA, 64 nt, Homo Sapiens
auuguuugaguacauuuuccauaaaugacuagauaaaaaaaaaaagcuagacucugugucaaaa

SEQ ID NO: 34372 - RNA, 64 nt, Homo Sapiens
agccgggcgugguggcgggcuuuacuaaaaauacaaaaaaaauuuaacacggugaaaccccguc

SEQ ID NO: 34373 - RNA, 64 nt, Homo Sapiens
uaacuagaacuucuagaacaaaaaaaaaaaaaaaaaaaaaaagagaaccugacucuuaaaaaaa

SEQ ID NO: 34374 - RNA, 64 nt, Homo Sapiens
auaacuagaacuucuagaacaaaaaaaaaaaaaaaaaaaaaaagagaaccugacucuuaaaaaa

SEQ ID NO: 34375 - RNA, 64 nt, Homo Sapiens
gauaacuagaacuucuagaaaaaaaaaaaaaaaaaaaaaaaaaagagaaccugacucuuaaaaa

SEQ ID NO: 34376 - RNA, 64 nt, Homo Sapiens
agauaacuagaacuucuagaaaaaaaaaaaaaaaaaaaaaaaaaugagaaccugacucuuaaaa

SEQ ID NO: 34377 - RNA, 64 nt, Homo Sapiens
aagauaacuagaacuucuagaaaaaaaaaaaaaaaaaaaaaaaagugagaaccugacucuuaaa

SEQ ID NO: 34378 - RNA, 64 nt, Homo Sapiens
aaagauaacuagaacuucuaaaaaaaaaaaaaaaaaaaaaaaaaagugagaaccugacucuuaa

SEQ ID NO: 34379 - RNA, 64 nt, Homo Sapiens
aaaagauaacuagaacuucuaaaaaaaaaaaaaaaaaaaaaaaacagugagaaccugacucuua

SEQ ID NO: 34380 - RNA, 64 nt, Homo Sapiens
aaaaagauaacuagaacuucaaaaaaaaaaaaaaaaaaaaaaaaacagugagaaccugacucuu

SEQ ID NO: 34381 - RNA, 64 nt, Homo Sapiens
aaaaaagauaacuagaacuuuaaaaaaaaaaaaaaaaaaaaaaacacagugagaaccugacucu

SEQ ID NO: 34382 - RNA, 64 nt, Homo Sapiens
aaaaaaagauaacuagaacuuuaaaaaaaaaaaaaaaaaaaaaagcacagugagaaccugacuc

SEQ ID NO: 34383 - RNA, 64 nt, Homo Sapiens
aaaaaaaagauaacuagaaccuuaaaaaaaaaaaaaaaaaaaaaggcacagugagaaccugacu

SEQ ID NO: 34384 - RNA, 64 nt, Homo Sapiens
aaaaaaaaagauaacuagaaucuuaaaaaaaaaaaaaaaaaaaauggcacagugagaaccugac

SEQ ID NO: 34385 - RNA, 64 nt, Homo Sapiens
aaaaaaaaaagauaacuagacucuuaaaaaaaaaaaaaaaaaaaguggcacagugagaaccuga

SEQ ID NO: 34386 - RNA, 64 nt, Homo Sapiens
aaaaaaaaaaagauaacuagacucuuaaaaaaaaaaaaaaaaaagguggcacagugagaaccug

SEQ ID NO: 34387 - RNA, 64 nt, Homo Sapiens
aaaaaaaaaaaagauaacuagacucuuaaaaaaaaaaaaaaaaaugguggcacagugagaaccu

SEQ ID NO: 34388 - RNA, 64 nt, Homo Sapiens
aaaaaaaaaaaaagauaacuugacucuuaaaaaaaaaaaaaaaauugguggcacagugagaacc

SEQ ID NO: 34389 - RNA, 64 nt, Homo Sapiens
aaaaaaaaaaaaaagauaaccugacucuuaaaaaaaaaaaaaaacuugguggcacagugagaac

SEQ ID NO: 34390 - RNA, 64 nt, Homo Sapiens
aaaaaaaaaaaaaaagauaaccugacucuuaaaaaaaaaaaaaaccuugguggcacagugagaa

SEQ ID NO: 34391 - RNA, 64 nt, Homo Sapiens
aaaaaaaaaaaaaaaagauaaccugacucuuaaaaaaaaaaaaaaccuugguggcacagugaga

SEQ ID NO: 34392 - RNA, 64 nt, Homo Sapiens
aaaaaaaaaaaaaaaaagauaaccugacucuuaaaaaaaaaaaaaaccuugguggcacagugag

SEQ ID NO: 34393 - RNA, 64 nt, Homo Sapiens
aaaaaaaaaaaaaaaaaagagaaccugacucuuaaaaaaaaaaacaaccuugguggcacaguga

SEQ ID NO: 34394 - RNA, 64 nt, Homo Sapiens
aaaaaaaaaaaaaaaaaaagagaaccugacucuuaaaaaaaaaaacaaccuugguggcacagug

SEQ ID NO: 34395 - RNA, 64 nt, Homo Sapiens
aaagcaacauagugggguuucaggaaaaaaaaaaaaaaaaaagaaacagagcaagacucugucu

SEQ ID NO: 34396 - RNA, 64 nt, Homo Sapiens
aaaagcaacauagugggguuucaggaaaaaaaaaaaaaaaaaagcaacagagcaagacucuguc

SEQ ID NO: 34397 - RNA, 64 nt, Homo Sapiens
gaaaagcaacauaguggggucucaggaaaaaaaaaaaaaaaaaagcaacagagcaagacucugu

SEQ ID NO: 34398 - RNA, 64 nt, Homo Sapiens
agaaaagcaacauaguggggucucaggaaaaaaaaaaaaaaaaaggcaacagagcaagacucug

SEQ ID NO: 34399 - RNA, 64 nt, Homo Sapiens
aagaaaagcaacauaguggggucucaggaaaaaaaaaaaaaaaagggcaacagagcaagacucu

SEQ ID NO: 34400 - RNA, 64 nt, Homo Sapiens
aaagaaaagcaacauaguggugucucaggaaaaaaaaaaaaaaaugggcaacagagcaagacuc

SEQ ID NO: 34401 - RNA, 64 nt, Homo Sapiens
aaaagaaaagcaacauagugcugucucaggaaaaaaaaaaaaaacugggcaacagagcaagacu

SEQ ID NO: 34402 - RNA, 64 nt, Homo Sapiens
aaaaagaaaagcaacauaguucugucucaggaaaaaaaaaaaaaccugggcaacagagcaagac

SEQ ID NO: 34403 - RNA, 64 nt, Homo Sapiens
aaaaaagaaaagcaacauagcucugucucaggaaaaaaaaaaaagccugggcaacagagcaaga

SEQ ID NO: 34404 - RNA, 64 nt, Homo Sapiens
aaaaaaagaaaagcaacauaacucugucucaggaaaaaaaaaaaagccugggcaacagagcaag

SEQ ID NO: 34405 - RNA, 64 nt, Homo Sapiens
aaaaaaaagaaaagcaacaugacucugucucaggaaaaaaaaaacagccugggcaacagagcaa

SEQ ID NO: 34406 - RNA, 64 nt, Homo Sapiens
aauccugauguugacauuauugcguuauuaaaaaaaaaaaaagaguugucuccauaagucauuu

SEQ ID NO: 34407 - RNA, 64 nt, Homo Sapiens
aaauccugauguugacauuauugcguuauuaaaaaaaaaaaaaggguugucuccauaagucauu

SEQ ID NO: 34408 - RNA, 64 nt, Homo Sapiens
gaaauccugauguugacauuuuugcguuauuaaaaaaaaaaaaaugguugucuccauaagucau

SEQ ID NO: 34409 - RNA, 64 nt, Homo Sapiens
agaaauccugauguugacauuuuugcguuauuaaaaaaaaaaaagugguugucuccauaaguca

SEQ ID NO: 34410 - RNA, 64 nt, Homo Sapiens
aagaaauccugauguugacaauuuugcguuauuaaaaaaaaaaaagugguugucuccauaaguc

SEQ ID NO: 34411 - RNA, 64 nt, Homo Sapiens
aaagaaauccugauguugaccauuuugcguuauuaaaaaaaaaacagugguugucuccauaagu

SEQ ID NO: 34412 - RNA, 64 nt, Homo Sapiens
cuauuuuaaacuuguauccuccaaauuugccaagaaaaaaaauuaugcaacugaaaaauaccuu

SEQ ID NO: 34413 - RNA, 64 nt, Homo Sapiens
aagguaaacugaaaagacaaaucaucaggucuuaaaaaaaaauaggcaguguuaaugaacauau

SEQ ID NO: 34414 - RNA, 64 nt, Homo Sapiens
aaagguaaacugaaaagacauaucaucaggucuuaaaaaaaaauuggcaguguuaaugaacaua

SEQ ID NO: 34415 - RNA, 64 nt, Homo Sapiens
acaaaaaacaaacccagagcaggagaaugucucaaaaaaaaagggauuaggggagguucagagg

SEQ ID NO: 34416 - RNA, 64 nt, Homo Sapiens
gacaaaaaacaaacccagaggaggagaaugucucaaaaaaaaagggauuaggggagguucagag

SEQ ID NO: 34417 - RNA, 64 nt, Homo Sapiens
aagaaaagaaaacucugucucucucaaaaaaaaaaaaaaaaagaggcaacacgagcaaaacuuc

SEQ ID NO: 34418 - RNA, 64 nt, Homo Sapiens
aaagaaaagaaaacucugucccucucaaaaaaaaaaaaaaaaagaggcaacacgagcaaaacuu

SEQ ID NO: 34419 - RNA, 64 nt, Homo Sapiens
gaaagaaaagaaaacucuguuccucucaaaaaaaaaaaaaaaaauaggcaacacgagcaaaacu

SEQ ID NO: 34420 - RNA, 64 nt, Homo Sapiens
agaaagaaaagaaaacucuguuccucucaaaaaaaaaaaaaaaacuaggcaacacgagcaaaac

SEQ ID NO: 34421 - RNA, 64 nt, Homo Sapiens
aagaaagaaaagaaaacucucuuccucucaaaaaaaaaaaaaaaccuaggcaacacgagcaaaa

SEQ ID NO: 34422 - RNA, 64 nt, Homo Sapiens
aaagaaagaaaagaaaacucacuuccucucaaaaaaaaaaaaaagccuaggcaacacgagcaaa

SEQ ID NO: 34423 - RNA, 64 nt, Homo Sapiens
aaaagaaagaaaagaaaacuaacuuccucucaaaaaaaaaaaaaagccuaggcaacacgagcaa

SEQ ID NO: 34424 - RNA, 64 nt, Homo Sapiens
aaaaagaaagaaaagaaaacaaacuuccucucaaaaaaaaaaaacagccuaggcaacacgagca

SEQ ID NO: 34425 - RNA, 64 nt, Homo Sapiens
aaaaaagaaagaaaagaaaaaaaacuuccucucaaaaaaaaaaaccagccuaggcaacacgagc

SEQ ID NO: 34426 - RNA, 64 nt, Homo Sapiens
aaaaaaagaaagaaaagaaacaaaacuuccucucaaaaaaaaaauccagccuaggcaacacgag

SEQ ID NO: 34427 - RNA, 64 nt, Homo Sapiens
cacacaaccuuaugagguagcucuaucucaaaaaaaaaaaaacccugccugggcgacagcgaga

SEQ ID NO: 34428 - RNA, 64 nt, Homo Sapiens
ccacacaaccuuaugagguaacucuaucucaaaaaaaaaaaaacgcugccugggcgacagcgag

SEQ ID NO: 34429 - RNA, 64 nt, Homo Sapiens
cccacacaaccuuaugaggugacucuaucucaaaaaaaaaaaaaugcugccugggcgacagcga

SEQ ID NO: 34430 - RNA, 64 nt, Homo Sapiens
acccacacaaccuuaugaggagacucuaucucaaaaaaaaaaaacugcugccugggcgacagcg

SEQ ID NO: 34431 - RNA, 64 nt, Homo Sapiens
aacccacacaaccuuaugaggagacucuaucucaaaaaaaaaaaacugcugccugggcgacagc

SEQ ID NO: 34432 - RNA, 64 nt, Homo Sapiens
aaacccacacaaccuuaugacgagacucuaucucaaaaaaaaaacacugcugccugggcgacag

SEQ ID NO: 34433 - RNA, 64 nt, Homo Sapiens
auuuuucucuuaccguuacaccagucucaaaaaaaaaaaaaagucuugggcgacagagcgagac

SEQ ID NO: 34434 - RNA, 64 nt, Homo Sapiens
uauuuuucucuuaccguuaccccagucucaaaaaaaaaaaaaaggcuugggcgacagagcgaga

SEQ ID NO: 34435 - RNA, 64 nt, Homo Sapiens
guauuuuucucuuaccguuaacccagucucaaaaaaaaaaaaaaagcuugggcgacagagcgag

SEQ ID NO: 34436 - RNA, 64 nt, Homo Sapiens
aguauuuuucucuuaccguugacccagucucaaaaaaaaaaaaacagcuugggcgacagagcga

SEQ ID NO: 34437 - RNA, 64 nt, Homo Sapiens
aaguauuuuucucuuaccguagacccagucucaaaaaaaaaaaaccagcuugggcgacagagcg

SEQ ID NO: 34438 - RNA, 64 nt, Homo Sapiens
aaaguauuuuucucuuaccggagacccagucucaaaaaaaaaaauccagcuugggcgacagagc

SEQ ID NO: 34439 - RNA, 64 nt, Homo Sapiens
aaaaguauuuuucucuuacccgagacccagucucaaaaaaaaaauuccagcuugggcgacagag

SEQ ID NO: 34440 - RNA, 64 nt, Homo Sapiens
agcugagugugguggugcaucuaaaaauaaauuuaaaaaaaauuauagugagacccugucucua

SEQ ID NO: 34441 - RNA, 64 nt, Homo Sapiens
caaaacccacaagcacuuauuaaaaaaaaaaaaaaaaaaaaacauuuaaaauuccugugaucug

SEQ ID NO: 34442 - RNA, 64 nt, Homo Sapiens
acaaaacccacaagcacuuaguaaaaaaaaaaaaaaaaaaaaacauuuaaaauuccugugaucu

SEQ ID NO: 34443 - RNA, 64 nt, Homo Sapiens
cacaaaacccacaagcacuuuguaaaaaaaaaaaaaaaaaaaaaaauuuaaaauuccugugauc

SEQ ID NO: 34444 - RNA, 64 nt, Homo Sapiens
acacaaaacccacaagcacucuguaaaaaaaaaaaaaaaaaaaacaauuuaaaauuccugugau

SEQ ID NO: 34445 - RNA, 64 nt, Homo Sapiens
aacacaaaacccacaagcacucuguaaaaaaaaaaaaaaaaaaagcaauuuaaaauuccuguga

SEQ ID NO: 34446 - RNA, 64 nt, Homo Sapiens
aaacacaaaacccacaagcaaucuguaaaaaaaaaaaaaaaaaaugcaauuuaaaauuccugug

SEQ ID NO: 34447 - RNA, 64 nt, Homo Sapiens
aaaacacaaaacccacaagcgaucuguaaaaaaaaaaaaaaaaacugcaauuuaaaauuccugu

SEQ ID NO: 34448 - RNA, 64 nt, Homo Sapiens
aaaaacacaaaacccacaagugaucuguaaaaaaaaaaaaaaaaucugcaauuuaaaauuccug

SEQ ID NO: 34449 - RNA, 64 nt, Homo Sapiens
aaaaaacacaaaacccacaagugaucuguaaaaaaaaaaaaaaaaucugcaauuuaaaauuccu

SEQ ID NO: 34450 - RNA, 64 nt, Homo Sapiens
aaaaaaacacaaaacccacaugugaucuguaaaaaaaaaaaaaagaucugcaauuuaaaauucc

SEQ ID NO: 34451 - RNA, 64 nt, Homo Sapiens
aaaaaaaacacaaaacccaccugugaucuguaaaaaaaaaaaaaugaucugcaauuuaaaauuc

SEQ ID NO: 34452 - RNA, 64 nt, Homo Sapiens
aaaaaaaaacacaaaacccaccugugaucuguaaaaaaaaaaaacugaucugcaauuuaaaauu

SEQ ID NO: 34453 - RNA, 64 nt, Homo Sapiens
aaaaaaaaaacacaaaacccuccugugaucuguaaaaaaaaaaaacugaucugcaauuuaaaau

SEQ ID NO: 34454 - RNA, 64 nt, Homo Sapiens
aaaaaaaaaaacacaaaaccuuccugugaucuguaaaaaaaaaagacugaucugcaauuuaaaa

SEQ ID NO: 34455 - RNA, 64 nt, Homo Sapiens
guugcuuucuuaaggaaagcuuauaaauaaauaaaaaaaaaagucaaauggauaugguuagccu

SEQ ID NO: 34456 - RNA, 64 nt, Homo Sapiens
uguugcuuucuuaaggaaaguuuauaaauaaauaaaaaaaaaagacaaauggauaugguuagcc

SEQ ID NO: 34457 - RNA, 64 nt, Homo Sapiens
guguugcuuucuuaaggaaacuuuauaaauaaauaaaaaaaaaagacaaauggauaugguuagc

SEQ ID NO: 34458 - RNA, 64 nt, Homo Sapiens
uuuuggguauaaaucuggguacgcaguuguacagaaaaaaaaugaaacuuauuucccaguguaa

SEQ ID NO: 34459 - RNA, 64 nt, Homo Sapiens
gcucuguauaguuacaacuuuguaauaauuguauaaaaaaaaucaaaaaacuuuuuuuaaucgu

SEQ ID NO: 34460 - RNA, 64 nt, Homo Sapiens
uuuuuuaaucguuguaauaaaaaaacaaaaaaacaaaaaaaacuccucauccuaguucuuuaaa

SEQ ID NO: 34461 - RNA, 56 nt, Homo Sapiens
aaaaaacaaaaaaaacuuuuuucuuuaaaaaaaacacggcucucuccucauccuag

SEQ ID NO: 34462 - RNA, 64 nt, Homo Sapiens
cuuggcauacaaaauauuuacaacuucgcuagaaaaaaaaaacacaaauauugaaguuguuuau

SEQ ID NO: 34463 - RNA, 64 nt, Homo Sapiens
acuuggcauacaaaauauuuucaacuucgcuagaaaaaaaaaacgcaaauauugaaguuguuua

SEQ ID NO: 34464 - RNA, 64 nt, Homo Sapiens
cacuuggcauacaaaauauuaucaacuucgcuagaaaaaaaaaaggcaaauauugaaguuguuu

SEQ ID NO: 34465 - RNA, 64 nt, Homo Sapiens
cccuggcuauuccucuuuccagaagaaaaaaaacaaaaaaaauuacacuucguauguauuuuaa

SEQ ID NO: 34466 - RNA, 64 nt, Homo Sapiens
aaaaaaauucccuggcuauuguauuuuaaagaagaaaaaaaacauuucucuuuacacuucguau

SEQ ID NO: 34467 - RNA, 64 nt, Homo Sapiens
agagaaaagcccaccuuugagucuuuaaaauaaaaaaaaaaaucaaugguuacaucugcuuuuu

SEQ ID NO: 34468 - RNA, 64 nt, Homo Sapiens
cagagaaaagcccaccuuugugucuuuaaaauaaaaaaaaaaauuaaugguuacaucugcuuuu

SEQ ID NO: 34469 - RNA, 64 nt, Homo Sapiens
ucagagaaaagcccaccuuuuugucuuuaaaauaaaaaaaaaaaauaaugguuacaucugcuuu

SEQ ID NO: 34470 - RNA, 64 nt, Homo Sapiens
aucagagaaaagcccaccuuuuugucuuuaaaauaaaaaaaaaauauaaugguuacaucugcuu

SEQ ID NO: 34471 - RNA, 64 nt, Homo Sapiens
ucauuggcuuguccgaguguaacuuuaaaaaaaaaaaaaaaacuuuuuuggggcaggggagaug

SEQ ID NO: 34472 - RNA, 64 nt, Homo Sapiens
uucauuggcuuguccgaguggaacuuuaaaaaaaaaaaaaaaacuuuuuuggggcaggggagau

SEQ ID NO: 34473 - RNA, 64 nt, Homo Sapiens
cuucauuggcuuguccgaguugaacuuuaaaaaaaaaaaaaaaaguuuuuuggggcaggggaga

SEQ ID NO: 34474 - RNA, 64 nt, Homo Sapiens
acuucauuggcuuguccgagaugaacuuuaaaaaaaaaaaaaaaaguuuuuuggggcaggggag

SEQ ID NO: 34475 - RNA, 64 nt, Homo Sapiens
aacuucauuggcuuguccgagaugaacuuuaaaaaaaaaaaaaacaguuuuuuggggcagggga

SEQ ID NO: 34476 - RNA, 64 nt, Homo Sapiens
aaacuucauuggcuuguccgagaugaacuuuaaaaaaaaaaaaaucaguuuuuuggggcagggg

SEQ ID NO: 34477 - RNA, 64 nt, Homo Sapiens
aaaacuucauuggcuuguccgagaugaacuuuaaaaaaaaaaaaaucaguuuuuuggggcaggg

SEQ ID NO: 34478 - RNA, 64 nt, Homo Sapiens
aaaaacuucauuggcuugucggagaugaacuuuaaaaaaaaaaauaucaguuuuuuggggcagg

SEQ ID NO: 34479 - RNA, 64 nt, Homo Sapiens
aaaaaacuucauuggcuugugggagaugaacuuuaaaaaaaaaacuaucaguuuuuuggggcag

SEQ ID NO: 34480 - RNA, 64 nt, Homo Sapiens
cuguuguauuuugacagaauuacuugagagacaaaaaaaaaacuaaaacaucuuauuaaaauug

SEQ ID NO: 34481 - RNA, 64 nt, Homo Sapiens
ucuguuguauuuugacagaaguacuugagagacaaaaaaaaaaccaaaacaucuuauuaaaauu

SEQ ID NO: 34482 - RNA, 64 nt, Homo Sapiens
cucuguuguauuuugacagauguacuugagagacaaaaaaaaaaacaaaacaucuuauuaaaau

SEQ ID NO: 34483 - RNA, 64 nt, Homo Sapiens
caguauuuaucguagcauuaaaauauauauauuaaaaaaaaagagauuauauauauauauauaa

SEQ ID NO: 34484 - RNA, 64 nt, Homo Sapiens
acaguauuuaucguagcauuaaaauauauauauuaaaaaaaaagagauuauauauauauauaua

SEQ ID NO: 34485 - RNA, 64 nt, Homo Sapiens
uaaaguuaaaugauaagucuuuuugagauguaaaaaaaaaaauuucuaauuauugcagacauau

SEQ ID NO: 34486 - RNA, 64 nt, Homo Sapiens
uuaaaguuaaaugauaagucuuuuugagauguaaaaaaaaaaaucucuaauuauugcagacaua

SEQ ID NO: 34487 - RNA, 64 nt, Homo Sapiens
uuuaaaguuaaaugauaaguauuuuugagauguaaaaaaaaaaagcucuaauuauugcagacau

SEQ ID NO: 34488 - RNA, 64 nt, Homo Sapiens
auuuaaaguuaaaugauaaguauuuuugagauguaaaaaaaaaaagcucuaauuauugcagaca

SEQ ID NO: 34489 - RNA, 64 nt, Homo Sapiens
gagaaaguuaaacaacauuaguaauuugaaaaaaaaaaaaaagaccuuggcuaauaaaauucua

SEQ ID NO: 34490 - RNA, 64 nt, Homo Sapiens
agagaaaguuaaacaacauuaguaauuugaaaaaaaaaaaaaagcccuuggcuaauaaaauucu

SEQ ID NO: 34491 - RNA, 64 nt, Homo Sapiens
gagagaaaguuaaacaacauuaguaauuugaaaaaaaaaaaaaaucccuuggcuaauaaaauuc

SEQ ID NO: 34492 - RNA, 64 nt, Homo Sapiens
agagagaaaguuaaacaacacuaguaauuugaaaaaaaaaaaaaaucccuuggcuaauaaaauu

SEQ ID NO: 34493 - RNA, 64 nt, Homo Sapiens
aagagagaaaguuaaacaacucuaguaauuugaaaaaaaaaaaauaucccuuggcuaauaaaau

SEQ ID NO: 34494 - RNA, 64 nt, Homo Sapiens
aaagagagaaaguuaaacaauucuaguaauuugaaaaaaaaaaacuaucccuuggcuaauaaaa

SEQ ID NO: 34495 - RNA, 64 nt, Homo Sapiens
aaaagagagaaaguuaaacaauucuaguaauuugaaaaaaaaaagcuaucccuuggcuaauaaa

SEQ ID NO: 34496 - RNA, 64 nt, Homo Sapiens
gagaaagaaaggaguaaacagcaaaaaaaaaaaaaaaaaaaagagcccuaggauugagcuaaca

SEQ ID NO: 34497 - RNA, 64 nt, Homo Sapiens
agagaaagaaaggaguaaacagcaaaaaaaaaaaaaaaaaaaagugcccuaggauugagcuaac

SEQ ID NO: 34498 - RNA, 64 nt, Homo Sapiens
gagagaaagaaaggaguaaacagcaaaaaaaaaaaaaaaaaaaauugcccuaggauugagcuaa

SEQ ID NO: 34499 - RNA, 64 nt, Homo Sapiens
agagagaaagaaaggaguaaacagcaaaaaaaaaaaaaaaaaaauuugcccuaggauugagcua

SEQ ID NO: 34500 - RNA, 64 nt, Homo Sapiens
aagagagaaagaaaggaguaaacagcaaaaaaaaaaaaaaaaaaauuugcccuaggauugagcu

SEQ ID NO: 34501 - RNA, 64 nt, Homo Sapiens
aaagagagaaagaaaggaguuaacagcaaaaaaaaaaaaaaaaaaauuugcccuaggauugagc

SEQ ID NO: 34502 - RNA, 64 nt, Homo Sapiens
aaaagagagaaagaaaggagcuaacagcaaaaaaaaaaaaaaaaaaauuugcccuaggauugag

SEQ ID NO: 34503 - RNA, 64 nt, Homo Sapiens
aaaaagagagaaagaaaggagcuaacagcaaaaaaaaaaaaaaauaaauuugcccuaggauuga

SEQ ID NO: 34504 - RNA, 64 nt, Homo Sapiens
aaaaaagagagaaagaaaggagcuaacagcaaaaaaaaaaaaaauuaaauuugcccuaggauug

SEQ ID NO: 34505 - RNA, 64 nt, Homo Sapiens
aaaaaaagagagaaagaaaggagcuaacagcaaaaaaaaaaaaauuuaaauuugcccuaggauu

SEQ ID NO: 34506 - RNA, 64 nt, Homo Sapiens
aaaaaaaagagagaaagaaaugagcuaacagcaaaaaaaaaaaaguuuaaauuugcccuaggau

SEQ ID NO: 34507 - RNA, 64 nt, Homo Sapiens
aaaaaaaaagagagaaagaauugagcuaacagcaaaaaaaaaaacguuuaaauuugcccuagga

SEQ ID NO: 34508 - RNA, 64 nt, Homo Sapiens
aaaaaaaaaagagagaaagaauugagcuaacagcaaaaaaaaaaacguuuaaauuugcccuagg

SEQ ID NO: 34509 - RNA, 64 nt, Homo Sapiens
uuugauuugcacuguuauauacaaaucugacuuuaaaaaaaauccuugaaaaugggaagcgaug

SEQ ID NO: 34510 - RNA, 64 nt, Homo Sapiens
acuguuaacacugcuaaugaauuaccgauggggaaaaaaaaacuuuagaauagaaacuuuuagu

SEQ ID NO: 34511 - RNA, 64 nt, Homo Sapiens
uacuguuaacacugcuaauguauuaccgauggggaaaaaaaaaccuuagaauagaaacuuuuag

SEQ ID NO: 34512 - RNA, 64 nt, Homo Sapiens
acgugggaaauaugaaccuucccugucucaaaaaaaaaaaaagaagccuugagacagagcgaga

SEQ ID NO: 34513 - RNA, 64 nt, Homo Sapiens
aacgugggaaauaugaaccuacccugucucaaaaaaaaaaaaagcagccuugagacagagcgag

SEQ ID NO: 34514 - RNA, 64 nt, Homo Sapiens
gaacgugggaaauaugaaccgacccugucucaaaaaaaaaaaaaccagccuugagacagagcga

SEQ ID NO: 34515 - RNA, 64 nt, Homo Sapiens
agaacgugggaaauaugaacagacccugucucaaaaaaaaaaaauccagccuugagacagagcg

SEQ ID NO: 34516 - RNA, 64 nt, Homo Sapiens
aagaacgugggaaauaugaagagacccugucucaaaaaaaaaaacuccagccuugagacagagc

SEQ ID NO: 34517 - RNA, 64 nt, Homo Sapiens
aaagaacgugggaaauaugacgagacccugucucaaaaaaaaaaacuccagccuugagacagag

SEQ ID NO: 34518 - RNA, 64 nt, Homo Sapiens
uguccgcguugcaaacuauugaggaagggguuaaaaaaaaaauuagggcccuagaaagugcuag

SEQ ID NO: 34519 - RNA, 64 nt, Homo Sapiens
uuguccgcguugcaaacuauggaggaagggguuaaaaaaaaaaucagggcccuagaaagugcua

SEQ ID NO: 34520 - RNA, 64 nt, Homo Sapiens
uuuguccgcguugcaaacuaaggaggaagggguuaaaaaaaaaaucagggcccuagaaagugcu

SEQ ID NO: 34521 - RNA, 64 nt, Homo Sapiens
aaauguccgucagugucugugaugccucaguuaaaaaaaaaauuccucacuauuaaacugccau

SEQ ID NO: 34522 - RNA, 64 nt, Homo Sapiens
uaaauguccgucagugucugugaugccucaguuaaaaaaaaaauaccucacuauuaaacugcca

SEQ ID NO: 34523 - RNA, 64 nt, Homo Sapiens
uuaaauguccgucagugucuaugaugccucaguuaaaaaaaaaauaccucacuauuaaacugcc

SEQ ID NO: 34524 - RNA, 64 nt, Homo Sapiens
ccacaucuuauacuccaauguuuuuuaaaaaaaaaaaaaaaagcuuaaggcuuuugaacuaucu

SEQ ID NO: 34525 - RNA, 64 nt, Homo Sapiens
cccacaucuuauacuccaauuuuuuuuaaaaaaaaaaaaaaaaguuuaaggcuuuugaacuauc

SEQ ID NO: 34526 - RNA, 64 nt, Homo Sapiens
gcccacaucuuauacuccaacuuuuuuuaaaaaaaaaaaaaaaauuuuaaggcuuuugaacuau

SEQ ID NO: 34527 - RNA, 64 nt, Homo Sapiens
agcccacaucuuauacuccaucuuuuuuuaaaaaaaaaaaaaaauuuuuaaggcuuuugaacua

SEQ ID NO: 34528 - RNA, 64 nt, Homo Sapiens
aagcccacaucuuauacuccaucuuuuuuuaaaaaaaaaaaaaacuuuuuaaggcuuuugaacu

SEQ ID NO: 34529 - RNA, 64 nt, Homo Sapiens
aaagcccacaucuuauacucuaucuuuuuuuaaaaaaaaaaaaaacuuuuuaaggcuuuugaac

SEQ ID NO: 34530 - RNA, 64 nt, Homo Sapiens
aaaagcccacaucuuauacucuaucuuuuuuuaaaaaaaaaaaauacuuuuuaaggcuuuugaa

SEQ ID NO: 34531 - RNA, 64 nt, Homo Sapiens
aaaaagcccacaucuuauacacuaucuuuuuuuaaaaaaaaaaaauacuuuuuaaggcuuuuga

SEQ ID NO: 34532 - RNA, 64 nt, Homo Sapiens
aaaaaagcccacaucuuauaaacuaucuuuuuuuaaaaaaaaaaaauacuuuuuaaggcuuuug

SEQ ID NO: 34533 - RNA, 64 nt, Homo Sapiens
uuaaauaaaaugucucagagugucuuuuuuuuaaaaaaaaaaguuucuuggcauuaauuauugc

SEQ ID NO: 34534 - RNA, 64 nt, Homo Sapiens
uuuaaauaaaaugucucagacugucuuuuuuuuaaaaaaaaaagguucuuggcauuaauuauug

SEQ ID NO: 34535 - RNA, 64 nt, Homo Sapiens
guuuaaauaaaaugucucaggcugucuuuuuuuuaaaaaaaaaauguucuuggcauuaauuauu

SEQ ID NO: 34536 - RNA, 64 nt, Homo Sapiens
aguacaagaguauaauaccucaaaaaaaaaaaagaaaaaaaagaacaggagugaaacuccgucu

SEQ ID NO: 34537 - RNA, 64 nt, Homo Sapiens
aaaaaaagaaguacaagaguacuccgucucaaaaaaaaaaaagauccuggacaacaggagugaa

SEQ ID NO: 34538 - RNA, 64 nt, Homo Sapiens
aaaaaaaagaaguacaagagaacuccgucucaaaaaaaaaaaagauccuggacaacaggaguga

SEQ ID NO: 34539 - RNA, 64 nt, Homo Sapiens
gaaaaaaaagaaguacaagaaaacuccgucucaaaaaaaaaaaacauccuggacaacaggagug

SEQ ID NO: 34540 - RNA, 64 nt, Homo Sapiens
agaaaaaaaagaaguacaaggaaacuccgucucaaaaaaaaaaaccauccuggacaacaggagu

SEQ ID NO: 34541 - RNA, 64 nt, Homo Sapiens
aagaaaaaaaagaaguacaaugaaacuccgucucaaaaaaaaaauccauccuggacaacaggag

SEQ ID NO: 34542 - RNA, 64 nt, Homo Sapiens
uauuuuguauugaaacuuuuaaacaauacugaagaaaaaaaaacuuuuccgacaucuguucuug

SEQ ID NO: 34543 - RNA, 64 nt, Homo Sapiens
auuuuguauugaaacuuuuaaacaauacugaagaaaaaaaaacuuuuccgacaucuguucuugg

SEQ ID NO: 34544 - RNA, 64 nt, Homo Sapiens
aucaaacuaccaauaacauucuucacagaaucagaaaaaaaaagcauuaaaauuuauuugaaac

SEQ ID NO: 34545 - RNA, 64 nt, Homo Sapiens
ucaaacuaccaauaacauucuucacagaaucagaaaaaaaaagcauuaaaauuuauuugaaacc

SEQ ID NO: 34546 - RNA, 64 nt, Homo Sapiens
cuccagccugggcaaccaagcgagacucugccuuaaaaaaaaaaaaaagaaaauguggcacaua

SEQ ID NO: 34547 - RNA, 64 nt, Homo Sapiens
uccagccugggcaaccaagcgagacucugccuuaaaaaaaaaaaaaagaaaauguggcacauau

SEQ ID NO: 34548 - RNA, 64 nt, Homo Sapiens
ccagccugggcaaccaagcgagacucugccuuaaaaaaaaaaaaaagaaaauguggcacauaua

SEQ ID NO: 34549 - RNA, 64 nt, Homo Sapiens
cagccugggcaaccaagcgagacucugccuuaaaaaaaaaaaaaagaaaauguggcacauauac

SEQ ID NO: 34550 - RNA, 64 nt, Homo Sapiens
agccugggcaaccaagcgagacucugccuuaaaaaaaaaaaaaagaaaauguggcacauauaca

SEQ ID NO: 34551 - RNA, 64 nt, Homo Sapiens
gccugggcaaccaagcgagacucugccuuaaaaaaaaaaaaaagaaaauguggcacauauacac

SEQ ID NO: 34552 - RNA, 64 nt, Homo Sapiens
ccugggcaaccaagcgagacucugccuuaaaaaaaaaaaaaagaaaauguggcacauauacacc

SEQ ID NO: 34553 - RNA, 64 nt, Homo Sapiens
uauauagcaagccuacacaugugccccugaaccuaaaaaaaaaguuaaaagaaaaacguuugga

SEQ ID NO: 34554 - RNA, 64 nt, Homo Sapiens
auauagcaagccuacacaugugccccugaaccuaaaaaaaaaguuaaaagaaaaacguuuggau

SEQ ID NO: 34555 - RNA, 64 nt, Homo Sapiens
uccagccugggcaacaagagcgaaacuccaucucaaaaaaaaaaaagugucuuguucacugcag

SEQ ID NO: 34556 - RNA, 64 nt, Homo Sapiens
ccagccugggcaacaagagcgaaacuccaucucaaaaaaaaaaaagugucuuguucacugcagc

SEQ ID NO: 34557 - RNA, 64 nt, Homo Sapiens
cagccugggcaacaagagcgaaacuccaucucaaaaaaaaaaaagugucuuguucacugcagca

SEQ ID NO: 34558 - RNA, 64 nt, Homo Sapiens
agccugggcaacaagagcgaaacuccaucucaaaaaaaaaaaagugucuuguucacugcagcau

SEQ ID NO: 34559 - RNA, 64 nt, Homo Sapiens
gccugggcaacaagagcgaaacuccaucucaaaaaaaaaaaagugucuuguucacugcagcaug

SEQ ID NO: 34560 - RNA, 64 nt, Homo Sapiens
ucuuggcuccaucucuucagaccccuuugccuuuaaaaaaaaaacaaaaacaaaaacaaaaaaa

SEQ ID NO: 34561 - RNA, 64 nt, Homo Sapiens
cuuggcuccaucucuucagaccccuuugccuuuaaaaaaaaaacaaaaacaaaaacaaaaaaac

SEQ ID NO: 34562 - RNA, 64 nt, Homo Sapiens
uuggcuccaucucuucagaccccuuugccuuuaaaaaaaaaacaaaaacaaaaacaaaaaaacc

SEQ ID NO: 34563 - RNA, 64 nt, Homo Sapiens
uuccuuaagaguaaaaaacagucauugcauucagaaaaaaaaaaaaaaaaaagucaauaaagau

SEQ ID NO: 34564 - RNA, 64 nt, Homo Sapiens
uccuuaagaguaaaaaacagucauugcauucagaaaaaaaaaaaaaaaaaagucaauaaagaua

SEQ ID NO: 34565 - RNA, 64 nt, Homo Sapiens
ccuuaagaguaaaaaacagucauugcauucagaaaaaaaaaaaaaaaaaagucaauaaagauac

SEQ ID NO: 34566 - RNA, 64 nt, Homo Sapiens
cuuaagaguaaaaaacagucauugcauucagaaaaaaaaaaaaaaaaaagucaauaaagauaca

SEQ ID NO: 34567 - RNA, 64 nt, Homo Sapiens
uuaagaguaaaaaacagucauugcauucagaaaaaaaaaaaaaaaaaagucaauaaagauacaa

SEQ ID NO: 34568 - RNA, 64 nt, Homo Sapiens
uaagaguaaaaaacagucauugcauucagaaaaaaaaaaaaaaaaaagucaauaaagauacaac

SEQ ID NO: 34569 - RNA, 64 nt, Homo Sapiens
aagaguaaaaaacagucauugcauucagaaaaaaaaaaaaaaaaaagucaauaaagauacaacg

SEQ ID NO: 34570 - RNA, 64 nt, Homo Sapiens
agaguaaaaaacagucauugcauucagaaaaaaaaaaaaaaaaaagucaauaaagauacaacga

SEQ ID NO: 34571 - RNA, 64 nt, Homo Sapiens
gaguaaaaaacagucauugcauucagaaaaaaaaaaaaaaaaaagucaauaaagauacaacgau

SEQ ID NO: 34572 - RNA, 64 nt, Homo Sapiens
aguaaaaaacagucauugcauucagaaaaaaaaaaaaaaaaaagucaauaaagauacaacgauu

SEQ ID NO: 34573 - RNA, 64 nt, Homo Sapiens
guaaaaaacagucauugcauucagaaaaaaaaaaaaaaaaaagucaauaaagauacaacgauug

SEQ ID NO: 34574 - RNA, 64 nt, Homo Sapiens
guauuuugcagagcuaucaauguccaaauaauuuaaaaaaaaaaauaaagguauuuaagcagug

SEQ ID NO: 34575 - RNA, 64 nt, Homo Sapiens
uauuuugcagagcuaucaauguccaaauaauuuaaaaaaaaaaauaaagguauuuaagcaguga

SEQ ID NO: 34576 - RNA, 64 nt, Homo Sapiens
auuuugcagagcuaucaauguccaaauaauuuaaaaaaaaaaauaaagguauuuaagcagugag

SEQ ID NO: 34577 - RNA, 64 nt, Homo Sapiens
uuuugcagagcuaucaauguccaaauaauuuaaaaaaaaaaauaaagguauuuaagcagugagu

SEQ ID NO: 34578 - RNA, 64 nt, Homo Sapiens
gaauuugauuacacauagaugaugauguuuauuuaaaaaaaaaacaacagcaacaaaaaauccu

SEQ ID NO: 34579 - RNA, 64 nt, Homo Sapiens
aauuugauuacacauagaugaugauguuuauuuaaaaaaaaaacaacagcaacaaaaaauccua

SEQ ID NO: 34580 - RNA, 64 nt, Homo Sapiens
auuugauuacacauagaugaugauguuuauuuaaaaaaaaaacaacagcaacaaaaaauccuag

SEQ ID NO: 34581 - RNA, 64 nt, Homo Sapiens
uuucuuuuagaaauaauguauugugucugugcagaaaaaaaaaaaaccaaaaaggauugcuuua

SEQ ID NO: 34582 - RNA, 64 nt, Homo Sapiens
uucuuuuagaaauaauguauugugucugugcagaaaaaaaaaaaaccaaaaaggauugcuuuac

SEQ ID NO: 34583 - RNA, 64 nt, Homo Sapiens
ucuuuuagaaauaauguauugugucugugcagaaaaaaaaaaaaccaaaaaggauugcuuuacu

SEQ ID NO: 34584 - RNA, 64 nt, Homo Sapiens
cuuuuagaaauaauguauugugucugugcagaaaaaaaaaaaaccaaaaaggauugcuuuacuc

SEQ ID NO: 34585 - RNA, 64 nt, Homo Sapiens
uuuuagaaauaauguauugugucugugcagaaaaaaaaaaaaccaaaaaggauugcuuuacucc

SEQ ID NO: 34586 - RNA, 64 nt, Homo Sapiens
cuguauauuuuuuuaaaaaucugguaguuucuggaaaaaaaagagaaggggguuuguaguacuu

SEQ ID NO: 34587 - RNA, 64 nt, Homo Sapiens
aaacaugaugaaacccugucucuacuaaaaauacaaaaaaaaaaaaaauuagccaggcguggug

SEQ ID NO: 34588 - RNA, 64 nt, Homo Sapiens
aacaugaugaaacccugucucuacuaaaaauacaaaaaaaaaaaaaauuagccaggcguggugg

SEQ ID NO: 34589 - RNA, 64 nt, Homo Sapiens
acaugaugaaacccugucucuacuaaaaauacaaaaaaaaaaaaaauuagccaggcgugguggu

SEQ ID NO: 34590 - RNA, 64 nt, Homo Sapiens
caugaugaaacccugucucuacuaaaaauacaaaaaaaaaaaaaauuagccaggcgugguggug

SEQ ID NO: 34591 - RNA, 64 nt, Homo Sapiens
augaugaaacccugucucuacuaaaaauacaaaaaaaaaaaaaauuagccaggcgugguggugc

SEQ ID NO: 34592 - RNA, 64 nt, Homo Sapiens
ugaugaaacccugucucuacuaaaaauacaaaaaaaaaaaaaauuagccaggcgugguggugca

SEQ ID NO: 34593 - RNA, 64 nt, Homo Sapiens
gaugaaacccugucucuacuaaaaauacaaaaaaaaaaaaaauuagccaggcgugguggugcac

SEQ ID NO: 34594 - RNA, 64 nt, Homo Sapiens
cuccaaccuggacaacagagcgagacuccaucucaaaaaaaaaaaaaaauuguguugccucaua

SEQ ID NO: 34595 - RNA, 64 nt, Homo Sapiens
uccaaccuggacaacagagcgagacuccaucucaaaaaaaaaaaaaaauuguguugccucauac

SEQ ID NO: 34596 - RNA, 64 nt, Homo Sapiens
ccaaccuggacaacagagcgagacuccaucucaaaaaaaaaaaaaaauuguguugccucauacg

SEQ ID NO: 34597 - RNA, 64 nt, Homo Sapiens
caaccuggacaacagagcgagacuccaucucaaaaaaaaaaaaaaauuguguugccucauacga

SEQ ID NO: 34598 - RNA, 64 nt, Homo Sapiens
aaccuggacaacagagcgagacuccaucucaaaaaaaaaaaaaaauuguguugccucauacgaa

SEQ ID NO: 34599 - RNA, 64 nt, Homo Sapiens
accuggacaacagagcgagacuccaucucaaaaaaaaaaaaaaauuguguugccucauacgaaa

SEQ ID NO: 34600 - RNA, 64 nt, Homo Sapiens
ccuggacaacagagcgagacuccaucucaaaaaaaaaaaaaaauuguguugccucauacgaaau

SEQ ID NO: 34601 - RNA, 64 nt, Homo Sapiens
cuggacaacagagcgagacuccaucucaaaaaaaaaaaaaaauuguguugccucauacgaaaug

SEQ ID NO: 34602 - RNA, 64 nt, Homo Sapiens
uacuaagggacaauuauuuuaagaccauggauuuaaaaaaaaaaaaaaaaacucuguuucugca

SEQ ID NO: 34603 - RNA, 64 nt, Homo Sapiens
acuaagggacaauuauuuuaagaccauggauuuaaaaaaaaaaaaaaaaacucuguuucugcag

SEQ ID NO: 34604 - RNA, 64 nt, Homo Sapiens
cuaagggacaauuauuuuaagaccauggauuuaaaaaaaaaaaaaaaaacucuguuucugcagg

SEQ ID NO: 34605 - RNA, 64 nt, Homo Sapiens
uaagggacaauuauuuuaagaccauggauuuaaaaaaaaaaaaaaaaacucuguuucugcaggg

SEQ ID NO: 34606 - RNA, 64 nt, Homo Sapiens
aagggacaauuauuuuaagaccauggauuuaaaaaaaaaaaaaaaaacucuguuucugcagggg

SEQ ID NO: 34607 - RNA, 64 nt, Homo Sapiens
agggacaauuauuuuaagaccauggauuuaaaaaaaaaaaaaaaaacucuguuucugcagggga

SEQ ID NO: 34608 - RNA, 64 nt, Homo Sapiens
gggacaauuauuuuaagaccauggauuuaaaaaaaaaaaaaaaaacucuguuucugcaggggau

SEQ ID NO: 34609 - RNA, 64 nt, Homo Sapiens
ggacaauuauuuuaagaccauggauuuaaaaaaaaaaaaaaaaacucuguuucugcaggggaug

SEQ ID NO: 34610 - RNA, 64 nt, Homo Sapiens
gacaauuauuuuaagaccauggauuuaaaaaaaaaaaaaaaaacucuguuucugcaggggauga

SEQ ID NO: 34611 - RNA, 64 nt, Homo Sapiens
acaauuauuuuaagaccauggauuuaaaaaaaaaaaaaaaaacucuguuucugcaggggaugau

SEQ ID NO: 34612 - RNA, 64 nt, Homo Sapiens
caguaaaaaaauaauaaaagacaaaaacaaauuuaaaaaaaaauuuaagccacaaaaaaaggca

SEQ ID NO: 34613 - RNA, 64 nt, Homo Sapiens
aguaaaaaaauaauaaaagacaaaaacaaauuuaaaaaaaaauuuaagccacaaaaaaaggcac

SEQ ID NO: 34614 - RNA, 64 nt, Homo Sapiens
aucaaucugagggaggggauaaagaggaagcaauaaaaaaaaaacauccgacagagcagcucug

SEQ ID NO: 34615 - RNA, 64 nt, Homo Sapiens
ucaaucugagggaggggauaaagaggaagcaauaaaaaaaaaacauccgacagagcagcucugg

SEQ ID NO: 34616 - RNA, 64 nt, Homo Sapiens
caaucugagggaggggauaaagaggaagcaauaaaaaaaaaacauccgacagagcagcucuggc

SEQ ID NO: 34617 - RNA, 64 nt, Homo Sapiens
cuccagccugggcgacagaaccagacuccgucucaaaaaaaaaaaaaaaacaaaaaaggcugaa

SEQ ID NO: 34618 - RNA, 64 nt, Homo Sapiens
uccagccugggcgacagaaccagacuccgucucaaaaaaaaaaaaaaaacaaaaaaggcugaag

SEQ ID NO: 34619 - RNA, 64 nt, Homo Sapiens
ccagccugggcgacagaaccagacuccgucucaaaaaaaaaaaaaaaacaaaaaaggcugaagg

SEQ ID NO: 34620 - RNA, 64 nt, Homo Sapiens
cagccugggcgacagaaccagacuccgucucaaaaaaaaaaaaaaaacaaaaaaggcugaaggc

SEQ ID NO: 34621 - RNA, 64 nt, Homo Sapiens
agccugggcgacagaaccagacuccgucucaaaaaaaaaaaaaaaacaaaaaaggcugaaggca

SEQ ID NO: 34622 - RNA, 64 nt, Homo Sapiens
gccugggcgacagaaccagacuccgucucaaaaaaaaaaaaaaaacaaaaaaggcugaaggcag

SEQ ID NO: 34623 - RNA, 64 nt, Homo Sapiens
ccugggcgacagaaccagacuccgucucaaaaaaaaaaaaaaaacaaaaaaggcugaaggcagc

SEQ ID NO: 34624 - RNA, 64 nt, Homo Sapiens
cugggcgacagaaccagacuccgucucaaaaaaaaaaaaaaaacaaaaaaggcugaaggcagcu

SEQ ID NO: 34625 - RNA, 64 nt, Homo Sapiens
ugggcgacagaaccagacuccgucucaaaaaaaaaaaaaaaacaaaaaaggcugaaggcagcug

SEQ ID NO: 34626 - RNA, 64 nt, Homo Sapiens
uccagccugggcaaaaagagugagacucugucucaaaaaaaaaacaaaacaaaaaaaaccucuu

SEQ ID NO: 34627 - RNA, 64 nt, Homo Sapiens
ccagccugggcaaaaagagugagacucugucucaaaaaaaaaacaaaacaaaaaaaaccucuuu

SEQ ID NO: 34628 - RNA, 64 nt, Homo Sapiens
cagccugggcaaaaagagugagacucugucucaaaaaaaaaacaaaacaaaaaaaaccucuuug

SEQ ID NO: 34629 - RNA, 64 nt, Homo Sapiens
agagugagacucugucucaaaaaaaaaacaaaacaaaaaaaaccucuuugcugguauauuugaa

SEQ ID NO: 34630 - RNA, 64 nt, Homo Sapiens
ugaacuucccuuccuuaaaguacucuaaaccuuuaaaaaaaaaucugauuuaugcagcagagau

SEQ ID NO: 34631 - RNA, 64 nt, Homo Sapiens
gaacuucccuuccuuaaaguacucuaaaccuuuaaaaaaaaaucugauuuaugcagcagagaug

SEQ ID NO: 34632 - RNA, 64 nt, Homo Sapiens
agucgaaagcuuuuaaguauagcuuccucccuugaaaaaaaauguaaacuaugacugcugagug

SEQ ID NO: 34633 - RNA, 64 nt, Homo Sapiens
cuguguuuucuaacacauuuuucuguuuuuaauuaaaaaaaaaaaaaaaagguuuucaguugcu

SEQ ID NO: 34634 - RNA, 64 nt, Homo Sapiens
uguguuuucuaacacauuuuucuguuuuuaauuaaaaaaaaaaaaaaaagguuuucaguugcuu

SEQ ID NO: 34635 - RNA, 64 nt, Homo Sapiens
guguuuucuaacacauuuuucuguuuuuaauuaaaaaaaaaaaaaaaagguuuucaguugcuuu

SEQ ID NO: 34636 - RNA, 64 nt, Homo Sapiens
uguuuucuaacacauuuuucuguuuuuaauuaaaaaaaaaaaaaaaagguuuucaguugcuuuu

SEQ ID NO: 34637 - RNA, 64 nt, Homo Sapiens
guuuucuaacacauuuuucuguuuuuaauuaaaaaaaaaaaaaaaagguuuucaguugcuuuug

SEQ ID NO: 34638 - RNA, 64 nt, Homo Sapiens
uuuucuaacacauuuuucuguuuuuaauuaaaaaaaaaaaaaaaagguuuucaguugcuuuugu

SEQ ID NO: 34639 - RNA, 64 nt, Homo Sapiens
uuucuaacacauuuuucuguuuuuaauuaaaaaaaaaaaaaaaagguuuucaguugcuuuuguc

SEQ ID NO: 34640 - RNA, 64 nt, Homo Sapiens
uucuaacacauuuuucuguuuuuaauuaaaaaaaaaaaaaaaagguuuucaguugcuuuugucu

SEQ ID NO: 34641 - RNA, 64 nt, Homo Sapiens
ucuaacacauuuuucuguuuuuaauuaaaaaaaaaaaaaaaagguuuucaguugcuuuugucuc

SEQ ID NO: 34642 - RNA, 64 nt, Homo Sapiens
ccccucugcgagaaacacccaagaaugaucaauuaaaaaaaaaauaauauaauaauaauucuug

SEQ ID NO: 34643 - RNA, 64 nt, Homo Sapiens
cccucugcgagaaacacccaagaaugaucaauuaaaaaaaaaauaauauaauaauaauucuugu

SEQ ID NO: 34644 - RNA, 64 nt, Homo Sapiens
ccucugcgagaaacacccaagaaugaucaauuaaaaaaaaaauaauauaauaauaauucuuguc

SEQ ID NO: 34645 - RNA, 64 nt, Homo Sapiens
aggcacccacagcaucaugcaaguggcaucuuguaaaaaaaaaaaaaaaguuuaaucugaaucu

SEQ ID NO: 34646 - RNA, 64 nt, Homo Sapiens
ggcacccacagcaucaugcaaguggcaucuuguaaaaaaaaaaaaaaaguuuaaucugaaucua

SEQ ID NO: 34647 - RNA, 64 nt, Homo Sapiens
gcacccacagcaucaugcaaguggcaucuuguaaaaaaaaaaaaaaaguuuaaucugaaucuaa

SEQ ID NO: 34648 - RNA, 64 nt, Homo Sapiens
cacccacagcaucaugcaaguggcaucuuguaaaaaaaaaaaaaaaguuuaaucugaaucuaac

SEQ ID NO: 34649 - RNA, 64 nt, Homo Sapiens
acccacagcaucaugcaaguggcaucuuguaaaaaaaaaaaaaaaguuuaaucugaaucuaacc

SEQ ID NO: 34650 - RNA, 64 nt, Homo Sapiens
cccacagcaucaugcaaguggcaucuuguaaaaaaaaaaaaaaaguuuaaucugaaucuaacca

SEQ ID NO: 34651 - RNA, 64 nt, Homo Sapiens
ccacagcaucaugcaaguggcaucuuguaaaaaaaaaaaaaaaguuuaaucugaaucuaaccau

SEQ ID NO: 34652 - RNA, 64 nt, Homo Sapiens
cacagcaucaugcaaguggcaucuuguaaaaaaaaaaaaaaaguuuaaucugaaucuaaccaug

SEQ ID NO: 34653 - RNA, 64 nt, Homo Sapiens
cugggcaacauagugagaccccaucucuacaaagaaaaaaaaauuagcuggacaugguaaugaa

SEQ ID NO: 34654 - RNA, 64 nt, Homo Sapiens
ugggcaacauagugagaccccaucucuacaaagaaaaaaaaauuagcuggacaugguaaugaau

SEQ ID NO: 34655 - RNA, 64 nt, Homo Sapiens
acuuagccugggugacagagugagacccuaucucaaaaaaaaaaaaaaucuaugcauuguaugg

SEQ ID NO: 34656 - RNA, 64 nt, Homo Sapiens
cuuagccugggugacagagugagacccuaucucaaaaaaaaaaaaaaucuaugcauuguauggg

SEQ ID NO: 34657 - RNA, 64 nt, Homo Sapiens
uuagccugggugacagagugagacccuaucucaaaaaaaaaaaaaaucuaugcauuguauggga

SEQ ID NO: 34658 - RNA, 64 nt, Homo Sapiens
uagccugggugacagagugagacccuaucucaaaaaaaaaaaaaaucuaugcauuguaugggac

SEQ ID NO: 34659 - RNA, 64 nt, Homo Sapiens
agccugggugacagagugagacccuaucucaaaaaaaaaaaaaaucuaugcauuguaugggacu

SEQ ID NO: 34660 - RNA, 64 nt, Homo Sapiens
gccugggugacagagugagacccuaucucaaaaaaaaaaaaaaucuaugcauuguaugggacuu

SEQ ID NO: 34661 - RNA, 64 nt, Homo Sapiens
ccugggugacagagugagacccuaucucaaaaaaaaaaaaaaucuaugcauuguaugggacuuu

SEQ ID NO: 34662 - RNA, 64 nt, Homo Sapiens
gcaacauagugauaccuugucucuaccaaaaguuaaaaaaaaaaaaaaaaaagcucaagaaccu

SEQ ID NO: 34663 - RNA, 64 nt, Homo Sapiens
caacauagugauaccuugucucuaccaaaaguuaaaaaaaaaaaaaaaaaagcucaagaaccug

SEQ ID NO: 34664 - RNA, 64 nt, Homo Sapiens
aacauagugauaccuugucucuaccaaaaguuaaaaaaaaaaaaaaaaaagcucaagaaccugc

SEQ ID NO: 34665 - RNA, 64 nt, Homo Sapiens
acauagugauaccuugucucuaccaaaaguuaaaaaaaaaaaaaaaaaagcucaagaaccugca

SEQ ID NO: 34666 - RNA, 64 nt, Homo Sapiens
cauagugauaccuugucucuaccaaaaguuaaaaaaaaaaaaaaaaaagcucaagaaccugcac

SEQ ID NO: 34667 - RNA, 64 nt, Homo Sapiens
auagugauaccuugucucuaccaaaaguuaaaaaaaaaaaaaaaaaagcucaagaaccugcacg

SEQ ID NO: 34668 - RNA, 64 nt, Homo Sapiens
uagugauaccuugucucuaccaaaaguuaaaaaaaaaaaaaaaaaagcucaagaaccugcacga

SEQ ID NO: 34669 - RNA, 64 nt, Homo Sapiens
agugauaccuugucucuaccaaaaguuaaaaaaaaaaaaaaaaaagcucaagaaccugcacgag

SEQ ID NO: 34670 - RNA, 64 nt, Homo Sapiens
gugauaccuugucucuaccaaaaguuaaaaaaaaaaaaaaaaaagcucaagaaccugcacgagg

SEQ ID NO: 34671 - RNA, 64 nt, Homo Sapiens
ugauaccuugucucuaccaaaaguuaaaaaaaaaaaaaaaaaagcucaagaaccugcacgaggg

SEQ ID NO: 34672 - RNA, 64 nt, Homo Sapiens
gauaccuugucucuaccaaaaguuaaaaaaaaaaaaaaaaaagcucaagaaccugcacgagggc

SEQ ID NO: 34673 - RNA, 64 nt, Homo Sapiens
aguauuaaguucuuagucauugauuuuuguguuuaaaaaaaaauaggaaagagggaaacugcag

SEQ ID NO: 34674 - RNA, 64 nt, Homo Sapiens
guauuaaguucuuagucauugauuuuuguguuuaaaaaaaaauaggaaagagggaaacugcagc

SEQ ID NO: 34675 - RNA, 64 nt, Homo Sapiens
cgggcuuuaauuugcuaaagcugugcacauauguaaaaaaaaaaaaaaaaagauuauuuuaggg

SEQ ID NO: 34676 - RNA, 64 nt, Homo Sapiens
gggcuuuaauuugcuaaagcugugcacauauguaaaaaaaaaaaaaaaaagauuauuuuagggg

SEQ ID NO: 34677 - RNA, 64 nt, Homo Sapiens
ggcuuuaauuugcuaaagcugugcacauauguaaaaaaaaaaaaaaaaagauuauuuuagggga

SEQ ID NO: 34678 - RNA, 64 nt, Homo Sapiens
gcuuuaauuugcuaaagcugugcacauauguaaaaaaaaaaaaaaaaagauuauuuuaggggag

SEQ ID NO: 34679 - RNA, 64 nt, Homo Sapiens
cuuuaauuugcuaaagcugugcacauauguaaaaaaaaaaaaaaaaagauuauuuuaggggaga

SEQ ID NO: 34680 - RNA, 64 nt, Homo Sapiens
uuuaauuugcuaaagcugugcacauauguaaaaaaaaaaaaaaaaagauuauuuuaggggagau

SEQ ID NO: 34681 - RNA, 64 nt, Homo Sapiens
uuaauuugcuaaagcugugcacauauguaaaaaaaaaaaaaaaaagauuauuuuaggggagaug

SEQ ID NO: 34682 - RNA, 64 nt, Homo Sapiens
uaauuugcuaaagcugugcacauauguaaaaaaaaaaaaaaaaagauuauuuuaggggagaugu

SEQ ID NO: 34683 - RNA, 64 nt, Homo Sapiens
aauuugcuaaagcugugcacauauguaaaaaaaaaaaaaaaaagauuauuuuaggggagaugua

SEQ ID NO: 34684 - RNA, 64 nt, Homo Sapiens
auuugcuaaagcugugcacauauguaaaaaaaaaaaaaaaaagauuauuuuaggggagauguag

SEQ ID NO: 34685 - RNA, 64 nt, Homo Sapiens
agaugauaaagcauuugaaugguacaguagauguaaaaaaaauucaguuuaaaagaacauuugu

SEQ ID NO: 34686 - RNA, 64 nt, Homo Sapiens
uuacuggcccaacuugggaguggggaaauugcuuaaaaaaaaagaaaaagaaaaaaaaaaagau

SEQ ID NO: 34687 - RNA, 64 nt, Homo Sapiens
uacuggcccaacuugggaguggggaaauugcuuaaaaaaaaagaaaaagaaaaaaaaaaagauu

SEQ ID NO: 34688 - RNA, 64 nt, Homo Sapiens
ggaguggggaaauugcuuaaaaaaaaagaaaaagaaaaaaaaaaagauuauucuaaauaaaagg

SEQ ID NO: 34689 - RNA, 64 nt, Homo Sapiens
gaguggggaaauugcuuaaaaaaaaagaaaaagaaaaaaaaaaagauuauucuaaauaaaagga

SEQ ID NO: 34690 - RNA, 64 nt, Homo Sapiens
aguggggaaauugcuuaaaaaaaaagaaaaagaaaaaaaaaaagauuauucuaaauaaaaggaa

SEQ ID NO: 34691 - RNA, 64 nt, Homo Sapiens
guggggaaauugcuuaaaaaaaaagaaaaagaaaaaaaaaaagauuauucuaaauaaaaggaaa

SEQ ID NO: 34692 - RNA, 64 nt, Homo Sapiens
augcugcuaugaagacuacuuuuagaucaacaauaaaaaaaaaccuacaaaaaaaccuuuauuc

SEQ ID NO: 34693 - RNA, 64 nt, Homo Sapiens
ugcugcuaugaagacuacuuuuagaucaacaauaaaaaaaaaccuacaaaaaaaccuuuauucu

SEQ ID NO: 34694 - RNA, 64 nt, Homo Sapiens
auggguuuuauuauauauauauauuuuuuuuuuuaaaaaaaaaacguauugcauuuaauuuauu

SEQ ID NO: 34695 - RNA, 64 nt, Homo Sapiens
uggguuuuauuauauauauauauuuuuuuuuuuaaaaaaaaaacguauugcauuuaauuuauug

SEQ ID NO: 34696 - RNA, 64 nt, Homo Sapiens
ggguuuuauuauauauauauauuuuuuuuuuuaaaaaaaaaacguauugcauuuaauuuauuga

SEQ ID NO: 34697 - RNA, 64 nt, Homo Sapiens
uucuaagaaauucuguuuucuuaguucucugguuaaaaaaaaaaauacauaaacuguauccuuc

SEQ ID NO: 34698 - RNA, 64 nt, Homo Sapiens
ucuaagaaauucuguuuucuuaguucucugguuaaaaaaaaaaauacauaaacuguauccuucu

SEQ ID NO: 34699 - RNA, 64 nt, Homo Sapiens
cuaagaaauucuguuuucuuaguucucugguuaaaaaaaaaaauacauaaacuguauccuucuu

SEQ ID NO: 34700 - RNA, 64 nt, Homo Sapiens
uaagaaauucuguuuucuuaguucucugguuaaaaaaaaaaauacauaaacuguauccuucuuu

SEQ ID NO: 34701 - RNA, 64 nt, Homo Sapiens
cuccagccugggcaacaaagugagacucugucucaaaaaaaaaaaaacaaaaaaaaaccuuuaa

SEQ ID NO: 34702 - RNA, 64 nt, Homo Sapiens
uccagccugggcaacaaagugagacucugucucaaaaaaaaaaaaacaaaaaaaaaccuuuaau

SEQ ID NO: 34703 - RNA, 64 nt, Homo Sapiens
ccagccugggcaacaaagugagacucugucucaaaaaaaaaaaaacaaaaaaaaaccuuuaaug

SEQ ID NO: 34704 - RNA, 64 nt, Homo Sapiens
cagccugggcaacaaagugagacucugucucaaaaaaaaaaaaacaaaaaaaaaccuuuaaugu

SEQ ID NO: 34705 - RNA, 64 nt, Homo Sapiens
agccugggcaacaaagugagacucugucucaaaaaaaaaaaaacaaaaaaaaaccuuuaauguc

SEQ ID NO: 34706 - RNA, 64 nt, Homo Sapiens
gccugggcaacaaagugagacucugucucaaaaaaaaaaaaacaaaaaaaaaccuuuaaugucu

SEQ ID NO: 34707 - RNA, 64 nt, Homo Sapiens
acaaagugagacucugucucaaaaaaaaaaaaacaaaaaaaaaccuuuaaugucuggcuuugua

SEQ ID NO: 34708 - RNA, 64 nt, Homo Sapiens
caaagugagacucugucucaaaaaaaaaaaaacaaaaaaaaaccuuuaaugucuggcuuuguac

SEQ ID NO: 34709 - RNA, 64 nt, Homo Sapiens
agccuggucaacagagcaagacuccaucucgaagaaaaaaaaaaaaaauuccccaccccuacca

SEQ ID NO: 34710 - RNA, 64 nt, Homo Sapiens
gccuggucaacagagcaagacuccaucucgaagaaaaaaaaaaaaaauuccccaccccuaccaa

SEQ ID NO: 34711 - RNA, 64 nt, Homo Sapiens
ccuggucaacagagcaagacuccaucucgaagaaaaaaaaaaaaaauuccccaccccuaccaau

SEQ ID NO: 34712 - RNA, 64 nt, Homo Sapiens
cuggucaacagagcaagacuccaucucgaagaaaaaaaaaaaaaauuccccaccccuaccaauu

SEQ ID NO: 34713 - RNA, 64 nt, Homo Sapiens
uggucaacagagcaagacuccaucucgaagaaaaaaaaaaaaaauuccccaccccuaccaauug

SEQ ID NO: 34714 - RNA, 64 nt, Homo Sapiens
ggucaacagagcaagacuccaucucgaagaaaaaaaaaaaaaauuccccaccccuaccaauugu

SEQ ID NO: 34715 - RNA, 64 nt, Homo Sapiens
gucaacagagcaagacuccaucucgaagaaaaaaaaaaaaaauuccccaccccuaccaauuguu

SEQ ID NO: 34716 - RNA, 64 nt, Homo Sapiens
cuccagccugggcgacagagugagacuccgucucaaaaaaaaaaagaagguuguacccacagua

SEQ ID NO: 34717 - RNA, 64 nt, Homo Sapiens
uccagccugggcgacagagugagacuccgucucaaaaaaaaaaagaagguuguacccacaguau

SEQ ID NO: 34718 - RNA, 64 nt, Homo Sapiens
ccagccugggcgacagagugagacuccgucucaaaaaaaaaaagaagguuguacccacaguaua

SEQ ID NO: 34719 - RNA, 64 nt, Homo Sapiens
cagccugggcgacagagugagacuccgucucaaaaaaaaaaagaagguuguacccacaguauac

SEQ ID NO: 34720 - RNA, 64 nt, Homo Sapiens
cuccagccugggcaacacagggagacuccaucucaaaaaaaaaaaaaaaaaaaaaaagacauuc

SEQ ID NO: 34721 - RNA, 64 nt, Homo Sapiens
uccagccugggcaacacagggagacuccaucucaaaaaaaaaaaaaaaaaaaaaaagacauuca

SEQ ID NO: 34722 - RNA, 64 nt, Homo Sapiens
ccagccugggcaacacagggagacuccaucucaaaaaaaaaaaaaaaaaaaaaaagacauucaa

SEQ ID NO: 34723 - RNA, 64 nt, Homo Sapiens
cagccugggcaacacagggagacuccaucucaaaaaaaaaaaaaaaaaaaaaaagacauucaac

SEQ ID NO: 34724 - RNA, 64 nt, Homo Sapiens
agccugggcaacacagggagacuccaucucaaaaaaaaaaaaaaaaaaaaaaagacauucaacu

SEQ ID NO: 34725 - RNA, 64 nt, Homo Sapiens
gccugggcaacacagggagacuccaucucaaaaaaaaaaaaaaaaaaaaaaagacauucaacuu

SEQ ID NO: 34726 - RNA, 64 nt, Homo Sapiens
ccugggcaacacagggagacuccaucucaaaaaaaaaaaaaaaaaaaaaaagacauucaacuug

SEQ ID NO: 34727 - RNA, 64 nt, Homo Sapiens
cugggcaacacagggagacuccaucucaaaaaaaaaaaaaaaaaaaaaaagacauucaacuuga

SEQ ID NO: 34728 - RNA, 64 nt, Homo Sapiens
ugggcaacacagggagacuccaucucaaaaaaaaaaaaaaaaaaaaaaagacauucaacuugag

SEQ ID NO: 34729 - RNA, 64 nt, Homo Sapiens
gggcaacacagggagacuccaucucaaaaaaaaaaaaaaaaaaaaaaagacauucaacuugagg

SEQ ID NO: 34730 - RNA, 64 nt, Homo Sapiens
ggcaacacagggagacuccaucucaaaaaaaaaaaaaaaaaaaaaaagacauucaacuugaggc

SEQ ID NO: 34731 - RNA, 64 nt, Homo Sapiens
gcaacacagggagacuccaucucaaaaaaaaaaaaaaaaaaaaaaagacauucaacuugaggcu

SEQ ID NO: 34732 - RNA, 64 nt, Homo Sapiens
caacacagggagacuccaucucaaaaaaaaaaaaaaaaaaaaaaagacauucaacuugaggcuc

SEQ ID NO: 34733 - RNA, 64 nt, Homo Sapiens
aacacagggagacuccaucucaaaaaaaaaaaaaaaaaaaaaaagacauucaacuugaggcucc

SEQ ID NO: 34734 - RNA, 64 nt, Homo Sapiens
acacagggagacuccaucucaaaaaaaaaaaaaaaaaaaaaaagacauucaacuugaggcuccu

SEQ ID NO: 34735 - RNA, 64 nt, Homo Sapiens
cacagggagacuccaucucaaaaaaaaaaaaaaaaaaaaaaagacauucaacuugaggcuccug

SEQ ID NO: 34736 - RNA, 64 nt, Homo Sapiens
cuccagccugggcgauagagcuagacucugucucaaaaaaaaaacaaaaaacaaguaacucuuu

SEQ ID NO: 34737 - RNA, 64 nt, Homo Sapiens
uccagccugggcgauagagcuagacucugucucaaaaaaaaaacaaaaaacaaguaacucuuua

SEQ ID NO: 34738 - RNA, 64 nt, Homo Sapiens
ccagccugggcgauagagcuagacucugucucaaaaaaaaaacaaaaaacaaguaacucuuuau

SEQ ID NO: 34739 - RNA, 64 nt, Homo Sapiens
cuccagccugggugacagagcgagacuccgucucaaaaaaaaaaaaaaauucggccaggugcgg

SEQ ID NO: 34740 - RNA, 64 nt, Homo Sapiens
uccagccugggugacagagcgagacuccgucucaaaaaaaaaaaaaaauucggccaggugcggu

SEQ ID NO: 34741 - RNA, 64 nt, Homo Sapiens
ccagccugggugacagagcgagacuccgucucaaaaaaaaaaaaaaauucggccaggugcggug

SEQ ID NO: 34742 - RNA, 63 nt, Homo Sapiens
cagccugggugacagagcgagacuccgucucaaaaaaaaaaaaaaauucggccaggugcggug

SEQ ID NO: 34743 - RNA, 62 nt, Homo Sapiens
agccugggugacagagcgagacuccgucucaaaaaaaaaaaaaaauucggccaggugcggug

SEQ ID NO: 34744 - RNA, 64 nt, Homo Sapiens
auuguccaauucuacgugcucucuauaccaaaacaaaaaaaaaaagcuauccaccuuuccaugu

SEQ ID NO: 34745 - RNA, 64 nt, Homo Sapiens
uuguccaauucuacgugcucucuauaccaaaacaaaaaaaaaaagcuauccaccuuuccaugug

SEQ ID NO: 34746 - RNA, 64 nt, Homo Sapiens
uguccaauucuacgugcucucuauaccaaaacaaaaaaaaaaagcuauccaccuuuccaugugg

SEQ ID NO: 34747 - RNA, 64 nt, Homo Sapiens
guccaauucuacgugcucucuauaccaaaacaaaaaaaaaaagcuauccaccuuuccauguggg

SEQ ID NO: 34748 - RNA, 64 nt, Homo Sapiens
auaauuguggagaggagagaaugagagaguguggaaaaaaaaagaauaaugacccggcccccgc

SEQ ID NO: 34749 - RNA, 64 nt, Homo Sapiens
uaauuguggagaggagagaaugagagaguguggaaaaaaaaagaauaaugacccggcccccgcc

SEQ ID NO: 34750 - RNA, 64 nt, Homo Sapiens
ccaaauugaugggugggcuaguaauaaaauauuuaaaaaaaaacauucaaaaacauggccacau

SEQ ID NO: 34751 - RNA, 64 nt, Homo Sapiens
caaauugaugggugggcuaguaauaaaauauuuaaaaaaaaacauucaaaaacauggccacauc

SEQ ID NO: 34752 - RNA, 64 nt, Homo Sapiens
uugccuucccuucugugugaccgaccccuuggccaaaaaaaaacaaaaagcaaaaaacaaaaac

SEQ ID NO: 34753 - RNA, 64 nt, Homo Sapiens
ugccuucccuucugugugaccgaccccuuggccaaaaaaaaacaaaaagcaaaaaacaaaaacc

SEQ ID NO: 34754 - RNA, 64 nt, Homo Sapiens
uuggaaaagagaaaaacaauggaguuacuuauuuaaaaaaaaagaaagaaaguuaucucuuccc

SEQ ID NO: 34755 - RNA, 64 nt, Homo Sapiens
uggaaaagagaaaaacaauggaguuacuuauuuaaaaaaaaagaaagaaaguuaucucuuccca

SEQ ID NO: 34756 - RNA, 64 nt, Homo Sapiens
gaaguuuuguuuacugaugcagcacaagagauguaaaaaaaaaaaaaaaaaaaaaaaaaaaaac

SEQ ID NO: 34757 - RNA, 64 nt, Homo Sapiens
aaguuuuguuuacugaugcagcacaagagauguaaaaaaaaaaaaaaaaaaaaaaaaaaaaaca

SEQ ID NO: 34758 - RNA, 64 nt, Homo Sapiens
aguuuuguuuacugaugcagcacaagagauguaaaaaaaaaaaaaaaaaaaaaaaaaaaaacac

SEQ ID NO: 34759 - RNA, 64 nt, Homo Sapiens
guuuuguuuacugaugcagcacaagagauguaaaaaaaaaaaaaaaaaaaaaaaaaaaaacaca

SEQ ID NO: 34760 - RNA, 64 nt, Homo Sapiens
uuuuguuuacugaugcagcacaagagauguaaaaaaaaaaaaaaaaaaaaaaaaaaaaacacac

SEQ ID NO: 34761 - RNA, 64 nt, Homo Sapiens
uuuguuuacugaugcagcacaagagauguaaaaaaaaaaaaaaaaaaaaaaaaaaaaacacaca

SEQ ID NO: 34762 - RNA, 64 nt, Homo Sapiens
uuguuuacugaugcagcacaagagauguaaaaaaaaaaaaaaaaaaaaaaaaaaaaacacacac

SEQ ID NO: 34763 - RNA, 64 nt, Homo Sapiens
uguuuacugaugcagcacaagagauguaaaaaaaaaaaaaaaaaaaaaaaaaaaaacacacaca

SEQ ID NO: 34764 - RNA, 64 nt, Homo Sapiens
guuuacugaugcagcacaagagauguaaaaaaaaaaaaaaaaaaaaaaaaaaaaacacacacac

SEQ ID NO: 34765 - RNA, 64 nt, Homo Sapiens
uuuacugaugcagcacaagagauguaaaaaaaaaaaaaaaaaaaaaaaaaaaaacacacacaca

SEQ ID NO: 34766 - RNA, 64 nt, Homo Sapiens
uuacugaugcagcacaagagauguaaaaaaaaaaaaaaaaaaaaaaaaaaaaacacacacacag

SEQ ID NO: 34767 - RNA, 64 nt, Homo Sapiens
uacugaugcagcacaagagauguaaaaaaaaaaaaaaaaaaaaaaaaaaaaacacacacacaga

SEQ ID NO: 34768 - RNA, 64 nt, Homo Sapiens
acugaugcagcacaagagauguaaaaaaaaaaaaaaaaaaaaaaaaaaaaacacacacacagag

SEQ ID NO: 34769 - RNA, 64 nt, Homo Sapiens
cugaugcagcacaagagauguaaaaaaaaaaaaaaaaaaaaaaaaaaaaacacacacacagagg

SEQ ID NO: 34770 - RNA, 64 nt, Homo Sapiens
ugaugcagcacaagagauguaaaaaaaaaaaaaaaaaaaaaaaaaaaaacacacacacagagga

SEQ ID NO: 34771 - RNA, 64 nt, Homo Sapiens
gaugcagcacaagagauguaaaaaaaaaaaaaaaaaaaaaaaaaaaaacacacacacagaggaa

SEQ ID NO: 34772 - RNA, 64 nt, Homo Sapiens
augcagcacaagagauguaaaaaaaaaaaaaaaaaaaaaaaaaaaaacacacacacagaggaaa

SEQ ID NO: 34773 - RNA, 64 nt, Homo Sapiens
ugcagcacaagagauguaaaaaaaaaaaaaaaaaaaaaaaaaaaaacacacacacagaggaaag

SEQ ID NO: 34774 - RNA, 64 nt, Homo Sapiens
gcagcacaagagauguaaaaaaaaaaaaaaaaaaaaaaaaaaaaacacacacacagaggaaaga

SEQ ID NO: 34775 - RNA, 64 nt, Homo Sapiens
cagcacaagagauguaaaaaaaaaaaaaaaaaaaaaaaaaaaaacacacacacagaggaaagac

SEQ ID NO: 34776 - RNA, 64 nt, Homo Sapiens
agcacaagagauguaaaaaaaaaaaaaaaaaaaaaaaaaaaaacacacacacagaggaaagacg

SEQ ID NO: 34777 - RNA, 64 nt, Homo Sapiens
gcacaagagauguaaaaaaaaaaaaaaaaaaaaaaaaaaaaacacacacacagaggaaagacgc

SEQ ID NO: 34778 - RNA, 64 nt, Homo Sapiens
agaaggaaggaaggaaggaacccccccccccccgaaaaaaaaaucaaagcgggaagaaaaucag

SEQ ID NO: 34779 - RNA, 64 nt, Homo Sapiens
gaaggaaggaaggaaggaacccccccccccccgaaaaaaaaaucaaagcgggaagaaaaucaga

SEQ ID NO: 34780 - RNA, 64 nt, Homo Sapiens
gcuuugauaucugguucagacuaucaucaggaagaaaaaaaaaucccacaguaccugaaaugug

SEQ ID NO: 34781 - RNA, 64 nt, Homo Sapiens
cuuugauaucugguucagacuaucaucaggaagaaaaaaaaaucccacaguaccugaaauguga

SEQ ID NO: 34782 - RNA, 64 nt, Homo Sapiens
uugggagauuuggaugauuugagaagagugacuuaaaaaaaaugcuucugugcucuaagauaua

SEQ ID NO: 34783 - RNA, 64 nt, Homo Sapiens
uaaucauuuccuggguuccacuuacucuugauuuaaaaaaaaaaaaacaacaaaagaguuugug

SEQ ID NO: 34784 - RNA, 64 nt, Homo Sapiens
aaucauuuccuggguuccacuuacucuugauuuaaaaaaaaaaaaacaacaaaagaguuugugu

SEQ ID NO: 34785 - RNA, 64 nt, Homo Sapiens
aucauuuccuggguuccacuuacucuugauuuaaaaaaaaaaaaacaacaaaagaguuugugug

SEQ ID NO: 34786 - RNA, 64 nt, Homo Sapiens
ucauuuccuggguuccacuuacucuugauuuaaaaaaaaaaaaacaacaaaagaguuugugugu

SEQ ID NO: 34787 - RNA, 64 nt, Homo Sapiens
cauuuccuggguuccacuuacucuugauuuaaaaaaaaaaaaacaacaaaagaguuugugugug

SEQ ID NO: 34788 - RNA, 64 nt, Homo Sapiens
auuuccuggguuccacuuacucuugauuuaaaaaaaaaaaaacaacaaaagaguuugugugugg

SEQ ID NO: 34789 - RNA, 64 nt, Homo Sapiens
aauuuuugaauuuuaaaacuaaucuauuuuauuuaaaaaaaaucaaguacuuuggaagugaaua

SEQ ID NO: 34790 - RNA, 64 nt, Homo Sapiens
aagccagcuggcuuaugcugguucucagcuguuuaaaaaaaaaaaaaaaaaggaauagaaacag

SEQ ID NO: 34791 - RNA, 64 nt, Homo Sapiens
agccagcuggcuuaugcugguucucagcuguuuaaaaaaaaaaaaaaaaaggaauagaaacagu

SEQ ID NO: 34792 - RNA, 64 nt, Homo Sapiens
gccagcuggcuuaugcugguucucagcuguuuaaaaaaaaaaaaaaaaaggaauagaaacaguu

SEQ ID NO: 34793 - RNA, 64 nt, Homo Sapiens
ccagcuggcuuaugcugguucucagcuguuuaaaaaaaaaaaaaaaaaggaauagaaacaguuu

SEQ ID NO: 34794 - RNA, 64 nt, Homo Sapiens
cagcuggcuuaugcugguucucagcuguuuaaaaaaaaaaaaaaaaaggaauagaaacaguuuc

SEQ ID NO: 34795 - RNA, 64 nt, Homo Sapiens
agcuggcuuaugcugguucucagcuguuuaaaaaaaaaaaaaaaaaggaauagaaacaguuuca

SEQ ID NO: 34796 - RNA, 64 nt, Homo Sapiens
gcuggcuuaugcugguucucagcuguuuaaaaaaaaaaaaaaaaaggaauagaaacaguuucaa

SEQ ID NO: 34797 - RNA, 64 nt, Homo Sapiens
cuggcuuaugcugguucucagcuguuuaaaaaaaaaaaaaaaaaggaauagaaacaguuucaac

SEQ ID NO: 34798 - RNA, 64 nt, Homo Sapiens
uggcuuaugcugguucucagcuguuuaaaaaaaaaaaaaaaaaggaauagaaacaguuucaacc

SEQ ID NO: 34799 - RNA, 64 nt, Homo Sapiens
ggcuuaugcugguucucagcuguuuaaaaaaaaaaaaaaaaaggaauagaaacaguuucaacca

SEQ ID NO: 34800 - RNA, 64 nt, Homo Sapiens
ugaucugggaacuuuuugcuguacaaaucuguuuaaaaaaaaaaaaaaguaacucauugaauua

SEQ ID NO: 34801 - RNA, 64 nt, Homo Sapiens
gaucugggaacuuuuugcuguacaaaucuguuuaaaaaaaaaaaaaaguaacucauugaauuaa

SEQ ID NO: 34802 - RNA, 64 nt, Homo Sapiens
aucugggaacuuuuugcuguacaaaucuguuuaaaaaaaaaaaaaaguaacucauugaauuaac

SEQ ID NO: 34803 - RNA, 64 nt, Homo Sapiens
ucugggaacuuuuugcuguacaaaucuguuuaaaaaaaaaaaaaaguaacucauugaauuaacu

SEQ ID NO: 34804 - RNA, 64 nt, Homo Sapiens
cugggaacuuuuugcuguacaaaucuguuuaaaaaaaaaaaaaaguaacucauugaauuaacuu

SEQ ID NO: 34805 - RNA, 64 nt, Homo Sapiens
ugggaacuuuuugcuguacaaaucuguuuaaaaaaaaaaaaaaguaacucauugaauuaacuug

SEQ ID NO: 34806 - RNA, 64 nt, Homo Sapiens
gggaacuuuuugcuguacaaaucuguuuaaaaaaaaaaaaaaguaacucauugaauuaacuugc

SEQ ID NO: 34807 - RNA, 64 nt, Homo Sapiens
ucuuggacucauguccucauugcuucacucaauuaaaaaaaaauuauucuccaguccccuccca

SEQ ID NO: 34808 - RNA, 64 nt, Homo Sapiens
cuuggacucauguccucauugcuucacucaauuaaaaaaaaauuauucuccaguccccucccac

SEQ ID NO: 34809 - RNA, 64 nt, Homo Sapiens
gguacacauuauaguccaaagugcuuagcgaaguaaaaaaaaaagcuuuuuaaaauuucuauug

SEQ ID NO: 34810 - RNA, 64 nt, Homo Sapiens
guacacauuauaguccaaagugcuuagcgaaguaaaaaaaaaagcuuuuuaaaauuucuauugu

SEQ ID NO: 34811 - RNA, 64 nt, Homo Sapiens
uacacauuauaguccaaagugcuuagcgaaguaaaaaaaaaagcuuuuuaaaauuucuauuguu

SEQ ID NO: 34812 - RNA, 64 nt, Homo Sapiens
uugaaauaauugacuugucuaaaaggacaaagagaaaaaaaaaauaccucaugacugcauucuc

SEQ ID NO: 34813 - RNA, 64 nt, Homo Sapiens
ugaaauaauugacuugucuaaaaggacaaagagaaaaaaaaaauaccucaugacugcauucucu

SEQ ID NO: 34814 - RNA, 64 nt, Homo Sapiens
gaaauaauugacuugucuaaaaggacaaagagaaaaaaaaaauaccucaugacugcauucucuc

SEQ ID NO: 34815 - RNA, 64 nt, Homo Sapiens
gaaaggauacuggagagagaaauuacccauuucuaaaaaaaaaccacacucugucguaucugug

SEQ ID NO: 34816 - RNA, 64 nt, Homo Sapiens
aaaggauacuggagagagaaauuacccauuucuaaaaaaaaaccacacucugucguaucugugu

SEQ ID NO: 34817 - RNA, 64 nt, Homo Sapiens
uaaacguggauuuuaaaaaaucaaucaauggugcaaaaaaaaacuuaaagcaaaauaguauugc

SEQ ID NO: 34818 - RNA, 64 nt, Homo Sapiens
aaacguggauuuuaaaaaaucaaucaauggugcaaaaaaaaacuuaaagcaaaauaguauugcu

SEQ ID NO: 34819 - RNA, 64 nt, Homo Sapiens
guaacccagcugcaauaccugucuguaauaugagaaaaaaaaaaugaaucuauuuaaucauuuc

SEQ ID NO: 34820 - RNA, 64 nt, Homo Sapiens
uaacccagcugcaauaccugucuguaauaugagaaaaaaaaaaugaaucuauuuaaucauuucu

SEQ ID NO: 34821 - RNA, 64 nt, Homo Sapiens
aacccagcugcaauaccugucuguaauaugagaaaaaaaaaaugaaucuauuuaaucauuucua

SEQ ID NO: 34822 - RNA, 64 nt, Homo Sapiens
auuucaucauugucccgggccugcauugcacuggaaaaaaaaaucgccaccuguucuuacacca

SEQ ID NO: 34823 - RNA, 64 nt, Homo Sapiens
uuucaucauugucccgggccugcauugcacuggaaaaaaaaaucgccaccuguucuuacaccag

SEQ ID NO: 34824 - RNA, 64 nt, Homo Sapiens
ucgauaaaaguucaucuuuggacagaaagccuuuaaaaaaaaaaucacucccucuucccccucc

SEQ ID NO: 34825 - RNA, 64 nt, Homo Sapiens
cgauaaaaguucaucuuuggacagaaagccuuuaaaaaaaaaaucacucccucuucccccuccu

SEQ ID NO: 34826 - RNA, 64 nt, Homo Sapiens
gauaaaaguucaucuuuggacagaaagccuuuaaaaaaaaaaucacucccucuucccccuccuc

SEQ ID NO: 34827 - RNA, 64 nt, Homo Sapiens
agggaguggcacuucugccuugaguccccaggggaaaaaaaaaaaagauauuuaugaaauaaau

SEQ ID NO: 34828 - RNA, 64 nt, Homo Sapiens
gggaguggcacuucugccuugaguccccaggggaaaaaaaaaaaagauauuuaugaaauaaaug

SEQ ID NO: 34829 - RNA, 64 nt, Homo Sapiens
ggaguggcacuucugccuugaguccccaggggaaaaaaaaaaaagauauuuaugaaauaaaugg

SEQ ID NO: 34830 - RNA, 64 nt, Homo Sapiens
gaguggcacuucugccuugaguccccaggggaaaaaaaaaaaagauauuuaugaaauaaauggu

SEQ ID NO: 34831 - RNA, 64 nt, Homo Sapiens
aguggcacuucugccuugaguccccaggggaaaaaaaaaaaagauauuuaugaaauaaauggua

SEQ ID NO: 34832 - RNA, 64 nt, Homo Sapiens
acgaugcaagcccauuguguuuccgggcuuuuuuaaaaaaaaaauuguagcacugggcguggug

SEQ ID NO: 34833 - RNA, 64 nt, Homo Sapiens
cgaugcaagcccauuguguuuccgggcuuuuuuaaaaaaaaaauuguagcacugggcguggugc

SEQ ID NO: 34834 - RNA, 64 nt, Homo Sapiens
gaugcaagcccauuguguuuccgggcuuuuuuaaaaaaaaaauuguagcacugggcguggugca

SEQ ID NO: 34835 - RNA, 64 nt, Homo Sapiens
agcugggaagaaucagaucagauauuuuccugacaaaaaaaaaugacccuacagagagcaucaa

SEQ ID NO: 34836 - RNA, 64 nt, Homo Sapiens
gcugggaagaaucagaucagauauuuuccugacaaaaaaaaaugacccuacagagagcaucaaa

SEQ ID NO: 34837 - RNA, 64 nt, Homo Sapiens
acaaagcaagacucugucucaaaaaaauaaaaauaaaaaaaaaaucuuaguuccauggaauuuu

SEQ ID NO: 34838 - RNA, 64 nt, Homo Sapiens
caaagcaagacucugucucaaaaaaauaaaaauaaaaaaaaaaucuuaguuccauggaauuuua

SEQ ID NO: 34839 - RNA, 64 nt, Homo Sapiens
aaagcaagacucugucucaaaaaaauaaaaauaaaaaaaaaaucuuaguuccauggaauuuuaa

SEQ ID NO: 34840 - RNA, 64 nt, Homo Sapiens
agcugggagacacagcaagacuccgucucaaaagaaaaaaaaaaaaaagaacaacugccaaggc

SEQ ID NO: 34841 - RNA, 64 nt, Homo Sapiens
gcugggagacacagcaagacuccgucucaaaagaaaaaaaaaaaaaagaacaacugccaaggcc

SEQ ID NO: 34842 - RNA, 64 nt, Homo Sapiens
cugggagacacagcaagacuccgucucaaaagaaaaaaaaaaaaaagaacaacugccaaggccu

SEQ ID NO: 34843 - RNA, 64 nt, Homo Sapiens
ugggagacacagcaagacuccgucucaaaagaaaaaaaaaaaaaagaacaacugccaaggccug

SEQ ID NO: 34844 - RNA, 64 nt, Homo Sapiens
gggagacacagcaagacuccgucucaaaagaaaaaaaaaaaaaagaacaacugccaaggccugu

SEQ ID NO: 34845 - RNA, 64 nt, Homo Sapiens
ggagacacagcaagacuccgucucaaaagaaaaaaaaaaaaaagaacaacugccaaggccuguc

SEQ ID NO: 34846 - RNA, 64 nt, Homo Sapiens
gagacacagcaagacuccgucucaaaagaaaaaaaaaaaaaagaacaacugccaaggccugucu

SEQ ID NO: 34847 - RNA, 64 nt, Homo Sapiens
cggugaaaccccaccucuacuaaaauuaaaaaagaaaaaaaauagccgggcgugguggcaggcg

SEQ ID NO: 34848 - RNA, 64 nt, Homo Sapiens
cuccagccugggugacagagugagacuccaacucaaaaaaaaaaaaaaaaaagaucuuggggag

SEQ ID NO: 34849 - RNA, 64 nt, Homo Sapiens
uccagccugggugacagagugagacuccaacucaaaaaaaaaaaaaaaaaagaucuuggggagg

SEQ ID NO: 34850 - RNA, 64 nt, Homo Sapiens
ccagccugggugacagagugagacuccaacucaaaaaaaaaaaaaaaaaagaucuuggggaggc

SEQ ID NO: 34851 - RNA, 64 nt, Homo Sapiens
cagccugggugacagagugagacuccaacucaaaaaaaaaaaaaaaaaagaucuuggggaggca

SEQ ID NO: 34852 - RNA, 64 nt, Homo Sapiens
agccugggugacagagugagacuccaacucaaaaaaaaaaaaaaaaaagaucuuggggaggcag

SEQ ID NO: 34853 - RNA, 64 nt, Homo Sapiens
gccugggugacagagugagacuccaacucaaaaaaaaaaaaaaaaaagaucuuggggaggcaga

SEQ ID NO: 34854 - RNA, 64 nt, Homo Sapiens
ccugggugacagagugagacuccaacucaaaaaaaaaaaaaaaaaagaucuuggggaggcagac

SEQ ID NO: 34855 - RNA, 64 nt, Homo Sapiens
cugggugacagagugagacuccaacucaaaaaaaaaaaaaaaaaagaucuuggggaggcagaca

SEQ ID NO: 34856 - RNA, 64 nt, Homo Sapiens
ugggugacagagugagacuccaacucaaaaaaaaaaaaaaaaaagaucuuggggaggcagacag

SEQ ID NO: 34857 - RNA, 64 nt, Homo Sapiens
gggugacagagugagacuccaacucaaaaaaaaaaaaaaaaaagaucuuggggaggcagacagc

SEQ ID NO: 34858 - RNA, 63 nt, Homo Sapiens
ggugacagagugagacuccaacucaaaaaaaaaaaaaaaaaagaucuuggggaggcagacagc

SEQ ID NO: 34859 - RNA, 64 nt, Homo Sapiens
aaaagcauuauacuguggguaaugaaaagggaggaaaaaaaaagaaggaaaaggaauuauagac

SEQ ID NO: 34860 - RNA, 64 nt, Homo Sapiens
aaagcauuauacuguggguaaugaaaagggaggaaaaaaaaagaaggaaaaggaauuauagacc

SEQ ID NO: 34861 - RNA, 64 nt, Homo Sapiens
aauuugucagcuggaacucagaaacaacaacuugaaaaaaaaauaauaauuagaacauauuugc

SEQ ID NO: 34862 - RNA, 64 nt, Homo Sapiens
auuugucagcuggaacucagaaacaacaacuugaaaaaaaaauaauaauuagaacauauuugca

SEQ ID NO: 34863 - RNA, 64 nt, Homo Sapiens
uaacauggugaaaccccaucucuacuaaaaauacaaaaaaaaauuagccgggggugguggcggg

SEQ ID NO: 34864 - RNA, 64 nt, Homo Sapiens
aacauggugaaaccccaucucuacuaaaaauacaaaaaaaaauuagccgggggugguggcgggu

SEQ ID NO: 34865 - RNA, 64 nt, Homo Sapiens
cugggcgacagagcaagacuccgucucaaaaaauaaaaaaaaaaaaaaaauaggugaaaauucc

SEQ ID NO: 34866 - RNA, 64 nt, Homo Sapiens
ugggcgacagagcaagacuccgucucaaaaaauaaaaaaaaaaaaaaaauaggugaaaauuccu

SEQ ID NO: 34867 - RNA, 64 nt, Homo Sapiens
gggcgacagagcaagacuccgucucaaaaaauaaaaaaaaaaaaaaaauaggugaaaauuccuu

SEQ ID NO: 34868 - RNA, 64 nt, Homo Sapiens
ggcgacagagcaagacuccgucucaaaaaauaaaaaaaaaaaaaaaauaggugaaaauuccuua

SEQ ID NO: 34869 - RNA, 64 nt, Homo Sapiens
gcgacagagcaagacuccgucucaaaaaauaaaaaaaaaaaaaaaauaggugaaaauuccuuau

SEQ ID NO: 34870 - RNA, 64 nt, Homo Sapiens
cgacagagcaagacuccgucucaaaaaauaaaaaaaaaaaaaaaauaggugaaaauuccuuaua

SEQ ID NO: 34871 - RNA, 64 nt, Homo Sapiens
gacagagcaagacuccgucucaaaaaauaaaaaaaaaaaaaaaauaggugaaaauuccuuauaa

SEQ ID NO: 34872 - RNA, 64 nt, Homo Sapiens
acagagcaagacuccgucucaaaaaauaaaaaaaaaaaaaaaauaggugaaaauuccuuauaaa

SEQ ID NO: 34873 - RNA, 64 nt, Homo Sapiens
cagagcaagacuccgucucaaaaaauaaaaaaaaaaaaaaaauaggugaaaauuccuuauaaau

SEQ ID NO: 34874 - RNA, 64 nt, Homo Sapiens
aacacccaguuuccuugggaguugucauuaaaggaaaaaaaaaaaaaaaaaagccagugcccag

SEQ ID NO: 34875 - RNA, 64 nt, Homo Sapiens
acacccaguuuccuugggaguugucauuaaaggaaaaaaaaaaaaaaaaaagccagugcccagg

SEQ ID NO: 34876 - RNA, 64 nt, Homo Sapiens
cacccaguuuccuugggaguugucauuaaaggaaaaaaaaaaaaaaaaaagccagugcccaggg

SEQ ID NO: 34877 - RNA, 64 nt, Homo Sapiens
acccaguuuccuugggaguugucauuaaaggaaaaaaaaaaaaaaaaaagccagugcccaggga

SEQ ID NO: 34878 - RNA, 64 nt, Homo Sapiens
cccaguuuccuugggaguugucauuaaaggaaaaaaaaaaaaaaaaaagccagugcccagggau

SEQ ID NO: 34879 - RNA, 64 nt, Homo Sapiens
ccaguuuccuugggaguugucauuaaaggaaaaaaaaaaaaaaaaaagccagugcccagggaug

SEQ ID NO: 34880 - RNA, 64 nt, Homo Sapiens
caguuuccuugggaguugucauuaaaggaaaaaaaaaaaaaaaaaagccagugcccagggaugg

SEQ ID NO: 34881 - RNA, 64 nt, Homo Sapiens
aguuuccuugggaguugucauuaaaggaaaaaaaaaaaaaaaaaagccagugcccagggauggg

SEQ ID NO: 34882 - RNA, 64 nt, Homo Sapiens
guuuccuugggaguugucauuaaaggaaaaaaaaaaaaaaaaaagccagugcccagggaugggc

SEQ ID NO: 34883 - RNA, 64 nt, Homo Sapiens
uuuccuugggaguugucauuaaaggaaaaaaaaaaaaaaaaaagccagugcccagggaugggca

SEQ ID NO: 34884 - RNA, 64 nt, Homo Sapiens
uuccuugggaguugucauuaaaggaaaaaaaaaaaaaaaaaagccagugcccagggaugggcau

SEQ ID NO: 34885 - RNA, 64 nt, Homo Sapiens
uauuguggcagaagcgagaaaacuuuguuuauugaaaaaaaaagaaaaagaaagcaagaaaaaa

SEQ ID NO: 34886 - RNA, 64 nt, Homo Sapiens
auuguggcagaagcgagaaaacuuuguuuauugaaaaaaaaagaaaaagaaagcaagaaaaaaa

SEQ ID NO: 34887 - RNA, 64 nt, Homo Sapiens
gaaaagauuccauuuuauacaagaagggagauucaaaaaaaaaauauaagguuggguuagcaau

SEQ ID NO: 34888 - RNA, 64 nt, Homo Sapiens
aaaagauuccauuuuauacaagaagggagauucaaaaaaaaaauauaagguuggguuagcaaua

SEQ ID NO: 34889 - RNA, 64 nt, Homo Sapiens
aaagauuccauuuuauacaagaagggagauucaaaaaaaaaauauaagguuggguuagcaauau

SEQ ID NO: 34890 - RNA, 64 nt, Homo Sapiens
aggaaggacagaggguuuugauuuuaaaaagaagaaaaaaaaaccuuauuuuuucuuucuuggc

SEQ ID NO: 34891 - RNA, 64 nt, Homo Sapiens
ggaaggacagaggguuuugauuuuaaaaagaagaaaaaaaaaccuuauuuuuucuuucuuggcc

SEQ ID NO: 34892 - RNA, 64 nt, Homo Sapiens
uuuuucacucugugucuaauaauguuaaggugggaaaaaaaaaaguguggcauagcuaccugcc

SEQ ID NO: 34893 - RNA, 64 nt, Homo Sapiens
uuuucacucugugucuaauaauguuaaggugggaaaaaaaaaaguguggcauagcuaccugccc

SEQ ID NO: 34894 - RNA, 64 nt, Homo Sapiens
uuucacucugugucuaauaauguuaaggugggaaaaaaaaaaguguggcauagcuaccugccca

SEQ ID NO: 34895 - RNA, 64 nt, Homo Sapiens
auuuuuguacagauuugcuuucucuuacaaaaagaaaaaaaaaauccuguuguauuaacauuua

SEQ ID NO: 34896 - RNA, 64 nt, Homo Sapiens
uuuuuguacagauuugcuuucucuuacaaaaagaaaaaaaaaauccuguuguauuaacauuuaa

SEQ ID NO: 34897 - RNA, 64 nt, Homo Sapiens
uuuuguacagauuugcuuucucuuacaaaaagaaaaaaaaaauccuguuguauuaacauuuaaa

SEQ ID NO: 34898 - RNA, 64 nt, Homo Sapiens
ccucaggcuuugcgauuuaaggaggagcugccuuaaaaaaaaauaaaggccuuauuuugcaauu

SEQ ID NO: 34899 - RNA, 64 nt, Homo Sapiens
cucaggcuuugcgauuuaaggaggagcugccuuaaaaaaaaauaaaggccuuauuuugcaauua

SEQ ID NO: 34900 - RNA, 64 nt, Homo Sapiens
uauuuauuuuguaaggagagguuuuaauuaaaacaaaaaaaaauucuuuuuuuuuuuuuuuucc

SEQ ID NO: 34901 - RNA, 64 nt, Homo Sapiens
auuuauuuuguaaggagagguuuuaauuaaaacaaaaaaaaauucuuuuuuuuuuuuuuuucca

SEQ ID NO: 34902 - RNA, 64 nt, Homo Sapiens
gucacaggcauccauccagucguaucuuucagagaaaaaaaaaguuagauguagccaaggaaag

SEQ ID NO: 34903 - RNA, 64 nt, Homo Sapiens
ucacaggcauccauccagucguaucuuucagagaaaaaaaaaguuagauguagccaaggaaagu

SEQ ID NO: 34904 - RNA, 64 nt, Homo Sapiens
uguuuguacagaaauauacuggccuagcagaggcaaaaaaaaaaaaaaugaauuuuauuuuacu

SEQ ID NO: 34905 - RNA, 64 nt, Homo Sapiens
guuuguacagaaauauacuggccuagcagaggcaaaaaaaaaaaaaaugaauuuuauuuuacuu

SEQ ID NO: 34906 - RNA, 64 nt, Homo Sapiens
uuuguacagaaauauacuggccuagcagaggcaaaaaaaaaaaaaaugaauuuuauuuuacuug

SEQ ID NO: 34907 - RNA, 64 nt, Homo Sapiens
uuguacagaaauauacuggccuagcagaggcaaaaaaaaaaaaaaugaauuuuauuuuacuugu

SEQ ID NO: 34908 - RNA, 64 nt, Homo Sapiens
uguacagaaauauacuggccuagcagaggcaaaaaaaaaaaaaaugaauuuuauuuuacuuguc

SEQ ID NO: 34909 - RNA, 64 nt, Homo Sapiens
guacagaaauauacuggccuagcagaggcaaaaaaaaaaaaaaugaauuuuauuuuacuuguca

SEQ ID NO: 34910 - RNA, 64 nt, Homo Sapiens
uacagaaauauacuggccuagcagaggcaaaaaaaaaaaaaaugaauuuuauuuuacuugucac

SEQ ID NO: 34911 - RNA, 64 nt, Homo Sapiens
cuccaaccugggugacagagugagacccugucucaaaaaaaaauaaaauaaggaccuuauugug

SEQ ID NO: 34912 - RNA, 64 nt, Homo Sapiens
uccaaccugggugacagagugagacccugucucaaaaaaaaauaaaauaaggaccuuauugugu

SEQ ID NO: 34913 - RNA, 64 nt, Homo Sapiens
ccaggucuaaaguuugaagaaaaagaaaaaucuuaaaaaaaaaaaaaaaaaaaaaaagaaaaaa

SEQ ID NO: 34914 - RNA, 64 nt, Homo Sapiens
caggucuaaaguuugaagaaaaagaaaaaucuuaaaaaaaaaaaaaaaaaaaaaaagaaaaaaa

SEQ ID NO: 34915 - RNA, 64 nt, Homo Sapiens
aggucuaaaguuugaagaaaaagaaaaaucuuaaaaaaaaaaaaaaaaaaaaaaagaaaaaaag

SEQ ID NO: 34916 - RNA, 64 nt, Homo Sapiens
ggucuaaaguuugaagaaaaagaaaaaucuuaaaaaaaaaaaaaaaaaaaaaaagaaaaaaaga

SEQ ID NO: 34917 - RNA, 64 nt, Homo Sapiens
gucuaaaguuugaagaaaaagaaaaaucuuaaaaaaaaaaaaaaaaaaaaaaagaaaaaaagaa

SEQ ID NO: 34918 - RNA, 64 nt, Homo Sapiens
ucuaaaguuugaagaaaaagaaaaaucuuaaaaaaaaaaaaaaaaaaaaaaagaaaaaaagaaa

SEQ ID NO: 34919 - RNA, 64 nt, Homo Sapiens
cuaaaguuugaagaaaaagaaaaaucuuaaaaaaaaaaaaaaaaaaaaaaagaaaaaaagaaaa

SEQ ID NO: 34920 - RNA, 64 nt, Homo Sapiens
uaaaguuugaagaaaaagaaaaaucuuaaaaaaaaaaaaaaaaaaaaaaagaaaaaaagaaaaa

SEQ ID NO: 34921 - RNA, 64 nt, Homo Sapiens
aaaguuugaagaaaaagaaaaaucuuaaaaaaaaaaaaaaaaaaaaaaagaaaaaaagaaaaac

SEQ ID NO: 34922 - RNA, 64 nt, Homo Sapiens
aaguuugaagaaaaagaaaaaucuuaaaaaaaaaaaaaaaaaaaaaaagaaaaaaagaaaaaca

SEQ ID NO: 34923 - RNA, 64 nt, Homo Sapiens
aguuugaagaaaaagaaaaaucuuaaaaaaaaaaaaaaaaaaaaaaagaaaaaaagaaaaacag

SEQ ID NO: 34924 - RNA, 64 nt, Homo Sapiens
guuugaagaaaaagaaaaaucuuaaaaaaaaaaaaaaaaaaaaaaagaaaaaaagaaaaacagg

SEQ ID NO: 34925 - RNA, 64 nt, Homo Sapiens
uuugaagaaaaagaaaaaucuuaaaaaaaaaaaaaaaaaaaaaaagaaaaaaagaaaaacagga

SEQ ID NO: 34926 - RNA, 64 nt, Homo Sapiens
uugaagaaaaagaaaaaucuuaaaaaaaaaaaaaaaaaaaaaaagaaaaaaagaaaaacaggaa

SEQ ID NO: 34927 - RNA, 64 nt, Homo Sapiens
ugaagaaaaagaaaaaucuuaaaaaaaaaaaaaaaaaaaaaaagaaaaaaagaaaaacaggaaa

SEQ ID NO: 34928 - RNA, 64 nt, Homo Sapiens
gaagaaaaagaaaaaucuuaaaaaaaaaaaaaaaaaaaaaaagaaaaaaagaaaaacaggaaaa

SEQ ID NO: 34929 - RNA, 63 nt, Homo Sapiens
aaaaaaaaauguugaaccaaaaaaaaaaaaggaaaaaaaaaagggcaagacucagucucaaaa

SEQ ID NO: 34930 - RNA, 64 nt, Homo Sapiens
aaaaaaaaauguugaaccaaaaaaaaaaaaaggaaaaaaaaaaggggcaagacucagucucaaa

SEQ ID NO: 34931 - RNA, 64 nt, Homo Sapiens
gaaaaaaaaauguugaaccaaaaaaaaaaaaaggaaaaaaaaaaagggcaagacucagucucaa

SEQ ID NO: 34932 - RNA, 64 nt, Homo Sapiens
aaaaaaaaaagaaaaaaaaaucagucucaaaaaaaaaaaaaaggccugagcgacagggcaagac

SEQ ID NO: 34933 - RNA, 64 nt, Homo Sapiens
gaaaaaaaaaagaaaaaaaacucagucucaaaaaaaaaaaaaaggccugagcgacagggcaaga

SEQ ID NO: 34934 - RNA, 64 nt, Homo Sapiens
ggaaaaaaaaaagaaaaaaaacucagucucaaaaaaaaaaaaaaagccugagcgacagggcaag

SEQ ID NO: 34935 - RNA, 64 nt, Homo Sapiens
aggaaaaaaaaaagaaaaaagacucagucucaaaaaaaaaaaaacagccugagcgacagggcaa

SEQ ID NO: 34936 - RNA, 64 nt, Homo Sapiens
aaggaaaaaaaaaagaaaaaagacucagucucaaaaaaaaaaaaccagccugagcgacagggca

SEQ ID NO: 34937 - RNA, 64 nt, Homo Sapiens
aaaggaaaaaaaaaagaaaaaagacucagucucaaaaaaaaaaauccagccugagcgacagggc

SEQ ID NO: 34938 - RNA, 64 nt, Homo Sapiens
aaaaggaaaaaaaaaagaaacaagacucagucucaaaaaaaaaauuccagccugagcgacaggg

SEQ ID NO: 34939 - RNA, 64 nt, Homo Sapiens
uuaagagguucugcugccagcaucucaaagaaaaaaaaaaaauaugggugacagagccagacuc

SEQ ID NO: 34940 - RNA, 64 nt, Homo Sapiens
auuaagagguucugcugccaccaucucaaagaaaaaaaaaaaaucugggugacagagccagacu

SEQ ID NO: 34941 - RNA, 64 nt, Homo Sapiens
uauuaagagguucugcugccuccaucucaaagaaaaaaaaaaaaccugggugacagagccagac

SEQ ID NO: 34942 - RNA, 64 nt, Homo Sapiens
auauuaagagguucugcugccuccaucucaaagaaaaaaaaaaagccugggugacagagccaga

SEQ ID NO: 34943 - RNA, 64 nt, Homo Sapiens
aauauuaagagguucugcugacuccaucucaaagaaaaaaaaaaagccugggugacagagccag

SEQ ID NO: 34944 - RNA, 64 nt, Homo Sapiens
agaggccgggugcgguggcugacuccaucucaaaaaaaaaaauacagcccaggugacaguguga

SEQ ID NO: 34945 - RNA, 64 nt, Homo Sapiens
aagaggccgggugcgguggcagacuccaucucaaaaaaaaaaauccagcccaggugacagugug

SEQ ID NO: 34946 - RNA, 64 nt, Homo Sapiens
uaagaggccgggugcggugggagacuccaucucaaaaaaaaaaauccagcccaggugacagugu

SEQ ID NO: 34947 - RNA, 64 nt, Homo Sapiens
auaagaggccgggugcggugugagacuccaucucaaaaaaaaaacuccagcccaggugacagug

SEQ ID NO: 34948 - RNA, 64 nt, Homo Sapiens
acaaaaacccuaauuuuguagcuguguggaaaaaaaaaaaaacuuuauguguuuggauacaucu

SEQ ID NO: 34949 - RNA, 64 nt, Homo Sapiens
uacaaaaacccuaauuuuguugcuguguggaaaaaaaaaaaaacuuuauguguuuggauacauc

SEQ ID NO: 34950 - RNA, 64 nt, Homo Sapiens
cuacaaaaacccuaauuuugcugcuguguggaaaaaaaaaaaaauuuuauguguuuggauacau

SEQ ID NO: 34951 - RNA, 64 nt, Homo Sapiens
acuacaaaaacccuaauuuuucugcuguguggaaaaaaaaaaaauuuuuauguguuuggauaca

SEQ ID NO: 34952 - RNA, 64 nt, Homo Sapiens
aacuacaaaaacccuaauuuaucugcuguguggaaaaaaaaaaaauuuuuauguguuuggauac

SEQ ID NO: 34953 - RNA, 64 nt, Homo Sapiens
aaacuacaaaaacccuaauucaucugcuguguggaaaaaaaaaagauuuuuauguguuuggaua

SEQ ID NO: 34954 - RNA, 64 nt, Homo Sapiens
aucccaaggguacagaagagaugguaaaaaaaaaaaaaaaaacaaaucaaagucagacacaccc

SEQ ID NO: 34955 - RNA, 64 nt, Homo Sapiens
aaucccaaggguacagaagacaugguaaaaaaaaaaaaaaaaacaaaucaaagucagacacacc

SEQ ID NO: 34956 - RNA, 64 nt, Homo Sapiens
caaucccaaggguacagaagccaugguaaaaaaaaaaaaaaaaagaaaucaaagucagacacac

SEQ ID NO: 34957 - RNA, 64 nt, Homo Sapiens
acaaucccaaggguacagaacccaugguaaaaaaaaaaaaaaaaugaaaucaaagucagacaca

SEQ ID NO: 34958 - RNA, 64 nt, Homo Sapiens
aacaaucccaaggguacagaacccaugguaaaaaaaaaaaaaaauugaaaucaaagucagacac

SEQ ID NO: 34959 - RNA, 64 nt, Homo Sapiens
aaacaaucccaaggguacagcacccaugguaaaaaaaaaaaaaauuugaaaucaaagucagaca

SEQ ID NO: 34960 - RNA, 64 nt, Homo Sapiens
aaaacaaucccaaggguacaacacccaugguaaaaaaaaaaaaauuuugaaaucaaagucagac

SEQ ID NO: 34961 - RNA, 64 nt, Homo Sapiens
aaaaacaaucccaaggguaccacacccaugguaaaaaaaaaaaauuuuugaaaucaaagucaga

SEQ ID NO: 34962 - RNA, 64 nt, Homo Sapiens
aaaaaacaaucccaaggguaacacacccaugguaaaaaaaaaaaauuuuugaaaucaaagucag

SEQ ID NO: 34963 - RNA, 64 nt, Homo Sapiens
aaaaaaacaaucccaagggugacacacccaugguaaaaaaaaaaaauuuuugaaaucaaaguca

SEQ ID NO: 34964 - RNA, 64 nt, Homo Sapiens
acuaaaaauucccacaaaucgaaaaacacacaaaaaaaaaaaucggggaaagguuucaaauggg

SEQ ID NO: 34965 - RNA, 64 nt, Homo Sapiens
cacuaaaaauucccacaaauggaaaaacacacaaaaaaaaaaaugggggaaagguuucaaaugg

SEQ ID NO: 34966 - RNA, 64 nt, Homo Sapiens
ucacuaaaaauucccacaaagggaaaaacacacaaaaaaaaaaaggggggaaagguuucaaaug

SEQ ID NO: 34967 - RNA, 64 nt, Homo Sapiens
aucacuaaaaauucccacaaggggaaaaacacacaaaaaaaaaagggggggaaagguuucaaau

SEQ ID NO: 34968 - RNA, 64 nt, Homo Sapiens
acagcaccuguccaggcuucaaaaaaaaaaaaaaaaaaaaaacacccucugccccgcccucaaa

SEQ ID NO: 34969 - RNA, 64 nt, Homo Sapiens
aacagcaccuguccaggcuuaaaaaaaaaaaaaaaaaaaaaaacucccucugccccgcccucaa

SEQ ID NO: 34970 - RNA, 64 nt, Homo Sapiens
caacagcaccuguccaggcuaaaaaaaaaaaaaaaaaaaaaaaacucccucugccccgcccuca

SEQ ID NO: 34971 - RNA, 64 nt, Homo Sapiens
acaacagcaccuguccaggcaaaaaaaaaaaaaaaaaaaaaaaagcucccucugccccgcccuc

SEQ ID NO: 34972 - RNA, 64 nt, Homo Sapiens
aacaacagcaccuguccaggcaaaaaaaaaaaaaaaaaaaaaaaugcucccucugccccgcccu

SEQ ID NO: 34973 - RNA, 64 nt, Homo Sapiens
aaacaacagcaccuguccagucaaaaaaaaaaaaaaaaaaaaaaaugcucccucugccccgccc

SEQ ID NO: 34974 - RNA, 64 nt, Homo Sapiens
aaaacaacagcaccuguccacucaaaaaaaaaaaaaaaaaaaaacaugcucccucugccccgcc

SEQ ID NO: 34975 - RNA, 64 nt, Homo Sapiens
aaaaacaacagcaccuguccccucaaaaaaaaaaaaaaaaaaaaucaugcucccucugccccgc

SEQ ID NO: 34976 - RNA, 64 nt, Homo Sapiens
aaaaaacaacagcaccuguccccucaaaaaaaaaaaaaaaaaaagucaugcucccucugccccg

SEQ ID NO: 34977 - RNA, 64 nt, Homo Sapiens
aaaaaaacaacagcaccugugcccucaaaaaaaaaaaaaaaaaacgucaugcucccucugcccc

SEQ ID NO: 34978 - RNA, 64 nt, Homo Sapiens
aaaaaaaacaacagcaccugcgcccucaaaaaaaaaaaaaaaaaccgucaugcucccucugccc

SEQ ID NO: 34979 - RNA, 64 nt, Homo Sapiens
aaaaaaaaacaacagcaccuccgcccucaaaaaaaaaaaaaaaacccgucaugcucccucugcc

SEQ ID NO: 34980 - RNA, 64 nt, Homo Sapiens
aaaaaaaaaacaacagcacccccgcccucaaaaaaaaaaaaaaaccccgucaugcucccucugc

SEQ ID NO: 34981 - RNA, 64 nt, Homo Sapiens
aaaaaaaaaaacaacagcacccccgcccucaaaaaaaaaaaaaauccccgucaugcucccucug

SEQ ID NO: 34982 - RNA, 64 nt, Homo Sapiens
aaaaaaaaaaaacaacagcagccccgcccucaaaaaaaaaaaaacuccccgucaugcucccucu

SEQ ID NO: 34983 - RNA, 64 nt, Homo Sapiens
aaaaaaaaaaaaacaacagcugccccgcccucaaaaaaaaaaaaucuccccgucaugcucccuc

SEQ ID NO: 34984 - RNA, 64 nt, Homo Sapiens
aaaaaaaaaaaaaacaacagcugccccgcccucaaaaaaaaaaacucuccccgucaugcucccu

SEQ ID NO: 34985 - RNA, 64 nt, Homo Sapiens
aaaaaaaaaaaaaaacaacaucugccccgcccucaaaaaaaaaaacucuccccgucaugcuccc

SEQ ID NO: 34986 - RNA, 64 nt, Homo Sapiens
uaaaaaaaugugcgagcuaacggcagccgaaugaaaaaaaaauuagaaguaauuuauuccuuuu

SEQ ID NO: 34987 - RNA, 64 nt, Homo Sapiens
uuaaaaaaaugugcgagcuaucggcagccgaaugaaaaaaaaauaagaaguaauuuauuccuuu

SEQ ID NO: 34988 - RNA, 64 nt, Homo Sapiens
acgcuguuuucuaguccugcgaacuacugaauaaaaaaaaaacaaggggacaauugagauggcu

SEQ ID NO: 34989 - RNA, 64 nt, Homo Sapiens
aacgcuguuuucuaguccugugaacuacugaauaaaaaaaaaacuaggggacaauugagauggc

SEQ ID NO: 34990 - RNA, 64 nt, Homo Sapiens
caacgcuguuuucuaguccucugaacuacugaauaaaaaaaaaauuaggggacaauugagaugg

SEQ ID NO: 34991 - RNA, 64 nt, Homo Sapiens
ccuuaagccaaaugguguucugauuuaaaaagaaaaaaaaaauuaagaucuguuugugaaagcc

SEQ ID NO: 34992 - RNA, 64 nt, Homo Sapiens
uccuuaagccaaaugguguucugauuuaaaaagaaaaaaaaaaucaagaucuguuugugaaagc

SEQ ID NO: 34993 - RNA, 64 nt, Homo Sapiens
uuccuuaagccaaaugguguccugauuuaaaaagaaaaaaaaaaacaagaucuguuugugaaag

SEQ ID NO: 34994 - RNA, 64 nt, Homo Sapiens
aaaauauaauauauuuuuuuuaauuuaaaaagaaaaaaaaaaucggcugggauggauaaccaua

SEQ ID NO: 34995 - RNA, 64 nt, Homo Sapiens
caaaauauaauauauuuuuuauaauuuaaaaagaaaaaaaaaauuggcugggauggauaaccau

SEQ ID NO: 34996 - RNA, 64 nt, Homo Sapiens
ucaaaauauaauauauuuuuuauaauuuaaaaagaaaaaaaaaauuggcugggauggauaacca

SEQ ID NO: 34997 - RNA, 64 nt, Homo Sapiens
uauuuuaaauuugaugcucaaugauuuaaagagaaaaaaaaagaauacccuggagaauggcaaa

SEQ ID NO: 34998 - RNA, 64 nt, Homo Sapiens
auauuuuaaauuugaugcucaaugauuuaaagagaaaaaaaaaguauacccuggagaauggcaa

SEQ ID NO: 34999 - RNA, 64 nt, Homo Sapiens
uuaagaguugaucuguuuuccagagcacuuauuaaaaaaaaaucgguccucacacaauuccuua

SEQ ID NO: 35000 - RNA, 64 nt, Homo Sapiens
cuuaagaguugaucuguuuuacagagcacuuauuaaaaaaaaauagguccucacacaauuccuu

SEQ ID NO: 35001 - RNA, 64 nt, Homo Sapiens
cauauaagguugauuaaagguuuucaaaaaguuaaaaaaaaagauguguuuuuuuaaauaaaaa

SEQ ID NO: 35002 - RNA, 64 nt, Homo Sapiens
acauauaagguugauuaaagauuuucaaaaaguuaaaaaaaaaguuguguuuuuuuaaauaaaa

SEQ ID NO: 35003 - RNA, 64 nt, Homo Sapiens
ugaauucaucucuaacuuaguuguaauugcuuuaaaaaaaaagucuguccucagcccagcguag

SEQ ID NO: 35004 - RNA, 64 nt, Homo Sapiens
uugaauucaucucuaacuuaguuguaauugcuuuaaaaaaaaaggcuguccucagcccagcgua

SEQ ID NO: 35005 - RNA, 64 nt, Homo Sapiens
uaccugaauagacauuucuagaaugugaaaaaaaaaaaaaaagacaucaaacaaggauuacagu

SEQ ID NO: 35006 - RNA, 64 nt, Homo Sapiens
auaccugaauagacauuucuugaaugugaaaaaaaaaaaaaaagacaucaaacaaggauuacag

SEQ ID NO: 35007 - RNA, 64 nt, Homo Sapiens
gauaccugaauagacauuucgugaaugugaaaaaaaaaaaaaaagacaucaaacaaggauuaca

SEQ ID NO: 35008 - RNA, 64 nt, Homo Sapiens
agauaccugaauagacauuuagugaaugugaaaaaaaaaaaaaaugacaucaaacaaggauuac

SEQ ID NO: 35009 - RNA, 64 nt, Homo Sapiens
aagauaccugaauagacauucagugaaugugaaaaaaaaaaaaauugacaucaaacaaggauua

SEQ ID NO: 35010 - RNA, 64 nt, Homo Sapiens
aaagauaccugaauagacauacagugaaugugaaaaaaaaaaaaauugacaucaaacaaggauu

SEQ ID NO: 35011 - RNA, 64 nt, Homo Sapiens
aaaagauaccugaauagacauacagugaaugugaaaaaaaaaaacauugacaucaaacaaggau

SEQ ID NO: 35012 - RNA, 64 nt, Homo Sapiens
aaaaagauaccugaauagacuuacagugaaugugaaaaaaaaaaacauugacaucaaacaagga

SEQ ID NO: 35013 - RNA, 64 nt, Homo Sapiens
caaaaauuagccgggcguggaaaaaaaaaaaaaaaaaaaaaauacagagcgagacuccgucuca

SEQ ID NO: 35014 - RNA, 64 nt, Homo Sapiens
acaaaaauuagccgggcgugaaaaaaaaaaaaaaaaaaaaaaauacagagcgagacuccgucuc

SEQ ID NO: 35015 - RNA, 64 nt, Homo Sapiens
uacaaaaauuagccgggcgucaaaaaaaaaaaaaaaaaaaaaaagacagagcgagacuccgucu

SEQ ID NO: 35016 - RNA, 64 nt, Homo Sapiens
auacaaaaauuagccgggcgucaaaaaaaaaaaaaaaaaaaaaacgacagagcgagacuccguc

SEQ ID NO: 35017 - RNA, 64 nt, Homo Sapiens
aauacaaaaauuagccgggccucaaaaaaaaaaaaaaaaaaaaagcgacagagcgagacuccgu

SEQ ID NO: 35018 - RNA, 64 nt, Homo Sapiens
aaauacaaaaauuagccgggucucaaaaaaaaaaaaaaaaaaaaggcgacagagcgagacuccg

SEQ ID NO: 35019 - RNA, 64 nt, Homo Sapiens
aaaauacaaaaauuagccgggucucaaaaaaaaaaaaaaaaaaagggcgacagagcgagacucc

SEQ ID NO: 35020 - RNA, 64 nt, Homo Sapiens
aaaaauacaaaaauuagccgcgucucaaaaaaaaaaaaaaaaaaugggcgacagagcgagacuc

SEQ ID NO: 35021 - RNA, 64 nt, Homo Sapiens
aaaaaauacaaaaauuagccccgucucaaaaaaaaaaaaaaaaacugggcgacagagcgagacu

SEQ ID NO: 35022 - RNA, 64 nt, Homo Sapiens
aaaaaaauacaaaaauuagcuccgucucaaaaaaaaaaaaaaaaccugggcgacagagcgagac

SEQ ID NO: 35023 - RNA, 64 nt, Homo Sapiens
aaaaaaaauacaaaaauuagcuccgucucaaaaaaaaaaaaaaagccugggcgacagagcgaga

SEQ ID NO: 35024 - RNA, 64 nt, Homo Sapiens
aaaaaaaaauacaaaaauuaacuccgucucaaaaaaaaaaaaaaagccugggcgacagagcgag

SEQ ID NO: 35025 - RNA, 64 nt, Homo Sapiens
aaaaaaaaaauacaaaaauugacuccgucucaaaaaaaaaaaaacagccugggcgacagagcga

SEQ ID NO: 35026 - RNA, 64 nt, Homo Sapiens
aaaaaaaaaaauacaaaaauagacuccgucucaaaaaaaaaaaaccagccugggcgacagagcg

SEQ ID NO: 35027 - RNA, 64 nt, Homo Sapiens
aaaaaaaaaaaauacaaaaagagacuccgucucaaaaaaaaaaauccagccugggcgacagagc

SEQ ID NO: 35028 - RNA, 64 nt, Homo Sapiens
aaaaaaaaaaaaauacaaaacgagacuccgucucaaaaaaaaaacuccagccugggcgacagag

SEQ ID NO: 35029 - RNA, 64 nt, Homo Sapiens
gagagagagagaagaagaagcugauuggaaaaaaaaaaaaaagaggcagggguacagagagugc

SEQ ID NO: 35030 - RNA, 64 nt, Homo Sapiens
agagagagagagaagaagaaccugauuggaaaaaaaaaaaaaaguggcagggguacagagagug

SEQ ID NO: 35031 - RNA, 64 nt, Homo Sapiens
gagagagagagagaagaagagccugauuggaaaaaaaaaaaaaaguggcagggguacagagagu

SEQ ID NO: 35032 - RNA, 64 nt, Homo Sapiens
agagagagagagagaagaagugccugauuggaaaaaaaaaaaaagguggcagggguacagagag

SEQ ID NO: 35033 - RNA, 64 nt, Homo Sapiens
aagagagagagagagaagaagugccugauuggaaaaaaaaaaaaggguggcagggguacagaga

SEQ ID NO: 35034 - RNA, 64 nt, Homo Sapiens
aaagagagagagagagaagaagugccugauuggaaaaaaaaaaaaggguggcagggguacagag

SEQ ID NO: 35035 - RNA, 64 nt, Homo Sapiens
aaaagagagagagagagaaggagugccugauuggaaaaaaaaaacaggguggcagggguacaga

SEQ ID NO: 35036 - RNA, 64 nt, Homo Sapiens
cuggaaaauagaaaaaaaaacccuccuggaaaaaaaaaaaaacccaaaagaggaaaaaaaaaau

SEQ ID NO: 35037 - RNA, 64 nt, Homo Sapiens
ccuggaaaauagaaaaaaaaucccuccuggaaaaaaaaaaaaacacaaaagaggaaaaaaaaaa

SEQ ID NO: 35038 - RNA, 64 nt, Homo Sapiens
cccuggaaaauagaaaaaaaaucccuccuggaaaaaaaaaaaaaaacaaaagaggaaaaaaaaa

SEQ ID NO: 35039 - RNA, 64 nt, Homo Sapiens
acccuggaaaauagaaaaaaaaucccuccuggaaaaaaaaaaaauaacaaaagaggaaaaaaaa

SEQ ID NO: 35040 - RNA, 64 nt, Homo Sapiens
aacccuggaaaauagaaaaaaaaucccuccuggaaaaaaaaaaaauaacaaaagaggaaaaaaa

SEQ ID NO: 35041 - RNA, 64 nt, Homo Sapiens
aaacccuggaaaauagaaaaaaaaucccuccuggaaaaaaaaaaaauaacaaaagaggaaaaaa

SEQ ID NO: 35042 - RNA, 64 nt, Homo Sapiens
ccuccuggaaaaaaaaaaaauaacaaaagaggaaaaaaaaaaucgagcaagccuuuuugaaaaa

SEQ ID NO: 35043 - RNA, 64 nt, Homo Sapiens
cccuccuggaaaaaaaaaaaauaacaaaagaggaaaaaaaaaaucgagcaagccuuuuugaaaa

SEQ ID NO: 35044 - RNA, 64 nt, Homo Sapiens
ucccuccuggaaaaaaaaaaaauaacaaaagaggaaaaaaaaaagcgagcaagccuuuuugaaa

SEQ ID NO: 35045 - RNA, 64 nt, Homo Sapiens
aaacccauuaaaaaguauuuuuguaaaaaauaaaaaaaaaaacuugcaugauucuccaguauau

SEQ ID NO: 35046 - RNA, 64 nt, Homo Sapiens
uaaacccauuaaaaaguauuuuuguaaaaaauaaaaaaaaaaacuugcaugauucuccaguaua

SEQ ID NO: 35047 - RNA, 64 nt, Homo Sapiens
cuaaacccauuaaaaaguauauuuguaaaaaauaaaaaaaaaaaauugcaugauucuccaguau

SEQ ID NO: 35048 - RNA, 64 nt, Homo Sapiens
acuaaacccauuaaaaaguauauuuguaaaaaauaaaaaaaaaacauugcaugauucuccagua

SEQ ID NO: 35049 - RNA, 64 nt, Homo Sapiens
acggaaaaagaaaugcuuacccgaaaaaaaaaaaaaaaaaaagagacagagugagacccugucu

SEQ ID NO: 35050 - RNA, 64 nt, Homo Sapiens
aacggaaaaagaaaugcuuauccgaaaaaaaaaaaaaaaaaaagugacagagugagacccuguc

SEQ ID NO: 35051 - RNA, 64 nt, Homo Sapiens
gaacggaaaaagaaaugcuucuccgaaaaaaaaaaaaaaaaaaagugacagagugagacccugu

SEQ ID NO: 35052 - RNA, 64 nt, Homo Sapiens
agaacggaaaaagaaaugcuucuccgaaaaaaaaaaaaaaaaaaggugacagagugagacccug

SEQ ID NO: 35053 - RNA, 64 nt, Homo Sapiens
aagaacggaaaaagaaaugcgucuccgaaaaaaaaaaaaaaaaagggugacagagugagacccu

SEQ ID NO: 35054 - RNA, 64 nt, Homo Sapiens
aaagaacggaaaaagaaaugugucuccgaaaaaaaaaaaaaaaaugggugacagagugagaccc

SEQ ID NO: 35055 - RNA, 64 nt, Homo Sapiens
aaaagaacggaaaaagaaaucugucuccgaaaaaaaaaaaaaaacugggugacagagugagacc

SEQ ID NO: 35056 - RNA, 64 nt, Homo Sapiens
aaaaagaacggaaaaagaaaccugucuccgaaaaaaaaaaaaaaccugggugacagagugagac

SEQ ID NO: 35057 - RNA, 64 nt, Homo Sapiens
aaaaaagaacggaaaaagaacccugucuccgaaaaaaaaaaaaagccugggugacagagugaga

SEQ ID NO: 35058 - RNA, 64 nt, Homo Sapiens
aaaaaaagaacggaaaaagaacccugucuccgaaaaaaaaaaaaagccugggugacagagugag

SEQ ID NO: 35059 - RNA, 64 nt, Homo Sapiens
aaaaaaaagaacggaaaaaggacccugucuccgaaaaaaaaaaacagccugggugacagaguga

SEQ ID NO: 35060 - RNA, 64 nt, Homo Sapiens
aaaaaaaaagaacggaaaaaagacccugucuccgaaaaaaaaaaccagccugggugacagagug

SEQ ID NO: 35061 - RNA, 64 nt, Homo Sapiens
aagcagauccucauggcuaucuccgucucaaaaaaaaaaaaagagccugggugacagagcgaga

SEQ ID NO: 35062 - RNA, 64 nt, Homo Sapiens
aaagcagauccucauggcuaacuccgucucaaaaaaaaaaaaagagccugggugacagagcgag

SEQ ID NO: 35063 - RNA, 64 nt, Homo Sapiens
gaaagcagauccucauggcugacuccgucucaaaaaaaaaaaaacagccugggugacagagcga

SEQ ID NO: 35064 - RNA, 64 nt, Homo Sapiens
agaaagcagauccucauggcagacuccgucucaaaaaaaaaaaaccagccugggugacagagcg

SEQ ID NO: 35065 - RNA, 64 nt, Homo Sapiens
aagaaagcagauccucaugggagacuccgucucaaaaaaaaaaauccagccugggugacagagc

SEQ ID NO: 35066 - RNA, 64 nt, Homo Sapiens
aaagaaagcagauccucaugcgagacuccgucucaaaaaaaaaacuccagccugggugacagag

SEQ ID NO: 35067 - RNA, 64 nt, Homo Sapiens
aagaaagaaaaggaaacccacuccgucucaaaaaaaaaaaaagagccugggcaacagagcgaga

SEQ ID NO: 35068 - RNA, 64 nt, Homo Sapiens
aaagaaagaaaaggaaacccacuccgucucaaaaaaaaaaaaagagccugggcaacagagcgag

SEQ ID NO: 35069 - RNA, 64 nt, Homo Sapiens
gaaagaaagaaaaggaaaccgacuccgucucaaaaaaaaaaaaacagccugggcaacagagcga

SEQ ID NO: 35070 - RNA, 64 nt, Homo Sapiens
agaaagaaagaaaaggaaacagacuccgucucaaaaaaaaaaaaccagccugggcaacagagcg

SEQ ID NO: 35071 - RNA, 64 nt, Homo Sapiens
aagaaagaaagaaaaggaaagagacuccgucucaaaaaaaaaaacccagccugggcaacagagc

SEQ ID NO: 35072 - RNA, 64 nt, Homo Sapiens
aaagaaagaaagaaaaggaacgagacuccgucucaaaaaaaaaaccccagccugggcaacagag

SEQ ID NO: 35073 - RNA, 64 nt, Homo Sapiens
cuuugguaaauggcaaaugauuaaaagaaaaagaaaaaaaaagucccuugaggaaacaacagcu

SEQ ID NO: 35074 - RNA, 64 nt, Homo Sapiens
ucuuugguaaauggcaaauguuuaaaagaaaaagaaaaaaaaagucccuugaggaaacaacagc

SEQ ID NO: 35075 - RNA, 64 nt, Homo Sapiens
aagaaggacacaagcgaagagugucuuucaaagaaaaaaaaaucgaacuuccagaucaacaaaa

SEQ ID NO: 35076 - RNA, 64 nt, Homo Sapiens
caagaaggacacaagcgaagagugucuuucaaagaaaaaaaaauggaacuuccagaucaacaaa

SEQ ID NO: 35077 - RNA, 64 nt, Homo Sapiens
gaccaagaaacuuucaaugaaaucacccccugcaaaaaaaaagaaacaaggaugguacuaccac

SEQ ID NO: 35078 - RNA, 64 nt, Homo Sapiens
agaccaagaaacuuucaaugcaaucacccccugcaaaaaaaaaggaacaaggaugguacuacca

SEQ ID NO: 35079 - RNA, 64 nt, Homo Sapiens
uaagauggacacagcugacuaucucaaaaaaaaaaaaaaaaacugggcgacagagugagacucc

SEQ ID NO: 35080 - RNA, 64 nt, Homo Sapiens
uuaagauggacacagcugaccaucucaaaaaaaaaaaaaaaaacugggcgacagagugagacuc

SEQ ID NO: 35081 - RNA, 64 nt, Homo Sapiens
cuuaagauggacacagcugaccaucucaaaaaaaaaaaaaaaaacugggcgacagagugagacu

SEQ ID NO: 35082 - RNA, 64 nt, Homo Sapiens
acuuaagauggacacagcuguccaucucaaaaaaaaaaaaaaaaccugggcgacagagugagac

SEQ ID NO: 35083 - RNA, 64 nt, Homo Sapiens
aacuuaagauggacacagcucuccaucucaaaaaaaaaaaaaaagccugggcgacagagugaga

SEQ ID NO: 35084 - RNA, 64 nt, Homo Sapiens
aaacuuaagauggacacagcacuccaucucaaaaaaaaaaaaaaagccugggcgacagagugag

SEQ ID NO: 35085 - RNA, 64 nt, Homo Sapiens
aaaacuuaagauggacacaggacuccaucucaaaaaaaaaaaaacagccugggcgacagaguga

SEQ ID NO: 35086 - RNA, 64 nt, Homo Sapiens
aaaaacuuaagauggacacaagacuccaucucaaaaaaaaaaaaccagccugggcgacagagug

SEQ ID NO: 35087 - RNA, 64 nt, Homo Sapiens
aaaaaacuuaagauggacacgagacuccaucucaaaaaaaaaaauccagccugggcgacagagu

SEQ ID NO: 35088 - RNA, 64 nt, Homo Sapiens
aaaaaaacuuaagauggacaugagacuccaucucaaaaaaaaaacuccagccugggcgacagag

SEQ ID NO: 35089 - RNA, 64 nt, Homo Sapiens
agacgggccggcacgguggcagacuccaucuuuaaaaaaaaacaccagccugggcgacagagcg

SEQ ID NO: 35090 - RNA, 64 nt, Homo Sapiens
aagacgggccggcacggugggagacuccaucuuuaaaaaaaaacuccagccugggcgacagagc

SEQ ID NO: 35091 - RNA, 64 nt, Homo Sapiens
aauauauccuaugcagaguuuuugacucugccucaaaaaaaagaguacaauuuggggccucaaa

SEQ ID NO: 35092 - RNA, 64 nt, Homo Sapiens
auuguguacaauuuggggccguuauuuagccaccaaaaaaaaguuuuagugucaaggcagauua

SEQ ID NO: 35093 - RNA, 64 nt, Homo Sapiens
aacuucaguuaacagccuccucaaaaaaaaaaaaaaaaaaaagacgacagucugagacucuguc

SEQ ID NO: 35094 - RNA, 64 nt, Homo Sapiens
aaacuucaguuaacagccuccucaaaaaaaaaaaaaaaaaaaaggcgacagucugagacucugu

SEQ ID NO: 35095 - RNA, 64 nt, Homo Sapiens
gaaacuucaguuaacagccuucucaaaaaaaaaaaaaaaaaaaaggcgacagucugagacucug

SEQ ID NO: 35096 - RNA, 64 nt, Homo Sapiens
agaaacuucaguuaacagccgucucaaaaaaaaaaaaaaaaaaagggcgacagucugagacucu

SEQ ID NO: 35097 - RNA, 64 nt, Homo Sapiens
aagaaacuucaguuaacagcugucucaaaaaaaaaaaaaaaaaaugggcgacagucugagacuc

SEQ ID NO: 35098 - RNA, 64 nt, Homo Sapiens
aaagaaacuucaguuaacagcugucucaaaaaaaaaaaaaaaaacugggcgacagucugagacu

SEQ ID NO: 35099 - RNA, 64 nt, Homo Sapiens
aaaagaaacuucaguuaacaucugucucaaaaaaaaaaaaaaaaccugggcgacagucugagac

SEQ ID NO: 35100 - RNA, 64 nt, Homo Sapiens
aaaaagaaacuucaguuaaccucugucucaaaaaaaaaaaaaaauccugggcgacagucugaga

SEQ ID NO: 35101 - RNA, 64 nt, Homo Sapiens
aaaaaagaaacuucaguuaaacucugucucaaaaaaaaaaaaaaauccugggcgacagucugag

SEQ ID NO: 35102 - RNA, 64 nt, Homo Sapiens
aaaaaaagaaacuucaguuagacucugucucaaaaaaaaaaaaacauccugggcgacagucuga

SEQ ID NO: 35103 - RNA, 64 nt, Homo Sapiens
aaaaaaaagaaacuucaguuagacucugucucaaaaaaaaaaaaccauccugggcgacagucug

SEQ ID NO: 35104 - RNA, 64 nt, Homo Sapiens
aaaaaaaaagaaacuucagugagacucugucucaaaaaaaaaaauccauccugggcgacagucu

SEQ ID NO: 35105 - RNA, 64 nt, Homo Sapiens
aaaaaaaaaagaaacuucagugagacucugucucaaaaaaaaaacuccauccugggcgacaguc

SEQ ID NO: 35106 - RNA, 64 nt, Homo Sapiens
uuuaaacagaagcacaugacuuuuaauuguuaaaaaaaaaaaguccucuuacuuucuguguagu

SEQ ID NO: 35107 - RNA, 64 nt, Homo Sapiens
uuuuaaacagaagcacaugauuuuuaauuguuaaaaaaaaaaagaccucuuacuuucuguguag

SEQ ID NO: 35108 - RNA, 64 nt, Homo Sapiens
guuuuaaacagaagcacaugguuuuuaauuguuaaaaaaaaaaaaaccucuuacuuucugugua

SEQ ID NO: 35109 - RNA, 64 nt, Homo Sapiens
aguuuuaaacagaagcacauaguuuuuaauuguuaaaaaaaaaacaaccucuuacuuucugugu

SEQ ID NO: 35110 - RNA, 64 nt, Homo Sapiens
aaagagucuauuuauggcugaaaaacaaacagaaaaaaaaaaguucuucugacagccaaagaug

SEQ ID NO: 35111 - RNA, 64 nt, Homo Sapiens
uaaagagucuauuuauggcugaaaaacaaacagaaaaaaaaaagcucuucugacagccaaagau

SEQ ID NO: 35112 - RNA, 64 nt, Homo Sapiens
guaaagagucuauuuauggcugaaaaacaaacagaaaaaaaaaaucucuucugacagccaaaga

SEQ ID NO: 35113 - RNA, 64 nt, Homo Sapiens
acugaucuucaauaugaagauaaaggaaaaaaaaaaaaaaaaguaaguuaagaugcuacuguuu

SEQ ID NO: 35114 - RNA, 64 nt, Homo Sapiens
uacugaucuucaauaugaaguuaaaggaaaaaaaaaaaaaaaagcaaguuaagaugcuacuguu

SEQ ID NO: 35115 - RNA, 64 nt, Homo Sapiens
guacugaucuucaauaugaauuuaaaggaaaaaaaaaaaaaaaaacaaguuaagaugcuacugu

SEQ ID NO: 35116 - RNA, 64 nt, Homo Sapiens
aguacugaucuucaauaugauuuuaaaggaaaaaaaaaaaaaaacacaaguuaagaugcuacug

SEQ ID NO: 35117 - RNA, 64 nt, Homo Sapiens
aaguacugaucuucaauaugguuuuaaaggaaaaaaaaaaaaaaccacaaguuaagaugcuacu

SEQ ID NO: 35118 - RNA, 64 nt, Homo Sapiens
aaaguacugaucuucaauauuguuuuaaaggaaaaaaaaaaaaagccacaaguuaagaugcuac

SEQ ID NO: 35119 - RNA, 64 nt, Homo Sapiens
aaaaguacugaucuucaauacuguuuuaaaggaaaaaaaaaaaaugccacaaguuaagaugcua

SEQ ID NO: 35120 - RNA, 64 nt, Homo Sapiens
aaaaaguacugaucuucaauacuguuuuaaaggaaaaaaaaaaagugccacaaguuaagaugcu

SEQ ID NO: 35121 - RNA, 64 nt, Homo Sapiens
aaaaaaguacugaucuucaauacuguuuuaaaggaaaaaaaaaaugugccacaaguuaagaugc

SEQ ID NO: 35122 - RNA, 64 nt, Homo Sapiens
aacugagguucagaaugauuuugugaccuuuuuuaaaaaaaagguaguagagcuuguucuugua

SEQ ID NO: 35123 - RNA, 64 nt, Homo Sapiens
cgguggggguagggggcugguuucuuuaaaaaaaaaaaaaaauaggccucccccacuuucuuuc

SEQ ID NO: 35124 - RNA, 64 nt, Homo Sapiens
acgguggggguagggggcugcuuucuuuaaaaaaaaaaaaaaauuggccucccccacuuucuuu

SEQ ID NO: 35125 - RNA, 64 nt, Homo Sapiens
uacgguggggguagggggcuucuuucuuuaaaaaaaaaaaaaaacuggccucccccacuuucuu

SEQ ID NO: 35126 - RNA, 64 nt, Homo Sapiens
auacgguggggguagggggcuucuuucuuuaaaaaaaaaaaaaaccuggccucccccacuuucu

SEQ ID NO: 35127 - RNA, 64 nt, Homo Sapiens
aauacgguggggguaggggguuucuuucuuuaaaaaaaaaaaaacccuggccucccccacuuuc

SEQ ID NO: 35128 - RNA, 64 nt, Homo Sapiens
aaauacgguggggguaggggcuuucuuucuuuaaaaaaaaaaaaccccuggccucccccacuuu

SEQ ID NO: 35129 - RNA, 64 nt, Homo Sapiens
aaaauacgguggggguagggucuuucuuucuuuaaaaaaaaaaacccccuggccucccccacuu

SEQ ID NO: 35130 - RNA, 64 nt, Homo Sapiens
aaaaauacgguggggguagguucuuucuuucuuuaaaaaaaaaaccccccuggccucccccacu

SEQ ID NO: 35131 - RNA, 64 nt, Homo Sapiens
uacagaaugcuguguaccagauugaaaaaaauaaaaaaaaaaguaaaaaaaaaaagaaggaaaa

SEQ ID NO: 35132 - RNA, 64 nt, Homo Sapiens
uuacagaaugcuguguaccaaauugaaaaaaauaaaaaaaaaagaaaaaaaaaaaagaaggaaa

SEQ ID NO: 35133 - RNA, 64 nt, Homo Sapiens
guuacagaaugcuguguaccaaauugaaaaaaauaaaaaaaaaauaaaaaaaaaaaagaaggaa

SEQ ID NO: 35134 - RNA, 64 nt, Homo Sapiens
aggaaaaauugaaaaaaauaacuagugcuuaaaaaaaaaaaagaauucuguucgcaaagcacag

SEQ ID NO: 35135 - RNA, 64 nt, Homo Sapiens
aaggaaaaauugaaaaaaaugacuagugcuuaaaaaaaaaaaaggauucuguucgcaaagcaca

SEQ ID NO: 35136 - RNA, 64 nt, Homo Sapiens
gaaggaaaaauugaaaaaaaagacuagugcuuaaaaaaaaaaaaugauucuguucgcaaagcac

SEQ ID NO: 35137 - RNA, 64 nt, Homo Sapiens
agaaggaaaaauugaaaaaacagacuagugcuuaaaaaaaaaaauugauucuguucgcaaagca

SEQ ID NO: 35138 - RNA, 64 nt, Homo Sapiens
aagaaggaaaaauugaaaaaacagacuagugcuuaaaaaaaaaacuugauucuguucgcaaagc

SEQ ID NO: 35139 - RNA, 64 nt, Homo Sapiens
uuguauuuuguaaauauuuuaacaaaaaauggaaaaaaaaaaccgcauugaaaaaaaaaacaaa

SEQ ID NO: 35140 - RNA, 64 nt, Homo Sapiens
cuuguauuuuguaaauauuuaaacaaaaaauggaaaaaaaaaacagcauugaaaaaaaaaacaa

SEQ ID NO: 35141 - RNA, 64 nt, Homo Sapiens
ccuuguauuuuguaaauauuaaaacaaaaaauggaaaaaaaaaauagcauugaaaaaaaaaaca

SEQ ID NO: 35142 - RNA, 64 nt, Homo Sapiens
aaaacaaaaaauggaaaaaacuuuuagcauugaaaaaaaaaacaguugaaaauucugaauaacc

SEQ ID NO: 35143 - RNA, 64 nt, Homo Sapiens
aaaaacaaaaaauggaaaaaccuuuuagcauugaaaaaaaaaacgguugaaaauucugaauaac

SEQ ID NO: 35144 - RNA, 64 nt, Homo Sapiens
caaaaacaaaaaauggaaaacccuuuuagcauugaaaaaaaaaaagguugaaaauucugaauaa

SEQ ID NO: 35145 - RNA, 64 nt, Homo Sapiens
caauaaugcaccauaucccuucauuguuucuuuaaaaaaaaauauuugcaaguuaaaggguuug

SEQ ID NO: 35146 - RNA, 64 nt, Homo Sapiens
acaauaaugcaccauaucccgucauuguuucuuuaaaaaaaaauguuugcaaguuaaaggguuu

SEQ ID NO: 35147 - RNA, 64 nt, Homo Sapiens
aauucgcauguuuaaugugaucccccaggaaaaaaaaaaaaagagugucugugguugcagucuu

SEQ ID NO: 35148 - RNA, 64 nt, Homo Sapiens
aaauucgcauguuuaauguguucccccaggaaaaaaaaaaaaagugugucugugguugcagucu

SEQ ID NO: 35149 - RNA, 64 nt, Homo Sapiens
gaaauucgcauguuuaauguuuucccccaggaaaaaaaaaaaaauugugucugugguugcaguc

SEQ ID NO: 35150 - RNA, 64 nt, Homo Sapiens
agaaauucgcauguuuaaugcuuucccccaggaaaaaaaaaaaauuugugucugugguugcagu

SEQ ID NO: 35151 - RNA, 64 nt, Homo Sapiens
aagaaauucgcauguuuaauucuuucccccaggaaaaaaaaaaaguuugugucugugguugcag

SEQ ID NO: 35152 - RNA, 64 nt, Homo Sapiens
aaagaaauucgcauguuuaagucuuucccccaggaaaaaaaaaauguuugugucugugguugca

SEQ ID NO: 35153 - RNA, 64 nt, Homo Sapiens
cuauuuaaaugaaaggaguuaacaaaaaaaacaaaaaaaaaaccaguaaaaaaacaaaacaaaa

SEQ ID NO: 35154 - RNA, 64 nt, Homo Sapiens
ccuauuuaaaugaaaggaguaaacaaaaaaaacaaaaaaaaaacaaguaaaaaaacaaaacaaa

SEQ ID NO: 35155 - RNA, 64 nt, Homo Sapiens
cccuauuuaaaugaaaggagaaaacaaaaaaaacaaaaaaaaaagaaguaaaaaaacaaaacaa

SEQ ID NO: 35156 - RNA, 64 nt, Homo Sapiens
aaaaaaaaacccuauuuaaaacaaaacaaaaaacaaaaaaaacaucgaauagggaaguaaaaaa

SEQ ID NO: 35157 - RNA, 64 nt, Homo Sapiens
cacaaaacaaaaacagaacaaaaaaacaaacaaaaaaaaaaacaucucccccaccccuuuuucu

SEQ ID NO: 35158 - RNA, 64 nt, Homo Sapiens
acacaaaacaaaaacagaacuaaaaaacaaacaaaaaaaaaaacuucucccccaccccuuuuuc

SEQ ID NO: 35159 - RNA, 64 nt, Homo Sapiens
cacacaaaacaaaaacagaacuaaaaaacaaacaaaaaaaaaaacuucucccccaccccuuuuu

SEQ ID NO: 35160 - RNA, 64 nt, Homo Sapiens
acacacaaaacaaaaacagaucuaaaaaacaaacaaaaaaaaaaucuucucccccaccccuuuu

SEQ ID NO: 35161 - RNA, 64 nt, Homo Sapiens
aaggacauugaguuuuaacaagcaaaaaggaaaaaaaaaaaagaacaaaucgucaggugccugg

SEQ ID NO: 35162 - RNA, 64 nt, Homo Sapiens
aaaggacauugaguuuuaacgagcaaaaaggaaaaaaaaaaaagaacaaaucgucaggugccug

SEQ ID NO: 35163 - RNA, 64 nt, Homo Sapiens
gaaaggacauugaguuuuaaggagcaaaaaggaaaaaaaaaaaagaacaaaucgucaggugccu

SEQ ID NO: 35164 - RNA, 64 nt, Homo Sapiens
agaaaggacauugaguuuuauggagcaaaaaggaaaaaaaaaaaagaacaaaucgucaggugcc

SEQ ID NO: 35165 - RNA, 64 nt, Homo Sapiens
aagaaaggacauugaguuuucuggagcaaaaaggaaaaaaaaaacagaacaaaucgucaggugc

SEQ ID NO: 35166 - RNA, 64 nt, Homo Sapiens
agagguagaagacuguagcuaaacauugaaaaaaaaaaaaaaggcccccaccccugaugcagua

SEQ ID NO: 35167 - RNA, 64 nt, Homo Sapiens
gagagguagaagacuguagcaaaacauugaaaaaaaaaaaaaagucccccaccccugaugcagu

SEQ ID NO: 35168 - RNA, 64 nt, Homo Sapiens
ggagagguagaagacuguaguaaaacauugaaaaaaaaaaaaaauucccccaccccugaugcag

SEQ ID NO: 35169 - RNA, 64 nt, Homo Sapiens
aggagagguagaagacuguaguaaaacauugaaaaaaaaaaaaauuucccccaccccugaugca

SEQ ID NO: 35170 - RNA, 64 nt, Homo Sapiens
aaggagagguagaagacuguaguaaaacauugaaaaaaaaaaaacuuucccccaccccugaugc

SEQ ID NO: 35171 - RNA, 64 nt, Homo Sapiens
aaaggagagguagaagacugcaguaaaacauugaaaaaaaaaaaacuuucccccaccccugaug

SEQ ID NO: 35172 - RNA, 64 nt, Homo Sapiens
aaaaggagagguagaagacugcaguaaaacauugaaaaaaaaaaaacuuucccccaccccugau

SEQ ID NO: 35173 - RNA, 64 nt, Homo Sapiens
auaaauaaauaacuuuuuaaaccaaaaaaaaaaaaaaaaaaagaccaaaagugcauucaaccuu

SEQ ID NO: 35174 - RNA, 64 nt, Homo Sapiens
aauaaauaaauaacuuuuuauaccaaaaaaaaaaaaaaaaaaagaccaaaagugcauucaaccu

SEQ ID NO: 35175 - RNA, 64 nt, Homo Sapiens
gaauaaauaaauaacuuuuuuuaccaaaaaaaaaaaaaaaaaaaaaccaaaagugcauucaacc

SEQ ID NO: 35176 - RNA, 64 nt, Homo Sapiens
agaauaaauaaauaacuuuucuuaccaaaaaaaaaaaaaaaaaaaaaccaaaagugcauucaac

SEQ ID NO: 35177 - RNA, 64 nt, Homo Sapiens
aagaauaaauaaauaacuuuccuuaccaaaaaaaaaaaaaaaaaaaaaccaaaagugcauucaa

SEQ ID NO: 35178 - RNA, 64 nt, Homo Sapiens
aaagaauaaauaaauaacuuaccuuaccaaaaaaaaaaaaaaaaaaaaaccaaaagugcauuca

SEQ ID NO: 35179 - RNA, 64 nt, Homo Sapiens
aaaagaauaaauaaauaacuaaccuuaccaaaaaaaaaaaaaaacaaaaaccaaaagugcauuc

SEQ ID NO: 35180 - RNA, 64 nt, Homo Sapiens
aaaaagaauaaauaaauaaccaaccuuaccaaaaaaaaaaaaaaccaaaaaccaaaagugcauu

SEQ ID NO: 35181 - RNA, 64 nt, Homo Sapiens
aaaaaagaauaaauaaauaaucaaccuuaccaaaaaaaaaaaaaaccaaaaaccaaaagugcau

SEQ ID NO: 35182 - RNA, 64 nt, Homo Sapiens
aaaaaaagaauaaauaaauauucaaccuuaccaaaaaaaaaaaagaccaaaaaccaaaagugca

SEQ ID NO: 35183 - RNA, 64 nt, Homo Sapiens
aaaaaaaagaauaaauaaauauucaaccuuaccaaaaaaaaaaaugaccaaaaaccaaaagugc

SEQ ID NO: 35184 - RNA, 64 nt, Homo Sapiens
aaaaaaaaagaauaaauaaacauucaaccuuaccaaaaaaaaaaaugaccaaaaaccaaaagug

SEQ ID NO: 35185 - RNA, 64 nt, Homo Sapiens
auuaaauuguuuuaauagugaaaccuuuguuaaaaaaaaaaaguucaaaaguucuucuggaaac

SEQ ID NO: 35186 - RNA, 64 nt, Homo Sapiens
uauuaaauuguuuuaauagucaaaccuuuguuaaaaaaaaaaagaucaaaaguucuucuggaaa

SEQ ID NO: 35187 - RNA, 64 nt, Homo Sapiens
guauuaaauuguuuuaauagacaaaccuuuguuaaaaaaaaaaacaucaaaaguucuucuggaa

SEQ ID NO: 35188 - RNA, 64 nt, Homo Sapiens
aguauuaaauuguuuuaauaaacaaaccuuuguuaaaaaaaaaaacaucaaaaguucuucugga

SEQ ID NO: 35189 - RNA, 64 nt, Homo Sapiens
uauauacuagaaguaauuguguauuaguucuaaaaaaaaaaagaugguugucagaacccugaaa

SEQ ID NO: 35190 - RNA, 64 nt, Homo Sapiens
auauauacuagaaguaauugaguauuaguucuaaaaaaaaaaaggugguugucagaacccugaa

SEQ ID NO: 35191 - RNA, 64 nt, Homo Sapiens
gauauauacuagaaguaauuaaguauuaguucuaaaaaaaaaaaugugguugucagaacccuga

SEQ ID NO: 35192 - RNA, 64 nt, Homo Sapiens
agauauauacuagaaguaauaaaguauuaguucuaaaaaaaaaaaugugguugucagaacccug

SEQ ID NO: 35193 - RNA, 64 nt, Homo Sapiens
aacuaaaccaagaugcugugaagcauugcguuaaaaaaaaaauucaugccacgcauuguuuuua

SEQ ID NO: 35194 - RNA, 64 nt, Homo Sapiens
uaacuaaaccaagaugcuguaaagcauugcguuaaaaaaaaaauucaugccacgcauuguuuuu

SEQ ID NO: 35195 - RNA, 64 nt, Homo Sapiens
uuaacuaaaccaagaugcuguaaagcauugcguuaaaaaaaaaaaucaugccacgcauuguuuu

SEQ ID NO: 35196 - RNA, 64 nt, Homo Sapiens
uacaaauuguguuuugcuaaaaaaaaaaaaauuuaaaaaaaaucauuguaguugacuuuuuaaa

SEQ ID NO: 35197 - RNA, 64 nt, Homo Sapiens
uaaaaaaaaucuacaaauuggacuuuuuaaaaaaaaaaaaaauuuggaauauagcauuguaguu

SEQ ID NO: 35198 - RNA, 64 nt, Homo Sapiens
uuaaaaaaaaucuacaaauuugacuuuuuaaaaaaaaaaaaaauauggaauauagcauuguagu

SEQ ID NO: 35199 - RNA, 64 nt, Homo Sapiens
uuuaaaaaaaaucuacaaauuugacuuuuuaaaaaaaaaaaaaagauggaauauagcauuguag

SEQ ID NO: 35200 - RNA, 64 nt, Homo Sapiens
auuuaaaaaaaaucuacaaaguugacuuuuuaaaaaaaaaaaaacgauggaauauagcauugua

SEQ ID NO: 35201 - RNA, 64 nt, Homo Sapiens
aauuuaaaaaaaaucuacaaaguugacuuuuuaaaaaaaaaaaaccgauggaauauagcauugu

SEQ ID NO: 35202 - RNA, 64 nt, Homo Sapiens
aaauuuaaaaaaaaucuacauaguugacuuuuuaaaaaaaaaaacccgauggaauauagcauug

SEQ ID NO: 35203 - RNA, 64 nt, Homo Sapiens
aaaauuuaaaaaaaaucuacguaguugacuuuuuaaaaaaaaaaucccgauggaauauagcauu

SEQ ID NO: 35204 - RNA, 64 nt, Homo Sapiens
gugcuuuuauaaagaacuuuuuucauuuguaagaaaaaaaaaugaugaaaacauucacuuggua

SEQ ID NO: 35205 - RNA, 64 nt, Homo Sapiens
ggugcuuuuauaaagaacuuauuucauuuguaagaaaaaaaaauaaugaaaacauucacuuggu

SEQ ID NO: 35206 - RNA, 64 nt, Homo Sapiens
uuuucaaaguuccauucugucaaaaaaaaaaaaaaaaaaaaauggacagagcgagacuccgucu

SEQ ID NO: 35207 - RNA, 64 nt, Homo Sapiens
guuuucaaaguuccauucugucaaaaaaaaaaaaaaaaaaaaaucgacagagcgagacuccguc

SEQ ID NO: 35208 - RNA, 64 nt, Homo Sapiens
uguuuucaaaguuccauucucucaaaaaaaaaaaaaaaaaaaaagcgacagagcgagacuccgu

SEQ ID NO: 35209 - RNA, 64 nt, Homo Sapiens
auguuuucaaaguuccauucucucaaaaaaaaaaaaaaaaaaaaggcgacagagcgagacuccg

SEQ ID NO: 35210 - RNA, 64 nt, Homo Sapiens
aauguuuucaaaguuccauugucucaaaaaaaaaaaaaaaaaaagggcgacagagcgagacucc

SEQ ID NO: 35211 - RNA, 64 nt, Homo Sapiens
aaauguuuucaaaguuccaucgucucaaaaaaaaaaaaaaaaaaugggcgacagagcgagacuc

SEQ ID NO: 35212 - RNA, 64 nt, Homo Sapiens
aaaauguuuucaaaguuccaccgucucaaaaaaaaaaaaaaaaacugggcgacagagcgagacu

SEQ ID NO: 35213 - RNA, 64 nt, Homo Sapiens
aaaaauguuuucaaaguuccuccgucucaaaaaaaaaaaaaaaaccugggcgacagagcgagac

SEQ ID NO: 35214 - RNA, 64 nt, Homo Sapiens
aaaaaauguuuucaaaguuccuccgucucaaaaaaaaaaaaaaagccugggcgacagagcgaga

SEQ ID NO: 35215 - RNA, 64 nt, Homo Sapiens
aaaaaaauguuuucaaaguuacuccgucucaaaaaaaaaaaaaaagccugggcgacagagcgag

SEQ ID NO: 35216 - RNA, 64 nt, Homo Sapiens
aaaaaaaauguuuucaaagugacuccgucucaaaaaaaaaaaaacagccugggcgacagagcga

SEQ ID NO: 35217 - RNA, 64 nt, Homo Sapiens
aaaaaaaaauguuuucaaagagacuccgucucaaaaaaaaaaaaccagccugggcgacagagcg

SEQ ID NO: 35218 - RNA, 64 nt, Homo Sapiens
aaaaaaaaaauguuuucaaagagacuccgucucaaaaaaaaaaauccagccugggcgacagagc

SEQ ID NO: 35219 - RNA, 64 nt, Homo Sapiens
aaaaaaaaaaauguuuucaacgagacuccgucucaaaaaaaaaacuccagccugggcgacagag

SEQ ID NO: 35220 - RNA, 64 nt, Homo Sapiens
uaauguuuuuaucuugagucgacucuuuuaaaaaaaaaaaaaccggggcucccuguuuuuaaga

SEQ ID NO: 35221 - RNA, 64 nt, Homo Sapiens
cuaauguuuuuaucuugaguagacucuuuuaaaaaaaaaaaaacaggggcucccuguuuuuaag

SEQ ID NO: 35222 - RNA, 64 nt, Homo Sapiens
ccuaauguuuuuaucuugaggagacucuuuuaaaaaaaaaaaaacaggggcucccuguuuuuaa

SEQ ID NO: 35223 - RNA, 64 nt, Homo Sapiens
accuaauguuuuuaucuugaagagacucuuuuaaaaaaaaaaaaucaggggcucccuguuuuua

SEQ ID NO: 35224 - RNA, 64 nt, Homo Sapiens
aaccuaauguuuuuaucuugaagagacucuuuuaaaaaaaaaaauucaggggcucccuguuuuu

SEQ ID NO: 35225 - RNA, 64 nt, Homo Sapiens
aaaccuaauguuuuuaucuuuaagagacucuuuuaaaaaaaaaaguucaggggcucccuguuuu

SEQ ID NO: 35226 - RNA, 64 nt, Homo Sapiens
aaauuauuuugaauuauucuacuugcucuuuguaaaaaaaaauaugaucuugaacagcuccugu

SEQ ID NO: 35227 - RNA, 64 nt, Homo Sapiens
aaaauuauuuugaauuauucuacuugcucuuuguaaaaaaaaauaugaucuugaacagcuccug

SEQ ID NO: 35228 - RNA, 64 nt, Homo Sapiens
ucuuuaugcuuugccaugagauuccuuuucaaggaaaaaaaaggggggaaaggacaauuuugaa

SEQ ID NO: 35229 - RNA, 64 nt, Homo Sapiens
cuucaaucauuuuuaaaauuauuggccagucaaaaaaaaaaagaacccaggucauugaaaugaa

SEQ ID NO: 35230 - RNA, 64 nt, Homo Sapiens
acuucaaucauuuuuaaaauaauuggccagucaaaaaaaaaaagaacccaggucauugaaauga

SEQ ID NO: 35231 - RNA, 64 nt, Homo Sapiens
gacuucaaucauuuuuaaaaaaauuggccagucaaaaaaaaaaacaacccaggucauugaaaug

SEQ ID NO: 35232 - RNA, 64 nt, Homo Sapiens
agacuucaaucauuuuuaaagaaauuggccagucaaaaaaaaaaccaacccaggucauugaaau

SEQ ID NO: 35233 - RNA, 64 nt, Homo Sapiens
ccuaaagcacgccuggugucgugaggaaacauuaaaaaaaaagcuucaugauauugucaaaaca

SEQ ID NO: 35234 - RNA, 64 nt, Homo Sapiens
cccuaaagcacgccugguguagugaggaaacauuaaaaaaaaaguuucaugauauugucaaaac

SEQ ID NO: 35235 - RNA, 64 nt, Homo Sapiens
acaacauaaaaauccuugcacuguuuuaacaaaaaaaaaaaacaaguaaguuauuuugcucuca

SEQ ID NO: 35236 - RNA, 64 nt, Homo Sapiens
aacaacauaaaaauccuugcacuguuuuaacaaaaaaaaaaaaccaguaaguuauuuugcucuc

SEQ ID NO: 35237 - RNA, 64 nt, Homo Sapiens
caacaacauaaaaauccuugcacuguuuuaacaaaaaaaaaaaaccaguaaguuauuuugcucu

SEQ ID NO: 35238 - RNA, 64 nt, Homo Sapiens
acaacaacauaaaaauccuuucacuguuuuaacaaaaaaaaaaauccaguaaguuauuuugcuc

SEQ ID NO: 35239 - RNA, 64 nt, Homo Sapiens
aacaacaacauaaaaauccucucacuguuuuaacaaaaaaaaaauuccaguaaguuauuuugcu

SEQ ID NO: 35240 - RNA, 64 nt, Homo Sapiens
accagcugccauagacacggagccuccgucacaaaaaaaaaaucauccugggacauguacucca

SEQ ID NO: 35241 - RNA, 64 nt, Homo Sapiens
caccagcugccauagacacgaagccuccgucacaaaaaaaaaaugauccugggacauguacucc

SEQ ID NO: 35242 - RNA, 64 nt, Homo Sapiens
ucaccagcugccauagacaccaagccuccgucacaaaaaaaaaaugauccugggacauguacuc

SEQ ID NO: 35243 - RNA, 64 nt, Homo Sapiens
aguguuuaaauaaagaccuaguguauauauuuaaaaaaaaaauccuugcugaacuaaguuuugu

SEQ ID NO: 35244 - RNA, 64 nt, Homo Sapiens
caguguuuaaauaaagaccuuguguauauauuuaaaaaaaaaauccuugcugaacuaaguuuug

SEQ ID NO: 35245 - RNA, 64 nt, Homo Sapiens
ucaguguuuaaauaaagaccguguguauauauuuaaaaaaaaaagccuugcugaacuaaguuuu

SEQ ID NO: 35246 - RNA, 64 nt, Homo Sapiens
ccaccugaaagccugucucugucucaaaaaaaaaaaaaaaaagcgggugacagagcgagauucc

SEQ ID NO: 35247 - RNA, 64 nt, Homo Sapiens
cccaccugaaagccugucuccgucucaaaaaaaaaaaaaaaaagugggugacagagcgagauuc

SEQ ID NO: 35248 - RNA, 64 nt, Homo Sapiens
gcccaccugaaagccugucuccgucucaaaaaaaaaaaaaaaaacugggugacagagcgagauu

SEQ ID NO: 35249 - RNA, 64 nt, Homo Sapiens
agcccaccugaaagccugucuccgucucaaaaaaaaaaaaaaaaccugggugacagagcgagau

SEQ ID NO: 35250 - RNA, 64 nt, Homo Sapiens
aagcccaccugaaagccuguuuccgucucaaaaaaaaaaaaaaagccugggugacagagcgaga

SEQ ID NO: 35251 - RNA, 64 nt, Homo Sapiens
aaagcccaccugaaagccugauuccgucucaaaaaaaaaaaaaaagccugggugacagagcgag

SEQ ID NO: 35252 - RNA, 64 nt, Homo Sapiens
aaaagcccaccugaaagccugauuccgucucaaaaaaaaaaaaacagccugggugacagagcga

SEQ ID NO: 35253 - RNA, 64 nt, Homo Sapiens
aaaaagcccaccugaaagccagauuccgucucaaaaaaaaaaaaccagccugggugacagagcg

SEQ ID NO: 35254 - RNA, 64 nt, Homo Sapiens
aaaaaagcccaccugaaagcgagauuccgucucaaaaaaaaaaauccagccugggugacagagc

SEQ ID NO: 35255 - RNA, 64 nt, Homo Sapiens
aaaaaaagcccaccugaaagcgagauuccgucucaaaaaaaaaacuccagccugggugacagag

SEQ ID NO: 35256 - RNA, 64 nt, Homo Sapiens
aaaccuggcagcuauagaauguuuccuuuaaaaaaaaaaaaaguuaaccacaguguaacuuaca

SEQ ID NO: 35257 - RNA, 64 nt, Homo Sapiens
uaaaccuggcagcuauagaaaguuuccuuuaaaaaaaaaaaaaguuaaccacaguguaacuuac

SEQ ID NO: 35258 - RNA, 64 nt, Homo Sapiens
guaaaccuggcagcuauagacaguuuccuuuaaaaaaaaaaaaacuuaaccacaguguaacuua

SEQ ID NO: 35259 - RNA, 64 nt, Homo Sapiens
aguaaaccuggcagcuauagacaguuuccuuuaaaaaaaaaaaaucuuaaccacaguguaacuu

SEQ ID NO: 35260 - RNA, 64 nt, Homo Sapiens
aaguaaaccuggcagcuauauacaguuuccuuuaaaaaaaaaaagucuuaaccacaguguaacu

SEQ ID NO: 35261 - RNA, 64 nt, Homo Sapiens
aaaguaaaccuggcagcuauuuacaguuuccuuuaaaaaaaaaaagucuuaaccacaguguaac

SEQ ID NO: 35262 - RNA, 64 nt, Homo Sapiens
gagggcugucugcuuuuugugucucaaaaaaaaaaaaaaaaagggggugacagagcgagacucu

SEQ ID NO: 35263 - RNA, 64 nt, Homo Sapiens
ggagggcugucugcuuuuugugucucaaaaaaaaaaaaaaaaagugggugacagagcgagacuc

SEQ ID NO: 35264 - RNA, 64 nt, Homo Sapiens
gggagggcugucugcuuuuucugucucaaaaaaaaaaaaaaaaacugggugacagagcgagacu

SEQ ID NO: 35265 - RNA, 64 nt, Homo Sapiens
agggagggcugucugcuuuuucugucucaaaaaaaaaaaaaaaaccugggugacagagcgagac

SEQ ID NO: 35266 - RNA, 64 nt, Homo Sapiens
aagggagggcugucugcuuucucugucucaaaaaaaaaaaaaaagccugggugacagagcgaga

SEQ ID NO: 35267 - RNA, 64 nt, Homo Sapiens
aaagggagggcugucugcuuacucugucucaaaaaaaaaaaaaaagccugggugacagagcgag

SEQ ID NO: 35268 - RNA, 64 nt, Homo Sapiens
aaaagggagggcugucugcugacucugucucaaaaaaaaaaaaacagccugggugacagagcga

SEQ ID NO: 35269 - RNA, 64 nt, Homo Sapiens
aaaaagggagggcugucugcagacucugucucaaaaaaaaaaaaacagccugggugacagagcg

SEQ ID NO: 35270 - RNA, 64 nt, Homo Sapiens
aaaaaagggagggcugucuggagacucugucucaaaaaaaaaaauacagccugggugacagagc

SEQ ID NO: 35271 - RNA, 64 nt, Homo Sapiens
aaaaaaagggagggcugucucgagacucugucucaaaaaaaaaacuacagccugggugacagag

SEQ ID NO: 35272 - RNA, 64 nt, Homo Sapiens
ucacuuaggucagcacucccuguauuuggcauuaaaaaaaaaugauuaaaagcuuggagauuac

SEQ ID NO: 35273 - RNA, 64 nt, Homo Sapiens
gucacuuaggucagcacucccuguauuuggcauuaaaaaaaaaucauuaaaagcuuggagauua

SEQ ID NO: 35274 - RNA, 64 nt, Homo Sapiens
aggagcccuugaaucugagagacagagaaaaaaaaaaaaaaagacaaugcacuccagccugggc

SEQ ID NO: 35275 - RNA, 64 nt, Homo Sapiens
aaggagcccuugaaucugagcgacagagaaaaaaaaaaaaaaagccaaugcacuccagccuggg

SEQ ID NO: 35276 - RNA, 64 nt, Homo Sapiens
gaaggagcccuugaaucugagcgacagagaaaaaaaaaaaaaaagccaaugcacuccagccugg

SEQ ID NO: 35277 - RNA, 64 nt, Homo Sapiens
agaaggagcccuugaaucugggcgacagagaaaaaaaaaaaaaacgccaaugcacuccagccug

SEQ ID NO: 35278 - RNA, 64 nt, Homo Sapiens
aagaaggagcccuugaaucugggcgacagagaaaaaaaaaaaaagcgccaaugcacuccagccu

SEQ ID NO: 35279 - RNA, 64 nt, Homo Sapiens
aaagaaggagcccuugaaucugggcgacagagaaaaaaaaaaaacgcgccaaugcacuccagcc

SEQ ID NO: 35280 - RNA, 64 nt, Homo Sapiens
aaaagaaggagcccuugaaucugggcgacagagaaaaaaaaaaaucgcgccaaugcacuccagc

SEQ ID NO: 35281 - RNA, 64 nt, Homo Sapiens
aaaaagaaggagcccuugaaccugggcgacagagaaaaaaaaaaaucgcgccaaugcacuccag

SEQ ID NO: 35282 - RNA, 64 nt, Homo Sapiens
ggagcaguggcauuuccaugaacacacuaccuuaaaaaaaaaguugcugaaauaaagcucaauc

SEQ ID NO: 35283 - RNA, 64 nt, Homo Sapiens
uggagcaguggcauuuccaucaacacacuaccuuaaaaaaaaaguugcugaaauaaagcucaau

SEQ ID NO: 35284 - RNA, 64 nt, Homo Sapiens
uuguuaaaaggcuacacgaggcaaaaaaaaaaaaaaaaaaaaguuggaugucuuguuucuaugu

SEQ ID NO: 35285 - RNA, 64 nt, Homo Sapiens
uuuguuaaaaggcuacacgaugcaaaaaaaaaaaaaaaaaaaagauggaugucuuguuucuaug

SEQ ID NO: 35286 - RNA, 64 nt, Homo Sapiens
guuuguuaaaaggcuacacggugcaaaaaaaaaaaaaaaaaaaacauggaugucuuguuucuau

SEQ ID NO: 35287 - RNA, 64 nt, Homo Sapiens
aguuuguuaaaaggcuacacugugcaaaaaaaaaaaaaaaaaaaacauggaugucuuguuucua

SEQ ID NO: 35288 - RNA, 64 nt, Homo Sapiens
aaguuuguuaaaaggcuacaaugugcaaaaaaaaaaaaaaaaaacacauggaugucuuguuucu

SEQ ID NO: 35289 - RNA, 64 nt, Homo Sapiens
aaaguuuguuaaaaggcuacuaugugcaaaaaaaaaaaaaaaaaacacauggaugucuuguuuc

SEQ ID NO: 35290 - RNA, 64 nt, Homo Sapiens
aaaaguuuguuaaaaggcuacuaugugcaaaaaaaaaaaaaaaauacacauggaugucuuguuu

SEQ ID NO: 35291 - RNA, 64 nt, Homo Sapiens
aaaaaguuuguuaaaaggcuucuaugugcaaaaaaaaaaaaaaaguacacauggaugucuuguu

SEQ ID NO: 35292 - RNA, 64 nt, Homo Sapiens
aaaaaaguuuguuaaaaggcuucuaugugcaaaaaaaaaaaaaauguacacauggaugucuugu

SEQ ID NO: 35293 - RNA, 64 nt, Homo Sapiens
aaaaaaaguuuguuaaaagguuucuaugugcaaaaaaaaaaaaacuguacacauggaugucuug

SEQ ID NO: 35294 - RNA, 64 nt, Homo Sapiens
aaaaaaaaguuuguuaaaagguuucuaugugcaaaaaaaaaaaaacuguacacauggaugucuu

SEQ ID NO: 35295 - RNA, 64 nt, Homo Sapiens
aaaaaaaaaguuuguuaaaauguuucuaugugcaaaaaaaaaaauacuguacacauggaugucu

SEQ ID NO: 35296 - RNA, 64 nt, Homo Sapiens
aaaaaaaaaaguuuguuaaauuguuucuaugugcaaaaaaaaaaauacuguacacauggauguc

SEQ ID NO: 35297 - RNA, 64 nt, Homo Sapiens
aaacccccuaugguugauaucaaaaaaaaaaaaaaaaaaaaagccccaauuuugucucauuugc

SEQ ID NO: 35298 - RNA, 64 nt, Homo Sapiens
caaacccccuaugguugauaccaaaaaaaaaaaaaaaaaaaaagucccaauuuugucucauuug

SEQ ID NO: 35299 - RNA, 64 nt, Homo Sapiens
gcaaacccccuaugguugaugccaaaaaaaaaaaaaaaaaaaaagucccaauuuugucucauuu

SEQ ID NO: 35300 - RNA, 64 nt, Homo Sapiens
agcaaacccccuaugguugaugccaaaaaaaaaaaaaaaaaaaaagucccaauuuugucucauu

SEQ ID NO: 35301 - RNA, 64 nt, Homo Sapiens
aagcaaacccccuaugguuguugccaaaaaaaaaaaaaaaaaaagagucccaauuuugucucau

SEQ ID NO: 35302 - RNA, 64 nt, Homo Sapiens
aaagcaaacccccuaugguuuuugccaaaaaaaaaaaaaaaaaaagagucccaauuuugucuca

SEQ ID NO: 35303 - RNA, 64 nt, Homo Sapiens
aaaagcaaacccccuaugguauuugccaaaaaaaaaaaaaaaaauagagucccaauuuugucuc

SEQ ID NO: 35304 - RNA, 64 nt, Homo Sapiens
aaaaagcaaacccccuauggcauuugccaaaaaaaaaaaaaaaauuagagucccaauuuugucu

SEQ ID NO: 35305 - RNA, 64 nt, Homo Sapiens
aaaaaagcaaacccccuaugucauuugccaaaaaaaaaaaaaaacuuagagucccaauuuuguc

SEQ ID NO: 35306 - RNA, 64 nt, Homo Sapiens
aaaaaaagcaaacccccuaucucauuugccaaaaaaaaaaaaaaacuuagagucccaauuuugu

SEQ ID NO: 35307 - RNA, 64 nt, Homo Sapiens
aaaaaaaagcaaacccccuaucucauuugccaaaaaaaaaaaaauacuuagagucccaauuuug

SEQ ID NO: 35308 - RNA, 64 nt, Homo Sapiens
aaaaaaaaagcaaacccccugucucauuugccaaaaaaaaaaaaauacuuagagucccaauuuu

SEQ ID NO: 35309 - RNA, 64 nt, Homo Sapiens
aaaaaaaaaagcaaacccccugucucauuugccaaaaaaaaaaaaauacuuagagucccaauuu

SEQ ID NO: 35310 - RNA, 64 nt, Homo Sapiens
aaaaaaaaaaagcaaaccccuugucucauuugccaaaaaaaaaacaauacuuagagucccaauu

SEQ ID NO: 35311 - RNA, 64 nt, Homo Sapiens
ccaauacuuagagucccaauagucauugaagagaaaaaaaaagccaauuuguugaaagggaaca

SEQ ID NO: 35312 - RNA, 64 nt, Homo Sapiens
cccaauacuuagagucccaaaagucauugaagagaaaaaaaaaggcaauuuguugaaagggaac

SEQ ID NO: 35313 - RNA, 64 nt, Homo Sapiens
caagccgugagccgaccagaaaaaaaagacaaaaaaaaaaaagcuauuuauaaaacuuaguuua

SEQ ID NO: 35314 - RNA, 64 nt, Homo Sapiens
ccaagccgugagccgaccagaaaaaaaagacaaaaaaaaaaaaguuauuuauaaaacuuaguuu

SEQ ID NO: 35315 - RNA, 64 nt, Homo Sapiens
gccaagccgugagccgaccauaaaaaaaagacaaaaaaaaaaaaauuauuuauaaaacuuaguu

SEQ ID NO: 35316 - RNA, 64 nt, Homo Sapiens
agccaagccgugagccgaccuuaaaaaaaagacaaaaaaaaaaacauuauuuauaaaacuuagu

SEQ ID NO: 35317 - RNA, 64 nt, Homo Sapiens
aagccaagccgugagccgacuuuaaaaaaaagacaaaaaaaaaaacauuauuuauaaaacuuag

SEQ ID NO: 35318 - RNA, 64 nt, Homo Sapiens
caaaaaaaaaaaagccaagcauaaaacuuaguuuaaaaaaaagaagaguuaucagacauuauuu

SEQ ID NO: 35319 - RNA, 64 nt, Homo Sapiens
ccuuucuuguaaacuuacggaaagaaaaaaaaagaaaaaaaaucaacuuugcuaguuaaaaaaa

SEQ ID NO: 35320 - RNA, 64 nt, Homo Sapiens
aaaaaaaucccuuucuuguauuaaaaaaaaaagaaaaaaaaagauauaauagaaacuuugcuag

SEQ ID NO: 35321 - RNA, 64 nt, Homo Sapiens
aaaaaaaaucccuuucuuguguuaaaaaaaaaagaaaaaaaaagguauaauagaaacuuugcua

SEQ ID NO: 35322 - RNA, 64 nt, Homo Sapiens
aaaaaaaagaaaaaaaauccacuuugcuaguuaaaaaaaaaagagggaagaaaguauaauagaa

SEQ ID NO: 35323 - RNA, 64 nt, Homo Sapiens
aaaaaaaaagaaaaaaaaucaacuuugcuaguuaaaaaaaaaagagggaagaaaguauaauaga

SEQ ID NO: 35324 - RNA, 64 nt, Homo Sapiens
gaaaaaaaaagaaaaaaaauaaacuuugcuaguuaaaaaaaaaaaagggaagaaaguauaauag

SEQ ID NO: 35325 - RNA, 64 nt, Homo Sapiens
agcaagaagaccauuugaccaaacugucuuuuagaaaaaaaacaagagcugcagaguauuuaua

SEQ ID NO: 35326 - RNA, 64 nt, Homo Sapiens
uuauuuuuagaaaaugaggacauuuaauaauaauaaaaaaaaagggauuaauagcuuuugaccu

SEQ ID NO: 35327 - RNA, 64 nt, Homo Sapiens
uauuuuuagaaaaugaggacauuuaauaauaauaaaaaaaaagggauuaauagcuuuugaccuc

SEQ ID NO: 35328 - RNA, 64 nt, Homo Sapiens
uacaguauaaacuaccucacuugccuuucuugggaaaaaaaaaaugaauggacuuuaacaauug

SEQ ID NO: 35329 - RNA, 64 nt, Homo Sapiens
acaguauaaacuaccucacuugccuuucuugggaaaaaaaaaaugaauggacuuuaacaauugu

SEQ ID NO: 35330 - RNA, 64 nt, Homo Sapiens
caguauaaacuaccucacuugccuuucuugggaaaaaaaaaaugaauggacuuuaacaauuguu

SEQ ID NO: 35331 - RNA, 64 nt, Homo Sapiens
uaugcuguuuuauaauaaauuagcaauauacuuuaaaaaaaauccaguuucuccuauaacauga

SEQ ID NO: 35332 - RNA, 64 nt, Homo Sapiens
cuguacuuggcaugcgcaauaaagcagcacauguaaaaaaaaaauacacagugcaaggacuuua

SEQ ID NO: 35333 - RNA, 64 nt, Homo Sapiens
uguacuuggcaugcgcaauaaagcagcacauguaaaaaaaaaauacacagugcaaggacuuuau

SEQ ID NO: 35334 - RNA, 64 nt, Homo Sapiens
guacuuggcaugcgcaauaaagcagcacauguaaaaaaaaaauacacagugcaaggacuuuauu

SEQ ID NO: 35335 - RNA, 64 nt, Homo Sapiens
augcacauggaggggauguaguugcauuuuugcuaaaaaaaaaaaaaaaccuuuaaaaauuguu

SEQ ID NO: 35336 - RNA, 64 nt, Homo Sapiens
ugcacauggaggggauguaguugcauuuuugcuaaaaaaaaaaaaaaaccuuuaaaaauuguug

SEQ ID NO: 35337 - RNA, 64 nt, Homo Sapiens
gcacauggaggggauguaguugcauuuuugcuaaaaaaaaaaaaaaaccuuuaaaaauuguugg

SEQ ID NO: 35338 - RNA, 64 nt, Homo Sapiens
cacauggaggggauguaguugcauuuuugcuaaaaaaaaaaaaaaaccuuuaaaaauuguugga

SEQ ID NO: 35339 - RNA, 64 nt, Homo Sapiens
acauggaggggauguaguugcauuuuugcuaaaaaaaaaaaaaaaccuuuaaaaauuguuggau

SEQ ID NO: 35340 - RNA, 64 nt, Homo Sapiens
cauggaggggauguaguugcauuuuugcuaaaaaaaaaaaaaaaccuuuaaaaauuguuggaug

SEQ ID NO: 35341 - RNA, 64 nt, Homo Sapiens
auggaggggauguaguugcauuuuugcuaaaaaaaaaaaaaaaccuuuaaaaauuguuggaugu

SEQ ID NO: 35342 - RNA, 64 nt, Homo Sapiens
uggaggggauguaguugcauuuuugcuaaaaaaaaaaaaaaaccuuuaaaaauuguuggaugug

SEQ ID NO: 35343 - RNA, 64 nt, Homo Sapiens
aggccaagaaaugaucauaccccuugccaaagguaaaaaaaaaaaaaaaaaaaugaguugaaaa

SEQ ID NO: 35344 - RNA, 64 nt, Homo Sapiens
ggccaagaaaugaucauaccccuugccaaagguaaaaaaaaaaaaaaaaaaaugaguugaaaau

SEQ ID NO: 35345 - RNA, 64 nt, Homo Sapiens
gccaagaaaugaucauaccccuugccaaagguaaaaaaaaaaaaaaaaaaaugaguugaaaauu

SEQ ID NO: 35346 - RNA, 64 nt, Homo Sapiens
ccaagaaaugaucauaccccuugccaaagguaaaaaaaaaaaaaaaaaaaugaguugaaaauug

SEQ ID NO: 35347 - RNA, 64 nt, Homo Sapiens
caagaaaugaucauaccccuugccaaagguaaaaaaaaaaaaaaaaaaaugaguugaaaauuga

SEQ ID NO: 35348 - RNA, 64 nt, Homo Sapiens
aagaaaugaucauaccccuugccaaagguaaaaaaaaaaaaaaaaaaaugaguugaaaauugaa

SEQ ID NO: 35349 - RNA, 64 nt, Homo Sapiens
agaaaugaucauaccccuugccaaagguaaaaaaaaaaaaaaaaaaaugaguugaaaauugaag

SEQ ID NO: 35350 - RNA, 64 nt, Homo Sapiens
gaaaugaucauaccccuugccaaagguaaaaaaaaaaaaaaaaaaaugaguugaaaauugaagu

SEQ ID NO: 35351 - RNA, 64 nt, Homo Sapiens
aaaugaucauaccccuugccaaagguaaaaaaaaaaaaaaaaaaaugaguugaaaauugaagug

SEQ ID NO: 35352 - RNA, 64 nt, Homo Sapiens
aaugaucauaccccuugccaaagguaaaaaaaaaaaaaaaaaaaugaguugaaaauugaaguga

SEQ ID NO: 35353 - RNA, 64 nt, Homo Sapiens
augaucauaccccuugccaaagguaaaaaaaaaaaaaaaaaaaugaguugaaaauugaagugac

SEQ ID NO: 35354 - RNA, 64 nt, Homo Sapiens
ugaucauaccccuugccaaagguaaaaaaaaaaaaaaaaaaaugaguugaaaauugaagugacc

SEQ ID NO: 35355 - RNA, 64 nt, Homo Sapiens
cauccuuacaauccugucccaugguauuuaacauaaaaaaaaauaaaacuguuaacagauucuu

SEQ ID NO: 35356 - RNA, 64 nt, Homo Sapiens
auccuuacaauccugucccaugguauuuaacauaaaaaaaaauaaaacuguuaacagauucuug

SEQ ID NO: 35357 - RNA, 64 nt, Homo Sapiens
gucauuauguucugagugugugguauguucccuuaaaaaaaaaugacacuuggaagaaaaaugu

SEQ ID NO: 35358 - RNA, 64 nt, Homo Sapiens
ucauuauguucugagugugugguauguucccuuaaaaaaaaaugacacuuggaagaaaaaugua

SEQ ID NO: 35359 - RNA, 64 nt, Homo Sapiens
aaaaugugaaguguccuuuuccuuuucacaauacaaaaaaaauuucaacagauugugugguuug

SEQ ID NO: 35360 - RNA, 64 nt, Homo Sapiens
uaaaggugauugaauauaaguaaccaugacuuguaaaaaaaaaaaaagaaagcaguuacucuug

SEQ ID NO: 35361 - RNA, 64 nt, Homo Sapiens
aaaggugauugaauauaaguaaccaugacuuguaaaaaaaaaaaaagaaagcaguuacucuugg

SEQ ID NO: 35362 - RNA, 64 nt, Homo Sapiens
aaggugauugaauauaaguaaccaugacuuguaaaaaaaaaaaaagaaagcaguuacucuugga

SEQ ID NO: 35363 - RNA, 64 nt, Homo Sapiens
aggugauugaauauaaguaaccaugacuuguaaaaaaaaaaaaagaaagcaguuacucuuggag

SEQ ID NO: 35364 - RNA, 64 nt, Homo Sapiens
ggugauugaauauaaguaaccaugacuuguaaaaaaaaaaaaagaaagcaguuacucuuggagc

SEQ ID NO: 35365 - RNA, 64 nt, Homo Sapiens
gugauugaauauaaguaaccaugacuuguaaaaaaaaaaaaagaaagcaguuacucuuggagcu

SEQ ID NO: 35366 - RNA, 64 nt, Homo Sapiens
ggccuaggugacagagggaaacuccaucuccaggaaaaaaaaaaaaaaacccaauuuggauacc

SEQ ID NO: 35367 - RNA, 64 nt, Homo Sapiens
gccuaggugacagagggaaacuccaucuccaggaaaaaaaaaaaaaaacccaauuuggauacca

SEQ ID NO: 35368 - RNA, 64 nt, Homo Sapiens
ccuaggugacagagggaaacuccaucuccaggaaaaaaaaaaaaaaacccaauuuggauaccaa

SEQ ID NO: 35369 - RNA, 64 nt, Homo Sapiens
cuaggugacagagggaaacuccaucuccaggaaaaaaaaaaaaaaacccaauuuggauaccaaa

SEQ ID NO: 35370 - RNA, 64 nt, Homo Sapiens
uaggugacagagggaaacuccaucuccaggaaaaaaaaaaaaaaacccaauuuggauaccaaau

SEQ ID NO: 35371 - RNA, 64 nt, Homo Sapiens
aggugacagagggaaacuccaucuccaggaaaaaaaaaaaaaaacccaauuuggauaccaaauu

SEQ ID NO: 35372 - RNA, 64 nt, Homo Sapiens
ggugacagagggaaacuccaucuccaggaaaaaaaaaaaaaaacccaauuuggauaccaaauua

SEQ ID NO: 35373 - RNA, 64 nt, Homo Sapiens
gugacagagggaaacuccaucuccaggaaaaaaaaaaaaaaacccaauuuggauaccaaauuaa

SEQ ID NO: 35374 - RNA, 64 nt, Homo Sapiens
agccuggcaacagaacaagacucugucuaaaaagaaaaaaaaauuuuuuuguuuaagacagcau

SEQ ID NO: 35375 - RNA, 64 nt, Homo Sapiens
gccuggcaacagaacaagacucugucuaaaaagaaaaaaaaauuuuuuuguuuaagacagcauc

SEQ ID NO: 35376 - RNA, 64 nt, Homo Sapiens
uguugcccagccugggugucaauaauuauuuuuuaaaaaaaauuuuuaaaaagguuuuuugaga

SEQ ID NO: 35377 - RNA, 64 nt, Homo Sapiens
aguuaaaaugauuuacauaggccgagcuguggacaaaaaaaaaagaagcagcagcuuguaguau

SEQ ID NO: 35378 - RNA, 64 nt, Homo Sapiens
guuaaaaugauuuacauaggccgagcuguggacaaaaaaaaaagaagcagcagcuuguaguaug

SEQ ID NO: 35379 - RNA, 64 nt, Homo Sapiens
uuaaaaugauuuacauaggccgagcuguggacaaaaaaaaaagaagcagcagcuuguaguaugc

SEQ ID NO: 35380 - RNA, 64 nt, Homo Sapiens
gauuuguagugcauagguguguguuucaagaaggaaaaaaaaagacuucuguucaaaguuaacu

SEQ ID NO: 35381 - RNA, 64 nt, Homo Sapiens
auuuguagugcauagguguguguuucaagaaggaaaaaaaaagacuucuguucaaaguuaacuu

SEQ ID NO: 35382 - RNA, 64 nt, Homo Sapiens
agaaagggcauuuuuacuuuugaaccaaaaagagaaaaaaaaaucagaaguguugcaucuugag

SEQ ID NO: 35383 - RNA, 64 nt, Homo Sapiens
gaaagggcauuuuuacuuuugaaccaaaaagagaaaaaaaaaucagaaguguugcaucuugagg

SEQ ID NO: 35384 - RNA, 64 nt, Homo Sapiens
acacuaaagauuucacaauauucauugguauuguaaaaaaaaaauacuauuguauggauuuuug

SEQ ID NO: 35385 - RNA, 64 nt, Homo Sapiens
cacuaaagauuucacaauauucauugguauuguaaaaaaaaaauacuauuguauggauuuuugu

SEQ ID NO: 35386 - RNA, 64 nt, Homo Sapiens
acuaaagauuucacaauauucauugguauuguaaaaaaaaaauacuauuguauggauuuuugua

SEQ ID NO: 35387 - RNA, 64 nt, Homo Sapiens
uccgaaaaucaugguaaagaauacugagacaaugaaaaaaaaucaacaaaauaugcuuucugga

SEQ ID NO: 35388 - RNA, 64 nt, Homo Sapiens
cuuuuauuuuccuuggggugcugaaauugagcugaaaaaaaaaggcucuuugaauauaguuuua

SEQ ID NO: 35389 - RNA, 64 nt, Homo Sapiens
uuuuauuuuccuuggggugcugaaauugagcugaaaaaaaaaggcucuuugaauauaguuuuaa

SEQ ID NO: 35390 - RNA, 64 nt, Homo Sapiens
ugcuguauuuggguauuuuucuccucuaccuucuaaaaaaaaauaccauaagaagaaucagaau

SEQ ID NO: 35391 - RNA, 64 nt, Homo Sapiens
gcuguauuuggguauuuuucuccucuaccuucuaaaaaaaaauaccauaagaagaaucagaaug

SEQ ID NO: 35392 - RNA, 64 nt, Homo Sapiens
auucucuuaacaaauuuuaaaagguagugaucuuaaaaaaaaaucacuggauaacuaggaaaua

SEQ ID NO: 35393 - RNA, 64 nt, Homo Sapiens
uucucuuaacaaauuuuaaaagguagugaucuuaaaaaaaaaucacuggauaacuaggaaauau

SEQ ID NO: 35394 - RNA, 64 nt, Homo Sapiens
ugagagaaaaggaaaaaggaaucaaagguggaagaaaaaaaaagccaaauucuguuuacgguga

SEQ ID NO: 35395 - RNA, 64 nt, Homo Sapiens
gagagaaaaggaaaaaggaaucaaagguggaagaaaaaaaaagccaaauucuguuuacggugaa

SEQ ID NO: 35396 - RNA, 64 nt, Homo Sapiens
uagagcgauuucagcugauagaaaaacaaaaaugaaaaaaaaaacacaaaaaacaaaaaacaug

SEQ ID NO: 35397 - RNA, 64 nt, Homo Sapiens
agagcgauuucagcugauagaaaaacaaaaaugaaaaaaaaaacacaaaaaacaaaaaacaugg

SEQ ID NO: 35398 - RNA, 64 nt, Homo Sapiens
gagcgauuucagcugauagaaaaacaaaaaugaaaaaaaaaacacaaaaaacaaaaaacauggc

SEQ ID NO: 35399 - RNA, 64 nt, Homo Sapiens
uuuuuacaacacuggugacagucauaugguuuugaaaaaaaaaagaaauuuugcuucuucccag

SEQ ID NO: 35400 - RNA, 64 nt, Homo Sapiens
uuuuacaacacuggugacagucauaugguuuugaaaaaaaaaagaaauuuugcuucuucccagc

SEQ ID NO: 35401 - RNA, 64 nt, Homo Sapiens
uuuacaacacuggugacagucauaugguuuugaaaaaaaaaagaaauuuugcuucuucccagcu

SEQ ID NO: 35402 - RNA, 64 nt, Homo Sapiens
gugucaugucacuaaguuuaaugcugcuguuuuuaaaaaaaaaaaaaaguuuuuuuaaaaagcc

SEQ ID NO: 35403 - RNA, 64 nt, Homo Sapiens
ugucaugucacuaaguuuaaugcugcuguuuuuaaaaaaaaaaaaaaguuuuuuuaaaaagcca

SEQ ID NO: 35404 - RNA, 64 nt, Homo Sapiens
gucaugucacuaaguuuaaugcugcuguuuuuaaaaaaaaaaaaaaguuuuuuuaaaaagccaa

SEQ ID NO: 35405 - RNA, 64 nt, Homo Sapiens
ucaugucacuaaguuuaaugcugcuguuuuuaaaaaaaaaaaaaaguuuuuuuaaaaagccaau

SEQ ID NO: 35406 - RNA, 64 nt, Homo Sapiens
caugucacuaaguuuaaugcugcuguuuuuaaaaaaaaaaaaaaguuuuuuuaaaaagccaauc

SEQ ID NO: 35407 - RNA, 64 nt, Homo Sapiens
augucacuaaguuuaaugcugcuguuuuuaaaaaaaaaaaaaaguuuuuuuaaaaagccaaucu

SEQ ID NO: 35408 - RNA, 64 nt, Homo Sapiens
ugucacuaaguuuaaugcugcuguuuuuaaaaaaaaaaaaaaguuuuuuuaaaaagccaaucua

SEQ ID NO: 35409 - RNA, 64 nt, Homo Sapiens
aggacuguaauugcauuucugugccuuucacuugaaaaaaaaaaaagaagaaaaaaaggcuuaa

SEQ ID NO: 35410 - RNA, 64 nt, Homo Sapiens
ggacuguaauugcauuucugugccuuucacuugaaaaaaaaaaaagaagaaaaaaaggcuuaaa

SEQ ID NO: 35411 - RNA, 64 nt, Homo Sapiens
gacuguaauugcauuucugugccuuucacuugaaaaaaaaaaaagaagaaaaaaaggcuuaaag

SEQ ID NO: 35412 - RNA, 64 nt, Homo Sapiens
acuguaauugcauuucugugccuuucacuugaaaaaaaaaaaagaagaaaaaaaggcuuaaagg

SEQ ID NO: 35413 - RNA, 64 nt, Homo Sapiens
cuguaauugcauuucugugccuuucacuugaaaaaaaaaaaagaagaaaaaaaggcuuaaaggc

SEQ ID NO: 35414 - RNA, 64 nt, Homo Sapiens
aacccucuggaugcugaaaaaugccacuuucggcaaaaaaaaaaguaugcaagcuauuauuuaa

SEQ ID NO: 35415 - RNA, 64 nt, Homo Sapiens
acccucuggaugcugaaaaaugccacuuucggcaaaaaaaaaaguaugcaagcuauuauuuaaa

SEQ ID NO: 35416 - RNA, 64 nt, Homo Sapiens
cccucuggaugcugaaaaaugccacuuucggcaaaaaaaaaaguaugcaagcuauuauuuaaaa

SEQ ID NO: 35417 - RNA, 64 nt, Homo Sapiens
cugaccuuucuauagcgugcugcauugguaaaugaaaaaaaauggggcaaacguuggaguccuu

SEQ ID NO: 35418 - RNA, 64 nt, Homo Sapiens
ucuaaagaaucauugucuuucagagacucauaggaaaaaaaaacuaggaaaagugucaccgcau

SEQ ID NO: 35419 - RNA, 64 nt, Homo Sapiens
cuaaagaaucauugucuuucagagacucauaggaaaaaaaaacuaggaaaagugucaccgcauu

SEQ ID NO: 35420 - RNA, 64 nt, Homo Sapiens
caaagcaagcguaagauugaggcaugaaguucagaaaaaaaaguguuacaacacacagggaagu

SEQ ID NO: 35421 - RNA, 64 nt, Homo Sapiens
uuugcagucuacauuuuaaagccaauuuauuuagaaaaaaaaauuugagcuuuaauucuuuaau

SEQ ID NO: 35422 - RNA, 64 nt, Homo Sapiens
uugcagucuacauuuuaaagccaauuuauuuagaaaaaaaaauuugagcuuuaauucuuuaauu

SEQ ID NO: 35423 - RNA, 64 nt, Homo Sapiens
uugccuugaauggaaccuacuaaaaagagagaugaaaaaaaaucagcgagguugauguagauaa

SEQ ID NO: 35424 - RNA, 64 nt, Homo Sapiens
aaagcauauuucauguuugauuuagaugacauucaaaaaaaaucaugggacugaauauaccugg

SEQ ID NO: 35425 - RNA, 64 nt, Homo Sapiens
gagaacucugcaaucuuuuaaauaagcuuccuucaaaaaaaaaagugcuuggaaaaccgccuua

SEQ ID NO: 35426 - RNA, 64 nt, Homo Sapiens
agaacucugcaaucuuuuaaauaagcuuccuucaaaaaaaaaagugcuuggaaaaccgccuuag

SEQ ID NO: 35427 - RNA, 64 nt, Homo Sapiens
gaacucugcaaucuuuuaaauaagcuuccuucaaaaaaaaaagugcuuggaaaaccgccuuagg

SEQ ID NO: 35428 - RNA, 64 nt, Homo Sapiens
gacagcuaguguuuuuuaccaaaaccaauuacugaaaaaaaauuuugaaaaaaaaaaagcacug

SEQ ID NO: 35429 - RNA, 64 nt, Homo Sapiens
acugaaaaccaauuacugaaucaucagauugaaaaaaaaaaagcuuucuaauugcaucaccuuc

SEQ ID NO: 35430 - RNA, 64 nt, Homo Sapiens
cacugaaaaccaauuacugacucaucagauugaaaaaaaaaaagcuuucuaauugcaucaccuu

SEQ ID NO: 35431 - RNA, 64 nt, Homo Sapiens
gcacugaaaaccaauuacugucucaucagauugaaaaaaaaaaaccuuucuaauugcaucaccu

SEQ ID NO: 35432 - RNA, 64 nt, Homo Sapiens
agcacugaaaaccaauuacuuucucaucagauugaaaaaaaaaauccuuucuaauugcaucacc

SEQ ID NO: 35433 - RNA, 64 nt, Homo Sapiens
acagaugugaugugcagaacaaauauauuuaaaaaaaaaaaagugagugagacuccgucucaaa

SEQ ID NO: 35434 - RNA, 64 nt, Homo Sapiens
uacagaugugaugugcagaaaaaauauauuuaaaaaaaaaaaagagagugagacuccgucucaa

SEQ ID NO: 35435 - RNA, 64 nt, Homo Sapiens
guacagaugugaugugcagaaaaaauauauuuaaaaaaaaaaaacagagugagacuccgucuca

SEQ ID NO: 35436 - RNA, 64 nt, Homo Sapiens
aguacagaugugaugugcagaaaaaauauauuuaaaaaaaaaaaacagagugagacuccgucuc

SEQ ID NO: 35437 - RNA, 64 nt, Homo Sapiens
aaguacagaugugaugugcacaaaaaauauauuuaaaaaaaaaaaacagagugagacuccgucu

SEQ ID NO: 35438 - RNA, 64 nt, Homo Sapiens
uucuccuacgagaaucaguccugacuaaggcaaaaaaaaaaagcacuguuccucgaauaaucuc

SEQ ID NO: 35439 - RNA, 64 nt, Homo Sapiens
cuucuccuacgagaaucaguccugacuaaggcaaaaaaaaaaaguacuguuccucgaauaaucu

SEQ ID NO: 35440 - RNA, 64 nt, Homo Sapiens
gcuucuccuacgagaaucaguccugacuaaggcaaaaaaaaaaauuacuguuccucgaauaauc

SEQ ID NO: 35441 - RNA, 64 nt, Homo Sapiens
agcuucuccuacgagaaucacuccugacuaaggcaaaaaaaaaauuuacuguuccucgaauaau

SEQ ID NO: 35442 - RNA, 64 nt, Homo Sapiens
ugcccagaaugcccauccugaaauucuuuuaugaaaaaaaaagaugcauuucaagcaguguugg

SEQ ID NO: 35443 - RNA, 64 nt, Homo Sapiens
augcccagaaugcccauccugaaauucuuuuaugaaaaaaaaaguugcauuucaagcaguguug

SEQ ID NO: 35444 - RNA, 64 nt, Homo Sapiens
ccugaauauucagaauagaucaucuuccaagaagaaaaaaaaugccucccaauguuaccccuuc

SEQ ID NO: 35445 - RNA, 64 nt, Homo Sapiens
aaaaaacacucaugagauaaacuuaucuuuuaaaaaaaaaaaugauuuuuuucccuugguuucu

SEQ ID NO: 35446 - RNA, 64 nt, Homo Sapiens
gaaaaaacacucaugagauauacuuaucuuuuaaaaaaaaaaauaauuuuuuucccuugguuuc

SEQ ID NO: 35447 - RNA, 64 nt, Homo Sapiens
ugaaaaaacacucaugagaucuacuuaucuuuuaaaaaaaaaaaaaauuuuuuucccuugguuu

SEQ ID NO: 35448 - RNA, 64 nt, Homo Sapiens
augaaaaaacacucaugagaucuacuuaucuuuuaaaaaaaaaauaaauuuuuuucccuugguu

SEQ ID NO: 35449 - RNA, 64 nt, Homo Sapiens
cuaugaccaaaauggcuuaaggcaagauuaaaaaaaaaaaaagaguggacuugggcccuauuca

SEQ ID NO: 35450 - RNA, 64 nt, Homo Sapiens
acuaugaccaaaauggcuuaaggcaagauuaaaaaaaaaaaaagaguggacuugggcccuauuc

SEQ ID NO: 35451 - RNA, 64 nt, Homo Sapiens
gacuaugaccaaaauggcuucaggcaagauuaaaaaaaaaaaaaaaguggacuugggcccuauu

SEQ ID NO: 35452 - RNA, 64 nt, Homo Sapiens
agacuaugaccaaaauggcuucaggcaagauuaaaaaaaaaaaacaaguggacuugggcccuau

SEQ ID NO: 35453 - RNA, 64 nt, Homo Sapiens
aagacuaugaccaaaauggcuucaggcaagauuaaaaaaaaaaaacaaguggacuugggcccua

SEQ ID NO: 35454 - RNA, 64 nt, Homo Sapiens
aaagacuaugaccaaaauggauucaggcaagauuaaaaaaaaaagacaaguggacuugggcccu

SEQ ID NO: 35455 - RNA, 64 nt, Homo Sapiens
ugacagccgcaguuggugcuugcaaaaaagaaaaaaaaaaaaggauaugucaaaagguaggaaa

SEQ ID NO: 35456 - RNA, 64 nt, Homo Sapiens
gugacagccgcaguuggugcaugcaaaaaagaaaaaaaaaaaaguauaugucaaaagguaggaa

SEQ ID NO: 35457 - RNA, 64 nt, Homo Sapiens
ggugacagccgcaguuggugaaugcaaaaaagaaaaaaaaaaaaauauaugucaaaagguagga

SEQ ID NO: 35458 - RNA, 64 nt, Homo Sapiens
aggugacagccgcaguugguaaaugcaaaaaagaaaaaaaaaaauauauaugucaaaagguagg

SEQ ID NO: 35459 - RNA, 64 nt, Homo Sapiens
aaggugacagccgcaguugggaaaugcaaaaaagaaaaaaaaaaauauauaugucaaaagguag

SEQ ID NO: 35460 - RNA, 64 nt, Homo Sapiens
uuuuaaacuggagagacuucaaaaaaaaauggaaaaaaaaaagcacuaaguguguguuuuuuua

SEQ ID NO: 35461 - RNA, 64 nt, Homo Sapiens
cuuuuaaacuggagagacuuaaaaaaaaaauggaaaaaaaaaaguacuaaguguguguuuuuuu

SEQ ID NO: 35462 - RNA, 64 nt, Homo Sapiens
gcuuuuaaacuggagagacuuaaaaaaaaaauggaaaaaaaaaacuacuaaguguguguuuuuu

SEQ ID NO: 35463 - RNA, 64 nt, Homo Sapiens
gaaaaaaaaaagcuuuuaaaguguguuuuuuuaaaaaaaaaaugcacugguggcacuacuaagu

SEQ ID NO: 35464 - RNA, 64 nt, Homo Sapiens
ggaaaaaaaaaagcuuuuaauguguguuuuuuuaaaaaaaaaauacacugguggcacuacuaag

SEQ ID NO: 35465 - RNA, 64 nt, Homo Sapiens
uggaaaaaaaaaagcuuuuaguguguguuuuuuuaaaaaaaaaagacacugguggcacuacuaa

SEQ ID NO: 35466 - RNA, 64 nt, Homo Sapiens
aaaggaaagaaagggguggcuuguaccaaaaaaaaaaaaaaagggcacaaauguuuuacauaau

SEQ ID NO: 35467 - RNA, 64 nt, Homo Sapiens
gaaaggaaagaaaggggugguuuguaccaaaaaaaaaaaaaaagagcacaaauguuuuacauaa

SEQ ID NO: 35468 - RNA, 64 nt, Homo Sapiens
ggaaaggaaagaaaggggugauuuguaccaaaaaaaaaaaaaaauagcacaaauguuuuacaua

SEQ ID NO: 35469 - RNA, 64 nt, Homo Sapiens
aggaaaggaaagaaagggguaauuuguaccaaaaaaaaaaaaaauuagcacaaauguuuuacau

SEQ ID NO: 35470 - RNA, 64 nt, Homo Sapiens
aaggaaaggaaagaaagggguaauuuguaccaaaaaaaaaaaaacuuagcacaaauguuuuaca

SEQ ID NO: 35471 - RNA, 64 nt, Homo Sapiens
aaaggaaaggaaagaaagggauaauuuguaccaaaaaaaaaaaaucuuagcacaaauguuuuac

SEQ ID NO: 35472 - RNA, 64 nt, Homo Sapiens
aaaaggaaaggaaagaaaggcauaauuuguaccaaaaaaaaaaauucuuagcacaaauguuuua

SEQ ID NO: 35473 - RNA, 64 nt, Homo Sapiens
aaaaaggaaaggaaagaaagacauaauuuguaccaaaaaaaaaaguucuuagcacaaauguuuu

SEQ ID NO: 35474 - RNA, 64 nt, Homo Sapiens
uuuaauuuugccauugaaacauuaucucuucaacaaaaaaaaccaauaucuuggugauugcuuc

SEQ ID NO: 35475 - RNA, 64 nt, Homo Sapiens
acaaaccaagaauuuuuuaagcuuuaugacuuuuaaaaaaaauuuaagucucugaaagccagug

SEQ ID NO: 35476 - RNA, 64 nt, Homo Sapiens
uuuucugaugcuuugaauauacuuuguaaaaagaaaaaaaaauugucccuaugacuuauacaua

SEQ ID NO: 35477 - RNA, 64 nt, Homo Sapiens
uuuuucugaugcuuugaauaaacuuuguaaaaagaaaaaaaaauggucccuaugacuuauacau

SEQ ID NO: 35478 - RNA, 64 nt, Homo Sapiens
ggagauuguuuucaggaauuuuuaauccauaauaaaaaaaaauggaugauaugucugacccaaa

SEQ ID NO: 35479 - RNA, 64 nt, Homo Sapiens
gggagauuguuuucaggaauauuuaauccauaauaaaaaaaaauagaugauaugucugacccaa

SEQ ID NO: 35480 - RNA, 61 nt, Homo Sapiens
aucagcacucaggucuuuuugaaauugaaaaaaaaaaaagaugaauguugugaaaguuuaa

SEQ ID NO: 35481 - RNA, 60 nt, Homo Sapiens
aaucagcacucaggucuuuugaaauugaaaaaaaaaaaagugaauguugugaaaguuuaa

SEQ ID NO: 35482 - RNA, 59 nt, Homo Sapiens
gaaucagcacucaggucuuugaaauugaaaaaaaaaaaaugaauguugugaaaguuuaa

SEQ ID NO: 35483 - RNA, 58 nt, Homo Sapiens
agaaucagcacucaggucuugaaauugaaaaaaaaaaaugaauguugugaaaguuuaa

SEQ ID NO: 35484 - RNA, 57 nt, Homo Sapiens
aagaaucagcacucaggucugaaauugaaaaaaaaaaugaauguugugaaaguuuaa

SEQ ID NO: 35485 - RNA, 64 nt, Homo Sapiens
cuucucagugaaaaaacaaguauuuuuuuaugaaaaaaaaaacacauaaaauuaucauuugaaa

SEQ ID NO: 35486 - RNA, 64 nt, Homo Sapiens
acuucucagugaaaaaacaaauauuuuuuuaugaaaaaaaaaacucauaaaauuaucauuugaa

SEQ ID NO: 35487 - RNA, 64 nt, Homo Sapiens
cacuucucagugaaaaaacaaauauuuuuuuaugaaaaaaaaaaaucauaaaauuaucauuuga

SEQ ID NO: 35488 - RNA, 64 nt, Homo Sapiens
ugaaucuuguuuucagauuuuuaaauuaaaaaaaaaaaaaaaucgauggaagacagauucugcu

SEQ ID NO: 35489 - RNA, 64 nt, Homo Sapiens
cugaaucuuguuuucagauuuuuaaauuaaaaaaaaaaaaaaauugauggaagacagauucugc

SEQ ID NO: 35490 - RNA, 64 nt, Homo Sapiens
ucugaaucuuguuuucagaucuuuaaauuaaaaaaaaaaaaaaaaugauggaagacagauucug

SEQ ID NO: 35491 - RNA, 64 nt, Homo Sapiens
aucugaaucuuguuuucagagcuuuaaauuaaaaaaaaaaaaaacaugauggaagacagauucu

SEQ ID NO: 35492 - RNA, 64 nt, Homo Sapiens
aaucugaaucuuguuuucagugcuuuaaauuaaaaaaaaaaaaaucaugauggaagacagauuc

SEQ ID NO: 35493 - RNA, 64 nt, Homo Sapiens
aaaucugaaucuuguuuucacugcuuuaaauuaaaaaaaaaaaacucaugauggaagacagauu

SEQ ID NO: 35494 - RNA, 64 nt, Homo Sapiens
aaaaucugaaucuuguuuucucugcuuuaaauuaaaaaaaaaaaucucaugauggaagacagau

SEQ ID NO: 35495 - RNA, 64 nt, Homo Sapiens
aaaaaucugaaucuuguuuuuucugcuuuaaauuaaaaaaaaaauucucaugauggaagacaga

SEQ ID NO: 35496 - RNA, 64 nt, Homo Sapiens
gugguuuuccuuguuugcaacuuggauggggagaaaaaaaaauaaauacacuauugaaaguuau

SEQ ID NO: 35497 - RNA, 64 nt, Homo Sapiens
agugguuuuccuuguuugcaucuuggauggggagaaaaaaaaauuaauacacuauugaaaguua

SEQ ID NO: 35498 - RNA, 64 nt, Homo Sapiens
aaugguggggaacuauaaaguccuggggcauuaaaaaaaaaaucauauggggguuaucuguaca

SEQ ID NO: 35499 - RNA, 64 nt, Homo Sapiens
caaugguggggaacuauaaaauccuggggcauuaaaaaaaaaauaauauggggguuaucuguac

SEQ ID NO: 35500 - RNA, 64 nt, Homo Sapiens
ucaaugguggggaacuauaacauccuggggcauuaaaaaaaaaagaauauggggguuaucugua

SEQ ID NO: 35501 - RNA, 64 nt, Homo Sapiens
uccagguguggaauaugggguugaaaaccugacaaaaaaaaaguucacuguaguuugguuuuau

SEQ ID NO: 35502 - RNA, 64 nt, Homo Sapiens
uuccagguguggaauauggguuugaaaaccugacaaaaaaaaaggucacuguaguuugguuuua

SEQ ID NO: 35503 - RNA, 64 nt, Homo Sapiens
ccagcuaaaauuuucgacuuaaaaaaaaaaaaggaaaaaaaagaugcuguaauauuuuuguaaa

SEQ ID NO: 35504 - RNA, 64 nt, Homo Sapiens
aaaaaaaagaccagcuaaaauuuuuguaaaaaaaaaaaaaaagguugcuuauacugcuguaaua

SEQ ID NO: 35505 - RNA, 64 nt, Homo Sapiens
gaaaaaaaagaccagcuaaaauuuuuguaaaaaaaaaaaaaaaguuugcuuauacugcuguaau

SEQ ID NO: 35506 - RNA, 64 nt, Homo Sapiens
ggaaaaaaaagaccagcuaauauuuuuguaaaaaaaaaaaaaaauuuugcuuauacugcuguaa

SEQ ID NO: 35507 - RNA, 64 nt, Homo Sapiens
aggaaaaaaaagaccagcuaauauuuuuguaaaaaaaaaaaaaaauuuugcuuauacugcugua

SEQ ID NO: 35508 - RNA, 64 nt, Homo Sapiens
aaggaaaaaaaagaccagcuaauauuuuuguaaaaaaaaaaaaaaauuuugcuuauacugcugu

SEQ ID NO: 35509 - RNA, 64 nt, Homo Sapiens
aaaggaaaaaaaagaccagcuaauauuuuuguaaaaaaaaaaaacaauuuugcuuauacugcug

SEQ ID NO: 35510 - RNA, 64 nt, Homo Sapiens
aaaaggaaaaaaaagaccagguaauauuuuuguaaaaaaaaaaaccaauuuugcuuauacugcu

SEQ ID NO: 35511 - RNA, 64 nt, Homo Sapiens
aaaaaggaaaaaaaagaccauguaauauuuuuguaaaaaaaaaauccaauuuugcuuauacugc

SEQ ID NO: 35512 - RNA, 64 nt, Homo Sapiens
aaaacgguaagcuuuuauauaaaacucugucucaaaaaaaaacauccagccugggcgacugaau

SEQ ID NO: 35513 - RNA, 64 nt, Homo Sapiens
aaaaacgguaagcuuuuauauaaaacucugucucaaaaaaaaaccuccagccugggcgacugaa

SEQ ID NO: 35514 - RNA, 64 nt, Homo Sapiens
augcuagguaaucuucguaguaaaaaaaaaaaaaaaaaaaaagagaaguauuguuuccuuuauu

SEQ ID NO: 35515 - RNA, 64 nt, Homo Sapiens
aaugcuagguaaucuucguauuaaaaaaaaaaaaaaaaaaaaagugaaguauuguuuccuuuau

SEQ ID NO: 35516 - RNA, 64 nt, Homo Sapiens
gaaugcuagguaaucuucguuuuaaaaaaaaaaaaaaaaaaaaaaugaaguauuguuuccuuua

SEQ ID NO: 35517 - RNA, 64 nt, Homo Sapiens
agaaugcuagguaaucuucgauuuaaaaaaaaaaaaaaaaaaaacaugaaguauuguuuccuuu

SEQ ID NO: 35518 - RNA, 64 nt, Homo Sapiens
aagaaugcuagguaaucuucuauuuaaaaaaaaaaaaaaaaaaaccaugaaguauuguuuccuu

SEQ ID NO: 35519 - RNA, 64 nt, Homo Sapiens
aaagaaugcuagguaaucuuuuauuuaaaaaaaaaaaaaaaaaauccaugaaguauuguuuccu

SEQ ID NO: 35520 - RNA, 64 nt, Homo Sapiens
aaaagaaugcuagguaaucuuuuauuuaaaaaaaaaaaaaaaaauuccaugaaguauuguuucc

SEQ ID NO: 35521 - RNA, 64 nt, Homo Sapiens
aaaaagaaugcuagguaauccuuuauuuaaaaaaaaaaaaaaaaauuccaugaaguauuguuuc

SEQ ID NO: 35522 - RNA, 64 nt, Homo Sapiens
aaaaaagaaugcuagguaauccuuuauuuaaaaaaaaaaaaaaauauuccaugaaguauuguuu

SEQ ID NO: 35523 - RNA, 64 nt, Homo Sapiens
aaaaaaagaaugcuagguaauccuuuauuuaaaaaaaaaaaaaauuauuccaugaaguauuguu

SEQ ID NO: 35524 - RNA, 64 nt, Homo Sapiens
aaaaaaaagaaugcuagguauuccuuuauuuaaaaaaaaaaaaaauuauuccaugaaguauugu

SEQ ID NO: 35525 - RNA, 64 nt, Homo Sapiens
aaaaaaaaagaaugcuagguuuuccuuuauuuaaaaaaaaaaaaaauuauuccaugaaguauug

SEQ ID NO: 35526 - RNA, 64 nt, Homo Sapiens
aaaaaaaaaagaaugcuaggguuuccuuuauuuaaaaaaaaaaagaauuauuccaugaaguauu

SEQ ID NO: 35527 - RNA, 64 nt, Homo Sapiens
aaaaaaaaaaagaaugcuaguguuuccuuuauuuaaaaaaaaaaugaauuauuccaugaaguau

SEQ ID NO: 35528 - RNA, 64 nt, Homo Sapiens
aaaaaagaaauguaccuguucgccucaaaaaaaaaaaaaaaagaugggcgacagagcgagacuc

SEQ ID NO: 35529 - RNA, 64 nt, Homo Sapiens
aaaaaaagaaauguaccuguccgccucaaaaaaaaaaaaaaaagcugggcgacagagcgagacu

SEQ ID NO: 35530 - RNA, 64 nt, Homo Sapiens
gaaaaaaagaaauguaccuguccgccucaaaaaaaaaaaaaaaaccugggcgacagagcgagac

SEQ ID NO: 35531 - RNA, 64 nt, Homo Sapiens
agaaaaaaagaaauguaccucuccgccucaaaaaaaaaaaaaaagccugggcgacagagcgaga

SEQ ID NO: 35532 - RNA, 64 nt, Homo Sapiens
aagaaaaaaagaaauguaccacuccgccucaaaaaaaaaaaaaaagccugggcgacagagcgag

SEQ ID NO: 35533 - RNA, 64 nt, Homo Sapiens
aaagaaaaaaagaaauguacgacuccgccucaaaaaaaaaaaaacagccugggcgacagagcga

SEQ ID NO: 35534 - RNA, 64 nt, Homo Sapiens
aaaagaaaaaaagaaauguaagacuccgccucaaaaaaaaaaaaccagccugggcgacagagcg

SEQ ID NO: 35535 - RNA, 64 nt, Homo Sapiens
aaaaagaaaaaaagaaaugugagacuccgccucaaaaaaaaaaauccagccugggcgacagagc

SEQ ID NO: 35536 - RNA, 64 nt, Homo Sapiens
aaaaaagaaaaaaagaaaugcgagacuccgccucaaaaaaaaaacuccagccugggcgacagag

SEQ ID NO: 35537 - RNA, 64 nt, Homo Sapiens
acaaaaaauuagccgggcgucccgucucuacuaaaaaaaaaaguccuggcuaacacggugaaac

SEQ ID NO: 35538 - RNA, 64 nt, Homo Sapiens
uacaaaaaauuagccgggcgccccgucucuacuaaaaaaaaaaguccuggcuaacacggugaaa

SEQ ID NO: 35539 - RNA, 64 nt, Homo Sapiens
guacaaaaaauuagccgggcaccccgucucuacuaaaaaaaaaaauccuggcuaacacggugaa

SEQ ID NO: 35540 - RNA, 64 nt, Homo Sapiens
ugcuaauaaaacuucccuccucccuugggggaaaaaaaaaaaugucuccuccuccuccuccucu

SEQ ID NO: 35541 - RNA, 64 nt, Homo Sapiens
gugcuaauaaaacuucccucuucccuugggggaaaaaaaaaaauuucuccuccuccuccuccuc

SEQ ID NO: 35542 - RNA, 64 nt, Homo Sapiens
ugugcuaauaaaacuucccucuucccuugggggaaaaaaaaaaacuucuccuccuccuccuccu

SEQ ID NO: 35543 - RNA, 64 nt, Homo Sapiens
augugcuaauaaaacuucccucuucccuugggggaaaaaaaaaaccuucuccuccuccuccucc

SEQ ID NO: 35544 - RNA, 64 nt, Homo Sapiens
aacauggugaaacccugucucuacuaaaaauacgaaaaaaaaaaaaagcugggcugugguggca

SEQ ID NO: 35545 - RNA, 64 nt, Homo Sapiens
acauggugaaacccugucucuacuaaaaauacgaaaaaaaaaaaaagcugggcugugguggcag

SEQ ID NO: 35546 - RNA, 64 nt, Homo Sapiens
cauggugaaacccugucucuacuaaaaauacgaaaaaaaaaaaaagcugggcugugguggcagg

SEQ ID NO: 35547 - RNA, 64 nt, Homo Sapiens
auggugaaacccugucucuacuaaaaauacgaaaaaaaaaaaaagcugggcugugguggcaggc

SEQ ID NO: 35548 - RNA, 64 nt, Homo Sapiens
uggugaaacccugucucuacuaaaaauacgaaaaaaaaaaaaagcugggcugugguggcaggcg

SEQ ID NO: 35549 - RNA, 64 nt, Homo Sapiens
ggugaaacccugucucuacuaaaaauacgaaaaaaaaaaaaagcugggcugugguggcaggcgc

SEQ ID NO: 35550 - RNA, 64 nt, Homo Sapiens
aggauuuuggguuuuguuuuguuuucauuuuuccaaaaaaaaaagaaaaaaaaauagaaaaaaa

SEQ ID NO: 35551 - RNA, 64 nt, Homo Sapiens
ggauuuuggguuuuguuuuguuuucauuuuuccaaaaaaaaaagaaaaaaaaauagaaaaaaaa

SEQ ID NO: 35552 - RNA, 64 nt, Homo Sapiens
gauuuuggguuuuguuuuguuuucauuuuuccaaaaaaaaaagaaaaaaaaauagaaaaaaaag

SEQ ID NO: 35553 - RNA, 64 nt, Homo Sapiens
uuuuguuuuguuuucauuuuuccaaaaaaaaaagaaaaaaaaauagaaaaaaaaggaguaaaag

SEQ ID NO: 35554 - RNA, 64 nt, Homo Sapiens
uuuguuuuguuuucauuuuuccaaaaaaaaaagaaaaaaaaauagaaaaaaaaggaguaaaagg

SEQ ID NO: 35555 - RNA, 64 nt, Homo Sapiens
uucauuuuuccaaaaaaaaaagaaaaaaaaauagaaaaaaaaggaguaaaaggggcggguuugu

SEQ ID NO: 35556 - RNA, 64 nt, Homo Sapiens
uggcgugaguuucauguaugaaaacauaaaauugaaaaaaaaaaaaaaaccuacacgagcaccg

SEQ ID NO: 35557 - RNA, 64 nt, Homo Sapiens
ggcgugaguuucauguaugaaaacauaaaauugaaaaaaaaaaaaaaaccuacacgagcaccgu

SEQ ID NO: 35558 - RNA, 64 nt, Homo Sapiens
gcgugaguuucauguaugaaaacauaaaauugaaaaaaaaaaaaaaaccuacacgagcaccgug

SEQ ID NO: 35559 - RNA, 64 nt, Homo Sapiens
cgugaguuucauguaugaaaacauaaaauugaaaaaaaaaaaaaaaccuacacgagcaccguga

SEQ ID NO: 35560 - RNA, 64 nt, Homo Sapiens
gugaguuucauguaugaaaacauaaaauugaaaaaaaaaaaaaaaccuacacgagcaccgugau

SEQ ID NO: 35561 - RNA, 64 nt, Homo Sapiens
ugaguuucauguaugaaaacauaaaauugaaaaaaaaaaaaaaaccuacacgagcaccgugauu

SEQ ID NO: 35562 - RNA, 64 nt, Homo Sapiens
gaguuucauguaugaaaacauaaaauugaaaaaaaaaaaaaaaccuacacgagcaccgugauuu

SEQ ID NO: 35563 - RNA, 64 nt, Homo Sapiens
aguuucauguaugaaaacauaaaauugaaaaaaaaaaaaaaaccuacacgagcaccgugauuuc

SEQ ID NO: 35564 - RNA, 64 nt, Homo Sapiens
uuaaauauuucuuucucuaacccaucagcacaauaaaaaaaagucacugguucaacaacagggu

SEQ ID NO: 35565 - RNA, 64 nt, Homo Sapiens
auaaaaaaaagucacugguucaacaacaggguuuaaaaaaaaugucuucagcuuuaauucaaaa

SEQ ID NO: 35566 - RNA, 64 nt, Homo Sapiens
aagagcauuaacuauuuaaaacaaggaaaagaggaaaaaaaaaacagaggcccgcccuacccca

SEQ ID NO: 35567 - RNA, 64 nt, Homo Sapiens
agagcauuaacuauuuaaaacaaggaaaagaggaaaaaaaaaacagaggcccgcccuaccccac

SEQ ID NO: 35568 - RNA, 64 nt, Homo Sapiens
gagcauuaacuauuuaaaacaaggaaaagaggaaaaaaaaaacagaggcccgcccuaccccacu

SEQ ID NO: 35569 - RNA, 64 nt, Homo Sapiens
cuuaauguucaaaacgccucucuuuggucuggagaaaaaaaaaaaaaaaaaaaaacaacuaaaa

SEQ ID NO: 35570 - RNA, 64 nt, Homo Sapiens
uuaauguucaaaacgccucucuuuggucuggagaaaaaaaaaaaaaaaaaaaaacaacuaaaaa

SEQ ID NO: 35571 - RNA, 64 nt, Homo Sapiens
uaauguucaaaacgccucucuuuggucuggagaaaaaaaaaaaaaaaaaaaaacaacuaaaaau

SEQ ID NO: 35572 - RNA, 64 nt, Homo Sapiens
aauguucaaaacgccucucuuuggucuggagaaaaaaaaaaaaaaaaaaaaacaacuaaaaauu

SEQ ID NO: 35573 - RNA, 64 nt, Homo Sapiens
auguucaaaacgccucucuuuggucuggagaaaaaaaaaaaaaaaaaaaaacaacuaaaaauuu

SEQ ID NO: 35574 - RNA, 64 nt, Homo Sapiens
uguucaaaacgccucucuuuggucuggagaaaaaaaaaaaaaaaaaaaaacaacuaaaaauuua

SEQ ID NO: 35575 - RNA, 64 nt, Homo Sapiens
guucaaaacgccucucuuuggucuggagaaaaaaaaaaaaaaaaaaaaacaacuaaaaauuuau

SEQ ID NO: 35576 - RNA, 64 nt, Homo Sapiens
uucaaaacgccucucuuuggucuggagaaaaaaaaaaaaaaaaaaaaacaacuaaaaauuuauu

SEQ ID NO: 35577 - RNA, 64 nt, Homo Sapiens
ucaaaacgccucucuuuggucuggagaaaaaaaaaaaaaaaaaaaaacaacuaaaaauuuauuu

SEQ ID NO: 35578 - RNA, 64 nt, Homo Sapiens
caaaacgccucucuuuggucuggagaaaaaaaaaaaaaaaaaaaaacaacuaaaaauuuauuua

SEQ ID NO: 35579 - RNA, 64 nt, Homo Sapiens
aaaacgccucucuuuggucuggagaaaaaaaaaaaaaaaaaaaaacaacuaaaaauuuauuuaa

SEQ ID NO: 35580 - RNA, 64 nt, Homo Sapiens
aaacgccucucuuuggucuggagaaaaaaaaaaaaaaaaaaaaacaacuaaaaauuuauuuaau

SEQ ID NO: 35581 - RNA, 64 nt, Homo Sapiens
aacgccucucuuuggucuggagaaaaaaaaaaaaaaaaaaaaacaacuaaaaauuuauuuaaua

SEQ ID NO: 35582 - RNA, 64 nt, Homo Sapiens
acgccucucuuuggucuggagaaaaaaaaaaaaaaaaaaaaacaacuaaaaauuuauuuaauaa

SEQ ID NO: 35583 - RNA, 64 nt, Homo Sapiens
caccuguaccucuggacucuccuaucgggggauuaaaaaaaaaaguaaaaugacaaaaaaagau

SEQ ID NO: 35584 - RNA, 64 nt, Homo Sapiens
accuguaccucuggacucuccuaucgggggauuaaaaaaaaaaguaaaaugacaaaaaaagaua

SEQ ID NO: 35585 - RNA, 64 nt, Homo Sapiens
ccuguaccucuggacucuccuaucgggggauuaaaaaaaaaaguaaaaugacaaaaaaagauac

SEQ ID NO: 35586 - RNA, 64 nt, Homo Sapiens
uuugugaggcucuuucuauaaauacauauuguuuaaaaaaaagcaagaaaaaaaggaaaacaaa

SEQ ID NO: 35587 - RNA, 64 nt, Homo Sapiens
uccagccugggcaacagagcgagacccugucuccaaaaaaaaaaaaaagcaauguuuauauuau

SEQ ID NO: 35588 - RNA, 64 nt, Homo Sapiens
ccagccugggcaacagagcgagacccugucuccaaaaaaaaaaaaaagcaauguuuauauuaua

SEQ ID NO: 35589 - RNA, 64 nt, Homo Sapiens
cagccugggcaacagagcgagacccugucuccaaaaaaaaaaaaaagcaauguuuauauuauaa

SEQ ID NO: 35590 - RNA, 64 nt, Homo Sapiens
agccugggcaacagagcgagacccugucuccaaaaaaaaaaaaaagcaauguuuauauuauaaa

SEQ ID NO: 35591 - RNA, 64 nt, Homo Sapiens
gccugggcaacagagcgagacccugucuccaaaaaaaaaaaaaagcaauguuuauauuauaaaa

SEQ ID NO: 35592 - RNA, 64 nt, Homo Sapiens
ccugggcaacagagcgagacccugucuccaaaaaaaaaaaaaagcaauguuuauauuauaaaag

SEQ ID NO: 35593 - RNA, 64 nt, Homo Sapiens
cugggcaacagagcgagacccugucuccaaaaaaaaaaaaaagcaauguuuauauuauaaaaga

SEQ ID NO: 35594 - RNA, 64 nt, Homo Sapiens
cauccuaaccucagaaacugaaauaaagccuuugaaaaaaaaaucuguaaaacaucaaccccca

SEQ ID NO: 35595 - RNA, 64 nt, Homo Sapiens
auccuaaccucagaaacugaaauaaagccuuugaaaaaaaaaucuguaaaacaucaacccccaa

SEQ ID NO: 35596 - RNA, 64 nt, Homo Sapiens
cggcuccggccauuuuguuuuauacaaaaaugggaaaaaaaaaaaagaaauuauauaaaguucc

SEQ ID NO: 35597 - RNA, 64 nt, Homo Sapiens
ggcuccggccauuuuguuuuauacaaaaaugggaaaaaaaaaaaagaaauuauauaaaguuccu

SEQ ID NO: 35598 - RNA, 64 nt, Homo Sapiens
gcuccggccauuuuguuuuauacaaaaaugggaaaaaaaaaaaagaaauuauauaaaguuccua

SEQ ID NO: 35599 - RNA, 64 nt, Homo Sapiens
cuccggccauuuuguuuuauacaaaaaugggaaaaaaaaaaaagaaauuauauaaaguuccuag

SEQ ID NO: 35600 - RNA, 64 nt, Homo Sapiens
uccggccauuuuguuuuauacaaaaaugggaaaaaaaaaaaagaaauuauauaaaguuccuaga

SEQ ID NO: 35601 - RNA, 64 nt, Homo Sapiens
agccuggguaacauagcgagaccccaccucugccaaaaaaaaaaaaaauaggguauccaaauau

SEQ ID NO: 35602 - RNA, 64 nt, Homo Sapiens
gccuggguaacauagcgagaccccaccucugccaaaaaaaaaaaaaauaggguauccaaauauc

SEQ ID NO: 35603 - RNA, 64 nt, Homo Sapiens
ccuggguaacauagcgagaccccaccucugccaaaaaaaaaaaaaauaggguauccaaauaucu

SEQ ID NO: 35604 - RNA, 64 nt, Homo Sapiens
cuggguaacauagcgagaccccaccucugccaaaaaaaaaaaaaauaggguauccaaauaucua

SEQ ID NO: 35605 - RNA, 64 nt, Homo Sapiens
uggguaacauagcgagaccccaccucugccaaaaaaaaaaaaaauaggguauccaaauaucuag

SEQ ID NO: 35606 - RNA, 64 nt, Homo Sapiens
ggguaacauagcgagaccccaccucugccaaaaaaaaaaaaaauaggguauccaaauaucuaga

SEQ ID NO: 35607 - RNA, 64 nt, Homo Sapiens
gguaacauagcgagaccccaccucugccaaaaaaaaaaaaaauaggguauccaaauaucuagau

SEQ ID NO: 35608 - RNA, 64 nt, Homo Sapiens
guggacaagaaaaaauaacaaaacaaaaaacaagaaaaaaaaaacacaaaaccccguaaaauca

SEQ ID NO: 35609 - RNA, 64 nt, Homo Sapiens
uggacaagaaaaaauaacaaaacaaaaaacaagaaaaaaaaaacacaaaaccccguaaaaucac

SEQ ID NO: 35610 - RNA, 64 nt, Homo Sapiens
ggacaagaaaaaauaacaaaacaaaaaacaagaaaaaaaaaacacaaaaccccguaaaaucaca

SEQ ID NO: 35611 - RNA, 64 nt, Homo Sapiens
cccaaaccuggggagagagcuagacucuugucucaaaaaaaaaaaaaaaaaaaaaaaaaaagcu

SEQ ID NO: 35612 - RNA, 64 nt, Homo Sapiens
ccaaaccuggggagagagcuagacucuugucucaaaaaaaaaaaaaaaaaaaaaaaaaaagcuc

SEQ ID NO: 35613 - RNA, 64 nt, Homo Sapiens
caaaccuggggagagagcuagacucuugucucaaaaaaaaaaaaaaaaaaaaaaaaaaagcucc

SEQ ID NO: 35614 - RNA, 64 nt, Homo Sapiens
aaaccuggggagagagcuagacucuugucucaaaaaaaaaaaaaaaaaaaaaaaaaaagcucca

SEQ ID NO: 35615 - RNA, 64 nt, Homo Sapiens
aaccuggggagagagcuagacucuugucucaaaaaaaaaaaaaaaaaaaaaaaaaaagcuccaa

SEQ ID NO: 35616 - RNA, 64 nt, Homo Sapiens
accuggggagagagcuagacucuugucucaaaaaaaaaaaaaaaaaaaaaaaaaaagcuccaaa

SEQ ID NO: 35617 - RNA, 64 nt, Homo Sapiens
ccuggggagagagcuagacucuugucucaaaaaaaaaaaaaaaaaaaaaaaaaaagcuccaaag

SEQ ID NO: 35618 - RNA, 64 nt, Homo Sapiens
cuggggagagagcuagacucuugucucaaaaaaaaaaaaaaaaaaaaaaaaaaagcuccaaagu

SEQ ID NO: 35619 - RNA, 64 nt, Homo Sapiens
uggggagagagcuagacucuugucucaaaaaaaaaaaaaaaaaaaaaaaaaaagcuccaaaguc

SEQ ID NO: 35620 - RNA, 64 nt, Homo Sapiens
ggggagagagcuagacucuugucucaaaaaaaaaaaaaaaaaaaaaaaaaaagcuccaaaguca

SEQ ID NO: 35621 - RNA, 64 nt, Homo Sapiens
gggagagagcuagacucuugucucaaaaaaaaaaaaaaaaaaaaaaaaaaagcuccaaagucac

SEQ ID NO: 35622 - RNA, 64 nt, Homo Sapiens
ggagagagcuagacucuugucucaaaaaaaaaaaaaaaaaaaaaaaaaaagcuccaaagucacc

SEQ ID NO: 35623 - RNA, 64 nt, Homo Sapiens
gagagagcuagacucuugucucaaaaaaaaaaaaaaaaaaaaaaaaaaagcuccaaagucaccu

SEQ ID NO: 35624 - RNA, 64 nt, Homo Sapiens
agagagcuagacucuugucucaaaaaaaaaaaaaaaaaaaaaaaaaaagcuccaaagucaccuc

SEQ ID NO: 35625 - RNA, 64 nt, Homo Sapiens
gagagcuagacucuugucucaaaaaaaaaaaaaaaaaaaaaaaaaaagcuccaaagucaccucu

SEQ ID NO: 35626 - RNA, 64 nt, Homo Sapiens
agagcuagacucuugucucaaaaaaaaaaaaaaaaaaaaaaaaaaagcuccaaagucaccucug

SEQ ID NO: 35627 - RNA, 64 nt, Homo Sapiens
gagcuagacucuugucucaaaaaaaaaaaaaaaaaaaaaaaaaaagcuccaaagucaccucugu

SEQ ID NO: 35628 - RNA, 64 nt, Homo Sapiens
agcuagacucuugucucaaaaaaaaaaaaaaaaaaaaaaaaaaagcuccaaagucaccucuguc

SEQ ID NO: 35629 - RNA, 64 nt, Homo Sapiens
gcuagacucuugucucaaaaaaaaaaaaaaaaaaaaaaaaaaagcuccaaagucaccucuguca

SEQ ID NO: 35630 - RNA, 64 nt, Homo Sapiens
cuagacucuugucucaaaaaaaaaaaaaaaaaaaaaaaaaaagcuccaaagucaccucugucaa

SEQ ID NO: 35631 - RNA, 64 nt, Homo Sapiens
aauuguaacauuuuuagaaaaagaacaaaaaaagaaaaaaaaaagaaagaaacacagcaacugu

SEQ ID NO: 35632 - RNA, 64 nt, Homo Sapiens
auuguaacauuuuuagaaaaagaacaaaaaaagaaaaaaaaaagaaagaaacacagcaacugua

SEQ ID NO: 35633 - RNA, 64 nt, Homo Sapiens
uuguaacauuuuuagaaaaagaacaaaaaaagaaaaaaaaaagaaagaaacacagcaacuguag

SEQ ID NO: 35634 - RNA, 64 nt, Homo Sapiens
gucuggccugggcgacagagcgagacuccgucucaaaaaaaaaaaacaaaaaaaaaccaugcau

SEQ ID NO: 35635 - RNA, 64 nt, Homo Sapiens
ucuggccugggcgacagagcgagacuccgucucaaaaaaaaaaaacaaaaaaaaaccaugcaug

SEQ ID NO: 35636 - RNA, 64 nt, Homo Sapiens
cuggccugggcgacagagcgagacuccgucucaaaaaaaaaaaacaaaaaaaaaccaugcaugg

SEQ ID NO: 35637 - RNA, 64 nt, Homo Sapiens
uggccugggcgacagagcgagacuccgucucaaaaaaaaaaaacaaaaaaaaaccaugcauggu

SEQ ID NO: 35638 - RNA, 64 nt, Homo Sapiens
ggccugggcgacagagcgagacuccgucucaaaaaaaaaaaacaaaaaaaaaccaugcauggug

SEQ ID NO: 35639 - RNA, 64 nt, Homo Sapiens
gacagagcgagacuccgucucaaaaaaaaaaaacaaaaaaaaaccaugcauggugcaucagcag

SEQ ID NO: 35640 - RNA, 64 nt, Homo Sapiens
acagagcgagacuccgucucaaaaaaaaaaaacaaaaaaaaaccaugcauggugcaucagcagc

SEQ ID NO: 35641 - RNA, 64 nt, Homo Sapiens
ccagugugcaaaacauagcaagaccucaucucagaaaaaaaaaaaaagucauuugaaaacuucu

SEQ ID NO: 35642 - RNA, 64 nt, Homo Sapiens
cagugugcaaaacauagcaagaccucaucucagaaaaaaaaaaaaagucauuugaaaacuucua

SEQ ID NO: 35643 - RNA, 64 nt, Homo Sapiens
agugugcaaaacauagcaagaccucaucucagaaaaaaaaaaaaagucauuugaaaacuucuaa

SEQ ID NO: 35644 - RNA, 64 nt, Homo Sapiens
gugugcaaaacauagcaagaccucaucucagaaaaaaaaaaaaagucauuugaaaacuucuaau

SEQ ID NO: 35645 - RNA, 64 nt, Homo Sapiens
ugugcaaaacauagcaagaccucaucucagaaaaaaaaaaaaagucauuugaaaacuucuaaua

SEQ ID NO: 35646 - RNA, 64 nt, Homo Sapiens
gugcaaaacauagcaagaccucaucucagaaaaaaaaaaaaagucauuugaaaacuucuaauac

SEQ ID NO: 35647 - RNA, 64 nt, Homo Sapiens
guguguuuguucuuuuuauugaaucuauuuaaguaaaaaaaaaauugguucuuuauuaauuucu

SEQ ID NO: 35648 - RNA, 64 nt, Homo Sapiens
uguguuuguucuuuuuauugaaucuauuuaaguaaaaaaaaaauugguucuuuauuaauuucug

SEQ ID NO: 35649 - RNA, 64 nt, Homo Sapiens
guguuuguucuuuuuauugaaucuauuuaaguaaaaaaaaaauugguucuuuauuaauuucugu

SEQ ID NO: 35650 - RNA, 64 nt, Homo Sapiens
aauauauauauauucauguuuauuuaagaaauggaaaaaaaaaucaaaaaucuuaaaaaaacaa

SEQ ID NO: 35651 - RNA, 64 nt, Homo Sapiens
auauauauauauucauguuuauuuaagaaauggaaaaaaaaaucaaaaaucuuaaaaaaacaag

SEQ ID NO: 35652 - RNA, 64 nt, Homo Sapiens
cagugaugaccucagccuagggacaccaaaaaagaaaaaaaaaaaaacccaaaccaaaaacgca

SEQ ID NO: 35653 - RNA, 64 nt, Homo Sapiens
agugaugaccucagccuagggacaccaaaaaagaaaaaaaaaaaaacccaaaccaaaaacgcaa

SEQ ID NO: 35654 - RNA, 64 nt, Homo Sapiens
gugaugaccucagccuagggacaccaaaaaagaaaaaaaaaaaaacccaaaccaaaaacgcaaa

SEQ ID NO: 35655 - RNA, 64 nt, Homo Sapiens
ugaugaccucagccuagggacaccaaaaaagaaaaaaaaaaaaacccaaaccaaaaacgcaaac

SEQ ID NO: 35656 - RNA, 64 nt, Homo Sapiens
gaugaccucagccuagggacaccaaaaaagaaaaaaaaaaaaacccaaaccaaaaacgcaaacc

SEQ ID NO: 35657 - RNA, 64 nt, Homo Sapiens
augaccucagccuagggacaccaaaaaagaaaaaaaaaaaaacccaaaccaaaaacgcaaacca

SEQ ID NO: 35658 - RNA, 64 nt, Homo Sapiens
gggcaacaggagauguggggacguguuaggagagaaaaaaaaaaaaacaaaaauauauaugggg

SEQ ID NO: 35659 - RNA, 64 nt, Homo Sapiens
ggcaacaggagauguggggacguguuaggagagaaaaaaaaaaaaacaaaaauauauauggggg

SEQ ID NO: 35660 - RNA, 64 nt, Homo Sapiens
gcaacaggagauguggggacguguuaggagagaaaaaaaaaaaaacaaaaauauauauggggga

SEQ ID NO: 35661 - RNA, 64 nt, Homo Sapiens
caacaggagauguggggacguguuaggagagaaaaaaaaaaaaacaaaaauauauaugggggaa

SEQ ID NO: 35662 - RNA, 64 nt, Homo Sapiens
aacaggagauguggggacguguuaggagagaaaaaaaaaaaaacaaaaauauauaugggggaaa

SEQ ID NO: 35663 - RNA, 64 nt, Homo Sapiens
acaggagauguggggacguguuaggagagaaaaaaaaaaaaacaaaaauauauaugggggaaau

SEQ ID NO: 35664 - RNA, 64 nt, Homo Sapiens
gaguuuuccuaucuuuguauguuaagagauuaagaaaaaaaaauucuauuuuuguuguaauguc

SEQ ID NO: 35665 - RNA, 64 nt, Homo Sapiens
aguuuuccuaucuuuguauguuaagagauuaagaaaaaaaaauucuauuuuuguuguaaugucc

SEQ ID NO: 35666 - RNA, 64 nt, Homo Sapiens
gagggcugaaggaaacguucacauuuuagaguuuaaaaaaaacaccucgacauuuaaaaaauca

SEQ ID NO: 35667 - RNA, 64 nt, Homo Sapiens
ccuuaucucaaaaauaaacaaacuaauaaaaagcaaaaaaaaaaaaaaaagaaaagaaaaaaca

SEQ ID NO: 35668 - RNA, 64 nt, Homo Sapiens
cuuaucucaaaaauaaacaaacuaauaaaaagcaaaaaaaaaaaaaaaagaaaagaaaaaacac

SEQ ID NO: 35669 - RNA, 64 nt, Homo Sapiens
uuaucucaaaaauaaacaaacuaauaaaaagcaaaaaaaaaaaaaaaagaaaagaaaaaacacu

SEQ ID NO: 35670 - RNA, 64 nt, Homo Sapiens
uaucucaaaaauaaacaaacuaauaaaaagcaaaaaaaaaaaaaaaagaaaagaaaaaacacug

SEQ ID NO: 35671 - RNA, 64 nt, Homo Sapiens
aucucaaaaauaaacaaacuaauaaaaagcaaaaaaaaaaaaaaaagaaaagaaaaaacacugc

SEQ ID NO: 35672 - RNA, 64 nt, Homo Sapiens
ucucaaaaauaaacaaacuaauaaaaagcaaaaaaaaaaaaaaaagaaaagaaaaaacacugca

SEQ ID NO: 35673 - RNA, 64 nt, Homo Sapiens
cucaaaaauaaacaaacuaauaaaaagcaaaaaaaaaaaaaaaagaaaagaaaaaacacugcau

SEQ ID NO: 35674 - RNA, 64 nt, Homo Sapiens
ucaaaaauaaacaaacuaauaaaaagcaaaaaaaaaaaaaaaagaaaagaaaaaacacugcauu

SEQ ID NO: 35675 - RNA, 64 nt, Homo Sapiens
caaaaauaaacaaacuaauaaaaagcaaaaaaaaaaaaaaaagaaaagaaaaaacacugcauuu

SEQ ID NO: 35676 - RNA, 64 nt, Homo Sapiens
ccagccugggugaaagagcuagauucucucucucaaaaaaaaaaaaaaaaaaaaggaaagaaag

SEQ ID NO: 35677 - RNA, 64 nt, Homo Sapiens
cagccugggugaaagagcuagauucucucucucaaaaaaaaaaaaaaaaaaaaggaaagaaaga

SEQ ID NO: 35678 - RNA, 64 nt, Homo Sapiens
agccugggugaaagagcuagauucucucucucaaaaaaaaaaaaaaaaaaaaggaaagaaagaa

SEQ ID NO: 35679 - RNA, 64 nt, Homo Sapiens
gccugggugaaagagcuagauucucucucucaaaaaaaaaaaaaaaaaaaaggaaagaaagaaa

SEQ ID NO: 35680 - RNA, 64 nt, Homo Sapiens
ccugggugaaagagcuagauucucucucucaaaaaaaaaaaaaaaaaaaaggaaagaaagaaag

SEQ ID NO: 35681 - RNA, 64 nt, Homo Sapiens
cugggugaaagagcuagauucucucucucaaaaaaaaaaaaaaaaaaaaggaaagaaagaaaga

SEQ ID NO: 35682 - RNA, 64 nt, Homo Sapiens
ugggugaaagagcuagauucucucucucaaaaaaaaaaaaaaaaaaaaggaaagaaagaaagaa

SEQ ID NO: 35683 - RNA, 64 nt, Homo Sapiens
gggugaaagagcuagauucucucucucaaaaaaaaaaaaaaaaaaaaggaaagaaagaaagaaa

SEQ ID NO: 35684 - RNA, 64 nt, Homo Sapiens
ggugaaagagcuagauucucucucucaaaaaaaaaaaaaaaaaaaaggaaagaaagaaagaaaa

SEQ ID NO: 35685 - RNA, 64 nt, Homo Sapiens
gugaaagagcuagauucucucucucaaaaaaaaaaaaaaaaaaaaggaaagaaagaaagaaaag

SEQ ID NO: 35686 - RNA, 64 nt, Homo Sapiens
ugaaagagcuagauucucucucucaaaaaaaaaaaaaaaaaaaaggaaagaaagaaagaaaaga

SEQ ID NO: 35687 - RNA, 64 nt, Homo Sapiens
gaaagagcuagauucucucucucaaaaaaaaaaaaaaaaaaaaggaaagaaagaaagaaaagaa

SEQ ID NO: 35688 - RNA, 64 nt, Homo Sapiens
aaagagcuagauucucucucucaaaaaaaaaaaaaaaaaaaaggaaagaaagaaagaaaagaaa

SEQ ID NO: 35689 - RNA, 64 nt, Homo Sapiens
cacuccagccugggugacggugagacuuugucucaaaaaaaaaaaaaaaaacaauggaaggcag

SEQ ID NO: 35690 - RNA, 64 nt, Homo Sapiens
acuccagccugggugacggugagacuuugucucaaaaaaaaaaaaaaaaacaauggaaggcaga

SEQ ID NO: 35691 - RNA, 64 nt, Homo Sapiens
cuccagccugggugacggugagacuuugucucaaaaaaaaaaaaaaaaacaauggaaggcagac

SEQ ID NO: 35692 - RNA, 64 nt, Homo Sapiens
uccagccugggugacggugagacuuugucucaaaaaaaaaaaaaaaaacaauggaaggcagaca

SEQ ID NO: 35693 - RNA, 64 nt, Homo Sapiens
ccagccugggugacggugagacuuugucucaaaaaaaaaaaaaaaaacaauggaaggcagacag

SEQ ID NO: 35694 - RNA, 64 nt, Homo Sapiens
cagccugggugacggugagacuuugucucaaaaaaaaaaaaaaaaacaauggaaggcagacagc

SEQ ID NO: 35695 - RNA, 64 nt, Homo Sapiens
agccugggugacggugagacuuugucucaaaaaaaaaaaaaaaaacaauggaaggcagacagca

SEQ ID NO: 35696 - RNA, 64 nt, Homo Sapiens
gccugggugacggugagacuuugucucaaaaaaaaaaaaaaaaacaauggaaggcagacagcaa

SEQ ID NO: 35697 - RNA, 64 nt, Homo Sapiens
ccugggugacggugagacuuugucucaaaaaaaaaaaaaaaaacaauggaaggcagacagcaag

SEQ ID NO: 35698 - RNA, 64 nt, Homo Sapiens
cugggugacggugagacuuugucucaaaaaaaaaaaaaaaaacaauggaaggcagacagcaagu

SEQ ID NO: 35699 - RNA, 64 nt, Homo Sapiens
cagccugggcaacaagaguggcacuccaucucagaaaaaaaaaaaaaagauaauucauacugaa

SEQ ID NO: 35700 - RNA, 64 nt, Homo Sapiens
agccugggcaacaagaguggcacuccaucucagaaaaaaaaaaaaaagauaauucauacugaaa

SEQ ID NO: 35701 - RNA, 64 nt, Homo Sapiens
gccugggcaacaagaguggcacuccaucucagaaaaaaaaaaaaaagauaauucauacugaaaa

SEQ ID NO: 35702 - RNA, 64 nt, Homo Sapiens
ccugggcaacaagaguggcacuccaucucagaaaaaaaaaaaaaagauaauucauacugaaaag

SEQ ID NO: 35703 - RNA, 64 nt, Homo Sapiens
cugggcaacaagaguggcacuccaucucagaaaaaaaaaaaaaagauaauucauacugaaaaga

SEQ ID NO: 35704 - RNA, 64 nt, Homo Sapiens
ugggcaacaagaguggcacuccaucucagaaaaaaaaaaaaaagauaauucauacugaaaagaa

SEQ ID NO: 35705 - RNA, 64 nt, Homo Sapiens
gggcaacaagaguggcacuccaucucagaaaaaaaaaaaaaagauaauucauacugaaaagaaa

SEQ ID NO: 35706 - RNA, 64 nt, Homo Sapiens
acuccaguuuggcaacagagugagacuccgucucaaaaaaaauuuauacuguacaaaaacccca

SEQ ID NO: 35707 - RNA, 64 nt, Homo Sapiens
ccuuuguuuuacaaacaauccaauucuacacuuuaaaaaaaaauuuuuaaauguacaauuaaau

SEQ ID NO: 35708 - RNA, 64 nt, Homo Sapiens
cuuuguuuuacaaacaauccaauucuacacuuuaaaaaaaaauuuuuaaauguacaauuaaauu

SEQ ID NO: 35709 - RNA, 64 nt, Homo Sapiens
aaaugcuucaauaacuuaucuugguauugcuaauaaaaaaaaaaagcugugaaacauuagugca

SEQ ID NO: 35710 - RNA, 64 nt, Homo Sapiens
aaugcuucaauaacuuaucuugguauugcuaauaaaaaaaaaaagcugugaaacauuagugcag

SEQ ID NO: 35711 - RNA, 64 nt, Homo Sapiens
augcuucaauaacuuaucuugguauugcuaauaaaaaaaaaaagcugugaaacauuagugcagu

SEQ ID NO: 35712 - RNA, 64 nt, Homo Sapiens
ugcuucaauaacuuaucuugguauugcuaauaaaaaaaaaaagcugugaaacauuagugcaguu

SEQ ID NO: 35713 - RNA, 64 nt, Homo Sapiens
ugacagaugagguccucuguuuaccuccccccccaaaaaaaaaauucaguaggaauuccuucau

SEQ ID NO: 35714 - RNA, 64 nt, Homo Sapiens
gacagaugagguccucuguuuaccuccccccccaaaaaaaaaauucaguaggaauuccuucaua

SEQ ID NO: 35715 - RNA, 64 nt, Homo Sapiens
acagaugagguccucuguuuaccuccccccccaaaaaaaaaauucaguaggaauuccuucauag

SEQ ID NO: 35716 - RNA, 64 nt, Homo Sapiens
uuuaauauuguauuuugguaauaaauuuuuuguuaaaaaaaacuuggcuccaaguucuauuaac

SEQ ID NO: 35717 - RNA, 64 nt, Homo Sapiens
gauguagauagaaauuaauuuaaggucuuuucuuaaaaaaaaaauccaccucauuuucaguuaa

SEQ ID NO: 35718 - RNA, 64 nt, Homo Sapiens
auguagauagaaauuaauuuaaggucuuuucuuaaaaaaaaaauccaccucauuuucaguuaac

SEQ ID NO: 35719 - RNA, 64 nt, Homo Sapiens
uguagauagaaauuaauuuaaggucuuuucuuaaaaaaaaaauccaccucauuuucaguuaaca

SEQ ID NO: 35720 - RNA, 64 nt, Homo Sapiens
ccugggugacagagugagauuccgucucaacaagaaaaaaaaaaaagaauauauauauauguau

SEQ ID NO: 35721 - RNA, 64 nt, Homo Sapiens
cugggugacagagugagauuccgucucaacaagaaaaaaaaaaaagaauauauauauauguaug

SEQ ID NO: 35722 - RNA, 64 nt, Homo Sapiens
ugggugacagagugagauuccgucucaacaagaaaaaaaaaaaagaauauauauauauguaugu

SEQ ID NO: 35723 - RNA, 64 nt, Homo Sapiens
gggugacagagugagauuccgucucaacaagaaaaaaaaaaaagaauauauauauauguaugua

SEQ ID NO: 35724 - RNA, 64 nt, Homo Sapiens
ggugacagagugagauuccgucucaacaagaaaaaaaaaaaagaauauauauauauguauguau

SEQ ID NO: 35725 - RNA, 64 nt, Homo Sapiens
uguguguuuuaauuuucuuuauggaaaaauugacaaaaaaaaaauagagagagagguauuuaac

SEQ ID NO: 35726 - RNA, 64 nt, Homo Sapiens
guguguuuuaauuuucuuuauggaaaaauugacaaaaaaaaaauagagagagagguauuuaacu

SEQ ID NO: 35727 - RNA, 64 nt, Homo Sapiens
uguguuuuaauuuucuuuauggaaaaauugacaaaaaaaaaauagagagagagguauuuaacug

SEQ ID NO: 35728 - RNA, 64 nt, Homo Sapiens
uuuggaaaauucuuacuugugaauguuaaaaaugaaaaaaaaaucauuuauuauauuuugccuc

SEQ ID NO: 35729 - RNA, 64 nt, Homo Sapiens
uuggaaaauucuuacuugugaauguuaaaaaugaaaaaaaaaucauuuauuauauuuugccuca

SEQ ID NO: 35730 - RNA, 64 nt, Homo Sapiens
ccagccugggaaacauagcaagaccccaucucuuaaaaaaaaagaaauauauagacauauaucu

SEQ ID NO: 35731 - RNA, 64 nt, Homo Sapiens
cagccugggaaacauagcaagaccccaucucuuaaaaaaaaagaaauauauagacauauaucug

SEQ ID NO: 35732 - RNA, 64 nt, Homo Sapiens
uccauuauugcuauaagaggaaauucauacuguuaaaaaaaaaaaaacccaguggauauaauca

SEQ ID NO: 35733 - RNA, 64 nt, Homo Sapiens
ccauuauugcuauaagaggaaauucauacuguuaaaaaaaaaaaaacccaguggauauaaucag

SEQ ID NO: 35734 - RNA, 64 nt, Homo Sapiens
cauuauugcuauaagaggaaauucauacuguuaaaaaaaaaaaaacccaguggauauaaucagu

SEQ ID NO: 35735 - RNA, 64 nt, Homo Sapiens
auuauugcuauaagaggaaauucauacuguuaaaaaaaaaaaaacccaguggauauaaucagug

SEQ ID NO: 35736 - RNA, 64 nt, Homo Sapiens
uuauugcuauaagaggaaauucauacuguuaaaaaaaaaaaaacccaguggauauaaucagugu

SEQ ID NO: 35737 - RNA, 64 nt, Homo Sapiens
uauugcuauaagaggaaauucauacuguuaaaaaaaaaaaaacccaguggauauaaucagugua

SEQ ID NO: 35738 - RNA, 64 nt, Homo Sapiens
ucuggccucacgugucucagauuuucuaagaaccaaaaaaaaaaaaggaaaaaaaacacaaaac

SEQ ID NO: 35739 - RNA, 64 nt, Homo Sapiens
cuggccucacgugucucagauuuucuaagaaccaaaaaaaaaaaaggaaaaaaaacacaaaaca

SEQ ID NO: 35740 - RNA, 64 nt, Homo Sapiens
uggccucacgugucucagauuuucuaagaaccaaaaaaaaaaaaggaaaaaaaacacaaaacaa

SEQ ID NO: 35741 - RNA, 64 nt, Homo Sapiens
ggccucacgugucucagauuuucuaagaaccaaaaaaaaaaaaggaaaaaaaacacaaaacaac

SEQ ID NO: 35742 - RNA, 64 nt, Homo Sapiens
gccucacgugucucagauuuucuaagaaccaaaaaaaaaaaaggaaaaaaaacacaaaacaaca

SEQ ID NO: 35743 - RNA, 64 nt, Homo Sapiens
ucucagauuuucuaagaaccaaaaaaaaaaaaggaaaaaaaacacaaaacaacaaaaaccaaaa

SEQ ID NO: 35744 - RNA, 64 nt, Homo Sapiens
aaaaaaggaaaaaaaacacaaaacaacaaaaaccaaaaaaaaaaaaaaucacaaaaacaaaaaa

SEQ ID NO: 35745 - RNA, 64 nt, Homo Sapiens
aaaaaggaaaaaaaacacaaaacaacaaaaaccaaaaaaaaaaaaaaucacaaaaacaaaaaaa

SEQ ID NO: 35746 - RNA, 64 nt, Homo Sapiens
aaaaggaaaaaaaacacaaaacaacaaaaaccaaaaaaaaaaaaaaucacaaaaacaaaaaaac

SEQ ID NO: 35747 - RNA, 64 nt, Homo Sapiens
aaaggaaaaaaaacacaaaacaacaaaaaccaaaaaaaaaaaaaaucacaaaaacaaaaaaacu

SEQ ID NO: 35748 - RNA, 64 nt, Homo Sapiens
aaggaaaaaaaacacaaaacaacaaaaaccaaaaaaaaaaaaaaucacaaaaacaaaaaaacua

SEQ ID NO: 35749 - RNA, 64 nt, Homo Sapiens
aggaaaaaaaacacaaaacaacaaaaaccaaaaaaaaaaaaaaucacaaaaacaaaaaaacuau

SEQ ID NO: 35750 - RNA, 64 nt, Homo Sapiens
ggaaaaaaaacacaaaacaacaaaaaccaaaaaaaaaaaaaaucacaaaaacaaaaaaacuaua

SEQ ID NO: 35751 - RNA, 64 nt, Homo Sapiens
uuccagccugggcaacagagcgagacuccaucuuaaaaaaaaaaaaaaaaaaaagaaagaaaag

SEQ ID NO: 35752 - RNA, 64 nt, Homo Sapiens
uccagccugggcaacagagcgagacuccaucuuaaaaaaaaaaaaaaaaaaaagaaagaaaaga

SEQ ID NO: 35753 - RNA, 64 nt, Homo Sapiens
ccagccugggcaacagagcgagacuccaucuuaaaaaaaaaaaaaaaaaaaagaaagaaaagaa

SEQ ID NO: 35754 - RNA, 64 nt, Homo Sapiens
cagccugggcaacagagcgagacuccaucuuaaaaaaaaaaaaaaaaaaaagaaagaaaagaaa

SEQ ID NO: 35755 - RNA, 64 nt, Homo Sapiens
agccugggcaacagagcgagacuccaucuuaaaaaaaaaaaaaaaaaaaagaaagaaaagaaaa

SEQ ID NO: 35756 - RNA, 64 nt, Homo Sapiens
gccugggcaacagagcgagacuccaucuuaaaaaaaaaaaaaaaaaaaagaaagaaaagaaaau

SEQ ID NO: 35757 - RNA, 64 nt, Homo Sapiens
ccugggcaacagagcgagacuccaucuuaaaaaaaaaaaaaaaaaaaagaaagaaaagaaaaug

SEQ ID NO: 35758 - RNA, 64 nt, Homo Sapiens
cugggcaacagagcgagacuccaucuuaaaaaaaaaaaaaaaaaaaagaaagaaaagaaaaugg

SEQ ID NO: 35759 - RNA, 64 nt, Homo Sapiens
ugggcaacagagcgagacuccaucuuaaaaaaaaaaaaaaaaaaaagaaagaaaagaaaaugga

SEQ ID NO: 35760 - RNA, 64 nt, Homo Sapiens
gggcaacagagcgagacuccaucuuaaaaaaaaaaaaaaaaaaaagaaagaaaagaaaauggag

SEQ ID NO: 35761 - RNA, 64 nt, Homo Sapiens
ggcaacagagcgagacuccaucuuaaaaaaaaaaaaaaaaaaaagaaagaaaagaaaauggagu

SEQ ID NO: 35762 - RNA, 64 nt, Homo Sapiens
gcaacagagcgagacuccaucuuaaaaaaaaaaaaaaaaaaaagaaagaaaagaaaauggaguu

SEQ ID NO: 35763 - RNA, 64 nt, Homo Sapiens
caacagagcgagacuccaucuuaaaaaaaaaaaaaaaaaaaagaaagaaaagaaaauggaguuc

SEQ ID NO: 35764 - RNA, 64 nt, Homo Sapiens
ccaggagcuguuuuacugucuacuuuucaggauuaaaaaaaaaaucaaaacuuaaaaaaaaaaa

SEQ ID NO: 35765 - RNA, 64 nt, Homo Sapiens
caggagcuguuuuacugucuacuuuucaggauuaaaaaaaaaaucaaaacuuaaaaaaaaaaaa

SEQ ID NO: 35766 - RNA, 64 nt, Homo Sapiens
aggagcuguuuuacugucuacuuuucaggauuaaaaaaaaaaucaaaacuuaaaaaaaaaaaag

SEQ ID NO: 35767 - RNA, 64 nt, Homo Sapiens
cuacuuuucaggauuaaaaaaaaaaucaaaacuuaaaaaaaaaaaaguuuaaaaagcaaaaugg

SEQ ID NO: 35768 - RNA, 64 nt, Homo Sapiens
uacuuuucaggauuaaaaaaaaaaucaaaacuuaaaaaaaaaaaaguuuaaaaagcaaaauggg

SEQ ID NO: 35769 - RNA, 64 nt, Homo Sapiens
acuuuucaggauuaaaaaaaaaaucaaaacuuaaaaaaaaaaaaguuuaaaaagcaaaaugggg

SEQ ID NO: 35770 - RNA, 64 nt, Homo Sapiens
cuuuucaggauuaaaaaaaaaaucaaaacuuaaaaaaaaaaaaguuuaaaaagcaaaaugggga

SEQ ID NO: 35771 - RNA, 64 nt, Homo Sapiens
uuuucaggauuaaaaaaaaaaucaaaacuuaaaaaaaaaaaaguuuaaaaagcaaaauggggag

SEQ ID NO: 35772 - RNA, 64 nt, Homo Sapiens
aacugaaauguuaaggaagaagauagauccaauuaaaaaaaauuaaaaccaauuuaaaaaaaaa

SEQ ID NO: 35773 - RNA, 64 nt, Homo Sapiens
gauagauccaauuaaaaaaaauuaaaaccaauuuaaaaaaaaaaagaacacaggagauuccagu

SEQ ID NO: 35774 - RNA, 64 nt, Homo Sapiens
auagauccaauuaaaaaaaauuaaaaccaauuuaaaaaaaaaaagaacacaggagauuccaguc

SEQ ID NO: 35775 - RNA, 64 nt, Homo Sapiens
uagauccaauuaaaaaaaauuaaaaccaauuuaaaaaaaaaaagaacacaggagauuccagucu

SEQ ID NO: 35776 - RNA, 64 nt, Homo Sapiens
agauccaauuaaaaaaaauuaaaaccaauuuaaaaaaaaaaagaacacaggagauuccagucua

SEQ ID NO: 35777 - RNA, 64 nt, Homo Sapiens
gaaaacaaacuuggauuuuuuucuuuguccaaauaaaaaaaaaugauguaaagaaauaaugggg

SEQ ID NO: 35778 - RNA, 64 nt, Homo Sapiens
aaaacaaacuuggauuuuuuucuuuguccaaauaaaaaaaaaugauguaaagaaauaauggggg

SEQ ID NO: 35779 - RNA, 64 nt, Homo Sapiens
acagugaaaucagauaauaaugagaucuuuuguuaaaaaaaaaaaaugggaagggagugcggga

SEQ ID NO: 35780 - RNA, 64 nt, Homo Sapiens
cagugaaaucagauaauaaugagaucuuuuguuaaaaaaaaaaaaugggaagggagugcgggag

SEQ ID NO: 35781 - RNA, 64 nt, Homo Sapiens
agugaaaucagauaauaaugagaucuuuuguuaaaaaaaaaaaaugggaagggagugcgggaga

SEQ ID NO: 35782 - RNA, 64 nt, Homo Sapiens
gugaaaucagauaauaaugagaucuuuuguuaaaaaaaaaaaaugggaagggagugcgggagag

SEQ ID NO: 35783 - RNA, 64 nt, Homo Sapiens
ugaaaucagauaauaaugagaucuuuuguuaaaaaaaaaaaaugggaagggagugcgggagaga

SEQ ID NO: 35784 - RNA, 64 nt, Homo Sapiens
uccagccagggcaacagagugagacccugucuccaaaaaaaaaaauuaaauaaauaccuuucuu

SEQ ID NO: 35785 - RNA, 64 nt, Homo Sapiens
ccagccagggcaacagagugagacccugucuccaaaaaaaaaaauuaaauaaauaccuuucuuu

SEQ ID NO: 35786 - RNA, 64 nt, Homo Sapiens
cagccagggcaacagagugagacccugucuccaaaaaaaaaaauuaaauaaauaccuuucuuug

SEQ ID NO: 35787 - RNA, 64 nt, Homo Sapiens
agccagggcaacagagugagacccugucuccaaaaaaaaaaauuaaauaaauaccuuucuuugu

SEQ ID NO: 35788 - RNA, 64 nt, Homo Sapiens
acacagcgagaucucuuggggguaaaacaaaaagaaaaaaaaaaguucauacuucuccaauaaa

SEQ ID NO: 35789 - RNA, 64 nt, Homo Sapiens
cacagcgagaucucuuggggguaaaacaaaaagaaaaaaaaaaguucauacuucuccaauaaau

SEQ ID NO: 35790 - RNA, 64 nt, Homo Sapiens
acagcgagaucucuuggggguaaaacaaaaagaaaaaaaaaaguucauacuucuccaauaaaua

SEQ ID NO: 35791 - RNA, 64 nt, Homo Sapiens
cgcuuaaugccuucaaaguuuugguuuuuuuaagaaaaaaaaauauauauauauuuggguuuug

SEQ ID NO: 35792 - RNA, 64 nt, Homo Sapiens
gcuuaaugccuucaaaguuuugguuuuuuuaagaaaaaaaaauauauauauauuuggguuuugg

SEQ ID NO: 35793 - RNA, 64 nt, Homo Sapiens
cucagaauacagacaaguagaaagauucucgcuuaaaaaaaauguauuuauuuuauggcaaguu

SEQ ID NO: 35794 - RNA, 64 nt, Homo Sapiens
uggaaucauauaguauguaaccuguuuugagcuuaaaaaaaaaguauacaugacuuuaaugagg

SEQ ID NO: 35795 - RNA, 64 nt, Homo Sapiens
ggaaucauauaguauguaaccuguuuugagcuuaaaaaaaaaguauacaugacuuuaaugagga

SEQ ID NO: 35796 - RNA, 64 nt, Homo Sapiens
aaguauucaagaucaucuugauugaccaaagaccaaaaaaaaaaaaaagaccugugguuccaga

SEQ ID NO: 35797 - RNA, 64 nt, Homo Sapiens
aguauucaagaucaucuugauugaccaaagaccaaaaaaaaaaaaaagaccugugguuccagaa

SEQ ID NO: 35798 - RNA, 64 nt, Homo Sapiens
guauucaagaucaucuugauugaccaaagaccaaaaaaaaaaaaaagaccugugguuccagaaa

SEQ ID NO: 35799 - RNA, 64 nt, Homo Sapiens
uauucaagaucaucuugauugaccaaagaccaaaaaaaaaaaaaagaccugugguuccagaaag

SEQ ID NO: 35800 - RNA, 64 nt, Homo Sapiens
auucaagaucaucuugauugaccaaagaccaaaaaaaaaaaaaagaccugugguuccagaaagc

SEQ ID NO: 35801 - RNA, 64 nt, Homo Sapiens
uucaagaucaucuugauugaccaaagaccaaaaaaaaaaaaaagaccugugguuccagaaagcu

SEQ ID NO: 35802 - RNA, 64 nt, Homo Sapiens
ucaagaucaucuugauugaccaaagaccaaaaaaaaaaaaaagaccugugguuccagaaagcuc

SEQ ID NO: 35803 - RNA, 64 nt, Homo Sapiens
cuccagucugggugacacagcaagacuccaucucaaaaaaaaaaaaagaaaaagaaaugaaugg

SEQ ID NO: 35804 - RNA, 64 nt, Homo Sapiens
uccagucugggugacacagcaagacuccaucucaaaaaaaaaaaaagaaaaagaaaugaauggg

SEQ ID NO: 35805 - RNA, 64 nt, Homo Sapiens
ccagucugggugacacagcaagacuccaucucaaaaaaaaaaaaagaaaaagaaaugaaugggu

SEQ ID NO: 35806 - RNA, 64 nt, Homo Sapiens
cagucugggugacacagcaagacuccaucucaaaaaaaaaaaaagaaaaagaaaugaauggguu

SEQ ID NO: 35807 - RNA, 64 nt, Homo Sapiens
agucugggugacacagcaagacuccaucucaaaaaaaaaaaaagaaaaagaaaugaauggguuc

SEQ ID NO: 35808 - RNA, 64 nt, Homo Sapiens
gucugggugacacagcaagacuccaucucaaaaaaaaaaaaagaaaaagaaaugaauggguuca

SEQ ID NO: 35809 - RNA, 64 nt, Homo Sapiens
agccugggcaacauaguaagacccugucucuauuaaaaaaaaaaaaucaacccuucuuccccac

SEQ ID NO: 35810 - RNA, 64 nt, Homo Sapiens
gccugggcaacauaguaagacccugucucuauuaaaaaaaaaaaaucaacccuucuuccccacc

SEQ ID NO: 35811 - RNA, 64 nt, Homo Sapiens
ccugggcaacauaguaagacccugucucuauuaaaaaaaaaaaaucaacccuucuuccccacca

SEQ ID NO: 35812 - RNA, 64 nt, Homo Sapiens
cugggcaacauaguaagacccugucucuauuaaaaaaaaaaaaucaacccuucuuccccaccaa

SEQ ID NO: 35813 - RNA, 64 nt, Homo Sapiens
ugggcaacauaguaagacccugucucuauuaaaaaaaaaaaaucaacccuucuuccccaccaaa

SEQ ID NO: 35814 - RNA, 64 nt, Homo Sapiens
uaguuggugacuggguguucauuuuagcucuaagaaaaaaaaucaguguuucgugaagguguug

SEQ ID NO: 35815 - RNA, 64 nt, Homo Sapiens
ugggcucugucucuuucuacccugcguuaagcggaaaaaaaaaauucugacaguguuuuucuuc

SEQ ID NO: 35816 - RNA, 64 nt, Homo Sapiens
gggcucugucucuuucuacccugcguuaagcggaaaaaaaaaauucugacaguguuuuucuucc

SEQ ID NO: 35817 - RNA, 64 nt, Homo Sapiens
ggcucugucucuuucuacccugcguuaagcggaaaaaaaaaauucugacaguguuuuucuuccu

SEQ ID NO: 35818 - RNA, 64 nt, Homo Sapiens
ggcaacauaguaagaccucaucucuacuaaaaauaaaaaaaaacagccagguguguuaguccac

SEQ ID NO: 35819 - RNA, 64 nt, Homo Sapiens
gcaacauaguaagaccucaucucuacuaaaaauaaaaaaaaacagccagguguguuaguccaca

SEQ ID NO: 35820 - RNA, 64 nt, Homo Sapiens
cucucauagaaaauauaaagaaucccucaaguugaaaaaaaaaucaauuuaaaggggagaaaac

SEQ ID NO: 35821 - RNA, 64 nt, Homo Sapiens
ucucauagaaaauauaaagaaucccucaaguugaaaaaaaaaucaauuuaaaggggagaaaacu

SEQ ID NO: 35822 - RNA, 64 nt, Homo Sapiens
agccuggcgacagagggagacuccaucucaaauuaaaaaaaaaaaaaaaaaagaaagaaaaaga

SEQ ID NO: 35823 - RNA, 64 nt, Homo Sapiens
gccuggcgacagagggagacuccaucucaaauuaaaaaaaaaaaaaaaaaagaaagaaaaagag

SEQ ID NO: 35824 - RNA, 64 nt, Homo Sapiens
ccuggcgacagagggagacuccaucucaaauuaaaaaaaaaaaaaaaaaagaaagaaaaagaga

SEQ ID NO: 35825 - RNA, 64 nt, Homo Sapiens
cuggcgacagagggagacuccaucucaaauuaaaaaaaaaaaaaaaaaagaaagaaaaagagaa

SEQ ID NO: 35826 - RNA, 64 nt, Homo Sapiens
uggcgacagagggagacuccaucucaaauuaaaaaaaaaaaaaaaaaagaaagaaaaagagaaa

SEQ ID NO: 35827 - RNA, 64 nt, Homo Sapiens
ggcgacagagggagacuccaucucaaauuaaaaaaaaaaaaaaaaaagaaagaaaaagagaaaa

SEQ ID NO: 35828 - RNA, 64 nt, Homo Sapiens
gcgacagagggagacuccaucucaaauuaaaaaaaaaaaaaaaaaagaaagaaaaagagaaaaa

SEQ ID NO: 35829 - RNA, 64 nt, Homo Sapiens
cgacagagggagacuccaucucaaauuaaaaaaaaaaaaaaaaaagaaagaaaaagagaaaaaa

SEQ ID NO: 35830 - RNA, 64 nt, Homo Sapiens
gacagagggagacuccaucucaaauuaaaaaaaaaaaaaaaaaagaaagaaaaagagaaaaaag

SEQ ID NO: 35831 - RNA, 64 nt, Homo Sapiens
acagagggagacuccaucucaaauuaaaaaaaaaaaaaaaaaagaaagaaaaagagaaaaaaga

SEQ ID NO: 35832 - RNA, 64 nt, Homo Sapiens
cagagggagacuccaucucaaauuaaaaaaaaaaaaaaaaaagaaagaaaaagagaaaaaagaa

SEQ ID NO: 35833 - RNA, 64 nt, Homo Sapiens
cuccagccugggcgacagagcgagacuccaucucaaaaaaaaaaaaaaaaaaaccacauaggcu

SEQ ID NO: 35834 - RNA, 64 nt, Homo Sapiens
uccagccugggcgacagagcgagacuccaucucaaaaaaaaaaaaaaaaaaaccacauaggcuc

SEQ ID NO: 35835 - RNA, 64 nt, Homo Sapiens
ccagccugggcgacagagcgagacuccaucucaaaaaaaaaaaaaaaaaaaccacauaggcuca

SEQ ID NO: 35836 - RNA, 64 nt, Homo Sapiens
cagccugggcgacagagcgagacuccaucucaaaaaaaaaaaaaaaaaaaccacauaggcucag

SEQ ID NO: 35837 - RNA, 64 nt, Homo Sapiens
agccugggcgacagagcgagacuccaucucaaaaaaaaaaaaaaaaaaaccacauaggcucagu

SEQ ID NO: 35838 - RNA, 64 nt, Homo Sapiens
gccugggcgacagagcgagacuccaucucaaaaaaaaaaaaaaaaaaaccacauaggcucaguc

SEQ ID NO: 35839 - RNA, 64 nt, Homo Sapiens
ccugggcgacagagcgagacuccaucucaaaaaaaaaaaaaaaaaaaccacauaggcucagucu

SEQ ID NO: 35840 - RNA, 64 nt, Homo Sapiens
cugggcgacagagcgagacuccaucucaaaaaaaaaaaaaaaaaaaccacauaggcucagucuu

SEQ ID NO: 35841 - RNA, 64 nt, Homo Sapiens
ugggcgacagagcgagacuccaucucaaaaaaaaaaaaaaaaaaaccacauaggcucagucuuu

SEQ ID NO: 35842 - RNA, 64 nt, Homo Sapiens
gggcgacagagcgagacuccaucucaaaaaaaaaaaaaaaaaaaccacauaggcucagucuuuu

SEQ ID NO: 35843 - RNA, 64 nt, Homo Sapiens
ggcgacagagcgagacuccaucucaaaaaaaaaaaaaaaaaaaccacauaggcucagucuuuuc

SEQ ID NO: 35844 - RNA, 64 nt, Homo Sapiens
gcgacagagcgagacuccaucucaaaaaaaaaaaaaaaaaaaccacauaggcucagucuuuuca

SEQ ID NO: 35845 - RNA, 64 nt, Homo Sapiens
agccuggccaacauggugaaaccccgccucuacuaaaaaaaaaaauacaaaaaauuaggcgugg

SEQ ID NO: 35846 - RNA, 64 nt, Homo Sapiens
gccuggccaacauggugaaaccccgccucuacuaaaaaaaaaaauacaaaaaauuaggcguggu

SEQ ID NO: 35847 - RNA, 64 nt, Homo Sapiens
ccuggccaacauggugaaaccccgccucuacuaaaaaaaaaaauacaaaaaauuaggcguggug

SEQ ID NO: 35848 - RNA, 64 nt, Homo Sapiens
cuggccaacauggugaaaccccgccucuacuaaaaaaaaaaauacaaaaaauuaggcguggugg

SEQ ID NO: 35849 - RNA, 64 nt, Homo Sapiens
ccugggcgacagagcaagacucugucucaagaagaaaaaaaaaauacauauacacauaaauaua

SEQ ID NO: 35850 - RNA, 64 nt, Homo Sapiens
cugggcgacagagcaagacucugucucaagaagaaaaaaaaaauacauauacacauaaauauau

SEQ ID NO: 35851 - RNA, 64 nt, Homo Sapiens
ugggcgacagagcaagacucugucucaagaagaaaaaaaaaauacauauacacauaaauauaua

SEQ ID NO: 35852 - RNA, 64 nt, Homo Sapiens
gugcacaugguacccuaaaacuuaaaguauaauuaaaaaaaaaaauuagagguuuuucuucggg

SEQ ID NO: 35853 - RNA, 64 nt, Homo Sapiens
ugcacaugguacccuaaaacuuaaaguauaauuaaaaaaaaaaauuagagguuuuucuucgggu

SEQ ID NO: 35854 - RNA, 64 nt, Homo Sapiens
gcacaugguacccuaaaacuuaaaguauaauuaaaaaaaaaaauuagagguuuuucuucgggug

SEQ ID NO: 35855 - RNA, 64 nt, Homo Sapiens
cacaugguacccuaaaacuuaaaguauaauuaaaaaaaaaaauuagagguuuuucuucgggugc

SEQ ID NO: 35856 - RNA, 64 nt, Homo Sapiens
ccagccagguugacagaaugagacccugucucuuaaaaaaaaaaaaaaaaauccuggugaugcu

SEQ ID NO: 35857 - RNA, 64 nt, Homo Sapiens
cagccagguugacagaaugagacccugucucuuaaaaaaaaaaaaaaaaauccuggugaugcuu

SEQ ID NO: 35858 - RNA, 64 nt, Homo Sapiens
agccagguugacagaaugagacccugucucuuaaaaaaaaaaaaaaaaauccuggugaugcuuu

SEQ ID NO: 35859 - RNA, 64 nt, Homo Sapiens
gccagguugacagaaugagacccugucucuuaaaaaaaaaaaaaaaaauccuggugaugcuuuu

SEQ ID NO: 35860 - RNA, 64 nt, Homo Sapiens
ccagguugacagaaugagacccugucucuuaaaaaaaaaaaaaaaaauccuggugaugcuuuuc

SEQ ID NO: 35861 - RNA, 64 nt, Homo Sapiens
cagguugacagaaugagacccugucucuuaaaaaaaaaaaaaaaaauccuggugaugcuuuucu

SEQ ID NO: 35862 - RNA, 64 nt, Homo Sapiens
agguugacagaaugagacccugucucuuaaaaaaaaaaaaaaaaauccuggugaugcuuuucug

SEQ ID NO: 35863 - RNA, 64 nt, Homo Sapiens
gguugacagaaugagacccugucucuuaaaaaaaaaaaaaaaaauccuggugaugcuuuucugg

SEQ ID NO: 35864 - RNA, 64 nt, Homo Sapiens
guugacagaaugagacccugucucuuaaaaaaaaaaaaaaaaauccuggugaugcuuuucugga

SEQ ID NO: 35865 - RNA, 64 nt, Homo Sapiens
uugacagaaugagacccugucucuuaaaaaaaaaaaaaaaaauccuggugaugcuuuucuggau

SEQ ID NO: 35866 - RNA, 64 nt, Homo Sapiens
auacacuaacauuaacaauagcugaugagcuaagaaaaaaaaaaagucugugcauaguuuuagu

SEQ ID NO: 35867 - RNA, 64 nt, Homo Sapiens
uacacuaacauuaacaauagcugaugagcuaagaaaaaaaaaaagucugugcauaguuuuagug

SEQ ID NO: 35868 - RNA, 64 nt, Homo Sapiens
acacuaacauuaacaauagcugaugagcuaagaaaaaaaaaaagucugugcauaguuuuaguga

SEQ ID NO: 35869 - RNA, 64 nt, Homo Sapiens
cacuaacauuaacaauagcugaugagcuaagaaaaaaaaaaagucugugcauaguuuuagugau

SEQ ID NO: 35870 - RNA, 64 nt, Homo Sapiens
auuuuggaaccaaaacaguaucuuuuuuuaagcuaaaaaaaaaguuuuaaauggugucuuucua

SEQ ID NO: 35871 - RNA, 64 nt, Homo Sapiens
uuuuggaaccaaaacaguaucuuuuuuuaagcuaaaaaaaaaguuuuaaauggugucuuucuau

SEQ ID NO: 35872 - RNA, 64 nt, Homo Sapiens
cggggaauauauacaagacuuuauuuagucaaguaaaaaaaaaucacuaauguuuaacugaaga

SEQ ID NO: 35873 - RNA, 64 nt, Homo Sapiens
ggggaauauauacaagacuuuauuuagucaaguaaaaaaaaaucacuaauguuuaacugaagaa

SEQ ID NO: 35874 - RNA, 64 nt, Homo Sapiens
uuacuuuaaguucuggguguacaagcacuuuuuaaaaaaaaauuuuuauuccucuuuaauuuuu

SEQ ID NO: 35875 - RNA, 64 nt, Homo Sapiens
uuuacuuuaaguucuggguguacaagcacuuuuuaaaaaaaaauuuuuauuccucuuuaauuuu

SEQ ID NO: 35876 - RNA, 64 nt, Homo Sapiens
ucaaaaguuuuuuuaaagugaaagacaaaaaaaaaaaaaaaaccuuaauguuacgauguuuuua

SEQ ID NO: 35877 - RNA, 64 nt, Homo Sapiens
cucaaaaguuuuuuuaaaguaaaagacaaaaaaaaaaaaaaaacguuaauguuacgauguuuuu

SEQ ID NO: 35878 - RNA, 64 nt, Homo Sapiens
ccucaaaaguuuuuuuaaaguaaaagacaaaaaaaaaaaaaaaauguuaauguuacgauguuuu

SEQ ID NO: 35879 - RNA, 64 nt, Homo Sapiens
accucaaaaguuuuuuuaaauuaaaagacaaaaaaaaaaaaaaaguguuaauguuacgauguuu

SEQ ID NO: 35880 - RNA, 64 nt, Homo Sapiens
aaccucaaaaguuuuuuuaauuuaaaagacaaaaaaaaaaaaaauguguuaauguuacgauguu

SEQ ID NO: 35881 - RNA, 64 nt, Homo Sapiens
aaaccucaaaaguuuuuuuauuuuaaaagacaaaaaaaaaaaaaauguguuaauguuacgaugu

SEQ ID NO: 35882 - RNA, 64 nt, Homo Sapiens
aaaaccucaaaaguuuuuuuuuuuuaaaagacaaaaaaaaaaaacauguguuaauguuacgaug

SEQ ID NO: 35883 - RNA, 64 nt, Homo Sapiens
aaaaaccucaaaaguuuuuuguuuuuaaaagacaaaaaaaaaaaccauguguuaauguuacgau

SEQ ID NO: 35884 - RNA, 64 nt, Homo Sapiens
aaaaaaccucaaaaguuuuuuguuuuuaaaagacaaaaaaaaaagccauguguuaauguuacga

SEQ ID NO: 35885 - RNA, 64 nt, Homo Sapiens
acacaucgauggacuuugcuuuaguuuuuccuuaaaaaaaaacaucuuccuccuguuuaguuuu

SEQ ID NO: 35886 - RNA, 64 nt, Homo Sapiens
aacacaucgauggacuuugcuuuaguuuuuccuuaaaaaaaaacuucuuccuccuguuuaguuu

SEQ ID NO: 35887 - RNA, 64 nt, Homo Sapiens
cuccacuuuuuuuuuucuuggcuugggggauuaaaaaaaaaauuagccuguggguuucuuucua

SEQ ID NO: 35888 - RNA, 64 nt, Homo Sapiens
ucuccacuuuuuuuuuucuuagcuugggggauuaaaaaaaaaauaagccuguggguuucuuucu

SEQ ID NO: 35889 - RNA, 64 nt, Homo Sapiens
uucuccacuuuuuuuuuucuuagcuugggggauuaaaaaaaaaagaagccuguggguuucuuuc

SEQ ID NO: 35890 - RNA, 64 nt, Homo Sapiens
aacacccacaccugugucugacaaaaguguuuuuaaaaaaaagcgauauuaaaaaaaaaaaaag

SEQ ID NO: 35891 - RNA, 64 nt, Homo Sapiens
caaaaguguuuuuaaaaaaaggggauauuaaaaaaaaaaaaagacuagcuugucuuuuaagaaa

SEQ ID NO: 35892 - RNA, 64 nt, Homo Sapiens
acaaaaguguuuuuaaaaaaaggggauauuaaaaaaaaaaaaagacuagcuugucuuuuaagaa

SEQ ID NO: 35893 - RNA, 64 nt, Homo Sapiens
gacaaaaguguuuuuaaaaaaaggggauauuaaaaaaaaaaaaauacuagcuugucuuuuaaga

SEQ ID NO: 35894 - RNA, 64 nt, Homo Sapiens
agacaaaaguguuuuuaaaaaaaggggauauuaaaaaaaaaaaaauacuagcuugucuuuuaag

SEQ ID NO: 35895 - RNA, 64 nt, Homo Sapiens
aagacaaaaguguuuuuaaagaaaggggauauuaaaaaaaaaaauauacuagcuugucuuuuaa

SEQ ID NO: 35896 - RNA, 64 nt, Homo Sapiens
aaagacaaaaguguuuuuaaagaaaggggauauuaaaaaaaaaaguauacuagcuugucuuuua

SEQ ID NO: 35897 - RNA, 64 nt, Homo Sapiens
caccacaaacguagaauccauacaaaauaauaaaaaaaaaaaccuaaaagucgauuuauuuuug

SEQ ID NO: 35898 - RNA, 64 nt, Homo Sapiens
ccaccacaaacguagaauccguacaaaauaauaaaaaaaaaaaccuaaaagucgauuuauuuuu

SEQ ID NO: 35899 - RNA, 64 nt, Homo Sapiens
cccaccacaaacguagaaucuguacaaaauaauaaaaaaaaaaaccuaaaagucgauuuauuuu

SEQ ID NO: 35900 - RNA, 64 nt, Homo Sapiens
acccaccacaaacguagaauuuguacaaaauaauaaaaaaaaaauccuaaaagucgauuuauuu

SEQ ID NO: 35901 - RNA, 64 nt, Homo Sapiens
gagcgagagagagagcgagaaagacaaaaaaaaaaaaaaaaagcaacuucuaugaaaaguugaa

SEQ ID NO: 35902 - RNA, 64 nt, Homo Sapiens
cgagcgagagagagagcgagaaagacaaaaaaaaaaaaaaaaagcaacuucuaugaaaaguuga

SEQ ID NO: 35903 - RNA, 64 nt, Homo Sapiens
gcgagcgagagagagagcgaaaaagacaaaaaaaaaaaaaaaaaccaacuucuaugaaaaguug

SEQ ID NO: 35904 - RNA, 64 nt, Homo Sapiens
agcgagcgagagagagagcggaaaagacaaaaaaaaaaaaaaaaaccaacuucuaugaaaaguu

SEQ ID NO: 35905 - RNA, 64 nt, Homo Sapiens
aagcgagcgagagagagagcugaaaagacaaaaaaaaaaaaaaaaaccaacuucuaugaaaagu

SEQ ID NO: 35906 - RNA, 64 nt, Homo Sapiens
aaagcgagcgagagagagaguugaaaagacaaaaaaaaaaaaaacaaccaacuucuaugaaaag

SEQ ID NO: 35907 - RNA, 64 nt, Homo Sapiens
aaaagcgagcgagagagagaguugaaaagacaaaaaaaaaaaaaacaaccaacuucuaugaaaa

SEQ ID NO: 35908 - RNA, 64 nt, Homo Sapiens
aaaaagcgagcgagagagagaguugaaaagacaaaaaaaaaaaauacaaccaacuucuaugaaa

SEQ ID NO: 35909 - RNA, 64 nt, Homo Sapiens
aaaaaagcgagcgagagagaaaguugaaaagacaaaaaaaaaaauuacaaccaacuucuaugaa

SEQ ID NO: 35910 - RNA, 64 nt, Homo Sapiens
aaaaaaagcgagcgagagagaaaguugaaaagacaaaaaaaaaaguuacaaccaacuucuauga

SEQ ID NO: 35911 - RNA, 64 nt, Homo Sapiens
caaccaaccacauuagaaguugaaaggaaggaaaaaaaaaaaggaaaaaaaagguuuuacaaaa

SEQ ID NO: 35912 - RNA, 64 nt, Homo Sapiens
gcaaccaaccacauuagaagaugaaaggaaggaaaaaaaaaaagaaaaaaaaagguuuuacaaa

SEQ ID NO: 35913 - RNA, 64 nt, Homo Sapiens
ggcaaccaaccacauuagaaaaugaaaggaaggaaaaaaaaaaaaaaaaaaaaagguuuuacaa

SEQ ID NO: 35914 - RNA, 64 nt, Homo Sapiens
aggcaaccaaccacauuagaaaaugaaaggaaggaaaaaaaaaagaaaaaaaaaagguuuuaca

SEQ ID NO: 35915 - RNA, 64 nt, Homo Sapiens
uuuuacaaaaugaaaggaagaaaacaaacuagaaaaaaaaaagguccaaugucacaaaagcaau

SEQ ID NO: 35916 - RNA, 64 nt, Homo Sapiens
guuuuacaaaaugaaaggaauaaaacaaacuagaaaaaaaaaaguuccaaugucacaaaagcaa

SEQ ID NO: 35917 - RNA, 64 nt, Homo Sapiens
gguuuuacaaaaugaaaggaauaaaacaaacuagaaaaaaaaaaauuccaaugucacaaaagca

SEQ ID NO: 35918 - RNA, 64 nt, Homo Sapiens
acccaccacccccccaaaaaagacagagagagagaaaaaaaauccagaaacccgagaaagagag

SEQ ID NO: 35919 - RNA, 64 nt, Homo Sapiens
aacaaaccaccucuacauauaagaaaagaaaaaaaaaaaaaagacgggcaaaaaaaaaaguaaa

SEQ ID NO: 35920 - RNA, 64 nt, Homo Sapiens
aaacaaaccaccucuacauaaaagaaaagaaaaaaaaaaaaaaggcgggcaaaaaaaaaaguaa

SEQ ID NO: 35921 - RNA, 64 nt, Homo Sapiens
gaaacaaaccaccucuacauaaaagaaaagaaaaaaaaaaaaaaggcgggcaaaaaaaaaagua

SEQ ID NO: 35922 - RNA, 64 nt, Homo Sapiens
agaaacaaaccaccucuacaaaaaagaaaagaaaaaaaaaaaaagggcgggcaaaaaaaaaagu

SEQ ID NO: 35923 - RNA, 64 nt, Homo Sapiens
aagaaacaaaccaccucuacuaaaaagaaaagaaaaaaaaaaaaggggcgggcaaaaaaaaaag

SEQ ID NO: 35924 - RNA, 64 nt, Homo Sapiens
aaagaaacaaaccaccucuaguaaaaagaaaagaaaaaaaaaaaaggggcgggcaaaaaaaaaa

SEQ ID NO: 35925 - RNA, 64 nt, Homo Sapiens
aaaagaaacaaaccaccucuaguaaaaagaaaagaaaaaaaaaacaggggcgggcaaaaaaaaa

SEQ ID NO: 35926 - RNA, 64 nt, Homo Sapiens
aaaaagaaaagaaaaaaaaaccaggggcgggcaaaaaaaaaaguccuccccgccaagagcucug

SEQ ID NO: 35927 - RNA, 64 nt, Homo Sapiens
uaaaaagaaaagaaaaaaaagccaggggcgggcaaaaaaaaaagcccuccccgccaagagcucu

SEQ ID NO: 35928 - RNA, 64 nt, Homo Sapiens
guaaaaagaaaagaaaaaaaugccaggggcgggcaaaaaaaaaaucccuccccgccaagagcuc

SEQ ID NO: 35929 - RNA, 64 nt, Homo Sapiens
agggauauaguucauaucccaaaaaaaaaaaagaaaaaaaaaucgagugagacuuagucucaaa

SEQ ID NO: 35930 - RNA, 64 nt, Homo Sapiens
cagggauauaguucauauccaaaaaaaaaaaaagaaaaaaaaauagagugagacuuagucucaa

SEQ ID NO: 35931 - RNA, 64 nt, Homo Sapiens
aaaaaaaaucagggauauaguagucucaaaaaaaaaaaaaaagaugggggacaagagugagacu

SEQ ID NO: 35932 - RNA, 64 nt, Homo Sapiens
aaaaaaaaaucagggauauauuagucucaaaaaaaaaaaaaaagcugggggacaagagugagac

SEQ ID NO: 35933 - RNA, 64 nt, Homo Sapiens
gaaaaaaaaaucagggauaucuuagucucaaaaaaaaaaaaaaaccugggggacaagagugaga

SEQ ID NO: 35934 - RNA, 64 nt, Homo Sapiens
agaaaaaaaaaucagggauaacuuagucucaaaaaaaaaaaaaagccugggggacaagagugag

SEQ ID NO: 35935 - RNA, 64 nt, Homo Sapiens
aagaaaaaaaaaucagggaugacuuagucucaaaaaaaaaaaaaagccugggggacaagaguga

SEQ ID NO: 35936 - RNA, 64 nt, Homo Sapiens
aaagaaaaaaaaaucagggaagacuuagucucaaaaaaaaaaaacagccugggggacaagagug

SEQ ID NO: 35937 - RNA, 64 nt, Homo Sapiens
aaaagaaaaaaaaaucaggggagacuuagucucaaaaaaaaaaaccagccugggggacaagagu

SEQ ID NO: 35938 - RNA, 64 nt, Homo Sapiens
aaaaagaaaaaaaaaucaggugagacuuagucucaaaaaaaaaauccagccugggggacaagag

SEQ ID NO: 35939 - RNA, 64 nt, Homo Sapiens
agccgggcaugguagcaggucuacuaaaaauacaaaaaaaaaugaacauggugaaaccccgucu

SEQ ID NO: 35940 - RNA, 64 nt, Homo Sapiens
gagccgggcaugguagcaggucuacuaaaaauacaaaaaaaaaucaacauggugaaaccccguc

SEQ ID NO: 35941 - RNA, 64 nt, Homo Sapiens
agccaggcaugguggcgggacuggcacaaaaaaaaaaaaaaagucugggugacagaaugaaauc

SEQ ID NO: 35942 - RNA, 64 nt, Homo Sapiens
uagccaggcaugguggcgggccuggcacaaaaaaaaaaaaaaagccugggugacagaaugaaau

SEQ ID NO: 35943 - RNA, 64 nt, Homo Sapiens
guagccaggcaugguggcgguccuggcacaaaaaaaaaaaaaaagccugggugacagaaugaaa

SEQ ID NO: 35944 - RNA, 64 nt, Homo Sapiens
aguagccaggcaugguggcgauccuggcacaaaaaaaaaaaaaaagccugggugacagaaugaa

SEQ ID NO: 35945 - RNA, 64 nt, Homo Sapiens
aaguagccaggcaugguggcaauccuggcacaaaaaaaaaaaaacagccugggugacagaauga

SEQ ID NO: 35946 - RNA, 64 nt, Homo Sapiens
aaaguagccaggcaugguggaaauccuggcacaaaaaaaaaaaaccagccugggugacagaaug

SEQ ID NO: 35947 - RNA, 64 nt, Homo Sapiens
aaaaguagccaggcaugguggaaauccuggcacaaaaaaaaaaauccagccugggugacagaau

SEQ ID NO: 35948 - RNA, 64 nt, Homo Sapiens
aaaaaguagccaggcaugguugaaauccuggcacaaaaaaaaaauuccagccugggugacagaa

SEQ ID NO: 35949 - RNA, 64 nt, Homo Sapiens
guauggcaguuuuuacuuuuaaaaugagaacaacaaaaaaaauuaggagauugaaacugaaaac

SEQ ID NO: 35950 - RNA, 64 nt, Homo Sapiens
cacucuugcuauuucuuuuucuuuuaaaaaggaaaaaaaaaaguccucuuguuuuuaaaauaaa

SEQ ID NO: 35951 - RNA, 64 nt, Homo Sapiens
ucacucuugcuauuucuuuuacuuuuaaaaaggaaaaaaaaaagcccucuuguuuuuaaaauaa

SEQ ID NO: 35952 - RNA, 64 nt, Homo Sapiens
gucacucuugcuauuucuuuaacuuuuaaaaaggaaaaaaaaaagcccucuuguuuuuaaaaua

SEQ ID NO: 35953 - RNA, 64 nt, Homo Sapiens
uaaaaauuaaaaacacaaagcucugccaaaaaaaaaaaaaaacugaagauagcgagaucuaaau

SEQ ID NO: 35954 - RNA, 64 nt, Homo Sapiens
uuaaaaauuaaaaacacaaaucucugccaaaaaaaaaaaaaaacagaagauagcgagaucuaaa

SEQ ID NO: 35955 - RNA, 64 nt, Homo Sapiens
cuuaaaaauuaaaaacacaaaucucugccaaaaaaaaaaaaaaagagaagauagcgagaucuaa

SEQ ID NO: 35956 - RNA, 64 nt, Homo Sapiens
acuuaaaaauuaaaaacacaaaucucugccaaaaaaaaaaaaaaagagaagauagcgagaucua

SEQ ID NO: 35957 - RNA, 64 nt, Homo Sapiens
aacuuaaaaauuaaaaacacaaaucucugccaaaaaaaaaaaaacagagaagauagcgagaucu

SEQ ID NO: 35958 - RNA, 64 nt, Homo Sapiens
aaacuuaaaaauuaaaaacauaaaucucugccaaaaaaaaaaaaccagagaagauagcgagauc

SEQ ID NO: 35959 - RNA, 64 nt, Homo Sapiens
aaaacuuaaaaauuaaaaaccuaaaucucugccaaaaaaaaaaagccagagaagauagcgagau

SEQ ID NO: 35960 - RNA, 64 nt, Homo Sapiens
aaaaacuuaaaaauuaaaaaucuaaaucucugccaaaaaaaaaaagccagagaagauagcgaga

SEQ ID NO: 35961 - RNA, 64 nt, Homo Sapiens
accaaauccccaaauucauuaaaaaacaaaaacaaaaaaaaaccacccaagcacccaaugaugc

SEQ ID NO: 35962 - RNA, 64 nt, Homo Sapiens
caccaaauccccaaauucaucaaaaaacaaaaacaaaaaaaaacaacccaagcacccaaugaug

SEQ ID NO: 35963 - RNA, 64 nt, Homo Sapiens
aaaaaacacguguagcugugucucuugaaaaaaaaaaaaaaauuggcaacaaagcaagacccug

SEQ ID NO: 35964 - RNA, 64 nt, Homo Sapiens
uaaaaaacacguguagcugugucucuugaaaaaaaaaaaaaaaugggcaacaaagcaagacccu

SEQ ID NO: 35965 - RNA, 64 nt, Homo Sapiens
uuaaaaaacacguguagcugugucucuugaaaaaaaaaaaaaaaugggcaacaaagcaagaccc

SEQ ID NO: 35966 - RNA, 64 nt, Homo Sapiens
auuaaaaaacacguguagcucugucucuugaaaaaaaaaaaaaacugggcaacaaagcaagacc

SEQ ID NO: 35967 - RNA, 64 nt, Homo Sapiens
aauuaaaaaacacguguagcccugucucuugaaaaaaaaaaaaaccugggcaacaaagcaagac

SEQ ID NO: 35968 - RNA, 64 nt, Homo Sapiens
aaauuaaaaaacacguguagcccugucucuugaaaaaaaaaaaagccugggcaacaaagcaaga

SEQ ID NO: 35969 - RNA, 64 nt, Homo Sapiens
aaaauuaaaaaacacguguaacccugucucuugaaaaaaaaaaaagccugggcaacaaagcaag

SEQ ID NO: 35970 - RNA, 64 nt, Homo Sapiens
aaaaauuaaaaaacacgugugacccugucucuugaaaaaaaaaacagccugggcaacaaagcaa

SEQ ID NO: 35971 - RNA, 64 nt, Homo Sapiens
caacaagaacacuucgcguuaaagacaaaaaaaaaaaaaaaaccaaaaaaaaaaagacaaaaca

SEQ ID NO: 35972 - RNA, 64 nt, Homo Sapiens
ccaacaagaacacuucgcguaaaagacaaaaaaaaaaaaaaaacaaaaaaaaaaaagacaaaac

SEQ ID NO: 35973 - RNA, 64 nt, Homo Sapiens
cccaacaagaacacuucgcgcaaaagacaaaaaaaaaaaaaaaaaaaaaaaaaaaaagacaaaa

SEQ ID NO: 35974 - RNA, 64 nt, Homo Sapiens
acccaacaagaacacuucgcacaaaagacaaaaaaaaaaaaaaaaaaaaaaaaaaaaagacaaa

SEQ ID NO: 35975 - RNA, 64 nt, Homo Sapiens
aacccaacaagaacacuucgaacaaaagacaaaaaaaaaaaaaaaaaaaaaaaaaaaaagacaa

SEQ ID NO: 35976 - RNA, 64 nt, Homo Sapiens
aaacccaacaagaacacuucaaacaaaagacaaaaaaaaaaaaaaaaaaaaaaaaaaaaagaca

SEQ ID NO: 35977 - RNA, 64 nt, Homo Sapiens
aaaacccaacaagaacacuuaaaacaaaagacaaaaaaaaaaaaaaaaaaaaaaaaaaaaagac

SEQ ID NO: 35978 - RNA, 64 nt, Homo Sapiens
aaaaacccaacaagaacacucaaaacaaaagacaaaaaaaaaaaaaaaaaaaaaaaaaaaaaga

SEQ ID NO: 35979 - RNA, 64 nt, Homo Sapiens
aaaaaacccaacaagaacacacaaaacaaaagacaaaaaaaaaaaaaaaaaaaaaaaaaaaaag

SEQ ID NO: 35980 - RNA, 64 nt, Homo Sapiens
caaaacaaaagacaaaaaaauaaaaaaaaaaaaaaaaaaaaagauuggaggugauaaaaaacug

SEQ ID NO: 35981 - RNA, 64 nt, Homo Sapiens
acaaaacaaaagacaaaaaaguaaaaaaaaaaaaaaaaaaaaagguuggaggugauaaaaaacu

SEQ ID NO: 35982 - RNA, 64 nt, Homo Sapiens
gacaaaacaaaagacaaaaauguaaaaaaaaaaaaaaaaaaaaauguuggaggugauaaaaaac

SEQ ID NO: 35983 - RNA, 64 nt, Homo Sapiens
agacaaaacaaaagacaaaacuguaaaaaaaaaaaaaaaaaaaaauguuggaggugauaaaaaa

SEQ ID NO: 35984 - RNA, 64 nt, Homo Sapiens
aagacaaaacaaaagacaaaacuguaaaaaaaaaaaaaaaaaaacauguuggaggugauaaaaa

SEQ ID NO: 35985 - RNA, 64 nt, Homo Sapiens
aaagacaaaacaaaagacaaaacuguaaaaaaaaaaaaaaaaaaccauguuggaggugauaaaa

SEQ ID NO: 35986 - RNA, 64 nt, Homo Sapiens
aaaagacaaaacaaaagacaaaacuguaaaaaaaaaaaaaaaaauccauguuggaggugauaaa

SEQ ID NO: 35987 - RNA, 64 nt, Homo Sapiens
aaaaagacaaaacaaaagacaaaacuguaaaaaaaaaaaaaaaaguccauguuggaggugauaa

SEQ ID NO: 35988 - RNA, 64 nt, Homo Sapiens
aaaaaagacaaaacaaaagaaaaaacuguaaaaaaaaaaaaaaaaguccauguuggaggugaua

SEQ ID NO: 35989 - RNA, 64 nt, Homo Sapiens
aaaaaaagacaaaacaaaagaaaaaacuguaaaaaaaaaaaaaagaguccauguuggaggugau

SEQ ID NO: 35990 - RNA, 64 nt, Homo Sapiens
aaaaaaaagacaaaacaaaauaaaaaacuguaaaaaaaaaaaaaagaguccauguuggagguga

SEQ ID NO: 35991 - RNA, 64 nt, Homo Sapiens
aaaaaaaaagacaaaacaaaauaaaaaacuguaaaaaaaaaaaacagaguccauguuggaggug

SEQ ID NO: 35992 - RNA, 64 nt, Homo Sapiens
aaaaaaaaaagacaaaacaagauaaaaaacuguaaaaaaaaaaaacagaguccauguuggaggu

SEQ ID NO: 35993 - RNA, 64 nt, Homo Sapiens
aaaaaaaaaaagacaaaacaugauaaaaaacuguaaaaaaaaaagacagaguccauguuggagg

SEQ ID NO: 35994 - RNA, 64 nt, Homo Sapiens
cauaaacuggcaccaguuaaaaaaaaaaggaaaaaaaaaaaagacacacagaagagauuuaaaa

SEQ ID NO: 35995 - RNA, 64 nt, Homo Sapiens
acauaaacuggcaccaguuaaaaaaaaaaggaaaaaaaaaaaagacacacagaagagauuuaaa

SEQ ID NO: 35996 - RNA, 64 nt, Homo Sapiens
gacauaaacuggcaccaguuaaaaaaaaaaggaaaaaaaaaaaaaacacacagaagagauuuaa

SEQ ID NO: 35997 - RNA, 64 nt, Homo Sapiens
agacauaaacuggcaccaguaaaaaaaaaaaggaaaaaaaaaaaaaacacacagaagagauuua

SEQ ID NO: 35998 - RNA, 64 nt, Homo Sapiens
aagacauaaacuggcaccagaaaaaaaaaaaaggaaaaaaaaaaaaaacacacagaagagauuu

SEQ ID NO: 35999 - RNA, 64 nt, Homo Sapiens
aaaaaaaaaaaagacauaaagaagagauuuaaaaaaaaaaaaggacaaaaaaagaaaacacaca

SEQ ID NO: 36000 - RNA, 64 nt, Homo Sapiens
gaaaaaaaaaaaagacauaaagaagagauuuaaaaaaaaaaaagaacaaaaaaagaaaacacac

SEQ ID NO: 36001 - RNA, 64 nt, Homo Sapiens
ggaaaaaaaaaaaagacauacagaagagauuuaaaaaaaaaaaacaacaaaaaaagaaaacaca

SEQ ID NO: 36002 - RNA, 64 nt, Homo Sapiens
aggaaaaaaaaaaaagacauacagaagagauuuaaaaaaaaaaagcaacaaaaaaagaaaacac

SEQ ID NO: 36003 - RNA, 64 nt, Homo Sapiens
aaggaaaaaaaaaaaagacacacagaagagauuuaaaaaaaaaaagcaacaaaaaaagaaaaca

SEQ ID NO: 36004 - RNA, 64 nt, Homo Sapiens
aacaaaaaaagaaaacacacacaaacagaagaggaaaaaaaagccaaaaaagcgacaaaaaaac

SEQ ID NO: 36005 - RNA, 64 nt, Homo Sapiens
ccaacagaagccacaggccguucuuucuuuaaaaaaaaaaaauugacauugcaucgcccuaguu

SEQ ID NO: 36006 - RNA, 64 nt, Homo Sapiens
uccaacagaagccacaggccuuucuuucuuuaaaaaaaaaaaauggacauugcaucgcccuagu

SEQ ID NO: 36007 - RNA, 64 nt, Homo Sapiens
uuccaacagaagccacaggcuuuucuuucuuuaaaaaaaaaaaauggacauugcaucgcccuag

SEQ ID NO: 36008 - RNA, 64 nt, Homo Sapiens
auuccaacagaagccacaggguuuucuuucuuuaaaaaaaaaaacuggacauugcaucgcccua

SEQ ID NO: 36009 - RNA, 64 nt, Homo Sapiens
aauuccaacagaagccacagaguuuucuuucuuuaaaaaaaaaaucuggacauugcaucgcccu

SEQ ID NO: 36010 - RNA, 64 nt, Homo Sapiens
aaauauuuuggcagguuaugaaaaaagacaaaaaaaaaaaaagaacuugaaaaaaaaaaacaca

SEQ ID NO: 36011 - RNA, 64 nt, Homo Sapiens
aaaauauuuuggcagguuauaaaaaaagacaaaaaaaaaaaaagaacuugaaaaaaaaaaacac

SEQ ID NO: 36012 - RNA, 64 nt, Homo Sapiens
gaaaauauuuuggcagguuacaaaaaaagacaaaaaaaaaaaaagaacuugaaaaaaaaaaaca

SEQ ID NO: 36013 - RNA, 64 nt, Homo Sapiens
agaaaauauuuuggcagguuacaaaaaaagacaaaaaaaaaaaaugaacuugaaaaaaaaaaac

SEQ ID NO: 36014 - RNA, 64 nt, Homo Sapiens
aagaaaauauuuuggcaggucacaaaaaaagacaaaaaaaaaaauugaacuugaaaaaaaaaaa

SEQ ID NO: 36015 - RNA, 64 nt, Homo Sapiens
aaagaaaauauuuuggcaggacacaaaaaaagacaaaaaaaaaacuugaacuugaaaaaaaaaa

SEQ ID NO: 36016 - RNA, 64 nt, Homo Sapiens
caaaaaaagacaaaaaaaaaucuugaacuugaaaaaaaaaaacaggagaauuuuuacuggggau

SEQ ID NO: 36017 - RNA, 64 nt, Homo Sapiens
acaaaaaaagacaaaaaaaauucuugaacuugaaaaaaaaaaacuggagaauuuuuacugggga

SEQ ID NO: 36018 - RNA, 64 nt, Homo Sapiens
cacaaaaaaagacaaaaaaaauucuugaacuugaaaaaaaaaaaguggagaauuuuuacugggg

SEQ ID NO: 36019 - RNA, 64 nt, Homo Sapiens
acacaaaaaaagacaaaaaagauucuugaacuugaaaaaaaaaacguggagaauuuuuacuggg

SEQ ID NO: 36020 - RNA, 64 nt, Homo Sapiens
ggggugggaggggaagaaaacagaaacaaaaugaaaaaaaaagggcaggcaguggggcuggaag

SEQ ID NO: 36021 - RNA, 64 nt, Homo Sapiens
gggggugggaggggaagaaagcagaaacaaaaugaaaaaaaaagagcaggcaguggggcuggaa

SEQ ID NO: 36022 - RNA, 64 nt, Homo Sapiens
acaugaaaggauucacucugcugucucaaaaaaaaaaaaaaagucugggcgacagagccagacc

SEQ ID NO: 36023 - RNA, 64 nt, Homo Sapiens
uacaugaaaggauucacucuccugucucaaaaaaaaaaaaaaagccugggcgacagagccagac

SEQ ID NO: 36024 - RNA, 64 nt, Homo Sapiens
guacaugaaaggauucacuccccugucucaaaaaaaaaaaaaaagccugggcgacagagccaga

SEQ ID NO: 36025 - RNA, 64 nt, Homo Sapiens
aguacaugaaaggauucacuacccugucucaaaaaaaaaaaaaaagccugggcgacagagccag

SEQ ID NO: 36026 - RNA, 64 nt, Homo Sapiens
aaguacaugaaaggauucacgacccugucucaaaaaaaaaaaaacagccugggcgacagagcca

SEQ ID NO: 36027 - RNA, 64 nt, Homo Sapiens
aaaguacaugaaaggauucaagacccugucucaaaaaaaaaaaaccagccugggcgacagagcc

SEQ ID NO: 36028 - RNA, 64 nt, Homo Sapiens
aaaaguacaugaaaggauuccagacccugucucaaaaaaaaaaacccagccugggcgacagagc

SEQ ID NO: 36029 - RNA, 64 nt, Homo Sapiens
aaaaaguacaugaaaggauuccagacccugucucaaaaaaaaaaccccagccugggcgacagag

SEQ ID NO: 36030 - RNA, 64 nt, Homo Sapiens
aaaagaaauaaacucuaugaucucaaaaaaaauaaaaaaaaagaggcaacagagugagacucca

SEQ ID NO: 36031 - RNA, 64 nt, Homo Sapiens
aaaaagaaauaaacucuaugaucucaaaaaaaauaaaaaaaaaguggcaacagagugagacucc

SEQ ID NO: 36032 - RNA, 64 nt, Homo Sapiens
aaaaaaaagaaaaagaaauaugagacuccaucucaaaaaaaauaacuccagccuggcaacagag

SEQ ID NO: 36033 - RNA, 64 nt, Homo Sapiens
auuuaauuuuuuaauuuauuuuuuuuuuuuuuuaaaaaaaaacuguucuucucguuuuccuuuu

SEQ ID NO: 36034 - RNA, 64 nt, Homo Sapiens
uauuuaauuuuuuaauuuauuuuuuuuuuuuuuuaaaaaaaaacgguucuucucguuuuccuuu

SEQ ID NO: 36035 - RNA, 64 nt, Homo Sapiens
uuuaaaaauaccuuuuaauuuuuguuaaaaaaaaaaaaaaaagugagcaggucucuggaagcca

SEQ ID NO: 36036 - RNA, 64 nt, Homo Sapiens
uuuuaaaaauaccuuuuaauauuuguuaaaaaaaaaaaaaaaagcgagcaggucucuggaagcc

SEQ ID NO: 36037 - RNA, 64 nt, Homo Sapiens
guuuuaaaaauaccuuuuaacauuuguuaaaaaaaaaaaaaaaaucgagcaggucucuggaagc

SEQ ID NO: 36038 - RNA, 64 nt, Homo Sapiens
aguuuuaaaaauaccuuuuaccauuuguuaaaaaaaaaaaaaaacucgagcaggucucuggaag

SEQ ID NO: 36039 - RNA, 64 nt, Homo Sapiens
aaguuuuaaaaauaccuuuugccauuuguuaaaaaaaaaaaaaaacucgagcaggucucuggaa

SEQ ID NO: 36040 - RNA, 64 nt, Homo Sapiens
aaaguuuuaaaaauaccuuuagccauuuguuaaaaaaaaaaaaaaacucgagcaggucucugga

SEQ ID NO: 36041 - RNA, 64 nt, Homo Sapiens
aaaaguuuuaaaaauaccuuaagccauuuguuaaaaaaaaaaaaaaacucgagcaggucucugg

SEQ ID NO: 36042 - RNA, 64 nt, Homo Sapiens
aaaaaguuuuaaaaauaccugaagccauuuguuaaaaaaaaaaagaaacucgagcaggucucug

SEQ ID NO: 36043 - RNA, 64 nt, Homo Sapiens
aaaaaaguuuuaaaaauaccggaagccauuuguuaaaaaaaaaaugaaacucgagcaggucucu

SEQ ID NO: 36044 - RNA, 64 nt, Homo Sapiens
gggggcgggggacgggugggaagacucuguuucaaaaaaaaagggccaaccugggucacauagc

SEQ ID NO: 36045 - RNA, 64 nt, Homo Sapiens
ggggggcgggggacggguggcaagacucuguuucaaaaaaaaagcgccaaccugggucacauag

SEQ ID NO: 36046 - RNA, 64 nt, Homo Sapiens
gaaaucugaccuauuguauaggcaagaaaaaggaaaaaaaaaugccugugagauagauguuuau

SEQ ID NO: 36047 - RNA, 64 nt, Homo Sapiens
ggaaaucugaccuauuguauuggcaagaaaaaggaaaaaaaaaugccugugagauagauguuua

SEQ ID NO: 36048 - RNA, 64 nt, Homo Sapiens
ucaucacuugaagccaccggaaaaaaaagaaaagaaaaaaaaucaaaaaaaaaagacaaaaaaa

SEQ ID NO: 36049 - RNA, 64 nt, Homo Sapiens
aaagaaaaaaaaucucaucaaaaagacaaaaaaaaaaaaaaagaacgaaauggaaaagaaaaaa

SEQ ID NO: 36050 - RNA, 64 nt, Homo Sapiens
aaaagaaaaaaaaucucaucaaaaagacaaaaaaaaaaaaaaagaacgaaauggaaaagaaaaa

SEQ ID NO: 36051 - RNA, 64 nt, Homo Sapiens
gaaaagaaaaaaaaucucauaaaaaagacaaaaaaaaaaaaaaacaacgaaauggaaaagaaaa

SEQ ID NO: 36052 - RNA, 64 nt, Homo Sapiens
agaaaagaaaaaaaaucucaaaaaaaagacaaaaaaaaaaaaaaucaacgaaauggaaaagaaa

SEQ ID NO: 36053 - RNA, 64 nt, Homo Sapiens
aagaaaagaaaaaaaaucucaaaaaaaagacaaaaaaaaaaaaauucaacgaaauggaaaagaa

SEQ ID NO: 36054 - RNA, 64 nt, Homo Sapiens
aaagaaaagaaaaaaaaucuaaaaaaaaagacaaaaaaaaaaaauuucaacgaaauggaaaaga

SEQ ID NO: 36055 - RNA, 64 nt, Homo Sapiens
aaaagaaaagaaaaaaaaucaaaaaaaaaagacaaaaaaaaaaaauuucaacgaaauggaaaag

SEQ ID NO: 36056 - RNA, 64 nt, Homo Sapiens
aaaaagaaaagaaaaaaaaugaaaaaaaaaagacaaaaaaaaaauauuucaacgaaauggaaaa

SEQ ID NO: 36057 - RNA, 64 nt, Homo Sapiens
caaaaaaaaaaaaaaagaaagaaauggaaaagaaaaaaaaaagaauugcuguaaauauuucaac

SEQ ID NO: 36058 - RNA, 64 nt, Homo Sapiens
acaaaaaaaaaaaaaaagaacgaaauggaaaagaaaaaaaaaagcauugcuguaaauauuucaa

SEQ ID NO: 36059 - RNA, 64 nt, Homo Sapiens
gacaaaaaaaaaaaaaaagaacgaaauggaaaagaaaaaaaaaaccauugcuguaaauauuuca

SEQ ID NO: 36060 - RNA, 64 nt, Homo Sapiens
aaaaauuagccaagcaugguccaucucuacccaaaaaaaaaauuugugggcaacagagugagaa

SEQ ID NO: 36061 - RNA, 64 nt, Homo Sapiens
uaaaaauuagccaagcauggaccaucucuacccaaaaaaaaaaugugugggcaacagagugaga

SEQ ID NO: 36062 - RNA, 64 nt, Homo Sapiens
uuaaaaauuagccaagcaugaaccaucucuacccaaaaaaaaaaagugugggcaacagagugag

SEQ ID NO: 36063 - RNA, 64 nt, Homo Sapiens
aaagaaaacuugaugugauugaccccaucucuuaaaaaaaaaggcaaccuggacaacauagcaa

SEQ ID NO: 36064 - RNA, 64 nt, Homo Sapiens
gaaagaaaacuugaugugauagaccccaucucuuaaaaaaaaagccaaccuggacaacauagca

SEQ ID NO: 36065 - RNA, 64 nt, Homo Sapiens
aaacaaaaccaaguucccacgacuccaucucaaaaaaaaaaacacagccuggguaacagagcga

SEQ ID NO: 36066 - RNA, 64 nt, Homo Sapiens
aaaacaaaaccaaguucccaagacuccaucucaaaaaaaaaaacccagccuggguaacagagcg

SEQ ID NO: 36067 - RNA, 64 nt, Homo Sapiens
caaaacaaaaccaaguucccgagacuccaucucaaaaaaaaaaauccagccuggguaacagagc

SEQ ID NO: 36068 - RNA, 64 nt, Homo Sapiens
acaaaacaaaaccaaguucccgagacuccaucucaaaaaaaaaacuccagccuggguaacagag

SEQ ID NO: 36069 - RNA, 64 nt, Homo Sapiens
agccaggcaugguggugugcccaccaucucugaaaaaaaaaauuugggcaacauagcaagaccc

SEQ ID NO: 36070 - RNA, 64 nt, Homo Sapiens
uagccaggcaugguggugugcccaccaucucugaaaaaaaaaaucugggcaacauagcaagacc

SEQ ID NO: 36071 - RNA, 64 nt, Homo Sapiens
uuagccaggcauggugguguccccaccaucucugaaaaaaaaaaccugggcaacauagcaagac

SEQ ID NO: 36072 - RNA, 64 nt, Homo Sapiens
cuccgccccuuuccucgaucaaaugggaagaagaaaaaaaaauucuuguguugguuuuuuaaag

SEQ ID NO: 36073 - RNA, 64 nt, Homo Sapiens
ucuccgccccuuuccucgaugaaaugggaagaagaaaaaaaaauucuuguguugguuuuuuaaa

SEQ ID NO: 36074 - RNA, 64 nt, Homo Sapiens
agauucuuaaaguguggcaauuguucuuuguuaaaaaaaaaauuagaagauuaaaucagaauag

SEQ ID NO: 36075 - RNA, 64 nt, Homo Sapiens
uagauucuuaaaguguggcaguuguucuuuguuaaaaaaaaaaugagaagauuaaaucagaaua

SEQ ID NO: 36076 - RNA, 64 nt, Homo Sapiens
uuagauucuuaaaguguggcaguuguucuuuguuaaaaaaaaaaugagaagauuaaaucagaau

SEQ ID NO: 36077 - RNA, 64 nt, Homo Sapiens
acuuguacuguauuuccuaaaaaaagaacaaaaaaaaaaaaagagucuauuugaaaagguuaaa

SEQ ID NO: 36078 - RNA, 64 nt, Homo Sapiens
aacuuguacuguauuuccuaaaaaaagaacaaaaaaaaaaaaagagucuauuugaaaagguuaa

SEQ ID NO: 36079 - RNA, 64 nt, Homo Sapiens
gaacuuguacuguauuuccuaaaaaaagaacaaaaaaaaaaaaaaagucuauuugaaaagguua

SEQ ID NO: 36080 - RNA, 64 nt, Homo Sapiens
agaacuuguacuguauuuccaaaaaaaagaacaaaaaaaaaaaauaagucuauuugaaaagguu

SEQ ID NO: 36081 - RNA, 64 nt, Homo Sapiens
aagaacuuguacuguauuucuaaaaaaaagaacaaaaaaaaaaauuaagucuauuugaaaaggu

SEQ ID NO: 36082 - RNA, 64 nt, Homo Sapiens
aaagaacuuguacuguauuuuuaaaaaaaagaacaaaaaaaaaaguuaagucuauuugaaaagg

SEQ ID NO: 36083 - RNA, 64 nt, Homo Sapiens
acaaaaaaaaaaaaagaacuuauuugaaaagguuaaaaaaaagaagugcucaaaggguuaaguc

SEQ ID NO: 36084 - RNA, 64 nt, Homo Sapiens
ugauugugguuaaaugaccucagacucucuuaugaaaaaaaauguguauauauuguauagauuu

SEQ ID NO: 36085 - RNA, 64 nt, Homo Sapiens
aacuuuuuaaaacuuucuaugcgauuccgucucaaaaaaaaagucaaaaaauuagcaacagagc

SEQ ID NO: 36086 - RNA, 64 nt, Homo Sapiens
uaacuuuuuaaaacuuucuacgcgauuccgucucaaaaaaaaagacaaaaaauuagcaacagag

SEQ ID NO: 36087 - RNA, 64 nt, Homo Sapiens
aauauagaaaagcugcuucugauaaucuaugcuaaaaaaaaaugucacuguuuccuaagcauca

SEQ ID NO: 36088 - RNA, 64 nt, Homo Sapiens
gaauauagaaaagcugcuucagauaaucuaugcuaaaaaaaaaucucacuguuuccuaagcauc

SEQ ID NO: 36089 - RNA, 64 nt, Homo Sapiens
uguuuuuugaauggguuuuuagacccugucucaaaaaaaaaauuccagccugggugacagagug

SEQ ID NO: 36090 - RNA, 64 nt, Homo Sapiens
uuguuuuuugaauggguuuugagacccugucucaaaaaaaaaauuccagccugggugacagagu

SEQ ID NO: 36091 - RNA, 64 nt, Homo Sapiens
uuuguuuuuugaauggguuuugagacccugucucaaaaaaaaaacuccagccugggugacagag

SEQ ID NO: 36092 - RNA, 64 nt, Homo Sapiens
aaaaaccuuuauguauacagagagaugcuacaaaaaaaaaaagauucaguauuucuaucaagaa

SEQ ID NO: 36093 - RNA, 64 nt, Homo Sapiens
aaaaaaccuuuauguauacaaagagaugcuacaaaaaaaaaaagauucaguauuucuaucaaga

SEQ ID NO: 36094 - RNA, 64 nt, Homo Sapiens
gaaaaaaccuuuauguauacaaagagaugcuacaaaaaaaaaaacauucaguauuucuaucaag

SEQ ID NO: 36095 - RNA, 64 nt, Homo Sapiens
agaaaaaaccuuuauguauagaaagagaugcuacaaaaaaaaaaucauucaguauuucuaucaa

SEQ ID NO: 36096 - RNA, 64 nt, Homo Sapiens
uuuuuagagauggggucucagccuagcucauuuaaaaaaaaauuccauagcuguucaucaccau

SEQ ID NO: 36097 - RNA, 64 nt, Homo Sapiens
uuuuuuagagauggggucucugccuagcucauuuaaaaaaaaauaccauagcuguucaucacca

SEQ ID NO: 36098 - RNA, 64 nt, Homo Sapiens
uagggggagcaaaaccaucacagaauaaacucaaaaaaaaaaggaaccaagaaaaaaaaucaau

SEQ ID NO: 36099 - RNA, 64 nt, Homo Sapiens
guagggggagcaaaaccaucucagaauaaacucaaaaaaaaaagaaaccaagaaaaaaaaucaa

SEQ ID NO: 36100 - RNA, 64 nt, Homo Sapiens
gguagggggagcaaaaccauaucagaauaaacucaaaaaaaaaagaaaccaagaaaaaaaauca

SEQ ID NO: 36101 - RNA, 64 nt, Homo Sapiens
aaucagaauaaacucaaaaaauccagaaaccaagaaaaaaaauccuguccccagagggugguuu

SEQ ID NO: 36102 - RNA, 64 nt, Homo Sapiens
ccagcuuugcagccagaagccaaugaaaaaaaaaaaaaaaaagagagaaagcaagacccuauau

SEQ ID NO: 36103 - RNA, 64 nt, Homo Sapiens
accagcuuugcagccagaagucaaugaaaaaaaaaaaaaaaaagugagaaagcaagacccuaua

SEQ ID NO: 36104 - RNA, 64 nt, Homo Sapiens
gaccagcuuugcagccagaaaucaaugaaaaaaaaaaaaaaaaagugagaaagcaagacccuau

SEQ ID NO: 36105 - RNA, 64 nt, Homo Sapiens
agaccagcuuugcagccagauaucaaugaaaaaaaaaaaaaaaaggugagaaagcaagacccua

SEQ ID NO: 36106 - RNA, 64 nt, Homo Sapiens
aagaccagcuuugcagccagauaucaaugaaaaaaaaaaaaaaagggugagaaagcaagacccu

SEQ ID NO: 36107 - RNA, 64 nt, Homo Sapiens
aaagaccagcuuugcagccauauaucaaugaaaaaaaaaaaaaaugggugagaaagcaagaccc

SEQ ID NO: 36108 - RNA, 64 nt, Homo Sapiens
aaaagaccagcuuugcagcccuauaucaaugaaaaaaaaaaaaacugggugagaaagcaagacc

SEQ ID NO: 36109 - RNA, 64 nt, Homo Sapiens
aaaaagaccagcuuugcagcccuauaucaaugaaaaaaaaaaaaccugggugagaaagcaagac

SEQ ID NO: 36110 - RNA, 64 nt, Homo Sapiens
aaaaaagaccagcuuugcagcccuauaucaaugaaaaaaaaaaagccugggugagaaagcaaga

SEQ ID NO: 36111 - RNA, 64 nt, Homo Sapiens
aaaaaaagaccagcuuugcaacccuauaucaaugaaaaaaaaaaagccugggugagaaagcaag

SEQ ID NO: 36112 - RNA, 64 nt, Homo Sapiens
auuuggagaugguucugcccacccugucucaaaaaaaaaaaagaagccugggugacagagcgag

SEQ ID NO: 36113 - RNA, 64 nt, Homo Sapiens
aauuuggagaugguucugccgacccugucucaaaaaaaaaaaagcagccugggugacagagcga

SEQ ID NO: 36114 - RNA, 64 nt, Homo Sapiens
gaauuuggagaugguucugcagacccugucucaaaaaaaaaaaaccagccugggugacagagcg

SEQ ID NO: 36115 - RNA, 64 nt, Homo Sapiens
agaauuuggagaugguucuggagacccugucucaaaaaaaaaaauccagccugggugacagagc

SEQ ID NO: 36116 - RNA, 64 nt, Homo Sapiens
aagaauuuggagaugguucucgagacccugucucaaaaaaaaaacuccagccugggugacagag

SEQ ID NO: 36117 - RNA, 64 nt, Homo Sapiens
uugggccaggcacaguggcuaagucuacguuaaaaaaaaaaaguggaccaggucaugcagcuga

SEQ ID NO: 36118 - RNA, 64 nt, Homo Sapiens
uuugggccaggcacaguggcaaagucuacguuaaaaaaaaaaaggggaccaggucaugcagcug

SEQ ID NO: 36119 - RNA, 64 nt, Homo Sapiens
guuugggccaggcacagugggaaagucuacguuaaaaaaaaaaaugggaccaggucaugcagcu

SEQ ID NO: 36120 - RNA, 64 nt, Homo Sapiens
aguuugggccaggcacagugugaaagucuacguuaaaaaaaaaacugggaccaggucaugcagc

SEQ ID NO: 36121 - RNA, 62 nt, Homo Sapiens
cccacaaaaucaaacaaaccaacaaaccaaaaaaaaaaaaaaacaaacaaaaaaaaaccaaa

SEQ ID NO: 36122 - RNA, 63 nt, Homo Sapiens
cccacaaaaucaaacaaaccaaacaaaccaaaaaaaaaaaaaaaacaaacaaaaaaaaaccaa

SEQ ID NO: 36123 - RNA, 64 nt, Homo Sapiens
cccacaaaaucaaacaaaccaaaacaaaccaaaaaaaaaaaaaaaaacaaacaaaaaaaaacca

SEQ ID NO: 36124 - RNA, 64 nt, Homo Sapiens
acccacaaaaucaaacaaacaaaaacaaaccaaaaaaaaaaaaaaaaacaaacaaaaaaaaacc

SEQ ID NO: 36125 - RNA, 64 nt, Homo Sapiens
aacccacaaaaucaaacaaacaaaaacaaaccaaaaaaaaaaaaaaaaacaaacaaaaaaaaac

SEQ ID NO: 36126 - RNA, 64 nt, Homo Sapiens
aaacccacaaaaucaaacaaccaaaaacaaaccaaaaaaaaaaagaaaaacaaacaaaaaaaaa

SEQ ID NO: 36127 - RNA, 64 nt, Homo Sapiens
aaaacccacaaaaucaaacaaccaaaaacaaaccaaaaaaaaaaugaaaaacaaacaaaaaaaa

SEQ ID NO: 36128 - RNA, 64 nt, Homo Sapiens
aaaaacaaaccaaaaaaaaagugaaaaacaaacaaaaaaaaacccugccccaaaggaaccagag

SEQ ID NO: 36129 - RNA, 64 nt, Homo Sapiens
caaaaacaaaccaaaaaaaaggugaaaaacaaacaaaaaaaaacgcugccccaaaggaaccaga

SEQ ID NO: 36130 - RNA, 64 nt, Homo Sapiens
aaagaaacuaaccaacaaaacaaccaaaaaaaaaaaaaaaaaggggaaagaccaaaaaaacaac

SEQ ID NO: 36131 - RNA, 64 nt, Homo Sapiens
gaaagaaacuaaccaacaaaccaaccaaaaaaaaaaaaaaaaagaggaaagaccaaaaaaacaa

SEQ ID NO: 36132 - RNA, 64 nt, Homo Sapiens
ggaaagaaacuaaccaacaaaccaaccaaaaaaaaaaaaaaaaagaggaaagaccaaaaaaaca

SEQ ID NO: 36133 - RNA, 64 nt, Homo Sapiens
aggaaagaaacuaaccaacaaaccaaccaaaaaaaaaaaaaaaaggaggaaagaccaaaaaaac

SEQ ID NO: 36134 - RNA, 64 nt, Homo Sapiens
aaggaaagaaacuaaccaaccaaccaaccaaaaaaaaaaaaaaagggaggaaagaccaaaaaaa

SEQ ID NO: 36135 - RNA, 64 nt, Homo Sapiens
aaaggaaagaaacuaaccaaacaaccaaccaaaaaaaaaaaaaaagggaggaaagaccaaaaaa

SEQ ID NO: 36136 - RNA, 64 nt, Homo Sapiens
aaaaggaaagaaacuaaccaaacaaccaaccaaaaaaaaaaaaaaagggaggaaagaccaaaaa

SEQ ID NO: 36137 - RNA, 64 nt, Homo Sapiens
aaaaaggaaagaaacuaaccaaacaaccaaccaaaaaaaaaaaacaagggaggaaagaccaaaa

SEQ ID NO: 36138 - RNA, 64 nt, Homo Sapiens
aaaaaaggaaagaaacuaacaaaacaaccaaccaaaaaaaaaaaacaagggaggaaagaccaaa

SEQ ID NO: 36139 - RNA, 64 nt, Homo Sapiens
aaaaaaaggaaagaaacuaaaaaaacaaccaaccaaaaaaaaaagacaagggaggaaagaccaa

SEQ ID NO: 36140 - RNA, 64 nt, Homo Sapiens
ggcuggaugugguggggcaucuccacuaaaaauaaaaaaaaauugcaacacagugagaccucau

SEQ ID NO: 36141 - RNA, 64 nt, Homo Sapiens
uggcuggaugugguggggcaucuccacuaaaaauaaaaaaaaauggcaacacagugagaccuca

SEQ ID NO: 36142 - RNA, 64 nt, Homo Sapiens
cugauuccuuguagcaacccccaucugauuaaaaaaaaaaaauagaugugagccaccacacaca

SEQ ID NO: 36143 - RNA, 64 nt, Homo Sapiens
acugauuccuuguagcaaccaccaucugauuaaaaaaaaaaaauagaugugagccaccacacac

SEQ ID NO: 36144 - RNA, 64 nt, Homo Sapiens
uacugauuccuuguagcaaccaccaucugauuaaaaaaaaaaaacagaugugagccaccacaca

SEQ ID NO: 36145 - RNA, 64 nt, Homo Sapiens
auacugauuccuuguagcaaacaccaucugauuaaaaaaaaaaaacagaugugagccaccacac

SEQ ID NO: 36146 - RNA, 64 nt, Homo Sapiens
aauacugauuccuuguagcacacaccaucugauuaaaaaaaaaauacagaugugagccaccaca

SEQ ID NO: 36147 - RNA, 64 nt, Homo Sapiens
uuuccacucuuuaguuuuugccuuuuagacaagaaaaaaaaaucgggcuguuuguaguuuuuug

SEQ ID NO: 36148 - RNA, 64 nt, Homo Sapiens
cuuuccacucuuuaguuuuugccuuuuagacaagaaaaaaaaauugggcuguuuguaguuuuuu

SEQ ID NO: 36149 - RNA, 64 nt, Homo Sapiens
aaagaaaagaaaaagccagacacucugucucaaaaaaaaaaagacagccugggcagcagagcaa

SEQ ID NO: 36150 - RNA, 64 nt, Homo Sapiens
aaaagaaaagaaaaagccagacacucugucucaaaaaaaaaaagccagccugggcagcagagca

SEQ ID NO: 36151 - RNA, 64 nt, Homo Sapiens
gaaaagaaaagaaaaagccaaacacucugucucaaaaaaaaaaauccagccugggcagcagagc

SEQ ID NO: 36152 - RNA, 64 nt, Homo Sapiens
agaaaagaaaagaaaaagcccaacacucugucucaaaaaaaaaacuccagccugggcagcagag

SEQ ID NO: 36153 - RNA, 64 nt, Homo Sapiens
aacucccaggagacagcagccaaaaaaaaaaaaaaaaaaaaagaaggcaacagagacucugucu

SEQ ID NO: 36154 - RNA, 64 nt, Homo Sapiens
aaacucccaggagacagcagucaaaaaaaaaaaaaaaaaaaaaguaggcaacagagacucuguc

SEQ ID NO: 36155 - RNA, 64 nt, Homo Sapiens
gaaacucccaggagacagcacucaaaaaaaaaaaaaaaaaaaaacuaggcaacagagacucugu

SEQ ID NO: 36156 - RNA, 64 nt, Homo Sapiens
agaaacucccaggagacagcucucaaaaaaaaaaaaaaaaaaaaccuaggcaacagagacucug

SEQ ID NO: 36157 - RNA, 64 nt, Homo Sapiens
aagaaacucccaggagacaggucucaaaaaaaaaaaaaaaaaaagccuaggcaacagagacucu

SEQ ID NO: 36158 - RNA, 64 nt, Homo Sapiens
aaagaaacucccaggagacaugucucaaaaaaaaaaaaaaaaaaagccuaggcaacagagacuc

SEQ ID NO: 36159 - RNA, 64 nt, Homo Sapiens
aaaagaaacucccaggagaccugucucaaaaaaaaaaaaaaaaacagccuaggcaacagagacu

SEQ ID NO: 36160 - RNA, 64 nt, Homo Sapiens
aaaaagaaacucccaggagaucugucucaaaaaaaaaaaaaaaaccagccuaggcaacagagac

SEQ ID NO: 36161 - RNA, 64 nt, Homo Sapiens
aaaaaagaaacucccaggagcucugucucaaaaaaaaaaaaaaauccagccuaggcaacagaga

SEQ ID NO: 36162 - RNA, 64 nt, Homo Sapiens
aaaaaaagaaacucccaggaacucugucucaaaaaaaaaaaaaacuccagccuaggcaacagag

SEQ ID NO: 36163 - RNA, 64 nt, Homo Sapiens
aaaaaaaagaaacucccagggacucugucucaaaaaaaaaaaaaacuccagccuaggcaacaga

SEQ ID NO: 36164 - RNA, 64 nt, Homo Sapiens
aaaaaaaaagaaacucccagagacucugucucaaaaaaaaaaaacacuccagccuaggcaacag

SEQ ID NO: 36165 - RNA, 64 nt, Homo Sapiens
aaaaaaaaaagaaacucccagagacucugucucaaaaaaaaaaagcacuccagccuaggcaaca

SEQ ID NO: 36166 - RNA, 64 nt, Homo Sapiens
aaaaaaaaaaagaaacucccagagacucugucucaaaaaaaaaaugcacuccagccuaggcaac

SEQ ID NO: 36167 - RNA, 64 nt, Homo Sapiens
cugggcaugguggcucacgcgaacauuuaaaaaaaaaaaaaaggaguccaagugguucccauuu

SEQ ID NO: 36168 - RNA, 64 nt, Homo Sapiens
gcugggcaugguggcucacgugaacauuuaaaaaaaaaaaaaagaaguccaagugguucccauu

SEQ ID NO: 36169 - RNA, 64 nt, Homo Sapiens
ggcugggcaugguggcucacuugaacauuuaaaaaaaaaaaaaacaaguccaagugguucccau

SEQ ID NO: 36170 - RNA, 64 nt, Homo Sapiens
aggcugggcaugguggcucauuugaacauuuaaaaaaaaaaaaaccaaguccaagugguuccca

SEQ ID NO: 36171 - RNA, 64 nt, Homo Sapiens
aaggcugggcaugguggcucauuugaacauuuaaaaaaaaaaaaaccaaguccaagugguuccc

SEQ ID NO: 36172 - RNA, 64 nt, Homo Sapiens
aaaggcugggcaugguggcucauuugaacauuuaaaaaaaaaaagaccaaguccaagugguucc

SEQ ID NO: 36173 - RNA, 64 nt, Homo Sapiens
aaaaggcugggcaugguggcccauuugaacauuuaaaaaaaaaaggaccaaguccaagugguuc

SEQ ID NO: 36174 - RNA, 64 nt, Homo Sapiens
aaguaaugugacucaaggccgugugcaacagaaaaaaaaaaauguccagaacuuuccauuugca

SEQ ID NO: 36175 - RNA, 64 nt, Homo Sapiens
gaaguaaugugacucaaggcagugugcaacagaaaaaaaaaaauuuccagaacuuuccauuugc

SEQ ID NO: 36176 - RNA, 64 nt, Homo Sapiens
ugaaguaaugugacucaaggcagugugcaacagaaaaaaaaaaacuuccagaacuuuccauuug

SEQ ID NO: 36177 - RNA, 64 nt, Homo Sapiens
augaaguaaugugacucaaggcagugugcaacagaaaaaaaaaaucuuccagaacuuuccauuu

SEQ ID NO: 36178 - RNA, 64 nt, Homo Sapiens
cuuuguguccccugauuuggcucaucagaaaaaaaaaaaaaagcgcuuauuuuaggauuaccca

SEQ ID NO: 36179 - RNA, 64 nt, Homo Sapiens
ccuuuguguccccugauuugacucaucagaaaaaaaaaaaaaagugcuuauuuuaggauuaccc

SEQ ID NO: 36180 - RNA, 64 nt, Homo Sapiens
gccuuuguguccccugauuucacucaucagaaaaaaaaaaaaaacugcuuauuuuaggauuacc

SEQ ID NO: 36181 - RNA, 64 nt, Homo Sapiens
agccuuuguguccccugauuccacucaucagaaaaaaaaaaaaaccugcuuauuuuaggauuac

SEQ ID NO: 36182 - RNA, 64 nt, Homo Sapiens
aagccuuuguguccccugaucccacucaucagaaaaaaaaaaaauccugcuuauuuuaggauua

SEQ ID NO: 36183 - RNA, 64 nt, Homo Sapiens
aaagccuuuguguccccugaacccacucaucagaaaaaaaaaaauuccugcuuauuuuaggauu

SEQ ID NO: 36184 - RNA, 64 nt, Homo Sapiens
aaaagccuuuguguccccuguacccacucaucagaaaaaaaaaauuuccugcuuauuuuaggau

SEQ ID NO: 36185 - RNA, 64 nt, Homo Sapiens
auaucaaagcuggaugguggcucaaaaaaaaaaaaaaaaaaagggggcgacagugagaaucugu

SEQ ID NO: 36186 - RNA, 64 nt, Homo Sapiens
gauaucaaagcuggauggugucucaaaaaaaaaaaaaaaaaaagugggcgacagugagaaucug

SEQ ID NO: 36187 - RNA, 64 nt, Homo Sapiens
ggauaucaaagcuggauggugucucaaaaaaaaaaaaaaaaaaacugggcgacagugagaaucu

SEQ ID NO: 36188 - RNA, 64 nt, Homo Sapiens
aggauaucaaagcuggauggugucucaaaaaaaaaaaaaaaaaaccugggcgacagugagaauc

SEQ ID NO: 36189 - RNA, 64 nt, Homo Sapiens
aaggauaucaaagcuggaugcugucucaaaaaaaaaaaaaaaaagccugggcgacagugagaau

SEQ ID NO: 36190 - RNA, 64 nt, Homo Sapiens
aaaggauaucaaagcuggauucugucucaaaaaaaaaaaaaaaaggccugggcgacagugagaa

SEQ ID NO: 36191 - RNA, 64 nt, Homo Sapiens
aaaaggauaucaaagcuggaaucugucucaaaaaaaaaaaaaaacggccugggcgacagugaga

SEQ ID NO: 36192 - RNA, 64 nt, Homo Sapiens
aaaaaggauaucaaagcuggaaucugucucaaaaaaaaaaaaaaccggccugggcgacagugag

SEQ ID NO: 36193 - RNA, 64 nt, Homo Sapiens
aaaaaaggauaucaaagcuggaaucugucucaaaaaaaaaaaaauccggccugggcgacaguga

SEQ ID NO: 36194 - RNA, 64 nt, Homo Sapiens
aaaaaaaggauaucaaagcuagaaucugucucaaaaaaaaaaaacuccggccugggcgacagug

SEQ ID NO: 36195 - RNA, 64 nt, Homo Sapiens
aaaaaaaaggauaucaaagcgagaaucugucucaaaaaaaaaaaacuccggccugggcgacagu

SEQ ID NO: 36196 - RNA, 64 nt, Homo Sapiens
aaaaaaaaaggauaucaaagugagaaucugucucaaaaaaaaaacacuccggccugggcgacag

SEQ ID NO: 36197 - RNA, 64 nt, Homo Sapiens
gaccaggugcucuggcucauucuuaauuuaaaaaaaaaaaaauagccaccaugaccaacguguu

SEQ ID NO: 36198 - RNA, 64 nt, Homo Sapiens
agaccaggugcucuggcucauucuuaauuuaaaaaaaaaaaaauagccaccaugaccaacgugu

SEQ ID NO: 36199 - RNA, 64 nt, Homo Sapiens
uagaccaggugcucuggcucuuucuuaauuuaaaaaaaaaaaaagagccaccaugaccaacgug

SEQ ID NO: 36200 - RNA, 64 nt, Homo Sapiens
auagaccaggugcucuggcuguuucuuaauuuaaaaaaaaaaaaugagccaccaugaccaacgu

SEQ ID NO: 36201 - RNA, 64 nt, Homo Sapiens
aauagaccaggugcucuggcuguuucuuaauuuaaaaaaaaaaaaugagccaccaugaccaacg

SEQ ID NO: 36202 - RNA, 64 nt, Homo Sapiens
aaauagaccaggugcucuggguguuucuuaauuuaaaaaaaaaacaugagccaccaugaccaac

SEQ ID NO: 36203 - RNA, 64 nt, Homo Sapiens
aagugaugcacagaguggcaaaaaaaaaaaaaaaaaaaaaaagaagcgagacuccaucucaaaa

SEQ ID NO: 36204 - RNA, 64 nt, Homo Sapiens
aaagugaugcacagaguggcaaaaaaaaaaaaaaaaaaaaaaaggagcgagacuccaucucaaa

SEQ ID NO: 36205 - RNA, 64 nt, Homo Sapiens
gaaagugaugcacagaguggaaaaaaaaaaaaaaaaaaaaaaaaagagcgagacuccaucucaa

SEQ ID NO: 36206 - RNA, 64 nt, Homo Sapiens
agaaagugaugcacagagugaaaaaaaaaaaaaaaaaaaaaaaacagagcgagacuccaucuca

SEQ ID NO: 36207 - RNA, 64 nt, Homo Sapiens
aagaaagugaugcacagaguaaaaaaaaaaaaaaaaaaaaaaaaacagagcgagacuccaucuc

SEQ ID NO: 36208 - RNA, 64 nt, Homo Sapiens
aaagaaagugaugcacagagcaaaaaaaaaaaaaaaaaaaaaaagacagagcgagacuccaucu

SEQ ID NO: 36209 - RNA, 64 nt, Homo Sapiens
aaaagaaagugaugcacagaucaaaaaaaaaaaaaaaaaaaaaaugacagagcgagacuccauc

SEQ ID NO: 36210 - RNA, 64 nt, Homo Sapiens
aaaaagaaagugaugcacagcucaaaaaaaaaaaaaaaaaaaaagugacagagcgagacuccau

SEQ ID NO: 36211 - RNA, 64 nt, Homo Sapiens
aaaaaagaaagugaugcacaucucaaaaaaaaaaaaaaaaaaaaggugacagagcgagacucca

SEQ ID NO: 36212 - RNA, 64 nt, Homo Sapiens
aaaaaaagaaagugaugcacaucucaaaaaaaaaaaaaaaaaaagggugacagagcgagacucc

SEQ ID NO: 36213 - RNA, 64 nt, Homo Sapiens
aaaaaaaagaaagugaugcacaucucaaaaaaaaaaaaaaaaaaugggugacagagcgagacuc

SEQ ID NO: 36214 - RNA, 64 nt, Homo Sapiens
aaaaaaaaagaaagugaugcccaucucaaaaaaaaaaaaaaaaacugggugacagagcgagacu

SEQ ID NO: 36215 - RNA, 64 nt, Homo Sapiens
aaaaaaaaaagaaagugauguccaucucaaaaaaaaaaaaaaaaccugggugacagagcgagac

SEQ ID NO: 36216 - RNA, 64 nt, Homo Sapiens
aaaaaaaaaaagaaagugaucuccaucucaaaaaaaaaaaaaaagccugggugacagagcgaga

SEQ ID NO: 36217 - RNA, 64 nt, Homo Sapiens
aaaaaaaaaaaagaaagugaacuccaucucaaaaaaaaaaaaaaagccugggugacagagcgag

SEQ ID NO: 36218 - RNA, 64 nt, Homo Sapiens
aaaaaaaaaaaaagaaaguggacuccaucucaaaaaaaaaaaaacagccugggugacagagcga

SEQ ID NO: 36219 - RNA, 64 nt, Homo Sapiens
aaaaaaaaaaaaaagaaaguagacuccaucucaaaaaaaaaaaaccagccugggugacagagcg

SEQ ID NO: 36220 - RNA, 64 nt, Homo Sapiens
aaaaaaaaaaaaaaagaaaggagacuccaucucaaaaaaaaaaauccagccugggugacagagc

SEQ ID NO: 36221 - RNA, 64 nt, Homo Sapiens
aaaaaaaaaaaaaaaagaaacgagacuccaucucaaaaaaaaaacuccagccugggugacagag

SEQ ID NO: 36222 - RNA, 64 nt, Homo Sapiens
caaugacuguggcaaacuccaucuuaaaggaaaaaaaaaaaaugggcaaaaagagcaaaacucc

SEQ ID NO: 36223 - RNA, 64 nt, Homo Sapiens
gcaaugacuguggcaaacuccaucuuaaaggaaaaaaaaaaaaugggcaaaaagagcaaaacuc

SEQ ID NO: 36224 - RNA, 64 nt, Homo Sapiens
ugcaaugacuguggcaaacuccaucuuaaaggaaaaaaaaaaaaugggcaaaaagagcaaaacu

SEQ ID NO: 36225 - RNA, 64 nt, Homo Sapiens
augcaaugacuguggcaaacuccaucuuaaaggaaaaaaaaaaacugggcaaaaagagcaaaac

SEQ ID NO: 36226 - RNA, 64 nt, Homo Sapiens
aaugcaaugacuguggcaaacuccaucuuaaaggaaaaaaaaaaccugggcaaaaagagcaaaa

SEQ ID NO: 36227 - RNA, 64 nt, Homo Sapiens
aaccuuacaaaggagugcggcaaaaaaaaaaaaaaaaaaaaagucaggagugaaacuccaucuc

SEQ ID NO: 36228 - RNA, 64 nt, Homo Sapiens
uaaccuuacaaaggagugcgccaaaaaaaaaaaaaaaaaaaaagacaggagugaaacuccaucu

SEQ ID NO: 36229 - RNA, 64 nt, Homo Sapiens
guaaccuuacaaaggagugcuccaaaaaaaaaaaaaaaaaaaaaaacaggagugaaacuccauc

SEQ ID NO: 36230 - RNA, 64 nt, Homo Sapiens
aguaaccuuacaaaggagugcuccaaaaaaaaaaaaaaaaaaaacaacaggagugaaacuccau

SEQ ID NO: 36231 - RNA, 64 nt, Homo Sapiens
aaguaaccuuacaaaggaguucuccaaaaaaaaaaaaaaaaaaagcaacaggagugaaacucca

SEQ ID NO: 36232 - RNA, 64 nt, Homo Sapiens
aaaguaaccuuacaaaggagaucuccaaaaaaaaaaaaaaaaaaggcaacaggagugaaacucc

SEQ ID NO: 36233 - RNA, 64 nt, Homo Sapiens
aaaaguaaccuuacaaaggacaucuccaaaaaaaaaaaaaaaaagggcaacaggagugaaacuc

SEQ ID NO: 36234 - RNA, 64 nt, Homo Sapiens
aaaaaguaaccuuacaaaggccaucuccaaaaaaaaaaaaaaaaugggcaacaggagugaaacu

SEQ ID NO: 36235 - RNA, 64 nt, Homo Sapiens
aaaaaaguaaccuuacaaaguccaucuccaaaaaaaaaaaaaaacugggcaacaggagugaaac

SEQ ID NO: 36236 - RNA, 64 nt, Homo Sapiens
aaaaaaaguaaccuuacaaacuccaucuccaaaaaaaaaaaaaaccugggcaacaggagugaaa

SEQ ID NO: 36237 - RNA, 64 nt, Homo Sapiens
aaaaaaaaguaaccuuacaaacuccaucuccaaaaaaaaaaaaagccugggcaacaggagugaa

SEQ ID NO: 36238 - RNA, 64 nt, Homo Sapiens
aaaaaaaaaguaaccuuacaaacuccaucuccaaaaaaaaaaaaagccugggcaacaggaguga

SEQ ID NO: 36239 - RNA, 64 nt, Homo Sapiens
aaaaaaaaaaguaaccuuacaaacuccaucuccaaaaaaaaaaacagccugggcaacaggagug

SEQ ID NO: 36240 - RNA, 64 nt, Homo Sapiens
aaaaaaaaaaaguaaccuuagaaacuccaucuccaaaaaaaaaaccagccugggcaacaggagu

SEQ ID NO: 36241 - RNA, 64 nt, Homo Sapiens
agccaggcaugguggcgggccucuacuaaaaauaaaaaaaaauuccaagauggugaaacccugu

SEQ ID NO: 36242 - RNA, 64 nt, Homo Sapiens
uagccaggcaugguggcgggucucuacuaaaaauaaaaaaaaaugccaagauggugaaacccug

SEQ ID NO: 36243 - RNA, 64 nt, Homo Sapiens
uacauuuacacuacacuacaagacucccucucaaaaaaaaaaguccagccuggguggccgagcg

SEQ ID NO: 36244 - RNA, 64 nt, Homo Sapiens
uuacauuuacacuacacuacgagacucccucucaaaaaaaaaaguccagccuggguggccgagc

SEQ ID NO: 36245 - RNA, 64 nt, Homo Sapiens
guuacauuuacacuacacuacgagacucccucucaaaaaaaaaacuccagccuggguggccgag

SEQ ID NO: 36246 - RNA, 64 nt, Homo Sapiens
acaaaaaauuagccgggcauccgucucuacuaaaaaaaaaaauucuggcuaacguggagaaacc

SEQ ID NO: 36247 - RNA, 64 nt, Homo Sapiens
uacaaaaaauuagccgggcacccgucucuacuaaaaaaaaaaauccuggcuaacguggagaaac

SEQ ID NO: 36248 - RNA, 64 nt, Homo Sapiens
uuacaaaaaauuagccgggcccccgucucuacuaaaaaaaaaaauccuggcuaacguggagaaa

SEQ ID NO: 36249 - RNA, 64 nt, Homo Sapiens
auuacaaaaaauuagccgggaccccgucucuacuaaaaaaaaaaauccuggcuaacguggagaa

SEQ ID NO: 36250 - RNA, 64 nt, Homo Sapiens
ggauagaauaaugaccaaaaacaaaacaaaacaaaaaaaaaaccguucuuguuuccaaacaaca

SEQ ID NO: 36251 - RNA, 64 nt, Homo Sapiens
cggauagaauaaugaccaaaaacaaaacaaaacaaaaaaaaaacaguucuuguuuccaaacaac

SEQ ID NO: 36252 - RNA, 64 nt, Homo Sapiens
ccggauagaauaaugaccaacaacaaaacaaaacaaaaaaaaaaaaguucuuguuuccaaacaa

SEQ ID NO: 36253 - RNA, 64 nt, Homo Sapiens
uuuaaguucaaggaagaacauuugcuuucacuuaaaaaaaaaccuccuuuacuuucuuaacaaa

SEQ ID NO: 36254 - RNA, 64 nt, Homo Sapiens
cuuuaaguucaaggaagaacauuugcuuucacuuaaaaaaaaacuuccuuuacuuucuuaacaa

SEQ ID NO: 36255 - RNA, 64 nt, Homo Sapiens
cugaaacaagcuugugcuaagagacuccauuucaaaaaaaaagauccagccugggugacagagc

SEQ ID NO: 36256 - RNA, 64 nt, Homo Sapiens
acugaaacaagcuugugcuacgagacuccauuucaaaaaaaaagcuccagccugggugacagag

SEQ ID NO: 36257 - RNA, 64 nt, Homo Sapiens
uuaagaaaaacaacaacaacaaaaaaagacaaugaaaaaaaaaacgucaugugagugaagagau

SEQ ID NO: 36258 - RNA, 64 nt, Homo Sapiens
uaagaaaaacaacaacaacaaaaaaagacaaugaaaaaaaaaacgucaugugagugaagagaug

SEQ ID NO: 36259 - RNA, 64 nt, Homo Sapiens
aagaaaaacaacaacaacaaaaaaagacaaugaaaaaaaaaacgucaugugagugaagagaugu

SEQ ID NO: 36260 - RNA, 64 nt, Homo Sapiens
ccuuggaccaaauggaaauaaggcuuucugaugcaaaaaaaaaaaaaaaaaaaaaaaaaaaaag

SEQ ID NO: 36261 - RNA, 64 nt, Homo Sapiens
cuuggaccaaauggaaauaaggcuuucugaugcaaaaaaaaaaaaaaaaaaaaaaaaaaaaaga

SEQ ID NO: 36262 - RNA, 64 nt, Homo Sapiens
uuggaccaaauggaaauaaggcuuucugaugcaaaaaaaaaaaaaaaaaaaaaaaaaaaaagaa

SEQ ID NO: 36263 - RNA, 64 nt, Homo Sapiens
uggaccaaauggaaauaaggcuuucugaugcaaaaaaaaaaaaaaaaaaaaaaaaaaaaagaau

SEQ ID NO: 36264 - RNA, 64 nt, Homo Sapiens
ggaccaaauggaaauaaggcuuucugaugcaaaaaaaaaaaaaaaaaaaaaaaaaaaaagaaua

SEQ ID NO: 36265 - RNA, 64 nt, Homo Sapiens
gaccaaauggaaauaaggcuuucugaugcaaaaaaaaaaaaaaaaaaaaaaaaaaaaagaauaa

SEQ ID NO: 36266 - RNA, 64 nt, Homo Sapiens
accaaauggaaauaaggcuuucugaugcaaaaaaaaaaaaaaaaaaaaaaaaaaaaagaauaag

SEQ ID NO: 36267 - RNA, 64 nt, Homo Sapiens
ccaaauggaaauaaggcuuucugaugcaaaaaaaaaaaaaaaaaaaaaaaaaaaaagaauaaga

SEQ ID NO: 36268 - RNA, 64 nt, Homo Sapiens
caaauggaaauaaggcuuucugaugcaaaaaaaaaaaaaaaaaaaaaaaaaaaaagaauaagag

SEQ ID NO: 36269 - RNA, 64 nt, Homo Sapiens
aaauggaaauaaggcuuucugaugcaaaaaaaaaaaaaaaaaaaaaaaaaaaaagaauaagagg

SEQ ID NO: 36270 - RNA, 64 nt, Homo Sapiens
aauggaaauaaggcuuucugaugcaaaaaaaaaaaaaaaaaaaaaaaaaaaaagaauaagaggu

SEQ ID NO: 36271 - RNA, 64 nt, Homo Sapiens
auggaaauaaggcuuucugaugcaaaaaaaaaaaaaaaaaaaaaaaaaaaaagaauaagaggug

SEQ ID NO: 36272 - RNA, 64 nt, Homo Sapiens
uggaaauaaggcuuucugaugcaaaaaaaaaaaaaaaaaaaaaaaaaaaaagaauaagagguga

SEQ ID NO: 36273 - RNA, 64 nt, Homo Sapiens
ggaaauaaggcuuucugaugcaaaaaaaaaaaaaaaaaaaaaaaaaaaaagaauaagaggugau

SEQ ID NO: 36274 - RNA, 64 nt, Homo Sapiens
gaaauaaggcuuucugaugcaaaaaaaaaaaaaaaaaaaaaaaaaaaaagaauaagaggugaua

SEQ ID NO: 36275 - RNA, 64 nt, Homo Sapiens
aaauaaggcuuucugaugcaaaaaaaaaaaaaaaaaaaaaaaaaaaaagaauaagaggugauau

SEQ ID NO: 36276 - RNA, 64 nt, Homo Sapiens
aauaaggcuuucugaugcaaaaaaaaaaaaaaaaaaaaaaaaaaaaagaauaagaggugauauu

SEQ ID NO: 36277 - RNA, 64 nt, Homo Sapiens
auaaggcuuucugaugcaaaaaaaaaaaaaaaaaaaaaaaaaaaaagaauaagaggugauauua

SEQ ID NO: 36278 - RNA, 64 nt, Homo Sapiens
uaaggcuuucugaugcaaaaaaaaaaaaaaaaaaaaaaaaaaaaagaauaagaggugauauuac

SEQ ID NO: 36279 - RNA, 64 nt, Homo Sapiens
aaggcuuucugaugcaaaaaaaaaaaaaaaaaaaaaaaaaaaaagaauaagaggugauauuaca

SEQ ID NO: 36280 - RNA, 64 nt, Homo Sapiens
aggcuuucugaugcaaaaaaaaaaaaaaaaaaaaaaaaaaaaagaauaagaggugauauuacac

SEQ ID NO: 36281 - RNA, 64 nt, Homo Sapiens
ggcuuucugaugcaaaaaaaaaaaaaaaaaaaaaaaaaaaaagaauaagaggugauauuacacc

SEQ ID NO: 36282 - RNA, 64 nt, Homo Sapiens
caaccuugggcaacauagcaagaccccauuucuuaaaaaaaaaaaaaaaaaauuuaaacuuagc

SEQ ID NO: 36283 - RNA, 64 nt, Homo Sapiens
aaccuugggcaacauagcaagaccccauuucuuaaaaaaaaaaaaaaaaaauuuaaacuuagcu

SEQ ID NO: 36284 - RNA, 64 nt, Homo Sapiens
accuugggcaacauagcaagaccccauuucuuaaaaaaaaaaaaaaaaaauuuaaacuuagcug

SEQ ID NO: 36285 - RNA, 64 nt, Homo Sapiens
ccuugggcaacauagcaagaccccauuucuuaaaaaaaaaaaaaaaaaauuuaaacuuagcugg

SEQ ID NO: 36286 - RNA, 64 nt, Homo Sapiens
cuugggcaacauagcaagaccccauuucuuaaaaaaaaaaaaaaaaaauuuaaacuuagcuggg

SEQ ID NO: 36287 - RNA, 64 nt, Homo Sapiens
uugggcaacauagcaagaccccauuucuuaaaaaaaaaaaaaaaaaauuuaaacuuagcugggu

SEQ ID NO: 36288 - RNA, 64 nt, Homo Sapiens
ugggcaacauagcaagaccccauuucuuaaaaaaaaaaaaaaaaaauuuaaacuuagcugggua

SEQ ID NO: 36289 - RNA, 64 nt, Homo Sapiens
gggcaacauagcaagaccccauuucuuaaaaaaaaaaaaaaaaaauuuaaacuuagcuggguau

SEQ ID NO: 36290 - RNA, 64 nt, Homo Sapiens
ggcaacauagcaagaccccauuucuuaaaaaaaaaaaaaaaaaauuuaaacuuagcuggguaug

SEQ ID NO: 36291 - RNA, 64 nt, Homo Sapiens
gcaacauagcaagaccccauuucuuaaaaaaaaaaaaaaaaaauuuaaacuuagcuggguaugg

SEQ ID NO: 36292 - RNA, 64 nt, Homo Sapiens
caacauagcaagaccccauuucuuaaaaaaaaaaaaaaaaaauuuaaacuuagcuggguauggu

SEQ ID NO: 36293 - RNA, 64 nt, Homo Sapiens
cugggcaauaaaguaacucuugacucaaaaaaauaaaaaaaauuguagugguagccauguguua

SEQ ID NO: 36294 - RNA, 64 nt, Homo Sapiens
gauacuguagugauucaaauaaguuuucuauuugaaaaaaaaaaucacuugauuguauccuugc

SEQ ID NO: 36295 - RNA, 64 nt, Homo Sapiens
auacuguagugauucaaauaaguuuucuauuugaaaaaaaaaaucacuugauuguauccuugcc

SEQ ID NO: 36296 - RNA, 64 nt, Homo Sapiens
uacuguagugauucaaauaaguuuucuauuugaaaaaaaaaaucacuugauuguauccuugccc

SEQ ID NO: 36297 - RNA, 64 nt, Homo Sapiens
gcuuaguucaaacauaaggaaacaguguuugauuaaaaaaaacacaucuaguaagacguaaggg

SEQ ID NO: 36298 - RNA, 64 nt, Homo Sapiens
ggauuggacguugugacucuugccuuuuaagaagaaaaaaaagauaggacaaaguauuugaagc

SEQ ID NO: 36299 - RNA, 64 nt, Homo Sapiens
uauuauucaagcugcaagucaucaaaagacccagaaaaaaaaaagucuguagguuauuuucucu

SEQ ID NO: 36300 - RNA, 64 nt, Homo Sapiens
auuauucaagcugcaagucaucaaaagacccagaaaaaaaaaagucuguagguuauuuucucua

SEQ ID NO: 36301 - RNA, 64 nt, Homo Sapiens
uuauucaagcugcaagucaucaaaagacccagaaaaaaaaaagucuguagguuauuuucucuac

SEQ ID NO: 36302 - RNA, 64 nt, Homo Sapiens
cuuuauuucugucauucaaaugggugauauccugaaaaaaaaaaaaaaaaaaaaacugggacag

SEQ ID NO: 36303 - RNA, 64 nt, Homo Sapiens
uuuauuucugucauucaaaugggugauauccugaaaaaaaaaaaaaaaaaaaaacugggacagc

SEQ ID NO: 36304 - RNA, 64 nt, Homo Sapiens
uuauuucugucauucaaaugggugauauccugaaaaaaaaaaaaaaaaaaaaacugggacagcu

SEQ ID NO: 36305 - RNA, 64 nt, Homo Sapiens
uauuucugucauucaaaugggugauauccugaaaaaaaaaaaaaaaaaaaaacugggacagcuu

SEQ ID NO: 36306 - RNA, 64 nt, Homo Sapiens
auuucugucauucaaaugggugauauccugaaaaaaaaaaaaaaaaaaaaacugggacagcuuu

SEQ ID NO: 36307 - RNA, 64 nt, Homo Sapiens
uuucugucauucaaaugggugauauccugaaaaaaaaaaaaaaaaaaaaacugggacagcuuuc

SEQ ID NO: 36308 - RNA, 64 nt, Homo Sapiens
uucugucauucaaaugggugauauccugaaaaaaaaaaaaaaaaaaaaacugggacagcuuucc

SEQ ID NO: 36309 - RNA, 64 nt, Homo Sapiens
ucugucauucaaaugggugauauccugaaaaaaaaaaaaaaaaaaaaacugggacagcuuuccc

SEQ ID NO: 36310 - RNA, 64 nt, Homo Sapiens
cugucauucaaaugggugauauccugaaaaaaaaaaaaaaaaaaaaacugggacagcuuucccc

SEQ ID NO: 36311 - RNA, 64 nt, Homo Sapiens
ugucauucaaaugggugauauccugaaaaaaaaaaaaaaaaaaaaacugggacagcuuuccccu

SEQ ID NO: 36312 - RNA, 64 nt, Homo Sapiens
gucauucaaaugggugauauccugaaaaaaaaaaaaaaaaaaaaacugggacagcuuuccccuc

SEQ ID NO: 36313 - RNA, 64 nt, Homo Sapiens
ucauucaaaugggugauauccugaaaaaaaaaaaaaaaaaaaaacugggacagcuuuccccuca

SEQ ID NO: 36314 - RNA, 64 nt, Homo Sapiens
cauucaaaugggugauauccugaaaaaaaaaaaaaaaaaaaaacugggacagcuuuccccucau

SEQ ID NO: 36315 - RNA, 64 nt, Homo Sapiens
auucaaaugggugauauccugaaaaaaaaaaaaaaaaaaaaacugggacagcuuuccccucauu

SEQ ID NO: 36316 - RNA, 64 nt, Homo Sapiens
uuucuggggcuccucacauagcuacccaaaagagaaaaaaaauuaagacaagccuggcaacaca

SEQ ID NO: 36317 - RNA, 64 nt, Homo Sapiens
uguacuugucuuacagaaauuucugaacuuuaguaaaaaaaaauaaaguuaaacuuuuaaaacu

SEQ ID NO: 36318 - RNA, 64 nt, Homo Sapiens
guacuugucuuacagaaauuucugaacuuuaguaaaaaaaaauaaaguuaaacuuuuaaaacuc

SEQ ID NO: 36319 - RNA, 64 nt, Homo Sapiens
uuccagccugggcaacagagcgagacuccaucucaaaaaaaaggagacuucaugugcccccaau

SEQ ID NO: 36320 - RNA, 64 nt, Homo Sapiens
aaauguucauuaauaaaguuguuggacgggaagcaaaaaaaaaaaguuguuuaagauaaauucc

SEQ ID NO: 36321 - RNA, 64 nt, Homo Sapiens
aauguucauuaauaaaguuguuggacgggaagcaaaaaaaaaaaguuguuuaagauaaauuccc

SEQ ID NO: 36322 - RNA, 64 nt, Homo Sapiens
auguucauuaauaaaguuguuggacgggaagcaaaaaaaaaaaguuguuuaagauaaauuccca

SEQ ID NO: 36323 - RNA, 64 nt, Homo Sapiens
uguucauuaauaaaguuguuggacgggaagcaaaaaaaaaaaguuguuuaagauaaauucccag

SEQ ID NO: 36324 - RNA, 64 nt, Homo Sapiens
uuccagccugggugacagagugagacucccccucaaaaaaaaaaaaaaaaaaaaaaaaaacaga

SEQ ID NO: 36325 - RNA, 64 nt, Homo Sapiens
uccagccugggugacagagugagacucccccucaaaaaaaaaaaaaaaaaaaaaaaaaacagaa

SEQ ID NO: 36326 - RNA, 64 nt, Homo Sapiens
ccagccugggugacagagugagacucccccucaaaaaaaaaaaaaaaaaaaaaaaaaacagaaa

SEQ ID NO: 36327 - RNA, 64 nt, Homo Sapiens
cagccugggugacagagugagacucccccucaaaaaaaaaaaaaaaaaaaaaaaaaacagaaag

SEQ ID NO: 36328 - RNA, 64 nt, Homo Sapiens
agccugggugacagagugagacucccccucaaaaaaaaaaaaaaaaaaaaaaaaaacagaaaga

SEQ ID NO: 36329 - RNA, 64 nt, Homo Sapiens
gccugggugacagagugagacucccccucaaaaaaaaaaaaaaaaaaaaaaaaaacagaaagaa

SEQ ID NO: 36330 - RNA, 64 nt, Homo Sapiens
ccugggugacagagugagacucccccucaaaaaaaaaaaaaaaaaaaaaaaaaacagaaagaaa

SEQ ID NO: 36331 - RNA, 64 nt, Homo Sapiens
cugggugacagagugagacucccccucaaaaaaaaaaaaaaaaaaaaaaaaaacagaaagaaag

SEQ ID NO: 36332 - RNA, 64 nt, Homo Sapiens
ugggugacagagugagacucccccucaaaaaaaaaaaaaaaaaaaaaaaaaacagaaagaaaga

SEQ ID NO: 36333 - RNA, 64 nt, Homo Sapiens
gggugacagagugagacucccccucaaaaaaaaaaaaaaaaaaaaaaaaaacagaaagaaagaa

SEQ ID NO: 36334 - RNA, 64 nt, Homo Sapiens
ggugacagagugagacucccccucaaaaaaaaaaaaaaaaaaaaaaaaaacagaaagaaagaaa

SEQ ID NO: 36335 - RNA, 64 nt, Homo Sapiens
gugacagagugagacucccccucaaaaaaaaaaaaaaaaaaaaaaaaaacagaaagaaagaaaa

SEQ ID NO: 36336 - RNA, 64 nt, Homo Sapiens
ugacagagugagacucccccucaaaaaaaaaaaaaaaaaaaaaaaaaacagaaagaaagaaaaa

SEQ ID NO: 36337 - RNA, 64 nt, Homo Sapiens
gacagagugagacucccccucaaaaaaaaaaaaaaaaaaaaaaaaaacagaaagaaagaaaaag

SEQ ID NO: 36338 - RNA, 64 nt, Homo Sapiens
acagagugagacucccccucaaaaaaaaaaaaaaaaaaaaaaaaaacagaaagaaagaaaaaga

SEQ ID NO: 36339 - RNA, 64 nt, Homo Sapiens
cagagugagacucccccucaaaaaaaaaaaaaaaaaaaaaaaaaacagaaagaaagaaaaagaa

SEQ ID NO: 36340 - RNA, 64 nt, Homo Sapiens
agagugagacucccccucaaaaaaaaaaaaaaaaaaaaaaaaaacagaaagaaagaaaaagaaa

SEQ ID NO: 36341 - RNA, 64 nt, Homo Sapiens
gagugagacucccccucaaaaaaaaaaaaaaaaaaaaaaaaaacagaaagaaagaaaaagaaaa

SEQ ID NO: 36342 - RNA, 64 nt, Homo Sapiens
agugagacucccccucaaaaaaaaaaaaaaaaaaaaaaaaaacagaaagaaagaaaaagaaaac

SEQ ID NO: 36343 - RNA, 64 nt, Homo Sapiens
cuccagccugggcaacagagcaaaacucugucucaaaaaaaaaaaaaaaaaggcaaaauuaaag

SEQ ID NO: 36344 - RNA, 64 nt, Homo Sapiens
uccagccugggcaacagagcaaaacucugucucaaaaaaaaaaaaaaaaaggcaaaauuaaaga

SEQ ID NO: 36345 - RNA, 64 nt, Homo Sapiens
ccagccugggcaacagagcaaaacucugucucaaaaaaaaaaaaaaaaaggcaaaauuaaagaa

SEQ ID NO: 36346 - RNA, 64 nt, Homo Sapiens
cagccugggcaacagagcaaaacucugucucaaaaaaaaaaaaaaaaaggcaaaauuaaagaau

SEQ ID NO: 36347 - RNA, 64 nt, Homo Sapiens
agccugggcaacagagcaaaacucugucucaaaaaaaaaaaaaaaaaggcaaaauuaaagaauu

SEQ ID NO: 36348 - RNA, 64 nt, Homo Sapiens
gccugggcaacagagcaaaacucugucucaaaaaaaaaaaaaaaaaggcaaaauuaaagaauuu

SEQ ID NO: 36349 - RNA, 64 nt, Homo Sapiens
ccugggcaacagagcaaaacucugucucaaaaaaaaaaaaaaaaaggcaaaauuaaagaauuuc

SEQ ID NO: 36350 - RNA, 64 nt, Homo Sapiens
cugggcaacagagcaaaacucugucucaaaaaaaaaaaaaaaaaggcaaaauuaaagaauuuca

SEQ ID NO: 36351 - RNA, 64 nt, Homo Sapiens
ugggcaacagagcaaaacucugucucaaaaaaaaaaaaaaaaaggcaaaauuaaagaauuucaa

SEQ ID NO: 36352 - RNA, 64 nt, Homo Sapiens
gggcaacagagcaaaacucugucucaaaaaaaaaaaaaaaaaggcaaaauuaaagaauuucaag

SEQ ID NO: 36353 - RNA, 64 nt, Homo Sapiens
ccaaaugguuguuuuaucauugguuugguuuaccaaaaaaaaggcagggaaaaaaaaaaaaaac

SEQ ID NO: 36354 - RNA, 64 nt, Homo Sapiens
aucauugguuugguuuaccaaaaaaaaggcagggaaaaaaaaaaaaaacaaccguaugagcgca

SEQ ID NO: 36355 - RNA, 64 nt, Homo Sapiens
ucauugguuugguuuaccaaaaaaaaggcagggaaaaaaaaaaaaaacaaccguaugagcgcau

SEQ ID NO: 36356 - RNA, 64 nt, Homo Sapiens
cauugguuugguuuaccaaaaaaaaggcagggaaaaaaaaaaaaaacaaccguaugagcgcauu

SEQ ID NO: 36357 - RNA, 64 nt, Homo Sapiens
auugguuugguuuaccaaaaaaaaggcagggaaaaaaaaaaaaaacaaccguaugagcgcauug

SEQ ID NO: 36358 - RNA, 64 nt, Homo Sapiens
uugguuugguuuaccaaaaaaaaggcagggaaaaaaaaaaaaaacaaccguaugagcgcauugg

SEQ ID NO: 36359 - RNA, 64 nt, Homo Sapiens
ugguuugguuuaccaaaaaaaaggcagggaaaaaaaaaaaaaacaaccguaugagcgcauuggc

SEQ ID NO: 36360 - RNA, 64 nt, Homo Sapiens
gguuugguuuaccaaaaaaaaggcagggaaaaaaaaaaaaaacaaccguaugagcgcauuggcu

SEQ ID NO: 36361 - RNA, 64 nt, Homo Sapiens
ucaagaacaauucacaguaugagaagaaaaauggaaaaaaaaaacuuuauuuaaaaaagaaaaa

SEQ ID NO: 36362 - RNA, 64 nt, Homo Sapiens
caagaacaauucacaguaugagaagaaaaauggaaaaaaaaaacuuuauuuaaaaaagaaaaaa

SEQ ID NO: 36363 - RNA, 64 nt, Homo Sapiens
aagaacaauucacaguaugagaagaaaaauggaaaaaaaaaacuuuauuuaaaaaagaaaaaag

SEQ ID NO: 36364 - RNA, 64 nt, Homo Sapiens
acucuguacccucaacauauaucccuugugcgauaaaaaaaaaaaaaaaaaaaaaaagagaauc

SEQ ID NO: 36365 - RNA, 64 nt, Homo Sapiens
cucuguacccucaacauauaucccuugugcgauaaaaaaaaaaaaaaaaaaaaaaagagaaucg

SEQ ID NO: 36366 - RNA, 64 nt, Homo Sapiens
ucuguacccucaacauauaucccuugugcgauaaaaaaaaaaaaaaaaaaaaaaagagaaucgu

SEQ ID NO: 36367 - RNA, 64 nt, Homo Sapiens
cuguacccucaacauauaucccuugugcgauaaaaaaaaaaaaaaaaaaaaaaagagaaucgua

SEQ ID NO: 36368 - RNA, 64 nt, Homo Sapiens
uguacccucaacauauaucccuugugcgauaaaaaaaaaaaaaaaaaaaaaaagagaaucguac

SEQ ID NO: 36369 - RNA, 64 nt, Homo Sapiens
guacccucaacauauaucccuugugcgauaaaaaaaaaaaaaaaaaaaaaaagagaaucguacg

SEQ ID NO: 36370 - RNA, 64 nt, Homo Sapiens
uacccucaacauauaucccuugugcgauaaaaaaaaaaaaaaaaaaaaaaagagaaucguacgu

SEQ ID NO: 36371 - RNA, 64 nt, Homo Sapiens
acccucaacauauaucccuugugcgauaaaaaaaaaaaaaaaaaaaaaaagagaaucguacguc

SEQ ID NO: 36372 - RNA, 64 nt, Homo Sapiens
cccucaacauauaucccuugugcgauaaaaaaaaaaaaaaaaaaaaaaagagaaucguacgucg

SEQ ID NO: 36373 - RNA, 64 nt, Homo Sapiens
ccucaacauauaucccuugugcgauaaaaaaaaaaaaaaaaaaaaaaagagaaucguacgucga

SEQ ID NO: 36374 - RNA, 64 nt, Homo Sapiens
cucaacauauaucccuugugcgauaaaaaaaaaaaaaaaaaaaaaaagagaaucguacgucgac

SEQ ID NO: 36375 - RNA, 64 nt, Homo Sapiens
ucaacauauaucccuugugcgauaaaaaaaaaaaaaaaaaaaaaaagagaaucguacgucgacu

SEQ ID NO: 36376 - RNA, 64 nt, Homo Sapiens
caacauauaucccuugugcgauaaaaaaaaaaaaaaaaaaaaaaagagaaucguacgucgacuu

SEQ ID NO: 36377 - RNA, 64 nt, Homo Sapiens
aacauauaucccuugugcgauaaaaaaaaaaaaaaaaaaaaaaagagaaucguacgucgacuuu

SEQ ID NO: 36378 - RNA, 64 nt, Homo Sapiens
acauauaucccuugugcgauaaaaaaaaaaaaaaaaaaaaaaagagaaucguacgucgacuuuc

SEQ ID NO: 36379 - RNA, 64 nt, Homo Sapiens
cauauaucccuugugcgauaaaaaaaaaaaaaaaaaaaaaaagagaaucguacgucgacuuucg

SEQ ID NO: 36380 - RNA, 64 nt, Homo Sapiens
aaagaaaaauuuaugcacugauuuaaaacaaaccaaaaaaaaagaaaaaaacaaaaaaaaaaau

SEQ ID NO: 36381 - RNA, 64 nt, Homo Sapiens
aagaaaaauuuaugcacugauuuaaaacaaaccaaaaaaaaagaaaaaaacaaaaaaaaaaauc

SEQ ID NO: 36382 - RNA, 64 nt, Homo Sapiens
ugauuuaaaacaaaccaaaaaaaaagaaaaaaacaaaaaaaaaaaucccuccuuucuagcugaa

SEQ ID NO: 36383 - RNA, 64 nt, Homo Sapiens
gauuuaaaacaaaccaaaaaaaaagaaaaaaacaaaaaaaaaaaucccuccuuucuagcugaac

SEQ ID NO: 36384 - RNA, 64 nt, Homo Sapiens
auuuaaaacaaaccaaaaaaaaagaaaaaaacaaaaaaaaaaaucccuccuuucuagcugaaca

SEQ ID NO: 36385 - RNA, 64 nt, Homo Sapiens
uuuaaaacaaaccaaaaaaaaagaaaaaaacaaaaaaaaaaaucccuccuuucuagcugaacaa

SEQ ID NO: 36386 - RNA, 64 nt, Homo Sapiens
ugccuucaagaaacaaugaccugauucugucuuuaaaaaaaaaaaucucagaauucuuuuuuug

SEQ ID NO: 36387 - RNA, 64 nt, Homo Sapiens
gccuucaagaaacaaugaccugauucugucuuuaaaaaaaaaaaucucagaauucuuuuuuugu

SEQ ID NO: 36388 - RNA, 64 nt, Homo Sapiens
ccuucaagaaacaaugaccugauucugucuuuaaaaaaaaaaaucucagaauucuuuuuuuguu

SEQ ID NO: 36389 - RNA, 64 nt, Homo Sapiens
cuucaagaaacaaugaccugauucugucuuuaaaaaaaaaaaucucagaauucuuuuuuuguuu

SEQ ID NO: 36390 - RNA, 64 nt, Homo Sapiens
gcaacauggcaaaaucccaucucuacaaaacaucaaaaaaaaaaaaaauuagucgggcauggug

SEQ ID NO: 36391 - RNA, 64 nt, Homo Sapiens
caacauggcaaaaucccaucucuacaaaacaucaaaaaaaaaaaaaauuagucgggcauggugg

SEQ ID NO: 36392 - RNA, 64 nt, Homo Sapiens
aacauggcaaaaucccaucucuacaaaacaucaaaaaaaaaaaaaauuagucgggcaugguggu

SEQ ID NO: 36393 - RNA, 64 nt, Homo Sapiens
acauggcaaaaucccaucucuacaaaacaucaaaaaaaaaaaaaauuagucgggcaugguggug

SEQ ID NO: 36394 - RNA, 64 nt, Homo Sapiens
cauggcaaaaucccaucucuacaaaacaucaaaaaaaaaaaaaauuagucgggcaugguggugc

SEQ ID NO: 36395 - RNA, 64 nt, Homo Sapiens
auggcaaaaucccaucucuacaaaacaucaaaaaaaaaaaaaauuagucgggcaugguggugca

SEQ ID NO: 36396 - RNA, 64 nt, Homo Sapiens
uggcaaaaucccaucucuacaaaacaucaaaaaaaaaaaaaauuagucgggcaugguggugcac

SEQ ID NO: 36397 - RNA, 64 nt, Homo Sapiens
gcagugauaguugacuuuggauacaagguuuggcaaaaaaaaaaauauuaacaaaauauucugu

SEQ ID NO: 36398 - RNA, 64 nt, Homo Sapiens
cagugauaguugacuuuggauacaagguuuggcaaaaaaaaaaauauuaacaaaauauucugua

SEQ ID NO: 36399 - RNA, 64 nt, Homo Sapiens
agugauaguugacuuuggauacaagguuuggcaaaaaaaaaaauauuaacaaaauauucuguaa

SEQ ID NO: 36400 - RNA, 64 nt, Homo Sapiens
gugauaguugacuuuggauacaagguuuggcaaaaaaaaaaauauuaacaaaauauucuguaag

SEQ ID NO: 36401 - RNA, 64 nt, Homo Sapiens
uggggggaaagaauagauauggggaaauaaacuuaaaaaaaaaucaggaauuuaaaaaaacgag

SEQ ID NO: 36402 - RNA, 64 nt, Homo Sapiens
ggggggaaagaauagauauggggaaauaaacuuaaaaaaaaaucaggaauuuaaaaaaacgagc

SEQ ID NO: 36403 - RNA, 64 nt, Homo Sapiens
uaucuuucuugacuuuaaaaaaauuauuaaaaacaaaaaaaaaauaaauuuuuuugcaauccuu

SEQ ID NO: 36404 - RNA, 64 nt, Homo Sapiens
aucuuucuugacuuuaaaaaaauuauuaaaaacaaaaaaaaaauaaauuuuuuugcaauccuuu

SEQ ID NO: 36405 - RNA, 64 nt, Homo Sapiens
ucuuucuugacuuuaaaaaaauuauuaaaaacaaaaaaaaaauaaauuuuuuugcaauccuuuc

SEQ ID NO: 36406 - RNA, 64 nt, Homo Sapiens
cauccuggcuggucugucuuuucuccauuuguuuaaaaaaaaaacaaaaacaaaaaacaacacu

SEQ ID NO: 36407 - RNA, 64 nt, Homo Sapiens
auccuggcuggucugucuuuucuccauuuguuuaaaaaaaaaacaaaaacaaaaaacaacacuu

SEQ ID NO: 36408 - RNA, 64 nt, Homo Sapiens
uccuggcuggucugucuuuucuccauuuguuuaaaaaaaaaacaaaaacaaaaaacaacacuuu

SEQ ID NO: 36409 - RNA, 64 nt, Homo Sapiens
uuuugauaccuugggaauuucuaugcagggcuuuaaaaaaaaauaagugauucaauuuuaaaaa

SEQ ID NO: 36410 - RNA, 64 nt, Homo Sapiens
uuugauaccuugggaauuucuaugcagggcuuuaaaaaaaaauaagugauucaauuuuaaaaau

SEQ ID NO: 36411 - RNA, 64 nt, Homo Sapiens
cuccagccugggugacagagcgaggcuccgucucaaaaaaaaaaaaaaaaaauuguuuuagcgc

SEQ ID NO: 36412 - RNA, 64 nt, Homo Sapiens
uccagccugggugacagagcgaggcuccgucucaaaaaaaaaaaaaaaaaauuguuuuagcgcu

SEQ ID NO: 36413 - RNA, 64 nt, Homo Sapiens
ccagccugggugacagagcgaggcuccgucucaaaaaaaaaaaaaaaaaauuguuuuagcgcug

SEQ ID NO: 36414 - RNA, 64 nt, Homo Sapiens
cagccugggugacagagcgaggcuccgucucaaaaaaaaaaaaaaaaaauuguuuuagcgcugg

SEQ ID NO: 36415 - RNA, 64 nt, Homo Sapiens
agccugggugacagagcgaggcuccgucucaaaaaaaaaaaaaaaaaauuguuuuagcgcuggg

SEQ ID NO: 36416 - RNA, 64 nt, Homo Sapiens
gccugggugacagagcgaggcuccgucucaaaaaaaaaaaaaaaaaauuguuuuagcgcugggu

SEQ ID NO: 36417 - RNA, 64 nt, Homo Sapiens
ccugggugacagagcgaggcuccgucucaaaaaaaaaaaaaaaaaauuguuuuagcgcuggguu

SEQ ID NO: 36418 - RNA, 64 nt, Homo Sapiens
cugggugacagagcgaggcuccgucucaaaaaaaaaaaaaaaaaauuguuuuagcgcuggguuu

SEQ ID NO: 36419 - RNA, 64 nt, Homo Sapiens
ugggugacagagcgaggcuccgucucaaaaaaaaaaaaaaaaaauuguuuuagcgcuggguuuc

SEQ ID NO: 36420 - RNA, 64 nt, Homo Sapiens
gggugacagagcgaggcuccgucucaaaaaaaaaaaaaaaaaauuguuuuagcgcuggguuucc

SEQ ID NO: 36421 - RNA, 64 nt, Homo Sapiens
ggugacagagcgaggcuccgucucaaaaaaaaaaaaaaaaaauuguuuuagcgcuggguuuccc

SEQ ID NO: 36422 - RNA, 64 nt, Homo Sapiens
cacuugaauuuccuagaacagaagcacuguuuuuaaaaaaaaaaaaaaaaaaagaagaaagaaa

SEQ ID NO: 36423 - RNA, 64 nt, Homo Sapiens
acuugaauuuccuagaacagaagcacuguuuuuaaaaaaaaaaaaaaaaaaagaagaaagaaag

SEQ ID NO: 36424 - RNA, 64 nt, Homo Sapiens
cuugaauuuccuagaacagaagcacuguuuuuaaaaaaaaaaaaaaaaaaagaagaaagaaaga

SEQ ID NO: 36425 - RNA, 64 nt, Homo Sapiens
uugaauuuccuagaacagaagcacuguuuuuaaaaaaaaaaaaaaaaaaagaagaaagaaagaa

SEQ ID NO: 36426 - RNA, 64 nt, Homo Sapiens
ugaauuuccuagaacagaagcacuguuuuuaaaaaaaaaaaaaaaaaaagaagaaagaaagaaa

SEQ ID NO: 36427 - RNA, 64 nt, Homo Sapiens
gaauuuccuagaacagaagcacuguuuuuaaaaaaaaaaaaaaaaaaagaagaaagaaagaaaa

SEQ ID NO: 36428 - RNA, 64 nt, Homo Sapiens
aauuuccuagaacagaagcacuguuuuuaaaaaaaaaaaaaaaaaaagaagaaagaaagaaaaa

SEQ ID NO: 36429 - RNA, 64 nt, Homo Sapiens
auuuccuagaacagaagcacuguuuuuaaaaaaaaaaaaaaaaaaagaagaaagaaagaaaaaa

SEQ ID NO: 36430 - RNA, 64 nt, Homo Sapiens
uuuccuagaacagaagcacuguuuuuaaaaaaaaaaaaaaaaaaagaagaaagaaagaaaaaaa

SEQ ID NO: 36431 - RNA, 64 nt, Homo Sapiens
uuccuagaacagaagcacuguuuuuaaaaaaaaaaaaaaaaaaagaagaaagaaagaaaaaaaa

SEQ ID NO: 36432 - RNA, 64 nt, Homo Sapiens
uccuagaacagaagcacuguuuuuaaaaaaaaaaaaaaaaaaagaagaaagaaagaaaaaaaaa

SEQ ID NO: 36433 - RNA, 64 nt, Homo Sapiens
ccuagaacagaagcacuguuuuuaaaaaaaaaaaaaaaaaaagaagaaagaaagaaaaaaaaaa

SEQ ID NO: 36434 - RNA, 64 nt, Homo Sapiens
auaauaggcugauuuucuuuuaguucagucauaaaaaaaaaauucguugcuuguggauuuauag

SEQ ID NO: 36435 - RNA, 64 nt, Homo Sapiens
uauaauaggcugauuuucuuguaguucagucauaaaaaaaaaauccguugcuuguggauuuaua

SEQ ID NO: 36436 - RNA, 64 nt, Homo Sapiens
uuauaauaggcugauuuucuaguaguucagucauaaaaaaaaaaaccguugcuuguggauuuau

SEQ ID NO: 36437 - RNA, 64 nt, Homo Sapiens
aaaacaaccaaaaaaauugauggacuuuaaugaaaaaaaaaauauggguuuuugugaugaucaa

SEQ ID NO: 36438 - RNA, 64 nt, Homo Sapiens
aaaaacaaccaaaaaaauugauggacuuuaaugaaaaaaaaaaucuggguuuuugugaugauca

SEQ ID NO: 36439 - RNA, 64 nt, Homo Sapiens
uaaaaacaaccaaaaaaauuaauggacuuuaaugaaaaaaaaaaccuggguuuuugugaugauc

SEQ ID NO: 36440 - RNA, 64 nt, Homo Sapiens
aaccuaaaugcuacuguuccgugugacaaaaaaaaaaaaaaacacaucccaaagaaauaaacaa

SEQ ID NO: 36441 - RNA, 64 nt, Homo Sapiens
aaaccuaaaugcuacuguucagugugacaaaaaaaaaaaaaaacacaucccaaagaaauaaaca

SEQ ID NO: 36442 - RNA, 64 nt, Homo Sapiens
caaaccuaaaugcuacuguuaagugugacaaaaaaaaaaaaaaaaacaucccaaagaaauaaac

SEQ ID NO: 36443 - RNA, 64 nt, Homo Sapiens
acaaaccuaaaugcuacugucaagugugacaaaaaaaaaaaaaacaacaucccaaagaaauaaa

SEQ ID NO: 36444 - RNA, 64 nt, Homo Sapiens
aacaaaccuaaaugcuacugacaagugugacaaaaaaaaaaaaagcaacaucccaaagaaauaa

SEQ ID NO: 36445 - RNA, 64 nt, Homo Sapiens
aaacaaaccuaaaugcuacuaacaagugugacaaaaaaaaaaaaagcaacaucccaaagaaaua

SEQ ID NO: 36446 - RNA, 64 nt, Homo Sapiens
aaaacaaaccuaaaugcuacaaacaagugugacaaaaaaaaaaacagcaacaucccaaagaaau

SEQ ID NO: 36447 - RNA, 64 nt, Homo Sapiens
aaaaacaaaccuaaaugcuauaaacaagugugacaaaaaaaaaaacagcaacaucccaaagaaa

SEQ ID NO: 36448 - RNA, 64 nt, Homo Sapiens
aagaaaggaaaacaaaaagcucuggcaaaaaaaaaaaaaaaagacuauauugaaagaauacuuu

SEQ ID NO: 36449 - RNA, 64 nt, Homo Sapiens
aaagaaaggaaaacaaaaaguucuggcaaaaaaaaaaaaaaaagucuauauugaaagaauacuu

SEQ ID NO: 36450 - RNA, 64 nt, Homo Sapiens
gaaagaaaggaaaacaaaaauuucuggcaaaaaaaaaaaaaaaauucuauauugaaagaauacu

SEQ ID NO: 36451 - RNA, 64 nt, Homo Sapiens
agaaagaaaggaaaacaaaauuuucuggcaaaaaaaaaaaaaaauuucuauauugaaagaauac

SEQ ID NO: 36452 - RNA, 64 nt, Homo Sapiens
aagaaagaaaggaaaacaaacuuuucuggcaaaaaaaaaaaaaauuuucuauauugaaagaaua

SEQ ID NO: 36453 - RNA, 64 nt, Homo Sapiens
aaagaaagaaaggaaaacaaacuuuucuggcaaaaaaaaaaaaaauuuucuauauugaaagaau

SEQ ID NO: 36454 - RNA, 64 nt, Homo Sapiens
aaaagaaagaaaggaaaacauacuuuucuggcaaaaaaaaaaaagauuuucuauauugaaagaa

SEQ ID NO: 36455 - RNA, 64 nt, Homo Sapiens
aaaaagaaagaaaggaaaacauacuuuucuggcaaaaaaaaaaaggauuuucuauauugaaaga

SEQ ID NO: 36456 - RNA, 64 nt, Homo Sapiens
aaaaaagaaagaaaggaaaaaauacuuuucuggcaaaaaaaaaaaggauuuucuauauugaaag

SEQ ID NO: 36457 - RNA, 64 nt, Homo Sapiens
ggcugaauggcugaaugagaaauaaaauguaaaaaaaaaaaacuccauuuuucacuuugguauu

SEQ ID NO: 36458 - RNA, 64 nt, Homo Sapiens
uggcugaauggcugaaugaguaauaaaauguaaaaaaaaaaaacgccauuuuucacuuugguau

SEQ ID NO: 36459 - RNA, 64 nt, Homo Sapiens
cuggcugaauggcugaaugauuaauaaaauguaaaaaaaaaaaaggccauuuuucacuuuggua

SEQ ID NO: 36460 - RNA, 64 nt, Homo Sapiens
acuggcugaauggcugaaugauuaauaaaauguaaaaaaaaaaaaggccauuuuucacuuuggu

SEQ ID NO: 36461 - RNA, 64 nt, Homo Sapiens
aacuggcugaauggcugaauuauuaauaaaauguaaaaaaaaaacaggccauuuuucacuuugg

SEQ ID NO: 36462 - RNA, 64 nt, Homo Sapiens
auaugugcagcucuggcuauacuccaucucaaaaaaaaaaaagagccugggcaacaagagcaaa

SEQ ID NO: 36463 - RNA, 64 nt, Homo Sapiens
aauaugugcagcucuggcuaaacuccaucucaaaaaaaaaaaagagccugggcaacaagagcaa

SEQ ID NO: 36464 - RNA, 64 nt, Homo Sapiens
gaauaugugcagcucuggcuaaacuccaucucaaaaaaaaaaaacagccugggcaacaagagca

SEQ ID NO: 36465 - RNA, 64 nt, Homo Sapiens
agaauaugugcagcucuggcaaaacuccaucucaaaaaaaaaaaccagccugggcaacaagagc

SEQ ID NO: 36466 - RNA, 64 nt, Homo Sapiens
aagaauaugugcagcucuggcaaaacuccaucucaaaaaaaaaauccagccugggcaacaagag

SEQ ID NO: 36467 - RNA, 64 nt, Homo Sapiens
aggaaagguacccuaaucguaaaugugcuuagacaaaaaaaaucaaccaaaagucuugguuuuu

SEQ ID NO: 36468 - RNA, 64 nt, Homo Sapiens
uuuuuuuaauuaaaaaaaccaccugucucuuaaaaaaaaaaauuccugggugauggagcgaaga

SEQ ID NO: 36469 - RNA, 64 nt, Homo Sapiens
uuuuuuuuaauuaaaaaaacaaccugucucuuaaaaaaaaaaauuccugggugauggagcgaag

SEQ ID NO: 36470 - RNA, 64 nt, Homo Sapiens
uuuuuuuuuaauuaaaaaaagaaccugucucuuaaaaaaaaaaaauccugggugauggagcgaa

SEQ ID NO: 36471 - RNA, 64 nt, Homo Sapiens
auuuuuuuuuaauuaaaaaaagaaccugucucuuaaaaaaaaaacauccugggugauggagcga

SEQ ID NO: 36472 - RNA, 64 nt, Homo Sapiens
agaaaaugcuaaauauuuauucuuccuuuuuuuaaaaaaaaauacuuuaaaaauacagagaauu

SEQ ID NO: 36473 - RNA, 64 nt, Homo Sapiens
aagaaaaugcuaaauauuuauucuuccuuuuuuuaaaaaaaaauacuuuaaaaauacagagaau

SEQ ID NO: 36474 - RNA, 64 nt, Homo Sapiens
auucccaaucuugacacggugaccaagaaaaagaaaaaaaaagcuguaagggucuguuguaaau

SEQ ID NO: 36475 - RNA, 64 nt, Homo Sapiens
cauucccaaucuugacacggugaccaagaaaaagaaaaaaaaagauguaagggucuguuguaaa

SEQ ID NO: 36476 - RNA, 64 nt, Homo Sapiens
auguaagggucuguuguaaauguuuaaaaacaggaaaaaaaauagaaccagaggguuguacuau

SEQ ID NO: 36477 - RNA, 64 nt, Homo Sapiens
uugugagugacucgguguaacuuacuuaaaaaaaaaaaaaaauuugcuguuguugcagggaagu

SEQ ID NO: 36478 - RNA, 64 nt, Homo Sapiens
uuugugagugacucgguguaucuuacuuaaaaaaaaaaaaaaauuugcuguuguugcagggaag

SEQ ID NO: 36479 - RNA, 64 nt, Homo Sapiens
uuuugugagugacucggugugucuuacuuaaaaaaaaaaaaaaaauugcuguuguugcagggaa

SEQ ID NO: 36480 - RNA, 64 nt, Homo Sapiens
auuuugugagugacucggugagucuuacuuaaaaaaaaaaaaaacauugcuguuguugcaggga

SEQ ID NO: 36481 - RNA, 64 nt, Homo Sapiens
aauuuugugagugacucgguaagucuuacuuaaaaaaaaaaaaaccauugcuguuguugcaggg

SEQ ID NO: 36482 - RNA, 64 nt, Homo Sapiens
aaauuuugugagugacucgggaagucuuacuuaaaaaaaaaaaauccauugcuguuguugcagg

SEQ ID NO: 36483 - RNA, 64 nt, Homo Sapiens
aaaauuuugugagugacucgggaagucuuacuuaaaaaaaaaaacuccauugcuguuguugcag

SEQ ID NO: 36484 - RNA, 64 nt, Homo Sapiens
aaaaauuuugugagugacucgggaagucuuacuuaaaaaaaaaaccuccauugcuguuguugca

SEQ ID NO: 36485 - RNA, 64 nt, Homo Sapiens
cuccgguuuccacuacugugaagaauauaaaguuaaaaaaaagcauauaaggaggaaaacggga

SEQ ID NO: 36486 - RNA, 64 nt, Homo Sapiens
gaauuaaaaauaacacagucgaugagauuugacaaaaaaaaauugugaaaacuaggagaacaga

SEQ ID NO: 36487 - RNA, 64 nt, Homo Sapiens
ugaauuaaaaauaacacaguagaugagauuugacaaaaaaaaauugugaaaacuaggagaacag

SEQ ID NO: 36488 - RNA, 64 nt, Homo Sapiens
auaguuuuauauuugaaaugcuauauguaaaaaaaaaaaaaaguucaucacacuggaaauugua

SEQ ID NO: 36489 - RNA, 64 nt, Homo Sapiens
uauaguuuuauauuugaaauacuauauguaaaaaaaaaaaaaaggucaucacacuggaaauugu

SEQ ID NO: 36490 - RNA, 64 nt, Homo Sapiens
guauaguuuuauauuugaaauacuauauguaaaaaaaaaaaaaaugucaucacacuggaaauug

SEQ ID NO: 36491 - RNA, 64 nt, Homo Sapiens
aguauaguuuuauauuugaaguacuauauguaaaaaaaaaaaaaaugucaucacacuggaaauu

SEQ ID NO: 36492 - RNA, 64 nt, Homo Sapiens
aaguauaguuuuauauuugauguacuauauguaaaaaaaaaaaaaaugucaucacacuggaaau

SEQ ID NO: 36493 - RNA, 64 nt, Homo Sapiens
aaaguauaguuuuauauuuguuguacuauauguaaaaaaaaaaaaaaugucaucacacuggaaa

SEQ ID NO: 36494 - RNA, 64 nt, Homo Sapiens
aaaaguauaguuuuauauuuauuguacuauauguaaaaaaaaaagaaaugucaucacacuggaa

SEQ ID NO: 36495 - RNA, 64 nt, Homo Sapiens
cuuaguggccugguuguucagucggggggaaagaaaaaaaaagccccuuccuaaaaucuggggg

SEQ ID NO: 36496 - RNA, 64 nt, Homo Sapiens
ccuuaguggccugguuguucggucggggggaaagaaaaaaaaagucccuuccuaaaaucugggg

SEQ ID NO: 36497 - RNA, 64 nt, Homo Sapiens
ccagugucuguauacaggaggagcuggguucaaaaaaaaaaauuugaaggcagcugagcuuuca

SEQ ID NO: 36498 - RNA, 64 nt, Homo Sapiens
uccagugucuguauacaggaagagcuggguucaaaaaaaaaaauaugaaggcagcugagcuuuc

SEQ ID NO: 36499 - RNA, 64 nt, Homo Sapiens
uuccagugucuguauacaggcagagcuggguucaaaaaaaaaaacaugaaggcagcugagcuuu

SEQ ID NO: 36500 - RNA, 64 nt, Homo Sapiens
auuccagugucuguauacagucagagcuggguucaaaaaaaaaaccaugaaggcagcugagcuu

SEQ ID NO: 36501 - RNA, 64 nt, Homo Sapiens
ugagauuaaucuucacuauagucucaccaaagaaaaaaaaaaggcugggcgacagugagacccu

SEQ ID NO: 36502 - RNA, 64 nt, Homo Sapiens
gugagauuaaucuucacuauugucucaccaaagaaaaaaaaaagccugggcgacagugagaccc

SEQ ID NO: 36503 - RNA, 64 nt, Homo Sapiens
ggugagauuaaucuucacuacugucucaccaaagaaaaaaaaaagccugggcgacagugagacc

SEQ ID NO: 36504 - RNA, 64 nt, Homo Sapiens
aaaaguuccgggcauuuugcaaguuaaaaagaaaaaaaaaaagaauuacgguauuuuuguuugu

SEQ ID NO: 36505 - RNA, 64 nt, Homo Sapiens
aaaaaguuccgggcauuuuguaaguuaaaaagaaaaaaaaaaaguauuacgguauuuuuguuug

SEQ ID NO: 36506 - RNA, 64 nt, Homo Sapiens
gaaaaaguuccgggcauuuuguaaguuaaaaagaaaaaaaaaaauuauuacgguauuuuuguuu

SEQ ID NO: 36507 - RNA, 64 nt, Homo Sapiens
agaaaaaguuccgggcauuuuguaaguuaaaaagaaaaaaaaaaauuauuacgguauuuuuguu

SEQ ID NO: 36508 - RNA, 64 nt, Homo Sapiens
uauuugcccuaaauccuuaauuuuaucaaguagaaaaaaaaaugcuuuuaaguacuaauuuucu

SEQ ID NO: 36509 - RNA, 64 nt, Homo Sapiens
guauuugcccuaaauccuuauuuuuaucaaguagaaaaaaaaauccuuuuaaguacuaauuuuc

SEQ ID NO: 36510 - RNA, 64 nt, Homo Sapiens
ucaggccauguugggguaacacaaacuugcaaaaaaaaaaaaucaggugugacuucagggagaa

SEQ ID NO: 36511 - RNA, 64 nt, Homo Sapiens
cucaggccauguugggguaaaacaaacuugcaaaaaaaaaaaauaaggugugacuucagggaga

SEQ ID NO: 36512 - RNA, 64 nt, Homo Sapiens
ucucaggccauguugggguaaaacaaacuugcaaaaaaaaaaaauaaggugugacuucagggag

SEQ ID NO: 36513 - RNA, 64 nt, Homo Sapiens
aucucaggccauguuggggugaaacaaacuugcaaaaaaaaaaauuaaggugugacuucaggga

SEQ ID NO: 36514 - RNA, 64 nt, Homo Sapiens
aaucucaggccauguuggggagaaacaaacuugcaaaaaaaaaauuuaaggugugacuucaggg

SEQ ID NO: 36515 - RNA, 64 nt, Homo Sapiens
cauuuauauuacaguuuuccuuuaaaagcaaaaaaaaaaaaaugauauuuauauugcaguaucc

SEQ ID NO: 36516 - RNA, 64 nt, Homo Sapiens
gcauuuauauuacaguuuuccuuuaaaagcaaaaaaaaaaaaauuauauuuauauugcaguauc

SEQ ID NO: 36517 - RNA, 64 nt, Homo Sapiens
ugcauuuauauuacaguuuuccuuuaaaagcaaaaaaaaaaaaaauauauuuauauugcaguau

SEQ ID NO: 36518 - RNA, 64 nt, Homo Sapiens
augcauuuauauuacaguuuuccuuuaaaagcaaaaaaaaaaaaaauauauuuauauugcagua

SEQ ID NO: 36519 - RNA, 64 nt, Homo Sapiens
aaugcauuuauauuacaguuauccuuuaaaagcaaaaaaaaaaauaauauauuuauauugcagu

SEQ ID NO: 36520 - RNA, 64 nt, Homo Sapiens
aaaugcauuuauauuacaguuauccuuuaaaagcaaaaaaaaaauuaauauauuuauauugcag

SEQ ID NO: 36521 - RNA, 64 nt, Homo Sapiens
aaccaaccccaacaacaaaacgauuuaaaaaaaaaaaaaaaagcaaaaaaaagaaaaagaaaaa

SEQ ID NO: 36522 - RNA, 64 nt, Homo Sapiens
caaccaaccccaacaacaaaacgauuuaaaaaaaaaaaaaaaagaaaaaaaaagaaaaagaaaa

SEQ ID NO: 36523 - RNA, 64 nt, Homo Sapiens
gcaaccaaccccaacaacaaaacgauuuaaaaaaaaaaaaaaaaaaaaaaaaaagaaaaagaaa

SEQ ID NO: 36524 - RNA, 64 nt, Homo Sapiens
agcaaccaaccccaacaacaaaacgauuuaaaaaaaaaaaaaaaaaaaaaaaaaagaaaaagaa

SEQ ID NO: 36525 - RNA, 64 nt, Homo Sapiens
aagcaaccaaccccaacaacaaaacgauuuaaaaaaaaaaaaaaaaaaaaaaaaaagaaaaaga

SEQ ID NO: 36526 - RNA, 64 nt, Homo Sapiens
aaagcaaccaaccccaacaaaaaaacgauuuaaaaaaaaaaaaaaaaaaaaaaaaaagaaaaag

SEQ ID NO: 36527 - RNA, 64 nt, Homo Sapiens
aaaagcaaccaaccccaacagaaaaacgauuuaaaaaaaaaaaauaaaaaaaaaaaaagaaaaa

SEQ ID NO: 36528 - RNA, 64 nt, Homo Sapiens
aaaaagcaaccaaccccaacagaaaaacgauuuaaaaaaaaaaauuaaaaaaaaaaaaagaaaa

SEQ ID NO: 36529 - RNA, 64 nt, Homo Sapiens
aaaaaagcaaccaaccccaaaagaaaaacgauuuaaaaaaaaaaauuaaaaaaaaaaaaagaaa

SEQ ID NO: 36530 - RNA, 64 nt, Homo Sapiens
aaaagaaaaacgauuuaaaauaacuuauuaaaaaaaaaaaaagauuuuauauuuguauuaacuu

SEQ ID NO: 36531 - RNA, 64 nt, Homo Sapiens
aaaaagaaaaacgauuuaaauuaacuuauuaaaaaaaaaaaaaguuuuuauauuuguauuaacu

SEQ ID NO: 36532 - RNA, 64 nt, Homo Sapiens
gaaaaagaaaaacgauuuaauuuaacuuauuaaaaaaaaaaaaacuuuuuauauuuguauuaac

SEQ ID NO: 36533 - RNA, 64 nt, Homo Sapiens
agaaaaagaaaaacgauuuacuuuaacuuauuaaaaaaaaaaaaccuuuuuauauuuguauuaa

SEQ ID NO: 36534 - RNA, 64 nt, Homo Sapiens
aagaaaaagaaaaacgauuuacuuuaacuuauuaaaaaaaaaaacccuuuuuauauuuguauua

SEQ ID NO: 36535 - RNA, 64 nt, Homo Sapiens
aaagaaaaagaaaaacgauuaacuuuaacuuauuaaaaaaaaaaccccuuuuuauauuuguauu

SEQ ID NO: 36536 - RNA, 64 nt, Homo Sapiens
gcacaaaagaaaaacuaaauccugcuucuacuaaaaaaaaaagaagguaguauugacaacuguu

SEQ ID NO: 36537 - RNA, 64 nt, Homo Sapiens
agcacaaaagaaaaacuaaauccugcuucuacuaaaaaaaaaagaagguaguauugacaacugu

SEQ ID NO: 36538 - RNA, 64 nt, Homo Sapiens
gagcacaaaagaaaaacuaauuccugcuucuacuaaaaaaaaaagaagguaguauugacaacug

SEQ ID NO: 36539 - RNA, 64 nt, Homo Sapiens
ggaaccaaaugugaccuuguauugucauguuaaaaaaaaaaacaugugcuguuaauagugugaa

SEQ ID NO: 36540 - RNA, 64 nt, Homo Sapiens
aggaaccaaaugugaccuugaauugucauguuaaaaaaaaaaacgugugcuguuaauaguguga

SEQ ID NO: 36541 - RNA, 64 nt, Homo Sapiens
caggaaccaaaugugaccuuaaauugucauguuaaaaaaaaaaacgugugcuguuaauagugug

SEQ ID NO: 36542 - RNA, 64 nt, Homo Sapiens
acaggaaccaaaugugaccugaaauugucauguuaaaaaaaaaaccgugugcuguuaauagugu

SEQ ID NO: 36543 - RNA, 64 nt, Homo Sapiens
gugcguuaauauuuaacaggauuuuaauauaauaaaaaaaaaguuauugucagaccauugccug

SEQ ID NO: 36544 - RNA, 64 nt, Homo Sapiens
ugugcguuaauauuuaacaggauuuuaauauaauaaaaaaaaaguuauugucagaccauugccu

SEQ ID NO: 36545 - RNA, 64 nt, Homo Sapiens
cauaccaaaacaaauacagaaguugaaaaaauaaaaaaaaaaugugcuaugcugcuuugcaaaa

SEQ ID NO: 36546 - RNA, 64 nt, Homo Sapiens
gcauaccaaaacaaauacagaaguugaaaaaauaaaaaaaaaauuugcuaugcugcuuugcaaa

SEQ ID NO: 36547 - RNA, 64 nt, Homo Sapiens
ugcauaccaaaacaaauacaaaaguugaaaaaauaaaaaaaaaaguugcuaugcugcuuugcaa

SEQ ID NO: 36548 - RNA, 64 nt, Homo Sapiens
uuuagugcuaaugagcagaaggauacuugacccaaaaaaaaauguuuucuacauaauaugacau

SEQ ID NO: 36549 - RNA, 64 nt, Homo Sapiens
guuuagugcuaaugagcagauggauacuugacccaaaaaaaaauauuuucuacauaauaugaca

SEQ ID NO: 36550 - RNA, 64 nt, Homo Sapiens
caguggcaaguaaguuauaggauucuaucaaaaaaaaaaaaaggcacccugggcgacagagcaa

SEQ ID NO: 36551 - RNA, 64 nt, Homo Sapiens
gcaguggcaaguaaguuauaagauucuaucaaaaaaaaaaaaagccacccugggcgacagagca

SEQ ID NO: 36552 - RNA, 64 nt, Homo Sapiens
ggcaguggcaaguaaguuauaagauucuaucaaaaaaaaaaaaauccacccugggcgacagagc

SEQ ID NO: 36553 - RNA, 64 nt, Homo Sapiens
aggcaguggcaaguaaguuacaagauucuaucaaaaaaaaaaaacuccacccugggcgacagag

SEQ ID NO: 36554 - RNA, 64 nt, Homo Sapiens
aaggcaguggcaaguaaguugcaagauucuaucaaaaaaaaaaaacuccacccugggcgacaga

SEQ ID NO: 36555 - RNA, 64 nt, Homo Sapiens
aaaggcaguggcaaguaaguagcaagauucuaucaaaaaaaaaacacuccacccugggcgacag

SEQ ID NO: 36556 - RNA, 64 nt, Homo Sapiens
augcuucauaguuguauuuucaugacuucucucaaaaaaaaagacuugacuacgauaucaucga

SEQ ID NO: 36557 - RNA, 64 nt, Homo Sapiens
aaugcuucauaguuguauuuacaugacuucucucaaaaaaaaagccuugacuacgauaucaucg

SEQ ID NO: 36558 - RNA, 64 nt, Homo Sapiens
acgcauaaagaaaaauggccaaaaccuagcaggaaaaaaaaacaauccuacaagcugugcaggc

SEQ ID NO: 36559 - RNA, 64 nt, Homo Sapiens
aacgcauaaagaaaaauggccaaaaccuagcaggaaaaaaaaacgauccuacaagcugugcagg

SEQ ID NO: 36560 - RNA, 64 nt, Homo Sapiens
caaaaaauuagccgggcguuccgucucuacuaaaaaaaaaaauacuggcuaacauggugaaacc

SEQ ID NO: 36561 - RNA, 64 nt, Homo Sapiens
acaaaaaauuagccgggcgucccgucucuacuaaaaaaaaaaauccuggcuaacauggugaaac

SEQ ID NO: 36562 - RNA, 64 nt, Homo Sapiens
uacaaaaaauuagccgggcgccccgucucuacuaaaaaaaaaaauccuggcuaacauggugaaa

SEQ ID NO: 36563 - RNA, 64 nt, Homo Sapiens
auacaaaaaauuagccgggcaccccgucucuacuaaaaaaaaaaguccuggcuaacauggugaa

SEQ ID NO: 36564 - RNA, 64 nt, Homo Sapiens
uguuuucugaacuagaagagaagaggccuauuaaaaaaaaaagucaggaguauuuuuguauuag

SEQ ID NO: 36565 - RNA, 64 nt, Homo Sapiens
uuguuuucugaacuagaagagaagaggccuauuaaaaaaaaaaggcaggaguauuuuuguauua

SEQ ID NO: 36566 - RNA, 64 nt, Homo Sapiens
guuguuuucugaacuagaagagaagaggccuauuaaaaaaaaaaggcaggaguauuuuuguauu

SEQ ID NO: 36567 - RNA, 64 nt, Homo Sapiens
ucuacaguagucuuucuugucuugaaggcaaaagaaaaaaaauuguuucuuuguugagcugugu

SEQ ID NO: 36568 - RNA, 64 nt, Homo Sapiens
acguuucuuuguugagcuguaaagaaaaaagaaaaaaaaaaaccaagagagcuugcaaaaaaaa

SEQ ID NO: 36569 - RNA, 64 nt, Homo Sapiens
cacguuucuuuguugagcugaaaagaaaaaagaaaaaaaaaaacuaagagagcuugcaaaaaaa

SEQ ID NO: 36570 - RNA, 64 nt, Homo Sapiens
ccacguuucuuuguugagcuaaaaagaaaaaagaaaaaaaaaaacuaagagagcuugcaaaaaa

SEQ ID NO: 36571 - RNA, 64 nt, Homo Sapiens
accacguuucuuuguugagcaaaaaagaaaaaagaaaaaaaaaagcuaagagagcuugcaaaaa

SEQ ID NO: 36572 - RNA, 64 nt, Homo Sapiens
aaaaagaaaaaaaaaaaccaagagagcuugcaaaaaaaaaaagauggucugaaugcacaagcua

SEQ ID NO: 36573 - RNA, 64 nt, Homo Sapiens
aaaaaagaaaaaaaaaaaccaagagagcuugcaaaaaaaaaaagcuggucugaaugcacaagcu

SEQ ID NO: 36574 - RNA, 64 nt, Homo Sapiens
gaaaaaagaaaaaaaaaaacuaagagagcuugcaaaaaaaaaaaucuggucugaaugcacaagc

SEQ ID NO: 36575 - RNA, 64 nt, Homo Sapiens
agaaaaaagaaaaaaaaaaacuaagagagcuugcaaaaaaaaaagucuggucugaaugcacaag

SEQ ID NO: 36576 - RNA, 64 nt, Homo Sapiens
cugucuuguucauaaauugacauuccaugggaaaaaaaaaaaucuggcagauugaaaaggaucu

SEQ ID NO: 36577 - RNA, 64 nt, Homo Sapiens
ccugucuuguucauaaauugucauuccaugggaaaaaaaaaaauauggcagauugaaaaggauc

SEQ ID NO: 36578 - RNA, 64 nt, Homo Sapiens
uccugucuuguucauaaauucucauuccaugggaaaaaaaaaaauauggcagauugaaaaggau

SEQ ID NO: 36579 - RNA, 64 nt, Homo Sapiens
auccugucuuguucauaaauucucauuccaugggaaaaaaaaaauuauggcagauugaaaagga

SEQ ID NO: 36580 - RNA, 64 nt, Homo Sapiens
ucuuuuaauggaugagaggggaacccucaaauuaaaaaaaaaugagcaaguguacccuuuauag

SEQ ID NO: 36581 - RNA, 64 nt, Homo Sapiens
gucuuuuaauggaugagaggggaacccucaaauuaaaaaaaaauaagcaaguguacccuuuaua

SEQ ID NO: 36582 - RNA, 64 nt, Homo Sapiens
gccaggaaggacaagaucucaggugugggaaaaaaaaaaaaacagacaacaggugcuagaauua

SEQ ID NO: 36583 - RNA, 64 nt, Homo Sapiens
agccaggaaggacaagaucuaaggugugggaaaaaaaaaaaaacugacaacaggugcuagaauu

SEQ ID NO: 36584 - RNA, 64 nt, Homo Sapiens
cagccaggaaggacaagaucuaaggugugggaaaaaaaaaaaaacugacaacaggugcuagaau

SEQ ID NO: 36585 - RNA, 64 nt, Homo Sapiens
acagccaggaaggacaagauuuaaggugugggaaaaaaaaaaaaucugacaacaggugcuagaa

SEQ ID NO: 36586 - RNA, 64 nt, Homo Sapiens
aacagccaggaaggacaagaauuaaggugugggaaaaaaaaaaagucugacaacaggugcuaga

SEQ ID NO: 36587 - RNA, 64 nt, Homo Sapiens
aaacagccaggaaggacaagaauuaaggugugggaaaaaaaaaaggucugacaacaggugcuag

SEQ ID NO: 36588 - RNA, 64 nt, Homo Sapiens
ucuguguuugugcccacaguuuuaauaagcuaaaaaaaaaaagucuccucaggaauauucucga

SEQ ID NO: 36589 - RNA, 64 nt, Homo Sapiens
uucuguguuugugcccacagauuuaauaagcuaaaaaaaaaaagccuccucaggaauauucucg

SEQ ID NO: 36590 - RNA, 64 nt, Homo Sapiens
guucuguguuugugcccacagauuuaauaagcuaaaaaaaaaaagccuccucaggaauauucuc

SEQ ID NO: 36591 - RNA, 64 nt, Homo Sapiens
aguucuguguuugugcccaccgauuuaauaagcuaaaaaaaaaaugccuccucaggaauauucu

SEQ ID NO: 36592 - RNA, 64 nt, Homo Sapiens
aaacaaaaccagcaucuguugacccugucuuaaaaaaaaaaacacagccugggugacagagcga

SEQ ID NO: 36593 - RNA, 64 nt, Homo Sapiens
aaaacaaaaccagcaucuguagacccugucuuaaaaaaaaaaacccagccugggugacagagcg

SEQ ID NO: 36594 - RNA, 64 nt, Homo Sapiens
caaaacaaaaccagcaucuggagacccugucuuaaaaaaaaaaauccagccugggugacagagc

SEQ ID NO: 36595 - RNA, 64 nt, Homo Sapiens
acaaaacaaaaccagcaucucgagacccugucuuaaaaaaaaaacuccagccugggugacagag

SEQ ID NO: 36596 - RNA, 64 nt, Homo Sapiens
agaaauaaagcugguucccaauacucugacaaaaaaaaaaaaucuuugcugcacucacuuuuuu

SEQ ID NO: 36597 - RNA, 64 nt, Homo Sapiens
cagaaauaaagcugguucccuauacucugacaaaaaaaaaaaauuuuugcugcacucacuuuuu

SEQ ID NO: 36598 - RNA, 64 nt, Homo Sapiens
ucagaaauaaagcugguuccuuauacucugacaaaaaaaaaaaaguuuugcugcacucacuuuu

SEQ ID NO: 36599 - RNA, 64 nt, Homo Sapiens
aucagaaauaaagcugguucuuuauacucugacaaaaaaaaaaauguuuugcugcacucacuuu

SEQ ID NO: 36600 - RNA, 64 nt, Homo Sapiens
aaucagaaauaaagcugguuuuuuauacucugacaaaaaaaaaauuguuuugcugcacucacuu

SEQ ID NO: 36601 - RNA, 64 nt, Homo Sapiens
agugacaauaaaacaugagauauaaaucaagcuuaaaaaaaaaaagcagcaccugugggccaua

SEQ ID NO: 36602 - RNA, 64 nt, Homo Sapiens
gugacaauaaaacaugagauauaaaucaagcuuaaaaaaaaaaagcagcaccugugggccauac

SEQ ID NO: 36603 - RNA, 64 nt, Homo Sapiens
ugacaauaaaacaugagauauaaaucaagcuuaaaaaaaaaaagcagcaccugugggccauacu

SEQ ID NO: 36604 - RNA, 64 nt, Homo Sapiens
gacaauaaaacaugagauauaaaucaagcuuaaaaaaaaaaagcagcaccugugggccauacua

SEQ ID NO: 36605 - RNA, 64 nt, Homo Sapiens
ucacaagccaguggaagggauuccugauuuuacuaaaaaaaaaaaaaaaaaagagagggcgggg

SEQ ID NO: 36606 - RNA, 64 nt, Homo Sapiens
cacaagccaguggaagggauuccugauuuuacuaaaaaaaaaaaaaaaaaagagagggcgggga

SEQ ID NO: 36607 - RNA, 64 nt, Homo Sapiens
acaagccaguggaagggauuccugauuuuacuaaaaaaaaaaaaaaaaaagagagggcggggac

SEQ ID NO: 36608 - RNA, 64 nt, Homo Sapiens
caagccaguggaagggauuccugauuuuacuaaaaaaaaaaaaaaaaaagagagggcggggaca

SEQ ID NO: 36609 - RNA, 64 nt, Homo Sapiens
aagccaguggaagggauuccugauuuuacuaaaaaaaaaaaaaaaaaagagagggcggggacaa

SEQ ID NO: 36610 - RNA, 64 nt, Homo Sapiens
agccaguggaagggauuccugauuuuacuaaaaaaaaaaaaaaaaaagagagggcggggacaaa

SEQ ID NO: 36611 - RNA, 64 nt, Homo Sapiens
gccaguggaagggauuccugauuuuacuaaaaaaaaaaaaaaaaaagagagggcggggacaaau

SEQ ID NO: 36612 - RNA, 64 nt, Homo Sapiens
ccaguggaagggauuccugauuuuacuaaaaaaaaaaaaaaaaaagagagggcggggacaaaua

SEQ ID NO: 36613 - RNA, 64 nt, Homo Sapiens
caguggaagggauuccugauuuuacuaaaaaaaaaaaaaaaaaagagagggcggggacaaauau

SEQ ID NO: 36614 - RNA, 64 nt, Homo Sapiens
aguggaagggauuccugauuuuacuaaaaaaaaaaaaaaaaaagagagggcggggacaaauauc

SEQ ID NO: 36615 - RNA, 64 nt, Homo Sapiens
guggaagggauuccugauuuuacuaaaaaaaaaaaaaaaaaagagagggcggggacaaauauca

SEQ ID NO: 36616 - RNA, 64 nt, Homo Sapiens
uauuuaauaccaccaacaaauauagggguuaaggaaaaaaaacgugagcuacauguguaagaag

SEQ ID NO: 36617 - RNA, 64 nt, Homo Sapiens
uauauauguccuauucauucacaauggauuauacaaaaaaaaguguauugcaagugaaauaaua

SEQ ID NO: 36618 - RNA, 64 nt, Homo Sapiens
aacauggugaaagcccgucucuaccgaaaaauacaaaaaaaaauagcuggguguggugguacgu

SEQ ID NO: 36619 - RNA, 64 nt, Homo Sapiens
acauggugaaagcccgucucuaccgaaaaauacaaaaaaaaauagcuggguguggugguacgug

SEQ ID NO: 36620 - RNA, 64 nt, Homo Sapiens
uagcuauagaaauccaauuaagacucacuuggguaaaaaaaaauaaaaaaauaaacaaaauaaa

SEQ ID NO: 36621 - RNA, 64 nt, Homo Sapiens
agcuauagaaauccaauuaagacucacuuggguaaaaaaaaauaaaaaaauaaacaaaauaaac

SEQ ID NO: 36622 - RNA, 64 nt, Homo Sapiens
cuccagccugggugacaaagugagacuccaucucaaaaaaaaaaaaaaaaaaaauugugagaaa

SEQ ID NO: 36623 - RNA, 64 nt, Homo Sapiens
uccagccugggugacaaagugagacuccaucucaaaaaaaaaaaaaaaaaaaauugugagaaac

SEQ ID NO: 36624 - RNA, 64 nt, Homo Sapiens
ccagccugggugacaaagugagacuccaucucaaaaaaaaaaaaaaaaaaaauugugagaaaca

SEQ ID NO: 36625 - RNA, 64 nt, Homo Sapiens
cagccugggugacaaagugagacuccaucucaaaaaaaaaaaaaaaaaaaauugugagaaacag

SEQ ID NO: 36626 - RNA, 64 nt, Homo Sapiens
agccugggugacaaagugagacuccaucucaaaaaaaaaaaaaaaaaaaauugugagaaacaga

SEQ ID NO: 36627 - RNA, 64 nt, Homo Sapiens
gccugggugacaaagugagacuccaucucaaaaaaaaaaaaaaaaaaaauugugagaaacagaa

SEQ ID NO: 36628 - RNA, 64 nt, Homo Sapiens
ccugggugacaaagugagacuccaucucaaaaaaaaaaaaaaaaaaaauugugagaaacagaaa

SEQ ID NO: 36629 - RNA, 64 nt, Homo Sapiens
cugggugacaaagugagacuccaucucaaaaaaaaaaaaaaaaaaaauugugagaaacagaaau

SEQ ID NO: 36630 - RNA, 64 nt, Homo Sapiens
ugggugacaaagugagacuccaucucaaaaaaaaaaaaaaaaaaaauugugagaaacagaaaua

SEQ ID NO: 36631 - RNA, 64 nt, Homo Sapiens
gggugacaaagugagacuccaucucaaaaaaaaaaaaaaaaaaaauugugagaaacagaaauac

SEQ ID NO: 36632 - RNA, 64 nt, Homo Sapiens
ggugacaaagugagacuccaucucaaaaaaaaaaaaaaaaaaaauugugagaaacagaaauacu

SEQ ID NO: 36633 - RNA, 64 nt, Homo Sapiens
gugacaaagugagacuccaucucaaaaaaaaaaaaaaaaaaaauugugagaaacagaaauacuu

SEQ ID NO: 36634 - RNA, 64 nt, Homo Sapiens
ugacaaagugagacuccaucucaaaaaaaaaaaaaaaaaaaauugugagaaacagaaauacuua

SEQ ID NO: 36635 - RNA, 64 nt, Homo Sapiens
cacuccagcugugugacagaaugagaccaucuccaaaaaaaaaaaaaaguagauuucagauaau

SEQ ID NO: 36636 - RNA, 64 nt, Homo Sapiens
acuccagcugugugacagaaugagaccaucuccaaaaaaaaaaaaaaguagauuucagauaauu

SEQ ID NO: 36637 - RNA, 64 nt, Homo Sapiens
cuccagcugugugacagaaugagaccaucuccaaaaaaaaaaaaaaguagauuucagauaauuu

SEQ ID NO: 36638 - RNA, 64 nt, Homo Sapiens
uccagcugugugacagaaugagaccaucuccaaaaaaaaaaaaaaguagauuucagauaauuua

SEQ ID NO: 36639 - RNA, 64 nt, Homo Sapiens
ccagcugugugacagaaugagaccaucuccaaaaaaaaaaaaaaguagauuucagauaauuuac

SEQ ID NO: 36640 - RNA, 64 nt, Homo Sapiens
cagcugugugacagaaugagaccaucuccaaaaaaaaaaaaaaguagauuucagauaauuuacu

SEQ ID NO: 36641 - RNA, 64 nt, Homo Sapiens
agcugugugacagaaugagaccaucuccaaaaaaaaaaaaaaguagauuucagauaauuuacug

SEQ ID NO: 36642 - RNA, 64 nt, Homo Sapiens
caaggguagauguaguugcuuaguagcauuuuggaaaaaaaagaaaaaaagguuugguuugguu

SEQ ID NO: 36643 - RNA, 64 nt, Homo Sapiens
cugggauuacaggcgugagccacugagcccggccaaaaaaaaauguauuuauuaaaaaaaaauu

SEQ ID NO: 36644 - RNA, 64 nt, Homo Sapiens
ugggauuacaggcgugagccacugagcccggccaaaaaaaaauguauuuauuaaaaaaaaauuu

SEQ ID NO: 36645 - RNA, 64 nt, Homo Sapiens
ccacugagcccggccaaaaaaaaauguauuuauuaaaaaaaaauuuuuuuaacccgccgaauaa

SEQ ID NO: 36646 - RNA, 64 nt, Homo Sapiens
cacugagcccggccaaaaaaaaauguauuuauuaaaaaaaaauuuuuuuaacccgccgaauaau

SEQ ID NO: 36647 - RNA, 64 nt, Homo Sapiens
uccagccugggcaacaagagcgaaacuccgucucaaaaaaaaaaaaaaaaaaaaagaaagaaaa

SEQ ID NO: 36648 - RNA, 64 nt, Homo Sapiens
ccagccugggcaacaagagcgaaacuccgucucaaaaaaaaaaaaaaaaaaaaagaaagaaaag

SEQ ID NO: 36649 - RNA, 64 nt, Homo Sapiens
cagccugggcaacaagagcgaaacuccgucucaaaaaaaaaaaaaaaaaaaaagaaagaaaaga

SEQ ID NO: 36650 - RNA, 64 nt, Homo Sapiens
agccugggcaacaagagcgaaacuccgucucaaaaaaaaaaaaaaaaaaaaagaaagaaaagag

SEQ ID NO: 36651 - RNA, 64 nt, Homo Sapiens
gccugggcaacaagagcgaaacuccgucucaaaaaaaaaaaaaaaaaaaaagaaagaaaagagu

SEQ ID NO: 36652 - RNA, 64 nt, Homo Sapiens
ccugggcaacaagagcgaaacuccgucucaaaaaaaaaaaaaaaaaaaaagaaagaaaagagua

SEQ ID NO: 36653 - RNA, 64 nt, Homo Sapiens
cugggcaacaagagcgaaacuccgucucaaaaaaaaaaaaaaaaaaaaagaaagaaaagaguaa

SEQ ID NO: 36654 - RNA, 64 nt, Homo Sapiens
ugggcaacaagagcgaaacuccgucucaaaaaaaaaaaaaaaaaaaaagaaagaaaagaguaac

SEQ ID NO: 36655 - RNA, 64 nt, Homo Sapiens
gggcaacaagagcgaaacuccgucucaaaaaaaaaaaaaaaaaaaaagaaagaaaagaguaaca

SEQ ID NO: 36656 - RNA, 64 nt, Homo Sapiens
ggcaacaagagcgaaacuccgucucaaaaaaaaaaaaaaaaaaaaagaaagaaaagaguaacag

SEQ ID NO: 36657 - RNA, 64 nt, Homo Sapiens
gcaacaagagcgaaacuccgucucaaaaaaaaaaaaaaaaaaaaagaaagaaaagaguaacaga

SEQ ID NO: 36658 - RNA, 64 nt, Homo Sapiens
caacaagagcgaaacuccgucucaaaaaaaaaaaaaaaaaaaaagaaagaaaagaguaacagaa

SEQ ID NO: 36659 - RNA, 64 nt, Homo Sapiens
aacaagagcgaaacuccgucucaaaaaaaaaaaaaaaaaaaaagaaagaaaagaguaacagaaa

SEQ ID NO: 36660 - RNA, 64 nt, Homo Sapiens
acaagagcgaaacuccgucucaaaaaaaaaaaaaaaaaaaaagaaagaaaagaguaacagaaag

SEQ ID NO: 36661 - RNA, 64 nt, Homo Sapiens
gaugaugaaugcacaacauaaugaugguuaaauuaaaaaaaaaaaagagcacgguaauaaaauu

SEQ ID NO: 36662 - RNA, 64 nt, Homo Sapiens
augaugaaugcacaacauaaugaugguuaaauuaaaaaaaaaaaagagcacgguaauaaaauuu

SEQ ID NO: 36663 - RNA, 64 nt, Homo Sapiens
ugaugaaugcacaacauaaugaugguuaaauuaaaaaaaaaaaagagcacgguaauaaaauuuc

SEQ ID NO: 36664 - RNA, 64 nt, Homo Sapiens
gaugaaugcacaacauaaugaugguuaaauuaaaaaaaaaaaagagcacgguaauaaaauuucc

SEQ ID NO: 36665 - RNA, 64 nt, Homo Sapiens
augaaugcacaacauaaugaugguuaaauuaaaaaaaaaaaagagcacgguaauaaaauuucca

SEQ ID NO: 36666 - RNA, 64 nt, Homo Sapiens
uuucaaauccucccuacuuccaagaaaaauaauuaaaaaaaaaacuucauucuaaaccaaaaca

SEQ ID NO: 36667 - RNA, 64 nt, Homo Sapiens
uucaaauccucccuacuuccaagaaaaauaauuaaaaaaaaaacuucauucuaaaccaaaacag

SEQ ID NO: 36668 - RNA, 64 nt, Homo Sapiens
ucaaauccucccuacuuccaagaaaaauaauuaaaaaaaaaacuucauucuaaaccaaaacaga

SEQ ID NO: 36669 - RNA, 64 nt, Homo Sapiens
cauguuuucuaagaaccauuuuguucacugauacaaaaaaaaaaaaaggaauucaugaugcugu

SEQ ID NO: 36670 - RNA, 64 nt, Homo Sapiens
auguuuucuaagaaccauuuuguucacugauacaaaaaaaaaaaaaggaauucaugaugcugua

SEQ ID NO: 36671 - RNA, 64 nt, Homo Sapiens
uguuuucuaagaaccauuuuguucacugauacaaaaaaaaaaaaaggaauucaugaugcuguac

SEQ ID NO: 36672 - RNA, 64 nt, Homo Sapiens
guuuucuaagaaccauuuuguucacugauacaaaaaaaaaaaaaggaauucaugaugcuguaca

SEQ ID NO: 36673 - RNA, 64 nt, Homo Sapiens
uuuucuaagaaccauuuuguucacugauacaaaaaaaaaaaaaggaauucaugaugcuguacag

SEQ ID NO: 36674 - RNA, 64 nt, Homo Sapiens
uuucuaagaaccauuuuguucacugauacaaaaaaaaaaaaaggaauucaugaugcuguacaga

SEQ ID NO: 36675 - RNA, 64 nt, Homo Sapiens
gguuugucaguacucgucaaagccaaguccaauuaaaaaaaaaagucuuugcccuccaauuugu

SEQ ID NO: 36676 - RNA, 64 nt, Homo Sapiens
guuugucaguacucgucaaagccaaguccaauuaaaaaaaaaagucuuugcccuccaauuugug

SEQ ID NO: 36677 - RNA, 64 nt, Homo Sapiens
uuugucaguacucgucaaagccaaguccaauuaaaaaaaaaagucuuugcccuccaauuugugu

SEQ ID NO: 36678 - RNA, 64 nt, Homo Sapiens
aauaaacuuuaguuguacauugaagucuuuucauaaaaaaaauuaucauuuaugaauaacaauc

SEQ ID NO: 36679 - RNA, 64 nt, Homo Sapiens
cuuagcaaugaaauugcuguauuuuucauaucuaaaaaaaaauuaaaagcugaauguuacuaau

SEQ ID NO: 36680 - RNA, 64 nt, Homo Sapiens
ucuuagcaaugaaauugcuguauuuuucauaucuaaaaaaaaauaaaaagcugaauguuacuaa

SEQ ID NO: 36681 - RNA, 64 nt, Homo Sapiens
cagauuuccauuuuuuguauuugauagauccuuuaaaaaaaaggugauuacaauugagggaagu

SEQ ID NO: 36682 - RNA, 64 nt, Homo Sapiens
uguuuauuuuuaacucuugguuugcuaaaaagaaaaaaaaaaggauaugcuuacauuuuucacu

SEQ ID NO: 36683 - RNA, 64 nt, Homo Sapiens
guguuuauuuuuaacucuuguuuugcuaaaaagaaaaaaaaaaguauaugcuuacauuuuucac

SEQ ID NO: 36684 - RNA, 64 nt, Homo Sapiens
gguguuuauuuuuaacucuucuuuugcuaaaaagaaaaaaaaaaauauaugcuuacauuuuuca

SEQ ID NO: 36685 - RNA, 64 nt, Homo Sapiens
uagugcugauucacagcuuaauaauuauccaauaaaaaaaaaccguuaaacaacucuuuaaagg

SEQ ID NO: 36686 - RNA, 64 nt, Homo Sapiens
cuagugcugauucacagcuugauaauuauccaauaaaaaaaaacuguuaaacaacucuuuaaag

SEQ ID NO: 36687 - RNA, 64 nt, Homo Sapiens
guaucaaguuccacagguagaacuguggggagaaaaaaaaaauuaucagaauaaagguuauucu

SEQ ID NO: 36688 - RNA, 64 nt, Homo Sapiens
uguaucaaguuccacagguauaacuguggggagaaaaaaaaaaugaucagaauaaagguuauuc

SEQ ID NO: 36689 - RNA, 64 nt, Homo Sapiens
uuguaucaaguuccacaggucuaacuguggggagaaaaaaaaaaggaucagaauaaagguuauu

SEQ ID NO: 36690 - RNA, 64 nt, Homo Sapiens
uuuaaaaauguuguaggagaaaagaucaguggaaaaaaaaaacaaaugaguauuacugaaacuu

SEQ ID NO: 36691 - RNA, 64 nt, Homo Sapiens
auuuaaaaauguuguaggaguaaagaucaguggaaaaaaaaaacaaaugaguauuacugaaacu

SEQ ID NO: 36692 - RNA, 64 nt, Homo Sapiens
cauuuaaaaauguuguaggauuaaagaucaguggaaaaaaaaaauaaaugaguauuacugaaac

SEQ ID NO: 36693 - RNA, 64 nt, Homo Sapiens
caaaauuguagaauuacuucagaccuucucucaaaaaaaaaacccuagucugggcaacagagug

SEQ ID NO: 36694 - RNA, 64 nt, Homo Sapiens
ccaaaauuguagaauuacuugagaccuucucucaaaaaaaaaacucuagucugggcaacagagu

SEQ ID NO: 36695 - RNA, 64 nt, Homo Sapiens
cccaaaauuguagaauuacuugagaccuucucucaaaaaaaaaauucuagucugggcaacagag

SEQ ID NO: 36696 - RNA, 64 nt, Homo Sapiens
agccaggcaugcgaaacgcuaaaaaaaaaaagaaaaaaaaaauuuagugagacgucgucucuac

SEQ ID NO: 36697 - RNA, 64 nt, Homo Sapiens
uagccaggcaugcgaaacgccaaaaaaaaaaagaaaaaaaaaauauagugagacgucgucucua

SEQ ID NO: 36698 - RNA, 64 nt, Homo Sapiens
uuagccaggcaugcgaaacgacaaaaaaaaaaagaaaaaaaaaacauagugagacgucgucucu

SEQ ID NO: 36699 - RNA, 64 nt, Homo Sapiens
aaaaaaaaauuagccaggcagucgucucuacaaaaaaaaaaagaaugaagcaacauagugagac

SEQ ID NO: 36700 - RNA, 64 nt, Homo Sapiens
aaaaaaaaaauuagccaggccgucgucucuacaaaaaaaaaaagaaugaagcaacauagugaga

SEQ ID NO: 36701 - RNA, 64 nt, Homo Sapiens
gaaaaaaaaaauuagccaggacgucgucucuacaaaaaaaaaaaaaaugaagcaacauagugag

SEQ ID NO: 36702 - RNA, 64 nt, Homo Sapiens
agaaaaaaaaaauuagccaggacgucgucucuacaaaaaaaaaauaaaugaagcaacauaguga

SEQ ID NO: 36703 - RNA, 64 nt, Homo Sapiens
cugucuguuuuuguauuuauuaccaaagacugaaaaaaaaaaucgaggaggagaaagcucucua

SEQ ID NO: 36704 - RNA, 64 nt, Homo Sapiens
ccugucuguuuuuguauuuaauaccaaagacugaaaaaaaaaauagaggaggagaaagcucucu

SEQ ID NO: 36705 - RNA, 64 nt, Homo Sapiens
uccugucuguuuuuguauuuuauaccaaagacugaaaaaaaaaaaagaggaggagaaagcucuc

SEQ ID NO: 36706 - RNA, 64 nt, Homo Sapiens
gaaaauacugaaaccacagaaaaauauauuaaaaaaaaaaaagauauaauuaaagaaaauugcc

SEQ ID NO: 36707 - RNA, 64 nt, Homo Sapiens
agaaaauacugaaaccacagcaaaauauauuaaaaaaaaaaaaguuauaauuaaagaaaauugc

SEQ ID NO: 36708 - RNA, 64 nt, Homo Sapiens
gagaaaauacugaaaccacaccaaaauauauuaaaaaaaaaaaauuuauaauuaaagaaaauug

SEQ ID NO: 36709 - RNA, 64 nt, Homo Sapiens
agagaaaauacugaaaccacgccaaaauauauuaaaaaaaaaaaauuuauaauuaaagaaaauu

SEQ ID NO: 36710 - RNA, 64 nt, Homo Sapiens
aagagaaaauacugaaaccaugccaaaauauauuaaaaaaaaaauauuuauaauuaaagaaaau

SEQ ID NO: 36711 - RNA, 64 nt, Homo Sapiens
auauagauagggacuugcuacuuggcuaauuuaaaaaaaaaauuuacaggcaugcaccaccaag

SEQ ID NO: 36712 - RNA, 64 nt, Homo Sapiens
uauauagauagggacuugcugcuuggcuaauuuaaaaaaaaaaucuacaggcaugcaccaccaa

SEQ ID NO: 36713 - RNA, 64 nt, Homo Sapiens
uuauauagauagggacuugcagcuuggcuaauuuaaaaaaaaaaacuacaggcaugcaccacca

SEQ ID NO: 36714 - RNA, 64 nt, Homo Sapiens
agaggaaaaagugugugguugcugugcuguggggaaaaaaaaguacaaauauugucauccgcuu

SEQ ID NO: 36715 - RNA, 64 nt, Homo Sapiens
uuuuaacuauuccauuuccacuugcucucaaaaaaaaaaaaaggaggauuuuauauuaagccuu

SEQ ID NO: 36716 - RNA, 64 nt, Homo Sapiens
guuuuaacuauuccauuuccucuugcucucaaaaaaaaaaaaagcaggauuuuauauuaagccu

SEQ ID NO: 36717 - RNA, 64 nt, Homo Sapiens
gguuuuaacuauuccauuucuucuugcucucaaaaaaaaaaaaaccaggauuuuauauuaagcc

SEQ ID NO: 36718 - RNA, 64 nt, Homo Sapiens
agguuuuaacuauuccauuucuucuugcucucaaaaaaaaaaaacccaggauuuuauauuaagc

SEQ ID NO: 36719 - RNA, 64 nt, Homo Sapiens
aagguuuuaacuauuccauuccuucuugcucucaaaaaaaaaaaccccaggauuuuauauuaag

SEQ ID NO: 36720 - RNA, 64 nt, Homo Sapiens
aaagguuuuaacuauuccaugccuucuugcucucaaaaaaaaaagccccaggauuuuauauuaa

SEQ ID NO: 36721 - RNA, 64 nt, Homo Sapiens
ugcuuccacucauguaacuauuauuuugguggucaaaaaaaauaaagcauuaggcugaaagagu

SEQ ID NO: 36722 - RNA, 64 nt, Homo Sapiens
uuuuugaucuaaacauagguguuaaucaguaaaaaaaaaaaauagauuuuuuaaaaauaauauu

SEQ ID NO: 36723 - RNA, 64 nt, Homo Sapiens
auuuuugaucuaaacauagguguuaaucaguaaaaaaaaaaaauagauuuuuuaaaaauaauau

SEQ ID NO: 36724 - RNA, 64 nt, Homo Sapiens
uauuuuugaucuaaacauaguuguuaaucaguaaaaaaaaaaaaaagauuuuuuaaaaauaaua

SEQ ID NO: 36725 - RNA, 64 nt, Homo Sapiens
auauuuuugaucuaaacauaauuguuaaucaguaaaaaaaaaaagaagauuuuuuaaaaauaau

SEQ ID NO: 36726 - RNA, 64 nt, Homo Sapiens
aauauuuuugaucuaaacauuauuguuaaucaguaaaaaaaaaacgaagauuuuuuaaaaauaa

SEQ ID NO: 36727 - RNA, 64 nt, Homo Sapiens
uacaaagauggguuucugaauaaaaaacaacaaaaaaaaaaacauucauaaggggaauuuuuuu

SEQ ID NO: 36728 - RNA, 64 nt, Homo Sapiens
auacaaagauggguuucugauuaaaaaacaacaaaaaaaaaaacguucauaaggggaauuuuuu

SEQ ID NO: 36729 - RNA, 64 nt, Homo Sapiens
cauacaaagauggguuucuguuuaaaaaacaacaaaaaaaaaaaaguucauaaggggaauuuuu

SEQ ID NO: 36730 - RNA, 64 nt, Homo Sapiens
acauacaaagauggguuucuuuuuaaaaaacaacaaaaaaaaaacaguucauaaggggaauuuu

SEQ ID NO: 36731 - RNA, 64 nt, Homo Sapiens
gaacgcagggcaagaacucgucaaaaaaaaaaaaaaaaaaaaugcaacagagugagacucuguc

SEQ ID NO: 36732 - RNA, 64 nt, Homo Sapiens
ggaacgcagggcaagaacuccucaaaaaaaaaaaaaaaaaaaaugcaacagagugagacucugu

SEQ ID NO: 36733 - RNA, 64 nt, Homo Sapiens
uggaacgcagggcaagaacuucucaaaaaaaaaaaaaaaaaaaaggcaacagagugagacucug

SEQ ID NO: 36734 - RNA, 64 nt, Homo Sapiens
auggaacgcagggcaagaacgucucaaaaaaaaaaaaaaaaaaagggcaacagagugagacucu

SEQ ID NO: 36735 - RNA, 64 nt, Homo Sapiens
aauggaacgcagggcaagaaugucucaaaaaaaaaaaaaaaaaaugggcaacagagugagacuc

SEQ ID NO: 36736 - RNA, 64 nt, Homo Sapiens
aaauggaacgcagggcaagacugucucaaaaaaaaaaaaaaaaacugggcaacagagugagacu

SEQ ID NO: 36737 - RNA, 64 nt, Homo Sapiens
aaaauggaacgcagggcaagucugucucaaaaaaaaaaaaaaaaccugggcaacagagugagac

SEQ ID NO: 36738 - RNA, 64 nt, Homo Sapiens
aaaaauggaacgcagggcaacucugucucaaaaaaaaaaaaaaagccugggcaacagagugaga

SEQ ID NO: 36739 - RNA, 64 nt, Homo Sapiens
aaaaaauggaacgcagggcaacucugucucaaaaaaaaaaaaaaagccugggcaacagagugag

SEQ ID NO: 36740 - RNA, 64 nt, Homo Sapiens
aaaaaaauggaacgcagggcgacucugucucaaaaaaaaaaaaacagccugggcaacagaguga

SEQ ID NO: 36741 - RNA, 64 nt, Homo Sapiens
aaaaaaaauggaacgcagggagacucugucucaaaaaaaaaaaaccagccugggcaacagagug

SEQ ID NO: 36742 - RNA, 64 nt, Homo Sapiens
aaaaaaaaauggaacgcagggagacucugucucaaaaaaaaaaauccagccugggcaacagagu

SEQ ID NO: 36743 - RNA, 64 nt, Homo Sapiens
aaaaaaaaaauggaacgcagugagacucugucucaaaaaaaaaacuccagccugggcaacagag

SEQ ID NO: 36744 - RNA, 64 nt, Homo Sapiens
cauguaggaaagagaggauaaacaaagaaaaaagaaaaaaaaauaagcucauacccaaauucac

SEQ ID NO: 36745 - RNA, 64 nt, Homo Sapiens
auguaggaaagagaggauaaacaaagaaaaaagaaaaaaaaauaagcucauacccaaauucaca

SEQ ID NO: 36746 - RNA, 64 nt, Homo Sapiens
gaccgagccccagcaagggcuccuccaggauugcaaaaaaaaaaggaagagaaaagaugaaccu

SEQ ID NO: 36747 - RNA, 64 nt, Homo Sapiens
accgagccccagcaagggcuccuccaggauugcaaaaaaaaaaggaagagaaaagaugaaccuu

SEQ ID NO: 36748 - RNA, 64 nt, Homo Sapiens
ccgagccccagcaagggcuccuccaggauugcaaaaaaaaaaggaagagaaaagaugaaccuuu

SEQ ID NO: 36749 - RNA, 64 nt, Homo Sapiens
aaaaucuucaaguuacauuuaacccauaagguuuaaaaaaaaggaaaaaaaacgguugugguuc

SEQ ID NO: 36750 - RNA, 64 nt, Homo Sapiens
aguuacauuuaacccauaagguuuaaaaaaaaggaaaaaaaacgguugugguucccuuucuucc

SEQ ID NO: 36751 - RNA, 64 nt, Homo Sapiens
aacagacucaugacaaaggauucaagauuguuugaaaaaaaaaaaaggggagcagggaggcaga

SEQ ID NO: 36752 - RNA, 64 nt, Homo Sapiens
acagacucaugacaaaggauucaagauuguuugaaaaaaaaaaaaggggagcagggaggcagaa

SEQ ID NO: 36753 - RNA, 64 nt, Homo Sapiens
cagacucaugacaaaggauucaagauuguuugaaaaaaaaaaaaggggagcagggaggcagaaa

SEQ ID NO: 36754 - RNA, 64 nt, Homo Sapiens
agacucaugacaaaggauucaagauuguuugaaaaaaaaaaaaggggagcagggaggcagaaag

SEQ ID NO: 36755 - RNA, 64 nt, Homo Sapiens
gacucaugacaaaggauucaagauuguuugaaaaaaaaaaaaggggagcagggaggcagaaagu

SEQ ID NO: 36756 - RNA, 64 nt, Homo Sapiens
acuccagccuggucgacagagugaacucugucucaaaaaaaaaaaaaaaagaaaagaaagaaga

SEQ ID NO: 36757 - RNA, 64 nt, Homo Sapiens
cuccagccuggucgacagagugaacucugucucaaaaaaaaaaaaaaaagaaaagaaagaagaa

SEQ ID NO: 36758 - RNA, 64 nt, Homo Sapiens
uccagccuggucgacagagugaacucugucucaaaaaaaaaaaaaaaagaaaagaaagaagaag

SEQ ID NO: 36759 - RNA, 64 nt, Homo Sapiens
ccagccuggucgacagagugaacucugucucaaaaaaaaaaaaaaaagaaaagaaagaagaagc

SEQ ID NO: 36760 - RNA, 64 nt, Homo Sapiens
cagccuggucgacagagugaacucugucucaaaaaaaaaaaaaaaagaaaagaaagaagaagcc

SEQ ID NO: 36761 - RNA, 64 nt, Homo Sapiens
agccuggucgacagagugaacucugucucaaaaaaaaaaaaaaaagaaaagaaagaagaagcca

SEQ ID NO: 36762 - RNA, 64 nt, Homo Sapiens
gccuggucgacagagugaacucugucucaaaaaaaaaaaaaaaagaaaagaaagaagaagccau

SEQ ID NO: 36763 - RNA, 64 nt, Homo Sapiens
ccuggucgacagagugaacucugucucaaaaaaaaaaaaaaaagaaaagaaagaagaagccauu

SEQ ID NO: 36764 - RNA, 64 nt, Homo Sapiens
cuggucgacagagugaacucugucucaaaaaaaaaaaaaaaagaaaagaaagaagaagccauuc

SEQ ID NO: 36765 - RNA, 64 nt, Homo Sapiens
ucagaauguuuguuauguaaauuuuaccucaacuaaaaaaaaaaaugcccagguacugcuugug

SEQ ID NO: 36766 - RNA, 64 nt, Homo Sapiens
cagaauguuuguuauguaaauuuuaccucaacuaaaaaaaaaaaugcccagguacugcuugugc

SEQ ID NO: 36767 - RNA, 64 nt, Homo Sapiens
agaauguuuguuauguaaauuuuaccucaacuaaaaaaaaaaaugcccagguacugcuugugca

SEQ ID NO: 36768 - RNA, 64 nt, Homo Sapiens
gaauguuuguuauguaaauuuuaccucaacuaaaaaaaaaaaugcccagguacugcuugugcag

SEQ ID NO: 36769 - RNA, 64 nt, Homo Sapiens
gagaaccagcgaaaucccccaugucaucagucuuaaaaaaaaaauuuuacaaauccacguauuu

SEQ ID NO: 36770 - RNA, 64 nt, Homo Sapiens
agaaccagcgaaaucccccaugucaucagucuuaaaaaaaaaauuuuacaaauccacguauuug

SEQ ID NO: 36771 - RNA, 64 nt, Homo Sapiens
gaaccagcgaaaucccccaugucaucagucuuaaaaaaaaaauuuuacaaauccacguauuugu

SEQ ID NO: 36772 - RNA, 64 nt, Homo Sapiens
ucuacuccaggacugguuuuguuuuuauauauauaaaaaaaaaaagugaaaacaccaaugugug

SEQ ID NO: 36773 - RNA, 64 nt, Homo Sapiens
cuacuccaggacugguuuuguuuuuauauauauaaaaaaaaaaagugaaaacaccaauguguga

SEQ ID NO: 36774 - RNA, 64 nt, Homo Sapiens
uacuccaggacugguuuuguuuuuauauauauaaaaaaaaaaagugaaaacaccaaugugugaa

SEQ ID NO: 36775 - RNA, 64 nt, Homo Sapiens
acuccaggacugguuuuguuuuuauauauauaaaaaaaaaaagugaaaacaccaaugugugaaa

SEQ ID NO: 36776 - RNA, 61 nt, Homo Sapiens
guccuggggaggccaaauaagccgccacugcaaaaaaaaacagggucagaaaauuacuugg

SEQ ID NO: 36777 - RNA, 62 nt, Homo Sapiens
guccuggggaggccaaauaagccgccacugcaaaaaaaaacagggucagaaaauuacuuggg

SEQ ID NO: 36778 - RNA, 64 nt, Homo Sapiens
uaggaaacagagcugccaauugaaacagaagaagaaaaaaaaaaaaagcagcagacaacacacu

SEQ ID NO: 36779 - RNA, 64 nt, Homo Sapiens
aggaaacagagcugccaauugaaacagaagaagaaaaaaaaaaaaagcagcagacaacacacug

SEQ ID NO: 36780 - RNA, 64 nt, Homo Sapiens
ggaaacagagcugccaauugaaacagaagaagaaaaaaaaaaaaagcagcagacaacacacugu

SEQ ID NO: 36781 - RNA, 64 nt, Homo Sapiens
gaaacagagcugccaauugaaacagaagaagaaaaaaaaaaaaagcagcagacaacacacugua

SEQ ID NO: 36782 - RNA, 64 nt, Homo Sapiens
aaacagagcugccaauugaaacagaagaagaaaaaaaaaaaaagcagcagacaacacacuguag

SEQ ID NO: 36783 - RNA, 64 nt, Homo Sapiens
aacagagcugccaauugaaacagaagaagaaaaaaaaaaaaagcagcagacaacacacuguaga

SEQ ID NO: 36784 - RNA, 64 nt, Homo Sapiens
cuccagucugggugucagaaugagaccccaucucaaaaaaaaaaaaaaaaaaaaaaaagaagaa

SEQ ID NO: 36785 - RNA, 64 nt, Homo Sapiens
uccagucugggugucagaaugagaccccaucucaaaaaaaaaaaaaaaaaaaaaaaagaagaag

SEQ ID NO: 36786 - RNA, 64 nt, Homo Sapiens
ccagucugggugucagaaugagaccccaucucaaaaaaaaaaaaaaaaaaaaaaaagaagaaga

SEQ ID NO: 36787 - RNA, 64 nt, Homo Sapiens
cagucugggugucagaaugagaccccaucucaaaaaaaaaaaaaaaaaaaaaaaagaagaagaa

SEQ ID NO: 36788 - RNA, 64 nt, Homo Sapiens
agucugggugucagaaugagaccccaucucaaaaaaaaaaaaaaaaaaaaaaaagaagaagaau

SEQ ID NO: 36789 - RNA, 64 nt, Homo Sapiens
gucugggugucagaaugagaccccaucucaaaaaaaaaaaaaaaaaaaaaaaagaagaagaaua

SEQ ID NO: 36790 - RNA, 64 nt, Homo Sapiens
ucugggugucagaaugagaccccaucucaaaaaaaaaaaaaaaaaaaaaaaagaagaagaauac

SEQ ID NO: 36791 - RNA, 64 nt, Homo Sapiens
cugggugucagaaugagaccccaucucaaaaaaaaaaaaaaaaaaaaaaaagaagaagaauaca

SEQ ID NO: 36792 - RNA, 64 nt, Homo Sapiens
ugggugucagaaugagaccccaucucaaaaaaaaaaaaaaaaaaaaaaaagaagaagaauacag

SEQ ID NO: 36793 - RNA, 64 nt, Homo Sapiens
gggugucagaaugagaccccaucucaaaaaaaaaaaaaaaaaaaaaaaagaagaagaauacagu

SEQ ID NO: 36794 - RNA, 64 nt, Homo Sapiens
ggugucagaaugagaccccaucucaaaaaaaaaaaaaaaaaaaaaaaagaagaagaauacaguc

SEQ ID NO: 36795 - RNA, 64 nt, Homo Sapiens
gugucagaaugagaccccaucucaaaaaaaaaaaaaaaaaaaaaaaagaagaagaauacaguca

SEQ ID NO: 36796 - RNA, 64 nt, Homo Sapiens
ugucagaaugagaccccaucucaaaaaaaaaaaaaaaaaaaaaaaagaagaagaauacagucau

SEQ ID NO: 36797 - RNA, 64 nt, Homo Sapiens
gucagaaugagaccccaucucaaaaaaaaaaaaaaaaaaaaaaaagaagaagaauacagucaug

SEQ ID NO: 36798 - RNA, 64 nt, Homo Sapiens
ucagaaugagaccccaucucaaaaaaaaaaaaaaaaaaaaaaaagaagaagaauacagucaugu

SEQ ID NO: 36799 - RNA, 64 nt, Homo Sapiens
cagaaugagaccccaucucaaaaaaaaaaaaaaaaaaaaaaaagaagaagaauacagucaugua

SEQ ID NO: 36800 - RNA, 64 nt, Homo Sapiens
agaaugagaccccaucucaaaaaaaaaaaaaaaaaaaaaaaagaagaagaauacagucauguau

SEQ ID NO: 36801 - RNA, 64 nt, Homo Sapiens
cuccagccugggugacagagcgagacuccaucucaaaaaaaaaaaaaaaaagaauauauugacg

SEQ ID NO: 36802 - RNA, 64 nt, Homo Sapiens
uccagccugggugacagagcgagacuccaucucaaaaaaaaaaaaaaaaagaauauauugacgg

SEQ ID NO: 36803 - RNA, 64 nt, Homo Sapiens
ccagccugggugacagagcgagacuccaucucaaaaaaaaaaaaaaaaagaauauauugacgga

SEQ ID NO: 36804 - RNA, 64 nt, Homo Sapiens
cagccugggugacagagcgagacuccaucucaaaaaaaaaaaaaaaaagaauauauugacggaa

SEQ ID NO: 36805 - RNA, 64 nt, Homo Sapiens
agccugggugacagagcgagacuccaucucaaaaaaaaaaaaaaaaagaauauauugacggaag

SEQ ID NO: 36806 - RNA, 64 nt, Homo Sapiens
gccugggugacagagcgagacuccaucucaaaaaaaaaaaaaaaaagaauauauugacggaaga

SEQ ID NO: 36807 - RNA, 64 nt, Homo Sapiens
ccugggugacagagcgagacuccaucucaaaaaaaaaaaaaaaaagaauauauugacggaagaa

SEQ ID NO: 36808 - RNA, 64 nt, Homo Sapiens
cugggugacagagcgagacuccaucucaaaaaaaaaaaaaaaaagaauauauugacggaagaau

SEQ ID NO: 36809 - RNA, 64 nt, Homo Sapiens
ugggugacagagcgagacuccaucucaaaaaaaaaaaaaaaaagaauauauugacggaagaaua

SEQ ID NO: 36810 - RNA, 64 nt, Homo Sapiens
gggugacagagcgagacuccaucucaaaaaaaaaaaaaaaaagaauauauugacggaagaauag

SEQ ID NO: 36811 - RNA, 64 nt, Homo Sapiens
uuuuuuccuuuuuuuccaaaacacuuuauacuuuaaaaaaaaaaaaaaaaagcaauuccuggug

SEQ ID NO: 36812 - RNA, 64 nt, Homo Sapiens
uuuuuccuuuuuuuccaaaacacuuuauacuuuaaaaaaaaaaaaaaaaagcaauuccuggugg

SEQ ID NO: 36813 - RNA, 64 nt, Homo Sapiens
uuuuccuuuuuuuccaaaacacuuuauacuuuaaaaaaaaaaaaaaaaagcaauuccugguggc

SEQ ID NO: 36814 - RNA, 64 nt, Homo Sapiens
uuuccuuuuuuuccaaaacacuuuauacuuuaaaaaaaaaaaaaaaaagcaauuccugguggcu

SEQ ID NO: 36815 - RNA, 64 nt, Homo Sapiens
uuccuuuuuuuccaaaacacuuuauacuuuaaaaaaaaaaaaaaaaagcaauuccugguggcug

SEQ ID NO: 36816 - RNA, 64 nt, Homo Sapiens
uccuuuuuuuccaaaacacuuuauacuuuaaaaaaaaaaaaaaaaagcaauuccugguggcugu

SEQ ID NO: 36817 - RNA, 64 nt, Homo Sapiens
ccuuuuuuuccaaaacacuuuauacuuuaaaaaaaaaaaaaaaaagcaauuccugguggcugug

SEQ ID NO: 36818 - RNA, 64 nt, Homo Sapiens
cuuuuuuuccaaaacacuuuauacuuuaaaaaaaaaaaaaaaaagcaauuccugguggcugugu

SEQ ID NO: 36819 - RNA, 64 nt, Homo Sapiens
uuuuuuuccaaaacacuuuauacuuuaaaaaaaaaaaaaaaaagcaauuccugguggcugugug

SEQ ID NO: 36820 - RNA, 64 nt, Homo Sapiens
uuuuuuccaaaacacuuuauacuuuaaaaaaaaaaaaaaaaagcaauuccugguggcugugugc

SEQ ID NO: 36821 - RNA, 64 nt, Homo Sapiens
cuccagccugggcaacauagcaaaauccugucucaaaaaaaaaguuaaaaaauauugcccggcu

SEQ ID NO: 36822 - RNA, 64 nt, Homo Sapiens
uccagccugggcaacauagcaaaauccugucucaaaaaaaaaguuaaaaaauauugcccggcuc

SEQ ID NO: 36823 - RNA, 64 nt, Homo Sapiens
cuccagccugggcgacaguaccagacuccaucucaaaaaaaaaaaaaccagacugaauuaauuu

SEQ ID NO: 36824 - RNA, 64 nt, Homo Sapiens
uccagccugggcgacaguaccagacuccaucucaaaaaaaaaaaaaccagacugaauuaauuuu

SEQ ID NO: 36825 - RNA, 64 nt, Homo Sapiens
ccagccugggcgacaguaccagacuccaucucaaaaaaaaaaaaaccagacugaauuaauuuua

SEQ ID NO: 36826 - RNA, 64 nt, Homo Sapiens
cagccugggcgacaguaccagacuccaucucaaaaaaaaaaaaaccagacugaauuaauuuuaa

SEQ ID NO: 36827 - RNA, 64 nt, Homo Sapiens
agccugggcgacaguaccagacuccaucucaaaaaaaaaaaaaccagacugaauuaauuuuaac

SEQ ID NO: 36828 - RNA, 64 nt, Homo Sapiens
gccugggcgacaguaccagacuccaucucaaaaaaaaaaaaaccagacugaauuaauuuuaacu

SEQ ID NO: 36829 - RNA, 64 nt, Homo Sapiens
acaugacaaagccccaucucuacaaaaaaauuacaaaaaaaaaaaaaacaggugugguggcaug

SEQ ID NO: 36830 - RNA, 64 nt, Homo Sapiens
caugacaaagccccaucucuacaaaaaaauuacaaaaaaaaaaaaaacaggugugguggcaugc

SEQ ID NO: 36831 - RNA, 64 nt, Homo Sapiens
augacaaagccccaucucuacaaaaaaauuacaaaaaaaaaaaaaacaggugugguggcaugca

SEQ ID NO: 36832 - RNA, 64 nt, Homo Sapiens
ugacaaagccccaucucuacaaaaaaauuacaaaaaaaaaaaaaacaggugugguggcaugcac

SEQ ID NO: 36833 - RNA, 64 nt, Homo Sapiens
gacaaagccccaucucuacaaaaaaauuacaaaaaaaaaaaaaacaggugugguggcaugcacc

SEQ ID NO: 36834 - RNA, 64 nt, Homo Sapiens
acaaagccccaucucuacaaaaaaauuacaaaaaaaaaaaaaacaggugugguggcaugcaccu

SEQ ID NO: 36835 - RNA, 64 nt, Homo Sapiens
caaagccccaucucuacaaaaaaauuacaaaaaaaaaaaaaacaggugugguggcaugcaccug

SEQ ID NO: 36836 - RNA, 64 nt, Homo Sapiens
uacccugucuguuggucagacucaaaugagaguuaaaaaaaaaaaaaaaaaucuguaugccuga

SEQ ID NO: 36837 - RNA, 64 nt, Homo Sapiens
acccugucuguuggucagacucaaaugagaguuaaaaaaaaaaaaaaaaaucuguaugccugag

SEQ ID NO: 36838 - RNA, 64 nt, Homo Sapiens
cccugucuguuggucagacucaaaugagaguuaaaaaaaaaaaaaaaaaucuguaugccugagu

SEQ ID NO: 36839 - RNA, 64 nt, Homo Sapiens
ccugucuguuggucagacucaaaugagaguuaaaaaaaaaaaaaaaaaucuguaugccugagua

SEQ ID NO: 36840 - RNA, 64 nt, Homo Sapiens
cugucuguuggucagacucaaaugagaguuaaaaaaaaaaaaaaaaaucuguaugccugaguac

SEQ ID NO: 36841 - RNA, 64 nt, Homo Sapiens
ugucuguuggucagacucaaaugagaguuaaaaaaaaaaaaaaaaaucuguaugccugaguacc

SEQ ID NO: 36842 - RNA, 64 nt, Homo Sapiens
gucuguuggucagacucaaaugagaguuaaaaaaaaaaaaaaaaaucuguaugccugaguacca

SEQ ID NO: 36843 - RNA, 64 nt, Homo Sapiens
ucuguuggucagacucaaaugagaguuaaaaaaaaaaaaaaaaaucuguaugccugaguaccau

SEQ ID NO: 36844 - RNA, 64 nt, Homo Sapiens
cuguuggucagacucaaaugagaguuaaaaaaaaaaaaaaaaaucuguaugccugaguaccauc

SEQ ID NO: 36845 - RNA, 64 nt, Homo Sapiens
uguuggucagacucaaaugagaguuaaaaaaaaaaaaaaaaaucuguaugccugaguaccaucc

SEQ ID NO: 36846 - RNA, 64 nt, Homo Sapiens
ggugcaaagauguucauucuuuuaaaaaauguuuaaaaaaaaaaaaaaacugccuuucuucccc

SEQ ID NO: 36847 - RNA, 64 nt, Homo Sapiens
gugcaaagauguucauucuuuuaaaaaauguuuaaaaaaaaaaaaaaacugccuuucuuccccu

SEQ ID NO: 36848 - RNA, 64 nt, Homo Sapiens
ugcaaagauguucauucuuuuaaaaaauguuuaaaaaaaaaaaaaaacugccuuucuuccccuc

SEQ ID NO: 36849 - RNA, 64 nt, Homo Sapiens
gcaaagauguucauucuuuuaaaaaauguuuaaaaaaaaaaaaaaacugccuuucuuccccuca

SEQ ID NO: 36850 - RNA, 64 nt, Homo Sapiens
caaagauguucauucuuuuaaaaaauguuuaaaaaaaaaaaaaaacugccuuucuuccccucaa

SEQ ID NO: 36851 - RNA, 64 nt, Homo Sapiens
aaagauguucauucuuuuaaaaaauguuuaaaaaaaaaaaaaaacugccuuucuuccccucaag

SEQ ID NO: 36852 - RNA, 64 nt, Homo Sapiens
aagauguucauucuuuuaaaaaauguuuaaaaaaaaaaaaaaacugccuuucuuccccucaagu

SEQ ID NO: 36853 - RNA, 64 nt, Homo Sapiens
agauguucauucuuuuaaaaaauguuuaaaaaaaaaaaaaaacugccuuucuuccccucaaguc

SEQ ID NO: 36854 - RNA, 64 nt, Homo Sapiens
ugugaaucagugagauguuaguagaauaagccuuaaaaaaaaaaaaaucgguugggugcagugg

SEQ ID NO: 36855 - RNA, 64 nt, Homo Sapiens
gugaaucagugagauguuaguagaauaagccuuaaaaaaaaaaaaaucgguugggugcaguggc

SEQ ID NO: 36856 - RNA, 64 nt, Homo Sapiens
ugaaucagugagauguuaguagaauaagccuuaaaaaaaaaaaaaucgguugggugcaguggca

SEQ ID NO: 36857 - RNA, 64 nt, Homo Sapiens
gaaucagugagauguuaguagaauaagccuuaaaaaaaaaaaaaucgguugggugcaguggcac

SEQ ID NO: 36858 - RNA, 64 nt, Homo Sapiens
aaucagugagauguuaguagaauaagccuuaaaaaaaaaaaaaucgguugggugcaguggcaca

SEQ ID NO: 36859 - RNA, 64 nt, Homo Sapiens
aucagugagauguuaguagaauaagccuuaaaaaaaaaaaaaucgguugggugcaguggcacac

SEQ ID NO: 36860 - RNA, 64 nt, Homo Sapiens
uccagccugggcaacaugagugaaagucugacucaaaaaaaaaaaauuuaaaaaacaaaauaau

SEQ ID NO: 36861 - RNA, 64 nt, Homo Sapiens
ccagccugggcaacaugagugaaagucugacucaaaaaaaaaaaauuuaaaaaacaaaauaauc

SEQ ID NO: 36862 - RNA, 64 nt, Homo Sapiens
cagccugggcaacaugagugaaagucugacucaaaaaaaaaaaauuuaaaaaacaaaauaaucu

SEQ ID NO: 36863 - RNA, 64 nt, Homo Sapiens
agccugggcaacaugagugaaagucugacucaaaaaaaaaaaauuuaaaaaacaaaauaaucua

SEQ ID NO: 36864 - RNA, 64 nt, Homo Sapiens
gccugggcaacaugagugaaagucugacucaaaaaaaaaaaauuuaaaaaacaaaauaaucuag

SEQ ID NO: 36865 - RNA, 64 nt, Homo Sapiens
acagaacgagacucugucuuaaaaacaaacaaacaaaaaaaaaaucuguuagauaagcuaucaa

SEQ ID NO: 36866 - RNA, 64 nt, Homo Sapiens
cagaacgagacucugucuuaaaaacaaacaaacaaaaaaaaaaucuguuagauaagcuaucaaa

SEQ ID NO: 36867 - RNA, 64 nt, Homo Sapiens
agaacgagacucugucuuaaaaacaaacaaacaaaaaaaaaaucuguuagauaagcuaucaaaa

SEQ ID NO: 36868 - RNA, 64 nt, Homo Sapiens
gacagaguuagauuccacccucucccaccccggcaaaaaaaaaaaaaaaagaugcaaucaaagg

SEQ ID NO: 36869 - RNA, 64 nt, Homo Sapiens
acagaguuagauuccacccucucccaccccggcaaaaaaaaaaaaaaaagaugcaaucaaaggg

SEQ ID NO: 36870 - RNA, 64 nt, Homo Sapiens
cagaguuagauuccacccucucccaccccggcaaaaaaaaaaaaaaaagaugcaaucaaagggg

SEQ ID NO: 36871 - RNA, 64 nt, Homo Sapiens
agaguuagauuccacccucucccaccccggcaaaaaaaaaaaaaaaagaugcaaucaaaggggc

SEQ ID NO: 36872 - RNA, 64 nt, Homo Sapiens
gaguuagauuccacccucucccaccccggcaaaaaaaaaaaaaaaagaugcaaucaaaggggcu

SEQ ID NO: 36873 - RNA, 64 nt, Homo Sapiens
aguuagauuccacccucucccaccccggcaaaaaaaaaaaaaaaagaugcaaucaaaggggcug

SEQ ID NO: 36874 - RNA, 64 nt, Homo Sapiens
guuagauuccacccucucccaccccggcaaaaaaaaaaaaaaaagaugcaaucaaaggggcugu

SEQ ID NO: 36875 - RNA, 64 nt, Homo Sapiens
uuagauuccacccucucccaccccggcaaaaaaaaaaaaaaaagaugcaaucaaaggggcuguu

SEQ ID NO: 36876 - RNA, 64 nt, Homo Sapiens
uagauuccacccucucccaccccggcaaaaaaaaaaaaaaaagaugcaaucaaaggggcuguug

SEQ ID NO: 36877 - RNA, 64 nt, Homo Sapiens
ccagccugggcaccaaugugagaaccugucuuggaaaaaaaaaaaaagaaacauguuuuaguag

SEQ ID NO: 36878 - RNA, 64 nt, Homo Sapiens
cagccugggcaccaaugugagaaccugucuuggaaaaaaaaaaaaagaaacauguuuuaguaga

SEQ ID NO: 36879 - RNA, 64 nt, Homo Sapiens
agccugggcaccaaugugagaaccugucuuggaaaaaaaaaaaaagaaacauguuuuaguagaa

SEQ ID NO: 36880 - RNA, 64 nt, Homo Sapiens
gccugggcaccaaugugagaaccugucuuggaaaaaaaaaaaaagaaacauguuuuaguagaag

SEQ ID NO: 36881 - RNA, 64 nt, Homo Sapiens
ccugggcaccaaugugagaaccugucuuggaaaaaaaaaaaaagaaacauguuuuaguagaagu

SEQ ID NO: 36882 - RNA, 64 nt, Homo Sapiens
cugggcaccaaugugagaaccugucuuggaaaaaaaaaaaaagaaacauguuuuaguagaaguu

SEQ ID NO: 36883 - RNA, 64 nt, Homo Sapiens
uccagccugggcaacaagagcaaaauucugccucaaaaaaaaaaauaguaauaauacaaaaauu

SEQ ID NO: 36884 - RNA, 64 nt, Homo Sapiens
ccagccugggcaacaagagcaaaauucugccucaaaaaaaaaaauaguaauaauacaaaaauua

SEQ ID NO: 36885 - RNA, 64 nt, Homo Sapiens
cagccugggcaacaagagcaaaauucugccucaaaaaaaaaaauaguaauaauacaaaaauuag

SEQ ID NO: 36886 - RNA, 64 nt, Homo Sapiens
agccugggcaacaagagcaaaauucugccucaaaaaaaaaaauaguaauaauacaaaaauuagc

SEQ ID NO: 36887 - RNA, 64 nt, Homo Sapiens
cucaagcuuggaugacagagcaagacuccguuucaaaaaaaaaaaaccuccucucuuccuucac

SEQ ID NO: 36888 - RNA, 64 nt, Homo Sapiens
ucaagcuuggaugacagagcaagacuccguuucaaaaaaaaaaaaccuccucucuuccuucaca

SEQ ID NO: 36889 - RNA, 64 nt, Homo Sapiens
caagcuuggaugacagagcaagacuccguuucaaaaaaaaaaaaccuccucucuuccuucacac

SEQ ID NO: 36890 - RNA, 64 nt, Homo Sapiens
aagcuuggaugacagagcaagacuccguuucaaaaaaaaaaaaccuccucucuuccuucacacc

SEQ ID NO: 36891 - RNA, 64 nt, Homo Sapiens
agcuuggaugacagagcaagacuccguuucaaaaaaaaaaaaccuccucucuuccuucacaccu

SEQ ID NO: 36892 - RNA, 64 nt, Homo Sapiens
acuguuuauuaaaguacaaccaauuuuuuugguaaaaaaaaauuaaggaaguagaaacaaaaua

SEQ ID NO: 36893 - RNA, 64 nt, Homo Sapiens
uacuguuuauuaaaguacaaacaauuuuuuugguaaaaaaaaaucaaggaaguagaaacaaaau

SEQ ID NO: 36894 - RNA, 64 nt, Homo Sapiens
uggguaugguggcgcaugcccgucucaaaaaaaaaaaaaaaagcgggggacaaaagugagacau

SEQ ID NO: 36895 - RNA, 64 nt, Homo Sapiens
cuggguaugguggcgcaugcucgucucaaaaaaaaaaaaaaaagugggggacaaaagugagaca

SEQ ID NO: 36896 - RNA, 64 nt, Homo Sapiens
gcuggguaugguggcgcaugaucgucucaaaaaaaaaaaaaaaacugggggacaaaagugagac

SEQ ID NO: 36897 - RNA, 64 nt, Homo Sapiens
agcuggguaugguggcgcaucaucgucucaaaaaaaaaaaaaaaccugggggacaaaagugaga

SEQ ID NO: 36898 - RNA, 64 nt, Homo Sapiens
aagcuggguaugguggcgcaacaucgucucaaaaaaaaaaaaaagccugggggacaaaagugag

SEQ ID NO: 36899 - RNA, 64 nt, Homo Sapiens
aaagcuggguaugguggcgcgacaucgucucaaaaaaaaaaaaaagccugggggacaaaaguga

SEQ ID NO: 36900 - RNA, 64 nt, Homo Sapiens
aaaagcuggguaugguggcgagacaucgucucaaaaaaaaaaaacagccugggggacaaaagug

SEQ ID NO: 36901 - RNA, 64 nt, Homo Sapiens
aaaaagcuggguaugguggcgagacaucgucucaaaaaaaaaaaccagccugggggacaaaagu

SEQ ID NO: 36902 - RNA, 64 nt, Homo Sapiens
aaaaaagcuggguaugguggugagacaucgucucaaaaaaaaaauccagccugggggacaaaag

SEQ ID NO: 36903 - RNA, 64 nt, Homo Sapiens
uuaaacauagucgcugucaugucucuuauuuacaaaaaaaaacccagucaaugcauugcuuaag

SEQ ID NO: 36904 - RNA, 64 nt, Homo Sapiens
cuuaaacauagucgcugucaggucucuuauuuacaaaaaaaaacgcagucaaugcauugcuuaa

SEQ ID NO: 36905 - RNA, 64 nt, Homo Sapiens
ucuacuuuuccucuuaaaggucccuuuaaaaaaaaaaaaaaacuaugccacugacaaugagauc

SEQ ID NO: 36906 - RNA, 64 nt, Homo Sapiens
uucuacuuuuccucuuaaagcucccuuuaaaaaaaaaaaaaaacaaugccacugacaaugagau

SEQ ID NO: 36907 - RNA, 64 nt, Homo Sapiens
cuucuacuuuuccucuuaaaucucccuuuaaaaaaaaaaaaaaaaaaugccacugacaaugaga

SEQ ID NO: 36908 - RNA, 64 nt, Homo Sapiens
acuucuacuuuuccucuuaaaucucccuuuaaaaaaaaaaaaaaaaaaugccacugacaaugag

SEQ ID NO: 36909 - RNA, 64 nt, Homo Sapiens
aacuucuacuuuuccucuuagaucucccuuuaaaaaaaaaaaaauaaaaugccacugacaauga

SEQ ID NO: 36910 - RNA, 64 nt, Homo Sapiens
aaacuucuacuuuuccucuuagaucucccuuuaaaaaaaaaaaauuaaaaugccacugacaaug

SEQ ID NO: 36911 - RNA, 64 nt, Homo Sapiens
aaaacuucuacuuuuccucugagaucucccuuuaaaaaaaaaaacuuaaaaugccacugacaau

SEQ ID NO: 36912 - RNA, 64 nt, Homo Sapiens
aaaaacuucuacuuuuccucugagaucucccuuuaaaaaaaaaaucuuaaaaugccacugacaa

SEQ ID NO: 36913 - RNA, 64 nt, Homo Sapiens
aaaaaacaaaaaaacaacugggaaauguuaaaaaaaaaaaaacaucugagccaccuuccuuaaa

SEQ ID NO: 36914 - RNA, 64 nt, Homo Sapiens
aaaaaaacaaaaaaacaacuaggaaauguuaaaaaaaaaaaaacaucugagccaccuuccuuaa

SEQ ID NO: 36915 - RNA, 64 nt, Homo Sapiens
caaaaaaacaaaaaaacaacaaggaaauguuaaaaaaaaaaaaaaaucugagccaccuuccuua

SEQ ID NO: 36916 - RNA, 64 nt, Homo Sapiens
acaaaaaaacaaaaaaacaaaaaggaaauguuaaaaaaaaaaaacaaucugagccaccuuccuu

SEQ ID NO: 36917 - RNA, 64 nt, Homo Sapiens
aacaaaaaaacaaaaaaacauaaaggaaauguuaaaaaaaaaaagcaaucugagccaccuuccu

SEQ ID NO: 36918 - RNA, 64 nt, Homo Sapiens
aaacaaaaaaacaaaaaaacuuaaaggaaauguuaaaaaaaaaaagcaaucugagccaccuucc

SEQ ID NO: 36919 - RNA, 64 nt, Homo Sapiens
cuccacauugccaaguuuuugacuuaauuaaaaaaaaaaaaagaugggaaauugcucugcauuu

SEQ ID NO: 36920 - RNA, 64 nt, Homo Sapiens
acuccacauugccaaguuuuugacuuaauuaaaaaaaaaaaaaggugggaaauugcucugcauu

SEQ ID NO: 36921 - RNA, 64 nt, Homo Sapiens
gacuccacauugccaaguuuuugacuuaauuaaaaaaaaaaaaaugugggaaauugcucugcau

SEQ ID NO: 36922 - RNA, 64 nt, Homo Sapiens
agacuccacauugccaaguuuuugacuuaauuaaaaaaaaaaaagugugggaaauugcucugca

SEQ ID NO: 36923 - RNA, 64 nt, Homo Sapiens
aagacuccacauugccaaguauuugacuuaauuaaaaaaaaaaaagugugggaaauugcucugc

SEQ ID NO: 36924 - RNA, 64 nt, Homo Sapiens
aaagacuccacauugccaagcauuugacuuaauuaaaaaaaaaauagugugggaaauugcucug

SEQ ID NO: 36925 - RNA, 64 nt, Homo Sapiens
augcauuuccaugucuguauacugugguaaaaaaaaaaaaaauauuuuuucuuuuuuuuuuuaa

SEQ ID NO: 36926 - RNA, 64 nt, Homo Sapiens
aaugcauuuccaugucuguaaacugugguaaaaaaaaaaaaaauuuuuuuucuuuuuuuuuuua

SEQ ID NO: 36927 - RNA, 64 nt, Homo Sapiens
uaaugcauuuccaugucuguaaacugugguaaaaaaaaaaaaaaauuuuuuucuuuuuuuuuuu

SEQ ID NO: 36928 - RNA, 64 nt, Homo Sapiens
auaaugcauuuccaugucuguaaacugugguaaaaaaaaaaaaacauuuuuuucuuuuuuuuuu

SEQ ID NO: 36929 - RNA, 64 nt, Homo Sapiens
aauaaugcauuuccaugucuuuaaacugugguaaaaaaaaaaaagcauuuuuuucuuuuuuuuu

SEQ ID NO: 36930 - RNA, 64 nt, Homo Sapiens
aaauaaugcauuuccaugucuuuaaacugugguaaaaaaaaaaaugcauuuuuuucuuuuuuuu

SEQ ID NO: 36931 - RNA, 64 nt, Homo Sapiens
aaaauaaugcauuuccauguuuuuaaacugugguaaaaaaaaaagugcauuuuuuucuuuuuuu

SEQ ID NO: 36932 - RNA, 64 nt, Homo Sapiens
caaaaaaagaaagaauacuucaaacaaacaaacaaaaaaaaacaagcaagaugaagaggaaaaa

SEQ ID NO: 36933 - RNA, 64 nt, Homo Sapiens
acaaaaaaagaaagaauacuacaaacaaacaaacaaaaaaaaacuagcaagaugaagaggaaaa

SEQ ID NO: 36934 - RNA, 64 nt, Homo Sapiens
gagagggauaaaaaauuaaaagaaaacaaacuuuaaaaaaaagcgggaaaauauaaacgaggga

SEQ ID NO: 36935 - RNA, 64 nt, Homo Sapiens
acaaaauauaagaggaacaaaacaaguaaauuuuaaaaaaaagacaaaaaaagagaaaaaacau

SEQ ID NO: 36936 - RNA, 64 nt, Homo Sapiens
aaaaaacaaaaaacaaaaaacaaaaacaaaaaacaaaaaaaacagcugggagaccuuccaaaag

SEQ ID NO: 36937 - RNA, 64 nt, Homo Sapiens
gaagaacuuuggggggaauuuaaaaaacugaaaaaaaaaaaacucuuuuuauuacuuuguaauu

SEQ ID NO: 36938 - RNA, 64 nt, Homo Sapiens
ugaagaacuuuggggggaauuuaaaaaacugaaaaaaaaaaaacgcuuuuuauuacuuuguaau

SEQ ID NO: 36939 - RNA, 64 nt, Homo Sapiens
cugaagaacuuuggggggaauuuaaaaaacugaaaaaaaaaaaaagcuuuuuauuacuuuguaa

SEQ ID NO: 36940 - RNA, 64 nt, Homo Sapiens
acugaagaacuuuggggggaauuuaaaaaacugaaaaaaaaaaaaagcuuuuuauuacuuugua

SEQ ID NO: 36941 - RNA, 64 nt, Homo Sapiens
aacugaagaacuuuggggggaauuuaaaaaacugaaaaaaaaaaaaagcuuuuuauuacuuugu

SEQ ID NO: 36942 - RNA, 64 nt, Homo Sapiens
caaaaauaaaccacucaaaaaaaaaaaaaaaaaaaaaaaaaaggucuucacuguauuuucuuua

SEQ ID NO: 36943 - RNA, 64 nt, Homo Sapiens
gcaaaaauaaaccacucaaaaaaaaaaaaaaaaaaaaaaaaaaggucuucacuguauuuucuuu

SEQ ID NO: 36944 - RNA, 64 nt, Homo Sapiens
ggcaaaaauaaaccacucaauaaaaaaaaaaaaaaaaaaaaaaaugucuucacuguauuuucuu

SEQ ID NO: 36945 - RNA, 64 nt, Homo Sapiens
aggcaaaaauaaaccacucauuaaaaaaaaaaaaaaaaaaaaaagugucuucacuguauuuucu

SEQ ID NO: 36946 - RNA, 64 nt, Homo Sapiens
aaggcaaaaauaaaccacucuuuaaaaaaaaaaaaaaaaaaaaaagugucuucacuguauuuuc

SEQ ID NO: 36947 - RNA, 64 nt, Homo Sapiens
aaaggcaaaaauaaaccacucuuuaaaaaaaaaaaaaaaaaaaauagugucuucacuguauuuu

SEQ ID NO: 36948 - RNA, 64 nt, Homo Sapiens
aaaaggcaaaaauaaaccacucuuuaaaaaaaaaaaaaaaaaaacuagugucuucacuguauuu

SEQ ID NO: 36949 - RNA, 64 nt, Homo Sapiens
aaaaaggcaaaaauaaaccauucuuuaaaaaaaaaaaaaaaaaaucuagugucuucacuguauu

SEQ ID NO: 36950 - RNA, 64 nt, Homo Sapiens
aaaaaaggcaaaaauaaaccuuucuuuaaaaaaaaaaaaaaaaauucuagugucuucacuguau

SEQ ID NO: 36951 - RNA, 64 nt, Homo Sapiens
aaaaaaaggcaaaaauaaacuuuucuuuaaaaaaaaaaaaaaaacuucuagugucuucacugua

SEQ ID NO: 36952 - RNA, 64 nt, Homo Sapiens
aaaaaaaaggcaaaaauaaaauuuucuuuaaaaaaaaaaaaaaaccuucuagugucuucacugu

SEQ ID NO: 36953 - RNA, 64 nt, Homo Sapiens
aaaaaaaaaggcaaaaauaauauuuucuuuaaaaaaaaaaaaaacccuucuagugucuucacug

SEQ ID NO: 36954 - RNA, 64 nt, Homo Sapiens
aaaaaaaaaaggcaaaaauaguauuuucuuuaaaaaaaaaaaaaucccuucuagugucuucacu

SEQ ID NO: 36955 - RNA, 64 nt, Homo Sapiens
aaaaaaaaaaaggcaaaaauuguauuuucuuuaaaaaaaaaaaacucccuucuagugucuucac

SEQ ID NO: 36956 - RNA, 64 nt, Homo Sapiens
aaaaaaaaaaaaggcaaaaacuguauuuucuuuaaaaaaaaaaaucucccuucuagugucuuca

SEQ ID NO: 36957 - RNA, 64 nt, Homo Sapiens
aaaaaaaaaaaaaggcaaaaacuguauuuucuuuaaaaaaaaaauucucccuucuagugucuuc

SEQ ID NO: 36958 - RNA, 64 nt, Homo Sapiens
uauauauauauauauagcugcauuuuguaaaaaaaaaaaaaauaaaugauccagucuggaauaa

SEQ ID NO: 36959 - RNA, 64 nt, Homo Sapiens
auauauauauauauauagcuacauuuuguaaaaaaaaaaaaaauaaaugauccagucuggaaua

SEQ ID NO: 36960 - RNA, 64 nt, Homo Sapiens
uauauauauauauauauagcaacauuuuguaaaaaaaaaaaaaaaaaaugauccagucuggaau

SEQ ID NO: 36961 - RNA, 64 nt, Homo Sapiens
auauauauauauauauauaguaacauuuuguaaaaaaaaaaaaacaaaaugauccagucuggaa

SEQ ID NO: 36962 - RNA, 64 nt, Homo Sapiens
aauauauauauauauauauaauaacauuuuguaaaaaaaaaaaaccaaaaugauccagucugga

SEQ ID NO: 36963 - RNA, 64 nt, Homo Sapiens
aaauauauauauauauauauaauaacauuuuguaaaaaaaaaaaaccaaaaugauccagucugg

SEQ ID NO: 36964 - RNA, 64 nt, Homo Sapiens
aaaauauauauauauauauagaauaacauuuuguaaaaaaaaaacaccaaaaugauccagucug

SEQ ID NO: 36965 - RNA, 64 nt, Homo Sapiens
uuuuuaaaauguuaaaauuacgucucaaaaaaaaaaaaaaaacuuaggugacagagugagacuc

SEQ ID NO: 36966 - RNA, 64 nt, Homo Sapiens
uuuuuuaaaauguuaaaauuccgucucaaaaaaaaaaaaaaaaccuaggugacagagugagacu

SEQ ID NO: 36967 - RNA, 64 nt, Homo Sapiens
cuuuuuuaaaauguuaaaauuccgucucaaaaaaaaaaaaaaaaccuaggugacagagugagac

SEQ ID NO: 36968 - RNA, 64 nt, Homo Sapiens
acuuuuuuaaaauguuaaaacuccgucucaaaaaaaaaaaaaaagccuaggugacagagugaga

SEQ ID NO: 36969 - RNA, 64 nt, Homo Sapiens
aacuuuuuuaaaauguuaaaacuccgucucaaaaaaaaaaaaaaagccuaggugacagagugag

SEQ ID NO: 36970 - RNA, 64 nt, Homo Sapiens
aaacuuuuuuaaaauguuaagacuccgucucaaaaaaaaaaaaacagccuaggugacagaguga

SEQ ID NO: 36971 - RNA, 64 nt, Homo Sapiens
aaaacuuuuuuaaaauguuaagacuccgucucaaaaaaaaaaaaccagccuaggugacagagug

SEQ ID NO: 36972 - RNA, 64 nt, Homo Sapiens
aaaaacuuuuuuaaaauguugagacuccgucucaaaaaaaaaaauccagccuaggugacagagu

SEQ ID NO: 36973 - RNA, 64 nt, Homo Sapiens
aaaaaacuuuuuuaaaauguugagacuccgucucaaaaaaaaaacuccagccuaggugacagag

SEQ ID NO: 36974 - RNA, 64 nt, Homo Sapiens
aauuuggaaaacugcaaugaccugucuuaaaaaaaaaaaaaaggcuugggugacaaaguaagac

SEQ ID NO: 36975 - RNA, 64 nt, Homo Sapiens
gaauuuggaaaacugcaaugcccugucuuaaaaaaaaaaaaaaggcuugggugacaaaguaaga

SEQ ID NO: 36976 - RNA, 64 nt, Homo Sapiens
ggaauuuggaaaacugcaauacccugucuuaaaaaaaaaaaaaaagcuugggugacaaaguaag

SEQ ID NO: 36977 - RNA, 64 nt, Homo Sapiens
aggaauuuggaaaacugcaagacccugucuuaaaaaaaaaaaaacagcuugggugacaaaguaa

SEQ ID NO: 36978 - RNA, 64 nt, Homo Sapiens
aaggaauuuggaaaacugcaagacccugucuuaaaaaaaaaaaaccagcuugggugacaaagua

SEQ ID NO: 36979 - RNA, 64 nt, Homo Sapiens
aaaggaauuuggaaaacugcaagacccugucuuaaaaaaaaaaauccagcuugggugacaaagu

SEQ ID NO: 36980 - RNA, 64 nt, Homo Sapiens
aaaaggaauuuggaaaacuguaagacccugucuuaaaaaaaaaacuccagcuugggugacaaag

SEQ ID NO: 36981 - RNA, 64 nt, Homo Sapiens
ggagaaauaaaaccuuuucuaaaacaaacuuuaaaaaaaaaagaagaaacauauuuuuucagga

SEQ ID NO: 36982 - RNA, 64 nt, Homo Sapiens
aggagaaauaaaaccuuuucaaaaacaaacuuuaaaaaaaaaaggagaaacauauuuuuucagg

SEQ ID NO: 36983 - RNA, 64 nt, Homo Sapiens
gaggagaaauaaaaccuuuugaaaaacaaacuuuaaaaaaaaaaagagaaacauauuuuuucag

SEQ ID NO: 36984 - RNA, 64 nt, Homo Sapiens
ggaaaagaaaaauguacaaaagaaaggaaaggccaaaaaaaagacacccaagaccacagaaaag

SEQ ID NO: 36985 - RNA, 64 nt, Homo Sapiens
aaaacuuugcuaauauuaacuuuaugagcagaaaaaaaaaaaguuauuggcuuuuucagaguca

SEQ ID NO: 36986 - RNA, 64 nt, Homo Sapiens
uaaaacuuugcuaauauuaaauuuaugagcagaaaaaaaaaaagguauuggcuuuuucagaguc

SEQ ID NO: 36987 - RNA, 64 nt, Homo Sapiens
guaaaacuuugcuaauauuacauuuaugagcagaaaaaaaaaaacguauuggcuuuuucagagu

SEQ ID NO: 36988 - RNA, 64 nt, Homo Sapiens
aguaaaacuuugcuaauauuucauuuaugagcagaaaaaaaaaagcguauuggcuuuuucagag

SEQ ID NO: 36989 - RNA, 64 nt, Homo Sapiens
uacauuggucuuuaaacccaaaaaaaaaaaaaaaaaaaaaaagacucaaaaaaaaaaaaaaaaa

SEQ ID NO: 36990 - RNA, 64 nt, Homo Sapiens
auacauuggucuuuaaacccaaaaaaaaaaaaaaaaaaaaaaagucucaaaaaaaaaaaaaaaa

SEQ ID NO: 36991 - RNA, 64 nt, Homo Sapiens
gauacauuggucuuuaaaccaaaaaaaaaaaaaaaaaaaaaaaagucucaaaaaaaaaaaaaaa

SEQ ID NO: 36992 - RNA, 64 nt, Homo Sapiens
agauacauuggucuuuaaacaaaaaaaaaaaaaaaaaaaaaaaaugucucaaaaaaaaaaaaaa

SEQ ID NO: 36993 - RNA, 64 nt, Homo Sapiens
aagauacauuggucuuuaaaaaaaaaaaaaaaaaaaaaaaaaaacugucucaaaaaaaaaaaaa

SEQ ID NO: 36994 - RNA, 64 nt, Homo Sapiens
aaagauacauuggucuuuaaaaaaaaaaaaaaaaaaaaaaaaaaucugucucaaaaaaaaaaaa

SEQ ID NO: 36995 - RNA, 64 nt, Homo Sapiens
aaaagauacauuggucuuuaaaaaaaaaaaaaaaaaaaaaaaaacucugucucaaaaaaaaaaa

SEQ ID NO: 36996 - RNA, 64 nt, Homo Sapiens
aaaaagauacauuggucuuuaaaaaaaaaaaaaaaaaaaaaaaaacucugucucaaaaaaaaaa

SEQ ID NO: 36997 - RNA, 64 nt, Homo Sapiens
aaaaaagauacauuggucuuaaaaaaaaaaaaaaaaaaaaaaaaaacucugucucaaaaaaaaa

SEQ ID NO: 36998 - RNA, 64 nt, Homo Sapiens
aaaaaaagauacauuggucuaaaaaaaaaaaaaaaaaaaaaaaaaaacucugucucaaaaaaaa

SEQ ID NO: 36999 - RNA, 64 nt, Homo Sapiens
aaaaaaaagauacauuggucaaaaaaaaaaaaaaaaaaaaaaaagaaacucugucucaaaaaaa

SEQ ID NO: 37000 - RNA, 64 nt, Homo Sapiens
aaaaaaaaagauacauugguaaaaaaaaaaaaaaaaaaaaaaaacgaaacucugucucaaaaaa

SEQ ID NO: 37001 - RNA, 64 nt, Homo Sapiens
aaaaaaaaaagauacauuggaaaaaaaaaaaaaaaaaaaaaaaagcgaaacucugucucaaaaa

SEQ ID NO: 37002 - RNA, 64 nt, Homo Sapiens
aaaaaaaaaaagauacauugaaaaaaaaaaaaaaaaaaaaaaaaagcgaaacucugucucaaaa

SEQ ID NO: 37003 - RNA, 64 nt, Homo Sapiens
aaaaaaaaaaaagauacauuaaaaaaaaaaaaaaaaaaaaaaaagagcgaaacucugucucaaa

SEQ ID NO: 37004 - RNA, 64 nt, Homo Sapiens
aaaaaaaaaaaaagauacauaaaaaaaaaaaaaaaaaaaaaaaaagagcgaaacucugucucaa

SEQ ID NO: 37005 - RNA, 64 nt, Homo Sapiens
aaaaaaaaaaaaaagauacaaaaaaaaaaaaaaaaaaaaaaaaagagagcgaaacucugucuca

SEQ ID NO: 37006 - RNA, 64 nt, Homo Sapiens
aaaaaaaaaaaaaaagauacaaaaaaaaaaaaaaaaaaaaaaaacgagagcgaaacucugucuc

SEQ ID NO: 37007 - RNA, 64 nt, Homo Sapiens
aaaaaaaaaaaaaaaagauacaaaaaaaaaaaaaaaaaaaaaaaacgagagcgaaacucugucu

SEQ ID NO: 37008 - RNA, 64 nt, Homo Sapiens
aaaaaaaaaaaaaaaaagauucaaaaaaaaaaaaaaaaaaaaaaaacgagagcgaaacucuguc

SEQ ID NO: 37009 - RNA, 64 nt, Homo Sapiens
aaaaaaaaaaaaaaaaaagacucaaaaaaaaaaaaaaaaaaaaacaacgagagcgaaacucugu

SEQ ID NO: 37010 - RNA, 64 nt, Homo Sapiens
aaaaaaaaaaaaaaaaaaagucucaaaaaaaaaaaaaaaaaaaagcaacgagagcgaaacucug

SEQ ID NO: 37011 - RNA, 64 nt, Homo Sapiens
aaaaaaaaaaaaaaaaaaaagucucaaaaaaaaaaaaaaaaaaaggcaacgagagcgaaacucu

SEQ ID NO: 37012 - RNA, 64 nt, Homo Sapiens
aaaaaaaaaaaaaaaaaaaaugucucaaaaaaaaaaaaaaaaaagggcaacgagagcgaaacuc

SEQ ID NO: 37013 - RNA, 64 nt, Homo Sapiens
aaaaaaaaaaaaaaaaaaaacugucucaaaaaaaaaaaaaaaaaugggcaacgagagcgaaacu

SEQ ID NO: 37014 - RNA, 64 nt, Homo Sapiens
aaaaaaaaaaaaaaaaaaaaucugucucaaaaaaaaaaaaaaaacugggcaacgagagcgaaac

SEQ ID NO: 37015 - RNA, 64 nt, Homo Sapiens
aaaaaaaaaaaaaaaaaaaacucugucucaaaaaaaaaaaaaaaccugggcaacgagagcgaaa

SEQ ID NO: 37016 - RNA, 64 nt, Homo Sapiens
aaaaaaaaaaaaaaaaaaaaacucugucucaaaaaaaaaaaaaagccugggcaacgagagcgaa

SEQ ID NO: 37017 - RNA, 64 nt, Homo Sapiens
aaaaaaaaaaaaaaaaaaaaaacucugucucaaaaaaaaaaaaaagccugggcaacgagagcga

SEQ ID NO: 37018 - RNA, 64 nt, Homo Sapiens
aaaaaaaaaaaaaaaaaaaaaaacucugucucaaaaaaaaaaaauagccugggcaacgagagcg

SEQ ID NO: 37019 - RNA, 64 nt, Homo Sapiens
aaaaaaaaaaaaaaaaaaaagaaacucugucucaaaaaaaaaaacuagccugggcaacgagagc

SEQ ID NO: 37020 - RNA, 64 nt, Homo Sapiens
aaaaaaaaaaaaaaaaaaaacgaaacucugucucaaaaaaaaaaucuagccugggcaacgagag

SEQ ID NO: 37021 - RNA, 64 nt, Homo Sapiens
agaagugcugguuagauaguuagaguuuuaagggaaaaaaaaucgacauacaacaccuguacuu

SEQ ID NO: 37022 - RNA, 64 nt, Homo Sapiens
uucccauacacuggccugccgccccccccaacaaaaaaaaaaguaaacagagggagacuccauc

SEQ ID NO: 37023 - RNA, 64 nt, Homo Sapiens
uuucccauacacuggccugccgccccccccaacaaaaaaaaaagcaaacagagggagacuccau

SEQ ID NO: 37024 - RNA, 64 nt, Homo Sapiens
guuucccauacacuggccugucgccccccccaacaaaaaaaaaagcaaacagagggagacucca

SEQ ID NO: 37025 - RNA, 64 nt, Homo Sapiens
uucuauuucaaacguuaauuuugcuucucuuucuaaaaaaaaaaaaaaaaaagaaagagaagaa

SEQ ID NO: 37026 - RNA, 64 nt, Homo Sapiens
ucuauuucaaacguuaauuuugcuucucuuucuaaaaaaaaaaaaaaaaaagaaagagaagaaa

SEQ ID NO: 37027 - RNA, 64 nt, Homo Sapiens
cuauuucaaacguuaauuuugcuucucuuucuaaaaaaaaaaaaaaaaaagaaagagaagaaag

SEQ ID NO: 37028 - RNA, 64 nt, Homo Sapiens
uauuucaaacguuaauuuugcuucucuuucuaaaaaaaaaaaaaaaaaagaaagagaagaaaga

SEQ ID NO: 37029 - RNA, 64 nt, Homo Sapiens
auuucaaacguuaauuuugcuucucuuucuaaaaaaaaaaaaaaaaaagaaagagaagaaagaa

SEQ ID NO: 37030 - RNA, 64 nt, Homo Sapiens
uuucaaacguuaauuuugcuucucuuucuaaaaaaaaaaaaaaaaaagaaagagaagaaagaag

SEQ ID NO: 37031 - RNA, 64 nt, Homo Sapiens
uucaaacguuaauuuugcuucucuuucuaaaaaaaaaaaaaaaaaagaaagagaagaaagaagu

SEQ ID NO: 37032 - RNA, 64 nt, Homo Sapiens
ucaaacguuaauuuugcuucucuuucuaaaaaaaaaaaaaaaaaagaaagagaagaaagaagug

SEQ ID NO: 37033 - RNA, 64 nt, Homo Sapiens
caaacguuaauuuugcuucucuuucuaaaaaaaaaaaaaaaaaagaaagagaagaaagaaguga

SEQ ID NO: 37034 - RNA, 64 nt, Homo Sapiens
aaacguuaauuuugcuucucuuucuaaaaaaaaaaaaaaaaaagaaagagaagaaagaagugau

SEQ ID NO: 37035 - RNA, 64 nt, Homo Sapiens
aacguuaauuuugcuucucuuucuaaaaaaaaaaaaaaaaaagaaagagaagaaagaagugauu

SEQ ID NO: 37036 - RNA, 64 nt, Homo Sapiens
uggcugaauggaaagaaacguaaaaagcugugccaaaaaaaaagcaaaaugcugugauaaacca

SEQ ID NO: 37037 - RNA, 64 nt, Homo Sapiens
ggcugaauggaaagaaacguaaaaagcugugccaaaaaaaaagcaaaaugcugugauaaaccaa

SEQ ID NO: 37038 - RNA, 64 nt, Homo Sapiens
uaagaaggcagggcaggggggcuuuuuacaggagaaaaaaaaaugacuuauaagagaaagagcc

SEQ ID NO: 37039 - RNA, 64 nt, Homo Sapiens
aagaaggcagggcaggggggcuuuuuacaggagaaaaaaaaaugacuuauaagagaaagagccu

SEQ ID NO: 37040 - RNA, 64 nt, Homo Sapiens
gacuuauaagagaaagagccuggaguauuuuuggaaaaaaaaauaauauuuuuauguuaaaaca

SEQ ID NO: 37041 - RNA, 64 nt, Homo Sapiens
acuuauaagagaaagagccuggaguauuuuuggaaaaaaaaauaauauuuuuauguuaaaacaa

SEQ ID NO: 37042 - RNA, 64 nt, Homo Sapiens
uuuuuuaaccuuuuguuccgccauuuaaaaaaagaaaaaaaaaaagcuuauguuucuugucaaa

SEQ ID NO: 37043 - RNA, 64 nt, Homo Sapiens
uuuuuaaccuuuuguuccgccauuuaaaaaaagaaaaaaaaaaagcuuauguuucuugucaaau

SEQ ID NO: 37044 - RNA, 64 nt, Homo Sapiens
uuuuaaccuuuuguuccgccauuuaaaaaaagaaaaaaaaaaagcuuauguuucuugucaaaug

SEQ ID NO: 37045 - RNA, 64 nt, Homo Sapiens
uuuaaccuuuuguuccgccauuuaaaaaaagaaaaaaaaaaagcuuauguuucuugucaaaugc

SEQ ID NO: 37046 - RNA, 64 nt, Homo Sapiens
ccgccaccuguacucacccucacgcucuuugaagaaaaaaaaaaaaaucaccuuguguguugua

SEQ ID NO: 37047 - RNA, 64 nt, Homo Sapiens
cgccaccuguacucacccucacgcucuuugaagaaaaaaaaaaaaaucaccuuguguguuguag

SEQ ID NO: 37048 - RNA, 64 nt, Homo Sapiens
gccaccuguacucacccucacgcucuuugaagaaaaaaaaaaaaaucaccuuguguguuguagc

SEQ ID NO: 37049 - RNA, 64 nt, Homo Sapiens
ccaccuguacucacccucacgcucuuugaagaaaaaaaaaaaaaucaccuuguguguuguagcu

SEQ ID NO: 37050 - RNA, 64 nt, Homo Sapiens
caccuguacucacccucacgcucuuugaagaaaaaaaaaaaaaucaccuuguguguuguagcuc

SEQ ID NO: 37051 - RNA, 64 nt, Homo Sapiens
accuguacucacccucacgcucuuugaagaaaaaaaaaaaaaucaccuuguguguuguagcuca

SEQ ID NO: 37052 - RNA, 64 nt, Homo Sapiens
uauuugugcaaagcuauuaauauacacauuuuguaaaaaaaaaaaaaaaacacguauaucuaua

SEQ ID NO: 37053 - RNA, 64 nt, Homo Sapiens
auuugugcaaagcuauuaauauacacauuuuguaaaaaaaaaaaaaaaacacguauaucuauac

SEQ ID NO: 37054 - RNA, 64 nt, Homo Sapiens
uuugugcaaagcuauuaauauacacauuuuguaaaaaaaaaaaaaaaacacguauaucuauaca

SEQ ID NO: 37055 - RNA, 64 nt, Homo Sapiens
uugugcaaagcuauuaauauacacauuuuguaaaaaaaaaaaaaaaacacguauaucuauacau

SEQ ID NO: 37056 - RNA, 64 nt, Homo Sapiens
ugugcaaagcuauuaauauacacauuuuguaaaaaaaaaaaaaaaacacguauaucuauacaua

SEQ ID NO: 37057 - RNA, 64 nt, Homo Sapiens
gugcaaagcuauuaauauacacauuuuguaaaaaaaaaaaaaaaacacguauaucuauacauau

SEQ ID NO: 37058 - RNA, 64 nt, Homo Sapiens
ugcaaagcuauuaauauacacauuuuguaaaaaaaaaaaaaaaacacguauaucuauacauaua

SEQ ID NO: 37059 - RNA, 64 nt, Homo Sapiens
gcaaagcuauuaauauacacauuuuguaaaaaaaaaaaaaaaacacguauaucuauacauauau

SEQ ID NO: 37060 - RNA, 64 nt, Homo Sapiens
caaagcuauuaauauacacauuuuguaaaaaaaaaaaaaaaacacguauaucuauacauauaua

SEQ ID NO: 37061 - RNA, 64 nt, Homo Sapiens
gggucauggggguggguuuccuggcaccuacaugaaaaaaaagacaaguuauaugggugaugaa

SEQ ID NO: 37062 - RNA, 64 nt, Homo Sapiens
gugguuugaauucuggcuacauguuuuaaguaagaaaaaaaaagacguauuuuugcuuacucag

SEQ ID NO: 37063 - RNA, 64 nt, Homo Sapiens
ugguuugaauucuggcuacauguuuuaaguaagaaaaaaaaagacguauuuuugcuuacucaga

SEQ ID NO: 37064 - RNA, 64 nt, Homo Sapiens
uacaaaauacuagaguaucuagaagggugaaaacaaaaaaaaauaaaaagaaacacagacgccc

SEQ ID NO: 37065 - RNA, 64 nt, Homo Sapiens
acaaaauacuagaguaucuagaagggugaaaacaaaaaaaaauaaaaagaaacacagacgccca

SEQ ID NO: 37066 - RNA, 64 nt, Homo Sapiens
ugccauuccaccauagaagagcaauccuuuuaggaaaaaaaaaaucaugcuauuaauuaaucaa

SEQ ID NO: 37067 - RNA, 64 nt, Homo Sapiens
gccauuccaccauagaagagcaauccuuuuaggaaaaaaaaaaucaugcuauuaauuaaucaaa

SEQ ID NO: 37068 - RNA, 64 nt, Homo Sapiens
ccauuccaccauagaagagcaauccuuuuaggaaaaaaaaaaucaugcuauuaauuaaucaaau

SEQ ID NO: 37069 - RNA, 64 nt, Homo Sapiens
uugaaauuacuugaauuuucuugucuuaaaacugaaaaaaaaauguaguuacacguuaaaaucu

SEQ ID NO: 37070 - RNA, 64 nt, Homo Sapiens
ugaaauuacuugaauuuucuugucuuaaaacugaaaaaaaaauguaguuacacguuaaaaucug

SEQ ID NO: 37071 - RNA, 64 nt, Homo Sapiens
aaucugauugcuguuguuuuguuuguuuggaaagaaaaaaaaugucuggcuucuucuacuauuu

SEQ ID NO: 37072 - RNA, 64 nt, Homo Sapiens
aaaaauggugacaguuucauugugaaccccucucaaaaaaaauguaucagaaaaguuugauuac

SEQ ID NO: 37073 - RNA, 64 nt, Homo Sapiens
uauuguuuacaaauauauuucaugcaagaaacagaaaaaaaaaaaaacccuuugauucugguuc

SEQ ID NO: 37074 - RNA, 64 nt, Homo Sapiens
auuguuuacaaauauauuucaugcaagaaacagaaaaaaaaaaaaacccuuugauucugguuca

SEQ ID NO: 37075 - RNA, 64 nt, Homo Sapiens
uuguuuacaaauauauuucaugcaagaaacagaaaaaaaaaaaaacccuuugauucugguucau

SEQ ID NO: 37076 - RNA, 64 nt, Homo Sapiens
uguuuacaaauauauuucaugcaagaaacagaaaaaaaaaaaaacccuuugauucugguucauc

SEQ ID NO: 37077 - RNA, 64 nt, Homo Sapiens
guuuacaaauauauuucaugcaagaaacagaaaaaaaaaaaaacccuuugauucugguucaucu

SEQ ID NO: 37078 - RNA, 64 nt, Homo Sapiens
uuuacaaauauauuucaugcaagaaacagaaaaaaaaaaaaacccuuugauucugguucaucuc

SEQ ID NO: 37079 - RNA, 64 nt, Homo Sapiens
uuauucucacccgaaguauucacacaaucuuuuuaaaaaaaauuugaaauggcauuuuguauug

SEQ ID NO: 37080 - RNA, 64 nt, Homo Sapiens
agauauuaaaauuuggugcuuauaagagagaguuaaaaaaaaauaggauugcuucaauuaaaau

SEQ ID NO: 37081 - RNA, 64 nt, Homo Sapiens
gauauuaaaauuuggugcuuauaagagagaguuaaaaaaaaauaggauugcuucaauuaaaauu

SEQ ID NO: 37082 - RNA, 64 nt, Homo Sapiens
cagugcaacaaaugccagcauugccauucgggggaaaaaaaaaaaaaaaaaaaaaagaugagaa

SEQ ID NO: 37083 - RNA, 64 nt, Homo Sapiens
agugcaacaaaugccagcauugccauucgggggaaaaaaaaaaaaaaaaaaaaaagaugagaag

SEQ ID NO: 37084 - RNA, 64 nt, Homo Sapiens
gugcaacaaaugccagcauugccauucgggggaaaaaaaaaaaaaaaaaaaaaagaugagaaga

SEQ ID NO: 37085 - RNA, 64 nt, Homo Sapiens
ugcaacaaaugccagcauugccauucgggggaaaaaaaaaaaaaaaaaaaaaagaugagaagaa

SEQ ID NO: 37086 - RNA, 64 nt, Homo Sapiens
gcaacaaaugccagcauugccauucgggggaaaaaaaaaaaaaaaaaaaaaagaugagaagaac

SEQ ID NO: 37087 - RNA, 64 nt, Homo Sapiens
caacaaaugccagcauugccauucgggggaaaaaaaaaaaaaaaaaaaaaagaugagaagaaca

SEQ ID NO: 37088 - RNA, 64 nt, Homo Sapiens
aacaaaugccagcauugccauucgggggaaaaaaaaaaaaaaaaaaaaaagaugagaagaacac

SEQ ID NO: 37089 - RNA, 64 nt, Homo Sapiens
acaaaugccagcauugccauucgggggaaaaaaaaaaaaaaaaaaaaaagaugagaagaacacu

SEQ ID NO: 37090 - RNA, 64 nt, Homo Sapiens
caaaugccagcauugccauucgggggaaaaaaaaaaaaaaaaaaaaaagaugagaagaacacuu

SEQ ID NO: 37091 - RNA, 64 nt, Homo Sapiens
aaaugccagcauugccauucgggggaaaaaaaaaaaaaaaaaaaaaagaugagaagaacacuug

SEQ ID NO: 37092 - RNA, 64 nt, Homo Sapiens
aaugccagcauugccauucgggggaaaaaaaaaaaaaaaaaaaaaagaugagaagaacacuugu

SEQ ID NO: 37093 - RNA, 64 nt, Homo Sapiens
augccagcauugccauucgggggaaaaaaaaaaaaaaaaaaaaaagaugagaagaacacuuguu

SEQ ID NO: 37094 - RNA, 64 nt, Homo Sapiens
ugccagcauugccauucgggggaaaaaaaaaaaaaaaaaaaaaagaugagaagaacacuuguuc

SEQ ID NO: 37095 - RNA, 64 nt, Homo Sapiens
gccagcauugccauucgggggaaaaaaaaaaaaaaaaaaaaaagaugagaagaacacuuguuca

SEQ ID NO: 37096 - RNA, 64 nt, Homo Sapiens
ccagcauugccauucgggggaaaaaaaaaaaaaaaaaaaaaagaugagaagaacacuuguucau

SEQ ID NO: 37097 - RNA, 64 nt, Homo Sapiens
uggaauuagaauaagcauuuccuugaaaauguuuaaaaaaaaaaagucagcaguaaaauguaug

SEQ ID NO: 37098 - RNA, 64 nt, Homo Sapiens
ggaauuagaauaagcauuuccuugaaaauguuuaaaaaaaaaaagucagcaguaaaauguaugg

SEQ ID NO: 37099 - RNA, 64 nt, Homo Sapiens
gaauuagaauaagcauuuccuugaaaauguuuaaaaaaaaaaagucagcaguaaaauguauggc

SEQ ID NO: 37100 - RNA, 64 nt, Homo Sapiens
aauuagaauaagcauuuccuugaaaauguuuaaaaaaaaaaagucagcaguaaaauguauggca

SEQ ID NO: 37101 - RNA, 64 nt, Homo Sapiens
cuugcaauaaaguuggugggaccaggaaguagagaaaaaaaaaguaaaauguggucaauucuug

SEQ ID NO: 37102 - RNA, 64 nt, Homo Sapiens
uugcaauaaaguuggugggaccaggaaguagagaaaaaaaaaguaaaauguggucaauucuugc

SEQ ID NO: 37103 - RNA, 64 nt, Homo Sapiens
gugcuuuaaaguagauaguauacuuuacauuuauaaaaaaaaaucaaauuuuguucuuuauuuu

SEQ ID NO: 37104 - RNA, 64 nt, Homo Sapiens
ugcuuuaaaguagauaguauacuuuacauuuauaaaaaaaaaucaaauuuuguucuuuauuuug

SEQ ID NO: 37105 - RNA, 64 nt, Homo Sapiens
uuguggacaaauaaauuuguaaaguccgaggauuaaaaaaaaaaaaagguuaaaccgguuucuc

SEQ ID NO: 37106 - RNA, 64 nt, Homo Sapiens
uguggacaaauaaauuuguaaaguccgaggauuaaaaaaaaaaaaagguuaaaccgguuucucu

SEQ ID NO: 37107 - RNA, 64 nt, Homo Sapiens
guggacaaauaaauuuguaaaguccgaggauuaaaaaaaaaaaaagguuaaaccgguuucucua

SEQ ID NO: 37108 - RNA, 64 nt, Homo Sapiens
uggacaaauaaauuuguaaaguccgaggauuaaaaaaaaaaaaagguuaaaccgguuucucuac

SEQ ID NO: 37109 - RNA, 64 nt, Homo Sapiens
ggacaaauaaauuuguaaaguccgaggauuaaaaaaaaaaaaagguuaaaccgguuucucuacu

SEQ ID NO: 37110 - RNA, 64 nt, Homo Sapiens
gacaaauaaauuuguaaaguccgaggauuaaaaaaaaaaaaagguuaaaccgguuucucuacug

SEQ ID NO: 37111 - RNA, 64 nt, Homo Sapiens
ggauguuaauugagagcccuggguccugccacagaaaaaaaaaaaaaaaagcccucucugcaau

SEQ ID NO: 37112 - RNA, 64 nt, Homo Sapiens
gauguuaauugagagcccuggguccugccacagaaaaaaaaaaaaaaaagcccucucugcaauc

SEQ ID NO: 37113 - RNA, 64 nt, Homo Sapiens
auguuaauugagagcccuggguccugccacagaaaaaaaaaaaaaaaagcccucucugcaaucu

SEQ ID NO: 37114 - RNA, 64 nt, Homo Sapiens
uguuaauugagagcccuggguccugccacagaaaaaaaaaaaaaaaagcccucucugcaaucuc

SEQ ID NO: 37115 - RNA, 64 nt, Homo Sapiens
guuaauugagagcccuggguccugccacagaaaaaaaaaaaaaaaagcccucucugcaaucucg

SEQ ID NO: 37116 - RNA, 64 nt, Homo Sapiens
uuaauugagagcccuggguccugccacagaaaaaaaaaaaaaaaagcccucucugcaaucucgc

SEQ ID NO: 37117 - RNA, 64 nt, Homo Sapiens
uaauugagagcccuggguccugccacagaaaaaaaaaaaaaaaagcccucucugcaaucucgcu

SEQ ID NO: 37118 - RNA, 64 nt, Homo Sapiens
aauugagagcccuggguccugccacagaaaaaaaaaaaaaaaagcccucucugcaaucucgcuu

SEQ ID NO: 37119 - RNA, 64 nt, Homo Sapiens
auugagagcccuggguccugccacagaaaaaaaaaaaaaaaagcccucucugcaaucucgcuuc

SEQ ID NO: 37120 - RNA, 64 nt, Homo Sapiens
uacuccagccugggcaacagcgagacuccaucucaaaaaaaaaggaaauguguaucaagaacau

SEQ ID NO: 37121 - RNA, 64 nt, Homo Sapiens
acuccagccugggcaacagcgagacuccaucucaaaaaaaaaggaaauguguaucaagaacaug

SEQ ID NO: 37122 - RNA, 64 nt, Homo Sapiens
agcucugcuaguaagggauucgucuccccaaaugaaaaaaaaaaguaaucucagaauguuggcc

SEQ ID NO: 37123 - RNA, 64 nt, Homo Sapiens
gcucugcuaguaagggauucgucuccccaaaugaaaaaaaaaaguaaucucagaauguuggccg

SEQ ID NO: 37124 - RNA, 64 nt, Homo Sapiens
cucugcuaguaagggauucgucuccccaaaugaaaaaaaaaaguaaucucagaauguuggccga

SEQ ID NO: 37125 - RNA, 64 nt, Homo Sapiens
cucccagccaucguaaucacauuucuguaccuggaaaaaaaauguaucuuauuuuugauaaugg

SEQ ID NO: 37126 - RNA, 64 nt, Homo Sapiens
cuugugcacagagaaaaaugcauuaaaaaugacuaaaaaaaauaaaaaauuaaaaaauggauaa

SEQ ID NO: 37127 - RNA, 64 nt, Homo Sapiens
acccuuccacacacacacacacacacacacacacaaaaaaaaaucccuuccuugugggauucuu

SEQ ID NO: 37128 - RNA, 64 nt, Homo Sapiens
cccuuccacacacacacacacacacacacacacaaaaaaaaaucccuuccuugugggauucuug

SEQ ID NO: 37129 - RNA, 64 nt, Homo Sapiens
cuguugccauuuguguaaauacuagucuuuuuggaaaaaaaauaauguaaagauguuuuguaua

SEQ ID NO: 37130 - RNA, 64 nt, Homo Sapiens
cuuguugcuuuuuucuuagaaaaaaaugagaacuaaaaaaaaaaaauuaaccacauggagaaau

SEQ ID NO: 37131 - RNA, 64 nt, Homo Sapiens
uuguugcuuuuuucuuagaaaaaaaugagaacuaaaaaaaaaaaauuaaccacauggagaaaug

SEQ ID NO: 37132 - RNA, 64 nt, Homo Sapiens
uguugcuuuuuucuuagaaaaaaaugagaacuaaaaaaaaaaaauuaaccacauggagaaaugg

SEQ ID NO: 37133 - RNA, 64 nt, Homo Sapiens
guugcuuuuuucuuagaaaaaaaugagaacuaaaaaaaaaaaauuaaccacauggagaaauggg

SEQ ID NO: 37134 - RNA, 64 nt, Homo Sapiens
uugcuuuuuucuuagaaaaaaaugagaacuaaaaaaaaaaaauuaaccacauggagaaaugggu

SEQ ID NO: 37135 - RNA, 64 nt, Homo Sapiens
uuucucuuagagauuuucauuuuaguguaucuuuaaaaaaaaaucuuguguuaacuugccucca

SEQ ID NO: 37136 - RNA, 64 nt, Homo Sapiens
uucucuuagagauuuucauuuuaguguaucuuuaaaaaaaaaucuuguguuaacuugccuccau

SEQ ID NO: 37137 - RNA, 64 nt, Homo Sapiens
cuuuaauuaccauguuaaaggaggaaagagcuagaaaaaaaaaccucaaaaaaguuaaucauug

SEQ ID NO: 37138 - RNA, 64 nt, Homo Sapiens
uuuaauuaccauguuaaaggaggaaagagcuagaaaaaaaaaccucaaaaaaguuaaucauugg

SEQ ID NO: 37139 - RNA, 64 nt, Homo Sapiens
uaccugggccaggccaggaaagagacuauuuaagaaaaaaaaaaucaauuccuagccuggaucc

SEQ ID NO: 37140 - RNA, 64 nt, Homo Sapiens
accugggccaggccaggaaagagacuauuuaagaaaaaaaaaaucaauuccuagccuggauccc

SEQ ID NO: 37141 - RNA, 64 nt, Homo Sapiens
ccugggccaggccaggaaagagacuauuuaagaaaaaaaaaaucaauuccuagccuggauccca

SEQ ID NO: 37142 - RNA, 64 nt, Homo Sapiens
acugcugcuaaagugauuuuuuuuuuauuugaccaaaaaaaaaaaggcccaagaagaagaaaau

SEQ ID NO: 37143 - RNA, 64 nt, Homo Sapiens
cugcugcuaaagugauuuuuuuuuuauuugaccaaaaaaaaaaaggcccaagaagaagaaaaug

SEQ ID NO: 37144 - RNA, 64 nt, Homo Sapiens
ugcugcuaaagugauuuuuuuuuuauuugaccaaaaaaaaaaaggcccaagaagaagaaaauga

SEQ ID NO: 37145 - RNA, 64 nt, Homo Sapiens
gcugcuaaagugauuuuuuuuuuauuugaccaaaaaaaaaaaggcccaagaagaagaaaaugaa

SEQ ID NO: 37146 - RNA, 64 nt, Homo Sapiens
gggcugcauuugugcccaggucaggagcaaauugaaaaaaaaaauaaaguaauacaaaaaaauc

SEQ ID NO: 37147 - RNA, 64 nt, Homo Sapiens
ggcugcauuugugcccaggucaggagcaaauugaaaaaaaaaauaaaguaauacaaaaaaauca

SEQ ID NO: 37148 - RNA, 64 nt, Homo Sapiens
gcugcauuugugcccaggucaggagcaaauugaaaaaaaaaauaaaguaauacaaaaaaaucaa

SEQ ID NO: 37149 - RNA, 64 nt, Homo Sapiens
cugcugaauuugugccccuggauuggaagcaaauaaaaaaaaaaaacaacacauaaacuaaacc

SEQ ID NO: 37150 - RNA, 64 nt, Homo Sapiens
ugcugaauuugugccccuggauuggaagcaaauaaaaaaaaaaaacaacacauaaacuaaacca

SEQ ID NO: 37151 - RNA, 64 nt, Homo Sapiens
gcugaauuugugccccuggauuggaagcaaauaaaaaaaaaaaacaacacauaaacuaaaccaa

SEQ ID NO: 37152 - RNA, 63 nt, Homo Sapiens
cugaauuugugccccuggauuggaagcaaauaaaaaaaaaaaacaacacauaaacuaaaccaa

SEQ ID NO: 37153 - RNA, 62 nt, Homo Sapiens
ugaauuugugccccuggauuggaagcaaauaaaaaaaaaaaacaacacauaaacuaaaccaa

SEQ ID NO: 37154 - RNA, 64 nt, Homo Sapiens
augcacaguaaauaugugaauuuuuccuagauguaaaaaaaaaaaucuuucauauaaagaccuu

SEQ ID NO: 37155 - RNA, 64 nt, Homo Sapiens
ugcacaguaaauaugugaauuuuuccuagauguaaaaaaaaaaaucuuucauauaaagaccuua

SEQ ID NO: 37156 - RNA, 64 nt, Homo Sapiens
gcacaguaaauaugugaauuuuuccuagauguaaaaaaaaaaaucuuucauauaaagaccuuaa

SEQ ID NO: 37157 - RNA, 64 nt, Homo Sapiens
cacaguaaauaugugaauuuuuccuagauguaaaaaaaaaaaucuuucauauaaagaccuuaaa

SEQ ID NO: 37158 - RNA, 64 nt, Homo Sapiens
uccaguagaaaauguuaggauaugugugcuauauaaaaaaaaaaaaagacuuguuaaguuuuaa

SEQ ID NO: 37159 - RNA, 64 nt, Homo Sapiens
ccaguagaaaauguuaggauaugugugcuauauaaaaaaaaaaaaagacuuguuaaguuuuaaa

SEQ ID NO: 37160 - RNA, 64 nt, Homo Sapiens
caguagaaaauguuaggauaugugugcuauauaaaaaaaaaaaaagacuuguuaaguuuuaaaa

SEQ ID NO: 37161 - RNA, 64 nt, Homo Sapiens
aguagaaaauguuaggauaugugugcuauauaaaaaaaaaaaaagacuuguuaaguuuuaaaau

SEQ ID NO: 37162 - RNA, 64 nt, Homo Sapiens
guagaaaauguuaggauaugugugcuauauaaaaaaaaaaaaagacuuguuaaguuuuaaaaua

SEQ ID NO: 37163 - RNA, 64 nt, Homo Sapiens
uagaaaauguuaggauaugugugcuauauaaaaaaaaaaaaagacuuguuaaguuuuaaaauaa

SEQ ID NO: 37164 - RNA, 64 nt, Homo Sapiens
acaguuuccuucuggaguuccaaaugcaauauagaaaaaaaaacccugugacucuggauuuuau

SEQ ID NO: 37165 - RNA, 64 nt, Homo Sapiens
caguuuccuucuggaguuccaaaugcaauauagaaaaaaaaacccugugacucuggauuuuauu

SEQ ID NO: 37166 - RNA, 64 nt, Homo Sapiens
agacuccuaccuugagaucuuagucuagguaaagaaaaaaaaaaaaaggucaugaaacacaaau

SEQ ID NO: 37167 - RNA, 64 nt, Homo Sapiens
gacuccuaccuugagaucuuagucuagguaaagaaaaaaaaaaaaaggucaugaaacacaaaug

SEQ ID NO: 37168 - RNA, 64 nt, Homo Sapiens
acuccuaccuugagaucuuagucuagguaaagaaaaaaaaaaaaaggucaugaaacacaaaugu

SEQ ID NO: 37169 - RNA, 64 nt, Homo Sapiens
cuccuaccuugagaucuuagucuagguaaagaaaaaaaaaaaaaggucaugaaacacaaauguc

SEQ ID NO: 37170 - RNA, 64 nt, Homo Sapiens
uccuaccuugagaucuuagucuagguaaagaaaaaaaaaaaaaggucaugaaacacaaaugucc

SEQ ID NO: 37171 - RNA, 64 nt, Homo Sapiens
ccuaccuugagaucuuagucuagguaaagaaaaaaaaaaaaaggucaugaaacacaaauguccu

SEQ ID NO: 37172 - RNA, 64 nt, Homo Sapiens
auucacaaguuuuuuuuugaagugaauucuuuugaaaaaaaaaugcaaaacuagaaaacuuuau

SEQ ID NO: 37173 - RNA, 64 nt, Homo Sapiens
uucacaaguuuuuuuuugaagugaauucuuuugaaaaaaaaaugcaaaacuagaaaacuuuauu

SEQ ID NO: 37174 - RNA, 64 nt, Homo Sapiens
augguuuucuuuaugucuuggcugcuugaaaauuaaaaaaaaaaaagguuuguucaauauugcc

SEQ ID NO: 37175 - RNA, 64 nt, Homo Sapiens
ugguuuucuuuaugucuuggcugcuugaaaauuaaaaaaaaaaaagguuuguucaauauugccg

SEQ ID NO: 37176 - RNA, 64 nt, Homo Sapiens
gguuuucuuuaugucuuggcugcuugaaaauuaaaaaaaaaaaagguuuguucaauauugccgu

SEQ ID NO: 37177 - RNA, 64 nt, Homo Sapiens
guuuucuuuaugucuuggcugcuugaaaauuaaaaaaaaaaaagguuuguucaauauugccguu

SEQ ID NO: 37178 - RNA, 64 nt, Homo Sapiens
uuuucuuuaugucuuggcugcuugaaaauuaaaaaaaaaaaagguuuguucaauauugccguua

SEQ ID NO: 37179 - RNA, 64 nt, Homo Sapiens
auuuugaccuguugacuuuuuaggaaguaggacuaaaaaaaaaaaucucaaguggcauucuuug

SEQ ID NO: 37180 - RNA, 64 nt, Homo Sapiens
uuuugaccuguugacuuuuuaggaaguaggacuaaaaaaaaaaaucucaaguggcauucuuugu

SEQ ID NO: 37181 - RNA, 64 nt, Homo Sapiens
uuugaccuguugacuuuuuaggaaguaggacuaaaaaaaaaaaucucaaguggcauucuuuguc

SEQ ID NO: 37182 - RNA, 64 nt, Homo Sapiens
uugaccuguugacuuuuuaggaaguaggacuaaaaaaaaaaaucucaaguggcauucuuuguca

SEQ ID NO: 37183 - RNA, 64 nt, Homo Sapiens
uuuagagcaaucccacaugcuuuucacaaacauuaaaaaaaaaaaccuuucagggucuuucaug

SEQ ID NO: 37184 - RNA, 64 nt, Homo Sapiens
uuagagcaaucccacaugcuuuucacaaacauuaaaaaaaaaaaccuuucagggucuuucauga

SEQ ID NO: 37185 - RNA, 64 nt, Homo Sapiens
uagagcaaucccacaugcuuuucacaaacauuaaaaaaaaaaaccuuucagggucuuucaugaa

SEQ ID NO: 37186 - RNA, 64 nt, Homo Sapiens
agagcaaucccacaugcuuuucacaaacauuaaaaaaaaaaaccuuucagggucuuucaugaag

SEQ ID NO: 37187 - RNA, 64 nt, Homo Sapiens
uccuuuuguccacuuauauaguuauuuucucuuuaaaaaaaaauuuuuuuuaauguauuagaga

SEQ ID NO: 37188 - RNA, 64 nt, Homo Sapiens
ccuuuuguccacuuauauaguuauuuucucuuuaaaaaaaaauuuuuuuuaauguauuagagau

SEQ ID NO: 37189 - RNA, 64 nt, Homo Sapiens
agauacuaacaacuuaaacuuacuacuuuaggagaaaaaaaaaaacauucaauuucggacacug

SEQ ID NO: 37190 - RNA, 64 nt, Homo Sapiens
gauacuaacaacuuaaacuuacuacuuuaggagaaaaaaaaaaacauucaauuucggacacuga

SEQ ID NO: 37191 - RNA, 64 nt, Homo Sapiens
auacuaacaacuuaaacuuacuacuuuaggagaaaaaaaaaaacauucaauuucggacacugag

SEQ ID NO: 37192 - RNA, 64 nt, Homo Sapiens
uacuaacaacuuaaacuuacuacuuuaggagaaaaaaaaaaacauucaauuucggacacugagu

SEQ ID NO: 37193 - RNA, 64 nt, Homo Sapiens
uucagucuuuuccuguuuuuguuaacuuuggguuaaaaaaaaaaaaagucugauugguuuuaau

SEQ ID NO: 37194 - RNA, 64 nt, Homo Sapiens
ucagucuuuuccuguuuuuguuaacuuuggguuaaaaaaaaaaaaagucugauugguuuuaauu

SEQ ID NO: 37195 - RNA, 64 nt, Homo Sapiens
cagucuuuuccuguuuuuguuaacuuuggguuaaaaaaaaaaaaagucugauugguuuuaauug

SEQ ID NO: 37196 - RNA, 64 nt, Homo Sapiens
agucuuuuccuguuuuuguuaacuuuggguuaaaaaaaaaaaaagucugauugguuuuaauuga

SEQ ID NO: 37197 - RNA, 64 nt, Homo Sapiens
gucuuuuccuguuuuuguuaacuuuggguuaaaaaaaaaaaaagucugauugguuuuaauugaa

SEQ ID NO: 37198 - RNA, 64 nt, Homo Sapiens
ucuuuuccuguuuuuguuaacuuuggguuaaaaaaaaaaaaagucugauugguuuuaauugaag

SEQ ID NO: 37199 - RNA, 64 nt, Homo Sapiens
ccauuuagagauaaugggcuuuguuagcacuuucaaaaaaaaaaaaagcaaaccauacuugucc

SEQ ID NO: 37200 - RNA, 64 nt, Homo Sapiens
cauuuagagauaaugggcuuuguuagcacuuucaaaaaaaaaaaaagcaaaccauacuugucca

SEQ ID NO: 37201 - RNA, 64 nt, Homo Sapiens
auuuagagauaaugggcuuuguuagcacuuucaaaaaaaaaaaaagcaaaccauacuuguccac

SEQ ID NO: 37202 - RNA, 64 nt, Homo Sapiens
uuuagagauaaugggcuuuguuagcacuuucaaaaaaaaaaaaagcaaaccauacuuguccacu

SEQ ID NO: 37203 - RNA, 64 nt, Homo Sapiens
uuagagauaaugggcuuuguuagcacuuucaaaaaaaaaaaaagcaaaccauacuuguccacug

SEQ ID NO: 37204 - RNA, 64 nt, Homo Sapiens
uagagauaaugggcuuuguuagcacuuucaaaaaaaaaaaaagcaaaccauacuuguccacugu

SEQ ID NO: 37205 - RNA, 64 nt, Homo Sapiens
aaggcagccugggacauuuaaaaaaauaaaaaugaaaaaaaaacccagaacccauuucucaggg

SEQ ID NO: 37206 - RNA, 64 nt, Homo Sapiens
aggcagccugggacauuuaaaaaaauaaaaaugaaaaaaaaacccagaacccauuucucagggc

SEQ ID NO: 37207 - RNA, 64 nt, Homo Sapiens
auguuuuucacuugcauugucauuagauguccagaaaaaaaaaagaugucaaaauguuuuucua

SEQ ID NO: 37208 - RNA, 64 nt, Homo Sapiens
uguuuuucacuugcauugucauuagauguccagaaaaaaaaaagaugucaaaauguuuuucuaa

SEQ ID NO: 37209 - RNA, 64 nt, Homo Sapiens
guuuuucacuugcauugucauuagauguccagaaaaaaaaaagaugucaaaauguuuuucuaaa

SEQ ID NO: 37210 - RNA, 64 nt, Homo Sapiens
auuaaggacuacagaauugggcccuuagaaugugaaaaaaaaaaguaauuaaaaagacacuuuu

SEQ ID NO: 37211 - RNA, 64 nt, Homo Sapiens
uuaaggacuacagaauugggcccuuagaaugugaaaaaaaaaaguaauuaaaaagacacuuuua

SEQ ID NO: 37212 - RNA, 64 nt, Homo Sapiens
uaaggacuacagaauugggcccuuagaaugugaaaaaaaaaaguaauuaaaaagacacuuuuac

SEQ ID NO: 37213 - RNA, 64 nt, Homo Sapiens
uucuuuauccaugagcaccaggcuuugcucacuuaaaaaaaaauuaagccacauuaaggaguga

SEQ ID NO: 37214 - RNA, 64 nt, Homo Sapiens
ucuuuauccaugagcaccaggcuuugcucacuuaaaaaaaaauuaagccacauuaaggagugag

SEQ ID NO: 37215 - RNA, 64 nt, Homo Sapiens
cuuccaaaucuaacuuugcacaaguaacccauguaaaaaaaaauguacauuuuucaaaaguugu

SEQ ID NO: 37216 - RNA, 64 nt, Homo Sapiens
uuccaaaucuaacuuugcacaaguaacccauguaaaaaaaaauguacauuuuucaaaaguugua

SEQ ID NO: 37217 - RNA, 64 nt, Homo Sapiens
ccucccaaccaggcuaauaaccuaacacauguuuaaaaaaaaucugccuaagccggguguggug

SEQ ID NO: 37218 - RNA, 64 nt, Homo Sapiens
gccugggugacagagugagauccugucucugaagaaaaaaaaaaccugccuggcaagguccuuc

SEQ ID NO: 37219 - RNA, 64 nt, Homo Sapiens
ccugggugacagagugagauccugucucugaagaaaaaaaaaaccugccuggcaagguccuucc

SEQ ID NO: 37220 - RNA, 64 nt, Homo Sapiens
cugggugacagagugagauccugucucugaagaaaaaaaaaaccugccuggcaagguccuuccc

SEQ ID NO: 37221 - RNA, 64 nt, Homo Sapiens
acaccuccaccagggggaaggcuggcacaaggagaaaaaaaaagcaagcaucagcgaauaguau

SEQ ID NO: 37222 - RNA, 64 nt, Homo Sapiens
caccuccaccagggggaaggcuggcacaaggagaaaaaaaaagcaagcaucagcgaauaguaua

SEQ ID NO: 37223 - RNA, 64 nt, Homo Sapiens
gauugaauuccauuagcauuugcuaccaaguaggaaaaaaaauguacauggcaguguuuuaguu

SEQ ID NO: 37224 - RNA, 64 nt, Homo Sapiens
cuccagccugggcaacagagcaagacucugucucaaaaaaaaaaaaaaaagaaauaagaaaaug

SEQ ID NO: 37225 - RNA, 64 nt, Homo Sapiens
uccagccugggcaacagagcaagacucugucucaaaaaaaaaaaaaaaagaaauaagaaaaugg

SEQ ID NO: 37226 - RNA, 64 nt, Homo Sapiens
ccagccugggcaacagagcaagacucugucucaaaaaaaaaaaaaaaagaaauaagaaaauggg

SEQ ID NO: 37227 - RNA, 64 nt, Homo Sapiens
cagccugggcaacagagcaagacucugucucaaaaaaaaaaaaaaaagaaauaagaaaauggga

SEQ ID NO: 37228 - RNA, 64 nt, Homo Sapiens
agccugggcaacagagcaagacucugucucaaaaaaaaaaaaaaaagaaauaagaaaaugggaa

SEQ ID NO: 37229 - RNA, 64 nt, Homo Sapiens
gccugggcaacagagcaagacucugucucaaaaaaaaaaaaaaaagaaauaagaaaaugggaag

SEQ ID NO: 37230 - RNA, 64 nt, Homo Sapiens
ccugggcaacagagcaagacucugucucaaaaaaaaaaaaaaaagaaauaagaaaaugggaagc

SEQ ID NO: 37231 - RNA, 64 nt, Homo Sapiens
cugggcaacagagcaagacucugucucaaaaaaaaaaaaaaaagaaauaagaaaaugggaagca

SEQ ID NO: 37232 - RNA, 64 nt, Homo Sapiens
ugggcaacagagcaagacucugucucaaaaaaaaaaaaaaaagaaauaagaaaaugggaagcaa

SEQ ID NO: 37233 - RNA, 64 nt, Homo Sapiens
uggcuuuugaaucgauuauuucaugcuuuuuuuuaaaaaaaaaaaaaaacaaaauaacaaucug

SEQ ID NO: 37234 - RNA, 64 nt, Homo Sapiens
ggcuuuugaaucgauuauuucaugcuuuuuuuuaaaaaaaaaaaaaaacaaaauaacaaucuga

SEQ ID NO: 37235 - RNA, 64 nt, Homo Sapiens
gcuuuugaaucgauuauuucaugcuuuuuuuuaaaaaaaaaaaaaaacaaaauaacaaucugaa

SEQ ID NO: 37236 - RNA, 64 nt, Homo Sapiens
cuuuugaaucgauuauuucaugcuuuuuuuuaaaaaaaaaaaaaaacaaaauaacaaucugaag

SEQ ID NO: 37237 - RNA, 64 nt, Homo Sapiens
uuuugaaucgauuauuucaugcuuuuuuuuaaaaaaaaaaaaaaacaaaauaacaaucugaaga

SEQ ID NO: 37238 - RNA, 64 nt, Homo Sapiens
uuugaaucgauuauuucaugcuuuuuuuuaaaaaaaaaaaaaaacaaaauaacaaucugaagag

SEQ ID NO: 37239 - RNA, 64 nt, Homo Sapiens
uugaaucgauuauuucaugcuuuuuuuuaaaaaaaaaaaaaaacaaaauaacaaucugaagagg

SEQ ID NO: 37240 - RNA, 64 nt, Homo Sapiens
ugaaucgauuauuucaugcuuuuuuuuaaaaaaaaaaaaaaacaaaauaacaaucugaagaggc

SEQ ID NO: 37241 - RNA, 64 nt, Homo Sapiens
guaaauuaucaagcuucaaaaagcuuuuuuuuuuaaaaaaaaacaugcauauucuaaaaaugac

SEQ ID NO: 37242 - RNA, 64 nt, Homo Sapiens
uaaauuaucaagcuucaaaaagcuuuuuuuuuuaaaaaaaaacaugcauauucuaaaaaugacu

SEQ ID NO: 37243 - RNA, 64 nt, Homo Sapiens
ccaugauuuuauuauaauuuugacacuagacaagaaaaaaaaauauuauuugucuuuccugccc

SEQ ID NO: 37244 - RNA, 64 nt, Homo Sapiens
caugauuuuauuauaauuuugacacuagacaagaaaaaaaaauauuauuugucuuuccugcccc

SEQ ID NO: 37245 - RNA, 64 nt, Homo Sapiens
agucugcucaaaguuuucaacauaaagaauaaagaaaaaaaaaugccaaagugcuuuucaaucu

SEQ ID NO: 37246 - RNA, 64 nt, Homo Sapiens
gucugcucaaaguuuucaacauaaagaauaaagaaaaaaaaaugccaaagugcuuuucaaucua

SEQ ID NO: 37247 - RNA, 64 nt, Homo Sapiens
ccaugcaggggcaaucagaucagcaucuucaugcaaaaaaaaaaaaaaaguugagugcucugca

SEQ ID NO: 37248 - RNA, 64 nt, Homo Sapiens
caugcaggggcaaucagaucagcaucuucaugcaaaaaaaaaaaaaaaguugagugcucugcag

SEQ ID NO: 37249 - RNA, 64 nt, Homo Sapiens
augcaggggcaaucagaucagcaucuucaugcaaaaaaaaaaaaaaaguugagugcucugcagg

SEQ ID NO: 37250 - RNA, 64 nt, Homo Sapiens
ugcaggggcaaucagaucagcaucuucaugcaaaaaaaaaaaaaaaguugagugcucugcaggc

SEQ ID NO: 37251 - RNA, 64 nt, Homo Sapiens
gcaggggcaaucagaucagcaucuucaugcaaaaaaaaaaaaaaaguugagugcucugcaggcc

SEQ ID NO: 37252 - RNA, 64 nt, Homo Sapiens
caggggcaaucagaucagcaucuucaugcaaaaaaaaaaaaaaaguugagugcucugcaggccu

SEQ ID NO: 37253 - RNA, 64 nt, Homo Sapiens
aggggcaaucagaucagcaucuucaugcaaaaaaaaaaaaaaaguugagugcucugcaggccug

SEQ ID NO: 37254 - RNA, 64 nt, Homo Sapiens
ggggcaaucagaucagcaucuucaugcaaaaaaaaaaaaaaaguugagugcucugcaggccugu

SEQ ID NO: 37255 - RNA, 64 nt, Homo Sapiens
cuaacuuaaagaauagaccaaaauuucuguguauaaaaaaaaaugaaaggcuccuuacauccug

SEQ ID NO: 37256 - RNA, 64 nt, Homo Sapiens
uaacuuaaagaauagaccaaaauuucuguguauaaaaaaaaaugaaaggcuccuuacauccugg

SEQ ID NO: 37257 - RNA, 64 nt, Homo Sapiens
cuccaaccuguguaacagagugaggccucaucucaaaaaaaaaaaaaggccacaaaacucaaca

SEQ ID NO: 37258 - RNA, 64 nt, Homo Sapiens
uccaaccuguguaacagagugaggccucaucucaaaaaaaaaaaaaggccacaaaacucaacaa

SEQ ID NO: 37259 - RNA, 64 nt, Homo Sapiens
ccaaccuguguaacagagugaggccucaucucaaaaaaaaaaaaaggccacaaaacucaacaau

SEQ ID NO: 37260 - RNA, 64 nt, Homo Sapiens
caaccuguguaacagagugaggccucaucucaaaaaaaaaaaaaggccacaaaacucaacaaua

SEQ ID NO: 37261 - RNA, 64 nt, Homo Sapiens
aaccuguguaacagagugaggccucaucucaaaaaaaaaaaaaggccacaaaacucaacaauaa

SEQ ID NO: 37262 - RNA, 64 nt, Homo Sapiens
accuguguaacagagugaggccucaucucaaaaaaaaaaaaaggccacaaaacucaacaauaaa

SEQ ID NO: 37263 - RNA, 64 nt, Homo Sapiens
aacuugguuguaccucagggguauuauggugaacaaaaaaaaaaccagucucaaauggucacau

SEQ ID NO: 37264 - RNA, 64 nt, Homo Sapiens
acuugguuguaccucagggguauuauggugaacaaaaaaaaaaccagucucaaauggucacaua

SEQ ID NO: 37265 - RNA, 64 nt, Homo Sapiens
cuugguuguaccucagggguauuauggugaacaaaaaaaaaaccagucucaaauggucacauac

SEQ ID NO: 37266 - RNA, 64 nt, Homo Sapiens
aauaaaagacgaagaauaggacccugucuccaaaaaaaaaaagaagccugggccacauagcaag

SEQ ID NO: 37267 - RNA, 64 nt, Homo Sapiens
aaauaaaagacgaagaauaggacccugucuccaaaaaaaaaaagcagccugggccacauagcaa

SEQ ID NO: 37268 - RNA, 64 nt, Homo Sapiens
gaaauaaaagacgaagaauaagacccugucuccaaaaaaaaaaaccagccugggccacauagca

SEQ ID NO: 37269 - RNA, 64 nt, Homo Sapiens
agaaauaaaagacgaagaauaagacccugucuccaaaaaaaaaauccagccugggccacauagc

SEQ ID NO: 37270 - RNA, 64 nt, Homo Sapiens
accaguggaacuaaacaguuaaucacuguccauuaaaaaaaaucaaaaacaccaaaucauuuga

SEQ ID NO: 37271 - RNA, 64 nt, Homo Sapiens
caaauagcugacccggguggcaaaacauaaaaauaaaaaaaauacacagagcaagacuccgucu

SEQ ID NO: 37272 - RNA, 64 nt, Homo Sapiens
uguuaaaacagugaaauuaccccaucucuauauaaaaaaaaagaccugggcagcauagcgagac

SEQ ID NO: 37273 - RNA, 64 nt, Homo Sapiens
auguuaaaacagugaaauuaccccaucucuauauaaaaaaaaagaccugggcagcauagcgaga

SEQ ID NO: 37274 - RNA, 64 nt, Homo Sapiens
aggcaauggcuuugugcuuucaaaaaaaaaaaaaaaaaaaaagaugacagagugagacccuguc

SEQ ID NO: 37275 - RNA, 64 nt, Homo Sapiens
aaggcaauggcuuugugcuuccaaaaaaaaaaaaaaaaaaaaaggugacagagugagacccugu

SEQ ID NO: 37276 - RNA, 64 nt, Homo Sapiens
gaaggcaauggcuuugugcuuccaaaaaaaaaaaaaaaaaaaaaggugacagagugagacccug

SEQ ID NO: 37277 - RNA, 64 nt, Homo Sapiens
agaaggcaauggcuuugugcguccaaaaaaaaaaaaaaaaaaaagggugacagagugagacccu

SEQ ID NO: 37278 - RNA, 64 nt, Homo Sapiens
aagaaggcaauggcuuuguguguccaaaaaaaaaaaaaaaaaaaugggugacagagugagaccc

SEQ ID NO: 37279 - RNA, 64 nt, Homo Sapiens
aaagaaggcaauggcuuugucuguccaaaaaaaaaaaaaaaaaacugggugacagagugagacc

SEQ ID NO: 37280 - RNA, 64 nt, Homo Sapiens
aaaagaaggcaauggcuuugccuguccaaaaaaaaaaaaaaaaaccugggugacagagugagac

SEQ ID NO: 37281 - RNA, 64 nt, Homo Sapiens
aaaaagaaggcaauggcuuucccuguccaaaaaaaaaaaaaaaagccugggugacagagugaga

SEQ ID NO: 37282 - RNA, 64 nt, Homo Sapiens
aaaaaagaaggcaauggcuuacccuguccaaaaaaaaaaaaaaaagccugggugacagagugag

SEQ ID NO: 37283 - RNA, 64 nt, Homo Sapiens
aaaaaaagaaggcaauggcugacccuguccaaaaaaaaaaaaaacagccugggugacagaguga

SEQ ID NO: 37284 - RNA, 64 nt, Homo Sapiens
aaaaaaaagaaggcaauggcagacccuguccaaaaaaaaaaaaaccagccugggugacagagug

SEQ ID NO: 37285 - RNA, 64 nt, Homo Sapiens
aaaaaaaaagaaggcaaugggagacccuguccaaaaaaaaaaaauccagccugggugacagagu

SEQ ID NO: 37286 - RNA, 64 nt, Homo Sapiens
aaaaaaaaaagaaggcaaugugagacccuguccaaaaaaaaaaauuccagccugggugacagag

SEQ ID NO: 37287 - RNA, 64 nt, Homo Sapiens
aaaaaaaaaaagaaggcaaugugagacccuguccaaaaaaaaaaauuccagccugggugacaga

SEQ ID NO: 37288 - RNA, 64 nt, Homo Sapiens
aucucacaugcauuuuauagauguugcaugcauuaaaaaaaaucggggacaacaucugaagggu

SEQ ID NO: 37289 - RNA, 64 nt, Homo Sapiens
cuguccuaggcuuuuacucuaaaaaaguaagaaaaaaaaaaaucgaaaaaagaaaaaaaaugag

SEQ ID NO: 37290 - RNA, 64 nt, Homo Sapiens
ccuguccuaggcuuuuacucgaaaaaaguaagaaaaaaaaaaauagaaaaaagaaaaaaaauga

SEQ ID NO: 37291 - RNA, 64 nt, Homo Sapiens
uccuguccuaggcuuuuacuagaaaaaaguaagaaaaaaaaaaagagaaaaaagaaaaaaaaug

SEQ ID NO: 37292 - RNA, 64 nt, Homo Sapiens
auccuguccuaggcuuuuacgagaaaaaaguaagaaaaaaaaaaagagaaaaaagaaaaaaaau

SEQ ID NO: 37293 - RNA, 64 nt, Homo Sapiens
agaaaaaaguaagaaaaaaaaaaagagaaaaaagaaaaaaaaugaauauacuugcuaucuauaa

SEQ ID NO: 37294 - RNA, 64 nt, Homo Sapiens
acuucacuuauauuaagcaaaaaggaacuuuuaaaaaaaaaaucauauucacaaagagaaaaca

SEQ ID NO: 37295 - RNA, 64 nt, Homo Sapiens
cacuucacuuauauuaagcaaaaaggaacuuuuaaaaaaaaaauuauauucacaaagagaaaac

SEQ ID NO: 37296 - RNA, 64 nt, Homo Sapiens
ucacuucacuuauauuaagccaaaaggaacuuuuaaaaaaaaaaauauauucacaaagagaaaa

SEQ ID NO: 37297 - RNA, 64 nt, Homo Sapiens
cauuuuacacagcaccacaguucccagguguuaaaaaaaaaaucaaguugcugucacuguuuuu

SEQ ID NO: 37298 - RNA, 64 nt, Homo Sapiens
ccauuuuacacagcaccacauuucccagguguuaaaaaaaaaaucaaguugcugucacuguuuu

SEQ ID NO: 37299 - RNA, 64 nt, Homo Sapiens
uccauuuuacacagcaccacuuuucccagguguuaaaaaaaaaaccaaguugcugucacuguuu

SEQ ID NO: 37300 - RNA, 64 nt, Homo Sapiens
gaauugacaugucacauauccauauguaaaaaaaaaaaaaaaggagacuagugcagcauuucag

SEQ ID NO: 37301 - RNA, 64 nt, Homo Sapiens
ggaauugacaugucacauaugcauauguaaaaaaaaaaaaaaagaagacuagugcagcauuuca

SEQ ID NO: 37302 - RNA, 64 nt, Homo Sapiens
gggaauugacaugucacauaagcauauguaaaaaaaaaaaaaaaaaagacuagugcagcauuuc

SEQ ID NO: 37303 - RNA, 64 nt, Homo Sapiens
agggaauugacaugucacaucagcauauguaaaaaaaaaaaaaacaaagacuagugcagcauuu

SEQ ID NO: 37304 - RNA, 64 nt, Homo Sapiens
aagggaauugacaugucacaucagcauauguaaaaaaaaaaaaaccaaagacuagugcagcauu

SEQ ID NO: 37305 - RNA, 64 nt, Homo Sapiens
aaagggaauugacaugucacuucagcauauguaaaaaaaaaaaaaccaaagacuagugcagcau

SEQ ID NO: 37306 - RNA, 64 nt, Homo Sapiens
aaaagggaauugacaugucauuucagcauauguaaaaaaaaaaaaaccaaagacuagugcagca

SEQ ID NO: 37307 - RNA, 64 nt, Homo Sapiens
aaaaagggaauugacaugucauuucagcauauguaaaaaaaaaaaaaccaaagacuagugcagc

SEQ ID NO: 37308 - RNA, 64 nt, Homo Sapiens
ugccacuuauccaaguccacauuaaaaauuaaaaaaaaaaaaucagcuaccaugauucaaaaaa

SEQ ID NO: 37309 - RNA, 64 nt, Homo Sapiens
cugccacuuauccaaguccaaauuaaaaauuaaaaaaaaaaaaucagcuaccaugauucaaaaa

SEQ ID NO: 37310 - RNA, 64 nt, Homo Sapiens
ucugccacuuauccaaguccaaauuaaaaauuaaaaaaaaaaaagcagcuaccaugauucaaaa

SEQ ID NO: 37311 - RNA, 64 nt, Homo Sapiens
aucugccacuuauccaagucaaaauuaaaaauuaaaaaaaaaaaugcagcuaccaugauucaaa

SEQ ID NO: 37312 - RNA, 64 nt, Homo Sapiens
aaucugccacuuauccaaguaaaaauuaaaaauuaaaaaaaaaaaugcagcuaccaugauucaa

SEQ ID NO: 37313 - RNA, 64 nt, Homo Sapiens
caagauuucauuguuuguugauuuguguaaaaaaaaaaaaaagcguguggcuaaauaaccaaac

SEQ ID NO: 37314 - RNA, 64 nt, Homo Sapiens
ccaagauuucauuguuuguucauuuguguaaaaaaaaaaaaaagaguguggcuaaauaaccaaa

SEQ ID NO: 37315 - RNA, 64 nt, Homo Sapiens
gccaagauuucauuguuuguacauuuguguaaaaaaaaaaaaaauaguguggcuaaauaaccaa

SEQ ID NO: 37316 - RNA, 64 nt, Homo Sapiens
agccaagauuucauuguuugaacauuuguguaaaaaaaaaaaaacuaguguggcuaaauaacca

SEQ ID NO: 37317 - RNA, 64 nt, Homo Sapiens
aagccaagauuucauuguuuaaacauuuguguaaaaaaaaaaaaacuaguguggcuaaauaacc

SEQ ID NO: 37318 - RNA, 64 nt, Homo Sapiens
aaagccaagauuucauuguucaaacauuuguguaaaaaaaaaaacacuaguguggcuaaauaac

SEQ ID NO: 37319 - RNA, 64 nt, Homo Sapiens
aaaagccaagauuucauuguccaaacauuuguguaaaaaaaaaaucacuaguguggcuaaauaa

SEQ ID NO: 37320 - RNA, 64 nt, Homo Sapiens
uuuccaaaaugccguuuucauaaacauaaaaaaaaaaaaaaagaauagucguauuuugccaccg

SEQ ID NO: 37321 - RNA, 64 nt, Homo Sapiens
auuuccaaaaugccguuuucguaaacauaaaaaaaaaaaaaaagcauagucguauuuugccacc

SEQ ID NO: 37322 - RNA, 64 nt, Homo Sapiens
gauuuccaaaaugccguuuucguaaacauaaaaaaaaaaaaaaaucauagucguauuuugccac

SEQ ID NO: 37323 - RNA, 64 nt, Homo Sapiens
agauuuccaaaaugccguuuccguaaacauaaaaaaaaaaaaaauucauagucguauuuugcca

SEQ ID NO: 37324 - RNA, 64 nt, Homo Sapiens
aagauuuccaaaaugccguuaccguaaacauaaaaaaaaaaaaauuucauagucguauuuugcc

SEQ ID NO: 37325 - RNA, 64 nt, Homo Sapiens
aaagauuuccaaaaugccgucaccguaaacauaaaaaaaaaaaauuuucauagucguauuuugc

SEQ ID NO: 37326 - RNA, 64 nt, Homo Sapiens
aaaagauuuccaaaaugccgccaccguaaacauaaaaaaaaaaacuuuucauagucguauuuug

SEQ ID NO: 37327 - RNA, 64 nt, Homo Sapiens
aaaaagauuuccaaaaugccgccaccguaaacauaaaaaaaaaaucuuuucauagucguauuuu

SEQ ID NO: 37328 - RNA, 64 nt, Homo Sapiens
agucuguuugucauauuuaagucugcaguugaagaaaaaaaauaacaauuugagggaggcagaa

SEQ ID NO: 37329 - RNA, 64 nt, Homo Sapiens
augcauugcugcuuuuccuauaauuacaaaaaaaaaaaaaaaccggguagaagaccaugucuac

SEQ ID NO: 37330 - RNA, 64 nt, Homo Sapiens
caugcauugcugcuuuuccucuaauuacaaaaaaaaaaaaaaacuggguagaagaccaugucua

SEQ ID NO: 37331 - RNA, 64 nt, Homo Sapiens
ccaugcauugcugcuuuuccacuaauuacaaaaaaaaaaaaaaaauggguagaagaccaugucu

SEQ ID NO: 37332 - RNA, 64 nt, Homo Sapiens
accaugcauugcugcuuuucuacuaauuacaaaaaaaaaaaaaauauggguagaagaccauguc

SEQ ID NO: 37333 - RNA, 64 nt, Homo Sapiens
aaccaugcauugcugcuuuucuacuaauuacaaaaaaaaaaaaauuauggguagaagaccaugu

SEQ ID NO: 37334 - RNA, 64 nt, Homo Sapiens
aaaccaugcauugcugcuuuucuacuaauuacaaaaaaaaaaaacuuauggguagaagaccaug

SEQ ID NO: 37335 - RNA, 64 nt, Homo Sapiens
aaaaccaugcauugcugcuugucuacuaauuacaaaaaaaaaaagcuuauggguagaagaccau

SEQ ID NO: 37336 - RNA, 64 nt, Homo Sapiens
aaaaaccaugcauugcugcuugucuacuaauuacaaaaaaaaaaagcuuauggguagaagacca

SEQ ID NO: 37337 - RNA, 64 nt, Homo Sapiens
auguacucauacagauuuuucaagaaggaaaaaaaaaaaaaagagacagagugagacucugucu

SEQ ID NO: 37338 - RNA, 64 nt, Homo Sapiens
aauguacucauacagauuuuucaagaaggaaaaaaaaaaaaaagugacagagugagacucuguc

SEQ ID NO: 37339 - RNA, 64 nt, Homo Sapiens
gaauguacucauacagauuucucaagaaggaaaaaaaaaaaaaagugacagagugagacucugu

SEQ ID NO: 37340 - RNA, 64 nt, Homo Sapiens
agaauguacucauacagauuucucaagaaggaaaaaaaaaaaaaggugacagagugagacucug

SEQ ID NO: 37341 - RNA, 64 nt, Homo Sapiens
aagaauguacucauacagaugucucaagaaggaaaaaaaaaaaagggugacagagugagacucu

SEQ ID NO: 37342 - RNA, 64 nt, Homo Sapiens
aaagaauguacucauacagaugucucaagaaggaaaaaaaaaaaugggugacagagugagacuc

SEQ ID NO: 37343 - RNA, 64 nt, Homo Sapiens
aaaagaauguacucauacagcugucucaagaaggaaaaaaaaaacugggugacagagugagacu

SEQ ID NO: 37344 - RNA, 64 nt, Homo Sapiens
uauuuuauuauccaaaugcuaacaacagccaaaaaaaaaaaaccucuuaagaaugguugccaaa

SEQ ID NO: 37345 - RNA, 64 nt, Homo Sapiens
cuauuuuauuauccaaaugcaaacaacagccaaaaaaaaaaaacgucuuaagaaugguugccaa

SEQ ID NO: 37346 - RNA, 64 nt, Homo Sapiens
ccuauuuuauuauccaaaugaaaacaacagccaaaaaaaaaaaaugucuuaagaaugguugcca

SEQ ID NO: 37347 - RNA, 64 nt, Homo Sapiens
accuauuuuauuauccaaauaaaaacaacagccaaaaaaaaaaauugucuuaagaaugguugcc

SEQ ID NO: 37348 - RNA, 64 nt, Homo Sapiens
aaccuauuuuauuauccaaacaaaaacaacagccaaaaaaaaaacuugucuuaagaaugguugc

SEQ ID NO: 37349 - RNA, 64 nt, Homo Sapiens
aguaaaaggagcuccacacucuuuuuuaaggagaaaaaaaaauguuggaacauuuguuucuuuu

SEQ ID NO: 37350 - RNA, 64 nt, Homo Sapiens
gaguaaaaggagcuccacacucuuuuuuaaggagaaaaaaaaaucuuggaacauuuguuucuuu

SEQ ID NO: 37351 - RNA, 64 nt, Homo Sapiens
gaucugcuuagaauguggcccaguugucaaaaaaaaaaaaaacucuguggggggaaaaaauucu

SEQ ID NO: 37352 - RNA, 64 nt, Homo Sapiens
ugaucugcuuagaauguggcucaguugucaaaaaaaaaaaaaacgcuguggggggaaaaaauuc

SEQ ID NO: 37353 - RNA, 64 nt, Homo Sapiens
cugaucugcuuagaauguggcucaguugucaaaaaaaaaaaaaaagcuguggggggaaaaaauu

SEQ ID NO: 37354 - RNA, 64 nt, Homo Sapiens
acugaucugcuuagaaugugucucaguugucaaaaaaaaaaaaacagcuguggggggaaaaaau

SEQ ID NO: 37355 - RNA, 64 nt, Homo Sapiens
aacugaucugcuuagaauguuucucaguugucaaaaaaaaaaaaacagcuguggggggaaaaaa

SEQ ID NO: 37356 - RNA, 64 nt, Homo Sapiens
aaacugaucugcuuagaaugauucucaguugucaaaaaaaaaaaaacagcuguggggggaaaaa

SEQ ID NO: 37357 - RNA, 64 nt, Homo Sapiens
aaaacugaucugcuuagaauaauucucaguugucaaaaaaaaaagaacagcuguggggggaaaa

SEQ ID NO: 37358 - RNA, 64 nt, Homo Sapiens
auauuuucaccauccagacgaaccuuaaaugucaaaaaaaaauaaaaaaaaacaaaaacaaaaa

SEQ ID NO: 37359 - RNA, 64 nt, Homo Sapiens
aauauuuucaccauccagacaaaccuuaaaugucaaaaaaaaauaaaaaaaaacaaaaacaaaa

SEQ ID NO: 37360 - RNA, 64 nt, Homo Sapiens
aaaacaaaaaaaccuuaaauccgacucuauuuaaaaaaaaaacacugggaaaugugguaaaacu

SEQ ID NO: 37361 - RNA, 64 nt, Homo Sapiens
aaaaacaaaaaaaccuuaaauccgacucuauuuaaaaaaaaaacccugggaaaugugguaaaac

SEQ ID NO: 37362 - RNA, 64 nt, Homo Sapiens
caaaaacaaaaaaaccuuaacuccgacucuauuuaaaaaaaaaagccugggaaaugugguaaaa

SEQ ID NO: 37363 - RNA, 64 nt, Homo Sapiens
auaauaaaugugucauuguuugggaaauaaaauaaaaaaaaauauguaagaggugucaacaaac

SEQ ID NO: 37364 - RNA, 64 nt, Homo Sapiens
aauaauaaaugugucauugucugggaaauaaaauaaaaaaaaauauguaagaggugucaacaaa

SEQ ID NO: 37365 - RNA, 64 nt, Homo Sapiens
uaguuuuuguuuguaaggaaaugaacuagcaaaaaaaaaaaaugagcaguuaaguugucucuaa

SEQ ID NO: 37366 - RNA, 64 nt, Homo Sapiens
guaguuuuuguuuguaaggaaaugaacuagcaaaaaaaaaaaaucagcaguuaaguugucucua

SEQ ID NO: 37367 - RNA, 64 nt, Homo Sapiens
uguaguuuuuguuuguaaggaaaugaacuagcaaaaaaaaaaaaacagcaguuaaguugucucu

SEQ ID NO: 37368 - RNA, 64 nt, Homo Sapiens
auguaguuuuuguuuguaaguaaaugaacuagcaaaaaaaaaaaaacagcaguuaaguugucuc

SEQ ID NO: 37369 - RNA, 64 nt, Homo Sapiens
aauguaguuuuuguuuguaacuaaaugaacuagcaaaaaaaaaaaaacagcaguuaaguugucu

SEQ ID NO: 37370 - RNA, 64 nt, Homo Sapiens
aaacuggguuugggcuuugcaaaaaaaaaaaaaaaaaaaaaagaacagcuuaagaauuccaaaa

SEQ ID NO: 37371 - RNA, 64 nt, Homo Sapiens
aaaacuggguuugggcuuugaaaaaaaaaaaaaaaaaaaaaaagaacagcuuaagaauuccaaa

SEQ ID NO: 37372 - RNA, 64 nt, Homo Sapiens
gaaaacuggguuugggcuuuaaaaaaaaaaaaaaaaaaaaaaaaaaacagcuuaagaauuccaa

SEQ ID NO: 37373 - RNA, 64 nt, Homo Sapiens
agaaaacuggguuugggcuuaaaaaaaaaaaaaaaaaaaaaaaagaaacagcuuaagaauucca

SEQ ID NO: 37374 - RNA, 64 nt, Homo Sapiens
aagaaaacuggguuugggcuaaaaaaaaaaaaaaaaaaaaaaaaugaaacagcuuaagaauucc

SEQ ID NO: 37375 - RNA, 64 nt, Homo Sapiens
aaagaaaacuggguuugggccaaaaaaaaaaaaaaaaaaaaaaagugaaacagcuuaagaauuc

SEQ ID NO: 37376 - RNA, 64 nt, Homo Sapiens
aaaagaaaacuggguuugggccaaaaaaaaaaaaaaaaaaaaaaagugaaacagcuuaagaauu

SEQ ID NO: 37377 - RNA, 64 nt, Homo Sapiens
aaaaagaaaacuggguuugguccaaaaaaaaaaaaaaaaaaaaauagugaaacagcuuaagaau

SEQ ID NO: 37378 - RNA, 64 nt, Homo Sapiens
aaaaaagaaaacuggguuuguuccaaaaaaaaaaaaaaaaaaaaguagugaaacagcuuaagaa

SEQ ID NO: 37379 - RNA, 64 nt, Homo Sapiens
aaaaaaagaaaacuggguuuauuccaaaaaaaaaaaaaaaaaaagguagugaaacagcuuaaga

SEQ ID NO: 37380 - RNA, 64 nt, Homo Sapiens
aaaaaaaagaaaacuggguuaauuccaaaaaaaaaaaaaaaaaaagguagugaaacagcuuaag

SEQ ID NO: 37381 - RNA, 64 nt, Homo Sapiens
aaaaaaaaagaaaacugggugaauuccaaaaaaaaaaaaaaaaacagguagugaaacagcuuaa

SEQ ID NO: 37382 - RNA, 64 nt, Homo Sapiens
aaaaaaaaaagaaaacugggagaauuccaaaaaaaaaaaaaaaaacagguagugaaacagcuua

SEQ ID NO: 37383 - RNA, 64 nt, Homo Sapiens
aaaaaaaaaaagaaaacuggaagaauuccaaaaaaaaaaaaaaaaacagguagugaaacagcuu

SEQ ID NO: 37384 - RNA, 64 nt, Homo Sapiens
aaaaaaaaaaaagaaaacuguaagaauuccaaaaaaaaaaaaaacaacagguagugaaacagcu

SEQ ID NO: 37385 - RNA, 64 nt, Homo Sapiens
aaaaaaaaaaaaagaaaacuuuaagaauuccaaaaaaaaaaaaaacaacagguagugaaacagc

SEQ ID NO: 37386 - RNA, 64 nt, Homo Sapiens
aaaaaaaaaaaaaagaaaaccuuaagaauuccaaaaaaaaaaaauacaacagguagugaaacag

SEQ ID NO: 37387 - RNA, 64 nt, Homo Sapiens
aaaaaaaaaaaaaaagaaaagcuuaagaauuccaaaaaaaaaaaauacaacagguagugaaaca

SEQ ID NO: 37388 - RNA, 64 nt, Homo Sapiens
aaaaaaaaaaaaaaaagaaaagcuuaagaauuccaaaaaaaaaagauacaacagguagugaaac

SEQ ID NO: 37389 - RNA, 64 nt, Homo Sapiens
aagaaagaaaaggacucccucaucucaaaaaaaaaaaaaaaagucuggcaacagagcgagacuc

SEQ ID NO: 37390 - RNA, 64 nt, Homo Sapiens
uaagaaagaaaaggacucccccaucucaaaaaaaaaaaaaaaagccuggcaacagagcgagacu

SEQ ID NO: 37391 - RNA, 64 nt, Homo Sapiens
guaagaaagaaaaggacuccuccaucucaaaaaaaaaaaaaaaagccuggcaacagagcgagac

SEQ ID NO: 37392 - RNA, 64 nt, Homo Sapiens
aguaagaaagaaaaggacuccuccaucucaaaaaaaaaaaaaaaagccuggcaacagagcgaga

SEQ ID NO: 37393 - RNA, 64 nt, Homo Sapiens
aaguaagaaagaaaaggacuacuccaucucaaaaaaaaaaaaaacagccuggcaacagagcgag

SEQ ID NO: 37394 - RNA, 64 nt, Homo Sapiens
aaaguaagaaagaaaaggacgacuccaucucaaaaaaaaaaaaaccagccuggcaacagagcga

SEQ ID NO: 37395 - RNA, 64 nt, Homo Sapiens
aaaaguaagaaagaaaaggaagacuccaucucaaaaaaaaaaaauccagccuggcaacagagcg

SEQ ID NO: 37396 - RNA, 64 nt, Homo Sapiens
aaaaaguaagaaagaaaagggagacuccaucucaaaaaaaaaaacuccagccuggcaacagagc

SEQ ID NO: 37397 - RNA, 64 nt, Homo Sapiens
aaaaaaguaagaaagaaaagcgagacuccaucucaaaaaaaaaaacuccagccuggcaacagag

SEQ ID NO: 37398 - RNA, 64 nt, Homo Sapiens
aucucuaaauacaggauuauugagacucugucucaaaaaaaagucuccagccugagugauagag

SEQ ID NO: 37399 - RNA, 64 nt, Homo Sapiens
acuaaccacugcaagcucuuuuaaaaaaaggaaaaaaaaaaacuuuuacucuauugcuuaugcu

SEQ ID NO: 37400 - RNA, 64 nt, Homo Sapiens
uacuaaccacugcaagcucuuuuaaaaaaaggaaaaaaaaaaacauuuacucuauugcuuaugc

SEQ ID NO: 37401 - RNA, 64 nt, Homo Sapiens
cuacuaaccacugcaagcuccuuuaaaaaaaggaaaaaaaaaaacauuuacucuauugcuuaug

SEQ ID NO: 37402 - RNA, 64 nt, Homo Sapiens
acuacuaaccacugcaagcugcuuuaaaaaaaggaaaaaaaaaagcauuuacucuauugcuuau

SEQ ID NO: 37403 - RNA, 64 nt, Homo Sapiens
ucaugaaguaccaaugcaagaaauauuugcuugaaaaaaaaaguucagaauuguuaacugaaac

SEQ ID NO: 37404 - RNA, 64 nt, Homo Sapiens
uucaugaaguaccaaugcaacaaauauuugcuugaaaaaaaaaggucagaauuguuaacugaaa

SEQ ID NO: 37405 - RNA, 64 nt, Homo Sapiens
ucuggacaccuuuaauaagcaagcaaaaagugaaaaaaaaaagcguggaggauuacauuuaaaa

SEQ ID NO: 37406 - RNA, 64 nt, Homo Sapiens
cucuggacaccuuuaauaagaaagcaaaaagugaaaaaaaaaaguguggaggauuacauuuaaa

SEQ ID NO: 37407 - RNA, 64 nt, Homo Sapiens
gcucuggacaccuuuaauaaaaaagcaaaaagugaaaaaaaaaauuguggaggauuacauuuaa

SEQ ID NO: 37408 - RNA, 64 nt, Homo Sapiens
guucccauaggugcagcaaaaaauguuuuuguuuaaaaaaaacuccuuaacucuguauuaaaaa

SEQ ID NO: 37409 - RNA, 64 nt, Homo Sapiens
uuuuuguuuaaaaaaaacugcuuaacucuguauuaaaaaaaauggugaaauauaagccugcggc

SEQ ID NO: 37410 - RNA, 64 nt, Homo Sapiens
auuaaauguuucucacauauuuuucuuaaaaaagaaaaaaaauuccucaaguuacuuuccuuca

SEQ ID NO: 37411 - RNA, 64 nt, Homo Sapiens
ccaaacuuaaccucugagaaaauuaaaagaaggaaaaaaaaagcuuguauaaaaauuuaaauug

SEQ ID NO: 37412 - RNA, 64 nt, Homo Sapiens
cccaaacuuaaccucugagagaauuaaaagaaggaaaaaaaaaguuuguauaaaaauuuaaauu

SEQ ID NO: 37413 - RNA, 64 nt, Homo Sapiens
gucaauauggauuuagaaaaagguugaauugaaaaaaaaaaacauguuuaguuuuguuuaccca

SEQ ID NO: 37414 - RNA, 64 nt, Homo Sapiens
agucaauauggauuuagaaaaagguugaauugaaaaaaaaaaacauguuuaguuuuguuuaccc

SEQ ID NO: 37415 - RNA, 64 nt, Homo Sapiens
cagucaauauggauuuagaacaagguugaauugaaaaaaaaaaaaauguuuaguuuuguuuacc

SEQ ID NO: 37416 - RNA, 64 nt, Homo Sapiens
acagucaauauggauuuagaccaagguugaauugaaaaaaaaaagaauguuuaguuuuguuuac

SEQ ID NO: 37417 - RNA, 64 nt, Homo Sapiens
agaagaauaauguaguuuaguuuaccaaaaaaaaaaaaaaaagcuaaaaaacacaugaagaaaa

SEQ ID NO: 37418 - RNA, 64 nt, Homo Sapiens
cagaagaauaauguaguuuaauuuaccaaaaaaaaaaaaaaaagcuaaaaaacacaugaagaaa

SEQ ID NO: 37419 - RNA, 64 nt, Homo Sapiens
gcagaagaauaauguaguuuaauuuaccaaaaaaaaaaaaaaaaucuaaaaaacacaugaagaa

SEQ ID NO: 37420 - RNA, 64 nt, Homo Sapiens
agcagaagaauaauguaguuaaauuuaccaaaaaaaaaaaaaaagucuaaaaaacacaugaaga

SEQ ID NO: 37421 - RNA, 64 nt, Homo Sapiens
aagcagaagaauaauguaguaaaauuuaccaaaaaaaaaaaaaaugucuaaaaaacacaugaag

SEQ ID NO: 37422 - RNA, 64 nt, Homo Sapiens
aaagcagaagaauaauguaggaaaauuuaccaaaaaaaaaaaaauugucuaaaaaacacaugaa

SEQ ID NO: 37423 - RNA, 64 nt, Homo Sapiens
aaaagcagaagaauaauguaagaaaauuuaccaaaaaaaaaaaauuugucuaaaaaacacauga

SEQ ID NO: 37424 - RNA, 64 nt, Homo Sapiens
aaaaagcagaagaauaauguaagaaaauuuaccaaaaaaaaaaauuuugucuaaaaaacacaug

SEQ ID NO: 37425 - RNA, 64 nt, Homo Sapiens
aaaaaagcagaagaauaauggaagaaaauuuaccaaaaaaaaaacuuuugucuaaaaaacacau

SEQ ID NO: 37426 - RNA, 64 nt, Homo Sapiens
cauuggcagauccaagaauguguuugugugggaaaaaaaaaacuuacauauacagcacuuaaaa

SEQ ID NO: 37427 - RNA, 64 nt, Homo Sapiens
ucauuggcagauccaagaauauguuugugugggaaaaaaaaaacuuacauauacagcacuuaaa

SEQ ID NO: 37428 - RNA, 64 nt, Homo Sapiens
cucauuggcagauccaagaaaauguuugugugggaaaaaaaaaauuuacauauacagcacuuaa

SEQ ID NO: 37429 - RNA, 64 nt, Homo Sapiens
cgcugacauaaucucccuaguuuuaguuggauaaaaaaaaaacugaccucauuaguuguuaauu

SEQ ID NO: 37430 - RNA, 64 nt, Homo Sapiens
ucgcugacauaaucucccuauuuuuaguuggauaaaaaaaaaacugaccucauuaguuguuaau

SEQ ID NO: 37431 - RNA, 64 nt, Homo Sapiens
cucgcugacauaaucucccuuuuuuuaguuggauaaaaaaaaaauugaccucauuaguuguuaa

SEQ ID NO: 37432 - RNA, 64 nt, Homo Sapiens
auugucuauaaaauguuucuuguuuaacauaugaaaaaaaaaguauguaucccauagaagcuga

SEQ ID NO: 37433 - RNA, 64 nt, Homo Sapiens
uauugucuauaaaauguuucauguuuaacauaugaaaaaaaaagaauguaucccauagaagcug

SEQ ID NO: 37434 - RNA, 64 nt, Homo Sapiens
uauaaaaagaauuaguguauucuggaauguaaaaaaaaaaaaugaacugcuauuuucgcuuauu

SEQ ID NO: 37435 - RNA, 64 nt, Homo Sapiens
guauaaaaagaauuaguguauucuggaauguaaaaaaaaaaaauaaacugcuauuuucgcuuau

SEQ ID NO: 37436 - RNA, 64 nt, Homo Sapiens
uguauaaaaagaauuaguguuuucuggaauguaaaaaaaaaaaaaaaacugcuauuuucgcuua

SEQ ID NO: 37437 - RNA, 64 nt, Homo Sapiens
auguauaaaaagaauuagugauuucuggaauguaaaaaaaaaaauaaaacugcuauuuucgcuu

SEQ ID NO: 37438 - RNA, 64 nt, Homo Sapiens
aauguauaaaaagaauuaguuauuucuggaauguaaaaaaaaaauuaaaacugcuauuuucgcu

SEQ ID NO: 37439 - RNA, 64 nt, Homo Sapiens
cccuaaguacucuguuuacucuguuacuauuuaaaaaaaaaauaaggcuuuuaaauuaguacaa

SEQ ID NO: 37440 - RNA, 64 nt, Homo Sapiens
acccuaaguacucuguuuacacuguuacuauuuaaaaaaaaaauaaggcuuuuaaauuaguaca

SEQ ID NO: 37441 - RNA, 64 nt, Homo Sapiens
uacccuaaguacucuguuuaaacuguuacuauuuaaaaaaaaaaaaaggcuuuuaaauuaguac

SEQ ID NO: 37442 - RNA, 64 nt, Homo Sapiens
ugcucagauacucagccaguaccaaaaaaaaaaaaaaaaaaaucgagguagaaacaaaccaacg

SEQ ID NO: 37443 - RNA, 64 nt, Homo Sapiens
cugcucagauacucagccaggaccaaaaaaaaaaaaaaaaaaauggagguagaaacaaaccaac

SEQ ID NO: 37444 - RNA, 64 nt, Homo Sapiens
ucugcucagauacucagccacgaccaaaaaaaaaaaaaaaaaaauggagguagaaacaaaccaa

SEQ ID NO: 37445 - RNA, 64 nt, Homo Sapiens
aucugcucagauacucagccacgaccaaaaaaaaaaaaaaaaaauuggagguagaaacaaacca

SEQ ID NO: 37446 - RNA, 64 nt, Homo Sapiens
aaucugcucagauacucagcaacgaccaaaaaaaaaaaaaaaaacuuggagguagaaacaaacc

SEQ ID NO: 37447 - RNA, 64 nt, Homo Sapiens
aaaucugcucagauacucagcaacgaccaaaaaaaaaaaaaaaagcuuggagguagaaacaaac

SEQ ID NO: 37448 - RNA, 64 nt, Homo Sapiens
aaaaucugcucagauacucaccaacgaccaaaaaaaaaaaaaaaugcuuggagguagaaacaaa

SEQ ID NO: 37449 - RNA, 64 nt, Homo Sapiens
aaaaaucugcucagauacucaccaacgaccaaaaaaaaaaaaaaaugcuuggagguagaaacaa

SEQ ID NO: 37450 - RNA, 64 nt, Homo Sapiens
aaaaaaucugcucagauacuaaccaacgaccaaaaaaaaaaaaauaugcuuggagguagaaaca

SEQ ID NO: 37451 - RNA, 64 nt, Homo Sapiens
aaaaaaaucugcucagauacaaaccaacgaccaaaaaaaaaaaaauaugcuuggagguagaaac

SEQ ID NO: 37452 - RNA, 64 nt, Homo Sapiens
aaaaaaaaucugcucagauacaaaccaacgaccaaaaaaaaaaacauaugcuuggagguagaaa

SEQ ID NO: 37453 - RNA, 64 nt, Homo Sapiens
aaaaaaaaaucugcucagauacaaaccaacgaccaaaaaaaaaaccauaugcuuggagguagaa

SEQ ID NO: 37454 - RNA, 64 nt, Homo Sapiens
cuaaccaguucuuccauuaauguacccucaaaaaaaaaaaaaugucuccucuccucucccccga

SEQ ID NO: 37455 - RNA, 64 nt, Homo Sapiens
gcuaaccaguucuuccauuaauguacccucaaaaaaaaaaaaaucucuccucuccucucccccg

SEQ ID NO: 37456 - RNA, 64 nt, Homo Sapiens
ugcuaaccaguucuuccauugauguacccucaaaaaaaaaaaaaccucuccucuccucuccccc

SEQ ID NO: 37457 - RNA, 64 nt, Homo Sapiens
augcuaaccaguucuuccaucgauguacccucaaaaaaaaaaaauccucuccucuccucucccc

SEQ ID NO: 37458 - RNA, 64 nt, Homo Sapiens
aaugcuaaccaguucuuccaccgauguacccucaaaaaaaaaaacuccucuccucuccucuccc

SEQ ID NO: 37459 - RNA, 64 nt, Homo Sapiens
aaaugcuaaccaguucuucccccgauguacccucaaaaaaaaaaucuccucuccucuccucucc

SEQ ID NO: 37460 - RNA, 64 nt, Homo Sapiens
aaugacaaagaaugugauagggugaguaaaaacaaaaaaaaacacagaauggauugcuaguguu

SEQ ID NO: 37461 - RNA, 64 nt, Homo Sapiens
aaaugacaaagaaugugauauggugaguaaaaacaaaaaaaaacacagaauggauugcuagugu

SEQ ID NO: 37462 - RNA, 64 nt, Homo Sapiens
aauugcucaaauaaaaaugucauggauuucuuugaaaaaaaauauuucuaucguucucucuuug

SEQ ID NO: 37463 - RNA, 64 nt, Homo Sapiens
aucaaguugugccaaauuauuuuugcaaagaaagaaaaaaaaccugguagcauauagauugucc

SEQ ID NO: 37464 - RNA, 64 nt, Homo Sapiens
aaagguauucccagguauguucaccccaagguaaaaaaaaaauaacauuuaugguuuggaacca

SEQ ID NO: 37465 - RNA, 64 nt, Homo Sapiens
aaaagguauucccagguaugaucaccccaagguaaaaaaaaaaucacauuuaugguuuggaacc

SEQ ID NO: 37466 - RNA, 64 nt, Homo Sapiens
uaaaagguauucccagguaucaucaccccaagguaaaaaaaaaaucacauuuaugguuuggaac

SEQ ID NO: 37467 - RNA, 64 nt, Homo Sapiens
auucugacuagagucagguuuuuucacaauuaaaaaaaaaaacucagcuaggcaaaagccauac

SEQ ID NO: 37468 - RNA, 64 nt, Homo Sapiens
uauucugacuagagucaggucuuuucacaauuaaaaaaaaaaacucagcuaggcaaaagccaua

SEQ ID NO: 37469 - RNA, 64 nt, Homo Sapiens
cuauucugacuagagucaggacuuuucacaauuaaaaaaaaaaauucagcuaggcaaaagccau

SEQ ID NO: 37470 - RNA, 64 nt, Homo Sapiens
acuauucugacuagagucaguacuuuucacaauuaaaaaaaaaaguucagcuaggcaaaagcca

SEQ ID NO: 37471 - RNA, 64 nt, Homo Sapiens
ggagugaagugcaauauuauaaauauuauagauuaaaaaaaaaauagccgugcacucuugaccc

SEQ ID NO: 37472 - RNA, 64 nt, Homo Sapiens
gagugaagugcaauauuauaaauauuauagauuaaaaaaaaaauagccgugcacucuugacccc

SEQ ID NO: 37473 - RNA, 64 nt, Homo Sapiens
agugaagugcaauauuauaaauauuauagauuaaaaaaaaaauagccgugcacucuugaccccg

SEQ ID NO: 37474 - RNA, 64 nt, Homo Sapiens
auuuagauacuucucccugagguggggauaaaagaaaaaaaaaaacaacuucuuuuuuucuucc

SEQ ID NO: 37475 - RNA, 64 nt, Homo Sapiens
uuuagauacuucucccugagguggggauaaaagaaaaaaaaaaacaacuucuuuuuuucuuccg

SEQ ID NO: 37476 - RNA, 64 nt, Homo Sapiens
uuagauacuucucccugagguggggauaaaagaaaaaaaaaaacaacuucuuuuuuucuuccgc

SEQ ID NO: 37477 - RNA, 64 nt, Homo Sapiens
uagauacuucucccugagguggggauaaaagaaaaaaaaaaacaacuucuuuuuuucuuccgca

SEQ ID NO: 37478 - RNA, 64 nt, Homo Sapiens
cucauucauccauuuuucuuaaaagcuggaaauuaaaaaaaaaaaagagagagagaggcuuuaa

SEQ ID NO: 37479 - RNA, 64 nt, Homo Sapiens
ucauucauccauuuuucuuaaaagcuggaaauuaaaaaaaaaaaagagagagagaggcuuuaau

SEQ ID NO: 37480 - RNA, 64 nt, Homo Sapiens
cauucauccauuuuucuuaaaagcuggaaauuaaaaaaaaaaaagagagagagaggcuuuaaua

SEQ ID NO: 37481 - RNA, 64 nt, Homo Sapiens
auucauccauuuuucuuaaaagcuggaaauuaaaaaaaaaaaagaggagagaggcuuucggugg

SEQ ID NO: 37482 - RNA, 64 nt, Homo Sapiens
uucauccauuuuucuuaaaagcuggaaauuaaaaaaaaaaaagaggagagaggcuuucggugga

SEQ ID NO: 37483 - RNA, 64 nt, Homo Sapiens
aggagagaggcuuucgguggacacguuugacauuaaaaaaaaaaaaaaaaaaaaaaaaaaacug

SEQ ID NO: 37484 - RNA, 64 nt, Homo Sapiens
ggagagaggcuuucgguggacacguuugacauuaaaaaaaaaaaaaaaaaaaaaaaaaaacugg

SEQ ID NO: 37485 - RNA, 64 nt, Homo Sapiens
gagagaggcuuucgguggacacguuugacauuaaaaaaaaaaaaaaaaaaaaaaaaaaacuggu

SEQ ID NO: 37486 - RNA, 64 nt, Homo Sapiens
agagaggcuuucgguggacacguuugacauuaaaaaaaaaaaaaaaaaaaaaaaaaaacuggug

SEQ ID NO: 37487 - RNA, 64 nt, Homo Sapiens
gagaggcuuucgguggacacguuugacauuaaaaaaaaaaaaaaaaaaaaaaaaaaacuggugc

SEQ ID NO: 37488 - RNA, 64 nt, Homo Sapiens
agaggcuuucgguggacacguuugacauuaaaaaaaaaaaaaaaaaaaaaaaaaaacuggugcc

SEQ ID NO: 37489 - RNA, 64 nt, Homo Sapiens
gaggcuuucgguggacacguuugacauuaaaaaaaaaaaaaaaaaaaaaaaaaaacuggugccu

SEQ ID NO: 37490 - RNA, 64 nt, Homo Sapiens
aggcuuucgguggacacguuugacauuaaaaaaaaaaaaaaaaaaaaaaaaaaacuggugccua

SEQ ID NO: 37491 - RNA, 64 nt, Homo Sapiens
ggcuuucgguggacacguuugacauuaaaaaaaaaaaaaaaaaaaaaaaaaaacuggugccuaa

SEQ ID NO: 37492 - RNA, 64 nt, Homo Sapiens
gcuuucgguggacacguuugacauuaaaaaaaaaaaaaaaaaaaaaaaaaaacuggugccuaau

SEQ ID NO: 37493 - RNA, 64 nt, Homo Sapiens
cuuucgguggacacguuugacauuaaaaaaaaaaaaaaaaaaaaaaaaaaacuggugccuaauu

SEQ ID NO: 37494 - RNA, 64 nt, Homo Sapiens
uuucgguggacacguuugacauuaaaaaaaaaaaaaaaaaaaaaaaaaaacuggugccuaauuu

SEQ ID NO: 37495 - RNA, 64 nt, Homo Sapiens
uucgguggacacguuugacauuaaaaaaaaaaaaaaaaaaaaaaaaaaacuggugccuaauuua

SEQ ID NO: 37496 - RNA, 64 nt, Homo Sapiens
ucgguggacacguuugacauuaaaaaaaaaaaaaaaaaaaaaaaaaaacuggugccuaauuuau

SEQ ID NO: 37497 - RNA, 64 nt, Homo Sapiens
cgguggacacguuugacauuaaaaaaaaaaaaaaaaaaaaaaaaaaacuggugccuaauuuauu

SEQ ID NO: 37498 - RNA, 64 nt, Homo Sapiens
gguggacacguuugacauuaaaaaaaaaaaaaaaaaaaaaaaaaaacuggugccuaauuuauua

SEQ ID NO: 37499 - RNA, 64 nt, Homo Sapiens
guggacacguuugacauuaaaaaaaaaaaaaaaaaaaaaaaaaaacuggugccuaauuuauuaa

SEQ ID NO: 37500 - RNA, 64 nt, Homo Sapiens
uggacacguuugacauuaaaaaaaaaaaaaaaaaaaaaaaaaaacuggugccuaauuuauuaaa

SEQ ID NO: 37501 - RNA, 64 nt, Homo Sapiens
ggacacguuugacauuaaaaaaaaaaaaaaaaaaaaaaaaaaacuggugccuaauuuauuaaag

SEQ ID NO: 37502 - RNA, 64 nt, Homo Sapiens
gacacguuugacauuaaaaaaaaaaaaaaaaaaaaaaaaaaacuggugccuaauuuauuaaaga

SEQ ID NO: 37503 - RNA, 64 nt, Homo Sapiens
cccucuguuauugucggcaggcggugagggguagaaaaaaaacaaacaaacaaacagaaaaaaa

SEQ ID NO: 37504 - RNA, 64 nt, Homo Sapiens
gugagggguagaaaaaaaacaaacaaacaaacagaaaaaaaaaccaaaaaaaaccacccugagu

SEQ ID NO: 37505 - RNA, 64 nt, Homo Sapiens
ugagggguagaaaaaaaacaaacaaacaaacagaaaaaaaaaccaaaaaaaaccacccugaguu

SEQ ID NO: 37506 - RNA, 64 nt, Homo Sapiens
aaaaaaaacaaacaaacaaacagaaaaaaaaaccaaaaaaaaccacccugaguuucucugguga

SEQ ID NO: 37507 - RNA, 64 nt, Homo Sapiens
cuccagccuggacgacagagcaagacccuguauuaaaaaaaaaauucauccugcacagggaaau

SEQ ID NO: 37508 - RNA, 64 nt, Homo Sapiens
uccagccuggacgacagagcaagacccuguauuaaaaaaaaaauucauccugcacagggaaaug

SEQ ID NO: 37509 - RNA, 64 nt, Homo Sapiens
ccagccuggacgacagagcaagacccuguauuaaaaaaaaaauucauccugcacagggaaaugg

SEQ ID NO: 37510 - RNA, 64 nt, Homo Sapiens
cuccagccugggugacagagugagacccuguuccaaaaaaaaaaaaaaacccaaaaaaccucaa

SEQ ID NO: 37511 - RNA, 64 nt, Homo Sapiens
uccagccugggugacagagugagacccuguuccaaaaaaaaaaaaaaacccaaaaaaccucaau

SEQ ID NO: 37512 - RNA, 64 nt, Homo Sapiens
ccagccugggugacagagugagacccuguuccaaaaaaaaaaaaaaacccaaaaaaccucaaug

SEQ ID NO: 37513 - RNA, 64 nt, Homo Sapiens
cagccugggugacagagugagacccuguuccaaaaaaaaaaaaaaacccaaaaaaccucaaugg

SEQ ID NO: 37514 - RNA, 64 nt, Homo Sapiens
agccugggugacagagugagacccuguuccaaaaaaaaaaaaaaacccaaaaaaccucaauggc

SEQ ID NO: 37515 - RNA, 64 nt, Homo Sapiens
gccugggugacagagugagacccuguuccaaaaaaaaaaaaaaacccaaaaaaccucaauggcu

SEQ ID NO: 37516 - RNA, 64 nt, Homo Sapiens
ccugggugacagagugagacccuguuccaaaaaaaaaaaaaaacccaaaaaaccucaauggcuu

SEQ ID NO: 37517 - RNA, 64 nt, Homo Sapiens
cugggugacagagugagacccuguuccaaaaaaaaaaaaaaacccaaaaaaccucaauggcuuu

SEQ ID NO: 37518 - RNA, 64 nt, Homo Sapiens
gccugggcagcauagcgagaccccaucucuauauaaaaaaaaagauguuaaaacagugaaauua

SEQ ID NO: 37519 - RNA, 64 nt, Homo Sapiens
ccugggcagcauagcgagaccccaucucuauauaaaaaaaaagauguuaaaacagugaaauuac

SEQ ID NO: 37520 - RNA, 64 nt, Homo Sapiens
auccuuuucauccuuugugccucgguuauuaaggaaaaaaaaauguccaacauacaguuuuuaa

SEQ ID NO: 37521 - RNA, 64 nt, Homo Sapiens
uccuuuucauccuuugugccucgguuauuaaggaaaaaaaaauguccaacauacaguuuuuaaa

SEQ ID NO: 37522 - RNA, 64 nt, Homo Sapiens
ugagcuuugaagugcacaggaaaauaaaacauuaaaaaaaaacaacucaucucuguaaaaaaua

SEQ ID NO: 37523 - RNA, 64 nt, Homo Sapiens
augagcuuugaagugcacagaaaaauaaaacauuaaaaaaaaacaacucaucucuguaaaaaau

SEQ ID NO: 37524 - RNA, 64 nt, Homo Sapiens
gugaaaaaccucagaguagcgugucucaugggggaaaaaaaacugcugagcgugggccuugggu

SEQ ID NO: 37525 - RNA, 64 nt, Homo Sapiens
ucuguuuugaaggcaaaauuacuuuuuacaauuaaaaaaaaagauauuucugcauauguugaau

SEQ ID NO: 37526 - RNA, 64 nt, Homo Sapiens
aucuguuuugaaggcaaaauuacuuuuuacaauuaaaaaaaaaguuauuucugcauauguugaa

SEQ ID NO: 37527 - RNA, 61 nt, Homo Sapiens
guuugucaguauugcugucaauggcagucauaacagggacugaugauuuagcaauaauaaa

SEQ ID NO: 37528 - RNA, 61 nt, Homo Sapiens
ucacacccauguuacuugccugaaagcaugcaacagggaucuuguaaauuuuuaguuuuaa

SEQ ID NO: 37529 - RNA, 61 nt, Homo Sapiens
ugcaugcaugauaaugcguggcagagacugcaacagggauuguguguucagagaucauaug

SEQ ID NO: 37530 - RNA, 61 nt, Homo Sapiens
caucccagguguguguaagagagagagagagaacagggaggauacagaaguauugcagccc

SEQ ID NO: 37531 - RNA, 61 nt, Homo Sapiens
uuauuucccuuaaguguuucacuggggagagaacagggagugcuccuccagcuucccaaag

SEQ ID NO: 37532 - RNA, 61 nt, Homo Sapiens
cagaguuuggaggccaguuuuccacagccuaaacagggaggagcugcagaauggggcucug

SEQ ID NO: 37533 - RNA, 61 nt, Homo Sapiens
ccucagcagggcuuacuaagcacuaccccuuaacagggaugacuccgcacugccccucaac

SEQ ID NO: 37534 - RNA, 61 nt, Homo Sapiens
ccuuaacagggaugacuccgcacugccccucaacagggaugacucagcagagaugacucag

SEQ ID NO: 37535 - RNA, 61 nt, Homo Sapiens
ccucagcagggaugacucagcaccgccucucaacagggaugacucagcagggaugacucag

SEQ ID NO: 37536 - RNA, 61 nt, Homo Sapiens
ccucagcaaggaugacucagcacugccgcucaacagggaugacucagggauggcuuaguac

SEQ ID NO: 37537 - RNA, 61 nt, Homo Sapiens
augacucagggauggcuuaguacugccccucaacagggaugacucagcagggaugacucag

SEQ ID NO: 37538 - RNA, 61 nt, Homo Sapiens
ccucagcagggaugacucagcacugccccucaacagggaugacucagcagggaugacucag

SEQ ID NO: 37539 - RNA, 61 nt, Homo Sapiens
ccucagcagggaugacucagcaccgccccucaacagggaugacucagcacugccccucaac

SEQ ID NO: 37540 - RNA, 61 nt, Homo Sapiens
ccucaacagggaugacucagcacugccccucaacagggaugacucagcagggaugacucag

SEQ ID NO: 37541 - RNA, 61 nt, Homo Sapiens
acucagcagggaugacucagcaccaccccucaacagggaugacucagcagggaugacucag

SEQ ID NO: 37542 - RNA, 61 nt, Homo Sapiens
acucagcagggaugacucagcacugccccucaacagggaugacugcagggaugacucagca

SEQ ID NO: 37543 - RNA, 61 nt, Homo Sapiens
gcucagcagggaugacucagcauugccccucaacagggaugacucagcagacucagcaggg

SEQ ID NO: 37544 - RNA, 61 nt, Homo Sapiens
ucugcauucuggaacaagcccugccuaauuuaacagggauuacacguccuccagcccaaga

SEQ ID NO: 37545 - RNA, 61 nt, Homo Sapiens
gggcaaaagaggggaguaaaaaguuuacaacaacagggacaacgcuuaaacauagccuuua

SEQ ID NO: 37546 - RNA, 64 nt, Homo Sapiens
augguauguagcauguagugcacaagcugauuuuaagugauauucagauggccuuuuaaauuua

SEQ ID NO: 37547 - RNA, 64 nt, Homo Sapiens
auuauuauguauuuaaaauuuaauuaauuauagcaagugauaugaacugugauaaugcagaagg

SEQ ID NO: 37548 - RNA, 64 nt, Homo Sapiens
aauuucuacuuuguaaaaauagggaaauuauuugaagugauauauuugguuaaacauuucuaaa

SEQ ID NO: 37549 - RNA, 64 nt, Homo Sapiens
uaauaaauaugaguguccuuuauuugccuaguagaagugauaaauuguguuauauaugauaauu

SEQ ID NO: 37550 - RNA, 64 nt, Homo Sapiens
gcuuaacacuugaccuaaacuaaggacagugucaaagugauaaauaaauuccuccauugugaga

SEQ ID NO: 37551 - RNA, 64 nt, Homo Sapiens
guacuuugaaucuaguuguuuuaaaggguauacuaagugauacauggacuggauaagugcuacc

SEQ ID NO: 37552 - RNA, 64 nt, Homo Sapiens
ccaaauuuucuuuaagcagcccagccuucagcguaagugauagugggguacauaugugaacacu

SEQ ID NO: 37553 - RNA, 64 nt, Homo Sapiens
cuguugaauaucagaugguuuggcuuuuguuaggaagugauauuagacuacaacaacuauagga

SEQ ID NO: 37554 - RNA, 64 nt, Homo Sapiens
uaaaaauauacacacauguaucagagugauacaaaagugauauuguuuucaguaugcuaaaaag

SEQ ID NO: 37555 - RNA, 64 nt, Homo Sapiens
cauucaagcaacucuguauuugauugcaguaauaaagugauaagauuuaaauuacuaucauuua

SEQ ID NO: 37556 - RNA, 64 nt, Homo Sapiens
aaacauuaguauuuuagguuucuauaaacacuauaagugauaguuucccccauccuuucauuga

SEQ ID NO: 37557 - RNA, 64 nt, Homo Sapiens
gcugaauucuguuuuuaccaguuucaaaaccuucaagugauauguggaaaaaagugaaugagac

SEQ ID NO: 37558 - RNA, 64 nt, Homo Sapiens
cccuuauuguccuggguggaccaauccaaaggcuaagugauagugacucaucaauguugggucc

SEQ ID NO: 37559 - RNA, 64 nt, Homo Sapiens
guccuaggucccuggguggacccaucaggaccccaagugauagugacccaguggucuuuuagau

SEQ ID NO: 37560 - RNA, 64 nt, Homo Sapiens
aagcgcagaaggcacagccuuacugaccagcacgcccacugacuggcaucugccggcuuugugc

SEQ ID NO: 37561 - RNA, 64 nt, Homo Sapiens
auggcacugaauauccccuuggcagcagagaaaacccacugaaagaucguagaguggcacaugc

SEQ ID NO: 37562 - RNA, 64 nt, Homo Sapiens
ucuuuccaguuagagaagaggaguggugauaaagcccacugaccuucacacauucuaaaaauug

SEQ ID NO: 37563 - RNA, 64 nt, Homo Sapiens
uugcuaaucaaucacagcacuauuuccuauuaagcccacugauuucuucacaauccuucucaaa

SEQ ID NO: 37564 - RNA, 64 nt, Homo Sapiens
gucagggaaaccuaaacugaggucagcacuugggcccacugacagugacugacugggggagaag

SEQ ID NO: 37565 - RNA, 64 nt, Homo Sapiens
aaagauguuuuuagaaccagaagaaaccucgguucccacugauccuucugggccacguugugcg

SEQ ID NO: 37566 - RNA, 64 nt, Homo Sapiens
agagaaggaggaggaagcccauagacccccaagccccacugaggccccuacugaggccagcccc

SEQ ID NO: 37567 - RNA, 64 nt, Homo Sapiens
gauccugggcaugaugggccgagccaccucggaucccacugauuggccagccgagcgagaacca

SEQ ID NO: 37568 - RNA, 64 nt, Homo Sapiens
agguggcagccacccucuaggagacaaaacuacccccacugacaaggcuuuaggagacccuaaa

SEQ ID NO: 37569 - RNA, 64 nt, Homo Sapiens
accauugcuacauuguagguugugaucauuuugccccacugaagcccauguaucugaccuuacg

SEQ ID NO: 37570 - RNA, 64 nt, Homo Sapiens
caagacugucauugccccuccgaugcugaggccacccacugacccaacugauccugcuccagca

SEQ ID NO: 37571 - RNA, 64 nt, Homo Sapiens
cccaacugauccugcuccagcagcacaccucagccccacugacacccaguguccuuccaucuuc

SEQ ID NO: 37572 - RNA, 64 nt, Homo Sapiens
acuuguguguugagcagcucaauuauuuaaccaacccacugaaaaauauagcccacugaccagg

SEQ ID NO: 37573 - RNA, 64 nt, Homo Sapiens
aggaauuauuuaaccaacccuggcaugaauauagcccacugaccuccaguaccaugcuguuuug

SEQ ID NO: 37574 - RNA, 64 nt, Homo Sapiens
auacugcagccccaucccauggggccccugaagacccacugaggaauuccguagggucuuguuc

SEQ ID NO: 37575 - RNA, 64 nt, Homo Sapiens
auugaugcagauggaaggaggaagggagacugggcccacugauuuccagccccaccaugugugc

SEQ ID NO: 37576 - RNA, 64 nt, Homo Sapiens
gcccccucccuguuucuuaucaccagcccaucagcccacugacucccauaugguagaaaaggua

SEQ ID NO: 37577 - RNA, 64 nt, Homo Sapiens
cuggcuuuccuuaggucaggcaagcagacagcuccccacugaagaggucuguacagugacaacc

SEQ ID NO: 37578 - RNA, 64 nt, Homo Sapiens
gguccucucuugcuagacacacuccauagauccccccacugagcuguggaugggcaaaccccgg

SEQ ID NO: 37579 - RNA, 64 nt, Homo Sapiens
gcaaaccccgguggaaucccacccuccccaacaccccacugagcccugggcccccuccucccuu

SEQ ID NO: 37580 - RNA, 64 nt, Homo Sapiens
cuugggagugaggugugggaguagccaccagccucccacugacuaggcauguuaggaauuagac

SEQ ID NO: 37581 - RNA, 64 nt, Homo Sapiens
agcacccaaacacauggcacuuggaagaaaaagacccacugaaucugagaaaguacuuucuggu

SEQ ID NO: 37582 - RNA, 64 nt, Homo Sapiens
agagacccgagggcugcuuugggggaggggggaacucgagaauguauggauuuaccugaaaaca

SEQ ID NO: 37583 - RNA, 64 nt, Homo Sapiens
gucaaggccaagucugcagggaccuguugaaagccucgagaaugucuuggcugcccaagacucu

SEQ ID NO: 37584 - RNA, 64 nt, Homo Sapiens
ggugccacagggaaagcuguagaaggcaagaagacucgagaaucccccagaguuauuuuucucc

SEQ ID NO: 37585 - RNA, 64 nt, Homo Sapiens
auucaucauuacuguggacauggcagcgacguggcucgagaagcagaaaugccugugaagaccu

SEQ ID NO: 37586 - RNA, 64 nt, Homo Sapiens
gucuugucucuguguguuuacagugugugagguucucgagaacugaaaacaaaugggagcauag

SEQ ID NO: 37587 - RNA, 64 nt, Homo Sapiens
agugccgccggugugaugagagagcauguccucccucgagaaacuccucauuugcauuccaaga

SEQ ID NO: 37588 - RNA, 64 nt, Homo Sapiens
aaagaaagauccucugcugaccccuggagcagcucucgagaacuaccuguugguauuguccaca

SEQ ID NO: 37589 - RNA, 64 nt, Homo Sapiens
gagagaaaaaucugcuauuuuucuaaguaagagucucgagaagcagaguuuuugucuugucauu

SEQ ID NO: 37590 - RNA, 64 nt, Homo Sapiens
aaccagggaagcuguccuggcuucugcugaaagacucgagaaccacccuucucuguuggucugc

SEQ ID NO: 37591 - RNA, 64 nt, Homo Sapiens
ugagaggaaggcaaaggccaucgcacagcuuggccucgagaagguuuggaaggaaugccagguc

SEQ ID NO: 37592 - RNA, 64 nt, Homo Sapiens
ggcauuucuagagaacagauauauaauacuauaacucgagaaaaauaaauuuuaauaguuauaa

SEQ ID NO: 37593 - RNA, 64 nt, Homo Sapiens
uagacaugcuuuagaauuauuuuauuugaaguugcucgagaaguguugguagauuacaacucuu

SEQ ID NO: 37594 - RNA, 64 nt, Homo Sapiens
ccaaaguccuaacuuccugugccuuuccuaucaccucgagaaguaauuaucaguugguuuggau

SEQ ID NO: 37595 - RNA, 64 nt, Homo Sapiens
ccaagacagaacucaagaaagccacuggggaaaacucgagaagaaagggaguauacuaguaggu

SEQ ID NO: 37596 - RNA, 64 nt, Homo Sapiens
gagccaagcgcaucgggagccagacaagcacggccucgagaaaauccuggucccugguuggccu

SEQ ID NO: 37597 - RNA, 64 nt, Homo Sapiens
cauggccugccugccuuuuguagccgucugcuaccucgagaagcaagacaacaguaugcugcua

SEQ ID NO: 37598 - RNA, 64 nt, Homo Sapiens
uuuuuuuuuuuaaccaaaaccgacucccauuaaccucgagaacccagccccagagcaccccgcc

SEQ ID NO: 37599 - RNA, 64 nt, Homo Sapiens
agccacugaccuuggcucaccuuagaggaauuuccucgagaacaacagagauaagaaaagaacc

SEQ ID NO: 37600 - RNA, 64 nt, Homo Sapiens
gcaccauuuuauuugguuugucccacuaaaaugacucgagaaguguuuagacaaacuccccuua

SEQ ID NO: 37601 - RNA, 64 nt, Homo Sapiens
gaugcaaucagacaaguguuuuggaaagagcacccucgagaaggguggaugacagggcagagca

SEQ ID NO: 37602 - RNA, 64 nt, Homo Sapiens
cauggacacggcccccagucccaaagugaggucacucgagaauuccagaugccugagccuuugu

SEQ ID NO: 37603 - RNA, 64 nt, Homo Sapiens
aauuuuuuccaaggaaauguaaccuggucgauagcucgagaaaggaaucccuuugcuuaggccc

SEQ ID NO: 37604 - RNA, 64 nt, Homo Sapiens
cacuuuuaaaccuaaagagccuuauuauuauuagcucgagaaauaccacaugccagucuuccca

SEQ ID NO: 37605 - RNA, 64 nt, Homo Sapiens
caccccagcgcagccuggcgccgcgggacugaagcucgagaagggccugaccuaaaggucaggu

SEQ ID NO: 37606 - RNA, 64 nt, Homo Sapiens
caaagggacauuuaagguggcccagauuaguauacucgagaauuuagguucaaaaccuaauucc

SEQ ID NO: 37607 - RNA, 64 nt, Homo Sapiens
uaggucaacaaucuguugugcagaaacaauaacccucgagaaaaaauuacugacccaagccaaa

SEQ ID NO: 37608 - RNA, 64 nt, Homo Sapiens
guuauugcucuagaaaguugcuugugcuagugcccucgagaagaaaagugaaaaucacuaccgc

SEQ ID NO: 37609 - RNA, 64 nt, Homo Sapiens
uaaaaaaaaaaaaaacuuaugacagagacccugucucgagaaaucacugcacuccagcuugggu

SEQ ID NO: 37610 - RNA, 64 nt, Homo Sapiens
gauucuccccuccaguauggacccccacagggcucucgagaacaaggagacgggcugggcggcg

SEQ ID NO: 37611 - RNA, 64 nt, Homo Sapiens
guguuguuucugaugugaaaauaguuaauaaaaacucgagaaauaaaucauauuguaguauuca

SEQ ID NO: 37612 - RNA, 64 nt, Homo Sapiens
uugggaccaguuuccuauaguucuucaaugaccccucgagaacuaaaaauuagcaaaccgaagu

SEQ ID NO: 37613 - RNA, 64 nt, Homo Sapiens
gaucaaggcucuggcauucagagaacccuugcaacucgagaagcuguuuuuauuucguuuuugu

SEQ ID NO: 37614 - RNA, 64 nt, Homo Sapiens
agugggggccagccugaggacccccgccuaccaccucgagaacuggaagccaaccucuaaccuc

SEQ ID NO: 37615 - RNA, 64 nt, Homo Sapiens
uguaagccacuagucuguggcauuguuauagcagcucgagaagacuaaggcagaugggcuucca

SEQ ID NO: 37616 - RNA, 64 nt, Homo Sapiens
agaggaacucagaaggcaacagcugaacggauugcucgagaaagcugaaggaacgucguaagga

SEQ ID NO: 37617 - RNA, 64 nt, Homo Sapiens
uucaaucacuguauagaaugcuauaaauacgaaacucgagaagaucaugcaagcgcucuaauuc

SEQ ID NO: 37618 - RNA, 64 nt, Homo Sapiens
cagaugccaugguaugggccacaggacacacuugcucgagaaccaaagugcauuugggugacau

SEQ ID NO: 37619 - RNA, 64 nt, Homo Sapiens
ugagauagggucaccugagcuguagucccaccuacucgagaagccgagcaugguggcacaugcc

SEQ ID NO: 37620 - RNA, 64 nt, Homo Sapiens
uucugaaggccaugacaccucaauaaauaugaaccucgagaaagaaggacucuaggucaaaugu

SEQ ID NO: 37621 - RNA, 64 nt, Homo Sapiens
gauauauguguuccuuuuagagagcugucuagaacucgagaaucauggcaccacagacgugaaa

SEQ ID NO: 37622 - RNA, 64 nt, Homo Sapiens
cauggcgcucccuucaacagcaagccugacuguucucgagaacucugcaaucuuuuaaauaagc

SEQ ID NO: 37623 - RNA, 64 nt, Homo Sapiens
agagcuggccgcgccaaauaaugucucugugagacucgagaacuuucauuuuuuuccaggcugg

SEQ ID NO: 37624 - RNA, 64 nt, Homo Sapiens
acuccuccauauucuuucaacccacaugagucuccucgagaagugaggagaggcaguuuggagc

SEQ ID NO: 37625 - RNA, 64 nt, Homo Sapiens
uucacgcccuccaucucacagucaagauaaaggccucgagaauaaagagccagcccccuuccau

SEQ ID NO: 37626 - RNA, 64 nt, Homo Sapiens
ggggggcagcuugcugacccgcuaaggaaggggacucgagaaugccucuucagagccugcacuc

SEQ ID NO: 37627 - RNA, 64 nt, Homo Sapiens
augaaaauuguguuacuauaaugccuuauuuuaccucgagaauuguuaccuuaaauuaguacag

SEQ ID NO: 37628 - RNA, 64 nt, Homo Sapiens
gccugcuccuaacaauucagccugggcucagaaucucgagaacccaugguucacagaaaaggau

SEQ ID NO: 37629 - RNA, 64 nt, Homo Sapiens
cuuuggggagaugggcgauaaguguugagguaggcucgagaacugcuccccaaaucagugagaa

SEQ ID NO: 37630 - RNA, 64 nt, Homo Sapiens
agucacucagacaagccauaaaacaggcuggggccucgagaaggaccauuuggggucugaggag

SEQ ID NO: 37631 - RNA, 64 nt, Homo Sapiens
uucccaugcuucaggaaguuaaccuuggccuggucucgagaagcguggugccaugaaggaaaga

SEQ ID NO: 37632 - RNA, 60 nt, Homo Sapiens
gcggcccagggugggccagaccagcagcccaggaagcagcacacgcggccguggggaggc

SEQ ID NO: 37633 - RNA, 60 nt, Homo Sapiens
gagacgaggauacccagcgaaagggacgggaggaagcauccgaaaccuaggauucguccu

SEQ ID NO: 37634 - RNA, 60 nt, Homo Sapiens
gcugcuccucuguccugcuagccuuccuccaggaagcacacugggugcagauaaucagga

SEQ ID NO: 37635 - RNA, 60 nt, Homo Sapiens
gaaugcuaccauuuuuuuuccaaaguagaaaggaagcacuucugagccagugaccacuga

SEQ ID NO: 37636 - RNA, 60 nt, Homo Sapiens
aaaccaguguagccuugcccggauucugggaggaagcagguugaggggcuccuggaaagg

SEQ ID NO: 37637 - RNA, 60 nt, Homo Sapiens
cagcgaccugccugucaugcccacccccugaggaagcauggggacccuaacacccuggug

SEQ ID NO: 37638 - RNA, 60 nt, Homo Sapiens
gcacaauuuaauauauucaagaguggggggaggaagcagaggucuucagggcucuuuuuu

SEQ ID NO: 37639 - RNA, 60 nt, Homo Sapiens
uuccucuuuuuauagugguggcuggcaagaaggaagcaguucuccacguucucaccuaag

SEQ ID NO: 37640 - RNA, 60 nt, Homo Sapiens
cugcaaaggggacccccaggugggaggggcaggaagcagccggagugagcccuucgcccc

SEQ ID NO: 37641 - RNA, 60 nt, Homo Sapiens
agccccaggagcugugccacccaaauccagaggaagcaaggaggagggaggugggguagg

SEQ ID NO: 37642 - RNA, 60 nt, Homo Sapiens
uacuugaguuuggagucagaaagcaagaccaggaagcaaauagcagcucaggaaauccca

SEQ ID NO: 37643 - RNA, 60 nt, Homo Sapiens
ucuucauaaauuagugcuguuuacuuucagaggaagcagagaaguugcuguuauguuuuu

SEQ ID NO: 37644 - RNA, 60 nt, Homo Sapiens
ucacuacugguaauuaaggggaaggauaugaggaagcaguuuaaauagcccuguucucau

SEQ ID NO: 37645 - RNA, 60 nt, Homo Sapiens
ugucugggguauucacuuggcuccucagcaaggaagcaaacgccuuggaggagaagcaca

SEQ ID NO: 37646 - RNA, 60 nt, Homo Sapiens
ugcguugcuaccuugcuucugugagaauucaggaagcaggugagaggagucaagccaaua

SEQ ID NO: 37647 - RNA, 60 nt, Homo Sapiens
uauccuuugaccaucugcacuuuauuuggaaggaagcaggggcuguccacccugaaaaag

SEQ ID NO: 37648 - RNA, 60 nt, Homo Sapiens
guauuacagugccacguuggaaaacgcuacaggaagcaugaccuauccacaucuuuccaa

SEQ ID NO: 37649 - RNA, 60 nt, Homo Sapiens
uuggcauagaagaauguaaagaaucauuaaaggaagcagggccuaggagacacgugaaac

SEQ ID NO: 37650 - RNA, 60 nt, Homo Sapiens
caaucucuuuuuuuccuugcucacauuaaaaggaagcauggaguucuaaugcucccauaa

SEQ ID NO: 37651 - RNA, 60 nt, Homo Sapiens
ccucucacaucuccuccugcccaagauguaaggaagcauuguaaggauuucuucccaucg

SEQ ID NO: 37652 - RNA, 60 nt, Homo Sapiens
cucuguauccagaacacacuuggcagauggaggaagcaucugaguuugagaccauggcug

SEQ ID NO: 37653 - RNA, 60 nt, Homo Sapiens
cagccugggcagccaucacaccacgaggacaggaagcaccagcacguuucacaccucccc

SEQ ID NO: 37654 - RNA, 60 nt, Homo Sapiens
aggaaaauggaagaccuaaggcagacaggaaggaagcacaaaagacaagcauugggucag

SEQ ID NO: 37655 - RNA, 60 nt, Homo Sapiens
guuggggcccaaaagacagucugaagaggaaggaagcagcaguaucugcguagcccacag

SEQ ID NO: 37656 - RNA, 60 nt, Homo Sapiens
cuggccccauccucuccucacuguaaugugaggaagcaccucugugucagggcucaccug

SEQ ID NO: 37657 - RNA, 60 nt, Homo Sapiens
uuuguuggaaaaacaugaauucauaaauucaggaagcacaauauauaccaaacauauauu

SEQ ID NO: 37658 - RNA, 60 nt, Homo Sapiens
aaaccaugugcuuauuagaugguuccacucaggaagcaaggaagcuaaaacucaaguuaa

SEQ ID NO: 37659 - RNA, 60 nt, Homo Sapiens
cagccaaggagaagaauggcccaaggaacuaggaagcagccaugggagaggggaaggguu

SEQ ID NO: 37660 - RNA, 60 nt, Homo Sapiens
guugcucaacacaucaccucggacaaauucaggaagcauuucuuuagcccacaaguccag

SEQ ID NO: 37661 - RNA, 60 nt, Homo Sapiens
ccgcuuuggggagcgccucgcuucacggacaggaagcacagcagguuuauccagaugaac

SEQ ID NO: 37662 - RNA, 60 nt, Homo Sapiens
gaccgagcgcuggucauuuucacuuggcugaggaagcagagcccaccuggcugaccugug

SEQ ID NO: 37663 - RNA, 60 nt, Homo Sapiens
aggaaaggaagacguuuugaacacugauguaggaagcacguaaaguuguacuaggcaaac

SEQ ID NO: 37664 - RNA, 60 nt, Homo Sapiens
uaugaauccauuguccuuguaugccuucuuaggaagcagcugcacccaaggggccucucc

SEQ ID NO: 37665 - RNA, 60 nt, Homo Sapiens
gcagagauuaagagcagaaaccccagaggaaggaagcacuuuccuaaaggucuccucagu

SEQ ID NO: 37666 - RNA, 60 nt, Homo Sapiens
cuggugcuaaguauuuuuuauuuggcauauaggaagcacgugaaguaguuugaugauuug

SEQ ID NO: 37667 - RNA, 60 nt, Homo Sapiens
ugccucucucaggccaaacuccaaggccaaaggaagcacaaaagcugccagccgagauag

SEQ ID NO: 37668 - RNA, 60 nt, Homo Sapiens
ccuugugcaagaucacauagagauucagagaggaagcaucuucucuagacuuggaagcug

SEQ ID NO: 37669 - RNA, 60 nt, Homo Sapiens
ccuguguacagaugcgaucauaaauguaaaaggaagcacuaacuucaaacaauauagaau

SEQ ID NO: 37670 - RNA, 60 nt, Homo Sapiens
agcugagcaccugcccucacugcuccaagaaggaagcaguagccaaacuccuuggucacc

SEQ ID NO: 37671 - RNA, 60 nt, Homo Sapiens
gguugcagugagccucgauuccuugagcccaggaagcagagaggcugagacacacgaauc

SEQ ID NO: 37672 - RNA, 60 nt, Homo Sapiens
ucuaaaauguauccccuuucucugucuugaaggaagcauuggucuccuuucuuucucacu

SEQ ID NO: 37673 - RNA, 50 nt, Homo Sapiens
guuggagcuacugcaaaugcaggaagcacuccccacugaauguuucauaa

SEQ ID NO: 37674 - RNA, 60 nt, Homo Sapiens
ucuuucuuguuauccaacauaagagugaaaaggaagcaucucaggcugacagggagggca

SEQ ID NO: 37675 - RNA, 60 nt, Homo Sapiens
ggcccuccuggcagcuccucgggcagaggcaggaagcaggucaaaaagcacaaagagcug

SEQ ID NO: 37676 - RNA, 60 nt, Homo Sapiens
ugugaucacaucaccccgucguuguggagaaggaagcagaugcccgccagcccugcucuu

SEQ ID NO: 37677 - RNA, 60 nt, Homo Sapiens
gccagauccuauaggaaugauggucaguguaggaagcacacugaacacaugaaucuuuuu

SEQ ID NO: 37678 - RNA, 60 nt, Homo Sapiens
agaguuccugguuauggcagaaauagccugaggaagcagguccuucccccucagagaacc

SEQ ID NO: 37679 - RNA, 60 nt, Homo Sapiens
ucgacuugagaucaacgugcgagaaguacaaggaagcagcugaagaucauuaagaaugug

SEQ ID NO: 37680 - RNA, 60 nt, Homo Sapiens
gaauggucagagaaugggauauuaaaaacaaggaagcagagaggaucacucucaaaugag

SEQ ID NO: 37681 - RNA, 60 nt, Homo Sapiens
auagcuccucuggccagcauuaacuucuaaaggaagcagaacaagccacaauaaaaagca

SEQ ID NO: 37682 - RNA, 60 nt, Homo Sapiens
gaugucgcaggaauccgcuggaguaugugaaggaagcagguguguuuugcaacauauuaa

SEQ ID NO: 37683 - RNA, 60 nt, Homo Sapiens
aucgcugugcuaggucugacugccccagcuaggaagcaagucuuugaggugagggugggg

SEQ ID NO: 37684 - RNA, 60 nt, Homo Sapiens
agcaguaaggacaaggggccuugcagucacaggaagcagcgagugccuccuuaguggugc

SEQ ID NO: 37685 - RNA, 60 nt, Homo Sapiens
gaugcagaccccaaggagacagaggcugccaggaagcagacaaauccccaagucgacuca

SEQ ID NO: 37686 - RNA, 60 nt, Homo Sapiens
ggaggaaagaaugcauuacucuaaaauucaaggaagcagugauucuccuaauuuuuaaca

SEQ ID NO: 37687 - RNA, 60 nt, Homo Sapiens
agccuggaccuaccaccugcggagcccccuaggaagcaccccagaugagcccugccucug

SEQ ID NO: 37688 - RNA, 60 nt, Homo Sapiens
gacgcccugcaugguuacaacaagacuugaaggaagcaaaucugggacgugguucaaguu

SEQ ID NO: 37689 - RNA, 60 nt, Homo Sapiens
ugguagaaggacugaacaacggaauugauuaggaagcauuuauaucacuaagcuguggcu

SEQ ID NO: 37690 - RNA, 60 nt, Homo Sapiens
ggaugcuagccccagagaugccagcccuucaggaagcagguguccuuuccccucucugcc

SEQ ID NO: 37691 - RNA, 60 nt, Homo Sapiens
uggguuugccaaacgccuaauuaccaggccaggaagcaugccaacaaagccacacgggug

SEQ ID NO: 37692 - RNA, 60 nt, Homo Sapiens
ggucucugggucggucagugacauguagguaggaagcacugaaaauaguguucccagagc

SEQ ID NO: 37693 - RNA, 60 nt, Homo Sapiens
gaggcugaggcacaauaauuguuugaacccaggaagcagagguugcagugagcugagauc

SEQ ID NO: 37694 - RNA, 60 nt, Homo Sapiens
ugaugagauaucaaguuuugaauauuauucaggaagcacuuuggagaaugugggaguccu

SEQ ID NO: 37695 - RNA, 60 nt, Homo Sapiens
ugcaauugcacaaauacaagccaagcuagaaggaagcaccuaugaaagcaacaacuuugu

SEQ ID NO: 37696 - RNA, 60 nt, Homo Sapiens
ugucauauuuuuuucacccugccuuuccacaggaagcacucacaggcaccacacacguau

SEQ ID NO: 37697 - RNA, 60 nt, Homo Sapiens
guuuauauuuugugcuuauucauacaagacaggaagcacggucuuaggcggauggaggcc

SEQ ID NO: 37698 - RNA, 60 nt, Homo Sapiens
agaugucucccugugggaaagcccuggaaaaggaagcaggggauguauucagccuacguu

SEQ ID NO: 37699 - RNA, 60 nt, Homo Sapiens
cucuggaggccagaaagaaauuuccuacaaaggaagcagugggaaguguuuauuguuccu

SEQ ID NO: 37700 - RNA, 60 nt, Homo Sapiens
ggauggaucccuuucaucccgccaucuuaaaggaagcaauagaaaacccacugccuagag

SEQ ID NO: 37701 - RNA, 60 nt, Homo Sapiens
aaauuugauugcucuaaauugcauuaagauaggaagcagggguguuggaggaggguuuaa

SEQ ID NO: 37702 - RNA, 60 nt, Homo Sapiens
uuaaaugagaccuguccucuguuggaccagaggaagcagguagcccuaguaguuuuuuag

SEQ ID NO: 37703 - RNA, 60 nt, Homo Sapiens
uuuccugcugcagauuccugauguuaauagaggaagcagucaucugugcuucagucauag

SEQ ID NO: 37704 - RNA, 60 nt, Homo Sapiens
acacagcguuaggagccguucccagcagggaggaagcaucaaagauuugcaguuugacag

SEQ ID NO: 37705 - RNA, 60 nt, Homo Sapiens
gccuguauugcagucuucauuugaauguaaaggaagcaagucuguagaaucuuacuggua

SEQ ID NO: 37706 - RNA, 60 nt, Homo Sapiens
cauucuuucuacuaaauccaguuuuuuuaaaggaagcagugaagcaagauuucuauauuu

SEQ ID NO: 37707 - RNA, 60 nt, Homo Sapiens
aauaguuuuugucgcuaacuggaucucccaaggaagcacaauauggcucagagcagagcc

SEQ ID NO: 37708 - RNA, 60 nt, Homo Sapiens
uuugcuuaaaauuguauaccaaaccauagcaggaagcaacacaugcuuuuuguagcauuc

SEQ ID NO: 37709 - RNA, 60 nt, Homo Sapiens
guagcuuugaauuuucucuguguaaauguuaggaagcaaauuaaacauuuuuaguugcug

SEQ ID NO: 37710 - RNA, 60 nt, Homo Sapiens
aacaaaauuauugaaaaauucuuaaauaaaaggaagcaaaaacuauaaauuuuucaaggu

SEQ ID NO: 37711 - RNA, 60 nt, Homo Sapiens
ugaaaaaguuuaaagacugugcaccaagaaaggaagcaaaaugacaggauaaacucugac

SEQ ID NO: 37712 - RNA, 60 nt, Homo Sapiens
gguugcagugagcugagaucgcuugaacccaggaagcagagaggcugaggcaggaggauc

SEQ ID NO: 37713 - RNA, 60 nt, Homo Sapiens
gaucaaaucaccuuggaguggacccaacagaggaagcacauaauagcccguuucgucucu

SEQ ID NO: 37714 - RNA, 60 nt, Homo Sapiens
aucccuuaaucuaugugcaccuaguucagaaggaagcaaaugaagccucuaacaaaugau

SEQ ID NO: 37715 - RNA, 60 nt, Homo Sapiens
aacaaaugucuuaaagggaaucauuuuuguaggaagcauuuuuuauaauuuucuaagucg

SEQ ID NO: 37716 - RNA, 60 nt, Homo Sapiens
ggugaucagcagagagauugaacuuugaggaggaagcagaaucuuugcaagaaagucaga

SEQ ID NO: 37717 - RNA, 60 nt, Homo Sapiens
ccaacccugccuugaagcaauucaauaaagaggaagcaaacagccaggcucccugagggc

SEQ ID NO: 37718 - RNA, 60 nt, Homo Sapiens
cuuuggaggcaugguggaugaaaggcgcaaaggaagcaagagguuaaagauaauggccca

SEQ ID NO: 37719 - RNA, 60 nt, Homo Sapiens
caaaaguuaaacguucuaaaaagaggcgaaaggaagcaagcaguucagaagagccaagga

SEQ ID NO: 37720 - RNA, 60 nt, Homo Sapiens
auaugaacggugagcauuguggcugucagcaggaagcaacgaagggaaaugucuuuccuu

SEQ ID NO: 37721 - RNA, 60 nt, Homo Sapiens
gcgugugugcagggagacuggguaggaaagaggaagcaaauagaagagagagguugaaaa

SEQ ID NO: 37722 - RNA, 60 nt, Homo Sapiens
ggggagggagcacucugggacugugagacaaggaagcagggccagcagugagacuaugag

SEQ ID NO: 37723 - RNA, 60 nt, Homo Sapiens
ucuuucauuaggaacauuuugcuggugaugaggaagcauuuagcugaauaaguuuaaagc

SEQ ID NO: 37724 - RNA, 60 nt, Homo Sapiens
gccaaguuacuuucucauauacagcauuuuaggaagcaugauuuuuuuuuucuaucaucu

SEQ ID NO: 37725 - RNA, 60 nt, Homo Sapiens
aacuuccuucugcuucuaccagauggcccaaggaagcacaucguccuguuuuauugcuuu

SEQ ID NO: 37726 - RNA, 60 nt, Homo Sapiens
uuaauuggcucauggcucugcaggcuuuacaggaagcaugguacuggcaucugcuugguu

SEQ ID NO: 37727 - RNA, 60 nt, Homo Sapiens
ggaucacugacaaaaaacacugcaccaguaaggaagcaacuaaauuuuguuuuguucuuu

SEQ ID NO: 37728 - RNA, 60 nt, Homo Sapiens
gacuuuaguaaauuugucaauauagaugguaggaagcagaaugccauuuuauuaaaacac

SEQ ID NO: 37729 - RNA, 60 nt, Homo Sapiens
aucugccaauagacccaggacgaguaagagaggaagcaucaaccuuuuaaaaauuuccuu

SEQ ID NO: 37730 - RNA, 60 nt, Homo Sapiens
gaggcugaggcacaagaaucgcuugaauccaggaagcaagcggagguugcagugaguuga

SEQ ID NO: 37731 - RNA, 60 nt, Homo Sapiens
ccugacaaagcuguuugcucuuggguugggaggaagcaaaugcaagcugggcugggucua

SEQ ID NO: 37732 - RNA, 60 nt, Homo Sapiens
uccauaacaugacauaucuguaucaucuucaggaagcaaguucuuucuaucaacugcuga

SEQ ID NO: 37733 - RNA, 60 nt, Homo Sapiens
gaaucacaaggaaccucuggagaggagaggaggaagcaaauuccuuagcagggaggagga

SEQ ID NO: 37734 - RNA, 60 nt, Homo Sapiens
guugguuucccuucuuuuugaacaggcaaaaggaagcagggcuuuauugcagcgauuaau

SEQ ID NO: 37735 - RNA, 60 nt, Homo Sapiens
gguugcaguaagcugagaucgcuugaacccaggaagcagagaggcugaggcaggagaauu

SEQ ID NO: 37736 - RNA, 60 nt, Homo Sapiens
cccucuucuacaggggucuguccggaauuuaggaagcauuacugaauccuugcagcgacu

SEQ ID NO: 37737 - RNA, 60 nt, Homo Sapiens
uccagggagagucagguucccuccauggcaaggaagcaguccucugagaucaugugaguc

SEQ ID NO: 37738 - RNA, 60 nt, Homo Sapiens
aacugugcacagaaguggauacucacagugaggaagcaaaugcacuuucggggaaggagg

SEQ ID NO: 37739 - RNA, 60 nt, Homo Sapiens
auccaaaaaugcuuaauaaacuuaagugguaggaagcaacauuaaaaugcauuuuuuauu

SEQ ID NO: 37740 - RNA, 60 nt, Homo Sapiens
auuacgaacauuuaggaaccaaaacaguuuaggaagcauagguucucuugccguagaaca

SEQ ID NO: 37741 - RNA, 60 nt, Homo Sapiens
ucaauuccaauauuuuauaacugagugcuaaggaagcauaaacuucaauguaccauuuua

SEQ ID NO: 37742 - RNA, 60 nt, Homo Sapiens
caaccucuuuugugugaauucuuuuagaggaggaagcauauaugagcaaauguauugcuu

SEQ ID NO: 37743 - RNA, 60 nt, Homo Sapiens
aucccacugagcaccucuugugaagaagagaggaagcagggcaaggaauuuaucuucagg

SEQ ID NO: 37744 - RNA, 60 nt, Homo Sapiens
uuuaauguuuucucucucacacagcuuuguaggaagcacucaacuggguauauaucacua

SEQ ID NO: 37745 - RNA, 60 nt, Homo Sapiens
gguuugcccacagaccuguccccuccagacaggaagcaugaggggcaucccggcccauac

SEQ ID NO: 37746 - RNA, 60 nt, Homo Sapiens
cugaccgcgggugucacgggcauuucucaaaggaagcaggggauucagugagugugaagg

SEQ ID NO: 37747 - RNA, 60 nt, Homo Sapiens
auugguggagcggcucccuauuuauacaauaggaagcaugggugcuuagaaaguuuauuu

SEQ ID NO: 37748 - RNA, 60 nt, Homo Sapiens
gaugucaaaaugaagauaguaaaacaagggaggaagcaguggauggaccaggauuaauuc

SEQ ID NO: 37749 - RNA, 60 nt, Homo Sapiens
uacaaaggcaugacucuggcggugguccuaaggaagcaugagcagaaaauucauaaaaau

SEQ ID NO: 37750 - RNA, 60 nt, Homo Sapiens
ucccuaaguauucuacaauggaaagaauggaggaagcacuucaaguagccaucaacaaca

SEQ ID NO: 37751 - RNA, 60 nt, Homo Sapiens
ccagcgcccacaugggcaugacaucuguacaggaagcaucuguguaacugaaggcaugag

SEQ ID NO: 37752 - RNA, 60 nt, Homo Sapiens
gucaagguauaaacuuucgugcauuccccaaggaagcagaacagugugccuguaaaaugg

SEQ ID NO: 37753 - RNA, 51 nt, Homo Sapiens
cacacccccaacuccuggacaaggaagcaucugagcucuccuccuguuuaa

SEQ ID NO: 37754 - RNA, 60 nt, Homo Sapiens
uuguguuguuaagaagcuuucacuagcuucaggaagcaugacacaguguuauaacucaag

SEQ ID NO: 37755 - RNA, 60 nt, Homo Sapiens
caagucgguuaguggaagcauaagcgcuagaggaagcagcgaaagggaacggugaaguac

SEQ ID NO: 37756 - RNA, 60 nt, Homo Sapiens
aaccacaaagcuuccgcucauuuaauuuaaaggaagcaguaccuagaaguuuguuuugcu

SEQ ID NO: 37757 - RNA, 60 nt, Homo Sapiens
gaagcgaaggauauauuauguaauauggucaggaagcaagaaaauguauaugaaugcucc

SEQ ID NO: 37758 - RNA, 60 nt, Homo Sapiens
uaccuugcaaagcaacuaguguuauaggaaaggaagcagacuaagaguaaagcaacucaa

SEQ ID NO: 37759 - RNA, 60 nt, Homo Sapiens
gcaguggugggugucugaaaggaaagggaaaggaagcaggcauuaucuucauucugcaag

SEQ ID NO: 37760 - RNA, 60 nt, Homo Sapiens
aauuaauuagaucaacacuucauggccacgaggaagcagcaagcuguagcuggagaagcc

SEQ ID NO: 37761 - RNA, 60 nt, Homo Sapiens
cacgagcugacccagcagaauucucuguguaggaagcaucggacuuuguccauugaauau

SEQ ID NO: 37762 - RNA, 60 nt, Homo Sapiens
aguauuucccauuuaucgcagaccuuuuuuaggaagcaagcuuaauggcugauaauuuua

SEQ ID NO: 37763 - RNA, 60 nt, Homo Sapiens
cuauguuguaaaugaucaacuacaauauucaggaagcacauuuauucagauucucaguaa

SEQ ID NO: 37764 - RNA, 60 nt, Homo Sapiens
ggagcugguucacuguaacuagcaggccacaggaagcaaagccuuggugccugugagcuc

SEQ ID NO: 37765 - RNA, 60 nt, Homo Sapiens
caaaguucauugguucaguggugugaagaaaggaagcacaauuggcagguuaucacuuuc

SEQ ID NO: 37766 - RNA, 54 nt, Homo Sapiens
ucgaccgcuucgauaauuaaaccaaggaagcaaucuguaacugcuuuucggaac

SEQ ID NO: 37767 - RNA, 60 nt, Homo Sapiens
uuagaacuaccaucuucauauacaggagaaaggaagcauuuaaauuuuuauagugauuau

SEQ ID NO: 37768 - RNA, 60 nt, Homo Sapiens
ucugugccagauugcccggucugacccugcaggaagcaaagaggugagcuuaaagaacaa

SEQ ID NO: 37769 - RNA, 60 nt, Homo Sapiens
augaccugugguaagcaaccugggcaucuuaggaagcagucccuggagaaggcauguucc

SEQ ID NO: 37770 - RNA, 60 nt, Homo Sapiens
uuaccuccugaccugaggguggagaguggcaggaagcaagcauguuugcugugcacuuag

SEQ ID NO: 37771 - RNA, 60 nt, Homo Sapiens
gucagacuccuagagggccuccagacuaauaggaagcauuucuguaaccaaccugccacc

SEQ ID NO: 37772 - RNA, 60 nt, Homo Sapiens
uugauuugcauucuggaaagcucucccaggaggaagcauuccccaccccaccuugccucu

SEQ ID NO: 37773 - RNA, 60 nt, Homo Sapiens
uuuggggaaggaggccguaggccggcccggaggaagcaauuccacuugguuugacaacuu

SEQ ID NO: 37774 - RNA, 60 nt, Homo Sapiens
gagcuggagcugguuggacuaaugagacugaggaagcagcuuuuccuacgaucugcauua

SEQ ID NO: 37775 - RNA, 60 nt, Homo Sapiens
aggaaguuaaagguugucuuauucccccagaggaagcagauuccuggccaugacagugug

SEQ ID NO: 37776 - RNA, 60 nt, Homo Sapiens
auaaauggguauguaggaugagggagaaaaaggaagcaagucuuauacuagugggacaaa

SEQ ID NO: 37777 - RNA, 60 nt, Homo Sapiens
gggagggacugggcagggacgaagagugggaggaagcagacagagcccuuuccgcaugug

SEQ ID NO: 37778 - RNA, 60 nt, Homo Sapiens
ucaaacguuuaacuuuauuucaagagaaguaggaagcauaauuucucaaugcuaacuaau

SEQ ID NO: 37779 - RNA, 60 nt, Homo Sapiens
uaaagggauaguugcuuugucuagacaagaaggaagcaggaaaaugugaaagacugggug

SEQ ID NO: 37780 - RNA, 60 nt, Homo Sapiens
cacaacaugcauuuauggagguagaaaccaaggaagcagaagaaauuggugggaaaauag

SEQ ID NO: 37781 - RNA, 60 nt, Homo Sapiens
gcauguuuuaguugagugcuaugucuccaaaggaagcaagcuuugggggaccuggaagaa

SEQ ID NO: 37782 - RNA, 60 nt, Homo Sapiens
ugagaacugcccagucuucaguucuccuacaggaagcagaagcucacuguuuuuccuuga

SEQ ID NO: 37783 - RNA, 60 nt, Homo Sapiens
guauauaacaggaaaagaaacuuccaggaaaggaagcaugcaccaaggucugaaaaauga

SEQ ID NO: 37784 - RNA, 60 nt, Homo Sapiens
agggcaacuauagugaggccgagagagcuuaggaagcaugaauuagaguuauuagagcaa

SEQ ID NO: 37785 - RNA, 60 nt, Homo Sapiens
gagcaaaucccaccuuuaccgcugcuccuaaggaagcagguuagugguguggcacuggga

SEQ ID NO: 37786 - RNA, 60 nt, Homo Sapiens
cucuuuggucaguaacaaguaauaagugcaaggaagcagucacaaacucucaauaucuaa

SEQ ID NO: 37787 - RNA, 60 nt, Homo Sapiens
aacucccccaagcugacucacacaccaagcaggaagcacagaccuuggcauguggcuggc

SEQ ID NO: 37788 - RNA, 60 nt, Homo Sapiens
aaacuuauaaauauuucuccagcaaauuugaggaagcaugauauauuugaauuaacacca

SEQ ID NO: 37789 - RNA, 60 nt, Homo Sapiens
uuccucaguaaccuccaucuaaaaucuccaaggaagcaauaaauuccuuuuaugagaucu

SEQ ID NO: 37790 - RNA, 60 nt, Homo Sapiens
cugugcuguugguucccaaaacuagaaagaaggaagcagggagcggugccccaagcaugg

SEQ ID NO: 37791 - RNA, 60 nt, Homo Sapiens
cuguggggcugggcaccguguccuccucugaggaagcaguuggggcccucuugccagccu

SEQ ID NO: 37792 - RNA, 60 nt, Homo Sapiens
accuaggggacugccucugugccucuccccaggaagcauccagggcagaggaagccacau

SEQ ID NO: 37793 - RNA, 60 nt, Homo Sapiens
uuuggagcuagaguugcuuccuggugagagaggaagcaacucuccuucugguugucugcc

SEQ ID NO: 37794 - RNA, 60 nt, Homo Sapiens
ucccuaccuugcaugguaauauaaaggacuaggaagcagucauacuuccaggaaaugcuu

SEQ ID NO: 37795 - RNA, 60 nt, Homo Sapiens
uaauaaucuuuugcuugguuauacuaggcuaggaagcaauaucaaagcccuuaaauucuc

SEQ ID NO: 37796 - RNA, 60 nt, Homo Sapiens
aaagccgcuuccugucauuaagcaucucagaggaagcagcccucccucgauggccucuag

SEQ ID NO: 37797 - RNA, 60 nt, Homo Sapiens
ggagaacaagccucaacuaacaaacccuucaggaagcauauaccggggaauguguagccu

SEQ ID NO: 37798 - RNA, 60 nt, Homo Sapiens
acuaucucagugguauuuugcauuggaaaaaggaagcacuguguagcagugaauugucug

SEQ ID NO: 37799 - RNA, 60 nt, Homo Sapiens
uaaagaagacugaccuucgucucugucagcaggaagcagucagaacaaccacuacagccc

SEQ ID NO: 37800 - RNA, 60 nt, Homo Sapiens
gagggugugucuuuguacuugcuuccucauaggaagcacugccaccuuuugauugauugg

SEQ ID NO: 37801 - RNA, 60 nt, Homo Sapiens
cuuaacaaaggcucuuuucauggcuuuuuaaggaagcaguuaaaacgagaacucuuauau

SEQ ID NO: 37802 - RNA, 60 nt, Homo Sapiens
ggguccccauccccagcuggcaggggacucaggaagcaggggaaagggagaggggaaggg

SEQ ID NO: 37803 - RNA, 60 nt, Homo Sapiens
agcauugaccauuuuuucccguuuauuaaaaggaagcagaguauaauaaucaagaaauua

SEQ ID NO: 37804 - RNA, 60 nt, Homo Sapiens
ucaucagagccgcucagcucgaggccgggcaggaagcaaggcauccacugcgggugacug

SEQ ID NO: 37805 - RNA, 60 nt, Homo Sapiens
gacucuccugagugagaagagccaaccaguaggaagcauguguugggucagccugaaacu

SEQ ID NO: 37806 - RNA, 60 nt, Homo Sapiens
acagaacgaaagagaucuuucuauauuuggaggaagcauucuguuuguucaggcagagag

SEQ ID NO: 37807 - RNA, 60 nt, Homo Sapiens
guucuuuauagugauucucuuucauaaaccaggaagcaauaguagaagauaaacuuuuua

SEQ ID NO: 37808 - RNA, 60 nt, Homo Sapiens
ugccaagcuuggucaucuauccaccgucacaggaagcacuuuaucgaggcacauacuuca

SEQ ID NO: 37809 - RNA, 60 nt, Homo Sapiens
uuuuuaaacggcuuuuuguaacuucgcugcaggaagcagguuuguuucuuuuucuuuucu

SEQ ID NO: 37810 - RNA, 60 nt, Homo Sapiens
gacacaucugugucaucacgcacugaagacaggaagcaguucacugagucagcugguucc

SEQ ID NO: 37811 - RNA, 60 nt, Homo Sapiens
guggcagcccuggggcccuuucccuucuggaggaagcacaagccucagggaaggggaagc

SEQ ID NO: 37812 - RNA, 60 nt, Homo Sapiens
uguacaauaucuaaaaagaaagugacaugaaggaagcaaucuacaacuuccuuccgcuua

SEQ ID NO: 37813 - RNA, 60 nt, Homo Sapiens
ugucacagggccaacuugagggcccagagcaggaagcauucagagagcagcuuuaaacuc

SEQ ID NO: 37814 - RNA, 60 nt, Homo Sapiens
gccaagaggcugaucaagcgucauuuauugaggaagcaucuuagaaaaugccucugaaug

SEQ ID NO: 37815 - RNA, 60 nt, Homo Sapiens
uauuuugauauguaucuauucaugauugaaaggaagcagucuuggccaggcacgguggcu

SEQ ID NO: 37816 - RNA, 60 nt, Homo Sapiens
gugaaagggaaguaggaccagagaaguggaaggaagcaaaauggaggugaugagaaaggu

SEQ ID NO: 37817 - RNA, 60 nt, Homo Sapiens
ccgugaaugccagacuuuaagauugcccggaggaagcaaacucuucguauaaaaaaagca

SEQ ID NO: 37818 - RNA, 60 nt, Homo Sapiens
uuauaacauuuggauauuacugaaaauguaaggaagcaggaaaaauuaacuacuuucauu

SEQ ID NO: 37819 - RNA, 60 nt, Homo Sapiens
guucagcacacuccugggcauggcggaagcaggaagcagacuccagagggccucccuguu

SEQ ID NO: 37820 - RNA, 60 nt, Homo Sapiens
aaacucaaugaaaugacaugccuuuuuagcaggaagcaaaguugguuucuguuuuuuguu

SEQ ID NO: 37821 - RNA, 60 nt, Homo Sapiens
acucacuaaguauggaaaacugauucugggaggaagcagaaaugucccuagauaacagca

SEQ ID NO: 37822 - RNA, 60 nt, Homo Sapiens
caugguccuggaaaauugggucuucagaaaaggaagcagguaauacaagcaacauuaaca

SEQ ID NO: 37823 - RNA, 60 nt, Homo Sapiens
cuguagauuuaagggcacuccacagacaugaggaagcagggcauuuauccaaauucugcu

SEQ ID NO: 37824 - RNA, 60 nt, Homo Sapiens
ugaacuuguuccucccuauacuucuugaaaaggaagcauuauauaagacguauacggcac

SEQ ID NO: 37825 - RNA, 60 nt, Homo Sapiens
uggaggagggacggaggaggagccuuaggaaggaagcacgaggucuucaguugagcucuc

SEQ ID NO: 37826 - RNA, 60 nt, Homo Sapiens
gggaauucacaggacccccuucagcgcaagaggaagcagaaugagugggggccaccaggc

SEQ ID NO: 37827 - RNA, 60 nt, Homo Sapiens
uuuccacgauuucugaagaggaggaaccaaaggaagcaagccaagcagauagcucccucu

SEQ ID NO: 37828 - RNA, 60 nt, Homo Sapiens
uuggguuuugaaagguuauucccucaccgcaggaagcaguucuccguggaggacccuggg

SEQ ID NO: 37829 - RNA, 60 nt, Homo Sapiens
cacugugaauggcagacuuuauuuucucucaggaagcacacagcccccuguauucucaug

SEQ ID NO: 37830 - RNA, 60 nt, Homo Sapiens
ugacaagacacauccucagucaggucaagcaggaagcaguccugacuaacuuggcauuug

SEQ ID NO: 37831 - RNA, 60 nt, Homo Sapiens
auuaucugcgguggggggaggggccacccgaggaagcaguagccugaugacuugccccaa

SEQ ID NO: 37832 - RNA, 60 nt, Homo Sapiens
agagugacuuaaacaucuuggggccugcaaaggaagcaguaaggaggcagggaagaaagg

SEQ ID NO: 37833 - RNA, 60 nt, Homo Sapiens
ugccuacuuguaauuucuaaaucugaauauaggaagcauauaauuaaucgaaaugaauuu

SEQ ID NO: 37834 - RNA, 60 nt, Homo Sapiens
cuauuuucuaaauuuauuuaaaugcuuagcaggaagcauaaggaaaagccaucggccucc

SEQ ID NO: 37835 - RNA, 60 nt, Homo Sapiens
gcaugggacagguuccccacaagccuuagaaggaagcauggcccugacuucagaauucca

SEQ ID NO: 37836 - RNA, 60 nt, Homo Sapiens
uuuacccucagauuuggagaugguaaccaaaggaagcagcugggacagguggagaaggaa

SEQ ID NO: 37837 - RNA, 60 nt, Homo Sapiens
uuugugauguuaauacaggcuucuuguuuuaggaagcaucaccuauacucugaagccuuu

SEQ ID NO: 37838 - RNA, 60 nt, Homo Sapiens
ucccauuucucucuuguuugagagagaaugaggaagcaaagagugagaaagaauaggggc

SEQ ID NO: 37839 - RNA, 60 nt, Homo Sapiens
auaaucuucuaaaggcuauacaauugaaugaggaagcacuaacaaaagcaguaguucagu

SEQ ID NO: 37840 - RNA, 60 nt, Homo Sapiens
uaaguauuauaccucaugaauucccguccaaggaagcagaguuguuaaagaguacuggaa

SEQ ID NO: 37841 - RNA, 60 nt, Homo Sapiens
augugcuuuguaaaaagauuucaaguuauuaggaagcauacucuguuuuuuaaucaugua

SEQ ID NO: 37842 - RNA, 60 nt, Homo Sapiens
cuagugauuuugcuauaaaauuauuuuugaaggaagcagacacagcaguauuuaccugua

SEQ ID NO: 37843 - RNA, 60 nt, Homo Sapiens
cguuuuugccugguguuuuggcagcaaagcaggaagcaauuuugugugggucauuguucu

SEQ ID NO: 37844 - RNA, 60 nt, Homo Sapiens
agcgguguuacaggugaggaguguaauccuaggaagcaucaggugaaaagcaggagacca

SEQ ID NO: 37845 - RNA, 60 nt, Homo Sapiens
uaggcugagacaggagaauugcuugaacccaggaagcagagguugcaaugagcugagauu

SEQ ID NO: 37846 - RNA, 60 nt, Homo Sapiens
ggggcagaaugggccugcagcuuccugcagaggaagcaggacuggguagcagagccggga

SEQ ID NO: 37847 - RNA, 60 nt, Homo Sapiens
gagauucucuccaacaaagggugaagguucaggaagcacgcucccaaacaggaaacccug

SEQ ID NO: 37848 - RNA, 60 nt, Homo Sapiens
gaaacaacacaaaacccuauucugagcgggaggaagcacuuugugauucagcaccugcug

SEQ ID NO: 37849 - RNA, 60 nt, Homo Sapiens
cccucaauagccagcacccaugcggaggacaggaagcaccaucuuugaaaaguccugcgc

SEQ ID NO: 37850 - RNA, 60 nt, Homo Sapiens
uuguguacaaaauacuuaugaauacaaacaaggaagcacacccuauuugaaauguguuau

SEQ ID NO: 37851 - RNA, 60 nt, Homo Sapiens
cuccugacgccgccuuccuccucugacccgaggaagcaccgagcgucuggaaacucucug

SEQ ID NO: 37852 - RNA, 60 nt, Homo Sapiens
agcuucagaaagagcucaaaauucucagguaggaagcaacgugcagcucucuaaauggga

SEQ ID NO: 37853 - RNA, 60 nt, Homo Sapiens
auauccuccaguguagcacacuugcacauuaggaagcagaacauggaaaaagaggacuuu

SEQ ID NO: 37854 - RNA, 60 nt, Homo Sapiens
caucuccgcaucgcauccucgaccaaaggaaggaagcaagccaaaggcgggguggcggug

SEQ ID NO: 37855 - RNA, 60 nt, Homo Sapiens
caguuugagaguguacccaggugcagggagaggaagcaccggccacuccccagugcuccc

SEQ ID NO: 37856 - RNA, 60 nt, Homo Sapiens
gcccuucuuuuuaggaaacccuaaaggagaaggaagcagaauauaacccucuggagagcu

SEQ ID NO: 37857 - RNA, 60 nt, Homo Sapiens
cuuacugcuuaauguauaaacucucaccacaggaagcaucgcuguuuccaauaaauauug

SEQ ID NO: 37858 - RNA, 60 nt, Homo Sapiens
ugcgcucauucuuauuacaggagugagcaaaggaagcauuuaccccgaugguuaccuaga

SEQ ID NO: 37859 - RNA, 60 nt, Homo Sapiens
gucaccuuacugguuuucccuuguucaggaaggaagcagcuguuuccuugccaacagguc

SEQ ID NO: 37860 - RNA, 60 nt, Homo Sapiens
guguaauuuuaggaauuaugcugguucaucaggaagcagagggggaguuuuaaaagucaa

SEQ ID NO: 37861 - RNA, 60 nt, Homo Sapiens
cuguacuugaagucuaaaagcagaaaauaaaggaagcaaguuuucuuccaugauuuuaaa

SEQ ID NO: 37862 - RNA, 60 nt, Homo Sapiens
gguuguaaaauagacuccauggagacucuuaggaagcaguagauucccgggggcugugcc

SEQ ID NO: 37863 - RNA, 60 nt, Homo Sapiens
uaggagcauuuaaucuguauuuuacaaguuaggaagcagaggaucagagaugggaaagga

SEQ ID NO: 37864 - RNA, 60 nt, Homo Sapiens
gugcuaccaaaggggauacacaagcccuuuaggaagcaguaccucucgccuggaggaucu

SEQ ID NO: 37865 - RNA, 60 nt, Homo Sapiens
gugcgugguauaaucuccauuucaaaaccaaggaagcagccucagaguggucgagugaca

SEQ ID NO: 37866 - RNA, 60 nt, Homo Sapiens
gaucaguguuaagcauuuuccuccaugggaaggaagcaugggauauagaaaagcgaaggg

SEQ ID NO: 37867 - RNA, 60 nt, Homo Sapiens
accuaaggaugaaagcaaaggagggccuugaggaagcagcccccaggccuggcagccacg

SEQ ID NO: 37868 - RNA, 60 nt, Homo Sapiens
aaaagucccaaaagcagcagaaggugaagcaggaagcacuugguuuucuccuuccugaua

SEQ ID NO: 37869 - RNA, 60 nt, Homo Sapiens
agucaguaucgagccugaccaccgcaagccaggaagcaggugaagugcccagcgcuggag

SEQ ID NO: 37870 - RNA, 60 nt, Homo Sapiens
uaaugucuacuugucucuuugccucaccucaggaagcacagauguuguuuccuuacuacu

SEQ ID NO: 37871 - RNA, 60 nt, Homo Sapiens
ggacacagugauucugcagaagaacaucucaggaagcacuccuuccauuccucagcugaa

SEQ ID NO: 37872 - RNA, 60 nt, Homo Sapiens
uuuuccugauucuggcucuaucugggaacaaggaagcagaagcugggcuuggccagggag

SEQ ID NO: 37873 - RNA, 60 nt, Homo Sapiens
accccagggaagccaaagggucccuaugugaggaagcaaaucuagcccaccuccaucaau

SEQ ID NO: 37874 - RNA, 60 nt, Homo Sapiens
caugugggggacagaacagugacguccgggaggaagcaagaagcuagcugcaguguucag

SEQ ID NO: 37875 - RNA, 60 nt, Homo Sapiens
auuguacagaacacgguauugaauguucagaggaagcagugaaaguguuucuuggguuug

SEQ ID NO: 37876 - RNA, 60 nt, Homo Sapiens
ugauaaagcaugcucagauguuucuggcacaggaagcacaauaagggacgcuaccuugcu

SEQ ID NO: 37877 - RNA, 60 nt, Homo Sapiens
agagaaguggggaauccagugucugucugaaggaagcaaccacuggcaaaugccugaaug

SEQ ID NO: 37878 - RNA, 60 nt, Homo Sapiens
ggucuuuaaggacuucucucgguugcagugaggaagcaugaggaaggaagcucugaggau

SEQ ID NO: 37879 - RNA, 60 nt, Homo Sapiens
acagagcugcaagugccugggggugggagaaggaagcaggccccagcuuucuccaggcug

SEQ ID NO: 37880 - RNA, 60 nt, Homo Sapiens
cucaagcagcccagcgggcgacaggcggggaggaagcaugggccgccaccgcucuggacc

SEQ ID NO: 37881 - RNA, 60 nt, Homo Sapiens
gguggggggugcaggugggccacagaggucaggaagcaggcgggcuaacgggaggcuggg

SEQ ID NO: 37882 - RNA, 60 nt, Homo Sapiens
aaguuguuaauuaucucuaaaauuggaauuaggaagcauaucaccaauacugauuaacau

SEQ ID NO: 37883 - RNA, 60 nt, Homo Sapiens
cacucuccuccaaaagagccuccaucuguaaggaagcaggucuccgcgagggguuucuuu

SEQ ID NO: 37884 - RNA, 60 nt, Homo Sapiens
aucuuaccugucucuucuccaugagggagaaggaagcagcuagcuaugucccuagcugca

SEQ ID NO: 37885 - RNA, 60 nt, Homo Sapiens
uuccuauuuucuaauauaaaacucuuuuccaggaagcaugcuuaagcaucuuguuacaga

SEQ ID NO: 37886 - RNA, 60 nt, Homo Sapiens
acauauauacagauuguuggcauuugcaaaaggaagcaucaauaguggacccagaggcag

SEQ ID NO: 37887 - RNA, 60 nt, Homo Sapiens
aaaggcaguuaugaagccaauucauuuugaaggaagcacaauuuccaccuuauuuuuuga

SEQ ID NO: 37888 - RNA, 60 nt, Homo Sapiens
aauuucacacaguaaauuuugaaucucauaaggaagcauauuugaaccuagucaauuuaa

SEQ ID NO: 37889 - RNA, 60 nt, Homo Sapiens
aaaacaaaucucuaggagauuuucuaaauuaggaagcagauuuuuuuuuucuuugaagac

SEQ ID NO: 37890 - RNA, 60 nt, Homo Sapiens
ccuccuuguuuacaucuucacucaucuugcaggaagcaaaaaaccaaacucagugaagua

SEQ ID NO: 37891 - RNA, 60 nt, Homo Sapiens
ugcacuaacuggguuuaaaugcgacgccagaggaagcacggccugaggcggaugcagccc

SEQ ID NO: 37892 - RNA, 60 nt, Homo Sapiens
gccugggagcuuggaagggagugauggagaaggaagcaugcacucagagaggguccaagg

SEQ ID NO: 37893 - RNA, 60 nt, Homo Sapiens
uucuggugcuuugcauauguaguuccagaaaggaagcaguuaagcacaccaacagaacug

SEQ ID NO: 37894 - RNA, 60 nt, Homo Sapiens
auucaugaaccgaucuuuuuuuauuggaggaggaagcaucgaaaaccauggagauuauuu

SEQ ID NO: 37895 - RNA, 60 nt, Homo Sapiens
uaauuguuucugaauaucucgaugugugagaggaagcaguuacaaaugaaacuuaugcag

SEQ ID NO: 37896 - RNA, 60 nt, Homo Sapiens
cgauccuagagugucagaacuugaccuguaaggaagcagucuccggagguaucuguucug

SEQ ID NO: 37897 - RNA, 60 nt, Homo Sapiens
ggcagauucagggaccaaaagccuuagaagaggaagcaaagcaguuauauucugcaucaa

SEQ ID NO: 37898 - RNA, 60 nt, Homo Sapiens
gcccugucuuaugggucacgagaugaaucaaggaagcaggccuguuuagacuuuggugga

SEQ ID NO: 37899 - RNA, 60 nt, Homo Sapiens
guaagcgguauuagccucacuuaacagaugaggaagcaagauuccagaaaguaccagaag

SEQ ID NO: 37900 - RNA, 60 nt, Homo Sapiens
gaucuaagaaggcuauaggccuuuguuuguaggaagcagugucauuacauucaagcuuca

SEQ ID NO: 37901 - RNA, 60 nt, Homo Sapiens
cugggaaggccgcaagaggcauagagggagaggaagcacacugcagggcugcuguggccc

SEQ ID NO: 37902 - RNA, 60 nt, Homo Sapiens
ugugccuuaaaaaucaagacacuaguucagaggaagcacauaauguccagaucuauggcg

SEQ ID NO: 37903 - RNA, 60 nt, Homo Sapiens
uuacccauggaacaauaugcuuaggauuacaggaagcaguccuuacuuacacuucuuguc

SEQ ID NO: 37904 - RNA, 60 nt, Homo Sapiens
gguacuaaauccuuauuggaaccaagacaaaggaagcaaaauuggucucuuuagagacca

SEQ ID NO: 37905 - RNA, 60 nt, Homo Sapiens
ggcuaaaucaacacucuaaucaguauagugaggaagcagcaggugaucugccuuacuuca

SEQ ID NO: 37906 - RNA, 60 nt, Homo Sapiens
auccugcucacagucaccgcaggugcaggcaggaagcagcccugggggacuggacgcugc

SEQ ID NO: 37907 - RNA, 60 nt, Homo Sapiens
uuauggaagaaugguuuaugaacuucccauaggaagcaccugagagauaguaaacugcag

SEQ ID NO: 37908 - RNA, 60 nt, Homo Sapiens
uugaaguacucaggauagugccuggcauguaggaagcaccuggaaaauauucgcugugau

SEQ ID NO: 37909 - RNA, 60 nt, Homo Sapiens
acagauguccucuuaagaaaaugaugcaucaggaagcaacgugauggaggacuuggggga

SEQ ID NO: 37910 - RNA, 60 nt, Homo Sapiens
cuucagggugggggggaaggggacaugggcaggaagcaccgagggaguugggcccuagcu

SEQ ID NO: 37911 - RNA, 60 nt, Homo Sapiens
gcagcaucuucaaacauguacaucgggcugaggaagcacacuacucuccucggcccccuc

SEQ ID NO: 37912 - RNA, 60 nt, Homo Sapiens
gccagcccugguucuccauccaagaggagcaggaagcaagugauaacacuggagugguaa

SEQ ID NO: 37913 - RNA, 60 nt, Homo Sapiens
ggaaggugaccugaggaggccuggaaggggaggaagcagguccgagggccaguuucaggu

SEQ ID NO: 37914 - RNA, 60 nt, Homo Sapiens
cccagggaccaauuuucccagagugaagagaggaagcagcgcccuuacccaccuuccugu

SEQ ID NO: 37915 - RNA, 60 nt, Homo Sapiens
cuuagcacacgggccucucccuuugggcucaggaagcagccggagcuggguuggccccuu

SEQ ID NO: 37916 - RNA, 60 nt, Homo Sapiens
caggaguggcuggggaagaagcaccugaggaggaagcagcuucagcuccguaagguggcg

SEQ ID NO: 37917 - RNA, 60 nt, Homo Sapiens
uaugggaacagucugugagaucuucugcagaggaagcacuacagagggcuagagaaagca

SEQ ID NO: 37918 - RNA, 60 nt, Homo Sapiens
agugauuaguucggguuaaaucuuaauagaaggaagcagguuacugcaagagaauggaag

SEQ ID NO: 37919 - RNA, 60 nt, Homo Sapiens
uuucuguggugagggagaaccucuccaaagaggaagcaggcauaugagugcgcacgccuu

SEQ ID NO: 37920 - RNA, 60 nt, Homo Sapiens
aagaugagaaaguccucaagugaggggaggaggaagcagauagaugguccagcaggcuug

SEQ ID NO: 37921 - RNA, 60 nt, Homo Sapiens
aucugagcagcagcauccaggcugaccucaaggaagcauagccacaaaacagaauagcac

SEQ ID NO: 37922 - RNA, 60 nt, Homo Sapiens
gcuaaaauaauggcuucacucuuauauuugaggaagcaacugaacaggagucaaugauuu

SEQ ID NO: 37923 - RNA, 60 nt, Homo Sapiens
uaaaaccugaugggacaauaacgccuuuggaggaagcacucaaccaguacucugucaucg

SEQ ID NO: 37924 - RNA, 60 nt, Homo Sapiens
auuauauuuuauagaauuuguuugaaauugaggaagcaguuaaauugugcgcuguauuuu

SEQ ID NO: 37925 - RNA, 60 nt, Homo Sapiens
uguuaaacaaaugauuuccacaaacagaucaggaagcacuagguuggcagagacacuuug

SEQ ID NO: 37926 - RNA, 60 nt, Homo Sapiens
cuaggaacaccuuauaaguugaauaaauuaaggaagcauuuucccauugaaaguguguuc

SEQ ID NO: 37927 - RNA, 60 nt, Homo Sapiens
gucccacagaccgcuccucccaucccagacaggaagcagacccacccggcaagcccgccc

SEQ ID NO: 37928 - RNA, 60 nt, Homo Sapiens
uacauaugaguguggaagcccagacuuaccaggaagcagaaggugcaguugccccaaccu

SEQ ID NO: 37929 - RNA, 60 nt, Homo Sapiens
uacauaugaguguggaagcccagacuuaccaggaagcagaaggugcaguucccccaaccu

SEQ ID NO: 37930 - RNA, 60 nt, Homo Sapiens
uaaaucugucuucauccuuacccugucagcaggaagcagucguuuccccaaaacaauguc

SEQ ID NO: 37931 - RNA, 60 nt, Homo Sapiens
agcaucuaugugagaccauucauuuaggugaggaagcaaauuuucccaaacugaucuuuu

SEQ ID NO: 37932 - RNA, 60 nt, Homo Sapiens
uaauggaauugucaauugguaagugguugaaggaagcaaacuaauauacauaauuccauu

SEQ ID NO: 37933 - RNA, 60 nt, Homo Sapiens
agugaacucuaccuguucugccauguuggaaggaagcaacaaacagaaccuuuucuuaau

SEQ ID NO: 37934 - RNA, 60 nt, Homo Sapiens
cuccccuguguaaacaacucccucuguuucaggaagcauuaucacuguccugauucugaa

SEQ ID NO: 37935 - RNA, 60 nt, Homo Sapiens
uaagagagggaacauuuccuggggguugggaggaagcauguaagguguugaaagagugca

SEQ ID NO: 37936 - RNA, 60 nt, Homo Sapiens
uguggaaggagcauuuccuuguggguggagaggaagcauagugguauugaccggcacuca

SEQ ID NO: 37937 - RNA, 60 nt, Homo Sapiens
aacccuccauccacuucccaguggccucgaaggaagcacagcaaccuguggccugcacuu

SEQ ID NO: 37938 - RNA, 60 nt, Homo Sapiens
uuguuucuaaacaaauagugauauaaacagaggaagcagcuuuauaucaagaauaaggaa

SEQ ID NO: 37939 - RNA, 60 nt, Homo Sapiens
aaacaugaauccugugauauugggcucuucaggaagcauaaagcaauugugaaauacagu

SEQ ID NO: 37940 - RNA, 60 nt, Homo Sapiens
guaaguaucaaccauuucuugaucaagauaaggaagcaacacugauacugagagagaggu

SEQ ID NO: 37941 - RNA, 60 nt, Homo Sapiens
cucuccagcucugcaguuuucacuguauucaggaagcauaaaguaguaugaaagguuuga

SEQ ID NO: 37942 - RNA, 60 nt, Homo Sapiens
uugcugcuaagucagaucagauuugcuaacaggaagcauucuuuacaugacaguaucuug

SEQ ID NO: 37943 - RNA, 60 nt, Homo Sapiens
uuuaaauauaaaugauauguugaaaacuuaaggaagcaaaugcuacauauaugcaauaua

SEQ ID NO: 37944 - RNA, 60 nt, Homo Sapiens
ucaugaaacacuagaauguacccucagagcaggaagcacaccugugccauuucugggacu

SEQ ID NO: 37945 - RNA, 60 nt, Homo Sapiens
aaauccauaauuuaccuuuucuaccuaagaaggaagcagugaaauuuuucauucccauau

SEQ ID NO: 37946 - RNA, 60 nt, Homo Sapiens
ugauugagaacaucuugggaauuguucaacaggaagcacacccguaugguauuuuguuag

SEQ ID NO: 37947 - RNA, 60 nt, Homo Sapiens
ugaaacuuacuaauucuauuaagagaaccgaggaagcacgucuuacuuauaaaguaggaa

SEQ ID NO: 37948 - RNA, 60 nt, Homo Sapiens
cucaggcagcagaaguugcaggaagaacaaaggaagcaggaaaaugcucuuaaacccaaa

SEQ ID NO: 37949 - RNA, 60 nt, Homo Sapiens
cacacaaaaugcccaaggcacucacuggggaggaagcaaggaagcaaacagucugagaaa

SEQ ID NO: 37950 - RNA, 60 nt, Homo Sapiens
augcccaaggcacucacuggggaggaagcaaggaagcaaacagucugagaaaaugaugca

SEQ ID NO: 37951 - RNA, 60 nt, Homo Sapiens
uggugugguuggugaacagugcaugccaggaggaagcagucccuccucaccagcucucca

SEQ ID NO: 37952 - RNA, 60 nt, Homo Sapiens
ccgucacaugucucaaggguccagcguucgaggaagcacuguuguagaugacagagcuuu

SEQ ID NO: 37953 - RNA, 60 nt, Homo Sapiens
ggcacacacgccuucaugccagugcaugccaggaagcacguucacuagacuaaaacacgg

SEQ ID NO: 37954 - RNA, 60 nt, Homo Sapiens
caggcagacacaugcuguuggccucaagcaaggaagcagagcacuguguaaccagcaguc

SEQ ID NO: 37955 - RNA, 60 nt, Homo Sapiens
ugacuucaagaugccucuucuaccucuuccaggaagcacaggccaggggaucugggugug

SEQ ID NO: 37956 - RNA, 60 nt, Homo Sapiens
ggucucucuucuauccccagaaacuuucagaggaagcagcucauagaaacauacaaaagc

SEQ ID NO: 37957 - RNA, 60 nt, Homo Sapiens
agggauauuccccaaccuguccuuccugacaggaagcauagggcacugcagauggggaag

SEQ ID NO: 37958 - RNA, 60 nt, Homo Sapiens
ggagggauguuccaguggaugagggccaccaggaagcacagguccaaggcuggucccaca

SEQ ID NO: 37959 - RNA, 60 nt, Homo Sapiens
aaagacucaaugagcuguuauguuguaaacaggaagcauuucacauccaaacgagaaaau

SEQ ID NO: 37960 - RNA, 60 nt, Homo Sapiens
auaaagcaauuuuccuugaagcuccuugggaggaagcagaaugcuggagccuguguaaca

SEQ ID NO: 37961 - RNA, 54 nt, Homo Sapiens
cuaagcccccgcuguaaugacuacaggaagcaaaaaaccaugaaacgcuacuaa

SEQ ID NO: 37962 - RNA, 60 nt, Homo Sapiens
uuauuuuuuuaaaaaauagacgauuuguauaggaagcaagauuuguauauuuuuaaauag

SEQ ID NO: 37963 - RNA, 60 nt, Homo Sapiens
agaaaguuggagaugaggaauuuagaagucaggaagcaauacacuguuuggcuucacuaa

SEQ ID NO: 37964 - RNA, 60 nt, Homo Sapiens
agcggucucaggccaauuacaauaccucuuaggaagcauugcuuaccaagcauauuagga

SEQ ID NO: 37965 - RNA, 60 nt, Homo Sapiens
gcaaucucccuuuguuuuucaaaacacaacaggaagcaaaaagcacauuuacugaaaugu

SEQ ID NO: 37966 - RNA, 60 nt, Homo Sapiens
gaauuccuaaagcugcuuaggcacggcacaaggaagcauuguggucaccucccagaagag

SEQ ID NO: 37967 - RNA, 60 nt, Homo Sapiens
ggccggccaucgcuaccuucaugucgcaauaggaagcaggcauccuaucgccacaaugcc

SEQ ID NO: 37968 - RNA, 60 nt, Homo Sapiens
cuguauauuugauugaauaauacauauuaaaggaagcacuagugcauuuuuguaaaugug

SEQ ID NO: 37969 - RNA, 60 nt, Homo Sapiens
uaaagggauaggcucauggcccuucacaagaggaagcacacuggguaacaaugaacagug

SEQ ID NO: 37970 - RNA, 60 nt, Homo Sapiens
cuugccugguaucauugagcccacacauggaggaagcagaacucaucaguucuuggcguu

SEQ ID NO: 37971 - RNA, 60 nt, Homo Sapiens
uaguguugugugauuuaaaauggacucagcaggaagcauauugucuggggauuguuggga

SEQ ID NO: 37972 - RNA, 60 nt, Homo Sapiens
augacuggcuuucucuuguggauggacuauaggaagcacuuucugaauuauguaaugauu

SEQ ID NO: 37973 - RNA, 60 nt, Homo Sapiens
cacuucccaaaccgcagacuacaucuuuagaggaagcacaacugugccuuuuucugaaaa

SEQ ID NO: 37974 - RNA, 60 nt, Homo Sapiens
ggguuggcaggggcuccaucucaguggaccaggaagcaagaggggaagcgggaucccagc

SEQ ID NO: 37975 - RNA, 60 nt, Homo Sapiens
cccaucccaucacacaugauccaccguaccaggaagcagaaauauuucuacaaagggggc

SEQ ID NO: 37976 - RNA, 60 nt, Homo Sapiens
ucuggugcagauucaagcuccuccucuuagaggaagcagcuccuuccucccacaggagcc

SEQ ID NO: 37977 - RNA, 60 nt, Homo Sapiens
ugggggccuccacccagcagcagaccaaccaggaagcagcuugaacuggauggagacuuu

SEQ ID NO: 37978 - RNA, 60 nt, Homo Sapiens
gaagaggaacacaaaggaagccacccaggaaggaagcacagagcugggggcucuggaaac

SEQ ID NO: 37979 - RNA, 60 nt, Homo Sapiens
ggagcuaauggaagugacagucauguucaaaggaagcauuucuagaaaaaaggagauaau

SEQ ID NO: 37980 - RNA, 60 nt, Homo Sapiens
uaccacgggcuuucguuaucuugacauagaaggaagcaaugccacggcuccaggguuuca

SEQ ID NO: 37981 - RNA, 60 nt, Homo Sapiens
ucacauagugacaaguccuuuuaggaauucaggaagcaaagcugcucugcugacuaucuu

SEQ ID NO: 37982 - RNA, 60 nt, Homo Sapiens
aagaauucaauauuugcauucgugucuuaaaggaagcaucuucauuaacuugacagagua

SEQ ID NO: 37983 - RNA, 60 nt, Homo Sapiens
guagagcuggaggauaagagcacugcuuuaaggaagcaggcauuuggagaugugaagaua

SEQ ID NO: 37984 - RNA, 60 nt, Homo Sapiens
uccacugacaaacgggaaacggaaaagugaaggaagcauguccuuccagacccaccagcu

SEQ ID NO: 37985 - RNA, 60 nt, Homo Sapiens
uaccaaauuuucuuagauuuggucaucaucaggaagcauuuguaaaaauaaaaaucucca

SEQ ID NO: 37986 - RNA, 60 nt, Homo Sapiens
cuggccuuucccgaggccugugagugccucaggaagcagcugggcccucugggaaggcug

SEQ ID NO: 37987 - RNA, 60 nt, Homo Sapiens
aacaccucagcugggcucuugggagaccuuaggaagcaggagaggcaacaccucuggcua

SEQ ID NO: 37988 - RNA, 60 nt, Homo Sapiens
ucagcgcagagaaguugagaggacccaugaaggaagcaaggacacggggcaggcaccugg

SEQ ID NO: 37989 - RNA, 60 nt, Homo Sapiens
gacuucaaggggaaguaugagacuucucugaggaagcagacccuucacaagcaaaaucag

SEQ ID NO: 37990 - RNA, 60 nt, Homo Sapiens
ugggcuaggaccucaaccccagggauucccaggaagcagaacucuccagaagaaggguuu

SEQ ID NO: 37991 - RNA, 60 nt, Homo Sapiens
cguccagaucuguguguguagcaugugcugaggaagcacgugcugggcugugccucagac

SEQ ID NO: 37992 - RNA, 60 nt, Homo Sapiens
augaagaggaguacacagaacacauaauucaggaagcagcuuuccccaugucucgacuca

SEQ ID NO: 37993 - RNA, 60 nt, Homo Sapiens
uucugggaaccuauggagaaagggaauccaaggaagcagccaaggcugcucgcagcuucc

SEQ ID NO: 37994 - RNA, 60 nt, Homo Sapiens
uuggccauauauuugcucaauaaagauugaaggaagcauggucauaguugcccuggguuc

SEQ ID NO: 37995 - RNA, 52 nt, Homo Sapiens
uucguguucauuccccuugaggaggaagcagagcagagugcgagauccugac

SEQ ID NO: 37996 - RNA, 60 nt, Homo Sapiens
acuucagcauugaaugugugaacuuagggcaggaagcaauggguggcaauaccucuuagg

SEQ ID NO: 37997 - RNA, 60 nt, Homo Sapiens
gccaguuaaagagcauuagaugucauuuauaggaagcacuuaaucaucucuauugcuugg

SEQ ID NO: 37998 - RNA, 60 nt, Homo Sapiens
guaaaauaauucugaguuuuguauuaagaaaggaagcauuacccaagaugggcaucuuuu

SEQ ID NO: 37999 - RNA, 60 nt, Homo Sapiens
cccaggcuggcaggcaucuccacagcgcuaaggaagcagggcccgucagacauaagcucu

SEQ ID NO: 38000 - RNA, 60 nt, Homo Sapiens
accaggccuaggaucuccccugaggcugggaggaagcagggcagggauugucagcccacc

SEQ ID NO: 38001 - RNA, 60 nt, Homo Sapiens
cuugugaacuaccuugcuagaaaaaagcaaaggaagcauaaaaauccaaaaaguuuuuuu

SEQ ID NO: 38002 - RNA, 60 nt, Homo Sapiens
aacaauaaaggagaaugguaccgaugcaggaggaagcaagcgugucuuccccugcagcac

SEQ ID NO: 38003 - RNA, 60 nt, Homo Sapiens
caaaaaaagcagaacccacuggaguagaaaaggaagcauguagcauauacucaguaguga

SEQ ID NO: 38004 - RNA, 60 nt, Homo Sapiens
ccuugucuauggagccccgccuugugagccaggaagcagcgucucaucaggacagaaggu

SEQ ID NO: 38005 - RNA, 60 nt, Homo Sapiens
cuacaucagacucuagaaaaaagggcugagaggaagcaagacguaaagaauuuucauccc

SEQ ID NO: 38006 - RNA, 60 nt, Homo Sapiens
ugcagaaucaaucugagggaggggauaaagaggaagcaauaaaaaaaaaacauccgacag

SEQ ID NO: 38007 - RNA, 60 nt, Homo Sapiens
cgcagaccugcagcgggcaaagagcucccgaggaagcacagcuugggucagguucuugcc

SEQ ID NO: 38008 - RNA, 60 nt, Homo Sapiens
uaugaagauauucagauacucuucuaugccaggaagcacaaagacuuuguugagauuugc

SEQ ID NO: 38009 - RNA, 60 nt, Homo Sapiens
gggucacugucccuuccagcugccccagacaggaagcagagucaccacgcagcagugucc

SEQ ID NO: 38010 - RNA, 60 nt, Homo Sapiens
gcagggaagggggaagaaaacccucccauuaggaagcaugcuuuugcaguuaaauggcga

SEQ ID NO: 38011 - RNA, 60 nt, Homo Sapiens
aggccgaggcaggggcugggcagaggggagaggaagcacaagaagugggagugggagagg

SEQ ID NO: 38012 - RNA, 60 nt, Homo Sapiens
uuccuuuacccuccacacacuucuuccaaaaggaagcacccguugaguccuuuugagggu

SEQ ID NO: 38013 - RNA, 60 nt, Homo Sapiens
uugagcauggccagacuauucccuaggacaaggaagcagagggaaaugggaggucuaagg

SEQ ID NO: 38014 - RNA, 60 nt, Homo Sapiens
cuccccucuugcuguguguacuggacacgcaggaagcaugcugucuugcugccucugcaa

SEQ ID NO: 38015 - RNA, 60 nt, Homo Sapiens
agggaaaauauagaccuaugauaaauaaccaggaagcauugcuuuuggacaaggaaggac

SEQ ID NO: 38016 - RNA, 60 nt, Homo Sapiens
ccagcagggcugggggcuccggagagcagcaggaagcacucccagccaccagugccuguc

SEQ ID NO: 38017 - RNA, 60 nt, Homo Sapiens
uuagguuggggcggaccuuuggauauauaaaggaagcaguuuuaguaucagaaaagauuu

SEQ ID NO: 38018 - RNA, 60 nt, Homo Sapiens
uucaggcugggguagcaggucaguccaggcaggaagcagcaccugccccccgcgccagcc

SEQ ID NO: 38019 - RNA, 60 nt, Homo Sapiens
agagagccuucuagaaugacagacugugcgaggaagcaggggcagggguuuccagcccgg

SEQ ID NO: 38020 - RNA, 60 nt, Homo Sapiens
aguccugaucuuucaugcuggaggcugguuaggaagcaagggucccuguccucugucuuu

SEQ ID NO: 38021 - RNA, 60 nt, Homo Sapiens
agcccccgaguccuuuccggacaggcccagaggaagcagagccgggaagccgaagagucc

SEQ ID NO: 38022 - RNA, 60 nt, Homo Sapiens
uggcaccaacucaccaaaggcugguggcagaggaagcaggccaaagcuccccaccccagc

SEQ ID NO: 38023 - RNA, 60 nt, Homo Sapiens
cagggcuuagguagcuugguaagggccauaaggaagcagguccauuuucuauuaccugga

SEQ ID NO: 38024 - RNA, 60 nt, Homo Sapiens
caggaagugagcaaggggccgaaagugaacaggaagcaaacaagggacaggaagcugaua

SEQ ID NO: 38025 - RNA, 60 nt, Homo Sapiens
caucacacuugaggcuugggguagcaccacaggaagcaggauacaaagguauccauggag

SEQ ID NO: 38026 - RNA, 60 nt, Homo Sapiens
uguuaacuugucccguuuauguaauagaagaggaagcacauuugucuuacucucauuucc

SEQ ID NO: 38027 - RNA, 60 nt, Homo Sapiens
uuggacagaaaccacuugcucaucccugccaggaagcagggaagccaaggcugggucuga

SEQ ID NO: 38028 - RNA, 60 nt, Homo Sapiens
uucggagggguggagauaaaaauugagggaaggaagcagagagaaaaggcaugguuucuu

SEQ ID NO: 38029 - RNA, 60 nt, Homo Sapiens
cuuccuuggagcaguucuucgccgagaggcaggaagcagcgaggugccuucagcuggugg

SEQ ID NO: 38030 - RNA, 60 nt, Homo Sapiens
gauggggaugaaggcacaggccccacccccaggaagcauggugucauauuuagucagagg

SEQ ID NO: 38031 - RNA, 60 nt, Homo Sapiens
ggguuuuguuuuggaggucauaauuuggggaggaagcaaagugugugugugugucagguu

SEQ ID NO: 38032 - RNA, 60 nt, Homo Sapiens
uacaccaccugggaaccccuggcaguccuuaggaagcacuaauaccccaagaccccagag

SEQ ID NO: 38033 - RNA, 60 nt, Homo Sapiens
agacucuguaccuauuuuguuaggggugggaggaagcaaacacaaagcaguuuuuccccc

SEQ ID NO: 38034 - RNA, 60 nt, Homo Sapiens
aaaaccuucaaaacaagacaauuaaaauucaggaagcagcuguuucucaugaaaaguuug

SEQ ID NO: 38035 - RNA, 60 nt, Homo Sapiens
ggggagugagacaggcugggguccuuuucuaggaagcacgaugccacuugggaaugaauu

SEQ ID NO: 38036 - RNA, 60 nt, Homo Sapiens
gagaguuggggaaggcaagacgauggucccaggaagcaggcugcugcuccccaccccuac

SEQ ID NO: 38037 - RNA, 60 nt, Homo Sapiens
ugguuguaacuuuguaaguagaaaauguuaaggaagcaaaacauguaugaacuuaacaug

SEQ ID NO: 38038 - RNA, 60 nt, Homo Sapiens
cagccuuggugcagcaagaacauucaacucaggaagcauuugacucguuguacuucagag

SEQ ID NO: 38039 - RNA, 60 nt, Homo Sapiens
uggcauguuuuauaauuaacugaauaaagaaggaagcauuauuauauauuauugugggga

SEQ ID NO: 38040 - RNA, 60 nt, Homo Sapiens
ucaucuucauaagaaugagaaaggcucaaaaggaagcacuuuuagaaaucuucucugacc

SEQ ID NO: 38041 - RNA, 60 nt, Homo Sapiens
ccuuagugccugcaccucaccacgauauugaggaagcacaggacauccaaggguacucuc

SEQ ID NO: 38042 - RNA, 60 nt, Homo Sapiens
caccuuuuaucuuaguaggcucaaauguucaggaagcacagggauggaaaccucuuccug

SEQ ID NO: 38043 - RNA, 60 nt, Homo Sapiens
ccauggucuuguuccucucguuuuggcuuuaggaagcaugucuuuaacagcaccgcucgu

SEQ ID NO: 38044 - RNA, 60 nt, Homo Sapiens
ugcauaaaccauguccccaggaaauuugaaaggaagcaggugcugaauggaauuuuuuuc

SEQ ID NO: 38045 - RNA, 60 nt, Homo Sapiens
aguaagaagcagcauuuuauauuaugauuuaggaagcaaauuucaauguaguugggguag

SEQ ID NO: 38046 - RNA, 60 nt, Homo Sapiens
ugucuaaaaugcagugggguuacuuuuauaaggaagcagcauauacagaauguuuuuucu

SEQ ID NO: 38047 - RNA, 60 nt, Homo Sapiens
ggcaggugacaucacuauuaaucacauucuaggaagcaaugaaacucuggaaugaacagu

SEQ ID NO: 38048 - RNA, 60 nt, Homo Sapiens
caucuucacuuggugcugccaguauuuugaaggaagcaccagauggcagaaucuaaauca

SEQ ID NO: 38049 - RNA, 60 nt, Homo Sapiens
gugugugagacagugucuguguguuuuggaaggaagcauggauguuguaacucaauagaa

SEQ ID NO: 38050 - RNA, 60 nt, Homo Sapiens
ucaauuuaguucaaacaagacacagaauuaaggaagcacccuuaagauuuggaauaaagu

SEQ ID NO: 38051 - RNA, 60 nt, Homo Sapiens
agcucugcuggacugggcucaauccaggguaggaagcagccccauucagccucaagggga

SEQ ID NO: 38052 - RNA, 60 nt, Homo Sapiens
gaucacagccccccuaccuuuugcccuaggaggaagcaauaaugguguauacccucauuc

SEQ ID NO: 38053 - RNA, 60 nt, Homo Sapiens
gaggcugacauaggagaauugcuugaauauaggaagcagagguugcagugagccgagguu

SEQ ID NO: 38054 - RNA, 60 nt, Homo Sapiens
cccugagcaaggcaaccgaucgccaggaccaggaagcaucacccaggagauuuggcgccc

SEQ ID NO: 38055 - RNA, 60 nt, Homo Sapiens
cccaugucccacccacguccuacggcacucaggaagcacuuggugaggacgagcccucac

SEQ ID NO: 38056 - RNA, 60 nt, Homo Sapiens
uugccaagucccuuuuuaggcuuuuuaauuaggaagcauuucgaaccugcgcaacagacc

SEQ ID NO: 38057 - RNA, 60 nt, Homo Sapiens
gaagagaccugcaacugugagaguccagacaggaagcagagaaggcguccuugcggaaag

SEQ ID NO: 38058 - RNA, 60 nt, Homo Sapiens
ccaccaggccugcccuaaaagagcuccugaaggaagcacuaaacauggaaaggaacaacu

SEQ ID NO: 38059 - RNA, 60 nt, Homo Sapiens
ugugacucccauggggaggaacagacuggcaggaagcacaccgggguuaacacugguuga

SEQ ID NO: 38060 - RNA, 60 nt, Homo Sapiens
guccuuaaaagcuuucuccuggccgauaggaggaagcauauaucaaggagguucuuuccc

SEQ ID NO: 38061 - RNA, 60 nt, Homo Sapiens
caauugacuuaaaaaauacaaauaacauuuaggaagcaaauagauuaaacacaaaaauaa

SEQ ID NO: 38062 - RNA, 60 nt, Homo Sapiens
aaaaguuuaaaaagcaaaauggggagggggaggaagcagugacuuuuuuuugguaauuau

SEQ ID NO: 38063 - RNA, 60 nt, Homo Sapiens
gaauaaaugacauggcaccuccuagcaggaaggaagcaggguugaaacccugaaguguua

SEQ ID NO: 38064 - RNA, 60 nt, Homo Sapiens
agccuggggaaggaaaaagcaggaaacugaaggaagcaggggcugaggaacacuuagagg

SEQ ID NO: 38065 - RNA, 60 nt, Homo Sapiens
uucuguggcuguagacugaucacagagucaaggaagcaguggcaauucuagauaucugag

SEQ ID NO: 38066 - RNA, 60 nt, Homo Sapiens
agaacacccacugccuagaggccaucuuaaaggaagcaggggcuggaugccuuucauccc

SEQ ID NO: 38067 - RNA, 60 nt, Homo Sapiens
gccccaagccacggggcaucccccucucccaggaagcagggagggggccgggagguuuuc

SEQ ID NO: 38068 - RNA, 60 nt, Homo Sapiens
uguguaucauuuaccuccugaaccugcucaaggaagcagaccucugcuucuccccauuug

SEQ ID NO: 38069 - RNA, 60 nt, Homo Sapiens
gugugugugugcgcacgcccauugggugugaggaagcaacgagauggagguuuuggucuu

SEQ ID NO: 38070 - RNA, 60 nt, Homo Sapiens
accagcucgcccucccccuacuccgccacaaggaagcacacccgcggaguggggggcccc

SEQ ID NO: 38071 - RNA, 60 nt, Homo Sapiens
aauaaauauuugagaaaugauugcagccugaggaagcauccaccaaacuggaagcuguuu

SEQ ID NO: 38072 - RNA, 60 nt, Homo Sapiens
gguugcagugagcagagaucacuugaacccaggaagcagagaggcugaggcaagugaauc

SEQ ID NO: 38073 - RNA, 60 nt, Homo Sapiens
acacacagcuggaggcuuggcugcugcuugaggaagcagaauggggaauaucagagucag

SEQ ID NO: 38074 - RNA, 60 nt, Homo Sapiens
gaagucgcaggcagccucucgagauaagaaaggaagcacaacuacaggaagaagguggcu

SEQ ID NO: 38075 - RNA, 60 nt, Homo Sapiens
gaugcaacaagaugaugcugacccacugcuaggaagcaagcaggaaugaggaguuguuga

SEQ ID NO: 38076 - RNA, 60 nt, Homo Sapiens
caccuuugggaaaguguaucaauaucuuaaaggaagcaacgaguuuauuuucuauugugc

SEQ ID NO: 38077 - RNA, 60 nt, Homo Sapiens
gagcgccagauuugugguggguggccccccaggaagcagauugaaggaguuaacagacag

SEQ ID NO: 38078 - RNA, 60 nt, Homo Sapiens
aguucaaggugaucgugccagcucgagggaaggaagcagaagaugccuuccuuugggcug

SEQ ID NO: 38079 - RNA, 60 nt, Homo Sapiens
uagaucccagaacagacaaacugaaacaugaggaagcaggcuaaaugccauauacucaca

SEQ ID NO: 38080 - RNA, 60 nt, Homo Sapiens
uuuugaaccugcaacuucaggcuuagccggaggaagcacauuugggguuucagucccagg

SEQ ID NO: 38081 - RNA, 60 nt, Homo Sapiens
agcuucccauuucacaaaggcagacuuggaaggaagcauaagcucaucgcaccaauauug

SEQ ID NO: 38082 - RNA, 60 nt, Homo Sapiens
gaaucgaaacgacagugcuggaggagacucaggaagcagaggcgucccugccgcugcccu

SEQ ID NO: 38083 - RNA, 60 nt, Homo Sapiens
gcccuaguuacugcauggggaaagagauccaggaagcaugagugcuggauauuuuacuac

SEQ ID NO: 38084 - RNA, 60 nt, Homo Sapiens
aguaacucaugguaccuuggccaaguuggaaggaagcaguuuguuaaugaggcacaguaa

SEQ ID NO: 38085 - RNA, 60 nt, Homo Sapiens
gacccugaagucagagcaggccagccaagcaggaagcacacuguuuacuuuuugcaugaa

SEQ ID NO: 38086 - RNA, 60 nt, Homo Sapiens
uggcucuuccauugccacugagcaaugcccaggaagcaggcacauugccaaggacugggg

SEQ ID NO: 38087 - RNA, 60 nt, Homo Sapiens
ggccgggaccagccaggagcugggagccacaggaagcaaaagucagccuuuucuucaagg

SEQ ID NO: 38088 - RNA, 60 nt, Homo Sapiens
aggcucucgaagcucauaaaauucaacgugaggaagcaagugacaaggacgcccgaagca

SEQ ID NO: 38089 - RNA, 60 nt, Homo Sapiens
gcccucgcuucaugagguggggccugagauaggaagcaguaguuuuucagugaaggaaaa

SEQ ID NO: 38090 - RNA, 60 nt, Homo Sapiens
ccaugccaaagcuaggguggcuauagcuacaggaagcacccccacccaggagggaggggg

SEQ ID NO: 38091 - RNA, 60 nt, Homo Sapiens
agauagauguugcucuuucauuuuuaagaaaggaagcaacucaguauuuucuccacuuca

SEQ ID NO: 38092 - RNA, 60 nt, Homo Sapiens
agacgggaggggaggcauuguagcuuuccaaggaagcagacaccuaacggccugcccugu

SEQ ID NO: 38093 - RNA, 60 nt, Homo Sapiens
accuuugaagagaucucugcguguuccucaaggaagcaguaaccccuuugugcccccuuu

SEQ ID NO: 38094 - RNA, 60 nt, Homo Sapiens
ccggcagaaauagcuauggaugggaagggaaggaagcaagcucagcugccucaucguggc

SEQ ID NO: 38095 - RNA, 60 nt, Homo Sapiens
aaauggccuaaaaaagcuaccuaauguauuaggaagcacuacauuuauucagauauggcu

SEQ ID NO: 38096 - RNA, 60 nt, Homo Sapiens
gccaggugccgagcgcgaccgcagagacagaggaagcagacuagggggagccugggugca

SEQ ID NO: 38097 - RNA, 60 nt, Homo Sapiens
uguuuacauauucaaaguggugcacuuugaaggaagcacaugugcaccuuuccuuuacac

SEQ ID NO: 38098 - RNA, 60 nt, Homo Sapiens
uaauugucgagaagccaagggugaggaggcaggaagcaccuccgguuggaggcacccagg

SEQ ID NO: 38099 - RNA, 60 nt, Homo Sapiens
cuucuguuucacagggaggcugauggaaaaaggaagcaagcuggacccauccucccugcu

SEQ ID NO: 38100 - RNA, 60 nt, Homo Sapiens
uuuauucuauauagcuuuaaggcccacacaaggaagcaacguaggaugggagaaugauuu

SEQ ID NO: 38101 - RNA, 60 nt, Homo Sapiens
gcccugcuugaauucaaacucagguuucagaggaagcacaccaggaaggcuccucuccca

SEQ ID NO: 38102 - RNA, 60 nt, Homo Sapiens
uuaaauccuuagggcaugguucaagucuguaggaagcaaaucuauacuuuuuuauauggg

SEQ ID NO: 38103 - RNA, 60 nt, Homo Sapiens
augcauuuuagcaaguggacuuguugaaacaggaagcaagggccuucaguguagcccauu

SEQ ID NO: 38104 - RNA, 60 nt, Homo Sapiens
ugaggcccagcaagaagggcuuggguucugaggaagcagauguuucaugcugugaggccu

SEQ ID NO: 38105 - RNA, 60 nt, Homo Sapiens
uugugccuguaucucgcugggggacuucacaggaagcaggauuugggcauuccugaagcu

SEQ ID NO: 38106 - RNA, 60 nt, Homo Sapiens
aagaggcagaucagcugaagcaggaccugcaggaagcacgcgaggcggagcgaagagcca

SEQ ID NO: 38107 - RNA, 60 nt, Homo Sapiens
ccucugccccacugccagccugagugggcaaggaagcagguggaucccccagaaggaacc

SEQ ID NO: 38108 - RNA, 60 nt, Homo Sapiens
ugucggccaggauugccacuccuguuucagaggaagcaggccgagagacuugcaccuugg

SEQ ID NO: 38109 - RNA, 60 nt, Homo Sapiens
ugaguuaugcaguucccaguguccaguuaaaggaagcacacaugcuagucaugugagaca

SEQ ID NO: 38110 - RNA, 60 nt, Homo Sapiens
cucugagcugaguugguuuuaugaaaagcuaggaagcaaccuuucgccugugcagcgguc

SEQ ID NO: 38111 - RNA, 60 nt, Homo Sapiens
ccguggaucccacaugcacuaggacgaagcaggaagcauggaguccccuacuggcugcag

SEQ ID NO: 38112 - RNA, 60 nt, Homo Sapiens
guuuuugguucgauucugccgcuguguuaaaggaagcagugcuaaauguaagccaguugg

SEQ ID NO: 38113 - RNA, 60 nt, Homo Sapiens
ucucagccccucagagaauggugaaaaucgaggaagcaccagagccaagcuaauguggua

SEQ ID NO: 38114 - RNA, 60 nt, Homo Sapiens
gcaggcaccaugcaaaccaaacaguaauacaggaagcaugaggccugccccauguauuua

SEQ ID NO: 38115 - RNA, 60 nt, Homo Sapiens
gaucucuagagcuguccuguuagcauugggaggaagcacaagauuagcaugaaagcaguu

SEQ ID NO: 38116 - RNA, 60 nt, Homo Sapiens
ugauggagagcugcccagcuuuccccaggcaggaagcacugcuccagagcaggaugggac

SEQ ID NO: 38117 - RNA, 60 nt, Homo Sapiens
uguucugugagguuguucggucauuuggggaggaagcaugugcucuugggggauuaggua

SEQ ID NO: 38118 - RNA, 60 nt, Homo Sapiens
aggaggaggagaggggggucaggcccuggcaggaagcagguaucagguccagagggugga

SEQ ID NO: 38119 - RNA, 60 nt, Homo Sapiens
ucauguucaauaagaaaccccaggccaaagaggaagcauuacaauuuuagcaaaacaguc

SEQ ID NO: 38120 - RNA, 60 nt, Homo Sapiens
gagaagagauaauuacaaucaggcuaccaaaggaagcacuaacuuuggugcuuucaaguu

SEQ ID NO: 38121 - RNA, 60 nt, Homo Sapiens
aaaugaccaaauuauaccaaagaacuuaagaggaagcacuuucagaacuauucacuugcc

SEQ ID NO: 38122 - RNA, 60 nt, Homo Sapiens
uacagagccuagaggcucacagccuccuggaggaagcagccuccacuuuggaucaggaaa

SEQ ID NO: 38123 - RNA, 60 nt, Homo Sapiens
cccaaaucuaccugaucauaauaauuuaccaggaagcagaggagagcuacuuguuuaaaa

SEQ ID NO: 38124 - RNA, 60 nt, Homo Sapiens
aaaaaccuguacacaguguuuauugugguuaggaagcaauuucccaauguaccuauaaga

SEQ ID NO: 38125 - RNA, 60 nt, Homo Sapiens
caguaacaucuggagccuggagauauccucaggaagcacaucuguagugcacucccagca

SEQ ID NO: 38126 - RNA, 60 nt, Homo Sapiens
aagagggccuggggcacgauguggucagccaggaagcauaggaugccauuucuuuuauag

SEQ ID NO: 38127 - RNA, 60 nt, Homo Sapiens
cccccagcacagucccaggagaugacaggaaggaagcaccagggcaaggcggacgcucac

SEQ ID NO: 38128 - RNA, 60 nt, Homo Sapiens
gcagcaucugcuucuggggacaggcugcacaggaagcauguggauuggcucacgguucug

SEQ ID NO: 38129 - RNA, 60 nt, Homo Sapiens
gcagacacgagaaggagggcuguugggaaaaggaagcaaugguugaucuugaucuacaau

SEQ ID NO: 38130 - RNA, 60 nt, Homo Sapiens
auaugagaagccauauuuuucacuaacaagaggaagcagaacccuuccuucgauaccaaa

SEQ ID NO: 38131 - RNA, 60 nt, Homo Sapiens
ggaauucccuucugggagguuauauuauuuaggaagcaauaccgcuucuucauguagaug

SEQ ID NO: 38132 - RNA, 60 nt, Homo Sapiens
ccuuuaucaagaugcuauuauucaaaugaaaggaagcauacauacaugugcagaaaugua

SEQ ID NO: 38133 - RNA, 60 nt, Homo Sapiens
auuuaauaaaacuaggucaaacacaccccaaggaagcaauuguucugggaguuguuauaa

SEQ ID NO: 38134 - RNA, 60 nt, Homo Sapiens
aagaaaaaaaugaaaagcaaagaucauaauaggaagcaaaggauuucucacuucaauuau

SEQ ID NO: 38135 - RNA, 60 nt, Homo Sapiens
ggcagaugggaaagcagagaugcuguugggaggaagcagaaagaaagcacauuuuaccau

SEQ ID NO: 38136 - RNA, 60 nt, Homo Sapiens
ugccuuccggagggggcucugaagaaaagaaggaagcagugaccuguuuauacauugaag

SEQ ID NO: 38137 - RNA, 60 nt, Homo Sapiens
caaagauugcaacccagggcgagcaguuggaggaagcaucggagacaaggauaaguuaua

SEQ ID NO: 38138 - RNA, 60 nt, Homo Sapiens
caacuggccugacccaugagucuggaguccaggaagcaggccucagccauggcaagucca

SEQ ID NO: 38139 - RNA, 60 nt, Homo Sapiens
ggagaaauccacguaaccuuucuguggaaaaggaagcacgacguccugagccgguuuaag

SEQ ID NO: 38140 - RNA, 64 nt, Homo Sapiens
cucucugggggaccagaagucaaccacauagccuugggaccagcgccccuuuucugucaccagc

SEQ ID NO: 38141 - RNA, 64 nt, Homo Sapiens
gaaugggcaccugcuggaguucaccugugcuuucugggaccaaagcagaguuccugauuccaag

SEQ ID NO: 38142 - RNA, 64 nt, Homo Sapiens
agaccaugaccacuguaggaggaccaucagaccaugggaccaucauggauggauaaauagauug

SEQ ID NO: 38143 - RNA, 64 nt, Homo Sapiens
agaccaugggaccaucagacauggauaaauagauugggaccauccuuccauaaauguuggaugg

SEQ ID NO: 38144 - RNA, 64 nt, Homo Sapiens
guuuucuguuuuuugauggaccaccacgcccaacugggaccagggcugggauuacaggcgugag

SEQ ID NO: 38145 - RNA, 64 nt, Homo Sapiens
ggcgacugccaccacacccagccuccugaguagcugggaccacacaagcgauucuccugccuca

SEQ ID NO: 38146 - RNA, 64 nt, Homo Sapiens
uggagggccacaugcacacaccccgcaucuccccugggaccagccugccuggacuguccccugu

SEQ ID NO: 38147 - RNA, 64 nt, Homo Sapiens
cuuuguucucuuccucaccuuugccagagugggcugggaccagagacaagguggggaacaaucc

SEQ ID NO: 38148 - RNA, 64 nt, Homo Sapiens
acagugaggaggcuguccaccuugcuuggcucacugggaccaggaaagccugucuuugguuagg

SEQ ID NO: 38149 - RNA, 64 nt, Homo Sapiens
uguucucaugguuggcucugacuuucagcuguguugggaccacuggcugaucacaucaccucuc

SEQ ID NO: 38150 - RNA, 64 nt, Homo Sapiens
gagcaugggacuguucuuuuacaagacaggacccugggaccacagagggcaggaacuugcacaa

SEQ ID NO: 38151 - RNA, 64 nt, Homo Sapiens
ugccccaugcugcccgcuucucacccuaugugggugggaccacagacucacauccugaccuugc

SEQ ID NO: 38152 - RNA, 64 nt, Homo Sapiens
agaauguggcaacguaguugugcucgccagaacgugggaccaaauuggccucagguguugaguc

SEQ ID NO: 38153 - RNA, 64 nt, Homo Sapiens
ggcuuggucuggauucccagaagcauagcuuagaugggaccacagugggcaauuuugaccuguc

SEQ ID NO: 38154 - RNA, 64 nt, Homo Sapiens
auucggcucccuucagcaaauuucagggguuuucugggaccaguucucccccaacaggaaacuu

SEQ ID NO: 38155 - RNA, 64 nt, Homo Sapiens
gucccaauuuguguguauucugaaacuuucucuuugggaccaaauucauucucaauggcccuga

SEQ ID NO: 38156 - RNA, 64 nt, Homo Sapiens
cagucugccucuuccuccuacuucugcuguagccugggaccagaccuggccaaggucagccagc

SEQ ID NO: 38157 - RNA, 64 nt, Homo Sapiens
cacaaacagcagaggccuucccuggaggaggcuuugggaccaccccuggggggacuucccaaag

SEQ ID NO: 38158 - RNA, 64 nt, Homo Sapiens
ucaugcagcugaaagucuacccgagcuacagggcugggaccaggaaccucaccuccuggggcuu

SEQ ID NO: 38159 - RNA, 64 nt, Homo Sapiens
ggcugggaccccucauuaacugccuuccagggccugggaccauucuugcaagacagccugacug

SEQ ID NO: 38160 - RNA, 64 nt, Homo Sapiens
ggagcccccucugccucuugaguaccagaccucaugggaccagaccccuugggaccacauggca

SEQ ID NO: 38161 - RNA, 64 nt, Homo Sapiens
ucuugaguaccagaccucaugggaccagaccccuugggaccacauggcacaaugggaccucugu

SEQ ID NO: 38162 - RNA, 64 nt, Homo Sapiens
cugaaauaagcugcgugugguggcucacaccuguaaucccaacacuuugggacguugaaauggg

SEQ ID NO: 38163 - RNA, 64 nt, Homo Sapiens
ggaaacuaggccaggcgugguggcucacgccuguaaucccaacacuuugggaggccgaggcggg

SEQ ID NO: 38164 - RNA, 64 nt, Homo Sapiens
cugagguagagauuccaggcccuggcauaagcugaaucccaaauuugaguuugggaagaaccag

SEQ ID NO: 38165 - RNA, 64 nt, Homo Sapiens
ccccuucucuccuccucugccucacuucuuuaguaaucccaacccuauaaaaaugaaccuaaug

SEQ ID NO: 38166 - RNA, 64 nt, Homo Sapiens
cuuugggaggccaaggcagguggcucacgccuguaaucccaacaacggaagccggcuggggugg

SEQ ID NO: 38167 - RNA, 64 nt, Homo Sapiens
aauaguccuaggcuggacagucggcuaacuccuaaaucccaauguuauguguuagcaaguauaa

SEQ ID NO: 38168 - RNA, 64 nt, Homo Sapiens
gcuuagcaggaugggcgcaguggcucacgccacuaaucccaacauuuuaggaggccuaggcagg

SEQ ID NO: 38169 - RNA, 64 nt, Homo Sapiens
uuaaaaaaggcugggugugguggcucacacccauaaucccaacacuuuggcucagcagauugcu

SEQ ID NO: 38170 - RNA, 64 nt, Homo Sapiens
agagcccuggcuggugaugugcuggcugggggugaaucccaaugagggucccucucagagcggg

SEQ ID NO: 38171 - RNA, 64 nt, Homo Sapiens
agagcccuggauggugaugcgcuggcugggggugaaucccaaugagggucccucucagaaaggg

SEQ ID NO: 38172 - RNA, 64 nt, Homo Sapiens
cuaacauuggccaggcacgguggcucacgccuguaaucccaacacuuuaggagaccaaggcggg

SEQ ID NO: 38173 - RNA, 64 nt, Homo Sapiens
auuuuucaagcugggccuaguggcgcacaccugcaaucccaacacuuugggaggccaagagagg

SEQ ID NO: 38174 - RNA, 64 nt, Homo Sapiens
ugaaagccuucaccugaugccucugcagcuacacaaucccaagacagagcuagagcaagggucu

SEQ ID NO: 38175 - RNA, 64 nt, Homo Sapiens
uuaaaaaauagaugaucaagaucuaaaggaaauuaaucccaaccaacaaacuuaaaaguuuauc

SEQ ID NO: 38176 - RNA, 64 nt, Homo Sapiens
cgaaaucaccucuuguuuuaaaaauaaaaaucccaaucccaaguagaacaaaacuccaucucaa

SEQ ID NO: 38177 - RNA, 64 nt, Homo Sapiens
ccaagucgaaaucaccucuuucucaaaaaauaaaaaucccaaucgcaacaagaacaaaacucca

SEQ ID NO: 38178 - RNA, 64 nt, Homo Sapiens
cugcauugccgaguucuuauuuucaccuuuucauaaucccaacuacaauaacaagaauuuuauu

SEQ ID NO: 38179 - RNA, 64 nt, Homo Sapiens
ugggccuaaggauccauggaagucaggagcauuaaaucccaaaccaaaucaacuccagauauau

SEQ ID NO: 38180 - RNA, 64 nt, Homo Sapiens
cuuugggaggcuaaggcagcuggcucaugccuguaaucccaacagaagaaaaggccgggcaugg

SEQ ID NO: 38181 - RNA, 64 nt, Homo Sapiens
cuucgggaggccaaggugaguggcucacgccuauaaucccaacaacuguccuggccaguugcag

SEQ ID NO: 38182 - RNA, 64 nt, Homo Sapiens
ccccaggaaacccaaucaugaaauuugaaaauccaaucccaaguccaaauccccagggaauccc

SEQ ID NO: 38183 - RNA, 64 nt, Homo Sapiens
uugaaaauccaaucccaaguccaaauccccagggaaucccaaaugacccccaaaucauggaauc

SEQ ID NO: 38184 - RNA, 64 nt, Homo Sapiens
ccccagggaaucccaaauuucccccaaaucauggaaucccaaaucaaugccguaacuccuagga

SEQ ID NO: 38185 - RNA, 64 nt, Homo Sapiens
guauauguauauguuaaaaaaggggagaauagcuaauagcuauagaaguaaggacugaaggaga

SEQ ID NO: 38186 - RNA, 64 nt, Homo Sapiens
agcuauaguauauguauaugaaggagaaggggagaauagcuaauggagccagaaguaaggacug

SEQ ID NO: 38187 - RNA, 64 nt, Homo Sapiens
cuaaguccauauuuugaugcaaaauccaugagugaauagcuaucgauguaguuuugcagagaca

SEQ ID NO: 38188 - RNA, 64 nt, Homo Sapiens
uuuuuacugauuauuuucauaccuacauuuuuuaaauagcuaggcuuacccaugaaugugcacu

SEQ ID NO: 38189 - RNA, 64 nt, Homo Sapiens
cucugcccucuguaauguagcaaucaaaccuuaaaauagcuacagucuaauaaaaaaaucugga

SEQ ID NO: 38190 - RNA, 64 nt, Homo Sapiens
auuggguuuucuaguuuuuuuuuuaguuuucuggaauagcuaguuuuuucaagcaauccuuuag

SEQ ID NO: 38191 - RNA, 64 nt, Homo Sapiens
gauggaaauggugauuuuuacauguguccuggaaagauauuaaaguaauucaaaucuuccccaa

SEQ ID NO: 38192 - RNA, 64 nt, Homo Sapiens
uuuuccuuuccaagcauuguaaauuguauaccaaagauauuaguuauuacuucuguguguacaa

SEQ ID NO: 38193 - RNA, 64 nt, Homo Sapiens
caacuccuaagggguccucugggauuaguuaugcagauauuaaaucacccgaagacacuaacuu

SEQ ID NO: 38194 - RNA, 64 nt, Homo Sapiens
gccaggauuuaggaauauuuucagaacagauuuuagauauuauuucuauccauauauugaaaag

SEQ ID NO: 38195 - RNA, 64 nt, Homo Sapiens
uaaauacaauaucauauauaaauugagauuacucagauauuaauuauccuuccuagaaaauggu

SEQ ID NO: 38196 - RNA, 64 nt, Homo Sapiens
uuaccaauuuucaaauuauuuuuucauauucacaagauauuaaaagcuaaucuauaccauaaua

SEQ ID NO: 38197 - RNA, 64 nt, Homo Sapiens
uaauuccauauaauaacugaaacauuuuaauuccagauauuauuauauagucauuagccaccua

SEQ ID NO: 38198 - RNA, 64 nt, Homo Sapiens
uccuuuagcuauagguucuugaaacuggcacuucagauauuauaaucacuaaaaugauuuguga

SEQ ID NO: 38199 - RNA, 64 nt, Homo Sapiens
gcugcuuuuggguaaaacaguaaccugguuaaacagauauuaaaauggaguucuuauuauagaa

SEQ ID NO: 38200 - RNA, 64 nt, Homo Sapiens
aagcuaguccucugcaaggguauuguauaaaagaagauauuacuugcaaguaauagcaagagag

SEQ ID NO: 38201 - RNA, 64 nt, Homo Sapiens
gguaaagagugaaugauaguuuagacagcagggaagauauuaguaggagggaagauauuaguga

SEQ ID NO: 38202 - RNA, 64 nt, Homo Sapiens
gauuagacagcagggaagauuuagacaggagggaagauauuaguaggaaggaagacauuaguga

SEQ ID NO: 38203 - RNA, 64 nt, Homo Sapiens
gcacaaacugccaucucgcugaacuucgaagggcagauauuacuauugcauuaguugguugcau

SEQ ID NO: 38204 - RNA, 64 nt, Homo Sapiens
cuuggcaaacugcuuaaucuagugcucaacuguuagauauuaauuccuuucccucacuuucucc

SEQ ID NO: 38205 - RNA, 64 nt, Homo Sapiens
aguuuuccuaagugauuguauauucagcuuuaguagauauuaccuagaggaugaggaaagcaug

SEQ ID NO: 38206 - RNA, 64 nt, Homo Sapiens
ccauguaaagaacauaaauauuuucuuucuaaugagauauuaaaaacuuucucuaugaacucug

SEQ ID NO: 38207 - RNA, 64 nt, Homo Sapiens
ggugcuacaaauaauccagacuaccaggucugguagauauuaaagcuggguacuaagaaauguu

SEQ ID NO: 38208 - RNA, 64 nt, Homo Sapiens
auucauuugaaagucugauggcuuuuacaauaaaagauauuaagaauuguuauccuuaacuuac

SEQ ID NO: 38209 - RNA, 64 nt, Homo Sapiens
ucaaaccgauccagaauaccgaagguauggacaggacagaaaagcgagucgcaggaggaaggga

SEQ ID NO: 38210 - RNA, 64 nt, Homo Sapiens
uaccacaccaaggcuggaggcuggucugucauaagacagaaagaaagacgcugggcccaauuuu

SEQ ID NO: 38211 - RNA, 64 nt, Homo Sapiens
aaaccagggaguuuguagaguauuugacuucacugacagaaaagguccagggccguuguguaga

SEQ ID NO: 38212 - RNA, 64 nt, Homo Sapiens
ugauuaagguaauguguccuuggcugagaagugggacagaaagaaugccccucucgggccuuug

SEQ ID NO: 38213 - RNA, 64 nt, Homo Sapiens
caaauagcaauugacuugaaguuaaauuaauuuagacagaaaaguuaacaauacuccaaucaca

SEQ ID NO: 38214 - RNA, 64 nt, Homo Sapiens
agucucuucuaaaaauuguugaugagcauuggucgacagaaagaccuauaucuaggagucucuu

SEQ ID NO: 38215 - RNA, 64 nt, Homo Sapiens
cuuccauaauugaacuagaucaguuuagagucaggacagaaaagagaguauccaauaaaggaga

SEQ ID NO: 38216 - RNA, 64 nt, Homo Sapiens
aaaaagagagacaaacucuagaaagagaaugaaugacagaaaaaacagacgugacguccugcca

SEQ ID NO: 38217 - RNA, 64 nt, Homo Sapiens
gguuacuauggguuugccauuaauuucugagugggacagaaauuauaauugugcuuuuucgugu

SEQ ID NO: 38218 - RNA, 64 nt, Homo Sapiens
auacuauuggaauauaguauguagggugaaaguugacagaaaucuguacuucuucaggaaaucc

SEQ ID NO: 38219 - RNA, 64 nt, Homo Sapiens
caugcugcuaguaucagaggggcaguagagcuuggacagaaagaaaagaaacuugguguuaggu

SEQ ID NO: 38220 - RNA, 64 nt, Homo Sapiens
acuguugcauggauccuguguuugcaacuggggagacagaaacugugguugauagccagucacu

SEQ ID NO: 38221 - RNA, 64 nt, Homo Sapiens
cagugacgaaggugcguuguucgugccgaaaugagacagaaauuauacaggguugguucucauu

SEQ ID NO: 38222 - RNA, 64 nt, Homo Sapiens
gacaaaagguccagucucauaaagucaguuuggagacagaaaaaacagcaguuucaaaaaugac

SEQ ID NO: 38223 - RNA, 64 nt, Homo Sapiens
gcaucgucaaaagauuuuugcuuggaauaagcaugacagaaagauuuaaccuaaguguuagaca

SEQ ID NO: 38224 - RNA, 64 nt, Homo Sapiens
auuuguuacagcaauccuaggaagcuaauacucugacagaaaaaaaucuuggauaauaugcaug

SEQ ID NO: 38225 - RNA, 64 nt, Homo Sapiens
aagcaguguuaagaauaccauuauagugaggauugacagaaauuuucuaaagaugucuuaacau

SEQ ID NO: 38226 - RNA, 64 nt, Homo Sapiens
aauggaaugucuucagucauagaaagugguuugggacagaaagaaguauuuccccauggaaagg

SEQ ID NO: 38227 - RNA, 64 nt, Homo Sapiens
gaagcauacauuccugucagacaacuaguugucugacagaaauguuaggcuucauguauguuac

SEQ ID NO: 38228 - RNA, 64 nt, Homo Sapiens
gccauuuuaaauuuaacuuugacauccagcuauagacagaaauaauaagccacccuggguguaa

SEQ ID NO: 38229 - RNA, 64 nt, Homo Sapiens
uauguucugauauccuccuacaguaguuuaaauugacagaaaaauuugaauguuuucuucuuaa

SEQ ID NO: 38230 - RNA, 64 nt, Homo Sapiens
auauaccugaacuguagugguuugaucggauggagacagaaaacccgauuuuuauucucauaaa

SEQ ID NO: 38231 - RNA, 64 nt, Homo Sapiens
aauaauugaaagaaucgauaaaaguucaucuuuggacagaaagccuuuaaaaaaaaaaucacuc

SEQ ID NO: 38232 - RNA, 64 nt, Homo Sapiens
gugaaaacaugucaagugucacauuagugucacagacagaaagcacacaccuaugcaauauggc

SEQ ID NO: 38233 - RNA, 64 nt, Homo Sapiens
augggugcugugguccucuguauggggaagcugugacagaaacgggcccugacuccugcggggg

SEQ ID NO: 38234 - RNA, 64 nt, Homo Sapiens
agaagccucuggacacugccgcugcaacacugaagacagaaagaggguaggguaaaaggcaugu

SEQ ID NO: 38235 - RNA, 64 nt, Homo Sapiens
cuuaaacaccccacugucaacauuagaucaaugagacagaaaguuaacaaggauauccaggaau

SEQ ID NO: 38236 - RNA, 64 nt, Homo Sapiens
aauaaauguaauccagcauauaaacagaaccaaagacagaaaccacaugauuaucucaauagau

SEQ ID NO: 38237 - RNA, 64 nt, Homo Sapiens
ugaggaacagcacaucagcucuacagaaguguguuuuacucauucuaccugacucauuccagca

SEQ ID NO: 38238 - RNA, 64 nt, Homo Sapiens
ggaggaacaguaccuuggcucuacagaagugcuguuuacucauucugccugacuuaggccagcc

SEQ ID NO: 38239 - RNA, 64 nt, Homo Sapiens
uugaagggacuucguugguuuugaagcuguuuccuuuacucacacuuguaaaaauugucagugc

SEQ ID NO: 38240 - RNA, 64 nt, Homo Sapiens
uugaagggacuuuguuggcuuugaaacuguuuccuuuacucaugcucguaaaaacugucagugc

SEQ ID NO: 38241 - RNA, 64 nt, Homo Sapiens
ccacucagaugagaauuuauguuuaacuucucuuuuuacucaucagcugcaagcaaaaucuugu

SEQ ID NO: 38242 - RNA, 64 nt, Homo Sapiens
uuagguaaagacauacucauuaaguguuauuuauuuuacucaagaacuggaaaccaacuaaaug

SEQ ID NO: 38243 - RNA, 64 nt, Homo Sapiens
cauuucuuuacaagaaaauguauucuuuuacucauuuacucaguuagcuuauaaauuuacuuau

SEQ ID NO: 38244 - RNA, 64 nt, Homo Sapiens
uacucagucauuucuuuacauuacuuauuauucuuuuacucauuuuaaccuguagcuuauaaau

SEQ ID NO: 38245 - RNA, 64 nt, Homo Sapiens
auuaccacucugauuauaguucugaguucuuugauuuacucaugcugcaugacaaaauguuuac

SEQ ID NO: 38246 - RNA, 64 nt, Homo Sapiens
acuuaucuuucucacugagguucauucacuggaauuuacucacgcaaucucaguagaguacaac

SEQ ID NO: 38247 - RNA, 64 nt, Homo Sapiens
uagcacuccagucacaaacauguaaucaugauaauuuacucaggcuucucuuaauugcuuuuca

SEQ ID NO: 38248 - RNA, 64 nt, Homo Sapiens
aaaacaaaaaaacaaaaaccauuguuuuaauaucuuuacucaaaaagacgacuuuggcaucuga

SEQ ID NO: 38249 - RNA, 64 nt, Homo Sapiens
aacuuuuggguaaauaaaaauaucuaacuuucaguuuacucaaaaugaguugcuguuccuggag

SEQ ID NO: 38250 - RNA, 64 nt, Homo Sapiens
acacaauuugcacuguacacugguauuugauguauuuacucaaaucaguucuguaagaaaugag

SEQ ID NO: 38251 - RNA, 64 nt, Homo Sapiens
uuacuuaaaagagaucuccuuuuagauuuuuuauuuuacucauuaauauuuguaucauuuccuu

SEQ ID NO: 38252 - RNA, 64 nt, Homo Sapiens
uaacaaauuaucuuuaguuauccagauuucauacuuuacucauuugaacaaaugaaaguguuca

SEQ ID NO: 38253 - RNA, 64 nt, Homo Sapiens
auuuuucuugagguugaucugcccuccuguacuauuuacucaguuuuaauaauacuuccaaauu

SEQ ID NO: 38254 - RNA, 64 nt, Homo Sapiens
cacauacaccaucacacuuucgaugagcucagccuuuacucauuagaggcagcaaagccgggug

SEQ ID NO: 38255 - RNA, 64 nt, Homo Sapiens
aggggcauuugacauccccuccugguucucaccaggaaaacauccaaagcuuuggaggaaacag

SEQ ID NO: 38256 - RNA, 64 nt, Homo Sapiens
cuuccccagccccugggccuggucacuacacaguggaaaacagacaagcggccccuuccccaaa

SEQ ID NO: 38257 - RNA, 64 nt, Homo Sapiens
gauauuuuauuuuuaaacuuuuuuuuuuuuuccuggaaaacauccugugcagaaaaggguauau

SEQ ID NO: 38258 - RNA, 64 nt, Homo Sapiens
gcagaccuagauaagaaaagcagagaacuacuuuggaaaacaguuuaucugcuguaauugaaca

SEQ ID NO: 38259 - RNA, 64 nt, Homo Sapiens
gugugcaugaaccaaaggaaauaacauugaagaaggaaaacaauauguagaaaguauuuuagaa

SEQ ID NO: 38260 - RNA, 64 nt, Homo Sapiens
caucugaauaauuauggaaguugggacauguuaaggaaaacaaauauguucaucaccaacaauc

SEQ ID NO: 38261 - RNA, 64 nt, Homo Sapiens
aguagaauaggugaccucuucugucacagguaauggaaaacauagcuuucauuccgugugcuuc

SEQ ID NO: 38262 - RNA, 64 nt, Homo Sapiens
auuuauagggcuuaaagcccaaacuuauuuucuuggaaaacaauguugucauuuugcacuuuca

SEQ ID NO: 38263 - RNA, 64 nt, Homo Sapiens
uauaauaaccagugcugugaaaaagauuuuauaaggaaaacaaaaguacacaauuuauaaagua

SEQ ID NO: 38264 - RNA, 64 nt, Homo Sapiens
ggaaauuuaaaucuccaaauauaaccuaacugcuggaaaacaagauauaggcuuccaacaccaa

SEQ ID NO: 38265 - RNA, 64 nt, Homo Sapiens
gaaggugauugcugcuauucacuuuugguaggaaggaaaacagguacauuauuugcugauacca

SEQ ID NO: 38266 - RNA, 64 nt, Homo Sapiens
acagcucagauugucgaguuauauuuaacaccugggaaaacagguuucauuucccaguuaaaug

SEQ ID NO: 38267 - RNA, 64 nt, Homo Sapiens
uaauaccagauaccuuaucuuacaauauugauugggaaaacauuugcugccauuacagagguau

SEQ ID NO: 38268 - RNA, 64 nt, Homo Sapiens
aaccacuuaaacgaagaguucccuugaaacuuugggaaaacauguuaaugacaauauuccagau

SEQ ID NO: 38269 - RNA, 64 nt, Homo Sapiens
ucacuacuuagggauuuuuguaggagcucugcuuggaaaacaguuaggacaggaaaugaaacau

SEQ ID NO: 38270 - RNA, 64 nt, Homo Sapiens
acaaaacaaaacaaaccuccgauaaaaggucuugggaaaacaaauuguaaauucucuggugcaa

SEQ ID NO: 38271 - RNA, 64 nt, Homo Sapiens
aagauuagaagcugaaaaccuaaguccuuuauguggaaaacagaacaucauuagaacaaaggac

SEQ ID NO: 38272 - RNA, 64 nt, Homo Sapiens
caucuauaaauuguccguguucauacauuugaggggaaaacaccauaagguuucguuucuguau

SEQ ID NO: 38273 - RNA, 64 nt, Homo Sapiens
guuacugauucacugcauggcucccacaggagugggaaaacacugccaucuuaguuuggauucu

SEQ ID NO: 38274 - RNA, 64 nt, Homo Sapiens
aaugauauaaagccauaugagaggaaaacauuagggaaaacaaauagaaauauuucaugucaag

SEQ ID NO: 38275 - RNA, 64 nt, Homo Sapiens
agggaaaacaaaaaugauauuuucaugucaaggaggaaaacauucuguuuaaccauuagaaaua

SEQ ID NO: 38276 - RNA, 64 nt, Homo Sapiens
gccaaaccuccacagcucauacaacuguuaagauggaaaacaguauaaaaucuuacaauacaga

SEQ ID NO: 38277 - RNA, 64 nt, Homo Sapiens
uagugggauuagcaaggugauaggauucuaccgaggaaaacaucgcacauggaaacccaugagc

SEQ ID NO: 38278 - RNA, 64 nt, Homo Sapiens
cuuuaaagggauugugucuaccugacaugauggaggaaaacaacuaauuuuaguuauguaacaa

SEQ ID NO: 38279 - RNA, 64 nt, Homo Sapiens
uguuacaguuuuauugcucuuuuuacaguauuugggaaaacaacguugcuggucagucuuagug

SEQ ID NO: 38280 - RNA, 64 nt, Homo Sapiens
auaggaauuugcuuccuaagucuacuuuugaagaggaaaacaggaacguaccauauauuuugcu

SEQ ID NO: 38281 - RNA, 64 nt, Homo Sapiens
acuugauuuuugacagauacggcaagcucuauggggaaaacaauauguacuaccuuauacccuu

SEQ ID NO: 38282 - RNA, 64 nt, Homo Sapiens
aggguuggagugugccagugcacagguagacuaaggaaaacauuauagaggagugaagagaaca

SEQ ID NO: 38283 - RNA, 64 nt, Homo Sapiens
caagaugucuaauuuuuuuuuaaguaggaccaaaggaaaacaagauuuagauagucugacuuug

SEQ ID NO: 38284 - RNA, 64 nt, Homo Sapiens
aaugaaaugccuaaauauaugaauuuuaaaugcuggaaaacauauuucaaacacagguuuugcg

SEQ ID NO: 38285 - RNA, 62 nt, Homo Sapiens
ugaauuacauugugcaaugcgauguuuugggaggaaaacaaugcagcuguagcauacccuaa

SEQ ID NO: 38286 - RNA, 64 nt, Homo Sapiens
acacuguaacugaagagucacuggacacagaaauggaaaacaggagucgauuuuccgucuuuug

SEQ ID NO: 38287 - RNA, 64 nt, Homo Sapiens
guuuuucccuaaauguuucccuacuagucuuuuuggaaaacauguuuguuuuaauuucaucuuc

SEQ ID NO: 38288 - RNA, 64 nt, Homo Sapiens
gucaaguuauuauugcuguuacucuggaugauauggaaaacacugccauauuuuaaaucaacua

SEQ ID NO: 38289 - RNA, 64 nt, Homo Sapiens
uaacuuauuggagcacaucaguuucuuggguaauggaaaacauuaccuagaguugccaguggca

SEQ ID NO: 38290 - RNA, 64 nt, Homo Sapiens
uguaguuuccacagugugagaagggcacucaaggggaaaacaaaaggaagcaggcuguagauuu

SEQ ID NO: 38291 - RNA, 64 nt, Homo Sapiens
ucuuuagggcugucugcaugcgaugugcccggcuggaaaacaugagccuucuggcugauuguuc

SEQ ID NO: 38292 - RNA, 64 nt, Homo Sapiens
gaguaaacccuagugucaacggaaaacagugaacggaaaacacauuugucaaaaugcagagaau

SEQ ID NO: 38293 - RNA, 64 nt, Homo Sapiens
gaacggaaaacacagaguaaaaaaugcagagaauggaaaacaguguaggguacuguaauuuguc

SEQ ID NO: 38294 - RNA, 64 nt, Homo Sapiens
gaagucaaagcaaggaaacuuuaaugaagaaaguggaaaacaaggacuccaguuaaaaaaaauu

SEQ ID NO: 38295 - RNA, 64 nt, Homo Sapiens
cauucacaacuuguuuuuggccagcacugcuugaggaaaacaagccuucaaacuagggccaagc

SEQ ID NO: 38296 - RNA, 64 nt, Homo Sapiens
gagaaaaccccuuuuaucaucaguggaaucuuacggaaaacacaaauauguaacuauucuaauc

SEQ ID NO: 38297 - RNA, 64 nt, Homo Sapiens
acugcuuagaagccccuuucacaauagaugguuaggaaaacaaauccagcuuaaugcaguguga

SEQ ID NO: 38298 - RNA, 64 nt, Homo Sapiens
acuuccugaauuacugacccuuuuuuuccauaaaggaaaacaucacuuauuuuacuuucgauuu

SEQ ID NO: 38299 - RNA, 64 nt, Homo Sapiens
uauuuuacuuucgauuuuuuuuaucuucaucaugggaaaacacuauaagccauuaaacuuagca

SEQ ID NO: 38300 - RNA, 64 nt, Homo Sapiens
gaaucaggauucuauagacuagggguucuggaagggaaaacaugcuauauuuguacuguacccu

SEQ ID NO: 38301 - RNA, 64 nt, Homo Sapiens
aggagaggguggcucaggacgacuuaccaaaccaggaaaacagcaccaucaaaccuuuccuccu

SEQ ID NO: 38302 - RNA, 64 nt, Homo Sapiens
ugaaagccauaaugacggugacuugugucgugggggaaaacauaaggucauuuucucccucuac

SEQ ID NO: 38303 - RNA, 64 nt, Homo Sapiens
aguauguuguuaguuuugaaagacauucacucaaggaaaacaccaucucaacuuugcccgcuca

SEQ ID NO: 38304 - RNA, 64 nt, Homo Sapiens
aauacauauuguuuaaaaaaaagcaagaaaaaaaggaaaacaaaggaaaauauccccaaaguug

SEQ ID NO: 38305 - RNA, 64 nt, Homo Sapiens
guguccuaacaguccccgggcuagagaggacuaaggaaaacagagagaguguuacgcaggagca

SEQ ID NO: 38306 - RNA, 64 nt, Homo Sapiens
uaccugaaagugagggggagaauggaaccaacuuggaaaacacucugcaggauauuauccagga

SEQ ID NO: 38307 - RNA, 64 nt, Homo Sapiens
aauaaaaggauggaggaagaucuacgaagcaaauggaaaacaaacaaaaaaagaggcagggguu

SEQ ID NO: 38308 - RNA, 64 nt, Homo Sapiens
ggcuuuucuuaacuauuucauuguuaccaaacugggaaaacagaaugcaucagacaaaagccau

SEQ ID NO: 38309 - RNA, 64 nt, Homo Sapiens
aagcacuuuuuucuuaauggaaaaaagaaagaaaggaaaacaaacuuuucuggcaaaaaaaaaa

SEQ ID NO: 38310 - RNA, 64 nt, Homo Sapiens
gcuuucuagcagcugcaaaaaaaucaggaaaacaggaaaacacaucuuagcuucuccauugucu

SEQ ID NO: 38311 - RNA, 64 nt, Homo Sapiens
aaaacacagcuuucuagcagcauugucuaaaucaggaaaacaggauuucucuucuuagcuucuc

SEQ ID NO: 38312 - RNA, 64 nt, Homo Sapiens
ccucggggcuggcguaaaccuaucucugucugacggaaaacagaaugguggaaggcaggacacg

SEQ ID NO: 38313 - RNA, 64 nt, Homo Sapiens
acaaaccuggcacaccauuuggguuuguuuugguggaaaacaucagguuggggugcccuuguuu

SEQ ID NO: 38314 - RNA, 64 nt, Homo Sapiens
aucugagucuccagccaggacucgucauuuaaagggaaaacaaagcuggguuucuuccaaccau

SEQ ID NO: 38315 - RNA, 64 nt, Homo Sapiens
acccagaaagugcggcaggacaaugaggaggaguggaaaacaaaccagguaaguaugugaugag

SEQ ID NO: 38316 - RNA, 64 nt, Homo Sapiens
cucccuucgggaaacauccuugccuuuguccaagggaaaacagagccugggcaaucagaugggc

SEQ ID NO: 38317 - RNA, 64 nt, Homo Sapiens
gucuuaagugaaccacuguguauauaaauauguuggaaaacagcuguauacauuuuugggcaac

SEQ ID NO: 38318 - RNA, 64 nt, Homo Sapiens
ccuccuaauuauuuuuuucaaugagugcugaaugggaaaacauuuauaucuuacuauaaaaggu

SEQ ID NO: 38319 - RNA, 64 nt, Homo Sapiens
accaauggagacagaaaacuggucaucucuaaacaaggcuuaucgaaaaagagugccagucuuu

SEQ ID NO: 38320 - RNA, 64 nt, Homo Sapiens
ugaguuuagaugggaaauagauugcgacauugugaaggcuuaaaguuugcaaguaacugaaucc

SEQ ID NO: 38321 - RNA, 64 nt, Homo Sapiens
cauacuuuugauguuucaauuccauaaaaacuucaaggcuuaucugaauuucucacauuuaugg

SEQ ID NO: 38322 - RNA, 64 nt, Homo Sapiens
cauuauauuuauagaauauagugucugcuaauucaaggcuuauauuuuggucaucccuaauaaa

SEQ ID NO: 38323 - RNA, 64 nt, Homo Sapiens
guuaaauaauguagaaguaaaaaaauuuuuuuuaaaggcuuaauuugggaggggggacuuauuu

SEQ ID NO: 38324 - RNA, 64 nt, Homo Sapiens
uuuuucuuuuuuaaauaaacagguuugcuuuggaaaggcuuaaugauggaauguuagcaucuuc

SEQ ID NO: 38325 - RNA, 64 nt, Homo Sapiens
uggcucacaccuguaaaagaaaaaagaaucaaauugaauauaucuuuuaagaauucaaaacuag

SEQ ID NO: 38326 - RNA, 64 nt, Homo Sapiens
acaauauaauggcaauagguagagauacaacaaaugaauauaacacuauaacacuucauauuuu

SEQ ID NO: 38327 - RNA, 64 nt, Homo Sapiens
uuucccuugauuauucaccaaacuauagguacucugaauauauauaaggaccgauuugagcacu

SEQ ID NO: 38328 - RNA, 64 nt, Homo Sapiens
uuacauuucuaugagccuaaauuauucuuucuuuugaauauauuugugacuacccaaauugcua

SEQ ID NO: 38329 - RNA, 64 nt, Homo Sapiens
uacagauagauagaugaguaauuuaaauguuuccugaauauauaacauaauuuaaaugaauuug

SEQ ID NO: 38330 - RNA, 64 nt, Homo Sapiens
uuaagcaaugggcuaaggucugcuaauauucuacugaauauaauuuauagcacauauuaguuag

SEQ ID NO: 38331 - RNA, 64 nt, Homo Sapiens
cauguauguauauacagaugauauguauauaauuugaauauauauugaaucuacaaauaucuuu

SEQ ID NO: 38332 - RNA, 64 nt, Homo Sapiens
uauauauauaucuguauagacacacacagaaagaugaauauauauguguggauauauauacaca

SEQ ID NO: 38333 - RNA, 64 nt, Homo Sapiens
uuucaggcuacaagugacaagacagauucugcuuugaauauagcuacagaaauaaaggauggac

SEQ ID NO: 38334 - RNA, 64 nt, Homo Sapiens
auucaggcuacaagugaugagaaagauucuguuuugaauauagccagaggaaaaaaggauggag

SEQ ID NO: 38335 - RNA, 64 nt, Homo Sapiens
gccuacuuuuaugucaccucuauauuguaggauuugaauauacagauaauuggaaaaaauugaa

SEQ ID NO: 38336 - RNA, 64 nt, Homo Sapiens
guaggauuugaauauacagcuaauuggaaaaaauugaauauauugcaaauuguuguucaaaaga

SEQ ID NO: 38337 - RNA, 64 nt, Homo Sapiens
uuuauuuuacauaguuuugugacuuaauuacacaugaauauaaaaucuauaauucuauaugaau

SEQ ID NO: 38338 - RNA, 64 nt, Homo Sapiens
aauuacacaugaauauaaaaucuauaauucuauaugaauauauagagauauagaaacaucugaa

SEQ ID NO: 38339 - RNA, 64 nt, Homo Sapiens
uuuucaaaauaauuagcuauauuuuuauauaauaugaauauauacauaaaaauuguuucuauaa

SEQ ID NO: 38340 - RNA, 64 nt, Homo Sapiens
auuagucauauuuuuguaaauaugacagaauuugugaauauauuuuuaaagcaaaaaacuucaa

SEQ ID NO: 38341 - RNA, 64 nt, Homo Sapiens
cacuguuugcuuuuauaaaauaacuuugauuacaugaauauaauaaauuaugugcauauaaaug

SEQ ID NO: 38342 - RNA, 64 nt, Homo Sapiens
acacuuuggcaugaacauuacugcagguuuuugaugaauauaaugaauguauggaauucaauug

SEQ ID NO: 38343 - RNA, 64 nt, Homo Sapiens
aauguguguguguaguuacuguucuuuaaagacuugaauauaugccauacccaguggcagaggu

SEQ ID NO: 38344 - RNA, 64 nt, Homo Sapiens
uacaguauuuuaauauuuaguuuuguuuuugcuaugaauauaauuacuguaucaaugucuauuu

SEQ ID NO: 38345 - RNA, 64 nt, Homo Sapiens
cauagagcuagaaucauauuuccuuuuguaauacugaauauaaaauuaauauuuuagaaaauau

SEQ ID NO: 38346 - RNA, 64 nt, Homo Sapiens
uguauuuuuuaaacacuuguuuauuuuuuagauuugaauauaaacacuuaacacauugaaacua

SEQ ID NO: 38347 - RNA, 64 nt, Homo Sapiens
uguuauuuggucuuuaacaguauuuuucccugagugaauauaacuaacuugugaaguugcuauu

SEQ ID NO: 38348 - RNA, 64 nt, Homo Sapiens
uuuugauuuaacacaucuuugaccuaucaguaaaugaauauauggccagcuucaguuaagacaa

SEQ ID NO: 38349 - RNA, 64 nt, Homo Sapiens
auuuuuauacuuuuuauaauguuuacguuuguccugaauauauauauauauauauauauauaua

SEQ ID NO: 38350 - RNA, 64 nt, Homo Sapiens
gauaagcuauuucuuuccaaaaucuauaaaucuuugaauauagucccacagaauacuuauguuc

SEQ ID NO: 38351 - RNA, 64 nt, Homo Sapiens
cauuagaauuaccauuuguuaacauuguccccaaugaauauacuuucuuaacccaagugacgaa

SEQ ID NO: 38352 - RNA, 64 nt, Homo Sapiens
uguguguauguguguuucugacugugugugagugugaauauaaagucuggaucaguaaaauuau

SEQ ID NO: 38353 - RNA, 64 nt, Homo Sapiens
aguauuuagaaauaaauugcgucugcuuaaaaaaugaauauaucaccauuauuaaccugaugug

SEQ ID NO: 38354 - RNA, 64 nt, Homo Sapiens
uuaauuugaaacugcuccugaaaaagcaagccugugaauauaauaggacaaagcaaaaacaaac

SEQ ID NO: 38355 - RNA, 64 nt, Homo Sapiens
aaauccacaaacacacuauauuagagaaagaguaugaauauauuuuuuuaguugucuagaacau

SEQ ID NO: 38356 - RNA, 64 nt, Homo Sapiens
aaagggcaaaaaauucauuuaagacaauaugugaugaauauaagcacaagacaauaaucugaau

SEQ ID NO: 38357 - RNA, 64 nt, Homo Sapiens
uagcacucagaucuucgugucaccucagcagaaaugaauauaccaaauggcuuagacacaaaaa

SEQ ID NO: 38358 - RNA, 64 nt, Homo Sapiens
acaguuuauccauucuacuaacuauuucauuguaugaauauaucguuucuuuuuauuaccaagu

SEQ ID NO: 38359 - RNA, 64 nt, Homo Sapiens
gaaugagaguucugguaccuuauuugucaauuuaugaauauaaucccuacuauagcaguuuuua

SEQ ID NO: 38360 - RNA, 64 nt, Homo Sapiens
guguauagaagcgauuuaagccaacaagguuauaugaauauauauaguaagcaucuacuucagg

SEQ ID NO: 38361 - RNA, 64 nt, Homo Sapiens
uguauuggauuguugucuugauuuggucuaaauuugaauauauaugaguuacuugaauauaaca

SEQ ID NO: 38362 - RNA, 64 nt, Homo Sapiens
gauuuggucuaaauuugaauauauaugaguuacuugaauauaacaaaaaugaauuuuguuugau

SEQ ID NO: 38363 - RNA, 64 nt, Homo Sapiens
augaaaaguauuuuucuuguauauuauuaaguaaugaauauauaagaacuguacucuucucagc

SEQ ID NO: 38364 - RNA, 64 nt, Homo Sapiens
gauagcuaaauuaaaccaaacccuauugaagaauugaauauaugcuacuucaagaaacuaaauu

SEQ ID NO: 38365 - RNA, 64 nt, Homo Sapiens
gaaaggauauauguggcaauauuaaccugguacaugaauauauggggauaacauuuuaauuuga

SEQ ID NO: 38366 - RNA, 64 nt, Homo Sapiens
uaugucuguaaaaauguuagaguacuugucaucuugaauauagccuccccaagagagaacaggg

SEQ ID NO: 38367 - RNA, 64 nt, Homo Sapiens
cuaaaagauuaaguaaaaugaaacuguauucuuaugaauauacgcuuauuuaaucuucacacca

SEQ ID NO: 38368 - RNA, 64 nt, Homo Sapiens
auauauaguuuacaaaaugagcuguguuauuacuugaauauagacucaguucuguauaggcaau

SEQ ID NO: 38369 - RNA, 64 nt, Homo Sapiens
aagagcaauaguuugccccuuuuggaaugaucucugaauauauaaaacacacacacaaagagca

SEQ ID NO: 38370 - RNA, 64 nt, Homo Sapiens
aagagcaauaguuugccccuuuuggaacgaccccugaauauauaaaacacacacacaccccgcg

SEQ ID NO: 38371 - RNA, 64 nt, Homo Sapiens
uacccuuucuaaacacuguccuuuuugaaaguuuugaauauauccacauucuauugaaaccuug

SEQ ID NO: 38372 - RNA, 64 nt, Homo Sapiens
uguugguuuaugcgugcugcagcagugggcauaaugaauauaauuuacccaguggacaaaggug

SEQ ID NO: 38373 - RNA, 64 nt, Homo Sapiens
uugaggcacagaagaauauuguauauuuaaaaagugaauauaauauauacauauauauauauau

SEQ ID NO: 38374 - RNA, 64 nt, Homo Sapiens
uauauauauauauguauauuucuaugaaaaaauuugaauauacacaacauggugaaagcucauc

SEQ ID NO: 38375 - RNA, 64 nt, Homo Sapiens
uuuaaauucuaaacaauacaguggaugacccuuuugaauauaccuaaugauuuccuuaaaaaag

SEQ ID NO: 38376 - RNA, 64 nt, Homo Sapiens
gcaccuucuauccugaauaacuagcauggaaaagugaauauaugugugagcagauauggcuaua

SEQ ID NO: 38377 - RNA, 64 nt, Homo Sapiens
auauauacuucacauuuuuaaaaaucauuuucuaugaauauauaucuguaaucauaccuacauu

SEQ ID NO: 38378 - RNA, 64 nt, Homo Sapiens
uuuuuaaauuauguguaugaugauuucggugucuugaauauauuuaguucuuauauuuguuaac

SEQ ID NO: 38379 - RNA, 64 nt, Homo Sapiens
ugagggagcguaguauugaccgcagauccuugguugaauauaguguaccuuagaaaaaguuuca

SEQ ID NO: 38380 - RNA, 64 nt, Homo Sapiens
ugagaugguaccuuagaaaacgcaguuccgugguugaauauauuguaccuuagaaaaaguuaca

SEQ ID NO: 38381 - RNA, 64 nt, Homo Sapiens
aucaugaaaggacucacacuggagagaagcccuaugaauauaagcaaugugggaaagccuucag

SEQ ID NO: 38382 - RNA, 64 nt, Homo Sapiens
uagcuauucaggaggcugacauaggagaauugcuugaauauaggaagcagagguugcagugagc

SEQ ID NO: 38383 - RNA, 64 nt, Homo Sapiens
uacagagaucaaauucacacucaauaguauguucugaauauauguucaagagagagucucuaaa

SEQ ID NO: 38384 - RNA, 64 nt, Homo Sapiens
ucugcccuguguuauccaguuaugagauaaaaaaugaauauaagagugcuugucauuauaaaag

SEQ ID NO: 38385 - RNA, 59 nt, Homo Sapiens
cuaaggucuggccuugccccuuugcucugccccugaagucuaucugcaggauggucuuc

SEQ ID NO: 38386 - RNA, 59 nt, Homo Sapiens
gucugcuaaaacagccaucuucaagacagccccugaaaagagaccaguucagguccugc

SEQ ID NO: 38387 - RNA, 59 nt, Homo Sapiens
cccugccucuggcuuccuaaguuucuuuuccccugaaauuuagagaauaaaccaggccu

SEQ ID NO: 38388 - RNA, 59 nt, Homo Sapiens
caucgcuggcccccaccuccgaaauaucaccccugaagccccagggcugauauauauug

SEQ ID NO: 38389 - RNA, 59 nt, Homo Sapiens
caggggccagggagggggcgacuugccugccccugaagcccuuguucccauuggcccca

SEQ ID NO: 38390 - RNA, 59 nt, Homo Sapiens
ggggggaggggaggagcacccccucagccccccugaaccugaccaaaagccauggcugu

SEQ ID NO: 38391 - RNA, 59 nt, Homo Sapiens
gcgccuccagggccccgcccacucucccaccccugaagcugcacucccacccaccuagc

SEQ ID NO: 38392 - RNA, 59 nt, Homo Sapiens
uuccuuggggcggggggagggcaccucagccccugaagacaagcagcacugcaguggca

SEQ ID NO: 38393 - RNA, 59 nt, Homo Sapiens
guauagaauccauuugucaucaccuuuccccccugaaauuuaaacucacauccauauua

SEQ ID NO: 38394 - RNA, 59 nt, Homo Sapiens
uccucuccggagcuugacuuugggcacuuccccugaagccgguuccccggccacgacuc

SEQ ID NO: 38395 - RNA, 59 nt, Homo Sapiens
aaaaacuccuuaacuuacuguugcuuacaccccugaaagucuguuuuuaagcaaauggg

SEQ ID NO: 38396 - RNA, 59 nt, Homo Sapiens
acccuuuuaaaagagaccuauguugaaaaccccugaaaauucacugaagaaaaaucauu

SEQ ID NO: 38397 - RNA, 59 nt, Homo Sapiens
ccugaguuuaaguggcuugaucuucuaacccccugaaaugauuuuagaaaucauauauc

SEQ ID NO: 38398 - RNA, 59 nt, Homo Sapiens
agggaaggacaagucaccucgcuuucuuaccccugaaaguccugcucuuucuccuuuuu

SEQ ID NO: 38399 - RNA, 59 nt, Homo Sapiens
ucaucaguccuuccuuccuaaucucuaauccccugaagccuaacacaguuccuaaugug

SEQ ID NO: 38400 - RNA, 59 nt, Homo Sapiens
gguagggcugugguuuacuccugucuaaaccccugaagccuaacacaguuccuggcaca

SEQ ID NO: 38401 - RNA, 59 nt, Homo Sapiens
acagaaguuauaccuuacuccuuuccuuuccccugaacaaaccugcuaaucccacuaau

SEQ ID NO: 38402 - RNA, 59 nt, Homo Sapiens
gagggaggaaauaugucccuugcacaccaccccugaagcacauggcaguaggaaacagc

SEQ ID NO: 38403 - RNA, 64 nt, Homo Sapiens
cucccuaacuugggccagaauggaccaaggcuaaccuuucuaaggggccucauucugccaaagc

SEQ ID NO: 38404 - RNA, 64 nt, Homo Sapiens
gcuuuugaggcccucccucaacccgccaagucauccuuucuacuacggucguauuuuccucccu

SEQ ID NO: 38405 - RNA, 64 nt, Homo Sapiens
cucacagcuccuggggccuuacagccuccaccucccuuucuaccacugguugcccggacacuca

SEQ ID NO: 38406 - RNA, 64 nt, Homo Sapiens
uccagugcccugagccuccaaggcggggagggcuccuuucuaccccuuccuggccuggggaagg

SEQ ID NO: 38407 - RNA, 64 nt, Homo Sapiens
cccagugaaguuagguggguuaauuacugccauuccuuucuaaguguguuuuauggcauccugc

SEQ ID NO: 38408 - RNA, 64 nt, Homo Sapiens
agcggggaaggaaaggaaugagggaggaaauauuccuuucuagcauucauuuugcuuagaucac

SEQ ID NO: 38409 - RNA, 64 nt, Homo Sapiens
cuuuuguccagccucuuuuucuucugcuguuccaccuuucuaaacauacaauaaagucauggga

SEQ ID NO: 38410 - RNA, 64 nt, Homo Sapiens
cccacugugcuauaguugcggguggaacagucaaccuuucuaguaguuuaugauauugcccucu

SEQ ID NO: 38411 - RNA, 64 nt, Homo Sapiens
cuacaaccaaauugcuccaauuuuuauuuuuauuccuuucuacacuccuuauuagucucccugu

SEQ ID NO: 38412 - RNA, 64 nt, Homo Sapiens
ucuucccuaauugauguaucucagauucauaucuccuuucuagacauuuauaugcaaaugacug

SEQ ID NO: 38413 - RNA, 64 nt, Homo Sapiens
ggccaaacucccacucucugccccccuuuaauccccuuucuacagugaguccacuacccucacu

SEQ ID NO: 38414 - RNA, 64 nt, Homo Sapiens
uuccucccuuaacuucugugacuaauuuuuauuuccuuucuagauuugcccaauuaauacuagg

SEQ ID NO: 38415 - RNA, 64 nt, Homo Sapiens
uguggucuuguucacaugcugauucuuaagugaaccuuucuaaauguuuugcgcauugucaugg

SEQ ID NO: 38416 - RNA, 64 nt, Homo Sapiens
augaaagcugaugaaucuuaguggcauuuuucucccuuucuaaacaugaguucauacuuucuac

SEQ ID NO: 38417 - RNA, 64 nt, Homo Sapiens
gguuauguaaauaaaucaaauauuuuuaaaaucuccuuucuacucuagaaacaaauguaauaaa

SEQ ID NO: 38418 - RNA, 64 nt, Homo Sapiens
guuguauaucaaaauuguauaaaggauaaauaugccuuucuaaagcauaaacuucucuggugug

SEQ ID NO: 38419 - RNA, 64 nt, Homo Sapiens
cccaguuaagcauggaagagcuacgcauagcucaccuuucuaaagaauaucccaaguaguucuu

SEQ ID NO: 38420 - RNA, 64 nt, Homo Sapiens
aaaauauacaccuuauacccaaguaagccucuucccuuucuaauuuuuacugggauuccugauc

SEQ ID NO: 38421 - RNA, 64 nt, Homo Sapiens
uucccggagccagcgagcauaugcugcaugaggaccuuucuaucuuacauuauggcugggaauc

SEQ ID NO: 38422 - RNA, 64 nt, Homo Sapiens
aucuagacuaaaagccaaaauauaauuauugcugccuuucuaaaaacccaaaauguaguucucu

SEQ ID NO: 38423 - RNA, 64 nt, Homo Sapiens
uaucuauuuugugaauucuauuuuuccuuuugguccuuucuacugcauaucuuauuuaaauguu

SEQ ID NO: 38424 - RNA, 64 nt, Homo Sapiens
auaccaaccucgauacucuuaaggagaauagccuccuuucuagcaggcaucauugaggaugauu

SEQ ID NO: 38425 - RNA, 64 nt, Homo Sapiens
aguuugaggaauauuucaaguuuugcuucuucccccuuucuaaauuuauuuugagaagcucuga

SEQ ID NO: 38426 - RNA, 64 nt, Homo Sapiens
caguacucgagcccagggcuguugaagucucuucccuuucuaccucuucuuauuuugguuucag

SEQ ID NO: 38427 - RNA, 64 nt, Homo Sapiens
cuugccuuuccaccuccagggcaugaacccugccccuuucuauccaugcuguguccaggaggug

SEQ ID NO: 38428 - RNA, 64 nt, Homo Sapiens
ccucuguguguaaaauugccuuuguguucuccugccuuucuauguuuugaaacuguaucccaca

SEQ ID NO: 38429 - RNA, 64 nt, Homo Sapiens
cuaaacacauccauaaaaaaccuuucuacccaccccuuucuaucuucaccucccugccuccucu

SEQ ID NO: 38430 - RNA, 64 nt, Homo Sapiens
caccccuuucuauccuaaacucccugccuccucuccuuucuaccuuguacauaauacauucacc

SEQ ID NO: 38431 - RNA, 64 nt, Homo Sapiens
gugucucucccucccgaguccccagauggagaccccuuucuacaggaugaccccuugauauuug

SEQ ID NO: 38432 - RNA, 64 nt, Homo Sapiens
uggaauuccaggaaagaacuucaggugucuggacccuuucuaucuagauaauauuuuuagauuc

SEQ ID NO: 38433 - RNA, 64 nt, Homo Sapiens
augauauaggaaugaaccaauacgcuuuuauuacccuuucuaacucugauuuuauaaucagacu

SEQ ID NO: 38434 - RNA, 64 nt, Homo Sapiens
gagcaagagaagcugaaauauauuucugcaagaaccuuucuauauuaugugccaauuaccacac

SEQ ID NO: 38435 - RNA, 64 nt, Homo Sapiens
uagauauaggaaugaaccaauacgcuuuuauuacccuuucuaacucugauuuuauaaucagacu

SEQ ID NO: 38436 - RNA, 64 nt, Homo Sapiens
gaacaagagaagcugaaauauauuucugcaagaaccuuucuauauuaugugccaauuaccacac

SEQ ID NO: 38437 - RNA, 62 nt, Homo Sapiens
aggcccucagguugaauccagagcuguagagguuacaguagcaucaccagccuugggggucc

SEQ ID NO: 38438 - RNA, 62 nt, Homo Sapiens
uggugccauagacacagguuuauaguuuuaacuuacaguauuguuugaaauuuaccuguuuu

SEQ ID NO: 38439 - RNA, 62 nt, Homo Sapiens
agaaaauacguuugaaagcuuuaucuuauuauuuacaguauuuuuauauuucuuacauuauc

SEQ ID NO: 38440 - RNA, 62 nt, Homo Sapiens
gggaaaaggcuucaguaaagcagaggcuagaauuacaguauuuauacauagcaacuuuucau

SEQ ID NO: 38441 - RNA, 62 nt, Homo Sapiens
agacacgaucaugguuuuagacgcuaaaaggcuuacaguaucgaauguugacccauuugagu

SEQ ID NO: 38442 - RNA, 62 nt, Homo Sapiens
cccaucuuuccuuaacgaaauaaaagauugaauuacaguaaaaacuugcaaguaauuuuuug

SEQ ID NO: 38443 - RNA, 62 nt, Homo Sapiens
cuccaucaacugaaguaaaugaugucugaguguuacaguaaaggugaccaagucucuuucuu

SEQ ID NO: 38444 - RNA, 62 nt, Homo Sapiens
uuauucacauuguagaacagcaaaugacauuuuuacaguauuuuuuuguaaagcaaacuauu

SEQ ID NO: 38445 - RNA, 62 nt, Homo Sapiens
aaauaagaccccugucuaauaucccuuuacucuuacaguagcccugccaccccuucccaguc

SEQ ID NO: 38446 - RNA, 62 nt, Homo Sapiens
aagcauagaccccugucuaaaacccuuuacccuuacaguagcccuaccaucccuucucaguc

SEQ ID NO: 38447 - RNA, 62 nt, Homo Sapiens
auucaaccuuuauuuucuaauauauuguacaguuacaguaaaauuucccuuuggacuucaug

SEQ ID NO: 38448 - RNA, 62 nt, Homo Sapiens
gaggauuuuuucuuucuuuuuaaucaggaauauuacaguaauaaaaaccaacauagcaucau

SEQ ID NO: 38449 - RNA, 62 nt, Homo Sapiens
uguaaagucggaguuuuaguaauuuguucuuguuacaguaacauuuaaauggugggucuaua

SEQ ID NO: 38450 - RNA, 62 nt, Homo Sapiens
ggguacauacaaggguaaaauuaaaaauacguuuacaguauuuaaauuuagugcacucuguc

SEQ ID NO: 38451 - RNA, 62 nt, Homo Sapiens
acucugagucugauuacgaaaaguacucuauguuacaguaaagcuaccacucuggcugcuag

SEQ ID NO: 38452 - RNA, 62 nt, Homo Sapiens
uuuuuauuuugauauuugucuuuuuuuaaauuuuacaguagucauugaaaguuauguuucuu

SEQ ID NO: 38453 - RNA, 64 nt, Homo Sapiens
aaugaagaagcaugaaaguaauaaugugggauuacuagaaaaccugacuaauggugucacugcu

SEQ ID NO: 38454 - RNA, 64 nt, Homo Sapiens
agaaccagaaauaaauaaggauggugauagagagcuagaaaauuuuauggcuaucgaagaaaug

SEQ ID NO: 38455 - RNA, 64 nt, Homo Sapiens
uuuaaucacaucauuacguugccaagcauacaaccuagaaaaugccgggacacccucaacauuc

SEQ ID NO: 38456 - RNA, 64 nt, Homo Sapiens
aaguuuuuaagagugacuaucuacacgaaaauuucuagaaaaagaaaugaaacauuccaccugg

SEQ ID NO: 38457 - RNA, 64 nt, Homo Sapiens
uuauguaugaaaaacgauaaauuguguuacagagcuagaaaauuuugaauggauuaaaaauugc

SEQ ID NO: 38458 - RNA, 64 nt, Homo Sapiens
guuuugcuuuguauuuuauaucuagaggaugcugcuagaaaaugauugugacuucuaguucuuu

SEQ ID NO: 38459 - RNA, 64 nt, Homo Sapiens
agggccagguuuauuuucuccuuuuuugagauuucuagaaaaaaugcugcuugcacauguuggu

SEQ ID NO: 38460 - RNA, 64 nt, Homo Sapiens
agugugcaguguguaaauacuuuaaauuauuaugcuagaaaaauaaaguuacauaccuugcugu

SEQ ID NO: 38461 - RNA, 64 nt, Homo Sapiens
agcguuuauuugaaugugaagagccugugccuggcuagaaaacauagaguuugaaaaacuaauu

SEQ ID NO: 38462 - RNA, 64 nt, Homo Sapiens
ugaguuuuacaccauacugugcaauuugucuggacuagaaaauccugccaaaucguuauagaga

SEQ ID NO: 38463 - RNA, 64 nt, Homo Sapiens
gaaauugaaaauaccaaaaguucauaauguauaccuagaaaagucuuuugauacaacuagguua

SEQ ID NO: 38464 - RNA, 64 nt, Homo Sapiens
aaaaucaaacugagauuucauguucucuguuuuccuagaaaaccaaagugcacauacgcaacug

SEQ ID NO: 38465 - RNA, 64 nt, Homo Sapiens
aaguuuaaaauugccugcggaaugugugcaguaucuagaaaaaugaaccguaguuuuuguuuuu

SEQ ID NO: 38466 - RNA, 64 nt, Homo Sapiens
caagagcuccuccugaucacuauuacauauuuuucuagaaaaucuaaaguucagaagagaaugu

SEQ ID NO: 38467 - RNA, 64 nt, Homo Sapiens
augaagugauugcaaugccaggauuuucuaaaagcuagaaaaaagaaccggaaaaugggagaca

SEQ ID NO: 38468 - RNA, 64 nt, Homo Sapiens
agauggaaagauauauaaauacuugcuacacagccuagaaaacacuaggccuuguccaagaaga

SEQ ID NO: 38469 - RNA, 64 nt, Homo Sapiens
auaaugguaguaaagaaacuuacguuaucuccggcuagaaaaaauaggccuuacuuugugauua

SEQ ID NO: 38470 - RNA, 64 nt, Homo Sapiens
aacucuacaaaaauuuugcaaacacaguaguccccuagaaaaacagauuaaaaacauucauuug

SEQ ID NO: 38471 - RNA, 64 nt, Homo Sapiens
aaauggcacaucaucauaauccauuuucucuuugcuagaaaaucagcccauagagugcauuccc

SEQ ID NO: 38472 - RNA, 64 nt, Homo Sapiens
aagugaaaaucauucugcuuuugaaucuuaaaagcuagaaaaaccauaauguaauauucuuuuu

SEQ ID NO: 38473 - RNA, 64 nt, Homo Sapiens
caaauaaaacugcuucucucuuacacugcuugaacuagaaaaucagcuuuuuaauguagguuac

SEQ ID NO: 38474 - RNA, 64 nt, Homo Sapiens
aaccacuacuguuacauuuuauuaauuuaaaaagcuagaaaauucauguaguuacuuuuuuuac

SEQ ID NO: 38475 - RNA, 64 nt, Homo Sapiens
aauugaugcaaacccuggaauuaaugaauuaaaacuagaaaacaccaauucacuauuuuauuuu

SEQ ID NO: 38476 - RNA, 64 nt, Homo Sapiens
aucccuaucugcagaucaaguaguccaucauagccuagaaaaugaaguccacugguuaguguac

SEQ ID NO: 38477 - RNA, 64 nt, Homo Sapiens
uuauuuugcucgugcuuagcuaaauaugucaucucuagaaaagaugugguuuguuuuggcacug

SEQ ID NO: 38478 - RNA, 64 nt, Homo Sapiens
aucucaaguuaccaaauuuuuuguaauccuuuuacuagaaaaaucuuuuuugaagaguuuuucu

SEQ ID NO: 38479 - RNA, 64 nt, Homo Sapiens
ucuucagaaucuugucccucauccagccccaccacuagaaaagcuggauuacucaggcagggcc

SEQ ID NO: 38480 - RNA, 64 nt, Homo Sapiens
cacagggaagaaaacauuucaaaaccucaaauugcuagaaaauugauaaaugcccaucuuagcu

SEQ ID NO: 38481 - RNA, 64 nt, Homo Sapiens
ugcuggacaccacuuuuaaaaagcaaucacugugcuagaaaaguauauuggcuuuguuaggauu

SEQ ID NO: 38482 - RNA, 64 nt, Homo Sapiens
uuaacauuauuuuaaaaugccaaauauguucuuucuagaaaaauauuuauuuuuguuuuuguug

SEQ ID NO: 38483 - RNA, 64 nt, Homo Sapiens
cucauuucaagaguguuuccuucucaaacuucugcuagaaaaugcugacucacuuuuauauaca

SEQ ID NO: 38484 - RNA, 64 nt, Homo Sapiens
auuacucuuuuaauuaaaacuagauuauuucaaucuagaaaagccuuguugagcagccuccuua

SEQ ID NO: 38485 - RNA, 64 nt, Homo Sapiens
caaagauuacuauaaacaccuguaugcacacaaacuagaaaaccuagaaaaaauuaauaaauuc

SEQ ID NO: 38486 - RNA, 64 nt, Homo Sapiens
cuauaaacaccuguaugcacacaaacuagaaaaccuagaaaaaauuaauaaauuccuugaaaga

SEQ ID NO: 38487 - RNA, 64 nt, Homo Sapiens
cuguagacugaauucagcaccagugaaaggcuuugagaaggacgugggcagcaaaacgacacug

SEQ ID NO: 38488 - RNA, 64 nt, Homo Sapiens
gccagcaccaccuacacaggagucuucagacccagagaaggacggugccaagggccccaggggc

SEQ ID NO: 38489 - RNA, 64 nt, Homo Sapiens
ccagggucauucagacacauucagauacugcacugagaaggagcuggcaucucucagugugcuc

SEQ ID NO: 38490 - RNA, 64 nt, Homo Sapiens
gugcaugugccuaugugggugacccuguggaagugagaaggagucacugugaugcuuagcuguc

SEQ ID NO: 38491 - RNA, 64 nt, Homo Sapiens
uagccaggacugcagagacacuccagugcagagggagaaggacuuguaauuuucaaagcagggc

SEQ ID NO: 38492 - RNA, 64 nt, Homo Sapiens
aaccucccucuauggggauggcuauuuuauuuuugagaaggaaaaaaaaagucauguauauaua

SEQ ID NO: 38493 - RNA, 64 nt, Homo Sapiens
ugcgucauguaagggaagcugaaaacccgaaucugagaaggaauagaacugcccagccucagcu

SEQ ID NO: 38494 - RNA, 64 nt, Homo Sapiens
gcucuuccccacccugggaucgagguccucacaggagaaggacacaucgccuccaucagccaga

SEQ ID NO: 38495 - RNA, 64 nt, Homo Sapiens
gcggggcuagggaagcagaguggauguaagggaugagaaggaugucaagaggaggaggacaucu

SEQ ID NO: 38496 - RNA, 64 nt, Homo Sapiens
acgcugcaggaacaagugggcaacuaaagggaaugagaaggaggcucagaugaaagagagggua

SEQ ID NO: 38497 - RNA, 64 nt, Homo Sapiens
ccgucucaaaaaaaaaagaacagccugggugacagagaaggacugagaucaugccaccgcacuu

SEQ ID NO: 38498 - RNA, 64 nt, Homo Sapiens
agaaaucagcaccugcguuuauccggaauuuuaugagaaggauuucaucagcccucaauuugug

SEQ ID NO: 38499 - RNA, 64 nt, Homo Sapiens
ugaaagaggcagaucccaguucaaaagcagccaugagaaggaaggauucaccaccuccaggaaa

SEQ ID NO: 38500 - RNA, 64 nt, Homo Sapiens
ucggaaaaaaccagccuugaaggcuacaagugaugagaaggauucuuuuucgaauauaaccaga

SEQ ID NO: 38501 - RNA, 64 nt, Homo Sapiens
ucggaaaaaaccauccuuggaggccacaagugaugagaaggauucuuuuucgaauauaaccaga

SEQ ID NO: 38502 - RNA, 64 nt, Homo Sapiens
gcugccuggccguggcuucucuuuggcucccaaagagaaggacaguguugggaguaucugccgu

SEQ ID NO: 38503 - RNA, 64 nt, Homo Sapiens
gaguaucugccguggcuucucuuuggcucccaaagagaaggacaguguugggaguaucugccgg

SEQ ID NO: 38504 - RNA, 64 nt, Homo Sapiens
guuaaaauguacuuguuaaacagguaauuuuaaagagaaggaacaauuguuuuuaguaaguuuu

SEQ ID NO: 38505 - RNA, 64 nt, Homo Sapiens
caaugaauugauucuucaaauuaaaaguucuugagagaaggagaggaagauacagcagacauag

SEQ ID NO: 38506 - RNA, 64 nt, Homo Sapiens
uaggauuugcugagaguuugaauguggaguguaagagaaggaagaguuaaugaugacauuaagg

SEQ ID NO: 38507 - RNA, 64 nt, Homo Sapiens
gcucucugggaaaugggaaaucagccaaaggacugagaaggaguuaccuuaaggucagagaaaa

SEQ ID NO: 38508 - RNA, 64 nt, Homo Sapiens
ucacuguauuuggaauucugaaugcccuauugaggagaaggacagauggcagaacccccaagcg

SEQ ID NO: 38509 - RNA, 64 nt, Homo Sapiens
aaggcuauuugaaaacagaaacaugucaugccuggagaaggaacucugcgagggacggugugug

SEQ ID NO: 38510 - RNA, 64 nt, Homo Sapiens
uuuccaaacugcaaacuuugagcucagccuuuuagagaaggauaagaaacaccccagcacagca

SEQ ID NO: 38511 - RNA, 64 nt, Homo Sapiens
aucaugccgcucaguuccuggaugcuaugaaagagagaaggaaaucaaucagccugguuuuggg

SEQ ID NO: 38512 - RNA, 64 nt, Homo Sapiens
ugaaggcuucuuuccccacugcaggacccacuuugagaaggaccgaggaggaggauuuggguug

SEQ ID NO: 38513 - RNA, 64 nt, Homo Sapiens
acgguguggggaaguggaagagaagcuggcgggggagaaggaggcuaaccugcacugaguacuu

SEQ ID NO: 38514 - RNA, 64 nt, Homo Sapiens
ggaauggaggaguuguuuggggagggaaaggagagagaaggaaaggagugagguauuucccguc

SEQ ID NO: 38515 - RNA, 64 nt, Homo Sapiens
uaauuaaauaaaaugcugcugcuuugacaguaaagagaaggaaguauucugauuagcuguaucu

SEQ ID NO: 38516 - RNA, 64 nt, Homo Sapiens
gcuccaucuccagugggaacgagcagagcugauggagaaggaaggaagagaucaggaagagaag

SEQ ID NO: 38517 - RNA, 64 nt, Homo Sapiens
agagcugauggagaaggaaggaagagaucaggaagagaaggagcgcagagaagaaagaacggaa

SEQ ID NO: 38518 - RNA, 64 nt, Homo Sapiens
ggagcugugggucaggaaucauacuugaauauuagagaaggagaugaggaguuagggaagcagc

SEQ ID NO: 38519 - RNA, 64 nt, Homo Sapiens
gaggaguuagggaagcagcaaagugaaauucaaggagaaggaauuagaaccuagcgcaauugua

SEQ ID NO: 38520 - RNA, 64 nt, Homo Sapiens
uuaauguuucuuaauaauccaccagucaucuagagagaaggaaaagaagcuaaaaagcuaaagu

SEQ ID NO: 38521 - RNA, 64 nt, Homo Sapiens
gcauuuuauugcagaagcuaugaauagaaaugcugagaaggaacaagugauucagggauuccua

SEQ ID NO: 38522 - RNA, 64 nt, Homo Sapiens
gucucuugcccaucucuccgagcaaaagaaacgugagaaggaggguuccagaaccgccgaauga

SEQ ID NO: 38523 - RNA, 64 nt, Homo Sapiens
uccacuucaacaaguaccugagcucacggaacuggagaaggagucaccaacuucacuaccaagc

SEQ ID NO: 38524 - RNA, 64 nt, Homo Sapiens
ggacaacauggagcaaaagagacagggagagguggagaaggaaaaaacccuacaaaacaaaaac

SEQ ID NO: 38525 - RNA, 64 nt, Homo Sapiens
ucgucuaaagaggcagcugagugagagacacagagagaaggagaaagagggagggagagagaga

SEQ ID NO: 38526 - RNA, 64 nt, Homo Sapiens
ggagccuguccguucagagcaucagagagagaaggagaaggaggcucagcaagccaaccuggga

SEQ ID NO: 38527 - RNA, 64 nt, Homo Sapiens
aggaggggagccuguccguucugggaaucagagagagaaggagaagagaacucagcaagccaac

SEQ ID NO: 38528 - RNA, 64 nt, Homo Sapiens
agaaagaaagaaaagaagaagaaaagagaagaaggagaaggagaugaaggaggaggaggaggag

SEQ ID NO: 38529 - RNA, 64 nt, Homo Sapiens
gaagaaggagaaggagaugaaggaggaggaggaggagaaggagaagaagaagaagaagaagacc

SEQ ID NO: 38530 - RNA, 64 nt, Homo Sapiens
gacauuuaaaaagcacagucuuugaccuguccaggagaaggauuuacuccaaaauuauacugga

SEQ ID NO: 38531 - RNA, 64 nt, Homo Sapiens
caaaacccuucuuuuuaaaaggaaaaaggauggagagaaggauggaaagccuggacuuaaaccu

SEQ ID NO: 38532 - RNA, 64 nt, Homo Sapiens
gggaguacaaagacagggaagcggcuggaaagaggagaaggagagacuauuuauacaaaugggg

SEQ ID NO: 38533 - RNA, 64 nt, Homo Sapiens
aggcuggcaagguggguuccccucugccuugauggagaaggaaacccuccccacccaccaaaug

SEQ ID NO: 38534 - RNA, 64 nt, Homo Sapiens
agaacaccaaggagguuccuggcuccuguucucagagaaggaggaugguaagguauccaggauu

SEQ ID NO: 38535 - RNA, 64 nt, Homo Sapiens
uauugugcaagaacccaacuuuuacucaggagcugagaaggaagaagccucaaaccacccauuu

SEQ ID NO: 38536 - RNA, 64 nt, Homo Sapiens
gggaagcauugcaaggaaauaacaauauuugggagagaaggaugagagagagagagagaaagag

SEQ ID NO: 38537 - RNA, 64 nt, Homo Sapiens
acaggucuggccagggacguaugucuugaaaauagagaaggaacacgacucuuuaaaaagaucu

SEQ ID NO: 38538 - RNA, 64 nt, Homo Sapiens
ugauacuuacauuucauggaauaaagcacuagcugagaaggaacaaccuggcaccaguauaacu

SEQ ID NO: 38539 - RNA, 64 nt, Homo Sapiens
aacuuucacaaaauaaacuuucauggaauacugggagaaggaauuguccugagaacagcuuuag

SEQ ID NO: 38540 - RNA, 64 nt, Homo Sapiens
gcccuggguagaaacgcuugacuucaugggaagagagaaggaaguuuaugggagaagggcaaag

SEQ ID NO: 38541 - RNA, 64 nt, Homo Sapiens
caaaaugagggguggcagggaggcaggugcuucagagaaggaaacuuuggggaacugagcucag

SEQ ID NO: 38542 - RNA, 64 nt, Homo Sapiens
ggaugcccagcugcugacugugcagaagcuagaggagaaggagcgagccuugcagggcagccuc

SEQ ID NO: 38543 - RNA, 64 nt, Homo Sapiens
ggagcgagccuugcagggcagccucggggguguggagaaggagcugacgcugcgcagccaagcc

SEQ ID NO: 38544 - RNA, 64 nt, Homo Sapiens
guucaggggucccaaaccagcaagcagagaccaugagaaggagagcccaggccagccugcugga

SEQ ID NO: 38545 - RNA, 64 nt, Homo Sapiens
augaagggaggagagagcuuugaaaucacauggugagaaggaggcggaagugaaaggacuuguc

SEQ ID NO: 38546 - RNA, 64 nt, Homo Sapiens
ugcgucauuguaacaugaagggauaaaaaugaaggagaaggaggguuugggaugggugucuaag

SEQ ID NO: 38547 - RNA, 64 nt, Homo Sapiens
aguuucuugcuuucuucagcacaucuuauaguaugagaaggaagguuugggcauguugggaagg

SEQ ID NO: 38548 - RNA, 64 nt, Homo Sapiens
cuccccuucugaaucagcugggaugacuggcuuugagaaggaagggaagauggaacaggcucag

SEQ ID NO: 38549 - RNA, 64 nt, Homo Sapiens
aggccuuggacaacugcauggagcugcacucuaggagaaggaggggaaccagauguuagaucag

SEQ ID NO: 38550 - RNA, 64 nt, Homo Sapiens
gaggcagagagggagagagggaaagagacaggcagagaaggagagagggaaagaggcagagaag

SEQ ID NO: 38551 - RNA, 64 nt, Homo Sapiens
gagacaggcagagaaggagagagggaaagaggcagagaaggaaacagaggggaagagaggcaga

SEQ ID NO: 38552 - RNA, 64 nt, Homo Sapiens
gccugccugcucagggaucccaucggggaagggugagaaggagauccaaccaugaggaugggug

SEQ ID NO: 38553 - RNA, 64 nt, Homo Sapiens
aagggaggagaaagcacaugggcuguuugaauaagagaaggacaguggcuggacuuugacaugu

SEQ ID NO: 38554 - RNA, 64 nt, Homo Sapiens
guuuucuuuguucucagacuaauggaugguuccagagaaggaaaugaaaggugcuggguggggc

SEQ ID NO: 38555 - RNA, 64 nt, Homo Sapiens
aagaugccaggucccaggaacucaggcuucaggugagaaggagcgguguguccaggcaccgcug

SEQ ID NO: 38556 - RNA, 64 nt, Homo Sapiens
augggagccguuuugaugagaaaaaugggcuggagagaaggagaaggauuaggaaaaaacaaag

SEQ ID NO: 38557 - RNA, 64 nt, Homo Sapiens
gccguuuugaugagaaaaaugggcuggagagaaggagaaggauuaggaaaaaacaaagaaggca

SEQ ID NO: 38558 - RNA, 64 nt, Homo Sapiens
gggcacuuggcaaccacuaugugaagggugauuggagaaggacaagacuguggaauggggaaua

SEQ ID NO: 38559 - RNA, 64 nt, Homo Sapiens
uugauguggagauguaaacacauguaggguuggugagaaggaaagaugagaacaaaagcaacau

SEQ ID NO: 38560 - RNA, 64 nt, Homo Sapiens
cguagaaauuuauuauuaaaagcuguaauccagagagaaggaaaagauuuugcccagcacaugg

SEQ ID NO: 38561 - RNA, 64 nt, Homo Sapiens
gagagagagaaagaaagucugagggaaggaaagagagaaggaaaacccgcucagcaacauagaa

SEQ ID NO: 38562 - RNA, 64 nt, Homo Sapiens
ggagaaaaaccgauucaaaucaacuuguacauggaaacagcaagcauuauggucaaacagcaaa

SEQ ID NO: 38563 - RNA, 64 nt, Homo Sapiens
caacuuguacauggaaacagcaagcauuauggucaaacagcaaaggccauaaccuuuugggauu

SEQ ID NO: 38564 - RNA, 64 nt, Homo Sapiens
ccugcuaagcuaagauagauuagacucaagaucaaaacagcauaaacaauagauuccauuaaua

SEQ ID NO: 38565 - RNA, 64 nt, Homo Sapiens
gauauauauauauauauauaaaacaacaccaaaaaaacagcaguaaaaaaaaaaaaaaaacaaa

SEQ ID NO: 38566 - RNA, 64 nt, Homo Sapiens
auaaaugcaauaauaugcauguuaacaacauuaaaaacagcaaacagcaaucuaaguacagaaa

SEQ ID NO: 38567 - RNA, 64 nt, Homo Sapiens
caauaauaugcauguuaacaacauuaaaaacagcaaacagcaaucuaaguacagaaaagcuuuu

SEQ ID NO: 38568 - RNA, 64 nt, Homo Sapiens
uucugcaauucaacacauccacagguucgagcccaaacagcagaacuuuuugccaaaaugacag

SEQ ID NO: 38569 - RNA, 64 nt, Homo Sapiens
gaucagaaacaugauuuguucauuucugagucacaaacagcaggauaccucacagguaagccau

SEQ ID NO: 38570 - RNA, 64 nt, Homo Sapiens
uacaggaaauguaaaguagaaacuuuauucaaacaaacagcacuuaaccguaaccucacacauu

SEQ ID NO: 38571 - RNA, 64 nt, Homo Sapiens
auuaugaauagugcugcgauaauagugcugcgauaaacagcacuuccauaacuuugcuauuacg

SEQ ID NO: 38572 - RNA, 64 nt, Homo Sapiens
cuuguagaacaucagagaaggcacauugacuagcaaacagcacuuuaggaaaagucaccguagc

SEQ ID NO: 38573 - RNA, 64 nt, Homo Sapiens
auuucacuguagaugauaugcuaggaucaaaguuaaacagcauucuucacugcaggacaucuca

SEQ ID NO: 38574 - RNA, 64 nt, Homo Sapiens
gaaaccaauuucuacuucauacugauguuuuuggaaacagcaauuaaaguuuuucuuccaugag

SEQ ID NO: 38575 - RNA, 64 nt, Homo Sapiens
uuugcagauucucugggauuuuaaggaacugagaaaacagcaaaguugacuaaauuuuauauuu

SEQ ID NO: 38576 - RNA, 64 nt, Homo Sapiens
gauuuuugcuacaguuuagacacugugguuuacaaaacagcaugcacucaacuugggacuuuau

SEQ ID NO: 38577 - RNA, 64 nt, Homo Sapiens
gucucagauguucuaauucucuuuguaugcuuggaaacagcauagauauguugcugugguuuuc

SEQ ID NO: 38578 - RNA, 64 nt, Homo Sapiens
ugggggcugaggcagaggcaugacccugagauguaaacagcaaggcaggcucugcuguuucuag

SEQ ID NO: 38579 - RNA, 64 nt, Homo Sapiens
aagugugcggagacaggcgguucagucuccacagaaacagcaucacccccucucagccacuguc

SEQ ID NO: 38580 - RNA, 64 nt, Homo Sapiens
guccugcagucguauaguauagcagugcaggaacaaacagcacuugccagcaaagucugugugu

SEQ ID NO: 38581 - RNA, 64 nt, Homo Sapiens
uuguuguugcuguuagaaaauuuguggcuggugaaaacagcacuccuuuggcuggagcacaugu

SEQ ID NO: 38582 - RNA, 64 nt, Homo Sapiens
cuguggaguuuguucagugguacgguguccaagcaaacagcagaaugcaacuuucuaaacagcc

SEQ ID NO: 38583 - RNA, 64 nt, Homo Sapiens
acagcagaaugcaacuuucuaaacagccccaagcaaacagcagaauucaacuuuuuaaacaaua

SEQ ID NO: 38584 - RNA, 64 nt, Homo Sapiens
ccagguaagacuuauaacagaaagucucuucugaaaacagcaauacaaagaaaaacagauacua

SEQ ID NO: 38585 - RNA, 64 nt, Homo Sapiens
uggugaaauucuuaaucaagguguacaugagcaaaaacagcaagccucacaccacuguuacuug

SEQ ID NO: 38586 - RNA, 64 nt, Homo Sapiens
uauucagaauuacauuuuaucguuuucacauugaaaacagcaaauguugacuuaguaauuuuua

SEQ ID NO: 38587 - RNA, 64 nt, Homo Sapiens
guuuagcauuugugccgccuccuuuugcuacucaaaacagcaaugcuuggcggcagccuuccau

SEQ ID NO: 38588 - RNA, 64 nt, Homo Sapiens
ucauuccaaaauaacuaggauguugcuuucuagaaaacagcauucuuucuuacugcuacuuuca

SEQ ID NO: 38589 - RNA, 64 nt, Homo Sapiens
agaaaggcauauguauaaccgugcaaagugccccaaacagcaaugauugcguagauguugccug

SEQ ID NO: 38590 - RNA, 64 nt, Homo Sapiens
acaugacaucaucaccaguauguccucauaaucaaaacagcauacuuuuuuccauucccauuuu

SEQ ID NO: 38591 - RNA, 64 nt, Homo Sapiens
ugaggucucaucaauuaaagaaguucaagagagaaaacagcacuauggacuguuuacuauccaa

SEQ ID NO: 38592 - RNA, 64 nt, Homo Sapiens
cagagcucagaggucacacuguaucaaagaucucaaacagcaaagucagcauuugcuguauaga

SEQ ID NO: 38593 - RNA, 64 nt, Homo Sapiens
augaaggagggagggagcacauuccuggcagagaaaacagcacgugcaaaggccccgagacugg

SEQ ID NO: 38594 - RNA, 64 nt, Homo Sapiens
guuuuagauacuuuuguucuuucuugcucuuaaggauuuuaaaaaccuguuaaucuuuuuauuu

SEQ ID NO: 38595 - RNA, 64 nt, Homo Sapiens
uuauuugucccacuuuuacuaaacaguggcagcagauuuuaaguuaaagaauauggaauauagu

SEQ ID NO: 38596 - RNA, 64 nt, Homo Sapiens
ccagacuucaguggacccagcagaaucagcucuggauuuuaagcgguacucuucucuguuugcc

SEQ ID NO: 38597 - RNA, 64 nt, Homo Sapiens
cuucugcuuuccaggcucuggacacaauucuauugauuuuaaaguuaaaccaaaaucuuuauaa

SEQ ID NO: 38598 - RNA, 64 nt, Homo Sapiens
uaaaucauuuaaaaaggacaauuugagaaaguaugauuuuaauguuuuaucugcuauaccaguu

SEQ ID NO: 38599 - RNA, 64 nt, Homo Sapiens
cugaauuuuaucugcuauaccuaaguguuuugaggauuuuaaaaaguauuucuaucuuugauau

SEQ ID NO: 38600 - RNA, 64 nt, Homo Sapiens
ucaaucuggaagaaugacuguaucagucaauggggauuuuaacagacugccuugguacugccga

SEQ ID NO: 38601 - RNA, 64 nt, Homo Sapiens
aaauccaguuuuaagaggagccacuuaucaaagagauuuuaacaguaguaagaaggcaaagaau

SEQ ID NO: 38602 - RNA, 64 nt, Homo Sapiens
uuuguuuaugaaauguuacauguagaaaaauacugauuuuaaauauuuuccauauuaacaauuu

SEQ ID NO: 38603 - RNA, 64 nt, Homo Sapiens
uuacucuuaaaaaaaaaaaaaaaagacuaagguggauuuuaaaaauuggaaacugacauaaugu

SEQ ID NO: 38604 - RNA, 64 nt, Homo Sapiens
guguguuagagcuuaugcauuuguuuuuaugagagauuuuaauaaauuuaauuauuugcuuguc

SEQ ID NO: 38605 - RNA, 64 nt, Homo Sapiens
ucugaauaguaaauuaaacaguuguuaucaaaaugauuuuaaagacuauuucuuuuucugggua

SEQ ID NO: 38606 - RNA, 64 nt, Homo Sapiens
aaugucuuguucacauauguguacuuucauauuugauuuuaaaauguacauuauaaccuguaug

SEQ ID NO: 38607 - RNA, 64 nt, Homo Sapiens
ucauuguugauauaccugaauuuacuuuguaagagauuuuaacuucacuucaugcugaugaugu

SEQ ID NO: 38608 - RNA, 64 nt, Homo Sapiens
acaaaccugcugcucaucuaguacaauggaaagggauuuuaagcuucuuauuguuaucaccuau

SEQ ID NO: 38609 - RNA, 64 nt, Homo Sapiens
guaacuaaauauacuucagcaaugaaugcaaucagauuuuaaaauuucuugugacuauucuaag

SEQ ID NO: 38610 - RNA, 64 nt, Homo Sapiens
gcuugcaguaaaaaauaaacaaguugaaacaaaugauuuuaaaaacaaaaugacuaauugaaaa

SEQ ID NO: 38611 - RNA, 64 nt, Homo Sapiens
uuuuuauuucuuuccuggcaauauagucuccucagauuuuaauagaaaucuuaaugcagaaauu

SEQ ID NO: 38612 - RNA, 64 nt, Homo Sapiens
acaucccauacauuuaaauaaauggggaauaagugauuuuaaguauguuuauuaguaaacauga

SEQ ID NO: 38613 - RNA, 64 nt, Homo Sapiens
aucccgucaaaggcagaaucagaucuaauauagugauuuuaagccagguuuuagaaaugaucuu

SEQ ID NO: 38614 - RNA, 64 nt, Homo Sapiens
uaaaacuugacauuggauaugauaacuugggaaagauuuuaauacaacaaaaugcccuggcaga

SEQ ID NO: 38615 - RNA, 64 nt, Homo Sapiens
aacuaguuaccaaaugaauugugccaccauaacugauuuuaauuuugcauuauuuaugauuuua

SEQ ID NO: 38616 - RNA, 64 nt, Homo Sapiens
ccaccauaacugauuuuaauuuugcauuauuuaugauuuuaaaauauuuguugcccagguguua

SEQ ID NO: 38617 - RNA, 64 nt, Homo Sapiens
uugaagucauaggacauuuuuauuuuauggaauagauuuuaaucuauuuacuacuauuaaggua

SEQ ID NO: 38618 - RNA, 64 nt, Homo Sapiens
uuuuauucugaaggacuuuaaggaagggauacaugauuuuaaaaaagccuguaagaggugaaau

SEQ ID NO: 38619 - RNA, 64 nt, Homo Sapiens
aaauuuugauacuuucuauuacuagaucuaauuugauuuuaagcucuaaguuucacuuuuccau

SEQ ID NO: 38620 - RNA, 64 nt, Homo Sapiens
ugggauuacaggugugagucaccacaucuggucggauuuuaacuauucuaauagguauguagug

SEQ ID NO: 38621 - RNA, 64 nt, Homo Sapiens
gccuuuuguuuuuguuuuuugguuggcaguaaccgauuuuaaugacuagcuuuuaaaaauacag

SEQ ID NO: 38622 - RNA, 64 nt, Homo Sapiens
ggaccucuuuauagucuaggauggcagagcagaagauuuuaauaugcuuuuauuaagugaugua

SEQ ID NO: 38623 - RNA, 64 nt, Homo Sapiens
aagcuuccuccaucaauuggcagaaccuaaagaagauuuuaaggggcaaaaguaauuacaauaa

SEQ ID NO: 38624 - RNA, 64 nt, Homo Sapiens
cuggaggauuuuagucuuucuuacacauaugugugauuuuaaacgaauauucucagaccacagg

SEQ ID NO: 38625 - RNA, 64 nt, Homo Sapiens
guaguaucuccuucugacaagcauucccuauugggauuuuaaagcuaugugcacagaauauuag

SEQ ID NO: 38626 - RNA, 64 nt, Homo Sapiens
uuacuuuuguguuugggggaaaauacgagggauugauuuuaaauaaaaaacauuccaucuuuca

SEQ ID NO: 38627 - RNA, 64 nt, Homo Sapiens
uuaaaaaggauucuuuauacauaugugcugaauugauuuuaagaaaguugcaugauccuguagg

SEQ ID NO: 38628 - RNA, 64 nt, Homo Sapiens
aaugcuaacuuuauaguauuucuaauuguucaaggauuuuaaaauucuauuucagggaguauau

SEQ ID NO: 38629 - RNA, 64 nt, Homo Sapiens
uauauugaaagaaauaggccagcagagacuuagggauuuuaaauuggcuugcuuuuuagcuguu

SEQ ID NO: 38630 - RNA, 64 nt, Homo Sapiens
uuaagauugcagaaugauagugauuauucaauuagauuuuaaguaaggauugugauauuagagg

SEQ ID NO: 38631 - RNA, 64 nt, Homo Sapiens
uacacuaacuaguuccuuagaggcuugcaauagggauuuuaaaauuacuagcgaggucaguguu

SEQ ID NO: 38632 - RNA, 64 nt, Homo Sapiens
gccauagaagaaacuugacuuaugauaccucagugauuuuaaaaaucagaagugaugauuauca

SEQ ID NO: 38633 - RNA, 64 nt, Homo Sapiens
gcuaggauucagcuaaauuuuguguaugaauccugauuuuaacucaaaaucuauuuagguucuc

SEQ ID NO: 38634 - RNA, 64 nt, Homo Sapiens
cuucuaagauuauucuccucgaaaaccaagcacagauuuuaaaaacguuuacuccuuucuagau

SEQ ID NO: 38635 - RNA, 64 nt, Homo Sapiens
uauuucuuuuaaaaguauguuuuggaaaaucaaugauuuuaaugcauagcaguauguuugaaaa

SEQ ID NO: 38636 - RNA, 64 nt, Homo Sapiens
uugggcauuccaaaauacagccuuugguucaguagauuuuaaugcuuuaaauagacugacgucg

SEQ ID NO: 38637 - RNA, 62 nt, Homo Sapiens
cccucaagcuccuuaagugaauugccguaacugauuuuaaaggguuuagauuuuaagaaugg

SEQ ID NO: 38638 - RNA, 64 nt, Homo Sapiens
aagugaauugccguaacugauuuuaaaggguuuagauuuuaagaauggugcucuuucaugccua

SEQ ID NO: 38639 - RNA, 64 nt, Homo Sapiens
cggaggcaaucccggaaaccucuuuuauaagugugauuuuaaaaauguggauuaaacucucgau

SEQ ID NO: 38640 - RNA, 64 nt, Homo Sapiens
gcauuaauauuauuagcaugaaauuuuuacuucagauuuuaagcucaugaauaaagauauaucu

SEQ ID NO: 38641 - RNA, 64 nt, Homo Sapiens
cuuuucuacugaaucuauauuuccauuuguaagugauuuuaaguuaacauaugaaggcagggaa

SEQ ID NO: 38642 - RNA, 64 nt, Homo Sapiens
uacauuuauuuaucuguuguacagauuugauuaugauuuuaauguuugaaagauugcacuuguu

SEQ ID NO: 38643 - RNA, 64 nt, Homo Sapiens
cauaucugauuaacauuuuuaauaacuuagaggagauuuuaacuuuauuuaaaaauagguaaaa

SEQ ID NO: 38644 - RNA, 64 nt, Homo Sapiens
ucugauuuuucagaauauuugcaauaagagucuggauuuuaaaaaacacaugcauacacacaau

SEQ ID NO: 38645 - RNA, 64 nt, Homo Sapiens
aaaugagugguucaguucauugucuuuuaagugugauuuuaaaaggggaacuuuuuugcccaug

SEQ ID NO: 38646 - RNA, 64 nt, Homo Sapiens
ugugcauuuuuaacccuacagucugcuguuaagggauuuuaaaucuggacagucagaaccacag

SEQ ID NO: 38647 - RNA, 64 nt, Homo Sapiens
uugagauuaaugugcuuaaaaguccuacgugacugauuuuaaacauugugauaaaauuaauuuu

SEQ ID NO: 38648 - RNA, 64 nt, Homo Sapiens
uuugcagcuacauuugaaagugauagaauaaagagauuuuaaugaguuaucacuuuuucagcug

SEQ ID NO: 38649 - RNA, 64 nt, Homo Sapiens
aaacaggaaauuagaaguguaaaaauugauugaagauuuuaaauccuuaugauguacuuuguaa

SEQ ID NO: 38650 - RNA, 64 nt, Homo Sapiens
ugcaugcucuccuuuauuuacaaucauggagacagauuuuaauuuaaaaaccaggaaauuucua

SEQ ID NO: 38651 - RNA, 64 nt, Homo Sapiens
ucuguuuaauguucauucucuauaaauagucucugauuuuaaguuuaagggaagaguuauuuaa

SEQ ID NO: 38652 - RNA, 64 nt, Homo Sapiens
agcauugacaucaucuguaaacucagucuucagugauuuuaaaccuccaauauuaccaggccca

SEQ ID NO: 38653 - RNA, 64 nt, Homo Sapiens
uuuagguuauuuauacaaagggaauaaauaggcugauuuuaauuugguaaguugaucuuuuuau

SEQ ID NO: 38654 - RNA, 64 nt, Homo Sapiens
augagaaaaggaaauuacaauaauaaaguuuuaugauuuuaaauaagucauauguuuguauccu

SEQ ID NO: 38655 - RNA, 64 nt, Homo Sapiens
uguccuuuuagauuagacuuuuuuccagcucuaagauuuuaaauauagaugauccacugaaauc

SEQ ID NO: 38656 - RNA, 64 nt, Homo Sapiens
ggcgagcaaauaaaauucaauuucuggauaguaggauuuuaauagccacuuauugaugacagaa

SEQ ID NO: 38657 - RNA, 64 nt, Homo Sapiens
gccaaagucaauaauugggacaaaugguaaagaugauuuuaaaaucuguuguauuuaggucccu

SEQ ID NO: 38658 - RNA, 64 nt, Homo Sapiens
ugaaccaaaaucuucccaggaauaguacuuaauagauuuuaauguuaauuuauauucauuguag

SEQ ID NO: 38659 - RNA, 64 nt, Homo Sapiens
uuccaaaggcucuacuuucaaagguuaagaaugagauuuuaaaauuggauuuuugccuggacuu

SEQ ID NO: 38660 - RNA, 64 nt, Homo Sapiens
gagaauaaagcgcuagcaagauacaucacuuacugauuuuaaaaauacagaaagauuuugagua

SEQ ID NO: 38661 - RNA, 64 nt, Homo Sapiens
auuaaauaugcacaauauuccauagcucacugaggauuuuaaaauuauaagcauaggauuuuau

SEQ ID NO: 38662 - RNA, 64 nt, Homo Sapiens
ggucaagauuauuuuuagagguuauuuuauuggggauuuuaagaacuaauaacaucuugaguua

SEQ ID NO: 38663 - RNA, 64 nt, Homo Sapiens
ggggagaauucuagaaauaauuuguuuuuguagagauuuuaaaguugaaugguuuaacaaaaga

SEQ ID NO: 38664 - RNA, 64 nt, Homo Sapiens
aguauaaaaaauucucauagauaauaauugaaaagauuuuaacauuacaugcuacuaaauuuuu

SEQ ID NO: 38665 - RNA, 64 nt, Homo Sapiens
guauuaaaauauuuuuguuuuaaagaaaaauuuggauuuuaaagaucuuuuucaugaaugauuu

SEQ ID NO: 38666 - RNA, 64 nt, Homo Sapiens
aaaaauuuggauuuuaaaggucuuuuucaugaaugauuuuaaaguguuaauucugacuugagaa

SEQ ID NO: 38667 - RNA, 64 nt, Homo Sapiens
aaucuuauuauguacuucugaaugaauggcaauagauuuuaaaauacguuuuugugcaaaaaua

SEQ ID NO: 38668 - RNA, 64 nt, Homo Sapiens
guucugccauguuaaguggcuuaacaacaaacuggauuuuaaaaccacccagcaguagguuuug

SEQ ID NO: 38669 - RNA, 64 nt, Homo Sapiens
guuaaaaagaaaauuauugcauuugaucuggauggauuuuaaaagaauauaauguucaauauua

SEQ ID NO: 38670 - RNA, 64 nt, Homo Sapiens
gagguugucuaaaagucuuuuuaauuaauagaaagauuuuaauauccaagaguagucaaauuaa

SEQ ID NO: 38671 - RNA, 64 nt, Homo Sapiens
acccaggguccuacagauagauauggugugcccagauuuuaaaaauaccuucaaaaauaaaaaa

SEQ ID NO: 38672 - RNA, 64 nt, Homo Sapiens
ugugccaaacuuuccaggguuuuguagucaccuagauuuuaagcugauagcauagugcuucagc

SEQ ID NO: 38673 - RNA, 64 nt, Homo Sapiens
uuguacauacuacuuuauaaaaauucucaccuuugauuuuaaaucccaguaccuaguuauaucu

SEQ ID NO: 38674 - RNA, 64 nt, Homo Sapiens
aaucaaaagacaguuuuaggaagucuuauuuauugauuuuaaaaguuuuacauguaggagugug

SEQ ID NO: 38675 - RNA, 64 nt, Homo Sapiens
auagaacacuucagacacaggaaaaauaaacguggauuuuaaaaaaucaaucaauggugcaaaa

SEQ ID NO: 38676 - RNA, 64 nt, Homo Sapiens
auucccaugagaaauguugaauuuaugaagaauagauuuuaaggcuuugaaaaugguuaauuuc

SEQ ID NO: 38677 - RNA, 64 nt, Homo Sapiens
gcugucuugaaguuaacaagagcugccaguccgugauuuuaauucugcucccaggggccuaggu

SEQ ID NO: 38678 - RNA, 64 nt, Homo Sapiens
accauuacauaaugacaaacgcccuagaaauauagauuuuaaucaucuagcaauucacaaaaau

SEQ ID NO: 38679 - RNA, 64 nt, Homo Sapiens
ccaguaucugcucuaaauaucugacuuagauacugauuuuaaugucaccauuucagacagacuu

SEQ ID NO: 38680 - RNA, 64 nt, Homo Sapiens
guguuaaauagugacucccucaacugccaguguagauuuuaaaagcauuguaaaaguuccauuc

SEQ ID NO: 38681 - RNA, 64 nt, Homo Sapiens
gggggacaaggucaguauuuaccaaaguguaucugauuuuaaaaauuccuuuagucuguaaaac

SEQ ID NO: 38682 - RNA, 64 nt, Homo Sapiens
cuccuuagagcucugaaggggucuccuaguuccagauuuuaauuuggggaacagaucuggguuc

SEQ ID NO: 38683 - RNA, 64 nt, Homo Sapiens
ggguauuuuaagugaugucauuugagcaggacuggauuuuaagccgaagggcaauaucuacgug

SEQ ID NO: 38684 - RNA, 64 nt, Homo Sapiens
uuaaaaaaacgagcaauuugaagagaaucuuuuggauuuuaagcaguccgaaauaauagcaauu

SEQ ID NO: 38685 - RNA, 64 nt, Homo Sapiens
aacaguaucaaaagaagaaucggaagaugcuugugauuuuaauauuauuugucaucaucauugu

SEQ ID NO: 38686 - RNA, 64 nt, Homo Sapiens
ugagagucacugcagguguucuuucaucccaucugauuuuaacccaugguugagacguuccaag

SEQ ID NO: 38687 - RNA, 64 nt, Homo Sapiens
ggcaccgcagugccagagaagaugcuugagguuagauuuuaaggaguggggaauugugaagccc

SEQ ID NO: 38688 - RNA, 64 nt, Homo Sapiens
uuguccacguuguuucacaucugguuagggggcagauuuuaaaauguaguuuuguaauguuaca

SEQ ID NO: 38689 - RNA, 64 nt, Homo Sapiens
augacugguguuuugucuuccugcauaucuguuagauuuuaaaauuuugaucuaaacauagguu

SEQ ID NO: 38690 - RNA, 64 nt, Homo Sapiens
uuaguguaacaaauaaggucauggcacuaauuuugauuuuaacacaaaaaacaaagcuaaccau

SEQ ID NO: 38691 - RNA, 64 nt, Homo Sapiens
agcuuguccugucaacuaugaaauauggugacuagauuuuaauucauaaccguaaaguuuuuua

SEQ ID NO: 38692 - RNA, 64 nt, Homo Sapiens
caaggacaucagagugaagugucaguugucagaugauuuuaaaaguuaugucuucagagaaaaa

SEQ ID NO: 38693 - RNA, 64 nt, Homo Sapiens
uuuuucuaacaacuguggaggagcccggcgcauggauuuuaauguuaggcgcacauggaaauga

SEQ ID NO: 38694 - RNA, 64 nt, Homo Sapiens
auuaucagaguaauaccauuauauaccuggaacagauuuuaauaaaagaaaauauuuucaauau

SEQ ID NO: 38695 - RNA, 64 nt, Homo Sapiens
agcccugaacaacagcauuugacaguguccuuuagauuuuaauuuuuucaauggauugcuuuaa

SEQ ID NO: 38696 - RNA, 64 nt, Homo Sapiens
cacguuaaaaucugcaaaugguuuuuacaccucugauuuuaacaugaacuuauacuaauguuug

SEQ ID NO: 38697 - RNA, 64 nt, Homo Sapiens
ugaauuuacagugaugagaaccugcuacuuaguugauuuuaaagauggaaacacauugcucuac

SEQ ID NO: 38698 - RNA, 64 nt, Homo Sapiens
auuuguaauaguucuauaaaagccuagauuguaagauuuuaaacucugaaaccagguagaagga

SEQ ID NO: 38699 - RNA, 64 nt, Homo Sapiens
gugugagugcauguacuaucccauuuagaauggugauuuuaaauccaauaugugauuuuuuuuc

SEQ ID NO: 38700 - RNA, 64 nt, Homo Sapiens
uguacauguauuaaauuacaugauaacagggauugauuuuaaaauuaaacucugaauuuaucuu

SEQ ID NO: 38701 - RNA, 64 nt, Homo Sapiens
gaaauuuucucaucuaaaauauacacuggauuuguuaggggaauuuguuuuucuuugaaguuuu

SEQ ID NO: 38702 - RNA, 64 nt, Homo Sapiens
uauguguggguacaugugagugugugugcuugguuuaggggaagguguguauguaugugugugg

SEQ ID NO: 38703 - RNA, 64 nt, Homo Sapiens
gaaauugccauuuuucggguaugggcagaacugcuuaggggaaucccugggaucaaguaggaaa

SEQ ID NO: 38704 - RNA, 64 nt, Homo Sapiens
ugcgugcaggugaggagagaugaaccaggucugcuuaggggacccccacacaggucuccgugcg

SEQ ID NO: 38705 - RNA, 64 nt, Homo Sapiens
agcugcauuuaaaucaagucccaaauucauugacuuaggggaguucaguauuuaaugaaacccu

SEQ ID NO: 38706 - RNA, 64 nt, Homo Sapiens
cuuuccaguuuccaagucuuuuccuagcaguaauuuaggggagacagaggaguuucauguaaag

SEQ ID NO: 38707 - RNA, 64 nt, Homo Sapiens
uggaagcuucagggccuugcugcuggggucauuuuuaggggaaaaaggaggauaugauggucac

SEQ ID NO: 38708 - RNA, 64 nt, Homo Sapiens
ucaaucucccaucugugaaauaaggacuccaccuuuaggggacccuccauguuugcuggguauu

SEQ ID NO: 38709 - RNA, 64 nt, Homo Sapiens
ggcguaagaugaaguggcccuccacaaaggcugguuaggggacaguucuuucucuaacauaguu

SEQ ID NO: 38710 - RNA, 64 nt, Homo Sapiens
caucucuaaaaaauaaaauauaagaaaauaaaacuuaggggauauacagauuuaaauauucaaa

SEQ ID NO: 38711 - RNA, 64 nt, Homo Sapiens
ugauuuuauuuuuacaacuaacauccauuccccuucauuuaaacaccuuuuguguuuuacuuca

SEQ ID NO: 38712 - RNA, 64 nt, Homo Sapiens
guauuuuuucaugaacauuuugauacaaauuucaucauuuaaugauucaccaauuucuugcauu

SEQ ID NO: 38713 - RNA, 64 nt, Homo Sapiens
auguuucacucaugucugucauuuuauaagcauaucauuuaaaaagcuucuaaaaagcuauuuc

SEQ ID NO: 38714 - RNA, 64 nt, Homo Sapiens
agaugaaaauauauuucccuguaagcugaauuacucauuuaaaaauuuuaacuucuauauggga

SEQ ID NO: 38715 - RNA, 64 nt, Homo Sapiens
aauagccagcacaucccuucaccccccucuaaagucauuuaacuggugagacagagacaaauga

SEQ ID NO: 38716 - RNA, 64 nt, Homo Sapiens
aaucuaagccaagaugauaaggaggcuugggauuucauuuaaauagacaaccaaaggaaaaugg

SEQ ID NO: 38717 - RNA, 64 nt, Homo Sapiens
uuaaccuagucugggagauggguacuacauccugucauuuaaucugaaugcuuacuaugugcca

SEQ ID NO: 38718 - RNA, 64 nt, Homo Sapiens
ucacauggucaguagguggcuaagauaaaaggacucauuuaagccuuuauaaagaauuugaggu

SEQ ID NO: 38719 - RNA, 64 nt, Homo Sapiens
aagggaucgaagacauuucaugauagacauuucgucauuuaaguucaaauugcucuaucugggc

SEQ ID NO: 38720 - RNA, 64 nt, Homo Sapiens
aagggaucgaaaacauuucaugauauacauuucaucauuuaaguuauccaauuuacagauagua

SEQ ID NO: 38721 - RNA, 64 nt, Homo Sapiens
ccaguauauucaguaguugauuugucucacuccaucauuuaaaaagcacgucagcaagagccuc

SEQ ID NO: 38722 - RNA, 64 nt, Homo Sapiens
uuugaugcuuaguuauguugauaggaauuuugacucauuuaaacaagauuugugaagacaucag

SEQ ID NO: 38723 - RNA, 64 nt, Homo Sapiens
uuccuacacgcuaacuucgucguuuaaauuuguuucauuuaaguuauuuuuaccguaacuauuu

SEQ ID NO: 38724 - RNA, 64 nt, Homo Sapiens
guuccuguaacaguuaugcaagaauggaagagaaucauuuaagauuuuuucuggccuuuacaac

SEQ ID NO: 38725 - RNA, 64 nt, Homo Sapiens
cugcuggccauggaagccucuuaacaacacacugucauuuaaggcugugcuugugcuuuauaca

SEQ ID NO: 38726 - RNA, 64 nt, Homo Sapiens
ccugcacuuuauguaagaauguaaaccuggagucucauuuaagaaugaucagcaauacguuuag

SEQ ID NO: 38727 - RNA, 64 nt, Homo Sapiens
ucaucaaugaaaaacccauauguaauaaucgaauucauuuaacaugaaucuugaguacguggac

SEQ ID NO: 38728 - RNA, 64 nt, Homo Sapiens
uuugaaggugccauucuuaugagccaaaaguuugucauuuaaaaguucauuuugagggaauaac

SEQ ID NO: 38729 - RNA, 64 nt, Homo Sapiens
caauuuguaaguagcgcagcugccguuucagcccucauuuaauucuacaguacaugcugaagcg

SEQ ID NO: 38730 - RNA, 64 nt, Homo Sapiens
gaaaaauauauaucuaucuaccacucauuucaucucauuuaaggccucccuccaccccaggacg

SEQ ID NO: 38731 - RNA, 64 nt, Homo Sapiens
uagucugccaucuuuaaaaaaaaauacaguauuuucauuuaaauucucugauggagggacaaca

SEQ ID NO: 38732 - RNA, 64 nt, Homo Sapiens
aguuauucucuuuuucaucuggggauuuaccuguucauuuaaucugccuguuuugaucuguuuu

SEQ ID NO: 38733 - RNA, 64 nt, Homo Sapiens
cauuaauaaugguguacuuuaaaaaauauauguuucauuuaaucuucacaaaagaucuguagag

SEQ ID NO: 38734 - RNA, 64 nt, Homo Sapiens
uuggaucacuuacauccaauauauguauauuuugucauuuaaaucagaacaaccacuugaaauu

SEQ ID NO: 38735 - RNA, 64 nt, Homo Sapiens
cauuuugucacucaguuauuuaacuguguuuagcucauuuaaaucaaaauguguacuuuaaucu

SEQ ID NO: 38736 - RNA, 64 nt, Homo Sapiens
augaauauuugaucuucuugagauuuucauacuaucauuuaaccaccaggaagcugaagugugu

SEQ ID NO: 38737 - RNA, 64 nt, Homo Sapiens
cauaccaaccauuauccagagagguugggcuuauucauuuaacacuugcugcguucuguuugcu

SEQ ID NO: 38738 - RNA, 64 nt, Homo Sapiens
uauaauugcgaauaucagaauuauugaguaguugucauuuaaaauaagaguuuaaaaguuuagc

SEQ ID NO: 38739 - RNA, 64 nt, Homo Sapiens
uaggaaaugaaaguagcgucuuuuaaauugcuauucauuuaauauaccuguuuucccaucuuuu

SEQ ID NO: 38740 - RNA, 64 nt, Homo Sapiens
uauuuacaguaucagccuuugauuauagaugugaucauuuaaaauuugauaaugacuuuaguga

SEQ ID NO: 38741 - RNA, 64 nt, Homo Sapiens
uacaguuuuucuuuugaucgugcacuuauagucuucauuuaauuccucauagaaucccagucac

SEQ ID NO: 38742 - RNA, 64 nt, Homo Sapiens
aauacaucuacccacuccauuauuuuuuaaaacuucauuuaauaguuuaaacaagauugguuuu

SEQ ID NO: 38743 - RNA, 64 nt, Homo Sapiens
cagaauuauuguuacucauauuuuaaucaguaagucauuuaagcuaugacagaguaggaauuga

SEQ ID NO: 38744 - RNA, 64 nt, Homo Sapiens
uuuuaaaaauuuaaaauuucauuuaaauuuucagucauuuaaaauuuuguuucagucauuuaaa

SEQ ID NO: 38745 - RNA, 64 nt, Homo Sapiens
uuuaaauuuucagucauuuaaaauuuuguuucagucauuuaaaaaauuuugaauaauaauguuu

SEQ ID NO: 38746 - RNA, 64 nt, Homo Sapiens
cucuguacuaugcauuuuuguucuuucgaagauuucauuuaaauuggacugaaaagcaaauuua

SEQ ID NO: 38747 - RNA, 64 nt, Homo Sapiens
ugugccucucaaaacuucagcauagauagugcacucauuuaaucuauagacuugcugaguuugg

SEQ ID NO: 38748 - RNA, 64 nt, Homo Sapiens
aguuaaaaucauaacuuaauuucauuaacuuuuaucauuuaacucucucauguuuguuguaacc

SEQ ID NO: 38749 - RNA, 64 nt, Homo Sapiens
aaaaagcaaauagcauugacacauuuaaagcuuuucauuuaaaguaguggauguuuuugaagua

SEQ ID NO: 38750 - RNA, 64 nt, Homo Sapiens
auacagucauuuaugccuaaagccuggugauuauucauuuaaaugaagaucacauuucauauca

SEQ ID NO: 38751 - RNA, 64 nt, Homo Sapiens
uuccaauugaauuaaaguguggccucguuuuuagucauuuaaaauuguuuucuaaguaauugcu

SEQ ID NO: 38752 - RNA, 64 nt, Homo Sapiens
uuuaaaggaauggaguuuuuauagccuuuaagcaucauuuaaaucaacuugcacaauguugaac

SEQ ID NO: 38753 - RNA, 64 nt, Homo Sapiens
uucuuuuuagaaaauaacaucaaugauggcuggaucauuuaaaggcuuauuuucuuuuaaugug

SEQ ID NO: 38754 - RNA, 64 nt, Homo Sapiens
agggaaguggaacuuugguaaaugacuguuugccucauuuaauaguauacaggcucagcccaua

SEQ ID NO: 38755 - RNA, 64 nt, Homo Sapiens
gccuucuuaauggagauauucaguuuucuuuuuuucauuuaaacaaagaaaaaaaauguaucua

SEQ ID NO: 38756 - RNA, 64 nt, Homo Sapiens
auuuuauaguauaaaguauuaugacuuauaccucucauuuaaaugcaaagacaggaucauacac

SEQ ID NO: 38757 - RNA, 64 nt, Homo Sapiens
aguaauucagaagaacagugccagaacaaaucacucauuuaaaaauaauuuuaauaaaagugaa

SEQ ID NO: 38758 - RNA, 64 nt, Homo Sapiens
caaauaccaaauaguuuacaugcaucauuaauauucauuuaauucaaaaccaaaaaaaccaagg

SEQ ID NO: 38759 - RNA, 64 nt, Homo Sapiens
gauguagggaaacuagauauuaacagaaaagcacucauuuaauauuuuuccauauucugauuuu

SEQ ID NO: 38760 - RNA, 64 nt, Homo Sapiens
aauuauuuuuucacuacaacucccaguauuauguucauuuaauaacuuuuauaaugcauuuuac

SEQ ID NO: 38761 - RNA, 64 nt, Homo Sapiens
aguaccauucuguaucuuaucuuaaaaagaacaaucauuuaaucuauucuagacuuacaaaagg

SEQ ID NO: 38762 - RNA, 64 nt, Homo Sapiens
uguaucauacaguaaugccaaaguuauugguggcucauuuaaacaaauuaagauauguauuugu

SEQ ID NO: 38763 - RNA, 64 nt, Homo Sapiens
auggauuagaaaaauauuuugacacuuuuaauuuucauuuaacauucaaauuuagcauuauuuu

SEQ ID NO: 38764 - RNA, 64 nt, Homo Sapiens
aauuucuaaaagggucuuuuuuuuuaaagagugaucauuuaaaugauucugagauuaaaaaaaa

SEQ ID NO: 38765 - RNA, 64 nt, Homo Sapiens
gccagaaauggucaagcaauaauauucugggaggucauuuaaauacuagucucagggcuugugu

SEQ ID NO: 38766 - RNA, 64 nt, Homo Sapiens
agcauuuuuaaaaacgaauuguaguuguuuuucuucauuuaaaauggaucuguuggagguuaug

SEQ ID NO: 38767 - RNA, 64 nt, Homo Sapiens
ucauauauauuuucuguauuaagcucauuuggcuucauuuaagcuguauacuuagucauauauc

SEQ ID NO: 38768 - RNA, 64 nt, Homo Sapiens
ccaggucccacgcuggauauuuucacaccuuaccucauuuaauacaacaagcaaggagguagac

SEQ ID NO: 38769 - RNA, 64 nt, Homo Sapiens
cucugugcuaggcacagacuuucuagggauuauuucauuuaauucucauggcaaccaccaugca

SEQ ID NO: 38770 - RNA, 64 nt, Homo Sapiens
ccaagucccugucucuuucagacacagacaagcuucauuuaaauuauuucaucugaucauuauc

SEQ ID NO: 38771 - RNA, 64 nt, Homo Sapiens
uaggaaauuuaaagcugcauggucugucuuguuuucauuuaauuauugugaauaccuagaaucu

SEQ ID NO: 38772 - RNA, 64 nt, Homo Sapiens
gaugggagccuuuaucugucauuagaaaucuuucucauuuaagaacuuaugaauaugcugaaga

SEQ ID NO: 38773 - RNA, 64 nt, Homo Sapiens
gugucuuacuuguacuguaucacauuccauacccucauuuaauucuuaauaaaacuguucacuu

SEQ ID NO: 38774 - RNA, 64 nt, Homo Sapiens
guaugguucaaguacugcucuacauaaauagaacucauuuaaaauuuguauuggggauauguuu

SEQ ID NO: 38775 - RNA, 64 nt, Homo Sapiens
guuuaaauugaaaaugggccugaagcaagcuaaaucauuuaaauggacuaucaagagugaccuu

SEQ ID NO: 38776 - RNA, 64 nt, Homo Sapiens
uccccaggggaaaaugaagguuaggauuuaacagucauuuaaaaaaaaaauuuguuuugacgga

SEQ ID NO: 38777 - RNA, 64 nt, Homo Sapiens
aaaaaaaauuuguuuugacggaugauuggauuauucauuuaaaaugauuagaaggcaaguuucu

SEQ ID NO: 38778 - RNA, 64 nt, Homo Sapiens
acaauaugguauaacaacaagugaauuugaagacucauuuaaaauauuguguuauuuauaaagu

SEQ ID NO: 38779 - RNA, 64 nt, Homo Sapiens
aagguuaaacuuauggcuauuuuuaaagggcuauucauuuaaucugaguuuucccuuauuuuca

SEQ ID NO: 38780 - RNA, 64 nt, Homo Sapiens
auuuucuuuauuguguuggugcaauauuuuauuaucauuuaaccucaggauauucagaccaaca

SEQ ID NO: 38781 - RNA, 64 nt, Homo Sapiens
aaacccuggugcuuccccugcagaauacuguacuucauuuaacagaaugauugauuuuucuuuc

SEQ ID NO: 38782 - RNA, 64 nt, Homo Sapiens
ugaauguauuauucaggaagaauacugagugccuucauuuaacuaaaguugaauguaaaaguca

SEQ ID NO: 38783 - RNA, 64 nt, Homo Sapiens
uuagaauuauaaauuguuaaaaccuugauaauugucauuuaauuauauuucagguguccugaac

SEQ ID NO: 38784 - RNA, 64 nt, Homo Sapiens
aauuaucuuuaguuaauugcauuucauacuuuacucauuuaacaaaaugaaaguguucauccag

SEQ ID NO: 38785 - RNA, 64 nt, Homo Sapiens
auauuaaaucuuagaaguuaaauuaugugggaaaucauuuaauauauacagagaaacuauaagc

SEQ ID NO: 38786 - RNA, 64 nt, Homo Sapiens
aaagaucagaucccuccuuccgugaaaauugguuucauuuaacauaaaauggccaaauauauac

SEQ ID NO: 38787 - RNA, 64 nt, Homo Sapiens
ugacaugggugucgguuuugaacaaucuaccucaucauuuaaaacuucacuuuacugcauagga

SEQ ID NO: 38788 - RNA, 64 nt, Homo Sapiens
agauaacuuucuggcauuuagaauuuuguuccauucauuuaauuuguucaucugagaauuuuuu

SEQ ID NO: 38789 - RNA, 64 nt, Homo Sapiens
cuguuguguuuauguagaaaauucacaaaucuguucauuuaauuuuuuaauuugagaauuuuua

SEQ ID NO: 38790 - RNA, 64 nt, Homo Sapiens
aauuguuuuguaguuucugguuaggaaaaucaggucauuuaagaaacuaauguuuuuaagguuu

SEQ ID NO: 38791 - RNA, 64 nt, Homo Sapiens
caaauccacaucuuuuguaaaauuauuuuuuuuuucauuuaaaaucuuugguauuucauauagg

SEQ ID NO: 38792 - RNA, 64 nt, Homo Sapiens
uagcaagcacuugauaaaagcaauggcaagugcucuccaauaaaguagggggagaaagcaaacc

SEQ ID NO: 38793 - RNA, 64 nt, Homo Sapiens
ccacugcacuccggccuaggcaacgagagcaaaacuccaauacaaacaaacaaacaaacaccug

SEQ ID NO: 38794 - RNA, 64 nt, Homo Sapiens
aaaguauacuuuuugcaguagaucaugcccugaccuccaauaaaaaccucuuuaaaacaaugcu

SEQ ID NO: 38795 - RNA, 64 nt, Homo Sapiens
ccagcuccuuucuccugugaauggaggcagagaccuccaauaaagugccuucugggcuuuuucu

SEQ ID NO: 38796 - RNA, 64 nt, Homo Sapiens
gucucggagcuacaaccgcauccuuccucacccccuccaauauacccaccugcuggcccccuug

SEQ ID NO: 38797 - RNA, 64 nt, Homo Sapiens
ucuuaaauuuaaaaccuacacuuuucccccaacccuccaauaaagaaaagcaguuugugcuaua

SEQ ID NO: 38798 - RNA, 64 nt, Homo Sapiens
aacacauuaaaagaguacaacauucuacccucaccuccaauauacccauuuuccuuuuauaaaa

SEQ ID NO: 38799 - RNA, 64 nt, Homo Sapiens
aacaagauaaaucuaucuucccaaaagcagaaggcuccaauauggagcaagaaacaaaaagaag

SEQ ID NO: 38800 - RNA, 50 nt, Homo Sapiens
ggaauggugagugauuagagcuccaauaaugcaauucuaggggcuuauag

SEQ ID NO: 38801 - RNA, 64 nt, Homo Sapiens
uucuuuuaccuaucaauauuugaugauguuucuucuccaauaucaccuccugucauuuuugucc

SEQ ID NO: 38802 - RNA, 64 nt, Homo Sapiens
cauuucccuugaguuucauucaaaauucaaaaugcuccaauaagaguauccaaauccaaaaauc

SEQ ID NO: 38803 - RNA, 64 nt, Homo Sapiens
gguucauugucaucaaucaucauugcauguuucccuccaauauuguuuucccuuguuuuccucu

SEQ ID NO: 38804 - RNA, 64 nt, Homo Sapiens
uccgaucuggaacacauauuggaauuggggccaacuccaauauaggguggguaaggccuuauaa

SEQ ID NO: 38805 - RNA, 64 nt, Homo Sapiens
uuuuccaauuuuaccuguauuaccaaacuggguucuccaauaauguccaaauuguaauguugcc

SEQ ID NO: 38806 - RNA, 64 nt, Homo Sapiens
agaguccuuucuucucuacauccaggggccuuuucuccaauaaugugccuuuaacucuagggac

SEQ ID NO: 38807 - RNA, 51 nt, Homo Sapiens
cagcucagcaagaagcuuaaucuccaauaaacaucuauguuaaauccaaau

SEQ ID NO: 38808 - RNA, 64 nt, Homo Sapiens
gugcuucagaucuguccauggcuuuggcucagagcuccaauaauaaucaauauacaggguaaua

SEQ ID NO: 38809 - RNA, 64 nt, Homo Sapiens
cuuauggagccuggauuuuuauuuuuuaaaaggccuccaauacucauuuaaaaaaauaacaaac

SEQ ID NO: 38810 - RNA, 64 nt, Homo Sapiens
gggaaaaugaagcuuuuuauuuuuguacuuuuaccuccaauaaaucuaggguggguuuacagcu

SEQ ID NO: 38811 - RNA, 64 nt, Homo Sapiens
aguaacuagagguuuggaguuuagagccuaauuacuccaauaaacccccuuuuuaaaaacaccu

SEQ ID NO: 38812 - RNA, 64 nt, Homo Sapiens
cuugcauccaccuacaaauaugauagaaauauuucuccaauauaccuaacaaaaccagugauuu

SEQ ID NO: 38813 - RNA, 64 nt, Homo Sapiens
aaaaaaaauggaaaucaaaucuuuuaucucucuucuccaauauuugcuuaucuguuacggccuc

SEQ ID NO: 38814 - RNA, 64 nt, Homo Sapiens
ugguuucaaauccuuuugaagauugauuuucuuccuccaauaguaauaggagacaaaggagagu

SEQ ID NO: 38815 - RNA, 64 nt, Homo Sapiens
uuaagcuaaaugguauuuucauuuuucucaagcucuccaauaaauaugaccaccaagaugcaga

SEQ ID NO: 38816 - RNA, 64 nt, Homo Sapiens
uagcugauauugacauaucugaggagggaggaggcuccaauacgacuacucccaauucacaggg

SEQ ID NO: 38817 - RNA, 64 nt, Homo Sapiens
cugccucaguccugcaaccuaaagcuguagucgccuccaauagccauccaugccaucccugccu

SEQ ID NO: 38818 - RNA, 64 nt, Homo Sapiens
uaucaaauccaaauagcauguuuuuacugugccacuccaauauuuugcugaaugcuuaauuuau

SEQ ID NO: 38819 - RNA, 64 nt, Homo Sapiens
cuggagcgacaaagggacauuuuguccacccacccuccaauaagcaaaaguggccaugucgaca

SEQ ID NO: 38820 - RNA, 61 nt, Homo Sapiens
ugggaauguucacaaagucaggccacagaggcuccaauacccuccacugagccacauuuaa

SEQ ID NO: 38821 - RNA, 64 nt, Homo Sapiens
guaagagauaguguugaaccuuuccaucaaacuucuccaauacaucggacugacuuuauucaua

SEQ ID NO: 38822 - RNA, 64 nt, Homo Sapiens
cagcaauaagauugucucuagugccacgaugcugcuccaauagacaucaucauugccugcugau

SEQ ID NO: 38823 - RNA, 64 nt, Homo Sapiens
acgcuaagacacaggcuccaguaggggcuguugccuccaauaaagcagcagugagcuuugccuu

SEQ ID NO: 38824 - RNA, 64 nt, Homo Sapiens
aaaaaccuguaucugacccacuuuguaauuuuugcuccaauauccauucuguagacuuuugaaa

SEQ ID NO: 38825 - RNA, 64 nt, Homo Sapiens
caauaugaauuuguguguuaugaauuucugauuucuccaauaguauaugccacuauauaaauuu

SEQ ID NO: 38826 - RNA, 64 nt, Homo Sapiens
uguacuuucacuuuugcugcuucacugccuugugcuccaauaaauccacuccuucaccacccau

SEQ ID NO: 38827 - RNA, 64 nt, Homo Sapiens
caaggggugacacaaaguagcaaacugaauacuucuccaauagcaaccccaagcuaccuccuca

SEQ ID NO: 38828 - RNA, 64 nt, Homo Sapiens
guaucccauaugguaucucuugcucuuccuucaacuccaauaaauuuaaugacuaaaugccaag

SEQ ID NO: 38829 - RNA, 64 nt, Homo Sapiens
aaaaauuguccacugacauuugggauuuacuuuucuccaauaccugccaauacagaaaacuauu

SEQ ID NO: 38830 - RNA, 64 nt, Homo Sapiens
uuauauaccugccuaaguugauguggacuggacacuccaauaaacagucaagugaaaaauuaac

SEQ ID NO: 38831 - RNA, 64 nt, Homo Sapiens
cugauauggaagcacccauuaugcgcuguggccacuccaauaggugcugaguguacagagugga

SEQ ID NO: 38832 - RNA, 64 nt, Homo Sapiens
accuccaucuuuauauucuucuguuauacuauuccuccaauaaagugauuuguagaaaaaaaug

SEQ ID NO: 38833 - RNA, 64 nt, Homo Sapiens
ggcagggacgagggaaggaaaguaacuccugacucuccaauaaaaaccuguccaaccuguggca

SEQ ID NO: 38834 - RNA, 64 nt, Homo Sapiens
aaccuaugcugaaaauacgauaaaagaaaaacaacuccaauaugcuaaaaguuaaauaugguau

SEQ ID NO: 38835 - RNA, 64 nt, Homo Sapiens
aaaaaauaucaccaaagaagcucuuuaagguuuucuccaauauuucuaguuagcaaucuuaagg

SEQ ID NO: 38836 - RNA, 64 nt, Homo Sapiens
cacucuuagagaaggauugccuggguccucaagacuccaauagagguaagaauauucagcuggu

SEQ ID NO: 38837 - RNA, 64 nt, Homo Sapiens
guuuaaguacaaucuuuuuauucauuccuuccuucuccaauaguaguagaaaugaaugcauuua

SEQ ID NO: 38838 - RNA, 64 nt, Homo Sapiens
gcaguuaucguggccucucgugucugagucagggcuccaauagucuacaaggacacccaagggg

SEQ ID NO: 38839 - RNA, 64 nt, Homo Sapiens
acuuuccggagucuauuuuuguuaagacaaucaacuccaauaacugagcugaaguuuuuguuua

SEQ ID NO: 38840 - RNA, 64 nt, Homo Sapiens
uuggaguaggggcagagggagggagccaaggucacuccaauaaaacaagcucauggcacggacu

SEQ ID NO: 38841 - RNA, 64 nt, Homo Sapiens
ccuaaaugggccccugggugcccagccuccccuccuccaauacauucucugauaaucugaccuu

SEQ ID NO: 38842 - RNA, 64 nt, Homo Sapiens
ccugggugucacccccuuacuuuaauucuugggccuccaauaagugucccauaggugucuggcc

SEQ ID NO: 38843 - RNA, 64 nt, Homo Sapiens
agaaagguuccuguguauugcaagguacaauuuucuccaauaaaucaggagaacaggaguuuga

SEQ ID NO: 38844 - RNA, 64 nt, Homo Sapiens
uaaacacuugauacuuuucacugauaauggaucgcuccaauaaacauauauugugaaaaugcau

SEQ ID NO: 38845 - RNA, 64 nt, Homo Sapiens
cccugggcacagcagcggccgaggggauguccugcuccaauacccgcacugcucuggaguuugc

SEQ ID NO: 38846 - RNA, 64 nt, Homo Sapiens
cuugagguuaggaaacagguuaaaacucagagaacuccaauaauaaugguuuaaaaacaucagg

SEQ ID NO: 38847 - RNA, 64 nt, Homo Sapiens
cguuauuuuccaaaggauuuaacuauauuuacugcuccaauaucagcauauuuuguggcauuug

SEQ ID NO: 38848 - RNA, 64 nt, Homo Sapiens
gacagguauguguuuacgcaagaaauuaucuuuccuccaauaaaaauaaaaacggaguugauca

SEQ ID NO: 38849 - RNA, 64 nt, Homo Sapiens
uauuaaggcuguugcugccagguuuggucuccagcuccaauacuccuccuggaaaaugguguug

SEQ ID NO: 38850 - RNA, 64 nt, Homo Sapiens
cagcuuguauuugcaguauuucucacacgccucucuccaauagaccaucaguguauaaucucuc

SEQ ID NO: 38851 - RNA, 64 nt, Homo Sapiens
agguaguucugggcccagcguguggacuccaugccuccaauaaagcacugagaccuccacccac

SEQ ID NO: 38852 - RNA, 64 nt, Homo Sapiens
aggauggaauacauauguaucauuaaauaaauaucuccaauauuuucagucagauaaaccuaaa

SEQ ID NO: 38853 - RNA, 64 nt, Homo Sapiens
ugguuaaaaaaacuauacaauaauauuaugguaacuccaauauuucauucuacaugaacugagg

SEQ ID NO: 38854 - RNA, 64 nt, Homo Sapiens
ugcuuagcaggaagcauaaggaaaagccaucggccuccaauacccaugaugacagagggagcac

SEQ ID NO: 38855 - RNA, 64 nt, Homo Sapiens
cagaugagggcccugcccccgccccacugacuuccuccaauaaagucaugucugcccccaaccu

SEQ ID NO: 38856 - RNA, 64 nt, Homo Sapiens
aggcagcuucaugugcagcuugggaaucuaguugcuccaauauguccaguaagaaucacagugc

SEQ ID NO: 38857 - RNA, 64 nt, Homo Sapiens
cgugcuaggaagcaagcugcaagcuuaaccaaggcuccaauaaaggggcuccugauccgcaucc

SEQ ID NO: 38858 - RNA, 64 nt, Homo Sapiens
gcaaaccuaauugcacaacagauauaaacagcuucuccaauacaguuguuagcauuuucaaugu

SEQ ID NO: 38859 - RNA, 64 nt, Homo Sapiens
gagcaucucaagcuucuccugagugggcuuuagucuccaauaugucuaccucaaauagccccag

SEQ ID NO: 38860 - RNA, 64 nt, Homo Sapiens
cacccuguuaugucuugcuaaaauauuuuuagaacuccaauacuauguaacuucauuauuuuaa

SEQ ID NO: 38861 - RNA, 64 nt, Homo Sapiens
caagagcuuaucgauccugucuuaagagagcaagcuccaauauguuccauaguagagaaaacau

SEQ ID NO: 38862 - RNA, 64 nt, Homo Sapiens
ccccaaaugguuaauccaacaggacuaacaucuccuccaauaaaagaaacuaugauguggagaa

SEQ ID NO: 38863 - RNA, 64 nt, Homo Sapiens
ucuuaggaauuuugcaggaaagaagaggccuagucuccaauaaaggacacgguuguggauccag

SEQ ID NO: 38864 - RNA, 64 nt, Homo Sapiens
agguagcauuuuugcugaaaucgggccugucacucuccaauaaagguucuggcacuucaaugcc

SEQ ID NO: 38865 - RNA, 64 nt, Homo Sapiens
uaaauacaucacuguauaccgaucaggaaucuugcuccaauaaaggaacauaaagauuuuuuuu

SEQ ID NO: 38866 - RNA, 64 nt, Homo Sapiens
agcucaguggcccuaaggagucuagccagcuuggcuccaauaggcuggacccagcggcccagag

SEQ ID NO: 38867 - RNA, 64 nt, Homo Sapiens
aaugauucuaccuacaaccuccaaacaggucaugcuccaauaaagggcugcagaguuauaagcc

SEQ ID NO: 38868 - RNA, 64 nt, Homo Sapiens
cacauuggcaaagggagaacugguguagaacuuucuccaauagucgcggccccugauuucugca

SEQ ID NO: 38869 - RNA, 64 nt, Homo Sapiens
uauguuauugugugaugcaguuuuuugcuucugucuccaauauuaaaccauuuuccuaauacuu

SEQ ID NO: 38870 - RNA, 64 nt, Homo Sapiens
caucaccuugccacaguguccccggcuucuaagccuccaauaucacccugugagccucgcacag

SEQ ID NO: 38871 - RNA, 64 nt, Homo Sapiens
cacuguccucuaaugccccacccaguggggaagucuccaauaggucccccugcuuauaacagcc

SEQ ID NO: 38872 - RNA, 64 nt, Homo Sapiens
aaguguuuuaggaugaacuuuguuauaguuuuaacuccaauaaaguucaucaguuuaauugacu

SEQ ID NO: 38873 - RNA, 64 nt, Homo Sapiens
acacugguuuacacuuuaugccggaugugcuuuucuccaauaucagugcucgagacacagugaa

SEQ ID NO: 38874 - RNA, 64 nt, Homo Sapiens
agcgaucaguuguuccccuccuuccaaaaacagccuccaauaccacaaccugaaaagagccgaa

SEQ ID NO: 38875 - RNA, 64 nt, Homo Sapiens
aauaugaacucguauuggauggcucugccaucagcuccaauaucucuacaucugcuucuccugu

SEQ ID NO: 38876 - RNA, 64 nt, Homo Sapiens
accaggcccaacucagucuuuugccuucaguucucuccaauauuaguuggggauuaaaccaucc

SEQ ID NO: 38877 - RNA, 64 nt, Homo Sapiens
gcccagaagaauggucccagagaaagcagacuggcuccaauagauaucaggcagcaaucccaau

SEQ ID NO: 38878 - RNA, 64 nt, Homo Sapiens
cagcugucucacguuguuuauucugcguccccuucuccaauaaaacaagccaguugggcguggu

SEQ ID NO: 38879 - RNA, 64 nt, Homo Sapiens
ggaggauggcugcaaagaaguaugaggaaacuuucuccaauagaugagaauuuuccguaucuug

SEQ ID NO: 38880 - RNA, 64 nt, Homo Sapiens
uggggugucaaccuuacccaggugcuggggucuucuccaauaaaccuuaagaccucagggggcg

SEQ ID NO: 38881 - RNA, 64 nt, Homo Sapiens
gccgccuggccuugucucugccccaccaccacuucuccaauaaagugcccuugccugccuucac

SEQ ID NO: 38882 - RNA, 64 nt, Homo Sapiens
gaguacaugcacuugggcauccuucugcagaagucuccaauaugccuuccagugguuccccuca

SEQ ID NO: 38883 - RNA, 64 nt, Homo Sapiens
gucccggacgggaagcuggugaaagcuuccuuugcuccaauaagcuuugcaaucaaggccaaag

SEQ ID NO: 38884 - RNA, 64 nt, Homo Sapiens
acgugcucaguuuugccucuuuuuguccugccuucuccaauaucuauguccccauuugcuuugg

SEQ ID NO: 38885 - RNA, 64 nt, Homo Sapiens
aaaaaaaaaaagguuuguuauucgcuguuuuuaucuccaauaaauaggguaugguaugugggac

SEQ ID NO: 38886 - RNA, 64 nt, Homo Sapiens
gcaccuuguugaaagaccucucucacacuguacucuccaauaaacaucaccucuaucugccuca

SEQ ID NO: 38887 - RNA, 64 nt, Homo Sapiens
ucuauaguauaccaaccaccaaccagugugccaucuccaauauuuuaguuuuuuuuuuucuuuc

SEQ ID NO: 38888 - RNA, 64 nt, Homo Sapiens
uauguugggaagcacaugcuugcucuaggaauaucuccaauaaagcuguuaacuauuuggugga

SEQ ID NO: 38889 - RNA, 64 nt, Homo Sapiens
uucuucuauaccgauuucauaaggauaagugacucuccaauaggguuuccucucuuggagagcc

SEQ ID NO: 38890 - RNA, 64 nt, Homo Sapiens
cccccacuccucgcaggucuccauccauccccaacuccaauaaugcugaagcccaguuccuuuc

SEQ ID NO: 38891 - RNA, 64 nt, Homo Sapiens
guguuuuaaguuuuccuaugaauuuucuagauuacuccaauaaacaaagauguaacaauuuuaa

SEQ ID NO: 38892 - RNA, 64 nt, Homo Sapiens
agugguguagugccgaaaguuguuuuuuuucuuccuccaauaaagggaacugugcccaguauac

SEQ ID NO: 38893 - RNA, 64 nt, Homo Sapiens
ggccagaugcuuuugaaugagugugaguugauuccuccaauauguaugaucuccuugcaacuca

SEQ ID NO: 38894 - RNA, 64 nt, Homo Sapiens
acuauuaaaacugucaccucaggucacuaagcgucuccaauauggggagcaacccauggcucac

SEQ ID NO: 38895 - RNA, 64 nt, Homo Sapiens
ccagaaaaguggcucucuuugguagggagaggggcuccaauauuucguucucuccccauggggc

SEQ ID NO: 38896 - RNA, 64 nt, Homo Sapiens
cuccccucaggcuuuuuuugggugguccuccaaccuccaauacccaggccuggccucuucagag

SEQ ID NO: 38897 - RNA, 64 nt, Homo Sapiens
ggggaaccuuccuuauccccugcccacauccccucuccaauaaagcaccugugcccucagcaau

SEQ ID NO: 38898 - RNA, 53 nt, Homo Sapiens
aggaaaaaagaugcuuauuucuucuccaauaccaagucaaggaagaacuuuag

SEQ ID NO: 38899 - RNA, 64 nt, Homo Sapiens
cccuuguugccuucucccuuuuccauacuauuuccuccaauagauucacugaagauauuccaau

SEQ ID NO: 38900 - RNA, 64 nt, Homo Sapiens
ugggaagcuuugcugaaaaagggauaaaaugaggcuccaauacacuuuuaaaguucauggguga

SEQ ID NO: 38901 - RNA, 64 nt, Homo Sapiens
cuuuuuuaugcuuuugcggacaccggcugugaugcuccaauaaacgacucagcaauacccgccc

SEQ ID NO: 38902 - RNA, 64 nt, Homo Sapiens
ccauauugaaagagucagcagucagugcaagagacuccaauaaugccaaacuccucugagaaca

SEQ ID NO: 38903 - RNA, 64 nt, Homo Sapiens
auauuugaccucaggcaccuguuucccccaccuacuccaauauuugcuggaggagcaaaugacc

SEQ ID NO: 38904 - RNA, 64 nt, Homo Sapiens
cuccuccacuggguucagaggguaagaaagcacccuccaauaaacccaggcuccaggccguggg

SEQ ID NO: 38905 - RNA, 64 nt, Homo Sapiens
ggggcaugaaugguuaacaaacaccagagcaguacuccaauauuggagagucgcugggggcaca

SEQ ID NO: 38906 - RNA, 64 nt, Homo Sapiens
agucacuacuauaguggcuuaacauuuaaucugucuccaauauuuuaaccaagugacaccgagg

SEQ ID NO: 38907 - RNA, 64 nt, Homo Sapiens
uauggaagugaguggacagccuuuguguguaucucuccaauaaagcucugugggccaaguccuc

SEQ ID NO: 38908 - RNA, 64 nt, Homo Sapiens
uuuuuuaucucuuuuguucucaggcaauaaauuccuccaauaauaacguuuauagacauggagg

SEQ ID NO: 38909 - RNA, 64 nt, Homo Sapiens
gacugucccagacuuuggccuaugacauuccaagcuccaauaaacucugaugagggcgaauugc

SEQ ID NO: 38910 - RNA, 64 nt, Homo Sapiens
ccugauucugcugcccagacccuacccccaaucccuccaauaaaaagccccaugccgugcucau

SEQ ID NO: 38911 - RNA, 64 nt, Homo Sapiens
ugagucagaauuaaaggagggaauuguauugauacuccaauaccuaaauuucacaauaccacuu

SEQ ID NO: 38912 - RNA, 64 nt, Homo Sapiens
aagcacucuucuaccaauguuugggugaccaccccuccaauaucccagaaugaauaagaacaau

SEQ ID NO: 38913 - RNA, 64 nt, Homo Sapiens
uuuuuaaggcaaagcaagcuccccaaucccuguucuccaauauguguaugaugugacuuccaug

SEQ ID NO: 38914 - RNA, 64 nt, Homo Sapiens
uccagucuuggccaucaaaucaaugauuuaaugacuccaauaauguguguguuuauaaccaucc

SEQ ID NO: 38915 - RNA, 64 nt, Homo Sapiens
gcagguuucccuguauaacgguuacccccuaagucuccaauauuggcaaccccuggauaugaau

SEQ ID NO: 38916 - RNA, 64 nt, Homo Sapiens
cgccaggucgguccucccugccaaccuuccccagcuccaauauguagcagucucucuggauggc

SEQ ID NO: 38917 - RNA, 64 nt, Homo Sapiens
uacuggugccugaaacaccuggccugcuaggaggcuccaauaaagcuaacccggaccagaccug

SEQ ID NO: 38918 - RNA, 64 nt, Homo Sapiens
gguaaaacaaaaagaaaaaaaaaaguucauacuucuccaauaaauaaagucucaccuguguccc

SEQ ID NO: 38919 - RNA, 64 nt, Homo Sapiens
cauuuugauuuuagguucuguuuuuuguacaacacuccaauaaauacauuuuaugacuggaaac

SEQ ID NO: 38920 - RNA, 64 nt, Homo Sapiens
gacagcauggaaacaaagucugccagccacagaccuccaauaaaggagccacccccaaggaccc

SEQ ID NO: 38921 - RNA, 64 nt, Homo Sapiens
uuucacugaacugaaccuggugacuuuuuucauucuccaauaaauacacuaaacaggugaaugc

SEQ ID NO: 38922 - RNA, 64 nt, Homo Sapiens
cugccccucuuggcccccagucaacugugagccacuccaauacccccucuauauccccaagccc

SEQ ID NO: 38923 - RNA, 64 nt, Homo Sapiens
cugugguguauucugcguguccauggcggggguucuccaauacacucacacuguccauguucuu

SEQ ID NO: 38924 - RNA, 64 nt, Homo Sapiens
uggcuaagauaccaaaaccacagugccgacagcucuccaauacucagguuaaugcugaaaaauc

SEQ ID NO: 38925 - RNA, 64 nt, Homo Sapiens
gcagcguggacaucugucccagagggggcagaaucuccaauagaggacugagcacugcuucugg

SEQ ID NO: 38926 - RNA, 64 nt, Homo Sapiens
uuacgagaaccucuucccccaauaguagacacaucuccaauacaaacacagguuuauaauaagu

SEQ ID NO: 38927 - RNA, 64 nt, Homo Sapiens
ggcucacaggcugugccacccgucccuccgacagcuccaauacugugacccuccuuccucagga

SEQ ID NO: 38928 - RNA, 64 nt, Homo Sapiens
ccaucucccagacccucuucccuuugcccuucuccuccaauacauaaaggacacagacaaggaa

SEQ ID NO: 38929 - RNA, 64 nt, Homo Sapiens
cugugaagccaaacaauaugcuccugccuugcaccuccaauagguuuuauuauuuuuuuuaaau

SEQ ID NO: 38930 - RNA, 64 nt, Homo Sapiens
ugcauccuuguccuugcaggugcuuuuuuagaugcuccaauaugucuucuuuuguuauuuucuu

SEQ ID NO: 38931 - RNA, 64 nt, Homo Sapiens
aacaagcuaguuguucugcccugaaacagaacagcuccaauagccauguaccuuauaucccucu

SEQ ID NO: 38932 - RNA, 64 nt, Homo Sapiens
uaauugcauuuuaaauuggcuccaaaauuuaagucuccaauaauggggaugaggcuuggcauag

SEQ ID NO: 38933 - RNA, 64 nt, Homo Sapiens
ugaaauucugacuucucuccauuuuaucguuugacuccaauaccugaguguugccaccaacagg

SEQ ID NO: 38934 - RNA, 64 nt, Homo Sapiens
uuguguuuuuuuuuuuauugaccaagacauacaucugauuuaccuggcugucuacagacauuug

SEQ ID NO: 38935 - RNA, 64 nt, Homo Sapiens
auugccauaaaguagacuggccaaaucuuuaccacugauuuaccuaucugccuuuuuaucuuug

SEQ ID NO: 38936 - RNA, 64 nt, Homo Sapiens
uauuguacaagagcccaaguugcauuauuuugaccugauuuauuauaugaucuucuaaggaggu

SEQ ID NO: 38937 - RNA, 64 nt, Homo Sapiens
auauuuaagcugcuuaacuucacugagacggugccugauuuaaucauucuuauaguuuguuugu

SEQ ID NO: 38938 - RNA, 64 nt, Homo Sapiens
ucccagaggucauuugauuaccuaauuuacugaacugauuuagcagggaauggaauccauucca

SEQ ID NO: 38939 - RNA, 64 nt, Homo Sapiens
gggaugccucuggcuggugaaguucucacauaggcugauuuaaauccagcaaaggucuauagaa

SEQ ID NO: 38940 - RNA, 64 nt, Homo Sapiens
aguuuuuauucaauguauauaagacagguagugccugauuuacuacuuuauauaaaauaguacc

SEQ ID NO: 38941 - RNA, 64 nt, Homo Sapiens
uuauauaaaauaguaccuccuucaguuacuguuucugauuuaauguacggaacuuuauuuguug

SEQ ID NO: 38942 - RNA, 64 nt, Homo Sapiens
uaaugcuuggaauaaaaacucuuaaggcaacucacugauuuacuucuagcaauagcaugauguu

SEQ ID NO: 38943 - RNA, 64 nt, Homo Sapiens
uauuaucagaauuucugaaaccuuuacaaaaauucugauuuauuccauuaauggccgguuaaac

SEQ ID NO: 38944 - RNA, 64 nt, Homo Sapiens
cuuacuuugugucuaggaacaauggauuuuguaucugauuuaaaaugccaacacuguuuugucu

SEQ ID NO: 38945 - RNA, 64 nt, Homo Sapiens
aacaaaacuguuugucucugagcuaggaauaccacugauuuagaugcaguauucuaaacauuuc

SEQ ID NO: 38946 - RNA, 64 nt, Homo Sapiens
gauugcuaauuaaauggcuaauuucuauaccucucugauuuacaaaauacaguuuagcugcuga

SEQ ID NO: 38947 - RNA, 64 nt, Homo Sapiens
caccccagcaauuaugaaaauaaucucugauucccugauuuaauaugcaaagucuagguuggua

SEQ ID NO: 38948 - RNA, 64 nt, Homo Sapiens
augcaguacaggacauauauuuuuuaaaauaagucugauuuaauugggcacuauuuauuuacaa

SEQ ID NO: 38949 - RNA, 64 nt, Homo Sapiens
aaccuacaauuuucccuugauaaccauauaaauucugauuuaagguccuaaauucuuaaccugg

SEQ ID NO: 38950 - RNA, 64 nt, Homo Sapiens
aacacauucauuuggauaaguugugauuugacgacugauuuaaauaaaauauuugcuucacuua

SEQ ID NO: 38951 - RNA, 64 nt, Homo Sapiens
ucacaaaauaguaaccaggagauguuuaaugugccugauuuaauguuuuuaauaaucacagcaa

SEQ ID NO: 38952 - RNA, 64 nt, Homo Sapiens
cugcacccagccuacuucacucuucugaauuauucugauuuauuuucaacaacuuuugugaacu

SEQ ID NO: 38953 - RNA, 64 nt, Homo Sapiens
acuuaugcauagauauaucuaugguauaugcaugcugauuuaccuguuaauacuauauugcugu

SEQ ID NO: 38954 - RNA, 64 nt, Homo Sapiens
acuuaugcguaagugguaugaugguauauguaugcugauuuacuuguuaauacuguauugcugu

SEQ ID NO: 38955 - RNA, 64 nt, Homo Sapiens
acuaugucuuauuuaucagaaaaaaaaaaaaacccugauuuauuagaaauggguaaaaaaaaaa

SEQ ID NO: 38956 - RNA, 64 nt, Homo Sapiens
gugaauuugcccaaucuuugucaacucaagaugucugauuuacuguugaaggagaaucaauucu

SEQ ID NO: 38957 - RNA, 64 nt, Homo Sapiens
aaaguaaguuuuuaaacacugauauucauuuauacugauuuaugcuuaaacauaauauauaaug

SEQ ID NO: 38958 - RNA, 64 nt, Homo Sapiens
aguaaaguucuccaauucuuucuucauuuagcugcugauuuaaauuuuuagaaaggaaaaguuu

SEQ ID NO: 38959 - RNA, 64 nt, Homo Sapiens
ucaccauccaauuaucuaccaucuacucaaauaucugauuuaucaaguaaugguacaguuaccc

SEQ ID NO: 38960 - RNA, 64 nt, Homo Sapiens
uagguuuugucaagcuaucuugauugauagguggcugauuuauuagaaguucaacucauaaacg

SEQ ID NO: 38961 - RNA, 64 nt, Homo Sapiens
uuaauucaaauugacagagauugauaaaaagaaacugauuuaccuaaguuuacuuuuuaauugc

SEQ ID NO: 38962 - RNA, 64 nt, Homo Sapiens
uagaaagcuuguauaauucagauuuaucaauuuccugauuuaauguagacuuugacuuuuuuau

SEQ ID NO: 38963 - RNA, 64 nt, Homo Sapiens
uuauaaaccagccacuucugaauacaauauguagcugauuuaauaagcuaguuagugaauggaa

SEQ ID NO: 38964 - RNA, 64 nt, Homo Sapiens
gauuggaggagggacaguuucugguacccauccucugauuuauacauaugcauuuuuuccccuc

SEQ ID NO: 38965 - RNA, 64 nt, Homo Sapiens
ccaacauaacaaucgugguaacagaaugcgacugcugauuuaccgauguauuuaauguaaguaa

SEQ ID NO: 38966 - RNA, 64 nt, Homo Sapiens
cuagccaaacuguaagaaacccaucacugauuuacugauuuaaggugggcaaaucaggaacaaa

SEQ ID NO: 38967 - RNA, 64 nt, Homo Sapiens
gauuuaagcuagccaaacugggaacaaaccaucacugauuuacucugaaauagugggcaaauca

SEQ ID NO: 38968 - RNA, 64 nt, Homo Sapiens
auuuuucuuuuaaguaaauuuuuuuuaaaaaauucugauuuagggcuaggugugguggcucagg

SEQ ID NO: 38969 - RNA, 64 nt, Homo Sapiens
cauagcgagaccccuaucuguauuaaaaaaaaaucugauuuaauucuuuuauuuaucauaaggg

SEQ ID NO: 38970 - RNA, 64 nt, Homo Sapiens
gcaagauauauugugucuaugauuuaaaccgucucugauuuaauauauuagaaguuacaagacu

SEQ ID NO: 38971 - RNA, 64 nt, Homo Sapiens
ccgucucugauuuaaugcaauagaaguuacaagacugauuuaaauaguugccagcccagaauau

SEQ ID NO: 38972 - RNA, 64 nt, Homo Sapiens
acuauaacugaacacaauguguauucauaguauacugauuuaauuucuaaguguaagugaauua

SEQ ID NO: 38973 - RNA, 64 nt, Homo Sapiens
acuuuuguaaucagaauuuuuagaaaguauuuugcugauuuaaaggcuuaggcauguucaaacg

SEQ ID NO: 38974 - RNA, 63 nt, Homo Sapiens
aucacgaaaauaauaauaauaaaucuuuaacauacuaccuaaagggaaccugcaauaaucuug

SEQ ID NO: 38975 - RNA, 63 nt, Homo Sapiens
aaagaaagaaagaaaccuccagcguauuuuaucacuaccuauagaaagaaauccugcuuugag

SEQ ID NO: 38976 - RNA, 64 nt, Homo Sapiens
cuuaccccccugggacagcuguuaccuuugcaguguugccgaaucacagcaguuaccuuugcag

SEQ ID NO: 38977 - RNA, 64 nt, Homo Sapiens
aguguugccgaaucacagcaguuaccuuugcaguguugccgaaucacagcaguucuguuggaga

SEQ ID NO: 38978 - RNA, 64 nt, Homo Sapiens
auggaugucccugaaugaaaaguccuggggaucagaauuccaaaaaaacaacacauuagcuuau

SEQ ID NO: 38979 - RNA, 64 nt, Homo Sapiens
cuggauacagucaugacagcacauugaaaaugaugaauuccaauggacucauucuaagggcaag

SEQ ID NO: 38980 - RNA, 64 nt, Homo Sapiens
uucuguccacuuccucaccaccagcaauguaugagaauuccaauugaaccauuccacauuccca

SEQ ID NO: 38981 - RNA, 64 nt, Homo Sapiens
ugcaauucacucuggcgaccgcaaaguucuucuagaauuccacacaaaucccauaggauggcaa

SEQ ID NO: 38982 - RNA, 64 nt, Homo Sapiens
uauucuguuuagaguacuuuguuuuaaaauguaagaauuccauuauccuuuauauuaagaaaau

SEQ ID NO: 38983 - RNA, 64 nt, Homo Sapiens
ccagccuaugcaacaucaugucacuugagcccuggaauuccauguggaagcugaggugagagga

SEQ ID NO: 38984 - RNA, 64 nt, Homo Sapiens
gggaccagggccaccgcaggcuccugcugugcuggaauuccacaaggccugcuucccccucccc

SEQ ID NO: 38985 - RNA, 64 nt, Homo Sapiens
cguccaagggacagcccacguccuuccuggggacgaauuccacugucugcucauaggaccugca

SEQ ID NO: 38986 - RNA, 64 nt, Homo Sapiens
guaaaaagaauauaauaccuguggaaauaaaaaugaauuccaaguguauacuugcucgggugau

SEQ ID NO: 38987 - RNA, 64 nt, Homo Sapiens
acaaaaauaaaaagcaaaacaaaaaucccaaaaugaauuccauucacaaacagaauuuuucaau

SEQ ID NO: 38988 - RNA, 64 nt, Homo Sapiens
uuagacccaaacaugcuuuucuguuccccugaacuaauuugagaacauaaauuuucagcuauuu

SEQ ID NO: 38989 - RNA, 64 nt, Homo Sapiens
auauacauguauguauauacucuuuauauguauauaauuugaauauaucuugaaucuacaaaua

SEQ ID NO: 38990 - RNA, 64 nt, Homo Sapiens
auggaacaggaaacuagagugcaggaugauuguuuaauuugaagaaaaaaguuuucuagaauaa

SEQ ID NO: 38991 - RNA, 64 nt, Homo Sapiens
aauaaaaccagaggaaaugcuuuaaguauuuucuuaauuugaaucaagcuguuaccaaaaaauu

SEQ ID NO: 38992 - RNA, 64 nt, Homo Sapiens
cuaaagagcacuuacuguaaccuguugcuguguuuaauuugacuucucugccuuugacauuuaa

SEQ ID NO: 38993 - RNA, 64 nt, Homo Sapiens
aaagcauugcuuuuauuuugaaaagcuucuuaauuaauuugauuaacaaauaugcuaauuuggg

SEQ ID NO: 38994 - RNA, 64 nt, Homo Sapiens
cucaguuuuagggucuaagugcgugucauuuaaguaauuugauguagaaauggcaaauuuguaa

SEQ ID NO: 38995 - RNA, 64 nt, Homo Sapiens
gaaaaaugcauccuaaccauaguuuuuaaugcuuuaauuugaaacacagaugcuauuuuuucuc

SEQ ID NO: 38996 - RNA, 64 nt, Homo Sapiens
uuucccaaauuaagucuuauguuucucccuguuguaauuugagacaaguacacauccugauuug

SEQ ID NO: 38997 - RNA, 64 nt, Homo Sapiens
caaaacuacuacuauagggauauuuuucaaaaauuaauuugaacauacuguuccauacaaaagc

SEQ ID NO: 38998 - RNA, 64 nt, Homo Sapiens
cugauguaugggacagcguagaaacugaaacuaauaauuugaucaucuuaaauuccuacaaugu

SEQ ID NO: 38999 - RNA, 64 nt, Homo Sapiens
gagccucuaaacuuuugagauugucucucauuauuaauuugaaacaggaaccuaacagauuauu

SEQ ID NO: 39000 - RNA, 64 nt, Homo Sapiens
ugauaugauuguuucauuuauauacuuugguccauaauuugauuaguagccagguuaaauuuuc

SEQ ID NO: 39001 - RNA, 64 nt, Homo Sapiens
acuuagguuucaggaaguugccaugggaaacaaauaauuugaacuuuggaacaggguuggcauu

SEQ ID NO: 39002 - RNA, 64 nt, Homo Sapiens
guuuugguggaaaaaacauuuuaaguuuuacugauaauuugagguuagaugggaggaugaauug

SEQ ID NO: 39003 - RNA, 64 nt, Homo Sapiens
aaauugaacuagcuaccauauaagcagauugcuuuaauuugaugggaaaauaguacacacauau

SEQ ID NO: 39004 - RNA, 64 nt, Homo Sapiens
ucaagagucucucuucacuuccuucuaaagagacuaauuugagaguacaggugcauauuaauuu

SEQ ID NO: 39005 - RNA, 64 nt, Homo Sapiens
cacacacacacacacacacacacauacacacauauaauuugaaagaggugaguauguacucuga

SEQ ID NO: 39006 - RNA, 64 nt, Homo Sapiens
ugaaggugauaacugacacguguucacugaauuuuaauuugauaggcaauacaucuacccacuc

SEQ ID NO: 39007 - RNA, 64 nt, Homo Sapiens
uauuuucuuuguuaaaauagacuuguauaccuuguaauuugaaauucacuucaaaacaguauug

SEQ ID NO: 39008 - RNA, 64 nt, Homo Sapiens
agaaaauuuaaaacauuacuauacaaaggcuuauuaauuugacuccaaaggaggauggcauaua

SEQ ID NO: 39009 - RNA, 64 nt, Homo Sapiens
cuuuuuucuuuuggagggacaagaugaaaauauauaauuugaauugauuaaaauuggucguuac

SEQ ID NO: 39010 - RNA, 64 nt, Homo Sapiens
caaacuuuaggaacuuuuccagauguaucgaauuuaauuugacauugaugucacucuucauacc

SEQ ID NO: 39011 - RNA, 64 nt, Homo Sapiens
cuuguuaaugucuaaacuuuaaaaucaguacauuuaauuugaguuccaacuguuaagcauauuu

SEQ ID NO: 39012 - RNA, 64 nt, Homo Sapiens
aaaaagaaucuccauuuucugaaggucuguuaguuaauuugagauaauuuguuaaaggcaagua

SEQ ID NO: 39013 - RNA, 64 nt, Homo Sapiens
uauugaguucuaauguuacaucugaggaaguauguaauuugagaauuguaacuucuaagggauu

SEQ ID NO: 39014 - RNA, 64 nt, Homo Sapiens
uaagcaaguuguaauguacagaugcuuuucuugguaauuugauagugauccuaacaauuggcau

SEQ ID NO: 39015 - RNA, 64 nt, Homo Sapiens
auugucacguacaacuuucuaaaccuaaguguauuaauuugaugaggauaaaucagacuauaca

SEQ ID NO: 39016 - RNA, 64 nt, Homo Sapiens
auagacacaaugcacuuuaucuuuucaaaucuaguaauuugaauuuaucaggaaagcuaaagaa

SEQ ID NO: 39017 - RNA, 64 nt, Homo Sapiens
ugcuguggucuccuugguaagggcaaucccuuuauaauuugaugggagauggggaucugguuua

SEQ ID NO: 39018 - RNA, 64 nt, Homo Sapiens
gcagcaauuugcuguucucauuuuuaggcugaauuaauuugaaaaauaaaauaacaucaauaga

SEQ ID NO: 39019 - RNA, 64 nt, Homo Sapiens
ucuuuaauuccuuauugaauaacacaagugugauuaauuugauuugaccuauucuuauuuaguu

SEQ ID NO: 39020 - RNA, 64 nt, Homo Sapiens
aaaauauuacccaguaacauaguguugggaauuauaauuugagacuuuugucacagguaaaauc

SEQ ID NO: 39021 - RNA, 64 nt, Homo Sapiens
acacuacaucguagggugacuguauacaucuguuuaauuugaacacuacacuaauuauuuuaac

SEQ ID NO: 39022 - RNA, 64 nt, Homo Sapiens
aguauaucuauaugaucuugauauuguuuuauaauaauuugaagucuaaaagacugcauuuuua

SEQ ID NO: 39023 - RNA, 64 nt, Homo Sapiens
gucaaaccuaagcauauuugaauaugaucucccauaauuugaaauugaaaucguauuguguggc

SEQ ID NO: 39024 - RNA, 64 nt, Homo Sapiens
cacauagcacugcucauuuuacuuuuauuuuguguaauuugaugacacugucuaucaaaaaaga

SEQ ID NO: 39025 - RNA, 64 nt, Homo Sapiens
uuaaaaguuuuccacauaaugaaaguccuucugauaauuugacaaauagcuauaauaggaacac

SEQ ID NO: 39026 - RNA, 64 nt, Homo Sapiens
auucuuuaacagauugcagcacaucccuguaauuuaauuugaagguguuugaguuaaaaaccaa

SEQ ID NO: 39027 - RNA, 64 nt, Homo Sapiens
uugaaacauuaauuuuugaguucuugaaguucuuuaauuugaaagauacuauauucuuugaaaa

SEQ ID NO: 39028 - RNA, 64 nt, Homo Sapiens
cacagaagaauauucuuaaauuaaaaagugaauauaauuugaggauauauauauauauguauau

SEQ ID NO: 39029 - RNA, 64 nt, Homo Sapiens
uuuacauaaaauagaaauuuucaugcacaauccauaauuugagucauuuucaugacagauacau

SEQ ID NO: 39030 - RNA, 64 nt, Homo Sapiens
auaaaauaaguauuuauuuaaacuaauguucucuuaauuugaccauugcagauuugggugacuu

SEQ ID NO: 39031 - RNA, 64 nt, Homo Sapiens
ugauacgauaauauuacucuugauugcugcugcuuaauuugauguaauauguuuaaaguucagc

SEQ ID NO: 39032 - RNA, 64 nt, Homo Sapiens
guauagagcaguaacacaguccuacucuucuaaauaauuugaaacauuugcuaguuagaauauc

SEQ ID NO: 39033 - RNA, 64 nt, Homo Sapiens
guugaguaucagcauaauuucuuucacuucaagauaauuugacaaucucuuugcuauuguaaau

SEQ ID NO: 39034 - RNA, 64 nt, Homo Sapiens
guuuuuuaauuaaaauauaaucacugaaguuuacuaauuugauuuuauaagguuuguagcauua

SEQ ID NO: 39035 - RNA, 64 nt, Homo Sapiens
aauuauguucuuuuucccccuuuauggucuuaacuaauuugaauccuucaagaaggauuuuucc

SEQ ID NO: 39036 - RNA, 64 nt, Homo Sapiens
auuuauuuauaugacguuuggaaauuccaguaguuaauuugaacuuuaccuuauuuaucuguau

SEQ ID NO: 39037 - RNA, 64 nt, Homo Sapiens
agggccaaaacaaaguugguagagauacucuugauaauuugaauagaaacaaaaucauggauca

SEQ ID NO: 39038 - RNA, 64 nt, Homo Sapiens
guagaaaauucacaaaucuguucauuuaauuuuuuaauuugagaauuuuuauuucuuuugacug

SEQ ID NO: 39039 - RNA, 64 nt, Homo Sapiens
uucugucagacauuuaccaacuauuuucuaaaacuaauuugacaaaucaugacacuagaaaacg

SEQ ID NO: 39040 - RNA, 64 nt, Homo Sapiens
cauccuagggugcuuuuuuguuuguguguguguguaauuugagugauuguaaauggcauugaug

SEQ ID NO: 39041 - RNA, 64 nt, Homo Sapiens
uuccuauagguuacuucaccuuuuuuuuuuuuaauaauuugauuugauacauauguaguguuuu

SEQ ID NO: 39042 - RNA, 64 nt, Homo Sapiens
uuguuaauuagaauguuguuaaaacagcuuuaaauaauuugaacauggacgcaaaugacagaua

SEQ ID NO: 39043 - RNA, 64 nt, Homo Sapiens
ucaacuuaauuuaagccaccauccuaaccaaauuuaauuugaauuguuuucaguccauuaaaaa

SEQ ID NO: 39044 - RNA, 64 nt, Homo Sapiens
uuacuucuguuuggcuaguuaaguaaaagugacuuaauuugaaacaauaaugaguaauagcaca

SEQ ID NO: 39045 - RNA, 64 nt, Homo Sapiens
aaaucuauagucaaaguuugaggcuguuuagcacuaauuugaccgaauaauaauguuguuaaag

SEQ ID NO: 39046 - RNA, 64 nt, Homo Sapiens
caacaaaaccugauucuggucuucuuuaccaauauaaucauaauguaaauaauaauuuguauau

SEQ ID NO: 39047 - RNA, 64 nt, Homo Sapiens
aaagauuaacguuauugauacuuggauaacuggcuaaucauauuaaaggacuaugugguuccag

SEQ ID NO: 39048 - RNA, 64 nt, Homo Sapiens
cuugcacuaucacccaggcuggagugcaguggcauaaucauaccucauugcagccucagacucc

SEQ ID NO: 39049 - RNA, 64 nt, Homo Sapiens
ugcuaaauguuagucauugagguggggccaauuuuaaucauaagccuuaauaagauuuuucuaa

SEQ ID NO: 39050 - RNA, 64 nt, Homo Sapiens
ggaacuuacgcaacacaccacugaguccucuaacuaaucauaugugcucagacacagcucaagc

SEQ ID NO: 39051 - RNA, 64 nt, Homo Sapiens
gcaaauagaaauuuauaagcauuuuacuacaaguuaaucauauccuucaguagcuuauuucuuc

SEQ ID NO: 39052 - RNA, 64 nt, Homo Sapiens
uccugaaucuaaagaaagacaacaugcugcuuuuuaaucauaggauggagaauuuuaaagaacu

SEQ ID NO: 39053 - RNA, 64 nt, Homo Sapiens
auugccacucaaugcuggaauauuuugggucaccuaaucauagauuucucagggcaucaauacu

SEQ ID NO: 39054 - RNA, 60 nt, Homo Sapiens
aguucgggagccacggaugacccuggacacucaagccaaaguuaggccacaccaggccca

SEQ ID NO: 39055 - RNA, 64 nt, Homo Sapiens
aaguuaggccacaccaggcccaacccugugcuggucaagccagggcagucacagcugcuugggg

SEQ ID NO: 39056 - RNA, 64 nt, Homo Sapiens
uuguuuguuaggcagugcuagagcuugaagccacucaagccaguuggggaggaaagggaugcgg

SEQ ID NO: 39057 - RNA, 64 nt, Homo Sapiens
uuagccccuuagcacauguuccuaagguguguugucaagccaaccugaauucugccucccuguu

SEQ ID NO: 39058 - RNA, 64 nt, Homo Sapiens
cggcggcagcauggagcuaugguguaauggagcaucaagccacuggaagguuggauccaaggag

SEQ ID NO: 39059 - RNA, 64 nt, Homo Sapiens
ccaaaguucaacuuggugacgcuccagggaugauucaagccauuccugacugcccggcacagau

SEQ ID NO: 39060 - RNA, 64 nt, Homo Sapiens
uuguagcguguggcugggccaggccccagcgggaggggcugagcuggggcugugugcuugcuag

SEQ ID NO: 39061 - RNA, 64 nt, Homo Sapiens
ucacugaggcaacaugaagcccgaggcccagaugggggcugaacagguagggcacaucaguuaa

SEQ ID NO: 39062 - RNA, 64 nt, Homo Sapiens
ucacagguguuuacugugcuccuggggcccugguggggcugaugggucccuggaguccccagca

SEQ ID NO: 39063 - RNA, 64 nt, Homo Sapiens
gggggguucugugagggagagggaggcucucccaggggcugauggccacccucauccccugccu

SEQ ID NO: 39064 - RNA, 57 nt, Homo Sapiens
ggauccucacagucaagugacgaggcuggggcugaaagcagaagcaugcacagggag

SEQ ID NO: 39065 - RNA, 64 nt, Homo Sapiens
acuuuuauugcuugucuggguggauggggcaggaggggcugagggccugucccagacaauaaag

SEQ ID NO: 39066 - RNA, 64 nt, Homo Sapiens
auucauuuuauacaaagcccuccagccuguuuguggggcugaaaccccaucccuaaaauauugc

SEQ ID NO: 39067 - RNA, 64 nt, Homo Sapiens
auuggagaaucuuaagaaaugcaagcuuguucagggggcugagaagauccugaguacacuaggu

SEQ ID NO: 39068 - RNA, 64 nt, Homo Sapiens
uggucuuucacugcaggcccucacauggucagaaggggcugagcuggggcugaaguuucugggg

SEQ ID NO: 39069 - RNA, 64 nt, Homo Sapiens
uuucuggggucacauggucaacaaccuuucugcuggggcugaagcagugccuuccuccagccuc

SEQ ID NO: 39070 - RNA, 64 nt, Homo Sapiens
gcugccccugcguggccugaggggcugacgauggggggcugaugaggucuccccauccccauuc

SEQ ID NO: 39071 - RNA, 64 nt, Homo Sapiens
auggggggcugauggcugccccccauccccauucggggcugacgucacacucagaaagaggucu

SEQ ID NO: 39072 - RNA, 64 nt, Homo Sapiens
gcccuggggucacagacauggaagggaccacccuggggcugacugcuuuucugugcuguugguu

SEQ ID NO: 39073 - RNA, 64 nt, Homo Sapiens
ucucuugucccuuauagguaccuuggaggggccaggggcugaggaaggccggacccagguucca

SEQ ID NO: 39074 - RNA, 64 nt, Homo Sapiens
ccuauuacggccugagucuggaugugucggggcuggggcugaacguguaccagacacagcuguu

SEQ ID NO: 39075 - RNA, 64 nt, Homo Sapiens
aguuguacccuacggugcucagacagacagggauggggcugacugcacuggugggccggcuggg

SEQ ID NO: 39076 - RNA, 64 nt, Homo Sapiens
ggcuguagggaccaccagccuugugcccgcucuuggggcugaccugugguacccaggccacacg

SEQ ID NO: 39077 - RNA, 64 nt, Homo Sapiens
guaugggcucugggcaucccgaugugccgaugauggggcugacagaccccggaggcugucggug

SEQ ID NO: 39078 - RNA, 64 nt, Homo Sapiens
uagaccaguuugcaugauucugcagagugauucgggggcugaccaagcuucgucuuguguuugc

SEQ ID NO: 39079 - RNA, 64 nt, Homo Sapiens
gaguauaaauaacccugggcaguccgggggacuuggggcugagacaaucagccuuuaggucuuu

SEQ ID NO: 39080 - RNA, 64 nt, Homo Sapiens
ccucaaauccggcugaggcacggagggucccagaggggcugagucaugacucacccauggcagg

SEQ ID NO: 39081 - RNA, 64 nt, Homo Sapiens
ccugcaggggaagcccugguaggacuuuugagcuggggcugacuagccuguggcuuugcccacc

SEQ ID NO: 39082 - RNA, 64 nt, Homo Sapiens
cauggccuuuuucaggggguuggcccagggcagaggggcugauaagagcucccacuacaugcag

SEQ ID NO: 39083 - RNA, 64 nt, Homo Sapiens
ccucgaguggccagaauaugauaggcccggagauggggcugacagcuuugaggagaggguaaac

SEQ ID NO: 39084 - RNA, 64 nt, Homo Sapiens
gugccugagacacucaccucucugccucgcaguuggggcugaggcuggggcuggcugccagccu

SEQ ID NO: 39085 - RNA, 64 nt, Homo Sapiens
ugcuggggcucaggcuguggggcaggcugggcagggggcugagcuggcagcgauucagagcccu

SEQ ID NO: 39086 - RNA, 64 nt, Homo Sapiens
cugcccacugcagugccaagacggcagcaggacuggggcugauagcccaccccgcccccacugc

SEQ ID NO: 39087 - RNA, 64 nt, Homo Sapiens
cacugcagcucccacaaagcacucuaagggagauggggcugaggacagcucaaaaaggagagga

SEQ ID NO: 39088 - RNA, 64 nt, Homo Sapiens
ucccucccagccucaaccacaauucuuccaugcuggggcugaugugggcuaguaagacuccagu

SEQ ID NO: 39089 - RNA, 64 nt, Homo Sapiens
gagaauuuguagaucauucucacuucaaauuccuggggcugauacuucucucaucuugcacccc

SEQ ID NO: 39090 - RNA, 64 nt, Homo Sapiens
cacgcucucguuuugucaggccgcgcagggccguggggcugagccacaggggcuuccagggagg

SEQ ID NO: 39091 - RNA, 64 nt, Homo Sapiens
cagaucugggucugccgcaacucccugcacccucggggcugaguugucuggcggagaaagccag

SEQ ID NO: 39092 - RNA, 64 nt, Homo Sapiens
ccugaguccuucuggacucuuccaucucgacccuggggcugagguuggauaggagagcugggac

SEQ ID NO: 39093 - RNA, 64 nt, Homo Sapiens
augagggcaccgacugugaacgcacggauggugaggggcugagaggcugcugggccccaggugg

SEQ ID NO: 39094 - RNA, 64 nt, Homo Sapiens
cuaucagggcacaaagccagucuagcucccccugggggcugagccuuuagccuagcagauuccu

SEQ ID NO: 39095 - RNA, 64 nt, Homo Sapiens
cucagacuucugaggugggguggagaagggacauggggcugaaucucauugaaaggugguugcu

SEQ ID NO: 39096 - RNA, 64 nt, Homo Sapiens
cuuccuuccuccuccuccccgaaguggcuccuagggggcugacucuguaggaaaccaaagaugg

SEQ ID NO: 39097 - RNA, 64 nt, Homo Sapiens
gggugaaaguguguggggaaacuuccccuuccccggggcugagaccucacacuccucacagccu

SEQ ID NO: 39098 - RNA, 64 nt, Homo Sapiens
uuauuucuguagcagccaaguccugcggcucccuggggcugagaucucccuuuguggaacuccg

SEQ ID NO: 39099 - RNA, 64 nt, Homo Sapiens
ggccacuccagggaucauuguuguccuuuugugaggggcugaggcgacugucccauggaggcau

SEQ ID NO: 39100 - RNA, 64 nt, Homo Sapiens
uggggaaggaaaaagcaggaaacugaaggaagcaggggcugaggaacacuuagagggugggcag

SEQ ID NO: 39101 - RNA, 64 nt, Homo Sapiens
ggcagcugcagcaagaggcagcugaagcccucguggggcugaaagauucaucccaggcuccucg

SEQ ID NO: 39102 - RNA, 64 nt, Homo Sapiens
cacacagagaggccaacuuccaggagaguuccagggggcugaggcccgacaccaggaggagggc

SEQ ID NO: 39103 - RNA, 64 nt, Homo Sapiens
ucccaccuagagagguugauucgccggggaagauggggcugauuguauauugcucuggggacuc

SEQ ID NO: 39104 - RNA, 64 nt, Homo Sapiens
augccuccgcugggcaucucgagggccaugacgcggggcugaggcagccgggcagguggucacu

SEQ ID NO: 39105 - RNA, 64 nt, Homo Sapiens
cugaggccaaaggggcugggccaaggcucgggugggggcugaggcaaauuugccaucucacucc

SEQ ID NO: 39106 - RNA, 64 nt, Homo Sapiens
cacucugccugccugcuguugguccucucucuguggggcugaauugccaggggcgaggcccuuc

SEQ ID NO: 39107 - RNA, 64 nt, Homo Sapiens
cucuggaagaggaaccaggagaagggcuggggccggggcugagggugcccuuuuccagccucag

SEQ ID NO: 39108 - RNA, 64 nt, Homo Sapiens
gcccagcuguugggaacagcauggaggcagauguggggcugagcuggggaaucaggguaaaagg

SEQ ID NO: 39109 - RNA, 64 nt, Homo Sapiens
uaccaccuucucccuccccacccccuccaggcccggggcugaaacagcccgaggacagccccag

SEQ ID NO: 39110 - RNA, 64 nt, Homo Sapiens
cugcagggucugcuuuuacuuggggugggggggcggggcugacccugaacccucccccccgcca

SEQ ID NO: 39111 - RNA, 64 nt, Homo Sapiens
gccgacccugggaggagguggucuuguaagggugggggcugacgccaguuugcugaacuuugcc

SEQ ID NO: 39112 - RNA, 64 nt, Homo Sapiens
ucugaggggugggugcucagagggugcccagcagggggcugagcgaggcuuggaccugcugugg

SEQ ID NO: 39113 - RNA, 64 nt, Homo Sapiens
acagacaauagcuuauuuucuuuccgcccccuccggggcugagccugggucugaagacugaaug

SEQ ID NO: 39114 - RNA, 64 nt, Homo Sapiens
cuggggcccccuaaccccaccccaggcagcggaaggggcugacugggucugguccuuaccaaca

SEQ ID NO: 39115 - RNA, 62 nt, Homo Sapiens
ugucuccacugccaaguagaagugacucaaaacccucugacaaggauauucccuuggcuaug

SEQ ID NO: 39116 - RNA, 62 nt, Homo Sapiens
gcucacugccaccuguggacacucugugucuacccucugagugggaacauacuucuaaguuc

SEQ ID NO: 39117 - RNA, 62 nt, Homo Sapiens
gcccucuuugagcuauuuggcuacuucccugucccucugacuccuacugucccaauuuucuc

SEQ ID NO: 39118 - RNA, 62 nt, Homo Sapiens
ccccccaacgcaaggaggaugcccaauuguugcccucugaaaaugcacaguucuccuggccc

SEQ ID NO: 39119 - RNA, 62 nt, Homo Sapiens
uuuuuuuuuuugaaauuugccgagcaguggagcccucugacaauuugcaaggcccucugaga

SEQ ID NO: 39120 - RNA, 62 nt, Homo Sapiens
cgagcaguggagcccucugacaauuugcaaggcccucugagaaaggaagcugcuuagagcca

SEQ ID NO: 39121 - RNA, 62 nt, Homo Sapiens
cgucuuugcucauggacuugaaaccugcccaccccucugagugcuccuguucuggugauacc

SEQ ID NO: 39122 - RNA, 62 nt, Homo Sapiens
augagggccacagagaaggucgggaacucugccccucugacagucccagaggacacaucccu

SEQ ID NO: 39123 - RNA, 62 nt, Homo Sapiens
aggcagagccuuuggaugaccagaacaagguucccucugagaauuccaaggaguuccaugaa

SEQ ID NO: 39124 - RNA, 62 nt, Homo Sapiens
ugcgaucuucagagcagggguccuuggugugacccucugaaugguccaggguugaucacacu

SEQ ID NO: 39125 - RNA, 62 nt, Homo Sapiens
gccuuagucucccaaauccaccaugcaucugccccucugagggugucuucacuuugucucug

SEQ ID NO: 39126 - RNA, 62 nt, Homo Sapiens
gagcagcugauaaguuucccuaccugauggcccccucugacauaaacugcacaccuggggug

SEQ ID NO: 39127 - RNA, 62 nt, Homo Sapiens
ccccgugcccugacccggggaccacagggacacccucugagacgugcuggccccaggaggau

SEQ ID NO: 39128 - RNA, 62 nt, Homo Sapiens
ucugcugacgggaacaagucauucugaaaggucccucugacccaggucaccaaauuugggcc

SEQ ID NO: 39129 - RNA, 62 nt, Homo Sapiens
ugggcgcuagcaagggcaaauacauuccuuuucccucugaccuggugagggaaggguacgag

SEQ ID NO: 39130 - RNA, 62 nt, Homo Sapiens
aaaugccugagugcuggggccccaccacccuucccucugaacgggagcuguguuguuuccca

SEQ ID NO: 39131 - RNA, 62 nt, Homo Sapiens
gcuauucuauuggaguagccucccuaggcagucccucugaagccuuggagugcagguaaaug

SEQ ID NO: 39132 - RNA, 62 nt, Homo Sapiens
ccaagaccugggucaguucuuugcuggugguccccucugaccacaagcuucugccugaagau

SEQ ID NO: 39133 - RNA, 62 nt, Homo Sapiens
cuaagaauucucucuucuggccuucuacuccucccucugacuagcuuuuuaaauaucuuuuu

SEQ ID NO: 39134 - RNA, 62 nt, Homo Sapiens
uccuucugcuaugacaaaacgacggggcaucucccucugauucucaacuucuuuccucugga

SEQ ID NO: 39135 - RNA, 62 nt, Homo Sapiens
ugcucaucucuuccgugagauuugcucccagacccucugaucucccuccaacaaacccuggc

SEQ ID NO: 39136 - RNA, 62 nt, Homo Sapiens
uggccuuguuaauuccaaguggcauguaucuucccucugagcuucauuucuucaagaugcuc

SEQ ID NO: 39137 - RNA, 62 nt, Homo Sapiens
gguuuuggucaaaaugggugaugacagcaucucccucugaaguugaagagguacccaucaua

SEQ ID NO: 39138 - RNA, 62 nt, Homo Sapiens
uauguuucgcagaaaagugugccagcuccgugcccucugaaucuggaccuccucucagcaca

SEQ ID NO: 39139 - RNA, 62 nt, Homo Sapiens
ccaacuucucuuucacccucgaucucugaauccccucugacuucugaccccaacuucucuuu

SEQ ID NO: 39140 - RNA, 62 nt, Homo Sapiens
ugcacuucaccgcugaccuuuguuugaccccucccucugagcgaccuauaaguucugguuua

SEQ ID NO: 39141 - RNA, 62 nt, Homo Sapiens
acuuugaagcacuuuugcauuuucaucuuuagcccucugaguugugcuggcauuucucaccc

SEQ ID NO: 39142 - RNA, 62 nt, Homo Sapiens
uguuguucuuggcacauguucaccuucaggcccccucugacuuugagggaaacuguggaagg

SEQ ID NO: 39143 - RNA, 62 nt, Homo Sapiens
uagguuuggaggucugccaguuacaccaaguccccucugagauucgaucaggggacuggaua

SEQ ID NO: 39144 - RNA, 62 nt, Homo Sapiens
gacaccagcccccugcauccuucaguagaccucccucugaacaccacagccagguccugccu

SEQ ID NO: 39145 - RNA, 62 nt, Homo Sapiens
uguuuuacuuuccuguaacuagcacacaugaucccucugaauaccgcaugaagauacuugua

SEQ ID NO: 39146 - RNA, 62 nt, Homo Sapiens
uuggccuucggugaggaauuaccccuccacuccccucugagauggccgaagcauagauugua

SEQ ID NO: 39147 - RNA, 62 nt, Homo Sapiens
agaguguggcugcuggacucuuuucgaaaugccccucugagucaggagccugguggggacaa

SEQ ID NO: 39148 - RNA, 62 nt, Homo Sapiens
ggcgggaggcaugcaagccagugggggaaaaccccucugaagcugggcagcccucuaccugg

SEQ ID NO: 39149 - RNA, 62 nt, Homo Sapiens
auuggaauccauuggcuugaugcaccacgauacccucugauucuccaguuugacauuauuca

SEQ ID NO: 39150 - RNA, 62 nt, Homo Sapiens
cuggaaacugucgacggccacaguaauaucuucccucugaugcgagagaagcugcccauccg

SEQ ID NO: 39151 - RNA, 62 nt, Homo Sapiens
uauuucauuuugguaguggaauacaguuuucucccucugauuuccucauuucauugccucuc

SEQ ID NO: 39152 - RNA, 62 nt, Homo Sapiens
cugacacaauuaaggaugaaggcugcaaauuucccucugaagcucaugcaaaauauuggugu

SEQ ID NO: 39153 - RNA, 62 nt, Homo Sapiens
uggcuccuucccagucaagguagaaaauucaccccucugaacuugcuauugauguaguguga

SEQ ID NO: 39154 - RNA, 62 nt, Homo Sapiens
cacuggaagagcuaguaaaugaaacccuguaucccucugaaacccauucauguuagaucguu

SEQ ID NO: 39155 - RNA, 64 nt, Homo Sapiens
cuauuuaacaagguccugguuucucuugcaacacaguagcuaaacuugccugcuuuuauaugca

SEQ ID NO: 39156 - RNA, 64 nt, Homo Sapiens
ccaagugaauuuaaauaauugguguggauuggccaguagcuaagaagugggcuuuuaaagagua

SEQ ID NO: 39157 - RNA, 64 nt, Homo Sapiens
ggauucaaggaauucucccugccucagccuccugaguagcuaggauuacaggugccugccacca

SEQ ID NO: 39158 - RNA, 64 nt, Homo Sapiens
auuauggagggaaucaaaaauacugcuuucaguuaguagcuagcuuuaagucaggaguuaguaa

SEQ ID NO: 39159 - RNA, 64 nt, Homo Sapiens
gcuucauucaaccuggcguuccccuccauaauuaagaugaaacauuccgguuuucucacaacac

SEQ ID NO: 39160 - RNA, 64 nt, Homo Sapiens
gaagucccugauuccuucuuaaacuuggaaugauagaugaaauucacaccccugcagaucagaa

SEQ ID NO: 39161 - RNA, 64 nt, Homo Sapiens
uuuuuuuuaaauaaaagacuaaagacagggagcuagaugaaauggcuuaauggugcuguuaagu

SEQ ID NO: 39162 - RNA, 64 nt, Homo Sapiens
uguuaaguauuuguaccuaacagucuugugugacagaugaaaauaggauguaacauaaugaaac

SEQ ID NO: 39163 - RNA, 64 nt, Homo Sapiens
acucaccaaaaugaauaguuguuucguuacauuuagaugaaaguuaaacuuuacugaauuucag

SEQ ID NO: 39164 - RNA, 64 nt, Homo Sapiens
acuuucaaguuggagcaauugucuguguuugaaaagaugaaauaaaaauaauaaucaagggcaa

SEQ ID NO: 39165 - RNA, 64 nt, Homo Sapiens
aauugcaauuacugguuggggggugcauuuuaaaagaugaaacaugcagcuucccuacauuaca

SEQ ID NO: 39166 - RNA, 64 nt, Homo Sapiens
cacucagaaauccuucaaacaugauuaauuaugaagaugaaacacuagagucauauaagaaaua

SEQ ID NO: 39167 - RNA, 64 nt, Homo Sapiens
agaaggcaaaaaauaucuuuuguacagaaaagcaagaugaaaaggaugugaaaugguagauaua

SEQ ID NO: 39168 - RNA, 64 nt, Homo Sapiens
uauauauguacuacauuaaaaaguguugauuaauagaugaaauuuuuaaauuaauuuuuuaaaa

SEQ ID NO: 39169 - RNA, 64 nt, Homo Sapiens
uaucaguuucaaauaauauuuucucuguaguaugagaugaaauuaaaaguggauagcuuucagg

SEQ ID NO: 39170 - RNA, 64 nt, Homo Sapiens
uucucugugccagacacuguucuggaagauagcuagaugaaaaucuuugcacucacagagcuua

SEQ ID NO: 39171 - RNA, 64 nt, Homo Sapiens
gggccacugaaaagugaauuuaggaaccagauagagaugaaaaguuuuucauagaggcagaaag

SEQ ID NO: 39172 - RNA, 64 nt, Homo Sapiens
aaccuaacauuauuuacaguaauaaagugguuugagaugaaaagauaacgaguaaguagacaag

SEQ ID NO: 39173 - RNA, 64 nt, Homo Sapiens
aauucagucccuaaauacaugaggcugggugagcagaugaaaccgguagccacugugcugaugc

SEQ ID NO: 39174 - RNA, 64 nt, Homo Sapiens
uacaaugucuacuguacugugggucauuuagaugagaugaaaaacuuaauuaaaucugaagugu

SEQ ID NO: 39175 - RNA, 64 nt, Homo Sapiens
acaguugugaaccaagaucuauaaagcgauauacagaugaaaauuugagacuauuuaaacuuau

SEQ ID NO: 39176 - RNA, 64 nt, Homo Sapiens
gagcacuuccaaaauucuuauuuuuccuaacaaaagaugaaagcagggaauuucuaucuaaaug

SEQ ID NO: 39177 - RNA, 64 nt, Homo Sapiens
uuuucaucgaaauugccugugugcacauauuuuuagaugaaaaaugaaacuaccuuacaauauu

SEQ ID NO: 39178 - RNA, 64 nt, Homo Sapiens
aagguugauguguucauuccaguuauucacuuacagaugaaacuaaaacaaauaaaggcaagcu

SEQ ID NO: 39179 - RNA, 64 nt, Homo Sapiens
caacaaucagaguagaaaaacugccacaacugccagaugaaaagcccaggcaaaauauagcaau

SEQ ID NO: 39180 - RNA, 64 nt, Homo Sapiens
guggugauagaaaugggugcagaacauuuaguguagaugaaaauccccuucacccacucccucc

SEQ ID NO: 39181 - RNA, 64 nt, Homo Sapiens
gucccugaguugcaccauucuuauuugucggggaagaugaaaccauauuuaaaagacaaacacc

SEQ ID NO: 39182 - RNA, 64 nt, Homo Sapiens
cugcauuuuuaaaggacaaauguaugcaagugggagaugaaaacauggaagaaacccuuccacg

SEQ ID NO: 39183 - RNA, 64 nt, Homo Sapiens
ugauugagcaguguacuuacucuguucuugauccagaugaaaucuuuccggaauauuggaauau

SEQ ID NO: 39184 - RNA, 64 nt, Homo Sapiens
caaaguaauugauguauuucaaguacaugcagaaagaugaaacauugcuguguauuuaguguaa

SEQ ID NO: 39185 - RNA, 64 nt, Homo Sapiens
uuuaaagacaauucuagcagaauuuaucaaaacaagaugaaacacagaaaaguugaaaccacaa

SEQ ID NO: 39186 - RNA, 64 nt, Homo Sapiens
uguguauuucagagcuggauacugccauuaccacagaugaaaguugcaaugaucuagcaguugu

SEQ ID NO: 39187 - RNA, 64 nt, Homo Sapiens
uggaaagcagcuucuuagcugccuaauuaaugaaagaugaaaauaggaagugcccuggaggggg

SEQ ID NO: 39188 - RNA, 64 nt, Homo Sapiens
caugccuggugccacagccaugguuuccauuucuagaugaaaggauggccuaggacauaggucu

SEQ ID NO: 39189 - RNA, 64 nt, Homo Sapiens
gggaaauaggccauggacggaaaauuauuuuaaaagaugaaagauaaaaagccuaaauguucag

SEQ ID NO: 39190 - RNA, 64 nt, Homo Sapiens
agaagguacccuaaggcugagagaauaauaauaaagaugaaaaguaauaauuaagcuaugauag

SEQ ID NO: 39191 - RNA, 64 nt, Homo Sapiens
auuaggggcuuccacacugcugauuaggcaaacuagaugaaaaguaauugguuaaguagcuuaa

SEQ ID NO: 39192 - RNA, 64 nt, Homo Sapiens
uuuuuacucuagaaacuguggucacauuucucuaagaugaaagaaaaaaauguauuuacuaagu

SEQ ID NO: 39193 - RNA, 64 nt, Homo Sapiens
aagcuuaauuauacuaugccugguugcagaucucagaugaaaccuuuucugacacccuuuaaug

SEQ ID NO: 39194 - RNA, 64 nt, Homo Sapiens
acucuaaguaaauacauuuuuacuuuuguuccccagaugaaagauuauauaauucacuuuguuu

SEQ ID NO: 39195 - RNA, 64 nt, Homo Sapiens
uuguauaguuauugagaccuauaguguguggcuuagaugaaagggagaguaaauuuucauacca

SEQ ID NO: 39196 - RNA, 64 nt, Homo Sapiens
gcaugagaauauaucaccugugguuuuuccuuugagaugaaacguaguuucuaguuauaucauu

SEQ ID NO: 39197 - RNA, 64 nt, Homo Sapiens
uuagauguuugauacauuuuaaguauuuuuaaauagaugaaaauucuaaaugauuuucccucaa

SEQ ID NO: 39198 - RNA, 64 nt, Homo Sapiens
acucccacaaaaauuuuauuggccuuuuuguaagagaugaaaaagaauugacacaguucucuuu

SEQ ID NO: 39199 - RNA, 64 nt, Homo Sapiens
uccuaaaauauaggagcacaaagaguagaaaauaagaugaaauaucgguacaucuuaugguuua

SEQ ID NO: 39200 - RNA, 64 nt, Homo Sapiens
uucuauagaaaaaaaaaauucuuugcuuacagcuagaugaaacuuuuuguuguuguugaaaaga

SEQ ID NO: 39201 - RNA, 64 nt, Homo Sapiens
auaaaacuauuauauaaaggaaacuaucaaagaaagaugaaauauaaagaaaagaugaaaaaaa

SEQ ID NO: 39202 - RNA, 64 nt, Homo Sapiens
aaaaacuaucaaagaaagaugaaccauaaagaaaagaugaaaaaagauucuggcuucuacugaa

SEQ ID NO: 39203 - RNA, 64 nt, Homo Sapiens
auucuuuagaugcucacauuguuuuaaauaaaauagaugaaaugggaaguuuagguaaucaucu

SEQ ID NO: 39204 - RNA, 64 nt, Homo Sapiens
agaugaaaugggaaguuuagguaaucaucuagacagaugaaauuauuaucuagguaggagggcu

SEQ ID NO: 39205 - RNA, 64 nt, Homo Sapiens
uccugcugugacaugucuguuagggaggcacucaagaugaaaacuacuucaacuaaaagccaac

SEQ ID NO: 39206 - RNA, 64 nt, Homo Sapiens
aagagaaaagaaaaaaagagagaagaaaaaggagagaugaaaaaggaggaugaggagaagaauu

SEQ ID NO: 39207 - RNA, 64 nt, Homo Sapiens
uuuuuuuggguaacaaucccgaaagauaguuuagagaugaaaggauaauguuuuugguuauuug

SEQ ID NO: 39208 - RNA, 64 nt, Homo Sapiens
auauucaaauuucauuuuuuaaagacacuuaagaagaugaaauacuugaagugcuaauaauguu

SEQ ID NO: 39209 - RNA, 64 nt, Homo Sapiens
cagccucagaacaaagugagacaguccagccuggagaugaaaucuuacagcuggguggcacugc

SEQ ID NO: 39210 - RNA, 64 nt, Homo Sapiens
aguaaggaugugggggaagaccuggcaaggacacagaugaaacacaaacaauaguaauucucag

SEQ ID NO: 39211 - RNA, 64 nt, Homo Sapiens
auggucuccaaaaaauuaauugaacuuuugagagagaugaaagguguaauauuauguaauuaug

SEQ ID NO: 39212 - RNA, 64 nt, Homo Sapiens
uccccuucauggaucuggcaugaaaugcucagugagaugaaacugcacucagggaaaugcaaau

SEQ ID NO: 39213 - RNA, 64 nt, Homo Sapiens
uuggcuuuuccccucuacuuccaguccuuagguuagaugaaaaguaggugauugaaggagagga

SEQ ID NO: 39214 - RNA, 64 nt, Homo Sapiens
caacagaacuaucaacuguauacuuauuugguggagaugaaauuucaagacagcaguaucgcag

SEQ ID NO: 39215 - RNA, 64 nt, Homo Sapiens
ccccaaggugccugaaaugggccaaaagucucagagaugaaacucgacuccccgaggugcagcu

SEQ ID NO: 39216 - RNA, 64 nt, Homo Sapiens
cccuaaaaugccugagauggcccgaaagucccagagaugaaacucaccucccggaagugcagcu

SEQ ID NO: 39217 - RNA, 64 nt, Homo Sapiens
cccugaggugaaacucccgagaugaagcucccugagaugaaacucagcuuccaaaagucccaga

SEQ ID NO: 39218 - RNA, 64 nt, Homo Sapiens
cccugaagugcaacucccgagaugaaacuuccugagaugaaacuaagcuuccaaaggugccuga

SEQ ID NO: 39219 - RNA, 64 nt, Homo Sapiens
uccugagaugaaacucccuguccaaaggugccugagaugaaacuaaagucccugagaugaagcu

SEQ ID NO: 39220 - RNA, 64 nt, Homo Sapiens
cccugagaugaagcuuccaagccgaaagugccagagaugaaagucggcuuccagaggugcagcu

SEQ ID NO: 39221 - RNA, 64 nt, Homo Sapiens
cccagaggugucagaggugggccgaaagugucagagaugaaacucggcuuccagagguacagcu

SEQ ID NO: 39222 - RNA, 64 nt, Homo Sapiens
cccaaaggugccagagaugggcugaaagugucggagaugaaacucggcuuccagagguacagcu

SEQ ID NO: 39223 - RNA, 64 nt, Homo Sapiens
cccaaaggugccagagaugggcccaaagugucagagaugaaacucggcuuccagagguagagcu

SEQ ID NO: 39224 - RNA, 64 nt, Homo Sapiens
cccaaaggugccagagauggccccaaggugucagagaugaaacucgacucccagagguggagcu

SEQ ID NO: 39225 - RNA, 64 nt, Homo Sapiens
uuugaugaauaguggaauucacagucuugagaauagaugaaaaucuaaaccuaguuugaaauca

SEQ ID NO: 39226 - RNA, 64 nt, Homo Sapiens
ugguaaaucaacuccacagauccaaggaauacugagaugaaaugguuaaauguucauggucaac

SEQ ID NO: 39227 - RNA, 64 nt, Homo Sapiens
caaagaaccugcucugaugacacuuagaggggagagaugaaagccaaacaaaugaauaaacaua

SEQ ID NO: 39228 - RNA, 64 nt, Homo Sapiens
cuggaaagguaagacugaggucagaaaggugcagagaugaaaagauuuugaaggaccuuaugaa

SEQ ID NO: 39229 - RNA, 64 nt, Homo Sapiens
uuuucaaaaaggaaaaagcuguagaacauuuuguagaugaaacuacuguuuaagauuaaugaau

SEQ ID NO: 39230 - RNA, 64 nt, Homo Sapiens
gugccucucacaaaagauccuggauggaggaguaagaugaaauauuaugcuauuauaugaugcu

SEQ ID NO: 39231 - RNA, 64 nt, Homo Sapiens
caaauaaccuaaaaaucaauggguuuuuuaauugagaugaaauucgggagcaguuugcguguuu

SEQ ID NO: 39232 - RNA, 64 nt, Homo Sapiens
ugugauuuucucuaauguaaguuuacggccuaugagaugaaauaauggcuuccuaaauggcccu

SEQ ID NO: 39233 - RNA, 64 nt, Homo Sapiens
cuuguugcuccuuucagguaaagaagcagauuuuagaugaaaagaucuacugcccuccugaggc

SEQ ID NO: 39234 - RNA, 64 nt, Homo Sapiens
aggagaaggaaagccgauucuuuggaaguucagcagaugaaagcccaggccagggaggagaagg

SEQ ID NO: 39235 - RNA, 64 nt, Homo Sapiens
cgcacgagggaugaguuggagaggaggcugcugcagaugaaagaagaagcaacaauggccaacg

SEQ ID NO: 39236 - RNA, 64 nt, Homo Sapiens
uuaggguacacagcuggccauuuauuaagaaaauagaugaaaaagcuuaugaaauguaauuaaa

SEQ ID NO: 39237 - RNA, 64 nt, Homo Sapiens
cgugcaauaugcuuuaaagcuuuacuagugugcuagaugaaaaguccaaaaagaguaauaguug

SEQ ID NO: 39238 - RNA, 64 nt, Homo Sapiens
ugaagcaguuugaaaauuugaauugagucuuaacuuuaggaaaugagguuucauaauucugccu

SEQ ID NO: 39239 - RNA, 64 nt, Homo Sapiens
ggcauguuugcaaaaauauggcacauguauacauuuuaggaaauguuacuuuuguuaaucuuua

SEQ ID NO: 39240 - RNA, 64 nt, Homo Sapiens
acacagauaccaugaugagaguauauuaaagaaauuuaggaaagcaccugguuccuuucucccc

SEQ ID NO: 39241 - RNA, 64 nt, Homo Sapiens
gauaacuccagcaggaaacuguaacugcuaugucuuuaggaaaauguagaagaaagaacauuau

SEQ ID NO: 39242 - RNA, 64 nt, Homo Sapiens
guucaugaaggcaaauguauggaugagagugugguuuaggaaagagggcacugauaucagauua

SEQ ID NO: 39243 - RNA, 64 nt, Homo Sapiens
aucuagucuccuugaaaaaaaaaucucuuggauguuuaggaaggaagacuuggccgugaugugg

SEQ ID NO: 39244 - RNA, 64 nt, Homo Sapiens
uguggauccauggugauucuagacuucagauauauuuaggaaggcgcagauuucaaaucugugu

SEQ ID NO: 39245 - RNA, 64 nt, Homo Sapiens
agaauaggaagaguagcacuuuccgccuaagcacuuuaggaaaucaccuuucuaagcccugggg

SEQ ID NO: 39246 - RNA, 64 nt, Homo Sapiens
guuagaguuaugguaggcaaaaagaaaaggagaauuuaggaaauaaauaugcuauaaacaaggu

SEQ ID NO: 39247 - RNA, 64 nt, Homo Sapiens
uucacacaaaagaauuaaaagcuuaaaaauaauuuuuaggaaacacaauauucaaaaucuaaac

SEQ ID NO: 39248 - RNA, 64 nt, Homo Sapiens
aauauguauaaguaauucggcauaauuacgaacauuuaggaaccaacaaaaacaguuuaggaag

SEQ ID NO: 39249 - RNA, 64 nt, Homo Sapiens
auaauuacgaacauuuaggauagaacaaaaacaguuuaggaagccacucuugguucucuugccg

SEQ ID NO: 39250 - RNA, 64 nt, Homo Sapiens
auguauaauaagauaaaaucuauugacuuuguaauuuaggaaaauagcagaauauauuugcagc

SEQ ID NO: 39251 - RNA, 64 nt, Homo Sapiens
caaauaaauaacaaacaaacuguuuaggaaggccuuuaggaagaauugcaaaauaauggccagu

SEQ ID NO: 39252 - RNA, 64 nt, Homo Sapiens
ccuuuaggaagacaaauaaaauaauggccaguuguuuaggaagguauuuccaaauaauugcaaa

SEQ ID NO: 39253 - RNA, 64 nt, Homo Sapiens
ucuaaggagagaaggguugucacauuauaaaaucuuuaggaaaaugugaacuggaaaacgcuuc

SEQ ID NO: 39254 - RNA, 64 nt, Homo Sapiens
cuggugacuauuauugcggaccgugguacccaguuuuaggaauguggagaaaggaauucuguug

SEQ ID NO: 39255 - RNA, 64 nt, Homo Sapiens
ugacagguguuccaauggccuuuaucaaaacauguuuaggaaaauugguacugugauaaauuug

SEQ ID NO: 39256 - RNA, 64 nt, Homo Sapiens
auaaacgacuuaaugaaugauacaucagucagauuuuaggaaggcagucaauuauggauauuuu

SEQ ID NO: 39257 - RNA, 64 nt, Homo Sapiens
uauggcaucagguaggagaaggagacgaagaugcuuuaggaagauaaaaaccuuacaaagaaug

SEQ ID NO: 39258 - RNA, 64 nt, Homo Sapiens
ucaguacuuucuccucccauccuaagcuucucauuuuaggaacugacaugauaaggugguucuu

SEQ ID NO: 39259 - RNA, 64 nt, Homo Sapiens
uuauucaugucuuuaaaucagauaccaaauauuuuuuaggaaagaaaaauguuauuacugucau

SEQ ID NO: 39260 - RNA, 64 nt, Homo Sapiens
uguguauuugaacccaccaugacagaaaguaaauuuuaggaaauaguuaugagauuaagggaaa

SEQ ID NO: 39261 - RNA, 64 nt, Homo Sapiens
aaauaaacaaaccagucuuuauuuuaaaagaaacuuuaggaaacaaacccacauaauaguuggg

SEQ ID NO: 39262 - RNA, 64 nt, Homo Sapiens
aauaucaaauugauaguaacaacagaagcauaauuuuaggaaggcuuucgcaaaccuagccuuu

SEQ ID NO: 39263 - RNA, 64 nt, Homo Sapiens
caaaggucuggacuaagcaaaacaacagugucaguuuaggaaauuauuacuacuuugaacacaa

SEQ ID NO: 39264 - RNA, 64 nt, Homo Sapiens
caucuuugcucuuaacuccaagucugcccuucuuuuuaggaaacccuaaaggagaaggaagcag

SEQ ID NO: 39265 - RNA, 64 nt, Homo Sapiens
uaaguuccuuuccuuuucuuuaaagaaguugaaguuuaggaauccuuuggugccaacugguguu

SEQ ID NO: 39266 - RNA, 64 nt, Homo Sapiens
gcacaucuuggcuauguaauucuuguaauuuuuauuuaggaaguguugaagggagguggcaaga

SEQ ID NO: 39267 - RNA, 64 nt, Homo Sapiens
guguuaauuccaggcagggaauuagcacaaaagguuuaggaaggaaucuuuuuuuaaagacuuc

SEQ ID NO: 39268 - RNA, 64 nt, Homo Sapiens
caggaugacuuucuggccagaauaccggaaagcuuuuaggaagcuucguucacaugcuauuuaa

SEQ ID NO: 39269 - RNA, 64 nt, Homo Sapiens
ucuugagaaaucuucauaauuggaaaguuuaagauuuaggaacuucuuuuuuuuaaagacagca

SEQ ID NO: 39270 - RNA, 64 nt, Homo Sapiens
ggcauauauucugcaaagugaauguagauuguaauuuaggaaauuuguuuuauaugcuuuuaag

SEQ ID NO: 39271 - RNA, 64 nt, Homo Sapiens
uauuugguagacaaagaguuugcuuaaaaacaguuuuaggaaaaaccuuuuaaguuaauguaua

SEQ ID NO: 39272 - RNA, 64 nt, Homo Sapiens
gauuuuacaguggugcuuuaugacccagcaaucuuuuaggaagauugcccuaaauugcuaggug

SEQ ID NO: 39273 - RNA, 64 nt, Homo Sapiens
aaauaggggauauuuaagguagcuucagcuagcuuuuaggaaaaucacuuugucuaacucagaa

SEQ ID NO: 39274 - RNA, 64 nt, Homo Sapiens
gcuacuaaguucacauuagaauuagugccagaauuuuaggaacuucagagaucguguauugaga

SEQ ID NO: 39275 - RNA, 64 nt, Homo Sapiens
aaaggaagggaagaccugaaagucauuugaacauuuuaggaaaagaauauuggagagaaaaagg

SEQ ID NO: 39276 - RNA, 64 nt, Homo Sapiens
uuguaucaaggcagaggugaugccaugccauacuuuuaggaagucugagaugauaaauauuuca

SEQ ID NO: 39277 - RNA, 64 nt, Homo Sapiens
ugucuuccacaguaaagaaaacuuaguggcuuaauuuaggaaacauguuaacaggacacuaugu

SEQ ID NO: 39278 - RNA, 64 nt, Homo Sapiens
guaaaguauuaauuauugaacuuugaaccagauuuuuaggaaaauuauguucuuuuucccccuu

SEQ ID NO: 39279 - RNA, 64 nt, Homo Sapiens
uuagggagccaauggaaucuuguccccuauaaauuuuaggaauggaaagaacucauacucuaug

SEQ ID NO: 39280 - RNA, 64 nt, Homo Sapiens
ucucauaccauaauuaccacgaauguggaaaucuuuuaggaauuagaaaaacucugaauguaag

SEQ ID NO: 39281 - RNA, 64 nt, Homo Sapiens
uuccucuucuucgugauaauauaaucucuauuuuuuuaggaaaacaaaaaugaaaaacuacucc

SEQ ID NO: 39282 - RNA, 64 nt, Homo Sapiens
uucuauuaguauuuguaucuucaguucauuccacuuuaggaaacagagcugccaauugaaacag

SEQ ID NO: 39283 - RNA, 64 nt, Homo Sapiens
acaucaagaauguaguguagcucauuauugagaauuuaggaaagccugaauccauuaauuaagg

SEQ ID NO: 39284 - RNA, 64 nt, Homo Sapiens
aaucauauuugaagacaguaagacaguaaacuauuuuaggaagucaacccccauugcacucugu

SEQ ID NO: 39285 - RNA, 64 nt, Homo Sapiens
guuuuccugguugcacucuguagacuggaucuguuuuaggaaguuacuuucacagugauguugu

SEQ ID NO: 39286 - RNA, 64 nt, Homo Sapiens
cuggaguacuuggacagauguuauagugguuucuuuuaggaaaaucugucauuaaaaaaguuau

SEQ ID NO: 39287 - RNA, 64 nt, Homo Sapiens
aauaaagauuuauauauucaauaaaauuaauaaauuuaggaaaguuagcaaccauaaaauuguc

SEQ ID NO: 39288 - RNA, 64 nt, Homo Sapiens
aaugacuuaacagaacucaaagaucuuuuauuuuuuuaggaaucggauuguuaaaaucauagaa

SEQ ID NO: 39289 - RNA, 64 nt, Homo Sapiens
gaguaugguaggggguuugaagaauccccuguccaccucccaaauccaggcccggcccccucug

SEQ ID NO: 39290 - RNA, 64 nt, Homo Sapiens
cucaaucuccugaccucgugauccacccaccucgaccucccaaagugcugagauuacaggcgug

SEQ ID NO: 39291 - RNA, 64 nt, Homo Sapiens
ugcaauuuccaaaagauauuuugguaagacaacaaccucccagugauaugccaccuuucaauuu

SEQ ID NO: 39292 - RNA, 64 nt, Homo Sapiens
aguggccccgcaaucucggcucacugcaaccucuaccucccagguucaagcuauucuacugccu

SEQ ID NO: 39293 - RNA, 64 nt, Homo Sapiens
uggccagaaccaauguccauugucuucuagccccaccucccacuagacagguccuccaguaccc

SEQ ID NO: 39294 - RNA, 64 nt, Homo Sapiens
cugaugaccucucuggcugggaaggggcauggccaccucccaacaggggcagggucccuggcca

SEQ ID NO: 39295 - RNA, 64 nt, Homo Sapiens
gcccuucugaaaagugccagcuauucucaguuacaccucccaguaacucuguggcuggcagcca

SEQ ID NO: 39296 - RNA, 64 nt, Homo Sapiens
accaccaugaaguuuggugaauagacugcccccuaccucccaccaggaccaugugguuggaagg

SEQ ID NO: 39297 - RNA, 64 nt, Homo Sapiens
gugcugggauuacaggcuuggucuacccaccuugaccucccaaacgaacucuugagcucaagca

SEQ ID NO: 39298 - RNA, 64 nt, Homo Sapiens
uagcugggacuauaggcaugauccucccacuucaaccucccaagcugccuucugggcucaagca

SEQ ID NO: 39299 - RNA, 64 nt, Homo Sapiens
ucgaacuccuggccuaggugauccacccgccucgaccucccaaagugcugggauuacaggcaug

SEQ ID NO: 39300 - RNA, 64 nt, Homo Sapiens
uuugccauggaugagaguccugggugugaggaacaccucccaccaggcuagaggcaacugccca

SEQ ID NO: 39301 - RNA, 64 nt, Homo Sapiens
ucucccuggcagcagaugaggaguaaugggaagaaccucccacagacgagacccccucaucuca

SEQ ID NO: 39302 - RNA, 64 nt, Homo Sapiens
ccuucaauguggggacgagagguccugaugcccaaccucccaccccaaggaaggccuaugaaaa

SEQ ID NO: 39303 - RNA, 64 nt, Homo Sapiens
ugcaguggugugaucucagcucacugcaaccuccaccucccagguucaagcaauucuucugccu

SEQ ID NO: 39304 - RNA, 64 nt, Homo Sapiens
cgcaguggugacaucucggcucacugcaaccuccaccucccagguucaagugauucuccugccu

SEQ ID NO: 39305 - RNA, 64 nt, Homo Sapiens
ucuaggggauauuugugcaacuuguauuauaauaaccucccaguauacauuucucaaauguaca

SEQ ID NO: 39306 - RNA, 64 nt, Homo Sapiens
guacugggauuacaggcgugauccaccugccucgaccucccaaaugaacuccugaacucaagug

SEQ ID NO: 39307 - RNA, 64 nt, Homo Sapiens
uacaguagugcaaucucagcucacugcaaccuccaccucccagacucaagccauccucccaccu

SEQ ID NO: 39308 - RNA, 64 nt, Homo Sapiens
ccaccucccagacucaagccauccucccaccucaaccucccaaguagcugggacuacaggcaua

SEQ ID NO: 39309 - RNA, 64 nt, Homo Sapiens
caccccaaacaaauggaagacuuauuuaaaacucaccucccaaucccguuagagagcugagacc

SEQ ID NO: 39310 - RNA, 64 nt, Homo Sapiens
agggcuccucacuaucuaggaucagcucugugccaccucccaagcccaccuggaaucccacaac

SEQ ID NO: 39311 - RNA, 64 nt, Homo Sapiens
gugcugugauuacaggugugauccacccgccucgaccucccaaacucgaucucuugaccucaug

SEQ ID NO: 39312 - RNA, 64 nt, Homo Sapiens
uucaagcaauucuccugccuucacugcaaccuccaccucccaggugcgguggugcaaucucggc

SEQ ID NO: 39313 - RNA, 64 nt, Homo Sapiens
ccauuguccccaaguaugaggugaacggggugaaaccucccauuggccaaaggacacggcucag

SEQ ID NO: 39314 - RNA, 64 nt, Homo Sapiens
caaguucugugguucugagaagcccgaggucaucaccucccaguacaacaacaugcgcguggag

SEQ ID NO: 39315 - RNA, 64 nt, Homo Sapiens
cucagcuccgccccauacccgucacuacagccucaccucccaccccugucacuacggccucacc

SEQ ID NO: 39316 - RNA, 64 nt, Homo Sapiens
cagccucaccucccaccccugucacuacggccucaccucccaccccugucacuacagccucacc

SEQ ID NO: 39317 - RNA, 64 nt, Homo Sapiens
cgguucaugagaggucugcucucaugaccuaaucaccucccaaaggccccaccucccaauacca

SEQ ID NO: 39318 - RNA, 64 nt, Homo Sapiens
ugcucucaugaccuaaucaccucccaaaggccccaccucccaauaccaucacauuagggguuag

SEQ ID NO: 39319 - RNA, 64 nt, Homo Sapiens
aaccaaccacacccggugggguaugggaaccagcaccucccacccucucagccgaugccccccg

SEQ ID NO: 39320 - RNA, 64 nt, Homo Sapiens
aaccagccacacccggugggguaugggaaccagcaccucccacccucucagccgaugcccccca

SEQ ID NO: 39321 - RNA, 64 nt, Homo Sapiens
aaccagccacacccaguggggugugggaaccagcaccucccacccucucagccgaugccccccg

SEQ ID NO: 39322 - RNA, 64 nt, Homo Sapiens
aaccagccacucccgguggggugcagaaaacagcaccucccacccacacccggggggcccccgg

SEQ ID NO: 39323 - RNA, 64 nt, Homo Sapiens
ugauaugcagugcuuuugacgucccuacccucccaccucccaccuuacuuugucccagguugga

SEQ ID NO: 39324 - RNA, 64 nt, Homo Sapiens
ggcucgcucccccccccccaggcugcacccuccaaccucccauuucucccccuccuaccugaga

SEQ ID NO: 39325 - RNA, 64 nt, Homo Sapiens
gacucugugcccuugcucucuaacuucugagcccaccucccaggguaggcaccugggggcaugc

SEQ ID NO: 39326 - RNA, 64 nt, Homo Sapiens
cccaggguaggcaccugggggcaugcaggugcccaccucccaggguaggcaccugggggcaugc

SEQ ID NO: 39327 - RNA, 64 nt, Homo Sapiens
cauacuugacuguccccaaaguccguggcuguccaccucccagcucacaucuccugagcuuagu

SEQ ID NO: 39328 - RNA, 64 nt, Homo Sapiens
cuccacuucccaguuugcaauagugcuuccccucaccucccacugaauccucuucauucauugc

SEQ ID NO: 39329 - RNA, 64 nt, Homo Sapiens
cuuccugugaacauuuguaaccacugcuucagucaccucccaccucuugccaccugcugcugcu

SEQ ID NO: 39330 - RNA, 64 nt, Homo Sapiens
ccaacccaugaacucuucacuccuuggggaagccaccucccaucacaccccugagcagaguuag

SEQ ID NO: 39331 - RNA, 64 nt, Homo Sapiens
uuaagcuuugcaggacagggagacacaaaucucuaccucccauggagagaagaagaagaagaag

SEQ ID NO: 39332 - RNA, 64 nt, Homo Sapiens
cucaagugauccucccacccucacuguaaccuccaccucccagguuggcucacuugaucuuggc

SEQ ID NO: 39333 - RNA, 61 nt, Homo Sapiens
cgggaccggggccagccuaggggggccugugaccucccauggagcccagccccgcccucca

SEQ ID NO: 39334 - RNA, 64 nt, Homo Sapiens
gccccgcccuccacaccuccggcgcuccgcacccaccucccacggccccgccccugcccccgcu

SEQ ID NO: 39335 - RNA, 64 nt, Homo Sapiens
ccuccgcugggccuggauggcugccucaccucucaccucccaacgucccuagcccuuacguccu

SEQ ID NO: 39336 - RNA, 64 nt, Homo Sapiens
uagcccaucuuucaagggaccucuccaugaucccaccucccauucacagauaccucucuuguag

SEQ ID NO: 39337 - RNA, 64 nt, Homo Sapiens
cagggcucuguguuuugucugagacggccggagaaccucccaggcagagccugguguggggucu

SEQ ID NO: 39338 - RNA, 64 nt, Homo Sapiens
ugccccucgagcaaaaaccugggcccugacgcccaccucccagggcuauguucccgccgcagug

SEQ ID NO: 39339 - RNA, 64 nt, Homo Sapiens
cuccuccucuucuccuucaaauccucggcaacccaccucccaccccccaagucuucaaccagau

SEQ ID NO: 39340 - RNA, 64 nt, Homo Sapiens
ccagaccauccaggccugguccuggacugcacagaccucccacuuccccccaccccccaaacgu

SEQ ID NO: 39341 - RNA, 64 nt, Homo Sapiens
ggugcagcugcccaaagucucgugcccgaugugcaccucccagacccaaggugccugaaauggc

SEQ ID NO: 39342 - RNA, 64 nt, Homo Sapiens
agugcagcuuccaaaagucccgugcccgaugugcaccucccagaccgaaggugcccgagauggc

SEQ ID NO: 39343 - RNA, 64 nt, Homo Sapiens
cuguauguacuuccaguaucggcucaggccaaagaccucccaagggaugggcuuggccaaaaca

SEQ ID NO: 39344 - RNA, 64 nt, Homo Sapiens
uucaagcgacucuccugccuucacugcaaccuccaccucccaggcaggcuggagugaucucagc

SEQ ID NO: 39345 - RNA, 64 nt, Homo Sapiens
gugggaccccaagugaagacucagcacauccgacaccucccagcucagucccugacuaacagcc

SEQ ID NO: 39346 - RNA, 64 nt, Homo Sapiens
agggugaagaguccaagaagugcagggccguaguaccucccagccucacagccccggcccccug

SEQ ID NO: 39347 - RNA, 64 nt, Homo Sapiens
gguuaauauacauauauaaauauauaaauacaaacacacacacacacuuuuuuuguacuguagc

SEQ ID NO: 39348 - RNA, 64 nt, Homo Sapiens
uuaauauacauauauaaauauauaaauacaaacacacacacacacuuuuuuuguacuguagcaa

SEQ ID NO: 39349 - RNA, 64 nt, Homo Sapiens
aauauacauauauaaauauauaaauacaaacacacacacacacuuuuuuuguacuguagcaauu

SEQ ID NO: 39350 - RNA, 64 nt, Homo Sapiens
auaaaccaguguuuucuacuuuggcaacucacgucacacacauauuacacacaugugcgcauua

SEQ ID NO: 39351 - RNA, 64 nt, Homo Sapiens
acgucacacacauauuacacacaugugcgcauuacacacacacaauacacauacaugcauauag

SEQ ID NO: 39352 - RNA, 64 nt, Homo Sapiens
gucacacacauauuacacacaugugcgcauuacacacacacaauacacauacaugcauauagac

SEQ ID NO: 39353 - RNA, 64 nt, Homo Sapiens
agagacaugcaacaacaacacacacgcacacacgcacacacacacacguacacacacauacaaa

SEQ ID NO: 39354 - RNA, 64 nt, Homo Sapiens
agacaugcaacaacaacacacacgcacacacgcacacacacacacguacacacacauacaaaau

SEQ ID NO: 39355 - RNA, 64 nt, Homo Sapiens
acaugcaacaacaacacacacgcacacacgcacacacacacacguacacacacauacaaaaucc

SEQ ID NO: 39356 - RNA, 64 nt, Homo Sapiens
aacacacacgcacacacgcacacacacacacguacacacacauacaaaaucccucugcaguuuu

SEQ ID NO: 39357 - RNA, 64 nt, Homo Sapiens
auguggccuaacaaaaggaaaaaauguuuuuaaacacacacacacacacacacacacacacaca

SEQ ID NO: 39358 - RNA, 64 nt, Homo Sapiens
guggccuaacaaaaggaaaaaauguuuuuaaacacacacacacacacacacacacacacacaca

SEQ ID NO: 39359 - RNA, 64 nt, Homo Sapiens
ggccuaacaaaaggaaaaaauguuuuuaaacacacacacacacacacacacacacacacacaua

SEQ ID NO: 39360 - RNA, 64 nt, Homo Sapiens
ccuaacaaaaggaaaaaauguuuuuaaacacacacacacacacacacacacacacacacauaca

SEQ ID NO: 39361 - RNA, 64 nt, Homo Sapiens
uaacaaaaggaaaaaauguuuuuaaacacacacacacacacacacacacacacacacauacaca

SEQ ID NO: 39362 - RNA, 64 nt, Homo Sapiens
acaaaaggaaaaaauguuuuuaaacacacacacacacacacacacacacacacacauacacaga

SEQ ID NO: 39363 - RNA, 64 nt, Homo Sapiens
aaaaggaaaaaauguuuuuaaacacacacacacacacacacacacacacacacauacacagaca

SEQ ID NO: 39364 - RNA, 64 nt, Homo Sapiens
aaggaaaaaauguuuuuaaacacacacacacacacacacacacacacacacauacacagacaaa

SEQ ID NO: 39365 - RNA, 64 nt, Homo Sapiens
ggaaaaaauguuuuuaaacacacacacacacacacacacacacacacacauacacagacaaaaa

SEQ ID NO: 39366 - RNA, 64 nt, Homo Sapiens
aaaaaauguuuuuaaacacacacacacacacacacacacacacacacauacacagacaaaaaca

SEQ ID NO: 39367 - RNA, 64 nt, Homo Sapiens
aaaauguuuuuaaacacacacacacacacacacacacacacacacauacacagacaaaaacaca

SEQ ID NO: 39368 - RNA, 64 nt, Homo Sapiens
aauguuuuuaaacacacacacacacacacacacacacacacacauacacagacaaaaacacaaa

SEQ ID NO: 39369 - RNA, 64 nt, Homo Sapiens
uguuuuuaaacacacacacacacacacacacacacacacacauacacagacaaaaacacaaaaa

SEQ ID NO: 39370 - RNA, 64 nt, Homo Sapiens
uggugucauccugaaaaacaaaacccaguguuugcacacacacaaaaucuugaccccguuaucu

SEQ ID NO: 39371 - RNA, 64 nt, Homo Sapiens
gugucauccugaaaaacaaaacccaguguuugcacacacacaaaaucuugaccccguuaucuau

SEQ ID NO: 39372 - RNA, 64 nt, Homo Sapiens
cacagacccacggagcucucuguguuuggccucucacacacacacaggcccauagacagauggg

SEQ ID NO: 39373 - RNA, 64 nt, Homo Sapiens
cagacccacggagcucucuguguuuggccucucacacacacacaggcccauagacagaugggca

SEQ ID NO: 39374 - RNA, 64 nt, Homo Sapiens
gacccacggagcucucuguguuuggccucucacacacacacaggcccauagacagaugggcaga

SEQ ID NO: 39375 - RNA, 64 nt, Homo Sapiens
gcagggacuaccuuucuuauaaacccagggggaccacacacacacacacacacacacacacaca

SEQ ID NO: 39376 - RNA, 64 nt, Homo Sapiens
agggacuaccuuucuuauaaacccagggggaccacacacacacacacacacacacacacacaca

SEQ ID NO: 39377 - RNA, 64 nt, Homo Sapiens
ggacuaccuuucuuauaaacccagggggaccacacacacacacacacacacacacacacacaca

SEQ ID NO: 39378 - RNA, 64 nt, Homo Sapiens
acuaccuuucuuauaaacccagggggaccacacacacacacacacacacacacacacacacaca

SEQ ID NO: 39379 - RNA, 64 nt, Homo Sapiens
uaccuuucuuauaaacccagggggaccacacacacacacacacacacacacacacacacacaca

SEQ ID NO: 39380 - RNA, 64 nt, Homo Sapiens
ccuuucuuauaaacccagggggaccacacacacacacacacacacacacacacacacacacaca

SEQ ID NO: 39381 - RNA, 64 nt, Homo Sapiens
uuucuuauaaacccagggggaccacacacacacacacacacacacacacacacacacacacaca

SEQ ID NO: 39382 - RNA, 64 nt, Homo Sapiens
ucuuauaaacccagggggaccacacacacacacacacacacacacacacacacacacacacaca

SEQ ID NO: 39383 - RNA, 64 nt, Homo Sapiens
uuauaaacccagggggaccacacacacacacacacacacacacacacacacacacacacacaca

SEQ ID NO: 39384 - RNA, 64 nt, Homo Sapiens
auaaacccagggggaccacacacacacacacacacacacacacacacacacacacacacacaca

SEQ ID NO: 39385 - RNA, 64 nt, Homo Sapiens
aaacccagggggaccacacacacacacacacacacacacacacacacacacacacacacacaca

SEQ ID NO: 39386 - RNA, 64 nt, Homo Sapiens
acccagggggaccacacacacacacacacacacacacacacacacacacacacacacacacacu

SEQ ID NO: 39387 - RNA, 64 nt, Homo Sapiens
ccagggggaccacacacacacacacacacacacacacacacacacacacacacacacacacucu

SEQ ID NO: 39388 - RNA, 64 nt, Homo Sapiens
agggggaccacacacacacacacacacacacacacacacacacacacacacacacacacucuug

SEQ ID NO: 39389 - RNA, 64 nt, Homo Sapiens
ggggaccacacacacacacacacacacacacacacacacacacacacacacacacacucuugau

SEQ ID NO: 39390 - RNA, 64 nt, Homo Sapiens
ggaccacacacacacacacacacacacacacacacacacacacacacacacacacucuugaucc

SEQ ID NO: 39391 - RNA, 64 nt, Homo Sapiens
accacacacacacacacacacacacacacacacacacacacacacacacacacucuugaucccu

SEQ ID NO: 39392 - RNA, 64 nt, Homo Sapiens
cacacacacacacacacacacacacacacacacacacacacacacacacacucuugaucccuug

SEQ ID NO: 39393 - RNA, 64 nt, Homo Sapiens
cacacacacacacacacacacacacacacacacacacacacacacacacucuugaucccuugcu

SEQ ID NO: 39394 - RNA, 64 nt, Homo Sapiens
cacacacacacacacacacacacacacacacacacacacacacacacucuugaucccuugcuuc

SEQ ID NO: 39395 - RNA, 64 nt, Homo Sapiens
cacacacacacacacacacacacacacacacacacacacacacacucuugaucccuugcuuccc

SEQ ID NO: 39396 - RNA, 64 nt, Homo Sapiens
cacacacacacacacacacacacacacacacacacacacacacucuugaucccuugcuucccuc

SEQ ID NO: 39397 - RNA, 64 nt, Homo Sapiens
cauguacauacaugcacauacucaaacaugcguacacacacacacauuuacacacgcaggacuc

SEQ ID NO: 39398 - RNA, 64 nt, Homo Sapiens
uguacauacaugcacauacucaaacaugcguacacacacacacauuuacacacgcaggacucug

SEQ ID NO: 39399 - RNA, 64 nt, Homo Sapiens
uacauacaugcacauacucaaacaugcguacacacacacacauuuacacacgcaggacucugga

SEQ ID NO: 39400 - RNA, 64 nt, Homo Sapiens
auauagaaauauauacgaacaaaacacacgcgcgcacacacacacauacacgaaagagagagaa

SEQ ID NO: 39401 - RNA, 64 nt, Homo Sapiens
auagaaauauauacgaacaaaacacacgcgcgcacacacacacauacacgaaagagagagaaac

SEQ ID NO: 39402 - RNA, 64 nt, Homo Sapiens
agaaauauauacgaacaaaacacacgcgcgcacacacacacauacacgaaagagagagaaacaa

SEQ ID NO: 39403 - RNA, 64 nt, Homo Sapiens
caacuuguuucuuaguucauauaaucucgggauacacacacacacacacauauauauacacaca

SEQ ID NO: 39404 - RNA, 64 nt, Homo Sapiens
acuuguuucuuaguucauauaaucucgggauacacacacacacacacauauauauacacacaca

SEQ ID NO: 39405 - RNA, 64 nt, Homo Sapiens
uuguuucuuaguucauauaaucucgggauacacacacacacacacauauauauacacacacaua

SEQ ID NO: 39406 - RNA, 64 nt, Homo Sapiens
guuucuuaguucauauaaucucgggauacacacacacacacacauauauauacacacacauacg

SEQ ID NO: 39407 - RNA, 64 nt, Homo Sapiens
uucuuaguucauauaaucucgggauacacacacacacacacauauauauacacacacauacgua

SEQ ID NO: 39408 - RNA, 64 nt, Homo Sapiens
ucucgggauacacacacacacacacauauauauacacacacauacguauacacacacauacaua

SEQ ID NO: 39409 - RNA, 64 nt, Homo Sapiens
cacacacacauauauauacacacacauacguauacacacacauacauauauauaaauauaccug

SEQ ID NO: 39410 - RNA, 64 nt, Homo Sapiens
ccuucccacggcgugucccacggccagacacaugcacacacaucacacccucaaacacccagcu

SEQ ID NO: 39411 - RNA, 64 nt, Homo Sapiens
cacacacaucacacccucaaacacccagcucagccacacacaacuacccuccaaaccaccacag

SEQ ID NO: 39412 - RNA, 64 nt, Homo Sapiens
gaaucaugcagggaagggucugccccugcccuggcacacacaggcacccauucccucccccugc

SEQ ID NO: 39413 - RNA, 64 nt, Homo Sapiens
cccugcugacauguguaugcguaugcauacacaccacacacacacacaugcacaagucaugugc

SEQ ID NO: 39414 - RNA, 64 nt, Homo Sapiens
cugcugacauguguaugcguaugcauacacaccacacacacacacaugcacaagucaugugcga

SEQ ID NO: 39415 - RNA, 64 nt, Homo Sapiens
gcugacauguguaugcguaugcauacacaccacacacacacacaugcacaagucaugugcgaac

SEQ ID NO: 39416 - RNA, 64 nt, Homo Sapiens
ugacauguguaugcguaugcauacacaccacacacacacacaugcacaagucaugugcgaacag

SEQ ID NO: 39417 - RNA, 64 nt, Homo Sapiens
uuucuggauuuauacguaaucacuccugccccaacacacacacacacacacacacacacacaca

SEQ ID NO: 39418 - RNA, 64 nt, Homo Sapiens
ucuggauuuauacguaaucacuccugccccaacacacacacacacacacacacacacacacaca

SEQ ID NO: 39419 - RNA, 64 nt, Homo Sapiens
uggauuuauacguaaucacuccugccccaacacacacacacacacacacacacacacacacaca

SEQ ID NO: 39420 - RNA, 64 nt, Homo Sapiens
gauuuauacguaaucacuccugccccaacacacacacacacacacacacacacacacacacaca

SEQ ID NO: 39421 - RNA, 64 nt, Homo Sapiens
uuuauacguaaucacuccugccccaacacacacacacacacacacacacacacacacacacaug

SEQ ID NO: 39422 - RNA, 64 nt, Homo Sapiens
uauacguaaucacuccugccccaacacacacacacacacacacacacacacacacacacaugca

SEQ ID NO: 39423 - RNA, 64 nt, Homo Sapiens
uacguaaucacuccugccccaacacacacacacacacacacacacacacacacacacaugcacg

SEQ ID NO: 39424 - RNA, 64 nt, Homo Sapiens
cguaaucacuccugccccaacacacacacacacacacacacacacacacacacacaugcacgca

SEQ ID NO: 39425 - RNA, 64 nt, Homo Sapiens
uaaucacuccugccccaacacacacacacacacacacacacacacacacacacaugcacgcaca

SEQ ID NO: 39426 - RNA, 64 nt, Homo Sapiens
aucacuccugccccaacacacacacacacacacacacacacacacacacacaugcacgcacaca

SEQ ID NO: 39427 - RNA, 64 nt, Homo Sapiens
cacuccugccccaacacacacacacacacacacacacacacacacacacaugcacgcacacaug

SEQ ID NO: 39428 - RNA, 64 nt, Homo Sapiens
cuccugccccaacacacacacacacacacacacacacacacacacacaugcacgcacacaugau

SEQ ID NO: 39429 - RNA, 64 nt, Homo Sapiens
ccugccccaacacacacacacacacacacacacacacacacacacaugcacgcacacaugauuu

SEQ ID NO: 39430 - RNA, 64 nt, Homo Sapiens
ugccccaacacacacacacacacacacacacacacacacacacaugcacgcacacaugauuuug

SEQ ID NO: 39431 - RNA, 64 nt, Homo Sapiens
ccccaacacacacacacacacacacacacacacacacacacaugcacgcacacaugauuuugau

SEQ ID NO: 39432 - RNA, 64 nt, Homo Sapiens
agaagauuaagacagagaaacagacagaaagagacacacacacagccaggaguggguagauuuc

SEQ ID NO: 39433 - RNA, 64 nt, Homo Sapiens
aagauuaagacagagaaacagacagaaagagacacacacacagccaggaguggguagauuucag

SEQ ID NO: 39434 - RNA, 64 nt, Homo Sapiens
uggacuccuccuccauacuguaugugcaugcauucacacacacauauguacaugcacauagaug

SEQ ID NO: 39435 - RNA, 64 nt, Homo Sapiens
gacuccuccuccauacuguaugugcaugcauucacacacacauauguacaugcacauagaugag

SEQ ID NO: 39436 - RNA, 64 nt, Homo Sapiens
accuugagaguaaagugcugcccucugcccccaacacacacacauaucaauuccuggauuccuu

SEQ ID NO: 39437 - RNA, 64 nt, Homo Sapiens
cuugagaguaaagugcugcccucugcccccaacacacacacauaucaauuccuggauuccuuag

SEQ ID NO: 39438 - RNA, 64 nt, Homo Sapiens
uguguauacauauguaugugugaguguauguauacacacacacacacacacacacacacacuuu

SEQ ID NO: 39439 - RNA, 64 nt, Homo Sapiens
uguauacauauguaugugugaguguauguauacacacacacacacacacacacacacacuuuug

SEQ ID NO: 39440 - RNA, 64 nt, Homo Sapiens
uauacauauguaugugugaguguauguauacacacacacacacacacacacacacacuuuugca

SEQ ID NO: 39441 - RNA, 64 nt, Homo Sapiens
uacauauguaugugugaguguauguauacacacacacacacacacacacacacacuuuugcaag

SEQ ID NO: 39442 - RNA, 64 nt, Homo Sapiens
cauauguaugugugaguguauguauacacacacacacacacacacacacacacuuuugcaagag

SEQ ID NO: 39443 - RNA, 64 nt, Homo Sapiens
uauguaugugugaguguauguauacacacacacacacacacacacacacacuuuugcaagagug

SEQ ID NO: 39444 - RNA, 64 nt, Homo Sapiens
uguaugugugaguguauguauacacacacacacacacacacacacacacuuuugcaagagugau

SEQ ID NO: 39445 - RNA, 64 nt, Homo Sapiens
uaugugugaguguauguauacacacacacacacacacacacacacacuuuugcaagagugaugg

SEQ ID NO: 39446 - RNA, 64 nt, Homo Sapiens
ugugugaguguauguauacacacacacacacacacacacacacacuuuugcaagagugauggga

SEQ ID NO: 39447 - RNA, 64 nt, Homo Sapiens
ugugaguguauguauacacacacacacacacacacacacacacuuuugcaagagugaugggaaa

SEQ ID NO: 39448 - RNA, 64 nt, Homo Sapiens
ucucauucuucuaaaacuacugccuuucaaagugcacacacacgcguccacauacacugcauuc

SEQ ID NO: 39449 - RNA, 64 nt, Homo Sapiens
agaaacagcuacugcgugcgugcgcgcacgcauacacacacacacacacacacuggcacaggga

SEQ ID NO: 39450 - RNA, 64 nt, Homo Sapiens
aaacagcuacugcgugcgugcgcgcacgcauacacacacacacacacacacuggcacagggagg

SEQ ID NO: 39451 - RNA, 64 nt, Homo Sapiens
acagcuacugcgugcgugcgcgcacgcauacacacacacacacacacacuggcacagggaggcu

SEQ ID NO: 39452 - RNA, 64 nt, Homo Sapiens
agcuacugcgugcgugcgcgcacgcauacacacacacacacacacacuggcacagggaggcuac

SEQ ID NO: 39453 - RNA, 64 nt, Homo Sapiens
cuacugcgugcgugcgcgcacgcauacacacacacacacacacacuggcacagggaggcuacaa

SEQ ID NO: 39454 - RNA, 64 nt, Homo Sapiens
acugcgugcgugcgcgcacgcauacacacacacacacacacacuggcacagggaggcuacaacu

SEQ ID NO: 39455 - RNA, 64 nt, Homo Sapiens
aguacagacguguaaauccuuccaccccgacccgcacacacacccacacugcugcccuggcggg

SEQ ID NO: 39456 - RNA, 64 nt, Homo Sapiens
cccagguguacgcacgcgcgcgcgcgcgcacagacacacacacacacacacacacacacacaca

SEQ ID NO: 39457 - RNA, 64 nt, Homo Sapiens
cagguguacgcacgcgcgcgcgcgcgcacagacacacacacacacacacacacacacacacaca

SEQ ID NO: 39458 - RNA, 64 nt, Homo Sapiens
gguguacgcacgcgcgcgcgcgcgcacagacacacacacacacacacacacacacacacacaca

SEQ ID NO: 39459 - RNA, 64 nt, Homo Sapiens
uguacgcacgcgcgcgcgcgcgcacagacacacacacacacacacacacacacacacacacaca

SEQ ID NO: 39460 - RNA, 64 nt, Homo Sapiens
uacgcacgcgcgcgcgcgcgcacagacacacacacacacacacacacacacacacacacacagu

SEQ ID NO: 39461 - RNA, 64 nt, Homo Sapiens
cgcacgcgcgcgcgcgcgcacagacacacacacacacacacacacacacacacacacacaguaa

SEQ ID NO: 39462 - RNA, 64 nt, Homo Sapiens
cacgcgcgcgcgcgcgcacagacacacacacacacacacacacacacacacacacacaguaacc

SEQ ID NO: 39463 - RNA, 64 nt, Homo Sapiens
cgcgcgcgcgcgcgcacagacacacacacacacacacacacacacacacacacacaguaaccac

SEQ ID NO: 39464 - RNA, 64 nt, Homo Sapiens
cgcgcgcgcgcgcacagacacacacacacacacacacacacacacacacacacaguaaccacgg

SEQ ID NO: 39465 - RNA, 64 nt, Homo Sapiens
cgcgcgcgcgcacagacacacacacacacacacacacacacacacacacacaguaaccacgggu

SEQ ID NO: 39466 - RNA, 64 nt, Homo Sapiens
cgcgcgcgcacagacacacacacacacacacacacacacacacacacacaguaaccacggguag

SEQ ID NO: 39467 - RNA, 64 nt, Homo Sapiens
cgcgcgcacagacacacacacacacacacacacacacacacacacacaguaaccacggguaggc

SEQ ID NO: 39468 - RNA, 64 nt, Homo Sapiens
cgcgcacagacacacacacacacacacacacacacacacacacacaguaaccacggguaggcac

SEQ ID NO: 39469 - RNA, 64 nt, Homo Sapiens
cgcacagacacacacacacacacacacacacacacacacacacaguaaccacggguaggcacca

SEQ ID NO: 39470 - RNA, 64 nt, Homo Sapiens
cacagacacacacacacacacacacacacacacacacacacaguaaccacggguaggcaccagg

SEQ ID NO: 39471 - RNA, 64 nt, Homo Sapiens
acucacuauauacaaaucauuagguuaaaacagacacacacacacacacacacacacacacaca

SEQ ID NO: 39472 - RNA, 64 nt, Homo Sapiens
ucacuauauacaaaucauuagguuaaaacagacacacacacacacacacacacacacacacaca

SEQ ID NO: 39473 - RNA, 64 nt, Homo Sapiens
acuauauacaaaucauuagguuaaaacagacacacacacacacacacacacacacacacacaca

SEQ ID NO: 39474 - RNA, 64 nt, Homo Sapiens
uauauacaaaucauuagguuaaaacagacacacacacacacacacacacacacacacacacaca

SEQ ID NO: 39475 - RNA, 64 nt, Homo Sapiens
uauacaaaucauuagguuaaaacagacacacacacacacacacacacacacacacacacacaca

SEQ ID NO: 39476 - RNA, 64 nt, Homo Sapiens
uacaaaucauuagguuaaaacagacacacacacacacacacacacacacacacacacacacaca

SEQ ID NO: 39477 - RNA, 64 nt, Homo Sapiens
caaaucauuagguuaaaacagacacacacacacacacacacacacacacacacacacacacaca

SEQ ID NO: 39478 - RNA, 64 nt, Homo Sapiens
aaucauuagguuaaaacagacacacacacacacacacacacacacacacacacacacacacaca

SEQ ID NO: 39479 - RNA, 64 nt, Homo Sapiens
ucauuagguuaaaacagacacacacacacacacacacacacacacacacacacacacacacaca

SEQ ID NO: 39480 - RNA, 64 nt, Homo Sapiens
auuagguuaaaacagacacacacacacacacacacacacacacacacacacacacacacacaag

SEQ ID NO: 39481 - RNA, 64 nt, Homo Sapiens
uagguuaaaacagacacacacacacacacacacacacacacacacacacacacacacacaagac

SEQ ID NO: 39482 - RNA, 64 nt, Homo Sapiens
gguuaaaacagacacacacacacacacacacacacacacacacacacacacacacacaagaccu

SEQ ID NO: 39483 - RNA, 64 nt, Homo Sapiens
uuaaaacagacacacacacacacacacacacacacacacacacacacacacacacaagaccugg

SEQ ID NO: 39484 - RNA, 64 nt, Homo Sapiens
aaaacagacacacacacacacacacacacacacacacacacacacacacacacaagaccugggc

SEQ ID NO: 39485 - RNA, 64 nt, Homo Sapiens
aacagacacacacacacacacacacacacacacacacacacacacacacacaagaccugggccc

SEQ ID NO: 39486 - RNA, 64 nt, Homo Sapiens
cagacacacacacacacacacacacacacacacacacacacacacacacaagaccugggcccuu

SEQ ID NO: 39487 - RNA, 64 nt, Homo Sapiens
gacacacacacacacacacacacacacacacacacacacacacacacaagaccugggcccuuaa

SEQ ID NO: 39488 - RNA, 64 nt, Homo Sapiens
cacacacacacacacacacacacacacacacacacacacacacacaagaccugggcccuuaagu

SEQ ID NO: 39489 - RNA, 64 nt, Homo Sapiens
cacacacacacacacacacacacacacacacacacacacacacaagaccugggcccuuaaguuu

SEQ ID NO: 39490 - RNA, 64 nt, Homo Sapiens
cacacacacacacacacacacacacacacacacacacacacaagaccugggcccuuaaguuuac

SEQ ID NO: 39491 - RNA, 64 nt, Homo Sapiens
gugugugugugugugugugugugucucccucucucacacacacaagagcaguuugcuguugcug

SEQ ID NO: 39492 - RNA, 64 nt, Homo Sapiens
gugugugugugugugugugugucucccucucucacacacacaagagcaguuugcuguugcuguu

SEQ ID NO: 39493 - RNA, 64 nt, Homo Sapiens
aacuugaauuaagaccaaacagaacaugagaauacacacacacacacacauauacacacacaca

SEQ ID NO: 39494 - RNA, 64 nt, Homo Sapiens
cuugaauuaagaccaaacagaacaugagaauacacacacacacacacauauacacacacacaca

SEQ ID NO: 39495 - RNA, 64 nt, Homo Sapiens
ugaauuaagaccaaacagaacaugagaauacacacacacacacacauauacacacacacacacu

SEQ ID NO: 39496 - RNA, 64 nt, Homo Sapiens
aauuaagaccaaacagaacaugagaauacacacacacacacacauauacacacacacacacuuc

SEQ ID NO: 39497 - RNA, 64 nt, Homo Sapiens
uuaagaccaaacagaacaugagaauacacacacacacacacauauacacacacacacacuucac

SEQ ID NO: 39498 - RNA, 64 nt, Homo Sapiens
agaacaugagaauacacacacacacacacauauacacacacacacacuucacacauacacacca

SEQ ID NO: 39499 - RNA, 64 nt, Homo Sapiens
aacaugagaauacacacacacacacacauauacacacacacacacuucacacauacacaccacu

SEQ ID NO: 39500 - RNA, 64 nt, Homo Sapiens
caugagaauacacacacacacacacauauacacacacacacacuucacacauacacaccacucc

SEQ ID NO: 39501 - RNA, 64 nt, Homo Sapiens
agaaucauauauaguccagucuucauuuuacauacacacacauauuuuacacacacacacauuu

SEQ ID NO: 39502 - RNA, 64 nt, Homo Sapiens
ccagucuucauuuuacauacacacacauauuuuacacacacacacauuuuacacacacacacac

SEQ ID NO: 39503 - RNA, 64 nt, Homo Sapiens
agucuucauuuuacauacacacacauauuuuacacacacacacauuuuacacacacacacacac

SEQ ID NO: 39504 - RNA, 64 nt, Homo Sapiens
ucuucauuuuacauacacacacauauuuuacacacacacacauuuuacacacacacacacacac

SEQ ID NO: 39505 - RNA, 64 nt, Homo Sapiens
uacacacacauauuuuacacacacacacauuuuacacacacacacacacacacacacauauguu

SEQ ID NO: 39506 - RNA, 64 nt, Homo Sapiens
cacacacauauuuuacacacacacacauuuuacacacacacacacacacacacacauauguuuu

SEQ ID NO: 39507 - RNA, 64 nt, Homo Sapiens
cacacauauuuuacacacacacacauuuuacacacacacacacacacacacacauauguuuuuc

SEQ ID NO: 39508 - RNA, 64 nt, Homo Sapiens
cacauauuuuacacacacacacauuuuacacacacacacacacacacacacauauguuuuucua

SEQ ID NO: 39509 - RNA, 64 nt, Homo Sapiens
cauauuuuacacacacacacauuuuacacacacacacacacacacacacauauguuuuucuagu

SEQ ID NO: 39510 - RNA, 64 nt, Homo Sapiens
uauuuuacacacacacacauuuuacacacacacacacacacacacacauauguuuuucuagucu

SEQ ID NO: 39511 - RNA, 64 nt, Homo Sapiens
uuuuacacacacacacauuuuacacacacacacacacacacacacauauguuuuucuagucucu

SEQ ID NO: 39512 - RNA, 64 nt, Homo Sapiens
uuacacacacacacauuuuacacacacacacacacacacacacauauguuuuucuagucucugg

SEQ ID NO: 39513 - RNA, 64 nt, Homo Sapiens
acacacacacacauuuuacacacacacacacacacacacacauauguuuuucuagucucuggca

SEQ ID NO: 39514 - RNA, 64 nt, Homo Sapiens
uuucauaagauucaaccaaauaaauauauauauacacacacacauacauauacaccuauauaug

SEQ ID NO: 39515 - RNA, 64 nt, Homo Sapiens
ucauaagauucaaccaaauaaauauauauauacacacacacauacauauacaccuauauaugug

SEQ ID NO: 39516 - RNA, 64 nt, Homo Sapiens
uucaaguauauaugauuuaaaccugggcuacugacacacacacaguagccauuaguuagacucu

SEQ ID NO: 39517 - RNA, 64 nt, Homo Sapiens
caaguauauaugauuuaaaccugggcuacugacacacacacaguagccauuaguuagacucuuc

SEQ ID NO: 39518 - RNA, 64 nt, Homo Sapiens
ugggcaaagccacaaggcuggcaugccacccucacacacacagccugggcuggacuggaggugg

SEQ ID NO: 39519 - RNA, 64 nt, Homo Sapiens
gcugggcaaagccacaaggcgggcaugccacccucacacacacacccugggcuggacuggaggu

SEQ ID NO: 39520 - RNA, 64 nt, Homo Sapiens
cauacacacauacgacacacugcuggggcacacacacacacaugggucaggaggccuucaccgc

SEQ ID NO: 39521 - RNA, 64 nt, Homo Sapiens
ugcauacacacauacgacacgcugcuggggcacacacacacacaagggucaggaggccuucacc

SEQ ID NO: 39522 - RNA, 64 nt, Homo Sapiens
caugcauacacacauacgacccgcugcuggggcacacacacacauaagggucaggaggccuuca

SEQ ID NO: 39523 - RNA, 64 nt, Homo Sapiens
cacaugcauacacacauacgcaccgcugcuggggcacacacacaucuaagggucaggaggccuu

SEQ ID NO: 39524 - RNA, 64 nt, Homo Sapiens
ucuccuucauucacguccuaugaucacacacaaacacacacaccuguguguguguguaugggcc

SEQ ID NO: 39525 - RNA, 64 nt, Homo Sapiens
cacacacaccucuccuucauuguaugggccugaucacacacaaagaucugugugugugugugug

SEQ ID NO: 39526 - RNA, 64 nt, Homo Sapiens
cacacacgacugaaucagaucacacacacacacacacacacauacuuucuuggcuggcaacaca

SEQ ID NO: 39527 - RNA, 64 nt, Homo Sapiens
uacacacacgacugaaucagcacacacacacacacacacacacagccuuucuuggcuggcaaca

SEQ ID NO: 39528 - RNA, 64 nt, Homo Sapiens
cauacacacacgacugaauccacacacacacacacacacacacaaagccuuucuuggcuggcaa

SEQ ID NO: 39529 - RNA, 64 nt, Homo Sapiens
cacauacacacacgacugaaaacacacacacacacacacacacaggaagccuuucuuggcuggc

SEQ ID NO: 39530 - RNA, 64 nt, Homo Sapiens
cacacauacacacacgacuggcaacacacacacacacacacacaagggaagccuuucuuggcug

SEQ ID NO: 39531 - RNA, 64 nt, Homo Sapiens
cacacacauacacacacgacuggcaacacacacacacacacacaauagggaagccuuucuuggc

SEQ ID NO: 39532 - RNA, 64 nt, Homo Sapiens
cacacacacauacacacacggcuggcaacacacacacacacacauuauagggaagccuuucuug

SEQ ID NO: 39533 - RNA, 64 nt, Homo Sapiens
cacacacacacauacacacauggcuggcaacacacacacacacaccuuauagggaagccuuucu

SEQ ID NO: 39534 - RNA, 64 nt, Homo Sapiens
cacacacacacacauacacacuuggcuggcaacacacacacacacuccuuauagggaagccuuu

SEQ ID NO: 39535 - RNA, 64 nt, Homo Sapiens
cacacacacacacacauacauucuuggcuggcaacacacacacaaacuccuuauagggaagccu

SEQ ID NO: 39536 - RNA, 64 nt, Homo Sapiens
ugaggccaccagaagacacuuacacacacacacacacacacaccacagacaccacacacacaca

SEQ ID NO: 39537 - RNA, 64 nt, Homo Sapiens
ccugaggccaccagaagacacauacacacacacacacacacacaacacagacaccacacacaca

SEQ ID NO: 39538 - RNA, 64 nt, Homo Sapiens
caccugaggccaccagaagacacauacacacacacacacacacaagacacagacaccacacaca

SEQ ID NO: 39539 - RNA, 64 nt, Homo Sapiens
cacaccugaggccaccagaacacacauacacacacacacacacagcagacacagacaccacaca

SEQ ID NO: 39540 - RNA, 64 nt, Homo Sapiens
cacacaccugaggccaccagcacacacauacacacacacacacaacgcagacacagacaccaca

SEQ ID NO: 39541 - RNA, 64 nt, Homo Sapiens
cacacacaccugaggccacccacacacacauacacacacacacaacacgcagacacagacacca

SEQ ID NO: 39542 - RNA, 64 nt, Homo Sapiens
cacacacacaccugaggccacacacacacacauacacacacacaacacacgcagacacagacac

SEQ ID NO: 39543 - RNA, 64 nt, Homo Sapiens
cacacacacacacacacacaacacagacaccacacacacacauaguguucauguacacacgcag

SEQ ID NO: 39544 - RNA, 64 nt, Homo Sapiens
uacacacacacacacacacaagacacagacaccacacacacacaguguguucauguacacacgc

SEQ ID NO: 39545 - RNA, 64 nt, Homo Sapiens
cauacacacacacacacacagcagacacagacaccacacacacaauguguguucauguacacac

SEQ ID NO: 39546 - RNA, 64 nt, Homo Sapiens
ccaauccauccaugcauacagggggcaaagcauacacacacacucuuuccugaacuggaacguc

SEQ ID NO: 39547 - RNA, 64 nt, Homo Sapiens
gaugaccugggacaugauuuccaccucccccgcacacacacaaauacaugccuuuuccucccau

SEQ ID NO: 39548 - RNA, 64 nt, Homo Sapiens
aagaugaccugggacaugauauccaccucccccgcacacacacaaauacaugccuuuuccuccc

SEQ ID NO: 39549 - RNA, 64 nt, Homo Sapiens
aagaugaauauauauauauagauauauauacacacacacacagaagauuuuauaugugugugug

SEQ ID NO: 39550 - RNA, 64 nt, Homo Sapiens
gaaagaugaauauauauauauggauauauauacacacacacacaauagauuuuauaugugugug

SEQ ID NO: 39551 - RNA, 64 nt, Homo Sapiens
cagaaagaugaauauauauauguggauauauauacacacacacacaauagauuuuauaugugug

SEQ ID NO: 39552 - RNA, 64 nt, Homo Sapiens
cauauucauacacaauucauuauacauacgugcacacacacauacacauacagacagaccuacc

SEQ ID NO: 39553 - RNA, 64 nt, Homo Sapiens
uacauauucauacacaauucccuauacauacgugcacacacacacccacauacagacagaccua

SEQ ID NO: 39554 - RNA, 64 nt, Homo Sapiens
uccauggacccaggucuugccuuauaugcacacacacacacauuuaguuccucaagcauaugug

SEQ ID NO: 39555 - RNA, 64 nt, Homo Sapiens
uuuccauggacccaggucuuugcuuauaugcacacacacacacauuuaguuccucaagcauaug

SEQ ID NO: 39556 - RNA, 64 nt, Homo Sapiens
cauuuccauggacccaggucugugcuuauaugcacacacacacagcuuuaguuccucaagcaua

SEQ ID NO: 39557 - RNA, 64 nt, Homo Sapiens
cacauuuccauggacccagguaugugcuuauaugcacacacacauggcuuuaguuccucaagca

SEQ ID NO: 39558 - RNA, 64 nt, Homo Sapiens
cauacacacucucucacucuauguacacacacaccacacacauagguacuuugugacagaagac

SEQ ID NO: 39559 - RNA, 64 nt, Homo Sapiens
acacacauacauacacacucacagaagacauguacacacacaccgacuauugugguacuuugug

SEQ ID NO: 39560 - RNA, 64 nt, Homo Sapiens
uuuuguuucuuucagguagaccgccacacauacacacacacacuugaauaaucuuccaucuucc

SEQ ID NO: 39561 - RNA, 64 nt, Homo Sapiens
cuuuuuguuucuuucagguaccccgccacacauacacacacacaugugaauaaucuuccaucuu

SEQ ID NO: 39562 - RNA, 64 nt, Homo Sapiens
agacuggcaacuguuuuguaauucuuucuagacacacacacaucagaacucuuuauuuucuauc

SEQ ID NO: 39563 - RNA, 64 nt, Homo Sapiens
ucagacuggcaacuguuuugucauucuuucuagacacacacacacaagaacucuuuauuuucua

SEQ ID NO: 39564 - RNA, 64 nt, Homo Sapiens
gcacacaacuccuaugacugcacacacacgugugcacacacaauuguguguauguauguacaca

SEQ ID NO: 39565 - RNA, 64 nt, Homo Sapiens
ugugcacacacaaugcacacuauguauguacacacacacacacguucuccccacugaaugugug

SEQ ID NO: 39566 - RNA, 64 nt, Homo Sapiens
cgugugcacacacaaugcacuguauguauguacacacacacacaaguucuccccacugaaugug

SEQ ID NO: 39567 - RNA, 64 nt, Homo Sapiens
cacgugugcacacacaaugcuguguauguauguacacacacacaugaguucuccccacugaaug

SEQ ID NO: 39568 - RNA, 64 nt, Homo Sapiens
cuuuuaggggacuaagagagcacacacacacacacacacacacugacacacacacacacacaca

SEQ ID NO: 39569 - RNA, 64 nt, Homo Sapiens
cucuuuuaggggacuaagagcacacacacacacacacacacacacugacacacacacacacaca

SEQ ID NO: 39570 - RNA, 64 nt, Homo Sapiens
cacucuuuuaggggacuaagcacacacacacacacacacacacaaacugacacacacacacaca

SEQ ID NO: 39571 - RNA, 64 nt, Homo Sapiens
cacacucuuuuaggggacuacacacacacacacacacacacacacaaacugacacacacacaca

SEQ ID NO: 39572 - RNA, 64 nt, Homo Sapiens
cacacacucuuuuaggggaccacacacacacacacacacacacacucaaacugacacacacaca

SEQ ID NO: 39573 - RNA, 64 nt, Homo Sapiens
cacacacacucuuuuaggggcacacacacacacacacacacacauccucaaacugacacacaca

SEQ ID NO: 39574 - RNA, 64 nt, Homo Sapiens
cacacacacacucuuuuaggcacacacacacacacacacacacaucuccucaaacugacacaca

SEQ ID NO: 39575 - RNA, 64 nt, Homo Sapiens
cacacacacacacucuuuuacacacacacacacacacacacacaacucuccucaaacugacaca

SEQ ID NO: 39576 - RNA, 64 nt, Homo Sapiens
cacacacacacacacucuuucacacacacacacacacacacacacuacucuccucaaacugaca

SEQ ID NO: 39577 - RNA, 64 nt, Homo Sapiens
cacacacacacacacacucucacacacacacacacacacacacauucuacucuccucaaacuga

SEQ ID NO: 39578 - RNA, 64 nt, Homo Sapiens
cacacacacacacacacacugacacacacacacacacacacacaaauucuacucuccucaaacu

SEQ ID NO: 39579 - RNA, 64 nt, Homo Sapiens
cacacacacacacacacacacugacacacacacacacacacacaccaauucuacucuccucaaa

SEQ ID NO: 39580 - RNA, 64 nt, Homo Sapiens
cacacacacacacacacacaaacugacacacacacacacacacagcccaauucuacucuccuca

SEQ ID NO: 39581 - RNA, 64 nt, Homo Sapiens
cacacacacacacacacacacaaacugacacacacacacacacacagcccaauucuacucuccu

SEQ ID NO: 39582 - RNA, 64 nt, Homo Sapiens
cacacacacacacacacacacucaaacugacacacacacacacaaccagcccaauucuacucuc

SEQ ID NO: 39583 - RNA, 64 nt, Homo Sapiens
cacacacacacacacacacauccucaaacugacacacacacacauuaccagcccaauucuacuc

SEQ ID NO: 39584 - RNA, 64 nt, Homo Sapiens
cacacacacacacacacacaucuccucaaacugacacacacacaacuuaccagcccaauucuac

SEQ ID NO: 39585 - RNA, 64 nt, Homo Sapiens
cccuacucuucauuugcuagcacacacacacacacacacacacgcacacacacacacacacaca

SEQ ID NO: 39586 - RNA, 64 nt, Homo Sapiens
cgcccuacucuucauuugcucacacacacacacacacacacacacacacacacacacacacaca

SEQ ID NO: 39587 - RNA, 64 nt, Homo Sapiens
cacgcccuacucuucauuugcacacacacacacacacacacacacacacacacacacacacaca

SEQ ID NO: 39588 - RNA, 64 nt, Homo Sapiens
cacacgcccuacucuucauucacacacacacacacacacacacacacacacacacacacacaca

SEQ ID NO: 39589 - RNA, 64 nt, Homo Sapiens
cacacacgcccuacucuucacacacacacacacacacacacacaaacacacacacacacacaca

SEQ ID NO: 39590 - RNA, 64 nt, Homo Sapiens
cacacacacgcccuacucuucacacacacacacacacacacacacaaacacacacacacacaca

SEQ ID NO: 39591 - RNA, 64 nt, Homo Sapiens
cacacacacacgcccuacuccacacacacacacacacacacacacccaaacacacacacacaca

SEQ ID NO: 39592 - RNA, 64 nt, Homo Sapiens
cacacacacacacgcccuaccacacacacacacacacacacacacccccaaacacacacacaca

SEQ ID NO: 39593 - RNA, 64 nt, Homo Sapiens
cacacacacacacacgcccucacacacacacacacacacacacaaccccccaaacacacacaca

SEQ ID NO: 39594 - RNA, 64 nt, Homo Sapiens
cacacacacacacacacgcccacacacacacacacacacacacacuaccccccaaacacacaca

SEQ ID NO: 39595 - RNA, 64 nt, Homo Sapiens
cacacacacacacacacacgcacacacacacacacacacacacacccuaccccccaaacacaca

SEQ ID NO: 39596 - RNA, 64 nt, Homo Sapiens
cacacacacacacacacacacacacacacacacacacacacacacccccuaccccccaaacaca

SEQ ID NO: 39597 - RNA, 64 nt, Homo Sapiens
cacacacacacacacacacacacacacacacacacacacacacacacccccuaccccccaaaca

SEQ ID NO: 39598 - RNA, 64 nt, Homo Sapiens
cacacacacacacacacacacacacacacacacacacacacacacgcacccccuaccccccaaa

SEQ ID NO: 39599 - RNA, 64 nt, Homo Sapiens
cacacacacacacacacacaaacacacacacacacacacacacagccgcacccccuacccccca

SEQ ID NO: 39600 - RNA, 64 nt, Homo Sapiens
cacacacacacacacacacacaaacacacacacacacacacacaucgccgcacccccuaccccc

SEQ ID NO: 39601 - RNA, 64 nt, Homo Sapiens
cacacacacacacacacacacccaaacacacacacacacacacacaucgccgcacccccuaccc

SEQ ID NO: 39602 - RNA, 64 nt, Homo Sapiens
cacacacacacacacacacacccccaaacacacacacacacacacccaucgccgcacccccuac

SEQ ID NO: 39603 - RNA, 64 nt, Homo Sapiens
cacacacacacacacacacaaccccccaaacacacacacacacauucccaucgccgcacccccu

SEQ ID NO: 39604 - RNA, 64 nt, Homo Sapiens
cacacacacacacacacacacuaccccccaaacacacacacacacauucccaucgccgcacccc

SEQ ID NO: 39605 - RNA, 64 nt, Homo Sapiens
cacacacacacacacacacacccuaccccccaaacacacacacauccauucccaucgccgcacc

SEQ ID NO: 39606 - RNA, 64 nt, Homo Sapiens
uagcaguagcagcagcagcacgcacgcacauacacacacacauacacacaugcgugugcacccg

SEQ ID NO: 39607 - RNA, 64 nt, Homo Sapiens
uauagcaguagcagcagcagcgcgcacgcacauacacacacacacgcacacaugcgugugcacc

SEQ ID NO: 39608 - RNA, 64 nt, Homo Sapiens
cacacaugcgugugcacccgcacacacgcacacacacacacacgccuccacuucuucagcacca

SEQ ID NO: 39609 - RNA, 64 nt, Homo Sapiens
cgcacacaugcgugugcacccacacacacgcacacacacacacaaaccuccacuucuucagcac

SEQ ID NO: 39610 - RNA, 64 nt, Homo Sapiens
cacgcacacaugcgugugcaaccacacacacgcacacacacacagcaaccuccacuucuucagc

SEQ ID NO: 39611 - RNA, 64 nt, Homo Sapiens
cacacgcacacaugcguguggcaccacacacacgcacacacacaaagcaaccuccacuucuuca

SEQ ID NO: 39612 - RNA, 64 nt, Homo Sapiens
cacacacacacacacgcacacacuucuucagcaccacacacacgagagaaggccaagcaaccuc

SEQ ID NO: 39613 - RNA, 64 nt, Homo Sapiens
uauaucuauuuaugcacauauacacacacacacacacacacacgauuauauauauauauauaua

SEQ ID NO: 39614 - RNA, 64 nt, Homo Sapiens
cguauaucuauuuaugcacauauacacacacacacacacacacaacauuauauauauauauaua

SEQ ID NO: 39615 - RNA, 64 nt, Homo Sapiens
cacguauaucuauuuaugcauauauacacacacacacacacacaacacauuauauauauauaua

SEQ ID NO: 39616 - RNA, 64 nt, Homo Sapiens
cacacguauaucuauuuauguauauauacacacacacacacacaacacacauuauauauauaua

SEQ ID NO: 39617 - RNA, 64 nt, Homo Sapiens
cacacacguauaucuauuuauauauauauacacacacacacacaacacacacauuauauauaua

SEQ ID NO: 39618 - RNA, 64 nt, Homo Sapiens
cacacacacguauaucuauuuauauauauauacacacacacacaauacacacacauuauauaua

SEQ ID NO: 39619 - RNA, 64 nt, Homo Sapiens
cacacacacacguauaucuauauauauauauauacacacacacaauauacacacacauuauaua

SEQ ID NO: 39620 - RNA, 64 nt, Homo Sapiens
auauauauauauauauauacaaaaauaugauauacacacacauuggcagcucuuaaaacuaaga

SEQ ID NO: 39621 - RNA, 64 nt, Homo Sapiens
cuccaaaagaggaaagaaaauacuccucccaccacacacacaugaaaaguuuacugccaugaaa

SEQ ID NO: 39622 - RNA, 64 nt, Homo Sapiens
ugcuccaaaagaggaaagaaaauacuccucccaccacacacacauuaaaaguuuacugccauga

SEQ ID NO: 39623 - RNA, 64 nt, Homo Sapiens
aaaagagagcucccuuagggaaaaaugaccaaaacacacacacacauuuacaauggacugcugg

SEQ ID NO: 39624 - RNA, 64 nt, Homo Sapiens
aagagagcucccuuagggaaaaaugaccaaaacacacacacacauuuacaauggacugcuggug

SEQ ID NO: 39625 - RNA, 64 nt, Homo Sapiens
gagagcucccuuagggaaaaaugaccaaaacacacacacacauuuacaauggacugcuggugca

SEQ ID NO: 39626 - RNA, 64 nt, Homo Sapiens
aaagucucaauguuccauucagucugcagcuauucacacacacacacacacacacacacacaca

SEQ ID NO: 39627 - RNA, 64 nt, Homo Sapiens
agucucaauguuccauucagucugcagcuauucacacacacacacacacacacacacacacaca

SEQ ID NO: 39628 - RNA, 64 nt, Homo Sapiens
ucucaauguuccauucagucugcagcuauucacacacacacacacacacacacacacacacaca

SEQ ID NO: 39629 - RNA, 64 nt, Homo Sapiens
ucaauguuccauucagucugcagcuauucacacacacacacacacacacacacacacacacaca

SEQ ID NO: 39630 - RNA, 64 nt, Homo Sapiens
aauguuccauucagucugcagcuauucacacacacacacacacacacacacacacacacacaca

SEQ ID NO: 39631 - RNA, 64 nt, Homo Sapiens
uguuccauucagucugcagcuauucacacacacacacacacacacacacacacacacacacaca

SEQ ID NO: 39632 - RNA, 64 nt, Homo Sapiens
uuccauucagucugcagcuauucacacacacacacacacacacacacacacacacacacacaca

SEQ ID NO: 39633 - RNA, 64 nt, Homo Sapiens
ccauucagucugcagcuauucacacacacacacacacacacacacacacacacacacacacaca

SEQ ID NO: 39634 - RNA, 64 nt, Homo Sapiens
auucagucugcagcuauucacacacacacacacacacacacacacacacacacacacacacaca

SEQ ID NO: 39635 - RNA, 64 nt, Homo Sapiens
ucagucugcagcuauucacacacacacacacacacacacacacacacacacacacacacacaaa

SEQ ID NO: 39636 - RNA, 64 nt, Homo Sapiens
agucugcagcuauucacacacacacacacacacacacacacacacacacacacacacacaaaua

SEQ ID NO: 39637 - RNA, 64 nt, Homo Sapiens
ucugcagcuauucacacacacacacacacacacacacacacacacacacacacacacaaauauu

SEQ ID NO: 39638 - RNA, 64 nt, Homo Sapiens
ugcagcuauucacacacacacacacacacacacacacacacacacacacacacacaaauauugc

SEQ ID NO: 39639 - RNA, 64 nt, Homo Sapiens
cagcuauucacacacacacacacacacacacacacacacacacacacacacacaaauauugcuu

SEQ ID NO: 39640 - RNA, 64 nt, Homo Sapiens
gcuauucacacacacacacacacacacacacacacacacacacacacacacaaauauugcuugg

SEQ ID NO: 39641 - RNA, 64 nt, Homo Sapiens
uauucacacacacacacacacacacacacacacacacacacacacacacaaauauugcuuggac

SEQ ID NO: 39642 - RNA, 64 nt, Homo Sapiens
uucacacacacacacacacacacacacacacacacacacacacacacaaauauugcuuggacua

SEQ ID NO: 39643 - RNA, 64 nt, Homo Sapiens
cacacacacacacacacacacacacacacacacacacacacacacaaauauugcuuggacuacc

SEQ ID NO: 39644 - RNA, 64 nt, Homo Sapiens
cacacacacacacacacacacacacacacacacacacacacacaaauauugcuuggacuaccua

SEQ ID NO: 39645 - RNA, 64 nt, Homo Sapiens
cacacacacacacacacacacacacacacacacacacacacaaauauugcuuggacuaccuaua

SEQ ID NO: 39646 - RNA, 64 nt, Homo Sapiens
cgcacaaucuacacugccuuaccuucacuuaaaccacacacacaaggugcucagacaugaaaug

SEQ ID NO: 39647 - RNA, 64 nt, Homo Sapiens
cacaaucuacacugccuuaccuucacuuaaaccacacacacaaggugcucagacaugaaaugua

SEQ ID NO: 39648 - RNA, 64 nt, Homo Sapiens
acuccccuugccuuccccugucuucaccugccaccacacacacacacacacacacacacacaca

SEQ ID NO: 39649 - RNA, 64 nt, Homo Sapiens
uccccuugccuuccccugucuucaccugccaccacacacacacacacacacacacacacacaca

SEQ ID NO: 39650 - RNA, 64 nt, Homo Sapiens
cccuugccuuccccugucuucaccugccaccacacacacacacacacacacacacacacacaca

SEQ ID NO: 39651 - RNA, 64 nt, Homo Sapiens
cuugccuuccccugucuucaccugccaccacacacacacacacacacacacacacacacacaca

SEQ ID NO: 39652 - RNA, 64 nt, Homo Sapiens
ugccuuccccugucuucaccugccaccacacacacacacacacacacacacacacacacacacg

SEQ ID NO: 39653 - RNA, 64 nt, Homo Sapiens
ccuuccccugucuucaccugccaccacacacacacacacacacacacacacacacacacacgca

SEQ ID NO: 39654 - RNA, 64 nt, Homo Sapiens
uuccccugucuucaccugccaccacacacacacacacacacacacacacacacacacacgcacg

SEQ ID NO: 39655 - RNA, 64 nt, Homo Sapiens
ccccugucuucaccugccaccacacacacacacacacacacacacacacacacacacgcacggc

SEQ ID NO: 39656 - RNA, 64 nt, Homo Sapiens
ccugucuucaccugccaccacacacacacacacacacacacacacacacacacacgcacggcuu

SEQ ID NO: 39657 - RNA, 64 nt, Homo Sapiens
ugucuucaccugccaccacacacacacacacacacacacacacacacacacacgcacggcuucc

SEQ ID NO: 39658 - RNA, 64 nt, Homo Sapiens
ucuucaccugccaccacacacacacacacacacacacacacacacacacacgcacggcuuccua

SEQ ID NO: 39659 - RNA, 64 nt, Homo Sapiens
uucaccugccaccacacacacacacacacacacacacacacacacacacgcacggcuuccuaua

SEQ ID NO: 39660 - RNA, 64 nt, Homo Sapiens
caccugccaccacacacacacacacacacacacacacacacacacacgcacggcuuccuauaac

SEQ ID NO: 39661 - RNA, 64 nt, Homo Sapiens
ccugccaccacacacacacacacacacacacacacacacacacacgcacggcuuccuauaacuu

SEQ ID NO: 39662 - RNA, 64 nt, Homo Sapiens
ugccaccacacacacacacacacacacacacacacacacacacgcacggcuuccuauaacuucu

SEQ ID NO: 39663 - RNA, 64 nt, Homo Sapiens
gcaguguuagaggaggagaugggagcggugacuacacacacacacacacacacacacacacaca

SEQ ID NO: 39664 - RNA, 64 nt, Homo Sapiens
aguguuagaggaggagaugggagcggugacuacacacacacacacacacacacacacacacaca

SEQ ID NO: 39665 - RNA, 64 nt, Homo Sapiens
uguuagaggaggagaugggagcggugacuacacacacacacacacacacacacacacacacaaa

SEQ ID NO: 39666 - RNA, 64 nt, Homo Sapiens
uuagaggaggagaugggagcggugacuacacacacacacacacacacacacacacacacaaaca

SEQ ID NO: 39667 - RNA, 64 nt, Homo Sapiens
agaggaggagaugggagcggugacuacacacacacacacacacacacacacacacacaaacaug

SEQ ID NO: 39668 - RNA, 64 nt, Homo Sapiens
aggaggagaugggagcggugacuacacacacacacacacacacacacacacacacaaacaugca

SEQ ID NO: 39669 - RNA, 64 nt, Homo Sapiens
gaggagaugggagcggugacuacacacacacacacacacacacacacacacacaaacaugcaca

SEQ ID NO: 39670 - RNA, 64 nt, Homo Sapiens
ggagaugggagcggugacuacacacacacacacacacacacacacacacacaaacaugcacaca

SEQ ID NO: 39671 - RNA, 64 nt, Homo Sapiens
agaugggagcggugacuacacacacacacacacacacacacacacacacaaacaugcacacaca

SEQ ID NO: 39672 - RNA, 64 nt, Homo Sapiens
augggagcggugacuacacacacacacacacacacacacacacacacaaacaugcacacacaca

SEQ ID NO: 39673 - RNA, 64 nt, Homo Sapiens
gggagcggugacuacacacacacacacacacacacacacacacacaaacaugcacacacacaua

SEQ ID NO: 39674 - RNA, 64 nt, Homo Sapiens
gagcggugacuacacacacacacacacacacacacacacacacaaacaugcacacacacauaug

SEQ ID NO: 39675 - RNA, 64 nt, Homo Sapiens
gcggugacuacacacacacacacacacacacacacacacacaaacaugcacacacacauaugca

SEQ ID NO: 39676 - RNA, 64 nt, Homo Sapiens
cacacacacacacacacacacacacacaaacaugcacacacacauaugcauaucuugacauugc

SEQ ID NO: 39677 - RNA, 64 nt, Homo Sapiens
cacacacacacacacacacacacacaaacaugcacacacacauaugcauaucuugacauugcuc

SEQ ID NO: 39678 - RNA, 64 nt, Homo Sapiens
uuauccauagguuucucucccuccuucuccuucucacacacaacuguccauacuaacaaguuug

SEQ ID NO: 39679 - RNA, 64 nt, Homo Sapiens
ucuguaauggguacaaugaagaaguuucuaaaaacacacacaaagcacauugggccaacuauuu

SEQ ID NO: 39680 - RNA, 64 nt, Homo Sapiens
aucuuuuuuucuuccuucauauauauauacacaacacacacacacauauguauaucuauacaca

SEQ ID NO: 39681 - RNA, 64 nt, Homo Sapiens
cuuuuuuucuuccuucauauauauauacacaacacacacacacauauguauaucuauacacaca

SEQ ID NO: 39682 - RNA, 64 nt, Homo Sapiens
uuuuuucuuccuucauauauauauacacaacacacacacacauauguauaucuauacacacaug

SEQ ID NO: 39683 - RNA, 64 nt, Homo Sapiens
aaaaauagauuugcaaaaagugaacagauugcuacacacacacacacacacacacacacacaca

SEQ ID NO: 39684 - RNA, 64 nt, Homo Sapiens
aaauagauuugcaaaaagugaacagauugcuacacacacacacacacacacacacacacacaca

SEQ ID NO: 39685 - RNA, 64 nt, Homo Sapiens
auagauuugcaaaaagugaacagauugcuacacacacacacacacacacacacacacacacaca

SEQ ID NO: 39686 - RNA, 64 nt, Homo Sapiens
agauuugcaaaaagugaacagauugcuacacacacacacacacacacacacacacacacacaca

SEQ ID NO: 39687 - RNA, 64 nt, Homo Sapiens
auuugcaaaaagugaacagauugcuacacacacacacacacacacacacacacacacacacagc

SEQ ID NO: 39688 - RNA, 64 nt, Homo Sapiens
uugcaaaaagugaacagauugcuacacacacacacacacacacacacacacacacacacagcca

SEQ ID NO: 39689 - RNA, 64 nt, Homo Sapiens
gcaaaaagugaacagauugcuacacacacacacacacacacacacacacacacacacagccauu

SEQ ID NO: 39690 - RNA, 64 nt, Homo Sapiens
aaaaagugaacagauugcuacacacacacacacacacacacacacacacacacacagccauuca

SEQ ID NO: 39691 - RNA, 64 nt, Homo Sapiens
aaagugaacagauugcuacacacacacacacacacacacacacacacacacacagccauucauc

SEQ ID NO: 39692 - RNA, 64 nt, Homo Sapiens
agugaacagauugcuacacacacacacacacacacacacacacacacacacagccauucaucug

SEQ ID NO: 39693 - RNA, 64 nt, Homo Sapiens
ugaacagauugcuacacacacacacacacacacacacacacacacacacagccauucaucuggg

SEQ ID NO: 39694 - RNA, 64 nt, Homo Sapiens
aacagauugcuacacacacacacacacacacacacacacacacacacagccauucaucugggcu

SEQ ID NO: 39695 - RNA, 64 nt, Homo Sapiens
cagauugcuacacacacacacacacacacacacacacacacacacagccauucaucugggcugg

SEQ ID NO: 39696 - RNA, 64 nt, Homo Sapiens
gauugcuacacacacacacacacacacacacacacacacacacagccauucaucugggcuggca

SEQ ID NO: 39697 - RNA, 64 nt, Homo Sapiens
uugcuacacacacacacacacacacacacacacacacacacagccauucaucugggcuggcaga

SEQ ID NO: 39698 - RNA, 64 nt, Homo Sapiens
aguauggcggaggccaugggggccccucggcauucacacacagccuggccuccccugcggagcu

SEQ ID NO: 39699 - RNA, 64 nt, Homo Sapiens
gaucuuuggggaagggagcuaccaacacuuuauacacacacacacgugcacacacacacacaca

SEQ ID NO: 39700 - RNA, 64 nt, Homo Sapiens
ucuuuggggaagggagcuaccaacacuuuauacacacacacacgugcacacacacacacacaca

SEQ ID NO: 39701 - RNA, 64 nt, Homo Sapiens
ggagcuaccaacacuuuauacacacacacacgugcacacacacacacacacacacuauauauau

SEQ ID NO: 39702 - RNA, 64 nt, Homo Sapiens
agcuaccaacacuuuauacacacacacacgugcacacacacacacacacacacuauauauauau

SEQ ID NO: 39703 - RNA, 64 nt, Homo Sapiens
cuaccaacacuuuauacacacacacacgugcacacacacacacacacacacuauauauauauau

SEQ ID NO: 39704 - RNA, 64 nt, Homo Sapiens
accaacacuuuauacacacacacacgugcacacacacacacacacacacuauauauauauauau

SEQ ID NO: 39705 - RNA, 64 nt, Homo Sapiens
caacacuuuauacacacacacacgugcacacacacacacacacacacuauauauauauauauua

SEQ ID NO: 39706 - RNA, 64 nt, Homo Sapiens
acacuuuauacacacacacacgugcacacacacacacacacacacuauauauauauauauuauu

SEQ ID NO: 39707 - RNA, 64 nt, Homo Sapiens
acuuuauacacacacacacgugcacacacacacacacacacacuauauauauauauauuauuua

SEQ ID NO: 39708 - RNA, 64 nt, Homo Sapiens
gcagugguaggauugcagccgugggccugcuggacacacacauacaccaaagauguauuuggau

SEQ ID NO: 39709 - RNA, 64 nt, Homo Sapiens
aguguccugugacuuaacacagaaacgcaauaaacacacacaaaauaguuucaugagugauucu

SEQ ID NO: 39710 - RNA, 64 nt, Homo Sapiens
ggcguguguguauauauggauaaauauauauauacacacacacauauuacugcaaucugugauu

SEQ ID NO: 39711 - RNA, 64 nt, Homo Sapiens
cguguguguauauauggauaaauauauauauacacacacacauauuacugcaaucugugauugc

SEQ ID NO: 39712 - RNA, 64 nt, Homo Sapiens
uccugggauuauuauacugagauauauauauauacacacacacacacauauguguauauaugua

SEQ ID NO: 39713 - RNA, 64 nt, Homo Sapiens
cugggauuauuauacugagauauauauauauacacacacacacacauauguguauauauguaua

SEQ ID NO: 39714 - RNA, 64 nt, Homo Sapiens
gggauuauuauacugagauauauauauauacacacacacacacauauguguauauauguauaua

SEQ ID NO: 39715 - RNA, 64 nt, Homo Sapiens
gauuauuauacugagauauauauauauacacacacacacacauauguguauauauguauauaua

SEQ ID NO: 39716 - RNA, 64 nt, Homo Sapiens
uguauauauguauauauauaugugaguauauauacacacacacacacacacacacauauauaua

SEQ ID NO: 39717 - RNA, 64 nt, Homo Sapiens
uauauauguauauauauaugugaguauauauacacacacacacacacacacacauauauauaua

SEQ ID NO: 39718 - RNA, 64 nt, Homo Sapiens
uauauguauauauauaugugaguauauauacacacacacacacacacacacauauauauauaua

SEQ ID NO: 39719 - RNA, 64 nt, Homo Sapiens
uauguauauauauaugugaguauauauacacacacacacacacacacacauauauauauauaca

SEQ ID NO: 39720 - RNA, 64 nt, Homo Sapiens
uguauauauauaugugaguauauauacacacacacacacacacacacauauauauauauacaca

SEQ ID NO: 39721 - RNA, 64 nt, Homo Sapiens
uauauauauaugugaguauauauacacacacacacacacacacacauauauauauauacacaca

SEQ ID NO: 39722 - RNA, 64 nt, Homo Sapiens
uauauauaugugaguauauauacacacacacacacacacacacauauauauauauacacacacg

SEQ ID NO: 39723 - RNA, 64 nt, Homo Sapiens
uauauaugugaguauauauacacacacacacacacacacacauauauauauauacacacacgca

SEQ ID NO: 39724 - RNA, 64 nt, Homo Sapiens
cguccacaccacucaccacacauacauacacaugcacacacacacacaugcaauucuaccuuuu

SEQ ID NO: 39725 - RNA, 64 nt, Homo Sapiens
uccacaccacucaccacacauacauacacaugcacacacacacacaugcaauucuaccuuuuuc

SEQ ID NO: 39726 - RNA, 64 nt, Homo Sapiens
cacaccacucaccacacauacauacacaugcacacacacacacaugcaauucuaccuuuuucua

SEQ ID NO: 39727 - RNA, 64 nt, Homo Sapiens
caccacucaccacacauacauacacaugcacacacacacacaugcaauucuaccuuuuucuaac

SEQ ID NO: 39728 - RNA, 64 nt, Homo Sapiens
ugcuucuaaauaucuaaacucauuaacauggaaacacacacacaggagcuacaguacauauugg

SEQ ID NO: 39729 - RNA, 64 nt, Homo Sapiens
cuucuaaauaucuaaacucauuaacauggaaacacacacacaggagcuacaguacauauuggca

SEQ ID NO: 39730 - RNA, 64 nt, Homo Sapiens
aaguggcauguuagugaggaguucugauauuaagcacacacacacaugcacacaaauggacuuc

SEQ ID NO: 39731 - RNA, 64 nt, Homo Sapiens
guggcauguuagugaggaguucugauauuaagcacacacacacaugcacacaaauggacuucuc

SEQ ID NO: 39732 - RNA, 64 nt, Homo Sapiens
ggcauguuagugaggaguucugauauuaagcacacacacacaugcacacaaauggacuucucug

SEQ ID NO: 39733 - RNA, 64 nt, Homo Sapiens
cacguuuuuguuuucgaauuagacuucuuuaaaacacacacacacacacacacacacacacaca

SEQ ID NO: 39734 - RNA, 64 nt, Homo Sapiens
cguuuuuguuuucgaauuagacuucuuuaaaacacacacacacacacacacacacacacacaca

SEQ ID NO: 39735 - RNA, 64 nt, Homo Sapiens
uuuuuguuuucgaauuagacuucuuuaaaacacacacacacacacacacacacacacacacaca

SEQ ID NO: 39736 - RNA, 64 nt, Homo Sapiens
uuuguuuucgaauuagacuucuuuaaaacacacacacacacacacacacacacacacacacaca

SEQ ID NO: 39737 - RNA, 64 nt, Homo Sapiens
uguuuucgaauuagacuucuuuaaaacacacacacacacacacacacacacacacacacacaca

SEQ ID NO: 39738 - RNA, 64 nt, Homo Sapiens
uuuucgaauuagacuucuuuaaaacacacacacacacacacacacacacacacacacacacaca

SEQ ID NO: 39739 - RNA, 64 nt, Homo Sapiens
uucgaauuagacuucuuuaaaacacacacacacacacacacacacacacacacacacacacaca

SEQ ID NO: 39740 - RNA, 64 nt, Homo Sapiens
cgaauuagacuucuuuaaaacacacacacacacacacacacacacacacacacacacacacaca

SEQ ID NO: 39741 - RNA, 64 nt, Homo Sapiens
aauuagacuucuuuaaaacacacacacacacacacacacacacacacacacacacacacacacc

SEQ ID NO: 39742 - RNA, 64 nt, Homo Sapiens
uuagacuucuuuaaaacacacacacacacacacacacacacacacacacacacacacacacccc

SEQ ID NO: 39743 - RNA, 64 nt, Homo Sapiens
agacuucuuuaaaacacacacacacacacacacacacacacacacacacacacacacaccccug

SEQ ID NO: 39744 - RNA, 64 nt, Homo Sapiens
acuucuuuaaaacacacacacacacacacacacacacacacacacacacacacacaccccugau

SEQ ID NO: 39745 - RNA, 64 nt, Homo Sapiens
uucuuuaaaacacacacacacacacacacacacacacacacacacacacacacaccccugaucc

SEQ ID NO: 39746 - RNA, 64 nt, Homo Sapiens
cuuuaaaacacacacacacacacacacacacacacacacacacacacacacaccccugauccuu

SEQ ID NO: 39747 - RNA, 64 nt, Homo Sapiens
uuaaaacacacacacacacacacacacacacacacacacacacacacacaccccugauccuugc

SEQ ID NO: 39748 - RNA, 64 nt, Homo Sapiens
aaaacacacacacacacacacacacacacacacacacacacacacacaccccugauccuugcca

SEQ ID NO: 39749 - RNA, 64 nt, Homo Sapiens
aacacacacacacacacacacacacacacacacacacacacacacaccccugauccuugccaac

SEQ ID NO: 39750 - RNA, 64 nt, Homo Sapiens
cacacacacacacacacacacacacacacacacacacacacacaccccugauccuugccaacau

SEQ ID NO: 39751 - RNA, 64 nt, Homo Sapiens
cacacacacacacacacacacacacacacacacacacacacaccccugauccuugccaacauga

SEQ ID NO: 39752 - RNA, 64 nt, Homo Sapiens
uacacauaugcacacacgcauacacacaugcacgcacacacacauacacacaugcacgcacgca

SEQ ID NO: 39753 - RNA, 64 nt, Homo Sapiens
cacauaugcacacacgcauacacacaugcacgcacacacacauacacacaugcacgcacgcacg

SEQ ID NO: 39754 - RNA, 64 nt, Homo Sapiens
gaaucuuuuuuuucccuaauggacgaaggaacaacacacacacaaaaauuaaaugcaauaaagg

SEQ ID NO: 39755 - RNA, 64 nt, Homo Sapiens
aucuuuuuuuucccuaauggacgaaggaacaacacacacacaaaaauuaaaugcaauaaaggaa

SEQ ID NO: 39756 - RNA, 64 nt, Homo Sapiens
cccacagcuuugaaugaucacaaacacacacacgcacacacagauuugaacugaaauggacaca

SEQ ID NO: 39757 - RNA, 64 nt, Homo Sapiens
cacacacagacccacagcuuaauggacacacaaacacacacacgguuuuaguauuuugaacuga

SEQ ID NO: 39758 - RNA, 64 nt, Homo Sapiens
uauauauauauauauaguacuauauauauaaacacacacacauaagugaccauuauacugugua

SEQ ID NO: 39759 - RNA, 64 nt, Homo Sapiens
uauauauauauauauauaguuauauauauauaaacacacacacagaagugaccauuauacugug

SEQ ID NO: 39760 - RNA, 64 nt, Homo Sapiens
uaagagauaagaaggcugcacuccuuucuuccagcacacacagccgauaugucuguccaucuuu

SEQ ID NO: 39761 - RNA, 64 nt, Homo Sapiens
acaagacauuuuuccuguuuuguauguacacacacacacacaauuaucuuacuuuacacauacg

SEQ ID NO: 39762 - RNA, 64 nt, Homo Sapiens
auacaagacauuuuuccugucguguauguacacacacacacacauauaucuuacuuuacacaua

SEQ ID NO: 39763 - RNA, 64 nt, Homo Sapiens
caauacaagacauuuuuccuuacguguauguacacacacacacaauuauaucuuacuuuacaca

SEQ ID NO: 39764 - RNA, 64 nt, Homo Sapiens
cacaauacaagacauuuuuccauacguguauguacacacacacauuauuauaucuuacuuuaca

SEQ ID NO: 39765 - RNA, 64 nt, Homo Sapiens
aauccacagcaauccaucagcacacacacacacacacacacacgacauucacuauuuucacaca

SEQ ID NO: 39766 - RNA, 64 nt, Homo Sapiens
cacacacacacacacacacgcacacacacacacacacacacacaauacauucacuauuuucaca

SEQ ID NO: 39767 - RNA, 64 nt, Homo Sapiens
cacacacacacacacacacacacacacacacacacacacacacaacauacauucacuauuuuca

SEQ ID NO: 39768 - RNA, 64 nt, Homo Sapiens
cacacacacacacacacacacacacacacacacacacacacacaccacauacauucacuauuuu

SEQ ID NO: 39769 - RNA, 64 nt, Homo Sapiens
cacacacacacacacacacauucacacacacacacacacacacaucccacauacauucacuauu

SEQ ID NO: 39770 - RNA, 64 nt, Homo Sapiens
cacacacacacacacacacauuuucacacacacacacacacacaauucccacauacauucacua

SEQ ID NO: 39771 - RNA, 64 nt, Homo Sapiens
cacacacacacacacacacauauuuucacacacacacacacacaacauucccacauacauucac

SEQ ID NO: 39772 - RNA, 64 nt, Homo Sapiens
cacacacacacacacacacaacuauuuucacacacacacacacaucacauucccacauacauuc

SEQ ID NO: 39773 - RNA, 64 nt, Homo Sapiens
cacacacacacacacacacaucacuauuuucacacacacacacaacucacauucccacauacau

SEQ ID NO: 39774 - RNA, 64 nt, Homo Sapiens
cacacacacacacacacacaauucacuauuuucacacacacacaauacucacauucccacauac

SEQ ID NO: 39775 - RNA, 64 nt, Homo Sapiens
cacacacacacacacacacaacauucacuauuuucacacacacaaaauacucacauucccacau

SEQ ID NO: 39776 - RNA, 64 nt, Homo Sapiens
gcuuuaagaaagggccaggucacacccauaaacacacacacaguaacacaggcacacacaugca

SEQ ID NO: 39777 - RNA, 64 nt, Homo Sapiens
gugcuuuaagaaagggccagcacacacccauaaacacacacacacaaacacaggcacacacaug

SEQ ID NO: 39778 - RNA, 64 nt, Homo Sapiens
cacacacccauaaacacacaaaugcaaacacaggcacacacaugaucugcaguugaugucccca

SEQ ID NO: 39779 - RNA, 64 nt, Homo Sapiens
gaaaaccuuuauuuuaaagucacacacacacacacacacacacggcuuucugcuuaaaaacaca

SEQ ID NO: 39780 - RNA, 64 nt, Homo Sapiens
cggaaaaccuuuauuuuaaacacacacacacacacacacacacauagcuuucugcuuaaaaaca

SEQ ID NO: 39781 - RNA, 64 nt, Homo Sapiens
cacggaaaaccuuuauuuuacacacacacacacacacacacacagauagcuuucugcuuaaaaa

SEQ ID NO: 39782 - RNA, 64 nt, Homo Sapiens
cacacggaaaaccuuuauuuaacacacacacacacacacacacagggauagcuuucugcuuaaa

SEQ ID NO: 39783 - RNA, 64 nt, Homo Sapiens
cacacacggaaaaccuuuauaaaacacacacacacacacacacagagggauagcuuucugcuua

SEQ ID NO: 39784 - RNA, 64 nt, Homo Sapiens
cacacacacggaaaaccuuuuaaaaacacacacacacacacacauugagggauagcuuucugcu

SEQ ID NO: 39785 - RNA, 64 nt, Homo Sapiens
cacacacacacggaaaaccucuuaaaaacacacacacacacacaccuugagggauagcuuucug

SEQ ID NO: 39786 - RNA, 64 nt, Homo Sapiens
cacacacacacacggaaaacugcuuaaaaacacacacacacacaaaccuugagggauagcuuuc

SEQ ID NO: 39787 - RNA, 64 nt, Homo Sapiens
cacacacacacacacggaaaucugcuuaaaaacacacacacacauaaaccuugagggauagcuu

SEQ ID NO: 39788 - RNA, 64 nt, Homo Sapiens
cacacacacacacacacggauuucugcuuaaaaacacacacacauguaaaccuugagggauagc

SEQ ID NO: 39789 - RNA, 64 nt, Homo Sapiens
ucagaguacucuuucuuacacacacacauauguacacacacaccaacaugugcccgaacauaca

SEQ ID NO: 39790 - RNA, 64 nt, Homo Sapiens
uguacacacacaccucagagugcccgaacauacacacacacauaugugacuguugaauaacaug

SEQ ID NO: 39791 - RNA, 64 nt, Homo Sapiens
uauguacacacacaccucagugugcccgaacauacacacacacaccugugacuguugaauaaca

SEQ ID NO: 39792 - RNA, 64 nt, Homo Sapiens
gacacaucuuaaggggacccuacacacacacacacacacacagaaaauguaacacacacacaca

SEQ ID NO: 39793 - RNA, 64 nt, Homo Sapiens
gagacacaucuuaaggggaccauacacacacacacacacacacaacaaauguaacacacacaca

SEQ ID NO: 39794 - RNA, 64 nt, Homo Sapiens
cagagacacaucuuaaggggcacauacacacacacacacacacaagacaaauguaacacacaca

SEQ ID NO: 39795 - RNA, 64 nt, Homo Sapiens
cacagagacacaucuuaaggcacacauacacacacacacacacaucagacaaauguaacacaca

SEQ ID NO: 39796 - RNA, 64 nt, Homo Sapiens
cacacagagacacaucuuaacacacacauacacacacacacacaguucagacaaauguaacaca

SEQ ID NO: 39797 - RNA, 64 nt, Homo Sapiens
cacacacagagacacaucuucacacacacauacacacacacacacaguucagacaaauguaaca

SEQ ID NO: 39798 - RNA, 64 nt, Homo Sapiens
cacacacacagagacacauccacacacacacauacacacacacaugcaguucagacaaauguaa

SEQ ID NO: 39799 - RNA, 64 nt, Homo Sapiens
cacacacacacacacacacaacaaauguaacacacacacacauagcuugguuguugcaguucag

SEQ ID NO: 39800 - RNA, 64 nt, Homo Sapiens
uacacacacacacacacacaagacaaauguaacacacacacacaaugcuugguuguugcaguuc

SEQ ID NO: 39801 - RNA, 64 nt, Homo Sapiens
cauacacacacacacacacaucagacaaauguaacacacacacaccaugcuugguuguugcagu

SEQ ID NO: 39802 - RNA, 64 nt, Homo Sapiens
cacacugucaugcacucaaccacacucacagacccacacacauacacacacacacacauauaca

SEQ ID NO: 39803 - RNA, 64 nt, Homo Sapiens
uacacacacucacagacccacacacacacacacacacacacauacucacuuauaaaccucugua

SEQ ID NO: 39804 - RNA, 64 nt, Homo Sapiens
uauacacacacucacagaccuacacacacacacacacacacacauucucacuuauaaaccucug

SEQ ID NO: 39805 - RNA, 64 nt, Homo Sapiens
cauauacacacacucacagauguacacacacacacacacacacaaguucucacuuauaaaccuc

SEQ ID NO: 39806 - RNA, 64 nt, Homo Sapiens
cacauauacacacacucacaucuguacacacacacacacacacaaaaguucucacuuauaaacc

SEQ ID NO: 39807 - RNA, 64 nt, Homo Sapiens
cacacauauacacacacucaccucuguacacacacacacacacaagaaaguucucacuuauaaa

SEQ ID NO: 39808 - RNA, 64 nt, Homo Sapiens
cacacacauauacacacacuaaccucuguacacacacacacacagaagaaaguucucacuuaua

SEQ ID NO: 39809 - RNA, 64 nt, Homo Sapiens
cacacacacauauacacacauaaaccucuguacacacacacacacagaagaaaguucucacuua

SEQ ID NO: 39810 - RNA, 64 nt, Homo Sapiens
cacacacacacauauacacauauaaaccucuguacacacacacacgcagaagaaaguucucacu

SEQ ID NO: 39811 - RNA, 64 nt, Homo Sapiens
ccuauguaguuuuuaaaacauaaacauacacacacacacacaccacaaauauguguguauaaaa

SEQ ID NO: 39812 - RNA, 64 nt, Homo Sapiens
ccccuauguaguuuuuaaaaaauaaacauacacacacacacacaauacaaauauguguguauaa

SEQ ID NO: 39813 - RNA, 64 nt, Homo Sapiens
caccccuauguaguuuuuaaaaaauaaacauacacacacacacaauauacaaauauguguguau

SEQ ID NO: 39814 - RNA, 64 nt, Homo Sapiens
cacaccccuauguaguuuuuauaaaauaaacauacacacacacagaauauacaaauaugugugu

SEQ ID NO: 39815 - RNA, 64 nt, Homo Sapiens
ccuagagaaaaguacagauucacacacacacacacacacacaccacaggacacacacacacaca

SEQ ID NO: 39816 - RNA, 64 nt, Homo Sapiens
ccccuagagaaaaguacagacacacacacacacacacacacacauuacaggacacacacacaca

SEQ ID NO: 39817 - RNA, 64 nt, Homo Sapiens
caccccuagagaaaaguacacacacacacacacacacacacacaguuuacaggacacacacaca

SEQ ID NO: 39818 - RNA, 64 nt, Homo Sapiens
cacaccccuagagaaaaguacacacacacacacacacacacacaauguuuacaggacacacaca

SEQ ID NO: 39819 - RNA, 64 nt, Homo Sapiens
cacacaccccuagagaaaagcacacacacacacacacacacacaagauguuuacaggacacaca

SEQ ID NO: 39820 - RNA, 64 nt, Homo Sapiens
cacacacaccccuagagaaacacacacacacacacacacacacaaaagauguuuacaggacaca

SEQ ID NO: 39821 - RNA, 64 nt, Homo Sapiens
cacacacacaccccuagagacacacacacacacacacacacacaucaaagauguuuacaggaca

SEQ ID NO: 39822 - RNA, 64 nt, Homo Sapiens
cacacacacacaccccuagacacacacacacacacacacacacaguucaaagauguuuacagga

SEQ ID NO: 39823 - RNA, 64 nt, Homo Sapiens
cacacacacacacaccccuagacacacacacacacacacacacaugguucaaagauguuuacag

SEQ ID NO: 39824 - RNA, 64 nt, Homo Sapiens
cacacacacacacacaccccaggacacacacacacacacacacauuugguucaaagauguuuac

SEQ ID NO: 39825 - RNA, 64 nt, Homo Sapiens
cacacacacacacacacaccacaggacacacacacacacacacagauuugguucaaagauguuu

SEQ ID NO: 39826 - RNA, 64 nt, Homo Sapiens
cacacacacacacacacacauuacaggacacacacacacacacagugauuugguucaaagaugu

SEQ ID NO: 39827 - RNA, 64 nt, Homo Sapiens
cacacacacacacacacacaguuuacaggacacacacacacacauagugauuugguucaaagau

SEQ ID NO: 39828 - RNA, 64 nt, Homo Sapiens
cacacacacacacacacacaauguuuacaggacacacacacacauauagugauuugguucaaag

SEQ ID NO: 39829 - RNA, 64 nt, Homo Sapiens
cacacacacacacacacacaagauguuuacaggacacacacacauuuauagugauuugguucaa

SEQ ID NO: 39830 - RNA, 64 nt, Homo Sapiens
ggaugaauggagccuuaaagcacagacacacacacacacacacguguauguguguauacacaca

SEQ ID NO: 39831 - RNA, 64 nt, Homo Sapiens
cgggaugaauggagccuuaacacacagacacacacacacacacauguguauguguguauacaca

SEQ ID NO: 39832 - RNA, 64 nt, Homo Sapiens
cacgggaugaauggagccuucacacacagacacacacacacacaucuguguauguguguauaca

SEQ ID NO: 39833 - RNA, 64 nt, Homo Sapiens
cacacgggaugaauggagcccacacacacagacacacacacacauaucuguguauguguguaua

SEQ ID NO: 39834 - RNA, 64 nt, Homo Sapiens
cacacacgggaugaauggaguacacacacacagacacacacacauauaucuguguaugugugua

SEQ ID NO: 39835 - RNA, 64 nt, Homo Sapiens
cacacacacacacacacggguauguguguauacacacacacagaguuguaaauauauaucugug

SEQ ID NO: 39836 - RNA, 64 nt, Homo Sapiens
gacacacacacacacacacguguauguguguauacacacacacaauguuguaaauauauaucug

SEQ ID NO: 39837 - RNA, 64 nt, Homo Sapiens
uccuugaauaucauugccagauuugaucaucacacacacacaaauauuuaaauuucuacucaca

SEQ ID NO: 39838 - RNA, 64 nt, Homo Sapiens
aauccuugaauaucauugcccaauuugaucaucacacacacacaacuauuuaaauuucuacuca

SEQ ID NO: 39839 - RNA, 64 nt, Homo Sapiens
caaauccuugaauaucauugcacaauuugaucaucacacacacaagacuauuuaaauuucuacu

SEQ ID NO: 39840 - RNA, 64 nt, Homo Sapiens
aaagaaucagcuagaguugucaugauaaagucagcacacacaaaaaggcuucuuacacauaccu

SEQ ID NO: 39841 - RNA, 64 nt, Homo Sapiens
acacugacuugauacagcaugaaguuucuagugccacacacaguauuuagaaaaccuuuaggcg

SEQ ID NO: 39842 - RNA, 64 nt, Homo Sapiens
ugggcacaugggcacauacagacucacauacagacacacacauauauguacagacauguacucu

SEQ ID NO: 39843 - RNA, 64 nt, Homo Sapiens
cagacacacacauauauguacagacauguacucucacacacacaggcaccagcauacacacguu

SEQ ID NO: 39844 - RNA, 64 nt, Homo Sapiens
gacacacacauauauguacagacauguacucucacacacacaggcaccagcauacacacguuuu

SEQ ID NO: 39845 - RNA, 64 nt, Homo Sapiens
ccaguauuucaucaaggacagggaauaucccucccacacacaggccagcugcucacccugccac

SEQ ID NO: 39846 - RNA, 64 nt, Homo Sapiens
cuuggacagcagauccacacaccacuuccccacccacacacaguacccugggcugguuggacaa

SEQ ID NO: 39847 - RNA, 64 nt, Homo Sapiens
ccccaucaaacacaguuacaccccacauaucucucacacacacacacacacgcacacacacaca

SEQ ID NO: 39848 - RNA, 64 nt, Homo Sapiens
ccaucaaacacaguuacaccccacauaucucucacacacacacacacacgcacacacacacaca

SEQ ID NO: 39849 - RNA, 64 nt, Homo Sapiens
aucaaacacaguuacaccccacauaucucucacacacacacacacacgcacacacacacacaca

SEQ ID NO: 39850 - RNA, 64 nt, Homo Sapiens
caaacacaguuacaccccacauaucucucacacacacacacacacgcacacacacacacacaga

SEQ ID NO: 39851 - RNA, 64 nt, Homo Sapiens
aacacaguuacaccccacauaucucucacacacacacacacacgcacacacacacacacagauc

SEQ ID NO: 39852 - RNA, 64 nt, Homo Sapiens
caccccacauaucucucacacacacacacacacgcacacacacacacacagaucugacguaauc

SEQ ID NO: 39853 - RNA, 64 nt, Homo Sapiens
ccccacauaucucucacacacacacacacacgcacacacacacacacagaucugacguaaucaa

SEQ ID NO: 39854 - RNA, 64 nt, Homo Sapiens
ccacauaucucucacacacacacacacacgcacacacacacacacagaucugacguaaucaaac

SEQ ID NO: 39855 - RNA, 64 nt, Homo Sapiens
acauaucucucacacacacacacacacgcacacacacacacacagaucugacguaaucaaacuc

SEQ ID NO: 39856 - RNA, 64 nt, Homo Sapiens
auaucucucacacacacacacacacgcacacacacacacacagaucugacguaaucaaacucca

SEQ ID NO: 39857 - RNA, 64 nt, Homo Sapiens
agcccacauauucuauuauagauauauaaauaaucacacacacacuugcugucaauguuuugag

SEQ ID NO: 39858 - RNA, 64 nt, Homo Sapiens
cccacauauucuauuauagauauauaaauaaucacacacacacuugcugucaauguuuugaguc

SEQ ID NO: 39859 - RNA, 64 nt, Homo Sapiens
aaguacaaguagaggaguuuuuuauuuuauauaucacacacacacacacacacacacacacaca

SEQ ID NO: 39860 - RNA, 64 nt, Homo Sapiens
guacaaguagaggaguuuuuuauuuuauauaucacacacacacacacacacacacacacacaca

SEQ ID NO: 39861 - RNA, 64 nt, Homo Sapiens
acaaguagaggaguuuuuuauuuuauauaucacacacacacacacacacacacacacacacaca

SEQ ID NO: 39862 - RNA, 64 nt, Homo Sapiens
aaguagaggaguuuuuuauuuuauauaucacacacacacacacacacacacacacacacacaca

SEQ ID NO: 39863 - RNA, 64 nt, Homo Sapiens
guagaggaguuuuuuauuuuauauaucacacacacacacacacacacacacacacacacacaca

SEQ ID NO: 39864 - RNA, 64 nt, Homo Sapiens
agaggaguuuuuuauuuuauauaucacacacacacacacacacacacacacacacacacacaua

SEQ ID NO: 39865 - RNA, 64 nt, Homo Sapiens
aggaguuuuuuauuuuauauaucacacacacacacacacacacacacacacacacacacauaua

SEQ ID NO: 39866 - RNA, 64 nt, Homo Sapiens
gaguuuuuuauuuuauauaucacacacacacacacacacacacacacacacacacacauauaug

SEQ ID NO: 39867 - RNA, 64 nt, Homo Sapiens
guuuuuuauuuuauauaucacacacacacacacacacacacacacacacacacacauauaugau

SEQ ID NO: 39868 - RNA, 64 nt, Homo Sapiens
uuuuuauuuuauauaucacacacacacacacacacacacacacacacacacacauauaugauac

SEQ ID NO: 39869 - RNA, 64 nt, Homo Sapiens
uuuauuuuauauaucacacacacacacacacacacacacacacacacacacauauaugauacaa

SEQ ID NO: 39870 - RNA, 64 nt, Homo Sapiens
uauuuuauauaucacacacacacacacacacacacacacacacacacacauauaugauacaaau

SEQ ID NO: 39871 - RNA, 64 nt, Homo Sapiens
uuuuauauaucacacacacacacacacacacacacacacacacacacauauaugauacaaaugc

SEQ ID NO: 39872 - RNA, 64 nt, Homo Sapiens
uuauauaucacacacacacacacacacacacacacacacacacacauauaugauacaaaugcuu

SEQ ID NO: 39873 - RNA, 64 nt, Homo Sapiens
auauaucacacacacacacacacacacacacacacacacacacauauaugauacaaaugcuuuc

SEQ ID NO: 39874 - RNA, 64 nt, Homo Sapiens
auaucacacacacacacacacacacacacacacacacacacauauaugauacaaaugcuuucag

SEQ ID NO: 39875 - RNA, 64 nt, Homo Sapiens
gaaaaauaaaguaggcaugaauaaauguucaggacacacacauacacucacacacaucacagua

SEQ ID NO: 39876 - RNA, 64 nt, Homo Sapiens
gcaugaauaaauguucaggacacacacauacacucacacacaucacaguaucagcucuuucagu

SEQ ID NO: 39877 - RNA, 64 nt, Homo Sapiens
cacacagcuauuagaacuaacacacacacacacacacacacacgagaaaauccuaaggaacuca

SEQ ID NO: 39878 - RNA, 64 nt, Homo Sapiens
cgcacacagcuauuagaacucacacacacacacacacacacacaauagaaaauccuaaggaacu

SEQ ID NO: 39879 - RNA, 64 nt, Homo Sapiens
cacgcacacagcuauuagaacucacacacacacacacacacacaauauagaaaauccuaaggaa

SEQ ID NO: 39880 - RNA, 64 nt, Homo Sapiens
cacacgcacacagcuauuagaacucacacacacacacacacacaguauauagaaaauccuaagg

SEQ ID NO: 39881 - RNA, 64 nt, Homo Sapiens
cacacacgcacacagcuauuggaacucacacacacacacacacauuguauauagaaaauccuaa

SEQ ID NO: 39882 - RNA, 64 nt, Homo Sapiens
cacacacacgcacacagcuaaaggaacucacacacacacacacauuuuguauauagaaaauccu

SEQ ID NO: 39883 - RNA, 64 nt, Homo Sapiens
cacacacacacgcacacagccuaaggaacucacacacacacacaaguuuuguauauagaaaauc

SEQ ID NO: 39884 - RNA, 64 nt, Homo Sapiens
cacacacacacacgcacacauccuaaggaacucacacacacacaacaguuuuguauauagaaaa

SEQ ID NO: 39885 - RNA, 64 nt, Homo Sapiens
cacacacacacacacgcacaaauccuaaggaacucacacacacaacacaguuuuguauauagaa

SEQ ID NO: 39886 - RNA, 64 nt, Homo Sapiens
aaaugguugguuugucaaaacacacauacacacacacacacacgcccccucacucucacacuug

SEQ ID NO: 39887 - RNA, 64 nt, Homo Sapiens
cgaaaugguugguuugucaaugcacacauacacacacacacacacacccccucacucucacacu

SEQ ID NO: 39888 - RNA, 64 nt, Homo Sapiens
cacgaaaugguugguuuguccuugcacacauacacacacacacaugcacccccucacucucaca

SEQ ID NO: 39889 - RNA, 64 nt, Homo Sapiens
cacacgaaaugguugguuugcacuugcacacauacacacacacacaugcacccccucacucuca

SEQ ID NO: 39890 - RNA, 64 nt, Homo Sapiens
cauauguguguguauaguauuauguauauauauacacacacauagauauacauauauacauaua

SEQ ID NO: 39891 - RNA, 64 nt, Homo Sapiens
uauauauauauauaauucaauauauauauacacacacacacauaaaguuaaaauuauauauaua

SEQ ID NO: 39892 - RNA, 64 nt, Homo Sapiens
uauauauauauauauaauucuauauauauauacacacacacacaaaaaguuaaaauuauauaua

SEQ ID NO: 39893 - RNA, 64 nt, Homo Sapiens
cauauauauauauauauaauuauauauauauauacacacacacaucaaaaguuaaaauuauaua

SEQ ID NO: 39894 - RNA, 64 nt, Homo Sapiens
ccucacacacggaggccagacucacacaagcacacacacacagucugggagggcugaaccccca

SEQ ID NO: 39895 - RNA, 64 nt, Homo Sapiens
guccucacacacggaggccacacucacacaagcacacacacacaugcugggagggcugaacccc

SEQ ID NO: 39896 - RNA, 64 nt, Homo Sapiens
caguccucacacacggaggccccacucacacaagcacacacacagaugcugggagggcugaacc

SEQ ID NO: 39897 - RNA, 64 nt, Homo Sapiens
ucagggaaggagguccugggccccuccauguacacacacacaacuccaggugcuacccaggagu

SEQ ID NO: 39898 - RNA, 64 nt, Homo Sapiens
acucagggaaggagguccugguccccuccauguacacacacacaccuccaggugcuacccagga

SEQ ID NO: 39899 - RNA, 64 nt, Homo Sapiens
uggggacugggcacagcucucacacacacacacacacacacaggugucccucccuugcugaaca

SEQ ID NO: 39900 - RNA, 64 nt, Homo Sapiens
gguggggacugggcacagcucacacacacacacacacacacacaacugucccucccuugcugaa

SEQ ID NO: 39901 - RNA, 64 nt, Homo Sapiens
cagguggggacugggcacagaacacacacacacacacacacacaaaacugucccucccuugcug

SEQ ID NO: 39902 - RNA, 64 nt, Homo Sapiens
cacagguggggacugggcacugaacacacacacacacacacacaccaaacugucccucccuugc

SEQ ID NO: 39903 - RNA, 64 nt, Homo Sapiens
cacacagguggggacugggcgcugaacacacacacacacacacaggccaaacugucccucccuu

SEQ ID NO: 39904 - RNA, 64 nt, Homo Sapiens
cacacacagguggggacugguugcugaacacacacacacacacagaggccaaacugucccuccc

SEQ ID NO: 39905 - RNA, 64 nt, Homo Sapiens
cacacacacagguggggacuccuugcugaacacacacacacacaaggaggccaaacugucccuc

SEQ ID NO: 39906 - RNA, 64 nt, Homo Sapiens
cacacacacacagguggggaucccuugcugaacacacacacacagcaggaggccaaacuguccc

SEQ ID NO: 39907 - RNA, 64 nt, Homo Sapiens
cacacacacacacaggugggccucccuugcugaacacacacacauugcaggaggccaaacuguc

SEQ ID NO: 39908 - RNA, 64 nt, Homo Sapiens
cccugcuugcaggaggccaaccuucccaccccuacacacacacuccugugcccacucccuaucu

SEQ ID NO: 39909 - RNA, 64 nt, Homo Sapiens
auggggugggguggguguagggcacacgcacaaacacacacacuacauucgacauaccccacug

SEQ ID NO: 39910 - RNA, 64 nt, Homo Sapiens
cagaguugugauucucaguacacacacacacacacacacacacgacaugcaaaacauacacaca

SEQ ID NO: 39911 - RNA, 64 nt, Homo Sapiens
cgcagaguugugauucucagcacacacacacacacacacacacaaaacaugcaaaacauacaca

SEQ ID NO: 39912 - RNA, 64 nt, Homo Sapiens
cacgcagaguugugauucuccacacacacacacacacacacacagaaaacaugcaaaacauaca

SEQ ID NO: 39913 - RNA, 64 nt, Homo Sapiens
cacacgcagaguugugauuccacacacacacacacacacacacaaggaaaacaugcaaaacaua

SEQ ID NO: 39914 - RNA, 64 nt, Homo Sapiens
cacacacgcagaguugugauuacacacacacacacacacacacaaaaggaaaacaugcaaaaca

SEQ ID NO: 39915 - RNA, 64 nt, Homo Sapiens
cacacacacgcagaguugugcauacacacacacacacacacacaggaaaggaaaacaugcaaaa

SEQ ID NO: 39916 - RNA, 64 nt, Homo Sapiens
cacacacacacgcagaguugaacauacacacacacacacacacauaggaaaggaaaacaugcaa

SEQ ID NO: 39917 - RNA, 64 nt, Homo Sapiens
cacacacacacacgcagaguaaaacauacacacacacacacacagguaggaaaggaaaacaugc

SEQ ID NO: 39918 - RNA, 64 nt, Homo Sapiens
cacacacacacacacgcagagcaaaacauacacacacacacacagugguaggaaaggaaaacau

SEQ ID NO: 39919 - RNA, 64 nt, Homo Sapiens
cacacacacacacacacgcaaugcaaaacauacacacacacacauugugguaggaaaggaaaac

SEQ ID NO: 39920 - RNA, 64 nt, Homo Sapiens
cacacacacacacacacacgacaugcaaaacauacacacacacaguuugugguaggaaaggaaa

SEQ ID NO: 39921 - RNA, 64 nt, Homo Sapiens
cucauauguguuuacucuguuaaauacacacacacacacacacggacaagcuuuugguuuuggc

SEQ ID NO: 39922 - RNA, 64 nt, Homo Sapiens
cgcucauauguguuuacucugcuaaauacacacacacacacacauugacaagcuuuugguuuug

SEQ ID NO: 39923 - RNA, 64 nt, Homo Sapiens
cacgcucauauguguuuacuuggcuaaauacacacacacacacauauugacaagcuuuugguuu

SEQ ID NO: 39924 - RNA, 64 nt, Homo Sapiens
cacacgcucauauguguuuauuuggcuaaauacacacacacacaguuauugacaagcuuuuggu

SEQ ID NO: 39925 - RNA, 64 nt, Homo Sapiens
cacacacgcucauauguguuguuuuggcuaaauacacacacacauaguuauugacaagcuuuug

SEQ ID NO: 39926 - RNA, 64 nt, Homo Sapiens
cacaauuugcuacagcaacacacacucacacacgcacacacaauuucaggaacacacacacaca

SEQ ID NO: 39927 - RNA, 64 nt, Homo Sapiens
cacacacgcacacacaaucacaggaacacacacacacacacacucugcuggcccuucaucuguu

SEQ ID NO: 39928 - RNA, 64 nt, Homo Sapiens
cucacacacgcacacacaauuucaggaacacacacacacacacacucugcuggcccuucaucug

SEQ ID NO: 39929 - RNA, 64 nt, Homo Sapiens
cacucacacacgcacacacauguucaggaacacacacacacacagucucugcuggcccuucauc

SEQ ID NO: 39930 - RNA, 64 nt, Homo Sapiens
cacacucacacacgcacacaucuguucaggaacacacacacacagagucucugcuggcccuuca

SEQ ID NO: 39931 - RNA, 64 nt, Homo Sapiens
cacacacucacacacgcacacaucuguucaggaacacacacacagggagucucugcuggcccuu

SEQ ID NO: 39932 - RNA, 64 nt, Homo Sapiens
ugggggcaaccacauccagucacacacacaaccacacacacaaauggccaccaacacacaacca

SEQ ID NO: 39933 - RNA, 64 nt, Homo Sapiens
aaugggggcaaccacauccacacacacacacaaccacacacacauguggccaccaacacacaac

SEQ ID NO: 39934 - RNA, 64 nt, Homo Sapiens
cacacacacaaaugggggcaaacacacaaccacacacacacaacgaggcucagcuguggccacc

SEQ ID NO: 39935 - RNA, 64 nt, Homo Sapiens
accacacacacaaaugggggccaacacacaaccacacacacacacagaggcucagcuguggcca

SEQ ID NO: 39936 - RNA, 64 nt, Homo Sapiens
caaccacacacacaaaugggcaccaacacacaaccacacacacagacagaggcucagcuguggc

SEQ ID NO: 39937 - RNA, 64 nt, Homo Sapiens
gggauagagagauuaccucuuauauauauacacacacacacaaaaugggauuauguaugauaua

SEQ ID NO: 39938 - RNA, 64 nt, Homo Sapiens
aagggauagagagauuaccuuauauauauauacacacacacacaauaugggauuauguaugaua

SEQ ID NO: 39939 - RNA, 64 nt, Homo Sapiens
caaagggauagagagauuacuauauauauauauacacacacacaagauaugggauuauguauga

SEQ ID NO: 39940 - RNA, 64 nt, Homo Sapiens
gauucaaaagaaaugugcauaauguuuucucucucacacacaaagcuuuguaggaagcacuuuu

SEQ ID NO: 39941 - RNA, 64 nt, Homo Sapiens
ccauaccauuuccauucaaccacacacacacacacacacacacuuacacacacacacacacaca

SEQ ID NO: 39942 - RNA, 64 nt, Homo Sapiens
cuccauaccauuuccauucacacacacacacacacacacacacagguacacacacacacacaca

SEQ ID NO: 39943 - RNA, 64 nt, Homo Sapiens
cacuccauaccauuuccauucacacacacacacacacacacacacagguacacacacacacaca

SEQ ID NO: 39944 - RNA, 64 nt, Homo Sapiens
cacacuccauaccauuuccacacacacacacacacacacacacaugcagguacacacacacaca

SEQ ID NO: 39945 - RNA, 64 nt, Homo Sapiens
cacacacuccauaccauuuccacacacacacacacacacacacaggugcagguacacacacaca

SEQ ID NO: 39946 - RNA, 64 nt, Homo Sapiens
cacacacacuccauaccauucacacacacacacacacacacacacuggugcagguacacacaca

SEQ ID NO: 39947 - RNA, 64 nt, Homo Sapiens
cacacacacacuccauaccacacacacacacacacacacacacaugcuggugcagguacacaca

SEQ ID NO: 39948 - RNA, 64 nt, Homo Sapiens
cacacacacacacuccauaccacacacacacacacacacacacaccugcuggugcagguacaca

SEQ ID NO: 39949 - RNA, 64 nt, Homo Sapiens
cacacacacacacacuccaucacacacacacacacacacacacauuccugcuggugcagguaca

SEQ ID NO: 39950 - RNA, 64 nt, Homo Sapiens
cacacacacacacacacucccacacacacacacacacacacacaucuuccugcuggugcaggua

SEQ ID NO: 39951 - RNA, 64 nt, Homo Sapiens
cacacacacacacacacacuuacacacacacacacacacacacauuucuuccugcuggugcagg

SEQ ID NO: 39952 - RNA, 64 nt, Homo Sapiens
cacacacacacacacacacagguacacacacacacacacacacaaguuucuuccugcuggugca

SEQ ID NO: 39953 - RNA, 64 nt, Homo Sapiens
cacacacacacacacacacacagguacacacacacacacacacagcaguuucuuccugcuggug

SEQ ID NO: 39954 - RNA, 64 nt, Homo Sapiens
cacacacacacacacacacaugcagguacacacacacacacacacugcaguuucuuccugcugg

SEQ ID NO: 39955 - RNA, 64 nt, Homo Sapiens
cacacacacacacacacacaggugcagguacacacacacacacaaccugcaguuucuuccugcu

SEQ ID NO: 39956 - RNA, 64 nt, Homo Sapiens
cacacacacacacacacacacuggugcagguacacacacacacaaaaccugcaguuucuuccug

SEQ ID NO: 39957 - RNA, 64 nt, Homo Sapiens
cacacacacacacacacacaugcuggugcagguacacacacacacuaaaccugcaguuucuucc

SEQ ID NO: 39958 - RNA, 64 nt, Homo Sapiens
cacacucuucucuaaccagucacaugcacacacacacacacauaacaauuuaugugcacacuca

SEQ ID NO: 39959 - RNA, 64 nt, Homo Sapiens
uacacacucuucucuaaccacacacaugcacacacacacacacaacacaauuuaugugcacacu

SEQ ID NO: 39960 - RNA, 64 nt, Homo Sapiens
cauacacacucuucucuaaccucacacaugcacacacacacacaacacacaauuuaugugcaca

SEQ ID NO: 39961 - RNA, 64 nt, Homo Sapiens
cacauacacacucuucucuacacucacacaugcacacacacacaucacacacaauuuaugugca

SEQ ID NO: 39962 - RNA, 64 nt, Homo Sapiens
cacacauacacacucuucuccacacucacacaugcacacacacaacucacacacaauuuaugug

SEQ ID NO: 39963 - RNA, 64 nt, Homo Sapiens
uuaugugcacacucacacaucuauaaugcacacucacacacaauccaagagagaaagcaagaaa

SEQ ID NO: 39964 - RNA, 64 nt, Homo Sapiens
uaaguugcugcaaauucaaacacacacacacacacacacacaaucucccccaaacacacacaca

SEQ ID NO: 39965 - RNA, 64 nt, Homo Sapiens
auuaaguugcugcaaauucacacacacacacacacacacacacauccucccccaaacacacaca

SEQ ID NO: 39966 - RNA, 64 nt, Homo Sapiens
cacacacaauuaaguugcugcacacacacacacacacacacacaccuccucccccaaacacaca

SEQ ID NO: 39967 - RNA, 64 nt, Homo Sapiens
cacacacacaauuaaguugccacacacacacacacacacacacacaccuccucccccaaacaca

SEQ ID NO: 39968 - RNA, 64 nt, Homo Sapiens
cacacacacacaauuaaguucacacacacacacacacacacacauucaccuccucccccaaaca

SEQ ID NO: 39969 - RNA, 64 nt, Homo Sapiens
cacacacacacacaauuaagcacacacacacacacacacacacaaguucaccuccucccccaaa

SEQ ID NO: 39970 - RNA, 64 nt, Homo Sapiens
cacacacacacacacaauuaaacacacacacacacacacacacaccaguucaccuccuccccca

SEQ ID NO: 39971 - RNA, 64 nt, Homo Sapiens
cacacacacacacacacaaucaaacacacacacacacacacacagcccaguucaccuccucccc

SEQ ID NO: 39972 - RNA, 64 nt, Homo Sapiens
cacacacacacacacacacacccaaacacacacacacacacacaaagcccaguucaccuccucc

SEQ ID NO: 39973 - RNA, 64 nt, Homo Sapiens
cacacacacacacacacacacccccaaacacacacacacacacacaaagcccaguucaccuccu

SEQ ID NO: 39974 - RNA, 64 nt, Homo Sapiens
cacacacacacacacacacacucccccaaacacacacacacacaaucaaagcccaguucaccuc

SEQ ID NO: 39975 - RNA, 64 nt, Homo Sapiens
cacacacacacacacacacauccucccccaaacacacacacacacuaucaaagcccaguucacc

SEQ ID NO: 39976 - RNA, 64 nt, Homo Sapiens
cacacacacacacacacacaccuccucccccaaacacacacacaaucuaucaaagcccaguuca

SEQ ID NO: 39977 - RNA, 64 nt, Homo Sapiens
aguucauaauguggugauggugcacacacacacacacacacacgcuagccugugcacgcgcgcg

SEQ ID NO: 39978 - RNA, 64 nt, Homo Sapiens
cgaguucauaauguggugaucgugcacacacacacacacacacacacuagccugugcacgcgcg

SEQ ID NO: 39979 - RNA, 64 nt, Homo Sapiens
cacgaguucauaauguggugcgcgugcacacacacacacacacagacacuagccugugcacgcg

SEQ ID NO: 39980 - RNA, 64 nt, Homo Sapiens
cacacgaguucauaauguggcgcgcgugcacacacacacacacaaggacacuagccugugcacg

SEQ ID NO: 39981 - RNA, 64 nt, Homo Sapiens
cacacacgaguucauaaugucgcgcgcgugcacacacacacacagaaggacacuagccugugca

SEQ ID NO: 39982 - RNA, 64 nt, Homo Sapiens
cacacacacgaguucauaaucacgcgcgcgugcacacacacacacagaaggacacuagccugug

SEQ ID NO: 39983 - RNA, 64 nt, Homo Sapiens
cacacacacacgaguucauaugcacgcgcgcgugcacacacacacacagaaggacacuagccug

SEQ ID NO: 39984 - RNA, 64 nt, Homo Sapiens
ggucauguuuuugucacauuagagaauaaacagccacacacacauuuuuuuuuuuccuuuaaaa

SEQ ID NO: 39985 - RNA, 64 nt, Homo Sapiens
ucauguuuuugucacauuagagaauaaacagccacacacacauuuuuuuuuuuccuuuaaaaca

SEQ ID NO: 39986 - RNA, 64 nt, Homo Sapiens
ccaggcagucugugugugaggcauagccccuggacacacacacacagacacacacacugccugg

SEQ ID NO: 39987 - RNA, 64 nt, Homo Sapiens
aggcagucugugugugaggcauagccccuggacacacacacacagacacacacacugccuggau

SEQ ID NO: 39988 - RNA, 64 nt, Homo Sapiens
gcagucugugugugaggcauagccccuggacacacacacacagacacacacacugccuggaugc

SEQ ID NO: 39989 - RNA, 64 nt, Homo Sapiens
ugugaggcauagccccuggacacacacacacagacacacacacugccuggaugcauguaugcac

SEQ ID NO: 39990 - RNA, 64 nt, Homo Sapiens
acacagacacacacacugccuggaugcauguaugcacacacaugcgcgcacacgugcucccuga

SEQ ID NO: 39991 - RNA, 64 nt, Homo Sapiens
acacgcacacccaugcgcagaugugcugccuggacacacacacacacacggauaugcugucugg

SEQ ID NO: 39992 - RNA, 64 nt, Homo Sapiens
acgcacacccaugcgcagaugugcugccuggacacacacacacacacggauaugcugucuggac

SEQ ID NO: 39993 - RNA, 64 nt, Homo Sapiens
gcacacccaugcgcagaugugcugccuggacacacacacacacacggauaugcugucuggacgc

SEQ ID NO: 39994 - RNA, 64 nt, Homo Sapiens
acacccaugcgcagaugugcugccuggacacacacacacacacggauaugcugucuggacgcac

SEQ ID NO: 39995 - RNA, 64 nt, Homo Sapiens
augcugccuggacacacagauaaugcugccuugacacacacaugcacggauauugccuggacac

SEQ ID NO: 39996 - RNA, 64 nt, Homo Sapiens
gccuugacacacacaugcacggauauugccuggacacacacacacacacgugugcacagauaug

SEQ ID NO: 39997 - RNA, 64 nt, Homo Sapiens
cuugacacacacaugcacggauauugccuggacacacacacacacacgugugcacagauaugcu

SEQ ID NO: 39998 - RNA, 64 nt, Homo Sapiens
ugacacacacaugcacggauauugccuggacacacacacacacacgugugcacagauaugcugu

SEQ ID NO: 39999 - RNA, 64 nt, Homo Sapiens
acacacacaugcacggauauugccuggacacacacacacacacgugugcacagauaugcugucu

SEQ ID NO: 40000 - RNA, 64 nt, Homo Sapiens
acacacgugugcacagauaugcugucuggacacgcacacacaugcagauaugcugccuggacac

SEQ ID NO: 40001 - RNA, 64 nt, Homo Sapiens
ugcugccuggacacacgcagauaugcugucuagucacacacacacgcagacaugcuguccggac

SEQ ID NO: 40002 - RNA, 64 nt, Homo Sapiens
cugccuggacacacgcagauaugcugucuagucacacacacacgcagacaugcuguccggacac

SEQ ID NO: 40003 - RNA, 64 nt, Homo Sapiens
cuagucacacacacacgcagacaugcuguccggacacacacacgcaugcacagauaugcugucc

SEQ ID NO: 40004 - RNA, 64 nt, Homo Sapiens
acacacacacgcaugcacagauaugcuguccggacacacacacgcacgcagauaugcugccugg

SEQ ID NO: 40005 - RNA, 64 nt, Homo Sapiens
ggacacacacacgcacgcagauaugcugccuggacacacacacagauaaugcugccucaacacu

SEQ ID NO: 40006 - RNA, 64 nt, Homo Sapiens
acacacacacgcacgcagauaugcugccuggacacacacacagauaaugcugccucaacacuca

SEQ ID NO: 40007 - RNA, 64 nt, Homo Sapiens
cucaacacucacacacgugcagauauugccuggacacacacaugugcacagauaugcugucugg

SEQ ID NO: 40008 - RNA, 64 nt, Homo Sapiens
augcugccugggcacacacuuccggacacacaugcacacacaggugcagauaugcugccuggac

SEQ ID NO: 40009 - RNA, 64 nt, Homo Sapiens
gucgaaaaugcaaacuuggggagggcggaaacaucacacacaagguuuccacuucacacuugga

SEQ ID NO: 40010 - RNA, 64 nt, Homo Sapiens
aaauuucuaaggauaccagaaaggaaauggcaugcacacacacaaaaaauaccuaaauuuugga

SEQ ID NO: 40011 - RNA, 64 nt, Homo Sapiens
auuucuaaggauaccagaaaggaaauggcaugcacacacacaaaaaauaccuaaauuuuggaug

SEQ ID NO: 40012 - RNA, 64 nt, Homo Sapiens
acuaaccgaaaaaccgaaaauauacaaacagcuucacacacacacacacacacacacacacaca

SEQ ID NO: 40013 - RNA, 64 nt, Homo Sapiens
uaaccgaaaaaccgaaaauauacaaacagcuucacacacacacacacacacacacacacacaca

SEQ ID NO: 40014 - RNA, 64 nt, Homo Sapiens
accgaaaaaccgaaaauauacaaacagcuucacacacacacacacacacacacacacacacaca

SEQ ID NO: 40015 - RNA, 64 nt, Homo Sapiens
cgaaaaaccgaaaauauacaaacagcuucacacacacacacacacacacacacacacacacaca

SEQ ID NO: 40016 - RNA, 64 nt, Homo Sapiens
aaaaaccgaaaauauacaaacagcuucacacacacacacacacacacacacacacacacacaca

SEQ ID NO: 40017 - RNA, 64 nt, Homo Sapiens
aaaccgaaaauauacaaacagcuucacacacacacacacacacacacacacacacacacacaca

SEQ ID NO: 40018 - RNA, 64 nt, Homo Sapiens
accgaaaauauacaaacagcuucacacacacacacacacacacacacacacacacacacacaca

SEQ ID NO: 40019 - RNA, 64 nt, Homo Sapiens
cgaaaauauacaaacagcuucacacacacacacacacacacacacacacacacacacacacaaa

SEQ ID NO: 40020 - RNA, 64 nt, Homo Sapiens
aaaauauacaaacagcuucacacacacacacacacacacacacacacacacacacacacaaagg

SEQ ID NO: 40021 - RNA, 64 nt, Homo Sapiens
aauauacaaacagcuucacacacacacacacacacacacacacacacacacacacacaaaggaa

SEQ ID NO: 40022 - RNA, 64 nt, Homo Sapiens
uauacaaacagcuucacacacacacacacacacacacacacacacacacacacacaaaggaaga

SEQ ID NO: 40023 - RNA, 64 nt, Homo Sapiens
uacaaacagcuucacacacacacacacacacacacacacacacacacacacacaaaggaagauc

SEQ ID NO: 40024 - RNA, 64 nt, Homo Sapiens
caaacagcuucacacacacacacacacacacacacacacacacacacacacaaaggaagaucau

SEQ ID NO: 40025 - RNA, 64 nt, Homo Sapiens
aacagcuucacacacacacacacacacacacacacacacacacacacacaaaggaagaucauca

SEQ ID NO: 40026 - RNA, 64 nt, Homo Sapiens
cagcuucacacacacacacacacacacacacacacacacacacacacaaaggaagaucaucaau

SEQ ID NO: 40027 - RNA, 64 nt, Homo Sapiens
gcuucacacacacacacacacacacacacacacacacacacacacaaaggaagaucaucaaugg

SEQ ID NO: 40028 - RNA, 64 nt, Homo Sapiens
uucacacacacacacacacacacacacacacacacacacacacaaaggaagaucaucaauggcu

SEQ ID NO: 40029 - RNA, 64 nt, Homo Sapiens
cacacacacacacacacacacacacacacacacacacacacaaaggaagaucaucaauggcugc

SEQ ID NO: 40030 - RNA, 64 nt, Homo Sapiens
uuuagcaacuauauucuacaaauguuacuuauaacacacacacacacaucugaaauauaugccg

SEQ ID NO: 40031 - RNA, 64 nt, Homo Sapiens
uagcaacuauauucuacaaauguuacuuauaacacacacacacacaucugaaauauaugccgaa

SEQ ID NO: 40032 - RNA, 64 nt, Homo Sapiens
gcaacuauauucuacaaauguuacuuauaacacacacacacacaucugaaauauaugccgaaaa

SEQ ID NO: 40033 - RNA, 64 nt, Homo Sapiens
aacuauauucuacaaauguuacuuauaacacacacacacacaucugaaauauaugccgaaaauu

SEQ ID NO: 40034 - RNA, 64 nt, Homo Sapiens
gaaauauauauguguguauguguguauauauaugcacacacacacagauaaugcuuccagugaa

SEQ ID NO: 40035 - RNA, 64 nt, Homo Sapiens
aauauauauguguguauguguguauauauaugcacacacacacagauaaugcuuccagugaaug

SEQ ID NO: 40036 - RNA, 64 nt, Homo Sapiens
uauauauguguguauguguguauauauaugcacacacacacagauaaugcuuccagugaaugug

SEQ ID NO: 40037 - RNA, 64 nt, Homo Sapiens
cauacauucaccgcccccccgcccccccaacgcgcacacacacguccucuccucccaggaaccu

SEQ ID NO: 40038 - RNA, 64 nt, Homo Sapiens
auucaaauauuuacccgggacacacacccccccccacacacacacacagacacacucacacaca

SEQ ID NO: 40039 - RNA, 64 nt, Homo Sapiens
ucaaauauuuacccgggacacacacccccccccacacacacacacagacacacucacacacaag

SEQ ID NO: 40040 - RNA, 64 nt, Homo Sapiens
aaauauuuacccgggacacacacccccccccacacacacacacagacacacucacacacaagag

SEQ ID NO: 40041 - RNA, 64 nt, Homo Sapiens
auauuuacccgggacacacacccccccccacacacacacacagacacacucacacacaagagcc

SEQ ID NO: 40042 - RNA, 64 nt, Homo Sapiens
cacacccccccccacacacacacacagacacacucacacacaagagccaggaugguggaguuuu

SEQ ID NO: 40043 - RNA, 64 nt, Homo Sapiens
uguguguguguguguguguauguaugugaauauacacacacacacacacacaggugagugugaa

SEQ ID NO: 40044 - RNA, 64 nt, Homo Sapiens
uguguguguguguguguauguaugugaauauacacacacacacacacacaggugagugugaaua

SEQ ID NO: 40045 - RNA, 64 nt, Homo Sapiens
uguguguguguguguauguaugugaauauacacacacacacacacacaggugagugugaauacu

SEQ ID NO: 40046 - RNA, 64 nt, Homo Sapiens
uguguguguguguauguaugugaauauacacacacacacacacacaggugagugugaauacuuc

SEQ ID NO: 40047 - RNA, 64 nt, Homo Sapiens
uguguguguguauguaugugaauauacacacacacacacacacaggugagugugaauacuuccu

SEQ ID NO: 40048 - RNA, 64 nt, Homo Sapiens
uguguguguauguaugugaauauacacacacacacacacacaggugagugugaauacuuccuug

SEQ ID NO: 40049 - RNA, 64 nt, Homo Sapiens
ccccaugacacaugagcgcucucacuuacccuuacacacacacacacacacacacacaccucua

SEQ ID NO: 40050 - RNA, 64 nt, Homo Sapiens
ccaugacacaugagcgcucucacuuacccuuacacacacacacacacacacacacaccucuaac

SEQ ID NO: 40051 - RNA, 64 nt, Homo Sapiens
augacacaugagcgcucucacuuacccuuacacacacacacacacacacacacaccucuaacag

SEQ ID NO: 40052 - RNA, 64 nt, Homo Sapiens
gacacaugagcgcucucacuuacccuuacacacacacacacacacacacacaccucuaacagaa

SEQ ID NO: 40053 - RNA, 64 nt, Homo Sapiens
cacaugagcgcucucacuuacccuuacacacacacacacacacacacacaccucuaacagaagg

SEQ ID NO: 40054 - RNA, 64 nt, Homo Sapiens
caugagcgcucucacuuacccuuacacacacacacacacacacacacaccucuaacagaaggga

SEQ ID NO: 40055 - RNA, 64 nt, Homo Sapiens
ugagcgcucucacuuacccuuacacacacacacacacacacacacaccucuaacagaagggaag

SEQ ID NO: 40056 - RNA, 64 nt, Homo Sapiens
agcgcucucacuuacccuuacacacacacacacacacacacacaccucuaacagaagggaagaa

SEQ ID NO: 40057 - RNA, 64 nt, Homo Sapiens
cgcucucacuuacccuuacacacacacacacacacacacacaccucuaacagaagggaagaagc

SEQ ID NO: 40058 - RNA, 64 nt, Homo Sapiens
guaagauagaauguauuauauauauauauauauacacacacacauauauauagcugaaucuuug

SEQ ID NO: 40059 - RNA, 64 nt, Homo Sapiens
aagauagaauguauuauauauauauauauauacacacacacauauauauagcugaaucuuuggu

SEQ ID NO: 40060 - RNA, 64 nt, Homo Sapiens
ucugugcuuucaaaaaaaaaaacaaaaaaaaaaccacacacacacauaaaaaacccaacagguc

SEQ ID NO: 40061 - RNA, 64 nt, Homo Sapiens
ugugcuuucaaaaaaaaaaacaaaaaaaaaaccacacacacacauaaaaaacccaacaggucaa

SEQ ID NO: 40062 - RNA, 64 nt, Homo Sapiens
ugcuuucaaaaaaaaaaacaaaaaaaaaaccacacacacacauaaaaaacccaacaggucaaaa

SEQ ID NO: 40063 - RNA, 64 nt, Homo Sapiens
aagguauucauggugacucaggaauacacacauacacacacacacacacacacacacacacaca

SEQ ID NO: 40064 - RNA, 64 nt, Homo Sapiens
gguauucauggugacucaggaauacacacauacacacacacacacacacacacacacacacaca

SEQ ID NO: 40065 - RNA, 64 nt, Homo Sapiens
uauucauggugacucaggaauacacacauacacacacacacacacacacacacacacacacaua

SEQ ID NO: 40066 - RNA, 64 nt, Homo Sapiens
uucauggugacucaggaauacacacauacacacacacacacacacacacacacacacacauaca

SEQ ID NO: 40067 - RNA, 64 nt, Homo Sapiens
cauggugacucaggaauacacacauacacacacacacacacacacacacacacacacauacaca

SEQ ID NO: 40068 - RNA, 64 nt, Homo Sapiens
uggugacucaggaauacacacauacacacacacacacacacacacacacacacacauacacaca

SEQ ID NO: 40069 - RNA, 64 nt, Homo Sapiens
gugacucaggaauacacacauacacacacacacacacacacacacacacacacauacacacaua

SEQ ID NO: 40070 - RNA, 64 nt, Homo Sapiens
gacucaggaauacacacauacacacacacacacacacacacacacacacacauacacacauaua

SEQ ID NO: 40071 - RNA, 64 nt, Homo Sapiens
cucaggaauacacacauacacacacacacacacacacacacacacacacauacacacauauaau

SEQ ID NO: 40072 - RNA, 64 nt, Homo Sapiens
caggaauacacacauacacacacacacacacacacacacacacacacauacacacauauaauuu

SEQ ID NO: 40073 - RNA, 64 nt, Homo Sapiens
ggaauacacacauacacacacacacacacacacacacacacacacauacacacauauaauuuga

SEQ ID NO: 40074 - RNA, 64 nt, Homo Sapiens
aauacacacauacacacacacacacacacacacacacacacacauacacacauauaauuugaaa

SEQ ID NO: 40075 - RNA, 64 nt, Homo Sapiens
uacacacauacacacacacacacacacacacacacacacacauacacacauauaauuugaaaga

SEQ ID NO: 40076 - RNA, 64 nt, Homo Sapiens
gaagaguguggccccaccccuacuuaacuucacacacacacagaauuguaaauauugugaacau

SEQ ID NO: 40077 - RNA, 64 nt, Homo Sapiens
gagaagaguguggccccaccauuacuuaacuucacacacacacauuauuguaaauauugugaac

SEQ ID NO: 40078 - RNA, 64 nt, Homo Sapiens
cagagaagaguguggccccaacauuacuuaacuucacacacacaucuuauuguaaauauuguga

SEQ ID NO: 40079 - RNA, 64 nt, Homo Sapiens
uuugcaggggugucucgguugcaaggaaaaggcacacacacacggcugcagagaaaucuaccga

SEQ ID NO: 40080 - RNA, 64 nt, Homo Sapiens
cguuugcaggggugucucgggagcaaggaaaaggcacacacacauggcugcagagaaaucuacc

SEQ ID NO: 40081 - RNA, 64 nt, Homo Sapiens
cagucacauagauauucuuacuuuucuacacacacacacacauaaaaccucuaauuuuugguga

SEQ ID NO: 40082 - RNA, 64 nt, Homo Sapiens
uacagucacauagauauucugacuuuucuacacacacacacacauaaaaccucuaauuuuuggu

SEQ ID NO: 40083 - RNA, 64 nt, Homo Sapiens
cauacagucacauagauauugugacuuuucuacacacacacacauauaaaaccucuaauuuuug

SEQ ID NO: 40084 - RNA, 64 nt, Homo Sapiens
cacauacagucacauagauauggugacuuuucuacacacacacaguuauaaaaccucuaauuuu

SEQ ID NO: 40085 - RNA, 64 nt, Homo Sapiens
uauauaauuuucuauacauaagaggccuuacacacacacacaaaagguuuguggcacuguucca

SEQ ID NO: 40086 - RNA, 64 nt, Homo Sapiens
aauauauaauuuucuauacacaagaggccuuacacacacacacaccagguuuguggcacuguuc

SEQ ID NO: 40087 - RNA, 64 nt, Homo Sapiens
caaauauauaauuuucuauauccaagaggccuuacacacacacaguccagguuuguggcacugu

SEQ ID NO: 40088 - RNA, 64 nt, Homo Sapiens
ugcagacacacaacaucaagcgcagacacacacacacacacaaaugugauggaacacacacaca

SEQ ID NO: 40089 - RNA, 64 nt, Homo Sapiens
aaugcagacacacaacaucacacgcagacacacacacacacacagaugugauggaacacacaca

SEQ ID NO: 40090 - RNA, 64 nt, Homo Sapiens
caaaugcagacacacaacaucacacgcagacacacacacacacaaugaugugauggaacacaca

SEQ ID NO: 40091 - RNA, 64 nt, Homo Sapiens
cacaaaugcagacacacaaccacacacgcagacacacacacacaagaugaugugauggaacaca

SEQ ID NO: 40092 - RNA, 64 nt, Homo Sapiens
cacacaaaugcagacacacacacacacacgcagacacacacacaggagaugaugugauggaaca

SEQ ID NO: 40093 - RNA, 64 nt, Homo Sapiens
cagacacacacacacacacagaugugauggaacacacacacacgcccagcguucuucaggagau

SEQ ID NO: 40094 - RNA, 64 nt, Homo Sapiens
cgcagacacacacacacacaaugaugugauggaacacacacacaaacccagcguucuucaggag

SEQ ID NO: 40095 - RNA, 64 nt, Homo Sapiens
cacacagaugugggguacaccauagccacgcauacacacacagacacugcauagauuacacgca

SEQ ID NO: 40096 - RNA, 64 nt, Homo Sapiens
cauaacuuuccaaaugaaacucccuguuugacuucacacacacuacagaugguguguaugcccc

SEQ ID NO: 40097 - RNA, 64 nt, Homo Sapiens
ccuuucuaacuuuauggacacugugcgagcacaacacacacaauaaagauuuuuacucuagaaa

SEQ ID NO: 40098 - RNA, 64 nt, Homo Sapiens
uccagaucaccuuggcaacuacuuggaccaggcacacacacaccgaagggaagagugcuccaag

SEQ ID NO: 40099 - RNA, 64 nt, Homo Sapiens
ccuccagaucaccuuggcaaagacuuggaccaggcacacacacaaggaagggaagagugcucca

SEQ ID NO: 40100 - RNA, 64 nt, Homo Sapiens
uaucauuuaaugcauaaaucuacacacacacaaacacacacauugcuuaugcucagaaaugcca

SEQ ID NO: 40101 - RNA, 64 nt, Homo Sapiens
cacacacauuuaucauuuaaagaaaugccauacacacacacaaacacuaauaaagcuuaugcuc

SEQ ID NO: 40102 - RNA, 64 nt, Homo Sapiens
aacacacacauuuaucauuuucagaaaugccauacacacacacacacacuaauaaagcuuaugc

SEQ ID NO: 40103 - RNA, 64 nt, Homo Sapiens
aguauuaggucuuuaaaacugccuaguucccacacacacacaaauuucauaaagcacuuuugug

SEQ ID NO: 40104 - RNA, 64 nt, Homo Sapiens
aaaguauuaggucuuuaaaauggccuaguucccacacacacacaucuuucauaaagcacuuuug

SEQ ID NO: 40105 - RNA, 64 nt, Homo Sapiens
caaaaguauuaggucuuuaauguggccuaguucccacacacacaacucuuucauaaagcacuuu

SEQ ID NO: 40106 - RNA, 64 nt, Homo Sapiens
ccuucucuaagauuccuugucacacacauacacacacacacacucucuuacacacacacacaca

SEQ ID NO: 40107 - RNA, 64 nt, Homo Sapiens
cuccuucucuaagauuccuucacacacacauacacacacacacauacucuuacacacacacaca

SEQ ID NO: 40108 - RNA, 64 nt, Homo Sapiens
cacuccuucucuaagauucccacacacacacauacacacacacaauuacucuuacacacacaca

SEQ ID NO: 40109 - RNA, 64 nt, Homo Sapiens
cacacacacacacuccuucucacacacacacacacacacacauacuuccagaucauuacucuua

SEQ ID NO: 40110 - RNA, 64 nt, Homo Sapiens
uacacacacacacacuccuuuacacacacacacacacacacacagacuuccagaucauuacucu

SEQ ID NO: 40111 - RNA, 64 nt, Homo Sapiens
cauacacacacacacacucccuuacacacacacacacacacacagagacuuccagaucauuacu

SEQ ID NO: 40112 - RNA, 64 nt, Homo Sapiens
cacauacacacacacacacucucuuacacacacacacacacacauugagacuuccagaucauua

SEQ ID NO: 40113 - RNA, 64 nt, Homo Sapiens
cacacauacacacacacacauacucuuacacacacacacacacacauugagacuuccagaucau

SEQ ID NO: 40114 - RNA, 64 nt, Homo Sapiens
cacacacauacacacacacaauuacucuuacacacacacacacaugcauugagacuuccagauc

SEQ ID NO: 40115 - RNA, 64 nt, Homo Sapiens
cacacacacauacacacacaucauuacucuuacacacacacacaagugcauugagacuuccaga

SEQ ID NO: 40116 - RNA, 64 nt, Homo Sapiens
cacacacacacauacacacagaucauuacucuuacacacacacacgagugcauugagacuucca

SEQ ID NO: 40117 - RNA, 64 nt, Homo Sapiens
gcacugggagaacuaacagaggagaaaggugaaacacacacacauucuuaaggcaauaaaacua

SEQ ID NO: 40118 - RNA, 64 nt, Homo Sapiens
acugggagaacuaacagaggagaaaggugaaacacacacacauucuuaaggcaauaaaacuagg

SEQ ID NO: 40119 - RNA, 64 nt, Homo Sapiens
ccagucaguauucccagccuugagcgcacgcgcgcacacacacacacacauacacacacgcauu

SEQ ID NO: 40120 - RNA, 64 nt, Homo Sapiens
agucaguauucccagccuugagcgcacgcgcgcacacacacacacacauacacacacgcauuaa

SEQ ID NO: 40121 - RNA, 64 nt, Homo Sapiens
ucaguauucccagccuugagcgcacgcgcgcacacacacacacacauacacacacgcauuaauu

SEQ ID NO: 40122 - RNA, 64 nt, Homo Sapiens
aguauucccagccuugagcgcacgcgcgcacacacacacacacauacacacacgcauuaauuuu

SEQ ID NO: 40123 - RNA, 64 nt, Homo Sapiens
uauucccagccuugagcgcacgcgcgcacacacacacacacauacacacacgcauuaauuuuug

SEQ ID NO: 40124 - RNA, 64 nt, Homo Sapiens
uauauauuuuaugaauuacaugugguuuuauauacacacacacacacacacacacacacacaca

SEQ ID NO: 40125 - RNA, 64 nt, Homo Sapiens
uauauuuuaugaauuacaugugguuuuauauacacacacacacacacacacacacacacacaca

SEQ ID NO: 40126 - RNA, 64 nt, Homo Sapiens
uauuuuaugaauuacaugugguuuuauauacacacacacacacacacacacacacacacacaca

SEQ ID NO: 40127 - RNA, 64 nt, Homo Sapiens
uuuuaugaauuacaugugguuuuauauacacacacacacacacacacacacacacacacacacu

SEQ ID NO: 40128 - RNA, 64 nt, Homo Sapiens
uuaugaauuacaugugguuuuauauacacacacacacacacacacacacacacacacacacucu

SEQ ID NO: 40129 - RNA, 64 nt, Homo Sapiens
augaauuacaugugguuuuauauacacacacacacacacacacacacacacacacacacucuga

SEQ ID NO: 40130 - RNA, 64 nt, Homo Sapiens
gaauuacaugugguuuuauauacacacacacacacacacacacacacacacacacacucugaca

SEQ ID NO: 40131 - RNA, 64 nt, Homo Sapiens
auuacaugugguuuuauauacacacacacacacacacacacacacacacacacacucugacauu

SEQ ID NO: 40132 - RNA, 64 nt, Homo Sapiens
uacaugugguuuuauauacacacacacacacacacacacacacacacacacacucugacauuuu

SEQ ID NO: 40133 - RNA, 64 nt, Homo Sapiens
caugugguuuuauauacacacacacacacacacacacacacacacacacacucugacauuuuau

SEQ ID NO: 40134 - RNA, 64 nt, Homo Sapiens
ugugguuuuauauacacacacacacacacacacacacacacacacacacucugacauuuuauua

SEQ ID NO: 40135 - RNA, 64 nt, Homo Sapiens
ugguuuuauauacacacacacacacacacacacacacacacacacacucugacauuuuauuaca

SEQ ID NO: 40136 - RNA, 64 nt, Homo Sapiens
guuuuauauacacacacacacacacacacacacacacacacacacucugacauuuuauuacaag

SEQ ID NO: 40137 - RNA, 64 nt, Homo Sapiens
uuuauauacacacacacacacacacacacacacacacacacacucugacauuuuauuacaagcu

SEQ ID NO: 40138 - RNA, 64 nt, Homo Sapiens
acacugaagguugacacaggaaagucguacuguucacacacacaguuugagacuccaagccaag

SEQ ID NO: 40139 - RNA, 64 nt, Homo Sapiens
acugaagguugacacaggaaagucguacuguucacacacacaguuugagacuccaagccaagag

SEQ ID NO: 40140 - RNA, 64 nt, Homo Sapiens
ggggaagaagauugaucaaacugaaugaaacccccacacacacacacaugcauacacacacaca

SEQ ID NO: 40141 - RNA, 64 nt, Homo Sapiens
ggaagaagauugaucaaacugaaugaaacccccacacacacacacaugcauacacacacacaca

SEQ ID NO: 40142 - RNA, 64 nt, Homo Sapiens
aagaagauugaucaaacugaaugaaacccccacacacacacacaugcauacacacacacacaca

SEQ ID NO: 40143 - RNA, 64 nt, Homo Sapiens
gaagauugaucaaacugaaugaaacccccacacacacacacaugcauacacacacacacacagc

SEQ ID NO: 40144 - RNA, 64 nt, Homo Sapiens
cugaaugaaacccccacacacacacacaugcauacacacacacacacagccacacacacagaaa

SEQ ID NO: 40145 - RNA, 64 nt, Homo Sapiens
gaaugaaacccccacacacacacacaugcauacacacacacacacagccacacacacagaaaau

SEQ ID NO: 40146 - RNA, 64 nt, Homo Sapiens
augaaacccccacacacacacacaugcauacacacacacacacagccacacacacagaaaauau

SEQ ID NO: 40147 - RNA, 64 nt, Homo Sapiens
gaaacccccacacacacacacaugcauacacacacacacacagccacacacacagaaaauauac

SEQ ID NO: 40148 - RNA, 64 nt, Homo Sapiens
cacacacacacaugcauacacacacacacacagccacacacacagaaaauauacuguaaagaaa

SEQ ID NO: 40149 - RNA, 64 nt, Homo Sapiens
cacacacacaugcauacacacacacacacagccacacacacagaaaauauacuguaaagaaaga

SEQ ID NO: 40150 - RNA, 64 nt, Homo Sapiens
cucugccucuccugaaaccucugacaacccccuacacacacacacaggcauacucagacccacu

SEQ ID NO: 40151 - RNA, 64 nt, Homo Sapiens
cugccucuccugaaaccucugacaacccccuacacacacacacaggcauacucagacccacuca

SEQ ID NO: 40152 - RNA, 64 nt, Homo Sapiens
gccucuccugaaaccucugacaacccccuacacacacacacaggcauacucagacccacucaaa

SEQ ID NO: 40153 - RNA, 64 nt, Homo Sapiens
ccagcguugguuacugaccaccccacccucccaccacacacacacacacacacacacacacaca

SEQ ID NO: 40154 - RNA, 64 nt, Homo Sapiens
agcguugguuacugaccaccccacccucccaccacacacacacacacacacacacacacacaca

SEQ ID NO: 40155 - RNA, 64 nt, Homo Sapiens
cguugguuacugaccaccccacccucccaccacacacacacacacacacacacacacacacaca

SEQ ID NO: 40156 - RNA, 64 nt, Homo Sapiens
uugguuacugaccaccccacccucccaccacacacacacacacacacacacacacacacacaca

SEQ ID NO: 40157 - RNA, 64 nt, Homo Sapiens
gguuacugaccaccccacccucccaccacacacacacacacacacacacacacacacacacaca

SEQ ID NO: 40158 - RNA, 64 nt, Homo Sapiens
uuacugaccaccccacccucccaccacacacacacacacacacacacacacacacacacacaca

SEQ ID NO: 40159 - RNA, 64 nt, Homo Sapiens
acugaccaccccacccucccaccacacacacacacacacacacacacacacacacacacacaca

SEQ ID NO: 40160 - RNA, 64 nt, Homo Sapiens
ugaccaccccacccucccaccacacacacacacacacacacacacacacacacacacacacaca

SEQ ID NO: 40161 - RNA, 64 nt, Homo Sapiens
accaccccacccucccaccacacacacacacacacacacacacacacacacacacacacacaca

SEQ ID NO: 40162 - RNA, 64 nt, Homo Sapiens
caccccacccucccaccacacacacacacacacacacacacacacacacacacacacacacaca

SEQ ID NO: 40163 - RNA, 64 nt, Homo Sapiens
ccccacccucccaccacacacacacacacacacacacacacacacacacacacacacacacaaa

SEQ ID NO: 40164 - RNA, 64 nt, Homo Sapiens
ccacccucccaccacacacacacacacacacacacacacacacacacacacacacacacaaagu

SEQ ID NO: 40165 - RNA, 64 nt, Homo Sapiens
acccucccaccacacacacacacacacacacacacacacacacacacacacacacacaaagugg

SEQ ID NO: 40166 - RNA, 64 nt, Homo Sapiens
ccucccaccacacacacacacacacacacacacacacacacacacacacacacacaaaguggag

SEQ ID NO: 40167 - RNA, 64 nt, Homo Sapiens
ucccaccacacacacacacacacacacacacacacacacacacacacacacacaaaguggagaa

SEQ ID NO: 40168 - RNA, 64 nt, Homo Sapiens
ccaccacacacacacacacacacacacacacacacacacacacacacacacaaaguggagaaaa

SEQ ID NO: 40169 - RNA, 64 nt, Homo Sapiens
accacacacacacacacacacacacacacacacacacacacacacacacaaaguggagaaaaau

SEQ ID NO: 40170 - RNA, 64 nt, Homo Sapiens
cacacacacacacacacacacacacacacacacacacacacacacacaaaguggagaaaaaugu

SEQ ID NO: 40171 - RNA, 64 nt, Homo Sapiens
cacacacacacacacacacacacacacacacacacacacacacacaaaguggagaaaaauguau

SEQ ID NO: 40172 - RNA, 64 nt, Homo Sapiens
cacacacacacacacacacacacacacacacacacacacacacaaaguggagaaaaauguauac

SEQ ID NO: 40173 - RNA, 64 nt, Homo Sapiens
cacacacacacacacacacacacacacacacacacacacacaaaguggagaaaaauguauacuc

SEQ ID NO: 40174 - RNA, 64 nt, Homo Sapiens
agcccauuuguugaggcugaccuuccugaucauacacacacacagcccagcaaaagccucuccu

SEQ ID NO: 40175 - RNA, 64 nt, Homo Sapiens
cccauuuguugaggcugaccuuccugaucauacacacacacagcccagcaaaagccucuccuga

SEQ ID NO: 40176 - RNA, 64 nt, Homo Sapiens
uacuguuguuauuaaaaacagaacaaaaacaaaacacacacacacacaaaaacagaaacaaaaa

SEQ ID NO: 40177 - RNA, 64 nt, Homo Sapiens
cuguuguuauuaaaaacagaacaaaaacaaaacacacacacacacaaaaacagaaacaaaaaaa

SEQ ID NO: 40178 - RNA, 64 nt, Homo Sapiens
guuguuauuaaaaacagaacaaaaacaaaacacacacacacacaaaaacagaaacaaaaaaaac

SEQ ID NO: 40179 - RNA, 64 nt, Homo Sapiens
uguuauuaaaaacagaacaaaaacaaaacacacacacacacaaaaacagaaacaaaaaaaacca

SEQ ID NO: 40180 - RNA, 64 nt, Homo Sapiens
gagcacgugccacgcaugccucgugugcucaucucacacacaccccccucccgggucacgcaga

SEQ ID NO: 40181 - RNA, 64 nt, Homo Sapiens
accccccucccgggucacgcagacaccccccaaccacacacaucucaugcuguacaccugaggc

SEQ ID NO: 40182 - RNA, 64 nt, Homo Sapiens
cugggacaagauuccuuugaaacacacacacacacacacacacucacacacacacacacacaca

SEQ ID NO: 40183 - RNA, 64 nt, Homo Sapiens
cucugggacaagauuccuuucaaacacacacacacacacacacacucacacacacacacacaca

SEQ ID NO: 40184 - RNA, 64 nt, Homo Sapiens
cacucugggacaagauuccucacaaacacacacacacacacacacucucacacacacacacaca

SEQ ID NO: 40185 - RNA, 64 nt, Homo Sapiens
cacacucugggacaagauuccacacaaacacacacacacacacacucucucacacacacacaca

SEQ ID NO: 40186 - RNA, 64 nt, Homo Sapiens
cacacacucugggacaagaucacacacaaacacacacacacacaaucucucucacacacacaca

SEQ ID NO: 40187 - RNA, 64 nt, Homo Sapiens
cacacacacucugggacaagcacacacacaaacacacacacacaaaaucucucucacacacaca

SEQ ID NO: 40188 - RNA, 64 nt, Homo Sapiens
cacacacacacucugggacacacacacacacaaacacacacacaagaaaucucucucacacaca

SEQ ID NO: 40189 - RNA, 64 nt, Homo Sapiens
cacacacacacacacacacacucacacacacacacacacacaaaaaauauuaauagaaaucucu

SEQ ID NO: 40190 - RNA, 64 nt, Homo Sapiens
aacacacacacacacacacacucucacacacacacacacacacaacaaauauuaauagaaaucu

SEQ ID NO: 40191 - RNA, 64 nt, Homo Sapiens
caaacacacacacacacacacucucucacacacacacacacacaacacaaauauuaauagaaau

SEQ ID NO: 40192 - RNA, 64 nt, Homo Sapiens
cacaaacacacacacacacaaucucucucacacacacacacacaaaacacaaauauuaauagaa

SEQ ID NO: 40193 - RNA, 64 nt, Homo Sapiens
cacacaaacacacacacacaaaaucucucucacacacacacacaagaaacacaaauauuaauag

SEQ ID NO: 40194 - RNA, 64 nt, Homo Sapiens
cacacacaaacacacacacaagaaaucucucucacacacacacaaaagaaacacaaauauuaau

SEQ ID NO: 40195 - RNA, 64 nt, Homo Sapiens
cacacacacaaacacacacaauagaaaucucucucacacacacaaaaaagaaacacaaauauua

SEQ ID NO: 40196 - RNA, 64 nt, Homo Sapiens
augauggauaaaugcaugaguauauacacacacacacacacacuuguugauauauauauauaua

SEQ ID NO: 40197 - RNA, 64 nt, Homo Sapiens
cuaugauggauaaaugcauguauauauacacacacacacacacaauuguugauauauauauaua

SEQ ID NO: 40198 - RNA, 64 nt, Homo Sapiens
cacuaugauggauaaaugcauauauauauacacacacacacacaauauuguugauauauauaua

SEQ ID NO: 40199 - RNA, 64 nt, Homo Sapiens
cacacuaugauggauaaauguauauauauauacacacacacacaauauauuguugauauauaua

SEQ ID NO: 40200 - RNA, 64 nt, Homo Sapiens
cacacacuaugauggauaaauauauauauauauacacacacacauuauauauuguugauauaua

SEQ ID NO: 40201 - RNA, 64 nt, Homo Sapiens
uacuuauuauucaaguugaacagaaugcacauuucacacacauaacacacauuacacacacaca

SEQ ID NO: 40202 - RNA, 64 nt, Homo Sapiens
augcacauuucacacacauaacacacauuacacacacacacagaauacaccuguaugugcacau

SEQ ID NO: 40203 - RNA, 64 nt, Homo Sapiens
gaaugcacauuucacacacaauacacacauuacacacacacacaguauacaccuguaugugcac

SEQ ID NO: 40204 - RNA, 64 nt, Homo Sapiens
cagaaugcacauuucacacaacauacacacauuacacacacacaauguauacaccuguaugugc

SEQ ID NO: 40205 - RNA, 64 nt, Homo Sapiens
uauggacacaguacaauucucaaacauacagaaacacacacagaccugugauagcauacaaauu

SEQ ID NO: 40206 - RNA, 64 nt, Homo Sapiens
accccaaaccacuaaaaacuagcacaggcaugcacacacacagaugaaugcaacagaagacaaa

SEQ ID NO: 40207 - RNA, 64 nt, Homo Sapiens
gaaccccaaaccacuaaaaaaaagcacaggcaugcacacacacaucugaaugcaacagaagaca

SEQ ID NO: 40208 - RNA, 64 nt, Homo Sapiens
cacauauauacauguguagcaucccacaugcaaacacacacagccauauacauacacaaacaca

SEQ ID NO: 40209 - RNA, 64 nt, Homo Sapiens
aacauauacauacacaaacaauucauucaacucacacacacauacccagguucuuuaguuuuuu

SEQ ID NO: 40210 - RNA, 64 nt, Homo Sapiens
uaaacauauacauacacaaauuauucauucaacucacacacacaugcccagguucuuuaguuuu

SEQ ID NO: 40211 - RNA, 64 nt, Homo Sapiens
ccagggcuggggaccccugcgauuccuaacaggccacacacagcgcucaccaacuguguggccc

SEQ ID NO: 40212 - RNA, 64 nt, Homo Sapiens
cacacauacacacuuauuucaacacacacacacacacacacacgcacacacacacacacacacg

SEQ ID NO: 40213 - RNA, 64 nt, Homo Sapiens
cgcacacauacacacuuauucgaacacacacacacacacacacacacacacacacacacacaca

SEQ ID NO: 40214 - RNA, 64 nt, Homo Sapiens
cacgcacacauacacacuuacacgaacacacacacacacacacaagcacacacacacacacaca

SEQ ID NO: 40215 - RNA, 64 nt, Homo Sapiens
cacacgcacacauacacacucacacgaacacacacacacacacacgagcacacacacacacaca

SEQ ID NO: 40216 - RNA, 64 nt, Homo Sapiens
cacacacgcacacauacacacacacacgaacacacacacacacacacgagcacacacacacaca

SEQ ID NO: 40217 - RNA, 64 nt, Homo Sapiens
cacacacacgcacacauacacacacacacgaacacacacacacacacacgagcacacacacaca

SEQ ID NO: 40218 - RNA, 64 nt, Homo Sapiens
cacacacacacgcacacauacacacacacacgaacacacacacacacacacgagcacacacaca

SEQ ID NO: 40219 - RNA, 64 nt, Homo Sapiens
aacacacacacacacacacaagcacacacacacacacacacacgacacagcacacacacacacg

SEQ ID NO: 40220 - RNA, 64 nt, Homo Sapiens
cgaacacacacacacacacacgagcacacacacacacacacacaaaacacagcacacacacaca

SEQ ID NO: 40221 - RNA, 64 nt, Homo Sapiens
cacgaacacacacacacacacacgagcacacacacacacacacacaaaacacagcacacacaca

SEQ ID NO: 40222 - RNA, 64 nt, Homo Sapiens
cacacgaacacacacacacacacacgagcacacacacacacacacucaaaacacagcacacaca

SEQ ID NO: 40223 - RNA, 64 nt, Homo Sapiens
cacacacgaacacacacacacacacacgagcacacacacacacagccucaaaacacagcacaca

SEQ ID NO: 40224 - RNA, 64 nt, Homo Sapiens
cacacacacgaacacacacacacacacacgagcacacacacacaaagccucaaaacacagcaca

SEQ ID NO: 40225 - RNA, 64 nt, Homo Sapiens
cacacacacacgaacacacacacacacacacgagcacacacacauaaagccucaaaacacagca

SEQ ID NO: 40226 - RNA, 64 nt, Homo Sapiens
agcacacacacacacacacacaaaacacagcacacacacacacgucaaagcccacguaaagccu

SEQ ID NO: 40227 - RNA, 64 nt, Homo Sapiens
cgagcacacacacacacacacucaaaacacagcacacacacacacuucaaagcccacguaaagc

SEQ ID NO: 40228 - RNA, 64 nt, Homo Sapiens
cacgagcacacacacacacagccucaaaacacagcacacacacagccuucaaagcccacguaaa

SEQ ID NO: 40229 - RNA, 64 nt, Homo Sapiens
guaaccuguaacucucaauucacacacacacacacacacacagaaaucgggaaauuuacacaca

SEQ ID NO: 40230 - RNA, 64 nt, Homo Sapiens
gaguaaccuguaacucucaacacacacacacacacacacacacauaaaucgggaaauuuacaca

SEQ ID NO: 40231 - RNA, 64 nt, Homo Sapiens
cacacacacacacagaguaacacacacacacacacacacacacagauaaaucgggaaauuuaca

SEQ ID NO: 40232 - RNA, 64 nt, Homo Sapiens
cacacacacacacacagagucacacacacacacacacacacacagugauaaaucgggaaauuua

SEQ ID NO: 40233 - RNA, 64 nt, Homo Sapiens
cacacacacacacacacagauacacacacacacacacacacacauagugauaaaucgggaaauu

SEQ ID NO: 40234 - RNA, 64 nt, Homo Sapiens
cacacacacacacacacacauuuacacacacacacacacacacaucuagugauaaaucgggaaa

SEQ ID NO: 40235 - RNA, 64 nt, Homo Sapiens
cacacacacacacacacacaaauuuacacacacacacacacacaacucuagugauaaaucggga

SEQ ID NO: 40236 - RNA, 64 nt, Homo Sapiens
cacacacacacacacacacagaaauuuacacacacacacacacaucacucuagugauaaaucgg

SEQ ID NO: 40237 - RNA, 64 nt, Homo Sapiens
cacacacacacacacacacagggaaauuuacacacacacacacaacucacucuagugauaaauc

SEQ ID NO: 40238 - RNA, 64 nt, Homo Sapiens
cacacacacacacacacacaucgggaaauuuacacacacacacauuacucacucuagugauaaa

SEQ ID NO: 40239 - RNA, 64 nt, Homo Sapiens
cacacacacacacacacacaaaucgggaaauuuacacacacacaaguuacucacucuagugaua

SEQ ID NO: 40240 - RNA, 64 nt, Homo Sapiens
cacagaggugaacagaaacugcacacaacacauacacacacacgacacacacacacacacacau

SEQ ID NO: 40241 - RNA, 64 nt, Homo Sapiens
cacacaacacauacacacaccacccccacacacacacacacaugcacauaccuaccccaucccc

SEQ ID NO: 40242 - RNA, 64 nt, Homo Sapiens
ugcacacaacacauacacaccccacccccacacacacacacacaagcacauaccuaccccaucc

SEQ ID NO: 40243 - RNA, 64 nt, Homo Sapiens
cacacacaugcacacaacaccccccacccccacacacacacacaaaagcacauaccuaccccau

SEQ ID NO: 40244 - RNA, 64 nt, Homo Sapiens
cacacacacaugcacacaacaucccccacccccacacacacacacaaaagcacauaccuacccc

SEQ ID NO: 40245 - RNA, 64 nt, Homo Sapiens
cacacacacacaugcacacaccaucccccacccccacacacacagccaaaagcacauaccuacc

SEQ ID NO: 40246 - RNA, 64 nt, Homo Sapiens
uauauauauauuaaacuuaguacuauuucaaacacacacacauauucaauucuuccuuuuuuau

SEQ ID NO: 40247 - RNA, 64 nt, Homo Sapiens
uauauauauauauuaaacuuauuacuauuucaaacacacacacaaauucaauucuuccuuuuuu

SEQ ID NO: 40248 - RNA, 64 nt, Homo Sapiens
uccuuucacuccugccugacugugucacucucaacacacacagcggagaggaaacccuagacuc

SEQ ID NO: 40249 - RNA, 64 nt, Homo Sapiens
gcagaacccagaacagaagguuccccaaucaauacacacacacucgaggguuuucuuacccaca

SEQ ID NO: 40250 - RNA, 64 nt, Homo Sapiens
ucugagaauacccacugccauaaacuuguaaauccacacacaacuucugaaaagagugggcuga

SEQ ID NO: 40251 - RNA, 64 nt, Homo Sapiens
cucgcgcucucucucucaaccacacacacacacacacacacacucgcacacacacacacacaca

SEQ ID NO: 40252 - RNA, 64 nt, Homo Sapiens
cucucgcgcucucucucucacacacacacacacacacacacacaagcgcacacacacacacaca

SEQ ID NO: 40253 - RNA, 64 nt, Homo Sapiens
cacucucgcgcucucucucucacacacacacacacacacacacaaaagcgcacacacacacaca

SEQ ID NO: 40254 - RNA, 64 nt, Homo Sapiens
cacacucucgcgcucucucucacacacacacacacacacacacauaaaagcgcacacacacaca

SEQ ID NO: 40255 - RNA, 64 nt, Homo Sapiens
cacacacucucgcgcucucucacacacacacacacacacacacauuuaaaagcgcacacacaca

SEQ ID NO: 40256 - RNA, 64 nt, Homo Sapiens
cacacacacucucgcgcucucacacacacacacacacacacacaugcucccuccaauuuaaaag

SEQ ID NO: 40257 - RNA, 64 nt, Homo Sapiens
cacacacacacucucgcgcuagcacacacacacacacacacacacaugcucccuccaauuuaaa

SEQ ID NO: 40258 - RNA, 64 nt, Homo Sapiens
cacacacacacacucucgcgaaagcacacacacacacacacacagacaugcucccuccaauuua

SEQ ID NO: 40259 - RNA, 64 nt, Homo Sapiens
cacacacacacacacucucguaaaagcacacacacacacacacacugacaugcucccuccaauu

SEQ ID NO: 40260 - RNA, 64 nt, Homo Sapiens
cacacacacacacacacucuuuuaaaagcacacacacacacacauccugacaugcucccuccaa

SEQ ID NO: 40261 - RNA, 64 nt, Homo Sapiens
cacacacacacacacacacuaauuuaaaagcacacacacacacaaauccugacaugcucccucc

SEQ ID NO: 40262 - RNA, 64 nt, Homo Sapiens
cacacacacacacacacacaccaauuuaaaagcacacacacacaacaauccugacaugcucccu

SEQ ID NO: 40263 - RNA, 64 nt, Homo Sapiens
cacacacacacacacacacacuccaauuuaaaagcacacacacauaacaauccugacaugcucc

SEQ ID NO: 40264 - RNA, 64 nt, Homo Sapiens
ccuaccccacacugacuguccacacacacacacacacacacaccuuacauaagcuguguauaca

SEQ ID NO: 40265 - RNA, 64 nt, Homo Sapiens
ccccuaccccacacugacugcacacacacacacacacacacacaauuuacauaagcuguguaua

SEQ ID NO: 40266 - RNA, 64 nt, Homo Sapiens
caccccuaccccacacugacuacacacacacacacacacacacacgauuuacauaagcugugua

SEQ ID NO: 40267 - RNA, 64 nt, Homo Sapiens
cacaccccuaccccacacuguauacacacacacacacacacacagucgauuuacauaagcugug

SEQ ID NO: 40268 - RNA, 64 nt, Homo Sapiens
cacacaccccuaccccacacuguauacacacacacacacacacagagucgauuuacauaagcug

SEQ ID NO: 40269 - RNA, 64 nt, Homo Sapiens
cacacacaccccuaccccacuguguauacacacacacacacacagagagucgauuuacauaagc

SEQ ID NO: 40270 - RNA, 64 nt, Homo Sapiens
cacacacacaccccuaccccgcuguguauacacacacacacacauggagagucgauuuacauaa

SEQ ID NO: 40271 - RNA, 64 nt, Homo Sapiens
cacacacacacaccccuaccaagcuguguauacacacacacacauguggagagucgauuuacau

SEQ ID NO: 40272 - RNA, 64 nt, Homo Sapiens
cacacacacacacaccccuaauaagcuguguauacacacacacaucuguggagagucgauuuac

SEQ ID NO: 40273 - RNA, 64 nt, Homo Sapiens
ggcauguuuauacacagggacacacacaccuguacacacacaccaaacacauuaugcuuuugca

SEQ ID NO: 40274 - RNA, 64 nt, Homo Sapiens
uguacacacacaccggcaugauuaugcuuuugcacacacacaccaugcaaaccuuugcaaacac

SEQ ID NO: 40275 - RNA, 64 nt, Homo Sapiens
ccuguacacacacaccggcaacauuaugcuuuugcacacacacaaaaugcaaaccuuugcaaac

SEQ ID NO: 40276 - RNA, 64 nt, Homo Sapiens
gcagauuuuuuagaagggauaggagacacacgcgcacacacacacacacacgaaacuugaaaug

SEQ ID NO: 40277 - RNA, 64 nt, Homo Sapiens
agauuuuuuagaagggauaggagacacacgcgcacacacacacacacacgaaacuugaaauggc

SEQ ID NO: 40278 - RNA, 64 nt, Homo Sapiens
auuuuuuagaagggauaggagacacacgcgcacacacacacacacacgaaacuugaaauggcuu

SEQ ID NO: 40279 - RNA, 64 nt, Homo Sapiens
uuuuuagaagggauaggagacacacgcgcacacacacacacacacgaaacuugaaauggcuuug

SEQ ID NO: 40280 - RNA, 64 nt, Homo Sapiens
uuuagaagggauaggagacacacgcgcacacacacacacacacgaaacuugaaauggcuuugcu

SEQ ID NO: 40281 - RNA, 64 nt, Homo Sapiens
ggaaaauauauguguauguacacauguguauguacacacacacacacaccugccauacacuuua

SEQ ID NO: 40282 - RNA, 64 nt, Homo Sapiens
aaaauauauguguauguacacauguguauguacacacacacacacaccugccauacacuuuaga

SEQ ID NO: 40283 - RNA, 64 nt, Homo Sapiens
aauauauguguauguacacauguguauguacacacacacacacaccugccauacacuuuagaag

SEQ ID NO: 40284 - RNA, 64 nt, Homo Sapiens
uauauguguauguacacauguguauguacacacacacacacaccugccauacacuuuagaagaa

SEQ ID NO: 40285 - RNA, 64 nt, Homo Sapiens
uuugccaggccaauguugcugauggccccuccagcacacacacauaagcacugaaaucacuuua

SEQ ID NO: 40286 - RNA, 64 nt, Homo Sapiens
ugccaggccaauguugcugauggccccuccagcacacacacauaagcacugaaaucacuuuacc

SEQ ID NO: 40287 - RNA, 64 nt, Homo Sapiens
ggccuucccucccaggucugugucugauagcauacacacacacauauauauacacacacacaca

SEQ ID NO: 40288 - RNA, 64 nt, Homo Sapiens
ccuucccucccaggucugugucugauagcauacacacacacauauauauacacacacacacaca

SEQ ID NO: 40289 - RNA, 64 nt, Homo Sapiens
ugugucugauagcauacacacacacauauauauacacacacacacacacacacacacacacaca

SEQ ID NO: 40290 - RNA, 64 nt, Homo Sapiens
ugucugauagcauacacacacacauauauauacacacacacacacacacacacacacacacaca

SEQ ID NO: 40291 - RNA, 64 nt, Homo Sapiens
ucugauagcauacacacacacauauauauacacacacacacacacacacacacacacacacaca

SEQ ID NO: 40292 - RNA, 64 nt, Homo Sapiens
ugauagcauacacacacacauauauauacacacacacacacacacacacacacacacacacaca

SEQ ID NO: 40293 - RNA, 64 nt, Homo Sapiens
auagcauacacacacacauauauauacacacacacacacacacacacacacacacacacacaua

SEQ ID NO: 40294 - RNA, 64 nt, Homo Sapiens
agcauacacacacacauauauauacacacacacacacacacacacacacacacacacacauaca

SEQ ID NO: 40295 - RNA, 64 nt, Homo Sapiens
cauacacacacacauauauauacacacacacacacacacacacacacacacacacacauacaua

SEQ ID NO: 40296 - RNA, 64 nt, Homo Sapiens
uacacacacacauauauauacacacacacacacacacacacacacacacacacacauacauaca

SEQ ID NO: 40297 - RNA, 64 nt, Homo Sapiens
cacacacacauauauauacacacacacacacacacacacacacacacacacacauacauacaca

SEQ ID NO: 40298 - RNA, 64 nt, Homo Sapiens
cacacacauauauauacacacacacacacacacacacacacacacacacacauacauacacaca

SEQ ID NO: 40299 - RNA, 64 nt, Homo Sapiens
cacacauauauauacacacacacacacacacacacacacacacacacacauacauacacacaca

SEQ ID NO: 40300 - RNA, 64 nt, Homo Sapiens
cacauauauauacacacacacacacacacacacacacacacacacacauacauacacacacaca

SEQ ID NO: 40301 - RNA, 64 nt, Homo Sapiens
cauauauauacacacacacacacacacacacacacacacacacacauacauacacacacacaua

SEQ ID NO: 40302 - RNA, 64 nt, Homo Sapiens
uauauauacacacacacacacacacacacacacacacacacacauacauacacacacacauaua

SEQ ID NO: 40303 - RNA, 64 nt, Homo Sapiens
uauauacacacacacacacacacacacacacacacacacacauacauacacacacacauauaua

SEQ ID NO: 40304 - RNA, 64 nt, Homo Sapiens
cacacacacacacacacacacacacacauacauacacacacacauauauauacacacacacaca

SEQ ID NO: 40305 - RNA, 64 nt, Homo Sapiens
cacacacacacacacacacacacacauacauacacacacacauauauauacacacacacacaca

SEQ ID NO: 40306 - RNA, 64 nt, Homo Sapiens
cacacacacauacauacacacacacauauauauacacacacacacacacacacacacacacacu

SEQ ID NO: 40307 - RNA, 64 nt, Homo Sapiens
cacacacauacauacacacacacauauauauacacacacacacacacacacacacacacacucu

SEQ ID NO: 40308 - RNA, 64 nt, Homo Sapiens
cacacauacauacacacacacauauauauacacacacacacacacacacacacacacacucucu

SEQ ID NO: 40309 - RNA, 64 nt, Homo Sapiens
cacauacauacacacacacauauauauacacacacacacacacacacacacacacacucucucu

SEQ ID NO: 40310 - RNA, 64 nt, Homo Sapiens
cauacauacacacacacauauauauacacacacacacacacacacacacacacacucucucucu

SEQ ID NO: 40311 - RNA, 64 nt, Homo Sapiens
uacauacacacacacauauauauacacacacacacacacacacacacacacacucucucucucu

SEQ ID NO: 40312 - RNA, 64 nt, Homo Sapiens
cauacacacacacauauauauacacacacacacacacacacacacacacacucucucucucucu

SEQ ID NO: 40313 - RNA, 64 nt, Homo Sapiens
uacacacacacauauauauacacacacacacacacacacacacacacacucucucucucucuca

SEQ ID NO: 40314 - RNA, 64 nt, Homo Sapiens
cacacacacauauauauacacacacacacacacacacacacacacacucucucucucucucaaa

SEQ ID NO: 40315 - RNA, 64 nt, Homo Sapiens
cacacacauauauauacacacacacacacacacacacacacacacucucucucucucucaaaca

SEQ ID NO: 40316 - RNA, 64 nt, Homo Sapiens
cacacauauauauacacacacacacacacacacacacacacacucucucucucucucaaacaca

SEQ ID NO: 40317 - RNA, 64 nt, Homo Sapiens
cacacacacacacacacucucucucucucucaaacacacacaaaugcccaaccagcucuaagag

SEQ ID NO: 40318 - RNA, 64 nt, Homo Sapiens
ugguuuuuacuuaacuguuucaaagccaagaccucacacacacaaaaaaugcacaaacaaugca

SEQ ID NO: 40319 - RNA, 64 nt, Homo Sapiens
guuuuuacuuaacuguuucaaagccaagaccucacacacacaaaaaaugcacaaacaaugcaau

SEQ ID NO: 40320 - RNA, 64 nt, Homo Sapiens
gagagacacucccagggacaagggaaggaagggacacacacacacacacacacacacacacaca

SEQ ID NO: 40321 - RNA, 64 nt, Homo Sapiens
gagacacucccagggacaagggaaggaagggacacacacacacacacacacacacacacacaca

SEQ ID NO: 40322 - RNA, 64 nt, Homo Sapiens
gacacucccagggacaagggaaggaagggacacacacacacacacacacacacacacacacaca

SEQ ID NO: 40323 - RNA, 64 nt, Homo Sapiens
cacucccagggacaagggaaggaagggacacacacacacacacacacacacacacacacacaca

SEQ ID NO: 40324 - RNA, 64 nt, Homo Sapiens
cucccagggacaagggaaggaagggacacacacacacacacacacacacacacacacacacaca

SEQ ID NO: 40325 - RNA, 64 nt, Homo Sapiens
cccagggacaagggaaggaagggacacacacacacacacacacacacacacacacacacacaua

SEQ ID NO: 40326 - RNA, 64 nt, Homo Sapiens
cagggacaagggaaggaagggacacacacacacacacacacacacacacacacacacacauaca

SEQ ID NO: 40327 - RNA, 64 nt, Homo Sapiens
gggacaagggaaggaagggacacacacacacacacacacacacacacacacacacacauacauc

SEQ ID NO: 40328 - RNA, 64 nt, Homo Sapiens
gacaagggaaggaagggacacacacacacacacacacacacacacacacacacacauacauccu

SEQ ID NO: 40329 - RNA, 64 nt, Homo Sapiens
caagggaaggaagggacacacacacacacacacacacacacacacacacacacauacauccugc

SEQ ID NO: 40330 - RNA, 64 nt, Homo Sapiens
agggaaggaagggacacacacacacacacacacacacacacacacacacacauacauccugcuu

SEQ ID NO: 40331 - RNA, 64 nt, Homo Sapiens
ggaaggaagggacacacacacacacacacacacacacacacacacacacauacauccugcuuuc

SEQ ID NO: 40332 - RNA, 64 nt, Homo Sapiens
aaggaagggacacacacacacacacacacacacacacacacacacacauacauccugcuuuccc

SEQ ID NO: 40333 - RNA, 64 nt, Homo Sapiens
ggaagggacacacacacacacacacacacacacacacacacacacauacauccugcuuucccuc

SEQ ID NO: 40334 - RNA, 64 nt, Homo Sapiens
aagggacacacacacacacacacacacacacacacacacacacauacauccugcuuucccuccc

SEQ ID NO: 40335 - RNA, 64 nt, Homo Sapiens
gggacacacacacacacacacacacacacacacacacacacauacauccugcuuucccucccca

SEQ ID NO: 40336 - RNA, 64 nt, Homo Sapiens
auuuaguuuacuagaaauucuuuaccuuaagcagcacacacauuuacuacacacacaguguuaa

SEQ ID NO: 40337 - RNA, 64 nt, Homo Sapiens
aauucuuuaccuuaagcagcacacacauuuacuacacacacaguguuaacaaagcacugugcuu

SEQ ID NO: 40338 - RNA, 64 nt, Homo Sapiens
ccgaaaacugguuucuaguaaagccuugaaugaacacacacacacacacacacacacacacaca

SEQ ID NO: 40339 - RNA, 64 nt, Homo Sapiens
gaaaacugguuucuaguaaagccuugaaugaacacacacacacacacacacacacacacacaca

SEQ ID NO: 40340 - RNA, 64 nt, Homo Sapiens
aaacugguuucuaguaaagccuugaaugaacacacacacacacacacacacacacacacacaca

SEQ ID NO: 40341 - RNA, 64 nt, Homo Sapiens
acugguuucuaguaaagccuugaaugaacacacacacacacacacacacacacacacacacaca

SEQ ID NO: 40342 - RNA, 64 nt, Homo Sapiens
ugguuucuaguaaagccuugaaugaacacacacacacacacacacacacacacacacacacaca

SEQ ID NO: 40343 - RNA, 64 nt, Homo Sapiens
guuucuaguaaagccuugaaugaacacacacacacacacacacacacacacacacacacacaca

SEQ ID NO: 40344 - RNA, 64 nt, Homo Sapiens
uucuaguaaagccuugaaugaacacacacacacacacacacacacacacacacacacacacaca

SEQ ID NO: 40345 - RNA, 64 nt, Homo Sapiens
cuaguaaagccuugaaugaacacacacacacacacacacacacacacacacacacacacacaca

SEQ ID NO: 40346 - RNA, 64 nt, Homo Sapiens
aguaaagccuugaaugaacacacacacacacacacacacacacacacacacacacacacacaca

SEQ ID NO: 40347 - RNA, 64 nt, Homo Sapiens
uaaagccuugaaugaacacacacacacacacacacacacacacacacacacacacacacacaca

SEQ ID NO: 40348 - RNA, 64 nt, Homo Sapiens
aagccuugaaugaacacacacacacacacacacacacacacacacacacacacacacacacacc

SEQ ID NO: 40349 - RNA, 64 nt, Homo Sapiens
gccuugaaugaacacacacacacacacacacacacacacacacacacacacacacacacaccgu

SEQ ID NO: 40350 - RNA, 64 nt, Homo Sapiens
cuugaaugaacacacacacacacacacacacacacacacacacacacacacacacacaccgucc

SEQ ID NO: 40351 - RNA, 64 nt, Homo Sapiens
ugaaugaacacacacacacacacacacacacacacacacacacacacacacacacaccguccua

SEQ ID NO: 40352 - RNA, 64 nt, Homo Sapiens
aaugaacacacacacacacacacacacacacacacacacacacacacacacacaccguccuaca

SEQ ID NO: 40353 - RNA, 64 nt, Homo Sapiens
ugaacacacacacacacacacacacacacacacacacacacacacacacacaccguccuacacu

SEQ ID NO: 40354 - RNA, 64 nt, Homo Sapiens
aacacacacacacacacacacacacacacacacacacacacacacacacaccguccuacacuuu

SEQ ID NO: 40355 - RNA, 64 nt, Homo Sapiens
cacacacacacacacacacacacacacacacacacacacacacacacaccguccuacacuuuaa

SEQ ID NO: 40356 - RNA, 64 nt, Homo Sapiens
cacacacacacacacacacacacacacacacacacacacacacacaccguccuacacuuuaagc

SEQ ID NO: 40357 - RNA, 64 nt, Homo Sapiens
cacacacacacacacacacacacacacacacacacacacacacaccguccuacacuuuaagcug

SEQ ID NO: 40358 - RNA, 64 nt, Homo Sapiens
cacacacacacacacacacacacacacacacacacacacacaccguccuacacuuuaagcugcu

SEQ ID NO: 40359 - RNA, 64 nt, Homo Sapiens
ucucuuuucucuuuugcuuucuguuucuuaagggcacacacacgugcgugcgagcacacacaca

SEQ ID NO: 40360 - RNA, 64 nt, Homo Sapiens
cuguuucuuaagggcacacacacgugcgugcgagcacacacacacauacgugcacagggucccc

SEQ ID NO: 40361 - RNA, 64 nt, Homo Sapiens
guuucuuaagggcacacacacgugcgugcgagcacacacacacauacgugcacaggguccccga

SEQ ID NO: 40362 - RNA, 64 nt, Homo Sapiens
uucuuaagggcacacacacgugcgugcgagcacacacacacauacgugcacaggguccccgagu

SEQ ID NO: 40363 - RNA, 64 nt, Homo Sapiens
acccugugacuggaguguuaaccacacacacacacacacacaaaaguuugcuuaaaacacacac

SEQ ID NO: 40364 - RNA, 64 nt, Homo Sapiens
aaacccugugacuggaguguacaccacacacacacacacacacauuaguuugcuuaaaacacac

SEQ ID NO: 40365 - RNA, 64 nt, Homo Sapiens
caaaacccugugacuggaguacacaccacacacacacacacacaauuuaguuugcuuaaaacac

SEQ ID NO: 40366 - RNA, 64 nt, Homo Sapiens
cacaaaacccugugacuggaacacacaccacacacacacacacauaauuuaguuugcuuaaaac

SEQ ID NO: 40367 - RNA, 64 nt, Homo Sapiens
cacacaaaacccugugacugacacacacaccacacacacacacauuuaauuuaguuugcuuaaa

SEQ ID NO: 40368 - RNA, 64 nt, Homo Sapiens
cacacacaaaacccugugacaaacacacacaccacacacacacauguuuaauuuaguuugcuua

SEQ ID NO: 40369 - RNA, 64 nt, Homo Sapiens
cacacacacaaaacccuguguaaaacacacacaccacacacacaaguguuuaauuuaguuugcu

SEQ ID NO: 40370 - RNA, 64 nt, Homo Sapiens
acacacacacacacacacaauaguuugcuuaaaacacacacacccuaugcuuaaguguuuaauu

SEQ ID NO: 40371 - RNA, 64 nt, Homo Sapiens
cccgucacccacaccuugagggggcugcccuccacacacacacgagaggcaaauccacagaagg

SEQ ID NO: 40372 - RNA, 64 nt, Homo Sapiens
cgcccgucacccacaccuugggggggcugcccuccacacacacagcagaggcaaauccacagaa

SEQ ID NO: 40373 - RNA, 64 nt, Homo Sapiens
aauaccugaauauccaacgguguuuuagcuguuacacacacaguuuauuuucccuccucccucu

SEQ ID NO: 40374 - RNA, 64 nt, Homo Sapiens
uaagaaaacggcaaacccaccuuuaguccgucuucacacacaaacagccaaaaucggaccucag

SEQ ID NO: 40375 - RNA, 64 nt, Homo Sapiens
cucccacuugcaacuauucuucucccacaccucacacacacauaccucugucuuucucucuccc

SEQ ID NO: 40376 - RNA, 64 nt, Homo Sapiens
uacucccacuugcaacuauuccucucccacaccucacacacacacuccucugucuuucucucuc

SEQ ID NO: 40377 - RNA, 64 nt, Homo Sapiens
cuugcucuacccaaagcucuucccauucaacacacacacacauuggacaccuacuagcuucccu

SEQ ID NO: 40378 - RNA, 64 nt, Homo Sapiens
uucuugcucuacccaaagcucuucccauucaacacacacacacauuggacaccuacuagcuucc

SEQ ID NO: 40379 - RNA, 64 nt, Homo Sapiens
cauucuugcucuacccaaagcccuucccauucaacacacacacauguuggacaccuacuagcuu

SEQ ID NO: 40380 - RNA, 64 nt, Homo Sapiens
gauauauuaaagcacaaguucacacucaugcucacacacacagaguuccacuugcacacacgca

SEQ ID NO: 40381 - RNA, 64 nt, Homo Sapiens
gagauauauuaaagcacaagcacacacucaugcucacacacacacuguuccacuugcacacacg

SEQ ID NO: 40382 - RNA, 64 nt, Homo Sapiens
caucucugucuagcaagcaggacagacagacacgcacacacaccccaggacagacagacagaca

SEQ ID NO: 40383 - RNA, 64 nt, Homo Sapiens
ugucuacugaccuggagugacacacacacacacacacacacaggcacacacacacacacacaca

SEQ ID NO: 40384 - RNA, 64 nt, Homo Sapiens
ggugucuacugaccuggagucacacacacacacacacacacacacacacacacacacacacaca

SEQ ID NO: 40385 - RNA, 64 nt, Homo Sapiens
caggugucuacugaccuggacacacacacacacacacacacacacacacacacacacacacaca

SEQ ID NO: 40386 - RNA, 64 nt, Homo Sapiens
cacaggugucuacugaccugcacacacacacacacacacacacacacacacacacacacacaca

SEQ ID NO: 40387 - RNA, 64 nt, Homo Sapiens
cacacaggugucuacugacccacacacacacacacacacacacacacacacacacacacacaca

SEQ ID NO: 40388 - RNA, 64 nt, Homo Sapiens
cacacacaggugucuacugacacacacacacacacacacacacacacacacacacacacacaca

SEQ ID NO: 40389 - RNA, 64 nt, Homo Sapiens
cacacacacaggugucuacucacacacacacacacacacacacauacacacacacacacacaca

SEQ ID NO: 40390 - RNA, 64 nt, Homo Sapiens
cacacacacacaggugucuacacacacacacacacacacacacaccuacacacacacacacaca

SEQ ID NO: 40391 - RNA, 64 nt, Homo Sapiens
cacacacacacacagguguccacacacacacacacacacacacaccccuacacacacacacaca

SEQ ID NO: 40392 - RNA, 64 nt, Homo Sapiens
cacacacacacacacaggugcacacacacacacacacacacacauuccccuacacacacacaca

SEQ ID NO: 40393 - RNA, 64 nt, Homo Sapiens
cacacacacacacacacaggcacacacacacacacacacacacagauuccccuacacacacaca

SEQ ID NO: 40394 - RNA, 64 nt, Homo Sapiens
cacacacacacacacacacacacacacacacacacacacacacauggauuccccuacacacaca

SEQ ID NO: 40395 - RNA, 64 nt, Homo Sapiens
cacacacacacacacacacacacacacacacacacacacacacaccuggauuccccuacacaca

SEQ ID NO: 40396 - RNA, 64 nt, Homo Sapiens
cacacacacacacacacacacacacacacacacacacacacacaagccuggauuccccuacaca

SEQ ID NO: 40397 - RNA, 64 nt, Homo Sapiens
cacacacacacacacacacacacacacacacacacacacacacagcagccuggauuccccuaca

SEQ ID NO: 40398 - RNA, 64 nt, Homo Sapiens
cacacacacacacacacacacacacacacacacacacacacacaaugcagccuggauuccccua

SEQ ID NO: 40399 - RNA, 64 nt, Homo Sapiens
cacacacacacacacacacauacacacacacacacacacacacagaaugcagccuggauucccc

SEQ ID NO: 40400 - RNA, 64 nt, Homo Sapiens
cacacacacacacacacacaccuacacacacacacacacacacagagaaugcagccuggauucc

SEQ ID NO: 40401 - RNA, 64 nt, Homo Sapiens
cacacacacacacacacacaccccuacacacacacacacacacauggagaaugcagccuggauu

SEQ ID NO: 40402 - RNA, 64 nt, Homo Sapiens
cacacacacacacacacacauuccccuacacacacacacacacagcuggagaaugcagccugga

SEQ ID NO: 40403 - RNA, 64 nt, Homo Sapiens
cacacacacacacacacacagauuccccuacacacacacacacaaggcuggagaaugcagccug

SEQ ID NO: 40404 - RNA, 64 nt, Homo Sapiens
cacacacacacacacacacauggauuccccuacacacacacacagaaggcuggagaaugcagcc

SEQ ID NO: 40405 - RNA, 64 nt, Homo Sapiens
cacacacacacacacacacaccuggauuccccuacacacacacaaugaaggcuggagaaugcag

SEQ ID NO: 40406 - RNA, 64 nt, Homo Sapiens
gaccaaaauacuuacaccugcacacacacacauacacacacacguauuuagguauacacacaca

SEQ ID NO: 40407 - RNA, 64 nt, Homo Sapiens
cacacacacggaccaaaauauacacacacacacacacacacauaagcaguuacauauuuaggua

SEQ ID NO: 40408 - RNA, 64 nt, Homo Sapiens
uacacacacacggaccaaaauauacacacacacacacacacacauaagcaguuacauauuuagg

SEQ ID NO: 40409 - RNA, 64 nt, Homo Sapiens
cauacacacacacggaccaagguauacacacacacacacacacaauuaagcaguuacauauuua

SEQ ID NO: 40410 - RNA, 64 nt, Homo Sapiens
cacauacacacacacggaccuagguauacacacacacacacacaccauuaagcaguuacauauu

SEQ ID NO: 40411 - RNA, 64 nt, Homo Sapiens
cacacauacacacacacggauuuagguauacacacacacacacaaaccauuaagcaguuacaua

SEQ ID NO: 40412 - RNA, 64 nt, Homo Sapiens
cacacacauacacacacacguauuuagguauacacacacacacagaaaccauuaagcaguuaca

SEQ ID NO: 40413 - RNA, 64 nt, Homo Sapiens
cacacacacauacacacacacauauuuagguauacacacacacacagaaaccauuaagcaguua

SEQ ID NO: 40414 - RNA, 64 nt, Homo Sapiens
cauacauacauauauauauacacacacacacacacacacacauaauuccauauauacacacaca

SEQ ID NO: 40415 - RNA, 64 nt, Homo Sapiens
uacauacauacauauauauacacacacacacacacacacacacauuauuccauauauacacaca

SEQ ID NO: 40416 - RNA, 64 nt, Homo Sapiens
cauacauacauacauauauacacacacacacacacacacacacacuuuauuccauauauacaca

SEQ ID NO: 40417 - RNA, 64 nt, Homo Sapiens
cacauacauacauacauauacacacacacacacacacacacacaaacuuuauuccauauauaca

SEQ ID NO: 40418 - RNA, 64 nt, Homo Sapiens
cacacauacauacauacauacacacacacacacacacacacacacaaacuuuauuccauauaua

SEQ ID NO: 40419 - RNA, 64 nt, Homo Sapiens
cacacacauacauacauacauacacacacacacacacacacacacucaaacuuuauuccauaua

SEQ ID NO: 40420 - RNA, 64 nt, Homo Sapiens
cacacacacauacauacauauauacacacacacacacacacacaaucucaaacuuuauuccaua

SEQ ID NO: 40421 - RNA, 64 nt, Homo Sapiens
cacacacacacauacauacauauauacacacacacacacacacagaaucucaaacuuuauucca

SEQ ID NO: 40422 - RNA, 64 nt, Homo Sapiens
cacacacacacacauacauacauauauacacacacacacacacagggaaucucaaacuuuauuc

SEQ ID NO: 40423 - RNA, 64 nt, Homo Sapiens
cacacacacacacacauacauccauauauacacacacacacacacagggaaucucaaacuuuau

SEQ ID NO: 40424 - RNA, 64 nt, Homo Sapiens
cacacacacacacacacauaauuccauauauacacacacacacaagcagggaaucucaaacuuu

SEQ ID NO: 40425 - RNA, 64 nt, Homo Sapiens
cacacacacacacacacacauuauuccauauauacacacacacaaaagcagggaaucucaaacu

SEQ ID NO: 40426 - RNA, 64 nt, Homo Sapiens
agauaauauaaacuuaauaauauuuagacaaacacacacacaccgugaauuacuaguuucucuu

SEQ ID NO: 40427 - RNA, 64 nt, Homo Sapiens
ccagauaauauaaacuuaauuuuauuuagacaaacacacacacaaagugaauuacuaguuucuc

SEQ ID NO: 40428 - RNA, 64 nt, Homo Sapiens
cuucaaguuuuuuucaaagucacgcgcgcgcgcgcacacacacuucuuuucaaacacacacaca

SEQ ID NO: 40429 - RNA, 64 nt, Homo Sapiens
cgcgcgcgcgcacacacacuucuuuucaaacacacacacacacgcuaccuucauuuucuaauuc

SEQ ID NO: 40430 - RNA, 64 nt, Homo Sapiens
cgcgcgcgcgcgcacacacaucucuuuucaaacacacacacacagucuaccuucauuuucuaau

SEQ ID NO: 40431 - RNA, 64 nt, Homo Sapiens
cacgcgcgcgcgcgcacacaauucucuuuucaaacacacacacagugucuaccuucauuuucua

SEQ ID NO: 40432 - RNA, 64 nt, Homo Sapiens
agagacagaaggaaagagaggauacauacacauacacacacacgguauacauauguguauauau

SEQ ID NO: 40433 - RNA, 64 nt, Homo Sapiens
gauguauauaggauacacacuaauauauguagaacacacacauacauauauauauggauggaug

SEQ ID NO: 40434 - RNA, 64 nt, Homo Sapiens
uauauauggauggauguaauuggcuagauauauacacacacauaaagagagagaaguaccacug

SEQ ID NO: 40435 - RNA, 64 nt, Homo Sapiens
gucucucucucucucucucuuugcucuaauaacacacacacacuuauuuuucuuguggaggucu

SEQ ID NO: 40436 - RNA, 64 nt, Homo Sapiens
cugucucucucucucucucucuuugcucuaauaacacacacacauguauuuuucuuguggaggu

SEQ ID NO: 40437 - RNA, 64 nt, Homo Sapiens
caguaugcuauaaaugauaccccccuaccacacccacacacacaguuuuugucuaaugaaaaug

SEQ ID NO: 40438 - RNA, 64 nt, Homo Sapiens
guaugcuauaaaugauaccccccuaccacacccacacacacaguuuuugucuaaugaaaauguu

SEQ ID NO: 40439 - RNA, 64 nt, Homo Sapiens
aggacugcaguauuugugugcccgauucuguaaacacacacacacagaguauauauguguauau

SEQ ID NO: 40440 - RNA, 64 nt, Homo Sapiens
gacugcaguauuugugugcccgauucuguaaacacacacacacagaguauauauguguauauau

SEQ ID NO: 40441 - RNA, 64 nt, Homo Sapiens
cugcaguauuugugugcccgauucuguaaacacacacacacagaguauauauguguauauauau

SEQ ID NO: 40442 - RNA, 64 nt, Homo Sapiens
gaggugccccugcccagcccuguccagccuuguccacacacacaucucacgccccuggucucac

SEQ ID NO: 40443 - RNA, 64 nt, Homo Sapiens
ggugccccugcccagcccuguccagccuuguccacacacacaucucacgccccuggucucacag

SEQ ID NO: 40444 - RNA, 64 nt, Homo Sapiens
cagaaaauauuuucagccuacaguuauguucagucacacacacauacaaaauguuccuuuugcu

SEQ ID NO: 40445 - RNA, 64 nt, Homo Sapiens
gaaaauauuuucagccuacaguuauguucagucacacacacauacaaaauguuccuuuugcuuu

SEQ ID NO: 40446 - RNA, 64 nt, Homo Sapiens
uucucucugccguggcccagagccggcccagcugcacacacacaccaugcucucgcccugcugu

SEQ ID NO: 40447 - RNA, 64 nt, Homo Sapiens
cucucugccguggcccagagccggcccagcugcacacacacaccaugcucucgcccugcuguaa

SEQ ID NO: 40448 - RNA, 64 nt, Homo Sapiens
acgggauccuucucccgcugcccaccaacaccaacacacacacaccucuaagcugcuggccgaa

SEQ ID NO: 40449 - RNA, 64 nt, Homo Sapiens
gggauccuucucccgcugcccaccaacaccaacacacacacaccucuaagcugcuggccgaaga

SEQ ID NO: 40450 - RNA, 64 nt, Homo Sapiens
gcagcuaaguggguccuuauguacacaccacguucacacacacacagagggaccacgugugcac

SEQ ID NO: 40451 - RNA, 64 nt, Homo Sapiens
agcuaaguggguccuuauguacacaccacguucacacacacacagagggaccacgugugcacgc

SEQ ID NO: 40452 - RNA, 64 nt, Homo Sapiens
cuaaguggguccuuauguacacaccacguucacacacacacagagggaccacgugugcacgcau

SEQ ID NO: 40453 - RNA, 64 nt, Homo Sapiens
uucuuccucucucucucucucacucacgcacacgcacacacacacacacacacacacacacaca

SEQ ID NO: 40454 - RNA, 64 nt, Homo Sapiens
cuuccucucucucucucucacucacgcacacgcacacacacacacacacacacacacacacacu

SEQ ID NO: 40455 - RNA, 64 nt, Homo Sapiens
uccucucucucucucucacucacgcacacgcacacacacacacacacacacacacacacacucc

SEQ ID NO: 40456 - RNA, 64 nt, Homo Sapiens
cucucucucucucucacucacgcacacgcacacacacacacacacacacacacacacacuccau

SEQ ID NO: 40457 - RNA, 64 nt, Homo Sapiens
cucucucucucucacucacgcacacgcacacacacacacacacacacacacacacacuccauuc

SEQ ID NO: 40458 - RNA, 64 nt, Homo Sapiens
cucucucucucacucacgcacacgcacacacacacacacacacacacacacacacuccauucac

SEQ ID NO: 40459 - RNA, 64 nt, Homo Sapiens
cucucucucacucacgcacacgcacacacacacacacacacacacacacacacuccauucacug

SEQ ID NO: 40460 - RNA, 64 nt, Homo Sapiens
cucucucacucacgcacacgcacacacacacacacacacacacacacacacuccauucacuguc

SEQ ID NO: 40461 - RNA, 64 nt, Homo Sapiens
cucucacucacgcacacgcacacacacacacacacacacacacacacacuccauucacugucuc

SEQ ID NO: 40462 - RNA, 64 nt, Homo Sapiens
cucacucacgcacacgcacacacacacacacacacacacacacacacuccauucacugucucca

SEQ ID NO: 40463 - RNA, 64 nt, Homo Sapiens
cacucacgcacacgcacacacacacacacacacacacacacacacuccauucacugucuccaug

SEQ ID NO: 40464 - RNA, 64 nt, Homo Sapiens
cucacgcacacgcacacacacacacacacacacacacacacacuccauucacugucuccaugac

SEQ ID NO: 40465 - RNA, 64 nt, Homo Sapiens
aaaaaacacaaaaaaacaaaaacaaaaaaccauacacacacacacacacacacaaaucagcauc

SEQ ID NO: 40466 - RNA, 64 nt, Homo Sapiens
aaaacacaaaaaaacaaaaacaaaaaaccauacacacacacacacacacacaaaucagcaucau

SEQ ID NO: 40467 - RNA, 64 nt, Homo Sapiens
aacacaaaaaaacaaaaacaaaaaaccauacacacacacacacacacacaaaucagcaucauaa

SEQ ID NO: 40468 - RNA, 64 nt, Homo Sapiens
cacaaaaaaacaaaaacaaaaaaccauacacacacacacacacacacaaaucagcaucauaagg

SEQ ID NO: 40469 - RNA, 64 nt, Homo Sapiens
caaaaaaacaaaaacaaaaaaccauacacacacacacacacacacaaaucagcaucauaaggga

SEQ ID NO: 40470 - RNA, 64 nt, Homo Sapiens
aaaaaacaaaaacaaaaaaccauacacacacacacacacacacaaaucagcaucauaagggaau

SEQ ID NO: 40471 - RNA, 64 nt, Homo Sapiens
aaaacaaaaacaaaaaaccauacacacacacacacacacacaaaucagcaucauaagggaaugu

SEQ ID NO: 40472 - RNA, 64 nt, Homo Sapiens
aagugccuccccagccucagcccccaccuccagccacacacacauuacacacacacacacacac

SEQ ID NO: 40473 - RNA, 64 nt, Homo Sapiens
gugccuccccagccucagcccccaccuccagccacacacacauuacacacacacacacacacac

SEQ ID NO: 40474 - RNA, 64 nt, Homo Sapiens
gccucagcccccaccuccagccacacacacauuacacacacacacacacacacacaaaugugcc

SEQ ID NO: 40475 - RNA, 64 nt, Homo Sapiens
cucagcccccaccuccagccacacacacauuacacacacacacacacacacacaaaugugccac

SEQ ID NO: 40476 - RNA, 64 nt, Homo Sapiens
cagcccccaccuccagccacacacacauuacacacacacacacacacacacaaaugugccacac

SEQ ID NO: 40477 - RNA, 64 nt, Homo Sapiens
gcccccaccuccagccacacacacauuacacacacacacacacacacacaaaugugccacaccc

SEQ ID NO: 40478 - RNA, 64 nt, Homo Sapiens
ccccaccuccagccacacacacauuacacacacacacacacacacacaaaugugccacacccag

SEQ ID NO: 40479 - RNA, 64 nt, Homo Sapiens
ccaccuccagccacacacacauuacacacacacacacacacacacaaaugugccacacccagac

SEQ ID NO: 40480 - RNA, 64 nt, Homo Sapiens
accuccagccacacacacauuacacacacacacacacacacacaaaugugccacacccagacac

SEQ ID NO: 40481 - RNA, 64 nt, Homo Sapiens
cuccagccacacacacauuacacacacacacacacacacacaaaugugccacacccagacacgc

SEQ ID NO: 40482 - RNA, 64 nt, Homo Sapiens
uugguuacaaaacagacacagccaagauaagauccacacacacauuauuaacaaggaagugauu

SEQ ID NO: 40483 - RNA, 64 nt, Homo Sapiens
gguuacaaaacagacacagccaagauaagauccacacacacauuauuaacaaggaagugauuug

SEQ ID NO: 40484 - RNA, 64 nt, Homo Sapiens
uguguguuuacacauaugucugcaugcaugugaacacacacacacacacacacacaccaggcgu

SEQ ID NO: 40485 - RNA, 64 nt, Homo Sapiens
uguguuuacacauaugucugcaugcaugugaacacacacacacacacacacacaccaggcgugu

SEQ ID NO: 40486 - RNA, 64 nt, Homo Sapiens
uguuuacacauaugucugcaugcaugugaacacacacacacacacacacacaccaggcguguuu

SEQ ID NO: 40487 - RNA, 64 nt, Homo Sapiens
uuuacacauaugucugcaugcaugugaacacacacacacacacacacacaccaggcguguuuga

SEQ ID NO: 40488 - RNA, 64 nt, Homo Sapiens
uacacauaugucugcaugcaugugaacacacacacacacacacacacaccaggcguguuugagu

SEQ ID NO: 40489 - RNA, 64 nt, Homo Sapiens
cacauaugucugcaugcaugugaacacacacacacacacacacacaccaggcguguuugagucc

SEQ ID NO: 40490 - RNA, 64 nt, Homo Sapiens
cauaugucugcaugcaugugaacacacacacacacacacacacaccaggcguguuugaguccac

SEQ ID NO: 40491 - RNA, 64 nt, Homo Sapiens
uaugucugcaugcaugugaacacacacacacacacacacacaccaggcguguuugaguccacag

SEQ ID NO: 40492 - RNA, 64 nt, Homo Sapiens
uggcagcacauagcguuuccgcaagucaucugcucacacacagugacggcucucccaucuuccu

SEQ ID NO: 40493 - RNA, 64 nt, Homo Sapiens
ggugcucuucuccccuuagcccgcuccguccgugcacacacagccaggaugcccacggugacug

SEQ ID NO: 40494 - RNA, 64 nt, Homo Sapiens
uugaaucugcacccucuggacccaccugcauaggcacacacaccuauggacuuccucuuccugc

SEQ ID NO: 40495 - RNA, 64 nt, Homo Sapiens
gcagcguuucauacaggucaguuuuguuuagaugcacacacaugagccacgugaaacugcugau

SEQ ID NO: 40496 - RNA, 64 nt, Homo Sapiens
gcucuuguguguguugucaagaggcauuugugcacacacacagggguuucuuucagguuaacaa

SEQ ID NO: 40497 - RNA, 64 nt, Homo Sapiens
gggcucuuguguguguugucaagaggcauuugugcacacacacagcgguuucuuucagguuaac

SEQ ID NO: 40498 - RNA, 64 nt, Homo Sapiens
aauugccauuuuaugacuguccugaaaaaagccacacacacaguccuggauaugcugggagagg

SEQ ID NO: 40499 - RNA, 64 nt, Homo Sapiens
guaauugccauuuuaugacuggccugaaaaaagccacacacacaauccuggauaugcugggaga

SEQ ID NO: 40500 - RNA, 64 nt, Homo Sapiens
ccucacauacuauaaaauaaucccaacacacacacacacacaccucucaguuucucccucucuc

SEQ ID NO: 40501 - RNA, 64 nt, Homo Sapiens
ccccucacauacuauaaaauucucccaacacacacacacacacauuucucaguuucucccucuc

SEQ ID NO: 40502 - RNA, 64 nt, Homo Sapiens
caccccucacauacuauaaaucucucccaacacacacacacacaauuuucucaguuucucccuc

SEQ ID NO: 40503 - RNA, 64 nt, Homo Sapiens
cacaccccucacauacuauaucucucucccaacacacacacacaccauuuucucaguuucuccc

SEQ ID NO: 40504 - RNA, 64 nt, Homo Sapiens
cacacaccccucacauacuaccucucucucccaacacacacacacaccauuuucucaguuucuc

SEQ ID NO: 40505 - RNA, 64 nt, Homo Sapiens
uguacauauauauguauauauacauauaauuauacacacacauauuggugagaccacuaaauuu

SEQ ID NO: 40506 - RNA, 64 nt, Homo Sapiens
ccuuguaccccuugcccuuccacacacacacacacacacacacucacacacacacacacacaca

SEQ ID NO: 40507 - RNA, 64 nt, Homo Sapiens
cuccuuguaccccuugcccucacacacacacacacacacacacaaacacacacacacacacaca

SEQ ID NO: 40508 - RNA, 64 nt, Homo Sapiens
cacuccuuguaccccuugcccacacacacacacacacacacacaccaacacacacacacacaca

SEQ ID NO: 40509 - RNA, 64 nt, Homo Sapiens
cacacuccuuguaccccuugcacacacacacacacacacacacaccccaacacacacacacaca

SEQ ID NO: 40510 - RNA, 64 nt, Homo Sapiens
cacacacuccuuguaccccucacacacacacacacacacacacacuccccaacacacacacaca

SEQ ID NO: 40511 - RNA, 64 nt, Homo Sapiens
cacacacacuccuuguaccccacacacacacacacacacacacacucuccccaacacacacaca

SEQ ID NO: 40512 - RNA, 64 nt, Homo Sapiens
cacacacacacuccuuguaccacacacacacacacacacacacacacucuccccaacacacaca

SEQ ID NO: 40513 - RNA, 64 nt, Homo Sapiens
cacacacacacacuccuugucacacacacacacacacacacacaaacacucuccccaacacaca

SEQ ID NO: 40514 - RNA, 64 nt, Homo Sapiens
cacacacacacacacuccuucacacacacacacacacacacacaauaacacucuccccaacaca

SEQ ID NO: 40515 - RNA, 64 nt, Homo Sapiens
cacacacacacacacacucccacacacacacacacacacacacaacauaacacucuccccaaca

SEQ ID NO: 40516 - RNA, 64 nt, Homo Sapiens
cacacacacacacacacacucacacacacacacacacacacacaccacauaacacucuccccaa

SEQ ID NO: 40517 - RNA, 64 nt, Homo Sapiens
cacacacacacacacacacaaacacacacacacacacacacacacaccacauaacacucucccc

SEQ ID NO: 40518 - RNA, 64 nt, Homo Sapiens
cacacacacacacacacacaccaacacacacacacacacacacauccaccacauaacacucucc

SEQ ID NO: 40519 - RNA, 64 nt, Homo Sapiens
cacacacacacacacacacaccccaacacacacacacacacacacauccaccacauaacacucu

SEQ ID NO: 40520 - RNA, 64 nt, Homo Sapiens
cacacacacacacacacacacuccccaacacacacacacacacacccauccaccacauaacacu

SEQ ID NO: 40521 - RNA, 64 nt, Homo Sapiens
cacacacacacacacacacacucuccccaacacacacacacacauccccauccaccacauaaca

SEQ ID NO: 40522 - RNA, 64 nt, Homo Sapiens
cacacacacacacacacacacacucuccccaacacacacacacaguuccccauccaccacauaa

SEQ ID NO: 40523 - RNA, 64 nt, Homo Sapiens
cacacacacacacacacacaaacacucuccccaacacacacacauuguuccccauccaccacau

SEQ ID NO: 40524 - RNA, 64 nt, Homo Sapiens
gcacguccacagugccauaccacgcuauggcgcacacacacaguuggggagcagaguuagggug

SEQ ID NO: 40525 - RNA, 64 nt, Homo Sapiens
gugcacguccacagugccauugcacgcuauggcgcacacacacagcuggggagcagaguuaggg

SEQ ID NO: 40526 - RNA, 64 nt, Homo Sapiens
ccuucuuuauagcuacaaagugcaugcacacacacacacacauacacuugaguguaauacuuga

SEQ ID NO: 40527 - RNA, 64 nt, Homo Sapiens
uaccuucuuuauagcuacaagaugcaugcacacacacacacacauucacuugaguguaauacuu

SEQ ID NO: 40528 - RNA, 64 nt, Homo Sapiens
cauaccuucuuuauagcuacuugaugcaugcacacacacacacauguucacuugaguguaauac

SEQ ID NO: 40529 - RNA, 64 nt, Homo Sapiens
cacauaccuucuuuauagcuacuugaugcaugcacacacacacaucuguucacuugaguguaau

SEQ ID NO: 40530 - RNA, 64 nt, Homo Sapiens
cacacauaccuucuuuauagauacuugaugcaugcacacacacaauucuguucacuugagugua

SEQ ID NO: 40531 - RNA, 64 nt, Homo Sapiens
gacauuauaucauggcauuucgcgcacacacacacacacacacuuauguaugcgugcaugcgug

SEQ ID NO: 40532 - RNA, 64 nt, Homo Sapiens
cugacauuauaucauggcauugcgcgcacacacacacacacacaauuauguaugcgugcaugcg

SEQ ID NO: 40533 - RNA, 64 nt, Homo Sapiens
cacacacacugacauuauaucgugcgcgcacacacacacacacaguauuauguaugcgugcaug

SEQ ID NO: 40534 - RNA, 64 nt, Homo Sapiens
cacacacacacugacauuauugcgugcgcgcacacacacacacaguguauuauguaugcgugca

SEQ ID NO: 40535 - RNA, 64 nt, Homo Sapiens
cacacacacacacugacauucaugcgugcgcgcacacacacacaauguguauuauguaugcgug

SEQ ID NO: 40536 - RNA, 64 nt, Homo Sapiens
cacacacacacacacugacaugcaugcgugcgcgcacacacacaauauguguauuauguaugcg

SEQ ID NO: 40537 - RNA, 64 nt, Homo Sapiens
cacgcacaagcgccagugcggacacaugcacgcacacacacauaacauucaccugguagcaaau

SEQ ID NO: 40538 - RNA, 64 nt, Homo Sapiens
uacacgcacaagcgccagugaugacacaugcacgcacacacacaaaacauucaccugguagcaa

SEQ ID NO: 40539 - RNA, 64 nt, Homo Sapiens
uugugugugcaaugcacacccagacacacgcacgcacacacacgcgcgcgcacacacaugcuuu

SEQ ID NO: 40540 - RNA, 64 nt, Homo Sapiens
cacccagacacacgcacgcacacacacgcgcgcgcacacacaugcuuuuuucuguuccccuccg

SEQ ID NO: 40541 - RNA, 64 nt, Homo Sapiens
aagcagccccuccucacacauacaugugcacaugcacacacaugcaugcacacacaugcacaca

SEQ ID NO: 40542 - RNA, 64 nt, Homo Sapiens
cacacauacaugugcacaugcacacacaugcaugcacacacaugcacacauacacgcacaugca

SEQ ID NO: 40543 - RNA, 64 nt, Homo Sapiens
caugcaugcacacauacacaggcauacaugcaugcacacacacaugcacgcacacacacaugca

SEQ ID NO: 40544 - RNA, 64 nt, Homo Sapiens
ugcaugcacacauacacaggcauacaugcaugcacacacacaugcacgcacacacacaugcaca

SEQ ID NO: 40545 - RNA, 64 nt, Homo Sapiens
cacaggcauacaugcaugcacacacacaugcacgcacacacacaugcacacauacacgugcaca

SEQ ID NO: 40546 - RNA, 64 nt, Homo Sapiens
caggcauacaugcaugcacacacacaugcacgcacacacacaugcacacauacacgugcacaca

SEQ ID NO: 40547 - RNA, 64 nt, Homo Sapiens
uacacaggcacacaugcaugcacacauacacaugcacacacacaugcacacauauaugcacagg

SEQ ID NO: 40548 - RNA, 64 nt, Homo Sapiens
cacaggcacacaugcaugcacacauacacaugcacacacacaugcacacauauaugcacaggca

SEQ ID NO: 40549 - RNA, 64 nt, Homo Sapiens
caugcacacacacaugcacacauauaugcacaggcacacacauguacgcacacacacaugcacu

SEQ ID NO: 40550 - RNA, 64 nt, Homo Sapiens
ugcacacauauaugcacaggcacacacauguacgcacacacacaugcacugcacacauauccau

SEQ ID NO: 40551 - RNA, 64 nt, Homo Sapiens
cacacauauaugcacaggcacacacauguacgcacacacacaugcacugcacacauauccaugc

SEQ ID NO: 40552 - RNA, 64 nt, Homo Sapiens
cuaggcccuuuucuaugucuuuacaucucugucucacacacacacacguauacacacacacagu

SEQ ID NO: 40553 - RNA, 64 nt, Homo Sapiens
aggcccuuuucuaugucuuuacaucucugucucacacacacacacguauacacacacacaguuu

SEQ ID NO: 40554 - RNA, 64 nt, Homo Sapiens
gcccuuuucuaugucuuuacaucucugucucacacacacacacguauacacacacacaguuuau

SEQ ID NO: 40555 - RNA, 64 nt, Homo Sapiens
cuuuacaucucugucucacacacacacacguauacacacacacaguuuauuuuuaauaaaauag

SEQ ID NO: 40556 - RNA, 64 nt, Homo Sapiens
uuacaucucugucucacacacacacacguauacacacacacaguuuauuuuuaauaaaauagga

SEQ ID NO: 40557 - RNA, 64 nt, Homo Sapiens
cacacaguuuauuuuuaauaaaauaggauuauaccacacacauccugucacuugcuuuuuugcu

SEQ ID NO: 40558 - RNA, 64 nt, Homo Sapiens
uugcaaaaaaaaaauuguuuaacacacacagacacacacacacccagccgccugacgaaaugga

SEQ ID NO: 40559 - RNA, 64 nt, Homo Sapiens
ccuugcaaaaaaaaaauugugaaacacacacagacacacacacaaacagccgccugacgaaaug

SEQ ID NO: 40560 - RNA, 64 nt, Homo Sapiens
cacacacacaccuugcaaaaugacgaaauggaaacacacacagacgcagacaagaacagccgcc

SEQ ID NO: 40561 - RNA, 64 nt, Homo Sapiens
acucgccuccacugaaucuacacacacacacacacacacacaccgcucuacaugacauucagga

SEQ ID NO: 40562 - RNA, 64 nt, Homo Sapiens
ccacucgccuccacugaaucgacacacacacacacacacacacaucgcucuacaugacauucag

SEQ ID NO: 40563 - RNA, 64 nt, Homo Sapiens
caccacucgccuccacugaaaggacacacacacacacacacacagaucgcucuacaugacauuc

SEQ ID NO: 40564 - RNA, 64 nt, Homo Sapiens
cacaccacucgccuccacugucaggacacacacacacacacacacagaucgcucuacaugacau

SEQ ID NO: 40565 - RNA, 64 nt, Homo Sapiens
cacacaccacucgccuccacauucaggacacacacacacacacacccagaucgcucuacaugac

SEQ ID NO: 40566 - RNA, 64 nt, Homo Sapiens
cacacacaccacucgccuccacauucaggacacacacacacacacucccagaucgcucuacaug

SEQ ID NO: 40567 - RNA, 64 nt, Homo Sapiens
cacacacacaccacucgccuugacauucaggacacacacacacauccucccagaucgcucuaca

SEQ ID NO: 40568 - RNA, 64 nt, Homo Sapiens
cacacacacacaccacucgccaugacauucaggacacacacacagcuccucccagaucgcucua

SEQ ID NO: 40569 - RNA, 64 nt, Homo Sapiens
ccacccagccucuuguuucuaaucagccauaacgcacacacacguguuuuuuuaccaccuggug

SEQ ID NO: 40570 - RNA, 64 nt, Homo Sapiens
ucuugaaacccuuccccaagcuccacuccucacacacacacaccgcuucuccuuuuaaaauccc

SEQ ID NO: 40571 - RNA, 64 nt, Homo Sapiens
ccucuugaaacccuuccccacccuccacuccucacacacacacaaugcuucuccuuuuaaaauc

SEQ ID NO: 40572 - RNA, 64 nt, Homo Sapiens
caccucuugaaacccuucccuccccuccacuccucacacacacaaaaugcuucuccuuuuaaaa

SEQ ID NO: 40573 - RNA, 64 nt, Homo Sapiens
cacagagagagagcugcaaguaugcacacacacacacacacaccuauguauagacacacacaca

SEQ ID NO: 40574 - RNA, 64 nt, Homo Sapiens
cccacagagagagagcugcacauaugcacacacacacacacacaaauauguauagacacacaca

SEQ ID NO: 40575 - RNA, 64 nt, Homo Sapiens
cacccacagagagagagcugcacauaugcacacacacacacacaauaauauguauagacacaca

SEQ ID NO: 40576 - RNA, 64 nt, Homo Sapiens
cacacccacagagagagagccacacauaugcacacacacacacaaaauaauauguauagacaca

SEQ ID NO: 40577 - RNA, 64 nt, Homo Sapiens
cacacacccacagagagagacacacacauaugcacacacacacaccaaauaauauguauagaca

SEQ ID NO: 40578 - RNA, 64 nt, Homo Sapiens
cacacacacccacagagagacacacacacauaugcacacacacaaaccaaauaauauguauaga

SEQ ID NO: 40579 - RNA, 64 nt, Homo Sapiens
ugcacacacacacacacacaaauauguauagacacacacacauaccugugcugaccaaccaaau

SEQ ID NO: 40580 - RNA, 64 nt, Homo Sapiens
uaugcacacacacacacacaauaauauguauagacacacacacacuccugugcugaccaaccaa

SEQ ID NO: 40581 - RNA, 64 nt, Homo Sapiens
ucaugugcagacgugccucugccuuuuuggugugcacacacauuuauagacaaccagcuaaacu

SEQ ID NO: 40582 - RNA, 64 nt, Homo Sapiens
cucauccacacuucaaauugcacacacacacacacacacacagacaggcauacucacacacaga

SEQ ID NO: 40583 - RNA, 64 nt, Homo Sapiens
gacucauccacacuucaaaugacacacacacacacacacacacacacaggcauacucacacaca

SEQ ID NO: 40584 - RNA, 64 nt, Homo Sapiens
cagacucauccacacuucaacagacacacacacacacacacacacacacaggcauacucacaca

SEQ ID NO: 40585 - RNA, 64 nt, Homo Sapiens
cacagacucauccacacuuccacagacacacacacacacacacacacacacaggcauacucaca

SEQ ID NO: 40586 - RNA, 64 nt, Homo Sapiens
cacacagacucauccacacucacacagacacacacacacacacacacacacacaggcauacuca

SEQ ID NO: 40587 - RNA, 64 nt, Homo Sapiens
cacacacagacucauccacacacacacagacacacacacacacacucacacacacaggcauacu

SEQ ID NO: 40588 - RNA, 64 nt, Homo Sapiens
cacacacacagacucauccacucacacacagacacacacacacacacucacacacacaggcaua

SEQ ID NO: 40589 - RNA, 64 nt, Homo Sapiens
cacacacacacagacucaucuacucacacacagacacacacacacacacucacacacacaggca

SEQ ID NO: 40590 - RNA, 64 nt, Homo Sapiens
cacacacacacacacacacacacacaggcauacucacacacagaaauauacacacacacucaca

SEQ ID NO: 40591 - RNA, 64 nt, Homo Sapiens
cauacucacacacagacacauacacacacacucacacacacaggacuucaaaugcuacaaaaua

SEQ ID NO: 40592 - RNA, 64 nt, Homo Sapiens
ggcauacucacacacagacauauacacacacacucacacacacaaaacuucaaaugcuacaaaa

SEQ ID NO: 40593 - RNA, 64 nt, Homo Sapiens
cacacacacaggcauacucaugcuacaaaauauacacacacacuucuugccacaaaacuucaaa

SEQ ID NO: 40594 - RNA, 64 nt, Homo Sapiens
cuuaaaucuugcccugcauguauauauacacacacacacacauauaugugugugugugugugug

SEQ ID NO: 40595 - RNA, 64 nt, Homo Sapiens
uacuuaaaucuugcccugcauguauauauacacacacacacacauguaugugugugugugugug

SEQ ID NO: 40596 - RNA, 64 nt, Homo Sapiens
cauacuuaaaucuugcccuguguguauauauacacacacacacauguguaugugugugugugug

SEQ ID NO: 40597 - RNA, 64 nt, Homo Sapiens
cacauacuuaaaucuugcccuguguguauauauacacacacacauauguguaugugugugugug

SEQ ID NO: 40598 - RNA, 64 nt, Homo Sapiens
cacacauaccgcacuucauaauaauacacacacacacacacauggggggcuucaauauauauau

SEQ ID NO: 40599 - RNA, 64 nt, Homo Sapiens
ugcacacauaccgcacuucaauauaauacacacacacacacacaaugggggcuucaauauauau

SEQ ID NO: 40600 - RNA, 64 nt, Homo Sapiens
caugcacacauaccgcacuuauauauaauacacacacacacacaaaaugggggcuucaauauau

SEQ ID NO: 40601 - RNA, 64 nt, Homo Sapiens
cacaugcacacauaccgcacauauauauaauacacacacacacaguaaaugggggcuucaauau

SEQ ID NO: 40602 - RNA, 64 nt, Homo Sapiens
cacacaugcacacauaccgcauauauauauaauacacacacacaauguaaaugggggcuucaau

SEQ ID NO: 40603 - RNA, 64 nt, Homo Sapiens
uaagagacucagccugcagucacacacacacacacacacacaagcacacacacacacacacaca

SEQ ID NO: 40604 - RNA, 64 nt, Homo Sapiens
aguaagagacucagccugcacacacacacacacacacacacacacacacacacacacacacaca

SEQ ID NO: 40605 - RNA, 64 nt, Homo Sapiens
caaguaagagacucagccugcacacacacacacacacacacacacacacacacacacacacaca

SEQ ID NO: 40606 - RNA, 64 nt, Homo Sapiens
cacaaguaagagacucagcccacacacacacacacacacacacacacacacacacacacacaca

SEQ ID NO: 40607 - RNA, 64 nt, Homo Sapiens
cacacaaguaagagacucagcacacacacacacacacacacacacacacacacacacacacaca

SEQ ID NO: 40608 - RNA, 64 nt, Homo Sapiens
cacacacaaguaagagacuccacacacacacacacacacacacacacacacacacacacacaca

SEQ ID NO: 40609 - RNA, 64 nt, Homo Sapiens
cacacacacaaguaagagaccacacacacacacacacacacacacacacacacacacacacaca

SEQ ID NO: 40610 - RNA, 64 nt, Homo Sapiens
cacacacacacaaguaagagcacacacacacacacacacacacauacacacacacacacacaca

SEQ ID NO: 40611 - RNA, 64 nt, Homo Sapiens
cacacacacacacaaguaagcacacacacacacacacacacacauauacacacacacacacaca

SEQ ID NO: 40612 - RNA, 64 nt, Homo Sapiens
cacacacacacacacaaguacacacacacacacacacacacacacauauacacacacacacaca

SEQ ID NO: 40613 - RNA, 64 nt, Homo Sapiens
cacacacacacacacacaagcacacacacacacacacacacacacacauauacacacacacaca

SEQ ID NO: 40614 - RNA, 64 nt, Homo Sapiens
cacacacacacacacacacacacacacacacacacacacacacacgcacauauacacacacaca

SEQ ID NO: 40615 - RNA, 64 nt, Homo Sapiens
cacacacacacacacacacacacacacacacacacacacacacacacgcacauauacacacaca

SEQ ID NO: 40616 - RNA, 64 nt, Homo Sapiens
cacacacacacacacacacacacacacacacacacacacacacacacacgcacauauacacaca

SEQ ID NO: 40617 - RNA, 64 nt, Homo Sapiens
cacacacacacacacacacacacacacacacacacacacacacacacacacgcacauauacaca

SEQ ID NO: 40618 - RNA, 64 nt, Homo Sapiens
cacacacacacacacacacacacacacacacacacacacacacacacacacacgcacauauaca

SEQ ID NO: 40619 - RNA, 64 nt, Homo Sapiens
cacacacacacacacacacacacacacacacacacacacacacacacacacacacgcacauaua

SEQ ID NO: 40620 - RNA, 64 nt, Homo Sapiens
cacacacacacacacacacauacacacacacacacacacacacacacacacacacacgcacaua

SEQ ID NO: 40621 - RNA, 64 nt, Homo Sapiens
cacacacacacacacacacauauacacacacacacacacacacauacacacacacacacgcaca

SEQ ID NO: 40622 - RNA, 64 nt, Homo Sapiens
cacacacacacacacacacacauauacacacacacacacacacauauacacacacacacacgca

SEQ ID NO: 40623 - RNA, 64 nt, Homo Sapiens
cacacacacacacacacacacacauauacacacacacacacacauauauacacacacacacacg

SEQ ID NO: 40624 - RNA, 64 nt, Homo Sapiens
cacacacacacacacacacacgcacauauacacacacacacacauauauauacacacacacaca

SEQ ID NO: 40625 - RNA, 64 nt, Homo Sapiens
cacacacacacacacacacacacgcacauauacacacacacacauauauauauacacacacaca

SEQ ID NO: 40626 - RNA, 64 nt, Homo Sapiens
cacacacacacacacacacacacacgcacauauacacacacacauauauauauauacacacaca

SEQ ID NO: 40627 - RNA, 64 nt, Homo Sapiens
cacauauacacacacacacauauauauauacacacacacacacguccauauauauauauauaua

SEQ ID NO: 40628 - RNA, 64 nt, Homo Sapiens
cgcacauauacacacacacauauauauauauacacacacacacagcuccauauauauauauaua

SEQ ID NO: 40629 - RNA, 64 nt, Homo Sapiens
cacgcacauauacacacacauauauauauauauacacacacacaaggcuccauauauauauaua

SEQ ID NO: 40630 - RNA, 64 nt, Homo Sapiens
gcaaacucccuuucauaaaauccuccccaaaacacacacacagaaaacuauuucauccgcuguu

SEQ ID NO: 40631 - RNA, 64 nt, Homo Sapiens
gagcaaacucccuuucauaauuuccuccccaaaacacacacacaauaaacuauuucauccgcug

SEQ ID NO: 40632 - RNA, 64 nt, Homo Sapiens
cuggaguuuuuccagcauacaauacaugcacgugcacacacauacacacacauccauuaauaua

SEQ ID NO: 40633 - RNA, 64 nt, Homo Sapiens
uccagcauacaauacaugcacgugcacacacauacacacacauccauuaauauacuucaguaag

SEQ ID NO: 40634 - RNA, 64 nt, Homo Sapiens
acauauauaauauauacacacagauacaaguguacacacacacaccacacaccacacacacccc

SEQ ID NO: 40635 - RNA, 64 nt, Homo Sapiens
auauauaauauauacacacagauacaaguguacacacacacaccacacaccacacacaccccac

SEQ ID NO: 40636 - RNA, 64 nt, Homo Sapiens
cacagauacaaguguacacacacacaccacacaccacacacaccccacuggcagucuuugugga

SEQ ID NO: 40637 - RNA, 64 nt, Homo Sapiens
cucagucuuuaauccuggcagggauucacgggcgcacacacacacacucaggauucagaucuug

SEQ ID NO: 40638 - RNA, 64 nt, Homo Sapiens
cagucuuuaauccuggcagggauucacgggcgcacacacacacacucaggauucagaucuuguu

SEQ ID NO: 40639 - RNA, 64 nt, Homo Sapiens
gucuuuaauccuggcagggauucacgggcgcacacacacacacucaggauucagaucuuguuga

SEQ ID NO: 40640 - RNA, 64 nt, Homo Sapiens
ggcccccuagaccagcucuuccagcuggauggagcacacacaggccuccagcugggccauguca

SEQ ID NO: 40641 - RNA, 64 nt, Homo Sapiens
acuaagauuuucccaugcauaauuacaaauaaugcacacacacaaauguauaugcuggguagua

SEQ ID NO: 40642 - RNA, 64 nt, Homo Sapiens
uaagauuuucccaugcauaauuacaaauaaugcacacacacaaauguauaugcuggguaguaug

SEQ ID NO: 40643 - RNA, 64 nt, Homo Sapiens
aggauguugaagauaaugacacuaaaucuauggacacacacacacacacacacacacacacaca

SEQ ID NO: 40644 - RNA, 64 nt, Homo Sapiens
gauguugaagauaaugacacuaaaucuauggacacacacacacacacacacacacacacacaca

SEQ ID NO: 40645 - RNA, 64 nt, Homo Sapiens
uguugaagauaaugacacuaaaucuauggacacacacacacacacacacacacacacacacaca

SEQ ID NO: 40646 - RNA, 64 nt, Homo Sapiens
uugaagauaaugacacuaaaucuauggacacacacacacacacacacacacacacacacacaca

SEQ ID NO: 40647 - RNA, 64 nt, Homo Sapiens
gaagauaaugacacuaaaucuauggacacacacacacacacacacacacacacacacacacaca

SEQ ID NO: 40648 - RNA, 64 nt, Homo Sapiens
agauaaugacacuaaaucuauggacacacacacacacacacacacacacacacacacacacaca

SEQ ID NO: 40649 - RNA, 64 nt, Homo Sapiens
auaaugacacuaaaucuauggacacacacacacacacacacacacacacacacacacacacaca

SEQ ID NO: 40650 - RNA, 64 nt, Homo Sapiens
aaugacacuaaaucuauggacacacacacacacacacacacacacacacacacacacacacaca

SEQ ID NO: 40651 - RNA, 64 nt, Homo Sapiens
ugacacuaaaucuauggacacacacacacacacacacacacacacacacacacacacacacaca

SEQ ID NO: 40652 - RNA, 64 nt, Homo Sapiens
acacuaaaucuauggacacacacacacacacacacacacacacacacacacacacacacacaca

SEQ ID NO: 40653 - RNA, 64 nt, Homo Sapiens
acuaaaucuauggacacacacacacacacacacacacacacacacacacacacacacacacaca

SEQ ID NO: 40654 - RNA, 64 nt, Homo Sapiens
uaaaucuauggacacacacacacacacacacacacacacacacacacacacacacacacacaca

SEQ ID NO: 40655 - RNA, 64 nt, Homo Sapiens
aaucuauggacacacacacacacacacacacacacacacacacacacacacacacacacacaca

SEQ ID NO: 40656 - RNA, 64 nt, Homo Sapiens
ucuauggacacacacacacacacacacacacacacacacacacacacacacacacacacacagu

SEQ ID NO: 40657 - RNA, 64 nt, Homo Sapiens
uauggacacacacacacacacacacacacacacacacacacacacacacacacacacacaguuu

SEQ ID NO: 40658 - RNA, 64 nt, Homo Sapiens
uggacacacacacacacacacacacacacacacacacacacacacacacacacacacaguuuaa

SEQ ID NO: 40659 - RNA, 64 nt, Homo Sapiens
gacacacacacacacacacacacacacacacacacacacacacacacacacacacaguuuaaug

SEQ ID NO: 40660 - RNA, 64 nt, Homo Sapiens
cacacacacacacacacacacacacacacacacacacacacacacacacacacaguuuaaugaa

SEQ ID NO: 40661 - RNA, 64 nt, Homo Sapiens
cacacacacacacacacacacacacacacacacacacacacacacacacacaguuuaaugaagg

SEQ ID NO: 40662 - RNA, 64 nt, Homo Sapiens
cacacacacacacacacacacacacacacacacacacacacacacacacaguuuaaugaaggcu

SEQ ID NO: 40663 - RNA, 64 nt, Homo Sapiens
cacacacacacacacacacacacacacacacacacacacacacacacaguuuaaugaaggcuua

SEQ ID NO: 40664 - RNA, 64 nt, Homo Sapiens
cacacacacacacacacacacacacacacacacacacacacacacaguuuaaugaaggcuuaaa

SEQ ID NO: 40665 - RNA, 64 nt, Homo Sapiens
cacacacacacacacacacacacacacacacacacacacacacaguuuaaugaaggcuuaaaga

SEQ ID NO: 40666 - RNA, 64 nt, Homo Sapiens
cacacacacacacacacacacacacacacacacacacacacaguuuaaugaaggcuuaaagaau

SEQ ID NO: 40667 - RNA, 64 nt, Homo Sapiens
auggaaacccauugacauuccaaaacaauauauacacacacacauaaaucagccaaaaucagag

SEQ ID NO: 40668 - RNA, 64 nt, Homo Sapiens
ggaaacccauugacauuccaaaacaauauauacacacacacauaaaucagccaaaaucagagaa

SEQ ID NO: 40669 - RNA, 64 nt, Homo Sapiens
aagccguauauagaucaauguccacauauauauacacacacacauauauauauauaaaguguaa

SEQ ID NO: 40670 - RNA, 64 nt, Homo Sapiens
gccguauauagaucaauguccacauauauauacacacacacauauauauauauaaaguguaaca

SEQ ID NO: 40671 - RNA, 64 nt, Homo Sapiens
caaucaucccuucuugcuccucuuugugcacguacacacacacacacacacacacacacacaca

SEQ ID NO: 40672 - RNA, 64 nt, Homo Sapiens
aucaucccuucuugcuccucuuugugcacguacacacacacacacacacacacacacacacacc

SEQ ID NO: 40673 - RNA, 64 nt, Homo Sapiens
caucccuucuugcuccucuuugugcacguacacacacacacacacacacacacacacacacccc

SEQ ID NO: 40674 - RNA, 64 nt, Homo Sapiens
ucccuucuugcuccucuuugugcacguacacacacacacacacacacacacacacacaccccug

SEQ ID NO: 40675 - RNA, 64 nt, Homo Sapiens
ccuucuugcuccucuuugugcacguacacacacacacacacacacacacacacacaccccugcu

SEQ ID NO: 40676 - RNA, 64 nt, Homo Sapiens
uucuugcuccucuuugugcacguacacacacacacacacacacacacacacacaccccugcuca

SEQ ID NO: 40677 - RNA, 64 nt, Homo Sapiens
cuugcuccucuuugugcacguacacacacacacacacacacacacacacacaccccugcucaac

SEQ ID NO: 40678 - RNA, 64 nt, Homo Sapiens
ugcuccucuuugugcacguacacacacacacacacacacacacacacacaccccugcucaacag

SEQ ID NO: 40679 - RNA, 64 nt, Homo Sapiens
cuccucuuugugcacguacacacacacacacacacacacacacacacaccccugcucaacagag

SEQ ID NO: 40680 - RNA, 64 nt, Homo Sapiens
ccucuuugugcacguacacacacacacacacacacacacacacacaccccugcucaacagaggu

SEQ ID NO: 40681 - RNA, 64 nt, Homo Sapiens
ucuuugugcacguacacacacacacacacacacacacacacacaccccugcucaacagagguuu

SEQ ID NO: 40682 - RNA, 64 nt, Homo Sapiens
uuugugcacguacacacacacacacacacacacacacacacaccccugcucaacagagguuuag

SEQ ID NO: 40683 - RNA, 64 nt, Homo Sapiens
gugcaacuagccccaguuuucacacacacacacacacacacagucacacacaugcacauacaca

SEQ ID NO: 40684 - RNA, 64 nt, Homo Sapiens
gugugcaacuagccccaguucacacacacacacacacacacacacacacacacaugcacauaca

SEQ ID NO: 40685 - RNA, 64 nt, Homo Sapiens
cagugugcaacuagccccagcacacacacacacacacacacacacacacacacacaugcacaua

SEQ ID NO: 40686 - RNA, 64 nt, Homo Sapiens
cacagugugcaacuagccccuacacacacacacacacacacacacacacacacacacaugcaca

SEQ ID NO: 40687 - RNA, 64 nt, Homo Sapiens
cacacagugugcaacuagcccauacacacacacacacacacacacacacacacacacacaugca

SEQ ID NO: 40688 - RNA, 64 nt, Homo Sapiens
cacacacagugugcaacuagcacauacacacacacacacacacaaacacacacacacacacaug

SEQ ID NO: 40689 - RNA, 64 nt, Homo Sapiens
cacacacacagugugcaacuugcacauacacacacacacacacauaaacacacacacacacaca

SEQ ID NO: 40690 - RNA, 64 nt, Homo Sapiens
cacacacacacagugugcaacaugcacauacacacacacacacauuuaaacacacacacacaca

SEQ ID NO: 40691 - RNA, 64 nt, Homo Sapiens
cacacacacacacagugugccacaugcacauacacacacacacaccuuuaaacacacacacaca

SEQ ID NO: 40692 - RNA, 64 nt, Homo Sapiens
cacacacacacacacagugucacacaugcacauacacacacacaccccuuuaaacacacacaca

SEQ ID NO: 40693 - RNA, 64 nt, Homo Sapiens
cacauacacacacacacacauuuaaacacacacacacacacauggggugaaaacagaguacccc

SEQ ID NO: 40694 - RNA, 64 nt, Homo Sapiens
ugcacauacacacacacacaccuuuaaacacacacacacacacacagggugaaaacagaguacc

SEQ ID NO: 40695 - RNA, 64 nt, Homo Sapiens
caugcacauacacacacacaccccuuuaaacacacacacacacauucagggugaaaacagagua

SEQ ID NO: 40696 - RNA, 64 nt, Homo Sapiens
cacaugcacauacacacacauaccccuuuaaacacacacacacaauuucagggugaaaacagag

SEQ ID NO: 40697 - RNA, 64 nt, Homo Sapiens
cacacaugcacauacacacaaguaccccuuuaaacacacacacaugauuucagggugaaaacag

SEQ ID NO: 40698 - RNA, 64 nt, Homo Sapiens
ccccuauaccuggaagauugguguguguaauacacacacacaacaauuuauauauacauugugu

SEQ ID NO: 40699 - RNA, 64 nt, Homo Sapiens
acccccuauaccuggaagauguguguguguaauacacacacacaaaaauuuauauauacauugu

SEQ ID NO: 40700 - RNA, 64 nt, Homo Sapiens
auuugaaaacugauuggcaccauacauauguauacacacacauacauacaugcaugcacacaua

SEQ ID NO: 40701 - RNA, 64 nt, Homo Sapiens
cuaggaugcggaaauccccucacacacacacacacacacacaugaacguuuucuuucacacaca

SEQ ID NO: 40702 - RNA, 64 nt, Homo Sapiens
ugcuaggaugcggaaauccccacacacacacacacacacacacaguaacguuuucuuucacaca

SEQ ID NO: 40703 - RNA, 64 nt, Homo Sapiens
caugcuaggaugcggaaauccacacacacacacacacacacacacuguaacguuuucuuucaca

SEQ ID NO: 40704 - RNA, 64 nt, Homo Sapiens
cacaugcuaggaugcggaaacacacacacacacacacacacacaaacuguaacguuuucuuuca

SEQ ID NO: 40705 - RNA, 64 nt, Homo Sapiens
cacacaugcuaggaugcggacacacacacacacacacacacacauuaacuguaacguuuucuuu

SEQ ID NO: 40706 - RNA, 64 nt, Homo Sapiens
cacacacaugcuaggaugcguucacacacacacacacacacacagguuaacuguaacguuuucu

SEQ ID NO: 40707 - RNA, 64 nt, Homo Sapiens
cacacacacaugcuaggaugcuuucacacacacacacacacacaacgguuaacuguaacguuuu

SEQ ID NO: 40708 - RNA, 64 nt, Homo Sapiens
cacacacacacaugcuaggauucuuucacacacacacacacacauaacgguuaacuguaacguu

SEQ ID NO: 40709 - RNA, 64 nt, Homo Sapiens
cacacacacacacaugcuaguuuucuuucacacacacacacacauguaacgguuaacuguaacg

SEQ ID NO: 40710 - RNA, 64 nt, Homo Sapiens
cacacacacacacacaugcucguuuucuuucacacacacacacaauuguaacgguuaacuguaa

SEQ ID NO: 40711 - RNA, 64 nt, Homo Sapiens
cacacacacacacacacaugaacguuuucuuucacacacacacacaauuguaacgguuaacugu

SEQ ID NO: 40712 - RNA, 64 nt, Homo Sapiens
cacacacacacacacacacaguaacguuuucuuucacacacacaagcaauuguaacgguuaacu

SEQ ID NO: 40713 - RNA, 64 nt, Homo Sapiens
ccaguguggagagcgccucuccucgagcacgucacacacacaugcucugcacaugcagcccucu

SEQ ID NO: 40714 - RNA, 64 nt, Homo Sapiens
ugccaguguggagagcgccucuccucgagcacgucacacacacacucucugcacaugcagcccu

SEQ ID NO: 40715 - RNA, 64 nt, Homo Sapiens
ucacaguuuucacacagccccacacacacacacacacacacauauuacacacacacaacacaua

SEQ ID NO: 40716 - RNA, 64 nt, Homo Sapiens
uaucacaguuuucacacagcuacacacacacacacacacacacauuuuacacacacacaacaca

SEQ ID NO: 40717 - RNA, 64 nt, Homo Sapiens
cauaucacaguuuucacacacauacacacacacacacacacacaccuuuuacacacacacaaca

SEQ ID NO: 40718 - RNA, 64 nt, Homo Sapiens
cacauaucacaguuuucacacacauacacacacacacacacacaggccuuuuacacacacacaa

SEQ ID NO: 40719 - RNA, 64 nt, Homo Sapiens
cacacauaucacaguuuucaaacacauacacacacacacacacaaaggccuuuuacacacacac

SEQ ID NO: 40720 - RNA, 64 nt, Homo Sapiens
cacacacauaucacaguuuuacaacacauacacacacacacacaagaaggccuuuuacacacac

SEQ ID NO: 40721 - RNA, 64 nt, Homo Sapiens
cacacacacauaucacaguuacacaacacauacacacacacacaggagaaggccuuuuacacac

SEQ ID NO: 40722 - RNA, 64 nt, Homo Sapiens
cacacacacacauaucacagacacacaacacauacacacacacacuggagaaggccuuuuacac

SEQ ID NO: 40723 - RNA, 64 nt, Homo Sapiens
acauacacacacacacacacgaaggccuuuuacacacacacaacggggcccuuccuggccugga

SEQ ID NO: 40724 - RNA, 64 nt, Homo Sapiens
acacauacacacacacacacgagaaggccuuuuacacacacacaaaggggcccuuccuggccug

SEQ ID NO: 40725 - RNA, 64 nt, Homo Sapiens
acagcuugacucacuaacugcaguuguguucagacacacacaucccccgguauaccaagggagc

SEQ ID NO: 40726 - RNA, 64 nt, Homo Sapiens
cccauuugcauaucacccuucacacacacacacacacacacagucugucugcuucucucucucu

SEQ ID NO: 40727 - RNA, 64 nt, Homo Sapiens
gucccauuugcauaucaccccucacacacacacacacacacacauacugucugcuucucucucu

SEQ ID NO: 40728 - RNA, 64 nt, Homo Sapiens
cagucccauuugcauaucaccucucacacacacacacacacacagguacugucugcuucucucu

SEQ ID NO: 40729 - RNA, 64 nt, Homo Sapiens
cacagucccauuugcauauccucucucacacacacacacacacacagguacugucugcuucucu

SEQ ID NO: 40730 - RNA, 64 nt, Homo Sapiens
cacacagucccauuugcauacucucucucacacacacacacacaggcagguacugucugcuucu

SEQ ID NO: 40731 - RNA, 64 nt, Homo Sapiens
cacacacagucccauuugcacucucucucucacacacacacacacaggcagguacugucugcuu

SEQ ID NO: 40732 - RNA, 64 nt, Homo Sapiens
cacacacacagucccauuuguucucucucucucacacacacacacacaggcagguacugucugc

SEQ ID NO: 40733 - RNA, 64 nt, Homo Sapiens
cacacacacacagucccauugcuucucucucucucacacacacaaacacaggcagguacugucu

SEQ ID NO: 40734 - RNA, 64 nt, Homo Sapiens
aaccacgagguaguuuaaaugaugugugugugcacacacacagauaaaaaccacccaaacacua

SEQ ID NO: 40735 - RNA, 64 nt, Homo Sapiens
gaaaccacgagguaguuuaauagaugugugugugcacacacacaccuaaaaaccacccaaacac

SEQ ID NO: 40736 - RNA, 64 nt, Homo Sapiens
aaaaaauaccuguagaaauaacauaauguauacacacacacaaaggaaagagacaauuaauugu

SEQ ID NO: 40737 - RNA, 64 nt, Homo Sapiens
aaaaaaaauaccuguagaaaguacauaauguauacacacacacaagggaaagagacaauuaauu

SEQ ID NO: 40738 - RNA, 64 nt, Homo Sapiens
acuggcugugaccccucaggagaaacugccucugcacacacaucaagaggcaaggagcuucuga

SEQ ID NO: 40739 - RNA, 64 nt, Homo Sapiens
uuguauuaauuuuaaugauuucccccagcugccacacacacauuaauuuucauggcggaauguc

SEQ ID NO: 40740 - RNA, 64 nt, Homo Sapiens
uuuuguauuaauuuuaaugaucucccccagcugccacacacacaucaauuuucauggcggaaug

SEQ ID NO: 40741 - RNA, 64 nt, Homo Sapiens
aagacacacacagacacaaaauuacauacacagacacacacagaccccgccacagagacacacc

SEQ ID NO: 40742 - RNA, 64 nt, Homo Sapiens
cacacaaucacacgcagccccauacacagaaagacacacacagagaaacacaccauuacacaca

SEQ ID NO: 40743 - RNA, 64 nt, Homo Sapiens
cacagaaagacacacacagagaaacacaccauuacacacacauagauacgcccuuccggccaca

SEQ ID NO: 40744 - RNA, 64 nt, Homo Sapiens
cuccccgccacagagacacacagacacaaaaucacacacacacccagacacacacagaaagaca

SEQ ID NO: 40745 - RNA, 64 nt, Homo Sapiens
cccuccccgccacagagacacacagacacaaaaucacacacacacacagacacacacagaaaga

SEQ ID NO: 40746 - RNA, 64 nt, Homo Sapiens
aagacacagacacaaaaucaauuacauacacagacacacacagacuccccgccacagagacacc

SEQ ID NO: 40747 - RNA, 64 nt, Homo Sapiens
cuccccgccacagagacacccagacacaaaaucacacacacacccacacacagaaagacacaca

SEQ ID NO: 40748 - RNA, 64 nt, Homo Sapiens
cccuccccgccacagagacacacagacacaaaaucacacacacagacacacacagaaagacaca

SEQ ID NO: 40749 - RNA, 64 nt, Homo Sapiens
cacaaaaucacacacacacccacacacagaaagacacacacagagacaccauuacauacacaga

SEQ ID NO: 40750 - RNA, 64 nt, Homo Sapiens
aagacacacacagacacaaaauuacauacacagacacacacagacuccccaccacagagacacc

SEQ ID NO: 40751 - RNA, 64 nt, Homo Sapiens
cccuccccaccacagagacauccccaccucaaaucacacacaccuaacugaagccuaggccccg

SEQ ID NO: 40752 - RNA, 64 nt, Homo Sapiens
aauuuugccuauaccuuuaagacaaacaaacaaacacacacacaaacaagcucuaagcugcugu

SEQ ID NO: 40753 - RNA, 64 nt, Homo Sapiens
uuuugccuauaccuuuaagacaaacaaacaaacacacacacaaacaagcucuaagcugcuguag

SEQ ID NO: 40754 - RNA, 64 nt, Homo Sapiens
uaaaguaaaaacuaaaaaaauacaaaauacaaaacacacacacacacacacacacacacacaca

SEQ ID NO: 40755 - RNA, 64 nt, Homo Sapiens
aaguaaaaacuaaaaaaauacaaaauacaaaacacacacacacacacacacacacacacacaca

SEQ ID NO: 40756 - RNA, 64 nt, Homo Sapiens
guaaaaacuaaaaaaauacaaaauacaaaacacacacacacacacacacacacacacacacaca

SEQ ID NO: 40757 - RNA, 64 nt, Homo Sapiens
aaaaacuaaaaaaauacaaaauacaaaacacacacacacacacacacacacacacacacacaca

SEQ ID NO: 40758 - RNA, 64 nt, Homo Sapiens
aaacuaaaaaaauacaaaauacaaaacacacacacacacacacacacacacacacacacacaca

SEQ ID NO: 40759 - RNA, 64 nt, Homo Sapiens
acuaaaaaaauacaaaauacaaaacacacacacacacacacacacacacacacacacacacaca

SEQ ID NO: 40760 - RNA, 64 nt, Homo Sapiens
uaaaaaaauacaaaauacaaaacacacacacacacacacacacacacacacacacacacacaaa

SEQ ID NO: 40761 - RNA, 64 nt, Homo Sapiens
aaaaaauacaaaauacaaaacacacacacacacacacacacacacacacacacacacacaaaau

SEQ ID NO: 40762 - RNA, 64 nt, Homo Sapiens
aaaauacaaaauacaaaacacacacacacacacacacacacacacacacacacacacaaaauaa

SEQ ID NO: 40763 - RNA, 64 nt, Homo Sapiens
aauacaaaauacaaaacacacacacacacacacacacacacacacacacacacacaaaauaaau

SEQ ID NO: 40764 - RNA, 64 nt, Homo Sapiens
uacaaaauacaaaacacacacacacacacacacacacacacacacacacacacaaaauaaaucc

SEQ ID NO: 40765 - RNA, 64 nt, Homo Sapiens
caaaauacaaaacacacacacacacacacacacacacacacacacacacacaaaauaaauccgg

SEQ ID NO: 40766 - RNA, 64 nt, Homo Sapiens
aaauacaaaacacacacacacacacacacacacacacacacacacacacaaaauaaauccgggu

SEQ ID NO: 40767 - RNA, 64 nt, Homo Sapiens
auacaaaacacacacacacacacacacacacacacacacacacacacaaaauaaauccgggugu

SEQ ID NO: 40768 - RNA, 64 nt, Homo Sapiens
acaaaacacacacacacacacacacacacacacacacacacacacaaaauaaauccgggugugc

SEQ ID NO: 40769 - RNA, 64 nt, Homo Sapiens
aaaacacacacacacacacacacacacacacacacacacacacaaaauaaauccgggugugccu

SEQ ID NO: 40770 - RNA, 64 nt, Homo Sapiens
aacacacacacacacacacacacacacacacacacacacacaaaauaaauccgggugugccuga

SEQ ID NO: 40771 - RNA, 64 nt, Homo Sapiens
ccgccaaacaaggcaaaaaaauuuaaacaugaagcacacacacaaaaaaggcaguaggaaaaau

SEQ ID NO: 40772 - RNA, 64 nt, Homo Sapiens
gccaaacaaggcaaaaaaauuuaaacaugaagcacacacacaaaaaaggcaguaggaaaaaugc

SEQ ID NO: 40773 - RNA, 64 nt, Homo Sapiens
auuccugccucucaccaugcacgcauccauuguccacacacacacaaccagauaaucuucugaa

SEQ ID NO: 40774 - RNA, 64 nt, Homo Sapiens
uccugccucucaccaugcacgcauccauuguccacacacacacaaccagauaaucuucugaaag

SEQ ID NO: 40775 - RNA, 64 nt, Homo Sapiens
cugccucucaccaugcacgcauccauuguccacacacacacaaccagauaaucuucugaaagug

SEQ ID NO: 40776 - RNA, 64 nt, Homo Sapiens
aggcaggcccgggccuguuggcaagcuucgaucucacacacacagaaacauacauucgugccug

SEQ ID NO: 40777 - RNA, 64 nt, Homo Sapiens
gcaggcccgggccuguuggcaagcuucgaucucacacacacagaaacauacauucgugccugga

SEQ ID NO: 40778 - RNA, 64 nt, Homo Sapiens
cugaugaauaugggccccuuauagagcugcaaaacacacacaugcguauagacauacauacaug

SEQ ID NO: 40779 - RNA, 64 nt, Homo Sapiens
ccauacauagacaagcaucauaaaggcacaagugcacacacaucuaugcagacaagcuuccucg

SEQ ID NO: 40780 - RNA, 64 nt, Homo Sapiens
ugugucuauaauuaaaaaaaaauauauauauauacacacacacauauacauacaaagucaaacu

SEQ ID NO: 40781 - RNA, 64 nt, Homo Sapiens
ugucuauaauuaaaaaaaaauauauauauauacacacacacauauacauacaaagucaaacuga

SEQ ID NO: 40782 - RNA, 64 nt, Homo Sapiens
cugggaaaccccuucucugugacccacuucucaucacacacauggaaacccauaggcccacaca

SEQ ID NO: 40783 - RNA, 64 nt, Homo Sapiens
cacuucucaucacacacauggaaacccauaggcccacacacagguggugucacugucccuccug

SEQ ID NO: 40784 - RNA, 64 nt, Homo Sapiens
cacaaggucauggccacacugugacacacuacaccacacacaacagccaacagcuacaacagcc

SEQ ID NO: 40785 - RNA, 64 nt, Homo Sapiens
cagcagaaucaccaacacucuccgcuucccccagcacacacacauacaacacagaucauuuccc

SEQ ID NO: 40786 - RNA, 64 nt, Homo Sapiens
gcagaaucaccaacacucuccgcuucccccagcacacacacauacaacacagaucauuucccag

SEQ ID NO: 40787 - RNA, 64 nt, Homo Sapiens
uguucuuaauuuuuaacugcuggaaguguuaaaacacacacacacacacacacacauuuuuuuu

SEQ ID NO: 40788 - RNA, 64 nt, Homo Sapiens
uucuuaauuuuuaacugcuggaaguguuaaaacacacacacacacacacacacauuuuuuuuuu

SEQ ID NO: 40789 - RNA, 64 nt, Homo Sapiens
cuuaauuuuuaacugcuggaaguguuaaaacacacacacacacacacacacauuuuuuuuuuga

SEQ ID NO: 40790 - RNA, 64 nt, Homo Sapiens
uaauuuuuaacugcuggaaguguuaaaacacacacacacacacacacacauuuuuuuuuugaga

SEQ ID NO: 40791 - RNA, 64 nt, Homo Sapiens
auuuuuaacugcuggaaguguuaaaacacacacacacacacacacacauuuuuuuuuugagaac

SEQ ID NO: 40792 - RNA, 64 nt, Homo Sapiens
uuuuaacugcuggaaguguuaaaacacacacacacacacacacacauuuuuuuuuugagaacuc

SEQ ID NO: 40793 - RNA, 64 nt, Homo Sapiens
uuaacugcuggaaguguuaaaacacacacacacacacacacacauuuuuuuuuugagaacucca

SEQ ID NO: 40794 - RNA, 64 nt, Homo Sapiens
aacugcuggaaguguuaaaacacacacacacacacacacacauuuuuuuuuugagaacuccaaa

SEQ ID NO: 40795 - RNA, 64 nt, Homo Sapiens
uggccgggacccggcagggagucgagcuggggcacacacacacccagccuggagaccaccgaga

SEQ ID NO: 40796 - RNA, 64 nt, Homo Sapiens
ccuggccgggacccggcagggagucgagcuggggcacacacacaugcagccuggagaccaccga

SEQ ID NO: 40797 - RNA, 64 nt, Homo Sapiens
uauauacacauauauauguguguauauauacacacacacacauguuagguuacagcuggaggug

SEQ ID NO: 40798 - RNA, 64 nt, Homo Sapiens
uguauauacacauauauauguguguauauauacacacacacacagguuagguuacagcuggagg

SEQ ID NO: 40799 - RNA, 64 nt, Homo Sapiens
cauguauauacacauauauagguguguauauauacacacacacacugguuagguuacagcugga

SEQ ID NO: 40800 - RNA, 64 nt, Homo Sapiens
gagcauuucaaggccacagcacagcacacacauacacacacagaucucuguaaauuaaaauguu

SEQ ID NO: 40801 - RNA, 64 nt, Homo Sapiens
cacacacagagagcauuucauuaaaauguuacagcacacacauaagucauugcuucucuguaaa

SEQ ID NO: 40802 - RNA, 64 nt, Homo Sapiens
cacagagacucuuucauuuucacacacucgcacacacacacauagaaaacaacaacacaaacca

SEQ ID NO: 40803 - RNA, 64 nt, Homo Sapiens
uacacagagacucuuucauucacacacacucgcacacacacacaaagaaaacaacaacacaaac

SEQ ID NO: 40804 - RNA, 64 nt, Homo Sapiens
cauacacagagacucuuucaaccacacacacucgcacacacacaacaagaaaacaacaacacaa

SEQ ID NO: 40805 - RNA, 64 nt, Homo Sapiens
cgcacacacacacauacacaacaacaacacaaaccacacacacugagcuuuuuaauacaagaaa

SEQ ID NO: 40806 - RNA, 64 nt, Homo Sapiens
ccuucuugaauggcuccaagcacacacacacacacacacacaccaaguugaugauuuacacaca

SEQ ID NO: 40807 - RNA, 64 nt, Homo Sapiens
ccccuucuugaauggcuccacacacacacacacacacacacacaacaaguugaugauuuacaca

SEQ ID NO: 40808 - RNA, 64 nt, Homo Sapiens
caccccuucuugaauggcuccacacacacacacacacacacacaauacaaguugaugauuuaca

SEQ ID NO: 40809 - RNA, 64 nt, Homo Sapiens
cacaccccuucuugaauggccacacacacacacacacacacacacuauacaaguugaugauuua

SEQ ID NO: 40810 - RNA, 64 nt, Homo Sapiens
cacacaccccuucuugaauguacacacacacacacacacacacaaacuauacaaguugaugauu

SEQ ID NO: 40811 - RNA, 64 nt, Homo Sapiens
cacacacaccccuucuugaauuuacacacacacacacacacacauuaacuauacaaguugauga

SEQ ID NO: 40812 - RNA, 64 nt, Homo Sapiens
cacacacacaccccuucuuggauuuacacacacacacacacacagcuuaacuauacaaguugau

SEQ ID NO: 40813 - RNA, 64 nt, Homo Sapiens
cacacacacacaccccuucuaugauuuacacacacacacacacaaagcuuaacuauacaaguug

SEQ ID NO: 40814 - RNA, 64 nt, Homo Sapiens
cacacacacacacaccccuuugaugauuuacacacacacacacacaaagcuuaacuauacaagu

SEQ ID NO: 40815 - RNA, 64 nt, Homo Sapiens
cacacacacacacacaccccguugaugauuuacacacacacacacacaaagcuuaacuauacaa

SEQ ID NO: 40816 - RNA, 64 nt, Homo Sapiens
cacacacacacacacacaccaaguugaugauuuacacacacacauacacaaagcuuaacuauac

SEQ ID NO: 40817 - RNA, 64 nt, Homo Sapiens
uuguguuuuagucccuugcuccugcuucuuucuacacacacaucuaaagacggugcggcucgcu

SEQ ID NO: 40818 - RNA, 64 nt, Homo Sapiens
agggguaggaggagggcccucagcuggcccuccccacacacaggacggcaggggcacugugagg

SEQ ID NO: 40819 - RNA, 64 nt, Homo Sapiens
caugguuauuuauauauauagauaucuguauauacacacacacauaugugcacacacacacucu

SEQ ID NO: 40820 - RNA, 64 nt, Homo Sapiens
ugguuauuuauauauauagauaucuguauauacacacacacauaugugcacacacacacucucu

SEQ ID NO: 40821 - RNA, 64 nt, Homo Sapiens
uauagauaucuguauauacacacacacauaugugcacacacacacucucucuccauuaucgaac

SEQ ID NO: 40822 - RNA, 64 nt, Homo Sapiens
uagauaucuguauauacacacacacauaugugcacacacacacucucucuccauuaucgaacga

SEQ ID NO: 40823 - RNA, 64 nt, Homo Sapiens
accaaaugagcuaaguugcaaauauauauauauacacacacacacauauauguacauguguaug

SEQ ID NO: 40824 - RNA, 64 nt, Homo Sapiens
caaaugagcuaaguugcaaauauauauauauacacacacacacauauauguacauguguaugua

SEQ ID NO: 40825 - RNA, 64 nt, Homo Sapiens
aaugagcuaaguugcaaauauauauauauacacacacacacauauauguacauguguauguaca

SEQ ID NO: 40826 - RNA, 64 nt, Homo Sapiens
aaauaugcuuucuuguugcauauaugcacagauacacacacacacacacacgaaaauaaauaaa

SEQ ID NO: 40827 - RNA, 64 nt, Homo Sapiens
auaugcuuucuuguugcauauaugcacagauacacacacacacacacacgaaaauaaauaaaug

SEQ ID NO: 40828 - RNA, 64 nt, Homo Sapiens
augcuuucuuguugcauauaugcacagauacacacacacacacacacgaaaauaaauaaauguu

SEQ ID NO: 40829 - RNA, 64 nt, Homo Sapiens
gcuuucuuguugcauauaugcacagauacacacacacacacacacgaaaauaaauaaauguuca

SEQ ID NO: 40830 - RNA, 64 nt, Homo Sapiens
uuucuuguugcauauaugcacagauacacacacacacacacacgaaaauaaauaaauguucaua

SEQ ID NO: 40831 - RNA, 64 nt, Homo Sapiens
cuccagagcugcccaccucccacugcccccucagcacacacacaguccccaggcggccuagggg

SEQ ID NO: 40832 - RNA, 64 nt, Homo Sapiens
ccagagcugcccaccucccacugcccccucagcacacacacaguccccaggcggccuaggggcc

SEQ ID NO: 40833 - RNA, 64 nt, Homo Sapiens
auagacuccuauuuuucuuguuuuauauuaugaccacacacaucucugcuggaaagucaacaug

SEQ ID NO: 40834 - RNA, 64 nt, Homo Sapiens
uuguaccauccacccauacccacacagucacagucacacacacauauguauuacuuacacuaua

SEQ ID NO: 40835 - RNA, 64 nt, Homo Sapiens
guaccauccacccauacccacacagucacagucacacacacauauguauuacuuacacuauaua

SEQ ID NO: 40836 - RNA, 64 nt, Homo Sapiens
cacauaugugggcauccagccucuggggccuuggcacacacacauucgugugcucugcugcaug

SEQ ID NO: 40837 - RNA, 64 nt, Homo Sapiens
cauaugugggcauccagccucuggggccuuggcacacacacauucgugugcucugcugcaugug

SEQ ID NO: 40838 - RNA, 64 nt, Homo Sapiens
aaugcaaucuccccuugauuuaaacacacagauacacacacacacacacacacacacaaaccuu

SEQ ID NO: 40839 - RNA, 64 nt, Homo Sapiens
ugcaaucuccccuugauuuaaacacacagauacacacacacacacacacacacacaaaccuucu

SEQ ID NO: 40840 - RNA, 64 nt, Homo Sapiens
caaucuccccuugauuuaaacacacagauacacacacacacacacacacacacaaaccuucugc

SEQ ID NO: 40841 - RNA, 64 nt, Homo Sapiens
aucuccccuugauuuaaacacacagauacacacacacacacacacacacacaaaccuucugccu

SEQ ID NO: 40842 - RNA, 64 nt, Homo Sapiens
cuccccuugauuuaaacacacagauacacacacacacacacacacacacaaaccuucugccuuu

SEQ ID NO: 40843 - RNA, 64 nt, Homo Sapiens
ccccuugauuuaaacacacagauacacacacacacacacacacacacaaaccuucugccuuuga

SEQ ID NO: 40844 - RNA, 64 nt, Homo Sapiens
ccuugauuuaaacacacagauacacacacacacacacacacacacaaaccuucugccuuugaug

SEQ ID NO: 40845 - RNA, 64 nt, Homo Sapiens
uugauuuaaacacacagauacacacacacacacacacacacacaaaccuucugccuuugauguu

SEQ ID NO: 40846 - RNA, 64 nt, Homo Sapiens
gauuuaaacacacagauacacacacacacacacacacacacaaaccuucugccuuugauguuac

SEQ ID NO: 40847 - RNA, 64 nt, Homo Sapiens
agcagcuucaccagagcauuuccaacaccacagacacacacacgcacgcacacacacaaacaca

SEQ ID NO: 40848 - RNA, 64 nt, Homo Sapiens
agcauuuccaacaccacagacacacacacgcacgcacacacacaaacacacaugcacacacaca

SEQ ID NO: 40849 - RNA, 64 nt, Homo Sapiens
cauuuccaacaccacagacacacacacgcacgcacacacacaaacacacaugcacacacacaca

SEQ ID NO: 40850 - RNA, 64 nt, Homo Sapiens
cacacacacgcacgcacacacacaaacacacaugcacacacacacaucucauuucucuaguguc

SEQ ID NO: 40851 - RNA, 64 nt, Homo Sapiens
cacacacgcacgcacacacacaaacacacaugcacacacacacaucucauuucucuagugucuu

SEQ ID NO: 40852 - RNA, 64 nt, Homo Sapiens
cacacgcacgcacacacacaaacacacaugcacacacacacaucucauuucucuagugucuuuu

SEQ ID NO: 40853 - RNA, 64 nt, Homo Sapiens
cucagccucuucacaaugacuuucuaaaaaaaaucacacacacacacacacacacuacagaaga

SEQ ID NO: 40854 - RNA, 64 nt, Homo Sapiens
cagccucuucacaaugacuuucuaaaaaaaaucacacacacacacacacacacuacagaagagg

SEQ ID NO: 40855 - RNA, 64 nt, Homo Sapiens
gccucuucacaaugacuuucuaaaaaaaaucacacacacacacacacacacuacagaagaggau

SEQ ID NO: 40856 - RNA, 64 nt, Homo Sapiens
cucuucacaaugacuuucuaaaaaaaaucacacacacacacacacacacuacagaagaggauug

SEQ ID NO: 40857 - RNA, 64 nt, Homo Sapiens
cuucacaaugacuuucuaaaaaaaaucacacacacacacacacacacuacagaagaggauugca

SEQ ID NO: 40858 - RNA, 64 nt, Homo Sapiens
ucacaaugacuuucuaaaaaaaaucacacacacacacacacacacuacagaagaggauugcaaa

SEQ ID NO: 40859 - RNA, 64 nt, Homo Sapiens
acaaugacuuucuaaaaaaaaucacacacacacacacacacacuacagaagaggauugcaaaca

SEQ ID NO: 40860 - RNA, 64 nt, Homo Sapiens
uauuuguauaaagcuaaguucacacacacacacacacacacauacauauauauauauacacaca

SEQ ID NO: 40861 - RNA, 64 nt, Homo Sapiens
uauauuuguauaaagcuaagcacacacacacacacacacacacauacauauauauauauacaca

SEQ ID NO: 40862 - RNA, 64 nt, Homo Sapiens
cauauauuuguauaaagcuacacacacacacacacacacacacacauacauauauauauauaca

SEQ ID NO: 40863 - RNA, 64 nt, Homo Sapiens
cacauauauuuguauaaagccacacacacacacacacacacacauucauacauauauauauaua

SEQ ID NO: 40864 - RNA, 64 nt, Homo Sapiens
cacacauauauuuguauaaauacacacacacacacacacacacauuuucauacauauauauaua

SEQ ID NO: 40865 - RNA, 64 nt, Homo Sapiens
cacacacauauauuuguauauauacacacacacacacacacacauguuuucauacauauauaua

SEQ ID NO: 40866 - RNA, 64 nt, Homo Sapiens
cacacacacauauauuuguauauauacacacacacacacacacaguuguuuucauacauauaua

SEQ ID NO: 40867 - RNA, 64 nt, Homo Sapiens
cacacacacacauauauuuguauauauacacacacacacacacauaguuguuuucauacauaua

SEQ ID NO: 40868 - RNA, 64 nt, Homo Sapiens
cacacacacacacauauauuuauauauauacacacacacacacagauaguuguuuucauacaua

SEQ ID NO: 40869 - RNA, 64 nt, Homo Sapiens
cacacacacacacacauauauauauauauauacacacacacacacagauaguuguuuucauaca

SEQ ID NO: 40870 - RNA, 64 nt, Homo Sapiens
cacacacacacacacacauacauauauauauauacacacacacaaucagauaguuguuuucaua

SEQ ID NO: 40871 - RNA, 64 nt, Homo Sapiens
aaaaauuugaaccaaaacauaaaaaaaacacacacacacacaacuguccucuuucagaaaacag

SEQ ID NO: 40872 - RNA, 64 nt, Homo Sapiens
acaaaaauuugaaccaaaacagaaaaaaaacacacacacacacaacuguccucuuucagaaaac

SEQ ID NO: 40873 - RNA, 64 nt, Homo Sapiens
caacaaaaauuugaaccaaaacagaaaaaaaacacacacacacaaaacuguccucuuucagaaa

SEQ ID NO: 40874 - RNA, 64 nt, Homo Sapiens
cacaacaaaaauuugaaccaaaacagaaaaaaaacacacacacaauaaacuguccucuuucaga

SEQ ID NO: 40875 - RNA, 64 nt, Homo Sapiens
uagaaguccucucccagcuacuucaagaaugggccacacacagcgcaccucccuuucagccauu

SEQ ID NO: 40876 - RNA, 64 nt, Homo Sapiens
ugcgccuucauagcccagccaugaugugagcaaacacacacacgacacagacacacauacaccc

SEQ ID NO: 40877 - RNA, 64 nt, Homo Sapiens
cacacauacacccaugaugucacaccccugaacacacacacagaacacacaacacacacacaua

SEQ ID NO: 40878 - RNA, 64 nt, Homo Sapiens
gacacacauacacccaugauuacacaccccugaacacacacacaagacacacaacacacacaca

SEQ ID NO: 40879 - RNA, 64 nt, Homo Sapiens
cacaccccugaacacacacaacagacacacaacacacacacauaugcacacccugaaaacacac

SEQ ID NO: 40880 - RNA, 64 nt, Homo Sapiens
uacacaccccugaacacacaacacagacacacaacacacacacacaugcacacccugaaaacac

SEQ ID NO: 40881 - RNA, 64 nt, Homo Sapiens
cacacaacacacacacauacgcacacccugaaaacacacacagacaaucuggcccucuccacau

SEQ ID NO: 40882 - RNA, 64 nt, Homo Sapiens
auaaagacacacaaggacgucacacacacacacacacacacaaagccuaucccagcaaaacaca

SEQ ID NO: 40883 - RNA, 64 nt, Homo Sapiens
aaauaaagacacacaaggaccacacacacacacacacacacacauugccuaucccagcaaaaca

SEQ ID NO: 40884 - RNA, 64 nt, Homo Sapiens
caaaauaaagacacacaaggcacacacacacacacacacacacacuuugccuaucccagcaaaa

SEQ ID NO: 40885 - RNA, 64 nt, Homo Sapiens
cacaaaauaaagacacacaaaacacacacacacacacacacacagacuuugccuaucccagcaa

SEQ ID NO: 40886 - RNA, 64 nt, Homo Sapiens
cacacaaaauaaagacacacaaaacacacacacacacacacacaaagacuuugccuaucccagc

SEQ ID NO: 40887 - RNA, 64 nt, Homo Sapiens
cacacacaaaauaaagacacgcaaaacacacacacacacacacaaaaagacuuugccuauccca

SEQ ID NO: 40888 - RNA, 64 nt, Homo Sapiens
cacacacacaaaauaaagaccagcaaaacacacacacacacacaccaaaagacuuugccuaucc

SEQ ID NO: 40889 - RNA, 64 nt, Homo Sapiens
cacacacacacaaaauaaagcccagcaaaacacacacacacacaucccaaaagacuuugccuau

SEQ ID NO: 40890 - RNA, 64 nt, Homo Sapiens
cacacacacacacaaaauaaaucccagcaaaacacacacacacaugucccaaaagacuuugccu

SEQ ID NO: 40891 - RNA, 64 nt, Homo Sapiens
cacacacacacacacaaaaucuaucccagcaaaacacacacacacgugucccaaaagacuuugc

SEQ ID NO: 40892 - RNA, 64 nt, Homo Sapiens
cccguaacaggauuuaucaccauagaagcccucacacacacaugaaaauggagucggggggcca

SEQ ID NO: 40893 - RNA, 64 nt, Homo Sapiens
ugcccguaacaggauuuauccacauagaagcccucacacacacaauaaaauggagucggggggc

SEQ ID NO: 40894 - RNA, 64 nt, Homo Sapiens
ggcaagcauagucgccuggucccccguguucacacacacacaaucugcgcgugcggagcggagc

SEQ ID NO: 40895 - RNA, 64 nt, Homo Sapiens
auggcaagcauagucgccuggccccccguguucacacacacacagccugcgcgugcggagcgga

SEQ ID NO: 40896 - RNA, 64 nt, Homo Sapiens
caauggcaagcauagucgccgagccccccguguucacacacacacggccugcgcgugcggagcg

SEQ ID NO: 40897 - RNA, 64 nt, Homo Sapiens
aucacucucuuaucccaucccacacucacauacacacacacaaauagaaaaauucagaaaagca

SEQ ID NO: 40898 - RNA, 64 nt, Homo Sapiens
aaaucacucucuuaucccaucacacacucacauacacacacacacuuagaaaaauucagaaaag

SEQ ID NO: 40899 - RNA, 64 nt, Homo Sapiens
cauauaaccuaugccaauaacacacacacacacacacacacaaacacacacacacacacacaca

SEQ ID NO: 40900 - RNA, 64 nt, Homo Sapiens
aacauauaaccuaugccaaucacacacacacacacacacacacagacacacacacacacacaca

SEQ ID NO: 40901 - RNA, 64 nt, Homo Sapiens
caaacauauaaccuaugccacacacacacacacacacacacacacagacacacacacacacaca

SEQ ID NO: 40902 - RNA, 64 nt, Homo Sapiens
cacaaacauauaaccuaugccacacacacacacacacacacacaagcagacacacacacacaca

SEQ ID NO: 40903 - RNA, 64 nt, Homo Sapiens
cacacaaacauauaaccuaucacacacacacacacacacacacagaagcagacacacacacaca

SEQ ID NO: 40904 - RNA, 64 nt, Homo Sapiens
cacacacaaacauauaaccucacacacacacacacacacacacaaugaagcagacacacacaca

SEQ ID NO: 40905 - RNA, 64 nt, Homo Sapiens
cacacacacaaacauauaaccacacacacacacacacacacacaaaaugaagcagacacacaca

SEQ ID NO: 40906 - RNA, 64 nt, Homo Sapiens
cacacacacacaaacauauacacacacacacacacacacacacaaaaaaugaagcagacacaca

SEQ ID NO: 40907 - RNA, 64 nt, Homo Sapiens
cacacacacacacaaacauacacacacacacacacacacacacaagaaaaaugaagcagacaca

SEQ ID NO: 40908 - RNA, 64 nt, Homo Sapiens
cacacacacacacacaaacacacacacacacacacacacacacauuagaaaaaugaagcagaca

SEQ ID NO: 40909 - RNA, 64 nt, Homo Sapiens
cacacacacacacacacaaacacacacacacacacacacacacagauuagaaaaaugaagcaga

SEQ ID NO: 40910 - RNA, 64 nt, Homo Sapiens
cacacacacacacacacacagacacacacacacacacacacacauugauuagaaaaaugaagca

SEQ ID NO: 40911 - RNA, 64 nt, Homo Sapiens
cacacacacacacacacacacagacacacacacacacacacacaguuugauuagaaaaaugaag

SEQ ID NO: 40912 - RNA, 64 nt, Homo Sapiens
cacacacacacacacacacaagcagacacacacacacacacacauuguuugauuagaaaaauga

SEQ ID NO: 40913 - RNA, 64 nt, Homo Sapiens
cacacacacacacacacacagaagcagacacacacacacacacaguuuguuugauuagaaaaau

SEQ ID NO: 40914 - RNA, 64 nt, Homo Sapiens
cacacacacacacacacacaaugaagcagacacacacacacacauuguuuguuugauuagaaaa

SEQ ID NO: 40915 - RNA, 64 nt, Homo Sapiens
cacacacacacacacacacaaaaugaagcagacacacacacacaaguuguuuguuugauuagaa

SEQ ID NO: 40916 - RNA, 64 nt, Homo Sapiens
cacacacacacacacacacaaaaaaugaagcagacacacacacaucaguuguuuguuugauuag

SEQ ID NO: 40917 - RNA, 64 nt, Homo Sapiens
gauaucuauacauauauacacugccauggggaaacacacacagaaaggcacaugagugugaccu

SEQ ID NO: 40918 - RNA, 64 nt, Homo Sapiens
aaaacguaaguuucauuuggacaacauccucugccacacacaacucuccucaucaucauuccca

SEQ ID NO: 40919 - RNA, 64 nt, Homo Sapiens
ugccccuuuuggaaugaucucugaauauauaaaacacacacacaaagagcaauaguuugccccu

SEQ ID NO: 40920 - RNA, 64 nt, Homo Sapiens
ccccuuuuggaaugaucucugaauauauaaaacacacacacaaagagcaauaguuugccccuuu

SEQ ID NO: 40921 - RNA, 64 nt, Homo Sapiens
ugccccuuuuggaacgaccccugaauauauaaaacacacacacaccccgcgcacucucacuccu

SEQ ID NO: 40922 - RNA, 64 nt, Homo Sapiens
ccccuuuuggaacgaccccugaauauauaaaacacacacacaccccgcgcacucucacuccuuu

SEQ ID NO: 40923 - RNA, 64 nt, Homo Sapiens
gcuauaugacuacggauccauuagugaggagcgacacacacaccuguaggcauccugugcaaac

SEQ ID NO: 40924 - RNA, 64 nt, Homo Sapiens
aauuuuaucuuuugguagaaauguguuuauuuaacacacacacacaccuaauacuacauucaaa

SEQ ID NO: 40925 - RNA, 64 nt, Homo Sapiens
uuuuaucuuuugguagaaauguguuuauuuaacacacacacacaccuaauacuacauucaaagu

SEQ ID NO: 40926 - RNA, 64 nt, Homo Sapiens
uuaucuuuugguagaaauguguuuauuuaacacacacacacaccuaauacuacauucaaaguau

SEQ ID NO: 40927 - RNA, 64 nt, Homo Sapiens
uauauauauauauauauauauauauauauauauacacacacacacacauacacaaauauuccag

SEQ ID NO: 40928 - RNA, 64 nt, Homo Sapiens
uauauauauauauauauauauauauauauauacacacacacacacauacacaaauauuccagga

SEQ ID NO: 40929 - RNA, 64 nt, Homo Sapiens
uauauauauauauauauauauauauauauacacacacacacacauacacaaauauuccaggaua

SEQ ID NO: 40930 - RNA, 64 nt, Homo Sapiens
uauauauauauauauauauauauauauacacacacacacacauacacaaauauuccaggauaca

SEQ ID NO: 40931 - RNA, 64 nt, Homo Sapiens
cuuacauuaguuaagcuaagcagcaaaaagaaaacacacacacacacucacauuuagcccaugu

SEQ ID NO: 40932 - RNA, 64 nt, Homo Sapiens
uacauuaguuaagcuaagcagcaaaaagaaaacacacacacacacucacauuuagcccauguca

SEQ ID NO: 40933 - RNA, 64 nt, Homo Sapiens
cauuaguuaagcuaagcagcaaaaagaaaacacacacacacacucacauuuagcccaugucauu

SEQ ID NO: 40934 - RNA, 64 nt, Homo Sapiens
gaaauggcccguggugggcugaccccccacccuccacacacacaguuccaugacccagcgggcc

SEQ ID NO: 40935 - RNA, 64 nt, Homo Sapiens
aauggcccguggugggcugaccccccacccuccacacacacaguuccaugacccagcgggcccc

SEQ ID NO: 40936 - RNA, 64 nt, Homo Sapiens
ucugcgugcagauuuuguacaaaaaaaaaaaagacacacacacauacaugauaaugauucccag

SEQ ID NO: 40937 - RNA, 64 nt, Homo Sapiens
ugcgugcagauuuuguacaaaaaaaaaaaagacacacacacauacaugauaaugauucccagcc

SEQ ID NO: 40938 - RNA, 64 nt, Homo Sapiens
cgcacgcacgcacacaaacaugcacacacgcaugcacacacacaaagccuuaagcagaagaaug

SEQ ID NO: 40939 - RNA, 64 nt, Homo Sapiens
cacgcacgcacacaaacaugcacacacgcaugcacacacacaaagccuuaagcagaagaauguc

SEQ ID NO: 40940 - RNA, 64 nt, Homo Sapiens
uguguguguguguauacauauauacacauauauacacacacacauacauauacauguguauaua

SEQ ID NO: 40941 - RNA, 64 nt, Homo Sapiens
uguguguguguauacauauauacacauauauacacacacacauacauauacauguguauauaua

SEQ ID NO: 40942 - RNA, 64 nt, Homo Sapiens
aaaaaugaucauggcuuuaaaaaaaaaacaaaaacacacacacaugaacucagauuugcaaacc

SEQ ID NO: 40943 - RNA, 64 nt, Homo Sapiens
aaaugaucauggcuuuaaaaaaaaaacaaaaacacacacacaugaacucagauuugcaaaccag

SEQ ID NO: 40944 - RNA, 64 nt, Homo Sapiens
uucuucauaucaauuuuguauaaauauauagaaacacacacacagccucagacuuacaaacuga

SEQ ID NO: 40945 - RNA, 64 nt, Homo Sapiens
cuucauaucaauuuuguauaaauauauagaaacacacacacagccucagacuuacaaacugauu

SEQ ID NO: 40946 - RNA, 64 nt, Homo Sapiens
gugcauucugaggucuaacccggggugccaggaacacacacauccuccaucccagcauagagaa

SEQ ID NO: 40947 - RNA, 64 nt, Homo Sapiens
uuugucagguucacguccuauaacgguuaaaaaacacacacacacauacacaaaccguuucuau

SEQ ID NO: 40948 - RNA, 64 nt, Homo Sapiens
ugucagguucacguccuauaacgguuaaaaaacacacacacacauacacaaaccguuucuauga

SEQ ID NO: 40949 - RNA, 64 nt, Homo Sapiens
ucagguucacguccuauaacgguuaaaaaacacacacacacauacacaaaccguuucuaugaga

SEQ ID NO: 40950 - RNA, 64 nt, Homo Sapiens
uuuaggacuguuuuuagacccuccuagccuugaacacacacauguacacacacacacacacaca

SEQ ID NO: 40951 - RNA, 64 nt, Homo Sapiens
uuuagacccuccuagccuugaacacacacauguacacacacacacacacacacacacacacacc

SEQ ID NO: 40952 - RNA, 64 nt, Homo Sapiens
uagacccuccuagccuugaacacacacauguacacacacacacacacacacacacacacacccu

SEQ ID NO: 40953 - RNA, 64 nt, Homo Sapiens
gacccuccuagccuugaacacacacauguacacacacacacacacacacacacacacacccuuu

SEQ ID NO: 40954 - RNA, 64 nt, Homo Sapiens
cccuccuagccuugaacacacacauguacacacacacacacacacacacacacacacccuuuca

SEQ ID NO: 40955 - RNA, 64 nt, Homo Sapiens
cuccuagccuugaacacacacauguacacacacacacacacacacacacacacacccuuucauu

SEQ ID NO: 40956 - RNA, 64 nt, Homo Sapiens
ccuagccuugaacacacacauguacacacacacacacacacacacacacacacccuuucauucc

SEQ ID NO: 40957 - RNA, 64 nt, Homo Sapiens
uagccuugaacacacacauguacacacacacacacacacacacacacacacccuuucauucccu

SEQ ID NO: 40958 - RNA, 64 nt, Homo Sapiens
gccuugaacacacacauguacacacacacacacacacacacacacacacccuuucauucccugu

SEQ ID NO: 40959 - RNA, 64 nt, Homo Sapiens
cuugaacacacacauguacacacacacacacacacacacacacacacccuuucauucccugugu

SEQ ID NO: 40960 - RNA, 64 nt, Homo Sapiens
ugaacacacacauguacacacacacacacacacacacacacacacccuuucauucccuguguug

SEQ ID NO: 40961 - RNA, 64 nt, Homo Sapiens
aacacacacauguacacacacacacacacacacacacacacacccuuucauucccuguguugug

SEQ ID NO: 40962 - RNA, 64 nt, Homo Sapiens
uugggacaaguggggagccccacacacacacacacacacacauugacagacagacagacagaca

SEQ ID NO: 40963 - RNA, 64 nt, Homo Sapiens
uuuugggacaaguggggagccacacacacacacacacacacacacggacagacagacagacaga

SEQ ID NO: 40964 - RNA, 64 nt, Homo Sapiens
cauuuugggacaaguggggagacacacacacacacacacacacauacggacagacagacagaca

SEQ ID NO: 40965 - RNA, 64 nt, Homo Sapiens
cacauuuugggacaagugggcagacacacacacacacacacacacuuacggacagacagacaga

SEQ ID NO: 40966 - RNA, 64 nt, Homo Sapiens
cacacauuuugggacaaguggacagacacacacacacacacacacacuuacggacagacagaca

SEQ ID NO: 40967 - RNA, 64 nt, Homo Sapiens
cacacacauuuugggacaagcagacagacacacacacacacacaaccacuuacggacagacaga

SEQ ID NO: 40968 - RNA, 64 nt, Homo Sapiens
cacacacacauuuugggacagacagacagacacacacacacacacuaccacuuacggacagaca

SEQ ID NO: 40969 - RNA, 64 nt, Homo Sapiens
cacacacacacauuuugggacagacagacagacacacacacacacucuaccacuuacggacaga

SEQ ID NO: 40970 - RNA, 64 nt, Homo Sapiens
cacacacacacacauuuugggacagacagacagacacacacacagacucuaccacuuacggaca

SEQ ID NO: 40971 - RNA, 64 nt, Homo Sapiens
uuucacgauguauggucaggcacaaacacacacacacacacaaucauacacacacacccacaca

SEQ ID NO: 40972 - RNA, 64 nt, Homo Sapiens
auuuucacgauguauggucacacacaaacacacacacacacacagacauacacacacacccaca

SEQ ID NO: 40973 - RNA, 64 nt, Homo Sapiens
caauuuucacgauguauggucacacacaaacacacacacacacauggacauacacacacaccca

SEQ ID NO: 40974 - RNA, 64 nt, Homo Sapiens
cacaauuuucacgauguaugcacacacacaaacacacacacacacauggacauacacacacacc

SEQ ID NO: 40975 - RNA, 64 nt, Homo Sapiens
cacacaauuuucacgauguacccacacacacaaacacacacacauacauggacauacacacaca

SEQ ID NO: 40976 - RNA, 64 nt, Homo Sapiens
cacacacacacacacaauuuuacacacacacccacacacacaaacaccagcauauacauggaca

SEQ ID NO: 40977 - RNA, 64 nt, Homo Sapiens
aacacacacacacacacaaucauacacacacacccacacacacaaccaccagcauauacaugga

SEQ ID NO: 40978 - RNA, 64 nt, Homo Sapiens
cacacacacaaacacacacauauacauggacauacacacacaccagggauaaaaaccaccagca

SEQ ID NO: 40979 - RNA, 64 nt, Homo Sapiens
agugaaaaacuguguugggguuauuaaccacacacacacacaaauacuuuacuucugguauggu

SEQ ID NO: 40980 - RNA, 64 nt, Homo Sapiens
aaagugaaaaacuguguuggguuuauuaaccacacacacacacacauacuuuacuucugguaug

SEQ ID NO: 40981 - RNA, 64 nt, Homo Sapiens
caaaagugaaaaacuguguuugguuuauuaaccacacacacacaaccauacuuuacuucuggua

SEQ ID NO: 40982 - RNA, 64 nt, Homo Sapiens
cacaaaagugaaaaacuguguaugguuuauuaaccacacacacaacaccauacuuuacuucugg

SEQ ID NO: 40983 - RNA, 64 nt, Homo Sapiens
cacacucacacucccuugucacacagccacugcacacacacacuuagcccugguugcuucugau

SEQ ID NO: 40984 - RNA, 64 nt, Homo Sapiens
cucacacucacacucccuugauacacagccacugcacacacacaccuagcccugguugcuucug

SEQ ID NO: 40985 - RNA, 64 nt, Homo Sapiens
cauacacuuagguuucaugcugcacacacacacucacacacaugcaugcacaaauacacacuca

SEQ ID NO: 40986 - RNA, 64 nt, Homo Sapiens
cacacacaugcauacacuuauacacacucaugcacacacacacucucccucguacaugcacaaa

SEQ ID NO: 40987 - RNA, 64 nt, Homo Sapiens
cucacacacaugcauacacuaauacacacucaugcacacacacauacucccucguacaugcaca

SEQ ID NO: 40988 - RNA, 64 nt, Homo Sapiens
cagagcucucugagggugaucgcacacgcacgcacacacacauaacaugccugcaccugcagcg

SEQ ID NO: 40989 - RNA, 64 nt, Homo Sapiens
uacagagcucucugagggugcgcgcacacgcacgcacacacacacaacaugccugcaccugcag

SEQ ID NO: 40990 - RNA, 64 nt, Homo Sapiens
cacccuaaggauccaauggacacacacacacacacacacacauucagacacacacacacacaca

SEQ ID NO: 40991 - RNA, 64 nt, Homo Sapiens
uucacccuaaggauccaaugcacacacacacacacacacacacacacagacacacacacacaca

SEQ ID NO: 40992 - RNA, 64 nt, Homo Sapiens
cauucacccuaaggauccaacacacacacacacacacacacacauacacagacacacacacaca

SEQ ID NO: 40993 - RNA, 64 nt, Homo Sapiens
cacauucacccuaaggaucccacacacacacacacacacacacacauacacagacacacacaca

SEQ ID NO: 40994 - RNA, 64 nt, Homo Sapiens
cacacauucacccuaaggaucacacacacacacacacacacacauacauacacagacacacaca

SEQ ID NO: 40995 - RNA, 64 nt, Homo Sapiens
cacacacauucacccuaaggcacacacacacacacacacacacaccuacauacacagacacaca

SEQ ID NO: 40996 - RNA, 64 nt, Homo Sapiens
cacacacacauucacccuaacacacacacacacacacacacacaacccuacauacacagacaca

SEQ ID NO: 40997 - RNA, 64 nt, Homo Sapiens
cacacacacacauucacccucacacacacacacacacacacacaccacccuacauacacagaca

SEQ ID NO: 40998 - RNA, 64 nt, Homo Sapiens
cacacacacacacauucacccacacacacacacacacacacacaacccacccuacauacacaga

SEQ ID NO: 40999 - RNA, 64 nt, Homo Sapiens
cacacacacacacacauucagacacacacacacacacacacacaacacccacccuacauacaca

SEQ ID NO: 41000 - RNA, 64 nt, Homo Sapiens
cacacacacacacacacauucagacacacacacacacacacacauaacacccacccuacauaca

SEQ ID NO: 41001 - RNA, 64 nt, Homo Sapiens
cacacacacacacacacacacacagacacacacacacacacacacuuaacacccacccuacaua

SEQ ID NO: 41002 - RNA, 64 nt, Homo Sapiens
cacacacacacacacacacauacacagacacacacacacacacacucuuaacacccacccuaca

SEQ ID NO: 41003 - RNA, 64 nt, Homo Sapiens
cacacacacacacacacacacauacacagacacacacacacacaaucucuuaacacccacccua

SEQ ID NO: 41004 - RNA, 64 nt, Homo Sapiens
cacacacacacacacacacauacauacacagacacacacacacaaaaucucuuaacacccaccc

SEQ ID NO: 41005 - RNA, 64 nt, Homo Sapiens
cacacacacacacacacacaccuacauacacagacacacacacagaaaaucucuuaacacccac

SEQ ID NO: 41006 - RNA, 64 nt, Homo Sapiens
acuauaaauaccagugcuaucacagccacacauacacacacacagacauaaaauaaccaaacau

SEQ ID NO: 41007 - RNA, 63 nt, Homo Sapiens
uauaaauaccagugcuaucacagccacacauacacacacacagacauaaaauaaccaaacauc

SEQ ID NO: 41008 - RNA, 64 nt, Homo Sapiens
uggucuaaaaaagggaagauauuguagaagauuucacacacacacgcgugugugggagacaacu

SEQ ID NO: 41009 - RNA, 64 nt, Homo Sapiens
gucuaaaaaagggaagauauuguagaagauuucacacacacacgcgugugugggagacaacuaa

SEQ ID NO: 41010 - RNA, 64 nt, Homo Sapiens
aaaaaaaaaaaaaaaaaauauauauauauauauacacacacacacacacauauguacacauaca

SEQ ID NO: 41011 - RNA, 64 nt, Homo Sapiens
aaaaaaaaaaaaaaaauauauauauauauauacacacacacacacacauauguacacauacaua

SEQ ID NO: 41012 - RNA, 64 nt, Homo Sapiens
aaaaaaaaaaaaaauauauauauauauauacacacacacacacacauauguacacauacauaua

SEQ ID NO: 41013 - RNA, 64 nt, Homo Sapiens
aaaaaaaaaaaauauauauauauauauacacacacacacacacauauguacacauacauauaua

SEQ ID NO: 41014 - RNA, 64 nt, Homo Sapiens
aaaaaaaaaauauauauauauauauacacacacacacacacauauguacacauacauauauaua

SEQ ID NO: 41015 - RNA, 64 nt, Homo Sapiens
aauauauauguguauauguauacacauauauauacacacacacauauauauauuuagaaacgug

SEQ ID NO: 41016 - RNA, 64 nt, Homo Sapiens
uauauauguguauauguauacacauauauauacacacacacauauauauauuuagaaacgugag

SEQ ID NO: 41017 - RNA, 64 nt, Homo Sapiens
ggacugcaaauuauccuucugccugccccugugacacacacacacacacacacacacacacaca

SEQ ID NO: 41018 - RNA, 64 nt, Homo Sapiens
acugcaaauuauccuucugccugccccugugacacacacacacacacacacacacacacacaaa

SEQ ID NO: 41019 - RNA, 64 nt, Homo Sapiens
ugcaaauuauccuucugccugccccugugacacacacacacacacacacacacacacacaaaca

SEQ ID NO: 41020 - RNA, 64 nt, Homo Sapiens
caaauuauccuucugccugccccugugacacacacacacacacacacacacacacacaaacaau

SEQ ID NO: 41021 - RNA, 64 nt, Homo Sapiens
aauuauccuucugccugccccugugacacacacacacacacacacacacacacacaaacaaucc

SEQ ID NO: 41022 - RNA, 64 nt, Homo Sapiens
uuauccuucugccugccccugugacacacacacacacacacacacacacacacaaacaauccag

SEQ ID NO: 41023 - RNA, 64 nt, Homo Sapiens
auccuucugccugccccugugacacacacacacacacacacacacacacacaaacaauccagug

SEQ ID NO: 41024 - RNA, 64 nt, Homo Sapiens
ccuucugccugccccugugacacacacacacacacacacacacacacacaaacaauccaguguu

SEQ ID NO: 41025 - RNA, 64 nt, Homo Sapiens
uucugccugccccugugacacacacacacacacacacacacacacacaaacaauccaguguuuu

SEQ ID NO: 41026 - RNA, 64 nt, Homo Sapiens
cugccugccccugugacacacacacacacacacacacacacacacaaacaauccaguguuuugu

SEQ ID NO: 41027 - RNA, 64 nt, Homo Sapiens
gccugccccugugacacacacacacacacacacacacacacacaaacaauccaguguuuuguca

SEQ ID NO: 41028 - RNA, 64 nt, Homo Sapiens
cugccccugugacacacacacacacacacacacacacacacaaacaauccaguguuuugucaug

SEQ ID NO: 41029 - RNA, 64 nt, Homo Sapiens
ugggaaaacgggcaaaauaauugugcuggauucucacacacacagaaauaucgaccaucacccu

SEQ ID NO: 41030 - RNA, 64 nt, Homo Sapiens
ggaaaacgggcaaaauaauugugcuggauucucacacacacagaaauaucgaccaucacccucc

SEQ ID NO: 41031 - RNA, 64 nt, Homo Sapiens
aacguguacacaagugugagcuccuacacgcauacacacacacacguguacaugcaccaaagca

SEQ ID NO: 41032 - RNA, 64 nt, Homo Sapiens
cguguacacaagugugagcuccuacacgcauacacacacacacguguacaugcaccaaagcaug

SEQ ID NO: 41033 - RNA, 64 nt, Homo Sapiens
gcagagagacguaugagcuucuacugcacacaugcacacacacacgcacacguacauucacuac

SEQ ID NO: 41034 - RNA, 64 nt, Homo Sapiens
agagagacguaugagcuucuacugcacacaugcacacacacacgcacacguacauucacuacaa

SEQ ID NO: 41035 - RNA, 64 nt, Homo Sapiens
ugcgcaggcuccugcaggcgugaauacacacaugcacacacauauacacacaugugccacaaac

SEQ ID NO: 41036 - RNA, 64 nt, Homo Sapiens
cuggagacaguagaggcaugaacacacauggaugcacacacacacacgccaaugcacacacaca

SEQ ID NO: 41037 - RNA, 64 nt, Homo Sapiens
ggagacaguagaggcaugaacacacauggaugcacacacacacacgccaaugcacacacacaga

SEQ ID NO: 41038 - RNA, 64 nt, Homo Sapiens
agacaguagaggcaugaacacacauggaugcacacacacacacgccaaugcacacacacagaga

SEQ ID NO: 41039 - RNA, 64 nt, Homo Sapiens
aacacacauggaugcacacacacacacgccaaugcacacacacagagauaugcacacacacgga

SEQ ID NO: 41040 - RNA, 64 nt, Homo Sapiens
cacacauggaugcacacacacacacgccaaugcacacacacagagauaugcacacacacggaug

SEQ ID NO: 41041 - RNA, 64 nt, Homo Sapiens
cacacacacgccaaugcacacacacagagauaugcacacacacggaugcacacacagaugguca

SEQ ID NO: 41042 - RNA, 64 nt, Homo Sapiens
ugcacacacacagagauaugcacacacacggaugcacacacagauggucacacagagauacgca

SEQ ID NO: 41043 - RNA, 64 nt, Homo Sapiens
caaacacaccgaugcacacgcacauagagauaugcacacacagaugcacacacagauauacaca

SEQ ID NO: 41044 - RNA, 64 nt, Homo Sapiens
ugcacacgcacauagagauaugcacacacagaugcacacacagauauacacauggaugcacgca

SEQ ID NO: 41045 - RNA, 64 nt, Homo Sapiens
cggaugcacagagauaugcacacaccgaugugcgcacacacagauaugcacacacauggaugag

SEQ ID NO: 41046 - RNA, 64 nt, Homo Sapiens
uaugcacacaccgaugugcgcacacacagauaugcacacacauggaugagcacacacacaccaa

SEQ ID NO: 41047 - RNA, 64 nt, Homo Sapiens
ugcgcacacacagauaugcacacacauggaugagcacacacacaccaaugcgcacacacaccga

SEQ ID NO: 41048 - RNA, 64 nt, Homo Sapiens
cgcacacacagauaugcacacacauggaugagcacacacacaccaaugcgcacacacaccgaug

SEQ ID NO: 41049 - RNA, 64 nt, Homo Sapiens
cacacacauggaugagcacacacacaccaaugcgcacacacaccgauguacacacacagaugca

SEQ ID NO: 41050 - RNA, 64 nt, Homo Sapiens
cacacacacaccaaugcgcacacacaccgauguacacacacagaugcacacacagaugcacaca

SEQ ID NO: 41051 - RNA, 64 nt, Homo Sapiens
aaugcgcacacacaccgauguacacacacagaugcacacacagaugcacacacaccgaugcuga

SEQ ID NO: 41052 - RNA, 64 nt, Homo Sapiens
caccgauguacacacacagaugcacacacagaugcacacacaccgaugcugacuccaugugugc

SEQ ID NO: 41053 - RNA, 64 nt, Homo Sapiens
cugacugucuuuauugcagacacauacacacacacacacacacuaucacacacacacucacacu

SEQ ID NO: 41054 - RNA, 64 nt, Homo Sapiens
cucugacugucuuuauugcacucacauacacacacacacacacaacaucacacacacacucaca

SEQ ID NO: 41055 - RNA, 64 nt, Homo Sapiens
cacucugacugucuuuauugcacucacauacacacacacacacaguacaucacacacacacuca

SEQ ID NO: 41056 - RNA, 64 nt, Homo Sapiens
cacacucugacugucuuuaucacacucacauacacacacacacaauguacaucacacacacacu

SEQ ID NO: 41057 - RNA, 64 nt, Homo Sapiens
cacacacucugacugucuuucucacacucacauacacacacacauaauguacaucacacacaca

SEQ ID NO: 41058 - RNA, 64 nt, Homo Sapiens
cacacucacauacacacacauuuaauguacaucacacacacacucacugugcccagcccuaacu

SEQ ID NO: 41059 - RNA, 64 nt, Homo Sapiens
cucacacucacauacacacacuuuuaauguacaucacacacacagccacugugcccagcccuaa

SEQ ID NO: 41060 - RNA, 64 nt, Homo Sapiens
cuuuauugcagaagacagugcacacacacacacacacacacagugagacacacacacacacaca

SEQ ID NO: 41061 - RNA, 64 nt, Homo Sapiens
gucuuuauugcagaagacagcacacacacacacacacacacacagugagacacacacacacaca

SEQ ID NO: 41062 - RNA, 64 nt, Homo Sapiens
cagucuuuauugcagaagaccacacacacacacacacacacacagcgugagacacacacacaca

SEQ ID NO: 41063 - RNA, 64 nt, Homo Sapiens
cacagucuuuauugcagaagcacacacacacacacacacacacaaggcgugagacacacacaca

SEQ ID NO: 41064 - RNA, 64 nt, Homo Sapiens
cacacagucuuuauugcagacacacacacacacacacacacacaauaggcgugagacacacaca

SEQ ID NO: 41065 - RNA, 64 nt, Homo Sapiens
cacacacagucuuuauugcacacacacacacacacacacacacauuauaggcgugagacacaca

SEQ ID NO: 41066 - RNA, 64 nt, Homo Sapiens
cacacacacagucuuuauugcacacacacacacacacacacacaccuuauaggcgugagacaca

SEQ ID NO: 41067 - RNA, 64 nt, Homo Sapiens
cacacacacacagucuuuaucacacacacacacacacacacacaugccuuauaggcgugagaca

SEQ ID NO: 41068 - RNA, 64 nt, Homo Sapiens
cacacacacacacagucuuucacacacacacacacacacacacaguugccuuauaggcgugaga

SEQ ID NO: 41069 - RNA, 64 nt, Homo Sapiens
cacacacacacacacagucugacacacacacacacacacacacaguguugccuuauaggcguga

SEQ ID NO: 41070 - RNA, 64 nt, Homo Sapiens
cacacacacacacacacagugagacacacacacacacacacacaguguguugccuuauaggcgu

SEQ ID NO: 41071 - RNA, 64 nt, Homo Sapiens
cacacacacacacacacacagugagacacacacacacacacacacaguguguugccuuauaggc

SEQ ID NO: 41072 - RNA, 64 nt, Homo Sapiens
cacacacacacacacacacagcgugagacacacacacacacacagacaguguguugccuuauag

SEQ ID NO: 41073 - RNA, 64 nt, Homo Sapiens
cacacacacacacacacacaaggcgugagacacacacacacacaaagacaguguguugccuuau

SEQ ID NO: 41074 - RNA, 64 nt, Homo Sapiens
cacacacacacacacacacaauaggcgugagacacacacacacaagaagacaguguguugccuu

SEQ ID NO: 41075 - RNA, 64 nt, Homo Sapiens
cacacacacacacacacacauuauaggcgugagacacacacacagcagaagacaguguguugcc

SEQ ID NO: 41076 - RNA, 64 nt, Homo Sapiens
gucuuuauugcagaagacaguacacacacauacacacacacagaaggcgugagacagacacaca

SEQ ID NO: 41077 - RNA, 64 nt, Homo Sapiens
gagucuuuauugcagaagaccauacacacacauacacacacacaacaggcgugagacagacaca

SEQ ID NO: 41078 - RNA, 64 nt, Homo Sapiens
cacacacacagagucuuuaugacagacacacauacacacacauaugcuaggauuacaggcguga

SEQ ID NO: 41079 - RNA, 64 nt, Homo Sapiens
auuucagaagacaguguguucacacacacacacacacacacacucacacacacacacacacaca

SEQ ID NO: 41080 - RNA, 64 nt, Homo Sapiens
cuauuucagaagacagugugcacacacacacacacacacacacacacacacacacacacacaca

SEQ ID NO: 41081 - RNA, 64 nt, Homo Sapiens
cacuauuucagaagacagugcacacacacacacacacacacacacacacacacacacacacaca

SEQ ID NO: 41082 - RNA, 64 nt, Homo Sapiens
cacacuauuucagaagacagcacacacacacacacacacacacacacacacacacacacacaca

SEQ ID NO: 41083 - RNA, 64 nt, Homo Sapiens
cacacacuauuucagaagaccacacacacacacacacacacacacacacacacacacacacaca

SEQ ID NO: 41084 - RNA, 64 nt, Homo Sapiens
cacacacacuauuucagaagcacacacacacacacacacacacacacacacacacacacacaca

SEQ ID NO: 41085 - RNA, 64 nt, Homo Sapiens
cacacacacacuauuucagacacacacacacacacacacacacacacacacacacacacacaca

SEQ ID NO: 41086 - RNA, 64 nt, Homo Sapiens
cacacacacacacuauuucacacacacacacacacacacacacacacacacacacacacacaca

SEQ ID NO: 41087 - RNA, 64 nt, Homo Sapiens
cacacacacacacacuauuucacacacacacacacacacacacaaacacacacacacacacaca

SEQ ID NO: 41088 - RNA, 64 nt, Homo Sapiens
cacacacacacacacacuaucacacacacacacacacacacacaacaacacacacacacacaca

SEQ ID NO: 41089 - RNA, 64 nt, Homo Sapiens
cacacacacacacacacacucacacacacacacacacacacacaauacaacacacacacacaca

SEQ ID NO: 41090 - RNA, 64 nt, Homo Sapiens
cacacacacacacacacacacacacacacacacacacacacacaauauacaacacacacacaca

SEQ ID NO: 41091 - RNA, 64 nt, Homo Sapiens
cacacacacacacacacacacacacacacacacacacacacacauaauauacaacacacacaca

SEQ ID NO: 41092 - RNA, 64 nt, Homo Sapiens
cacacacacacacacacacacacacacacacacacacacacacauuuaauauacaacacacaca

SEQ ID NO: 41093 - RNA, 64 nt, Homo Sapiens
cacacacacacacacacacacacacacacacacacacacacacacuuuuaauauacaacacaca

SEQ ID NO: 41094 - RNA, 64 nt, Homo Sapiens
cacacacacacacacacacacacacacacacacacacacacacaaacuuuuaauauacaacaca

SEQ ID NO: 41095 - RNA, 64 nt, Homo Sapiens
cacacacacacacacacacacacacacacacacacacacacacacuaacuuuuaauauacaaca

SEQ ID NO: 41096 - RNA, 64 nt, Homo Sapiens
cacacacacacacacacacacacacacacacacacacacacacacccuaacuuuuaauauacaa

SEQ ID NO: 41097 - RNA, 64 nt, Homo Sapiens
cacacacacacacacacacaaacacacacacacacacacacacaggcccuaacuuuuaauauac

SEQ ID NO: 41098 - RNA, 64 nt, Homo Sapiens
cacacacacacacacacacaacaacacacacacacacacacacacuggcccuaacuuuuaauau

SEQ ID NO: 41099 - RNA, 64 nt, Homo Sapiens
cacacacacacacacacacaauacaacacacacacacacacacaaccuggcccuaacuuuuaau

SEQ ID NO: 41100 - RNA, 64 nt, Homo Sapiens
cacacacacacacacacacaauauacaacacacacacacacacagcaccuggcccuaacuuuua

SEQ ID NO: 41101 - RNA, 64 nt, Homo Sapiens
cacacacacacacacacacauaauauacaacacacacacacacaccgcaccuggcccuaacuuu

SEQ ID NO: 41102 - RNA, 64 nt, Homo Sapiens
cacacacacacacacacacauuuaauauacaacacacacacacacaccgcaccuggcccuaacu

SEQ ID NO: 41103 - RNA, 64 nt, Homo Sapiens
cacacacacacacacacacacuuuuaauauacaacacacacacauccaccgcaccuggcccuaa

SEQ ID NO: 41104 - RNA, 64 nt, Homo Sapiens
aaaucuacauauacaaacaacacacacacacacacacacacaacaacacacacacacacacaca

SEQ ID NO: 41105 - RNA, 64 nt, Homo Sapiens
acaaaucuacauauacaaaccacacacacacacacacacacacaacaacacacacacacacaca

SEQ ID NO: 41106 - RNA, 64 nt, Homo Sapiens
cacacacaacaaaucuacaucacacacacacacacacacacacaguacaacacacacacacaca

SEQ ID NO: 41107 - RNA, 64 nt, Homo Sapiens
cacacacacaacaaaucuaccacacacacacacacacacacacaauguacaacacacacacaca

SEQ ID NO: 41108 - RNA, 64 nt, Homo Sapiens
cacacacacacaacaaaucucacacacacacacacacacacacauaauguacaacacacacaca

SEQ ID NO: 41109 - RNA, 64 nt, Homo Sapiens
cacacacacacacaacaaaucacacacacacacacacacacacaguuaauguacaacacacaca

SEQ ID NO: 41110 - RNA, 64 nt, Homo Sapiens
cacacacacacacacaacaacacacacacacacacacacacacauuguuaauguacaacacaca

SEQ ID NO: 41111 - RNA, 64 nt, Homo Sapiens
cacacacacacacacacaaccacacacacacacacacacacacauauuguuaauguacaacaca

SEQ ID NO: 41112 - RNA, 64 nt, Homo Sapiens
cacacacacacacacacacacacacacacacacacacacacacaaguauuguuaauguacaaca

SEQ ID NO: 41113 - RNA, 64 nt, Homo Sapiens
cacacacacacacacacacacacacacacacacacacacacacaagaguauuguuaauguacaa

SEQ ID NO: 41114 - RNA, 64 nt, Homo Sapiens
cacacacacacacacacacaaacacacacacacacacacacacaacagaguauuguuaauguac

SEQ ID NO: 41115 - RNA, 64 nt, Homo Sapiens
cacacacacacacacacacaacaacacacacacacacacacacaccacagaguauuguuaaugu

SEQ ID NO: 41116 - RNA, 64 nt, Homo Sapiens
cacacacacacacacacacaguacaacacacacacacacacacauuccacagaguauuguuaau

SEQ ID NO: 41117 - RNA, 64 nt, Homo Sapiens
cacacacacacacacacacaauguacaacacacacacacacacauauuccacagaguauuguua

SEQ ID NO: 41118 - RNA, 64 nt, Homo Sapiens
cacacacacacacacacacauaauguacaacacacacacacacaucuauuccacagaguauugu

SEQ ID NO: 41119 - RNA, 64 nt, Homo Sapiens
cacacacacacacacacacaguuaauguacaacacacacacacauuucuauuccacagaguauu

SEQ ID NO: 41120 - RNA, 64 nt, Homo Sapiens
cacacacacacacacacacauuguuaauguacaacacacacacauguuucuauuccacagagua

SEQ ID NO: 41121 - RNA, 64 nt, Homo Sapiens
aaauguuuauuaauagucauucaguccaacaaaccacacacaguaauacacguaugguuaaugu

SEQ ID NO: 41122 - RNA, 64 nt, Homo Sapiens
uaacugccaaaauacauugauaaaaagcacacaccacacacagcuguuuuauugagugaagccu

SEQ ID NO: 41123 - RNA, 64 nt, Homo Sapiens
ggaaugcuauuaagccuuaacaaaaugcgauacacacacacaauuggauggaugaauggacaaa

SEQ ID NO: 41124 - RNA, 64 nt, Homo Sapiens
auggaaugcuauuaagccuuaacaaaaugcgauacacacacacacauggauggaugaauggaca

SEQ ID NO: 41125 - RNA, 64 nt, Homo Sapiens
guuuuacuccuuuuuuuaaaaacacaugcgcgcgcacacacacaugcuuuacaaguuuuauuau

SEQ ID NO: 41126 - RNA, 64 nt, Homo Sapiens
uuuacuccuuuuuuuaaaaacacaugcgcgcgcacacacacaugcuuuacaaguuuuauuauaa

SEQ ID NO: 41127 - RNA, 64 nt, Homo Sapiens
aguuuauguucuacugaaagaggacguguguauacacacacacacacacacacacacacagauu

SEQ ID NO: 41128 - RNA, 64 nt, Homo Sapiens
uuuauguucuacugaaagaggacguguguauacacacacacacacacacacacacacagauugg

SEQ ID NO: 41129 - RNA, 64 nt, Homo Sapiens
uauguucuacugaaagaggacguguguauacacacacacacacacacacacacacagauuggua

SEQ ID NO: 41130 - RNA, 64 nt, Homo Sapiens
uguucuacugaaagaggacguguguauacacacacacacacacacacacacacagauugguaua

SEQ ID NO: 41131 - RNA, 64 nt, Homo Sapiens
uucuacugaaagaggacguguguauacacacacacacacacacacacacacagauugguauaau

SEQ ID NO: 41132 - RNA, 64 nt, Homo Sapiens
cuacugaaagaggacguguguauacacacacacacacacacacacacacagauugguauaaugg

SEQ ID NO: 41133 - RNA, 64 nt, Homo Sapiens
acugaaagaggacguguguauacacacacacacacacacacacacacagauugguauaauggag

SEQ ID NO: 41134 - RNA, 64 nt, Homo Sapiens
ugaaagaggacguguguauacacacacacacacacacacacacacagauugguauaauggagaa

SEQ ID NO: 41135 - RNA, 64 nt, Homo Sapiens
aaagaggacguguguauacacacacacacacacacacacacacagauugguauaauggagaaga

SEQ ID NO: 41136 - RNA, 64 nt, Homo Sapiens
agaggacguguguauacacacacacacacacacacacacacagauugguauaauggagaagaug

SEQ ID NO: 41137 - RNA, 64 nt, Homo Sapiens
acgacucugguggggaaaaccguuuuuuaaaggacacacacacacacagcgaugcaucucucuc

SEQ ID NO: 41138 - RNA, 64 nt, Homo Sapiens
gacucugguggggaaaaccguuuuuuaaaggacacacacacacacagcgaugcaucucucucua

SEQ ID NO: 41139 - RNA, 64 nt, Homo Sapiens
cucugguggggaaaaccguuuuuuaaaggacacacacacacacagcgaugcaucucucucuaaa

SEQ ID NO: 41140 - RNA, 64 nt, Homo Sapiens
cugguggggaaaaccguuuuuuaaaggacacacacacacacagcgaugcaucucucucuaaagc

SEQ ID NO: 41141 - RNA, 64 nt, Homo Sapiens
uuuaaaaacaaauaaaugaauaaagcugcugugacacacacacaaaaggaauuuaauaguauaa

SEQ ID NO: 41142 - RNA, 64 nt, Homo Sapiens
uaaaaacaaauaaaugaauaaagcugcugugacacacacacaaaaggaauuuaauaguauaaua

SEQ ID NO: 41143 - RNA, 64 nt, Homo Sapiens
gaucccuguuucccaacugaaaggugugaacggacacacacacagccuggaugacgccuuggcu

SEQ ID NO: 41144 - RNA, 64 nt, Homo Sapiens
ucccuguuucccaacugaaaggugugaacggacacacacacagccuggaugacgccuuggcugu

SEQ ID NO: 41145 - RNA, 64 nt, Homo Sapiens
ccugucauucccaccacccugaggccccaaccgccacacacacaggagcauuuggagagaaggc

SEQ ID NO: 41146 - RNA, 64 nt, Homo Sapiens
ugucauucccaccacccugaggccccaaccgccacacacacaggagcauuuggagagaaggcca

SEQ ID NO: 41147 - RNA, 64 nt, Homo Sapiens
uuugccaagcucaauaauggacaaaggauacaaacacacacacaucuacuauuuuagauaaaug

SEQ ID NO: 41148 - RNA, 64 nt, Homo Sapiens
ugccaagcucaauaauggacaaaggauacaaacacacacacaucuacuauuuuagauaaaugua

SEQ ID NO: 41149 - RNA, 64 nt, Homo Sapiens
gauuuuucuuccuuaaacuugaacaccaaaaaaacacacacacacacacacguggggauagcug

SEQ ID NO: 41150 - RNA, 64 nt, Homo Sapiens
uuuuucuuccuuaaacuugaacaccaaaaaaacacacacacacacacacguggggauagcugga

SEQ ID NO: 41151 - RNA, 64 nt, Homo Sapiens
uuucuuccuuaaacuugaacaccaaaaaaacacacacacacacacacguggggauagcuggaca

SEQ ID NO: 41152 - RNA, 64 nt, Homo Sapiens
ucuuccuuaaacuugaacaccaaaaaaacacacacacacacacacguggggauagcuggacaug

SEQ ID NO: 41153 - RNA, 64 nt, Homo Sapiens
uuccuuaaacuugaacaccaaaaaaacacacacacacacacacguggggauagcuggacauguc

SEQ ID NO: 41154 - RNA, 64 nt, Homo Sapiens
cucucucuugucucucugucgguguguucaugcacacacacacugcccaguguaugcaugugug

SEQ ID NO: 41155 - RNA, 64 nt, Homo Sapiens
cucucucucuugucucucuguggguguguucaugcacacacacauagcccaguguaugcaugug

SEQ ID NO: 41156 - RNA, 64 nt, Homo Sapiens
aggguuccaggacuuucugaagucugagcuuaggcacacacaggggccuuuuucccaugugugc

SEQ ID NO: 41157 - RNA, 64 nt, Homo Sapiens
uuaucccaugauguuccacuuacacauacaugcacacacacacguccccauccccauaaaugca

SEQ ID NO: 41158 - RNA, 64 nt, Homo Sapiens
cguuaucccaugauguuccacauacacauacaugcacacacacagcuccccauccccauaaaug

SEQ ID NO: 41159 - RNA, 64 nt, Homo Sapiens
auauauccuugguucuaucuacaugucugccuaccacacacaaauuggcacccugauuauucau

SEQ ID NO: 41160 - RNA, 64 nt, Homo Sapiens
gauccuccuccucagcuccuccaauccccacagacacacacauucagcagaguccugccuccuc

SEQ ID NO: 41161 - RNA, 64 nt, Homo Sapiens
uuuuuccucaaucauuugaauguacacacacacacacacacaaauuuaucuuucaugcuuucuc

SEQ ID NO: 41162 - RNA, 64 nt, Homo Sapiens
aauuuuuccucaaucauuugucuguacacacacacacacacacagcuuuaucuuucaugcuuuc

SEQ ID NO: 41163 - RNA, 64 nt, Homo Sapiens
caaauuuuuccucaaucauuucucuguacacacacacacacacagugcuuuaucuuucaugcuu

SEQ ID NO: 41164 - RNA, 64 nt, Homo Sapiens
cacaaauuuuuccucaaucauuucucuguacacacacacacacaacgugcuuuaucuuucaugc

SEQ ID NO: 41165 - RNA, 64 nt, Homo Sapiens
cacacaaauuuuuccucaaugcuuucucuguacacacacacacaauacgugcuuuaucuuucau

SEQ ID NO: 41166 - RNA, 64 nt, Homo Sapiens
cacacacaaauuuuuccucaaugcuuucucuguacacacacacaucauacgugcuuuaucuuuc

SEQ ID NO: 41167 - RNA, 64 nt, Homo Sapiens
uucccauccacucacccacacaccacauacaccacacacacacgauauacacaccacacacaca

SEQ ID NO: 41168 - RNA, 64 nt, Homo Sapiens
cguucccauccacucacccacacaccacauacaccacacacacaagauauacacaccacacaca

SEQ ID NO: 41169 - RNA, 64 nt, Homo Sapiens
acauacaccacacacacacgauauacacaccacacacacacacccaguccuugaggauagacag

SEQ ID NO: 41170 - RNA, 64 nt, Homo Sapiens
ccacauacaccacacacacaagauauacacaccacacacacacaggcaguccuugaggauagac

SEQ ID NO: 41171 - RNA, 64 nt, Homo Sapiens
caccacauacaccacacacaacagauauacacaccacacacacacaggcaguccuugaggauag

SEQ ID NO: 41172 - RNA, 64 nt, Homo Sapiens
aagaugaauguaauuauuauaaacagaacuggcacacacacauugaguuuuccaauguuaaugu

SEQ ID NO: 41173 - RNA, 64 nt, Homo Sapiens
uuaagaugaauguaauuauuguaaacagaacuggcacacacacauggaguuuuccaauguuaau

SEQ ID NO: 41174 - RNA, 64 nt, Homo Sapiens
aaggagagagagagaaaacucacacacacacacacacacacacgcgcacacacacacacacaca

SEQ ID NO: 41175 - RNA, 64 nt, Homo Sapiens
cgaaggagagagagagaaaacacacacacacacacacacacacacacgcacacacacacacaca

SEQ ID NO: 41176 - RNA, 64 nt, Homo Sapiens
cacgaaggagagagagagaacacacacacacacacacacacacacgcacgcacacacacacaca

SEQ ID NO: 41177 - RNA, 64 nt, Homo Sapiens
cacacgaaggagagagagagcacacacacacacacacacacacacacgcacgcacacacacaca

SEQ ID NO: 41178 - RNA, 64 nt, Homo Sapiens
cacacacgaaggagagagagcacacacacacacacacacacacaugcacgcacgcacacacaca

SEQ ID NO: 41179 - RNA, 64 nt, Homo Sapiens
cacacacacgaaggagagagcacacacacacacacacacacacaugugcacgcacgcacacaca

SEQ ID NO: 41180 - RNA, 64 nt, Homo Sapiens
cacacacacacgaaggagagcacacacacacacacacacacacaccugugcacgcacgcacaca

SEQ ID NO: 41181 - RNA, 64 nt, Homo Sapiens
cacacacacacacgaaggagcacacacacacacacacacacacagcccugugcacgcacgcaca

SEQ ID NO: 41182 - RNA, 64 nt, Homo Sapiens
cacacacacacacacgaaggcacacacacacacacacacacacauggcccugugcacgcacgca

SEQ ID NO: 41183 - RNA, 64 nt, Homo Sapiens
cacacacacacacacacgaacacacacacacacacacacacacaauuggcccugugcacgcacg

SEQ ID NO: 41184 - RNA, 64 nt, Homo Sapiens
cacacacacacacacacacgcgcacacacacacacacacacacaagauuggcccugugcacgca

SEQ ID NO: 41185 - RNA, 64 nt, Homo Sapiens
cacacacacacacacacacacacgcacacacacacacacacacagaagauuggcccugugcacg

SEQ ID NO: 41186 - RNA, 64 nt, Homo Sapiens
cacacacacacacacacacacgcacgcacacacacacacacacacugaagauuggcccugugca

SEQ ID NO: 41187 - RNA, 64 nt, Homo Sapiens
cacacacacacacacacacacacgcacgcacacacacacacacagccugaagauuggcccugug

SEQ ID NO: 41188 - RNA, 64 nt, Homo Sapiens
cacacacacacacacacacaugcacgcacgcacacacacacacaaagccugaagauuggcccug

SEQ ID NO: 41189 - RNA, 64 nt, Homo Sapiens
cacacacacacacacacacaugugcacgcacgcacacacacacaauaagccugaagauuggccc

SEQ ID NO: 41190 - RNA, 64 nt, Homo Sapiens
cacacacacacacacacacaccugugcacgcacgcacacacacaccauaagccugaagauuggc

SEQ ID NO: 41191 - RNA, 64 nt, Homo Sapiens
uuugaucaucggaaggagcagcauugcucagaaacacacacacacacacacacacuugacuuuc

SEQ ID NO: 41192 - RNA, 64 nt, Homo Sapiens
ugaucaucggaaggagcagcauugcucagaaacacacacacacacacacacacuugacuuucuu

SEQ ID NO: 41193 - RNA, 64 nt, Homo Sapiens
aucaucggaaggagcagcauugcucagaaacacacacacacacacacacacuugacuuucuugu

SEQ ID NO: 41194 - RNA, 64 nt, Homo Sapiens
caucggaaggagcagcauugcucagaaacacacacacacacacacacacuugacuuucuugucu

SEQ ID NO: 41195 - RNA, 64 nt, Homo Sapiens
ucggaaggagcagcauugcucagaaacacacacacacacacacacacuugacuuucuugucugc

SEQ ID NO: 41196 - RNA, 64 nt, Homo Sapiens
ggaaggagcagcauugcucagaaacacacacacacacacacacacuugacuuucuugucugcca

SEQ ID NO: 41197 - RNA, 64 nt, Homo Sapiens
aaggagcagcauugcucagaaacacacacacacacacacacacuugacuuucuugucugccaaa

SEQ ID NO: 41198 - RNA, 64 nt, Homo Sapiens
gaugagaucacacgcaugcacgugcacacauguacacacacacaccuaccugcacagcacgcug

SEQ ID NO: 41199 - RNA, 64 nt, Homo Sapiens
ugagaucacacgcaugcacgugcacacauguacacacacacaccuaccugcacagcacgcuguu

SEQ ID NO: 41200 - RNA, 64 nt, Homo Sapiens
cagcucugcucaacugcgucuucucucagcccuccacacacacucacccccacucccacacaca

SEQ ID NO: 41201 - RNA, 64 nt, Homo Sapiens
cucucagcccuccacacacacucacccccacucccacacacauacacacacacacacacauacc

SEQ ID NO: 41202 - RNA, 64 nt, Homo Sapiens
uccacacacacucacccccacucccacacacauacacacacacacacacauaccccaucucccg

SEQ ID NO: 41203 - RNA, 64 nt, Homo Sapiens
cacacacacucacccccacucccacacacauacacacacacacacacauaccccaucucccgag

SEQ ID NO: 41204 - RNA, 64 nt, Homo Sapiens
cacacacucacccccacucccacacacauacacacacacacacacauaccccaucucccgaggg

SEQ ID NO: 41205 - RNA, 64 nt, Homo Sapiens
cacacucacccccacucccacacacauacacacacacacacacauaccccaucucccgagggcu

SEQ ID NO: 41206 - RNA, 64 nt, Homo Sapiens
cacucacccccacucccacacacauacacacacacacacacauaccccaucucccgagggcuga

SEQ ID NO: 41207 - RNA, 64 nt, Homo Sapiens
aaaaaaagguuccaaaaaaaaccaaaacucaguacacacacacaggcacagaugcacacacacg

SEQ ID NO: 41208 - RNA, 64 nt, Homo Sapiens
aaaaagguuccaaaaaaaaccaaaacucaguacacacacacaggcacagaugcacacacacgca

SEQ ID NO: 41209 - RNA, 64 nt, Homo Sapiens
accaaaacucaguacacacacacaggcacagaugcacacacacgcagacagacacaccgacuuu

SEQ ID NO: 41210 - RNA, 64 nt, Homo Sapiens
auuuuauaaacuaugcacaugcauuacacacaugcacacacauaugcacacacaugugcaaaca

SEQ ID NO: 41211 - RNA, 64 nt, Homo Sapiens
augcacaugcauuacacacaugcacacacauaugcacacacaugugcaaacauagccacuuuuu

SEQ ID NO: 41212 - RNA, 64 nt, Homo Sapiens
uauacauacgcaauuguauagacacacaagcagacacacacauauuuauaccuguacacacaca

SEQ ID NO: 41213 - RNA, 64 nt, Homo Sapiens
cacacaagcagacacacacauuuuuauaccuguacacacacagaauauuacucugccugucaag

SEQ ID NO: 41214 - RNA, 64 nt, Homo Sapiens
ccgagcagcugucucggguccacacacacacacacacacacacgcacacacacacacacacaca

SEQ ID NO: 41215 - RNA, 64 nt, Homo Sapiens
cgccgagcagcugucucgggcacacacacacacacacacacacacacacacacacacacacaca

SEQ ID NO: 41216 - RNA, 64 nt, Homo Sapiens
cacgccgagcagcugucucgcacacacacacacacacacacacacacacacacacacacacaca

SEQ ID NO: 41217 - RNA, 64 nt, Homo Sapiens
cacacgccgagcagcugucucacacacacacacacacacacacacacacacacacacacacaca

SEQ ID NO: 41218 - RNA, 64 nt, Homo Sapiens
cacacacgccgagcagcugucacacacacacacacacacacacacacacacacacacacacaca

SEQ ID NO: 41219 - RNA, 64 nt, Homo Sapiens
cacacacacgccgagcagcucacacacacacacacacacacacacacacacacacacacacaca

SEQ ID NO: 41220 - RNA, 64 nt, Homo Sapiens
cacacacacacgccgagcagcacacacacacacacacacacacacacacacacacacacacaca

SEQ ID NO: 41221 - RNA, 64 nt, Homo Sapiens
cacacacacacacgccgagccacacacacacacacacacacacacacacacacacacacacaca

SEQ ID NO: 41222 - RNA, 64 nt, Homo Sapiens
cacacacacacacacgccgacacacacacacacacacacacacacacacacacacacacacaca

SEQ ID NO: 41223 - RNA, 64 nt, Homo Sapiens
cacacacacacacacacgcccacacacacacacacacacacacacacacacacacacacacaca

SEQ ID NO: 41224 - RNA, 64 nt, Homo Sapiens
cacacacacacacacacacgcacacacacacacacacacacacauacacacacacacacacaca

SEQ ID NO: 41225 - RNA, 64 nt, Homo Sapiens
cacacacacacacacacacacacacacacacacacacacacacaauuacacacacacacacaca

SEQ ID NO: 41226 - RNA, 64 nt, Homo Sapiens
cacacacacacacacacacacacacacacacacacacacacacaaaauuacacacacacacaca

SEQ ID NO: 41227 - RNA, 64 nt, Homo Sapiens
cacacacacacacacacacacacacacacacacacacacacacaguaaauuacacacacacaca

SEQ ID NO: 41228 - RNA, 64 nt, Homo Sapiens
cacacacacacacacacacacacacacacacacacacacacacacaguaaauuacacacacaca

SEQ ID NO: 41229 - RNA, 64 nt, Homo Sapiens
cacacacacacacacacacacacacacacacacacacacacacaaacaguaaauuacacacaca

SEQ ID NO: 41230 - RNA, 64 nt, Homo Sapiens
cacacacacacacacacacacacacacacacacacacacacacaagaacaguaaauuacacaca

SEQ ID NO: 41231 - RNA, 64 nt, Homo Sapiens
cacacacacacacacacacacacacacacacacacacacacacagcagaacaguaaauuacaca

SEQ ID NO: 41232 - RNA, 64 nt, Homo Sapiens
cacacacacacacacacacacacacacacacacacacacacacacagcagaacaguaaauuaca

SEQ ID NO: 41233 - RNA, 64 nt, Homo Sapiens
cacacacacacacacacacacacacacacacacacacacacacaagcagcagaacaguaaauua

SEQ ID NO: 41234 - RNA, 64 nt, Homo Sapiens
cacacacacacacacacacauacacacacacacacacacacacagcagcagcagaacaguaaau

SEQ ID NO: 41235 - RNA, 64 nt, Homo Sapiens
cacacacacacacacacacaauuacacacacacacacacacacacagcagcagcagaacaguaa

SEQ ID NO: 41236 - RNA, 62 nt, Homo Sapiens
cacacacacacacacacacaauuacacacacacacacacacacagcagcagcagaacaguaa

SEQ ID NO: 41237 - RNA, 60 nt, Homo Sapiens
cacacacacacacacacacaauuacacacacacacacacacagcagcagcagaacaguaa

SEQ ID NO: 41238 - RNA, 58 nt, Homo Sapiens
cacacacacacacacacacaauuacacacacacacacacagcagcagcagaacaguaa

SEQ ID NO: 41239 - RNA, 56 nt, Homo Sapiens
cacacacacacacacacacaauuacacacacacacacagcagcagcagaacaguaa

SEQ ID NO: 41240 - RNA, 54 nt, Homo Sapiens
cacacacacacacacacacaauuacacacacacacagcagcagcagaacaguaa

SEQ ID NO: 41241 - RNA, 64 nt, Homo Sapiens
uggccccagguggggguuguuacacauacacacacacacacacccccucaugcaagggugcgug

SEQ ID NO: 41242 - RNA, 64 nt, Homo Sapiens
ccuggccccagguggggguuuguacacauacacacacacacacacucccucaugcaagggugcg

SEQ ID NO: 41243 - RNA, 64 nt, Homo Sapiens
caccuggccccaggugggggcguguacacauacacacacacacaaccucccucaugcaagggug

SEQ ID NO: 41244 - RNA, 64 nt, Homo Sapiens
cacaccuggccccaggugggugcguguacacauacacacacacauuaccucccucaugcaaggg

SEQ ID NO: 41245 - RNA, 64 nt, Homo Sapiens
cuucucucuuacguucauggcccagagggaacugcacacacagacucuguagcuggucucacug

SEQ ID NO: 41246 - RNA, 64 nt, Homo Sapiens
uuuccaaagugcagcaguguaacacacagagacacacacacacgcccccuaagugauagguuua

SEQ ID NO: 41247 - RNA, 64 nt, Homo Sapiens
cguuuccaaagugcagcaguuaaacacacagagacacacacacaugcccccuaagugauagguu

SEQ ID NO: 41248 - RNA, 64 nt, Homo Sapiens
gccucccauccuucccucaucacacacacacacacacacacacucacacacacacacacacaca

SEQ ID NO: 41249 - RNA, 64 nt, Homo Sapiens
cugccucccauccuucccuccacacacacacacacacacacacacacacacacacacacacaca

SEQ ID NO: 41250 - RNA, 64 nt, Homo Sapiens
cacugccucccauccuuccccacacacacacacacacacacacacacacacacacacacacaca

SEQ ID NO: 41251 - RNA, 64 nt, Homo Sapiens
cacacugccucccauccuuccacacacacacacacacacacacacacacacacacacacacaca

SEQ ID NO: 41252 - RNA, 64 nt, Homo Sapiens
cacacacugccucccauccucacacacacacacacacacacacacacacacacacacacacaca

SEQ ID NO: 41253 - RNA, 64 nt, Homo Sapiens
cacacacacugccucccauccacacacacacacacacacacacacacacacacacacacacaca

SEQ ID NO: 41254 - RNA, 64 nt, Homo Sapiens
cacacacacacugccucccacacacacacacacacacacacacacacacacacacacacacaca

SEQ ID NO: 41255 - RNA, 64 nt, Homo Sapiens
cacacacacacacugccucccacacacacacacacacacacacacacacacacacacacacaca

SEQ ID NO: 41256 - RNA, 64 nt, Homo Sapiens
cacacacacacacacugccucacacacacacacacacacacacacacacacacacacacacaca

SEQ ID NO: 41257 - RNA, 64 nt, Homo Sapiens
cacacacacacacacacugccacacacacacacacacacacacauacacacacacacacacaca

SEQ ID NO: 41258 - RNA, 64 nt, Homo Sapiens
cacacacacacacacacacucacacacacacacacacacacacaccuacacacacacacacaca

SEQ ID NO: 41259 - RNA, 64 nt, Homo Sapiens
cacacacacacacacacacacacacacacacacacacacacacaucccuacacacacacacaca

SEQ ID NO: 41260 - RNA, 64 nt, Homo Sapiens
cacacacacacacacacacacacacacacacacacacacacacaccucccuacacacacacaca

SEQ ID NO: 41261 - RNA, 64 nt, Homo Sapiens
cacacacacacacacacacacacacacacacacacacacacacaccccucccuacacacacaca

SEQ ID NO: 41262 - RNA, 64 nt, Homo Sapiens
cacacacacacacacacacacacacacacacacacacacacacaacccccucccuacacacaca

SEQ ID NO: 41263 - RNA, 64 nt, Homo Sapiens
cacacacacacacacacacacacacacacacacacacacacacaucacccccucccuacacaca

SEQ ID NO: 41264 - RNA, 64 nt, Homo Sapiens
cacacacacacacacacacacacacacacacacacacacacacauaucacccccucccuacaca

SEQ ID NO: 41265 - RNA, 64 nt, Homo Sapiens
cacacacacacacacacacacacacacacacacacacacacacauguaucacccccucccuaca

SEQ ID NO: 41266 - RNA, 64 nt, Homo Sapiens
cacacacacacacacacacacacacacacacacacacacacacaccuguaucacccccucccua

SEQ ID NO: 41267 - RNA, 64 nt, Homo Sapiens
cacacacacacacacacacauacacacacacacacacacacacaucccuguaucacccccuccc

SEQ ID NO: 41268 - RNA, 64 nt, Homo Sapiens
cacacacacacacacacacaccuacacacacacacacacacacaccucccuguaucacccccuc

SEQ ID NO: 41269 - RNA, 64 nt, Homo Sapiens
cacacacacacacacacacaucccuacacacacacacacacacaccccucccuguaucaccccc

SEQ ID NO: 41270 - RNA, 64 nt, Homo Sapiens
cacacacacacacacacacaccucccuacacacacacacacacacuccccucccuguaucaccc

SEQ ID NO: 41271 - RNA, 64 nt, Homo Sapiens
cacacacacacacacacacaccccucccuacacacacacacacagccuccccucccuguaucac

SEQ ID NO: 41272 - RNA, 64 nt, Homo Sapiens
cacacacacacacacacacaacccccucccuacacacacacacagagccuccccucccuguauc

SEQ ID NO: 41273 - RNA, 64 nt, Homo Sapiens
cacacacacacacacacacaucacccccucccuacacacacacagggagccuccccucccugua

SEQ ID NO: 41274 - RNA, 64 nt, Homo Sapiens
uuuaacuuguuuuuuuguaccacacacgcacacacacacacaauaccagcuuuacucucugaca

SEQ ID NO: 41275 - RNA, 64 nt, Homo Sapiens
auuuuaacuuguuuuuuugucacacacacgcacacacacacacaccaccagcuuuacucucuga

SEQ ID NO: 41276 - RNA, 64 nt, Homo Sapiens
caauuuuaacuuguuuuuuugacacacacacgcacacacacacaauccaccagcuuuacucucu

SEQ ID NO: 41277 - RNA, 64 nt, Homo Sapiens
cacaauuuuaacuuguuuuucugacacacacacgcacacacacaccauccaccagcuuuacucu

SEQ ID NO: 41278 - RNA, 64 nt, Homo Sapiens
cacacacacacacaauuuuagcuuuacucucugacacacacacguaccuuagugccauccacca

SEQ ID NO: 41279 - RNA, 64 nt, Homo Sapiens
uccuccauguuccugccacagguggaagaggacacacacacauccucuugucaggcuacagagu

SEQ ID NO: 41280 - RNA, 64 nt, Homo Sapiens
ucuccuccauguuccugccagugguggaagaggacacacacacauccucuugucaggcuacaga

SEQ ID NO: 41281 - RNA, 64 nt, Homo Sapiens
cucgugcacaggcacgcagaugcgcucacacguacacacacacaaaugcacgcccacuugcaca

SEQ ID NO: 41282 - RNA, 64 nt, Homo Sapiens
cgugcacaggcacgcagaugcgcucacacguacacacacacaaaugcacgcccacuugcacaug

SEQ ID NO: 41283 - RNA, 64 nt, Homo Sapiens
caccucucuccccccaugcaccucuccccaacaacacacacagcccccugcaccgcccgccccc

SEQ ID NO: 41284 - RNA, 64 nt, Homo Sapiens
ucaccacaugugcacaugcacgugugugcacguacacacacauacacacacacgcgugcacaca

SEQ ID NO: 41285 - RNA, 64 nt, Homo Sapiens
ugcacaugcacgugugugcacguacacacacauacacacacacgcgugcacacaccagagccca

SEQ ID NO: 41286 - RNA, 64 nt, Homo Sapiens
cugcauacacacucgcaacaugucuacacacguccacacacacagacacacagauaccccaaau

SEQ ID NO: 41287 - RNA, 64 nt, Homo Sapiens
gcauacacacucgcaacaugucuacacacguccacacacacagacacacagauaccccaaaucc

SEQ ID NO: 41288 - RNA, 64 nt, Homo Sapiens
cauuccucacugaaaaagaaaacacacacccacccacacacacacacacagaagaaaaugaaag

SEQ ID NO: 41289 - RNA, 64 nt, Homo Sapiens
uuccucacugaaaaagaaaacacacacccacccacacacacacacacagaagaaaaugaaagcu

SEQ ID NO: 41290 - RNA, 64 nt, Homo Sapiens
ccucacugaaaaagaaaacacacacccacccacacacacacacacagaagaaaaugaaagcuga

SEQ ID NO: 41291 - RNA, 64 nt, Homo Sapiens
ucacugaaaaagaaaacacacacccacccacacacacacacacagaagaaaaugaaagcugaca

SEQ ID NO: 41292 - RNA, 64 nt, Homo Sapiens
acugaaaaagaaaacacacacccacccacacacacacacacagaagaaaaugaaagcugacaca

SEQ ID NO: 41293 - RNA, 64 nt, Homo Sapiens
ucauacaacacgauuguauuuuggcaagcaaauacacacacacacacauacucucacacaggaa

SEQ ID NO: 41294 - RNA, 64 nt, Homo Sapiens
auacaacacgauuguauuuuggcaagcaaauacacacacacacacauacucucacacaggaaac

SEQ ID NO: 41295 - RNA, 64 nt, Homo Sapiens
acaacacgauuguauuuuggcaagcaaauacacacacacacacauacucucacacaggaaacga

SEQ ID NO: 41296 - RNA, 64 nt, Homo Sapiens
aacacgauuguauuuuggcaagcaaauacacacacacacacauacucucacacaggaaacgacc

SEQ ID NO: 41297 - RNA, 64 nt, Homo Sapiens
gauuccaggcgaugugcaaguguaugcacgugugcacacacaccacacauacacacacacaagc

SEQ ID NO: 41298 - RNA, 64 nt, Homo Sapiens
aaguguaugcacgugugcacacacaccacacauacacacacacaagcuuuuuuacacaaauggu

SEQ ID NO: 41299 - RNA, 64 nt, Homo Sapiens
guguaugcacgugugcacacacaccacacauacacacacacaagcuuuuuuacacaaaugguag

SEQ ID NO: 41300 - RNA, 64 nt, Homo Sapiens
ggaaucagugcagccuguaaguucuccacauugacacacacacacacacacacacacacacacg

SEQ ID NO: 41301 - RNA, 64 nt, Homo Sapiens
aaucagugcagccuguaaguucuccacauugacacacacacacacacacacacacacacacgac

SEQ ID NO: 41302 - RNA, 64 nt, Homo Sapiens
ucagugcagccuguaaguucuccacauugacacacacacacacacacacacacacacacgacau

SEQ ID NO: 41303 - RNA, 64 nt, Homo Sapiens
agugcagccuguaaguucuccacauugacacacacacacacacacacacacacacacgacaugc

SEQ ID NO: 41304 - RNA, 64 nt, Homo Sapiens
ugcagccuguaaguucuccacauugacacacacacacacacacacacacacacacgacaugcuc

SEQ ID NO: 41305 - RNA, 64 nt, Homo Sapiens
cagccuguaaguucuccacauugacacacacacacacacacacacacacacacgacaugcuccu

SEQ ID NO: 41306 - RNA, 64 nt, Homo Sapiens
gccuguaaguucuccacauugacacacacacacacacacacacacacacacgacaugcuccuuu

SEQ ID NO: 41307 - RNA, 64 nt, Homo Sapiens
cuguaaguucuccacauugacacacacacacacacacacacacacacacgacaugcuccuuucu

SEQ ID NO: 41308 - RNA, 64 nt, Homo Sapiens
guaaguucuccacauugacacacacacacacacacacacacacacacgacaugcuccuuucugu

SEQ ID NO: 41309 - RNA, 64 nt, Homo Sapiens
aaguucuccacauugacacacacacacacacacacacacacacacgacaugcuccuuucugugg

SEQ ID NO: 41310 - RNA, 64 nt, Homo Sapiens
guucuccacauugacacacacacacacacacacacacacacacgacaugcuccuuucuguggca

SEQ ID NO: 41311 - RNA, 64 nt, Homo Sapiens
ugcaguugcuuacuaaagguuuuaaccgcacaugcacacacacacgcuuucuuaugcaaucuau

SEQ ID NO: 41312 - RNA, 64 nt, Homo Sapiens
caguugcuuacuaaagguuuuaaccgcacaugcacacacacacgcuuucuuaugcaaucuaugu

SEQ ID NO: 41313 - RNA, 64 nt, Homo Sapiens
ccuggggggcaggaugccuggggacaguucaggacacacacacaguaggcccgcaauaaaagca

SEQ ID NO: 41314 - RNA, 64 nt, Homo Sapiens
uggggggcaggaugccuggggacaguucaggacacacacacaguaggcccgcaauaaaagcaac

SEQ ID NO: 41315 - RNA, 64 nt, Homo Sapiens
cccacauguggguggggggcccacgccacgugcacacacacagaaacacaaggcggggaugcuc

SEQ ID NO: 41316 - RNA, 64 nt, Homo Sapiens
gacccacaugugggugggggucccacgccacgugcacacacacaccaacacaaggcggggaugc

SEQ ID NO: 41317 - RNA, 64 nt, Homo Sapiens
uuuauccaaugcaaacaaauauaugguaaacaagcacacacaauauauauauauauauauauau

SEQ ID NO: 41318 - RNA, 64 nt, Homo Sapiens
ugcauucaugaaucugauauuaagcacacaugcgcacacacacuuacgacccgaccucucuaug

SEQ ID NO: 41319 - RNA, 64 nt, Homo Sapiens
cucucgccccaggauagaagcacacacacacacacacacacagguguucacacacacacacaca

SEQ ID NO: 41320 - RNA, 64 nt, Homo Sapiens
ggcucucgccccaggauagacacacacacacacacacacacacauguguucacacacacacaca

SEQ ID NO: 41321 - RNA, 64 nt, Homo Sapiens
caggcucucgccccaggauacacacacacacacacacacacacauguguguucacacacacaca

SEQ ID NO: 41322 - RNA, 64 nt, Homo Sapiens
cacaggcucucgccccaggacacacacacacacacacacacacagcuguguguucacacacaca

SEQ ID NO: 41323 - RNA, 64 nt, Homo Sapiens
cacacaggcucucgccccagcacacacacacacacacacacacauggcuguguguucacacaca

SEQ ID NO: 41324 - RNA, 64 nt, Homo Sapiens
cacacacaggcucucgcccccacacacacacacacacacacacagguggcuguguguucacaca

SEQ ID NO: 41325 - RNA, 64 nt, Homo Sapiens
cacacacacaggcucucgcccacacacacacacacacacacacagagguggcuguguguucaca

SEQ ID NO: 41326 - RNA, 64 nt, Homo Sapiens
cacacacacacaggcucucgcacacacacacacacacacacacaacgagguggcuguguguuca

SEQ ID NO: 41327 - RNA, 64 nt, Homo Sapiens
cacacacacacacaggcucucacacacacacacacacacacacaggacgagguggcuguguguu

SEQ ID NO: 41328 - RNA, 64 nt, Homo Sapiens
cacacacacacacacaggcuuucacacacacacacacacacacaccggacgagguggcugugug

SEQ ID NO: 41329 - RNA, 64 nt, Homo Sapiens
cacacacacacacacacagguguucacacacacacacacacacaccccggacgagguggcugug

SEQ ID NO: 41330 - RNA, 64 nt, Homo Sapiens
cacacacacacacacacacauguguucacacacacacacacacaccccccggacgagguggcug

SEQ ID NO: 41331 - RNA, 64 nt, Homo Sapiens
cacacacacacacacacacauguguguucacacacacacacacaggccccccggacgagguggc

SEQ ID NO: 41332 - RNA, 64 nt, Homo Sapiens
cacacacacacacacacacagcuguguguucacacacacacacacuggccccccggacgaggug

SEQ ID NO: 41333 - RNA, 64 nt, Homo Sapiens
cacacacacacacacacacauggcuguguguucacacacacacacacuggccccccggacgagg

SEQ ID NO: 41334 - RNA, 64 nt, Homo Sapiens
cacacacacacacacacacagguggcuguguguucacacacacaggcacuggccccccggacga

SEQ ID NO: 41335 - RNA, 64 nt, Homo Sapiens
cacguaauaccagaccaaccccccuccccugccacacacacagaaagcuaacaccgacugcccg

SEQ ID NO: 41336 - RNA, 64 nt, Homo Sapiens
gacacguaauaccagaccaacgccccuccccugccacacacacaaaaagcuaacaccgacugcc

SEQ ID NO: 41337 - RNA, 64 nt, Homo Sapiens
guaaauugcaaaaugaaaaauuauuaaaguaacacacacacaaauuucugcacagggagugaga

SEQ ID NO: 41338 - RNA, 64 nt, Homo Sapiens
aaguaaauugcaaaaugaaagauuauuaaaguaacacacacacaaauuucugcacagggaguga

SEQ ID NO: 41339 - RNA, 64 nt, Homo Sapiens
cccacaccccuuugccgguuugcacacacacacacacacacaccccuagcugggugcaugugug

SEQ ID NO: 41340 - RNA, 64 nt, Homo Sapiens
cccccacaccccuuugccggugugcacacacacacacacacacaacccuagcugggugcaugug

SEQ ID NO: 41341 - RNA, 64 nt, Homo Sapiens
cacccccacaccccuuugccugugugcacacacacacacacacacuacccuagcugggugcaug

SEQ ID NO: 41342 - RNA, 64 nt, Homo Sapiens
cacacccccacaccccuuugugugugugcacacacacacacacauucuacccuagcugggugca

SEQ ID NO: 41343 - RNA, 64 nt, Homo Sapiens
cacacacccccacaccccuucaugugugugcacacacacacacauuuucuacccuagcugggug

SEQ ID NO: 41344 - RNA, 64 nt, Homo Sapiens
cacacacacccccacaccccugcaugugugugcacacacacacauauuuucuacccuagcuggg

SEQ ID NO: 41345 - RNA, 64 nt, Homo Sapiens
cacacacacacccccacaccggugcaugugugugcacacacacacuuauuuucuacccuagcug

SEQ ID NO: 41346 - RNA, 64 nt, Homo Sapiens
ggagaagccuuaugucugcacagucaccagaggacacacacaggagccggaagucagaccuccu

SEQ ID NO: 41347 - RNA, 64 nt, Homo Sapiens
ggggaagcccuacgucugcauacacaccaaaggacacacacaggagugauaagucagauguuau

SEQ ID NO: 41348 - RNA, 64 nt, Homo Sapiens
cacccacacaaauaggcucugccgugcacuccuacacacacacacacacacacacacgcuuguu

SEQ ID NO: 41349 - RNA, 64 nt, Homo Sapiens
cccacacaaauaggcucugccgugcacuccuacacacacacacacacacacacacgcuuguuca

SEQ ID NO: 41350 - RNA, 64 nt, Homo Sapiens
cacacaaauaggcucugccgugcacuccuacacacacacacacacacacacacgcuuguucaca

SEQ ID NO: 41351 - RNA, 64 nt, Homo Sapiens
cacaaauaggcucugccgugcacuccuacacacacacacacacacacacacgcuuguucacacu

SEQ ID NO: 41352 - RNA, 64 nt, Homo Sapiens
caaauaggcucugccgugcacuccuacacacacacacacacacacacacgcuuguucacacuca

SEQ ID NO: 41353 - RNA, 64 nt, Homo Sapiens
aauaggcucugccgugcacuccuacacacacacacacacacacacacgcuuguucacacucaga

SEQ ID NO: 41354 - RNA, 64 nt, Homo Sapiens
uaggcucugccgugcacuccuacacacacacacacacacacacacgcuuguucacacucagaac

SEQ ID NO: 41355 - RNA, 64 nt, Homo Sapiens
ggcucugccgugcacuccuacacacacacacacacacacacacgcuuguucacacucagaaccc

SEQ ID NO: 41356 - RNA, 64 nt, Homo Sapiens
cccacugacccacccacccaccuacaccccccgccacacacacacacaaacgugcacacgcguc

SEQ ID NO: 41357 - RNA, 64 nt, Homo Sapiens
cacugacccacccacccaccuacaccccccgccacacacacacacaaacgugcacacgcgucuc

SEQ ID NO: 41358 - RNA, 64 nt, Homo Sapiens
cugacccacccacccaccuacaccccccgccacacacacacacaaacgugcacacgcgucucau

SEQ ID NO: 41359 - RNA, 64 nt, Homo Sapiens
gacccacccacccaccuacaccccccgccacacacacacacaaacgugcacacgcgucucauuu

SEQ ID NO: 41360 - RNA, 64 nt, Homo Sapiens
caaccagacucuguaacucacccccaccaccauacacacacacaaaaacagaaacaaaaucaaa

SEQ ID NO: 41361 - RNA, 64 nt, Homo Sapiens
accagacucuguaacucacccccaccaccauacacacacacaaaaacagaaacaaaaucaaaac

SEQ ID NO: 41362 - RNA, 64 nt, Homo Sapiens
uuguuuuucuuuucuaaaaugaagugagauuguucacacacacacacacacacacacacacaca

SEQ ID NO: 41363 - RNA, 64 nt, Homo Sapiens
guuuuucuuuucuaaaaugaagugagauuguucacacacacacacacacacacacacacacaca

SEQ ID NO: 41364 - RNA, 64 nt, Homo Sapiens
uuuucuuuucuaaaaugaagugagauuguucacacacacacacacacacacacacacacacaaa

SEQ ID NO: 41365 - RNA, 64 nt, Homo Sapiens
uucuuuucuaaaaugaagugagauuguucacacacacacacacacacacacacacacacaaaca

SEQ ID NO: 41366 - RNA, 64 nt, Homo Sapiens
cuuuucuaaaaugaagugagauuguucacacacacacacacacacacacacacacacaaacaca

SEQ ID NO: 41367 - RNA, 64 nt, Homo Sapiens
uuucuaaaaugaagugagauuguucacacacacacacacacacacacacacacacaaacacaaa

SEQ ID NO: 41368 - RNA, 64 nt, Homo Sapiens
ucuaaaaugaagugagauuguucacacacacacacacacacacacacacacacaaacacaaagg

SEQ ID NO: 41369 - RNA, 64 nt, Homo Sapiens
uaaaaugaagugagauuguucacacacacacacacacacacacacacacacaaacacaaaggac

SEQ ID NO: 41370 - RNA, 64 nt, Homo Sapiens
aaaugaagugagauuguucacacacacacacacacacacacacacacacaaacacaaaggacag

SEQ ID NO: 41371 - RNA, 64 nt, Homo Sapiens
augaagugagauuguucacacacacacacacacacacacacacacacaaacacaaaggacaguc

SEQ ID NO: 41372 - RNA, 64 nt, Homo Sapiens
gaagugagauuguucacacacacacacacacacacacacacacacaaacacaaaggacagucau

SEQ ID NO: 41373 - RNA, 64 nt, Homo Sapiens
agugagauuguucacacacacacacacacacacacacacacacaaacacaaaggacagucauac

SEQ ID NO: 41374 - RNA, 64 nt, Homo Sapiens
ugagauuguucacacacacacacacacacacacacacacacaaacacaaaggacagucauacau

SEQ ID NO: 41375 - RNA, 64 nt, Homo Sapiens
cuagcucacacucauccacacuuaagcccucgugcacacacacaaauuauucagauguacaccc

SEQ ID NO: 41376 - RNA, 64 nt, Homo Sapiens
agcucacacucauccacacuuaagcccucgugcacacacacaaauuauucagauguacacccac

SEQ ID NO: 41377 - RNA, 64 nt, Homo Sapiens
gccugucugucaauuucugguugggcugggaggccacacacacacacugacaugacagggcuug

SEQ ID NO: 41378 - RNA, 64 nt, Homo Sapiens
cugucugucaauuucugguugggcugggaggccacacacacacacugacaugacagggcuuggg

SEQ ID NO: 41379 - RNA, 64 nt, Homo Sapiens
gucugucaauuucugguugggcugggaggccacacacacacacugacaugacagggcuugggca

SEQ ID NO: 41380 - RNA, 64 nt, Homo Sapiens
cuccuuccucucguccuuggauagauucagcucccacacacacacccgcacugcccaggucccu

SEQ ID NO: 41381 - RNA, 64 nt, Homo Sapiens
ccuuccucucguccuuggauagauucagcucccacacacacacccgcacugcccaggucccucc

SEQ ID NO: 41382 - RNA, 64 nt, Homo Sapiens
gggcugggggaagaugcccucaacucacccccuacacacacaugagagagagcccccacccagu

SEQ ID NO: 41383 - RNA, 64 nt, Homo Sapiens
cagccaccagcacccccauagggcccccagacaccacacacaugcgcgugcgcacacacacaaa

SEQ ID NO: 41384 - RNA, 64 nt, Homo Sapiens
uagggcccccagacaccacacacaugcgcgugcgcacacacacaaacacacacacacuggacag

SEQ ID NO: 41385 - RNA, 64 nt, Homo Sapiens
gggcccccagacaccacacacaugcgcgugcgcacacacacaaacacacacacacuggacagua

SEQ ID NO: 41386 - RNA, 64 nt, Homo Sapiens
acaccacacacaugcgcgugcgcacacacacaaacacacacacacuggacaguagaugggccga

SEQ ID NO: 41387 - RNA, 64 nt, Homo Sapiens
accacacacaugcgcgugcgcacacacacaaacacacacacacuggacaguagaugggccgaca

SEQ ID NO: 41388 - RNA, 64 nt, Homo Sapiens
uaggggccccacccucugggcuucccaucagcgacacacacacacuuauggcaccagccuggac

SEQ ID NO: 41389 - RNA, 64 nt, Homo Sapiens
ggggccccacccucugggcuucccaucagcgacacacacacacuuauggcaccagccuggacuc

SEQ ID NO: 41390 - RNA, 64 nt, Homo Sapiens
guguccagguauuguguguaugcauuuaguugugcacacacaaauaugcuccuauacuggcauu

SEQ ID NO: 41391 - RNA, 64 nt, Homo Sapiens
gcaggugcccggggcugggugaguggaauuaggacacacacaggcuugggcuucaaguucauuu

SEQ ID NO: 41392 - RNA, 64 nt, Homo Sapiens
gauguaaaaaaaaaaaaaaaaaaaaaaaaaaaaacacacacacagaggaaagacgcucuuuagg

SEQ ID NO: 41393 - RNA, 64 nt, Homo Sapiens
uguaaaaaaaaaaaaaaaaaaaaaaaaaaaaacacacacacagaggaaagacgcucuuuagguu

SEQ ID NO: 41394 - RNA, 64 nt, Homo Sapiens
aaggaccccucaccuugcaacacacagacacacgcacacacacacacaggaggagaaaucucac

SEQ ID NO: 41395 - RNA, 64 nt, Homo Sapiens
ggaccccucaccuugcaacacacagacacacgcacacacacacacaggaggagaaaucucacuu

SEQ ID NO: 41396 - RNA, 64 nt, Homo Sapiens
accccucaccuugcaacacacagacacacgcacacacacacacaggaggagaaaucucacuuuu

SEQ ID NO: 41397 - RNA, 64 nt, Homo Sapiens
cccucaccuugcaacacacagacacacgcacacacacacacaggaggagaaaucucacuuuucu

SEQ ID NO: 41398 - RNA, 64 nt, Homo Sapiens
cuuucuaugaaaggagcugcuauguacacaugugcacacacacacaacugggaaucaacaauga

SEQ ID NO: 41399 - RNA, 64 nt, Homo Sapiens
uucuaugaaaggagcugcuauguacacaugugcacacacacacaacugggaaucaacaaugagu

SEQ ID NO: 41400 - RNA, 64 nt, Homo Sapiens
cuaugaaaggagcugcuauguacacaugugcacacacacacaacugggaaucaacaaugaguuu

SEQ ID NO: 41401 - RNA, 64 nt, Homo Sapiens
uuauuuguuuauguuauuuaaauacacacccagacacacacacacacaguuuuugcuuuuucug

SEQ ID NO: 41402 - RNA, 64 nt, Homo Sapiens
auuuguuuauguuauuuaaauacacacccagacacacacacacacaguuuuugcuuuuucugga

SEQ ID NO: 41403 - RNA, 64 nt, Homo Sapiens
uuguuuauguuauuuaaauacacacccagacacacacacacacaguuuuugcuuuuucuggaaa

SEQ ID NO: 41404 - RNA, 64 nt, Homo Sapiens
guuuauguuauuuaaauacacacccagacacacacacacacaguuuuugcuuuuucuggaaaau

SEQ ID NO: 41405 - RNA, 64 nt, Homo Sapiens
cuuuuuuauuuuaagaggaagaagaagaaaggggcacacacacacaauaccgacgucuauccuu

SEQ ID NO: 41406 - RNA, 64 nt, Homo Sapiens
uuuuuauuuuaagaggaagaagaagaaaggggcacacacacacaauaccgacgucuauccuuuc

SEQ ID NO: 41407 - RNA, 64 nt, Homo Sapiens
uuuauuuuaagaggaagaagaagaaaggggcacacacacacaauaccgacgucuauccuuuccu

SEQ ID NO: 41408 - RNA, 64 nt, Homo Sapiens
cacgcacacgcacacaucuucacacacacacacacacacacacgcuuccagccugggacacaca

SEQ ID NO: 41409 - RNA, 64 nt, Homo Sapiens
cgcacgcacacgcacacauccacacacacacacacacacacacacccuuccagccugggacaca

SEQ ID NO: 41410 - RNA, 64 nt, Homo Sapiens
cacgcacgcacacgcacacacacacacacacacacacacacacaagcccuuccagccugggaca

SEQ ID NO: 41411 - RNA, 64 nt, Homo Sapiens
cacacgcacgcacacgcacacacacacacacacacacacacacacuagcccuuccagccuggga

SEQ ID NO: 41412 - RNA, 64 nt, Homo Sapiens
cacacacgcacgcacacgcagacacacacacacacacacacacacccuagcccuuccagccugg

SEQ ID NO: 41413 - RNA, 64 nt, Homo Sapiens
cacacacacgcacgcacacggggacacacacacacacacacacacucccuagcccuuccagccu

SEQ ID NO: 41414 - RNA, 64 nt, Homo Sapiens
cacacacacacgcacgcacacugggacacacacacacacacacacccucccuagcccuuccagc

SEQ ID NO: 41415 - RNA, 64 nt, Homo Sapiens
cacacacacacacgcacgcagccugggacacacacacacacacacucccucccuagcccuucca

SEQ ID NO: 41416 - RNA, 64 nt, Homo Sapiens
cacacacacacacacgcacgcagccugggacacacacacacacacccucccucccuagcccuuc

SEQ ID NO: 41417 - RNA, 64 nt, Homo Sapiens
cacacacacacacacacgcauccagccugggacacacacacacaggcccucccucccuagcccu

SEQ ID NO: 41418 - RNA, 64 nt, Homo Sapiens
cacacacacacacacacacgcuuccagccugggacacacacacacuggcccucccucccuagcc

SEQ ID NO: 41419 - RNA, 64 nt, Homo Sapiens
guccgugccaugucaccuccuacacccccaagcacacacacaugcacaaccaucuacacacauc

SEQ ID NO: 41420 - RNA, 64 nt, Homo Sapiens
ugguccgugccaugucaccuucuacacccccaagcacacacacaaacacaaccaucuacacaca

SEQ ID NO: 41421 - RNA, 64 nt, Homo Sapiens
ccuuacccuccucaggacuagagccacaagaccacacacacagccacauauugagacuuaggaa

SEQ ID NO: 41422 - RNA, 64 nt, Homo Sapiens
gcccuuacccuccucaggacaagagccacaagaccacacacacagacacauauugagacuuagg

SEQ ID NO: 41423 - RNA, 64 nt, Homo Sapiens
ccagaagucagggcccccuccccccauccucucccacacacauucaccgggggccaccugcccu

SEQ ID NO: 41424 - RNA, 64 nt, Homo Sapiens
cccaccgggggccaccugccaccugcccccaaugcacacacagauccuuaggauccccgccccc

SEQ ID NO: 41425 - RNA, 64 nt, Homo Sapiens
gcaugcauguacgcacaugccccugcaaacaccacacacacaugucuacuucaagaccaccucu

SEQ ID NO: 41426 - RNA, 64 nt, Homo Sapiens
uggcaugcauguacgcacaucucccugcaaacaccacacacacaucucuacuucaagaccaccu

SEQ ID NO: 41427 - RNA, 64 nt, Homo Sapiens
caccccagggccaagagaaacgcgcacacacacacacacacauccacacaugcacacacacgcg

SEQ ID NO: 41428 - RNA, 64 nt, Homo Sapiens
uccaccccagggccaagagacgcgcgcacacacacacacacacacacacacaugcacacacacg

SEQ ID NO: 41429 - RNA, 64 nt, Homo Sapiens
cauccaccccagggccaagacgcgcgcgcacacacacacacacacacacacacaugcacacaca

SEQ ID NO: 41430 - RNA, 64 nt, Homo Sapiens
cacauccaccccagggccaacacgcgcgcgcacacacacacacacacacacacacaugcacaca

SEQ ID NO: 41431 - RNA, 64 nt, Homo Sapiens
cacacauccaccccagggcccacacgcgcgcgcacacacacacacacacacacacacaugcaca

SEQ ID NO: 41432 - RNA, 64 nt, Homo Sapiens
cacacacauccaccccagggcacacacgcgcgcgcacacacacaugcacacacacacacaugca

SEQ ID NO: 41433 - RNA, 64 nt, Homo Sapiens
cgcgcgcacacacacacacacacacacacacaugcacacacacgcacccgugagcgccugugca

SEQ ID NO: 41434 - RNA, 64 nt, Homo Sapiens
cacacacacgcgcgcgcacacgccugugcacacacacacacaugacucacaugacacccgugag

SEQ ID NO: 41435 - RNA, 64 nt, Homo Sapiens
ugcacacacacgcgcgcgcaagcgccugugcacacacacacacaccacucacaugacacccgug

SEQ ID NO: 41436 - RNA, 64 nt, Homo Sapiens
caugcacacacacgcgcgcgugagcgccugugcacacacacacauaccacucacaugacacccg

SEQ ID NO: 41437 - RNA, 64 nt, Homo Sapiens
cacaugcacacacacgcgcgcgugagcgccugugcacacacacaccuaccacucacaugacacc

SEQ ID NO: 41438 - RNA, 64 nt, Homo Sapiens
aauuaguauauccauguaugacagcaucacaucacacacacagaaacaaguugucuggccugac

SEQ ID NO: 41439 - RNA, 64 nt, Homo Sapiens
gaaauuaguauauccauguaacacagcaucacaucacacacacaauaacaaguugucuggccug

SEQ ID NO: 41440 - RNA, 64 nt, Homo Sapiens
cauauauuuccuucuuuaaguauauauagacacacacacacagauauacauauaugucuauaua

SEQ ID NO: 41441 - RNA, 64 nt, Homo Sapiens
gacauauauuuccuucuuuauauauauauagacacacacacacaaguauacauauaugucuaua

SEQ ID NO: 41442 - RNA, 64 nt, Homo Sapiens
cagacauauauuuccuucuuuauauauauauagacacacacacaaaaguauacauauaugucua

SEQ ID NO: 41443 - RNA, 64 nt, Homo Sapiens
uauuuuguugcuaaagagauagcaauaagauaugcacacacaggcagccuuguuuaauguuuug

SEQ ID NO: 41444 - RNA, 64 nt, Homo Sapiens
ugguaaaugcucugcuggugcuggccauuugagacacacacaggccacagcaggaacugcccca

SEQ ID NO: 41445 - RNA, 64 nt, Homo Sapiens
ccccucuacugcuauguggccacacacacacacacacacacacgcacacacacacacacacaca

SEQ ID NO: 41446 - RNA, 64 nt, Homo Sapiens
cacacacacgccccucuacucacacacacacacacacacacacacacacacacacacacacaca

SEQ ID NO: 41447 - RNA, 64 nt, Homo Sapiens
cacacacacacgccccucuacacacacacacacacacacacacacacacacacacacacacaca

SEQ ID NO: 41448 - RNA, 64 nt, Homo Sapiens
cacacacacacacgccccuccacacacacacacacacacacacacacacacacacacacacaca

SEQ ID NO: 41449 - RNA, 64 nt, Homo Sapiens
cacacacacacacacgcccccacacacacacacacacacacacacacacacacacacacacaca

SEQ ID NO: 41450 - RNA, 64 nt, Homo Sapiens
cacacacacacacacacgcccacacacacacacacacacacacaaacacacacacacacacaca

SEQ ID NO: 41451 - RNA, 64 nt, Homo Sapiens
cacacacacacacacacacgcacacacacacacacacacacacaccaacacacacacacacaca

SEQ ID NO: 41452 - RNA, 64 nt, Homo Sapiens
cacacacacacacacacacacacacacacacacacacacacacacuccaacacacacacacaca

SEQ ID NO: 41453 - RNA, 64 nt, Homo Sapiens
cacacacacacacacacacacacacacacacacacacacacacacgcuccaacacacacacaca

SEQ ID NO: 41454 - RNA, 64 nt, Homo Sapiens
cacacacacacacacacacacacacacacacacacacacacacacacgcuccaacacacacaca

SEQ ID NO: 41455 - RNA, 64 nt, Homo Sapiens
cacacacacacacacacacacacacacacacacacacacacacacccacgcuccaacacacaca

SEQ ID NO: 41456 - RNA, 64 nt, Homo Sapiens
cacacacacacacacacacacacacacacacacacacacacacaaacccacgcuccaacacaca

SEQ ID NO: 41457 - RNA, 64 nt, Homo Sapiens
cacacacacacacacacacacacacacacacacacacacacacaccaacccacgcuccaacaca

SEQ ID NO: 41458 - RNA, 64 nt, Homo Sapiens
cacacacacacacacacacacacacacacacacacacacacacaccccaacccacgcuccaaca

SEQ ID NO: 41459 - RNA, 64 nt, Homo Sapiens
cacacacacacacacacacacacacacacacacacacacacacaucccccaacccacgcuccaa

SEQ ID NO: 41460 - RNA, 64 nt, Homo Sapiens
cacacacacacacacacacaaacacacacacacacacacacacaccucccccaacccacgcucc

SEQ ID NO: 41461 - RNA, 64 nt, Homo Sapiens
cacacacacacacacacacaccaacacacacacacacacacacagcccucccccaacccacgcu

SEQ ID NO: 41462 - RNA, 64 nt, Homo Sapiens
cacacacacacacacacacacuccaacacacacacacacacacagagcccucccccaacccacg

SEQ ID NO: 41463 - RNA, 64 nt, Homo Sapiens
cacacacacacacacacacacgcuccaacacacacacacacacacugagcccucccccaaccca

SEQ ID NO: 41464 - RNA, 64 nt, Homo Sapiens
cacacacacacacacacacacacgcuccaacacacacacacacaugcugagcccucccccaacc

SEQ ID NO: 41465 - RNA, 64 nt, Homo Sapiens
cacacacacacacacacacacccacgcuccaacacacacacacacuugcugagcccucccccaa

SEQ ID NO: 41466 - RNA, 64 nt, Homo Sapiens
cacacacacacacacacacaaacccacgcuccaacacacacacagucuugcugagcccuccccc

SEQ ID NO: 41467 - RNA, 64 nt, Homo Sapiens
acaauuuuuuaagaaauccuaaaacacacacauacacacacaaaauugggcagugguucacuuu

SEQ ID NO: 41468 - RNA, 64 nt, Homo Sapiens
cacacacaaaacaauuuuuugguucacuuuaaaacacacacauaaaacuuucauauugggcagu

SEQ ID NO: 41469 - RNA, 64 nt, Homo Sapiens
cucccucaucuuucgugcccuggucacgguaacacacacacacuugccagauagugcaguguuu

SEQ ID NO: 41470 - RNA, 64 nt, Homo Sapiens
cucucccucaucuuucgugcuuuggucacgguaacacacacacaacugccagauagugcagugu

SEQ ID NO: 41471 - RNA, 64 nt, Homo Sapiens
cuuacaaccuccaucaugggaacauaccuacacacacacacacucauacauacaaacacaugca

SEQ ID NO: 41472 - RNA, 64 nt, Homo Sapiens
cucuuacaaccuccaucaugcaaacauaccuacacacacacacacacauacauacaaacacaug

SEQ ID NO: 41473 - RNA, 64 nt, Homo Sapiens
cacucuuacaaccuccaucaugcaaacauaccuacacacacacaugcacauacauacaaacaca

SEQ ID NO: 41474 - RNA, 64 nt, Homo Sapiens
cacuugcacauacauacaaacauacucacaaacacacacacaagagaggaauacaucucucaca

SEQ ID NO: 41475 - RNA, 64 nt, Homo Sapiens
agcacuugcacauacauacacacauacucacaaacacacacacagcagaggaauacaucucuca

SEQ ID NO: 41476 - RNA, 64 nt, Homo Sapiens
gcccaaucccaguaaugcugcugccugacagaaacacacacacagccacaguugccaaaucccg

SEQ ID NO: 41477 - RNA, 64 nt, Homo Sapiens
ccaaucccaguaaugcugcugccugacagaaacacacacacagccacaguugccaaaucccgua

SEQ ID NO: 41478 - RNA, 64 nt, Homo Sapiens
guuggcuacuauuacaccuuaaaaauugaguuuacacacacacaauuaccuguuuauauggugc

SEQ ID NO: 41479 - RNA, 64 nt, Homo Sapiens
uggcuacuauuacaccuuaaaaauugaguuuacacacacacaauuaccuguuuauauggugcuc

SEQ ID NO: 41480 - RNA, 64 nt, Homo Sapiens
cucuugggucaacuggcuuacagauuuacaugugcacacacacacaaauuucuuaucacauuuu

SEQ ID NO: 41481 - RNA, 64 nt, Homo Sapiens
cuugggucaacuggcuuacagauuuacaugugcacacacacacaaauuucuuaucacauuuucg

SEQ ID NO: 41482 - RNA, 64 nt, Homo Sapiens
ugggucaacuggcuuacagauuuacaugugcacacacacacaaauuucuuaucacauuuucgac

SEQ ID NO: 41483 - RNA, 64 nt, Homo Sapiens
aauuaacagucuucaggcaacagacagacacacacacacacaacacauauaaacaucacacaca

SEQ ID NO: 41484 - RNA, 64 nt, Homo Sapiens
acaauuaacagucuucaggccacagacagacacacacacacacaacacauauaaacaucacaca

SEQ ID NO: 41485 - RNA, 64 nt, Homo Sapiens
caacaauuaacagucuucagcacacagacagacacacacacacaacacacauauaaacaucaca

SEQ ID NO: 41486 - RNA, 64 nt, Homo Sapiens
cacaacaauuaacagucuuccacacacagacagacacacacacauaacacacauauaaacauca

SEQ ID NO: 41487 - RNA, 64 nt, Homo Sapiens
cagacacacacacacacaacacauauaaacaucacacacacagauguuuaagaaaaaauaacac

SEQ ID NO: 41488 - RNA, 64 nt, Homo Sapiens
gacagacacacacacacacaacacauauaaacaucacacacacagcuguuuaagaaaaaauaac

SEQ ID NO: 41489 - RNA, 64 nt, Homo Sapiens
uucaacuugcaaacugacuuuugggacaaaccaacacacacacagaagagaaagcaaagaacuu

SEQ ID NO: 41490 - RNA, 64 nt, Homo Sapiens
caacuugcaaacugacuuuugggacaaaccaacacacacacagaagagaaagcaaagaacuugg

SEQ ID NO: 41491 - RNA, 64 nt, Homo Sapiens
uagucugaaacagaccugaacagacagacagacgcacacacacaacagaugcgcagcaacuccc

SEQ ID NO: 41492 - RNA, 64 nt, Homo Sapiens
gucugaaacagaccugaacagacagacagacgcacacacacaacagaugcgcagcaacuccccg

SEQ ID NO: 41493 - RNA, 64 nt, Homo Sapiens
agccucccgcggggccacacacuuccccucccaacacacacacacaccugccaucuuggucaug

SEQ ID NO: 41494 - RNA, 64 nt, Homo Sapiens
ccucccgcggggccacacacuuccccucccaacacacacacacaccugccaucuuggucaugag

SEQ ID NO: 41495 - RNA, 64 nt, Homo Sapiens
ucccgcggggccacacacuuccccucccaacacacacacacaccugccaucuuggucaugagcu

SEQ ID NO: 41496 - RNA, 64 nt, Homo Sapiens
agagaugcucaguguuaaaacugaaacacacaaacacacacacacacacauuuuucucuuguag

SEQ ID NO: 41497 - RNA, 64 nt, Homo Sapiens
agaugcucaguguuaaaacugaaacacacaaacacacacacacacacauuuuucucuuguagau

SEQ ID NO: 41498 - RNA, 64 nt, Homo Sapiens
augcucaguguuaaaacugaaacacacaaacacacacacacacacauuuuucucuuguagauuu

SEQ ID NO: 41499 - RNA, 64 nt, Homo Sapiens
gcucaguguuaaaacugaaacacacaaacacacacacacacacauuuuucucuuguagauuuua

SEQ ID NO: 41500 - RNA, 64 nt, Homo Sapiens
ucaguguuaaaacugaaacacacaaacacacacacacacacauuuuucucuuguagauuuuaau

SEQ ID NO: 41501 - RNA, 64 nt, Homo Sapiens
accgccacauggcuuccuccugcgcgcaugugcgcacacacacacacacacgcacacacacaca

SEQ ID NO: 41502 - RNA, 64 nt, Homo Sapiens
cgccacauggcuuccuccugcgcgcaugugcgcacacacacacacacacgcacacacacacaca

SEQ ID NO: 41503 - RNA, 64 nt, Homo Sapiens
ccacauggcuuccuccugcgcgcaugugcgcacacacacacacacacgcacacacacacacaca

SEQ ID NO: 41504 - RNA, 64 nt, Homo Sapiens
acauggcuuccuccugcgcgcaugugcgcacacacacacacacacgcacacacacacacacaca

SEQ ID NO: 41505 - RNA, 64 nt, Homo Sapiens
auggcuuccuccugcgcgcaugugcgcacacacacacacacacgcacacacacacacacacacu

SEQ ID NO: 41506 - RNA, 64 nt, Homo Sapiens
ccugcgcgcaugugcgcacacacacacacacacgcacacacacacacacacacucacugcggag

SEQ ID NO: 41507 - RNA, 64 nt, Homo Sapiens
ugcgcgcaugugcgcacacacacacacacacgcacacacacacacacacacucacugcggagaa

SEQ ID NO: 41508 - RNA, 64 nt, Homo Sapiens
cgcgcaugugcgcacacacacacacacacgcacacacacacacacacacucacugcggagaacc

SEQ ID NO: 41509 - RNA, 64 nt, Homo Sapiens
cgcaugugcgcacacacacacacacacgcacacacacacacacacacucacugcggagaaccuu

SEQ ID NO: 41510 - RNA, 64 nt, Homo Sapiens
caugugcgcacacacacacacacacgcacacacacacacacacacucacugcggagaaccuugu

SEQ ID NO: 41511 - RNA, 64 nt, Homo Sapiens
ugugcgcacacacacacacacacgcacacacacacacacacacucacugcggagaaccuugugc

SEQ ID NO: 41512 - RNA, 64 nt, Homo Sapiens
cacaugguaaccuacuguuugccagccuguaaaacacacacacacacacacacacacacacaaa

SEQ ID NO: 41513 - RNA, 64 nt, Homo Sapiens
caugguaaccuacuguuugccagccuguaaaacacacacacacacacacacacacacacaaaua

SEQ ID NO: 41514 - RNA, 64 nt, Homo Sapiens
ugguaaccuacuguuugccagccuguaaaacacacacacacacacacacacacacacaaauauu

SEQ ID NO: 41515 - RNA, 64 nt, Homo Sapiens
guaaccuacuguuugccagccuguaaaacacacacacacacacacacacacacacaaauauuau

SEQ ID NO: 41516 - RNA, 64 nt, Homo Sapiens
aaccuacuguuugccagccuguaaaacacacacacacacacacacacacacacaaauauuauua

SEQ ID NO: 41517 - RNA, 64 nt, Homo Sapiens
ccuacuguuugccagccuguaaaacacacacacacacacacacacacacacaaauauuauuaga

SEQ ID NO: 41518 - RNA, 64 nt, Homo Sapiens
uacuguuugccagccuguaaaacacacacacacacacacacacacacacaaauauuauuagaca

SEQ ID NO: 41519 - RNA, 64 nt, Homo Sapiens
cuguuugccagccuguaaaacacacacacacacacacacacacacacaaauauuauuagacaaa

SEQ ID NO: 41520 - RNA, 64 nt, Homo Sapiens
guuugccagccuguaaaacacacacacacacacacacacacacacaaauauuauuagacaaauu

SEQ ID NO: 41521 - RNA, 64 nt, Homo Sapiens
uugccagccuguaaaacacacacacacacacacacacacacacaaauauuauuagacaaauuag

SEQ ID NO: 41522 - RNA, 64 nt, Homo Sapiens
gccagccuguaaaacacacacacacacacacacacacacacaaauauuauuagacaaauuagau

SEQ ID NO: 41523 - RNA, 64 nt, Homo Sapiens
caccagcagugguggagaugucgguccaugagcgcacacacaagacugagggacugucggcccu

SEQ ID NO: 41524 - RNA, 64 nt, Homo Sapiens
cugucggcccucccagguggugucaacacaacaucacacacaggugggggggccugauagccca

SEQ ID NO: 41525 - RNA, 64 nt, Homo Sapiens
guaaccacguggaaagcggccccugcugccccuccacacacacauacacacucacugaucuaca

SEQ ID NO: 41526 - RNA, 64 nt, Homo Sapiens
aaccacguggaaagcggccccugcugccccuccacacacacauacacacucacugaucuacagc

SEQ ID NO: 41527 - RNA, 64 nt, Homo Sapiens
agacccccgcaggccaccaggcauucuggacacgcacacacacacacacacacacacacacaca

SEQ ID NO: 41528 - RNA, 64 nt, Homo Sapiens
acccccgcaggccaccaggcauucuggacacgcacacacacacacacacacacacacacacaca

SEQ ID NO: 41529 - RNA, 64 nt, Homo Sapiens
ccccgcaggccaccaggcauucuggacacgcacacacacacacacacacacacacacacacaaa

SEQ ID NO: 41530 - RNA, 64 nt, Homo Sapiens
ccgcaggccaccaggcauucuggacacgcacacacacacacacacacacacacacacacaaaac

SEQ ID NO: 41531 - RNA, 64 nt, Homo Sapiens
gcaggccaccaggcauucuggacacgcacacacacacacacacacacacacacacacaaaacuu

SEQ ID NO: 41532 - RNA, 64 nt, Homo Sapiens
aggccaccaggcauucuggacacgcacacacacacacacacacacacacacacacaaaacuuca

SEQ ID NO: 41533 - RNA, 64 nt, Homo Sapiens
gccaccaggcauucuggacacgcacacacacacacacacacacacacacacacaaaacuucaca

SEQ ID NO: 41534 - RNA, 64 nt, Homo Sapiens
caccaggcauucuggacacgcacacacacacacacacacacacacacacacaaaacuucacagc

SEQ ID NO: 41535 - RNA, 64 nt, Homo Sapiens
ccaggcauucuggacacgcacacacacacacacacacacacacacacacaaaacuucacagcag

SEQ ID NO: 41536 - RNA, 64 nt, Homo Sapiens
aggcauucuggacacgcacacacacacacacacacacacacacacacaaaacuucacagcaggc

SEQ ID NO: 41537 - RNA, 64 nt, Homo Sapiens
gcauucuggacacgcacacacacacacacacacacacacacacacaaaacuucacagcaggcca

SEQ ID NO: 41538 - RNA, 64 nt, Homo Sapiens
auucuggacacgcacacacacacacacacacacacacacacacaaaacuucacagcaggccagc

SEQ ID NO: 41539 - RNA, 64 nt, Homo Sapiens
ucuggacacgcacacacacacacacacacacacacacacacaaaacuucacagcaggccagcug

SEQ ID NO: 41540 - RNA, 64 nt, Homo Sapiens
ucacaccuccagccucacguucacuuaggcacaucacacacacacuggcacacgcaggcaucca

SEQ ID NO: 41541 - RNA, 64 nt, Homo Sapiens
acaccuccagccucacguucacuuaggcacaucacacacacacuggcacacgcaggcauccauc

SEQ ID NO: 41542 - RNA, 64 nt, Homo Sapiens
ucucugaagacuucucgcucaguuucagugaggacacacacaaagacgugggugaccauguugu

SEQ ID NO: 41543 - RNA, 64 nt, Homo Sapiens
cacugaggauaagcuggagccacaaugcaugaggcacacacacagcaaggaugacgcuguaaac

SEQ ID NO: 41544 - RNA, 64 nt, Homo Sapiens
cugaggauaagcuggagccacaaugcaugaggcacacacacagcaaggaugacgcuguaaacau

SEQ ID NO: 41545 - RNA, 64 nt, Homo Sapiens
uuucaaacucuuaugcacucaugaaacacacagacacacacacacacaaacuugcauaaauuuu

SEQ ID NO: 41546 - RNA, 64 nt, Homo Sapiens
ucaaacucuuaugcacucaugaaacacacagacacacacacacacaaacuugcauaaauuuucc

SEQ ID NO: 41547 - RNA, 64 nt, Homo Sapiens
aaacucuuaugcacucaugaaacacacagacacacacacacacaaacuugcauaaauuuucccu

SEQ ID NO: 41548 - RNA, 64 nt, Homo Sapiens
acucuuaugcacucaugaaacacacagacacacacacacacaaacuugcauaaauuuucccuga

SEQ ID NO: 41549 - RNA, 64 nt, Homo Sapiens
cacauauuuaaaguguacgaguuaagucuugauacacacacacacacacacacacacacacaca

SEQ ID NO: 41550 - RNA, 64 nt, Homo Sapiens
cauauuuaaaguguacgaguuaagucuugauacacacacacacacacacacacacacacacaca

SEQ ID NO: 41551 - RNA, 64 nt, Homo Sapiens
uauuuaaaguguacgaguuaagucuugauacacacacacacacacacacacacacacacacaca

SEQ ID NO: 41552 - RNA, 64 nt, Homo Sapiens
uuuaaaguguacgaguuaagucuugauacacacacacacacacacacacacacacacacacaca

SEQ ID NO: 41553 - RNA, 64 nt, Homo Sapiens
uaaaguguacgaguuaagucuugauacacacacacacacacacacacacacacacacacacacu

SEQ ID NO: 41554 - RNA, 64 nt, Homo Sapiens
aaguguacgaguuaagucuugauacacacacacacacacacacacacacacacacacacacuug

SEQ ID NO: 41555 - RNA, 64 nt, Homo Sapiens
guguacgaguuaagucuugauacacacacacacacacacacacacacacacacacacacuugaa

SEQ ID NO: 41556 - RNA, 64 nt, Homo Sapiens
guacgaguuaagucuugauacacacacacacacacacacacacacacacacacacacuugaaac

SEQ ID NO: 41557 - RNA, 64 nt, Homo Sapiens
acgaguuaagucuugauacacacacacacacacacacacacacacacacacacacuugaaacua

SEQ ID NO: 41558 - RNA, 64 nt, Homo Sapiens
gaguuaagucuugauacacacacacacacacacacacacacacacacacacacuugaaacuauc

SEQ ID NO: 41559 - RNA, 64 nt, Homo Sapiens
guuaagucuugauacacacacacacacacacacacacacacacacacacacuugaaacuaucac

SEQ ID NO: 41560 - RNA, 64 nt, Homo Sapiens
uaagucuugauacacacacacacacacacacacacacacacacacacacuugaaacuaucaccc

SEQ ID NO: 41561 - RNA, 64 nt, Homo Sapiens
agucuugauacacacacacacacacacacacacacacacacacacacuugaaacuaucacccua

SEQ ID NO: 41562 - RNA, 64 nt, Homo Sapiens
ucuugauacacacacacacacacacacacacacacacacacacacuugaaacuaucacccuauc

SEQ ID NO: 41563 - RNA, 64 nt, Homo Sapiens
uugauacacacacacacacacacacacacacacacacacacacuugaaacuaucacccuaucag

SEQ ID NO: 41564 - RNA, 64 nt, Homo Sapiens
cucaugugugaagggcagagugcucucugcuacucacacacacccccagacacugugcugucuc

SEQ ID NO: 41565 - RNA, 64 nt, Homo Sapiens
aagaaagauacaucugaccagcaggagccccggccacacacagcgcuguccuggcugagccccu

SEQ ID NO: 41566 - RNA, 64 nt, Homo Sapiens
gcagcgucgggugggagagacccccacccacgcacacacacaagaagagaguuaaggacacuca

SEQ ID NO: 41567 - RNA, 64 nt, Homo Sapiens
aggcagcgucgggugggagacacccccacccacgcacacacacaaaaagagaguuaaggacacu

SEQ ID NO: 41568 - RNA, 64 nt, Homo Sapiens
uauauauauauauauuuuuucacacacacacacacacacacauacauauacacacacacacaca

SEQ ID NO: 41569 - RNA, 64 nt, Homo Sapiens
uauauauauauauauauuuucacacacacacacacacacacacauacauauacacacacacaca

SEQ ID NO: 41570 - RNA, 64 nt, Homo Sapiens
cauauauauauauauauauucacacacacacacacacacacacauauacauauacacacacaca

SEQ ID NO: 41571 - RNA, 64 nt, Homo Sapiens
cacauauauauauauauauacacacacacacacacacacacacauauauacauauacacacaca

SEQ ID NO: 41572 - RNA, 64 nt, Homo Sapiens
cacacauauauauauauauacacacacacacacacacacacacacauauauacauauacacaca

SEQ ID NO: 41573 - RNA, 64 nt, Homo Sapiens
cacacacauauauauauauacacacacacacacacacacacacacacauauauacauauacaca

SEQ ID NO: 41574 - RNA, 64 nt, Homo Sapiens
cacacacacauauauauauacacacacacacacacacacacacacacacauauauacauauaca

SEQ ID NO: 41575 - RNA, 64 nt, Homo Sapiens
cacacacacacauauauauacacacacacacacacacacacacacacacacauauauacauaua

SEQ ID NO: 41576 - RNA, 64 nt, Homo Sapiens
cacacacacacacauauauauacacacacacacacacacacacacacacacacauauauacaua

SEQ ID NO: 41577 - RNA, 64 nt, Homo Sapiens
cacacacacacacacauauauauacacacacacacacacacacacacacacacacauauauaca

SEQ ID NO: 41578 - RNA, 64 nt, Homo Sapiens
cacacacacacacacacauacauauacacacacacacacacacacacacacacacacauauaua

SEQ ID NO: 41579 - RNA, 64 nt, Homo Sapiens
cacacacacacacacacacauacauauacacacacacacacacacacacacacacacacauaua

SEQ ID NO: 41580 - RNA, 64 nt, Homo Sapiens
cacacacacacacacacacauauacauauacacacacacacacacacacacacacacacacaua

SEQ ID NO: 41581 - RNA, 64 nt, Homo Sapiens
cacacacacacacacacacauauauacauauacacacacacacacacacacacacacacacaca

SEQ ID NO: 41582 - RNA, 64 nt, Homo Sapiens
cacacacacacacacacacacauauauacauauacacacacacacacacacacacacacacaca

SEQ ID NO: 41583 - RNA, 64 nt, Homo Sapiens
uauacauauacacacacacacacacacacacacacacacacauauauauauauauauauacaca

SEQ ID NO: 41584 - RNA, 64 nt, Homo Sapiens
uauauacauauacacacacacacacacacacacacacacacacauauauauauauauauauaca

SEQ ID NO: 41585 - RNA, 64 nt, Homo Sapiens
cauauauacauauacacacacacacacacacacacacacacacaauuauauauauauauauaua

SEQ ID NO: 41586 - RNA, 64 nt, Homo Sapiens
cacauauauacauauacacauacacacacacacacacacacacaauauuauauauauauauaua

SEQ ID NO: 41587 - RNA, 64 nt, Homo Sapiens
cacacauauauacauauacauauacacacacacacacacacacaauauauuauauauauauaua

SEQ ID NO: 41588 - RNA, 64 nt, Homo Sapiens
cacacacauauauacauauauauauacacacacacacacacacaauauauauuauauauauaua

SEQ ID NO: 41589 - RNA, 64 nt, Homo Sapiens
cacacacacauauauacauauauauauacacacacacacacacaauauauauauuauauauaua

SEQ ID NO: 41590 - RNA, 64 nt, Homo Sapiens
cacacacacacauauauacauauauauauacacacacacacacaauauauauauauuauauaua

SEQ ID NO: 41591 - RNA, 64 nt, Homo Sapiens
cacacacacacacauauauauauauauauauacacacacacacaauauauauauauauuauaua

SEQ ID NO: 41592 - RNA, 64 nt, Homo Sapiens
cacacacacacacacauauauauauauauauauacacacacacaauauauauauauauauuaua

SEQ ID NO: 41593 - RNA, 64 nt, Homo Sapiens
uucuacccaauucucaccuacacgcaugcccuuucacacacacuuauggcaccaacaucacaug

SEQ ID NO: 41594 - RNA, 64 nt, Homo Sapiens
cacagugacaacacacaccagacggugaugaugucacacacagacgcggcgauggcaucacaca

SEQ ID NO: 41595 - RNA, 64 nt, Homo Sapiens
auauguauauauaguauauauauauacacacacacacacacaauacacacuauauauauauaua

SEQ ID NO: 41596 - RNA, 64 nt, Homo Sapiens
auauauguauauauaguauauauauauacacacacacacacacauaacacacuauauauauaua

SEQ ID NO: 41597 - RNA, 64 nt, Homo Sapiens
caauauauguauauauaguauauauauauacacacacacacacacauaacacacuauauauaua

SEQ ID NO: 41598 - RNA, 64 nt, Homo Sapiens
cacaauauauguauauauaguauauauauauacacacacacacauacauaacacacuauauaua

SEQ ID NO: 41599 - RNA, 64 nt, Homo Sapiens
cacacaauauauguauauauuauauauauauauacacacacacaacuacauaacacacuauaua

SEQ ID NO: 41600 - RNA, 64 nt, Homo Sapiens
auauacauauaguguauauacacacacacacacacacacacacucugguuauauuccaccauaa

SEQ ID NO: 41601 - RNA, 64 nt, Homo Sapiens
cuauauacauauaguguauaaacacacacacacacacacacacaaacugguuauauuccaccau

SEQ ID NO: 41602 - RNA, 64 nt, Homo Sapiens
cacuauauacauauaguguaauaacacacacacacacacacacaggaacugguuauauuccacc

SEQ ID NO: 41603 - RNA, 64 nt, Homo Sapiens
cacacuauauacauauagugccauaacacacacacacacacacauaggaacugguuauauucca

SEQ ID NO: 41604 - RNA, 64 nt, Homo Sapiens
cacacacuauauacauauagcaccauaacacacacacacacacacauaggaacugguuauauuc

SEQ ID NO: 41605 - RNA, 64 nt, Homo Sapiens
cacacacacuauauacauauuccaccauaacacacacacacacauacauaggaacugguuauau

SEQ ID NO: 41606 - RNA, 64 nt, Homo Sapiens
cacacacacacuauauacauauuccaccauaacacacacacacacauacauaggaacugguuau

SEQ ID NO: 41607 - RNA, 64 nt, Homo Sapiens
cacacacacacacuauauacauauuccaccauaacacacacacacacauacauaggaacugguu

SEQ ID NO: 41608 - RNA, 64 nt, Homo Sapiens
augcauuuaauaaagaugagcacacacacacacacacacacacggcuauacacacacacacaca

SEQ ID NO: 41609 - RNA, 64 nt, Homo Sapiens
cgaugcauuuaauaaagaugcacacacacacacacacacacacagugcuauacacacacacaca

SEQ ID NO: 41610 - RNA, 64 nt, Homo Sapiens
cacgaugcauuuaauaaagacacacacacacacacacacacacaaugugcuauacacacacaca

SEQ ID NO: 41611 - RNA, 64 nt, Homo Sapiens
cacacgaugcauuuaauaaacacacacacacacacacacacacaguaugugcuauacacacaca

SEQ ID NO: 41612 - RNA, 64 nt, Homo Sapiens
cacacacgaugcauuuaauacacacacacacacacacacacacaaaguaugugcuauacacaca

SEQ ID NO: 41613 - RNA, 64 nt, Homo Sapiens
cacacacacgaugcauuuaacacacacacacacacacacacacaugaaguaugugcuauacaca

SEQ ID NO: 41614 - RNA, 64 nt, Homo Sapiens
cacacacacacgaugcauuucacacacacacacacacacacacaccugaaguaugugcuauaca

SEQ ID NO: 41615 - RNA, 64 nt, Homo Sapiens
cacacacacacacgaugcaucacacacacacacacacacacacaagccugaaguaugugcuaua

SEQ ID NO: 41616 - RNA, 64 nt, Homo Sapiens
cacacacacacacacgaugcuacacacacacacacacacacacacaagccugaaguaugugcua

SEQ ID NO: 41617 - RNA, 64 nt, Homo Sapiens
cacacacacacacacacgauuauacacacacacacacacacacacgcaagccugaaguaugugc

SEQ ID NO: 41618 - RNA, 64 nt, Homo Sapiens
cacacacacacacacacacggcuauacacacacacacacacacagccgcaagccugaaguaugu

SEQ ID NO: 41619 - RNA, 64 nt, Homo Sapiens
cacacacacacacacacacagugcuauacacacacacacacacagugccgcaagccugaaguau

SEQ ID NO: 41620 - RNA, 64 nt, Homo Sapiens
cacacacacacacacacacaaugugcuauacacacacacacacauggugccgcaagccugaagu

SEQ ID NO: 41621 - RNA, 64 nt, Homo Sapiens
cacacacacacacacacacaguaugugcuauacacacacacacagguggugccgcaagccugaa

SEQ ID NO: 41622 - RNA, 63 nt, Homo Sapiens
cacacacacacacacacacaaguaugugcuauacacacacacaggguggugccgcaagccuga

SEQ ID NO: 41623 - RNA, 64 nt, Homo Sapiens
uuguacgggguggggaggggaaaacaaaaaaccacacacacauuuguuaaaaaacaaaaaacaa

SEQ ID NO: 41624 - RNA, 64 nt, Homo Sapiens
uuuuguacgggguggggaggaaaaaacaaaaaaccacacacacacuuguuaaaaaacaaaaaac

SEQ ID NO: 41625 - RNA, 64 nt, Homo Sapiens
uguguccaccccuucuguucuguccuuucagacacacacacaccgucaaugggccaauccucuc

SEQ ID NO: 41626 - RNA, 64 nt, Homo Sapiens
ccuguguccaccccuucuguucuguccuuucagacacacacacaaugucaaugggccaauccuc

SEQ ID NO: 41627 - RNA, 64 nt, Homo Sapiens
guucacccucccggguggcucacacacucucauucacacacacaaaucucaggaacaaacgguc

SEQ ID NO: 41628 - RNA, 64 nt, Homo Sapiens
ucacccucccggguggcucacacacucucauucacacacacaaaucucaggaacaaacgguccc

SEQ ID NO: 41629 - RNA, 64 nt, Homo Sapiens
acccagagacagcacauacgugugcacacgcaugcacacacacauucaguauuuuaaaagaaug

SEQ ID NO: 41630 - RNA, 64 nt, Homo Sapiens
ccagagacagcacauacgugugcacacgcaugcacacacacauucaguauuuuaaaagaauguu

SEQ ID NO: 41631 - RNA, 64 nt, Homo Sapiens
agugaagauaugcgugcacgcacagacagacagacacacacacacacacacacacacacacaca

SEQ ID NO: 41632 - RNA, 64 nt, Homo Sapiens
ugaagauaugcgugcacgcacagacagacagacacacacacacacacacacacacacacacaca

SEQ ID NO: 41633 - RNA, 64 nt, Homo Sapiens
aagauaugcgugcacgcacagacagacagacacacacacacacacacacacacacacacacaca

SEQ ID NO: 41634 - RNA, 64 nt, Homo Sapiens
gauaugcgugcacgcacagacagacagacacacacacacacacacacacacacacacacacaca

SEQ ID NO: 41635 - RNA, 64 nt, Homo Sapiens
uaugcgugcacgcacagacagacagacacacacacacacacacacacacacacacacacacaca

SEQ ID NO: 41636 - RNA, 64 nt, Homo Sapiens
ugcgugcacgcacagacagacagacacacacacacacacacacacacacacacacacacacaca

SEQ ID NO: 41637 - RNA, 64 nt, Homo Sapiens
cgugcacgcacagacagacagacacacacacacacacacacacacacacacacacacacacaca

SEQ ID NO: 41638 - RNA, 64 nt, Homo Sapiens
ugcacgcacagacagacagacacacacacacacacacacacacacacacacacacacacacaca

SEQ ID NO: 41639 - RNA, 64 nt, Homo Sapiens
cacgcacagacagacagacacacacacacacacacacacacacacacacacacacacacacagu

SEQ ID NO: 41640 - RNA, 64 nt, Homo Sapiens
cgcacagacagacagacacacacacacacacacacacacacacacacacacacacacacaguca

SEQ ID NO: 41641 - RNA, 64 nt, Homo Sapiens
cacagacagacagacacacacacacacacacacacacacacacacacacacacacacagucaaa

SEQ ID NO: 41642 - RNA, 64 nt, Homo Sapiens
cagacagacagacacacacacacacacacacacacacacacacacacacacacacagucaaaua

SEQ ID NO: 41643 - RNA, 64 nt, Homo Sapiens
gacagacagacacacacacacacacacacacacacacacacacacacacacacagucaaauacu

SEQ ID NO: 41644 - RNA, 64 nt, Homo Sapiens
cagacagacacacacacacacacacacacacacacacacacacacacacacagucaaauacugu

SEQ ID NO: 41645 - RNA, 64 nt, Homo Sapiens
gacagacacacacacacacacacacacacacacacacacacacacacacagucaaauacuguuc

SEQ ID NO: 41646 - RNA, 64 nt, Homo Sapiens
cagacacacacacacacacacacacacacacacacacacacacacacagucaaauacuguucuc

SEQ ID NO: 41647 - RNA, 64 nt, Homo Sapiens
gacacacacacacacacacacacacacacacacacacacacacacagucaaauacuguucucug

SEQ ID NO: 41648 - RNA, 64 nt, Homo Sapiens
cacacacacacacacacacacacacacacacacacacacacacagucaaauacuguucucugaa

SEQ ID NO: 41649 - RNA, 64 nt, Homo Sapiens
cacacacacacacacacacacacacacacacacacacacacagucaaauacuguucucugaaaa

SEQ ID NO: 41650 - RNA, 64 nt, Homo Sapiens
aacuuuccaugacaguagcauacugaugagacaacacacacacacacaaaacaacagcaacaac

SEQ ID NO: 41651 - RNA, 64 nt, Homo Sapiens
cuuuccaugacaguagcauacugaugagacaacacacacacacacaaaacaacagcaacaacaa

SEQ ID NO: 41652 - RNA, 64 nt, Homo Sapiens
uuccaugacaguagcauacugaugagacaacacacacacacacaaaacaacagcaacaacaaca

SEQ ID NO: 41653 - RNA, 64 nt, Homo Sapiens
ccaugacaguagcauacugaugagacaacacacacacacacaaaacaacagcaacaacaacaga

SEQ ID NO: 41654 - RNA, 64 nt, Homo Sapiens
gacaugcguccccucccuccccccgccaagugcucacacacaaccucacgcgcacacacacaca

SEQ ID NO: 41655 - RNA, 64 nt, Homo Sapiens
ccccccgccaagugcucacacacaaccucacgcgcacacacacacacgcagauggaggcgccuc

SEQ ID NO: 41656 - RNA, 64 nt, Homo Sapiens
ccccgccaagugcucacacacaaccucacgcgcacacacacacacgcagauggaggcgccucac

SEQ ID NO: 41657 - RNA, 64 nt, Homo Sapiens
ccgccaagugcucacacacaaccucacgcgcacacacacacacgcagauggaggcgccucacug

SEQ ID NO: 41658 - RNA, 64 nt, Homo Sapiens
gcuucuccggaucaguacaugcaugucacauuaacacacacacacacacacauauacacacaca

SEQ ID NO: 41659 - RNA, 64 nt, Homo Sapiens
uucuccggaucaguacaugcaugucacauuaacacacacacacacacacauauacacacacaca

SEQ ID NO: 41660 - RNA, 64 nt, Homo Sapiens
cuccggaucaguacaugcaugucacauuaacacacacacacacacacauauacacacacacaca

SEQ ID NO: 41661 - RNA, 64 nt, Homo Sapiens
ccggaucaguacaugcaugucacauuaacacacacacacacacacauauacacacacacacaag

SEQ ID NO: 41662 - RNA, 64 nt, Homo Sapiens
ggaucaguacaugcaugucacauuaacacacacacacacacacauauacacacacacacaagcu

SEQ ID NO: 41663 - RNA, 64 nt, Homo Sapiens
aucaguacaugcaugucacauuaacacacacacacacacacauauacacacacacacaagcucg

SEQ ID NO: 41664 - RNA, 64 nt, Homo Sapiens
augucacauuaacacacacacacacacacauauacacacacacacaagcucgaucagugugugu

SEQ ID NO: 41665 - RNA, 64 nt, Homo Sapiens
gucacauuaacacacacacacacacacauauacacacacacacaagcucgaucaguguguguag

SEQ ID NO: 41666 - RNA, 64 nt, Homo Sapiens
cacauuaacacacacacacacacacauauacacacacacacaagcucgaucaguguguguagga

SEQ ID NO: 41667 - RNA, 64 nt, Homo Sapiens
gaaucccagcugauucccugacaggagccgacuucacacacaggugacucucaggcauuggcuc

SEQ ID NO: 41668 - RNA, 64 nt, Homo Sapiens
ugaaggcaaaaacuguacuguguuucgcauuaagcacacacaucuggcccugacuucuggagau

SEQ ID NO: 41669 - RNA, 64 nt, Homo Sapiens
cgcaaaggugccucauagcauagccagcauucagcacacacaaaccuacugcccacauuugggc

SEQ ID NO: 41670 - RNA, 64 nt, Homo Sapiens
cucaugcaccugugcacacucacauccacccauacacacacacacacacacacacacacacaca

SEQ ID NO: 41671 - RNA, 64 nt, Homo Sapiens
caugcaccugugcacacucacauccacccauacacacacacacacacacacacacacacacaca

SEQ ID NO: 41672 - RNA, 64 nt, Homo Sapiens
ugcaccugugcacacucacauccacccauacacacacacacacacacacacacacacacacaca

SEQ ID NO: 41673 - RNA, 64 nt, Homo Sapiens
caccugugcacacucacauccacccauacacacacacacacacacacacacacacacacacaca

SEQ ID NO: 41674 - RNA, 64 nt, Homo Sapiens
ccugugcacacucacauccacccauacacacacacacacacacacacacacacacacacacacu

SEQ ID NO: 41675 - RNA, 64 nt, Homo Sapiens
ugugcacacucacauccacccauacacacacacacacacacacacacacacacacacacacucc

SEQ ID NO: 41676 - RNA, 64 nt, Homo Sapiens
ugcacacucacauccacccauacacacacacacacacacacacacacacacacacacacucccu

SEQ ID NO: 41677 - RNA, 64 nt, Homo Sapiens
cacacucacauccacccauacacacacacacacacacacacacacacacacacacacucccuua

SEQ ID NO: 41678 - RNA, 64 nt, Homo Sapiens
cacucacauccacccauacacacacacacacacacacacacacacacacacacacucccuuaca

SEQ ID NO: 41679 - RNA, 64 nt, Homo Sapiens
cucacauccacccauacacacacacacacacacacacacacacacacacacacucccuuacacu

SEQ ID NO: 41680 - RNA, 64 nt, Homo Sapiens
cacauccacccauacacacacacacacacacacacacacacacacacacacucccuuacacugu

SEQ ID NO: 41681 - RNA, 64 nt, Homo Sapiens
cauccacccauacacacacacacacacacacacacacacacacacacacucccuuacacuguug

SEQ ID NO: 41682 - RNA, 64 nt, Homo Sapiens
uccacccauacacacacacacacacacacacacacacacacacacacucccuuacacuguugua

SEQ ID NO: 41683 - RNA, 64 nt, Homo Sapiens
cacccauacacacacacacacacacacacacacacacacacacacucccuuacacuguuguacu

SEQ ID NO: 41684 - RNA, 64 nt, Homo Sapiens
cccauacacacacacacacacacacacacacacacacacacacucccuuacacuguuguacuuc

SEQ ID NO: 41685 - RNA, 64 nt, Homo Sapiens
cucacaggucuugccuuuaaauuaccccucccugcacacacauacacagauacacacacacaaa

SEQ ID NO: 41686 - RNA, 64 nt, Homo Sapiens
aaauuaccccucccugcacacacauacacagauacacacacacaaauauaauguaacgaucuuu

SEQ ID NO: 41687 - RNA, 64 nt, Homo Sapiens
auuaccccucccugcacacacauacacagauacacacacacaaauauaauguaacgaucuuuua

SEQ ID NO: 41688 - RNA, 64 nt, Homo Sapiens
acccuaccugcuguguuugugagaagaguaggaucacacacacaggugcaaucuugaccacacu

SEQ ID NO: 41689 - RNA, 64 nt, Homo Sapiens
ccuaccugcuguguuugugagaagaguaggaucacacacacaggugcaaucuugaccacacuua

SEQ ID NO: 41690 - RNA, 64 nt, Homo Sapiens
cccgcgucucgggagaaaccagggcugcccccaccacacacaccagggacagcacaggccacag

SEQ ID NO: 41691 - RNA, 64 nt, Homo Sapiens
uccuacugucuucaguccauccacaccccacucccacacacaguauucacacacacacacaccc

SEQ ID NO: 41692 - RNA, 64 nt, Homo Sapiens
cccacaccccacucccacacuggccauucacacacacacacaccccaugcucaggccuuagguc

SEQ ID NO: 41693 - RNA, 64 nt, Homo Sapiens
cccccacaccccacucccacucuggccauucacacacacacacaauccaugcucaggccuuagg

SEQ ID NO: 41694 - RNA, 64 nt, Homo Sapiens
cacccccacaccccacucccggucuggccauucacacacacacaccauccaugcucaggccuua

SEQ ID NO: 41695 - RNA, 64 nt, Homo Sapiens
cacacccccacaccccacucuaggucuggccauucacacacacaucccauccaugcucaggccu

SEQ ID NO: 41696 - RNA, 64 nt, Homo Sapiens
auuuuaggaagugguucucccacacacacacacacacacacaccauaaacuugaacauguaaca

SEQ ID NO: 41697 - RNA, 64 nt, Homo Sapiens
ccauuuuaggaagugguucucacacacacacacacacacacacauaauaaacuugaacauguaa

SEQ ID NO: 41698 - RNA, 64 nt, Homo Sapiens
caccauuuuaggaagugguuaacacacacacacacacacacacaacuaauaaacuugaacaugu

SEQ ID NO: 41699 - RNA, 64 nt, Homo Sapiens
cacaccauuuuaggaaguggguaacacacacacacacacacacaugacuaauaaacuugaacau

SEQ ID NO: 41700 - RNA, 64 nt, Homo Sapiens
cacacaccauuuuaggaaguauguaacacacacacacacacacaaaugacuaauaaacuugaac

SEQ ID NO: 41701 - RNA, 64 nt, Homo Sapiens
cacacacaccauuuuaggaaacauguaacacacacacacacacacuaaugacuaauaaacuuga

SEQ ID NO: 41702 - RNA, 64 nt, Homo Sapiens
cacacacacaccauuuuagggaacauguaacacacacacacacacccuaaugacuaauaaacuu

SEQ ID NO: 41703 - RNA, 64 nt, Homo Sapiens
cacacacacacaccauuuuauugaacauguaacacacacacacauccccuaaugacuaauaaac

SEQ ID NO: 41704 - RNA, 64 nt, Homo Sapiens
cacacacacacacaccauuuacuugaacauguaacacacacacaaguccccuaaugacuaauaa

SEQ ID NO: 41705 - RNA, 64 nt, Homo Sapiens
cacauacaauccauauacauuauacacacacacacacacacauaggaaugcaaauauauauaua

SEQ ID NO: 41706 - RNA, 64 nt, Homo Sapiens
uacacauacaauccauauacuauauacacacacacacacacacaggggaaugcaaauauauaua

SEQ ID NO: 41707 - RNA, 64 nt, Homo Sapiens
cauacacauacaauccauauuauauauacacacacacacacacauuggggaaugcaaauauaua

SEQ ID NO: 41708 - RNA, 64 nt, Homo Sapiens
cacauacacauacaauccauuauauauauacacacacacacacaauuuggggaaugcaaauaua

SEQ ID NO: 41709 - RNA, 64 nt, Homo Sapiens
cacacauacacauacaauccuauauauauauacacacacacacaaaauuuggggaaugcaaaua

SEQ ID NO: 41710 - RNA, 64 nt, Homo Sapiens
cacacacauacacauacaauuauauauauauauacacacacacauuaaauuuggggaaugcaaa

SEQ ID NO: 41711 - RNA, 64 nt, Homo Sapiens
gacacggcaccauucugccucacacacacacacacacacacagacucucucucacacacacaca

SEQ ID NO: 41712 - RNA, 64 nt, Homo Sapiens
gagacacggcaccauucugccacacacacacacacacacacacacucucucucucacacacaca

SEQ ID NO: 41713 - RNA, 64 nt, Homo Sapiens
cagagacacggcaccauucucacacacacacacacacacacacacucucucucucucacacaca

SEQ ID NO: 41714 - RNA, 64 nt, Homo Sapiens
cacagagacacggcaccauucacacacacacacacacacacacacucucucucucucucacaca

SEQ ID NO: 41715 - RNA, 64 nt, Homo Sapiens
cacacagagacacggcaccacacacacacacacacacacacacacucucucucucucucucaca

SEQ ID NO: 41716 - RNA, 64 nt, Homo Sapiens
cacacacagagacacggcaccacacacacacacacacacacacacucucucucucucucucuca

SEQ ID NO: 41717 - RNA, 64 nt, Homo Sapiens
cacacacacagagacacggccacacacacacacacacacacacauucucucucucucucucucu

SEQ ID NO: 41718 - RNA, 64 nt, Homo Sapiens
cacacacacacagagacacgcucacacacacacacacacacacacuuucucucucucucucucu

SEQ ID NO: 41719 - RNA, 64 nt, Homo Sapiens
cacacacacacacagagacacucucacacacacacacacacacacucuuucucucucucucucu

SEQ ID NO: 41720 - RNA, 64 nt, Homo Sapiens
cacacacacacacacagagacucucucacacacacacacacacacacucuuucucucucucucu

SEQ ID NO: 41721 - RNA, 64 nt, Homo Sapiens
cacacacacacacacacagacucucucucacacacacacacacaugcacucuuucucucucucu

SEQ ID NO: 41722 - RNA, 64 nt, Homo Sapiens
cacacacacacacacacacacucucucucucacacacacacacaugugcacucuuucucucucu

SEQ ID NO: 41723 - RNA, 64 nt, Homo Sapiens
cacacacacacacacacacacucucucucucucacacacacacaagugugcacucuuucucucu

SEQ ID NO: 41724 - RNA, 64 nt, Homo Sapiens
cacacacacacacacacacacucucucucucucucacacacacaauagugugcacucuuucucu

SEQ ID NO: 41725 - RNA, 64 nt, Homo Sapiens
ucacaagaucuguuagaaaucacgcguuuacacacacacacauaauuugauuuguacuuagaca

SEQ ID NO: 41726 - RNA, 64 nt, Homo Sapiens
uaucacaagaucuguuagaacacacgcguuuacacacacacacagaauuugauuuguacuuaga

SEQ ID NO: 41727 - RNA, 64 nt, Homo Sapiens
cauaucacaagaucuguuaggacacacgcguuuacacacacacagugaauuugauuuguacuua

SEQ ID NO: 41728 - RNA, 64 nt, Homo Sapiens
aucauuaucaucaucaucaucggaaacacacacacacacacaucgagcagaguauguggauacc

SEQ ID NO: 41729 - RNA, 64 nt, Homo Sapiens
ucaucauuaucaucaucauccccggaaacacacacacacacacaaagagcagaguauguggaua

SEQ ID NO: 41730 - RNA, 64 nt, Homo Sapiens
caucaucauuaucaucaucauacccggaaacacacacacacacaggaagagcagaguaugugga

SEQ ID NO: 41731 - RNA, 64 nt, Homo Sapiens
cacaucaucauuaucaucaugauacccggaaacacacacacacagaggaagagcagaguaugug

SEQ ID NO: 41732 - RNA, 64 nt, Homo Sapiens
cacacaucaucauuaucaucuggauacccggaaacacacacacagugaggaagagcagaguaug

SEQ ID NO: 41733 - RNA, 64 nt, Homo Sapiens
cuaacuaguaucuucuugaacacacacacacacacacacacaccgauucuuguguacacacaca

SEQ ID NO: 41734 - RNA, 64 nt, Homo Sapiens
cccuaacuaguaucuucuugcacacacacacacacacacacacaaagauucuuguguacacaca

SEQ ID NO: 41735 - RNA, 64 nt, Homo Sapiens
cacccuaacuaguaucuucucacacacacacacacacacacacaucaagauucuuguguacaca

SEQ ID NO: 41736 - RNA, 64 nt, Homo Sapiens
cacacccuaacuaguaucuucacacacacacacacacacacacagcucaagauucuuguguaca

SEQ ID NO: 41737 - RNA, 64 nt, Homo Sapiens
cacacacccuaacuaguauccacacacacacacacacacacacagggcucaagauucuugugua

SEQ ID NO: 41738 - RNA, 64 nt, Homo Sapiens
cacacacacccuaacuaguauacacacacacacacacacacacacugggcucaagauucuugug

SEQ ID NO: 41739 - RNA, 64 nt, Homo Sapiens
cacacacacacccuaacuaguguacacacacacacacacacacacucugggcucaagauucuug

SEQ ID NO: 41740 - RNA, 64 nt, Homo Sapiens
cacacacacacacccuaacuuguguacacacacacacacacacacucucugggcucaagauucu

SEQ ID NO: 41741 - RNA, 64 nt, Homo Sapiens
cacacacacacacacccuaacuuguguacacacacacacacacacacucucugggcucaagauu

SEQ ID NO: 41742 - RNA, 64 nt, Homo Sapiens
cacacacacacacacacccuuucuuguguacacacacacacacacacacucucugggcucaaga

SEQ ID NO: 41743 - RNA, 64 nt, Homo Sapiens
cacacacacacacacacaccgauucuuguguacacacacacacagacacacucucugggcucaa

SEQ ID NO: 41744 - RNA, 64 nt, Homo Sapiens
cacacacacacacacacacaaagauucuuguguacacacacacacagacacacucucugggcuc

SEQ ID NO: 41745 - RNA, 64 nt, Homo Sapiens
uacaguauaaauacucauuuuauauauauauacacacacacauauacgugcagauuaauuuaua

SEQ ID NO: 41746 - RNA, 64 nt, Homo Sapiens
uauacaguauaaauacucauuauauauauauauacacacacacauauacgugcagauuaauuua

SEQ ID NO: 41747 - RNA, 64 nt, Homo Sapiens
cucucucccuggacauacgugcacuuguaaaccacacacacagcggggcuucccuggugcugca

SEQ ID NO: 41748 - RNA, 64 nt, Homo Sapiens
gccucucucccuggacauaccagcacuuguaaaccacacacacaguggggcuucccuggugcug

SEQ ID NO: 41749 - RNA, 64 nt, Homo Sapiens
cgugcaugcacacuccucgcacugcacacaugcacacacacacgcacacaagugcacagagcac

SEQ ID NO: 41750 - RNA, 64 nt, Homo Sapiens
cgcgugcaugcacacuccucacacugcacacaugcacacacacacacacacaagugcacagagc

SEQ ID NO: 41751 - RNA, 64 nt, Homo Sapiens
ugcacagagcacacugcacacacagaccacacagcacacacaagacagcacaugcacacaggug

SEQ ID NO: 41752 - RNA, 64 nt, Homo Sapiens
gugcauaggccacacagcacagcacuaacacaugcacacacaaacaagugcacagaccacacac

SEQ ID NO: 41753 - RNA, 64 nt, Homo Sapiens
acuaacacaugcacacacaaacaagugcacagaccacacacagccacacacaguauacacauac

SEQ ID NO: 41754 - RNA, 64 nt, Homo Sapiens
auacacauacacaagugcacacacacguguagcucacacacaguugcacagaucacacacaugc

SEQ ID NO: 41755 - RNA, 64 nt, Homo Sapiens
cacacacguguagcucacacacacgugcacagaucacacacaugacacaugcacgcuuacaugu

SEQ ID NO: 41756 - RNA, 64 nt, Homo Sapiens
ugcucacauacauguccgcauacgugcccacuggcacacacacguuuguuagagugcacauccc

SEQ ID NO: 41757 - RNA, 64 nt, Homo Sapiens
uuugagaguugagcuuuaacagccauggcaauuacacacacacacaaacauacacucacacaca

SEQ ID NO: 41758 - RNA, 64 nt, Homo Sapiens
ugagaguugagcuuuaacagccauggcaauuacacacacacacaaacauacacucacacacaca

SEQ ID NO: 41759 - RNA, 64 nt, Homo Sapiens
agaguugagcuuuaacagccauggcaauuacacacacacacaaacauacacucacacacacaau

SEQ ID NO: 41760 - RNA, 64 nt, Homo Sapiens
ccauggcaauuacacacacacacaaacauacacucacacacacaauuacuauguauaacauaua

SEQ ID NO: 41761 - RNA, 64 nt, Homo Sapiens
auggcaauuacacacacacacaaacauacacucacacacacaauuacuauguauaacauauaug

SEQ ID NO: 41762 - RNA, 64 nt, Homo Sapiens
auuaaagaaacuuauuacuguugucaacugaauucacacacacacaaauauaguaccauagaaa

SEQ ID NO: 41763 - RNA, 64 nt, Homo Sapiens
uaaagaaacuuauuacuguugucaacugaauucacacacacacaaauauaguaccauagaaaaa

SEQ ID NO: 41764 - RNA, 64 nt, Homo Sapiens
aagaaacuuauuacuguugucaacugaauucacacacacacaaauauaguaccauagaaaaagu

SEQ ID NO: 41765 - RNA, 64 nt, Homo Sapiens
uguucucucucucucucucucucucucucucuaucacacacacacacacacacacacacacaca

SEQ ID NO: 41766 - RNA, 64 nt, Homo Sapiens
uucucucucucucucucucucucucucucuaucacacacacacacacacacacacacacacaca

SEQ ID NO: 41767 - RNA, 64 nt, Homo Sapiens
cucucucucucucucucucucucucucuaucacacacacacacacacacacacacacacacaca

SEQ ID NO: 41768 - RNA, 64 nt, Homo Sapiens
cucucucucucucucucucucucucuaucacacacacacacacacacacacacacacacacaca

SEQ ID NO: 41769 - RNA, 64 nt, Homo Sapiens
cucucucucucucucucucucucuaucacacacacacacacacacacacacacacacacacaca

SEQ ID NO: 41770 - RNA, 64 nt, Homo Sapiens
cucucucucucucucucucucuaucacacacacacacacacacacacacacacacacacacaau

SEQ ID NO: 41771 - RNA, 64 nt, Homo Sapiens
cucucucucucucucucucuaucacacacacacacacacacacacacacacacacacacaauuu

SEQ ID NO: 41772 - RNA, 64 nt, Homo Sapiens
cucucucucucucucucuaucacacacacacacacacacacacacacacacacacacaauuuca

SEQ ID NO: 41773 - RNA, 64 nt, Homo Sapiens
cucucucucucucucuaucacacacacacacacacacacacacacacacacacacaauuucauu

SEQ ID NO: 41774 - RNA, 64 nt, Homo Sapiens
cucucucucucucuaucacacacacacacacacacacacacacacacacacacaauuucauuca

SEQ ID NO: 41775 - RNA, 64 nt, Homo Sapiens
cucucucucucuaucacacacacacacacacacacacacacacacacacacaauuucauucaua

SEQ ID NO: 41776 - RNA, 64 nt, Homo Sapiens
cucucucucuaucacacacacacacacacacacacacacacacacacacaauuucauucauaua

SEQ ID NO: 41777 - RNA, 64 nt, Homo Sapiens
cucucucuaucacacacacacacacacacacacacacacacacacacaauuucauucauauaug

SEQ ID NO: 41778 - RNA, 64 nt, Homo Sapiens
cucucuaucacacacacacacacacacacacacacacacacacacaauuucauucauauauggu

SEQ ID NO: 41779 - RNA, 64 nt, Homo Sapiens
cucuaucacacacacacacacacacacacacacacacacacacaauuucauucauauaugguau

SEQ ID NO: 41780 - RNA, 64 nt, Homo Sapiens
cuaucacacacacacacacacacacacacacacacacacacaauuucauucauauaugguauug

SEQ ID NO: 41781 - RNA, 64 nt, Homo Sapiens
guccuucccacaccuuuguuuaggagucaucauucacacacacacacacacacacacacacaca

SEQ ID NO: 41782 - RNA, 64 nt, Homo Sapiens
ccuucccacaccuuuguuuaggagucaucauucacacacacacacacacacacacacacacaca

SEQ ID NO: 41783 - RNA, 64 nt, Homo Sapiens
uucccacaccuuuguuuaggagucaucauucacacacacacacacacacacacacacacacaca

SEQ ID NO: 41784 - RNA, 64 nt, Homo Sapiens
cccacaccuuuguuuaggagucaucauucacacacacacacacacacacacacacacacacaca

SEQ ID NO: 41785 - RNA, 64 nt, Homo Sapiens
cacaccuuuguuuaggagucaucauucacacacacacacacacacacacacacacacacacaca

SEQ ID NO: 41786 - RNA, 64 nt, Homo Sapiens
caccuuuguuuaggagucaucauucacacacacacacacacacacacacacacacacacacaca

SEQ ID NO: 41787 - RNA, 64 nt, Homo Sapiens
ccuuuguuuaggagucaucauucacacacacacacacacacacacacacacacacacacacaca

SEQ ID NO: 41788 - RNA, 64 nt, Homo Sapiens
uuuguuuaggagucaucauucacacacacacacacacacacacacacacacacacacacacaca

SEQ ID NO: 41789 - RNA, 64 nt, Homo Sapiens
uguuuaggagucaucauucacacacacacacacacacacacacacacacacacacacacacacu

SEQ ID NO: 41790 - RNA, 64 nt, Homo Sapiens
uuuaggagucaucauucacacacacacacacacacacacacacacacacacacacacacacucu

SEQ ID NO: 41791 - RNA, 64 nt, Homo Sapiens
uaggagucaucauucacacacacacacacacacacacacacacacacacacacacacacucucu

SEQ ID NO: 41792 - RNA, 64 nt, Homo Sapiens
ggagucaucauucacacacacacacacacacacacacacacacacacacacacacacucucuga

SEQ ID NO: 41793 - RNA, 64 nt, Homo Sapiens
agucaucauucacacacacacacacacacacacacacacacacacacacacacacucucugagc

SEQ ID NO: 41794 - RNA, 64 nt, Homo Sapiens
ucaucauucacacacacacacacacacacacacacacacacacacacacacacucucugagcac

SEQ ID NO: 41795 - RNA, 64 nt, Homo Sapiens
aucauucacacacacacacacacacacacacacacacacacacacacacacucucugagcacau

SEQ ID NO: 41796 - RNA, 64 nt, Homo Sapiens
cauucacacacacacacacacacacacacacacacacacacacacacacucucugagcacauua

SEQ ID NO: 41797 - RNA, 64 nt, Homo Sapiens
uucacacacacacacacacacacacacacacacacacacacacucugagcacauuaucugugau

SEQ ID NO: 41798 - RNA, 64 nt, Homo Sapiens
uaaauauuuacggauagauugcuagguagauagacacacacacaugcacacacacacaucugga

SEQ ID NO: 41799 - RNA, 64 nt, Homo Sapiens
aauauuuacggauagauugcuagguagauagacacacacacaugcacacacacacaucuggaga

SEQ ID NO: 41800 - RNA, 64 nt, Homo Sapiens
gauagauugcuagguagauagacacacacacaugcacacacacacaucuggagauggcaaaauc

SEQ ID NO: 41801 - RNA, 64 nt, Homo Sapiens
uagauugcuagguagauagacacacacacaugcacacacacacaucuggagauggcaaaauccu

SEQ ID NO: 41802 - RNA, 64 nt, Homo Sapiens
gauugcuagguagauagacacacacacaugcacacacacacaucuggagauggcaaaauccucu

SEQ ID NO: 41803 - RNA, 64 nt, Homo Sapiens
ggaaggaacuacaagagagucggagaugaugcagcacacacacaauuccccagcccagugaugc

SEQ ID NO: 41804 - RNA, 64 nt, Homo Sapiens
aaggaacuacaagagagucggagaugaugcagcacacacacaauuccccagcccagugaugcuu

SEQ ID NO: 41805 - RNA, 64 nt, Homo Sapiens
aaaaaagcagcagacaacacacuguagagucuugcacacacacaagugcccaggcaaggugcuu

SEQ ID NO: 41806 - RNA, 64 nt, Homo Sapiens
aaaagcagcagacaacacacuguagagucuugcacacacacaagugcccaggcaaggugcuugg

SEQ ID NO: 41807 - RNA, 64 nt, Homo Sapiens
guucagcugccucugcacccccucccacccccagcacacacacaaguuggcccccagcugcgcc

SEQ ID NO: 41808 - RNA, 64 nt, Homo Sapiens
ucagcugccucugcacccccucccacccccagcacacacacaaguuggcccccagcugcgccug

SEQ ID NO: 41809 - RNA, 64 nt, Homo Sapiens
ccucugcccgccccugcugccccaccaccuucugcacacacagcgguggggaggcggggaggag

SEQ ID NO: 41810 - RNA, 64 nt, Homo Sapiens
cagcaaaucacuucucucccugcgcucacacagacacacacacacacacguacaugcacacauu

SEQ ID NO: 41811 - RNA, 64 nt, Homo Sapiens
gcaaaucacuucucucccugcgcucacacagacacacacacacacacguacaugcacacauuuu

SEQ ID NO: 41812 - RNA, 64 nt, Homo Sapiens
aaaucacuucucucccugcgcucacacagacacacacacacacacguacaugcacacauuuuuc

SEQ ID NO: 41813 - RNA, 64 nt, Homo Sapiens
aucacuucucucccugcgcucacacagacacacacacacacacguacaugcacacauuuuuccu

SEQ ID NO: 41814 - RNA, 64 nt, Homo Sapiens
uugggcuuggcccucucugccugagagagcucagcacacacacagcucagacccacggacagga

SEQ ID NO: 41815 - RNA, 64 nt, Homo Sapiens
gggcuuggcccucucugccugagagagcucagcacacacacagcucagacccacggacaggacc

SEQ ID NO: 41816 - RNA, 64 nt, Homo Sapiens
acccucugugggccacacgugcacuugcacccaccacacacacacacacacacacacacacaca

SEQ ID NO: 41817 - RNA, 64 nt, Homo Sapiens
ccucugugggccacacgugcacuugcacccaccacacacacacacacacacacacacacacaca

SEQ ID NO: 41818 - RNA, 64 nt, Homo Sapiens
ucugugggccacacgugcacuugcacccaccacacacacacacacacacacacacacacacaca

SEQ ID NO: 41819 - RNA, 64 nt, Homo Sapiens
ugugggccacacgugcacuugcacccaccacacacacacacacacacacacacacacacacaga

SEQ ID NO: 41820 - RNA, 64 nt, Homo Sapiens
ugggccacacgugcacuugcacccaccacacacacacacacacacacacacacacacacagaca

SEQ ID NO: 41821 - RNA, 64 nt, Homo Sapiens
ggccacacgugcacuugcacccaccacacacacacacacacacacacacacacacacagacaca

SEQ ID NO: 41822 - RNA, 64 nt, Homo Sapiens
ccacacgugcacuugcacccaccacacacacacacacacacacacacacacacacagacacaca

SEQ ID NO: 41823 - RNA, 64 nt, Homo Sapiens
acacgugcacuugcacccaccacacacacacacacacacacacacacacacacagacacacaga

SEQ ID NO: 41824 - RNA, 64 nt, Homo Sapiens
acgugcacuugcacccaccacacacacacacacacacacacacacacacacagacacacagaca

SEQ ID NO: 41825 - RNA, 64 nt, Homo Sapiens
gugcacuugcacccaccacacacacacacacacacacacacacacacacagacacacagacaca

SEQ ID NO: 41826 - RNA, 64 nt, Homo Sapiens
gcacuugcacccaccacacacacacacacacacacacacacacacacagacacacagacacaua

SEQ ID NO: 41827 - RNA, 64 nt, Homo Sapiens
acuugcacccaccacacacacacacacacacacacacacacacacagacacacagacacauacg

SEQ ID NO: 41828 - RNA, 64 nt, Homo Sapiens
uugcacccaccacacacacacacacacacacacacacacacacagacacacagacacauacgca

SEQ ID NO: 41829 - RNA, 64 nt, Homo Sapiens
gcacccaccacacacacacacacacacacacacacacacacagacacacagacacauacgcaca

SEQ ID NO: 41830 - RNA, 64 nt, Homo Sapiens
uacgcacacacgugcacacauguacacacggauacacacacacacacacacacugcauaucuga

SEQ ID NO: 41831 - RNA, 64 nt, Homo Sapiens
cgcacacacgugcacacauguacacacggauacacacacacacacacacacugcauaucugagc

SEQ ID NO: 41832 - RNA, 64 nt, Homo Sapiens
cacacacgugcacacauguacacacggauacacacacacacacacacacugcauaucugagcgc

SEQ ID NO: 41833 - RNA, 64 nt, Homo Sapiens
cacacgugcacacauguacacacggauacacacacacacacacacacugcauaucugagcgcgc

SEQ ID NO: 41834 - RNA, 64 nt, Homo Sapiens
cacgugcacacauguacacacggauacacacacacacacacacacugcauaucugagcgcgccc

SEQ ID NO: 41835 - RNA, 64 nt, Homo Sapiens
cgugcacacauguacacacggauacacacacacacacacacacugcauaucugagcgcgccccu

SEQ ID NO: 41836 - RNA, 64 nt, Homo Sapiens
cauauauauauauauauauauauauauguguauacacacacacauagacagacauauauauaua

SEQ ID NO: 41837 - RNA, 64 nt, Homo Sapiens
uauauauauauauauauauauauauguguauacacacacacauagacagacauauauauauaua

SEQ ID NO: 41838 - RNA, 64 nt, Homo Sapiens
cguuauugugaagucuuucguagacaccccagagcacacacauccccuuaguccaccgguuaga

SEQ ID NO: 41839 - RNA, 64 nt, Homo Sapiens
gcuugcuuucuuccuccuuacccuaccccccacucacacacacacacacacacacacacacaca

SEQ ID NO: 41840 - RNA, 64 nt, Homo Sapiens
uugcuuucuuccuccuuacccuaccccccacucacacacacacacacacacacacacacacaca

SEQ ID NO: 41841 - RNA, 64 nt, Homo Sapiens
gcuuucuuccuccuuacccuaccccccacucacacacacacacacacacacacacacacacaca

SEQ ID NO: 41842 - RNA, 64 nt, Homo Sapiens
uuucuuccuccuuacccuaccccccacucacacacacacacacacacacacacacacacacaca

SEQ ID NO: 41843 - RNA, 64 nt, Homo Sapiens
ucuuccuccuuacccuaccccccacucacacacacacacacacacacacacacacacacacaca

SEQ ID NO: 41844 - RNA, 64 nt, Homo Sapiens
uuccuccuuacccuaccccccacucacacacacacacacacacacacacacacacacacacaca

SEQ ID NO: 41845 - RNA, 64 nt, Homo Sapiens
ccuccuuacccuaccccccacucacacacacacacacacacacacacacacacacacacacaca

SEQ ID NO: 41846 - RNA, 64 nt, Homo Sapiens
uccuuacccuaccccccacucacacacacacacacacacacacacacacacacacacacacacu

SEQ ID NO: 41847 - RNA, 64 nt, Homo Sapiens
cuuacccuaccccccacucacacacacacacacacacacacacacacacacacacacacacuuu

SEQ ID NO: 41848 - RNA, 64 nt, Homo Sapiens
uacccuaccccccacucacacacacacacacacacacacacacacacacacacacacacuuucu

SEQ ID NO: 41849 - RNA, 64 nt, Homo Sapiens
cccuaccccccacucacacacacacacacacacacacacacacacacacacacacacuuucuau

SEQ ID NO: 41850 - RNA, 64 nt, Homo Sapiens
cuaccccccacucacacacacacacacacacacacacacacacacacacacacacuuucuauaa

SEQ ID NO: 41851 - RNA, 64 nt, Homo Sapiens
accccccacucacacacacacacacacacacacacacacacacacacacacacuuucuauaaaa

SEQ ID NO: 41852 - RNA, 64 nt, Homo Sapiens
cccccacucacacacacacacacacacacacacacacacacacacacacacuuucuauaaaacu

SEQ ID NO: 41853 - RNA, 64 nt, Homo Sapiens
cccacucacacacacacacacacacacacacacacacacacacacacacuuucuauaaaacuug

SEQ ID NO: 41854 - RNA, 64 nt, Homo Sapiens
cacucacacacacacacacacacacacacacacacacacacacacacuuucuauaaaacuugaa

SEQ ID NO: 41855 - RNA, 64 nt, Homo Sapiens
cucacacacacacacacacacacacacacacacacacacacacacuuucuauaaaacuugaaaa

SEQ ID NO: 41856 - RNA, 64 nt, Homo Sapiens
cacacacacacacacacacacacacacacacacacacacacacuuucuauaaaacuugaaaaua

SEQ ID NO: 41857 - RNA, 64 nt, Homo Sapiens
gaccacuucucugugucaucacacauacccacuucacacacacacaucccaaauaccaccacca

SEQ ID NO: 41858 - RNA, 64 nt, Homo Sapiens
ccacuucucugugucaucacacauacccacuucacacacacacaucccaaauaccaccaccaac

SEQ ID NO: 41859 - RNA, 64 nt, Homo Sapiens
acuucucugugucaucacacauacccacuucacacacacacaucccaaauaccaccaccaacca

SEQ ID NO: 41860 - RNA, 64 nt, Homo Sapiens
uuucuucuguccaaacaaacaaacaaaaacuaaacacacacacaaacccccagaaacccacaau

SEQ ID NO: 41861 - RNA, 64 nt, Homo Sapiens
ucuucuguccaaacaaacaaacaaaaacuaaacacacacacaaacccccagaaacccacaauau

SEQ ID NO: 41862 - RNA, 64 nt, Homo Sapiens
aaaagagaaaaaacauaacaaacaaaaaaacacacacacacaaaaaaaaaacaaaaaaacaaaa

SEQ ID NO: 41863 - RNA, 64 nt, Homo Sapiens
aaaaaagagaaaaaacauaaaaaacaaaaaaacacacacacacacaaaaaaaacaaaaaaacaa

SEQ ID NO: 41864 - RNA, 64 nt, Homo Sapiens
caaaaaaagagaaaaaacauaaaaaacaaaaaaacacacacacaaacaaaaaaaacaaaaaaac

SEQ ID NO: 41865 - RNA, 64 nt, Homo Sapiens
agcucuuucuauuuauaauaauguuuauaggacacacacacaaacaagaggauuuaagggagga

SEQ ID NO: 41866 - RNA, 64 nt, Homo Sapiens
aaagcucuuucuauuuauaagaauguuuauaggacacacacacacacaagaggauuuaagggag

SEQ ID NO: 41867 - RNA, 64 nt, Homo Sapiens
cacccacccacaccaggucgccuccucccauccacacacacagggccuuacauccccuucuagc

SEQ ID NO: 41868 - RNA, 64 nt, Homo Sapiens
ggcacccacccacaccaggugcccuccucccauccacacacacacugccuuacauccccuucua

SEQ ID NO: 41869 - RNA, 64 nt, Homo Sapiens
uugugagaucuucagcuaccucauggugcaauaacacacacacgcuuaaccauguugauggcac

SEQ ID NO: 41870 - RNA, 64 nt, Homo Sapiens
uaaauucuugugaaaaaaccuguguuuuuaguuacacacacacacacacacacaccuacuuaaa

SEQ ID NO: 41871 - RNA, 64 nt, Homo Sapiens
aauucuugugaaaaaaccuguguuuuuaguuacacacacacacacacacacaccuacuuaaaug

SEQ ID NO: 41872 - RNA, 64 nt, Homo Sapiens
uucuugugaaaaaaccuguguuuuuaguuacacacacacacacacacacaccuacuuaaaugga

SEQ ID NO: 41873 - RNA, 64 nt, Homo Sapiens
cuugugaaaaaaccuguguuuuuaguuacacacacacacacacacacaccuacuuaaauggaau

SEQ ID NO: 41874 - RNA, 64 nt, Homo Sapiens
ugugaaaaaaccuguguuuuuaguuacacacacacacacacacacaccuacuuaaauggaaucu

SEQ ID NO: 41875 - RNA, 64 nt, Homo Sapiens
ugaaaaaaccuguguuuuuaguuacacacacacacacacacacaccuacuuaaauggaaucuaa

SEQ ID NO: 41876 - RNA, 64 nt, Homo Sapiens
aaaaaaccuguguuuuuaguuacacacacacacacacacacaccuacuuaaauggaaucuaaac

SEQ ID NO: 41877 - RNA, 64 nt, Homo Sapiens
ugcucuucaucauauauauaguuaugcauacauacacacacacacauacaguauauucuuuccu

SEQ ID NO: 41878 - RNA, 64 nt, Homo Sapiens
cucuucaucauauauauaguuaugcauacauacacacacacacauacaguauauucuuuccuca

SEQ ID NO: 41879 - RNA, 64 nt, Homo Sapiens
cuucaucauauauauaguuaugcauacauacacacacacacauacaguauauucuuuccucaaa

SEQ ID NO: 41880 - RNA, 64 nt, Homo Sapiens
ucugaagggcauacaaugaaaagugaaggggaaacacacacacacaaaaaaacaaguauuuggc

SEQ ID NO: 41881 - RNA, 64 nt, Homo Sapiens
ugaagggcauacaaugaaaagugaaggggaaacacacacacacaaaaaaacaaguauuuggcuu

SEQ ID NO: 41882 - RNA, 64 nt, Homo Sapiens
aagggcauacaaugaaaagugaaggggaaacacacacacacaaaaaaacaaguauuuggcuugu

SEQ ID NO: 41883 - RNA, 64 nt, Homo Sapiens
cuuaccaaagcagacgcgugcgcgugcacagaugcacacacacagaugucuuaaaagacuagaa

SEQ ID NO: 41884 - RNA, 64 nt, Homo Sapiens
uaccaaagcagacgcgugcgcgugcacagaugcacacacacagaugucuuaaaagacuagaauc

SEQ ID NO: 41885 - RNA, 64 nt, Homo Sapiens
uuugacuaauucugguacugaaaaguuagcuauacacacacacacacacacacacacacacaca

SEQ ID NO: 41886 - RNA, 64 nt, Homo Sapiens
ugacuaauucugguacugaaaaguuagcuauacacacacacacacacacacacacacacacaca

SEQ ID NO: 41887 - RNA, 64 nt, Homo Sapiens
acuaauucugguacugaaaaguuagcuauacacacacacacacacacacacacacacacacaca

SEQ ID NO: 41888 - RNA, 64 nt, Homo Sapiens
uaauucugguacugaaaaguuagcuauacacacacacacacacacacacacacacacacacaca

SEQ ID NO: 41889 - RNA, 64 nt, Homo Sapiens
auucugguacugaaaaguuagcuauacacacacacacacacacacacacacacacacacacaca

SEQ ID NO: 41890 - RNA, 64 nt, Homo Sapiens
ucugguacugaaaaguuagcuauacacacacacacacacacacacacacacacacacacacaca

SEQ ID NO: 41891 - RNA, 64 nt, Homo Sapiens
ugguacugaaaaguuagcuauacacacacacacacacacacacacacacacacacacacacaca

SEQ ID NO: 41892 - RNA, 64 nt, Homo Sapiens
gcuauacacacacacacacacacacacacacacacacacacacacacacacacacacacacaca

SEQ ID NO: 41893 - RNA, 64 nt, Homo Sapiens
uauacacacacacacacacacacacacacacacacacacacacacacacacacacacacacaaa

SEQ ID NO: 41894 - RNA, 64 nt, Homo Sapiens
uacacacacacacacacacacacacacacacacacacacacacacacacacacacacacaaacu

SEQ ID NO: 41895 - RNA, 64 nt, Homo Sapiens
cacacacacacacacacacacacacacacacacacacacacacacacacacacacacaaacuuc

SEQ ID NO: 41896 - RNA, 64 nt, Homo Sapiens
cacacacacacacacacacacacacacacacacacacacacacacacacacacacaaacuucaa

SEQ ID NO: 41897 - RNA, 64 nt, Homo Sapiens
cacacacacacacacacacacacacacacacacacacacacacacacacacacaaacuucaaaa

SEQ ID NO: 41898 - RNA, 64 nt, Homo Sapiens
cacacacacacacacacacacacacacacacacacacacacacacacacacaaacuucaaaaau

SEQ ID NO: 41899 - RNA, 64 nt, Homo Sapiens
cacacacacacacacacacacacacacacacacacacacacacacacacaaacuucaaaaaugc

SEQ ID NO: 41900 - RNA, 64 nt, Homo Sapiens
cacacacacacacacacacacacacacacacacacacacacacacacaaacuucaaaaaugcuu

SEQ ID NO: 41901 - RNA, 64 nt, Homo Sapiens
cacacacacacacacacacacacacacacacacacacacacacacaaacuucaaaaaugcuuaa

SEQ ID NO: 41902 - RNA, 64 nt, Homo Sapiens
cacacacacacacacacacacacacacacacacacacacacacaaacuucaaaaaugcuuaacc

SEQ ID NO: 41903 - RNA, 64 nt, Homo Sapiens
cacacacacacacacacacacacacacacacacacacacacaaacuucaaaaaugcuuaaccau

SEQ ID NO: 41904 - RNA, 64 nt, Homo Sapiens
aguguuuaauuuccgauuuuuuccucugcauuuacacacacaccacacacgcacacacacacac

SEQ ID NO: 41905 - RNA, 64 nt, Homo Sapiens
uuuuuccucugcauuuacacacacaccacacacgcacacacacacaccaaguaccaguauaagc

SEQ ID NO: 41906 - RNA, 64 nt, Homo Sapiens
uuuccucugcauuuacacacacaccacacacgcacacacacacaccaaguaccaguauaagcau

SEQ ID NO: 41907 - RNA, 64 nt, Homo Sapiens
uccucugcauuuacacacacaccacacacgcacacacacacaccaaguaccaguauaagcaucu

SEQ ID NO: 41908 - RNA, 64 nt, Homo Sapiens
aguguuuaauuucagacuuuuuccucugcauuuacacacacacacacacacacacgcacacaca

SEQ ID NO: 41909 - RNA, 64 nt, Homo Sapiens
uguuuaauuucagacuuuuuccucugcauuuacacacacacacacacacacacgcacacacaca

SEQ ID NO: 41910 - RNA, 64 nt, Homo Sapiens
uuuaauuucagacuuuuuccucugcauuuacacacacacacacacacacacgcacacacacaca

SEQ ID NO: 41911 - RNA, 64 nt, Homo Sapiens
uaauuucagacuuuuuccucugcauuuacacacacacacacacacacacgcacacacacacacc

SEQ ID NO: 41912 - RNA, 64 nt, Homo Sapiens
auuucagacuuuuuccucugcauuuacacacacacacacacacacacgcacacacacacaccaa

SEQ ID NO: 41913 - RNA, 64 nt, Homo Sapiens
uucagacuuuuuccucugcauuuacacacacacacacacacacacgcacacacacacaccaagu

SEQ ID NO: 41914 - RNA, 64 nt, Homo Sapiens
cagacuuuuuccucugcauuuacacacacacacacacacacacgcacacacacacaccaaguac

SEQ ID NO: 41915 - RNA, 64 nt, Homo Sapiens
ccucugcauuuacacacacacacacacacacacgcacacacacacaccaaguaccaguauaagc

SEQ ID NO: 41916 - RNA, 64 nt, Homo Sapiens
ucugcauuuacacacacacacacacacacacgcacacacacacaccaaguaccaguauaagcau

SEQ ID NO: 41917 - RNA, 64 nt, Homo Sapiens
ugcauuuacacacacacacacacacacacgcacacacacacaccaaguaccaguauaagcaucu

SEQ ID NO: 41918 - RNA, 64 nt, Homo Sapiens
ugacccccuccauccuugacccccaacaccucaacacacacacacacacacacacacaaaauca

SEQ ID NO: 41919 - RNA, 64 nt, Homo Sapiens
acccccuccauccuugacccccaacaccucaacacacacacacacacacacacacaaaaucaca

SEQ ID NO: 41920 - RNA, 64 nt, Homo Sapiens
ccccuccauccuugacccccaacaccucaacacacacacacacacacacacacaaaaucacacc

SEQ ID NO: 41921 - RNA, 64 nt, Homo Sapiens
ccuccauccuugacccccaacaccucaacacacacacacacacacacacacaaaaucacaccau

SEQ ID NO: 41922 - RNA, 64 nt, Homo Sapiens
uccauccuugacccccaacaccucaacacacacacacacacacacacacaaaaucacaccauuu

SEQ ID NO: 41923 - RNA, 64 nt, Homo Sapiens
cauccuugacccccaacaccucaacacacacacacacacacacacacaaaaucacaccauuuuc

SEQ ID NO: 41924 - RNA, 64 nt, Homo Sapiens
uccuugacccccaacaccucaacacacacacacacacacacacacaaaaucacaccauuuucau

SEQ ID NO: 41925 - RNA, 64 nt, Homo Sapiens
cuugacccccaacaccucaacacacacacacacacacacacacaaaaucacaccauuuucaugc

SEQ ID NO: 41926 - RNA, 64 nt, Homo Sapiens
ugacccccaacaccucaacacacacacacacacacacacacaaaaucacaccauuuucaugccu

SEQ ID NO: 41927 - RNA, 64 nt, Homo Sapiens
cagacuucuuccucugcauuuacacaccacacaacacacacacacacacacacacaccaaguac

SEQ ID NO: 41928 - RNA, 64 nt, Homo Sapiens
gacuucuuccucugcauuuacacaccacacaacacacacacacacacacacacaccaaguacca

SEQ ID NO: 41929 - RNA, 64 nt, Homo Sapiens
cuucuuccucugcauuuacacaccacacaacacacacacacacacacacacaccaaguaccauu

SEQ ID NO: 41930 - RNA, 64 nt, Homo Sapiens
ucuuccucugcauuuacacaccacacaacacacacacacacacacacacaccaaguaccauuau

SEQ ID NO: 41931 - RNA, 64 nt, Homo Sapiens
uuccucugcauuuacacaccacacaacacacacacacacacacacacaccaaguaccauuauaa

SEQ ID NO: 41932 - RNA, 64 nt, Homo Sapiens
ccucugcauuuacacaccacacaacacacacacacacacacacacaccaaguaccauuauaagc

SEQ ID NO: 41933 - RNA, 64 nt, Homo Sapiens
ucugcauuuacacaccacacaacacacacacacacacacacacaccaaguaccauuauaagcau

SEQ ID NO: 41934 - RNA, 64 nt, Homo Sapiens
ugcauuuacacaccacacaacacacacacacacacacacacaccaaguaccauuauaagcaucu

SEQ ID NO: 41935 - RNA, 64 nt, Homo Sapiens
aguguuuaauuucagauuuuuuccucugcauuuacacacacacgcacacaaaccacaccacaca

SEQ ID NO: 41936 - RNA, 64 nt, Homo Sapiens
ucugcauuuacacacacacgcacacaaaccacaccacacacacacacacacacacacacacaca

SEQ ID NO: 41937 - RNA, 64 nt, Homo Sapiens
ugcauuuacacacacacgcacacaaaccacaccacacacacacacacacacacacacacacaca

SEQ ID NO: 41938 - RNA, 64 nt, Homo Sapiens
cauuuacacacacacgcacacaaaccacaccacacacacacacacacacacacacacacacaca

SEQ ID NO: 41939 - RNA, 64 nt, Homo Sapiens
uuuacacacacacgcacacaaaccacaccacacacacacacacacacacacacacacacacaca

SEQ ID NO: 41940 - RNA, 64 nt, Homo Sapiens
uacacacacacgcacacaaaccacaccacacacacacacacacacacacacacacacacacaca

SEQ ID NO: 41941 - RNA, 64 nt, Homo Sapiens
cacacacacgcacacaaaccacaccacacacacacacacacacacacacacacacacacacaca

SEQ ID NO: 41942 - RNA, 64 nt, Homo Sapiens
cacacacgcacacaaaccacaccacacacacacacacacacacacacacacacacacacacaca

SEQ ID NO: 41943 - RNA, 64 nt, Homo Sapiens
cacacgcacacaaaccacaccacacacacacacacacacacacacacacacacacacacacaca

SEQ ID NO: 41944 - RNA, 64 nt, Homo Sapiens
cacgcacacaaaccacaccacacacacacacacacacacacacacacacacacacacacacaca

SEQ ID NO: 41945 - RNA, 64 nt, Homo Sapiens
cgcacacaaaccacaccacacacacacacacacacacacacacacacacacacacacacacacc

SEQ ID NO: 41946 - RNA, 64 nt, Homo Sapiens
cacacaaaccacaccacacacacacacacacacacacacacacacacacacacacacacaccaa

SEQ ID NO: 41947 - RNA, 64 nt, Homo Sapiens
cacaaaccacaccacacacacacacacacacacacacacacacacacacacacacacaccaagu

SEQ ID NO: 41948 - RNA, 64 nt, Homo Sapiens
caaaccacaccacacacacacacacacacacacacacacacacacacacacacacaccaaguac

SEQ ID NO: 41949 - RNA, 64 nt, Homo Sapiens
aaccacaccacacacacacacacacacacacacacacacacacacacacacacaccaaguacca

SEQ ID NO: 41950 - RNA, 64 nt, Homo Sapiens
ccacaccacacacacacacacacacacacacacacacacacacacacacacaccaaguaccagu

SEQ ID NO: 41951 - RNA, 64 nt, Homo Sapiens
acaccacacacacacacacacacacacacacacacacacacacacacacaccaaguaccaguau

SEQ ID NO: 41952 - RNA, 64 nt, Homo Sapiens
accacacacacacacacacacacacacacacacacacacacacacacaccaaguaccaguauaa

SEQ ID NO: 41953 - RNA, 64 nt, Homo Sapiens
cacacacacacacacacacacacacacacacacacacacacacacaccaaguaccaguauaagc

SEQ ID NO: 41954 - RNA, 64 nt, Homo Sapiens
cacacacacacacacacacacacacacacacacacacacacacaccaaguaccaguauaagcau

SEQ ID NO: 41955 - RNA, 64 nt, Homo Sapiens
cacacacacacacacacacacacacacacacacacacacacaccaaguaccaguauaagcaucu

SEQ ID NO: 41956 - RNA, 64 nt, Homo Sapiens
ucuuauuuuugauaauggcucuuaaaucuuuaaacacacacacaaaaucguucuuuacuuucau

SEQ ID NO: 41957 - RNA, 64 nt, Homo Sapiens
uuauuuuugauaauggcucuuaaaucuuuaaacacacacacaaaaucguucuuuacuuucauuu

SEQ ID NO: 41958 - RNA, 64 nt, Homo Sapiens
uguguguguguguguauauguguuuauagagauacacacacauauauauguguguauauauaua

SEQ ID NO: 41959 - RNA, 64 nt, Homo Sapiens
cauacauauauauacacacacgcauuugcacagacacacacauauaucaauucucaugagugua

SEQ ID NO: 41960 - RNA, 64 nt, Homo Sapiens
uauccuggcaaugggguagucacugccacccuuccacacacacacacacacacacacacacaaa

SEQ ID NO: 41961 - RNA, 64 nt, Homo Sapiens
uccuggcaaugggguagucacugccacccuuccacacacacacacacacacacacacacaaaaa

SEQ ID NO: 41962 - RNA, 64 nt, Homo Sapiens
cuggcaaugggguagucacugccacccuuccacacacacacacacacacacacacacaaaaaaa

SEQ ID NO: 41963 - RNA, 64 nt, Homo Sapiens
ggcaaugggguagucacugccacccuuccacacacacacacacacacacacacacaaaaaaaaa

SEQ ID NO: 41964 - RNA, 64 nt, Homo Sapiens
caaugggguagucacugccacccuuccacacacacacacacacacacacacacaaaaaaaaauc

SEQ ID NO: 41965 - RNA, 64 nt, Homo Sapiens
augggguagucacugccacccuuccacacacacacacacacacacacacacaaaaaaaaauccc

SEQ ID NO: 41966 - RNA, 64 nt, Homo Sapiens
gggguagucacugccacccuuccacacacacacacacacacacacacacaaaaaaaaaucccuu

SEQ ID NO: 41967 - RNA, 64 nt, Homo Sapiens
gguagucacugccacccuuccacacacacacacacacacacacacacaaaaaaaaaucccuucc

SEQ ID NO: 41968 - RNA, 64 nt, Homo Sapiens
uagucacugccacccuuccacacacacacacacacacacacacacaaaaaaaaaucccuuccuu

SEQ ID NO: 41969 - RNA, 64 nt, Homo Sapiens
gucacugccacccuuccacacacacacacacacacacacacacaaaaaaaaaucccuuccuugu

SEQ ID NO: 41970 - RNA, 64 nt, Homo Sapiens
cacugccacccuuccacacacacacacacacacacacacacaaaaaaaaaucccuuccuugugg

SEQ ID NO: 41971 - RNA, 64 nt, Homo Sapiens
caggcucccucccucccagauccaggaacacaugcacacacacacacacacacacgcagacaca

SEQ ID NO: 41972 - RNA, 64 nt, Homo Sapiens
ggcucccucccucccagauccaggaacacaugcacacacacacacacacacacgcagacacaca

SEQ ID NO: 41973 - RNA, 64 nt, Homo Sapiens
cucccucccucccagauccaggaacacaugcacacacacacacacacacacgcagacacacaca

SEQ ID NO: 41974 - RNA, 64 nt, Homo Sapiens
cccucccucccagauccaggaacacaugcacacacacacacacacacacgcagacacacacaca

SEQ ID NO: 41975 - RNA, 64 nt, Homo Sapiens
cucccucccagauccaggaacacaugcacacacacacacacacacacgcagacacacacacaca

SEQ ID NO: 41976 - RNA, 64 nt, Homo Sapiens
cccucccagauccaggaacacaugcacacacacacacacacacacgcagacacacacacacaca

SEQ ID NO: 41977 - RNA, 64 nt, Homo Sapiens
cucccagauccaggaacacaugcacacacacacacacacacacgcagacacacacacacacaca

SEQ ID NO: 41978 - RNA, 64 nt, Homo Sapiens
aacacaugcacacacacacacacacacacgcagacacacacacacacacacauauauguauacg

SEQ ID NO: 41979 - RNA, 64 nt, Homo Sapiens
cacaugcacacacacacacacacacacgcagacacacacacacacacacauauauguauacgca

SEQ ID NO: 41980 - RNA, 64 nt, Homo Sapiens
caugcacacacacacacacacacacgcagacacacacacacacacacauauauguauacgcacg

SEQ ID NO: 41981 - RNA, 64 nt, Homo Sapiens
ugcacacacacacacacacacacgcagacacacacacacacacacauauauguauacgcacgca

SEQ ID NO: 41982 - RNA, 64 nt, Homo Sapiens
cacacacacacacacacacacgcagacacacacacacacacacauauauguauacgcacgcacc

SEQ ID NO: 41983 - RNA, 64 nt, Homo Sapiens
cacacacacacacacacacgcagacacacacacacacacacauauauguauacgcacgcaccca

SEQ ID NO: 41984 - RNA, 64 nt, Homo Sapiens
acugcuucuugcagucaacaagaaauaccaauaacacacacagaacaaaaaccaucaaaaucuc

SEQ ID NO: 41985 - RNA, 64 nt, Homo Sapiens
ucucucugcaaaacuuuaguuuucugaugaucuacacacacacacacacacacacgugcacaca

SEQ ID NO: 41986 - RNA, 64 nt, Homo Sapiens
ucucugcaaaacuuuaguuuucugaugaucuacacacacacacacacacacacgugcacacaca

SEQ ID NO: 41987 - RNA, 64 nt, Homo Sapiens
ucugcaaaacuuuaguuuucugaugaucuacacacacacacacacacacacgugcacacacaca

SEQ ID NO: 41988 - RNA, 64 nt, Homo Sapiens
ugcaaaacuuuaguuuucugaugaucuacacacacacacacacacacacgugcacacacacaca

SEQ ID NO: 41989 - RNA, 64 nt, Homo Sapiens
caaaacuuuaguuuucugaugaucuacacacacacacacacacacacgugcacacacacacaca

SEQ ID NO: 41990 - RNA, 64 nt, Homo Sapiens
aaacuuuaguuuucugaugaucuacacacacacacacacacacacgugcacacacacacacauu

SEQ ID NO: 41991 - RNA, 64 nt, Homo Sapiens
acuuuaguuuucugaugaucuacacacacacacacacacacacgugcacacacacacacauuua

SEQ ID NO: 41992 - RNA, 64 nt, Homo Sapiens
ugaugaucuacacacacacacacacacacacgugcacacacacacacauuuaaaugauauaaaa

SEQ ID NO: 41993 - RNA, 64 nt, Homo Sapiens
augaucuacacacacacacacacacacacgugcacacacacacacauuuaaaugauauaaaaag

SEQ ID NO: 41994 - RNA, 64 nt, Homo Sapiens
gaucuacacacacacacacacacacacgugcacacacacacacauuuaaaugauauaaaaagaa

SEQ ID NO: 41995 - RNA, 64 nt, Homo Sapiens
ucuacacacacacacacacacacacgugcacacacacacacauuuaaaugauauaaaaagaaga

SEQ ID NO: 41996 - RNA, 64 nt, Homo Sapiens
cacaaauuguucaguucuuaaaauguaauuaugucacacacacaaaaaauccuuuucaauccug

SEQ ID NO: 41997 - RNA, 64 nt, Homo Sapiens
caaauuguucaguucuuaaaauguaauuaugucacacacacaaaaaauccuuuucaauccugag

SEQ ID NO: 41998 - RNA, 64 nt, Homo Sapiens
uccuauccgaucugaaaacacacauacacaaaugcacacacaugcacacacacauuuaagggac

SEQ ID NO: 41999 - RNA, 64 nt, Homo Sapiens
ucugaaaacacacauacacaaaugcacacacaugcacacacacauuuaagggacauagcaguaa

SEQ ID NO: 42000 - RNA, 64 nt, Homo Sapiens
ugaaaacacacauacacaaaugcacacacaugcacacacacauuuaagggacauagcaguaaca

SEQ ID NO: 42001 - RNA, 64 nt, Homo Sapiens
ugaguuuguaaucuaguuacagaaguaaggcauacacacacacaaagauaacaguaccuagaga

SEQ ID NO: 42002 - RNA, 64 nt, Homo Sapiens
aguuuguaaucuaguuacagaaguaaggcauacacacacacaaagauaacaguaccuagagaga

SEQ ID NO: 42003 - RNA, 64 nt, Homo Sapiens
agauaguaaaacaggcaaagcagaaucacaugugcacacacacauacacauguaaacauuggaa

SEQ ID NO: 42004 - RNA, 64 nt, Homo Sapiens
auaguaaaacaggcaaagcagaaucacaugugcacacacacauacacauguaaacauuggaaug

SEQ ID NO: 42005 - RNA, 64 nt, Homo Sapiens
auuauauuucuuuuuagauugucuaucuguauaacacacacacacacaccuaagagucucuauu

SEQ ID NO: 42006 - RNA, 64 nt, Homo Sapiens
uauauuucuuuuuagauugucuaucuguauaacacacacacacacaccuaagagucucuauuuc

SEQ ID NO: 42007 - RNA, 64 nt, Homo Sapiens
uauuucuuuuuagauugucuaucuguauaacacacacacacacaccuaagagucucuauuucac

SEQ ID NO: 42008 - RNA, 64 nt, Homo Sapiens
uuucuuuuuagauugucuaucuguauaacacacacacacacaccuaagagucucuauuucacaa

SEQ ID NO: 42009 - RNA, 64 nt, Homo Sapiens
gaaaaauucuuaaaauauauaugaauuuguguaacacacacagagacacacacacauacuacuu

SEQ ID NO: 42010 - RNA, 64 nt, Homo Sapiens
aaauauauaugaauuuguguaacacacacagagacacacacacauacuacuuuaagggggugag

SEQ ID NO: 42011 - RNA, 64 nt, Homo Sapiens
auauauaugaauuuguguaacacacacagagacacacacacauacuacuuuaagggggugagga

SEQ ID NO: 42012 - RNA, 64 nt, Homo Sapiens
gauucucaaucucuuugaauuuuacuuacauuuacacacacacgcacacacauauguauauaca

SEQ ID NO: 42013 - RNA, 64 nt, Homo Sapiens
cucuuugaauuuuacuuacauuuacacacacacgcacacacauauguauauacacauaucauuu

SEQ ID NO: 42014 - RNA, 64 nt, Homo Sapiens
cucaaccucuuugaauuuuacuuauaauuacauacacacacacacugcuacuuauauaaauguu

SEQ ID NO: 42015 - RNA, 64 nt, Homo Sapiens
caaccucuuugaauuuuacuuauaauuacauacacacacacacugcuacuuauauaaauguucu

SEQ ID NO: 42016 - RNA, 64 nt, Homo Sapiens
ucccccagucucucuucucaaucccccuuucuaacacacacacacacacacacacacacacaca

SEQ ID NO: 42017 - RNA, 64 nt, Homo Sapiens
ccccagucucucuucucaaucccccuuucuaacacacacacacacacacacacacacacacaca

SEQ ID NO: 42018 - RNA, 64 nt, Homo Sapiens
ccagucucucuucucaaucccccuuucuaacacacacacacacacacacacacacacacacaca

SEQ ID NO: 42019 - RNA, 64 nt, Homo Sapiens
agucucucuucucaaucccccuuucuaacacacacacacacacacacacacacacacacacaca

SEQ ID NO: 42020 - RNA, 64 nt, Homo Sapiens
ucucucuucucaaucccccuuucuaacacacacacacacacacacacacacacacacacacaca

SEQ ID NO: 42021 - RNA, 64 nt, Homo Sapiens
ucucuucucaaucccccuuucuaacacacacacacacacacacacacacacacacacacacaca

SEQ ID NO: 42022 - RNA, 64 nt, Homo Sapiens
ucuucucaaucccccuuucuaacacacacacacacacacacacacacacacacacacacacaca

SEQ ID NO: 42023 - RNA, 64 nt, Homo Sapiens
uucucaaucccccuuucuaacacacacacacacacacacacacacacacacacacacacacaca

SEQ ID NO: 42024 - RNA, 64 nt, Homo Sapiens
cucaaucccccuuucuaacacacacacacacacacacacacacacacacacacacacacacaca

SEQ ID NO: 42025 - RNA, 64 nt, Homo Sapiens
caaucccccuuucuaacacacacacacacacacacacacacacacacacacacacacacacaca

SEQ ID NO: 42026 - RNA, 64 nt, Homo Sapiens
aucccccuuucuaacacacacacacacacacacacacacacacacacacacacacacacacaca

SEQ ID NO: 42027 - RNA, 64 nt, Homo Sapiens
cccccuuucuaacacacacacacacacacacacacacacacacacacacacacacacacacaca

SEQ ID NO: 42028 - RNA, 64 nt, Homo Sapiens
cccuuucuaacacacacacacacacacacacacacacacacacacacacacacacacacacaga

SEQ ID NO: 42029 - RNA, 64 nt, Homo Sapiens
cuuucuaacacacacacacacacacacacacacacacacacacacacacacacacacacagagu

SEQ ID NO: 42030 - RNA, 64 nt, Homo Sapiens
uucuaacacacacacacacacacacacacacacacacacacacacacacacacacacagaguca

SEQ ID NO: 42031 - RNA, 64 nt, Homo Sapiens
cuaacacacacacacacacacacacacacacacacacacacacacacacacacacagagucagg

SEQ ID NO: 42032 - RNA, 64 nt, Homo Sapiens
aacacacacacacacacacacacacacacacacacacacacacacacacacacagagucaggcc

SEQ ID NO: 42033 - RNA, 64 nt, Homo Sapiens
cacacacacacacacacacacacacacacacacacacacacacacacacacagagucaggccgu

SEQ ID NO: 42034 - RNA, 64 nt, Homo Sapiens
cacacacacacacacacacacacacacacacacacacacacacacacacagagucaggccguug

SEQ ID NO: 42035 - RNA, 64 nt, Homo Sapiens
cacacacacacacacacacacacacacacacacacacacacacacacagagucaggccguugcu

SEQ ID NO: 42036 - RNA, 64 nt, Homo Sapiens
cacacacacacacacacacacacacacacacacacacacacacacagagucaggccguugcuag

SEQ ID NO: 42037 - RNA, 64 nt, Homo Sapiens
cacacacacacacacacacacacacacacacacacacacacacagagucaggccguugcuaguc

SEQ ID NO: 42038 - RNA, 64 nt, Homo Sapiens
cacacacacacacacacacacacacacacacacacacacacagagucaggccguugcuagucag

SEQ ID NO: 42039 - RNA, 64 nt, Homo Sapiens
cggacucacacgaagucacacgcacacaugcacgcacacacacauauggggaccugcacaccug

SEQ ID NO: 42040 - RNA, 64 nt, Homo Sapiens
gacucacacgaagucacacgcacacaugcacgcacacacacauauggggaccugcacaccugca

SEQ ID NO: 42041 - RNA, 64 nt, Homo Sapiens
ugcaugcacauauguguauguguguggaucuguacacacacacguauauauggccagaugcgua

SEQ ID NO: 42042 - RNA, 64 nt, Homo Sapiens
acuuugggggguggggaaggggccaagcugcagacacacacagucauucauuucuguccacacc

SEQ ID NO: 42043 - RNA, 64 nt, Homo Sapiens
ugugugugcuugugugugcgcacgugucggcgcucacacacacaugcuagcccacugaugcacc

SEQ ID NO: 42044 - RNA, 64 nt, Homo Sapiens
ugugugcuugugugugcgcacgugucggcgcucacacacacaugcuagcccacugaugcaccca

SEQ ID NO: 42045 - RNA, 64 nt, Homo Sapiens
gaaucaguagggagaaacaaaaauuagagacaugcacacacaaagaguguauuuacagcuuguu

SEQ ID NO: 42046 - RNA, 64 nt, Homo Sapiens
agucauaucaccucuguuucuauauacacacacacacacacauuuacguauauaaauauauaua

SEQ ID NO: 42047 - RNA, 64 nt, Homo Sapiens
uuagucauaucaccucuguuuauauauacacacacacacacacauguacguauauaaauauaua

SEQ ID NO: 42048 - RNA, 64 nt, Homo Sapiens
cauuagucauaucaccucuguauauauauacacacacacacacaucuguacguauauaaauaua

SEQ ID NO: 42049 - RNA, 64 nt, Homo Sapiens
cacauuagucauaucaccucuauauauauauacacacacacacagcucuguacguauauaaaua

SEQ ID NO: 42050 - RNA, 64 nt, Homo Sapiens
cacacauuagucauaucaccuauauauauauauacacacacacagugcucuguacguauauaaa

SEQ ID NO: 42051 - RNA, 64 nt, Homo Sapiens
acuuugaggcagcgcauugucacacauacacacacacacacaaaacaaaacaaacacacacaca

SEQ ID NO: 42052 - RNA, 64 nt, Homo Sapiens
aaacuuugaggcagcgcauucacacacauacacacacacacacaaaacaaaacaaacacacaca

SEQ ID NO: 42053 - RNA, 64 nt, Homo Sapiens
caaaacuuugaggcagcgcacacacacacauacacacacacacaaaaaacaaaacaaacacaca

SEQ ID NO: 42054 - RNA, 64 nt, Homo Sapiens
cacaaaacuuugaggcagcgcacacacacacauacacacacacacuaaaaacaaaacaaacaca

SEQ ID NO: 42055 - RNA, 64 nt, Homo Sapiens
cacacacacacacaaaacuuaacaaacacacacacacacacauaauaaaaaccccuaaaaacaa

SEQ ID NO: 42056 - RNA, 64 nt, Homo Sapiens
uacacacacacacacaaaacaaaacaaacacacacacacacacauuauaaaaaccccuaaaaac

SEQ ID NO: 42057 - RNA, 64 nt, Homo Sapiens
cauacacacacacacacaaaacaaaacaaacacacacacacacaguuuauaaaaaccccuaaaa

SEQ ID NO: 42058 - RNA, 64 nt, Homo Sapiens
cacauacacacacacacacaaaacaaaacaaacacacacacacauuguuuauaaaaaccccuaa

SEQ ID NO: 42059 - RNA, 64 nt, Homo Sapiens
cacacauacacacacacacaaaaaacaaaacaaacacacacacaaguuguuuauaaaaaccccu

SEQ ID NO: 42060 - RNA, 64 nt, Homo Sapiens
aaguaccaguauaggcaucucacacacacacacacacacacacccgcgcacacacacacacaca

SEQ ID NO: 42061 - RNA, 64 nt, Homo Sapiens
ccaaguaccaguauaggcaucacacacacacacacacacacacacgcgcgcacacacacacaca

SEQ ID NO: 42062 - RNA, 64 nt, Homo Sapiens
caccaaguaccaguauaggccacacacacacacacacacacacacgcgcgcgcacacacacaca

SEQ ID NO: 42063 - RNA, 64 nt, Homo Sapiens
cacaccaaguaccaguauagcacacacacacacacacacacacacgcgcgcgcgcacacacaca

SEQ ID NO: 42064 - RNA, 64 nt, Homo Sapiens
cacacaccaaguaccaguaucacacacacacacacacacacacacgcgcgcgcgcgcacacaca

SEQ ID NO: 42065 - RNA, 64 nt, Homo Sapiens
cacacacaccaaguaccagucacacacacacacacacacacacaugcgcgcgcgcgcgcacaca

SEQ ID NO: 42066 - RNA, 64 nt, Homo Sapiens
cacacacacaccaaguaccacacacacacacacacacacacacacaugcgcgcgcgcgcgcaca

SEQ ID NO: 42067 - RNA, 64 nt, Homo Sapiens
cacacacacacaccaaguaccacacacacacacacacacacacacacaugcgcgcgcgcgcgca

SEQ ID NO: 42068 - RNA, 64 nt, Homo Sapiens
cacacacacacacaccaagucacacacacacacacacacacacacacacaugcgcgcgcgcgcg

SEQ ID NO: 42069 - RNA, 64 nt, Homo Sapiens
cacacacacacacacaccaacgcacacacacacacacacacacagacacacaugcgcgcgcgcg

SEQ ID NO: 42070 - RNA, 64 nt, Homo Sapiens
cacacacacacacacacacccgcgcacacacacacacacacacacagacacacaugcgcgcgcg

SEQ ID NO: 42071 - RNA, 64 nt, Homo Sapiens
cacacacacacacacacacacgcgcgcacacacacacacacacacacagacacacaugcgcgcg

SEQ ID NO: 42072 - RNA, 64 nt, Homo Sapiens
cacacacacacacacacacacgcgcgcgcacacacacacacacacacacagacacacaugcgcg

SEQ ID NO: 42073 - RNA, 64 nt, Homo Sapiens
cacacacacacacacacacacgcgcgcgcgcacacacacacacagccacacagacacacaugcg

SEQ ID NO: 42074 - RNA, 64 nt, Homo Sapiens
cacacacacacacacacacacgcgcgcgcgcgcacacacacacaaugccacacagacacacaug

SEQ ID NO: 42075 - RNA, 64 nt, Homo Sapiens
cacacacacacacacacacaugcgcgcgcgcgcgcacacacacaacaugccacacagacacaca

SEQ ID NO: 42076 - RNA, 64 nt, Homo Sapiens
ccacacagacacacaugcgccauuuacacaaacacacacacaugauuucagauuuuuuccucug

SEQ ID NO: 42077 - RNA, 64 nt, Homo Sapiens
ugccacacagacacacaugcugcauuuacacaaacacacacacauaauuucagauuuuuuccuc

SEQ ID NO: 42078 - RNA, 64 nt, Homo Sapiens
aaguaccaguauaagcaucucacacagagacacacacacacaccuacacacacacacacacaca

SEQ ID NO: 42079 - RNA, 64 nt, Homo Sapiens
ccaaguaccaguauaagcaucacacacagagacacacacacacauuuacacacacacacacaca

SEQ ID NO: 42080 - RNA, 64 nt, Homo Sapiens
caccaaguaccaguauaagccacacacacagagacacacacacacauuuacacacacacacaca

SEQ ID NO: 42081 - RNA, 64 nt, Homo Sapiens
gacacacacacacaccaagucacacacacacacacacacacagauuuucuccucugcauuuaca

SEQ ID NO: 42082 - RNA, 64 nt, Homo Sapiens
gagacacacacacacaccaacacacacacacacacacacacacagauuuucuccucugcauuua

SEQ ID NO: 42083 - RNA, 64 nt, Homo Sapiens
cagagacacacacacacaccuacacacacacacacacacacacaccgauuuucuccucugcauu

SEQ ID NO: 42084 - RNA, 64 nt, Homo Sapiens
cacagagacacacacacacauuuacacacacacacacacacacauuccgauuuucuccucugca

SEQ ID NO: 42085 - RNA, 64 nt, Homo Sapiens
cacacagagacacacacacacauuuacacacacacacacacacaauuuccgauuuucuccucug

SEQ ID NO: 42086 - RNA, 64 nt, Homo Sapiens
cacacacagagacacacacaugcauuuacacacacacacacacauaauuuccgauuuucuccuc

SEQ ID NO: 42087 - RNA, 64 nt, Homo Sapiens
cacacacacagagacacacaucugcauuuacacacacacacacauuuaauuuccgauuuucucc

SEQ ID NO: 42088 - RNA, 64 nt, Homo Sapiens
cacacacacacagagacacaccucugcauuuacacacacacacauguuuaauuuccgauuuucu

SEQ ID NO: 42089 - RNA, 64 nt, Homo Sapiens
cacacacacacacagagacacuccucugcauuuacacacacacaaguguuuaauuuccgauuuu

SEQ ID NO: 42090 - RNA, 64 nt, Homo Sapiens
cacacaccaaguaccaguaucacacacacacacacacacacagacacacacacaaaccacacca

SEQ ID NO: 42091 - RNA, 64 nt, Homo Sapiens
gacacacaccaaguaccagucacacacacacacacacacacacacacacacacacaaaccacac

SEQ ID NO: 42092 - RNA, 64 nt, Homo Sapiens
cagacacacaccaaguaccaaccacacacacacacacacacacauacacacacacacaaaccac

SEQ ID NO: 42093 - RNA, 64 nt, Homo Sapiens
cacagacacacaccaaguacacaccacacacacacacacacacauuuacacacacacacaaacc

SEQ ID NO: 42094 - RNA, 64 nt, Homo Sapiens
cacacagacacacaccaaguccacaccacacacacacacacacacauuuacacacacacacaaa

SEQ ID NO: 42095 - RNA, 64 nt, Homo Sapiens
cacacacagacacacaccaaaaccacaccacacacacacacacaugcauuuacacacacacaca

SEQ ID NO: 42096 - RNA, 64 nt, Homo Sapiens
cacacacacagacacacacccaaaccacaccacacacacacacaucugcauuuacacacacaca

SEQ ID NO: 42097 - RNA, 64 nt, Homo Sapiens
cacacacacacagacacacacacaaaccacaccacacacacacaccucugcauuuacacacaca

SEQ ID NO: 42098 - RNA, 64 nt, Homo Sapiens
cacacacacacacagacacacacacaaaccacaccacacacacauuccucugcauuuacacaca

SEQ ID NO: 42099 - RNA, 64 nt, Homo Sapiens
ccacaccacacacacacacaucugcauuuacacacacacacaaauuuaauuucagauuuuuucc

SEQ ID NO: 42100 - RNA, 64 nt, Homo Sapiens
aaccacaccacacacacacaccucugcauuuacacacacacacauguuuaauuucagauuuuuu

SEQ ID NO: 42101 - RNA, 64 nt, Homo Sapiens
caaaccacaccacacacacauuccucugcauuuacacacacacaaguguuuaauuucagauuuu

SEQ ID NO: 42102 - RNA, 64 nt, Homo Sapiens
aaguaccaguauaagcaucuaccacacacgcacacacacacaccuccucugcauuuacacacac

SEQ ID NO: 42103 - RNA, 64 nt, Homo Sapiens
ccaaguaccaguauaagcauacaccacacacgcacacacacacauuuccucugcauuuacacac

SEQ ID NO: 42104 - RNA, 64 nt, Homo Sapiens
caccaaguaccaguauaagcacacaccacacacgcacacacacauuuuuccucugcauuuacac

SEQ ID NO: 42105 - RNA, 64 nt, Homo Sapiens
acacacgcacacacacacacuuccucugcauuuacacacacaccaguguuuaauuuccgauuuu

SEQ ID NO: 42106 - RNA, 64 nt, Homo Sapiens
cacaccaaguaccaguauaacacacagacacacacacacacagaaccagacacacaaacacaca

SEQ ID NO: 42107 - RNA, 64 nt, Homo Sapiens
gacacaccaaguaccaguaucacacacagacacacacacacacaacaccagacacacaaacaca

SEQ ID NO: 42108 - RNA, 64 nt, Homo Sapiens
cagacacaccaaguaccagucacacacacagacacacacacacaacacaccagacacacaaaca

SEQ ID NO: 42109 - RNA, 64 nt, Homo Sapiens
cacagacacaccaaguaccacacacacacacagacacacacacauuacacaccagacacacaaa

SEQ ID NO: 42110 - RNA, 64 nt, Homo Sapiens
cacacacacacacagacacagacacacaaacacacacacacagacccucugcauuuacacacca

SEQ ID NO: 42111 - RNA, 64 nt, Homo Sapiens
gacacacacacacacagacacagacacacaaacacacacacacauccccucugcauuuacacac

SEQ ID NO: 42112 - RNA, 64 nt, Homo Sapiens
cagacacacacacacacagaaccagacacacaaacacacacacauuuccccucugcauuuacac

SEQ ID NO: 42113 - RNA, 64 nt, Homo Sapiens
gagauaaggaacaaaagugucacacacacacacacacacacagacacacagacacacacacaca

SEQ ID NO: 42114 - RNA, 64 nt, Homo Sapiens
gagagauaaggaacaaaagucacacacacacacacacacacacacacacacagacacacacaca

SEQ ID NO: 42115 - RNA, 64 nt, Homo Sapiens
cagagagauaaggaacaaaacacacacacacacacacacacacacacacacacagacacacaca

SEQ ID NO: 42116 - RNA, 64 nt, Homo Sapiens
cacagagagauaaggaacaacacacacacacacacacacacacacacacacacacagacacaca

SEQ ID NO: 42117 - RNA, 64 nt, Homo Sapiens
cacacagagagauaaggaaccacacacacacacacacacacacacacacacacacacagacaca

SEQ ID NO: 42118 - RNA, 64 nt, Homo Sapiens
cacacacagagagauaaggacacacacacacacacacacacacacacacacacacacacagaca

SEQ ID NO: 42119 - RNA, 64 nt, Homo Sapiens
cacacacacagagagauaagcacacacacacacacacacacacauacacacacacacacacaga

SEQ ID NO: 42120 - RNA, 64 nt, Homo Sapiens
cacacacacacagagagauagacacacacacacacacacacacacauacacacacacacacaca

SEQ ID NO: 42121 - RNA, 64 nt, Homo Sapiens
cacacacacacacagagagacagacacacacacacacacacacacacauacacacacacacaca

SEQ ID NO: 42122 - RNA, 64 nt, Homo Sapiens
cacacacacacacacagagacacagacacacacacacacacacauacacauacacacacacaca

SEQ ID NO: 42123 - RNA, 64 nt, Homo Sapiens
cacacacacacacacacagacacacagacacacacacacacacaaguacacauacacacacaca

SEQ ID NO: 42124 - RNA, 64 nt, Homo Sapiens
cacacacacacacacacacacacacacagacacacacacacacaugaguacacauacacacaca

SEQ ID NO: 42125 - RNA, 64 nt, Homo Sapiens
cacacacacacacacacacacacacacacagacacacacacacacuugaguacacauacacaca

SEQ ID NO: 42126 - RNA, 64 nt, Homo Sapiens
cacacacacacacacacacacacacacacacagacacacacacacccuugaguacacauacaca

SEQ ID NO: 42127 - RNA, 64 nt, Homo Sapiens
cacacacacacacacacacacacauacacacacacacacacagacacacagagacccuugagua

SEQ ID NO: 42128 - RNA, 64 nt, Homo Sapiens
gacacacacacacacacacauacacauacacacacacacacacacacacacagagacccuugag

SEQ ID NO: 42129 - RNA, 64 nt, Homo Sapiens
cagacacacacacacacacaaguacacauacacacacacacacacacacacacagagacccuug

SEQ ID NO: 42130 - RNA, 64 nt, Homo Sapiens
cacagacacacacacacacaugaguacacauacacacacacacacacacacacacagagacccu

SEQ ID NO: 42131 - RNA, 64 nt, Homo Sapiens
cacacagacacacacacacacuugaguacacauacacacacacacacacacacacacagagacc

SEQ ID NO: 42132 - RNA, 64 nt, Homo Sapiens
gacccuugaguacacauacauuuauacacacacacacacacagaucggagaagcacuguugaaa

SEQ ID NO: 42133 - RNA, 64 nt, Homo Sapiens
gagacccuugaguacacauaaauuuauacacacacacacacacauuucggagaagcacuguuga

SEQ ID NO: 42134 - RNA, 64 nt, Homo Sapiens
cagagacccuugaguacacagaaauuuauacacacacacacacauuuuucggagaagcacuguu

SEQ ID NO: 42135 - RNA, 64 nt, Homo Sapiens
cacagagacccuugaguacauugaaauuuauacacacacacacacuuuuuucggagaagcacug

SEQ ID NO: 42136 - RNA, 64 nt, Homo Sapiens
cacacagagacccuugaguauguugaaauuuauacacacacacaaccuuuuuucggagaagcac

SEQ ID NO: 42137 - RNA, 64 nt, Homo Sapiens
aauaucuaucuugggggaggcacacaaacacacacacacacauuuacacacacauauacauaga

SEQ ID NO: 42138 - RNA, 64 nt, Homo Sapiens
uuaauaucuaucuugggggagacacacaaacacacacacacacacauacacacacauauacaua

SEQ ID NO: 42139 - RNA, 64 nt, Homo Sapiens
cauuaauaucuaucuugggguagacacacaaacacacacacacacacauacacacacauauaca

SEQ ID NO: 42140 - RNA, 64 nt, Homo Sapiens
cacauuaauaucuaucuuggcauagacacacaaacacacacacacacacauacacacacauaua

SEQ ID NO: 42141 - RNA, 64 nt, Homo Sapiens
uacauagacacacaaacacacacacacacacauacacacacauacugucucccuccucaacaca

SEQ ID NO: 42142 - RNA, 64 nt, Homo Sapiens
cacacacauauacauagacaccucaacacacacacacacacauacuccuccacacugucucccu

SEQ ID NO: 42143 - RNA, 64 nt, Homo Sapiens
uacacacacauauacauagacuccucaacacacacacacacacaagcuccuccacacugucucc

SEQ ID NO: 42144 - RNA, 64 nt, Homo Sapiens
cauacacacacauauacauacccuccucaacacacacacacacauuagcuccuccacacugucu

SEQ ID NO: 42145 - RNA, 64 nt, Homo Sapiens
cacauacacacacauauacacucccuccucaacacacacacacauuuuagcuccuccacacugu

SEQ ID NO: 42146 - RNA, 64 nt, Homo Sapiens
cacacauacacacacauauagucucccuccucaacacacacacaccuuuuagcuccuccacacu

SEQ ID NO: 42147 - RNA, 64 nt, Homo Sapiens
ugaaauuuuuaaucuuugaauuuaaaaaaacacacacacacaaaucccacauuuaaaguucuua

SEQ ID NO: 42148 - RNA, 64 nt, Homo Sapiens
aaugaaauuuuuaaucuuuguauuuaaaaaaacacacacacacauaucccacauuuaaaguucu

SEQ ID NO: 42149 - RNA, 64 nt, Homo Sapiens
caaaugaaauuuuuaaucuucuuauuuaaaaaaacacacacacagauaucccacauuuaaaguu

SEQ ID NO: 42150 - RNA, 64 nt, Homo Sapiens
aaaacaaacacaaaaccacuaaauaacaaugacacacacacaacaauggucugguacaggaguu

SEQ ID NO: 42151 - RNA, 64 nt, Homo Sapiens
acaaaacaaacacaaaaccauuaaauaacaaugacacacacacaaaaauggucugguacaggag

SEQ ID NO: 42152 - RNA, 64 nt, Homo Sapiens
aaacacaacacagacacuaccacacacacagacacacacacacgcaaacacauacacacacaua

SEQ ID NO: 42153 - RNA, 64 nt, Homo Sapiens
cgaaacacaacacagacacuuacacacacacagacacacacacacacaaacacauacacacaca

SEQ ID NO: 42154 - RNA, 64 nt, Homo Sapiens
cacacacacacgaaacacaauacacacacauacacacacacagacccacacacacacaaacaca

SEQ ID NO: 42155 - RNA, 64 nt, Homo Sapiens
gacacacacacacgaaacaccauacacacacauacacacacacaugcccacacacacacaaaca

SEQ ID NO: 42156 - RNA, 64 nt, Homo Sapiens
cacacacacagacacacacacacacaaacacauacacacacauaaaagaaauucugcccacaca

SEQ ID NO: 42157 - RNA, 64 nt, Homo Sapiens
cacauacacacacauacacaaaauucugcccacacacacacaaaauuaggccuuaaauuaaaag

SEQ ID NO: 42158 - RNA, 64 nt, Homo Sapiens
aacacauacacacacauacaagaaauucugcccacacacacacaucauuaggccuuaaauuaaa

SEQ ID NO: 42159 - RNA, 64 nt, Homo Sapiens
caaacacauacacacacauaaaagaaauucugcccacacacacaacucauuaggccuuaaauua

SEQ ID NO: 42160 - RNA, 64 nt, Homo Sapiens
cacguccacacucacauuaacacacacacacacacacacacacgcucucacagacacacacaca

SEQ ID NO: 42161 - RNA, 64 nt, Homo Sapiens
cgcacguccacacucacauucacacacacacacacacacacacacucucucacagacacacaca

SEQ ID NO: 42162 - RNA, 64 nt, Homo Sapiens
cacgcacguccacacucacacacacacacacacacacacacacacccucucucacagacacaca

SEQ ID NO: 42163 - RNA, 64 nt, Homo Sapiens
cacacgcacguccacacucacacacacacacacacacacacacacucccucucucacagacaca

SEQ ID NO: 42164 - RNA, 64 nt, Homo Sapiens
cacacacgcacguccacacucacacacacacacacacacacacacccucccucucucacagaca

SEQ ID NO: 42165 - RNA, 64 nt, Homo Sapiens
cacacacacgcacguccacacacacacacacacacacacacacacucccucccucucucacaga

SEQ ID NO: 42166 - RNA, 64 nt, Homo Sapiens
cacacacacacgcacguccagacacacacacacacacacacacacucucccucccucucucaca

SEQ ID NO: 42167 - RNA, 64 nt, Homo Sapiens
cacacacacacacgcacguccagacacacacacacacacacacacucucucccucccucucuca

SEQ ID NO: 42168 - RNA, 64 nt, Homo Sapiens
cacacacacacacacgcacgcacagacacacacacacacacacacucucucucccucccucucu

SEQ ID NO: 42169 - RNA, 64 nt, Homo Sapiens
cacacacacacacacacgcacucacagacacacacacacacacacucucucucucccucccucu

SEQ ID NO: 42170 - RNA, 64 nt, Homo Sapiens
cacacacacacacacacacgcucucacagacacacacacacacacucucucucucucccucccu

SEQ ID NO: 42171 - RNA, 64 nt, Homo Sapiens
cacacacacacacacacacacucucucacagacacacacacacacucucucucucucucccucc

SEQ ID NO: 42172 - RNA, 64 nt, Homo Sapiens
cacacacacacacacacacacccucucucacagacacacacacacucucucucucucucucccu

SEQ ID NO: 42173 - RNA, 64 nt, Homo Sapiens
ccaucucuugcuuguuccuacacacacacacacacacacacaauuucucccuccuucuuacaca

SEQ ID NO: 42174 - RNA, 64 nt, Homo Sapiens
auccaucucuugcuuguucccacacacacacacacacacacacaacuucucccuccuucuuaca

SEQ ID NO: 42175 - RNA, 64 nt, Homo Sapiens
caauccaucucuugcuuguucacacacacacacacacacacacaauacuucucccuccuucuua

SEQ ID NO: 42176 - RNA, 64 nt, Homo Sapiens
cacaauccaucucuugcuuguacacacacacacacacacacacacuauacuucucccuccuucu

SEQ ID NO: 42177 - RNA, 64 nt, Homo Sapiens
cacacaauccaucucuugcucuuacacacacacacacacacacacccuauacuucucccuccuu

SEQ ID NO: 42178 - RNA, 64 nt, Homo Sapiens
cacacacaauccaucucuuguucuuacacacacacacacacacacucccuauacuucucccucc

SEQ ID NO: 42179 - RNA, 64 nt, Homo Sapiens
cacacacacaauccaucucuccuucuuacacacacacacacacacacucccuauacuucucccu

SEQ ID NO: 42180 - RNA, 64 nt, Homo Sapiens
cacacacacacaauccaucucuccuucuuacacacacacacacaaccacucccuauacuucucc

SEQ ID NO: 42181 - RNA, 64 nt, Homo Sapiens
cacacacacacacaauccaucccuccuucuuacacacacacacaccaccacucccuauacuucu

SEQ ID NO: 42182 - RNA, 64 nt, Homo Sapiens
cacacacacacacacaaucccucccuccuucuuacacacacacaugccaccacucccuauacuu

SEQ ID NO: 42183 - RNA, 64 nt, Homo Sapiens
uacacacaucccucacuucucacacacacacacacacacacacgcacacacacacacacacaca

SEQ ID NO: 42184 - RNA, 64 nt, Homo Sapiens
cguacacacaucccucacuucacacacacacacacacacacacacacacacacacacacacaca

SEQ ID NO: 42185 - RNA, 64 nt, Homo Sapiens
cacguacacacaucccucaccacacacacacacacacacacacacacacacacacacacacaca

SEQ ID NO: 42186 - RNA, 64 nt, Homo Sapiens
cacacguacacacaucccuccacacacacacacacacacacacacacacacacacacacacaca

SEQ ID NO: 42187 - RNA, 64 nt, Homo Sapiens
cacacacguacacacauccccacacacacacacacacacacacaaacacacacacacacacaca

SEQ ID NO: 42188 - RNA, 64 nt, Homo Sapiens
cacacacacguacacacauccacacacacacacacacacacacagaaacacacacacacacaca

SEQ ID NO: 42189 - RNA, 64 nt, Homo Sapiens
cacacacacacguacacacacacacacacacacacacacacacacugaaacacacacacacaca

SEQ ID NO: 42190 - RNA, 64 nt, Homo Sapiens
cacacacacacacguacacacacacacacacacacacacacacauucugaaacacacacacaca

SEQ ID NO: 42191 - RNA, 64 nt, Homo Sapiens
cacacacacacacacguacacacacacacacacacacacacacauuuucugaaacacacacaca

SEQ ID NO: 42192 - RNA, 64 nt, Homo Sapiens
cacacacacacacacacguacacacacacacacacacacacacagcuuuucugaaacacacaca

SEQ ID NO: 42193 - RNA, 64 nt, Homo Sapiens
cacacacacacacacacacgcacacacacacacacacacacacauggcuuuucugaaacacaca

SEQ ID NO: 42194 - RNA, 64 nt, Homo Sapiens
cacacacacacacacacacacacacacacacacacacacacacaaguggcuuuucugaaacaca

SEQ ID NO: 42195 - RNA, 64 nt, Homo Sapiens
cacacacacacacacacacacacacacacacacacacacacacaggaguggcuuuucugaaaca

SEQ ID NO: 42196 - RNA, 64 nt, Homo Sapiens
cacacacacacacacacacacacacacacacacacacacacacacuggaguggcuuuucugaaa

SEQ ID NO: 42197 - RNA, 64 nt, Homo Sapiens
cacacacacacacacacacaaacacacacacacacacacacacagacuggaguggcuuuucuga

SEQ ID NO: 42198 - RNA, 64 nt, Homo Sapiens
cacacacacacacacacacagaaacacacacacacacacacacacagacuggaguggcuuuucu

SEQ ID NO: 42199 - RNA, 64 nt, Homo Sapiens
cacacacacacacacacacacugaaacacacacacacacacacacccagacuggaguggcuuuu

SEQ ID NO: 42200 - RNA, 64 nt, Homo Sapiens
cacacacacacacacacacauucugaaacacacacacacacacauucccagacuggaguggcuu

SEQ ID NO: 42201 - RNA, 64 nt, Homo Sapiens
cacacacacacacacacacauuuucugaaacacacacacacacauuuucccagacuggaguggc

SEQ ID NO: 42202 - RNA, 64 nt, Homo Sapiens
cacacacacacacacacacagcuuuucugaaacacacacacacauauuuucccagacuggagug

SEQ ID NO: 42203 - RNA, 64 nt, Homo Sapiens
cacacacacacacacacacauggcuuuucugaaacacacacacauuuauuuucccagacuggag

SEQ ID NO: 42204 - RNA, 64 nt, Homo Sapiens
cauauauauauauaugcacaaauggaucaauacacacacacagaguuccaaaauauugacauug

SEQ ID NO: 42205 - RNA, 64 nt, Homo Sapiens
gacauauauauauauaugcaugaauggaucaauacacacacacaggguuccaaaauauugacau

SEQ ID NO: 42206 - RNA, 64 nt, Homo Sapiens
auugcuguucagucacaaaugcuaucuuggugcacacacacaacagauguuugggcacucagau

SEQ ID NO: 42207 - RNA, 64 nt, Homo Sapiens
acauugcuguucagucacaaaugcuaucuuggugcacacacacauuagauguuugggcacucag

SEQ ID NO: 42208 - RNA, 64 nt, Homo Sapiens
cagugcucucuccacccgacugcacgugcacgcacacacacacccccaugcucuugcgugugcu

SEQ ID NO: 42209 - RNA, 64 nt, Homo Sapiens
cccagugcucucuccacccgcuugcacgugcacgcacacacacacccccaugcucuugcgugug

SEQ ID NO: 42210 - RNA, 64 nt, Homo Sapiens
acugcuucuugcagucaagaagaaauaccaauaacacacacagaacaaaaaccaucaaaaucuc

SEQ ID NO: 42211 - RNA, 64 nt, Homo Sapiens
ucucucugcaaaccuuuaguuuucugaugaucuacacacacacauacacacacacacacacaca

SEQ ID NO: 42212 - RNA, 64 nt, Homo Sapiens
ucucugcaaaccuuuaguuuucugaugaucuacacacacacauacacacacacacacacacacg

SEQ ID NO: 42213 - RNA, 64 nt, Homo Sapiens
ccuuuaguuuucugaugaucuacacacacacauacacacacacacacacacacgugcacacaca

SEQ ID NO: 42214 - RNA, 64 nt, Homo Sapiens
uuuaguuuucugaugaucuacacacacacauacacacacacacacacacacgugcacacacaca

SEQ ID NO: 42215 - RNA, 64 nt, Homo Sapiens
uaguuuucugaugaucuacacacacacauacacacacacacacacacacgugcacacacacaca

SEQ ID NO: 42216 - RNA, 64 nt, Homo Sapiens
guuuucugaugaucuacacacacacauacacacacacacacacacacgugcacacacacacauu

SEQ ID NO: 42217 - RNA, 64 nt, Homo Sapiens
uuucugaugaucuacacacacacauacacacacacacacacacacgugcacacacacacauuua

SEQ ID NO: 42218 - RNA, 64 nt, Homo Sapiens
ucugaugaucuacacacacacauacacacacacacacacacacgugcacacacacacauuuaaa

SEQ ID NO: 42219 - RNA, 64 nt, Homo Sapiens
cacacacacauacacacacacacacacacacgugcacacacacacauuuaaaggauauaaaaag

SEQ ID NO: 42220 - RNA, 64 nt, Homo Sapiens
cacacacauacacacacacacacacacacgugcacacacacacauuuaaaggauauaaaaagaa

SEQ ID NO: 42221 - RNA, 64 nt, Homo Sapiens
cacacauacacacacacacacacacacgugcacacacacacauuuaaaggauauaaaaagaaga

SEQ ID NO: 42222 - RNA, 64 nt, Homo Sapiens
cacaaauuguucaguucuuaaaauguaauuaugucacacacacaaaaaaauccuuuucaauccu

SEQ ID NO: 42223 - RNA, 64 nt, Homo Sapiens
caaauuguucaguucuuaaaauguaauuaugucacacacacaaaaaaauccuuuucaauccuga

SEQ ID NO: 42224 - RNA, 64 nt, Homo Sapiens
aaaguggaauguauuuaaaacuuguugaauuagacacacacacacagacacacacaaagaauca

SEQ ID NO: 42225 - RNA, 64 nt, Homo Sapiens
aguggaauguauuuaaaacuuguugaauuagacacacacacacagacacacacaaagaaucagc

SEQ ID NO: 42226 - RNA, 64 nt, Homo Sapiens
uggaauguauuuaaaacuuguugaauuagacacacacacacagacacacacaaagaaucagcag

SEQ ID NO: 42227 - RNA, 64 nt, Homo Sapiens
uuaaaacuuguugaauuagacacacacacacagacacacacaaagaaucagcagagaaaacaaa

SEQ ID NO: 42228 - RNA, 64 nt, Homo Sapiens
aggggaaccaagagaaccaccuccuccacacacacacacacaccggugaucuaagggccgcggc

SEQ ID NO: 42229 - RNA, 64 nt, Homo Sapiens
ccaggggaaccaagagaaccgccuccuccacacacacacacacaaaggugaucuaagggccgcg

SEQ ID NO: 42230 - RNA, 64 nt, Homo Sapiens
caccaggggaaccaagagaacggccuccuccacacacacacacaagaaggugaucuaagggccg

SEQ ID NO: 42231 - RNA, 64 nt, Homo Sapiens
cacaccaggggaaccaagagcgcggccuccuccacacacacacacaagaaggugaucuaagggc

SEQ ID NO: 42232 - RNA, 64 nt, Homo Sapiens
cacacaccaggggaaccaaggccgcggccuccuccacacacacacucaagaaggugaucuaagg

SEQ ID NO: 42233 - RNA, 64 nt, Homo Sapiens
uuuuaagauggaaaacuuuacaggucuauugacucacacacaugcuuugagugaaaagauaaca

SEQ ID NO: 42234 - RNA, 64 nt, Homo Sapiens
ccacccuguugcugaccaagcccacuuccccccacacacacacccaagucagcuacucuccgug

SEQ ID NO: 42235 - RNA, 64 nt, Homo Sapiens
ccccacccuguugcugaccaugcccacuuccccccacacacacaugcaagucagcuacucuccg

SEQ ID NO: 42236 - RNA, 64 nt, Homo Sapiens
gaaggggagaaagugacucuguucucuuagcaaccgucuguagcaaagaagugcuuccagcauc

SEQ ID NO: 42237 - RNA, 64 nt, Homo Sapiens
uaaauaauuuuagaacagccagcauggcuuuuuacgucuguaaaauaauuggagaaaguucugc

SEQ ID NO: 42238 - RNA, 64 nt, Homo Sapiens
cuucucagaucaacucccuggcagacaugcugcacgucuguacccaggccccaaguuuccucug

SEQ ID NO: 42239 - RNA, 64 nt, Homo Sapiens
gaucaggaccagccuggucaagauggugaaacuccgucuguacuaaaaauacaaaauuuagcuu

SEQ ID NO: 42240 - RNA, 64 nt, Homo Sapiens
aggauggugucugugcacgugacuauuagaggagcgucuguagaaguaccugguuuggucagug

SEQ ID NO: 42241 - RNA, 64 nt, Homo Sapiens
gccauccuaguuuuuaucucaagaugugucauaccgucuguaaugaagcaggcaugcccucuuu

SEQ ID NO: 42242 - RNA, 64 nt, Homo Sapiens
gcggcaccgccauugucucaaccagccggcuccucgucuguacaccuggggauuucuuuugauu

SEQ ID NO: 42243 - RNA, 64 nt, Homo Sapiens
augagugaucuugugugggaaaagccuucccaggcgucuguaccgaaaggagcagcaaacaagg

SEQ ID NO: 42244 - RNA, 64 nt, Homo Sapiens
uaugguguaaccaugauucuauuauguauugguacgucuguagaccaagauauaauuuuuuaaa

SEQ ID NO: 42245 - RNA, 64 nt, Homo Sapiens
uaacaauacuuccuuggacgggugcgguggcucacgucuguaaucccagcacuuugggaggcug

SEQ ID NO: 42246 - RNA, 64 nt, Homo Sapiens
cccagcuauuugggaagcugggugugguguuucgcgucuguaguaaaaguacaaaaauuagaug

SEQ ID NO: 42247 - RNA, 64 nt, Homo Sapiens
gaaagacugugggaggauuccuacaaccacauaucgucuguauuuggaaccugcagaggccaac

SEQ ID NO: 42248 - RNA, 64 nt, Homo Sapiens
gcguagaaugaggguuguuagcguagaaucuguccgucuguaagaaguccugucugucuguaag

SEQ ID NO: 42249 - RNA, 64 nt, Homo Sapiens
uuuuauauauagauacauaugacuucuaaaauaacgucuguauaaauaaucuguuauaugaaca

SEQ ID NO: 42250 - RNA, 64 nt, Homo Sapiens
uagccuggaccucgccgggggaccagggagugcacgucuguagaucuguacauaucugggccuu

SEQ ID NO: 42251 - RNA, 64 nt, Homo Sapiens
cccagcacuuugggaggcugggcgcaguggcucacgucuguaauuccugaccuaaucuuagccc

SEQ ID NO: 42252 - RNA, 64 nt, Homo Sapiens
aaauguggacaagcuaguuuucaaauuuugugugcgucuguaaguucuuaaagaaccagcuucu

SEQ ID NO: 42253 - RNA, 64 nt, Homo Sapiens
cauuaagaauuaagaggcugggugcgguggcucacgucuguaaucccagcaccuugggaggccc

SEQ ID NO: 42254 - RNA, 64 nt, Homo Sapiens
gaauggcaaacacucggcugggcacaguggcucacgucuguaaucuuugggagcacuuugggag

SEQ ID NO: 42255 - RNA, 64 nt, Homo Sapiens
gauugugucuuuuuuuuuuuacucagcacuugcccgucuguauuagggacugauguuauguucg

SEQ ID NO: 42256 - RNA, 64 nt, Homo Sapiens
guuugguauuuagaauuagugcuguuguggagugcgucuguaaagugcuuguuuuaucauacuu

SEQ ID NO: 42257 - RNA, 64 nt, Homo Sapiens
cauaugcuuguuuuguuugacucuuggcugccuacgucuguaggguccccugaaaaucccacuu

SEQ ID NO: 42258 - RNA, 64 nt, Homo Sapiens
gagcugccccugucauagggagggggauucccagcgucuguagugcuuccuguuugcugaauaa

SEQ ID NO: 42259 - RNA, 64 nt, Homo Sapiens
uuggguuauaacacuaguauuauuguauaaagaacgucuguacagcauuccugauaauuguaug

SEQ ID NO: 42260 - RNA, 64 nt, Homo Sapiens
uaaaguacaacaauuagcagggcaugguggugcacgucuguagucccagcuacucaggaggcug

SEQ ID NO: 42261 - RNA, 64 nt, Homo Sapiens
caucuuauuugagauggggguggaugaaacauuacgucuguaguuuuagagucccagggacaac

SEQ ID NO: 42262 - RNA, 64 nt, Homo Sapiens
ggaagaggcagagggaggcaucucugugagugugcgucuguacggccccgugucgugugcauga

SEQ ID NO: 42263 - RNA, 64 nt, Homo Sapiens
auuucaucugguucauuuuguguuugcguggauacgucuguacuuuuucauaauaguggugaua

SEQ ID NO: 42264 - RNA, 64 nt, Homo Sapiens
gggcccucgccgcggccgccacgaccccccuggacgucuguaagacccuucugaacacucagga

SEQ ID NO: 42265 - RNA, 64 nt, Homo Sapiens
agaggaggaaguaauaguuucuaacugucggacccgucuguaaaccaaggacuaugaauacuaa

SEQ ID NO: 42266 - RNA, 64 nt, Homo Sapiens
guuguuaauauuucaaaugugugguuuaugaauacgucuguauaaucggcuucuggagugaaac

SEQ ID NO: 42267 - RNA, 64 nt, Homo Sapiens
aaaaauacaaaauuuagcugacauggugaaaccucgucuguacuguucaagaccagccuggcca

SEQ ID NO: 42268 - RNA, 64 nt, Homo Sapiens
ccuuugugacuccugagcgugaggugagccugugcgucuguaacacaaaaguauuggacugucg

SEQ ID NO: 42269 - RNA, 64 nt, Homo Sapiens
ucuggagcagccaggcgcucuauggaguuagaagcgucuguaucucugcuggucuccagccuug

SEQ ID NO: 42270 - RNA, 64 nt, Homo Sapiens
uuuaacugcugaaauuguauagugcuuggauuuccgucuguagaagaguuaggaauuguguuca

SEQ ID NO: 42271 - RNA, 64 nt, Homo Sapiens
aaauuuagacaacuuggccagccgugguggcucacgucuguaaucccagcacuuugggaggcug

SEQ ID NO: 42272 - RNA, 64 nt, Homo Sapiens
ugugucauugcgugaagcaguguuucuguauauccgucuguacgcucaugcacuccuugagaag

SEQ ID NO: 42273 - RNA, 64 nt, Homo Sapiens
auggaagcaagacuuccaacggccucagcuuucucgucuguauaggacaaguacuaccuuccug

SEQ ID NO: 42274 - RNA, 64 nt, Homo Sapiens
aggagcuagggcugcugccuguccuccaguauuccgucuguagcuaccuacgccuagggagccc

SEQ ID NO: 42275 - RNA, 64 nt, Homo Sapiens
ggggaaagagcaaccccagcccgucccuuccccccgucuguauauagacauauauccucuuuuu

SEQ ID NO: 42276 - RNA, 64 nt, Homo Sapiens
cuaauuuugcaugaguaaguuuacaaauauguaucgucuguaaagcagcaugugcagauuauuc

SEQ ID NO: 42277 - RNA, 64 nt, Homo Sapiens
auaggaagagaaacauaacuacuguuccagguaacgucuguaucauacaguuaguguugccagu

SEQ ID NO: 42278 - RNA, 64 nt, Homo Sapiens
aagaguccuuacugaagccaggcaccguggcucacgucuguaaucccagcgcuuugggaggccg

SEQ ID NO: 42279 - RNA, 64 nt, Homo Sapiens
caaaaugcaaaaauuagccaacauggcaaaaccccgucuguacuguuugagaccagccuggcca

SEQ ID NO: 42280 - RNA, 64 nt, Homo Sapiens
cccaggacuuugggaggcuggccaugguggcucacgucuguaaucuagaaagcauuuuaggcca

SEQ ID NO: 42281 - RNA, 64 nt, Homo Sapiens
augaugguauagauuuucuuaaguuuucuaaguacgucuguagcugauauuuacucuuccuuuu

SEQ ID NO: 42282 - RNA, 64 nt, Homo Sapiens
cagggagccagggugagggcggacuggcuggaaacgucuguaugcucgugcuggugugggcaug

SEQ ID NO: 42283 - RNA, 64 nt, Homo Sapiens
ugaagugcuguuaucggaaaccaucagacauuuccgucuguacucucagaaagcaccgaaugac

SEQ ID NO: 42284 - RNA, 64 nt, Homo Sapiens
cgcagaguaguugcaugucaccugauuccugcuucgucuguauccaccugagacuuauuggguc

SEQ ID NO: 42285 - RNA, 64 nt, Homo Sapiens
cuaaauuuauugguguuucuugaaaguucacugucgucuguauaaacaauguuaaugcuguaag

SEQ ID NO: 42286 - RNA, 64 nt, Homo Sapiens
uuuuauacuuagaacauuugguugugcagagugacgucuguacuacaagacuuagacuucccga

SEQ ID NO: 42287 - RNA, 64 nt, Homo Sapiens
ugagaugauucagaaggggaggggagacagguaacgucuguaagcugaaguuucacuccggagu

SEQ ID NO: 42288 - RNA, 64 nt, Homo Sapiens
cccagcacuuugggaggccgggcgcgguggcucacgucuguaauaaaaaauguugaaccggcug

SEQ ID NO: 42289 - RNA, 64 nt, Homo Sapiens
aaccccagugacaaguggguaaaaggggccauuccgucuguaccugcuccacagcuucaucacc

SEQ ID NO: 42290 - RNA, 64 nt, Homo Sapiens
cuguuuuucacgaguaucaacuuucauacugacgcgucuguaaucuguucuuaugcucauuuug

SEQ ID NO: 42291 - RNA, 64 nt, Homo Sapiens
guacucccaaugcuguguaucaugacacuaucuucgucuguaguauuuaugauguuaagauaau

SEQ ID NO: 42292 - RNA, 64 nt, Homo Sapiens
ggcgagaaccacauuggacggucccggcucagaccgucuguacucagagcgacggaugcccccu

SEQ ID NO: 42293 - RNA, 64 nt, Homo Sapiens
guuugugagaacucacgccgggggugaaaauguacgucuguagcauggagaagccuucagggua

SEQ ID NO: 42294 - RNA, 64 nt, Homo Sapiens
guuccagaccaggcuggccagcauggugaaaccccgucuguacuaaaaauacaaaaaauuaacu

SEQ ID NO: 42295 - RNA, 64 nt, Homo Sapiens
cccagcacuuugggaggcugggcgcgguggcucacgucuguaauauuauuuaaaagacaggccg

SEQ ID NO: 42296 - RNA, 64 nt, Homo Sapiens
cccagcacuuugggagggcaggcguggugacucacgucuguaaucaaugagaaauuaccggcca

SEQ ID NO: 42297 - RNA, 64 nt, Homo Sapiens
uauguuuuuauaauuccaugggagcacuguggaacgucuguaaaggucuuugcuucugauuaca

SEQ ID NO: 42298 - RNA, 64 nt, Homo Sapiens
aauaugugcacuaucagcugggugcaguggcucacgucuguaaucccagcacuuugggaggccg

SEQ ID NO: 42299 - RNA, 64 nt, Homo Sapiens
uauaaaaaauaaucuauuucuaugagaaaagaggcgucuguauauuuugggaaucuuuuccguu

SEQ ID NO: 42300 - RNA, 64 nt, Homo Sapiens
ggcugugaggacacugcggggguuggggggggggcgucuguaccucaggggaugccccgcugug

SEQ ID NO: 42301 - RNA, 64 nt, Homo Sapiens
gugcagggugggaggagaagaccaaacgaaguaacgucuguaaaaccccuuccuggacagcgua

SEQ ID NO: 42302 - RNA, 64 nt, Homo Sapiens
gucggucuucguccaucugcaguguagaaacccacgucuguaagcguagucagcccuugcgcuc

SEQ ID NO: 42303 - RNA, 64 nt, Homo Sapiens
auggcaaaaaugcugccccccaagcugggcuccccgucuguaagcacugcuggauggcucagag

SEQ ID NO: 42304 - RNA, 64 nt, Homo Sapiens
cauauagccuagcauuuauaacagaauuguugaacgucuguaaaugauuuuuuuuuuuuuugca

SEQ ID NO: 42305 - RNA, 64 nt, Homo Sapiens
auuauaauguugcccaguguuagcuugucuguagcgucuguauacuaugcagaugccugggccg

SEQ ID NO: 42306 - RNA, 64 nt, Homo Sapiens
guauaguaguuaaauacagcgauaaucaguauuugacuguaauauggugucagcaguacacaug

SEQ ID NO: 42307 - RNA, 64 nt, Homo Sapiens
ggugucagcaguacacauggcaaauagaugcaaugacuguaaaugguagcaagaguuccugaua

SEQ ID NO: 42308 - RNA, 64 nt, Homo Sapiens
gcccagggccgcccuagcaacuuccuguacauaugacuguaaaaugguaaacguguguauuaua

SEQ ID NO: 42309 - RNA, 64 nt, Homo Sapiens
auguauacauauacauauauauaauauauaugaagacuguaaauguuaagacgacuaguguucu

SEQ ID NO: 42310 - RNA, 64 nt, Homo Sapiens
cuuggggggugggggagauaaaaagaacuuaaaauggguaaaguaagaaauguuaaaaaguccc

SEQ ID NO: 42311 - RNA, 64 nt, Homo Sapiens
agucccuguuuuguccugaaauuuuagucuauucuggguaaauaggauuuucugacacagauau

SEQ ID NO: 42312 - RNA, 64 nt, Homo Sapiens
guggcuguaaccuaaaccaaauguaaaggaguccuggguaaaauucaggguccauuucucuugg

SEQ ID NO: 42313 - RNA, 64 nt, Homo Sapiens
aaaacaaaacauuuccuauacucuuugguugguguggguaaaagcuucaccauacugguuucuu

SEQ ID NO: 42314 - RNA, 64 nt, Homo Sapiens
accagcagcuagguuuugaauguuuucacuugaauggguaaauacaacugugccucccucuguc

SEQ ID NO: 42315 - RNA, 64 nt, Homo Sapiens
uuuaggaugagacauuuuugguuuugguuuuguuuggguaaauuuuaaauggugugaaaaucga

SEQ ID NO: 42316 - RNA, 64 nt, Homo Sapiens
uugaaagggugugugauuacaccauuguuaaugcuggguaaaaacuaucuucuugcagccuugc

SEQ ID NO: 42317 - RNA, 64 nt, Homo Sapiens
ccuauaaucccggcuacucgggaggcugaggcaggagaaucaccugaacccgggaggcaaaggu

SEQ ID NO: 42318 - RNA, 64 nt, Homo Sapiens
ccuguagucccaacuacuagggaggcugaggcaggagaaucacuugaacccaggagguggaggu

SEQ ID NO: 42319 - RNA, 64 nt, Homo Sapiens
uugcaaaacggaugaguuauaaucucuuaauauugagaaucagggagucauauacauuaguuuu

SEQ ID NO: 42320 - RNA, 64 nt, Homo Sapiens
agaugauaguccaauuuuuagaaaugucgaucaagagaaucaacuacauuuccauuuauuguuu

SEQ ID NO: 42321 - RNA, 64 nt, Homo Sapiens
ugaacccgggggacagagguggaggcugaggcaggagaaucacuccuauaaucccagcuacugg

SEQ ID NO: 42322 - RNA, 64 nt, Homo Sapiens
ugaaccccagaggcagagguggaggcugagacaggagaaucacccccguaaucccagcuacuca

SEQ ID NO: 42323 - RNA, 64 nt, Homo Sapiens
ugaaccugggaggcggauguggaggcugaggcaggagaaucacugccuguaaucucacuacaca

SEQ ID NO: 42324 - RNA, 64 nt, Homo Sapiens
auuucucaauaauuuccucccugagcucugauaagagaaucaacguuagcaccauuaacuccuc

SEQ ID NO: 42325 - RNA, 64 nt, Homo Sapiens
guaaaaaaaaaaaguuaacccuuaaaaacucaaugagaaucaugggcuucaauuauuugggugc

SEQ ID NO: 42326 - RNA, 64 nt, Homo Sapiens
aaagcaggagaccaguagcauggauuuugucaaggagaaucauauacacaaaauuacugucacg

SEQ ID NO: 42327 - RNA, 64 nt, Homo Sapiens
gcacccaguccacuggcaguggaauugcuuuccugagaaucauucugaggcugggcuauugcuu

SEQ ID NO: 42328 - RNA, 64 nt, Homo Sapiens
uuguagaauguaugaggaagugggaaguaucucagagaaucagcuaaguuuccuaacuugucca

SEQ ID NO: 42329 - RNA, 64 nt, Homo Sapiens
ugagcccaggagguggagguggaggcugaggcaggagaaucacuccuguaaucccagcuacuug

SEQ ID NO: 42330 - RNA, 64 nt, Homo Sapiens
caaaacauccccagccacaggacagggagcccgcgagaaucauuaccaacagggucaccaagca

SEQ ID NO: 42331 - RNA, 64 nt, Homo Sapiens
ugaacccaggaggcggagguggaggcugaggcacgagaaucacuccuuuaaucccagcuacucg

SEQ ID NO: 42332 - RNA, 64 nt, Homo Sapiens
ugaaccugggacacggagguggaggcuaaggcaggagaaucacuccuguaaucuuagcuacuca

SEQ ID NO: 42333 - RNA, 64 nt, Homo Sapiens
caauaauaguccuuguagccgcacaugaaaauaaaauauaaaguuuuuuaaaauaauuauacuu

SEQ ID NO: 42334 - RNA, 64 nt, Homo Sapiens
gaccauugaugauauccagugaguuauaaauuuaaauauaaauuaugcaaaucaugcagaauuu

SEQ ID NO: 42335 - RNA, 64 nt, Homo Sapiens
gcuaacuuaagaagaggugaaccauaucugauuuaauauaaacuacauuacuuccauuucagaa

SEQ ID NO: 42336 - RNA, 64 nt, Homo Sapiens
uaaaugucuuuuuccuccaauaagggcuagagcaaauauaaaauuuuuguuguuaugcauugau

SEQ ID NO: 42337 - RNA, 64 nt, Homo Sapiens
uacauccaaagaaaugccaaauaauguguuuuaaaauauaaagcuauuguggggauuaaguuag

SEQ ID NO: 42338 - RNA, 64 nt, Homo Sapiens
uauagacauggugguaggaagaucuuuugcauauaauauaaaugcacaaaugguaaauuaugug

SEQ ID NO: 42339 - RNA, 64 nt, Homo Sapiens
ugugaacauaaguguuuauuaaaaauggcaauuaaauauaaauuacuuuugugggggaaugccu

SEQ ID NO: 42340 - RNA, 64 nt, Homo Sapiens
cuagcaauaaaaucuaauuuuuaaaaaguauauaaauauaaaauguauaaaugauggauagauu

SEQ ID NO: 42341 - RNA, 64 nt, Homo Sapiens
uguuugugcauuuggggggaauucaucucucuuuaauauaaaguuggaugcggaacccaaauua

SEQ ID NO: 42342 - RNA, 64 nt, Homo Sapiens
ccacguauguuuuuguguauuuguuaaugguuugaauauaaacacuauauggcagugucuuucc

SEQ ID NO: 42343 - RNA, 64 nt, Homo Sapiens
cuuagaaauugucuuuauacuagguauuaacuagaauauaaaucuuaaguaauguuuagagucg

SEQ ID NO: 42344 - RNA, 64 nt, Homo Sapiens
uuaaaaaacuucuguucuacguuaagcaauguuuaauauaaauuuacacugacaggauuuacua

SEQ ID NO: 42345 - RNA, 64 nt, Homo Sapiens
augaaacucaauaauaaacaaauauaaaauacacaauauaaaauuguaacuaguacuaauuaua

SEQ ID NO: 42346 - RNA, 64 nt, Homo Sapiens
acacaauauaaaauaugaaauaguacuaauuauaaauauaaaauguccaugucauauguguaac

SEQ ID NO: 42347 - RNA, 64 nt, Homo Sapiens
aaacuaagacagacuguagacaaaauuuuucccaaauauaaagaacauuuucacacuuaagauu

SEQ ID NO: 42348 - RNA, 64 nt, Homo Sapiens
acaaaucugggcuccuuugaccccuuuucccuguaauauaaauucacucauacauauauguguu

SEQ ID NO: 42349 - RNA, 64 nt, Homo Sapiens
gaaauaaaaccaagaggugaucacguaucaaacuaauauaaaaaaaauuaaguuggacuaacau

SEQ ID NO: 42350 - RNA, 64 nt, Homo Sapiens
cuguaacauuuccuuuaaaaauaccaaaucaaauaauauaaaagguacuuauaacuguuauuaa

SEQ ID NO: 42351 - RNA, 64 nt, Homo Sapiens
uugauguacauguugagauaggagcccauuuuauaauauaaaccagucuugaaugaauacaaaa

SEQ ID NO: 42352 - RNA, 64 nt, Homo Sapiens
agauucuaacuaggaugaauaacagaguggaauaaauauaaaugaaauuaguuaccaaaucaua

SEQ ID NO: 42353 - RNA, 64 nt, Homo Sapiens
cauuuuaauuauuuguacuaguagauuucuauauaauauaaauauuaguaguaucuuccauugu

SEQ ID NO: 42354 - RNA, 64 nt, Homo Sapiens
auuaguuuacaucauuuuugcuuugggguuuuuuaauauaaauuucccaucuccacuguuaucc

SEQ ID NO: 42355 - RNA, 64 nt, Homo Sapiens
uguuaaaaaaaaaaaccaaagauuuaaaacauguaauauaaagacuaguuugcauuccugauau

SEQ ID NO: 42356 - RNA, 64 nt, Homo Sapiens
aaggaggaaguuuauauuuaccuccuaagggguuaauauaaaucaacauaaaguuauuauagug

SEQ ID NO: 42357 - RNA, 64 nt, Homo Sapiens
uagcaacaguaucuuugcuacuuuuuaaaggacaaauauaaaaaguaaguggagaagggccuac

SEQ ID NO: 42358 - RNA, 64 nt, Homo Sapiens
uaaagaggaaaggcgauggugaugucuguaguacaauauaaaccauaauugugauuuaccuuaa

SEQ ID NO: 42359 - RNA, 64 nt, Homo Sapiens
ucacucauagcauuucuauauuugaaaguagcccaauauaaaacuuuugauucuaaaauuaaac

SEQ ID NO: 42360 - RNA, 64 nt, Homo Sapiens
gauuucaauuuuuaucaauucauaaauuaaaaacaauauaaaaauuccagagggguguguguau

SEQ ID NO: 42361 - RNA, 64 nt, Homo Sapiens
auagagagguaagcauuaguggcacagcugagaaaauauaaaagguaguucugucucuauccug

SEQ ID NO: 42362 - RNA, 64 nt, Homo Sapiens
agccuuggauguuccuguggaccugacaguuaaaaauauaaagaaccuaggauucaauuccaac

SEQ ID NO: 42363 - RNA, 64 nt, Homo Sapiens
uagagucuagugaaaaaaaugagugggaagaaugaauauaaaaguaauaauauaaggaaaaagg

SEQ ID NO: 42364 - RNA, 64 nt, Homo Sapiens
aaaacguuacuuguauauugcaaauggaagauagaauauaaaauaaacaucgaaaggcuuaugc

SEQ ID NO: 42365 - RNA, 64 nt, Homo Sapiens
uaucucauugcagccagugauauauauaaauauaaauauaaauaaacauauauauauauauaca

SEQ ID NO: 42366 - RNA, 64 nt, Homo Sapiens
uaaauauaucucauugcagcuauacauauauauaaauauaaauaguacauaacauauauauaua

SEQ ID NO: 42367 - RNA, 64 nt, Homo Sapiens
uaacguguauuuuucaggacaaacuguuacacaaaauauaaaccuuuucauuucaguuuuccau

SEQ ID NO: 42368 - RNA, 64 nt, Homo Sapiens
accucuuuaaaaaguaaccaauucacucagaaguaauauaaauuucacagugaaaggcaaaauu

SEQ ID NO: 42369 - RNA, 64 nt, Homo Sapiens
ugaaaguauguagucagcucauccuuugucaggaaauauaaacuacaggauggaaaaaggucau

SEQ ID NO: 42370 - RNA, 64 nt, Homo Sapiens
aauuggagguuuuugcuaaaauguggaggaauuaaauauaaaggucaggcccuucaaagaugau

SEQ ID NO: 42371 - RNA, 64 nt, Homo Sapiens
guuuucuuuaaaagucauauuuuuuuuuuuuuucaauauaaaguaucccauuagcuuuuuuuuu

SEQ ID NO: 42372 - RNA, 64 nt, Homo Sapiens
ggaacuucaauuaugaaaaacugauuuuuuuguaaauauaaagacuugcugcuuucaguauuuc

SEQ ID NO: 42373 - RNA, 64 nt, Homo Sapiens
cuuccucuuuuuuuuuuaauuggguaggacacccaauauaaaaacagucaauauuugacaaugu

SEQ ID NO: 42374 - RNA, 64 nt, Homo Sapiens
uucuauauugaauaaacaauguaacauagauaacaauauaaauaaaagugguaugaccagugcu

SEQ ID NO: 42375 - RNA, 64 nt, Homo Sapiens
agucauuauaauugauauaauagcucuaacaugcaauauaaaauucauaggaguauuaauagcc

SEQ ID NO: 42376 - RNA, 64 nt, Homo Sapiens
gaugagucuauauuaucuagcuuucuauuacccuaauauaaacugguauaagaagacuuuccuu

SEQ ID NO: 42377 - RNA, 64 nt, Homo Sapiens
uuacuucuucucauacuauuuaagagaacaagcaaauauaaacagcaacuuguguuccuaacag

SEQ ID NO: 42378 - RNA, 64 nt, Homo Sapiens
caaaguuaagaaucuuuauaguucuacuccauuaaauauaaagcaagauaauaaaaauuguugc

SEQ ID NO: 42379 - RNA, 64 nt, Homo Sapiens
gcccgcugaugcauuguuuauuuuuuuugcucauaauauaaauaucagauuauguuuaggagug

SEQ ID NO: 42380 - RNA, 64 nt, Homo Sapiens
accugcuccuuauugccauacccacgaacuguuaaauauaaaaaaauucaaaguauuugacauc

SEQ ID NO: 42381 - RNA, 64 nt, Homo Sapiens
gaaaagaaaguuguaugugccacauaaaacucugaauauaaaaguugcuguucuacuauuuuaa

SEQ ID NO: 42382 - RNA, 64 nt, Homo Sapiens
uauauguaauauauugacauaaaagacacaaacuaauauaaaguuauaguuauaucuuaaaaua

SEQ ID NO: 42383 - RNA, 64 nt, Homo Sapiens
cuggagguguuugaucaguuuucaagaaacuuggaauauaaauaauuuuauaauucaacaaagg

SEQ ID NO: 42384 - RNA, 64 nt, Homo Sapiens
guuucccaguuaacuaggguuuacuguuugagccaauauaaauguuuaacuguuugugauggca

SEQ ID NO: 42385 - RNA, 64 nt, Homo Sapiens
aguguuuacuguacuauuucaaagcuucuaaauaaauauaaaauauauauauuauauuauauaa

SEQ ID NO: 42386 - RNA, 64 nt, Homo Sapiens
uauuuuacauaguuuugugacuuaauuacacaugaauauaaaaucuauaauucuauaugaauau

SEQ ID NO: 42387 - RNA, 64 nt, Homo Sapiens
acucuugugacauuuuuuugguuaucaacaacuaaauauaaauuacuuuggaaaaaguaaggcu

SEQ ID NO: 42388 - RNA, 64 nt, Homo Sapiens
aaauaaaaguugaacuugaguuacauuuaauuuaaauauaaaugcauuuugagaaauguuaaga

SEQ ID NO: 42389 - RNA, 64 nt, Homo Sapiens
acuuauuuacaaaccauauuaaaaggcuaauuuaaauauaaauaauauaaagugcucugaauaa

SEQ ID NO: 42390 - RNA, 64 nt, Homo Sapiens
caaaccauauuaaaaggcuaauuuaaauauaaauaauauaaagugcucugaauaaagcagaaau

SEQ ID NO: 42391 - RNA, 64 nt, Homo Sapiens
uucuuagagaacaccucuuuaggaaagauuauaaaauauaaaauaugucuuucucauauuucag

SEQ ID NO: 42392 - RNA, 64 nt, Homo Sapiens
acaaauauacuugaauauuguaaaguaauguaaaaauauaaagcugaaagcuaaaaauagguuc

SEQ ID NO: 42393 - RNA, 64 nt, Homo Sapiens
uugaaacuaugagaacauauucaaaagaaaauaaaauauaaauuccuuaauuuguuuuccagaa

SEQ ID NO: 42394 - RNA, 64 nt, Homo Sapiens
ucuuuauuaauauuuuauuauuauuauauauaaaaauauaaauguuguugguaaacuaaucauu

SEQ ID NO: 42395 - RNA, 64 nt, Homo Sapiens
uagagcuagaaucauauuaucuuuuguaauacugaauauaaacauaauauuuuagaaaauauuc

SEQ ID NO: 42396 - RNA, 64 nt, Homo Sapiens
uauuuuuuaaacacuuguuaauuuuuuagauuugaauauaaaugcuuaacacauugaaacuauu

SEQ ID NO: 42397 - RNA, 64 nt, Homo Sapiens
cgcaggcuauuuguucagagaggccuuuuguuuaaauauaaauguuuaaauauaaauguuuguc

SEQ ID NO: 42398 - RNA, 64 nt, Homo Sapiens
ucagagaggccuuuuguuuaaauauaaauguuuaaauauaaauguuugucuggauuggcuauaa

SEQ ID NO: 42399 - RNA, 64 nt, Homo Sapiens
auagucuugcuuauuuuguugcgaaggccaguggaauauaaaaaucaauggcauuaaugaggag

SEQ ID NO: 42400 - RNA, 64 nt, Homo Sapiens
aagauugaaaagacuaaugagaagauaacaugacaauauaaaaagacagaaacucaaaaaguau

SEQ ID NO: 42401 - RNA, 64 nt, Homo Sapiens
agacgucaaucaaaaugucaaauaugugugucagaauauaaauaauuuuucacauuguauuguu

SEQ ID NO: 42402 - RNA, 64 nt, Homo Sapiens
acuaguuaaauccucaccuaaucucuuggguaugaauauaaaugugugucaucguuauauuguu

SEQ ID NO: 42403 - RNA, 64 nt, Homo Sapiens
gucugccacugaauuuccagugacuaaguggaaaaauauaaaacauaugaauauaaagaaagaa

SEQ ID NO: 42404 - RNA, 64 nt, Homo Sapiens
uccagugacuaaguggaaaaauauaaaacauaugaauauaaagaaagaaagagacaagucaaau

SEQ ID NO: 42405 - RNA, 64 nt, Homo Sapiens
uugugggguuuuuuugagaucugaaaaaggaaguaauauaaauuacaaguuuuacgagggaaaa

SEQ ID NO: 42406 - RNA, 64 nt, Homo Sapiens
uacuuuaacuaagccagugacuuggaaacuaucaaauauaaauauuccccaaugguaaccuuac

SEQ ID NO: 42407 - RNA, 64 nt, Homo Sapiens
auuuugucaauuauaccuaauguuguacaacugaaauauaaauacaaaacauguugaacaucca

SEQ ID NO: 42408 - RNA, 64 nt, Homo Sapiens
ggaaacagggguuagggaaaauuuauccacugccaauauaaagaguagaguuaacuuacuuucc

SEQ ID NO: 42409 - RNA, 64 nt, Homo Sapiens
uaauuuucaggaauccaguacuauuccuugugaaaauauaaauucauugcuagucuagaauagu

SEQ ID NO: 42410 - RNA, 64 nt, Homo Sapiens
auaguguaugcaaguuaaugucgaaagcacacaaaauauaaauagacaacauuauaacuaaaag

SEQ ID NO: 42411 - RNA, 64 nt, Homo Sapiens
ucagagugcuucaguaaaaaauugcaaagcuuuaaauauaaauuaguacagugaauuuugcuuu

SEQ ID NO: 42412 - RNA, 64 nt, Homo Sapiens
uuguuaaagaauauuuuuaagaaguguggauaucaauauaaaauaaauguccuguucuuuuucu

SEQ ID NO: 42413 - RNA, 64 nt, Homo Sapiens
ugccauaguuaacaaaugaugauccuccaauguaaauauaaacacugaaaagggaagaggggua

SEQ ID NO: 42414 - RNA, 64 nt, Homo Sapiens
aagcaguuaauaguaugaucuuuaaaguuuugacaauauaaaauaaacuugguaacuguuuuac

SEQ ID NO: 42415 - RNA, 64 nt, Homo Sapiens
gacaauauaaaauaaacuugguaacuguuuuacaaauauaaaaguauaauaaauaugcagccca

SEQ ID NO: 42416 - RNA, 64 nt, Homo Sapiens
cauguacagaagaaauagaauacauguucaugcaaauauaaauuauguauucuaauauaggugu

SEQ ID NO: 42417 - RNA, 64 nt, Homo Sapiens
augaugcuaguuuauuuuuuuagcagugaaaaugaauauaaaaaaggugacauaggucaaguuu

SEQ ID NO: 42418 - RNA, 64 nt, Homo Sapiens
guaauuauuuaccaaacuuaaaaacauuucuauaaauauaaagcuuuucuuuauauuuaagaca

SEQ ID NO: 42419 - RNA, 64 nt, Homo Sapiens
auaaauauaaagcuuuucuuuauauuuaagacaaaauauaaaggcuagaauuugguuccuucuc

SEQ ID NO: 42420 - RNA, 64 nt, Homo Sapiens
uccaccauugccuguuagccguuaaucaaaguugaauauaaaaauucuuguaaaguccauuuau

SEQ ID NO: 42421 - RNA, 64 nt, Homo Sapiens
aucacauauacugauuuuaauucuuauggaaaaaaauauaaaagucgguguuuuuauuuuuuuu

SEQ ID NO: 42422 - RNA, 64 nt, Homo Sapiens
uaguuagauuuugcaagucucuaacaacaagcauaauauaaaaucuguaauuuugagcacugcu

SEQ ID NO: 42423 - RNA, 64 nt, Homo Sapiens
acagugccuuagaagacagucuuaugucauugagaauauaaagauguucauacuuguaaagcau

SEQ ID NO: 42424 - RNA, 64 nt, Homo Sapiens
augcuuuguauaauucauuuaagccaaauauaaaaauauaaaugccauauugccuuauguccca

SEQ ID NO: 42425 - RNA, 64 nt, Homo Sapiens
uauaaaugaugcuuuguauaaugucccaaagccaaauauaaaaauaaguucuccauauugccuu

SEQ ID NO: 42426 - RNA, 64 nt, Homo Sapiens
caagauguuucauuuuacuguauauuuuguaguuaauauaaauguugcucuaaucagauugcuu

SEQ ID NO: 42427 - RNA, 64 nt, Homo Sapiens
uuaauaagauuuuucaaaaucgccaggacuggugaauauaaaugaugauugaacuggaauaaua

SEQ ID NO: 42428 - RNA, 64 nt, Homo Sapiens
aaaccagccugggcaaaacccugucucuacuaaaaauauaaaaauuagccaggcaugauggcac

SEQ ID NO: 42429 - RNA, 64 nt, Homo Sapiens
cuggccaacauggcaaaaccccgucucuaugaaaaauauaaaaauuagcugggcaugguggcag

SEQ ID NO: 42430 - RNA, 64 nt, Homo Sapiens
caguacucaugcugacugaaagcugccacccacaaauauaaauacuauggauaaauaauuugag

SEQ ID NO: 42431 - RNA, 64 nt, Homo Sapiens
agucaaaauacacuucagguuaauuuuagcucagaauauaaauuuacacaaauccugagguucu

SEQ ID NO: 42432 - RNA, 64 nt, Homo Sapiens
aggaaaauaaaucaaugaaaguaaagagaauaucaauauaaauacauauugcuauaguacuucu

SEQ ID NO: 42433 - RNA, 64 nt, Homo Sapiens
ucacacuuuaauuuggagcauggcucagaauuuuaauauaaacauguguaccugcuuaguuaau

SEQ ID NO: 42434 - RNA, 64 nt, Homo Sapiens
ugcauuugccaaaauuuaccgaugugugaacuucaauauaaagugucucauucuuuaagauaca

SEQ ID NO: 42435 - RNA, 64 nt, Homo Sapiens
auaaaaauuuaugaauauuaaaauuaucauuaauaauauaaaacacuuauuugagauuaaauua

SEQ ID NO: 42436 - RNA, 64 nt, Homo Sapiens
cccaccuuuccaugcuuaagacaaaaaugucuuaaauauaaagcugugauuauaucaaaaaucc

SEQ ID NO: 42437 - RNA, 64 nt, Homo Sapiens
auuuguuauucuaacucuauuuuuuaaaguuaauaauauaaaguggccauguaaaauauuuuau

SEQ ID NO: 42438 - RNA, 64 nt, Homo Sapiens
aaaauaaaauuuuaacccaaaugaauaacuaagaaauauaaaacaagcacaaaaucuuagggaa

SEQ ID NO: 42439 - RNA, 64 nt, Homo Sapiens
aaggaagauugaacuaauaaaauuuuauuucuuaaauauaaauuugaccuaaaauauuuucuca

SEQ ID NO: 42440 - RNA, 64 nt, Homo Sapiens
aaaaugcuacuuaaaacuuugguuguuuuccuguaauauaaaagaaaaaguuaauuuaucaauu

SEQ ID NO: 42441 - RNA, 64 nt, Homo Sapiens
gcauuacuuugaguuaaauuugaauagaguauuaaauauaaaguuguagauucuuauguguuuu

SEQ ID NO: 42442 - RNA, 64 nt, Homo Sapiens
gaaagaacccuguuagaucuugguuugugauaaaaauauaaagacagaagacaugaggaaaaac

SEQ ID NO: 42443 - RNA, 64 nt, Homo Sapiens
aucuuuggaggaugggagagaucucauagcaguuaauauaaaacauuacgugaccggcaaauaa

SEQ ID NO: 42444 - RNA, 64 nt, Homo Sapiens
aaaaugugaaaaccaaagugacuugaauugacgcaauauaaaacgcgcugcccccugagaaaac

SEQ ID NO: 42445 - RNA, 64 nt, Homo Sapiens
caaauuaauguuuuauagaccaaaaaaauaguaaaauauaaaaagauuuaaaaacaaaaaaaca

SEQ ID NO: 42446 - RNA, 64 nt, Homo Sapiens
aaauaaaaaaaggaaaggaaaaaaaacauugcaaaauauaaaauaaaacuuaaauauuauggaa

SEQ ID NO: 42447 - RNA, 64 nt, Homo Sapiens
aauguuauugcaauacauacuguuugaauugucaaauauaaaaucaacugggccaauauaaaca

SEQ ID NO: 42448 - RNA, 64 nt, Homo Sapiens
uguuugaauugucaaauauaaauacaacugggccaauauaaacaauagccaauuaacacaacca

SEQ ID NO: 42449 - RNA, 64 nt, Homo Sapiens
uauugccuacaauuguggacuauuauaaaucaccaauauaaauuuaaugacugaaaaaaauuau

SEQ ID NO: 42450 - RNA, 64 nt, Homo Sapiens
uauuugcauauauuggaggaggagauuauucuaaaauauaaacuuuauuugcuuuuuuuaaaaa

SEQ ID NO: 42451 - RNA, 64 nt, Homo Sapiens
aaaacagccaaauaaaucacuuauggaaauguuuaauauaaauuuuauagucauagucauugga

SEQ ID NO: 42452 - RNA, 64 nt, Homo Sapiens
gucauagucauuggaacuugcauccuguauuguaaauauaaauguauauauuaugcauuaaauc

SEQ ID NO: 42453 - RNA, 64 nt, Homo Sapiens
uguacuagcccaguauuuauuuacauugcuuuguaauauaaaucuguuuuagaacugcagcggu

SEQ ID NO: 42454 - RNA, 64 nt, Homo Sapiens
aaugcugucccauaaaaugccauuccuauuuucuaauauaaaacucuuuuccaggaagcaugcu

SEQ ID NO: 42455 - RNA, 64 nt, Homo Sapiens
ucuguuugugcauuucugacggaaaggacaauuuaauauaaauuuucccauauuuuaaaaggag

SEQ ID NO: 42456 - RNA, 64 nt, Homo Sapiens
guaucaaagguuccuaaggaucuuuucugagguuaauauaaagaauguucaaaugagagagcuu

SEQ ID NO: 42457 - RNA, 64 nt, Homo Sapiens
gcaucuaaacaugacauuuaaagguguggaagugaauauaaaaucuuuaguaagaaaggauaaa

SEQ ID NO: 42458 - RNA, 64 nt, Homo Sapiens
ugucaguggaauaaaauuuccauuauauuuauagaauauaaauucugcuaauucaaggcuuaua

SEQ ID NO: 42459 - RNA, 64 nt, Homo Sapiens
guuucugauuugaagaaacugacauuccuuuaaaaauauaaauauaaauacauacauacauaga

SEQ ID NO: 42460 - RNA, 64 nt, Homo Sapiens
gauuugaagaaacugacauuccuuuaaaaauauaaauauaaauacauacauacauagauauaua

SEQ ID NO: 42461 - RNA, 64 nt, Homo Sapiens
ucuuguuuuaagauacaaguaaaauuaaucuuuaaauauaaauguaaauuaguacacaaaacua

SEQ ID NO: 42462 - RNA, 64 nt, Homo Sapiens
ccccuuauccuuaacauauauaguauauuuaaaaaauauaaaauuguauuguacuaaugugaug

SEQ ID NO: 42463 - RNA, 64 nt, Homo Sapiens
uucauguagcguaucacauaacuuuuuugcaaaaaauauaaaaagaaauaaacuucaauguauu

SEQ ID NO: 42464 - RNA, 64 nt, Homo Sapiens
uacugugcuagugacuggaggcccugcuacugcaaauauaaaacauaaaguuuguuuaaaaaaa

SEQ ID NO: 42465 - RNA, 64 nt, Homo Sapiens
auuauaccagggauguauaguaagucagggaacuaauauaaaugaugacagucauggcugcacu

SEQ ID NO: 42466 - RNA, 64 nt, Homo Sapiens
ucuggguauggaaauaacccugugaugauguguuaauauaaaauguugggagggaauauuccca

SEQ ID NO: 42467 - RNA, 64 nt, Homo Sapiens
gacacgggaaaugcuucucgagaaauaagcaaacaauauaaagaauacauuggaaauaaacagu

SEQ ID NO: 42468 - RNA, 64 nt, Homo Sapiens
uugaacugauuagaauguucucauauaaaauaauaauauaaagucuguaauuagagaauuuauu

SEQ ID NO: 42469 - RNA, 64 nt, Homo Sapiens
aagaucuuaauaaaagcaaguuuaaaaucuuaggaauauaaauauaucaagugaguuugcugau

SEQ ID NO: 42470 - RNA, 64 nt, Homo Sapiens
guaaaaaguaguauuuuguauauuuuuguaacaaaauauaaaugaagauauuuuaccaugaaga

SEQ ID NO: 42471 - RNA, 64 nt, Homo Sapiens
ugaagagauugcacuuauccuugagaacagucuaaauauaaaugaagauauuuuaccaugaaga

SEQ ID NO: 42472 - RNA, 64 nt, Homo Sapiens
cauuuuuguauguuuuauuguuuaguauuauauuaauauaaaaaaguuacaagcauugaacuuc

SEQ ID NO: 42473 - RNA, 64 nt, Homo Sapiens
guaaccuaugaaguuuauuugaauuauugggcuuaauauaaaucacaagacugucauuagaauu

SEQ ID NO: 42474 - RNA, 64 nt, Homo Sapiens
auauuucucucuuuuuaaaaugaauauguggguaaauauaaaaggaaugaaguucugaaaaugg

SEQ ID NO: 42475 - RNA, 64 nt, Homo Sapiens
agaggaaaacauaagauugaaaagagcuauuguaaauauaaaguauuaguagacaaggauauua

SEQ ID NO: 42476 - RNA, 64 nt, Homo Sapiens
cuggccaauauggugaaaccccaucucuacuaaaaauauaaaaaucagcaaaaaaaauuuagcc

SEQ ID NO: 42477 - RNA, 64 nt, Homo Sapiens
ggagugagacaccaucucaaaaaauacauauaauaauauaaauaaaaauaucuuuuuugaaaau

SEQ ID NO: 42478 - RNA, 64 nt, Homo Sapiens
uaaucuauuaauacugacucagugucugccuuuaaauauaaaugauauguugaaaacuuaagga

SEQ ID NO: 42479 - RNA, 64 nt, Homo Sapiens
ugaaaacuuaaggaagcaaaugcuacauauaugcaauauaaaauaguaaugugaugcugaugcu

SEQ ID NO: 42480 - RNA, 64 nt, Homo Sapiens
uuguauaauacuuuaauggaaugcuuuuuaaaaaaauauaaaaccaagguaaauuauuguuuca

SEQ ID NO: 42481 - RNA, 64 nt, Homo Sapiens
uguugauacuccuguugauguuaaauuacuauauaauauaaacaguauguguuuuuauauauca

SEQ ID NO: 42482 - RNA, 64 nt, Homo Sapiens
caaacuauauaauaaauauuuacaagcccaaacuaauauaaaugauugaaugggaacaaaucuc

SEQ ID NO: 42483 - RNA, 64 nt, Homo Sapiens
cuagggaaaucugaauacaguguggacuucaguuaauauaaaugagaaaaugguuucauuggcu

SEQ ID NO: 42484 - RNA, 64 nt, Homo Sapiens
ugccagaaaaacuuacauguaucagauuuuuaaaaauauaaauagagaacauuuugcaaaugcu

SEQ ID NO: 42485 - RNA, 64 nt, Homo Sapiens
uggaaaaccagauaaaacaauguuacaaaaggcaaauauaaagaguauguuuucuuuuuagugc

SEQ ID NO: 42486 - RNA, 64 nt, Homo Sapiens
uguguucuuaacuccagaacuugagaaauagagaaauauaaaaggauuuacuuuucugaucucu

SEQ ID NO: 42487 - RNA, 64 nt, Homo Sapiens
uaucuucaugcucugguaggggaacuuacucugcaauauaaaaaggacaaauucugacuguugg

SEQ ID NO: 42488 - RNA, 64 nt, Homo Sapiens
cuguaguuuaaaaggaagaaauaaaacauuuuaaaauauaaaucugcuaucuuaauguucugaa

SEQ ID NO: 42489 - RNA, 64 nt, Homo Sapiens
uuaaaaaauguaacugcuauagucauuuuaaaauaauauaaauauuuaaaacuguaucuuaaag

SEQ ID NO: 42490 - RNA, 64 nt, Homo Sapiens
ucagccaggcgucgugcacaccugucucuacaaaaauauaaaaagccuggucuuuuguagagac

SEQ ID NO: 42491 - RNA, 64 nt, Homo Sapiens
aagaauaggaaacauuuuauugcagaugacuuacaauauaaaugguugaaauucuagauaagca

SEQ ID NO: 42492 - RNA, 64 nt, Homo Sapiens
uuccaugagaauuauuacuuuaaaaacaaaacaaaauauaaaaaacuguguuugaguaaacuga

SEQ ID NO: 42493 - RNA, 64 nt, Homo Sapiens
aaguucaauaauaacuaaggcugugauuuuuuucaauauaaaaggcacagcuguuggccaaagu

SEQ ID NO: 42494 - RNA, 64 nt, Homo Sapiens
ugaaauaaaccugcacugaacuugccuggaauaaaauauaaaacuacuauccauguaauaagca

SEQ ID NO: 42495 - RNA, 64 nt, Homo Sapiens
guagcgaccccagacuguagucucuguuuccugaaauauaaacugugaggacucggccacugug

SEQ ID NO: 42496 - RNA, 64 nt, Homo Sapiens
gauccaggggacauaaauguccuucuucuaacuaaauauaaaaauaagaccuaauccccaccuc

SEQ ID NO: 42497 - RNA, 64 nt, Homo Sapiens
auuacuauuuuguacuguguuuuuuuuuuuugaaaauauaaauaagaacuuccaaauguuaauu

SEQ ID NO: 42498 - RNA, 64 nt, Homo Sapiens
ccuuuguuagguggagaagaaaugucucuagaggaauauaaauaccugauuucuugucaucgag

SEQ ID NO: 42499 - RNA, 64 nt, Homo Sapiens
auaguaaauagcuuuacaccaggauggauucugaaauauaaauucuaaauuauauuuguuauaa

SEQ ID NO: 42500 - RNA, 64 nt, Homo Sapiens
ggaucucaaacuugauuaaagguuuuucaaaaggaauauaaacauuuugcauggacaugggcca

SEQ ID NO: 42501 - RNA, 64 nt, Homo Sapiens
acuuguguagauuuucuacacacaaaucugccaaaauauaaagacaaguagccuauuuuauaug

SEQ ID NO: 42502 - RNA, 64 nt, Homo Sapiens
cucauaagcacuauagaauuacaauauaaaagccaauauaaauuggcacagacaaccuuaucaa

SEQ ID NO: 42503 - RNA, 64 nt, Homo Sapiens
ccaauauaaauucucauaagcaaccuuaucaaacaauauaaaagggaagucuggggggcacaga

SEQ ID NO: 42504 - RNA, 64 nt, Homo Sapiens
auuuucuuuuaaucuuuauuauuugagauuuaagaauauaaauaaauaaaaauauauaaaucuc

SEQ ID NO: 42505 - RNA, 64 nt, Homo Sapiens
caaauaacaaaugccaaauuaugcacuuugcuuuaauauaaaugacaagaaaaauaaagaaaag

SEQ ID NO: 42506 - RNA, 64 nt, Homo Sapiens
cguuuuauaagcaucauuauuauuauuacuuguaaauauaaagauuuuauguuauauauaaaua

SEQ ID NO: 42507 - RNA, 64 nt, Homo Sapiens
gggccacacagcaagaccccaucucuaaaaaauuaauauaaauauaaaauaaauuagccaggug

SEQ ID NO: 42508 - RNA, 64 nt, Homo Sapiens
cacagcaagaccccaucucuaaaaaauuaauauaaauauaaaauaaauuagccaggugugaugu

SEQ ID NO: 42509 - RNA, 64 nt, Homo Sapiens
ugggccccuugcuaauuaacuuccauuuuguaaaaauauaaacacauggggcuaugacuuuccc

SEQ ID NO: 42510 - RNA, 64 nt, Homo Sapiens
cuggccaacauggugaaauccccucucuacuaaaaauauaaaaauuagccaaguuugguggcau

SEQ ID NO: 42511 - RNA, 64 nt, Homo Sapiens
uaggaaagcauuuauacuugagauaaauuauacaaauauaaagacugugaaaaagccaucauua

SEQ ID NO: 42512 - RNA, 64 nt, Homo Sapiens
gugaagaguauuuauuuugaaguugaacaucacaaauauaaaaaggguuguagugccuuuacuu

SEQ ID NO: 42513 - RNA, 64 nt, Homo Sapiens
uuuguguauagcuguucccuucuuuuuuucuuuuaauauaaacauggcucauuaauuuuuuuag

SEQ ID NO: 42514 - RNA, 64 nt, Homo Sapiens
agaagagaaagccuucagugacagagaaacuugaaauauaaagaaacuugugagcauucacacu

SEQ ID NO: 42515 - RNA, 64 nt, Homo Sapiens
uuuaguagcugauaaagaaaccuuuuaaaaaaauaauauaaaugaaugaaauauaaacugugag

SEQ ID NO: 42516 - RNA, 64 nt, Homo Sapiens
agaaaccuuuuaaaaaaauaauauaaaugaaugaaauauaaacugugagauaaauaucauuaua

SEQ ID NO: 42517 - RNA, 64 nt, Homo Sapiens
ccaagauaauucacucuacucagccggcguggcaaauauaaaacuuacagagcguggcugugcu

SEQ ID NO: 42518 - RNA, 64 nt, Homo Sapiens
uguauaaacauuaaaugucuuauauagcagcaaaaauauaaaauaguuguccauauuuucacag

SEQ ID NO: 42519 - RNA, 64 nt, Homo Sapiens
guacugugggacauguuaauaagugcuauaaagaaauauaaaggguuugggagcaaaaagaggg

SEQ ID NO: 42520 - RNA, 64 nt, Homo Sapiens
aaacacuuaaaacuuuuuguuauggaagaauucaaauauaaauaaaaaauugugaguaauaaaa

SEQ ID NO: 42521 - RNA, 64 nt, Homo Sapiens
cccuccucacagauaaaugaaaaguaaguauucuaauauaaaaguucuaauacaaaagaguaga

SEQ ID NO: 42522 - RNA, 64 nt, Homo Sapiens
auuaggauguggacaugcuauuaggguuaucuacaauauaaaugggaauuaggauaauauaguc

SEQ ID NO: 42523 - RNA, 64 nt, Homo Sapiens
cccuuguacccuucacauacugcagaaaaauaauaauauaaaugaauuaaaaauauuucaaaua

SEQ ID NO: 42524 - RNA, 64 nt, Homo Sapiens
uguggaacuuuagaacuuggaaaauugugcccaaaauauaaaagccugccuuuugccacucuua

SEQ ID NO: 42525 - RNA, 64 nt, Homo Sapiens
ugaauuauuaagcauaugugcuuucgcagcugauaauauaaaaggaaaucccacagucuagaua

SEQ ID NO: 42526 - RNA, 64 nt, Homo Sapiens
uuaaaaaacguacucuuauuaucuggaacauagaaauauaaaagguaacaucuaaagcuuagaa

SEQ ID NO: 42527 - RNA, 64 nt, Homo Sapiens
ugaaaaagaagggggggagaauuccaggugccuuaauauaaaguuugaagcuucauccaccaaa

SEQ ID NO: 42528 - RNA, 64 nt, Homo Sapiens
guaaauaugucccaauuuguauugauucucuuuaaauauaaaauguaaauaaaauauuccaaua

SEQ ID NO: 42529 - RNA, 64 nt, Homo Sapiens
cggugcuacuaauccugcuguaucccggguuuuuaauauaaagguguuaagcuuauuuugcuuu

SEQ ID NO: 42530 - RNA, 64 nt, Homo Sapiens
aucaucuccugacuuaauguuuuuuaaacccaccaauauaaauuuaauuaaagauauauguugu

SEQ ID NO: 42531 - RNA, 64 nt, Homo Sapiens
gauauauaaagauguugacuaaaguuuauuauaaaauauaaacaauaucuguugcauguacuuu

SEQ ID NO: 42532 - RNA, 64 nt, Homo Sapiens
aauaauuuaaauuuuauugggggcuucuaauuuuaauauaaauaaaaucuaaagcagcucuuau

SEQ ID NO: 42533 - RNA, 64 nt, Homo Sapiens
auauauauggauuagcaugugacuuauguguuugaauauaaauguaaagacauaaauauagaga

SEQ ID NO: 42534 - RNA, 64 nt, Homo Sapiens
uuauaaauaauuauuuuuguaaauauacaguucuaauauaaaaguauaaacauauuuuuauauc

SEQ ID NO: 42535 - RNA, 64 nt, Homo Sapiens
aauagcaaguauuuacugagggcauauuuaggucaauauaaaauauauaacugauugaugaaag

SEQ ID NO: 42536 - RNA, 64 nt, Homo Sapiens
guuguuccuuucauaguuuuucugaugcaauuucaauauaaaaaauaacuuugcuacccuggau

SEQ ID NO: 42537 - RNA, 64 nt, Homo Sapiens
cagguaaaauguauaaaaauuauuagggaaagguaauauaaaaaucaguuuuaguguuuuucag

SEQ ID NO: 42538 - RNA, 64 nt, Homo Sapiens
caccuguuuuguuuuucuuagcaaagcuuuugagaauauaaacaaagucauauugggaaagaug

SEQ ID NO: 42539 - RNA, 64 nt, Homo Sapiens
ccuacacaaguguuucacauuggagacaucugcuaauauaaaugggagguuuuacugucaaguc

SEQ ID NO: 42540 - RNA, 64 nt, Homo Sapiens
uauuaagcaguuaauaauuuauauguauggauauaauauaaaaugaauucauauaauuaaaaag

SEQ ID NO: 42541 - RNA, 64 nt, Homo Sapiens
cugugccaccaauucaaaaguuauaggauuaggaaauauaaauuuauauuuggugauuggcagc

SEQ ID NO: 42542 - RNA, 64 nt, Homo Sapiens
aaucacagcucacugcagccuuguccucccaggcucaagcuauccuugcaccucagccucccaa

SEQ ID NO: 42543 - RNA, 64 nt, Homo Sapiens
ucacuuuuuggaauugucuugauuuuucggcaguucaagcuauaucgaauauaguucuguguag

SEQ ID NO: 42544 - RNA, 64 nt, Homo Sapiens
cuaagccauccuguuagcuuuuaaaggaaguuaauuuaauuaacauuaauauacucuaugggcu

SEQ ID NO: 42545 - RNA, 64 nt, Homo Sapiens
caagaccccaucuccauuuuuuuuuuaaugauuuuuuaauuaaaaaaaagaacaacaggauaga

SEQ ID NO: 42546 - RNA, 64 nt, Homo Sapiens
uggaaaacuuaggacuuauuggguuauuauuauuuuuaauuaaagcugguuuaauuaaaaagaa

SEQ ID NO: 42547 - RNA, 64 nt, Homo Sapiens
uuauuggguuauuauuauuuuuaauuaaagcugguuuaauuaaaaagaaagaaacuuuuuucug

SEQ ID NO: 42548 - RNA, 64 nt, Homo Sapiens
gaagggaacaucgacuucuaauccagcuuucuuguuuaauuaugaccuaaaucuaauuuacuuc

SEQ ID NO: 42549 - RNA, 64 nt, Homo Sapiens
uaaaaucuaaguaugaaauuaugaaaggacauucuuuaauuacugcccacucaacacauauuua

SEQ ID NO: 42550 - RNA, 64 nt, Homo Sapiens
aaauaaaagguguuaauuugcuuuuuaaaacaaauuuaauuaucacauuuuaaauuacuuugug

SEQ ID NO: 42551 - RNA, 64 nt, Homo Sapiens
auaucauuuagcaaguuggcauuaacauuuaugcuuuaauuaaaugccaguauaccuaugugug

SEQ ID NO: 42552 - RNA, 64 nt, Homo Sapiens
gucugcagauuuuuuuauuauggugcagcuuuuuuuuaauuauguuuuuaaaauuauacaguug

SEQ ID NO: 42553 - RNA, 64 nt, Homo Sapiens
guuuuauuuggcuguuuaaagccaaauucagcuauuuaauuaugguuucauggacacuguugag

SEQ ID NO: 42554 - RNA, 64 nt, Homo Sapiens
cagaagcuuagaggucauuuuuuguaauuuucuuuuuaauuacuuuagagagcuagggaugcaa

SEQ ID NO: 42555 - RNA, 64 nt, Homo Sapiens
cauacuucugugacaccccugcccauuuucugucuuuaauuaaccaagguguuaggugugacug

SEQ ID NO: 42556 - RNA, 64 nt, Homo Sapiens
acaauguuauguuuuuuagaacuguuuuccuuaguuuaauuaauaaccaauuauaagugagaau

SEQ ID NO: 42557 - RNA, 64 nt, Homo Sapiens
uggaaccacuacuuauauacuuaacuuaacauuguuuaauuaaauuaugaaauuugugccuaau

SEQ ID NO: 42558 - RNA, 64 nt, Homo Sapiens
caugcuacuuuugauuucauguaacucaaugaaauuuaauuaaaucacuaagaaaagagcaguu

SEQ ID NO: 42559 - RNA, 64 nt, Homo Sapiens
ucucuggcaaugauuuaauaucauucacccuugauuuaauuauugauaacuuuucaaaaauuca

SEQ ID NO: 42560 - RNA, 64 nt, Homo Sapiens
aucacuauaacauaacugauguuggcucuaccacuuuaauuaauagaaugaaacauaccaccuu

SEQ ID NO: 42561 - RNA, 64 nt, Homo Sapiens
uuugcagcuguuacaguugcuacccaaguaauauuuuaauuacugucuacagaacaauuaguaa

SEQ ID NO: 42562 - RNA, 64 nt, Homo Sapiens
aucuguguaaugugguuuuaguguugcuugguuguuuaauuauuuugagcuuguuuuguuuuug

SEQ ID NO: 42563 - RNA, 64 nt, Homo Sapiens
auaaacuaguuccauauaaguauacaccuagaguuuuaauuaccuuuauaauguuucuuaaaag

SEQ ID NO: 42564 - RNA, 64 nt, Homo Sapiens
aagaggaccuauaugaaugguuuuaugucauuuuuuuaauuaaaaaagaaaaauucauauaauc

SEQ ID NO: 42565 - RNA, 64 nt, Homo Sapiens
uuacaaaaaaaaaacacaugguuaaauguuaaauuuuaauuaaggcccccaaaaauuaaauaua

SEQ ID NO: 42566 - RNA, 64 nt, Homo Sapiens
auuuauauauguauuuauaaacgaaauguuauuuuuuaauuauuccucaagaugaaggcaaagc

SEQ ID NO: 42567 - RNA, 64 nt, Homo Sapiens
auucuucauaacaauuuuagauaguaccaaucauuuuaauuauuaagaacacccuauauuuugc

SEQ ID NO: 42568 - RNA, 64 nt, Homo Sapiens
guuuauauuuucaauucaaauuuucuuuuuauuuuuuaauuauuauguuuuuuauuaugcugua

SEQ ID NO: 42569 - RNA, 64 nt, Homo Sapiens
uuaacuauguacaauauuuuuugaagcuaauuauuuuaauuagguagcuuaucaauuugucauu

SEQ ID NO: 42570 - RNA, 64 nt, Homo Sapiens
uuuguuuuuauuuuuguacgaccuuucaaagguuuuuaauuauuuugcuuguacauuuuuuuuu

SEQ ID NO: 42571 - RNA, 64 nt, Homo Sapiens
uucuaacagaaccgcucccgguuuguacuuucauuuuaauuauuacugggcaacuacccuacaa

SEQ ID NO: 42572 - RNA, 64 nt, Homo Sapiens
cugauuuuaagugauauucagauggccuuuuaaauuuaauuauuauguauuuaaaauuuaauua

SEQ ID NO: 42573 - RNA, 64 nt, Homo Sapiens
uggccuuuuaaauuuaauuauuauguauuuaaaauuuaauuaauuauagcaagugauaugaacu

SEQ ID NO: 42574 - RNA, 64 nt, Homo Sapiens
aaaagagaauaaaaaauguaucuuaguaugugcauuuaauuagauauuugaagauuuaauuacu

SEQ ID NO: 42575 - RNA, 64 nt, Homo Sapiens
ucuuaguaugugcauuuaaucaauuauuugaagauuuaauuacuagauuuaagauauguaacaa

SEQ ID NO: 42576 - RNA, 64 nt, Homo Sapiens
cucuagguaaguauguuuuaguauugaauucuguuuuaauuauuuuccuaauagauacuagauu

SEQ ID NO: 42577 - RNA, 64 nt, Homo Sapiens
gaauugcuuauuguugagcuuauaucucgaagauuuuaauuaagaagagaauagucaucaaauu

SEQ ID NO: 42578 - RNA, 64 nt, Homo Sapiens
auagagaagauacauuaaaaggcacaacuuuuuuuuuaauuaccugccaauuaaagacuagaag

SEQ ID NO: 42579 - RNA, 64 nt, Homo Sapiens
cugauaaaugucuguuggauucuuuuuggauuucuuuaauuaauuuguaaguaaccaagauaau

SEQ ID NO: 42580 - RNA, 64 nt, Homo Sapiens
agagagaaauuaauaacaaaaagagugaaaauauuuuaauuagcaguagauggugcuacuggcu

SEQ ID NO: 42581 - RNA, 64 nt, Homo Sapiens
cucugcauugagcauauuuucuuacuuuuauuauuuuaauuaauaugacauaagcaaucauuuu

SEQ ID NO: 42582 - RNA, 64 nt, Homo Sapiens
agacuaacaugucaguuuuaucaauuauauuauguuuaauuauuuaagauuucuuuauguggaa

SEQ ID NO: 42583 - RNA, 64 nt, Homo Sapiens
aauuccauuuuuuucccuugugcuaagguaaagauuuaauuaaauaauuuuggccucucauagu

SEQ ID NO: 42584 - RNA, 64 nt, Homo Sapiens
uauucacagagguuggguaguguugggaggggaguuuaauuacucagauuggccuguuauuuga

SEQ ID NO: 42585 - RNA, 64 nt, Homo Sapiens
caggcauccauuuugccuuuucauauauacuuaauuuaauuaguaaacuuuaaaacacaaaucu

SEQ ID NO: 42586 - RNA, 64 nt, Homo Sapiens
uuuauuuuucaguuuucuugauuugcaucccucguuuaauuaaaauuuuuuaaaaagaaaauua

SEQ ID NO: 42587 - RNA, 64 nt, Homo Sapiens
uaauuuauuuuuuugagacauggcuuuucuaauuuuuaauuaaucaaacucuccauuuuacuua

SEQ ID NO: 42588 - RNA, 64 nt, Homo Sapiens
uaaaacucuagaaagaugaacucugcacugacuuuuuaauuauuaaugccauguuguuuucacu

SEQ ID NO: 42589 - RNA, 64 nt, Homo Sapiens
auuuuuagccagaaaaguccagaguaacauaccauuuaauuacauuuguuuguuuaguuauaac

SEQ ID NO: 42590 - RNA, 64 nt, Homo Sapiens
uaaauagcaaagggcuauugauuuaaagaaaaguuuuaauuauaucuuuuuccugucaauugaa

SEQ ID NO: 42591 - RNA, 64 nt, Homo Sapiens
uaaaagauucuucuguagaaguaugaguucuuccuuuaauuaucauuccaacuuucagcuguag

SEQ ID NO: 42592 - RNA, 64 nt, Homo Sapiens
cguuuugacuggcuugagauucagaugcauaauuuuuaauuauaauuauugugaaguggagagc

SEQ ID NO: 42593 - RNA, 64 nt, Homo Sapiens
guggcuuuuauuuuaaaaagguacauaguaauuauuuaauuacuugauauaagcaaguuguaau

SEQ ID NO: 42594 - RNA, 64 nt, Homo Sapiens
gucaaacuggcaagucagagauucguggugucaguuuaauuaguuuagaaugggcaacuaaaau

SEQ ID NO: 42595 - RNA, 64 nt, Homo Sapiens
uuaacugacccuugacaauccuuugucauccguuuuuaauuauuagcagguaaagggauaguug

SEQ ID NO: 42596 - RNA, 64 nt, Homo Sapiens
uaaauaaauaaaucugggucggagggcuaacauauuuaauuaaauuaaaaaaaaauguggaguu

SEQ ID NO: 42597 - RNA, 64 nt, Homo Sapiens
auuuguguaguuuuuaggugguuuuauauaacauuuuaauuacuugugauuuagauguauccau

SEQ ID NO: 42598 - RNA, 64 nt, Homo Sapiens
augacuuuuuccucuaaaaacuggauccuaguguuuuaauuaccugugugcagcuauuuuaaau

SEQ ID NO: 42599 - RNA, 64 nt, Homo Sapiens
caaucuauauggaacaaacaagaaacaaauacauuuuaauuaaaaacaaucuguaacagaauca

SEQ ID NO: 42600 - RNA, 64 nt, Homo Sapiens
caaucuguaacagaaucaagaucaagaaacaaauuuuaauuaaauucuccauguauauaacaga

SEQ ID NO: 42601 - RNA, 64 nt, Homo Sapiens
ucugucauuuaaaauucauguaacaguaaagaauuuuaauuaauuauaaaauuguacgugucaa

SEQ ID NO: 42602 - RNA, 64 nt, Homo Sapiens
cccuguuauaaccaguuauucaugccuucccuaguuuaauuagucucgaaugacuuaggcagaa

SEQ ID NO: 42603 - RNA, 64 nt, Homo Sapiens
ucucacuguuuguucagucuacgagaauuuuuuuuuuaauuaauguucuauguuuuuaagcuac

SEQ ID NO: 42604 - RNA, 64 nt, Homo Sapiens
aauaauauguaagcuaggacuaaaaugaacuguguuuaauuaugaucacuaguugccagaauaa

SEQ ID NO: 42605 - RNA, 64 nt, Homo Sapiens
uuguauaguuugagggaugcuauguuaauguauuuuuaauuagauacauauuuuguaaaguguu

SEQ ID NO: 42606 - RNA, 64 nt, Homo Sapiens
guuauuuuuauauguuuuaaaauguuuacucuuauuuaauuauuacaauaaacagaauuuuuuu

SEQ ID NO: 42607 - RNA, 64 nt, Homo Sapiens
acacaggccaugaauggaaggguaguuuaugaaauuuaauuaaagcauuguauugauuuguacu

SEQ ID NO: 42608 - RNA, 64 nt, Homo Sapiens
acuuugcaagccuuacaagauuauagucugcuuauuuaauuacccacuuuuuuucccuugugag

SEQ ID NO: 42609 - RNA, 64 nt, Homo Sapiens
gagacuacaugcuuuuguagcugacauuuaauuuuuuaauuaugaaaugccauuacuuguauau

SEQ ID NO: 42610 - RNA, 50 nt, Homo Sapiens
ggcuaauaaaggcagaauguuuuaauuagaagccaauggaucacucuuga

SEQ ID NO: 42611 - RNA, 64 nt, Homo Sapiens
gaaauaucuguauuuaauuuauauauguuuaccuuuuaauuaaugauauauuuuuaagauaaua

SEQ ID NO: 42612 - RNA, 64 nt, Homo Sapiens
caugaauguguaacacaguggagauuucaagagauuuaauuaauaagguccaagauaccuaaaa

SEQ ID NO: 42613 - RNA, 64 nt, Homo Sapiens
gaugauugaagaguaaaugggggaaaaggcaguguuuaauuaacauaaaaacucauuuuuguau

SEQ ID NO: 42614 - RNA, 64 nt, Homo Sapiens
uuguauuucuuggauuacuuugacuauucuaauguuuaauuacauaugguaacccuaaggccug

SEQ ID NO: 42615 - RNA, 64 nt, Homo Sapiens
cagaagaggcaguuaugauuccacuucuccuacauuuaauuauuuuuaauugagaacaacucau

SEQ ID NO: 42616 - RNA, 64 nt, Homo Sapiens
aauuaaaccuuuuuuuucccaacuaaagaauggauuuaauuaaacuauguauugaaaaaaaagu

SEQ ID NO: 42617 - RNA, 64 nt, Homo Sapiens
aauauugaugauccuacuaauuauccugcuguucuuuaauuaaugcuuaaugaauaauauggca

SEQ ID NO: 42618 - RNA, 64 nt, Homo Sapiens
ugaaucauuacauuuauaauaacaaaggccacaauuuaauuaauugguaagauauaaugcaaaa

SEQ ID NO: 42619 - RNA, 64 nt, Homo Sapiens
gauauguuuucaguacaauuuugaacagcaacuuuuuaauuaaacaucuuccaguguuaggaag

SEQ ID NO: 42620 - RNA, 64 nt, Homo Sapiens
uuuguuuguuuguuuaauguaucccuguucuguuuuuaauuaaacuccaagucucauuuuacau

SEQ ID NO: 42621 - RNA, 64 nt, Homo Sapiens
guauuucuugucugugaauucauuuuacacaauauuuaauuaaauuuaacuguauaaaaauguu

SEQ ID NO: 42622 - RNA, 64 nt, Homo Sapiens
auguuugccacauuaacuuuuuuacuucugauguuuuaauuaaagccuaaaguuuaaaauaaaa

SEQ ID NO: 42623 - RNA, 64 nt, Homo Sapiens
cuuaaauauuacauauuagggauuguaagaaaacuuuaauuaaaaauuaaagacuauauauaau

SEQ ID NO: 42624 - RNA, 64 nt, Homo Sapiens
gggaagcaaaauuucuaaaggcaguuucuguuguuuuaauuaguauuuguguaguucaaaccag

SEQ ID NO: 42625 - RNA, 64 nt, Homo Sapiens
gcuaccuccuaaacuauaguuucuguucauuucguuuaauuaaacacaaguugggaaauguggc

SEQ ID NO: 42626 - RNA, 64 nt, Homo Sapiens
cgaaacggggaguaauuaugggucaauacuugcauuuaauuagauuauauagaaaguaaacugu

SEQ ID NO: 42627 - RNA, 64 nt, Homo Sapiens
guauacugcacuggauucgccagagaagggaaaauuuaauuagugaaaaggaaagaacacuagg

SEQ ID NO: 42628 - RNA, 64 nt, Homo Sapiens
aaaccagucuagggaagucuaugagaaaguagcauuuaauuaaaguuuaaaaaaaaaaagguug

SEQ ID NO: 42629 - RNA, 64 nt, Homo Sapiens
guaaacacaggggacacagcuuaacaaugcaacuuuuaauuacuguuuucuuuuuucuuaaccu

SEQ ID NO: 42630 - RNA, 64 nt, Homo Sapiens
uguuucagcaugacuauguauuuuucuauguuuuuuuaauuaaaaauuuuuaaaauacuuguuu

SEQ ID NO: 42631 - RNA, 64 nt, Homo Sapiens
uuuaacucugguuucuaccaaugccuuaaauuuguuuaauuaaauuaaauuauguuuuaaacac

SEQ ID NO: 42632 - RNA, 64 nt, Homo Sapiens
ucucaaauuuauuuuaauguuuuaauuaaauguauuuaauuaaaugagccauucacacuuuuua

SEQ ID NO: 42633 - RNA, 64 nt, Homo Sapiens
uguauuuaauuaaaucucaaauucacacuuuuuauuuaauuaaagucauaaacgauucugagcc

SEQ ID NO: 42634 - RNA, 64 nt, Homo Sapiens
aauuuuagugacuuuuuaacccuguuacuuuauauuuaauuaaaugucuaauucaucuuugcuu

SEQ ID NO: 42635 - RNA, 64 nt, Homo Sapiens
aaaaccacucuugagaaguauauacuuuaucccauuuaauuauaguacugugauaacuacuuuu

SEQ ID NO: 42636 - RNA, 64 nt, Homo Sapiens
auauuugggcuuuuuuuuuuguacauuuaauuaauuuaauuaaguaugaaacccuaugguguuu

SEQ ID NO: 42637 - RNA, 64 nt, Homo Sapiens
uuaauuaagauauuugggcuaugguguuuguacauuuaauuaauuuuauucaguaugaaacccu

SEQ ID NO: 42638 - RNA, 64 nt, Homo Sapiens
guuuacuuaagccuuuuucaaagauccuaaauguuuuaauuaguacagaaguauugauacaacu

SEQ ID NO: 42639 - RNA, 64 nt, Homo Sapiens
ugauuuauuuaauuuucuaucauuuaacuuaauauuuaauuauuauuuaauauauguagucaug

SEQ ID NO: 42640 - RNA, 64 nt, Homo Sapiens
uccagauaaauuucuuuauuuuacuuuucaggaauuuaauuauuuauauuuuuccaaccacuga

SEQ ID NO: 42641 - RNA, 64 nt, Homo Sapiens
uuugaauaauuauauuuuucaccuauaugguuguuuuaauuacaaaacucaugucauguuuauu

SEQ ID NO: 42642 - RNA, 64 nt, Homo Sapiens
cuuguaggcacucuucacuuuuugccuaaguuucuuuaauuagaaaaaaaaacuucuuuaggca

SEQ ID NO: 42643 - RNA, 64 nt, Homo Sapiens
uuuuuucauaauugagacagucuuucaggauuauuuuaauuaauuuggggggagaaaaaggaug

SEQ ID NO: 42644 - RNA, 64 nt, Homo Sapiens
uaauucaaaacauguuaaacccccacagauuaaauuuaauuaaucuaagaauuacauuguauag

SEQ ID NO: 42645 - RNA, 64 nt, Homo Sapiens
aaacaagcggaacauagauagaagaccaaagcuuuuuaauuagugaaauugcguuuacaacacu

SEQ ID NO: 42646 - RNA, 64 nt, Homo Sapiens
augauuaaugucguccuucagcaauaucugucucuuuaauuauuucuuuauacgguuuacauaa

SEQ ID NO: 42647 - RNA, 64 nt, Homo Sapiens
uaaucuccaacuaauuacuacagauugacacguuuuuaauuagcuguccuuuguaagaagucag

SEQ ID NO: 42648 - RNA, 64 nt, Homo Sapiens
guuuuccgugggccuuccccucccuugaaaugucuuuaauuaccuccccuucaucgucaggcca

SEQ ID NO: 42649 - RNA, 64 nt, Homo Sapiens
cucugugcuguguuuucuaacacauuuuucuguuuuuaauuaaaaaaaaaaaaaaaagguuuuc

SEQ ID NO: 42650 - RNA, 64 nt, Homo Sapiens
auaaaaucugaaguaucauaaauaaaguuauuuauuuaauuauacuaccagucuuuuuuacugg

SEQ ID NO: 42651 - RNA, 64 nt, Homo Sapiens
gcaguuuccuuucuuauaaaaauuauuaaccugcuuuaauuaaagugcaguacuuugaaguuuu

SEQ ID NO: 42652 - RNA, 64 nt, Homo Sapiens
aaccugcuuuaauuaaagcacaguacuuugaaguuuuaauuauuaagaaaauucuguggcugug

SEQ ID NO: 42653 - RNA, 64 nt, Homo Sapiens
uuucuuuuaaaaauaugacauagccagugauguguuuaauuauauaacuguucuuacugauuuu

SEQ ID NO: 42654 - RNA, 64 nt, Homo Sapiens
agcagguuuuucuguuaguuuuucccccauaacauuuaauuauuacuaaaauuguauuuacaau

SEQ ID NO: 42655 - RNA, 58 nt, Homo Sapiens
ugaggagcacauuuuguuaacauucagauuuaauuacuguaaguaaaauuuaaaaugu

SEQ ID NO: 42656 - RNA, 64 nt, Homo Sapiens
gaaaaauauuuauuuuuguuuuuguuggauagcuuuuaauuacauuucagagagguguaauuuu

SEQ ID NO: 42657 - RNA, 64 nt, Homo Sapiens
uuuaugacuaacuuguagauaucguggguucuuauuuaauuauuuuuauaguuguuuugcauuu

SEQ ID NO: 42658 - RNA, 64 nt, Homo Sapiens
ucuuauuuaauuauuuuuauaguuguuuugcauuuuuaauuauaauuuauuuauuuagaaagga

SEQ ID NO: 42659 - RNA, 64 nt, Homo Sapiens
gaucuuagugauacauaccaguguccuuuaacacuuuaauuacacaggaauaaugaagcuuccu

SEQ ID NO: 42660 - RNA, 64 nt, Homo Sapiens
ggcagugcaaagaucaucagcauugguugccaucuuuaauuauuaguguuguuaccauuuagcc

SEQ ID NO: 42661 - RNA, 64 nt, Homo Sapiens
agaaauacauauuuuuauuugacuauguuuggaguuuaauuaauuauauauuuauacauuauuu

SEQ ID NO: 42662 - RNA, 64 nt, Homo Sapiens
uaccuuauucuacaucauuaaccaguaaggacuuuuuaauuaaccacaauaccacuaucacacc

SEQ ID NO: 42663 - RNA, 64 nt, Homo Sapiens
cuccuuggcagguaugaaauuuuuuguauucucuuuuaauuauggagcaagguucaccuuuaga

SEQ ID NO: 42664 - RNA, 64 nt, Homo Sapiens
ucuaaauucaaccaaaaaaugcuaccauaaugcuuuuaauuaguaauuuucuacaaaauuuaaa

SEQ ID NO: 42665 - RNA, 64 nt, Homo Sapiens
uaguauuuuauguguaauucuuccauuuauucuguuuaauuauacaacuaagaugaaauauuga

SEQ ID NO: 42666 - RNA, 64 nt, Homo Sapiens
caccacagugaauuauggguaaggugauaauauguuuaauuagcuugauuuaaucaucccacac

SEQ ID NO: 42667 - RNA, 64 nt, Homo Sapiens
accugcaaagaugaugugagauuuuuucuuguguuuuaauuauuuucacauuuucucucugcaa

SEQ ID NO: 42668 - RNA, 64 nt, Homo Sapiens
auuuuguguauucuuauuuacuuaacauuuuacuuuuaauuauguaaauuugguuagaaaauaa

SEQ ID NO: 42669 - RNA, 64 nt, Homo Sapiens
uucuggauuguguauggguguuggugaacuugguuuuaauuagugaacugcugagagacagagc

SEQ ID NO: 42670 - RNA, 64 nt, Homo Sapiens
uacuuucauaauaaguugcauagguuuaauaauuuuuaauuauauggcuugaguuuaaauugua

SEQ ID NO: 42671 - RNA, 64 nt, Homo Sapiens
gguauggccacaaggaagaauaguguacagagauuuuaauuaaugcaaguucugggaccuuuug

SEQ ID NO: 42672 - RNA, 64 nt, Homo Sapiens
uugcugugauagugcaaagaagcacaggaaaauguuuaauuauccauuuuucugugauuuguaa

SEQ ID NO: 42673 - RNA, 64 nt, Homo Sapiens
ugcuuuauaaaaauggcaacaagagcaucuucauuuuaauuaacgaagugucaaaauaugagaa

SEQ ID NO: 42674 - RNA, 64 nt, Homo Sapiens
auugcuaucaaauaauuucucuacuguugauaguuuuaauuauccauauuuguuggguccuauu

SEQ ID NO: 42675 - RNA, 64 nt, Homo Sapiens
ugguucacccuggcuuuaccaagguaggcaucuguuuaauuaguuggucuaagaguucuaaagg

SEQ ID NO: 42676 - RNA, 64 nt, Homo Sapiens
cuugugaauuacagaacagggaagagaggacauauuuaauuaaugcuuauccuagggucucaca

SEQ ID NO: 42677 - RNA, 64 nt, Homo Sapiens; identical to SEQ ID NO: 42667

SEQ ID NO: 42678 - RNA, 64 nt, Homo Sapiens; identical to SEQ ID NO: 42668

SEQ ID NO: 42679 - RNA, 64 nt, Homo Sapiens
uauuaaaacagagauaugugcaugaaaucaagaaaaaagaaaugaacaaaagcaaagcauuagu

SEQ ID NO: 42680 - RNA, 64 nt, Homo Sapiens
uuagaaugauaaaaaaaaaaaaaaaaaaccugacaaaagaaauaguaugaaaaguagaaaaaug

SEQ ID NO: 42681 - RNA, 64 nt, Homo Sapiens
caaguucaaaaccaagaggcguuuuugagaguggaaaagaaauuuaaacuucccgaaagaaggu

SEQ ID NO: 42682 - RNA, 64 nt, Homo Sapiens
cgagaccuugucucaaaaaaagacaaaaaaaacaaaaagaaauguagauucuugggccccacca

SEQ ID NO: 42683 - RNA, 64 nt, Homo Sapiens
gucaaauuuuaucaugguauaauuuguaaaaauaaaaagaaauuacaaaagaaauuauggauuu

SEQ ID NO: 42684 - RNA, 64 nt, Homo Sapiens
caugguauaauuuguaaaaauaaaaagaaauuacaaaagaaauuauggauuugucaauguaagu

SEQ ID NO: 42685 - RNA, 64 nt, Homo Sapiens
aaaagacauaggacuuaacuggaaaaugaaaaaaaaaagaaaaagaaaaaacuaaacaaaaaau

SEQ ID NO: 42686 - RNA, 64 nt, Homo Sapiens
cauaggacuuaacuggaaaaugaaaaaaaaaagaaaaagaaaaaacuaaacaaaaaaucccucu

SEQ ID NO: 42687 - RNA, 64 nt, Homo Sapiens
gcccagagaagcccccuacauccccccgggaaaaaaaagaaaacuagacagaaacucaucuaua

SEQ ID NO: 42688 - RNA, 64 nt, Homo Sapiens
aggccaccauauuuagaacuaguuaccuuauuaaaaaagaaaaaacagucuguuggcuucucag

SEQ ID NO: 42689 - RNA, 64 nt, Homo Sapiens
uaauuuaaagacaucuauuaucugcuuugugcuuaaaagaaaaauucaaccuuuuuuuuuuuuu

SEQ ID NO: 42690 - RNA, 64 nt, Homo Sapiens
gcucugugaaaucgucugauggucuguguggaagaaaagaaaaaucugucugccgccuauuucc

SEQ ID NO: 42691 - RNA, 64 nt, Homo Sapiens
uacucccauggcaaagaaaaaaaaaagaaugaaaaaaagaaaaaaauuuggaaaaaaaaaucag

SEQ ID NO: 42692 - RNA, 64 nt, Homo Sapiens
gcucuaguaugguguauuuaaauaauaaaaacuuaaaagaaaaaauauuuaaugguguuugggu

SEQ ID NO: 42693 - RNA, 64 nt, Homo Sapiens
aacuagggaagauaauauuaaggaagacaaugugaaaagaaaaaugagccuggcaagaaugugu

SEQ ID NO: 42694 - RNA, 64 nt, Homo Sapiens
cugggugacagagcaagugagacccugucucaaaaaaagaaaaagaaaaagaaaaaauauuuuc

SEQ ID NO: 42695 - RNA, 64 nt, Homo Sapiens
gacagagcaagugagacccugucucaaaaaaagaaaaagaaaaagaaaaaauauuuucccuauu

SEQ ID NO: 42696 - RNA, 64 nt, Homo Sapiens
gcaagugagacccugucucaaaaaaagaaaaagaaaaagaaaaaauauuuucccuauuagagaa

SEQ ID NO: 42697 - RNA, 64 nt, Homo Sapiens
cauuucuuuuuaggcucugagacuaaaugagaggaaaagaaaagaaaaaaaaaaugauugucua

SEQ ID NO: 42698 - RNA, 64 nt, Homo Sapiens
cuuuuuaggcucugagacuaaaugagaggaaaagaaaagaaaaaaaaaaugauugucuaaccaa

SEQ ID NO: 42699 - RNA, 64 nt, Homo Sapiens
cuaggaccuaucauuucaucagagacaugaucagaaaagaaacugcuucugccccauuucuugu

SEQ ID NO: 42700 - RNA, 64 nt, Homo Sapiens
uuucuuguuuuggagauuacuccaucuguccaucaaaagaaaccuguaaauaugaaagaacaaa

SEQ ID NO: 42701 - RNA, 64 nt, Homo Sapiens
auagcaacaaaauauuuauucuacuguaaaugacaaaagaaaaagaaaaauugagccuugggac

SEQ ID NO: 42702 - RNA, 64 nt, Homo Sapiens
acaaaauauuuauucuacuguaaaugacaaaagaaaaagaaaaauugagccuugggacgugccc

SEQ ID NO: 42703 - RNA, 64 nt, Homo Sapiens
cccaccccucuuuuccaguccuugccuuccaaccaaaagaaauggauguuuugguggaaggaca

SEQ ID NO: 42704 - RNA, 64 nt, Homo Sapiens
uauuggggaaggaagaugauacuucuuucucaagaaaagaaaauuggauuauuaggaauacauc

SEQ ID NO: 42705 - RNA, 64 nt, Homo Sapiens
cagccuggguaacagagcaagacuccaucucaaaaaaagaaagaaagaaaaaagaaaguacaag

SEQ ID NO: 42706 - RNA, 64 nt, Homo Sapiens
agcaagacuccaucucaaaaaaagaaagaaagaaaaaagaaaguacaaguuuauaaaguauuau

SEQ ID NO: 42707 - RNA, 64 nt, Homo Sapiens
agucccagauuugaaaacuuucaguuaaaagaaaaaaagaaacuccugggcugaaguuggcauu

SEQ ID NO: 42708 - RNA, 64 nt, Homo Sapiens
aagaaacuagucccagauuuuuggcauuucaguuaaaagaaaaagaaaaaacccugggcugaag

SEQ ID NO: 42709 - RNA, 64 nt, Homo Sapiens
gcgacaucuuucuaagauucuucucucauucauuaaaagaaaacauucagggauacaaaugggc

SEQ ID NO: 42710 - RNA, 64 nt, Homo Sapiens
gacucaguacuauuucuuuuuauuuaaaaaaacaaaaagaaauuuuguaaauacauagaacaaa

SEQ ID NO: 42711 - RNA, 64 nt, Homo Sapiens
auuuaaguauuuuuuuaaaaacacaaaaugaaacaaaagaaacaggauaacuaaaacuucaaau

SEQ ID NO: 42712 - RNA, 64 nt, Homo Sapiens
aauagcuugguuuuauuugucuaguuaauguuuaaaaagaaaaaauaaauguucuuuauacagc

SEQ ID NO: 42713 - RNA, 64 nt, Homo Sapiens
aaggaaaagguuuuuagcucaaagcuuuaaaaaaaaaagaaaaagguugguuuaacaaaaaaaa

SEQ ID NO: 42714 - RNA, 64 nt, Homo Sapiens
aaaaguccccuagugauagcucaaaaaagaaauaaaaagaaagugagacaggggagacccuaug

SEQ ID NO: 42715 - RNA, 64 nt, Homo Sapiens
aaaagaaaguaaaaguccccagacccuaugucaaaaaagaaauauucagccuuggagacagggg

SEQ ID NO: 42716 - RNA, 64 nt, Homo Sapiens
auucaaaccuuggaauuaaaucaucauucuugaaaaaagaaauagaaugucuuacauguuuuau

SEQ ID NO: 42717 - RNA, 64 nt, Homo Sapiens
gaagaagcuggggucuccaggggaugggggaaagaaaagaaagaagagagagaaggaauggcgu

SEQ ID NO: 42718 - RNA, 64 nt, Homo Sapiens
cuuaagaguuuaucuuuucuauaauuuggggcaaaaaagaaaguuauauuuuccuuucugacac

SEQ ID NO: 42719 - RNA, 64 nt, Homo Sapiens
cagccuuuuuaugcuguuaacaacauacuuauggaaaagaaagugacuggaaacuaguuggaaa

SEQ ID NO: 42720 - RNA, 64 nt, Homo Sapiens
auguauuaaaauuuacaucuccguucaaguucaaaaaagaaauaggaucaucccauucugguuc

SEQ ID NO: 42721 - RNA, 64 nt, Homo Sapiens
uucuacuaauuucagaccuccaaaaagagaaaagaaaagaaaauuaaaacacuucuacuagggc

SEQ ID NO: 42722 - RNA, 64 nt, Homo Sapiens
aaaauuucuacuaauuucagagggccaaaaagagaaaagaaaaggaagcuaaaacacuucuacu

SEQ ID NO: 42723 - RNA, 64 nt, Homo Sapiens
ucuacauaaaucguauuuguauugcaauuauguuaaaagaaauccuuuaguuucucacagaauc

SEQ ID NO: 42724 - RNA, 64 nt, Homo Sapiens
aaacuuaagaaacacugacuaaacuaguuuuuagaaaagaaagcaugcauugcuuguguaguag

SEQ ID NO: 42725 - RNA, 64 nt, Homo Sapiens
aaccauaggcugcucugccuucuuuaaagacguaaaaagaaaaaaccacgggguaggagaaguu

SEQ ID NO: 42726 - RNA, 64 nt, Homo Sapiens
ucuauaaccugaaaauguuuccucugugacaccaaaaagaaaagaaagaauucagaacuacuuu

SEQ ID NO: 42727 - RNA, 64 nt, Homo Sapiens
aagaauucagaacuacuuucauuuuccuaaaaaaaaaagaaaaaugaauuuagcaaauuaaguu

SEQ ID NO: 42728 - RNA, 64 nt, Homo Sapiens
gaagccaguauuuuaauaauaauuugaaaggaaaaaaagaaaccuauguaaagcaauuguagga

SEQ ID NO: 42729 - RNA, 64 nt, Homo Sapiens
guccagugaacuuggaaguguuugccaaacucuuaaaagaaagugggccugugucuucaggugc

SEQ ID NO: 42730 - RNA, 64 nt, Homo Sapiens
cauagaguucagucccuagacaaaaaaaagaaaaaaaagaaauaaacacagcaagacucuaucu

SEQ ID NO: 42731 - RNA, 64 nt, Homo Sapiens
aaagaaauacauagaguucaacucuaucucaaaaaaaagaaaaaacccuggguaacacagcaag

SEQ ID NO: 42732 - RNA, 64 nt, Homo Sapiens
cugaccagugucucuacuuucuaguuccccccaaaaaagaaauaucacuucuacuccugcucuc

SEQ ID NO: 42733 - RNA, 64 nt, Homo Sapiens
auccaggagugguggugugucuccacaaaaauaaaaaagaaacuacaacauagugagaccuugu

SEQ ID NO: 42734 - RNA, 64 nt, Homo Sapiens
auaguuugauucuucauuuuuuucaaaaaaacagaaaagaaaauaugacagaguggagacucug

SEQ ID NO: 42735 - RNA, 64 nt, Homo Sapiens
gaggcucaagaggcugcuucucaaauuucuaagaaaaagaaaauuuuucuagucacagauguuu

SEQ ID NO: 42736 - RNA, 64 nt, Homo Sapiens
uucgagccuccuuauauugcgcaggcauucuuauaaaagaaacuccuugcuggaacccuugcua

SEQ ID NO: 42737 - RNA, 64 nt, Homo Sapiens
gaagaagagagacuaaagguuguccagaaagccaaaaagaaacagaaagagcuggagucagcac

SEQ ID NO: 42738 - RNA, 64 nt, Homo Sapiens
gaggcagaaagaggaggaagccccaaaaaaaagaaaaagaaaagcugcagucagagagcaagcc

SEQ ID NO: 42739 - RNA, 64 nt, Homo Sapiens
gaaaaggaggcagaaagaggcaagccccccaaaaaaaagaaaaaccucaacugcagucagagag

SEQ ID NO: 42740 - RNA, 64 nt, Homo Sapiens
uagaagacauauaaauuaaacccaaaaaaagagaaaaagaaaaaaauuugucacauguaucacc

SEQ ID NO: 42741 - RNA, 64 nt, Homo Sapiens
ugaagaaaaguaauuagaauaagggagagagaagaaaagaaaaaaaagaagagagggaggaaga

SEQ ID NO: 42742 - RNA, 64 nt, Homo Sapiens
ggaagccacaaauuuguaugaaugaagaaggaauaaaagaaauaugagaauaauucuugcaaua

SEQ ID NO: 42743 - RNA, 64 nt, Homo Sapiens
caaaaugcuaaugaagccaucuauuaaggauccaaaaagaaaaacccuaacagaauugaguuuu

SEQ ID NO: 42744 - RNA, 64 nt, Homo Sapiens
uggagcugguggcuuaggccaaaaaaaaagaaagaaaagaaagcagagcaaaacuccagcucaa

SEQ ID NO: 42745 - RNA, 64 nt, Homo Sapiens
aaagaaagcuggagcuggugccagcucaaaaaaaaaaagaaagacuggcaacaagagcaaaacu

SEQ ID NO: 42746 - RNA, 64 nt, Homo Sapiens
uggaggcugggcgcaguggcccgcugcucuaaagaaaagaaaacgaagccaaaaggauuuaaaa

SEQ ID NO: 42747 - RNA, 64 nt, Homo Sapiens
gaagaaaggggagaagggaaagagaauagucaugaaaagaaagggggaguuuagcaaguuuagg

SEQ ID NO: 42748 - RNA, 64 nt, Homo Sapiens
gggugauuuuuaaaggauuagaggauauuaacucaaaagaaauauguaugaggguaaucgagau

SEQ ID NO: 42749 - RNA, 64 nt, Homo Sapiens
ggagaagaauauuuugugugcaaaacuggauugcaaaagaaagacacagauuauuuuuuggcuc

SEQ ID NO: 42750 - RNA, 64 nt, Homo Sapiens
cauaaaacuccugaauuuaagugauacucagaacaaaagaaaguaaaacuuuuuauacucuaaa

SEQ ID NO: 42751 - RNA, 64 nt, Homo Sapiens
aaaccaaaggguuaccggacgcccaucaagaauaaaaagaaauauuuuuuaaaggaggcuuuuu

SEQ ID NO: 42752 - RNA, 64 nt, Homo Sapiens
uagucuaacuccaacagaaagauuaagggcugugaaaagaaauccacuccuucucaccucguga

SEQ ID NO: 42753 - RNA, 64 nt, Homo Sapiens
uugguaaauuuaaauacauauaaaauguuccuguaaaagaaacaaccagguaguagaagugugu

SEQ ID NO: 42754 - RNA, 64 nt, Homo Sapiens
cuagguuccugcacuuuuugcuaaaacauaaaugaaaagaaacaguuuuauuacauugaagaaa

SEQ ID NO: 42755 - RNA, 64 nt, Homo Sapiens
acucugggaauagucauacuauaaaaauaggagcaaaagaaaauugauuauuguguuuauaugu

SEQ ID NO: 42756 - RNA, 64 nt, Homo Sapiens
uugaaaacugaggcaguuaaagcggagguaaaacaaaagaaauaacagcaacauucgccauacu

SEQ ID NO: 42757 - RNA, 64 nt, Homo Sapiens
acagaagacacuuggcauucacuaugauguuaauaaaagaaagucuauguaucuugaugcaaag

SEQ ID NO: 42758 - RNA, 64 nt, Homo Sapiens
ugcuaucauugcuauguaucaauacuaagcuuuaaaaagaaaccgggaaagauauuuaauauuu

SEQ ID NO: 42759 - RNA, 64 nt, Homo Sapiens
guuuuauuugcacuacugaguauuuuuauauuugaaaagaaaaucauggauagucuucuuggau

SEQ ID NO: 42760 - RNA, 64 nt, Homo Sapiens
caauggauggauuaauauuuauuuaaaaaaaagcaaaagaaauuacaugugcaaaucagaauau

SEQ ID NO: 42761 - RNA, 64 nt, Homo Sapiens
ugugaugaugugucuacuuuuaaguaauguauacaaaagaaauauucauagaagucgugaauac

SEQ ID NO: 42762 - RNA, 64 nt, Homo Sapiens
ggguuuaugcacuaaacguuaaaugcuaaaucuuaaaagaaacuuaagauaagagacuaaaaua

SEQ ID NO: 42763 - RNA, 64 nt, Homo Sapiens
ggaggcauuuucaucuuuauaaguauuauuuucuaaaagaaauaaaagaugcagcaagcuuauu

SEQ ID NO: 42764 - RNA, 64 nt, Homo Sapiens
cuugagggcuggaaccugagaggaggcagaaaucaaaagaaaucgguauauacagccugaacuc

SEQ ID NO: 42765 - RNA, 64 nt, Homo Sapiens
gaaaaagagagggauauugaaaauauuuccuguuaaaagaaagacugccaugacacuaggcaaa

SEQ ID NO: 42766 - RNA, 64 nt, Homo Sapiens
uaauuaccuuuguguuuccauuuggauaauuuuaaaaagaaaagcucuuuccaguaaguucaca

SEQ ID NO: 42767 - RNA, 64 nt, Homo Sapiens
cccuugaaaugaucaugagguaugugacaguugaaaaagaaauuguccuguguuaccaaguuua

SEQ ID NO: 42768 - RNA, 64 nt, Homo Sapiens
gugaaagacacagauacccaguaugcuuaacgugaaaagaaaauguguucuguuuuguaaagga

SEQ ID NO: 42769 - RNA, 64 nt, Homo Sapiens
ugaagauuaaccauuuuuuugucuuagaauaucaaaaagaaaaagaaaaagguguucuagcugu

SEQ ID NO: 42770 - RNA, 64 nt, Homo Sapiens
uuaaccauuuuuuugucuuagaauaucaaaaagaaaaagaaaaagguguucuagcuguuugcau

SEQ ID NO: 42771 - RNA, 64 nt, Homo Sapiens
uacucuuuuacuuugguuccuguugugcucuuguaaaagaaaaauauaauuuccugaagaauaa

SEQ ID NO: 42772 - RNA, 64 nt, Homo Sapiens
agcaacuucaguucuuuuacugcaaagaacagaaaaaagaaagaaagcaaacaagaagacuccg

SEQ ID NO: 42773 - RNA, 64 nt, Homo Sapiens
guuugugucuuguggaagaaauccucuuuguggaaaaagaaacaggguuuugaacucuguuaac

SEQ ID NO: 42774 - RNA, 64 nt, Homo Sapiens
uguuuaagcugacucuuugcucuaauuuuggaaaaaaagaaaugugaagggucaacuccaacgu

SEQ ID NO: 42775 - RNA, 64 nt, Homo Sapiens
auagacuuauugccaaaaacaaaaaauagcuuucaaaagaaauuuaaguucuaugagaaauucc

SEQ ID NO: 42776 - RNA, 64 nt, Homo Sapiens
cuuauaauguaccuggaaaauaaaccucuugagaaaaagaaaaguucauacugauuauuggaaa

SEQ ID NO: 42777 - RNA, 64 nt, Homo Sapiens
uuuugucuuaaaauauuaguggcuuacauuuuaaaaaagaaaaaucaccagcaugaacuugcac

SEQ ID NO: 42778 - RNA, 64 nt, Homo Sapiens
accauacaugaguuauuucuaaguuugaaaaauaaaaagaaauugcaucacacuaauuacaaaa

SEQ ID NO: 42779 - RNA, 64 nt, Homo Sapiens
gaagaggcuuaauuugggggugguaacuaaaaucaaaagaaaugauugacuugagggucucugu

SEQ ID NO: 42780 - RNA, 64 nt, Homo Sapiens
aaaguguugcuagagaaaauuagggaaaaggugaaaaagaaaaaaugguaguaauugagcagaa

SEQ ID NO: 42781 - RNA, 64 nt, Homo Sapiens
agauuuaucuaaguagaacugaauuggcuaggaaaaaagaaaaacugcauguuaaucauuuucc

SEQ ID NO: 42782 - RNA, 64 nt, Homo Sapiens
cacaugacucauugaguaguaaugauucagaagaaaaagaaaaaggagacuuuauuggucaaua

SEQ ID NO: 42783 - RNA, 64 nt, Homo Sapiens
ggagcaauuuaaacucccaguuguuuauuuucacaaaagaaaauaaaauugcaguugcaagacc

SEQ ID NO: 42784 - RNA, 64 nt, Homo Sapiens
ccagcccaggcaacaagagugaaacccugucucaaaaagaaaaaaaaaguugaccuugagaauu

SEQ ID NO: 42785 - RNA, 64 nt, Homo Sapiens
ccuccagaacugugaaaaauaaauuuguuauuuaaaaagaaaaaaaaaaaaacaaaaaccugag

SEQ ID NO: 42786 - RNA, 64 nt, Homo Sapiens
aaaaaaaaaaaaaaaaaaaaaaaaaggaaaaaaaaaaagaaaaagaaaacgugugcauuuugua

SEQ ID NO: 42787 - RNA, 64 nt, Homo Sapiens
aaaaaaaaaaaaaaaaaaaggaaaaaaaaaaagaaaaagaaaacgugugcauuuuguauaaugg

SEQ ID NO: 42788 - RNA, 64 nt, Homo Sapiens
uaacugcauuauggcugcuuuaaccucagucaucaaaagaaacuugcuguuuuuuaggcuugau

SEQ ID NO: 42789 - RNA, 64 nt, Homo Sapiens
gcuucucccugaaaaagagaaaaaaaaaaggaaaaaaagaaaagaaaagugaaaagaaaaacuc

SEQ ID NO: 42790 - RNA, 64 nt, Homo Sapiens
ucccugaaaaagagaaaaaaaaaaggaaaaaaagaaaagaaaagugaaaagaaaaacucuuauu

SEQ ID NO: 42791 - RNA, 64 nt, Homo Sapiens
agaaaaaaaaaaggaaaaaaagaaaagaaaagugaaaagaaaaacucuuauuggccuaaguucu

SEQ ID NO: 42792 - RNA, 64 nt, Homo Sapiens
uauaugaaugguuuuaugucauuuuuuuaauuaaaaaagaaaaauucauauaaucguguuuaaa

SEQ ID NO: 42793 - RNA, 64 nt, Homo Sapiens
aaaaacaguauaaacauuaauuuacuuuguguucaaaagaaaauuccaacugcuguuggggaag

SEQ ID NO: 42794 - RNA, 64 nt, Homo Sapiens
agaaaauuccaacugcuguuggggaaggacacagaaaagaaaaauaaccacccaagaaaaacaa

SEQ ID NO: 42795 - RNA, 64 nt, Homo Sapiens
gcaagagaacaagauccugucucaaaaaacaaaaaaaagaaagaauugauaguacaaaauccaa

SEQ ID NO: 42796 - RNA, 64 nt, Homo Sapiens
gcucagcuauuuuaaagaggaaauuaaauauuauaaaagaaauaguaaagauaaguuauccuca

SEQ ID NO: 42797 - RNA, 64 nt, Homo Sapiens
acaguaccuacuugaaaggaucauugugcggauuaaaagaaauaauauauguaaagcacuuuaa

SEQ ID NO: 42798 - RNA, 64 nt, Homo Sapiens
cuacuugauuuacaaaaauguacauuuagagguuaaaagaaacagugagaaauguaaacauuca

SEQ ID NO: 42799 - RNA, 64 nt, Homo Sapiens
uaaaauaaucaguguuuccaaucuguccuguuacaaaagaaacagauuauuauugaacuuaugc

SEQ ID NO: 42800 - RNA, 64 nt, Homo Sapiens
acuuuaccuaagggcugucagauauaaguaacuuaaaagaaagagaaguuuucuugacuuuuga

SEQ ID NO: 42801 - RNA, 64 nt, Homo Sapiens
aaaugcugauuuaacauuuaaguaucacagcauuaaaagaaaaagaaaguaaaccaguccuuug

SEQ ID NO: 42802 - RNA, 64 nt, Homo Sapiens
ugauuuaacauuuaaguaucacagcauuaaaagaaaaagaaaguaaaccaguccuuuguauuca

SEQ ID NO: 42803 - RNA, 64 nt, Homo Sapiens
uuuucuuuuuucuagaaaacacuuuccuggauaaaaaagaaaacauuccagaugcaugauccag

SEQ ID NO: 42804 - RNA, 64 nt, Homo Sapiens
uugacauuuaauaacuuugcuggaaaaucuguaaaaaagaaaaacaaguuugcuagugacuaag

SEQ ID NO: 42805 - RNA, 64 nt, Homo Sapiens
gccuuacacugguucauguuaugucauauaucacaaaagaaauuuacccuucccuucaaggagu

SEQ ID NO: 42806 - RNA, 64 nt, Homo Sapiens
caagaaccauauuagauggaaaucgaccucguugaaaagaaaucaucaccaaugucuuagaugg

SEQ ID NO: 42807 - RNA, 64 nt, Homo Sapiens
aaaaaacgaaugaaaauaacuaguuaaagaaaggaaaagaaaacuauuuaauaugcuuauaacc

SEQ ID NO: 42808 - RNA, 64 nt, Homo Sapiens
aauaguugaauuagugaguaaagucaguugcucaaaaagaaaucacuuuuaaggauaaaucaua

SEQ ID NO: 42809 - RNA, 64 nt, Homo Sapiens
aaaccaagaggugauuuuugaucaaacuaauauaaaaagaaauaaguuggacuaacauucacgu

SEQ ID NO: 42810 - RNA, 64 nt, Homo Sapiens
caguuuauaagauaaaucugaauuauuuugaugcaaaagaaauuacuuuuuuuuucuuaaagcc

SEQ ID NO: 42811 - RNA, 64 nt, Homo Sapiens
aagaaaaaaaaaggaaaaaaccuucauaugcaguaaaagaaagacccuacauuccagcaucuua

SEQ ID NO: 42812 - RNA, 64 nt, Homo Sapiens
gauccagaucuacuugguugaaaauacuggcaccaaaagaaauagcuuuaauaaugucuuuuua

SEQ ID NO: 42813 - RNA, 64 nt, Homo Sapiens
ggcuguuuugcccaaaguuuccuggugagagcuuaaaagaaaugaguauaaaagcuacuuugcu

SEQ ID NO: 42814 - RNA, 64 nt, Homo Sapiens
aauagcauugaagaaaauacaaaaaaaaaaaaaaaaaagaaagaauagagcgagacuccgucuc

SEQ ID NO: 42815 - RNA, 64 nt, Homo Sapiens
aagaaaaaaguacugugaccuuuguuucuaaaucaaaagaaaugaaccuuguccucccugcuga

SEQ ID NO: 42816 - RNA, 64 nt, Homo Sapiens
uuauaucuugauuauuuugucguugauguugauaaaaagaaaguuuuguaaguguuguauguac

SEQ ID NO: 42817 - RNA, 64 nt, Homo Sapiens
aaauacauaaaaaagggacauguguuugcaaaaaaaaagaaaauuacaaauucuaaaagauaag

SEQ ID NO: 42818 - RNA, 64 nt, Homo Sapiens
uucaauuuucuggguaugcaagaaaaaaaaaaagaaaagaaaacuaugaugcaaaaaaagaaaa

SEQ ID NO: 42819 - RNA, 64 nt, Homo Sapiens
aaaacuucaauuuucugggugaaaaagaaaaaaaaaaagaaaagaauguuaugaugcaaaaaaa

SEQ ID NO: 42820 - RNA, 64 nt, Homo Sapiens
aaaaaagaaaagaaaacuucgaugcaaaaaaagaaaaagaaaaaagauuuuuaucaaauguuau

SEQ ID NO: 42821 - RNA, 64 nt, Homo Sapiens
gaaaaaaaaaaagaaaagaauguuaugaugcaaaaaaagaaaaaaacaaaagauuuuuaucaaa

SEQ ID NO: 42822 - RNA, 64 nt, Homo Sapiens
aguuaguuuugagguaacugacagaaccauuaauaaaagaaagggguaaauugcacauugugca

SEQ ID NO: 42823 - RNA, 64 nt, Homo Sapiens
cuagaacaaauugguaauuuuagcagaaaauuccaaaagaaagauuaagcacuucuuaacauug

SEQ ID NO: 42824 - RNA, 64 nt, Homo Sapiens
aaaacaaguguucagggcauaaauacaaaggaagaaaagaaagagaguaacaauaaagaaaaaa

SEQ ID NO: 42825 - RNA, 64 nt, Homo Sapiens
guuucagaagagcagaaguagaaaaaagauagaaaaaagaaaaacgacuggagaagaaaaaaaa

SEQ ID NO: 42826 - RNA, 64 nt, Homo Sapiens
agauagaaaaaagaaaaaguacuggagaagaaaaaaaagaaaaaaauuacaggaaauuagaucg

SEQ ID NO: 42827 - RNA, 64 nt, Homo Sapiens
agaauacccaggugugguagaaaaaagaaaaagaaaaagaaaaacggucuguacuaaaaaaaaa

SEQ ID NO: 42828 - RNA, 64 nt, Homo Sapiens
gaaaaaagaauacccaggugaaaaaaaaaaaagaaaaagaaaaagaaacccggucuguacuaaa

SEQ ID NO: 42829 - RNA, 64 nt, Homo Sapiens
gaaaaagaaaaaagaauaccacuaaaaaaaaaaaaaaagaaaaacguggugaaacccggucugu

SEQ ID NO: 42830 - RNA, 64 nt, Homo Sapiens
gugaaaaaugagcuuguaaacuuggaauuuuguaaaaagaaauuaaugaaggauuucuuauuuu

SEQ ID NO: 42831 - RNA, 64 nt, Homo Sapiens
cugguuuguaauguuugucagcucuaugugggaaaaaagaaaucugauaagaguguaacaucca

SEQ ID NO: 42832 - RNA, 64 nt, Homo Sapiens
aggcgcuuugucuccuacaagaauguguccauugaaaagaaaauaggugauugcugcuauucug

SEQ ID NO: 42833 - RNA, 64 nt, Homo Sapiens
cagauuucccaguuaucuugguaacaaaaauggcaaaagaaauguugcgcauuguguaaguugg

SEQ ID NO: 42834 - RNA, 64 nt, Homo Sapiens
uguguauuuuaagaugaaauaguauuuucugguaaaaagaaaaaggguggcaauuuauuuuaag

SEQ ID NO: 42835 - RNA, 64 nt, Homo Sapiens
ggcauuuuagagaaaacuaacaccuuccucaucuaaaagaaaaagaaaaaauuuuuaggaaacu

SEQ ID NO: 42836 - RNA, 64 nt, Homo Sapiens
agaauguuuuaucaugguuuugggguuguaaaagaaaagaaagcuuuuuuuuuuuuugcguucg

SEQ ID NO: 42837 - RNA, 64 nt, Homo Sapiens
aaagcagaauguuuuaucauguucgugggguuguaaaagaaaaguuuguuuuuuuuuuuuuugc

SEQ ID NO: 42838 - RNA, 64 nt, Homo Sapiens
caaaaucucuacugcuuuggauccugggucaaaaaaaagaaaaaaaaaagaaaugcaaaacuuu

SEQ ID NO: 42839 - RNA, 64 nt, Homo Sapiens
cugcuuuggauccugggucaaaaaaaagaaaaaaaaaagaaaugcaaaacuuuaggcccugccc

SEQ ID NO: 42840 - RNA, 64 nt, Homo Sapiens
agaaagucagaccuguuucuuguaacuggguucaaaaagaaaaaaauaauaaaaauaaaagaga

SEQ ID NO: 42841 - RNA, 64 nt, Homo Sapiens
ggcuauuaaaaaagugguggcaaaagacauccucaaaagaaagagaaaugaaauauuuuugaau

SEQ ID NO: 42842 - RNA, 64 nt, Homo Sapiens
gcuaagaggauaaaggaacugagaccagaugagaaaaagaaaggauauagauuccuugagugga

SEQ ID NO: 42843 - RNA, 64 nt, Homo Sapiens
uggacaaauuuaacaaguuuucuguuacuuuuuaaaaagaaaaaauccagaacauaagaacuau

SEQ ID NO: 42844 - RNA, 64 nt, Homo Sapiens
uuuuacuggguuugcuuuucuuaaaacauaccaaaaaagaaaaaaauagaaaaaaaaaaaaaaa

SEQ ID NO: 42845 - RNA, 64 nt, Homo Sapiens
agcaguuacaagaaacccuaaaacccuuggauauaaaagaaaucuguuuauugauuuuuaaauc

SEQ ID NO: 42846 - RNA, 64 nt, Homo Sapiens
cagcaagacacucuggccaccauaaaaaacgcagaaaagaaaaaaagguuaagcauaaaaagaa

SEQ ID NO: 42847 - RNA, 64 nt, Homo Sapiens
aaaaaacgcagaaaagaaaaaaagguuaagcauaaaaagaaagggaaaaagcagaaacacugca

SEQ ID NO: 42848 - RNA, 64 nt, Homo Sapiens
cucagggcuggggccaagaggaaaaacagggaaaaaaagaaaaaaaaaagaaaaaggaaaagga

SEQ ID NO: 42849 - RNA, 64 nt, Homo Sapiens
ggccaagaggaaaaacagggaaaaaaagaaaaaaaaaagaaaaaggaaaaggaagcggugugug

SEQ ID NO: 42850 - RNA, 64 nt, Homo Sapiens
uguaaaguuuaauugaaagaauguaaagcaaccaaaaagaaaaaaaaaaagaaagaaagaggaa

SEQ ID NO: 42851 - RNA, 64 nt, Homo Sapiens
uugaaagaauguaaagcaaccaaaaagaaaaaaaaaaagaaagaaagaggaaaagaaauccaua

SEQ ID NO: 42852 - RNA, 64 nt, Homo Sapiens
caaccaaaaagaaaaaaaaaaagaaagaaagaggaaaagaaauccauacuaacccuuuuccauu

SEQ ID NO: 42853 - RNA, 64 nt, Homo Sapiens
uacugcaaacuauuuaaagaaauauguauucuguaaaagaaaaaaaaaaugcggccuuuucaug

SEQ ID NO: 42854 - RNA, 64 nt, Homo Sapiens
cccaccuuaacucuuucuugucaggaguauauaaaaaagaaagaaaacaaaacucgcccuacag

SEQ ID NO: 42855 - RNA, 64 nt, Homo Sapiens
ugcagguagcaaagauguaauaaauuugcuuaaaaaaagaaauuaaaguuuuauuuagaaucaa

SEQ ID NO: 42856 - RNA, 64 nt, Homo Sapiens
aaauacguuugacccauuuugaauaaggaaauugaaaagaaaaauuuaaaaggagaaaaaaaug

SEQ ID NO: 42857 - RNA, 64 nt, Homo Sapiens
ucuacagaaccaaagacauguauagaaaguauggaaaagaaaacagacaguuuaguucagaaug

SEQ ID NO: 42858 - RNA, 64 nt, Homo Sapiens
uguaaugcagaagcacuugaggcucaucuugcacaaaagaaaugucagacacucuuuggauuug

SEQ ID NO: 42859 - RNA, 64 nt, Homo Sapiens
auauuuaguucacuauuauauaguggguuauauuaaaagaaaagaagaaaaauaucuaauuucu

SEQ ID NO: 42860 - RNA, 64 nt, Homo Sapiens
cucauuaaaaaccuuuuuuuuuuaaaaaaaaaaaaaaagaaaaucucauuagugaacuuaucuu

SEQ ID NO: 42861 - RNA, 64 nt, Homo Sapiens
gggcuuugcugcauucccuaagauaauuacaggaaaaagaaaauguaaaagugcuaacaaggcu

SEQ ID NO: 42862 - RNA, 64 nt, Homo Sapiens
ugaaagaccgagacuccgccucaaaaaaaaaaaaaaaagaaagaaagaaagaaagaaagaaauc

SEQ ID NO: 42863 - RNA, 64 nt, Homo Sapiens
gauucuuccugauucaaagacugucaaauaggaaaaaagaaaacaguaaaugaacaaaaacauc

SEQ ID NO: 42864 - RNA, 64 nt, Homo Sapiens
agaaacauuugcugaguguuuuuaauaggagucaaaaagaaagggucuuuucagaaacugaagu

SEQ ID NO: 42865 - RNA, 64 nt, Homo Sapiens
auaacagacaaggucaaaaaauagaugcaggcugaaaagaaaaggaagugggcuaagaugggaa

SEQ ID NO: 42866 - RNA, 64 nt, Homo Sapiens
uauuuaucaaggaaauggaaaaugauacagcuauaaaagaaagcuguuauuuacuguaguugua

SEQ ID NO: 42867 - RNA, 64 nt, Homo Sapiens
ggccacaguccagccaaauccuauaauauccuugaaaagaaacuauuaaaaaggauagacauuu

SEQ ID NO: 42868 - RNA, 64 nt, Homo Sapiens
ugaaaugaaccuuggguuagaguuaugguaggcaaaaagaaaaggagaauuuaggaaauaaaua

SEQ ID NO: 42869 - RNA, 64 nt, Homo Sapiens
aacccuuuugagguuuugauuuggaaauagauuuaaaagaaaacaggcuaagauaauauccuug

SEQ ID NO: 42870 - RNA, 64 nt, Homo Sapiens
ucuugacaaagggauuuacacccuugacaaaaccaaaagaaauuaacaggccacagguuucuuu

SEQ ID NO: 42871 - RNA, 64 nt, Homo Sapiens
aggaaaagguuaaacuggauuuuuuuuuuuaaaaaaaagaaaaaaaaagaagaaaaguauacca

SEQ ID NO: 42872 - RNA, 64 nt, Homo Sapiens
gcaaacugcccuuuguccucaaagaaauuguugaaaaagaaaacuuuuuaaagagauuuuuugc

SEQ ID NO: 42873 - RNA, 64 nt, Homo Sapiens
ggacauacauuccaagcuuuucaacucuaggagaaaaagaaaaucauguuuuccuguauuguaa

SEQ ID NO: 42874 - RNA, 64 nt, Homo Sapiens
uguuuauugcuguuuugucuuucuuuuuucuaaaaaaagaaaaaaaagaaaaaaaggaaaagaa

SEQ ID NO: 42875 - RNA, 64 nt, Homo Sapiens
cuguuuugucuuucuuuuuucuaaaaaaagaaaaaaaagaaaaaaaggaaaagaagaacaaaga

SEQ ID NO: 42876 - RNA, 64 nt, Homo Sapiens
aguuauugaaauaggacuuaagaauuaccuauuaaaaagaaaucugauauauaaaaauauguac

SEQ ID NO: 42877 - RNA, 64 nt, Homo Sapiens
ucucugauagagcuauuaaugacuuaguuucuguaaaagaaauggagaguugauaugguucaga

SEQ ID NO: 42878 - RNA, 64 nt, Homo Sapiens
uguuaaggaguuuuucccaagaagaaaaguauuuaaaagaaauaccagugagugccuuaaaguu

SEQ ID NO: 42879 - RNA, 64 nt, Homo Sapiens
cagguaucacagccuaaagaaauuaucuuuuugcaaaagaaauauuaaaugauuuagcagucuc

SEQ ID NO: 42880 - RNA, 64 nt, Homo Sapiens
aaguacucacacaugccacaauuauuagacucuaaaaagaaauggucuguccacgcaauggaac

SEQ ID NO: 42881 - RNA, 64 nt, Homo Sapiens
aauguauccagauaggaaaagcauuugggaaagaaaaagaaauaaagaagcuaauguuuaagaa

SEQ ID NO: 42882 - RNA, 64 nt, Homo Sapiens
agcaacccucuuucaaacugaauuuagcauuucuaaaagaaaaauauuuuugucuuguuaagaa

SEQ ID NO: 42883 - RNA, 64 nt, Homo Sapiens
aaacccacacacaaagcaaacgauaucuaaaugaaaaagaaagaguccucuccacuuuauccca

SEQ ID NO: 42884 - RNA, 64 nt, Homo Sapiens
gugaaacacaauuuaguccuuuuuuaaaaaaaggaaaagaaaaucauucucauuguuacaugau

SEQ ID NO: 42885 - RNA, 64 nt, Homo Sapiens
aaagaguuuguuacucuauuuuauuuaaaaaaaaaaaagaaaaagaucuuuggaaacuugcccc

SEQ ID NO: 42886 - RNA, 64 nt, Homo Sapiens
ugcagagguuauuaaaaugucugccuaaauguguaaaagaaaaaugaggagaaaagaaagcaca

SEQ ID NO: 42887 - RNA, 64 nt, Homo Sapiens
acacugccuaaauguguaaacuuuaacugaggagaaaagaaagcaaauauuggccaagguguug

SEQ ID NO: 42888 - RNA, 64 nt, Homo Sapiens
aguguauuuuacuguuuucuaaaaaaaaaaaagaaaaagaaaaauagucuuguuuguaaaaaaa

SEQ ID NO: 42889 - RNA, 64 nt, Homo Sapiens
gaaaaaaguguauuuuacugaaaaaaaaaaaaaaaaaagaaaaaauaagcuagucuuguuugua

SEQ ID NO: 42890 - RNA, 64 nt, Homo Sapiens
ugguucaaauuauaucuaaaucaaaaaagaaaagaaaagaaacaugacagagugagacucuguu

SEQ ID NO: 42891 - RNA, 64 nt, Homo Sapiens
aaacaugguucaaauuauaucuguuucaaaaaagaaaagaaaagccuggugacagagugagacu

SEQ ID NO: 42892 - RNA, 64 nt, Homo Sapiens
aaaagaaacaugguucaaauagacucuguuucaaaaaagaaaaguccagccuggugacagagug

SEQ ID NO: 42893 - RNA, 64 nt, Homo Sapiens
acaugggugguacauugagggaggccccauuuaaaaaagaaagacgaugugcagccaaaucuga

SEQ ID NO: 42894 - RNA, 64 nt, Homo Sapiens
ucagauuguuacugugucuguaguccauguggggaaaagaaagaccauaucuaugauaucgcau

SEQ ID NO: 42895 - RNA, 64 nt, Homo Sapiens
gauaaagggauugugaaaagaaaaaaaaaaaaagaaaagaaaaaagagccagacucugucucaa

SEQ ID NO: 42896 - RNA, 64 nt, Homo Sapiens
aaaaagauaaagggauugugcucaaaaaaaaaaaaaaagaaaaggugacagagccagacucugu

SEQ ID NO: 42897 - RNA, 64 nt, Homo Sapiens
uggccccuuuccaucuucaagggcuuggacugugaaaagaaauguugucuggggccuggggaaa

SEQ ID NO: 42898 - RNA, 64 nt, Homo Sapiens
uuugcccccuuugcaucuucucuguuuaaaauauaaaagaaaacacgaagccuuucaggcugcu

SEQ ID NO: 42899 - RNA, 64 nt, Homo Sapiens
aaacuuuggcuuucauauucugaagcaggaucacaaaagaaaaauuggacagaacagaauaaua

SEQ ID NO: 42900 - RNA, 64 nt, Homo Sapiens
ggacagaacagaauaauauggcguuucccuacagaaaagaaauucucuuuuuuauaucucuuug

SEQ ID NO: 42901 - RNA, 64 nt, Homo Sapiens
ccgggucugcagagaaugaaaagcaguuuuuauaaaaagaaagcggugucucuaugcccuuuga

SEQ ID NO: 42902 - RNA, 64 nt, Homo Sapiens
aagcagauggcuuaaagcugacaaaaaaaaaaaaaaaagaaaucuuuuccuauauauguuccuu

SEQ ID NO: 42903 - RNA, 64 nt, Homo Sapiens
auuuaauguaaaauauucuacaauccuagcuuuuaaaagaaacuaugaagagaguugaguuuaa

SEQ ID NO: 42904 - RNA, 64 nt, Homo Sapiens
cuacacccaaacaauacaaccugacaacuugauaaaaagaaaagauaaauauguaugcauacuu

SEQ ID NO: 42905 - RNA, 64 nt, Homo Sapiens
aaguuacuugucugcagucaaguggaaaagacaaaaaagaaacuacuuuguucuuccaaguccu

SEQ ID NO: 42906 - RNA, 64 nt, Homo Sapiens
cagaagccuuauuugugauuuuuaccucacacuaaaaagaaaacccuuaauauugaauauacug

SEQ ID NO: 42907 - RNA, 64 nt, Homo Sapiens
cagaccauuuaaaaacucagauccuacauaaugaaaaagaaaaaagaauuuuggugggcaucua

SEQ ID NO: 42908 - RNA, 64 nt, Homo Sapiens
aaaauguuguuuaaaaaaugaguucauacauuugaaaagaaaaacuuccuggcuaucuuaaaca

SEQ ID NO: 42909 - RNA, 64 nt, Homo Sapiens
uuagauuuuacauaucuuuggcaaaaaaaaaaaaaaaagaaaaaugcuuagucuaaagacugua

SEQ ID NO: 42910 - RNA, 64 nt, Homo Sapiens
gcuuuagcuucuggucagcagccaaucuuagccuaaaagaaauuaauugggucuaugauuuuuu

SEQ ID NO: 42911 - RNA, 64 nt, Homo Sapiens
gccaaagugaaaaaaaguuaaaaucuucauuuauaaaagaaaaauuaucuuugacuuuuaccac

SEQ ID NO: 42912 - RNA, 64 nt, Homo Sapiens
cuuaaucacggugccaaaauaaagguuaaacuugaaaagaaauuguagcuacuguuuuuaaugu

SEQ ID NO: 42913 - RNA, 64 nt, Homo Sapiens
aaaaacuuaaauauuuauuuacagauugaagaagaaaagaaagaucugcucugagccuuaaaac

SEQ ID NO: 42914 - RNA, 64 nt, Homo Sapiens
ugcauauauuuauucuguaaacacacaaagauucaaaagaaaugcuuuuaauguuuucucucuc

SEQ ID NO: 42915 - RNA, 64 nt, Homo Sapiens
uaucccuugcucccuuuacaaagaaaaggaaaauaaaagaaauauagugcuuuuuuuuuuucaa

SEQ ID NO: 42916 - RNA, 64 nt, Homo Sapiens
gaaaauaaaagaaauauaucgcuuuuuuuuuuucaaaagaaaagagagaagaaaauauauuagu

SEQ ID NO: 42917 - RNA, 64 nt, Homo Sapiens
ggaaaaagaagaaucuugcuuggaauugguuauuaaaagaaaaaaaaauuucuauucaggcuac

SEQ ID NO: 42918 - RNA, 64 nt, Homo Sapiens
uuugaaaauuucuauucaggaaugcaguuuuaccaaaagaaaaaaaucauaacuuuaauucaag

SEQ ID NO: 42919 - RNA, 64 nt, Homo Sapiens
acagaaauauauccagcuaaaaaaaaaagaaaaaaaaagaaaaaucugugacaaaaaaaaaaaa

SEQ ID NO: 42920 - RNA, 64 nt, Homo Sapiens
aaaagaaaaaacagaaauauaaaaaaaaaaaaaaaaaagaaaaacaaacaguguucugugacaa

SEQ ID NO: 42921 - RNA, 64 nt, Homo Sapiens
aaguacacauucagaaucugugagugcauuuugaaaaagaaaaaauaugaacuuugguucuuca

SEQ ID NO: 42922 - RNA, 64 nt, Homo Sapiens
accucacuuuuccuuuauagaaguacguuaaagaaaaagaaaaaccaagaagcucaaagaaaag

SEQ ID NO: 42923 - RNA, 64 nt, Homo Sapiens
ugcaacuuuuuuugccuuggugacuuuugaaaaaaaaagaaaagaaaaagcagcauccuuauau

SEQ ID NO: 42924 - RNA, 64 nt, Homo Sapiens
cuuuuuuugccuuggugacuuuugaaaaaaaaagaaaagaaaaagcagcauccuuauauuucuu

SEQ ID NO: 42925 - RNA, 64 nt, Homo Sapiens
gcuaauguauaaugugcagaaaauauuuaauaucaaaagaaaauugauauuuuuauacaaguaa

SEQ ID NO: 42926 - RNA, 64 nt, Homo Sapiens
ugcuaaccauuuauauaaaacuuaaaaacaagagaaaagaaaaaucaauuagaucuaaacaguu

SEQ ID NO: 42927 - RNA, 64 nt, Homo Sapiens
uuccuugcuuagucuccuuucaguauuuggcaauaaaagaaagaagaaauagaacagcugaagu

SEQ ID NO: 42928 - RNA, 64 nt, Homo Sapiens
auaaaucauauggcgagucagggaauaaaaagucaaaagaaacaaauagaagcuuuuuuuuuua

SEQ ID NO: 42929 - RNA, 64 nt, Homo Sapiens
accugggugaugaagugagacucuccaaaaaaaaaaaagaaauuauuaaucccugccugugcuc

SEQ ID NO: 42930 - RNA, 64 nt, Homo Sapiens
cagccagaacuuucuuucacgguuacuguuccugaaaagaaaaagccaccuagcccuaucaagc

SEQ ID NO: 42931 - RNA, 64 nt, Homo Sapiens
auuaauuucaaaauuuaaagccaugcuaaaauuaaaaagaaaauauuaaauuacacaauuacac

SEQ ID NO: 42932 - RNA, 64 nt, Homo Sapiens
uagccuagacaacauagugagacuuggucucuaaaaaagaaaaaaaaaaauaaaacugauguaa

SEQ ID NO: 42933 - RNA, 64 nt, Homo Sapiens
aacugaaguggcauguuauguuuuuggcaugaacaaaagaaacaagagagaaaaaaaucaaaau

SEQ ID NO: 42934 - RNA, 64 nt, Homo Sapiens
agcgauucuucugccucagccucccaaaugucagaaaagaaagcauacaugcuuaugcaugaaa

SEQ ID NO: 42935 - RNA, 64 nt, Homo Sapiens
uuuuggaaggcuuuccacaaacuaaccuuggaugaaaagaaaaaauuccucuguaaguacugug

SEQ ID NO: 42936 - RNA, 64 nt, Homo Sapiens
aagaaguauauuuuagaaauuuguuaaugagaguaaaagaaaauaaauguguauagcucaguuu

SEQ ID NO: 42937 - RNA, 64 nt, Homo Sapiens
uagguuaaacaugguuagaaacaacugaaagcauaaaagaaaaaucuaggccgggugcaguggc

SEQ ID NO: 42938 - RNA, 64 nt, Homo Sapiens
cauuugcuauaaaguugaacuuuguauggcuugaaaaagaaaugacaauauggaacaucccaag

SEQ ID NO: 42939 - RNA, 64 nt, Homo Sapiens
aacauuuauaauugcaaaauaaaccaacuauaaaaaaagaaacuaagagagaauugguacuuua

SEQ ID NO: 42940 - RNA, 64 nt, Homo Sapiens
uaauuugcaucccucguuuagaugcaauuuuuuaaaaagaaaauaaaagagaauuuagaugaga

SEQ ID NO: 42941 - RNA, 64 nt, Homo Sapiens
ggccuucuugacugugaagauugccagcuacacuaaaagaaaauauaaggaugaucagagacuu

SEQ ID NO: 42942 - RNA, 64 nt, Homo Sapiens
guaucagucauccagagacccgugagcgccagcgaaaagaaacuaaaagaaacuaucucgguca

SEQ ID NO: 42943 - RNA, 64 nt, Homo Sapiens
aucucggucacgugagcgccugugagcgccaaggaaaagaaacuuagggccuuccuuuuugccu

SEQ ID NO: 42944 - RNA, 64 nt, Homo Sapiens
aaccaaagaaaauugguacuaacauuaauguugaaaaagaaaacaccuggcuacaauuacuuug

SEQ ID NO: 42945 - RNA, 64 nt, Homo Sapiens
guguaacagaguugagguugucaaaauugaccucaaaagaaaaugagaggacaaguguaauaaa

SEQ ID NO: 42946 - RNA, 64 nt, Homo Sapiens
uuaaaagaaaaaaaaucagagugcucauaugaauaaaagaaauuuucucuaauuacuauacauu

SEQ ID NO: 42947 - RNA, 64 nt, Homo Sapiens
aagccauuuaacauuuuuuaaacauaagagucuuaaaagaaauuaauacccauuuaaugugaaa

SEQ ID NO: 42948 - RNA, 64 nt, Homo Sapiens
aaaugaaucuauuuuucucucccuccuauaguuaaaaagaaaaauugcccauaauaucaacuuu

SEQ ID NO: 42949 - RNA, 64 nt, Homo Sapiens
caaaagcuauagauauacagaauuauagaaaaagaaaagaaacaaaucaacaaugugauacgua

SEQ ID NO: 42950 - RNA, 64 nt, Homo Sapiens
aaacacaaaagcuauagauaacguaaauuauagaaaaagaaaaguguugaaucaacaaugugau

SEQ ID NO: 42951 - RNA, 64 nt, Homo Sapiens
uauguugcuaagauuguguuccaaagauuauuacaaaagaaaaagaauucauuggaagaaauca

SEQ ID NO: 42952 - RNA, 64 nt, Homo Sapiens
aagcauaaaaaucgaguaauuaugguugaaauguaaaagaaaguucucauggaaaaauuaauua

SEQ ID NO: 42953 - RNA, 64 nt, Homo Sapiens
cugcauuugucacgaagacauugagccaaguaauaaaagaaauugaaaaggaucaacaguuaau

SEQ ID NO: 42954 - RNA, 64 nt, Homo Sapiens
ucacagaagagagaaugcaaaaaagguagauaugaaaagaaaaaaccaagucuuacauagaaaa

SEQ ID NO: 42955 - RNA, 64 nt, Homo Sapiens
cagucuuacaccaucaaggaaguucuuggaaugaaaaagaaauacucagaaaaaagaagcugcc

SEQ ID NO: 42956 - RNA, 64 nt, Homo Sapiens
aaaaaguuuuaagaggggucguauaucaaaccaaaaaagaaaaaaaaaagccagugccuauuga

SEQ ID NO: 42957 - RNA, 64 nt, Homo Sapiens
caagauuuugauaugaccacuaucugauagguacaaaagaaaacggccaccaacaauuuaguca

SEQ ID NO: 42958 - RNA, 64 nt, Homo Sapiens
gcauuuuauauuacuacucaacuuguaacaaugaaaaagaaaaauguuggcaaucaaagcaugc

SEQ ID NO: 42959 - RNA, 64 nt, Homo Sapiens
aaagaacguugcaaauuuguaaaaaaaaaacagaaaaagaaaaagaauuaggcagucuuaaaaa

SEQ ID NO: 42960 - RNA, 64 nt, Homo Sapiens
uaaugcuaguauauacugcagaaaaaaaauuuuaaaaagaaagccuuuuaaaaaugcuuauaga

SEQ ID NO: 42961 - RNA, 64 nt, Homo Sapiens
uauuuucuuccuaguucugggguaauuuaaaaagaaaagaaauuuaacagaauacgacagacug

SEQ ID NO: 42962 - RNA, 64 nt, Homo Sapiens
aaauuuauuuucuuccuagugacuggguaauuuaaaaagaaaaguacuauaacagaauacgaca

SEQ ID NO: 42963 - RNA, 64 nt, Homo Sapiens
aaucccuuguucucagugguaaaaaaagaaaagaaaaagaaaaagcccuucccccugcaaaaag

SEQ ID NO: 42964 - RNA, 64 nt, Homo Sapiens
gaaaaaaaucccuuguucucaaaaagaaaaaaagaaaagaaaaacucccugcccuucccccugc

SEQ ID NO: 42965 - RNA, 64 nt, Homo Sapiens
aaaaagaaaaaaaucccuugccugcaaaaagaaaaaaagaaaagauauacucccugcccuuccc

SEQ ID NO: 42966 - RNA, 64 nt, Homo Sapiens
aagaaaagaaaaagaaaaaacccuucccccugcaaaaagaaaaauguagacgauauacucccug

SEQ ID NO: 42967 - RNA, 64 nt, Homo Sapiens
uggcaagagaauugaugaggaauuaacaccuaggaaaagaaaacaaguaaaccauauauaggga

SEQ ID NO: 42968 - RNA, 64 nt, Homo Sapiens
uuacuuuugucugcuaaaguacuuucgguuuuaaaaaagaaacaccaauguuucaucaucagga

SEQ ID NO: 42969 - RNA, 64 nt, Homo Sapiens
ucaacuuaccaggcaccaaaagaaguaaaagcaaaaaagaaaaccuuucuucaccaaaucuugg

SEQ ID NO: 42970 - RNA, 64 nt, Homo Sapiens
uccccacagauaacugaaaauuauuuaaaccgcuaaaagaaacuuucuuucucacuaaaucuuu

SEQ ID NO: 42971 - RNA, 64 nt, Homo Sapiens
auuuaaagccacaaccacauacaacacaaagagaaaaagaaaugcaaaaaucucugcgugcagg

SEQ ID NO: 42972 - RNA, 64 nt, Homo Sapiens
cugauaagcuucaaagcugcuuuauucaauaaaaaaaagaaaugaaaaagauauaugaauauga

SEQ ID NO: 42973 - RNA, 64 nt, Homo Sapiens
ccagcuugggcaacagagcaagacuccaucucaaaaaagaaaaaagaaaagaaauagaauuauc

SEQ ID NO: 42974 - RNA, 64 nt, Homo Sapiens
gggcaacagagcaagacuccaucucaaaaaagaaaaaagaaaagaaauagaauuaucaagcuuu

SEQ ID NO: 42975 - RNA, 64 nt, Homo Sapiens
aagacuccaucucaaaaaaaaaaaaagaaaaaagaaaagaaauagaauuaucaagcuuuuaaaa

SEQ ID NO: 42976 - RNA, 64 nt, Homo Sapiens
uaggcaauguagugagacccugucucuaauuuaaaaaagaaaaagaaaaaaacauucccagugg

SEQ ID NO: 42977 - RNA, 64 nt, Homo Sapiens
auguagugagacccugucucuaauuuaaaaaagaaaaagaaaaaaacauucccaguggcagccu

SEQ ID NO: 42978 - RNA, 64 nt, Homo Sapiens
gaaagcuugcuguacaaaggcaacagcaacuuaaaaaagaaaaucuggacaauagauguggacu

SEQ ID NO: 42979 - RNA, 64 nt, Homo Sapiens
uuuugauaugacugaauugcaaucuauauuuuuaaaaagaaaaaucaaaauacauuaggguuua

SEQ ID NO: 42980 - RNA, 64 nt, Homo Sapiens
cuccauaccuagccccucuuuuauaaucuuccuuaaaagaaagaguguagccuauaaauacuaa

SEQ ID NO: 42981 - RNA, 64 nt, Homo Sapiens
aaccaaccacagaucaaaaauagaaaaaaaaaaaaaaagaaaaaaagaauguaaaauuuuaaaa

SEQ ID NO: 42982 - RNA, 64 nt, Homo Sapiens
uuguucuuaaggcaucauaucuagaagcaaagaaaaaagaaaaauaacaauuuaaguuguguaa

SEQ ID NO: 42983 - RNA, 64 nt, Homo Sapiens
aguuacuuauauuaauaauauucagaaaaaaaaaaaaagaaaaggaaaaagaaaaauauauauu

SEQ ID NO: 42984 - RNA, 64 nt, Homo Sapiens
gacucugucucagaaaaaaaaaaaaagaaaaggaaaaagaaaaauauauauucuauauuuuuuu

SEQ ID NO: 42985 - RNA, 64 nt, Homo Sapiens
uucauuguuuugcaaaaguguaugguaggggcuuaaaagaaacuauaaaguuuuauuugaauga

SEQ ID NO: 42986 - RNA, 64 nt, Homo Sapiens
cauuuguguuucagcucacaguucuuugcuggguaaaagaaauacuuucugacagucaccugag

SEQ ID NO: 42987 - RNA, 64 nt, Homo Sapiens
uaaagggaaaggggaaagaaagggaaaagggagaaaaagaaacacaagagacuuaaaggacagg

SEQ ID NO: 42988 - RNA, 64 nt, Homo Sapiens
uuuggaguuagguccucacuugggggaaaaaaaaaaaagaaaagccaagcaaaccaauggugau

SEQ ID NO: 42989 - RNA, 64 nt, Homo Sapiens
guugucguuuuaacaucuccacgucccuagcauaaaaagaaaaagaaaaaaauuuaaacugcuu

SEQ ID NO: 42990 - RNA, 64 nt, Homo Sapiens
guuuuaacaucuccacgucccuagcauaaaaagaaaaagaaaaaaauuuaaacugcuuuuucgg

SEQ ID NO: 42991 - RNA, 64 nt, Homo Sapiens
gaaguaucaucuauaagggagggcugggggcgggaaaagaaaaaaaaaagucauuuugaaauua

SEQ ID NO: 42992 - RNA, 64 nt, Homo Sapiens
uucaauuacauccugacuuguauagacacagccaaaaagaaacuguuaauagccauccguccau

SEQ ID NO: 42993 - RNA, 64 nt, Homo Sapiens
gguuugaauggaguugaaaguuuuacauaagugaaaaagaaaguuuaucuugggaguugaguug

SEQ ID NO: 42994 - RNA, 64 nt, Homo Sapiens
uuuuuucuuccuguccccuccuaccccagucccuaaaagaaauggggaaaaaagaaaacaacag

SEQ ID NO: 42995 - RNA, 64 nt, Homo Sapiens
cccuccuaccccagucccuaaaagaaauggggaaaaaagaaaacaacagcaagucagaaaaaaa

SEQ ID NO: 42996 - RNA, 64 nt, Homo Sapiens
caaauauuaauagaaaucucauuuuuaaaaaagaaaaagaaacaaaauacaaccgagaggggag

SEQ ID NO: 42997 - RNA, 64 nt, Homo Sapiens
gaaacacaaauauuaauagaggggagauuuuuaaaaaagaaaaaaggcuaaaauacaaccgaga

SEQ ID NO: 42998 - RNA, 64 nt, Homo Sapiens
cacagcaggaugcuaauggauaaagacuaacuugaaaagaaaacuuaguuaaaaaaaaauuccc

SEQ ID NO: 42999 - RNA, 64 nt, Homo Sapiens
uuuccacauaggaaaaugcccauagaaagaugacaaaagaaaauaaauugucaaaauuguuuac

SEQ ID NO: 43000 - RNA, 64 nt, Homo Sapiens
uuaguaauuauuugauggauacugauuuuuuuuaaaaagaaaacuuaauugugugcccauaaac

SEQ ID NO: 43001 - RNA, 64 nt, Homo Sapiens
auugguaaugcgaauguauacaagggauguuuugaaaagaaaaauuagaaaguagcacuugaug

SEQ ID NO: 43002 - RNA, 64 nt, Homo Sapiens
gcugagaaaugaaacuugguagcauaauaaauuuaaaagaaaagaaaugaaaaaagaaaagaaa

SEQ ID NO: 43003 - RNA, 64 nt, Homo Sapiens
cauaauaaauuuaaaagaaauuaaaugaaaaaagaaaagaaaagacaaagucucaauccuuauu

SEQ ID NO: 43004 - RNA, 64 nt, Homo Sapiens
aaaagcauaauaaauuuaaauuauuuuaaaugaaaaaagaaaaguggggacaaagucucaaucc

SEQ ID NO: 43005 - RNA, 64 nt, Homo Sapiens
cugaugauuagauuagguuacuugccuucuuuuaaaaagaaaaaucauggauaaaaacuaagcg

SEQ ID NO: 43006 - RNA, 64 nt, Homo Sapiens
accgacagcuguaaaauguugaucucuaaaccauaaaagaaaacaugagauugaaauuuuuuau

SEQ ID NO: 43007 - RNA, 64 nt, Homo Sapiens
ugagguuuuaggauuuucauaauuuuaaaaaagaaaaagaaaauguugaauaagaguuggcuua

SEQ ID NO: 43008 - RNA, 64 nt, Homo Sapiens
gaaaauugagguuuuaggauggcuuaaauuuuaaaaaagaaaaaagaaaaguugaauaagaguu

SEQ ID NO: 43009 - RNA, 64 nt, Homo Sapiens
caaggaaaaggcucuuuauuagaaaaaaagggaaaaaagaaaagguaagaaaagaaaaaagaaa

SEQ ID NO: 43010 - RNA, 64 nt, Homo Sapiens
aagggaaaaaagaaaagcaaagaaaagaaaaaagaaaagaaaaaacgacuuaauguauguugua

SEQ ID NO: 43011 - RNA, 64 nt, Homo Sapiens
aaaaaaagggaaaaaagaaauuguaagaaaagaaaaaagaaaaggauucacgacuuaauguaug

SEQ ID NO: 43012 - RNA, 64 nt, Homo Sapiens
agaaaagaaaaaaagggaaaauguauguuguaagaaaagaaaaaaacaucugauucacgacuua

SEQ ID NO: 43013 - RNA, 62 nt, Homo Sapiens
aaaggaacaguguaaauuuguuuuuuaauaacuaaaaagaaaguauuuugagguuuuauugu

SEQ ID NO: 43014 - RNA, 64 nt, Homo Sapiens
uaaauguucaagauaucagcuuuuaaaauauauuaaaagaaaccguauuuuuuauauaacuuca

SEQ ID NO: 43015 - RNA, 64 nt, Homo Sapiens
agggcagguuccagggccugaguugaaaaaaauaaaaagaaaugcugugauauuuuagacugca

SEQ ID NO: 43016 - RNA, 64 nt, Homo Sapiens
uacauggggaaccagaagacugguauauaacaggaaaagaaaacucuaauucccacaggaagca

SEQ ID NO: 43017 - RNA, 64 nt, Homo Sapiens
aaaaagccucucuguccuauaaaugccaaaaagaaaaagaaaaagaagauugaccaaaccaucc

SEQ ID NO: 43018 - RNA, 64 nt, Homo Sapiens
gaaaaaaaaaagccucucugccauccaaaugccaaaaagaaaaaggaagagaagauugaccaaa

SEQ ID NO: 43019 - RNA, 64 nt, Homo Sapiens
auuguuuuaauugagaggggaaaaaagaaaagaaaaaagaaagcagagcaagacuccgucucaa

SEQ ID NO: 43020 - RNA, 64 nt, Homo Sapiens
agaaagcauuguuuuaauuggucucaaaaaaaagaaaagaaaaagggugacagagcaagacucc

SEQ ID NO: 43021 - RNA, 64 nt, Homo Sapiens
aaaaaagaaagcauuguuuuacuccgucucaaaaaaaagaaaagagcccgggugacagagcaag

SEQ ID NO: 43022 - RNA, 64 nt, Homo Sapiens
gaaguaagauguaaauugaagaagccucacacguaaaagaaauguauuaauguauguaggagcu

SEQ ID NO: 43023 - RNA, 64 nt, Homo Sapiens
acauuucacuuuucuguaaauauacauaaacuuaaaaagaaaaccucauggagucaucuugcac

SEQ ID NO: 43024 - RNA, 64 nt, Homo Sapiens
ggggaagauuguguuacugcccuucacagugaaaaaaagaaaaaucuuucauuuuuaaaauuag

SEQ ID NO: 43025 - RNA, 64 nt, Homo Sapiens
uaauucucaugcugaagcuguagccuaaaaagccaaaagaaaguugucuucauuguacaaacau

SEQ ID NO: 43026 - RNA, 64 nt, Homo Sapiens
aaaauugcaguauuuaaagcuuaagcuuucaggaaaaagaaaauaagaauucagugugugcaug

SEQ ID NO: 43027 - RNA, 64 nt, Homo Sapiens
aaucaguuuagcuuuguguuguaugcuaguuuaaaaaagaaaauauguaauauaauguaaaaaa

SEQ ID NO: 43028 - RNA, 64 nt, Homo Sapiens
gggggggguaggagaggagaaaaaaaaagugaaaaaaagaaacgaaaaggacagacgaagaguu

SEQ ID NO: 43029 - RNA, 64 nt, Homo Sapiens
aaggacagacgaagaguuuaaagagaaaagggaaaaaagaaagaaaaaguaagcagggcuggcu

SEQ ID NO: 43030 - RNA, 64 nt, Homo Sapiens
cagucaguggagggcgagugguuucggaaaaaaaaaaagaaaaaaagaaaaaaaaagaaaaaaa

SEQ ID NO: 43031 - RNA, 64 nt, Homo Sapiens
ggagggcgagugguuucggaaaaaaaaaaagaaaaaaagaaaaaaaaagaaaaaaaaaagauuu

SEQ ID NO: 43032 - RNA, 64 nt, Homo Sapiens
ugguuucggaaaaaaaaaaagaaaaaaagaaaaaaaaagaaaaaaaaaagauuuuuuucuucuc

SEQ ID NO: 43033 - RNA, 64 nt, Homo Sapiens
auucaaggccacaaaaacaauguuugggggaaaaaaaagaaaaaaucaugccagcuaaucaugu

SEQ ID NO: 43034 - RNA, 64 nt, Homo Sapiens
ucagcagacuggaagcugaggaagaucuagaaguaaaagaaaaaauuagaugcguuaaaaugac

SEQ ID NO: 43035 - RNA, 64 nt, Homo Sapiens
auuuuuuuuucugugacuauguuuucacuuacauaaaagaaauugugauagaccuuuuucauau

SEQ ID NO: 43036 - RNA, 64 nt, Homo Sapiens
aagaugaagcaaaauuuuaaucuggcaauuaugaaaaagaaauauuuuagcucugaaggauuua

SEQ ID NO: 43037 - RNA, 64 nt, Homo Sapiens
gcaguuuauuuuguuauguuggauaaauacuguuaaaagaaaccagucaguaacuauauuguua

SEQ ID NO: 43038 - RNA, 64 nt, Homo Sapiens
cuccucuuuguuuuuaaaaguuauaacauggcugaaaagaaagauuaaaccuacuuucauaugu

SEQ ID NO: 43039 - RNA, 64 nt, Homo Sapiens
uuauaauaaaauccuucuguaauaauaaaguuucaaaagaaaauguuuauuuguucucauuaaa

SEQ ID NO: 43040 - RNA, 64 nt, Homo Sapiens
gauuuuuuuuuuccuucccaaccucucuugcaaaaaaagaaauggguuucugcuaaugaauuga

SEQ ID NO: 43041 - RNA, 64 nt, Homo Sapiens
caucaugauuaaugaaaacuaucuuuugaguuugaaaagaaauuaauuugcaguguuuggauug

SEQ ID NO: 43042 - RNA, 64 nt, Homo Sapiens
agaguucacacccacucuaaaaccauguccucugaaaagaaacaaaaauacagugaucaucaaa

SEQ ID NO: 43043 - RNA, 64 nt, Homo Sapiens
guugagauucggcaguugcccaauuccuuuaauaaaaagaaacuaaauaauuugggccccaaag

SEQ ID NO: 43044 - RNA, 64 nt, Homo Sapiens
gcaguguuucugggggagguuauggagggaagaaaaaagaaaaaucgauagugagugacugauu

SEQ ID NO: 43045 - RNA, 64 nt, Homo Sapiens
auaaauaccauuaaacugugaucaguuaaaauuuaaaagaaaaaucagcacaaaagggcgcuaa

SEQ ID NO: 43046 - RNA, 64 nt, Homo Sapiens
uguggaguaucccauucugaugaguacagaaaaaaaaagaaaaagaaaagaagagaaaaaauua

SEQ ID NO: 43047 - RNA, 64 nt, Homo Sapiens
guaucccauucugaugaguacagaaaaaaaaagaaaaagaaaagaagagaaaaaauuaagaaaa

SEQ ID NO: 43048 - RNA, 64 nt, Homo Sapiens
ucgcaagcccggggagagauuuauaaaaguaaacaaaagaaaaccuuccagcaacaaauuaaaa

SEQ ID NO: 43049 - RNA, 64 nt, Homo Sapiens
caagaaagcaggaacguggagaaauuggagcaggaaaagaaauuaucaaagcaauagaaauagc

SEQ ID NO: 43050 - RNA, 64 nt, Homo Sapiens
aaccguuauagacccaauaacaacuaaaccuuucaaaagaaaauauuuucuauuaugaauguug

SEQ ID NO: 43051 - RNA, 64 nt, Homo Sapiens
cuuaacacugacuggucaucaguaucauuagugaaaaagaaacaaauuguuuguuaucaucucu

SEQ ID NO: 43052 - RNA, 64 nt, Homo Sapiens
aaagcaaaacaagaagauacaucacuuuucauugaaaagaaaaguguagagcaugacugaauug

SEQ ID NO: 43053 - RNA, 64 nt, Homo Sapiens
aguaauggugaaaauuguugucuuuggaaagcacaaaagaaaccuggaaaggcaguucggcuca

SEQ ID NO: 43054 - RNA, 64 nt, Homo Sapiens
gaguccaaguuaucuugauuuaaaauugauagagaaaagaaacugucgagcaaguuauauaaca

SEQ ID NO: 43055 - RNA, 64 nt, Homo Sapiens
ggggccucauuaaacuaaagagcuucugcacagaaaaagaaacuagcaacacaguaaacagaca

SEQ ID NO: 43056 - RNA, 64 nt, Homo Sapiens
cacaaagucagagaugguggugaggcugcagagcaaaagaaacagacacuguuggugggaaagc

SEQ ID NO: 43057 - RNA, 64 nt, Homo Sapiens
aauaagcaaauuauuggcuucuuucuucuagacuaaaagaaauuaaagagaugaaacaaucaau

SEQ ID NO: 43058 - RNA, 64 nt, Homo Sapiens
gaagaaagagagaaagaaagaaacagaaaaaccuaaaagaaagcgaaugaauuugacaccuguu

SEQ ID NO: 43059 - RNA, 64 nt, Homo Sapiens
aaguuccugauuuuuguuuuuauuuuuguguuacaaaagaaagcccucccucccugaacuugca

SEQ ID NO: 43060 - RNA, 64 nt, Homo Sapiens
cauuuccuucaauuuccuuugaccuauaggcuaaaaaagaaaggcucauuccagccacagggca

SEQ ID NO: 43061 - RNA, 64 nt, Homo Sapiens
uuucuguucuuguuuauccagcguaggaagaaggaaaagaaaaucuuugcuccucugccccauu

SEQ ID NO: 43062 - RNA, 64 nt, Homo Sapiens
uuauauauuuuuucauuagggccauaucuccaaaaaaagaaagaaaaaauacaaaaaacaaaaa

SEQ ID NO: 43063 - RNA, 64 nt, Homo Sapiens
uuguauuucaagauaauguaguuuaaaaaaaaaaaaaagaaaaaaacuugauguaaauuccucc

SEQ ID NO: 43064 - RNA, 64 nt, Homo Sapiens
aguaaagcuccauuuuuguguuuuuuggaaauguaaaagaaaaaguuuauaucauuuuaacaag

SEQ ID NO: 43065 - RNA, 64 nt, Homo Sapiens
uaucguagccagccuguaaagaauuuuuuuuaaaaaaagaaagucuugauguugauacacauuu

SEQ ID NO: 43066 - RNA, 64 nt, Homo Sapiens
acugucugucuuaaauuuugaaaaaaaaaaagaaaaaagaaaguagaccuugucucaaaaaaaa

SEQ ID NO: 43067 - RNA, 64 nt, Homo Sapiens
agaaaguacugucugucuuaaaaaaaaaaaaaaaaaaagaaaaacagagccagaccuugucuca

SEQ ID NO: 43068 - RNA, 64 nt, Homo Sapiens
uacuuguuaggaaguagcuuaguaaagacuuugaaaaagaaauguuuaaaaauuaaucaguuac

SEQ ID NO: 43069 - RNA, 64 nt, Homo Sapiens
aauaguuggaaaauaagacagcuaaagguaaaagaaaagaaaaaaaaaugaugcuguuuucucu

SEQ ID NO: 43070 - RNA, 64 nt, Homo Sapiens
aaaaaaauaguuggaaaauaucucugcuaaagguaaaagaaaagccucuaaaaugaugcuguuu

SEQ ID NO: 43071 - RNA, 64 nt, Homo Sapiens
uuuguaauuaaaugccuuuuuugcuuuuuuauuuaaaagaaaauuuuuguggugauucgugcca

SEQ ID NO: 43072 - RNA, 64 nt, Homo Sapiens
gcaggacucauauuauucagucaagaguguaaauaaaagaaaugcugucauaauucuugcugag

SEQ ID NO: 43073 - RNA, 64 nt, Homo Sapiens
uguucaacaaacuuguuuaaagucauuauauuagaaaagaaaucucaguuguccauguacacau

SEQ ID NO: 43074 - RNA, 64 nt, Homo Sapiens
ggcugacuaggcaugauuuugagaauuugguuauaaaagaaaugcugcauucuuuaaaagacaa

SEQ ID NO: 43075 - RNA, 64 nt, Homo Sapiens
cgucucauucuucaauacuuuucaucaauaggaaaaaagaaauaggauagcuuuucuaauaauu

SEQ ID NO: 43076 - RNA, 64 nt, Homo Sapiens
uaaagugauugaugauaguuuuguuauuaagagcaaaagaaaaacaagagugagaaagaauaaa

SEQ ID NO: 43077 - RNA, 64 nt, Homo Sapiens
gacacauuuuauaauagaaucucaaaacuaaccuaaaagaaaauuuaguaggggcuuauugucu

SEQ ID NO: 43078 - RNA, 64 nt, Homo Sapiens
ucucacuauaguauaagaaucuauuuuggagaaaaaaagaaaauaugagggucucgaagcauga

SEQ ID NO: 43079 - RNA, 64 nt, Homo Sapiens
aagaaucaaaacaaaagcaaaaaaaaaaagcaaaaaaagaaaagagaaaaaaagaaaaaaugca

SEQ ID NO: 43080 - RNA, 64 nt, Homo Sapiens
agcaaaaaaaaaaagcaaaaaaagaaaagagaaaaaaagaaaaaaugcaaauggaauaauuuuc

SEQ ID NO: 43081 - RNA, 64 nt, Homo Sapiens
cuccagccugggugauagagcaagacugucucaaaaaagaaaaaaaagaaaaaauuuuaauuua

SEQ ID NO: 43082 - RNA, 64 nt, Homo Sapiens
gggugauagagcaagacugucucaaaaaagaaaaaaaagaaaaaauuuuaauuuaauccuucug

SEQ ID NO: 43083 - RNA, 64 nt, Homo Sapiens
aaaauuauuucagagaugugugcuccuggagggaaaaagaaauacagccucaacagauuaaaaa

SEQ ID NO: 43084 - RNA, 64 nt, Homo Sapiens
gggugacuagcaaaacuccaucucaaaaaaaaaaaaaagaaagaaagaaacugaaaagugaggu

SEQ ID NO: 43085 - RNA, 64 nt, Homo Sapiens
uaaauaaauaaauaaacaaaccagucuuuauuuuaaaagaaacuuuaggaaacaaacccacaua

SEQ ID NO: 43086 - RNA, 64 nt, Homo Sapiens
uaguuucuaguuauaucauuacuuaaagggcuuaaaaagaaaaaacuuagcaaacuuuugaauc

SEQ ID NO: 43087 - RNA, 64 nt, Homo Sapiens
uguaaaaugcaauuugaaaaaaauaaaacgcaaaaaaagaaacuguaaaggaaaccaagagauu

SEQ ID NO: 43088 - RNA, 64 nt, Homo Sapiens
cuacacuucuuuuuucccccucauguguaaaaugaaaagaaaacuaaauuugcccuaauaccaa

SEQ ID NO: 43089 - RNA, 64 nt, Homo Sapiens
ccuggcaacagagcaagagucugucucaaaaaaaaaaagaaaaaaagaaaaaaagaaaaaagaa

SEQ ID NO: 43090 - RNA, 64 nt, Homo Sapiens
cagagcaagagucugucucaaaaaaaaaaagaaaaaaagaaaaaaagaaaaaagaaaaaucuca

SEQ ID NO: 43091 - RNA, 64 nt, Homo Sapiens
gagucugucucaaaaaaaaaaagaaaaaaagaaaaaaagaaaaaagaaaaaucucauuauuuca

SEQ ID NO: 43092 - RNA, 64 nt, Homo Sapiens
ucucaaaaaaaaaaagaaaaaaagaaaaaaagaaaaaagaaaaaucucauuauuucaaaaugau

SEQ ID NO: 43093 - RNA, 64 nt, Homo Sapiens
ccugggccacagugcaagacuccaucucaaaaaaaaaagaaaagaaaaagccuguuuaaugcac

SEQ ID NO: 43094 - RNA, 64 nt, Homo Sapiens
gccacagugcaagacuccaucucaaaaaaaaaagaaaagaaaaagccuguuuaaugcacaggug

SEQ ID NO: 43095 - RNA, 64 nt, Homo Sapiens
ugaaagagcgagacuccgucucaaaaacaaaaaaaaaagaaaagaaauauauuuuauucauuca

SEQ ID NO: 43096 - RNA, 64 nt, Homo Sapiens
gagcgagacuccgucucaaaaacaaaaaaaaaagaaaagaaauauauuuuauucauucacauua

SEQ ID NO: 43097 - RNA, 64 nt, Homo Sapiens
ugauuuuagggauugugaguaaaugugaaaaaaaaaaagaaauuuaucaugaucauccaaucuc

SEQ ID NO: 43098 - RNA, 64 nt, Homo Sapiens
aaggguuugcagaggagaguuucucagagcacugaaaagaaagguuugaggcuuuucuauauac

SEQ ID NO: 43099 - RNA, 64 nt, Homo Sapiens
ugagaaggagggucucuugcccgccgaaugaagcaaaagaaacggugaagaucugguuccagaa

SEQ ID NO: 43100 - RNA, 63 nt, Homo Sapiens
cucccaaaacaggucagucccuggaugaaagucaaaagaaaccucuccagcgcagacuuuuga

SEQ ID NO: 43101 - RNA, 64 nt, Homo Sapiens
aacuauaaauacaaaucuguccuguagaugcagaaaaagaaaaaacaugcauaaaagggucaaa

SEQ ID NO: 43102 - RNA, 64 nt, Homo Sapiens
aaaagaauuaccaagagaagauaucccagcuuuaaaaagaaaaaauuuuuccuuccucuguaag

SEQ ID NO: 43103 - RNA, 64 nt, Homo Sapiens
cgguuaauaacauauaaauagucucgaaaaaaagaaaagaaacaaccuccagccuggacacucu

SEQ ID NO: 43104 - RNA, 64 nt, Homo Sapiens
aaacacgguuaauaacauauacucugucucgaaaaaaagaaaagagaucaccuccagccuggac

SEQ ID NO: 43105 - RNA, 64 nt, Homo Sapiens
auagggccaaguucaaaggaaaagaaaagaaaagaaaagaaaucgagcaaaacuccgucucaaa

SEQ ID NO: 43106 - RNA, 64 nt, Homo Sapiens
aaaucauagggccaaguucaucaaaaaagaaaagaaaagaaaagaacaagagcaaaacuccguc

SEQ ID NO: 43107 - RNA, 64 nt, Homo Sapiens
aaaagaaaucauagggccaaccgucucaaaaaagaaaagaaaagugggcaacaagagcaaaacu

SEQ ID NO: 43108 - RNA, 64 nt, Homo Sapiens
aaaagaaaagaaaucauaggaaacuccgucucaaaaaagaaaagcagccugggcaacaagagca

SEQ ID NO: 43109 - RNA, 64 nt, Homo Sapiens
ccaguguuagcuuaaucuuaaaaagggggggagcaaaagaaacacaguuauauauuuuguuuuu

SEQ ID NO: 43110 - RNA, 64 nt, Homo Sapiens
uuaaagaggaauggcccucaaggguuuucagaugaaaagaaaacuuaacuuauugcuagauaau

SEQ ID NO: 43111 - RNA, 64 nt, Homo Sapiens
uuuuuuucaaaaaugcuguuacucugcugaauguaaaagaaaauagaaauucuucaugaacaua

SEQ ID NO: 43112 - RNA, 64 nt, Homo Sapiens
ucaaaguagaaacuacuaaugugugaaaucaucaaaaagaaaaaguauuagacuucuaaauaag

SEQ ID NO: 43113 - RNA, 64 nt, Homo Sapiens
gaaaaggaagacagcauuuaacagaauggcuaucaaaagaaauaaaaagucauaaaugcauaug

SEQ ID NO: 43114 - RNA, 64 nt, Homo Sapiens
uagucuuguaguaugaaauaaauucugcuauuuuaaaagaaauggcaaucaauuuugaauuuau

SEQ ID NO: 43115 - RNA, 64 nt, Homo Sapiens
uauaguuaaugguuucaaauccuuaaaauaaugaaaaagaaaagugacuauuuuaucaaauuug

SEQ ID NO: 43116 - RNA, 64 nt, Homo Sapiens
aauugcaaaggaccaaaaaaguuucuucaaccaaaaaagaaagaaaaccugguuuucuuuuuug

SEQ ID NO: 43117 - RNA, 64 nt, Homo Sapiens
uuaaaaaaauccuacuaacacuuauuugcaauucaaaagaaauuauuugaucaggucucuggau

SEQ ID NO: 43118 - RNA, 64 nt, Homo Sapiens
ccucuccuuagcugagcagaugagacccugucucaaaagaaagccuccagccugggcgacaaaa

SEQ ID NO: 43119 - RNA, 64 nt, Homo Sapiens
gccgggugaggugguguguaaaaaaaaaaaagaaaaaagaaaaaugaccucccgucucucucgg

SEQ ID NO: 43120 - RNA, 64 nt, Homo Sapiens
agaaaaagccgggugaggugcucucggaaaaaaaaaaagaaaaaaacauggugaccucccgucu

SEQ ID NO: 43121 - RNA, 64 nt, Homo Sapiens
aaaaauuaaauuaaaaaaaacucacagaaaaagaaaaagaaaauguuucaauacaagccauagg

SEQ ID NO: 43122 - RNA, 64 nt, Homo Sapiens
gaaaauaaaaauuaaauuaacauaggcucacagaaaaagaaaaaccuaaaguuucaauacaagc

SEQ ID NO: 43123 - RNA, 64 nt, Homo Sapiens
uuuuguaguagcguuuuuuagcaaaaacaaaaagaaaagaaaauuauagcuaaguacacaauaa

SEQ ID NO: 43124 - RNA, 64 nt, Homo Sapiens
aaaauuuuuguaguagcguuaauaagcaaaaacaaaaagaaaaguuaucuauagcuaaguacac

SEQ ID NO: 43125 - RNA, 64 nt, Homo Sapiens
ucuacguaugcaugcuaaauuguauuuauauauaaaaagaaacgcugucuuuauuuuuguauau

SEQ ID NO: 43126 - RNA, 64 nt, Homo Sapiens
aggguuuaugcuuacgucucgcagaguauuuggaaaaagaaaaagccucuggagccgccauucu

SEQ ID NO: 43127 - RNA, 64 nt, Homo Sapiens
uugucucagaucccagauucuaugaucccugcuuaaaagaaaauguucacugcauguagguuga

SEQ ID NO: 43128 - RNA, 64 nt, Homo Sapiens
aaaaauauaauuaccuguaagguuaucugguuuuaaaagaaaaaaaaaaagccuacaaacucag

SEQ ID NO: 43129 - RNA, 64 nt, Homo Sapiens
uugcccaguuuuuaauuacacugagauaauuuugaaaagaaauagaaauuaagcuacuauauaa

SEQ ID NO: 43130 - RNA, 64 nt, Homo Sapiens
aaaaugugaauaaauaaauguucugauaaaauagaaaagaaaguaaauuacagugauuuccauc

SEQ ID NO: 43131 - RNA, 64 nt, Homo Sapiens
gcaaguuucccuaaguuugaguugauaguuauuaaaaagaaaacaaaacaaaaaaaaaaggcaa

SEQ ID NO: 43132 - RNA, 64 nt, Homo Sapiens
aaacuggguauauuuaugauuucuuucagcguuaaaaagaaacauaguguugcccuuuuucuua

SEQ ID NO: 43133 - RNA, 61 nt, Homo Sapiens
uucauguacuacaaaaauagcuaucugaggcaaaagaaacacaauuacaguuagcuccuca

SEQ ID NO: 43134 - RNA, 64 nt, Homo Sapiens
cuagacacaauaaaacaucagaaccagcuaagggaaaagaaauaucuggaguacauuaaaagug

SEQ ID NO: 43135 - RNA, 64 nt, Homo Sapiens
gggcaacaagagugaaacuccaucuccaaaaaaaaaaagaaaaaguaacaaaaggaaauuauuu

SEQ ID NO: 43136 - RNA, 64 nt, Homo Sapiens
aguucaacuuuguggauuauuuuuccucugaaggaaaagaaaaggcuuaaugguuaggauuuuu

SEQ ID NO: 43137 - RNA, 64 nt, Homo Sapiens
uggaaugcauuuguuuccaugagugaaaagaggaaaaagaaaauggcugugcugcauugcagga

SEQ ID NO: 43138 - RNA, 64 nt, Homo Sapiens
guuuaaauaucucuggcucaaguguucacccaguaaaagaaagauccagaaagcacuguuuuua

SEQ ID NO: 43139 - RNA, 64 nt, Homo Sapiens
aauuuaugagaauuuuggacaauuggaaagguagaaaagaaaagccaagaucauacuaaggacu

SEQ ID NO: 43140 - RNA, 64 nt, Homo Sapiens
auaaaaccuacugcaacuuagaaaaaggaaagaaaaaagaaaacuuuuccaacugcugcauuaa

SEQ ID NO: 43141 - RNA, 64 nt, Homo Sapiens
agaugacacaucauuuugacauuaucaauaggagaaaagaaaacuaacccuucuucugauuguu

SEQ ID NO: 43142 - RNA, 64 nt, Homo Sapiens
auaguagaaaaggaaacuaguagggccaaaaaaaaaaagaaaaagaaaaagaaaaaagaaaaaa

SEQ ID NO: 43143 - RNA, 64 nt, Homo Sapiens
gaaaaggaaacuaguagggccaaaaaaaaaaagaaaaagaaaaagaaaaaagaaaaaaaaagaa

SEQ ID NO: 43144 - RNA, 64 nt, Homo Sapiens
gaaacuaguagggccaaaaaaaaaaagaaaaagaaaaagaaaaaagaaaaaaaaagaaaaaacu

SEQ ID NO: 43145 - RNA, 64 nt, Homo Sapiens
guagggccaaaaaaaaaaagaaaaagaaaaagaaaaaagaaaaaaaaagaaaaaacugggaccu

SEQ ID NO: 43146 - RNA, 64 nt, Homo Sapiens
aaaaaaaaagaaaaagaaaaagaaaaaagaaaaaaaaagaaaaaacugggaccuaaguauaaau

SEQ ID NO: 43147 - RNA, 64 nt, Homo Sapiens
auuaucaaaaaccuagagaccaaucauauaucugaaaagaaauacccauuaaaaauucugccuc

SEQ ID NO: 43148 - RNA, 64 nt, Homo Sapiens
gcuacuuaaaacuuugguuguuuuccuguaauauaaaagaaaaaguuaauuuaucaauugauug

SEQ ID NO: 43149 - RNA, 64 nt, Homo Sapiens
uuaauugaacccauccacucugggcagguaagagaaaagaaaaagauaaggaaagaagagagaa

SEQ ID NO: 43150 - RNA, 64 nt, Homo Sapiens
gaucacuacagaccaaaacagaagaagaagaaaaaaaagaaaaagaaaucuaagcaacauggua

SEQ ID NO: 43151 - RNA, 64 nt, Homo Sapiens
uacagaccaaaacagaagaagaagaaaaaaaagaaaaagaaaucuaagcaacaugguaaguaca

SEQ ID NO: 43152 - RNA, 64 nt, Homo Sapiens
aaaaaaauagcucaagacacaguuaaucgagaagaaaagaaauauguacagaaccauaaagaac

SEQ ID NO: 43153 - RNA, 64 nt, Homo Sapiens
aaaaaaguuuuuuaccuuacguuaucuccacuccaaaagaaaaacauaggguggagaaggagga

SEQ ID NO: 43154 - RNA, 64 nt, Homo Sapiens
cuuucuuuuguuuuuuacacuguaaguaaaaacaaaaagaaaaccaaagauauucucuauguuu

SEQ ID NO: 43155 - RNA, 64 nt, Homo Sapiens
gacacuuucugcuuuacagacugaacacuggaggaaaagaaaauguauuuucgaagaggagcaa

SEQ ID NO: 43156 - RNA, 64 nt, Homo Sapiens
auaaauaucgugucauauuuauggaccagaaaagaaaagaaaccaguacauuaaguaaaauaaa

SEQ ID NO: 43157 - RNA, 64 nt, Homo Sapiens
aaaccauaaauaucgugucaauaaaauggaccagaaaagaaaaguagugaguacauuaaguaaa

SEQ ID NO: 43158 - RNA, 64 nt, Homo Sapiens
aagagggaaaaagagcugguaaaaaaagaaaaaaaaaagaaagaguaggaucguaaaaaaauag

SEQ ID NO: 43159 - RNA, 64 nt, Homo Sapiens
aaaaagaaagaaagagggaauaaaaaaauagaaaaaaagaaaaaggaccaucucuguaggaucg

SEQ ID NO: 43160 - RNA, 64 nt, Homo Sapiens
gacagcaucucacuauguuguuuaaaaaaaaaagaaaagaaaaagaauuagguuugaauugcuu

SEQ ID NO: 43161 - RNA, 64 nt, Homo Sapiens
aaaaagacagcaucucacuaugcuuuuuaaaaaaaaaagaaaaggggaagaauuagguuugaau

SEQ ID NO: 43162 - RNA, 64 nt, Homo Sapiens
uucgaaggugugguuuucaugaauuucauuuuuuaaaagaaaucugucguuguuguaguuaaag

SEQ ID NO: 43163 - RNA, 64 nt, Homo Sapiens
aagaaaagguacauguauauacucugucucaaaaaaaagaaagacagccugggcaacgggcgag

SEQ ID NO: 43164 - RNA, 64 nt, Homo Sapiens
aagaagccccuucacucuaccuuaaaaaaaacuaaaaagaaaaacaauuuuuuuaagacucugu

SEQ ID NO: 43165 - RNA, 64 nt, Homo Sapiens
acaucaucaauaaaacuguuaaacaaauguaaauaaaagaaaacuucaauaccaaauacaguaa

SEQ ID NO: 43166 - RNA, 64 nt, Homo Sapiens
gcuagcagauuuacuccuuugcuuucacauuaaaaaaagaaaaaucugccugagggcuugcaua

SEQ ID NO: 43167 - RNA, 64 nt, Homo Sapiens
ggaaagccauccaaauuugaaguaaccagauagcaaaagaaaaggcaucuaaaaaugaaaggug

SEQ ID NO: 43168 - RNA, 64 nt, Homo Sapiens
aguauuaagggaagcgcaaaucauugaucagacaaaaagaaacuaaaaacaaauuggcuuuguc

SEQ ID NO: 43169 - RNA, 64 nt, Homo Sapiens
gaaaaauuaguaaagaaaaagauuauucucuuguaaaagaaaaguuuuguaguauaauauuaau

SEQ ID NO: 43170 - RNA, 64 nt, Homo Sapiens
augguagcaguagagaauuucaaagugugguagaaaaagaaauaucuugcagaaaaguugauug

SEQ ID NO: 43171 - RNA, 64 nt, Homo Sapiens
aggggaagaaagauaucuauaaaguaauuacuuaaaaagaaaucgaaacuaaauggucuuuaua

SEQ ID NO: 43172 - RNA, 64 nt, Homo Sapiens
acaaaaugcuagugaaaaugguugcaucucaaggaaaagaaacauggccggacgaaacacacgu

SEQ ID NO: 43173 - RNA, 64 nt, Homo Sapiens
aaauauuugaaaaaaggcauauaugucuuauaauaaaagaaauaaaauaugcaaguuuuuaccu

SEQ ID NO: 43174 - RNA, 64 nt, Homo Sapiens
auguggaccuugcuggaaacuccaucaaacugugaaaagaaaugagaaucgugacuauuauugc

SEQ ID NO: 43175 - RNA, 64 nt, Homo Sapiens
uaagaaaucauucagaucaucaugcuacacucucaaaagaaaauauuuuauuccugggggggau

SEQ ID NO: 43176 - RNA, 64 nt, Homo Sapiens
augcagggugauuucuuauucuaguuuuaguuuaaaaagaaaaauuuguaacuuuacaguuaaa

SEQ ID NO: 43177 - RNA, 64 nt, Homo Sapiens
augauauuuacuguuuuguuaauaaaauaauaaaaaaagaaagcaacucauauuacaaaaacaa

SEQ ID NO: 43178 - RNA, 64 nt, Homo Sapiens
uaaucauagucaccugacuagggaaauauauacaaaaagaaaauggcaaaacuauuauauguaa

SEQ ID NO: 43179 - RNA, 64 nt, Homo Sapiens
cuuugaagucuauaaaaaauguuccagugucuauaaaagaaacaaugcuuaccagauucacacu

SEQ ID NO: 43180 - RNA, 64 nt, Homo Sapiens
aacauaaucaaguaaggaugauacaguuuucagaaaaagaaaugcuccauuacucugauuuuug

SEQ ID NO: 43181 - RNA, 64 nt, Homo Sapiens
gacaugguaauuuggauaggaauucugaagaaggaaaagaaacuuuauuaaacugcaggaaauu

SEQ ID NO: 43182 - RNA, 64 nt, Homo Sapiens
gaacuuaauguugugccaaaaggauccaauacccaaaagaaaugggcauacacacucaaaaagc

SEQ ID NO: 43183 - RNA, 64 nt, Homo Sapiens
gccuuucuucuuaaagugaggaggacaaauuugcaaaagaaauaggcuuuucuucuuuuuuaaa

SEQ ID NO: 43184 - RNA, 63 nt, Homo Sapiens
uuuuaaauauucuaguagccacauuaauaaaguaaaaagaaacaggugagguuaauuugaaug

SEQ ID NO: 43185 - RNA, 64 nt, Homo Sapiens
aucucuguucaucccuuccuauaaccucuagguaaaaagaaaagaaaaaaagaaauuucgagau

SEQ ID NO: 43186 - RNA, 64 nt, Homo Sapiens
uguucaucccuuccuauaaccucuagguaaaaagaaaagaaaaaaagaaauuucgagauauuuu

SEQ ID NO: 43187 - RNA, 64 nt, Homo Sapiens
ccuuccuauaaccucuagguaaaaagaaaagaaaaaaagaaauuucgagauauuuucaacauug

SEQ ID NO: 43188 - RNA, 64 nt, Homo Sapiens
ccuacuuucaaguaaauauagcauuccuuuggcaaaaagaaaaaaaaaguaaaagaaaagaaaa

SEQ ID NO: 43189 - RNA, 64 nt, Homo Sapiens
uauagcauuccuuuggcaaaaagaaaaaaaaaguaaaagaaaagaaaaaaaauguauuaccacc

SEQ ID NO: 43190 - RNA, 64 nt, Homo Sapiens
cauuccuuuggcaaaaagaaaaaaaaaguaaaagaaaagaaaaaaaauguauuaccacccgaug

SEQ ID NO: 43191 - RNA, 64 nt, Homo Sapiens
cucagguauuuguaguuuacccuaacgcuucuuuaaaagaaaguagguaaaaaaagaaaagggu

SEQ ID NO: 43192 - RNA, 64 nt, Homo Sapiens
uacccuaacgcuucuuuaaaagaaaguagguaaaaaaagaaaaggguagauaaucuuucguaug

SEQ ID NO: 43193 - RNA, 64 nt, Homo Sapiens
uaccauuaaagucauuaguauaauauugcuuucaaaaagaaaugguagacaaaacuauaaucca

SEQ ID NO: 43194 - RNA, 64 nt, Homo Sapiens
gaaaauauacaaucaagauaucucauggcauauuaaaagaaaaaucuuaauagcaguguuggcu

SEQ ID NO: 43195 - RNA, 64 nt, Homo Sapiens
uaucugcuucuuaaagaaucagccgagacaccauaaaagaaauaggcuuuuugugccuuuugcu

SEQ ID NO: 43196 - RNA, 64 nt, Homo Sapiens
ccugggugacaagagugaaacuccaucucaaaaaaaaagaaaagaagguccagcuuuuggauuc

SEQ ID NO: 43197 - RNA, 64 nt, Homo Sapiens
gcccgggugacaaagcaagacccugucucagaaaaaaagaaaauucaaggccaguuaagacaaa

SEQ ID NO: 43198 - RNA, 64 nt, Homo Sapiens
uguauggaaucaacaccaccgagcucugugggaaaaaagaaaaaccugcucccuucgcucugcu

SEQ ID NO: 43199 - RNA, 64 nt, Homo Sapiens
ccaacauguaucugucuacuuucucuuguuuaaaaaaagaaaaaaaaacuuaaaaaaauggggu

SEQ ID NO: 43200 - RNA, 64 nt, Homo Sapiens
cuuaacagaggcaagugcaaaauauuuuccccacaaaagaaacagcaacaguaaaaauuaauau

SEQ ID NO: 43201 - RNA, 64 nt, Homo Sapiens
aggaaaaaaacaguuugaacaaaaaaaaaggaaaaaaagaaaaaucuuaaaaaaagaaaaaaug

SEQ ID NO: 43202 - RNA, 64 nt, Homo Sapiens
augaaaaaaaaaggaaaaaauuugaaaucuuaaaaaaagaaaaauuuuccaguguguaacccag

SEQ ID NO: 43203 - RNA, 64 nt, Homo Sapiens
caacaauaguuuaagaaauuaagcaacugagggaaaaagaaacaccuuuccuucaagcagaaac

SEQ ID NO: 43204 - RNA, 64 nt, Homo Sapiens
auaucaaacacuauguuaaaaguauuugcaguacaaaagaaacuuacggggaggaaagaccaaa

SEQ ID NO: 43205 - RNA, 64 nt, Homo Sapiens
cucugaacugggucggucugacccuuauccuuuaaaaagaaauccacucauuuccaaggcccua

SEQ ID NO: 43206 - RNA, 64 nt, Homo Sapiens
acaauuagucacucaacauagcacaaguuuccagaaaagaaaauaacacaaaacugccaacuuu

SEQ ID NO: 43207 - RNA, 64 nt, Homo Sapiens
aacauggucuuguuuuuacuugcacauuuuuaaaaaaagaaaaauucauuuauguuagcauuaa

SEQ ID NO: 43208 - RNA, 64 nt, Homo Sapiens
aaaaggaacuucuuauaguugggaaaaaaaagaaaaaagaaacauguugccugcaaaaauaaaa

SEQ ID NO: 43209 - RNA, 64 nt, Homo Sapiens
agaaacaaaaaggaacuucuaauaaaagggaaaaaaaagaaaaaccaugacuguugccugcaaa

SEQ ID NO: 43210 - RNA, 64 nt, Homo Sapiens
aaccaaaguacuuuugguguagcaaauuauuuuuaaaagaaaaauccuguggcaugcaaaagaa

SEQ ID NO: 43211 - RNA, 64 nt, Homo Sapiens
aaauuauuuuuaaaagaaaaguccuguggcaugcaaaagaaagcuguuuugaaacuagaaaucu

SEQ ID NO: 43212 - RNA, 64 nt, Homo Sapiens
accacugggaaaaucuuuuuuaaaaacagaaaggaaaagaaauuacaacacugauaauaggaag

SEQ ID NO: 43213 - RNA, 64 nt, Homo Sapiens
acuuuauucacagaguccagauuaaaauauuuauaaaagaaacauggagugaggauuacuugua

SEQ ID NO: 43214 - RNA, 64 nt, Homo Sapiens
aaaguuguuuuaucuaauacauugcagguguuuaaaaagaaagaaacugaauuuuugaaagacu

SEQ ID NO: 43215 - RNA, 64 nt, Homo Sapiens
aaccaacagaauuuuaacucuguuuugcaaaagaaaaagaaaagcugaaggagaaggaggguag

SEQ ID NO: 43216 - RNA, 64 nt, Homo Sapiens
gaaaagaaccaacagaauuuggguaguguuuugcaaaagaaaaacagaugcugaaggagaagga

SEQ ID NO: 43217 - RNA, 64 nt, Homo Sapiens
guauuagauuuuggucuccagguguuuaucauaaaaaagaaacacacacugagauauaauaaaa

SEQ ID NO: 43218 - RNA, 64 nt, Homo Sapiens
uagaaucuaaugcagaagagaguuuugaaaccaaaaaagaaaccuuuuuauggauuguagaccc

SEQ ID NO: 43219 - RNA, 64 nt, Homo Sapiens
ggagcuggucacacagggccuuggggaagcuagaaaaagaaauguuuuaguaaggcauuugggg

SEQ ID NO: 43220 - RNA, 64 nt, Homo Sapiens
gaaaaguauuauuaagcuuccuuaugaaacaagaaaaagaaaauaacauuuggcaggaauuguc

SEQ ID NO: 43221 - RNA, 64 nt, Homo Sapiens
aaauuuuguaugucaauaacuucauuaaaaggaaaaaagaaaaagauuucuaaguuaaaucauu

SEQ ID NO: 43222 - RNA, 64 nt, Homo Sapiens
aaugauuguuuuagaaguuauaacccacugcugaaaaagaaaaauaaauuuacagaauauuaua

SEQ ID NO: 43223 - RNA, 64 nt, Homo Sapiens
uaugagagaacuauuguuugaacugucuugagagaaaagaaaaauuucacuaauacuuacuguu

SEQ ID NO: 43224 - RNA, 64 nt, Homo Sapiens
uacauaucacuaugacugaaguagaagaacuaaaaaaagaaaguucauuuguauucagauguga

SEQ ID NO: 43225 - RNA, 64 nt, Homo Sapiens
ugggaaaacgggauuccuuuuugauaagucuaggaaaagaaagacuauguaguugagacaggau

SEQ ID NO: 43226 - RNA, 64 nt, Homo Sapiens
aaguuuuguuuugaaagaugaaaaauguaaauacaaaagaaaucuuuugcuaagacuugaaaca

SEQ ID NO: 43227 - RNA, 64 nt, Homo Sapiens
aggcuggguuuacuauugcaccuuacuguauagaaaaagaaaaacauuacaggcugcauucuug

SEQ ID NO: 43228 - RNA, 64 nt, Homo Sapiens
acucuguuguaaaaacaguugguuuaauuaaaaaaaaagaaaaagucuucuguacaucuuacug

SEQ ID NO: 43229 - RNA, 64 nt, Homo Sapiens
gaaaugcaagagggaaggugauugguagugaguuaaaagaaaaagagaggaaaagagaguaguu

SEQ ID NO: 43230 - RNA, 64 nt, Homo Sapiens
ccuugguuugcaauaccugcaaauaaugaguuugaaaagaaacaaugaaauguguuaaaaauuu

SEQ ID NO: 43231 - RNA, 64 nt, Homo Sapiens
uuuccuuucacuggccacaguuguuugaugcauuaaaagaaaauaaaaaaaagaaaaaagagaa

SEQ ID NO: 43232 - RNA, 64 nt, Homo Sapiens
ccacaguuguuugaugcauuaaaagaaaauaaaaaaaagaaaaaagagaaaagaaaaaaaaaga

SEQ ID NO: 43233 - RNA, 64 nt, Homo Sapiens
ugcauuaaaagaaaauaaaaaaaagaaaaaagagaaaagaaaaaaaaagaaaaaaguuguaggc

SEQ ID NO: 43234 - RNA, 64 nt, Homo Sapiens
gaaaauaaaaaaaagaaaaaagagaaaagaaaaaaaaagaaaaaaguuguaggcgaaucauuug

SEQ ID NO: 43235 - RNA, 64 nt, Homo Sapiens
cuugaaggugugaugguagaaauaggaaaacaacaaaagaaaaacaauaacaaaaaaagaaagu

SEQ ID NO: 43236 - RNA, 64 nt, Homo Sapiens
aauaggaaaacaacaaaagaaaaacaauaacaaaaaaagaaagugugauggcugggugcagugg

SEQ ID NO: 43237 - RNA, 64 nt, Homo Sapiens
aaauaaauaaauagaaagagagagagaggaaaaaaaaagaaaagaacacuucuuuauuugaggg

SEQ ID NO: 43238 - RNA, 64 nt, Homo Sapiens
aguaccugaucaggaucugggagaauuugaaaaaaaaagaaaaacuagaaaaauaaacaaaauu

SEQ ID NO: 43239 - RNA, 64 nt, Homo Sapiens
aaaaaaagaaaaacuagaaaaauaaacaaaauuaaaaagaaaaaaaaauaccugagacugagua

SEQ ID NO: 43240 - RNA, 64 nt, Homo Sapiens
gccuggaagacagagugagaccccaucucaggaaaaaagaaaaaaaaaaagaugucauucagca

SEQ ID NO: 43241 - RNA, 64 nt, Homo Sapiens
aguuaaaucuaagaccucaaacuaugaaacagcuaaaagaaaacaucggggaaucucuccagga

SEQ ID NO: 43242 - RNA, 64 nt, Homo Sapiens
ucaaagaagaagaaaaacaccaaaaccacaagggaaaagaaaaacccaguuucuuaggaaacgc

SEQ ID NO: 43243 - RNA, 64 nt, Homo Sapiens
ccagauuauuuggauaaguccuuuuuaagaaaaaaaaagaaaaugaaaaacaacacaaaaaaaa

SEQ ID NO: 43244 - RNA, 64 nt, Homo Sapiens
aaugaucauuucuucuuaaggcucaagauauuagaaaagaaaucagaccuaaauaaucauugau

SEQ ID NO: 43245 - RNA, 64 nt, Homo Sapiens
ccuuuuuuuagaguuucuaauaaaguaguauguaaaaagaaacugcauuuuaagucagacagua

SEQ ID NO: 43246 - RNA, 64 nt, Homo Sapiens
cagcuuuuuaauguagguuaccacuuauaagcacaaaagaaacauguauaagaaaccagauuua

SEQ ID NO: 43247 - RNA, 64 nt, Homo Sapiens
cagagcgagacucugucuccccccgcaaaaaaaaaaaagaaagaaagaaagagaaaagaaaaga

SEQ ID NO: 43248 - RNA, 64 nt, Homo Sapiens
cccccgcaaaaaaaaaaaagaaagaaagaaagagaaaagaaaagaaaagcaaccacagccagcc

SEQ ID NO: 43249 - RNA, 64 nt, Homo Sapiens
gcaaaaaaaaaaaagaaagaaagaaagagaaaagaaaagaaaagcaaccacagccagccuuagg

SEQ ID NO: 43250 - RNA, 64 nt, Homo Sapiens
gagacugaucauuccucuggguuaucugcaucucaaaagaaaaugcuuacccacaggaacuguu

SEQ ID NO: 43251 - RNA, 64 nt, Homo Sapiens
uuuauuuccuaagaaauaauuuaauguuuaguaaaaaagaaaacagaaaaaagaaagaugcgug

SEQ ID NO: 43252 - RNA, 64 nt, Homo Sapiens
aauaauuuaauguuuaguaaaaaagaaaacagaaaaaagaaagaugcguguguuggcuuacgca

SEQ ID NO: 43253 - RNA, 64 nt, Homo Sapiens
acacauuuucuucaucugcacugauuauuucagcaaaagaaaucuaguauguuuucauacaucu

SEQ ID NO: 43254 - RNA, 64 nt, Homo Sapiens
cgaucuaaaucuauaccuagugcagauuugcaaaaaaagaaaaggaauagucauuaaggauacc

SEQ ID NO: 43255 - RNA, 64 nt, Homo Sapiens
aagugcauaagucuccugggcacacuauaacaagaaaagaaaugcagucacucacugccauucu

SEQ ID NO: 43256 - RNA, 64 nt, Homo Sapiens
aacacucaacaauaaagacuuuuuucaacuuggaaaaagaaagaagagacacugcuuggguucc

SEQ ID NO: 43257 - RNA, 64 nt, Homo Sapiens
ugcuuuuaauuuauucuuuuguugcagaauuaaaaaaagaaaucagauguacguuguagacaaa

SEQ ID NO: 43258 - RNA, 64 nt, Homo Sapiens
gccuguuucagccagaagacuucuucggaugcguaaaagaaauugauauaaagccccuauugga

SEQ ID NO: 43259 - RNA, 64 nt, Homo Sapiens
agugcuuuuauuugacuuguaaagguuccuaaggaaaagaaagcagguuaauauaaagaguauc

SEQ ID NO: 43260 - RNA, 64 nt, Homo Sapiens
aauguucaaaugagagagcuacucagcaggauauaaaagaaaaauuguccccccaggcaucuuc

SEQ ID NO: 43261 - RNA, 64 nt, Homo Sapiens
aaggucuaaaggaaaguagcguauugcuuggcagaaaagaaaaucauaauggccagaaaauauu

SEQ ID NO: 43262 - RNA, 64 nt, Homo Sapiens
gggauaucuuuuuuauauuugcuuuuagguuuguaaaagaaaaacccagagcuucauucuccug

SEQ ID NO: 43263 - RNA, 64 nt, Homo Sapiens
cacccacauuuuaauuuagcugcaaaaagaaaagaaaagaaaacuaauggcaugauuuuuuuua

SEQ ID NO: 43264 - RNA, 64 nt, Homo Sapiens
aaaaccacccacauuuuaauuuuuaugcaaaaagaaaagaaaagcacauuaauggcaugauuuu

SEQ ID NO: 43265 - RNA, 64 nt, Homo Sapiens
aaaagaaaaccacccacauuauuuuuuuuaugcaaaaagaaaaguuccacacauuaauggcaug

SEQ ID NO: 43266 - RNA, 64 nt, Homo Sapiens
gauucuauuuuuuaaagaaaacugugguugauucaaaagaaaguaaagaaaaacacgucucacc

SEQ ID NO: 43267 - RNA, 64 nt, Homo Sapiens
cacgucucaccacugugguuucauggggcaccugaaaagaaaaaccggguaaagcuguaugcca

SEQ ID NO: 43268 - RNA, 64 nt, Homo Sapiens
auuacauaauuuggcuagagugacagagaaaagaaaaagaaaacccacuacaguccagccuggg

SEQ ID NO: 43269 - RNA, 64 nt, Homo Sapiens
gaaaacauuacauaauuuggccugggugacagagaaaagaaaaaauuguuccacuacaguccag

SEQ ID NO: 43270 - RNA, 64 nt, Homo Sapiens
aggcauaaaucuuuauugcauagaaaaaaaaaagaaaagaaaaauguacuguuuguauaaaaaa

SEQ ID NO: 43271 - RNA, 64 nt, Homo Sapiens
aaaaaaggcauaaaucuuuaaaaaauagaaaaaaaaaagaaaagcuguuuguacuguuuguaua

SEQ ID NO: 43272 - RNA, 64 nt, Homo Sapiens
gagggguuuuuuuaaccucaaggacuugcaaaacaaaagaaaguuugcuguggacagaccugua

SEQ ID NO: 43273 - RNA, 64 nt, Homo Sapiens
gaggaagaagcagcuuugcuaaaaaaaaaaaagaaaaagaaaaaugggcuuuuuuuuccucuca

SEQ ID NO: 43274 - RNA, 64 nt, Homo Sapiens
gaaaaagaggaagaagcagccucucaaaaaaaaaaaaagaaaaauuccagugggcuuuuuuuuc

SEQ ID NO: 43275 - RNA, 64 nt, Homo Sapiens
auagagaugaauuguggugugccauguacuuuggaaaagaaagcugcaaaguaauucaaaccug

SEQ ID NO: 43276 - RNA, 64 nt, Homo Sapiens
ccuaccuauguaaauguuuggagaaucaaagcacaaaagaaaucgaaguauuuccauaguugcu

SEQ ID NO: 43277 - RNA, 64 nt, Homo Sapiens
gugucauauuggugugcugucuuucuccuguuugaaaagaaauucauaugaugacacacagugu

SEQ ID NO: 43278 - RNA, 64 nt, Homo Sapiens
gggagaaaaccucuuagcaauuguuucagagcagaaaagaaaaaugcacaaagcaaccgccaaa

SEQ ID NO: 43279 - RNA, 64 nt, Homo Sapiens
acaaaauccuagcuugggauuaacuuuuuggaacaaaagaaaacaaggaagggagaagguggca

SEQ ID NO: 43280 - RNA, 64 nt, Homo Sapiens
uuaucuauucuaaacuaauaaucaauagauggacaaaagaaacaacaaccccaggagaugggac

SEQ ID NO: 43281 - RNA, 64 nt, Homo Sapiens
ggagaugggaccugaucaugcaaccuggcacuggaaaagaaaucagcgggauuuuggggguggg

SEQ ID NO: 43282 - RNA, 64 nt, Homo Sapiens
auacugcauggcaggagagcuuuacgcuaaagacaaaagaaacagcuuugggggccgggcgugg

SEQ ID NO: 43283 - RNA, 64 nt, Homo Sapiens
ucuuauuuaucuuccugcaaacaaggguuaccugaaaagaaaaaaaaagucaacauugucaagc

SEQ ID NO: 43284 - RNA, 64 nt, Homo Sapiens
auaaauaaaacaaacuuaaucuucaucuuuaaaaaaaagaaaaaagaaaccaaaaugagaauca

SEQ ID NO: 43285 - RNA, 64 nt, Homo Sapiens
aaacaaacuuaaucuucaucuuuaaaaaaaagaaaaaagaaaccaaaaugagaaucaacacuuc

SEQ ID NO: 43286 - RNA, 64 nt, Homo Sapiens
gauuuucuguaguaaaacuuuuaaauauuauuuuaaaagaaauauguauauaaauaucucuaua

SEQ ID NO: 43287 - RNA, 64 nt, Homo Sapiens
ugcauuaauuuuguguguuuagaguucuguugucaaaagaaaacuaaugaauaaauuaguuugu

SEQ ID NO: 43288 - RNA, 63 nt, Homo Sapiens
aggcagaugaagaggaauagcgacaguuugaguaaaagaaaagucauauugaagaagcccaga

SEQ ID NO: 43289 - RNA, 64 nt, Homo Sapiens
aauaccaaaacuaaccucaucaaagauacagaaaaaaagaaauauagugagcccuaaaggacac

SEQ ID NO: 43290 - RNA, 64 nt, Homo Sapiens
aaagacucauuuguguggaugcgugaccaugggaaaaagaaaaaaaaaaagauccauuuuuuag

SEQ ID NO: 43291 - RNA, 64 nt, Homo Sapiens
uucacauuggaugacaccauguucuuccucuuugaaaagaaaaggggaaugugucccacuagug

SEQ ID NO: 43292 - RNA, 64 nt, Homo Sapiens
aaugcaugaauauaaaucuauauuauuugcuaaaaaaagaaaaaacauuuguguuuuaguuucu

SEQ ID NO: 43293 - RNA, 64 nt, Homo Sapiens
cucugauacuuuugaaacagaugugaaaaacagaaaaagaaaaaauugucugaaauguuuauuu

SEQ ID NO: 43294 - RNA, 64 nt, Homo Sapiens
aaaauugauagcauuuagcauuucuuuuuucucaaaaagaaacuguaggaaauacaugacagag

SEQ ID NO: 43295 - RNA, 64 nt, Homo Sapiens
uucccaaaaaauucuuaucucuguaugugauuggaaaagaaaagaucacauuuguauauucaac

SEQ ID NO: 43296 - RNA, 64 nt, Homo Sapiens
acagagcaagacuccaucucaaaaauaaaauaaaaaaagaaagaaagaaaagaagaagaaaaga

SEQ ID NO: 43297 - RNA, 64 nt, Homo Sapiens
ccaacauggcaaaaccccgucucuacaaaaauacaaaagaaauuagccagacaugauggcgggu

SEQ ID NO: 43298 - RNA, 64 nt, Homo Sapiens
agcucugaguuuucagcaccaguagauuuguauuaaaagaaaaaaaaauggggccuuagcuucu

SEQ ID NO: 43299 - RNA, 64 nt, Homo Sapiens
aacaaauagccaucugcuaucagcaucauuauguaaaagaaaauauauuuuagccccuaaaauu

SEQ ID NO: 43300 - RNA, 64 nt, Homo Sapiens
cugggggacuggacgcugcuauugauucauuaaaaaaagaaaagaaaaauacaccaaggcucca

SEQ ID NO: 43301 - RNA, 64 nt, Homo Sapiens
ggacuggacgcugcuauugauucauuaaaaaaagaaaagaaaaauacaccaaggcuccauguuc

SEQ ID NO: 43302 - RNA, 64 nt, Homo Sapiens
ucacaggggaauguacuuuuuuaaaaaaaaaugaaaaagaaaaaaaaagcugcacauuuacagu

SEQ ID NO: 43303 - RNA, 64 nt, Homo Sapiens
acuuacuaaaaaauguuucauugcgaagcagaggaaaagaaacguuuucagaccuaaaggaaau

SEQ ID NO: 43304 - RNA, 64 nt, Homo Sapiens
cauaugcuauauacagcuuaacucacagaacuguaaaagaaaauuauaaaauaauucaacaugu

SEQ ID NO: 43305 - RNA, 64 nt, Homo Sapiens
aauaauucaacauguccaucuuuuuagugauaauaaaagaaagcaugguauuaaacuaucauag

SEQ ID NO: 43306 - RNA, 64 nt, Homo Sapiens
agcaugguauuaaacuaucauagaaguagacagaaaaagaaaaaaggacucauggcauuauuaa

SEQ ID NO: 43307 - RNA, 64 nt, Homo Sapiens
aauauggcaagagcccaacucuacuaaaaauacaaaaagaaaagaaaacagccaagcuuggugg

SEQ ID NO: 43308 - RNA, 64 nt, Homo Sapiens
ggcaagagcccaacucuacuaaaaauacaaaaagaaaagaaaacagccaagcuuggugguaugu

SEQ ID NO: 43309 - RNA, 64 nt, Homo Sapiens
cuccaaccugagugacagagcaacacucugucuuaaaagaaaaaaaaaaaagagagagauagua

SEQ ID NO: 43310 - RNA, 64 nt, Homo Sapiens
cauuuuuggucucuguuagaaguagacucuguugaaaagaaagaagcuaagcuaggugugaaga

SEQ ID NO: 43311 - RNA, 64 nt, Homo Sapiens
ugcaaauuguauaaaauuagguacuucgauuaguaaaagaaaaaaauuugaauguuuuuuuuuu

SEQ ID NO: 43312 - RNA, 64 nt, Homo Sapiens
auacuuacuuccugcauuuagagggaguuuauuuaaaagaaauaaaugacaaucaaaccaaauc

SEQ ID NO: 43313 - RNA, 64 nt, Homo Sapiens
auuauuuguaaaucauguggcaucuauguauaauaaaagaaagagacaacuauauuacucaauu

SEQ ID NO: 43314 - RNA, 64 nt, Homo Sapiens
ucauugccuuuguggaaaggcuucccuaugugguaaaagaaaggcauuccuccguaaccuaggc

SEQ ID NO: 43315 - RNA, 64 nt, Homo Sapiens
ggaccaaaccaugcacauaaagcuuguaguuuaaaaaagaaaagcaaaaaaauaauuaugccug

SEQ ID NO: 43316 - RNA, 64 nt, Homo Sapiens
uuuuaccuggaaauuccaugaccaauacaugugcaaaagaaaaugauggguugaauuuacugau

SEQ ID NO: 43317 - RNA, 64 nt, Homo Sapiens
cuaaauuuuugcuaaggauguauuuugauuauugaaaagaaaauuucuauuuaaacuguaaaua

SEQ ID NO: 43318 - RNA, 64 nt, Homo Sapiens
guuaagcaauguugaaaucaguuugcaucucuucaaaagaaaccucucagguuagcuuugaacu

SEQ ID NO: 43319 - RNA, 64 nt, Homo Sapiens
cgaaaucaagucugucaaguacaauaacauuuuuaaaagaaaauggaucccacuguuccucuuu

SEQ ID NO: 43320 - RNA, 64 nt, Homo Sapiens
uauuuauuaaaaauucuauuaaaaaacaaaaaagaaaagaaauuuucaaaaaagugucuuuaca

SEQ ID NO: 43321 - RNA, 64 nt, Homo Sapiens
aaauuuauuuauuaaaaauuuuacaaaaaaacaaaaaagaaaagacuguuucaaaaaagugucu

SEQ ID NO: 43322 - RNA, 64 nt, Homo Sapiens
agauguaaaaaccauucuuaucccucucaaaagaaaaagaaaaaccugggugacagagcaagac

SEQ ID NO: 43323 - RNA, 64 nt, Homo Sapiens
gaaaaaagauguaaaaaccacaagacucccucucaaaagaaaaacuccagccugggugacagag

SEQ ID NO: 43324 - RNA, 64 nt, Homo Sapiens
aaaaacuuuccaaauuccaaggaaaugugugggaaaaagaaaacuuggaaaacaccccaacccc

SEQ ID NO: 43325 - RNA, 64 nt, Homo Sapiens
gaaaaaccccgugcucgcccagaggaaacgcaaaaaaagaaaaggccucaggcuucucuuacga

SEQ ID NO: 43326 - RNA, 64 nt, Homo Sapiens
cuguguuuaaucuucuuaaagagagagagagagaaaaagaaaugcucaaaaaaaaaaaaaaaaa

SEQ ID NO: 43327 - RNA, 64 nt, Homo Sapiens
aaaaaagacagguaaauguuguguauagcaugguaaaagaaaaauaguucuguaucucguaauu

SEQ ID NO: 43328 - RNA, 64 nt, Homo Sapiens
ccaacugacuuuuaaacuuuuuggucuuuuaauuaaaagaaauucaaaggagcuucuugucccc

SEQ ID NO: 43329 - RNA, 64 nt, Homo Sapiens
uugcuucacuguucaccugcaucucaaagccaguaaaagaaauccauguaaaagauguauuaca

SEQ ID NO: 43330 - RNA, 64 nt, Homo Sapiens
uugcguuuaauauauuuuuuggcagacauuauguaaaagaaaggacuuuaaaaggauuaaucug

SEQ ID NO: 43331 - RNA, 64 nt, Homo Sapiens
auacauuuguugguaacuaaaaugauuaguuaaaaaaagaaaauuagacugauuuagaaaaaca

SEQ ID NO: 43332 - RNA, 64 nt, Homo Sapiens
gaagacaauuucuguaaugguuuuaagagauuuaaaaagaaauucacugguucuuuacaaaaua

SEQ ID NO: 43333 - RNA, 64 nt, Homo Sapiens
aaauaccguuaauucaaauugacagagauugauaaaaagaaacugauuuaccuaaguuuacuuu

SEQ ID NO: 43334 - RNA, 64 nt, Homo Sapiens
ggcgacagugcaagacucugucuccaaaaaaaaaaaaagaaaaaagaaaaucccccuucauccc

SEQ ID NO: 43335 - RNA, 64 nt, Homo Sapiens
gugcaagacucugucuccaaaaaaaaaaaaagaaaaaagaaaaucccccuucaucccccaggac

SEQ ID NO: 43336 - RNA, 64 nt, Homo Sapiens
ccaucaaauggcuacaguucauuuaaauuuaaaaaaaagaaaaaagaaacagaaaacgugucuc

SEQ ID NO: 43337 - RNA, 64 nt, Homo Sapiens
auggcuacaguucauuuaaauuuaaaaaaaagaaaaaagaaacagaaaacgugucucagauggc

SEQ ID NO: 43338 - RNA, 64 nt, Homo Sapiens
aagcacaugaucaugggaaugauagcccagaacaaaaagaaaucuugucuuaccacaguguuuu

SEQ ID NO: 43339 - RNA, 64 nt, Homo Sapiens
uuaugaauggaggauauucuacuguacuuuuuuaaaaagaaacuauuuuuguguuugaaaguga

SEQ ID NO: 43340 - RNA, 64 nt, Homo Sapiens
acaaaauaccccaacacaggcgggggagagacgaaaaagaaaaggaaagagcaagauagacaaa

SEQ ID NO: 43341 - RNA, 64 nt, Homo Sapiens
gaaagagcaagauagacaaaagccaaucagcuuaaaaagaaaaacaaggaaggggaaaagaaaa

SEQ ID NO: 43342 - RNA, 64 nt, Homo Sapiens
gccaaucagcuuaaaaagaaaaacaaggaaggggaaaagaaaacucuugcgauuugggaggguu

SEQ ID NO: 43343 - RNA, 54 nt, Homo Sapiens
aggaagaaaacaaggacuaagcaaaaaagaaagacccccccccccuuagcaacu

SEQ ID NO: 43344 - RNA, 64 nt, Homo Sapiens
cauacuaccuaaagggaaccugcaauaaucuugaaaaagaaaaagagaaaaauuuuaaaauccu

SEQ ID NO: 43345 - RNA, 64 nt, Homo Sapiens
aaaaaagagaaaaaaauaaaaaucaaaaaaaaaaaaaagaaagaaagaaaccuccagcguauuu

SEQ ID NO: 43346 - RNA, 64 nt, Homo Sapiens
auuuauuuuuaagguaaaaauaauccaugaagauaaaagaaacauaugucugcgugcuacuuua

SEQ ID NO: 43347 - RNA, 64 nt, Homo Sapiens
uauaaaaauauuugcauauauaaguuugacaaagaaaagaaaaucaauguuaaaccauuaaauc

SEQ ID NO: 43348 - RNA, 64 nt, Homo Sapiens
uggagcaugaucuaaguacauagcacaugugaauaaaagaaaagcugacaguauauucugguuu

SEQ ID NO: 43349 - RNA, 64 nt, Homo Sapiens
uuuuuaaagcugcucauuucauuuuguccaaccaaaaagaaaagggagauaacuaaugagcuuc

SEQ ID NO: 43350 - RNA, 64 nt, Homo Sapiens
aagcaaaugugaaaagugaaaccuuaauuuuaucaaaagaaauuucuguaaaugguaugucucc

SEQ ID NO: 43351 - RNA, 64 nt, Homo Sapiens
agguuuuaaaaagccuugaauggcccuugucuuaaaaagaaauuaggagccaggugcgguggca

SEQ ID NO: 43352 - RNA, 64 nt, Homo Sapiens
guccagccugggugacauagcaagacccugucuuaaaagaaaaaugggaagaaagacaagguaa

SEQ ID NO: 43353 - RNA, 64 nt, Homo Sapiens
aaucuggcaucuucuccaggccuaaaucuuaagaaaaagaaaugggugcugggguuugggggau

SEQ ID NO: 43354 - RNA, 64 nt, Homo Sapiens
auaaacugaaguggcacugugacuuuaaaaauaaaaaagaaaucuacuuggaaguccuuuuugc

SEQ ID NO: 43355 - RNA, 64 nt, Homo Sapiens
aaaagcaaagauccaccgagagaagaagagaaagaaaagaaaaagaaaaagcacaaaaaaagau

SEQ ID NO: 43356 - RNA, 64 nt, Homo Sapiens
aaagauccaccgagagaagaagagaaagaaaagaaaaagaaaaagcacaaaaaaagaucucgaa

SEQ ID NO: 43357 - RNA, 64 nt, Homo Sapiens
aauagacuaucuagaacuugucuaccuggaaaagaaaagaaaugagcaguuguuccagggagcu

SEQ ID NO: 43358 - RNA, 64 nt, Homo Sapiens
aaaugaauagacuaucuagagagcuucuaccuggaaaagaaaagauuccagcaguuguuccagg

SEQ ID NO: 43359 - RNA, 64 nt, Homo Sapiens
ugaauuucucuuuacuucuccaccugacagaaaaaaaagaaaaacauuuuuuuucuuuguaaug

SEQ ID NO: 43360 - RNA, 64 nt, Homo Sapiens
aguuuuguuuuguuuuuuggugcuacaauuuuuaaaaagaaaaagaauguguuuuguuguuuug

SEQ ID NO: 43361 - RNA, 64 nt, Homo Sapiens
aauggaaaaaaauuacaaggauauuuuuucuauaaaaagaaaaagucacucuccccaaaauauu

SEQ ID NO: 43362 - RNA, 64 nt, Homo Sapiens
gaauaccuaagauuucugucagcaaugccugugaaaaagaaacuagaguuuugguuuuugaacu

SEQ ID NO: 43363 - RNA, 64 nt, Homo Sapiens
aaaggauaaaaaaacccaaacauacuuauuuuaaaaaagaaaaaaaacacaaauaagcagaaaa

SEQ ID NO: 43364 - RNA, 64 nt, Homo Sapiens
acaaauaagcagaaaacauacaauauauucaaagaaaagaaaacuuuaauaauaaaauauugug

SEQ ID NO: 43365 - RNA, 64 nt, Homo Sapiens
ugccauauuuuacaagcugcggcaaaaacaagagaaaagaaacuucaaauaauuauaagcauuu

SEQ ID NO: 43366 - RNA, 64 nt, Homo Sapiens
agugaaaaggaaacaacuagaaagauaaaguagaaaaagaaaaacacagucaaagaaagagaaa

SEQ ID NO: 43367 - RNA, 64 nt, Homo Sapiens
aaaagucuagcgaaaaaacuuuuuaauaagguuaaaaagaaaaaauuuuuaggaccaaucucau

SEQ ID NO: 43368 - RNA, 64 nt, Homo Sapiens
aaaaaauaauuuuucuuuucgacuaaaagccaaaaaaagaaagagcagagaugagguccuucug

SEQ ID NO: 43369 - RNA, 64 nt, Homo Sapiens
aagaaaaaaggcagaagcccaaaaaaaaaaagaaaaaagaaagaagagcgaaccucugucucaa

SEQ ID NO: 43370 - RNA, 64 nt, Homo Sapiens
agaaagaaagaaaaaaggcagucucaaaaaaaaaaaaagaaaaagggugacagagcgaaccucu

SEQ ID NO: 43371 - RNA, 64 nt, Homo Sapiens
aaaaauagcaacucuggugaaaagcacuaaacagaaaagaaaaaaccuauaagaauuaaggggu

SEQ ID NO: 43372 - RNA, 64 nt, Homo Sapiens
uaugaaaaaauaugcauaccuuaaaaaguaugugaaaagaaaauagaacaaguagccuauucuc

SEQ ID NO: 43373 - RNA, 64 nt, Homo Sapiens
uuuauguaguuaugcaugucagguuuaugaauuaaaaagaaagccgggcacucuauauucauua

SEQ ID NO: 43374 - RNA, 64 nt, Homo Sapiens
auaaaaaaaccuucagcugugggcucacuuuaaaaaaagaaagaugggaaagacaccaaaucau

SEQ ID NO: 43375 - RNA, 64 nt, Homo Sapiens
ugugcucuuuucuaauccaacagaacaaaacaaaaaaagaaaaucaguaugccacuucuuaaaa

SEQ ID NO: 43376 - RNA, 64 nt, Homo Sapiens
auccaaagggagaaagagcaccuuugaugggcuuaaaagaaauuuugaauuguguuuguuuuuu

SEQ ID NO: 43377 - RNA, 64 nt, Homo Sapiens
uuguuuacuuacccauuaguaauaacuuguuuguaaaagaaaauggaggaucccuaugacucaa

SEQ ID NO: 43378 - RNA, 64 nt, Homo Sapiens
ugagcuuaaggcaaaaggccuuuuuuucuaaucaaaaagaaaaugauuuuauuuuuuaaucuaa

SEQ ID NO: 43379 - RNA, 64 nt, Homo Sapiens
auagacauauuuuuuuaaagagaaaaaaagaaaaaaaagaaagcaguacuugacuaaaaaaaaa

SEQ ID NO: 43380 - RNA, 64 nt, Homo Sapiens
aaagaaagcauagacauauuaaaaaaaaaagaaaaaaagaaaaacuuuaagaaaguacuugacu

SEQ ID NO: 43381 - RNA, 64 nt, Homo Sapiens
aagaaaaaaaagaaagcauaacuugacuaaaaaaaaaagaaaaauauuguuucuuuaagaaagu

SEQ ID NO: 43382 - RNA, 64 nt, Homo Sapiens
acuuccuugaaaauuuuauuccaauggaauacugaaaagaaauccacacauucacccuaaggau

SEQ ID NO: 43383 - RNA, 64 nt, Homo Sapiens
auacaucauuuuugcccucucuauggacagauguaaaagaaacugcuuagcaauguucuaauca

SEQ ID NO: 43384 - RNA, 64 nt, Homo Sapiens
ggagaaaaacaaagagauuuaaaagagagaaaggaaaagaaaaauaugaauacaaagauaagug

SEQ ID NO: 43385 - RNA, 64 nt, Homo Sapiens
aaaaauauauauauauauauauaauguucuauagaaaagaaaaauugcuguugaucuuuuauca

SEQ ID NO: 43386 - RNA, 64 nt, Homo Sapiens
acccaaugaggaacaauugguugauguguguuuuaaaagaaaaaacaaagcaaccccaaaagag

SEQ ID NO: 43387 - RNA, 64 nt, Homo Sapiens
aaagcacgugaccuuaugagcucaaaaaagaaaaaaaagaaaaacaacaaaagcgaaacucugu

SEQ ID NO: 43388 - RNA, 64 nt, Homo Sapiens
aaagaaaaaaaagcacgugaaaacucugucucaaaaaagaaaaacagccugggcaacaaaagcg

SEQ ID NO: 43389 - RNA, 64 nt, Homo Sapiens
gcugcauaggaaaacugagauaacguguuccuagaaaagaaaauuuccuuguccugguugaagg

SEQ ID NO: 43390 - RNA, 64 nt, Homo Sapiens
accuacucccugacacugugcaugaacuauagggaaaagaaaucacccauuuagguaucacuac

SEQ ID NO: 43391 - RNA, 64 nt, Homo Sapiens
aucagcgucauuuguucccugagaguucaguuaaaaaagaaaaauucauaaaacauuuucuuga

SEQ ID NO: 43392 - RNA, 64 nt, Homo Sapiens
ucaguauuauuuuugcauguguuuaaaacuuuuuaaaagaaaacaaaagaaacauuuaaugacg

SEQ ID NO: 43393 - RNA, 64 nt, Homo Sapiens
uuuaaugacgguuuaaaacuuucagauuucuacaaaaagaaacacaaauucagacgcagaacuc

SEQ ID NO: 43394 - RNA, 64 nt, Homo Sapiens
uguuucaacagaugaccgugcuaagaucuguuaaaaaagaaaucguaccuaugacuuuuuuaaa

SEQ ID NO: 43395 - RNA, 64 nt, Homo Sapiens
uguuuuguuuuuuaauucucgacucuucacuccaaaaagaaaaggguuauaacagcaaaugaaa

SEQ ID NO: 43396 - RNA, 64 nt, Homo Sapiens
auaauaaaaggccuccauuuaaaagacuuugauaaaaagaaacauagcgcugguacaguacacu

SEQ ID NO: 43397 - RNA, 64 nt, Homo Sapiens
aaacacaaaaaauaaaaaaccaauucuaagcagaaaaagaaaaagcuuuucuucccuagaaacc

SEQ ID NO: 43398 - RNA, 64 nt, Homo Sapiens
aacaacaguuaaaagcuuuuggcuuucauugaagaaaagaaaaacaugucuuuucaaaaugaga

SEQ ID NO: 43399 - RNA, 64 nt, Homo Sapiens
caacaucuuauucuuuagcuuuuuaaauuauuuuaaaagaaauaccuuaggaaaauuuaauaua

SEQ ID NO: 43400 - RNA, 64 nt, Homo Sapiens
gaaggaccucaaagcaccuguuuucuuaucacaaaaaagaaaauucaacguuaauaauucugga

SEQ ID NO: 43401 - RNA, 64 nt, Homo Sapiens
acuuaaaaugaucauuaggaauuuaccuuuuugaaaaagaaaacaugugucuuucuuuuuggac

SEQ ID NO: 43402 - RNA, 64 nt, Homo Sapiens
ccgcugcacuccagccugggagacugcaucucaaaaaagaaaaauaaacgaaguaaaagauauu

SEQ ID NO: 43403 - RNA, 64 nt, Homo Sapiens
gauugugucacugcacucuagccugggcgacagaaaaagaaaauuuagguggggaaaaaaauca

SEQ ID NO: 43404 - RNA, 64 nt, Homo Sapiens
cuuaauuuggaauagagaaaccaguauauuuuaaaaaagaaaaauauucuuuguagcaacugua

SEQ ID NO: 43405 - RNA, 64 nt, Homo Sapiens
gacuacauuaguauuagugacaucagguggauauaaaagaaaacccuuggaaagagaacugccu

SEQ ID NO: 43406 - RNA, 64 nt, Homo Sapiens
aaaccacacauuaguacuuauguugcacaaugagaaaagaaauuaguuucaaauuuaccucagc

SEQ ID NO: 43407 - RNA, 64 nt, Homo Sapiens
agacccccaucuuuacaaagaaaaaaaaaaggggaaaagaaaaucuuuuaaaucuuuggauuug

SEQ ID NO: 43408 - RNA, 64 nt, Homo Sapiens
cugggugacacagcgagacuucaucucaaaaaaaaaaagaaaagaaaagcaauuguacuucacu

SEQ ID NO: 43409 - RNA, 64 nt, Homo Sapiens
ugacacagcgagacuucaucucaaaaaaaaaaagaaaagaaaagcaauuguacuucacuaugcc

SEQ ID NO: 43410 - RNA, 64 nt, Homo Sapiens
gcacauugcauguaguugagccacauuuuuuaaaaaaagaaaauggaugaccauuaauugacua

SEQ ID NO: 43411 - RNA, 64 nt, Homo Sapiens
ugacccuuuugaauauaccuaaugauuuccuuaaaaaagaaauuuuaaacagacuuguuuaauc

SEQ ID NO: 43412 - RNA, 64 nt, Homo Sapiens
ucaugaggucagcaguugagaccagccaaaaggaaaaagaaaauuaugagaguuacuuaaaggu

SEQ ID NO: 43413 - RNA, 64 nt, Homo Sapiens
cggggaaacgacccuguggcugugagaaagugaaaaaagaaaaaaaaaaaggcauuggcauuuu

SEQ ID NO: 43414 - RNA, 64 nt, Homo Sapiens
uuguauuaggacagaauuaaugaugcuuaaagagaaaagaaaaaaagagagaagaaaaaggaga

SEQ ID NO: 43415 - RNA, 64 nt, Homo Sapiens
cagcuauugucuguuguguucagcugagaugcaaaaaagaaauuaagcaaaaaagaaaaagaug

SEQ ID NO: 43416 - RNA, 64 nt, Homo Sapiens
uguucagcugagaugcaaaaaagaaauuaagcaaaaaagaaaaagaugaagacuuuucaugaau

SEQ ID NO: 43417 - RNA, 64 nt, Homo Sapiens
ucaaauuuagcaauaaacaauuagcauuaguuaaaaaagaaacauauuccaagggcagguucga

SEQ ID NO: 43418 - RNA, 64 nt, Homo Sapiens
ucaugugauucuagauuaacauuaaauagauugaaaaagaaacuuugcacgguaugagcuucau

SEQ ID NO: 43419 - RNA, 64 nt, Homo Sapiens
augcaccaaccguaucauuauuuguuugaggaaaaaaagaaaucugcauuuuaauucauguugg

SEQ ID NO: 43420 - RNA, 64 nt, Homo Sapiens
uuuaucuuauaucguagaucugauaacccuaucuaaaagaaagucacacgcuaaauguauucuu

SEQ ID NO: 43421 - RNA, 64 nt, Homo Sapiens
auguagaaugacuauucuaaauauuaauguauuaaaaagaaaauacaacaaaauguauauuuag

SEQ ID NO: 43422 - RNA, 64 nt, Homo Sapiens
uuuaaagggaaugauuggggggaaaaacuggugaaaaagaaauauaaaaaggacccuaaaaaga

SEQ ID NO: 43423 - RNA, 64 nt, Homo Sapiens
aaaacuuucuucaucuguugcaauguuuaaugugaaaagaaauuuguuagcugauugugguaaa

SEQ ID NO: 43424 - RNA, 64 nt, Homo Sapiens
aaaauguugggugaauucuaagaggaaaaaauggaaaagaaacuuuaauuacugggccaacuug

SEQ ID NO: 43425 - RNA, 64 nt, Homo Sapiens
uagccaggugugguggcaagaaaaaaaaaaaaagaaaagaaaauugagacuccaucgcaaaaaa

SEQ ID NO: 43426 - RNA, 64 nt, Homo Sapiens
aaaauuagccagguguggugaaaaaaaaaaaaaaaaaagaaaaggagagugagacuccaucgca

SEQ ID NO: 43427 - RNA, 64 nt, Homo Sapiens
acuugaaagaacacuucuaacugguuucuuuuuuaaaagaaaaaucaacaaaaaucuucaaaga

SEQ ID NO: 43428 - RNA, 64 nt, Homo Sapiens
uaaaugugacaaguggacaucuaauugauuguuuaaaagaaauaagacacuaauucauuaaaua

SEQ ID NO: 43429 - RNA, 64 nt, Homo Sapiens
uauuacauccuuuacauucaauauaauacuuuuaaaaagaaaauaugugccagcugaauuuaaa

SEQ ID NO: 43430 - RNA, 64 nt, Homo Sapiens
ggaacuugacaauuauaaaucuugcaauaaaugcaaaagaaacuugucaaacauaccuaacuuu

SEQ ID NO: 43431 - RNA, 64 nt, Homo Sapiens
cagggaucacugggagaagcaaaaaagaagaagaaaaagaaacuagcaguaaacuauggggaaa

SEQ ID NO: 43432 - RNA, 64 nt, Homo Sapiens
gaagaaaagcaaucucgcagauguuauugauggaaaaagaaaaaaaagaggcauuccagccccu

SEQ ID NO: 43433 - RNA, 64 nt, Homo Sapiens
aaaaaaaggaaagaaagaaagaacaaaaaaaacaaaaagaaaaaucaaccagugaggcugcccu

SEQ ID NO: 43434 - RNA, 64 nt, Homo Sapiens
ucagaauuaacuuagucuguaauguggcuucaaaaaaagaaagccuuuugacagcuacaugacu

SEQ ID NO: 43435 - RNA, 64 nt, Homo Sapiens
uacauaaagacuugagaagggaauuguuuaagggaaaagaaaagaguaauaauuuuuuuuaaaa

SEQ ID NO: 43436 - RNA, 64 nt, Homo Sapiens
uuaggcauuaccucagggaaaagccuugacagugaaaagaaacuacuuaaucgcuaauagcuag

SEQ ID NO: 43437 - RNA, 64 nt, Homo Sapiens
uuaaucuuuaucauuuucuugaaguaaauaaacaaaaagaaacauuuguuugcauaggaauuca

SEQ ID NO: 43438 - RNA, 64 nt, Homo Sapiens
caaaauucugaagucuggaaguuuuuccuucaagaaaagaaacugcauaaaaaauuuaaaacua

SEQ ID NO: 43439 - RNA, 64 nt, Homo Sapiens
uuaauuauguaaaaaacaaaacuacaacaacaaaaaaagaaaaaaguuaaaaaagaaaaaaaca

SEQ ID NO: 43440 - RNA, 64 nt, Homo Sapiens
caaaacuacaacaacaaaaaaagaaaaaaguuaaaaaagaaaaaaacaccaaaaaacaaaaaca

SEQ ID NO: 43441 - RNA, 64 nt, Homo Sapiens
uuaaagucuuaaaauggaaugagaauguuguuuuaaaagaaaauagcaaaacaacaaaaaagca

SEQ ID NO: 43442 - RNA, 64 nt, Homo Sapiens
uuaacuuaaaauauuuuagcaaaaaaaaaaaagaaaaagaaaauuaaacuuauuuugcuuuaaa

SEQ ID NO: 43443 - RNA, 64 nt, Homo Sapiens
gaaaauuuaacuuaaaauauuuuaaaaaaaaaaaaaaagaaaaacccuuuuaaacuuauuuugc

SEQ ID NO: 43444 - RNA, 64 nt, Homo Sapiens
ccacucccaguccccagcccuacauuuuguuguaaaaagaaaaagccuaguuuuuaguaaucug

SEQ ID NO: 43445 - RNA, 64 nt, Homo Sapiens
gaaaaacaaccaagcgcaucuuuuuuuuuuuaaaaaaagaaaaucccccccuaaaauuuguggg

SEQ ID NO: 43446 - RNA, 64 nt, Homo Sapiens
cuaagugaaugcgcguaugaaacuuuaguugugcaaaagaaauucuauuuuucugaucuuauuc

SEQ ID NO: 43447 - RNA, 64 nt, Homo Sapiens
cuuggagggagucugcgggcccccaagccccagaaaaagaaacucgaaggcugcaacggcccug

SEQ ID NO: 43448 - RNA, 64 nt, Homo Sapiens
ugaagaguaagagaaauuguacuuuugaauaauaaaaagaaaagggaugauuuaaaaacauuug

SEQ ID NO: 43449 - RNA, 64 nt, Homo Sapiens
gaggaaaaggaagugcuucugaaaggaagaaauuaaaagaaaguauccaauaaguaaauucaug

SEQ ID NO: 43450 - RNA, 64 nt, Homo Sapiens
uuauuggauuaaaagaugaggugcccuucguuuuaaaagaaagaaccaugccucuguguuucag

SEQ ID NO: 43451 - RNA, 64 nt, Homo Sapiens
aaaggaaguaguuaaaugcugacaaccuuugagaaaaagaaacacaggagaaaaaggguuguuu

SEQ ID NO: 43452 - RNA, 64 nt, Homo Sapiens
aaaaacaaaaacaaacaggcugaauuuggaaauaaaaagaaaaauuaauguaccuuuuuguuag

SEQ ID NO: 43453 - RNA, 64 nt, Homo Sapiens
caugauuaauauuuuugucuuaaaaacccuuauuaaaagaaaaauucaaagcuacacuuuugag

SEQ ID NO: 43454 - RNA, 64 nt, Homo Sapiens
guaagguggcaaccuuauuuaacaccccauuaccaaaagaaaaguuuuuucucuuaaaaaaaau

SEQ ID NO: 43455 - RNA, 64 nt, Homo Sapiens
guuuucagugugaauucacugaauguuuauagacaaaagaaaauacacacuaaaacuaaucuuc

SEQ ID NO: 43456 - RNA, 64 nt, Homo Sapiens
uaaucuauacugugaugauuugacucaaaaggagaaaagaaauuauguaguuuucaauucugau

SEQ ID NO: 43457 - RNA, 64 nt, Homo Sapiens
gggagaaaacuagucuaaauuauuucaacuggaaaaaagaaaaaagaguccucuucuuuuccca

SEQ ID NO: 43458 - RNA, 64 nt, Homo Sapiens
aacaggcaacuuuucaaaaacacagcuaucauagaaaagaaacuugccucauguaaacuggauu

SEQ ID NO: 43459 - RNA, 64 nt, Homo Sapiens
uggcauuuucauagauccuugguuuagucugugaaaaagaaaccaucucucuggauaggcuguc

SEQ ID NO: 43460 - RNA, 64 nt, Homo Sapiens
ucaaucacaucugauuguugaagguuauuaaauuaaaagaaagaucauuuguaacauacucuuu

SEQ ID NO: 43461 - RNA, 64 nt, Homo Sapiens
gaagagccuuaacauauauaaguagaguauauugaaaagaaaaaguuuauuuuuuaaaauucua

SEQ ID NO: 43462 - RNA, 64 nt, Homo Sapiens
uuauuuuuuaaaauucuaagacaagagguaccaaaaaagaaaguuucccaggcuaauacaggaa

SEQ ID NO: 43463 - RNA, 64 nt, Homo Sapiens
cuggauacuuuuuuguuguuauaaucuucauaagaaaagaaacaaccaauacuguguuuuauua

SEQ ID NO: 43464 - RNA, 64 nt, Homo Sapiens
cauacuguuaaaaugugcuuucuccuuucccuacaaaagaaaagcgauguuagacauagccaua

SEQ ID NO: 43465 - RNA, 64 nt, Homo Sapiens
uaauugaaauguugagagagagugaacugcuaaaaaaagaaaaagucuaguuuccagccauuga

SEQ ID NO: 43466 - RNA, 64 nt, Homo Sapiens
gcucagaaaaauuaggauguuguaauuuuucaugaaaagaaaggcaaacuucuguuuuauaaua

SEQ ID NO: 43467 - RNA, 64 nt, Homo Sapiens
ucuuuucccauauaauccaacaucugccguuugcaaaagaaaaauuccaggaacuacaagaugc

SEQ ID NO: 43468 - RNA, 64 nt, Homo Sapiens
ugggaccaucacacacaugaagcuugacucagggaaaagaaauggaggaugugaagccacugaa

SEQ ID NO: 43469 - RNA, 64 nt, Homo Sapiens
uuaagcaaacagucccaaaccucuuaggggugaaaaaagaaacaugccacuugauuaggagaga

SEQ ID NO: 43470 - RNA, 64 nt, Homo Sapiens
gggcaagaagagcgaaacugggucucaaguuaaaaaaagaaagcaaggaaagaguaauuuacaa

SEQ ID NO: 43471 - RNA, 64 nt, Homo Sapiens
uucaccaaauggagcuuggcacuaaaauuuauguaaaagaaaaaucacaaaccuugaaaaauuu

SEQ ID NO: 43472 - RNA, 64 nt, Homo Sapiens
gaauauauauuagauguaaagaauuuucugcaauaaaagaaacuagacuuguuaaucccugccu

SEQ ID NO: 43473 - RNA, 64 nt, Homo Sapiens
aagcacuguuucuauuuuuuucuuuuuuuccaaaaaaagaaaguaauaaaaacuuaaauucuuu

SEQ ID NO: 43474 - RNA, 64 nt, Homo Sapiens
ccaaggcccaggacacuugucagaaggaugcaaaaaaagaaaaaaguacauccacccucuuaau

SEQ ID NO: 43475 - RNA, 64 nt, Homo Sapiens
gggguuuuguuucuguuguuguucaaaugcaaaaaaaagaaaaaaaaagaaaaaaaaaggugac

SEQ ID NO: 43476 - RNA, 64 nt, Homo Sapiens
uucuguuguuguucaaaugcaaaaaaaagaaaaaaaaagaaaaaaaaaggugacucacauuguu

SEQ ID NO: 43477 - RNA, 64 nt, Homo Sapiens
gaauuucgaaagaaauaauuggcaagauaaugagaaaagaaaaaagucaugguaggugaggugg

SEQ ID NO: 43478 - RNA, 64 nt, Homo Sapiens
uuuuuguagccaagcagaguuguagagggggauaaaaagaaaagaaauuggauguauuuacagc

SEQ ID NO: 43479 - RNA, 64 nt, Homo Sapiens
guagccaagcagaguuguagagggggauaaaaagaaaagaaauuggauguauuuacagcugucc

SEQ ID NO: 43480 - RNA, 64 nt, Homo Sapiens
aaaaauccaaaagagagaagaaaaaaaaaaagaaaaaagaaaaagccaaaaaaaaaaaaaaaaa

SEQ ID NO: 43481 - RNA, 64 nt, Homo Sapiens
agaaaaaaaaaauccaaaagaaaaaaaaaaaaaaaaaagaaaaauuuaaaagccaaaaaaaaaa

SEQ ID NO: 43482 - RNA, 64 nt, Homo Sapiens
ucugucucaaaaaaaaaaaaaaaaaaaaagaaagaaaagaaaacaaacuuccucucaaaaaaaa

SEQ ID NO: 43483 - RNA, 64 nt, Homo Sapiens
aaagaaaacucugucucaaacaaaaaaaaaaaaaaaaagaaagaacacgagcaaaacuuccucu

SEQ ID NO: 43484 - RNA, 64 nt, Homo Sapiens
ugugaaaggugauggguuuuauucguugggcuuuaaaagaaaagguuuggcagaacuaaaaaca

SEQ ID NO: 43485 - RNA, 64 nt, Homo Sapiens
caaucaggcaagagaaagaaauaaaaggcaaccaaaaagaaaggaagucgaaguaucucuguuu

SEQ ID NO: 43486 - RNA, 64 nt, Homo Sapiens
ggcaaccaagcgagacucugccuuaaaaaaaaaaaaaagaaaauguggcacauauacaccaugg

SEQ ID NO: 43487 - RNA, 64 nt, Homo Sapiens
cuacacaugugccccugaaccuaaaaaaaaaguuaaaagaaaaacguuuggauuauuuucccuc

SEQ ID NO: 43488 - RNA, 64 nt, Homo Sapiens
guuugcccaaggacuacaaauaaaccaacgggaaaaaagaaagguuccaguuuugucugaaaau

SEQ ID NO: 43489 - RNA, 64 nt, Homo Sapiens
auugagaguggcaauuccgcuggagcugucugccaaaagaaacugccuacagacaucaucacag

SEQ ID NO: 43490 - RNA, 64 nt, Homo Sapiens
auugaucugacuucucagccucauuuggacuaaaaaaagaaagcagaaauccaugaacacauug

SEQ ID NO: 43491 - RNA, 64 nt, Homo Sapiens
uuuaauucuucccuuggauuaauauuuucuacugaaaagaaaugaaaucucaguuccacuauga

SEQ ID NO: 43492 - RNA, 64 nt, Homo Sapiens
cugaaaagaaaugaaaucucaguuccacuaugauaaaagaaacgaaucaccagugucugucagu

SEQ ID NO: 43493 - RNA, 64 nt, Homo Sapiens
guugauugacuguuaauugauucaggguacccuuaaaagaaaagaaguuuucccauugugaacc

SEQ ID NO: 43494 - RNA, 64 nt, Homo Sapiens
ggcccaacuugggaguggggaaauugcuuaaaaaaaaagaaaaagaaaaaaaaaaagauuauuc

SEQ ID NO: 43495 - RNA, 64 nt, Homo Sapiens
acuugggaguggggaaauugcuuaaaaaaaaagaaaaagaaaaaaaaaaagauuauucuaaaua

SEQ ID NO: 43496 - RNA, 64 nt, Homo Sapiens
cgauuucagcacaugcacuacugaaauuuacacaaaaagaaagcugugaaauugaagucccaau

SEQ ID NO: 43497 - RNA, 64 nt, Homo Sapiens
acuuaguuuuguuccaacaguuaaacuugcaaugaaaagaaaaugugccauuuuuuucacucag

SEQ ID NO: 43498 - RNA, 64 nt, Homo Sapiens
aaagagaaaaacaauggaguuacuuauuuaaaaaaaaagaaagaaaguuaucucuucccaggag

SEQ ID NO: 43499 - RNA, 64 nt, Homo Sapiens
acugugaauguagaagugggggggaggggggagaaaaagaaaacucuggcguuagaggauauag

SEQ ID NO: 43500 - RNA, 64 nt, Homo Sapiens
uuguuuuuuugcagcuugcugauauuuuauauaaaaaagaaaagcaaagcaaaagagaagcuga

SEQ ID NO: 43501 - RNA, 64 nt, Homo Sapiens
agcugauagucuugaauauuuuauuuuuuuaaugaaaagaaaaaacaagaaaguuauguuucau

SEQ ID NO: 43502 - RNA, 64 nt, Homo Sapiens
cccuuuauaaagagauuuucaaguggauauauauaaaagaaacaguugcuuguaaaauauacuu

SEQ ID NO: 43503 - RNA, 64 nt, Homo Sapiens
aauugaaauauuuucuugcaucaguauuggcuagaaaagaaaauaaauaaaaccaaguuaauuu

SEQ ID NO: 43504 - RNA, 64 nt, Homo Sapiens
gucaaacuuuuuccagcaaaauggaagcaaagacaaaagaaacuuaccaauugauguuuuacgu

SEQ ID NO: 43505 - RNA, 64 nt, Homo Sapiens
uaccuuccuuauauuuuuuuccucaacaguuuuaaaaagaaaaaaaggucuauuuuuuuuucuc

SEQ ID NO: 43506 - RNA, 64 nt, Homo Sapiens
uggcagaagcgagaaaacuuuguuuauugaaaaaaaaagaaaaagaaagcaagaaaaaaagaua

SEQ ID NO: 43507 - RNA, 64 nt, Homo Sapiens
aagcgagaaaacuuuguuuauugaaaaaaaaagaaaaagaaagcaagaaaaaaagauacuaugg

SEQ ID NO: 43508 - RNA, 64 nt, Homo Sapiens
gcuaugcaaaaccuuucccagaccucaguuucuuaaaagaaagauguugcuacaguucccgauu

SEQ ID NO: 43509 - RNA, 64 nt, Homo Sapiens
agaguauuuuuguacagauuugcuuucucuuacaaaaagaaaaaaaaaauccuguuguauuaac

SEQ ID NO: 43510 - RNA, 62 nt, Homo Sapiens
auauuauuguuuacaauaaauauacauugcauuaaaaagaaaguggcccuguggauuuauuc

SEQ ID NO: 43511 - RNA, 64 nt, Homo Sapiens
cuccccaaaaacuauugaaauaaaauaaaauauaaaaagaaagagaaagaaaagaaaauaguuc

SEQ ID NO: 43512 - RNA, 64 nt, Homo Sapiens
ugaaauaaaauaaaauauaaaaagaaagagaaagaaaagaaaauaguuccaauuuaucaugcca

SEQ ID NO: 43513 - RNA, 64 nt, Homo Sapiens
aggcucgccgugagccaggucuaaaguuugaagaaaaagaaaaaucuuaaaaaaaaaaaaaaaa

SEQ ID NO: 43514 - RNA, 64 nt, Homo Sapiens
aaaaagaaaaaucuuaaaaaaaaaaaaaaaaaaaaaaagaaaaaaagaaaaacaggaaaaagga

SEQ ID NO: 43515 - RNA, 64 nt, Homo Sapiens
aaaucuuaaaaaaaaaaaaaaaaaaaaaaagaaaaaaagaaaaacaggaaaaaggacuuuuuuu

SEQ ID NO: 43516 - RNA, 64 nt, Homo Sapiens
cucugcuagucuuggcaaaccauacagaauguuuaaaagaaaaaucccccagucugacauauuu

SEQ ID NO: 43517 - RNA, 64 nt, Homo Sapiens
caaugaauuagaagagauccugugcacaauguuuaaaagaaaaauuucuaugugaauauaagcu

SEQ ID NO: 43518 - RNA, 64 nt, Homo Sapiens
cuuacauugucagggauccuaaaaaaagaacggaaaaagaaaugugucuccgaaaaaaaaaaaa

SEQ ID NO: 43519 - RNA, 64 nt, Homo Sapiens
agauccucauggcuauagaggucucaaaaaaaaaaaaagaaagcgggugacagagcgagacucc

SEQ ID NO: 43520 - RNA, 64 nt, Homo Sapiens
aaaagucuuugguaaauggcacagcuuuaaaagaaaaagaaaaaaguuuucccuugaggaaaca

SEQ ID NO: 43521 - RNA, 64 nt, Homo Sapiens
gaaaaaaaaagucuuugguagaaacaacagcuuuaaaagaaaaaagauaaaguuuucccuugag

SEQ ID NO: 43522 - RNA, 64 nt, Homo Sapiens
gcaagaagaaggaagaaagaucuuaaaaaaaagaaaaagaaaaauucaaaucucuugcuuucuu

SEQ ID NO: 43523 - RNA, 64 nt, Homo Sapiens
gaaaaagcaagaagaaggaauuucuuucuuaaaaaaaagaaaaagcaagauucaaaucucuugc

SEQ ID NO: 43524 - RNA, 64 nt, Homo Sapiens
aaaucccuuucuuguaaacuaaaaaaaagaaaaaaaaagaaaaaauagaaacuuugcuaguuaa

SEQ ID NO: 43525 - RNA, 64 nt, Homo Sapiens
aaaagaaaaaaaaucccuuuugcuaguuaaaaaaaaaagaaaaaagaaaguauaauagaaacuu

SEQ ID NO: 43526 - RNA, 64 nt, Homo Sapiens
ugcaaaucaaagauauuugguagucaaaauaaguaaaagaaauauaggaauauuccagucaauc

SEQ ID NO: 43527 - RNA, 64 nt, Homo Sapiens
cuuuuauaaagagacucaaagcuaaugauagcuuaaaagaaaaguuaaugccuucucauuggaa

SEQ ID NO: 43528 - RNA, 64 nt, Homo Sapiens
uugaauauaaguaaccaugacuuguaaaaaaaaaaaaagaaagcaguuacucuuggagcuuaug

SEQ ID NO: 43529 - RNA, 64 nt, Homo Sapiens
auugccgagaguccuguuauugagguagaaacagaaaagaaagacguucuugauuuuggugacu

SEQ ID NO: 43530 - RNA, 64 nt, Homo Sapiens
gggcccuaaagaccuccuuugggaauucuggggaaaaagaaaaaguaaucuucuacuugcuuca

SEQ ID NO: 43531 - RNA, 64 nt, Homo Sapiens
uuagcaguuucucuggaauuccugucucuccuuuaaaagaaaggagagaacauuuuagaacaau

SEQ ID NO: 43532 - RNA, 64 nt, Homo Sapiens
caaacugcuuuguguauuguauauuuuuuuaagaaaaagaaaagccuuauuugacuuaugcuug

SEQ ID NO: 43533 - RNA, 64 nt, Homo Sapiens
ugaaucuagagccuacuuuuauuuugguuaaagaaaaagaaaauaucaauaauucaauuuugug

SEQ ID NO: 43534 - RNA, 64 nt, Homo Sapiens
gaaaguuuuacaaguuagagaaaagaaauacgagaaaagaaaguacagagaggaaaauguauuu

SEQ ID NO: 43535 - RNA, 64 nt, Homo Sapiens
cgagaaaagaaagugaaaguaggaaaauguauuuaaaagaaauagugaauauagaugaacagag

SEQ ID NO: 43536 - RNA, 64 nt, Homo Sapiens
ucuggcuggucucagcuagaucuaauccaacaacaaaagaaaugguuucuuguucaguuuuacu

SEQ ID NO: 43537 - RNA, 64 nt, Homo Sapiens
auaucuacuucuuuuaaaguuauaaaugaauuuuaaaagaaaaacucaaacuaaaauuuauuuu

SEQ ID NO: 43538 - RNA, 64 nt, Homo Sapiens
gaucaaguugucauuuuagaaauuuugaauguauaaaagaaaaaaaaauaauagaagaaauaga

SEQ ID NO: 43539 - RNA, 64 nt, Homo Sapiens
augaagacugaauuaaauuagaagaaaguuuuggaaaagaaacaaauauugaguaucacuaugu

SEQ ID NO: 43540 - RNA, 61 nt, Homo Sapiens
gcaucgauguaaucagaaugaaauuaaacauaaaagaaauuuuagaggacacacugguuaa

SEQ ID NO: 43541 - RNA, 64 nt, Homo Sapiens
auaauuuccauuaaguagaaggaauucagggaugaaaagaaagaaaaaugggagauuguuuuca

SEQ ID NO: 43542 - RNA, 64 nt, Homo Sapiens
gaccuguucuugaacagauauuauaaguaacuacaaaagaaagacacccuugguuucugaugau

SEQ ID NO: 43543 - RNA, 64 nt, Homo Sapiens
uaguucuaccuugauuacaugaagucaggaaaagaaaagaaacuugggucugaaauucauacau

SEQ ID NO: 43544 - RNA, 64 nt, Homo Sapiens
aaacuuaguucuaccuugauuacaugaagucaggaaaagaaaagugaggugggucugaaauuca

SEQ ID NO: 43545 - RNA, 64 nt, Homo Sapiens
cuaguucaguuuuauuccaaacaggaaauauaggaaaagaaacauucagcuaaaauaguacuuc

SEQ ID NO: 43546 - RNA, 64 nt, Homo Sapiens
ugucauccacuugaguuaauuuuuuuaauacaggaaaagaaacaaauuauuaaaugugaggagc

SEQ ID NO: 43547 - RNA, 64 nt, Homo Sapiens
uuacuuaaucuuucccuaagugaagugaauuugaaaaagaaaugaaugaacacaguugaguauu

SEQ ID NO: 43548 - RNA, 64 nt, Homo Sapiens
guagcuggaaucuuaauaacaauaaauaaguuccaaaagaaauuguaauuccuaaguaauuaag

SEQ ID NO: 43549 - RNA, 64 nt, Homo Sapiens
aaaaagccagaaucuuccuuaacaggcucuuuaaaaaagaaaacggaggaaagauuaugaaagg

SEQ ID NO: 43550 - RNA, 64 nt, Homo Sapiens
uacaggcuuacgaaaaugauacgucauugauagcaaaagaaaggcugagaaugaauaugggaac

SEQ ID NO: 43551 - RNA, 64 nt, Homo Sapiens
gaguuacacugagaaugaauguuacagaaaaugaaaaagaaaauggaguaauagggaaagaaga

SEQ ID NO: 43552 - RNA, 64 nt, Homo Sapiens
uaccuguuggcaggagaaggaaaaaaaaaagaaaaaaagaaaugcgagacuccgccucaaaaaa

SEQ ID NO: 43553 - RNA, 64 nt, Homo Sapiens
aagaaauguaccuguuggcaucaaaaaaaaaaaaaaaagaaaaacgacagagcgagacuccgcc

SEQ ID NO: 43554 - RNA, 64 nt, Homo Sapiens
uucuuuuacuguguuuaaugaucuugcacaaagaaaaagaaaauaaaggucuucugacacacuu

SEQ ID NO: 43555 - RNA, 64 nt, Homo Sapiens
gggaggguacaggcaacaggaauuugggagggaaaaaagaaauugcauaggacgguaggguaga

SEQ ID NO: 43556 - RNA, 64 nt, Homo Sapiens
uuacuguaucauauaacagaacugguuuauauacaaaagaaaacuuucagaaaaccugacucua

SEQ ID NO: 43557 - RNA, 64 nt, Homo Sapiens
gaagauauccagaaaggagccacagcugacgccaaaaagaaaagaaaaaagauauauauauaua

SEQ ID NO: 43558 - RNA, 64 nt, Homo Sapiens
uauccagaaaggagccacagcugacgccaaaaagaaaagaaaaaagauauauauauauauauau

SEQ ID NO: 43559 - RNA, 64 nt, Homo Sapiens
cugggcaacaagagcaaaacuccgucucaaaauaaaaagaaaagaaaagaauggacaguguuug

SEQ ID NO: 43560 - RNA, 64 nt, Homo Sapiens
caacaagagcaaaacuccgucucaaaauaaaaagaaaagaaaagaauggacaguguuugcagag

SEQ ID NO: 43561 - RNA, 64 nt, Homo Sapiens
ucaaagacucuuguccucuugucccuccugagaaaaaagaaaacgaaaagugggguuuuuuucu

SEQ ID NO: 43562 - RNA, 64 nt, Homo Sapiens
auuuuaauuguaacauuuuuagaaaaagaacaaaaaaagaaaaaaaaaagaaagaaacacagca

SEQ ID NO: 43563 - RNA, 64 nt, Homo Sapiens
aacauuuuuagaaaaagaacaaaaaaagaaaaaaaaaagaaagaaacacagcaacuguagaugc

SEQ ID NO: 43564 - RNA, 64 nt, Homo Sapiens
gggaagggaccuugcagggaccucucccuccaaaaaaagaaaaaaagaaaaagaaagaaaaaau

SEQ ID NO: 43565 - RNA, 64 nt, Homo Sapiens
accuugcagggaccucucccuccaaaaaaagaaaaaaagaaaaagaaagaaaaaauaaaugagg

SEQ ID NO: 43566 - RNA, 64 nt, Homo Sapiens
cagggaccucucccuccaaaaaaagaaaaaaagaaaaagaaagaaaaaauaaaugaggaaacgu

SEQ ID NO: 43567 - RNA, 64 nt, Homo Sapiens
aauaaacaaacuaauaaaaagcaaaaaaaaaaaaaaaagaaaagaaaaaacacugcauuugggc

SEQ ID NO: 43568 - RNA, 64 nt, Homo Sapiens
acaaacuaauaaaaagcaaaaaaaaaaaaaaaagaaaagaaaaaacacugcauuugggcaccau

SEQ ID NO: 43569 - RNA, 64 nt, Homo Sapiens
aaaaaaaaaaaaaaaaaaaaggaaagaaagaaagaaaagaaaagaaaauccuuuuugcuuuaac

SEQ ID NO: 43570 - RNA, 64 nt, Homo Sapiens
aaaaaaaaaaaaaaaggaaagaaagaaagaaaagaaaagaaaauccuuuuugcuuuaacuugcc

SEQ ID NO: 43571 - RNA, 64 nt, Homo Sapiens
gaagugagaagggaaguuuagagaaaaaaaauuaaaaagaaacaaagucuccaagaaauauggg

SEQ ID NO: 43572 - RNA, 64 nt, Homo Sapiens
gggaucuaauuaaacuaaagaccuucugcacagcaaaagaaacuaccaucagagucaacaggca

SEQ ID NO: 43573 - RNA, 64 nt, Homo Sapiens
uacucaaucuaggacauguuccuuuacuccuuaaaaaagaaaggaaagaucucuaaauucaaag

SEQ ID NO: 43574 - RNA, 64 nt, Homo Sapiens
aaaauacuaagacgugauagugaaaauagcuuugaaaagaaacuacauauggcaaaggugggga

SEQ ID NO: 43575 - RNA, 64 nt, Homo Sapiens
ucaaaaucccccaaauguuaagguauaugguaaaaaaagaaauaucugggaucccgauguucuu

SEQ ID NO: 43576 - RNA, 64 nt, Homo Sapiens
auaccaguuauaugaauugacuuaaguaucuugaaaaagaaacuuuagagaaagcaucaggggu

SEQ ID NO: 43577 - RNA, 64 nt, Homo Sapiens
aagaaagaaagggaaagauggaaggaaggaaggaaaaagaaagagaaagagagagagagagaaa

SEQ ID NO: 43578 - RNA, 64 nt, Homo Sapiens
gaaaaagaaagagaaagagagagagagagaaagaaaaagaaagaaaaguaagaaagaaaaaaga

SEQ ID NO: 43579 - RNA, 64 nt, Homo Sapiens
gagagaaagaaaaagaaagaaaaguaagaaagaaaaaagaaaaagaaagaaaaguaagaaagaa

SEQ ID NO: 43580 - RNA, 64 nt, Homo Sapiens
aagaaaaagaaagaaaaguaagaaagaaaaaagaaaaagaaagaaaaguaagaaagaaaaaaag

SEQ ID NO: 43581 - RNA, 64 nt, Homo Sapiens
uuuaggcagcaagaauuggagaacucacacugcgaaaagaaaaccuuggguggcagugauuuga

SEQ ID NO: 43582 - RNA, 64 nt, Homo Sapiens
agagcgagacuccaucuuaaaaaaaaaaaaaaaaaaaagaaagaaaagaaaauggaguucugag

SEQ ID NO: 43583 - RNA, 64 nt, Homo Sapiens
cuccaucuuaaaaaaaaaaaaaaaaaaaagaaagaaaagaaaauggaguucugagagcuaggaa

SEQ ID NO: 43584 - RNA, 64 nt, Homo Sapiens
cuccagucuggcaacagagcaagacuccaucucaaaaagaaaagaaaagaagacucugaccugu

SEQ ID NO: 43585 - RNA, 64 nt, Homo Sapiens
gucuggcaacagagcaagacuccaucucaaaaagaaaagaaaagaagacucugaccuguacucu

SEQ ID NO: 43586 - RNA, 64 nt, Homo Sapiens
gggugacacagcaagacuccaucucaaaaaaaaaaaaagaaaaagaaaugaauggguucaaaga

SEQ ID NO: 43587 - RNA, 64 nt, Homo Sapiens
cacagcaagacuccaucucaaaaaaaaaaaaagaaaaagaaaugaauggguucaaagaccauaa

SEQ ID NO: 43588 - RNA, 64 nt, Homo Sapiens
aauugucacauacccaugugacccgauaggaggcaaaagaaaugagacuucugggauuaguuua

SEQ ID NO: 43589 - RNA, 64 nt, Homo Sapiens
cuuuuaaaugaaaaggugaaaguucucaacuuaaaaaagaaaagaaaaaaaucauauacugagg

SEQ ID NO: 43590 - RNA, 64 nt, Homo Sapiens
aaaugaaaaggugaaaguucucaacuuaaaaaagaaaagaaaaaaaucauauacugagguugcu

SEQ ID NO: 43591 - RNA, 64 nt, Homo Sapiens
aaccaccucuacauauuaugaaagaaaaaaaaaaaaaagaaacacaaaaaaaaaaguaaaaaga

SEQ ID NO: 43592 - RNA, 64 nt, Homo Sapiens
aaaaaaaaagaaacaaaccaaaaaaaguaaaaagaaaagaaaaaucugccaggggcgggcaaaa

SEQ ID NO: 43593 - RNA, 64 nt, Homo Sapiens
aaaaaaaaaaaaaagaaacacaaaaaaaaaaguaaaaagaaaagagagcucugccaggggcggg

SEQ ID NO: 43594 - RNA, 64 nt, Homo Sapiens
acacagaagagauuuaaaaaaaaaaagcaacaaaaaaagaaaacaaacacaaacagaagaggaa

SEQ ID NO: 43595 - RNA, 64 nt, Homo Sapiens
aaucaaaaaagcgacaaaaagcugcaaggaacaaaaaagaaaaauaaacgucuguggagcuucu

SEQ ID NO: 43596 - RNA, 64 nt, Homo Sapiens
auuuuggcagguuauguuuaaagacaaaaaaaaaaaaagaaaaugaaaaaaaaaaacacaaaaa

SEQ ID NO: 43597 - RNA, 64 nt, Homo Sapiens
aacucuaugaauguaaaccaaauaaaaaaaaagaaaaagaaauaugagacuccaucucaaaaaa

SEQ ID NO: 43598 - RNA, 64 nt, Homo Sapiens
gaaauaaacucuaugaauguaaaaaaaauaaaaaaaaagaaaaaacagagugagacuccaucuc

SEQ ID NO: 43599 - RNA, 64 nt, Homo Sapiens
aaaucucaucacuugaagccaaaaaaaaaaaaagaaaagaaaaaaaaagaaaaaaaaaagacaa

SEQ ID NO: 43600 - RNA, 64 nt, Homo Sapiens
aaaaaaaaucucaucacuuggacaaaaaaaaaaaaaaagaaaagaauggaaaagaaaaaaaaaa

SEQ ID NO: 43601 - RNA, 64 nt, Homo Sapiens
aaaaagacaaaaaaaaaaaauuucaacgaaauggaaaagaaaaacuuccccauugcuguaaaua

SEQ ID NO: 43602 - RNA, 64 nt, Homo Sapiens
auuggcaaagagagcuggaauaaaauauucuagcaaaagaaauagaagauagacacauuuggau

SEQ ID NO: 43603 - RNA, 64 nt, Homo Sapiens
aaccaccuaggaauuuaauacaaaaauguggcuuaaaagaaauuuaaaauuaauuagaaacuau

SEQ ID NO: 43604 - RNA, 64 nt, Homo Sapiens
aauuacuacugcuaaauguguuuaaagaaugaguaaaagaaagccccgacucucacuucauaug

SEQ ID NO: 43605 - RNA, 64 nt, Homo Sapiens
uucuacauauuaaaacuugucuaucucaaagaaaaaaagaaaauugggcaacaagagcaaaacu

SEQ ID NO: 43606 - RNA, 64 nt, Homo Sapiens
ugaggaugaauaacaaguuuccuuuuguucauacaaaagaaaaaagaugauauaucuggaaugu

SEQ ID NO: 43607 - RNA, 64 nt, Homo Sapiens
gccagaaaaaguuggugcccaaaaaaaagaaaagaaaagaaaaagagcaacacucugucucaaa

SEQ ID NO: 43608 - RNA, 64 nt, Homo Sapiens
aaaaagccagaaaaaguuggucaaaaaaaaaaagaaaagaaaagcagcagagcaacacucuguc

SEQ ID NO: 43609 - RNA, 64 nt, Homo Sapiens
aaaagaaaaagccagaaaaacugucucaaaaaaaaaaagaaaagcugggcagcagagcaacacu

SEQ ID NO: 43610 - RNA, 64 nt, Homo Sapiens
auauaaaaauacuuuauugcuccauuauuuuuuaaaaagaaauucugaugcccuuauuugaagc

SEQ ID NO: 43611 - RNA, 64 nt, Homo Sapiens
auaccugaugcccuuauuugaaaccccaucuauuaaaagaaaaaucagccuggacaacauggca

SEQ ID NO: 43612 - RNA, 64 nt, Homo Sapiens
aaaacugaucaaaagcauaauugaaaguucugaaaaaagaaaaauaauaauauguagaaaaaug

SEQ ID NO: 43613 - RNA, 64 nt, Homo Sapiens
cauuagacacuuaauaaaacuuaacuuccaaugaaaaagaaaucuuuuguaaaucauucuacuu

SEQ ID NO: 43614 - RNA, 64 nt, Homo Sapiens
uuucauuugagagggagagcugugguacuggcuaaaaagaaaggaagauaacauccaguaacca

SEQ ID NO: 43615 - RNA, 64 nt, Homo Sapiens
aagaauaagcagcagaacccuguuccauauggaaaaaagaaaaacaauuuuuugucccuaaugu

SEQ ID NO: 43616 - RNA, 64 nt, Homo Sapiens
gcaagacacgcacagucaaccauuuuccgagaaaaaaagaaaauuccccacuuggaaagaaaga

SEQ ID NO: 43617 - RNA, 64 nt, Homo Sapiens
gggccacugcagaugacucuccuuugaaaugagaaaaagaaaagaaagcaagaacagaaaacga

SEQ ID NO: 43618 - RNA, 64 nt, Homo Sapiens
acugcagaugacucuccuuugaaaugagaaaaagaaaagaaagcaagaacagaaaacgaagcca

SEQ ID NO: 43619 - RNA, 64 nt, Homo Sapiens
cagccugggcaacauagcgagaccucaucuccaaaaaagaaaacaaaaaacaaaaaaaggaaug

SEQ ID NO: 43620 - RNA, 64 nt, Homo Sapiens
agaguccaucuguuuguccaucugcugaaaugagaaaagaaaaauuuaugcacugauuuaaaac

SEQ ID NO: 43621 - RNA, 64 nt, Homo Sapiens
aaaauuuaugcacugauuuaaaacaaaccaaaaaaaaagaaaaaaacaaaaaaaaaaaucccuc

SEQ ID NO: 43622 - RNA, 64 nt, Homo Sapiens
aagcacacccgugguugugaaaauaguauagcaaaaaagaaaaauccccgguuauugauguacu

SEQ ID NO: 43623 - RNA, 64 nt, Homo Sapiens
aucaugggauuuaaauuuaucauaaccauguguaaaaagaaauuaauguaugaugacaucucac

SEQ ID NO: 43624 - RNA, 64 nt, Homo Sapiens
ccaacccaguucuguuugacuauguagcaucuugaaaagaaaaauuauaauaaagccccaaaau

SEQ ID NO: 43625 - RNA, 64 nt, Homo Sapiens
ucucagucauccuggcagccaaaaaugugccaggaaaagaaagaauguggagcacgcguggcuc

SEQ ID NO: 43626 - RNA, 64 nt, Homo Sapiens
cuuuuuuaaaccagaauaaaguagaaagaaaagaaaaagaaaauuuaaccaggacuauguagaa

SEQ ID NO: 43627 - RNA, 64 nt, Homo Sapiens
gaaaaucuuuuuuaaaccagguagaaguagaaagaaaagaaaaaauuaauuuaaccaggacuau

SEQ ID NO: 43628 - RNA, 64 nt, Homo Sapiens
aaggaaaacaaaaagcacuugcaaaaaaaaaaaaaaaagaaagaauugaaagaauacuuuucug

SEQ ID NO: 43629 - RNA, 64 nt, Homo Sapiens
aagaaaaaaucccugcccucaauccuguguuuaaaaaagaaaaauaaauaagaauuuuaauaaa

SEQ ID NO: 43630 - RNA, 64 nt, Homo Sapiens
ccuguaggcagggagcccucuuucucaaauauggaaaagaaaacuuuauuuuauugugcaaaca

SEQ ID NO: 43631 - RNA, 64 nt, Homo Sapiens
guuccgggcauuuugcaucauaaaaagaaaaaaaaaaagaaaaacgguauuuuuguuuguaagu

SEQ ID NO: 43632 - RNA, 64 nt, Homo Sapiens
aaaaaagaaaaaguuccggguuguuuguaaguuaaaaagaaaaagguuuauuauuacgguauuu

SEQ ID NO: 43633 - RNA, 64 nt, Homo Sapiens
cgauuuaaaaaaaaaaaaaaaaaaaaaaaaaagaaaaagaaaaaguauuaacuuuaacuuauua

SEQ ID NO: 43634 - RNA, 64 nt, Homo Sapiens
gaaaaacgauuuaaaaaaaauuauuaaaaaaaaaaaaagaaaaaauauuuguauuaacuuuaac

SEQ ID NO: 43635 - RNA, 64 nt, Homo Sapiens
aaguugauguaugucccaaguuuuuaagguacugaaaagaaauggucccagaacugauguuuuu

SEQ ID NO: 43636 - RNA, 64 nt, Homo Sapiens
cccucgcaguuguggacauuucuguggccaguguaaaagaaaaugugguggugucaauaaacgc

SEQ ID NO: 43637 - RNA, 64 nt, Homo Sapiens
aaauuucuacaguagucuuuugugucuugaaggcaaaagaaaaaaccacguuucuuuguugagc

SEQ ID NO: 43638 - RNA, 64 nt, Homo Sapiens
aaaaaaccacguuucuuuguaaaaaaaaaaagaaaaaagaaaaacacaagcuaagagagcuugc

SEQ ID NO: 43639 - RNA, 64 nt, Homo Sapiens
agaaaaaaaaaaaccacguuagcuugcaaaaaaaaaaagaaaaacugaaugcacaagcuaagag

SEQ ID NO: 43640 - RNA, 64 nt, Homo Sapiens
aucaugaugaauaaaauguccgaaaagaagaaacaaaagaaagcgaaaaagaaaaagaagaaaa

SEQ ID NO: 43641 - RNA, 64 nt, Homo Sapiens
gaagaaaacgaaaagaagaaguugcugaaauugaaaaagaaaaacugaagaaauugagaaguau

SEQ ID NO: 43642 - RNA, 64 nt, Homo Sapiens
gguagauguaguugcuuaguagcauuuuggaaaaaaaagaaaaaaagguuugguuugguuuugu

SEQ ID NO: 43643 - RNA, 64 nt, Homo Sapiens
gagcgaaacuccgucucaaaaaaaaaaaaaaaaaaaaagaaagaaaagaguaacagaaagauag

SEQ ID NO: 43644 - RNA, 64 nt, Homo Sapiens
auguucagugagccuguuucauuugcuauauagaaaaagaaacuccuauuuuuaccuugcugga

SEQ ID NO: 43645 - RNA, 64 nt, Homo Sapiens
cucuccccggguagugaugaacauuuacuacuauaaaagaaacagcuauuuaaugaaauuuuga

SEQ ID NO: 43646 - RNA, 64 nt, Homo Sapiens
uaguaagaugaguggaaguguuuaucgagcaugcaaaagaaacccucacggcuaagggcucugg

SEQ ID NO: 43647 - RNA, 64 nt, Homo Sapiens
gaacuguugguuauuuguguaaugaaugugcaaaaaaagaaaaaacuuuuuuuguucuagggga

SEQ ID NO: 43648 - RNA, 64 nt, Homo Sapiens
uuuuauacccuugacuuaaccaaugcugugaauaaaaagaaagaugugaaugcuucugauuuag

SEQ ID NO: 43649 - RNA, 64 nt, Homo Sapiens
guaagccucugcaauuuuaaugcauauuugaaauaaaagaaagcuuauuccugguuaaucacua

SEQ ID NO: 43650 - RNA, 64 nt, Homo Sapiens
aagccuuuugauaugcauucccucaugaaagaacaaaagaaaugaaaauuugaugugcuacaag

SEQ ID NO: 43651 - RNA, 64 nt, Homo Sapiens
uauugcugaucacaaggacaagucucaaaaagaaaaaagaaauuugggcaacagagcgagacuc

SEQ ID NO: 43652 - RNA, 64 nt, Homo Sapiens
agaaauuuauugcugaucacgagacucagucucaaaaagaaaaauccagccugggcaacagagc

SEQ ID NO: 43653 - RNA, 64 nt, Homo Sapiens
uauugcugauuggccaggugaaugggguaaauagaaaagaaauuugaagugugaauuaauaaga

SEQ ID NO: 43654 - RNA, 64 nt, Homo Sapiens
cggaauucaaaaguuacaaaaaggguauucuuggaaaagaaaguuguuuuuuuuuagucuugcu

SEQ ID NO: 43655 - RNA, 64 nt, Homo Sapiens
agucacauacacuacacacacugugccacguuuaaaaagaaaaaaaacaauucucggcugggcg

SEQ ID NO: 43656 - RNA, 64 nt, Homo Sapiens
ucgacagagugaacucugucucaaaaaaaaaaaaaaaagaaaagaaagaagaagccauucccaa

SEQ ID NO: 43657 - RNA, 64 nt, Homo Sapiens
agagugaacucugucucaaaaaaaaaaaaaaaagaaaagaaagaagaagccauucccaacguug

SEQ ID NO: 43658 - RNA, 64 nt, Homo Sapiens
guugauuucuuaaugaugacuucaaaaauuaauaaaaagaaaagaaaaaaaugauuucuggccg

SEQ ID NO: 43659 - RNA, 64 nt, Homo Sapiens
uuucuuaaugaugacuucaaaaauuaauaaaaagaaaagaaaaaaaugauuucuggccgggcgu

SEQ ID NO: 43660 - RNA, 64 nt, Homo Sapiens
gcaccaaugugagaaccugucuuggaaaaaaaaaaaaagaaacauguuuuaguagaaguuuuau

SEQ ID NO: 43661 - RNA, 64 nt, Homo Sapiens
aaaagaaacauguuuuaguagaaguuuuauuugaaaaagaaaaauaagcauaaauauauuccca

SEQ ID NO: 43662 - RNA, 64 nt, Homo Sapiens
cauuucugaaaugcuugguucuuuuuugacucuuaaaagaaauuguguuaggcaauccuguaau

SEQ ID NO: 43663 - RNA, 64 nt, Homo Sapiens
ugucugccacaguauguuacaaaaguuuuuuuaaaaaagaaacuauuuaaagggggggaaccuc

SEQ ID NO: 43664 - RNA, 64 nt, Homo Sapiens
agaagcccaaacuagugagaguuuuguaaaaagaaaaagaaaaacauuucucuuuccagcugcu

SEQ ID NO: 43665 - RNA, 64 nt, Homo Sapiens
gaaaaaagaagcccaaacuagcugcuguuuuguaaaaagaaaaacaccuacauuucucuuucca

SEQ ID NO: 43666 - RNA, 64 nt, Homo Sapiens
ggaucugcggaaguaaccacaaaauauuaucgaaaaaagaaaagaauucuaaugaccagccgug

SEQ ID NO: 43667 - RNA, 64 nt, Homo Sapiens
uucuguuuuuuaaccuuuuguuccgccauuuaaaaaaagaaaaaaaaaaagcuuauguuucuug

SEQ ID NO: 43668 - RNA, 64 nt, Homo Sapiens
auuauuuucagaaaaacacugacugugucauuuaaaaagaaauaaaugauauguuauuauccca

SEQ ID NO: 43669 - RNA, 64 nt, Homo Sapiens
aucauacuaaagacauuugcgcuuacuuuguugaaaaagaaaaagaaauuaaauuugaacacag

SEQ ID NO: 43670 - RNA, 64 nt, Homo Sapiens
cuaaagacauuugcgcuuacuuuguugaaaaagaaaaagaaauuaaauuugaacacagugaaag

SEQ ID NO: 43671 - RNA, 64 nt, Homo Sapiens
guauucuguuuauauuauacauauauauacacguaaaagaaauauccaagaaagugaugacauu

SEQ ID NO: 43672 - RNA, 64 nt, Homo Sapiens
uuuagaaguaaaacacaaaacaaaaaagagagagaaaagaaaagaaaucacaauguauauaaaa

SEQ ID NO: 43673 - RNA, 64 nt, Homo Sapiens
aaguaaaacacaaaacaaaaaagagagagaaaagaaaagaaaucacaauguauauaaaacagua

SEQ ID NO: 43674 - RNA, 64 nt, Homo Sapiens
guuggaauuucuuugaauucuguuaguaaugcccaaaagaaaagucucaagcagucccccuauc

SEQ ID NO: 43675 - RNA, 64 nt, Homo Sapiens
agaguaucuagaagggugaaaacaaaaaaaaauaaaaagaaacacagacgcccaggugucagcu

SEQ ID NO: 43676 - RNA, 64 nt, Homo Sapiens
cuuuuguuaacuugauaauucuucaucuaccuuaaaaagaaaaaaauuacacauagucauucuu

SEQ ID NO: 43677 - RNA, 64 nt, Homo Sapiens
uaaauggguugccaacauaagcuggcugagaaauaaaagaaaacaagacaguuguucauaaagu

SEQ ID NO: 43678 - RNA, 64 nt, Homo Sapiens
ucuagaaauucucaguaugggguuucccucuggaaaaagaaaaucugaagacauuacaguugcc

SEQ ID NO: 43679 - RNA, 64 nt, Homo Sapiens
ccagcuccuaccaguccagugugcuuauaagugcaaaagaaaguaaaggcaaccccagauuucu

SEQ ID NO: 43680 - RNA, 64 nt, Homo Sapiens
ccuguuaauuauagaauggaccaaauacauuuuuaaaagaaaacugagaccaaucagauggaaa

SEQ ID NO: 43681 - RNA, 64 nt, Homo Sapiens
uuggacaaacaguucuuuuacagugguuauauggaaaagaaauugauugcuauuuuggggggcu

SEQ ID NO: 43682 - RNA, 64 nt, Homo Sapiens
aaaugagaaaaaaguaagaauauaaaaaagagaaaaaagaaaaagaaaaaauauacuugcuauc

SEQ ID NO: 43683 - RNA, 64 nt, Homo Sapiens
uguuuuuagaaaugcguacaagugaccucuagaaaaaagaaaaggugauauaucaguguuugag

SEQ ID NO: 43684 - RNA, 64 nt, Homo Sapiens
uguauauagcugugaguuuaaagagacuuuguaaaaaagaaaaaugccagccugaacuauauuu

SEQ ID NO: 43685 - RNA, 64 nt, Homo Sapiens
aaauuauuaaauguuucucacuucauuuucuuaaaaaagaaaaacuuuuccucaaguuacuuuc

SEQ ID NO: 43686 - RNA, 64 nt, Homo Sapiens
uacucaagaaaagacagaagaagaacuuaagagaaaaagaaacccaacacuaacaugagaacac

SEQ ID NO: 43687 - RNA, 64 nt, Homo Sapiens
uguugaagaaaggacagaaggcacaggaaagagaaaaagaaaucuccgagaaagaagaacguaa

SEQ ID NO: 43688 - RNA, 64 nt, Homo Sapiens
aagccaugauguacccuccggcuuaagcaucgaaaaaagaaaaagucaaggucaguucaggaaa

SEQ ID NO: 43689 - RNA, 64 nt, Homo Sapiens
aaagaucacauuuuaccuguguggcaguguuguaaaaagaaacucuuugagacuuuguuuacgu

SEQ ID NO: 43690 - RNA, 64 nt, Homo Sapiens
uauaauggagaaaaaauugaacucaaugccuuuuaaaagaaaguacucaaacucaguauuaccu

SEQ ID NO: 43691 - RNA, 64 nt, Homo Sapiens
aggggcaaggagccccgcggaaagaaaagaaggaaaaagaaaaacucuucuuucccauuuuaaa

SEQ ID NO: 43692 - RNA, 64 nt, Homo Sapiens
aaggaaaaagaaaaaaggggcuuucccauuuuaaaaaagaaaagucuucuacccucccccucuu

SEQ ID NO: 43693 - RNA, 64 nt, Homo Sapiens
uguuucuaccaaacauuucccccaccgaaaaaagaaaagaaaucgugaaaugucacuccauuga

SEQ ID NO: 43694 - RNA, 64 nt, Homo Sapiens
aaaucuguuucuaccaaacaauugacccaccgaaaaaagaaaagcaguggugaaaugucacucc

SEQ ID NO: 43695 - RNA, 64 nt, Homo Sapiens
uguucugaaguaccugauacuuugagaugucuguuucuucuagaagguaacaacgcuaagcuuu

SEQ ID NO: 43696 - RNA, 64 nt, Homo Sapiens
auuguuugagcucaagguaguugggaugucguuuuucuucuaaugaccuuggaagacagggcac

SEQ ID NO: 43697 - RNA, 64 nt, Homo Sapiens
acuagagggcuaaggauucugucugcugcuuuguuucuucuaaguaggcauuuagaucauuccu

SEQ ID NO: 43698 - RNA, 64 nt, Homo Sapiens
gaacuuuauuuacaguacuuugauuuggcagguuuucuucuacuugugcucugccuggagcugu

SEQ ID NO: 43699 - RNA, 64 nt, Homo Sapiens
uggaaagauagacagcagccugacaggaaauguuuucuucuacagugacuuuuuuuaagcaucc

SEQ ID NO: 43700 - RNA, 64 nt, Homo Sapiens
aaucaaaugacugauaagcauuauuuggggauuuuucuucuagaucaggauagaacagccuggc

SEQ ID NO: 43701 - RNA, 64 nt, Homo Sapiens
gcaguaagaauuagguggaaacaaacgugcuuuauucuucuaaccuacgauaauguguacuaug

SEQ ID NO: 43702 - RNA, 64 nt, Homo Sapiens
acgugaagaaaauaguuugaucaaugccuaugaauucuucuaauugaaauucuuauuuugacca

SEQ ID NO: 43703 - RNA, 64 nt, Homo Sapiens
cuauaaggggcaaaaagucuuuuucuaauaaguauucuucuaugguaguaccuacagaucugcc

SEQ ID NO: 43704 - RNA, 64 nt, Homo Sapiens
uucuucuaugguaguaccuacagaucugcccuucuucuucuaaaggguaagucauaaucugugu

SEQ ID NO: 43705 - RNA, 64 nt, Homo Sapiens
ucaagguuuucauaugcagcucggauggacauuuuucuucuaagauggaacuuauuuuucagau

SEQ ID NO: 43706 - RNA, 64 nt, Homo Sapiens
ccaccaauaaaaggauuuuucuugcuguuuugauuucuucuauuauuuguggaaugaauuauac

SEQ ID NO: 43707 - RNA, 64 nt, Homo Sapiens
uccauccaaucacacugcugugauucagggaucuuucuucuaagacggacacauuugaaccuca

SEQ ID NO: 43708 - RNA, 64 nt, Homo Sapiens
cauggacacccuuaauuuuaaaagguuuuaaucauucuucuauaaaauacauuuaaaauggaaa

SEQ ID NO: 43709 - RNA, 64 nt, Homo Sapiens
ucuaaggauuuuuaaaaguuuacuucuugucuuguucuucuaaagcuuucuccaggacagauau

SEQ ID NO: 43710 - RNA, 64 nt, Homo Sapiens
aaccuuuacuuauuucggcauauuuccucugggcuucuucuaguuucugccuuacaagcaaugc

SEQ ID NO: 43711 - RNA, 64 nt, Homo Sapiens
cauuuuuucuucaaacaguacauugauuuuuuuuuucuucuaaaaguucaucucauuuguauuc

SEQ ID NO: 43712 - RNA, 64 nt, Homo Sapiens
caucauguccuauaguuugucuuccugaugaugauucuucuaggagggaacacaaauuuauggg

SEQ ID NO: 43713 - RNA, 64 nt, Homo Sapiens
aauuggaucauaguaaagagcuuaagcugcuuuuuucuucuauuauuuuaagucauaauuuguc

SEQ ID NO: 43714 - RNA, 64 nt, Homo Sapiens
gccuacguugguuaggcugaauuguaucauucaguucuucuaaauuuccuagguagaucaaucc

SEQ ID NO: 43715 - RNA, 64 nt, Homo Sapiens
uuaacacuauugaacagccgacuuugagcauuguuucuucuaacugccccucaacuaccauuau

SEQ ID NO: 43716 - RNA, 64 nt, Homo Sapiens
aguauuugaagcucuuaaaauguacauauuuugguucuucuaucucaaauuauuuaaaaugcau

SEQ ID NO: 43717 - RNA, 64 nt, Homo Sapiens
gccucagagaguugaggaccgcagcauccccuccacuccagaguugggugguauggauuuucaa

SEQ ID NO: 43718 - RNA, 64 nt, Homo Sapiens
acagcacacaauuucaagccauuuucagaucagaacuccagaaguguugacaagaugccuauuc

SEQ ID NO: 43719 - RNA, 64 nt, Homo Sapiens
acaguugcaguauuucaaagucccuauccaggucacuccagaaaaggguauugaaacguugaaa

SEQ ID NO: 43720 - RNA, 64 nt, Homo Sapiens
cucauaacauauaugagguauacaaaauuuucuaacuccagauuguagucauuuugagagguac

SEQ ID NO: 43721 - RNA, 64 nt, Homo Sapiens
cugcuguugccauagccccagaaaagacccugagacuccagaaucccuguaacuuaucuagaaa

SEQ ID NO: 43722 - RNA, 64 nt, Homo Sapiens
cugagcccccggcuaguaccucggaagccgucugacuccagagucuugucugaggccucauccc

SEQ ID NO: 43723 - RNA, 64 nt, Homo Sapiens
ggacaauguccccuauucagcuugugguucucuaacuccagaaacagagcacagaccccagagu

SEQ ID NO: 43724 - RNA, 64 nt, Homo Sapiens
auguacaaaacacagccacuuucauauaaagguuacuccagaccccacacaccugggcagccac

SEQ ID NO: 43725 - RNA, 64 nt, Homo Sapiens
aaugcuaccuuuugggaaacaaacugccccguuaacuccagaucauugcacuggaauguaauca

SEQ ID NO: 43726 - RNA, 64 nt, Homo Sapiens
uaauuuacugugacuagauuugaagcaaauaaauacuccagauccaugcagcuagaacacacuu

SEQ ID NO: 43727 - RNA, 64 nt, Homo Sapiens
ucugaccucaucaugguucuaguucucauacagaacuccagaauuuuuaaagaacucuauaauu

SEQ ID NO: 43728 - RNA, 64 nt, Homo Sapiens
ccauguggcccaccagcagccuuuccaaaggggaacuccagagacauuucauaaugcaaacagc

SEQ ID NO: 43729 - RNA, 64 nt, Homo Sapiens
aucccuuccugcccaucccuucccuacaaugcccacuccagacgcaaagauacacuuuuuuccu

SEQ ID NO: 43730 - RNA, 64 nt, Homo Sapiens
cuaaaaugcagcuguuguuagacaacuguugaaaacuccagaaauacaucacccaagguggcag

SEQ ID NO: 43731 - RNA, 64 nt, Homo Sapiens
aagccuccgcaggaugccggacaauggugaagaaacuccagauaucaaggaauugggaaauccu

SEQ ID NO: 43732 - RNA, 64 nt, Homo Sapiens
ucagcaaaucucaugauaaaggacaaggucaagaacuccagagcacugagcagagaggcuggug

SEQ ID NO: 43733 - RNA, 64 nt, Homo Sapiens
cuugggccguccccauuugccagcagggaacaaaacuccagacuauuacuggguaaaagcaggg

SEQ ID NO: 43734 - RNA, 64 nt, Homo Sapiens
caguaguuagguuugguuugucauguugcaaagaacuccagagucaaccuaaaaauguaggcuu

SEQ ID NO: 43735 - RNA, 64 nt, Homo Sapiens
ucaugcucgcuucccuuggccaugcauguaguccacuccagaaacaguuuacugaacuccagac

SEQ ID NO: 43736 - RNA, 64 nt, Homo Sapiens
augcauguaguccacuccaguuccaguuuacugaacuccagaccuaagacuugggggugaaacu

SEQ ID NO: 43737 - RNA, 64 nt, Homo Sapiens
aacugcggcacgcgcuucgggucccccugcucccacuccagaagccuccucuacccaaagcucu

SEQ ID NO: 43738 - RNA, 64 nt, Homo Sapiens
ccugcccaggcucaggcccaugggggcuaugugcacuccagaccgucacugcccucucccugcc

SEQ ID NO: 43739 - RNA, 64 nt, Homo Sapiens
uuguggggagaguggggaaugguaaacacugggaacuccagaagcuucuggauacagccuuuug

SEQ ID NO: 43740 - RNA, 64 nt, Homo Sapiens
cgagggaagccagcuuccaacucccaaacccagcacuccagacuugaaagacugcaauagaaaa

SEQ ID NO: 43741 - RNA, 64 nt, Homo Sapiens
guccugcucacccuuuccuuuagccuccccaacuacuccagacuagaaacucacccaaagccug

SEQ ID NO: 43742 - RNA, 64 nt, Homo Sapiens
ugugaccuggcucugguucaaugcagggcccaggacuccagagcggaaugccagaggagcaagg

SEQ ID NO: 43743 - RNA, 64 nt, Homo Sapiens
uggggcucugggagggaugugguccuccauuucaacuccagaaggaagguaacugagagcagau

SEQ ID NO: 43744 - RNA, 64 nt, Homo Sapiens
ccacaaagccgugccuuucuuuccaaguuccugcacuccagaauccacccccuccagcuccagu

SEQ ID NO: 43745 - RNA, 64 nt, Homo Sapiens
cuucguccaaggcaccggugugugugugucuugcacuccagagcugaccuccaccgcccagccu

SEQ ID NO: 43746 - RNA, 64 nt, Homo Sapiens
gugccacccagccacuuagggucuacagggugggacuccagaccuagagcguaaguauggaugu

SEQ ID NO: 43747 - RNA, 64 nt, Homo Sapiens
uuccuugaccucauuauuuggucaucucuucagcaauccagagggaugugacuuuuuuuuuaaa

SEQ ID NO: 43748 - RNA, 64 nt, Homo Sapiens
ccuaauucuucaguucacuauuaagauaaacuguaauccagacagacagguuuuuuggaaacug

SEQ ID NO: 43749 - RNA, 64 nt, Homo Sapiens
uuuaauuuugccuucacaaaacagauuuacaugcaauccagaucaauggaaccacuacuuauau

SEQ ID NO: 43750 - RNA, 64 nt, Homo Sapiens
auugguuuuugccuauacuuaggacugaaauaauaauccagauauaagauuagcuauuauuugu

SEQ ID NO: 43751 - RNA, 64 nt, Homo Sapiens
gucauuuaaaauagaaccucaagaaauuuuuuaaaauccagaaauacaaaaaugauuguauuua

SEQ ID NO: 43752 - RNA, 64 nt, Homo Sapiens
aguuaaauuucaaaaucacaauucacugcucccuaauccagagcgauuucauaagucugccuug

SEQ ID NO: 43753 - RNA, 64 nt, Homo Sapiens
aauggauccuccaacaccacgacucugugcucacaauccagagcgccucagcccuggguggcca

SEQ ID NO: 43754 - RNA, 64 nt, Homo Sapiens
cgcugcugucuugcucucccguggcucggaggggaauccagaccuacuuagaaccugaccagau

SEQ ID NO: 43755 - RNA, 64 nt, Homo Sapiens
uuugagaagcaggaaauuuaaauagguagccaaaaauccagauaaacaccaaagacggaagcca

SEQ ID NO: 43756 - RNA, 64 nt, Homo Sapiens
guauuacauuugaaauuguuaguauugaaguucaaauccagauauaagaauuuuacuuaggaaa

SEQ ID NO: 43757 - RNA, 64 nt, Homo Sapiens
ccgauacaggcccuugguguugaacuacugcaggaauccagaugaauuuccaguggccugacaa

SEQ ID NO: 43758 - RNA, 64 nt, Homo Sapiens
cugggaaacaacccugguguggaacuacugcaggaauccagauuaauuugcaguggccugacca

SEQ ID NO: 43759 - RNA, 64 nt, Homo Sapiens
cuguggaaggcccuugguguugaacuacugcaggaauccagaucaauuuccagugacuugauca

SEQ ID NO: 43760 - RNA, 64 nt, Homo Sapiens
cacauccauugauuuuacagggauuuuaguucguaauccagaaaguaauaaucagggauuuuau

SEQ ID NO: 43761 - RNA, 64 nt, Homo Sapiens
guaauaaucagggauuuuauuuuaaucaggcaucaauccagauucacuguuauacugaaauauc

SEQ ID NO: 43762 - RNA, 64 nt, Homo Sapiens
ccuccaggccuccuucuggaucucucccuccauuucuacccagagaccuccagagaccauauuu

SEQ ID NO: 43763 - RNA, 64 nt, Homo Sapiens
aacauucaccaaucauuuauccucuuucuuggcuucuacccacaaugccauagaggucaguuuu

SEQ ID NO: 43764 - RNA, 64 nt, Homo Sapiens
gcaucccucuggucagaggccuggaagucuauacucuacccaggcgcagguuauccaccucugc

SEQ ID NO: 43765 - RNA, 64 nt, Homo Sapiens
gcagcagaccaauguguacaugacagagccaacuucuacccauuaagaauaacuugaucccuga

SEQ ID NO: 43766 - RNA, 64 nt, Homo Sapiens
cucccuucuagcagauuuugaaggcugguggcugucuacccaccuuuuguuugaauuuauaaac

SEQ ID NO: 43767 - RNA, 64 nt, Homo Sapiens
cucccuucuagcagauucuucggggcggguggcgucuacccaccacaaaccaaagugccuguga

SEQ ID NO: 43768 - RNA, 64 nt, Homo Sapiens
uagaacuucagugggagagcugucugguucauauucuacccaggaaugguacuuuucagugcag

SEQ ID NO: 43769 - RNA, 64 nt, Homo Sapiens
uugcacuguaggagauuuacuaauaucccuggccucuacccaguaguaccacuagcaccuauuc

SEQ ID NO: 43770 - RNA, 64 nt, Homo Sapiens
gagaccagcauguucuccccaaagacuggaauauucuacccaaaugucaggaccaggauuuucu

SEQ ID NO: 43771 - RNA, 64 nt, Homo Sapiens
ggaauauucuacccaaaugucaggaccaggauuuucuacccagagaccaagguguucuucccaa

SEQ ID NO: 43772 - RNA, 64 nt, Homo Sapiens
gagaccaagguguucuucccaaagaccaaaauauucuacccauaugucaggaccaggauuuucu

SEQ ID NO: 43773 - RNA, 64 nt, Homo Sapiens
aaaauauucuacccauaugucaggaccaggauuuucuacccagagaccaagguuaucuuccuaa

SEQ ID NO: 43774 - RNA, 64 nt, Homo Sapiens
gagaccaagguuaucuuccuaaagaccaaaauauucuacccauaugucaggaccgggauuuucu

SEQ ID NO: 43775 - RNA, 64 nt, Homo Sapiens
aaaauauucuacccauaugucaggaccgggauuuucuacccagagaccugcauguucucuccaa

SEQ ID NO: 43776 - RNA, 64 nt, Homo Sapiens
gagaccugcauguucucuccaacgaccagaauauucuacccaaaugucaggaccaagauuuucu

SEQ ID NO: 43777 - RNA, 64 nt, Homo Sapiens
uucugcacaucaugaugacuuuaccuccauucccucuacccagaacccuaaauuauucuguuau

SEQ ID NO: 43778 - RNA, 64 nt, Homo Sapiens
uggauuggggagguuggucagggaagagagggguucuacccacagaucaacuguguaaucuuuu

SEQ ID NO: 43779 - RNA, 64 nt, Homo Sapiens
uuagaagaauggaagguaaggggaaggucugucaucuacccaggacauucccaugaugaguaca

SEQ ID NO: 43780 - RNA, 64 nt, Homo Sapiens
aaccaguauuucacuuuuaaaaagacaaggcaucucuacccauuaacucugcaagccacuccac

SEQ ID NO: 43781 - RNA, 64 nt, Homo Sapiens
aacaaagaauauacauucuuuucaccccucccagucuacccauccagccuucaugauucauucc

SEQ ID NO: 43782 - RNA, 64 nt, Homo Sapiens
ucuguaaaucagauaaaugcuuggaauuugauugucuacccaaucaacaguuuucccucuuugc

SEQ ID NO: 43783 - RNA, 64 nt, Homo Sapiens
aauucaaacaauguugcauugauucuuuaaaccugugugcuaauuauuugccuuggauucugug

SEQ ID NO: 43784 - RNA, 64 nt, Homo Sapiens
gggcacagcaagacacugucacuggggacaggaugugugcuaaagaacagaaaacuauaaacuu

SEQ ID NO: 43785 - RNA, 64 nt, Homo Sapiens
guagaaaaugucuacuccucguaaacaucucccagugugcuauacauuucuaccuagaguacca

SEQ ID NO: 43786 - RNA, 64 nt, Homo Sapiens
aaaaaugaugucccauguucuggcuuguucacgugugugcuaugauaccuuguuuaaagaauaa

SEQ ID NO: 43787 - RNA, 64 nt, Homo Sapiens
accauugcuuucuguacugcuuugaaagaaguuucauuaaaagcacagcuagcauguucacaga

SEQ ID NO: 43788 - RNA, 64 nt, Homo Sapiens
aacuacuaaggaaagguuaaauucuucuucaguucauuaaaaguacuaggccuuugaugcuuua

SEQ ID NO: 43789 - RNA, 64 nt, Homo Sapiens
cauaaaagucuuccucuugcaauuucaugguauucauuaaaaagcuaacuuaguaaaguagaau

SEQ ID NO: 43790 - RNA, 64 nt, Homo Sapiens
guacaauaaaaauguuuaaacuccaauauaaacacauuaaaagaauaaaacauucuacccucac

SEQ ID NO: 43791 - RNA, 64 nt, Homo Sapiens
agaaaaauauuugggauaaguucaaguggauguccauuaaaagucauuaaaauuaagauuuguu

SEQ ID NO: 43792 - RNA, 64 nt, Homo Sapiens
aagauuuguuuucaaguggaugaaacuaaauugacauuaaaauuuaggcagcuggaaaaguauu

SEQ ID NO: 43793 - RNA, 64 nt, Homo Sapiens
ugauaaacaaaagaacgagucaguuguauccuuucauuaaaacuaucauguuguaaaguagcau

SEQ ID NO: 43794 - RNA, 64 nt, Homo Sapiens
auucugcuguguaauucuugguuucuauaaugaccauuaaaaaaaauaggugaagugcaagcua

SEQ ID NO: 43795 - RNA, 64 nt, Homo Sapiens
cauuucaguuguauuauaguccaguucuuaucaacauuaaaaccuauagcaaucauuucaaauc

SEQ ID NO: 43796 - RNA, 64 nt, Homo Sapiens
gcaugugcaggagacauaucauccaaacauaaaccauuaaaauguuugugguuugcuuggcugu

SEQ ID NO: 43797 - RNA, 64 nt, Homo Sapiens
uuuaugcuaauucugcuuauuuuagaguauuuuucauuaaaaggugagcaaagugaaagauacu

SEQ ID NO: 43798 - RNA, 64 nt, Homo Sapiens
ugauguagaguagggcaaaucuguguguguaugucauuaaaaaaauucuaccaucuuucuuuau

SEQ ID NO: 43799 - RNA, 64 nt, Homo Sapiens
ccauagcucuucacuuccuccagaagccuccuuacauuaaaaagccuuacaguuauccugcaag

SEQ ID NO: 43800 - RNA, 64 nt, Homo Sapiens
ggacaggaaggucugauuugcaggauuuuuagagcauuaaaauaacuaucaggcagaagaaucu

SEQ ID NO: 43801 - RNA, 64 nt, Homo Sapiens
ugguaaauugcucaauguaauucauugugauugucauuaaaaagucagucugaugguucuguuc

SEQ ID NO: 43802 - RNA, 64 nt, Homo Sapiens
gaaauuguaucaggacccauucuuucuagcucaucauuaaaaagcuagaggaugugaucuaauu

SEQ ID NO: 43803 - RNA, 64 nt, Homo Sapiens
uuucugaauugcaguugaauuaugcuucuaaauacauuaaaacauggagcacagguuugauauu

SEQ ID NO: 43804 - RNA, 64 nt, Homo Sapiens
aaaguuuaaguuuacgucaugugcuaguuuaagccauuaaaagugugagacauuaaacauuuua

SEQ ID NO: 43805 - RNA, 64 nt, Homo Sapiens
auugauuauacuuuccuaaaaugaaugcuauggucauuaaaauauggcagcagcauuugagucc

SEQ ID NO: 43806 - RNA, 64 nt, Homo Sapiens
uaauggcaaaaccaauauuugguuuuaaaccuggcauuaaaauguaaagcugcagcuuucaaca

SEQ ID NO: 43807 - RNA, 64 nt, Homo Sapiens
acuuuacacaccuguguaaauggaaauccuuuugcauuaaaagggguucugucccuggagacuc

SEQ ID NO: 43808 - RNA, 64 nt, Homo Sapiens
uucugcaucuuauaaugguacagggaccagaaaacauuaaaaagauuuggcccuauugaauuuu

SEQ ID NO: 43809 - RNA, 64 nt, Homo Sapiens
uaagccugccgccaaaauaacagagauuuguuuucauuaaaaaaucaaacuggccauuugacuu

SEQ ID NO: 43810 - RNA, 64 nt, Homo Sapiens
uuggaguucacccuaggugccugaucaagguccucauuaaaaaaauguuucaggcuuugugguc

SEQ ID NO: 43811 - RNA, 64 nt, Homo Sapiens
aauguuucaggcuuuguggugggcuguguuucugcauuaaaauaaaugcaaucaguguaacuag

SEQ ID NO: 43812 - RNA, 64 nt, Homo Sapiens
ugagacuaaaucuuuaucuuggggaaaaaacugacauuaaaagauccucauucccuuuaacaug

SEQ ID NO: 43813 - RNA, 64 nt, Homo Sapiens
uaccacucuaaucauuggccaucaguggacuaaacauuaaaaugcauuaaaauaauaucacagu

SEQ ID NO: 43814 - RNA, 64 nt, Homo Sapiens
auaucacaguaucaguggacuaaauuaaaccuugcauuaaaauaauaaaucuguaauaaaaaac

SEQ ID NO: 43815 - RNA, 64 nt, Homo Sapiens
augauaacugguaccuuaucuacuguaaauauuucauuaaaaaugaugcacacauagauauauu

SEQ ID NO: 43816 - RNA, 64 nt, Homo Sapiens
uuuaauguuuuauuggcaacguaugcugcuuuuucauuaaaauaugcuauuaaaauuaaauggc

SEQ ID NO: 43817 - RNA, 64 nt, Homo Sapiens
agcaguugaugugaguauugaaauaaacauuugacauuaaaauacugaggcaacuauggcauag

SEQ ID NO: 43818 - RNA, 64 nt, Homo Sapiens
gagggagagagauaauaaacucaguuuacacuaucauuaaaaaacugggggccaggaauuggau

SEQ ID NO: 43819 - RNA, 64 nt, Homo Sapiens
gucacuuuacaauuucaguaaaguaaauaucaaacauuaaaauguagucuugugccaauaagag

SEQ ID NO: 43820 - RNA, 64 nt, Homo Sapiens
gaguucuuauuauagaauaauaauggauaacgugcauuaaaauguagaauaucucacacauuug

SEQ ID NO: 43821 - RNA, 57 nt, Homo Sapiens
caaccacuacaaccgugugauguaugccauuaaaaaaauuguuuuuuuaauuuucua

SEQ ID NO: 43822 - RNA, 64 nt, Homo Sapiens
auauccuggguaugcauuauuuuaaauguuguaucauuaaaaaccucagaaugaugaaaaauau

SEQ ID NO: 43823 - RNA, 64 nt, Homo Sapiens
ggaccauaccuauuaaaaaaaaaggaucagagaccauuaaaagauggcguauggcacucauuaa

SEQ ID NO: 43824 - RNA, 64 nt, Homo Sapiens
gaucagagaccauuaaaagauggcguauggcacucauuaaaaagcaaaccugcaggcauaucau

SEQ ID NO: 43825 - RNA, 64 nt, Homo Sapiens
aauguugaacugcuuuuucuaacauuaaaauguucauuaaaauccauaauguucuguuauacau

SEQ ID NO: 43826 - RNA, 64 nt, Homo Sapiens
uucauuaaaaucaauguugaucuguuauacauaacauuaaaauguuccauuauauucauaaugu

SEQ ID NO: 43827 - RNA, 64 nt, Homo Sapiens
uuaaguuaaauauaaauguucaaagguaaaaauccauuaaaaccauuuuuuuuuugggugucug

SEQ ID NO: 43828 - RNA, 64 nt, Homo Sapiens
acacccucuacuugggcuuuguaagcaaaguagucauuaaaaauacauuugcacaaucuaaaau

SEQ ID NO: 43829 - RNA, 64 nt, Homo Sapiens
cucagcaguggguuucuuggagagugaggauuuucauuaaaaguacuaaaaauacgaggaaagg

SEQ ID NO: 43830 - RNA, 64 nt, Homo Sapiens
agcucaaaggggguuuaaaacaaagcaacugggucauuaaaacccuaaauaaauggcuuucaaa

SEQ ID NO: 43831 - RNA, 64 nt, Homo Sapiens
agaagugagaaaaacaauguuagacagucaauuccauuaaaauauuagaaagaccuauccaaau

SEQ ID NO: 43832 - RNA, 64 nt, Homo Sapiens
aaacaauuuacuuucuaauucucaguaacaaagacauuaaaagauauggcgcauucaaaacagu

SEQ ID NO: 43833 - RNA, 64 nt, Homo Sapiens
uuaccgagaggggacucaaaguguaagacucugccauuaaaacacaucugaagaaacuucccaa

SEQ ID NO: 43834 - RNA, 64 nt, Homo Sapiens
uaccacauguguuucugucuuuauccuagugggccauuaaaaacaucucaauuuaguuuguuau

SEQ ID NO: 43835 - RNA, 64 nt, Homo Sapiens
ucuccccuccccuccacaaaaaggagaaagagugcauuaaaauguuuaguuggguuuuuuaauu

SEQ ID NO: 43836 - RNA, 64 nt, Homo Sapiens
guuaaguaaacuuuaguguguaaguugaguuugucauuaaaaucauaaaccagcugcgguaaca

SEQ ID NO: 43837 - RNA, 64 nt, Homo Sapiens
ccugcaccuccgcagaccugcugugaugacuugccauuaaaagcauuguccaaaauccccuguu

SEQ ID NO: 43838 - RNA, 64 nt, Homo Sapiens
cugacaauagugccaggaaacuaauuuccugauacauuaaaaaaauuccaugcaccacuugcaa

SEQ ID NO: 43839 - RNA, 64 nt, Homo Sapiens
caaagugcagcagaguauuuauuuugaagagaaacauuaaaaguacaaagagguuuguaguacc

SEQ ID NO: 43840 - RNA, 64 nt, Homo Sapiens
auuauuuaugaccuuuucuguggaagaguaagaacauuaaaaugaaagaugcaugaugaaaauc

SEQ ID NO: 43841 - RNA, 64 nt, Homo Sapiens
agaccagacuuugugaaugguucagauauuuuuucauuaaaaaacaagguauggcagauggacu

SEQ ID NO: 43842 - RNA, 64 nt, Homo Sapiens
uguccaugucuaauaaguaaaaacugauagaauacauuaaaaagucacugguuuaucauagaaa

SEQ ID NO: 43843 - RNA, 64 nt, Homo Sapiens
auauauguuaauaaggaaguguguguuccaaaggcauuaaaauuaaauuacauuuauuaaaaaa

SEQ ID NO: 43844 - RNA, 64 nt, Homo Sapiens
uuuagcaauagaauguaaauuuugacaucuggcucauuaaaaaauaauaacaguggcucuaccu

SEQ ID NO: 43845 - RNA, 64 nt, Homo Sapiens
uguaauugaaauguugcuuugguaguuuaacaggcauuaaaauuacuucucagcuucucccaua

SEQ ID NO: 43846 - RNA, 64 nt, Homo Sapiens
aagcaaaucauuugcacucuauguagaauaaaagcauuaaaaaguuagccuaugguaguaauuu

SEQ ID NO: 43847 - RNA, 64 nt, Homo Sapiens
caaggcuccuuagauugggucguuacuaaaaguacauuaaaacacucuuguuuaucgaaguaua

SEQ ID NO: 43848 - RNA, 64 nt, Homo Sapiens
auucuuuugcauugaugaauuuuguaucugcuuccauuaaaagcauaacagccauaguuguugc

SEQ ID NO: 43849 - RNA, 64 nt, Homo Sapiens
gcuuucugaacucuaaugugccuucauugauuaucauuaaaauuaucauuaaaauugccuuauu

SEQ ID NO: 43850 - RNA, 64 nt, Homo Sapiens
cuaaugugccuucauugauuaucauuaaaauuaucauuaaaauugccuuauuucuauggacuca

SEQ ID NO: 43851 - RNA, 64 nt, Homo Sapiens
ucaauagucuauaaaaacaguuuuacuugcaauccauuaaaacaacaaacgaaaccuagugaag

SEQ ID NO: 43852 - RNA, 63 nt, Homo Sapiens
uacaaauguuuaaauaaaauauugauuaaaaaaacauuaaaagugcaucaugaccaggugaaa

SEQ ID NO: 43853 - RNA, 64 nt, Homo Sapiens
acugauucaugaagacguuuuugaaacuucuguacauuaaaagaagcgagcccaagucauguaa

SEQ ID NO: 43854 - RNA, 64 nt, Homo Sapiens
cuaaaggauauuauuguuugauuucaauaaaugacauuaaaaauaaguuucuguuaugauugcc

SEQ ID NO: 43855 - RNA, 64 nt, Homo Sapiens
ucuuuuggggagagacugucuaggcagaauaaagcauuaaaauuaccaggcagugaauaagccc

SEQ ID NO: 43856 - RNA, 64 nt, Homo Sapiens
gucagaauuugcuuacuauaguggaggcuauuuucauuaaaacuaucuucauaccugcaaaaug

SEQ ID NO: 43857 - RNA, 64 nt, Homo Sapiens
ccuguggauaauuaaguuauuauuguccagcagacauuaaaagcuuuauagcuuaucauucaug

SEQ ID NO: 43858 - RNA, 64 nt, Homo Sapiens
uauuauggaagaauguauuugcagguaguaauagcauuaaaaaauauacucguguguaaacaca

SEQ ID NO: 43859 - RNA, 64 nt, Homo Sapiens
aauagcaagaaaauugauguauauuuuaaugauacauuaaaauucccuuuuaaucauaauaguu

SEQ ID NO: 43860 - RNA, 64 nt, Homo Sapiens
ugaacaagguugaggagaaaugaauaagaugauccauuaaaaacaaacagguuguggcuccugu

SEQ ID NO: 43861 - RNA, 64 nt, Homo Sapiens
ucuugagaacuauaaagugaugaaaaggauaaaacauuaaaaacuaaacaauuuuuuucuaacg

SEQ ID NO: 43862 - RNA, 64 nt, Homo Sapiens
agggauuaaaugucuaggcuuuuucagaugugaacauuaaaaauuuuccauauuuuugaaagau

SEQ ID NO: 43863 - RNA, 64 nt, Homo Sapiens
acuuuuuguaauaaguuuaagauauaacacuaugcauuaaaagcuuuagugauauggcagcacg

SEQ ID NO: 43864 - RNA, 64 nt, Homo Sapiens
uuuguuguuguuguuguuguuuucuuaaguguuacauuaaaacucuaaccaaggaaaggguucu

SEQ ID NO: 43865 - RNA, 64 nt, Homo Sapiens
cauuuuuuccuuuacaauuuuaaacaaguuucuucauuaaaaacuauggugaugaaaugguuuu

SEQ ID NO: 43866 - RNA, 64 nt, Homo Sapiens
aaaaaaagacugucaaaugaacuuuuacagaaugcauuaaaaaaaaaaaaaaacuccugugucg

SEQ ID NO: 43867 - RNA, 64 nt, Homo Sapiens
uugauauaaucuuggcuucuuaaaaacuguguaucauuaaaauauauguucugcaagaauuaaa

SEQ ID NO: 43868 - RNA, 64 nt, Homo Sapiens
uauuuaaucagcguguacuccauuugcauugaagcauuaaaaauuauuuuucuuaaaaucucuu

SEQ ID NO: 43869 - RNA, 64 nt, Homo Sapiens
ucacucaguguuuguuaaauaaagcuauuagugucauuaaaauucaaaagacaguauaaugugu

SEQ ID NO: 43870 - RNA, 64 nt, Homo Sapiens
aaaaaauaaaucuugcucuguacaccuuuuugaucauuaaaauaguuuucauagugcuuucaaa

SEQ ID NO: 43871 - RNA, 64 nt, Homo Sapiens
uuucagaaaaucuugagguuuaagcaucaguugucauuaaaaguauauacccagucauaaagua

SEQ ID NO: 43872 - RNA, 64 nt, Homo Sapiens
aaaugucacuuaggucagcaauuacuguauuuggcauuaaaaaaaagccauuaaaagcuuggag

SEQ ID NO: 43873 - RNA, 64 nt, Homo Sapiens
uuggagauuacuguauuuggaucuuggcauaagccauuaaaagccagauuucacauauucuguc

SEQ ID NO: 43874 - RNA, 64 nt, Homo Sapiens
caguccuuugcugcuauccacugugauuuuuaugcauuaaaagcacauuucauguguauucaac

SEQ ID NO: 43875 - RNA, 64 nt, Homo Sapiens
ucuucuaguuugucuauuuuaauaaauggccuuacauuaaaaaauuguaaagaaauguauacca

SEQ ID NO: 43876 - RNA, 64 nt, Homo Sapiens
auuaauguauauaugaaaauagauacaaagaaaucauuaaaauuaaauauuaccuaaauugguu

SEQ ID NO: 43877 - RNA, 64 nt, Homo Sapiens
uaauaaacgaugcuauuuuaaugagcucaugacucauuaaaaaaugcuuuaugaagcuuuagaa

SEQ ID NO: 43878 - RNA, 64 nt, Homo Sapiens
ugucccagaggaaaggcccuaaacuuuuuuuuuucauuaaaagagacuuuugaagaacaaagua

SEQ ID NO: 43879 - RNA, 64 nt, Homo Sapiens
aaaguuguagggugggcuuugucacuuuuuagaacauuaaaaagucuguugaggaaaccuaggu

SEQ ID NO: 43880 - RNA, 64 nt, Homo Sapiens
aauucuguacagcuuuugauuauaacugcuuuagcauuaaaaauuguuuugaaagaagaacaca

SEQ ID NO: 43881 - RNA, 64 nt, Homo Sapiens
gauuuguaggcaaagauguuaagagcauuguuuccauuaaaaucaauaacaaugaaaaacgguu

SEQ ID NO: 43882 - RNA, 64 nt, Homo Sapiens
aaucaccaguggaacuaaacuugaaaucacuguccauuaaaaaagaacaaaaacaccaaaucau

SEQ ID NO: 43883 - RNA, 64 nt, Homo Sapiens
aaucaucucacaugcauuuuggguauguugcaugcauuaaaaaaucucggggacaacaucugaa

SEQ ID NO: 43884 - RNA, 64 nt, Homo Sapiens
aacuaaaacugaccugacuuaagcucagaaagcucauuaaaaacacaauuuugacauguuuucc

SEQ ID NO: 43885 - RNA, 64 nt, Homo Sapiens
uagaugcuuugucuaauuccuaauacugguucuccauuaaaauggccgaguuaccuggucacug

SEQ ID NO: 43886 - RNA, 64 nt, Homo Sapiens
gggaguucuagacuagccugggcgagacuucaucucuacaaaaaaagcaacaacgacaaaaaaa

SEQ ID NO: 43887 - RNA, 64 nt, Homo Sapiens
aaguccaaucugggcaacauggggaaaccccagcucuacaaaaaaaauuagccugguguggugg

SEQ ID NO: 43888 - RNA, 64 nt, Homo Sapiens
agauaaggucugaauaauagcagaaaaaccaacaucuacaaaacauuaaacuaguguuauacuu

SEQ ID NO: 43889 - RNA, 64 nt, Homo Sapiens
aguguacuauagcggcauauagagcuagcuaaucucuacaaacccucuguaggccaguaguucu

SEQ ID NO: 43890 - RNA, 64 nt, Homo Sapiens
aaucacagucugagcaacauggcaaaacccugugucuacaaaaaauaaaaaauuagcugggcau

SEQ ID NO: 43891 - RNA, 64 nt, Homo Sapiens
aauuaugaaaucaaaagcugguucuuugaaaagaucuacaaaauggcaaacauuuagcuagauu

SEQ ID NO: 43892 - RNA, 64 nt, Homo Sapiens
aaguauauacuuuuaaauuauggaguauuuuaagucuacaaaaagguauaaauaauaauauaau

SEQ ID NO: 43893 - RNA, 64 nt, Homo Sapiens
gacaccagccugggcaacauagugagaccuugucucuacaaaaaauaaaauaaaauaaaaacca

SEQ ID NO: 43894 - RNA, 64 nt, Homo Sapiens
gguggggaccuuggaaacaaguuuguccguccacucuacaaaguuuccuccucuccuacacuga

SEQ ID NO: 43895 - RNA, 64 nt, Homo Sapiens
gagugcuaagagaaucacucuccuuaccuaguuaucuacaaauguucauuccagaaauguuuag

SEQ ID NO: 43896 - RNA, 64 nt, Homo Sapiens
uucuauuuuucuugaggugaauuuaauaauuauuucuacaaauuaaaaggcuuagauuuuuaaa

SEQ ID NO: 43897 - RNA, 64 nt, Homo Sapiens
cacacugcuucacuuuguuuaccuagaccugagcucuacaaaaagcacuaccccaccuggcagc

SEQ ID NO: 43898 - RNA, 64 nt, Homo Sapiens
guaauaaaaugaaccgggcaagggagaccccuucucuacaaauaaagaccagccugggcaaagu

SEQ ID NO: 43899 - RNA, 64 nt, Homo Sapiens
gcccaauaaagaaagaggaaagaccugcgugacaucuacaaagcuauuuagcaguguaacuuuu

SEQ ID NO: 43900 - RNA, 64 nt, Homo Sapiens
ucuguuugucaguucauuccuguguguucuuaccucuacaaaguaaauuacacauuuaguuuuu

SEQ ID NO: 43901 - RNA, 64 nt, Homo Sapiens
aggaguuuugagaccagccugggaaacaucugucucuacaaaaaaauacaaaaauuagcugggc

SEQ ID NO: 43902 - RNA, 64 nt, Homo Sapiens
ucaagacaauccuggccaacggcgaaacucugucucuacaaaaaauauacaggcguguuagcau

SEQ ID NO: 43903 - RNA, 64 nt, Homo Sapiens
aaggccagccugggcaacauggcaaaaccccauuucuacaaaaaauacaaaaauuagcugggca

SEQ ID NO: 43904 - RNA, 64 nt, Homo Sapiens
ugaaagaugugacaaugcuucauacaugagagacucuacaaaccuuaagaaacauaggcuaauu

SEQ ID NO: 43905 - RNA, 64 nt, Homo Sapiens
ugaagaauguggcaaagcuuuacuggagagaaaaucuacaaaggaguaaacauaagaaaauuca

SEQ ID NO: 43906 - RNA, 64 nt, Homo Sapiens
auacauaaauuagcugggcagugaaaccaccuucucuacaaaaaagaccagccugggcagaaug

SEQ ID NO: 43907 - RNA, 64 nt, Homo Sapiens
aauaguuuuacuucuuucuuagaagaucaugucaucuacaaagacucuuugugauuuucuacac

SEQ ID NO: 43908 - RNA, 64 nt, Homo Sapiens
cauuacucuaaaauagcaccguuuguacacaaaaucuacaaauaauuuucuauuuuuguuuaga

SEQ ID NO: 43909 - RNA, 64 nt, Homo Sapiens
auuuaaaaauuagccaagugagugagaucuuuucucuacaaaaaagaauuugccugggcaguau

SEQ ID NO: 43910 - RNA, 64 nt, Homo Sapiens
guaacuuuucaaguaaaugcacaacuuuagaauuucuacaaauaaguucuuuuaaacagucuuu

SEQ ID NO: 43911 - RNA, 64 nt, Homo Sapiens
accuuccuguauuuccacagagcaugcaagaacuucuacaaaacuucuauaccacacagaagcu

SEQ ID NO: 43912 - RNA, 64 nt, Homo Sapiens
gguuauuggucaguggaagacuuuuaugugucuuucuacaaaggauauuucuuugagcacugug

SEQ ID NO: 43913 - RNA, 64 nt, Homo Sapiens
cugauuaagggccccugggguuuggguucauccaucuacaaacagaauuuuauuaacuacaucu

SEQ ID NO: 43914 - RNA, 64 nt, Homo Sapiens
agaggccugugcaguagaguguagacccuuucauguacuguacuguacaccugauacuguaaac

SEQ ID NO: 43915 - RNA, 64 nt, Homo Sapiens
ccugugcaguagaguguagacccuuucauguacuguacuguacaccugauacuguaaacauacu

SEQ ID NO: 43916 - RNA, 64 nt, Homo Sapiens
gacuuuuugcuaguuucuauaaaguauuuuuugaguacuguacuugcccuuuuuucauaccaca

SEQ ID NO: 43917 - RNA, 64 nt, Homo Sapiens
agagcuguugugacugauucagcauaucgaugcaguacuguacuaauaggcugcaggucuccag

SEQ ID NO: 43918 - RNA, 64 nt, Homo Sapiens
ugcggccaguauuagacuggaaguucauaccuaaguacuguaauaauaccucaauguuugagga

SEQ ID NO: 43919 - RNA, 64 nt, Homo Sapiens
uuuuguauacaaauauauuguuaaucucuguuauguacuguacuaauucuuacacugccuguau

SEQ ID NO: 43920 - RNA, 64 nt, Homo Sapiens
agcaaauaguuauuuuuugcacuugaacugaaacguacuguacuguaaauuaugacucauuuua

SEQ ID NO: 43921 - RNA, 64 nt, Homo Sapiens
auaguuauuuuuugcacuugaacugaaacguacuguacuguaaauuaugacucauuuuaaguga

SEQ ID NO: 43922 - RNA, 64 nt, Homo Sapiens
auuugugaaacugacuguaggaagucaaaaacuuguacuguaucuuguguuuacaguucugauu

SEQ ID NO: 43923 - RNA, 64 nt, Homo Sapiens
aggaaaaauguacugaucauauaauuaacauuauguacuguauauaucauuuuagacacaucaa

SEQ ID NO: 43924 - RNA, 64 nt, Homo Sapiens
augauuuuuuuuucuuacucauuucaccuucccuguacuguauguuuggaauugaucauaaaac

SEQ ID NO: 43925 - RNA, 64 nt, Homo Sapiens
cagcugaagaaccgccguucgcugcguccucaugguacuguaggcucauucuuacccagggugc

SEQ ID NO: 43926 - RNA, 64 nt, Homo Sapiens
uccuucucauaaccucaagguugcaggccaaaccguacuguauuugcuugugagaccauuagca

SEQ ID NO: 43927 - RNA, 64 nt, Homo Sapiens
acauccacgcuauuuauuaucgaggaguuuuaaaguacuguaacuuuaaaauaaauaacuacaa

SEQ ID NO: 43928 - RNA, 64 nt, Homo Sapiens
ucuuagaagcucuaauuuuuguuuucuuuggcuaguacuguauaaaaaacagaauuguguuuua

SEQ ID NO: 43929 - RNA, 64 nt, Homo Sapiens
ucacuuuaaacucuuuggggcucucauucaacaaguacuguaucuuauuaccaagcaucuuggu

SEQ ID NO: 43930 - RNA, 64 nt, Homo Sapiens
cuaaaauaacacaguauuuaguauccagauuacuguacuguaggguggcucucccuuaucauuu

SEQ ID NO: 43931 - RNA, 64 nt, Homo Sapiens
caccucagcuggauugauuuccaaaugcuagcauguacuguaugggaggaugauccagauguuu

SEQ ID NO: 43932 - RNA, 64 nt, Homo Sapiens
gaccuauuuaacaauuggugcauaaaugaaaguaguacuguauacuugaaacuguuuaaguaca

SEQ ID NO: 43933 - RNA, 64 nt, Homo Sapiens
uaaauuccagaggacucugcagcugaaaacuaauguacuguacaucuaacuguggaauauaaau

SEQ ID NO: 43934 - RNA, 64 nt, Homo Sapiens
ugcucagagcuuuaaaaguagcuaacaucuuuacguacuguaaccaucuaaugaaaaacaaaaa

SEQ ID NO: 43935 - RNA, 64 nt, Homo Sapiens
auuuuuaaucaucuuaaaguuaguaacuuggguaguacuguaauauuacacuauucuuauucuu

SEQ ID NO: 43936 - RNA, 64 nt, Homo Sapiens
uggaaugcuugacuuagcaauuuuaaaaagaacuguacuguaaaacacuuuguuaucaagcaua

SEQ ID NO: 43937 - RNA, 64 nt, Homo Sapiens
gcuucacacagcuccccugcuucuaaaggauaagguacuguagccuugguccuggggaccaccu

SEQ ID NO: 43938 - RNA, 64 nt, Homo Sapiens
aggaaacccugacuccuggggccauuuccuaaugguacuguaagccaagcagcuuugcuucugc

SEQ ID NO: 43939 - RNA, 64 nt, Homo Sapiens
aaugcucuuugaaaaagucuuccaaaaaaguacuguacuguagaaaaugaugucucucugaaua

SEQ ID NO: 43940 - RNA, 64 nt, Homo Sapiens
guagaaaugcucuuugaaaagaauauccaaaaaaguacuguacuucuugaaaugaugucucucu

SEQ ID NO: 43941 - RNA, 64 nt, Homo Sapiens
ggggguuuaugccuggacaagaaguauguaugucguacuguaauuuacccaaccaaagagaucu

SEQ ID NO: 43942 - RNA, 64 nt, Homo Sapiens
uuuagaggcaaccaauuauauuauuuuguugcauguacuguauguuucagaguucucaaaaaua

SEQ ID NO: 43943 - RNA, 64 nt, Homo Sapiens
cgcgccagauuuugaaaucucggagacaaaacuaguacuguaagauaaauuuuuuuguacugua

SEQ ID NO: 43944 - RNA, 64 nt, Homo Sapiens
gagacaaaacuaguacuguaagauaaauuuuuuuguacuguauuuauuguguauaacgauuuuu

SEQ ID NO: 43945 - RNA, 64 nt, Homo Sapiens
acuuugcuuaaaagucaugaccuuuaaaauguuuguacuguaauuuuccuaaacauugauaaag

SEQ ID NO: 43946 - RNA, 64 nt, Homo Sapiens
uccuaaacauugauaaagccaaaaaaaagaacuuguacuguauuguuaaaaaaaagaacaaaaa

SEQ ID NO: 43947 - RNA, 64 nt, Homo Sapiens
uuccuugcaaauauuggaguuuuuuuaguaauuuguacuguauucacaauucuauauuuuagua

SEQ ID NO: 43948 - RNA, 64 nt, Homo Sapiens
uuugccauauaauuuauauuugaaaaaaagcaauguacuguacaaaaacacuggaaaaagagac

SEQ ID NO: 43949 - RNA, 64 nt, Homo Sapiens
ugagacuucuccaagcugcuucacaagcaaacuaaccgaaaaaccgaaaauauacaaacagcuu

SEQ ID NO: 43950 - RNA, 64 nt, Homo Sapiens
cuccaagcugcuucacaagcaaacuaaccgaaaaaccgaaaauauacaaacagcuucacacaca

SEQ ID NO: 43951 - RNA, 64 nt, Homo Sapiens
uaaaauauacacuccuaagcaguauuauuuuaaaauccuuuacccuggcuaccuccccuacccg

SEQ ID NO: 43952 - RNA, 64 nt, Homo Sapiens
ccauuauugauacaugugggcuuuuaaaaacuccauccuuuauaaauagucaagguuugggcca

SEQ ID NO: 43953 - RNA, 64 nt, Homo Sapiens
cuacagcaggcauggauuguuuaugucguaugauauccuuuauuaaguaaguucacuuauagua

SEQ ID NO: 43954 - RNA, 64 nt, Homo Sapiens
aguuacaucuggaaaugagcauuugaaauagauaauccuuuaagccuuguggcaaaauuuuugu

SEQ ID NO: 43955 - RNA, 64 nt, Homo Sapiens
uuuaccaaaccugacucccuuguauuuuuuauguauccuuuauauaagcuuaugcaguuuauac

SEQ ID NO: 43956 - RNA, 64 nt, Homo Sapiens
aauuauauaauuugaaagcauuguuuuucuuuaaauccuuuacuuaagagaauagaauuuucau

SEQ ID NO: 43957 - RNA, 64 nt, Homo Sapiens
aaaguaucugauggagcuccugaugaccuaauguauccuuuagaaauuuaaaauagcauuagag

SEQ ID NO: 43958 - RNA, 64 nt, Homo Sapiens
cuugucauguugguuuccaacaguccuuucgauuauccuuuauuuucuuauccucccuucucuu

SEQ ID NO: 43959 - RNA, 64 nt, Homo Sapiens
aguuaagaucuuugaaucuugucaaauuccuuucauccuuuaauuuaucacuguucaaagcacu

SEQ ID NO: 43960 - RNA, 64 nt, Homo Sapiens
uuauaagcauccuuuuugaacuucccauuaggacauccuuuaaaccucuugcccuguaccuuuc

SEQ ID NO: 43961 - RNA, 64 nt, Homo Sapiens
gauuucagacuuugaaaggcaaugcauccuggaaauccuuuaaaguucugguggggaauuuaaa

SEQ ID NO: 43962 - RNA, 64 nt, Homo Sapiens
agaucucauacaccagaauuuuuuuauguguaccauccuuuaauaacagaaaugucucaugacu

SEQ ID NO: 43963 - RNA, 64 nt, Homo Sapiens
uaugugcuuuaagugcugcucuaccugaaaagaaauccuuuaaauuaccuauggaagugauguc

SEQ ID NO: 43964 - RNA, 64 nt, Homo Sapiens
aagugguuuggguuuguuguuuaaccuuagcgagauccuuuaacugcagcaauauucaagccag

SEQ ID NO: 43965 - RNA, 64 nt, Homo Sapiens
uucaguuaagaucaaaccucaagaaaauuauuacauccuuuacauaaaauauaauacuuuuaaa

SEQ ID NO: 43966 - RNA, 64 nt, Homo Sapiens
acaacuuuucaauuaauauuuuuaaaauuuuaaaauccuuuaaaaugaagcuuaaauuacucaa

SEQ ID NO: 43967 - RNA, 64 nt, Homo Sapiens
uuuuguucccaugaguuuugguggguuuuguuuuauccuuuaaagguuuguaauaugggucuug

SEQ ID NO: 43968 - RNA, 64 nt, Homo Sapiens
acuaagguaacaugacauaaguuuccuuauguuaauccuuuaacaucuuuuauauauugcugca

SEQ ID NO: 43969 - RNA, 64 nt, Homo Sapiens
cagaagucuguuaauauugcuguuuugaaggacaauccuuuauuuuacuugagaccuuacaucu

SEQ ID NO: 43970 - RNA, 64 nt, Homo Sapiens
agcuggcacccaucccagggcuccucuggagcuaauccuuuaagcaaaaugugcuugccuuuua

SEQ ID NO: 43971 - RNA, 64 nt, Homo Sapiens
uccuguuuauggucaauaacuguuacuuuuaaguauccuuuaauaccuguaccuuuuguuuuag

SEQ ID NO: 43972 - RNA, 64 nt, Homo Sapiens
aucauagauaaucacugucaaacuuuuggagcaaauccuuuaauacuaucucucauuguuuugg

SEQ ID NO: 43973 - RNA, 64 nt, Homo Sapiens
gagaaaggccuuaugaauguagugaaugugggaaauccuuuagcuuaagguccaaccucauuca

SEQ ID NO: 43974 - RNA, 64 nt, Homo Sapiens
cuggagaaaggcaugagugcgggcagugugggaaauccuuuagccgaaaaucuagccuuauuau

SEQ ID NO: 43975 - RNA, 64 nt, Homo Sapiens
auccuacuucaagauggugguggcaauagucaggagaagguaacauuggaguccugguuugauu

SEQ ID NO: 43976 - RNA, 64 nt, Homo Sapiens
uacguauacaauaaaacuaugcuauuaaaaaaaaagaagguaacugauaaaccaaaauugagca

SEQ ID NO: 43977 - RNA, 64 nt, Homo Sapiens
caacacuucaguuuuucuuggugauuuucucaugagaagguagauuuugaguuuuauuguggug

SEQ ID NO: 43978 - RNA, 64 nt, Homo Sapiens
uauaagugucuguccaugugcuaaucacuuauuuagaagguauuguggauuggaccaaaaacuu

SEQ ID NO: 43979 - RNA, 64 nt, Homo Sapiens
cuauuaaugugcacccagcuggucuccccaggcaagaagguauccucuucccaagguguaccca

SEQ ID NO: 43980 - RNA, 64 nt, Homo Sapiens
gaaauaaucagguaaguuaaaaguucauuuccagagaagguaaaccccacuuaccaucucugca

SEQ ID NO: 43981 - RNA, 64 nt, Homo Sapiens
cguugcuugauugagcuuauuacucucuauuuugagaagguagaagguaagagggcccauauuc

SEQ ID NO: 43982 - RNA, 64 nt, Homo Sapiens
ugauugagcuuauuacucucuauuuugagaagguagaagguaagagggcccauauucauucuuu

SEQ ID NO: 43983 - RNA, 64 nt, Homo Sapiens
guuacauuaagugcaucuguuaaccuauuuuugcagaagguacuuugcauuucugaguauuaug

SEQ ID NO: 43984 - RNA, 64 nt, Homo Sapiens
gaugagaagaaugauaaugggauacuaagaaaauagaagguaaacugaaaaaaaagaaagcaag

SEQ ID NO: 43985 - RNA, 64 nt, Homo Sapiens
gagagauacuuaggaaauccuaaaagaggcggcaagaagguaccucccuguguaacucaccuuc

SEQ ID NO: 43986 - RNA, 64 nt, Homo Sapiens
aagaguaaacauuacucaguggaaagcuaaguucagaagguacuuuguuuuuccucccuugccu

SEQ ID NO: 43987 - RNA, 64 nt, Homo Sapiens
uuuuaacucccaagcaguagaccuugugaacaucagaagguauuaucaaucagaagguauucug

SEQ ID NO: 43988 - RNA, 64 nt, Homo Sapiens
cugaccuugugaacaucagaaguggaaaucaaucagaagguauuuuuagauuuaaugaugcuuc

SEQ ID NO: 43989 - RNA, 64 nt, Homo Sapiens
guugccaaagguaauuuaggaagggucugaucauuuagaugagaguucuuuggggcuuauuuuc

SEQ ID NO: 43990 - RNA, 64 nt, Homo Sapiens
aaggaugaauccauguuauuguauuguaaauaauuuagaugauuaaaauggauuguuuaaaaag

SEQ ID NO: 43991 - RNA, 64 nt, Homo Sapiens
uagaaggcagcgccuccucuucacucuccucugauuagaugaaacuguuaccuuacccuaaaca

SEQ ID NO: 43992 - RNA, 64 nt, Homo Sapiens
aaccacuggaauuuuucaaugccgucauuuucaguuagaugauuuugcacuuugagauuaaaau

SEQ ID NO: 43993 - RNA, 64 nt, Homo Sapiens
uaugcuauaccaaucugcaguaaaaaaaauuuuuuuagaugauucuauauaacuucgucucaca

SEQ ID NO: 43994 - RNA, 64 nt, Homo Sapiens
agcaaguauggugcuaaagucuacaccaauggaauuagaugagugcuaugcacuuaauuuuaaa

SEQ ID NO: 43995 - RNA, 64 nt, Homo Sapiens
uauugaucuuccuaauaucaguuucauacagcacuuagaugaauaagcaacuuuuguagaugcu

SEQ ID NO: 43996 - RNA, 64 nt, Homo Sapiens
aagcaagauaccauugucguagguaaauuauuuguuagaugaguuuauccuuauauuuuucuaa

SEQ ID NO: 43997 - RNA, 64 nt, Homo Sapiens
ugaauauuguccugugaaaagaauagcaggacuuuuagaugaaaaguauucuuaaaaagaaaag

SEQ ID NO: 43998 - RNA, 64 nt, Homo Sapiens
ugaaagugcacguuaaaccugagcgccuuuaccuuuagaugagugcuuuggccccucugugaau

SEQ ID NO: 43999 - RNA, 64 nt, Homo Sapiens
ugucucuccucuagguaucguauuuuguugcucaagaauccaaaaugggucuguggacauaggg

SEQ ID NO: 44000 - RNA, 64 nt, Homo Sapiens
cagagauuacacaguuaggaugcugacacagucuagaauccauaaugcucccuacaucucacac

SEQ ID NO: 44001 - RNA, 64 nt, Homo Sapiens
acaaacuaaacuuuacuagggccuaauuuuuuaaagaauccaaguaggauaacuaaaauucugg

SEQ ID NO: 44002 - RNA, 64 nt, Homo Sapiens
cauauauauccuauuugauuuuuaucuuuuagcuagaauccacacauauguuuauucaaaauau

SEQ ID NO: 44003 - RNA, 64 nt, Homo Sapiens
uaguauuuuucuuuucacacaaucucuuuacagcagaauccagaguuggauuguaguuuaccuu

SEQ ID NO: 44004 - RNA, 64 nt, Homo Sapiens
ucucugauuggcuuccaaccacugggauucaaagagaauccaagguucugccuaugucugauga

SEQ ID NO: 44005 - RNA, 64 nt, Homo Sapiens
ggugucccauaccagcuuuuaaugguggaccuauagaauccaguacuuuuaauggugggaauuu

SEQ ID NO: 44006 - RNA, 64 nt, Homo Sapiens
uugucaacauacagacuucaaaauaccccuuaugagaauccaaagaaugauguguguaagggaa

SEQ ID NO: 44007 - RNA, 64 nt, Homo Sapiens
agccucugugagcucgcaccuuacugggugcaaaagaauccacggaacuugggagaaguccagu

SEQ ID NO: 44008 - RNA, 64 nt, Homo Sapiens
ccgguauccacucucaucuucuuccaauaucaagagaauccagguucugucagauuaguaaggu

SEQ ID NO: 44009 - RNA, 64 nt, Homo Sapiens
cuggacagaaaucuuacaaaucaauagacaucagagaauccaugguuuacuucacauucacacc

SEQ ID NO: 44010 - RNA, 64 nt, Homo Sapiens
augagagaucuuacaaguguuugcaaaucauuggagaauccauauuucaguaaugcuacaacca

SEQ ID NO: 44011 - RNA, 64 nt, Homo Sapiens
cuggacagaaaucuuacaaaucauuagacaucagagaauccaugguuuacuucacauucacacc

SEQ ID NO: 44012 - RNA, 64 nt, Homo Sapiens
gugaagagaucuuacaaguguugcacaucauuggagaauccacauuucaguaaugcuacaacca

SEQ ID NO: 44013 - RNA, 64 nt, Homo Sapiens
gagacugcuuccagaaggcaccugguuuuagggcagaauccauguggcagcuccaucuuccauu

SEQ ID NO: 44014 - RNA, 64 nt, Homo Sapiens
agauacgcacagccccacccguuuuccgagccucagaauccagguugaaggcaguucccaccga

SEQ ID NO: 44015 - RNA, 64 nt, Homo Sapiens
auaauguuuauucaaaguauuuuaucuuuuaucuagaauccacauauguauguccaauuugauu

SEQ ID NO: 44016 - RNA, 64 nt, Homo Sapiens
uaggauaacuaaaauucugggccuaauuuuuuaaagaauccaagacaaacuaaacuuuacuggg

SEQ ID NO: 44017 - RNA, 64 nt, Homo Sapiens; identical to SEQ ID NO: 44015

SEQ ID NO: 44018 - RNA, 64 nt, Homo Sapiens; identical to SEQ ID NO: 44016

SEQ ID NO: 44019 - RNA, 64 nt, Homo Sapiens
acacacaguucgucucugaggaaaguaaaauaaauggaauaagaguaaauuggguaaggagaua

SEQ ID NO: 44020 - RNA, 64 nt, Homo Sapiens
gguucucauaucagagucaucauuuuucuuccuguggaauaaaaugccuuguggacuucccaaa

SEQ ID NO: 44021 - RNA, 64 nt, Homo Sapiens
uaagugguccaggaguccaaguaagcagucuggcuggaauaaggcagcaucacggaaauucugu

SEQ ID NO: 44022 - RNA, 64 nt, Homo Sapiens
ucuaacacauacuagagcaagaauuuacuugauuuggaauaauuaauagcuacuggacauuaua

SEQ ID NO: 44023 - RNA, 64 nt, Homo Sapiens
gugcaguauuguaguauuacaaaugggauagaucuggaauaaauccucauccuguggaauaaga

SEQ ID NO: 44024 - RNA, 64 nt, Homo Sapiens
aaaugggauagaucuggaauuuucccucauccuguggaauaagaacauuuguaaccuggcacag

SEQ ID NO: 44025 - RNA, 64 nt, Homo Sapiens
agguugaaguguuugaaaucuagauuuccagguauggaauaauucucauuccugauuauuuccu

SEQ ID NO: 44026 - RNA, 64 nt, Homo Sapiens
ucaauuuauuucucccuuuuuuuucuaucaaauguggaauaaacuuguauuaguggcuguauag

SEQ ID NO: 44027 - RNA, 64 nt, Homo Sapiens
ugacaguccaccugccgaccugauuccugcaucauggaauaaccacauggcuaccuucuauccu

SEQ ID NO: 44028 - RNA, 64 nt, Homo Sapiens
agguaguucaugaaaaugcugugcacucauuccauggaauaaauguuggaaagcugaucuuuuc

SEQ ID NO: 44029 - RNA, 64 nt, Homo Sapiens
caagaaaauuaaaugguaccacucuuccacaguuuggaauaauuuuauaauuguaaagauagaa

SEQ ID NO: 44030 - RNA, 64 nt, Homo Sapiens
aaggauggagcccaaaauugcagagcaguaacuuuggaauaaaaccaggguggguauaaaacuu

SEQ ID NO: 44031 - RNA, 64 nt, Homo Sapiens
agacaucauuggguucuuacuuuaagacaucuccuggaauaacuguucaaaugcagguuuuaga

SEQ ID NO: 44032 - RNA, 64 nt, Homo Sapiens
uauuauacuuucaaaugacacauaguaaggagaauggaauaauacauguugcauauuuguuacc

SEQ ID NO: 44033 - RNA, 64 nt, Homo Sapiens
ucagcugucacuguuguuuucuuguaacaugauauggaauaaaguauagcagaaucuccguaca

SEQ ID NO: 44034 - RNA, 64 nt, Homo Sapiens
guuggaaagcugaucuuuucgugcacucauuccauggaauaaauagguaguucaugaaaaugcu

SEQ ID NO: 44035 - RNA, 64 nt, Homo Sapiens
acauggcuaccuucuauccuugauuccugcaucauggaauaaccugacaguccaccugccggcc

SEQ ID NO: 44036 - RNA, 64 nt, Homo Sapiens
uaaucaacggggaaaacaucuucuccaaaaaacuuggaauaaauccaaggaccaguuuuuaccc

SEQ ID NO: 44037 - RNA, 64 nt, Homo Sapiens
ucaacacaaaauaaacuagaaggccagaggauaauggaauaaaagaucauugcaauuacuuauc

SEQ ID NO: 44038 - RNA, 64 nt, Homo Sapiens
agugagcauaucugguauauuuuuggcugaguacuggaauaaacaauuuaaaugauauuuaggu

SEQ ID NO: 44039 - RNA, 64 nt, Homo Sapiens
aucucacuuccagauauccaucuuuuccugggaauggaauaacuuuguaacuuagcuuuauuuu

SEQ ID NO: 44040 - RNA, 64 nt, Homo Sapiens
uaucaaaugaaacagggaaacucaaagcauaaaauggaauaacagcaacagagcaagacccugu

SEQ ID NO: 44041 - RNA, 64 nt, Homo Sapiens
cauacuaaugaaguauuacaaaaggacuauuauguggaauaauaaaaguaugguacaucuaccu

SEQ ID NO: 44042 - RNA, 64 nt, Homo Sapiens
ucacaugaaaacaaaacacauagaaucuuucagguggaauaaagucccgcuaauggaagaaguu

SEQ ID NO: 44043 - RNA, 64 nt, Homo Sapiens
uguuaaauaucuguauauuaacuggagccaccucuggaauaaugccaucucucaagccccaagg

SEQ ID NO: 44044 - RNA, 64 nt, Homo Sapiens
uggucccacuugacuguuccagggcuuaugugacuggaauaagggaacacuguguuacuuuaca

SEQ ID NO: 44045 - RNA, 64 nt, Homo Sapiens
uuuuuagcugcuaaugacaagcuuuaagaacauguggaauaaguccuuuuuuuccaccauuaag

SEQ ID NO: 44046 - RNA, 64 nt, Homo Sapiens
uacuauuuuuacugccacucauggcggguggggguggaauaaaauggggguugcggggggaggg

SEQ ID NO: 44047 - RNA, 51 nt, Homo Sapiens
uauuuugaaaaauuccuauuguggaauaaccagggagaagaugaugacuaa

SEQ ID NO: 44048 - RNA, 64 nt, Homo Sapiens
ucacagaauuaaggaagcacgcaggcuuaagauuuggaauaaagggcaggggcagaaaacucug

SEQ ID NO: 44049 - RNA, 64 nt, Homo Sapiens
cuguggcauuauugcauuauccuugaaacauugauggaauaacuuucuuccaguuuagaaucag

SEQ ID NO: 44050 - RNA, 64 nt, Homo Sapiens
caacauaaauugccauagaugugauugccauagguggaauaaucaaaaggaaagaaaacuugau

SEQ ID NO: 44051 - RNA, 64 nt, Homo Sapiens
aagguugggugauuauaucugacaguagugcacuuggaauaauagcggcuguaacaugucucuu

SEQ ID NO: 44052 - RNA, 64 nt, Homo Sapiens
aacugaaagcagacagggaccaaagccuuauugcuggaauaauggaaguccacaccaccaucua

SEQ ID NO: 44053 - RNA, 64 nt, Homo Sapiens
gguccagaaaacaugaucuuuuucuagaccuuaauggaauaaugaggauuagaaaaaucaccau

SEQ ID NO: 44054 - RNA, 64 nt, Homo Sapiens
gagcauuguuuuuccacauuagcagaaaagaaaauggaauaaugggcuucuggcccaaacccca

SEQ ID NO: 44055 - RNA, 64 nt, Homo Sapiens
uuauugcagucuuccauuacggaacuuuagaacuuggaauaauuugcccaaaauauaaaagugu

SEQ ID NO: 44056 - RNA, 59 nt, Homo Sapiens
uccguagccuugaagauuagaagccuugaagauuacaacugugauuuccuuuuccucag

SEQ ID NO: 44057 - RNA, 64 nt, Homo Sapiens
agagaauucaggauaguuuuguuuaaauucuugcagauuacauguuuuuacaguggccugcuau

SEQ ID NO: 44058 - RNA, 64 nt, Homo Sapiens
cagacagucucacaaguaaacaccagcagcucauagauuacaaccaagaaagugacuguaucag

SEQ ID NO: 44059 - RNA, 64 nt, Homo Sapiens
agcaauccuaccaccuuggccucccaaagugcugagauuacaggcaugagccauugcaccuggc

SEQ ID NO: 44060 - RNA, 64 nt, Homo Sapiens
caggaacauugguuaagaacugcgucuagcaccuagauuacagcacacuuucgaggauuugcag

SEQ ID NO: 44061 - RNA, 63 nt, Homo Sapiens
agagcagaacuugcacccacuaaauaugaaguaagauuacaacucucucucuuuuaggaauaa

SEQ ID NO: 44062 - RNA, 64 nt, Homo Sapiens
uuuuugcucuucuugucuuuauauguucaccaggagauuacaauguaauuggcuccaauucaua

SEQ ID NO: 44063 - RNA, 64 nt, Homo Sapiens
ggccaaggguaauagaaaugaguuuauagcuuccagauuacaaaugcugaauugaacauuuuga

SEQ ID NO: 44064 - RNA, 64 nt, Homo Sapiens
auuaauauauugaacaccuuccaaauaauauuuuagauuacagguaagagauuaagaauauugc

SEQ ID NO: 44065 - RNA, 64 nt, Homo Sapiens
aguuauacuucuugguucacauuuuggaaaucagagauuacagauuacauggccauagcuuauc

SEQ ID NO: 44066 - RNA, 64 nt, Homo Sapiens
cuucuugguucacauuuuggaaaucagagauuacagauuacauggccauagcuuaucuguguua

SEQ ID NO: 44067 - RNA, 64 nt, Homo Sapiens
agugauucuccugccucauccucccaagaagcugagauuacagaugaccaccaccacuccuggc

SEQ ID NO: 44068 - RNA, 64 nt, Homo Sapiens
ggugauccaccugccucagccucccaaagugcugagauuacaggcaugagccaccacgcccagc

SEQ ID NO: 44069 - RNA, 64 nt, Homo Sapiens
ggcgauucuccugccucagcuucccgaguaacugagauuacaggcacccaccaccaugcccagc

SEQ ID NO: 44070 - RNA, 64 nt, Homo Sapiens
ggugaucuaccugccucagccucccaaagugcugagauuacagacaugagccuccgcgccuugc

SEQ ID NO: 44071 - RNA, 64 nt, Homo Sapiens
acaaauggauagagaagaaaagggucaaacaucgagauuacauggauguuaaauuauauggaga

SEQ ID NO: 44072 - RNA, 64 nt, Homo Sapiens
aaaauuauuuuauuuaacuuuaagcaauaacuagagauuacaauuaaauuuuaaucaaaaugaa

SEQ ID NO: 44073 - RNA, 64 nt, Homo Sapiens
aaagugcagaaagccagaggcaagaugaacuugaagauuacauaagaggacauaugauucuuuc

SEQ ID NO: 44074 - RNA, 64 nt, Homo Sapiens
aaaguacagaaagccagaggcaagaugaacuugaagauuacaucagaagacauaugacucuuuc

SEQ ID NO: 44075 - RNA, 64 nt, Homo Sapiens
aaugugcagaaagccagaggcaaaaugagugugcagauuacaucggaagacacaagacucuuac

SEQ ID NO: 44076 - RNA, 64 nt, Homo Sapiens
caugaaaaguaucauucuuugagaguauuccuaguauucccaacuuuguuaggccaagaagcaa

SEQ ID NO: 44077 - RNA, 64 nt, Homo Sapiens
guauguggcacaaucugugugcauggguucucuauauucccagauugcaagggcaguuuuucuu

SEQ ID NO: 44078 - RNA, 64 nt, Homo Sapiens
auuagucugcccaccuuucuuucccuucucaggcuauucccacccaauaaaugaaugaauggcc

SEQ ID NO: 44079 - RNA, 64 nt, Homo Sapiens
cuugaugcagggaaggaaccccagccucuugcaguauucccauaucuuugcccaccucuaugac

SEQ ID NO: 44080 - RNA, 64 nt, Homo Sapiens
gccugcuaaaucauuguaugugucuguaguauucuauucccagaaacuauuugaccaugauaau

SEQ ID NO: 44081 - RNA, 64 nt, Homo Sapiens
accuuucuaguaguuuaugauauugcccucuuuguauucccauuuucuacaguuuuuuccgcag

SEQ ID NO: 44082 - RNA, 64 nt, Homo Sapiens
gccaccauccuauugcaaagguuccaacuguauauauucccaauagcaacguagcuucuaccau

SEQ ID NO: 44083 - RNA, 64 nt, Homo Sapiens
uucauugagaguuuugucuugaaugucuuuugaauauucccaagcccaugaguccuugaaaaua

SEQ ID NO: 44084 - RNA, 64 nt, Homo Sapiens
uauucuaauauuccuucuagucaguggaaauuuguauucccauacaaacucagaaugcuauauu

SEQ ID NO: 44085 - RNA, 64 nt, Homo Sapiens
agaacuuacgcauccaauguggguugucacuuguuauucccaaguacuauuauuccauacuacu

SEQ ID NO: 44086 - RNA, 64 nt, Homo Sapiens
aaucaugcaguauugaguuaugacuuguuaaaucuauucccaugccagaaucuuaucaauacau

SEQ ID NO: 44087 - RNA, 64 nt, Homo Sapiens
cuagugcccucuuuucccuagggcauugcucuccuauucccacgccuuaacacagcucuauacc

SEQ ID NO: 44088 - RNA, 64 nt, Homo Sapiens
auaucuuuaaaggagagaugucaacuuucugcacuauucccagccucugcuccucccugucuac

SEQ ID NO: 44089 - RNA, 64 nt, Homo Sapiens
ucauagccagagaugguuuuccacuccuucuagauauucccaaaaagaggcugagacaggaggu

SEQ ID NO: 44090 - RNA, 64 nt, Homo Sapiens
acaacuuuguaaggguuucuaagcuaugcccauuuauucccaaauauuaagcccuuaaaaaaau

SEQ ID NO: 44091 - RNA, 64 nt, Homo Sapiens
uagaauccaugucagauuggugcuuccagacaucuauucccaguccaucagagugaaaugaagg

SEQ ID NO: 44092 - RNA, 64 nt, Homo Sapiens
gcacugaaauauguauuuuaaugaugaucuuauuuauucccauuuuugcccuuaguuaacauuu

SEQ ID NO: 44093 - RNA, 64 nt, Homo Sapiens
uuuuccuuauacaucucaaugcugagaguuaaaauauucccagguuaaaauuuuuuuaaaguac

SEQ ID NO: 44094 - RNA, 64 nt, Homo Sapiens
agcuugaaguucuguuaaauaauaaauaaauaaauauucccagcaucuugguguuaauagacca

SEQ ID NO: 44095 - RNA, 64 nt, Homo Sapiens
ccucccucucauuggaggagcauccucucagcccuauucccaugagaccauaagauagaucccc

SEQ ID NO: 44096 - RNA, 64 nt, Homo Sapiens
ccaugacccuaagaaguuuccucaugucuauuaauauucccaauccuaggcaccacugaguugu

SEQ ID NO: 44097 - RNA, 64 nt, Homo Sapiens
aaacagucaaacuguuuuccaacgugacauuuuauauucccaccaggaauguuuaaaacuagug

SEQ ID NO: 44098 - RNA, 64 nt, Homo Sapiens
cuagaccaagcaggaagaacugauaucuucauaauauucccagcgaaaacuuuaacaaacaggc

SEQ ID NO: 44099 - RNA, 64 nt, Homo Sapiens
cugugucccaugggcacaagcaggaaaacaauuguauucccagcucuggcauucagagaagagu

SEQ ID NO: 44100 - RNA, 64 nt, Homo Sapiens
gcccuuucugcacagcuggugucggcaucauacuaaaagcaauguuuaaaucaaacuaaagauu

SEQ ID NO: 44101 - RNA, 64 nt, Homo Sapiens
guguguguuuuuuuuuuuuuuuuuuuuguuguuuaaaagcaaggcaugcuuguggaugacucug

SEQ ID NO: 44102 - RNA, 64 nt, Homo Sapiens
caaacuuuuuuuagaauugaagucugaaacaaacaaaagcaauucaaugucaauagacauuaag

SEQ ID NO: 44103 - RNA, 64 nt, Homo Sapiens
auuaaucccauuaucucaggaguguguugguuauaaaagcaaguuuggcucccucuuuuccuca

SEQ ID NO: 44104 - RNA, 64 nt, Homo Sapiens
gauaaguuccaaauauguuaagggcuuuaauacaaaaagcaaaaauugucaguguuuggaugaa

SEQ ID NO: 44105 - RNA, 64 nt, Homo Sapiens
acaauaagaaugaaucucagaaaauauuaaggaaaaaagcaaguuugaagagaccacauggggc

SEQ ID NO: 44106 - RNA, 64 nt, Homo Sapiens
cuuaucaaggauuaauuuaaaacuccuaaaaaaaaaaagcaacucaaacuaguggucaaggacu

SEQ ID NO: 44107 - RNA, 64 nt, Homo Sapiens
uauuccauuuuaagcacuuaaugggguuauguagaaaagcaauuacuaaauaaaacccaucagc

SEQ ID NO: 44108 - RNA, 64 nt, Homo Sapiens
aucucuccauaaauauuaugaaguuuguugcuuuaaaagcaagugggaccuauccuugucuuga

SEQ ID NO: 44109 - RNA, 64 nt, Homo Sapiens
ccccauuuuccuuuuauaaaaaagaccuacaaucaaaagcaaauucaggaaccagcggaucugc

SEQ ID NO: 44110 - RNA, 64 nt, Homo Sapiens
agaaaagacagcagcaucaaauggaagaagcaggaaaagcaagaagagagcagagcaugcagug

SEQ ID NO: 44111 - RNA, 64 nt, Homo Sapiens
agaagaaaaggcgacaucaaagcagaacaucagaaaaagcaagagaagcacccagaacaugcug

SEQ ID NO: 44112 - RNA, 64 nt, Homo Sapiens
ggauauucacuuucagcgcuagugauguuuuuauaaaagcaaaauauaagugauaguuuauugu

SEQ ID NO: 44113 - RNA, 64 nt, Homo Sapiens
gauaauuauguuaaugucauuaggcugcgcuuccaaaagcaaauagagcuggagaugcaagcuc

SEQ ID NO: 44114 - RNA, 64 nt, Homo Sapiens
cuauuuucaaauugugcaauugcuuuuguuuaaaaaaagcaaauauuuuaagacaucuauuuua

SEQ ID NO: 44115 - RNA, 64 nt, Homo Sapiens
gcauuccuccucagcuccaccggggaagacagagaaaagcaaaccaccugccccgggagggcag

SEQ ID NO: 44116 - RNA, 64 nt, Homo Sapiens
gacacacauuccuuugaaauccacccaguguuuaaaaagcaacuuggaaauuuacacauuagca

SEQ ID NO: 44117 - RNA, 64 nt, Homo Sapiens
auccuuucuuaguuauuugcuccuugcaaauuaaaaaagcaacuaagagaaagaaaaacauugu

SEQ ID NO: 44118 - RNA, 64 nt, Homo Sapiens
ugugcucugccuggagcuguuuccauaugauauaaaaagcaaguguaguauuccauuacuaugu

SEQ ID NO: 44119 - RNA, 64 nt, Homo Sapiens
gagucccucaggaaaaaaaaaaaauucuguuuuaaaaagcaaucugauucuuagcucuugaaac

SEQ ID NO: 44120 - RNA, 64 nt, Homo Sapiens
uguguauuguaaguagcaguuaaauuauuuuuuuaaaagcaauuucaguuuuaaucacugaaca

SEQ ID NO: 44121 - RNA, 64 nt, Homo Sapiens
uccucuuauuuuucaguuuccagucaagauuauaaaaagcaaaugauugauauaauuugauauu

SEQ ID NO: 44122 - RNA, 64 nt, Homo Sapiens
ggaaugaagaaggcaaaaaauaucuuuuguacagaaaagcaagaugaaaaggaugugaaauggu

SEQ ID NO: 44123 - RNA, 64 nt, Homo Sapiens
ggucuaugauguguuuacuuuaaaaauugcuguuaaaagcaacacguauuaaauauguaauuau

SEQ ID NO: 44124 - RNA, 64 nt, Homo Sapiens
uugauuuuugcagcacuagcuaauggucugacacaaaagcaagucaaggggaaggaccauuucg

SEQ ID NO: 44125 - RNA, 64 nt, Homo Sapiens
agcaugaaguauugcuuaaagaaugcuuuuuauuaaaagcaagucacuugcaguguuacgaucg

SEQ ID NO: 44126 - RNA, 64 nt, Homo Sapiens
cucacaagcaucuuugucuugcaaauccuaagggaaaagcaagucccugcagugagcacuaggg

SEQ ID NO: 44127 - RNA, 64 nt, Homo Sapiens
acuuccgaauagaauguuuucuuuaagaggcaugaaaagcaacuauuguuguguuacaguguua

SEQ ID NO: 44128 - RNA, 64 nt, Homo Sapiens
cucaguaagcagcuugccaaucacuccaggucugaaaagcaagucccccagccccaccccaggg

SEQ ID NO: 44129 - RNA, 64 nt, Homo Sapiens
aaaagugauuuaaaaaugaucuuaccuguaccagaaaagcaaaguuaaaggaaacaaaauuugu

SEQ ID NO: 44130 - RNA, 64 nt, Homo Sapiens
uuuuuaaaacugcauuuuuacagaaauuuaccacaaaagcaaaacuuugcauuuaugauuucuc

SEQ ID NO: 44131 - RNA, 64 nt, Homo Sapiens
acugauuuucaaaaaaaugucauuuuaaguguuuaaaagcaaauaaggauuuuuuaaaaauugg

SEQ ID NO: 44132 - RNA, 64 nt, Homo Sapiens
cccaguauuuaaagucuauacuuaaaagauggagaaaagcaaaaaaagggaguuacagaggcug

SEQ ID NO: 44133 - RNA, 64 nt, Homo Sapiens
accugagccgaggagaggaugcauauauuaaaagaaaagcaaagaaaugccuacuauuuuauau

SEQ ID NO: 44134 - RNA, 64 nt, Homo Sapiens
guuugucauagagggaaccuaccuaaagcuaaaaaaaagcaaggucaaaagaugucaguguuau

SEQ ID NO: 44135 - RNA, 64 nt, Homo Sapiens
uccacaggacagcacugcuuuguguaguuggugcaaaagcaaucuuagaggucaaggaccuucc

SEQ ID NO: 44136 - RNA, 64 nt, Homo Sapiens
uugaagauuuagaaguuauauaaaaaauuaauuuaaaagcaaaccaaaagagguuuccauuaac

SEQ ID NO: 44137 - RNA, 64 nt, Homo Sapiens
ucugagugauugucaguguaaggccuuuuaaaacaaaagcaaguucuuuguuaggaauugguca

SEQ ID NO: 44138 - RNA, 64 nt, Homo Sapiens
aguguuuugccaauuaauauuauaugcuuguaauaaaagcaaaagaaaagcuuaagugaaagug

SEQ ID NO: 44139 - RNA, 64 nt, Homo Sapiens
cuaucaucauauggacucuauguaacacaaauucaaaagcaaacuaaaagcuauaugcagaguu

SEQ ID NO: 44140 - RNA, 64 nt, Homo Sapiens
uaaaauaaaaaauauuugucuccaccuuuuccccaaaagcaacagcaagacauauuuuguuaga

SEQ ID NO: 44141 - RNA, 64 nt, Homo Sapiens
uugaugauuuucuuuuaaagaaauuaguuuauuuaaaagcaagauagccuggguugggaguuag

SEQ ID NO: 44142 - RNA, 64 nt, Homo Sapiens
gcugaauagguuuaagucagauaauagauuuuaaaaaagcaaaugaggcaaugugucaaaauuu

SEQ ID NO: 44143 - RNA, 64 nt, Homo Sapiens
gcaagcagcagccugugaaguaauuaauauaauuaaaagcaacaugcauuaaaauuucaaaguu

SEQ ID NO: 44144 - RNA, 64 nt, Homo Sapiens
acagcaacaacacgaagauguguguagaagaggaaaaagcaacauacaagaaaguuuguuugaa

SEQ ID NO: 44145 - RNA, 64 nt, Homo Sapiens
aaaagaagaagaaacagcagagaaaaagcaaaagaaaagcaaaagccaagcaaaaaucaggcug

SEQ ID NO: 44146 - RNA, 64 nt, Homo Sapiens
gaaaagcaaaaaaaagaagaaaaucaggcugagaaaaagcaaaaaagaaaaagaagccaagcaa

SEQ ID NO: 44147 - RNA, 64 nt, Homo Sapiens
uguugaaacaagagaggguguuuacauuuuuaauaaaagcaacaaaugccaagguaauuuuaaa

SEQ ID NO: 44148 - RNA, 64 nt, Homo Sapiens
acaaaaaacaaaaaagaccuuguaguaaaacuuaaaaagcaaaacuauacagcugucacucauu

SEQ ID NO: 44149 - RNA, 64 nt, Homo Sapiens
acacuaugcacugcuguaacugguaguguucaguaaaagcaaaaugauaguuuucuagaugaca

SEQ ID NO: 44150 - RNA, 64 nt, Homo Sapiens
augaauuaaagcaacaaaaagauauugauuggcaaaaagcaagauauaagagauucauuugcuu

SEQ ID NO: 44151 - RNA, 64 nt, Homo Sapiens
aagcaucaggcugagauuugcacacaugggauguaaaagcaagcuguguguugcuuagucacuu

SEQ ID NO: 44152 - RNA, 64 nt, Homo Sapiens
ugccaucugaaguucauuaaucuuuagaugacaaaaaagcaaaaaguucccagaacguuuuugc

SEQ ID NO: 44153 - RNA, 64 nt, Homo Sapiens
uccuacuuaaauuuuaaguuaugagguuuaugucaaaagcaacauuucacaaauguacuuuuaa

SEQ ID NO: 44154 - RNA, 64 nt, Homo Sapiens
gaugcccuuacugugccaaaacaaaaaucuuaagaaaagcaaguagacaccuucauaacuauga

SEQ ID NO: 44155 - RNA, 64 nt, Homo Sapiens
uuuuauguuauugaaaauauacuaaauuauaacuaaaagcaacuuuagugaaaguauugaaaau

SEQ ID NO: 44156 - RNA, 64 nt, Homo Sapiens
aaaauugaaauaagacaucgaaauacacgucuuuaaaagcaacagagugucccauugcugccaa

SEQ ID NO: 44157 - RNA, 64 nt, Homo Sapiens
aauaaucugauauaaguccuggacacuagaaacuaaaagcaacauuccauuucuauacuuuaug

SEQ ID NO: 44158 - RNA, 64 nt, Homo Sapiens
ggccagugucugggauacugaggaaaggauaugaaaaagcaaguuagcagugagaagaaaccuc

SEQ ID NO: 44159 - RNA, 64 nt, Homo Sapiens
auacuaauuuuuuaagccaacacugccagcaucaaaaagcaaagcacacaacucugagaauacc

SEQ ID NO: 44160 - RNA, 64 nt, Homo Sapiens
accucccuuuuuaauugccuuuccuuucucauuuaaaagcaaaaaguaguaccaaaaagguauu

SEQ ID NO: 44161 - RNA, 64 nt, Homo Sapiens
uggaaaagccagccauuuaccuuaguguacggacaaaagcaaauggaccauaacuggcaaaauc

SEQ ID NO: 44162 - RNA, 64 nt, Homo Sapiens
ugaagaaauauuuuaaggaaaccuauuugaaaaaaaaagcaaagaccauuugauaaaagccuga

SEQ ID NO: 44163 - RNA, 64 nt, Homo Sapiens
gaauaauagaaaaauucuacuuuaauuuccauuaaaaagcaaauagcauugacacauuuaaagc

SEQ ID NO: 44164 - RNA, 64 nt, Homo Sapiens
cagauuuacaaguguaagcuauaugauuucuucaaaaagcaaaagcaauauaccuaauucauuu

SEQ ID NO: 44165 - RNA, 64 nt, Homo Sapiens
uacaaguguaagcuauaugauuucuucaaaaagcaaaagcaauauaccuaauucauuuggauca

SEQ ID NO: 44166 - RNA, 64 nt, Homo Sapiens
uguuuauaagaagauguuuguucaguguaugaccaaaagcaauaauuuaugcuguacauuucag

SEQ ID NO: 44167 - RNA, 64 nt, Homo Sapiens
caacacuuuauaguuauucuugugcagagggcauaaaagcaaaucugguguucuaccugcaaga

SEQ ID NO: 44168 - RNA, 64 nt, Homo Sapiens
uguuuuuuccaguuagucuuggaauuuuuauacuaaaagcaaaaguguaccuuucagcauccua

SEQ ID NO: 44169 - RNA, 64 nt, Homo Sapiens
ucaacauaugugauguuuauuuggaaacaaaacuaaaagcaaacggaacauugguuaagaacug

SEQ ID NO: 44170 - RNA, 64 nt, Homo Sapiens
cugugaauauaauuuaauuuagcaaaaacaaacaaaaagcaagcuguguuauaugacaggacaa

SEQ ID NO: 44171 - RNA, 64 nt, Homo Sapiens
uuuugauugagauuuuuuacgacccaugcaaucaaaaagcaaaauguuguuuucuguggguugc

SEQ ID NO: 44172 - RNA, 64 nt, Homo Sapiens
aacaaaaaaaaaaaaaaagggaguuuacuaugcuaaaagcaaaaguggcauuuucauuacagga

SEQ ID NO: 44173 - RNA, 64 nt, Homo Sapiens
uuuacuauguaacaaugguaaucuaagacagaaaaaaagcaauugguuugcauuuuuuaacaua

SEQ ID NO: 44174 - RNA, 64 nt, Homo Sapiens
ugaauaagaaaauaauguuuaaagaaaaaaaaaaaaaagcaaaccuccaaaacguggaccuaac

SEQ ID NO: 44175 - RNA, 64 nt, Homo Sapiens
uuaugacuuggauauaugguugaagaaucaaaacaaaagcaaaaaaaaaaagcaaaaaaagaaa

SEQ ID NO: 44176 - RNA, 64 nt, Homo Sapiens
auaugguugaagaaucaaaacaaaagcaaaaaaaaaaagcaaaaaaagaaaagagaaaaaaaga

SEQ ID NO: 44177 - RNA, 64 nt, Homo Sapiens
uuuagcuugucuuauaggauucaacugacuggcaaaaagcaagcagugaagagaugcaagacuu

SEQ ID NO: 44178 - RNA, 64 nt, Homo Sapiens
uuguuccuuuuuuuugaaaaucaguaauacaaugaaaagcaaaauacucaacuaccucagguau

SEQ ID NO: 44179 - RNA, 64 nt, Homo Sapiens
aaagcaaaacaauaaacuagauauaaaugaacaaaaaagcaagcauauccauggcaagcuuugu

SEQ ID NO: 44180 - RNA, 64 nt, Homo Sapiens
uguuuauuuaccuguaaggggaucuucagauagaaaaagcaaucuucauaaaacauguaacacu

SEQ ID NO: 44181 - RNA, 64 nt, Homo Sapiens
ucagaugaacucugcuguuuagaaguaaccacagaaaagcaaagucaguguacacucugaguga

SEQ ID NO: 44182 - RNA, 64 nt, Homo Sapiens
uuaacucauuuccuugagcuuauacaaaacauagaaaagcaaacuguuaaaguagucaauaauu

SEQ ID NO: 44183 - RNA, 64 nt, Homo Sapiens
aggaugaccuggcaaauaagaucuugaauaggccaaaagcaaguaucuugcuguguguagucuc

SEQ ID NO: 44184 - RNA, 64 nt, Homo Sapiens
auuggguauuagaaaucugaaaguacugucaucuaaaagcaauugugauuuuauuguaauuggu

SEQ ID NO: 44185 - RNA, 64 nt, Homo Sapiens
cagaacaaaacaaaaagccauucguuucccagugaaaagcaaacuuugccuagcaagaaucaca

SEQ ID NO: 44186 - RNA, 64 nt, Homo Sapiens
gcauaaaccccucccucuuuaaaacaaauuuaccaaaagcaaaaucugauuauuuguauugaag

SEQ ID NO: 44187 - RNA, 64 nt, Homo Sapiens
cuucuaccuccuaccuacuuccauccagagccacaaaagcaaacuuuccuuuuaccuuucucca

SEQ ID NO: 44188 - RNA, 64 nt, Homo Sapiens
guugcuugaauuaugaucauaaagccauagaagaaaaagcaauaucagcauauacauuucagcc

SEQ ID NO: 44189 - RNA, 64 nt, Homo Sapiens
uugguaaguugugugugcucagaagagcaagagaaaaagcaaauugaaaucagaagaacaaaaa

SEQ ID NO: 44190 - RNA, 64 nt, Homo Sapiens
aaagaaaaugcacucuaacucauguuuaaaaaaaaaaagcaacaccagauuuuuuauaugucug

SEQ ID NO: 44191 - RNA, 64 nt, Homo Sapiens
auuuuggucacuuccaagcugugaugauuauuaaaaaagcaaaaugcugaauacuuuuuauaau

SEQ ID NO: 44192 - RNA, 64 nt, Homo Sapiens
uucagugaaggucaccuggcguauguuauggcuuaaaagcaaguaauacuucaguaauaauuau

SEQ ID NO: 44193 - RNA, 64 nt, Homo Sapiens
ucuucauagaugaaugaaaccaaaauucaaaaaaaaaagcaacaaaauuuagauugguccuuuu

SEQ ID NO: 44194 - RNA, 64 nt, Homo Sapiens
cccauguaugccuauaugugaguaaccaccuuuaaaaagcaaccugauaauaucacaacccaga

SEQ ID NO: 44195 - RNA, 64 nt, Homo Sapiens
augauuacugauaauaucacgcagaaauguauaaaaaagcaaaaucauagaaaacuugaaaaau

SEQ ID NO: 44196 - RNA, 64 nt, Homo Sapiens
gcgcauaccugcuuccaagaauaaaacaguucugaaaagcaaccgcaaagccgggcgcgguggc

SEQ ID NO: 44197 - RNA, 64 nt, Homo Sapiens
aaaaaaaaagaaagaaagaaagagaaaagaaaagaaaagcaaccacagccagccuuagggaaaa

SEQ ID NO: 44198 - RNA, 64 nt, Homo Sapiens
agaauaguuucugagucugugacaccagugguaaaaaagcaaguggauuacaagcugucucucu

SEQ ID NO: 44199 - RNA, 64 nt, Homo Sapiens
aacaaaaacaagucccaugugccaaaaaaaaccaaaaagcaaaauaggggccauaucauucaug

SEQ ID NO: 44200 - RNA, 64 nt, Homo Sapiens
gagaaggaacaggaaugaaauuuaaaaacuguucaaaagcaaaaaugacuuagcuauuaguaua

SEQ ID NO: 44201 - RNA, 64 nt, Homo Sapiens
caauugucuaauuuacagcaguugugaucccacaaaaagcaaguuuauaccucagauuggggua

SEQ ID NO: 44202 - RNA, 64 nt, Homo Sapiens
caguaaauccaugucuuuguuuguuuuucuauuaaaaagcaaucaagaaagauaaugugaaaaa

SEQ ID NO: 44203 - RNA, 64 nt, Homo Sapiens
aggcccagacaggcucacucaagcucuuuaacugaaaagcaacaagccacuccaggacaagguu

SEQ ID NO: 44204 - RNA, 64 nt, Homo Sapiens
ggaguaggagagaggaaacauuugacuuaucuggaaaagcaaaauguacuuaagaauaagaaua

SEQ ID NO: 44205 - RNA, 64 nt, Homo Sapiens
uuuagaaguuaaaccacccgauaggccuucgagcaaaagcaaagauccaccgagagaagaagag

SEQ ID NO: 44206 - RNA, 64 nt, Homo Sapiens
auucgucauccaaguccaggucuagaucacacucaaaagcaaagcauucucuucccagugccua

SEQ ID NO: 44207 - RNA, 64 nt, Homo Sapiens
gucuuugguguuggaggacaccucuuguucuuaaaaaagcaaguuuauucagugaauuacacau

SEQ ID NO: 44208 - RNA, 64 nt, Homo Sapiens
gguggaucaacccaguuguuuggagcuaugguguaaaagcaacaacauauauauuuuuggaaaa

SEQ ID NO: 44209 - RNA, 64 nt, Homo Sapiens
cuguauaaaugugaaauuuuuaaauacauuauugaaaagcaaauauguucacugaauaaauaag

SEQ ID NO: 44210 - RNA, 64 nt, Homo Sapiens
cuuaauuugaaauaacagccucagaaaaaguccgaaaagcaaacagauccaacuauuucuuuca

SEQ ID NO: 44211 - RNA, 64 nt, Homo Sapiens
aagagagcugggaauaucuguacuuuuuucuuuuaaaagcaaccacugcuccagugaaaugugg

SEQ ID NO: 44212 - RNA, 64 nt, Homo Sapiens
ucugguugaccaugauuuuaccaucuucccaggcaaaagcaacacucugcaacagaauaugaca

SEQ ID NO: 44213 - RNA, 64 nt, Homo Sapiens
uaacuauuccuguguaaaaacaacaaaaacaaacaaaagcaagaaaaccacaacuaaaacugga

SEQ ID NO: 44214 - RNA, 64 nt, Homo Sapiens
agagggaaggaauaaucauucaaaugaacuuuaaaaaagcaaauuucaugcacugauuaaaaua

SEQ ID NO: 44215 - RNA, 64 nt, Homo Sapiens
gagaaaagagaaaccgggagaaggaaaaaaagcaaaaagcaaggcuaagacaugugaggaggaa

SEQ ID NO: 44216 - RNA, 64 nt, Homo Sapiens
agcaagggagaaaagagaaaggaggaaaaggaaaaaaagcaaaaagcaggccuaagacauguga

SEQ ID NO: 44217 - RNA, 64 nt, Homo Sapiens
aauguuguuuuaaaagaaaauagcaaaacaacaaaaaagcaaaccuuaaaaugugaagaaagug

SEQ ID NO: 44218 - RNA, 64 nt, Homo Sapiens
aacaauaaacugguuguauggccauagcuauccgaaaagcaagagacaaagcaagacaaauauu

SEQ ID NO: 44219 - RNA, 64 nt, Homo Sapiens
cuauuuugugacuaaauauuaacuaugugcauacaaaagcaauacaaaagcaaaguaaucuuac

SEQ ID NO: 44220 - RNA, 64 nt, Homo Sapiens
uaaucuuacaacuaugugcauaguuuuuauugacaaaagcaaaggaguuuuaugaaagauggua

SEQ ID NO: 44221 - RNA, 64 nt, Homo Sapiens
caaguacguauucagcauuauucaacugaagaaaaaaagcaagugguaaaagggaugcuagaaa

SEQ ID NO: 44222 - RNA, 64 nt, Homo Sapiens
auucccucaacaucagaacagcagucauuacagaaaaagcaaauaaagagcucccaucugaucu

SEQ ID NO: 44223 - RNA, 64 nt, Homo Sapiens
cuuaaaaaaaaaaaaaaagaaacauuuuucuuuaaaaagcaaaaacaugacuuggaacugaacu

SEQ ID NO: 44224 - RNA, 64 nt, Homo Sapiens
uuucuacugucaugugggaucccauucucaggucaaaagcaagaagaggguggacggagcgggg

SEQ ID NO: 44225 - RNA, 64 nt, Homo Sapiens
acaagaaaucaaaauccaaacaaaggaaauccaaaaaagcaaacuaccggacacaccucugcuc

SEQ ID NO: 44226 - RNA, 64 nt, Homo Sapiens
gaagcauacuugugaacuacaaaaguuuuuuuaaaaaagcaaaguggcuuuaaguaaaaaucca

SEQ ID NO: 44227 - RNA, 64 nt, Homo Sapiens
ucuuggcauuggaauucuacuggaaaaaaauacaaaaagcaaaacaaaacccucagcacuguua

SEQ ID NO: 44228 - RNA, 64 nt, Homo Sapiens
cauagggucacuuugccauuaugcaaauggagauaaaagcaauucugacuguccaggagcuaau

SEQ ID NO: 44229 - RNA, 64 nt, Homo Sapiens
auaugaagaaguaguucagagcauccugaaauaaaaaagcaagacuuccuggaaguaauuguaa

SEQ ID NO: 44230 - RNA, 64 nt, Homo Sapiens
agccuggcuuagcaaggagccugaauucuguaauaaaagcaaaccagaaugaauguagaaaagg

SEQ ID NO: 44231 - RNA, 64 nt, Homo Sapiens
ccccuaugguugauauuguuaaaaaaaaaaaaaaaaaagcaaacauuuugucucauuugccaaa

SEQ ID NO: 44232 - RNA, 64 nt, Homo Sapiens
uggacauuuccuucuaguccuuuuguuccccgugaaaagcaacauccagaaccuuuuugccuuu

SEQ ID NO: 44233 - RNA, 64 nt, Homo Sapiens
ugaggcucuuucuauaaauacauauuguuuaaaaaaaagcaagaaaaaaaggaaaacaaaggaa

SEQ ID NO: 44234 - RNA, 64 nt, Homo Sapiens
gcaacagagcgagacccugucuccaaaaaaaaaaaaaagcaauguuuauauuauaaaagagugu

SEQ ID NO: 44235 - RNA, 64 nt, Homo Sapiens
uuauuuggaaccagaaaagcccaaccuaaauagcaaaagcaauccuaagcaaaaagagcaaugu

SEQ ID NO: 44236 - RNA, 64 nt, Homo Sapiens
aaaucaaaacauagaugcuagugaggcugcagagaaaagcaaauacuuauacacugcugguggg

SEQ ID NO: 44237 - RNA, 64 nt, Homo Sapiens
gauguuuccauuaaucuuuuaacuaucaagucugaaaagcaauuaaaccaccuuuugaagcagc

SEQ ID NO: 44238 - RNA, 64 nt, Homo Sapiens
cauuguguacuaaagguuuuaugcauaccgaaauaaaagcaauucacuaaaugcugaaaugugg

SEQ ID NO: 44239 - RNA, 64 nt, Homo Sapiens
ucagugaucagaauagauauccuuuuacacgcacaaaagcaauagauucauucaguggacaagu

SEQ ID NO: 44240 - RNA, 64 nt, Homo Sapiens
auuuacauaguaaguuucacacuaccuuauuaccaaaagcaaacaccucuuacuuuaaacuaca

SEQ ID NO: 44241 - RNA, 64 nt, Homo Sapiens
agcacuuuuuaaaacaaacaaacaaacaaaacaaaaaagcaaaccacauuuguuaucucaaauu

SEQ ID NO: 44242 - RNA, 64 nt, Homo Sapiens
gcugcugacucacacugcuaacucuguuacugacaaaagcaaaucaauaacucuaaauucuggg

SEQ ID NO: 44243 - RNA, 64 nt, Homo Sapiens
gauaaugggcuuuguuagcacuuucaaaaaaaaaaaaagcaaaccauacuuguccacuguccug

SEQ ID NO: 44244 - RNA, 64 nt, Homo Sapiens
uccaccagggggaaggcuggcacaaggagaaaaaaaaagcaagcaucagcgaauaguauagugu

SEQ ID NO: 44245 - RNA, 64 nt, Homo Sapiens
acauguaggguuggugagaaggaaagaugagaacaaaagcaacauuggguuaagggaacucgcu

SEQ ID NO: 44246 - RNA, 64 nt, Homo Sapiens
agaaaagcacacgaacaggugggauucacuuaacaaaagcaagauuagucuaacuuaaacggau

SEQ ID NO: 44247 - RNA, 64 nt, Homo Sapiens
acaagaacaaaaacaccaaaguuugcuuugaagaaaaagcaaaaacuuaaagaccaaaucauuu

SEQ ID NO: 44248 - RNA, 64 nt, Homo Sapiens
aauuuaaaaacaagcccaccuauauuuuuacaaaaaaagcaaacggauuucuauucaccuuuaa

SEQ ID NO: 44249 - RNA, 64 nt, Homo Sapiens
uuacccucagaguuaugcuuuguuguuuccaaugaaaagcaagugcccccuguuuguuguuuug

SEQ ID NO: 44250 - RNA, 64 nt, Homo Sapiens
ccugcaaccaaacucccaucuuuccuuaugcuguaaaagcaaguuucuagcauauaugugucca

SEQ ID NO: 44251 - RNA, 64 nt, Homo Sapiens
ggcauuucccacccugaacacuucccugguaagaaaaagcaaaagcucuccuagguagcccccu

SEQ ID NO: 44252 - RNA, 64 nt, Homo Sapiens
aaaaugcuguguugaaaugccuagggaaaccuucaaaagcaauagcaauagaaugaugucugcu

SEQ ID NO: 44253 - RNA, 64 nt, Homo Sapiens
gaccccaucccucuaaagccgggugaugcacagcaaaagcaaugaaaauguaacugcuaaucaa

SEQ ID NO: 44254 - RNA, 64 nt, Homo Sapiens
acaauaugccaaguauaaccgauguugaucacacagcuucaaucggauuuaguuaggucauuaa

SEQ ID NO: 44255 - RNA, 64 nt, Homo Sapiens
acaauaagauguuaaaaagguuccuccauacauaagcuucaagguugcucuuuugguuuuuaac

SEQ ID NO: 44256 - RNA, 64 nt, Homo Sapiens
gcgaucugacaugaaagucaacugaggcauagccagcuucaaaauggcuaagagugcagcagag

SEQ ID NO: 44257 - RNA, 64 nt, Homo Sapiens
auggggaaacaggccagagcccucagaaauccucagcuucaaacaacgagcuuguuucccugaa

SEQ ID NO: 44258 - RNA, 64 nt, Homo Sapiens
ugaagagccacucagaaaaggcccauggccauggagcuucaaggaaagaaaccccucaguuuuu

SEQ ID NO: 44259 - RNA, 64 nt, Homo Sapiens
uucucaaacuccaaugcucacaaagcugaaaagaagcuucaaaacauugaucacccucucacaa

SEQ ID NO: 44260 - RNA, 64 nt, Homo Sapiens
gagaagguugcuucauuggcccugggacuucucucugcaggaggagagaacgcugccucuccuc

SEQ ID NO: 44261 - RNA, 64 nt, Homo Sapiens
uggccuuuggucagcguuuccacauccugcucugcugcaggagagggggcuaaggggcuggauc

SEQ ID NO: 44262 - RNA, 64 nt, Homo Sapiens
ccacuaugccagaaagcugcaaagcugcccccaucugcaggaagucaugucuguugugaccagg

SEQ ID NO: 44263 - RNA, 64 nt, Homo Sapiens
agccucccuggaugaucgaguagccuaaaagcaacugcaggacaaaagcugaugcagagcccau

SEQ ID NO: 44264 - RNA, 64 nt, Homo Sapiens
uaggcugaaugccucccagggugcuguaauuuggcugcaggagcaugcaucacauuguucucug

SEQ ID NO: 44265 - RNA, 64 nt, Homo Sapiens
gcuuacggagaacucugugucccagggggcggcucugcaggauuucccguauuucauuucugca

SEQ ID NO: 44266 - RNA, 64 nt, Homo Sapiens
gccaacaggugagaugggaacccaaggcuaccuacugcaggaggaugaaaagcucaggaucucu

SEQ ID NO: 44267 - RNA, 64 nt, Homo Sapiens
ugucugagaaaaucucccuagcagagccugggagcugcaggaacugugguugguucuagccccu

SEQ ID NO: 44268 - RNA, 64 nt, Homo Sapiens
ccucggggcacacugaagcuacugaaaauaccuacugcaggaucucucccuugcucuuccccaa

SEQ ID NO: 44269 - RNA, 64 nt, Homo Sapiens
ggguuagggaauuuggugcugacucagcacccuccugcaggacguggguagaggaugcugaacu

SEQ ID NO: 44270 - RNA, 64 nt, Homo Sapiens
cuggugucagggagagaaacagaacuuacagggccugcaggaagugcgaugugugccccaaagc

SEQ ID NO: 44271 - RNA, 64 nt, Homo Sapiens
uggccagccucaaacgacaaugucuggaagaguucugcaggaaauuacugcagacaaaacuucu

SEQ ID NO: 44272 - RNA, 64 nt, Homo Sapiens
aacuaagauuauaauuuccaguuuguaaaaccuccugcaggaguagugaagagcagcaggcugu

SEQ ID NO: 44273 - RNA, 64 nt, Homo Sapiens
uucccagcaggugaacagcucggagaagcugcagcugcaggagugcuugugggcuggugaguug

SEQ ID NO: 44274 - RNA, 64 nt, Homo Sapiens
cguggcuugguuucacgcgcagcggcgccagacccugcaggagggcggcgugguggucuugcuc

SEQ ID NO: 44275 - RNA, 64 nt, Homo Sapiens
ccagaugccgauacaggccccugacaaugaacuacugcaggaaugcuuuggaauuuccaguggc

SEQ ID NO: 44276 - RNA, 64 nt, Homo Sapiens
ccagauucugggaaacaacccugaccaggaacuacugcaggaauguucuggaauuugcaguggc

SEQ ID NO: 44277 - RNA, 64 nt, Homo Sapiens
ccagauccuguggaaggcccuugaucaugaacuacugcaggaaucuuuuggaauuuccagugac

SEQ ID NO: 44278 - RNA, 60 nt, Homo Sapiens
ccggauuguucggcaggcccucuccaacuacugcaggaauugugauuuucaguggcuuga

SEQ ID NO: 44279 - RNA, 64 nt, Homo Sapiens
uguuaccucacucccacaggggcaugugcucagucugcaggaaucuugaggagcugcagcagua

SEQ ID NO: 44280 - RNA, 64 nt, Homo Sapiens
gaagaagucgcacucgaguccgaugaaagcgaggcugcaggacuggcaaagagcuacugaguaa

SEQ ID NO: 44281 - RNA, 64 nt, Homo Sapiens
ccccggcccagggcugccaggaacaaguuccucucugcaggaucucacagcagcccugagaaga

SEQ ID NO: 44282 - RNA, 64 nt, Homo Sapiens
gucugcaaggacgcagaauaagcagugagggcggcugcaggagaggaaggggcucccacagccc

SEQ ID NO: 44283 - RNA, 64 nt, Homo Sapiens
ugauggagaaggugaugguuugucccccauggcucugcaggaccggcaaaaugccaccaggcuu

SEQ ID NO: 44284 - RNA, 64 nt, Homo Sapiens
ccuugggaucaggaaaucuaugcgaucagcugagcugcaggaggcacagaaucugaauuccuga

SEQ ID NO: 44285 - RNA, 64 nt, Homo Sapiens
gccggggcgguggggggggcagcgcgggcuaagccugcaggaaagccugcucaugggguccuaa

SEQ ID NO: 44286 - RNA, 64 nt, Homo Sapiens
ccaggcaccucccguuuguccucugcaggggccccugcaggauuugaagggcguccgcuggcca

SEQ ID NO: 44287 - RNA, 64 nt, Homo Sapiens
gcaugcggccacucggcaggccgcgggcauccggcugcaggaccagguggugaucaucgacgag

SEQ ID NO: 44288 - RNA, 64 nt, Homo Sapiens
gggcaugcccuuccccaacaucaggucugcagagcugcaggagaagauggccuacuuggaucaa

SEQ ID NO: 44289 - RNA, 64 nt, Homo Sapiens
cgacagaagucaaauauaucucuucccaccagugcugcaggaggccccaccugugacugcagca

SEQ ID NO: 44290 - RNA, 64 nt, Homo Sapiens
uggugcugugaguggggguacgaccagguggcugcugcaggagcaauuucugccuucuugacgg

SEQ ID NO: 44291 - RNA, 64 nt, Homo Sapiens
gagucuuaccuccccuggccucaccaacccgcuccugcaggagucgaguucccccagcccuuca

SEQ ID NO: 44292 - RNA, 64 nt, Homo Sapiens
ccagcuagcuggccagguggugacuauuccgcugcugcaggaaccacuucugcugggaacuccc

SEQ ID NO: 44293 - RNA, 64 nt, Homo Sapiens
cuggugagaggaggaccuugugccugcccagagccugcaggacagcacgccuugaggucagagg

SEQ ID NO: 44294 - RNA, 64 nt, Homo Sapiens
ucagaaacaacccgugcaucccugcccauggauucugcaggaccuagaagaguggcauugguuc

SEQ ID NO: 44295 - RNA, 64 nt, Homo Sapiens
guucuccagugccaaguacccugcuccagagcgccugcaggaauauggcuccaucuucacgggc

SEQ ID NO: 44296 - RNA, 64 nt, Homo Sapiens
ccagagcaagcaccgcccccuggacgagcgggcccugcaggacuuuccugugugcgugagcacc

SEQ ID NO: 44297 - RNA, 64 nt, Homo Sapiens
ggcugcuagagcagaagcggagagguugcuggagcugcaggagagagguugcuggagcaagagg

SEQ ID NO: 44298 - RNA, 64 nt, Homo Sapiens
gccugcuagagcagaagcggagaggcuacuggagcugcaggagagagguugcuggagcaagagg

SEQ ID NO: 44299 - RNA, 64 nt, Homo Sapiens
ugggaguguuucuguuguuggcuaauugcugugacugcaggaagugggaguguuuuuauuguua

SEQ ID NO: 44300 - RNA, 64 nt, Homo Sapiens
ugggaguguuuuuauuguuaucuuucagcugugacugcaggaagauguagucugccuugaaaag

SEQ ID NO: 44301 - RNA, 64 nt, Homo Sapiens
ucucaugccuuuacuuacaaucucuguaguuacacugcaggaucaggaauucaagaacagcuua

SEQ ID NO: 44302 - RNA, 54 nt, Homo Sapiens
uucuggaggaaagcacucauauuacugcaggaacuacauaauagauggauauga

SEQ ID NO: 44303 - RNA, 64 nt, Homo Sapiens
gaauggccgccuggggagccagggccuuuaggggcugcaggacguggcgugaagaggccugguc

SEQ ID NO: 44304 - RNA, 64 nt, Homo Sapiens
aggaagacaggccaaucccucacagguuggggcucugcaggaugcugaggcaugagcaccuggg

SEQ ID NO: 44305 - RNA, 64 nt, Homo Sapiens
cagggccaaagaggcagaucagcugaagcaggaccugcaggaagcacgcgaggcggagcgaaga

SEQ ID NO: 44306 - RNA, 64 nt, Homo Sapiens
cggcagaguggaauacauggaaaagagcaagcaucugcaggagcagcucaaugaacucaagaca

SEQ ID NO: 44307 - RNA, 64 nt, Homo Sapiens
uaugacucgucgugggcgcauggcggcgcaccugcugcaggagcggccacgucucagcuucauu

SEQ ID NO: 44308 - RNA, 64 nt, Homo Sapiens
cagcuccuccgucagugucugcauggguagcaggcugcaggaguggggucucugcacagccugg

SEQ ID NO: 44309 - RNA, 64 nt, Homo Sapiens
agacuuucugaaaacacuugaugauguggaaaugcugcaggauuaaauaacuugaagagccuuu

SEQ ID NO: 44310 - RNA, 64 nt, Homo Sapiens
uauacauaggcaucauuucacaaggucaguaaugcugcaggaaaagcaaaauugcaaucuacgu

SEQ ID NO: 44311 - RNA, 64 nt, Homo Sapiens; identical to SEQ ID NO: 44254

SEQ ID NO: 44312 - RNA, 64 nt, Homo Sapiens; identical to SEQ ID NO: 44255

SEQ ID NO: 44313 - RNA, 64 nt, Homo Sapiens; identical to SEQ ID NO: 44256

SEQ ID NO: 44314 - RNA, 64 nt, Homo Sapiens; identical to SEQ ID NO: 44257

SEQ ID NO: 44315 - RNA, 64 nt, Homo Sapiens; identical to SEQ ID NO: 44258

SEQ ID NO: 44316 - RNA, 64 nt, Homo Sapiens; identical to SEQ ID NO: 44259

SEQ ID NO: 44317 - RNA, 64 nt, Homo Sapiens; identical to SEQ ID NO: 44260

SEQ ID NO: 44318 - RNA, 64 nt, Homo Sapiens; identical to SEQ ID NO: 44261

SEQ ID NO: 44319 - RNA, 64 nt, Homo Sapiens; identical to SEQ ID NO: 44262

SEQ ID NO: 44320 - RNA, 64 nt, Homo Sapiens; identical to SEQ ID NO: 44263

SEQ ID NO: 44321 - RNA, 64 nt, Homo Sapiens; identical to SEQ ID NO: 44264

SEQ ID NO: 44322 - RNA, 64 nt, Homo Sapiens; identical to SEQ ID NO: 44265

SEQ ID NO: 44323 - RNA, 64 nt, Homo Sapiens; identical to SEQ ID NO: 44266

SEQ ID NO: 44324 - RNA, 64 nt, Homo Sapiens; identical to SEQ ID NO: 44267

SEQ ID NO: 44325 - RNA, 64 nt, Homo Sapiens; identical to SEQ ID NO: 44268

SEQ ID NO: 44326 - RNA, 64 nt, Homo Sapiens; identical to SEQ ID NO: 44269

SEQ ID NO: 44327 - RNA, 64 nt, Homo Sapiens; identical to SEQ ID NO: 44270

SEQ ID NO: 44328 - RNA, 64 nt, Homo Sapiens; identical to SEQ ID NO: 44271

SEQ ID NO: 44329 - RNA, 64 nt, Homo Sapiens; identical to SEQ ID NO: 44272

SEQ ID NO: 44330 - RNA, 64 nt, Homo Sapiens; identical to SEQ ID NO: 44273

SEQ ID NO: 44331 - RNA, 64 nt, Homo Sapiens; identical to SEQ ID NO: 44274

SEQ ID NO: 44332 - RNA, 64 nt, Homo Sapiens; identical to SEQ ID NO: 44275

SEQ ID NO: 44333 - RNA, 64 nt, Homo Sapiens; identical to SEQ ID NO: 44276

SEQ ID NO: 44334 - RNA, 64 nt, Homo Sapiens; identical to SEQ ID NO: 44277

SEQ ID NO: 44335 - RNA, 60 nt, Homo Sapiens; identical to SEQ ID NO: 44278

SEQ ID NO: 44336 - RNA, 64 nt, Homo Sapiens; identical to SEQ ID NO: 44279

SEQ ID NO: 44337 - RNA, 64 nt, Homo Sapiens; identical to SEQ ID NO: 44280

SEQ ID NO: 44338 - RNA, 64 nt, Homo Sapiens; identical to SEQ ID NO: 44281

SEQ ID NO: 44339 - RNA, 64 nt, Homo Sapiens; identical to SEQ ID NO: 44282

SEQ ID NO: 44340 - RNA, 64 nt, Homo Sapiens; identical to SEQ ID NO: 44283

SEQ ID NO: 44341 - RNA, 64 nt, Homo Sapiens; identical to SEQ ID NO: 44284

SEQ ID NO: 44342 - RNA, 64 nt, Homo Sapiens; identical to SEQ ID NO: 44285

SEQ ID NO: 44343 - RNA, 64 nt, Homo Sapiens; identical to SEQ ID NO: 44286

SEQ ID NO: 44344 - RNA, 64 nt, Homo Sapiens; identical to SEQ ID NO: 44287

SEQ ID NO: 44345 - RNA, 64 nt, Homo Sapiens; identical to SEQ ID NO: 44288

SEQ ID NO: 44346 - RNA, 64 nt, Homo Sapiens; identical to SEQ ID NO: 44289

SEQ ID NO: 44347 - RNA, 64 nt, Homo Sapiens; identical to SEQ ID NO: 44290

SEQ ID NO: 44348 - RNA, 64 nt, Homo Sapiens; identical to SEQ ID NO: 44291

SEQ ID NO: 44349 - RNA, 64 nt, Homo Sapiens; identical to SEQ ID NO: 44292

SEQ ID NO: 44350 - RNA, 64 nt, Homo Sapiens; identical to SEQ ID NO: 44293

SEQ ID NO: 44351 - RNA, 64 nt, Homo Sapiens; identical to SEQ ID NO: 44294

SEQ ID NO: 44352 - RNA, 64 nt, Homo Sapiens; identical to SEQ ID NO: 44295

SEQ ID NO: 44353 - RNA, 64 nt, Homo Sapiens; identical to SEQ ID NO: 44296

SEQ ID NO: 44354 - RNA, 64 nt, Homo Sapiens; identical to SEQ ID NO: 44297

SEQ ID NO: 44355 - RNA, 64 nt, Homo Sapiens; identical to SEQ ID NO: 44298

SEQ ID NO: 44356 - RNA, 64 nt, Homo Sapiens; identical to SEQ ID NO: 44299

SEQ ID NO: 44357 - RNA, 64 nt, Homo Sapiens; identical to SEQ ID NO: 44300

SEQ ID NO: 44358 - RNA, 64 nt, Homo Sapiens; identical to SEQ ID NO: 44301

SEQ ID NO: 44359 - RNA, 54 nt, Homo Sapiens; identical to SEQ ID NO: 44302

SEQ ID NO: 44360 - RNA, 64 nt, Homo Sapiens; identical to SEQ ID NO: 44303

SEQ ID NO: 44361 - RNA, 64 nt, Homo Sapiens; identical to SEQ ID NO: 44304

SEQ ID NO: 44362 - RNA, 64 nt, Homo Sapiens; identical to SEQ ID NO: 44305

SEQ ID NO: 44363 - RNA, 64 nt, Homo Sapiens; identical to SEQ ID NO: 44306

SEQ ID NO: 44364 - RNA, 64 nt, Homo Sapiens; identical to SEQ ID NO: 44307

SEQ ID NO: 44365 - RNA, 64 nt, Homo Sapiens; identical to SEQ ID NO: 44308

SEQ ID NO: 44366 - RNA, 64 nt, Homo Sapiens; identical to SEQ ID NO: 44309

SEQ ID NO: 44367 - RNA, 64 nt, Homo Sapiens; identical to SEQ ID NO: 44310

SEQ ID NO: 44368 - RNA, 64 nt, Homo Sapiens
cuaguaugucaauaaagcaacuuguuacacacacaggucuaagcuggugcuauuauuaggcuug

SEQ ID NO: 44369 - RNA, 64 nt, Homo Sapiens
ggaguuuuaagguuacugauaguuuucaauaauuaggucuaagucuuucacuucauuauaugca

SEQ ID NO: 44370 - RNA, 64 nt, Homo Sapiens
cuugcuaagggauaaacaaacaauacauaacuuuaggucuaaguacaauauccacacacugcau

SEQ ID NO: 44371 - RNA, 64 nt, Homo Sapiens
aagcucggguuguucaaagaaaagaaaaggagaaaggucuaaucgaaaugguuuguaagagggg

SEQ ID NO: 44372 - RNA, 64 nt, Homo Sapiens
guguaaauuaauauggauaauuuuauuuaccuccaggucuaaaagguagugugacccaaauuug

SEQ ID NO: 44373 - RNA, 64 nt, Homo Sapiens
uuucaugugaaaggacugggguuuuagcaaacacaggucuaaucucuuuuguguuuuugugcac

SEQ ID NO: 44374 - RNA, 64 nt, Homo Sapiens
uuuaucuaaccaaucagaaaggaucuuucagaucaugugcaauuaaauuguauauguuuauaca

SEQ ID NO: 44375 - RNA, 64 nt, Homo Sapiens
aaugacaauuauuugaauguuuuauuagaauaaaaugugcaaauuaagaaaaugagaaauuaua

SEQ ID NO: 44376 - RNA, 64 nt, Homo Sapiens
aaacacacaaaagauuauguauuggcauuuauuuaugugcaaggugauaggaaaacugaaucca

SEQ ID NO: 44377 - RNA, 64 nt, Homo Sapiens
aauuuccaagacaguuguaucacaaagcugugaaaugugcaagaguauacuuuguacccaucau

SEQ ID NO: 44378 - RNA, 64 nt, Homo Sapiens
uuaacuaugagauuuuuaaaaaauggggccgcugaugugcaauaucaaagugaacuugugagua

SEQ ID NO: 44379 - RNA, 64 nt, Homo Sapiens
aaguaccucucuuuugugacucuuguacagcuuaaugugcaauaaaggaaaaguuauaucuguc

SEQ ID NO: 44380 - RNA, 64 nt, Homo Sapiens
auggacauaauaguucacuucacaguggacgaguaugugcaaacgucuccuucaggugaucaca

SEQ ID NO: 44381 - RNA, 64 nt, Homo Sapiens
aauuauauauaaauauauuuuccuucuaaauuucaugugcaaauaucaaaguaaaucugcaaau

SEQ ID NO: 44382 - RNA, 64 nt, Homo Sapiens
ccacauuuuuauuccguagauguuaaucucuuucaugugcaaucuuugcuucuuguaggcuauc

SEQ ID NO: 44383 - RNA, 64 nt, Homo Sapiens
aggacaaccagaaguacacauuuacaauagauagaugugcaaaagaccuuuuuguagccaaaca

SEQ ID NO: 44384 - RNA, 64 nt, Homo Sapiens
acauauauuuaaacuuacagauggaaauugcccaaugugcaaauuguuaaguaccacacuuuac

SEQ ID NO: 44385 - RNA, 64 nt, Homo Sapiens
aggagacugaaacucaaacaacccugggcaaguaaugugcaaaagauggcaggguggggauuug

SEQ ID NO: 44386 - RNA, 64 nt, Homo Sapiens
ccaggucuaccuguugcagagucaagggacuugcaugugcaaguuggguggaugcugggaggca

SEQ ID NO: 44387 - RNA, 64 nt, Homo Sapiens
uucugggcugccagcaguacgugggaaagguggaaugugcaauaggaacagaucugugcauuuu

SEQ ID NO: 44388 - RNA, 64 nt, Homo Sapiens
guucugugguuaccagaaauacugagugucugucaugugcaagacaaugcuaagaacagaauac

SEQ ID NO: 44389 - RNA, 64 nt, Homo Sapiens
cuuuauuacugguuauauacauuuggccauuaugaugugcaagcaauuggaaaaaaagucaagu

SEQ ID NO: 44390 - RNA, 64 nt, Homo Sapiens
gcuuaaaguguuaaaauacccuagauacuguguuaugugcaacuguagaaacccuccagaaauu

SEQ ID NO: 44391 - RNA, 64 nt, Homo Sapiens
aaauguauuuguuuguauuuuuuaaaauauuuuuaugugcaauaugcaauacuucaauacuuca

SEQ ID NO: 44392 - RNA, 64 nt, Homo Sapiens
ugugauguggcaaaucucuaaauaguguuggaaaaugugcaauaggaauauuugcaagacauag

SEQ ID NO: 44393 - RNA, 64 nt, Homo Sapiens
aagggauguuagcauucauuagaguaugaggaugagucccaagaagguucuuuggaaggaggac

SEQ ID NO: 44394 - RNA, 64 nt, Homo Sapiens
uuuuuaagugggcuuccauuccauggauuuaaucagucccaagaagaucaaacucagcaguacu

SEQ ID NO: 44395 - RNA, 64 nt, Homo Sapiens
ugggguugcaaaaucauuuugauuucuuauguuaagucccaacuaacguuggcaacaccauaag

SEQ ID NO: 44396 - RNA, 64 nt, Homo Sapiens
agggugagggagaauaaggggugagcuuggcucuagucccaagauaucggaggcccuggaguuu

SEQ ID NO: 44397 - RNA, 64 nt, Homo Sapiens
uccuucagacauugacaugagaucuuaagcaaacagucccaaaccucuuaggggugaaaaaaga

SEQ ID NO: 44398 - RNA, 64 nt, Homo Sapiens
ucucauacucccacaggcuagaccagagaugccaagucccaacagcacugagcugugugcacug

SEQ ID NO: 44399 - RNA, 64 nt, Homo Sapiens
ggaacugaccagcuuauauugcccaguauucccacucuccaaaaucagcagaagaagcagccau

SEQ ID NO: 44400 - RNA, 64 nt, Homo Sapiens
ggaguguuggaaaauguucugccauguagacacacucuccaaauugucagaguuguggcucuca

SEQ ID NO: 44401 - RNA, 64 nt, Homo Sapiens
aacuugaccuaccuuaugggcuucauucucaacacucuccaaagauagccagaguuuaauacau

SEQ ID NO: 44402 - RNA, 64 nt, Homo Sapiens
accggaugaagaaguacauguggaggccaagaaacucuccaaggaaugaaagauaccaagaaca

SEQ ID NO: 44403 - RNA, 64 nt, Homo Sapiens
agagguagcauuuuugcugaaaucgggccugucacucuccaauaaagguucuggcacuucaaug

SEQ ID NO: 44404 - RNA, 64 nt, Homo Sapiens
acacagaacacaggaguuugcuuuuggcuucucacucuccaaguaacccugaauuaggcccaga

SEQ ID NO: 44405 - RNA, 64 nt, Homo Sapiens
gcuggccuaggagauaucugagggaggaggccaccucuccaagggcuucugcacccuccacccu

SEQ ID NO: 44406 - RNA, 64 nt, Homo Sapiens
gggcucgccaugccggggguucauaggucacuggcucuccaagugccagaggugggcagguggu

SEQ ID NO: 44407 - RNA, 64 nt, Homo Sapiens
ugacuguggagcacccagggacgugguuuuagagucuaccuaauauguuaaggacaaggaaacc

SEQ ID NO: 44408 - RNA, 64 nt, Homo Sapiens
uaccuaauauguuaaggacaaggaaaccucugagucuaccuaauauguuaaggacaaggaaacc

SEQ ID NO: 44409 - RNA, 64 nt, Homo Sapiens
uguagguaguauucucuuccuacuauauuucauaucuaccuacuacauuucauaucauuccuac

SEQ ID NO: 44410 - RNA, 64 nt, Homo Sapiens
acuacauuucauaucauuccuacuacauuucauaucuaccuacauuuacauguagguagauaug

SEQ ID NO: 44411 - RNA, 64 nt, Homo Sapiens
ugaugagccucuacucagccuaggaaauaaaguuucuaccuauuaagagguccagggagggauu

SEQ ID NO: 44412 - RNA, 64 nt, Homo Sapiens
gugcauuugaacugccuucuggcuuccucugccuucuaccuacaguucugcauugcuaaauaag

SEQ ID NO: 44413 - RNA, 64 nt, Homo Sapiens
aagauauucugccaaaauaucaggaccagaauuuucuaccuaaggaccagaauuuuuuaucuag

SEQ ID NO: 44414 - RNA, 64 nt, Homo Sapiens
aagauauucugccaaaauaucaggaccagaauuuucuaccuaaggaccagaauuuuuugucuag

SEQ ID NO: 44415 - RNA, 64 nt, Homo Sapiens
gagaccagcauguucuccccaaagaccagaauauucuaccuaaauaucaaggccaggauuuucu

SEQ ID NO: 44416 - RNA, 64 nt, Homo Sapiens
agaauauucuaccuaaauaucaaggccaggauuuucuaccuaaagaccaggacuuuuuaucuag

SEQ ID NO: 44417 - RNA, 64 nt, Homo Sapiens
uugacuccuugugguuuaugucaucauacaugacucagcauaccugcuggugcagagcugaaga

SEQ ID NO: 44418 - RNA, 64 nt, Homo Sapiens
cuuuuuccccaaagucuuaaaauaacuuauaucaucagcauaccuuuauugugaucuaucaaua

SEQ ID NO: 44419 - RNA, 64 nt, Homo Sapiens
auccgcuucgcuuucuguuugcuuucuucauucuucagcauauucagcauaagccaucaugugg

SEQ ID NO: 44420 - RNA, 64 nt, Homo Sapiens
ccaucaugugggcuuucuucacucuguuguaaagucagcauaagcuuuaauguuugaauguuuc

SEQ ID NO: 44421 - RNA, 62 nt, Homo Sapiens
aaggcuuuaccaagcaaugaauuccuagugcaucagcauauucauaaaugaaauauacuccg

SEQ ID NO: 44422 - RNA, 64 nt, Homo Sapiens
uauaugcauaugcagacauauguauauggucuggucagcauauguguauguaugcguauguaug

SEQ ID NO: 44423 - RNA, 64 nt, Homo Sapiens
uaucacaguugagaguuuaaucaaaaugaccggaucagcauauucuuuuuuuagaugagacaga

SEQ ID NO: 44424 - RNA, 64 nt, Homo Sapiens
ggauuacaggcgugagccaccacaccuggccagcucagcauauucuuaaguaggauucacauuu

SEQ ID NO: 44425 - RNA, 64 nt, Homo Sapiens
ucuugauugcuuuauuaucaucauacuaguguguucauuauagaguaucuguagaggugaaugu

SEQ ID NO: 44426 - RNA, 64 nt, Homo Sapiens
aaagcaagauucaauuccuuguucauuugaguguucauuauaugccaggcauugaccaguugca

SEQ ID NO: 44427 - RNA, 64 nt, Homo Sapiens
ugcuuaucuagguuuucauacuuaccuaggauucucauuauagaaaagauucucauuauaaaug

SEQ ID NO: 44428 - RNA, 64 nt, Homo Sapiens
ugcuuaccuaggauucucauaugaaaaaagauucucauuauaaaagauuaaaugaugcugagga

SEQ ID NO: 44429 - RNA, 64 nt, Homo Sapiens
gauauugauaaauuguggaaaaucauuuugaaguucauuauagcguucuaacaaucauauugug

SEQ ID NO: 44430 - RNA, 64 nt, Homo Sapiens
aaaaaauaacauuuuaauguaaacaguaccaauaucauuauagauauguagaaucaaauuauau

SEQ ID NO: 44431 - RNA, 64 nt, Homo Sapiens
caauaucuuuaauauaaaucuuuuuacugagagaucauuauagaaacauguuaaaguugguuag

SEQ ID NO: 44432 - RNA, 64 nt, Homo Sapiens
aauaacgauggugaugauaauuuuaguauuacugucauuauaauuauuauuauauucauucuac

SEQ ID NO: 44433 - RNA, 64 nt, Homo Sapiens
aucaauuuaagaaguuuaaagagcaaguauauacucauuauagauauauauauauuuguaauga

SEQ ID NO: 44434 - RNA, 64 nt, Homo Sapiens
uuuuguauaauaagaguagucaaaacucuguaaaucauuauagcgaagcacaagaguuccuaca

SEQ ID NO: 44435 - RNA, 64 nt, Homo Sapiens
uuauaugaaaagaucaccuuaaguuuguuucuuuucauuauaguuauaaaauccuacuuuggcc

SEQ ID NO: 44436 - RNA, 64 nt, Homo Sapiens
gugaucacuuugacuugagcacaaauggaacauuucauuauaacucuaaaaauuauuagcuguu

SEQ ID NO: 44437 - RNA, 64 nt, Homo Sapiens
uaugugaggaaacaugcaaagcauuaggaaauuuauuuccuaaaaacaguuuuguaaaauuagu

SEQ ID NO: 44438 - RNA, 64 nt, Homo Sapiens
cauuuacaugaguuaacauuuuuucauagaacuuauuuccuagauagaauuuuuuacuguuuuu

SEQ ID NO: 44439 - RNA, 64 nt, Homo Sapiens
aggaccucauauuaagagcuaagcaaauggccacauuuccuauauuuugacagagauacugcug

SEQ ID NO: 44440 - RNA, 64 nt, Homo Sapiens
aggcccucaucagaugcuggccccuuggucuugaauuuccuagccucuacaacuaagccaaaua

SEQ ID NO: 44441 - RNA, 64 nt, Homo Sapiens
uaguuuacuuucccugguuggaaauuuauuucuuauuuccuaacauugaauucguuagaaaaaa

SEQ ID NO: 44442 - RNA, 64 nt, Homo Sapiens
ucauuuugaucuagauauaaaauuaaaauuguccauuuccuauauaaauaccagcaagaucacu

SEQ ID NO: 44443 - RNA, 64 nt, Homo Sapiens
uuaaguucuguuggcuagcuaugguuuucaguacauuuccuacuuuaagaguaauuacugacaa

SEQ ID NO: 44444 - RNA, 64 nt, Homo Sapiens
uuccuacuuuaagaguaauuacugacaaauauguauuuccuauauguuuauacuuugauuauaa

SEQ ID NO: 44445 - RNA, 64 nt, Homo Sapiens
gccauggcagacauugcuaaucaaucacagcacuauuuccuauuaagcccacugauuucuucac

SEQ ID NO: 44446 - RNA, 64 nt, Homo Sapiens
guauauauucguauuccauguguuagauggaagcauuuccuauccagugugaauaaaaagaaca

SEQ ID NO: 44447 - RNA, 64 nt, Homo Sapiens
aauucuuaaauauauacagacauuuuaaauaaucauuuccuagaaaauaauuacuuagaaacuc

SEQ ID NO: 44448 - RNA, 64 nt, Homo Sapiens
aacacaaucagauugguuuuaguuuccagaacaaauuuccuaauccaucaauaauuuaugaaua

SEQ ID NO: 44449 - RNA, 64 nt, Homo Sapiens
gucagaguagaagauuuuauucagagacuaucugauuuccuaauuguccaauaacaggucaacu

SEQ ID NO: 44450 - RNA, 64 nt, Homo Sapiens
ucuggugcucuuucccuuuagcgccagaacccagauuuccuaacgacccgaauuauaaaggcca

SEQ ID NO: 44451 - RNA, 64 nt, Homo Sapiens
uuuacagucugucuauugguuuuccuuaacgaaaauuuccuaugugaauuacaguaaacccauc

SEQ ID NO: 44452 - RNA, 64 nt, Homo Sapiens
gugaccaugguugaacuuuaaaauaaacagggguauuuccuaaggauuuguauuucugauuaac

SEQ ID NO: 44453 - RNA, 64 nt, Homo Sapiens
gcaaacacugaacuuugucaauuaauuugaggcuauuuccuauuugaccccuuuucuuuuuuga

SEQ ID NO: 44454 - RNA, 64 nt, Homo Sapiens
uguucuugcauuagcucaauugaugucaucacugauuuccuaaacuagaaacuauggaagcauc

SEQ ID NO: 44455 - RNA, 64 nt, Homo Sapiens
cgcccucuugcuugaaaacuucacuugcuuccccauuuccuacucuuuaaggaaugauuucuuu

SEQ ID NO: 44456 - RNA, 64 nt, Homo Sapiens
auaaaaauacaacagugcaucuuucugguguuuuauuuccuaucacuuaccaaagaauaagugu

SEQ ID NO: 44457 - RNA, 64 nt, Homo Sapiens
gguucuggguuuucugaaagucauaauuuuaguaauuuccuagagcuuauaaaauuuaacuucu

SEQ ID NO: 44458 - RNA, 64 nt, Homo Sapiens
auguauaacuagcaacauuuaugguuauagguugauuuccuaaguguggcugaugguagccucu

SEQ ID NO: 44459 - RNA, 64 nt, Homo Sapiens
cugcuacagccaagaccugcucuuguggagguacauuuccuaagccggaacacucaagcuuuuu

SEQ ID NO: 44460 - RNA, 64 nt, Homo Sapiens
guaagccagcucuauuguaaguguuccugauaagauuuccuacaaauguuuaacaagaacacaa

SEQ ID NO: 44461 - RNA, 64 nt, Homo Sapiens
uguuuaacaagaacacaaguuucauuggcuugguauuuccuaaaucuuguauguuaauugcauc

SEQ ID NO: 44462 - RNA, 64 nt, Homo Sapiens
agcuguaauaguggagguauuaaaguggauuguaauuuccuauagaaugaaccuuugaggccug

SEQ ID NO: 44463 - RNA, 64 nt, Homo Sapiens
uuaccccaguaauuugcaucacuaaugcuauaaaauuuccuauauuuaguuuuuuaauucauuu

SEQ ID NO: 44464 - RNA, 64 nt, Homo Sapiens
uucucugggggauuugaggguagggucacuugccauuuccuaccuucuugcugaccugaggcua

SEQ ID NO: 44465 - RNA, 64 nt, Homo Sapiens
gaaggggaaggagaauaaacaccacugugugcccauuuccuaggcagccaaagcuggccccuga

SEQ ID NO: 44466 - RNA, 64 nt, Homo Sapiens
ggaaaggaaagguauuuuguuucuuugucuauacauuuccuagauuucuaugcaguugggauuu

SEQ ID NO: 44467 - RNA, 64 nt, Homo Sapiens
aucuauguacuaaauugcuuccagguaauuuuugauuuccuaaagugcacugagguuaucugga

SEQ ID NO: 44468 - RNA, 64 nt, Homo Sapiens
uuaaaaucuuaauugauuuuguaacaaucccaagauuuccuagaagauaagguuuuuuacaugu

SEQ ID NO: 44469 - RNA, 64 nt, Homo Sapiens
cacaauucuaugugacuuauuaauaaguaaauugauuuccuaauagcaagugcccugcacagag

SEQ ID NO: 44470 - RNA, 64 nt, Homo Sapiens
aaacuauauauauauacagucuuuuaaaauaaguauuuccuauuguaguuacaaaggggucagu

SEQ ID NO: 44471 - RNA, 64 nt, Homo Sapiens
aaucagcguaguuacaaagggaaacauccccaacauuuccuacauggccccuuugucuucguuu

SEQ ID NO: 44472 - RNA, 64 nt, Homo Sapiens
uuuucaugaaaaagcuggaauucaaaguauuuaaauuuccuagguccccacucuuuucuuccuc

SEQ ID NO: 44473 - RNA, 64 nt, Homo Sapiens
cuuucacaaaaauccgggaacucaaucuaguuaaauuuccuaagccccacuccuuucuucccuc

SEQ ID NO: 44474 - RNA, 64 nt, Homo Sapiens
agucuucaauauaaccaauugggaaauguaguaaccuaguuaguuaacuguacagugagugugg

SEQ ID NO: 44475 - RNA, 64 nt, Homo Sapiens
ucacuggcaccuagauaagucccaaagggagggaccuaguuaagcccgcgaaaagguaaauaca

SEQ ID NO: 44476 - RNA, 64 nt, Homo Sapiens
cauguaauuuaauucugguaaaugugucagaugcccuaguuaauugauuuuugggaaagggcaa

SEQ ID NO: 44477 - RNA, 64 nt, Homo Sapiens
cagacaaaauuuggaaacuuuacuucuuucuaauccuaguuauuuguccaaaccauuuuuuagu

SEQ ID NO: 44478 - RNA, 64 nt, Homo Sapiens
auuuaauaugagggugcaagaaaagcacaaguucccuaguuaccuuuuucauguugaaaggaga

SEQ ID NO: 44479 - RNA, 64 nt, Homo Sapiens
guagugcaaaucagaucagacaugaccugugguaccuaguuaugaguccauuaacucuuugggc

SEQ ID NO: 44480 - RNA, 64 nt, Homo Sapiens
uaguauggacaacuuuuugccacuaacugaauucuccaaauacucacacgugaaauuucaaaaa

SEQ ID NO: 44481 - RNA, 64 nt, Homo Sapiens
uagaaaugucaguauuuuuguaauuauuucuaccuccaaauauauauauauugucuuucacugg

SEQ ID NO: 44482 - RNA, 64 nt, Homo Sapiens
gucacauuuacaggguaccagcaaagacccugucuccaaauaagaccucaucuugacuacaucc

SEQ ID NO: 44483 - RNA, 64 nt, Homo Sapiens
aguuuaauuuuuauuaauuaagggggaaaaucauuccaaauaaggggcacuguuuaauuaugaa

SEQ ID NO: 44484 - RNA, 64 nt, Homo Sapiens
ucccaaguacuauuauuccauacuacuauauucuuccaaauauuuggaacacucuuagaauucc

SEQ ID NO: 44485 - RNA, 64 nt, Homo Sapiens
acagagcaguuaacuuuacucuugguucugagucuccaaauaauaauagccgacguuuauugag

SEQ ID NO: 44486 - RNA, 64 nt, Homo Sapiens
agauuguuuuuguacauucucuuuguuuucauuuuccaaauauaaucuuuaauaaacuugauuu

SEQ ID NO: 44487 - RNA, 64 nt, Homo Sapiens
uuucuguuuauuacaugaaauuacauuccauuuauccaaauauauguuuauauaauauuuccac

SEQ ID NO: 44488 - RNA, 64 nt, Homo Sapiens
cugagaucaguucuacugaaauggcaacaacaacuccaaauacaucucucccuucuugaaaucc

SEQ ID NO: 44489 - RNA, 64 nt, Homo Sapiens
augcuaaaccucuagggucugaugcuguuuuuguuccaaauauaaacgaaaggcacuagucagc

SEQ ID NO: 44490 - RNA, 64 nt, Homo Sapiens
auauaaacauuuuauuuauauaccauguaccuaauccaaauaucccagguaaaaacagauauug

SEQ ID NO: 44491 - RNA, 64 nt, Homo Sapiens
aauuagauggaaaaaugugacugaaauuauuuucuccaaauaaauuuauuagaauaauuucaua

SEQ ID NO: 44492 - RNA, 64 nt, Homo Sapiens
auuuuccccaguucaaugcuaugccauuaccaacuccaaauaaucucaaauaauuuuccacuua

SEQ ID NO: 44493 - RNA, 64 nt, Homo Sapiens
ucauauaauaaguacuggcuuacagcuaagugguuccaaauacugguaauuaaaacaaugaugu

SEQ ID NO: 44494 - RNA, 64 nt, Homo Sapiens
agcuaggguuugcccucuucaugucuacucuccuuccaaauaguuauauccaaaacuguuuuuc

SEQ ID NO: 44495 - RNA, 64 nt, Homo Sapiens
aucccauccuuuggguuguggguuuuuuguuuucuccaaauaaaucugaucuuuaaaguucauu

SEQ ID NO: 44496 - RNA, 64 nt, Homo Sapiens
agaacuuuauuuuggaaaauuuauaagaaaguaauccaaauaagaaacacgauaguugaaaaua

SEQ ID NO: 44497 - RNA, 64 nt, Homo Sapiens
auacuaccaguugugucuuuagauggcacacaaguccaaauaaguggucauacuucuuuauuca

SEQ ID NO: 44498 - RNA, 64 nt, Homo Sapiens
gggggacagacagggaaagcugcgaauucucuuguccaaauaguggauugggcagacuggccug

SEQ ID NO: 44499 - RNA, 64 nt, Homo Sapiens
cauagaugaaaacaaacuuggauuuuuuucuuuguccaaauaaaaaaaaaugauguaaagaaau

SEQ ID NO: 44500 - RNA, 64 nt, Homo Sapiens
uaaaagcaauguuuaaaucaaacuaaagauuaaaaauuaaaauucguuuuugcaauaaugacaa

SEQ ID NO: 44501 - RNA, 64 nt, Homo Sapiens
caccuuugaaaugcaccaaaugaauugaguuuguaauuaaaaaaauuuuuuucccuuucaguca

SEQ ID NO: 44502 - RNA, 64 nt, Homo Sapiens
ggaauugguuguuuagggcacacuguuauaugggaauuaaaauauguuuaggcaggggugugua

SEQ ID NO: 44503 - RNA, 64 nt, Homo Sapiens
aaauguaaaauucaguauaguuugaaagcggcacaauuaaaaauuaauuuucuaacaaaguugg

SEQ ID NO: 44504 - RNA, 64 nt, Homo Sapiens
auuuccuauauuuugacagagauacugcuggaaaaauuaaaauuaaaaugccauaauagcuacc

SEQ ID NO: 44505 - RNA, 64 nt, Homo Sapiens
uauauuuugacagagauacugcuggaaaaauuaaaauuaaaaugccauaauagcuaccuaacaa

SEQ ID NO: 44506 - RNA, 64 nt, Homo Sapiens
aaaaaaaguacucugaacugcuccaaguaacgcuaauuaaaaacuugcuuuaaagauauugaau

SEQ ID NO: 44507 - RNA, 64 nt, Homo Sapiens
gaacuuaguucagggacauagaagagucuuaaugaauuaaaaucauucacuugauuaaaugucu

SEQ ID NO: 44508 - RNA, 64 nt, Homo Sapiens
caagugguuuuuucauuauguaaagcacccguugaauuaaaagaauuuguuuuuguucaaccuc

SEQ ID NO: 44509 - RNA, 64 nt, Homo Sapiens
ugaauauauggacuuucucagauuaggaaauaccaauuaaaaauauaauaaauagcuacauuga

SEQ ID NO: 44510 - RNA, 64 nt, Homo Sapiens
guuuucuaggauugucuuuucacauagaaugaugaauuaaaaaacaucaccacuuauuaaaaca

SEQ ID NO: 44511 - RNA, 64 nt, Homo Sapiens
aaaaagacugucauucauacccaaacgacuaagaaauuaaaaaacuuuugcaugcuuaaggauu

SEQ ID NO: 44512 - RNA, 64 nt, Homo Sapiens
aaaaugcaagcugucaggaugugaggaaaaaaaaaauuaaaaaaccacagguauguggaauacg

SEQ ID NO: 44513 - RNA, 64 nt, Homo Sapiens
ccaaaauucauugaaauccucuaagcaccugucaaauuaaaauuuaugucaggaccuaaauggc

SEQ ID NO: 44514 - RNA, 64 nt, Homo Sapiens
acccuaaguaacuuuggcuuaauaacuuugcaauaauuaaaacuaggaaggugagcuccucaac

SEQ ID NO: 44515 - RNA, 64 nt, Homo Sapiens
uauuuauuuggacuucuucuaaguaauguaucauaauuaaaaauaugccaauuuuuacuguaau

SEQ ID NO: 44516 - RNA, 64 nt, Homo Sapiens
uuuugccuaucacucuggacauuuuaaucuauacaauuaaaaccuuaauuuuuguccaaaguua

SEQ ID NO: 44517 - RNA, 64 nt, Homo Sapiens
gaccaagaagaggaagaagacuugacguggacagaauuaaaaagaacaguaccuuggcuuggcu

SEQ ID NO: 44518 - RNA, 64 nt, Homo Sapiens
ucacccuuuucagcccucccaccauuuaaccagaaauuaaaauauuugcuucacacacaguuca

SEQ ID NO: 44519 - RNA, 64 nt, Homo Sapiens
uccaagggaauuuaaucuggcuuguucuagcauaaauuaaaaggaaaaaaagaaaagauaagug

SEQ ID NO: 44520 - RNA, 64 nt, Homo Sapiens
uacuauaaauccaggaggcaaugagguuuuuuucaauuaaaaaucuugcaaaugagcagaauaa

SEQ ID NO: 44521 - RNA, 64 nt, Homo Sapiens
guugggugaucuuaagugccgagauuugguuauaaauuaaaaagcacugaaauccugaagagga

SEQ ID NO: 44522 - RNA, 64 nt, Homo Sapiens
cuaaaauauguacccauuuuauaauguauuucacaauuaaaaaagaacaauguucuuacagguc

SEQ ID NO: 44523 - RNA, 64 nt, Homo Sapiens
guaauccuaacaaacaaaagauguacacagauguaauuaaaauuuaugugaacagucuuauucu

SEQ ID NO: 44524 - RNA, 64 nt, Homo Sapiens
aaaaaucaucaaagacagaaaaggcaaaugccagaauuaaaaaaguauucauuuaagaggcaau

SEQ ID NO: 44525 - RNA, 64 nt, Homo Sapiens
cacuugucauucaaaaaugauauuuuugucuacaaauuaaaaguucucuucauauguaagucag

SEQ ID NO: 44526 - RNA, 64 nt, Homo Sapiens
ggaaacagaagccuaaguuauuagagauuucaguaauuaaaaugacaugacaguugugucauua

SEQ ID NO: 44527 - RNA, 64 nt, Homo Sapiens
uuuaucuguaacuuguugauuaauauauuuaaucaauuaaaauguuucaaaaagaucuugaaag

SEQ ID NO: 44528 - RNA, 64 nt, Homo Sapiens
cauaaaaucauuuaaauauaauuggcaccuacugaauuaaaauauaaggauuuuauaaacucaa

SEQ ID NO: 44529 - RNA, 64 nt, Homo Sapiens
augccucaguuuccucauuuugaucuagauauaaaauuaaaauuguccauuuccuauauaaaua

SEQ ID NO: 44530 - RNA, 64 nt, Homo Sapiens
cauuuguauugcaaaaguuagaagucauuuuacaaauuaaaaaaacauuuuuuucuugguaguc

SEQ ID NO: 44531 - RNA, 64 nt, Homo Sapiens
cugcuauuaucauuaucucagaaugcuuauuuccaauuaaaacgccuacagcugccuccuagaa

SEQ ID NO: 44532 - RNA, 64 nt, Homo Sapiens
acuccagaaacauucugaagauguacuuggauuuaauuaaaaaguucacuuuguaagaacgugg

SEQ ID NO: 44533 - RNA, 64 nt, Homo Sapiens
ccaggcauagccuggauacaguauaaaaauagauaauuaaaaagaugguugccaagcaaggaaa

SEQ ID NO: 44534 - RNA, 64 nt, Homo Sapiens
uucugauguugccuuaauauucugcuauugcagcaauuaaaaauugucuucauguacauuugga

SEQ ID NO: 44535 - RNA, 64 nt, Homo Sapiens
cagauaacauuuguguguuauaccuugauuggggaauuaaaagucauuuaacugaagauguuga

SEQ ID NO: 44536 - RNA, 64 nt, Homo Sapiens
ccuguauauauauauucauucuccaguguugcugaauuaaaauucugcuggacuuuuuaacaua

SEQ ID NO: 44537 - RNA, 64 nt, Homo Sapiens
ucauuuugauaaucauuugcuuccaguguuuaaaaauuaaaaaaagaauggggagaagguuaug

SEQ ID NO: 44538 - RNA, 64 nt, Homo Sapiens
acagcugaaaauuuugagaagguaaaaguuucuuaauuaaaauaugaacauauuuagcuugcuu

SEQ ID NO: 44539 - RNA, 64 nt, Homo Sapiens
cauuuuacauuuuagggcacaguucuuuggggcuaauuaaaaugggguuugcaggcuuuuuaug

SEQ ID NO: 44540 - RNA, 64 nt, Homo Sapiens
cugagcaaccuaguaagaccucgucucuacuaauaauuaaaaaacuagcuggcaugguagcaca

SEQ ID NO: 44541 - RNA, 64 nt, Homo Sapiens
uuucaaauaauauuuucucuguaguaugagaugaaauuaaaaguggauagcuuucaggaaagau

SEQ ID NO: 44542 - RNA, 64 nt, Homo Sapiens
cuaaguaacccaguacaauaguugugaacugaauaauuaaaacuuuggcuucucuuaggaaaag

SEQ ID NO: 44543 - RNA, 64 nt, Homo Sapiens
ucuuaucagaauaucuggcuggcccuguaauuuaaauuaaaauaaaauuuuggagaaacagcau

SEQ ID NO: 44544 - RNA, 64 nt, Homo Sapiens
ucauuuuaggcuauuggcuaaugugaacaagcaaaauuaaaauugggaaaaaaaacccaaaauu

SEQ ID NO: 44545 - RNA, 64 nt, Homo Sapiens
ccaagcauugaucuguguaccuucuccaggauaaaauuaaaaacuucguugcgaacuugaucag

SEQ ID NO: 44546 - RNA, 64 nt, Homo Sapiens
uuagagauguuuagugcucacagcugugucuaagaauuaaaauuuacaaagagugccauuggaa

SEQ ID NO: 44547 - RNA, 64 nt, Homo Sapiens
auguaaaauuaauaauuugcauuuugaggaaaaaaauuaaaaauuugccaaccaauagaugaga

SEQ ID NO: 44548 - RNA, 64 nt, Homo Sapiens
aacguauuccuuuguaguguuuugaauuuguuaaaauuaaaaacugcugcugauaugacacacc

SEQ ID NO: 44549 - RNA, 64 nt, Homo Sapiens
aaaauuaccuagguguggugaaauuaaaaaaugaaauuaaaaaucucaucucuacaaaaaguaa

SEQ ID NO: 44550 - RNA, 64 nt, Homo Sapiens
ugaaauuaaaaauaaaauuacuacaaaaaguaaaaauuaaaaaaaacauagcaaaaucucaucu

SEQ ID NO: 44551 - RNA, 64 nt, Homo Sapiens
cuguguacccccccccccccuuuauuuguuuuaaaauuaaaauaucuuugacaaacaaauuauu

SEQ ID NO: 44552 - RNA, 64 nt, Homo Sapiens
ucugaaaaccaaugcgacaaucugauuuuuaaaaaauuaaaauucauacaacuuccaaaaggca

SEQ ID NO: 44553 - RNA, 64 nt, Homo Sapiens
aauguaaugugccuagcacaaaggguauuaggauaauuaaaaauaagaguuauguuuauuuuug

SEQ ID NO: 44554 - RNA, 64 nt, Homo Sapiens
aaguuauaucagugaaguaaauacuggguauuaaaauuaaaagcugaacaucucaaaguuauau

SEQ ID NO: 44555 - RNA, 64 nt, Homo Sapiens
uuuuccuucucuguccucugguuauauuaaagcaaauuaaaauauugugaucuacugaaaagag

SEQ ID NO: 44556 - RNA, 64 nt, Homo Sapiens
uggagaaaaguagaaauaauaaagugcaggcugcaauuaaaacaaaaauuauugggaaagauuu

SEQ ID NO: 44557 - RNA, 64 nt, Homo Sapiens
ugauuggcuuagguaaucccuaaaauaggguugcaauuaaaauguuacugucuggcuuugcccu

SEQ ID NO: 44558 - RNA, 64 nt, Homo Sapiens
uuccuacagucuuuagcauguaauuaaaaauaugaauuaaaauaugugauauuauuacauaaug

SEQ ID NO: 44559 - RNA, 64 nt, Homo Sapiens
augaauuaaaauauuccuacuuauuacauaauguaauuaaaaauuuguaaaauagacugugaua

SEQ ID NO: 44560 - RNA, 64 nt, Homo Sapiens
cucucuggcuuuacccaaguucugaaugcauuguaauuaaaauuuaaguuuuucuuuuccccca

SEQ ID NO: 44561 - RNA, 64 nt, Homo Sapiens
aaacuuacuaauucugauuuuaguguagccccuaaauuaaaaauggcuuccauaugccacucug

SEQ ID NO: 44562 - RNA, 64 nt, Homo Sapiens
uggucuaauuuaaugucuuuaaguuucauauuacaauuaaaaccucauuuuuuuuuuccauuuu

SEQ ID NO: 44563 - RNA, 64 nt, Homo Sapiens
agaccuuaaguaaaaggcacaauggguacuacagaauuaaaauguaggucuaacauaaugccag

SEQ ID NO: 44564 - RNA, 64 nt, Homo Sapiens
aagaaucuuauaguacauguuaauauaugcaaccaauuaaaauguauaaauuaguguaagaaau

SEQ ID NO: 44565 - RNA, 64 nt, Homo Sapiens
guaugugcaauggauaaauugccguuauuucaaaaauuaaaauucucauuuucuuucuuuuuuu

SEQ ID NO: 44566 - RNA, 64 nt, Homo Sapiens
auuguauuucucauguuaaagccucuucccuugaaauuaaaaaaaaauuuuaacugauaaaacu

SEQ ID NO: 44567 - RNA, 64 nt, Homo Sapiens
uaaauuauaucucuagggagaaaauguuguaaaaaauuaaaaguacaucccugauuguaaaaua

SEQ ID NO: 44568 - RNA, 64 nt, Homo Sapiens
acaagcugggcaaacugacaaccauuagaagcaaaauuaaaaguuucaagggauagggcagauu

SEQ ID NO: 44569 - RNA, 64 nt, Homo Sapiens
aauggcauaagagcuuaaaaauugaugucugggcaauuaaaauaugacuaagaauuuaggugga

SEQ ID NO: 44570 - RNA, 64 nt, Homo Sapiens
cugacaguugccuuuuuuuuuccaaacugaucacaauuaaaauuaaaguaccaaguaccagccg

SEQ ID NO: 44571 - RNA, 64 nt, Homo Sapiens
uguuugccucaugucccuuuguggugguuucuguaauuaaaauuccuuucuacaugacauugca

SEQ ID NO: 44572 - RNA, 64 nt, Homo Sapiens
agucuuauaugaaguauguuaagugcugaaauuuaauuaaaaucugggacagucccuucuauga

SEQ ID NO: 44573 - RNA, 64 nt, Homo Sapiens
auagagcuaauuauggcuuugaagaauugcuggcaauuaaaagaauaaguauuuuguugagguu

SEQ ID NO: 44574 - RNA, 64 nt, Homo Sapiens
aaugauucuauucauauuuguuaccucuguuaaaaauuaaaauauuggauaaguaugcuuuauu

SEQ ID NO: 44575 - RNA, 64 nt, Homo Sapiens
gaugucuuugcacaggugagaauuaaaaaaaaauaauuaaaaguacuggguauaacaguauuuu

SEQ ID NO: 44576 - RNA, 64 nt, Homo Sapiens
aaauaauuaaaagugaugucuauaacaguauuuuaauuaaaaaaugcugccgcauuccacuggg

SEQ ID NO: 44577 - RNA, 64 nt, Homo Sapiens
aguguaaugaaacaaggugaucagggcuccucacaauuaaaaugcgucacuacccuuuuuggau

SEQ ID NO: 44578 - RNA, 64 nt, Homo Sapiens
uaguuaucuaguaguaggaguucauauauuuauaaauuaaaacagcuuggaaaagagguaccca

SEQ ID NO: 44579 - RNA, 64 nt, Homo Sapiens
acucaaacuacuaucuuuagauauaaacacuaguaauuaaaaugugccuuuugaagauguuuuc

SEQ ID NO: 44580 - RNA, 64 nt, Homo Sapiens
aaacuuaauaaauugcuacuguuuuauaucauaaaauuaaaauaccaugguaauauuugcaaaa

SEQ ID NO: 44581 - RNA, 64 nt, Homo Sapiens
augauccuaagaaaauuauguacuuuuaccugaaaauuaaaaccaauauuuauaaaaaguguau

SEQ ID NO: 44582 - RNA, 64 nt, Homo Sapiens
gaacaaaagaaacaagagagaaaaaaaucaaaauaauuaaaauaaauuguuagagaaaaguuac

SEQ ID NO: 44583 - RNA, 64 nt, Homo Sapiens
aggagaagagaaggaauuugaagagaaaaaggaaaauuaaaauuacuaauuaauuuuuagauuc

SEQ ID NO: 44584 - RNA, 64 nt, Homo Sapiens
uuuguuucguuuuguuucuucuucugcauuuaaaaauuaaaagauugguuugaggaugugauga

SEQ ID NO: 44585 - RNA, 64 nt, Homo Sapiens
aaaaaaucuaauaaaucuuagauuuuuaaaaaagaauuaaaaugugggaguucucagaaagaaa

SEQ ID NO: 44586 - RNA, 64 nt, Homo Sapiens
ucucuuauaaucaugguaucuuucacagaauaaaaauuaaaaauaaugccagggugcaagugac

SEQ ID NO: 44587 - RNA, 64 nt, Homo Sapiens
auuguacuacaguauuuucagaauaugggaaaucaauuaaaaauguaaucuaaucuaguuuaag

SEQ ID NO: 44588 - RNA, 64 nt, Homo Sapiens
uuauuuuaacuaugaccuuuaauugaaaauaaauaauuaaaauaucagacauguuuuggaaaag

SEQ ID NO: 44589 - RNA, 64 nt, Homo Sapiens
aaacguuaucucauugcaaaauauaaauggugagaauuaaaauauuuuauucacuuguguuugu

SEQ ID NO: 44590 - RNA, 64 nt, Homo Sapiens
accuaagugacuaccacuuaacgauguuaaaacaaauuaaaaacggauuuuguggcuucaaucu

SEQ ID NO: 44591 - RNA, 64 nt, Homo Sapiens
aaguugcuggucagucuuaguauauaaaacacaaaauuaaaauacugacaaaauauuuuaaaaa

SEQ ID NO: 44592 - RNA, 64 nt, Homo Sapiens
cauuccuuggaacagagcuauuuaucugggcaaaaauuaaaacagugugcaaagcuuauuuucu

SEQ ID NO: 44593 - RNA, 64 nt, Homo Sapiens
gggaaguuuccuugagccuaaaauaaaaagaaaaaauuaaaaagaaucaguuuuuuuaauuaaa

SEQ ID NO: 44594 - RNA, 64 nt, Homo Sapiens
uaaaaagaaaaaauuaaaaagaaucaguuuuuuuaauuaaaaaaauagaaagcuguuaggcucc

SEQ ID NO: 44595 - RNA, 64 nt, Homo Sapiens
uuauagaaccauaucaacacauuuaaauuaaaaaaauuaaaaauaagaauuaaaaauuuuaaaa

SEQ ID NO: 44596 - RNA, 64 nt, Homo Sapiens
auuaaaaauuuauagaaccaauuuuaaaaauuuaaauuaaaaaauaaauuuuaaagaauuaaaa

SEQ ID NO: 44597 - RNA, 64 nt, Homo Sapiens
uuuaaaaauuuaaauuaaaauuuaaauuuuaaagaauuaaaaauaaacaggacaauuuaaaaau

SEQ ID NO: 44598 - RNA, 64 nt, Homo Sapiens
gacagaggacauuuagauacaagaauuuaaaccaaauuaaaacugaugaaggcuuauugguauc

SEQ ID NO: 44599 - RNA, 64 nt, Homo Sapiens
uuagauacuuaacauuuauuuaccaaauauuguuaauuaaaauuugauaagaauaaauuuaauu

SEQ ID NO: 44600 - RNA, 64 nt, Homo Sapiens
aggaaugauaagaauaaauuauauauauagacaaaauuaaaagaacuagaagcuauuacuaaaa

SEQ ID NO: 44601 - RNA, 64 nt, Homo Sapiens
uuuuuuuuuuuuuaaauaauaauuuggcaaucagaauuaaaaaguuuuuauaccugccuuaaau

SEQ ID NO: 44602 - RNA, 64 nt, Homo Sapiens
guauuugucauguuaaaaagcacucaguaaaggaaauuaaaaauucugcugccacgucgcaaac

SEQ ID NO: 44603 - RNA, 64 nt, Homo Sapiens
agagaacuugagauucaaaagaaaaagcuggauaaauuaaaaucugagguuaaugaaauggaaa

SEQ ID NO: 44604 - RNA, 64 nt, Homo Sapiens
aaacuaucuuuguaacagauaaguuauuuauaaaaauuaaaaaacuuauauucuaauguggauu

SEQ ID NO: 44605 - RNA, 64 nt, Homo Sapiens
guaagaaucagcuaagaugcauuauauauauuuuaauuaaaauuaaaacuucagauauuugugg

SEQ ID NO: 44606 - RNA, 64 nt, Homo Sapiens
aucagcuaagaugcauuauauauauuuuaauuaaaauuaaaacuucagauauuuguggauuaca

SEQ ID NO: 44607 - RNA, 64 nt, Homo Sapiens
auuguauuuugaguggauauuuuuguuugguaacaauuaaaauuuuaaaucguaaaaaauguac

SEQ ID NO: 44608 - RNA, 64 nt, Homo Sapiens
guacugaaugccauucagugguacccugcaaaauaauuaaaauccuaacucuuauguuguguau

SEQ ID NO: 44609 - RNA, 64 nt, Homo Sapiens
gauuuuuggcuggacuggcaacuucauagaccuaaauuaaaaguaagaucaaaucauauaggua

SEQ ID NO: 44610 - RNA, 64 nt, Homo Sapiens
uuguguuucuuaagaucaaaacaauuuacuuucuaauuaaaauuaacaaagacauuaaaagaaa

SEQ ID NO: 44611 - RNA, 56 nt, Homo Sapiens
caguugccaaccauuuguaguucacaaauuaaaacuggguuuccaggccuggugug

SEQ ID NO: 44612 - RNA, 64 nt, Homo Sapiens
aaacaaaucauuguuuauuacuggucacuuagaaaauuaaaagggauagggccaggcacagugg

SEQ ID NO: 44613 - RNA, 64 nt, Homo Sapiens
agagcaagacuccgucucaaagaaacaaacaaaaaauuaaaagggauagaauauaaugaaauau

SEQ ID NO: 44614 - RNA, 64 nt, Homo Sapiens
gcccagucuguuucaaauaaaugaacucaaucuaaauuaaaaaagaaagaaauuugaaaaaacu

SEQ ID NO: 44615 - RNA, 64 nt, Homo Sapiens
uugauuuagcauucauauuuuccaucuuauucccaauuaaaaguaugcagauuauuugcccaaa

SEQ ID NO: 44616 - RNA, 64 nt, Homo Sapiens
gcuaaaaucauggacuggcuuuuuucauacaaugaauuaaaauucuccuagcauucaugauuuu

SEQ ID NO: 44617 - RNA, 64 nt, Homo Sapiens
aaaaaauuagacuccaccuuuuuaagcacugauaaauuaaaaaaacuaagcuauuuugaagauu

SEQ ID NO: 44618 - RNA, 64 nt, Homo Sapiens
aaaaccugaugaaacagaugaaaaaacaaaaguaaauuaaaaacaaaacaaaaaaaaaaacaaa

SEQ ID NO: 44619 - RNA, 64 nt, Homo Sapiens
aaaacaaaaaaaaaaacaaaaccagaaaaauagaaauuaaaaacuuuuuaagguuucugaguua

SEQ ID NO: 44620 - RNA, 64 nt, Homo Sapiens
ggauggaucuucucugaacugcccaggcuuuaaaaauuaaaaaucagaaucuguugugagaaau

SEQ ID NO: 44621 - RNA, 64 nt, Homo Sapiens
gcagauaagacauaaauaguuaucugaauuuuaaaauuaaaaaggaaagcaggauuuucuccug

SEQ ID NO: 44622 - RNA, 64 nt, Homo Sapiens
uguuaaauguauauuuugguuuguaguaugaaauaauuaaaaauauuuuaaaagaaauguaguc

SEQ ID NO: 44623 - RNA, 64 nt, Homo Sapiens
cauaaagucucaucauucugaacaguaguggaagaauuaaaauuuaguaauuugcaaaagccac

SEQ ID NO: 44624 - RNA, 64 nt, Homo Sapiens
auaguuauuuuacaguuccacccucaauucuguaaauuaaaagauuuugacauuuaaaauacuu

SEQ ID NO: 44625 - RNA, 64 nt, Homo Sapiens
agauuuggcuaguugugugugacauuaucuuuuaaauuaaaaagucuauauguugcguugugau

SEQ ID NO: 44626 - RNA, 64 nt, Homo Sapiens
ugaagaaaaucuacuuguaaaaggcucagaucuuaauuaaaagguaauuguagcacauuaccaa

SEQ ID NO: 44627 - RNA, 64 nt, Homo Sapiens
auucgaacuuaacagaugccuccucuccaaagagaauuaaaaucguagcuuguacagaucaaga

SEQ ID NO: 44628 - RNA, 64 nt, Homo Sapiens
agaacaaaguaguaaaauaaaaaaaaauuuaaaaaauuaaaaaauaaaaaaaagaggucacuaa

SEQ ID NO: 44629 - RNA, 64 nt, Homo Sapiens
aauugcaggagauuuaauguauaaaauuucuaggaauuaaaagcuuaaacccaaaaauuguuca

SEQ ID NO: 44630 - RNA, 64 nt, Homo Sapiens
caaaaauuguucauccauauauaagaaauuaucgaauuaaaacuuaauguaugucaauuauuuu

SEQ ID NO: 44631 - RNA, 64 nt, Homo Sapiens
uuuaaagugaguuugagaaacaaguugaaacuaaaauuaaaauaccagccauuuaggugcuuuc

SEQ ID NO: 44632 - RNA, 64 nt, Homo Sapiens
auaaugcuuauuaugguaaaauaaaauuggaaaaaauuaaaacugaccuauaagaguguuaagg

SEQ ID NO: 44633 - RNA, 64 nt, Homo Sapiens
augugcuaucacaugugaaaaguacuuuggaugcaauuaaaacuugauugcuagaguuuuuguu

SEQ ID NO: 44634 - RNA, 64 nt, Homo Sapiens
uuggguguauuuucuuuaccuucugaauccugguaauuaaaaguuaaaauuguucucuuaaaua

SEQ ID NO: 44635 - RNA, 64 nt, Homo Sapiens
gagaagggggaagaggaaaugaaaauagcacaaaaauuaaaauuggaacgaaguaagauaauua

SEQ ID NO: 44636 - RNA, 64 nt, Homo Sapiens
uagcacaaaaauuaaaauuggaacgaaguaagauaauuaaaacaaaaaacuuauagauguuagg

SEQ ID NO: 44637 - RNA, 64 nt, Homo Sapiens
aggcuuugucauuuagcauuagacuuuaaacaagaauuaaaaucaugugcuguauuuuuaaaau

SEQ ID NO: 44638 - RNA, 64 nt, Homo Sapiens
aguuguauguauuucugaacuuggcaaaauuggaaauuaaaauuuuuaaaaauuacaaauauac

SEQ ID NO: 44639 - RNA, 64 nt, Homo Sapiens
cacuggcacucagccagcugccuccuuccagagcaauuaaaagucuuagcaacaguccucuggu

SEQ ID NO: 44640 - RNA, 64 nt, Homo Sapiens
cagcugaguuuauuauacuuguuuucuuuuacaaaauuaaaaacaucuaaaaccaggcccaagu

SEQ ID NO: 44641 - RNA, 64 nt, Homo Sapiens
aaauuuuaauuggcuggcugaccuauaaucccuaaauuaaaauuaaaagucacuaacuuugugu

SEQ ID NO: 44642 - RNA, 64 nt, Homo Sapiens
cacccaccagucuuaggcauacagucuucaagucaauuaaaaucuuuaugauaauagaacuaug

SEQ ID NO: 44643 - RNA, 64 nt, Homo Sapiens
augugugaaaaguacaugacaguggagaguuuuuaauuaaaagaaauacugaacuguaaggguu

SEQ ID NO: 44644 - RNA, 64 nt, Homo Sapiens
ccucauuucuagccuucuuuuaguacuugggaaaaauuaaaaaguuguaggccaacagagcuca

SEQ ID NO: 44645 - RNA, 64 nt, Homo Sapiens
uuaaaguaaccuaaaaugaaguacaguuacaggaaauuaaaaugaggugauuauauucucucau

SEQ ID NO: 44646 - RNA, 64 nt, Homo Sapiens
uaauugagggucagugauacauuccuuuaggaccaauuaaaacaccaaacuguuggggugguac

SEQ ID NO: 44647 - RNA, 64 nt, Homo Sapiens
gguugcauuauuuucugaaccuguaucuagauuaaauuaaaauuaauauuuguaaauaaaguac

SEQ ID NO: 44648 - RNA, 64 nt, Homo Sapiens
aaagaaaaaacucuguuguaaucuuacuggguuuaauuaaaaaaugccucauugucuucuguac

SEQ ID NO: 44649 - RNA, 64 nt, Homo Sapiens
uaugggauuaaaaaaaguuacuaaauuaaaaaaaaauuaaaaguugucaucuaaaagcuggcca

SEQ ID NO: 44650 - RNA, 64 nt, Homo Sapiens
aaauuaaaaguuaugggauuaaagcuggccacuaaauuaaaaaagugaagaucacugucaucua

SEQ ID NO: 44651 - RNA, 64 nt, Homo Sapiens
ccugucacuuuugcagauauucuucgguuugaauaauuaaaaugaaccagauaucagggugguu

SEQ ID NO: 44652 - RNA, 64 nt, Homo Sapiens
gaauaauuaaaaugaaccagauaucagggugguuaauuaaaaugaaccagauaucagggugguu

SEQ ID NO: 44653 - RNA, 64 nt, Homo Sapiens
cauuuuacuguuuguuuuuauuaucuuaagugcuaauuaaaaaaaaaauaaaauuuuaaaaaaa

SEQ ID NO: 44654 - RNA, 64 nt, Homo Sapiens
ugauugauagaaagaaaguugcuuuucuuuugagaauuaaaaacuuuggcuugauuucuuuuuu

SEQ ID NO: 44655 - RNA, 64 nt, Homo Sapiens
cucuacaucguucacgagucuggggagcggacaaaauuaaaagacugcgaguacccgcugauuu

SEQ ID NO: 44656 - RNA, 64 nt, Homo Sapiens
uuugaaaugccggugcuggacaguuuuguugaaaaauuaaaagaagaggaagaaagagaaauaa

SEQ ID NO: 44657 - RNA, 64 nt, Homo Sapiens
aaucuugugcgguuuucuuucuuuuuuucuuuuuaauuaaaauacuauaauccauugagaaaua

SEQ ID NO: 44658 - RNA, 64 nt, Homo Sapiens
ccugaaaguacauaacuucuaucacuugccacauaauuaaaagaacucacauuaagcgguuacu

SEQ ID NO: 44659 - RNA, 64 nt, Homo Sapiens
aaaucugcgaucaucgucauuugcugugaacugaaauuaaaacuauucaugcuacccagccauu

SEQ ID NO: 44660 - RNA, 64 nt, Homo Sapiens
cucacacuuacuguaagacauuaguaacauaauaaauuaaaagucacacgaaucucaccaacau

SEQ ID NO: 44661 - RNA, 64 nt, Homo Sapiens
uauacugcuuacagguuuagauauagucuguuagaauuaaaaccaaguuuaguguucauauuua

SEQ ID NO: 44662 - RNA, 64 nt, Homo Sapiens
agucauuuuauucucaagugcuuaaaauuaauguaauuaaaagcuuagcugacuacagaauagg

SEQ ID NO: 44663 - RNA, 64 nt, Homo Sapiens
aaaaaaaguuuucuuauaguuuuuauaggaagccaauuaaaaaaucucucauuugccgacuuau

SEQ ID NO: 44664 - RNA, 64 nt, Homo Sapiens
agaggucgacaugagauaccgggcuguaaauccuaauuaaaaauggaaagacauagggaagaau

SEQ ID NO: 44665 - RNA, 64 nt, Homo Sapiens
aauagaagacauuuucacuggaauuacaaagcagaauuaaaauuauauuguagaaggaaacacc

SEQ ID NO: 44666 - RNA, 64 nt, Homo Sapiens
uuuguaauauauucaugaggcuggaaguaagaagaauuaaaaauuuguccuaauuacaaugaga

SEQ ID NO: 44667 - RNA, 64 nt, Homo Sapiens
cacgaaaguuuuuuuaaagaacagaaacuuuuccaauuaaaaaaaaaaagcagacuucugguuc

SEQ ID NO: 44668 - RNA, 64 nt, Homo Sapiens
uagguauucuuuuugguuuaauuuuugccaauguaauuaaaaaaugguaugucauuuuuaaaau

SEQ ID NO: 44669 - RNA, 64 nt, Homo Sapiens
uuuuuuccaaaauucagguugguaagaaacuccuaauuaaaagguaaauauuaaaucauaacuu

SEQ ID NO: 44670 - RNA, 64 nt, Homo Sapiens
uuuacuugauucccaucuauccugugucuuuaaaaauuaaaaauaagaaagaauaaagcuuagu

SEQ ID NO: 44671 - RNA, 64 nt, Homo Sapiens
acuuaccaggaagguuuuuauuuuugucauaagaaauuaaaagauauuuguguguugugagaaa

SEQ ID NO: 44672 - RNA, 64 nt, Homo Sapiens
cuuguauuuaacucuuuucauugcuugucauguaaauuaaaaacgguucgauacagcguauuua

SEQ ID NO: 44673 - RNA, 64 nt, Homo Sapiens
guuaugauuaaugugaaacuauucacuacuuguuaauuaaaaaaacaauaucuuaaaguguccg

SEQ ID NO: 44674 - RNA, 64 nt, Homo Sapiens
uauuuuccagcaguccaaaguuuaacauguucauaauuaaaaagggcuucugcuguuuuuuauu

SEQ ID NO: 44675 - RNA, 64 nt, Homo Sapiens
ucauugaagcugaaauuccagcaagauugaacaaaauuaaaaauuuguuuuugguugaacaaau

SEQ ID NO: 44676 - RNA, 64 nt, Homo Sapiens
aaacuguuagaugcacacugcuuuucaguucucaaauuaaaagaauauuugaugugaugauuca

SEQ ID NO: 44677 - RNA, 64 nt, Homo Sapiens
uaagcuuucuacuccaaguagcuagcaaaucaguaauuaaaaauuuuaacagggcauuuaagug

SEQ ID NO: 44678 - RNA, 64 nt, Homo Sapiens
uacaguguuuuuccacucaccacccaaaucaaacaauuaaaauaacccauuuuuccuuaaccaa

SEQ ID NO: 44679 - RNA, 64 nt, Homo Sapiens
aauuccaacugacuuuuaaaccccuuggucuuuuaauuaaaagaguaacaaaggagcuucuugu

SEQ ID NO: 44680 - RNA, 64 nt, Homo Sapiens
cagcaucccaagaucauucuuuucuugcuucaaaaauuaaaaucgaaauaugucccccccuaac

SEQ ID NO: 44681 - RNA, 64 nt, Homo Sapiens
aaaaacuagauugacuauuuaagauugccucuugaauuaaaaaaacaagccuaacauuggugca

SEQ ID NO: 44682 - RNA, 64 nt, Homo Sapiens
aaagaauuucauucauaauguuuaaacugugugaaauuaaaaacagccugauuucauauuguau

SEQ ID NO: 44683 - RNA, 64 nt, Homo Sapiens
aauuagcacaucccuuuacuugaaugucaucuacaauuaaaaaaguacaggggaauuaugugug

SEQ ID NO: 44684 - RNA, 64 nt, Homo Sapiens
ugauggccacuucuaauaauacacuuagggaaaaaauuaaaauguuaauaagacggucaacuuc

SEQ ID NO: 44685 - RNA, 64 nt, Homo Sapiens
augaaacaaaaguuugacagcugcugaauaacaaaauuaaaaugaguaauuuaacaaagggagc

SEQ ID NO: 44686 - RNA, 64 nt, Homo Sapiens
ggaacucacagaacuuaaagaaaacaaauaauccaauuaaaaauggucaaaggggcugggcaug

SEQ ID NO: 44687 - RNA, 64 nt, Homo Sapiens
cuauuguggaaaacaguguagagguuucucaaaaaauuaaaacuaucauacaacccagcagucc

SEQ ID NO: 44688 - RNA, 64 nt, Homo Sapiens
uucagcaugacuauguauuuuucuauguuuuuuuaauuaaaaauuuuuaaaauacuuguuucag

SEQ ID NO: 44689 - RNA, 64 nt, Homo Sapiens
cacuguugugaaucaccaaaggagcuauggagagaauuaaaacucaacauuacuguuaacugug

SEQ ID NO: 44690 - RNA, 64 nt, Homo Sapiens
uuuauuuuaaaaaauaauaauaaaaauuuaaaaaaauuaaaaauaaaaaaaaccacagaaaaca

SEQ ID NO: 44691 - RNA, 64 nt, Homo Sapiens
cuugaaaauuauuugucaucauaaaaaugaaacaaauuaaaauauuuauugccaggcaaggcca

SEQ ID NO: 44692 - RNA, 64 nt, Homo Sapiens
uuagccaggcaugguggcaccaucucuacaaaaaaauuaaaaaaugggcaacaugacaagaccc

SEQ ID NO: 44693 - RNA, 64 nt, Homo Sapiens
ugauucuucugcagagcacuagauacauuaaaaaaauuaaaaacaucaacuuauuccauuaaau

SEQ ID NO: 44694 - RNA, 64 nt, Homo Sapiens
uguguuuauuauaagauacuguuguuaaaugaaaaauuaaaauuuauauaccucauucuuuagu

SEQ ID NO: 44695 - RNA, 64 nt, Homo Sapiens
gaaaugggaauuauugcacaagaaguaugaaucuaauuaaaacaccaaacuuauccagggccau

SEQ ID NO: 44696 - RNA, 64 nt, Homo Sapiens
gggguaugauagggacauugguggaaacugcaugaauuaaaagacauauaccccaaaaugcuaa

SEQ ID NO: 44697 - RNA, 64 nt, Homo Sapiens
uuuagugacuuuuuaacuugguuacuuuauauuuaauuaaaaaucuaauucaucuuugcuuccu

SEQ ID NO: 44698 - RNA, 64 nt, Homo Sapiens
acuguuaaacuaaaaaccacguuuuuaacaauaaaauuaaaacauccaacuacauccuuaugau

SEQ ID NO: 44699 - RNA, 64 nt, Homo Sapiens
aaagcuuuauguaguuaugccauuaagguuuaugaauuaaaaagaaaaucgggcacucuauauu

SEQ ID NO: 44700 - RNA, 64 nt, Homo Sapiens
acagggcuuuacuaucuuuucaucucauuaauucaauuaaaaccauuaccuuaaaauuuuuuuc

SEQ ID NO: 44701 - RNA, 64 nt, Homo Sapiens
uagugcauuugagcacacauuuuaauuuuccucuaauuaaaaugugcaguauuuucagugucaa

SEQ ID NO: 44702 - RNA, 64 nt, Homo Sapiens
uugucgcugaguugacagaagcaacuauuguacaaauuaaaaauaaccauaagggagaaaccag

SEQ ID NO: 44703 - RNA, 64 nt, Homo Sapiens
gggagaaaccagaagaauuccucugaccacuuacaauuaaaauauuuugucuucuuuaaaaaaa

SEQ ID NO: 44704 - RNA, 64 nt, Homo Sapiens
cagaaaauggaggcuuucacaaggguuugaucagaauuaaaaccccaaacccgcccucuguuag

SEQ ID NO: 44705 - RNA, 64 nt, Homo Sapiens
uguaacaaugucaguuguuaaaccuugacauuucaauuaaaacaugaauuguaguuauaacuca

SEQ ID NO: 44706 - RNA, 64 nt, Homo Sapiens
uucuucaucuguuguagaauuuaaugugaaaagaaauuaaaacucugauugugguaaacaaugu

SEQ ID NO: 44707 - RNA, 64 nt, Homo Sapiens
aaacuccauaguacuaauuuagaugaauucuuaaaauuaaaaaaaugcuuacuccuuagaguuc

SEQ ID NO: 44708 - RNA, 64 nt, Homo Sapiens
acuacucacuacaauaaaacgugccuuucaagaaaauuaaaaauacaaaaguaauuauucuugg

SEQ ID NO: 44709 - RNA, 64 nt, Homo Sapiens
uuaaaaugauuaauaguucaucucaugcauucuaaauuaaaaagugagcuuaaacaaaugccac

SEQ ID NO: 44710 - RNA, 64 nt, Homo Sapiens
auuuuuuguguggagucuaucaccacacccagcuaauuaaaaaacugggacuauaggugcaugc

SEQ ID NO: 44711 - RNA, 64 nt, Homo Sapiens
gcauguuuuuaaaaauuagcagguaaauccugguaauuaaaaacugacaaagaguaguuuuauc

SEQ ID NO: 44712 - RNA, 64 nt, Homo Sapiens
gaaacagugcucaugucauauuuaagaaaaaaauaauuaaaaaauguuaauuuuaaacacauuu

SEQ ID NO: 44713 - RNA, 64 nt, Homo Sapiens
caccuguuaauuuuaaacacggggggggggaagaaauuaaaaaaacauaaauacauuuucuaag

SEQ ID NO: 44714 - RNA, 64 nt, Homo Sapiens
ugacuucucuuuuaaaauugaguagcagaugaaaaauuaaaauuugaacuugauuauuaauauc

SEQ ID NO: 44715 - RNA, 64 nt, Homo Sapiens
gaaaaauuaaaauuugaacuugauuauuaauaucaauuaaaauguuuuauuuauuuuauuaaaa

SEQ ID NO: 44716 - RNA, 64 nt, Homo Sapiens
aaacuguguaucauuaaaauauauguucugcaagaauuaaaacugaguccaugaaaauaccaua

SEQ ID NO: 44717 - RNA, 64 nt, Homo Sapiens
uguuauauuccaaggaaaauugaaaguauucagaaauuaaaauauuauuugauaucugaaaccu

SEQ ID NO: 44718 - RNA, 64 nt, Homo Sapiens
uccaaacuaaagccaauagcaagaauauguuaacaauuaaaaguaaacaaguuguccaauugcc

SEQ ID NO: 44719 - RNA, 64 nt, Homo Sapiens
aacauaacgcaaacauguuuucauauuacugucuaauuaaaauagaaacauagcuauuaccauc

SEQ ID NO: 44720 - RNA, 64 nt, Homo Sapiens
aaugaaagaaaaaccauuauauuaauauguguacaauuaaaaugagaaacuaaauuuucaaaaa

SEQ ID NO: 44721 - RNA, 64 nt, Homo Sapiens
aaaaagggcaaaccuaggaaaaccuucucacaagaauuaaaaacaacucccaagcccuaaagag

SEQ ID NO: 44722 - RNA, 64 nt, Homo Sapiens
guugccgggggugguggcucaaaaauaaaauauaaauuaaaaaauugggccaccuauuucaaua

SEQ ID NO: 44723 - RNA, 64 nt, Homo Sapiens
aaauauauuuuguucuauuguacugugcugguauaauuaaaauauccauggucuuucugggccu

SEQ ID NO: 44724 - RNA, 64 nt, Homo Sapiens
cauguugggcugcaugauaaaaguuaauuauaaaaauuaaaagauuuuuuuuuuugagauggaa

SEQ ID NO: 44725 - RNA, 64 nt, Homo Sapiens
ggauuauaggcguaagccaccaugccuggccaaaaauuaaaagauuuuaugaaacgaaauggcu

SEQ ID NO: 44726 - RNA, 64 nt, Homo Sapiens
aaaaaaaaaaaugucuuaaccaaccgaaaagaaaaauuaaaaaaggauuuguauuaaaucuuau

SEQ ID NO: 44727 - RNA, 64 nt, Homo Sapiens
aacugcaggcgccuuuguaaaaugcaaaauauuuaauuaaaagagauuuuaacauaaugagagc

SEQ ID NO: 44728 - RNA, 64 nt, Homo Sapiens
uuaauuguuggcugggcacaacaaaauagaacacaauuaaaaucucuuaaaaucaaguaucaau

SEQ ID NO: 44729 - RNA, 64 nt, Homo Sapiens
uguuuaauuuacuuggcauuauuuacacuuaguaaauuaaaaguuuuuucauuugauacuuuua

SEQ ID NO: 44730 - RNA, 64 nt, Homo Sapiens
ugugcuguguuuucuaacacauuuuucuguuuuuaauuaaaaaaaaaaaaaaaagguuuucagu

SEQ ID NO: 44731 - RNA, 64 nt, Homo Sapiens
aaucccccucugcgagaaacacccaagaaugaucaauuaaaaaaaaaauaauauaauaauaauu

SEQ ID NO: 44732 - RNA, 64 nt, Homo Sapiens
agcguugguguugugagcggcccaugaaaagccaaauuaaaaaucaaggauucagucaaacuaa

SEQ ID NO: 44733 - RNA, 64 nt, Homo Sapiens
cacauggcuuuaagaaccacacugaugccuugauaauuaaaaagaauacaagcauuccauguac

SEQ ID NO: 44734 - RNA, 64 nt, Homo Sapiens
uggugccgauguugaacuuuuuuuaaggggagaaaauuaaaagaaauauacaguuugacuuuuu

SEQ ID NO: 44735 - RNA, 64 nt, Homo Sapiens
aaguguugagccaugcuacaguuagucuugucccaauuaaaauacuaugcaguaucucuuacau

SEQ ID NO: 44736 - RNA, 64 nt, Homo Sapiens
uacuuuguguuuagcuaccuuuuuauauuuaaaaaauuaaaaaugaaaauuacguucuuacaag

SEQ ID NO: 44737 - RNA, 64 nt, Homo Sapiens
uuuggcuugcuguuuacucccuucuguaguuuuuaauuaaaaacuuuaaagauaagucuacauu

SEQ ID NO: 44738 - RNA, 64 nt, Homo Sapiens
auacaaaaaagaaaaaaugauacuuaaauuuaagaauuaaaaaaccuauaaauuaaaaauuuuu

SEQ ID NO: 44739 - RNA, 64 nt, Homo Sapiens
uuuuuacuuaaauuuaagaaagaaaaccccuauaaauuaaaaaucaggcuuuccaguuuuuacc

SEQ ID NO: 44740 - RNA, 64 nt, Homo Sapiens
cagaauaaaccugugaccacacuuuuguauaauaaauuaaaacuaauauuaaauuaaaaccuuu

SEQ ID NO: 44741 - RNA, 64 nt, Homo Sapiens
uuuacuuuuguauaauaaauuacuauuaauauuaaauuaaaacccacguaagaaaguguuuuuc

SEQ ID NO: 44742 - RNA, 64 nt, Homo Sapiens
uuuucuugguguuagcuuuuuguuucuguaguuuaauuaaaacaauauucuguauuauaaccau

SEQ ID NO: 44743 - RNA, 64 nt, Homo Sapiens
cuacaaaaguugguguaaauccuucauuccuuaaaauuaaaaacaagagauugacucagcauug

SEQ ID NO: 44744 - RNA, 64 nt, Homo Sapiens
aacaaaaaaacuauauuaaacaggguuuaaaggaaauuaaaacagaacuaugagaaguacaauu

SEQ ID NO: 44745 - RNA, 64 nt, Homo Sapiens
cacagaaucaccugagugucaauugaaaguugucaauuaaaagguaaccuuuuaaucucguagg

SEQ ID NO: 44746 - RNA, 64 nt, Homo Sapiens
cauggaaaauucccuccucuuccccccuuuuuuuaauuaaaagaagucacuuaggaaaauaaca

SEQ ID NO: 44747 - RNA, 64 nt, Homo Sapiens
uugaauuuuacuguuacacauaguuuuugacuugaauuaaaauacuagacaaagcagaaaugua

SEQ ID NO: 44748 - RNA, 64 nt, Homo Sapiens
gaaaugaagugagaagggaaguuuagagaaaaaaaauuaaaaagaaacaaagucuccaagaaau

SEQ ID NO: 44749 - RNA, 64 nt, Homo Sapiens
uauuagcuuuaaauguaaaugggcuaaaugcuccaauuaaaagacacagacaggcaaauuggau

SEQ ID NO: 44750 - RNA, 64 nt, Homo Sapiens
caggaaagauccaaaauuaacacccuaacaucacaauuaaaagaacuagaauugcaagagcaaa

SEQ ID NO: 44751 - RNA, 64 nt, Homo Sapiens
cugggcaacacggggagacccugucucuacaagaaauuaaaaauuagccaggcauaguuggcac

SEQ ID NO: 44752 - RNA, 64 nt, Homo Sapiens
aaaugaugacuuuauugcuuagaaaguuguaaauaauuaaaagcuucccaagaguuaaaugaag

SEQ ID NO: 44753 - RNA, 64 nt, Homo Sapiens
cuccaacugaaauguuaaggaagaagauagauccaauuaaaaaaaauuaaaaccaauuuaaaaa

SEQ ID NO: 44754 - RNA, 64 nt, Homo Sapiens
aauguuaaggaagaagauagauccaauuaaaaaaaauuaaaaccaauuuaaaaaaaaaaagaac

SEQ ID NO: 44755 - RNA, 64 nt, Homo Sapiens
aaauaauccugccuuuuacaaaaauuaaaauuaaaauuaaaaaccagagcaagacugucucaaa

SEQ ID NO: 44756 - RNA, 64 nt, Homo Sapiens
aaaaacaaauaauccugccucucaaaaaaauuaaaauuaaaauugggcgacagagcaagacugu

SEQ ID NO: 44757 - RNA, 64 nt, Homo Sapiens
aaaauuaaaaacaaauaaucgacugucucaaaaaaauuaaaauuuagccugggcgacagagcaa

SEQ ID NO: 44758 - RNA, 64 nt, Homo Sapiens
gcaguguugcgcgucacaagagagccuguauauaaauuaaaauagucaagacaacacugaccuu

SEQ ID NO: 44759 - RNA, 64 nt, Homo Sapiens
aggguagugacugagauguaaaaauagauuuuagaauuaaaacaaaauccaaguccucacaccc

SEQ ID NO: 44760 - RNA, 64 nt, Homo Sapiens
auaccaugggaaaaaagcuucaguuaauuuucagaauuaaaaacaaauugucucuugucuccuu

SEQ ID NO: 44761 - RNA, 64 nt, Homo Sapiens
acccacccuuuuucauuuccaaaaauuuuuuuuuaauuaaaaaaagaaccugucucuuaaaaaa

SEQ ID NO: 44762 - RNA, 64 nt, Homo Sapiens
aacacagucuuuuuaaaacuacaaaaaaaaauugaauuaaaaaugagaacagagaugagauuug

SEQ ID NO: 44763 - RNA, 64 nt, Homo Sapiens
ucaaaccuuuauaugcauguaggcaaaaaaguggaauuaaaaagaugccaucuucccugcgauc

SEQ ID NO: 44764 - RNA, 64 nt, Homo Sapiens
uguuuaauaacuuagaauucuuggggaugaauauaauuaaaauauguuuuugaaucaaugcagu

SEQ ID NO: 44765 - RNA, 64 nt, Homo Sapiens
aaaugucuuuuaauggaugauauaggaacccucaaauuaaaaaaaccgaagcaaguguacccuu

SEQ ID NO: 44766 - RNA, 64 nt, Homo Sapiens
augacauuccaaguugacauuuuuuuuucauuuuaauuaaaauuugaaauucugaacaccguca

SEQ ID NO: 44767 - RNA, 64 nt, Homo Sapiens
gugaaugccaccuccugagauccucaccucuuggaauuaaaauuguuggucacuggggaaagcc

SEQ ID NO: 44768 - RNA, 64 nt, Homo Sapiens
cggguaacaugguaaauuuuuagaaaauuuaaaaaauuaaaaaacugucucuaaagaaaaacua

SEQ ID NO: 44769 - RNA, 64 nt, Homo Sapiens
uaaaguauaaaguauuuuaauuaaagguacuacaaauuaaaaauagcauuugaugcauuauaac

SEQ ID NO: 44770 - RNA, 64 nt, Homo Sapiens
acuauacaaacuuacgaaacuuuuucuuuuuucuaauuaaaaccuuaguagaguuuauagccua

SEQ ID NO: 44771 - RNA, 64 nt, Homo Sapiens
auuccacuguuuucuuuggggaauggaaguucugaauuaaaagcccacuguggagaugcugugg

SEQ ID NO: 44772 - RNA, 64 nt, Homo Sapiens
guuaaugcaaagcuaaaauaaaauuuuccuuggcaauuaaaaaugcugugcgcuaauacccugc

SEQ ID NO: 44773 - RNA, 64 nt, Homo Sapiens
uuacuucugggaauuuguauguaacagccuagaaaauuaaaaggagguggaugcauccaaagca

SEQ ID NO: 44774 - RNA, 64 nt, Homo Sapiens
gguucuguuuuaaaaaggauuuuguuugauuugaaauuaaaacuucaagcugaaugacuuauau

SEQ ID NO: 44775 - RNA, 64 nt, Homo Sapiens
gaaaagauguucaugguacauuguaaaaaaauaaaauuaaaauuaaaaaaaguuugcagaaccg

SEQ ID NO: 44776 - RNA, 64 nt, Homo Sapiens
auguucaugguacauuguaaaaaaauaaaauuaaaauuaaaaaaaguuugcagaaccgcauaua

SEQ ID NO: 44777 - RNA, 57 nt, Homo Sapiens
cuaccaagaacaaagcauaaugcuggcaauuaaaaaugugguuuaguuuuccaaaca

SEQ ID NO: 44778 - RNA, 64 nt, Homo Sapiens
uacuuauacaauguuuuguacuuguauuucaugaaauuaaaacagugaugcuaaaacuauggca

SEQ ID NO: 44779 - RNA, 64 nt, Homo Sapiens
uuucauuauuagcuauccaucuuaaaauuucaaaaauuaaaauucagcaucugaauuucaaguu

SEQ ID NO: 44780 - RNA, 64 nt, Homo Sapiens
cagggaaaauaacuuuucuguaaagguagaugcaaauuaaaaugcagagccucacugcaguguc

SEQ ID NO: 44781 - RNA, 64 nt, Homo Sapiens
aaaaaaucugccacuuauccucaaaaaaauuaaaaauuaaaaaaugugaugcagcuaccaugau

SEQ ID NO: 44782 - RNA, 64 nt, Homo Sapiens
uaaaaaaaaaaaaucugccaccaugauucaaaaaaauuaaaaaugagcuuuugugaugcagcua

SEQ ID NO: 44783 - RNA, 64 nt, Homo Sapiens
agaagcuuuaaacuggugugaugugcuuguuuuuaauuaaaacaauucacauguggcuguuaau

SEQ ID NO: 44784 - RNA, 64 nt, Homo Sapiens
uugaucaaccuauuaaaaugcaugagugaacauaaauuaaaaaguggugaacaaaaaucgaacc

SEQ ID NO: 44785 - RNA, 64 nt, Homo Sapiens
aacuuguuauucaguuacuaaauuugaggugaauaauuaaaaagaaaaggacauuaggagagug

SEQ ID NO: 44786 - RNA, 64 nt, Homo Sapiens
auauguauggauauaauauaaaaugaauucauauaauuaaaaagaauuugguuaauaagaauuu

SEQ ID NO: 44787 - RNA, 64 nt, Homo Sapiens; identical to SEQ ID NO: 44773

SEQ ID NO: 44788 - RNA, 64 nt, Homo Sapiens
gguucuguuuuaaaaaggauuuuguuugauuugaaauuaaaacuucaaacugaaugacuuauau

SEQ ID NO: 44789 - RNA, 62 nt, Homo Sapiens
uauuuaugaauauauaaaucuuugguaauuuuucaugccaccgcgcaaguauuccauuugca

SEQ ID NO: 44790 - RNA, 62 nt, Homo Sapiens
uggggucacagaugccuagccugcccuuuuauucaugccauucuccccuggcucuuagcaac

SEQ ID NO: 44791 - RNA, 62 nt, Homo Sapiens
ccuuugggcggccucugggcuugggcaccagcucaugccagccccagagggucaggguugga

SEQ ID NO: 44792 - RNA, 62 nt, Homo Sapiens
gaggcuaacagauccaaugggaguccauggugucaugccaagacaguaucagacacagcccc

SEQ ID NO: 44793 - RNA, 62 nt, Homo Sapiens
cgcaaucucacugcaagcuccacuuccuggguucaugccauuuuccugccucagccucccga

SEQ ID NO: 44794 - RNA, 62 nt, Homo Sapiens
uguuuagauguuggagcagauuagagcagcauucaugccacucggagcaaccagacuuacag

SEQ ID NO: 44795 - RNA, 64 nt, Homo Sapiens
acgaagcgaggagaguucucguuagggauuccccgggagagagggacagguaacgcagugcggg

SEQ ID NO: 44796 - RNA, 64 nt, Homo Sapiens
agcgaagauccggaacucgcgucgcccgagccccgggagagaggaagacagcccgguaggcugc

SEQ ID NO: 44797 - RNA, 64 nt, Homo Sapiens
aaguaccaucuuuaucuacaaccagcggugugcagggagagacccugcuccuuguugggcagac

SEQ ID NO: 44798 - RNA, 64 nt, Homo Sapiens
auggcuuaguguuuagacugcugaagcuuuugcagggagagaaggugcuuccauacagugguuu

SEQ ID NO: 44799 - RNA, 64 nt, Homo Sapiens
gcaggggauagcagugaggucagaagucuuucccgggagagagauggccuggguuaucauugcu

SEQ ID NO: 44800 - RNA, 64 nt, Homo Sapiens
cucacccagaccuggccagggaaugauguaucuggggagagaaugagcuggaggagggggccuc

SEQ ID NO: 44801 - RNA, 64 nt, Homo Sapiens
gaugaccucguggccugugucugggauggcuguugggagagaguccccuggacugcccauccug

SEQ ID NO: 44802 - RNA, 64 nt, Homo Sapiens
uucuuauuguuggccaugaauugcugugcaacaugggagagaaggagagaagggcgugccaccc

SEQ ID NO: 44803 - RNA, 64 nt, Homo Sapiens
cggggagauuugagaggggaaaaccccgccaggagggagagagaggcaccccucugggaugcgg

SEQ ID NO: 44804 - RNA, 64 nt, Homo Sapiens
guagcacuguucugguucuguuugcacgccaguggggagagaauaaagaggaaaauuuaacaga

SEQ ID NO: 44805 - RNA, 64 nt, Homo Sapiens
ggaggacugggaggagaagcagaaaguggccccagggagagaaucaugaaauaaggcaucucug

SEQ ID NO: 44806 - RNA, 64 nt, Homo Sapiens
gugagcugcaagacugccucugcagcugcucugagggagagacauucucuggcaucaaguuucu

SEQ ID NO: 44807 - RNA, 64 nt, Homo Sapiens
ccucacaccaccgccaggagaggccuuucccaccgggagagaaacuuccagaccagccccucac

SEQ ID NO: 44808 - RNA, 64 nt, Homo Sapiens
ccucacaccacagccaggagaggccuuucccaccgggagagaaacuuccagaccagcccucuca

SEQ ID NO: 44809 - RNA, 64 nt, Homo Sapiens
ggcugagccacaugaaggcagcacucagggccaggggagagagaagaggaucagcagugcagcc

SEQ ID NO: 44810 - RNA, 64 nt, Homo Sapiens
cucccaccuuuccccugcugggaaggagccaggagggagagagcuggccagagcagggcuggag

SEQ ID NO: 44811 - RNA, 64 nt, Homo Sapiens
gaacacccacgcugguuucugggggugggggagagggagagagccacaugggguaagggggguu

SEQ ID NO: 44812 - RNA, 64 nt, Homo Sapiens
agggcauccuggcaucugcggccuucaccccauugggagagagcaucacagccccgaagguccu

SEQ ID NO: 44813 - RNA, 64 nt, Homo Sapiens
uuggacaucucacucaaaagcagauuccuaaguggggagagagucagaguugaugcuggauguu

SEQ ID NO: 44814 - RNA, 64 nt, Homo Sapiens
aagcaguuuccaaggauauggagagaaagacgaagggagagagaugggaaagaagagggaggga

SEQ ID NO: 44815 - RNA, 64 nt, Homo Sapiens
aagacgaagggagagagaaaggaaagaagagggagggagagagaggcaguacugaagagaaaug

SEQ ID NO: 44816 - RNA, 64 nt, Homo Sapiens
aaaaggguacaggcucacguaguagcaaagaaaagggagagacguggggugggggcagaacaug

SEQ ID NO: 44817 - RNA, 64 nt, Homo Sapiens
uuuucuuguauaugcuuauauuuuguacagaguggggagagacuaugcacacaaagacagcaac

SEQ ID NO: 44818 - RNA, 64 nt, Homo Sapiens
gagggaggcgcuccugggacggcccgagggaggagggagagaaggagggagggagggagagaau

SEQ ID NO: 44819 - RNA, 64 nt, Homo Sapiens
ggcccgagggaggagggagagagggagggagggagggagagaauuauaaacacuggaggggagg

SEQ ID NO: 44820 - RNA, 64 nt, Homo Sapiens
agguugaucuaccgacaccuuccacuucuuuccugggagagacugcuggcuucauuggugauug

SEQ ID NO: 44821 - RNA, 64 nt, Homo Sapiens
cuuaagcugugaucaugccacugcauuccagccugggagagagagaggaccugucuguugaaaa

SEQ ID NO: 44822 - RNA, 64 nt, Homo Sapiens
aguguggaaaccacggugguaagagaggaauaaagggagagagccguugguauacagggcagga

SEQ ID NO: 44823 - RNA, 64 nt, Homo Sapiens
cagggagguucuggagguucuuauuuggguggccgggagagaccuuacugauuaaaguuuucuu

SEQ ID NO: 44824 - RNA, 64 nt, Homo Sapiens
ccccuacccuacucugauguacaugcucuguuaugggagagaaugaucuuuucuugacucuccc

SEQ ID NO: 44825 - RNA, 64 nt, Homo Sapiens
gggauagaaaacaagcgcagagcagcaagaagcggggagagagaugucggaaccaggacacaaa

SEQ ID NO: 44826 - RNA, 64 nt, Homo Sapiens
cuauaccccuuacuuagcaucauagagggagagagggagagagcuauuuuuauauagcuugaaa

SEQ ID NO: 44827 - RNA, 64 nt, Homo Sapiens
gagagagccuauaccccuuagcuugaaacauagagggagagaggcauuuguuuauuuuuauaua

SEQ ID NO: 44828 - RNA, 64 nt, Homo Sapiens
guguuuuuccucuccaccaccaaaaaaaagacaugggagagaugcaaaaaaaaacaaaacaaaa

SEQ ID NO: 44829 - RNA, 64 nt, Homo Sapiens
ggucauagcuaaaugcaacaccacauccacagaggggagagaagccugccucuccccacccugc

SEQ ID NO: 44830 - RNA, 64 nt, Homo Sapiens
uuccaauccagaggagccccugauuccucuauuugggagagaucacuauguuacaguguauaaa

SEQ ID NO: 44831 - RNA, 64 nt, Homo Sapiens
gagguauuaaacaaauacccuauaaaacaaaaaugggagagagaguggcuagaaaugcaacuug

SEQ ID NO: 44832 - RNA, 64 nt, Homo Sapiens
uuuuggagucuuuguugcuauauuuuguggggcugggagagagagauuagauuauuuugacaug

SEQ ID NO: 44833 - RNA, 64 nt, Homo Sapiens
ccuguuguaaugugcaggacccuucuccuuucaugggagagacagguaguuaccugaauauagg

SEQ ID NO: 44834 - RNA, 64 nt, Homo Sapiens
gggagaagggaaaagagagaaggcagggagaguagggagagaaaaccuuccagcagcccaguaa

SEQ ID NO: 44835 - RNA, 64 nt, Homo Sapiens
aaaggcugcuuuagcuguggaugcccuugauuaagggagagagcgccuaggagcugccugcccc

SEQ ID NO: 44836 - RNA, 64 nt, Homo Sapiens
ugagcaucuccagcauucucggccuaccuugugagggagagaacgggcaccaccaagaauuugu

SEQ ID NO: 44837 - RNA, 64 nt, Homo Sapiens
uggaugaggagugguugggcgggaccagaaaccugggagagacuaggggucauccuugcccauc

SEQ ID NO: 44838 - RNA, 64 nt, Homo Sapiens
acaaaaaccccacaaaauaccccaacacaggcgggggagagacgaaaaagaaaaggaaagagca

SEQ ID NO: 44839 - RNA, 64 nt, Homo Sapiens
uuuagaguuaguucuacccagcgaggaggaggcggggagagaaacugcguucucuuuccccagc

SEQ ID NO: 44840 - RNA, 64 nt, Homo Sapiens
ugggggcaagggggaaaugcagguaauuggggaggggagagaggaaaauaguuugcaaaggacc

SEQ ID NO: 44841 - RNA, 59 nt, Homo Sapiens
cccccauccccacgcgggccuugcccagcgggagagacaccccgguugcgcugguauag

SEQ ID NO: 44842 - RNA, 64 nt, Homo Sapiens
ugcuuuuuucuuuuuuuucuaaaagugaaguggugggagagaauagggauagacagucuccaag

SEQ ID NO: 44843 - RNA, 64 nt, Homo Sapiens
cgagcauccuccccacccccacgccucugcaagugggagagaccauccggaugcuucggacccc

SEQ ID NO: 44844 - RNA, 64 nt, Homo Sapiens
uucugaggagagagcuagcuaggggcugggaaaggggagagauuggaguccuggucucccuaag

SEQ ID NO: 44845 - RNA, 64 nt, Homo Sapiens
gccuguucuuagcacugaguugaucgcuccaugggggagagaucagacauuccuuaucagagau

SEQ ID NO: 44846 - RNA, 64 nt, Homo Sapiens
gacagagagagauagagcagcagagagacagagagggagagagggaggcagagagggagagagg

SEQ ID NO: 44847 - RNA, 64 nt, Homo Sapiens
cagagagacagagagggagagagagaggcagagagggagagagggaaggagagaggcagagagg

SEQ ID NO: 44848 - RNA, 64 nt, Homo Sapiens
cagagagggagagaggcagagagagaggcagagagggagagagggaaagagacaggcagagaag

SEQ ID NO: 44849 - RNA, 64 nt, Homo Sapiens
gacagaggggaagagaggcagagagagagacagagggagagagaaaacagaggagacagagagg

SEQ ID NO: 44850 - RNA, 64 nt, Homo Sapiens
gacagagggagagagagacaagaggagacagagagggagagagaaggcagagagggagagaaac

SEQ ID NO: 44851 - RNA, 64 nt, Homo Sapiens
cagaggagacagagagggagagaggaggcagagagggagagaaaagauaugaggagagagagac

SEQ ID NO: 44852 - RNA, 64 nt, Homo Sapiens
uaugaggagagagagacagaagagguggggagaggggagagagaagaggaggggagagagaaag

SEQ ID NO: 44853 - RNA, 64 nt, Homo Sapiens
aagagagguggggagagggggagauggagaggaggggagagagagagggaaaggaggagggaga

SEQ ID NO: 44854 - RNA, 64 nt, Homo Sapiens
uggagaggaggggagagagagagggaaaggaggagggagagagagugcauaaaugggggucagg

SEQ ID NO: 44855 - RNA, 64 nt, Homo Sapiens
uucucugugccucaguuuccuucuccuuugaggggggagagagaacagugcagccccauuuccg

SEQ ID NO: 44856 - RNA, 64 nt, Homo Sapiens
aaaucuuuauugagugccuaccggugcaggcgcugggagagacaauagcuuugaggagcucaca

SEQ ID NO: 44857 - RNA, 64 nt, Homo Sapiens
agagggcacaaggugacagcgucgggacugagaggggagagagacuggagcuggcaaggacgug

SEQ ID NO: 44858 - RNA, 64 nt, Homo Sapiens
cuuauaaagaaaacuguuugggaaaauacguugagggagagaagaccuugggccaagaugcuaa

SEQ ID NO: 44859 - RNA, 64 nt, Homo Sapiens
cgugacacuguccgccucggcaggggaaaguggagggagagaaaggcuggagcaccccaaaagc

SEQ ID NO: 44860 - RNA, 64 nt, Homo Sapiens
gagagagaagucuccucugcccccgaagccuggcgggagagagacagggaugggccccguggaa

SEQ ID NO: 44861 - RNA, 64 nt, Homo Sapiens
aaaaaaauuguuuuagcgcuggguuucccaaggugggagagacagacccagccuggagcuggcc

SEQ ID NO: 44862 - RNA, 64 nt, Homo Sapiens
aaaccacuguauuuuucuguugagccuguacuuggggagagaucaguagcauuugaggaaguaa

SEQ ID NO: 44863 - RNA, 64 nt, Homo Sapiens
cccuggcuugggagaccgcucucugcaagggagggggagagaagcagagggagagagaagguga

SEQ ID NO: 44864 - RNA, 64 nt, Homo Sapiens
accgcucucugcaagggagggggagagaagcagagggagagagaaggugacacggauggaagag

SEQ ID NO: 44865 - RNA, 63 nt, Homo Sapiens
aggagcacaacagaugccacgucuucgugcauucgccaacacgugcccucacagggccagcgu

SEQ ID NO: 44866 - RNA, 63 nt, Homo Sapiens
gcugccugugucuucaccuguccuguccaccagcgccaacagccguggggaagccaaggagac

SEQ ID NO: 44867 - RNA, 64 nt, Homo Sapiens
cugcaauaugaaaugagcacauucuuugauaaggcguaucuauucaugcuuuuguaccacuguu

SEQ ID NO: 44868 - RNA, 64 nt, Homo Sapiens
ccuaacuacugccucuaauaauagcuuucaaacccguaucuauuacuagacagauacaguggag

SEQ ID NO: 44869 - RNA, 64 nt, Homo Sapiens
aacaaacaugagaccucccuaguuuccuuaccugcguaucuacuccgaggagaggaugaauuca

SEQ ID NO: 44870 - RNA, 64 nt, Homo Sapiens
cacccccccccccccaggcacuccaucucaaucccguaucuacgucuuuugaauuuccucaucc

SEQ ID NO: 44871 - RNA, 64 nt, Homo Sapiens
ggaaggauuucaaacaccaagcccucugagauggcguaucuaucuacaguuaguuauauuagca

SEQ ID NO: 44872 - RNA, 64 nt, Homo Sapiens
gccucucucugugacuggaaucucuccaccucaucguaucuaaggauaacccagaaacaugggg

SEQ ID NO: 44873 - RNA, 64 nt, Homo Sapiens
gcuaaaaguaauaaaaugguuucuuuauuguaaacguaucuaauccuaggcucuauuaacauaa

SEQ ID NO: 44874 - RNA, 64 nt, Homo Sapiens
uguauauauaaaugcauuauuauacauauaugcacguaucuauagaugugugaauauuuguuua

SEQ ID NO: 44875 - RNA, 64 nt, Homo Sapiens
cuuugguaacugcggacaagaggcgcaucuaacgcguaucuagggcagacgcacaggccggaaa

SEQ ID NO: 44876 - RNA, 64 nt, Homo Sapiens
ggcucugcuacccaccuccggagacacaagcccacguaucuacuuucacuugcucauccuugcu

SEQ ID NO: 44877 - RNA, 64 nt, Homo Sapiens
aagcuuuauuuguagcuucugccuuguuugacggcguaucuauucagggaagcgcacaguaaaa

SEQ ID NO: 44878 - RNA, 64 nt, Homo Sapiens
gagcuggcauguaauucuucgucuuggauacauacguaucuauaaauugauuaaaaguauccau

SEQ ID NO: 44879 - RNA, 64 nt, Homo Sapiens
ucacauucaaaauuaaaguuuuuuuugguuugaucguaucuaaaagguaguaaaguauaaguaa

SEQ ID NO: 44880 - RNA, 64 nt, Homo Sapiens
ccuaagacauuaccaagguuauaccuguuaaguucguaucuaaauggaauacagaaaauuaaau

SEQ ID NO: 44881 - RNA, 64 nt, Homo Sapiens
uaacauguugagauucucuaguuguuuucuuuggcguaucuaaccccuucuuuuguuuucugag

SEQ ID NO: 44882 - RNA, 64 nt, Homo Sapiens
uacccgacagcagcgaccgaaaagaaauguauaccguaucuaucaggacucgggccacgaaagg

SEQ ID NO: 44883 - RNA, 64 nt, Homo Sapiens
auauccccacccuccacccacccaaacuaccagccguaucuagccaaagcucuggcucacaggc

SEQ ID NO: 44884 - RNA, 64 nt, Homo Sapiens
gcuuauugaaugucaucuacugcuuuaggaaaaacguaucuaguguauuauuuuuaaaauugua

SEQ ID NO: 44885 - RNA, 64 nt, Homo Sapiens
aggaggagccagggacuggggcuggaaaaaaacgcguaucuacuuucaggccccgcuugcaaga

SEQ ID NO: 44886 - RNA, 64 nt, Homo Sapiens
gaaauuuuuuuaagugaggacucucuacccuugccguaucuaaggagcugagguaauacagauc

SEQ ID NO: 44887 - RNA, 64 nt, Homo Sapiens
auuuaaaaaaauugaaaaagacguggcgaaaccccguaucuauuuugagcccaggaguugaaga

SEQ ID NO: 44888 - RNA, 64 nt, Homo Sapiens
gugcaacgcggccuuuggugcccacgacuuccaucguaucuacaucagcugaaccugaaacuca

SEQ ID NO: 44889 - RNA, 64 nt, Homo Sapiens
auuacuggugucauuuuguuuuaugacagacacacguaucuaacaaacaaacaaacagugaccu

SEQ ID NO: 44890 - RNA, 64 nt, Homo Sapiens
gacagaggcaucuggaugcauggaguucucacaccguaucuaggagcaaauuccagcucugaaa

SEQ ID NO: 44891 - RNA, 64 nt, Homo Sapiens
acugccucucuugagcacuucccuggagcuaccacguaucuagcuaauauguaugugucaguag

SEQ ID NO: 44892 - RNA, 64 nt, Homo Sapiens
gucaucuggagccugcucugaguuugaggaggaucguaucuaucuacauuccgagcaagggaua

SEQ ID NO: 44893 - RNA, 64 nt, Homo Sapiens
caguugaagagccuuuugaacgcaguagcccgcucguaucuaugguuucgcuuuccacaguuug

SEQ ID NO: 44894 - RNA, 64 nt, Homo Sapiens
aguaaugcugcaggaaaagcaaaauugcaaucuacguaucuaugguacuaaggaaguccuguuu

SEQ ID NO: 44895 - RNA, 64 nt, Homo Sapiens
ugaugcgauuuuuuguucuuuuauguuuauacaacguaucuauguuguguaggggaaauuuuuu

SEQ ID NO: 44896 - RNA, 64 nt, Homo Sapiens
uagaaaaguuaacaugaagauuuuagaaggagagaacuuacaggacacagauuugugauucuuu

SEQ ID NO: 44897 - RNA, 64 nt, Homo Sapiens
ucgucuuugaaaauguuaaauugagaaaccuguuaacuuacauuuuaugaauuggcacauugua

SEQ ID NO: 44898 - RNA, 64 nt, Homo Sapiens
ucguuuuuaaagcuuaaauuagagccaaaguaucaacuuacagacuuaaugaaauaagcuccaa

SEQ ID NO: 44899 - RNA, 64 nt, Homo Sapiens
aacuguacuuuuguuggauuaacugauuuacaguaacuuacaacguugguuugccauuguuaaa

SEQ ID NO: 44900 - RNA, 61 nt, Homo Sapiens
caguccaugagacaacuugauuauucucuuuaacuuacagaauguuaguuuaaaauaauaa

SEQ ID NO: 44901 - RNA, 64 nt, Homo Sapiens
cugggagauagggguugcuggcaugaaaauguauaacuuacaacauuuauuaauaaaaugauaa

SEQ ID NO: 44902 - RNA, 64 nt, Homo Sapiens
aaaauaauuauaucugacuguuccuaacaagacuaacuuacagaauuuuuuagugcuaucauca

SEQ ID NO: 44903 - RNA, 64 nt, Homo Sapiens
aaccuaugauauagaauucacuuuuaacagauaaaacuuacagaaggaaagaacaaccuuaaaa

SEQ ID NO: 44904 - RNA, 64 nt, Homo Sapiens
uuugcaauaaguagauacauacugaaaaaaucuaaacuuacaauguuuauagucuugugugugc

SEQ ID NO: 44905 - RNA, 64 nt, Homo Sapiens
gaaaauaaaaaacuuaguucuaccacauccaauuaacuuacacacccccuucccugucucaaca

SEQ ID NO: 44906 - RNA, 64 nt, Homo Sapiens
uuguuguguccucugccaacuuuaugaauuuucuaacuuacauuauuuccugaauaaauguaug

SEQ ID NO: 44907 - RNA, 64 nt, Homo Sapiens
aauacguguuuguuauuugacccuuugccuuuaaaacuuacaaaaugucugucaucauucugcc

SEQ ID NO: 44908 - RNA, 64 nt, Homo Sapiens
aacauuuguacuuuaagaaaucauuuucuguuacaacuuacaggaagacugaaagaguuggggu

SEQ ID NO: 44909 - RNA, 64 nt, Homo Sapiens
agcaacuguuagcgucucuaugagcaaucaguagaacuuacacauccuaggaaaucuuucuuug

SEQ ID NO: 44910 - RNA, 64 nt, Homo Sapiens
caaguaaagacuuauacagauagauuuuuguuuuaacuuacaauccguuuuuuccucuuuuuuu

SEQ ID NO: 44911 - RNA, 64 nt, Homo Sapiens
uuuagaggauuauaugguugucuccagagaaauuaacuuacauuaucaaaaaauucuuugucua

SEQ ID NO: 44912 - RNA, 64 nt, Homo Sapiens
guucucccuuguucuuuuaaauuuugugaaauauaacuuacaaauaaguacuuaaaacagagcu

SEQ ID NO: 44913 - RNA, 64 nt, Homo Sapiens
uuuuuucagcaaaauacuucaaaugaauaguauuaacuuacaaaaagucacaaaaacuuacaug

SEQ ID NO: 44914 - RNA, 64 nt, Homo Sapiens
aaaugaauaguauuaacuuacaaaaagucacaaaaacuuacaugagagugaaaauuuguuauga

SEQ ID NO: 44915 - RNA, 56 nt, Homo Sapiens
ccccagacucauggguguagcaucaagaugcccaacagaggaacucuuucuuucua

SEQ ID NO: 44916 - RNA, 64 nt, Homo Sapiens
auguucugauaguuuguacagaaaaaauaaaauggaugcccauguuuuauugcuauuacuaaau

SEQ ID NO: 44917 - RNA, 64 nt, Homo Sapiens
cucccaccccuucaaugugguaugaaaagguccugaugcccaacgugaagacccaaggaaggcc

SEQ ID NO: 44918 - RNA, 64 nt, Homo Sapiens
gaggcagccaggccccucacaguccuccauugaggaugcccacuccaggcucacuucaguguug

SEQ ID NO: 44919 - RNA, 64 nt, Homo Sapiens
cucacuucaguguugaguccggaagaggcccccagaugcccaggugagucuucccuggccccuu

SEQ ID NO: 44920 - RNA, 64 nt, Homo Sapiens
uacuucauuuccugccccuuucagggccugugaggaugcccaugagcuaccgcuguacaguucu

SEQ ID NO: 44921 - RNA, 64 nt, Homo Sapiens
uuagaaaaccagucugaauugggucugucuuugagaugcccaggccagcagaaagcagcucaga

SEQ ID NO: 44922 - RNA, 64 nt, Homo Sapiens
gaguggaagcugccccaggcccuuaccaggugcagaugcccaaucuugaugcccagccaucaga

SEQ ID NO: 44923 - RNA, 64 nt, Homo Sapiens
cccaggcccuuaccaggugcagaugcccaaucuugaugcccagccaucagaacugugagccaaa

SEQ ID NO: 44924 - RNA, 64 nt, Homo Sapiens
ccagcagcaugcuuuguacagcugugccacgccugaugcccagcugagucagucugucuuguuu

SEQ ID NO: 44925 - RNA, 64 nt, Homo Sapiens
uugcaccccaugccaaugaauuuaaacaaauucugaugcccaggauuagaaucaucugggaggu

SEQ ID NO: 44926 - RNA, 64 nt, Homo Sapiens
ggguggaaccaggaaccuccuccacaccagcgcugaugcccaauaaagaugcccacugaggaau

SEQ ID NO: 44927 - RNA, 64 nt, Homo Sapiens
aaccuccuccacaccagcgcugaugcccaauaaagaugcccacugaggaaugaugaagcuuccu

SEQ ID NO: 44928 - RNA, 64 nt, Homo Sapiens
gugacagugccccagcuugagagggugucuuuaagaugcccaccguggugagcugcuggugggu

SEQ ID NO: 44929 - RNA, 64 nt, Homo Sapiens
cugaagaugccuuccuuugggaugggagggugaagaugcccaagagggcaagggcuggggcugg

SEQ ID NO: 44930 - RNA, 64 nt, Homo Sapiens
ugcccucaggcaagguagagcacagcucagccuggaugcccaccugcccucgaucuguccaucc

SEQ ID NO: 44931 - RNA, 64 nt, Homo Sapiens
augaccaugcccaagcuagggaauuuggcuucaagaugcccaagcagaacaggcagaagggaug

SEQ ID NO: 44932 - RNA, 64 nt, Homo Sapiens
ccucacugcugagucucccaggacccccuuuggagaugcccauggcaugggcacugcccacagg

SEQ ID NO: 44933 - RNA, 64 nt, Homo Sapiens
acugggguacuuuuaagaagggugcuccuuuuaagaugcccagaaaagcuguauuuaacucuug

SEQ ID NO: 44934 - RNA, 64 nt, Homo Sapiens
gggcuuuuguucccuuuugacauaauauagucaaugcacuaacaauuauguauauucaaacuug

SEQ ID NO: 44935 - RNA, 64 nt, Homo Sapiens
caaaguucauuuuauuuugaucaguucaguauauugcacuaauuauuuuagguauuuucauuau

SEQ ID NO: 44936 - RNA, 64 nt, Homo Sapiens
gagguacaucugcaagugagagaaaaaaaaaguuugcacuaauuaccccccccaaaaaauagaa

SEQ ID NO: 44937 - RNA, 64 nt, Homo Sapiens
cuuaauccuggacaccaguagcucagagaggugaugcacuaagcagcaaggaucucgguggguu

SEQ ID NO: 44938 - RNA, 64 nt, Homo Sapiens
ugcuauacauuauucaaaaagucucccgcgcauuugcacuaaugauggcugcaugcauagcaau

SEQ ID NO: 44939 - RNA, 64 nt, Homo Sapiens
agccauggaugcuuuccacaaaaugucaccucgcugcacuaaaggaugaugaauccuaaucauu

SEQ ID NO: 44940 - RNA, 64 nt, Homo Sapiens
gaaucucguucccaaagaaccacuaagagaaaauugcacuaaaucaaucccagggcuggcucug

SEQ ID NO: 44941 - RNA, 64 nt, Homo Sapiens
gaaaauugcacuaaaugaaucccagggcuggcucugcacuaagacagaaaagcauaacaccaau

SEQ ID NO: 44942 - RNA, 64 nt, Homo Sapiens
uuuuuuuuuuucuuuuacacuguaaagaccguaaugcacuaagccuuuuuuaaaaaagaagcaa

SEQ ID NO: 44943 - RNA, 64 nt, Homo Sapiens
uuaaaaguugugcaugggcuuauuuaucagacccugcacuaagaccugauuuauuacuaugucu

SEQ ID NO: 44944 - RNA, 64 nt, Homo Sapiens
cacaaaacaaacacuugcaccaaaaaaagcugaaugcacuaacuuucuuuuucaaaauaacaug

SEQ ID NO: 44945 - RNA, 64 nt, Homo Sapiens
uuuucuaacagggucuuagucacucccuguaucuugcacuaaaugucuggucaacagccccaug

SEQ ID NO: 44946 - RNA, 64 nt, Homo Sapiens
uggagaaguuagugucagaauaacuuguggagucugcacuaacuugcacuaacuuggacugcac

SEQ ID NO: 44947 - RNA, 64 nt, Homo Sapiens
uguggagucugcacuaacuugcacuaacuuggacugcacuaacuugcacuaacuaacuugcacu

SEQ ID NO: 44948 - RNA, 64 nt, Homo Sapiens
uggacugcacuaacuugugguaacuaacuugcacugcacuaacuugcacuaauuuagacugcac

SEQ ID NO: 44949 - RNA, 64 nt, Homo Sapiens
aacuugcacugcacuaacuugcacuaauuuagacugcacuaacuccccuuaacuuguggagucu

SEQ ID NO: 44950 - RNA, 64 nt, Homo Sapiens
uagacugcacuaacuaacuuuaacuuguggagucugcacuaauuaagucuuggacugagccccu

SEQ ID NO: 44951 - RNA, 64 nt, Homo Sapiens
ugugccagcaggggggcugugccaaccuguucuuagaguguagcuguaagggcagugcccaugu

SEQ ID NO: 44952 - RNA, 64 nt, Homo Sapiens
cuguaagggcagugcccauguguacauucugccuagaguguagccuaaagggcagggcccacgu

SEQ ID NO: 44953 - RNA, 64 nt, Homo Sapiens
aguugccauguuaggaaggucagcugcacagccaagaguguaagaguguaaagaaaugccuuuu

SEQ ID NO: 44954 - RNA, 64 nt, Homo Sapiens
uguuaggaaggucagcugcacagccaagaguguaagaguguaaagaaaugccuuuuuuuuuuuu

SEQ ID NO: 44955 - RNA, 60 nt, Homo Sapiens
gcacaggcauugcacacgguagucagcccugcugcacaugaaggcugaaucccugggccc

SEQ ID NO: 44956 - RNA, 60 nt, Homo Sapiens
gugcaggcauugcacacgguugccagcccugcugcacaggagggcugaguucccaggccc

SEQ ID NO: 44957 - RNA, 60 nt, Homo Sapiens
cugcaugaguugggcuuccccuuacccagggcugcacagccaggugugagggucaccggc

SEQ ID NO: 44958 - RNA, 60 nt, Homo Sapiens
caugcgugagugugguggugugaccuucaggcugcacagaggcaaggacccagauguggc

SEQ ID NO: 44959 - RNA, 60 nt, Homo Sapiens
uucaggagccugacuuggaucagacuuggggcugcacaguggagcagguggguucccgug

SEQ ID NO: 44960 - RNA, 60 nt, Homo Sapiens
cuaccugccacaccucagaggguuccuacagcugcacacaagcaguugagaguugaugac

SEQ ID NO: 44961 - RNA, 60 nt, Homo Sapiens
auacaaaggacacacagggauuuugaaaaugcugcacaucccuuaauagucaucuacaua

SEQ ID NO: 44962 - RNA, 60 nt, Homo Sapiens
guugauuuacuuuuuauuaaguucuccagagcugcacaacuaguuauguuuugauuuguu

SEQ ID NO: 44963 - RNA, 60 nt, Homo Sapiens
ucaggcacuguaguugcugaucuguaaacggcugcacacuaaugcccucauauugagugg

SEQ ID NO: 44964 - RNA, 60 nt, Homo Sapiens
aacaaaauauaaaucuguaucagugcauaugcugcacaaguggaacagcagcaaguuuuu

SEQ ID NO: 44965 - RNA, 60 nt, Homo Sapiens
gccugccagcccagagcccuggaggagccggcugcacagagaggcuuuucuucccagcug

SEQ ID NO: 44966 - RNA, 60 nt, Homo Sapiens
cagggcuccucauugcucccaucugccucugcugcacacacaggcaccagcagggaugcc

SEQ ID NO: 44967 - RNA, 60 nt, Homo Sapiens
cugaaauauccacccagcagaacacaucuggcugcacaggggaaagcagagccuccuggg

SEQ ID NO: 44968 - RNA, 60 nt, Homo Sapiens
agcccugccugagaagcccccacgguggcggcugcacaaccugggacccagucccacuga

SEQ ID NO: 44969 - RNA, 60 nt, Homo Sapiens
caggagcuuuccaugacccgaccuagagaagcugcacaccgguuccugucccuccgggag

SEQ ID NO: 44970 - RNA, 60 nt, Homo Sapiens
cccauugacacaaacccucaacagguugaugcugcacagcgcuggggcauuggcaagauc

SEQ ID NO: 44971 - RNA, 60 nt, Homo Sapiens
gcuguaucuucgccauugcaucuacucuuugcugcacacacugugcuugcuccuggcuuu

SEQ ID NO: 44972 - RNA, 60 nt, Homo Sapiens
ugaaucuuccugaaguguacugacauuugggcugcacagagccccacaccuucacuuaca

SEQ ID NO: 44973 - RNA, 65 nt, Homo Sapiens
acacuggcacacacaaaaaaguaguuuuaagcuuguuugcacaguucuuuuuuuccauuggaaau

SEQ ID NO: 44974 - RNA, 65 nt, Homo Sapiens
uaagcagggagaauaaagauaauuguauuuuauguuuugcacacaaacgcagaauuuguauaacc

SEQ ID NO: 44975 - RNA, 65 nt, Homo Sapiens
aaaccuccaucuugaagcuucuaugguucauagucuuugcacaggaaccugugguuuuaacaaac

SEQ ID NO: 44976 - RNA, 65 nt, Homo Sapiens
gaaauguacugaaauaaucauuggaauauuugcauuuugcacaaugacugguaugauagcucuug

SEQ ID NO: 44977 - RNA, 65 nt, Homo Sapiens
ccagcuguugcauuucuugcuuauucuguuuuguuuuugcacaucauaauggauuuuucuuagug

SEQ ID NO: 44978 - RNA, 65 nt, Homo Sapiens
uaagguuuaugaauucaaguaauaauuagauuuuuuuugcacagacuuacuuaacuuccuuauug

SEQ ID NO: 44979 - RNA, 65 nt, Homo Sapiens
ucccaggcaaaccaguaguggagguuuuacauuuguuugcacaucucaguauauuucuguugagg

SEQ ID NO: 44980 - RNA, 65 nt, Homo Sapiens
uuugcacaucucaguauauuucuguugagguaaaguuugcacagucaucugacuucugaucaagc

SEQ ID NO: 44981 - RNA, 65 nt, Homo Sapiens
uguuuguguguguguguaugguguguuugucuguauuugcacaugcaaggcagaaguuucaagau

SEQ ID NO: 44982 - RNA, 65 nt, Homo Sapiens
caccagcuaccucagggacagguguagcuccuacuuuugcacaggcgucggcgggaagcguggga

SEQ ID NO: 44983 - RNA, 65 nt, Homo Sapiens
accuaauuaaccuuccuauuuuccguugcaggcaguuugcacaauguuagauaaggacugagugc

SEQ ID NO: 44984 - RNA, 65 nt, Homo Sapiens
gugaucaguuugcccagaaugauaauauauuauuuuuugcacauuauauuuuaaaauuauaaaua

SEQ ID NO: 44985 - RNA, 65 nt, Homo Sapiens
ccuagggcacuggacuuucuggcaugggggcuguguuugcacaaguuauuuucauguuaccugga

SEQ ID NO: 44986 - RNA, 65 nt, Homo Sapiens
acuaaggagggucuggccagaggaacagaccagcuuuugcacaaugaagcgcaagggaacaagug

SEQ ID NO: 44987 - RNA, 65 nt, Homo Sapiens
gagccccagguugauucaaugccuugggaacuauuuuugcacauuggaagccucaaaaacagucc

SEQ ID NO: 44988 - RNA, 65 nt, Homo Sapiens
aagccaauucuuuuuuaucccuuuuagaaguagaauuugcacacuuacuacaauugaggaguguc

SEQ ID NO: 44989 - RNA, 65 nt, Homo Sapiens
uguaaagguauucguuaauccugugaaugguagcuuuugcacagaacuuccaaaagcaaaacaaa

SEQ ID NO: 44990 - RNA, 65 nt, Homo Sapiens
uguugaucuuaaaacuaguugauuuaaagaguuuuuuugcacaacauuucaauuauauuugugaa

SEQ ID NO: 44991 - RNA, 65 nt, Homo Sapiens
ucugauuauauugaaagcagauuuaacaaauuguuuuugcacauauaauauaaucuucccauguu

SEQ ID NO: 44992 - RNA, 65 nt, Homo Sapiens
cuuauuuuucuguaaaauauuaugugugagagggauuugcacacuuauucacacaaucguuuuuc

SEQ ID NO: 44993 - RNA, 65 nt, Homo Sapiens
cagaaaauuauuuuaaauuucuaaguuauaauaaauuugcacacagauaacaugcaugcuauuua

SEQ ID NO: 44994 - RNA, 65 nt, Homo Sapiens
agcuuagccuagcagucagugacuuacuugcacuuuuugcacauagauauaaaguaaaauuaugu

SEQ ID NO: 44995 - RNA, 65 nt, Homo Sapiens
uaguaauacuuguauuuauuugaaacacugggcuguuugcacagcuccaacugugcaugcucaaa

SEQ ID NO: 44996 - RNA, 65 nt, Homo Sapiens
caauauaagguacaugccuauacagaacuuaacauuuugcacagaauauaucaaauauauuuuga

SEQ ID NO: 44997 - RNA, 65 nt, Homo Sapiens
acauauuauuguaauuuagguauguuuuguuuuguuuugcacaacuguaacccuguuguuacuuu

SEQ ID NO: 44998 - RNA, 65 nt, Homo Sapiens
guauacuaguuccuacuuagaacaaaaguaucaaguuugcacacaaguaaucugccagcugaccu

SEQ ID NO: 44999 - RNA, 65 nt, Homo Sapiens
uauguaaaauaucguguugaguccuaaugcuuauauuugcacaagaauuugccucagauauaucu

SEQ ID NO: 45000 - RNA, 65 nt, Homo Sapiens
uagugcugguuucagaaauuagauugucugcugccuuugcacaucaucuggcugcauugauggcc

SEQ ID NO: 45001 - RNA, 65 nt, Homo Sapiens
uugcaccagccuuuaaacacuuuucgugaagaaauuuugcacaguaguuuaaaucuuuuguuaau

SEQ ID NO: 45002 - RNA, 65 nt, Homo Sapiens
ggaucuuagagaaaaugaauauuuaaauuuuaaaguuugcacauuucaucuuuguccuaacauga

SEQ ID NO: 45003 - RNA, 65 nt, Homo Sapiens
uauuucuaaauuugauuauauucucugaugaucccuuugcacagaacuaugcuuaucucauguuu

SEQ ID NO: 45004 - RNA, 65 nt, Homo Sapiens
aagucuguacauauuuuuguaccuuuuauguaaauuuugcacagaaauuuuuggcauaaguuuau

SEQ ID NO: 45005 - RNA, 65 nt, Homo Sapiens
cuaguauguuuaggguucuguguucagauauuuuguuugcacacuacuuuuuaggaaacuuauaa

SEQ ID NO: 45006 - RNA, 65 nt, Homo Sapiens
auacuuaaaauaagcguccaguuauaaaaagccuauuugcacaacuuuuugggaauacuucuauu

SEQ ID NO: 45007 - RNA, 65 nt, Homo Sapiens
aacacaauucagugguacuuggaauccuguuuuaauuugcacaaauuuaaauguagagagccccu

SEQ ID NO: 45008 - RNA, 65 nt, Homo Sapiens
guuccagauuucacaccuacaauaauuccaaaagguuugcacauuagaguuuguaacaaaauauu

SEQ ID NO: 45009 - RNA, 65 nt, Homo Sapiens
uuauuggauucuagagcaacugugcuaauaaguccuuugcacauauugauuuaagucucacacac

SEQ ID NO: 45010 - RNA, 65 nt, Homo Sapiens
guaaaauuuuagguagagaguaaaauguuuuucguuuugcacaugcagaagagaugaucaauaac

SEQ ID NO: 45011 - RNA, 65 nt, Homo Sapiens
uaccuguugcagaagcgguuaucuuucuuuuuuacuuugcacaucaguguuagccuuucccuauu

SEQ ID NO: 45012 - RNA, 65 nt, Homo Sapiens
gccuuucccuauuucagcacaaucuuagacucauauuugcacacuuuugugucgugaaguucuag

SEQ ID NO: 45013 - RNA, 65 nt, Homo Sapiens
aaggaugagggaacaggcaaggaacaaaggcaaccuuugcacacucaccugagcccuggggaccc

SEQ ID NO: 45014 - RNA, 65 nt, Homo Sapiens
acccccugggaaugggggguacucacgcaccccgcuuugcacaccacagagugcccucacccacu

SEQ ID NO: 45015 - RNA, 65 nt, Homo Sapiens
gcuuuauuuucuagaggcucaaugccauauuguauuuugcacacuaaaaaccuagcuggaauaau

SEQ ID NO: 45016 - RNA, 65 nt, Homo Sapiens
uuuaauagcuugcuauucagugaagugcuuuacuuuuugcacaauuaaguucaguuauuagucug

SEQ ID NO: 45017 - RNA, 65 nt, Homo Sapiens
acuaccuaaaauaaauaccaaagauaaugcauauuuuugcacaguggagcuuacacuuaaaagaa

SEQ ID NO: 45018 - RNA, 65 nt, Homo Sapiens
ggugauguacucuuauauuuuucugggcuuuuccuuuugcacauuccaaaauucauuucauaaga

SEQ ID NO: 45019 - RNA, 65 nt, Homo Sapiens
auacacaauggcaguauuaacaagcauuuuaaaccuuugcacaugauauugaaccuguucaguuu

SEQ ID NO: 45020 - RNA, 65 nt, Homo Sapiens
accaaaguggcacaacugcacaguucucagauuucuuugcacagauugauuuuuauugcggguuu

SEQ ID NO: 45021 - RNA, 65 nt, Homo Sapiens
gcuuuccuaguuacucaaauugacuuucccccaccuuugcacaggugcuuucaauaguuuuaaaa

SEQ ID NO: 45022 - RNA, 65 nt, Homo Sapiens
guacgaugcucuaaucauauugcauuuaauuuuauuuugcacagugaccuuguagccacaugaga

SEQ ID NO: 45023 - RNA, 65 nt, Homo Sapiens
acuuccacccugacggccgcgccauggccaccaaguuugcacacuugaagcuguugcugcgacac

SEQ ID NO: 45024 - RNA, 65 nt, Homo Sapiens
uucuguuucuguuguuuuguuuuuaacaacuauacuuugcacacaugaaggucacugugguuugu

SEQ ID NO: 45025 - RNA, 64 nt, Homo Sapiens
accacugcaaauuuuuucaguauaaaauuuuucacugcaaaaaaauuucaguagaaaauaagga

SEQ ID NO: 45026 - RNA, 64 nt, Homo Sapiens
ucagguuaaauauucauugcauuuauaagaucuucugcaaaaagcccagaaaugguccuuuuca

SEQ ID NO: 45027 - RNA, 64 nt, Homo Sapiens
ggccagugaacaccaucccagaagcauuuucccucugcaaaaugacguuucuucccacgucugu

SEQ ID NO: 45028 - RNA, 64 nt, Homo Sapiens
gucuauauaagggaaugucuuccuuccuaucuaucugcaaaauggaaaucuagaccuccuucuu

SEQ ID NO: 45029 - RNA, 64 nt, Homo Sapiens
ggaccuccagccaggcuucauuuaugcacuugugcugcaaaagaaaagucuagguuuuaaggcu

SEQ ID NO: 45030 - RNA, 64 nt, Homo Sapiens
auugugaaggaauugagccagaucucucucccuacugcaaaacccuauuguaguaaaaaagucu

SEQ ID NO: 45031 - RNA, 64 nt, Homo Sapiens
aaucuuggcacccagaagaauucaacugcgcucacugcaaaaauacaauggccuacauuggauu

SEQ ID NO: 45032 - RNA, 64 nt, Homo Sapiens
accuucuuuccuuguuagguaguuaugaguaaaucugcaaaaggcaaugaaaaugccuuaaauu

SEQ ID NO: 45033 - RNA, 64 nt, Homo Sapiens
gagauguacagauuucgguugccugccuacuuuucugcaaaaauuuuuauguauaauucuuucu

SEQ ID NO: 45034 - RNA, 64 nt, Homo Sapiens
uuggauucacaaaugucccugcaggcuccagcuucugcaaaaacaaaaugaaggccaaacagaa

SEQ ID NO: 45035 - RNA, 64 nt, Homo Sapiens
ccaagaauguuuugcuagagcuaacagacauagacugcaaaagaauaauuuggaaucagcuaug

SEQ ID NO: 45036 - RNA, 64 nt, Homo Sapiens
gaccagccugggcaacauagcaagacccccaucucugcaaaaaaauaagaaaauuagcuuggca

SEQ ID NO: 45037 - RNA, 64 nt, Homo Sapiens
augaaacagccaucuuaaaaaaaaaaaaaguaaacugcaaaaguacaaaaucauuuuucaaucu

SEQ ID NO: 45038 - RNA, 64 nt, Homo Sapiens
ucccagugaugccuuauuugaaacugggcuuaaacugcaaaaagaaugaaguuggauuuaggaa

SEQ ID NO: 45039 - RNA, 64 nt, Homo Sapiens
auggaaacugugggagucaaacuuccuuauuuaucugcaaaagguuuuagccaaagguguacuu

SEQ ID NO: 45040 - RNA, 64 nt, Homo Sapiens
caccuuauucugacuuuugguguucugcagguugcugcaaaacuggcacaaugaagcguggaug

SEQ ID NO: 45041 - RNA, 64 nt, Homo Sapiens
guugacuggggcaaaggauugaccacaauggaugcugcaaaaacguaacuccaaguacaaggcc

SEQ ID NO: 45042 - RNA, 64 nt, Homo Sapiens
caaauacauuuuuuaaaaucguuugcguuccaaccugcaaaacaacgggacguggccagacugg

SEQ ID NO: 45043 - RNA, 64 nt, Homo Sapiens
auugagaggcuuuuggugcauccauaauuauuuacugcaaaaugggcuacuugucacaucacuu

SEQ ID NO: 45044 - RNA, 64 nt, Homo Sapiens
cagauucauucguaaauauugggacaauagaaaccugcaaaacagaucuucacuccagucacua

SEQ ID NO: 45045 - RNA, 64 nt, Homo Sapiens
uaacuuuagguaggagcuguuuuuguuugaaguacugcaaaauuauauuguaacuuccccucac

SEQ ID NO: 45046 - RNA, 64 nt, Homo Sapiens
aagccucagaaaagaaauaagcauauuucaaaagcugcaaaagguuuuucacugccugccucuu

SEQ ID NO: 45047 - RNA, 64 nt, Homo Sapiens
uugugauguaagaaauuuguauugcugaaccuuacugcaaaaacguagaaaucaugucuucuua

SEQ ID NO: 45048 - RNA, 64 nt, Homo Sapiens
guauagcuuugacaauuccauaaguaaagccaaucugcaaaacugaaaaacguuugcagaaaug

SEQ ID NO: 45049 - RNA, 64 nt, Homo Sapiens
cgguauuacuaugucaaguuaucucuaaguaauucugcaaaauccauaaaccugauuugcagug

SEQ ID NO: 45050 - RNA, 64 nt, Homo Sapiens
cuaaaauacccauuggugaucaaacaaaaaaaaacugcaaaaguaaaaacagcaaaacaaaaag

SEQ ID NO: 45051 - RNA, 64 nt, Homo Sapiens
uagggaagaccugcugagggaccagccaagagggcugcaaaagugagggcuugucauuaccaga

SEQ ID NO: 45052 - RNA, 64 nt, Homo Sapiens
aaagaccaaauuccuuggcaugccuuccagcacccugcaaaaugagacccucguggccuucccc

SEQ ID NO: 45053 - RNA, 64 nt, Homo Sapiens
aagcgcggacccuucuggguccagggaggggucccugcaaaacuccaggcaggacuucucacca

SEQ ID NO: 45054 - RNA, 64 nt, Homo Sapiens
ccagaaagcuucauccacagccuugcagcggcuccugcaaaaggaggugaaaucccugccucag

SEQ ID NO: 45055 - RNA, 64 nt, Homo Sapiens
agcaagaaugccagaaauagccuucauuucuacccugcaaaauaauccagaucugcuuucuaaa

SEQ ID NO: 45056 - RNA, 64 nt, Homo Sapiens
aaauccuagaguugauucauuguuuuccuccauccugcaaaagaagaucccuuuguuaagcagc

SEQ ID NO: 45057 - RNA, 64 nt, Homo Sapiens
aauuuuucacccauuuacacauauccacaaaugacugcaaaagugccacggauaucaauuugag

SEQ ID NO: 45058 - RNA, 64 nt, Homo Sapiens
aaucaaauaagcuaauaaagaaaagagguuuauacugcaaaagaagugaaacuauauguauuca

SEQ ID NO: 45059 - RNA, 64 nt, Homo Sapiens
caugguuuaaaucuauauggugucucuacuucggcugcaaaaccauaugaucccagaaaacauc

SEQ ID NO: 45060 - RNA, 64 nt, Homo Sapiens
guuuaaugcccccuacauaucagcuuucuagcagcugcaaaaugaucaggaaaacaggaaaaca

SEQ ID NO: 45061 - RNA, 64 nt, Homo Sapiens
uuucuuguguuuuaauuauuuucacauuuucucucugcaaaacuuuaguuuucugaugaucuac

SEQ ID NO: 45062 - RNA, 64 nt, Homo Sapiens
gcuauugugauguaugauguauguaguccuacaacugcaaaacgucuuacugaaccaacaauca

SEQ ID NO: 45063 - RNA, 64 nt, Homo Sapiens
caguaacaaaaugaaaucucaaaacagagcucagcugcaaaaaagcauauuuucuguguuucug

SEQ ID NO: 45064 - RNA, 64 nt, Homo Sapiens
uaacaguuauucuguuguuauaaaacuauacccacugcaaaaguaguagucaagugucuagguc

SEQ ID NO: 45065 - RNA, 64 nt, Homo Sapiens
augcacgcacacacacauauggggaccugcacaccugcaaaacgagggaacaacuaagguggcu

SEQ ID NO: 45066 - RNA, 64 nt, Homo Sapiens
caagcggcccugcagccacaaagcaacccgcccucugcaaaaacuaggcacauccgcagugcgc

SEQ ID NO: 45067 - RNA, 64 nt, Homo Sapiens
agaauaguuguuaauuuguuuagaauuuaaguucuacucagaaucauaacaucuggcagaacag

SEQ ID NO: 45068 - RNA, 64 nt, Homo Sapiens
uucauuaggaaaagccagauauaccaaagcgguuuacucagagucagggguguagcucuggcug

SEQ ID NO: 45069 - RNA, 64 nt, Homo Sapiens
ccacacauuuuauuuguauuucagucacauuuauuacucagagugccauucuucucauauuguc

SEQ ID NO: 45070 - RNA, 64 nt, Homo Sapiens
ggacuucaccacguggacaaacgaaagcacaggcuacucagacuuggccacaggucauagguca

SEQ ID NO: 45071 - RNA, 64 nt, Homo Sapiens
uagaaauaaacuaggaaaugcagauguuuuuaacuacucagacuuuugaggaauuaauccuuuu

SEQ ID NO: 45072 - RNA, 64 nt, Homo Sapiens
uuucaaauggauccuccagauggcauucaugucuuacucagaaagggcacugccauugucccca

SEQ ID NO: 45073 - RNA, 64 nt, Homo Sapiens
cuguccuaagcgucaucuugagccuugcacaugauacucagauuccucacccuugcuuaggagu

SEQ ID NO: 45074 - RNA, 64 nt, Homo Sapiens
ccaucacaguuuaaauguauaucuuuuaugucucuacucagaccauauuuuuaaaggggugccu

SEQ ID NO: 45075 - RNA, 64 nt, Homo Sapiens
auaaugacuccucaucaguagucuucaggaaaacuacucagaauuccuugacuugagacuugug

SEQ ID NO: 45076 - RNA, 64 nt, Homo Sapiens
uguggaauuuuauaauuucauuauaaguuucaaauacucagacucuugcauuuucugaugacuu

SEQ ID NO: 45077 - RNA, 64 nt, Homo Sapiens
gaucccuugcuucccucccccagugcguucugugaucgccaaguucaaagcugugcacaugugg

SEQ ID NO: 45078 - RNA, 64 nt, Homo Sapiens
ggugccaggccucagccucacccacagcagccccaucgccaaaggauggaaguaauuugaauag

SEQ ID NO: 45079 - RNA, 64 nt, Homo Sapiens
uuuaauaaaucagcuggaacugauagaaacucgcaucgccaauagucucuauggaagucaaacu

SEQ ID NO: 45080 - RNA, 64 nt, Homo Sapiens
ugucucuguagaagcuccggagaaggagucagccaucgccaacucaucauauaccucuugaaga

SEQ ID NO: 45081 - RNA, 64 nt, Homo Sapiens
cauucgccacugggcaacuauggcuagauuucagaucgccaacauguuuucucaagcuccagau

SEQ ID NO: 45082 - RNA, 64 nt, Homo Sapiens
cuauuagaucacuagcacugcuuuaccgcuccucaucgccaacacccccaugcucuguggccuu

SEQ ID NO: 45083 - RNA, 64 nt, Homo Sapiens
gcccacugucuaccuugccagauccucagugcguaucgccaaugcaggaugcuccuuagaaaag

SEQ ID NO: 45084 - RNA, 64 nt, Homo Sapiens
acugacugagacacgaugccgcgucugaggggacaucgccaaggacguaugcaagucugugagu

SEQ ID NO: 45085 - RNA, 64 nt, Homo Sapiens
aagaaagugaagcaaaucaggcugccagggcgccaucgccaagucacugguauguguggaugau

SEQ ID NO: 45086 - RNA, 64 nt, Homo Sapiens
uguccuuugacaucacuggcuccauggcgaguguaucgccaacuggaggagugcuuugagcggg

SEQ ID NO: 45087 - RNA, 54 nt, Homo Sapiens
acaaucaggugagcgaacgaggccaucgccaagcgccaugcggcgcuccuauga

SEQ ID NO: 45088 - RNA, 64 nt, Homo Sapiens
aguuccauuuuuuuuuuuuuuggaaaaggagguaaucgccaaaucaaaaugguuuuuaaguacu

SEQ ID NO: 45089 - RNA, 64 nt, Homo Sapiens
aagugaauuaaucugauucacaggauuauguuuaaucgccaaaaacacacuggccaguguacca

SEQ ID NO: 45090 - RNA, 64 nt, Homo Sapiens
ggcuucuaacaaaaacuacacauauguauuccugaucgccaaccuuucccccaccagcuaagga

SEQ ID NO: 45091 - RNA, 64 nt, Homo Sapiens
ccugcgaucagcuugugacuuccaccagaaaaccaucgccaacugcuuaccuaccacggccguc

SEQ ID NO: 45092 - RNA, 64 nt, Homo Sapiens
ccugccucgugccaccucaugacccccagguggcaucgccaacuggaagcuccagacucaaugu

SEQ ID NO: 45093 - RNA, 64 nt, Homo Sapiens
aagaagaaaaaaacgaaaacagucaaccaaccccaucgccaacuaagcgaggcaugccugagag

SEQ ID NO: 45094 - RNA, 64 nt, Homo Sapiens
uuagcaaacggugucaugguuuggaauguucauuaucgccaagaaccugguuagaggcauaaag

SEQ ID NO: 45095 - RNA, 64 nt, Homo Sapiens
ugugggaguuauuuauauccuacugcucaaggucaucgccaaggugugauuggaaaaauucaaa

SEQ ID NO: 45096 - RNA, 64 nt, Homo Sapiens
cacgucaagguaagguugacccccuuggggacugaucgccaaagcggggaggaggcuacguggu

SEQ ID NO: 45097 - RNA, 64 nt, Homo Sapiens
aggcgccugcuccaccagcugguggguguuuguaaucgccaagcaccagcuauaggucacagcc

SEQ ID NO: 45098 - RNA, 64 nt, Homo Sapiens
ugguuuucucacgcauaaaauggagaguggauuaaucgccaaagauucuucugaucugacauuu

SEQ ID NO: 45099 - RNA, 64 nt, Homo Sapiens
uuugcuguaaugcaggcuuucuguugagugacucaucgccaagacuuugguuuguggcugaaag

SEQ ID NO: 45100 - RNA, 64 nt, Homo Sapiens
cacuggccacugcaggggacaggcagcugagcugaucgccaacucucugcugagggugacucca

SEQ ID NO: 45101 - RNA, 64 nt, Homo Sapiens
caaaucacgagaagagagaaaaccaaagagaggaaucgccaaaagugggucacguggucugcag

SEQ ID NO: 45102 - RNA, 64 nt, Homo Sapiens
uacaguuucguuuccauucacgacgcguucacugaucgccaaauguaaacagaucgcacagagu

SEQ ID NO: 45103 - RNA, 64 nt, Homo Sapiens
caggacugcugaugaggaauauugcuugcuauuaaucgccaaaacggaccucuaauccaagcau

SEQ ID NO: 45104 - RNA, 64 nt, Homo Sapiens
uaggcuuguguuuuucaguguguuucuucaucucaucgccaaggcguuaacguuuccuguagua

SEQ ID NO: 45105 - RNA, 64 nt, Homo Sapiens
agauccugcacgucaccuggucauccagggcuacaucgccaaccgaugcagcauuucgugaagg

SEQ ID NO: 45106 - RNA, 64 nt, Homo Sapiens
gcugcauccuaaaauuccaaaauuauauugagcaaucgccaaggccuaaagccaacugacuuaa

SEQ ID NO: 45107 - RNA, 64 nt, Homo Sapiens
aaaucaguguagaaguagaguuaccuaaaccuuuaucgccaaugcacagcuuggccuguuaagu

SEQ ID NO: 45108 - RNA, 64 nt, Homo Sapiens
aguuguaauaaacguucaaccacugucuuaucacaucgccaauucaacauucaggccacgugag

SEQ ID NO: 45109 - RNA, 64 nt, Homo Sapiens
aggacuucagagcccuggggguuuccacuaaaucaucgccaaaggagcagcuccuccuaguuaa

SEQ ID NO: 45110 - RNA, 64 nt, Homo Sapiens
gcaguacaaugauuaguaauguaaaaauuaacacagaaauuaaccuaaggaaugaagggugggu

SEQ ID NO: 45111 - RNA, 64 nt, Homo Sapiens
guucaaggaagaugcacuauucaguuaucuauugagaaauuauuuugcagugguuuuagugggu

SEQ ID NO: 45112 - RNA, 64 nt, Homo Sapiens
aaauuuuaucaugguauaauuuguaaaaauaaaaagaaauuacaaaagaaauuauggauuuguc

SEQ ID NO: 45113 - RNA, 64 nt, Homo Sapiens
gguauaauuuguaaaaauaaaaagaaauuacaaaagaaauuauggauuugucaauguaaguauu

SEQ ID NO: 45114 - RNA, 59 nt, Homo Sapiens
uugacuuugcagccauguagugaauggaaagaaauuaugcaccuuuuauggaccaaauu

SEQ ID NO: 45115 - RNA, 64 nt, Homo Sapiens
gauccaaaacauuguacccagcuuuuuaaaagagagaaauuaucacuacaacucccgagcacua

SEQ ID NO: 45116 - RNA, 64 nt, Homo Sapiens
ggggagggagaaaauauuaaugggaaaggcauucagaaauuaugguuucuaccuuuuuaaaaag

SEQ ID NO: 45117 - RNA, 64 nt, Homo Sapiens
gaaaagagguccagaugagagcagagauacagugagaaauuaugugaucuguguguugugggaa

SEQ ID NO: 45118 - RNA, 64 nt, Homo Sapiens
ucuacaagaaguuuugcaaaagcagugaguguucagaaauuagaaacaggaggaauagaaauga

SEQ ID NO: 45119 - RNA, 64 nt, Homo Sapiens
cccugcaacaggaggaauagugagacaaaggagaagaaauuacugguguucuugauaagggaag

SEQ ID NO: 45120 - RNA, 64 nt, Homo Sapiens
agagaacauggucacccaaaagcaacuguaacucagaaauuaaguuacucagaaauuaaguagc

SEQ ID NO: 45121 - RNA, 64 nt, Homo Sapiens
caaaagcaacuguaacucagaaauuaaguuacucagaaauuaaguagcucagaaauuaagaaag

SEQ ID NO: 45122 - RNA, 64 nt, Homo Sapiens
ucagaaauuaaguuacucagaaauuaaguagcucagaaauuaagaaagaaugguauaaugaacc

SEQ ID NO: 45123 - RNA, 64 nt, Homo Sapiens
auuuugcuuuuucaaccaguuaaauuuuagcaacagaaauuagaagugaugauuguuuaguaac

SEQ ID NO: 45124 - RNA, 64 nt, Homo Sapiens
uauuacuguacucuuaguuguuaucauaaaagggagaaauuaaaacuuacguguugucacugga

SEQ ID NO: 45125 - RNA, 64 nt, Homo Sapiens
gaaauugacccuuuuuacacuucacucugaucuaagaaauuauuauuaucaaggaagccuuaga

SEQ ID NO: 45126 - RNA, 64 nt, Homo Sapiens
uagucuccucagauuuuaauagaaaucuuaaugcagaaauuauaagugccaaaaaaaaaaucuc

SEQ ID NO: 45127 - RNA, 64 nt, Homo Sapiens
uauacaacuuguuuuaaccuuugagaacauugacagaaauuaugcaaugguuuguugagauacg

SEQ ID NO: 45128 - RNA, 64 nt, Homo Sapiens
caaaguggccuacucaagaggcccuaagacugguagaaauuaaaaggauuucaaaaacuuucua

SEQ ID NO: 45129 - RNA, 64 nt, Homo Sapiens
auauaaccaucaauaaagaagcauucuuuuccaaagaaauuauuucuucaauuauuucucauuu

SEQ ID NO: 45130 - RNA, 64 nt, Homo Sapiens
uuucuucaauuauuucucauuuauuguauuaagcagaaauuaccuuuucuuucucaaaaucagu

SEQ ID NO: 45131 - RNA, 64 nt, Homo Sapiens
uugaaccucuuuauagcauugauacuaggugaacagaaauuaccugacuaauaauuugucuaac

SEQ ID NO: 45132 - RNA, 64 nt, Homo Sapiens
cuauggggguuuuuaccacaguugccauuguggaagaaauuauuugguacauuaauaaaaaaag

SEQ ID NO: 45133 - RNA, 64 nt, Homo Sapiens
ugacaaagggauuuacacccuugacaaaaccaaaagaaauuaacaggccacagguuucuuuaaa

SEQ ID NO: 45134 - RNA, 64 nt, Homo Sapiens
aauugggaggcaauaguaucaauauccuaaauguagaaauuaaaagauacuguauaauuuuaug

SEQ ID NO: 45135 - RNA, 64 nt, Homo Sapiens
ugguuuuaucucauauuuucuuggcaaaauugagagaaauuaggaacacugcuauuuuuuucuu

SEQ ID NO: 45136 - RNA, 64 nt, Homo Sapiens
ugggugaugaagugagacucuccaaaaaaaaaaaagaaauuauuaaucccugccugugcucuac

SEQ ID NO: 45137 - RNA, 64 nt, Homo Sapiens
ccuugauucuggcaaggcaaauaaagccagaaugagaaauuaccaucuucuacuagagaaaacc

SEQ ID NO: 45138 - RNA, 64 nt, Homo Sapiens
uuuaucuggcauuuuuaaacucccaccuucuguuagaaauuaguaguuccaguuucuauggccu

SEQ ID NO: 45139 - RNA, 64 nt, Homo Sapiens
uuaauuuucauguuugaaugugcauuuaauuuccagaaauuaaauuuucuaauauagugacauc

SEQ ID NO: 45140 - RNA, 64 nt, Homo Sapiens
gaggauuuaaaccagaauguaagaauuugucuugagaaauuacaagagcagcgaucagauuaug

SEQ ID NO: 45141 - RNA, 64 nt, Homo Sapiens
cuuuuaucuucucugcaguguuaaauuuuucagcagaaauuaugguauagauacccauuauacu

SEQ ID NO: 45142 - RNA, 64 nt, Homo Sapiens
uaauaaaaaaacaaucauuuuuucaguauuuuggagaaauuauuuuuugaauguuauuuguuau

SEQ ID NO: 45143 - RNA, 64 nt, Homo Sapiens
aaccuuaauauguggacguaaguuaauauaucccagaaauuagaaguagauggugaaauuuauu

SEQ ID NO: 45144 - RNA, 64 nt, Homo Sapiens
cuuauucucauauaauacuaaucuaaacaguacuagaaauuacagugccaagagccaccaggag

SEQ ID NO: 45145 - RNA, 64 nt, Homo Sapiens
guuguuaguagaaggucaauuuaaaauagggacuagaaauuauuugaaguuuucuuuauuacgg

SEQ ID NO: 45146 - RNA, 64 nt, Homo Sapiens
uccaagauuuuuauauguucacccaagacuuuagagaaauuagggcgccacucaaguucuuuua

SEQ ID NO: 45147 - RNA, 64 nt, Homo Sapiens
uuauuaaaaggaagcagaagauguauaauaaucaagaaauuaguucaaguggggaauaauaaua

SEQ ID NO: 45148 - RNA, 64 nt, Homo Sapiens
gggaaaugauuacauuuagaacugcccuguugagagaaauuagguacaaaaagguuuuagaauc

SEQ ID NO: 45149 - RNA, 64 nt, Homo Sapiens
aaguagugcauacccuucuaagguuugagguuuuagaaauuagcuuuaagaugggggaaaauua

SEQ ID NO: 45150 - RNA, 64 nt, Homo Sapiens
gucccugaguagcaagauuaggccucaccaaagaagaaauuaaccugcacuuucaaaaaguacc

SEQ ID NO: 45151 - RNA, 64 nt, Homo Sapiens
uccuuuuuccuaguauaauacauuguuuucaaccagaaauuaaaguagauauccaacauuauuu

SEQ ID NO: 45152 - RNA, 64 nt, Homo Sapiens
uuaugaccuuucaacuauagguaauaacucuuagagaaauuaauuuaauauuagaauuucuauu

SEQ ID NO: 45153 - RNA, 64 nt, Homo Sapiens
ggucauguaaaauauuagacacuaauauuuucauagaaauuaggcuggagaaagaaggaagaaa

SEQ ID NO: 45154 - RNA, 64 nt, Homo Sapiens
auaguauacuaucuacacucugcucaacaagcucagaaauuaaauauuuuuaauaauaaaaauc

SEQ ID NO: 45155 - RNA, 64 nt, Homo Sapiens
aagcuuaaacccaaaaauuguucauccauauauaagaaauuaucgaauuaaaacuuaauguaug

SEQ ID NO: 45156 - RNA, 64 nt, Homo Sapiens
aaaggccaugaaauagaaaagaagccucccuuucagaaauuaagaauugcuaaagaaggccuau

SEQ ID NO: 45157 - RNA, 64 nt, Homo Sapiens
aaaagccaggaaugaguuacuucaaccaccugugagaaauuagaccucuguuuucagucacugc

SEQ ID NO: 45158 - RNA, 64 nt, Homo Sapiens
ggaccagcuuguuacagauuuuggacuguaguuuagaaauuacacuauuacuuaaauguuuuaa

SEQ ID NO: 45159 - RNA, 64 nt, Homo Sapiens
ugcuuauuuaugaaucuaauaaauugugaugaaaagaaauuaacccguaggaugaauuagaaau

SEQ ID NO: 45160 - RNA, 64 nt, Homo Sapiens
aagcgucuuuggugcuugggagaccaagaaaccaagaaauuaacaacugaaagcauuuuaaugg

SEQ ID NO: 45161 - RNA, 64 nt, Homo Sapiens
gauuaacuacugacaugacuuggcuuucucauccagaaauuauggaaacagggucugucagugg

SEQ ID NO: 45162 - RNA, 64 nt, Homo Sapiens
ggcaguucugcaagauguacuaaauauguauauuagaaauuauagaaaaucauguuguccguuu

SEQ ID NO: 45163 - RNA, 64 nt, Homo Sapiens
augcaaaauacaguugucauuaauccugcacauuagaaauuauuagaaacauauuacuuuuuaa

SEQ ID NO: 45164 - RNA, 64 nt, Homo Sapiens
aaaaaaaaaaaaaaaaaagugaugaaucaaaauuagaaauuaagaguuuuaagaaaacaugugg

SEQ ID NO: 45165 - RNA, 64 nt, Homo Sapiens
ggaaaaacaggaaaagaauucacuuuuuaaaugaagaaauuagugaaaaaauugaccuaaugaa

SEQ ID NO: 45166 - RNA, 64 nt, Homo Sapiens
augugaaguauucaugagaauauuuaagauacauagaaauuaugaauaggaagaaaagaggaua

SEQ ID NO: 45167 - RNA, 64 nt, Homo Sapiens
cauaacagucucaucuacgguuuacaguuuuccaagaaauuaaguuuuuaaccugugaaauuuc

SEQ ID NO: 45168 - RNA, 64 nt, Homo Sapiens
uuuaauuaacuuaaugagcauuugaagcacuuugagaaauuaaugagucagauuuaauuuguuu

SEQ ID NO: 45169 - RNA, 64 nt, Homo Sapiens
agaacuuaccaggaagguuuaaauuuuugucauaagaaauuaaaaaauauuuguguguugugag

SEQ ID NO: 45170 - RNA, 64 nt, Homo Sapiens
cugacuguacuuacgcugcacugucgguguuaagagaaauuacucucacaagagcagaggccug

SEQ ID NO: 45171 - RNA, 64 nt, Homo Sapiens
aucaagaacuuuaucaguaugcuuuguugaaagcagaaauuaagauaauaauugaguucaauuc

SEQ ID NO: 45172 - RNA, 64 nt, Homo Sapiens
uuuuacuugcauuguaucuuauacuaaaggcuuuagaaauuacaacauaucagguuccccuacu

SEQ ID NO: 45173 - RNA, 64 nt, Homo Sapiens
aucuacacauuagcauugucucuagagcuaagacagaaauuaaccccguucagucacaaagcag

SEQ ID NO: 45174 - RNA, 64 nt, Homo Sapiens
agauugccaauacucauguguaucugauaugcugagaaauuauuguagaggaaaaucaaugcuu

SEQ ID NO: 45175 - RNA, 64 nt, Homo Sapiens
cguacauacacacauacauagaaugcugagcugaagaaauuauaucuauagcaguguucucucu

SEQ ID NO: 45176 - RNA, 64 nt, Homo Sapiens
gguauauuuguagauaccgaagucuucauaccccagaaauuauuucuagccauguagugcucuc

SEQ ID NO: 45177 - RNA, 64 nt, Homo Sapiens
ugguaaauuagaagcuacaauaauaauuaagggcagaaauuauacuuaaaaagugcagauccuu

SEQ ID NO: 45178 - RNA, 64 nt, Homo Sapiens
guauuauuugauuucggauugaaugaauguaaauagaaauuaaaugcaaauuugaaugaacaua

SEQ ID NO: 45179 - RNA, 64 nt, Homo Sapiens
auauccauguaugucaaauacacaucacacacacagaaauuaguugucuggccugacacagcau

SEQ ID NO: 45180 - RNA, 64 nt, Homo Sapiens
gguccaauugagauuggguguugugugugugugcagaaauuaaguagcaugcuaaaauaaauuu

SEQ ID NO: 45181 - RNA, 64 nt, Homo Sapiens
ucuacugaaaaauuuacauuuaaauaugcaaguuagaaauuaagcuugaguacaguugaauuau

SEQ ID NO: 45182 - RNA, 64 nt, Homo Sapiens
uuaucaaagggcugaguugacagugaacaagcugagaaauuauuucagauucauuucaaaagga

SEQ ID NO: 45183 - RNA, 64 nt, Homo Sapiens
cuuugaaaugaucuacugaaauaccuaaauugauagaaauuaaucauacucaaucuaggacaug

SEQ ID NO: 45184 - RNA, 64 nt, Homo Sapiens
agccugggcaacacggggagacccugucucuacaagaaauuaaaaauuagccaggcauaguugg

SEQ ID NO: 45185 - RNA, 64 nt, Homo Sapiens
aaaguauuaauuuggggaacuaaagacaggcauaagaaauuauauuuauguuuagagauugcag

SEQ ID NO: 45186 - RNA, 64 nt, Homo Sapiens
uuaauuuuaaaucaaugaggagaccaaauggcuuagaaauuaaucaaccauaagagaauaccgc

SEQ ID NO: 45187 - RNA, 64 nt, Homo Sapiens
caccuaggaauuuaauauugaaauguggcuuaaaagaaauuaacaauuaauuagaaacuaucaa

SEQ ID NO: 45188 - RNA, 64 nt, Homo Sapiens
aaacauaauuuauucuagguuccugucaccucucagaaauuauuauaauaaauguagaaaugcc

SEQ ID NO: 45189 - RNA, 64 nt, Homo Sapiens
ccagccuggugacagcgugagacucuuuaaaaaaagaaauuaaaagaguugagacaaacguuuc

SEQ ID NO: 45190 - RNA, 64 nt, Homo Sapiens
ggaaaaauguaacuaggaagaaaaacccaauuuaagaaauuacauaaugcuuuccaaaggcacc

SEQ ID NO: 45191 - RNA, 64 nt, Homo Sapiens
ucuguguuuuucagauuucauuuuuuguaaaaucagaaauuaaucuaaacauauucagugauaa

SEQ ID NO: 45192 - RNA, 64 nt, Homo Sapiens
uauuucauggucaguuuauuuuguaagagacagaagaaauuauaucuauacauuaccuuguagc

SEQ ID NO: 45193 - RNA, 64 nt, Homo Sapiens
cguuucucgaaagcuguucuugaugccuguauauagaaauuaagaaaaucauaaaauauugagc

SEQ ID NO: 45194 - RNA, 64 nt, Homo Sapiens
ugugucauguggucuucugauuccuuuugaguagagaaauuauguguguauacuuuacgcaucu

SEQ ID NO: 45195 - RNA, 64 nt, Homo Sapiens
ucugaauaaagaauucuuccuuugagaauguaagagaaauuaaaaccuggauuuccuuggcuuc

SEQ ID NO: 45196 - RNA, 64 nt, Homo Sapiens
agauagucaauucuugccuuagauaaagaacuaaagaaauuaagaaugagcaguaaaauagaug

SEQ ID NO: 45197 - RNA, 63 nt, Homo Sapiens
gaguaaaucagauguugaauucuuuugccaagggaauuauagcugcagguucucucucacugc

SEQ ID NO: 45198 - RNA, 63 nt, Homo Sapiens
gcuuugcuuugucuggaagaaagauaaaauagugaauuauaaauaagucaggccgggcguggu

SEQ ID NO: 45199 - RNA, 63 nt, Homo Sapiens
ccuuauuuuuuuccuuugcgagagauguauauagaauuauaguccauagcacaacagguuuau

SEQ ID NO: 45200 - RNA, 63 nt, Homo Sapiens
uuauauucagcccugagugggggggugggggaugaauuauaaaaagguucuuguguauauuug

SEQ ID NO: 45201 - RNA, 63 nt, Homo Sapiens
gaggaacauguagcgucuacacaggaaaguaaagaauuauagaauuaacuaauucuacuugaa

SEQ ID NO: 45202 - RNA, 63 nt, Homo Sapiens
cucuguguggcacauaggaaaaugugagaccuagaauuauagcaacuuuuuuuuucuguuaaa

SEQ ID NO: 45203 - RNA, 63 nt, Homo Sapiens
ucaauaaaguuguuaguaaauuauaugguaugugaauuauaucguauauuuuaagugggugaa

SEQ ID NO: 45204 - RNA, 63 nt, Homo Sapiens
guaugugaauuauaucucaaauuuuaagugggugaauuauauguaaaaaccauugaguuguau

SEQ ID NO: 45205 - RNA, 63 nt, Homo Sapiens
auaugacauaagcaaucauuuuaugcuguuuaugaauuauaaauguguuuauagcucauuugu

SEQ ID NO: 45206 - RNA, 63 nt, Homo Sapiens
aggugcauauuaauuuucuugguucuuucagcugaauuauauugguccagaaguucaaaauca

SEQ ID NO: 45207 - RNA, 63 nt, Homo Sapiens
aaaaaaaaagauaaagguuguacgguggucuuugaauuauaugucuaauucuauguguuuugu

SEQ ID NO: 45208 - RNA, 63 nt, Homo Sapiens
uaaauauuaugugaaaucaaagcgccauauguagaauuauaucuucaggacuauuucacuaau

SEQ ID NO: 45209 - RNA, 63 nt, Homo Sapiens
accuaacagucagaggucaguaucucagcgugugaauuauagaggaaauacagagagaaccuc

SEQ ID NO: 45210 - RNA, 63 nt, Homo Sapiens
uuucaguagcuuuaucacaauauucacaauggagaauuauaugacaugguagcagaaauaggc

SEQ ID NO: 45211 - RNA, 63 nt, Homo Sapiens
uaaaaaaaccaacagcagcacaggauguauuaagaauuauaugaagucagguuuguuuuuuuu

SEQ ID NO: 45212 - RNA, 63 nt, Homo Sapiens
aauaaccuuuaaaggguuguuuuguuuuguuuugaauuauaggaguuauaaucuuuggagaug

SEQ ID NO: 45213 - RNA, 63 nt, Homo Sapiens
gaugcauccaauccuaaaacuuacauuccaaaggaauuauaucauuauguuccuaaggaguaa

SEQ ID NO: 45214 - RNA, 63 nt, Homo Sapiens
uguguuuuauucagguuguguaaugcucccguagaauuauagaacaauuaaauaugguuaguu

SEQ ID NO: 45215 - RNA, 63 nt, Homo Sapiens
aaaagggaugcuuuuauauauggaaaaaauauggaauuauauauaucuugauucuauguuguc

SEQ ID NO: 45216 - RNA, 63 nt, Homo Sapiens
gaucuacaguuguaucuugaaauauuaaguuuagaauuauaauauuuucauguuugaaguucu

SEQ ID NO: 45217 - RNA, 63 nt, Homo Sapiens
agcuacuuuuuauaaagccacucuucauuuugugaauuauagaauacucaaauuauaauaaaa

SEQ ID NO: 45218 - RNA, 63 nt, Homo Sapiens
ccacuggcauuuuaguguauagauguuuugaaugaauuauaguucuuugggaaggaacacuaa

SEQ ID NO: 45219 - RNA, 63 nt, Homo Sapiens
uguuugaaucaaggcaacucugugauaacuugagaauuauacuuaaauuuuugugggaaauuu

SEQ ID NO: 45220 - RNA, 63 nt, Homo Sapiens
aaaaugauacaugagaaauauagugaaaccauggaauuauaugcuuauuguaacauauaauau

SEQ ID NO: 45221 - RNA, 63 nt, Homo Sapiens
caccucucuaaagaaucuuuaguuuccgacguugaauuauagaccaguuugaguaaguacugc

SEQ ID NO: 45222 - RNA, 63 nt, Homo Sapiens
acagcagugcaguccagagguuaagauguauuagaauuauacaauaucaguuuaaaaaucugu

SEQ ID NO: 45223 - RNA, 63 nt, Homo Sapiens
gaaucagaaaucccccuucucagaggcaacacagaauuauaagcucacccaagcucucccuua

SEQ ID NO: 45224 - RNA, 63 nt, Homo Sapiens
auuuccucugcauaauugaauuuucaaauaaaggaauuauauuucucugagguucaguaucau

SEQ ID NO: 45225 - RNA, 63 nt, Homo Sapiens
ugccauauuccaagucacauuauuuuaccaauggaauuauagaauuaacaguauuuuaaauua

SEQ ID NO: 45226 - RNA, 63 nt, Homo Sapiens
cagauauagugaacacuggaaagauuuauuaaagaauuauauuuguguauacuuuauaaauua

SEQ ID NO: 45227 - RNA, 63 nt, Homo Sapiens
acaacagaaaugcuccuggaacuucaaguugcugaauuauaaguuuauuuuuuaucaauaaau

SEQ ID NO: 45228 - RNA, 63 nt, Homo Sapiens
uauauuuuuacauaaaagcuugaacauacagaugaauuauaaccuaugugaagaaaucuuaga

SEQ ID NO: 45229 - RNA, 63 nt, Homo Sapiens
uagauauaaauaauucuaaacuuaaaaucacuagaauuauagcuuaaauauuaugaaauguac

SEQ ID NO: 45230 - RNA, 63 nt, Homo Sapiens
uuaaauuuugacuguacuaacuauaaauguaaugaauuauaauaauuauaaaugguauaaaug

SEQ ID NO: 45231 - RNA, 64 nt, Homo Sapiens
gcaugugugcaugugcugugugagagcaucucaggaggggcagcacccuacccuggcagggacc

SEQ ID NO: 45232 - RNA, 64 nt, Homo Sapiens
ucuaguguuccugcaccaaauggaggcagggggugaggggcagggcaguucagaauggcagucc

SEQ ID NO: 45233 - RNA, 64 nt, Homo Sapiens
cuugucugugaguuugaagcagcuuuauacagaggaggggcacagaccaugcagucagaggggc

SEQ ID NO: 45234 - RNA, 64 nt, Homo Sapiens
uuuauacagaggaggggcacggaccaugcagucagaggggcagccaugguugacacccuccuuu

SEQ ID NO: 45235 - RNA, 64 nt, Homo Sapiens
guuaaacauuagccacaauggugccuugcugaaggaggggcagauaagggcugcuggggcuaaa

SEQ ID NO: 45236 - RNA, 64 nt, Homo Sapiens
agagccaaccagaggguucccaguggcccucuaggaggggcagacccacucaacacaccuaagc

SEQ ID NO: 45237 - RNA, 64 nt, Homo Sapiens
uuaaguuuggggaggguagacuggcuggaggagugaggggcagcugggcucagaaaaaggaggg

SEQ ID NO: 45238 - RNA, 64 nt, Homo Sapiens
uagagggagaacagggguggcccagacauguauagaggggcaguuaagaagucuuaggcagcag

SEQ ID NO: 45239 - RNA, 64 nt, Homo Sapiens
uugguucaugccugggguggaggaagggaggccugaggggcagaccccacucugcugaggccag

SEQ ID NO: 45240 - RNA, 64 nt, Homo Sapiens
ccuuuuugagccaaucccacgugccaugguguuggaggggcaggaaaacagcgggagugugggg

SEQ ID NO: 45241 - RNA, 64 nt, Homo Sapiens
gccguagacucacggcugcagcagccggggagcugaggggcagggccuggggacggagcacugu

SEQ ID NO: 45242 - RNA, 64 nt, Homo Sapiens
cugcaaagcacagggccaccgccacagcccggcagaggggcacacucuggagaccuugcuggca

SEQ ID NO: 45243 - RNA, 64 nt, Homo Sapiens
guucucccacugcccugucugcucugcugcuacagaggggcagggccucccccagcccacgcuu

SEQ ID NO: 45244 - RNA, 64 nt, Homo Sapiens
cuccuaaauugcuggaugacuuaguuaaggugaggaggggcacauuuaagcuuuaugugaaagc

SEQ ID NO: 45245 - RNA, 64 nt, Homo Sapiens
aggaaccaugaucaggcuuuaaauuguuuuggaggaggggcaaaauccgacuaccagaaaaaaa

SEQ ID NO: 45246 - RNA, 64 nt, Homo Sapiens
ccugcugcuucaggguuuuuccccggcggguugggaggggcaggaggugggguggaaauagggu

SEQ ID NO: 45247 - RNA, 64 nt, Homo Sapiens
ucccugccccucaccccagagggugaggaggaaugaggggcauuggugguuaggccgguuggcu

SEQ ID NO: 45248 - RNA, 64 nt, Homo Sapiens
cugcuggagccgcccucugacugcugcugcuggggaggggcaggcgcacuagggacgucccucc

SEQ ID NO: 45249 - RNA, 64 nt, Homo Sapiens
ugccccccgcccuccccaucggaaggugaguggagaggggcaccgagguggguggggccuucug

SEQ ID NO: 45250 - RNA, 64 nt, Homo Sapiens
aagggccucuuugacaagguaggagcugugcuuggaggggcaggaaaagaacugagcaugucgc

SEQ ID NO: 45251 - RNA, 64 nt, Homo Sapiens
gccugaucgcugugggggcaggggccuggaguacgaggggcacccugggggcucccacccagaa

SEQ ID NO: 45252 - RNA, 64 nt, Homo Sapiens
uaagauggagaaaucaguuguucuuguccccuuugaggggcacuauuaaacuucuuuugccccc

SEQ ID NO: 45253 - RNA, 64 nt, Homo Sapiens
ucuaccuccucugucccucgugcugcaauucuuagaggggcaguuccccgauuccuuguagagc

SEQ ID NO: 45254 - RNA, 64 nt, Homo Sapiens
acaacagggucaagggugcagaaacagcagggaagaggggcaauaucugugcccugggaaggga

SEQ ID NO: 45255 - RNA, 64 nt, Homo Sapiens
uuaaagggaugacugugcauguuccugaaacuuggaggggcaugcaggcuggaggugacgauga

SEQ ID NO: 45256 - RNA, 64 nt, Homo Sapiens
uuggcuuccgccugugcuagacccuacagagccugaggggcaccgcccgggcccuuccuccaag

SEQ ID NO: 45257 - RNA, 64 nt, Homo Sapiens
uuugcucuuuuguacauuuuggccgucccgccgagaggggcagugaagccuuucuguaacaugc

SEQ ID NO: 45258 - RNA, 64 nt, Homo Sapiens
uucagggcagugucuccaugaggguuuuccuguugaggggcaccacauacaauagugugaagua

SEQ ID NO: 45259 - RNA, 64 nt, Homo Sapiens
aggggcaccacauacaauagugugaaguagguaugaggggcagucauuguauucuauaguuuuu

SEQ ID NO: 45260 - RNA, 64 nt, Homo Sapiens
cuaggccccagaggcccuggacacguggccucgugaggggcaaguccgcuuugaaagaagcaag

SEQ ID NO: 45261 - RNA, 64 nt, Homo Sapiens
gaaggacaggacccucaggagcucccuucaagacgaggggcaggguuucccugcugaaugccuc

SEQ ID NO: 45262 - RNA, 64 nt, Homo Sapiens
ggccaucagaacugcccggccacagggcuugggcgaggggcagagcccacuuugaggagggagg

SEQ ID NO: 45263 - RNA, 64 nt, Homo Sapiens
gcagggcgcagagcacacccggagccgggacccagaggggcagcggccuccucccaguagccac

SEQ ID NO: 45264 - RNA, 64 nt, Homo Sapiens
gccccggccccagccagaguuccugcggagugaagaggggcagcccuugcuuguugggauuccu

SEQ ID NO: 45265 - RNA, 64 nt, Homo Sapiens
gccaggcgggcucaaggaaagggggucccagugggaggggcaggcugacaucuguguuucaagu

SEQ ID NO: 45266 - RNA, 64 nt, Homo Sapiens
uauuaaacuuugaagcaacugugaauucauucuggaggggcaguggagaucaggagugacagau

SEQ ID NO: 45267 - RNA, 64 nt, Homo Sapiens
aacacaccuuggagaaguggcaucagucaacagagaggggcagggaaggagacaccaagcucac

SEQ ID NO: 45268 - RNA, 64 nt, Homo Sapiens
gcuaagagggaaggcccagguuugagagagcccagaggggcagagcccagagccuuguuuggcc

SEQ ID NO: 45269 - RNA, 64 nt, Homo Sapiens
agggaauucuugauuuaggguggcugguggcaaggaggggcaggggauauggggacgugacugg

SEQ ID NO: 45270 - RNA, 64 nt, Homo Sapiens
ccuucucuccugggcagccacaccacagagcggggaggggcaggugggggaauggaggcugcag

SEQ ID NO: 45271 - RNA, 64 nt, Homo Sapiens
uggaaggaaguuuagaccugcccagguguggagcgaggggcacaggggcauccuaaccucagaa

SEQ ID NO: 45272 - RNA, 64 nt, Homo Sapiens
uccucagcgugcagcccuagaggaccccagggcugaggggcaguggauccugcgggagucuccc

SEQ ID NO: 45273 - RNA, 64 nt, Homo Sapiens
gggugggggcugcuccuuucccaagugguguugugaggggcaaugagggcaacaggagaugugg

SEQ ID NO: 45274 - RNA, 64 nt, Homo Sapiens
gucacgagaacuuucgucccccaaucgagagcccgaggggcaccccagccccgccucugcuccc

SEQ ID NO: 45275 - RNA, 64 nt, Homo Sapiens
ggugagagaucaccuucccugucugggggauggggaggggcaaagugcugggaacggcaaggcg

SEQ ID NO: 45276 - RNA, 64 nt, Homo Sapiens
uucugagguugccaaaggccguuuccugggcagggaggggcagcgaagggaaaugagggcuuua

SEQ ID NO: 45277 - RNA, 64 nt, Homo Sapiens
ccagagucuuggacucauggaaauagaaugaauagaggggcauucacaaggcacaccagugcaa

SEQ ID NO: 45278 - RNA, 64 nt, Homo Sapiens
uaucccuacccacaacccugggaaguuggagcaagaggggcauacuauugggcugggaggauuu

SEQ ID NO: 45279 - RNA, 64 nt, Homo Sapiens
gucauugccauccauauuugggagccacuggguggaggggcagggaggcaaaaugagacaagua

SEQ ID NO: 45280 - RNA, 64 nt, Homo Sapiens
ggaggacugaugacacgagcugccauggcgggaggaggggcaguaguuauugauauggugagcc

SEQ ID NO: 45281 - RNA, 64 nt, Homo Sapiens
ugugacacugauaaagccuuuuuuagggaaaauuguuucauaaauugucccugauuuuauuuuc

SEQ ID NO: 45282 - RNA, 64 nt, Homo Sapiens
ugagcacuguugugauaacaaauugguaacaguuguuucauaaauuuagcacuguuaaagcacg

SEQ ID NO: 45283 - RNA, 64 nt, Homo Sapiens
gugagagcagccacagcagcgcagacacaaacugguuucauauguuccugaagacaguaauaau

SEQ ID NO: 45284 - RNA, 64 nt, Homo Sapiens
ugauuaaagcuauaucauucaaguuacaguauguguuucauaagggaaauuaccaguuuagacu

SEQ ID NO: 45285 - RNA, 64 nt, Homo Sapiens
guaaggagcaccaaagcugaggcuggcucagagaucuccagagaagcugcagccugcccuggcc

SEQ ID NO: 45286 - RNA, 64 nt, Homo Sapiens
aaugcugaccccucgucguaugaacugugcauagucuccagagcuucaaaggcaacacaagcuc

SEQ ID NO: 45287 - RNA, 64 nt, Homo Sapiens
ggccaugccgccauauaccuuaacuugaucccuuucuccagacuuuauuuguauuuaaagucau

SEQ ID NO: 45288 - RNA, 64 nt, Homo Sapiens
cagcacagcucauggaggguuuccuggacugcucucuccagaaacugcauuuuccuacaccccu

SEQ ID NO: 45289 - RNA, 64 nt, Homo Sapiens
caccaugcaugcucacagucguauucagagcaccucuccagaugggggccuggaucaguggggu

SEQ ID NO: 45290 - RNA, 64 nt, Homo Sapiens
gaacuugggagaugauggugagaagcagagucauucuccagaagucaaaauagaagaccuugca

SEQ ID NO: 45291 - RNA, 64 nt, Homo Sapiens
aguuuguaagaacaaucauaaaaggacuuguuagucuccagaacaucugcuaaaaugcaaguau

SEQ ID NO: 45292 - RNA, 64 nt, Homo Sapiens
agauuguuuaacaguauguguggugaugucauuaucuccagagaggcuucaagaaauccuuugg

SEQ ID NO: 45293 - RNA, 64 nt, Homo Sapiens
acacuuugagauacuuaaagguaguaaaaagauuucuccagaaaggaauaucaaguauaaugau

SEQ ID NO: 45294 - RNA, 64 nt, Homo Sapiens
ccuucuggcugauuguuccguugugcuuccucuuucuccagaaggguaguucuguucugugggu

SEQ ID NO: 45295 - RNA, 64 nt, Homo Sapiens
uggcacacccugccuguuuucuggacuggcccagucuccagagccucugcccugagccaccacc

SEQ ID NO: 45296 - RNA, 64 nt, Homo Sapiens
guuccagagaaggugcggggacccugaccuugcaucuccagacuaagggugaaccaggccuucc

SEQ ID NO: 45297 - RNA, 64 nt, Homo Sapiens
ccugcauugaauugaauaugaauuucucuaacucucuccagaaaauggauggagauaacuuguc

SEQ ID NO: 45298 - RNA, 64 nt, Homo Sapiens
ugugagauucuuuagccacuuuggggagccugucucuccagaagccuuucuuaguggugcccac

SEQ ID NO: 45299 - RNA, 64 nt, Homo Sapiens
ggugggccagggcgggcuggggcaggaggugcggucuccagaguccccgggccagcacuuggca

SEQ ID NO: 45300 - RNA, 64 nt, Homo Sapiens
cucacagcagccacgcccccagugugcugguuagucuccagaccgcggcugggcuggugcaggg

SEQ ID NO: 45301 - RNA, 64 nt, Homo Sapiens
ugacaacuuguugguaguuaggcacccaugaaugucuccagagacauccugagaggcaagauuc

SEQ ID NO: 45302 - RNA, 64 nt, Homo Sapiens
gcaaccuucauaccuuuaucuggaaaaugccuucucuccagacaauaagacaguucacaucugg

SEQ ID NO: 45303 - RNA, 64 nt, Homo Sapiens
ggggagugcguggugucagaucccauccugcuccucuccagaguuuccggucaccuccguguuc

SEQ ID NO: 45304 - RNA, 64 nt, Homo Sapiens
ggggagugcguggugucagaucccauccugcuccucuccagaguuuccucucaccuccguguuc

SEQ ID NO: 45305 - RNA, 64 nt, Homo Sapiens
uaccgaguucaucuguggguaggucaagacaggaucuccagagcaaaggguuuucaggaugagg

SEQ ID NO: 45306 - RNA, 64 nt, Homo Sapiens
caccugaggccccagagcuucaucuuuguuugcaucuccagagacccagaccccaccugaucug

SEQ ID NO: 45307 - RNA, 64 nt, Homo Sapiens
cgucagaauggaauacacagaaagguuagucugaucuccagaccucaguuccucuccuaaagac

SEQ ID NO: 45308 - RNA, 64 nt, Homo Sapiens
agaccuggaguccucuucaacaccuuuacgacccucuccagaccccagcacaaacucucccuuc

SEQ ID NO: 45309 - RNA, 64 nt, Homo Sapiens
ccauccuaucccuugacauacuuaaucauauaucucuccagagaacucaccugacaaaugucuc

SEQ ID NO: 45310 - RNA, 64 nt, Homo Sapiens
guuuuguguuuuuugguggguuucuuuccuuggcucuccagauuuacuuuuggggccuguucua

SEQ ID NO: 45311 - RNA, 64 nt, Homo Sapiens
cagccccaucuccucagcacccccaacagcacccucuccagaugccucuccagaugagaguaca

SEQ ID NO: 45312 - RNA, 64 nt, Homo Sapiens
agaguacaccccaacagcacccccaacagcacccucuccagaugccucuccagaugagaguaca

SEQ ID NO: 45313 - RNA, 64 nt, Homo Sapiens; identical to SEQ ID NO: 45312

SEQ ID NO: 45314 - RNA, 64 nt, Homo Sapiens
agaguacaccccaacagcacccccaacagcacccucuccagaugcccucuccagaugggagugc

SEQ ID NO: 45315 - RNA, 64 nt, Homo Sapiens
ggagugcccccaacagcaccccccaacagcacccucuccagaugccugccuucccaggaguaca

SEQ ID NO: 45316 - RNA, 64 nt, Homo Sapiens
ccugacuuaagagaguaagauguugggacagccaucuccagaaaguagacaggcuggauuccag

SEQ ID NO: 45317 - RNA, 64 nt, Homo Sapiens
ggcuggaaaggaugcugccaucagcugcugacugucuccagaagaugcugguucccggaaugaa

SEQ ID NO: 45318 - RNA, 64 nt, Homo Sapiens
gaaaaaggucaagauuucuaucacuuccccgucuucuccagaacuugugucuccagaggaguac

SEQ ID NO: 45319 - RNA, 64 nt, Homo Sapiens
uucuaucacuuccccgucuucuccagaacuugugucuccagaggaguacgccgacuucagcagc

SEQ ID NO: 45320 - RNA, 64 nt, Homo Sapiens
uauuuacuuugagacuaaagacugaagaauaaucuaaauucauacucagacaaaaaaaggaauu

SEQ ID NO: 45321 - RNA, 64 nt, Homo Sapiens
gucucaggacaaaaggaggcucuucucauucagcuaaauucacauuugccccccccccccgccc

SEQ ID NO: 45322 - RNA, 64 nt, Homo Sapiens
aucuccccuuccacccucacgugaaagagaagccuaaauucagcgucuagaugugaggcuuuuu

SEQ ID NO: 45323 - RNA, 64 nt, Homo Sapiens
uuuucuggcccugaacucauacauaguugaagcuuaaauucaagaaaucacaaacuaguaagag

SEQ ID NO: 45324 - RNA, 64 nt, Homo Sapiens
acugguaccuuauuauugagguaguuuaaaugaguaaauucagcgaaugcaggcaguauuuagg

SEQ ID NO: 45325 - RNA, 64 nt, Homo Sapiens
ucacacauuaauuuuaucuccucuucaaaaugcuuaaauucauugcaaugaccucauaaaauac

SEQ ID NO: 45326 - RNA, 64 nt, Homo Sapiens
ggguagaaucaccuguaaaauaauuugaaauuucuaaauucauauaaaaucagcaaugaaacaa

SEQ ID NO: 45327 - RNA, 64 nt, Homo Sapiens
ccacauuaaucuguaucccauugucuggcuuuuguaaauucauccaggucaagacuaaguaugu

SEQ ID NO: 45328 - RNA, 64 nt, Homo Sapiens
uuuaagccaaggagcugaaauauaucucaguuuauaaauucagguauauucuuuuugucuccau

SEQ ID NO: 45329 - RNA, 64 nt, Homo Sapiens
accagucccauuuguaaauauuuacguaccuuuauaaauucaguugcaucuguggcaaaauuuc

SEQ ID NO: 45330 - RNA, 64 nt, Homo Sapiens
uaguccaacucacaguccacuagcuucacuccuuuaaauucacuuugaaacaggccucauccca

SEQ ID NO: 45331 - RNA, 64 nt, Homo Sapiens
ucucugauuguccucagccuccacuuccccagaguaaauucaaauugaaucgagcucugcugcu

SEQ ID NO: 45332 - RNA, 64 nt, Homo Sapiens
guuaagacaaggucaugcuggaugaagguagaccuaaauucaauaugacugguuuccuuguaug

SEQ ID NO: 45333 - RNA, 64 nt, Homo Sapiens
ucucuuuaacuuacagaauguuaguuuaaaauaauaaauucauccuuuuuuuggagaugauuaa

SEQ ID NO: 45334 - RNA, 64 nt, Homo Sapiens
auaacuugauguuucauuuucuguugaggaaccauaaauucauucacagacuuaauauuuuuuu

SEQ ID NO: 45335 - RNA, 64 nt, Homo Sapiens
ccugcacuuucuuuagaugcuuccauuuacaaaauaaauucagcaauaauuaaaccuguacaua

SEQ ID NO: 45336 - RNA, 64 nt, Homo Sapiens
auaaacuauuuauuaacuaacaagucugguguuuuaaauucauugccaaaagcugaaauuuuag

SEQ ID NO: 45337 - RNA, 64 nt, Homo Sapiens
aauauuucuaaaaccuuaaacuauuguuuaauaauaaauucaaaauauucuguacaguacguuc

SEQ ID NO: 45338 - RNA, 64 nt, Homo Sapiens
gaaaaugugaauucuauuauuugaugauaaacuauaaauucauuucuuaauucauuuacucuau

SEQ ID NO: 45339 - RNA, 64 nt, Homo Sapiens
uuaagucagauuuuuauuuaugagucuuugagacuaaauucaaucaccaccagguaucaaauca

SEQ ID NO: 45340 - RNA, 64 nt, Homo Sapiens
cagcaaauauaugauucuagugucugacuuuuguuaaauucaguaaugcaguuuuuaaaaaccu

SEQ ID NO: 45341 - RNA, 64 nt, Homo Sapiens
uuauuacaagggaccuugaacauguuuuguauguuaaauucaaaaguaaugcuucaaucagaua

SEQ ID NO: 45342 - RNA, 64 nt, Homo Sapiens
cuuuguuucuuucauaugaaaaaaaugcauuuuauaaauucagaaagucauagauuucugaagg

SEQ ID NO: 45343 - RNA, 64 nt, Homo Sapiens
guguaacacagcucuuuuccagaggcugacaaccuaaauucaugcaguguuauaaauucaacau

SEQ ID NO: 45344 - RNA, 64 nt, Homo Sapiens
auagaggcugacaaccuaaaaugcuucaguguuauaaauucaacgcauuauuaggcuauuucug

SEQ ID NO: 45345 - RNA, 64 nt, Homo Sapiens
auuucuaaaccauguauauggaauagaauugguauaaauucauagaaagaaccauguggaaaug

SEQ ID NO: 45346 - RNA, 64 nt, Homo Sapiens
aucauguuuuugugauacaucuguuugccuuuuuuaaauucagcuguacaucaugcauucuuuu

SEQ ID NO: 45347 - RNA, 64 nt, Homo Sapiens
ugccauuuauuguuaaagauuuauuuuuacaaaguaaauucaggguuuuagauguguacacagc

SEQ ID NO: 45348 - RNA, 64 nt, Homo Sapiens
aaaauguuuguuuuucacuggauucugaauauaauaaauucaaaguacccuuuuuuuagaguuu

SEQ ID NO: 45349 - RNA, 64 nt, Homo Sapiens
ucaauaaaaagaggagacuguuaauguguacuuauaaauucacauugucaguauuuuuuaauau

SEQ ID NO: 45350 - RNA, 64 nt, Homo Sapiens
uaaaguugauccuuuguauauuuccuuauucaaauaaauucagucaucuucuuaucagguugcu

SEQ ID NO: 45351 - RNA, 64 nt, Homo Sapiens
cgaugcuugucuccugauccuuauucuuuaagucuaaauucagucuuuucaaaacaaaucacaa

SEQ ID NO: 45352 - RNA, 64 nt, Homo Sapiens
uggcgucugugagaccucaauguaauaagaaaauuaaauucagcuucaggccuuuaaacugcag

SEQ ID NO: 45353 - RNA, 64 nt, Homo Sapiens
uuuuccuaggcgcaauuuccuuaaacguacaguuuaaauucaaggcuggaccacucaguuauua

SEQ ID NO: 45354 - RNA, 64 nt, Homo Sapiens
ugaaauaucacuucucccugaucugcagugaguauaaauucacuugucaccucagugcuuuaca

SEQ ID NO: 45355 - RNA, 64 nt, Homo Sapiens
aaaccugccacuacauucugaugaucugaggauuuaaauucacaguaaauucagcucaaauugc

SEQ ID NO: 45356 - RNA, 64 nt, Homo Sapiens
ucaaauugcaugaucugagguuuacuacagcauguaaauucagcuuaaggaauuuauuucuccc

SEQ ID NO: 45357 - RNA, 64 nt, Homo Sapiens
uucuuaagauauggaccuuuucauugauaagcccuaaauucaaauccaccccuguauuucaaga

SEQ ID NO: 45358 - RNA, 64 nt, Homo Sapiens
caaaaaauguuuuacucuuacuuuuaauuaguucuaaauucaacaauuuaaagcuaccauaaug

SEQ ID NO: 45359 - RNA, 64 nt, Homo Sapiens
aucccaggaccuaaaccuuuguaucuuggcauuauaaauucaguugauaauuccaugauacaga

SEQ ID NO: 45360 - RNA, 64 nt, Homo Sapiens
ccagcauuugaaggacugcaacugcaccacagucuaaauucagauuguaccauguuacauguac

SEQ ID NO: 45361 - RNA, 64 nt, Homo Sapiens
uuccauguuuuaucuuuuuucugcuuuugcucaguaaauucaacuagcagcuucaccuggagag

SEQ ID NO: 45362 - RNA, 64 nt, Homo Sapiens
aauauuaauuuaaaaagcagcaggagaaguagcuuaaauucacucacaaaguuuccuagacaca

SEQ ID NO: 45363 - RNA, 64 nt, Homo Sapiens
gcugauuuaauuuauggaaaucuccaaauaugccuagauuuaaacaguguuagaaguuugugau

SEQ ID NO: 45364 - RNA, 64 nt, Homo Sapiens
cagcuuuuaaaucucucuuuauuuuuuuauuguuuagauuuaacuuauaauauuguacauaugg

SEQ ID NO: 45365 - RNA, 64 nt, Homo Sapiens
cauguggacauuuuuauaauuuuucaaccuuuuuuagauuuauguauuguagauuuacuguagg

SEQ ID NO: 45366 - RNA, 64 nt, Homo Sapiens
guagguuuucaaccuuuuuuuaaacacuauauuguagauuuacucacaaaccaguggucaaaug

SEQ ID NO: 45367 - RNA, 64 nt, Homo Sapiens
uuagcuagcaucuaauuugcguuaguggguaacuuagauuuauauuauguuauggcuaaauaca

SEQ ID NO: 45368 - RNA, 64 nt, Homo Sapiens
uaacccagggaaacaucaaugaagcacaaaaaaauagauuuaguuuaccuuuaaacauuuggaa

SEQ ID NO: 45369 - RNA, 64 nt, Homo Sapiens
uuuccaucagugaaaacauucauaaugguuuuguuagauuuauuuguaaaucaguauguuuuua

SEQ ID NO: 45370 - RNA, 64 nt, Homo Sapiens
gaauaugaaguucuaucuaguucaguucuagaaauagauuuaaaauaaaauuuuaaaaagucaa

SEQ ID NO: 45371 - RNA, 64 nt, Homo Sapiens
gagagaguacuauuuuuaagucuuucugucaaauuagauuuaauacuccuuuuucccuuaaacu

SEQ ID NO: 45372 - RNA, 64 nt, Homo Sapiens
cugcuaauuuuuuuuuuuuuuuuucaaauauagauagauuuaaggugguacuugugacuacguu

SEQ ID NO: 45373 - RNA, 64 nt, Homo Sapiens
uuaugcagcaaaaagaagcuauaauucaguccuuuagauuuauuaauggcuguacagguagacc

SEQ ID NO: 45374 - RNA, 64 nt, Homo Sapiens
ccaucucuagguuacaagauacagaaguucagucuagauuuagguuaaagggcuauuucuguag

SEQ ID NO: 45375 - RNA, 64 nt, Homo Sapiens
uuccauugcugcuuauaugcaguguuagccgaauuagauuuacaagacaaucuaagcuuuccgg

SEQ ID NO: 45376 - RNA, 64 nt, Homo Sapiens
aaggauacuuuauugcauuauuguugcagaagcauagauuuaauugcaucuuuauuuugaaaaa

SEQ ID NO: 45377 - RNA, 64 nt, Homo Sapiens
acaguacucaucacucggauugucaguuugcagauagauuuagcauuacagaaacugauuaguu

SEQ ID NO: 45378 - RNA, 64 nt, Homo Sapiens
auaucaagauaugguucaaaaccagcauucuaauuagauuuacuuaaaaugucacaaaacagga

SEQ ID NO: 45379 - RNA, 64 nt, Homo Sapiens
ucgagcucaguggcucacauaauaaaauaaaauuuagauuuaagggagcauggccauaaaauaa

SEQ ID NO: 45380 - RNA, 64 nt, Homo Sapiens
agagggagcauggccauaaaauuuauuuaaaauuuagauuuauuacacaacaauacuuggacuu

SEQ ID NO: 45381 - RNA, 64 nt, Homo Sapiens
cuuagacguuuuauauuuguugcacauccuucaauagauuuauugguuuucaguaaaguguucu

SEQ ID NO: 45382 - RNA, 64 nt, Homo Sapiens
aggaacaucugcacaucuuugcuuucuuguuaaauagauuuaacgacaggaaauugaccuugac

SEQ ID NO: 45383 - RNA, 64 nt, Homo Sapiens
uuauauugucuuuauuuuccauucugacaguguauagauuuaccuuuauuagaauuugugauug

SEQ ID NO: 45384 - RNA, 64 nt, Homo Sapiens
uagaauuaagaguugaaagacuuaucuaguaauguagauuuacaacauuucugaguaccauuau

SEQ ID NO: 45385 - RNA, 64 nt, Homo Sapiens
auuuuguuaagaggauagauacaauuuugcacuguagauuuaacccacaaugcgcauguaguua

SEQ ID NO: 45386 - RNA, 64 nt, Homo Sapiens
uaugaaugauuaguaggaaaggacuuuuugguaauagauuuaaugcaggugaggcaaagugcug

SEQ ID NO: 45387 - RNA, 64 nt, Homo Sapiens
uggcaguauaaauucuggcuauauuuuuuguuguuagauuuauuuggcuguuaaguauugcgau

SEQ ID NO: 45388 - RNA, 64 nt, Homo Sapiens
uauuuguguagaauaaugugggauaccugaauaauagauuuaaaaggaccaagugguaaaauug

SEQ ID NO: 45389 - RNA, 64 nt, Homo Sapiens
agauagaguguggcuucauuuuaauguuagaauuuagauuuaacaacuccaggauucaggaguu

SEQ ID NO: 45390 - RNA, 64 nt, Homo Sapiens
uagucuauaaugaacaugaaguaguaguuagaacuagauuuaaccuuugauuuuugaaguuggg

SEQ ID NO: 45391 - RNA, 64 nt, Homo Sapiens
uuguagaauuuaauuuaaaaaagcuaaaucugcauagauuuaguaaaaucugcucaggagaaag

SEQ ID NO: 45392 - RNA, 64 nt, Homo Sapiens
caagaugaaauaaaaaggccauuuucaaacaacauagauuuacuaaugauaauuggcuuuuuaa

SEQ ID NO: 45393 - RNA, 64 nt, Homo Sapiens
guuaucugaguguaaguaaauuaauguucucauuuagauuuaucucccagugauuucuacucag

SEQ ID NO: 45394 - RNA, 64 nt, Homo Sapiens
ucuuaaauuuugguccaaacugaacauauggaaauagauuuauuguaaguauuuacuuagagcu

SEQ ID NO: 45395 - RNA, 64 nt, Homo Sapiens
uguaaauaccauauuuuugauaaaaauguguaaauagauuuaucaaugaugaguggacaugugg

SEQ ID NO: 45396 - RNA, 64 nt, Homo Sapiens
aaucuauagcagaguuucucuauuuuauauuucauagauuuaaaaaacccaaauaaagauggau

SEQ ID NO: 45397 - RNA, 64 nt, Homo Sapiens
gucccaugugggaugaguuuuuuuguugcuuuuuuagauuuauuaaggaacugggugguuuggu

SEQ ID NO: 45398 - RNA, 64 nt, Homo Sapiens
gaugcuucaguggaaaucaagcaaugccacgauuuagauuuaaucauucagcuuccugcugcua

SEQ ID NO: 45399 - RNA, 64 nt, Homo Sapiens
gcaguucagaauggcaguccuaagccaaacucaggcccagaauuagucccuucagacuggcccu

SEQ ID NO: 45400 - RNA, 64 nt, Homo Sapiens
cacauaaaagccccagcuugggaggucucugggagcccagaaccgacucuggaggucaucuggc

SEQ ID NO: 45401 - RNA, 64 nt, Homo Sapiens
ucucuuggcuucauaaacagccagcugugaucuugcccagaacccagggccugggccuguuucc

SEQ ID NO: 45402 - RNA, 64 nt, Homo Sapiens
accuguauaaaaugaaucuggacuggcagugagagcccagaaggggagauggaucaagcucaga

SEQ ID NO: 45403 - RNA, 64 nt, Homo Sapiens
agucagggucaacucccaggccucagaugcaggggcccagaacaccugcucucaccugagcccc

SEQ ID NO: 45404 - RNA, 64 nt, Homo Sapiens
aacaccugcucucaccugaaccccaggugaaggggcccagaacaccugcucucaccugagcccc

SEQ ID NO: 45405 - RNA, 64 nt, Homo Sapiens
ugagugccuuaaaguuggagaaguaacugcccaugcccagaaauaaggaugccagugcccagaa

SEQ ID NO: 45406 - RNA, 64 nt, Homo Sapiens
guaacugcccaugcccagaaauaaggaugccagugcccagaagcagugagauuagucugugucc

SEQ ID NO: 45407 - RNA, 64 nt, Homo Sapiens
gaaccaugcauaccugcacuacccugcccagaaugcccagaagaaacuguggcuccugcagggc

SEQ ID NO: 45408 - RNA, 64 nt, Homo Sapiens
cccagaagagaaccaugcaucugcagggcacccugcccagaaugacugcaguuaacuguggcuc

SEQ ID NO: 45409 - RNA, 64 nt, Homo Sapiens
cgcucagcucccgcccgacggcagcgccgccgccgcccagaaucccagcccagaaucccgaccg

SEQ ID NO: 45410 - RNA, 64 nt, Homo Sapiens
cccgacggcagcgccgccgccgcccagaaucccagcccagaaucccgaccgccgcgccggacgc

SEQ ID NO: 45411 - RNA, 64 nt, Homo Sapiens
agggaaagggaagcacaugaucaugggaaugauagcccagaacaaaaagaaaucuugucuuacc

SEQ ID NO: 45412 - RNA, 64 nt, Homo Sapiens
uuuuuagaugaccaaaacuugcagggcaggggaugcccagaagaguggugagauaguaaaacac

SEQ ID NO: 45413 - RNA, 64 nt, Homo Sapiens
gcggcaccaggagauggaggaugucaucaggcuggcccagaaggaggaggagaugaagguaggg

SEQ ID NO: 45414 - RNA, 64 nt, Homo Sapiens
caaccaugaggggcauggcaaauuccucaucgcugcccagaacccugcugaugagcccacucca

SEQ ID NO: 45415 - RNA, 64 nt, Homo Sapiens
cugcugaugagccugcuccagauuccuggcagcugcccagaacccugcaacaaguggcauggca

SEQ ID NO: 45416 - RNA, 64 nt, Homo Sapiens
agccagaggcagcagccucaacccgguggccuuggcccagaagggcacugccagcgccugucuu

SEQ ID NO: 45417 - RNA, 64 nt, Homo Sapiens
cucaacuguuccccagcuacuguccuaaugugcugcccagaaaccaaauguuacacuagacaua

SEQ ID NO: 45418 - RNA, 64 nt, Homo Sapiens
aggaacuggcauacugcaaacaggaaggugccuggcccagaauaccauccccagggagguggcc

SEQ ID NO: 45419 - RNA, 64 nt, Homo Sapiens
gacacagacaccggacaaaccauugucuuggggagcccagaagagaaagugggcaggguggggu

SEQ ID NO: 45420 - RNA, 64 nt, Homo Sapiens
aguuaguuaggcauugaguuugcccugggcaaaagcccagaagugggaguaugugguauaucuu

SEQ ID NO: 45421 - RNA, 64 nt, Homo Sapiens
aggaaacugaggucuagagaggucaagauuacuugcccagaaucacucaggcagcuagugauag

SEQ ID NO: 45422 - RNA, 64 nt, Homo Sapiens
ucucacgaagaaucccucacucuucccggguucagcccagaagcccuuccaggcaugaucuucc

SEQ ID NO: 45423 - RNA, 64 nt, Homo Sapiens
guccgcguguugcuggagggacacguguauuggagcccagaagaggggcuguguggccugggaa

SEQ ID NO: 45424 - RNA, 64 nt, Homo Sapiens
gcggcagccaccaccaguguuguuuugaauaaaagcccagaagccuauuuaagaauuucuccgu

SEQ ID NO: 45425 - RNA, 64 nt, Homo Sapiens
ggggccuuuugcuuuugccuaagcaauaugagugacugaagagucuccacagugcucucuggag

SEQ ID NO: 45426 - RNA, 64 nt, Homo Sapiens
gaauauuauauaagauggaggauaaaaguucauuacugaagaugacugggggauuucuuaauua

SEQ ID NO: 45427 - RNA, 64 nt, Homo Sapiens
cccagugaguucugcauuuguuuuagauuuagguacugaagaaucccccuuucagcagcauucu

SEQ ID NO: 45428 - RNA, 64 nt, Homo Sapiens
ccguggccccucggccuucugaggaaggagggaaacugaagacaagacgaauguagccagagag

SEQ ID NO: 45429 - RNA, 64 nt, Homo Sapiens
ugaaugauuaaaucagaaaugggauucuugguaaacugaagacuuuuauuugggaaugaaaaac

SEQ ID NO: 45430 - RNA, 64 nt, Homo Sapiens
uuuuucccaacaaaauuuuguuggggguuauguuacugaagaaugaacagaugaguaaguggag

SEQ ID NO: 45431 - RNA, 64 nt, Homo Sapiens
uuccucagucuuuucuaaucauaagauaauucacacugaagagaaacugcaaacguggaaagug

SEQ ID NO: 45432 - RNA, 64 nt, Homo Sapiens
gcuugucacaucuuacuguauauauauaauuccuacugaagaaauccccuggaaaugcaaaaaa

SEQ ID NO: 45433 - RNA, 64 nt, Homo Sapiens
aaugggaaagaagagggaggcuguuuauggcaguacugaagagauauauaaucuugcuucccgc

SEQ ID NO: 45434 - RNA, 64 nt, Homo Sapiens
guuugauuaaaauaaagugauaagaaguccauauacugaagagccuuuucuaugacacaaguca

SEQ ID NO: 45435 - RNA, 64 nt, Homo Sapiens
cagucaugugaaguauuugucuaaaacagagcaaacugaagaccaaauuauucuccuguugagg

SEQ ID NO: 45436 - RNA, 64 nt, Homo Sapiens
uccuuaggugcucaauaaaggugugcuguauugaacugaagaagugagaaccaagcuuuuuuuu

SEQ ID NO: 45437 - RNA, 64 nt, Homo Sapiens
gaauuucuaguaaaugaaauaccuauacuuugauacugaagacugccaaauacauaggaauuuu

SEQ ID NO: 45438 - RNA, 64 nt, Homo Sapiens
gaauguuuuacuagcacugggugcucaccaugcaacugaagaaaauguggaaacucaaaagguc

SEQ ID NO: 45439 - RNA, 64 nt, Homo Sapiens
uuuagcaggaaaaaagagaacaucaccuuguaaaacugaagauugugaccagucagaauaaugu

SEQ ID NO: 45440 - RNA, 64 nt, Homo Sapiens
gauugugaccagaagauuuugaaaauuaaauauuacugaagauuucgacuuccacuguuaaaug

SEQ ID NO: 45441 - RNA, 64 nt, Homo Sapiens
uuaaagagauacuuaaacagaagggaugaucuuaacugaagaauggugucuagguuucugauaa

SEQ ID NO: 45442 - RNA, 64 nt, Homo Sapiens
agacuuggcuuagaacaaauuuguuugaaggaaaacugaagaaacuaaugggaaaguaaaggua

SEQ ID NO: 45443 - RNA, 64 nt, Homo Sapiens
aaagggggcagaagcaaagaagauacagaucugcacugaagacauuagacuggccauagaaaag

SEQ ID NO: 45444 - RNA, 64 nt, Homo Sapiens
auaucgugccuuaacaauguggcuguccuuuuccacugaagaaggaaagacguuuugaucuaga

SEQ ID NO: 45445 - RNA, 64 nt, Homo Sapiens
guccugaauucuuacuaaacauaagaacauucauacugaagaggaacccuaugagugugaagaa

SEQ ID NO: 45446 - RNA, 64 nt, Homo Sapiens
guugucacacuucauuauagguaagauaguucauacugaagaaaacuucuacaagugugaacag

SEQ ID NO: 45447 - RNA, 64 nt, Homo Sapiens
auuccuauuagcgaaauaguuuuuuaauauaaccacugaagaaaaucuguggugagaggaaaca

SEQ ID NO: 45448 - RNA, 64 nt, Homo Sapiens
gugagaggaaacaucuuaccaucuggucauucauacugaagagaaacuccauaaguaucaucuc

SEQ ID NO: 45449 - RNA, 51 nt, Homo Sapiens
aagaugaugaugauaucugaaauucaccagcugaguuucuauuucuucuau

SEQ ID NO: 45450 - RNA, 64 nt, Homo Sapiens
ccuaugucaguugccaaaucuuuuaaacuuauguauucaccaagcccaaaaauagauuguggcu

SEQ ID NO: 45451 - RNA, 64 nt, Homo Sapiens
ugacauuauucugaucacuggcuccaucauacauauucaccacuugagauucauaacauaucaa

SEQ ID NO: 45452 - RNA, 64 nt, Homo Sapiens
uuaauauguuuagcauuaucuuuauggaauuuauauucaccaauuucaggaaaaccaaccauag

SEQ ID NO: 45453 - RNA, 64 nt, Homo Sapiens
augaugauguaagaggaaagaacauuuuuuugugauucaccagacaucacuuuaaacuugguga

SEQ ID NO: 45454 - RNA, 64 nt, Homo Sapiens
aaaucagcaaagagggaaggcagggccccuguagauucaccaguauaaacuucagcugcaggga

SEQ ID NO: 45455 - RNA, 64 nt, Homo Sapiens
aggacuuaauucuuguuuuucauugccuugcuauauucaccaaauacaggccaaaugaacuaaa

SEQ ID NO: 45456 - RNA, 64 nt, Homo Sapiens
aggacuuacuucuuguuuuucauugccuugcuauauucaccaaacauuauaaaaaugaacuaaa

SEQ ID NO: 45457 - RNA, 64 nt, Homo Sapiens
uuguacauuauuuguuguccgcucuguuguguuuauucaccaaucucgggugggauguuuguug

SEQ ID NO: 45458 - RNA, 64 nt, Homo Sapiens
augauuuuccucucuuugauggaaacucgaggacauucaccacgccgaccacaaaggugucugc

SEQ ID NO: 45459 - RNA, 64 nt, Homo Sapiens
uaagggaacaguuagagcaguggagcugguuguuauucaccaacauguucuguuguuuuuagga

SEQ ID NO: 45460 - RNA, 64 nt, Homo Sapiens
cagacugcagauuggaugaacccacaaaccuuggauucaccaucgaggagagccauuggcgugg

SEQ ID NO: 45461 - RNA, 64 nt, Homo Sapiens
gagaaaggaaaggauagaaucacaggcugcgucugcaccugaaaagugacccgcggaaacucua

SEQ ID NO: 45462 - RNA, 64 nt, Homo Sapiens
agcacaggcaaggggugcuuguggcaguggccgggcaccugagccccagcucguuguuaaacgu

SEQ ID NO: 45463 - RNA, 64 nt, Homo Sapiens
gcagugacauugcuggaccccugaaaaccauuccauaggagaauggguuccccaggcucacagu

SEQ ID NO: 45464 - RNA, 64 nt, Homo Sapiens
uguuauaaaaaaucaguuaucacuauaccaugcuauaggagacugggcaaaaccuguacaauga

SEQ ID NO: 45465 - RNA, 64 nt, Homo Sapiens
cuaauuccaaccuucuaaauugacagaauacuagauaggagagaaaaguacaagcugggcaaac

SEQ ID NO: 45466 - RNA, 64 nt, Homo Sapiens
ucaugcaauuuggagauaaguuuaaguuucagauauaggagacuaggaagucauuagaaucauu

SEQ ID NO: 45467 - RNA, 64 nt, Homo Sapiens
uauuuuuaucauaguaaauguuugaaguguuuuuauaggagaugaccaaaaaaaaaaaaagaua

SEQ ID NO: 45468 - RNA, 64 nt, Homo Sapiens
acaauauauaacacacagaguuauauuugagugaauaggagaaacuguauauuggauuuuguga

SEQ ID NO: 45469 - RNA, 64 nt, Homo Sapiens
cauuauuguuuacuggacauucagagaagacuucauaggagacuggcuguucuucauaggagac

SEQ ID NO: 45470 - RNA, 64 nt, Homo Sapiens
cagagaagacuucauaggagauuggcuguucuucauaggagacuagaccccagguacccacagc

SEQ ID NO: 45471 - RNA, 64 nt, Homo Sapiens
gugaagcagccuuacuauucauagaagggcuagaauaggagaaaaugaaagguagugaguaauu

SEQ ID NO: 45472 - RNA, 64 nt, Homo Sapiens
cuuucuucagcagcgugcaauagcuggcuccucuauaggagaugagcuucauugggaguuccua

SEQ ID NO: 45473 - RNA, 64 nt, Homo Sapiens
aaaguuuucagucacagaucacgccuuaaaagacauaggagaauucauacuggagagaaaccuu

SEQ ID NO: 45474 - RNA, 64 nt, Homo Sapiens
aaggucuucagucaagcuucauccuaugcaaaacauaggagaauucaugcaggagagaaauguc

SEQ ID NO: 45475 - RNA, 64 nt, Homo Sapiens
uuauacaggagagaaaccucauccuaugcaaaacauaggagaauaaggucuucagucaagcuuc

SEQ ID NO: 45476 - RNA, 64 nt, Homo Sapiens
uuauacuggagagaaagcuucacaccuuaaagacauaggagaaucaaaguuuccauuuggaaau

SEQ ID NO: 45477 - RNA, 64 nt, Homo Sapiens
agcagcccacagcuguggggcuucagcagccacaccagcccagcccagcccagcucucgauacg

SEQ ID NO: 45478 - RNA, 64 nt, Homo Sapiens
cccacagcuguggggcuucagcagccacaccagcccagcccagcccagcucucgauacguuugg

SEQ ID NO: 45479 - RNA, 64 nt, Homo Sapiens
agcuguggggcuucagcagccacaccagcccagcccagcccagcucucgauacguuuggucuuu

SEQ ID NO: 45480 - RNA, 64 nt, Homo Sapiens
cucacucugccaugagaacaggacaccauccugcccagcccagacgggguugcuccugguccaa

SEQ ID NO: 45481 - RNA, 64 nt, Homo Sapiens
ggcuuagccaucucccuguccccagcaccccuccccagcccacagugguggccucugccucuuu

SEQ ID NO: 45482 - RNA, 64 nt, Homo Sapiens
aggccugaugacuagaccccgccuuccgcucccaccagcccacauccaguggggucucagucca

SEQ ID NO: 45483 - RNA, 64 nt, Homo Sapiens
caggugcuagggugccugcucuccuugcccugggccagcccaggauuguacgugggagaggcag

SEQ ID NO: 45484 - RNA, 64 nt, Homo Sapiens
ccugaccucaggaagugucauccagugucucccuccagcccagcucaggggcaggggacuaccu

SEQ ID NO: 45485 - RNA, 64 nt, Homo Sapiens
guggccacuggagaccucagagaagaccuggacuccagcccaccaagagcccugcccaggagau

SEQ ID NO: 45486 - RNA, 64 nt, Homo Sapiens
ucagcucagcuacugccaagcggcccaacccagcccagcccagcuagcccaacccagcccaacc

SEQ ID NO: 45487 - RNA, 64 nt, Homo Sapiens
ccagcucagcucagcuacugcaacccggcccaacccagcccagccggccuagcccaacccagcc

SEQ ID NO: 45488 - RNA, 56 nt, Homo Sapiens
ccggcccaacccagcccagccccaacccagcccaacccagcagcagcacggccuag

SEQ ID NO: 45489 - RNA, 64 nt, Homo Sapiens
gcuaugccauggaaaugauaucucuuccacgggaccagcccagaaaaucaccacauauuuggaa

SEQ ID NO: 45490 - RNA, 64 nt, Homo Sapiens
ucugccuccaagccccagauauucccagucgcucccagcccaccagcugcccaccucuuuuucc

SEQ ID NO: 45491 - RNA, 64 nt, Homo Sapiens
cuuggcuguccccuccaucuggggauggagaaugccagcccaaagcuggagccaauggugaggg

SEQ ID NO: 45492 - RNA, 64 nt, Homo Sapiens
caggaacauucccacauaauacauuccaucacagccagcccagcuccacucagggcuggcccgg

SEQ ID NO: 45493 - RNA, 64 nt, Homo Sapiens
auaugcacaagagcaagugaugcccccagcgcccccagcccagcccacuccccgcauggggagg

SEQ ID NO: 45494 - RNA, 64 nt, Homo Sapiens
cacaagagcaagugaugcccccagcgcccccagcccagcccacuccccgcauggggaggccgcc

SEQ ID NO: 45495 - RNA, 64 nt, Homo Sapiens
uccauuccagagcugcagaaggcucugaauguagccagcccacagcaagauucugugggcagcu

SEQ ID NO: 45496 - RNA, 64 nt, Homo Sapiens
uggcucccugggcuggcaugggauauuacaauggccagcccagauggccaggcugguaaauuua

SEQ ID NO: 45497 - RNA, 64 nt, Homo Sapiens
auuaacucacugaacaaugaauacagccagcccaccagcccaccgaguaaauaucuacucacuc

SEQ ID NO: 45498 - RNA, 64 nt, Homo Sapiens
agcccaccauuaacucacugacucacucauacagccagcccaccaccaggcagaguaaauaucu

SEQ ID NO: 45499 - RNA, 64 nt, Homo Sapiens
uaaauguuaauaacaauggaauuggagcauuuaaccagcccaguaugacuuccaaaagaagaga

SEQ ID NO: 45500 - RNA, 64 nt, Homo Sapiens
auagacaaaugacugucugggcccacacaguuaaccagcccauuucuccacacugguacaguag

SEQ ID NO: 45501 - RNA, 64 nt, Homo Sapiens
gaguguccggugaccucccccagggccuccuugcccagcccaguccaggcugcugugccaaauc

SEQ ID NO: 45502 - RNA, 64 nt, Homo Sapiens
uccagccccugcacacucccacccaggacagcccccagcccaacuaggaaagggccaugggcag

SEQ ID NO: 45503 - RNA, 64 nt, Homo Sapiens
gcacuugauggcuacaaauaaaugucccguggccccagcccacucuacuggugucucucucucu

SEQ ID NO: 45504 - RNA, 64 nt, Homo Sapiens
cagcagucaguacacaugccugaaaauauuuuaaccagcccaccuggggugccauguguacuuc

SEQ ID NO: 45505 - RNA, 64 nt, Homo Sapiens
aaauuaaaacaauuaacugaccuuccuccuauccccagcccaauugaaccauucaucaccucug

SEQ ID NO: 45506 - RNA, 64 nt, Homo Sapiens
uccggggaagacgugcgcgaaacgacguggucuuccagcccaucggaggagugaggagcccagg

SEQ ID NO: 45507 - RNA, 64 nt, Homo Sapiens
acuguggucugccauugcaauuggcaucugcacuccagcccaggcaagaagugccaagauuggc

SEQ ID NO: 45508 - RNA, 64 nt, Homo Sapiens
ccagugcucucggccacugacugcgugugcccucccagcccacaagcccggggcuccugagccu

SEQ ID NO: 45509 - RNA, 64 nt, Homo Sapiens
ccgagcugggcagcgucugcccaggcaggccagcccagcccacgcuagggcugggcucucgggg

SEQ ID NO: 45510 - RNA, 64 nt, Homo Sapiens
ccacgccgagcugggcagcgcggggccaggcaggccagcccagcagaaccuagggcugggcucu

SEQ ID NO: 45511 - RNA, 64 nt, Homo Sapiens
cuuccaaggugaggcaaaggcaucuggacuuguuccagcccagcccaccgggugacaucaccgg

SEQ ID NO: 45512 - RNA, 64 nt, Homo Sapiens
aaggugaggcaaaggcaucuggacuuguuccagcccagcccaccgggugacaucaccgggcagg

SEQ ID NO: 45513 - RNA, 64 nt, Homo Sapiens
uagaugcaagcaagguggacaagagcucaggacuccagcccacugccacugggugacacagacu

SEQ ID NO: 45514 - RNA, 64 nt, Homo Sapiens
cuccccucccuugcugcucugccccugccagugcccagcccagcggcucugggaagggguuccc

SEQ ID NO: 45515 - RNA, 64 nt, Homo Sapiens
gggccagugcccagacagggucauggggcucagaccagcccacuguagagaaucacucugaggc

SEQ ID NO: 45516 - RNA, 64 nt, Homo Sapiens
accugagcugggguugcaaagucacuggccacauccagcccaaagauaaauuuuguuuguccag

SEQ ID NO: 45517 - RNA, 64 nt, Homo Sapiens
cugcugcauguuguggguuaaagggagucucucaccagcccaggcccucaggaggaggagauac

SEQ ID NO: 45518 - RNA, 64 nt, Homo Sapiens
auuacacaaagacaaaaaaagugaggcugagaaaccagcccacaucuaauuagaaaaaggcuug

SEQ ID NO: 45519 - RNA, 64 nt, Homo Sapiens
uguccuguccuccuuauucucucaccagcccagcccagcccagccaugaucugguacaggcaug

SEQ ID NO: 45520 - RNA, 64 nt, Homo Sapiens
ccagcuguccuguccuccuugcaugcucaccagcccagcccagcgcaaccaugaucugguacag

SEQ ID NO: 45521 - RNA, 64 nt, Homo Sapiens
ccagcccagcuguccuguccuacaggcaugcucaccagcccagccaacugcaaccaugaucugg

SEQ ID NO: 45522 - RNA, 64 nt, Homo Sapiens
uauuuuuuguagagacgggguuucgccaaguugaccagcccaguuucaaacuccugaccucagg

SEQ ID NO: 45523 - RNA, 64 nt, Homo Sapiens
uaugagugaguaucuuggugaugacuccuccugaccagcccaggaccagcuuucuugucaccuu

SEQ ID NO: 45524 - RNA, 64 nt, Homo Sapiens
gcacaggcuccagcaauaugugggccaggccagcccagcccagacgguacugaccagcucccgu

SEQ ID NO: 45525 - RNA, 64 nt, Homo Sapiens
ccagagcacaggcuccagcacccguugggccaggccagcccagccccaccgguacugaccagcu

SEQ ID NO: 45526 - RNA, 64 nt, Homo Sapiens
ggcaggcggaucacuugaugccagaaguuugagaccagcccagccaacauggugaaaccccguc

SEQ ID NO: 45527 - RNA, 64 nt, Homo Sapiens
ggccagcccuggcccuugaagggguuggcugugcccagcccaccuggcugcagugggcagcuca

SEQ ID NO: 45528 - RNA, 64 nt, Homo Sapiens
aauaacucuugcagcccugaaggaccuagggagcccagcccaccuucccacggacugggguucc

SEQ ID NO: 45529 - RNA, 64 nt, Homo Sapiens
gggcaaaaucaucccaaaccaggcugccccagccccagcccagcaacagugaacucccuugggu

SEQ ID NO: 45530 - RNA, 64 nt, Homo Sapiens
gcaacugacccaguccgcaaauauuuauugggggccagcccagggcugggacugggcaugaggu

SEQ ID NO: 45531 - RNA, 64 nt, Homo Sapiens
uccuugucucuugucuuuggccagcccccucagcccagcccaccccacccgcuguccggccaca

SEQ ID NO: 45532 - RNA, 64 nt, Homo Sapiens
aacucaccccuggaauacaggggaaugaugacaaccagcccagccaggccugacucaucauggu

SEQ ID NO: 45533 - RNA, 64 nt, Homo Sapiens
ggaagggaaagguuuuucuuguagggaacuggaaccagcccacaacugcacacuugugagcugu

SEQ ID NO: 45534 - RNA, 64 nt, Homo Sapiens
ucccugcagcccaagucucaucgggucagcgcagccagcccagccuccucuuccucagaguggc

SEQ ID NO: 45535 - RNA, 64 nt, Homo Sapiens
agcagccccacucacagcuguccuacacaucuugccagcccaccuggcuaugcacccccaccau

SEQ ID NO: 45536 - RNA, 64 nt, Homo Sapiens
acgugggaggcugcuucccaccauuccccucaccccagcccaaguaaggcuggacuccaauggc

SEQ ID NO: 45537 - RNA, 64 nt, Homo Sapiens
ccacccugcccccacccucacuaucugucugccaccagcccaccuuggccccucaccaaugcau

SEQ ID NO: 45538 - RNA, 64 nt, Homo Sapiens
cccagaugccugagccuuugccuccagcuaggacccagcccaucuugggggcacugcugucccc

SEQ ID NO: 45539 - RNA, 64 nt, Homo Sapiens
ggaccagaacugggagaggaauccccccuccaucccagcccacuggccaggguggcaggaagac

SEQ ID NO: 45540 - RNA, 64 nt, Homo Sapiens
auacaggaggaucaaaggagccuuccuguucucuccagcccagcuauaaaaaugggucaguagc

SEQ ID NO: 45541 - RNA, 64 nt, Homo Sapiens
aagucucucauucuaggccuuuuuaaguuuccuuccagcccagauggggguuggauuugaagac

SEQ ID NO: 45542 - RNA, 64 nt, Homo Sapiens
gccaccuggaucuaucccuggaagagaagagggcccagcccagacaacagcaccuccccgcugg

SEQ ID NO: 45543 - RNA, 64 nt, Homo Sapiens
caggccaacagcaccuccccgaaacagauucaggccagcccagcugggcaggaagggagaacuu

SEQ ID NO: 45544 - RNA, 64 nt, Homo Sapiens
ucugucccuccccuagguaaacccaugggcuccaccagcccagcccacagcaccaucaggcagc

SEQ ID NO: 45545 - RNA, 64 nt, Homo Sapiens
agucccucacccacaucugcaccccagcgagugcccagcccacggcugcuggcacacggggccg

SEQ ID NO: 45546 - RNA, 64 nt, Homo Sapiens
cucugggaacaggcagcucccacuuccuccugccccagcccaacggcaaaggaccuggcguggc

SEQ ID NO: 45547 - RNA, 64 nt, Homo Sapiens
cagcccacagugcugcacguguccagccacagccccagcccaggucgggacagguagcacugcu

SEQ ID NO: 45548 - RNA, 64 nt, Homo Sapiens
auagcccgagggcuggaaaaugcugaggcccagcccagcccagccuagacaugaaaugucaccu

SEQ ID NO: 45549 - RNA, 64 nt, Homo Sapiens
ccagcauagcccgagggcugcaccuugcugaggcccagcccagcuauuucuagacaugaaaugu

SEQ ID NO: 45550 - RNA, 64 nt, Homo Sapiens
ccgacccuuugaguccccuugagugucuuaagaaccagcccacaacagccucucuuucuccucc

SEQ ID NO: 45551 - RNA, 64 nt, Homo Sapiens
auccugacccuccccacugcaagcccagggagccccagcccaagauggccagccugaaacuguu

SEQ ID NO: 45552 - RNA, 64 nt, Homo Sapiens
ccgcccgacggcagcgccgccgccgcccagaaucccagcccagaaucccgaccgccgcgccgga

SEQ ID NO: 45553 - RNA, 64 nt, Homo Sapiens
cauaggucucccucucugggcaccaggacucaguccagcccaagacuacucugggcagcuccca

SEQ ID NO: 45554 - RNA, 64 nt, Homo Sapiens
uuuguuuuguugagauggagucucgcucuguugcccagcccagaguacaguggcacuaucucag

SEQ ID NO: 45555 - RNA, 64 nt, Homo Sapiens
aaagugcugggauuacaggcgugagccacugugcccagcccagguuuugaaguuguccgagaua

SEQ ID NO: 45556 - RNA, 64 nt, Homo Sapiens
cacugccacagggacgccuucccuccccuccccuccagcccaccccugcacagccccuccuccu

SEQ ID NO: 45557 - RNA, 64 nt, Homo Sapiens
ccguguucucaggagugguugaggacacagggccccagcccagcccucugcaccccccagcccg

SEQ ID NO: 45558 - RNA, 64 nt, Homo Sapiens
ccauagugggccaggcugcccuccaugcugggccccagcccaggucugcacucgccuggaucac

SEQ ID NO: 45559 - RNA, 64 nt, Homo Sapiens
ccuugcggggaggagaggguuugcuaaucugcucccagcccaaccuauuaccaccccaccucgc

SEQ ID NO: 45560 - RNA, 64 nt, Homo Sapiens
caugguuacauacuaauugcugcagcucuguggcccagcccacugcuucagcugugggccaucu

SEQ ID NO: 45561 - RNA, 64 nt, Homo Sapiens
ugugggccaucugaggguacgugccaucaucucuccagcccaggccccugggcaucucaugcug

SEQ ID NO: 45562 - RNA, 64 nt, Homo Sapiens
gcagggaaggcaaacccucuuuauugaacauuagccagcccagcccagaccccagggcugccua

SEQ ID NO: 45563 - RNA, 64 nt, Homo Sapiens
gaaggcaaacccucuuuauugaacauuagccagcccagcccagaccccagggcugccuaaggac

SEQ ID NO: 45564 - RNA, 64 nt, Homo Sapiens
ucggagcaucccggaggaaaaaccucccagagguccagcccauccucccuuccgacccucuggg

SEQ ID NO: 45565 - RNA, 64 nt, Homo Sapiens
ggggacaggccucaccucuacccauguucugcccccagcccaaacuuagucccccaacucugag

SEQ ID NO: 45566 - RNA, 64 nt, Homo Sapiens
ccaggagcgccucaucuuccagugggaggcggggccagcccagggaggugaccagaggguucag

SEQ ID NO: 45567 - RNA, 64 nt, Homo Sapiens
gcgaauggcgagcuuggcucuccggagcugagauccagcccagggccucuucucgacgucuccu

SEQ ID NO: 45568 - RNA, 64 nt, Homo Sapiens
agugcuaagcugcccugaggguuuccuucggggaccagcccacagcacaccaagguggcccgga

SEQ ID NO: 45569 - RNA, 64 nt, Homo Sapiens
gucuuggguguuagugucagccaugggaaaugagccagcccaagggcaucauccucagcagcau

SEQ ID NO: 45570 - RNA, 64 nt, Homo Sapiens
guugccggaguacacagugacccaggagucugggccagcccaccgcaaagaauucaccaugacc

SEQ ID NO: 45571 - RNA, 64 nt, Homo Sapiens
acagggcaaggagccaaggaccacagagccucagccagcccaggauccguccucauuuuauugg

SEQ ID NO: 45572 - RNA, 64 nt, Homo Sapiens
cuugcccaccauuuaagaaaaguuacauuaucagccagcccagcaaauacggcucauguuaaug

SEQ ID NO: 45573 - RNA, 64 nt, Homo Sapiens
aaaccucaaaagcaugccuuuauuuuucuacuacccagcccaagaauccccaaaggaaaacacc

SEQ ID NO: 45574 - RNA, 64 nt, Homo Sapiens
uggugggaagcgucuguccgucucugcagccagcccagcccagcauacaacuucaagugcaugc

SEQ ID NO: 45575 - RNA, 64 nt, Homo Sapiens
ccagcuggugggaagcgucucaugcucucugcagccagcccagcgagugauacaacuucaagug

SEQ ID NO: 45576 - RNA, 64 nt, Homo Sapiens
cucucuccuguccaaccuaaccuccccuauccacccagcccauuguucagccccuccucugcca

SEQ ID NO: 45577 - RNA, 64 nt, Homo Sapiens
ccucugccgcuuguacauaccugucuaccccagcccagcccagccccagccuguggccagguca

SEQ ID NO: 45578 - RNA, 64 nt, Homo Sapiens
ccagcccucugccgcuuguaggucacugucuaccccagcccagcgccaacccagccuguggcca

SEQ ID NO: 45579 - RNA, 64 nt, Homo Sapiens
ggcggcgcugcucagcuuggccaggcucugagagccagcccaggguggcgggcuccacguuagc

SEQ ID NO: 45580 - RNA, 64 nt, Homo Sapiens
cacuucuuccacuccucccccaagccacagccagccagcccaucgcugggcugccagugccaug

SEQ ID NO: 45581 - RNA, 64 nt, Homo Sapiens
ccauuccagugcucagccuagcuucauuuucacaccagcccacagaggguccaagaagacguag

SEQ ID NO: 45582 - RNA, 64 nt, Homo Sapiens
gugguaaaccucuguauauuuccugcccaccugaccagcccagccugccuuaaucagaccgauu

SEQ ID NO: 45583 - RNA, 64 nt, Homo Sapiens
cuagaagcccccauggcuucguuccugggggcuuccagcccaggauucaagcaauaagaggggg

SEQ ID NO: 45584 - RNA, 64 nt, Homo Sapiens
uuacugcaagcagcguccugccccgcgccccuccccagcccaucagccugcugcaacagacccu

SEQ ID NO: 45585 - RNA, 64 nt, Homo Sapiens
ccacaguggagacuggagacacguggcauggccuccagcccaacuggcugguguuugcaguccc

SEQ ID NO: 45586 - RNA, 64 nt, Homo Sapiens
cucggcucugcagccgguuccuugaccugcagccccagcccaccugcagccaaaggugcaauua

SEQ ID NO: 45587 - RNA, 64 nt, Homo Sapiens
ugaggcgaaguggacuccagucuugggcugcaagccagcccagccuguuggacaccaacuuuag

SEQ ID NO: 45588 - RNA, 64 nt, Homo Sapiens
gcgcgcuucugccugcguuccgccuggacaucuaccagcccacgaugccaguggcccucgcgag

SEQ ID NO: 45589 - RNA, 64 nt, Homo Sapiens
uacccggcagaccccucuuccuacagcccccucuccagcccagcuaccuccucgccaaguggga

SEQ ID NO: 45590 - RNA, 64 nt, Homo Sapiens
ugugaccauuacgcccccucccuguuucuuaucaccagcccaucagcccacugacucccauaug

SEQ ID NO: 45591 - RNA, 64 nt, Homo Sapiens
ccucugcaugaguucugcaccccaagcccuugccccagcccaguccagcagcagauguuacaau

SEQ ID NO: 45592 - RNA, 64 nt, Homo Sapiens
cuggaaacgcccugugucucuggcuacagcaagaccagcccaggagcccaccagcaccugccuc

SEQ ID NO: 45593 - RNA, 64 nt, Homo Sapiens
uaaugagaaaccaggacaggccaucugcagugacccagcccaggacgaaguuuacaaacaccuc

SEQ ID NO: 45594 - RNA, 64 nt, Homo Sapiens
caggggagcccaggcugcccugcacuccugccucccagcccacagccaggugcuuucaucacag

SEQ ID NO: 45595 - RNA, 64 nt, Homo Sapiens
cuccagccaaugaaugggaucauucuggaugucaccagcccaauaggcucagcucaugaugaca

SEQ ID NO: 45596 - RNA, 64 nt, Homo Sapiens
caaaaucucuccuaccaagaugguguuccacuguccagcccagcaugaguagcagguagagcac

SEQ ID NO: 45597 - RNA, 64 nt, Homo Sapiens
uucucuucugugggucuguaccagguacuccaggccagcccaugggcccggggccugaccccaa

SEQ ID NO: 45598 - RNA, 64 nt, Homo Sapiens
aguugaaaccaaacaggccucucgcucacuccucccagcccaguaaugcugaggaguucaguug

SEQ ID NO: 45599 - RNA, 64 nt, Homo Sapiens
aagggggacgaucacggcccccucaccugcuuuuccagcccacaauggccucagcccagcccac

SEQ ID NO: 45600 - RNA, 64 nt, Homo Sapiens
cucaccugcuuuuccagcccgcaauggccucagcccagcccaccuuauuacacagauaguggcg

SEQ ID NO: 45601 - RNA, 64 nt, Homo Sapiens
ugccugcaggaagaucuggcgccagggagggaguccagcccagccagagacgaagggaagggua

SEQ ID NO: 45602 - RNA, 64 nt, Homo Sapiens
agcgcuauuuauugcauauugcagccggcccggcccagcccagggggccgagugggguuugaag

SEQ ID NO: 45603 - RNA, 64 nt, Homo Sapiens
ccucacagacaguaggauccacuuaaauggagaaccagcccauggaacuugccagauagaaaag

SEQ ID NO: 45604 - RNA, 64 nt, Homo Sapiens
uaaguucucuucgcuuaaaggcuccuaacaguugccagcccaccgauggugcuugcucuauuug

SEQ ID NO: 45605 - RNA, 64 nt, Homo Sapiens
gccagcuccgugcccgagugagcuggcccuucccccagcccacaacagagagcacgguguccag

SEQ ID NO: 45606 - RNA, 64 nt, Homo Sapiens
caccugccccagccccuccaccugaaugcacagcccagcccaugugagucacuagggaauguca

SEQ ID NO: 45607 - RNA, 64 nt, Homo Sapiens
cgagcccuacuuccagguucugguuagcucagccccagcccagcccagcugcucugcccagagc

SEQ ID NO: 45608 - RNA, 64 nt, Homo Sapiens
ccuacuuccagguucugguuagcucagccccagcccagcccagcugcucugcccagagcugggu

SEQ ID NO: 45609 - RNA, 64 nt, Homo Sapiens
acccuggugaggaagcuccaguccugcucucuacccagcccaucuugccuccauggugccucug

SEQ ID NO: 45610 - RNA, 64 nt, Homo Sapiens
cccauuaaccagggcaccaagcccacagguguccccagcccacuggaucagaaagaguucagua

SEQ ID NO: 45611 - RNA, 64 nt, Homo Sapiens
caguccaggcaggaagcagcaccugccccccgcgccagcccagccccagccugagugcaggagc

SEQ ID NO: 45612 - RNA, 64 nt, Homo Sapiens
guggcguguggcagaaucgcaccgccccggcuccccagcccaccgccaugcagggcucgcgugc

SEQ ID NO: 45613 - RNA, 64 nt, Homo Sapiens
ucccugccuauggugucgcuuggcuaagugacucccagcccaagcccccucaagagucuggguc

SEQ ID NO: 45614 - RNA, 64 nt, Homo Sapiens
cuucguugagggccauccauaugccagcugggggccagcccacaguggccauauuggcugcagc

SEQ ID NO: 45615 - RNA, 64 nt, Homo Sapiens
cagccaguggucgagcacugaggagaggcugagaccagcccaccgauuucagcccugggccugc

SEQ ID NO: 45616 - RNA, 64 nt, Homo Sapiens
uucuuuccauuccuugauagcaggcgcaagccacccagcccagccucccaaagugcugggauua

SEQ ID NO: 45617 - RNA, 64 nt, Homo Sapiens
cccuuugacucuggggugcaaccccagggcacugccagcccaccucagggagugcagacaccua

SEQ ID NO: 45618 - RNA, 64 nt, Homo Sapiens
caaagaugucuuaaccucagcagaccccucagccccagcccagaccucuccccaggaaguggcu

SEQ ID NO: 45619 - RNA, 64 nt, Homo Sapiens
cugcaaauccccguuccccugcacuccucuucucccagcccaucccuccggccccugugccucu

SEQ ID NO: 45620 - RNA, 64 nt, Homo Sapiens
agcccaucccuccggccccugugccucugcggccccagcccagcucccagggccgucaccugcu

SEQ ID NO: 45621 - RNA, 64 nt, Homo Sapiens
agcccagcccccugccccggcccugcuccagaacccagcccagaucggaggacaaguuccucuc

SEQ ID NO: 45622 - RNA, 64 nt, Homo Sapiens
aguuccucucuagaacccaauccaauuuggagccccagcccaacuccagaacccaacccuucuc

SEQ ID NO: 45623 - RNA, 64 nt, Homo Sapiens
agcccaacuccagaacccaacccuucucuagaauccagcccagaucugaggccaagcuaugugc

SEQ ID NO: 45624 - RNA, 64 nt, Homo Sapiens
gggggagaagaaauuuugagaauggaaaaaucccccagcccagcccagccccaccgaaaagcaa

SEQ ID NO: 45625 - RNA, 64 nt, Homo Sapiens
agaagaaauuuugagaauggaaaaaucccccagcccagcccagccccaccgaaaagcaaaaauu

SEQ ID NO: 45626 - RNA, 64 nt, Homo Sapiens
cccgcucacguccugccgcaagagaacgcccagcccagcccaccagcgggaugagcuggcggcc

SEQ ID NO: 45627 - RNA, 64 nt, Homo Sapiens
ccacccccgcucacguccugcggccagagaacgcccagcccagcagagcagcgggaugagcugg

SEQ ID NO: 45628 - RNA, 64 nt, Homo Sapiens
cagagcagguaggcgcccugcagccucccugcucccagcccaaggccagucggccugggaaguu

SEQ ID NO: 45629 - RNA, 64 nt, Homo Sapiens
ggccucagaccagccaaccuuuguggaauaagccccagcccagccaaaccaaacccagaugccu

SEQ ID NO: 45630 - RNA, 64 nt, Homo Sapiens
ggagaugccuggggaggggcuccuggaauccaggccagcccaacagcccuggcuggggaggugu

SEQ ID NO: 45631 - RNA, 64 nt, Homo Sapiens
cuggggucuuugugaauauccagacuguuucagcccagcccaucucagccaacccuccuuagac

SEQ ID NO: 45632 - RNA, 64 nt, Homo Sapiens
gccccagcuggccuuccccaggccucccucggcuccagcccaauccacccccacugggccugcu

SEQ ID NO: 45633 - RNA, 64 nt, Homo Sapiens
gcgggcacagcacaacacggcagucugggggaggccagcccaguugaaaaggcauugggagaag

SEQ ID NO: 45634 - RNA, 64 nt, Homo Sapiens
acccagacccccuuuucuccauguaccugcugggccagcccauuucacaggugaggaacccgag

SEQ ID NO: 45635 - RNA, 64 nt, Homo Sapiens
cccgcagggauggaggcagcuccugaacugguggccagcccacgggguacuggaagacaguggu

SEQ ID NO: 45636 - RNA, 64 nt, Homo Sapiens
uaagagugcacuacagcccaggcuuaugccacccccagcccaccugccucaccacccuggcugu

SEQ ID NO: 45637 - RNA, 64 nt, Homo Sapiens
aaugcacucaauuuaguacugaauggucuuucucccagcccauucccagcccuuccuauuuccu

SEQ ID NO: 45638 - RNA, 64 nt, Homo Sapiens
ggccccacagagcccaaaacagaagggggcugccccagcccagcagagcacagaguuucuggag

SEQ ID NO: 45639 - RNA, 64 nt, Homo Sapiens
acaguacccugggaggcauaggagaagggucgggccagcccagcccagggccugaguuagacua

SEQ ID NO: 45640 - RNA, 64 nt, Homo Sapiens
acccugggaggcauaggagaagggucgggccagcccagcccagggccugaguuagacuauuucc

SEQ ID NO: 45641 - RNA, 64 nt, Homo Sapiens
uggccccgggcuguggcgagacagcccaacucccccagcccagcucccccagcccagagccagg

SEQ ID NO: 45642 - RNA, 64 nt, Homo Sapiens
ggcgagacagcccaacucccccagcccagcucccccagcccagagccagggaagaggaaggugg

SEQ ID NO: 45643 - RNA, 64 nt, Homo Sapiens
guggcccaguagagcaaggcgugcaggccuccuuccagcccagaggucaccuacggcuguggcc

SEQ ID NO: 45644 - RNA, 64 nt, Homo Sapiens
gaauggaaucuagaggaauagaccugauucaccuccagcccagggggacaguccccuccgggau

SEQ ID NO: 45645 - RNA, 64 nt, Homo Sapiens
ccuggcaaggugcacuuguugggcaggcuuugccccagcccaccgucaggcugugcugugugau

SEQ ID NO: 45646 - RNA, 64 nt, Homo Sapiens
cugggccacccuuuguuuccagacuucucaggggccagcccaguccagcaccaucuguuccccu

SEQ ID NO: 45647 - RNA, 64 nt, Homo Sapiens
ccagcacugccagccuccucuuauggcaguggguccagcccaggggaccccaaguaggcaacug

SEQ ID NO: 45648 - RNA, 64 nt, Homo Sapiens
cacggaaugggagggcccugucuagaaaaaagauccagcccaggucgaucuucucacucuuacu

SEQ ID NO: 45649 - RNA, 64 nt, Homo Sapiens
caacaaagugagccccuguccacgccacugcaccccagcccaggaggcugcagugaaccgugau

SEQ ID NO: 45650 - RNA, 64 nt, Homo Sapiens
gacuggugucccuugauuccggggccgagcagggccagcccagugcccacccaccaggccugag

SEQ ID NO: 45651 - RNA, 64 nt, Homo Sapiens
ccucuucggcuucaggaacuuucuccaguaggccccagcccagacucgagccagucuaugcccu

SEQ ID NO: 45652 - RNA, 64 nt, Homo Sapiens
aacagggcccuaagcacuucccccccagcacccuccagcccacaacugccccuguacaguccug

SEQ ID NO: 45653 - RNA, 64 nt, Homo Sapiens
uccccacugccccuguacagcgccacccccugcaccagcccacacucaguuugcuccacauggc

SEQ ID NO: 45654 - RNA, 64 nt, Homo Sapiens
ccauggccggcuuucaggagccucuucccgccgcccagcccaccaucgcacucuggcagcaccg

SEQ ID NO: 45655 - RNA, 64 nt, Homo Sapiens
ugggcagagaggcugugguuugggugcuguuuugccagcccauuucccacaugccaggggccuu

SEQ ID NO: 45656 - RNA, 64 nt, Homo Sapiens
gauggaccuggccagaugucgggguugaccaggagccggucagaggcacucuuccagcucccug

SEQ ID NO: 45657 - RNA, 64 nt, Homo Sapiens
caccagcacgucccaccucgcagcuggcaggacugccggucacaccuuccucggcuagccaaaa

SEQ ID NO: 45658 - RNA, 64 nt, Homo Sapiens
ugcuugaaagagcacagccccuguugaagggaaaucuagucaguacaagugagucacaaacauu

SEQ ID NO: 45659 - RNA, 64 nt, Homo Sapiens
ccauaaagauugugcuaauuguaaggaagugguaucuagucaguaucaaaguuuaugauuaaau

SEQ ID NO: 45660 - RNA, 64 nt, Homo Sapiens
cauuuugucgccugcacccacucccuucauacaaucuagucagaauagcaguucuagagcacag

SEQ ID NO: 45661 - RNA, 64 nt, Homo Sapiens
ucugcagucaggucacugccuacugccugggggcucuagucauuccaguggaagacgaauguaa

SEQ ID NO: 45662 - RNA, 64 nt, Homo Sapiens
aggaggaucccuaugacucagucauuaaaaaaaaucuagucaccuaucuaaauaggcauuuuua

SEQ ID NO: 45663 - RNA, 64 nt, Homo Sapiens
guucauagucguuucguuuuguggguuaagaaguucuagucaguaccugaagugguuuacuucu

SEQ ID NO: 45664 - RNA, 64 nt, Homo Sapiens
aguaacauuuuuuuguauagguauaccaugauuuguugaugaacaaauuuaccuguugaugaac

SEQ ID NO: 45665 - RNA, 64 nt, Homo Sapiens
guauaccaugauuuguugaugaacaaauuuaccuguugaugaacauuuacguuguuaccaagau

SEQ ID NO: 45666 - RNA, 64 nt, Homo Sapiens
caguuuagcuugccaggguguuugcagggacaguguugaugaggaaucaacuucuacagaaacu

SEQ ID NO: 45667 - RNA, 64 nt, Homo Sapiens
gcccucaugaguagcauccaaauaguuuuccuacguugaugacaacaugucauccacuugaguu

SEQ ID NO: 45668 - RNA, 64 nt, Homo Sapiens
ccgaaguauuuuacagaaacggaccacggcaugauuucaugacuucuguccaguugaggccuca

SEQ ID NO: 45669 - RNA, 64 nt, Homo Sapiens
aauuacuuuuauuauaccauuucuuucaaaauauuuucaugaaauuaaauauuuauaauguagc

SEQ ID NO: 45670 - RNA, 64 nt, Homo Sapiens
gaagagguuauagcacauauguaacuacuaaauuuuucaugacuaucuuuuauuucauguguau

SEQ ID NO: 45671 - RNA, 64 nt, Homo Sapiens
auuauuggugggccacugaauucuauuuuuauuuuuucaugaaagugucugggagguuuuuuuu

SEQ ID NO: 45672 - RNA, 64 nt, Homo Sapiens
guuauugguaccaaaacucuugccagauaaccaguuucaugaacuguuuguauggcagcccaug

SEQ ID NO: 45673 - RNA, 64 nt, Homo Sapiens
uuacauaucaguaauuguuuuuauaauuugugguuuucaugaaacauugcuaugcauuuauuag

SEQ ID NO: 45674 - RNA, 64 nt, Homo Sapiens
cauuguagauaucuauuuauauuuaaaguuuauguuucaugaacugcagcugcaggauucuggc

SEQ ID NO: 45675 - RNA, 64 nt, Homo Sapiens
accuuguaagauaaauauaaauuggaguuaggaauuucaugaaccucacuaugaccaaaauuaa

SEQ ID NO: 45676 - RNA, 64 nt, Homo Sapiens
uaauuguaguguaguuguucuauaaaccauauuuuuucaugauguggauauuuucuucuauuuc

SEQ ID NO: 45677 - RNA, 64 nt, Homo Sapiens
cuggacucagaugcauagauuugguccaguguauuuucaugauaaagugaaauugagucagaac

SEQ ID NO: 45678 - RNA, 64 nt, Homo Sapiens
uaacacagaaacgcaauaaacacacacaaaauaguuucaugagugauucuucagaugcccuucc

SEQ ID NO: 45679 - RNA, 64 nt, Homo Sapiens
uucucauguuuauauaaugguaugcuugcauauauuucaugaauacauuguacauauuauguua

SEQ ID NO: 45680 - RNA, 64 nt, Homo Sapiens
ucaaauaaaauaaaucuaagucgguuaaaauggauuucaugauuuucccucagaaaaugaguaa

SEQ ID NO: 45681 - RNA, 64 nt, Homo Sapiens
cccggcugccauacugcaugcugcaggcucugccuuucaugaccccaggcaacagccagggccc

SEQ ID NO: 45682 - RNA, 64 nt, Homo Sapiens
cccuacaaaggguggaagagaaaggacacaguauuuucaugaauuuaccauauaucuuuguuuu

SEQ ID NO: 45683 - RNA, 64 nt, Homo Sapiens
auguauucuguaaaagaaaaaaaaaaugcggccuuuucaugaggaucgucugguuagaaaacau

SEQ ID NO: 45684 - RNA, 64 nt, Homo Sapiens
acuagcacugacugaacuguaauguaggggaaaguuucaugaugguaucuauagucaagacgaa

SEQ ID NO: 45685 - RNA, 64 nt, Homo Sapiens
uugacuuuuacagguaagugcaaaggagaagugguuucaugaaauguucuaauguauaauaaca

SEQ ID NO: 45686 - RNA, 64 nt, Homo Sapiens
auauuugauuaucuuaaaaauuguuaaauaccguuuucaugaaauuucucaguauuguaacagc

SEQ ID NO: 45687 - RNA, 64 nt, Homo Sapiens
ucaaaugugggcccagccuaaucaaagacacacuuuucaugaccuuguggccaagccacaugag

SEQ ID NO: 45688 - RNA, 64 nt, Homo Sapiens
gaauaacugcaaacuuuuaaugcuucacuuccuauuucaugacaugagaagagagaacuguagu

SEQ ID NO: 45689 - RNA, 64 nt, Homo Sapiens
gauauuuuuuacgauaauuagcugcaugugaauuuuucaugaccuucuuuacauuuuuuauuuu

SEQ ID NO: 45690 - RNA, 64 nt, Homo Sapiens
ugagaauugaagacuuagccagucagauaaguuuuuucaugaacccguuguggaaauuauugga

SEQ ID NO: 45691 - RNA, 64 nt, Homo Sapiens
gagcuggaaagaaauuuucuagcccaacucccuguuucaugaaagagaaaagaggcucagaaaa

SEQ ID NO: 45692 - RNA, 64 nt, Homo Sapiens
uuggcccuggguguggguuuuacaagacugugucuuucaugacaucauagcccaaccaugugag

SEQ ID NO: 45693 - RNA, 64 nt, Homo Sapiens
cggagccugccugccucugccguccucaguuuccuuucaugaggcuucuagccaaagaugauaa

SEQ ID NO: 45694 - RNA, 64 nt, Homo Sapiens
auauucauuuuaauggcuuuuuugaaaguuccuuuuucaugaacacacccgagaaaucuuaaau

SEQ ID NO: 45695 - RNA, 64 nt, Homo Sapiens
auuguggggaugaugaaauaaauaaucauucuuauuucaugaaauguauuugcagcugagagaa

SEQ ID NO: 45696 - RNA, 64 nt, Homo Sapiens
uugaaaucaugaagauauuuaccaugaagagauuuuucaugauuauauuuuucaugauuuugaa

SEQ ID NO: 45697 - RNA, 64 nt, Homo Sapiens
uugaaaccaugaagagauuuaaucauaagauauuuuucaugauugaaauuuuugcccaucccaa

SEQ ID NO: 45698 - RNA, 64 nt, Homo Sapiens
ugcuguugguuucaaaugaauauuuuucaugacguuucaugauuggagauuuuaccuugacuua

SEQ ID NO: 45699 - RNA, 64 nt, Homo Sapiens
uuucaugauuugcuguugguccuugacuuauauuuuucaugacgaauuacucuaggagauuuua

SEQ ID NO: 45700 - RNA, 64 nt, Homo Sapiens
uuacagugugguuugagcaccauguuuuucucuguuucaugaaccagaaccuagguuuagggua

SEQ ID NO: 45701 - RNA, 64 nt, Homo Sapiens
gauacauucaugcacaauccaagagguaccacauuuucaugacagcaaauacacagauuaugcc

SEQ ID NO: 45702 - RNA, 64 nt, Homo Sapiens
uaaagaaacugaacagugaaauaccaaguauucauuucaugaugucuugaaauuugggagguua

SEQ ID NO: 45703 - RNA, 64 nt, Homo Sapiens; identical to SEQ ID NO: 45702

SEQ ID NO: 45704 - RNA, 64 nt, Homo Sapiens
agaucaugaagucauaggcugccuucggcauauuuuucaugaauuucaaugcauugcauauuua

SEQ ID NO: 45705 - RNA, 64 nt, Homo Sapiens
caauaauccgaaaaguucgcaacaaccugcuuguuuucaugagagcacuuuccaaguucaucac

SEQ ID NO: 45706 - RNA, 64 nt, Homo Sapiens
augauaaaaauaaaauuguuguauaauuucaucauuucaugaaucaaccacuuuucuccuauca

SEQ ID NO: 45707 - RNA, 64 nt, Homo Sapiens
gauaagaguuuuuugguuuuuaaaacgcuuagaauuucaugagugguuccuggcauagagcucc

SEQ ID NO: 45708 - RNA, 64 nt, Homo Sapiens
augucaugugaugauagaaugggaaugauauaauuuucaugacauagucacaguuuuccaggga

SEQ ID NO: 45709 - RNA, 64 nt, Homo Sapiens
acaacuugguuuaugcaugauguagaauaccgacuuucaugaugacagagguuuugcuuuaugc

SEQ ID NO: 45710 - RNA, 64 nt, Homo Sapiens
aaccugucucucauuccuaaguugccucauuaauuuucaugaacaagaauauguaccuuuuuga

SEQ ID NO: 45711 - RNA, 64 nt, Homo Sapiens
gccaaaaucaacauauaaugaagagaugccuuuguuucaugagauucaaacuugaugcuaugcu

SEQ ID NO: 45712 - RNA, 64 nt, Homo Sapiens
uuuuuuaaauuugccaguuuuauuuucuaaauucuuucaugagcuugccuaaaauucggaaugg

SEQ ID NO: 45713 - RNA, 64 nt, Homo Sapiens
agcuaauacuaauagccuaaaagauuuugugaaauuucaugaaaacuuuuuaauggcaauaaug

SEQ ID NO: 45714 - RNA, 64 nt, Homo Sapiens
gguccucuguugcuauugucuucuauaaguggaguuucaugacuuacugcuuaacgaauaacua

SEQ ID NO: 45715 - RNA, 64 nt, Homo Sapiens
aaaaaguauacuuauacaauguuuuguacuuguauuucaugaaauuaaaacagugaugcuaaaa

SEQ ID NO: 45716 - RNA, 64 nt, Homo Sapiens
uaagacuaccagucuuuuucgaaaaaauaugguauuucaugauccaaaugggucacuaucuggu

SEQ ID NO: 45717 - RNA, 64 nt, Homo Sapiens
caaguuuuacucugcaauggcuuucacauacaguuuucaugagggacucuucugaguccauuau

SEQ ID NO: 45718 - RNA, 64 nt, Homo Sapiens
gggcuauuuguucuuuggaaugacugcuccacuccacacucacaccucuauucacagaccagca

SEQ ID NO: 45719 - RNA, 64 nt, Homo Sapiens
acuaaagagaaagaauacuugacagcucuaugcccacacucacauuacagcugaugugaaagag

SEQ ID NO: 45720 - RNA, 64 nt, Homo Sapiens
aagcuuaaccaagagugagaggauaugucauguucacacucaaugcaauucguagugguuuucu

SEQ ID NO: 45721 - RNA, 64 nt, Homo Sapiens
caaugcaccuagggaaaaaauuuaaggagguauucacacucagggucaugcacuugcacaaugu

SEQ ID NO: 45722 - RNA, 64 nt, Homo Sapiens
caugcacacacacacacacaacacaauuuaugugcacacucacaaaacuauaaugcacacucac

SEQ ID NO: 45723 - RNA, 64 nt, Homo Sapiens
cacaauuuaugugcacacucaagaaacuauaaugcacacucacagcuaaaccaagagagaaagc

SEQ ID NO: 45724 - RNA, 64 nt, Homo Sapiens
gagaauauuuauaacuuuuguaugagagagaauucacacucaacaagacacuaccagcaccacg

SEQ ID NO: 45725 - RNA, 64 nt, Homo Sapiens
auuugcuggugguggcuucgggcucaugcccagacacacucacugccccgucuguccaaggccu

SEQ ID NO: 45726 - RNA, 64 nt, Homo Sapiens
aaaauuacauuacaagauccagguucuucccccccacacucaaucaagccagcccucuccucuu

SEQ ID NO: 45727 - RNA, 64 nt, Homo Sapiens
cccucuccucuucugucacguaaaggauauuuggcacacucaugcgucauucauucacaaaaca

SEQ ID NO: 45728 - RNA, 64 nt, Homo Sapiens
cgccccgacugcacccggugggacacacucauuacacacucacaaugcucacauggacgcggac

SEQ ID NO: 45729 - RNA, 64 nt, Homo Sapiens
acacacucacacgccccgacuggacgcggacggacacacucauuaccccgucugcaugcucaca

SEQ ID NO: 45730 - RNA, 64 nt, Homo Sapiens
aggacaggcuugucugccagguggaugaggucgucacacucagacgcccccgccugugucaggu

SEQ ID NO: 45731 - RNA, 64 nt, Homo Sapiens
ggccucacugugcugggggcgacagaccacaagccacacucagauauuaacaacucuaacccag

SEQ ID NO: 45732 - RNA, 64 nt, Homo Sapiens
uucuaugagaauguggauuuauggcauugaguaucacacucagcucugcuguguuaacuuugug

SEQ ID NO: 45733 - RNA, 64 nt, Homo Sapiens
uuaucuguacaguugugcaagauaugaaugguuucacacucaaauaaaaaauauugaaacgacc

SEQ ID NO: 45734 - RNA, 64 nt, Homo Sapiens
cucccuugucugaugccccaugcacacacacacucacacucacaugcuucugauacacagccac

SEQ ID NO: 45735 - RNA, 64 nt, Homo Sapiens
cucacacucccuugucugauagccacugcacacacacacucacaccugguugcuucugauacac

SEQ ID NO: 45736 - RNA, 64 nt, Homo Sapiens
cacaugcauacacuuagguucacucaugcacacacacacucacacucguacaugcacaaauaca

SEQ ID NO: 45737 - RNA, 64 nt, Homo Sapiens
cacacacacacucacacacauacaugcacaaauacacacucaugugagugaucuuacucccucg

SEQ ID NO: 45738 - RNA, 64 nt, Homo Sapiens
uacacacacacacacacacuaucacacacacacucacacucacaagcccuaacuuuuaauguac

SEQ ID NO: 45739 - RNA, 64 nt, Homo Sapiens
cucacauacacacacacacaauguacaucacacacacacucacagugcccagcccuaacuuuua

SEQ ID NO: 45740 - RNA, 64 nt, Homo Sapiens
uguuucaaauuggaaccuugaggcuaguuaguaucacacucaggccacacucagcacuugccca

SEQ ID NO: 45741 - RNA, 64 nt, Homo Sapiens
ggaaccuugaggcuaguuaguaucacacucaggccacacucagcacuugcccacucuuguuuac

SEQ ID NO: 45742 - RNA, 64 nt, Homo Sapiens
accgugccucacagggcccagcguuccuggcgggcacacucaggaugugggcacuaacacgugu

SEQ ID NO: 45743 - RNA, 64 nt, Homo Sapiens
uucucaugggcaggcucaggugugcgcagguuugcacacucaagcuggagucuguucucacacc

SEQ ID NO: 45744 - RNA, 64 nt, Homo Sapiens
uuguuaaaagggacaauguggccacuucucuguggaaagggaguugguugggggguugagaugg

SEQ ID NO: 45745 - RNA, 64 nt, Homo Sapiens
uagguuuucauaagcauuguuucuuuaaggcauggaaagggaagaaugcucaagcaagucaugu

SEQ ID NO: 45746 - RNA, 64 nt, Homo Sapiens
gguggagauggguguggcagacuuggauauuacugaaagggaggcuuuggccagaaggaugaau

SEQ ID NO: 45747 - RNA, 64 nt, Homo Sapiens
guaauaccuacuugcagguuucucuucauuaguugaaagggauauuaaccccucugagcccggg

SEQ ID NO: 45748 - RNA, 64 nt, Homo Sapiens
auauccaugucaguuucuuuaucauacaucucuugaaagggaaagccucacaguggguaaauau

SEQ ID NO: 45749 - RNA, 64 nt, Homo Sapiens
agucagggaaggggagaagaggucggggaugggagaaagggaaaucuuccauugugggguaggu

SEQ ID NO: 45750 - RNA, 64 nt, Homo Sapiens
aacgcagaaaagaaaaaaagguuaagcauaaaaagaaagggaaaaagcagaaacacugcagaag

SEQ ID NO: 45751 - RNA, 64 nt, Homo Sapiens
aaagagaacacaccaaaaaagugaaagagaaauugaaagggaaaaaagacaaaaagcauaaggc

SEQ ID NO: 45752 - RNA, 64 nt, Homo Sapiens
cuggcugaggggauaccauaggagugcagagaaagaaagggaaaggaucuggggacugagugug

SEQ ID NO: 45753 - RNA, 64 nt, Homo Sapiens
cccagccgcaggaaggcagaguagaauaaaugaagaaagggagguagaaggauggcaucuccau

SEQ ID NO: 45754 - RNA, 64 nt, Homo Sapiens
augguguacccuuuauuucucaggaauugggagggaaagggagaagaugaagcagugaaagaga

SEQ ID NO: 45755 - RNA, 64 nt, Homo Sapiens
aagaguuguccagagaagacgcccagcccagggggaaagggagcgugugggugcucauagaguu

SEQ ID NO: 45756 - RNA, 64 nt, Homo Sapiens
aauuagguuugaauugcuuuggugggaggaggaagaaagggaagcuugagaagcaggcggguug

SEQ ID NO: 45757 - RNA, 64 nt, Homo Sapiens
aauuagguuugaauugcuuuggugggaggaggaagaaagggaagacugagaagcaggcggguug

SEQ ID NO: 45758 - RNA, 64 nt, Homo Sapiens
cuuuuccuuguauguucuugggugguuccuaagggaaagggaagcacaugaucaugggaaugau

SEQ ID NO: 45759 - RNA, 64 nt, Homo Sapiens
aggaugaaagaaaggucgcagcaguagcuuuggggaaagggaggaagauauggcacuucuccaa

SEQ ID NO: 45760 - RNA, 64 nt, Homo Sapiens
ggcugggguagcccccuccaguacaccccaaagugaaagggauaagagugcagccccagaauag

SEQ ID NO: 45761 - RNA, 64 nt, Homo Sapiens
cucggugauauuuuuucuacgccaaaacagacgggaaagggaacaaaauaaagugaaauccaau

SEQ ID NO: 45762 - RNA, 64 nt, Homo Sapiens
cuccuaaacccacccacuucgcucugaauuuuucgaaagggauuuaagaaggauuaauaauaau

SEQ ID NO: 45763 - RNA, 64 nt, Homo Sapiens
cauccagaauacuaugccucuuaugaauguacuagaaagggacuucugauugcacuuccuuaag

SEQ ID NO: 45764 - RNA, 64 nt, Homo Sapiens
gcacuguguauguuuauaaauuuuuccuuaauuugaaagggacaaguauuugugugugugguuu

SEQ ID NO: 45765 - RNA, 64 nt, Homo Sapiens
cacugccauuuggagacauuuccuagggagggcggaaagggaggggagcugguuauuggugugg

SEQ ID NO: 45766 - RNA, 64 nt, Homo Sapiens
uuugcugaggaaaaggucacuuguaaacagaggagaaagggaaagaguacaaagcccuaaguuu

SEQ ID NO: 45767 - RNA, 64 nt, Homo Sapiens
uuucuuuuuaauuaaaauacaagaagcagcugaggaaagggagacaagguauuuuauuucugac

SEQ ID NO: 45768 - RNA, 64 nt, Homo Sapiens
aguaccccgcauucccaugaauagagccuccaaggaaagggaggaugggguguccuuuguugug

SEQ ID NO: 45769 - RNA, 64 nt, Homo Sapiens
gaauaacuuucaguaguauggcagauggcacagagaaagggaaggggcucuggggacuucuccu

SEQ ID NO: 45770 - RNA, 64 nt, Homo Sapiens
gaggacgcgaggggaaaggcgagugaaggugcuggaaagggaggaggaggaagaaaaacaggcc

SEQ ID NO: 45771 - RNA, 64 nt, Homo Sapiens
gaaagacaagaugcaacuaggaacaagauggauggaaagggaggggggggaugacggggggugg

SEQ ID NO: 45772 - RNA, 64 nt, Homo Sapiens
ggaauggauuccccugccuggccuucagaugccagaaagggaaacaggggccaugaaugccgca

SEQ ID NO: 45773 - RNA, 64 nt, Homo Sapiens
gugcagauguauguaaguuauaccuucuguggcagaaagggacauccucagaaccugugacugu

SEQ ID NO: 45774 - RNA, 64 nt, Homo Sapiens
ccugcagcguccggcugaccgcaagaggaacaaagaaagggacuuucucuccccugggccaggu

SEQ ID NO: 45775 - RNA, 64 nt, Homo Sapiens
cggagcugggaaacccacgguccugggcaaaacugaaagggaccacucccuguugucccuucca

SEQ ID NO: 45776 - RNA, 64 nt, Homo Sapiens
gggugcagacggcagggccaguguguuuaguggggaaagggacggaacccaggauaggaaaugg

SEQ ID NO: 45777 - RNA, 64 nt, Homo Sapiens
aagcugggcuguguggucccgggggaggagaggagaaagggaggaggcaggucagagcagugca

SEQ ID NO: 45778 - RNA, 64 nt, Homo Sapiens
uuuugcauugcagagauuuucuagccacggggaugaaagggaucacaguugggcuuuguucauu

SEQ ID NO: 45779 - RNA, 64 nt, Homo Sapiens
uggccagugguuuaaguaccaguucuuuuucagagaaagggacucagggcaguuagccagcuca

SEQ ID NO: 45780 - RNA, 64 nt, Homo Sapiens
cgcaauuguuuuguuuucauuucuuguagucuaacccuuuuaaugccuuuaccucaaguugcuu

SEQ ID NO: 45781 - RNA, 64 nt, Homo Sapiens
auuuuagaguucauuccauuggggaauuuucuuucccuuuuauucuacccccacuaccgccuuu

SEQ ID NO: 45782 - RNA, 64 nt, Homo Sapiens
ugaaguauagaauuugacucauacuuggaaaaagcccuuuuaacuuuuaucuuuuauucauuga

SEQ ID NO: 45783 - RNA, 64 nt, Homo Sapiens
auguguuuggagaaggcugcaugacuuuguuuuucccuuuuagcaaaacuaaauaaaguuguca

SEQ ID NO: 45784 - RNA, 64 nt, Homo Sapiens
caacaacaaaaaaccagugaaauucuacaagugucccuuuuaaaaauagugugugcuaacuaag

SEQ ID NO: 45785 - RNA, 64 nt, Homo Sapiens
uagauuaagugcuuaguuuuauuccuaauucugccccuuuuaaccugauguguaccuuacucuu

SEQ ID NO: 45786 - RNA, 64 nt, Homo Sapiens
auuuguuuuaaugauuuugccuuaauuuuucugucccuuuuauaguccagaaugauguuugauu

SEQ ID NO: 45787 - RNA, 64 nt, Homo Sapiens
gcacuuuagcacaggcaauggcccccaagaaagucccuuuuauacugaaugcuuuuuuuuuuug

SEQ ID NO: 45788 - RNA, 64 nt, Homo Sapiens
guuggauuuuuuuauauaaauuagagcgucaauucccuuuuauucuuacauucucuugccaaaa

SEQ ID NO: 45789 - RNA, 64 nt, Homo Sapiens
cuuuuauaauuuguguccuguauaugcccuuggacccuuuuauaaauuauuuuugcuuauugag

SEQ ID NO: 45790 - RNA, 64 nt, Homo Sapiens
cuuccaauuuauaaucaagaaggggcucuggauccccuuuuaaauuacacacacucucacacac

SEQ ID NO: 45791 - RNA, 64 nt, Homo Sapiens
cauucuuuuuuaguggagugaaaguucugaagcccccuuuuaacuuccucuugguuuuucauua

SEQ ID NO: 45792 - RNA, 64 nt, Homo Sapiens
uuguaagcauucaauaagaagauguauacauugucccuuuuacaaaguagauauugguuuaaag

SEQ ID NO: 45793 - RNA, 64 nt, Homo Sapiens
uuuaggauauuguuuggaaauuguuuguuuuuuucccuuuuauuuguggaaggaagaaaggaua

SEQ ID NO: 45794 - RNA, 64 nt, Homo Sapiens
cacugguuuucaggaaaauguuccugucccugaccccuuuuagagcugggcugccuggggggag

SEQ ID NO: 45795 - RNA, 64 nt, Homo Sapiens
ucuuacccuuggaggcuguguggggaauuuccagcccuuuuaugccugugugaucccaccccac

SEQ ID NO: 45796 - RNA, 64 nt, Homo Sapiens
agaguuggggcccugagacugggguagcaacccccccuuuuaucuuuuaagaccuucccuuccu

SEQ ID NO: 45797 - RNA, 64 nt, Homo Sapiens
cuaaauaggggagaucccagccuccacaaagaggcccuuuuauuuuuuauucugauuagccauu

SEQ ID NO: 45798 - RNA, 64 nt, Homo Sapiens
gcauccggaagugauaacacagguuuuuuucccccccuuuuagaaaaaagcauaucguuuauug

SEQ ID NO: 45799 - RNA, 64 nt, Homo Sapiens
caaaguccuagcuuaacccucccuuuuaauaagacccuuuuacucuguucgcuccccuaacucg

SEQ ID NO: 45800 - RNA, 64 nt, Homo Sapiens
aagacccuuuuacucaaagugcuccccuaacucgcccuuuuaauaagcuccuccgagacuguuc

SEQ ID NO: 45801 - RNA, 64 nt, Homo Sapiens
uccaugugcuuuucgcagcccauccgauucagcccccuuuuauucacucagcuguuacauuuca

SEQ ID NO: 45802 - RNA, 64 nt, Homo Sapiens
ugaauccuaucaauuauucucuucuuuccucgcccccuuuuaucacgggcuuguagcaccucag

SEQ ID NO: 45803 - RNA, 64 nt, Homo Sapiens
uucccaugucuacagcuagagaacucuuugggaucccuuuuauaagggcaccaaucccauucau

SEQ ID NO: 45804 - RNA, 64 nt, Homo Sapiens
gccuuuaaugaucugggcccaggaugauuuccugcccuuuuaucauggguggaauuuuuuuuuc

SEQ ID NO: 45805 - RNA, 64 nt, Homo Sapiens
uuguuuuuccuuuugacuccccuuucucauuagccccuuuuaaucucucugucucaucucuccu

SEQ ID NO: 45806 - RNA, 64 nt, Homo Sapiens
uguuuuucuuuggucuuuagagcaaguaagcugucccuuuuaacaaguuaaaccugagacagag

SEQ ID NO: 45807 - RNA, 64 nt, Homo Sapiens
ugcaaaaguuucaauaaaaauuauuuuccaaagaguaauagacacaauaggauggagcuguuaa

SEQ ID NO: 45808 - RNA, 64 nt, Homo Sapiens
uccagcuaaauuggucuaaaugaauguggguuaaguaauagauuagacaagacuaugauaucaa

SEQ ID NO: 45809 - RNA, 64 nt, Homo Sapiens
ugugagauuugcauuuuacuuugcugacuuuguuguaauagaucccauucauuguccccuuugg

SEQ ID NO: 45810 - RNA, 64 nt, Homo Sapiens
gaguugcuuuugcguuucucaugccuaggcaaguguaauagaaauuauguagcuccuuauguug

SEQ ID NO: 45811 - RNA, 64 nt, Homo Sapiens
uaaaagauaccuuuuguaaaguugucaucucucuguaauagauaauggcugacuggaccauagu

SEQ ID NO: 45812 - RNA, 64 nt, Homo Sapiens
gaauuuuuuagauacuaucauuagguuggauaugguaauagauauauuucagaauagcaagugg

SEQ ID NO: 45813 - RNA, 64 nt, Homo Sapiens
ccaaauuagggaaguuuggcaaugcaaaaauuauguaauagauagauguauaaugaaaaaggau

SEQ ID NO: 45814 - RNA, 64 nt, Homo Sapiens
aucugauagaccagcacuucuguugaucuguaauguaauagaaaauucaucugaacuggaccag

SEQ ID NO: 45815 - RNA, 64 nt, Homo Sapiens
auuugcugauaccaacuuuugcacauuuuuguuagcuuuacauugcauugcaauauggaauuuu

SEQ ID NO: 45816 - RNA, 64 nt, Homo Sapiens
guuuaucccuguagagaucaugauugagcuucaggcuuuacaacugagaguuuccaacaucagu

SEQ ID NO: 45817 - RNA, 64 nt, Homo Sapiens
uacauaguacuuuuuaacaacaaacuugucaggugcuuuacaacagcuaagaaauauaccuaca

SEQ ID NO: 45818 - RNA, 64 nt, Homo Sapiens
ucaacugaaaaagaaacuagucuuaaauuccaaagcuuuacauuucuguaugcaggugugccug

SEQ ID NO: 45819 - RNA, 64 nt, Homo Sapiens
uuaugucacuaauaaugaguaguaacccaauuuagcuuuacaaagauuuuuucuauuacuuuuu

SEQ ID NO: 45820 - RNA, 64 nt, Homo Sapiens
guggcuaaaaccccacaauaacuuuacauuccuagcuuuacagucuugcugugaauucucuggu

SEQ ID NO: 45821 - RNA, 64 nt, Homo Sapiens
uuccucuaaccgugggccccagcagaacugcugagcuuuacaugguauccaugacaacugcuga

SEQ ID NO: 45822 - RNA, 64 nt, Homo Sapiens
agacuccaggagggguauagauugugccgucauagcuuuacaggugguuuuaaaguuaacaggg

SEQ ID NO: 45823 - RNA, 64 nt, Homo Sapiens
ccacgcuagguguuuugacauguuuaguguuucugcuuuacagugcugaauuccauauuuuaga

SEQ ID NO: 45824 - RNA, 64 nt, Homo Sapiens
auuauuuuaugucuagaguagguccugaaguuuggcuuuacauuaaguuuagcacuguaucaga

SEQ ID NO: 45825 - RNA, 64 nt, Homo Sapiens
auugcuccagaucuggaaugauaguuguuuuccugcuuuacaaacuaagaagcuacagauuguc

SEQ ID NO: 45826 - RNA, 64 nt, Homo Sapiens
uuccuuugaccaaauaguuuugugcuuuuauuuagcuuuacauaugccaugaauuucuaccaga

SEQ ID NO: 45827 - RNA, 64 nt, Homo Sapiens
uuacgaauaaaaaacuggauucugguuuacagcagcuuuacagugauaguuaaauuaacugggg

SEQ ID NO: 45828 - RNA, 64 nt, Homo Sapiens
gcaguggcuucuaggaaacugggaguuuagaucagcuuuacagauacaucgaucagaggcuaaa

SEQ ID NO: 45829 - RNA, 64 nt, Homo Sapiens
caguacaaugccaccaguaguacgaugagccgaagcuuuacauugugagaguagcaaguccagg

SEQ ID NO: 45830 - RNA, 64 nt, Homo Sapiens
ugaaaguaguuuuugcugaguguauacauuuuuggcuuuacaguuucuuucagugcuuuaaaga

SEQ ID NO: 45831 - RNA, 64 nt, Homo Sapiens
cugcagugaguauaaauucacuugucaccucagugcuuuacaguuugaaguggucacuuaccug

SEQ ID NO: 45832 - RNA, 64 nt, Homo Sapiens
uggucacuuaccugaugguucccacaagccuuaggcuuuacaggguuguaucauugacuuaaaa

SEQ ID NO: 45833 - RNA, 64 nt, Homo Sapiens
aucaaguuccauaauucauuuguugucugccugauccaaucauuugauauuaggacugaucagg

SEQ ID NO: 45834 - RNA, 64 nt, Homo Sapiens
aauuauacguuauauguaguuuuuaaauccaggauccaaucaaguauccuuuauagcuguuuau

SEQ ID NO: 45835 - RNA, 64 nt, Homo Sapiens
ggugcuuuccuuacccgagagguauuuugccuguuccaaucaaaccaccccauucagguccauc

SEQ ID NO: 45836 - RNA, 64 nt, Homo Sapiens
ggagguaaaguugacuucuccucgugggcaguuuuccaaucaccuugugaguagacaccugcca

SEQ ID NO: 45837 - RNA, 64 nt, Homo Sapiens
aggaaagauuuauuuaaaauauuucaaaacuauuuccaaucacaaccuccaaucaguuuacuuc

SEQ ID NO: 45838 - RNA, 64 nt, Homo Sapiens
uuacuucauuucaaaacuaucagcugugacaaccuccaaucagucuuggcauaauucacaaaag

SEQ ID NO: 45839 - RNA, 64 nt, Homo Sapiens
ucaugccucacuacccucugcccucauuacaagauccaaucauacagaucaagccuccugaauc

SEQ ID NO: 45840 - RNA, 64 nt, Homo Sapiens
uugagcccuggcgugauccaggcaugauccuugauccaaucagauuaagaaguggacaccacgu

SEQ ID NO: 45841 - RNA, 64 nt, Homo Sapiens
uuuuaaaguaacacaccacaccacuuagaaguauuauaguaaucaauuuaguaauucacaacau

SEQ ID NO: 45842 - RNA, 64 nt, Homo Sapiens
aaaauuggauucaugaagaauuaucagaacugccuauaguaaccucucaagcuucucucucaac

SEQ ID NO: 45843 - RNA, 64 nt, Homo Sapiens
ggauagccacauuaaugaauuggugcugucaaaauauaguaauuuuuaaauuuguuaauaauga

SEQ ID NO: 45844 - RNA, 64 nt, Homo Sapiens
cagcaugacuucuuuuaacuuggauuccuuuguauauaguaaaguuuaguauauauauauuuuu

SEQ ID NO: 45845 - RNA, 64 nt, Homo Sapiens
uuguaaacugcuuggcaaaccucuauuacguuuguauaguaaguccgagccuccggagaauuaa

SEQ ID NO: 45846 - RNA, 64 nt, Homo Sapiens
uaaaacucccuaccuugcuuacgguugugcuguuuauaguaaaauugcuuaaugaagacauuua

SEQ ID NO: 45847 - RNA, 64 nt, Homo Sapiens
gguaaaugauuguacuuauuaauuuaagucaagauauaguaaaucuuuuaauauuucuacauaa

SEQ ID NO: 45848 - RNA, 64 nt, Homo Sapiens
uuacuaugcaagcuguuuacuaguuugauauaauuauaguaaaaggaaaaugucuauauauuuu

SEQ ID NO: 45849 - RNA, 64 nt, Homo Sapiens
auuuuacauaaaaacuaauacuuucaauuuuuuauauaguaauauccccauuuuguaaauguua

SEQ ID NO: 45850 - RNA, 64 nt, Homo Sapiens
aaugcacuguauucuuacaguuaauguuuauaacuauaguaaaaaauuaauauauauccuauua

SEQ ID NO: 45851 - RNA, 64 nt, Homo Sapiens
gcaaugucuauuucagggauaguuucauaguuucuauaguaaagugaauuucugaacggaucag

SEQ ID NO: 45852 - RNA, 64 nt, Homo Sapiens
caugaaaaaaugcuacuccaaaaggaauggaaaauauaguaacauaucuuacuggguugacugg

SEQ ID NO: 45853 - RNA, 64 nt, Homo Sapiens
auugacuaaagccauuugucucauucauucacuguauaguaaucugacuauuaaauguugcaca

SEQ ID NO: 45854 - RNA, 64 nt, Homo Sapiens
cuaugagcaacuccuuacuuuucuaauucuucauuauaguaaaucucauuuuacuaaaaucgua

SEQ ID NO: 45855 - RNA, 64 nt, Homo Sapiens
caagucuauuugaaauagaaaacugucuauuuaauauaguaaaaucaaugcucccuuaauguug

SEQ ID NO: 45856 - RNA, 64 nt, Homo Sapiens
aggagauugauucauaauucacaugucaauuuuuuauaguaauauguacuucuaauuuauuauu

SEQ ID NO: 45857 - RNA, 64 nt, Homo Sapiens
aauaaauuaacuuuucuguaauuagauuguguuuuauaguaauucuugccugcuucuuagucuu

SEQ ID NO: 45858 - RNA, 64 nt, Homo Sapiens
acucugaaguaaacaaccguuaaguggacauguuuauaguaaauuagauagcaauaaaauaaca

SEQ ID NO: 45859 - RNA, 64 nt, Homo Sapiens
aagcacucauuauauaugcauugacauucgcuacuauaguaaccgacuuuuuuuagcaauuagu

SEQ ID NO: 45860 - RNA, 64 nt, Homo Sapiens
uccauuuuuuucccuugaaaagcagauuuuaaaauauaguaacaauuuauacacuuuuuuauaa

SEQ ID NO: 45861 - RNA, 64 nt, Homo Sapiens
uguuauguaguacaguuuuaauauuuuguaguaguauaguaaugcagugcauuuauagagaagg

SEQ ID NO: 45862 - RNA, 64 nt, Homo Sapiens
agaaggugcuggaaggcuggcagccgucagggucucagcuaagcaggguugugaggcaaacuuc

SEQ ID NO: 45863 - RNA, 64 nt, Homo Sapiens
auuacugagcaccuguuuggauucaguccuuucuucagcuaaugccccagccuuuggagcguuc

SEQ ID NO: 45864 - RNA, 64 nt, Homo Sapiens
gaccugccaacagcauuacagggagauucuuugcucagcuaacacauuucuguuuuucaaaauu

SEQ ID NO: 45865 - RNA, 64 nt, Homo Sapiens
uucauaaguuuuacaaucaaguauagaggggucuucagcuaacuuaguuauacauaaaugcuga

SEQ ID NO: 45866 - RNA, 64 nt, Homo Sapiens
cagaagaggggagagaguaccuucuucaagcugcucagcuaaccugucuggucgggggauuccu

SEQ ID NO: 45867 - RNA, 64 nt, Homo Sapiens
ucucauuaugugucuuaaaucauccuagaguuccucagcuaaccuguuguuugcaauggcagag

SEQ ID NO: 45868 - RNA, 64 nt, Homo Sapiens
auaacaacaacaguuacuauaaccuuuguguggcuccugguaacuggcuccaccuugauggguc

SEQ ID NO: 45869 - RNA, 64 nt, Homo Sapiens
guggcuccaccuugauggguagccuucguguggcuccugguaacguccuccacuuugcugguuc

SEQ ID NO: 45870 - RNA, 64 nt, Homo Sapiens
gcaaggccuccuggauccaacaucaguauuccucuccugguaccucccauucgccagauggaac

SEQ ID NO: 45871 - RNA, 64 nt, Homo Sapiens
cccucaccuaugccugaaagcucccccuuaaauuuccugguacccugcccccaggaaaaagagu

SEQ ID NO: 45872 - RNA, 64 nt, Homo Sapiens
ccagggucuggggagagcaacagcaccaggcuuuuccugguaguuggauugguacauucacugc

SEQ ID NO: 45873 - RNA, 64 nt, Homo Sapiens
accaaaauauguaauuuuaaaaaacuaaaacacauccugguagucccagugauguguaaaugag

SEQ ID NO: 45874 - RNA, 64 nt, Homo Sapiens
gaagacaggggauucuacuccuuucaccucaggcuccugguagaggauggaggagacgggacau

SEQ ID NO: 45875 - RNA, 64 nt, Homo Sapiens
ccacauccucuccuccgggaccugaagggaaccauccugguaccgggagaagggcuugggguga

SEQ ID NO: 45876 - RNA, 64 nt, Homo Sapiens
acacuguuguacaagaugucagcuuugcugaaacgcacauuaccuggaauaagugcuuuaauug

SEQ ID NO: 45877 - RNA, 64 nt, Homo Sapiens
ugacugugucucuugaacauacuuaggauauucugcacauuauggaaaaagguaaauuuuagaa

SEQ ID NO: 45878 - RNA, 64 nt, Homo Sapiens
uuuauaauugcacaugugcaugaagccugugguagcacauuauguaucuuuaacagcucuuugu

SEQ ID NO: 45879 - RNA, 64 nt, Homo Sapiens
acuaaaggaauccccucaauacuaaucucacuuggcacauuauauucuaagccuccuguugguu

SEQ ID NO: 45880 - RNA, 64 nt, Homo Sapiens
cuugcuuggggaacuugugucccuaauguguuuagauugcuagauugcuaaggagcugauacuu

SEQ ID NO: 45881 - RNA, 64 nt, Homo Sapiens
gggaacuugugucccuaauguguuuagauugcuagauugcuaaggagcugauacuuugacagug

SEQ ID NO: 45882 - RNA, 64 nt, Homo Sapiens
aacuguuacuuugugaauuaaucaccagcacacagauugcuauaguaggaucuuguuuuguuuu

SEQ ID NO: 45883 - RNA, 64 nt, Homo Sapiens
uggaggccuuccagcugcugacagagcuguggaggauugcuaucggucccccucagcaagcccu

SEQ ID NO: 45884 - RNA, 64 nt, Homo Sapiens
gaguucauaaggaggugagaaguaguaacuggccgauugcuaaaggaaagacaaauucaucugu

SEQ ID NO: 45885 - RNA, 64 nt, Homo Sapiens
ugcaugggggaaagcaguggguucauuuacgugagauugcuaaaugcagaaguuugaaaaccag

SEQ ID NO: 45886 - RNA, 64 nt, Homo Sapiens
accagaagugccaugcucagaaauguugguuacaugaaugaaugaaccaugaaugaaugaaauc

SEQ ID NO: 45887 - RNA, 64 nt, Homo Sapiens
gaagugccaugcucagaaauguugguuacaugaaugaaugaaccaugaaugaaugaaaucucug

SEQ ID NO: 45888 - RNA, 64 nt, Homo Sapiens
cucagaaauguugguuacaugaaugaaugaaccaugaaugaaugaaaucucuguccgugugcug

SEQ ID NO: 45889 - RNA, 64 nt, Homo Sapiens
gugauuaccaccaacuuucugacuaagcuaaaaaugaaugaaaaugguggcuaaagaaaauagg

SEQ ID NO: 45890 - RNA, 64 nt, Homo Sapiens
uguggaagaauguucaaguugaauccuaaugccgugaaugaaacacagucuguguagggaauga

SEQ ID NO: 45891 - RNA, 64 nt, Homo Sapiens
acucuuuuaaggguauuuuaaaaauuaguaaauuugaaugaacuaaagauauaucucuaccuuc

SEQ ID NO: 45892 - RNA, 64 nt, Homo Sapiens
uuaguucauucagauuuacuaauuuugguaaaucugaaugaacuaaagauguaucuguaccuuc

SEQ ID NO: 45893 - RNA, 64 nt, Homo Sapiens
auaauuuuuaaguuaugcccauuuaacuucaucaugaaugaacugucuuacucaaguacuagua

SEQ ID NO: 45894 - RNA, 64 nt, Homo Sapiens
cauauuaauaacugcauuuuaauauagguuuaacugaaugaagcguaacaggaauauuuugcag

SEQ ID NO: 45895 - RNA, 64 nt, Homo Sapiens
aggaagaaaacuguggguaaacugacugaaugaaugaaugaauggcucaauuacuauuugacug

SEQ ID NO: 45896 - RNA, 64 nt, Homo Sapiens
aaugaggaagaaaacuguggacugacugacugaaugaaugaaugaggugcucaauuacuauuug

SEQ ID NO: 45897 - RNA, 64 nt, Homo Sapiens
aaugaaugaggaagaaaacuuuugacugacugacugaaugaaugcaggaggugcucaauuacua

SEQ ID NO: 45898 - RNA, 64 nt, Homo Sapiens
aauaagugaguaugcuugggacaucuuucuugaaugaaugaaagguggaggguuugcacuccac

SEQ ID NO: 45899 - RNA, 64 nt, Homo Sapiens
aaagaauaagugaguaugcuccacacaucuuucuugaaugaaugccagguggaggguuugcacu

SEQ ID NO: 45900 - RNA, 64 nt, Homo Sapiens
uaaauguugauuaggaacaauaaauagauaccacugaaugaaauaggagguaucuagcaaugga

SEQ ID NO: 45901 - RNA, 64 nt, Homo Sapiens
aucuucguacaugaauaauauauucauugaauaaugaaugaaccaagugggaauguuuaauaaa

SEQ ID NO: 45902 - RNA, 64 nt, Homo Sapiens
auuauauacauuugcuaucacuuuccaagaagucugaaugaauuaucccagauugcuaaauguu

SEQ ID NO: 45903 - RNA, 64 nt, Homo Sapiens
ugcuuuugaauuuuguuauguagauacguguuccugaaugaagccccgcuguuacacagguguu

SEQ ID NO: 45904 - RNA, 64 nt, Homo Sapiens
gaacuuuacuugcugauuuucuuuuauuuuucacugaaugaaguuugugcuugaaugaagagug

SEQ ID NO: 45905 - RNA, 64 nt, Homo Sapiens
uuucuuuuauuuuucacugaaugaaguuugugcuugaaugaagaguguaucuuaaacccccuuu

SEQ ID NO: 45906 - RNA, 64 nt, Homo Sapiens
uggaauuaaaugacgguaaaauuggcuaauuauuugaaugaaugaauggauggauguuuugcau

SEQ ID NO: 45907 - RNA, 64 nt, Homo Sapiens
auuaaaugacgguaaaauuggcuaauuauuugaaugaaugaauggauggauguuuugcaugcuc

SEQ ID NO: 45908 - RNA, 64 nt, Homo Sapiens
gugguaggugcucaguaaauguguguugaauaaaugaaugaaugaaugaacaaaugaaugaauu

SEQ ID NO: 45909 - RNA, 64 nt, Homo Sapiens
uaggugcucaguaaauguguguugaauaaaugaaugaaugaaugaacaaaugaaugaauuugcu

SEQ ID NO: 45910 - RNA, 64 nt, Homo Sapiens
ugcucaguaaauguguguugaauaaaugaaugaaugaaugaacaaaugaaugaauuugcuuacu

SEQ ID NO: 45911 - RNA, 64 nt, Homo Sapiens
guguguugaauaaaugaaugaaugaaugaacaaaugaaugaauuugcuuacuucaaggcaaaag

SEQ ID NO: 45912 - RNA, 64 nt, Homo Sapiens
agacuagaaauguaucuaaauugggggaacagaaugaaugaauuaaugaaugagaguuccuuug

SEQ ID NO: 45913 - RNA, 64 nt, Homo Sapiens
gccuacaggauaaggaaguucacagccugcggggugaaugaacccaugugugaacugcacagag

SEQ ID NO: 45914 - RNA, 64 nt, Homo Sapiens
ggagacucugucucaaaaaaaaaaaaaaaaaagaugaaugaaaauaugaaauauauaaacuagu

SEQ ID NO: 45915 - RNA, 64 nt, Homo Sapiens
cagauuauaccuggaugauucaggagaguguauaugaaugaauaaagcauccaaguauauauga

SEQ ID NO: 45916 - RNA, 64 nt, Homo Sapiens
guguauaugaaugaauaaagcauccaaguauauaugaaugaauaaaguauguaaguaucaccag

SEQ ID NO: 45917 - RNA, 64 nt, Homo Sapiens
cccaaaaggcagaagcaacccaaauguucaucaaugaaugaaugaauggcuaagcaaaauguga

SEQ ID NO: 45918 - RNA, 64 nt, Homo Sapiens
aaaggcagaagcaacccaaauguucaucaaugaaugaaugaauggcuaagcaaaaugugauaug

SEQ ID NO: 45919 - RNA, 64 nt, Homo Sapiens
ggugccuagcacacaguaggcgcucaauaaauguugaaugaaugaaugauuuaaucaagacuug

SEQ ID NO: 45920 - RNA, 64 nt, Homo Sapiens
ccuagcacacaguaggcgcucaauaaauguugaaugaaugaaugauuuaaucaagacuugauca

SEQ ID NO: 45921 - RNA, 64 nt, Homo Sapiens
uuauuguggaaucuuugaaaggacaaggccucugugaaugaaucagucccagggaagcauuugg

SEQ ID NO: 45922 - RNA, 64 nt, Homo Sapiens
auuguaaaucuuugcuaaguaguguuuuccuuggugaaugaagucauuguugucuucaagugua

SEQ ID NO: 45923 - RNA, 64 nt, Homo Sapiens
gcaaugacucgaaguuugcaguauggagaacaggugaaugaaauccugugccguucuucagucu

SEQ ID NO: 45924 - RNA, 64 nt, Homo Sapiens
uacacauuaguauguauaacuggcuuuaccaaauugaaugaaaaggagcuugugcaaaaaaauu

SEQ ID NO: 45925 - RNA, 64 nt, Homo Sapiens
acaugaaaaaucauaaucugacuaauuuugggacugaaugaauaaguacaagagguuggauuuu

SEQ ID NO: 45926 - RNA, 64 nt, Homo Sapiens
ugaagucaugaccaacaacacuguaacucaugccugaaugaagcuuaucugacacauaagcuuc

SEQ ID NO: 45927 - RNA, 64 nt, Homo Sapiens
ggugucacccuccucccccucagucaguaugcccugaaugaaugggaugaggacgugucuauca

SEQ ID NO: 45928 - RNA, 64 nt, Homo Sapiens
guucugcugcuaaaaaaaaagguaaggcuucauuugaaugaagguuuuccaugacccaguccug

SEQ ID NO: 45929 - RNA, 64 nt, Homo Sapiens
ucccagccaagggccucggggagcguucuaaauaugaaugaaugggauauuuugaaaugaacuu

SEQ ID NO: 45930 - RNA, 64 nt, Homo Sapiens
uucuuugcaauacugcuuaauugcugauaccauaugaaugaaacaugggcugugauuacugcaa

SEQ ID NO: 45931 - RNA, 64 nt, Homo Sapiens
ccuugcauguaacaagcacuccagaaauguuuguugaaugaaugaauggugucaugggugaaug

SEQ ID NO: 45932 - RNA, 64 nt, Homo Sapiens
gcauguaacaagcacuccagaaauguuuguugaaugaaugaauggugucaugggugaaugaugg

SEQ ID NO: 45933 - RNA, 64 nt, Homo Sapiens
uggauugcuguuaacuagaaaaauagggaaugaaugaaugaauagcuaugauauauuuauuaua

SEQ ID NO: 45934 - RNA, 64 nt, Homo Sapiens
aauauggauugcuguuaacuuauaaaauagggaaugaaugaaugcacugcuaugauauauuuau

SEQ ID NO: 45935 - RNA, 64 nt, Homo Sapiens
aacaaguuuacccagccugcuuugcuuuacugcaugaaugaaacugaugguucaauuucagaag

SEQ ID NO: 45936 - RNA, 64 nt, Homo Sapiens
aaacaaaacaaaaaucuguguaacuguaaaacauugaaugaaacuauuuuaccugaacuagauu

SEQ ID NO: 45937 - RNA, 64 nt, Homo Sapiens
gauuuuuuguuguuuuugcagaggcaauucugaaugaaugaauggaagggagggggcaggggag

SEQ ID NO: 45938 - RNA, 64 nt, Homo Sapiens
aauggauuuuuuguuguuuuggaggaggcaauucugaaugaauggggggaagggagggggcagg

SEQ ID NO: 45939 - RNA, 64 nt, Homo Sapiens
cauggcuggcacauuguuggcacucaacaaugguugaaugaauaaaacaauaaaugaaugaaua

SEQ ID NO: 45940 - RNA, 64 nt, Homo Sapiens
cacucaacaaugguugaaugaauaaaacaauaaaugaaugaauaacuaagauauagaaacucuc

SEQ ID NO: 45941 - RNA, 64 nt, Homo Sapiens
ggauaagaaaaaauauauauugcucuucaacuagugaaugaaagaaacuucagaaagcuagaau

SEQ ID NO: 45942 - RNA, 64 nt, Homo Sapiens
aaaaacuaaacuaucagucauuuacauccucucaugaaugaaaugcaguguagggagaggagau

SEQ ID NO: 45943 - RNA, 64 nt, Homo Sapiens
uauggacguaauugcagaaggaacuucaaggagaugaaugaaugcuaaaaggguucuugacuga

SEQ ID NO: 45944 - RNA, 64 nt, Homo Sapiens
augccuuuccgaaaacugguuucuaguaaagccuugaaugaacacacacacacacacacacaca

SEQ ID NO: 45945 - RNA, 64 nt, Homo Sapiens
agaaguguuugcccacacagaaaguuccuggcuuugaaugaaccgagucccucuggaaccauau

SEQ ID NO: 45946 - RNA, 64 nt, Homo Sapiens
ggaguaggaaggaaaauggauauauaugauuauuugaaugaagauuuuuccagcuuuaagugcc

SEQ ID NO: 45947 - RNA, 64 nt, Homo Sapiens
cuuggggacuuuucccauauauuucacacuggagugaaugaaguuguacuucauuucuagagaa

SEQ ID NO: 45948 - RNA, 64 nt, Homo Sapiens
aaaaaaagagugaauguaauagucuugcagaaaaugaaugaauaccuuuguucaauaaaggaaa

SEQ ID NO: 45949 - RNA, 64 nt, Homo Sapiens
uugagucuuucuuaaucuaggcaacagaugugaaugaaugaaagaugauuaggaaaugugaggg

SEQ ID NO: 45950 - RNA, 64 nt, Homo Sapiens
aaaguugagucuuucuuaauaggggcaacagaugugaaugaaugaucuaugauuaggaaaugug

SEQ ID NO: 45951 - RNA, 64 nt, Homo Sapiens
agagcugccuuugauaaaugugcuguuaaacacuugaaugaagagaaugguggcagaaugagug

SEQ ID NO: 45952 - RNA, 64 nt, Homo Sapiens
aaagguuuugguauuugcccacuucuagauagaaugaaugaaaacaacacaagcguuuuaugag

SEQ ID NO: 45953 - RNA, 64 nt, Homo Sapiens
uguaauuaugcauccuagcuaaggcacagaagacugaaugaaugcaaggauucauuaacucuuu

SEQ ID NO: 45954 - RNA, 64 nt, Homo Sapiens
uggucugucauuauauugcaaaauauuuuuccucugaaugaaauuaucacagguugucucaagc

SEQ ID NO: 45955 - RNA, 64 nt, Homo Sapiens
cacgcagcaaaauucuccucaagaagucugugccugaaugaauaauguggcaugguacaagaua

SEQ ID NO: 45956 - RNA, 64 nt, Homo Sapiens
cauacccuauuagauagcucacuauggauaggccugaaugaagucaggcuucuguuuucagagu

SEQ ID NO: 45957 - RNA, 64 nt, Homo Sapiens
uuuaacauaugguagacauucaguaaauguuuguugaaugaaugcaugucuucuaaaaguuuuc

SEQ ID NO: 45958 - RNA, 64 nt, Homo Sapiens
ccugcucucuccuguugcucugggauugcacuucugaaugaaguagcagcucauaagcuuuugc

SEQ ID NO: 45959 - RNA, 64 nt, Homo Sapiens
uguggcacaaaaucuguucaaaugacaaacccuuugaaugaaauuccagcacaaucauaaagug

SEQ ID NO: 45960 - RNA, 64 nt, Homo Sapiens
uuuuacauaagaaauuauuaaaaucuuuuggguuugaaugaagguuuccccccaaguuagucuu

SEQ ID NO: 45961 - RNA, 64 nt, Homo Sapiens
aggcaugaauaugcggcagagaaaacagcaauagugaaugaaugcaaaaggugcugagaaauuc

SEQ ID NO: 45962 - RNA, 64 nt, Homo Sapiens
ucaacuucaaugucaucuucuccaugaagaccacugaaugaacaccuuuucauccagccuuaau

SEQ ID NO: 45963 - RNA, 64 nt, Homo Sapiens
gagcuucuuacauggcuccaaauggucaaauaagugaaugaaugaauggacagaaaauucaauc

SEQ ID NO: 45964 - RNA, 64 nt, Homo Sapiens
uucuuacauggcuccaaauggucaaauaagugaaugaaugaauggacagaaaauucaauccuuu

SEQ ID NO: 45965 - RNA, 64 nt, Homo Sapiens
gugcccucucacuuuaggcagcuugcacuauucuugaaugaaugaagaauuauuuccucauuug

SEQ ID NO: 45966 - RNA, 64 nt, Homo Sapiens
ccucucacuuuaggcagcuugcacuauucuugaaugaaugaagaauuauuuccucauuuggaag

SEQ ID NO: 45967 - RNA, 64 nt, Homo Sapiens
aggggugccaggagacugcuagguacugaaugaaugaaugaacacucaaagccuagcacauagu

SEQ ID NO: 45968 - RNA, 64 nt, Homo Sapiens
aacaaggggugccaggagacuaguagguacugaaugaaugaauguauccucaaagccuagcaca

SEQ ID NO: 45969 - RNA, 64 nt, Homo Sapiens
aaugaacaaggggugccaggcacauaguagguacugaaugaaugguuauauccucaaagccuag

SEQ ID NO: 45970 - RNA, 64 nt, Homo Sapiens
gcucagcugaggaauguaacaaugacugaaugaaugaaugaauguuucaguaagugggugaaug

SEQ ID NO: 45971 - RNA, 64 nt, Homo Sapiens
aauggcucagcugaggaaugaaugaaugacugaaugaaugaaugcagcuuucaguaagugggug

SEQ ID NO: 45972 - RNA, 64 nt, Homo Sapiens
aaugaauggcucagcugaggggugaaugaaugacugaaugaauguaggcagcuuucaguaagug

SEQ ID NO: 45973 - RNA, 64 nt, Homo Sapiens
acugaaugaaugaaugaauguuucaguaagugggugaaugaauggagccuggcacuuaggcagc

SEQ ID NO: 45974 - RNA, 64 nt, Homo Sapiens
cugaauuuaagacggugauguuucccaguuuacaugaaugaagucacuaaauaggagauucgag

SEQ ID NO: 45975 - RNA, 64 nt, Homo Sapiens
ucagacgcuguaacccggcaauccugucauuucgugaaugaaucacaucugcaaccaaaucagc

SEQ ID NO: 45976 - RNA, 64 nt, Homo Sapiens
ggagagaaggaaaccugaggaguaguguuccuccugaaugaagguucaggucaccagccuucug

SEQ ID NO: 45977 - RNA, 64 nt, Homo Sapiens
guaagagggcccauauucauucuuugccaugaaaugaaugaauuaggaagauuguauuuacuua

SEQ ID NO: 45978 - RNA, 64 nt, Homo Sapiens
acuagcauggugccugccccuaauacauuuucacugaaugaaugaaucagugaguuaaugaaua

SEQ ID NO: 45979 - RNA, 64 nt, Homo Sapiens
gcauggugccugccccuaauacauuuucacugaaugaaugaaucagugaguuaaugaauaaaua

SEQ ID NO: 45980 - RNA, 64 nt, Homo Sapiens
auugcucucuuuauaaugauuaaucacuuuauuaugaaugaaugaaugaauuugauggauuuaa

SEQ ID NO: 45981 - RNA, 64 nt, Homo Sapiens
cucucuuuauaaugauuaaucacuuuauuaugaaugaaugaaugaauuugauggauuuaaaaug

SEQ ID NO: 45982 - RNA, 64 nt, Homo Sapiens
cuuuauaaugauuaaucacuuuauuaugaaugaaugaaugaauuugauggauuuaaaauggcuu

SEQ ID NO: 45983 - RNA, 64 nt, Homo Sapiens
ugugcaguauuuaugugauugugccuaugcaugaugaaugaaugaauuucaguuguacauugcc

SEQ ID NO: 45984 - RNA, 64 nt, Homo Sapiens
caguauuuaugugauugugccuaugcaugaugaaugaaugaauuucaguuguacauugccuaaa

SEQ ID NO: 45985 - RNA, 64 nt, Homo Sapiens
auggccuaaaauauucauaaugguuggugucuuuugaaugaauucaugucaaaaauguuauuca

SEQ ID NO: 45986 - RNA, 64 nt, Homo Sapiens
cacuugacuagucuuaaaacaaagaaagaacgaaugaaugaaugaaucuguggcuggaugcagu

SEQ ID NO: 45987 - RNA, 64 nt, Homo Sapiens
ugacuagucuuaaaacaaagaaagaacgaaugaaugaaugaaucuguggcuggaugcaguggcu

SEQ ID NO: 45988 - RNA, 64 nt, Homo Sapiens
cuugccacagagcggggacucgguaagcacuuaaugaaugaaugaauucuaagucaauccaaga

SEQ ID NO: 45989 - RNA, 64 nt, Homo Sapiens
ccacagagcggggacucgguaagcacuuaaugaaugaaugaauucuaagucaauccaagagucu

SEQ ID NO: 45990 - RNA, 64 nt, Homo Sapiens
ucaguuguacauugccuaaacuaugcaugaugaaugaaugaauucaguauuuaugugauugugc

SEQ ID NO: 45991 - RNA, 64 nt, Homo Sapiens
aauuucaguuguacauugccgugccuaugcaugaugaaugaaugugugcaguauuuaugugauu

SEQ ID NO: 45992 - RNA, 64 nt, Homo Sapiens
acuuggaaagauuuuccacaaaaaaaaaacauauugaaugaagcaucagacaaaaugcagaagg

SEQ ID NO: 45993 - RNA, 64 nt, Homo Sapiens
gcuggggcagugguaugugcugcuaacgacaacuugaaugaacuagcacaacuaaaauuucaca

SEQ ID NO: 45994 - RNA, 64 nt, Homo Sapiens
uguauuuaguugacuguauuauuugauuucggauugaaugaauguaaauagaaauuaaaugcaa

SEQ ID NO: 45995 - RNA, 64 nt, Homo Sapiens
uugaaugaauguaaauagaaauuaaaugcaaauuugaaugaacauaaauagaagugauuuauuu

SEQ ID NO: 45996 - RNA, 64 nt, Homo Sapiens
guuguauauguaacucuaagagaccuuccuagagugaaugaagguagaaaacugaaaagggagu

SEQ ID NO: 45997 - RNA, 64 nt, Homo Sapiens
ucuucucacaauccgagcugcucuuuguccucugugaaugaagguacuuuugcuuccauuucau

SEQ ID NO: 45998 - RNA, 64 nt, Homo Sapiens
augaagguacuuuugcuuccauuucauccaaggaugaaugaaaauguauagcaucugcccaaac

SEQ ID NO: 45999 - RNA, 64 nt, Homo Sapiens
gcagcaacuagucuuuauuuaaauguuagcugaaugaaugaauaguguucauuaagggcucaau

SEQ ID NO: 46000 - RNA, 64 nt, Homo Sapiens
aauagcagcaacuagucuuucaauaaauguuagcugaaugaauguuauguguucauuaagggcu

SEQ ID NO: 46001 - RNA, 64 nt, Homo Sapiens
acagaaucuuggugcuuuguucaugggugguugcugaaugaagaauuggaauaaagcaggaggc

SEQ ID NO: 46002 - RNA, 64 nt, Homo Sapiens
gccuagcacauagcaaggacucaacaaauuucauugaaugaaugaaaaaacauaguuuaccaaa

SEQ ID NO: 46003 - RNA, 64 nt, Homo Sapiens
agcacauagcaaggacucaacaaauuucauugaaugaaugaaaaaacauaguuuaccaaauguc

SEQ ID NO: 46004 - RNA, 64 nt, Homo Sapiens
uccccaguaaugaaaguacuuagaaaauaauuauugaaugaaugaaaucuaaacugugaaccug

SEQ ID NO: 46005 - RNA, 64 nt, Homo Sapiens
caguaaugaaaguacuuagaaaauaauuauugaaugaaugaaaucuaaacugugaaccugaggg

SEQ ID NO: 46006 - RNA, 62 nt, Homo Sapiens
cgcucuuaagacauggcuggagcucagucuucauugaaugaaguuugcugugguauugcaua

SEQ ID NO: 46007 - RNA, 64 nt, Homo Sapiens
aguguguacaagcauucaagaaacugaugaaugaugaaugaaugaaugagccaaagaacaaaua

SEQ ID NO: 46008 - RNA, 64 nt, Homo Sapiens
uguacaagcauucaagaaacugaugaaugaugaaugaaugaaugagccaaagaacaaauaaaug

SEQ ID NO: 46009 - RNA, 64 nt, Homo Sapiens
ccgggccuguuuggggagguccagaggcuggauuugaaugaacugaguggcaaggccccugcuc

SEQ ID NO: 46010 - RNA, 64 nt, Homo Sapiens
gccugaagcucccucucccaggcuaaacaggaacugaaugaauggaugaggggaggagggugcu

SEQ ID NO: 46011 - RNA, 64 nt, Homo Sapiens
gcagagagcggauacucaaguaaguuuuguuaaaugaaugaaugaauuuagaaccacacaaugc

SEQ ID NO: 46012 - RNA, 64 nt, Homo Sapiens
agagcggauacucaaguaaguuuuguuaaaugaaugaaugaauuuagaaccacacaaugccaag

SEQ ID NO: 46013 - RNA, 64 nt, Homo Sapiens
gucucuguucuugcauuuaugcaacacauaacuuacacauaaauucaccaaacuuuuugacaag

SEQ ID NO: 46014 - RNA, 64 nt, Homo Sapiens
uacacauaaaugucucuguuuuuuugacaaggcaacacauaacucauaggguuacucaccaaac

SEQ ID NO: 46015 - RNA, 64 nt, Homo Sapiens
aaaaaaauauauuuuucauuuugaaaaauauaauacacauaaauccuaccaacuuauuagcugc

SEQ ID NO: 46016 - RNA, 64 nt, Homo Sapiens
uuguaugcauggaaacaugguacaguguagaguaacacauaacagugaauuugaauacugcauu

SEQ ID NO: 46017 - RNA, 64 nt, Homo Sapiens
uggcaaagccuuuaaccaguuuucaacccuuauuacacauaagauaauucauagcggagagaaa

SEQ ID NO: 46018 - RNA, 64 nt, Homo Sapiens
uggaaaagcuuuucaccgauacucaauccuuaguacacauaagaaaauucauacuggggagaaa

SEQ ID NO: 46019 - RNA, 64 nt, Homo Sapiens
cggaaaagccuuuaacugguccucaacucuuauuacacauaagauaauucacaguggagaaaaa

SEQ ID NO: 46020 - RNA, 64 nt, Homo Sapiens
ugaaaacugauuggcacuucacauauguauacacacacauaauuacaugcaugcacacauacau

SEQ ID NO: 46021 - RNA, 64 nt, Homo Sapiens
caaacauacaugcaugcacagaggaggaaaaaauacacauaauagagcgagcaagagagggaga

SEQ ID NO: 46022 - RNA, 64 nt, Homo Sapiens
ucuuaauuuucaccgagcaguaaaugcuguucuuacacauaauuuuuuuuuaauagcuauuugc

SEQ ID NO: 46023 - RNA, 64 nt, Homo Sapiens
ggcaguguuaaaacaugaaucuuccucaguauccacacauaaacccaugccuuacgaaccaugc

SEQ ID NO: 46024 - RNA, 64 nt, Homo Sapiens
uggaaaccaggggaguuuuaaagcccgagaaaccacacauaaucuuuuguugagaugaguuugc

SEQ ID NO: 46025 - RNA, 64 nt, Homo Sapiens
uacugguguacaguaugaguggaauauaaacuguacacauaauuaucauguugauauaaaucau

SEQ ID NO: 46026 - RNA, 64 nt, Homo Sapiens
uguucguaauaaaucaugugccacaucuugucuuacacauaaaagccacugcuuuuaacauccc

SEQ ID NO: 46027 - RNA, 64 nt, Homo Sapiens
aagccacugcuuuuaacaucccauuguacauuuaacacauaaaugguguuaacaucccauugua

SEQ ID NO: 46028 - RNA, 64 nt, Homo Sapiens
acauaaaugguguuaacaucccauuguacauuuaacacauaaauggccauugucuuugucucag

SEQ ID NO: 46029 - RNA, 64 nt, Homo Sapiens
uugugcaugaaacagaguuuuguauaugccucauacacauaauuuggaauucaccuguguuucg

SEQ ID NO: 46030 - RNA, 64 nt, Homo Sapiens
agaccuuggggaugggacccuugaauauuuguauacacauaaugccagaauuguuuugcauuuu

SEQ ID NO: 46031 - RNA, 64 nt, Homo Sapiens
gcugguguuuuguucaaucuggaagaaugacuguaucagucaauggggauuuuaacagacugcc

SEQ ID NO: 46032 - RNA, 64 nt, Homo Sapiens
ucuucuuucuguagggaugagaauuccucuuuuaaucagucaagggagaugcuucaaagcugga

SEQ ID NO: 46033 - RNA, 64 nt, Homo Sapiens
gugcguaagccuugaauaccaccugggaucagucaucagucaggccgucuuacaacucagggcc

SEQ ID NO: 46034 - RNA, 64 nt, Homo Sapiens
agucagggugcguaagccuucagggccaccugggaucagucaucacagucaccgucuuacaacu

SEQ ID NO: 46035 - RNA, 64 nt, Homo Sapiens
ugccccuccccacccugaccgugcuaacuguguguacauauauauucuacauauauguauauua

SEQ ID NO: 46036 - RNA, 64 nt, Homo Sapiens
ccugaccgugcuaacuguguguacauauauauucuacauauauguauauuaaaacugcacugcc

SEQ ID NO: 46037 - RNA, 64 nt, Homo Sapiens
aacuguauaguguacaugguuguguguacauauauacauauauaucuguaccuuuauauauaug

SEQ ID NO: 46038 - RNA, 64 nt, Homo Sapiens
cauauauaaacuguauaguguauauauguguguguacauauauauaaacuaaucuguaccuuua

SEQ ID NO: 46039 - RNA, 64 nt, Homo Sapiens
cauuauucugauagauuguauacauauguacacauacauauacacauaugcacagucaagguca

SEQ ID NO: 46040 - RNA, 64 nt, Homo Sapiens
gcauuuaucuaagaaacugugaggcuuucugguuuacauauaucuuacagguguuuuuuuguau

SEQ ID NO: 46041 - RNA, 64 nt, Homo Sapiens
ugucuguguguguguguguauguauacacacauauacauauauauauacacauacauacacaua

SEQ ID NO: 46042 - RNA, 64 nt, Homo Sapiens
uauauauacacauacauacacauacauacauacauacauauauaucugauaaaauugugauguu

SEQ ID NO: 46043 - RNA, 64 nt, Homo Sapiens
caaaaauuagcugggcaucaucuacauaaaaaaauacauauauacaacaucaugaaacaucauc

SEQ ID NO: 46044 - RNA, 64 nt, Homo Sapiens
cauauauaugccuauaucuaauuccaagaacuguuacauauaauauuuucucugaaagucgaga

SEQ ID NO: 46045 - RNA, 64 nt, Homo Sapiens
aaauuucauuuucucugaaauacaacauuguauguacauauacauuuaauuugguuagaaguuc

SEQ ID NO: 46046 - RNA, 64 nt, Homo Sapiens
auggguuucuuucagauuuuuugaaccauccacuuacauauauuuuuaaaaaaugaaauccuuu

SEQ ID NO: 46047 - RNA, 64 nt, Homo Sapiens
accauaugaucuguuuuguaucuuaaauuugauuuacauauauuauuuauuucugguaacucac

SEQ ID NO: 46048 - RNA, 64 nt, Homo Sapiens
cagagugguaaauaucuauguuacauguagauuauacauauauauacacacguguauaugagau

SEQ ID NO: 46049 - RNA, 64 nt, Homo Sapiens
caaauuauauauauacauauccacacacauacauuacauauaucuguguauauaaauccacaug

SEQ ID NO: 46050 - RNA, 64 nt, Homo Sapiens
gauuuuuaaauaaaguugcccagauauaauuuacuacauauauucauucauugagagacaguga

SEQ ID NO: 46051 - RNA, 64 nt, Homo Sapiens
uauauacauauguaauguguaccaagaggcauuauacauauagaaaacuucauuauagaauuga

SEQ ID NO: 46052 - RNA, 64 nt, Homo Sapiens
uguauauauauacacacacagugauauacauauauacauauauaugggaaauauauauguuucu

SEQ ID NO: 46053 - RNA, 64 nt, Homo Sapiens
cauauauauguauauauauaauguuucugugauauacauauauagaaaaauuugggaaauauau

SEQ ID NO: 46054 - RNA, 64 nt, Homo Sapiens
cacauauauguguguauguauacauaucuacacauacauauauauguguguacauauacauaua

SEQ ID NO: 46055 - RNA, 64 nt, Homo Sapiens
cauaucuacacauacauauaaauguguguacauauacauauauacuuguaugcuugugugugua

SEQ ID NO: 46056 - RNA, 64 nt, Homo Sapiens
uauauacauaucuacacauauguguaaauguguguacauauacagugugacuuguaugcuugug

SEQ ID NO: 46057 - RNA, 64 nt, Homo Sapiens
uauaucauauagcuuaagcuuauauauauauacauacauauauaugcgauuuuauauauauaua

SEQ ID NO: 46058 - RNA, 64 nt, Homo Sapiens
aauuuuugaugcauuuuauagguaaucucauuguuacauauagccagugggagggguugggaug

SEQ ID NO: 46059 - RNA, 64 nt, Homo Sapiens
aaacuuacaaggacaaagaggcuuguuggcacuuuacauauacaguguauacauguguacauau

SEQ ID NO: 46060 - RNA, 64 nt, Homo Sapiens
uguuggcacuuuacauauacaguguauacauguguacauauauauacaaauauuuguaucuucu

SEQ ID NO: 46061 - RNA, 64 nt, Homo Sapiens
uauauagagauauauguguguguguauguauauguacauauacauauauaugaguguauaauuc

SEQ ID NO: 46062 - RNA, 64 nt, Homo Sapiens
gagauauauguguguguguauguauauguacauauacauauauaugaguguauaauucuaaauu

SEQ ID NO: 46063 - RNA, 64 nt, Homo Sapiens
uuuuuuuuuuuuugagaugguauacauacacacauacauauaauuauauauauauauacauaua

SEQ ID NO: 46064 - RNA, 64 nt, Homo Sapiens
uacauacacacauacauauauauauauauauauauacauauauacacacacauacauacauaca

SEQ ID NO: 46065 - RNA, 64 nt, Homo Sapiens
uauauauauacauauauauacacacauacauacauacauauauacacacacacacacacacaca

SEQ ID NO: 46066 - RNA, 64 nt, Homo Sapiens
cacguaucuauauguauauaaauauuuguuuauauacauauaugcacguauguauagaugugug

SEQ ID NO: 46067 - RNA, 64 nt, Homo Sapiens
uaauauauacauacguguguuuacauuuaaacuauacauauacaguaauuuauggaugcccagg

SEQ ID NO: 46068 - RNA, 64 nt, Homo Sapiens
aaacuuuucaaaucuugcaaguaaacauauaucuuacauauaauauguuuuuagaggcuuuucc

SEQ ID NO: 46069 - RNA, 64 nt, Homo Sapiens
uuuucuuguggagcaauagaccaaccuguaguuuuacauauacauuuaguuacuauuaccauag

SEQ ID NO: 46070 - RNA, 64 nt, Homo Sapiens
ccaggguggguauaaaacuucuuauucuuaaauuuacauauaagaucuauuaagcuugacacau

SEQ ID NO: 46071 - RNA, 64 nt, Homo Sapiens
aacuucccacaaaagcugacuuuuuugggucucuuacauauaaaguagguuauugaguugauuu

SEQ ID NO: 46072 - RNA, 64 nt, Homo Sapiens
uauauguauauguguacauauggacauacacauuuacauauauauaaaguauauauauacauau

SEQ ID NO: 46073 - RNA, 64 nt, Homo Sapiens
acauacacauuuacauauauauaaaguauauauauacauauauauauauauauauguaugaaac

SEQ ID NO: 46074 - RNA, 64 nt, Homo Sapiens
uguauauaaucuugcuucccuacacacacauauguacauauauacuaaauuuuacauauaauua

SEQ ID NO: 46075 - RNA, 64 nt, Homo Sapiens
uauacacacacauauguacaagaccacuaaauuuuacauauaaucccaaguccacaauuuggug

SEQ ID NO: 46076 - RNA, 64 nt, Homo Sapiens
cacauauacacaucuauguauauacaugugaguguacauauauagaugcacacauaucuguaca

SEQ ID NO: 46077 - RNA, 64 nt, Homo Sapiens
ugugaguguacauauauacaugcacacauaucuguacauauacaguuauguguguggauauaga

SEQ ID NO: 46078 - RNA, 64 nt, Homo Sapiens
uaacauacacacaauauguaaagaugcacaugcguacauauacauauaugcaugcauguguaua

SEQ ID NO: 46079 - RNA, 64 nt, Homo Sapiens
uaaaccugaaaaaugaauugcgaacagcuacauauacauauaucuucuaagugauuaaugcaua

SEQ ID NO: 46080 - RNA, 64 nt, Homo Sapiens
uauaucuaaaccugaaaaauugcauacgaacagcuacauauacauaaaguuucuaagugauuaa

SEQ ID NO: 46081 - RNA, 64 nt, Homo Sapiens
agaucuugaaaagguaguugucauuuacuccauuuacauauaaaaguguuugaguucagccucu

SEQ ID NO: 46082 - RNA, 64 nt, Homo Sapiens
acaaaacuuuuauaaauuaucuaacaucuccgucuacauauaacguguucugagccauaguucu

SEQ ID NO: 46083 - RNA, 64 nt, Homo Sapiens
ucucaguaguaucccuagagcucaucucauaccuuacauauaaguaaagcugaugggauucugu

SEQ ID NO: 46084 - RNA, 64 nt, Homo Sapiens
uuugucuugcuuauagucauuaaaucauuacuuuuacauauauugcuguuacuucugcuuucuu

SEQ ID NO: 46085 - RNA, 64 nt, Homo Sapiens
aauauaguaaaggauguuuuaugaagucacaagauacauauauuuuuauuuugaccuaaauuug

SEQ ID NO: 46086 - RNA, 64 nt, Homo Sapiens
aaguauccuuacuaagagugcuccuuuuguauuuuacauauauacaguaugaaaauacauugga

SEQ ID NO: 46087 - RNA, 64 nt, Homo Sapiens
gccagagauacucuaggcauguaaagcacaaacauacauauaaaaucugcgggcuucaaaaaau

SEQ ID NO: 46088 - RNA, 64 nt, Homo Sapiens
uuuuuuuccucuucugcguuaccagguguguguguacauauaauauauauauauauauauuaua

SEQ ID NO: 46089 - RNA, 64 nt, Homo Sapiens
auaucuauccugggaugggaaaaugagggagggauacauauacggagggggaucuuacucuucc

SEQ ID NO: 46090 - RNA, 64 nt, Homo Sapiens
aaauauauauauuaaaauaauauauguauacauauacauauauaaaguuucaaggaaccauaaa

SEQ ID NO: 46091 - RNA, 64 nt, Homo Sapiens
uauauaaaauauauauauuacauaaauauauguauacauauacaccaaagaaguuucaaggaac

SEQ ID NO: 46092 - RNA, 64 nt, Homo Sapiens
uauauauauauauauguguguguguguguguguauacauauauacacauauauacacacacaca

SEQ ID NO: 46093 - RNA, 64 nt, Homo Sapiens
uguauacauauauacacauauauacacacacacauacauauacauguguauauauauaccaucc

SEQ ID NO: 46094 - RNA, 64 nt, Homo Sapiens
ugcuuggggugggggagucagcagcacccauuuguacauauaggucauucauacaucacauuuu

SEQ ID NO: 46095 - RNA, 64 nt, Homo Sapiens
uauguauauacacacguacauacauucauauauauacauauauacauaaugugcuuaaccacug

SEQ ID NO: 46096 - RNA, 64 nt, Homo Sapiens
uacauguauauauauauacauacacauauauguauacauauauacacauauauguauacauaua

SEQ ID NO: 46097 - RNA, 64 nt, Homo Sapiens
cacauauauguauacauauauacacauauauguauacauauauacacauauguauacauauaua

SEQ ID NO: 46098 - RNA, 64 nt, Homo Sapiens
uacacauauauguauacauauauacacauauguauacauauauauauauucuacaguaaaacug

SEQ ID NO: 46099 - RNA, 64 nt, Homo Sapiens
augaugauauauauaaugauggguauuauauauauacauauaagguacauauaucuauguacag

SEQ ID NO: 46100 - RNA, 64 nt, Homo Sapiens
uauguacagggguauuauauaauauauacauguguacauauaucacuuuaauuuuauacauaua

SEQ ID NO: 46101 - RNA, 64 nt, Homo Sapiens
uauauacauguguacauauaacacuuuaauuuuauacauauaaagacaggaaacuacaaguucc

SEQ ID NO: 46102 - RNA, 64 nt, Homo Sapiens
uauauauauauguauguauauauauauauacacauacauauauagaauuucauauauauauaca

SEQ ID NO: 46103 - RNA, 64 nt, Homo Sapiens
uauacacauacauauauauaauuucauauauauauacauauauauauguuucuaaccacagaga

SEQ ID NO: 46104 - RNA, 64 nt, Homo Sapiens
uauauauacacacacacacacacauauguacacauacauauauauacauauauauguauauaua

SEQ ID NO: 46105 - RNA, 64 nt, Homo Sapiens
cacacacacacacauauguacacauacauauauauacauauauauguauauauagaacacaugg

SEQ ID NO: 46106 - RNA, 64 nt, Homo Sapiens
cauugaacaaauguguggguuuuuaaaaauuauauacauauaugaguugccuauauuugcuauu

SEQ ID NO: 46107 - RNA, 64 nt, Homo Sapiens
aaaugauauguugaaaacuuaaggaagcaaaugcuacauauaugcaauauaaaauaguaaugug

SEQ ID NO: 46108 - RNA, 64 nt, Homo Sapiens
cacaucuauauagagagauaguucuauacauauauacauauauccugugggguuggaugccgcg

SEQ ID NO: 46109 - RNA, 64 nt, Homo Sapiens
cauauauccacaucuauauaaugccgcgguucuauacauauauacccggggccugugggguugg

SEQ ID NO: 46110 - RNA, 64 nt, Homo Sapiens
uauuuucacuugcuuucaagguauauacaguauauacauauauaaacaguauauacauaugugu

SEQ ID NO: 46111 - RNA, 64 nt, Homo Sapiens
uuuguuaauauauuaaaacaacuuuuaauauauauacauauauaaucugacaaagaugaaaucc

SEQ ID NO: 46112 - RNA, 64 nt, Homo Sapiens
gacuauacagaaauuuaaauagaaauaguguauauacauauaaaauacaagcuauguuaggacc

SEQ ID NO: 46113 - RNA, 64 nt, Homo Sapiens
uuuuguuuaugaauggaaagcuuugugcaaaauauacauauaagcagaguaagccuuuuaaaaa

SEQ ID NO: 46114 - RNA, 64 nt, Homo Sapiens
auaaggacaugaguuaaauauauuuauauguacauacauauauauaucccuuuacauauauaug

SEQ ID NO: 46115 - RNA, 64 nt, Homo Sapiens
uauauuuauauguacauacauauauauaucccuuuacauauauauguaugugggugugagugug

SEQ ID NO: 46116 - RNA, 64 nt, Homo Sapiens
uauaccgacaugaucaaaacuacaguuuuguauuuacauauaaauauucaauaucuuacaguga

SEQ ID NO: 46117 - RNA, 64 nt, Homo Sapiens
cacgauacuccuuuccagaaucguauucuauaaauacauauacauauuguaugugauaauauga

SEQ ID NO: 46118 - RNA, 64 nt, Homo Sapiens
cuguaucaggcuaggacgcucugagcugugcauguacauauauacauauauagauacauuuaua

SEQ ID NO: 46119 - RNA, 64 nt, Homo Sapiens
ggcuaggacgcucugagcugugcauguacauauauacauauauagauacauuuauaauauauac

SEQ ID NO: 46120 - RNA, 64 nt, Homo Sapiens
uaucuggccucguuauauaguguauauauauguauacauauacauauauauaauauauaugaag

SEQ ID NO: 46121 - RNA, 64 nt, Homo Sapiens
gccucguuauauaguguauauauauguauacauauacauauauauaauauauaugaagacugua

SEQ ID NO: 46122 - RNA, 64 nt, Homo Sapiens
uuuagaaauuuauucaaagcuaaagauguauauauacauauacuuuuguguguauauauacaca

SEQ ID NO: 46123 - RNA, 64 nt, Homo Sapiens
aagagaaucucagaaguaguuugcugcuaauauauacauauauuguauaaaaagguauauuuug

SEQ ID NO: 46124 - RNA, 64 nt, Homo Sapiens
ccacauguguguauguggaauaguuccauauauauacauauauuuaacaaaaugauggccaagg

SEQ ID NO: 46125 - RNA, 64 nt, Homo Sapiens
ucccuuucgauagcaucugaaaauuauaauuaaauacauauaauguaauuguauuacaaugacu

SEQ ID NO: 46126 - RNA, 64 nt, Homo Sapiens
cuggcuguagguuuuaaauuuuuauaucuauacauacauauauacauauauauauaauguacaa

SEQ ID NO: 46127 - RNA, 64 nt, Homo Sapiens
agguuuuaaauuuuuauaucuauacauacauauauacauauauauauaauguacaauauauaca

SEQ ID NO: 46128 - RNA, 64 nt, Homo Sapiens
cugcucaaaaaauuuucaaagauuaaaacuauuauacauauacaggucauauaaaauuaccugg

SEQ ID NO: 46129 - RNA, 64 nt, Homo Sapiens
aaauuuuauaaauguguauuucuguguauucacauacauauauauauacacacauauauaugua

SEQ ID NO: 46130 - RNA, 64 nt, Homo Sapiens
ggaggaguuuuagggcuuggggagagggaggacacaucuggaggaaauggccuucuuuuuaaaa

SEQ ID NO: 46131 - RNA, 64 nt, Homo Sapiens
cucugggagaugcuggaauaaaagacaagaguuacaucuggacuuggauugagguuuuguugug

SEQ ID NO: 46132 - RNA, 64 nt, Homo Sapiens
aaaggugggguguggggccccugggccaaugggccaucuggaccuguucuggcagcagggacac

SEQ ID NO: 46133 - RNA, 64 nt, Homo Sapiens
ucuucuccagcuuacccuaggccucuccagggcacaucuggaguguggccccugagaggugggg

SEQ ID NO: 46134 - RNA, 64 nt, Homo Sapiens
agcuccucguggcccuuccaaggugaggcaaaggcaucuggacuuguuccagcccagcccaccg

SEQ ID NO: 46135 - RNA, 64 nt, Homo Sapiens
ugaauucaucuggcauugcuuugccuuaucaucucaucuggaguuuuuaaaugccauuuguuuc

SEQ ID NO: 46136 - RNA, 64 nt, Homo Sapiens
uauauauauaucaaguuuuaaauuauugauaguucaucuggauuaccaaaaucacucugcagcc

SEQ ID NO: 46137 - RNA, 64 nt, Homo Sapiens
uugguucaaacuguuggagaacagaguuggccugcaucuggaacacacuuguccucagcuuacc

SEQ ID NO: 46138 - RNA, 64 nt, Homo Sapiens
uagaugggagggcauagcagaguuugcccucucccaucuggacuccuuaaucucugcccugggc

SEQ ID NO: 46139 - RNA, 64 nt, Homo Sapiens
cauggagacccaccacgucuuacccacacccagccaucuggagugacuggcggugagguuuuga

SEQ ID NO: 46140 - RNA, 64 nt, Homo Sapiens
cugaagggucaagugcugucgacaccacuguccucaucuggagcuuaucaugacugccuccagu

SEQ ID NO: 46141 - RNA, 64 nt, Homo Sapiens
accaaggacuuccugcagcggaucgcaccauccgcaucuggagcaccuggcuaccugugcagau

SEQ ID NO: 46142 - RNA, 64 nt, Homo Sapiens
uucccuaccugggcucugggauccuguuauaguacaucuggaccgagauagccugggaugagca

SEQ ID NO: 46143 - RNA, 64 nt, Homo Sapiens
gaaaccaaaauugggagggguucaaauucugccucaucuggagggagaauuuuuggaaccaaca

SEQ ID NO: 46144 - RNA, 64 nt, Homo Sapiens
ucauccuugaccucauuuacauacaaaggaagaacaucuggauuuccauacagugacaauacaa

SEQ ID NO: 46145 - RNA, 64 nt, Homo Sapiens
gagagcaagauuccuguccuacuggagcagagaacaucuggagagaaggaacuagggauauuua

SEQ ID NO: 46146 - RNA, 64 nt, Homo Sapiens
uggaccuccuucgcuggaaggucuuugacggcaccaucuggaaggacaucuacaaucaggagug

SEQ ID NO: 46147 - RNA, 64 nt, Homo Sapiens
gccuuguccugaugcugugcucaaucagccuggccaucuggauuuucacacaguaaagcaggaa

SEQ ID NO: 46148 - RNA, 64 nt, Homo Sapiens
cugcucuggcuuuccaguuaaucguaucuaucgucaucuggagcuuguacucaguuugaggagg

SEQ ID NO: 46149 - RNA, 64 nt, Homo Sapiens
ugcagaucuuagcggaccaaccaaacaaucucgucaucuggaggcauauuugugaugagacuag

SEQ ID NO: 46150 - RNA, 64 nt, Homo Sapiens
cuucccuucuacccacccgccucccaccagaucccaucuggaaaucauaauaaagacauaugcc

SEQ ID NO: 46151 - RNA, 64 nt, Homo Sapiens
gcaaggucuucugagcucaucuuaacuggugaggcaucuggaugugucugaucuuacugugaug

SEQ ID NO: 46152 - RNA, 64 nt, Homo Sapiens
ucagcuagaucuguuucuauauaacuuugggagauuuucagaucuuuucuguuaaacuuucacu

SEQ ID NO: 46153 - RNA, 64 nt, Homo Sapiens
gacuuucauauauuuucuguuguuuuuaaaauaguuuucagaauuaugcaaguaauaagugcau

SEQ ID NO: 46154 - RNA, 64 nt, Homo Sapiens
cuucagaguaguguaggaauacuguagaaauacuuuuucagaaacgaauccauagcugacaaau

SEQ ID NO: 46155 - RNA, 64 nt, Homo Sapiens
cuauuguuuaaaaaugauugauuuacuugcagauuuuucagaggauguuaugucuuugucauuc

SEQ ID NO: 46156 - RNA, 64 nt, Homo Sapiens
aacuggccaacccuuugccuccacuauugaauuuuuuucagacccccauucuucaugcuggaaa

SEQ ID NO: 46157 - RNA, 64 nt, Homo Sapiens
aaggaaaaagcacacagcacacaauuucaagccauuuucagaucagaacuccagaaguguugac

SEQ ID NO: 46158 - RNA, 64 nt, Homo Sapiens
gaggccacagagugccuugacacaaagauuacauuuuucagacccccacuccucugcugcuguc

SEQ ID NO: 46159 - RNA, 64 nt, Homo Sapiens
aguauauuaauaauugacuaggaagaugaacuuuuuuucagaucuuugggcagcugauaauuua

SEQ ID NO: 46160 - RNA, 64 nt, Homo Sapiens
accuucacucacauaaugucuggaacuuggcaaauuuucagagcaaugauaucugggauuucug

SEQ ID NO: 46161 - RNA, 64 nt, Homo Sapiens
uauagacuuaaaaaauuagacaggacuagagauuuuuucagauuguugcuguuguacauggaac

SEQ ID NO: 46162 - RNA, 64 nt, Homo Sapiens
ccacagaccacagugauuuuuacucuuuuuuuuuuuuucagagacuccucacacagaucccacu

SEQ ID NO: 46163 - RNA, 64 nt, Homo Sapiens
uaaagaggcauucaugaagggggguagaaguuccuuuucagaaagucuggaaaugggaaaggga

SEQ ID NO: 46164 - RNA, 64 nt, Homo Sapiens
uacaaucagugguccugguuguaggacacccagauuuucagacuuaucuuggccugguuauggg

SEQ ID NO: 46165 - RNA, 64 nt, Homo Sapiens
aguuaaaaaguagacuuuaacugccaugaggccauuuucagacaagugucaucucuacucuccu

SEQ ID NO: 46166 - RNA, 64 nt, Homo Sapiens
gcuucugaaguacaguuuaaccccuagaucugaguuuucagaguuacucuacuucaccuaacca

SEQ ID NO: 46167 - RNA, 64 nt, Homo Sapiens
uugccauacugaaccucauuauuuuuucucaguuuuuucagauagauacauaaauuuaaagaau

SEQ ID NO: 46168 - RNA, 64 nt, Homo Sapiens
gacaaucaacaccguuccaaaggccugaaaauaauuuucagauaaagagacuccaagguugacu

SEQ ID NO: 46169 - RNA, 64 nt, Homo Sapiens
cugaguggacugugcuugucaacggauguguagcuuuucagaaacuuaauuggggaugaauaga

SEQ ID NO: 46170 - RNA, 64 nt, Homo Sapiens
uuaaaggcuuagcauuuaaguagcaacauugcgguuuucagacacauggugagguccauggcuc

SEQ ID NO: 46171 - RNA, 64 nt, Homo Sapiens
auucaggacugcuggggaucaagcccaaggauguuuuucagagcucugugauuuaagaugcucg

SEQ ID NO: 46172 - RNA, 64 nt, Homo Sapiens
aagggcaguauauuaagagcaugaaauugaacuauuuucagaaacaauaaauauuagaauaaau

SEQ ID NO: 46173 - RNA, 64 nt, Homo Sapiens
uaaaauuuuguacauauauauuuuuauagguucuuuuucagaagaguuuuuuuaauacgaucua

SEQ ID NO: 46174 - RNA, 64 nt, Homo Sapiens
gaucaaaaugaucuaggguuaaauuagcagcccauuuucagaaaucuaacaagaaagacaugga

SEQ ID NO: 46175 - RNA, 64 nt, Homo Sapiens
aaaagaaaauuuuacaacagacccuugcuugccuuuuucagagaguucuccacacugugcaugc

SEQ ID NO: 46176 - RNA, 64 nt, Homo Sapiens
gcacuuuugaaaaaacaaaaaaccuccuuuuagcuuuucagauauguauuuaaauugaagucau

SEQ ID NO: 46177 - RNA, 64 nt, Homo Sapiens
cacacaguagcaaaauuuggggaaauccauaacauuuucagaccaugaaugaauguuuccauuu

SEQ ID NO: 46178 - RNA, 64 nt, Homo Sapiens
gccuaaacaauauugaaguauccauagggcacaauuuucagacauuuuaguaucuguauauagu

SEQ ID NO: 46179 - RNA, 64 nt, Homo Sapiens
aaaagaaaaaggacgaugucagucaagcagcacuuuuucagaauauacagaacauaaauaauau

SEQ ID NO: 46180 - RNA, 64 nt, Homo Sapiens
ggguauuuccaauacuugaauggcagauuggaguuuuucagaguauguguuucaucugcuaguc

SEQ ID NO: 46181 - RNA, 64 nt, Homo Sapiens
agagaagugacuguuuuuuauugauaaggcaagauuuucagaaaaaugaguaaaauaauuaaug

SEQ ID NO: 46182 - RNA, 64 nt, Homo Sapiens
ccuaauuaauucccacauucuaucuuaauguauuuuuucagacuauaaucacuuaaauuuuaua

SEQ ID NO: 46183 - RNA, 64 nt, Homo Sapiens
acgaaaagauacacaaucauguuuuauagcacuauuuucagaauuagaagcuaggaauaauuga

SEQ ID NO: 46184 - RNA, 64 nt, Homo Sapiens
aauuagaaaaaugucauugcauuguuuuucagacuuuucagaucuccauuuuuguuguaaagac

SEQ ID NO: 46185 - RNA, 64 nt, Homo Sapiens
uuucagaucaauuagaaaaauguaaagacauuguuuuucagacuaauuggaaauccauuuuugu

SEQ ID NO: 46186 - RNA, 64 nt, Homo Sapiens
uugcacuaccuuauaaugguuaauuggcaucgauuuuucagauaagaaaagaagugauaguagu

SEQ ID NO: 46187 - RNA, 64 nt, Homo Sapiens
aauuauuuuaaaagaacucagugaacuauguuuuuuuucagaaaauuaauuccugagugaaaaa

SEQ ID NO: 46188 - RNA, 64 nt, Homo Sapiens
uuuuuuugauauggaccuguuggucuaugucaucuuuucagaagaaaagcauuuaauugccaau

SEQ ID NO: 46189 - RNA, 64 nt, Homo Sapiens
cauauacuucuguuuguaaaaauaucaguuuuacuuuucagaggauuuguaagaaacauuuaaa

SEQ ID NO: 46190 - RNA, 64 nt, Homo Sapiens
ugugguguucuucauugaguuuuuuucuucacuauuuucagaaguuuuuguucuuuuuuuuuuu

SEQ ID NO: 46191 - RNA, 64 nt, Homo Sapiens
aguuuucauuuuuucuaaauccuccccuacaaaauuuucagauuggaaauuacucuuguauuug

SEQ ID NO: 46192 - RNA, 64 nt, Homo Sapiens
gcucuugggauuggagaggaaaaauuagaggugauuuucagauuucuuguucuauggaagagga

SEQ ID NO: 46193 - RNA, 64 nt, Homo Sapiens
uuuuuuugauauggaccuguugguccauaucaucuuuucagaagaaaagcauuuaauugccaau

SEQ ID NO: 46194 - RNA, 64 nt, Homo Sapiens
gcauauacuucuguuuguaaaaauaucgguuuuauuuucagaggauuuguaagaaacauuuaaa

SEQ ID NO: 46195 - RNA, 64 nt, Homo Sapiens
cuuauuuuuagaugguuacacuguuagaacacuauuuucagaaucugaauguaauuuguguaau

SEQ ID NO: 46196 - RNA, 64 nt, Homo Sapiens
uucagaaucugaauguaauuuguguaauaaaguguuuucagagcauuagcugucaguguauuuu

SEQ ID NO: 46197 - RNA, 64 nt, Homo Sapiens
ccagagaucauucuuccauacuuuacucccuccuuuuucagacuuguuuguaaaguacagaauc

SEQ ID NO: 46198 - RNA, 64 nt, Homo Sapiens
ucuuuacauauaaaucugcuucaaccuuaggauguuuucagaccagaggcaacuuauucaugaa

SEQ ID NO: 46199 - RNA, 64 nt, Homo Sapiens
ucuguaaaaauggaaaaacaaaucaaagcuaaaauuuucagaagggaauggggaagcuuauuuc

SEQ ID NO: 46200 - RNA, 64 nt, Homo Sapiens
gaacagacuguuggaccagcgagcacagaacauuuuuucagacuacauuuugucaaucugaaca

SEQ ID NO: 46201 - RNA, 64 nt, Homo Sapiens
gccaaaugaaggcuaaaauuuuuaaaauuagaacuuuucagaauuuucagaaaguccauuuuug

SEQ ID NO: 46202 - RNA, 64 nt, Homo Sapiens
guccauuuuuguuuaaaauuauaugcugagaaauuuuucagaaaauaucauaaccucuugguuc

SEQ ID NO: 46203 - RNA, 64 nt, Homo Sapiens
uauugguaaagauggacugaugucaaagaauuauuuuucagauaugugaaaauauuuguucuua

SEQ ID NO: 46204 - RNA, 64 nt, Homo Sapiens
aauuuaucuuuaguuuuucuacuuuauauacuuuuuuucagagagcuaacacauuaaacuucuc

SEQ ID NO: 46205 - RNA, 64 nt, Homo Sapiens
auaaugacucacaugggaaugcagaguuuucccauuuucagaagguucuguccacugcuaugga

SEQ ID NO: 46206 - RNA, 64 nt, Homo Sapiens
cuaugagcugugucaccugauugguguuuugucuuuuucagaaacaaccaccuuauuuuugagc

SEQ ID NO: 46207 - RNA, 64 nt, Homo Sapiens
acaugccauccauuauuuuaaauaaacuaauagguuuucagaauuaugaauuuuucagaacuca

SEQ ID NO: 46208 - RNA, 64 nt, Homo Sapiens
uuaaauaaacuaauagguuuucagaauuaugaauuuuucagaacucauccaguccuuguaaucu

SEQ ID NO: 46209 - RNA, 64 nt, Homo Sapiens
ugcucauauuucuggccaauguacagccucauauuuuucagaguaauacagauacuuguucuca

SEQ ID NO: 46210 - RNA, 64 nt, Homo Sapiens
ugccaaacaugggaacagccuugaauaggauaaauuuucagagggcugccuaaaauauuuuauu

SEQ ID NO: 46211 - RNA, 64 nt, Homo Sapiens
gugucaggcugcacuuugcuccauauaauuauuguuuucagauuucaacuuguauguguuuguc

SEQ ID NO: 46212 - RNA, 64 nt, Homo Sapiens
ugacccccaaagacaagacaagcacuuauuuuuauuuucagaagacaaaagaaccaagaugcca

SEQ ID NO: 46213 - RNA, 64 nt, Homo Sapiens
gccaagucacugcugccauguguguacuguauuauuuucagaaaaaaauauaauagucugaguc

SEQ ID NO: 46214 - RNA, 64 nt, Homo Sapiens
uguguguucugcuuuauauguuauauucaauaucuuuucagaugcagucuauauuuuaugcuga

SEQ ID NO: 46215 - RNA, 64 nt, Homo Sapiens
cugagaaaugcaauugcuauucuuuuuauauacuuuuucagauuuuuuauaugcuucuuuacua

SEQ ID NO: 46216 - RNA, 64 nt, Homo Sapiens
ggcuuuuuuuuuucuauucauguuauuaauguuauuuucagaauaacaauuacuuuauuauugu

SEQ ID NO: 46217 - RNA, 64 nt, Homo Sapiens
ccagugugacaugaggaauugccacuuuuuuuuuuuuucagauuugacuauggacaacucgggu

SEQ ID NO: 46218 - RNA, 64 nt, Homo Sapiens
agguuuuugagcagaacucuuuugacaaguuccuuuuucagaauuuuuuuuaaggugaaaaugu

SEQ ID NO: 46219 - RNA, 64 nt, Homo Sapiens
gaauugaguagagcaaaaauaauaauaauaaacuuuuucagaaacuuccacacuuuauuuccuu

SEQ ID NO: 46220 - RNA, 64 nt, Homo Sapiens
cacauuucuuucagggaaaaacaaugucaccaaauuuucagaguucuaaacuccuuuccuucaa

SEQ ID NO: 46221 - RNA, 64 nt, Homo Sapiens
uuaagacaguuuucaguguaccguaaauguuguguuuucagaaaaagacaaaacgauggugcug

SEQ ID NO: 46222 - RNA, 64 nt, Homo Sapiens
uuuauaacagacccauuuugcuuucaaaaacaaguuuucagauuacagccuguaauacugcucu

SEQ ID NO: 46223 - RNA, 64 nt, Homo Sapiens
uagcaaggugugaucuaguauaucaggacuaacauuuucagaaacuuuuaugguuuuuaauuuu

SEQ ID NO: 46224 - RNA, 64 nt, Homo Sapiens
acaucccgcuucugaagcugggaucguguugguauuuucagagaaauucaggucuguaugucau

SEQ ID NO: 46225 - RNA, 64 nt, Homo Sapiens
aaaagaaaacuuaaagaggagcuagauaauaggguuuucagaugugucucuaauuuaacuuauu

SEQ ID NO: 46226 - RNA, 64 nt, Homo Sapiens
gugaccgaauaggaagaaggaaacaaaccagcuuuuuucagagaagagugauucuacaugggaa

SEQ ID NO: 46227 - RNA, 64 nt, Homo Sapiens
gacuauuauuuccuaaccaugaaaaagcaccugcuuuucagaaacaggauauggaguuguagua

SEQ ID NO: 46228 - RNA, 64 nt, Homo Sapiens
accuuuuacagcguauuacuuagugaacauuacauuuucagaauagauccuaauauuuuauuga

SEQ ID NO: 46229 - RNA, 64 nt, Homo Sapiens
uaugcuuggaaacagcauagauauguugcugugguuuucagaauuuucucuuuuaaucacaaga

SEQ ID NO: 46230 - RNA, 64 nt, Homo Sapiens
uuucuaacccagucuuauuuuccauauggagcauuuuucagaguauauaaaaacaacaaauacu

SEQ ID NO: 46231 - RNA, 64 nt, Homo Sapiens
guuugaagcaccaugguguguauuagugccaaguuuuucagaaaggcaaugagugugccagagu

SEQ ID NO: 46232 - RNA, 64 nt, Homo Sapiens
aacacaaguggaguaugccaaauuuuauaugaauuuuucagauuaucuaagcuuccagguuuua

SEQ ID NO: 46233 - RNA, 64 nt, Homo Sapiens
aauauaccgugguucauauguuagcauggcagcauuuucagauagcuuuuuguuuguugggaag

SEQ ID NO: 46234 - RNA, 64 nt, Homo Sapiens
ucauagauaaauaugaauguacucuauuaccaauuuuucagaacacugcaauugaaaaaaucau

SEQ ID NO: 46235 - RNA, 64 nt, Homo Sapiens
guaauucugaaauucuguuuaugauauuccuucauuuucagagauaacucugaaagauggucau

SEQ ID NO: 46236 - RNA, 64 nt, Homo Sapiens
gcggggucuuuuccauuuauggagccuuucauuauuuucagauaaaaaccacauuaauuuaaau

SEQ ID NO: 46237 - RNA, 64 nt, Homo Sapiens
ucuuuuuuaaaauuuuaauugccaugguaaauaauuuucagaaucaaaaauaucagaaaaguug

SEQ ID NO: 46238 - RNA, 64 nt, Homo Sapiens
uuuaacuguauaaaaauguuuuuaucuguacauuuuuucagauaagacccuacaauaagauugu

SEQ ID NO: 46239 - RNA, 64 nt, Homo Sapiens
cacuuaaaauauuuagaaaacuugucuugaauuuuuuucagaucuguagcuaaauauuuauaca

SEQ ID NO: 46240 - RNA, 64 nt, Homo Sapiens
aguuacacaucuucaacagacccccucuagaaauuuuucagaugcuucugggagacacccaaag

SEQ ID NO: 46241 - RNA, 64 nt, Homo Sapiens
gcuguacaaugaccacuguuauuguuacuuugacuuuucagagcacacccuuccucugguuuuu

SEQ ID NO: 46242 - RNA, 64 nt, Homo Sapiens
gaaguggcaaauuacauguagagugucuccuuccuuuucagagaacaguuaaucaaggcaaauc

SEQ ID NO: 46243 - RNA, 64 nt, Homo Sapiens
uuauaagucauuuuuuuccugauauuuccaccacuuuucagagucaucuacaaaauuuuucuuu

SEQ ID NO: 46244 - RNA, 64 nt, Homo Sapiens
guuauucucucuggcuuuccuuucaacccacuuauuuucagaggccucuccccuuagcauccuu

SEQ ID NO: 46245 - RNA, 64 nt, Homo Sapiens
ggacuguugccuauugagcauuguggaugauguguuuucagauuuccaggugaaguucugaccc

SEQ ID NO: 46246 - RNA, 64 nt, Homo Sapiens
cauaauauagaaguuaaaauaaguauuagugcaauuuucagauauuuauuuuugcacagaaaac

SEQ ID NO: 46247 - RNA, 64 nt, Homo Sapiens
ggguuuucuuaaugccagugugaauuugcagauguuuucagaaaaucaagucacaguaacaauu

SEQ ID NO: 46248 - RNA, 64 nt, Homo Sapiens
cagacuccauuuguauuauauuagauaugaguuguuuucagacuaucgcuuaaucuuaaauuua

SEQ ID NO: 46249 - RNA, 64 nt, Homo Sapiens
ccagcggcugagucaugaucauggaggagaagaauuuucagaccucuccaucuggcaggguggg

SEQ ID NO: 46250 - RNA, 64 nt, Homo Sapiens
uuuuugaugacuguauuguaagguccaagauuuguuuucagauagagggaugcacuauuucaca

SEQ ID NO: 46251 - RNA, 64 nt, Homo Sapiens
uuagccugaauuuaacuguaugaauaaaacgggauuuucagaaguuacugguaccacagugagg

SEQ ID NO: 46252 - RNA, 64 nt, Homo Sapiens
gaauuguauaaccagaauuguuccugccuuuagcuuuucagaacuugagauguggcagcacugg

SEQ ID NO: 46253 - RNA, 64 nt, Homo Sapiens
gugcuguacauuuuggcccuuacgaaauacgucuuuuucagaacuguuaaaguuuugauguaca

SEQ ID NO: 46254 - RNA, 64 nt, Homo Sapiens
guggaaaaaagugaaugagaccucugauaggggguuuucagaaccuuguucacaccaaaaugug

SEQ ID NO: 46255 - RNA, 64 nt, Homo Sapiens
uuuaaauaauggugugaaucaauuauuucaggauuuuucagauguguucugugccuucaguuua

SEQ ID NO: 46256 - RNA, 64 nt, Homo Sapiens
ucagacuuaguuguuaaaauuuugugaguuuauauuuucagaaugaaacagucuuccacuaacc

SEQ ID NO: 46257 - RNA, 64 nt, Homo Sapiens
uuaacuauagccagaacuggcuaaaauuuuuauauuuucagaguugaaguuggugaagacauuc

SEQ ID NO: 46258 - RNA, 64 nt, Homo Sapiens
ucugguaauuuuagugaucuuauuugauuagacuuuuucagaaguacuaaauaaggaauuuuaa

SEQ ID NO: 46259 - RNA, 64 nt, Homo Sapiens
aucacaaggggaaauuuaagauuguuaacccuguuuuucagaagggcuacuguuaauugcacau

SEQ ID NO: 46260 - RNA, 64 nt, Homo Sapiens
ggcuuucauaauauguaacuuuuggguucugccuuuuucagaaaauggaaacuugggccaugug

SEQ ID NO: 46261 - RNA, 64 nt, Homo Sapiens
agaaauuuuucucugccuuucaguuuuaugaauuuuuucagaaguaacaauauuauuauugacu

SEQ ID NO: 46262 - RNA, 64 nt, Homo Sapiens
acuuuaaaaauaaaguuccaaaauucuuggaaaauuuucagaauagggaaguagguggugguua

SEQ ID NO: 46263 - RNA, 64 nt, Homo Sapiens
aauaauuucaagucauuuauguaugaguuuuaccuuuucagaggcauagucuuuuucauaauac

SEQ ID NO: 46264 - RNA, 64 nt, Homo Sapiens
caacauuuuugucuaugguguguucuauugucuuuuuucagauaaaguaucuuuuucagcuucc

SEQ ID NO: 46265 - RNA, 64 nt, Homo Sapiens
acuuuaaagucugauauuucuuugaaucaauucauuuucagagcaauauauuccauauuauuuc

SEQ ID NO: 46266 - RNA, 64 nt, Homo Sapiens
acugggaacagcuggaaugcuucuugauuuuauuuuuucagagaguuguuaguucucuggguuu

SEQ ID NO: 46267 - RNA, 64 nt, Homo Sapiens
aguaguacaggcuucuugccgauaugaagggaacuuuucagaaagagaccuacucugggucauu

SEQ ID NO: 46268 - RNA, 64 nt, Homo Sapiens
uaaaucggaaccuuuuucuauguugcacacaugguuuucagaugacccagccaucuacaagauc

SEQ ID NO: 46269 - RNA, 64 nt, Homo Sapiens
uuuuuagcaauaauucguuaaugauuccacuugauuuucagaauauuguccugguugauuuuga

SEQ ID NO: 46270 - RNA, 64 nt, Homo Sapiens
cccagaauuggguguuccugaguuugugccagccuuuucagacugucauucaaccaugccaagg

SEQ ID NO: 46271 - RNA, 64 nt, Homo Sapiens
acaccuuuaucaaaggcaaaccucaaaaaagucauuuucagagauuuuauuuaaaaaaaucaaa

SEQ ID NO: 46272 - RNA, 64 nt, Homo Sapiens
aucagacuggaaacgggacuuucuauuaauaucauuuucagaauaaaaaauaggauaauuuaac

SEQ ID NO: 46273 - RNA, 64 nt, Homo Sapiens
ccaauaacuguggucuauacagagucaauauauuuuuucagagaaaguuauucgcucgauuuuu

SEQ ID NO: 46274 - RNA, 64 nt, Homo Sapiens
caguuacgaagacuggcaacuuggcuuuacuaaguuuucagacuggcaggaagucaaaccuauu

SEQ ID NO: 46275 - RNA, 64 nt, Homo Sapiens
cagauacuggggcagcaaauaaaacugaaucuuguuuucagaccuuauacuguguaauuguaag

SEQ ID NO: 46276 - RNA, 64 nt, Homo Sapiens
uaauuauguuaccuuuucauccccuuuaggagcguuuucagauuuugguugcuaagaccugaau

SEQ ID NO: 46277 - RNA, 64 nt, Homo Sapiens
uaaauccgaaaacuuccauuguaguggccugugcuuuucagauaguauacucuccuguuuggag

SEQ ID NO: 46278 - RNA, 64 nt, Homo Sapiens
gcuuuuaucucgagugugcccuuuucagacuuuguuuucagaaugaccuggccuuccuguugug

SEQ ID NO: 46279 - RNA, 64 nt, Homo Sapiens
uuguuuucagaaugcuuuuaccuuccuguugugcuuuucagacuucagaugcagugagaccugg

SEQ ID NO: 46280 - RNA, 64 nt, Homo Sapiens
acaucccuuguaaagcuaaaauaguuacuucaaauuuucagaaaagauguauauagucaaaauu

SEQ ID NO: 46281 - RNA, 64 nt, Homo Sapiens
guuucuuuucaugugcccagcagguuaaguagcguuuucagaauauacauuauucccauccauu

SEQ ID NO: 46282 - RNA, 64 nt, Homo Sapiens
gcagccuucaaaagaauuggcacugggauaagauuuuucagaaaaagaaaaacaucggcaaacu

SEQ ID NO: 46283 - RNA, 64 nt, Homo Sapiens
cauaacuaugaaaaaacuuugcuaauaucuguguuuuucagauuucauuuuuuguaaaaucaga

SEQ ID NO: 46284 - RNA, 64 nt, Homo Sapiens
ggauagucaaauauaagagauaaauaguuuaauuuuuucagaccuuuuuuggauaguccaauau

SEQ ID NO: 46285 - RNA, 64 nt, Homo Sapiens
ggauaguccaauauuagagauaaauaguuuaauuuuuucagauauaaugccagucgaugugauc

SEQ ID NO: 46286 - RNA, 64 nt, Homo Sapiens
ucauauacauguaagcuacaaagugugauuuuuauuuucagaaggagcagaaagauuauguuag

SEQ ID NO: 46287 - RNA, 64 nt, Homo Sapiens
cuggguuuuaauagcaguauuuuccaaaaugccguuuucagaaccauaaaaaaaaaaaaaaaga

SEQ ID NO: 46288 - RNA, 64 nt, Homo Sapiens; identical to SEQ ID NO: 46280

SEQ ID NO: 46289 - RNA, 64 nt, Homo Sapiens; identical to SEQ ID NO: 46281

SEQ ID NO: 46290 - RNA, 64 nt, Homo Sapiens
aguuguucuccaccccuucuccaccuccaccagcaaggagaagucaaucuacacuuuuuucuca

SEQ ID NO: 46291 - RNA, 64 nt, Homo Sapiens
uaacuauuauaaagaguuuaacuuucuggaacugaaggagaaaacaugaaaauguuuauauugc

SEQ ID NO: 46292 - RNA, 64 nt, Homo Sapiens
aaauaaagccaggaaagucaaaaaaacgaaagagaaggagaagaaaaaggaaaagggcaaauug

SEQ ID NO: 46293 - RNA, 64 nt, Homo Sapiens
ggagaagaaaaaggaaaagggcaaauugaaagucaaggagaaaaagcgcaaagaggagaaugaa

SEQ ID NO: 46294 - RNA, 64 nt, Homo Sapiens
agaugggauugccacucaccucuuuucccugagaaaggagaaaagggcagaauggcccuagagu

SEQ ID NO: 46295 - RNA, 64 nt, Homo Sapiens
uuaacuuugcuauuuauuuuugcuuuauuuuuaaaaggagaaguuuguugcuugguugguuugu

SEQ ID NO: 46296 - RNA, 55 nt, Homo Sapiens
aaaacguagugaauucauaaaauggaaggagaagacugggcuagggagaaugcag

SEQ ID NO: 46297 - RNA, 64 nt, Homo Sapiens
ugacaacagacugaauuuuaaauguucacaacauaaggagaauguaucuccuccuauuuaugaa

SEQ ID NO: 46298 - RNA, 63 nt, Homo Sapiens
uguucuuuguguauuucuagaauauuuaaauuccaaggagaagcuucuaacaaaaaauaaaua

SEQ ID NO: 46299 - RNA, 64 nt, Homo Sapiens
ugaaggcaggucagggaaaaaaggguagaaguuaaaggagaaucuugaaaacagaaggcagguc

SEQ ID NO: 46300 - RNA, 64 nt, Homo Sapiens
auguaaaauaugcacugagacuggcuucucuuugaaggagaaaauguagcuccagcuugucucc

SEQ ID NO: 46301 - RNA, 64 nt, Homo Sapiens
gagcaggaaaccaaggcucugaggcuuagcccagaaggagaacuuuugcagaggggcggggggu

SEQ ID NO: 46302 - RNA, 64 nt, Homo Sapiens
gcugaaggagagagauauuucugccguuaauaagaaggagaauacagcaaucaacaagcccuuu

SEQ ID NO: 46303 - RNA, 64 nt, Homo Sapiens
gucuaaucaagcucggguugaagaggggaaagaaaaggagaaagaaggcgaggaaaugguuugu

SEQ ID NO: 46304 - RNA, 64 nt, Homo Sapiens
aaauguugaucgguagggcagccauauguguaggaaggagaaaacagaauuugguggauaccua

SEQ ID NO: 46305 - RNA, 64 nt, Homo Sapiens
uucuuuuauaauccuuaaugugaggcuaagguauaaggagaaaggagauugguaaggaagugug

SEQ ID NO: 46306 - RNA, 64 nt, Homo Sapiens
acaaaguauagaaacauguucauugcacacacccaaggagaagagcucaagcgcuuggaagagg

SEQ ID NO: 46307 - RNA, 64 nt, Homo Sapiens
gcugucuccaccuccaggauguccagcaggcugcaaggagaaggaugccagccacccauccucc

SEQ ID NO: 46308 - RNA, 64 nt, Homo Sapiens
cacaucugccuccacacacagcuccuccgcagggaaggagaagcugcucuguaacucauucugg

SEQ ID NO: 46309 - RNA, 64 nt, Homo Sapiens
cauuagauaucaccuggcaaguuucugccuaauuaaggagaagucuuuuaucauauuuauacug

SEQ ID NO: 46310 - RNA, 64 nt, Homo Sapiens
augaucauuaaauuuuuagaaauucucggaaguuaaggagaagcacuguuuuuuauaaaaauuu

SEQ ID NO: 46311 - RNA, 64 nt, Homo Sapiens
gcaaauuuuaccaaaagaugagcuuauuuugaaaaaggagaauuuggugacuccaacuauggau

SEQ ID NO: 46312 - RNA, 64 nt, Homo Sapiens
ucaauuaucaggaaagcuaauaagaaaaaauauaaaggagaaaaguaguaaauuauagaaugua

SEQ ID NO: 46313 - RNA, 64 nt, Homo Sapiens
gggaucuugacuaagauucaugagacauugaauuaaggagaaucaucuucaugccugaaaauuu

SEQ ID NO: 46314 - RNA, 64 nt, Homo Sapiens
uauuacggauucaaagacuuauuuugaaaguuggaaggagaagggagggaagagagcagaaggg

SEQ ID NO: 46315 - RNA, 64 nt, Homo Sapiens
cccuuuggagaaacuggaccacacaaguuggaccaaggagaaagaauggcuccucugugacaaa

SEQ ID NO: 46316 - RNA, 64 nt, Homo Sapiens
aaaugcuucugcaagauuuuauauuaguuauucuaaggagaaaagaaauugguauuuauuuuaa

SEQ ID NO: 46317 - RNA, 64 nt, Homo Sapiens
ggagaauagcuaauagcuauagaaguaaggacugaaggagaaggcacaagacaaaacaggagcc

SEQ ID NO: 46318 - RNA, 64 nt, Homo Sapiens
aguaauaaugugauggcaauuuuaacaaaacaaaaaggagaaaaucaucaguuaagaaaucuac

SEQ ID NO: 46319 - RNA, 64 nt, Homo Sapiens
ccgccaggggagcuguaagcagccggguggugacaaggagaaaagccuucuagggucacuguca

SEQ ID NO: 46320 - RNA, 64 nt, Homo Sapiens
uuccugguucuguuuucucagccaguugcuguggaaggagaaugcuuucuuuguggccucaucu

SEQ ID NO: 46321 - RNA, 64 nt, Homo Sapiens
gcaaaguuaaggcuugauacaugcauuuacuggcaaggagaagauugaauuucagaaaaaaaaa

SEQ ID NO: 46322 - RNA, 64 nt, Homo Sapiens
augcucuuguucuguuccugaaauguauguauuuaaggagaaccaugucagauugaauguauuu

SEQ ID NO: 46323 - RNA, 64 nt, Homo Sapiens
uuuuuucuaauaagcugagauucccauuucucuuaaggagaagccacccaugagaugucuuuuc

SEQ ID NO: 46324 - RNA, 64 nt, Homo Sapiens
uucuuagacuggcugccaaaggaugaagcuagugaaggagaaaaagcuuaaauuccaucuugag

SEQ ID NO: 46325 - RNA, 64 nt, Homo Sapiens
aggguaguguuuugcaaaagcacaacagaugcugaaggagaaggagaugugagggcagaauaua

SEQ ID NO: 46326 - RNA, 64 nt, Homo Sapiens
guacucccaggaaacagacggggauggaccccgaaaggagaaaacugcccguggaagccaggga

SEQ ID NO: 46327 - RNA, 64 nt, Homo Sapiens
ucugucucgaaagaaagaaagaaaaaaaggaaggaaggagaaggaaggaaggagaagaaaaggu

SEQ ID NO: 46328 - RNA, 64 nt, Homo Sapiens
aagaaagaaaaaaaggaaggaaggagaaggaaggaaggagaagaaaagguaccuguucuacgua

SEQ ID NO: 46329 - RNA, 64 nt, Homo Sapiens
uuaaaauuccaaacccaaagccuuuguuugacugaaggagaagagagggaaguaagcuucuguu

SEQ ID NO: 46330 - RNA, 64 nt, Homo Sapiens
ugccuguucccaaacuuuuuccauuccaggaacaaaggagaagccacuuuccccaggacgcaag

SEQ ID NO: 46331 - RNA, 64 nt, Homo Sapiens
aaaagaaagaaagaaaagaagaagaaaagagaagaaggagaaggagaugaaggaggaggaggag

SEQ ID NO: 46332 - RNA, 64 nt, Homo Sapiens
gaaggagaaggagaugaaggaggaggaggaggagaaggagaagaagaagaagaagaagaccaca

SEQ ID NO: 46333 - RNA, 64 nt, Homo Sapiens
uaaccauguuuagggaugugccucaguugggagcaaggagaaaaaugggaagaaccaguuuuau

SEQ ID NO: 46334 - RNA, 64 nt, Homo Sapiens
accugccauucguggaagucgccuggguuuuguaaaggagaauuuuuuggacucaagcugucau

SEQ ID NO: 46335 - RNA, 64 nt, Homo Sapiens
acccaguuagccaagauguuggaugcguugcuagaaggagaaauagaagaccuugaccugcugg

SEQ ID NO: 46336 - RNA, 64 nt, Homo Sapiens
auauuguuuggagacuuccagauggcucugcacgaaggagaaccacgcauuuaugaagacaucc

SEQ ID NO: 46337 - RNA, 64 nt, Homo Sapiens
aagcugcucgugcucguuccagagccggacucaaaaggagaagacucuuccagcaaaggcaaaa

SEQ ID NO: 46338 - RNA, 64 nt, Homo Sapiens
agauugagucaagugacuauuugaggcugaucucaaggagaaacggacacagaccuggcccguu

SEQ ID NO: 46339 - RNA, 64 nt, Homo Sapiens
ugccccaaaaugcaagauuuuaucauuauaacugaaggagaaggaauguaaaacuuuuaaggua

SEQ ID NO: 46340 - RNA, 64 nt, Homo Sapiens
aaggagacucaccucugccucaccaacccaucagaaggagaaggccuucccuggcuuguaacuc

SEQ ID NO: 46341 - RNA, 64 nt, Homo Sapiens
aaaaaucagaauugcgucugugggaacaggaauaaaggagaaaccacuauugacugggaagaca

SEQ ID NO: 46342 - RNA, 64 nt, Homo Sapiens
augccuguaauccuagcuacugggaaggcugaggaaggagaauugcuugaacccagguggugga

SEQ ID NO: 46343 - RNA, 64 nt, Homo Sapiens
cccugcccacuuucuguuccccuucuaaggagccaaggagaauugcuucccugggcucccacug

SEQ ID NO: 46344 - RNA, 64 nt, Homo Sapiens
ccagccagccucuacccaucgcaugagggugaggaaggagaagcgccagaggggcagccaccuu

SEQ ID NO: 46345 - RNA, 64 nt, Homo Sapiens
ugcccggcuagaaaucaacgugcucaaaaaaaucaaggagaaggacaaagaaaacaaguuguga

SEQ ID NO: 46346 - RNA, 64 nt, Homo Sapiens
ugagcuccugggcaagaacaccuuugaguuccugaaggagaauaacuuccagccuuacccccua

SEQ ID NO: 46347 - RNA, 64 nt, Homo Sapiens
uugggaugagaacagcucugacggccgguaugugaaggagaacugcaaaccucugaaggucagu

SEQ ID NO: 46348 - RNA, 64 nt, Homo Sapiens
aauguuacuuuuuaacuuuaguuaguuauuuuuaaaggagaagauagcauagugguuuuauuuu

SEQ ID NO: 46349 - RNA, 64 nt, Homo Sapiens
aauaacuuuuuccauguaucaauuuaggcacuuuaaggagaacuggacaaaauuaagucuuuaa

SEQ ID NO: 46350 - RNA, 64 nt, Homo Sapiens
ccagcaaaggaagcucugccaggaggugacugggaaggagaaaaacuugcucugaacugcaccc

SEQ ID NO: 46351 - RNA, 64 nt, Homo Sapiens
gaugcuugucuggccaugauguccagauggcaggaaggagaacgcacauccccugacgaagcuu

SEQ ID NO: 46352 - RNA, 64 nt, Homo Sapiens
uguuuagaacucuucaacuucgguaaugaggaagaaggagaaagagcugggggaagggcagaag

SEQ ID NO: 46353 - RNA, 64 nt, Homo Sapiens
agggcagaagacugguuuaggaggaaaaggaaauaaggagaaaagagaaugggagagugagaga

SEQ ID NO: 46354 - RNA, 64 nt, Homo Sapiens
ugauaaaauuuacaauagccacgcaauagccaucaaggagaauuucuauuaugauuauaaauuc

SEQ ID NO: 46355 - RNA, 64 nt, Homo Sapiens
uucuuaacaccuccaccagggggaaggcuggcacaaggagaaaaaaaaagcaagcaucagcgaa

SEQ ID NO: 46356 - RNA, 64 nt, Homo Sapiens
aagggggaggagaagguucuucguccaaaggaggaaggagaagaaguagaaagugcgaagagcu

SEQ ID NO: 46357 - RNA, 64 nt, Homo Sapiens
cuccugcccucugcccggcccuacugagauucccaaggagaaggccgagagggggcgcuccagg

SEQ ID NO: 46358 - RNA, 64 nt, Homo Sapiens
cugcaucauaacuuuacagaggugagaggagaggaaggagaaaaugaaagcugugcucagagga

SEQ ID NO: 46359 - RNA, 64 nt, Homo Sapiens
acuuucugucuuauuaaaaugacgaugagacuagaaggagaaauuauuuuuuccuuucaaauca

SEQ ID NO: 46360 - RNA, 64 nt, Homo Sapiens
augguaaguacauaauugugcauuuguauauaaaaaggagaaaaagguugaggacagugacugc

SEQ ID NO: 46361 - RNA, 64 nt, Homo Sapiens
uggaaaccauuuauguagugaacaaugaauaaauaaggagaacucagccuacuccuggguagac

SEQ ID NO: 46362 - RNA, 64 nt, Homo Sapiens
acaacccggcuuccucaccccacaggggacacaggcuucuuaaaagauaugccaugggccuuuu

SEQ ID NO: 46363 - RNA, 64 nt, Homo Sapiens
gauucuggauauuagaucuuguaaauuuuuugaagcuucuuauaggguugcuuguuuuucgcuu

SEQ ID NO: 46364 - RNA, 64 nt, Homo Sapiens
cucucaagugucuuaggguagaaaguaaaaaguugcuucuuaugaguugcuaaaggaaggcuuc

SEQ ID NO: 46365 - RNA, 64 nt, Homo Sapiens
guccaaagaaucggcaaaugagagugguuagaaggcuucuuagcgcaguuguucagagcccugg

SEQ ID NO: 46366 - RNA, 64 nt, Homo Sapiens
aguuccuggucugaacccuccagaagcugcaagagcuucuuagcguccacaucacagcucccuc

SEQ ID NO: 46367 - RNA, 64 nt, Homo Sapiens
gcccucucccugccccagcuuccccuuacugccugcuucuuaggaccuagaucagcguggcugg

SEQ ID NO: 46368 - RNA, 64 nt, Homo Sapiens
cucuaagugguuaaaaauuaguaugaauuuuuuagcuucuuaaugaauauggauuuaaaacucu

SEQ ID NO: 46369 - RNA, 64 nt, Homo Sapiens
gccagauaguuucuacuaaccauauacucuuucugcuucuuagcgucguugucacugcuucugu

SEQ ID NO: 46370 - RNA, 64 nt, Homo Sapiens
cagcaugggggguugguucugcagaguugcacaaggagagaacuucauuuucuguucucauuuu

SEQ ID NO: 46371 - RNA, 64 nt, Homo Sapiens
agggagacgcagguggacuuggagggggcagucuggagagaaggcaggggccuuucaggaucug

SEQ ID NO: 46372 - RNA, 64 nt, Homo Sapiens
ggugguguugaugguggcggugguaggguggaggggagagaagaagaugcugaugauauugaua

SEQ ID NO: 46373 - RNA, 64 nt, Homo Sapiens
aggcuguugugugcgcggaugaggggagguggcaggagagaauucuacauuuaggggguuaggc

SEQ ID NO: 46374 - RNA, 64 nt, Homo Sapiens
ccucuagcggugaagggggaaggggaagaggaaaggagagaaguggucggugucuguuuccuuc

SEQ ID NO: 46375 - RNA, 64 nt, Homo Sapiens
caaauggcagcuuagcuacaaaugccugucagucggagagaauggggugagcagccaccauucc

SEQ ID NO: 46376 - RNA, 64 nt, Homo Sapiens
uauguguguguguguuuuugggguggggagggagggagagaagagggggcuaaauuugaugcuu

SEQ ID NO: 46377 - RNA, 64 nt, Homo Sapiens
aaugguccuuucacaugugcuuuauuagacucugggagagaaaaguaaccaagugcuucagaac

SEQ ID NO: 46378 - RNA, 64 nt, Homo Sapiens
gcagaucagguaaagcauacauaguagagggaaaggagagaauggaaauaaaacugaauauuau

SEQ ID NO: 46379 - RNA, 64 nt, Homo Sapiens
gaaggugcuggaggugggagcaggagauugagaaggagagaaagugggugagaugcuggagaag

SEQ ID NO: 46380 - RNA, 64 nt, Homo Sapiens
cccacgcccuccccuccccugcugcaggggcucuggagagaaacaauaaagagauucacacaca

SEQ ID NO: 46381 - RNA, 64 nt, Homo Sapiens
ucuuauuguuggccaugaagugcugugcaacaugggagagaaguagagaagggcgugccacccu

SEQ ID NO: 46382 - RNA, 64 nt, Homo Sapiens
gcgugccacccuugcugugccagccucuggacuuggagagaaggcuuggaaaaguucuuagcag

SEQ ID NO: 46383 - RNA, 64 nt, Homo Sapiens
gagccguguuagagcuuccgagaauagcuccacuggagagaaguggaauccuauauagaaugcu

SEQ ID NO: 46384 - RNA, 64 nt, Homo Sapiens
ggucaucuagcaaccgccucaaaauguguaagcaggagagaaauuucucaucacagggauuuag

SEQ ID NO: 46385 - RNA, 64 nt, Homo Sapiens
cuuccuggguuugcaacacuacgaagggagaggaggagagaagguuuaacaacaugcuccguag

SEQ ID NO: 46386 - RNA, 64 nt, Homo Sapiens
ccaacguuuccacccacagaggaaaccaaauacuggagagaaaaagcagcaacgagcaacaauc

SEQ ID NO: 46387 - RNA, 64 nt, Homo Sapiens
cucaaaccuugauaaacauaagagaauucauaccggagagaaacuguacaaaugugaagaauau

SEQ ID NO: 46388 - RNA, 64 nt, Homo Sapiens
ugguccucaaugcuuaauaaauauaauucaugcuggagagaaacuucacaugugaaccgugugg

SEQ ID NO: 46389 - RNA, 64 nt, Homo Sapiens
cucucaccacacccagaagaggccuuucccaucuggagagaagcuuccagaccagcccuucaca

SEQ ID NO: 46390 - RNA, 64 nt, Homo Sapiens
cacacaccacagccaggaggggccuuucccaccuggagagaaacuuccagaccagccccucaua

SEQ ID NO: 46391 - RNA, 64 nt, Homo Sapiens
cucauaccacagccaagaggggccuuucucaccuggagagaaauuuccagaccauccccucuca

SEQ ID NO: 46392 - RNA, 64 nt, Homo Sapiens
cucacaccacagccaagagaagccuuuccagccuggagagaaacuuccagaccagcccucucac

SEQ ID NO: 46393 - RNA, 64 nt, Homo Sapiens
cucucaccacagccaggagaggccuuuaccaccuggagagaagcuuccagaccagccccucaca

SEQ ID NO: 46394 - RNA, 64 nt, Homo Sapiens
cucacaccacagccaggagaggccuuucccaccuggagagaaacuuccagaccagccccucaua

SEQ ID NO: 46395 - RNA, 64 nt, Homo Sapiens
cucauaccacagccaagaggggccuuucucaccuggagagaaacuuccagaccagccccucaca

SEQ ID NO: 46396 - RNA, 64 nt, Homo Sapiens
cucacaccaccgccaggagaggccuuucccaccgggagagaaacuuccagaccagccccucaca

SEQ ID NO: 46397 - RNA, 64 nt, Homo Sapiens
cucacaccacagccaggagaggccuuucccaccgggagagaaacuuccagaccagcccucucac

SEQ ID NO: 46398 - RNA, 64 nt, Homo Sapiens
cucacaccacagccaggagaggccuuucccgccuggagagaagcuucaggccagcuccucacac

SEQ ID NO: 46399 - RNA, 64 nt, Homo Sapiens
cucacaccacagccaggagagaccuuuucugccuggagagaaacuuucagaccagccccacaca

SEQ ID NO: 46400 - RNA, 64 nt, Homo Sapiens
cacacaccacagccaggagaggccguuccugccuggagagaagcuuccagaccagcccuucaca

SEQ ID NO: 46401 - RNA, 64 nt, Homo Sapiens
uucacaccacagccaggagaggccuuucccaccuggagagaaacuuccagaccagccccucuca

SEQ ID NO: 46402 - RNA, 64 nt, Homo Sapiens
uccaggaccuucuacccugcagagugugguuuugggagagaagugcaaaaucccacgacaggug

SEQ ID NO: 46403 - RNA, 64 nt, Homo Sapiens
gaaucucuguaagguuuauuuaucuucacccucuggagagaagauguuuuaccaaagccucuag

SEQ ID NO: 46404 - RNA, 64 nt, Homo Sapiens
ggggcguagacuugacaacaucccacaguggcacggagagaaggcccauaccuucugguugcuu

SEQ ID NO: 46405 - RNA, 64 nt, Homo Sapiens
uauuugaaacuguaaauauguuugugccuuaaaaggagagaagaaaguguagauaguuaaaaga

SEQ ID NO: 46406 - RNA, 64 nt, Homo Sapiens
cuacaagcuuacuacacauaggaaaauucauacuggagagaaacuacaaaugugaagaaugugu

SEQ ID NO: 46407 - RNA, 64 nt, Homo Sapiens
ucaaaccuuacugaaaguugagaaaauucguacuggagagaauccuacaaaugugaaaaaugug

SEQ ID NO: 46408 - RNA, 64 nt, Homo Sapiens
aauccucauaccuuacuauacagaaauucauacuggagagaaagccuacaauugugaagaaugu

SEQ ID NO: 46409 - RNA, 64 nt, Homo Sapiens
uucaacccuuauuacacauaagauaauucauagcggagagaaaccccacaaaugugaagaaugu

SEQ ID NO: 46410 - RNA, 64 nt, Homo Sapiens
cucaacucuuacugcacauaagaucauucauacuggagagaaaccuuacaaaugugaggaaugu

SEQ ID NO: 46411 - RNA, 64 nt, Homo Sapiens
cucgaacuuuacuaugcauaagaaaauucaaacuggagagaaacucuacaaaugugaagaaugu

SEQ ID NO: 46412 - RNA, 64 nt, Homo Sapiens
auccucaaaacuucuuacaccuaaaauucaugcaggagagaaacaccacaaaugugaaaaauuu

SEQ ID NO: 46413 - RNA, 64 nt, Homo Sapiens
uucaacccuuucugcacauaauauaauucauacuggagagaaaccccacaaauaugaagaaugu

SEQ ID NO: 46414 - RNA, 64 nt, Homo Sapiens
uucacaucuuauucagcaucaaagaauucacacaggagagaaagcacaugaauguaaugaaugu

SEQ ID NO: 46415 - RNA, 64 nt, Homo Sapiens
ccacauuucaggcuuuacccaacaucgaaauaauggagagaaaauuguugauuauuuguuuaug

SEQ ID NO: 46416 - RNA, 64 nt, Homo Sapiens
uacacaaaugugaugaauguagaugauucauacuggagagaagucucaacccuuacuaaacaua

SEQ ID NO: 46417 - RNA, 64 nt, Homo Sapiens
cuuacaagugugaagaauguagaaaauucauacuggagagaaaccucaaaacucauugaacaca

SEQ ID NO: 46418 - RNA, 64 nt, Homo Sapiens
ccuacaaaugugaagaauguagagaauucauacuggagagaaacuucaacccuuauuggacaua

SEQ ID NO: 46419 - RNA, 64 nt, Homo Sapiens
agggaggcgcuccugggaccgcccgagggaggagggagagaaggagggagggagggagagaaug

SEQ ID NO: 46420 - RNA, 64 nt, Homo Sapiens
gcccgagggaggagggagagagggagggagggagggagagaaugauaaacacuggaggggaggg

SEQ ID NO: 46421 - RNA, 64 nt, Homo Sapiens
cauaaaaauauagcauauaaaucauagacuuugaggagagaaagugcauaagugccauccuuua

SEQ ID NO: 46422 - RNA, 64 nt, Homo Sapiens
uuaaaauuaaaauaguauuuaaacacaucauggaggagagaaacuuacuuguaacagcguaauu

SEQ ID NO: 46423 - RNA, 64 nt, Homo Sapiens
uuccaaaacccuucuuuuuaaaaggaaaaaggauggagagaaggauggaaagccuggacuuaaa

SEQ ID NO: 46424 - RNA, 64 nt, Homo Sapiens
aaagccuggacuuaaaccuuuagaaaaaacuucuggagagaaaucccuuuuaaacaguuacuuu

SEQ ID NO: 46425 - RNA, 64 nt, Homo Sapiens
gaaauaaaacucaauauuauauaguagagggaaaggagagaauggcagaucagguaaagcauac

SEQ ID NO: 46426 - RNA, 64 nt, Homo Sapiens
uuaaccaagugcuucagaacuuuauuagacucugggagagaaaaaauggcucuuucacaugugc

SEQ ID NO: 46427 - RNA, 64 nt, Homo Sapiens
ugagauggcccucugugacugggugguuggaaggggagagaaacugcuauagagagguuggaag

SEQ ID NO: 46428 - RNA, 64 nt, Homo Sapiens
ggcucccaccugccagucccgggcccuggggagaggagagaaagugccaugcucugggacgugu

SEQ ID NO: 46429 - RNA, 64 nt, Homo Sapiens
cagugauaaaaacuuccuuuuagggaucaaugaaggagagaaggucuuggaaucaccuucaguc

SEQ ID NO: 46430 - RNA, 64 nt, Homo Sapiens
cauccugcaagguuccucuuccugcaagcaaaguggagagaaagaagaugcaucugucaccuuc

SEQ ID NO: 46431 - RNA, 64 nt, Homo Sapiens
gcuuuuuucuuuuuuuucuuaaagugaaguggugggagagaauugggauagacagucuccaaga

SEQ ID NO: 46432 - RNA, 64 nt, Homo Sapiens
gcaagaauuugugaacacggcccagaagguucuuggagagaaguacuuguacccucccugugcc

SEQ ID NO: 46433 - RNA, 64 nt, Homo Sapiens
ggccgggcuugagaggagagcgcuggccaugccaggagagaacccacgcacaugcacaccacaa

SEQ ID NO: 46434 - RNA, 64 nt, Homo Sapiens
aagcgugguucuguaagaaaucagagggagaaagggagagaagggggagggagacaacccaaac

SEQ ID NO: 46435 - RNA, 64 nt, Homo Sapiens
ggucgguggugaaggugcucucacuuuacagaauggagagaacaucgugugugugugugugugu

SEQ ID NO: 46436 - RNA, 64 nt, Homo Sapiens
cagggacccauuguucucuucagaacccuaucugggagagaaggcgaaccaccuccggguuucc

SEQ ID NO: 46437 - RNA, 64 nt, Homo Sapiens
auauagcucuuaggcuuccagccucuaccaugcaggagagaacacagaaggacugauguauguu

SEQ ID NO: 46438 - RNA, 64 nt, Homo Sapiens
agagugaagguggguggaguugaccagagaaaggggagagaauucgggaaagacccaaaguguu

SEQ ID NO: 46439 - RNA, 64 nt, Homo Sapiens
gggauguauccaugggggcaaagaugcugaaacaggagagaaagggaagugacucauccucuug

SEQ ID NO: 46440 - RNA, 64 nt, Homo Sapiens
ggaggagggcggggggcaccagaaugaggaggaaggagagaaggcauggccagcagcuugcguu

SEQ ID NO: 46441 - RNA, 64 nt, Homo Sapiens
cccagcccagggcggcggggacuccgagagccccggagagaacguggcccagcccuggagggca

SEQ ID NO: 46442 - RNA, 64 nt, Homo Sapiens
gagccaauagugguuggggaacucuugaaaaaggggagagaauggcugggugcuggggaguucc

SEQ ID NO: 46443 - RNA, 64 nt, Homo Sapiens
agacuccugugagaucagcagaccucguguuuaaggagagaaugccugccugcaacacucaugg

SEQ ID NO: 46444 - RNA, 64 nt, Homo Sapiens
cugcagauacaugcggcacagcaggcacgugccuggagagaacagcuccugagcacagcacccu

SEQ ID NO: 46445 - RNA, 64 nt, Homo Sapiens
caagucauuucaaauacaugaaaaaucuuacacuggagagaaacccuaugaguguaagcaaugu

SEQ ID NO: 46446 - RNA, 64 nt, Homo Sapiens
cacuuccuuucgauaucaugaaaggacucacacuggagagaaccccuaugaguguaagcaauuu

SEQ ID NO: 46447 - RNA, 64 nt, Homo Sapiens
caaaaaucuucgauuucauaaaaggacacacacuggagagaaacccugugaauguaagaaaugu

SEQ ID NO: 46448 - RNA, 64 nt, Homo Sapiens
cucuucuuugcaaauacaugaaaggaugcacagaggagagaagcucugugaauguaagcauugu

SEQ ID NO: 46449 - RNA, 64 nt, Homo Sapiens
caagauccuuugaauacaugcaagaacacacaauggagagaaacccuaugaauguaaagaaugc

SEQ ID NO: 46450 - RNA, 64 nt, Homo Sapiens
cacuucuuuucaauaucaugaaaggacucacaugggagagaaacccuaugaguguaugccaagu

SEQ ID NO: 46451 - RNA, 64 nt, Homo Sapiens
uaguucccuucaauaucaugaaaggacucacacuggagagaagcccuaugaauauaagcaaugu

SEQ ID NO: 46452 - RNA, 64 nt, Homo Sapiens
caaguuauuucaaacacaugaaaaaauucacacuggagagaaacccuauaaaugcaagcaaugu

SEQ ID NO: 46453 - RNA, 64 nt, Homo Sapiens
caagaaccuuucaauuuaugaaaggacacacacuggagagaaacccuaugaauguaagaaaugu

SEQ ID NO: 46454 - RNA, 64 nt, Homo Sapiens
ccaagaucguuugaauacaugcaaaacacacacuggagagaaaccuaugaauguaaggaaugca

SEQ ID NO: 46455 - RNA, 64 nt, Homo Sapiens
caagucauuucgaagacaugaaaaaacucacacuggagagaaacccuauaaaugcaugccaugu

SEQ ID NO: 46456 - RNA, 64 nt, Homo Sapiens
caguuccuuucaguaucaugaaaggacucacacuggagagaaacccuaugaguguaagcaaugu

SEQ ID NO: 46457 - RNA, 64 nt, Homo Sapiens
gccccacaccuucgaaggcaugguaggacucacuggagagaaacccuaugaguguaaggaaugu

SEQ ID NO: 46458 - RNA, 64 nt, Homo Sapiens
caguuccuuuugguaccaugaaaggacucacacuggagagaaacccuaugaguguaagcaaugu

SEQ ID NO: 46459 - RNA, 64 nt, Homo Sapiens
cccacaccuucgaauccaugguagaacucacacuggagagaaacccuaugaguguaaggaaugu

SEQ ID NO: 46460 - RNA, 64 nt, Homo Sapiens
caagucauuucaaauaccugaaaaaucuuacacuggagagaaacccuaugaguguaagcaaugu

SEQ ID NO: 46461 - RNA, 64 nt, Homo Sapiens
cacuucuuuucgauaacaugaaaggacucacacuggagagaaacccuaugaguguaagcaaugu

SEQ ID NO: 46462 - RNA, 64 nt, Homo Sapiens
cuuuacccuuaauacacauaagauaauuaaugcuggagagaaacccuacaaaugugaagaaugu

SEQ ID NO: 46463 - RNA, 64 nt, Homo Sapiens
cucauaccuuacuaaauauaagauaauucauauuggagagaaauucuacagaugugaagaaugu

SEQ ID NO: 46464 - RNA, 64 nt, Homo Sapiens
cucauccauuaguaaacauaagauaauucauacuggagagaaaaccuacaaaugugaggaaugu

SEQ ID NO: 46465 - RNA, 64 nt, Homo Sapiens
ccuccaauuuacugcacauaagauaauuuauacuggagagaagcccuacaaaugugaaaaaugu

SEQ ID NO: 46466 - RNA, 64 nt, Homo Sapiens
cucaacccuuacuacacauuagauaauucaugcuggagagaaacccuacaaaugugaaaaaugu

SEQ ID NO: 46467 - RNA, 64 nt, Homo Sapiens
caguccucaacuccuaguaaacauaauuaaugauggagagaaaccauacaacugugaagaaugu

SEQ ID NO: 46468 - RNA, 64 nt, Homo Sapiens
uccucaaacuuuauugaacaaaauaauucauacaggagagaaacccuacaaaugugaagaaugu

SEQ ID NO: 46469 - RNA, 64 nt, Homo Sapiens
cucaauuuuuacuaaacauaagaaaauucauacuggagagaaacccuaugauugugaaaaauau

SEQ ID NO: 46470 - RNA, 64 nt, Homo Sapiens
gucgucccugcuucaacaucacaguauucauacuggagagaaaccuuacgaauguauuaaaugu

SEQ ID NO: 46471 - RNA, 64 nt, Homo Sapiens
cucgaaucuuacugcccaucaaagaguacauaauggagagaaacccaauagugugguaagugug

SEQ ID NO: 46472 - RNA, 64 nt, Homo Sapiens
agaaaaucucauuacacaucagaaaauucacacuggagagaaaccuuaugaaugcagugaaugu

SEQ ID NO: 46473 - RNA, 64 nt, Homo Sapiens
aucaaaccucacugaacaugagaaaauucauacuggagagaaaccuuaucauuguaaucaaugu

SEQ ID NO: 46474 - RNA, 64 nt, Homo Sapiens
acaaaaucuucuugagcaugaaaaaauucauacuggagagaaaccauucaaauguaaugaaugu

SEQ ID NO: 46475 - RNA, 60 nt, Homo Sapiens
agccuugcaugucaucauagacuucauacuggagagaaaccuuacaaaugugaagcaugu

SEQ ID NO: 46476 - RNA, 64 nt, Homo Sapiens
aucacgccuuaaaagacauaggagaauucauacuggagagaaaccuuacaaguguaaugagugu

SEQ ID NO: 46477 - RNA, 64 nt, Homo Sapiens
uucauaccuugcaguucaucagugaacucauacuggagagaaaccuuacaaaugucaugacugu

SEQ ID NO: 46478 - RNA, 64 nt, Homo Sapiens
uucauccuaugcaaaacauaggagaauucaugcaggagagaaaugucacaagugugaugagugu

SEQ ID NO: 46479 - RNA, 64 nt, Homo Sapiens
uucacaccucauuagacaucagagaaucccuacuggagagaaaucuuacaaaugucaucagugu

SEQ ID NO: 46480 - RNA, 64 nt, Homo Sapiens
aaggggguucagaggccggucgucacccuguuggggagagaagagcaggccaggggucccccag

SEQ ID NO: 46481 - RNA, 64 nt, Homo Sapiens
cucuuuauuucccuccugagaauugguggaggacggagagaaaccuccugcggaugggcaaaua

SEQ ID NO: 46482 - RNA, 64 nt, Homo Sapiens
ccugcaauuuaaaugguaugugugaacucacauuggagagaaaccacaaaccuuaaugugugua

SEQ ID NO: 46483 - RNA, 64 nt, Homo Sapiens
uguaugaauguagagaaucuucagaaaucucacuggagagaaaccucaagccuuaccaaacaca

SEQ ID NO: 46484 - RNA, 64 nt, Homo Sapiens
cuuauaaauguaaggauuguugagaaugcacacuggagagaaacuacaggcuuucgagugcaca

SEQ ID NO: 46485 - RNA, 64 nt, Homo Sapiens
ccuaugaauguaaagaauguaacgaauucauacuggagagaaaccaguuauauucauauacaug

SEQ ID NO: 46486 - RNA, 64 nt, Homo Sapiens
cuuaugaauguaaacaguguaaagaacccacacuggagagaaacugcagguuuccagauacaug

SEQ ID NO: 46487 - RNA, 64 nt, Homo Sapiens
ccuacaaauguaaggaauguaaaggacucauacuggagagaaaccuacucagcucaaagacaug

SEQ ID NO: 46488 - RNA, 64 nt, Homo Sapiens
ccuacaaaugcaaggaauguaaaagacucauacuggagagaaaccaacucugcucaaagacaug

SEQ ID NO: 46489 - RNA, 64 nt, Homo Sapiens
ccuacaaauguaaggaauguaaaaggcucauacuggagagaaacccaaucugcucaaaaacaug

SEQ ID NO: 46490 - RNA, 64 nt, Homo Sapiens
cauauaaauguaagaaauguagugucaggaauauggagagaagccaccagacacaaacuguaua

SEQ ID NO: 46491 - RNA, 64 nt, Homo Sapiens
cguaugaauguaaggaaugcaaaggauucacacuggagagaagcuggucacuuaaagcaacaug

SEQ ID NO: 46492 - RNA, 64 nt, Homo Sapiens
cauaugaauguaaauaauguagacaacucauaugggagagaagcuuauucccuucaaaaucaug

SEQ ID NO: 46493 - RNA, 64 nt, Homo Sapiens
aacucuaugaaugcaagcagaaagaacucacacuggagagaagacaguacacugcaaagucaug

SEQ ID NO: 46494 - RNA, 64 nt, Homo Sapiens
ucuguacauguaaacaauguaaaaaacucacacuggagagaaaccaguucuugucuaagacaug

SEQ ID NO: 46495 - RNA, 64 nt, Homo Sapiens
uauaugaauguaagcaguguaaagaacucacucuggagagaaaccaguuuauuucguaugcaug

SEQ ID NO: 46496 - RNA, 64 nt, Homo Sapiens
guaauacacguaaacaauuuaguaucaggaauauggagagaagcugcugggcacaaaccacaug

SEQ ID NO: 46497 - RNA, 64 nt, Homo Sapiens
gagaagacucccagaaucugucucacacaugacuggagagaagugggcagugccugcccucagc

SEQ ID NO: 46498 - RNA, 64 nt, Homo Sapiens
uauaaagaaaauucuauaucugagaauauauacuggagagaaaccguaaucuuuuaaagacacc

SEQ ID NO: 46499 - RNA, 64 nt, Homo Sapiens
ucaaggaauguaaacgguguagaguacuuacgcuggagagaaauuaguuccuuuuggauguaug

SEQ ID NO: 46500 - RNA, 64 nt, Homo Sapiens
uacaaagcuggaagacaucaaaaaaacuuaaacuggagagaaacccuaaaucuuacuaaacaua

SEQ ID NO: 46501 - RNA, 64 nt, Homo Sapiens
ccuacaaaugugauaaauguagauaauucauacuggagagaaauucaacuuuuauuaaaacaca

SEQ ID NO: 46502 - RNA, 64 nt, Homo Sapiens
caugcaugugugaagaauguagacaacucauacuggagagaaaccuuaaggcuuacuacauaua

SEQ ID NO: 46503 - RNA, 64 nt, Homo Sapiens
ccuacaaaugcgaagaauguagagaauucauacuggagagaaaccucaaaccuuguggaacaua

SEQ ID NO: 46504 - RNA, 64 nt, Homo Sapiens
acuacaaacgugaagaauguagaaaauucaugcuggagagaaaccucaaucuuuauuacacaua

SEQ ID NO: 46505 - RNA, 64 nt, Homo Sapiens
ucuacaaaggugaagaauguagaaaauucauacuggagagaaaauucucagucuaguaaacaua

SEQ ID NO: 46506 - RNA, 64 nt, Homo Sapiens
cucacaagugugaugauuguggagaauuuauacaggagagaaacuucauccuaugcaaaacaua

SEQ ID NO: 46507 - RNA, 64 nt, Homo Sapiens
cuuacaaaugucaugacuguggugaacucauacuggagagaaacuucacauauugcaggucauc

SEQ ID NO: 46508 - RNA, 64 nt, Homo Sapiens
cuuacaaguguaaugagugucuggacuucacacuggagagaaacuucacaccuggaacaacaua

SEQ ID NO: 46509 - RNA, 64 nt, Homo Sapiens
cuuacaaauguaagguuucuggagaauuuauacuggagagaaagaaucacaccuuaaagacaua

SEQ ID NO: 46510 - RNA, 64 nt, Homo Sapiens
cucacaugugugaugauuguggagaauucauacaggagagaaacuucauccuaugcaaaacaua

SEQ ID NO: 46511 - RNA, 64 nt, Homo Sapiens
cuuacaaaugucaugacugugacacacucauacuggagagaaacuucauacauugcaguucauu

SEQ ID NO: 46512 - RNA, 64 nt, Homo Sapiens
ucacaagugugaugauugugggaggauucauacaggagagaaacuucauccuaugcaaaacaua

SEQ ID NO: 46513 - RNA, 64 nt, Homo Sapiens
cuuauaaaugucaugauuguaucgaacucaugcuggagagaaacuucauauauugcuauucauc

SEQ ID NO: 46514 - RNA, 64 nt, Homo Sapiens
cuuacaagugcaaugagugucuagaauucacacuggagagaaacuucacaccuggcacaccaua

SEQ ID NO: 46515 - RNA, 64 nt, Homo Sapiens
ccuacaaguguaaugaauguaggcaauucguauuggagagaaacuucauaccuuguaauucaaa

SEQ ID NO: 46516 - RNA, 64 nt, Homo Sapiens
cuuacaaaugugaugaguguuuagaauucaaacuggagagaaacuucauaccuggcaaaacaua

SEQ ID NO: 46517 - RNA, 64 nt, Homo Sapiens
uuuacaaguguaaugaauguaagccauucauacuggagagaaacuucaacccuuguaagucaca

SEQ ID NO: 46518 - RNA, 64 nt, Homo Sapiens
cuuaaaaguguaaugaguguauagacuucauaguggagagaaacgucaaaccuuguauaccauc

SEQ ID NO: 46519 - RNA, 64 nt, Homo Sapiens
cucacaagugugaugauuguggaggauucauacaggagagaaacuucauccuaugcaaaacaua

SEQ ID NO: 46520 - RNA, 64 nt, Homo Sapiens
cuuauaaaugucaugauugaggugaacucaugcuggagagaaacuucaugccuugcauuucacu

SEQ ID NO: 46521 - RNA, 64 nt, Homo Sapiens
cuuacaagugcaaugagugucuagaauucacacuggagagaaacuucacacguggcaccccaua

SEQ ID NO: 46522 - RNA, 64 nt, Homo Sapiens
cuuacaagcacaaugaauguuuguaauucauaguggagagaaacaaaaggucaaaauucacacc

SEQ ID NO: 46523 - RNA, 64 nt, Homo Sapiens
ucauuauaaguguaaugagucuagaauucacacuggagagaaacugcauaucuggcaaaacaua

SEQ ID NO: 46524 - RNA, 64 nt, Homo Sapiens
cuuacaaaugggaggaauguauagacuucauacuggagagaaacagcaaccuuugcacaucacc

SEQ ID NO: 46525 - RNA, 64 nt, Homo Sapiens
cuuacaagcauaaugaauguaggcaauucauacuggagagaaacauucaacccuguaagucaua

SEQ ID NO: 46526 - RNA, 64 nt, Homo Sapiens
auguuuuauaugaaucacaauuuguguagaaauuggagagaacuuaaauaaauuaaaagagcgg

SEQ ID NO: 46527 - RNA, 64 nt, Homo Sapiens
cauaaaugauuuuggcauaccaguaaagcuaucuggagagaacaauaaacauugcuguauguua

SEQ ID NO: 46528 - RNA, 64 nt, Homo Sapiens
cuuuacugaaagacuugguuaucaagucuuuuggggagagaaugacauuuuuuuuuugagacag

SEQ ID NO: 46529 - RNA, 64 nt, Homo Sapiens
ccuuaaaacaccuguucuccagcccuuggacaguggagagaaucuguaaaagugugacccccuc

SEQ ID NO: 46530 - RNA, 50 nt, Homo Sapiens
ccggaaccgacgaguccugaggagagaaccggugcguccugaggagagaa

SEQ ID NO: 46531 - RNA, 64 nt, Homo Sapiens
gacgaguccugaggagagaaccggugcguccugaggagagaaccggcgcugggcaacacgggcc

SEQ ID NO: 46532 - RNA, 64 nt, Homo Sapiens
guaugcaccaaacugugaaugcauccagcuguuggaaaaugauguauaagucuaaguccucuug

SEQ ID NO: 46533 - RNA, 64 nt, Homo Sapiens
acagaagcuuuugccaugggccccucacaucagggaaaaugaccuucacugcuguuaacaguaa

SEQ ID NO: 46534 - RNA, 64 nt, Homo Sapiens
acucuacuuaaguauucucuguguuuuaugaagagaaaaugaucugauuuucccuuauacuuca

SEQ ID NO: 46535 - RNA, 64 nt, Homo Sapiens
gggauauucuguggguuuuggcauauuagauagagaaaaugacagaucuagaugaagggagcuu

SEQ ID NO: 46536 - RNA, 64 nt, Homo Sapiens
aaacuaaagguagaucuaucgauugugaauacuggaaaaugacauuuaaaggaaacuuugaaag

SEQ ID NO: 46537 - RNA, 64 nt, Homo Sapiens
auccuaacuuauacaccaagugacaccugaaaaugaaaaugauacuuuucugcacuuccauuuc

SEQ ID NO: 46538 - RNA, 64 nt, Homo Sapiens
augauaauccuaacuuauaccauuucugacaccugaaaaugaaaaccuagcuuuucugcacuuc

SEQ ID NO: 46539 - RNA, 64 nt, Homo Sapiens
ucuuuuaaaaagaaauuaaaaguaacuuagaacugaaaaugaucaauaauagaauaaaggguug

SEQ ID NO: 46540 - RNA, 64 nt, Homo Sapiens
aaaggcaaaaaaaauuuuuuguuugacagauuuugaaaaugaguuuaauuuaaugcugaggaga

SEQ ID NO: 46541 - RNA, 64 nt, Homo Sapiens
auauuucuuaauacaaaauagauuuagaaaugaagaaaaugaauauuagucgaaaauaaagguu

SEQ ID NO: 46542 - RNA, 64 nt, Homo Sapiens
cuagacagauuuaaguaauuccucuauaugugaggaaaaugagaggaauacacuaauuuuugcu

SEQ ID NO: 46543 - RNA, 64 nt, Homo Sapiens
aaauccccaacuaugcaugcaaccccuugguacugaaaaugagagagaagagaugcugccauuu

SEQ ID NO: 46544 - RNA, 64 nt, Homo Sapiens
ccuggacaucaccaguccuauucaauuuauuacugaaaaugauuucugcuacuucacugucauc

SEQ ID NO: 46545 - RNA, 64 nt, Homo Sapiens
aaugugugaauaacauuguauuauguauaaauuagaaaaugaaauaacuucacuucuuuguaua

SEQ ID NO: 46546 - RNA, 64 nt, Homo Sapiens
aguagagaauacuacauugaucucugcaauuuuagaaaaugacacucuguuggcacaggcauua

SEQ ID NO: 46547 - RNA, 64 nt, Homo Sapiens
agaagcagcagauuguaauuucuuuauaguauuugaaaaugagaaaacccuuuaacagugugaa

SEQ ID NO: 46548 - RNA, 64 nt, Homo Sapiens
aagaagcaaaaguggaaaccacauggcagcaagagaaaaugaggggaggugaaaggcacuucuu

SEQ ID NO: 46549 - RNA, 64 nt, Homo Sapiens
ggccagguguggugguggcuguuuuuaaaaaacagaaaaugagguucugugugcugcagccuga

SEQ ID NO: 46550 - RNA, 64 nt, Homo Sapiens
gaguaccucagagaaauuuggauauacauugcuugaaaaugaguuuauaaaacauucaaauucu

SEQ ID NO: 46551 - RNA, 64 nt, Homo Sapiens
auaaucuggcaucaguuucauguauuuuauuaaggaaaaugaaagugaauuuugugcucuuguu

SEQ ID NO: 46552 - RNA, 64 nt, Homo Sapiens
auuuaaaauauagauguguuuuauuuugaagugagaaaaugaacauuaacaggcauguuuguac

SEQ ID NO: 46553 - RNA, 64 nt, Homo Sapiens
agucgguuaaaauggauuucaugauuuucccucagaaaaugaguaacagaguccacggcgugca

SEQ ID NO: 46554 - RNA, 64 nt, Homo Sapiens
gucacaggguguucuuuuuuaugaagaaaaauuugaaaaugauaaaagcuaagaugccuucuaa

SEQ ID NO: 46555 - RNA, 64 nt, Homo Sapiens
aggauuugaaauugcauuacaguucauaaaaauugaaaaugagaaauuaaaccugcaagugaaa

SEQ ID NO: 46556 - RNA, 64 nt, Homo Sapiens
aguaaaaauagugaagacaugcaucauggaaugagaaaaugagaaaggaaugaguugucuaaca

SEQ ID NO: 46557 - RNA, 64 nt, Homo Sapiens
ucucugccuuaggcucccaggggaauccaagacagaaaaugaagacacuggcuuccaacagcag

SEQ ID NO: 46558 - RNA, 64 nt, Homo Sapiens
aauuuuuauaaaugaaaauauuuuaaugguuuaagaaaaugaggacaacaggauaauaucuuug

SEQ ID NO: 46559 - RNA, 64 nt, Homo Sapiens
cgauucagacucugacacagacaguagucaagaagaaaaugaagugacagaacauaccccuuua

SEQ ID NO: 46560 - RNA, 64 nt, Homo Sapiens
agacgacaaugaagauacugacaguagugaugcagaaaaugaaauuaaugaacaugaugucgug

SEQ ID NO: 46561 - RNA, 64 nt, Homo Sapiens
uuuaugaaccuuuuccaaguauauuguuaccgcugaaaaugaacgggaaggauuuaacaccgau

SEQ ID NO: 46562 - RNA, 64 nt, Homo Sapiens
aaauccuguguauuuguuuucuagauucauggcagaaaaugacccuuccccgcacccacgugcc

SEQ ID NO: 46563 - RNA, 64 nt, Homo Sapiens
uggaaacuucuaaaauggaaacuuuguuuucuaugaaaaugauauaaauguuacuuguuuucaa

SEQ ID NO: 46564 - RNA, 64 nt, Homo Sapiens
ccaggccuugcuaugaagcacauauaagucaaaggaaaaugagcauaaaagagaauaggcugcc

SEQ ID NO: 46565 - RNA, 64 nt, Homo Sapiens
ucaauuuuuaaaacuuuuuuuuaauuacuguaaagaaaaugaauuuuuuccugcagcaggaaac

SEQ ID NO: 46566 - RNA, 64 nt, Homo Sapiens
aaauccauuaaggguccaagaagucuguccauaugaaaaugaggguaaauauaguuuauuuccc

SEQ ID NO: 46567 - RNA, 64 nt, Homo Sapiens
ccuuuacaggggcagaaaaaggauaccaaugauagaaaaugauagaagaugcuuagggaacaau

SEQ ID NO: 46568 - RNA, 64 nt, Homo Sapiens
cucacuucagaacacacacuaaugucccugaacagaaaaugaagugcaaaaacuuggauucaca

SEQ ID NO: 46569 - RNA, 64 nt, Homo Sapiens
gccaaacagaagcaggcucccauuugcaaagggagaaaaugaaguuaacccuaagguaaaaaug

SEQ ID NO: 46570 - RNA, 64 nt, Homo Sapiens
uacuuuggguauccuguaauuuaguuguaacauagaaaaugaaaaaacaguuaaaaaaagugaa

SEQ ID NO: 46571 - RNA, 64 nt, Homo Sapiens
uguaaagucacaaauuaaugaaaaaaauucgcaugaaaaugacagauaacacuguaguuccuaa

SEQ ID NO: 46572 - RNA, 64 nt, Homo Sapiens
auuaagaaccagaaaaauaauuuuaagauuagaggaaaaugaccccacuccauuuuuuuucuau

SEQ ID NO: 46573 - RNA, 64 nt, Homo Sapiens
auuuuuuacaacugccauuucuaacuugauuuuagaaaaugagcaaaacuguaaaauuauagca

SEQ ID NO: 46574 - RNA, 64 nt, Homo Sapiens
uuuaaauguuuuuuaaaagagagagaaaguauuugaaaaugauugguucuaaagaaaucuagau

SEQ ID NO: 46575 - RNA, 64 nt, Homo Sapiens
acuccuuuuaaaaauaaaauugaguuuccauaaggaaaaugaaagagcauugcuuguaaaaucc

SEQ ID NO: 46576 - RNA, 64 nt, Homo Sapiens
agaauauuccagcucaacaaccuaucuagauuaggaaaaugaucuugucagcauccagccaugu

SEQ ID NO: 46577 - RNA, 64 nt, Homo Sapiens
cuagacgggugggggacacuguaaacaaguacaggaaaaugaaaccgauuagaggcuacuuccu

SEQ ID NO: 46578 - RNA, 64 nt, Homo Sapiens
auauauucuugcagacgagcguugucgaaguggagaaaaugaggacuaugcaagaaaauguaca

SEQ ID NO: 46579 - RNA, 64 nt, Homo Sapiens
uaauuucgguacaucuuaugagaggaaaguagaggaaaaugaaaaaaguaaacuaaaaugacac

SEQ ID NO: 46580 - RNA, 64 nt, Homo Sapiens
acuuugaucauucagucuuugauaguccuacugagaaaaugagcuuaucauccuccuagcagaa

SEQ ID NO: 46581 - RNA, 64 nt, Homo Sapiens
cuuauguagaccagaagcugcaauauacaaugaugaaaaugaaacgaaaaggaaguccccccau

SEQ ID NO: 46582 - RNA, 64 nt, Homo Sapiens
ugagggagguuggcauggagacuaaaauucucaggaaaaugagauccguguuagauuagaaguc

SEQ ID NO: 46583 - RNA, 64 nt, Homo Sapiens
agccaucacucuuuuuggaucucuauaggggacagaaaaugagagaagaaaugauauuuauauu

SEQ ID NO: 46584 - RNA, 64 nt, Homo Sapiens
ccaguguguuggauuccagaaagugauacaucuugaaaaugaaucugucacgugcuggaaaaua

SEQ ID NO: 46585 - RNA, 64 nt, Homo Sapiens
cagagcauggaaaaggaauaccuucaauuucugagaaaaugaggaaaaaaauaauaaucaaaug

SEQ ID NO: 46586 - RNA, 64 nt, Homo Sapiens
gcaaacacaaaaccuugaguaauucaggggcuuagaaaaugaaaucagugauucuuuacuugca

SEQ ID NO: 46587 - RNA, 64 nt, Homo Sapiens
ggcaaaaagcacuucuuacauggcggcagcaagagaaaaugagaaagaagcaaaaguggaaacc

SEQ ID NO: 46588 - RNA, 64 nt, Homo Sapiens
ggugaaaagcacuucguacauggugguggcaagagaaaaugaagaagaagcaaaaguggaaacc

SEQ ID NO: 46589 - RNA, 64 nt, Homo Sapiens
gauuguugggcccuuuggcauguuaaggggguaggaaaaugacugaaaacaaaaugaggcauuu

SEQ ID NO: 46590 - RNA, 64 nt, Homo Sapiens
ucauuuauaaaugaacauacuguauuuuggaaaagaaaaugauuugccuugaauauugcuucca

SEQ ID NO: 46591 - RNA, 64 nt, Homo Sapiens
aaguuagagcuuuauaacuauauuuguguuuuuugaaaaugaagaacuuuauuuuuuucaugcu

SEQ ID NO: 46592 - RNA, 64 nt, Homo Sapiens
uaacagauggguaacuuuauauuuaauucugcaagaaaaugauuauucagaaaaauauauauua

SEQ ID NO: 46593 - RNA, 64 nt, Homo Sapiens
uuuucuaaguaaguuuauucugaaauauaggaaagaaaaugauacuuuugcaauaccucaauuu

SEQ ID NO: 46594 - RNA, 64 nt, Homo Sapiens
aucaaaggaagagaugugguuuauaaucccuuuugaaaaugauauccaucaaaagguucuuuuu

SEQ ID NO: 46595 - RNA, 64 nt, Homo Sapiens
ucuuuuaaaugagcaagagaaaagcacaugauuagaaaaugagagaaauaguauuaaaugucuc

SEQ ID NO: 46596 - RNA, 64 nt, Homo Sapiens
uucugggaacuuuuuugggggaugaauuuaagcagaaaaugaauaaggaaugagaaacaauuuu

SEQ ID NO: 46597 - RNA, 64 nt, Homo Sapiens
uauaacaagugggugaauguaaugaugcuuuucugaaaaugaaauggacaaaccgagugcaaug

SEQ ID NO: 46598 - RNA, 64 nt, Homo Sapiens
uuaugcagaaaaaaaugaggccgaaaauuuagaggaaaaugaagagcccuucguugcccccuua

SEQ ID NO: 46599 - RNA, 64 nt, Homo Sapiens
cuuugcuccaauaagcuuugcaaucaaggccaaagaaaaugaucugcuuccccuggaaaaaaau

SEQ ID NO: 46600 - RNA, 64 nt, Homo Sapiens
cauugauaacacaggucuuuuauggaggaaagaagaaaaugacaguaagguuucaagguacagu

SEQ ID NO: 46601 - RNA, 64 nt, Homo Sapiens
gccagcaguggaaaugccagcagggcggcaggaugaaaaugacuagaagcaggcaccuuuuuca

SEQ ID NO: 46602 - RNA, 64 nt, Homo Sapiens
cccacaguggucuuuucccuccugaucagaggcagaaaaugaccgggaggugcaacuggcaggg

SEQ ID NO: 46603 - RNA, 64 nt, Homo Sapiens
ccaucuuuugccugccaugauuuuuccucugaaggaaaaugaacaugguuguccacccuggggg

SEQ ID NO: 46604 - RNA, 64 nt, Homo Sapiens
aauuguuuacuggauuuauaagaaguuaauuuuugaaaaugacauauuuuugugugauagaaag

SEQ ID NO: 46605 - RNA, 64 nt, Homo Sapiens
uuuauuuagcauagacauuaaagauaacucucuggaaaaugacuugacuaaggcucucaugaaa

SEQ ID NO: 46606 - RNA, 64 nt, Homo Sapiens
aagccccaaagugagaacuuuucaucauucauuugaaaaugaaauuauuuuaaaaaauuauguu

SEQ ID NO: 46607 - RNA, 64 nt, Homo Sapiens
auguuuguguugcuacagcuuucaugugucacaugaaaaugaucuaacaaguguaaugagaaag

SEQ ID NO: 46608 - RNA, 64 nt, Homo Sapiens
ucucugccaagguuuuaagauccgcgacgauucugaaaaugagcaagccauuuaaggguggacc

SEQ ID NO: 46609 - RNA, 64 nt, Homo Sapiens
aaaagaguaguucaagaaguaagaaaugaagaaagaaaaugaugaaaaggugaucccucuaaga

SEQ ID NO: 46610 - RNA, 64 nt, Homo Sapiens
gcuugagucgccugaaccaaaagcccaugugcaagaaaaugagggaaucugacaggacagcuuu

SEQ ID NO: 46611 - RNA, 64 nt, Homo Sapiens
gcuugagucgccugaacgaaaagcccaaguggaagaaaaugagggaaucuggcaggacagcuuu

SEQ ID NO: 46612 - RNA, 64 nt, Homo Sapiens
ugccagugagaagugcaacauccagugggcagaugaaaaugaugcauggccaaguucaguguuu

SEQ ID NO: 46613 - RNA, 64 nt, Homo Sapiens
ccuuccccaucaaauccuugauaaggcuuugugggaaaaugaucuaaauuauuguuuuaauuuu

SEQ ID NO: 46614 - RNA, 64 nt, Homo Sapiens
guuacaggugacggacgccucaagagagagaagagaaaaugaaagcagcugguuuugcagaagu

SEQ ID NO: 46615 - RNA, 64 nt, Homo Sapiens
ccccuggggucuuaccucacugggaauguguuuugaaaaugaauuugaagacaagccaacaaac

SEQ ID NO: 46616 - RNA, 64 nt, Homo Sapiens
caucggugaugcgcucaccuguguguuugagaaggaaaaugacccacaauuggcaauaaaaccu

SEQ ID NO: 46617 - RNA, 64 nt, Homo Sapiens
uuucaaaacguaucuuaaauguguggacuggcaggaaaaugauuauugucuguugcaggucuuc

SEQ ID NO: 46618 - RNA, 64 nt, Homo Sapiens
ucaauguauuauuuuuguagauagaagcuuuggagaaaaugaaugaagaucacguucagaagaa

SEQ ID NO: 46619 - RNA, 64 nt, Homo Sapiens
gacauaagucauguaauuuuuguugauauaucaugaaaaugaacagaauucuuuuuccauacuu

SEQ ID NO: 46620 - RNA, 64 nt, Homo Sapiens
uuuacaauguaucccagcuuagguacaggcuuacgaaaaugauccgucauugauagcaaaagaa

SEQ ID NO: 46621 - RNA, 64 nt, Homo Sapiens
uacacugagaaugaauauggcagaaaaugaaaaagaaaaugaguuaauagggaaagaagaguua

SEQ ID NO: 46622 - RNA, 64 nt, Homo Sapiens
aagaaaaugaguuacacugaaaagaagaguuacagaaaaugaaagaguauguggaguaauaggg

SEQ ID NO: 46623 - RNA, 64 nt, Homo Sapiens
aagcaaaagcuggaagcauuccccuugagaacuggaaaaugacagggaugaccacucucaccac

SEQ ID NO: 46624 - RNA, 64 nt, Homo Sapiens
aggcucuuauccuaagugaauuaaugcaggaacagaaaaugaaauaucccauguucucacuuau

SEQ ID NO: 46625 - RNA, 64 nt, Homo Sapiens
uaugcaagcacauuggugacgaacugauaugcaggaaaaugaaagccugaaaugccuuaauugu

SEQ ID NO: 46626 - RNA, 64 nt, Homo Sapiens
uucagauggugaaauguggauuaauaacucaguggaaaaugauggcagaauaaacucuuuacaa

SEQ ID NO: 46627 - RNA, 64 nt, Homo Sapiens
gcagaauaaacucuuuacaauuaauaacucaguggaaaaugauguucagauggugaaaugugga

SEQ ID NO: 46628 - RNA, 64 nt, Homo Sapiens
gccugaaaugccuuaauugugaacugauacgcaggaaaaugaaauauguaagcacauuggugac

SEQ ID NO: 46629 - RNA, 64 nt, Homo Sapiens
uguaauucauucaguggugccaaagcuggggguucccuacaauggcuauuuagacuuucccugc

SEQ ID NO: 46630 - RNA, 64 nt, Homo Sapiens
uuucaucagaaguuuucauuuuuucuaaauccuccccuacaaaauuuucagauuggaaauuacu

SEQ ID NO: 46631 - RNA, 64 nt, Homo Sapiens
aacuguagauaagaaaauucauacuggaaagaaacccuacaaaugugaagucuguggcaaagcu

SEQ ID NO: 46632 - RNA, 64 nt, Homo Sapiens
uacuacauguaagaguauuuauacuggaaagaaacccuacaaauguaaaaaacguggcaaugcc

SEQ ID NO: 46633 - RNA, 64 nt, Homo Sapiens
cacugaacauaaguuaauucauacuggagaaaaacccuacaaauguaaagaauguggaaaagcu

SEQ ID NO: 46634 - RNA, 64 nt, Homo Sapiens
uauuacacauaagauaauucacaguggagaaaaacccuacaaaugugaagaauguggcaaagcu

SEQ ID NO: 46635 - RNA, 64 nt, Homo Sapiens
uaugagacauaagaaaauucauaguaaagagaaacccuacaaaugugaacaguguggcaagguc

SEQ ID NO: 46636 - RNA, 64 nt, Homo Sapiens
uacuaaacacaagaagauucauacuagagagaaacccuacaaaugugaagaauguggcauaucu

SEQ ID NO: 46637 - RNA, 64 nt, Homo Sapiens
ugcuauacauaagaugauucacacuugaaugaaacccuacaaaugugaacgauguggcaguugu

SEQ ID NO: 46638 - RNA, 64 nt, Homo Sapiens
cuuaguaaauuugagaguuuauauggaacacaaacccuacaaauauaaagaaugugacaaagcu

SEQ ID NO: 46639 - RNA, 64 nt, Homo Sapiens
acccuuauuacacauaauucauaccaaacagaagcccuacaagugugaagaauguggcaaaacc

SEQ ID NO: 46640 - RNA, 64 nt, Homo Sapiens
uaauacacauaagauaauuaaugcuggagagaaacccuacaaaugugaagaauguggcaaagau

SEQ ID NO: 46641 - RNA, 64 nt, Homo Sapiens
gccuacacguaagauaauucauacuggaaggaaacccuacaaauaugaggaaugucucaaagcu

SEQ ID NO: 46642 - RNA, 64 nt, Homo Sapiens
uacugcacauaagauaauuuauacuggagagaagcccuacaaaugugaaaaauguggcaaaccu

SEQ ID NO: 46643 - RNA, 64 nt, Homo Sapiens
uacuacacauuagauaauucaugcuggagagaaacccuacaaaugugaaaaauguggcaaagcu

SEQ ID NO: 46644 - RNA, 64 nt, Homo Sapiens
uuuauugaacaaaauaauucauacaggagagaaacccuacaaaugugaagaaugugacaaagcc

SEQ ID NO: 46645 - RNA, 60 nt, Homo Sapiens
uuacuaaacauaauucauaauggagaaaaacccuacaaaugugaagaaugugucaaagcu

SEQ ID NO: 46646 - RNA, 64 nt, Homo Sapiens
cuuacuaaacauaagggaauucauaauagagaaacccuacaaaugugaagaacguggccuggcu

SEQ ID NO: 46647 - RNA, 64 nt, Homo Sapiens
guaaggaaugugggaaagccauacuggagagaaacccuacaaauucaaagacaugaaaggacuc

SEQ ID NO: 46648 - RNA, 64 nt, Homo Sapiens
gcaaggaaugugggaaagccauacuggagagaaacccuacaaauucaaagacaugaaaagacuc

SEQ ID NO: 46649 - RNA, 64 nt, Homo Sapiens
guaaggaaugugggaaacccauacuggagagaaacccuacaaauucaaaaacaugaaaaggcuc

SEQ ID NO: 46650 - RNA, 64 nt, Homo Sapiens
gugaagaauguggcaagccuauacaggagggaaacccuacaaauuacugaacauaagggaauuu

SEQ ID NO: 46651 - RNA, 64 nt, Homo Sapiens
gugaaaaacguggcaaagcuuacuggaggaaaagcccuacaaauacuacucauaaaagaauuca

SEQ ID NO: 46652 - RNA, 64 nt, Homo Sapiens
gcgaagaaugugauaaagacauacuggagagaaacccuacaaauuguggaacauaagagaauuc

SEQ ID NO: 46653 - RNA, 64 nt, Homo Sapiens
uuuccagauggcuaguuuauuaaugauuucccaaaagccauaccuuaaagauaacuuuuuaaau

SEQ ID NO: 46654 - RNA, 64 nt, Homo Sapiens
aguauuuuggaauuuguauaauaaggauguuuagaagccauauaaguggcuuuuuuuaacagau

SEQ ID NO: 46655 - RNA, 64 nt, Homo Sapiens
guuagacugcaauacuaacgacauagcuuuagagaagccauaacgcauugaccuucaugaccuu

SEQ ID NO: 46656 - RNA, 64 nt, Homo Sapiens
cccaggcccgcccugcccgcccccacgccgauauaagccauagcagggacgagcagagcgcagc

SEQ ID NO: 46657 - RNA, 64 nt, Homo Sapiens
cuaaauucacuguugaaugcuugauuaaacagcaaagccauauugugucuccagguaacuuugc

SEQ ID NO: 46658 - RNA, 64 nt, Homo Sapiens
uagucaauaacucugauuuuuuccucgggaugaaaagccauauccgcuuagaaacauguuccug

SEQ ID NO: 46659 - RNA, 64 nt, Homo Sapiens
cccugaggcccugggcuggggaccacucuucuuuaagccauagacagugaccuuugaccucggu

SEQ ID NO: 46660 - RNA, 64 nt, Homo Sapiens
ugaccagaagccuuggaaccuuggaaauagaaagaagccauauaccuggacacauuggaaugcc

SEQ ID NO: 46661 - RNA, 64 nt, Homo Sapiens
uuuuuagggaaacuaaggagagcuacuuuuuauaaagccauauuuucauuuugugaauuauaga

SEQ ID NO: 46662 - RNA, 64 nt, Homo Sapiens
aagugguuugaucgauauauagcaacuauaagcaaagccauaagaucauuuugaaaggaccaug

SEQ ID NO: 46663 - RNA, 64 nt, Homo Sapiens
ugaggccacuuaucagggccuggagcccugauggaagccauaggaacuccagaguugccaagcc

SEQ ID NO: 46664 - RNA, 64 nt, Homo Sapiens
cccugauggaagccauaggaacuccagaguugccaagccauagcugagaagccuggugguuuuc

SEQ ID NO: 46665 - RNA, 64 nt, Homo Sapiens
guguccaggcucugggcacagugcugccccuugcaagccauaacgugcccccagaguguagggg

SEQ ID NO: 46666 - RNA, 64 nt, Homo Sapiens
auaacgugcccccagaguguagggggccuugcggaagccauagggggcugcacgggaugcgugg

SEQ ID NO: 46667 - RNA, 64 nt, Homo Sapiens
ccugaagauuggcccugugcagaaaauguuccaaaagccauaaguucuguucucuauuaaauua

SEQ ID NO: 46668 - RNA, 64 nt, Homo Sapiens
acucauauugacacucagcuuuuaaaggagauugaagccauagaggacccuuaagaauuuuauu

SEQ ID NO: 46669 - RNA, 65 nt, Homo Sapiens
cuaccacugagcugcuggagguggguccuuauuucaagccauauucaacccacccaacaaaaccu

SEQ ID NO: 46670 - RNA, 65 nt, Homo Sapiens
acaguuguuaacccacuaggcuccuuugaguagagaagccauaguccuucagccuccaauugaua

SEQ ID NO: 46671 - RNA, 65 nt, Homo Sapiens
gaugaaaagagcucuaaugccuuucaggcucuuagaagccauagauuuggacaagcccagcaaga

SEQ ID NO: 46672 - RNA, 65 nt, Homo Sapiens
cccuuuguaauaaaaagcuaguuuccugagugaacaagccauaaccuccccuaaacaccaccuag

SEQ ID NO: 46673 - RNA, 65 nt, Homo Sapiens
agacaguguacaaacuaagaaggccuaacugaacuaagccauauuuaucacccguggacagcaca

SEQ ID NO: 46674 - RNA, 65 nt, Homo Sapiens
gucucuuucgggggcagaggcuuucucugggugccaagccauauauauuagggaauaguagauug

SEQ ID NO: 46675 - RNA, 65 nt, Homo Sapiens
gcucaggaaguuucucugugcaacuagaaaauucaaagccauauuuagggaacauuuuuucugag

SEQ ID NO: 46676 - RNA, 65 nt, Homo Sapiens
gucuguagaccuuguaaucagcacauugucaccccaagccauagucucucucuuauuuguauccu

SEQ ID NO: 46677 - RNA, 65 nt, Homo Sapiens
guucacacuucugcuuugagaccaggaugggguguaagccauagaguaagguuaacaaaaagaau

SEQ ID NO: 46678 - RNA, 65 nt, Homo Sapiens
uaauucuucagauaugagauagugggcuuagaccuaagccauacauauuucuuuucccacauucu

SEQ ID NO: 46679 - RNA, 65 nt, Homo Sapiens
gaggcaacagcagcaagggcuggucuggacaagaaaagccauagcccggcagccccuaccaugag

SEQ ID NO: 46680 - RNA, 65 nt, Homo Sapiens
cuuccaagucugagcugugcugggguuugaacuaaaagccauauguggaauauugacauguguaa

SEQ ID NO: 46681 - RNA, 65 nt, Homo Sapiens
augggcuggccaggcugugucaccuucuccaagcaaagccauauggagcaucuacccagacuccc

SEQ ID NO: 46682 - RNA, 65 nt, Homo Sapiens
uaagcauaguuuuauccagggagaaaaauaaaaggaagccauagaauugcucuggucaaaaccaa

SEQ ID NO: 46683 - RNA, 65 nt, Homo Sapiens
gaaguauuugggcaggugagucauguuuuaaccacaagccauaacucaucuguugucuuugcuug

SEQ ID NO: 46684 - RNA, 65 nt, Homo Sapiens
gccccuccugguugauacuuuuagguuaauaaaucaagccauagauggcagugacuucuuuugag

SEQ ID NO: 46685 - RNA, 65 nt, Homo Sapiens
ugagaauguagcuacucaaagaacuuugauaaaugaagccauaucaaaauuauguaauacuugug

SEQ ID NO: 46686 - RNA, 65 nt, Homo Sapiens
gucccaaaauagauguucugaguaaauagcauuuuaagccauaauuguuuauuugugaaguuaaa

SEQ ID NO: 46687 - RNA, 65 nt, Homo Sapiens
aauccuuuccuaccaguuuuuuuguucuauagauaaagccauaaggaucuucagaaucucuaguu

SEQ ID NO: 46688 - RNA, 65 nt, Homo Sapiens
aauaacugcauuuuccuaacagguuuaacugaaugaagccauauuaggaauauuuugcagaauau

SEQ ID NO: 46689 - RNA, 65 nt, Homo Sapiens
uggugauacugaaaacuuuguuuuuuuuucuuuuuaagccauaaucaggggauuuuuuuuucucc

SEQ ID NO: 46690 - RNA, 65 nt, Homo Sapiens
gaucagagggccuuguccuuagggacaugggaaccaagccauagggaggggagauuuaaaggacc

SEQ ID NO: 46691 - RNA, 65 nt, Homo Sapiens
caggaaugccuuuggcaauacuugguuccaucgugaagccauaaauaggagucugcgagagccuc

SEQ ID NO: 46692 - RNA, 65 nt, Homo Sapiens
caaauacugaaaagaaggccccuguccuacccucaaagccauaugaagguggggaaaaagacuaa

SEQ ID NO: 46693 - RNA, 65 nt, Homo Sapiens
acaugagcuuaauaggcuguucacagauacuuuauaagccauagugaaucauggagcugagaauu

SEQ ID NO: 46694 - RNA, 65 nt, Homo Sapiens
auacucuuucacuuaauucuuuacaagggauaucaaagccauaauggacuucauuaguuuuaggg

SEQ ID NO: 46695 - RNA, 65 nt, Homo Sapiens
ucuugauuuucccauuucuaaagaugaauuucacaaagccauaaagcgugaaauuagagcuggac

SEQ ID NO: 46696 - RNA, 65 nt, Homo Sapiens
auuccuaagaacuuucuaucaaaagcauuggauccaagccauauauugaaauacaagcgugauua

SEQ ID NO: 46697 - RNA, 65 nt, Homo Sapiens
gacacagaagauugccuuacgcucgugagcgugagaagccauaagagagagaccgaauucugugg

SEQ ID NO: 46698 - RNA, 65 nt, Homo Sapiens
aauuguuuaauuucaccugaauaucauaaugcuuaaagccauauggaguuggaaauuauuuccaa

SEQ ID NO: 46699 - RNA, 65 nt, Homo Sapiens
uuuuccagauggcuaguuuauuaaugauuucccaaaagccauaccuuaaagauaacuuuuuaaau

SEQ ID NO: 46700 - RNA, 65 nt, Homo Sapiens
uaguauuuuggaauuuguauaauaaggauguuuagaagccauauaaguggcuuuuuuuaacagau

SEQ ID NO: 46701 - RNA, 65 nt, Homo Sapiens
gagaccacuuagagggucucuaugccaaggucaacaagccauaccauccacugguuccagcugac

SEQ ID NO: 46702 - RNA, 65 nt, Homo Sapiens
gaagacaagugaugcuaaaaccugaaauuccaaugaagccauaugaacagcuguucaguugcacu

SEQ ID NO: 46703 - RNA, 65 nt, Homo Sapiens
guuggaguuuauaucacucacuaugcacuuguauaaagccauaauauuacuugcugcaguugcaa

SEQ ID NO: 46704 - RNA, 65 nt, Homo Sapiens
uuuucaggauucuuccccuaugcugcugcugugugaagccauacuaucgauaguguuuucuucaa

SEQ ID NO: 46705 - RNA, 65 nt, Homo Sapiens
auggcgguuugggggagccugacauuacagaugagaagccauauaagagagaaacaaaaaagugu

SEQ ID NO: 46706 - RNA, 65 nt, Homo Sapiens
uaguuuuauuuuuguaaugcaauggcacuuuaagcaagccauaguuaaaaaagacaacuuuauaa

SEQ ID NO: 46707 - RNA, 65 nt, Homo Sapiens
acauagcuauaauuacuaccuuuaaaugaaauagaaagccauauaucacauuuuauuuggagaua

SEQ ID NO: 46708 - RNA, 65 nt, Homo Sapiens
uuaaauaguguuauaaaauagcacugguuuagaaaaagccauaacuauaacuauuaccuuaaaaa

SEQ ID NO: 46709 - RNA, 65 nt, Homo Sapiens
auauuuuccuuccuaucaaucugacucuuugguauaagccauaaaacagugacuaugcauuagug

SEQ ID NO: 46710 - RNA, 65 nt, Homo Sapiens
uccuuccccacucccauccuagaaagcucccuuguaagccauacuauccacauuuugaaaugcaa

SEQ ID NO: 46711 - RNA, 65 nt, Homo Sapiens
acacaauauuauauugcauauugcccaauaagcagaagccauaaggucucacacuuuucuuauaa

SEQ ID NO: 46712 - RNA, 65 nt, Homo Sapiens
auaauuugaaagcuaugagaauagaugugugggugaagccauagaacauauuugcuugaaauucu

SEQ ID NO: 46713 - RNA, 65 nt, Homo Sapiens
cccaggcucccuuugcacacagagcagcuacuucuaagccauaucgacuguuuugcagaggauuu

SEQ ID NO: 46714 - RNA, 65 nt, Homo Sapiens
uuagacuuuuguauaagagaugucaugccucaagaaagccauaaaccugguaggaacagguccca

SEQ ID NO: 46715 - RNA, 65 nt, Homo Sapiens
uucagggcagacggcaauaaucucuuacaagaaugaagccauauucaaccccagaugagaaaacc

SEQ ID NO: 46716 - RNA, 65 nt, Homo Sapiens
uguugcuaauauugaggaggcuugccccacccaacaagccauaguggagagaacugaauaaacag

SEQ ID NO: 46717 - RNA, 65 nt, Homo Sapiens
guaaaaagucuuuaagacauaagaauuccucaaagaagccauacauuuuuuaagguggggauuga

SEQ ID NO: 46718 - RNA, 65 nt, Homo Sapiens
caagcuaaaccucaaauauaaaaauuggcgaaaagaagccauacgccuuuuuaauuugccaaaaa

SEQ ID NO: 46719 - RNA, 65 nt, Homo Sapiens
uuauuagccagugaaacacuugcuugccaacugccaagccauacuuauuaaguucgaacauguuu

SEQ ID NO: 46720 - RNA, 65 nt, Homo Sapiens
gcagagcuaaaugcaauagauauuccugcauugggaagccauaucaaaucugucucagccuacuu

SEQ ID NO: 46721 - RNA, 65 nt, Homo Sapiens
agccuccagaugggggcuggcacacuaggugugggaagccauagggcgggcucagccuuccugga

SEQ ID NO: 46722 - RNA, 65 nt, Homo Sapiens
aagaaaaaugugauguauguggugggggugggcuaaagccauagguuuuuggucucuuuuggugg

SEQ ID NO: 46723 - RNA, 65 nt, Homo Sapiens
gauaccucaagccuagcaccugaccugugccuuuuaagccauaaauagcuuuuaauucagcugca

SEQ ID NO: 46724 - RNA, 65 nt, Homo Sapiens
aaccauagaaauguaaaagaugugacaaaaccuuuaagccauacuccaggcuucuuaaacauaau

SEQ ID NO: 46725 - RNA, 65 nt, Homo Sapiens
ucugugcauacucagcuuuguagaaccaugcugcaaagccauauaccgaugggguuauccaugca

SEQ ID NO: 46726 - RNA, 65 nt, Homo Sapiens
cugccucuguauagauguugucaguuaggaaacugaagccauaggucaggcagacaucagcucag

SEQ ID NO: 46727 - RNA, 65 nt, Homo Sapiens
acuuacuggugcauguuguaacauaucuaugauaaaagccauaguuuaccuaaaauggugauuuc

SEQ ID NO: 46728 - RNA, 65 nt, Homo Sapiens
ggcgcaucauaugcagugauauaugccuauaauauaagccauagguucacaccauuuuguuuaga

SEQ ID NO: 46729 - RNA, 65 nt, Homo Sapiens
guuagacugcaauacuaacguacauagcuuuagagaagccauaacggcauugaccuucaugaccu

SEQ ID NO: 46730 - RNA, 65 nt, Homo Sapiens
cccaggcccgcccugcccgccccccacgccgauauaagccauagcgagggacgagcagagcgcag

SEQ ID NO: 46731 - RNA, 65 nt, Homo Sapiens
uuucuuggauuuucuuccaauuaguugauaacauaaagccauaguuuacccugcuugaaauacag

SEQ ID NO: 46732 - RNA, 65 nt, Homo Sapiens
aaaaaaagaaaagaaaaauaaauaaagugucauccaagccauaaacuucuaguauuggaucugaa

SEQ ID NO: 46733 - RNA, 65 nt, Homo Sapiens
agguuauauugaaauguauuaacaaaaaugauauaaagccauaugaggaggaaaacauuagggaa

SEQ ID NO: 46734 - RNA, 65 nt, Homo Sapiens
uguucuuaguuugcaguuaccauggaguauaugucaagccauaauccucucccaucacuucccua

SEQ ID NO: 46735 - RNA, 65 nt, Homo Sapiens
ucagggucaucaagaaaaauuuggaacugaggaggaagccauagcacaacgaaagcugaauagug

SEQ ID NO: 46736 - RNA, 65 nt, Homo Sapiens
cuaaauucacuguugaaugccuugauuaaacagcaaagccauauuugugucuccagguaacuuug

SEQ ID NO: 46737 - RNA, 65 nt, Homo Sapiens
uagucaauaacucugauuuuguuccucgggaugaaaagccauaucgcgcuuagaaacauguuccu

SEQ ID NO: 46738 - RNA, 65 nt, Homo Sapiens
uaaaaagaacucaaaaggagaacugugcucucccaaagccauaucaccagucuuaccaaacaaua

SEQ ID NO: 46739 - RNA, 65 nt, Homo Sapiens
caugaaguauugaucauuuucuaucucaaaaguguaagccauaaggcuguuuuacagaauagcac

SEQ ID NO: 46740 - RNA, 65 nt, Homo Sapiens
uaguuuuguguggcaucacagugauuugucaugaaaagccauauaugggggacaugcuaaaaugg

SEQ ID NO: 46741 - RNA, 65 nt, Homo Sapiens
uucauaccaaguauuggguacagguuacaauuuugaagccauaugaguuuauauugauuuuuuuu

SEQ ID NO: 46742 - RNA, 65 nt, Homo Sapiens
aaugguaagaaauugaaguauccuuaaaggccaugaagccauaugucccuaaagccuguguggag

SEQ ID NO: 46743 - RNA, 65 nt, Homo Sapiens
uagguuugauucuuguuagaggguuuuuguucuggaagccauauuugauaguauacuuugucuuc

SEQ ID NO: 46744 - RNA, 65 nt, Homo Sapiens
acuccuguggcaccguuucucccuccacagggccaaagccauaguguccggucccaaggacaagg

SEQ ID NO: 46745 - RNA, 65 nt, Homo Sapiens
agacaugugucuucucuguccguuuccaauagguaaagccauaucaguuagacugcaauacuuua

SEQ ID NO: 46746 - RNA, 65 nt, Homo Sapiens
agaaacuugacuaugccuggccucagugauuuuaaaagccauagagugaugauuaucauaugaua

SEQ ID NO: 46747 - RNA, 65 nt, Homo Sapiens
ucauacuaaauaauauuauauuuaaagauucaaggaagccauaaguuuuuuuucaagagaguuau

SEQ ID NO: 46748 - RNA, 65 nt, Homo Sapiens
uaaauuucugaaguuaacuccaauaucaucuaaucaagccauauuuuguaaaaguaauaauuccc

SEQ ID NO: 46749 - RNA, 65 nt, Homo Sapiens
cgugccuguuugcuuagcaucucaaggagaaauugaagccauaguuuuuuuuuuuuuuuuuuaag

SEQ ID NO: 46750 - RNA, 65 nt, Homo Sapiens
uauuuaauuuccaaauaauuuuuuauuuuugaaggaagccauaacuucguuaauuaaaucugcag

SEQ ID NO: 46751 - RNA, 65 nt, Homo Sapiens
uugggcugaaggacaaauugggcauuauuauuuccaagccauagccaagcuauuuuaaagauaau

SEQ ID NO: 46752 - RNA, 65 nt, Homo Sapiens
ggucccuaguucauuguugaugggccauguucauuaagccauaguaaaaccauuaguaggagggg

SEQ ID NO: 46753 - RNA, 65 nt, Homo Sapiens
gaaauggcccuuuugaauguugaagauaggaaagaaagccauauauucaaauauguaauuuuccu

SEQ ID NO: 46754 - RNA, 65 nt, Homo Sapiens
uuccugagguggauuuacugagagaaggugaaauaaagccauauuuaguauaccagagaagguag

SEQ ID NO: 46755 - RNA, 65 nt, Homo Sapiens
gagcacauuggugacagaccuucggggccugucugaagccauagccuccacggagagcccugugg

SEQ ID NO: 46756 - RNA, 65 nt, Homo Sapiens
agacuugcuaaccaagcucgaaaaugaacaugaaaaagccauacauguauuauuucuccuaaaac

SEQ ID NO: 46757 - RNA, 65 nt, Homo Sapiens
cuugguaccaaguccagguauaacauuccuauuggaagccauacuuauauuuucuuguaaagugc

SEQ ID NO: 46758 - RNA, 65 nt, Homo Sapiens
uaaagacuuuagcugacucguuaagccugauacauaagccauauuuaaaauucuaagaaauaauu

SEQ ID NO: 46759 - RNA, 65 nt, Homo Sapiens
ggaccaggauggacaacucauuggcccugccucaaaagccauaccucuucuccugcuaugcagaa

SEQ ID NO: 46760 - RNA, 65 nt, Homo Sapiens
ugauuucccuaguaaccuugcagauauguuuaaccaagccauagcccaugccuuuugagggcuga

SEQ ID NO: 46761 - RNA, 65 nt, Homo Sapiens
cuccuacauguauuuuauaacccccucuugucuuuaagccauauuaugaacaauuaagaggcucu

SEQ ID NO: 46762 - RNA, 65 nt, Homo Sapiens
ggugaaaaauuguauauuugacuuacccaucagagaagccauacuaagcuucuaacaaaacucug

SEQ ID NO: 46763 - RNA, 65 nt, Homo Sapiens
ucuuauuaagcuuuauaucugagcaccugggcggaaagccauauauugaccuuccacuagaccau

SEQ ID NO: 46764 - RNA, 65 nt, Homo Sapiens
aauaaguauaaaaaagcuuuuugccauguugcaaaaagccauaaucugcuuuaagcuguaauguu

SEQ ID NO: 46765 - RNA, 65 nt, Homo Sapiens
ccccaugauuauauaguuaugaaaauuuuauguugaagccauaucgugguauuauggaccgaacu

SEQ ID NO: 46766 - RNA, 65 nt, Homo Sapiens
uguggaaaauauauugucuuggaaauuuguuguaaaagccauauuucuaauggaaaaucaggugu

SEQ ID NO: 46767 - RNA, 65 nt, Homo Sapiens
cuuuuacuaaacauaagguaauucauacuggagaaaagccauacaaaugagaagaauguggcaau

SEQ ID NO: 46768 - RNA, 65 nt, Homo Sapiens
auggagacuacuucguaguggaguaccgggaccagaagccauacugcaucagccccugugagccu

SEQ ID NO: 46769 - RNA, 65 nt, Homo Sapiens
ucccaaggccccacuuucaagaaucagacagcaggaagccauagaugcuggcuggguuccagguu

SEQ ID NO: 46770 - RNA, 65 nt, Homo Sapiens
caaauaaaacccugccuuguaaaauaguaaaagagaagccauauauuggcuuuucuucuuaacuu

SEQ ID NO: 46771 - RNA, 65 nt, Homo Sapiens
augcuaaaauucuauagagaguuuucugggggaaaaagccauaucuuggugcugguuuauuuguu

SEQ ID NO: 46772 - RNA, 65 nt, Homo Sapiens
cagaaaggacagaaucucucugcuugugcagaaagaagccauagcacuggggugggggcugagca

SEQ ID NO: 46773 - RNA, 65 nt, Homo Sapiens
gguagguuugcccuuugguauuuguaagccaucacaagccauaguaggcuaugcuucaguuuuuc

SEQ ID NO: 46774 - RNA, 62 nt, Homo Sapiens
gacacugugacaaugacuaaaaacaagcuucaaagccauaugacuuguaugauuucuuguga

SEQ ID NO: 46775 - RNA, 65 nt, Homo Sapiens
aaguauuuugcuuguuaaauguuauuuuccauuaaaagccauauuuaacaaaucauuucuaaaca

SEQ ID NO: 46776 - RNA, 65 nt, Homo Sapiens
cucacagaaaaagaaaaagacuaaaguuucaauacaagccauagggcaccacagcucaagaaaac

SEQ ID NO: 46777 - RNA, 65 nt, Homo Sapiens
gagucaaucucuuaauuauaugucagagcggccauaagccauaaaaguuuugagaaauacgaguc

SEQ ID NO: 46778 - RNA, 65 nt, Homo Sapiens
ggcagagaaagugaaggucgacccagggcuguaggaagccauaggagagugaccacgggauuccc

SEQ ID NO: 46779 - RNA, 65 nt, Homo Sapiens
agagugacuaagauuugaguccauugcaaaagguuaagccauaugacaauuucaaaaugcaugug

SEQ ID NO: 46780 - RNA, 65 nt, Homo Sapiens
uuuuagccuaaagugguuuucaaauccaguucuucaagccauaaaugaccaagauccaagcaauc

SEQ ID NO: 46781 - RNA, 65 nt, Homo Sapiens
uuuucaaggggguucuaaagcauucaagugcuuaaaagccauaaaaaaugacuucuuaauuccug

SEQ ID NO: 46782 - RNA, 65 nt, Homo Sapiens
gagcagaacuugccgaggguaacaaacaaacaaaaaagccauagacucuggcuuuaaaauuuuaa

SEQ ID NO: 46783 - RNA, 65 nt, Homo Sapiens
agaaaaagcaauaguugcuuuauacauuucagccaaagccauagauaauaaucaaucaaucagca

SEQ ID NO: 46784 - RNA, 65 nt, Homo Sapiens
cccugaggcccugggcugggugaccacucuucuuuaagccauagaccagugaccuuugaccucgg

SEQ ID NO: 46785 - RNA, 65 nt, Homo Sapiens
ugaccagaagccuuggaacccuuggaaauagaaagaagccauauauccuggacacauuggaaugc

SEQ ID NO: 46786 - RNA, 65 nt, Homo Sapiens
uuuaugucuggauuuaaaaaaggauguuaauaaugaagccauaugaauuuaguaauggacuauac

SEQ ID NO: 46787 - RNA, 65 nt, Homo Sapiens
uuuuuagggaaacuaaggagaagcuacuuuuuauaaagccauauucuucauuuugugaauuauag

SEQ ID NO: 46788 - RNA, 65 nt, Homo Sapiens
aagugguuugaucgauauaugagcaacuauaagcaaagccauaagcaucauuuugaaaggaccau

SEQ ID NO: 46789 - RNA, 65 nt, Homo Sapiens
cacaugccucauuuucucuuaaaggacagacaaaaaagccauauguuuaaguuauuuaggaacac

SEQ ID NO: 46790 - RNA, 65 nt, Homo Sapiens
uacugcaaaguuccuaacugaaaaaagaaaauaaaaagccauauaaaauaaauaggggcuuauac

SEQ ID NO: 46791 - RNA, 65 nt, Homo Sapiens
cugaggcggaagaucgcaaguuacccagguguaggaagccauacauaucaugcuggcaauguuaa

SEQ ID NO: 46792 - RNA, 65 nt, Homo Sapiens
gaacuguaguacauggacaaaaauuccauuuuuguaagccauaaugcuuacccaucuucaaauga

SEQ ID NO: 46793 - RNA, 65 nt, Homo Sapiens
uuuuucuguaaaaguuacuagaggcuuuuauuagaaagccauauuuugagauuucagcuaugcua

SEQ ID NO: 46794 - RNA, 65 nt, Homo Sapiens
ggauugcaguguuuguuucuuaaaugcauccgaauaagccauacuuucuucugguagcuucaugg

SEQ ID NO: 46795 - RNA, 65 nt, Homo Sapiens
gguggaagucaguuggccucucugcuccugcaccaaagccauaugcaauugggagauaccuuugg

SEQ ID NO: 46796 - RNA, 65 nt, Homo Sapiens
caauccucaaggcuggcacauuuauuuuugcacauaagccauaacacccugccagccccacagau

SEQ ID NO: 46797 - RNA, 65 nt, Homo Sapiens
uugccaccucuggccaaauaugcacuuucccuagaaagccauauuccagcagugaaacuugugcu

SEQ ID NO: 46798 - RNA, 65 nt, Homo Sapiens
ucugggauuuaugcucaugaacuaaauuuaagcuuaagccauaaaauagauuagauuguuuuuua

SEQ ID NO: 46799 - RNA, 65 nt, Homo Sapiens
aguuccuuguaagcugaaccaucaauuaucaguugaagccauacuuuuauuuaaauuaauauacg

SEQ ID NO: 46800 - RNA, 65 nt, Homo Sapiens
cugaggccacuuaucagggccuggagcccugauggaagccauaggaacuccagaguugccaagcc

SEQ ID NO: 46801 - RNA, 65 nt, Homo Sapiens
gcccugauggaagccauaggaacuccagaguugccaagccauagcugagaagccuggugguuuuc

SEQ ID NO: 46802 - RNA, 65 nt, Homo Sapiens
uucaacguguaaacuuguuuagauuuauucuaguuaagccauaaguauacaguuuuaacuuacuu

SEQ ID NO: 46803 - RNA, 56 nt, Homo Sapiens
uugcaccagcagcaugaaugcaggaaaagccauauccaugccccgucuccaucuag

SEQ ID NO: 46804 - RNA, 65 nt, Homo Sapiens
guauugacauauuuuuaaggagaaguuauuucauaaagccauacgagaaaaauuauauaaauuuu

SEQ ID NO: 46805 - RNA, 65 nt, Homo Sapiens; identical to SEQ ID NO: 46762

SEQ ID NO: 46806 - RNA, 65 nt, Homo Sapiens
uccuaacaggagcuucaucaguauuucuuuuugugaagccauaugucucucugacuuaucuggaa

SEQ ID NO: 46807 - RNA, 65 nt, Homo Sapiens
cuccccagcuuucuccaggcaaggaggagcagcagaagccauagggccagggguccugaaaacca

SEQ ID NO: 46808 - RNA, 65 nt, Homo Sapiens
auuccaccaaccaaaauuaaacuguuaagacuuaaaagccauauauuguagaaaauguaauaaac

SEQ ID NO: 46809 - RNA, 65 nt, Homo Sapiens
auuuuuaaaucacauuaauuuuaccaagugaaaccaagccauacuguuuuugagccaauuaagaa

SEQ ID NO: 46810 - RNA, 65 nt, Homo Sapiens
uuugaggcuauacagccacugugcccuguggaauaaagccauauauauaaauguuuuauauguau

SEQ ID NO: 46811 - RNA, 65 nt, Homo Sapiens
uggggcaggggacuaucugaagcgcuuccauccuaaagccauaaugaaaauaucuuccucucuuc

SEQ ID NO: 46812 - RNA, 65 nt, Homo Sapiens
ugggcccauuccccuaauaguuuuauuuuuaaagaaagccauacauagaaugcuucaagcuaucu

SEQ ID NO: 46813 - RNA, 65 nt, Homo Sapiens
ggauuagauaggguuccaacugggccuacaagcucaagccauacauaaaaggaccuugggacaua

SEQ ID NO: 46814 - RNA, 65 nt, Homo Sapiens
uuuccuccuauuuuuuuuuaaccuguuaaacucuaaagccauagcuuuuguuuuauauugagaca

SEQ ID NO: 46815 - RNA, 65 nt, Homo Sapiens
uggagcauucgguagcguaugucguucugcauuauaagccauagguccugcagugauagaaacag

SEQ ID NO: 46816 - RNA, 65 nt, Homo Sapiens
acaaugauacaguaauauugcauacaaucaauguaaagccauaucuaauuuuauuuuguucucua

SEQ ID NO: 46817 - RNA, 65 nt, Homo Sapiens
aauauuaguuugguguguaugauuuguaaaacuugaagccauaaauacaucauguuucuucauug

SEQ ID NO: 46818 - RNA, 65 nt, Homo Sapiens
augacacacagugucuuucuucccuucagccacauaagccauaugaggauacccuuuuaacuucu

SEQ ID NO: 46819 - RNA, 65 nt, Homo Sapiens
aaucuguuugaaggaauuuuccugguuuucagaugaagccauaaggcuuuggaguuaaaccacag

SEQ ID NO: 46820 - RNA, 65 nt, Homo Sapiens
guuauggcaacauuauugaauuuuuuauguacauaaagccauauguuuagggugguuucuaucug

SEQ ID NO: 46821 - RNA, 65 nt, Homo Sapiens
gucagcgcucaggaaugugcuccggcagagugcugaagccauaauccccaaccauuucccuuggc

SEQ ID NO: 46822 - RNA, 65 nt, Homo Sapiens
ccaaucuguuuuccauuuccauugcaauacuacuaaagccauacaauaucaagcacccucccucu

SEQ ID NO: 46823 - RNA, 65 nt, Homo Sapiens
uguguccaggcucugggcacagugcugccccuugcaagccauaacgugcccccagaguguagggg

SEQ ID NO: 46824 - RNA, 65 nt, Homo Sapiens
cauaacgugcccccagaguguagggggccuugcggaagccauagggggcugcacgggaugcgugg

SEQ ID NO: 46825 - RNA, 65 nt, Homo Sapiens
ugcuacaucauaguugauaaauugauguuaucguaaagccauauguucuguucaagucuuguuug

SEQ ID NO: 46826 - RNA, 65 nt, Homo Sapiens
accacugcucaggguccauuccucacuauaagaugaagccauaucugccugccuuuuccuaagga

SEQ ID NO: 46827 - RNA, 65 nt, Homo Sapiens
gaaaaccagucuguguuuacagacagaagagaaggaagccauagugucacuuccacacaauuauu

SEQ ID NO: 46828 - RNA, 65 nt, Homo Sapiens
aaagcuguguacuaauaaagaaaauuauuucuaagaagccauaacacaagaaucaugcacuuuuu

SEQ ID NO: 46829 - RNA, 65 nt, Homo Sapiens
gcucucuugccccuuggcauggaggaacagaaggaaagccauagcuaagugguggggcugggaga

SEQ ID NO: 46830 - RNA, 65 nt, Homo Sapiens
uaaggagcagcauuugaguacuuuggguagcucuuaagccauaaccucagccuacccacugaagu

SEQ ID NO: 46831 - RNA, 65 nt, Homo Sapiens
uuaacuccaguagcugaugugguuugaguccuauaaagccauaaucagaguugggaaaaacaaca

SEQ ID NO: 46832 - RNA, 65 nt, Homo Sapiens
auuuucugauuuauuuucuuuuauuuguccacuugaagccauauuacuuccuuagaaauucauau

SEQ ID NO: 46833 - RNA, 65 nt, Homo Sapiens
ccaauaaaacaagaauacugcagccagcugcccacaagccauaaagccucugguguuccuggccu

SEQ ID NO: 46834 - RNA, 65 nt, Homo Sapiens
cacuggggacugccagguugcuggggauauacacaaagccauaaggccaggcacugugccgggca

SEQ ID NO: 46835 - RNA, 65 nt, Homo Sapiens
cgacuggguguuuguccccccuuuggucagagcugaagccauauacaggagagcucccuauccgc

SEQ ID NO: 46836 - RNA, 65 nt, Homo Sapiens
ggaaaauaaaaucacuuucuugcuugguaagcaagaagccauaucgauuuuuuuuaacuuacaga

SEQ ID NO: 46837 - RNA, 65 nt, Homo Sapiens
uuuggucagcauaucuuagguauauaauaacuuugaagccauaacuuuuaacuggagugguuuga

SEQ ID NO: 46838 - RNA, 62 nt, Homo Sapiens
acuguaugcacacuaacuaaugaaaguccuagaagccauaaaagagacacuuuccugcuggu

SEQ ID NO: 46839 - RNA, 65 nt, Homo Sapiens
cuugcuguuuuuauugaucuuaugguuuauuucuuaagccauagucaguguaaauacagcccugc

SEQ ID NO: 46840 - RNA, 65 nt, Homo Sapiens
ugcggucuccaauuuaggacuuuuccauagugccaaagccauacauauucaguagaacaucaaua

SEQ ID NO: 46841 - RNA, 65 nt, Homo Sapiens
caguaaauguccaaguaauguuuuuauaauaaacuaagccauauuuagacaauaaacauugauaa

SEQ ID NO: 46842 - RNA, 65 nt, Homo Sapiens
gccuuuuaggaacguaaaguccuuuaagcacucagaagccauaccucaucucucuggcugaucug

SEQ ID NO: 46843 - RNA, 65 nt, Homo Sapiens
uuuaagauuuacuuaauacucagaaaauucagauaaagccauagaguccuguuugaagcuucacu

SEQ ID NO: 46844 - RNA, 65 nt, Homo Sapiens
ccaaaccugcaccauccaucauuauguagaugaaaaagccauaggucauagccucuuugcuauuc

SEQ ID NO: 46845 - RNA, 65 nt, Homo Sapiens
ggaacacuugccccucaguauaguacugucaagggaagccauacacuuuuuguagacauggguac

SEQ ID NO: 46846 - RNA, 65 nt, Homo Sapiens
cgaaucuuaauuucuggcucgcauuuaccuuggguaagccauaaguucauucugccauugacuug

SEQ ID NO: 46847 - RNA, 65 nt, Homo Sapiens
acaugggauuuuccucaauggaaaaacauuaauguaagccauauaaacuuaccuuaccuuaccua

SEQ ID NO: 46848 - RNA, 65 nt, Homo Sapiens
auaaauuuuauuccaaaauaggggucauagauccuaagccauaaaccauucucccucucaaggca

SEQ ID NO: 46849 - RNA, 65 nt, Homo Sapiens
ugaaugagguugguuuuugguauugguuaaaaaaaaagccauaugauagaaguacaccuaauugu

SEQ ID NO: 46850 - RNA, 65 nt, Homo Sapiens
ugagacugcagauuauauuggauggcauuauugauaagccauacaguuguuugacauacagugau

SEQ ID NO: 46851 - RNA, 65 nt, Homo Sapiens
cuuauaaugcuuuuuauagcccagcacagaauuuaaagccauaccaccaaaaguaccugugugug

SEQ ID NO: 46852 - RNA, 65 nt, Homo Sapiens
ugccgucucugggcaaccaggccccaacugugcuuaagccauaaugccugcugcucucuagacaa

SEQ ID NO: 46853 - RNA, 65 nt, Homo Sapiens
uucuaaguaguugccaucuugaauccuuuguaauaaagccauacuuuugugugugugugugaugc

SEQ ID NO: 46854 - RNA, 65 nt, Homo Sapiens
agagaucaaugacuuuuuaggcagcuguguuuuuuaagccauauacaagaguaaguuaaaagggg

SEQ ID NO: 46855 - RNA, 65 nt, Homo Sapiens
uguacauaaauuauguuuaaugcuauaauuguauaaagccauaaaacagacacaagaacaaucuu

SEQ ID NO: 46856 - RNA, 65 nt, Homo Sapiens
aguacaaagugucaaggggauaaguaaguugccagaagccauacaggugugagaaacagaguuau

SEQ ID NO: 46857 - RNA, 65 nt, Homo Sapiens
aaauuugcuuuaaacuguuucagagcuucuucccuaagccauaaacugucucaccuaaacaagau

SEQ ID NO: 46858 - RNA, 65 nt, Homo Sapiens
uuugauuuuguuuacugaaauuuguuauacuucaaaagccauaacuugaaaaauacugguggcgu

SEQ ID NO: 46859 - RNA, 65 nt, Homo Sapiens
augaacaccgugucuccuucucuuguguguaccuaaagccauauuuccaagucugugguacucca

SEQ ID NO: 46860 - RNA, 65 nt, Homo Sapiens
aaaguuacccgagggaaaaugaagagaaaauggugaagccauagaggauauuuuucuucaauuuu

SEQ ID NO: 46861 - RNA, 65 nt, Homo Sapiens
gugaguaaauguaaauaugauguuuaugauuuuugaagccauaugucuguaauuuuaguugagua

SEQ ID NO: 46862 - RNA, 65 nt, Homo Sapiens
ggcugguuuuccguacuccaugggagaugacucuuaagccauaggaaggccagcauugucuucca

SEQ ID NO: 46863 - RNA, 65 nt, Homo Sapiens
uggcaugggugaagugaaaggauucuggcuugaagaagccauauuaguuugguuuauggggccug

SEQ ID NO: 46864 - RNA, 65 nt, Homo Sapiens
ccugaagauuggcccugugcaagaaaauguuccaaaagccauaagauucuguucucuauuaaauu

SEQ ID NO: 46865 - RNA, 65 nt, Homo Sapiens
acucauauugacacucagcuuuuuaaaggagauugaagccauagauggacccuuaagaauuuuau

SEQ ID NO: 46866 - RNA, 65 nt, Homo Sapiens
cauauauuaugauguggaaauaauugauaacuuuuaagccauacuauguuuuuaaagauaauuug

SEQ ID NO: 46867 - RNA, 65 nt, Homo Sapiens
uuaugaauuuuacacuuggcaaauguuaaugacggaagccauagucugcuccuaauacaugucca

SEQ ID NO: 46868 - RNA, 65 nt, Homo Sapiens
gcugcugcgacacaggcagcgcuuuguaaacugugaagccauauacgugaaacugaagagugcau

SEQ ID NO: 46869 - RNA, 65 nt, Homo Sapiens
cggcuaggaauuuggaauucgggggcuuaccagcaaagccauauucccucccaaccucccuucca

SEQ ID NO: 46870 - RNA, 65 nt, Homo Sapiens
guaaggacagaauaauacaacacauucuguuuaucaagccauaauuuuggaaucagaauuggaau

SEQ ID NO: 46871 - RNA, 65 nt, Homo Sapiens
ccgcgccccgcuccccuucucucucuuacucgguuaagccauagcgaggccuccgcucguuucag

SEQ ID NO: 46872 - RNA, 65 nt, Homo Sapiens
uauucucuugcgugugaaucucuuacccugaaaaaaagccauaaugaauuaagccagacugacca

SEQ ID NO: 46873 - RNA, 65 nt, Homo Sapiens
gcugcugaacuugaacccagagccuucaggugccaaagccauacucaggcccccaccgacauugu

SEQ ID NO: 46874 - RNA, 65 nt, Homo Sapiens
uguauugccuuaaguuuucacucauugucuuuugaaagccauaugauaaaaugauuuuauuuaau

SEQ ID NO: 46875 - RNA, 65 nt, Homo Sapiens
aaaucgagcuguucgcauuuguuugccuugauuauaagccauaguauacaaccucuuauuguaua

SEQ ID NO: 46876 - RNA, 65 nt, Homo Sapiens
cuaauauuagaauauauuaaccgcuuaaggcauugaagccauaugggauggggaaugcauuucuu

SEQ ID NO: 46877 - RNA, 65 nt, Homo Sapiens
ccuuaguaccuccgcugcuucacuugcuuuagccaaagccauaaaaaaccugcaacguagagaaa

SEQ ID NO: 46878 - RNA, 65 nt, Homo Sapiens
ugcccccucaccuuuuuggguagguaaaagacuaaaagccauauggauuuuaacugauaacaaug

SEQ ID NO: 46879 - RNA, 65 nt, Homo Sapiens
gcuauguuuucaaaccuuuuugagccauaggauccaagccauaaaauucuuuaugcauguugaau

SEQ ID NO: 46880 - RNA, 65 nt, Homo Sapiens
uucauggcaggcuuuggccagcagacagaugcugaaagccauaguuuuugucaagagccaguaga

SEQ ID NO: 46881 - RNA, 65 nt, Homo Sapiens
cuuuugcaguggggucgagaugauacgcaugaacaaagccauauccgagucccggcuucgaguag

SEQ ID NO: 46882 - RNA, 65 nt, Homo Sapiens
auucgaaggacaucagcgaccccuuuuggaaauacaagccauaacaaucugggcugagccaaagu

SEQ ID NO: 46883 - RNA, 65 nt, Homo Sapiens
auggacaccccauggggagcucgucuggucggugaaagccauagccucccagcuuccuggcagca

SEQ ID NO: 46884 - RNA, 65 nt, Homo Sapiens
uuuaaaccuucccagucccccuggggugcuuaccaaagccauagccaaugccuuccuacagcuca

SEQ ID NO: 46885 - RNA, 65 nt, Homo Sapiens
augcagccuuugugccagcaauagggcauaagccuaagccauacccgaugucagugagggcgauc

SEQ ID NO: 46886 - RNA, 65 nt, Homo Sapiens
uuuuccuucaucacucuuggggaggugguagaauuaagccauacccuagaaugacaguuaucuau

SEQ ID NO: 46887 - RNA, 65 nt, Homo Sapiens
ugguugucugcuuuccuaaggggaccuuggucucgaagccauacgcgggcuggaggggcugccca

SEQ ID NO: 46888 - RNA, 65 nt, Homo Sapiens
uaaagcacuagguuuuaaaucaguggguaucauaaaagccauauauaaaagauccuuucuuauag

SEQ ID NO: 46889 - RNA, 65 nt, Homo Sapiens
cuugggcuagaauguacacgucuccuugccugaauaagccauauauaugcucuuaaacaaaaguu

SEQ ID NO: 46890 - RNA, 65 nt, Homo Sapiens
acuuuauuuauggauuguaauaacaaccacaagaaaagccauacaucuuaaugaacauacgccuu

SEQ ID NO: 46891 - RNA, 65 nt, Homo Sapiens
uaauuggaacaaagggaaacagauacuugauaugaaagccauaaugacggugacuugugucgugg

SEQ ID NO: 46892 - RNA, 65 nt, Homo Sapiens
uguucagguccaggguuacauaauugcagaagcacaagccauacaucgcagguaggaaaccacag

SEQ ID NO: 46893 - RNA, 65 nt, Homo Sapiens
acaugucuguagucagcaccacaauaauuuccugaaagccauaggaaaucuguuaaugcacaugc

SEQ ID NO: 46894 - RNA, 65 nt, Homo Sapiens
ugccauugcgcugccccggccgccaguccgcccagaagccauagacgagacguagguagccguag

SEQ ID NO: 46895 - RNA, 65 nt, Homo Sapiens
agaaauggcauuuacguuucucugaugcucccuugaagccauagaauuuaggggcuuuuuuaaaa

SEQ ID NO: 46896 - RNA, 65 nt, Homo Sapiens
gcuggugugggaugcagccggccgaugagaaaauaaagccauauugaaugaucgccaccaguguu

SEQ ID NO: 46897 - RNA, 65 nt, Homo Sapiens
aggguguaauauaccauagugauaaauaugaccaaaagccauaaaugacugugagauguaugaga

SEQ ID NO: 46898 - RNA, 65 nt, Homo Sapiens
aguguguaauauaccauagugauaaauaugaccaaaagccauaaaugacugugagauguaugaga

SEQ ID NO: 46899 - RNA, 65 nt, Homo Sapiens
gugccuuuuuuaauacaugaaagaauucuagagagaagccauauacauguaaguaacaugggaaa

SEQ ID NO: 46900 - RNA, 65 nt, Homo Sapiens
ggcugcgcggccccagccugggcacccugauuuuuaagccauagaccuggggucagggcaggaag

SEQ ID NO: 46901 - RNA, 65 nt, Homo Sapiens
accuuacuguacaucagagaauucauacuggagaaaagccauauaaauguagugagugugggaaa

SEQ ID NO: 46902 - RNA, 65 nt, Homo Sapiens
guccuggcuccgccucuuccaucaggaccacuauuaagccauaggaguccugggggugcaaaggg

SEQ ID NO: 46903 - RNA, 65 nt, Homo Sapiens
uccgccccccucagccccuuccuccccagggagcaaagccauaaggggcaggggccaccccacgg

SEQ ID NO: 46904 - RNA, 65 nt, Homo Sapiens
ccacuccacaugugcuggggacauaggaagaccuuaagccauagcucaucccuuucuagauuuga

SEQ ID NO: 46905 - RNA, 65 nt, Homo Sapiens
ccggccagccgcgccuccucaggcccucugcacagaagccauaugaaaguccacggccugaggcc

SEQ ID NO: 46906 - RNA, 65 nt, Homo Sapiens
aauguaagaaaugugggaaacaggaauauggagagaagccauauagacacaaacuguauaagugu

SEQ ID NO: 46907 - RNA, 65 nt, Homo Sapiens
aauguaaauaaugugggaaaacucauaugggagagaagccauaugcccuucaaaaucaugagaca

SEQ ID NO: 46908 - RNA, 65 nt, Homo Sapiens
uauuccugcuaaaguuagcucagaugcuccauaguaagccauaagugacaguucuugcuguguaa

SEQ ID NO: 46909 - RNA, 65 nt, Homo Sapiens
ccgccucugggcgggcaugggggcuucuccccucaaagccauaccccuuggcaaauggacaccag

SEQ ID NO: 46910 - RNA, 65 nt, Homo Sapiens
cucccccaucugggggcccucuggggccccuccugaagccauacccucgugacccugcccccucc

SEQ ID NO: 46911 - RNA, 65 nt, Homo Sapiens
guccgagcugcuggugcggggaauucaucuccuugaagccauaacuccuuuccugcccggaccgu

SEQ ID NO: 46912 - RNA, 65 nt, Homo Sapiens
cuugauuggagagaacaugggugaggaauuguccaaagccauaacucagaaaucaagauacacaa

SEQ ID NO: 46913 - RNA, 65 nt, Homo Sapiens
aauguaagguuugugacaagauucacacuggagaaaagccauagaagcuucaaauacauaggaga

SEQ ID NO: 46914 - RNA, 65 nt, Homo Sapiens
cccccugggaccuccggacuggggaagucucagagaagccauagcacacgagugacagggcuccg

SEQ ID NO: 46915 - RNA, 65 nt, Homo Sapiens
acacaucuuaccuuuccaagugucugcaugugggaaagccauagccuuuccccuucagaugucag

SEQ ID NO: 46916 - RNA, 65 nt, Homo Sapiens
cacuuuccaucuugccuggaugcagcauaaggcagaagccauaguuugcagggccaucucaccca

SEQ ID NO: 46917 - RNA, 65 nt, Homo Sapiens
caguggacgaaaauggggcuguuaauauacucuaaaagccauacuaaaaaugcucugagggaacu

SEQ ID NO: 46918 - RNA, 65 nt, Homo Sapiens
acuuguacgguacuggcagaaaagucauuuuucaaaagccauaggcuuuuccuugcccuuagcug

SEQ ID NO: 46919 - RNA, 65 nt, Homo Sapiens
gucuugcuguaacucagacauuccaaggguaugggaagccauauucacaccucacgcucuggaca

SEQ ID NO: 46920 - RNA, 65 nt, Homo Sapiens
agauuugaggcgcuguugagugcugcugcgcugcaaagccauagcuauuauauauuaaacauucu

SEQ ID NO: 46921 - RNA, 65 nt, Homo Sapiens
ccagagggcggggggaugucggcaauagggcaacaaagccauaggcacauugcuucugcgcuggu

SEQ ID NO: 46922 - RNA, 65 nt, Homo Sapiens
gacauuugcugucauauugcgacauuuucaucccgaagccauagacucgggucuuaaagugugug

SEQ ID NO: 46923 - RNA, 65 nt, Homo Sapiens
cccaggauauuucugagagugcuccacgaagccuuaagccauaggaaccacaagguccacucccu

SEQ ID NO: 46924 - RNA, 65 nt, Homo Sapiens
gcacagcaccuccuuguaacagcaugaaguuggccaagccauaggagagccaugacagguccauc

SEQ ID NO: 46925 - RNA, 65 nt, Homo Sapiens
uaaagacugauggaaucguugccuuccugccaaacaagccauauauaacucaucuugauugagug

SEQ ID NO: 46926 - RNA, 65 nt, Homo Sapiens
uauucuuugaaacuuguuggguagaaugaaaauuaaagccauaaugguagaagauggcauacuga

SEQ ID NO: 46927 - RNA, 65 nt, Homo Sapiens
aggggagugggguccaagugacagcuggaugggagaagccauaguuucucccagucagcuaggau

SEQ ID NO: 46928 - RNA, 65 nt, Homo Sapiens
uaaauauggaagucacgucauaaucuaccuuugcaaagccauacaugaacuuuuauuuacuuugu

SEQ ID NO: 46929 - RNA, 65 nt, Homo Sapiens
uuuauuuauuuuccaggauucagggaauauuccagaagccauagcuucuuaccgcacggcucuga

SEQ ID NO: 46930 - RNA, 65 nt, Homo Sapiens
gguaggcuccaugccaaguaacagcagagggaguuaagccauaggaauuuggcuguggaguaaga

SEQ ID NO: 46931 - RNA, 65 nt, Homo Sapiens
caugaacaacaccucacuacacauucaucaaaaauaagccauagaguccauaggauaucugagga

SEQ ID NO: 46932 - RNA, 65 nt, Homo Sapiens
uuuacauaggagucagauacgaagcagaauaugagaagccauauuauaccaaacacuaacaagag

SEQ ID NO: 46933 - RNA, 65 nt, Homo Sapiens
uuuagaaaguagucuacugaaggagucacucagacaagccauauuaacaggcuggggccucgaga

SEQ ID NO: 46934 - RNA, 65 nt, Homo Sapiens
uuugggaggcagagaggggcgggaacuccuuuccaaagccauauuagaggguccucuucauuuuu

SEQ ID NO: 46935 - RNA, 65 nt, Homo Sapiens
cagaaucaccuuaauuccaacuauguggacagcccaagccauaccgcuugcucauggcaugaaug

SEQ ID NO: 46936 - RNA, 65 nt, Homo Sapiens
uacaguguuuaauucucuuuucuguguaauuguguaagccauaaucaaaaguuugcacauauugu

SEQ ID NO: 46937 - RNA, 65 nt, Homo Sapiens
auuaaauuuuggcuuuagaaugaucaguuggcaugaagccauagaaggaacaacuguacuuuuuu

SEQ ID NO: 46938 - RNA, 65 nt, Homo Sapiens
uuucacaauuaaaaaaaaaaaguucagcuaggcaaaagccauacuuuacuuuuuggauuguagcc

SEQ ID NO: 46939 - RNA, 65 nt, Homo Sapiens
cacacaucaguacuguggagaguuucuguuaggaaaagccauacauuuuuaaaaauguagcaaaa

SEQ ID NO: 46940 - RNA, 64 nt, Homo Sapiens
aggguggagaaguucccugaaccuuccugucucccagggacauguaugcuuccagggacaagcu

SEQ ID NO: 46941 - RNA, 64 nt, Homo Sapiens
gaaccuuccugucucccagggacauguaugcuuccagggacaagcuuaggucaugaacaugguc

SEQ ID NO: 46942 - RNA, 64 nt, Homo Sapiens
cuccuaacuccuuucccauuagauuucuugaagccagggacaugcaguagaguuggagauucag

SEQ ID NO: 46943 - RNA, 64 nt, Homo Sapiens
ggacacuaggugcugcccucccccucugccugcacagggacauuccucacagacaggcugacag

SEQ ID NO: 46944 - RNA, 64 nt, Homo Sapiens
ccaggucacacguggggucaggacagggcagggacagggacagcacucucccgggccacaauag

SEQ ID NO: 46945 - RNA, 64 nt, Homo Sapiens
gacagcccaggucacacgugcaauagggacagggcagggacaggugcuggacucucccgggcca

SEQ ID NO: 46946 - RNA, 64 nt, Homo Sapiens
aguggugguagauggaaggaagcucacucuuuuccagggacagacugcugaggacauaggcaga

SEQ ID NO: 46947 - RNA, 64 nt, Homo Sapiens
cagccuucugcugaggacauuuagggggggcgaucagggacaggcuucuuuccuguaggugggg

SEQ ID NO: 46948 - RNA, 64 nt, Homo Sapiens
uccuuccccuguggucuuggaaguguguggaaggcagggacagagauggaggccgagccaauag

SEQ ID NO: 46949 - RNA, 64 nt, Homo Sapiens
caaaacagaacaauuaaacagccaaauaaaaccucagggacaacauuuuugguguauuugagcc

SEQ ID NO: 46950 - RNA, 64 nt, Homo Sapiens
ugggccaaugggccaucuggcgguguucuggcagcagggacaccaacuccuguaccccagucca

SEQ ID NO: 46951 - RNA, 64 nt, Homo Sapiens
augcaggcgaagcuugggauacccguugcagagccagggacaugucguccccggaguugggggu

SEQ ID NO: 46952 - RNA, 64 nt, Homo Sapiens
aauucacagccugccucuggccaggcugaauacucagggacagcauauauauauauauuaagcc

SEQ ID NO: 46953 - RNA, 64 nt, Homo Sapiens
agggagccuggggauugugggggccugagagaagcagggacaggcuagaugacagauugcggga

SEQ ID NO: 46954 - RNA, 64 nt, Homo Sapiens
uucugucgggggugacaccagugacaagaggagacagggacaggagggacagguucuguugggg

SEQ ID NO: 46955 - RNA, 64 nt, Homo Sapiens
uucuaucaugggugacaccagugacacgaggacacagggacaggagggacagguucugucaugg

SEQ ID NO: 46956 - RNA, 64 nt, Homo Sapiens
uucugucaugggugacacgagugacaccaggacacagggacaggagggacagguucugucgggg

SEQ ID NO: 46957 - RNA, 64 nt, Homo Sapiens
uucugucgggggugacaccagugacaccaggacacagggacaggagggacagguucugucaggg

SEQ ID NO: 46958 - RNA, 64 nt, Homo Sapiens
gaaugguaguguugccaccccugaagaaauggcacagggacaguuggugguggcggcccagagu

SEQ ID NO: 46959 - RNA, 60 nt, Homo Sapiens
ucuauugcugucccuacaauacccuucaggcagggacaguaggccaacaugggcuucuga

SEQ ID NO: 46960 - RNA, 64 nt, Homo Sapiens
agagcaggaagcauucagagagcagcuuuaaacucagggacagagccaugcugggaagacgccu

SEQ ID NO: 46961 - RNA, 64 nt, Homo Sapiens
uuggaggcgauuuaccuguuuucgcaccuaccaucagggacaggaugaccuggauaacuuaggu

SEQ ID NO: 46962 - RNA, 64 nt, Homo Sapiens
cccagaaagaacacagucugggcuaagucucaggcagggacagacccaacugucgcccccuuca

SEQ ID NO: 46963 - RNA, 64 nt, Homo Sapiens
caugggaaugugggggaugaccccaguguggaggcagggacaguuccauguggaugucaccaaa

SEQ ID NO: 46964 - RNA, 64 nt, Homo Sapiens
gcgggccguggccuccuccauggccgggacccggcagggacaagagcuggggcacacacacacc

SEQ ID NO: 46965 - RNA, 64 nt, Homo Sapiens
agccaggguggggguaguuuaaggcauugacagccagggacaggucuaaugacuuccuauugga

SEQ ID NO: 46966 - RNA, 64 nt, Homo Sapiens
cuugccaagacuucuccacccucuugcauaccuccagggacagagagcuuacuaccucccaagg

SEQ ID NO: 46967 - RNA, 64 nt, Homo Sapiens
cagcuuccagccuccccucaggcuuuccagucaccagggacacucggagccacagccuagagcc

SEQ ID NO: 46968 - RNA, 64 nt, Homo Sapiens
aggggagcaugauggggccuuugaggcagggucgcagggacaagcucagcuuuaggcaccaucu

SEQ ID NO: 46969 - RNA, 64 nt, Homo Sapiens
augugggcaugucguccaccccaggacgagccaucagggacagaccccccacccccaaggcugc

SEQ ID NO: 46970 - RNA, 64 nt, Homo Sapiens
gugugucucucugauugggcuuaaggugccucuucagggacacaaccugccagguucaguucuu

SEQ ID NO: 46971 - RNA, 64 nt, Homo Sapiens
acccacucaggacucuucccaauugcuuuaggugcagggacaccgguaucacaaagcauuugug

SEQ ID NO: 46972 - RNA, 64 nt, Homo Sapiens
uggccacuuauuauuaccuagcagugaaguuggucagggacauguaacuucaaaacuuuuaaga

SEQ ID NO: 46973 - RNA, 64 nt, Homo Sapiens
agcauucccuauagauuagggaccuguccuccuucagggacaugagagaauuugggcccuuacu

SEQ ID NO: 46974 - RNA, 64 nt, Homo Sapiens
cugguccaguggcuuuggugucugugucucuucucagggacaggcuucucauugcugaagcccc

SEQ ID NO: 46975 - RNA, 64 nt, Homo Sapiens
aggcuuggcugugagucuggucuguggagguagucagggacacaugaggagaauucuggugauc

SEQ ID NO: 46976 - RNA, 64 nt, Homo Sapiens
ccucuaguuuccuggagccccaacacauuccuggcagggacagcaggguggcaaggacucaggu

SEQ ID NO: 46977 - RNA, 64 nt, Homo Sapiens
uugcugcugccuccugagcacugccuuccaugaacagggacagaccagaggcccugcaaggacu

SEQ ID NO: 46978 - RNA, 64 nt, Homo Sapiens
ucccccuacuucuccccaagggccaagaacugcucagggacauuaaaggucaaaaguccagcca

SEQ ID NO: 46979 - RNA, 64 nt, Homo Sapiens
caagcugagaagcugagagcuggaggacaauauccagggacauggcucuggaaaauaacuuuuu

SEQ ID NO: 46980 - RNA, 64 nt, Homo Sapiens
acauucccccaguccugccucucccccauccuaucagggacauuuggcuccucuuagcuggcuc

SEQ ID NO: 46981 - RNA, 64 nt, Homo Sapiens
gauuaacugccucccuuccaauagacacuaucagcagggacagaugugugggagugcagggcug

SEQ ID NO: 46982 - RNA, 64 nt, Homo Sapiens
uaucugugugucauuauacacagacuuccuacaucagggacaggaaaauaccuugcaucugaga

SEQ ID NO: 46983 - RNA, 64 nt, Homo Sapiens
uguguuaguugcucacuagauguugauauuacaacagggacagaucucucucccaaucagagcc

SEQ ID NO: 46984 - RNA, 64 nt, Homo Sapiens
cuuggacacaaaaccgauccuugauggcuuuuggcagggacagacccaggggugauggagacuu

SEQ ID NO: 46985 - RNA, 64 nt, Homo Sapiens
agagccagcaggguggaugcgacaugguggagaccagggacagguguuucuucuaagggaggag

SEQ ID NO: 46986 - RNA, 64 nt, Homo Sapiens
ggggaaaaguuaaggagcaaugugggcugggagacagggacaaugagcaauuaggcugccugcc

SEQ ID NO: 46987 - RNA, 64 nt, Homo Sapiens
guugaugaggcaguuuagcuuacagaaacuuuugcagggacaguuuaauugaugaaucaacuuc

SEQ ID NO: 46988 - RNA, 64 nt, Homo Sapiens
gcugcuggaaaggcuagugacugcuucuggucuccagggacaguccacagggaaggggcuccca

SEQ ID NO: 46989 - RNA, 64 nt, Homo Sapiens
uccacagcagagaaaaagucccgugcuugcuagucagggacaagggaggcccuuuggcugugau

SEQ ID NO: 46990 - RNA, 64 nt, Homo Sapiens
gaccuccccaccccaguguaauggcccuucauggcagggacagaaagguggacugggggccauu

SEQ ID NO: 46991 - RNA, 64 nt, Homo Sapiens
ccucgucaggguuuggcaagucccugugcauauucagggacaugggguccccucuguccucauu

SEQ ID NO: 46992 - RNA, 64 nt, Homo Sapiens
cagcagggggaggcagcccacccaaggagguugucagggacacacugcagaggguagccugagg

SEQ ID NO: 46993 - RNA, 64 nt, Homo Sapiens
acuggagccauggcucagaggugauucgggcagccagggacaggagccacccuccccaggccca

SEQ ID NO: 46994 - RNA, 64 nt, Homo Sapiens
gacugaaucugggaccuguguuccccccggcaggcagggacaagauggcauggcaagcaugggg

SEQ ID NO: 46995 - RNA, 64 nt, Homo Sapiens
gcauuuugguuuccuuaaggcccagcaagacuuccagggacaucucuggugaagccagaaugga

SEQ ID NO: 46996 - RNA, 64 nt, Homo Sapiens
gaaacagccuuccuggagcguugucuggagguuccagggacagggcagccucccagagccgagc

SEQ ID NO: 46997 - RNA, 64 nt, Homo Sapiens
ucuggaggcccaggacauggggcaagacuaggaucagggacagaaggaugauggaccccucaga

SEQ ID NO: 46998 - RNA, 64 nt, Homo Sapiens
ccaucauuucacccucacaugggaguaaggcccccagggacacccaaaggacuugaucugaguu

SEQ ID NO: 46999 - RNA, 64 nt, Homo Sapiens
gugcaaugaagcccugcucccagccuuucagagacagggacacagccccuauuuggaacccuga

SEQ ID NO: 47000 - RNA, 64 nt, Homo Sapiens
uugcccccuaucuccuggggagggugaggcagggcagggacagucuccagggucagucccugga

SEQ ID NO: 47001 - RNA, 64 nt, Homo Sapiens
agcaaaagccuagaaauaacccagaugcccaugagcaagagaguggacaaguaaacuggaauau

SEQ ID NO: 47002 - RNA, 64 nt, Homo Sapiens
gcacaggaguuugaggcugcagugagcagccugggcaagagagugagacuccguuuugugccac

SEQ ID NO: 47003 - RNA, 64 nt, Homo Sapiens
aagauagcgccauugcacuccagcgugggcgacagcaagagacuucauuucgauaaauaaguaa

SEQ ID NO: 47004 - RNA, 64 nt, Homo Sapiens
gugggaggcaaaaagcacuucuuacauggcggcagcaagagaaaaugagaaagaagcaaaagug

SEQ ID NO: 47005 - RNA, 64 nt, Homo Sapiens
gcgggaggugaaaagcacuucguacauggugguggcaagagaaaaugaagaagaagcaaaagug

SEQ ID NO: 47006 - RNA, 64 nt, Homo Sapiens
aaaaucugacaggagaugggauuuuaaaugagcugcaagagagaucaaauaacuuucaggaugu

SEQ ID NO: 47007 - RNA, 58 nt, Homo Sapiens
uggaucugugagggaaaagaacagaagggcaagagaggcaggaagauucucaugcuga

SEQ ID NO: 47008 - RNA, 64 nt, Homo Sapiens
ggaaugaauguucauggaagaggcuccucugagggcaagagaccuguuuuagugcugcauucga

SEQ ID NO: 47009 - RNA, 64 nt, Homo Sapiens
uaagaugagagaguuuagggacuacucuguuuuagcaagagauauuuugggggucuuuuuguuu

SEQ ID NO: 47010 - RNA, 64 nt, Homo Sapiens
uguggcugcuguguugggcauggauggagaaucagcaagagaaaugcuguauuaggacuaauaa

SEQ ID NO: 47011 - RNA, 64 nt, Homo Sapiens
aggcacagcaaauggcacauacaagggccagggagcaagagagaggacagguccucaacaaaug

SEQ ID NO: 47012 - RNA, 64 nt, Homo Sapiens
uaaaacaauaauaaacauaaacagauuagacacagcaagagauuccuaugauaaaauuuaguuu

SEQ ID NO: 47013 - RNA, 64 nt, Homo Sapiens
gacucuaagacccccaguggguccccuauuuucugcaagagauguuccacucuugaguauggua

SEQ ID NO: 47014 - RNA, 64 nt, Homo Sapiens
cccugaggggccagucuccucacugguggggaacgcaagagaaucugcguagaugggugacuca

SEQ ID NO: 47015 - RNA, 64 nt, Homo Sapiens
gggccccucucuuuaccuuuguugggggaaggaggcaagagagaaauuccuucuucccagccag

SEQ ID NO: 47016 - RNA, 64 nt, Homo Sapiens
aaaauugacgcauguuaaucuaugcaaagagaaaggaaaggaugaggugauguauugacucaag

SEQ ID NO: 47017 - RNA, 64 nt, Homo Sapiens
aagauauuaaaguaauucaaaucuuccccaaaggggaaaggaagagagugauacugaccuuuuu

SEQ ID NO: 47018 - RNA, 64 nt, Homo Sapiens
ucacucaagcucccguaaggauauuaccgucucaggaaaggaucaggacuccaugucacagucc

SEQ ID NO: 47019 - RNA, 64 nt, Homo Sapiens
gauugggagucgucgaaauguuuagauucuuuuaggaaaggaauuauuuuccccccuuuuacag

SEQ ID NO: 47020 - RNA, 64 nt, Homo Sapiens
aaagguaucagggauuuuuaacagacuauaacuaggaaaggagguacccuuaacuuagggauga

SEQ ID NO: 47021 - RNA, 64 nt, Homo Sapiens
gaaaaugagcccuaaagguucuaagggaacaucuggaaaggaagggaaagaggccucugaaugg

SEQ ID NO: 47022 - RNA, 64 nt, Homo Sapiens
gggaagacacccuaguucucuggccuuuuuggaaggaaaggaaguuuggcuugcuugaggcugc

SEQ ID NO: 47023 - RNA, 64 nt, Homo Sapiens
uuggcuugcuugaggcugcucuacgcauucaagaggaaaggacuagacaguggaguucacaaga

SEQ ID NO: 47024 - RNA, 64 nt, Homo Sapiens
agaaaaagcaguaacugacauagccacaaaauugggaaaggaguuagggugguauuuagucuau

SEQ ID NO: 47025 - RNA, 64 nt, Homo Sapiens
aguuaagcaacaucuagcaaaugaggguccuuugggaaaggagacccaaaguaucaggacgaga

SEQ ID NO: 47026 - RNA, 64 nt, Homo Sapiens
cucacagagccacaggaagaucauucagaaacuaggaaaggaggcccccacagcugauccugcc

SEQ ID NO: 47027 - RNA, 64 nt, Homo Sapiens
uuuauaauuaggcuuuauuaucuuccuaaaucaaggaaaggaaaucauccccagaccauuuaug

SEQ ID NO: 47028 - RNA, 64 nt, Homo Sapiens
acagaccuggccaucccuggcucugggacagacuggaaaggaccuagagcuguucccaccaggg

SEQ ID NO: 47029 - RNA, 64 nt, Homo Sapiens
cuuuuccucuccuuugccuguaaagaagaucccuggaaaggaugacaugagcuguuucucuccu

SEQ ID NO: 47030 - RNA, 64 nt, Homo Sapiens
cuaaacagaugucccugaaguucuuugcugcuguggaaaggauucuuaauaaauauaguugucu

SEQ ID NO: 47031 - RNA, 64 nt, Homo Sapiens
aaugcagaggaggagaaaaggauuugguuaugauggaaaggaagaccucaugucauuucucaug

SEQ ID NO: 47032 - RNA, 64 nt, Homo Sapiens
uuguccacuuagucacacaucuuuugugggaaugggaaaggaaggagacagccaaacucugaca

SEQ ID NO: 47033 - RNA, 64 nt, Homo Sapiens
auaaugucccaugauuuaauauaugugguuugggggaaaggacaagaaaaaacuauaauuccac

SEQ ID NO: 47034 - RNA, 64 nt, Homo Sapiens
uaaugcugguggaauggaggaguuguuuggggagggaaaggagagagaaggaaaggagugaggu

SEQ ID NO: 47035 - RNA, 64 nt, Homo Sapiens
ggaggaguuguuuggggagggaaaggagagagaaggaaaggagugagguauuucccgucuaaca

SEQ ID NO: 47036 - RNA, 64 nt, Homo Sapiens
gccucugucuugugaaguagcaaauggaagguuuggaaaggaaugcucauguuagagcgacauu

SEQ ID NO: 47037 - RNA, 64 nt, Homo Sapiens
cguucaccgccacaaaucauuaaaaaaauaaaaaggaaaggaaguuuggcaguaauugucuguu

SEQ ID NO: 47038 - RNA, 64 nt, Homo Sapiens
agagguaucaaguaaauacuagacaaaguaagagggaaaggaaaucguuuauccugacugaaau

SEQ ID NO: 47039 - RNA, 64 nt, Homo Sapiens
ggaagagugcuccaagacuuuaguaggacccaagggaaaggaagcaaauccagaagcaaagaga

SEQ ID NO: 47040 - RNA, 64 nt, Homo Sapiens
gugaggauuuucauuaaaagaacuaaaaauacgaggaaaggagaaaggcagagagaagagacag

SEQ ID NO: 47041 - RNA, 64 nt, Homo Sapiens
gaagagaaugaagacuacuucaugugaggggaugggaaaggaaaagcuggaaaccuggcuucuc

SEQ ID NO: 47042 - RNA, 64 nt, Homo Sapiens
cugcagccucuugucugguugaggacuuggggcaggaaaggaaugcugcugaacuugaauuucc

SEQ ID NO: 47043 - RNA, 64 nt, Homo Sapiens
acuugaauuucccuuuacaaggggaagaaauaaaggaaaggaguugcugccgaccugucacugu

SEQ ID NO: 47044 - RNA, 64 nt, Homo Sapiens
uagcuuuuccaacaaaucuuugaaaagcaaucuuggaaaggaauucauuaacuaaaugggguaa

SEQ ID NO: 47045 - RNA, 64 nt, Homo Sapiens
uuuuauacugcacuuuuuaaagcuuuuauguugaggaaaggaaaagggcauuugucuaaacaug

SEQ ID NO: 47046 - RNA, 64 nt, Homo Sapiens
uugugguguuuguuuccauccccaaggcaaacaaggaaaggaaaggaaagaagaaaaggugccu

SEQ ID NO: 47047 - RNA, 64 nt, Homo Sapiens
guguuuguuuccauccccaaggcaaacaaggaaaggaaaggaaagaagaaaaggugccuuaguc

SEQ ID NO: 47048 - RNA, 64 nt, Homo Sapiens
ggggaagucagcugaaacuugucuuguuuugccaggaaaggaaguaguugccuuuggucaucca

SEQ ID NO: 47049 - RNA, 64 nt, Homo Sapiens
uuuaugagugauugcucuacauuauuucuucaaaggaaaggaaaggaauugaagacuuugcuac

SEQ ID NO: 47050 - RNA, 64 nt, Homo Sapiens
gagugauugcucuacauuauuucuucaaaggaaaggaaaggaauugaagacuuugcuacucucu

SEQ ID NO: 47051 - RNA, 64 nt, Homo Sapiens
caagaauaccacauuuugaaacccagaaagaccuggaaaggagcccagcauguccaucuuuuca

SEQ ID NO: 47052 - RNA, 64 nt, Homo Sapiens
guuuagacaggauauuuucuugaugaagugauaaggaaaggacccauuuuuuugcucaucaccu

SEQ ID NO: 47053 - RNA, 64 nt, Homo Sapiens
cucuggguccuguuauuugcgcacagacagcaguggaaaggacgaguuggaguccgcguaguca

SEQ ID NO: 47054 - RNA, 64 nt, Homo Sapiens
uugcacuaaacuguuuuucuaguuaccccauuuaggaaaggaguuagaaagcagcucugggacc

SEQ ID NO: 47055 - RNA, 51 nt, Homo Sapiens
ccucugccagcaccuacugagggaaaggaaaagccccuggaaaugcgugug

SEQ ID NO: 47056 - RNA, 64 nt, Homo Sapiens
cccagauuuguguugaacgaaaacauugugguuuggaaaggagaauucaacaauuaauaguuga

SEQ ID NO: 47057 - RNA, 64 nt, Homo Sapiens
gcacaauaagcacugcuauuuuucucuuugucuaggaaaggaagcugaaucuuauaucuuaucu

SEQ ID NO: 47058 - RNA, 64 nt, Homo Sapiens
caguuuucaagauuuuuuuuuuaucugcuuggcuggaaaggagacuagaguaucuaguuuuuag

SEQ ID NO: 47059 - RNA, 64 nt, Homo Sapiens
aaggcuaguguacuagauguacuuuuucuaaaaaggaaaggacagaaaaaaaugaagaaaggaa

SEQ ID NO: 47060 - RNA, 64 nt, Homo Sapiens
ucuaaaaaggaaaggacagaaaaaaaugaagaaaggaaaggaagacaaauguaaagaaauaagg

SEQ ID NO: 47061 - RNA, 64 nt, Homo Sapiens
acauccugaaauaaaugaugagcaaggcccugggggaaaggacaaauuaaacaauaaaccagac

SEQ ID NO: 47062 - RNA, 64 nt, Homo Sapiens
gcugacuuucucuuucuuuccuggagaaaaauaaggaaaggaauaugcaagcaaacgggcaacu

SEQ ID NO: 47063 - RNA, 64 nt, Homo Sapiens
ugcuguuaugagcagcucuuagccagcucugucaggaaaggagggagcacauugauuuuucaaa

SEQ ID NO: 47064 - RNA, 64 nt, Homo Sapiens
ugccccacaugaaaaggauaccaaagaaagcuguggaaaggaccuuucuuuuaaugaagaaaca

SEQ ID NO: 47065 - RNA, 64 nt, Homo Sapiens
aacauuagcuuaugcuucuuuagauggaauaaugggaaaggagggaaaugggaaauggauggaa

SEQ ID NO: 47066 - RNA, 64 nt, Homo Sapiens
gggaaaggagggaaaugggaaauggauggaaaugggaaaggagggaaaauaauagcccagugag

SEQ ID NO: 47067 - RNA, 64 nt, Homo Sapiens
aggcuuggagggaagggagagacggguauuguugggaaaggaacucuucauuccggggaacaaa

SEQ ID NO: 47068 - RNA, 64 nt, Homo Sapiens
aaagaaaaaagcaauuagguugaaacagaaaguuggaaaggaaacagcucacugcugcugccuc

SEQ ID NO: 47069 - RNA, 64 nt, Homo Sapiens
aaaaauaauggaaacacaucgacugauuuuuauaggaaaggaggugauaaagccagcggggagg

SEQ ID NO: 47070 - RNA, 64 nt, Homo Sapiens
aaacauuuggaaaauaguaaauacuaguaggagaggaaaggaaaugaacaucuaaacugggacu

SEQ ID NO: 47071 - RNA, 64 nt, Homo Sapiens
auugcuucaguuguaaaugugaaaaaugggcuggggaaaggagguggugucccuaauuguuuua

SEQ ID NO: 47072 - RNA, 64 nt, Homo Sapiens
cuuugucugcucucagugucuucccuuugacaugggaaaggaguuguggccaaaauccccaucu

SEQ ID NO: 47073 - RNA, 64 nt, Homo Sapiens
gccuuucuggcuccugauaggguggagcaaaaguggaaaggaaaggaaagaggccuuuucucac

SEQ ID NO: 47074 - RNA, 64 nt, Homo Sapiens
ucuggcuccugauaggguggagcaaaaguggaaaggaaaggaaagaggccuuuucucacagcca

SEQ ID NO: 47075 - RNA, 64 nt, Homo Sapiens
cccuaaaagagcuccugaaggaagcacuaaacauggaaaggaacaacugauaccagccgcugca

SEQ ID NO: 47076 - RNA, 64 nt, Homo Sapiens
gaccuuugacaaaccugacaaaaacaagcaauggggaaaggauucccuauuuaauaaauggugc

SEQ ID NO: 47077 - RNA, 64 nt, Homo Sapiens
acagauccuccccucugcuuaauaagaaaggaaaggaaaggaaaauggucaaauugauacccuu

SEQ ID NO: 47078 - RNA, 64 nt, Homo Sapiens
ggaaaacagauccuccccuccccuuaauaagaaaggaaaggaaagucuuauggucaaauugaua

SEQ ID NO: 47079 - RNA, 64 nt, Homo Sapiens
gggacucuggcgucccggcagaagagagcaacgaggaaaggagacggagaguaguccgcgccag

SEQ ID NO: 47080 - RNA, 64 nt, Homo Sapiens
acggaugcugguauuuuaacagauggagagacaaggaaaggaaaggaaaggccuggcaugggca

SEQ ID NO: 47081 - RNA, 64 nt, Homo Sapiens
ugcugguauuuuaacagauggagagacaaggaaaggaaaggaaaggccuggcaugggcauugug

SEQ ID NO: 47082 - RNA, 64 nt, Homo Sapiens
gugaccagguugucuuagcuuuaccggcaccucaggaaaggaggcuccuaccuaucugugcauu

SEQ ID NO: 47083 - RNA, 64 nt, Homo Sapiens
aaguucuuggcugaguacuacucauguguuuuggggaaaggaaggugguagccaucucuuuaga

SEQ ID NO: 47084 - RNA, 64 nt, Homo Sapiens
uaaaugaauguacauucuucucacugacuuuggugauuuugaaaccuagaaugauguguuucua

SEQ ID NO: 47085 - RNA, 64 nt, Homo Sapiens
uaguccacuuuugauuguaauuuuuaugguauaggauuuugaaucuucuauuuuaggcuuguca

SEQ ID NO: 47086 - RNA, 64 nt, Homo Sapiens
caguggcaaaaaagaacaaaaucugagcagagaugauuuugaaccagauauuuugccauuauca

SEQ ID NO: 47087 - RNA, 64 nt, Homo Sapiens
auucugauucaguaggucugggaguggcgcgcuggauuuugaucaaaauuguagagcauuuuaa

SEQ ID NO: 47088 - RNA, 64 nt, Homo Sapiens
ugguuuggaucuguguccccaaaauuuuuaauuggauuuugauacugugucuaaaacaaacaaa

SEQ ID NO: 47089 - RNA, 64 nt, Homo Sapiens
uggguggcauauguuuugcccaauaauaaggaaagauuuugagacaguggcuuucaaaguuaug

SEQ ID NO: 47090 - RNA, 64 nt, Homo Sapiens
uaugguuauugguuucagauuuuccugucuugaagauuuugaguuauauauauguacuguuuug

SEQ ID NO: 47091 - RNA, 64 nt, Homo Sapiens
uagacuagaaagcuuucccuacugcuuuuuacaugauuuugaaaagaaacaaugacauaucaaa

SEQ ID NO: 47092 - RNA, 64 nt, Homo Sapiens
aggguaacuucuucuuuauuaucagguuuguucugauuuugacacagaaaaucuucagaaagac

SEQ ID NO: 47093 - RNA, 64 nt, Homo Sapiens
uuucucuuuuagugguauuagaauuuuguaaacggauuuugauguuuuacaucagaucauugug

SEQ ID NO: 47094 - RNA, 64 nt, Homo Sapiens
auaugggguccuuacuuguauucuuuuaucagcugauuuugaaacauauaauaaugauuuucuu

SEQ ID NO: 47095 - RNA, 64 nt, Homo Sapiens
uuuucuuguucccuucuuuaacuagcugccuuuagauuuugauaaucacagucuuaaaauacua

SEQ ID NO: 47096 - RNA, 64 nt, Homo Sapiens
ucaugaagauauuuuuccauaagagauuuuucaugauuuugaaauucaugauuuugaaaccaug

SEQ ID NO: 47097 - RNA, 64 nt, Homo Sapiens
ccaugaagagauuuuucaugaagauauuuuucaugauuuugaaauuugcccaucccaaaaucau

SEQ ID NO: 47098 - RNA, 64 nt, Homo Sapiens
gcuaucaggaaaugacuagaguuuaugagucacagauuuugaaaaaaugcuggugggucuccgu

SEQ ID NO: 47099 - RNA, 64 nt, Homo Sapiens
uuuagguacauguguucuuucugugucacuggucgauuuugaacuccucccagauccccaagau

SEQ ID NO: 47100 - RNA, 64 nt, Homo Sapiens
uuauuuuuucucuguaaacuuuauuugaaaauuugauuuugauuuccauucucugagucagugg

SEQ ID NO: 47101 - RNA, 64 nt, Homo Sapiens
agauuuuaaagacguucccuucucuauacaaaaugauuuugaagucgccugaguugcuuuuacu

SEQ ID NO: 47102 - RNA, 64 nt, Homo Sapiens
uaagacugaggucagaaaggugcagagaugaaaagauuuugaaggaccuuaugaaauaugaugg

SEQ ID NO: 47103 - RNA, 64 nt, Homo Sapiens
cuuuuaguccacauuagcagggaagaauuuggaagauuuugagcaaaaaaacaaugaucugcuu

SEQ ID NO: 47104 - RNA, 64 nt, Homo Sapiens
ggguugcauuuuuguugcaauaguuauuacuaaugauuuugauuuuacugcuaagagggaguaa

SEQ ID NO: 47105 - RNA, 64 nt, Homo Sapiens
ucauguucuuuucauagucggcuauuuuuauacugauuuugauaucauauuuaaguagccugug

SEQ ID NO: 47106 - RNA, 64 nt, Homo Sapiens
caauuugagggaggcagaagagauauucccuugagauuuugauauguguauauuccaguuaccu

SEQ ID NO: 47107 - RNA, 64 nt, Homo Sapiens
augacaaagaagauuaaaauuguccuacaauuuggauuuugaucauuccaucuuuucugaagau

SEQ ID NO: 47108 - RNA, 64 nt, Homo Sapiens
uugcuaucuccaucugggcuguaagggaucgaagacauuucaaaauagacauuucgucauuuaa

SEQ ID NO: 47109 - RNA, 64 nt, Homo Sapiens
uugcucuaucugggcugauaguaagggaucgaaaacauuucaaaauauacauuucaucauuuaa

SEQ ID NO: 47110 - RNA, 64 nt, Homo Sapiens
auuuaaguaagggaucgaaaagauaguaugauauacauuucaucuaauggaauauccaauuuac

SEQ ID NO: 47111 - RNA, 64 nt, Homo Sapiens
aaauuaaguacucguuuaaguaugguucuuaauuacauuucauucauuuauauuagaguaaaug

SEQ ID NO: 47112 - RNA, 64 nt, Homo Sapiens
uauaagguacacuugaaacuagugaguguuugucacauuucacuuucaugguauauaaaaugca

SEQ ID NO: 47113 - RNA, 50 nt, Homo Sapiens
uagagccucgucgaccauagacauuucaaaugcccaaagcaacaguuugu

SEQ ID NO: 47114 - RNA, 64 nt, Homo Sapiens
auucuuaaauuugccagcguuaaaguagaaaauaacauuucagaagagcacaauaugcauaaaa

SEQ ID NO: 47115 - RNA, 64 nt, Homo Sapiens
ugaguuuugcuaugggcugccuuauaugcagaacacauuucaaaaccuugauuuguaaugagcu

SEQ ID NO: 47116 - RNA, 64 nt, Homo Sapiens
augauuuccucuguaaucuaagcagagauuuucaacauuucaaagucaaugaaugaaacuagaa

SEQ ID NO: 47117 - RNA, 64 nt, Homo Sapiens
gagaaagcccccucccugcucagcagaaaaccaaacauuucacuggggccuggggcagaggagg

SEQ ID NO: 47118 - RNA, 64 nt, Homo Sapiens
cccacuguacugggcuuccauccuugccccgcacacauuucacuggaggaaagaaaagcccuuc

SEQ ID NO: 47119 - RNA, 64 nt, Homo Sapiens
aauaaggugagauuuuguaacucauagcuagggaacauuucacaugucacaucaagggcaggau

SEQ ID NO: 47120 - RNA, 64 nt, Homo Sapiens
aucaaacuagugaauacagugaaauuugaucucuacauuucaaaccuuagcugcuggguugauu

SEQ ID NO: 47121 - RNA, 64 nt, Homo Sapiens
gugucacuugcaaauaacaaagggacuuugagggacauuucauuaaauauaauuacugauacuu

SEQ ID NO: 47122 - RNA, 64 nt, Homo Sapiens
uauugacugugaauucauuuacauguaacuucugacauuucacucugugcaaauaaagaacaug

SEQ ID NO: 47123 - RNA, 64 nt, Homo Sapiens
uaaaacuaguugauuuaaagaguuuuuuugcacaacauuucaauuauauuugugaacuuagaaa

SEQ ID NO: 47124 - RNA, 64 nt, Homo Sapiens
aaaauaugugauuauauauguuaaaguauagauaacauuucacacuuggauacauaugugcauu

SEQ ID NO: 47125 - RNA, 64 nt, Homo Sapiens
agucuauaucuauuuucacgaagcugcaaaggaaacauuucaaggacaaaguaugccaucaugc

SEQ ID NO: 47126 - RNA, 64 nt, Homo Sapiens
aaacucagagauauuacucucuucuauugcuaaaacauuucaaacaacaguuuagcaguacaag

SEQ ID NO: 47127 - RNA, 64 nt, Homo Sapiens
aauguacagaaaauagcuuuuauugaguaauauuacauuucauuuauacuguagcaauauauuu

SEQ ID NO: 47128 - RNA, 64 nt, Homo Sapiens
uucacaagcuaggccaaugaaggcugaaucaaagacauuucauccaccaauaucauguguagau

SEQ ID NO: 47129 - RNA, 64 nt, Homo Sapiens
cucauuuuuauuguuuuuaccucuaauaauccacacauuucaugaauaauccacacauuucaug

SEQ ID NO: 47130 - RNA, 64 nt, Homo Sapiens
cucuaauaauccacacauuuuucuaauaauccacacauuucaugcauuucacaagugcaugucu

SEQ ID NO: 47131 - RNA, 64 nt, Homo Sapiens
uaauuuccuucagucuccagccaucaugcaguguacauuucagauguaucauuuuuauuugaau

SEQ ID NO: 47132 - RNA, 64 nt, Homo Sapiens
cgugugugcaaugccuuuuuaguucuaguacuucacauuucaccguaguuugauaauaaauagc

SEQ ID NO: 47133 - RNA, 64 nt, Homo Sapiens
aguguccacaagaagggguguuuauucuuccaacacauuucacuuuucuguaaauauacauaaa

SEQ ID NO: 47134 - RNA, 64 nt, Homo Sapiens
uggagcuccacugccauguacccaguaggguuugacauuucauuagccaugcaacauggauaug

SEQ ID NO: 47135 - RNA, 64 nt, Homo Sapiens
aucaaauaaaaccagugaagaucugaagaugcaaacauuucaacuaugaagauuuacauuucac

SEQ ID NO: 47136 - RNA, 64 nt, Homo Sapiens
ucugaagaugcaaacauuucaacuaugaagauuuacauuucacuuucuaauuuauuaaacaucu

SEQ ID NO: 47137 - RNA, 64 nt, Homo Sapiens
ugagguucaguuugguuggguaaaucuguuguguacauuucaacaaauacuuuuacauuugaca

SEQ ID NO: 47138 - RNA, 64 nt, Homo Sapiens
augcacucaggugcccuuuguuucaugaacaaauacauuucauuguacauguuuucuguuuaaa

SEQ ID NO: 47139 - RNA, 64 nt, Homo Sapiens
aagggugcugccacggaguggugagguaccgucuacauuucacauuauucugggcaccacaaaa

SEQ ID NO: 47140 - RNA, 64 nt, Homo Sapiens
aaucaauuuaaguguuggaaaaaauuugucugaaacauuucauaauuuguuuccagcaugaggu

SEQ ID NO: 47141 - RNA, 64 nt, Homo Sapiens
ucaaaaauaagcccuguagcugaaagacccugugacauuucacugaucuuccuuugaaagagaa

SEQ ID NO: 47142 - RNA, 64 nt, Homo Sapiens
aaggugcuuuuuugguacucgaaucuucacaguaacauuucagauaaaaaaaauauguugucau

SEQ ID NO: 47143 - RNA, 64 nt, Homo Sapiens
cguacucacagguuugcaaaugggaaaaaaguuuacauuucaguuuaggggcauaucuaagcua

SEQ ID NO: 47144 - RNA, 64 nt, Homo Sapiens
ugcuauuauauuuggcaggaacccagaguccagaacauuucaucuaugauggguuagauaaugu

SEQ ID NO: 47145 - RNA, 64 nt, Homo Sapiens
aauuauuuugauaaguguugauguuucauaugaaacauuucagacucuuuuuauugcuuugucu

SEQ ID NO: 47146 - RNA, 64 nt, Homo Sapiens
uaauggugccugacauauugaauauuaauguauuacauuucaaaaaaaacuuauuuuucuagua

SEQ ID NO: 47147 - RNA, 64 nt, Homo Sapiens
auucucuuccuacuauauuucauaucuaccuacuacauuucauaucauuccuacuacauuucau

SEQ ID NO: 47148 - RNA, 64 nt, Homo Sapiens
auaucuaccuacuacauuucauaucauuccuacuacauuucauaucuaccuacauuuacaugua

SEQ ID NO: 47149 - RNA, 64 nt, Homo Sapiens
auaauuuaauuacauuuuacuuuaaaaacuuuacacauuucaguuucuaaaauuuuaaauuaac

SEQ ID NO: 47150 - RNA, 64 nt, Homo Sapiens
uuuuauuuagaacugugagaccgguauuuuggaaacauuucaaaggaaacauaugaauuuguuu

SEQ ID NO: 47151 - RNA, 64 nt, Homo Sapiens
aaggcaaagggguaccccaaauccagaggugccuacauuucaggcagccuuggaguauuuuaaa

SEQ ID NO: 47152 - RNA, 64 nt, Homo Sapiens
augacauucuuauacugcugucucaaauccaaaaacauuucagagcucuugucucagagaugug

SEQ ID NO: 47153 - RNA, 64 nt, Homo Sapiens
ggcaucacuauuuuuaaauggacauuuuccccuuacauuucaaauuaaauuauaauguaaaguu

SEQ ID NO: 47154 - RNA, 64 nt, Homo Sapiens
cucugggauauaaauuacguagacaauuaccuuuacauuucaagugaucuaaagauaaugucuu

SEQ ID NO: 47155 - RNA, 64 nt, Homo Sapiens
auaaauuauagcuuccugguuuaaguauguaucaacauuucauuagcuacagcugcaguagcuu

SEQ ID NO: 47156 - RNA, 51 nt, Homo Sapiens
acuugauauuucauuuugcguacauuucaaaaacgcaggcaacagaccuaa

SEQ ID NO: 47157 - RNA, 64 nt, Homo Sapiens
ugguagaauccauguagaagucacuauuaagcagacauuucaguaccugcuaauagcaccaucg

SEQ ID NO: 47158 - RNA, 64 nt, Homo Sapiens
ucuuggaaaaggccuccuuccuuucauuucugucacauuucauuccaagucugugguccauggg

SEQ ID NO: 47159 - RNA, 64 nt, Homo Sapiens
ggccuuuuuuuuuuuuuaagucagaccauuuuauacauuucagucuuugauaccaccaucaugu

SEQ ID NO: 47160 - RNA, 64 nt, Homo Sapiens
uaccuauauuuaucugagugaagauaauugcuuuacauuucacaaaccauaauuaaaguugcau

SEQ ID NO: 47161 - RNA, 64 nt, Homo Sapiens
augguaacagccccaugaagaccacaauuggaauacauuucaaggcaucagucuguucucuuug

SEQ ID NO: 47162 - RNA, 64 nt, Homo Sapiens
uucuuuacucaguucugcauuguuuuuuuaaaagacauuucagcauuaaauaaauucauggcaa

SEQ ID NO: 47163 - RNA, 64 nt, Homo Sapiens
guguaaauacaucuugucuuguuuucauucaaaaacauuucacuuuugggguugcgugucagau

SEQ ID NO: 47164 - RNA, 64 nt, Homo Sapiens
aaagucgaaauuaauguaguuuucugccuugauaacauuucauaugugguauuaguuuuaaagg

SEQ ID NO: 47165 - RNA, 64 nt, Homo Sapiens
acaagaugugucaugaaaacaacauuucacaugcacauuucaaaccuuuacagagguucggacu

SEQ ID NO: 47166 - RNA, 64 nt, Homo Sapiens
ugcacauuucaaaacaagauagagguucggacuaacauuucacauacgcaaaaacuuccuuuac

SEQ ID NO: 47167 - RNA, 64 nt, Homo Sapiens
aauucugucuguaauugauuauuaaaaacaauuuacauuucagguucugugugcucuuaaauau

SEQ ID NO: 47168 - RNA, 64 nt, Homo Sapiens
uuuuaauccgaauuuagcuagcaacuccauaaaaacauuucagaagguacauuccagccuguug

SEQ ID NO: 47169 - RNA, 64 nt, Homo Sapiens
guggaaggucauagccuggaacccaaguuugaaaacauuucauuguguucaguagugaauuucu

SEQ ID NO: 47170 - RNA, 64 nt, Homo Sapiens
ucuuugaaagucuaggaguagguggucaucuuguacauuucagcaaagcauccacuaggaaacc

SEQ ID NO: 47171 - RNA, 64 nt, Homo Sapiens
cuuuggcaggguuuaaaauauuugugagaagcccacauuucaguauacauccucacuggcuucc

SEQ ID NO: 47172 - RNA, 64 nt, Homo Sapiens
aauguugauauuuggcugauagugguuacauuucacauuucacuagaagccuaacuuuuuacac

SEQ ID NO: 47173 - RNA, 64 nt, Homo Sapiens
uuucacuaauguugauauuuuuuacacagugguuacauuucacaauguuucagaagccuaacuu

SEQ ID NO: 47174 - RNA, 64 nt, Homo Sapiens
cuggccaugaugauauuauuaaacaccauuauucacauuucaaauaauaacaauacuuuuuguu

SEQ ID NO: 47175 - RNA, 64 nt, Homo Sapiens
uaauucuaaccuuugauaguaaucagaauguauuacauuucauuucugaauagcuuuugaauuu

SEQ ID NO: 47176 - RNA, 62 nt, Homo Sapiens
accacccagcuuucucccagccacagccaagauucccaaagucaaggcccaaagauuuccaa

SEQ ID NO: 47177 - RNA, 62 nt, Homo Sapiens
uucccaaagucaaggcccaaagauuuccaagguucccaaagucaaggccaggccaaggccug

SEQ ID NO: 47178 - RNA, 62 nt, Homo Sapiens
uaaaagugcuagagaauuuaacuaaaagcugguucccaaaugcauagcuggcauuuuaauuu

SEQ ID NO: 47179 - RNA, 62 nt, Homo Sapiens
uaaaucaucuaacuggauuuuuccauuggucauucccaaacacaccuaugguccuagaaucc

SEQ ID NO: 47180 - RNA, 62 nt, Homo Sapiens
ggaaguuguugacccaagaacauagguuauauuucccaaaucuuuaauuauugagugaaaga

SEQ ID NO: 47181 - RNA, 62 nt, Homo Sapiens
caucccaggaugugagugggucugaagauacauucccaaauaaacgaccuaggcuagaagau

SEQ ID NO: 47182 - RNA, 62 nt, Homo Sapiens
ugcaaaacaggcugauuucaauuaggcagcacuucccaaagugcacugaggaagguggcccc

SEQ ID NO: 47183 - RNA, 62 nt, Homo Sapiens
ccugaccucaggcgauccacccccaccucggcuucccaaagugcugagauuacaggugugag

SEQ ID NO: 47184 - RNA, 62 nt, Homo Sapiens
aauuauagguaccuguuuagcgauaugcccaguucccaaaucucaucugcuuuuucguucug

SEQ ID NO: 47185 - RNA, 62 nt, Homo Sapiens
uuguacaaucuguccuggaauuuacaacgauuuucccaaauuucaaccccaggaaguaauua

SEQ ID NO: 47186 - RNA, 62 nt, Homo Sapiens
uggcuggucgggaauaccugcuaagucagugguucccaaaucauagaccuuaaauaaguguc

SEQ ID NO: 47187 - RNA, 62 nt, Homo Sapiens
ucuuguaggccguuguuucaaucaaaugucauuucccaaauuccaauugagaggaaaaugag

SEQ ID NO: 47188 - RNA, 62 nt, Homo Sapiens
gaaagccauucugaaacccugcaagucuugcuuucccaaacauauacuguagccuuuuaaca

SEQ ID NO: 47189 - RNA, 62 nt, Homo Sapiens
aagcccuuccuggcucccacgagugagcgguuuucccaaaacucuccacugggggcuuacgg

SEQ ID NO: 47190 - RNA, 62 nt, Homo Sapiens
ucuaaagaauuuaauucuaaaaguuauagacauucccaaagauauaccugcaagcaucacag

SEQ ID NO: 47191 - RNA, 62 nt, Homo Sapiens
ugaguuuuguaccuucuauuuuaaaagaggcuuucccaaacugugccauuuaucaauuuauu

SEQ ID NO: 47192 - RNA, 62 nt, Homo Sapiens
augauuugcacuuuuucacugcaugcuuacaauucccaaaggcaaaaucuguacugagguag

SEQ ID NO: 47193 - RNA, 62 nt, Homo Sapiens
accugcuugcuuccuaccacagauucuuuauuuucccaaacacuacaaaaaaacuuuuaaaa

SEQ ID NO: 47194 - RNA, 62 nt, Homo Sapiens
gcuuuaggcggcagaugauauacauaucugacuucccaaaagcuccaggauuugugugcugu

SEQ ID NO: 47195 - RNA, 62 nt, Homo Sapiens
ggucagcucuuuuuaacuucuugcugcucuuuuucccaaaagguaaaaauauagauugaaaa

SEQ ID NO: 47196 - RNA, 62 nt, Homo Sapiens
ucuuuaugcauugucucaacacuuucccuuuuuucccaaaaugaguagagaauuaaagccac

SEQ ID NO: 47197 - RNA, 62 nt, Homo Sapiens
auuuuuucuuuucaccacccuguugagcaauuuucccaaaaaaagggcagcaauuauuaaau

SEQ ID NO: 47198 - RNA, 62 nt, Homo Sapiens
uaaaaucuguuuuucucauccaguaaucccauuucccaaaccgcauuuggauguguaaauua

SEQ ID NO: 47199 - RNA, 62 nt, Homo Sapiens
ccuuauguuuaaucagcgauacccugagauacuucccaaagccucugcaguuuuucccaagu

SEQ ID NO: 47200 - RNA, 62 nt, Homo Sapiens
gaacauauuacuggggaaaguaccaauuccuauucccaaaauuacacaaaucuuuacuucuc

SEQ ID NO: 47201 - RNA, 62 nt, Homo Sapiens
auugcugaaaaaguagauugaucuugggauaguucccaaaagaugcacuuaugcaguaaauu

SEQ ID NO: 47202 - RNA, 62 nt, Homo Sapiens
ucagugucuagggacuaguuucucuuacauccuucccaaaaaccuaaaucugagucaguaau

SEQ ID NO: 47203 - RNA, 62 nt, Homo Sapiens
ucagugucuagggacugguucucuaaaaauccuucccaaaaacuaaaucugagucaguaauu

SEQ ID NO: 47204 - RNA, 62 nt, Homo Sapiens
cauuuggauguacagaucgacguagguguagauucccaaauguauaacauuaaauaauguaa

SEQ ID NO: 47205 - RNA, 62 nt, Homo Sapiens
cuagcucauuaaagaugaaaacauggcuaaucuucccaaaaagcaguaggcauuacuacagu

SEQ ID NO: 47206 - RNA, 62 nt, Homo Sapiens
acgagccuugccugaccucuucggugcugaccuucccaaagugaugccuuacugguuuugua

SEQ ID NO: 47207 - RNA, 62 nt, Homo Sapiens
uguugaguuaccaauggaagccaaaaguucucuucccaaacugccaagaaugauacaggcca

SEQ ID NO: 47208 - RNA, 62 nt, Homo Sapiens
acaaagcaguuuuucccccuuucagagacaacuucccaaagcugcguccucuguccccgggu

SEQ ID NO: 47209 - RNA, 62 nt, Homo Sapiens
ugucuccccagaagacacagccccuccacuccuucccaaaucccacaccccccuuggggccu

SEQ ID NO: 47210 - RNA, 62 nt, Homo Sapiens
agcaucuguccccagaaucaggcagaauccacuucccaaacagagccccacgcagguucacc

SEQ ID NO: 47211 - RNA, 62 nt, Homo Sapiens
uuuuacuuggcauugguuuugaaaccagcuguuucccaaacucugcuucccaagggcaaccg

SEQ ID NO: 47212 - RNA, 62 nt, Homo Sapiens
uaacugcagcucagcuuucacuauagcagugcuucccaaacggguucuagacuuggguguuu

SEQ ID NO: 47213 - RNA, 62 nt, Homo Sapiens
ggggggccugccaagggggggccuuguucuuguucccaaacucugacuuggaagaacucagc

SEQ ID NO: 47214 - RNA, 62 nt, Homo Sapiens
uguuuaggcauuugugaaggauuccagagccuuucccaaagugagaccauuucugggguauu

SEQ ID NO: 47215 - RNA, 62 nt, Homo Sapiens
uagcuuugugucaccuuugaaucugaggcaguuucccaaacaaaaaggcuggagccauuuuu

SEQ ID NO: 47216 - RNA, 62 nt, Homo Sapiens
ggagccauuuuucagaaguugcuuauacccuguucccaaacuaucagccuugauuaauuucu

SEQ ID NO: 47217 - RNA, 62 nt, Homo Sapiens
caguuauucauguuuucauucuacaauuacaguucccaaaguuuuuuggaaaaacaaaauuu

SEQ ID NO: 47218 - RNA, 62 nt, Homo Sapiens
cacaguuguucauguuauuucuacaauuacaguucccaaagauucuuggauaaagaaaauuu

SEQ ID NO: 47219 - RNA, 62 nt, Homo Sapiens
aggaccgacuuuauaacuuuuccaguguuugauucccaaauugggucugguuuuguuuugga

SEQ ID NO: 47220 - RNA, 62 nt, Homo Sapiens
auugcuucagaugaaaacaaaucacacaccguuucccaaaccaacagucuucacauuucuau

SEQ ID NO: 47221 - RNA, 64 nt, Homo Sapiens
aacccccagucaguguuugagccuccucguuccccucacgcacccgcucacgcacccucgguga

SEQ ID NO: 47222 - RNA, 64 nt, Homo Sapiens
guguuugagccuccucguuccccucacgcacccgcucacgcacccucggugaauccuuggugau

SEQ ID NO: 47223 - RNA, 64 nt, Homo Sapiens
acauuuuuguauguguguguuuuuggcgauaggucucacgcaacaaaaaaucaaacuguaguug

SEQ ID NO: 47224 - RNA, 64 nt, Homo Sapiens
aacguuuuuaauaggauuuuaaacaagugaguagcucacgcagcaacucccuuucauguuaauc

SEQ ID NO: 47225 - RNA, 61 nt, Homo Sapiens
aagccaugggaccuccucccucauucaucuugcaagcaaaucccauuucuugaaaagccuu

SEQ ID NO: 47226 - RNA, 61 nt, Homo Sapiens
cccaccccagugcacucuucuggcccaggcagcaagcaagcugugaacagcuggccugagc

SEQ ID NO: 47227 - RNA, 61 nt, Homo Sapiens
ccuuuagcucaauugauagggucagcgucucgcaagcaaaaaaucucaugaccucauauuu

SEQ ID NO: 47228 - RNA, 61 nt, Homo Sapiens
aagcauuccucagaacugucccauuugaagggcaagcaaaccugggguauuuauccacuga

SEQ ID NO: 47229 - RNA, 61 nt, Homo Sapiens
aaauuuuaaucaauaaaguaugucuguugaagcaagcaagcaaacaaauccauaacaacca

SEQ ID NO: 47230 - RNA, 61 nt, Homo Sapiens
uuuaaucaauaaaguaugucuguugaagcaagcaagcaaacaaauccauaacaaccacaac

SEQ ID NO: 47231 - RNA, 61 nt, Homo Sapiens
ugaauauuuuagcuauauuuaguggcuuucugcaagcaacuagaacagagaaguaaugggu

SEQ ID NO: 47232 - RNA, 61 nt, Homo Sapiens
gaaugucauaguacauugugugcuaaccauggcaagcaaacauuuacauuuguuuuuuaca

SEQ ID NO: 47233 - RNA, 61 nt, Homo Sapiens
gaucacggauguuggcucccccucgcccuaugcaagcaaacacacucucaccuccucuccc

SEQ ID NO: 47234 - RNA, 61 nt, Homo Sapiens
ucccaagguucaauaaggccuuauuuaacaagcaagcaaaaugcaaaccaaaccauuauuc

SEQ ID NO: 47235 - RNA, 61 nt, Homo Sapiens
ggcuuaaaauucccuuucuuucaacaggccagcaagcaaucgagguagaaguacuucaaau

SEQ ID NO: 47236 - RNA, 61 nt, Homo Sapiens
gaccuuaaacauacaggaaaggccuugguuugcaagcaacaguacauuuuauaaccaucca

SEQ ID NO: 47237 - RNA, 61 nt, Homo Sapiens
gauuguccccuucugcauauaaaugucucaggcaagcaaaaccuuguaaaaggccagggua

SEQ ID NO: 47238 - RNA, 61 nt, Homo Sapiens
gugaccuccaguggcccacuuccaauaugcagcaagcaaggcaaauaauucuuuucuguaa

SEQ ID NO: 47239 - RNA, 61 nt, Homo Sapiens
uucguaaucuucaucaagaaguuuuuaaaaggcaagcaaaaacagaagcaaaucauaucaa

SEQ ID NO: 47240 - RNA, 61 nt, Homo Sapiens
caacugugggauggcgauggugggaugugucgcaagcaauucacuagacaaucuucacaug

SEQ ID NO: 47241 - RNA, 61 nt, Homo Sapiens
gcuccaucccuggcuuccccagccugcggccgcaagcaaaaccaagcgcgagaugcagcua

SEQ ID NO: 47242 - RNA, 64 nt, Homo Sapiens
guaaaggguugauuugcugcaagaguagcugagaauucaaaaacauccuugcagaaugauucaa

SEQ ID NO: 47243 - RNA, 64 nt, Homo Sapiens
guagcugagaauucaaaaacauccuugcagaaugauucaaaagacaaaagccaggcucaacuua

SEQ ID NO: 47244 - RNA, 64 nt, Homo Sapiens
agagaaaaaaauucggaaagugaucagagcacuuauucaaaauacagugauagaaguucagaaa

SEQ ID NO: 47245 - RNA, 64 nt, Homo Sapiens
gaagaaaaauccaagucugaacgggaaugcccucauucaaaaaaaagaacuuugaaagagaauc

SEQ ID NO: 47246 - RNA, 60 nt, Homo Sapiens
acauuuuuauuaguggauagcguuguuggaauucaaaaaacagacaauauugccauagaa

SEQ ID NO: 47247 - RNA, 64 nt, Homo Sapiens
aagucuugacuaaugguucccgguuuagcugaagauucaaaaaaaaaaaaaaaagcuuuaugcu

SEQ ID NO: 47248 - RNA, 64 nt, Homo Sapiens
uaauauuuaugcauacuauacuguauaacauguuauucaaaagggauugccauuucugagacac

SEQ ID NO: 47249 - RNA, 64 nt, Homo Sapiens
uuucacguuugcuuaaaugcuucaucacagucacauucaaaauagugacucuaaacaaagaaga

SEQ ID NO: 47250 - RNA, 64 nt, Homo Sapiens
aacuaaaguagcuccagaaugcagggcuuugaucauucaaaaguaucacaagugguuuaguugg

SEQ ID NO: 47251 - RNA, 64 nt, Homo Sapiens
uccaccugcccaugcugcuuaaucaggguaugaaauucaaaaccauggaauugugaaaacuaug

SEQ ID NO: 47252 - RNA, 64 nt, Homo Sapiens
ucagugugcuuuauugaguguggauuuugcauacauucaaaacauuaaccacaaaauacagcaa

SEQ ID NO: 47253 - RNA, 64 nt, Homo Sapiens
uuuaaggucaaaauacagaucaucuagaaguuagauucaaaauggaaaaccuauucauggcuca

SEQ ID NO: 47254 - RNA, 64 nt, Homo Sapiens
uucagaagcaaccuggagaacagcuaucaaucauauucaaaaccaguacaagaacugcugccug

SEQ ID NO: 47255 - RNA, 64 nt, Homo Sapiens
agaaagaaaaaaaugguguuugacguugauggaaauucaaaaauauauauggaacugaaacauu

SEQ ID NO: 47256 - RNA, 64 nt, Homo Sapiens
ggggaaaugggucuuuucauaaccuuggauuuagauucaaaaggugacaucacaguagaaacca

SEQ ID NO: 47257 - RNA, 64 nt, Homo Sapiens
aaaccaaacagcaguucauaagccauucacaagcauucaaaaccccagucgccauugcuuuuuc

SEQ ID NO: 47258 - RNA, 64 nt, Homo Sapiens
uuaagauuggaggguaggugaucauaaagagauaauucaaaacuguccaaccaggggacagggu

SEQ ID NO: 47259 - RNA, 64 nt, Homo Sapiens
auacaguuuucaaaaaaucagauauauagaaguuauucaaaauuaaauaacaauuacagauccu

SEQ ID NO: 47260 - RNA, 64 nt, Homo Sapiens
uguugaaaggaaaaaaagugagccucuaggaauuauucaaaaaaagucugugauacauuccuuu

SEQ ID NO: 47261 - RNA, 64 nt, Homo Sapiens
acugcaggccaguuccaaagaguguuugcuuaagauucaaaaguggguaaguaaaauggaucag

SEQ ID NO: 47262 - RNA, 64 nt, Homo Sapiens
aaaauuagccgggcaugaugucaucucuacuaaaauucaaaaaccugggcaucauagcaagacc

SEQ ID NO: 47263 - RNA, 64 nt, Homo Sapiens
cucucucccaggaccucggauuucuaagugggacauucaaaaaaccaacucccucucugugcau

SEQ ID NO: 47264 - RNA, 64 nt, Homo Sapiens
cguauagggugcagaguaauaugucuagugagacauucaaaauugagcuauaggucauacauga

SEQ ID NO: 47265 - RNA, 64 nt, Homo Sapiens
cacaucaagucuucaggauaacuuaguaaugcacauucaaaacagguuauauuuuuuaaaauuu

SEQ ID NO: 47266 - RNA, 64 nt, Homo Sapiens
gaacccacgaaaauacccagcgcagcaucuacacauucaaaagauaagcugaguguucccacca

SEQ ID NO: 47267 - RNA, 64 nt, Homo Sapiens
aaagaggucacauauugugauuuccagcuguagcauucaaaaaaaaaauugguguucaugacuc

SEQ ID NO: 47268 - RNA, 64 nt, Homo Sapiens
uuuguauuuuuuuuuguuuguuuuguuuuuaaacauucaaaagcaauuaaugaucagacauagg

SEQ ID NO: 47269 - RNA, 64 nt, Homo Sapiens
aacccugaauagaaacaaaacuuuugaaugcuggauucaaaaaaaaaaaaaaguuaucuggaca

SEQ ID NO: 47270 - RNA, 64 nt, Homo Sapiens
ugccacugcacuccagccugagugacagagagagauucaaaaaacaaaaaaaaagcaaaaauau

SEQ ID NO: 47271 - RNA, 64 nt, Homo Sapiens
cuugucacaacugcaaacaauaccugaguggaguauucaaaaacuugcuuagaaagaaaacucu

SEQ ID NO: 47272 - RNA, 64 nt, Homo Sapiens
uuuuuuuuauuuuuaagggaucauaauaucuucuauucaaaaucaggaacuucuugagaaaucu

SEQ ID NO: 47273 - RNA, 64 nt, Homo Sapiens
gaguuuucuuauuauaguguacagaaacaucacaauucaaaaguaacguauuguccuuccguua

SEQ ID NO: 47274 - RNA, 64 nt, Homo Sapiens
cauguacacagaguaucuggagaauaaaacccaaauucaaaaaaaaaaaugauaauuuauuuuu

SEQ ID NO: 47275 - RNA, 64 nt, Homo Sapiens
gauaagcacauggguaaaaaugagggugauccuuauucaaaaauaacaucugacuacuauaaaa

SEQ ID NO: 47276 - RNA, 64 nt, Homo Sapiens
uguuguaacugaaagcacuguuuuagagaaggaaauucaaaaaaggacaccucugcugugaaug

SEQ ID NO: 47277 - RNA, 64 nt, Homo Sapiens
ugucacccaagcucuguucaugguaagguugcaaauucaaaacauuaugauguucaucacagug

SEQ ID NO: 47278 - RNA, 64 nt, Homo Sapiens
uuuaaaucauauuuuacagauguagaagaaauuuauucaaaagugugggcucaugaaguucacu

SEQ ID NO: 47279 - RNA, 64 nt, Homo Sapiens
auacacaacaccaagugguacaucugcagagauaauucaaaauuccugcuuuugagagagcaaa

SEQ ID NO: 47280 - RNA, 64 nt, Homo Sapiens
ccuauugauaguggccauuuaaacgugguccaagauucaaaaauuuauagggagcuggauuuca

SEQ ID NO: 47281 - RNA, 64 nt, Homo Sapiens
cauuguguauauuacuacaauacuuuauuauuguauucaaaauucccccagugcaaaagacugu

SEQ ID NO: 47282 - RNA, 64 nt, Homo Sapiens
uaguaugggacaauugaauagggagaguuagguuauucaaaaauccucucuuaguagaaacaaa

SEQ ID NO: 47283 - RNA, 64 nt, Homo Sapiens
aaaaccggauuucaaauaacacuuaaccaaaacuauucaaaauggacauucugccaugacauac

SEQ ID NO: 47284 - RNA, 64 nt, Homo Sapiens
auguaacauaguuucagugugauuucuagagcuaauucaaaauaguauugauauauuuuaugug

SEQ ID NO: 47285 - RNA, 64 nt, Homo Sapiens
aauccaaaauuuuaaauuuaacucugccucggccauucaaaagucuaauaacaaaaaauguaaa

SEQ ID NO: 47286 - RNA, 64 nt, Homo Sapiens
auuuuauuuauuuuugaauccacuaucucuuuccauucaaaauauuuccauucaaaaugugguu

SEQ ID NO: 47287 - RNA, 64 nt, Homo Sapiens
gaauccacuaucucuuuccauucaaaauauuuccauucaaaaugugguucacagacccgccaca

SEQ ID NO: 47288 - RNA, 64 nt, Homo Sapiens
gacuaucaucuaagauuaauaaccaaacuuuuucucaaaccaggggcuuaauuacuaaauguca

SEQ ID NO: 47289 - RNA, 64 nt, Homo Sapiens
cuuuuucucaaaccagggacuuaauuacuaaaugucaaaccaaagaaguaucaugcaauaaggc

SEQ ID NO: 47290 - RNA, 64 nt, Homo Sapiens
uuacaguaagugguuguaugaugccaauacugacucaaaccaaccuuuggauagaaaaguguuu

SEQ ID NO: 47291 - RNA, 64 nt, Homo Sapiens
cagaaggacaaaauauuccuagacgagucuacccucaaaccaguagugucuuuuacaugaagag

SEQ ID NO: 47292 - RNA, 64 nt, Homo Sapiens
ugguccauuccaggaccuucauuugcauaagguaucaaaccacaucagccucugauuggccaug

SEQ ID NO: 47293 - RNA, 64 nt, Homo Sapiens
ugguucauuccaggacauucauuugcauaaggagucaaaccacaccagucuuggauuggcugug

SEQ ID NO: 47294 - RNA, 64 nt, Homo Sapiens
gucugguaacuauggauuuccccucuuacaacuuucaaaccagaguuggagacucagcauuggg

SEQ ID NO: 47295 - RNA, 64 nt, Homo Sapiens
ugggccuguggcauucauauuucauauucauauuucaaaccacaauauccagcaaaaugucucc

SEQ ID NO: 47296 - RNA, 64 nt, Homo Sapiens
gccauauauaugucuguauaaauugucuucucuuucaaaccagauaaaucauaauacuagacaa

SEQ ID NO: 47297 - RNA, 64 nt, Homo Sapiens
ccucccccagaugguacuuccucuacucccugccucaaaccacccaccuaccacuccaugcuuu

SEQ ID NO: 47298 - RNA, 64 nt, Homo Sapiens
ggagccugucaaaaaguagaaucauaaggacuguucaaaccauaaggacuguucaaaucauacc

SEQ ID NO: 47299 - RNA, 64 nt, Homo Sapiens
ccauaaggacuguucaaaucauaccagugacuguucaaaccaaccauacuuuuuauuagauuug

SEQ ID NO: 47300 - RNA, 64 nt, Homo Sapiens
ccauuacuuauauacuaacuacauaaugaccuguucaaaccagacucuauuuaaugaacuguga

SEQ ID NO: 47301 - RNA, 64 nt, Homo Sapiens
ggccccuggccugugugcugacuucuugggguccucaaaccacuguauuuuucuguugagccug

SEQ ID NO: 47302 - RNA, 64 nt, Homo Sapiens
caauaggaauuuuucaaguccacuauaaaucuuaucaaaccaugguuguauaugcaguugaccg

SEQ ID NO: 47303 - RNA, 64 nt, Homo Sapiens
ggugcuugguaccagcaugagcuaacuuuauggcucaaaccaauaggacaauuugcugaggucu

SEQ ID NO: 47304 - RNA, 65 nt, Homo Sapiens
aaagaaaucauuguucaaucuuccauaaggaagagauucuuuaccaggcugugagccaguguuag

SEQ ID NO: 47305 - RNA, 65 nt, Homo Sapiens
ggaggagagagcuguucucuagugguuaacaugguauucuuuaagaagaaaaaacaaagccaaag

SEQ ID NO: 47306 - RNA, 65 nt, Homo Sapiens
agccuuugaaugcuaagaaugcauuauugagggucauucuuuauucuuuacuauuaaaauauuuu

SEQ ID NO: 47307 - RNA, 65 nt, Homo Sapiens
gaaugcuaagaaugcauuauugagggucauucuuuauucuuuacuauuaaaauauuuuggaugca

SEQ ID NO: 47308 - RNA, 65 nt, Homo Sapiens
gaaccuuguagugccaaaaauaaauugucacuucuauucuuuacaggaaagaauuucauguguuu

SEQ ID NO: 47309 - RNA, 65 nt, Homo Sapiens
uucuauuagcuguauucauaaauuuaaaaaauuacauucuuuauugaugaauuguauaaagagag

SEQ ID NO: 47310 - RNA, 65 nt, Homo Sapiens
uccuaaacuuuuaguugcaacuuccaagugugcuaauucuuuaccuuguauuaaauguauacaga

SEQ ID NO: 47311 - RNA, 65 nt, Homo Sapiens
aauucaguucuaaggaaagagaauuuuauuaagcuauucuuuagaggcguuuuauagaauaauau

SEQ ID NO: 47312 - RNA, 65 nt, Homo Sapiens
caaauuaagggcaagcgaaaaaguaauaauuuggcauucuuuaagccuacagaaugugauucuuu

SEQ ID NO: 47313 - RNA, 65 nt, Homo Sapiens
cgcuuguucacuaguaaccuaaagaggcuauauucauucuuuaugcaaugaggguauuuuugagu

SEQ ID NO: 47314 - RNA, 65 nt, Homo Sapiens
gaaauacuuaaaguguggcaauacucuuucacuuaauucuuuacaagggauaucaaagccauaau

SEQ ID NO: 47315 - RNA, 65 nt, Homo Sapiens
uucaaaguuauuuugucuugauguauguaacaguaauucuuuacaucuuuugauuuuucucuucc

SEQ ID NO: 47316 - RNA, 65 nt, Homo Sapiens
aauuuucuagaauacuaauaaaauacauacuauagauucuuuauuagugaaguaugcacuaauca

SEQ ID NO: 47317 - RNA, 65 nt, Homo Sapiens
uguaagaguaagcaccuuuagaauauuaaaaauuaauucuuuaucacauguugucauuucuuccc

SEQ ID NO: 47318 - RNA, 65 nt, Homo Sapiens
auguuuuggaguuauuacuguguauuuuagaaaucauucuuuacaguuuugcauugcugaggaga

SEQ ID NO: 47319 - RNA, 65 nt, Homo Sapiens
uggguauaacuauguuauaggaaaguagaaauuguauucuuuauuuuccaucuuuguuuucuguu

SEQ ID NO: 47320 - RNA, 65 nt, Homo Sapiens
ccaguguauaccaacaaucagcuguugaaagcaucauucuuuaauuacuguaccauccauaaugc

SEQ ID NO: 47321 - RNA, 65 nt, Homo Sapiens
aguguuuaagauauguuuucuguauaaaugaacuaauucuuuauauuaaauuccugucuaugcau

SEQ ID NO: 47322 - RNA, 65 nt, Homo Sapiens
aacauuucagaauaggaaguaaaugauaaacuuauauucuuuauuauuauuuaguacaaaaauag

SEQ ID NO: 47323 - RNA, 65 nt, Homo Sapiens
ggacacagauaaccccuucgcuuccagcucuuaaaauucuuuaucuuuuucuuggcaaaaccaga

SEQ ID NO: 47324 - RNA, 65 nt, Homo Sapiens
caguuuuacugaacaaaaaauguaauuuauuuagcauucuuuauaaaagaauugaugcuagaggu

SEQ ID NO: 47325 - RNA, 65 nt, Homo Sapiens
ugucuguauuucaaguacaaauguuuuuaaaaaggauucuuuauacauaugugcugaauugauuu

SEQ ID NO: 47326 - RNA, 65 nt, Homo Sapiens
gacaguagaauauuggcuaucccagggaagacuguauucuuuaaauuagauaaaguauauucuuc

SEQ ID NO: 47327 - RNA, 65 nt, Homo Sapiens
gaaggacauuuauuuagaguagcagaggacauugcauucuuuaguaugccaaagaaccauaaacu

SEQ ID NO: 47328 - RNA, 65 nt, Homo Sapiens
aaaauaaaaacucuguguaauaaauauaaacaaauauucuuuacuaaugucuuuuuaaauguuuu

SEQ ID NO: 47329 - RNA, 65 nt, Homo Sapiens
auaucacuuuuuguaaguguaaacuaguacuuuauauucuuuaucucuuuugaaguguuaaaagg

SEQ ID NO: 47330 - RNA, 65 nt, Homo Sapiens
ugugcauaccaaugugaaaaauaacuguagcuuauauucuuuauuaucuguguuauuuuguaaaa

SEQ ID NO: 47331 - RNA, 65 nt, Homo Sapiens
ugauugagugagaguauguacaaauaaagaauucaauucuuuacaagcaacguuuauggauauca

SEQ ID NO: 47332 - RNA, 65 nt, Homo Sapiens
cuugauguguacuuagagaaagacuuuacguguuaauucuuuauuuuuuaagggauauuuguuua

SEQ ID NO: 47333 - RNA, 65 nt, Homo Sapiens
auuuuacauccaguuaccuccacuuucuagaacauauucuuuacuaauguuauugaaaccaauuu

SEQ ID NO: 47334 - RNA, 65 nt, Homo Sapiens
gauggggaaugggggagauggucccugggcuuaauauucuuuaaagggcaugggaauuuagccuc

SEQ ID NO: 47335 - RNA, 65 nt, Homo Sapiens
cagccagaaggaaaaaaguuuuccauuuuuauuacauucuuuaggaaaguuaacguuaaagggau

SEQ ID NO: 47336 - RNA, 65 nt, Homo Sapiens
auuuuuauaaaauguuuaaccaaauguaccuuugcauucuuuaauuaaaauugcuuaaaaaaaaa

SEQ ID NO: 47337 - RNA, 65 nt, Homo Sapiens
gcaauaccuaguucugcuucugaaacuggaguaucauucuuuacauauuuauauguauguuuuaa

SEQ ID NO: 47338 - RNA, 65 nt, Homo Sapiens
agccuccuagauguaacauuccugaucaagguacaauucuuuaaaauucacuaaugauugagguc

SEQ ID NO: 47339 - RNA, 65 nt, Homo Sapiens
uacauacugauaauacauaccucaugaaagauuuuauucuuuauuguguuacagagcaguuucau

SEQ ID NO: 47340 - RNA, 65 nt, Homo Sapiens
ucuagaugcuuccucuuuuguauaaagucacugacauucuuuagaguggguugggugcauccaaa

SEQ ID NO: 47341 - RNA, 65 nt, Homo Sapiens
agaaguuuuauuuuuucgugcuugugcucagcaugauucuuuaauaaugucacaaccucucugau

SEQ ID NO: 47342 - RNA, 65 nt, Homo Sapiens
uucacguaagauacaaguuuguagaaaugcauuuuauucuuuaagguccugggggcgagaucggg

SEQ ID NO: 47343 - RNA, 65 nt, Homo Sapiens
uuuugccuuguuuauuaaauuuuuacuauagaaaaauucuuuauuuauucuuuaaaauugaacuc

SEQ ID NO: 47344 - RNA, 65 nt, Homo Sapiens
uuauuaaauuuuuacuauagaaaaauucuuuauuuauucuuuaaaauugaacuccaacccugauu

SEQ ID NO: 47345 - RNA, 65 nt, Homo Sapiens
uauuaggauacaagcugggaacuucuaaacacuucauucuuuauauauggacagcuuuauuuuaa

SEQ ID NO: 47346 - RNA, 65 nt, Homo Sapiens
ugauagcaauguaagugccuauaaccauguucuauauucuuuauucucaguaacuuuuaaaaggg

SEQ ID NO: 47347 - RNA, 65 nt, Homo Sapiens
uuauuuaggcuuccugguggcuucauuuuauugaaauucuuuaaauuguuuaaaguggccauuau

SEQ ID NO: 47348 - RNA, 65 nt, Homo Sapiens
aaaauuuaaagaaugugucuucaacuaaaaacuuuauucuuuagcauuuauuuauauuucucugu

SEQ ID NO: 47349 - RNA, 65 nt, Homo Sapiens
gaaguguuuaaaacuauuuuagcugggcaccccuaauucuuuaugucccuagggggaaaucaagg

SEQ ID NO: 47350 - RNA, 65 nt, Homo Sapiens
ggaugaaauauuucaaaagagaaggcagagcuucuauucuuuaugacagaagcuugaaaugcuau

SEQ ID NO: 47351 - RNA, 65 nt, Homo Sapiens
auguauaaccugccauuaugacuaaguggaaagagauucuuuaaauucaauuucuaucuuauuug

SEQ ID NO: 47352 - RNA, 65 nt, Homo Sapiens
cagacauugauguagacuuguuugucuauuuaccuauucuuuacuaauacuaucuuuuauagggg

SEQ ID NO: 47353 - RNA, 65 nt, Homo Sapiens
auuccuauuguucaggcuaauguggcaaaaccacaauucuuuaagucuucuuaguaacuucuuuc

SEQ ID NO: 47354 - RNA, 65 nt, Homo Sapiens
gacuuuuugcccuaaauugcaaauaaaguaccuuaauucuuuauuaagggaaaugaggcuuuuaa

SEQ ID NO: 47355 - RNA, 65 nt, Homo Sapiens
auaaccauuucaaaaaauaaucugaauuuaaggaaauucuuuaggagaguaggaauuuugcaaaa

SEQ ID NO: 47356 - RNA, 65 nt, Homo Sapiens
guucuagaauaaaaguacaaaaaauuagaauaagaauucuuuaacauuuucuuuaaugauuugca

SEQ ID NO: 47357 - RNA, 65 nt, Homo Sapiens
aguucacaauguauuuucuacuucugcaauuaaauauucuuuagugcuuguuuauuauuacuaaa

SEQ ID NO: 47358 - RNA, 65 nt, Homo Sapiens
ggagaaaaacaucacacaaauuccaauugagaagcauucuuuaaaauaccuaaccaguacuucuc

SEQ ID NO: 47359 - RNA, 65 nt, Homo Sapiens
auuuguaaguuaucaugaaaagguuuauauucacuauucuuuauuucaguguagcacuuuuagag

SEQ ID NO: 47360 - RNA, 65 nt, Homo Sapiens
cagguauuuugauauuggagccaggaaguuuaaaaauucuuuaaaagagagaagagaaaacucac

SEQ ID NO: 47361 - RNA, 65 nt, Homo Sapiens
ccaauuuccagagagaagagucuuggagggaaaagauucuuuauugaguagguguuuguuuuggu

SEQ ID NO: 47362 - RNA, 65 nt, Homo Sapiens
uguauagcauguguauuaauuaaaugaaaaacacaauucuuuauggaaguaugcaugcaggccua

SEQ ID NO: 47363 - RNA, 65 nt, Homo Sapiens
uaugaaauaucauugccaggacaucaccuuccugaauucuuuaaauuucuuuuugcacaaagaac

SEQ ID NO: 47364 - RNA, 65 nt, Homo Sapiens
gauuacaggcaugagccaccgugcucagccgcaaaauucuuuaugaauuuuacacuuggcaaaug

SEQ ID NO: 47365 - RNA, 65 nt, Homo Sapiens
ccaggcuggauggcucaaauauaaaugaaugaggaauucuuuaugaaguaucagucagauuuuau

SEQ ID NO: 47366 - RNA, 65 nt, Homo Sapiens
uguagucaugaauagucucccuccccuuucucgccauucuuuagcaacuuccaaggcucuuccag

SEQ ID NO: 47367 - RNA, 65 nt, Homo Sapiens
ccacucaaucaaaggaacucuuuggcaccauucucauucuuuauccucaguccuggcaaugaggg

SEQ ID NO: 47368 - RNA, 65 nt, Homo Sapiens
caaaccuuuuugagccauaggauccaagccauaaaauucuuuaugcauguugaauucagucagaa

SEQ ID NO: 47369 - RNA, 65 nt, Homo Sapiens
uggaggaugcauguaugauacuccauaaauucaacauucuuuacuauagguaaugaaugauuaua

SEQ ID NO: 47370 - RNA, 65 nt, Homo Sapiens
cagaagucuuguuuuauuacugacaaacgugggauauucuuuaugggaucaggaccuuaugagug

SEQ ID NO: 47371 - RNA, 65 nt, Homo Sapiens
uaaaccucugugcaucuucuaaagaaauuugggaaauucuuuagcaaagaaguccuuacaaguga

SEQ ID NO: 47372 - RNA, 65 nt, Homo Sapiens
uauuuucuuuuuccccauuaaaagaggaccaaacaauucuuuauacaaauggaguagcaacuagu

SEQ ID NO: 47373 - RNA, 65 nt, Homo Sapiens
auaaaggggaacuaggcuagcaguucuaaugugacauucuuuaagcauaucuuaaaauaguauuu

SEQ ID NO: 47374 - RNA, 65 nt, Homo Sapiens
gcuagauaguauuagaauaguccaauagaaaauucauucuuuauaggucuuuaaaaauuacuuuu

SEQ ID NO: 47375 - RNA, 65 nt, Homo Sapiens
aacuuuuaaaaggcauaacuguauuuuauguguuuauucuuuauauagauaguauuuuauauuuu

SEQ ID NO: 47376 - RNA, 65 nt, Homo Sapiens
caaauagcagacaucugaucauuuuauccauaaauauucuuuauauaucucugaaagcuauggga

SEQ ID NO: 47377 - RNA, 65 nt, Homo Sapiens
ugauaauuccauuaucgcaagugauauuuacaguaauucuuuaauaucaguaaauauccagugag

SEQ ID NO: 47378 - RNA, 64 nt, Homo Sapiens
cugcgugugguggcucacaccuguaaucccaacacuuugggacguugaaaugggagaauugcuu

SEQ ID NO: 47379 - RNA, 64 nt, Homo Sapiens
ccaggcgugguggcucacgccuguaaucccaacacuuugggaggccgaggcgggcggaucacga

SEQ ID NO: 47380 - RNA, 64 nt, Homo Sapiens
ccgaggcggguggaucacgauuguaaucccagcacuuugggaggccgagcguguuggcucacgc

SEQ ID NO: 47381 - RNA, 64 nt, Homo Sapiens
ccaaggugggcggaucacaacuguaaucccagcacuuugggaggcugggcgcgguggcucacgc

SEQ ID NO: 47382 - RNA, 64 nt, Homo Sapiens
ccgaggcagguggaucaccuuguuaaugccaguacuuugggaggcgggcacaguggcuuacgcc

SEQ ID NO: 47383 - RNA, 64 nt, Homo Sapiens
ccaaggcaggcagaucacuucuguaaucccaacacuuugggaggcugggcgugguggcucaugc

SEQ ID NO: 47384 - RNA, 64 nt, Homo Sapiens
gggaucccuugcugauugacugaucuuaaaaucacuuugggacuggguacuuugaucuuagauu

SEQ ID NO: 47385 - RNA, 64 nt, Homo Sapiens
ccgagacggguggaucacgacuguaaucccagcacuuugggaggguuaaaaaucaacucauugc

SEQ ID NO: 47386 - RNA, 64 nt, Homo Sapiens
aaugggauugcugaguugaaugggauaugcauuccuuugggaauuacaaugauuuauauuuccu

SEQ ID NO: 47387 - RNA, 64 nt, Homo Sapiens
ccgagguggccagaucaccucuguaaucccagcacuuugggaggauuagccugguggcucacgc

SEQ ID NO: 47388 - RNA, 64 nt, Homo Sapiens
cccaggugggcggaucaccucuguaaucccagcacuuugggaggccgggcaugguggcucacgc

SEQ ID NO: 47389 - RNA, 64 nt, Homo Sapiens
cugaggugggagggucgcuucuguagucucagcacuuugggaggcuguguaugguggcccuugc

SEQ ID NO: 47390 - RNA, 64 nt, Homo Sapiens
uuuuuucugaacauucuaagggaccagaagagagcuuugggacaacauucugauugucuuguau

SEQ ID NO: 47391 - RNA, 64 nt, Homo Sapiens
uuaaagcccccuuugggcuuugauuacaguagcacuuugggaaggggaggcccaggggaauugg

SEQ ID NO: 47392 - RNA, 64 nt, Homo Sapiens
cugaggcgggcggaucacaacuguaaucucagcacuuugggaggccaggcaugguggcucacgc

SEQ ID NO: 47393 - RNA, 64 nt, Homo Sapiens
cugaggcagguggaucgccucuguaaucccagcacuuugggaggccagccgugguggcucacac

SEQ ID NO: 47394 - RNA, 64 nt, Homo Sapiens
cugaauggaagaagaaaagaucugcuccucacagcuuugggaaucugugaugcuucgaaauagg

SEQ ID NO: 47395 - RNA, 64 nt, Homo Sapiens
cugggcgcaguggcucacgccuguaaucccagcacuuugggaggccaaggcaaacggaucacga

SEQ ID NO: 47396 - RNA, 64 nt, Homo Sapiens
accaguuuaggcuggguaugguggcucaccagcacuuugggaggcugaggcagguggaucucuu

SEQ ID NO: 47397 - RNA, 64 nt, Homo Sapiens
gccagcgcaguggcucaugccuguaaucccagcacuuugggaggcugaggcgggcggaucaccu

SEQ ID NO: 47398 - RNA, 64 nt, Homo Sapiens
ccgggcgcgguggcucacgccuguaaucccaacacuuugggaggccaagguggguggaucacaa

SEQ ID NO: 47399 - RNA, 64 nt, Homo Sapiens
caauaacacugucuccuuucucuuaugcuuaaggcuuugggaauguuuuuagcugguggcaaua

SEQ ID NO: 47400 - RNA, 64 nt, Homo Sapiens
ccacguaugguggcucaugucuauaaucccagcacuuugggagguugaggugggaggauugcuu

SEQ ID NO: 47401 - RNA, 64 nt, Homo Sapiens
caccuauacuuaggaaaaagaggucccacuaugccuuugggagaucagcuugccuggaagaggg

SEQ ID NO: 47402 - RNA, 64 nt, Homo Sapiens
ccugggucuuucccaccugccacaacuugugugucuuugggagcuggaggcaucagguucugug

SEQ ID NO: 47403 - RNA, 64 nt, Homo Sapiens
ccgaggugggaggaucacuucuauaaucccaacacuuugggaggccaggcguggaggcucacac

SEQ ID NO: 47404 - RNA, 64 nt, Homo Sapiens
uuaaagaugcagaaguauuaccucuacuguaucgcuuugggacuucauacccagccagccuuug

SEQ ID NO: 47405 - RNA, 64 nt, Homo Sapiens
cugaggcgggcagaucgcuucuguaaucucagcacuuugggaggcuaggcuuaguggcucacgc

SEQ ID NO: 47406 - RNA, 64 nt, Homo Sapiens
ccgagucagguggaucaccucuguaaucccaguacuuugggaggccgggcaugguggcucacgc

SEQ ID NO: 47407 - RNA, 64 nt, Homo Sapiens
ccauggcggguggaacauuucuguaaucccagcacuuugggaggcugggcaugguggcucacgc

SEQ ID NO: 47408 - RNA, 64 nt, Homo Sapiens
cugaggcaggcggaucacgauuguaaucccagcacuuugggaggcugggugcgguggcucacgc

SEQ ID NO: 47409 - RNA, 64 nt, Homo Sapiens
cagaggugggcggaucacaacuauaauuccagcacuuugggaggccggguacaguggcucaugc

SEQ ID NO: 47410 - RNA, 64 nt, Homo Sapiens
ccgaggcagguggaucacuucuguaaucccagcacuuugggaggccgggagugguggcuuacac

SEQ ID NO: 47411 - RNA, 64 nt, Homo Sapiens
ccgagaugggugaaucaugacuauaaucccagcacuuugggaggccgggcgcggugacucacgc

SEQ ID NO: 47412 - RNA, 64 nt, Homo Sapiens
ccgaaguggguggaucaccucuguaaucccagcacuuugggaggccgggugugguggcucacac

SEQ ID NO: 47413 - RNA, 64 nt, Homo Sapiens
cugaggcaggaaggcugcugggcacaguggcucacuuugggaggggaacuggagccucuggcug

SEQ ID NO: 47414 - RNA, 64 nt, Homo Sapiens
ggaggacuuuauuuaaacaggggagcaggaguaccuuugggaggccaggacccugcuguaguug

SEQ ID NO: 47415 - RNA, 64 nt, Homo Sapiens
cugcuuccucauuuuauagauagggaaacugaggcuuugggaggacucacugacauaccuaccu

SEQ ID NO: 47416 - RNA, 64 nt, Homo Sapiens
ucaguucuggggcuugggaaaagggccccaguggcuuugggaagcacccccagcccagggugaa

SEQ ID NO: 47417 - RNA, 64 nt, Homo Sapiens
acuuacucaggaucaguggcaccagccaacucagcuuugggacaaacccagccaagugaccagg

SEQ ID NO: 47418 - RNA, 64 nt, Homo Sapiens
cugagcgcgguggcucacgccuguaaucccagcacuuugggaggccaagguggguggaccacau

SEQ ID NO: 47419 - RNA, 64 nt, Homo Sapiens
ccaggugugguggcucacgccugugaucccagcacuuugggaggccaagacgggcggaucauga

SEQ ID NO: 47420 - RNA, 64 nt, Homo Sapiens
aauuacucagauuggccuguuauuugauuuccuccuuugggaaaagaauuauguagauaccaca

SEQ ID NO: 47421 - RNA, 64 nt, Homo Sapiens
gcuaggugcagugguucaugccuguaauccagcacuuugggaggcuaagaugaguggauugcuu

SEQ ID NO: 47422 - RNA, 64 nt, Homo Sapiens
cccaggcccuuccucuaucauggaugcugggugacuuugggaagucaccaccucuucccaagcc

SEQ ID NO: 47423 - RNA, 64 nt, Homo Sapiens
cugggccuaguggcgcacaccugcaaucccaacacuuugggaggccaagagaggaagauugcuu

SEQ ID NO: 47424 - RNA, 64 nt, Homo Sapiens
ccgggcgcgguggcucacaccuguaaucccagcacuuugggagguggaggcggguggaucacaa

SEQ ID NO: 47425 - RNA, 64 nt, Homo Sapiens
acauuuuuacuugcuuguagccguuuuuguuugccuuugggauucgggcuuuggcugugcccau

SEQ ID NO: 47426 - RNA, 64 nt, Homo Sapiens
ucugggaaaucccgcgauacuaaaauccagugagcuuugggagaucauucccuaaagguaugug

SEQ ID NO: 47427 - RNA, 64 nt, Homo Sapiens
ccgggcgcgguggcucaaaccuguaaucccagcacuuugggaggccgagguggguggaucacga

SEQ ID NO: 47428 - RNA, 64 nt, Homo Sapiens
ccaggugcaguggcucacaccuguaaucccagcacuuugggaggccaaaguggguggaucacuu

SEQ ID NO: 47429 - RNA, 64 nt, Homo Sapiens
cacucggcugggcacaguggcucacgucuguaaucuuugggagcacuuugggaggccgaggugg

SEQ ID NO: 47430 - RNA, 64 nt, Homo Sapiens
gcacaguggcucacgucuguaaucuuugggagcacuuugggaggccgaggugggcggaucacga

SEQ ID NO: 47431 - RNA, 64 nt, Homo Sapiens
ccaaggugggcaguucacgucuauagucgcagcacuuugggaggcggguacgguagcucacguc

SEQ ID NO: 47432 - RNA, 64 nt, Homo Sapiens
ccgaggugggcggaucacaacuguaauccuggcacuuugggagggccggugugguggcucacgg

SEQ ID NO: 47433 - RNA, 64 nt, Homo Sapiens
cugaggcaggcggaucacuucuguaauaccagcacuuugggaggccagccgcaguggcucacgc

SEQ ID NO: 47434 - RNA, 64 nt, Homo Sapiens
aacuccaccuacgcagcagaucccagccugugaccuuugggaccacaccaaagccuuggacccc

SEQ ID NO: 47435 - RNA, 64 nt, Homo Sapiens
ucuaauguuccuuaaaucccacggagaggagcagcuuugggaacuguguucagagagauuccga

SEQ ID NO: 47436 - RNA, 64 nt, Homo Sapiens
ccaggcaugguggcucaugccuguaaucccagcacuuugggaggcugagguagguggaaaaccu

SEQ ID NO: 47437 - RNA, 64 nt, Homo Sapiens
ccggguacaauggcucacgccuguaauccuaacacuuugggaggccgaggcagacagaucaccu

SEQ ID NO: 47438 - RNA, 64 nt, Homo Sapiens
ccaggcacaguggcucauaccuguaaugccagcacuuugggaggccaaggcgggcagaucacga

SEQ ID NO: 47439 - RNA, 64 nt, Homo Sapiens
ccaggcgugguggcucaugccuauaaucccagcacuuugggaggcuaagacaggcagaucaccu

SEQ ID NO: 47440 - RNA, 64 nt, Homo Sapiens
ccagguguggugacucacaccuauaaucccaauacuuugggaggccaaggcaggaggauugcuu

SEQ ID NO: 47441 - RNA, 64 nt, Homo Sapiens
cagaggcgggaggauugcuucuguaauuccaacacuuugggaggcccugugcaauggcucacac

SEQ ID NO: 47442 - RNA, 64 nt, Homo Sapiens
ccgcgguggguggaucaccucuguaauccuagcgcuuugggagguugggcgccguggcucacac

SEQ ID NO: 47443 - RNA, 64 nt, Homo Sapiens
ucgaggugggcagaucaccucuguuaucccagcacuuugggaggccggacgcaguagcuuacgc

SEQ ID NO: 47444 - RNA, 64 nt, Homo Sapiens
ugacaacucaauccagaagggccaaggcauuuggcuuugggacgagccacugcucguuguaaau

SEQ ID NO: 47445 - RNA, 64 nt, Homo Sapiens
ccaggugcgguggcucacgccuguaaucccagcacuuugggaggccgaggugagcggaucaccu

SEQ ID NO: 47446 - RNA, 63 nt, Homo Sapiens
ccgggcgccguggcucacgccuguaaucgcagcacuuugggaggccgaggcaggcggaucacg

SEQ ID NO: 47447 - RNA, 64 nt, Homo Sapiens
caggggcggguggaucaccuguuuaaucccagcacuuugggaggccagacauggugucucacac

SEQ ID NO: 47448 - RNA, 64 nt, Homo Sapiens
ccaagacgggaugauugcuucuguaaucccagaacuuugggaggccgggcacaguggcgcaugc

SEQ ID NO: 47449 - RNA, 64 nt, Homo Sapiens
ccgaggcaggcggaucacaacuguaaucccagcacuuugggaggcugggcgugguggcucacgc

SEQ ID NO: 47450 - RNA, 64 nt, Homo Sapiens
cuaaggcaggcggaucacuuuuguaaucccagcacuuugggaugccaggagcgguggcucacac

SEQ ID NO: 47451 - RNA, 64 nt, Homo Sapiens
ccaaggugggcggaucaugauuguaaucccagcacuuugggaggcggggcgugguggcucacac

SEQ ID NO: 47452 - RNA, 64 nt, Homo Sapiens
uugaggcaggaggaucgcuuuguggucccagcuacuuugggaggcaggcguuguggugcaugcu

SEQ ID NO: 47453 - RNA, 64 nt, Homo Sapiens
cccaggugggaggaucgcuucuguaaucccauuacuuugggaggucgggcacaguggcucccgc

SEQ ID NO: 47454 - RNA, 64 nt, Homo Sapiens
aaccauguuucauguggccuguuagggccugucacuuugggagccggaaggaggugcuagucau

SEQ ID NO: 47455 - RNA, 64 nt, Homo Sapiens
cugggcaugguggcuuacgccuguaaucccagcacuuugggaggccaaggcgggcggaucauga

SEQ ID NO: 47456 - RNA, 64 nt, Homo Sapiens
ccgggcgcgguggcucacgccuguaaucccagcacuuugggaggcugaggcgggcagaucaccu

SEQ ID NO: 47457 - RNA, 64 nt, Homo Sapiens
gggcacgguggcucaugccuauaaaauuccagcacuuugggaggccaaggcaggaggaucacuu

SEQ ID NO: 47458 - RNA, 64 nt, Homo Sapiens
ccaaggcgggcagcucaccucuguaaucccugcacuuugggaagccgagugugguggcuuaugc

SEQ ID NO: 47459 - RNA, 64 nt, Homo Sapiens
ccgaggcagguggaucacgacuguaaucccagcacuuugggaggccgggcgcgguggcuuaugc

SEQ ID NO: 47460 - RNA, 64 nt, Homo Sapiens
uuugaauuucuuugguuucguuccugcuuucuuucuuugggacuuuggauuauagaauuauuau

SEQ ID NO: 47461 - RNA, 64 nt, Homo Sapiens
cugaggcgggugaaucacuucuguaaucccagcacuuugggaggcuggacgcgguggcucacgc

SEQ ID NO: 47462 - RNA, 64 nt, Homo Sapiens
cugggcgcaguggcucacaccuguaaucccagcacuuugggaggcugaggcggguggaucaccu

SEQ ID NO: 47463 - RNA, 64 nt, Homo Sapiens
uuuggaacuuuaucuguguuauaguuaugaguugcuuugggagacuuggagcucucuguagcua

SEQ ID NO: 47464 - RNA, 64 nt, Homo Sapiens
ccaggugugguggcucaugccuauaaucccagcacuuugggaggccaaggcagguggaucaccu

SEQ ID NO: 47465 - RNA, 64 nt, Homo Sapiens
cugggugugguggcucacgccuguaauccuagcacuuugggaggccgaguugggagguuugcuu

SEQ ID NO: 47466 - RNA, 64 nt, Homo Sapiens
cuagacccaauggcucaugccuguaaucccaacacuuugggaggccaaggugggaggauggcuu

SEQ ID NO: 47467 - RNA, 64 nt, Homo Sapiens
uagaaacucugggcugggcacaguggcucacacacuuugggaggccaagcgggggugcagauca

SEQ ID NO: 47468 - RNA, 64 nt, Homo Sapiens
ucacagaaauacauuuuugugggaaaugucuguacuuugggaaggcuuuacccccuggggccug

SEQ ID NO: 47469 - RNA, 64 nt, Homo Sapiens
gacaccuggccuuuuucuccgcaggggugagcagcuuugggagauucugccuccaggcaggacg

SEQ ID NO: 47470 - RNA, 64 nt, Homo Sapiens
aagcugcggaaucuucuuacgaaaacugccugaccuuugggacuccacagaguuuuucaggaga

SEQ ID NO: 47471 - RNA, 64 nt, Homo Sapiens
gcucuugucucuucuuccccggagaccacacacccuuugggaaaaaaucuggagcuggcacugu

SEQ ID NO: 47472 - RNA, 64 nt, Homo Sapiens
ccgggugggguggcacaugccuguaaucccagcacuuugggaggccaaggcugguggaucaccu

SEQ ID NO: 47473 - RNA, 64 nt, Homo Sapiens
cugggugcaguggcucacgccuguaaucccagcacuuugggaggcuuaggcggcuggaucaccu

SEQ ID NO: 47474 - RNA, 64 nt, Homo Sapiens
cugggcgcugcggcuugcgccuguaaucucagcacuuugggaggcugagauggguggaucaccu

SEQ ID NO: 47475 - RNA, 64 nt, Homo Sapiens
accccauguuggcugcugcuguugagauacugugcuuugggaguaaaaaaagaaaguuauuucu

SEQ ID NO: 47476 - RNA, 64 nt, Homo Sapiens
cugggcacgguggcucaugccuguaaucccagcacuuugggaggccgaggugggcggaucacuu

SEQ ID NO: 47477 - RNA, 64 nt, Homo Sapiens
uuugcuuauuugaaaguaauucagcaacaggucacuuugggauauaaccugaaccuuuuuuugg

SEQ ID NO: 47478 - RNA, 64 nt, Homo Sapiens
ccuagugcaguggcucacaccuauaaucccaacacuuugggaggccaggaguuuugagaccagc

SEQ ID NO: 47479 - RNA, 64 nt, Homo Sapiens
uccagcuccguuuuaaagacauuccucaugguggcuuugggagguuuacauacaccauucuacu

SEQ ID NO: 47480 - RNA, 64 nt, Homo Sapiens
agcugcugagcucuuugccuccuucccucccuggcuuugggaagauaacuucugcucucaccuc

SEQ ID NO: 47481 - RNA, 64 nt, Homo Sapiens
ccgggcaugguggcucaugccuguaaucccagcacuuugggaggccaggaguucgagaccagcc

SEQ ID NO: 47482 - RNA, 64 nt, Homo Sapiens
cugggcgcaguggcucacgccuguaaucccagcacuuugggagggauaggugggcggaucaccu

SEQ ID NO: 47483 - RNA, 64 nt, Homo Sapiens
cagagcagggauugugccgggagagugccucugacuuugggacauuucauccacagaaauuucc

SEQ ID NO: 47484 - RNA, 64 nt, Homo Sapiens
cagauggaccaugcccuugcuggguuuuccuuuucuuugggacugugaggggaaaugguuuuua

SEQ ID NO: 47485 - RNA, 64 nt, Homo Sapiens
aauauuaauggaggauauuccucggaaaaacagacuuugggaaugaaggagggacucaggauca

SEQ ID NO: 47486 - RNA, 64 nt, Homo Sapiens
ucauaagcauuugcccucaccaugguuuauaaaacuuugggaaaacggaauauucagaaauagg

SEQ ID NO: 47487 - RNA, 64 nt, Homo Sapiens
cugugcacgguagcuuaugccuguaaucucagcacuuugggaggccaaggcaggcagaucauga

SEQ ID NO: 47488 - RNA, 64 nt, Homo Sapiens
ccggacaugcuggcucauaccuguaaucccagaacuuugggaggccgaggcagguggaucauuu

SEQ ID NO: 47489 - RNA, 64 nt, Homo Sapiens
cugaggcaggaggauugcuucuguaauaccagcgcuuugggaggcugggcuugguggcucacau

SEQ ID NO: 47490 - RNA, 64 nt, Homo Sapiens
cugaggcagguggaucacaacuguaaucccagcacuuugggaggcugggcgcaguggcucacgc

SEQ ID NO: 47491 - RNA, 64 nt, Homo Sapiens
uauagcccuagcccaguggugacaugaccacucccuuugggaggccugagguagaggggagugg

SEQ ID NO: 47492 - RNA, 64 nt, Homo Sapiens
guaucagaagccagacuugcucuucggucaugcacuuugggauacagcguauaggugcagcccu

SEQ ID NO: 47493 - RNA, 64 nt, Homo Sapiens
ucgggcaugguggcucaugccuguaaucucagcacuuugggaggcugaggcagaaggauuaccu

SEQ ID NO: 47494 - RNA, 64 nt, Homo Sapiens
gugcaguggcucaugccuguaaucccagccagcacuuugggaggcugagaugggaagaucacuu

SEQ ID NO: 47495 - RNA, 64 nt, Homo Sapiens
ccaggcaccguggcucacgucuguaaucccagcgcuuugggaggccgaggcaggcagaucaccu

SEQ ID NO: 47496 - RNA, 64 nt, Homo Sapiens
ccaggugugguggcucacaccuguaaucccagcacuuugggagaccaaggcgggcggaucacuu

SEQ ID NO: 47497 - RNA, 64 nt, Homo Sapiens
cugaggcgggugguucaucucuguaauccugacacuuugggaguccagguacgguggcuaacgc

SEQ ID NO: 47498 - RNA, 64 nt, Homo Sapiens
ccgaggcaggcggaucacaacuaugaucccagcacuuugggaggccgggugcgguggcucacgc

SEQ ID NO: 47499 - RNA, 64 nt, Homo Sapiens
augugaauuucaguguuagauguuauuugagguacuuugggaagauucuuggcauuuuuauucu

SEQ ID NO: 47500 - RNA, 64 nt, Homo Sapiens
ccaaggcagguggaucaccucuguaauccuagcacuuugggaggcugggcacaguggcucacac

SEQ ID NO: 47501 - RNA, 64 nt, Homo Sapiens
acaaugugggagaauggcuucugaaauccuagcacuuugggaagcugggcacaguggcucaugc

SEQ ID NO: 47502 - RNA, 64 nt, Homo Sapiens
cugaggcaggcggaucacuucuguaaucccagcacuuugggaggucaggcacgguggcucaugc

SEQ ID NO: 47503 - RNA, 64 nt, Homo Sapiens
ccaaggugggcggaucacccuuguaaucccagcacuuugggaggcaggagcaguggcucacacc

SEQ ID NO: 47504 - RNA, 64 nt, Homo Sapiens
cugaggugggaggacugcuucuguaaucccagcacuuugggaggcugggugugacggcacaugc

SEQ ID NO: 47505 - RNA, 64 nt, Homo Sapiens
gugaauagaauguagcaaaauugaaauagcauuucuuugggauugccaaacaucuggucuugca

SEQ ID NO: 47506 - RNA, 64 nt, Homo Sapiens
ccgaggcagguggaucacaacuguaaucccagcacuuugggaggccgggcgcgguggcaaaugc

SEQ ID NO: 47507 - RNA, 64 nt, Homo Sapiens
ccaaggcggguggaucaccucuguaauuccagcacuuugggaggccaggcaugguggcucaugc

SEQ ID NO: 47508 - RNA, 64 nt, Homo Sapiens
ccccaucuauggcuguagauaaggauacagcuuccuuugggaaggguagcuucuguguucccgu

SEQ ID NO: 47509 - RNA, 64 nt, Homo Sapiens
cauuaaaggauguuugagggaccuguagaccugucuuugggaaaaaaucaaagguaauuuuauu

SEQ ID NO: 47510 - RNA, 64 nt, Homo Sapiens
ccaggcgggauggcucacgccuguaaucccagcacuuugggaggcugaggcgggcagaucacuu

SEQ ID NO: 47511 - RNA, 64 nt, Homo Sapiens
gcccacacgguggcucacuucuguaaucccaucacuuugggaggcuuaggcagaaggaucaccu

SEQ ID NO: 47512 - RNA, 64 nt, Homo Sapiens
ccgggcgugguggcuuacgccuguaaucccagcacuuugggaggccaaggugggcggaucacaa

SEQ ID NO: 47513 - RNA, 64 nt, Homo Sapiens
ccgggugcgguggcucaugccuguaaucccaacgcuuugggacgccgaggcggguggaucauga

SEQ ID NO: 47514 - RNA, 64 nt, Homo Sapiens
uagacugugauggcucacaccuguaaucccagugcuuugggaggcugaggugggaagauucuuu

SEQ ID NO: 47515 - RNA, 64 nt, Homo Sapiens
ccgaggcggguggaucacuccuguaaucccagcucuuugggaggccgggccugguggcucacac

SEQ ID NO: 47516 - RNA, 64 nt, Homo Sapiens
uggugccucaugcucucuggggccacauaccaagcuuugggacaaaauugggggaggagcccag

SEQ ID NO: 47517 - RNA, 64 nt, Homo Sapiens
cugaggcaggcagaucaccucuguaaucccagcacuuugggaggccgggcgugguggcucacgc

SEQ ID NO: 47518 - RNA, 64 nt, Homo Sapiens
ggcuggguauggagguucacugguaaucccagcacuuugggaggcccaggcagaaggaucgcug

SEQ ID NO: 47519 - RNA, 64 nt, Homo Sapiens
accucgucucuacaaaaaaaaauuaaaaagggggcuuugggaggccaaggcgggcagaucauga

SEQ ID NO: 47520 - RNA, 64 nt, Homo Sapiens
cggcgcacagugacucacgccuguaaucccagcacuuugggagggcgaggcuagcagaucacuu

SEQ ID NO: 47521 - RNA, 64 nt, Homo Sapiens
uggaccuagcagcucaugccuguaaucuccagcacuuugggaggcggaggcaggaggaucucuu

SEQ ID NO: 47522 - RNA, 64 nt, Homo Sapiens
auaguacauugccaucuccaggaagacuugacggcuuugggauuuuguuuaaacuuuuauaaua

SEQ ID NO: 47523 - RNA, 64 nt, Homo Sapiens
ccgggcgcaguggcucacgccuguaaucccagcacuuugggaggccaagguggguggaucaccu

SEQ ID NO: 47524 - RNA, 64 nt, Homo Sapiens
cuaaggcagcuggaucacuucuguaaucccaacacuuugggaggccgggcaugguggcucaugc

SEQ ID NO: 47525 - RNA, 64 nt, Homo Sapiens
ccaaggcaggugggucaccucuguaaucucagcacuuugggaggccgggcaugguggcucacgc

SEQ ID NO: 47526 - RNA, 64 nt, Homo Sapiens
ccuaggcgggcggaucaugaugucaaucccagcacuuugggaggggucucuauuuaaaugccac

SEQ ID NO: 47527 - RNA, 64 nt, Homo Sapiens
gacccaccugaaaugcaguaucaucugauuuacucuuugggaucuugaagaagcucuuuugggu

SEQ ID NO: 47528 - RNA, 64 nt, Homo Sapiens
ccgggcgcgguggcucacgccuguaaucccagcacuuugggaggccaaggcgggcggaucaccu

SEQ ID NO: 47529 - RNA, 64 nt, Homo Sapiens
uuaagaagagagacucucuugcuucuucaaagagcuuugggaaauuaaauugcuaaauuuguau

SEQ ID NO: 47530 - RNA, 64 nt, Homo Sapiens
gaggaaugcuugcaaugcucauugaagggauuugcuuugggacuuugucaucuuccagaaagga

SEQ ID NO: 47531 - RNA, 64 nt, Homo Sapiens
cugggugugguggcucacgccuauaaucccagcacuuugggaggcugagguggguggaccacuu

SEQ ID NO: 47532 - RNA, 64 nt, Homo Sapiens
ccaggcgagguggcucacaccuguaaucccagcacuuugggaggccaaggcggguggaucacaa

SEQ ID NO: 47533 - RNA, 64 nt, Homo Sapiens
ccaggcacgguggcucacaccuguaaucccagcacuuugggaggccaaggcgggcggaucagcu

SEQ ID NO: 47534 - RNA, 64 nt, Homo Sapiens
ccgggugcggcagcucaugccuguaaucccaacacuuugggaggcugaggcaggcggaucacga

SEQ ID NO: 47535 - RNA, 64 nt, Homo Sapiens
ccgaggcaggcagaucacgacuguaaucccagcacuuugggaggccgggugcgguggcucaagc

SEQ ID NO: 47536 - RNA, 64 nt, Homo Sapiens
cuaaggugggcggaucaccucuguaaucccagcacuuugggaggccagguaugguggcucacgc

SEQ ID NO: 47537 - RNA, 64 nt, Homo Sapiens
ccgaggugggcggaucacgacuguaaucccagcacuuugggagguggggcgcaguggcucacgc

SEQ ID NO: 47538 - RNA, 64 nt, Homo Sapiens
ccgaggcggguggaucagcucuguaaucccaacacuuugggagcccuggugugguggcucacac

SEQ ID NO: 47539 - RNA, 64 nt, Homo Sapiens
cugaggugggaggguugcuucuguacucccagcacuuugggaggccaagccugauggcucgugc

SEQ ID NO: 47540 - RNA, 64 nt, Homo Sapiens
cugaggcaggcggaucaccucuguaaucccagcacuuugggaggccaggugcaguggcucacgc

SEQ ID NO: 47541 - RNA, 64 nt, Homo Sapiens
auggucaggucccauguugugcggcugcagccugcuuugggacgggcccggcccacggcccuga

SEQ ID NO: 47542 - RNA, 64 nt, Homo Sapiens
ugugucuuccagggaucagcugccuucugccucccuuugggaucgcagcucuuggcuucgggcc

SEQ ID NO: 47543 - RNA, 64 nt, Homo Sapiens
uuuuuauuuugguguugcaauuguguguguuuugcuuugggaccuggauauuguuagugacuuu

SEQ ID NO: 47544 - RNA, 64 nt, Homo Sapiens
uguuuauuuacauugucagauguuuuuuucucuacuuugggagauucuucuuguauuaaaauuu

SEQ ID NO: 47545 - RNA, 64 nt, Homo Sapiens
ccgggcgcaguggcucacgccuguaaucccagcacuuugggaggccgaggcggguggaucauga

SEQ ID NO: 47546 - RNA, 64 nt, Homo Sapiens
cagacacaggugccucacgccuguaaucccagcacuuugggaggcugagcuggaucacuugagu

SEQ ID NO: 47547 - RNA, 64 nt, Homo Sapiens
cugggcaugguggcucacgccuguaaucccagcacuuugggaggccgaggucaggaguuagaga

SEQ ID NO: 47548 - RNA, 64 nt, Homo Sapiens
ccgagugcgguggcucacgccuauaaucccagcacuuugggaggccgaggcgggcggaucacua

SEQ ID NO: 47549 - RNA, 64 nt, Homo Sapiens
ccgggggcgguggcucacgccuguaaucccaacacuuugggagcccgaggcgggcggaucacaa

SEQ ID NO: 47550 - RNA, 64 nt, Homo Sapiens
ccaggcacaguggcccaggccuguaaucccaucacuuugggaggugcaggcaggcagauggcuu

SEQ ID NO: 47551 - RNA, 64 nt, Homo Sapiens
cugggcgugguggcucacgccuguaaucccagcacuuugggaggccgaggcgggcagaucacga

SEQ ID NO: 47552 - RNA, 64 nt, Homo Sapiens
ccaggugcgguggcucacgcuugcaaucccagugcuuugggagacugaggcaggaggaucacuu

SEQ ID NO: 47553 - RNA, 64 nt, Homo Sapiens
ccaggccugguggcacaugccuguaauccgagugcuuugggaggcugaggcaggaggaucacuc

SEQ ID NO: 47554 - RNA, 64 nt, Homo Sapiens
aguuggaaaauauguaacuggaaucucaaaaguucuuugggacaaaacagaaguccauggaguu

SEQ ID NO: 47555 - RNA, 64 nt, Homo Sapiens
cugagagcaguggcucacgccuguaaucccagaacuuugggaggcuaagguggguggaucaccu

SEQ ID NO: 47556 - RNA, 64 nt, Homo Sapiens
ccaggcaugguggcucaugcuuguaaaccugaugcuuugggaggacaaggugguucauuggagg

SEQ ID NO: 47557 - RNA, 64 nt, Homo Sapiens
ucaggcgcaguggcucacaccuguaaucccagcacuuugggaggccgagguggguggauggauc

SEQ ID NO: 47558 - RNA, 64 nt, Homo Sapiens
gggagggcccgggcguccaguucccccaagggggcuuugggacauuggcccccagcagccacag

SEQ ID NO: 47559 - RNA, 64 nt, Homo Sapiens
ccgaggugaaaggaucacuucuguaaucccagcacuuugggaggucaucuguggccaggcacgc

SEQ ID NO: 47560 - RNA, 64 nt, Homo Sapiens
ccgaggugggcggaucacgauguaaucccuaacacuuugggaggugggcacgguggcucaugcc

SEQ ID NO: 47561 - RNA, 64 nt, Homo Sapiens
ccuucaaagacacauggcaggaaguccuucaauucuuugggaaauaugauuguaaggaauguag

SEQ ID NO: 47562 - RNA, 64 nt, Homo Sapiens
cugagaugggcagaucacuucuguaaccccagcacuuugggagggugggugcaguggcucacau

SEQ ID NO: 47563 - RNA, 64 nt, Homo Sapiens
ccaaggagggaggaucacuuauguaaucccagcacuuugggaagccaggugcaguggcucacgu

SEQ ID NO: 47564 - RNA, 64 nt, Homo Sapiens
cugagguggucagaucaccucuauaaucccagcacuuugggaggccaggcacaguggcucacgc

SEQ ID NO: 47565 - RNA, 64 nt, Homo Sapiens
gugaggcaggaggauggcuccuguaauccuagcacuuugggagggguauggcacaguucaugcc

SEQ ID NO: 47566 - RNA, 64 nt, Homo Sapiens
cugagguggguggaucacugcuguaaucucagcacuuugggaggccaggcgugguggcucaugc

SEQ ID NO: 47567 - RNA, 64 nt, Homo Sapiens
ccaagaugggcggaucacgacuguaaucccagcacuuugggaggccaggcacaguggcucacac

SEQ ID NO: 47568 - RNA, 64 nt, Homo Sapiens
cugaggcagguggaucaccucuauaaucccagcacuuugggaggccgagcacaguggcccaugc

SEQ ID NO: 47569 - RNA, 64 nt, Homo Sapiens
cugaggugggaggacugcuucuguaaucccgguacuuugggaggcaaggcauaguggcuuaugc

SEQ ID NO: 47570 - RNA, 64 nt, Homo Sapiens
ccauggcagguggaucaccucuguaaucccagcacuuugggaggccaggugcgguggcucaugc

SEQ ID NO: 47571 - RNA, 64 nt, Homo Sapiens
acaagguggguggaucacuucuguaaucccagcacuuugggagggccuggcacaggggucacac

SEQ ID NO: 47572 - RNA, 64 nt, Homo Sapiens
ccaaggugggaggaucaguucuguaaucccugcacuuugggaggucaggcaggguggcucacac

SEQ ID NO: 47573 - RNA, 64 nt, Homo Sapiens
cugaggcaggcggaucaccucuguaaucccagcacuuugggaggccaggcacaguggcucaugc

SEQ ID NO: 47574 - RNA, 64 nt, Homo Sapiens
ccaaggugggcagaucaccucuguaaucccagcacuuugggaggccaggugcucuggcucaugc

SEQ ID NO: 47575 - RNA, 64 nt, Homo Sapiens
ccgaggcaagagcaucacgacuguaaucccagcacuuugggaggacaggugugguggcucacac

SEQ ID NO: 47576 - RNA, 64 nt, Homo Sapiens
ccaaggcaagcagaucaccucuguaaucccaguacuuugggaggccaggcacgguggcucacac

SEQ ID NO: 47577 - RNA, 64 nt, Homo Sapiens
cugaggcagguggaucaccucuguaaucccagcacuuugggaggccaggcgcgguggcucacac

SEQ ID NO: 47578 - RNA, 64 nt, Homo Sapiens
ccgaggcagguggauugcuucuguaaucccagcacuuugggaggcuggguggggugacucacgc

SEQ ID NO: 47579 - RNA, 64 nt, Homo Sapiens
cggaggcgggcagaucgcgacuguaauaccagcacuuugggaggccgggcgcgguggcucaugc

SEQ ID NO: 47580 - RNA, 64 nt, Homo Sapiens
ccaaggcaggaagauugcuuuuguaaucccacuacuuugggaggccagauguggugggucacac

SEQ ID NO: 47581 - RNA, 64 nt, Homo Sapiens
ugcuuccaugcaccucaguaagaaguggaucugccuuugggaccugcucagugaggaaaucucu

SEQ ID NO: 47582 - RNA, 64 nt, Homo Sapiens
ccggguauggugacucaugccuguaauccuagcacuuugggaggccgagguggguggaccaccu

SEQ ID NO: 47583 - RNA, 64 nt, Homo Sapiens
ccgaggugggcggaucacuucuguaaucccagcacuuugggagguugccuuugccccggcuugc

SEQ ID NO: 47584 - RNA, 64 nt, Homo Sapiens
guucauucaaaauguccagcuuaguuguuaucaucuuugggagaacuucacuuaaaaaaaugcc

SEQ ID NO: 47585 - RNA, 64 nt, Homo Sapiens
cugaggcgggcggaucaugacugcaaucccagcacuuugggagacugggugcuguggcucacgc

SEQ ID NO: 47586 - RNA, 64 nt, Homo Sapiens
ccaaggcagguagaucacaacuguaaucccagcucuuugggaggccaggugcggugguucgugc

SEQ ID NO: 47587 - RNA, 64 nt, Homo Sapiens
cgagagugacauccaguugcaccuuucucaccuacuuugggaccuuugggggugaguuccccuu

SEQ ID NO: 47588 - RNA, 64 nt, Homo Sapiens
cugggcauagugguucaugccuguaaucccagcacuuugggaggcugaggaggguggaucacuu

SEQ ID NO: 47589 - RNA, 64 nt, Homo Sapiens
gcugggcacagcgguuccgccuguaaucccagcacuuugggagguccaggcagguggaucucuu

SEQ ID NO: 47590 - RNA, 64 nt, Homo Sapiens
ccgggcgugguggcucaagccuguaaucccagcacuuugggaggccgaggugggcggaucacga

SEQ ID NO: 47591 - RNA, 64 nt, Homo Sapiens
ccaggcacagucgcucauacuuguaaucccagcacuuugggaggccgaggcggguggaucacaa

SEQ ID NO: 47592 - RNA, 64 nt, Homo Sapiens
cuaggcacaguggcucacacauggaaucccagcacuuugggaggccgaggugggaggaucacuu

SEQ ID NO: 47593 - RNA, 64 nt, Homo Sapiens
cucccacuucuugggaggguauuugccuucuccacuuugggagguccccccaaauggaaauugu

SEQ ID NO: 47594 - RNA, 64 nt, Homo Sapiens
ucugaggccucagagugcuucccuguuacuauuccuuugggaucagggcgccuggagaaagagg

SEQ ID NO: 47595 - RNA, 64 nt, Homo Sapiens
ccgaggcagguggaucaccucuguaaucccagcacuuugggaggccaggcaugguggcucacgc

SEQ ID NO: 47596 - RNA, 64 nt, Homo Sapiens
cugaggcaggaagauugagccuguaacccugggacuuugggaagcugggugcgguggugcacuc

SEQ ID NO: 47597 - RNA, 64 nt, Homo Sapiens
cugagguggguggauugcuucuauagucccagcacuuugggaggcuggaugcaguggcuuguuc

SEQ ID NO: 47598 - RNA, 64 nt, Homo Sapiens
ccgaggcgggcagaucacuucuauaaucccaguacuuugggaggcugggugcgguggcuccugc

SEQ ID NO: 47599 - RNA, 64 nt, Homo Sapiens
cugaggcgggcagaucacuucuguaacccuagcacuuugggaggcugggcgcgguggcucaugc

SEQ ID NO: 47600 - RNA, 64 nt, Homo Sapiens
ccaaggugggcggaucacuuccuauaauccuacacuuugggagggccgggugugguggcucauc

SEQ ID NO: 47601 - RNA, 64 nt, Homo Sapiens
ugggccaggcucacaccuguaauccuaaguaacacuuugggaggcuggggcgagaggauugcuu

SEQ ID NO: 47602 - RNA, 64 nt, Homo Sapiens
ccuggcagagugugucaugccugcaaucccagcacuuugggaggccaaggcaggcagaucaccu

SEQ ID NO: 47603 - RNA, 64 nt, Homo Sapiens
auacuuuugggcauaaaaauaaaacguaauguagcaguaucaauuuacugaacugaacuuucug

SEQ ID NO: 47604 - RNA, 64 nt, Homo Sapiens
uauauccacauucuuuaucauguuaccugggauccaguaucaaauuuuauuuguauucgaucug

SEQ ID NO: 47605 - RNA, 64 nt, Homo Sapiens
gaaaggacauucuuuaauuacugcccacucaacacauauuuaauaugugcccagauuauucuaa

SEQ ID NO: 47606 - RNA, 64 nt, Homo Sapiens
auaagucuauuccauuauuauauuuugcgcuuggcauauuuauuccuuuaugcuuuuaaucacu

SEQ ID NO: 47607 - RNA, 64 nt, Homo Sapiens
ccaauuauuuuauguaauccuauaguuuacaaagcauauuuacauuugcauuuguguaguacuu

SEQ ID NO: 47608 - RNA, 64 nt, Homo Sapiens
uugaaguggacuuugaaaguauucagcaguaugccauauuuaauuuuuuaaucuucauauaucu

SEQ ID NO: 47609 - RNA, 64 nt, Homo Sapiens
gggguaaguuagaguagggggagggauaggaagacauauuuaaaaaccauuaaaacacugucuc

SEQ ID NO: 47610 - RNA, 64 nt, Homo Sapiens
aaauacauagacauugucuuuuaugaauucugaucauauuuagucauuuugaccaaaugaggga

SEQ ID NO: 47611 - RNA, 64 nt, Homo Sapiens
auguaagcaacgcuacugguucaccccaaccuuccauauuuaucuguucaaaggagcaagaacu

SEQ ID NO: 47612 - RNA, 64 nt, Homo Sapiens
guauuuguugagcuccuauuugcccagagauggucauauuuaaacagaaguauacguuuuucag

SEQ ID NO: 47613 - RNA, 64 nt, Homo Sapiens
aacugaugguaacuguacauuuugugcuaaaaugcauauuuauauguguauaccauauguggag

SEQ ID NO: 47614 - RNA, 64 nt, Homo Sapiens
caccucacagaguuacuaaaaaaugucuguaaagcauauuuaccucuugggagauaggcacuau

SEQ ID NO: 47615 - RNA, 64 nt, Homo Sapiens
guuaaaaccaggcuuucuagaaagaauaaacuuacauauuuauuuuuaggacaugaaaauagca

SEQ ID NO: 47616 - RNA, 64 nt, Homo Sapiens
uugauacaaucauagcauugucuauuuuucucuucauauuuauaugggggggagggcgcuggau

SEQ ID NO: 47617 - RNA, 64 nt, Homo Sapiens
aacacagaggaauuuauaccucaaacuaucuggccauauuuacuaccuuaucacugcauuauuc

SEQ ID NO: 47618 - RNA, 64 nt, Homo Sapiens
auguaaagaaaugucuuaauuuuugaaaaaaguacauauuuauuuucuuuugaauuguuuuuau

SEQ ID NO: 47619 - RNA, 64 nt, Homo Sapiens
gcagaaaaaaaguuacauguucuguccuguuauacauauuuaagauugaaucagauuuaagggc

SEQ ID NO: 47620 - RNA, 64 nt, Homo Sapiens
aggggcuucuguuggcauuuacuuuuuugguugucauauuuacugcugagaaauguguaggggc

SEQ ID NO: 47621 - RNA, 64 nt, Homo Sapiens
gauaauagauaaauucauaaagagguucaccaaacauauuuagguuggagccaggcauugaugu

SEQ ID NO: 47622 - RNA, 64 nt, Homo Sapiens
uugaacugcucugcauuaauugguauugaaguaccauauuuaagucaaacaauguagcauaaag

SEQ ID NO: 47623 - RNA, 64 nt, Homo Sapiens
aaccagucaccaaauguaagacccauaagaaacccauauuuaaaaaucugaauuuuuuagaaga

SEQ ID NO: 47624 - RNA, 64 nt, Homo Sapiens
cacuguauuggagguuuuuuuuuaauuuacagaucauauuuauuuuacuauuuuuguagaaaau

SEQ ID NO: 47625 - RNA, 64 nt, Homo Sapiens
aacuggaaaaaauauauauuauguaucuauguaucauauuuaucacaugaccacuuuugauucc

SEQ ID NO: 47626 - RNA, 64 nt, Homo Sapiens
aagccucacaaauuauuuguaaaauuuaguaguucauauuuaguauaucaguaauauagaagac

SEQ ID NO: 47627 - RNA, 64 nt, Homo Sapiens
aguugcagauagccuauuuaguuuacuaaagagacauauuuaucuacugauauuucauuccuuu

SEQ ID NO: 47628 - RNA, 64 nt, Homo Sapiens
agcugaacuuacugcuuauauuauuguacacuaacauauuuagaguaauuaugaggugaaacaa

SEQ ID NO: 47629 - RNA, 64 nt, Homo Sapiens
caaguuucugccuaauuaaggagaagucuuuuaucauauuuauacugcuguccaaucuuuucua

SEQ ID NO: 47630 - RNA, 64 nt, Homo Sapiens
uccaaucuuuucuauauuuagaaauaauaauguacauauuuaucuaugguuuuauuuucuuaua

SEQ ID NO: 47631 - RNA, 64 nt, Homo Sapiens
gagguggauuuacugagagaaggugaaauaaagccauauuuaguauaccagagaagguagauuu

SEQ ID NO: 47632 - RNA, 64 nt, Homo Sapiens
uuuuuuucuguaacugugcuuguugaaugucaaucauauuuaaagggaaugacuuugaaguaaa

SEQ ID NO: 47633 - RNA, 64 nt, Homo Sapiens
guuuugucuucacuagcucauuuguuuaucaagucauauuuagggucccacacccucuuuuccu

SEQ ID NO: 47634 - RNA, 64 nt, Homo Sapiens
uguuuuugcaagauaaauggugacuuauaaugggcauauuuauuugccuguauuucauuucccc

SEQ ID NO: 47635 - RNA, 64 nt, Homo Sapiens
aguucugcuucugaaacuggaguaucauucuuuacauauuuauauguauguuuuaaguaguccu

SEQ ID NO: 47636 - RNA, 64 nt, Homo Sapiens
uacaauucuuuaaaauucacuaaugauugagguccauauuuagugguacucugaaauuggucac

SEQ ID NO: 47637 - RNA, 64 nt, Homo Sapiens
ugcuauaugcaugaagcuucuguuuauuguuuuccauauuuaaggaaacaacaucccauaauag

SEQ ID NO: 47638 - RNA, 64 nt, Homo Sapiens
auguauuuuuauuuuuguuuuguuuuuuacuuuucauauuuauauuagcauacaaggacaauug

SEQ ID NO: 47639 - RNA, 64 nt, Homo Sapiens
uauauaauacaaauggaaauuaaauguuguauuucauauuuauuaauacugauuuucuuaaacu

SEQ ID NO: 47640 - RNA, 64 nt, Homo Sapiens
uguauuuuuaaagauaaagacaacauagaguacacauauuuauaaaauuucacacaauaaaaaa

SEQ ID NO: 47641 - RNA, 64 nt, Homo Sapiens
aauuuuuguuucuccuuagguuagaaaaaauaaacauauuuaaucaguggcuacauuugacacu

SEQ ID NO: 47642 - RNA, 64 nt, Homo Sapiens
acucucacagcuuuguguuuguaaaucuaguguccauauuuaauaugaauuucuuguuggaaau

SEQ ID NO: 47643 - RNA, 64 nt, Homo Sapiens
uucguugaaguuuagaagauaagaaacaugucaucauauuuaaauguuccgguaaugugaugcc

SEQ ID NO: 47644 - RNA, 64 nt, Homo Sapiens
auacucaugauugcuaaguguuuuuuuauuuuugcauauuuauugaacugucuaauugaauaca

SEQ ID NO: 47645 - RNA, 64 nt, Homo Sapiens
aguuaacagaaugaaaaaaauuugccuucgaaugcauauuuaagacaguauagaaaccuccauu

SEQ ID NO: 47646 - RNA, 64 nt, Homo Sapiens
uaugcuguggaugaaaauaaaccaccuguguuugcauauuuauauugguaguaaagugauuuuu

SEQ ID NO: 47647 - RNA, 64 nt, Homo Sapiens
auaaaaccucuuauuuuauuuauguggcagguugcauauuuauguggacacauagguugcacug

SEQ ID NO: 47648 - RNA, 64 nt, Homo Sapiens
cuuaguucuuauuuuaaggcuaaaaaaacuuugucauauuuaagucggcagcuuucuaauuuaa

SEQ ID NO: 47649 - RNA, 64 nt, Homo Sapiens
auucuucuugcaguucugggaguaaagcucccagcauauuuagauaauagggcaggggaagcac

SEQ ID NO: 47650 - RNA, 64 nt, Homo Sapiens
guucuccagcacugagguggggcagauaacggggcauauuuaagggggcaucuuuguguaaaag

SEQ ID NO: 47651 - RNA, 64 nt, Homo Sapiens
cacguuccaauuuaauuccagacuuucacauuuucauauuuaggaguacauaacagaaaagugg

SEQ ID NO: 47652 - RNA, 64 nt, Homo Sapiens
ugaaauggggagauauuuaccaugcagacauacccauauuuaaagaguuuggaggccuuuuuaa

SEQ ID NO: 47653 - RNA, 64 nt, Homo Sapiens
ugauucaaaauauuuaaaaaugucuugcuguugacauauuuaauguuuuaaauguacagacaua

SEQ ID NO: 47654 - RNA, 64 nt, Homo Sapiens
gcuguugacauauuuaauguuuuaaauguacagacauauuuaacuggugcacuuuguaaauucc

SEQ ID NO: 47655 - RNA, 64 nt, Homo Sapiens
cuucggcauauuuuucaugaauuucaaugcauugcauauuuagcaaugugaauucuucccagaa

SEQ ID NO: 47656 - RNA, 64 nt, Homo Sapiens
uacuggaaagucauuauaauuuuagguguucuuacauauuuaaaaacuuuauuuuaaaaccaaa

SEQ ID NO: 47657 - RNA, 64 nt, Homo Sapiens
gccaucacaaaauuuugcccuuuuuaaguguuuucauauuuauaugcauucuuuguauucugau

SEQ ID NO: 47658 - RNA, 64 nt, Homo Sapiens
cauuauuuuaauauuauaagcuuaacuaaaggaccauauuuauuuuucacuuaagguggaggac

SEQ ID NO: 47659 - RNA, 64 nt, Homo Sapiens
acaugccuggauaaauaaaaauguaacaaacagccauauuuaagcaugucugcagaaucacugu

SEQ ID NO: 47660 - RNA, 64 nt, Homo Sapiens
uauuucacuguuaugucaacuuuuauccacauuacauauuuaugcuuuaauuguaaugacuuug

SEQ ID NO: 47661 - RNA, 64 nt, Homo Sapiens; identical to SEQ ID NO: 47659

SEQ ID NO: 47662 - RNA, 64 nt, Homo Sapiens
uauuucacugucaugucaacgccuuuucucauuacauauuuauguuuguuuuauccacaguuaa

SEQ ID NO: 47663 - RNA, 64 nt, Homo Sapiens
uucucacuuaaguuauuuauaaagaguuaaguuacauauuuauugaaugaaaguagugguuuuu

SEQ ID NO: 47664 - RNA, 64 nt, Homo Sapiens
gcugacaaacuccuggaagacuauuuauggcugacauauuuacggaaaaaaaaaaguaaagagu

SEQ ID NO: 47665 - RNA, 64 nt, Homo Sapiens
uuuagugccuagagauuuucgggagacccuaaaacauauuuagugugccuuugcaaccuauccu

SEQ ID NO: 47666 - RNA, 64 nt, Homo Sapiens
ggcugcccaauguagagucugcauuacaaagaaucauauuuaaaagagaaaaaaaggcuauuua

SEQ ID NO: 47667 - RNA, 64 nt, Homo Sapiens
acucuccuccuauacaaugugauguaaccuuugacauauuuagaugucaugcuugaauguuuua

SEQ ID NO: 47668 - RNA, 64 nt, Homo Sapiens
gaagguuuauaccuaaauguaugguugcuguugccauauuuacuugcuggggaauaugcuuuuu

SEQ ID NO: 47669 - RNA, 64 nt, Homo Sapiens
cuguacugaagaacugcaugcacugacuuaguggcauauuuauuggggaggcuguuggaguucu

SEQ ID NO: 47670 - RNA, 64 nt, Homo Sapiens
ccuuuuuaaaaaagcuaaucuagaauuacuuccacauauuuaucaauuauuuucagggauaugc

SEQ ID NO: 47671 - RNA, 64 nt, Homo Sapiens
uauuguuuuauaccuguaggauaugguacuuuaccauauuuauaauuguauguguuuauucuuc

SEQ ID NO: 47672 - RNA, 64 nt, Homo Sapiens
ggaaaaaagcaagcuuauaaauguuguauuugaucauauuuaaauccuuuuauuauuucucugu

SEQ ID NO: 47673 - RNA, 64 nt, Homo Sapiens
aauuuucagucauaaaagcuuuacuauuuauuuacauauuuauucauguucaugguacucuucu

SEQ ID NO: 47674 - RNA, 64 nt, Homo Sapiens
cuaaaucuuguauaugcaucuuuguugcuuauuacauauuuacacacacaaccacaaauuuuaa

SEQ ID NO: 47675 - RNA, 64 nt, Homo Sapiens
ccaagauuuuauaguucuugcucaaguuggcacauaaacccauuuucuguagugugcuaaaaug

SEQ ID NO: 47676 - RNA, 64 nt, Homo Sapiens
cuuugauccacuuaucuaugucucuuugccuuuuuaaacccaugccaguaaaucacuucuucuu

SEQ ID NO: 47677 - RNA, 64 nt, Homo Sapiens
auaaagucaaaaaauccuaagggcugcaucccuauaaacccaucgagcuccucagcuugaaaug

SEQ ID NO: 47678 - RNA, 64 nt, Homo Sapiens
auaaguuaaaaaugcauauaugguuaauucccaauaaacccaucaugguccucgauuuacauug

SEQ ID NO: 47679 - RNA, 64 nt, Homo Sapiens
ugugcuagcauggaagaaucaugggcuuuggaauuaaacccauuugguggaauuaaacccauuu

SEQ ID NO: 47680 - RNA, 64 nt, Homo Sapiens
caugggcuuuggaauuaaacccauuugguggaauuaaacccauuugguuucaaaucccaguuau

SEQ ID NO: 47681 - RNA, 64 nt, Homo Sapiens
auaaguugaaaauaugaucagguuugcauccugauaaacccaucaccccuccauuuaugugaug

SEQ ID NO: 47682 - RNA, 64 nt, Homo Sapiens
gaagaauuacucauuaaccaucuacucugaaccauaaacccagaggcugccugaggucuccuau

SEQ ID NO: 47683 - RNA, 64 nt, Homo Sapiens
cacuucucuugcccaggcuggaaagggauucuccuaaacccaccaauaaugcucugaauuuuuc

SEQ ID NO: 47684 - RNA, 64 nt, Homo Sapiens
uauguuuauuaaaaugugugagccucucugaaguuaaacccaacuuuaaaguaaacacaauuga

SEQ ID NO: 47685 - RNA, 64 nt, Homo Sapiens
cugaaaauauuuuuuaacucaguuucaauguacauaaacccaggucaucuaaacccauaaccau

SEQ ID NO: 47686 - RNA, 64 nt, Homo Sapiens
accauaguuucaauguacaugcaaggaaaucaucuaaacccauagauagaauauucauuuuaug

SEQ ID NO: 47687 - RNA, 64 nt, Homo Sapiens
cccccuuuaaggcauguugggauacauuggucuuuaaacccaaaaaaaaaaaaaaaaaaaaaaa

SEQ ID NO: 47688 - RNA, 64 nt, Homo Sapiens
ucuuagggcagcacagagcccgauuucauguuccuaaacccaugccugacagcucagcucugca

SEQ ID NO: 47689 - RNA, 64 nt, Homo Sapiens
gccuuaaucauuccaguuugauuuacguguauaccucauaaacauuuuucuuuuguuucucucu

SEQ ID NO: 47690 - RNA, 64 nt, Homo Sapiens
ugcaaacaugcaauugagaaacuggauagauacacucauaaaacccccaccccuccccacccca

SEQ ID NO: 47691 - RNA, 64 nt, Homo Sapiens
cucucuuuguuuuuaaaggauguauaauuauugccucauaaacugcucaaguaaauccucaaug

SEQ ID NO: 47692 - RNA, 64 nt, Homo Sapiens
uuagaauguacuauuuuaaaauacauaucuaugucucauaaaaauuccaucuaccuuuuuauaa

SEQ ID NO: 47693 - RNA, 64 nt, Homo Sapiens
caguauuuuaacucaaaauucagaaagauucaaacucauaaacuggcuuauuguguuaacacuu

SEQ ID NO: 47694 - RNA, 64 nt, Homo Sapiens
cucggguaguuuuucuuugguuaaucugcaaugucucauaaagaauuauugaaugguuuucauu

SEQ ID NO: 47695 - RNA, 64 nt, Homo Sapiens
gcaugccuaagauaaaauuguauauuuuuuccaucucauaaauauucauuuucuucaaagucuu

SEQ ID NO: 47696 - RNA, 64 nt, Homo Sapiens
uaaauauucauuuucuucaaagucuuuuuucaaucucauaaaaaagggauagugcaucuuuuaa

SEQ ID NO: 47697 - RNA, 64 nt, Homo Sapiens
uuaacugugcguuaaauaagcaaauaaacaguggcucauaaaaauaaaagucgcauuccauauc

SEQ ID NO: 47698 - RNA, 64 nt, Homo Sapiens
uuuggaugggccuuuuagaaaccucauuggccagcucauaaaauggaagcaauugcucauguug

SEQ ID NO: 47699 - RNA, 64 nt, Homo Sapiens
aaugccacugugugcauccauuuuaaaggguucccucauaaaaaaauguuauuccccauuauca

SEQ ID NO: 47700 - RNA, 64 nt, Homo Sapiens
aaccuguugaguuucuaaugaauauuuguagaaucucauaaaacaguuuaaauacaagcuuaag

SEQ ID NO: 47701 - RNA, 64 nt, Homo Sapiens
gcguggcccagauaagaauagguguuccuuugugcucauaaaacagaaugcggcgaugguugcu

SEQ ID NO: 47702 - RNA, 64 nt, Homo Sapiens
gggcugugcuacacuucccaguuacauucugaagcucauaaauguaugagaagguuugugauuu

SEQ ID NO: 47703 - RNA, 64 nt, Homo Sapiens
guucuaagaauuccauuugccucuaugaucuuagcucauaaaaauauaauaugacuugauaaag

SEQ ID NO: 47704 - RNA, 64 nt, Homo Sapiens
cugaaguuauaaguuuaaaacucaauuucagaugcucauaaaaguuacuuagcuaaaauuuuag

SEQ ID NO: 47705 - RNA, 64 nt, Homo Sapiens
ugcacugcccggccuucagaaagacagaauuucaucacccaaugcagggggagcucuuccugga

SEQ ID NO: 47706 - RNA, 64 nt, Homo Sapiens
gagcucuuccuggaccaagggaggagccgcucauucacccaacaaaacugugucuuaucugcca

SEQ ID NO: 47707 - RNA, 64 nt, Homo Sapiens
uugcaugccaaauuguaguucuugucugauuggcucacccaagcaaggccaaaauuaccaaaaa

SEQ ID NO: 47708 - RNA, 64 nt, Homo Sapiens
cucagcccugacuggugcuauaggcuggagaagcucacccaauaaacauuaagauugaggccug

SEQ ID NO: 47709 - RNA, 64 nt, Homo Sapiens
ccaaacucccuguacagaagccuuagaugucuuuucacccaacccaccccugggauagaaagac

SEQ ID NO: 47710 - RNA, 53 nt, Homo Sapiens
gccggccuuagugaccccaugggucacccaaccgaccucgggcccagcgcuga

SEQ ID NO: 47711 - RNA, 64 nt, Homo Sapiens
gccauaaugcagacuuucccauuccuucucuuuccacccgcaacuguggggcuaagaauucuua

SEQ ID NO: 47712 - RNA, 64 nt, Homo Sapiens
cgaccacuagaggucagcgucgcgccgcacucuucacccgcauguccagagggcggccgggaug

SEQ ID NO: 47713 - RNA, 51 nt, Homo Sapiens
ggccacccaaacauaaauaaccacccgcaguguccagaggcccucagaucg

SEQ ID NO: 47714 - RNA, 64 nt, Homo Sapiens
aaaggggaaacauucaaaggggggaguccccacacacccgcaccaggguccugcauaugcaccu

SEQ ID NO: 47715 - RNA, 64 nt, Homo Sapiens
gagucacuaacuggcguguuucugcccauuggagcacccgcacacuacuccaaaucaaaaccac

SEQ ID NO: 47716 - RNA, 64 nt, Homo Sapiens
guagagaggcccgcccgcccaccgugggcagugccacccgcagaugacacgcgcucuccaccac

SEQ ID NO: 47717 - RNA, 64 nt, Homo Sapiens
ugggccaagcucugggggcacgaaggcccuucuccacccgcaggaugcggggagaccgacggug

SEQ ID NO: 47718 - RNA, 64 nt, Homo Sapiens
ucucgcccagugcugcagccuguggcccuuaccucacccgcaguaauagaugagcaggucaggc

SEQ ID NO: 47719 - RNA, 64 nt, Homo Sapiens
gucccagagaugaugugggccuuggggcagagggcacccgcagaccugagucccuggcaguagc

SEQ ID NO: 47720 - RNA, 64 nt, Homo Sapiens
ugggggucgcugcccuucaccauguccuccccuccacccgcacagcuuugcagugagugcugcu

SEQ ID NO: 47721 - RNA, 64 nt, Homo Sapiens
accugcacuucucgcacaucacacccuuccugcacacccgcacucaccugcccagccauggcac

SEQ ID NO: 47722 - RNA, 64 nt, Homo Sapiens
aaauucacccagagggaaauaggagcuuugaggccacccgcacaggaggucucacgguguagag

SEQ ID NO: 47723 - RNA, 64 nt, Homo Sapiens
guugucauuggauugaauuuacuuuuuuguuucucacccgcaacuugagccaggacagcugguc

SEQ ID NO: 47724 - RNA, 59 nt, Homo Sapiens
gcaucaagcucugcccuugauuauccugccacccgcaggggccccucugucagcacuug

SEQ ID NO: 47725 - RNA, 64 nt, Homo Sapiens
aaaaugcaccauguccugaaagauggcacccucccacccgcagagugcuuccugcaagcuggcg

SEQ ID NO: 47726 - RNA, 64 nt, Homo Sapiens
cucuccgcggucccccacccucaccccggccccccacccgcagccggccacacuggagcagcuc

SEQ ID NO: 47727 - RNA, 64 nt, Homo Sapiens
cugcagccuccgucagcuauguaauguuugccaucacccgcacccuuacuggcucagcccuggc

SEQ ID NO: 47728 - RNA, 64 nt, Homo Sapiens
agcugggcccccucacgccuaucacuccagggagcacccgcaggggauggccgucaccucagac

SEQ ID NO: 47729 - RNA, 64 nt, Homo Sapiens
ucaucgugucuguccugagaggcuccacaaugcccacccgcaucgccauucuguagucuucagg

SEQ ID NO: 47730 - RNA, 64 nt, Homo Sapiens
gcugucucgagccaagcugugaaaacccuagacgcacccgcagggaggguggggagagcuggca

SEQ ID NO: 47731 - RNA, 64 nt, Homo Sapiens
ccccucacucggcggaaaccugggaugcccgcgccacccgcagcgcgguauacggugcggggcc

SEQ ID NO: 47732 - RNA, 64 nt, Homo Sapiens
cucugccacugucagggaccagccggccaacgcccacccgcaaaggugucuaaaaacuucagcu

SEQ ID NO: 47733 - RNA, 64 nt, Homo Sapiens
caucugagggcgccaggcaggcgggcgccaccgccacccgcagcgagggcggagccggccccag

SEQ ID NO: 47734 - RNA, 64 nt, Homo Sapiens
ucucccaaaaggcagaugacgccugccucggccucacccgcacugccccuaagcaaccggacuu

SEQ ID NO: 47735 - RNA, 64 nt, Homo Sapiens
cccugggccucgguuuccccgacuuugggcaagucacccgcacugagccuugccaccaucccag

SEQ ID NO: 47736 - RNA, 64 nt, Homo Sapiens
gcucgccgguccagagccauccggcgcccaucuccacccgcacgacgcccgcgccgcggaggag

SEQ ID NO: 47737 - RNA, 64 nt, Homo Sapiens
ccuguucccucccccaacccuaucccuccuaccucacccgcagggggaaggagggaggcugaca

SEQ ID NO: 47738 - RNA, 64 nt, Homo Sapiens
uggcuuccucuaaaucauuucaccuuucaguccccacccgcacccguccccuagagccauagua

SEQ ID NO: 47739 - RNA, 64 nt, Homo Sapiens
ccuuccuccucccaugggucgagaucagcccgaacacccgcaucggaccuaagccuaggcccca

SEQ ID NO: 47740 - RNA, 64 nt, Homo Sapiens
gucacugcauucccucccaguugauaccaccccucacccgcagaucucugucuugcugccggcc

SEQ ID NO: 47741 - RNA, 64 nt, Homo Sapiens
agaagggcaccacuuggaugagaucuggcauaugcacccgcaauuacacaaaggaccuuagaug

SEQ ID NO: 47742 - RNA, 64 nt, Homo Sapiens
ccuuaccgcucuguuuauaggaugucuccacuuucacccgcaggcccagccccuccaaaggucu

SEQ ID NO: 47743 - RNA, 64 nt, Homo Sapiens
ccucccaugcuccaagcagcacccuggugucuuccacccgcaggcggaccaugcaccaggcugc

SEQ ID NO: 47744 - RNA, 64 nt, Homo Sapiens
ugucagggguagucccacauacuaaagauugucucacccgcagugccaauaacacuccuaagaa

SEQ ID NO: 47745 - RNA, 64 nt, Homo Sapiens
agaauguuggaguggaaaugauuuuccagaaugacacccgcagcgcaaggaacagcaaggaauu

SEQ ID NO: 47746 - RNA, 64 nt, Homo Sapiens
cuccuggacaggcgcuguauccaugcguggcacucacccgcagugauuugccgcacuuggaccu

SEQ ID NO: 47747 - RNA, 64 nt, Homo Sapiens
cagccagcaccaccgcccccagccacucccagcacacccgcacacaguccccugcuaucccugc

SEQ ID NO: 47748 - RNA, 64 nt, Homo Sapiens
caaaccuggcccuuccccacuccucuagcaucgccacccgcauggcccuggaacucccgcggcg

SEQ ID NO: 47749 - RNA, 64 nt, Homo Sapiens
ggccucccaaagugcugggauugaccuugugacucacccgcaucgccaggauggucucgaucuc

SEQ ID NO: 47750 - RNA, 64 nt, Homo Sapiens
ccuaccagccuuguggccacgucugaaacccacccacccgcaagcgcucaaagcucagacucag

SEQ ID NO: 47751 - RNA, 64 nt, Homo Sapiens
ggccugacugcgaagcugugccuugccccucucccacccgcaguuucucaccccguucugcucc

SEQ ID NO: 47752 - RNA, 64 nt, Homo Sapiens
acgggaggauuccagaacagcagcacugagcucccacccgcagagccucuggacggccuuggca

SEQ ID NO: 47753 - RNA, 64 nt, Homo Sapiens
gccagagccgaggguccucccacacgugcucacccacccgcagccuaggcaggcucugcaugcu

SEQ ID NO: 47754 - RNA, 64 nt, Homo Sapiens
uggcccaggcgcgguugaccugccccugcuguaacacccgcaagaaggaugcaguccuuaccaa

SEQ ID NO: 47755 - RNA, 64 nt, Homo Sapiens
ccgcaguggcugugucagccucacccuucgugugcacccgcaugggagggucggagggugcugc

SEQ ID NO: 47756 - RNA, 64 nt, Homo Sapiens
uccucacccauccagccugagagagcccaggccccacccgcacccaaagccauggcccgccgcc

SEQ ID NO: 47757 - RNA, 64 nt, Homo Sapiens
uucccgagcaccgcgccccgcaccccccauugcccacccgcacugcaugucacgacagcuccgc

SEQ ID NO: 47758 - RNA, 64 nt, Homo Sapiens
ucucguccuuggauagauucagcucccacacacacacccgcacugcccaggucccuccucagac

SEQ ID NO: 47759 - RNA, 64 nt, Homo Sapiens
gcuacuccauccuugcaccccugggggcccagcccacccgcaugcacagagcaggggcuaggug

SEQ ID NO: 47760 - RNA, 64 nt, Homo Sapiens
gcggcaacaccagaaucuuccagaagcccagcuccacccgcacacgcagcuucccauccagucc

SEQ ID NO: 47761 - RNA, 64 nt, Homo Sapiens
cccuccuucccauccucugacuggccaagccccacacccgcagagaggccccuccuucugcugc

SEQ ID NO: 47762 - RNA, 64 nt, Homo Sapiens
ucaagccgccccuuguagaaucguauccaccuugcacccgcaagcugaaaucaacucucuucgg

SEQ ID NO: 47763 - RNA, 64 nt, Homo Sapiens
ggaagggacuugagcugggcaaguccuggccuggcacccgcagccgucucccuuccguggccca

SEQ ID NO: 47764 - RNA, 64 nt, Homo Sapiens
uggcgggcaccgcccuggccuuccgcacccucgucacccgcaucuccaacgaccucgagcucug

SEQ ID NO: 47765 - RNA, 64 nt, Homo Sapiens
gguccuccggugcagugggagggccggcuugcuccacccgcagccccgggguggcguagggaag

SEQ ID NO: 47766 - RNA, 64 nt, Homo Sapiens
cgcgccucacgaucccucaccuaguacccucucacacccgcaccaacucccugcaugcaaaccc

SEQ ID NO: 47767 - RNA, 64 nt, Homo Sapiens
aucacugugugauggucucaucauggcgccgccccacccgcauucuguauaaauaacgggauuu

SEQ ID NO: 47768 - RNA, 64 nt, Homo Sapiens
ucccauguuugcacuggcuggcuccuucucacugcacccgcauccucaacuccuggucuccucu

SEQ ID NO: 47769 - RNA, 64 nt, Homo Sapiens
acccccuccugggaagugcccccucaccucagggcacccgcaaccugggcuccucccugagcgc

SEQ ID NO: 47770 - RNA, 64 nt, Homo Sapiens
gccgggauccugagccuaggccucccgauguucccacccgcaugaucccuucccgccacacgau

SEQ ID NO: 47771 - RNA, 59 nt, Homo Sapiens
ccaaucacuacaagaaaugagcccaggcccacccgcagcuggccucacugucccgggug

SEQ ID NO: 47772 - RNA, 64 nt, Homo Sapiens
uccaccugcacaaacauagacagauguggacaugcacccgcauguacaaaaacacaaauacgga

SEQ ID NO: 47773 - RNA, 64 nt, Homo Sapiens
uuuaacagaacagacagauggcccggccaaaauaaugcaccacuuuacagacaugaacugccag

SEQ ID NO: 47774 - RNA, 64 nt, Homo Sapiens
uuuuuuuuuuuuuugacaggguuggccuuuaaaaaugcaccacuucuuuucuaaaugccaauga

SEQ ID NO: 47775 - RNA, 64 nt, Homo Sapiens
augcccagcuaauuuuuguacugggauuacaggcaugcaccaccuuccucagccucccaaguag

SEQ ID NO: 47776 - RNA, 64 nt, Homo Sapiens
augagauggugcugacacuuuuucuuuuaccgugaugcaccaguugguuuuguuucuaaaaugu

SEQ ID NO: 47777 - RNA, 64 nt, Homo Sapiens
uuguuuguuuuuuguuuuuuuucuugguaaagccaugcaccacagacuucugggcagagcugag

SEQ ID NO: 47778 - RNA, 64 nt, Homo Sapiens
uugcugagcaacgagauggugagcaucagugcaaaugcaccauucagcacaucagucauaugcc

SEQ ID NO: 47779 - RNA, 64 nt, Homo Sapiens
gcccgaucgccagcccgaggacuuaccauccacaaugcaccacggaagaggccguucuaugaaa

SEQ ID NO: 47780 - RNA, 64 nt, Homo Sapiens
cccuggcauuagcagcuucgaccucauuuuccagaugcaccagcuccuauuaauaaguuagcaa

SEQ ID NO: 47781 - RNA, 64 nt, Homo Sapiens
aggucaugucugcagcccccagaauguucuggacaugcaccaccagccgguggucccaaugucc

SEQ ID NO: 47782 - RNA, 64 nt, Homo Sapiens
uuuacaaaugcuuuauucucuucuuuaauaaaaaaugcaccaguauucuaaaagcaaaaauggc

SEQ ID NO: 47783 - RNA, 64 nt, Homo Sapiens
auacccagcuaauuucuguacugggauuacaggcaugcaccaccugccucagccucccuaguag

SEQ ID NO: 47784 - RNA, 64 nt, Homo Sapiens
acaccuggcuaauuuuguaucugggauugcaggcaugcaccaucugccucagccucccgaguag

SEQ ID NO: 47785 - RNA, 61 nt, Homo Sapiens
uuaauaugaaagauccucaugaauuaaauaguugaugcaauuuuuaacguuaauugauaua

SEQ ID NO: 47786 - RNA, 61 nt, Homo Sapiens
ugguggggagggaaggccuccugaauugaguuugaugcagagcuuuuuagccaugaagaau

SEQ ID NO: 47787 - RNA, 61 nt, Homo Sapiens
gucacuucuuuacuauuuaacuaccuucagcuugaugcauguagcucuugagcauuaguca

SEQ ID NO: 47788 - RNA, 61 nt, Homo Sapiens
acauuuaagaauucucuuuauauuaggaccauugaugcauuugguauucuguuuacagaug

SEQ ID NO: 47789 - RNA, 61 nt, Homo Sapiens
uuaaauauaacaggagacuuauaauuuaaauuugaugcaauaugccagucuuauaauuaac

SEQ ID NO: 47790 - RNA, 61 nt, Homo Sapiens
ggauguuuugaaaagaaaaagaaaguagcacuugaugcaaggagaaucuuaagagcuguua

SEQ ID NO: 47791 - RNA, 61 nt, Homo Sapiens
uuggguugggguucacucuuaccaagaaucuuugaugcagcuuuaagaugguggggaggau

SEQ ID NO: 47792 - RNA, 61 nt, Homo Sapiens
aagaaguagaaagucauugaacugacaguguuugaugcaacuaaaagaggauuguaagaca

SEQ ID NO: 47793 - RNA, 61 nt, Homo Sapiens
gcuuucaguauuuugccauuaagcauaguauuugaugcagguuuuuuuugauugaugcagg

SEQ ID NO: 47794 - RNA, 61 nt, Homo Sapiens
aagcauaguauuugaugcagguuuuuuuugauugaugcaggggaucaaauuuaggaaguuc

SEQ ID NO: 47795 - RNA, 61 nt, Homo Sapiens
augaaaaucugacuuugcccagcucuuuuccuugaugcaguuucccgguguggaaggaacc

SEQ ID NO: 47796 - RNA, 61 nt, Homo Sapiens
ucagauucaucuccacugauaaccgguuuccuugaugcagacauaguuuagcuuucuuuga

SEQ ID NO: 47797 - RNA, 61 nt, Homo Sapiens
uuuuggucaagcuugaggcugaauaaagccuuugaugcacaaaaugggacugcugaagagu

SEQ ID NO: 47798 - RNA, 61 nt, Homo Sapiens
guguaaaguuaaucagaaagaaaaaauuuuauugaugcagugugucuuuauaaagcuguuc

SEQ ID NO: 47799 - RNA, 61 nt, Homo Sapiens
agaaaaugagugaauauucuucucacuuuuauugaugcauucagagaauaagcaaugaaau

SEQ ID NO: 47800 - RNA, 61 nt, Homo Sapiens
uuaauauuucuauugcaaaagucuauccgauuugaugcacuuugaauauugagauauuuug

SEQ ID NO: 47801 - RNA, 61 nt, Homo Sapiens
uccuuuuguaauaagaaagaagagagagaacuugaugcaaaguccacgaaaaaacaauuuu

SEQ ID NO: 47802 - RNA, 61 nt, Homo Sapiens
ccagagauaccuguuuugaugaguaccuauuuugaugcaaaggaacggcccugggaccuca

SEQ ID NO: 47803 - RNA, 61 nt, Homo Sapiens
acgaccggagugcuggcucucacagugaauuuugaugcauuuaaaauaagauucugaugcc

SEQ ID NO: 47804 - RNA, 61 nt, Homo Sapiens
gcgcugguucugaagcaccgauggaaacagauugaugcagauggaaggaggaagggagacu

SEQ ID NO: 47805 - RNA, 61 nt, Homo Sapiens
cucguagugguaacucauccagaacugauacuugaugcacaucugggaagcagauaagcau

SEQ ID NO: 47806 - RNA, 61 nt, Homo Sapiens
ugauguucacacagugagaguguaggcauaauugaugcacauccaccauaaugcaguuacc

SEQ ID NO: 47807 - RNA, 64 nt, Homo Sapiens
uaggcaugcaccaaggaauucuuagagguugguggggaagaaaacgggccuugcucuuguggag

SEQ ID NO: 47808 - RNA, 64 nt, Homo Sapiens
cuucuucccauccuguucagacugcuggugaccugggaagaaacgaugggagccaagcuugagg

SEQ ID NO: 47809 - RNA, 64 nt, Homo Sapiens
aucuccaaaaugacuccccaaacuugauccuucagggaagaaucagucuugguuugacaagggg

SEQ ID NO: 47810 - RNA, 64 nt, Homo Sapiens
cagaaccccaccuggccugccccaagaaagauaggggaagaagcgccagagucuuauaacaccu

SEQ ID NO: 47811 - RNA, 64 nt, Homo Sapiens
ucaaaacccaccaugccccagggaagaaaagaaggggaagaagaucaaagaagaaaagaagaag

SEQ ID NO: 47812 - RNA, 64 nt, Homo Sapiens
gaaggggaagaagaucaaaaaagaaaagaagaaggggaagaaaagaaggggaagaagaucaaag

SEQ ID NO: 47813 - RNA, 64 nt, Homo Sapiens
ucaaagaagaaaagaagaaggggaagaaaagaaggggaagaagaaaauugaaaagaaggggaag

SEQ ID NO: 47814 - RNA, 64 nt, Homo Sapiens
gaaggggaagaagaucaaagaaaagaaggggaaggggaagaaaaugaauuuauugcagaaauug

SEQ ID NO: 47815 - RNA, 64 nt, Homo Sapiens
aauuagacacucugccugccggaagaaggaaggugggaagaaggaaagugagacuuggguggug

SEQ ID NO: 47816 - RNA, 64 nt, Homo Sapiens
aaggugggaagaaggaauuagagacuuggguggugggaagaagguuucuuuuaauaaguaaagu

SEQ ID NO: 47817 - RNA, 64 nt, Homo Sapiens
agugguuuaauuggacuuaaacauacccgagacugggaagaaaauuuucacgcugcugauaaag

SEQ ID NO: 47818 - RNA, 64 nt, Homo Sapiens
agagguuuacuuggacuuacacguacccgagacugggaagaaaauauuaaugcugcugauaaag

SEQ ID NO: 47819 - RNA, 64 nt, Homo Sapiens
uggagauuuaauccuaaaacucagauucaacagggggaagaaaagaugaggauaaaagaaaguu

SEQ ID NO: 47820 - RNA, 64 nt, Homo Sapiens
aucuucauaaaaaacuuucauagaccgaagccaggggaagaagcccagaggagcaagggugccu

SEQ ID NO: 47821 - RNA, 64 nt, Homo Sapiens
agaaccauuugcugccgcauagugccauuggauagggaagaacuucagaaaucugugguacucu

SEQ ID NO: 47822 - RNA, 64 nt, Homo Sapiens
gagcccuaacuuucaggcuuugcauuuuguauaugggaagaaauaugacaauccuagguaauua

SEQ ID NO: 47823 - RNA, 64 nt, Homo Sapiens
cagggacagggaccaggauagaggaggagcccuagggaagaaguccucugagugagaugcccag

SEQ ID NO: 47824 - RNA, 64 nt, Homo Sapiens
aaucgggcucacgaaugccauuccccuaagguuagggaagaaagucccuccguucugcuucagc

SEQ ID NO: 47825 - RNA, 64 nt, Homo Sapiens
cuaauugauuccuugugaccuaauucuagagaaugggaagaaggccuguuauuuuguuguccuu

SEQ ID NO: 47826 - RNA, 64 nt, Homo Sapiens
uguaggaaggccucaaggauguaauucuagcccagggaagaaaauccuuuucagcagacgcuuc

SEQ ID NO: 47827 - RNA, 64 nt, Homo Sapiens
agguuugaauugcuuuuuuaggaggaggaagaaagggaagaauuagaagcaggcggguugggug

SEQ ID NO: 47828 - RNA, 64 nt, Homo Sapiens
agguuugaauugcuuuuuaaggaggaggaagaaagggaagaauuagaagcaggcggguugggug

SEQ ID NO: 47829 - RNA, 64 nt, Homo Sapiens
acaccuguuacccauuaggggugauaacauuaaugggaagaaaugauggcaacuuugaaugcua

SEQ ID NO: 47830 - RNA, 64 nt, Homo Sapiens
gccaucucugggauuugaaauauccagacuuguagggaagaaaacaaugacuugacgaccuuaa

SEQ ID NO: 47831 - RNA, 64 nt, Homo Sapiens
gauggagagaauaggaaucuucacuagaagccgugggaagaauuggaaguuacaugcuguauau

SEQ ID NO: 47832 - RNA, 64 nt, Homo Sapiens
uuuugguagagaaggagcagaaagauguguuuuugggaagaagaagaccucuaggaggagcuag

SEQ ID NO: 47833 - RNA, 64 nt, Homo Sapiens
auugugcucagagacacuguugaucggccaucaagggaagaacucuuggcacuuauugaauaua

SEQ ID NO: 47834 - RNA, 64 nt, Homo Sapiens
gcuaucaggagaaagcuugggaagugcgggguaggggaagaagacauuugggguaauacuucca

SEQ ID NO: 47835 - RNA, 64 nt, Homo Sapiens
uuauuaaaaauugagucuuaaauuuaaaugggaagggaagaaaacaccaaauaagaaaaaaauu

SEQ ID NO: 47836 - RNA, 64 nt, Homo Sapiens
aaggacagcauuuaaauauuugugcuggagugaggggaagaagcuguuacagaaguggaauggu

SEQ ID NO: 47837 - RNA, 64 nt, Homo Sapiens
gggaugugccucaguugggagcaaggagaaaaaugggaagaaccaguuuuauccaucuuaaaac

SEQ ID NO: 47838 - RNA, 64 nt, Homo Sapiens
gccaggcaccucuucacaggugguaaacauuuaggggaagaaagcagcccagggugccaugccu

SEQ ID NO: 47839 - RNA, 64 nt, Homo Sapiens
ucccagccaucuuccgaagauucuacguaauggagggaagaauuaacugaggaggggaagaaag

SEQ ID NO: 47840 - RNA, 64 nt, Homo Sapiens
uucuacguaauggagggaagccucaacugaggaggggaagaaagcguugugggacaucuaggca

SEQ ID NO: 47841 - RNA, 64 nt, Homo Sapiens
aaauuccacaacugccuuuaacaaucagagcacugggaagaaauugagcuuuauucaaauuuug

SEQ ID NO: 47842 - RNA, 64 nt, Homo Sapiens
aaaaaaaauuaaaaggguagacuguaaaguuagggggaagaaagcuuggucucgcugucgguua

SEQ ID NO: 47843 - RNA, 64 nt, Homo Sapiens
acugcucauuguaacuuucaaaaccccgucuuuggggaagaaucaucuagggugacauuccuug

SEQ ID NO: 47844 - RNA, 64 nt, Homo Sapiens
caggauuccugccagguccccgauguguauccaggggaagaauugguggccugagccgaugggg

SEQ ID NO: 47845 - RNA, 64 nt, Homo Sapiens
ggaaagcuuguaauagcaaaauuguaaauuacaagggaagaaucuacuuuuuagaaaucgcuuu

SEQ ID NO: 47846 - RNA, 64 nt, Homo Sapiens
uuuauuucucugucauuuggauggcuggucaauggggaagaauugagugggugauuuaaucaac

SEQ ID NO: 47847 - RNA, 64 nt, Homo Sapiens
aggaaugcuggacuggaggcccccacccaaucaagggaagaaggccuggcugcccaucaugugg

SEQ ID NO: 47848 - RNA, 64 nt, Homo Sapiens
ucaacgccucacugaaacauagguugggacaccagggaagaagaggcuguaacguggcacuggu

SEQ ID NO: 47849 - RNA, 64 nt, Homo Sapiens
uucacaccauaacuagguaacaguuugauaacuagggaagaaagcagaacaguuaagcagccgc

SEQ ID NO: 47850 - RNA, 64 nt, Homo Sapiens
ucaaaaucuguagagcagggcaaguaacauggaagggaagaaaaggugaaaaauuagaaauguu

SEQ ID NO: 47851 - RNA, 55 nt, Homo Sapiens
caaaggaccggagaaagugagccuggggaagaaggggguuugaagcccaccaaga

SEQ ID NO: 47852 - RNA, 64 nt, Homo Sapiens
ggaacccccccccccccgaaaaaaaaaucaaagcgggaagaaaaucagagggaagguuaagguu

SEQ ID NO: 47853 - RNA, 64 nt, Homo Sapiens
gccugugugcagggaaagagguuagaggccuuuagggaagaaaauggucccuaucuuccagcag

SEQ ID NO: 47854 - RNA, 64 nt, Homo Sapiens
cuguaggggagcaugguuuucuucuguaacuguagggaagaaagcuuacgaggauuucuggaag

SEQ ID NO: 47855 - RNA, 64 nt, Homo Sapiens
agcuccagccaguucugcugaagauguccuuccugggaagaagaagucacgcuggcauaucagg

SEQ ID NO: 47856 - RNA, 64 nt, Homo Sapiens
agcaccagccacaggggcagagauguccuuccuggggaagaagagucacagugacaccucagga

SEQ ID NO: 47857 - RNA, 64 nt, Homo Sapiens
uguuucucacugcuaacguugguguuucuggcgugggaagaaaugcacaggcgugcauggcaug

SEQ ID NO: 47858 - RNA, 64 nt, Homo Sapiens
ugcauuguaagaguucugucaugcagucugaaaagggaagaaacaggauggcuuucuguagcca

SEQ ID NO: 47859 - RNA, 64 nt, Homo Sapiens
ccaggucccucugagcagcccugguaacaagggugggaagaagggacagcuguucuccggcccc

SEQ ID NO: 47860 - RNA, 64 nt, Homo Sapiens
caaagaggccacaaagaagaaaaagaaacaguuugggaagaaaaguaagugcugcaccggugca

SEQ ID NO: 47861 - RNA, 64 nt, Homo Sapiens
gaaagcaaaggaacagaaggggcagaaggaaggagggaagaaaagggagaagaaggaagggaag

SEQ ID NO: 47862 - RNA, 64 nt, Homo Sapiens
cagagaaaagcaaggagagaucaccuggccuccagggaagaauguuuccugucaguuggacccc

SEQ ID NO: 47863 - RNA, 64 nt, Homo Sapiens
gccagcuccggccagccugggacagcucaucccagccgacuacaccugcuucugguccugucca

SEQ ID NO: 47864 - RNA, 64 nt, Homo Sapiens
cucaaccacgccgccaguccauucuuaaggaacugccgacuaggacugaugaugcauuuuagcu

SEQ ID NO: 47865 - RNA, 64 nt, Homo Sapiens
accugccaguggacuggccaucccucuccugucugccgacuauggagucuccaccuuuggacac

SEQ ID NO: 47866 - RNA, 64 nt, Homo Sapiens
uuuagcaguaucuguuuacaugcgcaaggaucaagccgacuaccugugcugucuacugggacag

SEQ ID NO: 47867 - RNA, 64 nt, Homo Sapiens
uggccccggccuaagaccugccuaggacucuguggccgacuauaggcgucucccauccccuaca

SEQ ID NO: 47868 - RNA, 62 nt, Homo Sapiens
cucucaccucacccacuagaccuugugccggagccgacuacuggagaugacagugaugcugc

SEQ ID NO: 47869 - RNA, 64 nt, Homo Sapiens
ugaaaccccaucucuacuaaaaguacaaauauuagccgacuauguggcgggcaccuguaauccc

SEQ ID NO: 47870 - RNA, 64 nt, Homo Sapiens
acgguguggauucagcucccccuccacacccucugccgacuacccccaaauguucccagagggu

SEQ ID NO: 47871 - RNA, 64 nt, Homo Sapiens
uggccaccacaagcugcagucccucugacgacuugccgacuaacuagcuccugccaaaucgaga

SEQ ID NO: 47872 - RNA, 64 nt, Homo Sapiens
gcuacugaagaagugacuuccguugcauaccaaagccgacuacacugaacaguaccuuccuuuc

SEQ ID NO: 47873 - RNA, 64 nt, Homo Sapiens
ugcuagcugcuaugggaaauaauagucacggaaugccgacuagguguaucuugcauucacacuc

SEQ ID NO: 47874 - RNA, 64 nt, Homo Sapiens
uuuacucugcugcaaaaugaaggcgggccugcaagccgacuacaccuacggaggcuguugagga

SEQ ID NO: 47875 - RNA, 64 nt, Homo Sapiens
gccccucaacccugucacuaccaccuugagucaagccgacuaaguacaaaaggccacagugagg

SEQ ID NO: 47876 - RNA, 64 nt, Homo Sapiens
auauggaauuuugcaaagauuuaaucugccaagggccgacuaagagaaguuguaaaguauguau

SEQ ID NO: 47877 - RNA, 64 nt, Homo Sapiens
ccgccaccacacccggcuaauuuuuuguguuuuuacaaaauacaaaaaaguagagacaggauuu

SEQ ID NO: 47878 - RNA, 64 nt, Homo Sapiens
ucauggugcagagguaggcauucugagcaggggaacaaaauaagggccuagaaacucacccgug

SEQ ID NO: 47879 - RNA, 64 nt, Homo Sapiens
uaaguaauauauuuuuguugcaaguaccagaauuacaaaauaucuuuucuauuugucuuuauuu

SEQ ID NO: 47880 - RNA, 64 nt, Homo Sapiens
uaaaaacuaaucccgauuugaaccgugugaaacaacaaaauaucauaaauauguuuuaauugcc

SEQ ID NO: 47881 - RNA, 64 nt, Homo Sapiens
cuucugguuuugggaguucauaagagagaauagaacaaaauacaggacaucaaauauuagccau

SEQ ID NO: 47882 - RNA, 64 nt, Homo Sapiens
auggaauuuuuaaguagguaaauaaaugguuaagacaaaauaguguuauagccuucauucucug

SEQ ID NO: 47883 - RNA, 64 nt, Homo Sapiens
aauuuuuaaaaaacauuuaaaucuucuguuauuuacaaaauaauaccuuacuuuuuggaaacaa

SEQ ID NO: 47884 - RNA, 64 nt, Homo Sapiens
cuauaugguacuugaucuacaacuuuauucuagaacaaaauaguauauguuccuuuuucaaaga

SEQ ID NO: 47885 - RNA, 64 nt, Homo Sapiens
gcaagcuaucugcaccucaauugagauaguaacaacaaaauaaaguuauaauuguuggaccucc

SEQ ID NO: 47886 - RNA, 64 nt, Homo Sapiens
gcuguuguuaaauuuuaaacaguaaagaacaacaacaaaauaaaagcaaugagccacagcaaaa

SEQ ID NO: 47887 - RNA, 64 nt, Homo Sapiens
uggggaccacgcgaaaaccuccaagauauuuuucacaaaauagaaacucauauggaacaaaaua

SEQ ID NO: 47888 - RNA, 64 nt, Homo Sapiens
aagauauuuuucacaaaauagaaacucauauggaacaaaauaagaaaccccagccaugaaaucu

SEQ ID NO: 47889 - RNA, 64 nt, Homo Sapiens
aauguuuugagucagugcauuucaaggaacagccacaaaauacacaccccuaagaaaaggcaag

SEQ ID NO: 47890 - RNA, 64 nt, Homo Sapiens
augaaaucaaguuccaguaacccaaaucuuguuuacaaaauauucgugguaucugugaacaugu

SEQ ID NO: 47891 - RNA, 64 nt, Homo Sapiens
agcucacauggauauauuuaagugagcaugucaaacaaaauaggggcagaacugaugugaggua

SEQ ID NO: 47892 - RNA, 64 nt, Homo Sapiens
cuuacuuggucaguugccucaggggaaaaauguuacaaaauaucauucuuuucugcuuuuccag

SEQ ID NO: 47893 - RNA, 64 nt, Homo Sapiens
ccugaauucaccacagcuggaauagcuguggaaaacaaaauaaaacaacaaaauuaauaaugaa

SEQ ID NO: 47894 - RNA, 64 nt, Homo Sapiens
cuaguaaugcaaacaaauuauuuuuuacaaaaaaacaaaauaaauaaaauuagacuuccuuccc

SEQ ID NO: 47895 - RNA, 64 nt, Homo Sapiens
gucuauauauuuaugauaaaucuuuuccauuuguacaaaauaaaauuccauuucauugugaccu

SEQ ID NO: 47896 - RNA, 64 nt, Homo Sapiens
aaccuauauuuauguaacuguauacugaauucugacaaaauaaaaaaagauaccuuauugacga

SEQ ID NO: 47897 - RNA, 64 nt, Homo Sapiens
uuuugugugauaauuuugaugcauugugaaaaaaacaaaauaaauacuuauuugucuucuuuuu

SEQ ID NO: 47898 - RNA, 64 nt, Homo Sapiens
auuuauuaaauguaguucaggaaaacacuguauuacaaaauauuaaauauuuuuauaaaaacca

SEQ ID NO: 47899 - RNA, 64 nt, Homo Sapiens
guuuauagguaaagccaaugugugcuuagcauuaacaaaauaagcuaugagcccauaaggguuc

SEQ ID NO: 47900 - RNA, 64 nt, Homo Sapiens
cugcaaauuuaaauguggcggauugagcagcuagacaaaauaaucuuugagugguauuucucuu

SEQ ID NO: 47901 - RNA, 64 nt, Homo Sapiens
aguguggauuuugcauacauucaaaacauuaaccacaaaauacagcaagugcaccuauauucac

SEQ ID NO: 47902 - RNA, 64 nt, Homo Sapiens
uuuaaaauauguguauaagucugucaugugcuaaacaaaauaauaugaaagaccuaguuaaaaa

SEQ ID NO: 47903 - RNA, 64 nt, Homo Sapiens
uggguuuuaaaaauccuuuuuuacagugguauccacaaaauacuucucugcuuauaaauguuau

SEQ ID NO: 47904 - RNA, 64 nt, Homo Sapiens
ugcuguugcgcugcuuuauuuaaugcacuguggaacaaaauauaaggguacuguugggguguga

SEQ ID NO: 47905 - RNA, 64 nt, Homo Sapiens
agccagccaucguggugcguucucuacaaaauauacaaaauauuggcaacauggggaaacucca

SEQ ID NO: 47906 - RNA, 64 nt, Homo Sapiens
caaaauauuagccagccaucgaaacuccaucucuacaaaauauaaccagccugggcaacauggg

SEQ ID NO: 47907 - RNA, 64 nt, Homo Sapiens
aaaagacaggaaaauaagucaacaaaauaaguagacaaaauaacugugauagaagauuauucag

SEQ ID NO: 47908 - RNA, 64 nt, Homo Sapiens
uagacaaaauaacaaaagacgaagauuauucagaacaaaauaagauagaaggggaaaugugaua

SEQ ID NO: 47909 - RNA, 64 nt, Homo Sapiens
uucuggguuaaaaccccagcuuugauucuuccuaacaaaauauucuagauguauaaaucuuucu

SEQ ID NO: 47910 - RNA, 64 nt, Homo Sapiens
uguugggagaaaugauauaucuccuuucucagccacaaaauaaaugaaaguuuucuauaccugu

SEQ ID NO: 47911 - RNA, 64 nt, Homo Sapiens
uucuuguuuuauuaacucuguucauuuuuauucuacaaaauaugucaugcauucuuucuuauga

SEQ ID NO: 47912 - RNA, 64 nt, Homo Sapiens
uuugcacuccagaaaacaacauacauguuuaaauacaaaauaauuaugggccaugacgacgauu

SEQ ID NO: 47913 - RNA, 64 nt, Homo Sapiens
gguaccgucuacauuucacauuauucugggcaccacaaaauauacaaaacuuuaucagggaaac

SEQ ID NO: 47914 - RNA, 64 nt, Homo Sapiens
uuuaguaaguuaauguauauaaaaauggcuucggacaaaauaucucugaguucuguguauuuuc

SEQ ID NO: 47915 - RNA, 64 nt, Homo Sapiens
cuauucaguucguucauucaaaauggcauuuuguacaaaauaguacuagucauuuuaguguuau

SEQ ID NO: 47916 - RNA, 64 nt, Homo Sapiens
auugagggcauguugcauauacauuucccccaaaacaaaauaaaaaagcucuagguucuucagc

SEQ ID NO: 47917 - RNA, 64 nt, Homo Sapiens
auaaaagguuccaauaggaauuccuuaagcaucaacaaaauagggaguuaugggcaaagcuuuu

SEQ ID NO: 47918 - RNA, 64 nt, Homo Sapiens
ggguuguucaauauugucuuccuucucaauccucacaaaauagggucucaagccucuauucacc

SEQ ID NO: 47919 - RNA, 64 nt, Homo Sapiens
uucccguacaauauggggcucuugugcacaugauacaaaauaugcagcuuuagcuguucuuuau

SEQ ID NO: 47920 - RNA, 64 nt, Homo Sapiens
ccucuaaauuaguucccuaggcaacccccuaaccacaaaauaucaacaacuuugcaggaauaaa

SEQ ID NO: 47921 - RNA, 64 nt, Homo Sapiens
guucacuacuguguaaaguaaaaacuaaaaaaauacaaaauacaaaacacacacacacacacac

SEQ ID NO: 47922 - RNA, 64 nt, Homo Sapiens
acacacacacacacacacacacacacacacacacacaaaauaaauccgggugugccugaaccuc

SEQ ID NO: 47923 - RNA, 64 nt, Homo Sapiens
uaaugaaaauaucuuccucucuuccccauucuauacaaaauacuaagugguuuucuugcuccca

SEQ ID NO: 47924 - RNA, 64 nt, Homo Sapiens
ucuagauaugcaaaugauuuucuuagaaaacuucacaaaauaaaagaucuuguuuuuuuuucca

SEQ ID NO: 47925 - RNA, 64 nt, Homo Sapiens
ucacuaauaaauucugaguaaauuaguggugaagacaaaauauaacuuguuuuagugagccacu

SEQ ID NO: 47926 - RNA, 64 nt, Homo Sapiens
uuuuuacuggauuaaaaauguucaaaaaggaaaaacaaaauagucucucaagcuauaguuuguu

SEQ ID NO: 47927 - RNA, 64 nt, Homo Sapiens
auggccugggcagaguugguaaagaaaugucuguacaaaauaagaguuguguaauggugaugcu

SEQ ID NO: 47928 - RNA, 64 nt, Homo Sapiens
ugucacgcaacuuauuuuuuuuaauguuaacaagacaaaauaaauaaaaauguuucuacagaua

SEQ ID NO: 47929 - RNA, 64 nt, Homo Sapiens
gccguuguuccuucuguacucauaccuacaucagacaaaauauccucaccaaaagauccagccu

SEQ ID NO: 47930 - RNA, 64 nt, Homo Sapiens
aauuuuuuuuucuuuuuaauauuuucuucuggucacaaaauaaagaaauuugggaugcaaagua

SEQ ID NO: 47931 - RNA, 63 nt, Homo Sapiens
cauuucucauuguuggaaucugaauaaaccaauuacaaaauaacauaugugcacauuguaagu

SEQ ID NO: 47932 - RNA, 64 nt, Homo Sapiens
auauauauauauugcuuauccguauaccuuauuaacaaaauagagcauuuuugagaaagcaaau

SEQ ID NO: 47933 - RNA, 64 nt, Homo Sapiens
gggauuacuggugugagccacccaccucugccuuacaaaauacaucuugggcccaagugauacu

SEQ ID NO: 47934 - RNA, 64 nt, Homo Sapiens
caacucuggauucugugaauugaaacuaacccauacaaaauauccaaagaagacaaaauagcau

SEQ ID NO: 47935 - RNA, 64 nt, Homo Sapiens
auugaaacuaacccauacaagaccgacaaagaagacaaaauagcggugaguccuauugcaauau

SEQ ID NO: 47936 - RNA, 64 nt, Homo Sapiens
uggcccaaagaauaggaacuuagcuagcauguauacaaaauauauuugagguuacuaaaugaau

SEQ ID NO: 47937 - RNA, 64 nt, Homo Sapiens
aaauguugcuuguuauuugguagagauuaggcucacaaaauauuucuccauuuccagugauuug

SEQ ID NO: 47938 - RNA, 64 nt, Homo Sapiens
uauaauuguuaacguguauuuagaguauacauguacaaaauacauuaauauagcccaauaaacc

SEQ ID NO: 47939 - RNA, 64 nt, Homo Sapiens
aaaauauuguuuuaugaguuaauuuuucacuaauacaaaauaaauaaaaguuuaguuaguauua

SEQ ID NO: 47940 - RNA, 64 nt, Homo Sapiens
cauacaguguuuuacauucucuccuuuauagguaacaaaauaauguuuagcucaguaaguacug

SEQ ID NO: 47941 - RNA, 64 nt, Homo Sapiens
acaugcuuaaugauggaaaugaaauguuaaaucaacaaaauaagauccaguguuucauaacauu

SEQ ID NO: 47942 - RNA, 64 nt, Homo Sapiens
ugguaaagaauacugagacaaugaaaaaaaaucaacaaaauaugcuuucuggagaacuguaccu

SEQ ID NO: 47943 - RNA, 64 nt, Homo Sapiens
uucuaauuaaagaauuccuaaauacuuugaaaauacaaaauauuccugaauaguugugccuuac

SEQ ID NO: 47944 - RNA, 64 nt, Homo Sapiens
acuaauuuuuaagaguaacucaaaagugaaacauacaaaauaagacaguuuuuacccuaaagug

SEQ ID NO: 47945 - RNA, 64 nt, Homo Sapiens
gcuaagauacugaugacaguauuucaggguccaaacaaaauagaaaugaugaauuuaucagcgu

SEQ ID NO: 47946 - RNA, 64 nt, Homo Sapiens
cauauaaaagugauggaauuuaucuucaagcagcacaaaauauguuuauuuacaugcugucugu

SEQ ID NO: 47947 - RNA, 64 nt, Homo Sapiens
aauuucaaauguaaauauugccucaagccaucucacaaaauaagaaaaccuguaugccgauuuu

SEQ ID NO: 47948 - RNA, 64 nt, Homo Sapiens
ucaaaauggacagucauuuuugaauggcaccaaaacaaaauaagcuaaggcuuuuaauacauuu

SEQ ID NO: 47949 - RNA, 64 nt, Homo Sapiens
aauuaaaacugauuuauuuauguugguacauccaacaaaauaguuggagccacaaggcccuugu

SEQ ID NO: 47950 - RNA, 64 nt, Homo Sapiens
guuggagccacaaggcccuugucuuuuuaaaaaaacaaaauauuuugaagauggugaaagugac

SEQ ID NO: 47951 - RNA, 64 nt, Homo Sapiens
acacaaagagaccacccugucugauagauaacuaacaaaauaguuuuaguugggcaaaauuaaa

SEQ ID NO: 47952 - RNA, 64 nt, Homo Sapiens
aaauuuuuaaaaagacuguuuuuaaaaaggugcuacaaaauaaagugcuaucuuuuucuguuuc

SEQ ID NO: 47953 - RNA, 64 nt, Homo Sapiens
auauuaacaucuugaugagacagauuuccaggcaacaaaauaauuucuaaaauggauauaugug

SEQ ID NO: 47954 - RNA, 64 nt, Homo Sapiens
ucaugguggcuguugcaugauaaugauaggauaaacaaaauaccacugucuucaagaaacauua

SEQ ID NO: 47955 - RNA, 64 nt, Homo Sapiens
auuauuucaugcuuuuuuuuaaaaaaaaaaaaaaacaaaauaacaaucugaagaggcauuuggu

SEQ ID NO: 47956 - RNA, 64 nt, Homo Sapiens
uuugcgaggcuuaggcagcuagacaucguuuaaaacaaaauauuaacuuauauuacauguguau

SEQ ID NO: 47957 - RNA, 64 nt, Homo Sapiens
uuugucuguuuucaaccaaaacauaacuaucaaaacaaaauaaacuucuaauacauauuaaaag

SEQ ID NO: 47958 - RNA, 64 nt, Homo Sapiens
acacaggagcaucacuaugcuagguuuugcuauuacaaaauacuauggacauuaagacuguuuu

SEQ ID NO: 47959 - RNA, 64 nt, Homo Sapiens
uucuuuuugcucuaaaauaugggccaccauugcaacaaaauacaauguuguuuuguacagaugu

SEQ ID NO: 47960 - RNA, 64 nt, Homo Sapiens
uuggaguuggaguagaauguauauuuaauguugaacaaaauaaaacuuguuuuuguaaagaaaa

SEQ ID NO: 47961 - RNA, 64 nt, Homo Sapiens
agaaauuuucuagaaucaugagguuauaguuugacuuuaagauagaguaugcuuuauugaguaa

SEQ ID NO: 47962 - RNA, 64 nt, Homo Sapiens
augcuuuauugaguaaaggucaugcaucacagaccuuuaagagucccaucacuguucuuuaaag

SEQ ID NO: 47963 - RNA, 64 nt, Homo Sapiens
aaagccugugguauuuuauauaauauuuuuauaacuuuaagagacuguaguaauugaccuaaaa

SEQ ID NO: 47964 - RNA, 64 nt, Homo Sapiens
uagucaacaguauuuggcuaucaauaaagaaucucuuuaagaucucacccggcuggcauucugu

SEQ ID NO: 47965 - RNA, 64 nt, Homo Sapiens
uuuauauuuuuaaagauauucuuuuucuuauggacuuuaagaccauuauuucugaaauauccau

SEQ ID NO: 47966 - RNA, 64 nt, Homo Sapiens
ucaacguguuucccuuugauuaaaugcacuggagcuuuaagagcucugugguguucuaaggaau

SEQ ID NO: 47967 - RNA, 64 nt, Homo Sapiens
uauuuucccuguuugcuuugcuacuguauguugacuuuaagaucuuuuuuuaaauacauuugau

SEQ ID NO: 47968 - RNA, 64 nt, Homo Sapiens
acaaaaaagauuugacuuccgaauagaauguuuucuuuaagaggcaugaaaagcaacuauuguu

SEQ ID NO: 47969 - RNA, 64 nt, Homo Sapiens
gaagagaagaaaacuaguauaguuguaauauauacuuuaagaaauuugcauuaaguuauggaag

SEQ ID NO: 47970 - RNA, 64 nt, Homo Sapiens
ugagaagaaaugaauuuacucaaagauaucuuugcuuuaagaugauauuauucucgcauguaaa

SEQ ID NO: 47971 - RNA, 64 nt, Homo Sapiens
uaaaacugggaaauagaaacucuuuuuuuuuuuccuuuaagaauauacauaauaaacccuuuca

SEQ ID NO: 47972 - RNA, 64 nt, Homo Sapiens
gaaaucccaguucucuaauuguuauguuuugcuucuuuaagauaugcuaccauuauauuuuggg

SEQ ID NO: 47973 - RNA, 64 nt, Homo Sapiens
ugggguucacucuuaccaagaaucuuugaugcagcuuuaagaugguggggaggauggggugaau

SEQ ID NO: 47974 - RNA, 64 nt, Homo Sapiens
aagagcaugaagcauaucugggaauaucuuuugccuuuaagacgauucauucuugucuagaggg

SEQ ID NO: 47975 - RNA, 53 nt, Homo Sapiens
gccacagcacaaaguuuuaaugucuuuaagaaaaagaaaucaaucugcagaaa

SEQ ID NO: 47976 - RNA, 64 nt, Homo Sapiens
uuaagacucucugguucuguccuugcuuuggagacuuuaagacauuuccuaaagcacaaauaaa

SEQ ID NO: 47977 - RNA, 64 nt, Homo Sapiens
ugucuugaaugauaauuaggaaugcuugauaaaucuuuaagauaacaugguaagguggagagua

SEQ ID NO: 47978 - RNA, 64 nt, Homo Sapiens
uuaaaaaugugauguuuugugacccuuacaagugcuuuaagauugacaguaaacacacauguau

SEQ ID NO: 47979 - RNA, 64 nt, Homo Sapiens
ggaauauccucauauuuuuaccauauuuuaagaacuuuaagacgauuaauuguaaauaauuuau

SEQ ID NO: 47980 - RNA, 64 nt, Homo Sapiens
auucugaguuuuuucaaggaauguaauacuggagcuuuaagaacauacuuaguuucucauguga

SEQ ID NO: 47981 - RNA, 64 nt, Homo Sapiens
acuauuuucaaagcagaaaaauugacauugcugccuuuaagaauaccaugaauguaagaaauug

SEQ ID NO: 47982 - RNA, 64 nt, Homo Sapiens
aucaauaggauuugcuaauuuccagaaaaguuuacuuuaagaucaugauuugagcaagcucauu

SEQ ID NO: 47983 - RNA, 64 nt, Homo Sapiens
uuacagggccagccgggcauagggcuucugaucccuuuaagaaaugacugccuaacuucagagc

SEQ ID NO: 47984 - RNA, 64 nt, Homo Sapiens
aaauguguuugauauaaggcugaugagcuucucacuuuaagaaucacucuccucuagcuauccu

SEQ ID NO: 47985 - RNA, 64 nt, Homo Sapiens
gugggugguauuggagaaagaaaagcuaaauaaccuuuaagaauuucuacguauccuuguggag

SEQ ID NO: 47986 - RNA, 64 nt, Homo Sapiens
uggagaaggaaaaauagcuuauaaaaauuaaaugcuuuaagaaaaaauuaugaacauuuuuuuc

SEQ ID NO: 47987 - RNA, 64 nt, Homo Sapiens
ugauuuauuacaaaauuaugacuccacauccacccuuuaagaaucgagcgugacauuaugcauu

SEQ ID NO: 47988 - RNA, 64 nt, Homo Sapiens
agggaagaaaacaccaaauaagaaaaaaauuugccuuuaagaguuacuuuuguugaauguauuu

SEQ ID NO: 47989 - RNA, 64 nt, Homo Sapiens
gcgggcagaaccauuucaguuagcaugugccucacuuuaagaaaguccuguaggggaaaaaaaa

SEQ ID NO: 47990 - RNA, 64 nt, Homo Sapiens
uguguguguguguauguuugcauauuauagcucucuuuaagacagacaucuaaaaagauuuugg

SEQ ID NO: 47991 - RNA, 64 nt, Homo Sapiens
auauuuuuugucauuuuuugucaugcuuuugugccuuuaagaaaauacaacucucauuuaauau

SEQ ID NO: 47992 - RNA, 64 nt, Homo Sapiens
ccuauuguucaggcuaaggcgcaaaaccacaauucuuuaagauucuuaguaacuucuuucugug

SEQ ID NO: 47993 - RNA, 64 nt, Homo Sapiens
uuaagggaguggccucauuucacuagagacaaaucuuuaagaauaguucuaaaauugggcuugu

SEQ ID NO: 47994 - RNA, 64 nt, Homo Sapiens
uuuuuuuuuuuuuacauguuuccaucauuucugucuuuaagaacuaauucguacauaauaaguu

SEQ ID NO: 47995 - RNA, 64 nt, Homo Sapiens
aagugguggucuuuuggaugguaaagccaaguagcuuuaagauacuauuuuauuuuuauuuuuu

SEQ ID NO: 47996 - RNA, 64 nt, Homo Sapiens
uuuuguuggguauccaucccuucuguuugaauuccuuuaagagaguacuuuuuauuauuauuuu

SEQ ID NO: 47997 - RNA, 64 nt, Homo Sapiens
gucccuuuguccuuccccgugccucccaaaguuacuuuaagauccuuagaauauuucuuuaaau

SEQ ID NO: 47998 - RNA, 64 nt, Homo Sapiens
auauauugcuuauuuuaaguuccaaaggugaagucuuuaagaauaaaacauuaccaacuccugc

SEQ ID NO: 47999 - RNA, 64 nt, Homo Sapiens
auucacacuuaggcaagcauacacaggcacauggcuuuaagaaccacacugaugccuugauaau

SEQ ID NO: 48000 - RNA, 64 nt, Homo Sapiens
cacugaaaacuuagguccuguaucauacuuuuuucuuuaagacuuuuuaagaaauauuacuuaa

SEQ ID NO: 48001 - RNA, 64 nt, Homo Sapiens
cagguaacaugagaagggcugaucaggagaugcucuuuaagaaguucgcaccccugcugacacc

SEQ ID NO: 48002 - RNA, 64 nt, Homo Sapiens
ggaucuggguucaucucacccacagagggaggaucuuuaagaggagaaaaaagccaagagggaa

SEQ ID NO: 48003 - RNA, 64 nt, Homo Sapiens
aaaaaccccacaagugugaaaaacauggcaaagccuuuaagaagcccucaauucuuaacagaca

SEQ ID NO: 48004 - RNA, 64 nt, Homo Sapiens
aacuaaaguugguagaaaaguuauuuguauagaacuuuaagaggaucagaagguuuuuugcaga

SEQ ID NO: 48005 - RNA, 64 nt, Homo Sapiens
auauauuuuccaguugaaaacaaacuaagaaguccuuuaagaauuuauaauccguuccccauua

SEQ ID NO: 48006 - RNA, 64 nt, Homo Sapiens
gcugagccuuacaaaccccugaaggaaagugacccuuuaagagaggaucaucuuuuuuuauauu

SEQ ID NO: 48007 - RNA, 64 nt, Homo Sapiens
uauuggggcugggcgcaguguaaucccaaacccccuuuaagacacucagcggaaaacuguacuu

SEQ ID NO: 48008 - RNA, 64 nt, Homo Sapiens
uuagguuuccucagcggaaaugaucccaaaaccccuuuaagaccguuuuccucaacaggacacu

SEQ ID NO: 48009 - RNA, 64 nt, Homo Sapiens
augcagucauggucuuucagcauacauucuguuucuuuaagaagcauucucucuuugagugauu

SEQ ID NO: 48010 - RNA, 64 nt, Homo Sapiens
uuuugacuccuuuccaacaccaaugaaaacuuggcuuuaagacuagagugagugguccuuuggu

SEQ ID NO: 48011 - RNA, 51 nt, Homo Sapiens
aaaagcaacggaaaaaauagaaauacuuaaaguguggcaauacucuuucac

SEQ ID NO: 48012 - RNA, 64 nt, Homo Sapiens
ugccaaucuuugcucauauuaaaaacaacuuacaaauacuuaguuuuuguaucuaaucucugau

SEQ ID NO: 48013 - RNA, 64 nt, Homo Sapiens
ggugcaaucaacuguuaguauuuuuugcauaaucaauacuuaagacugaugcgagaugauuuug

SEQ ID NO: 48014 - RNA, 64 nt, Homo Sapiens
uucaagaucacuguucaaaccuucucaugauaacaauacuuaggcagaugccaaauacuguaac

SEQ ID NO: 48015 - RNA, 64 nt, Homo Sapiens
uuagaaauauucaccuuaggaacuuuuacaaaugaauacuuacccagacaugaugaaaaaaaaa

SEQ ID NO: 48016 - RNA, 64 nt, Homo Sapiens
ccagcauucucaacuauaucaaguuacuguucagaauacuuaauaucuccucucuucauaauua

SEQ ID NO: 48017 - RNA, 64 nt, Homo Sapiens
ccaugcugaugaaaugaccuaugcccaaagaacaaauacuuaacgugggaguggaaccacauga

SEQ ID NO: 48018 - RNA, 64 nt, Homo Sapiens
uuuuauccauuuuauggaaauggaaagaugugugaauacuuaauggcuugcuuugauguauguu

SEQ ID NO: 48019 - RNA, 64 nt, Homo Sapiens
uagaccgcagagagcuggcaccagugcaugcauuaauacuuaguugagccuggaaaaauacaag

SEQ ID NO: 48020 - RNA, 64 nt, Homo Sapiens
ccuguuguuacuuuauauuucauaaucaggcaaaaauacuuacaguuaauaauauagauauaau

SEQ ID NO: 48021 - RNA, 64 nt, Homo Sapiens
ugguucuaaguacuuuacuuguauuaucccauuuaauacuuagaacaaccccgugagauaagua

SEQ ID NO: 48022 - RNA, 64 nt, Homo Sapiens
ugcaauaaucacauugccuuuguguuaauagucaaauacuuaccuuuggagaauacuuaccuuu

SEQ ID NO: 48023 - RNA, 64 nt, Homo Sapiens
cuuuguguuaauagucaaauacuuaccuuuggagaauacuuaccuuuggaggaauguauaaaau

SEQ ID NO: 48024 - RNA, 64 nt, Homo Sapiens
gauuguuacaaaccaagccuaagacacaucugugaauacuuagauuuguagcuuaaucacauuc

SEQ ID NO: 48025 - RNA, 64 nt, Homo Sapiens
acugcuaccacuaacagguuguaaauagaagacuaauacuuaauuaaagucaccuuccuaccau

SEQ ID NO: 48026 - RNA, 64 nt, Homo Sapiens
ccucuuccauugcaaauuaaaguccaaauagagaaauacuuagguuuuagaacacaucagaggu

SEQ ID NO: 48027 - RNA, 64 nt, Homo Sapiens
cucuuaauuuauuuagaguauuucucuauugcugaauacuuaaguaguuuuaaauuuuauuaug

SEQ ID NO: 48028 - RNA, 64 nt, Homo Sapiens
cuuucauuccaguggccuuagucaucucugaagaaauacuuacuugauuuuuuuuuuuccaauc

SEQ ID NO: 48029 - RNA, 64 nt, Homo Sapiens
uaaagucuuguauagcaauaugcuuggagaggagaauacuuaucucuggcgcacaucacuauau

SEQ ID NO: 48030 - RNA, 64 nt, Homo Sapiens
uugcuuauuuuuaaauuaacuguuuugagcuuugaauacuuaaggcuuuagagggagaacccaa

SEQ ID NO: 48031 - RNA, 64 nt, Homo Sapiens
uuguucaccuauuuugugcuuuaaaucucaauaaaauacuuacugagggaaaggcuuguuuuga

SEQ ID NO: 48032 - RNA, 64 nt, Homo Sapiens
cucgaggagcaccugcuggucuccuuguaaaguuccaugagaugcccccaccccuccccugcgu

SEQ ID NO: 48033 - RNA, 64 nt, Homo Sapiens
uguugggaaguucaugaguugucguucaugaauuccaugagaaugacagcuauaucaugcuugg

SEQ ID NO: 48034 - RNA, 64 nt, Homo Sapiens
ugccacauuucucucugggagacuuugaaaauaaccaugagagacucaagcuauccaauuuucu

SEQ ID NO: 48035 - RNA, 64 nt, Homo Sapiens
agaacacaguuauuaaacacggcaaguaaauugaccaugagaaauuacuauacuauuucuucaa

SEQ ID NO: 48036 - RNA, 64 nt, Homo Sapiens
guggcauugccauugcccaggaggggcccagucaccaugagagcucccuugccuuaccuggagg

SEQ ID NO: 48037 - RNA, 64 nt, Homo Sapiens
uuuucacaauagcucugugauguaagugcuaucuccaugagaaaauucauaaaggguguuuugu

SEQ ID NO: 48038 - RNA, 64 nt, Homo Sapiens
gcugagauucccauuucucuuaaggagaagccacccaugagaugucuuuuccuucuccaucauc

SEQ ID NO: 48039 - RNA, 64 nt, Homo Sapiens
acagccuguugucuaaagccaaggagucauaaaaccaugagaaauaaauaggaaucaauaguua

SEQ ID NO: 48040 - RNA, 64 nt, Homo Sapiens
aggaaagaaauauuucaggugcuuuuauggacuuccaugagagaaaggauaaggaggaggggug

SEQ ID NO: 48041 - RNA, 64 nt, Homo Sapiens
ugaauagauuuuuaguucccgaaaauaagguuguccaugagauuaaggaaggagguucagugag

SEQ ID NO: 48042 - RNA, 64 nt, Homo Sapiens
augagaggcuguaccccucacccacauccuacauccaugagaauuaccugcagcucuucgaguu

SEQ ID NO: 48043 - RNA, 64 nt, Homo Sapiens
ccaggugacauuggccccuagacccucucuauagccaugagacuccuuguggccucaagaaauu

SEQ ID NO: 48044 - RNA, 64 nt, Homo Sapiens
cgauagugguggugaacagaugcuugcuucaaccccaugagacuuuuauauauaagccaaaaaa

SEQ ID NO: 48045 - RNA, 64 nt, Homo Sapiens
augccaugggcccucucagcagccauuccuguucccaugagauguccuucuuccccccgcuguc

SEQ ID NO: 48046 - RNA, 64 nt, Homo Sapiens
uaaauguuuguugauuaauucccagccucccaaaccaugagaaaagugccuugauauuggacuu

SEQ ID NO: 48047 - RNA, 64 nt, Homo Sapiens
gugcagugagaagauagcuaagcuuugcccuucaccaugagaggauaggaaucccuagagagcu

SEQ ID NO: 48048 - RNA, 64 nt, Homo Sapiens
ggaugaguaaaaacaagaaaauuuggggagggggagaaagaagaaagggauugcugucucccuu

SEQ ID NO: 48049 - RNA, 64 nt, Homo Sapiens
uagauuuucuuuuaaauugguucuuuguuucugaagaaagaauuuuuuuuaacuucaugguuuu

SEQ ID NO: 48050 - RNA, 64 nt, Homo Sapiens
ugguagaucaaggcuuuguuucauuugaaaaaaaagaaagaaagaaagaaagaaagaaauccua

SEQ ID NO: 48051 - RNA, 64 nt, Homo Sapiens
agaucaaggcuuuguuucauuugaaaaaaaagaaagaaagaaagaaagaaagaaauccuacuac

SEQ ID NO: 48052 - RNA, 64 nt, Homo Sapiens
caaggcuuuguuucauuugaaaaaaaagaaagaaagaaagaaagaaagaaauccuacuacgagc

SEQ ID NO: 48053 - RNA, 64 nt, Homo Sapiens
gcuuuguuucauuugaaaaaaaagaaagaaagaaagaaagaaagaaauccuacuacgagcgauc

SEQ ID NO: 48054 - RNA, 64 nt, Homo Sapiens
uguuucauuugaaaaaaaagaaagaaagaaagaaagaaagaaauccuacuacgagcgaucacac

SEQ ID NO: 48055 - RNA, 64 nt, Homo Sapiens
ccuggguaacagagcaagacuccaucucaaaaaaagaaagaaagaaaaaagaaaguacaaguuu

SEQ ID NO: 48056 - RNA, 64 nt, Homo Sapiens
gguaacagagcaagacuccaucucaaaaaaagaaagaaagaaaaaagaaaguacaaguuuauaa

SEQ ID NO: 48057 - RNA, 64 nt, Homo Sapiens
uaacaauaaagaauuuucauaauauaucuguuggagaaagaaauggcuccauauuucaacuaaa

SEQ ID NO: 48058 - RNA, 64 nt, Homo Sapiens
caagugcgcuuugcaauauuuauuugacuugaaaagaaagaaacgucugggacauuagucguua

SEQ ID NO: 48059 - RNA, 64 nt, Homo Sapiens
cuguguuuuugccacugauucuugaaagaaagaaagaaagaagacuuaauugcuuuccugccuc

SEQ ID NO: 48060 - RNA, 64 nt, Homo Sapiens
aagacuguguuuuugccacuccuccuugaaagaaagaaagaaagaccacuuaauugcuuuccug

SEQ ID NO: 48061 - RNA, 64 nt, Homo Sapiens
aaagaagacuguguuuuugcccugccuccuugaaagaaagaaagggugaccacuuaauugcuuu

SEQ ID NO: 48062 - RNA, 64 nt, Homo Sapiens
agagauaauauauauauagaagguuuaucuaagaagaaagaaacuaggauaugacauauaugaa

SEQ ID NO: 48063 - RNA, 64 nt, Homo Sapiens
gaugcugagggaccuagugaggggugagaagaugagaaagaaauacugaugggggaagauaccu

SEQ ID NO: 48064 - RNA, 64 nt, Homo Sapiens
acuaugguguaauuuaaacuaaugauuugcagaaagaaagaaaaaaaaacugcaaaucagaaag

SEQ ID NO: 48065 - RNA, 64 nt, Homo Sapiens
aaaaacuaugguguaauuuaaaagaaugauuugcagaaagaaaguggaaaaaacugcaaaucag

SEQ ID NO: 48066 - RNA, 64 nt, Homo Sapiens
auuugcagaaagaaagaaaaaaaaacugcaaaucagaaagaaugcuaauauggcucuguuugga

SEQ ID NO: 48067 - RNA, 64 nt, Homo Sapiens
aggacucugguuacccuugcugaccccaaucaaaagaaagaacacacacaucggaagggcugga

SEQ ID NO: 48068 - RNA, 64 nt, Homo Sapiens
ccagguguccugguguucucuuuaugacagacaaagaaagaagccuuaaagacaggagcuggca

SEQ ID NO: 48069 - RNA, 64 nt, Homo Sapiens
caacaaaaguuuuaccacagucugcacuugcagaagaaagaaaaaaauucaaaccacauguuua

SEQ ID NO: 48070 - RNA, 64 nt, Homo Sapiens
gaauauauucaugacauuuguaauaaaugucuugagaaagaauuuguuucauggcuucaugguc

SEQ ID NO: 48071 - RNA, 64 nt, Homo Sapiens
aaguagcuggcgagguuaccuuaacuaucacugaagaaagaaauuuucugacacacugauggca

SEQ ID NO: 48072 - RNA, 64 nt, Homo Sapiens
acauagauaguacuagguauuaauagauauguaaagaaagaaaucacaccauuaauaaugguaa

SEQ ID NO: 48073 - RNA, 64 nt, Homo Sapiens
cuaccacugcaacauuaaugaguuaacucuagaaagaaagaacagagaauuguugugcuuugac

SEQ ID NO: 48074 - RNA, 64 nt, Homo Sapiens
aacacuaccacugcaacauuugacaguuaacucuagaaagaaaguacugagaauuguugugcuu

SEQ ID NO: 48075 - RNA, 64 nt, Homo Sapiens
aaaaaggaaaaaaaaaaaaaaugcaguaaaagaaagaaagaaaauuccagcaucuuaccuucau

SEQ ID NO: 48076 - RNA, 64 nt, Homo Sapiens
aaaaaaaaaggaaaaaaaaaucauaugcaguaaaagaaagaaaguacauuccagcaucuuaccu

SEQ ID NO: 48077 - RNA, 64 nt, Homo Sapiens
uuaagaguagcaguauauaucuuaaaaaaagaagagaaagaauuuugcauuuaaaugugacauu

SEQ ID NO: 48078 - RNA, 64 nt, Homo Sapiens
ccauucucuauuuuuccaugggucagaaagaaaaagaaagaaaaugauuucuugagcauguauu

SEQ ID NO: 48079 - RNA, 64 nt, Homo Sapiens
agaaagaaaaccauucucuaagcauguauuggucagaaagaaaacucagauauuugauuucuug

SEQ ID NO: 48080 - RNA, 64 nt, Homo Sapiens
ccacaaggauucagcaauuuccaguaggaaguugagaaagaaagaaaccccaagacguuugagg

SEQ ID NO: 48081 - RNA, 64 nt, Homo Sapiens
cauaagccuuaacaauacucaucugaaaugaauuagaaagaaacacaguuuguuauuaaguaau

SEQ ID NO: 48082 - RNA, 64 nt, Homo Sapiens
cucuucuaaaaauuguuaaugagcauuggucgacagaaagaaguauaucuaggagucucuugau

SEQ ID NO: 48083 - RNA, 64 nt, Homo Sapiens
cacugugguauaguguccaaacugacugucauugagaaagaaagaaaguaguuugcgauugcag

SEQ ID NO: 48084 - RNA, 64 nt, Homo Sapiens
gugguauaguguccaaacugacugucauugagaaagaaagaaaguaguuugcgauugcaguaga

SEQ ID NO: 48085 - RNA, 64 nt, Homo Sapiens
gccuacuugaggugggcaucugggaauacaggguagaaagaaauuccugcuuuucagauaaagc

SEQ ID NO: 48086 - RNA, 64 nt, Homo Sapiens
uuggucuuuaggagaaagcauuaguaaugaaagaagaaagaauuuucacuugguuggacauugg

SEQ ID NO: 48087 - RNA, 64 nt, Homo Sapiens
gauagguuugcgaauauaccauuuuauauuguugagaaagaacaaaaagggaauuuccagaugu

SEQ ID NO: 48088 - RNA, 64 nt, Homo Sapiens
uagaacuguaaugggguuguauuuaugggcgccuagaaagaaaacacaaggacuugguaggcca

SEQ ID NO: 48089 - RNA, 64 nt, Homo Sapiens
aaagaauguaaagcaaccaaaaagaaaaaaaaaaagaaagaaagaggaaaagaaauccauacua

SEQ ID NO: 48090 - RNA, 64 nt, Homo Sapiens
gguguaguauuaauagguuaaaaccaggcuuucuagaaagaauaaacuuacauauuuauuuuua

SEQ ID NO: 48091 - RNA, 64 nt, Homo Sapiens
guuuauuucagcaaacuuguugaauuuauuuuuaagaaagaaauacuguauugggaaguuacug

SEQ ID NO: 48092 - RNA, 64 nt, Homo Sapiens
aagaccgagacuccgccucaaaaaaaaaaaaaaaagaaagaaagaaagaaagaaagaaaucuac

SEQ ID NO: 48093 - RNA, 64 nt, Homo Sapiens
ccgagacuccgccucaaaaaaaaaaaaaaaagaaagaaagaaagaaagaaagaaaucuaccugu

SEQ ID NO: 48094 - RNA, 64 nt, Homo Sapiens
gacuccgccucaaaaaaaaaaaaaaaagaaagaaagaaagaaagaaagaaaucuaccugucaag

SEQ ID NO: 48095 - RNA, 64 nt, Homo Sapiens
ccgccucaaaaaaaaaaaaaaaagaaagaaagaaagaaagaaagaaaucuaccugucaaggaac

SEQ ID NO: 48096 - RNA, 64 nt, Homo Sapiens
cucaaaaaaaaaaaaaaaagaaagaaagaaagaaagaaagaaaucuaccugucaaggaacuaag

SEQ ID NO: 48097 - RNA, 64 nt, Homo Sapiens
aucuauuacucuugagagcuggcuguccuuugaaagaaagaaguaauguucuuugaaagaaaga

SEQ ID NO: 48098 - RNA, 64 nt, Homo Sapiens
uguccuuugaaagaaagaaguaauguucuuugaaagaaagaaaaaucucuugcugugucaaacc

SEQ ID NO: 48099 - RNA, 64 nt, Homo Sapiens
ucucaauaauugauaauaacaguccaaagaaagcagaaagaaggaaagccuagaacagaaauaa

SEQ ID NO: 48100 - RNA, 64 nt, Homo Sapiens
uuuuauuaccaaacuuauagaaauaaaaauuauuagaaagaaauacuaugaacaauugaaugcc

SEQ ID NO: 48101 - RNA, 64 nt, Homo Sapiens
auaggcauagaucuuuguaaaacuauaaaaucuuagaaagaaacgaucuaaauauaagagcuga

SEQ ID NO: 48102 - RNA, 64 nt, Homo Sapiens
aaauaggaaucaacuuaacauuuauaauaccaucagaaagaauaaacgaaguuaaauaauucca

SEQ ID NO: 48103 - RNA, 64 nt, Homo Sapiens
ugggugguacauugaggagugccccauuuaaaaaagaaagaacaugugcagccaaaucugagag

SEQ ID NO: 48104 - RNA, 64 nt, Homo Sapiens
ucuuugucugggacccccaaaugacaaguuauaaagaaagaagauccacccuuuaaaucuuagg

SEQ ID NO: 48105 - RNA, 64 nt, Homo Sapiens
cuggauguggagaaaugccgucagaagggaauauagaaagaacugaacagauaagugauggaaa

SEQ ID NO: 48106 - RNA, 64 nt, Homo Sapiens
caauuuuuauuuggccaaaagugagcuuagaggaagaaagaaaaguuaccugacaugccguagg

SEQ ID NO: 48107 - RNA, 64 nt, Homo Sapiens
acgaggaagccguggggcaguagauaguggaugaagaaagaaggaagagggcggcugcugggac

SEQ ID NO: 48108 - RNA, 64 nt, Homo Sapiens
cuacaaccacaggcuguuuguggccauaaauaauagaaagaaagguaacuguugccaggacaca

SEQ ID NO: 48109 - RNA, 64 nt, Homo Sapiens
gugagagcacaaagauaacgcaggagagagagagagaaagaaugagaaagaaaaggaaugcaag

SEQ ID NO: 48110 - RNA, 64 nt, Homo Sapiens
aaagauaacgcaggagagagagagagaaagaaugagaaagaaaaggaaugcaagagaaggagau

SEQ ID NO: 48111 - RNA, 64 nt, Homo Sapiens
uuuuaguaucgaugccacucaucugcagcagaagagaaagaaguccucuuggggcuuuuuaguu

SEQ ID NO: 48112 - RNA, 64 nt, Homo Sapiens
aaugagugcuguagcuuuagaaguggcccucuauagaaagaagucaaaagaugaggccccuucu

SEQ ID NO: 48113 - RNA, 64 nt, Homo Sapiens
ucacggugggcggugggcaagaagccagcauggaagaaagaagggagaaaacuuuggugacugc

SEQ ID NO: 48114 - RNA, 64 nt, Homo Sapiens
acuaaguggaaaaauauaaaacauaugaauauaaagaaagaaagagacaagucaaauguaguaa

SEQ ID NO: 48115 - RNA, 64 nt, Homo Sapiens
aacuaauucuuuacaaauguaacucgagcuacaaagaaagaaugaaaauguucuaagauaaaaa

SEQ ID NO: 48116 - RNA, 64 nt, Homo Sapiens
ccacguauguugggguaauuuaaaaaaaaaucaaagaaagaaggauguaguccaaauuugucau

SEQ ID NO: 48117 - RNA, 64 nt, Homo Sapiens
uuagaaaaucuguucauugauaauauaugaguuaagaaagaaaaugcaaagaucuauugcuagc

SEQ ID NO: 48118 - RNA, 64 nt, Homo Sapiens
aagccuuuucuaaauuuguugugacuuggggacuagaaagaauagccaacuugcuaucuggugg

SEQ ID NO: 48119 - RNA, 64 nt, Homo Sapiens
uggagccuucgcucuguagaacuuggaaaaauccagaaagaaaaaauaauugauuucaagaccu

SEQ ID NO: 48120 - RNA, 64 nt, Homo Sapiens
agugagagggcaugcgcacaaggcugaccaagagagaaagaaguaggcaugagggaucacaggg

SEQ ID NO: 48121 - RNA, 64 nt, Homo Sapiens
caagguuuuaaagcauugccaaaaaaaagaaaacagaaagaaaaaauguaucaucuaaaggacu

SEQ ID NO: 48122 - RNA, 64 nt, Homo Sapiens
gcuuagcuuccucaacuacuguuuuucagaaggaagaaagaaucaaauggaagaagaaucaagu

SEQ ID NO: 48123 - RNA, 64 nt, Homo Sapiens
uguuaaccguccuuccccuagcaaauuuaaaaacagaaagaaaauguuguaccaguuaccauuc

SEQ ID NO: 48124 - RNA, 64 nt, Homo Sapiens
uugccaaaugucacuaaaggguuuaguuuuaaggagaaagaaaaggaaaaaaaaaaaaaacaaa

SEQ ID NO: 48125 - RNA, 64 nt, Homo Sapiens
ugucucaauaugaauagggggugaguagcuucauagaaagaauggggaacucccuuggccucaa

SEQ ID NO: 48126 - RNA, 64 nt, Homo Sapiens
cuagguuaugaaaacuaucuuagaaggugcuuuuagaaagaaccaggagaacaaccaaagcagc

SEQ ID NO: 48127 - RNA, 64 nt, Homo Sapiens
ugauuccaaaaaaaaaaaaaaaaagaagaaagagagaaagaaagaaacagaaaaaccuaaaaga

SEQ ID NO: 48128 - RNA, 64 nt, Homo Sapiens
uccaaaaaaaaaaaaaaaaagaagaaagagagaaagaaagaaacagaaaaaccuaaaagaaagc

SEQ ID NO: 48129 - RNA, 64 nt, Homo Sapiens
uauccagcucucuuguguuauaaagaaaggcacaagaaagaaaauauuuuuuauugcucuuuag

SEQ ID NO: 48130 - RNA, 64 nt, Homo Sapiens
uucuacuggcauucugauugacucuuauaucagaagaaagaaguuuagcaauauauucaguggc

SEQ ID NO: 48131 - RNA, 64 nt, Homo Sapiens
gagauuauuacccagaauucaaacacaacucuauagaaagaaagcugaugcaggaauuaaguuu

SEQ ID NO: 48132 - RNA, 59 nt, Homo Sapiens
augcauuauugacgaacuggacauucuacagaaagaaaaaaacugacucauccaacuag

SEQ ID NO: 48133 - RNA, 64 nt, Homo Sapiens
ccccaccaccucaaccucugagcgucauaugagaagaaagaaauaguaagaagucaccgacggu

SEQ ID NO: 48134 - RNA, 64 nt, Homo Sapiens
uucaguggaaaaaucaauaucuagucagagcccaagaaagaauucuuuacuuagaauuguccac

SEQ ID NO: 48135 - RNA, 64 nt, Homo Sapiens
cagucuuccauagauuuuuaacacaaauuuaaaaagaaagaaaaugcccucugcugccauaauc

SEQ ID NO: 48136 - RNA, 64 nt, Homo Sapiens
uaauaaacucgaaguuuaggagagugauuuuacuagaaagaauuacuuuuaacagauuguuuau

SEQ ID NO: 48137 - RNA, 64 nt, Homo Sapiens
uauuugucaaauaaaaucauacauaaagaauuuaagaaagaauauuauagacuuuuuaaaaugu

SEQ ID NO: 48138 - RNA, 64 nt, Homo Sapiens
ugacuagcaaaacuccaucucaaaaaaaaaaaaaagaaagaaagaaacugaaaagugaggugug

SEQ ID NO: 48139 - RNA, 64 nt, Homo Sapiens
uagcaaaacuccaucucaaaaaaaaaaaaaagaaagaaagaaacugaaaagugagguguggaac

SEQ ID NO: 48140 - RNA, 64 nt, Homo Sapiens
ugguggaugacaaaagaaaaucugcucuguggaaagaaagaacugucucuaccagggucaagag

SEQ ID NO: 48141 - RNA, 64 nt, Homo Sapiens
ucucuaccagggucaagagcaugaacgcaucaauagaaagaacucggggaaacaucccaucaac

SEQ ID NO: 48142 - RNA, 64 nt, Homo Sapiens
cgagcccuggcugugaaaagaaucucaacauagaagaaagaagaaacaauaaauauucugcaga

SEQ ID NO: 48143 - RNA, 64 nt, Homo Sapiens
gaaacaauaaauauucugcagauuaaugcagcaaagaaagaagguugguagugaaacacaaagc

SEQ ID NO: 48144 - RNA, 64 nt, Homo Sapiens
auagaacuccaagccuuuucuccacuacuauacaagaaagaauucagcaagcugcuucuccaau

SEQ ID NO: 48145 - RNA, 64 nt, Homo Sapiens
cucuguagggacacuguguuaucaaccauuaagaagaaagaaccacaagccucccaaguauuug

SEQ ID NO: 48146 - RNA, 64 nt, Homo Sapiens
uuaauagcccauuucuguuaaccucuuaucacuaagaaagaaaggaaagaaggagaugaauaga

SEQ ID NO: 48147 - RNA, 64 nt, Homo Sapiens
acuaagaaagaaaggaaagaaggagaugaauagaagaaagaaaauggaaagaaggaaaaaagga

SEQ ID NO: 48148 - RNA, 64 nt, Homo Sapiens
aagaaggaaaaaaggaggauagaaaaaggauggaagaaagaagcauugaaaacaaagacauucu

SEQ ID NO: 48149 - RNA, 64 nt, Homo Sapiens
caggauuuucuccuguaucuuccauuaacacacaagaaagaaagcacuuuauugaaaauugccu

SEQ ID NO: 48150 - RNA, 64 nt, Homo Sapiens
ucaaaucagaugaaguuauaagauaucaaaucucagaaagaaugacuaagguaacuucucagaa

SEQ ID NO: 48151 - RNA, 64 nt, Homo Sapiens
caguggaucaugaaaagugcuguuuuguccuuugagaaagaaauaauuguuugagcgcagagua

SEQ ID NO: 48152 - RNA, 64 nt, Homo Sapiens
aacucacucuuaugaaaugggcuuuaacaaaacaagaaagaaacguacuuaacugugugaagaa

SEQ ID NO: 48153 - RNA, 64 nt, Homo Sapiens
caucaagagggaucaacuguggagaagcuacuucagaaagaagagaucacaaacauaugaguac

SEQ ID NO: 48154 - RNA, 64 nt, Homo Sapiens
uuagacacuaauauuuucauagaaauuaggcuggagaaagaaggaagaaaugguuuucuuaaau

SEQ ID NO: 48155 - RNA, 64 nt, Homo Sapiens
cuuuguuauuuuucuaaaaaaauaaaauuuaaaaagaaagaaaacuaaggaagaacaagaagcu

SEQ ID NO: 48156 - RNA, 64 nt, Homo Sapiens
gcuauguacgaccauuuguauguguaucuaugucagaaagaaucuuuauuaaaauauuuugauc

SEQ ID NO: 48157 - RNA, 64 nt, Homo Sapiens
aguucucacaauguugcuagauaucuacacauacagaaagaagcuauauguaucuacaauacau

SEQ ID NO: 48158 - RNA, 64 nt, Homo Sapiens
agggaaaaagagcuggugguaaaagaaaaaaaaaagaaagaaagggaucguaaaaaaauagaaa

SEQ ID NO: 48159 - RNA, 64 nt, Homo Sapiens
gguacauguauauauuuguccucaaaaaaaagaaagaaagaaaaggcaacgggcgagacucugu

SEQ ID NO: 48160 - RNA, 64 nt, Homo Sapiens
aaaagguacauguauauauucugucucaaaaaaaagaaagaaagccugggcaacgggcgagacu

SEQ ID NO: 48161 - RNA, 64 nt, Homo Sapiens
aaguauucugugguguauguugacuaaauaaaaaagaaagaacaucuguuguacugauguguug

SEQ ID NO: 48162 - RNA, 64 nt, Homo Sapiens
cuaguaaauugucugccuccaucagcuuuauccaagaaagaagaaagcguugacaaaucagaug

SEQ ID NO: 48163 - RNA, 64 nt, Homo Sapiens
gcagcugaacuuacuugccugaaaaggaguuaggagaaagaagacugcuauuuuuccauaggaa

SEQ ID NO: 48164 - RNA, 64 nt, Homo Sapiens
ucaaaaauggcuaggaagugggugaauaauuggaagaaagaauuauugucacaccuggaagcuu

SEQ ID NO: 48165 - RNA, 64 nt, Homo Sapiens
aaucauauuccuuuaugaauucuucgaccacaucagaaagaagggauccuuaccuuguauauca

SEQ ID NO: 48166 - RNA, 64 nt, Homo Sapiens
cguuucuaacaguaaauuauugucacagcuaaaaagaaagaaauuuugcauauuguaaaagcag

SEQ ID NO: 48167 - RNA, 64 nt, Homo Sapiens
ugacaacacaccuuggguaggccaaauucaauguagaaagaaugaucugaauaaauaaaauguu

SEQ ID NO: 48168 - RNA, 64 nt, Homo Sapiens
gaaaugaagacuauauauauggaauggaggugacagaaagaaagaaauucuuuguuugagggag

SEQ ID NO: 48169 - RNA, 64 nt, Homo Sapiens
ugaagacuauauauauggaauggaggugacagaaagaaagaaauucuuuguuugagggagacuu

SEQ ID NO: 48170 - RNA, 64 nt, Homo Sapiens
ucaggaagguagagagagaaaaagggagggaaggagaaagaaugggaauaaaauaaggagguaa

SEQ ID NO: 48171 - RNA, 64 nt, Homo Sapiens
uuucuggaugagaaaauuuucaauucuggccaugagaaagaaaaaaaaauaaacagccuucuuu

SEQ ID NO: 48172 - RNA, 64 nt, Homo Sapiens
cuuucccaagcuccuagccaacacuauccuugggagaaagaaauuugcagaaacugcuaagacc

SEQ ID NO: 48173 - RNA, 64 nt, Homo Sapiens
ccuugcuguugcucugaggagauauaauucugggagaaagaaucuuuuauaagaacaguacaga

SEQ ID NO: 48174 - RNA, 64 nt, Homo Sapiens
gucaauuuguuguuauaggucuuaccugugugaaagaaagaaaaagaaagaaagaaagaaagag

SEQ ID NO: 48175 - RNA, 64 nt, Homo Sapiens
uguuauaggucuuaccugugugaaagaaagaaaaagaaagaaagaaagaaagagaaaggaaauu

SEQ ID NO: 48176 - RNA, 64 nt, Homo Sapiens
auaggucuuaccugugugaaagaaagaaaaagaaagaaagaaagaaagagaaaggaaauuauaa

SEQ ID NO: 48177 - RNA, 64 nt, Homo Sapiens
gucuuaccugugugaaagaaagaaaaagaaagaaagaaagaaagagaaaggaaauuauaagguc

SEQ ID NO: 48178 - RNA, 64 nt, Homo Sapiens
cuauuggugucgucugagcaaccauauuuuaaggagaaagaacuaccuguuagcauucacugcc

SEQ ID NO: 48179 - RNA, 64 nt, Homo Sapiens
caacuggauuuacagauuuacuauauaaaauuccagaaagaaaguuguggaacauggugagaca

SEQ ID NO: 48180 - RNA, 64 nt, Homo Sapiens
uugaucaagcagauguuuaaauaggaugagcuuuagaaagaaaagaaagaaagugagcuugaac

SEQ ID NO: 48181 - RNA, 64 nt, Homo Sapiens
ugagcuugaacauaggaugagauuucaauuccacagaaagaaaggaaaacuagagccuuuaaau

SEQ ID NO: 48182 - RNA, 64 nt, Homo Sapiens
ucagccgaacccacaccccauuaauuagugaucuagaaagaaguccccagcaugaaugugccuu

SEQ ID NO: 48183 - RNA, 64 nt, Homo Sapiens
gaucgaguucuaauuaugauuuguaguauuuuaaagaaagaacaguuuuuuuuuaaauaguagu

SEQ ID NO: 48184 - RNA, 64 nt, Homo Sapiens
guuguuuuaucuaauacugugcagguguuuaaaaagaaagaaaaugaauuuuugaaagacuauu

SEQ ID NO: 48185 - RNA, 64 nt, Homo Sapiens
gaaagaaagcaaagcaaagucaucuuucccucacagaaagaaaccuugcuaacuuguaaaaagu

SEQ ID NO: 48186 - RNA, 64 nt, Homo Sapiens
guguggaagcacgucucaaacacuuuaaaguuugagaaagaauaugcaagcaaggaaguauguu

SEQ ID NO: 48187 - RNA, 64 nt, Homo Sapiens
uuuggguuuuuaauuuuuuuuauuuugaauaaacagaaagaaaucauaauucuauguguauuuu

SEQ ID NO: 48188 - RNA, 64 nt, Homo Sapiens
aaagcuggagagagagugaacuagggaaagagaaagaaagaauauugggucaagugcauuggac

SEQ ID NO: 48189 - RNA, 64 nt, Homo Sapiens
aauaaaagcuggagagagagggaccuagggaaagagaaagaaagugaguugggucaagugcauu

SEQ ID NO: 48190 - RNA, 64 nt, Homo Sapiens
cucaaauauuuugccucauuauucuuguuuuaaaagaaagaaaacaggccgggcacaguggcuc

SEQ ID NO: 48191 - RNA, 64 nt, Homo Sapiens
cagccugggugacagagggagacucugucucgaaagaaagaaagaaaaaaaggaaggaaggaga

SEQ ID NO: 48192 - RNA, 64 nt, Homo Sapiens
cugggugacagagggagacucugucucgaaagaaagaaagaaaaaaaggaaggaaggagaagga

SEQ ID NO: 48193 - RNA, 64 nt, Homo Sapiens
uucagggaagcugccaaagaaugucgacgucgaaagaaagaauauguaaaaugucuggagagcc

SEQ ID NO: 48194 - RNA, 64 nt, Homo Sapiens
aaguaaaccacaaaaaaauaccucaggaaagaauagaaagaaagucuaucuaaugacaugccua

SEQ ID NO: 48195 - RNA, 64 nt, Homo Sapiens
agcgagacucugucuccccccgcaaaaaaaaaaaagaaagaaagaaagagaaaagaaaagaaaa

SEQ ID NO: 48196 - RNA, 64 nt, Homo Sapiens
agacucugucuccccccgcaaaaaaaaaaaagaaagaaagaaagagaaaagaaaagaaaagcaa

SEQ ID NO: 48197 - RNA, 64 nt, Homo Sapiens
ugaugauauucagacgaagcauugauguuauggaagaaagaaagaaacaaacaaaauauauaua

SEQ ID NO: 48198 - RNA, 64 nt, Homo Sapiens
gauauucagacgaagcauugauguuauggaagaaagaaagaaacaaacaaaauauauauauaua

SEQ ID NO: 48199 - RNA, 64 nt, Homo Sapiens
acaaaaacaugaaacacaguaaccaccgacagaaagaaagaaacugaucgucacaacccucagg

SEQ ID NO: 48200 - RNA, 64 nt, Homo Sapiens
aaacacaaaaacaugaaacacaggaaccaccgacagaaagaaaggcccugaucgucacaacccu

SEQ ID NO: 48201 - RNA, 64 nt, Homo Sapiens
aaaacuauaucugcacaugagauccagaucauaaagaaagaagucaagauaaagaaauaaaagu

SEQ ID NO: 48202 - RNA, 64 nt, Homo Sapiens
ccuuuacauuuccauaaaacaaggcaacuccagaagaaagaagcuugucucaaauccuguccac

SEQ ID NO: 48203 - RNA, 64 nt, Homo Sapiens
aaagaggguauguuuuucacaauuuuaaaaagaaagaaagaaggcaaaacuuugccucaaaaca

SEQ ID NO: 48204 - RNA, 64 nt, Homo Sapiens
aaggaaagaggguauguuuuaacaaauuuuaaaaagaaagaaagggagcaaaacuuugccucaa

SEQ ID NO: 48205 - RNA, 64 nt, Homo Sapiens
uuaaguuuucuuucacagaaggagagggguaaagagaaagaaacuaacuuugagcugagugagg

SEQ ID NO: 48206 - RNA, 64 nt, Homo Sapiens
aguggguuucagaagugucaauggcagagaugaaagaaagaaaggccucucagucuuaggggac

SEQ ID NO: 48207 - RNA, 64 nt, Homo Sapiens
gcaaagcugcugucagaaguuguaguucaggcacagaaagaauauccugauguccaugacuuca

SEQ ID NO: 48208 - RNA, 64 nt, Homo Sapiens
ucugauaaaccucuuaguaucuauaaacuauaggagaaagaaguuauggacugggcaaagccca

SEQ ID NO: 48209 - RNA, 64 nt, Homo Sapiens
aaggaaggaaaaacuuguuaacaaagagagagaaagaaagaagguguauuguauugauaauugg

SEQ ID NO: 48210 - RNA, 64 nt, Homo Sapiens
aaggaaggaaggaaaaacuuuuggacaaagagagagaaagaaagcaauuguauuguauugauaa

SEQ ID NO: 48211 - RNA, 64 nt, Homo Sapiens
gagcaagacuccaucucaaaaauaaaauaaaaaaagaaagaaagaaaagaagaagaaaagagaa

SEQ ID NO: 48212 - RNA, 64 nt, Homo Sapiens
aagacuccaucucaaaaauaaaauaaaaaaagaaagaaagaaaagaagaagaaaagagaagaag

SEQ ID NO: 48213 - RNA, 64 nt, Homo Sapiens
gcagcagagagcuuuuugcacuuuaaaaaaaaaaagaaagaaagaaaggucggaauuucuuuug

SEQ ID NO: 48214 - RNA, 64 nt, Homo Sapiens
cagagagcuuuuugcacuuuaaaaaaaaaaagaaagaaagaaaggucggaauuucuuuuggguc

SEQ ID NO: 48215 - RNA, 64 nt, Homo Sapiens
ugcuugcguuugaaacuacaacuugauaaccccuagaaagaagaggacaugaaaggaugcuggc

SEQ ID NO: 48216 - RNA, 64 nt, Homo Sapiens
auuugcauuuaaauugcaauccagcacacgugugagaaagaagaggcacuagucuaaaaggcug

SEQ ID NO: 48217 - RNA, 64 nt, Homo Sapiens
aaaggcagagaagaccagccgcaucuggagacugagaaagaaucccugagcuaugccuguugag

SEQ ID NO: 48218 - RNA, 64 nt, Homo Sapiens
gagaggcuagggugguguggguggaagauucaggagaaagaaagauggccaggggagggggucu

SEQ ID NO: 48219 - RNA, 64 nt, Homo Sapiens
aucuuuuuucuucccucauuuucugggauucucaagaaagaaaaaguaacccauuaucacucug

SEQ ID NO: 48220 - RNA, 64 nt, Homo Sapiens
cuaaagagcacuuuauuucuuugaagccuuucuaagaaagaaaugggggugcgaguggcuugaa

SEQ ID NO: 48221 - RNA, 64 nt, Homo Sapiens
aaagagaaaaaaauaaaaaucaaaaaaaaaaaaaagaaagaaagaaaccuccagcguauuuuau

SEQ ID NO: 48222 - RNA, 64 nt, Homo Sapiens
agaaaaaaauaaaaaucaaaaaaaaaaaaaagaaagaaagaaaccuccagcguauuuuaucacu

SEQ ID NO: 48223 - RNA, 64 nt, Homo Sapiens
aaagaaaccuccagcguauuuuaucacuaccuauagaaagaaauccugcuuugagaguauuugu

SEQ ID NO: 48224 - RNA, 64 nt, Homo Sapiens
cuuauuuggguaguuaaauuuugagauuaugcauagaaagaauccaugcuauagguuuauuucc

SEQ ID NO: 48225 - RNA, 64 nt, Homo Sapiens
aauaccauuuugagugagaaaguacuuuuaaacaagaaagaaauuguacauuaugacuaaaguu

SEQ ID NO: 48226 - RNA, 64 nt, Homo Sapiens
gcuuauuaugaguuuaagaagcaguucuuccuccagaaagaagggggcgauagcaugcagguac

SEQ ID NO: 48227 - RNA, 64 nt, Homo Sapiens
ucgagcaaaagcaaagauccaccgagagaagaagagaaagaaaagaaaaagaaaaagcacaaaa

SEQ ID NO: 48228 - RNA, 64 nt, Homo Sapiens
uaauuuuuaaagaaugggaguuguccuggggcuaagaaagaagaaaaggagaaucaaagauuga

SEQ ID NO: 48229 - RNA, 64 nt, Homo Sapiens
aucaagcaucaauuaauuauuuuuuaaaagauguagaaagaagaaacacuaguguccaauuuca

SEQ ID NO: 48230 - RNA, 64 nt, Homo Sapiens
aaggcagaagcccuggauucaaaagaaaaaagaaagaaagaaaaaccucugucucaaaaaaaaa

SEQ ID NO: 48231 - RNA, 64 nt, Homo Sapiens
aaaaaaggcagaagcccuggaaaaaaaagaaaaaagaaagaaaggcgaaccucugucucaaaaa

SEQ ID NO: 48232 - RNA, 64 nt, Homo Sapiens
aguaugaauggucaaaaugauuaucuucuuagaaagaaagaaaauugcaaagcacucagcucaa

SEQ ID NO: 48233 - RNA, 64 nt, Homo Sapiens
aaaaaguaugaauggucaaaucaauuaucuucuuagaaagaaagucauuugcaaagcacucagc

SEQ ID NO: 48234 - RNA, 64 nt, Homo Sapiens
gccuuucaagaaucaaacuuugguaagccuucaaagaaagaaaguauggaggagguugugaugg

SEQ ID NO: 48235 - RNA, 64 nt, Homo Sapiens
uaacaggcacugauggggagugggcaauauuugaagaaagaauucucaggaaaagacuaguauu

SEQ ID NO: 48236 - RNA, 64 nt, Homo Sapiens
ccaacuguggucauccagaguaauaucauuugguagaaagaaaauauuuauaugauuccuaaca

SEQ ID NO: 48237 - RNA, 64 nt, Homo Sapiens
uuacugccuuaauaaaaaaucuccgccuccaggaagaaagaaugagccucagaugauuuccccc

SEQ ID NO: 48238 - RNA, 64 nt, Homo Sapiens
uauuuuccagguacccuucuaaaucuagaggaaaagaaagaaguugauuuauuugcuucuucga

SEQ ID NO: 48239 - RNA, 64 nt, Homo Sapiens
ugaugaaaagaguaguucaauaagaaagaaaugaagaaagaaaacagguaaaaggugaucccuc

SEQ ID NO: 48240 - RNA, 64 nt, Homo Sapiens
gaagaaagaaaaugaugaaaaggugaucccucuaagaaagaaauguucgaaccuuucagguaaa

SEQ ID NO: 48241 - RNA, 64 nt, Homo Sapiens
aaggaugguuaagccauuggaccaaaaagcaaacagaaagaaggcucuuuguaacccagccacc

SEQ ID NO: 48242 - RNA, 64 nt, Homo Sapiens
ugucuccuuuccuggaaagccucacacagggcugagaaagaaagcuuucugggcuaacauaguc

SEQ ID NO: 48243 - RNA, 64 nt, Homo Sapiens
uucccuuuggggauagucugagaaaacaagagaaagaaagaacgggcugccccuuggaucaagc

SEQ ID NO: 48244 - RNA, 64 nt, Homo Sapiens
aacguucccuuuggggauagaagcagaaaacaagagaaagaaaggcgaggcugccccuuggauc

SEQ ID NO: 48245 - RNA, 64 nt, Homo Sapiens
agauugagaaauuggaugguugccgugucuguguagaaagaaguagacaugggagacuuuucau

SEQ ID NO: 48246 - RNA, 64 nt, Homo Sapiens
aggccagugcuuuuuccucuuaggguuucuuugcagaaagaaaccuccagcaagggaagagagg

SEQ ID NO: 48247 - RNA, 64 nt, Homo Sapiens
ggaaacccaagagcugccugaaaaaaaaaaagaaagaaagaaaaagagcgagacuccgucucaa

SEQ ID NO: 48248 - RNA, 64 nt, Homo Sapiens
aaaaggaaacccaagagcugucaaaaaaaaaaaaagaaagaaagcaacagagcgagacuccguc

SEQ ID NO: 48249 - RNA, 64 nt, Homo Sapiens
gcugccuuugcaaaaauccuagagagagaaagaaagaaagaaagaaagaaagaaagaaagagag

SEQ ID NO: 48250 - RNA, 64 nt, Homo Sapiens
aaaggcugccuuugcaaaaaagagagagagagaaagaaagaaaguuggaaagaaagaaagaaag

SEQ ID NO: 48251 - RNA, 64 nt, Homo Sapiens
aaagaaaggcugccuuugcaaaagagagagagagagaaagaaaguuauuuggaaagaaagaaag

SEQ ID NO: 48252 - RNA, 64 nt, Homo Sapiens
agagagagagagaaagaaaguuauuuggaaagaaagaaagaaaggcaccauaaugaggaaaaag

SEQ ID NO: 48253 - RNA, 64 nt, Homo Sapiens
aaagagagagagagagaaagaaaguuauuuggaaagaaagaaaguaaagcaccauaaugaggaa

SEQ ID NO: 48254 - RNA, 64 nt, Homo Sapiens
gagacauugugaaaaggcaaauuuguauauguagagaaagaauaguaguaacuguuucauagca

SEQ ID NO: 48255 - RNA, 64 nt, Homo Sapiens
uuauuguagaauaagucauuguauuuuuaacaccagaaagaaccuugccgaucaccaggcauaa

SEQ ID NO: 48256 - RNA, 64 nt, Homo Sapiens
auuuuucauuucucuuguaccaauguccaaaacaagaaagaaugcaaugcuuuugagccucugg

SEQ ID NO: 48257 - RNA, 64 nt, Homo Sapiens
gugggugugaagggguagaugaaagcuuuaauuuagaaagaaaguucaaguaaaggaaauuauu

SEQ ID NO: 48258 - RNA, 64 nt, Homo Sapiens
guuacaguacucugugggaaacauaugaguauauagaaagaaaagucauuucuuuuuccuuaaa

SEQ ID NO: 48259 - RNA, 64 nt, Homo Sapiens
auuuccauuaaguagaauucauucagggaugaaaagaaagaauaaugggagauuguuuucagga

SEQ ID NO: 48260 - RNA, 64 nt, Homo Sapiens
guaguuagguucccuaacacgugcauuuucucacagaaagaauagucaacuuuugggacuuggg

SEQ ID NO: 48261 - RNA, 64 nt, Homo Sapiens
acuaacaaaaggaacaacgauuuguauauuguugagaaagaaacgauaguccuguaguguuauu

SEQ ID NO: 48262 - RNA, 64 nt, Homo Sapiens
ucucucucucaaaaaaaaaaaaaaaaaaaaggaaagaaagaaagaaaagaaaagaaaauccuuu

SEQ ID NO: 48263 - RNA, 64 nt, Homo Sapiens
ucucucaaaaaaaaaaaaaaaaaaaaggaaagaaagaaagaaaagaaaagaaaauccuuuuugc

SEQ ID NO: 48264 - RNA, 64 nt, Homo Sapiens
cgggacagagugagacccugucugaaagaaagagagaaagaaagaaagaaagagagagaaagaa

SEQ ID NO: 48265 - RNA, 64 nt, Homo Sapiens
acagagugagacccugucugaaagaaagagagaaagaaagaaagaaagagagagaaagaaagaa

SEQ ID NO: 48266 - RNA, 64 nt, Homo Sapiens
agugagacccugucugaaagaaagagagaaagaaagaaagaaagagagagaaagaaagaaagaa

SEQ ID NO: 48267 - RNA, 64 nt, Homo Sapiens
ugaaagaaagagagaaagaaagaaagaaagagagagaaagaaagaaagaaagaaagggaaagau

SEQ ID NO: 48268 - RNA, 64 nt, Homo Sapiens
agaaagagagaaagaaagaaagaaagagagagaaagaaagaaagaaagaaagggaaagauggaa

SEQ ID NO: 48269 - RNA, 64 nt, Homo Sapiens
agagagaaagaaagaaagaaagagagagaaagaaagaaagaaagaaagggaaagauggaaggaa

SEQ ID NO: 48270 - RNA, 64 nt, Homo Sapiens
agaaagaaagaaagaaagagagagaaagaaagaaagaaagaaagggaaagauggaaggaaggaa

SEQ ID NO: 48271 - RNA, 64 nt, Homo Sapiens
aaggaaggaaaaagaaagagaaagagagagagagagaaagaaaaagaaagaaaaguaagaaaga

SEQ ID NO: 48272 - RNA, 64 nt, Homo Sapiens
aaagaaagagaaagagagagagagagaaagaaaaagaaagaaaaguaagaaagaaaaaagaaaa

SEQ ID NO: 48273 - RNA, 64 nt, Homo Sapiens
gagagagagagagaaagaaaaagaaagaaaaguaagaaagaaaaaagaaaaagaaagaaaagua

SEQ ID NO: 48274 - RNA, 64 nt, Homo Sapiens
aaaaagaaagaaaaguaagaaagaaaaaagaaaaagaaagaaaaguaagaaagaaaaaaagaaa

SEQ ID NO: 48275 - RNA, 64 nt, Homo Sapiens
cccccucaaaaaaaaaaaaaaaaaaaaaaaaaacagaaagaaagaaaaagaaaacugcagauaa

SEQ ID NO: 48276 - RNA, 64 nt, Homo Sapiens
cucaaaaaaaaaaaaaaaaaaaaaaaaaacagaaagaaagaaaaagaaaacugcagauaacccu

SEQ ID NO: 48277 - RNA, 64 nt, Homo Sapiens
uggggggcccuaauggagagguguggguuuggcaagaaagaagcaacacagaugucguccccaa

SEQ ID NO: 48278 - RNA, 64 nt, Homo Sapiens
cuugggccucaguuucccgacuugcaaaauaagcagaaagaaccagaugcucuccagggucuuu

SEQ ID NO: 48279 - RNA, 64 nt, Homo Sapiens
gaaaaagaaaaucuuuuuuagacuauguagaaguagaaagaaaagauuguauuaauuuaaccag

SEQ ID NO: 48280 - RNA, 64 nt, Homo Sapiens
gaaaacaaaaagcacuuuuuaaaaaaaaaaaaaaagaaagaaaggaaagaauacuuuucuggca

SEQ ID NO: 48281 - RNA, 64 nt, Homo Sapiens
acaugcucauccuuugagucaaugugccgaagaaagaaagaaaauggagccgccacacccagcc

SEQ ID NO: 48282 - RNA, 64 nt, Homo Sapiens
aaaaacaugcucauccuuugagccaaugugccgaagaaagaaagggcauggagccgccacaccc

SEQ ID NO: 48283 - RNA, 64 nt, Homo Sapiens
cugagcagcagagcgggaccucgucucuaagaauagaaagaaagaaagagaaacgguguccucc

SEQ ID NO: 48284 - RNA, 64 nt, Homo Sapiens
gcagcagagcgggaccucgucucuaagaauagaaagaaagaaagagaaacgguguccuccgcac

SEQ ID NO: 48285 - RNA, 64 nt, Homo Sapiens
uagauaauuucaagaaacugaguaggacaaagggagaaagaaauacauguucuuuuuccugcaa

SEQ ID NO: 48286 - RNA, 64 nt, Homo Sapiens
gcuuauaaaauauacuacuagcuuuuaaguuuuaagaaagaagaacguaaguuguacaaagaua

SEQ ID NO: 48287 - RNA, 64 nt, Homo Sapiens
aaaauuguauguuaaugcuggaaagaaaaaaagaagaaagaaagaaaccaucccuguccuucag

SEQ ID NO: 48288 - RNA, 64 nt, Homo Sapiens
uuguauguuaaugcuggaaagaaaaaaagaagaaagaaagaaaccaucccuguccuucaguuua

SEQ ID NO: 48289 - RNA, 64 nt, Homo Sapiens
gaguucucaacugagugagcaucauggagggagaagaaagaaagaaguucagccugggugugug

SEQ ID NO: 48290 - RNA, 64 nt, Homo Sapiens
ucucaacugagugagcaucauggagggagaagaaagaaagaaguucagccugggugugugaagc

SEQ ID NO: 48291 - RNA, 64 nt, Homo Sapiens
cuacucuaucacaaggccaguaccacacucaugaagaaagaacacaggaguagcugagaggcua

SEQ ID NO: 48292 - RNA, 64 nt, Homo Sapiens
uacucuuucuaaaaauaauaauaauaaugcuaacagaaagaagagaaccguucguuugcaaucu

SEQ ID NO: 48293 - RNA, 64 nt, Homo Sapiens
caaauugauucaaauguuacuuuguaaguaaguaagaaagaaggugcgaguaguuccacacagg

SEQ ID NO: 48294 - RNA, 64 nt, Homo Sapiens
uacuucuagucagucauccaugucacauccuaauagaaagaaauuuccauuuuuuaaauguuca

SEQ ID NO: 48295 - RNA, 64 nt, Homo Sapiens
auuagaaaaauuacuuuaaauuuggcccucuugcagaaagaagccuaaaacaguauguucuggu

SEQ ID NO: 48296 - RNA, 64 nt, Homo Sapiens
cugcaugaguugcuuuuguauuccuggggcaaacagaaagaaauaaaauugaggaucucuguuu

SEQ ID NO: 48297 - RNA, 64 nt, Homo Sapiens
ugauagaauucaaaaaggccaaaauaauuguugaagaaagaaguaaacugaauccauguaagaa

SEQ ID NO: 48298 - RNA, 64 nt, Homo Sapiens
uaaauugaguaaaaucaucaccuaugggacuuccagaaagaaguacuuuucuuuucccccugua

SEQ ID NO: 48299 - RNA, 64 nt, Homo Sapiens
acaaggaguaagggggauuuccuuccagccagaaagaaagaaagaacugguugcauguaaaauu

SEQ ID NO: 48300 - RNA, 64 nt, Homo Sapiens
aaagacaaggaguaagggggaauuccuuccagccagaaagaaagaaauaacugguugcauguaa

SEQ ID NO: 48301 - RNA, 64 nt, Homo Sapiens
cuacugcucagcaauguaaaagagacaaauaaggagaaagaaaaucuccaaaccaggaauguuu

SEQ ID NO: 48302 - RNA, 64 nt, Homo Sapiens
auaggcuuuuacacagcacaugaagcaguaauccagaaagaaggaaaugcagaauuuuauuauc

SEQ ID NO: 48303 - RNA, 64 nt, Homo Sapiens
agaaccgccaccucaaugcaauuucaguuucccagggcuuaaccguaaaaauaggucagcagag

SEQ ID NO: 48304 - RNA, 64 nt, Homo Sapiens
agaaccgccaccucaaugcaauuucaguuucccagggcuuaaccguaaaaauagguuggcagag

SEQ ID NO: 48305 - RNA, 64 nt, Homo Sapiens
ugcagauacauucaugaggggagaggcgcccucccuuccugaggagcuguuggccugggugggc

SEQ ID NO: 48306 - RNA, 64 nt, Homo Sapiens
auguaggccccuggucugcccugggcucaucagccuuccugaccuccuccugcccuccccuuca

SEQ ID NO: 48307 - RNA, 64 nt, Homo Sapiens
aaagccuuggagaccagcgcaaacagaugcaaaccuuccugaauaccccugcacagugccuguc

SEQ ID NO: 48308 - RNA, 64 nt, Homo Sapiens
ucucugcauuuggagauucgugcuccaggcaccucuuccugaagaugugguggaugccagggcg

SEQ ID NO: 48309 - RNA, 64 nt, Homo Sapiens
aguggagauuggaucauuuaacaauauaacaaaacuuccugauuugauuuuacguaucuucuau

SEQ ID NO: 48310 - RNA, 64 nt, Homo Sapiens
aacuucacagagacucuguccuuccaugcaaaggcuuccugaaauagggagacugacugaguag

SEQ ID NO: 48311 - RNA, 64 nt, Homo Sapiens
ccuugucccucuuuuaugaucagggugaaauguacuuccugauguaaugaaccuaauuugauuu

SEQ ID NO: 48312 - RNA, 64 nt, Homo Sapiens
auguccaggaagaagcccauuuguugaggcugaccuuccugaucauacacacacacagcccagc

SEQ ID NO: 48313 - RNA, 64 nt, Homo Sapiens
cagucaaggccucugucugaaucagcacggcugccuuccugaccgcggggccuucugaugccca

SEQ ID NO: 48314 - RNA, 64 nt, Homo Sapiens
gauguguucgcuuguagggugcguguguguccaccuuccugaguaugaauguccguguacguca

SEQ ID NO: 48315 - RNA, 64 nt, Homo Sapiens
aaaaaucucuguagaguuagucuucuccuuuucucuuccugagaaguucuccugccugcauaac

SEQ ID NO: 48316 - RNA, 64 nt, Homo Sapiens
aaauuauaggcaagauacaauuauaugcguuccucuuccugaaauuauaacauuucuaaacuua

SEQ ID NO: 48317 - RNA, 64 nt, Homo Sapiens
aucucagaaaaggagagcuuguugugaaacacugcuuccugaaacuuccugcuauugccuaaag

SEQ ID NO: 48318 - RNA, 64 nt, Homo Sapiens
aaacuccugggcucaagcaauccuccugccucagcuuccugaguagcuggaaccacaggugugu

SEQ ID NO: 48319 - RNA, 64 nt, Homo Sapiens
uguccccuggagaaggucccuguuggguccucugcuuccugagcggucuuguucaagcagcgag

SEQ ID NO: 48320 - RNA, 64 nt, Homo Sapiens
caccccucuguccagccagcucccacgugcacagcuuccugagucccaggccaccugucuucuc

SEQ ID NO: 48321 - RNA, 64 nt, Homo Sapiens
uaaucuggguggcucagcuaaccucucuucuucccuuccugaagugacaaaggaaacucagucu

SEQ ID NO: 48322 - RNA, 64 nt, Homo Sapiens
guggcccccgaacccaagccucacuuuucugugccuuccugaggggguugggccggggaggaaa

SEQ ID NO: 48323 - RNA, 64 nt, Homo Sapiens
gugaccaagcuuccaaagcuuguuuggguguugccuuccugaaggauuuugguuccacaagcag

SEQ ID NO: 48324 - RNA, 64 nt, Homo Sapiens
cgcucuggucugcuccucaggauguuuacucucccuuccugaacgauguaguggcaaguguggc

SEQ ID NO: 48325 - RNA, 64 nt, Homo Sapiens
cugucugcccaguuucaccgggagaagucggccucuuccugaugggcaaccacaccacugccug

SEQ ID NO: 48326 - RNA, 64 nt, Homo Sapiens
cuccugcccaggggcuugucaccuuccccuccuccuuccugagucacuccuucaguagaaggcc

SEQ ID NO: 48327 - RNA, 64 nt, Homo Sapiens
ugaccucauucucuguccagaauguggacucccucuuccugagcaucuuauggaaauuacccca

SEQ ID NO: 48328 - RNA, 64 nt, Homo Sapiens
agaaaccuucaucuaaagcaagucacugugccaucuuccugaccacuacccucuuuccuagggc

SEQ ID NO: 48329 - RNA, 64 nt, Homo Sapiens
acaaucuugcucuugccaugauauuuaugguuuccuuccugagaaaggauuuuacauaaaugcc

SEQ ID NO: 48330 - RNA, 51 nt, Homo Sapiens
ccaugugcgguuucugaggcccuuccugaggccaccagcaggagggccuga

SEQ ID NO: 48331 - RNA, 64 nt, Homo Sapiens
gucaggguuggcuugugaaaccauuuucauuucacuuccugaaaggaucuucggauaaauucug

SEQ ID NO: 48332 - RNA, 64 nt, Homo Sapiens
cuuccccagaagcagaugccaccaugaguaaaagcuuccugaggcuucuccuauuuugccuucu

SEQ ID NO: 48333 - RNA, 64 nt, Homo Sapiens
cacaaauggaaugguuaauggucacaugccaucucuuccugacagccccuuuacagguuacauc

SEQ ID NO: 48334 - RNA, 64 nt, Homo Sapiens
caacaaagaagcuggaucucuggaggcuuccacccuuccugauuauucaccuuaagcgauuuca

SEQ ID NO: 48335 - RNA, 64 nt, Homo Sapiens
aauuuaaauuccuuuuaugaauagauuucccuuucuuccugaccccaaggucagaggagacuau

SEQ ID NO: 48336 - RNA, 64 nt, Homo Sapiens
uacgaguccuuuuucuuguagagguaaguaaaaucuuccugacaagguaguccucuuuucaugg

SEQ ID NO: 48337 - RNA, 64 nt, Homo Sapiens
accccagggaucccccagcucccccagccccuggcuuccugacccugcgccucacccucagacu

SEQ ID NO: 48338 - RNA, 64 nt, Homo Sapiens
cagcccuucagggcuucugguuccuucugccgcccuuccugagaccuuagaaaccagaagagcc

SEQ ID NO: 48339 - RNA, 64 nt, Homo Sapiens
agccccaagucccuucauuuuucccuuucccuuucuuccugacuaccccucucucuugccuucc

SEQ ID NO: 48340 - RNA, 64 nt, Homo Sapiens
uucccuucaccccucucucuuguccuuaacaccccuuccugagguacuagaugauuuuuccggu

SEQ ID NO: 48341 - RNA, 64 nt, Homo Sapiens
guugacaugccaguggguguagaacagaugccaucuuccugaauaugagguuuauggagccucc

SEQ ID NO: 48342 - RNA, 64 nt, Homo Sapiens
gaucaacugugucuuaaggcaagcuacgggauuccuuccugaaaugcagauuucggaaauuggc

SEQ ID NO: 48343 - RNA, 64 nt, Homo Sapiens
cucggguucuggcccccaaggucagagcaagcaucuuccugacagcauuuugucaucuaaaguc

SEQ ID NO: 48344 - RNA, 64 nt, Homo Sapiens
ucaaccagauucuagaaacugcggucauccaguucuuccugacaccggaugggugcuugggaac

SEQ ID NO: 48345 - RNA, 64 nt, Homo Sapiens
aggaggggguccgccagcagcuggagcugggccgcuuccugaggagccgcuacgaggccuuccu

SEQ ID NO: 48346 - RNA, 64 nt, Homo Sapiens
agcugggccgcuuccugaggagccgcuacgaggccuuccugaguccggaguaccggcgggagga

SEQ ID NO: 48347 - RNA, 64 nt, Homo Sapiens
ccgaguaccaggaggcccuggagggcuggacgggcuuccugagucgccuggagaacuucacggg

SEQ ID NO: 48348 - RNA, 64 nt, Homo Sapiens
cauugccucuugccuggauuauagccggggucuccuuccugaccacuuccugccuuuauucucu

SEQ ID NO: 48349 - RNA, 64 nt, Homo Sapiens
uggaaagcucuccaacccaucuucuacagcacagcuuccugaacaggguauaaguaugcugaga

SEQ ID NO: 48350 - RNA, 64 nt, Homo Sapiens
aaaucacaggguuggaaagacagagaaguuacaugacaaagauauuuuuugaugaaaugaguca

SEQ ID NO: 48351 - RNA, 64 nt, Homo Sapiens
agaggaaauaucuucccuuugcauaaaaaacuaagacaaagaccaauagaguaaaauaucugcu

SEQ ID NO: 48352 - RNA, 64 nt, Homo Sapiens
aucccuaaaaaaaugaucauuacagauguuuagugacaaagaaucaauauguaaaaaguauaau

SEQ ID NO: 48353 - RNA, 64 nt, Homo Sapiens
uauagaaaaaaauagauuuuuaaaauucagaauggacaaagagaauauucauuuucuuauuaau

SEQ ID NO: 48354 - RNA, 64 nt, Homo Sapiens
agccaccgggagaggcuuccaacugggguaagaagacaaagaguggcuucugcaagcugcacag

SEQ ID NO: 48355 - RNA, 64 nt, Homo Sapiens
uaugugauguucuauguggaugauuguuuuaaaugacaaagacauauuuuuacacuggaaacgu

SEQ ID NO: 48356 - RNA, 64 nt, Homo Sapiens
ccagaugugaaaugggagccccaaguucugagguaacucucagcgugcagagagugucaguuuc

SEQ ID NO: 48357 - RNA, 64 nt, Homo Sapiens
auuuacagccuucaguuguaauccuauuauaaccaacucucaggcauuuaaaaauccaggccag

SEQ ID NO: 48358 - RNA, 64 nt, Homo Sapiens
uugguuuucuuacgauacagggccauuuuuuuaaaacucucaggacugaacagaagagaaaaau

SEQ ID NO: 48359 - RNA, 64 nt, Homo Sapiens
caggcguccaauccuagaaaccaauggucuccagaacucucacacaaguguuuuucugauucua

SEQ ID NO: 48360 - RNA, 64 nt, Homo Sapiens
aaugggauuguguguuuuauuuuggagggauuaaaggucauaguuugguccucaguauaaaauc

SEQ ID NO: 48361 - RNA, 64 nt, Homo Sapiens
acauugcacacugugauuauuuuucagcuaugguaggucauauuuuguuuuauaccagagcugu

SEQ ID NO: 48362 - RNA, 64 nt, Homo Sapiens
ugaaauccugccaauuuuccuuccugauucuuaaaggucauacucuaaagcauaaguuagucuu

SEQ ID NO: 48363 - RNA, 64 nt, Homo Sapiens
ugaggcaagcuaaaaacuuauucuagaagaacaaaggucauauuacugauuuuggaggaaauuu

SEQ ID NO: 48364 - RNA, 64 nt, Homo Sapiens
ccuagagucaguguccuguugaacggguauggacaggucauaaaguggguacccagcugcugug

SEQ ID NO: 48365 - RNA, 64 nt, Homo Sapiens
gugcucuucuguuuacaagagcuccuuugaaaacaggucauauuucagaaccagauuccugccg

SEQ ID NO: 48366 - RNA, 64 nt, Homo Sapiens
caauuggaaaagggaaagacguucugaguguccgaggucauaagugggugguuucacaucagug

SEQ ID NO: 48367 - RNA, 64 nt, Homo Sapiens
caugaauaauacucaguauacaugaagaauuucuaggucauaaaaucacccuuuucagcccucc

SEQ ID NO: 48368 - RNA, 64 nt, Homo Sapiens
guauuucacaauuaaaaaacaacaauguucuuacaggucauaauacccugaauagaauaggaag

SEQ ID NO: 48369 - RNA, 64 nt, Homo Sapiens
augucucgaguccuaaggccgccccuauugggagaggucauaaacaccaggggugcucaccucu

SEQ ID NO: 48370 - RNA, 64 nt, Homo Sapiens
cuaaagauuuuuauucugauuuuuucauaaucaaaggucauaugauacuguauagacaagcuuu

SEQ ID NO: 48371 - RNA, 64 nt, Homo Sapiens
augugcuuucuuaaagaaugccaaaaguguaauaaggucauaacugcauuuaucaugaacacua

SEQ ID NO: 48372 - RNA, 64 nt, Homo Sapiens
cacugcgccuggccuugaugugugaauauuugagaggucauaagcagugguuuuggccauaccg

SEQ ID NO: 48373 - RNA, 64 nt, Homo Sapiens
auugugauuccuccuuuuagucuaauaucuuuccaggucauacuuguuuuuaaucauuaaauau

SEQ ID NO: 48374 - RNA, 64 nt, Homo Sapiens
agaagaccaaaacuuggugaauagucccagugcuaggucauauaggaaacagaaagcaugacag

SEQ ID NO: 48375 - RNA, 64 nt, Homo Sapiens
uaauguauauauugugaguauuuauuagauucguaggucauauuacuuaucaacugagccaaau

SEQ ID NO: 48376 - RNA, 64 nt, Homo Sapiens
ccucuuagccagugagcuaaauauggcuaagcacaggucauaagagcaccuaaggccagcauau

SEQ ID NO: 48377 - RNA, 64 nt, Homo Sapiens
aauucagucuuuuaggggcaccaaguaaagcauaaggucauauauacuauacaauauguuuauu

SEQ ID NO: 48378 - RNA, 64 nt, Homo Sapiens
aaggucauuugcuaacuagcuuggaaacuggaugaggucauagcagugcuugauugcguggaau

SEQ ID NO: 48379 - RNA, 64 nt, Homo Sapiens
gaaagcaagcgagugaauuagaggacgggugaagaggucauaaccuuuuuaaguguauauuuug

SEQ ID NO: 48380 - RNA, 64 nt, Homo Sapiens
gaugcaagaaguggguuccccaggucucacauccaggucauacuagaauaaucuccuuugacuc

SEQ ID NO: 48381 - RNA, 64 nt, Homo Sapiens
ggcuagaaugcagcuuuucugcagaugcauuauuaggucauacuacuccuccugcugguggauu

SEQ ID NO: 48382 - RNA, 64 nt, Homo Sapiens
cauaguuuucauagguguuucuuacauuuuauagaggucauauguauuaugggauguuggcaau

SEQ ID NO: 48383 - RNA, 64 nt, Homo Sapiens
agugcacuccaggcgggugaguugcagugagccaaggucauacccuugaacccaggaggcagag

SEQ ID NO: 48384 - RNA, 64 nt, Homo Sapiens
gguuauaacaaaauacauuuauaaguauuauuuuaggucauaaaauguuuauauguuugacugc

SEQ ID NO: 48385 - RNA, 64 nt, Homo Sapiens
ugcggcaucauaguuaugucaauaaaguuuauuuaggucauagaauauccuaaaguaucacaua

SEQ ID NO: 48386 - RNA, 64 nt, Homo Sapiens
aacaauaagaacaaguuuuggcagccaugauaauaggucauauguuguguuugguucaauuuuu

SEQ ID NO: 48387 - RNA, 64 nt, Homo Sapiens
gucaguccuacaaaaauaaacuguguuuucacgcaggucauauuuccaaggucccauuuucccc

SEQ ID NO: 48388 - RNA, 64 nt, Homo Sapiens
agaucugagugccccacagaagccacugucaugcaggucauaucgucuggacacugccacaugg

SEQ ID NO: 48389 - RNA, 64 nt, Homo Sapiens
caauuccuccagagacacuggcaucuacuuggcaaggucauagacauucauuccauguccauau

SEQ ID NO: 48390 - RNA, 64 nt, Homo Sapiens
caaagaccauaauugaugauauaaagcuuuuugaaggucauaaaggcacuuaaauuuuuucuuu

SEQ ID NO: 48391 - RNA, 64 nt, Homo Sapiens
cagaagcuaagcugggugcaauuccaagauacugaggucauaaucauaguauuccucaguaucu

SEQ ID NO: 48392 - RNA, 64 nt, Homo Sapiens
cuuugucaggaaauauaaacuacaggauggaaaaaggucauaucgugguucuuuuucucugaau

SEQ ID NO: 48393 - RNA, 64 nt, Homo Sapiens
gcuuuugcagggucaaugguagaacgugcuucuuaggucauaacgcggggggagguggguguga

SEQ ID NO: 48394 - RNA, 64 nt, Homo Sapiens
ugagauuccugguucgggugguagcuaagugaaaaggucauagcaucuuggacugacauuuagc

SEQ ID NO: 48395 - RNA, 64 nt, Homo Sapiens
aauauuguuaugugggaccauccuccuugucuuaaggucauaaauuuccuuguagagguuuuuu

SEQ ID NO: 48396 - RNA, 64 nt, Homo Sapiens
ccaaauuguauauuggauugcauuuugggguccuaggucauacguucuucaaaauuauuaugau

SEQ ID NO: 48397 - RNA, 64 nt, Homo Sapiens
ugaauugaaugaagacaucucaguacacucuuuuaggucauaguaguugccauuuuguaaaauu

SEQ ID NO: 48398 - RNA, 64 nt, Homo Sapiens
aaaguuguauuuucccacaaauauaguaugaaugaggucauauuaaagaacagcaacuguuaau

SEQ ID NO: 48399 - RNA, 64 nt, Homo Sapiens
ccuggugcacagugcuuagaaguaagcaauucccaggucauagcucaagaauuguuagcaaaug

SEQ ID NO: 48400 - RNA, 64 nt, Homo Sapiens
gcuuucagcaauugaugucaauguagcauaacaaaggucauaauucacauuuuguaucaguauu

SEQ ID NO: 48401 - RNA, 64 nt, Homo Sapiens
ugcaugagaauucaacuauuagaaagcuguaugcaggucauauaucacgauaaaaguuaaacaa

SEQ ID NO: 48402 - RNA, 64 nt, Homo Sapiens
ccaaacuaguuguguauuaagauaaguucaauaaaggucauaucacauuauuuccacucuggug

SEQ ID NO: 48403 - RNA, 64 nt, Homo Sapiens
guuuuuacuauguuuaaaaaguuuuauuuuaauaaggucauauuaggcacguauaguuaagaga

SEQ ID NO: 48404 - RNA, 64 nt, Homo Sapiens
aauuuauuuucuuuugugggaggugggaucaaagaggucauaaguguuuauugugagauauuuc

SEQ ID NO: 48405 - RNA, 64 nt, Homo Sapiens
uuuauuuuuuguagcaguggccgaaaguccugcaaggucauaaaucuuucagagugacaucacc

SEQ ID NO: 48406 - RNA, 64 nt, Homo Sapiens
uguugguucuugaaaccuuagcuagaagaauuucaggucauaccaacauguggauaggcuauag

SEQ ID NO: 48407 - RNA, 64 nt, Homo Sapiens
caaacgaaagcacaggcuacucagacuuggccacaggucauaggucagagaauuuuuucuucaa

SEQ ID NO: 48408 - RNA, 64 nt, Homo Sapiens
uaugaguauuacuaguugauaaucaguuuugucuaggucauaacauaccauuuguaaguuuguu

SEQ ID NO: 48409 - RNA, 64 nt, Homo Sapiens
cagugauuuuuguuauaugaaucaguaauauugaaggucauaaucaucaaaucaguuuccaugc

SEQ ID NO: 48410 - RNA, 64 nt, Homo Sapiens
agaaaucaucaauugagguagcaguguauuugcuaggucauaccagacugaaauuucagugaaa

SEQ ID NO: 48411 - RNA, 64 nt, Homo Sapiens
auugucucuggucugaccaagauauucauguuugaggucauaaauuugagagcucuuguuagcu

SEQ ID NO: 48412 - RNA, 64 nt, Homo Sapiens
agaugcauauaaaggguggaaugggagccauggcaggucauagaguccucucaaugggaaccug

SEQ ID NO: 48413 - RNA, 64 nt, Homo Sapiens
uaaaaugaacuuuuaacacuuggcucaaaccucuaggucauacugccaaucuuuagacaaaugg

SEQ ID NO: 48414 - RNA, 64 nt, Homo Sapiens
aauguuaaguuucaagaaaguuuaccuuugcuuuaggucauaaguuccuuauuugauugcugua

SEQ ID NO: 48415 - RNA, 64 nt, Homo Sapiens
gauaaccuaagagcauuaagcucugaguccagugaggucauagcaguguaugcuccuugcccuu

SEQ ID NO: 48416 - RNA, 64 nt, Homo Sapiens
cacaucugcuaagugaucauuuucugccauaccaaggucauaauuccuuccgugagaaauauuu

SEQ ID NO: 48417 - RNA, 64 nt, Homo Sapiens
cugugauucagaugaagccaauauauuuaaucucaggucauagaaugauugaaagugagaacaa

SEQ ID NO: 48418 - RNA, 64 nt, Homo Sapiens
uacuuacugccuuagucccaaagugacuuccucgaggucauaguaacugagacccagagagcuu

SEQ ID NO: 48419 - RNA, 64 nt, Homo Sapiens
uucuugagcuguugugguuugauuucuuuauauaaggucauagaguuguauuuuguacauuuug

SEQ ID NO: 48420 - RNA, 64 nt, Homo Sapiens
ccaccguuggagcccagcugccuggccugggaggaggucauaccuucuucccugccuuggaagc

SEQ ID NO: 48421 - RNA, 64 nt, Homo Sapiens
aacaugggggugagacugaagccugaggaauuaaaggucauaugacagggcuguuaccucaaag

SEQ ID NO: 48422 - RNA, 64 nt, Homo Sapiens
auauauacuuuuagacccacagugaaaccacagaaggucauauuuuguaccuuaaaccaguagc

SEQ ID NO: 48423 - RNA, 64 nt, Homo Sapiens
ccggucaccaguccucuugcugcccaugguucauaggucauagaaggcagcaaugcacugacug

SEQ ID NO: 48424 - RNA, 64 nt, Homo Sapiens
ggucaccaaacuaguaacuaguggggcuuaaugaaggucauaaguuucugagaugggagagcaa

SEQ ID NO: 48425 - RNA, 64 nt, Homo Sapiens
aagccuacuuauuagaaacaaugaaguucacaauaggucauaaggucucuuccuuuucuaaaau

SEQ ID NO: 48426 - RNA, 64 nt, Homo Sapiens
cacguuaaaaguugaccaauuucagaacuguuaaaggucauaugguuacuggccaaggcuauuu

SEQ ID NO: 48427 - RNA, 64 nt, Homo Sapiens
cugccacucccgucgcagagaaugucucaaaaauaggucauaucuuaaggccuguucucagcac

SEQ ID NO: 48428 - RNA, 64 nt, Homo Sapiens
aauauauuuccauuaaaaaacucauaauuuauacaggucauauuguggcgccacuguuuugaau

SEQ ID NO: 48429 - RNA, 64 nt, Homo Sapiens
ugaaugucuagugagacauuugcagacgagcuauaggucauacaagaaaaugaggauauauucu

SEQ ID NO: 48430 - RNA, 64 nt, Homo Sapiens
gauguuaaacgucacagcaguacuugcucaauaaaggucauauuggaaacauagucaauugcug

SEQ ID NO: 48431 - RNA, 64 nt, Homo Sapiens
ugaucaucuugaugucuaugauagauaauaaacaaggucauacauaccuuacuaaacaauuuug

SEQ ID NO: 48432 - RNA, 64 nt, Homo Sapiens
uuuuuugcuacuuuugcuguaaauguuuuuaaaaaggucauauaacaaaaaagaaaaaaaagga

SEQ ID NO: 48433 - RNA, 64 nt, Homo Sapiens
uagccucaauugaguuuuuuuacuauagaguaauaggucauauagucaaagauuaacaaugcua

SEQ ID NO: 48434 - RNA, 64 nt, Homo Sapiens
agggcacauuucugaccgaagucccuuagcagucaggucauaacguguuuaagaaagcaagcaa

SEQ ID NO: 48435 - RNA, 64 nt, Homo Sapiens
ugugugaucccaccccacccccauaguuguauaaaggucauagugaagaagcugggggaagacu

SEQ ID NO: 48436 - RNA, 64 nt, Homo Sapiens
caagguauuauaucagccccuugcuugaggcuugaggucauaauaucccucuaggacuuaccug

SEQ ID NO: 48437 - RNA, 64 nt, Homo Sapiens
aaauuugccaucaccuuuugugugguggccuggcaggucauauacuuuuuuuuggcauauaccu

SEQ ID NO: 48438 - RNA, 64 nt, Homo Sapiens
agcuuucccaucaugaaucauguucgaaugugaaaggucauaauauuuacacaacaaaaugaca

SEQ ID NO: 48439 - RNA, 64 nt, Homo Sapiens
uuucauguuugcuuuuguuugguggagugaagucaggucauaaggucauaaugcaggcaugaag

SEQ ID NO: 48440 - RNA, 64 nt, Homo Sapiens
uguuuuucuuuaucauucaucccaagauauugagaggucauaucacaucauccuaacuuacuuc

SEQ ID NO: 48441 - RNA, 64 nt, Homo Sapiens
ugccuuaccuccagagaguccaaccagcuucuccaggucauaugaaagugaugaccuuacacca

SEQ ID NO: 48442 - RNA, 64 nt, Homo Sapiens
ggugaacaugccaucaguaaaagcccuggaaacaaggucauacuagagauugguugugccuugu

SEQ ID NO: 48443 - RNA, 64 nt, Homo Sapiens
ugcuccccugcucccuguuguguuagggauguuuaggucauacuaggagcaauuaggagccaua

SEQ ID NO: 48444 - RNA, 64 nt, Homo Sapiens
cuuagaauccacguauuccccuucccacuagccuaggucauaaagaggcguugcuuucacucuc

SEQ ID NO: 48445 - RNA, 64 nt, Homo Sapiens
ugagaaucaguggaaaauaaggguauaauuuuguaggucauaugauugaagaaaauauuauuuu

SEQ ID NO: 48446 - RNA, 64 nt, Homo Sapiens
aaaaacccaucuucauuccuuuuuauggggcuccaggucauaaggaugagauauauuuggggua

SEQ ID NO: 48447 - RNA, 64 nt, Homo Sapiens
aauacugugguugugguuguaaguagcuaagaugaggucauacuggagcagggcaggcccuuaa

SEQ ID NO: 48448 - RNA, 64 nt, Homo Sapiens
guucacuggagagaaaagguaguguuuuuguacaaggucauaccgccagaagccccaaauccua

SEQ ID NO: 48449 - RNA, 64 nt, Homo Sapiens
gcccgugggcagggcuguggucagccaagaauagaggucauauaguugggccauggggcaauug

SEQ ID NO: 48450 - RNA, 64 nt, Homo Sapiens
uuccucggagaccuguuuaauuuuuuguucucugaggucauaauuucaugaaagcuauagaucc

SEQ ID NO: 48451 - RNA, 64 nt, Homo Sapiens
auucuggggacucucuuuaaggauccaggccugaaggucauacaacucugugcuacacaggagu

SEQ ID NO: 48452 - RNA, 64 nt, Homo Sapiens
cuccaacaguuuucagagcuacaguuucagucccaggucauacuugacacuggcuaugugcucc

SEQ ID NO: 48453 - RNA, 64 nt, Homo Sapiens
gagagugggaacucaacccacagugagagguugaaggucauaaccuccgugcagcccuugggaa

SEQ ID NO: 48454 - RNA, 64 nt, Homo Sapiens
uuuuuaaaaggaccuggauugcacauucauuccaaggucauagagcuuucagaucagguauucu

SEQ ID NO: 48455 - RNA, 64 nt, Homo Sapiens
ccagacaccgacacccugaggacguguggagcuaaggucauaucaucugaccaggucuggaggc

SEQ ID NO: 48456 - RNA, 64 nt, Homo Sapiens
acugugggacugagaguccuauuccccuaguaauaggucauauuccccuaguaauaugaguucu

SEQ ID NO: 48457 - RNA, 64 nt, Homo Sapiens
gcaccauccaucauuauguagaugaaaaagccauaggucauagccucuuugcuauucuauugga

SEQ ID NO: 48458 - RNA, 64 nt, Homo Sapiens
gcuagcgaguggcgggccugcgguaaugagucccaggucauacgccgaggugcucagaaaggcu

SEQ ID NO: 48459 - RNA, 64 nt, Homo Sapiens
ggagcaugauaggauuugggggggucuggaaagaaggucauaagcaggugggaucggcacucag

SEQ ID NO: 48460 - RNA, 64 nt, Homo Sapiens
ucaagauaaggaagcaacacugauacugagagagaggucauauguccaauaguugccuuucuuc

SEQ ID NO: 48461 - RNA, 64 nt, Homo Sapiens
aacgauucgucuucuauguacucucuaauuaaccaggucauaaaaugggaacgcaaggcagcaa

SEQ ID NO: 48462 - RNA, 64 nt, Homo Sapiens
gugcuuuagcaucuaugccacaugcguugauggaaggucauagcacccacucacuuagaugcua

SEQ ID NO: 48463 - RNA, 64 nt, Homo Sapiens
cuucuuaagcagagguguucaaggaagggagggaaggucauagcucaaacaaaacuaaguugug

SEQ ID NO: 48464 - RNA, 64 nt, Homo Sapiens
uucucagggguucaaauuucacuuagacaugauuaggucauacaguuaauacuaagauguucaa

SEQ ID NO: 48465 - RNA, 64 nt, Homo Sapiens
agagauauuuauguacucucuaagaagacaaaugaggucauaaacacugcauaaagcaaggcaa

SEQ ID NO: 48466 - RNA, 64 nt, Homo Sapiens
aucaaaauauguugucacagaaagaauagguggaaggucauagccuggaacccaaguuugaaaa

SEQ ID NO: 48467 - RNA, 64 nt, Homo Sapiens
ucugucaaucucuagaaaccacaagaugauggagaggucauaaaaacugugguaguaugcuuag

SEQ ID NO: 48468 - RNA, 64 nt, Homo Sapiens
agggcugagguuuuaagccagggcuggagggcaaaggucauaaccucaccagccaccucugagg

SEQ ID NO: 48469 - RNA, 64 nt, Homo Sapiens
aacacggggacucugccguaacuggaaucuucauaggucauauugaaaucuucaaggugaccau

SEQ ID NO: 48470 - RNA, 64 nt, Homo Sapiens
cucaguaaauguacaacugcaccugucaucauggaggucauacaugcauacaaagagguguaca

SEQ ID NO: 48471 - RNA, 64 nt, Homo Sapiens
gggcagagucagaacuaaacgaaggaggagccccaggucauacaauggagggucccagaaaagg

SEQ ID NO: 48472 - RNA, 64 nt, Homo Sapiens
uuucauguccauugaagaauucuauagucucucuaggucauagcggcguacgcuuaccagcgac

SEQ ID NO: 48473 - RNA, 64 nt, Homo Sapiens
agaaaggaguuugccaagaagugaucuguuuuaaaggucauauuuggagaaagggcaaggaauu

SEQ ID NO: 48474 - RNA, 64 nt, Homo Sapiens
ccuccgcucagagaugcugcuucauuuacccaggaggucauauucuuuauauauauuuuuuguu

SEQ ID NO: 48475 - RNA, 64 nt, Homo Sapiens
ucuuacaacugacugacuuagcaggaauuuaauuaggucauauuuggugaugagacuuauggag

SEQ ID NO: 48476 - RNA, 64 nt, Homo Sapiens
agacucucuagcuccaucuccccugugccacccuaggucauaugaccuuggccaccuuggagua

SEQ ID NO: 48477 - RNA, 64 nt, Homo Sapiens
aucuacucuccucaucucuagaggggggaagaucaggucauacuuacuguuaaaggaaaaaaaa

SEQ ID NO: 48478 - RNA, 64 nt, Homo Sapiens
uuguguuugguuauuguuacuucuuguuuuccaaaggucauacaagaaaugauccauuugcugu

SEQ ID NO: 48479 - RNA, 64 nt, Homo Sapiens
ccuucccugccccucgcugucuuacuaugggaagaggucauauccuugccaggcuuccuuauuc

SEQ ID NO: 48480 - RNA, 64 nt, Homo Sapiens
gcuggggcucuguaaugaauuaguuuaaaagccaaggucauaacaugaauugauggucaauuuc

SEQ ID NO: 48481 - RNA, 64 nt, Homo Sapiens
caccaauucugaaggcacuuuauguacuacauggaggucauaucugguuuuguuuuuauuuuuu

SEQ ID NO: 48482 - RNA, 64 nt, Homo Sapiens
acauccuaaaauggugaaguugccaugacaauaaaggucauagaaccugguagugucaaauuua

SEQ ID NO: 48483 - RNA, 64 nt, Homo Sapiens
gagaugaguuuguaugcugugucauaguuucaguaggucauaggcuagaguagcuuaaaaaguu

SEQ ID NO: 48484 - RNA, 64 nt, Homo Sapiens
ucucucaaagagcaucccuuucuauacauaagagaggucauacaggugagagacaccaaguaua

SEQ ID NO: 48485 - RNA, 64 nt, Homo Sapiens
gacuuugcugauaaaacagauccguacaagauacaggucauaaaucacaggaugagacaggagg

SEQ ID NO: 48486 - RNA, 64 nt, Homo Sapiens
gugaucuaguauguaacugggcagcugaauggcuaggucauaugauacaugagaaauguaccuu

SEQ ID NO: 48487 - RNA, 64 nt, Homo Sapiens
gucuuuguccuuuuucuugcacuauaaaauuauaaggucauaaauguuuugguacuuguagaug

SEQ ID NO: 48488 - RNA, 64 nt, Homo Sapiens
gcauuggaguuucaaaucccggaggcauugacauaggucauaaaaggaagcagaagacgggagg

SEQ ID NO: 48489 - RNA, 64 nt, Homo Sapiens
aauucauaaaauuauuuaugcuugucuuuuguauaggucauaugaucuaaauuuagugcaauau

SEQ ID NO: 48490 - RNA, 64 nt, Homo Sapiens
cucaucaauagaucgcccuuaaagacccauuguaaggucauaaaaaaccucggccaccugcaca

SEQ ID NO: 48491 - RNA, 64 nt, Homo Sapiens
cccaaaggcccaaagagggccguggggccugaggaggucauaaucucuucugagugggggcagg

SEQ ID NO: 48492 - RNA, 64 nt, Homo Sapiens
ugcccaacggcagccaaacccggggugggaccagaggucauaggcucccagcuccuauuaggcc

SEQ ID NO: 48493 - RNA, 64 nt, Homo Sapiens
uguguccugggucacugugguuggcagaugccugaggucauagcuuuucuuuuugggggugaaa

SEQ ID NO: 48494 - RNA, 64 nt, Homo Sapiens
ugaauuuuaaacuggugaacuaaaggaaaucuugaggucauauacugaaauaugaauaaauuaa

SEQ ID NO: 48495 - RNA, 64 nt, Homo Sapiens
agcuuucaguauuagugaugucaucugucacuauaggucauacaauccauucuuaaaguacuug

SEQ ID NO: 48496 - RNA, 64 nt, Homo Sapiens
aaauuuucaaagauuaaaacuauuauacauauacaggucauauaaaauuaccuggauucacuaa

SEQ ID NO: 48497 - RNA, 64 nt, Homo Sapiens
gauaauauauuuuccccaucuacagcucuuuuaaaggucauaagucaccaauggugaguaaaga

SEQ ID NO: 48498 - RNA, 64 nt, Homo Sapiens
cagaaacaucagaagagaaagcugaccaucaagcaggucauaaaucucuucagaaaacaauacu

SEQ ID NO: 48499 - RNA, 64 nt, Homo Sapiens
acuuaauauaguggcauaccaauaaacuauaucauauuacuaggaugaguugaaaaaaaauuga

SEQ ID NO: 48500 - RNA, 64 nt, Homo Sapiens
gaaugaguuaaguuugagauauaauacaauauuauauuacuaaaaagacuagccaaaggacuuu

SEQ ID NO: 48501 - RNA, 64 nt, Homo Sapiens
acucuccacacuucuguggcucagugauuacugcuauuacuauauuuacuugcauaugucagaa

SEQ ID NO: 48502 - RNA, 64 nt, Homo Sapiens
cacagcccucuguagugguugaaucauuuuacacuauuacuacauuaugggaagauuccaguug

SEQ ID NO: 48503 - RNA, 64 nt, Homo Sapiens
acuaguacuaugacacuguugcuauuacuaguacuauuacuaguuugcuaguacuaguacuauu

SEQ ID NO: 48504 - RNA, 64 nt, Homo Sapiens
acuauuacuaguacuaguacacuaguacuauugcuauuacuaguauaauaguacuauugcuagu

SEQ ID NO: 48505 - RNA, 64 nt, Homo Sapiens
uuuauuuuaaaauaaaauuuaauaguacuauuacuauuacuauuuuaguauuauuaacacuaau

SEQ ID NO: 48506 - RNA, 64 nt, Homo Sapiens
acuauuuuuauuuuaaaauaacuaauaauaguacuauuacuauuuaacuauuaguauuauuaac

SEQ ID NO: 48507 - RNA, 64 nt, Homo Sapiens
auuugcuaugacuucagguuccaaccuacauauuuauuacuauaaauuuaaaagaaaucucuua

SEQ ID NO: 48508 - RNA, 64 nt, Homo Sapiens
caaagaguuuuuuaucuuuuuuuuauaauuuauuuauuacuaauauguaaaauaaaugugacau

SEQ ID NO: 48509 - RNA, 64 nt, Homo Sapiens
agcuagagcaauguaggcuuuuuuuaauuuaaauuauuacuacacuuuauuacuacacuugcag

SEQ ID NO: 48510 - RNA, 64 nt, Homo Sapiens
uaggcuuuuuuuaauuuaaauuauuacuacacuuuauuacuacacuugcagaaaagaaacaugu

SEQ ID NO: 48511 - RNA, 64 nt, Homo Sapiens
cugggcugagguuggagaaggggcagccgggggcacugcugaggguuugccgugcacgccucgg

SEQ ID NO: 48512 - RNA, 64 nt, Homo Sapiens
gucauggucauuucauuccuacucuucaggagacacugcugaacagaggaaugauucuguuccu

SEQ ID NO: 48513 - RNA, 64 nt, Homo Sapiens
ggcuuuuccugaguccccagacagcagaguaugaacugcugacacccagauuccauuaaaaauu

SEQ ID NO: 48514 - RNA, 64 nt, Homo Sapiens
ugcccacauauucuucuugcacaccccuuccauuacugcugaauaggacauugcaugggaagag

SEQ ID NO: 48515 - RNA, 64 nt, Homo Sapiens
uaauagcgcuuuuuaaagacgaugcacuguagucacugcugaguaaaucccauugacaaauguu

SEQ ID NO: 48516 - RNA, 64 nt, Homo Sapiens
cuuugaaaaucugagguauuuucuaguagguaagacugcugacuuaaauagaaaggaaaauaua

SEQ ID NO: 48517 - RNA, 64 nt, Homo Sapiens
acguggaguuccucuaaccgugggccccagcagaacugcugagcuuuacaugguauccaugaca

SEQ ID NO: 48518 - RNA, 64 nt, Homo Sapiens
cagaacugcugagcuuuacaugguauccaugacaacugcugauuccagugucgaggccauuucu

SEQ ID NO: 48519 - RNA, 64 nt, Homo Sapiens
ugcaucagaucauggaugcaucauucaauuuaucacugcugaauacauuucugcuuuuuucuag

SEQ ID NO: 48520 - RNA, 64 nt, Homo Sapiens
uauuacaaaacagaaaaauagaauaagaaugaaaacugcugacgugaaaaaaagaaggaaaaaa

SEQ ID NO: 48521 - RNA, 64 nt, Homo Sapiens
ucuggucuguugcugccacuccagcucggacuauacugcugaguaacacuggcgagcaggugcc

SEQ ID NO: 48522 - RNA, 64 nt, Homo Sapiens
uaaugugauuuuggucucuauaaacaaauuguugacugcugaauugcauggacaucuacccaga

SEQ ID NO: 48523 - RNA, 64 nt, Homo Sapiens
ucucgccuacaucccgaaucauugcaguggcaagacugcugaccuugacuucuuccgucgagug

SEQ ID NO: 48524 - RNA, 64 nt, Homo Sapiens
ggauccacucccccagcuccuuuagagaauggcuacugcugaguccuuugggguugagggagau

SEQ ID NO: 48525 - RNA, 64 nt, Homo Sapiens
uugaagcauuguuaaagacuauuuuccuaaaguuacugcugaccgaagagaacugcugaggagg

SEQ ID NO: 48526 - RNA, 64 nt, Homo Sapiens
aggauuuuccuaaaguuacuaggagcugaagagaacugcugaggccaacuguaccacgggcaug

SEQ ID NO: 48527 - RNA, 64 nt, Homo Sapiens
gggcugcugaccauuuggucauacaaaaauaccuacugcugagacagaggaccuuggguuccca

SEQ ID NO: 48528 - RNA, 64 nt, Homo Sapiens
acacucaguguccaguugcaaggguccucaguccacugcugagggccucagaaggacccuguug

SEQ ID NO: 48529 - RNA, 64 nt, Homo Sapiens
cucacccgugcauauguugaccuuugcaaaaugaccuggugacauggcaagucaguggggacag

SEQ ID NO: 48530 - RNA, 64 nt, Homo Sapiens
gggaaaaaaagaaauuuuacuuucucucaccuuaccuggugauaaguuccaaauauguuaaggg

SEQ ID NO: 48531 - RNA, 64 nt, Homo Sapiens
uuuucaccacugcguuuuagugagcaaagguuucccuggugaaucagcagcugaacauuccugg

SEQ ID NO: 48532 - RNA, 64 nt, Homo Sapiens
aaagguuucccuggugaauuagcagcugaacauuccuggugagcguggcucuagaucacuguuc

SEQ ID NO: 48533 - RNA, 64 nt, Homo Sapiens
aggaguauuuuguggcauaaugacuagagcuuugccuggugaugcaggaaacuuaauucccugg

SEQ ID NO: 48534 - RNA, 64 nt, Homo Sapiens
agagcuuugccuggugaugaaggaaacuuaauucccuggugacuggugggggcugucugugucc

SEQ ID NO: 48535 - RNA, 64 nt, Homo Sapiens
agaccaaggcagggcccagccugacuucccaagcccuggugaccggaaggagagaaugauuuug

SEQ ID NO: 48536 - RNA, 64 nt, Homo Sapiens
cgggggcugucucagacgaccuaggauaugcccuccuggugacucucccuucaggcccgcugcc

SEQ ID NO: 48537 - RNA, 64 nt, Homo Sapiens
ugagaguaauucaucugugaaucugcuuuaauuaccuggugaguaacuuagaaaagugguguaa

SEQ ID NO: 48538 - RNA, 64 nt, Homo Sapiens
cuuacugacaccagggguccgcugccccauguguccuggugagaaaauauaugccuggcacagc

SEQ ID NO: 48539 - RNA, 64 nt, Homo Sapiens
aggggaagcaggacccaguguuuccugacagaugccuggugagcccugguagaggggccggcug

SEQ ID NO: 48540 - RNA, 64 nt, Homo Sapiens
ggguuacguggggugcgggacaggccugcgggccccuggugaugagccccaggccagcugcggc

SEQ ID NO: 48541 - RNA, 64 nt, Homo Sapiens
uuuuugcuagacauuagcuguuuggggaagguacccuggugaugguuuuagaaaaugaggccug

SEQ ID NO: 48542 - RNA, 64 nt, Homo Sapiens
guggcaaagacuccugucccagaaagggaggaagccuggugauuugagcagaggagggaggggg

SEQ ID NO: 48543 - RNA, 64 nt, Homo Sapiens
agugagccuggcucccacgcucccugugacagagccuggugaacaggccauggcguugccagcc

SEQ ID NO: 48544 - RNA, 64 nt, Homo Sapiens
acaggaagccugaacccgggcucucucgcuggccccuggugaggcauaggagcgaacacugcug

SEQ ID NO: 48545 - RNA, 64 nt, Homo Sapiens
caggauguuaauggagcuggaaguucagaaaaagccuggugaagugacccuuggccuuucacuu

SEQ ID NO: 48546 - RNA, 64 nt, Homo Sapiens
cuguuccuacugaaggccuagcaccugcucuuggccuggugagccccuccaccuuccaggcuua

SEQ ID NO: 48547 - RNA, 64 nt, Homo Sapiens
gaauacguuagaaaaugacagaugguagagacuuccauagaauuaagaggguucucauggaggg

SEQ ID NO: 48548 - RNA, 64 nt, Homo Sapiens
agucaccauucaagcuccuuccccaaaguguguuccauagaacacugggaccaugagaugcucu

SEQ ID NO: 48549 - RNA, 64 nt, Homo Sapiens
guaagugacuaaccaagauuauuucauuuuaaaaccauagaauaaaaaugacaccugagcuucu

SEQ ID NO: 48550 - RNA, 64 nt, Homo Sapiens
ugcuaaaacaugaugauuaagugcacaccgugugccauagaauggcacaugucauugcccacuu

SEQ ID NO: 48551 - RNA, 64 nt, Homo Sapiens
ccacugagcaccuugugacccccgccccugccugccauagaacaacccccuuugauuguaauuu

SEQ ID NO: 48552 - RNA, 64 nt, Homo Sapiens
cuguuauuuuuaggcauaagaugacuuaggaggcccauagaaacauucucguuuaaacaacaac

SEQ ID NO: 48553 - RNA, 64 nt, Homo Sapiens
cgugaaagguuaguugagacugaaguguucacuuccauagaagaacaucacuuuuaaccuugcu

SEQ ID NO: 48554 - RNA, 64 nt, Homo Sapiens
guuuuaaaggaugaacauuggauuucaugccaucccauagaaaaccuguuuuaaaauuuuaggg

SEQ ID NO: 48555 - RNA, 64 nt, Homo Sapiens
cauaguuuuauccagggagaaaaauaaaaggaagccauagaauugcucuggucaaaaccaagca

SEQ ID NO: 48556 - RNA, 64 nt, Homo Sapiens
ucucaugauggaaaaucagccaaggacuaagcuuccauagaaauacacuuuguaucuggaccuc

SEQ ID NO: 48557 - RNA, 64 nt, Homo Sapiens
cuguagaaagauaucuguauugaagucucuuauuccauagaaaaaugccagccauuuuauauga

SEQ ID NO: 48558 - RNA, 64 nt, Homo Sapiens
auuucaugagcagaucaggaccccacagcuucccccauagaaggagggucgcuuaaggaaucug

SEQ ID NO: 48559 - RNA, 64 nt, Homo Sapiens
gucauuccacuggguuuugaaagaaaaguaaacuccauagaagugggauagggaagauagcagg

SEQ ID NO: 48560 - RNA, 64 nt, Homo Sapiens
cgggaagaaagagguaugaaacucuggaauuuacccauagaagagaggagcuuaaaacucaacc

SEQ ID NO: 48561 - RNA, 64 nt, Homo Sapiens
gucacaugccugagggagacuguaaaggggccugccauagaaaaaggauggggcauaaugugac

SEQ ID NO: 48562 - RNA, 64 nt, Homo Sapiens
agauuucuaggaaugaagugacaaagaacaggugccauagaaguggaaagugagaugaauuaag

SEQ ID NO: 48563 - RNA, 64 nt, Homo Sapiens
auuuacgaaauugcauuucaaaauaauccuugugccauagaaguuacaagguugaaucugagga

SEQ ID NO: 48564 - RNA, 64 nt, Homo Sapiens
uaugccuaccccuggccagucugaggucuccuagccauagaacugacuccuggaagccuggaga

SEQ ID NO: 48565 - RNA, 64 nt, Homo Sapiens
cuuugaaacaggccucaucccacuuccaccagcaccauagaagaauaauucugggcagaagucu

SEQ ID NO: 48566 - RNA, 64 nt, Homo Sapiens
acauuuuuggguuaaaaaauguaauuuaaagccaccauagaaaguauuuucugauuuacugucc

SEQ ID NO: 48567 - RNA, 64 nt, Homo Sapiens
uccugacauccuccccagcucaagucuauucuuaccauagaacccagggcagggagagaagaac

SEQ ID NO: 48568 - RNA, 64 nt, Homo Sapiens
uucaguauggguggagcaugguacagucuuggugccauagaaggaguaguugcauagucacaca

SEQ ID NO: 48569 - RNA, 64 nt, Homo Sapiens
aacaaacuggaaaggaaacuucacacgucaaaauccauagaagcgccuggacgaggcuuaaagu

SEQ ID NO: 48570 - RNA, 64 nt, Homo Sapiens
uccgugcuuugccucacucguaguaaaugaccauccauagaauaugugaaucuuuggugagcuu

SEQ ID NO: 48571 - RNA, 64 nt, Homo Sapiens
gguugcugguagcaguagagaggccuuucccuugccauagaaaucuauccugucccuggaucug

SEQ ID NO: 48572 - RNA, 64 nt, Homo Sapiens
augaaaauaucaagauuauuuugauguaauaaaaccauagaacuagcuuaauaaauauugguaa

SEQ ID NO: 48573 - RNA, 64 nt, Homo Sapiens
cuauguucuuacuuugugugagagcaaaugaugaccauagaaagaucugcaaucugggagcuua

SEQ ID NO: 48574 - RNA, 64 nt, Homo Sapiens
auaauaaauauacaaguuguccuuguugugauccccauagaaacuuuguacuaagcugugccug

SEQ ID NO: 48575 - RNA, 64 nt, Homo Sapiens
aggaugauuagauugaaacacucuguguaauuuaccauagaauuaugcucccuccucuaucucu

SEQ ID NO: 48576 - RNA, 64 nt, Homo Sapiens
uuaggggcuugguaguuuggaaaguucuuaggcaccauagaagaacagcagauggcggugauca

SEQ ID NO: 48577 - RNA, 64 nt, Homo Sapiens
uuugaaagcuaugagaauagaugugugggugaagccauagaacauauuugcuugaaauucuuga

SEQ ID NO: 48578 - RNA, 64 nt, Homo Sapiens
uagcuugaaaucugcggcaauuggaguauuuacaccauagaaaugcuauaagugaagaccuacc

SEQ ID NO: 48579 - RNA, 64 nt, Homo Sapiens
agcguuguuggaauucaaaaaacagacaauauugccauagaaaugugugaagaauuugcauuac

SEQ ID NO: 48580 - RNA, 64 nt, Homo Sapiens
aucccauucuaguuuucagaauaggaccagaugcccauagaagcacaguacagacugaaguaaa

SEQ ID NO: 48581 - RNA, 64 nt, Homo Sapiens
uuauaaaugucugugcacuauauuaauuagaagaccauagaacaugccagcagguuggcuaaug

SEQ ID NO: 48582 - RNA, 64 nt, Homo Sapiens
ccagcauuacagaaccuugguuauuguuuuuuagccauagaaucuucuaguaaaaaauaucugc

SEQ ID NO: 48583 - RNA, 64 nt, Homo Sapiens
caaaauggcuuucagcaauguauuuauuucccccccauagaagguuucauauaacauauauauu

SEQ ID NO: 48584 - RNA, 64 nt, Homo Sapiens
ggcgugcaguacuaagggaaaauuugaaaaaguuccauagaaaaccaaacuuguucauuuagau

SEQ ID NO: 48585 - RNA, 64 nt, Homo Sapiens
aaaccggaaaaauacgccaaggauaugaaaugguccauagaaaaugguaauauucugugugaug

SEQ ID NO: 48586 - RNA, 64 nt, Homo Sapiens
guaaguaggcuaaguugggggaaaaaucacaaacccauagaaaaucugauuugcacaauuuguu

SEQ ID NO: 48587 - RNA, 64 nt, Homo Sapiens
ugccgccccaccuucuacuuugcccaagacucagccauagaagacaauaugacagagcacccac

SEQ ID NO: 48588 - RNA, 64 nt, Homo Sapiens
aagaugaauauaagaauucauccuagauauaaaaccauagaaauguaaaagaugugacaaaacc

SEQ ID NO: 48589 - RNA, 64 nt, Homo Sapiens
uaaaguuacuacuggugucuaugcaaauuggauuccauagaaguuuuagcuauguuauuuacaa

SEQ ID NO: 48590 - RNA, 64 nt, Homo Sapiens
aauaacuuucuuaccauuaacauuuuuuacccuuccauagaagggagggaauaaaucaugacuu

SEQ ID NO: 48591 - RNA, 64 nt, Homo Sapiens
cucuuugguacuauaugccauggaugugaauuucccauagaagcuggugacauguuccuggaag

SEQ ID NO: 48592 - RNA, 64 nt, Homo Sapiens
guauuuuaaauaauuaaaacauuaaauggcaacaccauagaauauagguguucucuggaccuau

SEQ ID NO: 48593 - RNA, 64 nt, Homo Sapiens
aauauccugucucucucucuagaaaccacagguuccauagaacuugauuauaugacaauccuga

SEQ ID NO: 48594 - RNA, 64 nt, Homo Sapiens
aacacauuuuaaggcugaaaucuuucuagguauuccauagaaucugagaaaucauucuuggcug

SEQ ID NO: 48595 - RNA, 64 nt, Homo Sapiens
aaauucucucuaguuuacuuuuuccuaaaaauucccauagaauauaagccuuaagucuuuuuuu

SEQ ID NO: 48596 - RNA, 64 nt, Homo Sapiens
uagauggcccugucuugaccugcuacuugcaaggccauagaaucgggguucccagcauuguggg

SEQ ID NO: 48597 - RNA, 64 nt, Homo Sapiens
auuaaugcaugguuauuuggaccagaaaaaagugccauagaagaccaauaacuguuuaguugag

SEQ ID NO: 48598 - RNA, 64 nt, Homo Sapiens
auauauuugagcccauacaguguauuagguugaaccauagaaacugcuauucucguaggucaaa

SEQ ID NO: 48599 - RNA, 64 nt, Homo Sapiens
auggaccaaugaggugguaucaaugaauauaguuccauagaacauuuuccagaaguucuucugu

SEQ ID NO: 48600 - RNA, 64 nt, Homo Sapiens
uggaauuuauauucaccaauuucaggaaaaccaaccauagaacuuuauaauaggacaguuauaa

SEQ ID NO: 48601 - RNA, 64 nt, Homo Sapiens
ucaauguucauuaaaaauauccaagauuuaaaugccauagaaauguagguccucagaaagugua

SEQ ID NO: 48602 - RNA, 64 nt, Homo Sapiens
ucaaggaagaauaauuuuaacagacauguauacuccauagaaacuaaacuaaaauaguuuaaaa

SEQ ID NO: 48603 - RNA, 64 nt, Homo Sapiens
aacuugacuaugccuggucaagugauuuuaaaagccauagaagaugauuaucauaugauaccuc

SEQ ID NO: 48604 - RNA, 64 nt, Homo Sapiens
augacaaaagaaaauuuuccgucaaaauuguuuaccauagaaagggacagacggaaaugaaauu

SEQ ID NO: 48605 - RNA, 64 nt, Homo Sapiens
aguuugauaaacaggucacuaaaaaucaacccauccauagaaauacuuaauuuagaggaagaaa

SEQ ID NO: 48606 - RNA, 64 nt, Homo Sapiens
cugauuggauagccauccuauuugguaugugauaccauagaauagacugucauauuguagagac

SEQ ID NO: 48607 - RNA, 64 nt, Homo Sapiens
gacugcaguuucggaaguuugaucugagaaccaaccauagaauguuucaguucuaggaaauaaa

SEQ ID NO: 48608 - RNA, 55 nt, Homo Sapiens
acaaggccaaaggcaaauaaugucuccauagaaucacuuuccaauacaacggcuc

SEQ ID NO: 48609 - RNA, 64 nt, Homo Sapiens
cucugcaauccauauauauccuggucuugggaguccauagaauacuguuuccuucuaauaaagg

SEQ ID NO: 48610 - RNA, 64 nt, Homo Sapiens
cuacuggaagcuagaaagaaauaggaauuuaaguccauagaaugaagguaguuauuccugccug

SEQ ID NO: 48611 - RNA, 64 nt, Homo Sapiens
aauucuccccacuugauuuuucuucuauaaaaucccauagaacaauguuuaugcuauagccauu

SEQ ID NO: 48612 - RNA, 64 nt, Homo Sapiens
guucagaaaaaaagccccugaacugauuuuguuaccauagaauuuaaaaaaaaaaaaagcuuua

SEQ ID NO: 48613 - RNA, 64 nt, Homo Sapiens
gcugggauuacagacgugagccaccacucccggcccauagaagguuuuuugcuggauaauuugu

SEQ ID NO: 48614 - RNA, 64 nt, Homo Sapiens
caacuccuacuugugugugggagaagccaugucaccauagaagggccugaugggaauuagugca

SEQ ID NO: 48615 - RNA, 64 nt, Homo Sapiens
uuuuguucgagagccaaaggcacaggcucaaauaccauagaaauuacguagacuccaaaaugua

SEQ ID NO: 48616 - RNA, 64 nt, Homo Sapiens
aagaaacagacugcaaggaaauaacuaaucaccaccauagaagaucuauauaagcagucuugca

SEQ ID NO: 48617 - RNA, 64 nt, Homo Sapiens
cuguggguuucgaugguuuccagaucagaucacuccauagaagcuguucucuuuacucuucuca

SEQ ID NO: 48618 - RNA, 64 nt, Homo Sapiens
ugcuuuuucccaaggcuagauccucacauuuucuccauagaagaccauagugcccacaggguau

SEQ ID NO: 48619 - RNA, 64 nt, Homo Sapiens
ccacuuaguuuuuucuuauucccaccuuucuaucccauagaacacucuuuuuuaucuucccuga

SEQ ID NO: 48620 - RNA, 64 nt, Homo Sapiens
aauuaguagaaucaugcucucuaaauuuauucugccauagaagguagaaauauuuuuaagcucc

SEQ ID NO: 48621 - RNA, 64 nt, Homo Sapiens
cuuguauuacccacaggaaugagggcagcuaaacccauagaaggaguuggaccaaggcgaauua

SEQ ID NO: 48622 - RNA, 64 nt, Homo Sapiens
aggcagaacugaggucucaaguuugcacucuuggccauagaacuaaaaaugaaaccugagauug

SEQ ID NO: 48623 - RNA, 64 nt, Homo Sapiens
cucuuuuuuaucuucccugacccaccuuucuaucccauagaacaccacuuaguuuuuugucauu

SEQ ID NO: 48624 - RNA, 64 nt, Homo Sapiens
ugaggccauuauuucaaccggauuugcacccaugccauagaaacacugugagcucuaacagacc

SEQ ID NO: 48625 - RNA, 64 nt, Homo Sapiens
gcaucgacugugucacuuaaugugccacuguuguccauagaagaagucccaaagcugugaccuc

SEQ ID NO: 48626 - RNA, 64 nt, Homo Sapiens
uugggguucuaaauauacaauuuggagcauaguaccauagaaauauauaaacaucacacuuuaa

SEQ ID NO: 48627 - RNA, 64 nt, Homo Sapiens
uuuaaaaaaagggucagacuuuuaaacacucugaccauagaaauguuuuucaaaauggcaacaa

SEQ ID NO: 48628 - RNA, 64 nt, Homo Sapiens
gauuucuaggcuaguuacuugagauaugaauuuuccauagaauaugcacugauacaauauuacc

SEQ ID NO: 48629 - RNA, 64 nt, Homo Sapiens
cguaccagguguuuacagauuuaaaugcauguuaccauagaaacuauuaaaguaacuagaacug

SEQ ID NO: 48630 - RNA, 64 nt, Homo Sapiens
ugagaaacuuguaaccuaugugccucaauauauuccauagaaaguaggucccccugccuucucc

SEQ ID NO: 48631 - RNA, 64 nt, Homo Sapiens
uuaacauaagccucaccuuucauuuuaaagguuuccauagaauuuaguuauuuuaucuuucagc

SEQ ID NO: 48632 - RNA, 64 nt, Homo Sapiens
aaaagcaauaguugcuugaacauuucagccaaagccauagaagaaaucaaucaaucagcauaua

SEQ ID NO: 48633 - RNA, 64 nt, Homo Sapiens
aagaauuggcagucaaaaaaagaauuggcccauaccauagaagauaaauaaucccaaauagacc

SEQ ID NO: 48634 - RNA, 64 nt, Homo Sapiens
ggcagcauuauuucaaacauaauaucuauuguauccauagaauagugcaguuacuuauauauua

SEQ ID NO: 48635 - RNA, 64 nt, Homo Sapiens
gucccacaaaauauuucuaacuuauuuuagacaaccauagaacuuguauaacaagccaaacauu

SEQ ID NO: 48636 - RNA, 64 nt, Homo Sapiens
auuauccagacuggaauuuuaauucuuuugucuaccauagaauuaggaaacccaagaggcugag

SEQ ID NO: 48637 - RNA, 64 nt, Homo Sapiens
cuccugaucugaaugaauuugucucuuaaugcauccauagaaaaguguuaauuguggguucaaa

SEQ ID NO: 48638 - RNA, 64 nt, Homo Sapiens
gggaucgaaagccugaaauaaauauucauacuuuccauagaacugagcacuugguugcuauuua

SEQ ID NO: 48639 - RNA, 64 nt, Homo Sapiens
aaauagaacauacugaaaauaaucuaaguuccaaccauagaagaagcugcagaagaaaugaaga

SEQ ID NO: 48640 - RNA, 64 nt, Homo Sapiens
aagauuuuuaaagcuuuuauguuauaccauggagccauagaaaggcuauggauuguuuaagaac

SEQ ID NO: 48641 - RNA, 64 nt, Homo Sapiens
gugacgggaagauggaagggcaugaugaacucugccauagaaaacuuccuccagccugaagaga

SEQ ID NO: 48642 - RNA, 64 nt, Homo Sapiens
ucccagggcagagccucuccuuguacuuuggcagccauagaaagcgugcucauuuucuguuuuc

SEQ ID NO: 48643 - RNA, 64 nt, Homo Sapiens
caaauuguuaugauugagugcugugaauauugcuccauagaaaacaccuauuuauucacaggau

SEQ ID NO: 48644 - RNA, 64 nt, Homo Sapiens
uuaaacacaaaguguauacaacugcuuacuuaugccauagaaaaaauaccagcaauucauaaaa

SEQ ID NO: 48645 - RNA, 64 nt, Homo Sapiens
cuugacauguagcuucuucuaguauuaauacuacccauagaaaaaacauaagcuaaaucauauu

SEQ ID NO: 48646 - RNA, 64 nt, Homo Sapiens
gccucuuuguuacaaaaugauuguaaaaauacaaccauagaaaguuuaacugggauaaauguuu

SEQ ID NO: 48647 - RNA, 64 nt, Homo Sapiens
agauaccaggcacuuaaagcccaagagaucugugccauagaacaugcuuuccuucuccucaugc

SEQ ID NO: 48648 - RNA, 64 nt, Homo Sapiens
gagcugccucgggcuggguugcuuggucauagagccauagaaggaagcugucagcccggagugc

SEQ ID NO: 48649 - RNA, 64 nt, Homo Sapiens
agccaacauuaguaaaaggaaucccaacuucuucccauagaauuagaaacaugugaaaguacaa

SEQ ID NO: 48650 - RNA, 64 nt, Homo Sapiens
uaauuuauagaugcguguauagaaagagaacucuccauagaaugccuggccaaagauaggagga

SEQ ID NO: 48651 - RNA, 64 nt, Homo Sapiens
ggaggcaugccucugauaugggacugagccuggcccauagaaacaugacacugaccuuggagag

SEQ ID NO: 48652 - RNA, 64 nt, Homo Sapiens
cuccuacccccugcggcacacuuaucuucaaauaccauagaauucuaaucucuggaggcuggca

SEQ ID NO: 48653 - RNA, 64 nt, Homo Sapiens
ccccucccuuuuuccuucuccugcuuuucuuuccccauagaaaguaccuugaaguagcacagcc

SEQ ID NO: 48654 - RNA, 64 nt, Homo Sapiens
gacugagcugcugggggacaugugagccucaaauccauagaaagacaaacggccaccuugggug

SEQ ID NO: 48655 - RNA, 64 nt, Homo Sapiens
cuuuuauuaauaacacuacuaaauuuugguuccuccauagaauuaguuuugaaacacuugaugu

SEQ ID NO: 48656 - RNA, 64 nt, Homo Sapiens
auacagucauucauuggcaaauuuuaaaucuugaccauagaaaauuuucauaauguaucccaga

SEQ ID NO: 48657 - RNA, 64 nt, Homo Sapiens
guaucccuuuuuuuuuuuuuuuaaagucaaaaauccauagaaaaauacuuuagauuuuaaauua

SEQ ID NO: 48658 - RNA, 64 nt, Homo Sapiens
aucauuuauuuuugcagauccaauuuggauuucuccauagaauaagacauguugaugcuagcca

SEQ ID NO: 48659 - RNA, 64 nt, Homo Sapiens
ucugugaaccagaaugagacucaucugaaagcugccauagaaauucaagaaguagcuaaugguu

SEQ ID NO: 48660 - RNA, 64 nt, Homo Sapiens
aaauuugccuauacuaucugaauaaaugcuucuaccauagaaauuguuauuuuucuauaucuga

SEQ ID NO: 48661 - RNA, 64 nt, Homo Sapiens
uuggguguguauacuuguauuggcaaagcgugucccauagaaaagcuuggcccucuuuccucug

SEQ ID NO: 48662 - RNA, 64 nt, Homo Sapiens
uaauaagcucuucuuauucauguguaagggagguccauagaauuuagguggucugucaacuauu

SEQ ID NO: 48663 - RNA, 64 nt, Homo Sapiens
cugaagaaagcaccaagucuuaauggaacaaagaccauagaaugaauuauuuuaucuccuccca

SEQ ID NO: 48664 - RNA, 64 nt, Homo Sapiens
uagugaaaauaauuagacauuuuaagaaccagagccauagaauuauuuuaaauuaguagaaaag

SEQ ID NO: 48665 - RNA, 64 nt, Homo Sapiens
ccuauuuauucccuaauguaccugaacacuaguaccauagaacugaaccaccaucuguaucagc

SEQ ID NO: 48666 - RNA, 64 nt, Homo Sapiens
ucauuuauuuuccucacaauucuauuugggcuaaccauagaauugguugaagaagcuaucuuug

SEQ ID NO: 48667 - RNA, 64 nt, Homo Sapiens
auuucacugcaaacaugcauuccacaggaccaaaccauagaacagacugucagauuucuuagac

SEQ ID NO: 48668 - RNA, 64 nt, Homo Sapiens
ccaugauuuucaggguuaauacaaagcuugauuaccauagaaaagauguuuuauuuucugaugu

SEQ ID NO: 48669 - RNA, 64 nt, Homo Sapiens
augaaucuaauuaaaacagaaaacuuauccagggccauagaaguuaucauuguuuucuuguccc

SEQ ID NO: 48670 - RNA, 64 nt, Homo Sapiens
augggguuguuuuccaaaguaguuccucaaugugccauagaaaggaaaugagguaaaguacuuc

SEQ ID NO: 48671 - RNA, 64 nt, Homo Sapiens
aaauauucugguggucugucaaauaagguauuugccauagaacuaugaagcucaugagcuccuc

SEQ ID NO: 48672 - RNA, 64 nt, Homo Sapiens
aacaugggaauacagaauauaaggaaguaaaaccccauagaagacucuuugaagaaauugcuga

SEQ ID NO: 48673 - RNA, 64 nt, Homo Sapiens
uaggaaaaugcacauauuccaugaauuuuaagacccauagaaaaguugaagaaugcuuaauuuu

SEQ ID NO: 48674 - RNA, 64 nt, Homo Sapiens
gaaaugggaugcuagcgugccgggcuuugcagucccauagaacaaguggaaugagugugagcau

SEQ ID NO: 48675 - RNA, 64 nt, Homo Sapiens
cccgacauggugcuaguuucaaagagaaugcuucccauagaaagccuuggaacugaaucagugg

SEQ ID NO: 48676 - RNA, 64 nt, Homo Sapiens
gaaaaaagagcaccaccauuaacuucauuuucccccauagaagauccggggagccauaaucugc

SEQ ID NO: 48677 - RNA, 64 nt, Homo Sapiens
uuauuaagaugucuuucauguguauaugccucugccauagaauacucagucuuguggucaagag

SEQ ID NO: 48678 - RNA, 64 nt, Homo Sapiens
gcuuuccagaaguaaaagucccagugauguauucccauagaaauauuuuucaguuguuuauguc

SEQ ID NO: 48679 - RNA, 64 nt, Homo Sapiens
cccuccagugaguguccugcagcccuuauucccuccauagaaagcauccucagagcaccuuccc

SEQ ID NO: 48680 - RNA, 64 nt, Homo Sapiens
ggcagauuaagaagauugaccacuggguacucugccauagaaauacacaccaaacaagauguuu

SEQ ID NO: 48681 - RNA, 64 nt, Homo Sapiens
guuacccgagggaaaauaaaagaaaauggugaagccauagaaaaauuuuucuucaauuuugaag

SEQ ID NO: 48682 - RNA, 64 nt, Homo Sapiens
uauucuuuuauguuaaauuaucgggaugacaaauccauagaauaguuaauuuuguucauauuua

SEQ ID NO: 48683 - RNA, 64 nt, Homo Sapiens
gaacacagguuaccauauugaugacauaaucauaccauagaagguccuuuaacacuaagguaac

SEQ ID NO: 48684 - RNA, 64 nt, Homo Sapiens
ccacuggaauaccacauagccaucuaguuuccuaccauagaauccauugucaaccuuuucugca

SEQ ID NO: 48685 - RNA, 64 nt, Homo Sapiens
cauauugacacucagcuguuaaaggagauugaagccauagaacucccuuaagaauuuuauuuuu

SEQ ID NO: 48686 - RNA, 64 nt, Homo Sapiens
guaaauagugauaugauuaacaucuuaaucacauccauagaaaaugacuuauuuccagaagaua

SEQ ID NO: 48687 - RNA, 64 nt, Homo Sapiens
aagauacagaucugcacugaagacauuagacuggccauagaaaaguaagcuugaacucccaauu

SEQ ID NO: 48688 - RNA, 64 nt, Homo Sapiens
cuucaccucugguuugagguugaugguuuguggaccauagaaguggcuggugggugacuuaguc

SEQ ID NO: 48689 - RNA, 64 nt, Homo Sapiens
guuucuguuucauaucauuuaggaauaaaguaguccauagaaauauaagcuuuuuucauaauuc

SEQ ID NO: 48690 - RNA, 64 nt, Homo Sapiens
aaaaagaacacccaucguauaaggaaauccagccccauagaaaacaaucugcccaccgaccccc

SEQ ID NO: 48691 - RNA, 64 nt, Homo Sapiens
uacauaugggagagacucagugagccagcaaaggccauagaaacaacaauuuauuaaauguauu

SEQ ID NO: 48692 - RNA, 64 nt, Homo Sapiens
aacuucacauuauucaaguuacaaaucacuguguccauagaaaaacugugcugguauuugcugg

SEQ ID NO: 48693 - RNA, 64 nt, Homo Sapiens
auggaaagggaaggucagcaugggucucuccuggccauagaaugugggggaggcccucugugaa

SEQ ID NO: 48694 - RNA, 64 nt, Homo Sapiens
auucuggcuuggggcagcagcuucccuuguagagccauagaaauugagaacacaggccccgccc

SEQ ID NO: 48695 - RNA, 64 nt, Homo Sapiens
aaaaguacuuauuuucuaccuggaaagucacuucccauagaagccauuugauacacaagugaac

SEQ ID NO: 48696 - RNA, 64 nt, Homo Sapiens
guacauugugagcucugguuauuuuucucuuguaccauagaaaaauguauaaaaauuaucaaaa

SEQ ID NO: 48697 - RNA, 64 nt, Homo Sapiens
uucaucccuaaagaaggcuccuuucccuaaggaaccauagaagagaggaagaaaacaaagggca

SEQ ID NO: 48698 - RNA, 64 nt, Homo Sapiens
aauguaaauagaggucuguaaagaaaaauaauugccauagaaaguauaauuucagugcaguaau

SEQ ID NO: 48699 - RNA, 64 nt, Homo Sapiens
cuugauuuuuccuguccaucacccauuaagagccccauagaacuucuuugcccucugggucuug

SEQ ID NO: 48700 - RNA, 64 nt, Homo Sapiens
cugaagagccauuuaauugaggcuauaaaggccaccauagaaagagggaugguggaccacagaa

SEQ ID NO: 48701 - RNA, 64 nt, Homo Sapiens
ggaugaguucauauucuucaggaauacuaugcagccauagaaaaacgugacacauauacaccau

SEQ ID NO: 48702 - RNA, 64 nt, Homo Sapiens
gcuucccaaaccuuguuuuggacacaaaaccgauccauagaagguuuuggcagggacagacuug

SEQ ID NO: 48703 - RNA, 64 nt, Homo Sapiens
ucgagguuguuuucuuucaagauacucuaaucagccauagaauuuaguguaaauauuuuuuuuu

SEQ ID NO: 48704 - RNA, 64 nt, Homo Sapiens
ccagucuccuggcccccaggccagggucuguccaccauagaaugucuuccucuacuggggucgu

SEQ ID NO: 48705 - RNA, 64 nt, Homo Sapiens
uuuacuuaaaaacaaucccauagaguaaaaauguccauagaacuuguuucuuagugcaaaucug

SEQ ID NO: 48706 - RNA, 64 nt, Homo Sapiens
auggcauuuacguuucucugaugcucccuugaagccauagaauuuaggggcuuuuuuaaaaaaa

SEQ ID NO: 48707 - RNA, 64 nt, Homo Sapiens
uuuguaaauacagaacauuguuuaaaagacauaaccauagaacauagcuuccuguuuguggauu

SEQ ID NO: 48708 - RNA, 64 nt, Homo Sapiens
uuccacaaaaguugugauuuguccucauucuaauccauagaaggcaacauuucuaacagguuuc

SEQ ID NO: 48709 - RNA, 64 nt, Homo Sapiens
uucuaagcagaagagggacugagugaggugggagccauagaagcgaggacuucgcuuuugcucu

SEQ ID NO: 48710 - RNA, 64 nt, Homo Sapiens
ggcauuugaaggguguggcaacaggcaagaagcuccauagaaguuuuuccaugagauucucuac

SEQ ID NO: 48711 - RNA, 64 nt, Homo Sapiens
acagaacaauccugaaccagauguacagucuauuccauagaaucugccccugaacccaagagug

SEQ ID NO: 48712 - RNA, 64 nt, Homo Sapiens
guaagguuugugacaaggcuacacuggagaaaagccauagaaauucaaauacauaggagaauuc

SEQ ID NO: 48713 - RNA, 64 nt, Homo Sapiens
cuuggcaaucuuggcucaccuugguaacaaaaggccauagaagucuguuuuucugggucaguuu

SEQ ID NO: 48714 - RNA, 64 nt, Homo Sapiens
ugucaacugaauucacacacacacaaauauaguaccauagaaaaaguuuguuuucucgaaauaa

SEQ ID NO: 48715 - RNA, 64 nt, Homo Sapiens
acuaaauugugcaguuuggggcuuuucccccuuaccauagaagugcagaggaguucaguaucuc

SEQ ID NO: 48716 - RNA, 64 nt, Homo Sapiens
uuuagaucuuuuaugauuuaauuauuauuguuucccauagaaguucccucccuuugaaauuaau

SEQ ID NO: 48717 - RNA, 64 nt, Homo Sapiens
gaacugcuaaauacuguacacauguacaaaaguaccauagaacauaauuaguaauaaaacccag

SEQ ID NO: 48718 - RNA, 64 nt, Homo Sapiens
ugaacacuaacuauauccuaaccuuugauauuagccauagaacuacagauguaggaagucaucu

SEQ ID NO: 48719 - RNA, 64 nt, Homo Sapiens
gacucccaccuugguagggugcugccucagggagccauagaagucggcuguguuuugagacggc

SEQ ID NO: 48720 - RNA, 64 nt, Homo Sapiens
gauggcccuggccugaauccagccuccgcuguggccauagaaggaauggagaacagggcugggc

SEQ ID NO: 48721 - RNA, 64 nt, Homo Sapiens
caguaucugcagccucgaccuggucacuuuauuuccauagaagacaauaagguucugggaacac

SEQ ID NO: 48722 - RNA, 64 nt, Homo Sapiens
guguuuuccugagaguucgugguguuuccagagaccauagaaauccaccugggugccaguuaca

SEQ ID NO: 48723 - RNA, 64 nt, Homo Sapiens
ugguuacuugguaagugaccggcauccauguccaccauagaauuggucugugguccauccucca

SEQ ID NO: 48724 - RNA, 64 nt, Homo Sapiens
ugcuacgguuuuaaucauccagggugccauuccaccauagaagagcaauccuuuuaggaaaaaa

SEQ ID NO: 48725 - RNA, 64 nt, Homo Sapiens
cagaggcaucuuuugagccauacgaauuccugacccauagaaacugcaagacaauaaauguugu

SEQ ID NO: 48726 - RNA, 64 nt, Homo Sapiens
uaccucagaaaacaaguauugucagguauucucuccauagaacagcacuacccuccucucuccc

SEQ ID NO: 48727 - RNA, 64 nt, Homo Sapiens
uacgucagaaaacaaguauugucagguauucucuccauagaacagcacuauccucaucucuccc

SEQ ID NO: 48728 - RNA, 64 nt, Homo Sapiens
auguuugcaaaccaacauguuucuaccuggaacuccauagaauguuaucuguguuacccuguuu

SEQ ID NO: 48729 - RNA, 64 nt, Homo Sapiens
gcacuaccuuccucucucccgucagguauucucuccauagaacauaccucagaaaacaaguaua

SEQ ID NO: 48730 - RNA, 64 nt, Homo Sapiens
gcacuacccuccucucucccgucagguauucucuccauagaacauaccucagaaaacaaguauu

SEQ ID NO: 48731 - RNA, 64 nt, Homo Sapiens
gcacuacccuccucucucccgucagguauucucuccauagaacauaccucagaaagcaaguaua

SEQ ID NO: 48732 - RNA, 64 nt, Homo Sapiens
aaauuuuggcuuuagaauaccaguuggcaugaagccauagaauuacaacuguacuuuuuuugau

SEQ ID NO: 48733 - RNA, 64 nt, Homo Sapiens
ugauguuuaacauaugaaaaucuggaaauguaucccauagaagcuaaagugguaacacaaccau

SEQ ID NO: 48734 - RNA, 64 nt, Homo Sapiens
ccugcuagcucuguugccccccaaccucagcugauuguaguacacagguacuccagucuucacc

SEQ ID NO: 48735 - RNA, 64 nt, Homo Sapiens
ggucacaaaugcuguucccuucuuuccauauuauuuguaguauuuaucuagagagcuugguuaa

SEQ ID NO: 48736 - RNA, 64 nt, Homo Sapiens
ucucaacucaacucaaagucuuccuaaccuccucuuguaguaauucccucuuuccaauccuggu

SEQ ID NO: 48737 - RNA, 64 nt, Homo Sapiens
uucauuugaguuaaauuuacuuuuaaagcaauuauuguaguaauccucauuuuccuaaauaugu

SEQ ID NO: 48738 - RNA, 64 nt, Homo Sapiens
aaauaauuaaaaauuguuaaaaagaaauguagucuuguaguauguuuauaauucugcuauuuua

SEQ ID NO: 48739 - RNA, 64 nt, Homo Sapiens
guuuuuguaauuuaacaauauuaaucuguuguaauuguaguauuaaccuuuucucauugcugag

SEQ ID NO: 48740 - RNA, 64 nt, Homo Sapiens
uaauuaccuuguacaggacccaucacgagaguguuuguaguaauaauacacuauuggccauguc

SEQ ID NO: 48741 - RNA, 64 nt, Homo Sapiens
caaguaagauaagugaccuauuauagugugagacuuguaguauuagccugauuucuagaagagg

SEQ ID NO: 48742 - RNA, 64 nt, Homo Sapiens
caaugcugauauauuucuaguucagugaaauaauuuguaguaaccuuacucugagguuuuacgg

SEQ ID NO: 48743 - RNA, 64 nt, Homo Sapiens
aauuacauggaaaauacuagcaaugugaaugcuuuuguaguaaccaucuuguaguaccugugaa

SEQ ID NO: 48744 - RNA, 64 nt, Homo Sapiens
uacuagcaaugugaaugcuuuuguaguaaccaucuuguaguaccugugaaaucuauaacucaga

SEQ ID NO: 48745 - RNA, 64 nt, Homo Sapiens
uucugugaagucauuuuuuuucuugucauuccuuuuguaguaguugcuguuuggauaaaaguug

SEQ ID NO: 48746 - RNA, 64 nt, Homo Sapiens
augccaguugcuuggcuagaauaugaucaacgacuuguaguagacucaaguuuuuaaaaaacac

SEQ ID NO: 48747 - RNA, 64 nt, Homo Sapiens
aacauuuuuaaauuaaauguagcuauuuuauauauuguaguaucacacuaugugcauuuauaau

SEQ ID NO: 48748 - RNA, 64 nt, Homo Sapiens
uucuguaaaauacuuugguuguuuuuauggcguuuuguaguaaaagagagcuuaagugaaggca

SEQ ID NO: 48749 - RNA, 64 nt, Homo Sapiens
acucacucuccuuauuacacaagcacagccgcccagugugcacaucaugugcagacaccuugga

SEQ ID NO: 48750 - RNA, 64 nt, Homo Sapiens
cacccuagaccccucuuccucucucccccaccauagugugcaauaaagugucuguucuuaccaa

SEQ ID NO: 48751 - RNA, 64 nt, Homo Sapiens
cugugauaucugaauguucaaagaauuacuaucuagugugcagugugguuauguaaaagaccug

SEQ ID NO: 48752 - RNA, 64 nt, Homo Sapiens
ucuaaugucaugcuuuugaauaacauuucuauguagugugcaacauuuguucauccauguauuc

SEQ ID NO: 48753 - RNA, 64 nt, Homo Sapiens
aggugugugugacccacuggaugggagggcaaugagugugcacauacaaauggggcagugugca

SEQ ID NO: 48754 - RNA, 64 nt, Homo Sapiens
gggagggcaaugagugugcacauacaaauggggcagugugcaugcaacacacuuaggggaggag

SEQ ID NO: 48755 - RNA, 64 nt, Homo Sapiens
uggggguuccgggaaugaugcaacugguuuuacuagugugcaaguguguucauccccaaguucu

SEQ ID NO: 48756 - RNA, 64 nt, Homo Sapiens
ccugagugugaacagguuugccuacguuggugcaagugugcauggcuggggacuucucacuucc

SEQ ID NO: 48757 - RNA, 64 nt, Homo Sapiens
guaaaaacaaaaugaugcauuuugagaagaacaaagugugcacucagcggcuggaaaggaaaua

SEQ ID NO: 48758 - RNA, 64 nt, Homo Sapiens
auuucugcaaagaucaagauaagcuggaugaaguagugugcauuuguaauacuauugcaagacu

SEQ ID NO: 48759 - RNA, 64 nt, Homo Sapiens
aucuuaaaaauaccaaauaacagaagaucgcauugcagaugauaucaggaugugguuuccagcu

SEQ ID NO: 48760 - RNA, 64 nt, Homo Sapiens
uuaacauuucaaaaguuuuucguauuuuuuuauggcagaugauuugucauuuauuuauauuagg

SEQ ID NO: 48761 - RNA, 64 nt, Homo Sapiens
guuuacacauggagagaugccccauggugggcaggcagaugaugaaguacuggcagguaggcag

SEQ ID NO: 48762 - RNA, 64 nt, Homo Sapiens
cacccuucucuccuuuccucauccuaagugccuggcagaugaaggaguuuucaggagcuuuuga

SEQ ID NO: 48763 - RNA, 64 nt, Homo Sapiens
cagggggagccuaggcccagcucacuggccugcugcagaugagcgcgggccggagcugaucgcu

SEQ ID NO: 48764 - RNA, 64 nt, Homo Sapiens
ggcucccugaaacugcugccuccaaggccccccagcagaugaugagcguguuccccuguaccug

SEQ ID NO: 48765 - RNA, 64 nt, Homo Sapiens
ccuuucuuaaagacaggcugaaaccccuucaaaggcagaugaggagguacagacacgugaccuu

SEQ ID NO: 48766 - RNA, 64 nt, Homo Sapiens
aaguugaguaccugugaucuaaaauguccuggaggcagaugacaucuaaaauaugugcuuucca

SEQ ID NO: 48767 - RNA, 64 nt, Homo Sapiens
ugucaauauaagaaaaaucaucacccagacaugugcagaugaaauuacauugauuaaugaauua

SEQ ID NO: 48768 - RNA, 64 nt, Homo Sapiens
ccagcucuugcuugguuggacaggguggccaugagcagaugagauguuuagcaaauggcucuga

SEQ ID NO: 48769 - RNA, 64 nt, Homo Sapiens
ucauaugcagauuuuauucucaccugggccauuugcagaugagacuguaguuugcagaugagac

SEQ ID NO: 48770 - RNA, 64 nt, Homo Sapiens
ucaccugggccauuugcagaugagacuguaguuugcagaugagacuguaguuugcagauggcgu

SEQ ID NO: 48771 - RNA, 64 nt, Homo Sapiens
ugaggagaaggaaagccgauucuuuggaaguucagcagaugaaagcccaggccagggaggagaa

SEQ ID NO: 48772 - RNA, 64 nt, Homo Sapiens
cgcagauggagcggcagcgccucgcucgagagaagcagaugagggaggaggcugaacgcacgag

SEQ ID NO: 48773 - RNA, 64 nt, Homo Sapiens
aacgcacgagggaugaguuggagaggaggcugcugcagaugaaagaagaagcaacaauggccaa

SEQ ID NO: 48774 - RNA, 63 nt, Homo Sapiens
aaggcaaaaagauugucaaaauaaaaacaauaauucaaguaacaaugcccggaauauacgucc

SEQ ID NO: 48775 - RNA, 63 nt, Homo Sapiens
uucuaaaaucaaggugaaauuugaacagaaugguucaaguaaaaauucucaucuggucucccc

SEQ ID NO: 48776 - RNA, 63 nt, Homo Sapiens
acagaagcccguuuccuuccuagcuuccccggcuucaaguagacuccuuugagaaggagaccu

SEQ ID NO: 48777 - RNA, 63 nt, Homo Sapiens
gacauuucucaccucugauuagcagccuaacucuucaaguaccuagacgcuggguagaugcaa

SEQ ID NO: 48778 - RNA, 63 nt, Homo Sapiens
uucuaccauuugugaagaaaugaauuuuccaguuucaaguaccuauucaaaauuuuauuaaaa

SEQ ID NO: 48779 - RNA, 63 nt, Homo Sapiens
agcucacugccuauuugauggcuguaacaagucuucaaguauauacuuuuauaauaaguugaa

SEQ ID NO: 48780 - RNA, 63 nt, Homo Sapiens
gaaugaagauaaaaaaggaaagauuaauauuuguucaaguagaugucucuaaaauuauuuuaa

SEQ ID NO: 48781 - RNA, 63 nt, Homo Sapiens
auaguauucucuuacagaaguucaaaucauaucuucaaguacucauuugguacaugauuuuuu

SEQ ID NO: 48782 - RNA, 63 nt, Homo Sapiens
cggcuggguuaauucaugauguuacuuuuguaauucaaguaaguuauuuucauauugaaucau

SEQ ID NO: 48783 - RNA, 63 nt, Homo Sapiens
cuuacuaugguugcuuuccccauauucuaucaauucaaguauugguggaaguagagaguaacu

SEQ ID NO: 48784 - RNA, 63 nt, Homo Sapiens
uuucguauuuacugucuuuuuugcauuguucuuuucaaguaugcccuuucaucuuacuaaauu

SEQ ID NO: 48785 - RNA, 63 nt, Homo Sapiens
cccggaagaaagaccuauaugaugcgguuuggauucaaguauccugguuagcaagaccacucc

SEQ ID NO: 48786 - RNA, 63 nt, Homo Sapiens
ccucccaguggaggcaucuuacauuuaggcuacuucaaguauccucagaaauguauucugcac

SEQ ID NO: 48787 - RNA, 63 nt, Homo Sapiens
uagcuuagugccauuaugucauuuugauuuguauucaaguacucuucaaguaucuuuguaaug

SEQ ID NO: 48788 - RNA, 63 nt, Homo Sapiens
cauuaugucauuuugauuuguauucaaguacucuucaaguaucuuuguaaugaagguuuggcu

SEQ ID NO: 48789 - RNA, 64 nt, Homo Sapiens
augguuacuuuccuugugauucacugucauaaaaggcucuaauugauaugaaaaacaaauuuuc

SEQ ID NO: 48790 - RNA, 64 nt, Homo Sapiens
augauuucccuagucagugccacuugccuuacaaggcucuaauuaaguguccuugucaugaaaa

SEQ ID NO: 48791 - RNA, 64 nt, Homo Sapiens
ucccccguagaaaucccccuuucucuaauagcgaggcucuaaccacacagccuacaaugcugcg

SEQ ID NO: 48792 - RNA, 64 nt, Homo Sapiens
augacuucccaacugcaagucacaaaggaauggaggcucuaauugaauuuucaagcaucuccug

SEQ ID NO: 48793 - RNA, 64 nt, Homo Sapiens
ccugcgaaagcugucaacuuuugugguuguagcaaguauuaauaaauauuuauaaauccucuaa

SEQ ID NO: 48794 - RNA, 64 nt, Homo Sapiens
ucuagcuaccuauccaauacuaaauaccccuuaaaguauuaaaugcacuaucugcuguaaaaga

SEQ ID NO: 48795 - RNA, 64 nt, Homo Sapiens
gccuuucuuuuccuauuucuuuuuuuuaaggguuaguauuaacaaauggcaaugaguagaaaag

SEQ ID NO: 48796 - RNA, 64 nt, Homo Sapiens
uuggcagggaaaaagggcaauguugauuaaucucaguauuaaaccacauuaaucuguaucccau

SEQ ID NO: 48797 - RNA, 64 nt, Homo Sapiens
gaagaccuuuuaaagcauuguuuuagaaugucugaguauuaagauacagauuaauugggaauau

SEQ ID NO: 48798 - RNA, 64 nt, Homo Sapiens
gaguauuaagauacagauuaauugggaauaucugaguauuaaguacuuucuucagaguauaaga

SEQ ID NO: 48799 - RNA, 64 nt, Homo Sapiens
auuacauucuuagaguagagcagaguuuuuaguuaguauuaauuuauuuuccuccauucaugua

SEQ ID NO: 48800 - RNA, 64 nt, Homo Sapiens
ucauuaacacuuacauuuccauaaagaaaacucaaguauuaauaaaagagacuuuacuggcuua

SEQ ID NO: 48801 - RNA, 64 nt, Homo Sapiens
cuuuagguagaugcaacugguauaucguccagaaaguauuaagguaugcuguguuuaucaugug

SEQ ID NO: 48802 - RNA, 64 nt, Homo Sapiens
ccaaaaaguuguuuuuaaagaaguauucuguguuaguauuaaugcuuuugcagaauguucaagg

SEQ ID NO: 48803 - RNA, 64 nt, Homo Sapiens
cccuguccuuugccucuauuaagcagaggauggaaguauuaaggauuuuguaacaccuuuuaug

SEQ ID NO: 48804 - RNA, 64 nt, Homo Sapiens
uaauagcucuaacaugcaauauaaaauucauaggaguauuaauagcccauuuacacaucuauaa

SEQ ID NO: 48805 - RNA, 64 nt, Homo Sapiens
auuaguauuauuaacacuaauaguguuaacuguuaguauuaacuuugucaauaguauuaacuau

SEQ ID NO: 48806 - RNA, 64 nt, Homo Sapiens
auuaguguuaacuguuaguauauggguugucaauaguauuaacuggaugucugaaaucagugcc

SEQ ID NO: 48807 - RNA, 64 nt, Homo Sapiens
aagcugcuaauuguaaacaaaacaguuacccuccaguauuaauaugacucauuagugugagcca

SEQ ID NO: 48808 - RNA, 64 nt, Homo Sapiens
caaguaugauuaugacccuuggacuuccugauguaguauuaaauuucaacucugguuauccauu

SEQ ID NO: 48809 - RNA, 64 nt, Homo Sapiens
agucuuauuuucuauguuuuauucauagaaauggaguauuaauuuuuaauauuuucaccauaug

SEQ ID NO: 48810 - RNA, 64 nt, Homo Sapiens
caaaggaucuuucaugaauguccaaggguaagucaguauuaauuaaugcuguauuacaaggcaa

SEQ ID NO: 48811 - RNA, 64 nt, Homo Sapiens
uuugcguugcuuucuacauagagacuuguauaauaguauuaauaguagcucauucucucuaaaa

SEQ ID NO: 48812 - RNA, 64 nt, Homo Sapiens
ugagcucuugauuacaauuuaauacauuguaaaaaguauuaaauccuuugaaacaucuuuuguu

SEQ ID NO: 48813 - RNA, 64 nt, Homo Sapiens
agguuuuaaugugagauauuuugccacugacuguaguauuaauauuaacaguagaaugcgaucu

SEQ ID NO: 48814 - RNA, 64 nt, Homo Sapiens
caucgcaauaauguuccugugaggauaucgugacaguauuaaaaaaguucuucaguuuuuaagu

SEQ ID NO: 48815 - RNA, 64 nt, Homo Sapiens
acuugccaaacagucuuuuaugaaggaaaguuacaguauuaauuuuugaaaagguuuuuuuuau

SEQ ID NO: 48816 - RNA, 64 nt, Homo Sapiens
acccuacaacugcccugggacauuucacuguaccaguauuaacugcaaacagcaauaauuguca

SEQ ID NO: 48817 - RNA, 64 nt, Homo Sapiens
cccuuaugagaagugaagguuuuguaaacuuuccaguauuaauuugggcggguauuccccgcuu

SEQ ID NO: 48818 - RNA, 64 nt, Homo Sapiens
gauauuaagaucaaagggaggaagggaagacagcaguauuaauucacccuagauuacucaauuu

SEQ ID NO: 48819 - RNA, 64 nt, Homo Sapiens
aaaugaaaagcuguggagaaaauguccucauuaaaguauuaaagugugggcagaauuacaauua

SEQ ID NO: 48820 - RNA, 64 nt, Homo Sapiens
aaauugguaucuauuauuuuaccaauuuuuuuuuaguauuaaguccauuuagaacuaaccauau

SEQ ID NO: 48821 - RNA, 64 nt, Homo Sapiens
aauccucacgcaaguagauacauguucauccaaaaguauuaauagaaauucucuaucagcuauu

SEQ ID NO: 48822 - RNA, 64 nt, Homo Sapiens
uuguucuuuuuucagcaaaauacuucaaaugaauaguauuaacuuacaaaaagucacaaaaacu

SEQ ID NO: 48823 - RNA, 64 nt, Homo Sapiens
ucaaggauuuucauguugaugacucgaaacugacaguauuaaggguaggauguugcuucugaau

SEQ ID NO: 48824 - RNA, 64 nt, Homo Sapiens
gggauuuauaaaccagcugugauuaacaauguaaaguauuaauuauugaacuuugaaccagauu

SEQ ID NO: 48825 - RNA, 64 nt, Homo Sapiens
uaaugaaugauuauaaacaagaugcaucuuagauaguauuaauauacugagccuuggauuauau

SEQ ID NO: 48826 - RNA, 64 nt, Homo Sapiens
aaauaccaccauccuuaacauauacaggaaaaccaguauuaagcagccauaagaaaauaucugc

SEQ ID NO: 48827 - RNA, 64 nt, Homo Sapiens
ugauuuuuuuaaaagauguaauggucaagccuguaguauuaaaauauagacauaucauuauuuc

SEQ ID NO: 48828 - RNA, 64 nt, Homo Sapiens
uuuaaugggaugagcauuaaagcagaacuaaugcugacuggaugaucgcaauuaccuuauguaa

SEQ ID NO: 48829 - RNA, 64 nt, Homo Sapiens
auagucauuauaaucacagguuaucccgucucuaugacuggaucagacacuaaagcguuacacu

SEQ ID NO: 48830 - RNA, 64 nt, Homo Sapiens
gggacagccuuauucccaaaugucucuauccuuuugacuggagcaucuucugcacaaccuuggg

SEQ ID NO: 48831 - RNA, 64 nt, Homo Sapiens
ucugggguuauagauucccccacugccccagcucugacuggaccccaaguggcugcuauguaaa

SEQ ID NO: 48832 - RNA, 64 nt, Homo Sapiens
uuguggauaucaggguauaaaaaugccaagggggugacuggaagugaauauuccuggacuuaca

SEQ ID NO: 48833 - RNA, 64 nt, Homo Sapiens
uucuaucauuccaauucuaaacagauggggucugugacuggauccaaaagacaaaaaucaaaga

SEQ ID NO: 48834 - RNA, 64 nt, Homo Sapiens
gcuuggggugggggacgaucaucucuucugguguugacuggacuaaauuuuaacuguagguaug

SEQ ID NO: 48835 - RNA, 64 nt, Homo Sapiens
aggccugucccaauucugccgcccugugcccgacugacuggaggcuuccucagcugccuccugc

SEQ ID NO: 48836 - RNA, 64 nt, Homo Sapiens
ugauuccagucacccuguaguuacugacagaaauugacuggacugucauugugugaagucuagg

SEQ ID NO: 48837 - RNA, 64 nt, Homo Sapiens
gccuggccuuauguaaagcucuugaccuagcaucugacuggaaacaagcgggaauugcauuggg

SEQ ID NO: 48838 - RNA, 64 nt, Homo Sapiens
cacuucccagcuaggagugcacuuuaugggacugugacuggacucuuccguucuggcuccagcc

SEQ ID NO: 48839 - RNA, 64 nt, Homo Sapiens
ccagucaucauuaauacaauguguugggauucugugacuggaaaaggugacaaguuggugacuu

SEQ ID NO: 48840 - RNA, 64 nt, Homo Sapiens
uucuaucacacaagaggcaauuaauuaaaccuucugacuggaagacaaaagugcauggggggga

SEQ ID NO: 48841 - RNA, 64 nt, Homo Sapiens
gcgguuguaaauacaauucauauaacagacagcaugacuggacacgcaaaaucuuacacccugg

SEQ ID NO: 48842 - RNA, 64 nt, Homo Sapiens
ggaaggcgcuacugguuuuaaaggggcccaccaagucuuggacggcccauuagcacuuugguuc

SEQ ID NO: 48843 - RNA, 64 nt, Homo Sapiens
ucacucagcagguuccuugccuccacugucuuuugucuuggaggucaagacucucugaaugcug

SEQ ID NO: 48844 - RNA, 64 nt, Homo Sapiens
gguaccagagccuauggaaauccagaguaggugggucuuggauuagcgaggcagaauggugggc

SEQ ID NO: 48845 - RNA, 64 nt, Homo Sapiens
ggagguguggaguggagggguaggacccaagguggucuuggagauugggguagagaggacaguu

SEQ ID NO: 48846 - RNA, 64 nt, Homo Sapiens
ucuguguauauauagaagguagaaaugaaaagugagaaaauauuugaaagggauuauauuaauu

SEQ ID NO: 48847 - RNA, 64 nt, Homo Sapiens
aaaugucacguuuccauaucuccugcuggaaaucagaaaauauaauaaaauugcacaaaaaaaa

SEQ ID NO: 48848 - RNA, 64 nt, Homo Sapiens
auuguauauaauaguauagucaccaucaagauguagaaaauagaaaauaggcuaggcacagugg

SEQ ID NO: 48849 - RNA, 64 nt, Homo Sapiens
auaauaguauagucaccaucaagauguagaaaauagaaaauaggcuaggcacaguggcucacgc

SEQ ID NO: 48850 - RNA, 64 nt, Homo Sapiens
cauuuugaaucccucuuccucacuuuuuuuucuaagaaaauaaacauuuuacuguuuuuaugga

SEQ ID NO: 48851 - RNA, 64 nt, Homo Sapiens
caaauauugucacaaguaaauagcaaucaaaaggagaaaauaacuuuuguauuuuuuuaaugug

SEQ ID NO: 48852 - RNA, 64 nt, Homo Sapiens
uuaaaggaagaaauauuuucaaauucuuaauccaagaaaauacugaguuggaaucuuagacuuc

SEQ ID NO: 48853 - RNA, 64 nt, Homo Sapiens
aaacuugaucuaacugaaaauaacaccuuguguaagaaaauaaacugaaagauuggauuuucua

SEQ ID NO: 48854 - RNA, 64 nt, Homo Sapiens
aagucucugaucuauaggcccaguggacccagauagaaaauauauggauuuuaagcccagacuu

SEQ ID NO: 48855 - RNA, 64 nt, Homo Sapiens
accauguaaauauguacauagaaaaucauauuucagaaaauauuaugcuguuacugagaauaau

SEQ ID NO: 48856 - RNA, 64 nt, Homo Sapiens
ccuuauucaugaugcuguuaauaaggcaaaagccagaaaauagcaaaaggcaagauacauguga

SEQ ID NO: 48857 - RNA, 64 nt, Homo Sapiens
ucuucaggagggccgaccuuaaguaggcagaauaagaaaauaguuugggaauuuuacagaguca

SEQ ID NO: 48858 - RNA, 64 nt, Homo Sapiens
uuucagcauuauaagaaaggguuuuaacuucuaaagaaaauaugcaggccacuuugucguguuu

SEQ ID NO: 48859 - RNA, 64 nt, Homo Sapiens
aggcuauaaauguccuaagggcaacuuugauggaagaaaauauuuauucuggugaugggguuua

SEQ ID NO: 48860 - RNA, 64 nt, Homo Sapiens
guuugauucuucauuuuuuucaaaaaaacagaaaagaaaauauaacagaguggagacucuguuu

SEQ ID NO: 48861 - RNA, 64 nt, Homo Sapiens
guuugaggccgggcacgguguuacuguacuaauuagaaaauauagugucaugauuaauguguau

SEQ ID NO: 48862 - RNA, 64 nt, Homo Sapiens
cugggaauagucauacugacaaaauaggagcaaaagaaaauacuuuauuguguuuauauguaua

SEQ ID NO: 48863 - RNA, 64 nt, Homo Sapiens
aguuuuaaaaguuuucuauuguacauaaacuaguagaaaauagcuuauuauuagcaugucauuu

SEQ ID NO: 48864 - RNA, 64 nt, Homo Sapiens
cagaauaacuggucuuguuaucauuuaucuaaagagaaaauauguuuuuaaaaaccgaauuuca

SEQ ID NO: 48865 - RNA, 64 nt, Homo Sapiens
aaggucuccccuuuuucuauccaagguauuccaaagaaaauauuauucuuaaaauuuuuuccca

SEQ ID NO: 48866 - RNA, 64 nt, Homo Sapiens
guugggagcucuccaaagaaacugguugguuuuaagaaaauaguuucaagaaguucaacuauau

SEQ ID NO: 48867 - RNA, 64 nt, Homo Sapiens
uaauacuucauuguguuguacuggaugcaaagcuagaaaauauugcaauaaaugagaccgauga

SEQ ID NO: 48868 - RNA, 64 nt, Homo Sapiens
cgcuuugucuccuacaaucuuguguccauugaaaagaaaauaggugauugcugcuauucuggaa

SEQ ID NO: 48869 - RNA, 64 nt, Homo Sapiens
gcucauuacaauaaaauuguuaaaagagaaauuuagaaaauacaacuguaugaaaacaggaaaa

SEQ ID NO: 48870 - RNA, 64 nt, Homo Sapiens
accuuucaaacugguuuguauuuauuucaaaggaagaaaauauauugauucuuagaaaauaaac

SEQ ID NO: 48871 - RNA, 64 nt, Homo Sapiens
auuuauuucaaaggaagaaaauauauugauucuuagaaaauaaacugucaauuuagaauucuuu

SEQ ID NO: 48872 - RNA, 64 nt, Homo Sapiens
uuuuugacagacuauuugcuaauguauaaugugcagaaaauauuuaauaucaaaagaaaauuga

SEQ ID NO: 48873 - RNA, 64 nt, Homo Sapiens
gcuuugauaauuguguaccuuaagauauugaaggagaaaauagauaauuuacaagauauuauua

SEQ ID NO: 48874 - RNA, 64 nt, Homo Sapiens
ucacagaugacugcaaguucagggagcguuuucaagaaaauagcuauaauaccuaugccucagc

SEQ ID NO: 48875 - RNA, 64 nt, Homo Sapiens
uugguggcugggauaugauggguuagaagcaaggagaaaauauaaggacuuuuugauggaauua

SEQ ID NO: 48876 - RNA, 64 nt, Homo Sapiens
aauuucaaaauuuaaagccaugcuaaaauuaaaaagaaaauauuaaauuacacaauuacacuug

SEQ ID NO: 48877 - RNA, 64 nt, Homo Sapiens
ucucaugucagacccagaaauacucuaguuaaaaagaaaauaaaucaaacaaaacagauaugcu

SEQ ID NO: 48878 - RNA, 64 nt, Homo Sapiens
uuguaaaagaauguuuauuuguuuugcacugggaagaaaauauuauagaaacaaugguuccuua

SEQ ID NO: 48879 - RNA, 64 nt, Homo Sapiens
auauaaauuuugaaacuauguuuccagaaucaaaagaaaauaaacagaauugaccuuaauuugu

SEQ ID NO: 48880 - RNA, 64 nt, Homo Sapiens
gaaggcuaauauauaauuuuaaaaaaaggagagaagaaaauaaaccugucucaaaaaaaaaaaa

SEQ ID NO: 48881 - RNA, 64 nt, Homo Sapiens
auucacuugaauuugacaaaaagcaaauuacuuaagaaaauacaggugacuuucuuuuuuugua

SEQ ID NO: 48882 - RNA, 64 nt, Homo Sapiens
ccauuugacacacuauagauuuacuaaagugacaagaaaauauaaaaugugugcuuuauagugu

SEQ ID NO: 48883 - RNA, 64 nt, Homo Sapiens
agaaaugugaaaggaccuuuugucacagcacuucagaaaauacacaacagccccuucugccccc

SEQ ID NO: 48884 - RNA, 64 nt, Homo Sapiens
guauuuugucuuuguaauuuacagaaguuauuggagaaaauaaacuuguuucauuuugcauuuc

SEQ ID NO: 48885 - RNA, 64 nt, Homo Sapiens
gugugacuguggguuuuauuuuguauucugguuaagaaaauaauguauugaguuacugucaagu

SEQ ID NO: 48886 - RNA, 64 nt, Homo Sapiens
uaaaguuuaugugugugaugugacuuaacuaugcagaaaauauuuaaguuggauguacuuguuu

SEQ ID NO: 48887 - RNA, 64 nt, Homo Sapiens
acaugcauacacacacacacacagccacacacacagaaaauauacuguaaagaaagagagaaaa

SEQ ID NO: 48888 - RNA, 64 nt, Homo Sapiens
ccacacacacagaaaauauacuguaaagaaagagagaaaauaaaaaguuaaaaaguuaaaaaaa

SEQ ID NO: 48889 - RNA, 64 nt, Homo Sapiens
uagcauuaaauauaaaauacauaaaagaauguacagaaaauagcuuuuauugaguaauauuaca

SEQ ID NO: 48890 - RNA, 64 nt, Homo Sapiens
ucauccaccaauaucauguguagauauuauguauagaaaauaaaauaaauuauggcucuaacuu

SEQ ID NO: 48891 - RNA, 64 nt, Homo Sapiens
guagggggacuaaggaacauuucggaucuaugaaagaaaauauacguguucuuacaaaugaacc

SEQ ID NO: 48892 - RNA, 64 nt, Homo Sapiens
cacuuucucugaaagaccuggauguuguaauucaagaaaauagguuuggaguguaaaucuucau

SEQ ID NO: 48893 - RNA, 64 nt, Homo Sapiens
gcacaguguccucaggauauuuugaauugcuaauagaaaauaauuccguaggcagagugcucac

SEQ ID NO: 48894 - RNA, 64 nt, Homo Sapiens
caaagagaucauuuuuaaguguggguggaaugagagaaaauauguacagcaggaaaucaaagga

SEQ ID NO: 48895 - RNA, 64 nt, Homo Sapiens
acuuauuagcaauuaaagggaaauacucaugaucagaaaauaguagaguugauuucaagauuau

SEQ ID NO: 48896 - RNA, 64 nt, Homo Sapiens
ccagcaaaaugaaggaguacagggaagcuguuggagaaaauacuuaccuccaugugcccuuuuu

SEQ ID NO: 48897 - RNA, 64 nt, Homo Sapiens
agaaaaaccagccaggcacaugaaugaaguagagagaaaauaaauuucagaugccuuugagaaa

SEQ ID NO: 48898 - RNA, 64 nt, Homo Sapiens
uaccuauccagacauaaauguguguauguaaauuagaaaauacaugucuauacucaacuggaua

SEQ ID NO: 48899 - RNA, 64 nt, Homo Sapiens
guuggcuuagucuagucucucuguuaccuguuauagaaaauaguuaaaauuuuugaaaucacua

SEQ ID NO: 48900 - RNA, 64 nt, Homo Sapiens
uuacaagugugcaaauuaugacugcgugagccuuagaaaauaaaauguauaaagggcaacacau

SEQ ID NO: 48901 - RNA, 64 nt, Homo Sapiens
auugcaguauuuaaagcuuaagcuuucaggaaaaagaaaauaagaauucagugugugcaugaca

SEQ ID NO: 48902 - RNA, 64 nt, Homo Sapiens
caguuuagcuuuguguuguaugcuaguuuaaaaaagaaaauauguaauauaauguaaaaaaaaa

SEQ ID NO: 48903 - RNA, 64 nt, Homo Sapiens
uugaugguaaaguugguaaaaggcaacuuucagaagaaaauaaugugcuuuagaaaaaaaauuc

SEQ ID NO: 48904 - RNA, 64 nt, Homo Sapiens
acuccaauaugcuaaaaguuaaauaugguauuuaagaaaauagucauguaugcaauugagaaag

SEQ ID NO: 48905 - RNA, 64 nt, Homo Sapiens
acacacccaguuauggaauguccagaguucucgaagaaaauaaaugacuuuaggaagagguaua

SEQ ID NO: 48906 - RNA, 64 nt, Homo Sapiens
cugcuggaaagugggacccucugaguggguggucagaaaauacccaugcugaugaaaugaccua

SEQ ID NO: 48907 - RNA, 64 nt, Homo Sapiens
gguguacaaauuggucaaguugcaauuauuuaugagaaaauaaugauaaauguaaaauaucuaa

SEQ ID NO: 48908 - RNA, 64 nt, Homo Sapiens
caugaaucuaagagcacgcaauauauaauuuuaaagaaaauauucuauuugguagaauacaaau

SEQ ID NO: 48909 - RNA, 64 nt, Homo Sapiens
gucucaugaggaacacuacuuaaugcagugggaaagaaaauauuucagaggagaauuuuuucuu

SEQ ID NO: 48910 - RNA, 64 nt, Homo Sapiens
gccauucagucuggacuucaaaucacuugucuucagaaaauaaaagauuuguuccacccgggug

SEQ ID NO: 48911 - RNA, 64 nt, Homo Sapiens
agagggaagggaaaaaagugugaaaggaugaugaagaaaauaauuuuacuauuucuuuuaaaag

SEQ ID NO: 48912 - RNA, 64 nt, Homo Sapiens
auguccuguucacugaauauuccggguaauugaaagaaaauauaauggaugggcuccauuaaaa

SEQ ID NO: 48913 - RNA, 64 nt, Homo Sapiens
gaagauaaaaagacauucuuccaaaaagauuuucagaaaauauuauguguuuccauauuuuaua

SEQ ID NO: 48914 - RNA, 64 nt, Homo Sapiens
uauuuuuccaaaauaauuuuaagaaaucaaagagagaaaauaaagaccuugcuuaugauugcag

SEQ ID NO: 48915 - RNA, 64 nt, Homo Sapiens
ucgcuuuuuucuuuuuaugcuagggcccaacuucagaaaauacuauuguuuuucuaauacuuua

SEQ ID NO: 48916 - RNA, 64 nt, Homo Sapiens
uaugcaagcacaacuugaagggcagcaaagcuucagaaaauauaucuuuuccuguuaacaagcu

SEQ ID NO: 48917 - RNA, 64 nt, Homo Sapiens
acuggaauuaaaaauauauauuaacaggaauuuaagaaaauauucuuuaauauugauuauauuu

SEQ ID NO: 48918 - RNA, 64 nt, Homo Sapiens
cuuuauaugauauacuaugagaauuuucaaaauaagaaaauaacggauuucuccaaaucuggga

SEQ ID NO: 48919 - RNA, 64 nt, Homo Sapiens
uuuauuuuuuucccuuuagcauugcaugugaauaagaaaauaauguuuaaagaaaaaaaaaaaa

SEQ ID NO: 48920 - RNA, 64 nt, Homo Sapiens
cacuauaguauaagaaucuauuuuggagaaaaaaagaaaauaugagggucucgaagcaugauuu

SEQ ID NO: 48921 - RNA, 64 nt, Homo Sapiens
uuucuuucugguuaaaaaaaggaaaaaccaucuaagaaaauauauauguauguauguguguaua

SEQ ID NO: 48922 - RNA, 64 nt, Homo Sapiens
cauuauaaaugcaauuuuugucaagagaucuuucagaaaauauaagccuuuaaagugaagaaga

SEQ ID NO: 48923 - RNA, 64 nt, Homo Sapiens
auuugugaaaacauuuuuuaaaaaacuacagcuuagaaaauaccagaggccucauacuaaaaua

SEQ ID NO: 48924 - RNA, 64 nt, Homo Sapiens
acauugcugaguauagaaucagaaugcugaguauagaaaauaauuuaaaacuaaaguugguagg

SEQ ID NO: 48925 - RNA, 64 nt, Homo Sapiens
guuuuguaguucaacaacuccuucggaugacugcagaaaauaguucacaaguaauggcacaauu

SEQ ID NO: 48926 - RNA, 64 nt, Homo Sapiens
guggaguccuacuuguuuaauuggggacuauuggagaaaauaagcuucaagugaccuguacugc

SEQ ID NO: 48927 - RNA, 64 nt, Homo Sapiens
ggaauguuauuauaaacucuuauuuacccuggaaagaaaauauuuuaguauagaaacuacagaa

SEQ ID NO: 48928 - RNA, 64 nt, Homo Sapiens
ucagaucauguuuaugcauuagguugcugcacucagaaaauaauuuaggauuuucaaagaaugg

SEQ ID NO: 48929 - RNA, 64 nt, Homo Sapiens
gguucuuacuggaaugucuaucauucuacauuaaagaaaauaauccuuguagaauauguauuaa

SEQ ID NO: 48930 - RNA, 64 nt, Homo Sapiens
ugaaaauaaauuacauugccagcacagacuuucaagaaaauacuaacuuuucaugauuuuuaug

SEQ ID NO: 48931 - RNA, 64 nt, Homo Sapiens
guucuuuuucuccagaaaaaaauauaaauucuacagaaaauagugaagcaauagucuccaaguc

SEQ ID NO: 48932 - RNA, 64 nt, Homo Sapiens
aauaacuuuuauuacucagcuaacauaggaaguuagaaaauacuauaaaguacuaauuaaaugc

SEQ ID NO: 48933 - RNA, 64 nt, Homo Sapiens
ccauguuuuuauauagguucauaaaagguacagcagaaaauauaauuugugucaaauuauaauu

SEQ ID NO: 48934 - RNA, 64 nt, Homo Sapiens
aauuuuuaauugacaaagacgaucaacaaccugaagaaaauaucaaacaauuuguugauuaagu

SEQ ID NO: 48935 - RNA, 64 nt, Homo Sapiens
auauaaacauagaauagaaugaagcgauugcuugagaaaauaacuuuguaaacccuauaauuau

SEQ ID NO: 48936 - RNA, 64 nt, Homo Sapiens
uacacauauuuccaaauauuuucuuaugaccugcagaaaauauuuacagugcccuaaaauggug

SEQ ID NO: 48937 - RNA, 64 nt, Homo Sapiens
cauucuuuucaguuggagagaauugggcuaagauagaaaauaacaugauuuguuccuuauuaaa

SEQ ID NO: 48938 - RNA, 64 nt, Homo Sapiens
auucauauugcugugaaugcuuuaucuuggagauagaaaauauaaugauaaauucaucaugugu

SEQ ID NO: 48939 - RNA, 64 nt, Homo Sapiens
auaugaaaauuacacauuuuauaauuuuuagaugagaaaauaccacuagcagaauagcuuugug

SEQ ID NO: 48940 - RNA, 64 nt, Homo Sapiens
gcagaaguaauaauuggagguaaaguuuccuuagagaaaauaauuuuauucugcuuuguccaau

SEQ ID NO: 48941 - RNA, 64 nt, Homo Sapiens
cccuucuuacaaaaagaaaugacucaaguguagaagaaaauaucugaaaucucacagauguaag

SEQ ID NO: 48942 - RNA, 64 nt, Homo Sapiens
aagagugugaaaucucagauuguguuugacacuaagaaaauagcaaacaguuccugguuccucu

SEQ ID NO: 48943 - RNA, 64 nt, Homo Sapiens
ggagaaucacuuuucuagacgggguggcugugaaagaaaauaauguggaugaagguggguauug

SEQ ID NO: 48944 - RNA, 64 nt, Homo Sapiens
ugcccaacuaaacccagaacucaaacuuaacauuagaaaauaagguccagggccggacacagug

SEQ ID NO: 48945 - RNA, 64 nt, Homo Sapiens
ugaacuugccaaucaaaaaaugacaaucaauuugagaaaauagaaauagauauuuuuaaauaaa

SEQ ID NO: 48946 - RNA, 64 nt, Homo Sapiens
gacagccaacagaaacaaaaccuagcauagggauagaaaauaccaugcacgugugcagccccac

SEQ ID NO: 48947 - RNA, 64 nt, Homo Sapiens
gguuuuguguuuuuuucuggaacuacuucaagugagaaaauaaaaaaaaauggugacaaagcug

SEQ ID NO: 48948 - RNA, 64 nt, Homo Sapiens
accaauuagguugaaaaugcaaauggaaaauacaagaaaauagauuaaguuaugaagcaaauua

SEQ ID NO: 48949 - RNA, 64 nt, Homo Sapiens
gaagcaaaucucuuuaccgggacuagauauuccuagaaaauaaaugaccagucaacucuaagaa

SEQ ID NO: 48950 - RNA, 64 nt, Homo Sapiens
agaauggacccauugaggauaacuauaaaauuacagaaaauauuuaaaugcaacuuauugcuau

SEQ ID NO: 48951 - RNA, 64 nt, Homo Sapiens
gaugagccugaaucaucucauguaccugacaguaagaaaauacucuggcuggucucaguggcuc

SEQ ID NO: 48952 - RNA, 64 nt, Homo Sapiens
ucauuauuauuaaagcacaaaauaaccuauuguuagaaaauauguguuuuuauaaaugaaugua

SEQ ID NO: 48953 - RNA, 64 nt, Homo Sapiens
aaaauaauuaaaugaauugugaaauggauguuuaagaaaauauaggcuuaaaaaguaaaucuau

SEQ ID NO: 48954 - RNA, 64 nt, Homo Sapiens
uaagcaagagaaagacaacuguucugcggguuggagaaaauacaauuuuuuuuuuuuuuuuuga

SEQ ID NO: 48955 - RNA, 64 nt, Homo Sapiens
gggauuacaggcguuagccacugcgcccggcccgagaaaauacaguuuuaaaaagagaaagcuu

SEQ ID NO: 48956 - RNA, 64 nt, Homo Sapiens
aauaaggguauaauuuuguaggucauaugauugaagaaaauauuauuuuaacaauguaaagcaa

SEQ ID NO: 48957 - RNA, 64 nt, Homo Sapiens
aaguauaagguuuaaguaauuugguuuaauaaucagaaaauauucaauacaguguuggauauuc

SEQ ID NO: 48958 - RNA, 64 nt, Homo Sapiens
gauacaauuaaggcugacaugcauuguuucaugcagaaaauaaauagucuuuagucaaaucucu

SEQ ID NO: 48959 - RNA, 58 nt, Homo Sapiens
uggcuguagucucaaauuuuaagguuuuagaaaauauuaauccacuggagcgucuuga

SEQ ID NO: 48960 - RNA, 64 nt, Homo Sapiens
gucuaaaggaaaguagcacauugcuuggcagaaaagaaaauaagaauggccagaaaauauugua

SEQ ID NO: 48961 - RNA, 64 nt, Homo Sapiens
guauugcuuggcagaaaagauuggcauaauggccagaaaauauuauggacauuaucgcauuauc

SEQ ID NO: 48962 - RNA, 64 nt, Homo Sapiens
auuugaaauggacauuaucgugcaaaauaccauuagaaaauacuuugaacaaauauuuuaaagg

SEQ ID NO: 48963 - RNA, 64 nt, Homo Sapiens
aucaccaucauaaccuuucugcuguuuacaaagcagaaaauaucgugcugugggucaccaacag

SEQ ID NO: 48964 - RNA, 64 nt, Homo Sapiens
uuuuuucuuuucauugucaauuuauuuauuagaaagaaaauauacucuagcauuuuaaauuauu

SEQ ID NO: 48965 - RNA, 64 nt, Homo Sapiens
guagacagaucuuucucuuuaagcaagaauugccagaaaauaaaacugguggaaacguuaggau

SEQ ID NO: 48966 - RNA, 64 nt, Homo Sapiens
cacagaaaauuauaauguagauuuccuccccugcagaaaauaagguggcguugaauagaugugu

SEQ ID NO: 48967 - RNA, 64 nt, Homo Sapiens
ucugggauuacaaugaauguaugaggguaaauggagaaaauauucuguuaaauuucacaaaguc

SEQ ID NO: 48968 - RNA, 64 nt, Homo Sapiens
gcuucucuugcauuauuuucgccaaccuaagcaaagaaaauacgcugcaaagagcugcugcuuu

SEQ ID NO: 48969 - RNA, 64 nt, Homo Sapiens
ucucucucugcagagcccuguuucuaauugugguagaaaauauugagacagagcauuugccaug

SEQ ID NO: 48970 - RNA, 64 nt, Homo Sapiens
cuuguaaaacaugucaagauuuuuccaccaagcuagaaaauaaaaaacuuaguucuaccacauc

SEQ ID NO: 48971 - RNA, 64 nt, Homo Sapiens
gaaauggauuauuugucagcccgauuauuugcaaagaaaauauacaauuaucaagcagagacca

SEQ ID NO: 48972 - RNA, 64 nt, Homo Sapiens
aagaauaaaauuuucuacaucaaaguaagacuugagaaaauaaacuuauguguauauauguuua

SEQ ID NO: 48973 - RNA, 64 nt, Homo Sapiens
auucaacucaagcauaaagcaaaaucacuuugggagaaaauaaauuaacauuuauaggaggaaa

SEQ ID NO: 48974 - RNA, 64 nt, Homo Sapiens
caagauuuggaaaggaaguaaaaaagacaauuacagaaaauaagaagggucagcaacaacaaag

SEQ ID NO: 48975 - RNA, 64 nt, Homo Sapiens
acuucugagaaaaaguucaaagaaaauguagauuagaaaauaaguagagcagaaauaaaaagga

SEQ ID NO: 48976 - RNA, 64 nt, Homo Sapiens
uuuuuacaaaaagucacuuuucuucuuuuaguguagaaaauaaugauugcaugacuauuauuua

SEQ ID NO: 48977 - RNA, 64 nt, Homo Sapiens
gccaggacccgguaggccugagccucaacucuucagaaaauaguguuuuuaauauuccucuuca

SEQ ID NO: 48978 - RNA, 64 nt, Homo Sapiens
ucuucagaaaauaguguuuuuaauauuccucuucagaaaauaguguuuuuaauauuccgagcua

SEQ ID NO: 48979 - RNA, 64 nt, Homo Sapiens
uaauguaguuugagauagugauuaagugcuaugaagaaaauaaacuagggugaugauuuuagug

SEQ ID NO: 48980 - RNA, 64 nt, Homo Sapiens
augucgagcuuuaaaguccauaauuguuaucuucagaaaauauuauuugaccuacaguaugucc

SEQ ID NO: 48981 - RNA, 64 nt, Homo Sapiens
uaucuuuuacauauguauguuacuuuauuuuaguagaaaauauauauauauaucaagauuuggg

SEQ ID NO: 48982 - RNA, 64 nt, Homo Sapiens
guaaaaacacaggagaagaaaagucuaagauagcagaaaauacaacuacaaauaauuuucuuaa

SEQ ID NO: 48983 - RNA, 64 nt, Homo Sapiens
auaaauuucauaauguuaguguuagacgaaguguagaaaauaaagggcuauaauagcaauaaaa

SEQ ID NO: 48984 - RNA, 64 nt, Homo Sapiens
caaaugcauuauguaaggucucugacuuuucagaagaaaauaaaagcauuaaggaaguauauga

SEQ ID NO: 48985 - RNA, 64 nt, Homo Sapiens
ggccugaagggauaagauugaucuuaguggcccaagaaaauacagagagaaaauauguaaccac

SEQ ID NO: 48986 - RNA, 64 nt, Homo Sapiens
uaaccacaucuuaguggccccuaggagaugugagagaaaauaugggaauuguuuugcaaacguu

SEQ ID NO: 48987 - RNA, 64 nt, Homo Sapiens
caaaugguaucuaauuaauaacuagucugacaucagaaaauaaaauugaggcugauuuuuaaaa

SEQ ID NO: 48988 - RNA, 64 nt, Homo Sapiens
ggugugaaaacaagugucaaaauuccucauauagagaaaauaauuuugaguuuagaguauuauc

SEQ ID NO: 48989 - RNA, 64 nt, Homo Sapiens
uagaaugacuauucuaaauauuaauguauuaaaaagaaaauacaacaaaauguauauuuagaca

SEQ ID NO: 48990 - RNA, 64 nt, Homo Sapiens
aggaaagugugacacaguuuuuaaauuuagauguagaaaauaaugaauuaaugagauuggugaa

SEQ ID NO: 48991 - RNA, 64 nt, Homo Sapiens
acuuucucaaaauggaagccaaaagagaaggaagagaaaauacuaauauuuuaucauauguucu

SEQ ID NO: 48992 - RNA, 64 nt, Homo Sapiens
acaguuacaaccaauaggaagaaggcuucuuguuagaaaauaguuaggauccauuauuuccccu

SEQ ID NO: 48993 - RNA, 64 nt, Homo Sapiens
uauggacaguggaggcagcuggaauggcaagugcagaaaauaggaacaguucuauacagugcuc

SEQ ID NO: 48994 - RNA, 64 nt, Homo Sapiens
ucacauucugaaaaauaacauucucagaauccacagaaaauauacuuaguuacuacugaagaua

SEQ ID NO: 48995 - RNA, 64 nt, Homo Sapiens
uucuucagagauaacuucaaaagcaaaaaaagugagaaaauaauguugcucucuagucucugaa

SEQ ID NO: 48996 - RNA, 64 nt, Homo Sapiens
uaaauucuauugagcaaaauccauuuuaaaggaaagaaaauauggauuauacaggcuaugaaaa

SEQ ID NO: 48997 - RNA, 64 nt, Homo Sapiens
aaaaugcaaugugugugauucagaggccucuuuuagaaaauaauauuucauuuuucuaaagggg

SEQ ID NO: 48998 - RNA, 64 nt, Homo Sapiens
gaaaaggcuaugccuguaauuuucauauaaauauagaaaauagauagcaugaagcaugaauuau

SEQ ID NO: 48999 - RNA, 64 nt, Homo Sapiens
gaucaucuugaaguauuauuucacauugaaaagaagaaaauauauugauaacuauagauguuau

SEQ ID NO: 49000 - RNA, 64 nt, Homo Sapiens
auaauucagguuugaucaaggugugaauaacugaagaaaauaacuugcuggcuauauaggaaaa

SEQ ID NO: 49001 - RNA, 64 nt, Homo Sapiens
auuuuaaaguuagaauauauuugaaugcauggguagaaaauaucauauuuuaaaacuauguaua

SEQ ID NO: 49002 - RNA, 64 nt, Homo Sapiens
uucagugugaauucacugaauguuuauagacaaaagaaaauacacacuaaaacuaaucuucauu

SEQ ID NO: 49003 - RNA, 64 nt, Homo Sapiens
uuucuccuauuuuuaaauuuauuaugcaaauuuuagaaaauaaaauuugcucuaguuacacacc

SEQ ID NO: 49004 - RNA, 64 nt, Homo Sapiens
ggaaacuuguuuuuuuaacgucagccagauauuuagaaaauaaccucaaaaguguuuauauggu

SEQ ID NO: 49005 - RNA, 64 nt, Homo Sapiens
cuagagagaucccaucucuaaaaaauaaaauauaagaaaauaaaacuuaggggauauacagauu

SEQ ID NO: 49006 - RNA, 64 nt, Homo Sapiens
uguaauguucauauucaauaacugagucugauucagaaaauaauuuuguauuuaauaucaaugg

SEQ ID NO: 49007 - RNA, 64 nt, Homo Sapiens
ucccugggaggaugagcuggagaaaaaaccacuaagaaaauaccggggagcccagguaugagaa

SEQ ID NO: 49008 - RNA, 64 nt, Homo Sapiens
ucugccuuaaaaaauaugauguaguaaccauuacagaaaauacuaauuaaccaguaaacacucu

SEQ ID NO: 49009 - RNA, 64 nt, Homo Sapiens
cagugcauuuauagagaagguaauaaaaugcccaagaaaauauuuaauaaugcuaaaaaaggcc

SEQ ID NO: 49010 - RNA, 64 nt, Homo Sapiens
uagggacccugccaaguggcaccugauuuacucuagaaaauaaaaguagaaaauacugagucca

SEQ ID NO: 49011 - RNA, 64 nt, Homo Sapiens
aaguggcaccugauuuacucuagaaaauaaaaguagaaaauacugaguccagcuguguuguuug

SEQ ID NO: 49012 - RNA, 63 nt, Homo Sapiens
ucaagaagagcaaagcauggggaacgggcuuggaagaaaauaauuucagaugaugaagaaaga

SEQ ID NO: 49013 - RNA, 64 nt, Homo Sapiens
cuuacuggccagugauccucuucugguucuucagagaaaauagacuaaaugagguagaugaaua

SEQ ID NO: 49014 - RNA, 64 nt, Homo Sapiens
gcucugauggcaucaaacggccaaaagagagaggagaaaauacauuuguacauacaaaauucuu

SEQ ID NO: 49015 - RNA, 64 nt, Homo Sapiens
caguuaaccugauuucaauuuaagaggucuuagaagaaaauaacagaaacaaaagucucauuca

SEQ ID NO: 49016 - RNA, 64 nt, Homo Sapiens
ugggagauuauaaucaguuuguuuucaagauaauagaaaauaagguccaugagaauagaaguua

SEQ ID NO: 49017 - RNA, 64 nt, Homo Sapiens
auuuauucauacuaggauagaaaauuuuggaaucagaaaauagauccaguguuuagcuacauac

SEQ ID NO: 49018 - RNA, 64 nt, Homo Sapiens
ugauuaauuauguacacaaaaauauuuuccuuguagaaaauaguuuuccagacacuuagccuuc

SEQ ID NO: 49019 - RNA, 64 nt, Homo Sapiens
caugcaaaaauagaaaauuauuuguuaaauucagagaaaauaugugaaguuuacaaaggaacca

SEQ ID NO: 49020 - RNA, 64 nt, Homo Sapiens
caugauaagugcaauuacugccaaaagaucuuucagaaaauauuauccuuuaaagugaaggaga

SEQ ID NO: 49021 - RNA, 64 nt, Homo Sapiens
uucgaauauucuacuaaaugagaguucugaguauagaaaauaaaacuaaaguugguagaaaaau

SEQ ID NO: 49022 - RNA, 64 nt, Homo Sapiens
aaaauugcugggaauauuugacucuccguauuggagaaaauaaaauuacaacauuacgacauac

SEQ ID NO: 49023 - RNA, 64 nt, Homo Sapiens
ggaauuugaaaagccaaacugugaaaccauugggagaaaauagaugauauugucuaugacguug

SEQ ID NO: 49024 - RNA, 64 nt, Homo Sapiens
aguucagaaucuuaaggccuguacuuuucaugccagaaaauaaaauggaauuguuuaauuauuu

SEQ ID NO: 49025 - RNA, 64 nt, Homo Sapiens
uuggcagguuauguuuaccaacaaaaaaaaaaaaagaaaauauuaaaaaaaaacacaaaaaaag

SEQ ID NO: 49026 - RNA, 64 nt, Homo Sapiens
cuaaaacuaaaauugguaaaagagugcugaguauagaaaauaauuucagguauuuuacuaaauc

SEQ ID NO: 49027 - RNA, 64 nt, Homo Sapiens
agcuuuuaaagugaagaguaucaaaauaucuuuaagaaaauauaaaacauaagugcaacuacug

SEQ ID NO: 49028 - RNA, 64 nt, Homo Sapiens
gucacaguucugaaggaaguuagggaggaagccaagaaaauaucuauugugauuaaagguagca

SEQ ID NO: 49029 - RNA, 64 nt, Homo Sapiens
guuaauuauuugaugggccugccaugugaaaaccagaaaauaaccucguacucacaagccagug

SEQ ID NO: 49030 - RNA, 64 nt, Homo Sapiens
uuagguggcaaagugagacccugucuccaaaaaaagaaaauagagcuuuauaagcagagagaag

SEQ ID NO: 49031 - RNA, 64 nt, Homo Sapiens
aaaaaaagaaaauagagcuuuauaagcagagagaagaaaauaaucaucuaagaccaucucucca

SEQ ID NO: 49032 - RNA, 64 nt, Homo Sapiens
agcuucugcuggaauuugcaaucacugaagucauagaaaauagguaacuaucuaauuagagaaa

SEQ ID NO: 49033 - RNA, 64 nt, Homo Sapiens
auucauuacugcauccccaguaaugaaaguacuuagaaaauaauuauugaaugaaugaaaucua

SEQ ID NO: 49034 - RNA, 64 nt, Homo Sapiens
uauaguagguagauagaaaaauacuuuuguguauagaaaauaugaaaacacaaauuucaaucaa

SEQ ID NO: 49035 - RNA, 64 nt, Homo Sapiens
acaguuugauuucugucauaacagggaccaagaaagaaaauauauguuuccuuuaagaaaaacc

SEQ ID NO: 49036 - RNA, 64 nt, Homo Sapiens
aauucugggccuuacuuguucccaaaaaugucuuagaaaauaaaauguauuuaugcccuuauau

SEQ ID NO: 49037 - RNA, 64 nt, Homo Sapiens
aauacacagguaauuuaguaucaguagugaaugcagaaaauaaaaauuaaucaauggauauccu

SEQ ID NO: 49038 - RNA, 64 nt, Homo Sapiens
gcauugugggaaaaacugaggucaaaacuaggugagaaaauagaggaagagaaggaauaaauuu

SEQ ID NO: 49039 - RNA, 64 nt, Homo Sapiens
uuuuauggguuuuuuugguucugagagauaauggagaaaauaauucucaaguuaugaaauaaaa

SEQ ID NO: 49040 - RNA, 64 nt, Homo Sapiens
uuaauggugggguuuucugcuuuguuuuuauuuaagaaaauaaacacgacauauuuaaagaagg

SEQ ID NO: 49041 - RNA, 64 nt, Homo Sapiens
gggauuggaugaaagucaaagguugucuacuuuaagaaaauaaaauacccugaauggagcccag

SEQ ID NO: 49042 - RNA, 64 nt, Homo Sapiens
aucaccaacuuaauuuucuuccauagcaaaacugagaaaauaccuuguuucaguauaacacuaa

SEQ ID NO: 49043 - RNA, 64 nt, Homo Sapiens
uuaacauuuuacuuuuaauuauguaaauuugguuagaaaauaauaauaaaugguuagugcuauu

SEQ ID NO: 49044 - RNA, 64 nt, Homo Sapiens
uugaguuuugcaacaguaccuguguuguuauuucagaaaauauuauuucucucuuuuuaacuac

SEQ ID NO: 49045 - RNA, 64 nt, Homo Sapiens
aauaguuccucauucauuuuuauauugaccacuaagaaaauaauucaucagcauuaucucauag

SEQ ID NO: 49046 - RNA, 64 nt, Homo Sapiens
ggacgagaaaacaauaacgauaaaagacagugaaagaaaauaacgauaaaagacagugaaagaa

SEQ ID NO: 49047 - RNA, 64 nt, Homo Sapiens
acagugaaagaaaauaacgauaaaagacagugaaagaaaauaacaauaaaagacaaggaaaaaa

SEQ ID NO: 49048 - RNA, 64 nt, Homo Sapiens
auaugaacaacuuucaacaaaaacuacugcaauuagaaaauaaagauguaaagaaaucagauac

SEQ ID NO: 49049 - RNA, 64 nt, Homo Sapiens
auguuugaaauccaagaauauauaagcuaugcacagaaaauaaaugauuccuauaauacagugc

SEQ ID NO: 49050 - RNA, 64 nt, Homo Sapiens
uaaauguuauguauaugguguaaaauauuuaugaagaaaauacuaaaauacauucuuuuugcuc

SEQ ID NO: 49051 - RNA, 64 nt, Homo Sapiens
uauuaacacuacucaaagcaauauuaagcaugacagaaaauauguuccuauuucagaaguuuaa

SEQ ID NO: 49052 - RNA, 64 nt, Homo Sapiens
cuggucucacugugguugccguaagaugagcuagagaaaauaacauuucuuuuagaauauggga

SEQ ID NO: 49053 - RNA, 64 nt, Homo Sapiens
aaauggauauauuuucuuuaguauauguacuacuagaaaauaccugaguauuuccuugauugcg

SEQ ID NO: 49054 - RNA, 64 nt, Homo Sapiens
aucaccaacuugauuuucuuccauagcaaaacugagaaaauaccuuguuucaguauaacacuaa

SEQ ID NO: 49055 - RNA, 64 nt, Homo Sapiens; identical to SEQ ID NO: 49043

SEQ ID NO: 49056 - RNA, 63 nt, Homo Sapiens
aacuacaguuuuuccaaacugaaugugcuauucauaagcuagaagaugaagagccaacuugau

SEQ ID NO: 49057 - RNA, 63 nt, Homo Sapiens
cuaauuuuugagagaaacacauauaauauccucauaagcuauuguaauauaccaauuaguuuu

SEQ ID NO: 49058 - RNA, 63 nt, Homo Sapiens
gaauucaagguugguucaacaucuaaaaaucaaauaagcuaauauacagucaguucucauuau

SEQ ID NO: 49059 - RNA, 63 nt, Homo Sapiens
gaauucaagguuuguucaacaucuaaaaaucaaauaagcuaauaaagaaaagagguuuauacu

SEQ ID NO: 49060 - RNA, 63 nt, Homo Sapiens
uguauacacauuugcauauacccacauggggacauaagcuaauuuuuuuacaggacacagaau

SEQ ID NO: 49061 - RNA, 63 nt, Homo Sapiens
aaagcgaugucagagggcgguuuugagcuuucuauaagcuauagcuuuguuuauuucacccgu

SEQ ID NO: 49062 - RNA, 63 nt, Homo Sapiens
uaaaaacaaacaaacaaaaaaaaaaucuguuagauaagcuaucaaaaugcagcuguuguuuug

SEQ ID NO: 49063 - RNA, 63 nt, Homo Sapiens
aacagagucucaagacccccgcucuggacugucauaagcuagcacccgugguaagcgggacga

SEQ ID NO: 49064 - RNA, 63 nt, Homo Sapiens
uucuagugacccaugugucagccuuuguuguauauaagcuaaauggugaguuuaguugugcau

SEQ ID NO: 49065 - RNA, 63 nt, Homo Sapiens
uaagggcgaugauuauuauucaucuggagaagcauaagcuaauacucauuuuauucucggcaa

SEQ ID NO: 49066 - RNA, 64 nt, Homo Sapiens
aguuuguggggaggaaagacaucuguguaucacuucaaaauauugauuuacugcuaaacaucac

SEQ ID NO: 49067 - RNA, 64 nt, Homo Sapiens
cagagagaaaaauguuucgacagccaaguuuucuucaaaauauuaugugacagaauacgacuca

SEQ ID NO: 49068 - RNA, 64 nt, Homo Sapiens
uggaguuucauaugcagcauuaauuaagcucacaucaaaauagaccagccauuugcacauaguu

SEQ ID NO: 49069 - RNA, 64 nt, Homo Sapiens
uauuggacaagugacagaaacugaucauccauauucaaaauauuuacagaaaaaagugucagug

SEQ ID NO: 49070 - RNA, 64 nt, Homo Sapiens
cacagaguuauauguguguguaucaaaaguggucucaaaauauuuuuuuaagaaaaaaagcaaa

SEQ ID NO: 49071 - RNA, 64 nt, Homo Sapiens
uauucuuuucaaauauuuguaggacaacuuugaaucaaaauaaauuauguuccuucuccaauuu

SEQ ID NO: 49072 - RNA, 64 nt, Homo Sapiens
aauauguuuuuaucacagucauuguaaacaugguucaaaauauuuaaaauaugaauuuugcucu

SEQ ID NO: 49073 - RNA, 64 nt, Homo Sapiens
uauuuaguauaaaguuuuugauuuuuguuauaauucaaaauagauauaaacuauuauaaguacu

SEQ ID NO: 49074 - RNA, 64 nt, Homo Sapiens
uccugcaauuauguugaaaagaguaguacuuucuucaaaauauaaaaugccaagcacuucaggc

SEQ ID NO: 49075 - RNA, 64 nt, Homo Sapiens
gguuuuguucuuguauugcuuucuuucaacaguuucaaaauaaaauaucauauaaauauugagg

SEQ ID NO: 49076 - RNA, 64 nt, Homo Sapiens
cauauaaauauugagggaaauguuuucauauuuuucaaaauagguuuuuauuguugaauguaca

SEQ ID NO: 49077 - RNA, 64 nt, Homo Sapiens
ucacguuugcuuaaaugcuucaucacagucacauucaaaauagugacucuaaacaaagaagaaa

SEQ ID NO: 49078 - RNA, 64 nt, Homo Sapiens
agacuuguuuuauuagauuuuaccaaugaauuuuucaaaauacaaaaaaaaguaguuuuuccuu

SEQ ID NO: 49079 - RNA, 64 nt, Homo Sapiens
guuuguugcauuucaguaaaagcagaauaaccuuucaaaauaauaacaggcugggugcaauggc

SEQ ID NO: 49080 - RNA, 64 nt, Homo Sapiens
cagccuggccugggcaacagagcaagacccugucucaaaauaauaauaauauauaauuuuacac

SEQ ID NO: 49081 - RNA, 64 nt, Homo Sapiens
ggugggaaauagcagugaauuuuagucauuaacuucaaaauauauauauauauauaauuuaaag

SEQ ID NO: 49082 - RNA, 64 nt, Homo Sapiens
uaaguuuaguaaauauuaauaaauggauacacauucaaaauacuuuuaaaaaaaagaaaauguu

SEQ ID NO: 49083 - RNA, 64 nt, Homo Sapiens
aguuaguaacuaggugguucacaaaauuacaacaucaaaauaguuacaucuugugaaaauauau

SEQ ID NO: 49084 - RNA, 64 nt, Homo Sapiens
ugagaauaugguacagauugucagcaauugguuuucaaaauagaacuuugaugucaguacaacu

SEQ ID NO: 49085 - RNA, 64 nt, Homo Sapiens
uuucagccucuacugauagugucugacaacauauucaaaauauugugaaggacauuuauuuaga

SEQ ID NO: 49086 - RNA, 64 nt, Homo Sapiens
uguguacguguguauauguguucugaaauauauuucaaaauaugguaaauuauauuuauacauc

SEQ ID NO: 49087 - RNA, 64 nt, Homo Sapiens
auaaaaauaacauauuggugagagugagacugucucaaaauaaaggcacuccagccugggugac

SEQ ID NO: 49088 - RNA, 64 nt, Homo Sapiens
auuaauuaauauaaaaauauccauauauauugcaucaaaauaucacacauauggagguuugcug

SEQ ID NO: 49089 - RNA, 64 nt, Homo Sapiens
uuuggggaucaccacuauauucgucaaaauaaugucaaaauagugguugagacuaaauuacuca

SEQ ID NO: 49090 - RNA, 64 nt, Homo Sapiens
gucaaaauaguuuuggggauuaaauuacucaucgucaaaauaauaaaaagauuuugguugagac

SEQ ID NO: 49091 - RNA, 64 nt, Homo Sapiens
guggcacaauuuaauuguuuaugaacaacuguagucaaaauaagugucaucguuauccucucuu

SEQ ID NO: 49092 - RNA, 64 nt, Homo Sapiens
agugacaauuguagcauugaucugagcuuccuuuucaaaauaaaucucuaagaguuuuuuuccu

SEQ ID NO: 49093 - RNA, 64 nt, Homo Sapiens
ugcaaucuaucuacucauuuaaaaauaauuacagucaaaauauuaaaguggggaggaagggagg

SEQ ID NO: 49094 - RNA, 64 nt, Homo Sapiens
cgguccuguccacuguuuauuuaaaauucuuaauucaaaauauuauaaaagguguuguggaaac

SEQ ID NO: 49095 - RNA, 64 nt, Homo Sapiens
cacuccagccugggugacaaagcaagacugugucucaaaauaaauaaauaaaauaaaauaaaau

SEQ ID NO: 49096 - RNA, 64 nt, Homo Sapiens
guagauagcagagcaugguauuagugaaaaagguucaaaauacacaaguaacauacacucugaa

SEQ ID NO: 49097 - RNA, 64 nt, Homo Sapiens
aacaugaaaagggcuuuauuuucaaaaauuaacuucaaaauaaguguauaaaaugcaacuguug

SEQ ID NO: 49098 - RNA, 64 nt, Homo Sapiens
uaucaaaguaauaacacaaaugaagugucauuauucaaaauaguccacugacuccucacaucug

SEQ ID NO: 49099 - RNA, 64 nt, Homo Sapiens
uggaagaauauuuauaggcaauacagucaaaguuucaaaauagcaucacacaaaacauguuuau

SEQ ID NO: 49100 - RNA, 64 nt, Homo Sapiens
uagauguuuuguguguauuuuuuuaaaugaaaacucaaaauaagacaaguaauuuguugauaaa

SEQ ID NO: 49101 - RNA, 64 nt, Homo Sapiens
aauuuuuacuuucacaaguucauugagaaaucaaucaaaauaaauggcauuauacugaacuaua

SEQ ID NO: 49102 - RNA, 64 nt, Homo Sapiens
uuagggaccaccaccauauuuaagcuaccugccuucaaaauaguaaaaauauuuuagcuuagac

SEQ ID NO: 49103 - RNA, 64 nt, Homo Sapiens
uguauuauuugauacuaaauuuucaauuauuacuucaaaauaagagucugaggauuucuucuua

SEQ ID NO: 49104 - RNA, 64 nt, Homo Sapiens
cugaaaacuaaucaaauauagugccuauuuagucucaaaauaagguaacuauuaacuugauuau

SEQ ID NO: 49105 - RNA, 64 nt, Homo Sapiens
acacuacugaauuauaaaaauucaaucauaaaagucaaaauauauuacauaauauaguuuaaug

SEQ ID NO: 49106 - RNA, 64 nt, Homo Sapiens
uuuuaacuguuuuugcuacuccauauauugucauucaaaauauauuuuaacccaaaauaaguua

SEQ ID NO: 49107 - RNA, 64 nt, Homo Sapiens
cagagcuaauguuuauccauuuaaaagguauaaaucaaaauaacaaauuaucuaaaaaaaaucu

SEQ ID NO: 49108 - RNA, 64 nt, Homo Sapiens
ucaauauuuccauugaacacagaugcagaaauccucaaaauauuagcaaaucaggaaugcaagg

SEQ ID NO: 49109 - RNA, 64 nt, Homo Sapiens
aacaucucaauuucuaauacuuacucucaaauagucaaaauaaauuggaacauuaucuacaauu

SEQ ID NO: 49110 - RNA, 64 nt, Homo Sapiens
augaaaagguagauggaguugauuuguuuuggugucaaaauaacauguauucauucacuuucaa

SEQ ID NO: 49111 - RNA, 64 nt, Homo Sapiens
acaguucaauuugcagcuacacucuuaggaaguaucaaaauagaaugaucugauuacacuggac

SEQ ID NO: 49112 - RNA, 64 nt, Homo Sapiens
agucaaucagcauuguuauuuuuucaaugauuuuucaaaauaaagucucagaugauuauuccag

SEQ ID NO: 49113 - RNA, 64 nt, Homo Sapiens
uaggaacucauacuaaaauuaucuguagauuccaucaaaauaaggaugugaaguauucaugaga

SEQ ID NO: 49114 - RNA, 64 nt, Homo Sapiens
aggcugaugcuugaaguaacuguggagggaguguucaaaauacuacugacgcaggcaccuucuu

SEQ ID NO: 49115 - RNA, 64 nt, Homo Sapiens
uaaaaaagcacuaugaacuacagguguuugacuuucaaaauauauuuuguauuguuaauaucuu

SEQ ID NO: 49116 - RNA, 64 nt, Homo Sapiens
uauuguaaauuauauuugugcuauaguauuugauucaaaauauuuaaaaaugucuugcuguuga

SEQ ID NO: 49117 - RNA, 64 nt, Homo Sapiens
cacaagugccgcaaauuguaccuuuuuuguuuuuucaaaauagaaaaguuauuagugguuuauc

SEQ ID NO: 49118 - RNA, 64 nt, Homo Sapiens
ccucaggccuguaacuucuggaaaagaugauuauucaaaauaauguuuugggguaaccagugga

SEQ ID NO: 49119 - RNA, 64 nt, Homo Sapiens
ugguauccuguuacagccuuggcucuuaaacaacucaaaauauugggauaggcugucaguaugu

SEQ ID NO: 49120 - RNA, 64 nt, Homo Sapiens
aaucauuggacaaaggcuuuauugucaauagauaucaaaauauugagauuuaaaguucuaaggg

SEQ ID NO: 49121 - RNA, 64 nt, Homo Sapiens
uacauacauacauacaauaaagugagauucugucucaaaauaaacacuccagccuggacgacag

SEQ ID NO: 49122 - RNA, 64 nt, Homo Sapiens
acaggugugagaauugugugcacaauagagaacuucaaaauaaaagaaguagaucaaaauagaa

SEQ ID NO: 49123 - RNA, 64 nt, Homo Sapiens
acacaauagagaacuucaaagacacagaaguagaucaaaauagaaugacccaggaauagcuaau

SEQ ID NO: 49124 - RNA, 64 nt, Homo Sapiens
aaguuauauauuuuauaggcuacaauagcauucuucaaaauauuuuagaucuuguuucaaacuu

SEQ ID NO: 49125 - RNA, 64 nt, Homo Sapiens
ugacaucugcuauuaugccuccuauaauuauacuucaaaauauuagaguuaauuuuaauccuuc

SEQ ID NO: 49126 - RNA, 64 nt, Homo Sapiens
ugcuauaugcacuggguauaaaagacugaucuguucaaaauauuccagaaucaucaaaauagug

SEQ ID NO: 49127 - RNA, 64 nt, Homo Sapiens
gaaagacugaucuguucaaaaaugcccagaaucaucaaaauaguccaagacuguaacagggaga

SEQ ID NO: 49128 - RNA, 64 nt, Homo Sapiens
aguuuuguacaauggaaugacuauuagauuuuucucaaaauaugaugguguuggagacuauuag

SEQ ID NO: 49129 - RNA, 64 nt, Homo Sapiens
gccuugacauuaaauaccccucuggaacagaaauucaaaauaaaaugaaugcuguggagaggca

SEQ ID NO: 49130 - RNA, 64 nt, Homo Sapiens
uugcaucugagacagacuucugucaguucaagcaucaaaauaccuuuccauuuauacccuacug

SEQ ID NO: 49131 - RNA, 64 nt, Homo Sapiens
aaaacagcauuacuauuucuaaguagaacccacuucaaaauaaaccagaauuaaaaccaaucau

SEQ ID NO: 49132 - RNA, 64 nt, Homo Sapiens
gguaaaaguaaauauuuaccacaguauuauaaaaucaaaauaugcuacaucaccgccuugguaa

SEQ ID NO: 49133 - RNA, 64 nt, Homo Sapiens
gauuugaauagcagcauuagguaacucaguaauuucaaaauacaaauaagacuaauuuuuaaga

SEQ ID NO: 49134 - RNA, 64 nt, Homo Sapiens
gaaguuauggcuucacauucaaauggguauuuguucaaaauaauacuaauuuuucuuacacacu

SEQ ID NO: 49135 - RNA, 64 nt, Homo Sapiens
uucuuaauaggccuaaaauagugagcauauauaaucaaaauaauacuucauacaacauauacuu

SEQ ID NO: 49136 - RNA, 64 nt, Homo Sapiens
cuaucauuuggcuggaugggggugaaguaugucuucaaaauauauugaaguaaguucaucaaac

SEQ ID NO: 49137 - RNA, 64 nt, Homo Sapiens
acugacacagcauucaugauguuaccuucacuuuucaaaauauuguagaaggauuuuucucaug

SEQ ID NO: 49138 - RNA, 64 nt, Homo Sapiens
auuugagagcaugaagauauucaugcuuuugaacucaaaauauugaagauacucucaagccugu

SEQ ID NO: 49139 - RNA, 64 nt, Homo Sapiens
aacaaccaagaacaaagccccgggacuguuuucuuuuuaauaaagccacaggcaggcaucguag

SEQ ID NO: 49140 - RNA, 64 nt, Homo Sapiens
augaaugagucaccuugugauuuuuaaauuuuuauuuuaauaaagcuaaucaauuucuacaacc

SEQ ID NO: 49141 - RNA, 64 nt, Homo Sapiens
gaugcauauagugaaauuuuuuaaauggauauacuuuuaauaaaguuuuauaacucacugacaa

SEQ ID NO: 49142 - RNA, 64 nt, Homo Sapiens
guuguauuaauucaguauuugucauuaugcaguauuuuaauaccuacauaagucuauuccauua

SEQ ID NO: 49143 - RNA, 64 nt, Homo Sapiens
agauacuauuuuggauguguaucaguauuuuuguuuuuaauaaugauugauuuguggagcauug

SEQ ID NO: 49144 - RNA, 64 nt, Homo Sapiens
ucacuggcacuucucuccucaacuguaauucuauuuuuaauaauaaaaauggcauacuguaggg

SEQ ID NO: 49145 - RNA, 64 nt, Homo Sapiens
aaccuuaacuguuccuuaaggauuuuagccaguauuuuaauagaacaugauuaaugaaagugac

SEQ ID NO: 49146 - RNA, 64 nt, Homo Sapiens
uaugguagcuuuguuguauauuauuguaaaauuauuuuaauaagucauggggaugacaauuuga

SEQ ID NO: 49147 - RNA, 64 nt, Homo Sapiens
auuaagaccucaagcccuuuauucuuaaaaggguuuuuaauaaagucuuucucaaaugagguag

SEQ ID NO: 49148 - RNA, 64 nt, Homo Sapiens
aucaccuuaucaaauuaaaaugggaagaaaguaauuuuaauaauuuuuaauaaucauaugucag

SEQ ID NO: 49149 - RNA, 64 nt, Homo Sapiens
caaauuaaaaugggaagaaaguaauuuuaauaauuuuuaauaaucauaugucagcauucugacu

SEQ ID NO: 49150 - RNA, 64 nt, Homo Sapiens
uuaaaaauauuuuagaaguuuuguaauggugguguuuuaauauuuuacauaauuaaauauguac

SEQ ID NO: 49151 - RNA, 64 nt, Homo Sapiens
cugggcucauagggacacuuggucacuccagaguuuuuaauagcucccaggaggugauauuauu

SEQ ID NO: 49152 - RNA, 64 nt, Homo Sapiens
aacuucuagaauaacccagaugcgcuuuaauuuuuuuuaauauguuuugaucacagaacuucua

SEQ ID NO: 49153 - RNA, 64 nt, Homo Sapiens
acuucuagaauaacccagaugcucuuucauauucuuuuaauacaucuugaucacagcuggggga

SEQ ID NO: 49154 - RNA, 64 nt, Homo Sapiens
gauugagccaauauacaaauaccucaucuguucuuuuuaauauuuuaucucuguuuguagagag

SEQ ID NO: 49155 - RNA, 64 nt, Homo Sapiens
cauauucaaucauugaauccuuauagaauuugucuuuuaauagacagaaaaauuaaugaaacuu

SEQ ID NO: 49156 - RNA, 64 nt, Homo Sapiens
gauuuuaaaaaccagaauuuuaguugcaauacaauuuuaauaucacccuacauauuauuuauaa

SEQ ID NO: 49157 - RNA, 64 nt, Homo Sapiens
gugcaaacaaguauucauuuucauacaggaauuuuuuuaauauguuauuuuuuuaaaaguucau

SEQ ID NO: 49158 - RNA, 64 nt, Homo Sapiens
auuucauuucuggaggaugaccuugagggaagcuuuuuaauauuaguuucaagcuuuccuuacc

SEQ ID NO: 49159 - RNA, 64 nt, Homo Sapiens
auuaaccucaccaaaugaagcuuuuucuauccauuuuuaauauuguccuuacauaauauugucc

SEQ ID NO: 49160 - RNA, 64 nt, Homo Sapiens
uugcacauguauugggggaggcgcuucauuuuuauuuuaauacacauguauuuccuccuugcac

SEQ ID NO: 49161 - RNA, 64 nt, Homo Sapiens
guacaaagccuuggauacaguuugcuuguaauauuuuuaauaaugugaggaguacaguguuuuc

SEQ ID NO: 49162 - RNA, 64 nt, Homo Sapiens
ccgaaaauuucaucaucuaauggaugaaugucuuuuuuaauacuguacacacacuugauuguuc

SEQ ID NO: 49163 - RNA, 64 nt, Homo Sapiens
aaguuauauauaauuaucccauacagaguugauuuuuuaauaaauccuaccaacuauugacaga

SEQ ID NO: 49164 - RNA, 64 nt, Homo Sapiens
uuguaggaaaucuucauaauaaaaaaaucuuuuauuuuaauacaaagagcuauaauuuuuaaaa

SEQ ID NO: 49165 - RNA, 64 nt, Homo Sapiens
uucauuuuuggggaaaaaucguauuuuaacuuaguuuuaauauuguguggaauacuaacuauau

SEQ ID NO: 49166 - RNA, 64 nt, Homo Sapiens
ugcuuugcauauucacacauauuggacauacugguuuuaauaccauuacaaacugguuuuaaau

SEQ ID NO: 49167 - RNA, 64 nt, Homo Sapiens
uaauuccuucucuuuuuucacuaagugugcuuaguuuuaauaaguaggauugggaaagaaguug

SEQ ID NO: 49168 - RNA, 64 nt, Homo Sapiens
gucauaaagauuauaauaugguuuuaaucuuagcuuuuaauaguaguagguucuguuuuguuuu

SEQ ID NO: 49169 - RNA, 64 nt, Homo Sapiens
uuguggagcagagggaugguaauguggcuauaaguuuuaauauugcucuugagauuacuugcac

SEQ ID NO: 49170 - RNA, 64 nt, Homo Sapiens
augcuuuaaagacugaugagaugugaguauuagauuuuaauagcaucugaaaacugaauguccu

SEQ ID NO: 49171 - RNA, 64 nt, Homo Sapiens
ggggaaagaaaaaugaaaauguauaauuaucccuuuuuaauauuauuaucaaauuauaaugaua

SEQ ID NO: 49172 - RNA, 64 nt, Homo Sapiens
gaaaaauauuuucgugacaauuuauaacaauuuuuuuuaauaauuccauaucagaagaaauaac

SEQ ID NO: 49173 - RNA, 64 nt, Homo Sapiens
auauuauaaacucaaaauauuggaauuuucuucguuuuaauagaucuuguaaaaaguauguauu

SEQ ID NO: 49174 - RNA, 64 nt, Homo Sapiens
cuguacugcuucuuaaaccacuccaaauaaggcauuuuaauagaaaaacaagggaaauuuaaau

SEQ ID NO: 49175 - RNA, 64 nt, Homo Sapiens
ugagaaaaugaaauagaaacuuucuggaaaaauauuuuaauagugauaauaacaucagauuuua

SEQ ID NO: 49176 - RNA, 64 nt, Homo Sapiens
ggaaaaauauuuuaauagugauaauaacaucagauuuuaauauaacauuccagagaauugugga

SEQ ID NO: 49177 - RNA, 64 nt, Homo Sapiens
uguugugaauguaaaggagggagcauucuuugcuuuuuaauauacaaaccaugguuuuuuggag

SEQ ID NO: 49178 - RNA, 64 nt, Homo Sapiens
cccuacuauugccucucugaccuuuuuaaauuauuuuuaauaccaaaagaguucuuuugaaaug

SEQ ID NO: 49179 - RNA, 64 nt, Homo Sapiens
aaauaguaacaccaaacaugauuauacaggaauauuuuaauaaguguaucaccaugcagaugua

SEQ ID NO: 49180 - RNA, 64 nt, Homo Sapiens
aaagccuaacauucuaauaaaggcacaaauuucuuuuuaauacuuguuucagccucuuuaaucu

SEQ ID NO: 49181 - RNA, 64 nt, Homo Sapiens
uuuuguaaugugcucaauacaaauacuugugaacuuuuaauauguugagugcuuucauuuugau

SEQ ID NO: 49182 - RNA, 64 nt, Homo Sapiens
gaguuguuuccuuuaaagaauuuuacacuacauauuuuaauaguaaacagggaucacuuuuccu

SEQ ID NO: 49183 - RNA, 64 nt, Homo Sapiens
gcuacuguauaauugggggugauaauaccaggaauuuuaauaagauuuuguaaagaauauccag

SEQ ID NO: 49184 - RNA, 64 nt, Homo Sapiens
acgaguaugauuuagcauucauacuaguugaaauuuuuaauagaaucaaggcacaaaagucuua

SEQ ID NO: 49185 - RNA, 64 nt, Homo Sapiens
cuuuugaucuguaaugcuuuuauacaaaaguuuauuuuaauaauaaaauguuuguucuaacuug

SEQ ID NO: 49186 - RNA, 64 nt, Homo Sapiens
acagaacaagaccccgucucaaaaaaaauuuuuuuuuuaauaaaacaaaauuuguuugaaaucu

SEQ ID NO: 49187 - RNA, 64 nt, Homo Sapiens
cuuuaaaauuuaaguaucuuuuuucaaaaacauuuuuuaauagaauaaaauauaauuugaucuu

SEQ ID NO: 49188 - RNA, 64 nt, Homo Sapiens
guguuagagcuuaugcauuuguuuuuaugagagauuuuaauaaauuuaauuauuugcuugucca

SEQ ID NO: 49189 - RNA, 64 nt, Homo Sapiens
uacaucuagcuaaaagugugguuuaucuaaaccguuuuaauaagcaagaugacugggaaaucuc

SEQ ID NO: 49190 - RNA, 64 nt, Homo Sapiens
auuacugcccuaaaaugucuuacaguagaugugguuuuaauacagaaaagaaccuaacauuauu

SEQ ID NO: 49191 - RNA, 64 nt, Homo Sapiens
cuggcucacagucugguaggaaaguacaguauucuuuuaauaaaaaaaauaguuuuuaaaggaa

SEQ ID NO: 49192 - RNA, 64 nt, Homo Sapiens
uccaaauuuuuaagaaaagcagguaugaggaauguuuuaauaccgucuauuugaaauaugcaaa

SEQ ID NO: 49193 - RNA, 64 nt, Homo Sapiens
cuuuuuugagugguuccucaccaaguaugaccacuuuuaauacacagaguuggagugccuucau

SEQ ID NO: 49194 - RNA, 64 nt, Homo Sapiens
guauuuuguguuggcuauuaagguaaaaaucuuauuuuaauagcaaaugcauugaaaauuugaa

SEQ ID NO: 49195 - RNA, 64 nt, Homo Sapiens
guuacacucaguuccuuuguggaaaaugcuaaaauuuuaauauaaagauugaauaaacuuuauu

SEQ ID NO: 49196 - RNA, 64 nt, Homo Sapiens
aaacuuuuuguauuuacuuguuggcuuccaaguuuuuuaauaaguacaaaccaugcuuucaaug

SEQ ID NO: 49197 - RNA, 64 nt, Homo Sapiens
uuugguuguauucacuuuaugguaauugaaaccauuuuaauauauuuugcacuguuucaaugcu

SEQ ID NO: 49198 - RNA, 64 nt, Homo Sapiens
ucuauuaaaacuguauauuuaaguguaaugauuauuuuaauauuaugguuucugcaaugagagg

SEQ ID NO: 49199 - RNA, 64 nt, Homo Sapiens
uauguauuaaucacacagugaaaaauuggauaauuuuuaauauuaacuguguuguucuuaaauc

SEQ ID NO: 49200 - RNA, 64 nt, Homo Sapiens
uuuauuucuuuccuggcacaauagucuccucagauuuuaauauuaaucuuaaugcagaaauuau

SEQ ID NO: 49201 - RNA, 64 nt, Homo Sapiens
uguuaauguugccagaaugaggaguguauaaacauuuuaauauacuaaauuuacacuuaaaguu

SEQ ID NO: 49202 - RNA, 64 nt, Homo Sapiens
acuauccuugagaaccaaaauguucaagauuuucuuuuaauagcaaaaaauuacuaaccacuga

SEQ ID NO: 49203 - RNA, 64 nt, Homo Sapiens
uucauauauuuuacaacaguuuuaauuauaauacuuuuaauacuuauuuaggauaagaaucauu

SEQ ID NO: 49204 - RNA, 64 nt, Homo Sapiens
aauacagaauuauuuuaaguguuuugaacuuaauuuuuaauaacaugcaugggucccucucacu

SEQ ID NO: 49205 - RNA, 64 nt, Homo Sapiens
uccugguaccuguauuuaaaauguacauuccacauuuuaauaaauuaaccacaagaaaauaauc

SEQ ID NO: 49206 - RNA, 64 nt, Homo Sapiens
uauuuggcauuuagacuaacuucuagauguauauuuuuaauaauagauucauaauguuacauuu

SEQ ID NO: 49207 - RNA, 64 nt, Homo Sapiens
uaauuuuaaaacuaaacucauacuuuugcuaucuuuuuaauauuuaucucguuugggaguauac

SEQ ID NO: 49208 - RNA, 64 nt, Homo Sapiens
ucagggcgaaagacaggugauguagcacuucuguuuuuaauaauuauugcuuaaaauaccuauu

SEQ ID NO: 49209 - RNA, 64 nt, Homo Sapiens
gauugugaaaauaucaaaauauaaaugaaucaaguuuuaauauacuguaugauggguggaugag

SEQ ID NO: 49210 - RNA, 64 nt, Homo Sapiens
caugcguuuaaucauugucucuucauuuuaagacuuuuaauacaaaugucauuuuuaaagaaac

SEQ ID NO: 49211 - RNA, 64 nt, Homo Sapiens
accucuuuauagucuaggauggcagagcagaagauuuuaauaugcuuuuauuaagugauguaaa

SEQ ID NO: 49212 - RNA, 64 nt, Homo Sapiens
auguuauuucaaaaggguuauuuuuguccuccuuuuuuaauagcuucaggaaaguuaaagguau

SEQ ID NO: 49213 - RNA, 64 nt, Homo Sapiens
caacaaaacuagagguaugaauuaaugcuacacauuuuaauacacacauuuauucagauacucc

SEQ ID NO: 49214 - RNA, 64 nt, Homo Sapiens
auuuaaaucaaaauguguacuuuaaucuaaaauguuuuaauaaucuguauuucuuauaauuuua

SEQ ID NO: 49215 - RNA, 64 nt, Homo Sapiens
uagugauauaagcauuguuucuuuucuggauuuuuuuuaauaauuccucuucuauuccuauauu

SEQ ID NO: 49216 - RNA, 64 nt, Homo Sapiens
gaaaaagcucccuauaaugccuguagaacacuauuuuuaauacaaaauguccuguuugauacua

SEQ ID NO: 49217 - RNA, 64 nt, Homo Sapiens
gugagcuugagaguuuucuuuuagauuuaucacuuuuuaauaggugauugagaguuggcuguau

SEQ ID NO: 49218 - RNA, 64 nt, Homo Sapiens
uaguaaacucucauuuauuuacuaaaguuguaccuuuuaauauguauaguaaaauuuuuuauaa

SEQ ID NO: 49219 - RNA, 64 nt, Homo Sapiens
ccagcuagagauauggccuugugagauuaauuuuuuuuaauaucaacuuuuagaauuugggcug

SEQ ID NO: 49220 - RNA, 64 nt, Homo Sapiens
uucaaggacuuuaaaaaaaucuuuucucugagaguuuuaauacuuguuuuucuuucuuccuuuc

SEQ ID NO: 49221 - RNA, 64 nt, Homo Sapiens
aaaaaaaggcacaucaacugauguuaaauagcacuuuuaauagcgugccauaagacauuuuagc

SEQ ID NO: 49222 - RNA, 64 nt, Homo Sapiens
ucaaagggguuuacuaugccuuucaccagaacuauuuuaauauaguuuguuuauguuacauuua

SEQ ID NO: 49223 - RNA, 64 nt, Homo Sapiens
guacgcgccauuagggcuuuggagauguccugaauuuuaauaggaaacagagagagagaauauu

SEQ ID NO: 49224 - RNA, 64 nt, Homo Sapiens
aaugaguuggaaaaaaaauagcauuuuuuuauuuuuuuaauaaauuguaaagcugauaguugga

SEQ ID NO: 49225 - RNA, 64 nt, Homo Sapiens
auauaauuaucggaagcaguuauaaaugguguuuuuuuaauagauuaucagugacagaguucac

SEQ ID NO: 49226 - RNA, 64 nt, Homo Sapiens
ggguagauaaccuguacuuccuuuaggcagcagcuuuuaauacaaucuugguacuacuagaugu

SEQ ID NO: 49227 - RNA, 64 nt, Homo Sapiens
uacauauuguauauuuuaagaauucuuuauacaauuuuaauauacugcaauacugcaguuuuug

SEQ ID NO: 49228 - RNA, 64 nt, Homo Sapiens
uauaugaauuuuugcauucauuauugaauaacucuuuuaauauuuuugagcaaugauuauacug

SEQ ID NO: 49229 - RNA, 64 nt, Homo Sapiens
gcugaagguaaaucaauggaaaaaugaaauuuauuuuuaauauuacuacuauaugaauuaucuu

SEQ ID NO: 49230 - RNA, 64 nt, Homo Sapiens
ugacuucauuauuuggaaggaaaauuaguauuuuuuuuaauauuauauggaccaucugauuaua

SEQ ID NO: 49231 - RNA, 64 nt, Homo Sapiens
uauaaaaugcauaguaaaccacuaacguuagcuguuuuaauaaaaguuuucaguuauaaguuua

SEQ ID NO: 49232 - RNA, 64 nt, Homo Sapiens
uuuauauguauguacguauuucagguccuugaaauuuuaauaaauauuacaguuaaauccugau

SEQ ID NO: 49233 - RNA, 64 nt, Homo Sapiens
cauuuaauuuuccauaauauccuaauaaaacuuauuuuaauaaguuaucagauaucagcauaug

SEQ ID NO: 49234 - RNA, 64 nt, Homo Sapiens
aagcaauccccaaaagauuugcaaacaagcuuuguuuuaauauauugacacugaagcauauuau

SEQ ID NO: 49235 - RNA, 64 nt, Homo Sapiens
augugucacugauuuuuuagcuuuguuccuuuuguuuuaauaaaguauggucugguuaaaguuc

SEQ ID NO: 49236 - RNA, 64 nt, Homo Sapiens
gucaauuuuuguaaaauaaagauaaucauguugguuuuaauagucaguuauuggaugagugaaa

SEQ ID NO: 49237 - RNA, 64 nt, Homo Sapiens
auugaguacugauggauguuuauucauacauucauuuuaauaaccuauauauucauuuacagau

SEQ ID NO: 49238 - RNA, 64 nt, Homo Sapiens
uauuuuguuuaaauauaaucuaaagauggaauaauuuuaauacaaaguucuaugauucauguuu

SEQ ID NO: 49239 - RNA, 64 nt, Homo Sapiens
uauuuugucauuuuggccaaaugauuuuauugccuuuuaauagaaacaucccuuauuggcuuac

SEQ ID NO: 49240 - RNA, 64 nt, Homo Sapiens
aguaaugcuuuauaaaaauguuucccuuuuuccuuuuuaauauguuucuaagauucccauuagu

SEQ ID NO: 49241 - RNA, 64 nt, Homo Sapiens
acuuccuuauguagccauuauuguuuguugguuguuuuaauaaugggaaugacuuaaugucaau

SEQ ID NO: 49242 - RNA, 64 nt, Homo Sapiens
uccuuuuguauaaaaauguagugucuuacugguuuuuuaauaaagacagugucaugauguagua

SEQ ID NO: 49243 - RNA, 64 nt, Homo Sapiens
agcaacauguugaaacaagauuuuaaauuuacauuuuuaauaaaugacccaaaugccaagguaa

SEQ ID NO: 49244 - RNA, 64 nt, Homo Sapiens
uuaaaaaaucuaaauuuuaaaacagaaauuuaccuuuuaauaaaugcauauuuucaggcauggu

SEQ ID NO: 49245 - RNA, 64 nt, Homo Sapiens
uuacuauaagguucucaauucaugcaggugaauauuuuaauaggaacaagaugugcaaaccgga

SEQ ID NO: 49246 - RNA, 64 nt, Homo Sapiens
augccugcaaguguggauuugguucucccauacauuuuaauauguauuauauuuaaaucaaaca

SEQ ID NO: 49247 - RNA, 64 nt, Homo Sapiens
auuacauacauguuuauacauaagcauuacauuuuuuuaauaaaaauguauacagguggggcac

SEQ ID NO: 49248 - RNA, 64 nt, Homo Sapiens
uuuucagaauggaaauuuauaauauaaauauauguuuuaauaccacaaacacuguggggcacuu

SEQ ID NO: 49249 - RNA, 64 nt, Homo Sapiens
uuaccuuugcccuaccuucuguuuguaaggaugauuuuaauauuaauuccaggaacacauguuu

SEQ ID NO: 49250 - RNA, 64 nt, Homo Sapiens
cuauggaugaucuuuaggaaaagcagcccuuuacuuuuaauacaggcuuuaaugaacuauaccu

SEQ ID NO: 49251 - RNA, 64 nt, Homo Sapiens
cuuuuauuacugagagaucuucauauacuucauuuuuuaauauaaauaauuuuaauaaauuuua

SEQ ID NO: 49252 - RNA, 64 nt, Homo Sapiens
gaucuucauauacuucauuuuuuaauauaaauaauuuuaauaaauuuuauuuucuuauauucug

SEQ ID NO: 49253 - RNA, 64 nt, Homo Sapiens
aaaaugcagacauuuuuggugaauguuuagccauuuuuaauauuaauaaauugauguuaagugu

SEQ ID NO: 49254 - RNA, 64 nt, Homo Sapiens
uuaaauaugauuucuguuauauuugaaguauuaauuuuaauauaaucaucuuaaugugaaagau

SEQ ID NO: 49255 - RNA, 64 nt, Homo Sapiens
gcaaaggcccauuggaguuuaugcauucuccacauuuuaauauucauugauuaaauaaugauua

SEQ ID NO: 49256 - RNA, 64 nt, Homo Sapiens
uuaauuuauuuuuuacuauuauauauauucacaauuuuaauauuuggagcuuuuucuuuugaaa

SEQ ID NO: 49257 - RNA, 64 nt, Homo Sapiens
guaaaaccuugggauauagauagaugucauauuuuuuuaauauacaguucucaauauuuuuaau

SEQ ID NO: 49258 - RNA, 64 nt, Homo Sapiens
aacucuuaaauugccaaccuuagguaaauuauuauuuuaauaaccuugggaaaaaaucagcauc

SEQ ID NO: 49259 - RNA, 64 nt, Homo Sapiens
ugcagauucuaagauuacauuacucuaaauguacuuuuaauacuagcaucuugaaauucaguuu

SEQ ID NO: 49260 - RNA, 64 nt, Homo Sapiens
gaaccauuuuuuaacuucuuaaaauaaaauaauauuuuaauauuuuucugaaagauugggcuuu

SEQ ID NO: 49261 - RNA, 64 nt, Homo Sapiens
ucauuguguuugaccguacauuuuuacguuuuauuuuuaauaaaaagcauauguacaaaaauca

SEQ ID NO: 49262 - RNA, 64 nt, Homo Sapiens
cuaauaugaucauuugaauuuuggauauuuuuucuuuuaauaaaagauuauuuuauagcuuauu

SEQ ID NO: 49263 - RNA, 64 nt, Homo Sapiens
cauuucacuaauagggaucuggccuuacgaaauguuuuaauaggcugaugcacacugccaugcu

SEQ ID NO: 49264 - RNA, 64 nt, Homo Sapiens
uggauuuauuuucauauacuguuaagguuguguuuuuuaauacugguggccuuauuuuugcuau

SEQ ID NO: 49265 - RNA, 64 nt, Homo Sapiens
gcauguaaagcuuuuaaaguuaaaugaagaacauuuuuaauauggaugauggaaaauaguuaua

SEQ ID NO: 49266 - RNA, 64 nt, Homo Sapiens
ggaccacugccuugaaagcaagugugauuuuuauuuuuaauauuauuuuauuugugucugugua

SEQ ID NO: 49267 - RNA, 64 nt, Homo Sapiens
auaaauuuuaugaaacccaagcauagugcuuauuuuuuaauaaaacaacugacuuaacacauug

SEQ ID NO: 49268 - RNA, 64 nt, Homo Sapiens
auauuagccaccaugccuguccuauuuucuuauguuuuaauauauuuuaauauauuacaugugc

SEQ ID NO: 49269 - RNA, 64 nt, Homo Sapiens
ccaugccuguccuauuuucuuauguuuuaauauauuuuaauauauuacaugugcaguaauuaga

SEQ ID NO: 49270 - RNA, 64 nt, Homo Sapiens
auacauuacaaauuauuaaguuagcuuuucagaguuuuaauauagaaguuacuagcacugacac

SEQ ID NO: 49271 - RNA, 64 nt, Homo Sapiens
uucaaaaugaguagauaugauuagauccuuuaccuuuuaauaucuaguuuuuccaaaaaugaua

SEQ ID NO: 49272 - RNA, 64 nt, Homo Sapiens
gaaagaaaaauguuauuacugucauuagguugucuuuuaauacuuuaaguuauuuugacgaaaa

SEQ ID NO: 49273 - RNA, 64 nt, Homo Sapiens
uacuaguuuauauuaauauaguuuuuuucucccuuuuuaauaaaauaauuacagucaucccuca

SEQ ID NO: 49274 - RNA, 64 nt, Homo Sapiens
gcacaaaugagagugugagagaaaguaccuucuauuuuaauaauaauauuauuauaaaaauaau

SEQ ID NO: 49275 - RNA, 64 nt, Homo Sapiens
uguauaaacaauggcacugugaaaauacuguuaguuuuaauacaagagaaugcauuuguaaaua

SEQ ID NO: 49276 - RNA, 64 nt, Homo Sapiens
acugccaggccugauaggaaaaaucugcucuuccuuuuaauaacagugaugaauugucaggacc

SEQ ID NO: 49277 - RNA, 64 nt, Homo Sapiens
aaacaagggauuuguccuuacauccuauaugaguuuuuaauaaucuguguaucuauaaauaaag

SEQ ID NO: 49278 - RNA, 64 nt, Homo Sapiens
gacuaacacaaacuuaaugauaguuauuuuuuguuuuuaauaaauacaucgcugucugaaauuu

SEQ ID NO: 49279 - RNA, 64 nt, Homo Sapiens
uauuguaaaauuuagacugauuagcauuuuaauauuuuaauauaucuauauugcaaugauuuuu

SEQ ID NO: 49280 - RNA, 64 nt, Homo Sapiens
uuaauauauauuguaaaauuugauuuuuuuagcauuuuaauauucaguguauucuauauugcaa

SEQ ID NO: 49281 - RNA, 64 nt, Homo Sapiens
auggaaaaauaugcuucuacaacuggaauaucgcuuuuaauaaaucacuuuucauguggcagga

SEQ ID NO: 49282 - RNA, 64 nt, Homo Sapiens
uuaaagauuuuuagugcaauucacuucuggcgcauuuuaauaaucuacaaagaugauaaagcag

SEQ ID NO: 49283 - RNA, 64 nt, Homo Sapiens
aaaacuaaaguguuuuucuucgaauuaauaaacauuuuaauaucuuugggaaacauuuuaauaa

SEQ ID NO: 49284 - RNA, 64 nt, Homo Sapiens
gaauuaauaaacauuuuaauauguuugggaaacauuuuaauaacaaaauggagacggcuuucau

SEQ ID NO: 49285 - RNA, 64 nt, Homo Sapiens
aaccaggagauguuuaaugugccugauuuaauguuuuuaauaaucacagcaaaugaaagguggu

SEQ ID NO: 49286 - RNA, 64 nt, Homo Sapiens
ccuccuugaaacaagccauucuacugugcuaauguuuuaauaucacaucucacaaauaacaggg

SEQ ID NO: 49287 - RNA, 64 nt, Homo Sapiens
aucauuugugaccucagacacucucuggcuaauauuuuaauaagcucacagcagauaauucuga

SEQ ID NO: 49288 - RNA, 64 nt, Homo Sapiens
cugcauacuuuuugucuagcuguuugauuucauuuuuuaauauaguaugccaauuuugugacug

SEQ ID NO: 49289 - RNA, 64 nt, Homo Sapiens
aaaaauguuauuuguacaaacauugcacagacuauuuuaauaacaugauuuguucuuuaaauuu

SEQ ID NO: 49290 - RNA, 64 nt, Homo Sapiens
cacuuaguuuuuauucacuuguuuucacucugaauuuuaauauuuggcugauaugaaugcauug

SEQ ID NO: 49291 - RNA, 64 nt, Homo Sapiens
uuguacuuucuaacugagcccucuauuuucuuuauuuuaauaauauuucuccccacuugagaau

SEQ ID NO: 49292 - RNA, 64 nt, Homo Sapiens
aaagggcuucaagaauauauccaauuuuuaaauauuuuaauauaucuccuaucugauaacuuaa

SEQ ID NO: 49293 - RNA, 64 nt, Homo Sapiens
aaauauaagaaauuuauuucagguaaggguaauauuuuaauaguagucaauaaucuagcuuaag

SEQ ID NO: 49294 - RNA, 64 nt, Homo Sapiens
aaaaguaugagaucugguuccauccaguaagacauuuuaauagagaagaucaaaauguuaccug

SEQ ID NO: 49295 - RNA, 64 nt, Homo Sapiens
auuuuauuuauagaacucauuuaagcuguuuuuauuuuaauaugcccuauaaacauuuuuauau

SEQ ID NO: 49296 - RNA, 64 nt, Homo Sapiens
uguauaguuguuuauccauuaccacauuuuuguauuuuaauagucuacaggcuauauaaaagaa

SEQ ID NO: 49297 - RNA, 64 nt, Homo Sapiens
ccuucuacguacacacuguucuacuguuugaauuuuuuaauaugagcccaaauuguauaaucuu

SEQ ID NO: 49298 - RNA, 64 nt, Homo Sapiens
auuuuuuaauaugagcccaaauuguauaaucuuuuuuuaauaaaggggagaaaaaucacuuaca

SEQ ID NO: 49299 - RNA, 64 nt, Homo Sapiens
augaaagggucaacggcccuauaauuaugugccauuuuaauaaagugaucaguaugcuguuuua

SEQ ID NO: 49300 - RNA, 64 nt, Homo Sapiens
uaugugccauuuuaauaaaaugaucaguaugcuguuuuaauaaugggcuagcagaaguauaaag

SEQ ID NO: 49301 - RNA, 64 nt, Homo Sapiens
agugaaccagaacaaaucaccagcuaaggaauaauuuuaauaaaagguguuucacuauaaggaa

SEQ ID NO: 49302 - RNA, 64 nt, Homo Sapiens
acaaggaaaacauaaugauggauaugggaaaauauuuuaauaaacuuaauaaauacuuuaauaa

SEQ ID NO: 49303 - RNA, 64 nt, Homo Sapiens
ugauuaaaugccuaugcauguacuuuuagcuaguuuuuaauauuuuauaaaacuucauuuaaau

SEQ ID NO: 49304 - RNA, 64 nt, Homo Sapiens
caaaccugccuaugugccaucucacaaaagaaacuuuuaauaccuacaauaaaucaaaagaaua

SEQ ID NO: 49305 - RNA, 64 nt, Homo Sapiens
guggaagucagagggauuccccuuuuucaucucauuuuaauaggaaaauuccuuaugguuaaca

SEQ ID NO: 49306 - RNA, 64 nt, Homo Sapiens
cuucauagaugcugucacauuucuuaaagcaaccuuuuaauaugcagauaauaccccccaacuu

SEQ ID NO: 49307 - RNA, 64 nt, Homo Sapiens
cugaaaacagaaaaugugcagguuaauaauauuuuuuuaauagugugggaggacagaguuagag

SEQ ID NO: 49308 - RNA, 64 nt, Homo Sapiens
cgauauuagugccaaucaaauggaaaaaagguaguuuuaauaaacaagacacaacguuuuuaua

SEQ ID NO: 49309 - RNA, 64 nt, Homo Sapiens
auuuaagaguauuuuaagaagacauacugcuugauuuuaauacauugaucaggccauccaggac

SEQ ID NO: 49310 - RNA, 64 nt, Homo Sapiens
uuuccuucaaugugcauaaugauaaaauaaauaauuuuaauauucuuuuguuuccaugguuacc

SEQ ID NO: 49311 - RNA, 64 nt, Homo Sapiens
gaaguuaagaccuucauuuaaguuggauuuuauauuuuaauaaguguaucuuauauaaaccuca

SEQ ID NO: 49312 - RNA, 64 nt, Homo Sapiens
auuggaaauauauucaagaguaugauuuuuuauuuuuuaauaacaaugugcuaaauauaucuug

SEQ ID NO: 49313 - RNA, 64 nt, Homo Sapiens
aaauguauuuaaaaaaagaagcagacaagugccauuuuaauaaauuccagguccagagagguug

SEQ ID NO: 49314 - RNA, 64 nt, Homo Sapiens
ugauucucuaugaaauugauuucaauuuacuuguuuuuaauacaauuuuuaauuuauuugguca

SEQ ID NO: 49315 - RNA, 64 nt, Homo Sapiens
acaccuaaagagggaacaaaaguuaguuuuauuuuuuuaauaaacaacagaguuuguuuuguga

SEQ ID NO: 49316 - RNA, 64 nt, Homo Sapiens
acuuuuccaagccaaucuuauuugucacuuuuuguuuuaauaucuugcucucugacaggaaaga

SEQ ID NO: 49317 - RNA, 64 nt, Homo Sapiens
uuuugccagauaaauauuuugauauuauuuuccuuuuuaauauaaaggauagguuugaauugua

SEQ ID NO: 49318 - RNA, 64 nt, Homo Sapiens
uucaugagaucuacuugguuuacccaagucauguuuuuaauagacugcuaauaucaaaggagaa

SEQ ID NO: 49319 - RNA, 64 nt, Homo Sapiens
aauauucuguguaaaaaguaugaauuagaacugauuuuaauaaauuuccccuaaucugcauaaa

SEQ ID NO: 49320 - RNA, 64 nt, Homo Sapiens
uaaggccuugaaauuauauuaguuauaaaauuauuuuuaauauuagccaauuaaacuaugaaau

SEQ ID NO: 49321 - RNA, 64 nt, Homo Sapiens
aagacaugauguauguauuucauagauuuaaggauuuuaauagaucuuaucuaccacacauccc

SEQ ID NO: 49322 - RNA, 64 nt, Homo Sapiens
gucuuaucuaccacacauccuaaugaggaaaaauuuuuaauauauuuuaauuuaaugaaauugu

SEQ ID NO: 49323 - RNA, 64 nt, Homo Sapiens
auauguugauugaucccuuuuuuauuuugugguuuuuuaauauaguauaaaaauccuuuuaaaa

SEQ ID NO: 49324 - RNA, 64 nt, Homo Sapiens
gguuauauuaaauuauucuuuguuuuucuuuuucuuuuaauaaagccugcaaguuacuaaauug

SEQ ID NO: 49325 - RNA, 64 nt, Homo Sapiens
auaucaaaauauguguucaaaauugguauuuuaauuuuaauauuuuuguaaguugauuuaaauu

SEQ ID NO: 49326 - RNA, 64 nt, Homo Sapiens
uaucaaguagaggauaaguguaguuuaacuuaguuuuuaauauaacccauaaucaagaacauga

SEQ ID NO: 49327 - RNA, 64 nt, Homo Sapiens
uuauauuaccacaucagcauuauauuaaaaguguuuuuaauaguugauuguauuuugccaacua

SEQ ID NO: 49328 - RNA, 64 nt, Homo Sapiens
auauuuacaaucauauagaauauauagaguuacauuuuaauagcaacuguguacaugucacgaa

SEQ ID NO: 49329 - RNA, 64 nt, Homo Sapiens
agacacauaucuauccaaaauaccuauuuuaaauuuuuaauacaauauuuuauuuuaauauaaa

SEQ ID NO: 49330 - RNA, 64 nt, Homo Sapiens
aauaccuauuuuaaauuuuuaauacaauauuuuauuuuaauauaaacaucugucaguuauagac

SEQ ID NO: 49331 - RNA, 64 nt, Homo Sapiens
gucuugcuaucugugacuaguuuuauuuuugugcuuuuaauaguccgagcagucuuaccuuguu

SEQ ID NO: 49332 - RNA, 64 nt, Homo Sapiens
uuacuauuuauaggauuccguuuuuucacaagacuuuuaauaaaaagaaauuguagaaauaaac

SEQ ID NO: 49333 - RNA, 64 nt, Homo Sapiens
guguuucuauauacuccguccaauauagauaauguuuuaauaacaacugugggauaaaaguuau

SEQ ID NO: 49334 - RNA, 64 nt, Homo Sapiens
uuuuuguuaaauuuuuaaguuauagcuuuaaagguuuuaauaggaccuucuugaacgacuuuuc

SEQ ID NO: 49335 - RNA, 64 nt, Homo Sapiens
ucacuguaaaaaaaauggccaaaauguguuuuuuuuuuaauaaguaacuugacuauaaaauaaa

SEQ ID NO: 49336 - RNA, 64 nt, Homo Sapiens
auauuuuaaauauuuuuucuggugguuuuagugauuuuaauaauaaccuuguauaucuuguuuu

SEQ ID NO: 49337 - RNA, 64 nt, Homo Sapiens
uacuaugaggcccuaucuuuuaauuauauaauauuuuuaauauaagcagcaguaguagucaugc

SEQ ID NO: 49338 - RNA, 64 nt, Homo Sapiens
ggucagacuuuuggauuaaauuauaauuuuuauuuuuuaauauggcuuguguaauuggcuuugu

SEQ ID NO: 49339 - RNA, 64 nt, Homo Sapiens
uugcaagggcaaagaaggcaugguaacuuuuguauuuuaauaucuauuuuuaauugcuacuaag

SEQ ID NO: 49340 - RNA, 64 nt, Homo Sapiens
aauggaauguuucaaagguuucucauugugagaauuuuaauacuguguuaaauaugaaccauau

SEQ ID NO: 49341 - RNA, 64 nt, Homo Sapiens
aucugggugugagugugucuuguucuguuuuucuuuuuaauaaaacuuuuaaaccauauauuua

SEQ ID NO: 49342 - RNA, 64 nt, Homo Sapiens
gaguagacaccugccaauauuguuugaaaccuuuuuuuaauaugacauccucucuugucauucu

SEQ ID NO: 49343 - RNA, 64 nt, Homo Sapiens
ggaaggaagaccagaucuguaugauuuguuccauuuuuaauaacaaaaauauccacacccuuuu

SEQ ID NO: 49344 - RNA, 64 nt, Homo Sapiens
uguuccauuuuuaauaacaaaaauauccacacccuuuuaauaaugcucaguucuguaggcucuc

SEQ ID NO: 49345 - RNA, 64 nt, Homo Sapiens
cuuguguuaaccaucuuaaaugauguuuuguauauuuuaauagacugauaggaugagaaagauu

SEQ ID NO: 49346 - RNA, 64 nt, Homo Sapiens
agugccagacacuaaggaauauuauuguuuauuauuuuaauacauauaaaaagggauuaaucug

SEQ ID NO: 49347 - RNA, 64 nt, Homo Sapiens
uauaaaaguucauuuguugaaaaauaaggauccuuuuuaauaccacagcauuuguacuguuccu

SEQ ID NO: 49348 - RNA, 64 nt, Homo Sapiens
uccuuuuuaauaccacagcauuuguacuguuccuuuuuaauauacugaaaauauaaaaggaagg

SEQ ID NO: 49349 - RNA, 64 nt, Homo Sapiens
cucuaauggaacuguuuaaaaaauuuuuuuuucuuuuuaauauuuucuucuggucacaaaauaa

SEQ ID NO: 49350 - RNA, 64 nt, Homo Sapiens
ugauuauugaccuaauggauggcuuuuuaaaauguuuuaauaaaaagcagaauagauguuuguu

SEQ ID NO: 49351 - RNA, 64 nt, Homo Sapiens
aucuaccaguaauuuaaauguucuuuuuucuuuuuuuuaauaaauuacagucuuaucuuuuuuu

SEQ ID NO: 49352 - RNA, 64 nt, Homo Sapiens
aaaauguacuuuuacauucuuuuuuaaaaugcuuuuuuaauauugucauaaaguuguuauagau

SEQ ID NO: 49353 - RNA, 64 nt, Homo Sapiens
aaaauguuugcugccuaccuacuaucugcauuuguuuuaauauauuauauacuauuucaauauu

SEQ ID NO: 49354 - RNA, 64 nt, Homo Sapiens
cauuuaaucuugggaaaauuaguguggcgcgcuuuuuuaauaaugagaauguugauuucuauac

SEQ ID NO: 49355 - RNA, 64 nt, Homo Sapiens
cacaauuuugcugccaaaaaaguccagguuuuuuuuuuaauaaaaagcauugaaguguguucau

SEQ ID NO: 49356 - RNA, 64 nt, Homo Sapiens
gauuggucuuuuuauuuggcaccaguuauacugcuuuuaauauuuauguauuuuuaagaaagua

SEQ ID NO: 49357 - RNA, 64 nt, Homo Sapiens
cauuccuacuaucuguguucuaguugcugagguuuuuuaauaacauuugaagcauagaagaaaa

SEQ ID NO: 49358 - RNA, 64 nt, Homo Sapiens
uaggcaagaaaaaugccacuauuccauggaauguuuuuaauaaggguacagagaaaccaucuac

SEQ ID NO: 49359 - RNA, 64 nt, Homo Sapiens
cauguuuguaugugugaagcuuaauaaauauauuuuuuaauaaacuaugcagcagguguaaaaa

SEQ ID NO: 49360 - RNA, 64 nt, Homo Sapiens
acggucaacuucacacuuaggacucaucuagaccuuuuaauaaguuuaacuuuaaacauauugu

SEQ ID NO: 49361 - RNA, 64 nt, Homo Sapiens
uccccuucaguuucuauuuaggaggugaagaaucuuuuaauaagguagaaaguugcuuuauuua

SEQ ID NO: 49362 - RNA, 64 nt, Homo Sapiens
auaauuucucaaagucuauuguuugaucuaguuauuuuaauaaaggaacucuagaaguuucaag

SEQ ID NO: 49363 - RNA, 64 nt, Homo Sapiens
uaggccugagccucaacucuucagaaaauaguguuuuuaauauuccucuucagaaaauaguguu

SEQ ID NO: 49364 - RNA, 64 nt, Homo Sapiens
aguguuuuuaauauuccucuucagaaaauaguguuuuuaauauuccgagcuagagcucuucuuc

SEQ ID NO: 49365 - RNA, 64 nt, Homo Sapiens
agggguguuacacuauuugaauuuggauuuauguuuuuaauaaaucuuucauucacuuuuuuac

SEQ ID NO: 49366 - RNA, 64 nt, Homo Sapiens
cuuuuuuugugugcucuuuacuuaacagguuuccuuuuaauaucuuuuuagaauaacuuuaaag

SEQ ID NO: 49367 - RNA, 64 nt, Homo Sapiens
caaguaaauacuuuucauuuuccauauauaucuuuuuuaauaacguauuaaaaauuugggggaa

SEQ ID NO: 49368 - RNA, 64 nt, Homo Sapiens
aauaagaaaaauuaauacuaucuugaagagcuaauuuuaauaaaucaagauuuguuaguaacaa

SEQ ID NO: 49369 - RNA, 64 nt, Homo Sapiens
aaaguuaaacguuuuaaacaaccuuuucggcagcuuuuaauaggcuugaaaguuguuauuguua

SEQ ID NO: 49370 - RNA, 64 nt, Homo Sapiens
cugugaguccaaguaaaugacuuucaaugauuaauuuuaauagcugccauaguuuggacaguac

SEQ ID NO: 49371 - RNA, 64 nt, Homo Sapiens
auuucauuauucacaaaugaauagcaauguauuuuuuuaauauaaaauaaacuuuggacagaaa

SEQ ID NO: 49372 - RNA, 64 nt, Homo Sapiens
uguacuuaauagaggucuugcacuaacauuagauuuuuaauaaaacaacuucagaguaauauua

SEQ ID NO: 49373 - RNA, 64 nt, Homo Sapiens
aaaaauugcuauuguauaguuuucuuuuuuaaguuuuuaauaucguguuaauuaacuugaggga

SEQ ID NO: 49374 - RNA, 64 nt, Homo Sapiens
auauaaggguagaguucauucaugauguuugcccuuuuaauaaaaguaagcggcuggguuaauu

SEQ ID NO: 49375 - RNA, 64 nt, Homo Sapiens
uccaagcacuugcaacugauguuacugucuucaauuuuaauaauuacacauauuuguauauuuc

SEQ ID NO: 49376 - RNA, 64 nt, Homo Sapiens
aauaauuacacauauuuguauauuucagagaaguuuuuaauauuucucuguccacuuuuuauaa

SEQ ID NO: 49377 - RNA, 64 nt, Homo Sapiens
gguugucuaaaagucuuuuuaauuaauagaaagauuuuaauauccaagaguagucaaauuaagg

SEQ ID NO: 49378 - RNA, 64 nt, Homo Sapiens
auccuguuuucagucucuauguguacagcaguauuuuuaauaaagaauuacagagauaaauuug

SEQ ID NO: 49379 - RNA, 64 nt, Homo Sapiens
ugaauugagaucaggguuucuuuuccagggugcauuuuaauauacguaugaaaugaaauauuug

SEQ ID NO: 49380 - RNA, 64 nt, Homo Sapiens
uguuguuauagccaugcauugaccauuaaaugcauuuuaauaucucggcaaaaugagauuugaa

SEQ ID NO: 49381 - RNA, 64 nt, Homo Sapiens
auauccaguuuuguguauuauauguacauuugauuuuuaauagccuuuccaaagaaaugagggc

SEQ ID NO: 49382 - RNA, 64 nt, Homo Sapiens
aaaugcuuuauauuauuuggcuagaaauugcuguuuuuaauaaaugugaauuuuuuaaaaauaa

SEQ ID NO: 49383 - RNA, 64 nt, Homo Sapiens
uuuaacuauuuagagaaugauuuccaccuuuauguuuuaauauccuaggcaucugcuguaauaa

SEQ ID NO: 49384 - RNA, 64 nt, Homo Sapiens
aucacagauuuuuucuuuaaauaaaaauaagucauuuuaauaacuaaaccagauucuuugugga

SEQ ID NO: 49385 - RNA, 64 nt, Homo Sapiens
acuaugccacagucuggauguguuuacugaaacauuuuaauaaggaaguuuauuuuugauaaag

SEQ ID NO: 49386 - RNA, 64 nt, Homo Sapiens
cuguguauuuuucacuuguuucuaagaucaaacauuuuaauaugugcauguuauauauaaauau

SEQ ID NO: 49387 - RNA, 64 nt, Homo Sapiens
auccaauaauucaagccaagcaaguauauagguguuuuaauaguuuuuguuugcaguccucugu

SEQ ID NO: 49388 - RNA, 64 nt, Homo Sapiens
uuucuuaaauauucuaaaauguaagucaaauauguuuuaauaacaaagacuuaaauggcuuuuc

SEQ ID NO: 49389 - RNA, 64 nt, Homo Sapiens
acucaguacugucuggcuuggauucauuucauguuuuuaauauaagaaugaucuaauauuuuuu

SEQ ID NO: 49390 - RNA, 64 nt, Homo Sapiens
acuaacaauucuuugaaaggaccugcagaagcauuuuuaauaccucauucugucuaugcaagau

SEQ ID NO: 49391 - RNA, 64 nt, Homo Sapiens
caacacacacacacacacaccaccuggcccuaacuuuuaauauaauuacaggugugauccaccg

SEQ ID NO: 49392 - RNA, 64 nt, Homo Sapiens
aguuaagcaguauuuggcaaaguaauugugauucuuuuaauaccuucuucauggauaaugacau

SEQ ID NO: 49393 - RNA, 64 nt, Homo Sapiens
aucuuuauuauaaaccaugauuauuuuaacacuuuuuuaauaaauguucuggaauauguauuau

SEQ ID NO: 49394 - RNA, 64 nt, Homo Sapiens
ggauuauaaaucagcuaguggacuauagauuuuuuuuuaauauaaaguaugucaaaagacugca

SEQ ID NO: 49395 - RNA, 64 nt, Homo Sapiens
uauccaauaaugccuuccauucagggggucuuuuuuuuaauacauuuauuuuauuuuauuuuuu

SEQ ID NO: 49396 - RNA, 64 nt, Homo Sapiens
cugucauagguuuuaaaucucuuucuuuguuuuauuuuaauagcugaguuauaaauauuuuuuu

SEQ ID NO: 49397 - RNA, 64 nt, Homo Sapiens
aauacacaugaaaacaagaaagccuuauucaccuuuuuaauaaauggauuugggguguuacagu

SEQ ID NO: 49398 - RNA, 64 nt, Homo Sapiens
uaauguguacuuauaaauucacauugucaguauuuuuuaauauugggucugaauaauuaucuga

SEQ ID NO: 49399 - RNA, 64 nt, Homo Sapiens
uuuauuaaaaaucuagaauauuaaagauuuauacuuuuaauauugaauauaguuucguagaaaa

SEQ ID NO: 49400 - RNA, 64 nt, Homo Sapiens
augggaacaugggaaugauaauauauauuuuuucuuuuaauauuuuauuuuucuuuuuaugcca

SEQ ID NO: 49401 - RNA, 64 nt, Homo Sapiens
ggugagcugucuaacccuuuguacacauugacauuuuuaauaucguaacugauuucuugaugcu

SEQ ID NO: 49402 - RNA, 64 nt, Homo Sapiens
guuaagugcaauaaaguuuuugccuugcuuuauuuuuuaauacauaaaacuuacauucucauaa

SEQ ID NO: 49403 - RNA, 64 nt, Homo Sapiens
aauaugccacucuguuaauuucuuguuccagacauuuuaauagagauugcuugagccauguugu

SEQ ID NO: 49404 - RNA, 64 nt, Homo Sapiens
agcacaauuaauuuuauagagagguuuuuuauuuuuuuaauauuucuauugcaaaagucuaucc

SEQ ID NO: 49405 - RNA, 64 nt, Homo Sapiens
cucuaaaguugcaguuagaaacuaaaauaauguuuuuuaauauguaauaugcuccucuuggcua

SEQ ID NO: 49406 - RNA, 64 nt, Homo Sapiens
guuucaguguauuuaucauuuauauacccugaccuuuuaauaaacaaacaugccuuuuguuuuc

SEQ ID NO: 49407 - RNA, 64 nt, Homo Sapiens
gcacuauuacccagggcagauugcaggucuaguauuuuaauaauccaaggcauaggaagagauc

SEQ ID NO: 49408 - RNA, 64 nt, Homo Sapiens
caccaagaauguggacauauaauuuauuuuaaaauuuuaauagcuaaauuauucccaagauuug

SEQ ID NO: 49409 - RNA, 64 nt, Homo Sapiens
aggacagauggcacugauuauccauaauagauauuuuuaauagcacauuuaauacccaauuucu

SEQ ID NO: 49410 - RNA, 64 nt, Homo Sapiens
uacuuagccucuucugacuuuucuauuuauuuuauuuuaauaagcaguccuuuauuuuauucua

SEQ ID NO: 49411 - RNA, 64 nt, Homo Sapiens
aaaauaugaagccaugucucuuuaauauccaauuuuuuaauagaacuaaacuuuauacuucauu

SEQ ID NO: 49412 - RNA, 64 nt, Homo Sapiens
caauuuuuuaauagaaaaauacuuuauacuucauuuuuaauaucgggaaaaagaaggagacuaa

SEQ ID NO: 49413 - RNA, 64 nt, Homo Sapiens
ggcacccaccaccaugcccagcuaauuuuuguauuuuuaauagagagcuaauaauuguauauuu

SEQ ID NO: 49414 - RNA, 64 nt, Homo Sapiens
augaaucaaaaaauaccccuaguaaugcuuuauauuuuaauacugcaaaagcuuuacaaaugga

SEQ ID NO: 49415 - RNA, 64 nt, Homo Sapiens
caggggcccugaauuuaugugguuuuuauacauuuuuuaauaagaugcacuuuaugucauuuuu

SEQ ID NO: 49416 - RNA, 64 nt, Homo Sapiens
auacauuuuuuaauaagaugcacuuuaugucauuuuuuaauaaagucugaagaauuacuguuua

SEQ ID NO: 49417 - RNA, 64 nt, Homo Sapiens
agaauuuuaguuugcuugcauaauaaaagauuuuuuuuaauaacgcucccuuccaggagcauuu

SEQ ID NO: 49418 - RNA, 64 nt, Homo Sapiens
agauuuuuuuuaauaacagacccuuccaggagcauuuuaauaaaacuaugcaauaccaccugcu

SEQ ID NO: 49419 - RNA, 64 nt, Homo Sapiens
uuuguuuaccacuuguuuauuuuuaguauuucuauuuuaauacaauucuguugcaccacucuag

SEQ ID NO: 49420 - RNA, 64 nt, Homo Sapiens
cacacaauugugacggaauuagaacacuguauuauuuuaauaauuuaguauggccuuauggcaa

SEQ ID NO: 49421 - RNA, 64 nt, Homo Sapiens
gucugcauguucacaauaccaagcauuaaauguauuuuaauaacuaaacuuuucugaaagaagg

SEQ ID NO: 49422 - RNA, 64 nt, Homo Sapiens
ggaguugguuuuuuucuuuuuucuucuucuuuuuuuuuaauaugaaaaguacuuagcugggagu

SEQ ID NO: 49423 - RNA, 64 nt, Homo Sapiens
uuuacaugguggugauguccaaaagauacccaaauuuuaauauuccagaagaacaacuuuagca

SEQ ID NO: 49424 - RNA, 64 nt, Homo Sapiens
uugugggcaugagcugcugugcccagccuccauguuuuaauaucaacucucacuccugaauuca

SEQ ID NO: 49425 - RNA, 64 nt, Homo Sapiens
agcuuguauuauaguuauuaagccauaaaacacauuuuaauauuuaauacuguaauuugauuug

SEQ ID NO: 49426 - RNA, 64 nt, Homo Sapiens
aaugaacuuuugauuaguauaaggaaaaaaggguuuuuaauagacuugccagauguagcuacuu

SEQ ID NO: 49427 - RNA, 64 nt, Homo Sapiens
uuaggguccugauuuguggguuuuggguuuuguuuuuuaauacugugugggguuuuuuguuguu

SEQ ID NO: 49428 - RNA, 64 nt, Homo Sapiens
uauggcuuaugacauacucuuauacuguuaaugauuuuaauauauuggagcuaccgugggacua

SEQ ID NO: 49429 - RNA, 64 nt, Homo Sapiens
gggcaaaugguauuuguuuuuguuuuaauuuuuuuuuuaauagacggaagucuugcucugucau

SEQ ID NO: 49430 - RNA, 64 nt, Homo Sapiens
ggcaugagccaccacgacuggccagaggacaaaauuuuaauaaaggucuuagcuuaagcaguaa

SEQ ID NO: 49431 - RNA, 64 nt, Homo Sapiens
gacgggguuucaccauguuggcuaauuuuuguauuuuuaauagaggugagcacuaccacgcccg

SEQ ID NO: 49432 - RNA, 64 nt, Homo Sapiens
uaugggguuucgccauguugaauuuuuuguauuuuuuuaauagaacgugccaccaugucuggcu

SEQ ID NO: 49433 - RNA, 64 nt, Homo Sapiens
uguacacauucuuugagcacuuaaagaaugguauuuuuaauauuccugguuuuggauguaaguu

SEQ ID NO: 49434 - RNA, 64 nt, Homo Sapiens
aaaugugcagauaugcuucgauuuauuuuuuuauuuuuaauauugaaucagaacgcuggcuuuu

SEQ ID NO: 49435 - RNA, 64 nt, Homo Sapiens
uuaacuuuguggauucauuuuguguauauuuuauuuuuaauauacuggaugccuguuguuuuac

SEQ ID NO: 49436 - RNA, 64 nt, Homo Sapiens
ugaaauaggcuugccuuuagcucucuuguugguguuuuaauaaauaguugcuuuguugauuaau

SEQ ID NO: 49437 - RNA, 64 nt, Homo Sapiens
cugcauuguugcugucugccugccccuuuaauauuuuuaauaacaguaauucaaagcaugccuc

SEQ ID NO: 49438 - RNA, 64 nt, Homo Sapiens
uuuuuguguuuuugauguuucaaaagacuugcuguuuuaauaucgcuuaugcuacagugaugua

SEQ ID NO: 49439 - RNA, 64 nt, Homo Sapiens
uuaucuguaaauuguacaguuuucuuuuugaaaguuuuaauauugucuuccuuuuuaauaacuu

SEQ ID NO: 49440 - RNA, 64 nt, Homo Sapiens
guuuucuuuuugaaaguuuuaauauugucuuccuuuuuaauaacuuauuuuauacauauugugc

SEQ ID NO: 49441 - RNA, 64 nt, Homo Sapiens
cuuugaaugaaaauucugaaauuguaaaugucuauuuuaauauucaccuaugaaagaaucugug

SEQ ID NO: 49442 - RNA, 64 nt, Homo Sapiens
ggaacauuaaaagcuaauuuauaaaagcaauacuuuuuaauaugaaaacuuacugcaaaguuug

SEQ ID NO: 49443 - RNA, 64 nt, Homo Sapiens
uauauugaaguuuugguaaaaauucuuuuuucuuuuuuaauaaaaaauuagguuauuacuuuuu

SEQ ID NO: 49444 - RNA, 64 nt, Homo Sapiens
uuuuucuuugguugucccuauuaacaaaaaaguauuuuaauaaaaaauugaaaugagugaguca

SEQ ID NO: 49445 - RNA, 64 nt, Homo Sapiens
aauucauaaauaaagaauuguucuuucuuugugguuuuaauaagaguucaagaauuguucagag

SEQ ID NO: 49446 - RNA, 64 nt, Homo Sapiens
aguucaagaauuguucagagucuuguaaauguuauuuuaauaaucccuuuaaauuuuaucuguu

SEQ ID NO: 49447 - RNA, 64 nt, Homo Sapiens
guauauacaaaauucuuauauuuuccaaaguuauuuuuaauaaaugcugaucaggcaaaaauag

SEQ ID NO: 49448 - RNA, 64 nt, Homo Sapiens
uuaagauuacaauuuuaacauuguaaaguuauuuuuuuaauauuggcuagucauaucugugugu

SEQ ID NO: 49449 - RNA, 64 nt, Homo Sapiens
aacagaucaggaauucuaaauguuucccccacaguuuuaauaaguagcacuuacguaaaacauu

SEQ ID NO: 49450 - RNA, 64 nt, Homo Sapiens
acuaaccaaugccuuuuuaggagcacauagagcuuuuuaauagcguaagaaaaaaaauguaccc

SEQ ID NO: 49451 - RNA, 64 nt, Homo Sapiens
uggccugugauucuuuuuugaacccaggcgggcauuuuaauaaagaguguugugacugaugguc

SEQ ID NO: 49452 - RNA, 64 nt, Homo Sapiens
uuuugaauggcaccaaaacauuaguugcuaaggcuuuuaauacauauugaaacccagucuucau

SEQ ID NO: 49453 - RNA, 64 nt, Homo Sapiens
aguaaaugugcccagccucuguuuuguuaccugguuuuaauaacuggcugccuuuugcuguggg

SEQ ID NO: 49454 - RNA, 64 nt, Homo Sapiens
aagccuguuuugucuuuuguaagaacguggacguuuuuaauauacugcuuuagaaguaacaaug

SEQ ID NO: 49455 - RNA, 64 nt, Homo Sapiens
uucaaauaaauaaucugaggaauaaacgaugcuauuuuaauauucucaugacucauuaaaaaau

SEQ ID NO: 49456 - RNA, 64 nt, Homo Sapiens
ggauaauaauauggggucuuauguauauuuccuuuuuuaauacauggggugucuguguacauau

SEQ ID NO: 49457 - RNA, 64 nt, Homo Sapiens
uugauauuuuuuucuguguagugcucuuaauaguuuuuaauaagaagauuuugaauuauagaca

SEQ ID NO: 49458 - RNA, 64 nt, Homo Sapiens
uauuuuuuuuauauuuucuuaaaucauuaaaccauuuuaauauauguuaacuacuaauaaaugg

SEQ ID NO: 49459 - RNA, 64 nt, Homo Sapiens
guauuucgaguuccauuauacugaaguacucauguuuuaauagugccucuccaaaggccucacc

SEQ ID NO: 49460 - RNA, 64 nt, Homo Sapiens
cucuucugucauuaugugaugucauuuuuuugccuuuuaauagucuugucaauacuuuaccuga

SEQ ID NO: 49461 - RNA, 64 nt, Homo Sapiens
cuagucuuccuauagguuacuucaccuuuuuuuuuuuuaauaauuugauuugauacauauguag

SEQ ID NO: 49462 - RNA, 64 nt, Homo Sapiens
acuuuauggacacugagcuuugaucauggcuauguuuuaauaaauauagacaaucauaaaugaa

SEQ ID NO: 49463 - RNA, 64 nt, Homo Sapiens
acuuuacagacacugaacuuugaucauggcuauguuuuaauaaauauagacaaucauaaaugaa

SEQ ID NO: 49464 - RNA, 64 nt, Homo Sapiens
uauccaacucuuacucaacagaaugugggaagguuuuuaauaauagaaacccuaucaguguaaa

SEQ ID NO: 49465 - RNA, 64 nt, Homo Sapiens
caucagagaauucacaaaggauuuguuuuuuugauuuuaauagaaugaaugugggaaugccuuc

SEQ ID NO: 49466 - RNA, 64 nt, Homo Sapiens
ggggcacuuggcagcgcggggagcccgucgguaauuuuaauauuuuauuauauauauauaucua

SEQ ID NO: 49467 - RNA, 64 nt, Homo Sapiens
ugggaaucuuuuccguuucaagcauuaagaacacuuuuaauaaacuuuuuuuugagaaugguua

SEQ ID NO: 49468 - RNA, 64 nt, Homo Sapiens
gauucuauuuucguauaacaguuaugccuugcuauuuuaauaaauuuccugaguagcagugauu

SEQ ID NO: 49469 - RNA, 64 nt, Homo Sapiens
guuguuuaccaaauauucucuauuauuugcuauauuuuaauauuaccauugugauuauuguuac

SEQ ID NO: 49470 - RNA, 64 nt, Homo Sapiens
uuauuuaaaaugauuuuaccuccccccaaacauauuuuaauauggcugugcaauugcuggguug

SEQ ID NO: 49471 - RNA, 64 nt, Homo Sapiens
agaacacugaauuuuggcuucuuucuucgguaucuuuuaauauaaauucaaagaacaaggauag

SEQ ID NO: 49472 - RNA, 64 nt, Homo Sapiens
cucuucuuaguuggugacuguuuggggccugguauuuuaauagaugaacacuacuuuuuuaauu

SEQ ID NO: 49473 - RNA, 64 nt, Homo Sapiens
uaauuaaaguaucugauguaaaauuauuuugaguuuuuaauauuuugauaaacguguauuccug

SEQ ID NO: 49474 - RNA, 64 nt, Homo Sapiens
guuuaucaaugauucauguucuauacucauacauuuuuaauaugcuccuacucugcuucucuua

SEQ ID NO: 49475 - RNA, 64 nt, Homo Sapiens
aaagaauuauguaacugaucuuauuauaagauguuuuuaauauaaagcucaugagaguuuauuu

SEQ ID NO: 49476 - RNA, 64 nt, Homo Sapiens
auguaguauauuuucugacuagaacuugcugcuguuuuaauaagggauauuuuacuggaaauua

SEQ ID NO: 49477 - RNA, 64 nt, Homo Sapiens
cucuuucaguguaucucagcuaauuuuuuguaauuuuuaauauguuuuagcacuuuaagaaguu

SEQ ID NO: 49478 - RNA, 64 nt, Homo Sapiens
uucuuuguuaaucugagaacaagaauguaaaauguuuuaauauacuuuuuuaugcaguugugga

SEQ ID NO: 49479 - RNA, 64 nt, Homo Sapiens
uguacaauauauacauagacuguaacuacuuugcuuuuaauaauuuuaugaaauggcaaagguu

SEQ ID NO: 49480 - RNA, 64 nt, Homo Sapiens
uaaaauuuuguacuuauauuauuaaaaaucacauuuuuaauauuuguaguccagucucagcugu

SEQ ID NO: 49481 - RNA, 64 nt, Homo Sapiens
guuuuuacuaaugcuaaaacuuuuaaaguuuauuuuuuaauaaauuguugaguauuacaucauu

SEQ ID NO: 49482 - RNA, 64 nt, Homo Sapiens
guaguuuuaaucagcuuaaaagcuauuuaacccauuuuaauaagcuugcaguuuuguuucucug

SEQ ID NO: 49483 - RNA, 64 nt, Homo Sapiens
augauuauuugaauaaauuacacauuguuuaguuuuuuaauacaacugcuauaugacucuucug

SEQ ID NO: 49484 - RNA, 64 nt, Homo Sapiens
aacuccuauacacguguacuguagaaugaguauuuuuuaauaccuuaagguaggcgucaaauuc

SEQ ID NO: 49485 - RNA, 64 nt, Homo Sapiens
auuuccucauauacguaguguguagaaucaagucuuuuaauaauucauuuuuucuucauaauau

SEQ ID NO: 49486 - RNA, 64 nt, Homo Sapiens
cacacauacacauguaaacauuggaaugcauaaguuuuaauauuuuagcgcuaucaguuucuaa

SEQ ID NO: 49487 - RNA, 64 nt, Homo Sapiens
uuucuccuuaccccuuccuuagguaaauuuucaguuuuaauacuguuauguccacuuauucacu

SEQ ID NO: 49488 - RNA, 64 nt, Homo Sapiens
ugaauuauuacuuagcacauauauuuguguuuauuuuuaauauucaauuguauuacuccuugua

SEQ ID NO: 49489 - RNA, 64 nt, Homo Sapiens
acaugguagagaagauaaggucagucauucacuguuuuaauaugcaaaccaacaugugcucuuu

SEQ ID NO: 49490 - RNA, 64 nt, Homo Sapiens
cuccaguauuauucaaaugaguuucucuuauggauuuuaauaagugggcuaauaaaaaacaugu

SEQ ID NO: 49491 - RNA, 64 nt, Homo Sapiens
aauaaauaauuuaaauuuuauuaugggcuucuaauuuuaauauaaaaaaaaucuaaagcagcuc

SEQ ID NO: 49492 - RNA, 64 nt, Homo Sapiens
ugauccuauuaugugagagauucuuggggaugccuuuuaauauucuuggagaaaugaaaauuau

SEQ ID NO: 49493 - RNA, 64 nt, Homo Sapiens
gggacuccagaucagaugugagccaugaaaugguuuuuaauagguagcuugaaggcagugaggg

SEQ ID NO: 49494 - RNA, 64 nt, Homo Sapiens
acuuccaaauugcccuccugauuuauauauugguuuuuaauaaugaauugcaaagucauaggau

SEQ ID NO: 49495 - RNA, 64 nt, Homo Sapiens
cauugggggcaguggaauugaauucagguugcaguuuuaauauuacuuuagguauagauaaccu

SEQ ID NO: 49496 - RNA, 64 nt, Homo Sapiens
uauacacacuaaguccaucuauuauuauuugccuuuuuaauacccuuguuuuauuauuacuuuc

SEQ ID NO: 49497 - RNA, 64 nt, Homo Sapiens
auagacaucuguauuacugaccuguuuguaacuuuuuuaauaaauaagacgacccugcagucca

SEQ ID NO: 49498 - RNA, 64 nt, Homo Sapiens
uuaauugauuucuuuaaucaauacaaggguuaauuuuuaauauuaguucuuauugauggcuaau

SEQ ID NO: 49499 - RNA, 64 nt, Homo Sapiens
uugcuguugccucaagaaaaauauuuuguaucagugcuguuaaucuacaaccauugaauuugcc

SEQ ID NO: 49500 - RNA, 64 nt, Homo Sapiens
gauugaagcuauugucaaaucauuuucuuuugccugcuguuaaaauuaauauagcauggcaccu

SEQ ID NO: 49501 - RNA, 64 nt, Homo Sapiens
uuuucauccuaaagaacaaaguaaugacagaacaugcuguuauuuagguauuuuucuuuaacca

SEQ ID NO: 49502 - RNA, 64 nt, Homo Sapiens
cuucccuccccucuaguuuuuucuuccuuuucacugcuguuauauuucaucaugauaauucagc

SEQ ID NO: 49503 - RNA, 64 nt, Homo Sapiens
aauaaacaucuauguuaaauccaaauucagcauuugcuguuagcuauucagcaucaggcacucu

SEQ ID NO: 49504 - RNA, 64 nt, Homo Sapiens
ucuuauugauucaugaggaacauuacugcuaaucugcuguuaagugaacgguuuuucauuuuac

SEQ ID NO: 49505 - RNA, 64 nt, Homo Sapiens
accauaguuuuguuuaauuuuauaacuagacaucugcuguuaucucagcauuagagaaaugaau

SEQ ID NO: 49506 - RNA, 64 nt, Homo Sapiens
agagccucuuugcuggagucuaauaaauuaaacaugcuguuaccaaacuguucuuuugcaauaa

SEQ ID NO: 49507 - RNA, 64 nt, Homo Sapiens
aaguuuucacaacuauuuaugcugguaaaacaaaugcuguuaaaucaccuuaugcgucguuuuc

SEQ ID NO: 49508 - RNA, 64 nt, Homo Sapiens
gguuuuucguuuuucauuguuauuauugugagaaugcuguuauugggguugugugugagugccc

SEQ ID NO: 49509 - RNA, 64 nt, Homo Sapiens
gacagcgauauaauuuuauuuauaucauuaucuuugcuguuauucuaacugcuguuaaaauuaa

SEQ ID NO: 49510 - RNA, 64 nt, Homo Sapiens
auuaauauaucauuaucuuucuucugguucuaacugcuguuaaauucuguauaacagccuuuuc

SEQ ID NO: 49511 - RNA, 64 nt, Homo Sapiens
ucgguuuaaauuuuuaaauuuuaacuuguaaaacugcuguuaacuaauuugcuugugucaacuc

SEQ ID NO: 49512 - RNA, 64 nt, Homo Sapiens
uaaaaucagagacugguguaaggaguuugcuuugugcuguuacccuaagugaguuguugauuuu

SEQ ID NO: 49513 - RNA, 64 nt, Homo Sapiens
caggaguugaccuucauuuaguauaaaaaaauaaugcuguuaaauaaaugaagauuugguuuuu

SEQ ID NO: 49514 - RNA, 64 nt, Homo Sapiens
gcucauguuccuuagaccugcaggauggaucaagugcuguuacaucucaucgaaacccugguuu

SEQ ID NO: 49515 - RNA, 64 nt, Homo Sapiens
uuuucucaugaauucuuaaaggauuaugcuuuaaugcuguuaucuauuuuauuguucuugaaaa

SEQ ID NO: 49516 - RNA, 64 nt, Homo Sapiens
agagcuaguggauguguuugucuacaaguaugauugcuguuacauaacaccccaaauuaacucc

SEQ ID NO: 49517 - RNA, 64 nt, Homo Sapiens
gugaucaucagcugagggguggccuuugagaagcugcuguuaacguauuugccaguuacgaagu

SEQ ID NO: 49518 - RNA, 64 nt, Homo Sapiens
ccuccauccuugaucuuguuagcaaugcuguuuuugcuguuagucggguuagaguuggcucuac

SEQ ID NO: 49519 - RNA, 55 nt, Homo Sapiens
agauuauugauagagaguaguuagaugcuguuaaaagaggaggaaacuacuugag

SEQ ID NO: 49520 - RNA, 64 nt, Homo Sapiens
gugugaauguacaaagaaaacaaaccauugcuuaugcuguuauauacuagagaaauuuuguuuu

SEQ ID NO: 49521 - RNA, 64 nt, Homo Sapiens
aaaaagcaaacaaacacaggcugaaaacccaugcugcuguuauacacaauggcaguauuaacaa

SEQ ID NO: 49522 - RNA, 64 nt, Homo Sapiens
uaaaaaaaaaauacuauuguauggauuuuuguauugcuguuaaguauuguuuugugugugugug

SEQ ID NO: 49523 - RNA, 64 nt, Homo Sapiens
aauuucuuguggauuucauuaaaacguaaacacgugcuguuaguuaaaauguaugauucaggau

SEQ ID NO: 49524 - RNA, 64 nt, Homo Sapiens
ugggaaacaagauucuaacaggaauguagccauuugcuguuaucuaaguugauauuuuuuuucu

SEQ ID NO: 49525 - RNA, 64 nt, Homo Sapiens
accaaacuuucuuccuugugagcagaagguuggcugcuguuagcaggaucccacagugauaacc

SEQ ID NO: 49526 - RNA, 64 nt, Homo Sapiens
gaaaagagcuggcauugugggaauuuucuuuuuaugcuguuagcuguuuaccuucuuagaagac

SEQ ID NO: 49527 - RNA, 64 nt, Homo Sapiens
agugugaaauugucauguuacagccaggcccgugugcuguuaauaugucauaguuaaaaacgua

SEQ ID NO: 49528 - RNA, 64 nt, Homo Sapiens
gcaggcugcuuccugccuaagcuaagcgggaggcugcuguuagaaugugcucaucccacucucc

SEQ ID NO: 49529 - RNA, 64 nt, Homo Sapiens
gcugucacuagggaguggccuuagacagugcacaugcuguuaggucaggauggugggaugugau

SEQ ID NO: 49530 - RNA, 64 nt, Homo Sapiens
ugggcagcccuucuggguuuggccaagagggaggugcuguuagucaacccuagacaaagccuuu

SEQ ID NO: 49531 - RNA, 64 nt, Homo Sapiens
augugccugccgccugcccuccacacaucccuguccccccaacccgggaaccccugcccuccuc

SEQ ID NO: 49532 - RNA, 64 nt, Homo Sapiens
ccccccuucucaccuucccuucuccccgaccccaccccccaaaaaagcuacuucuucauuccgu

SEQ ID NO: 49533 - RNA, 53 nt, Homo Sapiens
aagagggggcugaggacugaggcccccccaacucuuccuccccucucaucccc

SEQ ID NO: 49534 - RNA, 64 nt, Homo Sapiens
gaagagucuuccaaggccagaaggagggggacaaccccccaagaccaucccugaagacgagcau

SEQ ID NO: 49535 - RNA, 64 nt, Homo Sapiens
guacccccaggccaaagcaaguaagcgguuagcaccccccaaucccagaggcaacaauagagac

SEQ ID NO: 49536 - RNA, 64 nt, Homo Sapiens
gucccccuggcugagccccuguccuccccucuguccccccaaccgcccccccugcaugcagcca

SEQ ID NO: 49537 - RNA, 64 nt, Homo Sapiens
gaaacgguuugagagacgcaggccucuaauuccaccccccaagucuuccuuuuuaucauaacgc

SEQ ID NO: 49538 - RNA, 64 nt, Homo Sapiens
uggccacagaugccacuacuggcauccuugcgagccccccaagcugagauugucuuccaagccg

SEQ ID NO: 49539 - RNA, 64 nt, Homo Sapiens
uauuugcucacauuaacaaaagaagccuccccgaccccccaagcaaccaaaagauuuucugucc

SEQ ID NO: 49540 - RNA, 64 nt, Homo Sapiens
ccuggcuauuuuauauuaauauagggagcuucuuccccccaaccagguuauggugaauaaaacc

SEQ ID NO: 49541 - RNA, 64 nt, Homo Sapiens
ucuguugaaaugauucacugucaucauuuucugcccccccaaaacaguuucuaucuuuagccca

SEQ ID NO: 49542 - RNA, 64 nt, Homo Sapiens
uccucauauugccucugaacgaugccccugccauccccccaaccgccugccccccaacccugag

SEQ ID NO: 49543 - RNA, 64 nt, Homo Sapiens
cugaggaugccccugccauccaucccuuggccugccccccaaccaaagcuguccuuugccaucu

SEQ ID NO: 49544 - RNA, 64 nt, Homo Sapiens
cauuugucucaccccugauauugguuccugaugcccccccaacaaaaauaaauaaauaaauuau

SEQ ID NO: 49545 - RNA, 64 nt, Homo Sapiens
gcuauacaaacauuuugcuaagucugcccaaagcccccccaaugcauuccuucaacaaaauaca

SEQ ID NO: 49546 - RNA, 64 nt, Homo Sapiens
aauaagguuuuauuuugauuguguucguuuccccccccccaauaguaaaauuucuccuccuuua

SEQ ID NO: 49547 - RNA, 64 nt, Homo Sapiens
aauaguaaaauuucuccuccuuuaacuccuccuaccccccaagguaagaaacaaaaaacaaaca

SEQ ID NO: 49548 - RNA, 64 nt, Homo Sapiens
ucuggcucccacaaggcccgacugggaccugccuccccccaaccacugacuguaauccaggggg

SEQ ID NO: 49549 - RNA, 64 nt, Homo Sapiens
ccccaacacgccugucccucauccccauccggcaccccccaauccuuccagccggagcaccccg

SEQ ID NO: 49550 - RNA, 64 nt, Homo Sapiens
acacaaaaaaagaaaaucuaaaaucacccaccacccccccaaaagagacagagagagagaaaaa

SEQ ID NO: 49551 - RNA, 64 nt, Homo Sapiens
cacggcccgggguucaaggcagaagaggccaaguccccccaagcgcaucccugcaaaagggaac

SEQ ID NO: 49552 - RNA, 64 nt, Homo Sapiens
ccuuaauuuuauucuccgcuucccagcagcguuuccccccaacuccccaagcccaagucuuucc

SEQ ID NO: 49553 - RNA, 64 nt, Homo Sapiens
cugcuuuuagcuucccuauucagcuguaggcauaccccccaaguugcuuuuauacauuuuucug

SEQ ID NO: 49554 - RNA, 64 nt, Homo Sapiens
aaccauuguuggcaaccuggaacuuugaaugcuaccccccaaguuugauuuaggggcuuuggag

SEQ ID NO: 49555 - RNA, 64 nt, Homo Sapiens
ccaaauuugucuaagcacugcaaaccaaaguguuccccccaaccggcaaacugcucugugcuuu

SEQ ID NO: 49556 - RNA, 64 nt, Homo Sapiens
aucgugauuugucuuuucauuuuuuuuaauuuuuccccccaaccuuuuuccuuuuuucuuuuuu

SEQ ID NO: 49557 - RNA, 64 nt, Homo Sapiens
ugcgguucaggaaaauugaaugcaaaccauagcacaggcuaauuuuuuguuguuucuuaaauaa

SEQ ID NO: 49558 - RNA, 64 nt, Homo Sapiens
gaguagcugggacuacaggcacgcaccaccaugccaggcuaauuuuuuuguauuuuagcagaga

SEQ ID NO: 49559 - RNA, 64 nt, Homo Sapiens
uggagaagggaccagggauugcaggccccaucuccaggcuaaggggaggagagcaucaucacuu

SEQ ID NO: 49560 - RNA, 64 nt, Homo Sapiens
uuguaaaggcaauucuuuugagagcaggauucuccaggcuaaaucaaaggcagcuaauccuguc

SEQ ID NO: 49561 - RNA, 64 nt, Homo Sapiens
aagugggggaagggagaugccagugauaggggaucaggcuaagagcagccccagagggagaccu

SEQ ID NO: 49562 - RNA, 64 nt, Homo Sapiens
guggauaccagcgacucccuccugagggucauagcaggcuaaggcagguuccuacacacccacg

SEQ ID NO: 49563 - RNA, 64 nt, Homo Sapiens
uggaagugcuaaaauaggaagccccuauauucauccaggauacucauugucaguguagccccuc

SEQ ID NO: 49564 - RNA, 64 nt, Homo Sapiens
gaggggagcccagggccaucccuucgucacgauaccaggauacgaccagagcugguucucaugg

SEQ ID NO: 49565 - RNA, 64 nt, Homo Sapiens
agcaaauaucaaauacugcaaaaauccccuugucccaggauacccuaaaauagaagugcuuaaa

SEQ ID NO: 49566 - RNA, 64 nt, Homo Sapiens
uuguuguuuguaaauagaauugaauuuaaauacaccaggauaaaucuuauuuaaaggaagccug

SEQ ID NO: 49567 - RNA, 64 nt, Homo Sapiens
cacgugcaucugagaaccgcaugaaugagauacaccaggauauguuuugcaggcccgcuucuca

SEQ ID NO: 49568 - RNA, 64 nt, Homo Sapiens
aaugaacaugccaugguugaaauauaauauuaugccaggauagauuacaaauauacaagcaaau

SEQ ID NO: 49569 - RNA, 64 nt, Homo Sapiens
uuagcaugggguugugguugaaauaucuugguauccaggauaaggguauguggaaaaacaggcu

SEQ ID NO: 49570 - RNA, 64 nt, Homo Sapiens
uuauaccuuccauuuccaucguauucuccaguuuccaggauagacguugcucaucgucuuuacc

SEQ ID NO: 49571 - RNA, 64 nt, Homo Sapiens
gcagcuuuauuaaaguuaaagaguuccugugaaaccaggauacuaauguucguggaagggccag

SEQ ID NO: 49572 - RNA, 64 nt, Homo Sapiens
ugcaucaagaguacuguagcaguaaaggaauuugccaggauaucuuuuuaaaauuuaauuuuua

SEQ ID NO: 49573 - RNA, 64 nt, Homo Sapiens
ucugagagugaaaccaugaccuuaagccauaggcccaggauauucacucccugcuccacgaagc

SEQ ID NO: 49574 - RNA, 64 nt, Homo Sapiens
gagacugaggcuuagagagaugugggcgcugcuuccaggauaaguaaucaccaugggaaacugu

SEQ ID NO: 49575 - RNA, 64 nt, Homo Sapiens; identical to SEQ ID NO: 49557

SEQ ID NO: 49576 - RNA, 64 nt, Homo Sapiens; identical to SEQ ID NO: 49558

SEQ ID NO: 49577 - RNA, 64 nt, Homo Sapiens; identical to SEQ ID NO: 49559

SEQ ID NO: 49578 - RNA, 64 nt, Homo Sapiens; identical to SEQ ID NO: 49560

SEQ ID NO: 49579 - RNA, 64 nt, Homo Sapiens; identical to SEQ ID NO: 49561

SEQ ID NO: 49580 - RNA, 64 nt, Homo Sapiens; identical to SEQ ID NO: 49562

SEQ ID NO: 49581 - RNA, 64 nt, Homo Sapiens; identical to SEQ ID NO: 49563

SEQ ID NO: 49582 - RNA, 64 nt, Homo Sapiens; identical to SEQ ID NO: 49564

SEQ ID NO: 49583 - RNA, 64 nt, Homo Sapiens; identical to SEQ ID NO: 49565

SEQ ID NO: 49584 - RNA, 64 nt, Homo Sapiens; identical to SEQ ID NO: 49566

SEQ ID NO: 49585 - RNA, 64 nt, Homo Sapiens; identical to SEQ ID NO: 49567

SEQ ID NO: 49586 - RNA, 64 nt, Homo Sapiens; identical to SEQ ID NO: 49568

SEQ ID NO: 49587 - RNA, 64 nt, Homo Sapiens; identical to SEQ ID NO: 49569

SEQ ID NO: 49588 - RNA, 64 nt, Homo Sapiens; identical to SEQ ID NO: 49570

SEQ ID NO: 49589 - RNA, 64 nt, Homo Sapiens; identical to SEQ ID NO: 49571

SEQ ID NO: 49590 - RNA, 64 nt, Homo Sapiens; identical to SEQ ID NO: 49572

SEQ ID NO: 49591 - RNA, 64 nt, Homo Sapiens; identical to SEQ ID NO: 49573

SEQ ID NO: 49592 - RNA, 64 nt, Homo Sapiens; identical to SEQ ID NO: 49574

SEQ ID NO: 49593 - RNA, 64 nt, Homo Sapiens
accagauauuuuguucccaucaguuuagcccagagauagacaguagaaugcaaauaccucccuc

SEQ ID NO: 49594 - RNA, 64 nt, Homo Sapiens
cacgaacaugcaguuauugaagauuaggaucaaggauagacaagguauaguaguuaucuuaaaa

SEQ ID NO: 49595 - RNA, 64 nt, Homo Sapiens
acucuauauggcugaggaaggagcuagggaaagagauagacacaauggggugaaaacaauuuug

SEQ ID NO: 49596 - RNA, 64 nt, Homo Sapiens
aacaaauuguaccacauuguuaaggacauauaaugauagacacuagaacucagaccucugcaug

SEQ ID NO: 49597 - RNA, 64 nt, Homo Sapiens
cuacaggaagcaugaccuauccacaucuuuccaagauagacacuaacaugucaugucccaaaca

SEQ ID NO: 49598 - RNA, 64 nt, Homo Sapiens
augaaucuuccccccaacccccaccaugcagauggauagacagaaucuuuccugacuagucauu

SEQ ID NO: 49599 - RNA, 64 nt, Homo Sapiens
cacuacaagucagcuccagcaacugaggcuuagagauagacaauuccccauuaacagauggaaa

SEQ ID NO: 49600 - RNA, 64 nt, Homo Sapiens
gaccccuucuacugaaccuugucccacucuaggugauagacagguaaguguccuuccaugcaag

SEQ ID NO: 49601 - RNA, 64 nt, Homo Sapiens
uacccaguguuuguuacuuuugguuuauguuaaugauagacaaaguuuaacugucugcaacagu

SEQ ID NO: 49602 - RNA, 64 nt, Homo Sapiens
guauaugccugcuggauggaagggcuugacucaugauagacaaaaguuaacaagccuuuggauc

SEQ ID NO: 49603 - RNA, 64 nt, Homo Sapiens
gcuggcucugcugccccaaccagggccuugcccagauagacaggcuuuucaugcuuccaagugu

SEQ ID NO: 49604 - RNA, 64 nt, Homo Sapiens
caaugaugaaacucagauggauaaaucuugccaagauagacaaaccccauuauggugcuucuga

SEQ ID NO: 49605 - RNA, 64 nt, Homo Sapiens
ucgucauuuaaguaagggaugcucuaucugggcugauagacauugaucgaaaacauuucaaauu

SEQ ID NO: 49606 - RNA, 64 nt, Homo Sapiens
aaaucauuagguaauuuaaggggggaggaaaguagauagacagauuaugugcagguccuagccu

SEQ ID NO: 49607 - RNA, 64 nt, Homo Sapiens
uagugcaaauuugccagcuugcuggcagcugaaugauagacaaaaagugugcaaacaaguuaga

SEQ ID NO: 49608 - RNA, 64 nt, Homo Sapiens
auugcugccgucuggccucuggccucagucuucagauagacaguaagaagaaagcagccucauu

SEQ ID NO: 49609 - RNA, 64 nt, Homo Sapiens
caaaucaaccaaccaacucaguauccuguguuuugauagacaagaguuuacuaaauauauugau

SEQ ID NO: 49610 - RNA, 64 nt, Homo Sapiens
agccaacccugaucuggaagcuucuacauggaaagauagacagcauccugacaggaaauguuuu

SEQ ID NO: 49611 - RNA, 64 nt, Homo Sapiens
gcaggggauacuggcagccuccuaugcacaccaggauagacaagagauugccaggcccuuuucu

SEQ ID NO: 49612 - RNA, 64 nt, Homo Sapiens
acugacuuuuagcugucauacuuuuuguuccucugauagacauguauucacaaguuuuggaggg

SEQ ID NO: 49613 - RNA, 64 nt, Homo Sapiens
gcagagaagacuacccagccagugaagugcagaggauagacauaggaaaacauuccaggcauuu

SEQ ID NO: 49614 - RNA, 64 nt, Homo Sapiens
uuaucacaagggaggggaggccgagagucagacugauagacaccauaggagccgacucuuugau

SEQ ID NO: 49615 - RNA, 64 nt, Homo Sapiens
ucuugcagaaucagcuacacuuaauuauguugcugauagacaagcauccacgcuucagcuggca

SEQ ID NO: 49616 - RNA, 64 nt, Homo Sapiens
ccuauaauauccuugaaaagaaacuauuaaaaaggauagacauuucugauguaaguaaaacccc

SEQ ID NO: 49617 - RNA, 64 nt, Homo Sapiens
agcucuaaaaaaccaucucauggacugaaagguagauagacagauggaccacaaugggaaauag

SEQ ID NO: 49618 - RNA, 64 nt, Homo Sapiens
acucuuuuauuuuuagaucacaaaauuuguccaggauagacauagagcuagaagaaacagacuu

SEQ ID NO: 49619 - RNA, 64 nt, Homo Sapiens
cggagcagaauaaagaguacguuacugguuuaaggauagacauaaaagguaaucagcucagugu

SEQ ID NO: 49620 - RNA, 64 nt, Homo Sapiens
uucauauaucuugaacucaacuuuuauccuuuuugauagacaguaaguauuucauguaggagga

SEQ ID NO: 49621 - RNA, 64 nt, Homo Sapiens
cuggugaugauuuaggggcuuuaguacaaucauggauagacauuagccucucaaauauugagcu

SEQ ID NO: 49622 - RNA, 64 nt, Homo Sapiens
auaugugggaaagauuuuuucuauucuuguauuugauagacaaaggacauguugaaauuagaau

SEQ ID NO: 49623 - RNA, 64 nt, Homo Sapiens
uuccccuccuuugaaaccuagccuauguagcagugauagacauaggguggguuuuaaacagaau

SEQ ID NO: 49624 - RNA, 64 nt, Homo Sapiens
uaucaaagaaguuaaaaugggucuaaaucacaaggauagacauuuucuuuacaggagaggaaag

SEQ ID NO: 49625 - RNA, 64 nt, Homo Sapiens
aagagaguuguuagcuaaacugaucugucugcaugauagacaguuuaaaaauucaucccaguuc

SEQ ID NO: 49626 - RNA, 64 nt, Homo Sapiens
aagagaugauuuacaccuaauagacauugaauaugauagacauacauguauauauguaucaguu

SEQ ID NO: 49627 - RNA, 64 nt, Homo Sapiens
cuuuacaaucugcuuguuuuuuuuguaauuauuagauagacagccuagagugagaaguuaaagg

SEQ ID NO: 49628 - RNA, 64 nt, Homo Sapiens
gagccacugcgccuggcugguuuucaugaaucuugauagacaucuauaacguuauuauuuucag

SEQ ID NO: 49629 - RNA, 64 nt, Homo Sapiens
cuaucugugcuagguuaaaugguuggcccccaaagauagacagguccugauuucuagaacccgu

SEQ ID NO: 49630 - RNA, 64 nt, Homo Sapiens
uuuucaagcuucucagugcuggaaaaaauacugagauagacauguuuaguugaaguuauuucau

SEQ ID NO: 49631 - RNA, 64 nt, Homo Sapiens
aagcagcuuugucuauaguuaacaaaguuuuaaggauagacaagaauguguuuucuuuaauaaa

SEQ ID NO: 49632 - RNA, 64 nt, Homo Sapiens
aaugacuuaguuaugacuggacaucuuaaaagcugauagacaagccaaauggcuggcagaugau

SEQ ID NO: 49633 - RNA, 64 nt, Homo Sapiens
aaauuguuugaaaaacauuugcucaggaugaaaggauagacacaucacauucucaauaguucca

SEQ ID NO: 49634 - RNA, 64 nt, Homo Sapiens
gaguucaguaugguguccaagagugcccuguguggauagacaugugcacuccuuccaggagugg

SEQ ID NO: 49635 - RNA, 64 nt, Homo Sapiens
gccaucccuuggggaaggguggggagaaauauaggauagacacuggacauggcccauuggagca

SEQ ID NO: 49636 - RNA, 64 nt, Homo Sapiens
ccauaccucuuccuuucccaucccacccacauaugauagacagccccucuguugagauauggag

SEQ ID NO: 49637 - RNA, 64 nt, Homo Sapiens
gaagcaguugauauaauggguuuauacuuuaaaagauagacauggugccaugaaguuggggagu

SEQ ID NO: 49638 - RNA, 64 nt, Homo Sapiens
gggcuccugggaguagagagcggugguagauccugauagacaugaaguggcacauccaguggag

SEQ ID NO: 49639 - RNA, 64 nt, Homo Sapiens
uggaccuauggggugggaggcccuugacuguugggauagacagaauccugaccaaaggaaggca

SEQ ID NO: 49640 - RNA, 64 nt, Homo Sapiens
ccucugcaguaagagaguggggagaccagggcaggauagacagagaaaacucuccuggggugga

SEQ ID NO: 49641 - RNA, 64 nt, Homo Sapiens
uaugagggggaauagucuagaaaauuuaaugcaugauagacacaauuuggauuggggucccucu

SEQ ID NO: 49642 - RNA, 64 nt, Homo Sapiens
guccaccuuucggccggccaaaucuagcagaaaugauagacacacccuggccuccucacauagg

SEQ ID NO: 49643 - RNA, 64 nt, Homo Sapiens
auuggugaacuacucauuuaugauauucaccugggauagacaguauuggaaguaagaucagggc

SEQ ID NO: 49644 - RNA, 64 nt, Homo Sapiens
uaguuaagagcuaagagcaguaaaagcuuaggcugauagacaagccucaggagagagucuaaga

SEQ ID NO: 49645 - RNA, 64 nt, Homo Sapiens
gaaggauagaaaagacuuaaggaaauaauaaagugauagacagggucgcuacuaaaagaaugaa

SEQ ID NO: 49646 - RNA, 64 nt, Homo Sapiens
aucaguuuaggacuauuaaaguuccuuuugcucugauagacaaaucagguggauuuuuaccuuu

SEQ ID NO: 49647 - RNA, 64 nt, Homo Sapiens
cucuuaaaauauuuuuacaacagaagauaaagaggauagacaacuccugagguuuuuuuccccc

SEQ ID NO: 49648 - RNA, 64 nt, Homo Sapiens
agugagagggagaguggguggacguggguggggggauagacagggccuaggcuguggccacuaa

SEQ ID NO: 49649 - RNA, 64 nt, Homo Sapiens
aaaagaaaaaagaaaaaucucauuauuucaaaaugauagacauauaccaaaaacaagucuauaa

SEQ ID NO: 49650 - RNA, 64 nt, Homo Sapiens
aaucaccucacuuguguagguagguuggaaucaggauagacacugugaucaaggcugaggccac

SEQ ID NO: 49651 - RNA, 64 nt, Homo Sapiens
aacgguguuuaguuuuauaccauaagcccaaacugauagacaguucacaguucccuuuauuuca

SEQ ID NO: 49652 - RNA, 64 nt, Homo Sapiens
gaagccuuccccauagagacuacaaaucacagcugauagacagcagauuuaaagauuuuauuuu

SEQ ID NO: 49653 - RNA, 64 nt, Homo Sapiens
uucagcuagccacauauuguucuaaaugcuacgugauagacaaucuagcaugaggcuuuuuaua

SEQ ID NO: 49654 - RNA, 64 nt, Homo Sapiens
ugagguaaguuuuuugaaauaguacaugauaaaugauagacaauuauuuaggaaguugacuuau

SEQ ID NO: 49655 - RNA, 64 nt, Homo Sapiens
guucucgcaaucuguauaaaugcauuuuagaacugauagacaguaaacuugaauuuaucuuuga

SEQ ID NO: 49656 - RNA, 64 nt, Homo Sapiens
acuggauccagaacacaauuuuccccucagaacagauagacagacugaagccacugaacucugc

SEQ ID NO: 49657 - RNA, 64 nt, Homo Sapiens
gcaagcccccagaggcugugucucuggacagacggauagacauacggaagcgaggccuggacca

SEQ ID NO: 49658 - RNA, 64 nt, Homo Sapiens
agcgggcaggcccgcacauaaaggaagaccugcggauagacaggcccuugaccagccaggccug

SEQ ID NO: 49659 - RNA, 64 nt, Homo Sapiens
uuuacaaagguuacuaauguauuuagcuguuacugauagacaccgacugaagacaaaguguuuc

SEQ ID NO: 49660 - RNA, 64 nt, Homo Sapiens
gaauggggagaagaaagaccuaggaggcagcggggauagacaggagauggaggccugcccagac

SEQ ID NO: 49661 - RNA, 64 nt, Homo Sapiens
aaacaugagugagucguguaguuacauaauuuuagauagacaaaaaaaagagacaaauuuaacu

SEQ ID NO: 49662 - RNA, 64 nt, Homo Sapiens
gaaagguuugguaacuuuggauucaaauaaaaaugauagacacauuucuaccuguugcaccgau

SEQ ID NO: 49663 - RNA, 64 nt, Homo Sapiens
ggcuaugggaggauuggacucgacuuugucuugggauagacaguggguacuaauuagcuuuuuu

SEQ ID NO: 49664 - RNA, 64 nt, Homo Sapiens
ucagcugggccucuaucuguaauaaagucguuccgauagacacggguggggcccaguguacuga

SEQ ID NO: 49665 - RNA, 64 nt, Homo Sapiens
uaaguguugccguaguaucauuuacaguguuuaagauagacacuuuuucuaucuuguuggauuu

SEQ ID NO: 49666 - RNA, 64 nt, Homo Sapiens
uaguucauauguucugaaaacuguuuuggagaaagauagacagaaaaaugucaucauauugaaa

SEQ ID NO: 49667 - RNA, 64 nt, Homo Sapiens
cgggggagagacgaaaaagaaaaggaaagagcaagauagacaaaagccaaucagcuuaaaaaga

SEQ ID NO: 49668 - RNA, 64 nt, Homo Sapiens
gcauagagagacagagagagagacaagaaacagagauagacagaaaauguucgggguggcaggc

SEQ ID NO: 49669 - RNA, 64 nt, Homo Sapiens
ucaaaugaauugguaaguguucuaaucuccuaaagauagacagcgacaaugcuggcaacugggc

SEQ ID NO: 49670 - RNA, 64 nt, Homo Sapiens
uuuuuagauggugcauucaaagccuagggguagagauagacacgggaugacugaagagcuaaga

SEQ ID NO: 49671 - RNA, 64 nt, Homo Sapiens
gcuaaaacugggcuacagaaagcaaccaauacaugauagacagguaaauaguuggccagaauua

SEQ ID NO: 49672 - RNA, 64 nt, Homo Sapiens
gccagaauuaagugagucaauugugccuaccucagauagacagucuaggaaaugggggugauaa

SEQ ID NO: 49673 - RNA, 64 nt, Homo Sapiens
aggggguagcaaaguguuacagaaaagcggacuggauagacaaaacugcagaagguguauguug

SEQ ID NO: 49674 - RNA, 64 nt, Homo Sapiens
cuccaagaaaagugaaguggaagagaauucgagggauagacagucguuauuuucuacauaggca

SEQ ID NO: 49675 - RNA, 64 nt, Homo Sapiens
ucuuuuuuuaaggaaucaaugaauaauaaauguagauagacaauuuucuucuggugagcugucu

SEQ ID NO: 49676 - RNA, 64 nt, Homo Sapiens
ucuugcagccuugccucauaacaguggaauuucugauagacaaaccacaggacuuugauuuuaa

SEQ ID NO: 49677 - RNA, 64 nt, Homo Sapiens
uauacacaccacacacacacaggcaguccuugaggauagacagaaugugggugccgcugagauc

SEQ ID NO: 49678 - RNA, 64 nt, Homo Sapiens
guggguccuuaaguuugguugugaauaaucucuugauagacaauuuauacccaugaaaguucag

SEQ ID NO: 49679 - RNA, 64 nt, Homo Sapiens
uuccucucugccaccuuccuucuuguccauaccugauagacacagagcacauuucuuucaucuc

SEQ ID NO: 49680 - RNA, 64 nt, Homo Sapiens
ugagggucaaggauaccaggggucccaagucacagauagacauuccaguuuguauucuuaggaa

SEQ ID NO: 49681 - RNA, 64 nt, Homo Sapiens
aagagagcuuagcagugauugaaacugugguacagauagacauggacgucacagucuaagaugg

SEQ ID NO: 49682 - RNA, 64 nt, Homo Sapiens
auaggagguuugaagcagaagucgucaaaacagcgauagacagcuuuuucuguugagcuaugca

SEQ ID NO: 49683 - RNA, 64 nt, Homo Sapiens
gcugcccugcgaaguggcuccauggucauggacagauagacagucagccgggcacccccaaccu

SEQ ID NO: 49684 - RNA, 64 nt, Homo Sapiens
accauacuacuggacuggacucaggcuggaggcagauagacacaguauagggggaaugggcuug

SEQ ID NO: 49685 - RNA, 64 nt, Homo Sapiens
uuuagggcagagacagaccacugacaaauacacagauagacaaggaauuucccaugguaaaaag

SEQ ID NO: 49686 - RNA, 64 nt, Homo Sapiens
gauuguuuuuaaauguuuuacuuuugguacaguugauagacaucauaaacgauaucaagcuuac

SEQ ID NO: 49687 - RNA, 64 nt, Homo Sapiens
ucuugucacugugauuggaugcuggaugccgccugauagacaugcuggccuggcugagaaaccc

SEQ ID NO: 49688 - RNA, 64 nt, Homo Sapiens
aaauugguuuaucuccuccauuuuuguauaacaugauagacauaacaaaucuauuauuucuaga

SEQ ID NO: 49689 - RNA, 64 nt, Homo Sapiens
uaagaugcagagggggaggggaagggaugguagagauagacagcucuccccuacuagguugggu

SEQ ID NO: 49690 - RNA, 64 nt, Homo Sapiens
uucuacuuagacguuaaacuaaaucauguuacaagauagacauacuguaauuuaugauuuuuca

SEQ ID NO: 49691 - RNA, 64 nt, Homo Sapiens
ccgcucuucauccagaaaaccaucauuuucuauggauagacaaugcuccccccuacaccuagcu

SEQ ID NO: 49692 - RNA, 64 nt, Homo Sapiens
aagagacagaagcuggggcugacacguggacagggauagacagaggacugguuggccaaacuca

SEQ ID NO: 49693 - RNA, 64 nt, Homo Sapiens
uuuggauuaaaauauucuaguacuaugaaaugaagauagacacaaucguaugauaugagauaca

SEQ ID NO: 49694 - RNA, 64 nt, Homo Sapiens
cugacagcuagguaucuagcuagcuagaaaggcagauagacagauauauagaugauagauagau

SEQ ID NO: 49695 - RNA, 64 nt, Homo Sapiens
ucagagggagccaggaaucuacauggguagaugagauagacacagaccugcuccccgcagccuu

SEQ ID NO: 49696 - RNA, 64 nt, Homo Sapiens
uuggggagacauauauuaaaauuuuagccaagaugauagacaugucucaauuauauaugugugu

SEQ ID NO: 49697 - RNA, 64 nt, Homo Sapiens
guuauaaaaacuuguaccauagggcuucaguagugauagacauuuccccuacagucaguuuaua

SEQ ID NO: 49698 - RNA, 64 nt, Homo Sapiens
caaacauaaauauuuacggauagauugcuagguagauagacacacacacaugcacacacacaca

SEQ ID NO: 49699 - RNA, 64 nt, Homo Sapiens
agaauuacucugacaaggagucccugucguucaugauagacacaaugaaauccacccucaaaga

SEQ ID NO: 49700 - RNA, 64 nt, Homo Sapiens
ugaagaggugaacacuugagugguuagagcuguagauagacauuguggggaagugugccagggu

SEQ ID NO: 49701 - RNA, 64 nt, Homo Sapiens
caaggccagaaagugaucacaaaaagaggcagaugauagacacugggguagggucauaccacag

SEQ ID NO: 49702 - RNA, 64 nt, Homo Sapiens
agcgaauaaauacaucacagcuuacuuuagcaaugauagacaaauaugaaguaccagguuuagu

SEQ ID NO: 49703 - RNA, 64 nt, Homo Sapiens
ggcauuaucccuuuaggaaguuucucugcagauagauagacacuuucucucucccugcuacccc

SEQ ID NO: 49704 - RNA, 64 nt, Homo Sapiens
aacuccugaccucaggugauccgcccaccucagccucccaaagugcugggaugacaggugugag

SEQ ID NO: 49705 - RNA, 64 nt, Homo Sapiens
aacuccugaccucaggugaucugcccgccucggucucccaaagugcugggauuacaggcaugag

SEQ ID NO: 49706 - RNA, 64 nt, Homo Sapiens
guaugguaggggguuugaagaauccccuguccaccucccaaauccaggcccggcccccucuggc

SEQ ID NO: 49707 - RNA, 64 nt, Homo Sapiens
caaucuccugaccucgugauccacccaccucgaccucccaaagugcugagauuacaggcgugag

SEQ ID NO: 49708 - RNA, 64 nt, Homo Sapiens
aacuccugaccucaagugaucugcccgccucggccucccaaagugcuggaaccacaggccugag

SEQ ID NO: 49709 - RNA, 64 nt, Homo Sapiens
ggaucucuuggccucaugaucagccugccucggccucccaaagugcugggauuacaggugugag

SEQ ID NO: 49710 - RNA, 64 nt, Homo Sapiens
cuccuccucuugcagggcauggggccaggcuccacucccaaaugagacuggcccccuccauggu

SEQ ID NO: 49711 - RNA, 64 nt, Homo Sapiens
aacuccugaccucaggugauccgccggccucacccucccaaagugcugggauuacaggcaugag

SEQ ID NO: 49712 - RNA, 64 nt, Homo Sapiens
cgauauccugaucucgugauccgccugccucugccucccaaagugcugggauuacaggugugac

SEQ ID NO: 49713 - RNA, 64 nt, Homo Sapiens
aacuccuaaccucgggugauccacccaccuuggccucccaaaguguuaggauuacaggcaugag

SEQ ID NO: 49714 - RNA, 64 nt, Homo Sapiens
ugaucucuugaccucgugauccguccaccucagccucccaaagugcugggauuacaggugugag

SEQ ID NO: 49715 - RNA, 64 nt, Homo Sapiens
gacuccugaccucaggucauccuccugccucggccucccaaagugcugagacuacaggugugag

SEQ ID NO: 49716 - RNA, 64 nt, Homo Sapiens
aacuccuggccucaggugauccucuugucucagccucccaaagugcugggauuacaggcaugag

SEQ ID NO: 49717 - RNA, 64 nt, Homo Sapiens
aacuccugaccucaaguaaucugcccaccucggccucccaaagugcuaggauuacaggagugag

SEQ ID NO: 49718 - RNA, 64 nt, Homo Sapiens
gccuccugggcucaagcaauccucccacuucagccucccaaauagcuggggcuaccaugguauu

SEQ ID NO: 49719 - RNA, 64 nt, Homo Sapiens
aacuccuggccucaugugaucugcccaccucagccucccaaaguacagggauuagaguugugag

SEQ ID NO: 49720 - RNA, 64 nt, Homo Sapiens
gcugggauuacuagacguaaccacccacuuugaccucccaaaguaacuucugaccucaggugau

SEQ ID NO: 49721 - RNA, 64 nt, Homo Sapiens
guggggauuacaggugcgagccuccugccucagccucccaaaguaacuccuggccucaaguggu

SEQ ID NO: 49722 - RNA, 64 nt, Homo Sapiens
gcugggauuacaggugugagccacccgccucagccucccaaaguaacuccuaaccucaagugau

SEQ ID NO: 49723 - RNA, 64 nt, Homo Sapiens
gcugggauuacaggugugagcgaccugccucggccucccaaaguaacuccugaccucagguaau

SEQ ID NO: 49724 - RNA, 64 nt, Homo Sapiens
gcugggauuacaggcgugagccacucgccuucaucucccaaaguaacuccugaccuuaggugau

SEQ ID NO: 49725 - RNA, 64 nt, Homo Sapiens
gcugggauuacaggcgugagcugccugccuuggccucccaaagucgaucucuugaccucgugau

SEQ ID NO: 49726 - RNA, 64 nt, Homo Sapiens
ccauuucugucacccuuuuugcugugcugcuucccucccaaacuaucacuccccacuucuuucu

SEQ ID NO: 49727 - RNA, 64 nt, Homo Sapiens
guucuaguucuagucuguugaucugccuuuuguucucccaaaauguacaguaauuccauuuguu

SEQ ID NO: 49728 - RNA, 64 nt, Homo Sapiens
aacuccugaccucaggugauccgccugccucggccucccaaagugcugggauuacaggcauaag

SEQ ID NO: 49729 - RNA, 64 nt, Homo Sapiens
aacuccuggccucaagcaauccucucuccucagccucccaaagugcugggauuacaagugugag

SEQ ID NO: 49730 - RNA, 64 nt, Homo Sapiens
aacuccuggguucaagcaauccucccaccucggccucccaaagugcugggauugcaggcaugag

SEQ ID NO: 49731 - RNA, 64 nt, Homo Sapiens
agguuguggaauuucuuucuucuccccuucuucccucccaaaagcuuagcuauguauaaagugc

SEQ ID NO: 49732 - RNA, 64 nt, Homo Sapiens
auuaugaucugacuggaaaacaauccuguauccccucccaaagaaucaugggcuuuuuuuuuga

SEQ ID NO: 49733 - RNA, 64 nt, Homo Sapiens
aaucuuuuuaagauuaaaaaugaauaccuuaaaucucccaaaagagauaaccaguaucugaagg

SEQ ID NO: 49734 - RNA, 64 nt, Homo Sapiens
aacuccugaccgcaagugauccacacgccuuggucucccaaagugcugggauuacgguguuagc

SEQ ID NO: 49735 - RNA, 64 nt, Homo Sapiens
cgaacuccugaccucaugagccgcccgccuuggccucccaaagugcugggacgugacaggagug

SEQ ID NO: 49736 - RNA, 64 nt, Homo Sapiens
acucucccacuucuguggucaacucccugcagaacucccaaacugccguucuuuucgauagcuc

SEQ ID NO: 49737 - RNA, 64 nt, Homo Sapiens
cuggccuggcugccuggccguggcuucucuuuggcucccaaagagaaggacaguguugggagua

SEQ ID NO: 49738 - RNA, 64 nt, Homo Sapiens
aguguugggaguaucugccguggcuucucuuuggcucccaaagagaaggacaguguugggagua

SEQ ID NO: 49739 - RNA, 64 nt, Homo Sapiens
ggugagauuacaggcaugagcccccugccuuggccucccaaacuaacuccugggcucaagugau

SEQ ID NO: 49740 - RNA, 64 nt, Homo Sapiens
acuggggccacaggugugcacccgcugccucagccucccaaauauggcucacugaagucuugac

SEQ ID NO: 49741 - RNA, 64 nt, Homo Sapiens
cgaucucuugaccuugggauccacccgccuuggccucccaaagugcugggauuacaggugugag

SEQ ID NO: 49742 - RNA, 64 nt, Homo Sapiens
aaacccuuggcucaagcaauuugccugccucagccucccaaagugcugggauuacaggcgugag

SEQ ID NO: 49743 - RNA, 64 nt, Homo Sapiens
aacuccugaccuccagugauccgccugccuugaccucccaaagugcugggauuacagacaugag

SEQ ID NO: 49744 - RNA, 64 nt, Homo Sapiens
acuccuggacuuaacgccauccaccugccacagccucccaaagugcuaggaauacaggagugca

SEQ ID NO: 49745 - RNA, 64 nt, Homo Sapiens
aacuccugagcucaagugauccucccgucucagccucccaaagggcugagauuacaggugugag

SEQ ID NO: 49746 - RNA, 64 nt, Homo Sapiens
aacuccugagcucaaaugauccuccugccuuggccucccaaagugcuggaauuacaggcaugag

SEQ ID NO: 49747 - RNA, 64 nt, Homo Sapiens
aacuccuggacucaagggauccuccugucuugggcucccaaaguguugggauuacaggcgugag

SEQ ID NO: 49748 - RNA, 64 nt, Homo Sapiens
gaacuccuggccuaggugauccacccgccucgaccucccaaagugcugggauuacaggcaugag

SEQ ID NO: 49749 - RNA, 64 nt, Homo Sapiens
caaacuccugacuuugugauccacccgccucggccucccaaagugcugggauuacaggcaugag

SEQ ID NO: 49750 - RNA, 64 nt, Homo Sapiens
gcugggauuacaggugugagccacccgccucggccucccaaaaucgaucuccugacgucgugau

SEQ ID NO: 49751 - RNA, 64 nt, Homo Sapiens
gcugggauuacaggcgugagccacccaccucugccucccaaaguaacuccugggcucaagcaau

SEQ ID NO: 49752 - RNA, 64 nt, Homo Sapiens
gcugggauuacagaugugagccuccugccucggccucccaaaguaccuccugggcucaagcaau

SEQ ID NO: 49753 - RNA, 64 nt, Homo Sapiens
gcugggaucacuggcacaaaucucccaccucagccucccaaauagccuccugggcucaagcaau

SEQ ID NO: 49754 - RNA, 64 nt, Homo Sapiens
aacuccugaccucaagugauccaccugccucagccucccaaagugcugggauuauagucgugag

SEQ ID NO: 49755 - RNA, 64 nt, Homo Sapiens
ugaucucuugaccucgugaucugccugccucggccucccaaagugcuggcauuacaggcaugag

SEQ ID NO: 49756 - RNA, 64 nt, Homo Sapiens
cucccagccaucuguauaaacacaauccuuuguucucccaaaucugaaucgaauuacucuuuug

SEQ ID NO: 49757 - RNA, 64 nt, Homo Sapiens
aacuccugaccucagguaauccgccugccuuggccucccaaagugcugggauuacagacaugaa

SEQ ID NO: 49758 - RNA, 64 nt, Homo Sapiens
aacuccugggcucaagugauccuccugccuuggccucccaaaaugcugggauuacaggcaugag

SEQ ID NO: 49759 - RNA, 64 nt, Homo Sapiens
aacuccugaccucaggugauccacccgccucagccucccaaagugcugggauuacaggcaaaag

SEQ ID NO: 49760 - RNA, 64 nt, Homo Sapiens
cgaacuccugaccuugugaugcucccaccucggccucccaaagugcugggauuaaagcugugag

SEQ ID NO: 49761 - RNA, 64 nt, Homo Sapiens
cgaucuccugaccucaugauccucccgccucagccucccaaaaugcugggauuacaggcgugag

SEQ ID NO: 49762 - RNA, 64 nt, Homo Sapiens
uaaacucuugaccucauguuccacccgccacggccucccaaagugcugugauuaccggugugag

SEQ ID NO: 49763 - RNA, 64 nt, Homo Sapiens
aacuucugagcucaagagaugcacuccccucagccucccaaagugcugggauuacaggcggcca

SEQ ID NO: 49764 - RNA, 64 nt, Homo Sapiens
gcugggauuacagggacgagccucucaucuuggccucccaaagugacuccugguuucaagugau

SEQ ID NO: 49765 - RNA, 64 nt, Homo Sapiens
gcuaggauuacaggcgugaguccgccgccucggccucccaaaguucucgaacucgaccucguga

SEQ ID NO: 49766 - RNA, 64 nt, Homo Sapiens
gcugggacuacaggcaugagcuuccuaucucagccucccaaaguaacuccuggucucgagugau

SEQ ID NO: 49767 - RNA, 64 nt, Homo Sapiens
gcuggauuacaggcgugagccuuccggccucagccucccaaaguaacuccugaccucaagugau

SEQ ID NO: 49768 - RNA, 64 nt, Homo Sapiens
cuuguugggguguaguguuugcaaaauaauuuggcucccaaacuguuuguguucuuaaggguuu

SEQ ID NO: 49769 - RNA, 64 nt, Homo Sapiens
gcugggauuacaggcgugagucaccugccucggccucccaaaguaacuccugaccucaagugau

SEQ ID NO: 49770 - RNA, 64 nt, Homo Sapiens
gcugggauuacaggugugagccacccaccucagccucccaaaguacuuccugaccucagguuau

SEQ ID NO: 49771 - RNA, 64 nt, Homo Sapiens
gcugggauuacaggcgugagccacccgccuuggccucccaaagucaaucuccugaccucgugau

SEQ ID NO: 49772 - RNA, 64 nt, Homo Sapiens
gcugagauuacaagugugagccacuugccucggccucccaaaguaacuccugaccucaggugau

SEQ ID NO: 49773 - RNA, 64 nt, Homo Sapiens
gcugggaucacaggcgugagccacccaccccggccucccaaaauaacucccgaccucaggugau

SEQ ID NO: 49774 - RNA, 64 nt, Homo Sapiens
aauuccugaccucaagugauccaccugccuuagccucccaaagugcugggauuacaggcaugag

SEQ ID NO: 49775 - RNA, 64 nt, Homo Sapiens
cgaucucuugaccuuguguuccacccgccuuggccucccaaagugcuggaauuacaggcaugag

SEQ ID NO: 49776 - RNA, 64 nt, Homo Sapiens
gcuaggauuacaggcauaagccgccuaccucagccucccaaaguaacuccuggccucaagcgau

SEQ ID NO: 49777 - RNA, 64 nt, Homo Sapiens
gcugggauuacaggcuugagccacccgccucggccucccaaagucgaucuccugaccucgugau

SEQ ID NO: 49778 - RNA, 64 nt, Homo Sapiens
gcugggauuacaggcgugagcugcccgccucggccucccaaagucgaucuccugaccuugugau

SEQ ID NO: 49779 - RNA, 64 nt, Homo Sapiens
auugggauuacccgcgugagccgcccgccucggccucccaaagucgaucuccuaaccuggugau

SEQ ID NO: 49780 - RNA, 64 nt, Homo Sapiens
gcugggauuacaggcgugagcugcccaccucagccucccaaaguaauuccugaccucaggugau

SEQ ID NO: 49781 - RNA, 64 nt, Homo Sapiens
gcugggauuacaggcgugagcagcccgccucggccucccaaaguaacuccugaccacagguaau

SEQ ID NO: 49782 - RNA, 64 nt, Homo Sapiens
gcugggauuacaggcuugagccaccugccucagccucccaaaauucuugaacugaccucaugau

SEQ ID NO: 49783 - RNA, 64 nt, Homo Sapiens
gcugugauuacaggugugagccacccgccucgaccucccaaagucgaucucuugaccucaugau

SEQ ID NO: 49784 - RNA, 64 nt, Homo Sapiens
guuguagaauccgauagauguuguuagccugacacucccaaacaucaaugcccaguuuugacuu

SEQ ID NO: 49785 - RNA, 64 nt, Homo Sapiens
gcugggauuacaggcgugagccuucugccuuggccucccaaaguaacuccugaccucagguggu

SEQ ID NO: 49786 - RNA, 64 nt, Homo Sapiens
gcugggauuacaggagugagcugcccgccucagccucccaaagucgaucuccugaccucgugau

SEQ ID NO: 49787 - RNA, 64 nt, Homo Sapiens
uuuuuuuuauuuugagcaauucuccugccucagccucccaaauagcugggauuacaggugcaug

SEQ ID NO: 49788 - RNA, 64 nt, Homo Sapiens
aacuccugaccucagaugauccgccugccuuggccucccaaagugcugggauuacagguguggg

SEQ ID NO: 49789 - RNA, 64 nt, Homo Sapiens
aacuccugaccucaggugauacacccaucucggccucccaaagugcugggauuacaggcuugag

SEQ ID NO: 49790 - RNA, 64 nt, Homo Sapiens
acaggcuggccucaagugauccucuuaccuuggccucccaaacaccgggauuauaggcgugagc

SEQ ID NO: 49791 - RNA, 64 nt, Homo Sapiens
ccuuagaguagggacacugggcucucccaagucucucccaaauaggugagacaguccacccaga

SEQ ID NO: 49792 - RNA, 64 nt, Homo Sapiens
gcugggauuacagaugugagcugcccaccucggccucccaaaguaacucuugaccucaggugau

SEQ ID NO: 49793 - RNA, 64 nt, Homo Sapiens
gcugggauuacaggcgugagcuaccugccucggccucccaaaguaacucccgacgucaggugau

SEQ ID NO: 49794 - RNA, 64 nt, Homo Sapiens
ucuaggauuacaggugugagccacccaccuuggccucccaaaguuggacuccugaccucgugau

SEQ ID NO: 49795 - RNA, 64 nt, Homo Sapiens
ccuuauuuuuaaaauacuuuggucagaucuuggccucccaaaccaggaguccuucuacagaaua

SEQ ID NO: 49796 - RNA, 64 nt, Homo Sapiens
gcuaggauuacagguaugagcugcccgccuuggccucccaaaguaacuccugagcucaggcaau

SEQ ID NO: 49797 - RNA, 64 nt, Homo Sapiens
uccugggcuccagggauccacagucccccuuggccucccaaaguguugggauuacaugcaugag

SEQ ID NO: 49798 - RNA, 64 nt, Homo Sapiens
ugaacuccugagcucaugauccacccgccucagccucccaaagugcugggauuacaggccccuu

SEQ ID NO: 49799 - RNA, 64 nt, Homo Sapiens
gcugggauuacaggugugagccacucaccucggccucccaaaguaacuccugaccucaagugau

SEQ ID NO: 49800 - RNA, 64 nt, Homo Sapiens
gcugggauuacaggcaugaagugcccaacucggccucccaaaguaaccccuaggcucaaaugau

SEQ ID NO: 49801 - RNA, 64 nt, Homo Sapiens
aauaaaacauaauucuugucauaccgccuauguacucccaaaugaagauagcaccauuguuuaa

SEQ ID NO: 49802 - RNA, 64 nt, Homo Sapiens
gcugggauuacaggcgugagccgccugccuuggccucccaaagucaaucuccugaccuugugau

SEQ ID NO: 49803 - RNA, 64 nt, Homo Sapiens
gcugagauuacaggugugagccgcccgccucagccucccaaaguaacuccugaccucaggugau

SEQ ID NO: 49804 - RNA, 64 nt, Homo Sapiens
gcugugauuacaggcgugcaucuccugccucagccucccaaauaaccuccuggguuccagcgau

SEQ ID NO: 49805 - RNA, 64 nt, Homo Sapiens
agauucauggauagucagacggccauuuuucuuucucccaaagauucagaaacauuauacauug

SEQ ID NO: 49806 - RNA, 64 nt, Homo Sapiens
gcccaugugucuacaucaucgaaaaaaauaucagcucccaaaggccaacaggcagagcaggguu

SEQ ID NO: 49807 - RNA, 64 nt, Homo Sapiens
gcugggauuaaaggugugauccgccugucucggccucccaaaguaacuccugaccucaggugau

SEQ ID NO: 49808 - RNA, 64 nt, Homo Sapiens
aauugaaauauuucuuuuuucaugacucuucaaacucccaaaacugcuuaucuuguggucugaa

SEQ ID NO: 49809 - RNA, 64 nt, Homo Sapiens
gcugggauuacaggcgugagcuacccgccucggccucccaaagucgaucuccugaccucaugau

SEQ ID NO: 49810 - RNA, 64 nt, Homo Sapiens
gcugggauuacaggcaugagccaccugccucagccucccaaaguaauuccuggccucaggugau

SEQ ID NO: 49811 - RNA, 64 nt, Homo Sapiens
gcuaggauuacuggcgugagcugcccaccucggccucccaaaguucucaaucugaccuugugau

SEQ ID NO: 49812 - RNA, 64 nt, Homo Sapiens
ugcugggauuauaggcgugaccgcccgccuuggccucccaaaagugaucuccugaccucgugau

SEQ ID NO: 49813 - RNA, 64 nt, Homo Sapiens
aaugcccaaacuugguuggagcauagccccugcucucccaaaguugcacuuucacugggaagau

SEQ ID NO: 49814 - RNA, 64 nt, Homo Sapiens
aacuccugaccucaggugauccaccugccucagccucccaaagugcugggauuacaggcgugag

SEQ ID NO: 49815 - RNA, 64 nt, Homo Sapiens
caaacuucugaccucauaauccacccaccuuggccucccaaagugcuaggauuacaggcaugag

SEQ ID NO: 49816 - RNA, 64 nt, Homo Sapiens
gcuggaauuacuggcgugagucgcccgccucggccucccaaagucgaucuccugaccucgugau

SEQ ID NO: 49817 - RNA, 64 nt, Homo Sapiens
auuaggauuauaggcgugaggcuuccaccucagccucccaaagccugcagccugaaacuccuug

SEQ ID NO: 49818 - RNA, 64 nt, Homo Sapiens
cgaacuccugaccuugugaucugcccgccucagccucccaaaguacugggauuauaggcaugag

SEQ ID NO: 49819 - RNA, 64 nt, Homo Sapiens
caaucuccugaccucgugaaucgccccccucggucucccaaagugcugggauuacaggcgugag

SEQ ID NO: 49820 - RNA, 64 nt, Homo Sapiens
caaacuccuaaccucgugauccgccugccucgaccucccaaagugcugggauuacaggcaugag

SEQ ID NO: 49821 - RNA, 64 nt, Homo Sapiens
aaauugggcagcuaaauuuuucaguuccaugugccucccaaauaaaaaacagaaaauaaguagu

SEQ ID NO: 49822 - RNA, 64 nt, Homo Sapiens
cgaucucuugaccucaugaucuacccgccuuggccucccaaagugcugagauuacaggcgugag

SEQ ID NO: 49823 - RNA, 64 nt, Homo Sapiens
aacucuuggccucaaguaauccuccugccucagccucccaaaguguugggauugcagauaugag

SEQ ID NO: 49824 - RNA, 64 nt, Homo Sapiens
gcuuggauuacagguguaagccgccugccucggccucccaaaguuugaucuccugacuugugau

SEQ ID NO: 49825 - RNA, 64 nt, Homo Sapiens
ggugggaucacaggcgugagccgccugccuuggccucccaaaguagcuccugaccucaggugau

SEQ ID NO: 49826 - RNA, 64 nt, Homo Sapiens
aacuucugaccucagaugaucugcccgccucagccucccaaagugcugggauuacaggcaugag

SEQ ID NO: 49827 - RNA, 64 nt, Homo Sapiens
aacucccgaccucagguaauccgcccgccucggccucccaaaaugcugggauuagaggugugag

SEQ ID NO: 49828 - RNA, 64 nt, Homo Sapiens
aacuccugaccucaagcgauccacccaccuaggccucccaaagugcugggauuacaggcaugaa

SEQ ID NO: 49829 - RNA, 64 nt, Homo Sapiens
aacucccgaccucaggugauccgcccgccugggccucccaaagugcugggauuacaggcgugag

SEQ ID NO: 49830 - RNA, 64 nt, Homo Sapiens
aauggaccaaccacuuucguuuuaaagauuauagcucccaaaagaguuuuacccauaaguaaua

SEQ ID NO: 49831 - RNA, 64 nt, Homo Sapiens
aggugagcuauagugaagaaacagccuugauuuccucccaaaguagguaccauggccauucagc

SEQ ID NO: 49832 - RNA, 64 nt, Homo Sapiens
cuaccaacuccaccuccacccccucauuccccuucucccaaaguacuacugcuguugcaugaca

SEQ ID NO: 49833 - RNA, 64 nt, Homo Sapiens
cgaacuccugaccucgugauccgccugccucagccucccaaagugcugggauuacaggugugag

SEQ ID NO: 49834 - RNA, 64 nt, Homo Sapiens
aacuccugaccucaggugauccuccugccucggccucccaaagugcugggauuacaggcaugag

SEQ ID NO: 49835 - RNA, 64 nt, Homo Sapiens
aacucuugaccucaggugauccacccaccucagccucccaaagugcugggauuacaagcgugag

SEQ ID NO: 49836 - RNA, 64 nt, Homo Sapiens
aacuccuggccucaagugauucuccugccucagccucccaaagugcugggauuacaggugugaa

SEQ ID NO: 49837 - RNA, 64 nt, Homo Sapiens
aacuccuguccucagguaauccgcccaccucagccucccaaagugcugggauuacaggcgugag

SEQ ID NO: 49838 - RNA, 64 nt, Homo Sapiens
aacuccugaccucaagugauccaccuuccuugugcucccaaagugcugagauuacaggcgugag

SEQ ID NO: 49839 - RNA, 64 nt, Homo Sapiens
aacuccugggcucaagcgauccuccuggcucagccucccaaagugcugggauuacaggcgugag

SEQ ID NO: 49840 - RNA, 64 nt, Homo Sapiens
gcagggauuacaggcaugaggcacccaccucagccucccaaaguaacuccugaccucaggugau

SEQ ID NO: 49841 - RNA, 64 nt, Homo Sapiens
gcugggauuacaggcaugagccacccgccucagccucccaaaguaacuccugaccucaggugau

SEQ ID NO: 49842 - RNA, 64 nt, Homo Sapiens
gcuggaauuacaggugugagccacccgccuuggccucccaaaguaaugccugaccucaggugau

SEQ ID NO: 49843 - RNA, 64 nt, Homo Sapiens
gcugggacuacaggugcaugccuccugccuuggccucccaaaguaacuccuagccuugauugau

SEQ ID NO: 49844 - RNA, 64 nt, Homo Sapiens
ccaucucuugaccuugugauccacccaccucagccucccaaagugcugggauuacaggcaugag

SEQ ID NO: 49845 - RNA, 64 nt, Homo Sapiens
aacuccugaccuaaagugaucugcccgccuuggccucccaaagugcugggauuacagacaugag

SEQ ID NO: 49846 - RNA, 64 nt, Homo Sapiens
ucucccgcucuccaggagcuuaucuucgccccaucucccaaauaagugggcccuugugcuguga

SEQ ID NO: 49847 - RNA, 64 nt, Homo Sapiens
aauuccugagcucaagcaaccugccggccucggccucccaaaguacugggauuacacgcagaag

SEQ ID NO: 49848 - RNA, 64 nt, Homo Sapiens
gcugggauuacaggugugagcugcccgccuuggccucccaaaguaacucuugaccucaggugau

SEQ ID NO: 49849 - RNA, 64 nt, Homo Sapiens
gcugggauuacaggugugagccgcccaccucggccucccaaaguaacuccugaccucaggugau

SEQ ID NO: 49850 - RNA, 64 nt, Homo Sapiens
gcuaggauuacaggcgugagccaccugccucggccucccaaaguaacuccugaccucaggugau

SEQ ID NO: 49851 - RNA, 64 nt, Homo Sapiens
gcugggauuacacgcgugagccgcccaccuuggccucccaaaguaacuccugaccucaggugau

SEQ ID NO: 49852 - RNA, 64 nt, Homo Sapiens
gccucccguguucaagcaguucuccugccucagccucccaaauagcugggauuacaguugccug

SEQ ID NO: 49853 - RNA, 64 nt, Homo Sapiens
aacuccugaccucaagugauccacccgccuuggccucccaaagugcugggauaauaggugucag

SEQ ID NO: 49854 - RNA, 64 nt, Homo Sapiens
gcugggauuacaggcgugagccaccagccucagccucccaaaguugaucuccugaccuugugau

SEQ ID NO: 49855 - RNA, 64 nt, Homo Sapiens
gcuggaaucacaggggugagccuccauccucggccucccaaaguaacuccuggccuccagugau

SEQ ID NO: 49856 - RNA, 64 nt, Homo Sapiens
gcugggauuacaggccugagucgcccgccgcguccucccaaagucgaucucuugaccucgugau

SEQ ID NO: 49857 - RNA, 64 nt, Homo Sapiens
ugcugggauuacaggugugacugcccgccucggccucccaaaauaacucccgaccucagaugau

SEQ ID NO: 49858 - RNA, 64 nt, Homo Sapiens
gcugggauuacaggugugagcugcccgccuuggccucccaaaguccaucuccugaguuugugau

SEQ ID NO: 49859 - RNA, 64 nt, Homo Sapiens
gcuaggauuccaggcgugagccgcccgccuuggccucccaaaguccugaccucaggugauccac

SEQ ID NO: 49860 - RNA, 64 nt, Homo Sapiens
gcugggauuauaggcgugagccgcccuccucggccucccaaaguugaucuccugaccucgugau

SEQ ID NO: 49861 - RNA, 64 nt, Homo Sapiens
gcugggauuacaggcgugagccaccugccuuggccucccaaaguaacuccugaccucagguaau

SEQ ID NO: 49862 - RNA, 64 nt, Homo Sapiens
guucguuuuacuuuuuuuuuccacccaccuuggccucccaaauuaacucuugaccucaaaugau

SEQ ID NO: 49863 - RNA, 64 nt, Homo Sapiens
gcugggauuacaggugugagcugccugccucggccucccaaaguaacuccugaccucaggugau

SEQ ID NO: 49864 - RNA, 64 nt, Homo Sapiens
gcuaggauuacaggcgugagccacccaucuccaccucccaaaguaacuccugggcucaagugau

SEQ ID NO: 49865 - RNA, 64 nt, Homo Sapiens
guugggauuauaggcgugagccaccugccuuggccucccaaaguaacuccugaccucaagugau

SEQ ID NO: 49866 - RNA, 64 nt, Homo Sapiens
gcugggauuacaggcaugagccacccaccucagccucccaaaguaaauccugaccucaaaugau

SEQ ID NO: 49867 - RNA, 64 nt, Homo Sapiens
gcugggacuacaaggugcccucuccuaccucagccucccaaauagcccccugggaucaagcgau

SEQ ID NO: 49868 - RNA, 64 nt, Homo Sapiens
gcugggauuacaggcaugagcccccugccucggccucccaaagucgauuuccugaccuugugau

SEQ ID NO: 49869 - RNA, 64 nt, Homo Sapiens
gcugggauuacaggcaugagccacccgccucagccucccaaaguaacucccgaccucaggugau

SEQ ID NO: 49870 - RNA, 64 nt, Homo Sapiens
ugccagagauggcugugccgugucggagaugaaacucccaaaggagagguacagcugcugaaag

SEQ ID NO: 49871 - RNA, 64 nt, Homo Sapiens
ugccagagauggcugugccgugucagagaugaaacucccaaaggagagguagagcugcccaaag

SEQ ID NO: 49872 - RNA, 64 nt, Homo Sapiens
ugccagagauggcugugccgugucagagaugaaacucccaaaggagagguggagcuccccaagg

SEQ ID NO: 49873 - RNA, 64 nt, Homo Sapiens
gcugggauuacaggggugagccacccgccucagccucccaaaguaacuccugagcucaagugau

SEQ ID NO: 49874 - RNA, 64 nt, Homo Sapiens
guugggauuacaggugugagccucccgccucagccucccaaaguaacucuugggcucaagugau

SEQ ID NO: 49875 - RNA, 64 nt, Homo Sapiens
uaaauggcuacugugcauucuauucaagaacauucucccaaaucgauauuuauuuaaccuugaa

SEQ ID NO: 49876 - RNA, 64 nt, Homo Sapiens
ggguggcuuaccagaccaccagccagccugggaccucccaaaguaucguggguucccugagccc

SEQ ID NO: 49877 - RNA, 64 nt, Homo Sapiens
gcuaggauuacaggcaugaguugccugccugggccucccaaagucgaacuccugaccucgugau

SEQ ID NO: 49878 - RNA, 64 nt, Homo Sapiens
gcugggauuacaggugugagcugcccgccucggccucccaaaguugaucuccugagcucgugau

SEQ ID NO: 49879 - RNA, 64 nt, Homo Sapiens
gcugggauuauaggcaugagccuccugcuuuggccucccaaaauaaauccugggcucaagugau

SEQ ID NO: 49880 - RNA, 64 nt, Homo Sapiens
gcugggacuacaggcacaggucucaugccucagccucccaaauaucuuccucucucgcccaagu

SEQ ID NO: 49881 - RNA, 64 nt, Homo Sapiens
gcugagauuacaggugugagccuccugucuuggccucccaaaguaacuccuagacucaagugau

SEQ ID NO: 49882 - RNA, 64 nt, Homo Sapiens
gcugggauuacaggugugagccacccgccuuggccucccaaaguugaacuccugaccucgugac

SEQ ID NO: 49883 - RNA, 64 nt, Homo Sapiens
aacuccugaccucaggugauccgccuaucucagccucccaaagugcugggauuacaggcgugag

SEQ ID NO: 49884 - RNA, 64 nt, Homo Sapiens
cagggaggaaaagcagucaggccacacaccauugcucccaaaauggacuucucugcaagccuga

SEQ ID NO: 49885 - RNA, 64 nt, Homo Sapiens
ggaacacggaucuaaacucagguguguccaaguccucccaaaggacagcagugauggagaggac

SEQ ID NO: 49886 - RNA, 64 nt, Homo Sapiens
uuccucccagcugcccuccccuacuucucccuugcucccaaagcuuuccuuggagaagggcccu

SEQ ID NO: 49887 - RNA, 64 nt, Homo Sapiens
acugggauuacaggcgugagccacccgccucggccucccaaagccgaacaccugaccucguggu

SEQ ID NO: 49888 - RNA, 64 nt, Homo Sapiens
gcuggaauuacaggcauuagcacucgccccuuggcucccaaaguacucuugaccucaggugauc

SEQ ID NO: 49889 - RNA, 64 nt, Homo Sapiens
aacucuugaccucaagugauccacucgcuucggccucccaaagugcugggauuauaggcgugag

SEQ ID NO: 49890 - RNA, 64 nt, Homo Sapiens
cgaacuccugaccucaugauccuccugccucggccucccaaagugcugggauuauaggcaugaa

SEQ ID NO: 49891 - RNA, 64 nt, Homo Sapiens
gcugggauuacaggugugagucuccugccucagccucccaaagugccuccugacuucaagcaau

SEQ ID NO: 49892 - RNA, 64 nt, Homo Sapiens
gcuaggauuacaggcaugaaccacccgccucagccucccaaaguaacuccugaccucaguugau

SEQ ID NO: 49893 - RNA, 64 nt, Homo Sapiens
acugggauuacaggcgugagcugcccgccuuggccucccaaaguugaacuccugaccucgugau

SEQ ID NO: 49894 - RNA, 64 nt, Homo Sapiens
gggacccucccuauuccauccaagggaagcagaacugccaaagacucaagucuuuucauauuua

SEQ ID NO: 49895 - RNA, 64 nt, Homo Sapiens
gacccagugccaggagcuggaagacaagguguuucugccaaacggggaccuccauccagagaaa

SEQ ID NO: 49896 - RNA, 64 nt, Homo Sapiens
ccuucucauuuaaugcuuaucugcauaauguucacugccaaacuaggauaccuucaguuugaau

SEQ ID NO: 49897 - RNA, 64 nt, Homo Sapiens
uacuuagccccacaaaaauguucauuucucuccucugccaaaucauaauuaaaugaauuauuua

SEQ ID NO: 49898 - RNA, 64 nt, Homo Sapiens
gugggggcuguacuggggaccccuuacccuaccucugccaaaaauaggaggagggugcacauaa

SEQ ID NO: 49899 - RNA, 64 nt, Homo Sapiens
uggaccaaggcuaaccuuuccugugggccucauucugccaaagcguugugccuuauugucccau

SEQ ID NO: 49900 - RNA, 64 nt, Homo Sapiens
uaaaaaaaagcucauuuuaugauuuuuuuuuaaccugccaaaaaaugcuauauuuaaaaacacu

SEQ ID NO: 49901 - RNA, 64 nt, Homo Sapiens
ucaaacaguuaguaguauuugggagauuaacuuacugccaaauugauaagaaaacugaggcaag

SEQ ID NO: 49902 - RNA, 64 nt, Homo Sapiens
auaauaaagccaacuggaaaccccuaaacaacuucugccaaacauuguaggaagccacucuucu

SEQ ID NO: 49903 - RNA, 64 nt, Homo Sapiens
uuuuuaaagguuuuaggacuacuacuggauucaacugccaaaaucauuccuugaaucaaggagc

SEQ ID NO: 49904 - RNA, 64 nt, Homo Sapiens
cuccagaauugacuuagcccuaguaauaaaagcacugccaaaacaucucagagacuucuuuuau

SEQ ID NO: 49905 - RNA, 64 nt, Homo Sapiens
uaacuuaccuggcuuaauguaauuucacaguuaccugccaaacuacuagucacuuuacauccuc

SEQ ID NO: 49906 - RNA, 64 nt, Homo Sapiens
uucugguaaagaucaugguuaaguauaaucauuacugccaaacuggaauuuucaaguuauuaua

SEQ ID NO: 49907 - RNA, 64 nt, Homo Sapiens
uugguagaugcaaggucuaucucucccaucagggcugccaaagcugggcuuuguuuuucccagc

SEQ ID NO: 49908 - RNA, 64 nt, Homo Sapiens
aaacuaaccaucucggagcugggcuccucauuuacugccaaacccucagcuuauguagcuagaa

SEQ ID NO: 49909 - RNA, 64 nt, Homo Sapiens
auuaucuagaagcacaucaacaauucauucuuaucugccaaagaggauggugggucugggaccc

SEQ ID NO: 49910 - RNA, 64 nt, Homo Sapiens
uuuaaacacccaggagaccacccaaagggaugcucugccaaagggagacucagcuguugucaca

SEQ ID NO: 49911 - RNA, 64 nt, Homo Sapiens
cagugcaaagaaggaaggcugucuaccccaaagucugccaaaggaugcccuacacacccccaca

SEQ ID NO: 49912 - RNA, 64 nt, Homo Sapiens
caaaucuuuuaagaaaauuaugaaucacgguauucugccaaaacgaugaggauguuuuugucug

SEQ ID NO: 49913 - RNA, 64 nt, Homo Sapiens
caaguuacacagacuuccauacuuauuucaugcccugccaaauuaucaguuugcuguuuuuacc

SEQ ID NO: 49914 - RNA, 64 nt, Homo Sapiens
ccacacacccucuguggauagacauaguacaucucugccaaaaaacaagcuaagaugaaauucu

SEQ ID NO: 49915 - RNA, 64 nt, Homo Sapiens
agucacgcccucucugugccuccguuuucugcaucugccaaagggguuaaacacuucugcccca

SEQ ID NO: 49916 - RNA, 64 nt, Homo Sapiens
gucugauauguuggccccuucuauggaaacaacgcugccaaauccuggagcaaaaccugaagug

SEQ ID NO: 49917 - RNA, 64 nt, Homo Sapiens
guuauagagagcaauuugucaugucuccauugaucugccaaaucgaacaguaaaguuaaaacgg

SEQ ID NO: 49918 - RNA, 64 nt, Homo Sapiens
cuggaggaaccauugugcuguacaguaagaccaccugccaaaagugugucauuuauaacuucug

SEQ ID NO: 49919 - RNA, 64 nt, Homo Sapiens
aaaccuguucuuccuuuuuuucuauuuuacuuuucugccaaaauaagacaaauuuugcauauuc

SEQ ID NO: 49920 - RNA, 64 nt, Homo Sapiens
aaaacaauacaucaacaagagguuuauuuucauucugccaaaguugaacaaagacauuuauaug

SEQ ID NO: 49921 - RNA, 64 nt, Homo Sapiens
aaaaauuuacuauuuccuuugcacaguuuaucuucugccaaaauaaauugaggcauuuuaaucu

SEQ ID NO: 49922 - RNA, 52 nt, Homo Sapiens
auuucauugagaauuaugauaacugccaaagcgagacugugauaugucuuaa

SEQ ID NO: 49923 - RNA, 64 nt, Homo Sapiens
gcccaagguaaacaguuugaaaagacaaaugggccugccaaacuguacaguuucuuccccaaga

SEQ ID NO: 49924 - RNA, 64 nt, Homo Sapiens
gugcuuuucugguugagaucaugucauugaugaacugccaaagucaggggaggagggcagagac

SEQ ID NO: 49925 - RNA, 64 nt, Homo Sapiens
ggcccagcagagggcagcacuaaguugaagucgacugccaaagaaccuuacggcgcuaaugcau

SEQ ID NO: 49926 - RNA, 64 nt, Homo Sapiens
gaaaaucagcuuuucuaagaucaccggaaauaugcugccaaaaaaccaccuuucccaucaguuc

SEQ ID NO: 49927 - RNA, 64 nt, Homo Sapiens
auuggaauagcaaguuuaaaccuuuguuguccaucugccaaaugaacuagugauugucagacug

SEQ ID NO: 49928 - RNA, 64 nt, Homo Sapiens
ucuuaauuaucaucugcaaguuucaagaaguauucugccaaaaguauuuacaaguauggacuca

SEQ ID NO: 49929 - RNA, 64 nt, Homo Sapiens
cauuuuaauggagucaguuuccugugcugcuauccugccaaaauaugaauauggaauauccaau

SEQ ID NO: 49930 - RNA, 64 nt, Homo Sapiens
gaaauaucauuuauuuuuuagaaucagcuauuuacugccaaaggcagucuucaggcaaaacguc

SEQ ID NO: 49931 - RNA, 64 nt, Homo Sapiens
guucccuuucauacagaggguuuucuauggaucacugccaaacauugggaucaucuccucuguc

SEQ ID NO: 49932 - RNA, 64 nt, Homo Sapiens
uccagccugguuuccugggcugggcucaggaaagcugccaaauucaguccuauguuggguccaa

SEQ ID NO: 49933 - RNA, 64 nt, Homo Sapiens
cuaagaugaauccaaaugugaaagaugcauguuacugccaaaaccaaauugagcucagcuuccu

SEQ ID NO: 49934 - RNA, 64 nt, Homo Sapiens
uuucgcaaauguugcucuagucaguccagcucaucugccaaaauguagggcuaccgucuuggau

SEQ ID NO: 49935 - RNA, 64 nt, Homo Sapiens
cuguggucuccauccugacucuugaacuuacccacaauaagaauaaauucugccucaucuuugc

SEQ ID NO: 49936 - RNA, 64 nt, Homo Sapiens
gagugcacagccuauugaacuaccucauuuuugccaauaagagcuggcuuuucugccauagugu

SEQ ID NO: 49937 - RNA, 64 nt, Homo Sapiens
uagucauccaacaagaagaaauaugaaauuccagcaauaagaaaugaacaaaagauuggagcug

SEQ ID NO: 49938 - RNA, 64 nt, Homo Sapiens
cuccauccuguucgugucuuucugcaguuuucggcaauaagaaguagaagauuugcuguccugc

SEQ ID NO: 49939 - RNA, 64 nt, Homo Sapiens
gaauugacaauguuuaaguaaugguggaaucugucaauaagacuucccagaguguuaauauaua

SEQ ID NO: 49940 - RNA, 64 nt, Homo Sapiens
gguuuccauaugguaauuacauuggaaaguucugcaauaagauucuaguucucucuuuucuuua

SEQ ID NO: 49941 - RNA, 64 nt, Homo Sapiens
ccuuggggcuucucugaccacaugugcccaacuucaauaagagaaccaagggacccucauuuuc

SEQ ID NO: 49942 - RNA, 64 nt, Homo Sapiens
cugcauuaaaauggguuucacugugaaugcgugacaauaagauauucccuuguuccuaaaacuu

SEQ ID NO: 49943 - RNA, 64 nt, Homo Sapiens
cggucagacuggaggucgaagcaaucagcaaacacaauaagagucuccuucucuucucuucuuu

SEQ ID NO: 49944 - RNA, 64 nt, Homo Sapiens
uuuuuuucuuuuaaaauauuuaacaguucaaucucaauaagaccucgcauuauguaugaauguu

SEQ ID NO: 49945 - RNA, 64 nt, Homo Sapiens
ucuaccuggggaccccugucugcacaccagggaucaauaagagccaaagugggacaccuccuag

SEQ ID NO: 49946 - RNA, 64 nt, Homo Sapiens
aguugccaaagaagauguauuaugaacaauucagcaauaagacaauugucaacacaguugagaa

SEQ ID NO: 49947 - RNA, 64 nt, Homo Sapiens
guaguggaaaugagugaacuacagcuauaccucacaauaagaaugaaucucagaaaauauuaag

SEQ ID NO: 49948 - RNA, 64 nt, Homo Sapiens
guguuuuuccuuugaggggauaggggaaguaagccaauaagaaccuuuuaaacaaaucguccug

SEQ ID NO: 49949 - RNA, 64 nt, Homo Sapiens
gcagacagaaauuccagugauuucauaaucaaugcaauaagauucagccaaugauccuuccuuc

SEQ ID NO: 49950 - RNA, 64 nt, Homo Sapiens
uaaccaaagaugaagcugguuccuuacagagcugcaauaagaaaggagcuuugggaacagucug

SEQ ID NO: 49951 - RNA, 64 nt, Homo Sapiens
caauccacauuuacaaagauucaguucccuguuucaauaagaguuaaggcugcaauacaagcau

SEQ ID NO: 49952 - RNA, 64 nt, Homo Sapiens
auuuaagugugugcuaaacaccuuuccccucccacaauaagaccgggaaucugcaagaaccucc

SEQ ID NO: 49953 - RNA, 64 nt, Homo Sapiens
cuugccuaugaauaccccucugcagaacaaaggucaauaagaucgggguauccucugcaacacu

SEQ ID NO: 49954 - RNA, 64 nt, Homo Sapiens
agcccaaauaagcauccucagacaucgaaucaaccaauaagaagucugcauaagacaaagaaga

SEQ ID NO: 49955 - RNA, 64 nt, Homo Sapiens
agacaaaguccucgagauuccuuaguauucuacacaauaagaaagugcuguauggugaugcuuu

SEQ ID NO: 49956 - RNA, 64 nt, Homo Sapiens
uaguugaguuauuccacaaauaggguucuaaaugcaauaagauuauaaauuuuuugaccuauuu

SEQ ID NO: 49957 - RNA, 64 nt, Homo Sapiens
ggaggcauaguacauaguugccacauuaccauagcaauaagaaacaguaguuuuauuuccacag

SEQ ID NO: 49958 - RNA, 64 nt, Homo Sapiens
uuuuuuacugaggagcaacucauuccagcaucaacaauaagauaaccuuuaaguauggcacacu

SEQ ID NO: 49959 - RNA, 64 nt, Homo Sapiens
gaggguaguaggagcaguucacccugggagcagacaauaagaggaagaaugaagccaacuaaaa

SEQ ID NO: 49960 - RNA, 64 nt, Homo Sapiens
gcuaaugauguguucaguguaacucgcagauuggcaauaagauacccgcuacaaacugugauug

SEQ ID NO: 49961 - RNA, 64 nt, Homo Sapiens
gcacauaucccagcuguuuugccccuauuuauuucaauaagaacccuuagaccucaguucaagu

SEQ ID NO: 49962 - RNA, 64 nt, Homo Sapiens
ugcuuacuuuuuaauuuuuauggggaaaaauaaacaauaagacaaaaauagucauuuuuagcac

SEQ ID NO: 49963 - RNA, 64 nt, Homo Sapiens
aacagucuguacauguucacuguuuagggaauaacaauaagaaauaguuguuguuauacuguau

SEQ ID NO: 49964 - RNA, 64 nt, Homo Sapiens
gcaguggaacaguuaaguagcugguacgaauucucaauaagaauaaguuguuaccacauaggca

SEQ ID NO: 49965 - RNA, 64 nt, Homo Sapiens
gucugugacaauguauaugcccuuuacagauuugcaauaagaugaaccaagucaauaugaggua

SEQ ID NO: 49966 - RNA, 64 nt, Homo Sapiens
auauaccauuaauuuuuaggaugugguuauggagcaauaagaauaauauuguucgguuauguuc

SEQ ID NO: 49967 - RNA, 64 nt, Homo Sapiens
uuaggagccuaaaagcuauuggaaaaaaaauauucaauaagagauuuugaaaaguagcaauuau

SEQ ID NO: 49968 - RNA, 64 nt, Homo Sapiens
ucucauccaaaagugaccagcauaccaguucuugcaauaagauauuacccucagaauauuaagc

SEQ ID NO: 49969 - RNA, 64 nt, Homo Sapiens
caaaauucuuucugguuguuuuuaaacaauaaagcaauaagaacaaauacaauacauaggaagu

SEQ ID NO: 49970 - RNA, 64 nt, Homo Sapiens
auaauucuggagauacugguggaaguuccaaguccaauaagacacucaaauaugaguacaaaug

SEQ ID NO: 49971 - RNA, 64 nt, Homo Sapiens
cuaaggauuuaguuuaccacaacaauucugacuacaauaagacauuuugaggaggauauuuggc

SEQ ID NO: 49972 - RNA, 64 nt, Homo Sapiens
aucucaaguaaaacaaaugaaauuuaauuacaaacaauaagaacaaguuuuggcagccaugaua

SEQ ID NO: 49973 - RNA, 64 nt, Homo Sapiens
cuuggcuaguaauaaacacuuacugaagaagaagcaauaagagaaagauauuuguaaucucucc

SEQ ID NO: 49974 - RNA, 64 nt, Homo Sapiens
aaggaaccauuucuugaagaaacugaaguaauagcaauaagauuugaugugugaguagcuuuga

SEQ ID NO: 49975 - RNA, 64 nt, Homo Sapiens
aauggggccagcugggccgacagcagaauaaaggcaauaagaugauucucuugccccuucuuau

SEQ ID NO: 49976 - RNA, 64 nt, Homo Sapiens
auuagucgugcaugucugugagcuccucccuuuucaauaagauucuuguccuccugugugccug

SEQ ID NO: 49977 - RNA, 64 nt, Homo Sapiens
aauuuccucaaguuuccauguccuauaguccuagcaauaagagaauucaucuugaaucccauug

SEQ ID NO: 49978 - RNA, 64 nt, Homo Sapiens
acuuuuuaaaagacguauauuuacauuuuauguucaauaagaaccuuguuuccagaauguuauu

SEQ ID NO: 49979 - RNA, 64 nt, Homo Sapiens
uaagaaauaauuuuuuucaaucuauucuguuuaacaauaagaaauuguuguuguuacuguaaag

SEQ ID NO: 49980 - RNA, 64 nt, Homo Sapiens
ugugcccucaucauaaauauuacauaacagaaaucaauaagauaugcauguugucaucuucaau

SEQ ID NO: 49981 - RNA, 64 nt, Homo Sapiens
cuuaaaauguuuaaaaauaaauauuguuauauuucaauaagaagguacuguguauguguuuccu

SEQ ID NO: 49982 - RNA, 64 nt, Homo Sapiens
gucucuaauuugagcaguaagcuccaauagacagcaauaagauuugcugaugugccacgaugcu

SEQ ID NO: 49983 - RNA, 64 nt, Homo Sapiens
gccucucucuaucaacaccagcuuaucuaauuugcaauaagagagaauaugcuuuuacauuugg

SEQ ID NO: 49984 - RNA, 64 nt, Homo Sapiens
auguggaacaucuauagagauaaauagaaauuuucaauaagauguaguaacacugugauuuauc

SEQ ID NO: 49985 - RNA, 64 nt, Homo Sapiens
acucagaguagagaguaagaugucagcaaauagacaauaagaugucagcaaaagugccucaaau

SEQ ID NO: 49986 - RNA, 64 nt, Homo Sapiens
uugccuuacaguggaucauucuaguaggaaaggacaauaagauuuuuuaucaaaaugugucaug

SEQ ID NO: 49987 - RNA, 64 nt, Homo Sapiens
uauuucagauauguauguaaaacuguuuccugaacaauaagauguaugaacggagcagaaauaa

SEQ ID NO: 49988 - RNA, 64 nt, Homo Sapiens
gaauggcugacuguugccuuugcucuuauaaaaucaauaagagaacucuccucuuuuuuuaaaa

SEQ ID NO: 49989 - RNA, 64 nt, Homo Sapiens
augcuccuuuauauuauaaguaagggaauagaaucaauaagacaguuucugcccaaagucaugu

SEQ ID NO: 49990 - RNA, 64 nt, Homo Sapiens
aaaaucuacaucccuuaccaacacuucucauucacaauaagaauucgaugauuaaaauccuuca

SEQ ID NO: 49991 - RNA, 64 nt, Homo Sapiens
cacgugguaaaacacuugcgcucagcuucuccaacaauaagaaguuuuuaugacaggauguuug

SEQ ID NO: 49992 - RNA, 64 nt, Homo Sapiens
aaggaucgaaagggaccaagacaacugaacccaucaauaagaaaacugccucuuacaguaggaa

SEQ ID NO: 49993 - RNA, 64 nt, Homo Sapiens
auguaaagguuuuugucuauugauuguauaaaugcaauaagaaacaguuuugcuuauugugugu

SEQ ID NO: 49994 - RNA, 64 nt, Homo Sapiens
uuaaaaaggaggaaauaauuauaagcuucaaggacaauaagaugguuuuuaacuuccuccauac

SEQ ID NO: 49995 - RNA, 64 nt, Homo Sapiens
aguaaauaucaaacauuaaauauuagucuugugccaauaagagaguaauacaacccaucuaucu

SEQ ID NO: 49996 - RNA, 64 nt, Homo Sapiens
uuggaaagucagugaaacugucaaaauguuaucucaauaagauacuuauaugagaacuacaauc

SEQ ID NO: 49997 - RNA, 58 nt, Homo Sapiens
augugaaauuuaugcuauaacauuuuuacaauaagauguacaauuuauuaccuauaug

SEQ ID NO: 49998 - RNA, 50 nt, Homo Sapiens
aagccaaagccauugccuagcaauaagauuguugccguuaagaagaccuu

SEQ ID NO: 49999 - RNA, 64 nt, Homo Sapiens
auaauaagaaacuuauuucucauaucaacuuagucaauaagaaaauauauucuuucaaaggaac

SEQ ID NO: 50000 - RNA, 64 nt, Homo Sapiens
acaugcagcauuccaggaacuugauuguuaaauucaauaagaaauuugcuuuauuaaugaaacu

SEQ ID NO: 50001 - RNA, 64 nt, Homo Sapiens
uguagcucaaucagugucucuuuaacugcauaagcaauaagaucuuaauaaagucuucuaggcu

SEQ ID NO: 50002 - RNA, 64 nt, Homo Sapiens
gagccgagauugcaccauuguacuccagccugggcaauaagagcaaaacuccaucaaaauaaaa

SEQ ID NO: 50003 - RNA, 64 nt, Homo Sapiens
ugccuuccauucugugagauuugacagauggugacaauaagaaaaugagcugauuguaauuacu

SEQ ID NO: 50004 - RNA, 64 nt, Homo Sapiens
ucugauacuuaucuugggacuucaguuuuuccgucaauaagaugagggauuaggugagaucuga

SEQ ID NO: 50005 - RNA, 64 nt, Homo Sapiens
guuuguacagcuccaccuuuuagaggucuuacugcaauaagaaguaaugccugggggacgguaa

SEQ ID NO: 50006 - RNA, 64 nt, Homo Sapiens
cuggggagauguggucggauuagggagguagaaucaauaagacucagugaagaaucggaugugg

SEQ ID NO: 50007 - RNA, 64 nt, Homo Sapiens
auuugaggccggguguggugcaguugcucaagggcaauaagaaauacauguucggaaaaacuuu

SEQ ID NO: 50008 - RNA, 64 nt, Homo Sapiens
aaaacucugccucaaaaaaacacuccagccuaggcaauaagagcgagcugagaugacgccauug

SEQ ID NO: 50009 - RNA, 64 nt, Homo Sapiens
cauuuagaaauccuuaauguuuaugcuaaauacacaauaagauagauaauauuagcauggccac

SEQ ID NO: 50010 - RNA, 64 nt, Homo Sapiens
ggguuguuucaggauucucuccaauuuuaggagacaauaagacacagcaaacgcaggaccugua

SEQ ID NO: 50011 - RNA, 64 nt, Homo Sapiens
acuuaauucuaguucccgaccauuuucugcuaugcaauaagaauuaugcaaauaaaacugaccu

SEQ ID NO: 50012 - RNA, 64 nt, Homo Sapiens
aaccuagucuagagacaaugugaugacgugagaucaauaagaagaagcugcuguugcugcuuug

SEQ ID NO: 50013 - RNA, 64 nt, Homo Sapiens
ccagcccagugcagucccggcccagaguagagagcaauaagagcaguagguccuaucagugccc

SEQ ID NO: 50014 - RNA, 64 nt, Homo Sapiens
uucuuugucccccaguacccccagcccagccagccaauaagaggacacaaaugaggacacgugg

SEQ ID NO: 50015 - RNA, 64 nt, Homo Sapiens
aucuacaucuauccuacuuaugcagaaaaauaggcaauaagaacuucauuuuacaauuuaguuu

SEQ ID NO: 50016 - RNA, 64 nt, Homo Sapiens
uucuaugcauauauggauuagcuauaaaaaaugucaauaagauuguacaaggaaaauuagagaa

SEQ ID NO: 50017 - RNA, 64 nt, Homo Sapiens
auagugacuuagagacacuguguaucaguuuugccaauaagacuguggacuucaugauuguugu

SEQ ID NO: 50018 - RNA, 64 nt, Homo Sapiens
ugggguuccaggcaugguuuaggcccuguuccagcaauaagaaccaaucugcuguacaaucuga

SEQ ID NO: 50019 - RNA, 64 nt, Homo Sapiens
ccuuaaaaaaaaacaacuucauaaauaguaaauccaauaagaacaguauuugaucuacaauuua

SEQ ID NO: 50020 - RNA, 64 nt, Homo Sapiens
ggaagagucuggaucucugaauguuugagcggcacaauaagauaggcaccaugaaguagcggca

SEQ ID NO: 50021 - RNA, 64 nt, Homo Sapiens
cuuccuguguuuuuuggccugcugccaaaguucccaauaagaugacauagauaaaaacauguuu

SEQ ID NO: 50022 - RNA, 64 nt, Homo Sapiens
cccaaacacuaaaauauuucaccaagaccaaauucaauaagaagaaaaagauacaacucaucuu

SEQ ID NO: 50023 - RNA, 64 nt, Homo Sapiens
uauggcaaaaagcaaaaggaaguuuauuggaggacaauaagaguauggauaugauagauuacac

SEQ ID NO: 50024 - RNA, 64 nt, Homo Sapiens
ucaagauacaaaaaugaauggcuaugcauaauaacaauaagaauguauuccccaaacaaaucuu

SEQ ID NO: 50025 - RNA, 64 nt, Homo Sapiens
agcaucaauacaacggccggaguuucuguuuuugcaauaagaagauguugguauuuuauguagg

SEQ ID NO: 50026 - RNA, 64 nt, Homo Sapiens
aauucucacuuaacuaauuuuguaagccugagaucaauaagaaauguucaggagagaggaaaga

SEQ ID NO: 50027 - RNA, 64 nt, Homo Sapiens
cuuuguaaaguugaaauaagggaucuuuuuaaaucaauaagauggugaacuuuaucaauaguau

SEQ ID NO: 50028 - RNA, 64 nt, Homo Sapiens
caguuuaacagaaaaaugaaaguggcaguauugacaauaagaaaucuguuguaauaucaguuac

SEQ ID NO: 50029 - RNA, 64 nt, Homo Sapiens
auagcagaauuagccaauccuuuuuugccgcagccaauaagauaagacagcagcucuguguucu

SEQ ID NO: 50030 - RNA, 64 nt, Homo Sapiens
gguuuuauuucagguaagcaguuuauaugacuuccaauaagauuuguaaaucaugggcuugacc

SEQ ID NO: 50031 - RNA, 64 nt, Homo Sapiens
cagacccaauagcucuaauuuuaacauuucuacccaauaagaggcucuguuuuccacugaagcu

SEQ ID NO: 50032 - RNA, 64 nt, Homo Sapiens
caugaucaguacuauugugacauuaaaacaacaacaauaagaucuuccuaucuggaggguacag

SEQ ID NO: 50033 - RNA, 64 nt, Homo Sapiens
augaucccaaaauaugguaauacagugcuguacgcaauaagauguuugguuucguuuacuugcc

SEQ ID NO: 50034 - RNA, 64 nt, Homo Sapiens
aauagguaaagcuauaauuaaagcagcauaggaacaauaagaacuaguugauguaacauuguag

SEQ ID NO: 50035 - RNA, 64 nt, Homo Sapiens
uagcugcggauguaauuuuuacauuguaagcauucaauaagaacauguauacauugucccuuuu

SEQ ID NO: 50036 - RNA, 64 nt, Homo Sapiens
uguuucccucuuguggaugucaccaguggguauucaauaagaacugccacgaccagauaagaau

SEQ ID NO: 50037 - RNA, 64 nt, Homo Sapiens
uuaugguuucacuggcccuuuauauauguugaaacaauaagauuaaauguaaaaacagccuauu

SEQ ID NO: 50038 - RNA, 64 nt, Homo Sapiens
auugccugaauaaguuuagguaugguuucggguacaauaagaaagagauaaaauggaaugcuuu

SEQ ID NO: 50039 - RNA, 64 nt, Homo Sapiens
uucauguaauauuucugauuuuucagaauauuugcaauaagagucuggauuuuaaaaaacacau

SEQ ID NO: 50040 - RNA, 64 nt, Homo Sapiens
cauaccuuuaucuggaaaaugccuucucuccagacaauaagacaguucacaucuggagacauca

SEQ ID NO: 50041 - RNA, 64 nt, Homo Sapiens
caggugagggacaaagguggacugguucugucuacaauaagacaccacuggucuaccugauaug

SEQ ID NO: 50042 - RNA, 64 nt, Homo Sapiens
gagaaugggcaucuaaggcauaaaagaaccuagccaauaagauaaauuauuuuuuucuuuaaau

SEQ ID NO: 50043 - RNA, 64 nt, Homo Sapiens
uuaaggaaagaaacaaaccaugcccgguaaauaccaauaagaaaauagcaggcaccaaagcaag

SEQ ID NO: 50044 - RNA, 64 nt, Homo Sapiens
ugcacugugagaucuguguaugguguguuaauaacaauaagaaacuuagggaagcaggcugugg

SEQ ID NO: 50045 - RNA, 64 nt, Homo Sapiens
gccaaaacagcaauaugauaucucagauuuaguucaauaagaacagugaaacuuuugguucacu

SEQ ID NO: 50046 - RNA, 64 nt, Homo Sapiens
ccucuauuauuuucacuauuagccccagagaaaccaauaagaauagaaaagccaugcccacccc

SEQ ID NO: 50047 - RNA, 64 nt, Homo Sapiens
uuaauacccuuaugcaguugggaauggaaaagggcaauaagaaacuaagucugcaugggauaug

SEQ ID NO: 50048 - RNA, 64 nt, Homo Sapiens
uuuucaccucuuccugcuucgagaguaaaagcaacaauaagauugacuagcguuuuaagaacuu

SEQ ID NO: 50049 - RNA, 64 nt, Homo Sapiens
auagauccuaaaggauccucggcugagccaugugcaauaagaacuugguagaugucccuagacg

SEQ ID NO: 50050 - RNA, 64 nt, Homo Sapiens
guuuuaucuguacauuuuuuuguuaaagacccuacaauaagauucacuaaaugguagauuuuac

SEQ ID NO: 50051 - RNA, 64 nt, Homo Sapiens
gccccuagaaaccaccuggguucagccucucccacaauaagaguucuugcccuucauacccucu

SEQ ID NO: 50052 - RNA, 64 nt, Homo Sapiens
gauggaugauggacccuuuccuaaugagccuccucaauaagagagaaguucucauugugggaau

SEQ ID NO: 50053 - RNA, 64 nt, Homo Sapiens
caaaaacaauauggaagugccuuuugaugucuuacaauaagagaagaagccaauggaaaugaaa

SEQ ID NO: 50054 - RNA, 64 nt, Homo Sapiens
cuuucccugaugccgacgccccugcccccugcagcaauaagaugcucggauucacucugugacc

SEQ ID NO: 50055 - RNA, 64 nt, Homo Sapiens
cuguaacuagcauuuuuugaugccuuagauuccucaauaagauguacucaggucucccuacucc

SEQ ID NO: 50056 - RNA, 64 nt, Homo Sapiens
caucacagucacaugcuugaguggcucuuuuacccaauaagauaauccagcaauugugugguca

SEQ ID NO: 50057 - RNA, 64 nt, Homo Sapiens
ccagaaccuugcggcccagugcccccagguugagcaauaagaaaauguccuuacaacgccccug

SEQ ID NO: 50058 - RNA, 64 nt, Homo Sapiens
auaaaauaagaacauguauagaauaggauuucaacaauaagagauugccacucacuugagaaca

SEQ ID NO: 50059 - RNA, 64 nt, Homo Sapiens
uuuaaauacacaaucacuaacuucaguaacuauucaauaagacaugcuuauucuuauaaauuac

SEQ ID NO: 50060 - RNA, 64 nt, Homo Sapiens
uccauuuuacauguucacauuggacuuuaaccuacaauaagaaacaagaagcuuuuaaacuuuu

SEQ ID NO: 50061 - RNA, 64 nt, Homo Sapiens
ucaaacuacuaggguuacuucacaguaaaauauucaauaagaagguauaaauaaugagcguuaa

SEQ ID NO: 50062 - RNA, 64 nt, Homo Sapiens
caauucuuaacagucuuuucaggaaacuugauuucaauaagaccuucaggcugcacaacacaga

SEQ ID NO: 50063 - RNA, 64 nt, Homo Sapiens
uggugaauuguaauucuagucuuaccccaccccucaauaagauugccugccuucagguuuucuu

SEQ ID NO: 50064 - RNA, 64 nt, Homo Sapiens
ccuauuccccaccccauggccacagggcaucuggcaauaagacuaguauacauugaccucccgu

SEQ ID NO: 50065 - RNA, 64 nt, Homo Sapiens
uuagggagaaauguuguucagagagguuaaggugcaauaagaaugaguagaagauuugaugcug

SEQ ID NO: 50066 - RNA, 64 nt, Homo Sapiens
cucuaagcugacugaguugcucugacuaaauaagcaauaagaggucuaggcccagccaggcuuu

SEQ ID NO: 50067 - RNA, 64 nt, Homo Sapiens
ugcuagaaauauguuuauaaguuauuuugaaauacaauaagaacccaaguacauugauuuuaca

SEQ ID NO: 50068 - RNA, 64 nt, Homo Sapiens
agacacuuugugguggccuuaagccaaaaagaggcaauaagaaauaaccaguauuuuacuucaa

SEQ ID NO: 50069 - RNA, 64 nt, Homo Sapiens
gggguuccugggggcuuccacuugcaaauucaagcaauaagagggcgaggccagcgagggugug

SEQ ID NO: 50070 - RNA, 64 nt, Homo Sapiens
augucagaaguuccuaauucacaugugggagguacaauaagaacccaugcuuuuucaacacauu

SEQ ID NO: 50071 - RNA, 64 nt, Homo Sapiens
uucuauaauuguauauaugcccaugcuacauguacaauaagaacaaagucauaaaauguaucuu

SEQ ID NO: 50072 - RNA, 64 nt, Homo Sapiens
cacagcuccgagcuguaggauguugugguacuggcaauaagauaaugauauauucgggcaggac

SEQ ID NO: 50073 - RNA, 64 nt, Homo Sapiens
aauaguucucuaauuuuugaaaaaucgugccaagcaauaagauuuauguauauuuguuuaauaa

SEQ ID NO: 50074 - RNA, 64 nt, Homo Sapiens
gccuuugagccuacucuugauucaugcagagugccaauaagauaaaucaaccaaguuuuggggc

SEQ ID NO: 50075 - RNA, 64 nt, Homo Sapiens
ugauguugaauauuuaccuuaaaaaccuauacaacaauaagaggagugcgcccuucagcagcau

SEQ ID NO: 50076 - RNA, 64 nt, Homo Sapiens
aaauuuauuuugcuuaccacaauuauaaugagagcaauaagaacacauuuguagauuaagcugg

SEQ ID NO: 50077 - RNA, 64 nt, Homo Sapiens
gaagaauggaaauggaaaagcaaagucaacagcccaauaagaauggugcugaccaaaaaugucu

SEQ ID NO: 50078 - RNA, 64 nt, Homo Sapiens
gcucaucucauuuuuacuuuuugaccucggauaacaauaagagacccuugacaguugcagccuc

SEQ ID NO: 50079 - RNA, 64 nt, Homo Sapiens
uucauaagugaucuacuucaguuagucucuaugacaauaagaaaacuaaggcucagagaaaaag

SEQ ID NO: 50080 - RNA, 64 nt, Homo Sapiens
uuuugcuuaugauuuguaaaagccgucauggggucaauaagaaaauaggggugauggaggggga

SEQ ID NO: 50081 - RNA, 64 nt, Homo Sapiens
aacuuuuaguuaaugucuuacaaggaaaaagacacaauaagaagaguuuaauuuuuuuuuuuuu

SEQ ID NO: 50082 - RNA, 64 nt, Homo Sapiens
ccuagggcagcuuuaucaaaucucuuucagucuacaauaagauuguuuccaaagugcagcagug

SEQ ID NO: 50083 - RNA, 64 nt, Homo Sapiens
gcagcuguacaaaaugacuauauuuacuguaguccaauaagauaauugguguccuuuuaaaaaa

SEQ ID NO: 50084 - RNA, 64 nt, Homo Sapiens
ggugggcccacugcuuuggaggugaugggacuaucaauaagaacucuguucacgcaagcugcug

SEQ ID NO: 50085 - RNA, 64 nt, Homo Sapiens
uuuuguuggggguuaauuuuaugaaaauuaugcucaauaagaguuguauauuuaauauauuugc

SEQ ID NO: 50086 - RNA, 64 nt, Homo Sapiens
ucacccccaccccaccccuaaguagucaucaaugcaauaagauugcgccugagauacaaggccc

SEQ ID NO: 50087 - RNA, 64 nt, Homo Sapiens
uuaccacccgccugaauccugggauucuaguaugcaauaagagaugcccuguacugaugcaaaa

SEQ ID NO: 50088 - RNA, 64 nt, Homo Sapiens
agcagccaaugaaaacggccgccugaacccacagcaauaagaaugaaugaggaugccuugaaug

SEQ ID NO: 50089 - RNA, 64 nt, Homo Sapiens
acaguguuuuuauugcucgcccagacaccaugugcaauaagauugguguucguuuccaucaugu

SEQ ID NO: 50090 - RNA, 64 nt, Homo Sapiens
ucugcauuugggcugugacgucucccaccugccccaauaagaucugcucugucugcgacaccaa

SEQ ID NO: 50091 - RNA, 64 nt, Homo Sapiens
ugugcauagccuugugaaaaaguaucuuucuaugcaauaagaugaauuuuccucccagaauauu

SEQ ID NO: 50092 - RNA, 64 nt, Homo Sapiens
gaauauguuugugggagcucaugaaacaaacuuacaauaagaaaggauauggggaauccucuuu

SEQ ID NO: 50093 - RNA, 63 nt, Homo Sapiens
accucgugugccagcuucugagagccaagaggagcaauaagaaaaauuaagaaggugugcucc

SEQ ID NO: 50094 - RNA, 64 nt, Homo Sapiens
guuuggggauauuucagugucuaaauuuccgcagcaauaagaaugcucaggaacaguucaggag

SEQ ID NO: 50095 - RNA, 64 nt, Homo Sapiens
ugcacacacagguauuuuguuuuaauguuuugagcaauaagauauguguuuguauacagccuug

SEQ ID NO: 50096 - RNA, 64 nt, Homo Sapiens
guggacaucaugacgaggacagcggccccucggccaauaagacaugguggucucccccugcucg

SEQ ID NO: 50097 - RNA, 64 nt, Homo Sapiens
uguucaggggcucccuguuuucauuuauuugugacaauaagaugaccauuuagucuaaacuuag

SEQ ID NO: 50098 - RNA, 64 nt, Homo Sapiens
cagugaacauuuggaaccccuggcaaaagaauugcaauaagaagacuucauauucuaauggaug

SEQ ID NO: 50099 - RNA, 64 nt, Homo Sapiens
ugaaacugggauugacccaucaagaugcuuggcucaauaagaaaaccacguuaggagcaaccuu

SEQ ID NO: 50100 - RNA, 64 nt, Homo Sapiens
cuccauucauaacccagucucaaugcccucguaucaauaagaccgggguaagggggacaggaua

SEQ ID NO: 50101 - RNA, 64 nt, Homo Sapiens
uacuuuguguuggaucugaguuuaaaaugugaggcaauaagaauaagaucauuuauaauacugu

SEQ ID NO: 50102 - RNA, 64 nt, Homo Sapiens
auggauauggauauauaguaucucaucaaggcuucaauaagaagauucuccuuuuaagcuaaaa

SEQ ID NO: 50103 - RNA, 64 nt, Homo Sapiens
gagcugagaucuucccacugcacuccagccuggccaauaagaccugucuccagcaagacccugu

SEQ ID NO: 50104 - RNA, 64 nt, Homo Sapiens
uaugaccuuccuccauuuaacaguguugguuaugcaauaagacacccaauuuuucaugggaguu

SEQ ID NO: 50105 - RNA, 64 nt, Homo Sapiens
cccucaacaaauuacacauugagggaacauacuucaauaagaaccaucuaugcuggacucacag

SEQ ID NO: 50106 - RNA, 64 nt, Homo Sapiens
aaaucauauacugagguugcuaagaucuacaugacaauaagauauuuugggagagagauacguu

SEQ ID NO: 50107 - RNA, 64 nt, Homo Sapiens
guagaaugaguuaugaguuaggagcgucccaaaucaauaagaaguucaggcauggggggugggg

SEQ ID NO: 50108 - RNA, 64 nt, Homo Sapiens
caaaaucuuccaacuuuucaugaaaaauucuuuucaauaagaugcauuuguacagaaacauuuu

SEQ ID NO: 50109 - RNA, 64 nt, Homo Sapiens
guugucuccuagccuagaaaaccaguguuuggagcaauaagaugauuauuuuugcuugaaucuu

SEQ ID NO: 50110 - RNA, 64 nt, Homo Sapiens
gaaagugcacacacuucauggagggacuccuuuucaauaagaauuaggaagaugagaaaguaau

SEQ ID NO: 50111 - RNA, 64 nt, Homo Sapiens
cagaaaguccuggaaaaguaaauuguuuauuuuacaauaagaaagugauuacauauuuuuuuuu

SEQ ID NO: 50112 - RNA, 64 nt, Homo Sapiens
cuaaggaaaaacuagcacccuucuguccacucagcaauaagagggaucucuucccaccuacccu

SEQ ID NO: 50113 - RNA, 64 nt, Homo Sapiens
guggccaccugcccagcuucugcgagcuggcugacaauaagaacggcuagucuaggggcaagag

SEQ ID NO: 50114 - RNA, 64 nt, Homo Sapiens
cccagccauuccgcauggcuaagcauuucauguucaauaagaaaaacaguccaggccaaagagg

SEQ ID NO: 50115 - RNA, 64 nt, Homo Sapiens
uuuuuuaaaauacauauugacuugaauugugaggcaauaagauaccuucuauauguaaugauca

SEQ ID NO: 50116 - RNA, 64 nt, Homo Sapiens
acugaagauagaagaaaaaagaaugucagaaaaacaauaagagcguuugcccaaaucugccuau

SEQ ID NO: 50117 - RNA, 64 nt, Homo Sapiens
ugcuuuaucaauaaguguaguuguaaugucaaaucaauaagauauucacacuccucaauaacau

SEQ ID NO: 50118 - RNA, 64 nt, Homo Sapiens
aagaaauguuagugaucaaaagcuuuuacuguugcaauaagagagauaucuuuuuauuuuacag

SEQ ID NO: 50119 - RNA, 64 nt, Homo Sapiens
agaugagacucggccggagauugcaugcaucccccaauaagaaggaugauuuuuaacaugcauu

SEQ ID NO: 50120 - RNA, 64 nt, Homo Sapiens
uuaugagaugccagcggcauaccugugccauucucaauaagaauuacccagaaacuuuuuuaau

SEQ ID NO: 50121 - RNA, 64 nt, Homo Sapiens
auuuaaguguguguuaaacaccuuucccuucccccaauaagaccgggaaucugcaagaaccucc

SEQ ID NO: 50122 - RNA, 64 nt, Homo Sapiens
agccugugcccuuccccaccuuugcccucccagugguugguaugugggaagcccaucucaguuc

SEQ ID NO: 50123 - RNA, 64 nt, Homo Sapiens
gggaggugaggacuucaucucaacaucggcuggugguugguaggggagcuuuuucuuuucuuuc

SEQ ID NO: 50124 - RNA, 64 nt, Homo Sapiens
agagauguccuuguaauauucccuuuuaggugaggguugguaagggguugguaucucaggucug

SEQ ID NO: 50125 - RNA, 64 nt, Homo Sapiens
uguaauauucccuuuuaggugaggguugguaagggguugguaucucaggucugaaucuucacca

SEQ ID NO: 50126 - RNA, 64 nt, Homo Sapiens
ugcagugagccaugaucgcaccacugcacuccagcuuaggcaauacagcgagaccuugucucaa

SEQ ID NO: 50127 - RNA, 64 nt, Homo Sapiens
cggccugggacccucaguguaggguuuucugacucuuaggcaacuuccuagggugcuguacuuc

SEQ ID NO: 50128 - RNA, 64 nt, Homo Sapiens
cacagcuguaguaccccaagucccuuuggcaaaacuuaggcaugggguaauaaccaagauggag

SEQ ID NO: 50129 - RNA, 64 nt, Homo Sapiens
cauggguaauaaccaagaugccccauggguuuugcuuaggcacuuagcauugugguuuuagcac

SEQ ID NO: 50130 - RNA, 64 nt, Homo Sapiens
ccuuagcccaccugguuugcaggugcagggggaccuuaggcacgccccaagcaccaggcaccag

SEQ ID NO: 50131 - RNA, 64 nt, Homo Sapiens
aaaaaaaaaauccuuguacuuaucaauuuugccccuuaggcagucaguuuuguugagaacugug

SEQ ID NO: 50132 - RNA, 64 nt, Homo Sapiens
ccucaggcauuugaauuagagcuacuuugagccucuuaggcagaaaaccuaccacauucacuac

SEQ ID NO: 50133 - RNA, 64 nt, Homo Sapiens
cugucuaaaaaugauucucuaaacuuucccuauacuuaggcauagucuucuuucuuagauucuc

SEQ ID NO: 50134 - RNA, 64 nt, Homo Sapiens
uuuuacauaaagcagaagagaauuaugucuuuauaacucugauccuuagauccuuugaaauaaa

SEQ ID NO: 50135 - RNA, 64 nt, Homo Sapiens
agcauuuauauguggaacuuuuaagaagaauuacaacucugaaaacaaguggaaaaucaaacgu

SEQ ID NO: 50136 - RNA, 64 nt, Homo Sapiens
caccgcgaggcccauguacugccucucuggcaggaacucugaugugccauguucaugccugugg

SEQ ID NO: 50137 - RNA, 64 nt, Homo Sapiens
ucagugagcucugaucuccaucuucuccuguaugaacucugagacccucgugauuguauagggc

SEQ ID NO: 50138 - RNA, 64 nt, Homo Sapiens
cuaguucugcggaagaaaagguacgcagcugccgaacucugacuagccgagggcagaggccuuu

SEQ ID NO: 50139 - RNA, 64 nt, Homo Sapiens
ucggaggcauucccagccgguguucaaagcauccaacucugacuacauuaggcuagaggggucu

SEQ ID NO: 50140 - RNA, 64 nt, Homo Sapiens
aguauuucccuuccaaagagggauguuuggaaaaaacucugaaggagaggaggaauuaguuggg

SEQ ID NO: 50141 - RNA, 64 nt, Homo Sapiens
caagaauaauuuuggaauaauuucuauuaauaucaacucugaagcuaauuguacuaaucugaga

SEQ ID NO: 50142 - RNA, 64 nt, Homo Sapiens
cauuuaaauauguuuuuuauguucuuuauuuagcaacucugauuguacuuuuuuucacauccuu

SEQ ID NO: 50143 - RNA, 64 nt, Homo Sapiens
cuucaguauaaauguaaauaggaacuccacuaaaaacucugaaacaguguggcugagaaagugc

SEQ ID NO: 50144 - RNA, 64 nt, Homo Sapiens
cagaucuuuuuguagacauuuucuucuagaggaaaacucugaagcaguugaucaaacuuuguuc

SEQ ID NO: 50145 - RNA, 64 nt, Homo Sapiens
cagauuuuuugaaaauugaauaaugucaucauucaacucugaaauuauuuccuguuguuucuuc

SEQ ID NO: 50146 - RNA, 64 nt, Homo Sapiens
auguaacaaaucacuuucaaaugauagcucauaaaacucugauacuuccuuguguccuuaccaa

SEQ ID NO: 50147 - RNA, 56 nt, Homo Sapiens
aaaaguguucaucaaaaaguuucucaaacucugagaugcagagagaguggagauaa

SEQ ID NO: 50148 - RNA, 64 nt, Homo Sapiens
uuggaaagucauugaauccaggcccauuuccuuuucucuaaaaugagggucaucauaccuaagg

SEQ ID NO: 50149 - RNA, 64 nt, Homo Sapiens
uggccagggucuccaauuuaggcuuucaacauuaucucuaaagaagguuauacauuaugucggc

SEQ ID NO: 50150 - RNA, 64 nt, Homo Sapiens
aauacuuauguacuacuaucgcacuuuucaauucucucuaaagaccacugucucuuaaaauaua

SEQ ID NO: 50151 - RNA, 64 nt, Homo Sapiens
auucugaaauagguuaaaucucaaauaugaauuuucucuaaaauuagcugcaucuuuugaaaua

SEQ ID NO: 50152 - RNA, 64 nt, Homo Sapiens
uggagaggccaaauggucuuagccucagucucugucucuaaauauuccaccauaaaacagcuga

SEQ ID NO: 50153 - RNA, 64 nt, Homo Sapiens
agauaggcccccuaggaaacugagguaagagcagucucuaaaaacuacccacagcagcauuggu

SEQ ID NO: 50154 - RNA, 64 nt, Homo Sapiens
cauugcccacuuccaaaaaucauauccuuuguguucucuaaauauuuucacauuacuuugucac

SEQ ID NO: 50155 - RNA, 64 nt, Homo Sapiens
uuuuuuaauuuucaaacucauaaugugaaaguugucucuaaauaugaauauauuauuuugcuau

SEQ ID NO: 50156 - RNA, 64 nt, Homo Sapiens
ugcacuccagccugggcaacagagcgagacuccaucucuaaauaaauaaauaaauaaauaaaua

SEQ ID NO: 50157 - RNA, 64 nt, Homo Sapiens
uuucauaccaugcucucuccuacucaguuugaucucucuaaaauuguaguuugguuugauuuaa

SEQ ID NO: 50158 - RNA, 64 nt, Homo Sapiens
uuacauguagaaacauaaaauuuaucaaaauucaucucuaaauuacacuuuuauuuuuaaacga

SEQ ID NO: 50159 - RNA, 64 nt, Homo Sapiens
augaugugaaacugacaaucaaaaggaauaauauucucuaaaccuaugugucauuucacaagaa

SEQ ID NO: 50160 - RNA, 64 nt, Homo Sapiens
augauggggcuaaguuauacucuuccuccucuauucucuaaauaccuuuaaaauccuuccucuu

SEQ ID NO: 50161 - RNA, 64 nt, Homo Sapiens
aaauuguacauuuuuugaaauugguucugaaacuucucuaaagggcuuuucauguaaauuaguc

SEQ ID NO: 50162 - RNA, 64 nt, Homo Sapiens
agacuuguauaauaguauuaauaguagcucauucucucuaaaaauuuacugcccacugauagga

SEQ ID NO: 50163 - RNA, 64 nt, Homo Sapiens
ucugaggauuucuucuuacuggcguucuuaaaggucucuaaaauuaaagaacaagaugugguuu

SEQ ID NO: 50164 - RNA, 64 nt, Homo Sapiens
auaaaauaguuagauaaugagaaguuguuaauuaucucuaaaauuggaauuaggaagcauauca

SEQ ID NO: 50165 - RNA, 64 nt, Homo Sapiens
aauuuuggugcaaaagcaaacaguuccagcaggcucucuaaagaaaaacucauuguaacuuauu

SEQ ID NO: 50166 - RNA, 64 nt, Homo Sapiens
cacuaaauuuuucuuaacauuccaagauuucagaucucuaaaucacaaagagaaaucuuggcau

SEQ ID NO: 50167 - RNA, 64 nt, Homo Sapiens
ucauaugauucacccuaauagauaccuccauuauucucuaaaugaaauagaagacuuuggagua

SEQ ID NO: 50168 - RNA, 64 nt, Homo Sapiens
guuaugcuguacaauuaaaaccauacuucccagcucucuaaaguagaaagacgggaaugauguc

SEQ ID NO: 50169 - RNA, 64 nt, Homo Sapiens
ccuuaaugaaauaaacaacaacaauggaguauuaucucuaaauuagaacuaugcaagcuauaag

SEQ ID NO: 50170 - RNA, 64 nt, Homo Sapiens
ccuuuuccccuacaaacuguuguugaacagugcuucucuaaaaugcaauaauaaugggccaggu

SEQ ID NO: 50171 - RNA, 64 nt, Homo Sapiens
cugcacuccagcuuggugacagagugagauccugucucuaaauaaauaaauaaaaugcgggcca

SEQ ID NO: 50172 - RNA, 64 nt, Homo Sapiens
aauaaagagacaauaagccaaaagugagccccugucucuaaauaugcaccccagcccaggcaac

SEQ ID NO: 50173 - RNA, 64 nt, Homo Sapiens
aaauaauaaaaacuuagcugauagcaagacccugucucuaaaaaaaaugaccagccugggcagc

SEQ ID NO: 50174 - RNA, 64 nt, Homo Sapiens
cccaacagaggaggccagugaggcagagacagagcucucccacucucagacccucuuuugucuu

SEQ ID NO: 50175 - RNA, 64 nt, Homo Sapiens
ucccacucucagacccucuuuugucuucauuuuccucucccacuuagcacaugugugcuugagg

SEQ ID NO: 50176 - RNA, 64 nt, Homo Sapiens
ucuagguggcucaguccauguaccauaccaacuucucucccauccucaaauauauuuauuuuuu

SEQ ID NO: 50177 - RNA, 64 nt, Homo Sapiens
ccccugccacagccucuuucuccccuccucccugcucucccaggugcaggccccagagcgagcu

SEQ ID NO: 50178 - RNA, 64 nt, Homo Sapiens
aaauccaggugcuuuccagaagaaauccaggcuccucucccaaguccacagcccuccucuccca

SEQ ID NO: 50179 - RNA, 64 nt, Homo Sapiens
aaauccaggcuccucucccacuuccacagcccuccucucccaagcgaagaagaacugauugggg

SEQ ID NO: 50180 - RNA, 64 nt, Homo Sapiens
gcuaccuacugcaggagggcgaaaagcucaggaucucucccaagaaaauaaaacgguagaauau

SEQ ID NO: 50181 - RNA, 64 nt, Homo Sapiens
uuucugaaaguggcugauguccagcaaaaaaugucucucccauuggagcuuuguuuccuguuca

SEQ ID NO: 50182 - RNA, 64 nt, Homo Sapiens
cccuguucuggaggcuaaccgggaacugccacugcucucccagggcccuucuuccuccagcagc

SEQ ID NO: 50183 - RNA, 64 nt, Homo Sapiens
ucccacaaggguuccaggaaagccucugcccugccucucccagcguccacugaaaacaaagcca

SEQ ID NO: 50184 - RNA, 64 nt, Homo Sapiens
caugcccacgugagcaccugucucccacucaaaccucucccaucucccaacaacugcacuuuag

SEQ ID NO: 50185 - RNA, 64 nt, Homo Sapiens
uucauccuugccacugucuugcuuuuauuuuuuacucucccacugagcaagcgucugugguccu

SEQ ID NO: 50186 - RNA, 64 nt, Homo Sapiens
auaagcugccaguguugcuuuucuguugguagagcucucccauuuggugacauggaaaauaccu

SEQ ID NO: 50187 - RNA, 64 nt, Homo Sapiens
ugguacuaaauccaguagaugggcuguguagcaacucucccagggaacacacuaggguacuuag

SEQ ID NO: 50188 - RNA, 64 nt, Homo Sapiens
gcccugggcguguaguguaacuggaaucuuuugccucucccagccaccuccucccagcccccca

SEQ ID NO: 50189 - RNA, 64 nt, Homo Sapiens
ugguguuuuuuugggugguggcuggaaacagccccucucccacguggcagaggcucagccuggc

SEQ ID NO: 50190 - RNA, 64 nt, Homo Sapiens
uaccuuagaguagggacacugagcucucccaagucucucccaaaagggugagacaguccaccca

SEQ ID NO: 50191 - RNA, 64 nt, Homo Sapiens
ucucucccaaauaccuuagacaguccacccagagcucucccaagggcauuugaacagggugaga

SEQ ID NO: 50192 - RNA, 64 nt, Homo Sapiens
accucggaugaccauacucaacauucaaaaaacucucucccaggcugugcauuuucuaaguggg

SEQ ID NO: 50193 - RNA, 64 nt, Homo Sapiens
gggcacaccccuggggcugaacucacauagccaacucucccaaauguuuuuuuuuuuaaguuuc

SEQ ID NO: 50194 - RNA, 64 nt, Homo Sapiens
caucuucuuguggcacaggaaagcugcccucucccucucccaccacacuccugacuaauggccu

SEQ ID NO: 50195 - RNA, 64 nt, Homo Sapiens
cagaggucagcacugggggaaacuugcugguggucucucccacaaccuugcccagaguccuuuc

SEQ ID NO: 50196 - RNA, 64 nt, Homo Sapiens
uccaucuggcaucccacgcguuugcacuuccauccucucccacuggggggugaccuuucugguc

SEQ ID NO: 50197 - RNA, 64 nt, Homo Sapiens
caacaucacccaguggaugggguacuggaagaaacucucccaucgccacaauugucacaugacc

SEQ ID NO: 50198 - RNA, 64 nt, Homo Sapiens
ugcucuguuaugggagagaaggaucuuuucuugacucucccacauuuuuaauuguuaugaaaau

SEQ ID NO: 50199 - RNA, 64 nt, Homo Sapiens
ucgcugcugcagccaacccagauccugcaccuuccucucccagggggcucgccucucccgccuc

SEQ ID NO: 50200 - RNA, 64 nt, Homo Sapiens
gagccccagcccccuuugggccgccugcccgucucucucccauguggagccccacacuggggug

SEQ ID NO: 50201 - RNA, 64 nt, Homo Sapiens
cuacccagagaagccccuucgccccagucagccucucucccaguggccuugcuggggacggggg

SEQ ID NO: 50202 - RNA, 64 nt, Homo Sapiens
cguccugggcaggcugcagccucaugccaugucucucucccacuaccugaugggcacauggaca

SEQ ID NO: 50203 - RNA, 64 nt, Homo Sapiens
ucgguccucucagcccugccugcccuggccugggcucucccagccucccagcccucugcccccu

SEQ ID NO: 50204 - RNA, 64 nt, Homo Sapiens
ggcucgugggaaacagcaaaacacuaagccugaccucucccaaauugggaagaccagaggagaa

SEQ ID NO: 50205 - RNA, 64 nt, Homo Sapiens
auuuccugcaucuuuccuuaagggaagccccauccucucccaggaccaggaguuuaugaccagg

SEQ ID NO: 50206 - RNA, 64 nt, Homo Sapiens
acugguccagucaucccagugggcuucucuuugucucucccagauuagaccuuugggugagauu

SEQ ID NO: 50207 - RNA, 64 nt, Homo Sapiens
uuucauuucuuccuccaggccucccaccagauugcucucccaccagggcuccuuuuccccuucc

SEQ ID NO: 50208 - RNA, 64 nt, Homo Sapiens
ccauugauaccaacucuuucugugaucuccucaccucucccacuccugggcuccaaauuccucu

SEQ ID NO: 50209 - RNA, 64 nt, Homo Sapiens
augagugaggagcugugcugcuuuaaguguccuucucucccaggauuucauuuuuuuggucacc

SEQ ID NO: 50210 - RNA, 64 nt, Homo Sapiens
aacucccuucguggggacaacacacuacucgcuccucucccaacagcccugucccaucugcagc

SEQ ID NO: 50211 - RNA, 64 nt, Homo Sapiens
ugcccuuggugggguuuccaggcuucagugagaacucucccagugguggggcagcuuucuuugg

SEQ ID NO: 50212 - RNA, 64 nt, Homo Sapiens
cucuuggcaggacggcuacgagcagcuuaggcagcucucccagcacgccaugaagggggucauc

SEQ ID NO: 50213 - RNA, 64 nt, Homo Sapiens
cccuguuuguggucuguguugacagccacccacccucucccaccucaugcuccugcaccugcac

SEQ ID NO: 50214 - RNA, 64 nt, Homo Sapiens
ccagaauguagaagccugucucucccaacccagacucucccacugagcccccaccaccaccgac

SEQ ID NO: 50215 - RNA, 64 nt, Homo Sapiens
ccagacucucccacuccagacccaccaccaccgacucucccaaccuuuuagauaaagaugagcc

SEQ ID NO: 50216 - RNA, 64 nt, Homo Sapiens
cacccuguguaacaggacccauccuaaucccuuccucucccauuugcaaagguggggagaaggg

SEQ ID NO: 50217 - RNA, 64 nt, Homo Sapiens
cacaagaacuccucccacccucaggggcacagaccucucccaccauuuggcaggaucggcuucc

SEQ ID NO: 50218 - RNA, 64 nt, Homo Sapiens
gugccugccauccaggcagcgguucagagcauuacucucccacuucggcuucaucacauuggga

SEQ ID NO: 50219 - RNA, 64 nt, Homo Sapiens
accgcugccaccaccgccacgcgcugggguuucccucucccagaucccggcccauagacaagug

SEQ ID NO: 50220 - RNA, 64 nt, Homo Sapiens
acucaucugucccugaccucuaaccuuucucugccucucccacacucucccagagcucacugau

SEQ ID NO: 50221 - RNA, 64 nt, Homo Sapiens
cccugaccucuaaccuuucucugccucucccacacucucccagagcucacugauuagacagcac

SEQ ID NO: 50222 - RNA, 64 nt, Homo Sapiens
ggugugguuggaggucuguggagucaaggucccccucucccaggcaggcucucugagggcauuc

SEQ ID NO: 50223 - RNA, 64 nt, Homo Sapiens
ugacuccacaucuucugccccaguguguccccaccucucccagccuguauacccagauuacuuu

SEQ ID NO: 50224 - RNA, 64 nt, Homo Sapiens
ucccugacucugggaauaacccuacccaggcuuucucucccacuuuuaucacuucccucacugc

SEQ ID NO: 50225 - RNA, 64 nt, Homo Sapiens
gaggugaaggagcaccuggcgauggacagcuuggcucucccagaagcauccuggggauccagcg

SEQ ID NO: 50226 - RNA, 64 nt, Homo Sapiens
cuaugucaucuuguucuccugcuaucucucacaccucucccagaucuccuguuuuccuuccucu

SEQ ID NO: 50227 - RNA, 64 nt, Homo Sapiens
accagugcccuucuccugcuucccagucaccucgcucucccagcggcugcucuaguguucuguc

SEQ ID NO: 50228 - RNA, 64 nt, Homo Sapiens
gagggggcucgcuucccccaacuccauggccacccucucccaaacuugcuuugacucaugccuu

SEQ ID NO: 50229 - RNA, 64 nt, Homo Sapiens
auaccaugcuguccucuuaguggggucucccuggcucucccaggacuuucccugcuuggaagcg

SEQ ID NO: 50230 - RNA, 64 nt, Homo Sapiens
agggcccugccuucagcuggccagugccaacuuccucucccacuucaacagcugcagggggacc

SEQ ID NO: 50231 - RNA, 64 nt, Homo Sapiens
cccuuccagggccucugcucuuuccccaugcacucucucccaccaggcauaucagcuuucacac

SEQ ID NO: 50232 - RNA, 64 nt, Homo Sapiens
cccuccccaaagccacuggacccagaccugucgucucucccaccggccuugaagacucccugau

SEQ ID NO: 50233 - RNA, 64 nt, Homo Sapiens
ccugguaggguuccccaaccagcccccaaccccccucucccagcacuggcuuggcuuuacuuug

SEQ ID NO: 50234 - RNA, 64 nt, Homo Sapiens
aaaugugcuagagcucugcccuuucccaggcuuacucucccaauccugccaccacucccuuagu

SEQ ID NO: 50235 - RNA, 64 nt, Homo Sapiens
ccaaccuccccagacucugcccaaacuguacagacucucccaccgccaacuagaacacccaaca

SEQ ID NO: 50236 - RNA, 64 nt, Homo Sapiens
gccugggaccugcaucugaugcuggggccagggacucucccacgcacgagcuagugaguggcac

SEQ ID NO: 50237 - RNA, 64 nt, Homo Sapiens
accaaauuuaagagggugggacaguccccugcuccucucccagagggcacugcuuggaaauugu

SEQ ID NO: 50238 - RNA, 64 nt, Homo Sapiens
uguggcaguuugcguuuacuuuuuauuaccacuccucucccauucuuugggacaucuucagccc

SEQ ID NO: 50239 - RNA, 64 nt, Homo Sapiens
ucaucugccugcccacacgcgcuccaaacgccuccucucccagggagaaccuuccccacacuca

SEQ ID NO: 50240 - RNA, 64 nt, Homo Sapiens
cauuccagccugggugacagaguuagauuccacccucucccaccccggcaaaaaaaaaaaaaaa

SEQ ID NO: 50241 - RNA, 64 nt, Homo Sapiens
ccauuguccaggggagccuggcggcgcaucccuccucucccaccuccuggcacuuccagcuggg

SEQ ID NO: 50242 - RNA, 64 nt, Homo Sapiens
acacacucagauagcacaaaaggggucaggcugccucucccaacccauccccaggccuugccug

SEQ ID NO: 50243 - RNA, 64 nt, Homo Sapiens
uggacuccugcaugcuccucugggacuggccccacucucccagcgccuccuugcccuagcacac

SEQ ID NO: 50244 - RNA, 64 nt, Homo Sapiens
ggccagaacuaagaaugccaagguuuuauauauguguguauauauauauauauauauauauaua

SEQ ID NO: 50245 - RNA, 64 nt, Homo Sapiens
uauauauauauauauauauauauauauguuuguguguguauauauauauauauauauauauguu

SEQ ID NO: 50246 - RNA, 64 nt, Homo Sapiens
uguguauauauauauauauauauauauguuuguguguguauauauauguuuguguauauauaua

SEQ ID NO: 50247 - RNA, 64 nt, Homo Sapiens
uauauauauauguuuguguguguauauauauguuuguguauauauauacacauaugcauacaua

SEQ ID NO: 50248 - RNA, 64 nt, Homo Sapiens
gauaaaaacuguugaauacuauugauguagagaauguguauauguguauauuugcauugauuaa

SEQ ID NO: 50249 - RNA, 64 nt, Homo Sapiens
cuguugaauacuauugauguagagaauguguauauguguauauuugcauugauuaaauuauugg

SEQ ID NO: 50250 - RNA, 64 nt, Homo Sapiens
guugagcuaugauaugugcuuguguguaugucuauguguauauauuauauauacauuagacaca

SEQ ID NO: 50251 - RNA, 64 nt, Homo Sapiens
acacacauauacauuauuucuguauauagaugucuguguauacauauguaugugugaguguaug

SEQ ID NO: 50252 - RNA, 64 nt, Homo Sapiens
cuguguacaaacacauuuucuaugcaugugucucuguguauauggcauauaccuaguaaguaug

SEQ ID NO: 50253 - RNA, 64 nt, Homo Sapiens
ugccacaagcaugagugugauuguaugugcacuguguguauauauauaaauauauguauaugua

SEQ ID NO: 50254 - RNA, 64 nt, Homo Sapiens
uaacaaaccuguguaugcuucacuuguaaccauauguguauaauaaugaacuuuuuugcaagca

SEQ ID NO: 50255 - RNA, 64 nt, Homo Sapiens
uccaaugaacuuuuuugcaacauuuccagagccuuguguauauuuuguaacacuacacggugua

SEQ ID NO: 50256 - RNA, 64 nt, Homo Sapiens
uagaauaaaaaauuccuuucccuuuauuuugagcuguguauaggucucaguuccagaaguuaua

SEQ ID NO: 50257 - RNA, 64 nt, Homo Sapiens
cuuaucaaagcuauuuucuuuauauauaugccuuuguguauacagagagggguguuugugugua

SEQ ID NO: 50258 - RNA, 64 nt, Homo Sapiens
uauaugccuuuguguauacagagagggguguuuguguguauauaagccuguauaguauauaaga

SEQ ID NO: 50259 - RNA, 64 nt, Homo Sapiens
uugcuuuuguuuuauaacauacguguguauagaguguguauacuagcaggcugagugcagguau

SEQ ID NO: 50260 - RNA, 64 nt, Homo Sapiens
guguguauacuuugcuuuugagugcagguauacguguguauagauuuaaauacucagcaggcug

SEQ ID NO: 50261 - RNA, 64 nt, Homo Sapiens
uauauaugugugugugucuauaugcauauauuuguguguauaugaaaaaaaaaaauagaaugug

SEQ ID NO: 50262 - RNA, 64 nt, Homo Sapiens
uagauauuuaaaugguugcuuguaaaaacuugaauguguauaguuuccucauaaggcaugaagu

SEQ ID NO: 50263 - RNA, 64 nt, Homo Sapiens
ugcagagagagagcuuauauugggucuguuuauauguguauauaaacaucaguggucuaaugcu

SEQ ID NO: 50264 - RNA, 64 nt, Homo Sapiens
acacacauauguauaucuauacacacauguguguuguguauaugcaugugugugugugcgugug

SEQ ID NO: 50265 - RNA, 64 nt, Homo Sapiens
guguguuguguauaugcaugugugugugugcguguguguauaguuuuagcuccaagccaagcaa

SEQ ID NO: 50266 - RNA, 64 nt, Homo Sapiens
caguuucugaaagauaaagaggaaaaaaacuugcuguguauauuuuugccuaugaaaauauuuu

SEQ ID NO: 50267 - RNA, 64 nt, Homo Sapiens
uaaaaucguuuuuaauccuuaaauugugaccauauguguauaauccaacaaucuuuuuaaggca

SEQ ID NO: 50268 - RNA, 64 nt, Homo Sapiens
uggggggugggggaugaauuuuuuuuaagguucuuguguauauuuuuauucauccauuuguaaa

SEQ ID NO: 50269 - RNA, 64 nt, Homo Sapiens
auuuccaaagcuccuuuguaugucucuaguugucuguguauaauuaaaauuccaguuugauguu

SEQ ID NO: 50270 - RNA, 64 nt, Homo Sapiens
aguuccuacacugauuuugacuucaauucagcaauguguauaaagucugguggguuauguuuug

SEQ ID NO: 50271 - RNA, 64 nt, Homo Sapiens
gagagagagcugagaguuauuauauguauguguauguguauauauguguguauauauguauaca

SEQ ID NO: 50272 - RNA, 64 nt, Homo Sapiens
uguauacauauauguaugugacagcuguacaguguguguauauaguguacacgugcauguacac

SEQ ID NO: 50273 - RNA, 64 nt, Homo Sapiens
ccuaaaucaccuagagguaccguuuacaugguuuuguguauauagaguuggcuugcauuuuagg

SEQ ID NO: 50274 - RNA, 64 nt, Homo Sapiens
guuacugaccauugaguguuuacuauguacccaauguguauauuuuucuuuuuaaucuucccaa

SEQ ID NO: 50275 - RNA, 64 nt, Homo Sapiens
caacugugauuuccuuuuccucagcaagcuccuauguguauauuuuccugaauuucucaucuca

SEQ ID NO: 50276 - RNA, 64 nt, Homo Sapiens
auccuugagauuucacuaccuuuauguuaaaaguuguguauaauuguuaaaaucugugaaagaa

SEQ ID NO: 50277 - RNA, 64 nt, Homo Sapiens
uauauauauuuaugcaucuacgugucuguagguguguguauauauacacauguauacguaugua

SEQ ID NO: 50278 - RNA, 64 nt, Homo Sapiens
gaugugugcauauauacacacauacguauauguguguguauauccucucucgacauucucucua

SEQ ID NO: 50279 - RNA, 64 nt, Homo Sapiens
ccuuccacaaacacauccucuauagagauagacuuguguauacauauguguguacauaauuaua

SEQ ID NO: 50280 - RNA, 64 nt, Homo Sapiens
auuuuuugccagauaaaaauaaaaauuuaaaucauguguauacaaaaaacuguuaaaauuuaaa

SEQ ID NO: 50281 - RNA, 64 nt, Homo Sapiens
uuaugucaaucaagacaaaugaaauauauauguauguguauauauauacauguauguaugaaau

SEQ ID NO: 50282 - RNA, 64 nt, Homo Sapiens
auguauguaugaaauauauauaugugcguguguguguguauauauauauauauauauauauauu

SEQ ID NO: 50283 - RNA, 64 nt, Homo Sapiens
uauacacauauauauacacauguacguguguauauguguauauaaauauauuucaaaauaugug

SEQ ID NO: 50284 - RNA, 64 nt, Homo Sapiens
uguauauauauacacauauaaauauguguguacguguguauaugucuucugaaauauauuucaa

SEQ ID NO: 50285 - RNA, 64 nt, Homo Sapiens
uauauauauauauguguguguguguguguguguguguguauauauauauauauauauauauaua

SEQ ID NO: 50286 - RNA, 64 nt, Homo Sapiens
uauauauauauauauauauauauauauauauguguguguauauauauauauauguguauauaua

SEQ ID NO: 50287 - RNA, 64 nt, Homo Sapiens
uauauauauauauguguguguauauauauauauauguguauauauauauguauauacauauaug

SEQ ID NO: 50288 - RNA, 64 nt, Homo Sapiens
uauauagaaauuccauguuugauuuuuuaaaauauguguauaagucugucaugugcuaaacaaa

SEQ ID NO: 50289 - RNA, 64 nt, Homo Sapiens
auugcuguuuuauguacugaugaaaguaccuauuuguguauauuggauuuuucacuugguuagc

SEQ ID NO: 50290 - RNA, 64 nt, Homo Sapiens
ucaagggauuuaugucuacauauuuguguguguguguguauauauauguaauaugcauacacag

SEQ ID NO: 50291 - RNA, 64 nt, Homo Sapiens
guauauauauguaauaugcauacacagaugcauauguguauauauaaugaaauuuauguugcug

SEQ ID NO: 50292 - RNA, 64 nt, Homo Sapiens
ucuugccauauacaauauacauacauuuggguuguguguauacaguacacacaaaaaugugugu

SEQ ID NO: 50293 - RNA, 64 nt, Homo Sapiens
uuuggguuguguguauacauuacacacaaaaauguguguauacauauaccaaauagcauacaug

SEQ ID NO: 50294 - RNA, 64 nt, Homo Sapiens
cacacacacacacacacacacgauuuacauaagcuguguauacaacacccguucuguggagagu

SEQ ID NO: 50295 - RNA, 64 nt, Homo Sapiens
gaugugucuguaucuuuaaucugucauagccuuuuguguauaguucuucugauucugcugcuca

SEQ ID NO: 50296 - RNA, 64 nt, Homo Sapiens
uugccuauguaauaggauauauccuaaguggggauguguauauuucaggaacuuuaauucacaa

SEQ ID NO: 50297 - RNA, 64 nt, Homo Sapiens
acuuuaauucacaaguauauauugauaucugauguguguauaguacaucuguugguuauguaca

SEQ ID NO: 50298 - RNA, 64 nt, Homo Sapiens
cauauacacaucucuguccauauguauggauauguguguauacauauauacacauauacacauc

SEQ ID NO: 50299 - RNA, 64 nt, Homo Sapiens
gaugcacaugcguacauauauguauaugcaugcauguguauaaaugcguguguauguaugugua

SEQ ID NO: 50300 - RNA, 64 nt, Homo Sapiens
ugcaauggccuuuuuuuccaaacaugaacagauuuguguauaacgccaugagauuuuguuuggc

SEQ ID NO: 50301 - RNA, 64 nt, Homo Sapiens
uacagugaaaauguugucucuacauguauggauguguguauauggguuucucuugguuugugcu

SEQ ID NO: 50302 - RNA, 64 nt, Homo Sapiens
gacaagcaugugccuguguguguguguguguguguguguauaugugugugugugcacgcacaug

SEQ ID NO: 50303 - RNA, 64 nt, Homo Sapiens
uguguguauaugugugugugugcacgcacaugcguguguauaagcccaccugaguggggcucgu

SEQ ID NO: 50304 - RNA, 64 nt, Homo Sapiens
uauauuuaaaguguauuuaugugugggauaucaauguguauauugcagagcaugacuuuuauau

SEQ ID NO: 50305 - RNA, 64 nt, Homo Sapiens
aaguauuugcagagcaugacccccacaaggacaguguguauacagacacauccuggaauucaua

SEQ ID NO: 50306 - RNA, 64 nt, Homo Sapiens
uacaaaaacaaaacaaacaagaccugcugguguguguguauauugggacucacccagggaccau

SEQ ID NO: 50307 - RNA, 64 nt, Homo Sapiens
auuuuaaugaagaaaauaaacuaacaauacauucuguguauauuuaaaauuugaaggaaucgaa

SEQ ID NO: 50308 - RNA, 64 nt, Homo Sapiens
aaagggaggguuuuuuuaaacauguagcauguuuuguguauauagcauuucucacaaaguguac

SEQ ID NO: 50309 - RNA, 64 nt, Homo Sapiens
acauauauaugcauuuagaucccuugugcacguauguguauaccauauacauguguaugagccu

SEQ ID NO: 50310 - RNA, 64 nt, Homo Sapiens
ugaaaacguauuuggcaauauuacagcacaucacuguguauauagagaaccugcugucaaauau

SEQ ID NO: 50311 - RNA, 64 nt, Homo Sapiens
uaaauauauuucuacacacauguacauauguuuguguguauauggacauaauuauauaugugua

SEQ ID NO: 50312 - RNA, 64 nt, Homo Sapiens
uauauuauauauauaauauauauaauauaauauauguguauauaauuauauauguguguauaua

SEQ ID NO: 50313 - RNA, 64 nt, Homo Sapiens
uauaauauaauauauguguaauauauuauauauguguguauauaaaaggauuguuucuccauau

SEQ ID NO: 50314 - RNA, 64 nt, Homo Sapiens
auggcuauugcauuuugggauucuucgcauuuuguguguauauuuuuacagugagguacauugu

SEQ ID NO: 50315 - RNA, 64 nt, Homo Sapiens
uaaggauuuuuuaaggagggaauauauauguguguguguauauaagcucccacauagauacaug

SEQ ID NO: 50316 - RNA, 64 nt, Homo Sapiens
aauaagcuuuccauuuuauucauaaucuaauguguguguauauauguauguguguaugugugug

SEQ ID NO: 50317 - RNA, 64 nt, Homo Sapiens
cuaauguguguguauauauguauguguguauguguguguauauauagauguauauauauacaca

SEQ ID NO: 50318 - RNA, 64 nt, Homo Sapiens
cgaccaagaucccucccugcaagacagaugggaauguguauaauaacuagguauuugagaaguu

SEQ ID NO: 50319 - RNA, 64 nt, Homo Sapiens
ucucucucucucucuccauauauauauguguguguguguauauauauauauaugugugugugug

SEQ ID NO: 50320 - RNA, 64 nt, Homo Sapiens
uguguguauauauauauauauguguguguguguguguguauacauauauacacauauauacaca

SEQ ID NO: 50321 - RNA, 64 nt, Homo Sapiens
uauacacauauauacacacacacauacauauacauguguauauauauaccaucccauauauaug

SEQ ID NO: 50322 - RNA, 64 nt, Homo Sapiens
cugaucuuucaagucugggagucuaccgcguugauguguauacaucauugucagacucccccug

SEQ ID NO: 50323 - RNA, 64 nt, Homo Sapiens
aaagaggaagauggaaacaaaaucugugucucuguguguauaacccagaugauacuuuccuuua

SEQ ID NO: 50324 - RNA, 64 nt, Homo Sapiens
auuugaaugaguuuuuaauagucuagaauguuauuguguauagauauuuccucuugaacguuau

SEQ ID NO: 50325 - RNA, 64 nt, Homo Sapiens
uuuggagagccacauacuuuacaguaaaauuaaguguguauaaaacauuaauugcuaacaauug

SEQ ID NO: 50326 - RNA, 64 nt, Homo Sapiens
uuguuaacacuagaaaccuauaagagcuuauaauuguguauaauuugauaaguauguugcauuu

SEQ ID NO: 50327 - RNA, 64 nt, Homo Sapiens
ugucagagguguuucuagugcucuauacuuugcuuguguauauuuuuucuugaucuguuuuguu

SEQ ID NO: 50328 - RNA, 64 nt, Homo Sapiens
uaaauaauauguguuuuaccgacuauguugacaauguguauaugauaauuaugcaaaugaaugc

SEQ ID NO: 50329 - RNA, 64 nt, Homo Sapiens
uuuauauuuauaugacagcuugaacugacaacauuguguauauagaucaucuugaaguauuauu

SEQ ID NO: 50330 - RNA, 64 nt, Homo Sapiens
gcuggcuauauaggaaaaugcuguggaaaugaacuguguauauacuucugggaggaacaaauuu

SEQ ID NO: 50331 - RNA, 64 nt, Homo Sapiens
gaugcugaaaaaugugcauuccaaaaaaugaacauguguauaguguauagauuaauaucuaaaa

SEQ ID NO: 50332 - RNA, 64 nt, Homo Sapiens
uguacacuuuuuuagacaugacauacauauauguuguguauaaauuauauguauaugcacacau

SEQ ID NO: 50333 - RNA, 64 nt, Homo Sapiens
auuauuuuuuacaaucauuuauaagcucuuugaauguguauauucucaauaauuuuauacugua

SEQ ID NO: 50334 - RNA, 64 nt, Homo Sapiens
auauauauuguaugugauaagguccauauguacguguguauauaugugugcacuuauguguaug

SEQ ID NO: 50335 - RNA, 64 nt, Homo Sapiens
uuuuauuacuccguggggagcauguacagagcucuguguauacacagcuucacacccaccagau

SEQ ID NO: 50336 - RNA, 64 nt, Homo Sapiens
ugagagaaaagucaaaggugcuucagccuuguacuguguauauauauuaaaaaaaaaacaaagu

SEQ ID NO: 50337 - RNA, 64 nt, Homo Sapiens
ugugugcccuggacuguuucuaucuuuguauauauguguauauagcauuaugcacgugucuggg

SEQ ID NO: 50338 - RNA, 64 nt, Homo Sapiens
uguguguguguucaagugcgcuuuuauaggccuguguguauagcgcugugugucugcuuguaug

SEQ ID NO: 50339 - RNA, 64 nt, Homo Sapiens
uggcaugugucccagucacuugggauguggguuguguguauaucgggcauguguggggugugug

SEQ ID NO: 50340 - RNA, 64 nt, Homo Sapiens
gggguguguguagugugugugugugugggaugcguguguauaagaugcguguguauaagggggu

SEQ ID NO: 50341 - RNA, 64 nt, Homo Sapiens
ggggugugugugggaugcgugugugugggaugcguguguauaagcuagucacuuggagaagggu

SEQ ID NO: 50342 - RNA, 64 nt, Homo Sapiens
gaaacuacaugaagucaccguuacaguaacuugauguguauauuaauaaaaguaauucagucau

SEQ ID NO: 50343 - RNA, 64 nt, Homo Sapiens
caaagcuaaagauguauauauacauauacuuuuguguguauauauacacauauguguguaugca

SEQ ID NO: 50344 - RNA, 64 nt, Homo Sapiens
auauggaacaacugcuuuuaggagaaaguguauuuguguauauguguguauacauauguuuauc

SEQ ID NO: 50345 - RNA, 64 nt, Homo Sapiens
acugcuuuuaggagaaaguguauuuguguauauguguguauacauauguuuaucucacacacau

SEQ ID NO: 50346 - RNA, 64 nt, Homo Sapiens
acuccugugggaaagaaacauguauauuuauguguguguauaaacuaggaauuuaauauuguug

SEQ ID NO: 50347 - RNA, 64 nt, Homo Sapiens
uauguguguguauaaaacucgaauuuaauauuguuguguauauuaaaagaaauuaaccaccuag

SEQ ID NO: 50348 - RNA, 64 nt, Homo Sapiens
auauauauuugccuuaaauguauguauauguguguguguauaaauauuccauauauauauucca

SEQ ID NO: 50349 - RNA, 64 nt, Homo Sapiens
uuccacauauguauacauucguauacauuccacguguguauauauguguauauaguccccauau

SEQ ID NO: 50350 - RNA, 64 nt, Homo Sapiens
guccccauauguauacauucguauacauuccacguguguauauacauguauauauuccacauau

SEQ ID NO: 50351 - RNA, 64 nt, Homo Sapiens
uuccacguguauguauuccagaauauauuccacauguguauauaauuccacauguguguaugug

SEQ ID NO: 50352 - RNA, 64 nt, Homo Sapiens
gcugcuggugaaagucgugugaaauccuguacacuguguauagaauaauguaauuuuauguuaa

SEQ ID NO: 50353 - RNA, 64 nt, Homo Sapiens
aauguaacagugcagaucuuguuagacacaugaauguguauaaucauguuaaaugcaaauaaaa

SEQ ID NO: 50354 - RNA, 64 nt, Homo Sapiens
cuaaaaauaaaccaaaggacauuaugugugcauguguguauaagugcacacagaaauauauaua

SEQ ID NO: 50355 - RNA, 64 nt, Homo Sapiens
agaaauauauauacauauguagacuauauacauguguguauauauguguauauauacauacacu

SEQ ID NO: 50356 - RNA, 64 nt, Homo Sapiens
auacauauguagacuauauacauguguguauauauguguauauauacauacacuuguauaaaug

SEQ ID NO: 50357 - RNA, 64 nt, Homo Sapiens
gagacagcgcuugguggugugauacuuuuggugcuguguauaguauuguaugucgguacacgga

SEQ ID NO: 50358 - RNA, 64 nt, Homo Sapiens
cugaaaugucuuacauuaagaauaucuugaauguuguguauauauuuuaaaaagcacuuugcaa

SEQ ID NO: 50359 - RNA, 64 nt, Homo Sapiens
ggcaauucauguuuuaauguuccucuuauauuuguguguauacauauugugcauaacagauugu

SEQ ID NO: 50360 - RNA, 64 nt, Homo Sapiens
auguacuaaauauuacaguuuuaacagauacugcuguguauaacuuuucacucaaaccacugac

SEQ ID NO: 50361 - RNA, 64 nt, Homo Sapiens
aaauauguauaguagguagacaaucaaauacuuuuguguauagaugcuguuaaaacacaaauuu

SEQ ID NO: 50362 - RNA, 64 nt, Homo Sapiens
uguacauacagacauacugacagauacacacacuuguguauauacgcauguagagcuacagauc

SEQ ID NO: 50363 - RNA, 64 nt, Homo Sapiens
uguaugugugcauaugucuggguucucaaccacguguguauauaaugauacacacacaugcaca

SEQ ID NO: 50364 - RNA, 64 nt, Homo Sapiens
caaauaaagaaaaauaauuucagaaauuaccgaauguguauaaauauuuuuaaaucuugcuuuu

SEQ ID NO: 50365 - RNA, 64 nt, Homo Sapiens
cuugcuuuauuuucuuggaauccuuuggcgucucuguguauauccguuccuuccugucacaccc

SEQ ID NO: 50366 - RNA, 64 nt, Homo Sapiens
ugacacugugaacaauguaguuggaaaauagguauguguauaugcauuauuuauacucauuguu

SEQ ID NO: 50367 - RNA, 64 nt, Homo Sapiens
aaaauguaucagaaaaguuugauuaccuagaaaguguguauagaaacugcaaauaaacgugacu

SEQ ID NO: 50368 - RNA, 64 nt, Homo Sapiens
uauauauauauauauauauguguguguguguguguguguauauguguuuauagagauacacaca

SEQ ID NO: 50369 - RNA, 64 nt, Homo Sapiens
uauguguuuauagagauacacacacauauauauguguguauauauauacacauacauauauaua

SEQ ID NO: 50370 - RNA, 64 nt, Homo Sapiens
uagaagucauuauggcagauuguguguaugccuguguguauauaugugugugugugugugugug

SEQ ID NO: 50371 - RNA, 64 nt, Homo Sapiens
aauagauuagagcacaguuguuucucuguaccuguguguauagaggcauaaggacaucuccacu

SEQ ID NO: 50372 - RNA, 64 nt, Homo Sapiens
ggccugaggacauuuccaguuuucucuguaccuguguguauagaaauagaucagagcacaguug

SEQ ID NO: 50373 - RNA, 64 nt, Homo Sapiens
uugauuauaaccacaaauuguguguguguguguguguguauauauagaagucauuauggcagau

SEQ ID NO: 50374 - RNA, 64 nt, Homo Sapiens
cuggauguggguaaacuaagguaaaggggaugauauuccacaaacuaauuaugcacacagaaaa

SEQ ID NO: 50375 - RNA, 64 nt, Homo Sapiens
agucucuuuucuuacucuggcaaaccugugagugauuccacaaagauacaguauuacuuagcua

SEQ ID NO: 50376 - RNA, 64 nt, Homo Sapiens
uucucaguugccauuugauuucucguuagucugcauuccacagcuuggugguuucuguguuaga

SEQ ID NO: 50377 - RNA, 64 nt, Homo Sapiens
cucagguaccaucuguggugucuuuucaucaaaaauuccacaccgacuaguccucacuucaggc

SEQ ID NO: 50378 - RNA, 64 nt, Homo Sapiens
aguauaauuacauccuccaauguaccguuuccuuauuccacagauaucuuuuucauuauuguga

SEQ ID NO: 50379 - RNA, 64 nt, Homo Sapiens
gacuuaucaacacuauaauuguucccuaugaaagauuccacagagauguuuauggugagguuua

SEQ ID NO: 50380 - RNA, 64 nt, Homo Sapiens
gauugcaaacuaggaugcuacauaggauucugguauuccacauccaauauggauuucuagaaug

SEQ ID NO: 50381 - RNA, 64 nt, Homo Sapiens
accugccacccacugauucagaaauggaaaucacauuccacaaucuauggcuuccaccagcuag

SEQ ID NO: 50382 - RNA, 64 nt, Homo Sapiens
cccaccagcaauguaugagaacagcaguugaaccauuccacauugaacagacaaacuguuuucc

SEQ ID NO: 50383 - RNA, 64 nt, Homo Sapiens
caauucacucuggcgacccuaaaguucuucuagaauuccacaugaaucccauaggauggcaagc

SEQ ID NO: 50384 - RNA, 64 nt, Homo Sapiens
guauacauauuucaaacuauaguucaacugauccauuccacaauaggugauacauauguuaauu

SEQ ID NO: 50385 - RNA, 64 nt, Homo Sapiens
guuacagaaaagcauuucuuucagcuacaguuuaauuccacacugggaucaugaaaaggucugg

SEQ ID NO: 50386 - RNA, 64 nt, Homo Sapiens
augaugauguuaguaguuuggaagaagaacaagaauuccacaugagaaguaaaaacaguuuaca

SEQ ID NO: 50387 - RNA, 64 nt, Homo Sapiens
aaggguacuguauguaaaacucuguauuaaaacuauuccacauauccuaaaauuucagcuugcc

SEQ ID NO: 50388 - RNA, 64 nt, Homo Sapiens
gaggccuucccauccagcucuucuucccgcacaaauuccacauagccuuuuuuuuccuauuuau

SEQ ID NO: 50389 - RNA, 64 nt, Homo Sapiens
auucucugccuuuuuuuuccuuuuaaaaaaaacaauuccacacuuggauuuguauuacacacag

SEQ ID NO: 50390 - RNA, 64 nt, Homo Sapiens
aucaucauuuaaaaaaaaagauggaaguaaaggcauuccacagguguuacaauauuaggugaau

SEQ ID NO: 50391 - RNA, 64 nt, Homo Sapiens
acgaaugcauauucaacacacucuguggugguucauuccacaggguguaugguaucauguaucu

SEQ ID NO: 50392 - RNA, 64 nt, Homo Sapiens
augcaauauuucucugaguauguauuuccauguuauuccacaaugaccuuuagaguuaagccuu

SEQ ID NO: 50393 - RNA, 64 nt, Homo Sapiens
guauuguuaauguacaacaccaucggguguuucuauuccacagaaggcuaaaaauauugcaggg

SEQ ID NO: 50394 - RNA, 64 nt, Homo Sapiens
ggcucuugaauuaauaaaauuauagucucuaagaauuccacauuuuauggaaaguuagagcaaa

SEQ ID NO: 50395 - RNA, 64 nt, Homo Sapiens
cugaguuuucaucggucuucacaugcugcuauauauuccacagaguuccuugcauguacugagc

SEQ ID NO: 50396 - RNA, 64 nt, Homo Sapiens
uguauuccauauauauauucccauauauguauauauuccacauaauauguauauauuccauaua

SEQ ID NO: 50397 - RNA, 64 nt, Homo Sapiens
uguauacauuccauguauguccacguguguauauauuccacauaaguccccauauguauacauu

SEQ ID NO: 50398 - RNA, 64 nt, Homo Sapiens
uguauacauuccacguguguuuccacauguauauauuccacauaauauauuccacguguaugua

SEQ ID NO: 50399 - RNA, 64 nt, Homo Sapiens
uauauauuccacauauguauuuccacguguauguauuccacaugauauuccacauguguauaua

SEQ ID NO: 50400 - RNA, 64 nt, Homo Sapiens
uguauauauuccacguguauuguauguggaauauauuccacaugauacauauauuccacaugug

SEQ ID NO: 50401 - RNA, 64 nt, Homo Sapiens
uguguauguggaauauauucuguauguggaauauauuccacaugauacauauauuccacaugug

SEQ ID NO: 50402 - RNA, 64 nt, Homo Sapiens
uguguauguggaauauauacauauauauacauauauuccacaugaugauggccaagguaguucc

SEQ ID NO: 50403 - RNA, 64 nt, Homo Sapiens
aauuaaacugggcaauagccuaagaaggggggaauauuguaacacaaauuuaaacccacuacgc

SEQ ID NO: 50404 - RNA, 64 nt, Homo Sapiens
uaguuaugaagaaaacaaugucauuugcugcuauuauuguaagagucuuauaauuaaugguacu

SEQ ID NO: 50405 - RNA, 64 nt, Homo Sapiens
ccugccaaacuacuagucacuuuacauccucagguauuguaaccacugggccuuccaacuuugc

SEQ ID NO: 50406 - RNA, 64 nt, Homo Sapiens
uacauccaucaauaccauuccauuuaaaaugggcuauuguaauuuacccacauuaucacauuuu

SEQ ID NO: 50407 - RNA, 64 nt, Homo Sapiens
augucuuucaauuuaaauucacuucaguuuuuguuauuguaauauauuuacuuuuacaugguua

SEQ ID NO: 50408 - RNA, 64 nt, Homo Sapiens
uucccucuuuggggcaaauucuuauaaaaauguuuauuguaaaguuauauauuuugucuacgau

SEQ ID NO: 50409 - RNA, 64 nt, Homo Sapiens
gaguugcuucugagguacauuuugaaugacagcauauuguaagaaaaaaaaaggugaauaaaau

SEQ ID NO: 50410 - RNA, 64 nt, Homo Sapiens
uacuuuaaaugccaauuacagugcaaucuuuauuuauuguaaaauuuuuuaaguguacuuaugu

SEQ ID NO: 50411 - RNA, 64 nt, Homo Sapiens
aacucuaggagaaaaagaaaaucauguuuuccuguauuguaaauuuuagacuauuucauauaca

SEQ ID NO: 50412 - RNA, 64 nt, Homo Sapiens
ucuuaucucuguauacuguauuacacacacaguauauuguaaauuuuuaaggcucuguuagaaa

SEQ ID NO: 50413 - RNA, 64 nt, Homo Sapiens
acaaaauugcaugcgggauugaaaugcuccugauuauuguaaauauugcuguggaauaaaagau

SEQ ID NO: 50414 - RNA, 64 nt, Homo Sapiens
uauguuuuauagaccuacacuagugccaggucacuauuguaagauguuaaaaucucaagaaaau

SEQ ID NO: 50415 - RNA, 64 nt, Homo Sapiens
acaaaaauugaauugcauuuugugcucaguuguuuauuguaauuuuauuuuuguuacauuaaua

SEQ ID NO: 50416 - RNA, 64 nt, Homo Sapiens
aagaaaucuuuccugugaaguuaaaucagcaaaauauuguaauauuucccuuguauuuuuauaa

SEQ ID NO: 50417 - RNA, 64 nt, Homo Sapiens
uuuugagucugguuucauuguuagauuuucuuccuauuguaaacuugaaauaccuagaugaagu

SEQ ID NO: 50418 - RNA, 64 nt, Homo Sapiens
uuuccauguuaaugaucuaaaacauuaagggccauauuguaagaaggaacaaauaaagacaaac

SEQ ID NO: 50419 - RNA, 64 nt, Homo Sapiens
uagaauuucgaagagacauuaacuucucugucuauauuguaauaaacucaagcccucaaggccc

SEQ ID NO: 50420 - RNA, 64 nt, Homo Sapiens
cagaggcucccauuggaauggacaucuaaccugguauuguaaggauuuagggguucugggcaca

SEQ ID NO: 50421 - RNA, 64 nt, Homo Sapiens
uuccuacuucuuugauaaaaaucucuagaauucuuauuguaauuuaggucuguaauuuauagag

SEQ ID NO: 50422 - RNA, 64 nt, Homo Sapiens
auuuagaaaucacuuuaagauaaaugaacaaaauuauuguaagucuucuaaacuugguuuauug

SEQ ID NO: 50423 - RNA, 64 nt, Homo Sapiens
cuuaguuuagaucuccaucaucaauuccacuuacuauuguaauaccuucagcuggagccugugu

SEQ ID NO: 50424 - RNA, 64 nt, Homo Sapiens
auuagugguuuacaaugcgcgcuuuuuuuuuugcuauuguaaauggccaaaaugcauuuuauga

SEQ ID NO: 50425 - RNA, 64 nt, Homo Sapiens
auucuucccugcaguccaaguuuuaauugccuuguauuguaagucaacuuuuuucuuuuuuuuu

SEQ ID NO: 50426 - RNA, 64 nt, Homo Sapiens
ccauugaucccguaucuuaaacuuucauugucuuuauuguaacucuguguauuaauaaauuguc

SEQ ID NO: 50427 - RNA, 64 nt, Homo Sapiens
ugcgugugccagacaccgggagagcagauugucauauuguaacaacacucaggugcucacaaau

SEQ ID NO: 50428 - RNA, 64 nt, Homo Sapiens
cuagcacuuugggaggccaaaacauaaaauccaauauuguaaucauaaaggacaggcuggugcu

SEQ ID NO: 50429 - RNA, 64 nt, Homo Sapiens
acuggacucaggaacuuuugugcuagugcuguaauauuguaaauaugaguuguagacacugauc

SEQ ID NO: 50430 - RNA, 64 nt, Homo Sapiens
cauuuugguuucaggaggacaugaauaguguguuuauuguaacuccucauacacuuuuaaaacc

SEQ ID NO: 50431 - RNA, 64 nt, Homo Sapiens
auauaacaaaaaugaauuuuguuugauagauuuauauuguaaccuuuuucuaguucuugaauaa

SEQ ID NO: 50432 - RNA, 64 nt, Homo Sapiens
uuugugguaauuuggcaacuugagcucucccaauuauuguaauauaaggacagacauaauagua

SEQ ID NO: 50433 - RNA, 64 nt, Homo Sapiens
gcugcuuuuucccuuugauauaguugaaagaauguauuguaaauuggcauacaauacugccuuu

SEQ ID NO: 50434 - RNA, 64 nt, Homo Sapiens
ugaacuaaucaaauacaauagauuauaaauuguguauuguaaauaaaaguucacucugugagug

SEQ ID NO: 50435 - RNA, 64 nt, Homo Sapiens
uauuacacaaaauuacuuugugguaaacagacaguauuguaaucccaucaaaagaugaaagaaa

SEQ ID NO: 50436 - RNA, 64 nt, Homo Sapiens
cucaguggauagcacucaauuuauuccguagugauauuguaacaauacugccauucccuucuac

SEQ ID NO: 50437 - RNA, 64 nt, Homo Sapiens
ucuaugguugacaauggaguuuugugauccugcuuauuguaacugacaacuguuuucaacucca

SEQ ID NO: 50438 - RNA, 64 nt, Homo Sapiens
gcacuguuauuuugagaugucauacuguacacuguauuguaaaaauaaaaaguaaaauuauauu

SEQ ID NO: 50439 - RNA, 64 nt, Homo Sapiens
cuuaaagagugaaaaccauguaaacuauugaaacuauuguaauccauuaaugcuuuuuuagaau

SEQ ID NO: 50440 - RNA, 64 nt, Homo Sapiens
guuuuaugauuuaaagcaucugguuugcauauuguauuguaauacugauacaguuuggcugugu

SEQ ID NO: 50441 - RNA, 64 nt, Homo Sapiens
auuuugucaaagauguacugauugaaagguggaauauuguaaaagccuuuuuaagcuguuucau

SEQ ID NO: 50442 - RNA, 64 nt, Homo Sapiens
auauacuuuggcuguauugaaguaggcauuuuaauauuguaaacaacaugauuugaugcuauaa

SEQ ID NO: 50443 - RNA, 64 nt, Homo Sapiens
uuguuuuguggauaauugaaauauuuuuauaaaguauuguaauaauaaugguagccuaaacuua

SEQ ID NO: 50444 - RNA, 64 nt, Homo Sapiens
uuucuaagcauauucaaaaguaugugaacuaugauauuguaauuaugagauuuuuuaagggcuu

SEQ ID NO: 50445 - RNA, 64 nt, Homo Sapiens; identical to SEQ ID NO: 45461

SEQ ID NO: 50446 - RNA, 64 nt, Homo Sapiens; identical to SEQ ID NO: 45462

SEQ ID NO: 50447 - RNA, 63 nt, Homo Sapiens
gguuuuucccaccccagcugccccagcacgcgggacccauagcacaccccuuagcgcuugccu

SEQ ID NO: 50448 - RNA, 63 nt, Homo Sapiens
aggaaggaagcacaaaagacaagcauugggucagacccauaaaccaccucccaaaggcuguca

SEQ ID NO: 50449 - RNA, 63 nt, Homo Sapiens
ucaguaugucugaauuccagguaaaacacuucugacccauagcggggauuguuugcuuuuuaa

SEQ ID NO: 50450 - RNA, 63 nt, Homo Sapiens
guuuacucuuaaaauuguguucaaggauaugcugacccauauauuacaaagucuacuuuuugu

SEQ ID NO: 50451 - RNA, 63 nt, Homo Sapiens
acauuaucauuuuuauaaguauguauucauguugacccauaaguuucuuucucucuugccaga

SEQ ID NO: 50452 - RNA, 63 nt, Homo Sapiens
gccuugaccacaucacuccauuugagguggagagacccauaaacuacccuagggcacuuucuc

SEQ ID NO: 50453 - RNA, 57 nt, Homo Sapiens
aggcuuuuaaggauucucugauucaaagacccauaaaagaaugccauucuacaauaa

SEQ ID NO: 50454 - RNA, 63 nt, Homo Sapiens
ugcaguuagaaaaagacaacccuuaaacauguggacccauaggccaaaaacaucuauuuguga

SEQ ID NO: 50455 - RNA, 63 nt, Homo Sapiens
acauauacauuaaaacauuuaaugaguaccuaugacccauaacaauaaauuaugaagcauacu

SEQ ID NO: 50456 - RNA, 63 nt, Homo Sapiens
ucuauauguauguguucccaaaucuuugguaaugacccauaucguugugaagccauuaauaua

SEQ ID NO: 50457 - RNA, 63 nt, Homo Sapiens
auuaaauacauaucauuuuuuuucccaaaacaugacccauaguauaauauauccuaugcugau

SEQ ID NO: 50458 - RNA, 63 nt, Homo Sapiens
caaacuauguugguaguagaauaaucggauucagacccauaaccaaguucaaauaaaauuuuu

SEQ ID NO: 50459 - RNA, 63 nt, Homo Sapiens
gauuuuaguaacaucuugcuuuuguauguuacugacccauaugaaaauaauuucaucagguuu

SEQ ID NO: 50460 - RNA, 63 nt, Homo Sapiens
ggaaaguucuagaagcaauaacacuuaaauucugacccauaaagccucaauauuugucugaag

SEQ ID NO: 50461 - RNA, 63 nt, Homo Sapiens
aaaaacucuugcuaccuguauuacuugaucucagacccauaccugaugguucagucuguccuu

SEQ ID NO: 50462 - RNA, 63 nt, Homo Sapiens
aaugucauucucaaugcccagauccugagauuggacccauacccugucuccaacccugccuug

SEQ ID NO: 50463 - RNA, 63 nt, Homo Sapiens
ccaacccugacugcccacuccuccacaaaccgugacccauagccgcccccaccccauaccuug

SEQ ID NO: 50464 - RNA, 63 nt, Homo Sapiens
caaacuucgagcccaucagcgguccuuugauaagacccauaggcuagucagggaggggauggc

SEQ ID NO: 50465 - RNA, 63 nt, Homo Sapiens
acucuuguuugcuuugaaaaaucccuguacucugacccauagcccuguugaccuucccacaca

SEQ ID NO: 50466 - RNA, 63 nt, Homo Sapiens
ugguuuuaacacuaacuagaaccaugccaggaagacccauaacuauccacguguggauuaucc

SEQ ID NO: 50467 - RNA, 63 nt, Homo Sapiens
gccagcacacugcuaaccagucaccaaauguaagacccauaagaaacccauauuuaaaaaucu

SEQ ID NO: 50468 - RNA, 63 nt, Homo Sapiens
uucaaaaacaaaucagaagcagaugcugauugggacccauauaccacguugcugacucacguu

SEQ ID NO: 50469 - RNA, 63 nt, Homo Sapiens
acaucuacaaguaaguacagcugaaauucagaggacccauaagaguucacaugaaaaaaauca

SEQ ID NO: 50470 - RNA, 63 nt, Homo Sapiens
ugugucccagacagauccccuaggccuaucugagacccauacaggcccacaccugagcuccug

SEQ ID NO: 50471 - RNA, 63 nt, Homo Sapiens
gauuacguguauguuucuucuuucuuuuaagcagacccauaccuuuccagggucaaaguacag

SEQ ID NO: 50472 - RNA, 63 nt, Homo Sapiens
agguuguacaaaccuuaagguuuuuuccuuauggacccauacuccuaaccauuucuacuacag

SEQ ID NO: 50473 - RNA, 63 nt, Homo Sapiens
aucuaccuugguaggagggagucaguacuguuggacccauagguagccucaucccugccacug

SEQ ID NO: 50474 - RNA, 63 nt, Homo Sapiens
caauggugagcagacugcaaaucugccugauaggacccauauucccacagcacuaauucaaca

SEQ ID NO: 50475 - RNA, 63 nt, Homo Sapiens
aaauaaguugucuuuacugaaaaaugaagugaagacccauauaugcaguuaaaaaaaaguuaa

SEQ ID NO: 50476 - RNA, 63 nt, Homo Sapiens
cccaagucccagcccagaaccucuuucauuggugacccauaacuccuccuccucuuccccucc

SEQ ID NO: 50477 - RNA, 63 nt, Homo Sapiens
caggucagaagaaugauggaugguguccagcaugacccauaaaauuuaugugauguggauugc

SEQ ID NO: 50478 - RNA, 63 nt, Homo Sapiens
aggaacagaaacaacuuugcauugcauuggcuugacccauaaacuaaguuauauccgugggca

SEQ ID NO: 50479 - RNA, 63 nt, Homo Sapiens
cuuuaaaacaucuacccuaaaccaucugcuauggacccauaauaagaggccuguuguauauga

SEQ ID NO: 50480 - RNA, 63 nt, Homo Sapiens
auccccuugucgaaaacuagaaaaaaaggaguugacccauauaaauuaucucuaacgucuuug

SEQ ID NO: 50481 - RNA, 63 nt, Homo Sapiens
cgucugcucaggaaguggggccagcuccacugggacccauaguuuuacuuccuugucauuuga

SEQ ID NO: 50482 - RNA, 63 nt, Homo Sapiens
ugaacuauuagacaugaaauacugcaugcucaggacccauagauagacaaaggcucuacacau

SEQ ID NO: 50483 - RNA, 63 nt, Homo Sapiens
uggagaagguguacaacuuucuucuuccacaaagacccauaucucuucauucuccuucuucuc

SEQ ID NO: 50484 - RNA, 63 nt, Homo Sapiens
agguucuuucauucaagaucaucauucuugacagacccauaaauauuuccuauaaagacugua

SEQ ID NO: 50485 - RNA, 63 nt, Homo Sapiens
ucuucugaaaugaaacaaauuggcgggcagugggacccauagaugagaaccaggagacacgug

SEQ ID NO: 50486 - RNA, 63 nt, Homo Sapiens
agcuuugucucugucacaucauugaagguuuuagacccauagcugagugucauuaguuacuuu

SEQ ID NO: 50487 - RNA, 63 nt, Homo Sapiens
ucagacccgacggcccggaggagacucagcaacgacccauaccaacgcgcggccggggcggga

SEQ ID NO: 50488 - RNA, 63 nt, Homo Sapiens
cgccaaguaagauuuuaaaacaaaccacgccaugacccauauacagaaugauuuccaaaauug

SEQ ID NO: 50489 - RNA, 63 nt, Homo Sapiens
uuauuuauagagagcacacagaccucccauuuggacccauaguuuuuuucucccgucuucaau

SEQ ID NO: 50490 - RNA, 63 nt, Homo Sapiens
cguuucugauucagaaucagaccuauuucaccugacccauacuuguguaaacauagggugccu

SEQ ID NO: 50491 - RNA, 63 nt, Homo Sapiens
uuuaacucuucccagggaaacuucacuuuguaagacccauauuggcuucucaccuguggccaa

SEQ ID NO: 50492 - RNA, 63 nt, Homo Sapiens
uucauauggcugcuccagccuagaauucauugagacccauagcggcuugaagacaaauggucu

SEQ ID NO: 50493 - RNA, 63 nt, Homo Sapiens
agugacgccuguggagcgcgauaauuaaagauggacccauaaguacuuuuauuaauauuuaac

SEQ ID NO: 50494 - RNA, 63 nt, Homo Sapiens
cucuuacuguacugucuaucugcaguaauugaggacccauaaaauuuagauaacuacaugucu

SEQ ID NO: 50495 - RNA, 63 nt, Homo Sapiens
aaaucuuguccagagacaaggaaugaucaaggggacccauaggagaaaccccaaacucaggcc

SEQ ID NO: 50496 - RNA, 63 nt, Homo Sapiens
ggcuugccuguuuccgcuacucuaaggggaagggacccauagacucguucccuacccuaaaau

SEQ ID NO: 50497 - RNA, 63 nt, Homo Sapiens
ggugcccuguagaacucuguuacacauauuuuugacccauauuauuuacaaugucuugauaau

SEQ ID NO: 50498 - RNA, 63 nt, Homo Sapiens
ccucuugcuugaaugugauuucuuucucccugagacccauaagguucaucuuaugggaccuua

SEQ ID NO: 50499 - RNA, 63 nt, Homo Sapiens
uauaccuuucagguacugaaauuuucuuccauugacccauauucuguaauaguuucaguuccu

SEQ ID NO: 50500 - RNA, 63 nt, Homo Sapiens
agaauuuuccaggucacagaagaggcuguguuggacccauagucucuccuacucucagugguc

SEQ ID NO: 50501 - RNA, 63 nt, Homo Sapiens
auuaggaaaaugcacauauuccaugaauuuuaagacccauagaaaaguugaagaaugcuuaau

SEQ ID NO: 50502 - RNA, 63 nt, Homo Sapiens
gccaaagucucccuucuguuucuucagcacauugacccauagcacacacauacacaccaccac

SEQ ID NO: 50503 - RNA, 63 nt, Homo Sapiens
ccgugugacgguggccuuggaggacccagcacugacccauagagggcuccucucagaugggca

SEQ ID NO: 50504 - RNA, 63 nt, Homo Sapiens
ccagccccaggcggaccagagggggcagcgugggacccauaucguuggguagagaagccagca

SEQ ID NO: 50505 - RNA, 63 nt, Homo Sapiens
uaccaacguagaauuuuucaaggccucauaaaugacccauaauuuaauaggaaaaugcuaagg

SEQ ID NO: 50506 - RNA, 63 nt, Homo Sapiens
aucagagaugggaaaaccauuggggaggacuaggacccauaugggaauuauuaccucucaggg

SEQ ID NO: 50507 - RNA, 63 nt, Homo Sapiens
cccugcuaccuuaguucugcaugagaaucagcugacccauacagacuugaaaccagagaacau

SEQ ID NO: 50508 - RNA, 63 nt, Homo Sapiens
gcuagacacuuugaggcaagcccuccauggagggacccauaggggcggcccuucucagccccu

SEQ ID NO: 50509 - RNA, 63 nt, Homo Sapiens
uuccgagagcguucaguguuucacugaagacaggacccauagccuucauuucuggcucugugu

SEQ ID NO: 50510 - RNA, 63 nt, Homo Sapiens
ugaacucuguugauaauaccacaccauguucuggacccauagcucuggcauccucagggguug

SEQ ID NO: 50511 - RNA, 63 nt, Homo Sapiens
uaaauaugcucuguguaaaggggaggagacagagacccauaacucugggaguuuuucugugug

SEQ ID NO: 50512 - RNA, 63 nt, Homo Sapiens
uuucaccuuguucccuuccauuugucucaccaggacccauaccuguucucaggccccccugcu

SEQ ID NO: 50513 - RNA, 63 nt, Homo Sapiens
uuuuaguggcuucuauguugcucuugauuaauagacccauauuucuuaucauuuugaaauggg

SEQ ID NO: 50514 - RNA, 63 nt, Homo Sapiens
ccauggccuguuaggaggcgcuuggggcuggcagacccauagagcugcugcuuuuucuugguc

SEQ ID NO: 50515 - RNA, 63 nt, Homo Sapiens
uuaucaaacuuugaaauugagcuuuuuagaaaggacccauaugaacuagugagagugccaagu

SEQ ID NO: 50516 - RNA, 63 nt, Homo Sapiens
ugccggugacaagcugucugugaaaucccagaggacccauaaguacagaaguuggguauuguc

SEQ ID NO: 50517 - RNA, 63 nt, Homo Sapiens
uccacgggaaagaggucgauggauuuaccccuggacccauaagucuguucauccugcugaagu

SEQ ID NO: 50518 - RNA, 63 nt, Homo Sapiens
cauguuuuaaagucaccuucgcaucccucccccgacccauagcccccaacuucccaaagagca

SEQ ID NO: 50519 - RNA, 63 nt, Homo Sapiens
uguucccuuggggguguugaggccaggggaggagacccauaaaggggaugggauccuagguag

SEQ ID NO: 50520 - RNA, 63 nt, Homo Sapiens
guguuguaaaaaacacuuagauguguuuugugugacccauacaggucuuaauccuaucuaugg

SEQ ID NO: 50521 - RNA, 63 nt, Homo Sapiens
aggugcagcgggucacccuguggcccguccugugacccauauuuagccguguuugggacuccg

SEQ ID NO: 50522 - RNA, 63 nt, Homo Sapiens
gaggaaguaagucagggcgggcuuugagaaggggacccauauccuacaggcaaaaagcaggcu

SEQ ID NO: 50523 - RNA, 63 nt, Homo Sapiens
uaaagguugaauuauauuuucccccauauuauugacccauagugacaccaguuuugggagaug

SEQ ID NO: 50524 - RNA, 63 nt, Homo Sapiens
cagcccugggggagccucuuaauaucaaacacggacccauagacguucccaaagauccaccca

SEQ ID NO: 50525 - RNA, 63 nt, Homo Sapiens
ucccuaccucccaccaccuagauugugaagacggacccauauauuaaauaaggaagaggccca

SEQ ID NO: 50526 - RNA, 63 nt, Homo Sapiens
ucuucaauaaauauuuaaugagccaccacaccugacccauagggugcugggauuacaggugug

SEQ ID NO: 50527 - RNA, 63 nt, Homo Sapiens
gagguaaagcuguugggggaagaagaguuuuuggacccauagauguuuggaugaugucucuaa

SEQ ID NO: 50528 - RNA, 63 nt, Homo Sapiens
gguuuuagcaggggaggggaccugcuaagcugagacccauaguccugcucagaguuaucccaa

SEQ ID NO: 50529 - RNA, 63 nt, Homo Sapiens
gcugaugggagcagcugguggaggggugcuggagacccauagacacacgccugccagaagcug

SEQ ID NO: 50530 - RNA, 63 nt, Homo Sapiens
aaucccaucagugucgucccagcuuuauuuacagacccauaaaaacuccagugggaaagaaag

SEQ ID NO: 50531 - RNA, 63 nt, Homo Sapiens
uuuaacugaaaagggccaaauugaacuguacuggacccauagugaagcccuaauaucuauaau

SEQ ID NO: 50532 - RNA, 63 nt, Homo Sapiens
gccagaggcaucuuuugagccauacgaauuccugacccauagaaacugcaagacaauaaaugu

SEQ ID NO: 50533 - RNA, 63 nt, Homo Sapiens
uguuuauaguauccauccugaaccauucguuuugacccauaauaauagugauaguauaauggc

SEQ ID NO: 50534 - RNA, 63 nt, Homo Sapiens
uaaggaaacaucaccuguccccacuuauuaauggacccauaacuggaaacugucgacggccau

SEQ ID NO: 50535 - RNA, 63 nt, Homo Sapiens
ccaguccacuguuauacccgugcuugaccccuggacccauaaaacugucggaguucuaucacu

SEQ ID NO: 50536 - RNA, 64 nt, Homo Sapiens; identical to SEQ ID NO: 50134

SEQ ID NO: 50537 - RNA, 64 nt, Homo Sapiens; identical to SEQ ID NO: 50135

SEQ ID NO: 50538 - RNA, 64 nt, Homo Sapiens; identical to SEQ ID NO: 50136

SEQ ID NO: 50539 - RNA, 64 nt, Homo Sapiens; identical to SEQ ID NO: 50137

SEQ ID NO: 50540 - RNA, 64 nt, Homo Sapiens; identical to SEQ ID NO: 50138

SEQ ID NO: 50541 - RNA, 64 nt, Homo Sapiens; identical to SEQ ID NO: 50139

SEQ ID NO: 50542 - RNA, 64 nt, Homo Sapiens; identical to SEQ ID NO: 50140

SEQ ID NO: 50543 - RNA, 64 nt, Homo Sapiens; identical to SEQ ID NO: 50141

SEQ ID NO: 50544 - RNA, 64 nt, Homo Sapiens; identical to SEQ ID NO: 50142

SEQ ID NO: 50545 - RNA, 64 nt, Homo Sapiens; identical to SEQ ID NO: 50143

SEQ ID NO: 50546 - RNA, 64 nt, Homo Sapiens; identical to SEQ ID NO: 50144

SEQ ID NO: 50547 - RNA, 64 nt, Homo Sapiens; identical to SEQ ID NO: 50145

SEQ ID NO: 50548 - RNA, 64 nt, Homo Sapiens; identical to SEQ ID NO: 50146

SEQ ID NO: 50549 - RNA, 56 nt, Homo Sapiens; identical to SEQ ID NO: 50147

SEQ ID NO: 50550 - RNA, 64 nt, Homo Sapiens
uuccuuuuauaagauuuaauuguaauugucucaaagcaucaaauaauacaucuuuaucauuaaa

SEQ ID NO: 50551 - RNA, 64 nt, Homo Sapiens
uggacugcaauaucaacaacaaguuguuucaaacagcaucaaaauacaacuucauugcuacacu

SEQ ID NO: 50552 - RNA, 64 nt, Homo Sapiens
acaaucaaaagagcgauuugaagcauagcauuuuagcaucaacuccuuaaaaccacagauugca

SEQ ID NO: 50553 - RNA, 64 nt, Homo Sapiens
cuuuuucccuguuagaauucuuacucuuaaaucaagcaucaacaaaaacugaacacgauaacac

SEQ ID NO: 50554 - RNA, 64 nt, Homo Sapiens
ggccucauggaauggaaugucuccacuucacuccagcaucaacaaguggggaauucugauggau

SEQ ID NO: 50555 - RNA, 64 nt, Homo Sapiens
ucaguuuauaccuugccuguaguccagucucuccagcaucaauuccaucagcacaaagacauaa

SEQ ID NO: 50556 - RNA, 64 nt, Homo Sapiens
ccguuugagugucugcgccccgccuccccauacuuccugggaugaugugugaaaccugacaccu

SEQ ID NO: 50557 - RNA, 64 nt, Homo Sapiens
gcaaguuucaucagcccuagggaaaacacggcccuccugggaaccuccuuaccuggaguaaccg

SEQ ID NO: 50558 - RNA, 64 nt, Homo Sapiens
ccaaacucacggaccacucgaggccugcaaaccuuccugggaggacaggcaggccagauggccc

SEQ ID NO: 50559 - RNA, 64 nt, Homo Sapiens
agaagcugauguuuugguguauugucagccaucguccugggacucggagacuauggccucgccu

SEQ ID NO: 50560 - RNA, 64 nt, Homo Sapiens
auccagccaaaucuugcgacccaucccccaagccuccugggaggggguccagccaagcugugcc

SEQ ID NO: 50561 - RNA, 64 nt, Homo Sapiens
gaggccaucucucuuccagaaugggacccaugucuccugggacaccagcuaugcccagugcugc

SEQ ID NO: 50562 - RNA, 64 nt, Homo Sapiens
ccaggucagugauguagucuuccucuccugcugcuccugggauaacaacuccuccuccuccucc

SEQ ID NO: 50563 - RNA, 64 nt, Homo Sapiens
ccugucugccccuucccaccgcuacaaagaggucuccugggaacgagauaguaacugagcaggg

SEQ ID NO: 50564 - RNA, 64 nt, Homo Sapiens
gacccucagagauccgcccaccugaacagaugaguccugggagaaggcuugguuccauuucuca

SEQ ID NO: 50565 - RNA, 64 nt, Homo Sapiens
ccucugacucagaacccucgacagcucagugcuguccugggaguugccucuggcagcugugcua

SEQ ID NO: 50566 - RNA, 64 nt, Homo Sapiens
augcuuuauaggauguggucaggaauucucuugauccugggauugggggccugggguucugguu

SEQ ID NO: 50567 - RNA, 64 nt, Homo Sapiens
cccgaaaaagguugucaugguagcaacccauguuuccugggaaaccugacugaugcaguuucca

SEQ ID NO: 50568 - RNA, 64 nt, Homo Sapiens
aaaugaaacuaaagaacaguaaaagagcaguacauccugggaggcuaguacacgcccuauuuaa

SEQ ID NO: 50569 - RNA, 64 nt, Homo Sapiens
gucagauucuucuaaaucagccaagaauucuguauccugggacacccaguuccacaagauccaa

SEQ ID NO: 50570 - RNA, 64 nt, Homo Sapiens
uccuuaaagccccuaaccauccagaauccuauuuuccugggaagccacccccagcaaccccauc

SEQ ID NO: 50571 - RNA, 64 nt, Homo Sapiens
aguucuaagaagcuugcauuagcauugccuguguuccugggaaguggguacccaggaaacugca

SEQ ID NO: 50572 - RNA, 64 nt, Homo Sapiens
uaugcgcaguaaccuaacuuuggaggggacaaucuccugggagcaaaagaaugagugggagaaa

SEQ ID NO: 50573 - RNA, 64 nt, Homo Sapiens
cugugacugaaaggacccaggagucugggaccccuccugggauccccagcacauucuccugcuc

SEQ ID NO: 50574 - RNA, 64 nt, Homo Sapiens
gaccccuccugggauccccagcacauucuccugcuccugggagaggccugggggcggugcucac

SEQ ID NO: 50575 - RNA, 64 nt, Homo Sapiens
gccaauuucagcacccaacugagauccgaggagcuccugggaagcccugggugcaggacacugg

SEQ ID NO: 50576 - RNA, 64 nt, Homo Sapiens
ggaagacuccccugccuccccagggccucugcucuccugggagacaaagcaauaauaaaaggaa

SEQ ID NO: 50577 - RNA, 64 nt, Homo Sapiens
uggugucguugggaagcuuauacuggaucuucuuuccugggacaugcuaaaggccucugcuucu

SEQ ID NO: 50578 - RNA, 64 nt, Homo Sapiens
cagugaucucuacuggcccagucuugccucugguuccugggaucagacucagaaauucgucuuu

SEQ ID NO: 50579 - RNA, 64 nt, Homo Sapiens
gagacacugguggggagcuggcaaugaaacccuguccugggacauggguuucauguucuuguac

SEQ ID NO: 50580 - RNA, 64 nt, Homo Sapiens
cacgggagcucuaggugggcacaaccaaccccucuccugggaggccccugccccacuggggaua

SEQ ID NO: 50581 - RNA, 64 nt, Homo Sapiens
aggagguacacagccaucauacgcccucagguacuccugggaaacugugaauccucaggcugug

SEQ ID NO: 50582 - RNA, 64 nt, Homo Sapiens
acaguuggcuacaggccucuagaccaucagccucuccugggagccaaagguuuaaacacccagg

SEQ ID NO: 50583 - RNA, 64 nt, Homo Sapiens
uuacggaagugaugggugccuguccucuccugccuccugggauucagacggugaagacugacuu

SEQ ID NO: 50584 - RNA, 64 nt, Homo Sapiens
ugaguuguugcuggaagaucuaauaagcuguguuuccugggaaguggugcuuuacuuagcccug

SEQ ID NO: 50585 - RNA, 64 nt, Homo Sapiens
gaugcucuaaaaauccaccucccuuugggcgaaauccugggaguggaggucacugguucaggcu

SEQ ID NO: 50586 - RNA, 64 nt, Homo Sapiens
gcuucccucugcuggugcccgguccauccggcaguccugggacggcaggcugaguuuggagcag

SEQ ID NO: 50587 - RNA, 64 nt, Homo Sapiens
acucugaugcagggcgucugcuccuuuggacuauuccugggaggguauaaaggggcaagagcag

SEQ ID NO: 50588 - RNA, 64 nt, Homo Sapiens
ggccuccaaagcaaaggaucccuuuaccccaccuuccugggaaagaagcagggagcaaauccca

SEQ ID NO: 50589 - RNA, 64 nt, Homo Sapiens
auuguaauggaauaugauuuucugucuaaugaaguccugggacuggaggcuuaauuacugggag

SEQ ID NO: 50590 - RNA, 64 nt, Homo Sapiens
ugcacguuuggugauguugcaauucuaaaaugaauccugggaaauauuauuaaauuuucaugag

SEQ ID NO: 50591 - RNA, 64 nt, Homo Sapiens
gguagccuucaagcuuguccuucagccgugguccuccugggaccacagagcggguggcuguggc

SEQ ID NO: 50592 - RNA, 64 nt, Homo Sapiens
cgcuccauguucagggucuaauccaagcauuuucuccugggaccccccaauuccccaccagcca

SEQ ID NO: 50593 - RNA, 64 nt, Homo Sapiens
cugcgguuugcagugccagcugcacguuggagucuccugggaagcuucuaguguugaucucccu

SEQ ID NO: 50594 - RNA, 64 nt, Homo Sapiens
cugcccugcacaccaccacauuggaccugugcuguccugggaggugguguuggaggccccauga

SEQ ID NO: 50595 - RNA, 64 nt, Homo Sapiens
guuuucucauugaaugggggugggggcucguguguccugggaaaccccaucagucccuucauuu

SEQ ID NO: 50596 - RNA, 64 nt, Homo Sapiens
accccaucagucccuucauuucuugagacucaacuccugggaggagagggucucaagaguuguc

SEQ ID NO: 50597 - RNA, 64 nt, Homo Sapiens
ggugaagcuaggcaucuggacccuuccuuccuucuccugggacuugccaggccucugcccaugc

SEQ ID NO: 50598 - RNA, 64 nt, Homo Sapiens
guccuccacccuguccuguguguuguggagggacuccugggacagccacugggaccaggccucc

SEQ ID NO: 50599 - RNA, 64 nt, Homo Sapiens
gcugucgggagcuguaucacucgacccucugucguccugggaugggggcuuccgagggucuccc

SEQ ID NO: 50600 - RNA, 64 nt, Homo Sapiens
augggguccugucccaaggaaucacuccccacucuccugggauaccccaggaauggacccccca

SEQ ID NO: 50601 - RNA, 64 nt, Homo Sapiens
uggggaggaagccccaucucugccucugccuuuauccugggagaaacagcuccucuuccagagc

SEQ ID NO: 50602 - RNA, 64 nt, Homo Sapiens
ugcuccaggcaugugggaaggugagcccggauccuccugggagcggccaaggcuuucuccaaaa

SEQ ID NO: 50603 - RNA, 64 nt, Homo Sapiens
ccucagcuuucccuccucgcuggccugggcacccuccugggagcaggccuuccucccucccacc

SEQ ID NO: 50604 - RNA, 64 nt, Homo Sapiens
cuccccacacagcugggacuggccuggauggcuguccugggagccccugcccacccugacagag

SEQ ID NO: 50605 - RNA, 64 nt, Homo Sapiens
ucuggccuuuuaauuccuccucugccaggguggguccugggaccucuaaugugggcaugucguc

SEQ ID NO: 50606 - RNA, 64 nt, Homo Sapiens
uugggauuucuucucagcuuauucccaguagcuguccugggacuccagguggacugccucucuc

SEQ ID NO: 50607 - RNA, 64 nt, Homo Sapiens
gaucguggguuuugguggauuggcgccauugcuguccugggauggcagaugccagcggcccagg

SEQ ID NO: 50608 - RNA, 64 nt, Homo Sapiens
accuccuuucguugauggccaaagcaaaggagaguccugggagcccacaagauccaggcagaag

SEQ ID NO: 50609 - RNA, 64 nt, Homo Sapiens
ucccaugauuuuuccacugagacaaauccuaggcuccugggaggcccuggcagaagccagaaca

SEQ ID NO: 50610 - RNA, 64 nt, Homo Sapiens
uugcaguucgugaccagcugcuccagacccccgcuccugggauucgccuaccucaagccuccau

SEQ ID NO: 50611 - RNA, 64 nt, Homo Sapiens
ugccagggaccuucagcucccagaggcagugugguccugggaaugugaccaacaugccagguga

SEQ ID NO: 50612 - RNA, 64 nt, Homo Sapiens
ugguaugcuuuggggcuggguuccccagauaguguccugggacaaggcugaggaauuuccuggc

SEQ ID NO: 50613 - RNA, 64 nt, Homo Sapiens
auuuuguacaauauuuuguauuuucccucuuuuuuccugggaaugguucagggcugagcccuuc

SEQ ID NO: 50614 - RNA, 64 nt, Homo Sapiens
uauuuaaaaaaaaaaaaaaaaaacucacccguuuuccugggauuuguuguaaggaguuuucacu

SEQ ID NO: 50615 - RNA, 64 nt, Homo Sapiens
gugcagagugaacucugaugcaguaucagucuuguccugggagccggguccugcugcucacaag

SEQ ID NO: 50616 - RNA, 64 nt, Homo Sapiens
uuuccaggaagagccagcuuuucucggagcgcaguccugggacucuccgcagccccgccccgcc

SEQ ID NO: 50617 - RNA, 64 nt, Homo Sapiens
gcucaggccuggucauugccuccucagcacucccuccugggaggccuuagcucuagagugaggg

SEQ ID NO: 50618 - RNA, 64 nt, Homo Sapiens
uaggaauugcagccacugggcaguugggguggcuuccugggagaugagccgcgaccagguccug

SEQ ID NO: 50619 - RNA, 64 nt, Homo Sapiens
gggguggcuuccugggagaugagccgcgaccagguccugggaaggacuauggacucuuguugug

SEQ ID NO: 50620 - RNA, 64 nt, Homo Sapiens
gacauuccaaauaaagaauaggccccugccuggcuccugggagauaaccucuaagccauuagaa

SEQ ID NO: 50621 - RNA, 64 nt, Homo Sapiens
gcgaucccuacugaacgcuuuguuaucucguaccuccugggaugaaguuuccagagggaggugc

SEQ ID NO: 50622 - RNA, 64 nt, Homo Sapiens
gaaccauauagacauggacacaucuuugcucaacuccugggacugacuuccaggagcgugaaag

SEQ ID NO: 50623 - RNA, 64 nt, Homo Sapiens
ggcagacgagugaguuucacaguccugucucaucuccugggagaagggugggagauucuccucc

SEQ ID NO: 50624 - RNA, 64 nt, Homo Sapiens
agacaccagugcuccagcucaaguguuuucagauuccugggaacuacucuggagauagauggag

SEQ ID NO: 50625 - RNA, 64 nt, Homo Sapiens
ccucuccucuccugccgagaguggaacacgcguguccugggagcugcaucuuguguagggucca

SEQ ID NO: 50626 - RNA, 64 nt, Homo Sapiens
ugcacugcguggcugcccagccagcugccuccuguccugggaggaggccuccuggguguccuca

SEQ ID NO: 50627 - RNA, 64 nt, Homo Sapiens
ggcaccccagacccucuucagcuacagccacagguccugggaaagaagugggaucuagggcccu

SEQ ID NO: 50628 - RNA, 64 nt, Homo Sapiens
ggcugacaguggauauucuuguacccuucuuggguccugggaucucuugaaauccccaauaaag

SEQ ID NO: 50629 - RNA, 64 nt, Homo Sapiens
uguggauuuacuuuuuuuuuuuuuuuuuaaguuuuccugggauagggaugauaguguaauuguu

SEQ ID NO: 50630 - RNA, 64 nt, Homo Sapiens
gggaugauaguguaauuguucaugcccacaguaauccugggaaucuuaguuuuuuccuaugauu

SEQ ID NO: 50631 - RNA, 64 nt, Homo Sapiens
agaaugcuuuccuggaaaaagagagcagucugcauccugggaccgggucccugcucuguugccc

SEQ ID NO: 50632 - RNA, 64 nt, Homo Sapiens
ggcggcgggcccguccagcggcucugccgagugguccugggaauuccugcucacucagucccgg

SEQ ID NO: 50633 - RNA, 64 nt, Homo Sapiens
gcuccgggcaaaagcgggggcgaguguagagcgauccugggaaauccuuugauccgggagcccu

SEQ ID NO: 50634 - RNA, 64 nt, Homo Sapiens
gggacaggaucccugcugcaccuuccccacccccuccugggaagugcccccucaccucagggca

SEQ ID NO: 50635 - RNA, 64 nt, Homo Sapiens
gcaagagccccuuccaaagcucagcacaguuuccuccugggaugaggagaggaaucagaaaccc

SEQ ID NO: 50636 - RNA, 64 nt, Homo Sapiens
agguauuuaaaauaauaauaauaaaguguuauuuuccugggauucaugauauuugauauauucg

SEQ ID NO: 50637 - RNA, 64 nt, Homo Sapiens
ugucagcaaggagcagguaaucucuggagccagauccugggagcaaaauucccaguuuugccac

SEQ ID NO: 50638 - RNA, 64 nt, Homo Sapiens
ucugaggauugggauucuuuucaugagccaugaguccugggacagcugccuuagauuccguggg

SEQ ID NO: 50639 - RNA, 64 nt, Homo Sapiens
ggaaagugcuugccugaggugcagggagcugagguccugggagggccgucauccccauuucaaa

SEQ ID NO: 50640 - RNA, 64 nt, Homo Sapiens
gcgguggguggaaucccaagaggucuucagaguuuccugggaccagacgcccccuuuacccagg

SEQ ID NO: 50641 - RNA, 64 nt, Homo Sapiens
gguggcucagccucgaauccgaggugcugggcccuccugggaugccuguguuuggucugcccug

SEQ ID NO: 50642 - RNA, 64 nt, Homo Sapiens
guugcggggcccuguuuuggagggaaggugcacguccugggaugagucucugggcccugggaag

SEQ ID NO: 50643 - RNA, 64 nt, Homo Sapiens
uccccagcccaggaaaaacugaaggaaggggcuauccugggaccaacauguagggcaagaggau

SEQ ID NO: 50644 - RNA, 64 nt, Homo Sapiens
gggagaugucaggauguugcguccuagccaggucuccugggaaagacccuguccccuagggacu

SEQ ID NO: 50645 - RNA, 64 nt, Homo Sapiens
ucuuuuaaaaacuuucuagacguguuacaucaccuaaagagauuuuguuguuccuuagaguuuu

SEQ ID NO: 50646 - RNA, 64 nt, Homo Sapiens
uguuauuuucagguagugccauugauaaacuucuuaaagagaucaauauccucuacacuuaguu

SEQ ID NO: 50647 - RNA, 64 nt, Homo Sapiens
augcagagguugagaggaggacuugguugauguuuaaagagaaguucccagccaagggccucgg

SEQ ID NO: 50648 - RNA, 64 nt, Homo Sapiens
ugguacuauagcauuuugcuaucuuuuuuaguguuaaagagauaaagaauaauaauuaaccaac

SEQ ID NO: 50649 - RNA, 64 nt, Homo Sapiens
aaccaagucugaggaaauauuuggcuucauaaaguaaagagacgguuuggcauuuauuauuacu

SEQ ID NO: 50650 - RNA, 64 nt, Homo Sapiens
aauaauuuuggccucucauaguuuucucucucuuuaaagagaauaaauagagggccaggugugg

SEQ ID NO: 50651 - RNA, 64 nt, Homo Sapiens
uuccugucacauuauauuccauugguagcguauauaaagagaagacagugaauagugcucauaa

SEQ ID NO: 50652 - RNA, 64 nt, Homo Sapiens
agguguuucguuggguauugacauuucugaauaauaaagagaaaacaaacagauccauguuagg

SEQ ID NO: 50653 - RNA, 64 nt, Homo Sapiens
aagacaaaaauuuauguuuggagccuguguucuguaaagagaagguugauuugucuuuuagcua

SEQ ID NO: 50654 - RNA, 64 nt, Homo Sapiens
aaacagauaguuaugacucaaggcuuugagaauguaaagagaccaccuucacuuguugagaaau

SEQ ID NO: 50655 - RNA, 64 nt, Homo Sapiens; identical to SEQ ID NO: 50653

SEQ ID NO: 50656 - RNA, 64 nt, Homo Sapiens
aaacagauaguuaugacucaaggcuuugagaauguaaagagacgcccuucacauguugagaaau

SEQ ID NO: 50657 - RNA, 64 nt, Homo Sapiens
acaguaguuuuuuuauugaaacuuguauuauuuuuaaagagaucuauacuauaaauauggugau

SEQ ID NO: 50658 - RNA, 64 nt, Homo Sapiens
aucuuauguaaaugaaauuuugucauguuucaaauaaagagaacugaaguagaaaauagaaaug

SEQ ID NO: 50659 - RNA, 64 nt, Homo Sapiens
cuguuaccuucuacagaauuuaagucugaagauguaaagagagaacaggccuuguguaacagaa

SEQ ID NO: 50660 - RNA, 64 nt, Homo Sapiens
ucuuguguucccuguggucucugacccauuaggcuaaagagagacaagagaagcccccaaccug

SEQ ID NO: 50661 - RNA, 64 nt, Homo Sapiens
uucuuuugaaaguaugaaaaugauuuuuacaauguaaagagagucugagaaaugcaauugcuau

SEQ ID NO: 50662 - RNA, 64 nt, Homo Sapiens
gaauauuuguguaggugaaugcauuuugugaacuuaaagagaagaucauuuuucuuuucuucuu

SEQ ID NO: 50663 - RNA, 64 nt, Homo Sapiens
gcacugguccugacaauuuucucaccuccuacuguaaagagaauugaaccaacccaaccccuag

SEQ ID NO: 50664 - RNA, 64 nt, Homo Sapiens
augguaaauuuuugaguuguuuguuucuguuuuguaaagagaauccuuauuggacaccagugaa

SEQ ID NO: 50665 - RNA, 64 nt, Homo Sapiens
ugcugcauuuugaugaauuuuuucuagccauuuuuaaagagaaaacuaggaauugaguauuuug

SEQ ID NO: 50666 - RNA, 64 nt, Homo Sapiens
aggccaccugucccacuccuacgauacgcuacuauaaagagaagacgaaauagugacauaauau

SEQ ID NO: 50667 - RNA, 64 nt, Homo Sapiens
uuauuguuuuguuaauuacaccauaaugcuaauuuaaagagacuccaaaucucaaugaagccag

SEQ ID NO: 50668 - RNA, 64 nt, Homo Sapiens
uaaaaauaaacugauuuaauuugcucuauaguccuaaagagaauuauauccucucauagaccaa

SEQ ID NO: 50669 - RNA, 64 nt, Homo Sapiens
uuaucuuuaaagucaucugggaggugcagguaaguaaagagaaacaauuuuugucacaaaguag

SEQ ID NO: 50670 - RNA, 64 nt, Homo Sapiens
ucuuuuuguuuuaacuauugucaggagauugggcuaaagagaagacgacgagaguaaggaaaua

SEQ ID NO: 50671 - RNA, 64 nt, Homo Sapiens
acagucuugcacauaagugcagauuuggcucaaguaaagagaauuuccucaacacuaacuucac

SEQ ID NO: 50672 - RNA, 64 nt, Homo Sapiens
augccaaggcccccuccuccacagcucagagacauaaagagaagccagaagggguggcgaaggc

SEQ ID NO: 50673 - RNA, 53 nt, Homo Sapiens
aaagaggccagccacccaccuaauaaagagacaugaagcccuacucaauauaa

SEQ ID NO: 50674 - RNA, 64 nt, Homo Sapiens
agagaauugaauggcguuuauucccaaauucaauuaaagagaggaucccuuugucaaaccuugu

SEQ ID NO: 50675 - RNA, 64 nt, Homo Sapiens
aaagaccacuggagaccuaggcaguuaaaccaucuaaagagaagagagaaagaucaacucaccu

SEQ ID NO: 50676 - RNA, 64 nt, Homo Sapiens
acgauugcccugcauuucuaccaaguccugugaauaaagagaugggagauuugauuccgucaga

SEQ ID NO: 50677 - RNA, 64 nt, Homo Sapiens
gguguauguguuugagacaagcugguuuuguugauaaagagauguuaaauaauugugaagccag

SEQ ID NO: 50678 - RNA, 64 nt, Homo Sapiens
auaagccacucauucauucuugucucuaaauaaauaaagagacacaggcaacaaagugagcccc

SEQ ID NO: 50679 - RNA, 64 nt, Homo Sapiens
aaugaccagccugggcagcaauacacgugggaacuaaagagaaaugagaacgggaagcaaagga

SEQ ID NO: 50680 - RNA, 64 nt, Homo Sapiens
ggcugaugguuauugccuuaaggcacagaagaaaaguacagauauuuucucaauuuuacugagu

SEQ ID NO: 50681 - RNA, 64 nt, Homo Sapiens
cuucacuuagccuagggggcucaaagcagucacaaguacagacaagugaaugcuuagaaccuuc

SEQ ID NO: 50682 - RNA, 64 nt, Homo Sapiens
ucuuuuaagcagacccauaccuuuccagggucaaaguacagaauagaauacauugauacaaagu

SEQ ID NO: 50683 - RNA, 64 nt, Homo Sapiens
gggucaaaguacagaauagaauacauugauacaaaguacagaaaaauacuuugauuuuuaucca

SEQ ID NO: 50684 - RNA, 64 nt, Homo Sapiens
acuuuacucccuccuuuuucagacuuguuuguaaaguacagaaucugaauuuagccuuuaugau

SEQ ID NO: 50685 - RNA, 64 nt, Homo Sapiens
gcaccguuuuuucagugaagcucucagaauguccaguacagauguugcagauaauuccaagaac

SEQ ID NO: 50686 - RNA, 64 nt, Homo Sapiens
gcucguuugaggugacaguggcuguuuaccaacuaguacagagcgauucagcguuuucaugaau

SEQ ID NO: 50687 - RNA, 64 nt, Homo Sapiens
agccaggccucaucugggguagggccaagaggaaaguacagagugcccgugggggagaaguccc

SEQ ID NO: 50688 - RNA, 64 nt, Homo Sapiens
cugcgaucuuagaaauaauguuuuaugaaaauuaaguacagaggcuguugggaaaaguuuauaa

SEQ ID NO: 50689 - RNA, 64 nt, Homo Sapiens
aguuguagauuucaaauuuuugucugccacauugaguacagaaagaggggaaaaaaaucuaagc

SEQ ID NO: 50690 - RNA, 64 nt, Homo Sapiens
ugaugugcagaacauauuguuuuaaaaaaaaaaaaguacagaugacuccgucucaaaaaauaua

SEQ ID NO: 50691 - RNA, 64 nt, Homo Sapiens
uggccgggcacaguggcucagcuguacccuuaaaaguacagaugaaauuccuauguacuguaaa

SEQ ID NO: 50692 - RNA, 64 nt, Homo Sapiens
gcucacggugaaauaagcuugccaggaggcuggcaguacagagugcagcagcgagcaaauccug

SEQ ID NO: 50693 - RNA, 64 nt, Homo Sapiens
guccuguuaauucuagaucagagagcaagaaaaaaguacagaacauauccucuacgguuauuuc

SEQ ID NO: 50694 - RNA, 62 nt, Homo Sapiens
uaaaacuaaccgugaccacuacuccaaacaaaacacaauaugccuaggggcacggaugaacg

SEQ ID NO: 50695 - RNA, 62 nt, Homo Sapiens
cuaauguaguuagaaguuucauugucugauggacacaauaugcccuuccgguucuauucaaa

SEQ ID NO: 50696 - RNA, 62 nt, Homo Sapiens
uugauaaugcuuuuccaaagugaaaauaagauacacaauaaucauugcucugugugauuaca

SEQ ID NO: 50697 - RNA, 62 nt, Homo Sapiens
uuaauuguauuuuguguuuauacagguauuucacacaauaauuuguucuuaaugcagccacu

SEQ ID NO: 50698 - RNA, 62 nt, Homo Sapiens
uaaaucuuaauagauuuaaugcaauuuuacagacacaauaccuucaugaauuucaaaauuca

SEQ ID NO: 50699 - RNA, 62 nt, Homo Sapiens
acuugugcacugaaagcuaacagggagagguuacacaauauuuuacaguuucuuaaacauaa

SEQ ID NO: 50700 - RNA, 62 nt, Homo Sapiens
guuuuuucuuucccauguauacuauuuauaucacacaauauauuuuucuguaauguaaauaa

SEQ ID NO: 50701 - RNA, 62 nt, Homo Sapiens
guauuauagacaaaagaauaagagcuuggacuacacaauacaucacaguggcuggacuaccg

SEQ ID NO: 50702 - RNA, 62 nt, Homo Sapiens
uaggguauuugauacaaucauuaauggaucauacacaauagguuuuuaaaaauuaauaacuu

SEQ ID NO: 50703 - RNA, 62 nt, Homo Sapiens
uacaugaucugauacaaccauuaaugaaucauacacaauagguuuuuuaaaauuaauauuaa

SEQ ID NO: 50704 - RNA, 64 nt, Homo Sapiens
uuggacaagcuugcccuaggguuggacuucaugcgggccacaggaagaaaguuuaaaaauuugu

SEQ ID NO: 50705 - RNA, 64 nt, Homo Sapiens
uaaaacacacuaacacuaacggaagaauuuucuugggccacauguagcuucccuggaccgcauu

SEQ ID NO: 50706 - RNA, 64 nt, Homo Sapiens
uuagggcucuggaggugcuuucacucaaccaagggggccacagcacuggggagugaaacugccc

SEQ ID NO: 50707 - RNA, 64 nt, Homo Sapiens
ccgugcuugucucuagacgaggggaaugggggaagggccacaaccucuguuucugugacccagc

SEQ ID NO: 50708 - RNA, 64 nt, Homo Sapiens
acucaggauggucaucuuggagggaccaaggggugggccacagccauggugggaguggccugga

SEQ ID NO: 50709 - RNA, 64 nt, Homo Sapiens
cacagccauggugggaguggccuggaccugcccugggccacacugacccugauacaggcauggc

SEQ ID NO: 50710 - RNA, 64 nt, Homo Sapiens
gcccucacaccuccucgagugcccugggaccacugggccacagauggucaucaggggaagccac

SEQ ID NO: 50711 - RNA, 64 nt, Homo Sapiens
accugcuccauagcuccgggcgcugcgucccgaggggccacagucuccauuucagcgucuugca

SEQ ID NO: 50712 - RNA, 64 nt, Homo Sapiens
aaaaggaacguuuccaggcaggacaccggcucuagggccacaggcgugagagagcccccaccgu

SEQ ID NO: 50713 - RNA, 64 nt, Homo Sapiens
agaauaaggccuuggccccaugaaagauggagcugggccacaucacccuggaacauccccagag

SEQ ID NO: 50714 - RNA, 64 nt, Homo Sapiens
guaaaucacagguguccaaacuuuuggcuucccugggccacauuugaagaagaauuuucuuggg

SEQ ID NO: 50715 - RNA, 64 nt, Homo Sapiens
cuucccugggccacauuugaagaagaauuuucuugggccacauaaaauacacuaacgauagcug

SEQ ID NO: 50716 - RNA, 64 nt, Homo Sapiens
ugugggcccggcgcaugggcaccuggagcuucgggggccacagcgcacguggccccuggguugc

SEQ ID NO: 50717 - RNA, 64 nt, Homo Sapiens
cccccagcagguagcauuccagacccagcuguccgggccacagaacguuccuauacggcccccc

SEQ ID NO: 50718 - RNA, 64 nt, Homo Sapiens
aaucagaguucccagggccagacaggcucuuccugggccacagaggggaggcaucaggaaagcu

SEQ ID NO: 50719 - RNA, 64 nt, Homo Sapiens
ucucagcucccagcgaagccuccacaacagaauggggccacagggcagccgggacucccugucu

SEQ ID NO: 50720 - RNA, 64 nt, Homo Sapiens
gcagcccagggggcaggagauggcugccaggucugggccacaugugcagcuggugcaaaagcug

SEQ ID NO: 50721 - RNA, 64 nt, Homo Sapiens
gccgggguagaucugagcccaggacacuuguuuggggccacacagggugaggcucagagagcua

SEQ ID NO: 50722 - RNA, 64 nt, Homo Sapiens
uggaacaguccccugggugugccuucaccagcaagggccacagucccaggcuauggggacaaag

SEQ ID NO: 50723 - RNA, 64 nt, Homo Sapiens
cccucuuggcugccaagcacaaguccagcgugaagggccacagcccagaggguccaggcauccc

SEQ ID NO: 50724 - RNA, 64 nt, Homo Sapiens
acuucccacuggaaaucucuacauagccagggaggggccacaucagcgcaggggccagccaggg

SEQ ID NO: 50725 - RNA, 64 nt, Homo Sapiens
uuauagcuccaaaaacaaaaauauacuuguauaugucacagagaaaaaaaaugcaaaauuuaua

SEQ ID NO: 50726 - RNA, 64 nt, Homo Sapiens
gguacucguacugauaagggauuauuggaagucagucacagaauuuggaaauaaauucuagucu

SEQ ID NO: 50727 - RNA, 64 nt, Homo Sapiens
uuccucuaccacuuugcuggaaagcuucacaauugucacagacaaagauuuuuguuccaauacu

SEQ ID NO: 50728 - RNA, 64 nt, Homo Sapiens
auucuacuggugaaaaacaugcaaagaagaggaagucacagaaacaugucucaauucccaugug

SEQ ID NO: 50729 - RNA, 64 nt, Homo Sapiens
aguuacaugacaaagauaaauuuugaugaaaugagucacagagaagagaguagagucacacuuu

SEQ ID NO: 50730 - RNA, 64 nt, Homo Sapiens
agaauuugaucagaaucacacaaauuugaucagagucacagaguacuuaauagauuaacugucg

SEQ ID NO: 50731 - RNA, 64 nt, Homo Sapiens
uauucuugccuagcagugaagagaaaacuguucagucacagauacuggaaauauuggauucuug

SEQ ID NO: 50732 - RNA, 64 nt, Homo Sapiens
gcagcuacuuuauaagccccucuucaagcagaaugucacagaagauguuugggcaaagccuuug

SEQ ID NO: 50733 - RNA, 64 nt, Homo Sapiens
ugggaggggacuuaagaccugacaccugucaaaugucacagauccaccgagguccagaggaaaa

SEQ ID NO: 50734 - RNA, 64 nt, Homo Sapiens
cgccucugcuccuguggucccagacugcaugacagucacagacuccugcccuggcagcauggcu

SEQ ID NO: 50735 - RNA, 51 nt, Homo Sapiens
uaccgcugccaugggacuaacgucacagauuucuuuucugagaguugauga

SEQ ID NO: 50736 - RNA, 64 nt, Homo Sapiens
aucuauaguugcauuguugcaaucaaaauauguugucacagaaagaauagguggaaggucauag

SEQ ID NO: 50737 - RNA, 64 nt, Homo Sapiens
uaguuccgcaccucugagagguuuguccacauucgucacagauaggugcuuccgcugcuugaag

SEQ ID NO: 50738 - RNA, 64 nt, Homo Sapiens
ggcucgguggcccaggugguccuggcccucuguggucacagagggguggguucgggcuucaccg

SEQ ID NO: 50739 - RNA, 64 nt, Homo Sapiens
ggcucacacuuggcucugagggacagguguggcgagaccugauuucuccugcguguucucagag

SEQ ID NO: 50740 - RNA, 64 nt, Homo Sapiens
agaugauuuaaugguagaacggauaccugcugcuagaccugauggaauguuaccuguccguguu

SEQ ID NO: 50741 - RNA, 64 nt, Homo Sapiens
uuauuuuccuucuuuuggaguccucuuugauaucagaccugaugcaucucuacaggcucaaaac

SEQ ID NO: 50742 - RNA, 64 nt, Homo Sapiens
aauuuauagaaugugaagacuacuggugaauuacagaccugauguaugaugaugaucaugaucu

SEQ ID NO: 50743 - RNA, 64 nt, Homo Sapiens
uuaaacauuuaaauuuagcucugauaguguguuaagaccugaauaucuuuccuaguaaaaauag

SEQ ID NO: 50744 - RNA, 64 nt, Homo Sapiens
guucacaccuggucucacugccuuuccuucccacagaccugagugugaaagacugagaguugag

SEQ ID NO: 50745 - RNA, 64 nt, Homo Sapiens
gcauuuggauggugucuuagaacccucauugcucagaccugaaggcuacuucuaggagcaugaa

SEQ ID NO: 50746 - RNA, 64 nt, Homo Sapiens
aucaucucaguuggccaccuuccuggcaggcuguagaccugacauuuugagacaagccuagagg

SEQ ID NO: 50747 - RNA, 64 nt, Homo Sapiens
caaguggacagggaaggccucugacauuuauccaagaccugaaagaugggcaaaagacgggaag

SEQ ID NO: 50748 - RNA, 64 nt, Homo Sapiens
gaggcuccgcggcaggaggagccggugcucuggaagaccugaaagaagcccagguggccacagg

SEQ ID NO: 50749 - RNA, 64 nt, Homo Sapiens
uuugaaaucguauauaugagauguauuaaaauuuuugacuuaauacaauaacacucaaugaagg

SEQ ID NO: 50750 - RNA, 64 nt, Homo Sapiens
uuuaauucaaggauugaaaauuaauacacauuuguugacuuaaagccuagcauagagaaaauac

SEQ ID NO: 50751 - RNA, 64 nt, Homo Sapiens
aggaucaucuugugaauuugcgcgugccaagcaguugacuuaauauuguuaacuguagcuucag

SEQ ID NO: 50752 - RNA, 64 nt, Homo Sapiens
auuggaccaagacuaugaggucacugaagaacaguugacuuaaacugguggaaauucaaaguua

SEQ ID NO: 50753 - RNA, 64 nt, Homo Sapiens
agugaaacugucuuauaauaucugugccaugugauugacuuacacaguaagcccuccugggaug

SEQ ID NO: 50754 - RNA, 64 nt, Homo Sapiens
gaagauucuugugaaguuucauagcucuucuuuauugacuuaaacugagcauugugcaggacug

SEQ ID NO: 50755 - RNA, 64 nt, Homo Sapiens
gaaggaacagcucaaagcaccuucacaaguugccuugacuuacccuaggugggugugaaagagc

SEQ ID NO: 50756 - RNA, 64 nt, Homo Sapiens
guagccacuuuaauuuacaauuaagagccuuaguuugacuuaacacuuuuguaggcuuuucauu

SEQ ID NO: 50757 - RNA, 64 nt, Homo Sapiens
ugaaaagcugcauuuaaaucaagucccaaauucauugacuuaggggaguucaguauuuaaugaa

SEQ ID NO: 50758 - RNA, 64 nt, Homo Sapiens
uuaaugauaccauaaaucaauauuagaaagcuaguugacuuaaagccugaaauaaugggaguuu

SEQ ID NO: 50759 - RNA, 64 nt, Homo Sapiens
acuucaucacaucuuauagguaguguguggccaauugacuuaaaaaauacaaauaacauuuagg

SEQ ID NO: 50760 - RNA, 64 nt, Homo Sapiens
gaugcucccauggaauuuauaccaguuauaugaauugacuuaaguaucuugaaaaagaaacuuu

SEQ ID NO: 50761 - RNA, 64 nt, Homo Sapiens
uuuccuauugggccuuccccacaauuagaauauuuugacuuaguguccugucccccuuggacgu

SEQ ID NO: 50762 - RNA, 64 nt, Homo Sapiens
gacuuaguguccugucccccuuggacguuccaacuugacuuaguguccagugccccuuggacau

SEQ ID NO: 50763 - RNA, 57 nt, Homo Sapiens
gcuucaaacagcgcagauaaaugcaggcaagaaaagaugccgccguugcugccguca

SEQ ID NO: 50764 - RNA, 64 nt, Homo Sapiens
cuauuuuuguuuguuuauacaaauaucugauuugcaagaaaaagugcaugggagggguuuuagu

SEQ ID NO: 50765 - RNA, 64 nt, Homo Sapiens
gacuugaaaaucuuaaaaaaaaaaaacaaaaaaacaagaaaaggcaacaucucauuuuaaauag

SEQ ID NO: 50766 - RNA, 64 nt, Homo Sapiens
guauucauagacaaauuuuuuucaauauauuuugcaagaaaaaucuuugaauaagacuaacugc

SEQ ID NO: 50767 - RNA, 64 nt, Homo Sapiens
cuuuggccauugugggaagucauuauucuggagacaagaaaaucaucacucuggugccuuggug

SEQ ID NO: 50768 - RNA, 64 nt, Homo Sapiens
ugaauauuggggaaggaagaugauacuucuuucucaagaaaagaaaauuggauuauuaggaaua

SEQ ID NO: 50769 - RNA, 64 nt, Homo Sapiens
aacgggagcuauuucacagaacuaaguagggucccaagaaaaaaucccaaugggagcccacgga

SEQ ID NO: 50770 - RNA, 64 nt, Homo Sapiens
aacuaaggacucucaaaccauacuaccuaacgcccaagaaaaccgggguuccugguggauuucu

SEQ ID NO: 50771 - RNA, 64 nt, Homo Sapiens
aaucgacacuguggauugacaaagucugcaacuucaagaaaaaagguuugaggguuugccuucu

SEQ ID NO: 50772 - RNA, 64 nt, Homo Sapiens
uuauuggccuggguaagacuaaauucagaugaggcaagaaaauuuaauuaaucacauuugcagg

SEQ ID NO: 50773 - RNA, 64 nt, Homo Sapiens
augagaguuuuaacuagaugcugaaaauguguuacaagaaaaauugggcauuaaauuauacaaa

SEQ ID NO: 50774 - RNA, 64 nt, Homo Sapiens
augugucucuguuuacugaagaacaguuucaaaucaagaaaacuucuaguuucucaaguccuca

SEQ ID NO: 50775 - RNA, 64 nt, Homo Sapiens
ugcuuuuucuccauggaugaauuugcuguugccucaagaaaaagauuuuguaucagugcuguua

SEQ ID NO: 50776 - RNA, 64 nt, Homo Sapiens
ucagaauguaucacucuccuauucaacagaauaacaagaaaacuuaaguuuggaaguccuugcu

SEQ ID NO: 50777 - RNA, 64 nt, Homo Sapiens
ggaacucuagaauaucaagggagcaagaggaagccaagaaaacuuggguaaauaucugucuucu

SEQ ID NO: 50778 - RNA, 64 nt, Homo Sapiens
uuuucuuacucuaaaauaugugguagauaguaugcaagaaaagccgggugcgguggcucaggcc

SEQ ID NO: 50779 - RNA, 64 nt, Homo Sapiens
gguuguaguaaagaaauuuaaaagacacuguuuacaagaaaaaaugaauuuuguuuggacuucu

SEQ ID NO: 50780 - RNA, 64 nt, Homo Sapiens
auggguagagaaacacuaaagcauucaauuuauucaagaaaaguaagcccuugaagauaucuug

SEQ ID NO: 50781 - RNA, 64 nt, Homo Sapiens
agagaacaaaagcuauaccaaaagggccauguuucaagaaaauggauuuaaacauauuucccug

SEQ ID NO: 50782 - RNA, 64 nt, Homo Sapiens
cugaagugaacuaugaaguaagcaacaaggaugacaagaaaaacauggggaaacagaugccuca

SEQ ID NO: 50783 - RNA, 64 nt, Homo Sapiens
agauuaaaugcauacagaucacauggcaauaaggcaagaaaaagggcuguucuggaaguucuag

SEQ ID NO: 50784 - RNA, 64 nt, Homo Sapiens
agacucagaggggcugagucuuggcucuuacagacaagaaaacucaaugagaugcacgucauca

SEQ ID NO: 50785 - RNA, 64 nt, Homo Sapiens
aagucugggcaccgaaagagagcaucaaaaucaccaagaaaaacagcuucucaguuaagugaaa

SEQ ID NO: 50786 - RNA, 64 nt, Homo Sapiens
gaagcagggccaaauggaaagaacacauaauaaacaagaaaaaaacagaggugaagaaaaaucc

SEQ ID NO: 50787 - RNA, 64 nt, Homo Sapiens
ucaccuguucagccggcacugagaagaacgaacacaagaaaaagauaagaaauacuagaguaaa

SEQ ID NO: 50788 - RNA, 64 nt, Homo Sapiens
agaccauacugacucaacauggagucucacuggccaagaaaauugccuuuaaaacucgaaaaua

SEQ ID NO: 50789 - RNA, 64 nt, Homo Sapiens
uaacacccaaauuuuccuuuuacagaaacggucccaagaaaaucauauugugaagggcaaaggu

SEQ ID NO: 50790 - RNA, 64 nt, Homo Sapiens
aauuuuuuaaauaaguuuaagagcaagacugucucaagaaaaaagcacuccagccugggccaca

SEQ ID NO: 50791 - RNA, 64 nt, Homo Sapiens
aauaaaaaauuuauauauagagaucuucccaauacaagaaaauucucauccuggagcguauuca

SEQ ID NO: 50792 - RNA, 64 nt, Homo Sapiens
auuuauuuuguggaucuuugaugggggugggaaccaagaaaaauauaauuauuauuuggcaaua

SEQ ID NO: 50793 - RNA, 64 nt, Homo Sapiens
guaagaaauuauuuuugagagaaccauuuaucaucaagaaaaguccuauaaaauauauagccag

SEQ ID NO: 50794 - RNA, 64 nt, Homo Sapiens
gaaccaaagcuugcuuguuguccuuuguguaggacaagaaaauuagauucugcacucaaaaucu

SEQ ID NO: 50795 - RNA, 64 nt, Homo Sapiens
agauauuaagugcuuuuuaaaaaaugcuaacacccaagaaaagauagcaugauuuaaaaaauga

SEQ ID NO: 50796 - RNA, 64 nt, Homo Sapiens
aaugcacaaaaccacuuauuauguuauuggguaucaagaaaauuaagucuggauuuuaauuggc

SEQ ID NO: 50797 - RNA, 64 nt, Homo Sapiens
ggaauaauauucucuaaaccuaugugucauuucacaagaaaaaacuguaugcacacaguaugcu

SEQ ID NO: 50798 - RNA, 64 nt, Homo Sapiens
aaaacggaagaggagaaacuaaagaagaaaggaccaagaaaaccagaggauauucuugccucau

SEQ ID NO: 50799 - RNA, 64 nt, Homo Sapiens
ucaaacgaaacguaagagaagucaacaauaaaaccaagaaaagugaguauuuuuauaccaaaca

SEQ ID NO: 50800 - RNA, 64 nt, Homo Sapiens
aggagcuucuaccuauggcuuauucacaacugggcaagaaaacaucauugguaagaacugcuga

SEQ ID NO: 50801 - RNA, 64 nt, Homo Sapiens
aaaaaaguuuguuuuuucuuauacucuuuucucucaagaaaaaaccugauauuauuucuauuua

SEQ ID NO: 50802 - RNA, 64 nt, Homo Sapiens
uaaaaucguucucuucaauuaugcuguuuauugucaagaaaaaguauuccuaauaauagggaua

SEQ ID NO: 50803 - RNA, 64 nt, Homo Sapiens
acaacuguuuauagaauuuuauuguagauauauacaagaaaagagcgguacuuuacaugauuac

SEQ ID NO: 50804 - RNA, 64 nt, Homo Sapiens
ucauguaaacauuuucucucucaccauguuuuggcaagaaaagguagaaagagaagacccagag

SEQ ID NO: 50805 - RNA, 64 nt, Homo Sapiens
guuaauauucaagugaucagacuuugagugacaucaagaaaagaugauaucagguucauuuuuc

SEQ ID NO: 50806 - RNA, 64 nt, Homo Sapiens
aaacuucaguuacugaccagucaagagaauuucucaagaaaaaucccagcaacguucccucuuu

SEQ ID NO: 50807 - RNA, 64 nt, Homo Sapiens
aaauuguucaacaauaagggcaagauuccguucccaagaaaaaacuccagccugggcgacagag

SEQ ID NO: 50808 - RNA, 64 nt, Homo Sapiens
agagaaaagccugaucccuguagcauugcauacacaagaaaaacauguuuaggaauuguccuua

SEQ ID NO: 50809 - RNA, 64 nt, Homo Sapiens
aucugucccuguggucugaacaagaacugcucugcaagaaaaauguacugcauugcaccaugag

SEQ ID NO: 50810 - RNA, 64 nt, Homo Sapiens
uucuuagcauucuggaauucuuauagaauccacccaagaaaauugguuuuauucaaaccacaaa

SEQ ID NO: 50811 - RNA, 64 nt, Homo Sapiens
cauacuaauuuugaccuugaaagaugaauuccuucaagaaaaauaaaauaaugcuuaagauaau

SEQ ID NO: 50812 - RNA, 64 nt, Homo Sapiens
uuagaaagaaaugcguuauagaaacaaguaauagcaagaaaauugauguauauuuuaaugauac

SEQ ID NO: 50813 - RNA, 64 nt, Homo Sapiens
acaguacauugcuacauuacugucucucauacuucaagaaaagguaagcacauuucauugaccu

SEQ ID NO: 50814 - RNA, 64 nt, Homo Sapiens
gagaaauaauuuuguaaaacgaagaguagaauuccaagaaaaauaauuuaaggcuuuguaaaau

SEQ ID NO: 50815 - RNA, 64 nt, Homo Sapiens
aauaaauuauguucagcuuaucucacaucauguccaagaaaaagccaggccaggauguuuuauu

SEQ ID NO: 50816 - RNA, 64 nt, Homo Sapiens
uaaucuucugacucccaggccucagccuugagaucaagaaaaccaaguaacuuggucgagacca

SEQ ID NO: 50817 - RNA, 64 nt, Homo Sapiens
guaacagaaaauaaauuuugucaacuccuuuuggcaagaaaacuaagauaagcaaaaaaauucu

SEQ ID NO: 50818 - RNA, 64 nt, Homo Sapiens
cuagagaagaaaagugaagaccauuauuuuaacucaagaaaacucucauaugaucuucuucaag

SEQ ID NO: 50819 - RNA, 64 nt, Homo Sapiens
uauauuaaaaagauauuugauauuauugucaucccaagaaaaaauaauacuaucauaguaauau

SEQ ID NO: 50820 - RNA, 64 nt, Homo Sapiens
gauauuuuaaaaauuuauuuuauuauugucaucccaagaaaaaauaauacuaucauguuaauac

SEQ ID NO: 50821 - RNA, 64 nt, Homo Sapiens
agauuuuuguuuuguuuuguucuuaagaacauaccaagaaaauaccagugaauuguuggauaug

SEQ ID NO: 50822 - RNA, 64 nt, Homo Sapiens
uuuaaaaugauuuucucugccuugagauuugcaucaagaaaaagcaccucucuucaccugaaag

SEQ ID NO: 50823 - RNA, 64 nt, Homo Sapiens
aaauuugacaacauaguuucguacaauuuaacuucaagaaaacaacauaaauaaccuuccuuaa

SEQ ID NO: 50824 - RNA, 64 nt, Homo Sapiens
auuauugugaggauggucugcaaugauugcaguacaagaaaagggacucauagaguuuuuucug

SEQ ID NO: 50825 - RNA, 64 nt, Homo Sapiens
aauacccuuuucuuuuccuuggcauuuuacaaaacaagaaaaaaguaauaaucgagaaugccug

SEQ ID NO: 50826 - RNA, 64 nt, Homo Sapiens
acauucuuuagaaacuaacauuaaaaaaguaaaacaagaaaaguuuuugaaaugaaaagacuuu

SEQ ID NO: 50827 - RNA, 64 nt, Homo Sapiens
uaacuuucagguaaccagacccaucucaaagaaccaagaaaaggcuuuagcaugaaauaucuuu

SEQ ID NO: 50828 - RNA, 64 nt, Homo Sapiens
ggaagguugcucuccaaaaauacacagugcagugcaagaaaaugcuaucucauuggccuacucu

SEQ ID NO: 50829 - RNA, 64 nt, Homo Sapiens
cuguuguauaucauauuguaaaguaucauacugccaagaaaauaacuccuagaaaggcauuauc

SEQ ID NO: 50830 - RNA, 64 nt, Homo Sapiens
ccaauuauauucuuggccaauuuuguccaacggacaagaaaaaagcaaagucaacgacaccauu

SEQ ID NO: 50831 - RNA, 64 nt, Homo Sapiens
aacuuuguuuauugaaaaaaaaagaaaaagaaagcaagaaaaaaagauacuauggggucaagug

SEQ ID NO: 50832 - RNA, 64 nt, Homo Sapiens
ccucuuccuccaugggauggacugcaaaaggggacaagaaaaucuccagugacaguguccugug

SEQ ID NO: 50833 - RNA, 64 nt, Homo Sapiens
cagaaugaggagagucaagguugucccgaaaccccaagaaaaaugaggcuuuggggccccuuag

SEQ ID NO: 50834 - RNA, 64 nt, Homo Sapiens
cuucugcuagaaaaugcugacucacuuuuauauacaagaaaaaccuuuccacugaaaaaucccu

SEQ ID NO: 50835 - RNA, 64 nt, Homo Sapiens
cuuaaaacucuggagugagaggaugccagaggaucaagaaaaggaucacaguuucuugaagaag

SEQ ID NO: 50836 - RNA, 64 nt, Homo Sapiens
uaguacuacuaguaucugccauauuuuacaguuucaagaaaacuguaucuuuucauuuuuauau

SEQ ID NO: 50837 - RNA, 64 nt, Homo Sapiens
cuuaaaaguugugaugugacugcaugaguauuaccaagaaaaauaccauauuguuuaugcauau

SEQ ID NO: 50838 - RNA, 64 nt, Homo Sapiens
ccuuuuuguggguguugcaugcaaaucaaguggacaagaaaaaauaacaaaacaaaaaacaaga

SEQ ID NO: 50839 - RNA, 64 nt, Homo Sapiens
ucaaguggacaagaaaaaauaacaaaacaaaaaacaagaaaaaaaaaacacaaaaccccguaaa

SEQ ID NO: 50840 - RNA, 64 nt, Homo Sapiens
cucuggaaauccagcaguagaggaagggaccacccaagaaaacuaaaaaccaaggcaccuuacc

SEQ ID NO: 50841 - RNA, 64 nt, Homo Sapiens
augcaguccacaguggccagguggccagauuuuucaagaaaagcuggauggauguuucugaguc

SEQ ID NO: 50842 - RNA, 64 nt, Homo Sapiens
uguccauggucucaaacaaggggcuguuacauaacaagaaaaucaaagcugaggacagggugug

SEQ ID NO: 50843 - RNA, 64 nt, Homo Sapiens
uguugcaaaggucuuuuuaaaccaguuuagauuucaagaaaaaauaaauggaaaucaucgaaaa

SEQ ID NO: 50844 - RNA, 64 nt, Homo Sapiens
cagaagagacagugauuuggaaaagaaaccuacucaagaaaagagaacacaagaacuuaagaga

SEQ ID NO: 50845 - RNA, 64 nt, Homo Sapiens
acucuggcucauacaguguaugagccuuaaucagcaagaaaauacccagaaaaaccaguacccu

SEQ ID NO: 50846 - RNA, 64 nt, Homo Sapiens
uuauuuucuccaaauaaaaauauuagaauaauuucauacugaaaauuguauguuagaauaauuu

SEQ ID NO: 50847 - RNA, 64 nt, Homo Sapiens
uuuaagucaacacuauauauccagucucagauaucauacugauugauucuuccuuuuauuaaaa

SEQ ID NO: 50848 - RNA, 64 nt, Homo Sapiens
agcuguggaccccgauugguagucugcccuuugccauacugaacgcagaguggaugaaggagua

SEQ ID NO: 50849 - RNA, 64 nt, Homo Sapiens
uuuuuuuucaguauguauccgguuuucuuucuuucauacugagauucauguauuuuaacacugg

SEQ ID NO: 50850 - RNA, 64 nt, Homo Sapiens
cccguccugaauucuuacuaaacauaagaacauucauacugaagaggaacccuaugagugugaa

SEQ ID NO: 50851 - RNA, 64 nt, Homo Sapiens
cacuccaucucagaaaaaaaaaaaaaagauaauucauacugaaaagaaacucuacaaacuugaa

SEQ ID NO: 50852 - RNA, 64 nt, Homo Sapiens
augguugucacacuucauuauagguaagauaguucauacugaagaaaacuucuacaagugugaa

SEQ ID NO: 50853 - RNA, 64 nt, Homo Sapiens
ugaauuggugcugucaaaauauaguaauuuuuaaauuuguuaauaaugaaaacccuuaagcaug

SEQ ID NO: 50854 - RNA, 64 nt, Homo Sapiens
aaugaaaguguaagaaugcuuucugauucaacaaauuuguuaucaaacuguuuccuuauccucu

SEQ ID NO: 50855 - RNA, 64 nt, Homo Sapiens
uuguuacaaagaagaaaagauacagauuuggugaauuuguuacugugagguacagucaguacac

SEQ ID NO: 50856 - RNA, 64 nt, Homo Sapiens
ccuaugaauuuguaguagacuuucaaaaugagugauuuguuagcuugguacuuuuaaguuugug

SEQ ID NO: 50857 - RNA, 64 nt, Homo Sapiens
acuuagagaacaaagggccaaauagaguuuuuauauuuguuaugauaaaaggaaguagauguga

SEQ ID NO: 50858 - RNA, 64 nt, Homo Sapiens
cauguucugagcuauaacauuugcugaauaugcaauuuguuauucuuuuauuaauggcauguaa

SEQ ID NO: 50859 - RNA, 64 nt, Homo Sapiens
aacaguuuuaaggauaugauuugguuaaaaaauaauuuguuauaaaaauucuguuugcaaauua

SEQ ID NO: 50860 - RNA, 64 nt, Homo Sapiens
agaacauuauaacugauuguugugaauggggugaauuuguuaaaaugaguaacuuugauaaagu

SEQ ID NO: 50861 - RNA, 64 nt, Homo Sapiens
cuugagacuuguaaaccuggauauguugaaggguauuuguuaauuuuacuuuucaaagauacuu

SEQ ID NO: 50862 - RNA, 64 nt, Homo Sapiens
gauuuuuaacccuuaaaaaaguggagauguauacauuuguuaacaaugccaugaaagcauuuuc

SEQ ID NO: 50863 - RNA, 64 nt, Homo Sapiens
aauauuuuagcaaaugcuuuuuuuguacauaaguauuuguuacagaacuagccuuuugugaauu

SEQ ID NO: 50864 - RNA, 64 nt, Homo Sapiens
guccuauuauuuaccuuaaugagauugacaaagcauuuguuaacuccugugcuuucuccuuuga

SEQ ID NO: 50865 - RNA, 64 nt, Homo Sapiens
ccuugaaaguuuugugacaaauuggaaaauucuaauuuguuaggugaaaaaauauauauuuuuu

SEQ ID NO: 50866 - RNA, 64 nt, Homo Sapiens
gcugcccaccucaccuuuccagcaugcacugcauauuuguuacugaacaaacuccuggguuggc

SEQ ID NO: 50867 - RNA, 64 nt, Homo Sapiens
gagcuuuuuacuaauuuauuugucaguguucccuauuuguuacuuaaccaugauccuccagauu

SEQ ID NO: 50868 - RNA, 64 nt, Homo Sapiens
accuuaacccugccaaaccuugauccauuuugacauuuguuaugcacuauuuuuauaucucugu

SEQ ID NO: 50869 - RNA, 64 nt, Homo Sapiens
gucaggaauuaauauacuggaauaccuaccuucuauuuguuauucagaucagaucuggccuauu

SEQ ID NO: 50870 - RNA, 64 nt, Homo Sapiens
acuuuggggaggagggaaggugcugauaccuucaauuuguuacuuuucaagauuuuuaaaaaua

SEQ ID NO: 50871 - RNA, 64 nt, Homo Sapiens
ucauuucacaugaaagaagaaguauauuuuagaaauuuguuaaugagaguaaaagaaaauaaau

SEQ ID NO: 50872 - RNA, 64 nt, Homo Sapiens
uaagaaaaguaauuuuuacucugaugugcaauacauuuguuauuaaauuuauuauuuaagaugg

SEQ ID NO: 50873 - RNA, 64 nt, Homo Sapiens
uuuaguuacaggacaauaaugaaauggaguuuauauuuguuauuucuauuuuguuauauuuaau

SEQ ID NO: 50874 - RNA, 64 nt, Homo Sapiens
cuauggaguauuuucaauucauugugauuuuuagauuuguuaguuucaguuucuucauuuuuaa

SEQ ID NO: 50875 - RNA, 64 nt, Homo Sapiens
aauacagacauuguauguuauuaguuguguacuuauuuguuaauuaaaaguguaacauuuuuau

SEQ ID NO: 50876 - RNA, 64 nt, Homo Sapiens
ggauacaaaguuacagcuuggagacuagagagagauuuguuaaaugggaaagcugcagcaaagg

SEQ ID NO: 50877 - RNA, 64 nt, Homo Sapiens
agguuguuucaguuguauuggaaaaauaaaauuaauuuguuaucccagagcauuccuuuuuauu

SEQ ID NO: 50878 - RNA, 64 nt, Homo Sapiens
augccaaaaaggacaguuuaaaagaacguugcaaauuuguuaaaaaaaaacagaaaaagaaaaa

SEQ ID NO: 50879 - RNA, 64 nt, Homo Sapiens
uucuaccuccaacccacaaagagagauuugcuugauuuguuaacggauuuggggagaguagaag

SEQ ID NO: 50880 - RNA, 64 nt, Homo Sapiens
agugucuuuuuuuaaaaaguagagaaauaauuguauuuguuaacugcuggcugaguggauuuua

SEQ ID NO: 50881 - RNA, 64 nt, Homo Sapiens
gaagcgggagaggaggagcacuuacucauguuguauuuguuaauggaggaugucaucuuuucau

SEQ ID NO: 50882 - RNA, 64 nt, Homo Sapiens
agguuugagcuuuacacaaaaugucuucaucuguauuuguuauugucuacaauauauuugaauu

SEQ ID NO: 50883 - RNA, 64 nt, Homo Sapiens
uguauauaaauguuaauuauuaaaauuuguccuuauuuguuaaugcaguaguagaaguuuugua

SEQ ID NO: 50884 - RNA, 64 nt, Homo Sapiens
aaaucccaauuaucuuuacaaaccacuuauuaucauuuguuaugucaagaaaauuaaugcacaa

SEQ ID NO: 50885 - RNA, 64 nt, Homo Sapiens
augcuacuggaaguggaacuugagauagggccuaauuuguuauacauauuagccaacauguugg

SEQ ID NO: 50886 - RNA, 64 nt, Homo Sapiens
augaugucagcauuuuaguaaacuuuuagacaaaauuuguuagggucauucaugaaaacuuuaa

SEQ ID NO: 50887 - RNA, 64 nt, Homo Sapiens
aaagaaaaaaaaacacacauguguuuuaaccuguauuuguuaaauagcuaacugaauuuguuca

SEQ ID NO: 50888 - RNA, 64 nt, Homo Sapiens
agauuuugagucucaaccaagaggaaaagcaugaauuuguuaacuuuuucuuuuuuuuuuuuuu

SEQ ID NO: 50889 - RNA, 64 nt, Homo Sapiens
uuucaaacaauagugaauaauuuagacucauauaauuuguuauucaaacugcaccauagguguu

SEQ ID NO: 50890 - RNA, 64 nt, Homo Sapiens
uaacauccuaucucauaauuauacucuguacaaaauuuguuagcuugaacuucauccauagauc

SEQ ID NO: 50891 - RNA, 64 nt, Homo Sapiens
uuuguaaaaugacaaucauguuuaaaaacgugaaauuuguuaucaacuauguuguuuuaagaca

SEQ ID NO: 50892 - RNA, 64 nt, Homo Sapiens
cacugccauaauaucauuauuaaaaauauucugaauuuguuaaguacagcauagguuuuucaua

SEQ ID NO: 50893 - RNA, 64 nt, Homo Sapiens
ucaaaccagucugcugguuacaggucuaucuuuaauuuguuaucucaucuaucaauuuauuaag

SEQ ID NO: 50894 - RNA, 64 nt, Homo Sapiens
auuuaucaggauucauugauguauugaacaugaaauuuguuaucaggacuuuuuuggucuuuua

SEQ ID NO: 50895 - RNA, 64 nt, Homo Sapiens
acguuuuuucucacaucuaucugcuaguccaggaauuuguuacuaaauagauuuucuuggauau

SEQ ID NO: 50896 - RNA, 64 nt, Homo Sapiens
uuucuuggauauuugguugccucaaagugcuuacauuuguuaacagauuguaaaccacauuuau

SEQ ID NO: 50897 - RNA, 64 nt, Homo Sapiens
cuuuaaauucucaggucagaacauaacauuucucauuuguuaaaagcagcaagaagccugguaa

SEQ ID NO: 50898 - RNA, 64 nt, Homo Sapiens
ucuuuguguguagugcagcaacaguuuggucugcauuuguuagaaguuuaacuccuaacaaccc

SEQ ID NO: 50899 - RNA, 64 nt, Homo Sapiens
gauuucacuuugaaggauacauauauacuguuaaauuuguuaaggcuguuucaucagcagccua

SEQ ID NO: 50900 - RNA, 64 nt, Homo Sapiens
uuaauauuuaaaccugagagaugcauuaaaauauauuuguuaauacacauaaucuguaccaggu

SEQ ID NO: 50901 - RNA, 64 nt, Homo Sapiens
uucaaucagaauccccgaaaucauuuauacuauuauuuguuacguuugccauauuaaaucuucc

SEQ ID NO: 50902 - RNA, 64 nt, Homo Sapiens
accagucuuuugaaagaaaagccacacugucaacauuuguuagagagcugugggagugauuuug

SEQ ID NO: 50903 - RNA, 64 nt, Homo Sapiens
cuauuaaaucuuaaucuuguggcaucagggaaauauuuguuacauaguaggcaauuuuuaucca

SEQ ID NO: 50904 - RNA, 64 nt, Homo Sapiens
agaaaauauuauuuuaacaauguaaagcaauaugauuuguuacuauaauuaaccuguauaaaag

SEQ ID NO: 50905 - RNA, 64 nt, Homo Sapiens
uuuuauugcaaugaugccuaagaaauuuguuagaauuuguuagaauuugaguuuuacauaaaau

SEQ ID NO: 50906 - RNA, 64 nt, Homo Sapiens
auuuguuagauuuuauugcauacauaaaauagaaauuuguuagaacaauccauaauuugaguuu

SEQ ID NO: 50907 - RNA, 64 nt, Homo Sapiens
aacagguuauguaaaaauauagucuggcuuuagaauuuguuaauucaccugcuuugccacagaa

SEQ ID NO: 50908 - RNA, 64 nt, Homo Sapiens
ucaagauauaugauuucucuauggaaauaaaaauauuuguuagugaauugguugaguuuugauu

SEQ ID NO: 50909 - RNA, 64 nt, Homo Sapiens
aguuguuauccaaaccuaaucaagccagaguaggauuuguuaccauuuguuagcaguuauuauc

SEQ ID NO: 50910 - RNA, 64 nt, Homo Sapiens
aguuauuauccaagccagagacuuuuaaguuagcauuuguuagcuagcuauugaauucaugaaa

SEQ ID NO: 50911 - RNA, 64 nt, Homo Sapiens
uuuaaaguuaguuuaagacuauacugugccuuugauuuguuagcuaauuauuuuaaauguguua

SEQ ID NO: 50912 - RNA, 64 nt, Homo Sapiens
auuuacagacaccauuggaaacuuaugguucggaauuuguuacuucuugugacuaauuucuaua

SEQ ID NO: 50913 - RNA, 64 nt, Homo Sapiens
uuuuugcauauuagguuaauucuugauacuaaggauuuguuacuaugaauuuauaaauuauuaa

SEQ ID NO: 50914 - RNA, 64 nt, Homo Sapiens
uuaaaagggaggguugggaggacauauucagcauauuuguuauuuaccaguccacaugcaauua

SEQ ID NO: 50915 - RNA, 64 nt, Homo Sapiens
aauacuuugcccucagaaagauacugauauuuuuauuuguuaauuccuguaauugucuuuuaaa

SEQ ID NO: 50916 - RNA, 64 nt, Homo Sapiens
ugaacucuuaauuauguuuuaaaguaugaaacagauuuguuaacuggcauuuuuacuguuugug

SEQ ID NO: 50917 - RNA, 64 nt, Homo Sapiens
acuaaauguaagaaaaaucuuuucccaucaagucauuuguuaaacauaucguauaccaccacuu

SEQ ID NO: 50918 - RNA, 64 nt, Homo Sapiens
gagccacagauaauacaagacuaauuauaggagcauuuguuacuuaagccauguaacugaaaau

SEQ ID NO: 50919 - RNA, 64 nt, Homo Sapiens
caguuaugugcugaggugauaauucauccaacauauuuguuagcauaaauauuaugcuucaguu

SEQ ID NO: 50920 - RNA, 64 nt, Homo Sapiens
caggauggauucugaaauauaaauucuaaauuauauuuguuauaacuauauuuuauguuguaug

SEQ ID NO: 50921 - RNA, 64 nt, Homo Sapiens
gugcugugcuggggauuggcucccgggucuguccauuuguuacuacccucuucccccugcgggc

SEQ ID NO: 50922 - RNA, 64 nt, Homo Sapiens
aaaaaaaaaaaaaguuuuaaggucucuggaagccauuuguuaaacaccccaugaaacucgagca

SEQ ID NO: 50923 - RNA, 64 nt, Homo Sapiens
ugaaucagugaucuaguauuuuccuuucggcaagauuuguuagguuuuuaccccuucuaaaaua

SEQ ID NO: 50924 - RNA, 64 nt, Homo Sapiens
uaaauauucuggauaggaacuacuugaaauaguaauuuguuaaaagauaugacaaaaugaaaau

SEQ ID NO: 50925 - RNA, 64 nt, Homo Sapiens
uguaaaauuuuugaacuuacugugucuaaucaucauuuguuagucuguaguuaaugucaacagu

SEQ ID NO: 50926 - RNA, 64 nt, Homo Sapiens
cccuuucguggcagcuuugacuguuggcauagccauuuguuauguagugguagcgacuuuccug

SEQ ID NO: 50927 - RNA, 64 nt, Homo Sapiens
cucaagccaggguugaaagaucuauucaauuuguauuuguuaaaauggaguuugacuaauuuuu

SEQ ID NO: 50928 - RNA, 64 nt, Homo Sapiens
aacuuguuuauggaguuugaucgauuagauuuguauuuguuauaauagaguuugacuaguuuuu

SEQ ID NO: 50929 - RNA, 64 nt, Homo Sapiens
acagaacuuuucuacuuucagacagacugcuugcuaguuuuaugaauucagcacacgaauuaug

SEQ ID NO: 50930 - RNA, 64 nt, Homo Sapiens
uauauauggaucccuuauauuuagauuuaacucguaguuuuauuugaaaguagaaaagaacucu

SEQ ID NO: 50931 - RNA, 64 nt, Homo Sapiens
gguauggguuuuuucucccccgugucaagugaaguaguuuuauacuuauuguugguaggcacau

SEQ ID NO: 50932 - RNA, 64 nt, Homo Sapiens
auuuucauuuuuggggaaaauauguauuuuaacuuaguuuuaaugcuguguggaauacuaacua

SEQ ID NO: 50933 - RNA, 64 nt, Homo Sapiens
gcacuuuuuauuuugagagcaaaaaacuuagaguuaguuuuagguaguauuaaugucagugacu

SEQ ID NO: 50934 - RNA, 64 nt, Homo Sapiens
uacuuaccauaaagucuuuccagguugguauauuuaguuuuaaauuaaaauguguaauauacca

SEQ ID NO: 50935 - RNA, 64 nt, Homo Sapiens
uuugugguaaugcuuugguaguuuaaaauggauauaguuuuagaccagucuauuaaagguguuu

SEQ ID NO: 50936 - RNA, 64 nt, Homo Sapiens
accagucuauuaaagguguuaaauuguccaauuauaguuuuauaaaaaguauaaacuggccuua

SEQ ID NO: 50937 - RNA, 64 nt, Homo Sapiens
aucucggaagaugauaccaagugugaagaaggaauaguuuuauaaggggaaggaaaauaaaagg

SEQ ID NO: 50938 - RNA, 64 nt, Homo Sapiens
aagcauugucuguuccagaggccuucccagaccuuaguuuuauaaacucaguggccauucuucu

SEQ ID NO: 50939 - RNA, 64 nt, Homo Sapiens
auccuuaauaaugauagcaagugaucuuucuuuuuaguuuuagccuuccuuuuucaauaguaau

SEQ ID NO: 50940 - RNA, 64 nt, Homo Sapiens
gcaauuaaaagucuuuagcuguuagcaaaccuguuaguuuuacuucugcauugaaccagccuca

SEQ ID NO: 50941 - RNA, 64 nt, Homo Sapiens
uaagauuuccuuugguuguauuuagaaacacaaauaguuuuauaaucaggauugcauuugugcu

SEQ ID NO: 50942 - RNA, 64 nt, Homo Sapiens
ggaggcauagugcugacauauauucagaguguuguaguuuuaagguuagcgugacuucaguuuu

SEQ ID NO: 50943 - RNA, 64 nt, Homo Sapiens
uaugccagucuuggcugaaauguuuuauuuaccauaguuuuauaucugugugguguuuuguacc

SEQ ID NO: 50944 - RNA, 64 nt, Homo Sapiens
caguccuaauuugaggggaaauuacugucaccacuaguuuuaauauaguacaaugaaaaaauaa

SEQ ID NO: 50945 - RNA, 64 nt, Homo Sapiens
uuuaaaaguagcuuuacauaggaaggaaguggcauaguuuuaucaauaucugucaaauuaaacu

SEQ ID NO: 50946 - RNA, 64 nt, Homo Sapiens
gacaccaccacaaaucaugguuaauaaaagagaguaguuuuaacuuuauuuuuauuuguuuaga

SEQ ID NO: 50947 - RNA, 64 nt, Homo Sapiens
uauuuucccauugacuacuuuucauucuucacuguaguuuuaaagaagaacuguaaaugacggu

SEQ ID NO: 50948 - RNA, 64 nt, Homo Sapiens
uacuguuaaagaauuguauuuucuuuugcaauuguaguuuuaugggacauuuuuuucugccauu

SEQ ID NO: 50949 - RNA, 64 nt, Homo Sapiens
uacuguuaaagaauuguacuuucuuuugcaauuuuaguuuuauggacuauuuaaaaguuucauu

SEQ ID NO: 50950 - RNA, 64 nt, Homo Sapiens
aaaugcaggcagcacaauauggccuaaacugccauaguuuuagaaugugaaaaaaaugcauguu

SEQ ID NO: 50951 - RNA, 64 nt, Homo Sapiens
aaaaaaucgucuuacauguguacaauaugcaaauuaguuuuagauuagagagugcagccauuuu

SEQ ID NO: 50952 - RNA, 64 nt, Homo Sapiens
uagacuuugucaugaccaaaaagagaaauguaaauaguuuuauaaaauacagucgaaucaccag

SEQ ID NO: 50953 - RNA, 64 nt, Homo Sapiens
ugucccucuggaccgaaucucuuuaacugcuggauaguuuuagaggaauucuccugcuacuuag

SEQ ID NO: 50954 - RNA, 64 nt, Homo Sapiens
uggcauuuuuaaacauuuaacuucuguuagaaauuaguuuuaucaguuucuauggccuucccac

SEQ ID NO: 50955 - RNA, 64 nt, Homo Sapiens
gguuccuuagccaugggauuuagaaucuggcauauaguuuuauucugugaauauucaaaaguaa

SEQ ID NO: 50956 - RNA, 64 nt, Homo Sapiens
uggugacugccuuagagggaucaguuaauuuguauaguuuuauauuuuuuguauauguuugcua

SEQ ID NO: 50957 - RNA, 64 nt, Homo Sapiens
aagcaacgaguucaccuaaguaaggcucagauccuaguuuuaaaaaccauuucccauuaaaaug

SEQ ID NO: 50958 - RNA, 64 nt, Homo Sapiens
aagaaaagaagucugauauccagcaucauuuaaguaguuuuauaacuuugagugccauugcaag

SEQ ID NO: 50959 - RNA, 64 nt, Homo Sapiens
gguuuagaaaucuaugucucuaguaugaaaccuguaguuuuaauuaauuaugcagcauuaucca

SEQ ID NO: 50960 - RNA, 64 nt, Homo Sapiens
gaugcuugcugcagcaagagauuauaaucaaaauuaguuuuauuucaaagaucaccagggcaua

SEQ ID NO: 50961 - RNA, 64 nt, Homo Sapiens
cauuguuaaaaugcaaucauaguaugcaaaucaauaguuuuaacauagcuguuuuucucccaug

SEQ ID NO: 50962 - RNA, 64 nt, Homo Sapiens
uuaaucuuaaaagauuauugcuuuuuaaaguguguaguuuuaugcauguguguuuaugguuugc

SEQ ID NO: 50963 - RNA, 64 nt, Homo Sapiens
aaacuaauaauacaaugucacuuuaucagaauacuaguuuuaaaagcugaauguuaauagggga

SEQ ID NO: 50964 - RNA, 64 nt, Homo Sapiens
uuuuaaaucucuuagugguuugcuuguuaaauucuaguuuuaugaaaagccauauuaaguauuu

SEQ ID NO: 50965 - RNA, 64 nt, Homo Sapiens
caagauguucagggguauuauagaaaaauuguaauaguuuuaaucuuuucaaguaguuuuauaa

SEQ ID NO: 50966 - RNA, 64 nt, Homo Sapiens
auagaaaaauuguaauaguugccaacuuuucaaguaguuuuauacuucaauaccaggaaguuau

SEQ ID NO: 50967 - RNA, 64 nt, Homo Sapiens
accgguauaagagauucuguugugauuauuugaauaguuuuauauuaauaaaagaagacaaaau

SEQ ID NO: 50968 - RNA, 64 nt, Homo Sapiens
uuuuuuuuccauagcagguauuuucuacuagaaguaguuuuacuacuuuucauuuagaacagag

SEQ ID NO: 50969 - RNA, 64 nt, Homo Sapiens
uguauguauuauaaauaucuuaucaguuaacauauaguuuuaaaucucaaaucauauuccauug

SEQ ID NO: 50970 - RNA, 64 nt, Homo Sapiens
uaugcugcaauguauaaucucaagaauguguguguaguuuuaauuccuauauaccagcauguac

SEQ ID NO: 50971 - RNA, 64 nt, Homo Sapiens
gacugaaaaugguagguuuggacuuuagccuguuuaguuuuaagauuuuccccauaccacuuca

SEQ ID NO: 50972 - RNA, 64 nt, Homo Sapiens
gaccuuguguaaagauaauaaaacugaaauacuuuaguuuuacuacagagagaauaguucuuug

SEQ ID NO: 50973 - RNA, 64 nt, Homo Sapiens
uucucacguuguagaaaaaggcagaagugcaaaguaguuuuaauucaguguuuccuguguuugg

SEQ ID NO: 50974 - RNA, 64 nt, Homo Sapiens
uguaaauauuagcagggacuuuuauugugaagaguaguuuuaccgguuucauuacauauucucc

SEQ ID NO: 50975 - RNA, 64 nt, Homo Sapiens
uggguacaaauaaacagguguacuuaaaaauuaauaguuuuauccugcauaaguaauuaaaaua

SEQ ID NO: 50976 - RNA, 64 nt, Homo Sapiens
ucugcuugugacauuaaaagugagucuuugaagauaguuuuaauuuuaaaucuuuucuucaacu

SEQ ID NO: 50977 - RNA, 64 nt, Homo Sapiens
guucuuaaucuaaacauuuuuuauaggcacccuguaguuuuauaaauaaggaguaagccaccuu

SEQ ID NO: 50978 - RNA, 64 nt, Homo Sapiens
agagacgggguuucaccacgcccggcuaauuuuuuaguuuuaguuauaggugcccgccaccaga

SEQ ID NO: 50979 - RNA, 64 nt, Homo Sapiens
auucuuuagcuguacuguaauuucuuugaguugauaguuuuacaaauucuuaauagguucaaaa

SEQ ID NO: 50980 - RNA, 64 nt, Homo Sapiens
uuuugcugcuacuucuguggaaguagcuuugaacuaguuuuacuuugaacuuucacgcugaaac

SEQ ID NO: 50981 - RNA, 64 nt, Homo Sapiens
ccacuagguagauauuuaggaaagaccauaguuuuaguuuuaaguugacuuucuuuuuaaagcc

SEQ ID NO: 50982 - RNA, 64 nt, Homo Sapiens
uuuaagccacuagguagauaaaagccaaagaccauaguuuuaguaauuuuuugacuuucuuuuu

SEQ ID NO: 50983 - RNA, 64 nt, Homo Sapiens
uuacagagguagcauuggugauucauuuugcuucuaguuuuauuuagccgacugucuugaaacu

SEQ ID NO: 50984 - RNA, 64 nt, Homo Sapiens
uuauaauagaaagccagccacuuuuuauuucugauaguuuuauaguucuauacuauucagguau

SEQ ID NO: 50985 - RNA, 64 nt, Homo Sapiens
auacuuuaugcauauuacugauuuaauuugaauauaguuuuacagccuccuugacaccuauaau

SEQ ID NO: 50986 - RNA, 64 nt, Homo Sapiens
gugucaugugacuuuggcacccuauagacauacuuaguuuuaacuuuucaaaguuuggccuccu

SEQ ID NO: 50987 - RNA, 64 nt, Homo Sapiens
gcugaucaggcaaaaauagugcuuaucuuaucaguaguuuuauuagggaauuauuugauaacca

SEQ ID NO: 50988 - RNA, 64 nt, Homo Sapiens
uuuuauuguauauaaaauccauuuugguggaguuuaguuuuagggcauugacuauuacaauuuc

SEQ ID NO: 50989 - RNA, 64 nt, Homo Sapiens
gauuaacccucaaaguucucaaaccuuugauuuguaguuuuaaaugccaguuaucuauuaacca

SEQ ID NO: 50990 - RNA, 64 nt, Homo Sapiens
uuuuaaucuaaagauguuagaaaaaaucaccuuuuaguuuuaguucuccacagacuggguagca

SEQ ID NO: 50991 - RNA, 64 nt, Homo Sapiens
uuaccuuucaaggcauuaguaaauuacuugcaaauaguuuuaaaaggaaaauacgaccuuuguu

SEQ ID NO: 50992 - RNA, 64 nt, Homo Sapiens
ccucuuacggccuagagaguugacaaguugcuuguaguuuuaaaaaaauaauaaaguauacccu

SEQ ID NO: 50993 - RNA, 64 nt, Homo Sapiens
ugaaaauguuugcuuuuaaaauuucaauuuucuuuaguuuuaauaguuaguagaucacuauggu

SEQ ID NO: 50994 - RNA, 64 nt, Homo Sapiens
ucaaaauauuggcuuuucaaucuccaaacauggguaguuuuauguguagaaaauaaaaaauucc

SEQ ID NO: 50995 - RNA, 64 nt, Homo Sapiens
aauauagauaagaaaagguggggcuauacuagcaacaaaaaaagaaugcuguuccugcaccugc

SEQ ID NO: 50996 - RNA, 64 nt, Homo Sapiens
gcaaagcauuaguggcuauggucuguaaaaugaaacaaaaaaacuuuauuucacuauaagagua

SEQ ID NO: 50997 - RNA, 64 nt, Homo Sapiens
uccugcuggaaaucagaaaauauaauaaaauugcacaaaaaaaaaaaugaaaaagaugcagacu

SEQ ID NO: 50998 - RNA, 64 nt, Homo Sapiens
uauuuguuuuugagauggagucucuacuaaaaauacaaaaaauuagccaggcauggugccgcau

SEQ ID NO: 50999 - RNA, 64 nt, Homo Sapiens
gccaauauggugaaaccccaucucuacuaagaauacaaaaaauuagcugagcaugguggugggc

SEQ ID NO: 51000 - RNA, 64 nt, Homo Sapiens
aaauguguucagaggaaauagaauguaaaacaucacaaaaaaaauugcaguacauaaaauuucu

SEQ ID NO: 51001 - RNA, 64 nt, Homo Sapiens
ucaugacuuuuuuuuuuaaauaaagugaguuucaacaaaaaaaaaacugaaaauucuacauugc

SEQ ID NO: 51002 - RNA, 64 nt, Homo Sapiens
acuguuuuuaaugguaaaaaaaaaaaaaaaaaauacaaaaaaaaauucugaaggacaaaaaagg

SEQ ID NO: 51003 - RNA, 64 nt, Homo Sapiens
aaaaaaaaaaaaauacaaaaaaaaauucugaaggacaaaaaaggugacugcugaacugugugug

SEQ ID NO: 51004 - RNA, 64 nt, Homo Sapiens
caucaccaucguguuugcaaagguuaaaacaaaaacaaaaaaccacaaaaauaaaaaacaaaaa

SEQ ID NO: 51005 - RNA, 64 nt, Homo Sapiens
uuaaaacaaaaacaaaaaaccacaaaaauaaaaaacaaaaaaaacaaaaaacccaagaaaaaaa

SEQ ID NO: 51006 - RNA, 64 nt, Homo Sapiens
aaacaaaaaaccacaaaaauaaaaaacaaaaaaaacaaaaaacccaagaaaaaaaaaaagaguc

SEQ ID NO: 51007 - RNA, 64 nt, Homo Sapiens
accagccgggccaacauggugaaaccccaucucuacaaaaaauacaaaaauuagccuggcauau

SEQ ID NO: 51008 - RNA, 64 nt, Homo Sapiens
cgacugagcgagacucuaucucaaaacaaucaaaacaaaaaagaccuguggacucuaguagauu

SEQ ID NO: 51009 - RNA, 64 nt, Homo Sapiens
uauuucaucuuuugaugugacuuuucacuaguuuacaaaaaaaagguugguggucaacaaaaaa

SEQ ID NO: 51010 - RNA, 64 nt, Homo Sapiens
uuucacuaguuuacaaaaaaaagguugguggucaacaaaaaaagcaagucauagcaguucagug

SEQ ID NO: 51011 - RNA, 64 nt, Homo Sapiens
gagaugcgccugggcaacauagaaaccugugucuacaaaaaauuuaaaaauuagccaaguaugg

SEQ ID NO: 51012 - RNA, 64 nt, Homo Sapiens
gcuaacacggugaaacuccaucucuacuaaaaauacaaaaaauuggccgggcgcagcggcucac

SEQ ID NO: 51013 - RNA, 64 nt, Homo Sapiens
cugucucaaaaaaacaaaacaaacaaacaaaaauacaaaaaauuagccgggcgugguggcaccu

SEQ ID NO: 51014 - RNA, 64 nt, Homo Sapiens
uuguuguuuucguuuugaacuuauccuuccucccacaaaaaaagaaaagaagaaaaaauuccaa

SEQ ID NO: 51015 - RNA, 64 nt, Homo Sapiens
ccaccagaagacuugaaaaucuuaaaaaaaaaaaacaaaaaaacaagaaaaggcaacaucucau

SEQ ID NO: 51016 - RNA, 64 nt, Homo Sapiens
ggcaacauggugaaacccccgucucuacuaaaauacaaaaaaauuagccaggcauaguggcgcg

SEQ ID NO: 51017 - RNA, 64 nt, Homo Sapiens
uaauccucaguuccacgagacugcccacccacagacaaaaaaauauauauauuccuaaagucgg

SEQ ID NO: 51018 - RNA, 64 nt, Homo Sapiens
aaauacaaccuagggugccuuaaaaauaacaacaacaaaaaaccugugugcaucuggcugacac

SEQ ID NO: 51019 - RNA, 64 nt, Homo Sapiens
cacacccggcuaauuuuuuguguuuuuacaaaauacaaaaaaguagagacaggauuucacugug

SEQ ID NO: 51020 - RNA, 64 nt, Homo Sapiens
agcugggcgugguggcaggauuuuuacuaaaaguacaaaaaacuggcuaacacagugaaacgug

SEQ ID NO: 51021 - RNA, 64 nt, Homo Sapiens
uuagccagccaugguggcggucucuacuaaaaauacaaaaaaaagcuaacauggugaaacccug

SEQ ID NO: 51022 - RNA, 64 nt, Homo Sapiens
uagccaggcguggucgugggcuacuaaaaaaaauacaaaaaaauaacacggugaaaccccgucu

SEQ ID NO: 51023 - RNA, 64 nt, Homo Sapiens
aacaaaacaguuuuuaaaacaaaaaaacaaaaaaacaaaaaaaauaguccugagcaaaaaaaaa

SEQ ID NO: 51024 - RNA, 64 nt, Homo Sapiens
aaaaaaaaaacaaaacaguuaaaaaaaaaaaaaaacaaaaaaacaaagcaaauaguccugagca

SEQ ID NO: 51025 - RNA, 64 nt, Homo Sapiens
cugagaaguuugaauuguagaaaaacaaacaaaaacaaaaaaaccccaccuccucauuuuagua

SEQ ID NO: 51026 - RNA, 64 nt, Homo Sapiens
aaagcuuuaaaaaaaaaagagggugguugguuuaacaaaaaaaauucacauguggaaacuuuca

SEQ ID NO: 51027 - RNA, 64 nt, Homo Sapiens
acaccaaaaaaacagcagugaaaaaaaaaaaaaaacaaaaaacacaccugggcacuuuuagaua

SEQ ID NO: 51028 - RNA, 64 nt, Homo Sapiens
aaucucucuauaaaaugaauuggaacaaaagcaaacaaaaaagaucaaccacucuccuaaugau

SEQ ID NO: 51029 - RNA, 64 nt, Homo Sapiens
cuaaguuauaagugaacuguaaacaaaaaaaacaacaaaaaaagauucuuuggaaaaaaacaaa

SEQ ID NO: 51030 - RNA, 64 nt, Homo Sapiens
caacaaaaaaagcuaaguuagaaaaaaacaaaaaacaaaaaaaauuuuaaggaacuauucuuug

SEQ ID NO: 51031 - RNA, 64 nt, Homo Sapiens
aaaaaaacaacaaaaaaagcuucuuuggaaaaaaacaaaaaacagcauccauuuuaaggaacua

SEQ ID NO: 51032 - RNA, 64 nt, Homo Sapiens
accugggccugguggcacacaguuuuguaaaaauacaaaaaauuuggugaaaccccaucucuac

SEQ ID NO: 51033 - RNA, 64 nt, Homo Sapiens
aaaauucauguuacuaaaagacgccaucucaaaaacaaaaaaacagccugggcgacagagcaag

SEQ ID NO: 51034 - RNA, 64 nt, Homo Sapiens
aaguuaagucugagacucuauuugaauaagccgcacaaaaaauauuucauaaggaaaaccacug

SEQ ID NO: 51035 - RNA, 64 nt, Homo Sapiens
uccuaaugcaucugagagauuguugcugagagaaacaaaaaauucuagaaacagauguuuucag

SEQ ID NO: 51036 - RNA, 64 nt, Homo Sapiens
auaaaaaaguugugccugaagauuuaaaaacaaaacaaaaaaaaaggacccgguuucuuuuacu

SEQ ID NO: 51037 - RNA, 64 nt, Homo Sapiens
ugaaugcacaaacuugcugcauauuuaaacaaaaacaaaaaaaaagcagugugauaauuuaaac

SEQ ID NO: 51038 - RNA, 64 nt, Homo Sapiens
ugcugaaaggcagcguuuuucuuguuuauucaguacaaaaaaaaccuuauucuuaagaauagug

SEQ ID NO: 51039 - RNA, 64 nt, Homo Sapiens
aaucaagaaggcauagcuguugugaacaacaacaacaaaaaauaaaaucccaucaacaaaaugc

SEQ ID NO: 51040 - RNA, 64 nt, Homo Sapiens
aaaacucuugucuccuuaggaaacaaacaaacaaacaaaaaaaaacagaacaagaacccaucuc

SEQ ID NO: 51041 - RNA, 64 nt, Homo Sapiens
auccaggcaugguggcguacgucucuacuaaaauacaaaaaauugggcaacacgaugaaacucc

SEQ ID NO: 51042 - RNA, 64 nt, Homo Sapiens
accuuguuccuuuauagguuaaaaaaaacaaaaaacaaaaaaaaucacuugccuagucuugaag

SEQ ID NO: 51043 - RNA, 64 nt, Homo Sapiens
aaaaaaaaccuuguuccuuucuugaagaaaaaaaacaaaaaacacacugcuucacuugccuagu

SEQ ID NO: 51044 - RNA, 64 nt, Homo Sapiens
uuacugaguguuauaaguauaaaaauaaaggaaaacaaaaaacuugcacuuuuaugaaguuuuu

SEQ ID NO: 51045 - RNA, 64 nt, Homo Sapiens
uuucccaaaacaaucuauuuuauaacauuauauaacaaaaaaggaagaaguuaauucuuaaaac

SEQ ID NO: 51046 - RNA, 64 nt, Homo Sapiens
cuuuguugcuaggauuaaggaaaaaaaaaaaccuacaaaaaaaaaaaaagacaaaaaaaaacca

SEQ ID NO: 51047 - RNA, 64 nt, Homo Sapiens
accaaaaaaaaaaaaccuacacgcaaaaaaaaagacaaaaaaaagaauagcccaaauguuuuaa

SEQ ID NO: 51048 - RNA, 64 nt, Homo Sapiens
aagaugagucgcacaucugcaaacaaaaaaaaaaacaaaaaacacgagacucuaucucaaaaaa

SEQ ID NO: 51049 - RNA, 64 nt, Homo Sapiens
aaacaaaaaacaaagaugaguaucucaaaaaaaaacaaaaaaaaugggcaacagagcgagacuc

SEQ ID NO: 51050 - RNA, 64 nt, Homo Sapiens
agccgggcgugguggugcauucucuacuaaagauacaaaaaauugccaacauggugaaaccccg

SEQ ID NO: 51051 - RNA, 64 nt, Homo Sapiens
uaagagaacuuaaagaacuggugauuuuuuuuuaacaaaaaaagggaccauugcaacuuuuguu

SEQ ID NO: 51052 - RNA, 64 nt, Homo Sapiens
ggagcuugaaaaaaugcagacuguacaaacgcuuacaaaaaaaaaaacugugaacugacuuaag

SEQ ID NO: 51053 - RNA, 64 nt, Homo Sapiens
uggaaugucaggucuuaaggcauuuaauugagggacaaaaaaaaaaaaagccgauauaguagcu

SEQ ID NO: 51054 - RNA, 64 nt, Homo Sapiens
acuagccugggcaacauagugagacaccggaucuacaaaaaaauaaaaagccagacugguggua

SEQ ID NO: 51055 - RNA, 64 nt, Homo Sapiens
aguucuagacuagccugggcgagacuucaucucuacaaaaaaagcaacaacgacaaaaaaaauu

SEQ ID NO: 51056 - RNA, 64 nt, Homo Sapiens
gcgagacuucaucucuacaaaaaaagcaacaacgacaaaaaaaauuagccaagcauaguggcac

SEQ ID NO: 51057 - RNA, 64 nt, Homo Sapiens
uccaaucugggcaacauggggaaaccccagcucuacaaaaaaaauuagccuggugugguggcac

SEQ ID NO: 51058 - RNA, 64 nt, Homo Sapiens
gccaacaugacgaaaccccaucucuacuaaaaagacaaaaaauuagcugggcaugguggcauau

SEQ ID NO: 51059 - RNA, 64 nt, Homo Sapiens
aacagagcaagacugucucaaaaaacaaaacgaaacaaaaaaagaaaguuauucuuaguaagga

SEQ ID NO: 51060 - RNA, 64 nt, Homo Sapiens
guaacaauaccuugcagaggagcaaaaaucaguaacaaaaaauaugaaacaagaagguuauugc

SEQ ID NO: 51061 - RNA, 64 nt, Homo Sapiens
caaaacauaauaaaacaccaaguuaaacaaacaaacaaaaaacaaaacugagguagcgacacaa

SEQ ID NO: 51062 - RNA, 64 nt, Homo Sapiens
agcuaccuaugauccuggauacacaaaacauaacacaaaaaagaaaggcacaacacaaaaacca

SEQ ID NO: 51063 - RNA, 64 nt, Homo Sapiens
ggggccaauaaauucccuaaaagaaaaacaaaaaacaaaaaacacaugcucuuguuucucaaaa

SEQ ID NO: 51064 - RNA, 64 nt, Homo Sapiens
aaaaacaggggccaauaaaucucaaaaaagaaaaacaaaaaacaaguaucucaugcucuuguuu

SEQ ID NO: 51065 - RNA, 64 nt, Homo Sapiens
uugauugagacaaugaagaguuaaaaaaauaaaaacaaaaaagugagaaaaggguguuuuaaau

SEQ ID NO: 51066 - RNA, 64 nt, Homo Sapiens
gcuccuaacuccaccgccuauccacccccugcccacaaaaaauuugagaaugugcuuuguaaga

SEQ ID NO: 51067 - RNA, 64 nt, Homo Sapiens
agccaagugugguggcauauuuucuacuaaaaauacaaaaaauugccaacauggugaaacccca

SEQ ID NO: 51068 - RNA, 64 nt, Homo Sapiens
gaaugcuuagaaccuucucaggacaaaaaaucaaacaaaaaaguuagcaaaugaguuuuagcgg

SEQ ID NO: 51069 - RNA, 64 nt, Homo Sapiens
aaacaaaaaagugaaugcuugaguuuuagcggggacaaaaaaucgaaagaaugagcuagcaaau

SEQ ID NO: 51070 - RNA, 64 nt, Homo Sapiens
aaagaaaaaauuuccagaagaggaaaaaaaaacuacaaaaaacaaaacauugaagguugauauu

SEQ ID NO: 51071 - RNA, 64 nt, Homo Sapiens
uaggagcuuauggucaaaaagugcaaaaaaaaaaacaaaaaaaaagcaauagauagagaaauug

SEQ ID NO: 51072 - RNA, 64 nt, Homo Sapiens
aaacaaacaaacaaaaacaaauuuuaagaacacaacaaaaaagauuugacuuccgaauagaaug

SEQ ID NO: 51073 - RNA, 64 nt, Homo Sapiens
uuugacaaaaauguguacuguguaagccuugcaaacaaaaaacaacaaaaaagaagcagcagca

SEQ ID NO: 51074 - RNA, 64 nt, Homo Sapiens
auguguacuguguaagccuugcaaacaaaaaacaacaaaaaagaagcagcagcagcagccugcu

SEQ ID NO: 51075 - RNA, 52 nt, Homo Sapiens
auuuauuguaucccauguaaaaacaaaaaaacaaaaaacaaagaaaagaaag

SEQ ID NO: 51076 - RNA, 60 nt, Homo Sapiens
auuuauuguaucccauguaaaaacaaaaaaacaaaaaacaaagaaaagaaagagauuuua

SEQ ID NO: 51077 - RNA, 64 nt, Homo Sapiens
acuaacauggugaaaucccgucucuacuaaaaauacaaaaaaaaaaaaaaaaaaaagccaggca

SEQ ID NO: 51078 - RNA, 64 nt, Homo Sapiens
ucucaaugaaaaauguaaaaguaccuagaaauucacaaaaaaauuaauaccucuguggagaaaa

SEQ ID NO: 51079 - RNA, 64 nt, Homo Sapiens
gccaacauggugaaauccugccucuacuaaaaauacaaaaaaaaaaaaaaauuagcugggcaug

SEQ ID NO: 51080 - RNA, 64 nt, Homo Sapiens
cacagucugagcaacauggcaaaacccugugucuacaaaaaauaaaaaauuagcugggcaugac

SEQ ID NO: 51081 - RNA, 64 nt, Homo Sapiens
gaagaaaagcaauuauuucauuucagauagaaauacaaaaaaaaaaaaaauacuuuucuuagaa

SEQ ID NO: 51082 - RNA, 64 nt, Homo Sapiens
accagccugggcaacauagugagacuccgucucuacaaaaaauaaauuuagcugggcauggugg

SEQ ID NO: 51083 - RNA, 64 nt, Homo Sapiens
auucaaaagggauugccauuucugagacacaguaacaaaaaaaugaggaaauuauuuugcuucu

SEQ ID NO: 51084 - RNA, 64 nt, Homo Sapiens
uuuuauuagauuuuaccaaugaauuuuucaaaauacaaaaaaaaguaguuuuuccuucauaaca

SEQ ID NO: 51085 - RNA, 64 nt, Homo Sapiens
cauuuuucaaaacuacugcauguuuaaaacuucaacaaaaaaagagagaaagaacuauacuaag

SEQ ID NO: 51086 - RNA, 64 nt, Homo Sapiens
aucaguuucugccaauuucagugguuuauuguucacaaaaaaaucuucaaaacaaguauugacu

SEQ ID NO: 51087 - RNA, 64 nt, Homo Sapiens
cauuaaaauuuuaaguuguaaaaaagaauaagaaacaaaaaacaguucaaauuauaucuaaaca

SEQ ID NO: 51088 - RNA, 64 nt, Homo Sapiens
auaagaaacaaaaaacacaucaaauuauaucuaaacaaaaaagaaaaagaaaagaaacaugguu

SEQ ID NO: 51089 - RNA, 64 nt, Homo Sapiens
uagcugggagugguggcauauuucuacuaaaaauacaaaaaaaugccaacauggcgaaacccca

SEQ ID NO: 51090 - RNA, 64 nt, Homo Sapiens
gccccaacuacaguuugcaagaccagaccucucuacaaaaaauugucucugacgguggguccag

SEQ ID NO: 51091 - RNA, 64 nt, Homo Sapiens
ucaaaaaauuagccaggugugaaaccccaucuccacaaaaaaauaacagcuuggacaucaugac

SEQ ID NO: 51092 - RNA, 64 nt, Homo Sapiens
agcugggcaugguggcaguuucucuacuaaaaauacaaaaaauugccagcauggcgaaacccca

SEQ ID NO: 51093 - RNA, 64 nt, Homo Sapiens
agcagaccaacauauagagugaaugcauuauuccacaaaaaaacaaaccuuuuaaggaugccaa

SEQ ID NO: 51094 - RNA, 64 nt, Homo Sapiens
aaaaaaaagaaaucaagcaguauauauguuccuuacaaaaaaaaaaaggggaauucucuuuucc

SEQ ID NO: 51095 - RNA, 64 nt, Homo Sapiens
aauaaauauuuaaauuccaaaaucccaccuucuaacaaaaaauacuucaucuuauucuucaugu

SEQ ID NO: 51096 - RNA, 64 nt, Homo Sapiens
cucuuuaccuccuuggccauucuuaggcuaaaggacaaaaaaaugaggcucgaggaagcugacu

SEQ ID NO: 51097 - RNA, 64 nt, Homo Sapiens
cuuuuaaaaaaaaguaaaaauacaacccuucuuuacaaaaaaauucuagcuacuggccucuaaa

SEQ ID NO: 51098 - RNA, 64 nt, Homo Sapiens
uauggcacuagaauuuaagacaaaaaacaaacaaacaaaaaagcugaacaaaacaaaacaacaa

SEQ ID NO: 51099 - RNA, 64 nt, Homo Sapiens
aacaaacaaaaaagcuauggaaaacaaaacaacaacaaaaaacauuucucucuuucuuaugaac

SEQ ID NO: 51100 - RNA, 64 nt, Homo Sapiens
uagaguucgaggaauuaccacaaaaggccaaaaaacaaaaaaguguccccauuacuaaaaaacc

SEQ ID NO: 51101 - RNA, 64 nt, Homo Sapiens
uaaaaauuaguuaggugugggagaccccgucucuacaaaaaauaaucagccugggaaacauagu

SEQ ID NO: 51102 - RNA, 64 nt, Homo Sapiens
aauuucuucuugaggugggguucuaaaaauaaaaacaaaaaauagggugaccgagugagacugu

SEQ ID NO: 51103 - RNA, 64 nt, Homo Sapiens
uaaaaaugaaacaaguguggagacccccauugcuacaaaaaauuccagccugggcaacauagcg

SEQ ID NO: 51104 - RNA, 64 nt, Homo Sapiens
aaagagucucauugaacgaaacccaaauauuuguacaaaaaacuaggcuugcugcuacucauua

SEQ ID NO: 51105 - RNA, 64 nt, Homo Sapiens
acucaguaugaaaaaauacauaaaaaaaaaaaaaacaaaaaaaauuaauuauagcuuugaaaga

SEQ ID NO: 51106 - RNA, 64 nt, Homo Sapiens
caagugugccuugaauuguacaaacaaaaaaccaacaaaaaaucaguuuuccguuguuaaaaag

SEQ ID NO: 51107 - RNA, 64 nt, Homo Sapiens
aacaaaaaauccaagugugcuuguuaaaaagcaaacaaaaaaccaauggaguauaaguuuuccg

SEQ ID NO: 51108 - RNA, 64 nt, Homo Sapiens
cuuuccguacauuagugguuaaaacccugucucuacaaaaaauaaccagccugggcaacauagc

SEQ ID NO: 51109 - RNA, 64 nt, Homo Sapiens
uuuauggcccaaaaugaccaaguuaccaaacauuacaaaaaaauuguaauuccauguggauauc

SEQ ID NO: 51110 - RNA, 64 nt, Homo Sapiens
uguuaagaaauggguuucuuucaaauguuugaaaacaaaaaaaaauacguuuugguguugcuuu

SEQ ID NO: 51111 - RNA, 64 nt, Homo Sapiens
cauguguuaaaauacucaguaaacaaacaaacaaacaaaaaaccaucugaaguaugguauuaca

SEQ ID NO: 51112 - RNA, 64 nt, Homo Sapiens
gagagguuuuuuuuuuuaauuuuucccccuuuauacaaaaaaaaaagaacauuuccaaaacuaa

SEQ ID NO: 51113 - RNA, 64 nt, Homo Sapiens
acuccgucccaaaaaaacaaacaaacaaaacaaaacaaaaaaaaacagaaguuacaaaugaaua

SEQ ID NO: 51114 - RNA, 64 nt, Homo Sapiens
gaguucaagaccaaccuggugaaaccccgucucuacaaaaaaacacaaaaaauagccaggcaug

SEQ ID NO: 51115 - RNA, 64 nt, Homo Sapiens
ccaaccuggugaaaccccgucucuacaaaaaaacacaaaaaauagccaggcaugguggcgugua

SEQ ID NO: 51116 - RNA, 64 nt, Homo Sapiens
uggaaggcagaaaccauuaaaaguaaaaauaaaaacaaaaaaguuuuagaaaaaaaagacaaaa

SEQ ID NO: 51117 - RNA, 64 nt, Homo Sapiens
aaaaauaaaaacaaaaaaguuuuagaaaaaaaagacaaaaaaguucaaccaacuuagugacuug

SEQ ID NO: 51118 - RNA, 64 nt, Homo Sapiens
augggauguaacuaaugcuuugauagaugcauagacaaaaaauuuagucacaguccggaagaga

SEQ ID NO: 51119 - RNA, 64 nt, Homo Sapiens
uuaucauaaauuauuucauguaaagaguacuuguacaaaaaagcguauauauguauauauuuaa

SEQ ID NO: 51120 - RNA, 64 nt, Homo Sapiens
uuuaaaaaguaaaaauuagcgagacucugucucuacaaaaaaaucugucucuaaaaagcauauu

SEQ ID NO: 51121 - RNA, 64 nt, Homo Sapiens
ugacagccguggugguucaucuauuuucaaaaagacaaaaaauaucucauccuaauuaagguga

SEQ ID NO: 51122 - RNA, 64 nt, Homo Sapiens
guuaagaaguccuaguugaccagcagcucauagcacaaaaaaagagggauggaccagacugcca

SEQ ID NO: 51123 - RNA, 64 nt, Homo Sapiens
augaaauguaauuucuaaauagcuauguacugccacaaaaaaaggauaccauuauauuuauaug

SEQ ID NO: 51124 - RNA, 64 nt, Homo Sapiens
gccagugccuauugaguauaaaaaaagccacaucacaaaaaaaaguguggaaagccacaucaca

SEQ ID NO: 51125 - RNA, 64 nt, Homo Sapiens
ccacaucacaaaaaaaagccuggaaagccacaucacaaaaaaagucuggacuucuacaauagug

SEQ ID NO: 51126 - RNA, 64 nt, Homo Sapiens
gaagcaaaacacauuguauuauucugguaaaaaaacaaaaaauaaaugcaguuuuauuuuuauc

SEQ ID NO: 51127 - RNA, 64 nt, Homo Sapiens
uauuugaucugaguuucuauucuaccuccaacccacaaaaaagaauuugcuugauuuguuaacu

SEQ ID NO: 51128 - RNA, 64 nt, Homo Sapiens
ccuuccugugauacuuuauuagcaaaaacaaaaaacaaaaaagaauuuguaguaaaacuuaaaa

SEQ ID NO: 51129 - RNA, 64 nt, Homo Sapiens
aaaaagaccuuccugugauacuuaaaaagcaaaaacaaaaaacagucacucauuuguaguaaaa

SEQ ID NO: 51130 - RNA, 64 nt, Homo Sapiens
ucuuuaaugguuaauaggauuaaaugagacacauacaaaaaaaauaagguauaaggaucuuuug

SEQ ID NO: 51131 - RNA, 64 nt, Homo Sapiens
aauaaaaaaauauauacagaguuauuaaaaaaacacaaaaaaauuggggcauuaauauucuuuu

SEQ ID NO: 51132 - RNA, 64 nt, Homo Sapiens
caacacaccacucauuggaaaauggaaaaaaaaaacaaaaaaaaaacaaaaaaauguacaaugg

SEQ ID NO: 51133 - RNA, 64 nt, Homo Sapiens
ucauuggaaaauggaaaaaaaaaacaaaaaaaaaacaaaaaaauguacaauggaugcauugaaa

SEQ ID NO: 51134 - RNA, 64 nt, Homo Sapiens
caucuuucuuuggaugggacuagagcuuucuuucacaaaaaagaaguaggggaagacaugcagc

SEQ ID NO: 51135 - RNA, 64 nt, Homo Sapiens
augcacauauauauauguauuuaaaaaaaucaaaacaaaaaaaaacucauuuauaccuguguau

SEQ ID NO: 51136 - RNA, 64 nt, Homo Sapiens
gucuacauggugaaaccccaucucaacuaaaaauacaaaaaauacaaaaaauuagccgggcgcg

SEQ ID NO: 51137 - RNA, 64 nt, Homo Sapiens
gugaaaccccaucucaacuaaaaauacaaaaaauacaaaaaauuagccgggcgcgguggcucac

SEQ ID NO: 51138 - RNA, 64 nt, Homo Sapiens
accagccuggccaauauggugaaacccugucucuacaaaaaauacaaaaauuagcugggcaugg

SEQ ID NO: 51139 - RNA, 64 nt, Homo Sapiens
gugugguaguauuuuguuggaagagaauguuuauacaaaaaaugaaauucuuccaacagcagag

SEQ ID NO: 51140 - RNA, 64 nt, Homo Sapiens
gcuaacacugugaaaccccgucucuacuaaaaauacaaaaaauuagcggggcaugguggcacgc

SEQ ID NO: 51141 - RNA, 64 nt, Homo Sapiens
ggugacagagcgagacuccgucucaaacaaacaaacaaaaaacuguuuucauuugcucucuuga

SEQ ID NO: 51142 - RNA, 64 nt, Homo Sapiens
cuuuacuaugugcuaggauaucauauuuaaaaggacaaaaaaauguaaaauacuugaaugagcu

SEQ ID NO: 51143 - RNA, 64 nt, Homo Sapiens
uguaauuugugguaauuaugcuuuucuuuuuaauacaaaaaaauguauaaaaauaaacacuuga

SEQ ID NO: 51144 - RNA, 64 nt, Homo Sapiens
gcuaacauggugaaacccugccucuacuaaaaauacaaaaaaaaacaaaauuagccgggcgugg

SEQ ID NO: 51145 - RNA, 64 nt, Homo Sapiens
cugggcgacagagugagacuccaucucaaaacaaacaaaaaaaggauggggcugggcuggagag

SEQ ID NO: 51146 - RNA, 64 nt, Homo Sapiens
accagccuggucaacaugucaaaacccuguaccuacaaaaaaauacaaaaguuaaccaagccua

SEQ ID NO: 51147 - RNA, 64 nt, Homo Sapiens
auugaaaauaucccuuaggaaaaaaaaaaaacacacaaaaaaccacaagagccccagccaguuu

SEQ ID NO: 51148 - RNA, 64 nt, Homo Sapiens
aaaaaagaaaauauguaauauaauguaaaaaaaaacaaaaaaaagcuuuuaugauggauuuugu

SEQ ID NO: 51149 - RNA, 64 nt, Homo Sapiens
auacugugagccagagagaaaguaaaagcacuucacaaaaaaaugaaaauucuaaggacauaca

SEQ ID NO: 51150 - RNA, 64 nt, Homo Sapiens
ugagaguuuuuacagcucaucauucaaauaacgcacaaaaaacaaaagccgcuaugaccggcgu

SEQ ID NO: 51151 - RNA, 64 nt, Homo Sapiens
gcuaacacggugaaaccccgucucuacuaaaaauacaaaaaaaauuagucggaugugguggcag

SEQ ID NO: 51152 - RNA, 64 nt, Homo Sapiens
uuucccugagaaagggaauuaugaaauuuuuaauacaaaaaauaauccauuuaggugcugaguu

SEQ ID NO: 51153 - RNA, 64 nt, Homo Sapiens
accaauauggugaaaccccaucucuacuaaaauuacaaaaaaaauuauccaggcgugguggugc

SEQ ID NO: 51154 - RNA, 64 nt, Homo Sapiens
gcgacugaggcuggaagaugauauggauuggaacacaaaaaaucuuuuuuuaaucuuuuuaaaa

SEQ ID NO: 51155 - RNA, 64 nt, Homo Sapiens
uucuccucucccugacuggugucagauucaucaaacaaaaaauaaaucucgaagaaaaaaaaug

SEQ ID NO: 51156 - RNA, 64 nt, Homo Sapiens
gauauacugugggaugaguaucucaggguaaguaacaaaaaaacaaacaaaaaaaaucacugaa

SEQ ID NO: 51157 - RNA, 64 nt, Homo Sapiens
gaugaguaucucaggguaaguaacaaaaaaacaaacaaaaaaaaucacugaaauuuuucccuca

SEQ ID NO: 51158 - RNA, 64 nt, Homo Sapiens
aaccuuuguucugggauuuacuguuaaaaaacaaacaaaaaacaacaaaaaagcggugacagga

SEQ ID NO: 51159 - RNA, 64 nt, Homo Sapiens
cugggauuuacuguuaaaaaacaaacaaaaaacaacaaaaaagcggugacaggaaacaguuaag

SEQ ID NO: 51160 - RNA, 64 nt, Homo Sapiens
gccaacauggugaaaccccaucucuacuaaaaauacaaaaaauuagcugggcaugcacuuguaa

SEQ ID NO: 51161 - RNA, 64 nt, Homo Sapiens
ggcaugguggaauaaccaaaauguguaucauucuacaaaaaaauaggccuggacuauuuaagga

SEQ ID NO: 51162 - RNA, 64 nt, Homo Sapiens
ucuagcacaauuauggguuacuuccuuuuucuuaacaaaaaagaauguuugauuuccucugggu

SEQ ID NO: 51163 - RNA, 64 nt, Homo Sapiens
uacuuagauuuucuuuuaaaaaaauuaaaauaaaacaaaaaaaaauuucuaggacuagacgaug

SEQ ID NO: 51164 - RNA, 64 nt, Homo Sapiens
uagggccauaucuccaaaaaaagaaagaaaaaauacaaaaaacaaaaacaaaaaaaaaagaggg

SEQ ID NO: 51165 - RNA, 64 nt, Homo Sapiens
ccaaaaaaagaaagaaaaaauacaaaaaacaaaaacaaaaaaaaaagaggguaauguacaaguu

SEQ ID NO: 51166 - RNA, 64 nt, Homo Sapiens
auuaguagcuguccuggcccacuuaaacaagguuacaaaaaaucagagucggaagcagccaaau

SEQ ID NO: 51167 - RNA, 64 nt, Homo Sapiens
cacacagaauuguguugacugggggaggugaaucacaaaaaaguuacgaggaguuuaagaguua

SEQ ID NO: 51168 - RNA, 64 nt, Homo Sapiens
aaucuaacugaagaacuaaggagacuccaucucaacaaaaaaaauccagcuugggugacagagu

SEQ ID NO: 51169 - RNA, 64 nt, Homo Sapiens
aagccagcuguccuuggagccaugaguaauguagacaaaaaaaaggauguauaaaguguuacug

SEQ ID NO: 51170 - RNA, 64 nt, Homo Sapiens
cuagugugugaggugauacauaaguguucucaccacaaaaaaugaaguguuugaaaguacauuu

SEQ ID NO: 51171 - RNA, 64 nt, Homo Sapiens
acucgaaugacuuaggcagaauuaaaaacgaaaaacaaaaaaaauuugcuugggcaccaacaga

SEQ ID NO: 51172 - RNA, 64 nt, Homo Sapiens
acccugagaccaugagugggaaaaaaaaaaaaaaacaaaaaaaauaaggguuuauuuuauguaa

SEQ ID NO: 51173 - RNA, 64 nt, Homo Sapiens
agguguaguggcaggcaccuucucuacuaaaaauacaaaaaauugccaacauggugaaacccca

SEQ ID NO: 51174 - RNA, 64 nt, Homo Sapiens
aauuaaaaaaaaaaacagaaacaaaaaacaaacaacaaaaaaaaugcuauguuaaaaacaaaca

SEQ ID NO: 51175 - RNA, 64 nt, Homo Sapiens
aacaacaaaaaaaaaauuaaguuaaaaacaaacaacaaaaaacacaccaaagaaguccugcuau

SEQ ID NO: 51176 - RNA, 64 nt, Homo Sapiens
agaagcaaguuguacugcuaauuaagaaauaaaaacaaaaaacaaaacaaaaaacaaccuuagc

SEQ ID NO: 51177 - RNA, 64 nt, Homo Sapiens
accuuagcauuaagaaauaaaaacaaacaaacaaacaaaaaacaaagaagccuuaauacucugu

SEQ ID NO: 51178 - RNA, 64 nt, Homo Sapiens
aaaaacccauggaagcaacacuuuacucaaaaaaacaaaaaaaccaucugaauuguuuuaauau

SEQ ID NO: 51179 - RNA, 64 nt, Homo Sapiens
ccuuggaaccuuuguacgcuuugcucaaaaaaaaacaaaaaaaaaaaacaaaaaaaaaaaacaa

SEQ ID NO: 51180 - RNA, 64 nt, Homo Sapiens
guacgcuuugcucaaaaaaaaacaaaaaaaaaaaacaaaaaaaaaaaacaacgguggagccuuc

SEQ ID NO: 51181 - RNA, 64 nt, Homo Sapiens
uucuggcaaauaacaauuagaaaagauagguuuaacaaaaaaauuuacuuguauauaaugcacc

SEQ ID NO: 51182 - RNA, 64 nt, Homo Sapiens
uguauaauauuacuucaaagauauguaaucacaaacaaaaaaaacuauuuuuuauaaugucauu

SEQ ID NO: 51183 - RNA, 64 nt, Homo Sapiens
gugacagggucugacauggucagucuacuaaaaaacaaaaaaaaaaaacaaaaaaaaaaaaaca

SEQ ID NO: 51184 - RNA, 64 nt, Homo Sapiens
acauggucagucuacuaaaaaacaaaaaaaaaaaacaaaaaaaaaaaaacaaaagaaaaaaaua

SEQ ID NO: 51185 - RNA, 64 nt, Homo Sapiens
ggcaauggagucagauucucuuucuuaaaaaaccacaaaaaaacuggauuuccaguucucuaau

SEQ ID NO: 51186 - RNA, 64 nt, Homo Sapiens
guggacagagcaagacuccgucucaaagaaacaaacaaaaaauuaaaagggauagaauauaaug

SEQ ID NO: 51187 - RNA, 64 nt, Homo Sapiens
ugggcgacagagcaggacucucucucaaaaaaacacaaaaaaacaaaaacaaaaaaccauacac

SEQ ID NO: 51188 - RNA, 64 nt, Homo Sapiens
ggacucucucucaaaaaaacacaaaaaaacaaaaacaaaaaaccauacacacacacacacacac

SEQ ID NO: 51189 - RNA, 64 nt, Homo Sapiens
uaaaaaccaccaaggaaaccuacuccaaaaaugaacaaaaaaaaaaaaagcgaaagacugcagu

SEQ ID NO: 51190 - RNA, 64 nt, Homo Sapiens
guugugcuaaaaacaaaacaaaacaaacaaacaaacaaaaaaguaaaaaaagauuacuuucgag

SEQ ID NO: 51191 - RNA, 64 nt, Homo Sapiens
gcuaacaaggugaaaccccgucucuacuaaaaauacaaaaaauuagccaggcgcgguggcgggg

SEQ ID NO: 51192 - RNA, 64 nt, Homo Sapiens
ggccugggugaaagagcgagacuccgucucaaaaacaaaaaaaaaagaaaagaaauauauuuua

SEQ ID NO: 51193 - RNA, 64 nt, Homo Sapiens
aauggaauauaauggaauauucuugagacugaucacaaaaaaaaaaaccuuuuuaauauuucuu

SEQ ID NO: 51194 - RNA, 64 nt, Homo Sapiens
cugaguuuucccuucuguaucaaaacaaaauaauacaaaaaaugcuuuuagaguuuaagcaaug

SEQ ID NO: 51195 - RNA, 64 nt, Homo Sapiens
ccucuuuaaauaauauguauagacaacaacaacgacaaaaaauagacuguuuuaaaguuucagg

SEQ ID NO: 51196 - RNA, 64 nt, Homo Sapiens
acauucuauuuauuuauugaaaaaaacuuaaaauacaaaaaacaccucugaggggaaaaacaaa

SEQ ID NO: 51197 - RNA, 64 nt, Homo Sapiens
acuuaaaauacaaaaaacaacucugaggggaaaaacaaaaaaaaaauucuuuuuuucauccuuc

SEQ ID NO: 51198 - RNA, 64 nt, Homo Sapiens
acaaaaguaaauuaaaaacaaaacaaaaaaaaaaacaaaaaaaaaaaaauagaaauuaaaaaca

SEQ ID NO: 51199 - RNA, 64 nt, Homo Sapiens
aaacaaaaaaaaacaaaaguaaauuaaaaacaaaacaaaaaaaaugaguuaaccagaaaaauag

SEQ ID NO: 51200 - RNA, 64 nt, Homo Sapiens
uugacaucagaugaaaugaaugacgacgacaaccacaaaaaaaaaaaaaaaaaaaaaaacaaga

SEQ ID NO: 51201 - RNA, 64 nt, Homo Sapiens
aaaaaaaaaaaacaagaugauuuguuaaaaaaaaacaaaaaaaaaaaaacaagaccagauguga

SEQ ID NO: 51202 - RNA, 64 nt, Homo Sapiens
aaaacuaaggcacuucacuuaaaaaccacaaaaaacaaaaaaaccccacccccccaaaaaauaa

SEQ ID NO: 51203 - RNA, 64 nt, Homo Sapiens
aaaaaacaaaacuaaggcacaaaauaaaaaaaccacaaaaaacaagcuccucccacccccccaa

SEQ ID NO: 51204 - RNA, 64 nt, Homo Sapiens
cagagaagcugccugcguaagcagguuacaaaaaacaaaaaaaaaaccugagauuucuaagcuu

SEQ ID NO: 51205 - RNA, 64 nt, Homo Sapiens
aaaaaaacagagaagcugccuaagcuugcagguuacaaaaaacaggagcacaaccugagauuuc

SEQ ID NO: 51206 - RNA, 64 nt, Homo Sapiens
agccgggcgcgguggcgggcucucuacuaaaaauacaaaaaauugcuaacaaggugaaaccccg

SEQ ID NO: 51207 - RNA, 64 nt, Homo Sapiens
uuuuacuucgugauuccacgauccagauuuguuaacaaaaaagacgucacccauugggcaagag

SEQ ID NO: 51208 - RNA, 64 nt, Homo Sapiens
ugugagauccacaguuacaaaaccaggaugguucacaaaaaagcaaaguaaugaagccuuuccc

SEQ ID NO: 51209 - RNA, 64 nt, Homo Sapiens
agcaccaugaauuuguacuguauuaaaaaaaaauacaaaaaaaacugucuuugcagaauuaucu

SEQ ID NO: 51210 - RNA, 64 nt, Homo Sapiens
aguuugaguugauaguuauuaaaaagaaaacaaaacaaaaaaaaaaggcaaggcacaacaaaaa

SEQ ID NO: 51211 - RNA, 64 nt, Homo Sapiens
aagaaaacaaaacaaaaaaaaaaggcaaggcacaacaaaaaaauauccugggcaauaaaaaaaa

SEQ ID NO: 51212 - RNA, 63 nt, Homo Sapiens
aaggaaaagaaaaaaaaucaaucucuacuugggcacaaaaaaacaucguuucaaucgcaucgu

SEQ ID NO: 51213 - RNA, 64 nt, Homo Sapiens
uucaacugccuuaugcccuuacaaacacaaacaaacaaaaaaccaaagaacaaaacaaaacaaa

SEQ ID NO: 51214 - RNA, 64 nt, Homo Sapiens
aagaauuaauaagucacaacccaacaccaccacuacaaaaaaaaccaccaccaacaccgccaca

SEQ ID NO: 51215 - RNA, 64 nt, Homo Sapiens
cauaugcacaugccucauuuaacacaaaggacagacaaaaaagcuacguuuuaaguuauuuagg

SEQ ID NO: 51216 - RNA, 63 nt, Homo Sapiens
aaacaauucauuagccucagauuaaaagcaaaaacaaaaaacauucaaggcuuucagguauga

SEQ ID NO: 51217 - RNA, 64 nt, Homo Sapiens
guguaauaaaguuaguggcuaaaaaaaacaaaaaacaaaaaaacaacaauaagcuagaaaagac

SEQ ID NO: 51218 - RNA, 64 nt, Homo Sapiens
aaaaaacguguaauaaaguuaaaagacaaaaaaaacaaaaaacauucuaccaacaauaagcuag

SEQ ID NO: 51219 - RNA, 64 nt, Homo Sapiens
caaaaaacaaaaaaacguguauaagcuagaaaagacaaaaaaaaagccuguuuuucuaccaaca

SEQ ID NO: 51220 - RNA, 64 nt, Homo Sapiens
acuuuucuaaggacugaagauuuuuuuuuuuuuaacaaaaaaacagaauaguuaucccccccuu

SEQ ID NO: 51221 - RNA, 64 nt, Homo Sapiens
aguaaaauauaaaaacaaauaaaaacaaaaaaacacaaaaaaauccuagauuacuuauugauuu

SEQ ID NO: 51222 - RNA, 64 nt, Homo Sapiens
acaaaaaaauaguaaaauauuuauugauuuaaaaacaaaaaaacuaaugcuaguccuagauuac

SEQ ID NO: 51223 - RNA, 64 nt, Homo Sapiens
acuauggacagcuuucugauucuuuuacuuguuaacaaaaaaauucacuggaugaacuugaaga

SEQ ID NO: 51224 - RNA, 64 nt, Homo Sapiens
uaaagauuuuauguaucacuuuauugcaauacauacaaaaaaguuugucaaauauaaaauaaug

SEQ ID NO: 51225 - RNA, 64 nt, Homo Sapiens
guacuaguuuugcuuuaaaaugcuauguaaauauacaaaaaaacuagaaagaaauauauauaac

SEQ ID NO: 51226 - RNA, 64 nt, Homo Sapiens
gcuaaugcguugaaacuccgucucuacuaaaaauacaaaaaauuagcugggcgugguggugggc

SEQ ID NO: 51227 - RNA, 64 nt, Homo Sapiens
acccuguauucuggaugcuaaaaaacaaaaacaaacaaaaaaacaaaaacaaaaaaacaaaacc

SEQ ID NO: 51228 - RNA, 64 nt, Homo Sapiens
augcuaaaaaacaaaaacaaacaaaaaaacaaaaacaaaaaaacaaaaccagaaucagguaaaa

SEQ ID NO: 51229 - RNA, 64 nt, Homo Sapiens
caagaccuaacugcagccgcuuugggaaaaaaaaacaaaaaacaaaaaacagaaaacaaaaaaa

SEQ ID NO: 51230 - RNA, 64 nt, Homo Sapiens
uaacugcagccgcuuugggaaaaaaaaacaaaaaacaaaaaacagaaaacaaaaaaaaaaaaac

SEQ ID NO: 51231 - RNA, 64 nt, Homo Sapiens
accgucauggcgaaaccccgucuauacuaaaaauacaaaaaauagccaggcaugguggcgcacg

SEQ ID NO: 51232 - RNA, 64 nt, Homo Sapiens
ucucugucuacucagaucauagugaaaacuggaaacaaaaaaaaaaaacagccucuucuuggaa

SEQ ID NO: 51233 - RNA, 64 nt, Homo Sapiens
cuguauauuuaugaccagagcaaaaauguaaaaaacaaaaaaaacaacaaaaaaaguuuguuac

SEQ ID NO: 51234 - RNA, 64 nt, Homo Sapiens
gaccagagcaaaaauguaaaaaacaaaaaaaacaacaaaaaaaguuuguuacuuugaauagucc

SEQ ID NO: 51235 - RNA, 64 nt, Homo Sapiens
cauauauacugcuguaucauuugucucaaaaaaaacaaaaaaaacuggggacagagcaagacuc

SEQ ID NO: 51236 - RNA, 64 nt, Homo Sapiens
auacaagcgccucaccuuagguuuccaugaaauaacaaaaaaaacuaugaaaaggcuuccagga

SEQ ID NO: 51237 - RNA, 64 nt, Homo Sapiens
auaccuguagaaauauuauuauguauacacacacacaaaaaaaagagacaauuaauuguacaua

SEQ ID NO: 51238 - RNA, 64 nt, Homo Sapiens
uagacaaggagagaggcacuaaaaaaaaaaaaaaacaaaaaaacucaaacuugcaaaaaaaaaa

SEQ ID NO: 51239 - RNA, 64 nt, Homo Sapiens
uugauaagacaaguuuagaauugguuuacuuaauacaaaaaaaaaaaaaagaauuucaaaaaaa

SEQ ID NO: 51240 - RNA, 64 nt, Homo Sapiens
guauaaaucccuaauauuuaaaaaaaaaaacaaaacaaaaaaagguuacaaaguuuguuaacuu

SEQ ID NO: 51241 - RNA, 64 nt, Homo Sapiens
ccuguaguuucauuaccuuuuugaauaaugucauacaaaaaauguauuuguuuuuuugugcugu

SEQ ID NO: 51242 - RNA, 64 nt, Homo Sapiens
gccaacacggugaaaccccgccucuacuaaaaauacaaaaaauagccgggugugguggugggca

SEQ ID NO: 51243 - RNA, 64 nt, Homo Sapiens
guagaaauaggaaaacaacaaaagaaaaacaauaacaaaaaaagaaagugugauggcugggugc

SEQ ID NO: 51244 - RNA, 64 nt, Homo Sapiens
agguaaccgucuaugguguguuuuuucauuaaugacaaaaaaaaaaagguuucaacuggauuau

SEQ ID NO: 51245 - RNA, 64 nt, Homo Sapiens
gccaacauggugaaaccccacgucuacuaaaaauacaaaaaauuagccgggcgugguggcacac

SEQ ID NO: 51246 - RNA, 64 nt, Homo Sapiens
gucaacauggugaaacccccuaucuacuaaaaauacaaaaaauuagcugggcaugguggcaugc

SEQ ID NO: 51247 - RNA, 64 nt, Homo Sapiens
aggagaacuuacucaaguugguaaagaacauacuacaaaaaacccuacagcuaacauuauccuu

SEQ ID NO: 51248 - RNA, 64 nt, Homo Sapiens
acuccagccugagugacagagagagauucaaaaaacaaaaaaaaagcaaaaauauacuuugcua

SEQ ID NO: 51249 - RNA, 64 nt, Homo Sapiens
uacaaccuugauaacaaaaccuaaaaaaaaaacaacaaaaaaacccauaaagcuauagaccaaa

SEQ ID NO: 51250 - RNA, 64 nt, Homo Sapiens
caacugccaaguuauuaguuccuaaauacuauccacaaaaaaggggaacagggaugauuccuag

SEQ ID NO: 51251 - RNA, 64 nt, Homo Sapiens
agaccagccugggcaacauggcacaauugucucuacaaaaaauacaaaaauuagccaggcaugg

SEQ ID NO: 51252 - RNA, 64 nt, Homo Sapiens
acaaagaccgagucuucuuuuuuuuuaaacaaaaacaaaaaaagcaaccagggcuauuuguaca

SEQ ID NO: 51253 - RNA, 64 nt, Homo Sapiens
uguguauuguuuuuauuuugcgaaacaaaacaaaacaaaaaaaaaagcuuggaacuccaucacg

SEQ ID NO: 51254 - RNA, 64 nt, Homo Sapiens
agccgggcgucgcagcaugcgucucuacuaaaauacaaaaaauugggcaacacggugaaacccc

SEQ ID NO: 51255 - RNA, 64 nt, Homo Sapiens
ugguaugugaagaugcaccgcccagaaggccgacacaaaaaaaaucacugaaagggcugucaac

SEQ ID NO: 51256 - RNA, 64 nt, Homo Sapiens
auagccagguguggggugcaaaauaaauuuaaauacaaaaaaaaucugccucaaaaaaaaauua

SEQ ID NO: 51257 - RNA, 64 nt, Homo Sapiens
agggcugggcgcgguugcucgucucuacuaaaauacaaaaaaauggccaacguggugaaacgcu

SEQ ID NO: 51258 - RNA, 64 nt, Homo Sapiens
gaaagcaucuucacaaugaaacugaaaacaaaaaacaaaaaaacucauucuucagugccucaug

SEQ ID NO: 51259 - RNA, 64 nt, Homo Sapiens
aaaaaacgaaagcaucuucaccucaugacugaaaacaaaaaacagcacaacucauucuucagug

SEQ ID NO: 51260 - RNA, 64 nt, Homo Sapiens
ucacacauaccuaaaauaagcccugucucuuaaaacaaaaaaccgccuaggcaacagagcaaga

SEQ ID NO: 51261 - RNA, 64 nt, Homo Sapiens
acccuuuuacaauaugaaugugcuucaucuguacacaaaaaaauagccaguaaaaauauuguuu

SEQ ID NO: 51262 - RNA, 64 nt, Homo Sapiens
gcugcagaucuagaaaugcauuguguuuugagguacaaaaaaaucuucgaagcuuccagauggu

SEQ ID NO: 51263 - RNA, 64 nt, Homo Sapiens
guugucuaauauaucuacagaucuaaaaaaaaaaacaaaaaacucuuauucuuuaacaaagaga

SEQ ID NO: 51264 - RNA, 64 nt, Homo Sapiens
gccaaccuggugaaacccugucucuacuaaaaauacaaaaaaaauuagcugagcgugguggcgg

SEQ ID NO: 51265 - RNA, 64 nt, Homo Sapiens
gacuccaucucaaaacaaaacaaaacaaaacaaaacaaaaaaacccggcuuugcugcuuuuaac

SEQ ID NO: 51266 - RNA, 64 nt, Homo Sapiens
acagcucagacuuuguauuuaaaaguuaaaaaggacaaaaaaaaaaucuaaagcauuuaaaauc

SEQ ID NO: 51267 - RNA, 64 nt, Homo Sapiens
uauaaaauugauguugucuuuaccagaaagguagacaaaaaagaagcagcagcagcucuuaaag

SEQ ID NO: 51268 - RNA, 64 nt, Homo Sapiens
agauuugaaaauacaagauugauuagaugaaucuacaaaaaaguuguccuccucucaggucccu

SEQ ID NO: 51269 - RNA, 64 nt, Homo Sapiens
aaaauguauucuccuuuccuauaccgcucucccaacaaaaaaacaacuaguuaguucuacuaau

SEQ ID NO: 51270 - RNA, 64 nt, Homo Sapiens
gccaacaaggugaaacccugucucuacuaaaaauacaaaaaauuagccaggcaugguggugcgc

SEQ ID NO: 51271 - RNA, 64 nt, Homo Sapiens
aaagaauuguuaaauguucuuaaauguucucacuacaaaaaaagaaaaaagauaacuacgugag

SEQ ID NO: 51272 - RNA, 64 nt, Homo Sapiens
cccccaucagggaccagacuguuccaaaaaaaaaacaaaaaacaaaaacaaacaaaaaaacacu

SEQ ID NO: 51273 - RNA, 64 nt, Homo Sapiens
acuguuccaaaaaaaaaacaaaaaacaaaaacaaacaaaaaaacacuuaaaagcccaaggagua

SEQ ID NO: 51274 - RNA, 64 nt, Homo Sapiens
auauuuauuguauuuuaguaauucaccauguaaaacaaaaaacacucucuaugguaaagauauu

SEQ ID NO: 51275 - RNA, 64 nt, Homo Sapiens
accccaaaaugaagauuauuuagaacagaaaacaacaaaaaauaggagaacagugauuuuuuuu

SEQ ID NO: 51276 - RNA, 64 nt, Homo Sapiens
gcucacacuccacaucccguauuaaggcaacugaacaaaaaaauugacuagaaagugaauaaaa

SEQ ID NO: 51277 - RNA, 64 nt, Homo Sapiens
aaagaaauuuauuuauuaaagucuuuacaaaaaaacaaaaaagaaucuacuguuucaaaaaagu

SEQ ID NO: 51278 - RNA, 64 nt, Homo Sapiens
aaaaaagaaaagaaauuuauaaaaaagugucuuuacaaaaaaacugggcuaaaucuacuguuuc

SEQ ID NO: 51279 - RNA, 64 nt, Homo Sapiens
aacaaucaaaaaaaaagacaacauuuacagaguuacaaaaaacaacaagagacucaaaucuaaa

SEQ ID NO: 51280 - RNA, 64 nt, Homo Sapiens
auuagguuugcuaaauucuuucacagacuauaaaacaaaaaauuuugaggaacaccucucauca

SEQ ID NO: 51281 - RNA, 64 nt, Homo Sapiens
uaaugacaaaaagcacaugcagaguaauacacaaacaaaaaaagugacaguuacuuuuuuguga

SEQ ID NO: 51282 - RNA, 64 nt, Homo Sapiens
uaaauauguacagugcacgggcuaugagauagcaacaaaaaaugcauaguuaauggucauagac

SEQ ID NO: 51283 - RNA, 64 nt, Homo Sapiens
acccuuuuuuuuuuccuuuaaguauucuugagauacaaaaaaaaaaaguaaauacaauuucaaa

SEQ ID NO: 51284 - RNA, 64 nt, Homo Sapiens
aguccaaacugauauauccuaaaaaacaacaacaacaaaaaacaacugaacuucaaaacaaaac

SEQ ID NO: 51285 - RNA, 64 nt, Homo Sapiens
acaacaacaaaaaacaagucaacuucaaaacaaaacaaaaaacacuguaaaaaaaagugcacug

SEQ ID NO: 51286 - RNA, 64 nt, Homo Sapiens
cauucuaaauacuagagauacaaaacaaaaaaacacaaaaaacauuccuucuuaaaaucaaaaa

SEQ ID NO: 51287 - RNA, 64 nt, Homo Sapiens
acaaaaaacacauucuaaauaaaucaaaaacaaaacaaaaaaacuggaaaagaauuccuucuua

SEQ ID NO: 51288 - RNA, 64 nt, Homo Sapiens
cuaucaaucuuauaaauauauaacauuguucauaacaaaaaauguauguucugagauauaaugu

SEQ ID NO: 51289 - RNA, 64 nt, Homo Sapiens
cuaggagauaaauguagaggacaauauuccgaaaacaaaaaaacuuuggucuuuauuaaaaauc

SEQ ID NO: 51290 - RNA, 64 nt, Homo Sapiens
aguuugcuuacuauuugauuuuuucuugagacaaacaaaaaaaaaaauuccaaaguaauaaaac

SEQ ID NO: 51291 - RNA, 64 nt, Homo Sapiens
aaaagaagaaauuccaaaguuagaaaaaauaaauacaaaaaaaaauugcaaaaauuucuuuuuc

SEQ ID NO: 51292 - RNA, 64 nt, Homo Sapiens
gggaaauggggaggggaaaauuaccaugguuugaacaaaaaaaguucugcagaaaucagaacuc

SEQ ID NO: 51293 - RNA, 64 nt, Homo Sapiens
uuuaaaaaaaauggcagcaaaauaaaaaaccccuacaaaaaaacaaaagaaaaaaaacacaaaa

SEQ ID NO: 51294 - RNA, 64 nt, Homo Sapiens
aaaaaccccuacaaaaaaacaaaagaaaaaaaacacaaaaaauagaaacccaauucuaagcaga

SEQ ID NO: 51295 - RNA, 64 nt, Homo Sapiens
aaaaauguaauaauugauauuguccugguuauuaacaaaaaaggguucuuccaagagacuucca

SEQ ID NO: 51296 - RNA, 64 nt, Homo Sapiens
uggauguauauugcuuuaagccaauaaaccaacaacaaaaaaaguggagacaguuuuaacaaaa

SEQ ID NO: 51297 - RNA, 64 nt, Homo Sapiens
aaaaaaaaaagaaaacagaaauuuuuugccauuuacaaaaaaaaaggacuacagaugagauuaa

SEQ ID NO: 51298 - RNA, 64 nt, Homo Sapiens
uaaugcuaguccuagauuacuuauugauuuaaaaacaaaaaaaagauuacuuaauuuugauuua

SEQ ID NO: 51299 - RNA, 64 nt, Homo Sapiens
aacaaaaaaaagauuacuuaauuuugauuuaaaaacaaaaaaucguaaaauacaaaaaccaguu

SEQ ID NO: 51300 - RNA, 64 nt, Homo Sapiens
gaggaagcggaaagcguuuucuuugcucgaggggacaaaaaagucaaaacgaggcgagaggcga

SEQ ID NO: 51301 - RNA, 64 nt, Homo Sapiens
auuuugcuuaaaccacucauucguuaaagugauuacaaaaaaguucaagaaugauguccacugc

SEQ ID NO: 51302 - RNA, 64 nt, Homo Sapiens
acugcaaaagucuaaaauacaaaacaaaaagcaaacaaaaaaaagaguauaaaggaaaaacagc

SEQ ID NO: 51303 - RNA, 64 nt, Homo Sapiens
uaacuuaaaaacaagaaacuuugguggaacugacacaaaaaaaguacaagccaaaugauuuuca

SEQ ID NO: 51304 - RNA, 64 nt, Homo Sapiens
uaaaaaaaagguuugcuaauaaaacaaaaaaaaaacaaaaaauuccaucaauuuaaaaguaaaa

SEQ ID NO: 51305 - RNA, 64 nt, Homo Sapiens
aacaaaaaauuuaaaaaaaauaaaaguaaaaaaaacaaaaaaaagccacgguucaccaucaauu

SEQ ID NO: 51306 - RNA, 64 nt, Homo Sapiens
acuucugcaaaagcuuggaaaaugaaaacuuuauacaaaaaaggacaauaaagaugaaagaaaa

SEQ ID NO: 51307 - RNA, 63 nt, Homo Sapiens
aaaaaaaaaaaaaagccaagagagaaaagcaaugacaaaaaaaaaaaaaaaaaaggaaagaaa

SEQ ID NO: 51308 - RNA, 64 nt, Homo Sapiens
agaaaacuaccuucugaucugauuucacaaauagacaaaaaagagguaaaaugugaugaagaug

SEQ ID NO: 51309 - RNA, 64 nt, Homo Sapiens
accagccugggcaacauggcaaaaccccaucucuacaaaaaauacaaaaaguaggccgggcacg

SEQ ID NO: 51310 - RNA, 64 nt, Homo Sapiens
gccaacaugguggaacccaaucucuacuaaaaauacaaaaaaacuagccggauaugguggcggg

SEQ ID NO: 51311 - RNA, 64 nt, Homo Sapiens
uagaaauauuuuucaguuguuuaugucguuuacuacaaaaaaaaagauucagaguggauggagu

SEQ ID NO: 51312 - RNA, 64 nt, Homo Sapiens
uuuaaaauaaucuaagcaucauugaagcaguaacacaaaaaaaagguucaguauuuucuuuuua

SEQ ID NO: 51313 - RNA, 64 nt, Homo Sapiens
uccaucucaaaaacaaaaacaaaacaaaacaacaacaaaaaaagaaguuaaauaacuuguuuaa

SEQ ID NO: 51314 - RNA, 64 nt, Homo Sapiens
uggaaaucuucauucucaguaaacuaucgcaaggacaaaaaaccaaacaccacauguucucacu

SEQ ID NO: 51315 - RNA, 64 nt, Homo Sapiens
uccuuaguuuaauucuauuguaucuguuuauuuaacaaaaaauucaucauaccaaaaaguguaa

SEQ ID NO: 51316 - RNA, 64 nt, Homo Sapiens
aaaaaguguaagugaaaacccccuuuaaaacaaaacaaaaaaaugaaauaaaauuaggcaaauu

SEQ ID NO: 51317 - RNA, 64 nt, Homo Sapiens
ucuguuuaauuauguaaaaaacaaaacuacaacaacaaaaaaagaaaaaaguuaaaaaagaaaa

SEQ ID NO: 51318 - RNA, 64 nt, Homo Sapiens
uaaaaaagaaaaaaacaccaaaaaacaaaaacaaacaaaaaaaaaaacccacaacccuuaucug

SEQ ID NO: 51319 - RNA, 64 nt, Homo Sapiens
ugagaauguuguuuuaaaagaaaauagcaaaacaacaaaaaagcaaaccuuaaaaugugaagaa

SEQ ID NO: 51320 - RNA, 64 nt, Homo Sapiens
uagccggguaugauggugugucucuacaaaaaauacaaaaaaauggcaacauggugaagcccca

SEQ ID NO: 51321 - RNA, 64 nt, Homo Sapiens
caaaaaaauuagccggguaugaagccccaucucuacaaaaaauaaccagccugggcaacauggu

SEQ ID NO: 51322 - RNA, 64 nt, Homo Sapiens
uacgaucacucaguguguguuuaauccuuuauauacaaaaaaaaauguauuaaauuggaauuuu

SEQ ID NO: 51323 - RNA, 64 nt, Homo Sapiens
aaaaauuguuuagugaauacacaaaaguagccuuacaaaaaaaacaaagggaaaacaaaaagcu

SEQ ID NO: 51324 - RNA, 64 nt, Homo Sapiens
agucacuaaauuggaaacaaaagguugcaacgugacaaaaaaaauuguguaguauuuaccagca

SEQ ID NO: 51325 - RNA, 64 nt, Homo Sapiens
guuaguguuuuuuuauuccccuaagacagaaagaacaaaaaauguuuuaaauuucucuuauaua

SEQ ID NO: 51326 - RNA, 64 nt, Homo Sapiens
agcagccuggccaacauagugggacccugucucuacaaaaaaaaaauuugccaagagccugagu

SEQ ID NO: 51327 - RNA, 64 nt, Homo Sapiens
agcaagaccccaucucaaaaaaaaaaacaaacaaacaaaaaaaaaaccauauauauacauauau

SEQ ID NO: 51328 - RNA, 64 nt, Homo Sapiens
ccucaugagugcauggauuuaaaaaacaaaaaaaacaaaaaaaacugcuaaaaagacaaaaaac

SEQ ID NO: 51329 - RNA, 64 nt, Homo Sapiens
caaaaaaaaccucaugagugacaaaaaacaaaaaacaaaaaaaaccccucuuccugcuaaaaag

SEQ ID NO: 51330 - RNA, 64 nt, Homo Sapiens
aaaaaaacaaaaaaaaccucuaaaaagacaaaaaacaaaaaacauauucucccccucuuccugc

SEQ ID NO: 51331 - RNA, 64 nt, Homo Sapiens
aaaaacaaaaaaaacaaaaauuccugcuaaaaagacaaaaaacauucauuauauucucccccuc

SEQ ID NO: 51332 - RNA, 64 nt, Homo Sapiens
agcaauuuucuugagccuuaaagcuuuucuugcuacaaaaaauagaaccauuugccaaaaaaaa

SEQ ID NO: 51333 - RNA, 64 nt, Homo Sapiens
agccagguguagggguaggcucuguacaaaaaauacaaaaaauuggcaacauggcaaaacgcag

SEQ ID NO: 51334 - RNA, 64 nt, Homo Sapiens
caaaaaauuagccagguguaaaaacgcagucuguacaaaaaauaaccagccugggcaacauggc

SEQ ID NO: 51335 - RNA, 64 nt, Homo Sapiens
caaaaauuagcugggcaugggaaaccccgucucuacaaaaaauaaccagccuggccaacauggu

SEQ ID NO: 51336 - RNA, 64 nt, Homo Sapiens
auugaaauuguuucccaugcgaaggagaugcuuaacaaaaaaaaaggaaacagcucaucccaga

SEQ ID NO: 51337 - RNA, 64 nt, Homo Sapiens
acaguauagagucucauaaacaagacaaacaacuacaaaaaaagagaaacaaacaaacaaaaaa

SEQ ID NO: 51338 - RNA, 64 nt, Homo Sapiens
agacaaacaacuacaaaaaaaaagaaacaaacaaacaaaaaacaauaucuauauaaauuaaaac

SEQ ID NO: 51339 - RNA, 64 nt, Homo Sapiens
uucaucuaaaguaauauuucuuucuaaguaagauacaaaaaauuuuuaaauaucaacuuaauuu

SEQ ID NO: 51340 - RNA, 64 nt, Homo Sapiens
aguuugaguguuaugaauauaaacauaaauggccacaaaaaaguaccauacaaucuagugucaa

SEQ ID NO: 51341 - RNA, 64 nt, Homo Sapiens
acuagccugggcaacauagcgagaccucgucucuacaaaaaaaaauuaaaaagggggcuuuggg

SEQ ID NO: 51342 - RNA, 64 nt, Homo Sapiens
ggccaacauggugaaaccccgucucuacuaaaauacaaaaaauuagcugggcaugguggcgcac

SEQ ID NO: 51343 - RNA, 64 nt, Homo Sapiens
agacaauccuggccaacggcgaaacucugucucuacaaaaaauauacaggcguguuagcaugug

SEQ ID NO: 51344 - RNA, 64 nt, Homo Sapiens
gccagccugggcaacauggcaaaaccccauuucuacaaaaaauacaaaaauuagcugggcaugg

SEQ ID NO: 51345 - RNA, 64 nt, Homo Sapiens
ucauguggggauguuugugcugcagacaaaaagaacaaaaaaaaauuuuuaaauaccacaagau

SEQ ID NO: 51346 - RNA, 64 nt, Homo Sapiens
aaaauuuuuaaauaccacaagauggaaaaaaaaaacaaaaaaauuuaaaaagauggaauguagu

SEQ ID NO: 51347 - RNA, 64 nt, Homo Sapiens
ugaaaggcauugugggucugucuuuaaaguguuuacaaaaaaaaauuauauaaaaaaaaagucu

SEQ ID NO: 51348 - RNA, 64 nt, Homo Sapiens
ggcccucguggauuuuuuuuuucagaaaacuuaaacaaaaaaagacuuacuaagaaauauguac

SEQ ID NO: 51349 - RNA, 64 nt, Homo Sapiens
ugcaagauagguuucuguauuuauauauuaaaauacaaaaaaaaacuuauaaaauguuuaaaaa

SEQ ID NO: 51350 - RNA, 64 nt, Homo Sapiens
gcuuuacuucaaaagcauguuuacucaagcaaaaacaaaaaacacuucagagguaccuggcacc

SEQ ID NO: 51351 - RNA, 64 nt, Homo Sapiens
uuagccgggcgugguggcggucuuuacuaaaaauacaaaaaaaagcuaacacggugaaaccccg

SEQ ID NO: 51352 - RNA, 64 nt, Homo Sapiens
cuuuuuuuaaucguuguaauaaaaaaacaaaaaaacaaaaaaaacuccucauccuaguucuuua

SEQ ID NO: 51353 - RNA, 63 nt, Homo Sapiens
aaaaaaaacuuuuuuuaaucuucuuuaaaaaaaacaaaaaaaccggcucucuccucauccuag

SEQ ID NO: 51354 - RNA, 64 nt, Homo Sapiens
aagaaguugguuuauuuccaaaauaaauccccugacaaaaaaccuggugauguuaagcaauuga

SEQ ID NO: 51355 - RNA, 64 nt, Homo Sapiens
auugacugucuuagaguccagcagaagaccuuagacaaaaaaagcagaacccacuggaguagaa

SEQ ID NO: 51356 - RNA, 64 nt, Homo Sapiens
uaagaaaauuuuaaaaggaagagauguuuggaugacaaaaaaaugccuuauugaaaaacuaaag

SEQ ID NO: 51357 - RNA, 64 nt, Homo Sapiens
augaugauguuuauuuaaaaaaaaaacaacagcaacaaaaaauccuagccuccaguugccuuuu

SEQ ID NO: 51358 - RNA, 64 nt, Homo Sapiens
gcuaacguggugaaaccccaucucuacuaaaaauacaaaaaaauuagcugggcgugguggcacg

SEQ ID NO: 51359 - RNA, 64 nt, Homo Sapiens
cagaaccagacuccgucucaaaaaaaaaaaaaaaacaaaaaaggcugaaggcagcuguagcucc

SEQ ID NO: 51360 - RNA, 64 nt, Homo Sapiens
uuuaacucugccucggccauucaaaagucuaauaacaaaaaauguaaaccuaauuuggcaguuu

SEQ ID NO: 51361 - RNA, 64 nt, Homo Sapiens
uaauuguccaauucuacgugcucucuauaccaaaacaaaaaaaaaaagcuauccaccuuuccau

SEQ ID NO: 51362 - RNA, 64 nt, Homo Sapiens
gcuaacauggugaaaccccaucucuacuaaaaauacaaaaaaaaauuagccgggggugguggcg

SEQ ID NO: 51363 - RNA, 64 nt, Homo Sapiens
ggcucugagagaacuggcuaagauucaggaagaaacaaaaaauucagaauccuacaagguuuug

SEQ ID NO: 51364 - RNA, 64 nt, Homo Sapiens
aacagguucuguugcugcugaagacccugucucaacaaaaaaauuccagccugggugacagagu

SEQ ID NO: 51365 - RNA, 64 nt, Homo Sapiens
uuuuuuaguucaccgagcaugagaccguaucacuacaaaaaaguaccagccugggcaauauagu

SEQ ID NO: 51366 - RNA, 64 nt, Homo Sapiens
uagucgggcgugguggcggaucucuacuaaaaauacaaaaaaaugcuaacacggugaaaccccg

SEQ ID NO: 51367 - RNA, 64 nt, Homo Sapiens
agccaggcgugguggugggcucuuuacuaaaaauacaaaaaacugccaacauggugaaacccca

SEQ ID NO: 51368 - RNA, 64 nt, Homo Sapiens
aacccuauuuaaaugaaaggaaaaaacaaaaaaaacaaaaaaaagggaaguaaaaaaacaaaac

SEQ ID NO: 51369 - RNA, 64 nt, Homo Sapiens
caaaaaaaaaacccuauuuaaaacaaaacaaaaaacaaaaaaaaaaucgaauagggaaguaaaa

SEQ ID NO: 51370 - RNA, 64 nt, Homo Sapiens
aaaaaaacaaaaaaaaaaccaguaaaaaaacaaaacaaaaaacaaaacucaaaucgaauaggga

SEQ ID NO: 51371 - RNA, 64 nt, Homo Sapiens
aaagggugagaauuugcuuaaagaaaaacaaaaaacaaaaaacuuugguuuauuuagaaaaagg

SEQ ID NO: 51372 - RNA, 64 nt, Homo Sapiens
aaaaacuaaagggugagaauaaaaaggaagaaaaacaaaaaacacaagcauuugguuuauuuag

SEQ ID NO: 51373 - RNA, 64 nt, Homo Sapiens
auccuagauaguuuucccuuuaaauuacucuaaaacaaaaaagaaaucugucuuuaaguaggga

SEQ ID NO: 51374 - RNA, 64 nt, Homo Sapiens
aaaacaacaacauaaaaauccucucacuguuuuaacaaaaaaaauauuccaguaaguuauuuug

SEQ ID NO: 51375 - RNA, 60 nt, Homo Sapiens
cccugccagaaauauucugagaccaaauuuacaaaaaaacgaaaaaaauaaggauugacu

SEQ ID NO: 51376 - RNA, 64 nt, Homo Sapiens
gauucagaaucaugaaaacaacauuuuuacaacaacaaaaaaacuauauuaaacaggguuuaaa

SEQ ID NO: 51377 - RNA, 64 nt, Homo Sapiens
cagcugauagaaaaacaaaaaugaaaaaaaaaacacaaaaaacaaaaaacauggcacguugcua

SEQ ID NO: 51378 - RNA, 64 nt, Homo Sapiens
uagaaaaacaaaaaugaaaaaaaaaacacaaaaaacaaaaaacauggcacguugcuaguuuaca

SEQ ID NO: 51379 - RNA, 64 nt, Homo Sapiens
ggcuaacacgugaaaccccgucucuacuaaaaauacaaaaaauuagccgggcgugguggcgggc

SEQ ID NO: 51380 - RNA, 64 nt, Homo Sapiens
gcgacagagcgagacuccgucucaaaaaaaaaaaacaaaaaaaaaccaugcauggugcaucagc

SEQ ID NO: 51381 - RNA, 64 nt, Homo Sapiens
auggaggaagaucuacgaagcaaauggaaaacaaacaaaaaaagaggcagggguugcaauccua

SEQ ID NO: 51382 - RNA, 64 nt, Homo Sapiens
aacuaaaaucagcagaacucaaggaaauagagacacaaaaaaaccuucaaaaaauuaauguauc

SEQ ID NO: 51383 - RNA, 64 nt, Homo Sapiens
ucccccagcugcguuuuuuuauaguagauuuuuaacaaaaaacggggagaaauaaugcauuucu

SEQ ID NO: 51384 - RNA, 64 nt, Homo Sapiens
uguguguguuuuaauuuucuuuauggaaaaauugacaaaaaaaaaauagagagagagguauuua

SEQ ID NO: 51385 - RNA, 64 nt, Homo Sapiens
uuauggaagaaccgggacauuuuacagaaaaaaaacaaaaaacaacaaaaaauauacgugggaa

SEQ ID NO: 51386 - RNA, 64 nt, Homo Sapiens
accgggacauuuuacagaaaaaaaacaaaaaacaacaaaaaauauacgugggaaaaaaaacgau

SEQ ID NO: 51387 - RNA, 64 nt, Homo Sapiens
accagccuggguaacauggcaaaauccugucuuuacaaaaaauacaaaaauuagccuagcaugg

SEQ ID NO: 51388 - RNA, 64 nt, Homo Sapiens
gcuaauauggugaaacccugucucuacuaaaaauacaaaaaaauuagcuaggcaugguggcggg

SEQ ID NO: 51389 - RNA, 64 nt, Homo Sapiens
aaaaaaaaagcgagcgagaggaaaaguugaaaagacaaaaaaaaaaguuacaaccaacuucuau

SEQ ID NO: 51390 - RNA, 64 nt, Homo Sapiens
aaaaucuaucuauauacagaacccccccaaaaacacaaaaaaaggagaaaaaaaaucacccacc

SEQ ID NO: 51391 - RNA, 64 nt, Homo Sapiens
aaaaaaaacccaacaagaacagacaaaacaaaagacaaaaaaaaaaaaaaaaaaaaaaaaaaaa

SEQ ID NO: 51392 - RNA, 64 nt, Homo Sapiens
aaaacacacagaagagauuuaggaaaaaaaagcaacaaaaaaagcaaaaaaacacaaacagaag

SEQ ID NO: 51393 - RNA, 64 nt, Homo Sapiens
acaaacagaagaggaaaaaaaaaucaaaaaagcgacaaaaaaacgcaaggaacaaaaaagaaaa

SEQ ID NO: 51394 - RNA, 64 nt, Homo Sapiens
aaaaaaucaaaaaagcgacauucugcugcaaggaacaaaaaagauuauuaaacgucuguggagc

SEQ ID NO: 51395 - RNA, 64 nt, Homo Sapiens
aaaaagaaaauauuuuggcaaaacacaaaaaaagacaaaaaaaauucuugaacuugaaaaaaaa

SEQ ID NO: 51396 - RNA, 64 nt, Homo Sapiens
acaaaaaaaaaaaaagaaaaugaaaaaaaaaaacacaaaaaaaguuacuggggauucuugaacu

SEQ ID NO: 51397 - RNA, 64 nt, Homo Sapiens
acacacacauuuuguacgggacaaaaaacaaaaaacaaaaaaccccccuuuuucuuguuaaaaa

SEQ ID NO: 51398 - RNA, 64 nt, Homo Sapiens
aaaaaccacacacacauuuuuuaaaaaacaaaaaacaaaaaacacuuuugcccccuuuuucuug

SEQ ID NO: 51399 - RNA, 64 nt, Homo Sapiens
aaaaacaaaaaaccacacacuuucuuguuaaaaaacaaaaaacauuccuggcuuuugcccccuu

SEQ ID NO: 51400 - RNA, 64 nt, Homo Sapiens
uagccgggugcgguggcgggucucuacuaaaaauacaaaaaaaugcuaacacggugaaaccccg

SEQ ID NO: 51401 - RNA, 64 nt, Homo Sapiens
caaaaauuagcugagugugggagaccccaucucuacaaaaaauaaccagccugggcaacauggu

SEQ ID NO: 51402 - RNA, 64 nt, Homo Sapiens
agccaggcgugguugugggcucucuacuaaaaauacaaaaaauugcuaacacggugaaacccca

SEQ ID NO: 51403 - RNA, 64 nt, Homo Sapiens
cauaaauuagcugggcauugaaaccaccuucucuacaaaaaauaccagccugggcagaauggug

SEQ ID NO: 51404 - RNA, 64 nt, Homo Sapiens
agccgggcaugguagcagguuaaaaaaaaaaauuacaaaaaauuuggagaaaccccgucucuac

SEQ ID NO: 51405 - RNA, 64 nt, Homo Sapiens
aaccggauagaauaaugaccaacaacaaaacaaaacaaaaaaaagcaaguucuuguuuccaaac

SEQ ID NO: 51406 - RNA, 64 nt, Homo Sapiens
gcaacauagcgagaccucaucuccaaaaaagaaaacaaaaaacaaaaaaaggaaugauguucug

SEQ ID NO: 51407 - RNA, 64 nt, Homo Sapiens
agcgagaccucaucuccaaaaaagaaaacaaaaaacaaaaaaaggaaugauguucuguagagau

SEQ ID NO: 51408 - RNA, 64 nt, Homo Sapiens
acugauuuaaaacaaaccaaaaaaaaagaaaaaaacaaaaaaaaaaaucccuccuuucuagcug

SEQ ID NO: 51409 - RNA, 64 nt, Homo Sapiens
agccggguuccaucaccuguuuucuacaaaaaauacaaaaaauuggcaacauggugaaacccag

SEQ ID NO: 51410 - RNA, 64 nt, Homo Sapiens
caaaaaauuagccggguuccgaaacccaguuucuacaaaaaauaaccagccugggcaacauggu

SEQ ID NO: 51411 - RNA, 64 nt, Homo Sapiens
agccugggcacuguggcucacuaguagcugcauuacaaaaaagauauauguaauuaaaauguuu

SEQ ID NO: 51412 - RNA, 64 nt, Homo Sapiens
gcuaacauggugaaacccugucucuacuaaaaauacaaaaaauuagccgggugugguggugggc

SEQ ID NO: 51413 - RNA, 64 nt, Homo Sapiens
ccugggugacagcacgagaugccgucuuaaaaaaacaaaaaagaggugugcugcuugucagcau

SEQ ID NO: 51414 - RNA, 64 nt, Homo Sapiens
ccacucuucuccaaaugcccaacaaacaaaaaacacaaaaaaaaauuauuuuucucaaaaaaca

SEQ ID NO: 51415 - RNA, 64 nt, Homo Sapiens
caaaaaaaaccacucuucuccaaaaaacaaacaaacaaaaaacaucaauuagaauuauuuuucu

SEQ ID NO: 51416 - RNA, 64 nt, Homo Sapiens
agccgggcgugguggcgggcucuccacuaaaaauacaaaaaauuuggcuaacagugaaacccug

SEQ ID NO: 51417 - RNA, 64 nt, Homo Sapiens
agcugggcgugguggugcacugucugcuaaaauuacaaaaaauugcuaauacagugaaacccca

SEQ ID NO: 51418 - RNA, 64 nt, Homo Sapiens
uuaucuuauauuuagggaaagccggagagcaacaacaaaaaauguuuaagccgggcgcgguggc

SEQ ID NO: 51419 - RNA, 64 nt, Homo Sapiens
accagccuggacaacauggugaaaccccaucucuacaaaaaauacaaaaauuagccaugcaugg

SEQ ID NO: 51420 - RNA, 64 nt, Homo Sapiens
accagccugggccacaugacaaagccccaucucuacaaaaaaauuacaaaaaaaaaaaaaacag

SEQ ID NO: 51421 - RNA, 64 nt, Homo Sapiens
ccacaugacaaagccccaucucuacaaaaaaauuacaaaaaaaaaaaaaacaggugugguggca

SEQ ID NO: 51422 - RNA, 64 nt, Homo Sapiens
aacuguucuuugccuaauaaaaaaaaacaaaaaaacaaaaaaacuuaaaggaaauguuaaaaaa

SEQ ID NO: 51423 - RNA, 64 nt, Homo Sapiens
aaaaaaacaacuguucuuuguuaaaaaaaaaaaaacaaaaaaaccaccuuccuuaaaggaaaug

SEQ ID NO: 51424 - RNA, 64 nt, Homo Sapiens
aaagaauacuuuuuuauaccaaacaaaaaaaaacacaaaaaaagaagaggaaaaacaaacaaac

SEQ ID NO: 51425 - RNA, 64 nt, Homo Sapiens
acacaaaaaaagaaagaauaaaacaaacaaacaaacaaaaaaaauauagcaagaugaagaggaa

SEQ ID NO: 51426 - RNA, 64 nt, Homo Sapiens
agaaaaaacauaacaaguaaaaaaacacacacacacaaaaaaagaacaaaaaaacaaaaaacaa

SEQ ID NO: 51427 - RNA, 64 nt, Homo Sapiens
acacacacacaaaaaaagagcaaaaaaacaaaaaacaaaaaaacaaaacaaaaaacaaaaaaaa

SEQ ID NO: 51428 - RNA, 64 nt, Homo Sapiens
aaaaaacacacacacacaaaaaaaaaacaaaaaaacaaaaaacaaaaagcaaaaacaaaaaaca

SEQ ID NO: 51429 - RNA, 64 nt, Homo Sapiens
aaaaaacaaaaaaacacacaaaaaaacaaaaaaaacaaaaaaacgaccuuccaaaagcaaaaac

SEQ ID NO: 51430 - RNA, 64 nt, Homo Sapiens
caaaaaaacaaaaaacaaaaagcaaaaacaaaaaacaaaaaaaaccgcugggagaccuuccaaa

SEQ ID NO: 51431 - RNA, 64 nt, Homo Sapiens
aaaaaaacaaaaaaacaaaauuccaaaagcaaaaacaaaaaacaagacccuccgcugggagacc

SEQ ID NO: 51432 - RNA, 64 nt, Homo Sapiens
ucaaaaaaucaaaaaaauaauaaaaaaacaaaaaacaaaaaaaaguuucacaaacaguuuuauu

SEQ ID NO: 51433 - RNA, 64 nt, Homo Sapiens
aaaaaaaucaaaaaaucaaauuuuauuuaaaaaaacaaaaaacaaauagcuguuucacaaacag

SEQ ID NO: 51434 - RNA, 64 nt, Homo Sapiens
cuuguuauggccuuaagaagaaaaagaaaaaaguacaaaaaaauuuuaaauaucugaguuuuaa

SEQ ID NO: 51435 - RNA, 64 nt, Homo Sapiens
uguucaguucuuaaaauguaauuaugucacacacacaaaaaauccuuuucaauccugagaaaau

SEQ ID NO: 51436 - RNA, 64 nt, Homo Sapiens
aaagcaguucaaguugacaacagcagaaacaguaacaaaaaaaucugcucagaaaaauguaugu

SEQ ID NO: 51437 - RNA, 64 nt, Homo Sapiens
cugaaaaacaaaaacaaaaacagaaaacaaacaaacaaaaaacaaaaaauccccacaacuuugu

SEQ ID NO: 51438 - RNA, 64 nt, Homo Sapiens
acaaaaacaaaaacagaaaacaaacaaacaaaaaacaaaaaauccccacaacuuugucaaauaa

SEQ ID NO: 51439 - RNA, 64 nt, Homo Sapiens
guugaaugagguaaaauggcaagacacauuucuuacaaaaaagaaagucuuauaaaaauuuaaa

SEQ ID NO: 51440 - RNA, 64 nt, Homo Sapiens
uguugcucucuucacaguaucauaacaguaucuuacaaaaaacgguaauuugccaggaauucuu

SEQ ID NO: 51441 - RNA, 64 nt, Homo Sapiens
uuuaggccaggcacagugguggaaagcauuuuuaacaaaaaauuagccacugcacccggccggu

SEQ ID NO: 51442 - RNA, 64 nt, Homo Sapiens
uauaggcaugagccacugcacaucuucugaaaaaacaaaaaaaugaaccuaccauguugccucc

SEQ ID NO: 51443 - RNA, 64 nt, Homo Sapiens
ccuucuugguggauuagacauugauucaaauguuacaaaaaaacuaaguaagaaagaaggcaaa

SEQ ID NO: 51444 - RNA, 64 nt, Homo Sapiens
uauaagaaaacuacauguaagucuaugcaauuguacaaaaaaguaacaauggcagguuuuacac

SEQ ID NO: 51445 - RNA, 64 nt, Homo Sapiens
agcugggcgugguggugggcucucuaucagaaauacaaaaaauugccaacauggugaaacccca

SEQ ID NO: 51446 - RNA, 64 nt, Homo Sapiens
aucaacuacaaauuaguugcgauuucaaacuuaaacaaaaaacuuuagaaugggugguaugggg

SEQ ID NO: 51447 - RNA, 64 nt, Homo Sapiens
uguucaguucuuaaaauguaauuaugucacacacacaaaaaaauccuuuucaauccugagaaaa

SEQ ID NO: 51448 - RNA, 64 nt, Homo Sapiens; identical to SEQ ID NO: 51436

SEQ ID NO: 51449 - RNA, 64 nt, Homo Sapiens; identical to SEQ ID NO: 49066

SEQ ID NO: 51450 - RNA, 64 nt, Homo Sapiens; identical to SEQ ID NO: 49067

SEQ ID NO: 51451 - RNA, 64 nt, Homo Sapiens; identical to SEQ ID NO: 49068

SEQ ID NO: 51452 - RNA, 64 nt, Homo Sapiens; identical to SEQ ID NO: 49069

SEQ ID NO: 51453 - RNA, 64 nt, Homo Sapiens; identical to SEQ ID NO: 49070

SEQ ID NO: 51454 - RNA, 64 nt, Homo Sapiens; identical to SEQ ID NO: 49071

SEQ ID NO: 51455 - RNA, 64 nt, Homo Sapiens; identical to SEQ ID NO: 49072

SEQ ID NO: 51456 - RNA, 64 nt, Homo Sapiens; identical to SEQ ID NO: 49073

SEQ ID NO: 51457 - RNA, 64 nt, Homo Sapiens; identical to SEQ ID NO: 49074

SEQ ID NO: 51458 - RNA, 64 nt, Homo Sapiens; identical to SEQ ID NO: 49075

SEQ ID NO: 51459 - RNA, 64 nt, Homo Sapiens; identical to SEQ ID NO: 49076

SEQ ID NO: 51460 - RNA, 64 nt, Homo Sapiens; identical to SEQ ID NO: 49077

SEQ ID NO: 51461 - RNA, 64 nt, Homo Sapiens; identical to SEQ ID NO: 49078

SEQ ID NO: 51462 - RNA, 64 nt, Homo Sapiens; identical to SEQ ID NO: 49079

SEQ ID NO: 51463 - RNA, 64 nt, Homo Sapiens; identical to SEQ ID NO: 49080

SEQ ID NO: 51464 - RNA, 64 nt, Homo Sapiens; identical to SEQ ID NO: 49081

SEQ ID NO: 51465 - RNA, 64 nt, Homo Sapiens; identical to SEQ ID NO: 49082

SEQ ID NO: 51466 - RNA, 64 nt, Homo Sapiens; identical to SEQ ID NO: 49083

SEQ ID NO: 51467 - RNA, 64 nt, Homo Sapiens; identical to SEQ ID NO: 49084

SEQ ID NO: 51468 - RNA, 64 nt, Homo Sapiens; identical to SEQ ID NO: 49085

SEQ ID NO: 51469 - RNA, 64 nt, Homo Sapiens; identical to SEQ ID NO: 49086

SEQ ID NO: 51470 - RNA, 64 nt, Homo Sapiens; identical to SEQ ID NO: 49087

SEQ ID NO: 51471 - RNA, 64 nt, Homo Sapiens; identical to SEQ ID NO: 49088

SEQ ID NO: 51472 - RNA, 64 nt, Homo Sapiens; identical to SEQ ID NO: 49089

SEQ ID NO: 51473 - RNA, 64 nt, Homo Sapiens; identical to SEQ ID NO: 49090

SEQ ID NO: 51474 - RNA, 64 nt, Homo Sapiens; identical to SEQ ID NO: 49091

SEQ ID NO: 51475 - RNA, 64 nt, Homo Sapiens; identical to SEQ ID NO: 49092

SEQ ID NO: 51476 - RNA, 64 nt, Homo Sapiens; identical to SEQ ID NO: 49093

SEQ ID NO: 51477 - RNA, 64 nt, Homo Sapiens; identical to SEQ ID NO: 49094

SEQ ID NO: 51478 - RNA, 64 nt, Homo Sapiens; identical to SEQ ID NO: 49095

SEQ ID NO: 51479 - RNA, 64 nt, Homo Sapiens; identical to SEQ ID NO: 49096

SEQ ID NO: 51480 - RNA, 64 nt, Homo Sapiens; identical to SEQ ID NO: 49097

SEQ ID NO: 51481 - RNA, 64 nt, Homo Sapiens; identical to SEQ ID NO: 49098

SEQ ID NO: 51482 - RNA, 64 nt, Homo Sapiens; identical to SEQ ID NO: 49099

SEQ ID NO: 51483 - RNA, 64 nt, Homo Sapiens; identical to SEQ ID NO: 49100

SEQ ID NO: 51484 - RNA, 64 nt, Homo Sapiens; identical to SEQ ID NO: 49101

SEQ ID NO: 51485 - RNA, 64 nt, Homo Sapiens; identical to SEQ ID NO: 49102

SEQ ID NO: 51486 - RNA, 64 nt, Homo Sapiens; identical to SEQ ID NO: 49103

SEQ ID NO: 51487 - RNA, 64 nt, Homo Sapiens; identical to SEQ ID NO: 49104

SEQ ID NO: 51488 - RNA, 64 nt, Homo Sapiens; identical to SEQ ID NO: 49105

SEQ ID NO: 51489 - RNA, 64 nt, Homo Sapiens; identical to SEQ ID NO: 49106

SEQ ID NO: 51490 - RNA, 64 nt, Homo Sapiens; identical to SEQ ID NO: 49107

SEQ ID NO: 51491 - RNA, 64 nt, Homo Sapiens; identical to SEQ ID NO: 49108

SEQ ID NO: 51492 - RNA, 64 nt, Homo Sapiens; identical to SEQ ID NO: 49109

SEQ ID NO: 51493 - RNA, 64 nt, Homo Sapiens; identical to SEQ ID NO: 49110

SEQ ID NO: 51494 - RNA, 64 nt, Homo Sapiens; identical to SEQ ID NO: 49111

SEQ ID NO: 51495 - RNA, 64 nt, Homo Sapiens; identical to SEQ ID NO: 49112

SEQ ID NO: 51496 - RNA, 64 nt, Homo Sapiens; identical to SEQ ID NO: 49113

SEQ ID NO: 51497 - RNA, 64 nt, Homo Sapiens; identical to SEQ ID NO: 49114

SEQ ID NO: 51498 - RNA, 64 nt, Homo Sapiens; identical to SEQ ID NO: 49115

SEQ ID NO: 51499 - RNA, 64 nt, Homo Sapiens; identical to SEQ ID NO: 49116

SEQ ID NO: 51500 - RNA, 64 nt, Homo Sapiens; identical to SEQ ID NO: 49117

SEQ ID NO: 51501 - RNA, 64 nt, Homo Sapiens; identical to SEQ ID NO: 49118

SEQ ID NO: 51502 - RNA, 64 nt, Homo Sapiens; identical to SEQ ID NO: 49119

SEQ ID NO: 51503 - RNA, 64 nt, Homo Sapiens; identical to SEQ ID NO: 49120

SEQ ID NO: 51504 - RNA, 64 nt, Homo Sapiens; identical to SEQ ID NO: 49121

SEQ ID NO: 51505 - RNA, 64 nt, Homo Sapiens; identical to SEQ ID NO: 49122

SEQ ID NO: 51506 - RNA, 64 nt, Homo Sapiens; identical to SEQ ID NO: 49123

SEQ ID NO: 51507 - RNA, 64 nt, Homo Sapiens; identical to SEQ ID NO: 49124

SEQ ID NO: 51508 - RNA, 64 nt, Homo Sapiens; identical to SEQ ID NO: 49125

SEQ ID NO: 51509 - RNA, 64 nt, Homo Sapiens; identical to SEQ ID NO: 49126

SEQ ID NO: 51510 - RNA, 64 nt, Homo Sapiens; identical to SEQ ID NO: 49127

SEQ ID NO: 51511 - RNA, 64 nt, Homo Sapiens; identical to SEQ ID NO: 49128

SEQ ID NO: 51512 - RNA, 64 nt, Homo Sapiens; identical to SEQ ID NO: 49129

SEQ ID NO: 51513 - RNA, 64 nt, Homo Sapiens; identical to SEQ ID NO: 49130

SEQ ID NO: 51514 - RNA, 64 nt, Homo Sapiens; identical to SEQ ID NO: 49131

SEQ ID NO: 51515 - RNA, 64 nt, Homo Sapiens; identical to SEQ ID NO: 49132

SEQ ID NO: 51516 - RNA, 64 nt, Homo Sapiens; identical to SEQ ID NO: 49133

SEQ ID NO: 51517 - RNA, 64 nt, Homo Sapiens; identical to SEQ ID NO: 49134

SEQ ID NO: 51518 - RNA, 64 nt, Homo Sapiens; identical to SEQ ID NO: 49135

SEQ ID NO: 51519 - RNA, 64 nt, Homo Sapiens; identical to SEQ ID NO: 49136

SEQ ID NO: 51520 - RNA, 64 nt, Homo Sapiens; identical to SEQ ID NO: 49137

SEQ ID NO: 51521 - RNA, 64 nt, Homo Sapiens; identical to SEQ ID NO: 49138

SEQ ID NO: 51522 - RNA, 64 nt, Homo Sapiens
acaaagaauacugaagccacucaagacucgggcccugaaggauucaucuaauuucucaguuucu

SEQ ID NO: 51523 - RNA, 64 nt, Homo Sapiens
uuugauuuauauuucagcuagaucuaaaaagcaucugaaggaauuuacaaugaaagauaccuau

SEQ ID NO: 51524 - RNA, 64 nt, Homo Sapiens
ccauccuggcuagaaaggguuuccuaaugcuuaccugaaggaacugaucucaaccugcugacuu

SEQ ID NO: 51525 - RNA, 64 nt, Homo Sapiens
uauuucaaacucucuaaugccuucuuuccaaacacugaaggauuugguuucacucuccucucuc

SEQ ID NO: 51526 - RNA, 64 nt, Homo Sapiens
uuugggagagggaugcccaggaccccagccagaucugaaggacagcugcccucaaugugggagu

SEQ ID NO: 51527 - RNA, 64 nt, Homo Sapiens
ccacuccaucucaccucgggcuccugggcaagggcugaaggaggucaguugcuugcucuugugc

SEQ ID NO: 51528 - RNA, 64 nt, Homo Sapiens
uuguugacccagugaccugggaccagccucagaacugaaggagacaaguaaucauuaaccccca

SEQ ID NO: 51529 - RNA, 64 nt, Homo Sapiens
ccuugacuuccagcuuuuacccuguccuuggcagcugaaggacauccaccccacccaccucugc

SEQ ID NO: 51530 - RNA, 64 nt, Homo Sapiens
cccucccucccaugacugagcccaucagccauuccugaaggaagacagugguagccacaggaac

SEQ ID NO: 51531 - RNA, 64 nt, Homo Sapiens
uauuugucaccagauuagagaggcgugucaaggccugaaggagcccaugugguuggauaaaauc

SEQ ID NO: 51532 - RNA, 64 nt, Homo Sapiens
uuuguuagcaauaacugaccuucaguuuacccuucugaaggagcagggacucagcacagaauuc

SEQ ID NO: 51533 - RNA, 64 nt, Homo Sapiens
cagggacucagcacagaauucacuuuagacggggcugaaggagugucccuccucuaugugaaaa

SEQ ID NO: 51534 - RNA, 64 nt, Homo Sapiens
cacccuaggugugagaugggauucuggaagcuuccugaaggauuugagugggaccuugugggag

SEQ ID NO: 51535 - RNA, 64 nt, Homo Sapiens
cuaagaugucacugggggucacuaaagcugaagccugaaggaaagccucucauugcuguagagc

SEQ ID NO: 51536 - RNA, 64 nt, Homo Sapiens
guucuggggcauaggaaacacggguuaccuguaucugaaggacgaaggcugcugauguaguucc

SEQ ID NO: 51537 - RNA, 64 nt, Homo Sapiens
uaagauguuugaagcuuaugcaaccagaaaaccccugaaggaagugggaaaagucaaaauaaaa

SEQ ID NO: 51538 - RNA, 64 nt, Homo Sapiens
gcccaacguuuuuggauuaucccucuuccuccaacugaaggaucugugagcuacuuaacugacg

SEQ ID NO: 51539 - RNA, 64 nt, Homo Sapiens
auacuguaacuugauuuauccagagcacuuuaaucugaaggaugugcuguggcauugguuauau

SEQ ID NO: 51540 - RNA, 64 nt, Homo Sapiens
gacauuugagccuagaccugcagaaaauacuucccugaaggacuaccugaccucuuugaaggau

SEQ ID NO: 51541 - RNA, 64 nt, Homo Sapiens
ucaccaggaccugaccucuuuggugacaggugcucugaaggagggcagacaugcaccagugaug

SEQ ID NO: 51542 - RNA, 64 nt, Homo Sapiens
cgagccauugaggacccuauccuggccuacacagcugaaggagagaucaacaaugugcaguggg

SEQ ID NO: 51543 - RNA, 64 nt, Homo Sapiens
gaauugcucaucugagauuaguagaguagcaggccugaaggaugaugguuuuguccucuuuggu

SEQ ID NO: 51544 - RNA, 64 nt, Homo Sapiens
gcacagcugccuguauuguccucaucuguucugacugaaggauggaggugcugaauaaauuagg

SEQ ID NO: 51545 - RNA, 64 nt, Homo Sapiens
gccgugagccugacuacucaagaccuucaaggcccugaaggaggcgagcuggaaaaguuuaugg

SEQ ID NO: 51546 - RNA, 64 nt, Homo Sapiens
agcaggagguaagacugcggcccagaagaagcagcugaaggagccgucacagagcuuucagacg

SEQ ID NO: 51547 - RNA, 64 nt, Homo Sapiens
ugggaugguggacuccgggggccagggcggcuuccugaaggauggcuaagcagccggagagaca

SEQ ID NO: 51548 - RNA, 64 nt, Homo Sapiens
ggggcuccuggcagugaccuggggcccaugugggcugaaggaugcgggaagggugggcccugga

SEQ ID NO: 51549 - RNA, 64 nt, Homo Sapiens
guccaagaggaggaggacgaaggccuagacucagcugaaggaucuucaaagcaggaugaagacc

SEQ ID NO: 51550 - RNA, 64 nt, Homo Sapiens
gaagaccuagacuuaccugaaggccuagacucagcugaaggaucuucaaagcaggaugaagacc

SEQ ID NO: 51551 - RNA, 64 nt, Homo Sapiens
ggaucuucaaagcaggaugaagaccuagacuuaccugaaggaucuucaaagcagaaugaagacc

SEQ ID NO: 51552 - RNA, 64 nt, Homo Sapiens
ggaucuucaaagcagaaugaagaccuaggcuuaccugaaggaucuucaaagcaggaugaagacc

SEQ ID NO: 51553 - RNA, 64 nt, Homo Sapiens
ggaucuucaaagcaggaugaagaccuagacuuaccugaaggaucuucacaggaggauaaagacg

SEQ ID NO: 51554 - RNA, 64 nt, Homo Sapiens
ggaucuucacaggaggauaaagacguagaauuaccugaaggaucuucacaggaggaugaagacc

SEQ ID NO: 51555 - RNA, 64 nt, Homo Sapiens
gucagaggagggugaggaagagacccagacucaucugaaggaucggaucuuugauggaggaaga

SEQ ID NO: 51556 - RNA, 64 nt, Homo Sapiens
uuugauggaggaagaagaccagaccuagacucaucugaaggaucggaucuucacaagaggauga

SEQ ID NO: 51557 - RNA, 64 nt, Homo Sapiens
uucacaagaggaugaagaccagaccuaggguuaucugaaggaucggaucuucacaggaggauga

SEQ ID NO: 51558 - RNA, 64 nt, Homo Sapiens
uucacaggaggaugaagaccagaccuacaauuaccugaaggaucgaaucuucaaagcaggauga

SEQ ID NO: 51559 - RNA, 64 nt, Homo Sapiens
cccauccauuuuuuuuuaaucuuuuucucucucaucaccaaaguccuaacugcagacuuuugcc

SEQ ID NO: 51560 - RNA, 64 nt, Homo Sapiens
cauggcuuuuucucaaagcuuaccaguuauccaaucaccaaaucaacuaaacuuuucuaaaggu

SEQ ID NO: 51561 - RNA, 64 nt, Homo Sapiens
uacuagaucuauguaaguugaauuuuaagaggacucaccaaaagagauugguaaugccagaaaa

SEQ ID NO: 51562 - RNA, 64 nt, Homo Sapiens
aaaucaucaguccucauauucuuccauaacuaacucaccaaaucaauaagagaugccagaacua

SEQ ID NO: 51563 - RNA, 64 nt, Homo Sapiens
uauuuagggauaauagauaaauugauguagagguucaccaaacaagauaguuuuggagccaggc

SEQ ID NO: 51564 - RNA, 64 nt, Homo Sapiens
uauagccuucauaagcaaccuugguucuaaguugucaccaaagcgaaucaacugcagaucuaau

SEQ ID NO: 51565 - RNA, 64 nt, Homo Sapiens
aucagcagccaaaacacuacaagccucuuguuuuucaccaaaacccuacaucucaggcuuacua

SEQ ID NO: 51566 - RNA, 64 nt, Homo Sapiens
auaaaccaaagauggccagcacacugcuaaccagucaccaaauguaagacccauaagaaaccca

SEQ ID NO: 51567 - RNA, 64 nt, Homo Sapiens
aaucaaguaugucccugaguagcaagauuaggccucaccaaagaagaaauuaaccugcacuuuc

SEQ ID NO: 51568 - RNA, 64 nt, Homo Sapiens
ggugaggacucauuacugcaguauauugaucucuucaccaaaugcuuuuucuuuuucugaauaa

SEQ ID NO: 51569 - RNA, 64 nt, Homo Sapiens
aguuuaaugaguagagagaauucccauguacacuucaccaaacuuccucuaaggauaauguaua

SEQ ID NO: 51570 - RNA, 64 nt, Homo Sapiens
aaaaugaaagaggccaucacagcuaauccuauggucaccaaaaggauuagaaagaaacauggac

SEQ ID NO: 51571 - RNA, 64 nt, Homo Sapiens
agcuaggcaguagugaccuuaggauaugacuaacucaccaaacaaugccaaggagaaaggcgga

SEQ ID NO: 51572 - RNA, 64 nt, Homo Sapiens
aucgauuacauguauagcaguaguuuuggugaauucaccaaaucagcuuccacuuagcauuagg

SEQ ID NO: 51573 - RNA, 64 nt, Homo Sapiens
uagauuuccaaaauuuucuacagagaguuaauuaucaccaaaaugugaaugguacauacaaaac

SEQ ID NO: 51574 - RNA, 64 nt, Homo Sapiens
caaucugcccuuuucuccuuuguuuuuguaguuuucaccaaagaugaucaacuagaaauguuaa

SEQ ID NO: 51575 - RNA, 64 nt, Homo Sapiens
gacuuaauucuuguuuuuuuuugccuugcuauauucaccaaaagcaggccaaaugaacuaaaca

SEQ ID NO: 51576 - RNA, 64 nt, Homo Sapiens
gacuuacuucuuguuuuuucuugccuugcuauauucaccaaaaguuauaaaaaugaacuaaaca

SEQ ID NO: 51577 - RNA, 64 nt, Homo Sapiens
aggaaauggagaguagugagcaaaacaucagauuucaccaaagaaccaaagugacuccacaauu

SEQ ID NO: 51578 - RNA, 64 nt, Homo Sapiens
auuccaauaauuagggaaaauugauaaauaucugucaccaaaccacaagaaauccaaaaucauu

SEQ ID NO: 51579 - RNA, 64 nt, Homo Sapiens
uuuucucuuuaguccacuuuugauuguaauuuuuaugguauaggauuuugaaucuucuauuuua

SEQ ID NO: 51580 - RNA, 64 nt, Homo Sapiens
gaaaaacacugguauuuuuaugucuguauucaauaugguauaaaauauaaaaacuauauuuuaa

SEQ ID NO: 51581 - RNA, 64 nt, Homo Sapiens
aacauuuuggcagguguagcuuuuucuguuaaaaaugguauacaugaagucacauacuuuuuua

SEQ ID NO: 51582 - RNA, 64 nt, Homo Sapiens
uaacucacagaauggccuuaguuuucaaugucugaugguauauuugugaguuguguuaucugua

SEQ ID NO: 51583 - RNA, 64 nt, Homo Sapiens
ccuuuccaaaauuaggugcuugguaaucacguuaaugguauaauuuuuuuuuuuuaauaucugg

SEQ ID NO: 51584 - RNA, 64 nt, Homo Sapiens
auucuacaguuugaaacucugaugcuauauauacaugguauaauguauucagacuuugauuacu

SEQ ID NO: 51585 - RNA, 64 nt, Homo Sapiens
uaaccuuguuguuuaccuuucacugauuucuuauaugguauaaauuaaaguucaggcauuuaug

SEQ ID NO: 51586 - RNA, 64 nt, Homo Sapiens
caaguuugcugucuuuagaaugguuugugaaaauaugguauaaagguguuuucauuuuccuguu

SEQ ID NO: 51587 - RNA, 64 nt, Homo Sapiens
caugcugauuuaccacuuauuacuauauugcuguaugguauaugcagugccuauggguuguuaa

SEQ ID NO: 51588 - RNA, 64 nt, Homo Sapiens
uaugcugauuuacuacuuauuacuguauugcuguaugguauaugcagugccucuggguuguuaa

SEQ ID NO: 51589 - RNA, 64 nt, Homo Sapiens
ucuucacuuuaagucuuuuguccuauucauuaacaugguauaucaucauuaaaauauucaaucu

SEQ ID NO: 51590 - RNA, 64 nt, Homo Sapiens
ccacagggcugagauugcuggaaagcauguggcuaugguauagccccuuugagcaggaaauggu

SEQ ID NO: 51591 - RNA, 64 nt, Homo Sapiens
cuguugcuccuaggcuacaauacaccuaggcuauaugguauaguuagaugguauagccuaccag

SEQ ID NO: 51592 - RNA, 64 nt, Homo Sapiens
cuaccaguacaccuaggcuauuccacaaaccuagaugguauagcguaaacaucauguuguuuac

SEQ ID NO: 51593 - RNA, 64 nt, Homo Sapiens
uucuggaucuguuuaaucaauaagcccuauaaucacuugcuaaacacugggcuucaucacccag

SEQ ID NO: 51594 - RNA, 64 nt, Homo Sapiens
ugaacccaacagucagaugagagaaaugaacccuacuugcuaucucuaucuuagaaagcaaaaa

SEQ ID NO: 51595 - RNA, 64 nt, Homo Sapiens
uuguuuugaauuaagaaaugaguuucaggaauugacaaaccauuuguuaaccagcuguccuggg

SEQ ID NO: 51596 - RNA, 64 nt, Homo Sapiens
uucuagaucuauccaccuuguuuuuuuauugucuacaaaccauuaaauguaaauauuguuuuua

SEQ ID NO: 51597 - RNA, 64 nt, Homo Sapiens
ugaccaagagggaagugagccgaguagcucuaaaacaaaccaccuuauaaaaaguuauaaauau

SEQ ID NO: 51598 - RNA, 64 nt, Homo Sapiens
ucaguucucaaaaaaugaccguuuacuuuguuggacaaaccaaacugccacacagcaaaaaauu

SEQ ID NO: 51599 - RNA, 64 nt, Homo Sapiens
uuacuucugucacuucagggacucagcacaucauacaaaccacaguuguuuuuaaagguuuugu

SEQ ID NO: 51600 - RNA, 64 nt, Homo Sapiens
gcugcuguucaucccacaucggacacccugggcuacaaaccaagagcauucgggucaaauccau

SEQ ID NO: 51601 - RNA, 64 nt, Homo Sapiens
aaauggcuuacaugaccugguacauauuuuuaaaacaaaccaauaacuucauguauaaauaaaa

SEQ ID NO: 51602 - RNA, 64 nt, Homo Sapiens
cuggggccuuccuggcuuugaaaugcagucagucacaaaccagcuuuuucaccauggcaaaccu

SEQ ID NO: 51603 - RNA, 64 nt, Homo Sapiens
guggggcucccauucugguagagggagacagucuacaaaccagaaagcaucagggaugcuaagu

SEQ ID NO: 51604 - RNA, 64 nt, Homo Sapiens
aguuuagcauuuccaucugcgaugaauguaggccacaaaccacaguaguauuagcagugccugg

SEQ ID NO: 51605 - RNA, 64 nt, Homo Sapiens
uuuuuucagagagugaccgaucuacaugggaaaaacaaaccagcguucuuguacccagagugau

SEQ ID NO: 51606 - RNA, 64 nt, Homo Sapiens
ccaaccagcucuuggaugugugguuuccaaagaaacaaaccaaagaaaaaauugcuucuuuuau

SEQ ID NO: 51607 - RNA, 64 nt, Homo Sapiens
gaaacaguuuauuuuauguuuugaaaaauaacugacaaaccauuugacuguacauuuuagugau

SEQ ID NO: 51608 - RNA, 64 nt, Homo Sapiens
gaaaaauggaccuuuuuccaaaccuuuuauacugacaaaccagauaaauauauauaaauaaagg

SEQ ID NO: 51609 - RNA, 64 nt, Homo Sapiens
gugcauguccuuugcgccugugaccaccaccccaacaaaccauccagugacaaaccauccagug

SEQ ID NO: 51610 - RNA, 64 nt, Homo Sapiens
gccugugaccaccaccccaacaaaccauccagugacaaaccauccaguggagguuugucgggca

SEQ ID NO: 51611 - RNA, 64 nt, Homo Sapiens
cacaguaaauguuuauuaauuaauguucaguccaacaaaccacacuuagaaauacacguauggu

SEQ ID NO: 51612 - RNA, 64 nt, Homo Sapiens
auacuuccugggaccuuuuguguugaaugaaucaacaaaccacagcauugucauuugggcuuuc

SEQ ID NO: 51613 - RNA, 64 nt, Homo Sapiens
cugcuuaagauccugucauagcaacaugaaauggacaaaccaauuuagaggggccuacaaacca

SEQ ID NO: 51614 - RNA, 64 nt, Homo Sapiens
aacaugaaauggacaaaccaccuuagaggggccuacaaaccagcauagaaggaaaaacgaaggg

SEQ ID NO: 51615 - RNA, 64 nt, Homo Sapiens
ugauuguaaggaauguaggauucucacacaggacacaaaccauaucguuucaaacccacaaaau

SEQ ID NO: 51616 - RNA, 64 nt, Homo Sapiens
ugaguaucaggaauauggagaguugaugcugggcacaaaccacaucccuucauugccacaucag

SEQ ID NO: 51617 - RNA, 64 nt, Homo Sapiens
ucagaguuacuuucgguuagcaaaacuuaacagcacaaaccagguuagucuuuugauucaaauu

SEQ ID NO: 51618 - RNA, 64 nt, Homo Sapiens
gcuagaauuccuccaccuagaccuguguacauucacaaaccacaaaaggugcuaaaccucucug

SEQ ID NO: 51619 - RNA, 64 nt, Homo Sapiens
gcauaagugaucugugccuugggguuccugaaccacaaaccauaagggcggaaaaccgcuuaaa

SEQ ID NO: 51620 - RNA, 64 nt, Homo Sapiens
cuguucacagcuuccucagccaucaugcugugugacaaaccaggugcugcuucagugugguggc

SEQ ID NO: 51621 - RNA, 64 nt, Homo Sapiens
aggaaggugagggugagcagagauguguguggacaucucugaccauccaucgcuguauucaaau

SEQ ID NO: 51622 - RNA, 64 nt, Homo Sapiens
uggaacagcucaccuugucagacagccucagggcaucucugagacacaggggcagaaaaugaca

SEQ ID NO: 51623 - RNA, 64 nt, Homo Sapiens
agcuaugaacugguuuugguccucacacccacucaucucugaggaaaucaagucaaucccccau

SEQ ID NO: 51624 - RNA, 64 nt, Homo Sapiens
ccauccugacuguuuaguaaugagaagguucuggaucucugacuccaggcaagagccauguuuu

SEQ ID NO: 51625 - RNA, 64 nt, Homo Sapiens
gagauggguuggguaccugguccaaaugaccaucaucucugaugagcugcuucugcccccuuga

SEQ ID NO: 51626 - RNA, 64 nt, Homo Sapiens
gccaagcuaugcccaggaauauuggucaccagauaucucugagggcugcccacuccugaugccc

SEQ ID NO: 51627 - RNA, 64 nt, Homo Sapiens
ccccucugacuccaacuucuccaacuucucuuugaucucugaaucccagcuccuaccucugacc

SEQ ID NO: 51628 - RNA, 64 nt, Homo Sapiens
ccuagagccccgcuuucccuccgcuaggccccccaucucugaaccgaggcuucugaccuuugau

SEQ ID NO: 51629 - RNA, 64 nt, Homo Sapiens
uuugggcuauuucuguaugauccaauaacuuauuuugucacagggcuuaauuugccauuuuugg

SEQ ID NO: 51630 - RNA, 64 nt, Homo Sapiens
gucucaucuuuucuagguugucaacagguacuauuugucacauaacuaacuuucgaggcacugg

SEQ ID NO: 51631 - RNA, 64 nt, Homo Sapiens
aauuaugauccucuauuuccccugcaaaaaugaguugucacagaucucagaccuccagugagua

SEQ ID NO: 51632 - RNA, 64 nt, Homo Sapiens
gaccucgggcuaguuaagguagugcauaccggacuugucacacgcuggggugcauuucccccgc

SEQ ID NO: 51633 - RNA, 64 nt, Homo Sapiens
guauuguauuuuugugaucuuucuuaaacugggcuugucacauuauaugagcuacugcauguaa

SEQ ID NO: 51634 - RNA, 64 nt, Homo Sapiens
uccccggugcuguuuuacaauaaaauggacagccuugucacaccucuucuguuguccaaggcug

SEQ ID NO: 51635 - RNA, 64 nt, Homo Sapiens
aaaagacacugguguaucucagaaggggaugguguugucacaaacugugguuaauccaaucaau

SEQ ID NO: 51636 - RNA, 64 nt, Homo Sapiens
ccaaccaguaggauauuucuacaagguguucauuuugucacaagcuguagauaacagcaagaga

SEQ ID NO: 51637 - RNA, 64 nt, Homo Sapiens
gcuuaguuacaacuguuaauaagaacuggcuaauuugucacaguuuaauagggacuaauguggg

SEQ ID NO: 51638 - RNA, 64 nt, Homo Sapiens
ugaaauuggcaguauugaccgacuccaagugcuauugucacagaaauaauggaggcaaugguau

SEQ ID NO: 51639 - RNA, 64 nt, Homo Sapiens
acuuauuuaauguauuucaucucauguuuucuuauugucacaagaguacaguuaaugcugcgug

SEQ ID NO: 51640 - RNA, 64 nt, Homo Sapiens
auaaagccccaaaauuaagaauucuuuugucauuuugucacauuugcucuauggggggaauuau

SEQ ID NO: 51641 - RNA, 62 nt, Homo Sapiens
ucacgccaggccccguccugccgugacacccuucauccuacccuuggaaccccaaggccaag

SEQ ID NO: 51642 - RNA, 62 nt, Homo Sapiens
gauaaagcaacagccugcccagaucccucuguucauccuaucccuuccaagguugguccaug

SEQ ID NO: 51643 - RNA, 62 nt, Homo Sapiens
auguguagacaauaaucugccaaauaaugaauucauccuagguguaggaaaaacaaucuugc

SEQ ID NO: 51644 - RNA, 62 nt, Homo Sapiens
acuggaaacuuauuucucaugccucaacuuucucauccuaaacauaugcaaaaguccugcau

SEQ ID NO: 51645 - RNA, 62 nt, Homo Sapiens
uagcugccuggcaaaucccucuuuucuuucucucauccuacaccuccacccagaaaacugcc

SEQ ID NO: 51646 - RNA, 62 nt, Homo Sapiens
acccaaaagagggacaaacauacauaccuaggucauccuaucccucccccaauccauacaca

SEQ ID NO: 51647 - RNA, 64 nt, Homo Sapiens
ucauccaaacugagcaguuucuguguauauauagaagguagaaaugaaaagugagaaaauauuu

SEQ ID NO: 51648 - RNA, 64 nt, Homo Sapiens
acaaauaagcuuuuaaacuggugucuuuggaaggaagguagauacaaaaagauugugguaaaaa

SEQ ID NO: 51649 - RNA, 64 nt, Homo Sapiens
aaagaugaagcuggagagagaggaaccaguugccaagguagagagcugcccgcuccugcccucu

SEQ ID NO: 51650 - RNA, 64 nt, Homo Sapiens
aguacccaugucuuuuucaugucuaaccauugggaagguagaggcuggcagggaagacaaaucu

SEQ ID NO: 51651 - RNA, 64 nt, Homo Sapiens
auaaaccuaaauugugucguacaacaaaauuauaaagguagaaaaaaaacaaaaacaaacaaca

SEQ ID NO: 51652 - RNA, 64 nt, Homo Sapiens
ccagacgcaguggcucacgcauuauuuaauuguaaagguagaggaugaacucccagaagauuuu

SEQ ID NO: 51653 - RNA, 64 nt, Homo Sapiens
agaucugugcccaugggucuucuuuuagcucaggaagguagaaguguauuccuuuggcuuggca

SEQ ID NO: 51654 - RNA, 64 nt, Homo Sapiens
ugacuucaaggucacgagguagaagggaauaugaaagguagaagaaagagccuauucgauagcu

SEQ ID NO: 51655 - RNA, 64 nt, Homo Sapiens
acucacugucuuuucuccacacuuguccuaagccaagguagauuuguacguagacagacuggug

SEQ ID NO: 51656 - RNA, 64 nt, Homo Sapiens
auaggaaggaccacaacaugacccguaagucaagaagguagacauuucauauccagcuuccuug

SEQ ID NO: 51657 - RNA, 64 nt, Homo Sapiens
ugauaccaagucuguacuguuuuucgagauacuuaagguagaaaauggauucacugaugugcau

SEQ ID NO: 51658 - RNA, 64 nt, Homo Sapiens
ucaguaggcauauauaucuacucaaagcucauaaaagguagaucuuccuugcaagaugcauucu

SEQ ID NO: 51659 - RNA, 64 nt, Homo Sapiens
guagccagugguaauacaaagcagggagaacagaaagguagaguuacuaaggccuucagugaac

SEQ ID NO: 51660 - RNA, 64 nt, Homo Sapiens
cucacuuauguuaaugcaaucuugaaaugacugaaagguagauugccagcacagugaguuuccc

SEQ ID NO: 51661 - RNA, 64 nt, Homo Sapiens
aaccccaucugaagguuaccagcaucaaagaccaaagguagauaaauucacgaagaugaggaga

SEQ ID NO: 51662 - RNA, 64 nt, Homo Sapiens
uacaggcaaccagccugacuuaaaacaguaucuuaagguagauggugauuagcacauguaguau

SEQ ID NO: 51663 - RNA, 64 nt, Homo Sapiens
ccucacccacccucuguguuuccccuucuuugaaaagguagaagagaaaggaauauuuuaaacc

SEQ ID NO: 51664 - RNA, 64 nt, Homo Sapiens
uuagcauuuugaaagacuuucacagugagaguagaagguagauuuggaaucaugcauuuuagca

SEQ ID NO: 51665 - RNA, 63 nt, Homo Sapiens
aauugcuuugacuucuaaauguuucugcuucccagaaugcaccugacuuaugaaauggggaua

SEQ ID NO: 51666 - RNA, 63 nt, Homo Sapiens
uguucccaucaguuuagcccagagauagacaguagaaugcaaauaccucccuccccuaaacug

SEQ ID NO: 51667 - RNA, 63 nt, Homo Sapiens
augaaaacugguuuguagcaguuuugaaagaauagaaugcauucaaauguaaggcugcuucug

SEQ ID NO: 51668 - RNA, 63 nt, Homo Sapiens
uaggagagagugagugaaagaagccaagggucaagaaugcagaagcaaaggaaggacuaaaaa

SEQ ID NO: 51669 - RNA, 63 nt, Homo Sapiens
ggaaaaguuuaaagacaguucaauuuaaucaucagaaugcauucuuuuuuuuuucggagacgg

SEQ ID NO: 51670 - RNA, 63 nt, Homo Sapiens
ggauuacaggcaugagccacugcgccuggccucagaaugcauucuuacacaucuauccuagac

SEQ ID NO: 51671 - RNA, 63 nt, Homo Sapiens
gaaacagucaacugcagugucgaauucucagugagaaugcaauuaacuacguuggcacuggua

SEQ ID NO: 51672 - RNA, 63 nt, Homo Sapiens
ggaacaguuaaguagaacugcgaauucucaauaagaaugcaguuuaccacauaggcacuggua

SEQ ID NO: 51673 - RNA, 63 nt, Homo Sapiens
caagcaauuguuaauaucucuccuuggaacuuaagaaugcagcccuaauauucuugcccagga

SEQ ID NO: 51674 - RNA, 63 nt, Homo Sapiens
gagggugcaagcagaauacaggacaugaggaaaagaaugcagaggcccucgggacaagcuuug

SEQ ID NO: 51675 - RNA, 63 nt, Homo Sapiens
cuucugguaccaugauccuccugucaugaucacagaaugcaagaggcuuugugauuguaagca

SEQ ID NO: 51676 - RNA, 63 nt, Homo Sapiens
aauaauguuggugaggauaauuugugaacgaagagaaugcauaaaggauuuuuaacuuguacu

SEQ ID NO: 51677 - RNA, 63 nt, Homo Sapiens
ccagcugacaucuugaauccuuccauuccacacagaaugcaaccaagucacacgcuuuugaau

SEQ ID NO: 51678 - RNA, 63 nt, Homo Sapiens
aacauccacaauaaccaagauauuuuuaucccaagaaugcaagauuucagaaaaugaaaaauc

SEQ ID NO: 51679 - RNA, 63 nt, Homo Sapiens
uucuaaagaaaucuagaugaacccugaauuuccagaaugcagguugacuugauuuuuuaagcu

SEQ ID NO: 51680 - RNA, 63 nt, Homo Sapiens
agcagcugagcauguuaaaaaagcuaaauccccagaaugcagcaguuguagauuauugggaug

SEQ ID NO: 51681 - RNA, 63 nt, Homo Sapiens
uucugugugcccugaaaaugauuuugcuaccaaagaaugcaugaauauaucugugauuuuaaa

SEQ ID NO: 51682 - RNA, 63 nt, Homo Sapiens
agucuagaggggguaacaguaaauucaaaaguaagaaugcaaacuacucacacauuaaccccc

SEQ ID NO: 51683 - RNA, 63 nt, Homo Sapiens
gcccauucagcauggggaucagggcagcucagaagaaugcaggguuucucagcacacugcaga

SEQ ID NO: 51684 - RNA, 63 nt, Homo Sapiens
gggcagagaccuaccugcagucuaaaagugugaagaaugcaaucucuacagccuggccucaac

SEQ ID NO: 51685 - RNA, 63 nt, Homo Sapiens
cuaugcauguuuaaagaucugguccccuuuaugagaaugcaagccgauccacauccugacuua

SEQ ID NO: 51686 - RNA, 63 nt, Homo Sapiens
aacuaauaaguaguaacaauaaacuucauauuuagaaugcaaagucuauaaagaauaauuuua

SEQ ID NO: 51687 - RNA, 63 nt, Homo Sapiens
aacauuguuaaaggugcuuauuuguauaucaguagaaugcaaggccaacugaaaccccagagg

SEQ ID NO: 51688 - RNA, 63 nt, Homo Sapiens
auaccagaucuggucacuuuuggcuacuugaguagaaugcauucuuuuuuuuuuuucuucccc

SEQ ID NO: 51689 - RNA, 64 nt, Homo Sapiens
ccacacggccacaccaccacucagcucuaggcaugcagacaacccauccacauguguuguacuu

SEQ ID NO: 51690 - RNA, 64 nt, Homo Sapiens
cacacccacucgcacaagcuccagacaccacacagcagacaauagccucccauccccagaccca

SEQ ID NO: 51691 - RNA, 64 nt, Homo Sapiens
agaaguccaaacuuuuuuuuuauuacuagcuucagcagacaaaaacuuccucugucaagguguu

SEQ ID NO: 51692 - RNA, 64 nt, Homo Sapiens
gucuuagagcauguguguauucagucagauacuggcagacaauucagaacuuucaccacaugag

SEQ ID NO: 51693 - RNA, 64 nt, Homo Sapiens
uguaaaggaggguuugguccugucugcuuccucaccuugagaguaaagugcugcccucugcccc

SEQ ID NO: 51694 - RNA, 64 nt, Homo Sapiens
aaggcauuucccaaguuagucgcuaccuaaucagccuugagaagaauccuuuccucuucuuuga

SEQ ID NO: 51695 - RNA, 64 nt, Homo Sapiens
aaaauuuaaguuaacuguugauuuuuuuuuguucccuugagaccuauauuaaauucugaaugca

SEQ ID NO: 51696 - RNA, 64 nt, Homo Sapiens
acaaucagguaagaucauaaagaugauuagcucaccuugagauaguauuuuuuaaggcaaauaa

SEQ ID NO: 51697 - RNA, 64 nt, Homo Sapiens
ugaagauauuuuaccaugaagagauugcacuuauccuugagaacagucuaaauauaaaugaaga

SEQ ID NO: 51698 - RNA, 64 nt, Homo Sapiens
ugaagauauuuuaccaugaagagauugcacuuauccuugagaacagucuaaugauacuuuuuuu

SEQ ID NO: 51699 - RNA, 64 nt, Homo Sapiens
acuggggucucccacaagguccuuuauucacagaccuugagaccaggcaucuugguuguaaguc

SEQ ID NO: 51700 - RNA, 64 nt, Homo Sapiens
gggcuggcuuaccccccaagguggccuacuggccccuugagaagugccugccugggccgccucu

SEQ ID NO: 51701 - RNA, 64 nt, Homo Sapiens
gugagccaauuaacagcugcugagacagugcuugccuugagagaucucugccuugagacugccu

SEQ ID NO: 51702 - RNA, 64 nt, Homo Sapiens
gugcuugccuugagagagugcugccuugagacugccuugagacauguuuuuugcugugucaucu

SEQ ID NO: 51703 - RNA, 64 nt, Homo Sapiens
gccuugagacagugcuugcccugugucaucucugccuugagacuuucucccccucuguuuuuug

SEQ ID NO: 51704 - RNA, 64 nt, Homo Sapiens
auuuuuuuaaaaugagucgugggguagugcuucaccuugagaugcuuugaaagagcccuaaaca

SEQ ID NO: 51705 - RNA, 64 nt, Homo Sapiens
uaauuaaacauggaggaugaauuaccuuccuaucccuugagauaagacaucuuucaguuucaug

SEQ ID NO: 51706 - RNA, 64 nt, Homo Sapiens; identical to SEQ ID NO: 51689

SEQ ID NO: 51707 - RNA, 64 nt, Homo Sapiens; identical to SEQ ID NO: 51690

SEQ ID NO: 51708 - RNA, 64 nt, Homo Sapiens; identical to SEQ ID NO: 51691

SEQ ID NO: 51709 - RNA, 64 nt, Homo Sapiens; identical to SEQ ID NO: 51692

SEQ ID NO: 51710 - RNA, 64 nt, Homo Sapiens; identical to SEQ ID NO: 51693

SEQ ID NO: 51711 - RNA, 64 nt, Homo Sapiens; identical to SEQ ID NO: 51694

SEQ ID NO: 51712 - RNA, 64 nt, Homo Sapiens; identical to SEQ ID NO: 51695

SEQ ID NO: 51713 - RNA, 64 nt, Homo Sapiens; identical to SEQ ID NO: 51696

SEQ ID NO: 51714 - RNA, 64 nt, Homo Sapiens; identical to SEQ ID NO: 51697

SEQ ID NO: 51715 - RNA, 64 nt, Homo Sapiens; identical to SEQ ID NO: 51698

SEQ ID NO: 51716 - RNA, 64 nt, Homo Sapiens; identical to SEQ ID NO: 51699

SEQ ID NO: 51717 - RNA, 64 nt, Homo Sapiens; identical to SEQ ID NO: 51700

SEQ ID NO: 51718 - RNA, 64 nt, Homo Sapiens; identical to SEQ ID NO: 51701

SEQ ID NO: 51719 - RNA, 64 nt, Homo Sapiens; identical to SEQ ID NO: 51702

SEQ ID NO: 51720 - RNA, 64 nt, Homo Sapiens; identical to SEQ ID NO: 51703

SEQ ID NO: 51721 - RNA, 64 nt, Homo Sapiens; identical to SEQ ID NO: 51704

SEQ ID NO: 51722 - RNA, 64 nt, Homo Sapiens; identical to SEQ ID NO: 51705

SEQ ID NO: 51723 - RNA, 64 nt, Homo Sapiens
cccugacucucugugaccugccccgcccagcugcaccugccagccuggcuucuggagcccuugg

SEQ ID NO: 51724 - RNA, 64 nt, Homo Sapiens
aaagccaaacucugccagccacauccaaccccccaccugccauuugcacccuccgccuucacuc

SEQ ID NO: 51725 - RNA, 64 nt, Homo Sapiens
aggggaggccagcccugcccucaggaccugccugaccugccagugaugccaagagggggaucaa

SEQ ID NO: 51726 - RNA, 64 nt, Homo Sapiens
ucaagcacuggccucugccccuccuccuuccagcaccugccagagcuucuccaggaggccaagc

SEQ ID NO: 51727 - RNA, 64 nt, Homo Sapiens
gagcccacacccaugcccacguuuccgucugcucaccugccacagcuguucauaccacaucagu

SEQ ID NO: 51728 - RNA, 64 nt, Homo Sapiens
cagcgcuccggggccugaggccaggucuccucccaccugccacacccucccagggcagccccaa

SEQ ID NO: 51729 - RNA, 64 nt, Homo Sapiens
uacaggaguggccucucccaacugggcacaagccaccugccaaaccugccauagccuugaugcc

SEQ ID NO: 51730 - RNA, 64 nt, Homo Sapiens
aggcauccucauccuacugacacagacauccugcaccugccacuucucccacacacgacaaagu

SEQ ID NO: 51731 - RNA, 64 nt, Homo Sapiens
ugacccgcccagacuguccccagacucccccgagaccugccagccccggcauccuggaaguccc

SEQ ID NO: 51732 - RNA, 64 nt, Homo Sapiens
gccccggcauccuggaagucccgacuccccccagaccugccagccccggcguccuggagcuggg

SEQ ID NO: 51733 - RNA, 64 nt, Homo Sapiens
cccuggggggaggcaggagggagaaagggcucccaccugccaguugugggcccuggggagagga

SEQ ID NO: 51734 - RNA, 64 nt, Homo Sapiens
cucugggacgugugggcccucuuccauccgagaaaccugccaugcaccaagagugacccacucu

SEQ ID NO: 51735 - RNA, 64 nt, Homo Sapiens
auauucaccauaauuuuuuugaacuucaaaucuuaccugccaacgccguuuaucuucucugaaa

SEQ ID NO: 51736 - RNA, 64 nt, Homo Sapiens
acgcccagcuaauuuuuguacugggacuacaggcaccugccaccugccucagccuccugaguag

SEQ ID NO: 51737 - RNA, 64 nt, Homo Sapiens
aguucucuugccccaugccuguuuggccaccgugaccugccaaagucuuccaggaaaaaauccc

SEQ ID NO: 51738 - RNA, 64 nt, Homo Sapiens
uugaaccguuucugcacuaacgcucaugucccacaccugccauagugguuucuccacuccuccc

SEQ ID NO: 51739 - RNA, 64 nt, Homo Sapiens
uucucuccaaggaguggggucgauugcucaguucaccugccacgaauuuaguugaggcuggauu

SEQ ID NO: 51740 - RNA, 64 nt, Homo Sapiens
agugucucuaagagauccagacuguuaagccaagaccugccaggacucccuugucuuuuuccag

SEQ ID NO: 51741 - RNA, 64 nt, Homo Sapiens
agccccucugcccucacaacgcauggacccugacaccugccaacccucuaccuuuccagccaag

SEQ ID NO: 51742 - RNA, 64 nt, Homo Sapiens
agcacuuggccugcaggggcuucaguggagcuagaccugccaggguccccucucucacucugcc

SEQ ID NO: 51743 - RNA, 64 nt, Homo Sapiens
ccuugggcucggagccccgguggcuuugcccuccaccugccaaccccucagcagaggcagcugg

SEQ ID NO: 51744 - RNA, 64 nt, Homo Sapiens
gucaaggauuccagucaggucuguucauagaaacaccugccagugaagacaggcacaguccucu

SEQ ID NO: 51745 - RNA, 64 nt, Homo Sapiens
augaccacugacccacaucucuguccacagugauaccugccaagggaguggcccucagugucau

SEQ ID NO: 51746 - RNA, 64 nt, Homo Sapiens
uguauggcuacaaguuaucccucugacuugcagaaccugccaggcccagcaugugguuacaguu

SEQ ID NO: 51747 - RNA, 64 nt, Homo Sapiens
agcugaggguggcagcagucccuggcagcaugggaccugccaacgccucugacccuagcccugc

SEQ ID NO: 51748 - RNA, 64 nt, Homo Sapiens
cagcggggaaguucaccagacauaggccucugcuaccugccagucuugggcaaguccugcccac

SEQ ID NO: 51749 - RNA, 61 nt, Homo Sapiens
aaauauuuuugcuguagacuuguaugcaacaggcacucaauccggugccuaggauugugcc

SEQ ID NO: 51750 - RNA, 61 nt, Homo Sapiens
cgcgaaaguaucaccaggguccacguagggcggcacucacaaccucgaguuagaacccggc

SEQ ID NO: 51751 - RNA, 61 nt, Homo Sapiens
ccccugcuuucucaaacacuugcccaccucaggcacucagcgggcuccgccguggugagag

SEQ ID NO: 51752 - RNA, 61 nt, Homo Sapiens
agccagguccgcaucuccccaccaccaccagggcacucacucgcagcuauagcccaggaca

SEQ ID NO: 51753 - RNA, 64 nt, Homo Sapiens
agcaugcacacuuguugcuacccucauuuuguaaccaauuuauuugccuuaugaaugugauugc

SEQ ID NO: 51754 - RNA, 64 nt, Homo Sapiens
accucuggcuaccuagaguucuuccugucuugacccaauuuaugagaaagcucccaguugggac

SEQ ID NO: 51755 - RNA, 64 nt, Homo Sapiens
aagcaaaagauuaagaguucaaaaguaaaugcaaccaauuuaacauguaguguuauuaaaaaau

SEQ ID NO: 51756 - RNA, 64 nt, Homo Sapiens
uguuuugcaaugggauauauuuuuacuuauaauaccaauuuaggcugggcgcaguggcucacgc

SEQ ID NO: 51757 - RNA, 64 nt, Homo Sapiens
uaaagcaauauacuggucuagauaggauauugagccaauuuaaaaaaccacuggucuagcuuua

SEQ ID NO: 51758 - RNA, 64 nt, Homo Sapiens
uaaagcaauguuauugugacgauagguuguugagccaauuuaagcaagaauaaagauuucuuua

SEQ ID NO: 51759 - RNA, 64 nt, Homo Sapiens
cugggaauagacaugguacuuaccuuagaguuuuccaauuuaucucaauuuuauauggcuugug

SEQ ID NO: 51760 - RNA, 64 nt, Homo Sapiens
gcaugggauuuuuuaaagagcugcucagguaauuccaauuuaauugcguguccuacuuggguuu

SEQ ID NO: 51761 - RNA, 64 nt, Homo Sapiens
ugaggcuggauucgauugcugucaaccccaauuaccaauuuagugaguuuugggccugugcacg

SEQ ID NO: 51762 - RNA, 64 nt, Homo Sapiens
aauccauauucaaaaauacccauugucggugauuccaauuuaaacugcacuuuuuauagagcug

SEQ ID NO: 51763 - RNA, 64 nt, Homo Sapiens
uccaugucuucaauugucaccaguuagagacaaaccaauuuaauaacucuugauuacuaagagg

SEQ ID NO: 51764 - RNA, 64 nt, Homo Sapiens
gacacugucuuaaauccuaauguaugggcuuguaccaauuuacuuccaucacuuugaggacuug

SEQ ID NO: 51765 - RNA, 64 nt, Homo Sapiens
caggugugugguaaacggguaaugcaugggaaauaaugagaagcagcucacagaguuuaaacua

SEQ ID NO: 51766 - RNA, 64 nt, Homo Sapiens
agcacuuuaauuuuuuugccuuacuuucaugugcaaugagaauuacuuaagaauugguaacgca

SEQ ID NO: 51767 - RNA, 64 nt, Homo Sapiens
ugcagacagaccucaacauuugacuuggcaugaaaaugagaaaaagacagccagauccagugau

SEQ ID NO: 51768 - RNA, 64 nt, Homo Sapiens
ccaaauuuugggggaauaaaaauaagucaaacaaaaugagaacaccucuucaucaacauaguaa

SEQ ID NO: 51769 - RNA, 64 nt, Homo Sapiens
uuuauuaagaaagauccuauucaguagugagggcaaugagaagcucucuaacacguuuuuuacu

SEQ ID NO: 51770 - RNA, 64 nt, Homo Sapiens
ucccagauucaauuaccugguccuuuucuaaccuaaugagaauggcuagugauuuucucaucuu

SEQ ID NO: 51771 - RNA, 64 nt, Homo Sapiens
aaaacuaauuuuuggagcaggcugaauaaggagcaaugagaaacagcuuauugaaauaacuguc

SEQ ID NO: 51772 - RNA, 64 nt, Homo Sapiens
uauaccaauaaaaagcauuucaaaauaagugggaaaugagaaguaaugaauauauuucuuaaua

SEQ ID NO: 51773 - RNA, 64 nt, Homo Sapiens
acauaagaugauaaauaaaaaaaauaguaauuaaaaugagaaauaauacuugaaauagaccuau

SEQ ID NO: 51774 - RNA, 64 nt, Homo Sapiens
aagugaaaagggaaacccuugguggacaagagagaaugagaacuaaaggcacgucuuacauggc

SEQ ID NO: 51775 - RNA, 64 nt, Homo Sapiens
aaaggucauuguauccauuuuuaaaacaaacuaaaaugagaacauuagguucaauuuucuuauu

SEQ ID NO: 51776 - RNA, 64 nt, Homo Sapiens
auuagcuaauucuauuacuacuuagcguguuucuaaugagaaguuacugaaaucuauuacuguc

SEQ ID NO: 51777 - RNA, 64 nt, Homo Sapiens
auuugaaauugcauuacaguucauaaaaauugaaaaugagaaauuaaaccugcaagugaaacau

SEQ ID NO: 51778 - RNA, 64 nt, Homo Sapiens
accucaguaaaaauagugaagacaugcaucauggaaugagaaaaugagaaaggaaugaguuguc

SEQ ID NO: 51779 - RNA, 64 nt, Homo Sapiens
aaaaauagugaagacaugcaucauggaaugagaaaaugagaaaggaaugaguugucuaacauca

SEQ ID NO: 51780 - RNA, 64 nt, Homo Sapiens
ucaagagccaucugcuuuccaggugaacauuggaaaugagaaucuuugaaacuuagcaauaugu

SEQ ID NO: 51781 - RNA, 64 nt, Homo Sapiens
gccauuuuccaagugguggcugacuguugcagggaaugagaauuucauaauacacugcuauuuc

SEQ ID NO: 51782 - RNA, 64 nt, Homo Sapiens
ccagcagaaguagauuaaaauuguuuuaagaggaaaugagaagguaaaaauuguugcuucuguu

SEQ ID NO: 51783 - RNA, 64 nt, Homo Sapiens
cacaucagucacaagaaucaucagcacaauauuuaaugagaaauuauugguuaauuagaaauac

SEQ ID NO: 51784 - RNA, 64 nt, Homo Sapiens
cagaaaauuuacgaaaaucuuagauuuuguuuagaaugagaaaauauacaauuagaauuauuuu

SEQ ID NO: 51785 - RNA, 64 nt, Homo Sapiens
ucaauuuggguaaagaaaggaauacuuuuguuagaaugagaauuaaagagaaaacaaaagaauc

SEQ ID NO: 51786 - RNA, 64 nt, Homo Sapiens
cugagauuugauaggcauguaauuuaagcaugaaaaugagaacacaagcuucccauuucuguau

SEQ ID NO: 51787 - RNA, 64 nt, Homo Sapiens
aagcagaauuccaggaguccacacgguuaaaggcaaugagaaacacuuuuggacuggguuugua

SEQ ID NO: 51788 - RNA, 64 nt, Homo Sapiens
ugauggaauguugacugugugcucguuuaagagcaaugagaaaauagaaaaagaauuugguuuu

SEQ ID NO: 51789 - RNA, 64 nt, Homo Sapiens
ucuacaauuaauggaauucccaaagcugaaauuuaaugagaauugaguguuucuucugaagaac

SEQ ID NO: 51790 - RNA, 64 nt, Homo Sapiens
accugaagugaaggcuagaggacaauucuggacuaaugagaaaguagcaaguagcuuacaaggg

SEQ ID NO: 51791 - RNA, 64 nt, Homo Sapiens
uaaaucuaugcuggugcagcaagucauaaagaauaaugagaaaaggagauggugagcacaaggu

SEQ ID NO: 51792 - RNA, 64 nt, Homo Sapiens
uuucucuuuugcaauagaacuagauagauagagaaaugagaagguagauagauagauagauaga

SEQ ID NO: 51793 - RNA, 64 nt, Homo Sapiens
cauguugauguugaugggaguauaugauugagcaaaugagaaaauaaaacuauuucagauguau

SEQ ID NO: 51794 - RNA, 64 nt, Homo Sapiens
ugugaaaagagccaaguguuuuuuaaaacuuaguaaugagaaacaauuaucaguuaggcaaugu

SEQ ID NO: 51795 - RNA, 64 nt, Homo Sapiens
cacaaggccugccucugacuaccccuugaaggauaaugagaaaccaagaauuaguccaaaugga

SEQ ID NO: 51796 - RNA, 64 nt, Homo Sapiens
gaaaaaaguaucuuuaacagucuaagguaauauuaaugagaaggaacaagcauggggauucuuu

SEQ ID NO: 51797 - RNA, 64 nt, Homo Sapiens
aauggaagaugguaaacaauugagauaaauggucaaugagaaagagguuaccaagauuaaaaag

SEQ ID NO: 51798 - RNA, 64 nt, Homo Sapiens
gggcuuaucagaacuccuuucuaaggagcacuagaaugagaaaucauguuguucgaucguuuca

SEQ ID NO: 51799 - RNA, 64 nt, Homo Sapiens
uagccaacuuaaaccugugcuuucauguuuaagaaaugagaaauugugccaaagauagcagaag

SEQ ID NO: 51800 - RNA, 64 nt, Homo Sapiens
guuuaauacaacagguguccuuaauuuuuguuugaaugagaaaaauauuuuacugccuuuccuu

SEQ ID NO: 51801 - RNA, 64 nt, Homo Sapiens
gccuucuuccuuugcuucagcucccagugaauggaaugagaaaaugaauacuccauccccuucc

SEQ ID NO: 51802 - RNA, 64 nt, Homo Sapiens
ccugugguuucacuuauuuauuaaaaugcucuaaaaugagaaagcaggccuucuaaaaagcagg

SEQ ID NO: 51803 - RNA, 64 nt, Homo Sapiens
aauuuuguaaaacuuaacaaagaauuccaagaaaaaugagaaauggcuuuguaaaaugaagagu

SEQ ID NO: 51804 - RNA, 64 nt, Homo Sapiens
ucagacugagguaauaagacuuccagagaagcauaaugagaaaguccaggauuuagaagugucu

SEQ ID NO: 51805 - RNA, 64 nt, Homo Sapiens
aaaaauuuucuaaauauuaauacacauccaagugaaugagaauuaugaagcuguaauucugaaa

SEQ ID NO: 51806 - RNA, 64 nt, Homo Sapiens
cccaagcuugcuuuuaacucauauguaggacagaaaugagaagcuaaggggaugacugucucaa

SEQ ID NO: 51807 - RNA, 64 nt, Homo Sapiens
ccucaggaaaagacuaguauacauuuauuauuuuaaugagaaugauacaauuuauuuaguacau

SEQ ID NO: 51808 - RNA, 64 nt, Homo Sapiens
aaaucugaauacaguguggacuucaguuaauauaaaugagaaaaugguuucauuggcuuuaaag

SEQ ID NO: 51809 - RNA, 64 nt, Homo Sapiens
accacauguucucacucauagauaggaauugaacaaugagaacacauggagacaggaaggggaa

SEQ ID NO: 51810 - RNA, 64 nt, Homo Sapiens
cgcuaggauuacaaguaugagacuuugccauuccaaugagaauuuuguccuuagcaaucucauc

SEQ ID NO: 51811 - RNA, 64 nt, Homo Sapiens
caauggccacuggagauguguguagggccacaagaaugagaaagggggcaauggagugacaggu

SEQ ID NO: 51812 - RNA, 64 nt, Homo Sapiens
aaaaaaguugcugaaguacuguacaggguuguacaaugagaacccaaugccaaggcaaaaagaa

SEQ ID NO: 51813 - RNA, 64 nt, Homo Sapiens
gggaagaauuauauugaauggaauuauuuuugauaaugagaauuauuuggguagauucacugag

SEQ ID NO: 51814 - RNA, 64 nt, Homo Sapiens
uuccaaguacagugagcacaaaagagaaaugggaaaugagaacaggaacauucaaugucaccug

SEQ ID NO: 51815 - RNA, 64 nt, Homo Sapiens
auccuaacccaauagaaucagugauucuauucagaaugagaaaaucaugagaauaaaacaaaag

SEQ ID NO: 51816 - RNA, 64 nt, Homo Sapiens
aauacagccaaccagguaagugaaagauuucuacaaugagaauuacaaagcagugcacaaagaa

SEQ ID NO: 51817 - RNA, 64 nt, Homo Sapiens
auccagaaucuauaaagaacucaaacaaaucaacaaugagaaaaacaaccccauuaaaaacugg

SEQ ID NO: 51818 - RNA, 64 nt, Homo Sapiens
aaugcauugucucugguuugagugaauuugaauaaaugagaaaauuuuaguguuuacuuccugc

SEQ ID NO: 51819 - RNA, 64 nt, Homo Sapiens
uguaauacuuaaauaaacauguuguuaacaaaggaaugagaauaguuggcugguuguuuucguu

SEQ ID NO: 51820 - RNA, 64 nt, Homo Sapiens
guuuaauuucaaauagaauauggacuuaaauguuaaugagaaaauggcuuuaaucaauucuagc

SEQ ID NO: 51821 - RNA, 64 nt, Homo Sapiens
acuauuggaagauaaacuugucaaacuugucaagaaugagaaaagccaaauuagaaaauccuau

SEQ ID NO: 51822 - RNA, 64 nt, Homo Sapiens
gcaacuccauuuguugagggucuuuguguucuucaaugagaaaucaaauuugagacguugaaau

SEQ ID NO: 51823 - RNA, 64 nt, Homo Sapiens
uaucugccuguuauaaagaugaacaaaaaaacuuaaugagaaagaucacagauacguaauaauu

SEQ ID NO: 51824 - RNA, 64 nt, Homo Sapiens
gaucauaucauugcuacuuuuuauaccuuauuugcuacaacauauuuauacugugaagacuuug

SEQ ID NO: 51825 - RNA, 64 nt, Homo Sapiens
uuagcuuuugcccaucuaaaguuagucgucuuuccuacaacauucaagaaauagugagguagua

SEQ ID NO: 51826 - RNA, 64 nt, Homo Sapiens
uuuggaaaaccucuguggggacauuuuagucaagcuacaacagguuuaaaaucauacauucuga

SEQ ID NO: 51827 - RNA, 64 nt, Homo Sapiens
ucugccugguucuccgggaucaccagccagucaucuacaacaaaaguggaacgaagacuaaccu

SEQ ID NO: 51828 - RNA, 64 nt, Homo Sapiens
cagccccuccccaggagcucuccuccggggccaccgaccgcagcugugggugugagccuggccg

SEQ ID NO: 51829 - RNA, 64 nt, Homo Sapiens
gcaaggaggggaagaaaguccgacaugaccuucacgaccgcaauagccucaugcaagucauccc

SEQ ID NO: 51830 - RNA, 64 nt, Homo Sapiens
gcgaggaaugugguggccaccuguacuacggugccgaccgcaauuguucacaggggcuagccac

SEQ ID NO: 51831 - RNA, 64 nt, Homo Sapiens
ugagccuccgccauccagcaugacaaacuguggccgaccgcagcugugccguggcacgauggcg

SEQ ID NO: 51832 - RNA, 64 nt, Homo Sapiens
cacuuccagccgggccccucauguauccacuggccgaccgcagagugucccuaccuccucucca

SEQ ID NO: 51833 - RNA, 64 nt, Homo Sapiens
gcucccucucugggggcugagagccucccacugccgaccgcacaagggagggcuggugccuucg

SEQ ID NO: 51834 - RNA, 64 nt, Homo Sapiens
ucaaucuuugcggauacuuugcuuauucguuuaacgaccgcacagcuccgagguuuggccucua

SEQ ID NO: 51835 - RNA, 64 nt, Homo Sapiens
uaugguaaucaguuuuguauaaaauaaaagcagucgaccgcacuuuuccaacacacacaacgua

SEQ ID NO: 51836 - RNA, 64 nt, Homo Sapiens
gcggccgugggacugaugcggugaucacaggugacgaccgcaccgcagggggcgccaggcagcc

SEQ ID NO: 51837 - RNA, 64 nt, Homo Sapiens
acugucuuccggagucccccgccugcacaaucuccgaccgcauccgcccacuucccggcccggg

SEQ ID NO: 51838 - RNA, 64 nt, Homo Sapiens
guacccgcauccucucucccauccgaccccgggccgaccgcaccgcacuggggaacgucuuggg

SEQ ID NO: 51839 - RNA, 64 nt, Homo Sapiens
aaauaguuuuaacuagcuuaguuuucugguuuccaaaacuaaaauagauuaaauccuacaaauu

SEQ ID NO: 51840 - RNA, 64 nt, Homo Sapiens
guugguaaauuuuuaggauauuguguugcacuagaaaacuaagugguucauauuucuaaugagg

SEQ ID NO: 51841 - RNA, 64 nt, Homo Sapiens
uuuacuuucugcugugaacuuugugaggugagagaaaacuaauggcguuggccaucucuacauu

SEQ ID NO: 51842 - RNA, 64 nt, Homo Sapiens
uaccacaauagcuguauuuuuuaaauacauugaaaaaacuaaagugcucaggugagaucauagc

SEQ ID NO: 51843 - RNA, 64 nt, Homo Sapiens
ggugcuuuauauuuagauuguuuuuucauugccaaaaacuaaauaaaaaccaauguuuugcagu

SEQ ID NO: 51844 - RNA, 64 nt, Homo Sapiens
aaaaaaaaacuuugccagccaggagcauuuuuuaaaaacuaaaaaauugaacacaaucucauug

SEQ ID NO: 51845 - RNA, 64 nt, Homo Sapiens
aaagaagcguaaaaagugaguugaaaaacuaauaaaaacuaauauucuguuauuucugauacuu

SEQ ID NO: 51846 - RNA, 64 nt, Homo Sapiens
aaaacuaauaaaagaagcguucugauacuuuugaaaaacuaauaucucccaacauucuguuauu

SEQ ID NO: 51847 - RNA, 64 nt, Homo Sapiens
uuuauuuucuagauuaucccaugucuuugaaagcaaaacuaauagguuccugcucauuccagua

SEQ ID NO: 51848 - RNA, 64 nt, Homo Sapiens
aauaaguuaauuaauauaacucuaagcagacaggaaaacuaaauuucaaccuaaacagccaauu

SEQ ID NO: 51849 - RNA, 64 nt, Homo Sapiens
agacuucugcccuccaacauugcaaguguauacaaaaacuaaauuauacugaguaaugcacucu

SEQ ID NO: 51850 - RNA, 64 nt, Homo Sapiens
aauaacaaaggugcauaauucuuagguaaucccaaaaacuaacaugcaauuaaaaugugauugg

SEQ ID NO: 51851 - RNA, 64 nt, Homo Sapiens
uuucaucacuuuuuauucauaacuucagauuuguaaaacuaauuuccaaaauauaagcuguuuu

SEQ ID NO: 51852 - RNA, 64 nt, Homo Sapiens
caaaauuuuacaaaucauuuguggaaugaaugguaaaacuaaucugaugaaauggaaaauuauu

SEQ ID NO: 51853 - RNA, 64 nt, Homo Sapiens
uugggaaaacauuugcugccauuacagagguauuaaaacuaaauuucacuacuagauugacuaa

SEQ ID NO: 51854 - RNA, 64 nt, Homo Sapiens
gccaggacaugcaauaaaauuuaaaaaauaaauaaaaacuaauuaagaaauugugugugugucu

SEQ ID NO: 51855 - RNA, 64 nt, Homo Sapiens
uuuuaagugcuuauuuuuaucacccaaccccuggaaaacuaaauauugcaggcaugagccacug

SEQ ID NO: 51856 - RNA, 64 nt, Homo Sapiens
uuuuuuuuucucuugagacgaaaacucauacuggaaaacuaaauaauauaauugcgaauaucag

SEQ ID NO: 51857 - RNA, 64 nt, Homo Sapiens
caaaaauccagugucacauguaaaauauucaaacaaaacuaaaaaaauaaguaagaacuauuuu

SEQ ID NO: 51858 - RNA, 64 nt, Homo Sapiens
uucuuaauauauuucauuaugauugaaaaacauaaaaacuaacauaggaaagugaaugaucagu

SEQ ID NO: 51859 - RNA, 64 nt, Homo Sapiens
guguauaccugggggugggcagugcucuuuuucuaaaacuaauauggcuuauauaucugaauua

SEQ ID NO: 51860 - RNA, 64 nt, Homo Sapiens
aauaguggaaaaauaaaaaaauaaguaaacagaaaaaacuaaaguuguauuuucccacaaauau

SEQ ID NO: 51861 - RNA, 64 nt, Homo Sapiens
aucuaauaggaaaacaugauacuuucaaugugccaaaacuaaaccuuaguauacaacuaaaaau

SEQ ID NO: 51862 - RNA, 64 nt, Homo Sapiens
cagguacuaugaauguaauucauaauuuaaaaggaaaacuaaaaacuauuuugauuugggaaaa

SEQ ID NO: 51863 - RNA, 64 nt, Homo Sapiens
uuuauauucagcuacucuugucauuucucguugaaaaacuaaaaucugacuagguuaguuuacu

SEQ ID NO: 51864 - RNA, 64 nt, Homo Sapiens
ucaugaagccacugcugggcuccagagagaagggaaaacuaagagguuuuaaaaccccuacccu

SEQ ID NO: 51865 - RNA, 64 nt, Homo Sapiens
uuaaaaaacaacaaugacaacgacaacaaaaaacaaaacuaaaacgacuuauuauuuauuaauu

SEQ ID NO: 51866 - RNA, 64 nt, Homo Sapiens
aguguaucuuguauuuucccgaaaagcagaaggaaaaacuaaaauggagugauugugguucuug

SEQ ID NO: 51867 - RNA, 64 nt, Homo Sapiens
agagaaugcuucuuacaggaacauuuuuaaauauaaaacuaaagcauuaucugauccaguccuc

SEQ ID NO: 51868 - RNA, 64 nt, Homo Sapiens
gaaugaaaaguauuugccucaacuaacggaaggaaaaacuaagauuggaaaaacccaugaaggu

SEQ ID NO: 51869 - RNA, 64 nt, Homo Sapiens
aaaaacaauaauuuggaaaaaugcauucacuugaaaaacuaaaaaaaauuuuauguauuaauau

SEQ ID NO: 51870 - RNA, 64 nt, Homo Sapiens
cuccuacauagaugcugccccacgaaggacccacaaaacuaaccuaguucaggguucucaggca

SEQ ID NO: 51871 - RNA, 64 nt, Homo Sapiens
acuuucaaccuaugaaaauguaaauaccuuugaaaaaacuaaacuaucagucauuuacauccuc

SEQ ID NO: 51872 - RNA, 64 nt, Homo Sapiens
agaacuuauuagaaacgauuccggauggcauuggaaaacuaaagaaacugucaaucuugaaggu

SEQ ID NO: 51873 - RNA, 64 nt, Homo Sapiens
uguuauuuuaacagacccugccuaaaagcauuggaaaacuaaagaaguugagcaacuugaaugc

SEQ ID NO: 51874 - RNA, 64 nt, Homo Sapiens
cuguaucagaaugaagaaacuaauauuuuacauaaaaacuaauacuuucaauuuuuuauauagu

SEQ ID NO: 51875 - RNA, 64 nt, Homo Sapiens
uugaucacuuguguacgaaaaauaaaucuccuuaaaaacuaaauaaaaugcacuguauucuuac

SEQ ID NO: 51876 - RNA, 64 nt, Homo Sapiens
uaaaauuagaaagaccuaucaccccaagaaagugaaaacuaauagucugcugauaaaauauuua

SEQ ID NO: 51877 - RNA, 64 nt, Homo Sapiens
aagaaaacacuguaauugcuauuaccaguguuggaaaacuaaugaguaauugcaucauaauuac

SEQ ID NO: 51878 - RNA, 64 nt, Homo Sapiens
uaacuucucagaaagauaucucacuguggaaauaaaaacuaaggacacagucuuuaauuuucac

SEQ ID NO: 51879 - RNA, 64 nt, Homo Sapiens
auguuuuaauauuucugaauaucaugguaaauauaaaacuaaauagaaaaauuggagacuuaua

SEQ ID NO: 51880 - RNA, 64 nt, Homo Sapiens
uuagaaguuugaagacuuuauaaauguguugauaaaaacuaauuuaaauuaaguugacaugagg

SEQ ID NO: 51881 - RNA, 64 nt, Homo Sapiens
uucucugcugagcaauugugucuuuagccuugugaaaacuaaccuaugagggagcaucuguaaa

SEQ ID NO: 51882 - RNA, 64 nt, Homo Sapiens
ucuuaaauaaaacagaaaaccuuucuucagaauuaaaacuaaaaaaaaacaaggaaauguaccu

SEQ ID NO: 51883 - RNA, 64 nt, Homo Sapiens
acaaggaaauguaccucuuuuauaaccugacgcuaaaacuaaaaaaagaaaacagaaaccuggu

SEQ ID NO: 51884 - RNA, 64 nt, Homo Sapiens
cauaaaguagauauugguuuaugucuuagauaauaaaacuaaauacuuguuauuucuuuguaaa

SEQ ID NO: 51885 - RNA, 64 nt, Homo Sapiens
uaaauuaaaacugcuuacacacugaagauuggcaaaaacuaaaaaaaaaaacacuuuucuaagg

SEQ ID NO: 51886 - RNA, 64 nt, Homo Sapiens
ucauuagugacagacuuguuauggaaaccuaaguaaaacuaagcuauuuaaaaggguuucauga

SEQ ID NO: 51887 - RNA, 64 nt, Homo Sapiens
acaaaaaguaaaaauuaguuucagucaaaauaauaaaacuaaaacuuauugcauauuuucauaa

SEQ ID NO: 51888 - RNA, 64 nt, Homo Sapiens
ugcaauguauaaaaaguuuauuuugcuauugugaaaaacuaaauguaaaggaaaucaccuacuu

SEQ ID NO: 51889 - RNA, 64 nt, Homo Sapiens
uaauuuuguguguuuagaguucuguugucaaaagaaaacuaaugaauaaauuaguuugucauuc

SEQ ID NO: 51890 - RNA, 64 nt, Homo Sapiens
guuugucuucacaaauaucaaaacaaaauggaggaaaacuaagcauuggccucauguucagucu

SEQ ID NO: 51891 - RNA, 63 nt, Homo Sapiens
uucagucuucaggauaucacaccacgucuuuucaaaaacuaaagagaauucaaaaagggcuga

SEQ ID NO: 51892 - RNA, 64 nt, Homo Sapiens
gcagaaaauguaaaaugcucuucucauuuuauugaaaacuaagaccaaagugagcguuuaaauc

SEQ ID NO: 51893 - RNA, 64 nt, Homo Sapiens
gcuagcuuuccuuucauuucacaaaagggcaugaaaaacuaacuacaguuuucaauguagugac

SEQ ID NO: 51894 - RNA, 64 nt, Homo Sapiens
acucugcgugaagggccuuaaugucacccaccagaaaacuaacuccaaauaaacgcuuacccuu

SEQ ID NO: 51895 - RNA, 64 nt, Homo Sapiens
gguuuuuucuuuaaaugauuuguauuacuuuauuaaaacuaaaucugaaauggaauagaaaaua

SEQ ID NO: 51896 - RNA, 64 nt, Homo Sapiens
auucucaaaaaaacuuguucgcuaaacaaaaacuaaaacuaagaucaaaauuuucaguguguaa

SEQ ID NO: 51897 - RNA, 64 nt, Homo Sapiens
cuaagaauucucaaaaaaacguguaagcuaaacaaaaacuaaaaugcuucucaaaauuuucagu

SEQ ID NO: 51898 - RNA, 64 nt, Homo Sapiens
uguuuaaaaauauuuggaguccaugauuccaaacaaaacuaacuaagauauauaucuugguuua

SEQ ID NO: 51899 - RNA, 64 nt, Homo Sapiens
uuggcauccuaucacuauguaacucuuaaagaaaaaaacuaaucgggguuuaguacuccaaaug

SEQ ID NO: 51900 - RNA, 64 nt, Homo Sapiens
cagaaagucugaauguagcaugucagguuauacuaaaacuaaauuacuggagacggguuaccaa

SEQ ID NO: 51901 - RNA, 64 nt, Homo Sapiens
gccaaaaaaccuuugagauuauaagaaaauuaugaaaacuaauaaucuuguuuuugugugcaac

SEQ ID NO: 51902 - RNA, 64 nt, Homo Sapiens
ucucuggaaaauggauuugcgcugauucuuccuuaaaacuaaaagcaucucgguggccugccug

SEQ ID NO: 51903 - RNA, 64 nt, Homo Sapiens
aaugcaaaacuuuugcuauuugacucaaagggggaaaacuaaaguguuuucucuuucaguuagu

SEQ ID NO: 51904 - RNA, 64 nt, Homo Sapiens
uaaauaaaagugaaccauauuuaucugguuauauaaaacuaaaaauggggguguuuauauaaaa

SEQ ID NO: 51905 - RNA, 64 nt, Homo Sapiens
gguuauauaaaacuaaaaauggggguguuuauauaaaacuaaaaacuaagaaugauguaaccuu

SEQ ID NO: 51906 - RNA, 64 nt, Homo Sapiens
uaaaacuaaaaauggggguguuuauauaaaacuaaaaacuaagaaugauguaaccuuuugucug

SEQ ID NO: 51907 - RNA, 64 nt, Homo Sapiens
caacucuugaauuaaauccacuagagcgagcuuuaaaacuaaucugagcauaacccccaacgug

SEQ ID NO: 51908 - RNA, 64 nt, Homo Sapiens
gagauguuuggaugacaaaaaaaugccuuauugaaaaacuaaagcaaauucuuuauaggaagaa

SEQ ID NO: 51909 - RNA, 64 nt, Homo Sapiens
ugucaguuaucacuguagauauuugcaaaaucacaaaacuaagugggaugacccaggcaucuug

SEQ ID NO: 51910 - RNA, 64 nt, Homo Sapiens
uauaaacuauguacuccuggauuuuuuuccauuuaaaacuaauuuuuauccauucaaaauauau

SEQ ID NO: 51911 - RNA, 64 nt, Homo Sapiens
gccucaaaaaugcuaaaagaaagaugacuacuagaaaacuaaaaacaaaacaaaucauuuuaac

SEQ ID NO: 51912 - RNA, 64 nt, Homo Sapiens
uugguaaaauauuuguauauauagaaaauaaucuaaaacuaaaaacuaaaucagagugcugagu

SEQ ID NO: 51913 - RNA, 64 nt, Homo Sapiens
uaggaaagccuuuccuauuaaacacagucuuuuuaaaacuaacaaaaaaaauugaauuaaaaau

SEQ ID NO: 51914 - RNA, 64 nt, Homo Sapiens
gggcaggggaagugaaaggaauuguuuuuaauagaaaacuaaagauauagaugcuaugguucag

SEQ ID NO: 51915 - RNA, 64 nt, Homo Sapiens
caauuaauuauucaauuaggcucuuccuaggaugaaaacuaaauaggauugaaaugauuuguuu

SEQ ID NO: 51916 - RNA, 64 nt, Homo Sapiens
uuuucugaaucguguguuuauuggaaauguacauaaaacuaaaaacauaauauguugagguugc

SEQ ID NO: 51917 - RNA, 64 nt, Homo Sapiens
uaauauguugagguugcuugccuguaaaauauugaaaacuaacaugagcuauuuuuuucuguac

SEQ ID NO: 51918 - RNA, 64 nt, Homo Sapiens
uccugaaacucucaagccucucaucucugcccagcccccucaguggcgcugcuaugcaaggcuu

SEQ ID NO: 51919 - RNA, 64 nt, Homo Sapiens
uguccagcgucuggcugccuguggccuggagggacccccucaagaggagacaaagccuaaguuu

SEQ ID NO: 51920 - RNA, 64 nt, Homo Sapiens
ggaagcgcugagggaacaaaugguuggcaugcagcccccucaggcgccccgagaccucaucuuc

SEQ ID NO: 51921 - RNA, 64 nt, Homo Sapiens
uccuuucuauccuuuuauauuuuucccuuccccacccccucacucaaugguauaaaagcuagga

SEQ ID NO: 51922 - RNA, 64 nt, Homo Sapiens
uaacggcacuugagauaugugcaguggguggucucccccucagucuuacuuugagcugcuguua

SEQ ID NO: 51923 - RNA, 64 nt, Homo Sapiens
ucagaguaaugggaagaaccauguggggacgagacccccucauccccaaccucccaccccuuca

SEQ ID NO: 51924 - RNA, 64 nt, Homo Sapiens
cccucacuuccuguaccuagggggcuggcucccucccccucagacaucagcacagacuacggga

SEQ ID NO: 51925 - RNA, 64 nt, Homo Sapiens
ggccucugccccucuucccuggccaggggcuucucccccucagcucucccucacaccucccuuc

SEQ ID NO: 51926 - RNA, 64 nt, Homo Sapiens
caaugugucagugccuggggggaggggaggagcacccccucagccccccugaaccugaccaaaa

SEQ ID NO: 51927 - RNA, 64 nt, Homo Sapiens
guagcccauuuccaccccacucccaacuucauuucccccucacugaggcucccaccccgccaca

SEQ ID NO: 51928 - RNA, 64 nt, Homo Sapiens
gcugagauggaagacauggcuccuuugguacgcacccccucagaagaccaaucccuuccuuugg

SEQ ID NO: 51929 - RNA, 64 nt, Homo Sapiens
cgccauagagcugggccuggguucucuggccucacccccucaguggaggucccagaagucuucu

SEQ ID NO: 51930 - RNA, 64 nt, Homo Sapiens
cucuguuuaucuguucucugcuacacacuccacacccccucaaauuaccccugugccugugucu

SEQ ID NO: 51931 - RNA, 64 nt, Homo Sapiens
ccugcccugaacaugccccacaugugcagggcgucccccucaaccagucauugcacagcaaagc

SEQ ID NO: 51932 - RNA, 64 nt, Homo Sapiens
uuugcagaugcccaccuggagagacccaccggagcccccucaaccugagucuccucacagcaga

SEQ ID NO: 51933 - RNA, 64 nt, Homo Sapiens
ggcgccucaacaguagcccccgggcccccgucagcccccucaaguucuccccuuuugagggguu

SEQ ID NO: 51934 - RNA, 64 nt, Homo Sapiens
ccgcccucgaccaccgccccucuccccauccguccccccucagggaccaagaaguccaagaggg

SEQ ID NO: 51935 - RNA, 64 nt, Homo Sapiens
agaccagagcgcccucugaugagcccacugcccacccccucaagccaauccccuccuugggcac

SEQ ID NO: 51936 - RNA, 64 nt, Homo Sapiens
gugcccugguggagaaagcacugaccugucaugccccccucaaaccuccucuucugacgugccu

SEQ ID NO: 51937 - RNA, 64 nt, Homo Sapiens
gggugucucccucgggggcucuuccccuagaccucccccucacuuacauaaagcucccuugaag

SEQ ID NO: 51938 - RNA, 64 nt, Homo Sapiens
ggaaaaugacuuuauugcuuaauuucugccuuuccccccucacacaugcacuuuugggccuuuu

SEQ ID NO: 51939 - RNA, 64 nt, Homo Sapiens
ccgcgcagccugcccccuccuggacgugcccauccccccucagauccagacaugccccuccccc

SEQ ID NO: 51940 - RNA, 64 nt, Homo Sapiens
cugcugcaccuuccccacccccuccugggaagugcccccucaccucagggcacccgcaaccugg

SEQ ID NO: 51941 - RNA, 64 nt, Homo Sapiens
uauguuugcucacauucuuucagccuucugucaccccccucaacaccaaacuuucuuccuugug

SEQ ID NO: 51942 - RNA, 64 nt, Homo Sapiens
gugggcagccugguaggggucgccagccuccaugcccccucaucuuccaguucuugcuuagugg

SEQ ID NO: 51943 - RNA, 64 nt, Homo Sapiens
cuggccugaugauggugggugggugggaugaguacccccucaaacccugcccuccuuagaccug

SEQ ID NO: 51944 - RNA, 64 nt, Homo Sapiens
ccgucccccaaacauguuguacauuucaccauggcccccucaucauagcaauaacauucccacu

SEQ ID NO: 51945 - RNA, 64 nt, Homo Sapiens
gggcugcuuccugggggcucuccagaccccucucuaggaccaagucacccgucgugcugggagu

SEQ ID NO: 51946 - RNA, 64 nt, Homo Sapiens
agugcccagguguggugguggcauccugaagcaguaggaccauuagugugcgugcacacccacg

SEQ ID NO: 51947 - RNA, 64 nt, Homo Sapiens
ggcuucacagccccagaggauuccauauaaaagacauuguaauggaguggauugaacucacaga

SEQ ID NO: 51948 - RNA, 64 nt, Homo Sapiens
caagguggagucuuaccugguuuuccuuuccaagcauuguaaauuguauaccaaagauauuagu

SEQ ID NO: 51949 - RNA, 64 nt, Homo Sapiens
ccagcuacccaguauccaugcugccauaucccuucauuguaaaaaguaccuaaacauucgugaa

SEQ ID NO: 51950 - RNA, 64 nt, Homo Sapiens
ugguugacuuagaccguaagcuuuuuaaguuucucauuguaauuuaccuucucaugcagauugc

SEQ ID NO: 51951 - RNA, 64 nt, Homo Sapiens
uccugcuccucaggaacuaugggagccucagacucauuguaauucaagcuuuccgagucaagug

SEQ ID NO: 51952 - RNA, 64 nt, Homo Sapiens
uuaucugugaguucuguuguguuugucaaaaagucauuguaaucuuucauagccauaccuggua

SEQ ID NO: 51953 - RNA, 64 nt, Homo Sapiens
caguauuuuagggugcauccaguauaccauugagcauuguaaccucaggaaacaguuuauuuug

SEQ ID NO: 51954 - RNA, 64 nt, Homo Sapiens
guaacaauuguauaucuuacaauauuuuuccuugcauuguaauuuuuaaguauuuaucauuuua

SEQ ID NO: 51955 - RNA, 64 nt, Homo Sapiens
auuaaccuuuuuugucuuaucuuuauuuguaaaccauuguaacuuuaaaagcacaaucacuaaa

SEQ ID NO: 51956 - RNA, 64 nt, Homo Sapiens
auuuacucuuugcaaacccugaaugggguagaaacauuguaaauugcagaaccacaaacaauuc

SEQ ID NO: 51957 - RNA, 64 nt, Homo Sapiens
agagcccaucaaauccugaguguuaaauguauagcauuguaaugaagucacugauguuuguucc

SEQ ID NO: 51958 - RNA, 64 nt, Homo Sapiens
ucucacuuuagaucaucaaaauuaaaaaucacgacauuguaaaaauaaaauuacuaugaaguau

SEQ ID NO: 51959 - RNA, 64 nt, Homo Sapiens
uguuuccagcaaaagugagcuuuucuaaucgucucauuguaacauggcuuauuuuguagaggua

SEQ ID NO: 51960 - RNA, 64 nt, Homo Sapiens
auaacuuauuuuucuccauugcuguucuuaaaaacauuguaaguagcuguaauauaccaguacc

SEQ ID NO: 51961 - RNA, 64 nt, Homo Sapiens
uuuuuuacuagaguguuuuuuuuauccaaaacgccauuguaacggucauguaauguauagugaa

SEQ ID NO: 51962 - RNA, 64 nt, Homo Sapiens
uacguuaaaacacacaacuccagugguaucagcacauuguaaaugggcuacuucugcuuuaccu

SEQ ID NO: 51963 - RNA, 64 nt, Homo Sapiens
ugguaccagaagucccuuuccuguucugucucuucauuguaauggaaguuucaguugggcauga

SEQ ID NO: 51964 - RNA, 64 nt, Homo Sapiens
caagccuauacugauggccuuagcuuuguucagucauuguaacugggauuguugucauugcuac

SEQ ID NO: 51965 - RNA, 64 nt, Homo Sapiens
auacauccacaggguaucuauuaccagcauaaugcauuguaagauggcaagguggcauuuugaa

SEQ ID NO: 51966 - RNA, 64 nt, Homo Sapiens
aacagagggucagucacaggauguucugacacaccauuguaacuuuuuguuagagaugauccca

SEQ ID NO: 51967 - RNA, 64 nt, Homo Sapiens
cacuugaauaaaaaauaguuuuguuuccuagggccauuguaaguaugggggauaauaacagaac

SEQ ID NO: 51968 - RNA, 64 nt, Homo Sapiens
uuaacuuuguuguuucaaauguuuuucuugaaaucauuguaauguguaaguguauauauucuua

SEQ ID NO: 51969 - RNA, 64 nt, Homo Sapiens
agagaagaaaguggcagguuuuaugucgaaacugcauuguaaaauguuguuuacucuaccaaug

SEQ ID NO: 51970 - RNA, 64 nt, Homo Sapiens
aaagcaccuggaguuucaaaauuccaguuuuaaucauuguaaaagcuuuguuuuuaaaaauuau

SEQ ID NO: 51971 - RNA, 64 nt, Homo Sapiens
uugggccucuggccuuccuuacuuaaugucuucuuuucccuacucuaaugcauuucuaacucac

SEQ ID NO: 51972 - RNA, 64 nt, Homo Sapiens
uaucacugaaauccuuaagguugaggaggcuuuauuucccuagcacuggugaagggcuucaacu

SEQ ID NO: 51973 - RNA, 64 nt, Homo Sapiens
agaacauccuccaauuccacagucucugggagacuuucccuaagaggcgacuuccucuccagcc

SEQ ID NO: 51974 - RNA, 64 nt, Homo Sapiens
auuuuaugaaaaacucuucuacuuucaucuauucuuucccuagaggcaaacauuucuuaaaaug

SEQ ID NO: 51975 - RNA, 64 nt, Homo Sapiens
ggcuguguccugcagugggaccuugggcaacuccuuucccuaugagaagcuggcucuucugagu

SEQ ID NO: 51976 - RNA, 64 nt, Homo Sapiens
gagaaccccuuuaaccucugcgggacagcaugucuuucccuauccaccuucgauucuuuucucu

SEQ ID NO: 51977 - RNA, 52 nt, Homo Sapiens
uugaggaccucuuugagugagcuuucccuaauucuuucuccuuucucuaaug

SEQ ID NO: 51978 - RNA, 64 nt, Homo Sapiens
aguuuauuuuggguucugauauguagcaugguauuuucccuaaggcagaacuuuaaaaauaaag

SEQ ID NO: 51979 - RNA, 64 nt, Homo Sapiens
uuauuuuaauauggauuucuuauuuuauacaucauuucccuaauaaaucuccaagaagcaccuc

SEQ ID NO: 51980 - RNA, 64 nt, Homo Sapiens
aagucaaaaaugcugugauuaaccaaaaacuccuuuucccuaggaaagaaaaaaaaaacccuaa

SEQ ID NO: 51981 - RNA, 64 nt, Homo Sapiens
cacucagucucucauuugguaaacagaaagcuguuuucccuacaaggugcuugguggugaagcc

SEQ ID NO: 51982 - RNA, 64 nt, Homo Sapiens
uucacuuugugagcaaaguaaccccauaaguuuauuucccuauuucaugguauuguuuaaacuu

SEQ ID NO: 51983 - RNA, 64 nt, Homo Sapiens
acuguagcaagcuucagaaauaaaucuuuugaucuuucccuaucuugauuagauccaaagucaa

SEQ ID NO: 51984 - RNA, 64 nt, Homo Sapiens
gcaaaagaaucagugagguuaaaguaguggaaguuuucccuaugagccuacagucuguauuguu

SEQ ID NO: 51985 - RNA, 64 nt, Homo Sapiens
uuauuaagacuaaauaagugaaguaugucacuuauuucccuaccacugcauggauucuucuaaa

SEQ ID NO: 51986 - RNA, 64 nt, Homo Sapiens
gucauuuuugaaaccacugaaauucagucucuaguuucccuagauguacaucacaauaauauau

SEQ ID NO: 51987 - RNA, 64 nt, Homo Sapiens
cuaaguucuugaccucaguaauuuuauuuuuguuuuucccuaaauguuucccuacuagucuuuu

SEQ ID NO: 51988 - RNA, 64 nt, Homo Sapiens
ccucaguaauuuuauuuuuguuuuucccuaaauguuucccuacuagucuuuuuggaaaacaugu

SEQ ID NO: 51989 - RNA, 64 nt, Homo Sapiens
ucucuuuuggccaaaagaaugauaggcaaaguuuuuucccuacaaaguaacuuugagaggacaa

SEQ ID NO: 51990 - RNA, 64 nt, Homo Sapiens
aaauaguuuuaucagggacaaggcguccauagcauuucccuaauccucccuacucucccugccg

SEQ ID NO: 51991 - RNA, 64 nt, Homo Sapiens
accuuuuucuaguucuugaauaaauauagccugcuuucccuagaugcauuuguguaggaaguau

SEQ ID NO: 51992 - RNA, 64 nt, Homo Sapiens
uucccuagaugcauuuguguaggaaguauauacauuucccuauuacucucaucagcugaagaau

SEQ ID NO: 51993 - RNA, 64 nt, Homo Sapiens
acagcgucugucgaacaaacagaggucuggugguuuucccuacuauccucccacucgagaguuc

SEQ ID NO: 51994 - RNA, 64 nt, Homo Sapiens
acaccugccagcaacuugggggaauaagcgaagguuucccuacaagagggaaagaaggcaaaaa

SEQ ID NO: 51995 - RNA, 64 nt, Homo Sapiens
ucauugcacaagcuccuuuguagccugauuguucuuucccuaaucccauguuucccuaaaccuc

SEQ ID NO: 51996 - RNA, 64 nt, Homo Sapiens
ccucuagccugauuguucuuuuugaaaucccauguuucccuaaacauuugacuuuucccuguug

SEQ ID NO: 51997 - RNA, 64 nt, Homo Sapiens
agcaucugguugcuuuuaagccaaguacaucuaguuucccuauuaaaaaugugucugaauagcg

SEQ ID NO: 51998 - RNA, 64 nt, Homo Sapiens
acaagccaaguuuucgcccugucuccugagaccauuucccuacgcuuugcugcugcugagaguu

SEQ ID NO: 51999 - RNA, 64 nt, Homo Sapiens
uguguaacauuuaaaguagcauggaaccuacgucuuucccuacugcuugcuggcauauaucagu

SEQ ID NO: 52000 - RNA, 64 nt, Homo Sapiens
uuauagacuugauuucaaauucuuaaguucagccuuucccuaucaaucacaaaucauguauugg

SEQ ID NO: 52001 - RNA, 64 nt, Homo Sapiens
caaugcucugaaaauguguccuaguuaugguuacuuucccuaguaaacuuggccuuacagggcu

SEQ ID NO: 52002 - RNA, 64 nt, Homo Sapiens
cagugcucugaagaugugucggcucuaauuaugauuucccuaguugaaaacacuugccuuacaa

SEQ ID NO: 52003 - RNA, 64 nt, Homo Sapiens
uauaaaaguccacacuucguguuuuguugguuuuuuucccuaaaauuuguaaaugagcagaacu

SEQ ID NO: 52004 - RNA, 64 nt, Homo Sapiens
uccacacaggauuccguuggugaaccuguaaaaacaaaacaaacaaaacaaaacaaaaaagaca

SEQ ID NO: 52005 - RNA, 64 nt, Homo Sapiens
gauuccguuggugaaccuguaaaaacaaaacaaacaaaacaaaacaaaaaagacaaaaccuaaa

SEQ ID NO: 52006 - RNA, 64 nt, Homo Sapiens
cguuggugaaccuguaaaaacaaaacaaacaaaacaaaacaaaaaagacaaaaccuaaaacuga

SEQ ID NO: 52007 - RNA, 64 nt, Homo Sapiens
gccugauaaccccuugucaguugucagcucuucccaaaacaaagcucuggaguuucugcuggaa

SEQ ID NO: 52008 - RNA, 64 nt, Homo Sapiens
ugggaguugcagugaaugucauuaaaauuucuuccaaaacaaaacuagaaauaauugcugaggg

SEQ ID NO: 52009 - RNA, 64 nt, Homo Sapiens
ccagccugguuacagagcaagacucugucucaaacaaaacaaaacaaaacaaaaacacacuacu

SEQ ID NO: 52010 - RNA, 64 nt, Homo Sapiens
cugguuacagagcaagacucugucucaaacaaaacaaaacaaaacaaaaacacacuacuguauu

SEQ ID NO: 52011 - RNA, 64 nt, Homo Sapiens
uacagagcaagacucugucucaaacaaaacaaaacaaaacaaaaacacacuacuguauuuugga

SEQ ID NO: 52012 - RNA, 64 nt, Homo Sapiens
acuccagccugggcgacugagcgagacucuaucucaaaacaaucaaaacaaaaaagaccugugg

SEQ ID NO: 52013 - RNA, 64 nt, Homo Sapiens
ugggcgacugagcgagacucuaucucaaaacaaucaaaacaaaaaagaccuguggacucuagua

SEQ ID NO: 52014 - RNA, 64 nt, Homo Sapiens
aaaccucauuuuaguuguagaagaaaauuucuuacaaaacaaauuccacaaagaacacccuaua

SEQ ID NO: 52015 - RNA, 64 nt, Homo Sapiens
caaacccgcuuuuguuuccuucccagaaacaaugcaaaacaacagguggagauagucuggucuu

SEQ ID NO: 52016 - RNA, 64 nt, Homo Sapiens
gaguggcugaaagucacaccggcagguccugaaucaaaacaacaccauagccagcaaaagaccu

SEQ ID NO: 52017 - RNA, 64 nt, Homo Sapiens
ugccccccgcccaucccaugguacggucagcuuucaaaacaauagaagagaugaagagggggag

SEQ ID NO: 52018 - RNA, 64 nt, Homo Sapiens
uuagagauugggucuuucccaaaacaaaacaaaacaaaacaaaaagagcgacacucggucucaa

SEQ ID NO: 52019 - RNA, 64 nt, Homo Sapiens
caaaauuagagauugggucucucaaaaaacaaaacaaaacaaaagugacagagcgacacucggu

SEQ ID NO: 52020 - RNA, 64 nt, Homo Sapiens
caaaacaaaauuagagauugucggucucaaaaaacaaaacaaaaccugggugacagagcgacac

SEQ ID NO: 52021 - RNA, 64 nt, Homo Sapiens
uuuugagaacaaagaugaccaagguaaaacaaaacaaaacaacauacaaaggggaaagaacaua

SEQ ID NO: 52022 - RNA, 64 nt, Homo Sapiens
caacauuuugagaacaaagaacauaaagguaaaacaaaacaaaaaucuguacaaaggggaaaga

SEQ ID NO: 52023 - RNA, 64 nt, Homo Sapiens
cugguaggaaagggcaagucguaaugcaacuacccaaaacaagcacuggcagacuguguaaaau

SEQ ID NO: 52024 - RNA, 64 nt, Homo Sapiens
aaacacuaggaguccacucaauaaaaaaacaaaacaaaacaaaaccacaucgugcagucguguc

SEQ ID NO: 52025 - RNA, 64 nt, Homo Sapiens
caaaaaaacacuaggaguccgugucauaaaaaaacaaaacaaaacagauccacaucgugcaguc

SEQ ID NO: 52026 - RNA, 64 nt, Homo Sapiens
uuccaaacaguguguugguggaauuaaaacaaaacaaaacaaacuauguugguuucaguggcug

SEQ ID NO: 52027 - RNA, 64 nt, Homo Sapiens
caaacuuccaaacaguguguggcuggaauuaaaacaaaacaaaaacuucuauguugguuucagu

SEQ ID NO: 52028 - RNA, 64 nt, Homo Sapiens
auguuacauuccucaaagugccuuuguacccagacaaaacaauuacccccaguguuguaacgua

SEQ ID NO: 52029 - RNA, 64 nt, Homo Sapiens
ggaagaagagaaccuucuguugagacaaugugcccaaaacaaaguguaacaaagugaaaacagg

SEQ ID NO: 52030 - RNA, 64 nt, Homo Sapiens
aaccaguagcugaucuuaaggcuuuuuuaaaaaacaaaacaaaacaacaaaaaaaaaucuuuau

SEQ ID NO: 52031 - RNA, 64 nt, Homo Sapiens
guagcugaucuuaaggcuuuuuuaaaaaacaaaacaaaacaacaaaaaaaaaucuuuauaagaa

SEQ ID NO: 52032 - RNA, 64 nt, Homo Sapiens
acuccaguuuggacuacagagugagacuccaucucaaaacaaaacaaaacaacaacagcaaaaa

SEQ ID NO: 52033 - RNA, 64 nt, Homo Sapiens
aguuuggacuacagagugagacuccaucucaaaacaaaacaaaacaacaacagcaaaaaacaac

SEQ ID NO: 52034 - RNA, 64 nt, Homo Sapiens
ggacuacagagugagacuccaucucaaaacaaaacaaaacaacaacagcaaaaaacaacaaaac

SEQ ID NO: 52035 - RNA, 64 nt, Homo Sapiens
caaaacaaaacaaaacaacaacagcaaaaaacaacaaaacaaaacacaaauacucucacagggc

SEQ ID NO: 52036 - RNA, 64 nt, Homo Sapiens
uuuucuccuucccaaggcagcuggauugaaaaaacaaaacaaaacaaaaaaacccaggggcguc

SEQ ID NO: 52037 - RNA, 64 nt, Homo Sapiens
uccuucccaaggcagcuggauugaaaaaacaaaacaaaacaaaaaaacccaggggcgucagucg

SEQ ID NO: 52038 - RNA, 64 nt, Homo Sapiens
gaaacuaguuucauauauuaccuaguuauucuuucaaaacaaaacaaaaaaaaaacaaaaacug

SEQ ID NO: 52039 - RNA, 64 nt, Homo Sapiens
uaguuucauauauuaccuaguuauucuuucaaaacaaaacaaaaaaaaaacaaaaacugacgca

SEQ ID NO: 52040 - RNA, 64 nt, Homo Sapiens
acuuugaagauuguuuguaucuuuuuuuaaaaaacaaaacaaaacaaaaauccccaaaauauau

SEQ ID NO: 52041 - RNA, 64 nt, Homo Sapiens
gaagauuguuuguaucuuuuuuuaaaaaacaaaacaaaacaaaaauccccaaaauauauagaaa

SEQ ID NO: 52042 - RNA, 64 nt, Homo Sapiens
gccacacaucacccuuaccacuauucugauuacacaaaacaaauagaaguuggaugggugggua

SEQ ID NO: 52043 - RNA, 64 nt, Homo Sapiens
cuagaguguuguugagaauuggacccaaugcacacaaaacaaccucuuacaggcacaaaaugau

SEQ ID NO: 52044 - RNA, 64 nt, Homo Sapiens
aauuacuugaauauguuuguguuacauaauaacccaaaacaaauuugauauauaauuauuucau

SEQ ID NO: 52045 - RNA, 64 nt, Homo Sapiens
agcaauaacaauauuauuaucccugucucaaaagcaaaacaaacgccugggugacagagugaga

SEQ ID NO: 52046 - RNA, 64 nt, Homo Sapiens
cucccuuccccagcagggcuaaaacaaaacaaaacaaaacaaacgcaagauaaaaggucuuggg

SEQ ID NO: 52047 - RNA, 64 nt, Homo Sapiens
caaaccucccuuccccagcauugggaaaacaaaacaaaacaaaacuggugcaagauaaaagguc

SEQ ID NO: 52048 - RNA, 64 nt, Homo Sapiens
caaaacaaaccucccuucccaggucuugggaaaacaaaacaaaaauucucuggugcaagauaaa

SEQ ID NO: 52049 - RNA, 64 nt, Homo Sapiens
acaaaaaacaaacaaacaaaucuuaugaacaaaacaaaacaacaaaguaguaucuuucucucuu

SEQ ID NO: 52050 - RNA, 64 nt, Homo Sapiens
caacaacaaaaaacaaacaacucuuucuuaugaacaaaacaaaacggauaaguaguaucuuucu

SEQ ID NO: 52051 - RNA, 64 nt, Homo Sapiens
uacacuuuacugguaaaauuuaaaacaaaaaaggcaaaacaaaacaaacucauuuuccccuuag

SEQ ID NO: 52052 - RNA, 64 nt, Homo Sapiens
uuuacugguaaaauuuaaaacaaaaaaggcaaaacaaaacaaacucauuuuccccuuaguuccc

SEQ ID NO: 52053 - RNA, 64 nt, Homo Sapiens
uggauauuauucuuguaguuuaccucuuuaaaaacaaaacaaaacaaaacaaaaaacuccccuu

SEQ ID NO: 52054 - RNA, 64 nt, Homo Sapiens
auuauucuuguaguuuaccucuuuaaaaacaaaacaaaacaaaacaaaaaacuccccuuccuca

SEQ ID NO: 52055 - RNA, 64 nt, Homo Sapiens
ucuuguaguuuaccucuuuaaaaacaaaacaaaacaaaacaaaaaacuccccuuccucacugcc

SEQ ID NO: 52056 - RNA, 64 nt, Homo Sapiens
gucuguuggauaauggcuguaaaauguuuaaaaacaaaacaaaacaaaaaagaggcacuagucu

SEQ ID NO: 52057 - RNA, 64 nt, Homo Sapiens
uuggauaauggcuguaaaauguuuaaaaacaaaacaaaacaaaaaagaggcacuagucuaucug

SEQ ID NO: 52058 - RNA, 64 nt, Homo Sapiens
cagagucagacuccgucccaaaaaaacaaacaaacaaaacaaaacaaaaaaaaacagaaguuac

SEQ ID NO: 52059 - RNA, 64 nt, Homo Sapiens
ucagacuccgucccaaaaaaacaaacaaacaaaacaaaacaaaaaaaaacagaaguuacaaaug

SEQ ID NO: 52060 - RNA, 64 nt, Homo Sapiens
cagccuggaugacagagugagaccuugucucaaacaaaacaaaacaaaaaugaaauguucuagu

SEQ ID NO: 52061 - RNA, 64 nt, Homo Sapiens
uggaugacagagugagaccuugucucaaacaaaacaaaacaaaaaugaaauguucuaguuuugg

SEQ ID NO: 52062 - RNA, 64 nt, Homo Sapiens
acaauacaacaagaacaacaguacaaaaacaaaacaaaacaacaucuccuacuuuacacucucu

SEQ ID NO: 52063 - RNA, 64 nt, Homo Sapiens
caacaacaauacaacaagaaucucuguacaaaaacaaaacaaaagaauuucuccuacuuuacac

SEQ ID NO: 52064 - RNA, 64 nt, Homo Sapiens
aaaaacaaggagaaguugucuguuaaaaacaaaacaaaacaaaaggaccagagagagcuuggaa

SEQ ID NO: 52065 - RNA, 64 nt, Homo Sapiens
caaaaaaaaacaaggagaaguggaauguuaaaaacaaaacaaaaauaggggaccagagagagcu

SEQ ID NO: 52066 - RNA, 64 nt, Homo Sapiens
agccaugaugggagacaggacaaaacaaggaccacaaaacaacucaacaacacgaagaugauac

SEQ ID NO: 52067 - RNA, 64 nt, Homo Sapiens
accacaaaacaacuagccaucacgaagaugauaccaaaacaaggaaaagcaacaacagcaacaa

SEQ ID NO: 52068 - RNA, 64 nt, Homo Sapiens
cuguuguuucucuuucuugccuagcagaaaaaaacaaaacaaaaaauagaaacacauuuucugg

SEQ ID NO: 52069 - RNA, 64 nt, Homo Sapiens
caugagcaaacacaaaacccuggugcagcuaaaacaaaacaaaaauggcacaaggaaucacacg

SEQ ID NO: 52070 - RNA, 64 nt, Homo Sapiens
ccugggcgacagagcgagacucugccucaaaaaacaaaacaaaacaaaacacucacccaucaac

SEQ ID NO: 52071 - RNA, 64 nt, Homo Sapiens
gcgacagagcgagacucugccucaaaaaacaaaacaaaacaaaacacucacccaucaacgaaua

SEQ ID NO: 52072 - RNA, 64 nt, Homo Sapiens
aaacaaauacaaucuaacuuaaaacaaaacaaaacaaaacaacccacaaguccugugaggcaaa

SEQ ID NO: 52073 - RNA, 64 nt, Homo Sapiens
caaccaaacaaauacaaucugcaaaaaaacaaaacaaaacaaaauauuucacaaguccugugag

SEQ ID NO: 52074 - RNA, 64 nt, Homo Sapiens
caaaacaaccaaacaaauacgugaggcaaaaaaacaaaacaaaaaagacuauuucacaaguccu

SEQ ID NO: 52075 - RNA, 64 nt, Homo Sapiens
gaaugcccaacauuuuguguugcuguaugggaaucaaaacaauugcucgcucuuuuuaaucaga

SEQ ID NO: 52076 - RNA, 64 nt, Homo Sapiens
aacaaaaccacuuauauugcgacccugucugucucaaaacaaaacagccugggcaacagagcaa

SEQ ID NO: 52077 - RNA, 64 nt, Homo Sapiens
cacaguccugcauacucaccgcuaaaaaacaaaacaaaacaaaaaaagaaaauguguaaggcuu

SEQ ID NO: 52078 - RNA, 64 nt, Homo Sapiens
caaaacacaguccugcauacggcuugcuaaaaaacaaaacaaaaauacaaaagaaaauguguaa

SEQ ID NO: 52079 - RNA, 64 nt, Homo Sapiens
ugcaauauuaaauguuugcuauccaaaauguuagcaaaacaaaguuucaauuaggaaaaguaaa

SEQ ID NO: 52080 - RNA, 64 nt, Homo Sapiens
aggcuuuuccauaaguggccucuuaaagcucauacaaaacaaaucuugaccugguuaaauacug

SEQ ID NO: 52081 - RNA, 64 nt, Homo Sapiens
cuuugaaaaaacuuuaacauagcacaacaaggaacaaaacaaagcuuaaaacuuguuugugguc

SEQ ID NO: 52082 - RNA, 64 nt, Homo Sapiens
acaggaaaaaaacaaaaaacaaaacaaaacaaaacaaaacaaaagaagccucggguaacacuga

SEQ ID NO: 52083 - RNA, 64 nt, Homo Sapiens
caaaaacaggaaaaaaacaaacugaaaaacaaaacaaaacaaaaucagagaagccucggguaac

SEQ ID NO: 52084 - RNA, 64 nt, Homo Sapiens
caaaacaaaaacaggaaaaaguaacacugaaaaacaaaacaaaagcucuucagagaagccucgg

SEQ ID NO: 52085 - RNA, 64 nt, Homo Sapiens
acaacaacgcccucuuaaggagcaaaauccauaccaaaacaacguuuccccuccuauuuuaauc

SEQ ID NO: 52086 - RNA, 64 nt, Homo Sapiens
gaugggagaguaaguaggccguggugccacuaaacaaaacaaauaucucauuuuguacuugguu

SEQ ID NO: 52087 - RNA, 64 nt, Homo Sapiens
ucuggagaugcugaauuuuggcuccaaaacaaaacaaaacaaaaagaaggaaacuaaggacuug

SEQ ID NO: 52088 - RNA, 64 nt, Homo Sapiens
caaaaucuggagaugcugaaacuuggcuccaaaacaaaacaaaauacugagaaggaaacuaagg

SEQ ID NO: 52089 - RNA, 64 nt, Homo Sapiens
caaaacaaaaucuggagauguaaggacuuggcuccaaaacaaaagguguuacugagaaggaaac

SEQ ID NO: 52090 - RNA, 64 nt, Homo Sapiens
aaacaaaaagauuuuauuaacucugucuccaaaacaaaacaaacacuccaaccugggugacaga

SEQ ID NO: 52091 - RNA, 64 nt, Homo Sapiens
caaacaaacaaaaagauuuuacagacucugucuccaaaacaaaaacugcacuccaaccugggug

SEQ ID NO: 52092 - RNA, 64 nt, Homo Sapiens
agucuuuuguuugugaacacaguucaaaacaaaacaaaacaaaagcacagaauaucaccauugc

SEQ ID NO: 52093 - RNA, 64 nt, Homo Sapiens
caaaaagucuuuuguuugugauugcaguucaaaacaaaacaaaauugcugcacagaauaucacc

SEQ ID NO: 52094 - RNA, 64 nt, Homo Sapiens
caaaacaaaaagucuuuuguucaccauugcaguucaaaacaaaacaaauuugcugcacagaaua

SEQ ID NO: 52095 - RNA, 64 nt, Homo Sapiens
caaaauauugaugaucaggcuuaauaaaacaaaacaaaacaaagggacugggacuccagaacca

SEQ ID NO: 52096 - RNA, 64 nt, Homo Sapiens
caaagcaaaauauugaugauaaccauuaauaaaacaaaacaaaagguagggacugggacuccag

SEQ ID NO: 52097 - RNA, 64 nt, Homo Sapiens
cuuaguuuuuaaaugaccaaaaaaacaagcaaaacaaaacaagauaaguaugaaaggaguaauu

SEQ ID NO: 52098 - RNA, 64 nt, Homo Sapiens
caagacuuaguuuuuaaauguaauuaaaaacaagcaaaacaaaaaauauuaaguaugaaaggag

SEQ ID NO: 52099 - RNA, 64 nt, Homo Sapiens
aaaaaaaagcgaaagacugcaguugugcuaaaaacaaaacaaaacaaacaaacaaacaaaaaag

SEQ ID NO: 52100 - RNA, 64 nt, Homo Sapiens
aaagcgaaagacugcaguugugcuaaaaacaaaacaaaacaaacaaacaaacaaaaaaguaaaa

SEQ ID NO: 52101 - RNA, 64 nt, Homo Sapiens
auccugucuuaucugaagaucaguuuucucaaaacaaaacaauucuuuuaagagauuuaagcuu

SEQ ID NO: 52102 - RNA, 64 nt, Homo Sapiens
caauuauccugucuuaucugagcuucaguuuucucaaaacaaaacaggucuuuuaagagauuua

SEQ ID NO: 52103 - RNA, 64 nt, Homo Sapiens
aacuagcagaagaacuaguaaaaagcaagcaaagcaaaacaauacuuuguauauaaaugaacaa

SEQ ID NO: 52104 - RNA, 64 nt, Homo Sapiens
uuuaaaagauuugaaauaaucauuuuuaauaugacaaaacaaauuuaccaaaucuucuccuaug

SEQ ID NO: 52105 - RNA, 64 nt, Homo Sapiens
augaaacacuuauacugacucauuuaugggaagacaaaacaagaccauauaacuaagacauaug

SEQ ID NO: 52106 - RNA, 64 nt, Homo Sapiens
gcaugugacuaguuacaaaagcaauaaauugaaacaaaacaaaacaaaacaaaacuuguuucuu

SEQ ID NO: 52107 - RNA, 64 nt, Homo Sapiens
ugacuaguuacaaaagcaauaaauugaaacaaaacaaaacaaaacaaaacuuguuucuuaaaaa

SEQ ID NO: 52108 - RNA, 64 nt, Homo Sapiens
aguuacaaaagcaauaaauugaaacaaaacaaaacaaaacaaaacuuguuucuuaaaaaugcgg

SEQ ID NO: 52109 - RNA, 64 nt, Homo Sapiens
augaacucccccaaacauggcuguggagagacaacaaaacaaaacaaagcacaaaagucucugc

SEQ ID NO: 52110 - RNA, 64 nt, Homo Sapiens
cucccccaaacauggcuguggagagacaacaaaacaaaacaaagcacaaaagucucugccaaca

SEQ ID NO: 52111 - RNA, 64 nt, Homo Sapiens
agccaccgcaauaauucgguaaagcaaaccagaacaaaacaaaaucacauucguuucccaguga

SEQ ID NO: 52112 - RNA, 64 nt, Homo Sapiens
acaaacaaacaaaaaaccuuagaacaaaacaaaacaaaacaaacugggauuggugcugauugaa

SEQ ID NO: 52113 - RNA, 64 nt, Homo Sapiens
caaacacaaacaaacaaaaauugaaagaacaaaacaaaacaaaaauuuaugggauuggugcuga

SEQ ID NO: 52114 - RNA, 64 nt, Homo Sapiens
caaaacaaacacaaacaaacgcugauugaaagaacaaaacaaaaagaucauuuaugggauuggu

SEQ ID NO: 52115 - RNA, 64 nt, Homo Sapiens
cagaaucucucccugaguuuaaaacagaacaaaacaaaacaauauucaauacaugguuuuuaac

SEQ ID NO: 52116 - RNA, 64 nt, Homo Sapiens
caauacagaaucucucccuguuaacaaaacagaacaaaacaaaauuaaauucaauacaugguuu

SEQ ID NO: 52117 - RNA, 64 nt, Homo Sapiens
aauguuaaggauugucuuaaaguuccuuagccagcaaaacaaaacaaaacaaaacaaacaaaug

SEQ ID NO: 52118 - RNA, 64 nt, Homo Sapiens
uaaggauugucuuaaaguuccuuagccagcaaaacaaaacaaaacaaaacaaacaaaugaaaaa

SEQ ID NO: 52119 - RNA, 64 nt, Homo Sapiens
auugucuuaaaguuccuuagccagcaaaacaaaacaaaacaaaacaaacaaaugaaaaacguuu

SEQ ID NO: 52120 - RNA, 64 nt, Homo Sapiens
cuuaaaguuccuuagccagcaaaacaaaacaaaacaaaacaaacaaaugaaaaacguuuaaaaa

SEQ ID NO: 52121 - RNA, 64 nt, Homo Sapiens
gaaagauggaggauuaccuacaaaucagacauggcaaaacaauaauggcuguuugcuuccauaa

SEQ ID NO: 52122 - RNA, 64 nt, Homo Sapiens
aauccuuguuuuugucgugucuauaaaggaagaacaaaacaaaauaaaaacagagcccuagaga

SEQ ID NO: 52123 - RNA, 64 nt, Homo Sapiens
aaacccacaaaaauuuguaaaaaaugaagcaaaacaaaacaaaauuguacacacacaacagaac

SEQ ID NO: 52124 - RNA, 64 nt, Homo Sapiens
caaaaaaacccacaaaaauuagaacaaaaugaagcaaaacaaaauguuguuguacacacacaac

SEQ ID NO: 52125 - RNA, 64 nt, Homo Sapiens
cucuuggaauguguauuguuuuuauuuugcgaaacaaaacaaaacaaaaaaaaaagcuuggaac

SEQ ID NO: 52126 - RNA, 64 nt, Homo Sapiens
ggaauguguauuguuuuuauuuugcgaaacaaaacaaaacaaaaaaaaaagcuuggaacuccau

SEQ ID NO: 52127 - RNA, 64 nt, Homo Sapiens
aaauuggguucaugaugcagucuccucuuuaaaacaaaacaaaacaaaacaaaacuauacuuga

SEQ ID NO: 52128 - RNA, 64 nt, Homo Sapiens
ggguucaugaugcagucuccucuuuaaaacaaaacaaaacaaaacaaaacuauacuugaacaaa

SEQ ID NO: 52129 - RNA, 64 nt, Homo Sapiens
caugaugcagucuccucuuuaaaacaaaacaaaacaaaacaaaacuauacuugaacaaaagggu

SEQ ID NO: 52130 - RNA, 64 nt, Homo Sapiens
guuucaggugcuagggacuuaaugaaaaacaggacaaaacaauuccuuuuuguggcccagguaa

SEQ ID NO: 52131 - RNA, 64 nt, Homo Sapiens
aaaagacaugggagagauggaaaaaaaaacaaaacaaaacaaaaugacagagccaaacuccguc

SEQ ID NO: 52132 - RNA, 64 nt, Homo Sapiens
caaaaaaaagacaugggagaccgucaaaaaaaaacaaaacaaaauggagugacagagccaaacu

SEQ ID NO: 52133 - RNA, 64 nt, Homo Sapiens
aauuucuugauggaauguagaauugucauaacaucaaaacaagaaauguguuuuuuacuugcua

SEQ ID NO: 52134 - RNA, 64 nt, Homo Sapiens
agauaauucacacaagaggucugaauuaauccuucaaaacaaucgaguugggaaauucucuuga

SEQ ID NO: 52135 - RNA, 64 nt, Homo Sapiens
aaacgguggaacuacgacuaggucugugucuugucaaaacaagugggcaauagagguucugaaa

SEQ ID NO: 52136 - RNA, 64 nt, Homo Sapiens
uuuaaaaagaaagaaagaaggcaaaacuuugccucaaaacaaaucacuccagccuggggacgga

SEQ ID NO: 52137 - RNA, 64 nt, Homo Sapiens
acuccagcuugggcaacagagugagacuccaucucaaaacaaaacaaaacaaaacaaaacaaaa

SEQ ID NO: 52138 - RNA, 64 nt, Homo Sapiens
agcuugggcaacagagugagacuccaucucaaaacaaaacaaaacaaaacaaaacaaaaaaacc

SEQ ID NO: 52139 - RNA, 64 nt, Homo Sapiens
gggcaacagagugagacuccaucucaaaacaaaacaaaacaaaacaaaacaaaaaaacccggcu

SEQ ID NO: 52140 - RNA, 64 nt, Homo Sapiens
acagagugagacuccaucucaaaacaaaacaaaacaaaacaaaacaaaaaaacccggcuuugcu

SEQ ID NO: 52141 - RNA, 64 nt, Homo Sapiens
gugagacuccaucucaaaacaaaacaaaacaaaacaaaacaaaaaaacccggcuuugcugcuuu

SEQ ID NO: 52142 - RNA, 64 nt, Homo Sapiens
ccuaauaaauccacauuuccuacaaauuacauuucaaaacaaacaaggaauaaaaagcuggccg

SEQ ID NO: 52143 - RNA, 64 nt, Homo Sapiens
uugaaucuugcucucuuaaauaaauuuugaaacacaaaacaauuuuaggagauaaauuuauuuu

SEQ ID NO: 52144 - RNA, 64 nt, Homo Sapiens
gugcuuuuuucaaaccugauagaaaaaaacaaaacaaaacaacaggagaagauauucucgugaa

SEQ ID NO: 52145 - RNA, 64 nt, Homo Sapiens
caacagugcuuuuuucaaacgugaaagaaaaaaacaaaacaaaaccaagggagaagauauucuc

SEQ ID NO: 52146 - RNA, 64 nt, Homo Sapiens
ugcuuaaauauaccagucauauaaacaaggguaacaaaacaagcaaaugacaacuuuauuccac

SEQ ID NO: 52147 - RNA, 64 nt, Homo Sapiens
cuuucaaacaaucauuguccuccuggcuuccuuacaaaacaagcucaucaaacucauauauucc

SEQ ID NO: 52148 - RNA, 64 nt, Homo Sapiens
caucugguccacucaauuguauauuuuuauuuugcaaaacaacccaaaacuuacuuuauguugc

SEQ ID NO: 52149 - RNA, 64 nt, Homo Sapiens
aguaccuuuugaauucccccagaagaguuguuuucaaaacaaacauuccagaaugaaugucgcu

SEQ ID NO: 52150 - RNA, 64 nt, Homo Sapiens
gaccugcucagcaguuucuucucucauauauucccaaaacaaguacaucugcgaucaacucuag

SEQ ID NO: 52151 - RNA, 64 nt, Homo Sapiens
cauguauuuuuguuacaaaucuucugaaaaaaaacaaaacaaugugaaacauuaaaauuaaaag

SEQ ID NO: 52152 - RNA, 64 nt, Homo Sapiens
ugggaacacagcgagacccucucauuaaaaacaacaaaacaaaacaauuccagucuuggaguag

SEQ ID NO: 52153 - RNA, 64 nt, Homo Sapiens
acacagcgagacccucucauuaaaaacaacaaaacaaaacaauuccagucuuggaguagucuaa

SEQ ID NO: 52154 - RNA, 63 nt, Homo Sapiens
acguaacuuuguuguuguuuaauaaacuuucuuucaaaacaaucucaaaacuuuacuagggcc

SEQ ID NO: 52155 - RNA, 64 nt, Homo Sapiens
ggggguggggcuuuaagagugaacugaaaucugucaaaacaaagaagagacuaggacucagucu

SEQ ID NO: 52156 - RNA, 64 nt, Homo Sapiens
aacaacaacaacaaaaaacaacugaacuucaaaacaaaacaaaacuuacuguaaaaaaaagugc

SEQ ID NO: 52157 - RNA, 64 nt, Homo Sapiens
caaaaaacaacaacaacaaaagugcacugaacuucaaaacaaaaguaaucuuacuguaaaaaaa

SEQ ID NO: 52158 - RNA, 64 nt, Homo Sapiens
aaacaugagcagugguguuccgaaaaaaacaaaacaaaacaaaauaaugcuuuguuuaaaaaaa

SEQ ID NO: 52159 - RNA, 64 nt, Homo Sapiens
caaaaaaacaugagcaguggaaaaacgaaaaaaacaaaacaaaaaacacuaaugcuuuguuuaa

SEQ ID NO: 52160 - RNA, 64 nt, Homo Sapiens
aacuagauauguaauuucuaaaaacaaaacaaaacaaaacaaaaucuuaucuuaaaaaguaaac

SEQ ID NO: 52161 - RNA, 64 nt, Homo Sapiens
caaaaaacuagauauguaauuaaacaaaacaaaacaaaacaaaaaggacucuuaucuuaaaaag

SEQ ID NO: 52162 - RNA, 64 nt, Homo Sapiens
caaaacaaaaaacuagauauaaaaguaaacaaaacaaaacaaaagcggcaggacucuuaucuua

SEQ ID NO: 52163 - RNA, 64 nt, Homo Sapiens
caaaacaaaacaaaaaacuaucuuaaaaaguaaacaaaacaaaagaggugcggcaggacucuua

SEQ ID NO: 52164 - RNA, 64 nt, Homo Sapiens
aacuauguauuugcacagcaaacauuugccaaaacaaaacaaaaaagucauuaaaacaaaauga

SEQ ID NO: 52165 - RNA, 64 nt, Homo Sapiens
caaaaaacuauguauuugcaaaugaaacauuugccaaaacaaaagaccgaagucauuaaaacaa

SEQ ID NO: 52166 - RNA, 64 nt, Homo Sapiens
gagacagagcaagacuccaucucaaaaacaaaaacaaaacaaaacaacaacaaaaaaagaaguu

SEQ ID NO: 52167 - RNA, 64 nt, Homo Sapiens
agagcaagacuccaucucaaaaacaaaaacaaaacaaaacaacaacaaaaaaagaaguuaaaua

SEQ ID NO: 52168 - RNA, 64 nt, Homo Sapiens
gauaaugacuggacaucagaagaggaaaaaaacucaaaacaaaagcgagagagacuauugccau

SEQ ID NO: 52169 - RNA, 64 nt, Homo Sapiens
aauggaaugagaauguuguuuuaaaagaaaauagcaaaacaacaaaaaagcaaaccuuaaaaug

SEQ ID NO: 52170 - RNA, 64 nt, Homo Sapiens
aaaauuagccuacuuaaaggacuccaucucaaaacaaaacaaaacagccuggcgacagagagag

SEQ ID NO: 52171 - RNA, 64 nt, Homo Sapiens
caaaaaaaauuagccuacuugagagacuccaucucaaaacaaaacacuccagccuggcgacaga

SEQ ID NO: 52172 - RNA, 64 nt, Homo Sapiens
gaaauccuucaccaauagaguauaguuggcuuuccaaaacaacauuucccuccaugcagccagc

SEQ ID NO: 52173 - RNA, 64 nt, Homo Sapiens
uugauaugguacagucauuuccuaaaacacaaggcaaaacaacuuuauagcaaugcaagaaugg

SEQ ID NO: 52174 - RNA, 64 nt, Homo Sapiens
aaaguggacuuuguuguuaucauaucuauuauagcaaaacaagauuuauuuuuuauuaccagag

SEQ ID NO: 52175 - RNA, 64 nt, Homo Sapiens
aaaauuaaggggaaaauuauuucaaaacaagaaacaaaacaaaagcugaaaccgcuuuuuaaaa

SEQ ID NO: 52176 - RNA, 64 nt, Homo Sapiens
aacaaaacaaaaaaaauuaacgcuuuuuaaaauucaaaacaagaagguucccaauagcugaaac

SEQ ID NO: 52177 - RNA, 64 nt, Homo Sapiens
aaaaaaauacccuuuucuuugccugggcauuuuacaaaacaagauauuuguaauaaucgagaau

SEQ ID NO: 52178 - RNA, 64 nt, Homo Sapiens
acaauucaggaacaacggcucguugaaugaaaagcaaaacaaaacacaaguuacaaguugauau

SEQ ID NO: 52179 - RNA, 64 nt, Homo Sapiens
uguguuuauauuuccuguaagugaauaaauaaaacaaaacaaaacaaaaaaaacuugugccuga

SEQ ID NO: 52180 - RNA, 64 nt, Homo Sapiens
uuauauuuccuguaagugaauaaauaaaacaaaacaaaacaaaaaaaacuugugccugauaagc

SEQ ID NO: 52181 - RNA, 64 nt, Homo Sapiens
cagccugggugacagagcgagacuaucucagaaacaaaacaaaacaaaacaacaaaaaaagaaa

SEQ ID NO: 52182 - RNA, 64 nt, Homo Sapiens
ugggugacagagcgagacuaucucagaaacaaaacaaaacaaaacaacaaaaaaagaaaaggca

SEQ ID NO: 52183 - RNA, 64 nt, Homo Sapiens
gacagagcgagacuaucucagaaacaaaacaaaacaaaacaacaaaaaaagaaaaggcagagua

SEQ ID NO: 52184 - RNA, 57 nt, Homo Sapiens
uaaaacaaaaaaaaggaaggaacaaaacaaaacaaaaaaggauuuggcaugcuguaa

SEQ ID NO: 52185 - RNA, 52 nt, Homo Sapiens
caaaauaaaacaaaaaaaagaacaaaacaaaaaaggauuuggcaugcuguaa

SEQ ID NO: 52186 - RNA, 64 nt, Homo Sapiens
uuagcugagcauggugguguaucucaaaacaaaacaaaacaaaagggcgacacagcgagacucc

SEQ ID NO: 52187 - RNA, 64 nt, Homo Sapiens
caaaauuagcugagcaugguacuccaucucaaaacaaaacaaaaagccugggcgacacagcgag

SEQ ID NO: 52188 - RNA, 64 nt, Homo Sapiens
caaaacaaaauuagcugagcgcgagacuccaucucaaaacaaaaacuugagccugggcgacaca

SEQ ID NO: 52189 - RNA, 64 nt, Homo Sapiens
gcuauccugacuuaauauccaguugugggguuugcaaaacaaaacagcuguauguaaucauugc

SEQ ID NO: 52190 - RNA, 64 nt, Homo Sapiens
uuaauccagucugggucaugaccuuuucuucauccaaaacaaggugaugggaagacaaaaacaa

SEQ ID NO: 52191 - RNA, 64 nt, Homo Sapiens
ugcuugaagaguuuucuaauucguuucuagugagcaaaacaaagaaggugcuugagucacugaa

SEQ ID NO: 52192 - RNA, 64 nt, Homo Sapiens
uuugcaugcuaugaggcuaaaugguacugauucucaaaacaaggagcucauagucuaaaaccau

SEQ ID NO: 52193 - RNA, 64 nt, Homo Sapiens
acaacaacaaaaaacaaaagcucaaaaaacaaaacaaaacaaaacaacaagaguaaaacuucau

SEQ ID NO: 52194 - RNA, 64 nt, Homo Sapiens
caaaaacaacaacaaaaaacuucaucucaaaaaacaaaacaaaacuggucaacaagaguaaaac

SEQ ID NO: 52195 - RNA, 64 nt, Homo Sapiens
aagcaaaaaacacaaaaaccuauuuucaacaaaacaaaacaaaccuccccauucugugcccuac

SEQ ID NO: 52196 - RNA, 64 nt, Homo Sapiens
caaacaagcaaaaaacacaaccuacuauuuucaacaaaacaaaacuccucuccccauucugugc

SEQ ID NO: 52197 - RNA, 64 nt, Homo Sapiens
aaguuguuuucuagauuuguggcuuuaagaaaaacaaaacaaaacaaacacauuguuuuucuca

SEQ ID NO: 52198 - RNA, 64 nt, Homo Sapiens
guuuucuagauuuguggcuuuaagaaaaacaaaacaaaacaaacacauuguuuuucucagaacc

SEQ ID NO: 52199 - RNA, 64 nt, Homo Sapiens
gggagggggacauagcgagacucggucucaaaaacaaaacaaaacaaaacaaaacaaaacaaaa

SEQ ID NO: 52200 - RNA, 64 nt, Homo Sapiens
ggggacauagcgagacucggucucaaaaacaaaacaaaacaaaacaaaacaaaacaaaaacaaa

SEQ ID NO: 52201 - RNA, 64 nt, Homo Sapiens
cauagcgagacucggucucaaaaacaaaacaaaacaaaacaaaacaaaacaaaaacaaaacaaa

SEQ ID NO: 52202 - RNA, 64 nt, Homo Sapiens
cgagacucggucucaaaaacaaaacaaaacaaaacaaaacaaaacaaaacaaaacaaaacaaaa

SEQ ID NO: 52203 - RNA, 64 nt, Homo Sapiens
cucggucucaaaaacaaaacaaaacaaaacaaaacaaaacaaaacaaaacaaaacaaaacacug

SEQ ID NO: 52204 - RNA, 64 nt, Homo Sapiens
ucucaaaaacaaaacaaaacaaaacaaaacaaaacaaaacaaaacaaaacaaaacacugccaaa

SEQ ID NO: 52205 - RNA, 64 nt, Homo Sapiens
aaaacaaaacaaaacaaaacaaaacaaaacaaaacaaaacaaaacaaaacacugccaaacuguu

SEQ ID NO: 52206 - RNA, 64 nt, Homo Sapiens
aaaacaaaacaaaacaaaacaaaacaaaacaaaacaaaacaaaacacugccaaacuguuuccaa

SEQ ID NO: 52207 - RNA, 64 nt, Homo Sapiens
aaacaagcaaaaaaccacaacagaaaaagcaaaacaaaacaaacaacagagcgagacuccaacu

SEQ ID NO: 52208 - RNA, 64 nt, Homo Sapiens
caaacaaacaagcaaaaaaccaacucagaaaaagcaaaacaaaaugggcaacagagcgagacuc

SEQ ID NO: 52209 - RNA, 64 nt, Homo Sapiens
aaaaaaccggauagaauaauaaacaacaacaaaacaaaacaaaacacagcaaguucuuguuucc

SEQ ID NO: 52210 - RNA, 64 nt, Homo Sapiens
caaaaaaaaaaccggauagauuuccaaacaacaacaaaacaaaaggcgacacagcaaguucuug

SEQ ID NO: 52211 - RNA, 64 nt, Homo Sapiens
ucuggucggcaagagugagacuccgucucaaaaacaaaacaaaacaaaaaaaccacauaacaua

SEQ ID NO: 52212 - RNA, 64 nt, Homo Sapiens
ucggcaagagugagacuccgucucaaaaacaaaacaaaacaaaaaaaccacauaacauaaauuu

SEQ ID NO: 52213 - RNA, 64 nt, Homo Sapiens
augaugugaaauuuuaaauucuaccauguuagagcaaaacaaugaauccuauccccuuucuuuc

SEQ ID NO: 52214 - RNA, 64 nt, Homo Sapiens
ggaaaccauaucauucauauuuagaaguaaaacacaaaacaaaaaagagagagaaaagaaaaga

SEQ ID NO: 52215 - RNA, 64 nt, Homo Sapiens
auauauauauaaauauaaauauauauaaaaacaacaaaacaaaacaaaaaaagaaaaaaaaaca

SEQ ID NO: 52216 - RNA, 64 nt, Homo Sapiens
uauauaaauauaaauauauauaaaaacaacaaaacaaaacaaaaaaagaaaaaaaaacaaaaaa

SEQ ID NO: 52217 - RNA, 64 nt, Homo Sapiens
ucaugacugagccaaucacuguuucucagaaaaacaaaacaaaacaaaacaaaugacaguaacc

SEQ ID NO: 52218 - RNA, 64 nt, Homo Sapiens
acugagccaaucacuguuucucagaaaaacaaaacaaaacaaaacaaaugacaguaacccuucc

SEQ ID NO: 52219 - RNA, 64 nt, Homo Sapiens
gccaaucacuguuucucagaaaaacaaaacaaaacaaaacaaaugacaguaacccuuccccgga

SEQ ID NO: 52220 - RNA, 64 nt, Homo Sapiens
gccugggugacagagcaagacucugucuaaaaaacaaaacaaaacaaaacaaaacaaaaaaacc

SEQ ID NO: 52221 - RNA, 64 nt, Homo Sapiens
ggugacagagcaagacucugucuaaaaaacaaaacaaaacaaaacaaaacaaaaaaaccucuua

SEQ ID NO: 52222 - RNA, 64 nt, Homo Sapiens
cagagcaagacucugucuaaaaaacaaaacaaaacaaaacaaaacaaaaaaaccucuuaauauu

SEQ ID NO: 52223 - RNA, 64 nt, Homo Sapiens
caagacucugucuaaaaaacaaaacaaaacaaaacaaaacaaaaaaaccucuuaauauucugga

SEQ ID NO: 52224 - RNA, 64 nt, Homo Sapiens
acugaagcaugaagauuccuaaggcaagaaacagcaaaacaaauacaguaugcaugaagacaug

SEQ ID NO: 52225 - RNA, 64 nt, Homo Sapiens
uaaauuugucuguuuucaacaaagacauaacuaucaaaacaaaauauucuucuaauacauauua

SEQ ID NO: 52226 - RNA, 64 nt, Homo Sapiens
cagcuuuaaaaaaauaauuguauuucacaugagucaaaacaaagauaagaauguaggccuuaac

SEQ ID NO: 52227 - RNA, 64 nt, Homo Sapiens
aaacaaacaaaacuugcaucaaaacaaaacaaaacaaaacaaaccaaaaacgaaacuccaucuc

SEQ ID NO: 52228 - RNA, 64 nt, Homo Sapiens
caaacaaacaaacaaaacuuaucucaaaacaaaacaaaacaaaaggcgacaaaaacgaaacucc

SEQ ID NO: 52229 - RNA, 64 nt, Homo Sapiens
caaaacaaacaaacaaacaaacuccaucucaaaacaaaacaaaagccugggcgacaaaaacgaa

SEQ ID NO: 52230 - RNA, 64 nt, Homo Sapiens
caaaacaaaacaaacaaacaacgaaacuccaucucaaaacaaaacuccagccugggcgacaaaa

SEQ ID NO: 52231 - RNA, 64 nt, Homo Sapiens
uuaacugcuuaaauguuuugcaaacaaaacaaaacaaaacaaaaccacaauuguucuucaaaaa

SEQ ID NO: 52232 - RNA, 64 nt, Homo Sapiens
caaaauuaacugcuuaaaugaaaaacaaacaaaacaaaacaaaaaaagaccacaauuguucuuc

SEQ ID NO: 52233 - RNA, 64 nt, Homo Sapiens
caaaacaaaauuaacugcuuucuucaaaaacaaacaaaacaaaaauguaaaagaccacaauugu

SEQ ID NO: 52234 - RNA, 64 nt, Homo Sapiens
guggguggcucacggguccgacuccgucucaaaacaaaacaaaaagccuggaggccagagugag

SEQ ID NO: 52235 - RNA, 64 nt, Homo Sapiens
caaaaguggguggcucacgggugagacuccgucucaaaacaaaaacuccagccuggaggccaga

SEQ ID NO: 52236 - RNA, 64 nt, Homo Sapiens
ucaaaugaggacugugggacccagauuugaagacccaauaaaaauacucaacuuuuuaaaaaag

SEQ ID NO: 52237 - RNA, 64 nt, Homo Sapiens
ggaggacaaauaauuggauugucugauaagucugccaauaaacuauccagaaauagcaagugua

SEQ ID NO: 52238 - RNA, 64 nt, Homo Sapiens
cacuugggaguuauuuacuguguuccucuggcagccaauaaaaucaucauaagcccuuuguaau

SEQ ID NO: 52239 - RNA, 64 nt, Homo Sapiens
aguucuguaugcuucuauuccaaaucauucauuaccaauaaaaacgaaauaccacccuuuccau

SEQ ID NO: 52240 - RNA, 64 nt, Homo Sapiens
ucccucguuuccguauacucaguacaauauguaaccaauaaagcaugcucucuguuggcucugc

SEQ ID NO: 52241 - RNA, 64 nt, Homo Sapiens
aauggggacccagaggcuggagugcuaccacuucccaauaaagguauuuagugggucagugcca

SEQ ID NO: 52242 - RNA, 64 nt, Homo Sapiens
auuuuugaaaggcauguuccuaagaaaguuucacccaauaaaauaccaaaaguuuuccugagaa

SEQ ID NO: 52243 - RNA, 64 nt, Homo Sapiens
guuagaaugaaaacucauuauuggcccggaaaggccaauaaagaaggaccagagaauucuuaga

SEQ ID NO: 52244 - RNA, 64 nt, Homo Sapiens
gucacaaguaauaacugcuguaaauugucauacgccaauaaaauugaugcaacagggacccuug

SEQ ID NO: 52245 - RNA, 64 nt, Homo Sapiens
uuuuggcaggaagcuuguuguuuuucaaaugucaccaauaaaagauaguauuuuaaaaaaauug

SEQ ID NO: 52246 - RNA, 64 nt, Homo Sapiens
gaauuuacaugauagguuaaaguaaacagguguaccaauaaaaaaauagcaaucaaucauaauu

SEQ ID NO: 52247 - RNA, 64 nt, Homo Sapiens
agagaagaaaaaagagaaacuaccaucucccccgccaauaaaaaugauaaauaacaaguuauag

SEQ ID NO: 52248 - RNA, 64 nt, Homo Sapiens
auaauaaaaagacaaagcacucacauugguaggaccaauaaagacagugggccuggguaaagag

SEQ ID NO: 52249 - RNA, 64 nt, Homo Sapiens
uccaaauuggaauuguuuuguuuauacaacuguaccaauaaaaugcaugacugauuaacagaau

SEQ ID NO: 52250 - RNA, 64 nt, Homo Sapiens
aaacauaaugugaucaugcucuaacuucaauauaccaauaaaauaaucagcuugcaauuucuga

SEQ ID NO: 52251 - RNA, 64 nt, Homo Sapiens
aauuuugaacuaacaguaauaacuucuugaaaauccaauaaaauuggcaaaagauugugaaaau

SEQ ID NO: 52252 - RNA, 64 nt, Homo Sapiens
uagaguauacauguacaaaauauuuuaauauagcccaauaaaccgcauaagcaguaaauuuuuu

SEQ ID NO: 52253 - RNA, 64 nt, Homo Sapiens
uuaacugcuacuuugaaaaugcauauaguaauacccaauaaauaaacacuuagaacaguuccug

SEQ ID NO: 52254 - RNA, 64 nt, Homo Sapiens
guaccucaauacauguucuucuuacguucuuauaccaauaaaagaugacaugguuaaucuggaa

SEQ ID NO: 52255 - RNA, 64 nt, Homo Sapiens
cccauagggaagagagagagagggacuucagagaccaauaaaagagcuggcacugaagaucucc

SEQ ID NO: 52256 - RNA, 64 nt, Homo Sapiens
guaaaacuaaaaugaaaaaaguaggccuucugacauuguguacuuggugguucugucccucugc

SEQ ID NO: 52257 - RNA, 64 nt, Homo Sapiens
ugcgucugauuauugcuuuuuuaauuuuaugaaaauuguguaaaauuacauuuuuuuuccaggg

SEQ ID NO: 52258 - RNA, 64 nt, Homo Sapiens
uauuuguaaucaaauguguagugauuacacuugaauuguguacuuaguguguaugugauccucc

SEQ ID NO: 52259 - RNA, 64 nt, Homo Sapiens
caccgggauuuaucagaacaggauuaguagcuguauuguguaaugcauuguucucaguuucccu

SEQ ID NO: 52260 - RNA, 64 nt, Homo Sapiens
uaagaaaaguguuuucacaaaaucauaucuuuuaauuguguauuuucacauccuguaagugcuu

SEQ ID NO: 52261 - RNA, 64 nt, Homo Sapiens
accuuuaaauauuucacaucuugguaacccgauuauuguguauuaaaaauuggaaggcguccuu

SEQ ID NO: 52262 - RNA, 64 nt, Homo Sapiens
gccgcuuugugcuacaguagucacccuuuuaaauauuguguauguuauuggggcacacccaugc

SEQ ID NO: 52263 - RNA, 64 nt, Homo Sapiens
uauguuuaucaauuuguucuugcucagugagcaaauuguguauuugcucuugugcaauauuuua

SEQ ID NO: 52264 - RNA, 64 nt, Homo Sapiens
uaccucaaguucaaguuaauaagguuguguguguauuguguauauuaugaaaaguauuuugcuu

SEQ ID NO: 52265 - RNA, 64 nt, Homo Sapiens
cuaugguaaguacaaagggaaauccucucaggacauuguguagcuugacauuuuucucauaaug

SEQ ID NO: 52266 - RNA, 64 nt, Homo Sapiens
aacuacuaaaaaaaccaacugcuuuuuaaauccuauuguguaguuaaagugucaugccuugacc

SEQ ID NO: 52267 - RNA, 64 nt, Homo Sapiens
ugucuuugacuagagcuugaaaccuuguuaucugauuguguaccacuccaaauucccugccuuc

SEQ ID NO: 52268 - RNA, 64 nt, Homo Sapiens
agagccuauauaguuguuuugaaaauuaagaaagauuguguaugguaaucauuucuuacaaggu

SEQ ID NO: 52269 - RNA, 64 nt, Homo Sapiens
uuucaguaacagcuuuccauugaaaaaaaguuagauuguguauuuauaaaagaaaaagccaaag

SEQ ID NO: 52270 - RNA, 64 nt, Homo Sapiens
aaauaauagacauuuuuucuugguggucagaauuauuguguaauccgcccccgccguugguugu

SEQ ID NO: 52271 - RNA, 64 nt, Homo Sapiens
uaauuuuuaauuuuuuugugauuuaauguauccuauuguguaauacauacaaaaagcugcacau

SEQ ID NO: 52272 - RNA, 64 nt, Homo Sapiens
guacaauauuagagaaaggacagguguagcuacaauuguguaaucauugaaacucacuucuuuu

SEQ ID NO: 52273 - RNA, 64 nt, Homo Sapiens
uaacaggugguuuuuuauuacaucaauaaucauaauuguguauuacaagauuuaauugaaagga

SEQ ID NO: 52274 - RNA, 64 nt, Homo Sapiens
ugagucauuguuaaugggagaaaauugauuugugauuguguauaaucacauauuuagcaugaga

SEQ ID NO: 52275 - RNA, 64 nt, Homo Sapiens
uaauauuuucaauuaugaaauauuguuguuuguuauuguguagguucaguaaaaagcuacuaua

SEQ ID NO: 52276 - RNA, 64 nt, Homo Sapiens
cucuagucgcucagcauccacuuugugucuccaaauuguguaggacucuguaaucuuuugauua

SEQ ID NO: 52277 - RNA, 64 nt, Homo Sapiens
ucaacaaaucccauaaguauguguuaauauuuuaauuguguaaaacucauuuguuacuuuacag

SEQ ID NO: 52278 - RNA, 64 nt, Homo Sapiens
cccuucuuuggcuuuccuugguugcuuauugaauauuguguaaauugcacacugaacagauacu

SEQ ID NO: 52279 - RNA, 64 nt, Homo Sapiens
augaucauguauuuauaaauucuagaagaucuguauuguguagaguaauauccuuuagaaaugc

SEQ ID NO: 52280 - RNA, 64 nt, Homo Sapiens
uguuaaauguccaguuuugccgacacuuuuaaaaauuguguaauguauauaguugagaauuuua

SEQ ID NO: 52281 - RNA, 64 nt, Homo Sapiens
gcacuguaaggugaaaauuauuuuuucucaacuaauuguguacuauauauaucuuauguuuauu

SEQ ID NO: 52282 - RNA, 64 nt, Homo Sapiens
cucaucuugcacauucgggaacccuggagguggcauuguguaacgucauuucauccucauggcc

SEQ ID NO: 52283 - RNA, 64 nt, Homo Sapiens
ggucucuggugcucaaaguuggcuaaugggucacauuguguaaacacugaaaguggaagcagaa

SEQ ID NO: 52284 - RNA, 64 nt, Homo Sapiens
uguuuauuauagagcuaauauuuauugaauaguuauuguguaccaagcauugugcuaaauacuu

SEQ ID NO: 52285 - RNA, 64 nt, Homo Sapiens
guacaaaauuacauuauugauaguuaagcucuuaauuguguagcuugcaaaagacagcacuuuu

SEQ ID NO: 52286 - RNA, 64 nt, Homo Sapiens
uccaccuuuaaaaguugugccaagucauaaucauauuguguauaacuuggaaauggugcuguuu

SEQ ID NO: 52287 - RNA, 64 nt, Homo Sapiens
uguguauaacuuggaaauggugcuguuuaaaaaaauuguguauuuauacaguaacaguaugaau

SEQ ID NO: 52288 - RNA, 64 nt, Homo Sapiens
acuucugggaaagaucuccugauguuugggaaguauuguguaguggugaacuugggagcaauga

SEQ ID NO: 52289 - RNA, 64 nt, Homo Sapiens
uguuugggcacggucuauguauccuugauuuuucauuguguaucuaaugaaaggcccuuuugau

SEQ ID NO: 52290 - RNA, 64 nt, Homo Sapiens
aaaaguacuaaauaaauuaauuugcucucaucguauuguguauauucaccuaaugcccauugug

SEQ ID NO: 52291 - RNA, 64 nt, Homo Sapiens
cucucaucguauuguguauauucaccuaaugcccauuguguauugauauugcauucuugaauuu

SEQ ID NO: 52292 - RNA, 64 nt, Homo Sapiens
gcuguuuuuuaagaaaaaauuuuugguaaacaguauuguguaaaauugcuuuuuguauaccaau

SEQ ID NO: 52293 - RNA, 64 nt, Homo Sapiens
uauauaauauaaacaguauguguuuuuauauaucauuguguaaauuuaauauaacauaugcagu

SEQ ID NO: 52294 - RNA, 64 nt, Homo Sapiens
gacuuaauuaugcacaugcuugaaauacauguauauuguguaugagauagcagaugucuuuaaa

SEQ ID NO: 52295 - RNA, 64 nt, Homo Sapiens
uuacuacaaagacaaccccauguauucaaaauucauuguguauaaaagacuguuacuuuauuau

SEQ ID NO: 52296 - RNA, 64 nt, Homo Sapiens
ucucucagcagauauuucuuugguacuaccauguauuguguaacuuuugggaaaguaagguggc

SEQ ID NO: 52297 - RNA, 64 nt, Homo Sapiens
gugcauauaguauauuacuaauaguaugcuguuaauuguguaagaaagaaaggaaauuagaaaa

SEQ ID NO: 52298 - RNA, 64 nt, Homo Sapiens
cucuugggcauuauacaacauaaaaugccauuuuauuguguaaggcucaaaauagaaauuaggu

SEQ ID NO: 52299 - RNA, 64 nt, Homo Sapiens
uguguguguauguguguguguuucaaauguaaauauuguguauugccaucucacaaaauaagaa

SEQ ID NO: 52300 - RNA, 64 nt, Homo Sapiens
uauacagcacuuaaaagcagugaaccagauccauauuguguaacauggauaguuaaaacaaugu

SEQ ID NO: 52301 - RNA, 64 nt, Homo Sapiens
uguugaaugaaaaaaaucaaaauacaaaugaaacauuguguaauaauauuuauguaaauuggaa

SEQ ID NO: 52302 - RNA, 64 nt, Homo Sapiens
ucugugauucuuccaggggcgagacaugguggaaauuguguagcgugugguguuaaguuucguu

SEQ ID NO: 52303 - RNA, 64 nt, Homo Sapiens
auucugugguuuggugggucugugguccagcugcauuguguaggggguugugagucugggauag

SEQ ID NO: 52304 - RNA, 64 nt, Homo Sapiens
auuuuucuuuccaagauaaaauuuugaaacuuaaauuguguauuguguaauuaauuugauagug

SEQ ID NO: 52305 - RNA, 64 nt, Homo Sapiens
uuuccaagauaaaauuuugaaacuuaaauuguguauuguguaauuaauuugauaguguacccuc

SEQ ID NO: 52306 - RNA, 64 nt, Homo Sapiens
cuugaucauccagagaacauugacagacaauuaugaauaauaaagauguuaacaauccaucugu

SEQ ID NO: 52307 - RNA, 64 nt, Homo Sapiens
ucucuaaaauacauaaguaaauuuaaaaaaaaaagaauaauaauuugaacagugaauguugaug

SEQ ID NO: 52308 - RNA, 64 nt, Homo Sapiens
caguauauguauaauaucauuaggucauaaacaugaauaauacugcccucccaugaagaauuuc

SEQ ID NO: 52309 - RNA, 64 nt, Homo Sapiens
accagaggaaaugcauacaguauuuucuuaauuugaauaauaaaguuaccaaaaaauuuuuaag

SEQ ID NO: 52310 - RNA, 64 nt, Homo Sapiens
uauuuugcacccacugaaaggaaagugcuuuccagaauaauaugaaguaucuaaaagugucacc

SEQ ID NO: 52311 - RNA, 64 nt, Homo Sapiens
auacacuuggggagauuugccacaucuuaaacuugaauaauaguaugaguaaugcuuaagggag

SEQ ID NO: 52312 - RNA, 64 nt, Homo Sapiens
aggugaagacuucauagaagauucucagccuguggaauaauagcgaccauuucuuucagaagua

SEQ ID NO: 52313 - RNA, 64 nt, Homo Sapiens
uagcauauaauugucuacagcucacuguuauguugaauaauaaugcaguauugucacuuuugcu

SEQ ID NO: 52314 - RNA, 64 nt, Homo Sapiens
aacagugucccaucuacugaauagaaaacuuugagaauaauauauauauauauuuuaaauguuu

SEQ ID NO: 52315 - RNA, 64 nt, Homo Sapiens
ucuauacccucuuccuucuuucugcaaggcagaggaauaauauuuuuaaagguuauuuuguuuu

SEQ ID NO: 52316 - RNA, 64 nt, Homo Sapiens
ugguuuugccagacagcaggucagcauguaaggugaauaauaacggaacucuccucuuaccaca

SEQ ID NO: 52317 - RNA, 64 nt, Homo Sapiens
uaggugugauauaguguuagggaucuaagcuuaggaauaauauuuauaaggaucucugcaaaca

SEQ ID NO: 52318 - RNA, 64 nt, Homo Sapiens
guggugugugaaguuuggagauagauggauaagggaauaauaggccacagaaggugaacuuugu

SEQ ID NO: 52319 - RNA, 64 nt, Homo Sapiens
auuuugcuaucuuuuuuaguguuaaagagauaaagaauaauaauuaaccaaccuuguuuaauag

SEQ ID NO: 52320 - RNA, 64 nt, Homo Sapiens
uaagcuaggacuucuacuuucuguguuuaauuaugaauaauaugugccagaauaauaaaaugaa

SEQ ID NO: 52321 - RNA, 64 nt, Homo Sapiens
augaacuguguuuaauuaugaucacuaguugccagaauaauaaaaaggccuauaaucaugaaau

SEQ ID NO: 52322 - RNA, 64 nt, Homo Sapiens
accaggucccucuuuucugucaaggacuuucugggaauaauacuggggguuuuguuuuuguuuu

SEQ ID NO: 52323 - RNA, 64 nt, Homo Sapiens
gugacuuguuauccuacuauauuuucuaaggagugaauaauauuguccgaguaacuaacuuauu

SEQ ID NO: 52324 - RNA, 64 nt, Homo Sapiens
aaguacaaugagccuuacuguauuuaguguggcagaauaauaacaucaguggcaggccacugau

SEQ ID NO: 52325 - RNA, 64 nt, Homo Sapiens
acugagaguuugguaaaagaauauuuucuucucugaauaauaauuauuuucacagugaaaauuu

SEQ ID NO: 52326 - RNA, 64 nt, Homo Sapiens
ugaugaugaaaauuauuuccugggaacucaguaggaauaauaccguauuaaggaauaauacugu

SEQ ID NO: 52327 - RNA, 64 nt, Homo Sapiens
ccugggaacucaguaggaauaauaccguauuaaggaauaauacuguacauaaaacaucaugaaa

SEQ ID NO: 52328 - RNA, 64 nt, Homo Sapiens
guuguuaaagaggcuguuuauauauaaaucaguugaauaauaauuugacuacuaaaaagcaaau

SEQ ID NO: 52329 - RNA, 64 nt, Homo Sapiens
uacuaucagcugauuacuagccaauauaggaguagaauaauaucgauuucugcuauuuugcauc

SEQ ID NO: 52330 - RNA, 64 nt, Homo Sapiens
aguucagcagugugugcacagcuuucuuuugguuggcagagauucaggaucauggaguacugcu

SEQ ID NO: 52331 - RNA, 64 nt, Homo Sapiens
uacugcucucauaauugaagacguguuuguuauuggcagagaaccuuaaaaaaggccuuuaccu

SEQ ID NO: 52332 - RNA, 64 nt, Homo Sapiens
uugcugcccaggcccagggguggccucuguccuuggcagagaccuuuccaagcugguccaucac

SEQ ID NO: 52333 - RNA, 64 nt, Homo Sapiens
aggagggaggcugucaggaugaacagcaagucagggcagagaggagaugccagcacugacucag

SEQ ID NO: 52334 - RNA, 64 nt, Homo Sapiens
gggagggcuggcucaggcaucgucucccgcaaugggcagagagagcagagacagguggaccaac

SEQ ID NO: 52335 - RNA, 64 nt, Homo Sapiens
cauucuacccccagcuucacucagcacuggagcuggcagagacgcaaaacccagucugcccuug

SEQ ID NO: 52336 - RNA, 64 nt, Homo Sapiens
ugcagugggugcggggggauaggcaggcacccugggcagagagaguggcgcggggcauccuaug

SEQ ID NO: 52337 - RNA, 63 nt, Homo Sapiens
cucuguggcgcggggcauccggcgggcgcccugggcagagagauggacgaggaccagcuguga

SEQ ID NO: 52338 - RNA, 64 nt, Homo Sapiens
cacuagaagaccuucauccugccaacacggagagggcagagaugggcccauucaugccaaccuu

SEQ ID NO: 52339 - RNA, 64 nt, Homo Sapiens
ucagauggcccuuuuaagggacaaugggacguuaggcagagagcccaaaacggaaucuauguag

SEQ ID NO: 52340 - RNA, 64 nt, Homo Sapiens
gacuggacuugggaucagcauggcagagagccagggcagagagaauaucuguaugucaccagga

SEQ ID NO: 52341 - RNA, 64 nt, Homo Sapiens
cagggcagagagagacuggauaugucaccaggauggcagagagcgacaaugucccccauaucug

SEQ ID NO: 52342 - RNA, 64 nt, Homo Sapiens
cuuccagaugauaaaccccagaggcugaggcugaggcagagaauaggguaagcuguuguucccu

SEQ ID NO: 52343 - RNA, 64 nt, Homo Sapiens
agacuuaaggaaaccuguaauacagggcagcacuggcagagagcccuggcuccucuuacugaga

SEQ ID NO: 52344 - RNA, 64 nt, Homo Sapiens
cuccuugccaaaucuaaauaguuuauauagggauggcagagaguucccaucucaucugucagcc

SEQ ID NO: 52345 - RNA, 64 nt, Homo Sapiens
ugcaugauacaaggagagguugucaucuggguagggcagagaggagggcuugcucaucugaaca

SEQ ID NO: 52346 - RNA, 64 nt, Homo Sapiens
ugguaaaagaggguugcauuucuugcagccagaaggcagagaaagugaagaccaaguccagaac

SEQ ID NO: 52347 - RNA, 64 nt, Homo Sapiens
ggaagggaacuggagcuggccagggcagggcuggggcagagaaaccuggacaccgccaugagca

SEQ ID NO: 52348 - RNA, 64 nt, Homo Sapiens
agcucauugggucacuggugucacacagacccgaggcagagaacguggcccaggagccauggcc

SEQ ID NO: 52349 - RNA, 64 nt, Homo Sapiens
gaguuaagucauagguggccguccuccacucagaggcagagacuaguggacuguggcagagaaa

SEQ ID NO: 52350 - RNA, 64 nt, Homo Sapiens
guccuccacucagaggcagaagccaguggacuguggcagagaaaucucuuuugucaggaaacuc

SEQ ID NO: 52351 - RNA, 64 nt, Homo Sapiens
aagugaggucccucccaaaguuguuuucgugugaggcagagaaagccacacucugaauacauuu

SEQ ID NO: 52352 - RNA, 64 nt, Homo Sapiens
uuauuuugggacuucaguucucgugguccauaggggcagagaugucaaagugaagguugccuga

SEQ ID NO: 52353 - RNA, 64 nt, Homo Sapiens
gggguccuguccugcaggaugcugcauaggaaugggcagagauguccuggaugggaacaugguc

SEQ ID NO: 52354 - RNA, 64 nt, Homo Sapiens
cagaccagugaggggugauucagagguggggaugggcagagagggcuggccacucugccucagg

SEQ ID NO: 52355 - RNA, 64 nt, Homo Sapiens
gaguaauuguaaccgaggucagagcucugggguuggcagagaugaguggccauaucugggggua

SEQ ID NO: 52356 - RNA, 64 nt, Homo Sapiens
accuccucgggcuucauuuucucuauuuagagauggcagagagugagguaguggcgagaaagcu

SEQ ID NO: 52357 - RNA, 64 nt, Homo Sapiens
ccaggccuucugacugucagcaccaccggcacagggcagagaugcggguggcccaaggaccacg

SEQ ID NO: 52358 - RNA, 64 nt, Homo Sapiens
guggggggacagcaaggucccuuguuauaagaggggcagagaggacaacuccgcuuuggccaac

SEQ ID NO: 52359 - RNA, 64 nt, Homo Sapiens
cucagaacccacagugagaggggagggcuccuggggcagagaaguuccuuagguuuucuuugga

SEQ ID NO: 52360 - RNA, 64 nt, Homo Sapiens
auaucuuauauugggcgauuugggggcucggggaggcagagaaucucuugggagucuugggugg

SEQ ID NO: 52361 - RNA, 59 nt, Homo Sapiens
gcugcugcuccuucaugugaaucccagggggcagagaggaggcucuggaggcacacagg

SEQ ID NO: 52362 - RNA, 64 nt, Homo Sapiens
uaagagauauggagaugggagggggaggacaaggggcagagaguagggucuagcuggcuaucuc

SEQ ID NO: 52363 - RNA, 64 nt, Homo Sapiens
cagagagggagagagggacacagagagggagagaggcagagagagaggcagagagggagagagg

SEQ ID NO: 52364 - RNA, 64 nt, Homo Sapiens
gagagaggcagagagacagacagagagggagagaggcagagaggcaggcagagaaggagagagg

SEQ ID NO: 52365 - RNA, 64 nt, Homo Sapiens
gagagaggcagagagggagacagagaaggagagaggcagagaggcagagaaggaaagagacagg

SEQ ID NO: 52366 - RNA, 64 nt, Homo Sapiens
gagagaggcagagagggagagaaggaaagagacaggcagagaagcagagagggaaagaggcaga

SEQ ID NO: 52367 - RNA, 64 nt, Homo Sapiens
gaaagagacaggcagagaagcagagagggaaagaggcagagaaggagacagaggggaagagagg

SEQ ID NO: 52368 - RNA, 64 nt, Homo Sapiens
gaaagaggcagagaaggaaacagaggggaagagaggcagagagggagacagagggagagagaga

SEQ ID NO: 52369 - RNA, 64 nt, Homo Sapiens
gagagaaacagaggagacagagagagacagaggaggcagagaggggggagagagauaugaggag

SEQ ID NO: 52370 - RNA, 64 nt, Homo Sapiens
uguugcuaggugaauauauaagagcaggagagacggcagagauaucggcuaugucuucauuaug

SEQ ID NO: 52371 - RNA, 64 nt, Homo Sapiens
cggcuaugucuucauuaugacagcaaggggcccgggcagagaauacgcagacccggaggagcau

SEQ ID NO: 52372 - RNA, 64 nt, Homo Sapiens
gcgaguuugcugggagcugggagcaggcuugccuggcagagaaccuguucagauacaggccagu

SEQ ID NO: 52373 - RNA, 64 nt, Homo Sapiens
gccuuuauuucccuggcaggcagccuugccagaaggcagagaggcaguucugaaucauucucuc

SEQ ID NO: 52374 - RNA, 64 nt, Homo Sapiens
cuggggucgcuugugcgggcgggagggcaaugguggcagagacaugcugguggccccggcggag

SEQ ID NO: 52375 - RNA, 64 nt, Homo Sapiens
guuucuuuugaaagcaaguguagacaccuucgagggcagagaucgggagauuuaagauguuaca

SEQ ID NO: 52376 - RNA, 64 nt, Homo Sapiens
acacaggugugauccuccuugagcauugaggaggcacauggagaacuaaaucuuuuguaguagc

SEQ ID NO: 52377 - RNA, 64 nt, Homo Sapiens
uuuuuucaacaauuucaacaaugacacaaaaauucacauggaaauggggaagauggucuguuuu

SEQ ID NO: 52378 - RNA, 64 nt, Homo Sapiens
gguuuuuuuuauacuaaaaaguuuuuuuuaaaaucacauggaacuucuaucuagauguguaagu

SEQ ID NO: 52379 - RNA, 64 nt, Homo Sapiens
cuuauagacagacuuauugguuaauaaacuguugcacauggauagcaguacauguaagcagcca

SEQ ID NO: 52380 - RNA, 64 nt, Homo Sapiens
cuugccaugccugugugcccaguugggucacugccacauggagucuggacauuggacauugcua

SEQ ID NO: 52381 - RNA, 64 nt, Homo Sapiens
cacugucaugcaggucauauugucuggacacugccacauggagcugccacaucugggcauacag

SEQ ID NO: 52382 - RNA, 64 nt, Homo Sapiens
ucuuccauuucguuuagcuguuggguuuguuggucacauggagcgccuguuguuuuggcucaau

SEQ ID NO: 52383 - RNA, 64 nt, Homo Sapiens
cuacauguguuugaacuauuacugucucucuugucacauggaauuaaagccucaaaucuuccuu

SEQ ID NO: 52384 - RNA, 64 nt, Homo Sapiens
cauauuuuuggaagcaaaacgacaacaccacgaccacauggaaacuuuggcccuaauagcacug

SEQ ID NO: 52385 - RNA, 64 nt, Homo Sapiens
uugaggccauagucuuuaaaauacacuuguuucacacauggacgaagacuuaaagaauuuucua

SEQ ID NO: 52386 - RNA, 64 nt, Homo Sapiens
acacuuguguuggcugugccuuuuacuguccucacacauggaagcguccuagaaagccugguca

SEQ ID NO: 52387 - RNA, 64 nt, Homo Sapiens
gauuaaaagcaaauaccuguucuaguaaagcuugcacauggauuaaguaacuccccuuaaaaug

SEQ ID NO: 52388 - RNA, 64 nt, Homo Sapiens
uuuuacagacacugggcuaaaaaggguauucagacacauggacacacauuccuagaaugucauc

SEQ ID NO: 52389 - RNA, 64 nt, Homo Sapiens
aaugugaugcaauaaaauuuaaaauaaauuucugcacauggaauauuuucagcuggcucuucug

SEQ ID NO: 52390 - RNA, 64 nt, Homo Sapiens
gccuucauugcuggagacaguagaggcaugaacacacauggaugcacacacacacacgccaaug

SEQ ID NO: 52391 - RNA, 64 nt, Homo Sapiens
gagauaugcacacacagaugcacacacagauauacacauggaugcacgcacaugccaaugcacg

SEQ ID NO: 52392 - RNA, 64 nt, Homo Sapiens
cacacaccgaugugcgcacacacagauaugcacacacauggaugagcacacacacaccaaugcg

SEQ ID NO: 52393 - RNA, 64 nt, Homo Sapiens
uauugaaaguagaauaaaaauuguuuuauccacaacuuuucaaguucaguuuuuaacauaauuu

SEQ ID NO: 52394 - RNA, 64 nt, Homo Sapiens
uuuuaacauaauuuuuguuuacugagcccagccuacuuuucaguuaagauuacaggcgugagcc

SEQ ID NO: 52395 - RNA, 64 nt, Homo Sapiens
uuuguuuuguuuuuugagacguauuuaguugauuacuuuucaguuagaauauuauaguuuaaaa

SEQ ID NO: 52396 - RNA, 64 nt, Homo Sapiens
aucacacagcuaauaaguggcagagagguuagggacuuuucaugcaguggggaaaacugaggca

SEQ ID NO: 52397 - RNA, 64 nt, Homo Sapiens
gcagugggauggugacuucuccggucaaguucugacuuuucaggacaggugugagcgaccacau

SEQ ID NO: 52398 - RNA, 64 nt, Homo Sapiens
ccugauaauauugcuugauuuuuccuaucaaguuacuuuucaauccauucagaaucugccccag

SEQ ID NO: 52399 - RNA, 64 nt, Homo Sapiens
guuaccuucaauuguauguuacauaugauuagucacuuuucauacacuauaaccucugauuuuu

SEQ ID NO: 52400 - RNA, 64 nt, Homo Sapiens
uggguucucaguagugaauugagacuuggaggugacuuuucauguuuggaguaucaucucuguc

SEQ ID NO: 52401 - RNA, 64 nt, Homo Sapiens
uuaaaaccuagaguagugcuuaugcugaaaugauacuuuucauuuuuugguugauuuuuuugcc

SEQ ID NO: 52402 - RNA, 64 nt, Homo Sapiens
cggaagggcuguggccaccucguuucgcccaucuacuuuucaccuugccguaucugauucuuca

SEQ ID NO: 52403 - RNA, 64 nt, Homo Sapiens
ucugugucuuacacagaaacuuaaaauauuucaaacuuuucauuauauguguuuuggugauuag

SEQ ID NO: 52404 - RNA, 64 nt, Homo Sapiens
cuggguggggaacagcauuggacauuaauagggcacuuuucagacccauuuuuuaaagugcuag

SEQ ID NO: 52405 - RNA, 64 nt, Homo Sapiens
aacaaccauuugaaaaauuuuugucaccagcaaaacuuuucacuaauuagugauaugaaaugug

SEQ ID NO: 52406 - RNA, 64 nt, Homo Sapiens
cugguaauguuugugguuauaucauuuacacaaaacuuuucaggaacuucuguguuguuuaagc

SEQ ID NO: 52407 - RNA, 64 nt, Homo Sapiens
uauuaauauuuaguaauuuugaaggaaaguccuuacuuuucacacauaaagcaauaaucccuca

SEQ ID NO: 52408 - RNA, 64 nt, Homo Sapiens
agucuguauuacuaauggauuuuuuugcagcauaacuuuucauguuaucagaggagguucagca

SEQ ID NO: 52409 - RNA, 64 nt, Homo Sapiens
aaaaaugaacaaucguuugugguuucuugggaaaacuuuucauaccaggugauacuauucaaaa

SEQ ID NO: 52410 - RNA, 64 nt, Homo Sapiens
aacuuuuuucuuuuuuuucagcugaagucuuaugacuuuucaugagucaaaauuguuuggauuu

SEQ ID NO: 52411 - RNA, 64 nt, Homo Sapiens
guacagaagaauuuuuuuuuuaagauaugugagaacuuuucauagaugaacuuuuuaacaaaug

SEQ ID NO: 52412 - RNA, 64 nt, Homo Sapiens
uacuugagagugggggagaauggcaugguaggcuacuuuucagggccuugacaaguacaucacc

SEQ ID NO: 52413 - RNA, 64 nt, Homo Sapiens
uggucuuuugcauugcuaaugugacauguacccaacuuuucauuaauuuguauuuccauuuuua

SEQ ID NO: 52414 - RNA, 64 nt, Homo Sapiens
uaccugaggcaauucuuauuagagcuuacucaggacuuuucaaacaucaggacacacauagcaa

SEQ ID NO: 52415 - RNA, 64 nt, Homo Sapiens
aauguuguaguaaaauuuaauuuuuccuuuuguuacuuuucauuugccucuaauuuugcuugcu

SEQ ID NO: 52416 - RNA, 64 nt, Homo Sapiens
cuaaaauauuuuauuucuagcauccugauucuggacuuuucauuauaauucugagcaggaaauu

SEQ ID NO: 52417 - RNA, 64 nt, Homo Sapiens
auuuuacuauagggguuuugcuuuuucuagagauacuuuucauuuaacagcuuuuguuaagugu

SEQ ID NO: 52418 - RNA, 64 nt, Homo Sapiens
caaauccagugauaucuaagcucacaagauacccacuuuucaggaugggacaguaucagaugaa

SEQ ID NO: 52419 - RNA, 64 nt, Homo Sapiens
aauguagaaacaaacauuuuuaaauagcugcuguacuuuucacauuuugauuuauuagguacua

SEQ ID NO: 52420 - RNA, 64 nt, Homo Sapiens
aaagaaaugcaaaauuaaauguuauacaugauaaacuuuucaugcaucuuauccaauuuuauug

SEQ ID NO: 52421 - RNA, 64 nt, Homo Sapiens
cuuucuguugauucaccuaaaugucacuguuaacacuuuucacuaaaaucauguaaccauuuaa

SEQ ID NO: 52422 - RNA, 64 nt, Homo Sapiens
cagauuuugugaauaugaacgccaaguuguguuuacuuuucauuuguuacccugcgucagaaau

SEQ ID NO: 52423 - RNA, 64 nt, Homo Sapiens
ggccaaggcgggcaaaucacccuguaaucccagcacuuuucagagcugggcgcgguugcucacg

SEQ ID NO: 52424 - RNA, 64 nt, Homo Sapiens
aguaguggaagguuucacuaauacaugauauuugacuuuucauacuaguugaucuggaugaguu

SEQ ID NO: 52425 - RNA, 64 nt, Homo Sapiens
aguaguggaagguuucacuaauaaaugguauuugacuuuucauacugguugaucuagaugaguu

SEQ ID NO: 52426 - RNA, 64 nt, Homo Sapiens
cuaauuugcauuugaauguauaacaaauugcaucacuuuucacaaacuuaacaccugccuggag

SEQ ID NO: 52427 - RNA, 64 nt, Homo Sapiens
uuaauucauuuguuuuccaccauuauauuuuuauacuuuucaguuagauauacuucugcauaaa

SEQ ID NO: 52428 - RNA, 64 nt, Homo Sapiens
aacucugcucagcaauaaucuguucucagaacagacuuuucaaccugcugccggauuucuccau

SEQ ID NO: 52429 - RNA, 64 nt, Homo Sapiens
gguauaccugaguuuggggguacccuuuuuugugacuuuucaaaacagugaauuacugucaccu

SEQ ID NO: 52430 - RNA, 64 nt, Homo Sapiens
ucugagccaaggaauaugcuauaaccaaguaaauacuuuucauuauccauauauaucuuuuuua

SEQ ID NO: 52431 - RNA, 64 nt, Homo Sapiens
agaauuuugucuuuaaauauacuuauauuaauaaacuuuucaagaaguugaaugauuuauuguu

SEQ ID NO: 52432 - RNA, 64 nt, Homo Sapiens
aauuuaauuauuuccagauauccaaccacugauuacuuuucaggcauuugaauaauuauauuuu

SEQ ID NO: 52433 - RNA, 64 nt, Homo Sapiens
auguugcaugcauauuucacaaauuucuuacuauacuuuucauauacccuuagucuccucacau

SEQ ID NO: 52434 - RNA, 64 nt, Homo Sapiens
aggcugguauucccuuuuuauauauaucuauauuacuuuucaccucuuuuucacuuuacuuuag

SEQ ID NO: 52435 - RNA, 64 nt, Homo Sapiens
ucaguaguacaggcuucuugccgauaugaagggaacuuuucagaaagagaccuacucuggguca

SEQ ID NO: 52436 - RNA, 64 nt, Homo Sapiens
gccgugucuguguagaaagaaguagacaugggagacuuuucauuuuguucuguacuaagaaaaa

SEQ ID NO: 52437 - RNA, 64 nt, Homo Sapiens
uuuccuuuuugguccuuuuaaguaaccacucaaaacuuuucauuucacugaaaaaauaugaaaa

SEQ ID NO: 52438 - RNA, 64 nt, Homo Sapiens
ggugucaguguucucuuguacguuguugcuuucgacuuuucagagcccuccugcucacuugacc

SEQ ID NO: 52439 - RNA, 64 nt, Homo Sapiens
auccaucuccugccugugugagguagcagugggcacuuuucauugagacaaacuccaggguguc

SEQ ID NO: 52440 - RNA, 64 nt, Homo Sapiens
auagcagauccuguaguauuuccaguagacauggccuuuuaaucuaagggcuuaagacugauua

SEQ ID NO: 52441 - RNA, 64 nt, Homo Sapiens
cucccauuuucugaauuuuuuuuuaaauuuccccccuuuuaaaauuguucgaaagcccacaguu

SEQ ID NO: 52442 - RNA, 64 nt, Homo Sapiens
cagggacagggugucuccuguuuuaacucccugcccuuuuaauauuaccaaaauuauuuuaacc

SEQ ID NO: 52443 - RNA, 50 nt, Homo Sapiens
cccugcccuuuuaauacaggccuuuuaacuaguuaccaaaauuauuuuaa

SEQ ID NO: 52444 - RNA, 64 nt, Homo Sapiens
uguuuugagggaucuguggaugccauaagacugaccuuuuaaaauugucucauuagccugaaug

SEQ ID NO: 52445 - RNA, 64 nt, Homo Sapiens
auaguauacacuuauuuuaaagaaaaaaaaaggcccuuuuaaaaccucuuaagaagauuaaaag

SEQ ID NO: 52446 - RNA, 64 nt, Homo Sapiens
caaaaugccaaauuuauuaagacuguuaaaacuuccuuuuaaauaguauaaaccuuuuuagugu

SEQ ID NO: 52447 - RNA, 64 nt, Homo Sapiens
cuaaguaguauuacccuauguugugaagaauuggccuuuuaauuuauauauacuuucagugcca

SEQ ID NO: 52448 - RNA, 64 nt, Homo Sapiens
uccaagacuuuacuacuuaaggaugugaaaaacaccuuuuaaagguuuuaaaguaaguuauauu

SEQ ID NO: 52449 - RNA, 64 nt, Homo Sapiens
ugcccacccuuuaauuuugaacucaauuuccuguccuuuuaaauaccguacacacacaucaauc

SEQ ID NO: 52450 - RNA, 64 nt, Homo Sapiens
ugccuugcuggcugugagaaauuucuuuggaaacccuuuuaagugucaauauggaguugagcuu

SEQ ID NO: 52451 - RNA, 64 nt, Homo Sapiens
uucaagauuuccaaagagaugaaauuuucuuaauccuuuuaaguuuucauaguaaacaguaugg

SEQ ID NO: 52452 - RNA, 64 nt, Homo Sapiens
uugguuguccuaccuggucuauuuuuaaaagucaccuuuuaaagugacauuauuagauacacuu

SEQ ID NO: 52453 - RNA, 64 nt, Homo Sapiens
gugcacaagcugauuuuaagugauauucagauggccuuuuaaauuuaauuauuauguauuuaaa

SEQ ID NO: 52454 - RNA, 64 nt, Homo Sapiens
caagugauaugaacugugauaaugcagaagguuuccuuuuaaaauaaaguucagucaaaaaagu

SEQ ID NO: 52455 - RNA, 64 nt, Homo Sapiens
auuuauuugcugaaagagcucuucugaacuguguccuuuuaauuuuugcuuagaauagaaugga

SEQ ID NO: 52456 - RNA, 64 nt, Homo Sapiens
cugagaagaguaucuguaaauaaaaggguuccaaccuuuuaaaaaagaaggaaaaaacuuuuug

SEQ ID NO: 52457 - RNA, 64 nt, Homo Sapiens
aacaacaaaaaaccagugaaauucuacaagugucccuuuuaaaaauagugugugcuaacuaagg

SEQ ID NO: 52458 - RNA, 64 nt, Homo Sapiens
agauuaagugcuuaguuuuauuccuaauucugccccuuuuaaccugauguguaccuuacucuuu

SEQ ID NO: 52459 - RNA, 64 nt, Homo Sapiens
auuguuaauuuuguaaacuuccaauuaaauaggaccuuuuaaaaggggggaagaaaaggaggaa

SEQ ID NO: 52460 - RNA, 64 nt, Homo Sapiens
uucuguaguguaugguaaguggccuccauaucccccuuuuaaaaaggcgugagccaccgcaccc

SEQ ID NO: 52461 - RNA, 64 nt, Homo Sapiens
guuaauaagaaaaccaaauggaggaagaaaauugccuuuuaauuuaaugucuacauguguuagg

SEQ ID NO: 52462 - RNA, 64 nt, Homo Sapiens
auuuaagacuacuuuucuuauugguauuuugauuccuuuuaaccuacucuucgcacacuaaacu

SEQ ID NO: 52463 - RNA, 64 nt, Homo Sapiens
acaacugggugguccuuguaaauguucacagcagccuuuuaacaaggcauugacguaucuuuga

SEQ ID NO: 52464 - RNA, 64 nt, Homo Sapiens
cacuacguuuucacagacaacagguaaaaaugcaccuuuuaaagcaugaacugauuuagcaaca

SEQ ID NO: 52465 - RNA, 64 nt, Homo Sapiens
aagcauaauuuuaggaaggcuuucgcaaaccuagccuuuuaagagagguuuuuaaccugaagca

SEQ ID NO: 52466 - RNA, 64 nt, Homo Sapiens
acuaagugcuagaauuuauaguuacaggcgguguccuuuuaaauguggaaaggcuuuuaaaaua

SEQ ID NO: 52467 - RNA, 64 nt, Homo Sapiens
uuccaauuuauaaucaagaaggggcucuggauccccuuuuaaauuacacacacucucacacaca

SEQ ID NO: 52468 - RNA, 64 nt, Homo Sapiens
auucuuuuuuaguggagugaaaguucugaagcccccuuuuaacuuccucuugguuuuucauuau

SEQ ID NO: 52469 - RNA, 64 nt, Homo Sapiens
uuuuguguuccuuuuugcagauucuuccuucccuccuuuuaaaaguauccugaaaggcaacaua

SEQ ID NO: 52470 - RNA, 64 nt, Homo Sapiens
ugguaugccaacuuaaguauuauuccuuuuuauuccuuuuaaaaaugaaaauaucagcuuuucu

SEQ ID NO: 52471 - RNA, 64 nt, Homo Sapiens
auauguaaggaagauuccacaucaugaguacuugccuuuuaacuuucccccacauuacuguuga

SEQ ID NO: 52472 - RNA, 64 nt, Homo Sapiens
gacccaccuacauuaccuucaggagacuguucuaccuuuuaauuugaaaacaaggaaauuaaau

SEQ ID NO: 52473 - RNA, 64 nt, Homo Sapiens
uguuucuugauauaugaagacauuccuuguuuguccuuuuaauucagcuuuuuaugagcuuuca

SEQ ID NO: 52474 - RNA, 64 nt, Homo Sapiens
uccugggauaaauuuuagaaguuuauaggccugaccuuuuaaauaucuauuguuuaacucacua

SEQ ID NO: 52475 - RNA, 64 nt, Homo Sapiens
uguuuuaacauuuuuuaauccaugguggcaauauccuuuuaaugugggcucuaaaaguugggcu

SEQ ID NO: 52476 - RNA, 64 nt, Homo Sapiens
auuaugcaugaaaacaggugucaaaaaugacucaccuuuuaaaaucccuuuaaaauauguaaug

SEQ ID NO: 52477 - RNA, 64 nt, Homo Sapiens
cagaaggaaccucgguacuugaauaaaacauuaaccuuuuaaguaauuauuguuauugguuccu

SEQ ID NO: 52478 - RNA, 64 nt, Homo Sapiens
uagguggcuagccaaaguuugcagugccuuuuuuccuuuuaacagggcaccacgaaauacauau

SEQ ID NO: 52479 - RNA, 64 nt, Homo Sapiens
aucacaugcuacaacuagaaagauuuaaacugauccuuuuaaggcgggaaggaaauccuuuuaa

SEQ ID NO: 52480 - RNA, 64 nt, Homo Sapiens
auuuaaacugauccuuuuaaaacgggaaggaaauccuuuuaaagauggaaugcuauuaagccuu

SEQ ID NO: 52481 - RNA, 64 nt, Homo Sapiens
uuuagaguuccauuucagauuucuucuuugccacccuuuuaaggacuuugaauuuuucuuuguc

SEQ ID NO: 52482 - RNA, 64 nt, Homo Sapiens
cucuuuuaaaggaauguggaucauagugauuuuuccuuuuaauuuuauugcucagaaaugaggc

SEQ ID NO: 52483 - RNA, 64 nt, Homo Sapiens
uuucaggaauacauauaagcgaaugggugacgggccuuuuaaucgagaaaguauuuuuugguau

SEQ ID NO: 52484 - RNA, 64 nt, Homo Sapiens
cauguugagaaaguauuuuuacaaaauaaggaauccuuuuaaaguaaaaaauaaaaaaauaaaa

SEQ ID NO: 52485 - RNA, 64 nt, Homo Sapiens
aaguuucaguguauuuaucaucuauauacccugaccuuuuaauaugcaaacaugccuuuuguuu

SEQ ID NO: 52486 - RNA, 64 nt, Homo Sapiens
acauuaaauguaaacuuaaauagcuuuuaaaagaccuuuuaaaggcaauuuauaauagaacuua

SEQ ID NO: 52487 - RNA, 64 nt, Homo Sapiens
ggauuuaauguaccuuuuugaacuguaagcuuguccuuuuaaagacuggagcucguaauuuuuu

SEQ ID NO: 52488 - RNA, 64 nt, Homo Sapiens
gugcaauaauuucuguauuuuacaaauuguggagccuuuuaacuccgaggguugauuaaggcag

SEQ ID NO: 52489 - RNA, 64 nt, Homo Sapiens
accuguuuuagugcugcauucgacauggaaaaguccuuuuaaccugugcuugcauccuccuuuc

SEQ ID NO: 52490 - RNA, 64 nt, Homo Sapiens
uagcagauaaugaugacuaguucacacauaaaguccuuuuaaggagaaaaucuaaaaugaaaag

SEQ ID NO: 52491 - RNA, 64 nt, Homo Sapiens
ucauccuuaucuuuguuccucuuuacauaauguuccuuuuaaaaaaaaucacugauuaugaugu

SEQ ID NO: 52492 - RNA, 64 nt, Homo Sapiens
uuuuugggucuuuuuauauauguucugugucuaaccuuuuaaaaccuggaacacagauauaaca

SEQ ID NO: 52493 - RNA, 64 nt, Homo Sapiens
uuuggucacuguauguaucagagugcauucaccaccuuuuaaauguuaucugugucgucccacu

SEQ ID NO: 52494 - RNA, 64 nt, Homo Sapiens
uuuuuccaaccauugcuugaaagguaguaauauuccuuuuaaauuuccucaagaaugucugaag

SEQ ID NO: 52495 - RNA, 64 nt, Homo Sapiens
ucccaggaauucauuaauaaucauccuuggcuuuccuuuuaaaggcuauuuugaaauggucuuu

SEQ ID NO: 52496 - RNA, 64 nt, Homo Sapiens
caaugaaauagauguaaggaaggagggauuuaaaccuuuuaaaaaacuuuugcugacuuauauu

SEQ ID NO: 52497 - RNA, 64 nt, Homo Sapiens
aacuuaacucucgcuggcaugagucuagcccucuccuuuuaaugugcuaauuuugugaaauaaa

SEQ ID NO: 52498 - RNA, 64 nt, Homo Sapiens
aaaauuucugguuuuuauugccugagggaaaaauccuuuuaaaagccaguuuuuacuuguuugc

SEQ ID NO: 52499 - RNA, 64 nt, Homo Sapiens
aguuguugaaagcugaaaagcauacaagauucuuccuuuuaacuuggauuucucguuccagaaa

SEQ ID NO: 52500 - RNA, 64 nt, Homo Sapiens
cccgauuauuacccauaaggcacacucucuaaggccuuuuaaggggccuacaaaaauguuuuau

SEQ ID NO: 52501 - RNA, 64 nt, Homo Sapiens
cugcuuuugagcuucaagguuuaaugaaggauuuccuuuuaaugcauguaucuugauuguugau

SEQ ID NO: 52502 - RNA, 64 nt, Homo Sapiens
gguuuucccuuuucugaucuccucuccuucagugccuuuuaaaaacuacugaauuucugucuug

SEQ ID NO: 52503 - RNA, 64 nt, Homo Sapiens
uguuuuuccuuuugacuccucuuucucauuagccccuuuuaauuucucugucucaucucuccuc

SEQ ID NO: 52504 - RNA, 64 nt, Homo Sapiens
guuuuucuuuggucuuuagugcaaguaagcugucccuuuuaacuaguuaaaccugagacagaga

SEQ ID NO: 52505 - RNA, 64 nt, Homo Sapiens
gguggagguugcagugagccaagauugcaccauugcacuccagccuggcgacagagcaagacuc

SEQ ID NO: 52506 - RNA, 64 nt, Homo Sapiens
ggcacagguuccagugagccaagguugugccacugcacuccagccugggcaaaaaagcaaaacu

SEQ ID NO: 52507 - RNA, 64 nt, Homo Sapiens
ggcagagguugcaguaagccaagaucgugccauugcacuccagccugggugacagagcgagacu

SEQ ID NO: 52508 - RNA, 64 nt, Homo Sapiens
ugggcaagagagugagacuccguuuugugccacugcacuccagccagggugacagagugagacu

SEQ ID NO: 52509 - RNA, 64 nt, Homo Sapiens
gguggagguuucagugagccaagauagcgccauugcacuccagcgugggcgacagcaagagacu

SEQ ID NO: 52510 - RNA, 64 nt, Homo Sapiens
ggcggagguugcagugaggcgagauugugccacugcacuccagcuugggcgacagagugagacu

SEQ ID NO: 52511 - RNA, 64 nt, Homo Sapiens
ggcagaaguugcagugagccgagaucgcaccacugcacuccagccuaggagacaaaacgagacu

SEQ ID NO: 52512 - RNA, 64 nt, Homo Sapiens
cugggcaacagagcgagacugagauugcgccacugcacuccagcggcagagcuugcagugagcu

SEQ ID NO: 52513 - RNA, 64 nt, Homo Sapiens
cugggugacagagcgagacugagauagugucacugcacuccagcggcggagcuugcagggagcc

SEQ ID NO: 52514 - RNA, 64 nt, Homo Sapiens
cugggcgacaagagugaaacaagaucgcgccacugcacuccagcagguggagguugcgugagcu

SEQ ID NO: 52515 - RNA, 64 nt, Homo Sapiens
cugggcgacagagcgagacugagaucacgccauugcacuccagcggcggaguuugcagugagcc

SEQ ID NO: 52516 - RNA, 64 nt, Homo Sapiens
cugggcgacagagcgagacugagaucacaucacugcacuccagcggcggagguuacagugagcc

SEQ ID NO: 52517 - RNA, 64 nt, Homo Sapiens
cuggguggcagagcaacacugagaucacaccacugcacuccagcgguggagguuacagugagca

SEQ ID NO: 52518 - RNA, 64 nt, Homo Sapiens
cugggcgacagagcaagacggagaucgugcuauugcacuccagcgguggagguugcagugagcu

SEQ ID NO: 52519 - RNA, 64 nt, Homo Sapiens
agcuuauuuggauuuuuuucaagauuuaaacuuugcacuccaaaugcaugauaauuuaaaaugg

SEQ ID NO: 52520 - RNA, 64 nt, Homo Sapiens
ucaggauggacaauguguuuucaguuguuggugugcacuccaagaaagucugcagaagagcucu

SEQ ID NO: 52521 - RNA, 64 nt, Homo Sapiens
cugggugacugagcaagaccguguucuugccacugcacuccaauauuugaagcugcagugagcu

SEQ ID NO: 52522 - RNA, 64 nt, Homo Sapiens
cuggcuacagggcgagacucgagaucacgccacugcacuccagcggcagagguugcagugagcc

SEQ ID NO: 52523 - RNA, 64 nt, Homo Sapiens
cugggcaacagagcgagacugagaucacgccacugcacuccagcggcagaggucauggugagcc

SEQ ID NO: 52524 - RNA, 64 nt, Homo Sapiens
cugggcgacagagugagacugagaucaugccauugcacuccagcggcggagguugcagugagcc

SEQ ID NO: 52525 - RNA, 64 nt, Homo Sapiens
ggcggagguugcagugagccaagaucgcaccacugcacuccagccuggcaacagagcgagacuc

SEQ ID NO: 52526 - RNA, 64 nt, Homo Sapiens
gauggagguugcagugagcagagaucgcaccacugcacuccagccugggcaagagugagacugu

SEQ ID NO: 52527 - RNA, 64 nt, Homo Sapiens
cgggugacagagcaagacugaaggucauaccagugcacuccaggggcagagguugcagugagcc

SEQ ID NO: 52528 - RNA, 64 nt, Homo Sapiens
cugggcgacagagcgagacugagauugugccacugcacuccagcggcagaaguugcagugagcu

SEQ ID NO: 52529 - RNA, 64 nt, Homo Sapiens
gguggagguugcagugagcugaggucgcaccacugcacuccagccuggacaacagagcaagacu

SEQ ID NO: 52530 - RNA, 64 nt, Homo Sapiens
ggucgaggcugcagugagcugugacugugccacugcacuccagcuugagcaacacagugauacu

SEQ ID NO: 52531 - RNA, 64 nt, Homo Sapiens
gccgcugccuguucccacgugucaccagcacgcugcacuccagaugaaauccuccuaggacagg

SEQ ID NO: 52532 - RNA, 64 nt, Homo Sapiens
ggcggagguugcagugugccaagaucauaccacugcacuccagcccuggugacagaggagaccc

SEQ ID NO: 52533 - RNA, 64 nt, Homo Sapiens
cugggcaacagagugagacugagaucccaccauugcacuccagcagcagagguugcaguaagcu

SEQ ID NO: 52534 - RNA, 64 nt, Homo Sapiens
cugggugacagagccagacugagaucaugcgacugcacuccagcagguggaguugcagugagcc

SEQ ID NO: 52535 - RNA, 64 nt, Homo Sapiens
gggagagguugcagugagccaagaucguaccacugcacuccagccugggugacagagugagacu

SEQ ID NO: 52536 - RNA, 64 nt, Homo Sapiens
gacggaaguugcagugagcugagaucacaccacugcacuccagccuggugacagagcaagacuc

SEQ ID NO: 52537 - RNA, 64 nt, Homo Sapiens
ggcagagguuccagugagccaagaucgcaccacugcacuccagccugggcaacaaagagcgaaa

SEQ ID NO: 52538 - RNA, 64 nt, Homo Sapiens
ggcggagguugcagugagcugagaucgcacuacugcacuccagccugggcgacagagcaagacc

SEQ ID NO: 52539 - RNA, 64 nt, Homo Sapiens
ucccauacaaacucagaaugcuauauuuuuaacagcacuccagcauuuuucuucauguaucacc

SEQ ID NO: 52540 - RNA, 64 nt, Homo Sapiens
uaccucacagguuuucauucuuuugaacucuggugcacuccaucuguaauccaugucuauaauc

SEQ ID NO: 52541 - RNA, 64 nt, Homo Sapiens
gacggaggcggcagugagccaagauugugccacugcacuccagccugggcgacagagugaaacu

SEQ ID NO: 52542 - RNA, 64 nt, Homo Sapiens
ggcggagguugcaaugagccgagaucgcgcuacugcacuccagccugggcaacagagagagacc

SEQ ID NO: 52543 - RNA, 64 nt, Homo Sapiens
gaaaguuucaugcuguugcgcagguaaugacuuggcacuccagaugaccuguccccaguguuuc

SEQ ID NO: 52544 - RNA, 64 nt, Homo Sapiens
cugggcaacagagugagacccagaucacaccacugcacuccagcgguugagguugcagugagca

SEQ ID NO: 52545 - RNA, 64 nt, Homo Sapiens
guucaagucugcagugagcuaugauugcaccacugcacuccagccugggugauagagcaagacc

SEQ ID NO: 52546 - RNA, 64 nt, Homo Sapiens
agagaccccacuccccugcugagaucgcgccacugcacuccagccugggcgacagagcaagacu

SEQ ID NO: 52547 - RNA, 64 nt, Homo Sapiens
ggcggagguugccgugagccaagaucgcaccacugcacuccagccugggcgacaaagugagacu

SEQ ID NO: 52548 - RNA, 64 nt, Homo Sapiens
ggcggagguugcagugagcagagaucgugccacugcacuccagccuggguggacagagcaagac

SEQ ID NO: 52549 - RNA, 64 nt, Homo Sapiens
gguggagauugcaguaagccgagaucgugccacugcacuccagccugggugauagagcaagacu

SEQ ID NO: 52550 - RNA, 64 nt, Homo Sapiens
cugggucacagagugagacuaagaucgcaccacugcacuccagcgacagagguuguagugagcc

SEQ ID NO: 52551 - RNA, 64 nt, Homo Sapiens
cugagugacagagcgagacucaugauuucccacugcacuccagcaguuugaggcugcaaugagc

SEQ ID NO: 52552 - RNA, 64 nt, Homo Sapiens
cugggcaacagagugagacuaagaucgcaccacugcacuccagcggcggagguugcagugagcc

SEQ ID NO: 52553 - RNA, 64 nt, Homo Sapiens
aucccagcgaugucagacaccgaggccacacucagcacuccagguggaggagugaagccaccau

SEQ ID NO: 52554 - RNA, 64 nt, Homo Sapiens
ggcggagguugcagugagcugagaucgcaccacugcacuccagcacuccagccugggugacaga

SEQ ID NO: 52555 - RNA, 64 nt, Homo Sapiens
uugcagugagcugagaucgcaccacugcacuccagcacuccagccugggugacagagcaagacu

SEQ ID NO: 52556 - RNA, 64 nt, Homo Sapiens
ggcagagauugcagugagccgagaucacgccauugcacuccagccugggugacacagugagacu

SEQ ID NO: 52557 - RNA, 64 nt, Homo Sapiens
cugggcaacgggcgagacucgagaucacaucauugcacuccagcgguggagguugcagugagcu

SEQ ID NO: 52558 - RNA, 64 nt, Homo Sapiens
cugggcaagaguuuuuuuaaaagaucgugccacugcacuccagcgauggaggcugcagcgagcc

SEQ ID NO: 52559 - RNA, 64 nt, Homo Sapiens
gguggagguugcagugagccaagaucgcgccacugcacuccagccuggaugacagagcaaaaaa

SEQ ID NO: 52560 - RNA, 64 nt, Homo Sapiens
ggucgaggcugcagugagccacgaucacaccacugcacuccagccuaggugacagagugagauc

SEQ ID NO: 52561 - RNA, 64 nt, Homo Sapiens
ggcggagguugcagugagccaagauggcgccauugcacuccagccugggugacaagagugaaac

SEQ ID NO: 52562 - RNA, 64 nt, Homo Sapiens
ggcggagguugcagugagccaagauggcgccauugcacuccagccugggcgacaagagcaaaac

SEQ ID NO: 52563 - RNA, 64 nt, Homo Sapiens
cugggugacagagugagacuucacaggagccacugcacuccagcgagguugcagugagccaaga

SEQ ID NO: 52564 - RNA, 64 nt, Homo Sapiens
cugggcaacagagcaagacugagaucaugccacugcacuccagcgauggagguugcagugagcu

SEQ ID NO: 52565 - RNA, 64 nt, Homo Sapiens
cgcucuagucucucaggaauacaggcuguggcuugcacuccagccugcagccuggccuccccgc

SEQ ID NO: 52566 - RNA, 64 nt, Homo Sapiens
cugcuggccccaggacuucuagcagccuguuccugcacuccacccaagcugccacacugcccgg

SEQ ID NO: 52567 - RNA, 64 nt, Homo Sapiens
ggcggagcuugcaguuagccgagaucaugccacugcacuccagccuacaugacaaugugacacu

SEQ ID NO: 52568 - RNA, 64 nt, Homo Sapiens
ggcggagguugcagugagcugagcucauaccacugcacuccagccugaacagagugagauccug

SEQ ID NO: 52569 - RNA, 64 nt, Homo Sapiens
ggcggcgguugcagugagccgagaucguaccauugcacuccagccugggcaacaagagcgaaac

SEQ ID NO: 52570 - RNA, 64 nt, Homo Sapiens
ggcggagguugcaaugagccaagaucguaccacugcacuccagccugggcgacagagcaagaca

SEQ ID NO: 52571 - RNA, 64 nt, Homo Sapiens
gguagagguugcagugagccaagaucgcgccacugcacuccagucugggcaacagagugagacc

SEQ ID NO: 52572 - RNA, 64 nt, Homo Sapiens
aguggagguugcagugagccgagauugugcugcugcacuccagccugggugaaaaagacaggcu

SEQ ID NO: 52573 - RNA, 64 nt, Homo Sapiens
uuuggcaacagaacgagaucaugaucaugucucagcacuccagcaaucauagcucacugcagcu

SEQ ID NO: 52574 - RNA, 64 nt, Homo Sapiens
cuggaugacagagugagacugagacugggccacugcacuccagcgucagaggcugcagagagcc

SEQ ID NO: 52575 - RNA, 64 nt, Homo Sapiens
cugggcgacaagagugaaacaagaucauacuacugcacuccagcgguagaaguugcagugagcc

SEQ ID NO: 52576 - RNA, 64 nt, Homo Sapiens
cuggugacagagugagacucgagaucgugccacugcacuccagcggcagagauugcaguaagcu

SEQ ID NO: 52577 - RNA, 64 nt, Homo Sapiens
cuagaaaugcaguauugcuuugaccugccauguggcacuccacaaugucaauugcaguuuacac

SEQ ID NO: 52578 - RNA, 64 nt, Homo Sapiens
ggcggagauugcagugagccaagguuccaccacugcacuccagccuggcgacagagcaaggcuc

SEQ ID NO: 52579 - RNA, 64 nt, Homo Sapiens
gguggagguugcagugagcugggaucgcgccauugcacuccagccuggcugacagagcgagacu

SEQ ID NO: 52580 - RNA, 64 nt, Homo Sapiens
ggucggggcugcagugagccaagaucacgccacugcacuccagcacccugggcgacagagugag

SEQ ID NO: 52581 - RNA, 64 nt, Homo Sapiens
ggcggagcuugcagugagccaagaucgcgccacugcacuccagccugggcgacagagugagacu

SEQ ID NO: 52582 - RNA, 64 nt, Homo Sapiens
gguggagacugcaguaagccaagaucaugccauugcacuccagccugggcaacacagggagacu

SEQ ID NO: 52583 - RNA, 64 nt, Homo Sapiens
gguggagguugcagugagccgagauugugccacugcacuccagccugggcgauagagcuagacu

SEQ ID NO: 52584 - RNA, 64 nt, Homo Sapiens
ggcagagguugcagucagccaagaucaugcuacugcacuccagccugggugacagagcgagacu

SEQ ID NO: 52585 - RNA, 64 nt, Homo Sapiens
cuguccuagguuacaaagacaugggggccuuguggcacuccaaguaugagucggauacccugga

SEQ ID NO: 52586 - RNA, 64 nt, Homo Sapiens
gccggaggcugcagugagccaagaucgcaccauugcacuccagcugggagacacagcaagacuc

SEQ ID NO: 52587 - RNA, 64 nt, Homo Sapiens
cugggugacagaguaagaccaagaucgcacuacugcacuccagcggcugaggcugcagugagcc

SEQ ID NO: 52588 - RNA, 64 nt, Homo Sapiens
cugggugacagagccagacugagaucgcgccacugcacuccagcggaagagcuugcagugagcc

SEQ ID NO: 52589 - RNA, 64 nt, Homo Sapiens
ccaggugacagugugagacugagaucgcuccacugcacuccagcggcggagguugcagugagcc

SEQ ID NO: 52590 - RNA, 64 nt, Homo Sapiens
cugggcgacagagugagacugagaucgugccacugcacuccagcggcggagcuugcagugagcc

SEQ ID NO: 52591 - RNA, 64 nt, Homo Sapiens
cugggcgacagagcgagacugagauugcgccaccgcacuccagcggcaaagguugcagugaacu

SEQ ID NO: 52592 - RNA, 64 nt, Homo Sapiens
cugggcuacaagauugaaaaaagaucgugccacugcacuccagcgguggagguugcggugagcc

SEQ ID NO: 52593 - RNA, 64 nt, Homo Sapiens
cugggcgacagagaaaaaaagagaucgcgccaaugcacuccagcggcggagcuugcagugagcc

SEQ ID NO: 52594 - RNA, 64 nt, Homo Sapiens
gcccugagggagugaguucacauuugagacaacugcacuccaguguggacgugccuuugucuuc

SEQ ID NO: 52595 - RNA, 64 nt, Homo Sapiens
uuccucaaaaggucuugcugcugucagguguuaugcacuccauccaucauaacuguaugaaaca

SEQ ID NO: 52596 - RNA, 64 nt, Homo Sapiens
gguugugguugcagugagcuaugauuguaccacugcacuccagccugggcaacagagcaagacc

SEQ ID NO: 52597 - RNA, 64 nt, Homo Sapiens
ggcggagguugcggucagcugagauggugccacugcacuccagccugggcgaaagagcgacucu

SEQ ID NO: 52598 - RNA, 64 nt, Homo Sapiens
ggcagagguugaagugagcugagaucgcgccauugcacuccagccugggcaacaagaguggcac

SEQ ID NO: 52599 - RNA, 64 nt, Homo Sapiens
gcgccauugcacuccagccugggcaacaagaguggcacuccaucucagaaaaaaaaaaaaaaga

SEQ ID NO: 52600 - RNA, 64 nt, Homo Sapiens
acccaguaucuucugugccaugguucccacauucgcacuccauggccuccuguccuggacccca

SEQ ID NO: 52601 - RNA, 64 nt, Homo Sapiens
ggcagagguugcagugagccaagaucacacuauugcacuccagccugggcgacagggcaagacu

SEQ ID NO: 52602 - RNA, 64 nt, Homo Sapiens
gguugaagcugcagugagcugugaucgcaccacugcacuccagcuugguucauggagacccugu

SEQ ID NO: 52603 - RNA, 64 nt, Homo Sapiens
ggcggagcuugcagugagccgagaucgcgccacugcacuccagccugggcgacagagugagacu

SEQ ID NO: 52604 - RNA, 64 nt, Homo Sapiens
gauugaggcugcagugagcuguguucacaccacugcacuccagucugggcaacagugcaagacc

SEQ ID NO: 52605 - RNA, 64 nt, Homo Sapiens
cuuggugacagagugagacugagaucacaccacugcacuccagcgguggagguuucagcgagcu

SEQ ID NO: 52606 - RNA, 64 nt, Homo Sapiens
cuggguaacagagcgagacuugagccgagauugugcacuccagccugggaggcagaaguugugg

SEQ ID NO: 52607 - RNA, 64 nt, Homo Sapiens
cugggcgacagagcaagacagacaucaugccacugcacuccagcgguggagguugcagugagcc

SEQ ID NO: 52608 - RNA, 64 nt, Homo Sapiens
cugggcaacacagcaagaucaugacugcaucacugcacuccagcguuggaggcugaagagagcu

SEQ ID NO: 52609 - RNA, 64 nt, Homo Sapiens
cuggguaacagagcaagagugagaucgcgccacugcacuccagcggcggaguuuguggugaguu

SEQ ID NO: 52610 - RNA, 64 nt, Homo Sapiens
cugggugacagagugagaccgagaucgugccacugcacuccagcggcagaguuugcagugagcu

SEQ ID NO: 52611 - RNA, 64 nt, Homo Sapiens
cugggugacagagcgagaccaugaucauaccacugcacuccagcgguugaggcuauagugagcc

SEQ ID NO: 52612 - RNA, 64 nt, Homo Sapiens
cugggcaacacagcgagacuaagaucaugccacugcacuccagcggcagaggcugcagugaacc

SEQ ID NO: 52613 - RNA, 64 nt, Homo Sapiens
cugggcagcagagcaacacugagauugcgccacugcacuccagcggcggagcuugcagugagcc

SEQ ID NO: 52614 - RNA, 64 nt, Homo Sapiens
cugggcaacagagggagcccaugauugcaccacugcacuccagcgguagaggcugcauugagcc

SEQ ID NO: 52615 - RNA, 64 nt, Homo Sapiens
cuggguggccgagcgagacuaagaucgcgccacugcacuccagcggcggagcuugcagugagcc

SEQ ID NO: 52616 - RNA, 64 nt, Homo Sapiens
cugggcgacacagcaaguucaugaucgugcuacugcacuccagcuggugaggcugcagugagcu

SEQ ID NO: 52617 - RNA, 64 nt, Homo Sapiens
cugaacagagcuccacacaucugucagggugugagcacuccaaggccucgcguggagcauccuu

SEQ ID NO: 52618 - RNA, 64 nt, Homo Sapiens
ggucgaggcugcagugagccaagaucaugcuacugcacuccagcuuagguggcaaagugagacc

SEQ ID NO: 52619 - RNA, 64 nt, Homo Sapiens
auuugaggcugcagugagcuaugauuguaucacugcacuccagccuagaugacagaacgagacc

SEQ ID NO: 52620 - RNA, 64 nt, Homo Sapiens
ggcagagguuucagugagcugaaauugugccacugcacuccagccugagugacagagugagacu

SEQ ID NO: 52621 - RNA, 64 nt, Homo Sapiens
cugggcaacagagugagacugagaucacgccacugcacuccagcggcggagcuugcagugagcu

SEQ ID NO: 52622 - RNA, 64 nt, Homo Sapiens
cugggcaacagagcgagacugaagucccgccacugcacuccagcggcagagguagcagugagcu

SEQ ID NO: 52623 - RNA, 64 nt, Homo Sapiens
ggcggagguuacagugagcugagaucgugccacugcacuccagccugggugacagagugagacc

SEQ ID NO: 52624 - RNA, 64 nt, Homo Sapiens
uguccauauuccacauuugcugacugugcucccugcacuccacucaaguugagaguucaaauag

SEQ ID NO: 52625 - RNA, 64 nt, Homo Sapiens
gguggagguugcagugagcugagcucaugcgacugcacuccagccugggugacugagcaagacu

SEQ ID NO: 52626 - RNA, 64 nt, Homo Sapiens
ggcagagcuugcagugagccaagaucgcgccacugcacuccagccugggugacagagcgagacu

SEQ ID NO: 52627 - RNA, 64 nt, Homo Sapiens
cuggcaauagggcgagacucaagaucgcgccacugcacuccagcggcggagguugcagugagcc

SEQ ID NO: 52628 - RNA, 64 nt, Homo Sapiens
cugggggacaaaagugagacaagaucaugccaucgcacuccagccacggagguugcagugagcu

SEQ ID NO: 52629 - RNA, 64 nt, Homo Sapiens
cugggcaacagagccagacugagaucgugccacugcacuccagcggcggagguuguagugagcu

SEQ ID NO: 52630 - RNA, 64 nt, Homo Sapiens
cccuucacacccaccccucuccaccucuaccugugcacuccaaccaacacagugaagaccccag

SEQ ID NO: 52631 - RNA, 64 nt, Homo Sapiens
ugagagugugacccugucucaugaucuugccauugcacuccagcguuugagguuguagggagcu

SEQ ID NO: 52632 - RNA, 64 nt, Homo Sapiens
uugggugacaaaguaagaccgggaucacgccacugcacuccagcgacauagguugcaguguaau

SEQ ID NO: 52633 - RNA, 64 nt, Homo Sapiens
agcggagguugcagugagccgagaucgugccuuugcacuccagcguggaagacagugagacucc

SEQ ID NO: 52634 - RNA, 64 nt, Homo Sapiens
ggcggaggcugcagugggccgggaucguacuacugcacuccagcauggaagacagcgagacucc

SEQ ID NO: 52635 - RNA, 64 nt, Homo Sapiens
aaaugcuguugcuucagguucuuaaaaucacucagcacuccaacuucuaaucaaauuuuuggag

SEQ ID NO: 52636 - RNA, 64 nt, Homo Sapiens
ggcagagcuugcagugagccgagaucucgccacugcacuccagccugggcaacagagcaagacu

SEQ ID NO: 52637 - RNA, 64 nt, Homo Sapiens
cugggcaacaagagugaaauaagaucuugccauugcacuccagcguuggagguugcagugagcc

SEQ ID NO: 52638 - RNA, 64 nt, Homo Sapiens
cugggcaacagugaaacuccgagaucacaccacugcacuccagcgguggagguugcaaugagcc

SEQ ID NO: 52639 - RNA, 64 nt, Homo Sapiens
cuggaggccagagugagacuaagacuacgccacugcacuccagcgguggagguugcagugagcc

SEQ ID NO: 52640 - RNA, 64 nt, Homo Sapiens
cugggcgacaagagcgagacaagcugagaucgcugcacuccagcugggagguggagguugcagu

SEQ ID NO: 52641 - RNA, 64 nt, Homo Sapiens; identical to SEQ ID NO: 24182

SEQ ID NO: 52642 - RNA, 64 nt, Homo Sapiens; identical to SEQ ID NO: 24183

SEQ ID NO: 52643 - RNA, 64 nt, Homo Sapiens; identical to SEQ ID NO: 24184

SEQ ID NO: 52644 - RNA, 64 nt, Homo Sapiens; identical to SEQ ID NO: 24185

SEQ ID NO: 52645 - RNA, 64 nt, Homo Sapiens; identical to SEQ ID NO: 24186

SEQ ID NO: 52646 - RNA, 64 nt, Homo Sapiens; identical to SEQ ID NO: 24187

SEQ ID NO: 52647 - RNA, 64 nt, Homo Sapiens; identical to SEQ ID NO: 24188

SEQ ID NO: 52648 - RNA, 64 nt, Homo Sapiens; identical to SEQ ID NO: 24189

SEQ ID NO: 52649 - RNA, 64 nt, Homo Sapiens; identical to SEQ ID NO: 24190

SEQ ID NO: 52650 - RNA, 64 nt, Homo Sapiens; identical to SEQ ID NO: 24191

SEQ ID NO: 52651 - RNA, 64 nt, Homo Sapiens; identical to SEQ ID NO: 24192

SEQ ID NO: 52652 - RNA, 64 nt, Homo Sapiens; identical to SEQ ID NO: 24193

SEQ ID NO: 52653 - RNA, 64 nt, Homo Sapiens; identical to SEQ ID NO: 24194

SEQ ID NO: 52654 - RNA, 64 nt, Homo Sapiens; identical to SEQ ID NO: 24195

SEQ ID NO: 52655 - RNA, 64 nt, Homo Sapiens; identical to SEQ ID NO: 24196

SEQ ID NO: 52656 - RNA, 64 nt, Homo Sapiens; identical to SEQ ID NO: 24197

SEQ ID NO: 52657 - RNA, 64 nt, Homo Sapiens; identical to SEQ ID NO: 24198

SEQ ID NO: 52658 - RNA, 64 nt, Homo Sapiens; identical to SEQ ID NO: 24199

SEQ ID NO: 52659 - RNA, 64 nt, Homo Sapiens; identical to SEQ ID NO: 24200

SEQ ID NO: 52660 - RNA, 64 nt, Homo Sapiens; identical to SEQ ID NO: 24201

SEQ ID NO: 52661 - RNA, 64 nt, Homo Sapiens; identical to SEQ ID NO: 24202

SEQ ID NO: 52662 - RNA, 64 nt, Homo Sapiens; identical to SEQ ID NO: 24203

SEQ ID NO: 52663 - RNA, 64 nt, Homo Sapiens; identical to SEQ ID NO: 24204

SEQ ID NO: 52664 - RNA, 64 nt, Homo Sapiens; identical to SEQ ID NO: 24205

SEQ ID NO: 52665 - RNA, 64 nt, Homo Sapiens; identical to SEQ ID NO: 24206

SEQ ID NO: 52666 - RNA, 64 nt, Homo Sapiens; identical to SEQ ID NO: 24207

SEQ ID NO: 52667 - RNA, 64 nt, Homo Sapiens; identical to SEQ ID NO: 24208

SEQ ID NO: 52668 - RNA, 64 nt, Homo Sapiens; identical to SEQ ID NO: 24209

SEQ ID NO: 52669 - RNA, 64 nt, Homo Sapiens; identical to SEQ ID NO: 24210

SEQ ID NO: 52670 - RNA, 64 nt, Homo Sapiens; identical to SEQ ID NO: 24211

SEQ ID NO: 52671 - RNA, 64 nt, Homo Sapiens; identical to SEQ ID NO: 24212

SEQ ID NO: 52672 - RNA, 64 nt, Homo Sapiens; identical to SEQ ID NO: 24213

SEQ ID NO: 52673 - RNA, 64 nt, Homo Sapiens; identical to SEQ ID NO: 24214

SEQ ID NO: 52674 - RNA, 64 nt, Homo Sapiens; identical to SEQ ID NO: 24215

SEQ ID NO: 52675 - RNA, 64 nt, Homo Sapiens; identical to SEQ ID NO: 24216

SEQ ID NO: 52676 - RNA, 64 nt, Homo Sapiens; identical to SEQ ID NO: 24217

SEQ ID NO: 52677 - RNA, 64 nt, Homo Sapiens; identical to SEQ ID NO: 24218

SEQ ID NO: 52678 - RNA, 64 nt, Homo Sapiens; identical to SEQ ID NO: 24219

SEQ ID NO: 52679 - RNA, 64 nt, Homo Sapiens; identical to SEQ ID NO: 24220

SEQ ID NO: 52680 - RNA, 64 nt, Homo Sapiens; identical to SEQ ID NO: 24221

SEQ ID NO: 52681 - RNA, 64 nt, Homo Sapiens; identical to SEQ ID NO: 24222

SEQ ID NO: 52682 - RNA, 64 nt, Homo Sapiens; identical to SEQ ID NO: 24223

SEQ ID NO: 52683 - RNA, 64 nt, Homo Sapiens; identical to SEQ ID NO: 24224

SEQ ID NO: 52684 - RNA, 64 nt, Homo Sapiens; identical to SEQ ID NO: 24225

SEQ ID NO: 52685 - RNA, 64 nt, Homo Sapiens; identical to SEQ ID NO: 24226

SEQ ID NO: 52686 - RNA, 64 nt, Homo Sapiens; identical to SEQ ID NO: 24227

SEQ ID NO: 52687 - RNA, 64 nt, Homo Sapiens; identical to SEQ ID NO: 24228

SEQ ID NO: 52688 - RNA, 64 nt, Homo Sapiens; identical to SEQ ID NO: 24229

SEQ ID NO: 52689 - RNA, 64 nt, Homo Sapiens; identical to SEQ ID NO: 24230

SEQ ID NO: 52690 - RNA, 64 nt, Homo Sapiens; identical to SEQ ID NO: 24231

SEQ ID NO: 52691 - RNA, 64 nt, Homo Sapiens; identical to SEQ ID NO: 24232

SEQ ID NO: 52692 - RNA, 64 nt, Homo Sapiens; identical to SEQ ID NO: 24233

SEQ ID NO: 52693 - RNA, 64 nt, Homo Sapiens; identical to SEQ ID NO: 24234

SEQ ID NO: 52694 - RNA, 64 nt, Homo Sapiens; identical to SEQ ID NO: 24235

SEQ ID NO: 52695 - RNA, 64 nt, Homo Sapiens; identical to SEQ ID NO: 24236

SEQ ID NO: 52696 - RNA, 64 nt, Homo Sapiens; identical to SEQ ID NO: 24237

SEQ ID NO: 52697 - RNA, 64 nt, Homo Sapiens; identical to SEQ ID NO: 24238

SEQ ID NO: 52698 - RNA, 64 nt, Homo Sapiens; identical to SEQ ID NO: 24239

SEQ ID NO: 52699 - RNA, 64 nt, Homo Sapiens; identical to SEQ ID NO: 24240

SEQ ID NO: 52700 - RNA, 64 nt, Homo Sapiens; identical to SEQ ID NO: 24241

SEQ ID NO: 52701 - RNA, 64 nt, Homo Sapiens; identical to SEQ ID NO: 24242

SEQ ID NO: 52702 - RNA, 64 nt, Homo Sapiens; identical to SEQ ID NO: 24243

SEQ ID NO: 52703 - RNA, 64 nt, Homo Sapiens; identical to SEQ ID NO: 24244

SEQ ID NO: 52704 - RNA, 64 nt, Homo Sapiens; identical to SEQ ID NO: 24245

SEQ ID NO: 52705 - RNA, 64 nt, Homo Sapiens; identical to SEQ ID NO: 24246

SEQ ID NO: 52706 - RNA, 64 nt, Homo Sapiens; identical to SEQ ID NO: 24247

SEQ ID NO: 52707 - RNA, 64 nt, Homo Sapiens; identical to SEQ ID NO: 24248

SEQ ID NO: 52708 - RNA, 64 nt, Homo Sapiens; identical to SEQ ID NO: 24249

SEQ ID NO: 52709 - RNA, 64 nt, Homo Sapiens; identical to SEQ ID NO: 24250

SEQ ID NO: 52710 - RNA, 64 nt, Homo Sapiens; identical to SEQ ID NO: 24251

SEQ ID NO: 52711 - RNA, 64 nt, Homo Sapiens; identical to SEQ ID NO: 24252

SEQ ID NO: 52712 - RNA, 64 nt, Homo Sapiens; identical to SEQ ID NO: 24253

SEQ ID NO: 52713 - RNA, 64 nt, Homo Sapiens; identical to SEQ ID NO: 24254

SEQ ID NO: 52714 - RNA, 64 nt, Homo Sapiens; identical to SEQ ID NO: 24255

SEQ ID NO: 52715 - RNA, 64 nt, Homo Sapiens; identical to SEQ ID NO: 24256

SEQ ID NO: 52716 - RNA, 64 nt, Homo Sapiens; identical to SEQ ID NO: 24257

SEQ ID NO: 52717 - RNA, 64 nt, Homo Sapiens; identical to SEQ ID NO: 24258

SEQ ID NO: 52718 - RNA, 64 nt, Homo Sapiens; identical to SEQ ID NO: 24259

SEQ ID NO: 52719 - RNA, 64 nt, Homo Sapiens; identical to SEQ ID NO: 24260

SEQ ID NO: 52720 - RNA, 64 nt, Homo Sapiens; identical to SEQ ID NO: 24261

SEQ ID NO: 52721 - RNA, 64 nt, Homo Sapiens; identical to SEQ ID NO: 24262

SEQ ID NO: 52722 - RNA, 64 nt, Homo Sapiens; identical to SEQ ID NO: 24263

SEQ ID NO: 52723 - RNA, 64 nt, Homo Sapiens; identical to SEQ ID NO: 24264

SEQ ID NO: 52724 - RNA, 64 nt, Homo Sapiens; identical to SEQ ID NO: 24265

SEQ ID NO: 52725 - RNA, 64 nt, Homo Sapiens; identical to SEQ ID NO: 24266

SEQ ID NO: 52726 - RNA, 64 nt, Homo Sapiens; identical to SEQ ID NO: 24267

SEQ ID NO: 52727 - RNA, 64 nt, Homo Sapiens; identical to SEQ ID NO: 24268

SEQ ID NO: 52728 - RNA, 64 nt, Homo Sapiens; identical to SEQ ID NO: 24269

SEQ ID NO: 52729 - RNA, 64 nt, Homo Sapiens; identical to SEQ ID NO: 24270

SEQ ID NO: 52730 - RNA, 64 nt, Homo Sapiens; identical to SEQ ID NO: 24271

SEQ ID NO: 52731 - RNA, 64 nt, Homo Sapiens; identical to SEQ ID NO: 24272

SEQ ID NO: 52732 - RNA, 64 nt, Homo Sapiens; identical to SEQ ID NO: 24273

SEQ ID NO: 52733 - RNA, 64 nt, Homo Sapiens; identical to SEQ ID NO: 24274

SEQ ID NO: 52734 - RNA, 64 nt, Homo Sapiens; identical to SEQ ID NO: 24275

SEQ ID NO: 52735 - RNA, 64 nt, Homo Sapiens; identical to SEQ ID NO: 24276

SEQ ID NO: 52736 - RNA, 64 nt, Homo Sapiens; identical to SEQ ID NO: 24277

SEQ ID NO: 52737 - RNA, 64 nt, Homo Sapiens; identical to SEQ ID NO: 24278

SEQ ID NO: 52738 - RNA, 64 nt, Homo Sapiens; identical to SEQ ID NO: 24279

SEQ ID NO: 52739 - RNA, 64 nt, Homo Sapiens; identical to SEQ ID NO: 24280

SEQ ID NO: 52740 - RNA, 64 nt, Homo Sapiens; identical to SEQ ID NO: 24281

SEQ ID NO: 52741 - RNA, 64 nt, Homo Sapiens; identical to SEQ ID NO: 24282

SEQ ID NO: 52742 - RNA, 64 nt, Homo Sapiens; identical to SEQ ID NO: 24283

SEQ ID NO: 52743 - RNA, 64 nt, Homo Sapiens; identical to SEQ ID NO: 24284

SEQ ID NO: 52744 - RNA, 64 nt, Homo Sapiens; identical to SEQ ID NO: 24285

SEQ ID NO: 52745 - RNA, 64 nt, Homo Sapiens; identical to SEQ ID NO: 24286

SEQ ID NO: 52746 - RNA, 64 nt, Homo Sapiens; identical to SEQ ID NO: 24287

SEQ ID NO: 52747 - RNA, 64 nt, Homo Sapiens; identical to SEQ ID NO: 24288

SEQ ID NO: 52748 - RNA, 64 nt, Homo Sapiens; identical to SEQ ID NO: 24289

SEQ ID NO: 52749 - RNA, 64 nt, Homo Sapiens; identical to SEQ ID NO: 24290

SEQ ID NO: 52750 - RNA, 64 nt, Homo Sapiens; identical to SEQ ID NO: 24291

SEQ ID NO: 52751 - RNA, 64 nt, Homo Sapiens; identical to SEQ ID NO: 24292

SEQ ID NO: 52752 - RNA, 64 nt, Homo Sapiens; identical to SEQ ID NO: 24293

SEQ ID NO: 52753 - RNA, 64 nt, Homo Sapiens; identical to SEQ ID NO: 24294

SEQ ID NO: 52754 - RNA, 64 nt, Homo Sapiens; identical to SEQ ID NO: 24295

SEQ ID NO: 52755 - RNA, 64 nt, Homo Sapiens; identical to SEQ ID NO: 24296

SEQ ID NO: 52756 - RNA, 64 nt, Homo Sapiens; identical to SEQ ID NO: 24297

SEQ ID NO: 52757 - RNA, 64 nt, Homo Sapiens; identical to SEQ ID NO: 24298

SEQ ID NO: 52758 - RNA, 64 nt, Homo Sapiens; identical to SEQ ID NO: 24299

SEQ ID NO: 52759 - RNA, 64 nt, Homo Sapiens; identical to SEQ ID NO: 24300

SEQ ID NO: 52760 - RNA, 64 nt, Homo Sapiens; identical to SEQ ID NO: 24301

SEQ ID NO: 52761 - RNA, 64 nt, Homo Sapiens; identical to SEQ ID NO: 24302

SEQ ID NO: 52762 - RNA, 64 nt, Homo Sapiens; identical to SEQ ID NO: 24303

SEQ ID NO: 52763 - RNA, 64 nt, Homo Sapiens; identical to SEQ ID NO: 24304

SEQ ID NO: 52764 - RNA, 64 nt, Homo Sapiens; identical to SEQ ID NO: 24305

SEQ ID NO: 52765 - RNA, 64 nt, Homo Sapiens; identical to SEQ ID NO: 24306

SEQ ID NO: 52766 - RNA, 64 nt, Homo Sapiens; identical to SEQ ID NO: 24307

SEQ ID NO: 52767 - RNA, 64 nt, Homo Sapiens; identical to SEQ ID NO: 24308

SEQ ID NO: 52768 - RNA, 64 nt, Homo Sapiens; identical to SEQ ID NO: 24309

SEQ ID NO: 52769 - RNA, 64 nt, Homo Sapiens; identical to SEQ ID NO: 24310

SEQ ID NO: 52770 - RNA, 64 nt, Homo Sapiens; identical to SEQ ID NO: 24311

SEQ ID NO: 52771 - RNA, 64 nt, Homo Sapiens; identical to SEQ ID NO: 24312

SEQ ID NO: 52772 - RNA, 64 nt, Homo Sapiens; identical to SEQ ID NO: 24313

SEQ ID NO: 52773 - RNA, 64 nt, Homo Sapiens; identical to SEQ ID NO: 24314

SEQ ID NO: 52774 - RNA, 64 nt, Homo Sapiens; identical to SEQ ID NO: 24315

SEQ ID NO: 52775 - RNA, 64 nt, Homo Sapiens; identical to SEQ ID NO: 24316

SEQ ID NO: 52776 - RNA, 64 nt, Homo Sapiens; identical to SEQ ID NO: 24317

SEQ ID NO: 52777 - RNA, 64 nt, Homo Sapiens; identical to SEQ ID NO: 24318

SEQ ID NO: 52778 - RNA, 64 nt, Homo Sapiens; identical to SEQ ID NO: 24319

SEQ ID NO: 52779 - RNA, 64 nt, Homo Sapiens; identical to SEQ ID NO: 24320

SEQ ID NO: 52780 - RNA, 64 nt, Homo Sapiens; identical to SEQ ID NO: 24321

SEQ ID NO: 52781 - RNA, 64 nt, Homo Sapiens; identical to SEQ ID NO: 24322

SEQ ID NO: 52782 - RNA, 64 nt, Homo Sapiens; identical to SEQ ID NO: 24323

SEQ ID NO: 52783 - RNA, 64 nt, Homo Sapiens; identical to SEQ ID NO: 24324

SEQ ID NO: 52784 - RNA, 64 nt, Homo Sapiens; identical to SEQ ID NO: 24325

SEQ ID NO: 52785 - RNA, 64 nt, Homo Sapiens; identical to SEQ ID NO: 24326

SEQ ID NO: 52786 - RNA, 64 nt, Homo Sapiens; identical to SEQ ID NO: 24327

SEQ ID NO: 52787 - RNA, 64 nt, Homo Sapiens
aaguaccuaggggagaaagagccauguaaauaucuguaauaaacuuguagcauauguaaaguuu

SEQ ID NO: 52788 - RNA, 64 nt, Homo Sapiens
uugguuguaaacuauauuucaaaguaaacccuaguguaauaaguuuuauaacuaaaaagguuua

SEQ ID NO: 52789 - RNA, 64 nt, Homo Sapiens
aguguguuauggaguacacccauuuugacacacuuguaauaagagaaucuuucauuugccugcc

SEQ ID NO: 52790 - RNA, 64 nt, Homo Sapiens
ggaaauuguauucccuauaauauacaaauuuuccuguaauaaagucaacuuagaaacuccaagg

SEQ ID NO: 52791 - RNA, 64 nt, Homo Sapiens
uuauaagaugaagcguagugaauuguacagcuguuguaauaaugaccuauuucuauauaaaaua

SEQ ID NO: 52792 - RNA, 64 nt, Homo Sapiens
aaguuuucuuguguuuuucugugagugaaaauuuuguaauaaauuaacaaauuuguacaauuuc

SEQ ID NO: 52793 - RNA, 64 nt, Homo Sapiens
uuuucaguuaucuucuaccuccuguauuuucuacuguaauaauguaauuuaaggccuuccacaa

SEQ ID NO: 52794 - RNA, 64 nt, Homo Sapiens
gcccggagcccugcucaucaaugaaaaacccauauguaauaaucgaauucauuuaacaugaauc

SEQ ID NO: 52795 - RNA, 64 nt, Homo Sapiens
aaaugagcuuucucuauagcggaaguuaaacaauuguaauaauguuuuauaacccauguuacaa

SEQ ID NO: 52796 - RNA, 64 nt, Homo Sapiens
uuuauuucugugaguuuugucuauaugcuguauauguaauaagguauguagcauauauacaugg

SEQ ID NO: 52797 - RNA, 64 nt, Homo Sapiens
accauaguagcucagacccaaacugacccaaauauguaauaaaucuauauuuuuaaacugguga

SEQ ID NO: 52798 - RNA, 64 nt, Homo Sapiens
aaggcaguccgcauucuuccaguugugaaauuucuguaauaacauucgggguugucauuaagua

SEQ ID NO: 52799 - RNA, 64 nt, Homo Sapiens
uuauuuuccuuggccuucaagcuuccaaaaaacuuguaauaaucauguuagcuauagcuuguau

SEQ ID NO: 52800 - RNA, 64 nt, Homo Sapiens
uuaauuuuuagaaauucaugggaaauuggauuuuuguaauaaucuuuugauguuuuaaacauug

SEQ ID NO: 52801 - RNA, 64 nt, Homo Sapiens
auuaaaucacaguucagaugaaacugaauaucauuguaauaaucucauaauauauauuuguaac

SEQ ID NO: 52802 - RNA, 64 nt, Homo Sapiens
guauucaguguuuugccaauuaauauuauaugcuuguaauaaaagcaaaagaaaagcuuaagug

SEQ ID NO: 52803 - RNA, 64 nt, Homo Sapiens
uuauugccucauaccauuuuaaugauuaaaucaauguaauaaaugauauauguuuacaguguag

SEQ ID NO: 52804 - RNA, 64 nt, Homo Sapiens
gcuaauaaaauuauauugaaaaugugaauuuugauguaauaacuacaguccucuggauccucua

SEQ ID NO: 52805 - RNA, 64 nt, Homo Sapiens
gaaaaguagagcaaagagccugacaaauguuaaguguaauaauauguucuggcaccaaaaguaa

SEQ ID NO: 52806 - RNA, 64 nt, Homo Sapiens
augauggugccuucuauuaauuguucucugguaauguaauaagcaaauugucuuuacuguauuu

SEQ ID NO: 52807 - RNA, 64 nt, Homo Sapiens
uguggucacaugaugugcauagagauagcuacaguguaauaauuuacacuauuuugugcuccaa

SEQ ID NO: 52808 - RNA, 64 nt, Homo Sapiens
agcuucuaugcauuaagaguaaaauuccucuuacuguaauaaaaacaauugaagaagacuguug

SEQ ID NO: 52809 - RNA, 64 nt, Homo Sapiens
uuacauugccuaaaguagaauguguaaguaaugcuguaauaauacauaucauaguauauuauaa

SEQ ID NO: 52810 - RNA, 64 nt, Homo Sapiens
uguuuaauaggaaauauauaauaauagcauuuuauguaauaaaauaugggcaacgauuaucuug

SEQ ID NO: 52811 - RNA, 64 nt, Homo Sapiens
uagcccucauuagguauuuagaugugaaaaaaacuguaauaauugagauguaauaaauguaaug

SEQ ID NO: 52812 - RNA, 64 nt, Homo Sapiens
guaauggaugugaaaaaaacauccuugagagagauguaauaaaucaaagcucaucgaagaauac

SEQ ID NO: 52813 - RNA, 64 nt, Homo Sapiens
uucuacaugaggacucauauauuuaagccuuuuguguaauaagaaaguauaaagucacuuccag

SEQ ID NO: 52814 - RNA, 64 nt, Homo Sapiens
gugauuuccuacagaaauacugcucugaauauuuuguaauaaaggucuuugcacaugugaccac

SEQ ID NO: 52815 - RNA, 64 nt, Homo Sapiens
ucagggaauuuguauuggagaaaaacccugcaaauguaauaaauauggaaaaacauuuuuucaa

SEQ ID NO: 52816 - RNA, 64 nt, Homo Sapiens
aaaauuaauuaucauuuuguugauugugcuuuuauguaauaaaaugcaguacuuuaaaacauuu

SEQ ID NO: 52817 - RNA, 64 nt, Homo Sapiens
uucuaaugugguauuuuaaauaaaguaucauaaauguaauaaguaaauauuuauuuaggaauac

SEQ ID NO: 52818 - RNA, 64 nt, Homo Sapiens
acauucaggacaaaugauuagcccuaaaugaaacuguaauaauuucaguggaaacucaaucugu

SEQ ID NO: 52819 - RNA, 64 nt, Homo Sapiens
uaccauucuaaauaucaccuacuuaugaauaacauguaauaauuuuuaacauuaaugauuccau

SEQ ID NO: 52820 - RNA, 64 nt, Homo Sapiens
guauccuuuaaggcaccugugcuagccuagauuuuguaauaacacugauuuaugagaauggaca

SEQ ID NO: 52821 - RNA, 64 nt, Homo Sapiens
guccuaaagccuuugccauuccuaauacucguuuuguaauaauugcuguauuucuguguaauaa

SEQ ID NO: 52822 - RNA, 64 nt, Homo Sapiens
uaauacucguuuuguaauaauugcuguauuucuguguaauaaaauauaaaaauaaaauauucag

SEQ ID NO: 52823 - RNA, 64 nt, Homo Sapiens
auuuuuaaaaucuccuuucuuuucuagaaacaaauguaauaaauucaauuuuuauuuucuauga

SEQ ID NO: 52824 - RNA, 64 nt, Homo Sapiens
auuauuuguauuuuuaaguuggauuucaaaucuuuguaauaaaacuuaguucagacucauauau

SEQ ID NO: 52825 - RNA, 64 nt, Homo Sapiens
aucuggaauggacccauccggauuauucauacgguguaauaagcaaugaccaaagugaagagca

SEQ ID NO: 52826 - RNA, 64 nt, Homo Sapiens
guacuuccuggaagugucuuucuuaagaugccaauguaauaaauagaauaaaaggaacagaaau

SEQ ID NO: 52827 - RNA, 64 nt, Homo Sapiens
uuugguauuuaauucuugaucuuucagaguugaauguaauaauggcuuuaagauuucuauccau

SEQ ID NO: 52828 - RNA, 64 nt, Homo Sapiens
uaacugacucacaacaccugguuuacauuuuaucuguaauaagaguguggacauccugggacuu

SEQ ID NO: 52829 - RNA, 64 nt, Homo Sapiens
aaucguaaaaguuguaaauuuaggucaguucuacuguaauaacuaauuauuuagaugugaaugu

SEQ ID NO: 52830 - RNA, 64 nt, Homo Sapiens
caagggccuaucuccuuuaauuaacauuucggcauguaauaaaaaugaacuaaaauuucuaaca

SEQ ID NO: 52831 - RNA, 64 nt, Homo Sapiens
uuacaugaucaugggugugguaauauuucaugauuguaauaaugaauguuaaucacgaauguag

SEQ ID NO: 52832 - RNA, 64 nt, Homo Sapiens
caggcuuagaacaucaauucagugugaugucccauguaauaaaaccuucagugaaauuaagggu

SEQ ID NO: 52833 - RNA, 64 nt, Homo Sapiens
acauaaaccuguaaugaaugaggcugggcuuuucuguaauaagcuuccuuuuauaauacugguc

SEQ ID NO: 52834 - RNA, 64 nt, Homo Sapiens
cucuuacugauugaaagauuuuuuauguuuuccuuguaauaaaggaccuaaaccgaagguaccu

SEQ ID NO: 52835 - RNA, 64 nt, Homo Sapiens
ucaacuucauauuuuaaaaaguauaucugaaauuuguaauaaaaauaaaauaauuuucuaaugu

SEQ ID NO: 52836 - RNA, 64 nt, Homo Sapiens
aagggcuucauuccuuuuauagaaauugguggguuguaauaaucccuuauagcaucuuagucuu

SEQ ID NO: 52837 - RNA, 64 nt, Homo Sapiens
aacauuuacuauuuuugaagacuagugagauuucuguaauaauuuuaauucuuuaaaaagugaa

SEQ ID NO: 52838 - RNA, 64 nt, Homo Sapiens
uuucagucaaacaguaaagacuuuauuuauggauuguaauaacaaccacaagaaaagccauaca

SEQ ID NO: 52839 - RNA, 64 nt, Homo Sapiens
agaccgcagagaccauaccuguugucaaagaggguguaauaaacuguaauaauaaucaugacca

SEQ ID NO: 52840 - RNA, 64 nt, Homo Sapiens
gaccauaccuguugucaaagaggguguaauaaacuguaauaauaaucaugaccacaaaccauaa

SEQ ID NO: 52841 - RNA, 64 nt, Homo Sapiens
aaaauauuuaugaacuauauuucucauugcacucuguaauaaaaagcaguuaguuguuacuuac

SEQ ID NO: 52842 - RNA, 64 nt, Homo Sapiens
cuauugauggauauuuguauuuuuuauacuuuuguguaauaauaaaaauacugcuguaaauauu

SEQ ID NO: 52843 - RNA, 64 nt, Homo Sapiens
ugugagaagucacacaggggagaaacccuaugaauguaauaaaugugggaaagccuuuucucag

SEQ ID NO: 52844 - RNA, 64 nt, Homo Sapiens
gaaugaaaaaaaucaaaauacaaaugaaacauuguguaauaauauuuauguaaauuggaaugaa

SEQ ID NO: 52845 - RNA, 64 nt, Homo Sapiens
ugcaguacauuuuuaaauuuuauuuguacuuuuauguaauaaaaaaauuaguacguuauuuuac

SEQ ID NO: 52846 - RNA, 64 nt, Homo Sapiens
uugaaaaaaaaguuuuccaaaaaaacccugcaaauguaauaaauucagggaauucagauuggag

SEQ ID NO: 52847 - RNA, 64 nt, Homo Sapiens
uacacauugugacguuuaguauacaguugccuuuuguaauaacuuuuuuuuuguaaauacauau

SEQ ID NO: 52848 - RNA, 64 nt, Homo Sapiens
auuaucgcaauuauccauaacauuuauauagcgguguaauaacugcagcaguucugaaaugaug

SEQ ID NO: 52849 - RNA, 64 nt, Homo Sapiens
uugacaaggcccaaaguugacaaaaguccaaaaauguaauaauucauuuauucacaagcaaccc

SEQ ID NO: 52850 - RNA, 64 nt, Homo Sapiens
cauuuauaucagaaaccuuuuuuguuagucaucauguaauaagcagaauguacucauacagauu

SEQ ID NO: 52851 - RNA, 64 nt, Homo Sapiens
gccaaaggccucuguaugaaaacacuaauuuaaauguaauaaaguaaauagauauucuauauua

SEQ ID NO: 52852 - RNA, 64 nt, Homo Sapiens
uggucuucacaguaauauuccuugucucucaaagcuauuauauauugcuuugucuuggccaauu

SEQ ID NO: 52853 - RNA, 64 nt, Homo Sapiens
cagucccugcugacauuuuuuuccuaaccuuuugcuauuauaaauaaugauucauuuuauaacc

SEQ ID NO: 52854 - RNA, 64 nt, Homo Sapiens
auuucccaacaggugaacugaaaaguuauuuuaacuauuauacauaaucaagauccugccucua

SEQ ID NO: 52855 - RNA, 64 nt, Homo Sapiens
agcuacuuggggugguaguagaggauuagguugucuauuauaaaaccaaaacucauucguuuaa

SEQ ID NO: 52856 - RNA, 64 nt, Homo Sapiens
uuucagauaaguguaacuaaaugcaccaauuguccuauuauaaugauaguaauaugaaugugac

SEQ ID NO: 52857 - RNA, 64 nt, Homo Sapiens
ucagagaaagauugagaauggugcuuuuauaccacuauuauauaaauagugagcauuucaugaa

SEQ ID NO: 52858 - RNA, 64 nt, Homo Sapiens
uuaugaauaucaaaauuuguaauugauuuaauagcuauuauaguauuuugaaaggcuauuuuga

SEQ ID NO: 52859 - RNA, 64 nt, Homo Sapiens
ugggaccucucuuuuagaccaggagaaaagcauacuauuauauccaauaccacacccucaugga

SEQ ID NO: 52860 - RNA, 60 nt, Homo Sapiens
aacagaaaaagaaaagaugaauaucaauaccuauuauaucuguguggaguagguuuucuc

SEQ ID NO: 52861 - RNA, 64 nt, Homo Sapiens
acagguuuaaaacaacuuuuuuggggauuuagggcuauuauaggaauaguuuguugucagaagc

SEQ ID NO: 52862 - RNA, 64 nt, Homo Sapiens
acacuaaugguagaaugcuuuuuuaugugcuagacuauuauauuuaguaguaugucauuguaac

SEQ ID NO: 52863 - RNA, 64 nt, Homo Sapiens
uuuuuauguacaauauugauagugagagguaugucuauuauaauaaagauuauggcacaguaaa

SEQ ID NO: 52864 - RNA, 64 nt, Homo Sapiens
uaugaaauuuuagauagcagcgaguccuucguuugaucaauaaacaguguuacagauaacuuca

SEQ ID NO: 52865 - RNA, 64 nt, Homo Sapiens
gaguacauauauaggcaauaaauauauaugcucagaucaauauacuuguuuagaaaaacuucaa

SEQ ID NO: 52866 - RNA, 64 nt, Homo Sapiens
caggcccacuccagaauggcaaggaguacccagggccugguaccggaggccagccugguaccaa

SEQ ID NO: 52867 - RNA, 64 nt, Homo Sapiens
aaaaggaguacccagggccugaaucaggaggccagccugguaccgugccgagccaacgccucag

SEQ ID NO: 52868 - RNA, 64 nt, Homo Sapiens
aaggugcccauuguucagagccuaagcagccccugccugguaagguuaggucugcugaccuuua

SEQ ID NO: 52869 - RNA, 64 nt, Homo Sapiens
cagaaauguaccuguguuuauccucuuagagcuggccugguacucucucaacucaugguuuguu

SEQ ID NO: 52870 - RNA, 64 nt, Homo Sapiens
accaacgccgcauaggacugcccacaugggaccgcccacauaggaccgcccacauaggaccgcc

SEQ ID NO: 52871 - RNA, 64 nt, Homo Sapiens
ggacugcccacaugggaccgcccacauaggaccgcccacauaggaccgcccacaugggaccgcc

SEQ ID NO: 52872 - RNA, 64 nt, Homo Sapiens
ggaccgcccacaugggaccgcccacaugggaccgcccacauagaaccguccuccaguggugaag

SEQ ID NO: 52873 - RNA, 64 nt, Homo Sapiens
aguggaacuuacaugugucccucgccuucccucucccacauaugagagacucagcaaaaacagg

SEQ ID NO: 52874 - RNA, 64 nt, Homo Sapiens
ccucuggagaccgccuagauucgaagaaguacaacccacauagcuggugacucucacaugggca

SEQ ID NO: 52875 - RNA, 64 nt, Homo Sapiens
caagcuggggagggauguggaggggaaaaagaugacagagaaguggacuccaaaccucauuuua

SEQ ID NO: 52876 - RNA, 64 nt, Homo Sapiens
cagucuauaauuaacugacagaccuaacugaagcacagagaauacaucagacuuaugcauccaa

SEQ ID NO: 52877 - RNA, 64 nt, Homo Sapiens
aaaccgcaaacgugaaauucaguucaugucugaaacagagaaccagguuuuucaucugaaaagc

SEQ ID NO: 52878 - RNA, 64 nt, Homo Sapiens
uccugcuacuuccccagcuccugucuucagucucacagagaagcgaggagaaguauuccuguug

SEQ ID NO: 52879 - RNA, 64 nt, Homo Sapiens
uagccuuuuuuccccagacuuguuggcguaggcuacagagaagccuucaagcucugagggaaag

SEQ ID NO: 52880 - RNA, 64 nt, Homo Sapiens
gaaaaacaggcacuuggcagccuugugaugucauacagagaagucacagggcaguaccugaggg

SEQ ID NO: 52881 - RNA, 64 nt, Homo Sapiens
gguccaaugagcuuucugaacagcugguguagcuacagagaaaccagcuuccuucagagagcag

SEQ ID NO: 52882 - RNA, 64 nt, Homo Sapiens
gcuuauuuauuguauucugggguauggcguaaguacagagaagccaucaccucagauggcagcu

SEQ ID NO: 52883 - RNA, 64 nt, Homo Sapiens
uggccauggagaaagcugacuuggcuggugugguacagagaagccagcuuguuuacaugcuuau

SEQ ID NO: 52884 - RNA, 64 nt, Homo Sapiens
agguaagagaugcuaacuauuuuucaagcaagcuacagagaaaugauaaauguuuuuuguuuua

SEQ ID NO: 52885 - RNA, 64 nt, Homo Sapiens
gaagaggaaauguuuacuuccaaauuaggaugugacagagaagggauagggaaauccucucugc

SEQ ID NO: 52886 - RNA, 64 nt, Homo Sapiens
ugguguuuccaugguagaugugacaaugagggccacagagaaggccucgggaacucugccccuc

SEQ ID NO: 52887 - RNA, 64 nt, Homo Sapiens
ccccccggagcuccucgcucacgcaggauggaagacagagaagaaaggguccaggagaacugag

SEQ ID NO: 52888 - RNA, 64 nt, Homo Sapiens
ugcauccgcuugcccugccuccaucccgcagggcacagagaagccucuucugccccugccagau

SEQ ID NO: 52889 - RNA, 64 nt, Homo Sapiens
uuguuuauaacagaugguauaagagagguaauaaacagagaaaaaucuaugcuuguaaagaaua

SEQ ID NO: 52890 - RNA, 64 nt, Homo Sapiens
uuaguaauuugcaaaagccaauggaaaaguagucacagagaaauccaaccaaauuacuuaagaa

SEQ ID NO: 52891 - RNA, 64 nt, Homo Sapiens
aagaaaaugacauuucugggacaauauauaacacacagagaauuauuugagugaauaggagaaa

SEQ ID NO: 52892 - RNA, 64 nt, Homo Sapiens
cggaggcuguugcuuuuaucccuaaacugcauccacagagaagccccaagaaggagguuggggc

SEQ ID NO: 52893 - RNA, 64 nt, Homo Sapiens
cagucauauuuagaacaaagucaaguauaaauuuacagagaaaaaauucuaagacaguuggaug

SEQ ID NO: 52894 - RNA, 64 nt, Homo Sapiens
ucaauguaauucccuucccagcuacccaaaugcuacagagaaauguuuucuacuuggccacuau

SEQ ID NO: 52895 - RNA, 64 nt, Homo Sapiens
ccuuuuuuauuuuucuucuguacagucuaaagcuacagagaaaaaaaaaugcacucuucccuug

SEQ ID NO: 52896 - RNA, 64 nt, Homo Sapiens
uugacauggaaugccuuugaccauuggugcucugacagagaagucauggagucauugccauuuc

SEQ ID NO: 52897 - RNA, 64 nt, Homo Sapiens
uaaaguccuuuucucuuacagguauuaaaugaggacagagaaccucagguguucuuaugcuagu

SEQ ID NO: 52898 - RNA, 64 nt, Homo Sapiens
uuuuuucucaaaaagaaacuguaggaaauacaugacagagaaaguuacacucagggagcagcag

SEQ ID NO: 52899 - RNA, 64 nt, Homo Sapiens
uucaucuaucgcaaaguaaaaauguaaaauccuuacagagaauuguuucacaaaacuuauauuu

SEQ ID NO: 52900 - RNA, 64 nt, Homo Sapiens
uauuuuguguucaaauaaacagccaauuuuauagacagagaaagaugcugcugcuacugcuaac

SEQ ID NO: 52901 - RNA, 64 nt, Homo Sapiens
gccucagaggacaccugcagucagcagacagaguacagagaaggagucaaaauaccccauuccc

SEQ ID NO: 52902 - RNA, 64 nt, Homo Sapiens
gcaaucuacaaaacuacaccuuucaugugguaggacagagaacgaacagaaggccgaauccaag

SEQ ID NO: 52903 - RNA, 64 nt, Homo Sapiens
gaaggccgaauccaaguuucuuucauguaguaggacagagaacauagugaaggcugaauccaag

SEQ ID NO: 52904 - RNA, 64 nt, Homo Sapiens
cgcuucccaacuucauacuguucuguucugggggacagagaaggccacagagaacaagaguuug

SEQ ID NO: 52905 - RNA, 64 nt, Homo Sapiens
agaguuuguucuguucugggccuuuuccccaaccacagagaacacuagguccaagccccccaca

SEQ ID NO: 52906 - RNA, 64 nt, Homo Sapiens
ugccuuuguggcaacugaagguuacgaacaauucacagagaauucauguugacaccaaccucac

SEQ ID NO: 52907 - RNA, 64 nt, Homo Sapiens
gaucagagaggaaaaacuggcugcugacagauacacagagaagagugcugcucccaggagacca

SEQ ID NO: 52908 - RNA, 64 nt, Homo Sapiens
guuuauagauaacugcuggucuuaauugcagaguacagagaacugaaccagcuccugauauugu

SEQ ID NO: 52909 - RNA, 64 nt, Homo Sapiens
gacuucuacuauauacauuucucugucccugagaacagagaaacguaacccuguaggggacugg

SEQ ID NO: 52910 - RNA, 64 nt, Homo Sapiens
uggugucacagauacaucgccaaagcucuguagcacagagaaugccaaaaaccauguuuuaugu

SEQ ID NO: 52911 - RNA, 64 nt, Homo Sapiens
uccuguguguuucucuguacgcuaccuuuaggagacagagaagaccuccaucucugccuccaug

SEQ ID NO: 52912 - RNA, 64 nt, Homo Sapiens
gguugaugucagacccagacagaaacacacaggaacagagaaauaagauaggagauagcucugu

SEQ ID NO: 52913 - RNA, 64 nt, Homo Sapiens
gguugauucuggacccagauggauacucauggguacagagaaauaagaugagagagaacucugu

SEQ ID NO: 52914 - RNA, 64 nt, Homo Sapiens
ggucgauuccagacccagacggaaacccguagauacagagaaguaagauggaagagaguucuuu

SEQ ID NO: 52915 - RNA, 64 nt, Homo Sapiens
ugcagcugagagaaaauaauuacuuuguguuucagccauguauucuacaugaucuagagccagu

SEQ ID NO: 52916 - RNA, 64 nt, Homo Sapiens
guucccuuauauuaauauucucauccuuuucauugccauguaggaugucauguguacaaaaguu

SEQ ID NO: 52917 - RNA, 64 nt, Homo Sapiens
aacuaccaauuccagguuaacuuuguuggagaauuucccccacccccauccagugggucaccca

SEQ ID NO: 52918 - RNA, 64 nt, Homo Sapiens
auuuauucagccuucucuacaggaaucucuuauguucccccacaugcaggugguuuuucaguag

SEQ ID NO: 52919 - RNA, 64 nt, Homo Sapiens
gcagcagcaucucaugcauaacccuguggcuugcuucccccagggcagcacaggcuaagucagg

SEQ ID NO: 52920 - RNA, 64 nt, Homo Sapiens
acagcaggugaaugggugcccuacggggcccuccuucccccaccaggaacagauggaaccugcc

SEQ ID NO: 52921 - RNA, 64 nt, Homo Sapiens
gucucuuauucuuaucucuuaagaauuuugguucuucccccagugauugcugguugaauucuua

SEQ ID NO: 52922 - RNA, 64 nt, Homo Sapiens
uugcugguugaauucuuauauggacagguuucccuucccccaguaucgcacaugguucuaguua

SEQ ID NO: 52923 - RNA, 64 nt, Homo Sapiens
caaccaaucuuuuucuuuuuuggacgguuaaaccuucccccacuuguguccucccuuuguucag

SEQ ID NO: 52924 - RNA, 64 nt, Homo Sapiens
uucugucgcaugcagugccuccuuuccucuuucauucccccaacccauccuugaauccuuuauc

SEQ ID NO: 52925 - RNA, 64 nt, Homo Sapiens
gcccugcccuagacccugccagaaaagggggcucuucccccagagaaguggcuuggagggaacu

SEQ ID NO: 52926 - RNA, 64 nt, Homo Sapiens
cugucuccugggaaugcuggaccagggggauuacuucccccacccacacccccauuuggacauc

SEQ ID NO: 52927 - RNA, 64 nt, Homo Sapiens
ugucuggcauuuuguagucuuaacuucuccccauuucccccaucuuuugguugccuuaaaagaa

SEQ ID NO: 52928 - RNA, 64 nt, Homo Sapiens
uucauaugcuucaaacuaacacauuuuuaaagcuuucccccacuuuucucucuauuuguauugu

SEQ ID NO: 52929 - RNA, 64 nt, Homo Sapiens
gccaccauguaggccaccacuccaggccguggacuucccccaacuuggggacagccuuauuccc

SEQ ID NO: 52930 - RNA, 64 nt, Homo Sapiens
ugggggucugggggguacccucugggguuauagauucccccacugccccagcucugacuggacc

SEQ ID NO: 52931 - RNA, 64 nt, Homo Sapiens
caugaccucuuggccucuccuuugauucucaaucuucccccaaagcaugguuuggugccagccc

SEQ ID NO: 52932 - RNA, 64 nt, Homo Sapiens
uucauuguuugacguuuccacugcaugccuugacuucccccaccuccuccucaaacaagagacu

SEQ ID NO: 52933 - RNA, 64 nt, Homo Sapiens
acaugggagcuuggagcuaauacgacacucugccuucccccagaaggugcaggcuuuccugagu

SEQ ID NO: 52934 - RNA, 64 nt, Homo Sapiens
gucaaagaagccccuagcugcucucguggccuccuucccccacucccuaucccuucaccuguga

SEQ ID NO: 52935 - RNA, 64 nt, Homo Sapiens
aacuucagccuguccacacaaucuaucucuugccuucccccaugcaagccucucuggcccacau

SEQ ID NO: 52936 - RNA, 64 nt, Homo Sapiens
uccuucaguaccagucuauaaguagucucugaaguucccccauucccagauacaaguaccaaac

SEQ ID NO: 52937 - RNA, 64 nt, Homo Sapiens
ggauugcuucuugugaaaccacaggcccuugggguucccccagacagagccgcaaaucaacccc

SEQ ID NO: 52938 - RNA, 64 nt, Homo Sapiens
gcaccauggaggcaggcucccccugccuuugaaauucccccacuugggagcuuguauauacuuc

SEQ ID NO: 52939 - RNA, 64 nt, Homo Sapiens
augggcuucacuaaccuucccuaggcauugaaacuucccccaaaucugauggaccuagaagucu

SEQ ID NO: 52940 - RNA, 64 nt, Homo Sapiens
uaaauagaaguccuuauguauguguuacaagaauuucccccacaacauccuuuaugacugaagu

SEQ ID NO: 52941 - RNA, 64 nt, Homo Sapiens
accuccaagcaaguagcuuuaguucccccaucaguucccccaguggaguuccuaacaggaugaa

SEQ ID NO: 52942 - RNA, 64 nt, Homo Sapiens
aguucccccaguaccuccaauaacaggaugaaaguucccccaucggaauggaaagcggaguucc

SEQ ID NO: 52943 - RNA, 64 nt, Homo Sapiens
gggcucugccccaccuggagcucuuggagaguuguucccccaggccgcccaccuccugcggaua

SEQ ID NO: 52944 - RNA, 64 nt, Homo Sapiens
accucuuauuuauuuggugugcucuugucucuucuucccccacuaccacacacccuuugggaaa

SEQ ID NO: 52945 - RNA, 64 nt, Homo Sapiens
gcuuugggggagaauccacccucccaucaucugcuucccccaaggccucccacaggugacagaa

SEQ ID NO: 52946 - RNA, 64 nt, Homo Sapiens
gucugaagauuaguucaggggauggaccaagaauuucccccagagcuuuaaagaagugggacuc

SEQ ID NO: 52947 - RNA, 64 nt, Homo Sapiens
ugauagggucuaccacaucuguaaugucuguccuuucccccacuuuuacugggaauugauaguc

SEQ ID NO: 52948 - RNA, 64 nt, Homo Sapiens
aaauguuucuaggggagagcauuggaaaauccccuucccccaucuagaucgaaggaagaugagg

SEQ ID NO: 52949 - RNA, 64 nt, Homo Sapiens
cccacugucccucaugugccggugcuucuuccucuucccccaccgggugggccaaaggcuacag

SEQ ID NO: 52950 - RNA, 64 nt, Homo Sapiens
ucucuuucucugaccccucccugcuuuuucucucuucccccacuccgugcaucgugucucuucu

SEQ ID NO: 52951 - RNA, 64 nt, Homo Sapiens
ccugcuccauuaccaaccgaaggcucggucuuaauucccccaccugucuaaggggaacagaaaa

SEQ ID NO: 52952 - RNA, 64 nt, Homo Sapiens
aaggggaacagaaaaccccugccaaaacuacccuuucccccauggggugcugugaaacucaagg

SEQ ID NO: 52953 - RNA, 64 nt, Homo Sapiens
acugcagcaccuccaggccucuccaccuuccauuuucccccacuccugcagcaaacacuccacc

SEQ ID NO: 52954 - RNA, 64 nt, Homo Sapiens
ccauccauuaggccagcaacccugucccacccccuucccccagcccagagccccuccuccagcc

SEQ ID NO: 52955 - RNA, 64 nt, Homo Sapiens
uucaacuugauccacugaggaagagggggcucgcuucccccauuuccauggccacccucuccca

SEQ ID NO: 52956 - RNA, 64 nt, Homo Sapiens
caccacuggcaggguugcccaccagauggguguuuucccccaucccccggcacccuuuaacacc

SEQ ID NO: 52957 - RNA, 64 nt, Homo Sapiens
cagggcuggggaguugugcaggcuggggugacccuucccccaucauugggccccaacgggcaug

SEQ ID NO: 52958 - RNA, 64 nt, Homo Sapiens
cagggcuuaccaccugccaccaagguuuccucucuucccccaggaccugggcagagcaggcaug

SEQ ID NO: 52959 - RNA, 64 nt, Homo Sapiens
gcugcugugagggguccuugcguggcccccauccuucccccaaugcagaacuccaugggcaggg

SEQ ID NO: 52960 - RNA, 64 nt, Homo Sapiens
gccuugggcagugggggugcuccugucuguccuuuucccccacacccuggacugugcuuggcug

SEQ ID NO: 52961 - RNA, 64 nt, Homo Sapiens
uuucuuucuuucuuuuuuucuuuuuuaaaguaauuucccccacaguaaaauacacugacuccug

SEQ ID NO: 52962 - RNA, 64 nt, Homo Sapiens
aauggagacauucugauggaauuugggcaccuguuucccccaccuacuccaauauuugcuggag

SEQ ID NO: 52963 - RNA, 64 nt, Homo Sapiens
gaagggcuucugggaccaauuccagcuccugacauucccccaguccugccucucccccauccua

SEQ ID NO: 52964 - RNA, 64 nt, Homo Sapiens
cuccucuuagcuggcucugcucauccagaggauauucccccaucccccccccaucaaguuuggu

SEQ ID NO: 52965 - RNA, 64 nt, Homo Sapiens
ccauugcccuuccacuugucagucaaauaaauguuucccccacuuuguuuguagcuuuccugga

SEQ ID NO: 52966 - RNA, 64 nt, Homo Sapiens
aaaaaaaaaaaaagaaauucugugguugcagucuuucccccagguguuucugaauguuuguguc

SEQ ID NO: 52967 - RNA, 64 nt, Homo Sapiens
cggcuggguccuuccaguuaccucgccaaugcccuucccccaucuuggggggaggucuggagca

SEQ ID NO: 52968 - RNA, 64 nt, Homo Sapiens
cccagggccacagauccccuauucucugagcacuuucccccaucuggagcugcccuacccccag

SEQ ID NO: 52969 - RNA, 64 nt, Homo Sapiens
gauuuucacacacggaaggaugugggauuuuuuuuucccccaagccugauggccaagaacaccg

SEQ ID NO: 52970 - RNA, 64 nt, Homo Sapiens
ccacuggcucuucuuaauuauuuugguuuucagcuucccccaccccacguaugucuacguggau

SEQ ID NO: 52971 - RNA, 64 nt, Homo Sapiens
acaacauauccguauauauccccucuacucuuacuucccccaaauuuaaagaaguaugggaaau

SEQ ID NO: 52972 - RNA, 64 nt, Homo Sapiens
ccaaauuuaaagaaguaugggaaaugagaggcauuucccccaccccauuucucuccucacacac

SEQ ID NO: 52973 - RNA, 64 nt, Homo Sapiens
gccccuccucuucuuucuccuuccgaguucgcccuucccccaccuccuugucuuuccccgaccg

SEQ ID NO: 52974 - RNA, 64 nt, Homo Sapiens
augagcucugacaaagcuauucccugguguuuuuuucccccacuggggagggggugagguggaa

SEQ ID NO: 52975 - RNA, 64 nt, Homo Sapiens
aaggcagaagcuuggaggagaaaaacuggaagccuucccccagcugggaccuccccagcccagg

SEQ ID NO: 52976 - RNA, 64 nt, Homo Sapiens
cucccaugagacugcccugcugaggccccgccuuuucccccaccgaaaggaggaccagucagga

SEQ ID NO: 52977 - RNA, 64 nt, Homo Sapiens
ugggcuggaagguuccauaaccccugcugcaccauucccccagcgcucccaccucccugaccua

SEQ ID NO: 52978 - RNA, 64 nt, Homo Sapiens
ggcgugcuccuggcuguaguucucaccugccugcuucccccaguccaccagugggcccagcucu

SEQ ID NO: 52979 - RNA, 64 nt, Homo Sapiens
uugacucucgugggaaucccacuguugagguugaucucuucaccucagaaggucucuucagagc

SEQ ID NO: 52980 - RNA, 64 nt, Homo Sapiens
ccacuguugagguugaucucuucaccucagaaggucucuucagagcugcugugcccaguggugc

SEQ ID NO: 52981 - RNA, 64 nt, Homo Sapiens
ccuggaaugagccauggacaucucuuugagcaucucucuucauuggaaugugugugugugugug

SEQ ID NO: 52982 - RNA, 64 nt, Homo Sapiens
ccuggaauguguguguguguugucuuugagcauuucucuucauuugugugugugugugugugug

SEQ ID NO: 52983 - RNA, 64 nt, Homo Sapiens
uguaagucaguauuuuuguccucauguucuugcuucucuucauauuuuuuuugcucuagccugu

SEQ ID NO: 52984 - RNA, 64 nt, Homo Sapiens
auagucaucaugauuuaaaaugcuggugcugaaaucucuucagaacugaauguacaaaucuuag

SEQ ID NO: 52985 - RNA, 64 nt, Homo Sapiens
acuuuuacuaacucacuucgaaguugccauucauucucuucauguccaguauguugcuucccuu

SEQ ID NO: 52986 - RNA, 64 nt, Homo Sapiens
gacuucagcagcaaaccaaauuugaauacauaauucucuucaaagccaaugggcaaagagcuac

SEQ ID NO: 52987 - RNA, 64 nt, Homo Sapiens
gacugugucuggacuuugagcuugagaggggcucucucuucacgcucccagccuggaccuaauu

SEQ ID NO: 52988 - RNA, 64 nt, Homo Sapiens
cuuugcucauggcaugacacgcuguggacacagcucucuucacuggccaaggagaccccuucgu

SEQ ID NO: 52989 - RNA, 64 nt, Homo Sapiens
aaacccuuuucuacaguuaguuugcagcagugagucucuucagauaugaauacagggcaugcau

SEQ ID NO: 52990 - RNA, 64 nt, Homo Sapiens
uucuuagugucacuuaccuaaaaaguucauagggucucuucagguuggaaacggccuccuaggg

SEQ ID NO: 52991 - RNA, 64 nt, Homo Sapiens
uaauugaacauuugguagucuuucaagaauagugucucuucaagguuuuacuugauuuaauuug

SEQ ID NO: 52992 - RNA, 64 nt, Homo Sapiens
aauuccuuauaauugucccugcuccccuucuugaucucuucagggggaauacuaggcaguuuug

SEQ ID NO: 52993 - RNA, 64 nt, Homo Sapiens
accagguacgauucucuuucaccaaaaccugcuaucucuucaucucuagcugcccacagaugcc

SEQ ID NO: 52994 - RNA, 64 nt, Homo Sapiens
ugggaaaacuagcucuucagugggagguguuaugucucuucagcgaugucauagauuccaggcc

SEQ ID NO: 52995 - RNA, 64 nt, Homo Sapiens
uugcuauuugagcaugcacagcugcuuguccugcucucuucaggaggcccuggugucaggcagg

SEQ ID NO: 52996 - RNA, 64 nt, Homo Sapiens
caccucagcugauauuauggcaagugauaucaccucucuucagccccuagugcuauucuguguu

SEQ ID NO: 52997 - RNA, 64 nt, Homo Sapiens
cccaggaauaucccaaacuucggaaacaaguuauucucuucacucccaauaacuaaugcuaaga

SEQ ID NO: 52998 - RNA, 64 nt, Homo Sapiens
augaauuuuuuccagauuugggguauaggucucaucucuucagguucucaugauaccaccuuua

SEQ ID NO: 52999 - RNA, 64 nt, Homo Sapiens
uuucaacaugaguguauuuuuuaaaauugauuuuucucuucauuuuuuuuucaaucaacuuuac

SEQ ID NO: 53000 - RNA, 64 nt, Homo Sapiens
ccugcgggacuuaacgugcucaugggcugugugaucucuucagggugggguggucucugauagg

SEQ ID NO: 53001 - RNA, 64 nt, Homo Sapiens
ucugaaauuugugauggaaucagauuuuaacagcucucuucaaugacauagaaaguucauggaa

SEQ ID NO: 53002 - RNA, 64 nt, Homo Sapiens
uguauauaaaugguuggcagcuuauuccaguugaucucuucacaucugccuuaaaagugcuaug

SEQ ID NO: 53003 - RNA, 64 nt, Homo Sapiens
uuuugggugaggacucauuacugcaguauauugaucucuucaccaaaugcuuuuucuuuuucug

SEQ ID NO: 53004 - RNA, 64 nt, Homo Sapiens
uuacucagccagguuuuguaucuugaauagauccucucuucauuuuuacauuuggucuuaauga

SEQ ID NO: 53005 - RNA, 59 nt, Homo Sapiens
gguccuuagguguaaauugauggaauuuuucucuucaaaucaagaaagaaaagaaauaa

SEQ ID NO: 53006 - RNA, 64 nt, Homo Sapiens
cuggguaugcuucauauuacuggaaugaauuuauucucuucagagagaaauauuagguuagugc

SEQ ID NO: 53007 - RNA, 64 nt, Homo Sapiens
ugccucuguguucacacggccuuucccucugucuucucuucauuaccuuuuaaggacagugucu

SEQ ID NO: 53008 - RNA, 64 nt, Homo Sapiens
gaaaaaaucgaauugguggcacuaucacacacuuucucuucaaucuauccucucucucucuaug

SEQ ID NO: 53009 - RNA, 64 nt, Homo Sapiens
cauccucagaagccucgacuaccuccugacaacgucucuucaagccuaaugauuccgcgcggag

SEQ ID NO: 53010 - RNA, 64 nt, Homo Sapiens
aucuuuaguauuuuccugguuccuaucaucuuagucucuucagguucuaaauguuugggaucau

SEQ ID NO: 53011 - RNA, 64 nt, Homo Sapiens
cuuuuauaaucuccaguggcuuuccagacugucuucucuucagacgcagugaacugucaaggac

SEQ ID NO: 53012 - RNA, 64 nt, Homo Sapiens
agccagagaugacuaauuuagggugacuucuuuuucucuucauuuucuacuguauucccagcac

SEQ ID NO: 53013 - RNA, 64 nt, Homo Sapiens
ggaaaacagggaggggggauaguguucucugcugucucuucacugaaaagcuacuacagggaag

SEQ ID NO: 53014 - RNA, 64 nt, Homo Sapiens
uaagaauuauuugaaugccuagugggcuuuuguaucucuucauucugauuugcauaaaugacuc

SEQ ID NO: 53015 - RNA, 64 nt, Homo Sapiens
uugacugcagacagacugaaagcuccaaaggcuaucucuucauauucaauguaauauuuucugu

SEQ ID NO: 53016 - RNA, 64 nt, Homo Sapiens
ccguuugcaguuucucucuguguugugauucccuucucuucaacguuuucaguacguguuucuc

SEQ ID NO: 53017 - RNA, 64 nt, Homo Sapiens
gauucccuucucuucaacguuuucaguacguguuucucuucaauaaacuucauucaguguucca

SEQ ID NO: 53018 - RNA, 64 nt, Homo Sapiens
agcauugucaagcuccuaaaggguucauuuggccccuccucaaagacuaauguccccaugugaa

SEQ ID NO: 53019 - RNA, 64 nt, Homo Sapiens
caucccacaccccacccucccuucccuucauaccccuccucaacguucuuuuacuuuauacuuu

SEQ ID NO: 53020 - RNA, 64 nt, Homo Sapiens
gguuuggagcacaauggugaagcacacuccccucccuccucaccugggguccaauguucugucu

SEQ ID NO: 53021 - RNA, 64 nt, Homo Sapiens
ccaucaccagcuucuugcucagggagacuuccgcccuccucacugaggcaacaugaagcccgag

SEQ ID NO: 53022 - RNA, 64 nt, Homo Sapiens
cuccagaauuacccuuccucucugccucuaacucccuccucacaaaccccuggcugaacagugc

SEQ ID NO: 53023 - RNA, 64 nt, Homo Sapiens
cagaccaaucuuaguuucuacucugccucauccuccuccucauuagggccucggaggcuccucc

SEQ ID NO: 53024 - RNA, 64 nt, Homo Sapiens
gacggggcucucagggcugggaggaccccagugcccuccucagaagaagcacaugggcuccugc

SEQ ID NO: 53025 - RNA, 64 nt, Homo Sapiens
uaccucacuugggggagcacagggccccgcugggccuccucaccaacggcagugccaaaaucag

SEQ ID NO: 53026 - RNA, 64 nt, Homo Sapiens
gacaccuggggcucuugauccuggcacugcuggcccuccucacccuacuggguguuguucuggc

SEQ ID NO: 53027 - RNA, 64 nt, Homo Sapiens
aagucccagcccaguccccgcgcgcgucccucuuccuccucauacuuucccuugacugagagcu

SEQ ID NO: 53028 - RNA, 64 nt, Homo Sapiens
ugucuuaauuauuauuuguguuuuaauuuaaacaccuccucauguacauacccuggccgccccc

SEQ ID NO: 53029 - RNA, 64 nt, Homo Sapiens
ugggcauuuuuauuuuaugaaauacuauuuaaagccuccucaucccguguucuccuuuuccucu

SEQ ID NO: 53030 - RNA, 64 nt, Homo Sapiens
cuuggaccaguagaggacacggaggguucagaccccuccucagacccuccccacaucugaaacu

SEQ ID NO: 53031 - RNA, 64 nt, Homo Sapiens
ucccguguuaaguccugguuccccaccugcugccccuccucaacacagagccccucccgccgcc

SEQ ID NO: 53032 - RNA, 64 nt, Homo Sapiens
cagccuccuugugagaguggccucccaaagucccccuccucagccuugcuugcugacuuagccu

SEQ ID NO: 53033 - RNA, 64 nt, Homo Sapiens
gggcuuucccccaacucaggcagugaacucggccccuccucaaucgccaaggagggaagagucc

SEQ ID NO: 53034 - RNA, 64 nt, Homo Sapiens
cuagaguaaaagucccaguuuccuuaggaggcccccuccucacgcaguuuacccagcaugacuu

SEQ ID NO: 53035 - RNA, 64 nt, Homo Sapiens
gaucacacugccgucacccaagcugcugcagcucccuccucaggagagaacaucccgcuucuga

SEQ ID NO: 53036 - RNA, 64 nt, Homo Sapiens
gaggcccccaagaugccgcagcuccagggcucuuccuccucaccagaaaucccugggcuuccac

SEQ ID NO: 53037 - RNA, 64 nt, Homo Sapiens
accuuuauuccccagugggcaguuacugagcuuuccuccucagagccaugcuggcagcccuggg

SEQ ID NO: 53038 - RNA, 64 nt, Homo Sapiens
ucccucuauugcggauccacagaggauaaagcccccuccucacauggaggguccuggggacggc

SEQ ID NO: 53039 - RNA, 64 nt, Homo Sapiens
uggauggaagguucuggguggggccucaacugugccuccucaggucuguacccggguaaagugg

SEQ ID NO: 53040 - RNA, 64 nt, Homo Sapiens
guuuuuaauauuaaacacauuacaugauaaucucccuccucaaggguugggcccagccagauaa

SEQ ID NO: 53041 - RNA, 64 nt, Homo Sapiens
augcaggaggcugcccuguaggccggggccacugccuccucagcaguuccuacccaggcugccu

SEQ ID NO: 53042 - RNA, 64 nt, Homo Sapiens
auucucaccaggccaugggauguguugccccucuccuccucacuuuugugacagcagaccuggc

SEQ ID NO: 53043 - RNA, 64 nt, Homo Sapiens
gccauuauaguuuauuguguauuaaucccgugcuccuccucacuaugacagaucuccccacuac

SEQ ID NO: 53044 - RNA, 64 nt, Homo Sapiens
ccacguccuggggucaggccuuaugcccaguguuccuccucaccugccuguuuccgcuacuaua

SEQ ID NO: 53045 - RNA, 64 nt, Homo Sapiens
gcccaugaagaccccuucuccucaggccugcuuaccuccucacacgcucccaucucuacccagu

SEQ ID NO: 53046 - RNA, 64 nt, Homo Sapiens
ugaggaggacgcuguggggugagguccagggcugccuccucauggagcugugugugagcaggcg

SEQ ID NO: 53047 - RNA, 64 nt, Homo Sapiens
gcucuguagaacugcagaccugugcuguuugaugccuccucacugucccgucacuccugggaag

SEQ ID NO: 53048 - RNA, 64 nt, Homo Sapiens
gaggagagggccugugucugacaugccagaggucccuccucacagggacccaccacacacccac

SEQ ID NO: 53049 - RNA, 64 nt, Homo Sapiens
agggcugagcaccuucucugccugcuucccagaaccuccucacugacugcauugagcaggccca

SEQ ID NO: 53050 - RNA, 64 nt, Homo Sapiens
caccagaggacacacaggggagccggaagucaguccuccucauugagagugugagcggggcuuu

SEQ ID NO: 53051 - RNA, 64 nt, Homo Sapiens
caccagaggacacacacaggagccggaagucagaccuccucaguagagagugugggagggcuuu

SEQ ID NO: 53052 - RNA, 64 nt, Homo Sapiens
acucuccuuucaugucccugugccccccaguucuccuccucagccuuuuccuccucaguuuucu

SEQ ID NO: 53053 - RNA, 64 nt, Homo Sapiens
cccugugccccccaguucuccuccucagccuuuuccuccucaguuuucucuuuaaaacugugaa

SEQ ID NO: 53054 - RNA, 64 nt, Homo Sapiens
aacuggggggaaaccgaagggaccaagacugaauccuccucacacucaucaccaucgcccuagg

SEQ ID NO: 53055 - RNA, 64 nt, Homo Sapiens
accaucgcccuagggaccaagccauucccuucuuccuccucaucgcaugaagaucuccguggcu

SEQ ID NO: 53056 - RNA, 64 nt, Homo Sapiens
cacaagccaccucagcuugucagcgggucccuucccuccucagagaagcgugaaccccagggaa

SEQ ID NO: 53057 - RNA, 64 nt, Homo Sapiens
ccucagggaugaccuccugcgcugcugaagcuauccuccucaggugacccagccuucagugugg

SEQ ID NO: 53058 - RNA, 64 nt, Homo Sapiens
ucuaccugcucuucaccaacauccugcugcucaaccuccucaucgccauguucaagugagcgcc

SEQ ID NO: 53059 - RNA, 64 nt, Homo Sapiens
accacggccgccccgccgcgccgccccccuucauccuccucagccaccugcagcucuucaucaa

SEQ ID NO: 53060 - RNA, 63 nt, Homo Sapiens
gaaguuuauacccguuucacaugcuuuucaagaaugucgcaauuacuaagaagcagauaaugg

SEQ ID NO: 53061 - RNA, 63 nt, Homo Sapiens
caugaggcgggcugcaggcccuguuaaggcuaaaugucgcaugagggccgagggcuggugaag

SEQ ID NO: 53062 - RNA, 63 nt, Homo Sapiens
aauccgcuggcuaacaucuggaaggaagcagggaugucgcagggcaacauauuaagaguaugu

SEQ ID NO: 53063 - RNA, 63 nt, Homo Sapiens
gaaacugaagagcaacuuguuagaaaacugacaaugucgcaagauguacucaguuuuguuucu

SEQ ID NO: 53064 - RNA, 63 nt, Homo Sapiens
ggccaaucagugucaucuccuggguaaauuuugaugucgcauuauaaagacaugcauaauuga

SEQ ID NO: 53065 - RNA, 63 nt, Homo Sapiens
gugccuuauauugguuuugguuuggggcacuggaugucgcagcuacugcuaugguuucaggag

SEQ ID NO: 53066 - RNA, 63 nt, Homo Sapiens
auguuugauguccccaaaguaauagucuuuugcaugucgcacauauauuuuguguuauucgug

SEQ ID NO: 53067 - RNA, 63 nt, Homo Sapiens
cuccuccacguggcgggaaucauuguguguggaaugucgcagacagcaggugucuuuaacugu

SEQ ID NO: 53068 - RNA, 63 nt, Homo Sapiens
agaagguucuuugugguuaagcccaucuucauaaugucgcagcuuagucuggccacaugcaua

SEQ ID NO: 53069 - RNA, 63 nt, Homo Sapiens
ugaacaguaucagucgucugggcucaugcugggaugucgcagugcuccuguugcaacuccucc

SEQ ID NO: 53070 - RNA, 63 nt, Homo Sapiens
ggccaggccugcgagaagacccagcuggaguucaugucgcaacagugcgccaggaccgacggc

SEQ ID NO: 53071 - RNA, 63 nt, Homo Sapiens
guaccugcgcgcggcugcggcugggccaucgcgaugucgcacgccguggaccuggcugaggag

SEQ ID NO: 53072 - RNA, 63 nt, Homo Sapiens
cgccgagacucugccguaccacaggacagauggaugucgcacaaugaacuggcuucggacaga

SEQ ID NO: 53073 - RNA, 63 nt, Homo Sapiens
uagcagagguggguagagacacuuaauaguaucaugucgcaugcagaugucacaucggccucu

SEQ ID NO: 53074 - RNA, 63 nt, Homo Sapiens
gcugaaggaaaagcaaccuagaucaccuuauggaugucgcaauaauacaaaccaacguaccuc

SEQ ID NO: 53075 - RNA, 63 nt, Homo Sapiens
gcugugcuuggaggggcaggaaaagaacugagcaugucgcaggcagcgggcccagccugagca

SEQ ID NO: 53076 - RNA, 63 nt, Homo Sapiens
aagaccuguugauccuuuuagauuaaaaauaaaaugucgcauguaaaggcugaagucgcguuu

SEQ ID NO: 53077 - RNA, 63 nt, Homo Sapiens
uucuccacaggcaugugguuaguauuucuaaacaugucgcacucuuacuccugguucccuacc

SEQ ID NO: 53078 - RNA, 63 nt, Homo Sapiens
agcauuucaccccugaagucgaaaccaucacguaugucgcagcuaaggcccuggugucuuaca

SEQ ID NO: 53079 - RNA, 63 nt, Homo Sapiens
aggaagcaggggccggccauucgccacaaugccaugucgcaauggccagccccagacauccua

SEQ ID NO: 53080 - RNA, 63 nt, Homo Sapiens
augaaccaaacuucuggcuaggaccccucaaacaugucgcaaaggaggguugaguuucucuaa

SEQ ID NO: 53081 - RNA, 63 nt, Homo Sapiens
cagaacccccauuccccagccucugcugguagcaugucgcaguuuccauguguuucaggaucu

SEQ ID NO: 53082 - RNA, 63 nt, Homo Sapiens
ugguggacgagaaggugcuugcuuggcucccgaaugucgcauugacucacacuuacugcaaag

SEQ ID NO: 53083 - RNA, 63 nt, Homo Sapiens
cacuccacggcaggucccuagccugcaacauuuaugucgcaugucaauccgaagagugaugcc

SEQ ID NO: 53084 - RNA, 63 nt, Homo Sapiens
uacugcauggacuguauacucgauuucauguguaugucgcaguaaacaaaaccaaaccucuuu

SEQ ID NO: 53085 - RNA, 63 nt, Homo Sapiens
aauaaaaauucaagugugguuucuacugaaugcaugucgcauucgcaccauuguaaagucaag

SEQ ID NO: 53086 - RNA, 63 nt, Homo Sapiens
gugugagggccugaccgggcccagggcaagcagaugucgcaagcccuauuuauucagucuuca

SEQ ID NO: 53087 - RNA, 63 nt, Homo Sapiens
uccguuagaucuugauuuuaccuguggguugccaugucgcacggucuuggcuuaaggagacuu

SEQ ID NO: 53088 - RNA, 63 nt, Homo Sapiens
aauacaaaccaguguaccucgaucaccuuauggaugucgcaaugcugaaggaaaagcaaccua

SEQ ID NO: 53089 - RNA, 63 nt, Homo Sapiens
aaguguguucuccuguugcaaggcuaccgcugcaugucgcacuauggggaggugcccaacgcc

SEQ ID NO: 53090 - RNA, 64 nt, Homo Sapiens
aacuggcagggauagucacuugugaagccuaauuuaccugcaggaaggagcaaacgucuggcua

SEQ ID NO: 53091 - RNA, 64 nt, Homo Sapiens
aagaaaaccugcuuguucaccaccgucacuucuguaccugcauccucccaugucaucaccccac

SEQ ID NO: 53092 - RNA, 64 nt, Homo Sapiens
acagauagcuugcuguauucuguauagcuuacucuaccugcagacagaaaaugaaagaaaaaaa

SEQ ID NO: 53093 - RNA, 64 nt, Homo Sapiens
cuuaauugaaguguaauauagguuguagaauuguuaccugcaguucuaugguuuuguuucacuu

SEQ ID NO: 53094 - RNA, 64 nt, Homo Sapiens
cagugcccgucagccaacugugggccuucaccucuaccugcacuuccccucucacaccagcugc

SEQ ID NO: 53095 - RNA, 64 nt, Homo Sapiens
cgcaugcacgugcacacauguacacacacacaccuaccugcacagcacgcuguugaguguuggu

SEQ ID NO: 53096 - RNA, 64 nt, Homo Sapiens
guaguaaagguuuagacgaauccguauauuucuguaccugcagugucaauucucuaaaaaugug

SEQ ID NO: 53097 - RNA, 64 nt, Homo Sapiens
aauucucucacaaauaaccuauuuaaacauguuuuaccugcagagacacgcuacuguugguuaa

SEQ ID NO: 53098 - RNA, 64 nt, Homo Sapiens
guugcugcgacacgcugacccugacuuuuaucaauaccugcaagaggcaggcgcugaugaccuc

SEQ ID NO: 53099 - RNA, 64 nt, Homo Sapiens
cguccugcgccgggcuagggcucucuuugcugauuaccugcagucagaggugugggacucagag

SEQ ID NO: 53100 - RNA, 64 nt, Homo Sapiens
aagcagagaacuucauaaaaaagagagaaauaauuaccugcacaucaaauuacuagauuuuuua

SEQ ID NO: 53101 - RNA, 64 nt, Homo Sapiens
ucugauguugcauaauacaaauguguauaauuuguaccugcagaaaaccugcucauuaacaugc

SEQ ID NO: 53102 - RNA, 64 nt, Homo Sapiens
uuuuaaacauagauuauauuccucaagaugaagggcuuaacauauccacagcuuccucaguuug

SEQ ID NO: 53103 - RNA, 64 nt, Homo Sapiens
uguaauuccaaaacuuaagaaccauauuuacauugcuuaacacagaauuuuacaucuaagcaag

SEQ ID NO: 53104 - RNA, 64 nt, Homo Sapiens
cacuuuuuagagcggcgucuuaguuuauuuaaacgcuuaacaucuuccaccgcaacagcuugcc

SEQ ID NO: 53105 - RNA, 64 nt, Homo Sapiens
uguaauauagaaaacugucccuuuccaggugggagcuuaacaccuguauaaaaccuaagguuuu

SEQ ID NO: 53106 - RNA, 64 nt, Homo Sapiens
ccuggagcaauugagaggacuguuuaaacacagagcuuaacaauggcagaauuguauaucucgu

SEQ ID NO: 53107 - RNA, 64 nt, Homo Sapiens
cagagcuuaacaauggcagaauuguauaucucgugcuuaacagauuuugguugaacuuuacccu

SEQ ID NO: 53108 - RNA, 64 nt, Homo Sapiens
uauugaugccauuuaaagggauggaugcaaccuagcuuaacaguauaaugcugcaaauuuuccu

SEQ ID NO: 53109 - RNA, 64 nt, Homo Sapiens
agaagugcaacauguaugugcaaaagcuaaaauggcuuaacaucaugcuacacuuuacacuaaa

SEQ ID NO: 53110 - RNA, 64 nt, Homo Sapiens; identical to SEQ ID NO: 50680

SEQ ID NO: 53111 - RNA, 64 nt, Homo Sapiens; identical to SEQ ID NO: 50681

SEQ ID NO: 53112 - RNA, 64 nt, Homo Sapiens; identical to SEQ ID NO: 50682

SEQ ID NO: 53113 - RNA, 64 nt, Homo Sapiens; identical to SEQ ID NO: 50683

SEQ ID NO: 53114 - RNA, 64 nt, Homo Sapiens; identical to SEQ ID NO: 50684

SEQ ID NO: 53115 - RNA, 64 nt, Homo Sapiens; identical to SEQ ID NO: 50685

SEQ ID NO: 53116 - RNA, 64 nt, Homo Sapiens; identical to SEQ ID NO: 50686

SEQ ID NO: 53117 - RNA, 64 nt, Homo Sapiens; identical to SEQ ID NO: 50687

SEQ ID NO: 53118 - RNA, 64 nt, Homo Sapiens; identical to SEQ ID NO: 50688

SEQ ID NO: 53119 - RNA, 64 nt, Homo Sapiens; identical to SEQ ID NO: 50689

SEQ ID NO: 53120 - RNA, 64 nt, Homo Sapiens; identical to SEQ ID NO: 50690

SEQ ID NO: 53121 - RNA, 64 nt, Homo Sapiens; identical to SEQ ID NO: 50691

SEQ ID NO: 53122 - RNA, 64 nt, Homo Sapiens; identical to SEQ ID NO: 50692

SEQ ID NO: 53123 - RNA, 64 nt, Homo Sapiens; identical to SEQ ID NO: 50693

SEQ ID NO: 53124 - RNA, 62 nt, Homo Sapiens; identical to SEQ ID NO: 50694

SEQ ID NO: 53125 - RNA, 62 nt, Homo Sapiens; identical to SEQ ID NO: 50695

SEQ ID NO: 53126 - RNA, 62 nt, Homo Sapiens; identical to SEQ ID NO: 50696

SEQ ID NO: 53127 - RNA, 62 nt, Homo Sapiens; identical to SEQ ID NO: 50697

SEQ ID NO: 53128 - RNA, 62 nt, Homo Sapiens; identical to SEQ ID NO: 50698

SEQ ID NO: 53129 - RNA, 62 nt, Homo Sapiens; identical to SEQ ID NO: 50699

SEQ ID NO: 53130 - RNA, 62 nt, Homo Sapiens; identical to SEQ ID NO: 50700

SEQ ID NO: 53131 - RNA, 62 nt, Homo Sapiens; identical to SEQ ID NO: 50701

SEQ ID NO: 53132 - RNA, 62 nt, Homo Sapiens; identical to SEQ ID NO: 50702

SEQ ID NO: 53133 - RNA, 62 nt, Homo Sapiens; identical to SEQ ID NO: 50703

SEQ ID NO: 53134 - RNA, 64 nt, Homo Sapiens; identical to SEQ ID NO: 50680

SEQ ID NO: 53135 - RNA, 64 nt, Homo Sapiens; identical to SEQ ID NO: 50681

SEQ ID NO: 53136 - RNA, 64 nt, Homo Sapiens; identical to SEQ ID NO: 50682

SEQ ID NO: 53137 - RNA, 64 nt, Homo Sapiens; identical to SEQ ID NO: 50683

SEQ ID NO: 53138 - RNA, 64 nt, Homo Sapiens; identical to SEQ ID NO: 50684

SEQ ID NO: 53139 - RNA, 64 nt, Homo Sapiens; identical to SEQ ID NO: 50685

SEQ ID NO: 53140 - RNA, 64 nt, Homo Sapiens; identical to SEQ ID NO: 50686

SEQ ID NO: 53141 - RNA, 64 nt, Homo Sapiens; identical to SEQ ID NO: 50687

SEQ ID NO: 53142 - RNA, 64 nt, Homo Sapiens; identical to SEQ ID NO: 50688

SEQ ID NO: 53143 - RNA, 64 nt, Homo Sapiens; identical to SEQ ID NO: 50689

SEQ ID NO: 53144 - RNA, 64 nt, Homo Sapiens; identical to SEQ ID NO: 50690

SEQ ID NO: 53145 - RNA, 64 nt, Homo Sapiens; identical to SEQ ID NO: 50691

SEQ ID NO: 53146 - RNA, 64 nt, Homo Sapiens; identical to SEQ ID NO: 50692

SEQ ID NO: 53147 - RNA, 64 nt, Homo Sapiens; identical to SEQ ID NO: 50693

SEQ ID NO: 53148 - RNA, 62 nt, Homo Sapiens; identical to SEQ ID NO: 50694

SEQ ID NO: 53149 - RNA, 62 nt, Homo Sapiens; identical to SEQ ID NO: 50695

SEQ ID NO: 53150 - RNA, 62 nt, Homo Sapiens; identical to SEQ ID NO: 50696

SEQ ID NO: 53151 - RNA, 62 nt, Homo Sapiens; identical to SEQ ID NO: 50697

SEQ ID NO: 53152 - RNA, 62 nt, Homo Sapiens; identical to SEQ ID NO: 50698

SEQ ID NO: 53153 - RNA, 62 nt, Homo Sapiens; identical to SEQ ID NO: 50699

SEQ ID NO: 53154 - RNA, 62 nt, Homo Sapiens; identical to SEQ ID NO: 50700

SEQ ID NO: 53155 - RNA, 62 nt, Homo Sapiens; identical to SEQ ID NO: 50701

SEQ ID NO: 53156 - RNA, 62 nt, Homo Sapiens; identical to SEQ ID NO: 50702

SEQ ID NO: 53157 - RNA, 62 nt, Homo Sapiens; identical to SEQ ID NO: 50703

SEQ ID NO: 53158 - RNA, 64 nt, Homo Sapiens; identical to SEQ ID NO: 50680

SEQ ID NO: 53159 - RNA, 64 nt, Homo Sapiens; identical to SEQ ID NO: 50681

SEQ ID NO: 53160 - RNA, 64 nt, Homo Sapiens; identical to SEQ ID NO: 50682

SEQ ID NO: 53161 - RNA, 64 nt, Homo Sapiens; identical to SEQ ID NO: 50683

SEQ ID NO: 53162 - RNA, 64 nt, Homo Sapiens; identical to SEQ ID NO: 50684

SEQ ID NO: 53163 - RNA, 64 nt, Homo Sapiens; identical to SEQ ID NO: 50685

SEQ ID NO: 53164 - RNA, 64 nt, Homo Sapiens; identical to SEQ ID NO: 50686

SEQ ID NO: 53165 - RNA, 64 nt, Homo Sapiens; identical to SEQ ID NO: 50687

SEQ ID NO: 53166 - RNA, 64 nt, Homo Sapiens; identical to SEQ ID NO: 50688

SEQ ID NO: 53167 - RNA, 64 nt, Homo Sapiens; identical to SEQ ID NO: 50689

SEQ ID NO: 53168 - RNA, 64 nt, Homo Sapiens; identical to SEQ ID NO: 50690

SEQ ID NO: 53169 - RNA, 64 nt, Homo Sapiens; identical to SEQ ID NO: 50691

SEQ ID NO: 53170 - RNA, 64 nt, Homo Sapiens; identical to SEQ ID NO: 50692

SEQ ID NO: 53171 - RNA, 64 nt, Homo Sapiens; identical to SEQ ID NO: 50693

SEQ ID NO: 53172 - RNA, 62 nt, Homo Sapiens; identical to SEQ ID NO: 50694

SEQ ID NO: 53173 - RNA, 62 nt, Homo Sapiens; identical to SEQ ID NO: 50695

SEQ ID NO: 53174 - RNA, 62 nt, Homo Sapiens; identical to SEQ ID NO: 50696

SEQ ID NO: 53175 - RNA, 62 nt, Homo Sapiens; identical to SEQ ID NO: 50697

SEQ ID NO: 53176 - RNA, 62 nt, Homo Sapiens; identical to SEQ ID NO: 50698

SEQ ID NO: 53177 - RNA, 62 nt, Homo Sapiens; identical to SEQ ID NO: 50699

SEQ ID NO: 53178 - RNA, 62 nt, Homo Sapiens; identical to SEQ ID NO: 50700

SEQ ID NO: 53179 - RNA, 62 nt, Homo Sapiens; identical to SEQ ID NO: 50701

SEQ ID NO: 53180 - RNA, 62 nt, Homo Sapiens; identical to SEQ ID NO: 50702

SEQ ID NO: 53181 - RNA, 62 nt, Homo Sapiens; identical to SEQ ID NO: 50703

SEQ ID NO: 53182 - RNA, 64 nt, Homo Sapiens
aaaaggaaguaguuauuuuagcagaaaauuuaauaugaaucaaagcuuauauguaaacuucaag

SEQ ID NO: 53183 - RNA, 64 nt, Homo Sapiens
ucuuaauuuuucuuucaugacaacacauuccaaaaugaaucaugcuuauguacuaagagggaaa

SEQ ID NO: 53184 - RNA, 64 nt, Homo Sapiens
aaaaaaacacccaauaucuucucuuguagacuauaugaaucaauuauuacaucuguuuuacuau

SEQ ID NO: 53185 - RNA, 64 nt, Homo Sapiens
aauucuucuugaguuaaaaaagacacuuuuuauuaugaaucagauuccaaaucauuaacuauuu

SEQ ID NO: 53186 - RNA, 64 nt, Homo Sapiens
uggcuguaccuucuccacaugauggcccaaaguaaugaaucauguccaugucucucguaaaaca

SEQ ID NO: 53187 - RNA, 64 nt, Homo Sapiens
gcccaagacauauuuucugugaacagaaaguuagaugaaucaguaaaaucuggcuuucagugua

SEQ ID NO: 53188 - RNA, 64 nt, Homo Sapiens
accgaaaaaacaugaaauuuuucauuaaaaugccaugaaucaagccagggccguuggcuuaugc

SEQ ID NO: 53189 - RNA, 64 nt, Homo Sapiens
gagacccagccucaaaaaaaaaaaaaaaaaagugaugaaucaaaauuagaaauuaagaguuuua

SEQ ID NO: 53190 - RNA, 64 nt, Homo Sapiens
auagacaaguuuuguuuccuuuuauaguuauuaaauguuucaaaaugugucucaggcucaaguu

SEQ ID NO: 53191 - RNA, 64 nt, Homo Sapiens
aaugcaguucucacgaaaguauuauaaaguucagauguuucaucuugaguuauuccacaaacac

SEQ ID NO: 53192 - RNA, 64 nt, Homo Sapiens
caagugacauuucaaaagaaguucuauaacaauuauguuucaugcuuaaaguaaaaauucccag

SEQ ID NO: 53193 - RNA, 64 nt, Homo Sapiens
auuaaucaugcaguguacaauucaaaaucaugcaauguuucacuuuagaauuggauuugaagaa

SEQ ID NO: 53194 - RNA, 64 nt, Homo Sapiens
gacaguuuuuaacaauaaaucagauguguaucagauguuucacuuugaaucuaccauucauagc

SEQ ID NO: 53195 - RNA, 64 nt, Homo Sapiens
aacagcugaaggguuuuauuguguaauuauacuuauguuucaauuuauaauaccuuuuccuugu

SEQ ID NO: 53196 - RNA, 64 nt, Homo Sapiens
uugaaacagucucuuuugagcugguuuaaucauuauguuucaaauagagacagcccagucucuu

SEQ ID NO: 53197 - RNA, 64 nt, Homo Sapiens
uggggaacugagcuaggcggacuuaacaaaaacaauguuucaucuccucaugccuucaggaaag

SEQ ID NO: 53198 - RNA, 64 nt, Homo Sapiens
uagagauaaggauugcacauuggaaaaguaaaccauguuucauuccuuuuucccuauuuauauu

SEQ ID NO: 53199 - RNA, 64 nt, Homo Sapiens
cagaaaugcccuccaugugucccucuaauguugcauguuucaguggguuggaaguuuuguauau

SEQ ID NO: 53200 - RNA, 64 nt, Homo Sapiens
cuguuggaauugucaucuguacaauuaguccauaauguuucauguuuguccuaagugugcuguu

SEQ ID NO: 53201 - RNA, 64 nt, Homo Sapiens
ugcuaugcagugugaucuuuauuuauaguaaauuauguuucauguaaaugauauauuuuuggug

SEQ ID NO: 53202 - RNA, 64 nt, Homo Sapiens
cgggaaacaugacucuuuaucaaauuuauuuccaauguuucaagccuuuucuuguaucuggauu

SEQ ID NO: 53203 - RNA, 64 nt, Homo Sapiens
ugcacaaguagggcugccucgaaucaguccuagaauguuucauuuuuuuuaucagagucaugau

SEQ ID NO: 53204 - RNA, 64 nt, Homo Sapiens
gcucaccaggcaguaccaaugaacauuaauccacauguuucagacuuuuguccugcaucaucuu

SEQ ID NO: 53205 - RNA, 64 nt, Homo Sapiens
cuccugccguuuucuuccugccaagccugaaucaauguuucaucuccaacccucugccaguuug

SEQ ID NO: 53206 - RNA, 64 nt, Homo Sapiens
cccauugggcccucgucugccucuccaggauuguauguuucaagccuuguccuguguuccuuug

SEQ ID NO: 53207 - RNA, 64 nt, Homo Sapiens
uauggaauauuacuucuaucagaagaugaucaagauguuucaguccagugcacaucagcauugc

SEQ ID NO: 53208 - RNA, 64 nt, Homo Sapiens
ugagcaggaagucuagaaaugauaacuagacuguauguuucaugugugugauuuuucagaauuc

SEQ ID NO: 53209 - RNA, 64 nt, Homo Sapiens
ugaaacauuucagaaauuauuuauugcuuugucuauguuucauagauaaacauauauccucuuu

SEQ ID NO: 53210 - RNA, 64 nt, Homo Sapiens
uuuugaccuagaaaugcgaguucucucauuggccauguuucagaggcgcccucucaauuuaguc

SEQ ID NO: 53211 - RNA, 64 nt, Homo Sapiens
aaugaugcauacagcaauuuuuuauaaguauuucauguuucagaaagcaauguagaguuacgcu

SEQ ID NO: 53212 - RNA, 64 nt, Homo Sapiens
caauuucagaucacugguacuuuauuaagaauugauguuucauucacugguagauauagaagcc

SEQ ID NO: 53213 - RNA, 64 nt, Homo Sapiens
gauacugugcggaaacacacaaaacacaaugugcauguuucaauugucauuccacuugugaaag

SEQ ID NO: 53214 - RNA, 64 nt, Homo Sapiens
acauccaacuguuuguuauaugcuaaauacuguaauguuucaaaguucaguucauagcguagac

SEQ ID NO: 53215 - RNA, 64 nt, Homo Sapiens
auucuuucuaaauuugauaaugaaauuucaaaguauguuucauuuaaucugugagaacaauggu

SEQ ID NO: 53216 - RNA, 64 nt, Homo Sapiens
gacaguuuuaaagggagccagcucuuuaaguaaaauguuucaaaugacaauuuaucuuccauau

SEQ ID NO: 53217 - RNA, 64 nt, Homo Sapiens
gcuggauuuggacaaaaagcaaaucuagacaugcauguuucaggguucaguaguauacuucaug

SEQ ID NO: 53218 - RNA, 64 nt, Homo Sapiens
gacaugcauguuucaggguucaguaguauacuucauguuucauacagauaauucacauucaaaa

SEQ ID NO: 53219 - RNA, 64 nt, Homo Sapiens
aucugcaacugcuugauaagauugauagcugauaauguuucauuagugaaagugccaacaaauu

SEQ ID NO: 53220 - RNA, 64 nt, Homo Sapiens
gaaagaauuuuuucuugaucauguguuuuaccagauguuucauaaauguguauauguaaauaau

SEQ ID NO: 53221 - RNA, 64 nt, Homo Sapiens
cagugacagaccucauauauugugcccuauaaugauguuucagugauuuauuaaauucuaguua

SEQ ID NO: 53222 - RNA, 64 nt, Homo Sapiens
ggguacucugccauagaaauacacaccaaacaagauguuucacuucugcagcagggggugacug

SEQ ID NO: 53223 - RNA, 64 nt, Homo Sapiens
uuugacugccuaagggacagcacgaaugacucacauguuucagacaggccuccacggcuaugga

SEQ ID NO: 53224 - RNA, 64 nt, Homo Sapiens
ccuugguggauuaaccaaggccuuggauuccagaauguuucaugguaagcacuguggagaaccu

SEQ ID NO: 53225 - RNA, 64 nt, Homo Sapiens
gucgucccuuuguuauuuuaugugggagagggaaauguuucagaaacgaaagaucucauccccu

SEQ ID NO: 53226 - RNA, 64 nt, Homo Sapiens
acacauuguccacuucagaugcuuguuuaaaaaaauguuucaccaugugucuuuacccaauaca

SEQ ID NO: 53227 - RNA, 64 nt, Homo Sapiens
uuagagaaauaacuauuacuauaaaaugaaauauauguuucauuuguaauauauauauauauau

SEQ ID NO: 53228 - RNA, 64 nt, Homo Sapiens
cuucagccuuuaaccuauacggauuuuuuuuuguauguuucaagaauauaucuugcucuauaga

SEQ ID NO: 53229 - RNA, 64 nt, Homo Sapiens
aacauuaacuucuaaagaaguuuuuucuaagaaaauguuucaaggcaauauuuuuuuugaggcu

SEQ ID NO: 53230 - RNA, 64 nt, Homo Sapiens
cacuaaacuuuuguguccauauuuuacugagaccauguuucauuaaaagcauaguuucauagua

SEQ ID NO: 53231 - RNA, 64 nt, Homo Sapiens
caacuagaaaugaauggaagucaguuguguggaaauguaugauccuuugaugguucucaugcca

SEQ ID NO: 53232 - RNA, 64 nt, Homo Sapiens
caaacauagaugacuggauuugaguuguggagagauguaugauuaaauggccacucagaugacc

SEQ ID NO: 53233 - RNA, 64 nt, Homo Sapiens
ucucacaaaguugagauuugcuaacccuguagaaauguaugaccauaaauuaugcaggguacuc

SEQ ID NO: 53234 - RNA, 64 nt, Homo Sapiens
ugaauuuaaaaaaccacuaaaauguuuuaaccucauguaugaacagacagaaauggcuauuaaa

SEQ ID NO: 53235 - RNA, 64 nt, Homo Sapiens
agaccagcagcaaaacauaacguugaugaagcacauguaugaggcaugccuagaguagugcucu

SEQ ID NO: 53236 - RNA, 64 nt, Homo Sapiens
auuccuugugagauuacuuauuuacccuguugccauguaugauuuggaagaacugcccugcuuu

SEQ ID NO: 53237 - RNA, 64 nt, Homo Sapiens
ucuucaacugucuuacaagauuuggggcuggaaaauguaugaauuugugauucuguguggccuu

SEQ ID NO: 53238 - RNA, 64 nt, Homo Sapiens
ucuuuguucauauauuaugacaacaggauucuuaauguaugauuuugcucuuaagagcaaauca

SEQ ID NO: 53239 - RNA, 64 nt, Homo Sapiens
aauuguguggcagugauuggucuguuuguggagaauguaugaaagcuauuaauauucuagaaua

SEQ ID NO: 53240 - RNA, 64 nt, Homo Sapiens
uauaucguucucaauucuauagacuuucaagccuauguaugaauaugaagggguuuuuuuuuuu

SEQ ID NO: 53241 - RNA, 64 nt, Homo Sapiens
aaaacaaaaauaccucucuuugcuagagaguuauauguaugacuuaaauuauuagcuaugguuu

SEQ ID NO: 53242 - RNA, 64 nt, Homo Sapiens
uuaaaauacugcaggaugcuuagugcucaguguuauguaugaacuuguggacuuuacaaugcag

SEQ ID NO: 53243 - RNA, 64 nt, Homo Sapiens
uaccucaaagcguugucauguggauugagaugauauguaugaaucacauaaaagagugccuggc

SEQ ID NO: 53244 - RNA, 64 nt, Homo Sapiens
ccuuaagggucuaacuuguaaugaagacagaaauauguaugaggaugaucacugaaauauuuau

SEQ ID NO: 53245 - RNA, 64 nt, Homo Sapiens
uggugagcggacaucuguuauuuagacuuguaaaauguaugaacguagaagaauaucacuuauu

SEQ ID NO: 53246 - RNA, 64 nt, Homo Sapiens
ucacggaagaagcacaaccggugcugaccuuguaauguaugaguacgcuguaacccggcaucga

SEQ ID NO: 53247 - RNA, 64 nt, Homo Sapiens
gauccaguuucuucacaucccaauucagacagcaauguaugauuuuuacauacagccacucaua

SEQ ID NO: 53248 - RNA, 64 nt, Homo Sapiens
aguuucuuccuuuuuuucuuauccaaguuguugcauguaugaaugcauaauucccuugaaaucc

SEQ ID NO: 53249 - RNA, 64 nt, Homo Sapiens
gcacccagcuuugucuguggguuaguauugguguauguaugaguaucuguauguauauauacac

SEQ ID NO: 53250 - RNA, 64 nt, Homo Sapiens
uuguuugcaaacccgaaaauaaaagacguucauuauguaugaaaaguaacugauuuguauucug

SEQ ID NO: 53251 - RNA, 64 nt, Homo Sapiens
gagcaaacauauuugaaaguugaagggcauguauauguaugaauauuuccugcauauauaugua

SEQ ID NO: 53252 - RNA, 64 nt, Homo Sapiens
ggcauguauauguaugaauguuuccugcauauauauguaugaaguguguaugaaugaacauaca

SEQ ID NO: 53253 - RNA, 64 nt, Homo Sapiens
ggaggaguucccugggcuucuggcaccuguuucuaggccuaaccauuaguacuuacugugcagg

SEQ ID NO: 53254 - RNA, 64 nt, Homo Sapiens
cuaaaacuccuuuuaaccaagcuuagcuucucaaaggccuaaccaagccuuggcaccgccagau

SEQ ID NO: 53255 - RNA, 64 nt, Homo Sapiens
uaucugucauggaacugaacauucaucgauggucuccauguauucauuuauucacuuguucauu

SEQ ID NO: 53256 - RNA, 64 nt, Homo Sapiens
acccuuuccccuuuuuccuaccccacagcucuguuccauguaaguugccaacaguuucacugaa

SEQ ID NO: 53257 - RNA, 64 nt, Homo Sapiens
cuaacauuucuauguaguguuguucauuuguucauccauguauuuguucauucauccauccacc

SEQ ID NO: 53258 - RNA, 64 nt, Homo Sapiens
uuuauuuaccaacaucuauuauaucuuucuguguuccauguaaauaaacuaauuauuucucugg

SEQ ID NO: 53259 - RNA, 64 nt, Homo Sapiens
uaugagaagauauugucuccuuuuccauauugauuccauguauuuugucuguuguauaguuuac

SEQ ID NO: 53260 - RNA, 64 nt, Homo Sapiens
uuauuggccauaguuaacuaaacuacaaauuaccuccauguauagaaaaaagaugaaaaacuug

SEQ ID NO: 53261 - RNA, 64 nt, Homo Sapiens
uuguguacuuucuucccuuauucccuguguacccuccauguaccuccauguuuauccauguacu

SEQ ID NO: 53262 - RNA, 64 nt, Homo Sapiens
uucccuguguacccuccaugcacguccauguuuauccauguacuucaugucuuuccuauuugca

SEQ ID NO: 53263 - RNA, 64 nt, Homo Sapiens
aauagucacagaaagacuguucuauaaauauaauuccauguauuuuacccuguacagcuguauc

SEQ ID NO: 53264 - RNA, 64 nt, Homo Sapiens
acaaaaggaaaaaaaaauugcucugacuuuauuuuccauguauugcacguccugguacuguauc

SEQ ID NO: 53265 - RNA, 64 nt, Homo Sapiens
cuuuuaguauuuaauaauuaauuguuuuauuuuauccauguacuguacuaaggaauuacuagug

SEQ ID NO: 53266 - RNA, 64 nt, Homo Sapiens
aagauuaugagguuaaaaauaacuaauaacuuuuuccauguaucaauuuaggcacuuuaaggag

SEQ ID NO: 53267 - RNA, 64 nt, Homo Sapiens
auuacuuacugguaauuaccugcugguauauaauuccauguagccuuuaauaugcuggguuauc

SEQ ID NO: 53268 - RNA, 64 nt, Homo Sapiens
cuuuuaaaagacuuaaggucgggaugccuuuuuuuccauguaaggaaaugaaaagaccaaaauc

SEQ ID NO: 53269 - RNA, 64 nt, Homo Sapiens; identical to SEQ ID NO: 53253

SEQ ID NO: 53270 - RNA, 64 nt, Homo Sapiens; identical to SEQ ID NO: 53254

SEQ ID NO: 53271 - RNA, 64 nt, Homo Sapiens
acaaauggagcuuucuguauauaaauguggagauuagaguuaaucuccccaaucacauaauuug

SEQ ID NO: 53272 - RNA, 64 nt, Homo Sapiens
cacuucauuaaaauucuucuaaaacuuguauguuuagaguuaagcaagacuuuuuuucuuccuc

SEQ ID NO: 53273 - RNA, 64 nt, Homo Sapiens
aacacugaccgacccuccuggggucugucaggaaaaaguagaagaaaagccacccccugcaccc

SEQ ID NO: 53274 - RNA, 64 nt, Homo Sapiens
cugugucaugccauccuuugggcccucugcuggaaaaguagaaucaagucucaaauaaugccuu

SEQ ID NO: 53275 - RNA, 64 nt, Homo Sapiens
ucaguauguauggaggcacaagccuuggaagagaaaaguagaauuuuuguuaaccuauggaaaa

SEQ ID NO: 53276 - RNA, 64 nt, Homo Sapiens
gguauaugguuaauguguaauuuaccauugccauaaaguagacuugccaaaucuuuaccacuga

SEQ ID NO: 53277 - RNA, 64 nt, Homo Sapiens
uaaugccauaagucuagauuuuaaaacauggagaaaaguagaaaauuuaaagugcaggcugcaa

SEQ ID NO: 53278 - RNA, 64 nt, Homo Sapiens
ggcaacauuaagugcuaugccucugaguugaggcaaaguagagcauuuaucuacuuuuuaggug

SEQ ID NO: 53279 - RNA, 64 nt, Homo Sapiens
cauuucauuuguuaauuuaguaugggcauauauaaaaguagacaucaauguuaagugucugcuu

SEQ ID NO: 53280 - RNA, 64 nt, Homo Sapiens
auuguuacguaccauauuugaauuguacugaaauaaaguagaaaauaguagacuguauguugaa

SEQ ID NO: 53281 - RNA, 64 nt, Homo Sapiens
auggccuuuuuaaguauugcugaugaagguaauuaaaguagauuuauuuauaguuaauaaucua

SEQ ID NO: 53282 - RNA, 64 nt, Homo Sapiens
cuacuaauuuuuuaagaggacaaaaagaaaaaucaaaguagaaauaaauaaggugugaaaucau

SEQ ID NO: 53283 - RNA, 64 nt, Homo Sapiens
accuggaggucauucaguuauuccugcaccucccaaaguagauaaaaaaauucaguuuauagca

SEQ ID NO: 53284 - RNA, 64 nt, Homo Sapiens
ucaggaauuaaaagaauuacuacuggagauaggaaaaguagaaugcuuagauccagggcccuuc

SEQ ID NO: 53285 - RNA, 64 nt, Homo Sapiens
cuucuacacuagugccaugggaaccaggucugaaaaaguagagagaagugaaaguagagucugg

SEQ ID NO: 53286 - RNA, 64 nt, Homo Sapiens
augggaaccaggucugaaaaaguagagagaagugaaaguagagucugggaaguagcugccuaua

SEQ ID NO: 53287 - RNA, 64 nt, Homo Sapiens
gauagugcuuuugaacaagccuauuuccauuuugaaaguagauuucaggcuaggugcgguggcu

SEQ ID NO: 53288 - RNA, 64 nt, Homo Sapiens
ugugacagaaugagaccaucuccaaaaaaaaaaaaaaguagauuucagauaauuuacuguucag

SEQ ID NO: 53289 - RNA, 64 nt, Homo Sapiens
uuucucacugcguugggcaugaugugucagcagcaaaguagaaugaaaaaugaauucaaaagua

SEQ ID NO: 53290 - RNA, 64 nt, Homo Sapiens
ugucagcagcaaaguagaaugaaaaaugaauucaaaaguagaugcacaguccaaagcaguagaa

SEQ ID NO: 53291 - RNA, 64 nt, Homo Sapiens
ucagaugagaugacugccauagagggaaagugacggaaaccaagcuccuucgagcuugacucug

SEQ ID NO: 53292 - RNA, 64 nt, Homo Sapiens
ccagaucagucccaaggccaugagaggaauguaaggaaaccagcagcauacagggggaagggcc

SEQ ID NO: 53293 - RNA, 64 nt, Homo Sapiens
aaaaaacucacacaacauauuuguauugacugaaggaaaccaucauaaugcaugcuagaauucu

SEQ ID NO: 53294 - RNA, 64 nt, Homo Sapiens
gcauuuauugaaaaccuucuaaaaaguagacuaaggaaaccauaaucagaauuacuaugucuuu

SEQ ID NO: 53295 - RNA, 64 nt, Homo Sapiens
augauauagacuaacuuccccauuuuucacaagaggaaaccauccuuaugacuuaccuuaaagu

SEQ ID NO: 53296 - RNA, 64 nt, Homo Sapiens
ugacuuaccuuaaaguuuuuuguucuguuuugaaggaaaccaugugcuucaugaaaccuacagu

SEQ ID NO: 53297 - RNA, 64 nt, Homo Sapiens
auugggagggggaagaggacugccucaucuggagggaaaccaaauggaaccaacauucaaauuc

SEQ ID NO: 53298 - RNA, 64 nt, Homo Sapiens
ucuugcuaaaccuguuucuggguaguggugggagggaaaccauggggggacggggguggggggu

SEQ ID NO: 53299 - RNA, 64 nt, Homo Sapiens
gcuuggcacaggaaguucccucguugggguaugaggaaaccaggacuguugaaacccacagcac

SEQ ID NO: 53300 - RNA, 64 nt, Homo Sapiens
gcaccuuccagagccgugguuccuagugcaaaccggaaaccaugaguagggggcuagauguggc

SEQ ID NO: 53301 - RNA, 64 nt, Homo Sapiens
aggcuaggacuuacuuaauagcacugugcagggaggaaaccauguauagcuuguacauauuuua

SEQ ID NO: 53302 - RNA, 64 nt, Homo Sapiens
agagagaaagucaaauaaagucaaagaccaguuuggaaaccaaaguuggaaaagaagaauugua

SEQ ID NO: 53303 - RNA, 64 nt, Homo Sapiens
ccuuugcuacccaccaauguuacaaaaugcauuuggaaaccagaucuaaacagacugacuuucu

SEQ ID NO: 53304 - RNA, 64 nt, Homo Sapiens
ccugcgggcuaagcaggugcaacccaccccccacggaaaccagccccuccucugcuucccccug

SEQ ID NO: 53305 - RNA, 64 nt, Homo Sapiens
gcuugaaggcagugagggagguacagccagauuuggaaaccauaaagguuaccacaugacuagg

SEQ ID NO: 53306 - RNA, 64 nt, Homo Sapiens
uguaaaacagccauuaaccacacuguuuaguuggggaaaccauuuauccugccuuugaggagcu

SEQ ID NO: 53307 - RNA, 60 nt, Homo Sapiens
ucccaauugagacagcuagaaacaguugacugacuaaauggaaacuagucuauuugacaa

SEQ ID NO: 53308 - RNA, 60 nt, Homo Sapiens
agcaguuugccuuuauaaaaacuugcugccugacuaaagauuaacagguuauaguuuaaa

SEQ ID NO: 53309 - RNA, 60 nt, Homo Sapiens
aauaacagucuuuauuauauuaucuaauuuugacuaaagaaauacuuuugaaguaugaca

SEQ ID NO: 53310 - RNA, 60 nt, Homo Sapiens
uugcucuuccuucaacuccaauaaauuuaaugacuaaaugccaaguuaacaaaucaacuu

SEQ ID NO: 53311 - RNA, 60 nt, Homo Sapiens
agugagaaccauaggcguugugaaccccacugacuaaauucugguccagacuguacugug

SEQ ID NO: 53312 - RNA, 60 nt, Homo Sapiens
aucucuggugccaacguaauaauuuccucuugacuaaaacugaacuuguuaucuucauuc

SEQ ID NO: 53313 - RNA, 60 nt, Homo Sapiens
uucugaggcuucaggaguaacaaaugauaaugacuaaaauccagguuguuucucagccau

SEQ ID NO: 53314 - RNA, 60 nt, Homo Sapiens
acagguggcagaauuuuucaacccgcuucaugacuaaaucuaccaacuugacuauguuuc

SEQ ID NO: 53315 - RNA, 60 nt, Homo Sapiens
caggguuuuuguguuguuuucaaauaaguuugacuaaaauaaguuuggcugacaguuuuu

SEQ ID NO: 53316 - RNA, 60 nt, Homo Sapiens
auuccauauguaaugccauugggagaguauugacuaaaauaucauucgucagggaaauau

SEQ ID NO: 53317 - RNA, 64 nt, Homo Sapiens
guucuuguuauaacccccuacgcuaugaguuagagucuaucaguugacauccacuacuuauugc

SEQ ID NO: 53318 - RNA, 64 nt, Homo Sapiens
auuaaaaauacuaaaaaauagauagauaaagcaagucuaucaacaaucucacuaaugauacaca

SEQ ID NO: 53319 - RNA, 64 nt, Homo Sapiens
cuagguauuauggaaaguacaguaucuccuggcguucuaggaguagccuugcccagugccacac

SEQ ID NO: 53320 - RNA, 64 nt, Homo Sapiens
ugcccagcaagagggaaagccagcauccucugccuucuaggaagaggcuaagcugggccugacc

SEQ ID NO: 53321 - RNA, 64 nt, Homo Sapiens
agaaacucaagagaggcauucuauagcaagcuguuucuaggauccuggcauuugccuuaaggac

SEQ ID NO: 53322 - RNA, 64 nt, Homo Sapiens
uaaaauucacauuacuuuugaaaaagugcagugcuucuaggauaagaagucucuacaauagaaa

SEQ ID NO: 53323 - RNA, 64 nt, Homo Sapiens
acuuugucaagcaccucaguuacacauucgccuuuucuaggauugcauuucccaagugcuauug

SEQ ID NO: 53324 - RNA, 64 nt, Homo Sapiens
uguuacccuucaguaaguucuccccauuuuaguuuucuaggacugaaaggauucuuuucuacau

SEQ ID NO: 53325 - RNA, 64 nt, Homo Sapiens
ucccaggguucugugauuuccccaugcucugcauuucuaggauauuucuaggacaccuggauug

SEQ ID NO: 53326 - RNA, 64 nt, Homo Sapiens
ugugauuuccccaugcucugcauuucuaggauauuucuaggacaccuggauuggcuccaucaca

SEQ ID NO: 53327 - RNA, 64 nt, Homo Sapiens
acaggugugagccaccacguuuggccucccaaaguucuaggauugaccucgugauccacccacc

SEQ ID NO: 53328 - RNA, 64 nt, Homo Sapiens
gccucaacuagaauaacacuuuguuuacuugguuuucuaggacuuaaccagucauggugcuaga

SEQ ID NO: 53329 - RNA, 64 nt, Homo Sapiens
acugcagaugccauaggccucaaaucagcuguaauucuaggagacacguguugaucuaguuauc

SEQ ID NO: 53330 - RNA, 64 nt, Homo Sapiens
acccuuuugcuagugugcuuaacuuauuuauuucuucuaggaaacaauagauaaacagcaugaa

SEQ ID NO: 53331 - RNA, 64 nt, Homo Sapiens
uucuugaaaauauaagugguaagauuccucgaaguucuaggaaaacagugcauuuacaagguua

SEQ ID NO: 53332 - RNA, 64 nt, Homo Sapiens
aaacggguuaaaaauuguuuauaugcgugccuaguucuaggagguuuucuucucuuucauacau

SEQ ID NO: 53333 - RNA, 64 nt, Homo Sapiens
uuucagcaauacugauauucaguuuuauccaauauucuaggaauuuauucauguuuucauuuaa

SEQ ID NO: 53334 - RNA, 64 nt, Homo Sapiens
uuucagcaauacuaauauucaguuuuauccaguauucuaggaaucaguuguucauguuauuuaa

SEQ ID NO: 53335 - RNA, 64 nt, Homo Sapiens
ucccuuucuacccucacagccccggacacucaacagccuccaccggugcugacuaaacugguug

SEQ ID NO: 53336 - RNA, 64 nt, Homo Sapiens
ccgucucccccugcaugcccccuccagugcccugagccuccagugcggggagggcuccuuucua

SEQ ID NO: 53337 - RNA, 64 nt, Homo Sapiens
uggucacaggacucugccuccucuucaacugaccagccuccaugcugccuccagaauggucuuu

SEQ ID NO: 53338 - RNA, 64 nt, Homo Sapiens
uaaucuggacuccucuguccaggcacugcugcccagccuccaagcuccaucuccacuccagauu

SEQ ID NO: 53339 - RNA, 64 nt, Homo Sapiens
ugcagccccaggccucccucccaccuagaauggaagccuccaccagugcagcccccuccugacc

SEQ ID NO: 53340 - RNA, 64 nt, Homo Sapiens
cccugucugaaaccagaagacauucccuucucucagccuccacuagugagaugucagacaaauu

SEQ ID NO: 53341 - RNA, 64 nt, Homo Sapiens
aaucuuagguaggugcuuaacucuugugguggccagccuccaagaugagccccaguguucuugc

SEQ ID NO: 53342 - RNA, 64 nt, Homo Sapiens
cauguaagggagccaucuuggaagcagauccuccagccuccagucaagucuucagauaauugca

SEQ ID NO: 53343 - RNA, 51 nt, Homo Sapiens
accuggagcuguuugagugacagccuccaucagggucauccuacagccucc

SEQ ID NO: 53344 - RNA, 64 nt, Homo Sapiens
guuugagugacagccuccaucagggucauccuacagccuccaagcgggcuuuccccuggacaaa

SEQ ID NO: 53345 - RNA, 64 nt, Homo Sapiens
gcuggagggcagugguacagucuuggcuaauugcagccuccaacuccuggacucaagugauccu

SEQ ID NO: 53346 - RNA, 64 nt, Homo Sapiens
uccaacuccuggacucaagugauccucccaccucagccuccagaguaaguaggaccacaggcau

SEQ ID NO: 53347 - RNA, 64 nt, Homo Sapiens
ccuggagugcaauggcacaaucauggcuuacugcagccuccagcucccaggcucaagcguuucu

SEQ ID NO: 53348 - RNA, 64 nt, Homo Sapiens
uccagcuugcagacagccuaugggaggacuucucagccuccauaagugugugggccaguucgcc

SEQ ID NO: 53349 - RNA, 64 nt, Homo Sapiens
gggaggccucauggccaacaauggacaccuccagagccuccaggggaccacacaguagacuauc

SEQ ID NO: 53350 - RNA, 64 nt, Homo Sapiens
caucuggguucaccuccccacucugaugaucuccagccuccacugcuucugccccccgcugcug

SEQ ID NO: 53351 - RNA, 64 nt, Homo Sapiens
gcuagcugaggccaacgcagccccucccccacagagccuccagacugacugcaaggcccaccug

SEQ ID NO: 53352 - RNA, 64 nt, Homo Sapiens
ccuggggguccacgagccugccagcuggugacaaagccuccaauuccugguauugauacaagac

SEQ ID NO: 53353 - RNA, 64 nt, Homo Sapiens
gcuuaauuuuucccuccacucagugcuaaggcugagccuccagaugcuguuaccucagauuuaa

SEQ ID NO: 53354 - RNA, 64 nt, Homo Sapiens
uuaaucacugguugaaacuccguauaaucuguagagccuccauggcucuaaaauuuggaauuaa

SEQ ID NO: 53355 - RNA, 64 nt, Homo Sapiens
uugaaggcugucuacacuuauaccaagcauuuucagccuccauugcucuagaguuacuucuuuu

SEQ ID NO: 53356 - RNA, 64 nt, Homo Sapiens
accaagaaaugaacuuagagcuccagaagaaaugagccuccaccuaucccaaaaauuucaguga

SEQ ID NO: 53357 - RNA, 64 nt, Homo Sapiens
acacuauggccuguuuuaagcucacuucuuucucagccuccagguagguggcuuuggugacaca

SEQ ID NO: 53358 - RNA, 64 nt, Homo Sapiens
gguuucgacugguccagcucccaacugcaaaaaaagccuccaagggccuccaacgccccugugg

SEQ ID NO: 53359 - RNA, 64 nt, Homo Sapiens
ugguaauacgugaggaauuuaaagacucauccccagccuccaccuccugugugauacuuggggg

SEQ ID NO: 53360 - RNA, 64 nt, Homo Sapiens
gcuagaaugcagcggugcaaucaugagucaaugcagccuccagccucgaccucccgaggcucag

SEQ ID NO: 53361 - RNA, 64 nt, Homo Sapiens
gggaggacagagccgguuucaaaucagagcuggcagccuccagucuccuucuuaacucugcagg

SEQ ID NO: 53362 - RNA, 64 nt, Homo Sapiens
cacccccaggauucccagagcuucccugggccucagccuccagggcagcacugggguuuggggg

SEQ ID NO: 53363 - RNA, 64 nt, Homo Sapiens
gugcaccugccaggccaagggucagggugcccagagccuccaaagagagcugaggggauguggg

SEQ ID NO: 53364 - RNA, 64 nt, Homo Sapiens
cccgugucccuugcugaguauucugucacagacaagccuccauuaaagccacagcagugcuacc

SEQ ID NO: 53365 - RNA, 64 nt, Homo Sapiens
ggugcugcacgcuccagcgcccacucuagacaucagccuccagguugacuaagggucaggucau

SEQ ID NO: 53366 - RNA, 64 nt, Homo Sapiens
gucacagcucagguucccacaccucacuuuucacagccuccaagggcagcagugcacauggagg

SEQ ID NO: 53367 - RNA, 64 nt, Homo Sapiens
aaggaggcagagcuggggccugaaggcucugagcagccuccagccagggggcuccuccagggcu

SEQ ID NO: 53368 - RNA, 64 nt, Homo Sapiens
cugagccucagugaggcugggcagauggucucggagccuccauggggcguagcaggaaccgggc

SEQ ID NO: 53369 - RNA, 64 nt, Homo Sapiens
gcaggaccuuggagggaggauggauuucuccuggagccuccagggacuccacccucccacuccu

SEQ ID NO: 53370 - RNA, 64 nt, Homo Sapiens
caauuggaucagaagucgcaagccugugcuccagagccuccagguaaaaauagaccaacgcuaa

SEQ ID NO: 53371 - RNA, 64 nt, Homo Sapiens
aaggcguggcagcucaugccuuccaaaaagucucagccuccaucgacauggagagagggaggga

SEQ ID NO: 53372 - RNA, 64 nt, Homo Sapiens
gggaacuggaggaugcguaaggauccuccccuagagccuccaggggagcugggagaggcaggaa

SEQ ID NO: 53373 - RNA, 64 nt, Homo Sapiens
acugaugagcaaaggaggagucaacuaaugaagaaaugaauaauaaauuuugacacugaaaaac

SEQ ID NO: 53374 - RNA, 64 nt, Homo Sapiens
uaacaauauaauggcaauagguagagauacaacaaaugaauauaacacuauaacacuucauauu

SEQ ID NO: 53375 - RNA, 64 nt, Homo Sapiens
uugaucauuaggggugugggauacuaaauaaaaaaaugaauauggauaaauugcugcgugacau

SEQ ID NO: 53376 - RNA, 64 nt, Homo Sapiens
aagaaaaauuggaaggcgucgaacaaaacaucaaaaugaauagagagagaaaauguuuugaaaa

SEQ ID NO: 53377 - RNA, 64 nt, Homo Sapiens
cuuaaaucuaaauuuguguguuaaaaagguuuuuaaugaauaguuauugacauuaacgaguguu

SEQ ID NO: 53378 - RNA, 64 nt, Homo Sapiens
ccuaacuuaguaaaguagaagaaaggacccaauaaaugaauauugguuuuuaaaugugcuuaug

SEQ ID NO: 53379 - RNA, 64 nt, Homo Sapiens
gacaaaagccaagguguaugugaauaaauaaauaaaugaauaaaccagaagggcacaaaaugaa

SEQ ID NO: 53380 - RNA, 64 nt, Homo Sapiens
uaaauaaaugaauaaagacaaagggcacaaaaugaaugaauaaauaguccugguucauucccag

SEQ ID NO: 53381 - RNA, 64 nt, Homo Sapiens
guguucuuugaauuaguaaaauaaaauugauaugaaugaauauauuauuguucauaauuaauga

SEQ ID NO: 53382 - RNA, 64 nt, Homo Sapiens
auugauaugaaugaauauaguauuguucauaauuaaugaauaaaaagcauggaauauuauauuu

SEQ ID NO: 53383 - RNA, 64 nt, Homo Sapiens
gauuauaccuggaugauucaggagaguguauaugaaugaauaaagcauccaaguauauaugaau

SEQ ID NO: 53384 - RNA, 64 nt, Homo Sapiens
guauaugaaugaauaaagcauccaaguauauaugaaugaauaaaguauguaaguaucaccagaa

SEQ ID NO: 53385 - RNA, 64 nt, Homo Sapiens
agaguaucauccaaauaauggggccuaugacuugaaugaauagaaaugaauaagcugguguuug

SEQ ID NO: 53386 - RNA, 64 nt, Homo Sapiens
ccaaauaauggggccuaugacuugaaugaauagaaaugaauaagcugguguuuguuuuuucaaa

SEQ ID NO: 53387 - RNA, 64 nt, Homo Sapiens
auauuucuuuuuaaagaaucuuuuuaagauuaaaaaugaauaccuuaaaucucccaaaagagau

SEQ ID NO: 53388 - RNA, 64 nt, Homo Sapiens
cguuaaauuguaguuugcuguauuaaaauagaucaaugaauauaauucagucuuuuaggggcac

SEQ ID NO: 53389 - RNA, 64 nt, Homo Sapiens
augaaaaaucauaaucugacuaauuuugggacugaaugaauaaguacaagagguuggauuuucu

SEQ ID NO: 53390 - RNA, 64 nt, Homo Sapiens
agcauaaucauuccuuggaguuauacuaacuaauaaugaauauuaaaugauuuuucuucaguca

SEQ ID NO: 53391 - RNA, 64 nt, Homo Sapiens
uucuaacuucugaaacuuuuaggucagaugacauaaugaauaugauuuucaccuggaacaugag

SEQ ID NO: 53392 - RNA, 64 nt, Homo Sapiens
ccugcucugcuggucaauaaaagcugagcugcuaaaugaauaucaugugggagaggagggucug

SEQ ID NO: 53393 - RNA, 64 nt, Homo Sapiens
accugguauuugauagcacaaaauuuuuaaaaagaaugaauaaguggaacuuaauaaaaguugg

SEQ ID NO: 53394 - RNA, 64 nt, Homo Sapiens
uggaguuucauuauacuuuuuuuuuagauuggguaaugaauacauuggccauauguuuauaauu

SEQ ID NO: 53395 - RNA, 64 nt, Homo Sapiens
uagugauuauagagaaugauuauaugauguuuguaaugaauaaaauaguaguuucauuauuugg

SEQ ID NO: 53396 - RNA, 64 nt, Homo Sapiens
ucuauauguaaaugauggguuuguugguauuuaaaaugaauacaacuugaauguaauuaaagug

SEQ ID NO: 53397 - RNA, 64 nt, Homo Sapiens
aucagugaauggaauggaccaaugaggugguaucaaugaauauaguuccauagaacauuuucca

SEQ ID NO: 53398 - RNA, 64 nt, Homo Sapiens
gcuuccaaauaauaauguauguuagacagcaagaaaugaauacuuuaaaaagugauguauguug
